United States Patent 7,888,497 (BIOINFORMATICALLY DETECTABLE GROUP OF NOVEL REGULATORY OLIGONUCLEOTIDES AND USES THEREOF) - sequence listing, part 101

SEQ ID NO: 4271527 - DNA, 15 bp, Homo sapiens
gtctccacccctcaa

SEQ ID NO: 4271528 - DNA, 14 bp, Homo sapiens
gtctccacctcagg

SEQ ID NO: 4271529 - DNA, 21 bp, Homo sapiens
gtctcctgggcatctggccct

SEQ ID NO: 4271530 - DNA, 15 bp, Homo sapiens
gtctcgtcaggaggt

SEQ ID NO: 4271531 - DNA, 20 bp, Homo sapiens
gtctcgtcaggaggtgcctg

SEQ ID NO: 4271532 - DNA, 16 bp, Homo sapiens
gtctctcatgaacctc

SEQ ID NO: 4271533 - DNA, 16 bp, Homo sapiens
gtctcttctccactgg

SEQ ID NO: 4271534 - DNA, 20 bp, Homo sapiens
gtctgaaaccagaagactgg

SEQ ID NO: 4271535 - DNA, 16 bp, Homo sapiens
gtctgaagtcactgca

SEQ ID NO: 4271536 - DNA, 12 bp, Homo sapiens
gtctgagccctg

SEQ ID NO: 4271537 - DNA, 15 bp, Homo sapiens
gtctgagccctgccc

SEQ ID NO: 4271538 - DNA, 24 bp, Homo sapiens
gtctgagccctgccctcactccac

SEQ ID NO: 4271539 - DNA, 17 bp, Homo sapiens
gtctgagcggccgcctg

SEQ ID NO: 4271540 - DNA, 21 bp, Homo sapiens
gtctgagcggccgcctgtcct

SEQ ID NO: 4271541 - DNA, 16 bp, Homo sapiens
gtctgcaccccacagg

SEQ ID NO: 4271542 - DNA, 14 bp, Homo sapiens
gtctgcgccgctgt

SEQ ID NO: 4271543 - DNA, 17 bp, Homo sapiens
gtctgcgccgctgtgct

SEQ ID NO: 4271544 - DNA, 14 bp, Homo sapiens
gtctgctcctgtgg

SEQ ID NO: 4271545 - DNA, 22 bp, Homo sapiens
gtctgctcctgtggcggtgcag

SEQ ID NO: 4271546 - DNA, 16 bp, Homo sapiens
gtctgctgccctccat

SEQ ID NO: 4271547 - DNA, 18 bp, Homo sapiens
gtctgctgccctccatcc

SEQ ID NO: 4271548 - DNA, 23 bp, Homo sapiens
gtctgctgtaagacggccttgga

SEQ ID NO: 4271549 - DNA, 23 bp, Homo sapiens
gtctggagaccaggactctgcct

SEQ ID NO: 4271550 - DNA, 14 bp, Homo sapiens
gtctggctgtggcc

SEQ ID NO: 4271551 - DNA, 15 bp, Homo sapiens
gtctggctgtggccc

SEQ ID NO: 4271552 - DNA, 21 bp, Homo sapiens
gtctggctgtggcccctcctt

SEQ ID NO: 4271553 - DNA, 13 bp, Homo sapiens
gtcttcaagcctg

SEQ ID NO: 4271554 - DNA, 16 bp, Homo sapiens
gtcttcaagcctggcc

SEQ ID NO: 4271555 - DNA, 20 bp, Homo sapiens
gtcttgagagcgctggcctc

SEQ ID NO: 4271556 - DNA, 21 bp, Homo sapiens
gtcttgagagcgctggcctct

SEQ ID NO: 4271557 - DNA, 13 bp, Homo sapiens
gtcttgagtgggc

SEQ ID NO: 4271558 - DNA, 16 bp, Homo sapiens
gtctttagctattact

SEQ ID NO: 4271559 - DNA, 23 bp, Homo sapiens
gtctttgggggattcaaatgcat

SEQ ID NO: 4271560 - DNA, 15 bp, Homo sapiens
gtctttgtgtgctgt

SEQ ID NO: 4271561 - DNA, 18 bp, Homo sapiens
gtctttttaacctcagaa

SEQ ID NO: 4271562 - DNA, 14 bp, Homo sapiens
gtgaaacacagctg

SEQ ID NO: 4271563 - DNA, 19 bp, Homo sapiens
gtgaaagtgtaaaatagaa

SEQ ID NO: 4271564 - DNA, 22 bp, Homo sapiens
gtgaaatttacagttactgcct

SEQ ID NO: 4271565 - DNA, 17 bp, Homo sapiens
gtgaaatttgttaatat

SEQ ID NO: 4271566 - DNA, 11 bp, Homo sapiens
gtgaacagctt

SEQ ID NO: 4271567 - DNA, 20 bp, Homo sapiens
gtgaacttggggaacaaggg

SEQ ID NO: 4271568 - DNA, 21 bp, Homo sapiens
gtgaacttggtgcctaatgtt

SEQ ID NO: 4271569 - DNA, 16 bp, Homo sapiens
gtgaataaagccacat

SEQ ID NO: 4271570 - DNA, 12 bp, Homo sapiens
gtgaatacatgg

SEQ ID NO: 4271571 - DNA, 10 bp, Homo sapiens
gtgaatgtag

SEQ ID NO: 4271572 - DNA, 16 bp, Homo sapiens
gtgacacaactcatcc

SEQ ID NO: 4271573 - DNA, 18 bp, Homo sapiens
gtgacatcagtggcatgg

SEQ ID NO: 4271574 - DNA, 13 bp, Homo sapiens
gtgacatgcggct

SEQ ID NO: 4271575 - DNA, 14 bp, Homo sapiens
gtgaccccagctcc

SEQ ID NO: 4271576 - DNA, 19 bp, Homo sapiens
gtgaccccagctccaggca

SEQ ID NO: 4271577 - DNA, 13 bp, Homo sapiens
gtgaccctggagc

SEQ ID NO: 4271578 - DNA, 20 bp, Homo sapiens
gtgacccttctgtctgtaag

SEQ ID NO: 4271579 - DNA, 14 bp, Homo sapiens
gtgactccaggaga

SEQ ID NO: 4271580 - DNA, 22 bp, Homo sapiens
gtgactccatatcccgggagca

SEQ ID NO: 4271581 - DNA, 14 bp, Homo sapiens
gtgactgctgcgct

SEQ ID NO: 4271582 - DNA, 23 bp, Homo sapiens
gtgacttcagactctctcctctc

SEQ ID NO: 4271583 - DNA, 15 bp, Homo sapiens
gtgaggagggggaga

SEQ ID NO: 4271584 - DNA, 21 bp, Homo sapiens
ggttcccccagccctgtggaa

SEQ ID NO: 4271585 - DNA, 12 bp, Homo sapiens
ggttcctccagc

SEQ ID NO: 4271586 - DNA, 16 bp, Homo sapiens
ggttccttaagtggct

SEQ ID NO: 4271587 - DNA, 11 bp, Homo sapiens
ggttctagaag

SEQ ID NO: 4271588 - DNA, 16 bp, Homo sapiens
ggttctggggctgaga

SEQ ID NO: 4271589 - DNA, 21 bp, Homo sapiens
ggttggccagagggcccctca

SEQ ID NO: 4271590 - DNA, 23 bp, Homo sapiens
ggttgggttccagacagagtgga

SEQ ID NO: 4271591 - DNA, 18 bp, Homo sapiens
ggttgtcaaaactccact

SEQ ID NO: 4271592 - DNA, 23 bp, Homo sapiens
ggttgtcaaaactccactcagca

SEQ ID NO: 4271593 - DNA, 21 bp, Homo sapiens
ggtttaaaactagttagattc

SEQ ID NO: 4271594 - DNA, 16 bp, Homo sapiens
ggtttaagtagatttc

SEQ ID NO: 4271595 - DNA, 22 bp, Homo sapiens
ggtttactctgtgctaagttgt

SEQ ID NO: 4271596 - DNA, 15 bp, Homo sapiens
ggtttcagaaagggc

SEQ ID NO: 4271597 - DNA, 19 bp, Homo sapiens
ggtttccacacaggcccat

SEQ ID NO: 4271598 - DNA, 17 bp, Homo sapiens
ggtttctgagttcctgc

SEQ ID NO: 4271599 - DNA, 20 bp, Homo sapiens
ggtttgggcagtggagaggg

SEQ ID NO: 4271600 - DNA, 17 bp, Homo sapiens
ggtttggtggccaggct

SEQ ID NO: 4271601 - DNA, 19 bp, Homo sapiens
ggttttcgaagctcagccc

SEQ ID NO: 4271602 - DNA, 17 bp, Homo sapiens
ggttttgcatgtctgca

SEQ ID NO: 4271603 - DNA, 15 bp, Homo sapiens
gtaaaattacagaag

SEQ ID NO: 4271604 - DNA, 15 bp, Homo sapiens
gtaaaggtaggtgca

SEQ ID NO: 4271605 - DNA, 20 bp, Homo sapiens
gtaaatctaacattattact

SEQ ID NO: 4271606 - DNA, 18 bp, Homo sapiens
gtaacacataaagtaaat

SEQ ID NO: 4271607 - DNA, 22 bp, Homo sapiens
gtaacacataaagtaaatgcta

SEQ ID NO: 4271608 - DNA, 16 bp, Homo sapiens
gtaacagttggtgatt

SEQ ID NO: 4271609 - DNA, 18 bp, Homo sapiens
gtaacatagatgcctggg

SEQ ID NO: 4271610 - DNA, 16 bp, Homo sapiens
gtaacatgtctaaagt

SEQ ID NO: 4271611 - DNA, 21 bp, Homo sapiens
gtaagaagcccgatccacatt

SEQ ID NO: 4271612 - DNA, 17 bp, Homo sapiens
gtaagctgctctattgt

SEQ ID NO: 4271613 - DNA, 15 bp, Homo sapiens
gtaagttctgaaaac

SEQ ID NO: 4271614 - DNA, 13 bp, Homo sapiens
gtaatatctttca

SEQ ID NO: 4271615 - DNA, 12 bp, Homo sapiens
gtaatatttaca

SEQ ID NO: 4271616 - DNA, 19 bp, Homo sapiens
gtaatatttacaatgtatt

SEQ ID NO: 4271617 - DNA, 20 bp, Homo sapiens
gtaatcatttatcttatcta

SEQ ID NO: 4271618 - DNA, 12 bp, Homo sapiens
gtaatcttttct

SEQ ID NO: 4271619 - DNA, 13 bp, Homo sapiens
gtaatcttttctg

SEQ ID NO: 4271620 - DNA, 12 bp, Homo sapiens
gtaatgtatctt

SEQ ID NO: 4271621 - DNA, 17 bp, Homo sapiens
gtaatgtatcttattta

SEQ ID NO: 4271622 - DNA, 17 bp, Homo sapiens
gtaatgtgtcaaagaga

SEQ ID NO: 4271623 - DNA, 21 bp, Homo sapiens
gtacaaaaaaataatcaagtg

SEQ ID NO: 4271624 - DNA, 23 bp, Homo sapiens
gtacaaagggaagcagagcctgg

SEQ ID NO: 4271625 - DNA, 23 bp, Homo sapiens
gtacaagtgctcagttccaatgt

SEQ ID NO: 4271626 - DNA, 20 bp, Homo sapiens
gtacacccaattttaaaaaa

SEQ ID NO: 4271627 - DNA, 20 bp, Homo sapiens
gtacagttatacatacctct

SEQ ID NO: 4271628 - DNA, 21 bp, Homo sapiens
gtacatgtggaaaactcacag

SEQ ID NO: 4271629 - DNA, 13 bp, Homo sapiens
gtaccaactgagc

SEQ ID NO: 4271630 - DNA, 16 bp, Homo sapiens
gtaccatgttaaagag

SEQ ID NO: 4271631 - DNA, 18 bp, Homo sapiens
gtactaccccaggacgca

SEQ ID NO: 4271632 - DNA, 14 bp, Homo sapiens
gtactggatttaac

SEQ ID NO: 4271633 - DNA, 16 bp, Homo sapiens
gtacttcttctgtaat

SEQ ID NO: 4271634 - DNA, 16 bp, Homo sapiens
gtacttgctcaataaa

SEQ ID NO: 4271635 - DNA, 21 bp, Homo sapiens
gtacttgctcaataaaggtca

SEQ ID NO: 4271636 - DNA, 20 bp, Homo sapiens
gtacttgtgaaacacagctg

SEQ ID NO: 4271637 - DNA, 16 bp, Homo sapiens
gtagaactgttcattt

SEQ ID NO: 4271638 - DNA, 16 bp, Homo sapiens
gtagaagagggagaag

SEQ ID NO: 4271639 - DNA, 23 bp, Homo sapiens
gtagatagtatgcactatataca

SEQ ID NO: 4271640 - DNA, 13 bp, Homo sapiens
gtagcatatataa

SEQ ID NO: 4271641 - DNA, 16 bp, Homo sapiens
gtagctgtggggagct

SEQ ID NO: 4271642 - DNA, 17 bp, Homo sapiens
gtagctgtggggagctg

SEQ ID NO: 4271643 - DNA, 18 bp, Homo sapiens
gtagctgtggggagctgg

SEQ ID NO: 4271644 - DNA, 19 bp, Homo sapiens
gtaggctgtattttctttt

SEQ ID NO: 4271645 - DNA, 22 bp, Homo sapiens
gtaggctgtattttcttttata

SEQ ID NO: 4271646 - DNA, 23 bp, Homo sapiens
gtagggaacggcctgagaggagc

SEQ ID NO: 4271647 - DNA, 17 bp, Homo sapiens
gtagggccagggctctg

SEQ ID NO: 4271648 - DNA, 20 bp, Homo sapiens
gtaggggaagtgtgctgagg

SEQ ID NO: 4271649 - DNA, 17 bp, Homo sapiens
gtagggtgaggcgtggg

SEQ ID NO: 4271650 - DNA, 17 bp, Homo sapiens
gtagtacttcttctgta

SEQ ID NO: 4271651 - DNA, 22 bp, Homo sapiens
gtagtacttcttctgtaatatt

SEQ ID NO: 4271652 - DNA, 17 bp, Homo sapiens
gtagtagaatctcagca

SEQ ID NO: 4271653 - DNA, 13 bp, Homo sapiens
gtagtatgatggg

SEQ ID NO: 4271654 - DNA, 21 bp, Homo sapiens
gtagtgttattgccaggaaag

SEQ ID NO: 4271655 - DNA, 19 bp, Homo sapiens
gtataaaacagtgtttcca

SEQ ID NO: 4271656 - DNA, 21 bp, Homo sapiens
gtataacaagccaaacattct

SEQ ID NO: 4271657 - DNA, 11 bp, Homo sapiens
gtatacaaaca

SEQ ID NO: 4271658 - DNA, 14 bp, Homo sapiens
gtatacaaacaggt

SEQ ID NO: 4271659 - DNA, 17 bp, Homo sapiens
gtatacaaacaggtgct

SEQ ID NO: 4271660 - DNA, 15 bp, Homo sapiens
gtataccgtgtgctc

SEQ ID NO: 4271661 - DNA, 12 bp, Homo sapiens
gtatatatgtac

SEQ ID NO: 4271662 - DNA, 15 bp, Homo sapiens
gtatatatgtacagt

SEQ ID NO: 4271663 - DNA, 14 bp, Homo sapiens
gtatatcagggttt

SEQ ID NO: 4271664 - DNA, 18 bp, Homo sapiens
gtatatttgtatgatatt

SEQ ID NO: 4271665 - DNA, 22 bp, Homo sapiens
gtatcagagatgtccattttta

SEQ ID NO: 4271666 - DNA, 14 bp, Homo sapiens
gtatccagaggtga

SEQ ID NO: 4271667 - DNA, 19 bp, Homo sapiens
gtatcgctgccttgccatg

SEQ ID NO: 4271668 - DNA, 15 bp, Homo sapiens
gtatctaaaaaataa

SEQ ID NO: 4271669 - DNA, 23 bp, Homo sapiens
gtatctgatatctgtttgcttct

SEQ ID NO: 4271670 - DNA, 19 bp, Homo sapiens
gtatctgctgcctctgaaa

SEQ ID NO: 4271671 - DNA, 23 bp, Homo sapiens
gtatctgtacctgcccccactca

SEQ ID NO: 4271672 - DNA, 14 bp, Homo sapiens
gtatcttatttata

SEQ ID NO: 4271673 - DNA, 17 bp, Homo sapiens
gtatctttaaagacttg

SEQ ID NO: 4271674 - DNA, 11 bp, Homo sapiens
gtatgaaatat

SEQ ID NO: 4271675 - DNA, 18 bp, Homo sapiens
gtatgaataaagacacct

SEQ ID NO: 4271676 - DNA, 17 bp, Homo sapiens
gtatgcaagaagaatat

SEQ ID NO: 4271677 - DNA, 20 bp, Homo sapiens
gtatgcaagaagaatataaa

SEQ ID NO: 4271678 - DNA, 19 bp, Homo sapiens
gtatgcagtgtagatttta

SEQ ID NO: 4271679 - DNA, 14 bp, Homo sapiens
gtatgtggaagcag

SEQ ID NO: 4271680 - DNA, 13 bp, Homo sapiens
gtattaaatgcca

SEQ ID NO: 4271681 - DNA, 14 bp, Homo sapiens
gtattatgcaaagt

SEQ ID NO: 4271682 - DNA, 18 bp, Homo sapiens
gtattcaggaccccatct

SEQ ID NO: 4271683 - DNA, 20 bp, Homo sapiens
gtattgtctgacttctcagg

SEQ ID NO: 4271684 - DNA, 16 bp, Homo sapiens
gtattgttagatgttt

SEQ ID NO: 4271685 - DNA, 15 bp, Homo sapiens
gtattttcgtgcatt

SEQ ID NO: 4271686 - DNA, 19 bp, Homo sapiens
gtattttcgtgcatttgtg

SEQ ID NO: 4271687 - DNA, 19 bp, Homo sapiens
gtattttcttcccatttgt

SEQ ID NO: 4271688 - DNA, 22 bp, Homo sapiens
gtattttcttcccatttgtaat

SEQ ID NO: 4271689 - DNA, 22 bp, Homo sapiens
gtattttcttttatatctgtaa

SEQ ID NO: 4271690 - DNA, 13 bp, Homo sapiens
gtatttttagaga

SEQ ID NO: 4271691 - DNA, 14 bp, Homo sapiens
gtatttttagagat

SEQ ID NO: 4271692 - DNA, 20 bp, Homo sapiens
gtcaaaactccactcagcac

SEQ ID NO: 4271693 - DNA, 22 bp, Homo sapiens
gtcaacatttgttagaaccagt

SEQ ID NO: 4271694 - DNA, 16 bp, Homo sapiens
gtcaactccaaggcaa

SEQ ID NO: 4271695 - DNA, 21 bp, Homo sapiens
gtcaactccaaggcaaatgtc

SEQ ID NO: 4271696 - DNA, 23 bp, Homo sapiens
gtcaactgctgttttatgtcata

SEQ ID NO: 4271697 - DNA, 15 bp, Homo sapiens
gtcaagattcagcta

SEQ ID NO: 4271698 - DNA, 19 bp, Homo sapiens
gtcaagattcagctagtgg

SEQ ID NO: 4271699 - DNA, 16 bp, Homo sapiens
gtcaagtgtgcctgct

SEQ ID NO: 4271700 - DNA, 13 bp, Homo sapiens
gtcaatcaaacag

SEQ ID NO: 4271701 - DNA, 15 bp, Homo sapiens
gtcaatcaaacaggg

SEQ ID NO: 4271702 - DNA, 20 bp, Homo sapiens
gtcaatgaaatatttgctta

SEQ ID NO: 4271703 - DNA, 22 bp, Homo sapiens
gtcaatgaaatatttgcttatt

SEQ ID NO: 4271704 - DNA, 16 bp, Homo sapiens
gtcaatgtttgcttta

SEQ ID NO: 4271705 - DNA, 16 bp, Homo sapiens
gtcacaataaagtgta

SEQ ID NO: 4271706 - DNA, 15 bp, Homo sapiens
gtcacagaggcagtg

SEQ ID NO: 4271707 - DNA, 21 bp, Homo sapiens
gtcacagaggcagtggcagca

SEQ ID NO: 4271708 - DNA, 22 bp, Homo sapiens
gtcacatatcaagtcccgaggc

SEQ ID NO: 4271709 - DNA, 22 bp, Homo sapiens
gtcacccccacccccgggtgcc

SEQ ID NO: 4271710 - DNA, 13 bp, Homo sapiens
gtcacccctgtct

SEQ ID NO: 4271711 - DNA, 14 bp, Homo sapiens
gtcaccttcctggg

SEQ ID NO: 4271712 - DNA, 17 bp, Homo sapiens
gtcaccttcctgggcag

SEQ ID NO: 4271713 - DNA, 22 bp, Homo sapiens
gtcaccttcctgggcagcccag

SEQ ID NO: 4271714 - DNA, 20 bp, Homo sapiens
gtcactaaatggcagtgaga

SEQ ID NO: 4271715 - DNA, 23 bp, Homo sapiens
gtcactgcacagtgcatctcagc

SEQ ID NO: 4271716 - DNA, 16 bp, Homo sapiens
gtcacttatttcataa

SEQ ID NO: 4271717 - DNA, 19 bp, Homo sapiens
ggccctttcacccctcttc

SEQ ID NO: 4271718 - DNA, 22 bp, Homo sapiens
ggccctttcacccctcttccca

SEQ ID NO: 4271719 - DNA, 22 bp, Homo sapiens
ggccgaggcaggggctgggcag

SEQ ID NO: 4271720 - DNA, 13 bp, Homo sapiens
ggccgaggcctgc

SEQ ID NO: 4271721 - DNA, 13 bp, Homo sapiens
ggccgcctgtcct

SEQ ID NO: 4271722 - DNA, 15 bp, Homo sapiens
ggccgcctgtccttg

SEQ ID NO: 4271723 - DNA, 19 bp, Homo sapiens
ggccgctagatgggcatgg

SEQ ID NO: 4271724 - DNA, 15 bp, Homo sapiens
ggccgctgcagggtg

SEQ ID NO: 4271725 - DNA, 17 bp, Homo sapiens
ggccgctgcagtcagca

SEQ ID NO: 4271726 - DNA, 15 bp, Homo sapiens
ggccgcttcgccatg

SEQ ID NO: 4271727 - DNA, 12 bp, Homo sapiens
ggccggccctgc

SEQ ID NO: 4271728 - DNA, 14 bp, Homo sapiens
ggccgggctggctt

SEQ ID NO: 4271729 - DNA, 20 bp, Homo sapiens
ggccgtggagtcgagctggc

SEQ ID NO: 4271730 - DNA, 16 bp, Homo sapiens
ggcctacaaatcagta

SEQ ID NO: 4271731 - DNA, 18 bp, Homo sapiens
ggcctactggggatcaga

SEQ ID NO: 4271732 - DNA, 21 bp, Homo sapiens
ggcctagtggcttcagcccct

SEQ ID NO: 4271733 - DNA, 17 bp, Homo sapiens
ggcctatgccacctgca

SEQ ID NO: 4271734 - DNA, 20 bp, Homo sapiens
ggcctcacctggcttcccag

SEQ ID NO: 4271735 - DNA, 21 bp, Homo sapiens
ggcctcagcagaaggccttgc

SEQ ID NO: 4271736 - DNA, 16 bp, Homo sapiens
ggcctcagggaccaag

SEQ ID NO: 4271737 - DNA, 22 bp, Homo sapiens
ggcctcagggaccaaggagatg

SEQ ID NO: 4271738 - DNA, 14 bp, Homo sapiens
ggcctctggcctgg

SEQ ID NO: 4271739 - DNA, 15 bp, Homo sapiens
ggcctctggcctggg

SEQ ID NO: 4271740 - DNA, 16 bp, Homo sapiens
ggcctctggcctggga

SEQ ID NO: 4271741 - DNA, 23 bp, Homo sapiens
ggcctcttcctccctccctgcag

SEQ ID NO: 4271742 - DNA, 21 bp, Homo sapiens
ggcctgaactaggtgctggca

SEQ ID NO: 4271743 - DNA, 14 bp, Homo sapiens
ggcctgagaagagt

SEQ ID NO: 4271744 - DNA, 14 bp, Homo sapiens
ggcctgatggccag

SEQ ID NO: 4271745 - DNA, 16 bp, Homo sapiens
ggcctgatggtggggc

SEQ ID NO: 4271746 - DNA, 22 bp, Homo sapiens
ggcctgccccccttcccacccc

SEQ ID NO: 4271747 - DNA, 15 bp, Homo sapiens
ggcctgctgtgggtc

SEQ ID NO: 4271748 - DNA, 10 bp, Homo sapiens
ggcctggccc

SEQ ID NO: 4271749 - DNA, 13 bp, Homo sapiens
ggcctggcccagc

SEQ ID NO: 4271750 - DNA, 14 bp, Homo sapiens
ggcctggcccagcc

SEQ ID NO: 4271751 - DNA, 15 bp, Homo sapiens
ggcctggcccagcca

SEQ ID NO: 4271752 - DNA, 17 bp, Homo sapiens
ggcctggcccagccagc

SEQ ID NO: 4271753 - DNA, 11 bp, Homo sapiens
ggcctggccct

SEQ ID NO: 4271754 - DNA, 13 bp, Homo sapiens
ggcctggcccttt

SEQ ID NO: 4271755 - DNA, 21 bp, Homo sapiens
ggcctgggaaaagggcaggag

SEQ ID NO: 4271756 - DNA, 15 bp, Homo sapiens
ggcctggggacggag

SEQ ID NO: 4271757 - DNA, 16 bp, Homo sapiens
ggcctggggacggagc

SEQ ID NO: 4271758 - DNA, 17 bp, Homo sapiens
ggcctggggccgggctg

SEQ ID NO: 4271759 - DNA, 16 bp, Homo sapiens
ggcctggtctggagcc

SEQ ID NO: 4271760 - DNA, 17 bp, Homo sapiens
ggcctggtgccctggcc

SEQ ID NO: 4271761 - DNA, 21 bp, Homo sapiens
ggcctggtgccctggcccagc

SEQ ID NO: 4271762 - DNA, 17 bp, Homo sapiens
ggcctgtccacctgtgc

SEQ ID NO: 4271763 - DNA, 19 bp, Homo sapiens
ggcctgtccacctgtgctg

SEQ ID NO: 4271764 - DNA, 22 bp, Homo sapiens
ggccttctttctagagagggaa

SEQ ID NO: 4271765 - DNA, 20 bp, Homo sapiens
ggccttggacggggacacgg

SEQ ID NO: 4271766 - DNA, 18 bp, Homo sapiens
ggccttggttcctccagc

SEQ ID NO: 4271767 - DNA, 21 bp, Homo sapiens
ggcgagccagattaggcctgg

SEQ ID NO: 4271768 - DNA, 12 bp, Homo sapiens
ggcgaggcagag

SEQ ID NO: 4271769 - DNA, 13 bp, Homo sapiens
ggcgaggcagagg

SEQ ID NO: 4271770 - DNA, 21 bp, Homo sapiens
ggcgaggggagggtggcaggt

SEQ ID NO: 4271771 - DNA, 18 bp, Homo sapiens
ggcgcacccggcagcccc

SEQ ID NO: 4271772 - DNA, 17 bp, Homo sapiens
ggcgcagtgcctctggt

SEQ ID NO: 4271773 - DNA, 13 bp, Homo sapiens
ggcggggccagga

SEQ ID NO: 4271774 - DNA, 22 bp, Homo sapiens
ggcggtcaataattgtggagag

SEQ ID NO: 4271775 - DNA, 23 bp, Homo sapiens
ggcggtcaataattgtggagagg

SEQ ID NO: 4271776 - DNA, 21 bp, Homo sapiens
ggcggtccagaggaggtgccc

SEQ ID NO: 4271777 - DNA, 13 bp, Homo sapiens
ggcgtagggccag

SEQ ID NO: 4271778 - DNA, 17 bp, Homo sapiens
ggcgtgggatccagaga

SEQ ID NO: 4271779 - DNA, 18 bp, Homo sapiens
ggcgtgggatccagagag

SEQ ID NO: 4271780 - DNA, 19 bp, Homo sapiens
ggcgtgggatccagagaga

SEQ ID NO: 4271781 - DNA, 21 bp, Homo sapiens
ggctaaaaaagctgaatcaga

SEQ ID NO: 4271782 - DNA, 20 bp, Homo sapiens
ggctaaatgcctaataaaca

SEQ ID NO: 4271783 - DNA, 12 bp, Homo sapiens
ggctaagcctgg

SEQ ID NO: 4271784 - DNA, 16 bp, Homo sapiens
ggctaagcctggacac

SEQ ID NO: 4271785 - DNA, 14 bp, Homo sapiens
ggctagactgggct

SEQ ID NO: 4271786 - DNA, 20 bp, Homo sapiens
ggctattcctaggcctcagg

SEQ ID NO: 4271787 - DNA, 14 bp, Homo sapiens
ggctcacaccagcc

SEQ ID NO: 4271788 - DNA, 16 bp, Homo sapiens
ggctcacaccagccct

SEQ ID NO: 4271789 - DNA, 17 bp, Homo sapiens
ggctcacaccagccctg

SEQ ID NO: 4271790 - DNA, 12 bp, Homo sapiens
ggctcacagcca

SEQ ID NO: 4271791 - DNA, 14 bp, Homo sapiens
ggctcattcttttc

SEQ ID NO: 4271792 - DNA, 18 bp, Homo sapiens
ggctccagagtaggtggg

SEQ ID NO: 4271793 - DNA, 15 bp, Homo sapiens
ggctccagtctgctg

SEQ ID NO: 4271794 - DNA, 18 bp, Homo sapiens
ggctccagtctgctgccc

SEQ ID NO: 4271795 - DNA, 24 bp, Homo sapiens
ggctccagtctgctgccctccatc

SEQ ID NO: 4271796 - DNA, 18 bp, Homo sapiens
ggctcccacaggcccttc

SEQ ID NO: 4271797 - DNA, 17 bp, Homo sapiens
ggctcccacgccctcct

SEQ ID NO: 4271798 - DNA, 22 bp, Homo sapiens
ggctcccacgccctcctccctc

SEQ ID NO: 4271799 - DNA, 19 bp, Homo sapiens
ggctcccactgcccctgca

SEQ ID NO: 4271800 - DNA, 14 bp, Homo sapiens
ggctcccagcagag

SEQ ID NO: 4271801 - DNA, 11 bp, Homo sapiens
ggctcccctct

SEQ ID NO: 4271802 - DNA, 12 bp, Homo sapiens
ggctcccctcta

SEQ ID NO: 4271803 - DNA, 13 bp, Homo sapiens
ggctcctcaccac

SEQ ID NO: 4271804 - DNA, 20 bp, Homo sapiens
ggctcctccagcaagacctc

SEQ ID NO: 4271805 - DNA, 13 bp, Homo sapiens
ggctcctccccga

SEQ ID NO: 4271806 - DNA, 13 bp, Homo sapiens
ggctctaatttcc

SEQ ID NO: 4271807 - DNA, 18 bp, Homo sapiens
ggctctacaactgagtcc

SEQ ID NO: 4271808 - DNA, 19 bp, Homo sapiens
ggctctacaactgagtcct

SEQ ID NO: 4271809 - DNA, 19 bp, Homo sapiens
ggctctctcacccagcctg

SEQ ID NO: 4271810 - DNA, 20 bp, Homo sapiens
ggctctctcacccagcctgg

SEQ ID NO: 4271811 - DNA, 21 bp, Homo sapiens
ggctctgcagcacattgccct

SEQ ID NO: 4271812 - DNA, 22 bp, Homo sapiens
ggctctgcagcacattgccctg

SEQ ID NO: 4271813 - DNA, 18 bp, Homo sapiens
ggctctgcgtcccactga

SEQ ID NO: 4271814 - DNA, 18 bp, Homo sapiens
ggctctggcaggtggcca

SEQ ID NO: 4271815 - DNA, 12 bp, Homo sapiens
ggctcttctcct

SEQ ID NO: 4271816 - DNA, 14 bp, Homo sapiens
ggctcttctccttt

SEQ ID NO: 4271817 - DNA, 15 bp, Homo sapiens
ggctcttctcctttc

SEQ ID NO: 4271818 - DNA, 23 bp, Homo sapiens
ggctcttctcctttcacaacctt

SEQ ID NO: 4271819 - DNA, 13 bp, Homo sapiens
ggctgaaaagtgc

SEQ ID NO: 4271820 - DNA, 19 bp, Homo sapiens
ggctgaaaagtgctttgct

SEQ ID NO: 4271821 - DNA, 21 bp, Homo sapiens
ggctgagactggatactgccc

SEQ ID NO: 4271822 - DNA, 18 bp, Homo sapiens
ggctgagctgtgccagct

SEQ ID NO: 4271823 - DNA, 17 bp, Homo sapiens
ggctgcacctgcaggga

SEQ ID NO: 4271824 - DNA, 16 bp, Homo sapiens
ggctgcatcctcagcc

SEQ ID NO: 4271825 - DNA, 23 bp, Homo sapiens
ggctgcatcctcagccccagggc

SEQ ID NO: 4271826 - DNA, 12 bp, Homo sapiens
ggctgccctggt

SEQ ID NO: 4271827 - DNA, 15 bp, Homo sapiens
ggctgccctggtgct

SEQ ID NO: 4271828 - DNA, 22 bp, Homo sapiens
ggctgccctggtgctgccacac

SEQ ID NO: 4271829 - DNA, 10 bp, Homo sapiens
ggctgcctgc

SEQ ID NO: 4271830 - DNA, 11 bp, Homo sapiens
ggctgcctgcc

SEQ ID NO: 4271831 - DNA, 14 bp, Homo sapiens
ggctgcctgcccca

SEQ ID NO: 4271832 - DNA, 17 bp, Homo sapiens
ggctgccttctgcggag

SEQ ID NO: 4271833 - DNA, 22 bp, Homo sapiens
ggctgctgcagtcagcacagag

SEQ ID NO: 4271834 - DNA, 14 bp, Homo sapiens
ggctggactggagg

SEQ ID NO: 4271835 - DNA, 15 bp, Homo sapiens
ggctggactggaggc

SEQ ID NO: 4271836 - DNA, 17 bp, Homo sapiens
ggctggattggcaggtg

SEQ ID NO: 4271837 - DNA, 12 bp, Homo sapiens
ggctggcatggg

SEQ ID NO: 4271838 - DNA, 12 bp, Homo sapiens
ggctggccagct

SEQ ID NO: 4271839 - DNA, 14 bp, Homo sapiens
ggctggccagctgt

SEQ ID NO: 4271840 - DNA, 13 bp, Homo sapiens
ggctggctgcctt

SEQ ID NO: 4271841 - DNA, 22 bp, Homo sapiens
ggctgggagcctcgcccctcca

SEQ ID NO: 4271842 - DNA, 22 bp, Homo sapiens
ggctgggtttgggcagtggaga

SEQ ID NO: 4271843 - DNA, 21 bp, Homo sapiens
ggctggtttggtggccaggct

SEQ ID NO: 4271844 - DNA, 16 bp, Homo sapiens
ggctgtattttctttt

SEQ ID NO: 4271845 - DNA, 15 bp, Homo sapiens
ggctgtcccctgcaa

SEQ ID NO: 4271846 - DNA, 19 bp, Homo sapiens
ggctgtgcgctgacaacca

SEQ ID NO: 4271847 - DNA, 14 bp, Homo sapiens
ggctgtggcccctc

SEQ ID NO: 4271848 - DNA, 16 bp, Homo sapiens
ggctgtggcccctcct

SEQ ID NO: 4271849 - DNA, 20 bp, Homo sapiens
ggctgtgtcctaaatgcaaa

SEQ ID NO: 4271850 - DNA, 17 bp, Homo sapiens
ggcttccatggtggttt

SEQ ID NO: 4271851 - DNA, 14 bp, Homo sapiens
ggcttcccaggacc

SEQ ID NO: 4271852 - DNA, 15 bp, Homo sapiens
ggcttcccaggaccc

SEQ ID NO: 4271853 - DNA, 14 bp, Homo sapiens
ggcttcccgctcag

SEQ ID NO: 4271854 - DNA, 18 bp, Homo sapiens
ggcttcccgctcagccct

SEQ ID NO: 4271855 - DNA, 22 bp, Homo sapiens
ggcttcccgctcagccctccct

SEQ ID NO: 4271856 - DNA, 14 bp, Homo sapiens
ggcttccctctgct

SEQ ID NO: 4271857 - DNA, 15 bp, Homo sapiens
ggcttccggctgagc

SEQ ID NO: 4271858 - DNA, 14 bp, Homo sapiens
ggcttcctgcccta

SEQ ID NO: 4271859 - DNA, 20 bp, Homo sapiens
ggcttctccctggactctgt

SEQ ID NO: 4271860 - DNA, 23 bp, Homo sapiens
ggcttgcaagtatgttttagcat

SEQ ID NO: 4271861 - DNA, 19 bp, Homo sapiens
ggcttgcattaaaagactg

SEQ ID NO: 4271862 - DNA, 16 bp, Homo sapiens
ggcttgtagggtgagg

SEQ ID NO: 4271863 - DNA, 21 bp, Homo sapiens
ggctttggaaagacctgtgag

SEQ ID NO: 4271864 - DNA, 18 bp, Homo sapiens
ggctttggctcgggactt

SEQ ID NO: 4271865 - DNA, 13 bp, Homo sapiens
ggcttttcactgc

SEQ ID NO: 4271866 - DNA, 17 bp, Homo sapiens
ggcttttgtgccaggag

SEQ ID NO: 4271867 - DNA, 22 bp, Homo sapiens
gggaaagccagtgactccagga

SEQ ID NO: 4271868 - DNA, 18 bp, Homo sapiens
gggaaatgctgatttaaa

SEQ ID NO: 4271869 - DNA, 16 bp, Homo sapiens
gggaagcagagcctgg

SEQ ID NO: 4271870 - DNA, 17 bp, Homo sapiens
gggaagggggcaggccc

SEQ ID NO: 4271871 - DNA, 17 bp, Homo sapiens
gggaagtgtgctgaggt

SEQ ID NO: 4271872 - DNA, 14 bp, Homo sapiens
gggaatcagggagc

SEQ ID NO: 4271873 - DNA, 22 bp, Homo sapiens
gggaatgcgctcttcaccagga

SEQ ID NO: 4271874 - DNA, 14 bp, Homo sapiens
gggaattctcttgg

SEQ ID NO: 4271875 - DNA, 22 bp, Homo sapiens
gggaattgaggtctgctcggcc

SEQ ID NO: 4271876 - DNA, 21 bp, Homo sapiens
gggactggcccacccctcttc

SEQ ID NO: 4271877 - DNA, 18 bp, Homo sapiens
gggactggtccaggcatg

SEQ ID NO: 4271878 - DNA, 15 bp, Homo sapiens
gggagaaggagaggc

SEQ ID NO: 4271879 - DNA, 17 bp, Homo sapiens
gggagaaggagaggctc

SEQ ID NO: 4271880 - DNA, 12 bp, Homo sapiens
gggagaccctgg

SEQ ID NO: 4271881 - DNA, 13 bp, Homo sapiens
gggagactgagct

SEQ ID NO: 4271882 - DNA, 14 bp, Homo sapiens
gggagaggaagcca

SEQ ID NO: 4271883 - DNA, 18 bp, Homo sapiens
gggagagtgaggtcatcc

SEQ ID NO: 4271884 - DNA, 22 bp, Homo sapiens
gggagcccccgccccgccccac

SEQ ID NO: 4271885 - DNA, 22 bp, Homo sapiens
gggagcctcgcccctccagtgt

SEQ ID NO: 4271886 - DNA, 23 bp, Homo sapiens
gggagcctcgcccctccagtgtt

SEQ ID NO: 4271887 - DNA, 12 bp, Homo sapiens
gggagctgaggg

SEQ ID NO: 4271888 - DNA, 17 bp, Homo sapiens
gggagctgaggggcagg

SEQ ID NO: 4271889 - DNA, 18 bp, Homo sapiens
gggagctgaggggcaggg

SEQ ID NO: 4271890 - DNA, 15 bp, Homo sapiens
gggaggagactcagg

SEQ ID NO: 4271891 - DNA, 10 bp, Homo sapiens
gggaggaggg

SEQ ID NO: 4271892 - DNA, 21 bp, Homo sapiens
gggaggagggggcccggctgg

SEQ ID NO: 4271893 - DNA, 14 bp, Homo sapiens
gggaggcgcgagcc

SEQ ID NO: 4271894 - DNA, 16 bp, Homo sapiens
gggaggggagagaagg

SEQ ID NO: 4271895 - DNA, 15 bp, Homo sapiens
gggagtgggagagga

SEQ ID NO: 4271896 - DNA, 13 bp, Homo sapiens
gggatccagagag

SEQ ID NO: 4271897 - DNA, 17 bp, Homo sapiens
gggatgggcacaggctg

SEQ ID NO: 4271898 - DNA, 16 bp, Homo sapiens
gggattcaaatgcatg

SEQ ID NO: 4271899 - DNA, 17 bp, Homo sapiens
gggattcaaatgcatga

SEQ ID NO: 4271900 - DNA, 18 bp, Homo sapiens
gggatttcaagggactgg

SEQ ID NO: 4271901 - DNA, 13 bp, Homo sapiens
gggcacagccaga

SEQ ID NO: 4271902 - DNA, 14 bp, Homo sapiens
gggcacagccagaa

SEQ ID NO: 4271903 - DNA, 19 bp, Homo sapiens
gggcacaggctgccccacc

SEQ ID NO: 4271904 - DNA, 22 bp, Homo sapiens
gggcagaaggaggaagggactg

SEQ ID NO: 4271905 - DNA, 23 bp, Homo sapiens
gggcagaaggaggaagggactgg

SEQ ID NO: 4271906 - DNA, 23 bp, Homo sapiens
gggcagaggggagaggaagcaca

SEQ ID NO: 4271907 - DNA, 13 bp, Homo sapiens
gggcagcccagag

SEQ ID NO: 4271908 - DNA, 12 bp, Homo sapiens
gggcagcccctc

SEQ ID NO: 4271909 - DNA, 14 bp, Homo sapiens
gggcagcccctccc

SEQ ID NO: 4271910 - DNA, 20 bp, Homo sapiens
gggcagcctgtgggagaagg

SEQ ID NO: 4271911 - DNA, 18 bp, Homo sapiens
gggcagctgccagagaag

SEQ ID NO: 4271912 - DNA, 14 bp, Homo sapiens
gggcaggagcctag

SEQ ID NO: 4271913 - DNA, 21 bp, Homo sapiens
gggcaggagcctagaggagga

SEQ ID NO: 4271914 - DNA, 15 bp, Homo sapiens
gggcaggcagagctc

SEQ ID NO: 4271915 - DNA, 14 bp, Homo sapiens
gggcatctccagga

SEQ ID NO: 4271916 - DNA, 14 bp, Homo sapiens
gggcatctggccct

SEQ ID NO: 4271917 - DNA, 17 bp, Homo sapiens
gggcatctggccctgct

SEQ ID NO: 4271918 - DNA, 21 bp, Homo sapiens
gggcatctggccctgctgccc

SEQ ID NO: 4271919 - DNA, 17 bp, Homo sapiens
gggcatggacagggcca

SEQ ID NO: 4271920 - DNA, 15 bp, Homo sapiens
gggcatggccaggtg

SEQ ID NO: 4271921 - DNA, 17 bp, Homo sapiens
gggcatggccaggtggc

SEQ ID NO: 4271922 - DNA, 20 bp, Homo sapiens
gggcatggccaggtggccac

SEQ ID NO: 4271923 - DNA, 16 bp, Homo sapiens
gggcatgtccccagtg

SEQ ID NO: 4271924 - DNA, 23 bp, Homo sapiens
gggcatgtccccagtgtggactc

SEQ ID NO: 4271925 - DNA, 15 bp, Homo sapiens
gggccaacaccaggg

SEQ ID NO: 4271926 - DNA, 16 bp, Homo sapiens
gggccaacaccaggga

SEQ ID NO: 4271927 - DNA, 23 bp, Homo sapiens
gggccaagccagggttccagaca

SEQ ID NO: 4271928 - DNA, 13 bp, Homo sapiens
gggccaaggactg

SEQ ID NO: 4271929 - DNA, 13 bp, Homo sapiens
gggccactggcat

SEQ ID NO: 4271930 - DNA, 23 bp, Homo sapiens
gggccactggcatctctggagtg

SEQ ID NO: 4271931 - DNA, 12 bp, Homo sapiens
gggccagcccct

SEQ ID NO: 4271932 - DNA, 15 bp, Homo sapiens
gggccagcccctccc

SEQ ID NO: 4271933 - DNA, 11 bp, Homo sapiens
gggccaggaga

SEQ ID NO: 4271934 - DNA, 12 bp, Homo sapiens
gggccaggagaa

SEQ ID NO: 4271935 - DNA, 13 bp, Homo sapiens
gggccagggttgc

SEQ ID NO: 4271936 - DNA, 18 bp, Homo sapiens
gggccatgaactttgtcc

SEQ ID NO: 4271937 - DNA, 12 bp, Homo sapiens
gggcccagaggg

SEQ ID NO: 4271938 - DNA, 15 bp, Homo sapiens
gggccccagggaact

SEQ ID NO: 4271939 - DNA, 16 bp, Homo sapiens
gggccccagggaacta

SEQ ID NO: 4271940 - DNA, 14 bp, Homo sapiens
gggcccggctgggc

SEQ ID NO: 4271941 - DNA, 23 bp, Homo sapiens
gggccctaggcatactctccagg

SEQ ID NO: 4271942 - DNA, 10 bp, Homo sapiens
gggccctgct

SEQ ID NO: 4271943 - DNA, 11 bp, Homo sapiens
gggccctgctc

SEQ ID NO: 4271944 - DNA, 18 bp, Homo sapiens
gggccctgctcaggcctc

SEQ ID NO: 4271945 - DNA, 18 bp, Homo sapiens
gggccctggttcccccag

SEQ ID NO: 4271946 - DNA, 22 bp, Homo sapiens
gggccctggttcccccaggacc

SEQ ID NO: 4271947 - DNA, 21 bp, Homo sapiens
gggcccttcccaacctcccct

SEQ ID NO: 4271948 - DNA, 20 bp, Homo sapiens
gggccgcttcgccatgtgct

SEQ ID NO: 4271949 - DNA, 16 bp, Homo sapiens
gggcgctgagggcagg

SEQ ID NO: 4271950 - DNA, 21 bp, Homo sapiens
gggcggtccagaggaggtgcc

SEQ ID NO: 4271951 - DNA, 22 bp, Homo sapiens
gggcggtccagaggaggtgccc

SEQ ID NO: 4271952 - DNA, 10 bp, Homo sapiens
gggctcacac

SEQ ID NO: 4271953 - DNA, 18 bp, Homo sapiens
gggctcacaccagccctg

SEQ ID NO: 4271954 - DNA, 12 bp, Homo sapiens
gggctccagagt

SEQ ID NO: 4271955 - DNA, 13 bp, Homo sapiens
gggctctgcgtcc

SEQ ID NO: 4271956 - DNA, 21 bp, Homo sapiens
gggctgccgtgcacggggcca

SEQ ID NO: 4271957 - DNA, 13 bp, Homo sapiens
gggctggattggc

SEQ ID NO: 4271958 - DNA, 14 bp, Homo sapiens
gggctggattggca

SEQ ID NO: 4271959 - DNA, 16 bp, Homo sapiens
gggctggcatggggag

SEQ ID NO: 4271960 - DNA, 15 bp, Homo sapiens
gggctggccagctgt

SEQ ID NO: 4271961 - DNA, 15 bp, Homo sapiens
gggctggctgccttc

SEQ ID NO: 4271962 - DNA, 17 bp, Homo sapiens
gggctggcttctccctg

SEQ ID NO: 4271963 - DNA, 19 bp, Homo sapiens
gggctggtttggtggccag

SEQ ID NO: 4271964 - DNA, 16 bp, Homo sapiens
gggcttggaagggcgc

SEQ ID NO: 4271965 - DNA, 19 bp, Homo sapiens
gggcttggggtagagagga

SEQ ID NO: 4271966 - DNA, 15 bp, Homo sapiens
ggggacttggatagg

SEQ ID NO: 4271967 - DNA, 21 bp, Homo sapiens
ggggagagaaggtggtctgca

SEQ ID NO: 4271968 - DNA, 13 bp, Homo sapiens
ggggagctggtgg

SEQ ID NO: 4271969 - DNA, 18 bp, Homo sapiens
ggggaggaaactcacctg

SEQ ID NO: 4271970 - DNA, 21 bp, Homo sapiens
ggggaggccaagtgcaggctg

SEQ ID NO: 4271971 - DNA, 18 bp, Homo sapiens
ggggaggccgaggcaggg

SEQ ID NO: 4271972 - DNA, 13 bp, Homo sapiens
ggggagggagaga

SEQ ID NO: 4271973 - DNA, 19 bp, Homo sapiens
ggggatttcaagggactgg

SEQ ID NO: 4271974 - DNA, 13 bp, Homo sapiens
ggggcaagagctc

SEQ ID NO: 4271975 - DNA, 19 bp, Homo sapiens
ggggcaagagctcaggaga

SEQ ID NO: 4271976 - DNA, 13 bp, Homo sapiens
ggggcacagccag

SEQ ID NO: 4271977 - DNA, 16 bp, Homo sapiens
ggggcagaaggaggaa

SEQ ID NO: 4271978 - DNA, 14 bp, Homo sapiens
ggggcagctgccag

SEQ ID NO: 4271979 - DNA, 12 bp, Homo sapiens
ggggcaggaagt

SEQ ID NO: 4271980 - DNA, 21 bp, Homo sapiens
ggggcaggcctttttgagcca

SEQ ID NO: 4271981 - DNA, 18 bp, Homo sapiens
ggggcatggacagggcca

SEQ ID NO: 4271982 - DNA, 20 bp, Homo sapiens
ggggcatggacagggccagg

SEQ ID NO: 4271983 - DNA, 22 bp, Homo sapiens
ggggcatggacagggccagggt

SEQ ID NO: 4271984 - DNA, 14 bp, Homo sapiens
ggggccatgaggcc

SEQ ID NO: 4271985 - DNA, 22 bp, Homo sapiens
ggggcccctttttactcccctt

SEQ ID NO: 4271986 - DNA, 21 bp, Homo sapiens
ggggcccgcctggcagaactg

SEQ ID NO: 4271987 - DNA, 23 bp, Homo sapiens
ggggcccgcctggcagaactgag

SEQ ID NO: 4271988 - DNA, 18 bp, Homo sapiens
ggggccgggctggcttct

SEQ ID NO: 4271989 - DNA, 22 bp, Homo sapiens
ggggcctagtggcttcagcccc

SEQ ID NO: 4271990 - DNA, 16 bp, Homo sapiens
ggggctagactgggct

SEQ ID NO: 4271991 - DNA, 21 bp, Homo sapiens
ggggctgcatcctcagcccca

SEQ ID NO: 4271992 - DNA, 16 bp, Homo sapiens
ggggctggccagctgt

SEQ ID NO: 4271993 - DNA, 13 bp, Homo sapiens
ggggctgggcaga

SEQ ID NO: 4271994 - DNA, 14 bp, Homo sapiens
ggggctgggcagag

SEQ ID NO: 4271995 - DNA, 13 bp, Homo sapiens
ggggcttggaagg

SEQ ID NO: 4271996 - DNA, 21 bp, Homo sapiens
ggggcttggggtagagaggac

SEQ ID NO: 4271997 - DNA, 14 bp, Homo sapiens
gggggaggccgagg

SEQ ID NO: 4271998 - DNA, 15 bp, Homo sapiens
gggggccatgagctc

SEQ ID NO: 4271999 - DNA, 22 bp, Homo sapiens
ggggtctccacctcaggggaga

SEQ ID NO: 4272000 - DNA, 14 bp, Homo sapiens
ggggtctgggaggc

SEQ ID NO: 4272001 - DNA, 17 bp, Homo sapiens
ggggtctgggaggcagg

SEQ ID NO: 4272002 - DNA, 14 bp, Homo sapiens
ggggtgagccccgc

SEQ ID NO: 4272003 - DNA, 14 bp, Homo sapiens
ggggtgggcctctg

SEQ ID NO: 4272004 - DNA, 19 bp, Homo sapiens
ggggtggggcttggaaggg

SEQ ID NO: 4272005 - DNA, 22 bp, Homo sapiens
ggggtgggggagaatggctctg

SEQ ID NO: 4272006 - DNA, 18 bp, Homo sapiens
ggggtggttggaggcctg

SEQ ID NO: 4272007 - DNA, 13 bp, Homo sapiens
ggggttggctggg

SEQ ID NO: 4272008 - DNA, 17 bp, Homo sapiens
ggggtttccacacaggc

SEQ ID NO: 4272009 - DNA, 15 bp, Homo sapiens
gggtagggggcctga

SEQ ID NO: 4272010 - DNA, 20 bp, Homo sapiens
gggtcagcaggggggttggg

SEQ ID NO: 4272011 - DNA, 14 bp, Homo sapiens
gggtctccacctca

SEQ ID NO: 4272012 - DNA, 17 bp, Homo sapiens
gggtctgggaggcaggt

SEQ ID NO: 4272013 - DNA, 15 bp, Homo sapiens
gggtgagggtgacag

SEQ ID NO: 4272014 - DNA, 21 bp, Homo sapiens
gggtgccaaccacctctggcc

SEQ ID NO: 4272015 - DNA, 12 bp, Homo sapiens
gggtgccatggt

SEQ ID NO: 4272016 - DNA, 21 bp, Homo sapiens
gggtgctgcttccctctgcct

SEQ ID NO: 4272017 - DNA, 23 bp, Homo sapiens
gggtgctgcttccctctgcctgt

SEQ ID NO: 4272018 - DNA, 17 bp, Homo sapiens
gggtggccggccctgcc

SEQ ID NO: 4272019 - DNA, 14 bp, Homo sapiens
gggtggggcttgga

SEQ ID NO: 4272020 - DNA, 24 bp, Homo sapiens
gggtgggggcctgctgtgggtcag

SEQ ID NO: 4272021 - DNA, 17 bp, Homo sapiens
gggtggtcttcaagcct

SEQ ID NO: 4272022 - DNA, 21 bp, Homo sapiens
gggtggtcttcaagcctggcc

SEQ ID NO: 4272023 - DNA, 22 bp, Homo sapiens
gggtggtcttcaagcctggccc

SEQ ID NO: 4272024 - DNA, 23 bp, Homo sapiens
gggtgtatttattttcctcccca

SEQ ID NO: 4272025 - DNA, 14 bp, Homo sapiens
gggtgtgagcaggg

SEQ ID NO: 4272026 - DNA, 12 bp, Homo sapiens
gggtgtgctcca

SEQ ID NO: 4272027 - DNA, 21 bp, Homo sapiens
gggtgtgctccaggcttcctg

SEQ ID NO: 4272028 - DNA, 14 bp, Homo sapiens
gggtgtggcttgga

SEQ ID NO: 4272029 - DNA, 18 bp, Homo sapiens
gggtgtgggtcagggagg

SEQ ID NO: 4272030 - DNA, 21 bp, Homo sapiens
gggttagacaagcctggagga

SEQ ID NO: 4272031 - DNA, 20 bp, Homo sapiens
gggttccagacagagtggat

SEQ ID NO: 4272032 - DNA, 21 bp, Homo sapiens
gggttcccactggctcctcca

SEQ ID NO: 4272033 - DNA, 23 bp, Homo sapiens
gggttggccagagggcccctcac

SEQ ID NO: 4272034 - DNA, 20 bp, Homo sapiens
gggttggctgggcccagaag

SEQ ID NO: 4272035 - DNA, 16 bp, Homo sapiens
gggtttccacacaggc

SEQ ID NO: 4272036 - DNA, 17 bp, Homo sapiens
gggtttccacacaggcc

SEQ ID NO: 4272037 - DNA, 20 bp, Homo sapiens
gggtttggcgggccaaggac

SEQ ID NO: 4272038 - DNA, 19 bp, Homo sapiens
ggtaacatagatgcctggg

SEQ ID NO: 4272039 - DNA, 22 bp, Homo sapiens
ggtaacatagatgcctgggcct

SEQ ID NO: 4272040 - DNA, 15 bp, Homo sapiens
ggtaagattgttatt

SEQ ID NO: 4272041 - DNA, 22 bp, Homo sapiens
ggtaagttggctcacatcatgt

SEQ ID NO: 4272042 - DNA, 21 bp, Homo sapiens
ggtacttctgtgttgtgattc

SEQ ID NO: 4272043 - DNA, 13 bp, Homo sapiens
ggtagggggcctg

SEQ ID NO: 4272044 - DNA, 19 bp, Homo sapiens
ggtagtagaatctcagcac

SEQ ID NO: 4272045 - DNA, 14 bp, Homo sapiens
ggtatccagaggtg

SEQ ID NO: 4272046 - DNA, 18 bp, Homo sapiens
ggtattttcgtgcatttg

SEQ ID NO: 4272047 - DNA, 18 bp, Homo sapiens
ggtcaataattgtggaga

SEQ ID NO: 4272048 - DNA, 24 bp, Homo sapiens
ggtcaccttcctgggcagcccaga

SEQ ID NO: 4272049 - DNA, 22 bp, Homo sapiens
ggtcagcggcctggggacggag

SEQ ID NO: 4272050 - DNA, 14 bp, Homo sapiens
ggtcagggaggggt

SEQ ID NO: 4272051 - DNA, 19 bp, Homo sapiens
ggtcagtgaggcccaggga

SEQ ID NO: 4272052 - DNA, 19 bp, Homo sapiens
ggtcatcctgggcatgtcc

SEQ ID NO: 4272053 - DNA, 20 bp, Homo sapiens
ggtccacattctgctgcccc

SEQ ID NO: 4272054 - DNA, 21 bp, Homo sapiens
ggtcccagacatgctgcccac

SEQ ID NO: 4272055 - DNA, 16 bp, Homo sapiens
ggtctcatgcctgaga

SEQ ID NO: 4272056 - DNA, 13 bp, Homo sapiens
ggtctccacccct

SEQ ID NO: 4272057 - DNA, 18 bp, Homo sapiens
ggtctccacccctcaagc

SEQ ID NO: 4272058 - DNA, 15 bp, Homo sapiens
ggtctccacctcagg

SEQ ID NO: 4272059 - DNA, 17 bp, Homo sapiens
ggtctccacctcagggg

SEQ ID NO: 4272060 - DNA, 15 bp, Homo sapiens
ggtctctaggcctga

SEQ ID NO: 4272061 - DNA, 16 bp, Homo sapiens
ggtctgctcctgtggc

SEQ ID NO: 4272062 - DNA, 20 bp, Homo sapiens
ggtctgctcctgtggcggtg

SEQ ID NO: 4272063 - DNA, 23 bp, Homo sapiens
ggtctggctttggaaagacctgt

SEQ ID NO: 4272064 - DNA, 16 bp, Homo sapiens
ggtctgtgggactggc

SEQ ID NO: 4272065 - DNA, 17 bp, Homo sapiens
ggtcttcaagcctggcc

SEQ ID NO: 4272066 - DNA, 13 bp, Homo sapiens
ggtcttggagagg

SEQ ID NO: 4272067 - DNA, 14 bp, Homo sapiens
ggtcttggagagga

SEQ ID NO: 4272068 - DNA, 20 bp, Homo sapiens
ggtcttggagaggaggtgtg

SEQ ID NO: 4272069 - DNA, 13 bp, Homo sapiens
ggtgacagaggga

SEQ ID NO: 4272070 - DNA, 14 bp, Homo sapiens
ggtgacagagggac

SEQ ID NO: 4272071 - DNA, 16 bp, Homo sapiens
ggtgacagagggacag

SEQ ID NO: 4272072 - DNA, 21 bp, Homo sapiens
ggtgacagagggacagtgggc

SEQ ID NO: 4272073 - DNA, 12 bp, Homo sapiens
ggtgataagtgg

SEQ ID NO: 4272074 - DNA, 16 bp, Homo sapiens
ggtgataagtggaaaa

SEQ ID NO: 4272075 - DNA, 18 bp, Homo sapiens
ggtgataagtggaaaaaa

SEQ ID NO: 4272076 - DNA, 17 bp, Homo sapiens
ggtgcagtggcaaagga

SEQ ID NO: 4272077 - DNA, 18 bp, Homo sapiens
ggtgcagtggcaaaggat

SEQ ID NO: 4272078 - DNA, 22 bp, Homo sapiens
ggtgccatggtgttggaggggc

SEQ ID NO: 4272079 - DNA, 20 bp, Homo sapiens
ggtgcccaccagctggctct

SEQ ID NO: 4272080 - DNA, 16 bp, Homo sapiens
ggtgcccgggcagggg

SEQ ID NO: 4272081 - DNA, 15 bp, Homo sapiens
ggtgccctggcccag

SEQ ID NO: 4272082 - DNA, 13 bp, Homo sapiens
ggtgcctgtgacc

SEQ ID NO: 4272083 - DNA, 15 bp, Homo sapiens
ggtggaacaggagga

SEQ ID NO: 4272084 - DNA, 21 bp, Homo sapiens
ggtggaggctaagcctggaca

SEQ ID NO: 4272085 - DNA, 23 bp, Homo sapiens
ggtggccaagcctgccccggcca

SEQ ID NO: 4272086 - DNA, 16 bp, Homo sapiens
ggtggcccgacagcct

SEQ ID NO: 4272087 - DNA, 18 bp, Homo sapiens
ggtggcccgacagcctgg

SEQ ID NO: 4272088 - DNA, 20 bp, Homo sapiens
ggtggcccgacagcctggca

SEQ ID NO: 4272089 - DNA, 18 bp, Homo sapiens
ggtggccggccctgcccc

SEQ ID NO: 4272090 - DNA, 16 bp, Homo sapiens
ggtggccgggggtggg

SEQ ID NO: 4272091 - DNA, 13 bp, Homo sapiens
ggtgggctccaga

SEQ ID NO: 4272092 - DNA, 14 bp, Homo sapiens
ggtgggctccagag

SEQ ID NO: 4272093 - DNA, 18 bp, Homo sapiens
ggtgggctccagagtagg

SEQ ID NO: 4272094 - DNA, 17 bp, Homo sapiens
ggtggggcgggaaagcc

SEQ ID NO: 4272095 - DNA, 22 bp, Homo sapiens
ggtggggcttggaagggcgctg

SEQ ID NO: 4272096 - DNA, 14 bp, Homo sapiens
ggtgggggcctgct

SEQ ID NO: 4272097 - DNA, 21 bp, Homo sapiens
ggtgggggcctgctgtgggtc

SEQ ID NO: 4272098 - DNA, 18 bp, Homo sapiens
ggtggtcttcaagcctgg

SEQ ID NO: 4272099 - DNA, 14 bp, Homo sapiens
ggtggtcttggaga

SEQ ID NO: 4272100 - DNA, 16 bp, Homo sapiens
ggtggttggaggcctg

SEQ ID NO: 4272101 - DNA, 17 bp, Homo sapiens
ggtggttggaggcctgg

SEQ ID NO: 4272102 - DNA, 17 bp, Homo sapiens
ggtggtttcagaaaggg

SEQ ID NO: 4272103 - DNA, 20 bp, Homo sapiens
ggtgtagggaacggcctgag

SEQ ID NO: 4272104 - DNA, 17 bp, Homo sapiens
ggtgtatttattttcct

SEQ ID NO: 4272105 - DNA, 18 bp, Homo sapiens
ggtgtcacagaggcagtg

SEQ ID NO: 4272106 - DNA, 13 bp, Homo sapiens
ggtgtccctgcct

SEQ ID NO: 4272107 - DNA, 17 bp, Homo sapiens
ggtgtccctgcctggcc

SEQ ID NO: 4272108 - DNA, 19 bp, Homo sapiens
ggtgtgaatgctgtacctt

SEQ ID NO: 4272109 - DNA, 17 bp, Homo sapiens
ggtgtgctccaggcttc

SEQ ID NO: 4272110 - DNA, 13 bp, Homo sapiens
ggtgtgggctccc

SEQ ID NO: 4272111 - DNA, 14 bp, Homo sapiens
ggtgtgggctccca

SEQ ID NO: 4272112 - DNA, 21 bp, Homo sapiens
ggtgtgggctcccacgccctc

SEQ ID NO: 4272113 - DNA, 14 bp, Homo sapiens
ggtgttctggcctc

SEQ ID NO: 4272114 - DNA, 15 bp, Homo sapiens
ggtgttctggcctct

SEQ ID NO: 4272115 - DNA, 16 bp, Homo sapiens
ggtgttttcagaaaga

SEQ ID NO: 4272116 - DNA, 17 bp, Homo sapiens
ggttaagccatatgaca

SEQ ID NO: 4272117 - DNA, 16 bp, Homo sapiens
ggttcatgcctggggt

SEQ ID NO: 4272118 - DNA, 17 bp, Homo sapiens
ggttccagacagagtgg

SEQ ID NO: 4272119 - DNA, 13 bp, Homo sapiens
ggttccagacagg

SEQ ID NO: 4272120 - DNA, 16 bp, Homo sapiens
ggttcccactggctcc

SEQ ID NO: 4272121 - DNA, 18 bp, Homo sapiens
ggatgtcttgagatgtat

SEQ ID NO: 4272122 - DNA, 15 bp, Homo sapiens
ggattataatcagaa

SEQ ID NO: 4272123 - DNA, 11 bp, Homo sapiens
ggattcaaatg

SEQ ID NO: 4272124 - DNA, 20 bp, Homo sapiens
ggattcagtttctaaaattg

SEQ ID NO: 4272125 - DNA, 22 bp, Homo sapiens
ggattcccgtggctttgtgctt

SEQ ID NO: 4272126 - DNA, 22 bp, Homo sapiens
ggattggcaggtgtgggctccc

SEQ ID NO: 4272127 - DNA, 15 bp, Homo sapiens
ggattggtaccagag

SEQ ID NO: 4272128 - DNA, 18 bp, Homo sapiens
ggattgtccacaaatgtc

SEQ ID NO: 4272129 - DNA, 13 bp, Homo sapiens
ggattttgtggct

SEQ ID NO: 4272130 - DNA, 11 bp, Homo sapiens
ggatttttcat

SEQ ID NO: 4272131 - DNA, 16 bp, Homo sapiens
ggcaaatatcttgaaa

SEQ ID NO: 4272132 - DNA, 17 bp, Homo sapiens
ggcaaatgtccaagcat

SEQ ID NO: 4272133 - DNA, 20 bp, Homo sapiens
ggcaaccccctcggagcctg

SEQ ID NO: 4272134 - DNA, 21 bp, Homo sapiens
ggcaaccccctcggagcctgt

SEQ ID NO: 4272135 - DNA, 16 bp, Homo sapiens
ggcacagggcagtggg

SEQ ID NO: 4272136 - DNA, 14 bp, Homo sapiens
ggcacctggggagt

SEQ ID NO: 4272137 - DNA, 22 bp, Homo sapiens
ggcacttcgtggatgacctcct

SEQ ID NO: 4272138 - DNA, 14 bp, Homo sapiens
ggcagaactgagct

SEQ ID NO: 4272139 - DNA, 21 bp, Homo sapiens
ggcagaactgagctcctctgg

SEQ ID NO: 4272140 - DNA, 21 bp, Homo sapiens
ggcagagattgggggggcttg

SEQ ID NO: 4272141 - DNA, 13 bp, Homo sapiens
ggcagaggggaga

SEQ ID NO: 4272142 - DNA, 17 bp, Homo sapiens
ggcagcaacaggaccag

SEQ ID NO: 4272143 - DNA, 22 bp, Homo sapiens
ggcagcaacaggaccaggagcc

SEQ ID NO: 4272144 - DNA, 17 bp, Homo sapiens
ggcagccaccctgccat

SEQ ID NO: 4272145 - DNA, 16 bp, Homo sapiens
ggcagcccagagagac

SEQ ID NO: 4272146 - DNA, 20 bp, Homo sapiens
ggcagcccagagagaccctg

SEQ ID NO: 4272147 - DNA, 12 bp, Homo sapiens
ggcagcccctcc

SEQ ID NO: 4272148 - DNA, 21 bp, Homo sapiens
ggcagccgtgccttcagctct

SEQ ID NO: 4272149 - DNA, 15 bp, Homo sapiens
ggcagcctgtgggag

SEQ ID NO: 4272150 - DNA, 18 bp, Homo sapiens
ggcagcctgtgggtcctt

SEQ ID NO: 4272151 - DNA, 22 bp, Homo sapiens
ggcagctgcagttagcacagag

SEQ ID NO: 4272152 - DNA, 11 bp, Homo sapiens
ggcagctgcca

SEQ ID NO: 4272153 - DNA, 12 bp, Homo sapiens
ggcagctggctc

SEQ ID NO: 4272154 - DNA, 16 bp, Homo sapiens
ggcagctggctctgaa

SEQ ID NO: 4272155 - DNA, 17 bp, Homo sapiens
ggcagctggctctgaat

SEQ ID NO: 4272156 - DNA, 20 bp, Homo sapiens
ggcaggaaccatggacctgc

SEQ ID NO: 4272157 - DNA, 21 bp, Homo sapiens
ggcaggaaccatggacctgca

SEQ ID NO: 4272158 - DNA, 21 bp, Homo sapiens
ggcaggaagtcaggagccagc

SEQ ID NO: 4272159 - DNA, 14 bp, Homo sapiens
ggcaggcagagctc

SEQ ID NO: 4272160 - DNA, 19 bp, Homo sapiens
ggcaggcccctttggacct

SEQ ID NO: 4272161 - DNA, 20 bp, Homo sapiens
ggcaggcctttttgagccaa

SEQ ID NO: 4272162 - DNA, 22 bp, Homo sapiens
ggcagggagggaaacccgggga

SEQ ID NO: 4272163 - DNA, 16 bp, Homo sapiens
ggcaggggctgcatcc

SEQ ID NO: 4272164 - DNA, 13 bp, Homo sapiens
ggcagggttctag

SEQ ID NO: 4272165 - DNA, 20 bp, Homo sapiens
ggcaggtcccgagccccctg

SEQ ID NO: 4272166 - DNA, 21 bp, Homo sapiens
ggcaggtcccgagccccctgt

SEQ ID NO: 4272167 - DNA, 15 bp, Homo sapiens
ggcaggtgtgggctc

SEQ ID NO: 4272168 - DNA, 13 bp, Homo sapiens
ggcagtggcccag

SEQ ID NO: 4272169 - DNA, 23 bp, Homo sapiens
ggcagtggcccagggaatcaggg

SEQ ID NO: 4272170 - DNA, 15 bp, Homo sapiens
ggcatactctccagg

SEQ ID NO: 4272171 - DNA, 15 bp, Homo sapiens
ggcatccacttcaca

SEQ ID NO: 4272172 - DNA, 19 bp, Homo sapiens
ggcatccccagccccctgg

SEQ ID NO: 4272173 - DNA, 16 bp, Homo sapiens
ggcatctccaggaagg

SEQ ID NO: 4272174 - DNA, 16 bp, Homo sapiens
ggcatctctggagtgt

SEQ ID NO: 4272175 - DNA, 17 bp, Homo sapiens
ggcatctggccctgctg

SEQ ID NO: 4272176 - DNA, 20 bp, Homo sapiens
ggcatgaccctggagcccgg

SEQ ID NO: 4272177 - DNA, 15 bp, Homo sapiens
ggcatgccgagtgcc

SEQ ID NO: 4272178 - DNA, 18 bp, Homo sapiens
ggcatgccgagtgcccca

SEQ ID NO: 4272179 - DNA, 16 bp, Homo sapiens
ggcatggacagggcca

SEQ ID NO: 4272180 - DNA, 18 bp, Homo sapiens
ggcatggacagggccagg

SEQ ID NO: 4272181 - DNA, 14 bp, Homo sapiens
ggcatgtccccagt

SEQ ID NO: 4272182 - DNA, 24 bp, Homo sapiens
ggcattagctaaaaccttccatgt

SEQ ID NO: 4272183 - DNA, 14 bp, Homo sapiens
ggcattgtttccac

SEQ ID NO: 4272184 - DNA, 18 bp, Homo sapiens
ggccaacaccagggatgg

SEQ ID NO: 4272185 - DNA, 22 bp, Homo sapiens
ggccaagccagggttccagaca

SEQ ID NO: 4272186 - DNA, 15 bp, Homo sapiens
ggccaagcctgcccc

SEQ ID NO: 4272187 - DNA, 17 bp, Homo sapiens
ggccaaggactgccgac

SEQ ID NO: 4272188 - DNA, 14 bp, Homo sapiens
ggccacgggggagg

SEQ ID NO: 4272189 - DNA, 18 bp, Homo sapiens
ggccactctgtttgctca

SEQ ID NO: 4272190 - DNA, 13 bp, Homo sapiens
ggccactgcagtc

SEQ ID NO: 4272191 - DNA, 14 bp, Homo sapiens
ggccactggcatct

SEQ ID NO: 4272192 - DNA, 17 bp, Homo sapiens
ggccactttgcagacct

SEQ ID NO: 4272193 - DNA, 19 bp, Homo sapiens
ggccactttgcagacctgg

SEQ ID NO: 4272194 - DNA, 13 bp, Homo sapiens
ggccagaggaagg

SEQ ID NO: 4272195 - DNA, 22 bp, Homo sapiens
ggccagaggaagggaggcctga

SEQ ID NO: 4272196 - DNA, 22 bp, Homo sapiens
ggccagcatccatgcggccggc

SEQ ID NO: 4272197 - DNA, 14 bp, Homo sapiens
ggccagcccagatg

SEQ ID NO: 4272198 - DNA, 20 bp, Homo sapiens
ggccagcccagatggctccc

SEQ ID NO: 4272199 - DNA, 18 bp, Homo sapiens
ggccagcccctcccacca

SEQ ID NO: 4272200 - DNA, 21 bp, Homo sapiens
ggccagcccctcccaccacag

SEQ ID NO: 4272201 - DNA, 23 bp, Homo sapiens
ggccagcccctcccaccacagca

SEQ ID NO: 4272202 - DNA, 13 bp, Homo sapiens
ggccagctcctta

SEQ ID NO: 4272203 - DNA, 15 bp, Homo sapiens
ggccagggctctggc

SEQ ID NO: 4272204 - DNA, 22 bp, Homo sapiens
ggccagggttgcggtcgcggct

SEQ ID NO: 4272205 - DNA, 17 bp, Homo sapiens
ggccatgaactttgtcc

SEQ ID NO: 4272206 - DNA, 21 bp, Homo sapiens
ggccatgagctccagaccccc

SEQ ID NO: 4272207 - DNA, 20 bp, Homo sapiens
ggccatggaagctggcagga

SEQ ID NO: 4272208 - DNA, 21 bp, Homo sapiens
ggcccaccagagcctccctca

SEQ ID NO: 4272209 - DNA, 18 bp, Homo sapiens
ggcccagcagcggcccag

SEQ ID NO: 4272210 - DNA, 13 bp, Homo sapiens
ggcccagcctggc

SEQ ID NO: 4272211 - DNA, 19 bp, Homo sapiens
ggcccagcctgtggcctca

SEQ ID NO: 4272212 - DNA, 22 bp, Homo sapiens
ggcccagcctgtggcctcagca

SEQ ID NO: 4272213 - DNA, 23 bp, Homo sapiens
ggcccagcctgtggcctcagcat

SEQ ID NO: 4272214 - DNA, 21 bp, Homo sapiens
ggcccagggaatcagggagca

SEQ ID NO: 4272215 - DNA, 19 bp, Homo sapiens
ggcccagtgagagtgaggc

SEQ ID NO: 4272216 - DNA, 22 bp, Homo sapiens
ggcccatgccctccgtcctggc

SEQ ID NO: 4272217 - DNA, 16 bp, Homo sapiens
ggccccaaaaccacag

SEQ ID NO: 4272218 - DNA, 23 bp, Homo sapiens
ggccccacccaccctctggtcct

SEQ ID NO: 4272219 - DNA, 14 bp, Homo sapiens
ggccccagagactc

SEQ ID NO: 4272220 - DNA, 11 bp, Homo sapiens
ggccccaggct

SEQ ID NO: 4272221 - DNA, 12 bp, Homo sapiens
ggccccaggctg

SEQ ID NO: 4272222 - DNA, 13 bp, Homo sapiens
ggccccaggctgg

SEQ ID NO: 4272223 - DNA, 14 bp, Homo sapiens
ggccccaggctgga

SEQ ID NO: 4272224 - DNA, 15 bp, Homo sapiens
ggccccaggctggat

SEQ ID NO: 4272225 - DNA, 15 bp, Homo sapiens
ggccccagggaacta

SEQ ID NO: 4272226 - DNA, 15 bp, Homo sapiens
ggcccccagagcgcc

SEQ ID NO: 4272227 - DNA, 14 bp, Homo sapiens
ggcccccgccctct

SEQ ID NO: 4272228 - DNA, 17 bp, Homo sapiens
ggcccccgccctctgcc

SEQ ID NO: 4272229 - DNA, 18 bp, Homo sapiens
ggcccccgccctctgccc

SEQ ID NO: 4272230 - DNA, 23 bp, Homo sapiens
ggcccctgaagtgaccccagctc

SEQ ID NO: 4272231 - DNA, 14 bp, Homo sapiens
ggccccttgctgct

SEQ ID NO: 4272232 - DNA, 19 bp, Homo sapiens
ggccccttgctgctggctc

SEQ ID NO: 4272233 - DNA, 18 bp, Homo sapiens
ggcccgagggtcccaagg

SEQ ID NO: 4272234 - DNA, 15 bp, Homo sapiens
ggcccgcctggcaga

SEQ ID NO: 4272235 - DNA, 19 bp, Homo sapiens
ggcccgcctggcagaactg

SEQ ID NO: 4272236 - DNA, 15 bp, Homo sapiens
ggcccggctgggccc

SEQ ID NO: 4272237 - DNA, 22 bp, Homo sapiens
ggcccgggaggaggatccgggc

SEQ ID NO: 4272238 - DNA, 12 bp, Homo sapiens
ggccctaggcat

SEQ ID NO: 4272239 - DNA, 16 bp, Homo sapiens
ggccctccgcggggga

SEQ ID NO: 4272240 - DNA, 10 bp, Homo sapiens
ggccctgccc

SEQ ID NO: 4272241 - DNA, 12 bp, Homo sapiens
ggccctgcccca

SEQ ID NO: 4272242 - DNA, 17 bp, Homo sapiens
ggccctgccccacacag

SEQ ID NO: 4272243 - DNA, 12 bp, Homo sapiens
ggccctgccccc

SEQ ID NO: 4272244 - DNA, 23 bp, Homo sapiens
ggccctgccccccacattctggc

SEQ ID NO: 4272245 - DNA, 16 bp, Homo sapiens
ggccctgctcaggcct

SEQ ID NO: 4272246 - DNA, 17 bp, Homo sapiens
ggccctgctcaggcctc

SEQ ID NO: 4272247 - DNA, 13 bp, Homo sapiens
ggccctgctgccc

SEQ ID NO: 4272248 - DNA, 17 bp, Homo sapiens
ggccctgctgcccccta

SEQ ID NO: 4272249 - DNA, 19 bp, Homo sapiens
ggccctgctgccccctacc

SEQ ID NO: 4272250 - DNA, 13 bp, Homo sapiens
ggccctggctctg

SEQ ID NO: 4272251 - DNA, 17 bp, Homo sapiens
ggccctgttgtgggggt

SEQ ID NO: 4272252 - DNA, 13 bp, Homo sapiens
ggcccttcctctc

SEQ ID NO: 4272253 - DNA, 15 bp, Homo sapiens
ggcccttcctctcca

SEQ ID NO: 4272254 - DNA, 17 bp, Homo sapiens
ggcccttcctctccact

SEQ ID NO: 4272255 - DNA, 20 bp, Homo sapiens
ggaatcgaggaaccagagcc

SEQ ID NO: 4272256 - DNA, 19 bp, Homo sapiens
ggaatgactataaacatta

SEQ ID NO: 4272257 - DNA, 15 bp, Homo sapiens
ggacaagcccaggac

SEQ ID NO: 4272258 - DNA, 23 bp, Homo sapiens
ggacacagaggacagcttcccca

SEQ ID NO: 4272259 - DNA, 23 bp, Homo sapiens
ggacacagaggacggcttcccca

SEQ ID NO: 4272260 - DNA, 22 bp, Homo sapiens
ggacacagtcagggcggggctg

SEQ ID NO: 4272261 - DNA, 23 bp, Homo sapiens
ggacaccatcccctcctagcaca

SEQ ID NO: 4272262 - DNA, 14 bp, Homo sapiens
ggacacggcctctg

SEQ ID NO: 4272263 - DNA, 16 bp, Homo sapiens
ggacacggcctctggg

SEQ ID NO: 4272264 - DNA, 18 bp, Homo sapiens
ggacacggcctctgggga

SEQ ID NO: 4272265 - DNA, 15 bp, Homo sapiens
ggacactgcctttgc

SEQ ID NO: 4272266 - DNA, 20 bp, Homo sapiens
ggacactgcctttgctgcct

SEQ ID NO: 4272267 - DNA, 21 bp, Homo sapiens
ggacactgcctttgctgcctt

SEQ ID NO: 4272268 - DNA, 18 bp, Homo sapiens
ggacagatcaatggcgca

SEQ ID NO: 4272269 - DNA, 16 bp, Homo sapiens
ggacaggaacacccag

SEQ ID NO: 4272270 - DNA, 17 bp, Homo sapiens
ggacaggaacacccagc

SEQ ID NO: 4272271 - DNA, 20 bp, Homo sapiens
ggacaggaacacccagcccc

SEQ ID NO: 4272272 - DNA, 21 bp, Homo sapiens
ggacaggaacacccagcccca

SEQ ID NO: 4272273 - DNA, 15 bp, Homo sapiens
ggacagggcatggcc

SEQ ID NO: 4272274 - DNA, 15 bp, Homo sapiens
ggacagggccagggt

SEQ ID NO: 4272275 - DNA, 18 bp, Homo sapiens
ggacagggccagggttgc

SEQ ID NO: 4272276 - DNA, 22 bp, Homo sapiens
ggacaggtggaggcgagccaga

SEQ ID NO: 4272277 - DNA, 14 bp, Homo sapiens
ggacagtctggagg

SEQ ID NO: 4272278 - DNA, 15 bp, Homo sapiens
ggacagtctggaggt

SEQ ID NO: 4272279 - DNA, 18 bp, Homo sapiens
ggacagtctggaggtccc

SEQ ID NO: 4272280 - DNA, 12 bp, Homo sapiens
ggaccaggagcc

SEQ ID NO: 4272281 - DNA, 15 bp, Homo sapiens
ggaccaggagccagg

SEQ ID NO: 4272282 - DNA, 17 bp, Homo sapiens
ggacccagcaggggcag

SEQ ID NO: 4272283 - DNA, 17 bp, Homo sapiens
ggaccccatctgctgag

SEQ ID NO: 4272284 - DNA, 23 bp, Homo sapiens
ggaccctgagggtttccaccttg

SEQ ID NO: 4272285 - DNA, 11 bp, Homo sapiens
ggaccctgggt

SEQ ID NO: 4272286 - DNA, 21 bp, Homo sapiens
ggacctgcagttggcctcagc

SEQ ID NO: 4272287 - DNA, 23 bp, Homo sapiens
ggacctgcagttggcctcagcag

SEQ ID NO: 4272288 - DNA, 21 bp, Homo sapiens
ggacgccccccggcctgatgg

SEQ ID NO: 4272289 - DNA, 16 bp, Homo sapiens
ggacgtgggctccagg

SEQ ID NO: 4272290 - DNA, 22 bp, Homo sapiens
ggactcgggctaagtccagctc

SEQ ID NO: 4272291 - DNA, 19 bp, Homo sapiens
ggactctgtggggccacac

SEQ ID NO: 4272292 - DNA, 20 bp, Homo sapiens
ggactgcatgcaagctcagg

SEQ ID NO: 4272293 - DNA, 17 bp, Homo sapiens
ggactggaggctgggtg

SEQ ID NO: 4272294 - DNA, 18 bp, Homo sapiens
ggactggcccacccctct

SEQ ID NO: 4272295 - DNA, 19 bp, Homo sapiens
ggactgggaagggggcagg

SEQ ID NO: 4272296 - DNA, 23 bp, Homo sapiens
ggacttcaaaatcagtgatggga

SEQ ID NO: 4272297 - DNA, 22 bp, Homo sapiens
ggacttcctgctacagtagctg

SEQ ID NO: 4272298 - DNA, 21 bp, Homo sapiens
ggactttccaccccctccctg

SEQ ID NO: 4272299 - DNA, 18 bp, Homo sapiens
ggacttttgttcatggga

SEQ ID NO: 4272300 - DNA, 14 bp, Homo sapiens
ggagaaaagccaga

SEQ ID NO: 4272301 - DNA, 20 bp, Homo sapiens
ggagaacttgaacaaagtct

SEQ ID NO: 4272302 - DNA, 18 bp, Homo sapiens
ggagaaggagaggctctg

SEQ ID NO: 4272303 - DNA, 18 bp, Homo sapiens
ggagaaggcctgcccccc

SEQ ID NO: 4272304 - DNA, 23 bp, Homo sapiens
ggagaagggttagacaagcctgg

SEQ ID NO: 4272305 - DNA, 16 bp, Homo sapiens
ggagaccaggactctg

SEQ ID NO: 4272306 - DNA, 19 bp, Homo sapiens
ggagaccctgggagagtga

SEQ ID NO: 4272307 - DNA, 13 bp, Homo sapiens
ggagactgaccca

SEQ ID NO: 4272308 - DNA, 16 bp, Homo sapiens
ggagactgacccattc

SEQ ID NO: 4272309 - DNA, 14 bp, Homo sapiens
ggagactgagcttg

SEQ ID NO: 4272310 - DNA, 17 bp, Homo sapiens
ggagagaaggtggtctg

SEQ ID NO: 4272311 - DNA, 18 bp, Homo sapiens
ggagagaatgagagagtg

SEQ ID NO: 4272312 - DNA, 20 bp, Homo sapiens
ggagaggaagccacgtgctg

SEQ ID NO: 4272313 - DNA, 21 bp, Homo sapiens
ggagagtgaggtcatcccggg

SEQ ID NO: 4272314 - DNA, 14 bp, Homo sapiens
ggagatccgccctg

SEQ ID NO: 4272315 - DNA, 23 bp, Homo sapiens
ggagatccgccctgggctctggg

SEQ ID NO: 4272316 - DNA, 20 bp, Homo sapiens
ggagatggggagggcgcttt

SEQ ID NO: 4272317 - DNA, 14 bp, Homo sapiens
ggagattgctctgg

SEQ ID NO: 4272318 - DNA, 16 bp, Homo sapiens
ggagcactggaggcct

SEQ ID NO: 4272319 - DNA, 23 bp, Homo sapiens
ggagcagcacgccaaccccagca

SEQ ID NO: 4272320 - DNA, 19 bp, Homo sapiens
ggagcaggaagcaaggcca

SEQ ID NO: 4272321 - DNA, 22 bp, Homo sapiens
ggagcagtgggccctggctctg

SEQ ID NO: 4272322 - DNA, 14 bp, Homo sapiens
ggagcatacccagt

SEQ ID NO: 4272323 - DNA, 12 bp, Homo sapiens
ggagccagcagg

SEQ ID NO: 4272324 - DNA, 16 bp, Homo sapiens
ggagccaggtgtcctg

SEQ ID NO: 4272325 - DNA, 22 bp, Homo sapiens
ggagcctcgcccctccagtgtt

SEQ ID NO: 4272326 - DNA, 12 bp, Homo sapiens
ggagcctgtgtt

SEQ ID NO: 4272327 - DNA, 20 bp, Homo sapiens
ggagcctgtgttagtgtctg

SEQ ID NO: 4272328 - DNA, 16 bp, Homo sapiens
ggagcgggacctgtgg

SEQ ID NO: 4272329 - DNA, 12 bp, Homo sapiens
ggagctgagggg

SEQ ID NO: 4272330 - DNA, 17 bp, Homo sapiens
ggagctgaggggcaggg

SEQ ID NO: 4272331 - DNA, 17 bp, Homo sapiens
ggagctggcgtctgtct

SEQ ID NO: 4272332 - DNA, 18 bp, Homo sapiens
ggagcttctccagccacc

SEQ ID NO: 4272333 - DNA, 16 bp, Homo sapiens
ggaggaaaaaggctgg

SEQ ID NO: 4272334 - DNA, 22 bp, Homo sapiens
ggaggaaaaaggctggtggaca

SEQ ID NO: 4272335 - DNA, 14 bp, Homo sapiens
ggaggaactggtcc

SEQ ID NO: 4272336 - DNA, 22 bp, Homo sapiens
ggaggaaggagcctatggcatc

SEQ ID NO: 4272337 - DNA, 18 bp, Homo sapiens
ggaggaagggactggtcc

SEQ ID NO: 4272338 - DNA, 11 bp, Homo sapiens
ggaggacagaa

SEQ ID NO: 4272339 - DNA, 15 bp, Homo sapiens
ggaggagacagtcag

SEQ ID NO: 4272340 - DNA, 23 bp, Homo sapiens
ggaggagacagtcaggaagcctc

SEQ ID NO: 4272341 - DNA, 16 bp, Homo sapiens
ggaggagactcaggcc

SEQ ID NO: 4272342 - DNA, 19 bp, Homo sapiens
ggaggcaggtcccgagccc

SEQ ID NO: 4272343 - DNA, 17 bp, Homo sapiens
ggaggcagtggcttgga

SEQ ID NO: 4272344 - DNA, 14 bp, Homo sapiens
ggaggccgaggcag

SEQ ID NO: 4272345 - DNA, 16 bp, Homo sapiens
ggaggccgaggcaggg

SEQ ID NO: 4272346 - DNA, 15 bp, Homo sapiens
ggaggcctgaggggc

SEQ ID NO: 4272347 - DNA, 16 bp, Homo sapiens
ggaggcctgaggggca

SEQ ID NO: 4272348 - DNA, 15 bp, Homo sapiens
ggaggcctggtctgg

SEQ ID NO: 4272349 - DNA, 12 bp, Homo sapiens
ggaggcgcgagc

SEQ ID NO: 4272350 - DNA, 17 bp, Homo sapiens
ggagggaaacccgggga

SEQ ID NO: 4272351 - DNA, 13 bp, Homo sapiens
ggagggcgctttt

SEQ ID NO: 4272352 - DNA, 13 bp, Homo sapiens
ggaggggcctggc

SEQ ID NO: 4272353 - DNA, 16 bp, Homo sapiens
ggaggtcccagacatg

SEQ ID NO: 4272354 - DNA, 17 bp, Homo sapiens
ggaggtgtggagtggag

SEQ ID NO: 4272355 - DNA, 19 bp, Homo sapiens
ggagtcagggagccctggg

SEQ ID NO: 4272356 - DNA, 15 bp, Homo sapiens
ggagtccagacctgg

SEQ ID NO: 4272357 - DNA, 22 bp, Homo sapiens
ggagtccagacctgggccctgg

SEQ ID NO: 4272358 - DNA, 17 bp, Homo sapiens
ggagtcctgttctcaga

SEQ ID NO: 4272359 - DNA, 13 bp, Homo sapiens
ggagtcgagctgg

SEQ ID NO: 4272360 - DNA, 18 bp, Homo sapiens
ggagtctgaaggagagga

SEQ ID NO: 4272361 - DNA, 20 bp, Homo sapiens
ggagtctgaaggagaggagt

SEQ ID NO: 4272362 - DNA, 12 bp, Homo sapiens
ggagtgcagtgg

SEQ ID NO: 4272363 - DNA, 21 bp, Homo sapiens
ggagtggaggggtcagcaggg

SEQ ID NO: 4272364 - DNA, 13 bp, Homo sapiens
ggagtgggagagg

SEQ ID NO: 4272365 - DNA, 24 bp, Homo sapiens
ggagtgggagaggaagccacgtgc

SEQ ID NO: 4272366 - DNA, 17 bp, Homo sapiens
ggagtggtaacaagagg

SEQ ID NO: 4272367 - DNA, 15 bp, Homo sapiens
ggagtgtgtgggggt

SEQ ID NO: 4272368 - DNA, 21 bp, Homo sapiens
ggagtgtgtgggggtctggga

SEQ ID NO: 4272369 - DNA, 13 bp, Homo sapiens
ggagttgggctgg

SEQ ID NO: 4272370 - DNA, 14 bp, Homo sapiens
ggagttgggctggt

SEQ ID NO: 4272371 - DNA, 15 bp, Homo sapiens
ggatacgtgtcaatg

SEQ ID NO: 4272372 - DNA, 20 bp, Homo sapiens
ggatcaaggggttcccactg

SEQ ID NO: 4272373 - DNA, 18 bp, Homo sapiens
ggatccagatagcctagg

SEQ ID NO: 4272374 - DNA, 23 bp, Homo sapiens
ggatccagatagcctagggtgag

SEQ ID NO: 4272375 - DNA, 13 bp, Homo sapiens
ggatctccaggcc

SEQ ID NO: 4272376 - DNA, 14 bp, Homo sapiens
ggatctccaggccc

SEQ ID NO: 4272377 - DNA, 16 bp, Homo sapiens
ggatctccaggcccag

SEQ ID NO: 4272378 - DNA, 19 bp, Homo sapiens
ggatctccaggcccagcct

SEQ ID NO: 4272379 - DNA, 17 bp, Homo sapiens
ggatctcttaagacagc

SEQ ID NO: 4272380 - DNA, 18 bp, Homo sapiens
ggatctgctccatgcaga

SEQ ID NO: 4272381 - DNA, 14 bp, Homo sapiens
ggatgaactagcca

SEQ ID NO: 4272382 - DNA, 16 bp, Homo sapiens
ggatgctgggttctgg

SEQ ID NO: 4272383 - DNA, 20 bp, Homo sapiens
ggatgctgggttctggggct

SEQ ID NO: 4272384 - DNA, 21 bp, Homo sapiens
ggatgcttgcctagggcctgg

SEQ ID NO: 4272385 - DNA, 23 bp, Homo sapiens
ggatggcgtgtcccctgcctgtg

SEQ ID NO: 4272386 - DNA, 14 bp, Homo sapiens
ggatgggcacaggc

SEQ ID NO: 4272387 - DNA, 23 bp, Homo sapiens
ggatggtactagggggaagtgac

SEQ ID NO: 4272388 - DNA, 18 bp, Homo sapiens
gctggcaggagacactgg

SEQ ID NO: 4272389 - DNA, 11 bp, Homo sapiens
gctggcccctc

SEQ ID NO: 4272390 - DNA, 12 bp, Homo sapiens
gctggcccctca

SEQ ID NO: 4272391 - DNA, 23 bp, Homo sapiens
gctggcccctcacctgggcacct

SEQ ID NO: 4272392 - DNA, 13 bp, Homo sapiens
gctggcctcttcc

SEQ ID NO: 4272393 - DNA, 16 bp, Homo sapiens
gctggctcccagggcc

SEQ ID NO: 4272394 - DNA, 18 bp, Homo sapiens
gctggctctgcagcacat

SEQ ID NO: 4272395 - DNA, 14 bp, Homo sapiens
gctggctgccttag

SEQ ID NO: 4272396 - DNA, 20 bp, Homo sapiens
gctggctgccttagaacctt

SEQ ID NO: 4272397 - DNA, 16 bp, Homo sapiens
gctggcttctccctgg

SEQ ID NO: 4272398 - DNA, 19 bp, Homo sapiens
gctggcttctccctggact

SEQ ID NO: 4272399 - DNA, 12 bp, Homo sapiens
gctgggaccctc

SEQ ID NO: 4272400 - DNA, 16 bp, Homo sapiens
gctgggagaaaagcca

SEQ ID NO: 4272401 - DNA, 10 bp, Homo sapiens
gctgggagag

SEQ ID NO: 4272402 - DNA, 12 bp, Homo sapiens
gctgggagagcc

SEQ ID NO: 4272403 - DNA, 16 bp, Homo sapiens
gctgggagagccaagg

SEQ ID NO: 4272404 - DNA, 19 bp, Homo sapiens
gctgggagcctcgcccctc

SEQ ID NO: 4272405 - DNA, 14 bp, Homo sapiens
gctgggcccagaag

SEQ ID NO: 4272406 - DNA, 13 bp, Homo sapiens
gctggggagggag

SEQ ID NO: 4272407 - DNA, 22 bp, Homo sapiens
gctggggcttttgtgccaggag

SEQ ID NO: 4272408 - DNA, 23 bp, Homo sapiens
gctgggggccatgagctccagac

SEQ ID NO: 4272409 - DNA, 14 bp, Homo sapiens
gctgggtcccgggt

SEQ ID NO: 4272410 - DNA, 21 bp, Homo sapiens
gctgggtggccggccctgccc

SEQ ID NO: 4272411 - DNA, 23 bp, Homo sapiens
gctggtcacccccacccccgggt

SEQ ID NO: 4272412 - DNA, 17 bp, Homo sapiens
gctggtcatcctgggca

SEQ ID NO: 4272413 - DNA, 19 bp, Homo sapiens
gctggtctctaggcctgaa

SEQ ID NO: 4272414 - DNA, 22 bp, Homo sapiens
gctggtgcccaccagctggctc

SEQ ID NO: 4272415 - DNA, 15 bp, Homo sapiens
gctggtgcccaccct

SEQ ID NO: 4272416 - DNA, 18 bp, Homo sapiens
gctggtggacagacccag

SEQ ID NO: 4272417 - DNA, 22 bp, Homo sapiens
gctggtggacagacccagggtg

SEQ ID NO: 4272418 - DNA, 19 bp, Homo sapiens
gctgtaagacggccttgga

SEQ ID NO: 4272419 - DNA, 16 bp, Homo sapiens
gctgtacactgcacga

SEQ ID NO: 4272420 - DNA, 17 bp, Homo sapiens
gctgtatacaaacaggt

SEQ ID NO: 4272421 - DNA, 14 bp, Homo sapiens
gctgtatctgtgct

SEQ ID NO: 4272422 - DNA, 19 bp, Homo sapiens
gctgtattttcttttatat

SEQ ID NO: 4272423 - DNA, 14 bp, Homo sapiens
gctgtctccagacc

SEQ ID NO: 4272424 - DNA, 13 bp, Homo sapiens
gctgtgccagctg

SEQ ID NO: 4272425 - DNA, 14 bp, Homo sapiens
gctgtgccagctgc

SEQ ID NO: 4272426 - DNA, 17 bp, Homo sapiens
gctgtgccagctgcttc

SEQ ID NO: 4272427 - DNA, 13 bp, Homo sapiens
gctgtgctggtct

SEQ ID NO: 4272428 - DNA, 14 bp, Homo sapiens
gctgtgctggtctc

SEQ ID NO: 4272429 - DNA, 18 bp, Homo sapiens
gctgtgctggtctctagg

SEQ ID NO: 4272430 - DNA, 20 bp, Homo sapiens
gctgtgctggtctctaggcc

SEQ ID NO: 4272431 - DNA, 22 bp, Homo sapiens
gctgtgctggtctctaggcctg

SEQ ID NO: 4272432 - DNA, 14 bp, Homo sapiens
gctgtggcccctcc

SEQ ID NO: 4272433 - DNA, 18 bp, Homo sapiens
gctgtgggagtgattttg

SEQ ID NO: 4272434 - DNA, 19 bp, Homo sapiens
gctgtgggtcagtgtgcca

SEQ ID NO: 4272435 - DNA, 22 bp, Homo sapiens
gctgttgtctgccgtgagagcc

SEQ ID NO: 4272436 - DNA, 19 bp, Homo sapiens
gctgttttatgtcatactc

SEQ ID NO: 4272437 - DNA, 22 bp, Homo sapiens
gcttaaaaaagaaagattttat

SEQ ID NO: 4272438 - DNA, 13 bp, Homo sapiens
gcttaattccaat

SEQ ID NO: 4272439 - DNA, 21 bp, Homo sapiens
gcttagctgaaacctaaggca

SEQ ID NO: 4272440 - DNA, 19 bp, Homo sapiens
gcttcaatctacgatgtta

SEQ ID NO: 4272441 - DNA, 17 bp, Homo sapiens
gcttcagcccctggggt

SEQ ID NO: 4272442 - DNA, 13 bp, Homo sapiens
gcttcaggtgagc

SEQ ID NO: 4272443 - DNA, 15 bp, Homo sapiens
gcttcaggtgagcca

SEQ ID NO: 4272444 - DNA, 21 bp, Homo sapiens
gcttccagttggactgtggcc

SEQ ID NO: 4272445 - DNA, 21 bp, Homo sapiens
gcttccatggtggtttcagaa

SEQ ID NO: 4272446 - DNA, 11 bp, Homo sapiens
gcttcccagga

SEQ ID NO: 4272447 - DNA, 14 bp, Homo sapiens
gcttcccaggaccc

SEQ ID NO: 4272448 - DNA, 20 bp, Homo sapiens
gcttcccaggaccctgggtc

SEQ ID NO: 4272449 - DNA, 20 bp, Homo sapiens
gcttccccatcgccttctgg

SEQ ID NO: 4272450 - DNA, 14 bp, Homo sapiens
gcttccccattgcc

SEQ ID NO: 4272451 - DNA, 17 bp, Homo sapiens
gcttcccgctcagccct

SEQ ID NO: 4272452 - DNA, 20 bp, Homo sapiens
gcttccctctgcctgtccct

SEQ ID NO: 4272453 - DNA, 23 bp, Homo sapiens
gcttccctctgcctgtccctctc

SEQ ID NO: 4272454 - DNA, 16 bp, Homo sapiens
gcttccctctgctcca

SEQ ID NO: 4272455 - DNA, 15 bp, Homo sapiens
gcttccggctgagct

SEQ ID NO: 4272456 - DNA, 16 bp, Homo sapiens
gcttccggctgagctg

SEQ ID NO: 4272457 - DNA, 12 bp, Homo sapiens
gcttcctgccct

SEQ ID NO: 4272458 - DNA, 17 bp, Homo sapiens
gcttcctgccctagcag

SEQ ID NO: 4272459 - DNA, 19 bp, Homo sapiens
gcttcgccatgtgctgtgc

SEQ ID NO: 4272460 - DNA, 21 bp, Homo sapiens
gcttcgccatgtgctgtgcac

SEQ ID NO: 4272461 - DNA, 12 bp, Homo sapiens
gcttctccagcc

SEQ ID NO: 4272462 - DNA, 21 bp, Homo sapiens
gcttctccagccaccaaggct

SEQ ID NO: 4272463 - DNA, 13 bp, Homo sapiens
gcttctgcccacc

SEQ ID NO: 4272464 - DNA, 15 bp, Homo sapiens
gcttctgcccacccc

SEQ ID NO: 4272465 - DNA, 20 bp, Homo sapiens
gcttctgcccaccccgcctc

SEQ ID NO: 4272466 - DNA, 21 bp, Homo sapiens
gcttctgcccaccccgcctct

SEQ ID NO: 4272467 - DNA, 22 bp, Homo sapiens
gcttctgcccaccccgcctctg

SEQ ID NO: 4272468 - DNA, 23 bp, Homo sapiens
gcttctgcccaccccgcctctgg

SEQ ID NO: 4272469 - DNA, 18 bp, Homo sapiens
gcttgaagattcaggctt

SEQ ID NO: 4272470 - DNA, 20 bp, Homo sapiens
gcttgaagattcaggcttgc

SEQ ID NO: 4272471 - DNA, 21 bp, Homo sapiens
gcttgattctaaaggggacag

SEQ ID NO: 4272472 - DNA, 21 bp, Homo sapiens
gcttggaacatttgggagact

SEQ ID NO: 4272473 - DNA, 16 bp, Homo sapiens
gcttggagcagaggtg

SEQ ID NO: 4272474 - DNA, 13 bp, Homo sapiens
gcttggccagaag

SEQ ID NO: 4272475 - DNA, 19 bp, Homo sapiens
gcttgggaccgccagatgg

SEQ ID NO: 4272476 - DNA, 15 bp, Homo sapiens
gcttgtcagagctgg

SEQ ID NO: 4272477 - DNA, 18 bp, Homo sapiens
gcttgtcagagctgggag

SEQ ID NO: 4272478 - DNA, 13 bp, Homo sapiens
gcttgtcctgctc

SEQ ID NO: 4272479 - DNA, 14 bp, Homo sapiens
gcttgtcctgctca

SEQ ID NO: 4272480 - DNA, 15 bp, Homo sapiens
gcttgttcagtcact

SEQ ID NO: 4272481 - DNA, 17 bp, Homo sapiens
gctttatgaagttaaca

SEQ ID NO: 4272482 - DNA, 16 bp, Homo sapiens
gctttccaacacacaa

SEQ ID NO: 4272483 - DNA, 18 bp, Homo sapiens
gctttgctggagtcctgt

SEQ ID NO: 4272484 - DNA, 22 bp, Homo sapiens
gctttggaaagacctgtgaggg

SEQ ID NO: 4272485 - DNA, 21 bp, Homo sapiens
gctttggctcgggacttcaaa

SEQ ID NO: 4272486 - DNA, 15 bp, Homo sapiens
gctttgggctgccct

SEQ ID NO: 4272487 - DNA, 16 bp, Homo sapiens
gctttgggctgccctg

SEQ ID NO: 4272488 - DNA, 13 bp, Homo sapiens
gcttttcactgct

SEQ ID NO: 4272489 - DNA, 23 bp, Homo sapiens
gcttttcactgctggctgcctta

SEQ ID NO: 4272490 - DNA, 17 bp, Homo sapiens
gcttttctgcaattcaa

SEQ ID NO: 4272491 - DNA, 15 bp, Homo sapiens
ggaaaaaatatttta

SEQ ID NO: 4272492 - DNA, 22 bp, Homo sapiens
ggaaaaccaagccgtggcttcc

SEQ ID NO: 4272493 - DNA, 13 bp, Homo sapiens
ggaaaagggcagg

SEQ ID NO: 4272494 - DNA, 21 bp, Homo sapiens
ggaaacccggggaactggttt

SEQ ID NO: 4272495 - DNA, 18 bp, Homo sapiens
ggaaaccttcacccagca

SEQ ID NO: 4272496 - DNA, 21 bp, Homo sapiens
ggaaactcacctgctggcccc

SEQ ID NO: 4272497 - DNA, 20 bp, Homo sapiens
ggaaagggtgctgcttccct

SEQ ID NO: 4272498 - DNA, 23 bp, Homo sapiens
ggaaataggcccaaccaccagat

SEQ ID NO: 4272499 - DNA, 13 bp, Homo sapiens
ggaaatcctgtta

SEQ ID NO: 4272500 - DNA, 14 bp, Homo sapiens
ggaaatgctgattt

SEQ ID NO: 4272501 - DNA, 20 bp, Homo sapiens
ggaacagagtatatatgtac

SEQ ID NO: 4272502 - DNA, 17 bp, Homo sapiens
ggaacaggaggaactgg

SEQ ID NO: 4272503 - DNA, 23 bp, Homo sapiens
ggaacaggaggaactggtccagg

SEQ ID NO: 4272504 - DNA, 21 bp, Homo sapiens
ggaacctcgaagctgttctct

SEQ ID NO: 4272505 - DNA, 13 bp, Homo sapiens
ggaagagagaaag

SEQ ID NO: 4272506 - DNA, 18 bp, Homo sapiens
ggaagaggccgctgcagg

SEQ ID NO: 4272507 - DNA, 17 bp, Homo sapiens
ggaagcaaggccagccc

SEQ ID NO: 4272508 - DNA, 18 bp, Homo sapiens
ggaagcaccagcctcagt

SEQ ID NO: 4272509 - DNA, 14 bp, Homo sapiens
ggaagcagagcctg

SEQ ID NO: 4272510 - DNA, 17 bp, Homo sapiens
ggaagcctcctgctgag

SEQ ID NO: 4272511 - DNA, 22 bp, Homo sapiens
ggaagctggcaggagacactgg

SEQ ID NO: 4272512 - DNA, 16 bp, Homo sapiens
ggaagggactaggagc

SEQ ID NO: 4272513 - DNA, 20 bp, Homo sapiens
ggaaggtctcatgcctgaga

SEQ ID NO: 4272514 - DNA, 18 bp, Homo sapiens
ggaagtcaggagccagca

SEQ ID NO: 4272515 - DNA, 21 bp, Homo sapiens
ggaagtcaggagccagcaggg

SEQ ID NO: 4272516 - DNA, 18 bp, Homo sapiens
ggaagtccctgagaagcc

SEQ ID NO: 4272517 - DNA, 17 bp, Homo sapiens
ggaagtgacaaggcccc

SEQ ID NO: 4272518 - DNA, 22 bp, Homo sapiens
ggaagtgacaaggccccagaga

SEQ ID NO: 4272519 - DNA, 17 bp, Homo sapiens
ggaagtggcctgagaag

SEQ ID NO: 4272520 - DNA, 16 bp, Homo sapiens
ggaagtgtgctgaggt

SEQ ID NO: 4272521 - DNA, 15 bp, Homo sapiens
ggaatcagggagcac

SEQ ID NO: 4272522 - DNA, 15 bp, Homo sapiens
gctatgtctgtgatg

SEQ ID NO: 4272523 - DNA, 12 bp, Homo sapiens
gctattaagaaa

SEQ ID NO: 4272524 - DNA, 12 bp, Homo sapiens
gctattaatatt

SEQ ID NO: 4272525 - DNA, 13 bp, Homo sapiens
gctattcccaggc

SEQ ID NO: 4272526 - DNA, 17 bp, Homo sapiens
gctattcccaggcaggg

SEQ ID NO: 4272527 - DNA, 22 bp, Homo sapiens
gctcaacctacagtggagggag

SEQ ID NO: 4272528 - DNA, 15 bp, Homo sapiens
gctcacaccagccct

SEQ ID NO: 4272529 - DNA, 16 bp, Homo sapiens
gctcacaccagccctg

SEQ ID NO: 4272530 - DNA, 22 bp, Homo sapiens
gctcacagaacccttggagcca

SEQ ID NO: 4272531 - DNA, 11 bp, Homo sapiens
gctcacagcca

SEQ ID NO: 4272532 - DNA, 15 bp, Homo sapiens
gctcacagccaccac

SEQ ID NO: 4272533 - DNA, 21 bp, Homo sapiens
gctcacagccaccacctggat

SEQ ID NO: 4272534 - DNA, 13 bp, Homo sapiens
gctcacccaggac

SEQ ID NO: 4272535 - DNA, 18 bp, Homo sapiens
gctcacccaggacctctg

SEQ ID NO: 4272536 - DNA, 20 bp, Homo sapiens
gctcacccaggacctctggg

SEQ ID NO: 4272537 - DNA, 23 bp, Homo sapiens
gctcagatgctggtcatcctggg

SEQ ID NO: 4272538 - DNA, 16 bp, Homo sapiens
gctcagcccacccccc

SEQ ID NO: 4272539 - DNA, 17 bp, Homo sapiens
gctcagcccacccccct

SEQ ID NO: 4272540 - DNA, 12 bp, Homo sapiens
gctcagccctcc

SEQ ID NO: 4272541 - DNA, 17 bp, Homo sapiens
gctcagccctccctgcc

SEQ ID NO: 4272542 - DNA, 21 bp, Homo sapiens
gctccacagaaaccctgtttt

SEQ ID NO: 4272543 - DNA, 21 bp, Homo sapiens
gctccacgggggcctagtggc

SEQ ID NO: 4272544 - DNA, 15 bp, Homo sapiens
gctccagacccccag

SEQ ID NO: 4272545 - DNA, 14 bp, Homo sapiens
gctccagccaaccc

SEQ ID NO: 4272546 - DNA, 21 bp, Homo sapiens
gctccaggcttcctgccctag

SEQ ID NO: 4272547 - DNA, 23 bp, Homo sapiens
gctccaggcttcctgccctagca

SEQ ID NO: 4272548 - DNA, 12 bp, Homo sapiens
gctccagggact

SEQ ID NO: 4272549 - DNA, 17 bp, Homo sapiens
gctccagtctgctgccc

SEQ ID NO: 4272550 - DNA, 18 bp, Homo sapiens
gctccagtctgctgccct

SEQ ID NO: 4272551 - DNA, 14 bp, Homo sapiens
gctccagtgttttc

SEQ ID NO: 4272552 - DNA, 19 bp, Homo sapiens
gctccagtgttttcttgtg

SEQ ID NO: 4272553 - DNA, 20 bp, Homo sapiens
gctccagtgttttcttgtgt

SEQ ID NO: 4272554 - DNA, 14 bp, Homo sapiens
gctccatcttattt

SEQ ID NO: 4272555 - DNA, 19 bp, Homo sapiens
gctccatgcagatctagcc

SEQ ID NO: 4272556 - DNA, 23 bp, Homo sapiens
gctccatgcagatctagccaggc

SEQ ID NO: 4272557 - DNA, 20 bp, Homo sapiens
gctcccacaggcccttcctc

SEQ ID NO: 4272558 - DNA, 21 bp, Homo sapiens
gctcccacaggcccttcctct

SEQ ID NO: 4272559 - DNA, 15 bp, Homo sapiens
gctcccacgccctcc

SEQ ID NO: 4272560 - DNA, 15 bp, Homo sapiens
gctcccactgcccct

SEQ ID NO: 4272561 - DNA, 18 bp, Homo sapiens
gctcccactgcccctgca

SEQ ID NO: 4272562 - DNA, 22 bp, Homo sapiens
gctcccaggacgcagggagacc

SEQ ID NO: 4272563 - DNA, 14 bp, Homo sapiens
gctcccagggccat

SEQ ID NO: 4272564 - DNA, 14 bp, Homo sapiens
gctcccagggtcct

SEQ ID NO: 4272565 - DNA, 23 bp, Homo sapiens
gctcccagggtcctgggggctgc

SEQ ID NO: 4272566 - DNA, 21 bp, Homo sapiens
gctcccatctccctcccattt

SEQ ID NO: 4272567 - DNA, 14 bp, Homo sapiens
gctccccagcccag

SEQ ID NO: 4272568 - DNA, 18 bp, Homo sapiens
gctcccccatcctcccct

SEQ ID NO: 4272569 - DNA, 13 bp, Homo sapiens
gctccctgggctg

SEQ ID NO: 4272570 - DNA, 14 bp, Homo sapiens
gctccctgggctgg

SEQ ID NO: 4272571 - DNA, 15 bp, Homo sapiens
gctccctgggctggc

SEQ ID NO: 4272572 - DNA, 16 bp, Homo sapiens
gctcctctgcctgtgc

SEQ ID NO: 4272573 - DNA, 15 bp, Homo sapiens
gctcctctgccttgg

SEQ ID NO: 4272574 - DNA, 22 bp, Homo sapiens
gctcctgtggcggtgcagtggc

SEQ ID NO: 4272575 - DNA, 13 bp, Homo sapiens
gctcgttccccca

SEQ ID NO: 4272576 - DNA, 18 bp, Homo sapiens
gctctagacaaccctgca

SEQ ID NO: 4272577 - DNA, 15 bp, Homo sapiens
gctctcctgggccag

SEQ ID NO: 4272578 - DNA, 16 bp, Homo sapiens
gctctcctgggccagg

SEQ ID NO: 4272579 - DNA, 22 bp, Homo sapiens
gctctcctgggccagggtctcg

SEQ ID NO: 4272580 - DNA, 16 bp, Homo sapiens
gctctgaaagctgctt

SEQ ID NO: 4272581 - DNA, 17 bp, Homo sapiens
gctctgaaagctgcttc

SEQ ID NO: 4272582 - DNA, 18 bp, Homo sapiens
gctctgaatgtagccagc

SEQ ID NO: 4272583 - DNA, 20 bp, Homo sapiens
gctctgaatgtagccagccc

SEQ ID NO: 4272584 - DNA, 21 bp, Homo sapiens
gctctgaatgtagccagccca

SEQ ID NO: 4272585 - DNA, 23 bp, Homo sapiens
gctctgaggcaaccccctcggag

SEQ ID NO: 4272586 - DNA, 19 bp, Homo sapiens
gctctgaggctgccccagg

SEQ ID NO: 4272587 - DNA, 14 bp, Homo sapiens
gctctgccatcagc

SEQ ID NO: 4272588 - DNA, 23 bp, Homo sapiens
gctctggcaggtggccagggctc

SEQ ID NO: 4272589 - DNA, 19 bp, Homo sapiens
gctctgtcttggtaggttt

SEQ ID NO: 4272590 - DNA, 17 bp, Homo sapiens
gctcttctcctttcaca

SEQ ID NO: 4272591 - DNA, 19 bp, Homo sapiens
gctgaaaaattgtagagtg

SEQ ID NO: 4272592 - DNA, 18 bp, Homo sapiens
gctgaatgtatgtaaata

SEQ ID NO: 4272593 - DNA, 22 bp, Homo sapiens
gctgacaaccaccgctccccag

SEQ ID NO: 4272594 - DNA, 19 bp, Homo sapiens
gctgacagcactaaacttg

SEQ ID NO: 4272595 - DNA, 22 bp, Homo sapiens
gctgaccagaagtggcaggagg

SEQ ID NO: 4272596 - DNA, 14 bp, Homo sapiens
gctgagctgtgcca

SEQ ID NO: 4272597 - DNA, 23 bp, Homo sapiens
gctgagctgtgccagctgcttct

SEQ ID NO: 4272598 - DNA, 14 bp, Homo sapiens
gctgaggggcaggg

SEQ ID NO: 4272599 - DNA, 12 bp, Homo sapiens
gctgaggtgggc

SEQ ID NO: 4272600 - DNA, 15 bp, Homo sapiens
gctgaggtgggcctt

SEQ ID NO: 4272601 - DNA, 15 bp, Homo sapiens
gctgagtggtccaca

SEQ ID NO: 4272602 - DNA, 12 bp, Homo sapiens
gctgcaccaacc

SEQ ID NO: 4272603 - DNA, 14 bp, Homo sapiens
gctgcacctgcagg

SEQ ID NO: 4272604 - DNA, 17 bp, Homo sapiens
gctgcacctgcagggag

SEQ ID NO: 4272605 - DNA, 18 bp, Homo sapiens
gctgcacctgcagggagc

SEQ ID NO: 4272606 - DNA, 20 bp, Homo sapiens
gctgcacctgcagggagcag

SEQ ID NO: 4272607 - DNA, 14 bp, Homo sapiens
gctgcactgccctc

SEQ ID NO: 4272608 - DNA, 22 bp, Homo sapiens
gctgcaggaatcaaaaattgaa

SEQ ID NO: 4272609 - DNA, 15 bp, Homo sapiens
gctgcatcctcagcc

SEQ ID NO: 4272610 - DNA, 16 bp, Homo sapiens
gctgcatcctcagccc

SEQ ID NO: 4272611 - DNA, 20 bp, Homo sapiens
gctgcatcctcagccccagg

SEQ ID NO: 4272612 - DNA, 22 bp, Homo sapiens
gctgcatcctcagccccagggc

SEQ ID NO: 4272613 - DNA, 23 bp, Homo sapiens
gctgcatcctcagccccagggcc

SEQ ID NO: 4272614 - DNA, 15 bp, Homo sapiens
gctgccacacttcag

SEQ ID NO: 4272615 - DNA, 21 bp, Homo sapiens
gctgccacacttcaggctctt

SEQ ID NO: 4272616 - DNA, 17 bp, Homo sapiens
gctgcccaccccctgct

SEQ ID NO: 4272617 - DNA, 15 bp, Homo sapiens
gctgccccacccctc

SEQ ID NO: 4272618 - DNA, 21 bp, Homo sapiens
gctgcccccagaccccatcca

SEQ ID NO: 4272619 - DNA, 17 bp, Homo sapiens
gctgcccgtgaggaggg

SEQ ID NO: 4272620 - DNA, 21 bp, Homo sapiens
gctgcccgtgaggagggggag

SEQ ID NO: 4272621 - DNA, 23 bp, Homo sapiens
gctgcccgtgaggagggggagaa

SEQ ID NO: 4272622 - DNA, 21 bp, Homo sapiens
gctgccctccatcccgacatg

SEQ ID NO: 4272623 - DNA, 15 bp, Homo sapiens
gctgccctgcaaacc

SEQ ID NO: 4272624 - DNA, 12 bp, Homo sapiens
gctgccctggtg

SEQ ID NO: 4272625 - DNA, 13 bp, Homo sapiens
gctgccctggtgc

SEQ ID NO: 4272626 - DNA, 17 bp, Homo sapiens
gctgccctggtgctgcc

SEQ ID NO: 4272627 - DNA, 22 bp, Homo sapiens
gctgcctaaatccactctgcag

SEQ ID NO: 4272628 - DNA, 15 bp, Homo sapiens
gctgcctccccaacc

SEQ ID NO: 4272629 - DNA, 23 bp, Homo sapiens
gctgcctccccaaccctgcccct

SEQ ID NO: 4272630 - DNA, 19 bp, Homo sapiens
gctgcctctgaaaatattt

SEQ ID NO: 4272631 - DNA, 13 bp, Homo sapiens
gctgcctgcctcc

SEQ ID NO: 4272632 - DNA, 22 bp, Homo sapiens
gctgcctgcctccggccctgcc

SEQ ID NO: 4272633 - DNA, 15 bp, Homo sapiens
gctgccttagaacct

SEQ ID NO: 4272634 - DNA, 17 bp, Homo sapiens
gctgccttctgtctctt

SEQ ID NO: 4272635 - DNA, 19 bp, Homo sapiens
gctgccttctgtctcttgc

SEQ ID NO: 4272636 - DNA, 20 bp, Homo sapiens
gctgccttctgtctcttgca

SEQ ID NO: 4272637 - DNA, 14 bp, Homo sapiens
gctgcgctgccctg

SEQ ID NO: 4272638 - DNA, 15 bp, Homo sapiens
gctgcgctgccctgc

SEQ ID NO: 4272639 - DNA, 19 bp, Homo sapiens
gctgcgctgtgctggtctc

SEQ ID NO: 4272640 - DNA, 14 bp, Homo sapiens
gctgctcctcgcag

SEQ ID NO: 4272641 - DNA, 16 bp, Homo sapiens
gctgctgcactgccct

SEQ ID NO: 4272642 - DNA, 23 bp, Homo sapiens
gctgctgcagtcagcacagagag

SEQ ID NO: 4272643 - DNA, 18 bp, Homo sapiens
gctgctggctcccatctc

SEQ ID NO: 4272644 - DNA, 20 bp, Homo sapiens
gctgctggctcccatctccc

SEQ ID NO: 4272645 - DNA, 20 bp, Homo sapiens
gctgctggtcacccccaccc

SEQ ID NO: 4272646 - DNA, 15 bp, Homo sapiens
gctgcttccctctgc

SEQ ID NO: 4272647 - DNA, 20 bp, Homo sapiens
gctgcttccctctgcctgtc

SEQ ID NO: 4272648 - DNA, 12 bp, Homo sapiens
gctgcttctgcc

SEQ ID NO: 4272649 - DNA, 13 bp, Homo sapiens
gctgctttccaac

SEQ ID NO: 4272650 - DNA, 13 bp, Homo sapiens
gctggagagtaga

SEQ ID NO: 4272651 - DNA, 19 bp, Homo sapiens
gctggagtcctgttctcag

SEQ ID NO: 4272652 - DNA, 20 bp, Homo sapiens
gctggagtgcagtggtgcga

SEQ ID NO: 4272653 - DNA, 14 bp, Homo sapiens
gctggatgctgggt

SEQ ID NO: 4272654 - DNA, 22 bp, Homo sapiens
gctggattggcaggtgtgggct

SEQ ID NO: 4272655 - DNA, 17 bp, Homo sapiens
gctggcaccgccttctc

SEQ ID NO: 4272656 - DNA, 21 bp, Homo sapiens
gaacaggaggaactggtccag

SEQ ID NO: 4272657 - DNA, 13 bp, Homo sapiens
gaacattcatgtg

SEQ ID NO: 4272658 - DNA, 23 bp, Homo sapiens
gaaccagagccatggactctaca

SEQ ID NO: 4272659 - DNA, 19 bp, Homo sapiens
gaaccagtcttttgaaaga

SEQ ID NO: 4272660 - DNA, 13 bp, Homo sapiens
gaacccccctccc

SEQ ID NO: 4272661 - DNA, 14 bp, Homo sapiens
gaacctctgattta

SEQ ID NO: 4272662 - DNA, 18 bp, Homo sapiens
gaacgatccttcaaagtc

SEQ ID NO: 4272663 - DNA, 14 bp, Homo sapiens
gaactcagccttaa

SEQ ID NO: 4272664 - DNA, 21 bp, Homo sapiens
gaactcagccttaagaaagct

SEQ ID NO: 4272665 - DNA, 15 bp, Homo sapiens
gaactccttgatttt

SEQ ID NO: 4272666 - DNA, 19 bp, Homo sapiens
gaactgagctcctctgggc

SEQ ID NO: 4272667 - DNA, 18 bp, Homo sapiens
gaactggtccaggccagg

SEQ ID NO: 4272668 - DNA, 17 bp, Homo sapiens
gaactgtcccacaaaat

SEQ ID NO: 4272669 - DNA, 23 bp, Homo sapiens
gaactgtcttagtcataccatcc

SEQ ID NO: 4272670 - DNA, 20 bp, Homo sapiens
gaactgttgtttgatgtgta

SEQ ID NO: 4272671 - DNA, 19 bp, Homo sapiens
gaacttgaacaaagtctct

SEQ ID NO: 4272672 - DNA, 21 bp, Homo sapiens
gaacttgatgttcctgggatg

SEQ ID NO: 4272673 - DNA, 20 bp, Homo sapiens
gaagaaaagtgggccagtgt

SEQ ID NO: 4272674 - DNA, 12 bp, Homo sapiens
gaagaaagcctg

SEQ ID NO: 4272675 - DNA, 17 bp, Homo sapiens
gaagaaagtctatgctt

SEQ ID NO: 4272676 - DNA, 14 bp, Homo sapiens
gaagaagctcctga

SEQ ID NO: 4272677 - DNA, 14 bp, Homo sapiens
gaagaagggaaatt

SEQ ID NO: 4272678 - DNA, 14 bp, Homo sapiens
gaagaattggcaga

SEQ ID NO: 4272679 - DNA, 14 bp, Homo sapiens
gaagaatttgaaga

SEQ ID NO: 4272680 - DNA, 24 bp, Homo sapiens
gaagacacgtgtttttgtatcttt

SEQ ID NO: 4272681 - DNA, 16 bp, Homo sapiens
gaagaccttctgaaga

SEQ ID NO: 4272682 - DNA, 19 bp, Homo sapiens
gaagagagatatatctgaa

SEQ ID NO: 4272683 - DNA, 18 bp, Homo sapiens
gaagagcgctcctctgcc

SEQ ID NO: 4272684 - DNA, 16 bp, Homo sapiens
gaagagctagagaaat

SEQ ID NO: 4272685 - DNA, 17 bp, Homo sapiens
gaagaggccgctgcagg

SEQ ID NO: 4272686 - DNA, 19 bp, Homo sapiens
gaagagggagaaggagagg

SEQ ID NO: 4272687 - DNA, 23 bp, Homo sapiens
gaagatcctccttccaggcccca

SEQ ID NO: 4272688 - DNA, 18 bp, Homo sapiens
gaagcaaacacacagact

SEQ ID NO: 4272689 - DNA, 14 bp, Homo sapiens
gaagcaaataaata

SEQ ID NO: 4272690 - DNA, 15 bp, Homo sapiens
gaagcaaataaatat

SEQ ID NO: 4272691 - DNA, 15 bp, Homo sapiens
gaagcaaggccagcc

SEQ ID NO: 4272692 - DNA, 19 bp, Homo sapiens
gaagcacaagaagtgggag

SEQ ID NO: 4272693 - DNA, 17 bp, Homo sapiens
gaagcaccagcctcagt

SEQ ID NO: 4272694 - DNA, 16 bp, Homo sapiens
gaagcagagcctgggg

SEQ ID NO: 4272695 - DNA, 20 bp, Homo sapiens
gaagcagcatcaacctagga

SEQ ID NO: 4272696 - DNA, 19 bp, Homo sapiens
gaagcaggttgcttcaaga

SEQ ID NO: 4272697 - DNA, 21 bp, Homo sapiens
gaagccacgtgctggagagta

SEQ ID NO: 4272698 - DNA, 13 bp, Homo sapiens
gaagcctccacct

SEQ ID NO: 4272699 - DNA, 17 bp, Homo sapiens
gaagcctccacctgcag

SEQ ID NO: 4272700 - DNA, 19 bp, Homo sapiens
gaagcctccacctgcagcc

SEQ ID NO: 4272701 - DNA, 15 bp, Homo sapiens
gaagctcagcccacc

SEQ ID NO: 4272702 - DNA, 18 bp, Homo sapiens
gaagctcagcccaccccc

SEQ ID NO: 4272703 - DNA, 15 bp, Homo sapiens
gaagctggcaggaga

SEQ ID NO: 4272704 - DNA, 15 bp, Homo sapiens
gaaggaagagcaagc

SEQ ID NO: 4272705 - DNA, 18 bp, Homo sapiens
gaaggaatggtgcttggc

SEQ ID NO: 4272706 - DNA, 17 bp, Homo sapiens
gaaggagaggagtgcgc

SEQ ID NO: 4272707 - DNA, 12 bp, Homo sapiens
gaaggagaggct

SEQ ID NO: 4272708 - DNA, 21 bp, Homo sapiens
gaaggaggaagggactggtcc

SEQ ID NO: 4272709 - DNA, 13 bp, Homo sapiens
gaaggatgaacag

SEQ ID NO: 4272710 - DNA, 19 bp, Homo sapiens
gaaggattttaaatgctgt

SEQ ID NO: 4272711 - DNA, 17 bp, Homo sapiens
gaaggcctgcccccctt

SEQ ID NO: 4272712 - DNA, 14 bp, Homo sapiens
gaagggactggtcc

SEQ ID NO: 4272713 - DNA, 13 bp, Homo sapiens
gaagggaggcctg

SEQ ID NO: 4272714 - DNA, 15 bp, Homo sapiens
gaagggaggcctgag

SEQ ID NO: 4272715 - DNA, 18 bp, Homo sapiens
gaagggaggcctgagggg

SEQ ID NO: 4272716 - DNA, 19 bp, Homo sapiens
gaagggcgctgagggcagg

SEQ ID NO: 4272717 - DNA, 20 bp, Homo sapiens
gaagggcgctgagggcaggg

SEQ ID NO: 4272718 - DNA, 14 bp, Homo sapiens
gaagggggccatga

SEQ ID NO: 4272719 - DNA, 20 bp, Homo sapiens
gaagggttagacaagcctgg

SEQ ID NO: 4272720 - DNA, 21 bp, Homo sapiens
gaagggttagacaagcctgga

SEQ ID NO: 4272721 - DNA, 22 bp, Homo sapiens
gaagggttagacaagcctggag

SEQ ID NO: 4272722 - DNA, 23 bp, Homo sapiens
gaagggttagacaagcctggagg

SEQ ID NO: 4272723 - DNA, 15 bp, Homo sapiens
gaaggtcggaggctt

SEQ ID NO: 4272724 - DNA, 20 bp, Homo sapiens
gaaggttggaactgctgcca

SEQ ID NO: 4272725 - DNA, 15 bp, Homo sapiens
gaaggttgtgatgaa

SEQ ID NO: 4272726 - DNA, 22 bp, Homo sapiens
gaagtaagttctgaaaactgtt

SEQ ID NO: 4272727 - DNA, 17 bp, Homo sapiens
gaagtcaggagccagca

SEQ ID NO: 4272728 - DNA, 18 bp, Homo sapiens
gaagtcaggagccagcag

SEQ ID NO: 4272729 - DNA, 17 bp, Homo sapiens
gaagtccagtgaccctg

SEQ ID NO: 4272730 - DNA, 16 bp, Homo sapiens
gaagtcttccatcagc

SEQ ID NO: 4272731 - DNA, 19 bp, Homo sapiens
gaagtcttccatcagcagt

SEQ ID NO: 4272732 - DNA, 22 bp, Homo sapiens
gaagtcttccatcagcagtgat

SEQ ID NO: 4272733 - DNA, 16 bp, Homo sapiens
gaagtgaatacatggt

SEQ ID NO: 4272734 - DNA, 18 bp, Homo sapiens
gaagtgacaaggccccag

SEQ ID NO: 4272735 - DNA, 13 bp, Homo sapiens
gaagtgaccccag

SEQ ID NO: 4272736 - DNA, 15 bp, Homo sapiens
gaagtgaccccagct

SEQ ID NO: 4272737 - DNA, 20 bp, Homo sapiens
gaagtgataacactggagtg

SEQ ID NO: 4272738 - DNA, 13 bp, Homo sapiens
gaagtgcccctgc

SEQ ID NO: 4272739 - DNA, 18 bp, Homo sapiens
gaagtgcccctgctgcct

SEQ ID NO: 4272740 - DNA, 13 bp, Homo sapiens
gaagtggcaggag

SEQ ID NO: 4272741 - DNA, 15 bp, Homo sapiens
gaagtggcctgagaa

SEQ ID NO: 4272742 - DNA, 19 bp, Homo sapiens
gaagtgggattcaggaatg

SEQ ID NO: 4272743 - DNA, 22 bp, Homo sapiens
gaagtgggattcaggaatgggc

SEQ ID NO: 4272744 - DNA, 20 bp, Homo sapiens
gaagtgtgctgaggtgggcc

SEQ ID NO: 4272745 - DNA, 12 bp, Homo sapiens
gaagttgttagt

SEQ ID NO: 4272746 - DNA, 18 bp, Homo sapiens
gaataaataaagaagaaa

SEQ ID NO: 4272747 - DNA, 13 bp, Homo sapiens
gaataagttttat

SEQ ID NO: 4272748 - DNA, 21 bp, Homo sapiens
gaatacagtaagctgctctat

SEQ ID NO: 4272749 - DNA, 13 bp, Homo sapiens
gaatactgtattg

SEQ ID NO: 4272750 - DNA, 17 bp, Homo sapiens
gaatataaatgtgtgta

SEQ ID NO: 4272751 - DNA, 18 bp, Homo sapiens
gaatcaaatctgagcctt

SEQ ID NO: 4272752 - DNA, 19 bp, Homo sapiens
gaatcaacagtgaacagct

SEQ ID NO: 4272753 - DNA, 16 bp, Homo sapiens
gaatcaagtctgtgaa

SEQ ID NO: 4272754 - DNA, 16 bp, Homo sapiens
gcccgcccacctgggc

SEQ ID NO: 4272755 - DNA, 18 bp, Homo sapiens
gcccgctgcgctgccctg

SEQ ID NO: 4272756 - DNA, 19 bp, Homo sapiens
gcccgctgcgctgccctgc

SEQ ID NO: 4272757 - DNA, 17 bp, Homo sapiens
gcccggcagtgcacccc

SEQ ID NO: 4272758 - DNA, 12 bp, Homo sapiens
gcccggctgggc

SEQ ID NO: 4272759 - DNA, 22 bp, Homo sapiens
gcccgggagatccgccctgggc

SEQ ID NO: 4272760 - DNA, 21 bp, Homo sapiens
gcccgggaggaggatccgggc

SEQ ID NO: 4272761 - DNA, 14 bp, Homo sapiens
gcccgtgaggaggg

SEQ ID NO: 4272762 - DNA, 17 bp, Homo sapiens
gcccgtgtggccccttc

SEQ ID NO: 4272763 - DNA, 17 bp, Homo sapiens
gccctagcagtttgcct

SEQ ID NO: 4272764 - DNA, 20 bp, Homo sapiens
gccctagcagtttgcctctg

SEQ ID NO: 4272765 - DNA, 23 bp, Homo sapiens
gccctagcagtttgcctctgcac

SEQ ID NO: 4272766 - DNA, 21 bp, Homo sapiens
gccctaggcatactctccagg

SEQ ID NO: 4272767 - DNA, 16 bp, Homo sapiens
gccctcaggcttgggg

SEQ ID NO: 4272768 - DNA, 16 bp, Homo sapiens
gccctccccctgccag

SEQ ID NO: 4272769 - DNA, 12 bp, Homo sapiens
gccctccctccc

SEQ ID NO: 4272770 - DNA, 15 bp, Homo sapiens
gccctccctgcccct

SEQ ID NO: 4272771 - DNA, 21 bp, Homo sapiens
gccctccctgcccctcccttc

SEQ ID NO: 4272772 - DNA, 15 bp, Homo sapiens
gccctccgcccttcc

SEQ ID NO: 4272773 - DNA, 18 bp, Homo sapiens
gccctccgcccttccctg

SEQ ID NO: 4272774 - DNA, 17 bp, Homo sapiens
gccctccgtcctggcag

SEQ ID NO: 4272775 - DNA, 21 bp, Homo sapiens
gccctccgtcctggcagggca

SEQ ID NO: 4272776 - DNA, 13 bp, Homo sapiens
gccctcctccctc

SEQ ID NO: 4272777 - DNA, 12 bp, Homo sapiens
gccctcctctgg

SEQ ID NO: 4272778 - DNA, 16 bp, Homo sapiens
gccctcctctggtcac

SEQ ID NO: 4272779 - DNA, 17 bp, Homo sapiens
gccctcgtctccctggc

SEQ ID NO: 4272780 - DNA, 20 bp, Homo sapiens
gccctctcttaatgccacgg

SEQ ID NO: 4272781 - DNA, 13 bp, Homo sapiens
gccctctgccact

SEQ ID NO: 4272782 - DNA, 15 bp, Homo sapiens
gccctctgcccccag

SEQ ID NO: 4272783 - DNA, 21 bp, Homo sapiens
gccctgacatgctaacctctc

SEQ ID NO: 4272784 - DNA, 11 bp, Homo sapiens
gccctgagggg

SEQ ID NO: 4272785 - DNA, 12 bp, Homo sapiens
gccctgaggggc

SEQ ID NO: 4272786 - DNA, 16 bp, Homo sapiens
gccctgaggggcctgc

SEQ ID NO: 4272787 - DNA, 21 bp, Homo sapiens
gccctgaggggcctgccactc

SEQ ID NO: 4272788 - DNA, 15 bp, Homo sapiens
gccctgcattttcat

SEQ ID NO: 4272789 - DNA, 16 bp, Homo sapiens
gccctgccccacacag

SEQ ID NO: 4272790 - DNA, 11 bp, Homo sapiens
gccctgccccc

SEQ ID NO: 4272791 - DNA, 12 bp, Homo sapiens
gccctgcccccc

SEQ ID NO: 4272792 - DNA, 20 bp, Homo sapiens
gccctgcccttcagcatcct

SEQ ID NO: 4272793 - DNA, 16 bp, Homo sapiens
gccctgctcaggcctc

SEQ ID NO: 4272794 - DNA, 20 bp, Homo sapiens
gccctgctttgggctgccct

SEQ ID NO: 4272795 - DNA, 15 bp, Homo sapiens
gccctggctcccaca

SEQ ID NO: 4272796 - DNA, 16 bp, Homo sapiens
gccctggctctgtcac

SEQ ID NO: 4272797 - DNA, 14 bp, Homo sapiens
gccctgggctctgg

SEQ ID NO: 4272798 - DNA, 17 bp, Homo sapiens
gccctgggctctgggtt

SEQ ID NO: 4272799 - DNA, 21 bp, Homo sapiens
gccctggggtttccacacagg

SEQ ID NO: 4272800 - DNA, 16 bp, Homo sapiens
gccctggtgctgccac

SEQ ID NO: 4272801 - DNA, 21 bp, Homo sapiens
gccctggtgctgccacacttc

SEQ ID NO: 4272802 - DNA, 21 bp, Homo sapiens
gccctggtggccaagcctgcc

SEQ ID NO: 4272803 - DNA, 23 bp, Homo sapiens
gccctggtggccaagcctgcccc

SEQ ID NO: 4272804 - DNA, 21 bp, Homo sapiens
gccctggttcccccaggaccc

SEQ ID NO: 4272805 - DNA, 19 bp, Homo sapiens
gccctggttctccatcccc

SEQ ID NO: 4272806 - DNA, 20 bp, Homo sapiens
gccctggttctccatcccca

SEQ ID NO: 4272807 - DNA, 16 bp, Homo sapiens
gccctgtggaagggac

SEQ ID NO: 4272808 - DNA, 23 bp, Homo sapiens
gccctgtggaagggactaggagc

SEQ ID NO: 4272809 - DNA, 23 bp, Homo sapiens
gccctgttgtgggggtgtcacag

SEQ ID NO: 4272810 - DNA, 18 bp, Homo sapiens
gcccttcccaacctcccc

SEQ ID NO: 4272811 - DNA, 21 bp, Homo sapiens
gcccttcctctccactgcctt

SEQ ID NO: 4272812 - DNA, 18 bp, Homo sapiens
gccctttcacccctcttc

SEQ ID NO: 4272813 - DNA, 17 bp, Homo sapiens
gccgagctctcctgggc

SEQ ID NO: 4272814 - DNA, 15 bp, Homo sapiens
gccgagtgccccaga

SEQ ID NO: 4272815 - DNA, 14 bp, Homo sapiens
gccgctgcagggtg

SEQ ID NO: 4272816 - DNA, 16 bp, Homo sapiens
gccgctgcagggtggc

SEQ ID NO: 4272817 - DNA, 19 bp, Homo sapiens
gccgctgcagggtggcatc

SEQ ID NO: 4272818 - DNA, 19 bp, Homo sapiens
gccgctgcagtcagcacag

SEQ ID NO: 4272819 - DNA, 13 bp, Homo sapiens
gccgctgggagag

SEQ ID NO: 4272820 - DNA, 14 bp, Homo sapiens
gccgctgggagagc

SEQ ID NO: 4272821 - DNA, 15 bp, Homo sapiens
gccgctgggagagcc

SEQ ID NO: 4272822 - DNA, 12 bp, Homo sapiens
gccgctggtgcc

SEQ ID NO: 4272823 - DNA, 16 bp, Homo sapiens
gccgctgtgtccccgc

SEQ ID NO: 4272824 - DNA, 14 bp, Homo sapiens
gccggggagctgag

SEQ ID NO: 4272825 - DNA, 21 bp, Homo sapiens
gccgggggtgggggcctgctg

SEQ ID NO: 4272826 - DNA, 21 bp, Homo sapiens
gccgtagactcacggctgcac

SEQ ID NO: 4272827 - DNA, 20 bp, Homo sapiens
gccgtcttcactcgcccccg

SEQ ID NO: 4272828 - DNA, 11 bp, Homo sapiens
gccgtgagagc

SEQ ID NO: 4272829 - DNA, 16 bp, Homo sapiens
gccgtgcacggggcca

SEQ ID NO: 4272830 - DNA, 17 bp, Homo sapiens
gccgtgcacggggccag

SEQ ID NO: 4272831 - DNA, 20 bp, Homo sapiens
gccgtgcacggggccagcat

SEQ ID NO: 4272832 - DNA, 15 bp, Homo sapiens
gccgtgcagggccag

SEQ ID NO: 4272833 - DNA, 20 bp, Homo sapiens
gccgtggagtcgagctggcc

SEQ ID NO: 4272834 - DNA, 11 bp, Homo sapiens
gccgtggcttc

SEQ ID NO: 4272835 - DNA, 12 bp, Homo sapiens
gccgtggcttcc

SEQ ID NO: 4272836 - DNA, 15 bp, Homo sapiens
gccgtggcttcccgc

SEQ ID NO: 4272837 - DNA, 15 bp, Homo sapiens
gccgtgtctgtggcc

SEQ ID NO: 4272838 - DNA, 19 bp, Homo sapiens
gccgtgtctgtggccctct

SEQ ID NO: 4272839 - DNA, 15 bp, Homo sapiens
gccgttgcctctctg

SEQ ID NO: 4272840 - DNA, 16 bp, Homo sapiens
gcctacaaatcagtaa

SEQ ID NO: 4272841 - DNA, 18 bp, Homo sapiens
gcctacccaccccttccc

SEQ ID NO: 4272842 - DNA, 22 bp, Homo sapiens
gcctacccaccccttcccgccc

SEQ ID NO: 4272843 - DNA, 22 bp, Homo sapiens
gcctagaggaggaaaaaggctg

SEQ ID NO: 4272844 - DNA, 22 bp, Homo sapiens
gcctaggagctggggagggaga

SEQ ID NO: 4272845 - DNA, 15 bp, Homo sapiens
gcctaggccagctcc

SEQ ID NO: 4272846 - DNA, 17 bp, Homo sapiens
gcctagggcctggtcca

SEQ ID NO: 4272847 - DNA, 17 bp, Homo sapiens
gcctagggtgagggtga

SEQ ID NO: 4272848 - DNA, 17 bp, Homo sapiens
gcctatgccacctgcag

SEQ ID NO: 4272849 - DNA, 18 bp, Homo sapiens
gcctatgccacctgcagc

SEQ ID NO: 4272850 - DNA, 19 bp, Homo sapiens
gcctatgccacctgcagcg

SEQ ID NO: 4272851 - DNA, 20 bp, Homo sapiens
gcctatggaaagggtgtggc

SEQ ID NO: 4272852 - DNA, 13 bp, Homo sapiens
gcctattgtaata

SEQ ID NO: 4272853 - DNA, 18 bp, Homo sapiens
gcctcaaccctccctcag

SEQ ID NO: 4272854 - DNA, 15 bp, Homo sapiens
gcctcacctggcttc

SEQ ID NO: 4272855 - DNA, 19 bp, Homo sapiens
gcctcacctggcttcccag

SEQ ID NO: 4272856 - DNA, 21 bp, Homo sapiens
gcctcacctggcttcccagga

SEQ ID NO: 4272857 - DNA, 19 bp, Homo sapiens
gcctcagaggccccttgct

SEQ ID NO: 4272858 - DNA, 21 bp, Homo sapiens
gcctcagcagaaggccttgcc

SEQ ID NO: 4272859 - DNA, 18 bp, Homo sapiens
gcctcaggcctggccctt

SEQ ID NO: 4272860 - DNA, 17 bp, Homo sapiens
gcctcaggctttttcca

SEQ ID NO: 4272861 - DNA, 18 bp, Homo sapiens
gcctcaggctttttccat

SEQ ID NO: 4272862 - DNA, 21 bp, Homo sapiens
gcctcagtccctccctcctgg

SEQ ID NO: 4272863 - DNA, 23 bp, Homo sapiens
gcctcagtccctccctcctggct

SEQ ID NO: 4272864 - DNA, 15 bp, Homo sapiens
gcctcagtgcagccc

SEQ ID NO: 4272865 - DNA, 21 bp, Homo sapiens
gcctcagtgcagccccctcct

SEQ ID NO: 4272866 - DNA, 21 bp, Homo sapiens
gcctcagtggactttccaccc

SEQ ID NO: 4272867 - DNA, 22 bp, Homo sapiens
gcctcagtggactttccacccc

SEQ ID NO: 4272868 - DNA, 22 bp, Homo sapiens
gcctcatcctcctggacccagc

SEQ ID NO: 4272869 - DNA, 13 bp, Homo sapiens
gcctcatgggagt

SEQ ID NO: 4272870 - DNA, 17 bp, Homo sapiens
gcctccacctgcagccc

SEQ ID NO: 4272871 - DNA, 22 bp, Homo sapiens
gcctccacctgcagccccaggc

SEQ ID NO: 4272872 - DNA, 12 bp, Homo sapiens
gcctcccagcca

SEQ ID NO: 4272873 - DNA, 17 bp, Homo sapiens
gcctccccaaccctgcc

SEQ ID NO: 4272874 - DNA, 20 bp, Homo sapiens
gcctccccaaccctgcccct

SEQ ID NO: 4272875 - DNA, 21 bp, Homo sapiens
gcctccccaaccctgcccctg

SEQ ID NO: 4272876 - DNA, 22 bp, Homo sapiens
gcctccccaaccctgcccctgc

SEQ ID NO: 4272877 - DNA, 22 bp, Homo sapiens
gcctcccgaacacgcacagaag

SEQ ID NO: 4272878 - DNA, 18 bp, Homo sapiens
gcctccctcagccacgcc

SEQ ID NO: 4272879 - DNA, 20 bp, Homo sapiens
gcctccggccctgccccaca

SEQ ID NO: 4272880 - DNA, 21 bp, Homo sapiens
gcctcgcccctccagtgttgc

SEQ ID NO: 4272881 - DNA, 14 bp, Homo sapiens
gcctctcactctgg

SEQ ID NO: 4272882 - DNA, 17 bp, Homo sapiens
gcctctcactctggcag

SEQ ID NO: 4272883 - DNA, 15 bp, Homo sapiens
gcctctctcagccca

SEQ ID NO: 4272884 - DNA, 18 bp, Homo sapiens
gcctctctcagcccaggt

SEQ ID NO: 4272885 - DNA, 15 bp, Homo sapiens
gcctctctgccagcc

SEQ ID NO: 4272886 - DNA, 12 bp, Homo sapiens
gcctctgaactg

SEQ ID NO: 4272887 - DNA, 18 bp, Homo sapiens
gcctctgaactgctgctg

SEQ ID NO: 4272888 - DNA, 19 bp, Homo sapiens
gcctctgaactgctgctgg

SEQ ID NO: 4272889 - DNA, 20 bp, Homo sapiens
gcctctgcacgtgcacacac

SEQ ID NO: 4272890 - DNA, 23 bp, Homo sapiens
gcctctgcacgtgcacacacctg

SEQ ID NO: 4272891 - DNA, 15 bp, Homo sapiens
gcctctggcctggga

SEQ ID NO: 4272892 - DNA, 17 bp, Homo sapiens
gcctctgggctcacacc

SEQ ID NO: 4272893 - DNA, 23 bp, Homo sapiens
gcctctggggagaccgagtgtgg

SEQ ID NO: 4272894 - DNA, 23 bp, Homo sapiens
gcctctggtttggggcgaggcag

SEQ ID NO: 4272895 - DNA, 22 bp, Homo sapiens
gcctcttcctccctccctgcag

SEQ ID NO: 4272896 - DNA, 23 bp, Homo sapiens
gcctcttcctccctccctgcagg

SEQ ID NO: 4272897 - DNA, 15 bp, Homo sapiens
gcctcttcgggaaga

SEQ ID NO: 4272898 - DNA, 18 bp, Homo sapiens
gcctgaagttggagtgag

SEQ ID NO: 4272899 - DNA, 15 bp, Homo sapiens
gcctgagagcagaat

SEQ ID NO: 4272900 - DNA, 12 bp, Homo sapiens
gcctgaggggca

SEQ ID NO: 4272901 - DNA, 15 bp, Homo sapiens
gcctgagttgagggg

SEQ ID NO: 4272902 - DNA, 13 bp, Homo sapiens
gcctgcccacccg

SEQ ID NO: 4272903 - DNA, 14 bp, Homo sapiens
gcctgcccacccgt

SEQ ID NO: 4272904 - DNA, 12 bp, Homo sapiens
gcctgcccccct

SEQ ID NO: 4272905 - DNA, 14 bp, Homo sapiens
gcctgccccccttc

SEQ ID NO: 4272906 - DNA, 18 bp, Homo sapiens
gcctgcctccggccctgc

SEQ ID NO: 4272907 - DNA, 19 bp, Homo sapiens
gcctgcgatggtgctgcac

SEQ ID NO: 4272908 - DNA, 19 bp, Homo sapiens
gcctgcgtggcctggggct

SEQ ID NO: 4272909 - DNA, 17 bp, Homo sapiens
gcctgctatccagccgc

SEQ ID NO: 4272910 - DNA, 17 bp, Homo sapiens
gcctggacacagtcagg

SEQ ID NO: 4272911 - DNA, 18 bp, Homo sapiens
gcctggacacagtcaggg

SEQ ID NO: 4272912 - DNA, 18 bp, Homo sapiens
gcctggcacagggcagtg

SEQ ID NO: 4272913 - DNA, 18 bp, Homo sapiens
gcctggcagaactgagct

SEQ ID NO: 4272914 - DNA, 21 bp, Homo sapiens
gcctggcagccgtgccttcag

SEQ ID NO: 4272915 - DNA, 16 bp, Homo sapiens
gcctggcccagccagc

SEQ ID NO: 4272916 - DNA, 17 bp, Homo sapiens
gcctggcccagccagca

SEQ ID NO: 4272917 - DNA, 16 bp, Homo sapiens
gcctggcccagtgaga

SEQ ID NO: 4272918 - DNA, 18 bp, Homo sapiens
gcctggcccagtgagagt

SEQ ID NO: 4272919 - DNA, 16 bp, Homo sapiens
gcctggccccaaatgt

SEQ ID NO: 4272920 - DNA, 14 bp, Homo sapiens
gcctgggccactgg

SEQ ID NO: 4272921 - DNA, 19 bp, Homo sapiens
gcctgggccactggcatct

SEQ ID NO: 4272922 - DNA, 13 bp, Homo sapiens
gcctggggacgga

SEQ ID NO: 4272923 - DNA, 16 bp, Homo sapiens
gcctggggtggaggct

SEQ ID NO: 4272924 - DNA, 20 bp, Homo sapiens
gcctggggtggaggctaagc

SEQ ID NO: 4272925 - DNA, 17 bp, Homo sapiens
gcctggtctggagcccc

SEQ ID NO: 4272926 - DNA, 21 bp, Homo sapiens
gcctgtccacctgtgctgctg

SEQ ID NO: 4272927 - DNA, 14 bp, Homo sapiens
gcctgtccctctca

SEQ ID NO: 4272928 - DNA, 19 bp, Homo sapiens
gcctgtgaccggggtcctg

SEQ ID NO: 4272929 - DNA, 23 bp, Homo sapiens
gcctgtgaccggggtcctgaggc

SEQ ID NO: 4272930 - DNA, 13 bp, Homo sapiens
gcctgtgcccgct

SEQ ID NO: 4272931 - DNA, 18 bp, Homo sapiens
gcctgtgcccgctgcgct

SEQ ID NO: 4272932 - DNA, 19 bp, Homo sapiens
gcctgtgcccgctgcgctg

SEQ ID NO: 4272933 - DNA, 21 bp, Homo sapiens
gcctgtgcccgctgcgctgcc

SEQ ID NO: 4272934 - DNA, 22 bp, Homo sapiens
gcctgtgcccgctgcgctgccc

SEQ ID NO: 4272935 - DNA, 13 bp, Homo sapiens
gcctgtggcctca

SEQ ID NO: 4272936 - DNA, 24 bp, Homo sapiens
gcctgtgttagtgtctgtccatct

SEQ ID NO: 4272937 - DNA, 16 bp, Homo sapiens
gccttaagtcttactg

SEQ ID NO: 4272938 - DNA, 19 bp, Homo sapiens
gccttccacgctgtctcca

SEQ ID NO: 4272939 - DNA, 22 bp, Homo sapiens
gccttccacgctgtctccagac

SEQ ID NO: 4272940 - DNA, 15 bp, Homo sapiens
gccttccatgggcat

SEQ ID NO: 4272941 - DNA, 18 bp, Homo sapiens
gccttcccctcagccaca

SEQ ID NO: 4272942 - DNA, 23 bp, Homo sapiens
gccttcgatacaccgggcctgga

SEQ ID NO: 4272943 - DNA, 15 bp, Homo sapiens
gccttctacctgcag

SEQ ID NO: 4272944 - DNA, 14 bp, Homo sapiens
gccttctcccctcc

SEQ ID NO: 4272945 - DNA, 17 bp, Homo sapiens
gccttctgatgaaatgt

SEQ ID NO: 4272946 - DNA, 23 bp, Homo sapiens
gccttctggggagggacacagag

SEQ ID NO: 4272947 - DNA, 16 bp, Homo sapiens
gccttctgtctcttgc

SEQ ID NO: 4272948 - DNA, 21 bp, Homo sapiens
gccttgagtgacatgcggctg

SEQ ID NO: 4272949 - DNA, 16 bp, Homo sapiens
gccttggttcctccag

SEQ ID NO: 4272950 - DNA, 16 bp, Homo sapiens
gcctttgctgccttct

SEQ ID NO: 4272951 - DNA, 11 bp, Homo sapiens
gcctttgtaac

SEQ ID NO: 4272952 - DNA, 22 bp, Homo sapiens
gcctttgtaaccacaactttca

SEQ ID NO: 4272953 - DNA, 16 bp, Homo sapiens
gccttttagttcctgt

SEQ ID NO: 4272954 - DNA, 17 bp, Homo sapiens
gccttttagttcctgtg

SEQ ID NO: 4272955 - DNA, 20 bp, Homo sapiens
gccttttagttcctgtgcac

SEQ ID NO: 4272956 - DNA, 20 bp, Homo sapiens
gcctttttgagccaatccca

SEQ ID NO: 4272957 - DNA, 20 bp, Homo sapiens
gcgacggctcctccccgatc

SEQ ID NO: 4272958 - DNA, 16 bp, Homo sapiens
gcgagaacacaagcca

SEQ ID NO: 4272959 - DNA, 15 bp, Homo sapiens
gcgagcctgcttgct

SEQ ID NO: 4272960 - DNA, 22 bp, Homo sapiens
gcgaggacgtgaagcctcccga

SEQ ID NO: 4272961 - DNA, 14 bp, Homo sapiens
gcgaggggagggtg

SEQ ID NO: 4272962 - DNA, 12 bp, Homo sapiens
gcgagtctggag

SEQ ID NO: 4272963 - DNA, 10 bp, Homo sapiens
gcgatgtgtt

SEQ ID NO: 4272964 - DNA, 12 bp, Homo sapiens
gcgcacacacac

SEQ ID NO: 4272965 - DNA, 14 bp, Homo sapiens
gcgccctccctccc

SEQ ID NO: 4272966 - DNA, 18 bp, Homo sapiens
gcgccctccctccctcca

SEQ ID NO: 4272967 - DNA, 20 bp, Homo sapiens
gcgccctccctccctccaca

SEQ ID NO: 4272968 - DNA, 14 bp, Homo sapiens
gcgccttcctgggt

SEQ ID NO: 4272969 - DNA, 18 bp, Homo sapiens
gcgccttcctgggttggc

SEQ ID NO: 4272970 - DNA, 17 bp, Homo sapiens
gcgccttctacctgcag

SEQ ID NO: 4272971 - DNA, 18 bp, Homo sapiens
gcgccttctacctgcagg

SEQ ID NO: 4272972 - DNA, 19 bp, Homo sapiens
gcgccttctacctgcagga

SEQ ID NO: 4272973 - DNA, 20 bp, Homo sapiens
gcgccttctacctgcaggac

SEQ ID NO: 4272974 - DNA, 23 bp, Homo sapiens
gcgctagagcattctggggtggg

SEQ ID NO: 4272975 - DNA, 16 bp, Homo sapiens
gcgctcctctgccttg

SEQ ID NO: 4272976 - DNA, 18 bp, Homo sapiens
gcgctctgcatgctcctc

SEQ ID NO: 4272977 - DNA, 23 bp, Homo sapiens
gcgctgacaaccaccgctcccca

SEQ ID NO: 4272978 - DNA, 21 bp, Homo sapiens
gcgctgtgctggtctctaggc

SEQ ID NO: 4272979 - DNA, 14 bp, Homo sapiens
gcggagcttctcca

SEQ ID NO: 4272980 - DNA, 18 bp, Homo sapiens
gcggagcttctccagcca

SEQ ID NO: 4272981 - DNA, 15 bp, Homo sapiens
gcggccgcctgtcct

SEQ ID NO: 4272982 - DNA, 19 bp, Homo sapiens
gcggcctggggacggagca

SEQ ID NO: 4272983 - DNA, 19 bp, Homo sapiens
gcgggcagtgacgtgagtg

SEQ ID NO: 4272984 - DNA, 15 bp, Homo sapiens
gcgggccaaggactg

SEQ ID NO: 4272985 - DNA, 11 bp, Homo sapiens
gcgggccagga

SEQ ID NO: 4272986 - DNA, 18 bp, Homo sapiens
gcgggtaaaaagagaagg

SEQ ID NO: 4272987 - DNA, 14 bp, Homo sapiens
gcggtatccagagg

SEQ ID NO: 4272988 - DNA, 23 bp, Homo sapiens
gcggtcaataattgtggagagga

SEQ ID NO: 4272989 - DNA, 12 bp, Homo sapiens
gcgtaggagaga

SEQ ID NO: 4272990 - DNA, 13 bp, Homo sapiens
gcgtagggccagg

SEQ ID NO: 4272991 - DNA, 17 bp, Homo sapiens
gcgtagggccagggctc

SEQ ID NO: 4272992 - DNA, 23 bp, Homo sapiens
gcgtctgagcggccgcctgtcct

SEQ ID NO: 4272993 - DNA, 24 bp, Homo sapiens
gcgtgacttcagactctctcctct

SEQ ID NO: 4272994 - DNA, 21 bp, Homo sapiens
gcgtgcaggggcggtccagag

SEQ ID NO: 4272995 - DNA, 16 bp, Homo sapiens
gcgtgggatccagaga

SEQ ID NO: 4272996 - DNA, 19 bp, Homo sapiens
gctaaatgcctaataaaca

SEQ ID NO: 4272997 - DNA, 15 bp, Homo sapiens
gctaacactggcccc

SEQ ID NO: 4272998 - DNA, 16 bp, Homo sapiens
gctaacactggcccct

SEQ ID NO: 4272999 - DNA, 18 bp, Homo sapiens
gctaaccagttctctttg

SEQ ID NO: 4273000 - DNA, 16 bp, Homo sapiens
gctaagcctgatgatg

SEQ ID NO: 4273001 - DNA, 14 bp, Homo sapiens
gctaaggcttccgg

SEQ ID NO: 4273002 - DNA, 15 bp, Homo sapiens
gctaagtccagctct

SEQ ID NO: 4273003 - DNA, 14 bp, Homo sapiens
gctaatcagcattc

SEQ ID NO: 4273004 - DNA, 13 bp, Homo sapiens
gctaatgtaatca

SEQ ID NO: 4273005 - DNA, 15 bp, Homo sapiens
gctaatgtaatcatt

SEQ ID NO: 4273006 - DNA, 20 bp, Homo sapiens
gctaatgtaatcatttatct

SEQ ID NO: 4273007 - DNA, 14 bp, Homo sapiens
gctaattaaaaagt

SEQ ID NO: 4273008 - DNA, 18 bp, Homo sapiens
gctacagtagctgtgggg

SEQ ID NO: 4273009 - DNA, 23 bp, Homo sapiens
gctacggttccctgcctaggagc

SEQ ID NO: 4273010 - DNA, 17 bp, Homo sapiens
gctagactgggctggct

SEQ ID NO: 4273011 - DNA, 17 bp, Homo sapiens
gctaggtgggccagccc

SEQ ID NO: 4273012 - DNA, 19 bp, Homo sapiens
gctaggtgggccagcccct

SEQ ID NO: 4273013 - DNA, 18 bp, Homo sapiens
gctagtgatacactgtat

SEQ ID NO: 4273014 - DNA, 23 bp, Homo sapiens
gctagtgatacactgtatctaaa

SEQ ID NO: 4273015 - DNA, 18 bp, Homo sapiens
gctataacaactctattt

SEQ ID NO: 4273016 - DNA, 23 bp, Homo sapiens
gctatagttactgtcctgttgat

SEQ ID NO: 4273017 - DNA, 21 bp, Homo sapiens
gctatgaagagctagagaaat

SEQ ID NO: 4273018 - DNA, 21 bp, Homo sapiens
gctatgccactaggccctggt

SEQ ID NO: 4273019 - DNA, 24 bp, Homo sapiens
gctatgccactaggccctggtctg

SEQ ID NO: 4273020 - DNA, 14 bp, Homo sapiens
gctatgtctgtgat

SEQ ID NO: 4273021 - DNA, 14 bp, Homo sapiens
cttgtgaaacacag

SEQ ID NO: 4273022 - DNA, 19 bp, Homo sapiens
cttgtgaaacacagctgtt

SEQ ID NO: 4273023 - DNA, 19 bp, Homo sapiens
cttgtgcctcttgggagac

SEQ ID NO: 4273024 - DNA, 17 bp, Homo sapiens
cttgtgtatgtgactcc

SEQ ID NO: 4273025 - DNA, 15 bp, Homo sapiens
cttgtgtgagtgtga

SEQ ID NO: 4273026 - DNA, 15 bp, Homo sapiens
cttgtgttgttttct

SEQ ID NO: 4273027 - DNA, 13 bp, Homo sapiens
cttgtgtttgtat

SEQ ID NO: 4273028 - DNA, 18 bp, Homo sapiens
cttgttatggtagaaaaa

SEQ ID NO: 4273029 - DNA, 14 bp, Homo sapiens
cttgttcagtcact

SEQ ID NO: 4273030 - DNA, 22 bp, Homo sapiens
cttgttcagtcacttgtttgtg

SEQ ID NO: 4273031 - DNA, 12 bp, Homo sapiens
cttgttcttcct

SEQ ID NO: 4273032 - DNA, 13 bp, Homo sapiens
cttgttcttcctc

SEQ ID NO: 4273033 - DNA, 23 bp, Homo sapiens
cttgtttctatactgtttgtaat

SEQ ID NO: 4273034 - DNA, 21 bp, Homo sapiens
cttgtttgcctttaggcagga

SEQ ID NO: 4273035 - DNA, 14 bp, Homo sapiens
cttgtttgttctag

SEQ ID NO: 4273036 - DNA, 21 bp, Homo sapiens
ctttacagttctggaggagga

SEQ ID NO: 4273037 - DNA, 22 bp, Homo sapiens
ctttagaaataaaccttaatat

SEQ ID NO: 4273038 - DNA, 23 bp, Homo sapiens
ctttagaaataaaccttaatatt

SEQ ID NO: 4273039 - DNA, 14 bp, Homo sapiens
ctttaggcaggaag

SEQ ID NO: 4273040 - DNA, 21 bp, Homo sapiens
ctttatcttgggaccaaaact

SEQ ID NO: 4273041 - DNA, 23 bp, Homo sapiens
ctttatggcagacattgtgctag

SEQ ID NO: 4273042 - DNA, 15 bp, Homo sapiens
ctttattgtctgtaa

SEQ ID NO: 4273043 - DNA, 13 bp, Homo sapiens
ctttatttaaaat

SEQ ID NO: 4273044 - DNA, 16 bp, Homo sapiens
ctttcaagatctaaat

SEQ ID NO: 4273045 - DNA, 14 bp, Homo sapiens
ctttcacaaccttc

SEQ ID NO: 4273046 - DNA, 18 bp, Homo sapiens
ctttcacccctcttccca

SEQ ID NO: 4273047 - DNA, 20 bp, Homo sapiens
ctttcactataatgtgaaat

SEQ ID NO: 4273048 - DNA, 13 bp, Homo sapiens
ctttcactgaagt

SEQ ID NO: 4273049 - DNA, 19 bp, Homo sapiens
ctttcagtttgtccacaca

SEQ ID NO: 4273050 - DNA, 20 bp, Homo sapiens
ctttcagtttgtccacacaa

SEQ ID NO: 4273051 - DNA, 17 bp, Homo sapiens
ctttcatgatttgcaac

SEQ ID NO: 4273052 - DNA, 12 bp, Homo sapiens
ctttcatttctt

SEQ ID NO: 4273053 - DNA, 16 bp, Homo sapiens
ctttccaccccctccc

SEQ ID NO: 4273054 - DNA, 13 bp, Homo sapiens
ctttccagaacta

SEQ ID NO: 4273055 - DNA, 14 bp, Homo sapiens
ctttcccaaaccct

SEQ ID NO: 4273056 - DNA, 23 bp, Homo sapiens
ctttcccgatgcgtggctcccag

SEQ ID NO: 4273057 - DNA, 15 bp, Homo sapiens
ctttccctgcatccc

SEQ ID NO: 4273058 - DNA, 13 bp, Homo sapiens
ctttcctgatgtt

SEQ ID NO: 4273059 - DNA, 16 bp, Homo sapiens
ctttcctgatgttgat

SEQ ID NO: 4273060 - DNA, 23 bp, Homo sapiens
ctttcctttcatcctcagcaagt

SEQ ID NO: 4273061 - DNA, 13 bp, Homo sapiens
ctttctatgtaga

SEQ ID NO: 4273062 - DNA, 19 bp, Homo sapiens
ctttctatgtagaactgtt

SEQ ID NO: 4273063 - DNA, 14 bp, Homo sapiens
ctttctccaaagtt

SEQ ID NO: 4273064 - DNA, 19 bp, Homo sapiens
ctttctgacaataaataat

SEQ ID NO: 4273065 - DNA, 21 bp, Homo sapiens
ctttctgacaataaataatat

SEQ ID NO: 4273066 - DNA, 17 bp, Homo sapiens
ctttgacctcaacctgt

SEQ ID NO: 4273067 - DNA, 18 bp, Homo sapiens
ctttgacctcaacctgtg

SEQ ID NO: 4273068 - DNA, 20 bp, Homo sapiens
ctttgcattgtctgtctgca

SEQ ID NO: 4273069 - DNA, 12 bp, Homo sapiens
ctttgctgcctt

SEQ ID NO: 4273070 - DNA, 17 bp, Homo sapiens
ctttgctgccttctgtc

SEQ ID NO: 4273071 - DNA, 18 bp, Homo sapiens
ctttgctgccttctgtct

SEQ ID NO: 4273072 - DNA, 20 bp, Homo sapiens
ctttgctgccttctgtctct

SEQ ID NO: 4273073 - DNA, 15 bp, Homo sapiens
ctttgcttgtcctgc

SEQ ID NO: 4273074 - DNA, 15 bp, Homo sapiens
ctttggacctgcagt

SEQ ID NO: 4273075 - DNA, 19 bp, Homo sapiens
ctttggacctgcagttggc

SEQ ID NO: 4273076 - DNA, 16 bp, Homo sapiens
ctttggcttaattcca

SEQ ID NO: 4273077 - DNA, 20 bp, Homo sapiens
ctttgggctgccctggtgct

SEQ ID NO: 4273078 - DNA, 20 bp, Homo sapiens
ctttggtaatgtgtcaaaga

SEQ ID NO: 4273079 - DNA, 16 bp, Homo sapiens
ctttggtttctgtctg

SEQ ID NO: 4273080 - DNA, 16 bp, Homo sapiens
cttttaacttcacctt

SEQ ID NO: 4273081 - DNA, 16 bp, Homo sapiens
cttttaatgatactgt

SEQ ID NO: 4273082 - DNA, 18 bp, Homo sapiens
cttttattcattagctgt

SEQ ID NO: 4273083 - DNA, 16 bp, Homo sapiens
cttttcaaacacacac

SEQ ID NO: 4273084 - DNA, 18 bp, Homo sapiens
cttttcagcttgtttcta

SEQ ID NO: 4273085 - DNA, 19 bp, Homo sapiens
cttttcagcttgtttctat

SEQ ID NO: 4273086 - DNA, 16 bp, Homo sapiens
cttttcatatcatttc

SEQ ID NO: 4273087 - DNA, 16 bp, Homo sapiens
cttttccattctgggt

SEQ ID NO: 4273088 - DNA, 18 bp, Homo sapiens
cttttccattctgggtgt

SEQ ID NO: 4273089 - DNA, 16 bp, Homo sapiens
cttttctagcaactgt

SEQ ID NO: 4273090 - DNA, 11 bp, Homo sapiens
cttttctgctg

SEQ ID NO: 4273091 - DNA, 20 bp, Homo sapiens
cttttggcccccgagctggg

SEQ ID NO: 4273092 - DNA, 13 bp, Homo sapiens
cttttgtcctgca

SEQ ID NO: 4273093 - DNA, 21 bp, Homo sapiens
cttttgtcctgcatcatcttg

SEQ ID NO: 4273094 - DNA, 16 bp, Homo sapiens
cttttgtgccaggagt

SEQ ID NO: 4273095 - DNA, 21 bp, Homo sapiens
ctttttaaaaagttgcacatt

SEQ ID NO: 4273096 - DNA, 19 bp, Homo sapiens
ctttttactccccttgagc

SEQ ID NO: 4273097 - DNA, 16 bp, Homo sapiens
ctttttcttttttgag

SEQ ID NO: 4273098 - DNA, 19 bp, Homo sapiens
ctttttcttttttgagtgt

SEQ ID NO: 4273099 - DNA, 21 bp, Homo sapiens
cttttttcttccccctccatg

SEQ ID NO: 4273100 - DNA, 16 bp, Homo sapiens
cttttttgagtgtgca

SEQ ID NO: 4273101 - DNA, 15 bp, Homo sapiens
gaaaaaagagaaaaa

SEQ ID NO: 4273102 - DNA, 15 bp, Homo sapiens
gaaaaaccaatgatt

SEQ ID NO: 4273103 - DNA, 16 bp, Homo sapiens
gaaaaattgtagagtg

SEQ ID NO: 4273104 - DNA, 15 bp, Homo sapiens
gaaaaatttcacgat

SEQ ID NO: 4273105 - DNA, 23 bp, Homo sapiens
gaaaacatctcatcatgtctatt

SEQ ID NO: 4273106 - DNA, 18 bp, Homo sapiens
gaaaaccaagccgtggct

SEQ ID NO: 4273107 - DNA, 19 bp, Homo sapiens
gaaaaccaagccgtggctt

SEQ ID NO: 4273108 - DNA, 12 bp, Homo sapiens
gaaaagaagaaa

SEQ ID NO: 4273109 - DNA, 19 bp, Homo sapiens
gaaaagaagaaagtctatg

SEQ ID NO: 4273110 - DNA, 18 bp, Homo sapiens
gaaaagatgttgtgtctt

SEQ ID NO: 4273111 - DNA, 12 bp, Homo sapiens
gaaaagccagat

SEQ ID NO: 4273112 - DNA, 16 bp, Homo sapiens
gaaaagggcaggagcc

SEQ ID NO: 4273113 - DNA, 18 bp, Homo sapiens
gaaaagggcaggagccta

SEQ ID NO: 4273114 - DNA, 19 bp, Homo sapiens
gaaaagggcaggagcctag

SEQ ID NO: 4273115 - DNA, 20 bp, Homo sapiens
gaaaatagtaaatgctttgt

SEQ ID NO: 4273116 - DNA, 17 bp, Homo sapiens
gaaacaaatttttttct

SEQ ID NO: 4273117 - DNA, 18 bp, Homo sapiens
gaaacaacactcagtcct

SEQ ID NO: 4273118 - DNA, 18 bp, Homo sapiens
gaaacacagaactcagcc

SEQ ID NO: 4273119 - DNA, 21 bp, Homo sapiens
gaaacacagaactcagcctta

SEQ ID NO: 4273120 - DNA, 19 bp, Homo sapiens
gaaacacgtttagaaatga

SEQ ID NO: 4273121 - DNA, 22 bp, Homo sapiens
gaaacagcttgatgctgtttct

SEQ ID NO: 4273122 - DNA, 20 bp, Homo sapiens
gaaactatgcacctataaat

SEQ ID NO: 4273123 - DNA, 16 bp, Homo sapiens
gaaactgacttgctgt

SEQ ID NO: 4273124 - DNA, 21 bp, Homo sapiens
ctgtctgagccctgccctcac

SEQ ID NO: 4273125 - DNA, 11 bp, Homo sapiens
ctgtctgattc

SEQ ID NO: 4273126 - DNA, 17 bp, Homo sapiens
ctgtctgattctatgcc

SEQ ID NO: 4273127 - DNA, 20 bp, Homo sapiens
ctgtctgcgccgctgtgctg

SEQ ID NO: 4273128 - DNA, 12 bp, Homo sapiens
ctgtctgtggct

SEQ ID NO: 4273129 - DNA, 22 bp, Homo sapiens
ctgtctgtgtgaggctccctcc

SEQ ID NO: 4273130 - DNA, 14 bp, Homo sapiens
ctgtcttcaagggc

SEQ ID NO: 4273131 - DNA, 18 bp, Homo sapiens
ctgtgaaagtctcctgta

SEQ ID NO: 4273132 - DNA, 23 bp, Homo sapiens
ctgtgaactgccaggcagctgca

SEQ ID NO: 4273133 - DNA, 19 bp, Homo sapiens
ctgtgaacttgatgttcct

SEQ ID NO: 4273134 - DNA, 17 bp, Homo sapiens
ctgtgaataaagccaca

SEQ ID NO: 4273135 - DNA, 18 bp, Homo sapiens
ctgtgaatcaaaacaaat

SEQ ID NO: 4273136 - DNA, 16 bp, Homo sapiens
ctgtgacacagctgag

SEQ ID NO: 4273137 - DNA, 22 bp, Homo sapiens
ctgtgaccggggtcctgaggct

SEQ ID NO: 4273138 - DNA, 13 bp, Homo sapiens
ctgtgacctgtgg

SEQ ID NO: 4273139 - DNA, 15 bp, Homo sapiens
ctgtgacctgtgggg

SEQ ID NO: 4273140 - DNA, 16 bp, Homo sapiens
ctgtgacctgtgggga

SEQ ID NO: 4273141 - DNA, 20 bp, Homo sapiens
ctgtgatcgtgtgttgccat

SEQ ID NO: 4273142 - DNA, 23 bp, Homo sapiens
ctgtgatgtcagtagtgcctgtg

SEQ ID NO: 4273143 - DNA, 19 bp, Homo sapiens
ctgtgattaattattgaaa

SEQ ID NO: 4273144 - DNA, 12 bp, Homo sapiens
ctgtgcacagcc

SEQ ID NO: 4273145 - DNA, 17 bp, Homo sapiens
ctgtgcacccgtgccac

SEQ ID NO: 4273146 - DNA, 21 bp, Homo sapiens
ctgtgcagccggggagctgag

SEQ ID NO: 4273147 - DNA, 22 bp, Homo sapiens
ctgtgcagccggggagctgagg

SEQ ID NO: 4273148 - DNA, 18 bp, Homo sapiens
ctgtgccagctgcttctg

SEQ ID NO: 4273149 - DNA, 20 bp, Homo sapiens
ctgtgcgagaacacaagcca

SEQ ID NO: 4273150 - DNA, 16 bp, Homo sapiens
ctgtgcgttttagagt

SEQ ID NO: 4273151 - DNA, 15 bp, Homo sapiens
ctgtgctaagttgtc

SEQ ID NO: 4273152 - DNA, 13 bp, Homo sapiens
ctgtgctgctgca

SEQ ID NO: 4273153 - DNA, 17 bp, Homo sapiens
ctgtgctggtctctagg

SEQ ID NO: 4273154 - DNA, 16 bp, Homo sapiens
ctgtgctgttgtctgc

SEQ ID NO: 4273155 - DNA, 22 bp, Homo sapiens
ctgtggagcccgcacccccacc

SEQ ID NO: 4273156 - DNA, 23 bp, Homo sapiens
ctgtggagcccgcacccccaccc

SEQ ID NO: 4273157 - DNA, 16 bp, Homo sapiens
ctgtggattctatatt

SEQ ID NO: 4273158 - DNA, 17 bp, Homo sapiens
ctgtggattctatattt

SEQ ID NO: 4273159 - DNA, 14 bp, Homo sapiens
ctgtggcccctcct

SEQ ID NO: 4273160 - DNA, 19 bp, Homo sapiens
ctgtggcccctccttctcc

SEQ ID NO: 4273161 - DNA, 23 bp, Homo sapiens
ctgtggcccctccttctcccctc

SEQ ID NO: 4273162 - DNA, 15 bp, Homo sapiens
ctgtggccctctctt

SEQ ID NO: 4273163 - DNA, 12 bp, Homo sapiens
ctgtggcctcag

SEQ ID NO: 4273164 - DNA, 13 bp, Homo sapiens
ctgtggcctcagc

SEQ ID NO: 4273165 - DNA, 14 bp, Homo sapiens
ctgtggcctcagca

SEQ ID NO: 4273166 - DNA, 15 bp, Homo sapiens
ctgtggcctcagcat

SEQ ID NO: 4273167 - DNA, 14 bp, Homo sapiens
ctgtggcctcagga

SEQ ID NO: 4273168 - DNA, 15 bp, Homo sapiens
ctgtggcctcaggag

SEQ ID NO: 4273169 - DNA, 21 bp, Homo sapiens
ctgtgggactggcccacccct

SEQ ID NO: 4273170 - DNA, 17 bp, Homo sapiens
ctgtgggcagctggctc

SEQ ID NO: 4273171 - DNA, 20 bp, Homo sapiens
ctgtgggcagctggctctga

SEQ ID NO: 4273172 - DNA, 14 bp, Homo sapiens
ctgtggggagctgg

SEQ ID NO: 4273173 - DNA, 15 bp, Homo sapiens
ctgtggggagctggt

SEQ ID NO: 4273174 - DNA, 22 bp, Homo sapiens
ctgtggggagctggtgggggca

SEQ ID NO: 4273175 - DNA, 20 bp, Homo sapiens
ctgtggggatttctcccagc

SEQ ID NO: 4273176 - DNA, 15 bp, Homo sapiens
ctgtgggtagtatga

SEQ ID NO: 4273177 - DNA, 22 bp, Homo sapiens
ctgtggtcttcaaattgtcttt

SEQ ID NO: 4273178 - DNA, 16 bp, Homo sapiens
ctgtgtaatctctgat

SEQ ID NO: 4273179 - DNA, 21 bp, Homo sapiens
ctgtgtccccgcgggcagtga

SEQ ID NO: 4273180 - DNA, 19 bp, Homo sapiens
ctgtgtccctctctctgga

SEQ ID NO: 4273181 - DNA, 20 bp, Homo sapiens
ctgtgtccctctctctggaa

SEQ ID NO: 4273182 - DNA, 19 bp, Homo sapiens
ctgtgttagtgtctgtcca

SEQ ID NO: 4273183 - DNA, 21 bp, Homo sapiens
ctgttaaggcatccacttcac

SEQ ID NO: 4273184 - DNA, 23 bp, Homo sapiens
ctgttcatttccaccaagggtat

SEQ ID NO: 4273185 - DNA, 12 bp, Homo sapiens
ctgttccctgct

SEQ ID NO: 4273186 - DNA, 18 bp, Homo sapiens
ctgttccctgctgggtgg

SEQ ID NO: 4273187 - DNA, 22 bp, Homo sapiens
ctgttctcagagctccacagaa

SEQ ID NO: 4273188 - DNA, 14 bp, Homo sapiens
ctgttctctgcttt

SEQ ID NO: 4273189 - DNA, 13 bp, Homo sapiens
ctgttctgtgtct

SEQ ID NO: 4273190 - DNA, 13 bp, Homo sapiens
ctgttgattaatt

SEQ ID NO: 4273191 - DNA, 19 bp, Homo sapiens
ctgttgattaatttctgcc

SEQ ID NO: 4273192 - DNA, 21 bp, Homo sapiens
ctgttgattaatttctgccat

SEQ ID NO: 4273193 - DNA, 22 bp, Homo sapiens
ctgttgtctgccgtgagagccc

SEQ ID NO: 4273194 - DNA, 23 bp, Homo sapiens
ctgttgtctgccgtgagagccca

SEQ ID NO: 4273195 - DNA, 17 bp, Homo sapiens
ctgtttaccctccctgt

SEQ ID NO: 4273196 - DNA, 22 bp, Homo sapiens
ctgtttaccctccctgtcccct

SEQ ID NO: 4273197 - DNA, 16 bp, Homo sapiens
ctgtttatggtatttt

SEQ ID NO: 4273198 - DNA, 19 bp, Homo sapiens
ctgtttgctcacccaggac

SEQ ID NO: 4273199 - DNA, 21 bp, Homo sapiens
ctgtttgctcacccaggacct

SEQ ID NO: 4273200 - DNA, 15 bp, Homo sapiens
ctgttttatgtcata

SEQ ID NO: 4273201 - DNA, 19 bp, Homo sapiens
ctgttttatgtcatactct

SEQ ID NO: 4273202 - DNA, 20 bp, Homo sapiens
ctgttttattgagttctgaa

SEQ ID NO: 4273203 - DNA, 14 bp, Homo sapiens
ctgtttttgtagtg

SEQ ID NO: 4273204 - DNA, 17 bp, Homo sapiens
cttaaaaaaaaaaatga

SEQ ID NO: 4273205 - DNA, 21 bp, Homo sapiens
cttaaaaaagaaagattttat

SEQ ID NO: 4273206 - DNA, 21 bp, Homo sapiens
cttaaaagctatcttcatgta

SEQ ID NO: 4273207 - DNA, 16 bp, Homo sapiens
cttaaaataatgattt

SEQ ID NO: 4273208 - DNA, 18 bp, Homo sapiens
cttaaaattagcatctgg

SEQ ID NO: 4273209 - DNA, 14 bp, Homo sapiens
cttaaacagggcat

SEQ ID NO: 4273210 - DNA, 22 bp, Homo sapiens
cttaaacagggcatctccagga

SEQ ID NO: 4273211 - DNA, 15 bp, Homo sapiens
cttaacctgcttttg

SEQ ID NO: 4273212 - DNA, 12 bp, Homo sapiens
cttaatatttct

SEQ ID NO: 4273213 - DNA, 20 bp, Homo sapiens
cttaatgttctgaataattt

SEQ ID NO: 4273214 - DNA, 13 bp, Homo sapiens
cttacacacaaaa

SEQ ID NO: 4273215 - DNA, 18 bp, Homo sapiens
cttacatgcattactgca

SEQ ID NO: 4273216 - DNA, 20 bp, Homo sapiens
cttacattagcagtttgctt

SEQ ID NO: 4273217 - DNA, 21 bp, Homo sapiens
cttacattagcagtttgcttt

SEQ ID NO: 4273218 - DNA, 18 bp, Homo sapiens
cttaccccgtccctttcc

SEQ ID NO: 4273219 - DNA, 21 bp, Homo sapiens
cttactaaacattttgttatt

SEQ ID NO: 4273220 - DNA, 15 bp, Homo sapiens
cttactgattaactc

SEQ ID NO: 4273221 - DNA, 16 bp, Homo sapiens
cttagaaattgcattt

SEQ ID NO: 4273222 - DNA, 12 bp, Homo sapiens
cttagaatgggg

SEQ ID NO: 4273223 - DNA, 19 bp, Homo sapiens
cttagctgaacaatgaatg

SEQ ID NO: 4273224 - DNA, 13 bp, Homo sapiens
cttagcttttctg

SEQ ID NO: 4273225 - DNA, 13 bp, Homo sapiens
cttagtatctcat

SEQ ID NO: 4273226 - DNA, 22 bp, Homo sapiens
cttagtatctcatcaacaaaga

SEQ ID NO: 4273227 - DNA, 13 bp, Homo sapiens
cttagtcatacca

SEQ ID NO: 4273228 - DNA, 22 bp, Homo sapiens
cttagtttcagctgaccagaag

SEQ ID NO: 4273229 - DNA, 14 bp, Homo sapiens
cttatattgttcac

SEQ ID NO: 4273230 - DNA, 16 bp, Homo sapiens
cttatattgttcactt

SEQ ID NO: 4273231 - DNA, 14 bp, Homo sapiens
cttatgctgctgtg

SEQ ID NO: 4273232 - DNA, 16 bp, Homo sapiens
cttatgctgctgtgaa

SEQ ID NO: 4273233 - DNA, 16 bp, Homo sapiens
cttattcaaagagaaa

SEQ ID NO: 4273234 - DNA, 17 bp, Homo sapiens
cttattcaaagagaaaa

SEQ ID NO: 4273235 - DNA, 13 bp, Homo sapiens
cttatttatatat

SEQ ID NO: 4273236 - DNA, 15 bp, Homo sapiens
cttatttatatatga

SEQ ID NO: 4273237 - DNA, 14 bp, Homo sapiens
cttattttagacaa

SEQ ID NO: 4273238 - DNA, 11 bp, Homo sapiens
cttattttctg

SEQ ID NO: 4273239 - DNA, 17 bp, Homo sapiens
cttcaaccttgagacag

SEQ ID NO: 4273240 - DNA, 21 bp, Homo sapiens
cttcaagctcaccctgctcct

SEQ ID NO: 4273241 - DNA, 13 bp, Homo sapiens
cttcaccaagctt

SEQ ID NO: 4273242 - DNA, 14 bp, Homo sapiens
cttcaccaggaaga

SEQ ID NO: 4273243 - DNA, 11 bp, Homo sapiens
cttcaccttaa

SEQ ID NO: 4273244 - DNA, 15 bp, Homo sapiens
cttcacttctgacca

SEQ ID NO: 4273245 - DNA, 12 bp, Homo sapiens
cttcagactctc

SEQ ID NO: 4273246 - DNA, 10 bp, Homo sapiens
cttccagatg

SEQ ID NO: 4273247 - DNA, 16 bp, Homo sapiens
cttccaggccccaggc

SEQ ID NO: 4273248 - DNA, 24 bp, Homo sapiens
cttccaggccccaggctggatgct

SEQ ID NO: 4273249 - DNA, 15 bp, Homo sapiens
cttccatcagcagtg

SEQ ID NO: 4273250 - DNA, 17 bp, Homo sapiens
cttccatcagcagtgat

SEQ ID NO: 4273251 - DNA, 20 bp, Homo sapiens
cttccatcagcagtgattga

SEQ ID NO: 4273252 - DNA, 21 bp, Homo sapiens
cttccatggtggtttcagaaa

SEQ ID NO: 4273253 - DNA, 22 bp, Homo sapiens
cttccatggtggtttcagaaag

SEQ ID NO: 4273254 - DNA, 15 bp, Homo sapiens
cttccattcccagac

SEQ ID NO: 4273255 - DNA, 13 bp, Homo sapiens
cttcccaccaact

SEQ ID NO: 4273256 - DNA, 19 bp, Homo sapiens
cttcccacggccactgcag

SEQ ID NO: 4273257 - DNA, 21 bp, Homo sapiens
cttcccacggccactgcagtc

SEQ ID NO: 4273258 - DNA, 17 bp, Homo sapiens
cttcccaggaccctggg

SEQ ID NO: 4273259 - DNA, 18 bp, Homo sapiens
cttcccaggaccctgggt

SEQ ID NO: 4273260 - DNA, 19 bp, Homo sapiens
cttcccaggaccctgggtc

SEQ ID NO: 4273261 - DNA, 14 bp, Homo sapiens
cttcccatttgtaa

SEQ ID NO: 4273262 - DNA, 23 bp, Homo sapiens
cttccccaacgaaaagcacatcc

SEQ ID NO: 4273263 - DNA, 11 bp, Homo sapiens
cttccccactg

SEQ ID NO: 4273264 - DNA, 14 bp, Homo sapiens
cttccccactgcct

SEQ ID NO: 4273265 - DNA, 19 bp, Homo sapiens
cttccccatcgccttctgg

SEQ ID NO: 4273266 - DNA, 19 bp, Homo sapiens
cttccccattgccttctgg

SEQ ID NO: 4273267 - DNA, 20 bp, Homo sapiens
cttcccccttcccctgcgcc

SEQ ID NO: 4273268 - DNA, 19 bp, Homo sapiens
cttcccctgcgccctccct

SEQ ID NO: 4273269 - DNA, 22 bp, Homo sapiens
cttcccctgcgccctccctccc

SEQ ID NO: 4273270 - DNA, 15 bp, Homo sapiens
cttcccgctcagccc

SEQ ID NO: 4273271 - DNA, 18 bp, Homo sapiens
cttcccgctcagccctcc

SEQ ID NO: 4273272 - DNA, 23 bp, Homo sapiens
cttcccgctcagccctccctgcc

SEQ ID NO: 4273273 - DNA, 13 bp, Homo sapiens
cttccctccacct

SEQ ID NO: 4273274 - DNA, 19 bp, Homo sapiens
cttccctccacctgcttgt

SEQ ID NO: 4273275 - DNA, 15 bp, Homo sapiens
cttccctctgcctgt

SEQ ID NO: 4273276 - DNA, 19 bp, Homo sapiens
cttccctctgcctgtccct

SEQ ID NO: 4273277 - DNA, 15 bp, Homo sapiens
cttccctctgctcca

SEQ ID NO: 4273278 - DNA, 15 bp, Homo sapiens
cttccgctctgaggc

SEQ ID NO: 4273279 - DNA, 20 bp, Homo sapiens
cttccggctgagctgtgcca

SEQ ID NO: 4273280 - DNA, 17 bp, Homo sapiens
cttcctccctccctgca

SEQ ID NO: 4273281 - DNA, 19 bp, Homo sapiens
cttcctccctccctgcagg

SEQ ID NO: 4273282 - DNA, 20 bp, Homo sapiens
cttcctccctccctgcaggg

SEQ ID NO: 4273283 - DNA, 15 bp, Homo sapiens
cttcctctccactgc

SEQ ID NO: 4273284 - DNA, 16 bp, Homo sapiens
cttcctctccactgcc

SEQ ID NO: 4273285 - DNA, 19 bp, Homo sapiens
cttcctctccactgccttc

SEQ ID NO: 4273286 - DNA, 12 bp, Homo sapiens
cttcctgcccta

SEQ ID NO: 4273287 - DNA, 19 bp, Homo sapiens
cttcctgctacagtagctg

SEQ ID NO: 4273288 - DNA, 22 bp, Homo sapiens
cttcctggattttctttctatg

SEQ ID NO: 4273289 - DNA, 20 bp, Homo sapiens
cttcctgggcagcccagaga

SEQ ID NO: 4273290 - DNA, 19 bp, Homo sapiens
cttcctgggttggccagag

SEQ ID NO: 4273291 - DNA, 13 bp, Homo sapiens
cttccttcatttc

SEQ ID NO: 4273292 - DNA, 16 bp, Homo sapiens
cttccttcatttcctc

SEQ ID NO: 4273293 - DNA, 19 bp, Homo sapiens
cttccttttgtatcctcca

SEQ ID NO: 4273294 - DNA, 13 bp, Homo sapiens
cttcgactgtgac

SEQ ID NO: 4273295 - DNA, 16 bp, Homo sapiens
cttcgctattcccagg

SEQ ID NO: 4273296 - DNA, 13 bp, Homo sapiens
cttcgtggagctc

SEQ ID NO: 4273297 - DNA, 18 bp, Homo sapiens
cttcgtggagctctaact

SEQ ID NO: 4273298 - DNA, 20 bp, Homo sapiens
cttctaatccatgtgctgct

SEQ ID NO: 4273299 - DNA, 15 bp, Homo sapiens
cttctacctgcagga

SEQ ID NO: 4273300 - DNA, 21 bp, Homo sapiens
cttctcaaatgctactcagta

SEQ ID NO: 4273301 - DNA, 20 bp, Homo sapiens
cttctccagccaccaaggct

SEQ ID NO: 4273302 - DNA, 21 bp, Homo sapiens
cttctccagccaccaaggctg

SEQ ID NO: 4273303 - DNA, 13 bp, Homo sapiens
cttctccccaatc

SEQ ID NO: 4273304 - DNA, 22 bp, Homo sapiens
cttctcccctccagacccctac

SEQ ID NO: 4273305 - DNA, 21 bp, Homo sapiens
cttctccctggactctgtggg

SEQ ID NO: 4273306 - DNA, 14 bp, Homo sapiens
cttctcctttcaca

SEQ ID NO: 4273307 - DNA, 17 bp, Homo sapiens
cttctcctttcacaacc

SEQ ID NO: 4273308 - DNA, 20 bp, Homo sapiens
cttctcctttcacaaccttc

SEQ ID NO: 4273309 - DNA, 15 bp, Homo sapiens
cttctctcagcctcc

SEQ ID NO: 4273310 - DNA, 21 bp, Homo sapiens
cttctcttacgctctctgtct

SEQ ID NO: 4273311 - DNA, 17 bp, Homo sapiens
cttctgaccacacttcc

SEQ ID NO: 4273312 - DNA, 18 bp, Homo sapiens
cttctgaccacacttcct

SEQ ID NO: 4273313 - DNA, 16 bp, Homo sapiens
cttctgcccaccccgc

SEQ ID NO: 4273314 - DNA, 16 bp, Homo sapiens
cttctggccgctgcag

SEQ ID NO: 4273315 - DNA, 18 bp, Homo sapiens
cttctggctgctgcagtc

SEQ ID NO: 4273316 - DNA, 15 bp, Homo sapiens
cttctggggagggac

SEQ ID NO: 4273317 - DNA, 21 bp, Homo sapiens
cttctggggagggacacagag

SEQ ID NO: 4273318 - DNA, 22 bp, Homo sapiens
cttctggggagggacacagagg

SEQ ID NO: 4273319 - DNA, 12 bp, Homo sapiens
cttctgtctctt

SEQ ID NO: 4273320 - DNA, 15 bp, Homo sapiens
cttctgtctcttgca

SEQ ID NO: 4273321 - DNA, 16 bp, Homo sapiens
cttctgtctcttgcat

SEQ ID NO: 4273322 - DNA, 13 bp, Homo sapiens
cttctgtctgtaa

SEQ ID NO: 4273323 - DNA, 22 bp, Homo sapiens
cttctgtggctcacagaaccct

SEQ ID NO: 4273324 - DNA, 12 bp, Homo sapiens
cttcttctgtaa

SEQ ID NO: 4273325 - DNA, 17 bp, Homo sapiens
cttcttctgtaatattt

SEQ ID NO: 4273326 - DNA, 18 bp, Homo sapiens
cttcttctgtaatattta

SEQ ID NO: 4273327 - DNA, 22 bp, Homo sapiens
cttcttctgtaatatttacaat

SEQ ID NO: 4273328 - DNA, 17 bp, Homo sapiens
cttctttactaacactg

SEQ ID NO: 4273329 - DNA, 24 bp, Homo sapiens
cttgaaattatatctgtggtcttc

SEQ ID NO: 4273330 - DNA, 16 bp, Homo sapiens
cttgaacattaatcca

SEQ ID NO: 4273331 - DNA, 17 bp, Homo sapiens
cttgaagattcaggctt

SEQ ID NO: 4273332 - DNA, 18 bp, Homo sapiens
cttgaagattcaggcttg

SEQ ID NO: 4273333 - DNA, 15 bp, Homo sapiens
cttgaatagtattgt

SEQ ID NO: 4273334 - DNA, 18 bp, Homo sapiens
cttgaatagtattgtgtt

SEQ ID NO: 4273335 - DNA, 23 bp, Homo sapiens
cttgaatggaaggtccgagtctt

SEQ ID NO: 4273336 - DNA, 18 bp, Homo sapiens
cttgagagcgctggcctc

SEQ ID NO: 4273337 - DNA, 22 bp, Homo sapiens
cttgagatgtattatgcaaagt

SEQ ID NO: 4273338 - DNA, 18 bp, Homo sapiens
cttgagcaaggcaagaag

SEQ ID NO: 4273339 - DNA, 21 bp, Homo sapiens
cttgagcaaggcaagaagtgg

SEQ ID NO: 4273340 - DNA, 22 bp, Homo sapiens
cttgagcaaggcaagaagtggg

SEQ ID NO: 4273341 - DNA, 15 bp, Homo sapiens
cttgagcccactcct

SEQ ID NO: 4273342 - DNA, 16 bp, Homo sapiens
cttgagtgggccccct

SEQ ID NO: 4273343 - DNA, 23 bp, Homo sapiens
cttgatgttgcttagtcacttat

SEQ ID NO: 4273344 - DNA, 21 bp, Homo sapiens
cttgattttagccttctctgt

SEQ ID NO: 4273345 - DNA, 14 bp, Homo sapiens
cttgcaacacacag

SEQ ID NO: 4273346 - DNA, 17 bp, Homo sapiens
cttgcataagcctcagg

SEQ ID NO: 4273347 - DNA, 18 bp, Homo sapiens
cttgcataagcctcaggc

SEQ ID NO: 4273348 - DNA, 17 bp, Homo sapiens
cttgcattaaaagactg

SEQ ID NO: 4273349 - DNA, 13 bp, Homo sapiens
cttgccccccacc

SEQ ID NO: 4273350 - DNA, 15 bp, Homo sapiens
cttgccccccacccc

SEQ ID NO: 4273351 - DNA, 17 bp, Homo sapiens
cttgccgctgggagagc

SEQ ID NO: 4273352 - DNA, 18 bp, Homo sapiens
cttgccgctgggagagcc

SEQ ID NO: 4273353 - DNA, 18 bp, Homo sapiens
cttgcctagggcctggtc

SEQ ID NO: 4273354 - DNA, 20 bp, Homo sapiens
cttgcctagggcctggtcca

SEQ ID NO: 4273355 - DNA, 20 bp, Homo sapiens
cttgctcaataaaggtcata

SEQ ID NO: 4273356 - DNA, 16 bp, Homo sapiens
cttgctgcactcttgc

SEQ ID NO: 4273357 - DNA, 12 bp, Homo sapiens
cttgctgctggc

SEQ ID NO: 4273358 - DNA, 23 bp, Homo sapiens
cttgctttcacaaatatagttga

SEQ ID NO: 4273359 - DNA, 14 bp, Homo sapiens
cttggacggggaca

SEQ ID NO: 4273360 - DNA, 23 bp, Homo sapiens
cttggacggggacacggcctctg

SEQ ID NO: 4273361 - DNA, 12 bp, Homo sapiens
cttggagaggag

SEQ ID NO: 4273362 - DNA, 20 bp, Homo sapiens
ctggcttctccctggactct

SEQ ID NO: 4273363 - DNA, 21 bp, Homo sapiens
ctggcttctccctggactctg

SEQ ID NO: 4273364 - DNA, 16 bp, Homo sapiens
ctggcttttcactgct

SEQ ID NO: 4273365 - DNA, 16 bp, Homo sapiens
ctgggaaaagggcagg

SEQ ID NO: 4273366 - DNA, 18 bp, Homo sapiens
ctgggagaaaagccagat

SEQ ID NO: 4273367 - DNA, 19 bp, Homo sapiens
ctgggagaaaagccagatg

SEQ ID NO: 4273368 - DNA, 13 bp, Homo sapiens
ctgggagagtgag

SEQ ID NO: 4273369 - DNA, 21 bp, Homo sapiens
ctgggagatgctgggaccctc

SEQ ID NO: 4273370 - DNA, 15 bp, Homo sapiens
ctgggagcctcgccc

SEQ ID NO: 4273371 - DNA, 13 bp, Homo sapiens
ctgggaggcaggt

SEQ ID NO: 4273372 - DNA, 19 bp, Homo sapiens
ctgggcacctggggagtgg

SEQ ID NO: 4273373 - DNA, 15 bp, Homo sapiens
ctgggcagaggggag

SEQ ID NO: 4273374 - DNA, 23 bp, Homo sapiens
ctgggcagaggggagaggaagca

SEQ ID NO: 4273375 - DNA, 13 bp, Homo sapiens
ctgggcagcccag

SEQ ID NO: 4273376 - DNA, 15 bp, Homo sapiens
ctgggcatccccagc

SEQ ID NO: 4273377 - DNA, 21 bp, Homo sapiens
ctgggcatccccagccccctg

SEQ ID NO: 4273378 - DNA, 16 bp, Homo sapiens
ctgggcatctggccct

SEQ ID NO: 4273379 - DNA, 23 bp, Homo sapiens
ctgggccactggcatctctggag

SEQ ID NO: 4273380 - DNA, 14 bp, Homo sapiens
ctgggcccagaagg

SEQ ID NO: 4273381 - DNA, 23 bp, Homo sapiens
ctgggcccagaaggttgtgatga

SEQ ID NO: 4273382 - DNA, 20 bp, Homo sapiens
ctgggcccgagggtcccaag

SEQ ID NO: 4273383 - DNA, 21 bp, Homo sapiens
ctgggctcacaccagccctgg

SEQ ID NO: 4273384 - DNA, 14 bp, Homo sapiens
ctgggctggcatgg

SEQ ID NO: 4273385 - DNA, 18 bp, Homo sapiens
ctgggctggcatggggag

SEQ ID NO: 4273386 - DNA, 14 bp, Homo sapiens
ctggggacggagca

SEQ ID NO: 4273387 - DNA, 15 bp, Homo sapiens
ctggggacggagcac

SEQ ID NO: 4273388 - DNA, 17 bp, Homo sapiens
ctggggacggagcactg

SEQ ID NO: 4273389 - DNA, 15 bp, Homo sapiens
ctggggagggacaca

SEQ ID NO: 4273390 - DNA, 19 bp, Homo sapiens
ctggggagggacacagagg

SEQ ID NO: 4273391 - DNA, 16 bp, Homo sapiens
ctggggaggggctccg

SEQ ID NO: 4273392 - DNA, 16 bp, Homo sapiens
ctggggcggtcaataa

SEQ ID NO: 4273393 - DNA, 16 bp, Homo sapiens
ctggggctgagagtgg

SEQ ID NO: 4273394 - DNA, 19 bp, Homo sapiens
ctggggctgagagtggggc

SEQ ID NO: 4273395 - DNA, 22 bp, Homo sapiens
ctggggcttttgtgccaggagt

SEQ ID NO: 4273396 - DNA, 22 bp, Homo sapiens
ctgggggccatgagctccagac

SEQ ID NO: 4273397 - DNA, 19 bp, Homo sapiens
ctggggggggcaagagctc

SEQ ID NO: 4273398 - DNA, 18 bp, Homo sapiens
ctggggtggaggctaagc

SEQ ID NO: 4273399 - DNA, 13 bp, Homo sapiens
ctggggtggggct

SEQ ID NO: 4273400 - DNA, 15 bp, Homo sapiens
ctggggtggggcttg

SEQ ID NO: 4273401 - DNA, 18 bp, Homo sapiens
ctggggtggggcttggaa

SEQ ID NO: 4273402 - DNA, 23 bp, Homo sapiens
ctggggtgggtgtgagcagggtg

SEQ ID NO: 4273403 - DNA, 21 bp, Homo sapiens
ctggggtggttggaggcctgg

SEQ ID NO: 4273404 - DNA, 17 bp, Homo sapiens
ctgggtcaccttcctgg

SEQ ID NO: 4273405 - DNA, 18 bp, Homo sapiens
ctgggtcaccttcctggg

SEQ ID NO: 4273406 - DNA, 16 bp, Homo sapiens
ctgggtcagcttgaat

SEQ ID NO: 4273407 - DNA, 18 bp, Homo sapiens
ctgggtggccggccctgc

SEQ ID NO: 4273408 - DNA, 13 bp, Homo sapiens
ctgggtgtgctcc

SEQ ID NO: 4273409 - DNA, 16 bp, Homo sapiens
ctgggtgtgctccagg

SEQ ID NO: 4273410 - DNA, 18 bp, Homo sapiens
ctgggtgtgctccaggct

SEQ ID NO: 4273411 - DNA, 17 bp, Homo sapiens
ctgggtttgggcagtgg

SEQ ID NO: 4273412 - DNA, 19 bp, Homo sapiens
ctgggtttgggcagtggag

SEQ ID NO: 4273413 - DNA, 17 bp, Homo sapiens
ctggtaagattgttatt

SEQ ID NO: 4273414 - DNA, 20 bp, Homo sapiens
ctggtaagattgttattaaa

SEQ ID NO: 4273415 - DNA, 22 bp, Homo sapiens
ctggtaagattgttattaaatg

SEQ ID NO: 4273416 - DNA, 23 bp, Homo sapiens
ctggtaagattgttattaaatgt

SEQ ID NO: 4273417 - DNA, 13 bp, Homo sapiens
ctggtattaaatg

SEQ ID NO: 4273418 - DNA, 19 bp, Homo sapiens
ctggtattaaatgccaagg

SEQ ID NO: 4273419 - DNA, 14 bp, Homo sapiens
ctggtcatcctggg

SEQ ID NO: 4273420 - DNA, 17 bp, Homo sapiens
ctggtccaggcatgggt

SEQ ID NO: 4273421 - DNA, 16 bp, Homo sapiens
ctggtccatgatggag

SEQ ID NO: 4273422 - DNA, 17 bp, Homo sapiens
ctggtccttctgacccc

SEQ ID NO: 4273423 - DNA, 19 bp, Homo sapiens
ctggtccttctgaccccac

SEQ ID NO: 4273424 - DNA, 16 bp, Homo sapiens
ctggtctctaggcctg

SEQ ID NO: 4273425 - DNA, 14 bp, Homo sapiens
ctggtctctccttg

SEQ ID NO: 4273426 - DNA, 12 bp, Homo sapiens
ctggtctggagc

SEQ ID NO: 4273427 - DNA, 20 bp, Homo sapiens
ctggtctggagcccctatcc

SEQ ID NO: 4273428 - DNA, 12 bp, Homo sapiens
ctggtctggctt

SEQ ID NO: 4273429 - DNA, 23 bp, Homo sapiens
ctggtgaaagagtaaaaccaaag

SEQ ID NO: 4273430 - DNA, 22 bp, Homo sapiens
ctggtgcatttaaaatggactt

SEQ ID NO: 4273431 - DNA, 14 bp, Homo sapiens
ctggtgccctggcc

SEQ ID NO: 4273432 - DNA, 17 bp, Homo sapiens
ctggtgccctggcccag

SEQ ID NO: 4273433 - DNA, 15 bp, Homo sapiens
ctggtgcgttcctaa

SEQ ID NO: 4273434 - DNA, 22 bp, Homo sapiens
ctggtgctgccacacttcaggc

SEQ ID NO: 4273435 - DNA, 18 bp, Homo sapiens
ctggtggccaagcctgcc

SEQ ID NO: 4273436 - DNA, 22 bp, Homo sapiens
ctggtggcccgacagcctggca

SEQ ID NO: 4273437 - DNA, 13 bp, Homo sapiens
ctggtgtctagtt

SEQ ID NO: 4273438 - DNA, 15 bp, Homo sapiens
ctggttcccccagga

SEQ ID NO: 4273439 - DNA, 17 bp, Homo sapiens
ctggttcccccaggacc

SEQ ID NO: 4273440 - DNA, 19 bp, Homo sapiens
ctggttcccccaggaccct

SEQ ID NO: 4273441 - DNA, 18 bp, Homo sapiens
ctggttctccatccccat

SEQ ID NO: 4273442 - DNA, 20 bp, Homo sapiens
ctggttctccatccccatgt

SEQ ID NO: 4273443 - DNA, 19 bp, Homo sapiens
ctggttggtgttcttccca

SEQ ID NO: 4273444 - DNA, 17 bp, Homo sapiens
ctggtttggggcgaggc

SEQ ID NO: 4273445 - DNA, 21 bp, Homo sapiens
ctggtttggtggccaggctgg

SEQ ID NO: 4273446 - DNA, 18 bp, Homo sapiens
ctggtttttctgttccct

SEQ ID NO: 4273447 - DNA, 15 bp, Homo sapiens
ctgtaaatatgtcac

SEQ ID NO: 4273448 - DNA, 13 bp, Homo sapiens
ctgtaatatttac

SEQ ID NO: 4273449 - DNA, 21 bp, Homo sapiens
ctgtaatatttacaatgtatt

SEQ ID NO: 4273450 - DNA, 16 bp, Homo sapiens
ctgtacaaagggaagc

SEQ ID NO: 4273451 - DNA, 15 bp, Homo sapiens
ctgtacctttctgac

SEQ ID NO: 4273452 - DNA, 18 bp, Homo sapiens
ctgtacgtctggtgttct

SEQ ID NO: 4273453 - DNA, 21 bp, Homo sapiens
ctgtagaaaggttgattctca

SEQ ID NO: 4273454 - DNA, 15 bp, Homo sapiens
ctgtagacatctgtc

SEQ ID NO: 4273455 - DNA, 14 bp, Homo sapiens
ctgtagtaattgtt

SEQ ID NO: 4273456 - DNA, 15 bp, Homo sapiens
ctgtatatttgtatg

SEQ ID NO: 4273457 - DNA, 16 bp, Homo sapiens
ctgtatatttgtatga

SEQ ID NO: 4273458 - DNA, 19 bp, Homo sapiens
ctgtatatttgtatgatat

SEQ ID NO: 4273459 - DNA, 20 bp, Homo sapiens
ctgtatctaaaaaataactg

SEQ ID NO: 4273460 - DNA, 15 bp, Homo sapiens
ctgtatgtcattaaa

SEQ ID NO: 4273461 - DNA, 12 bp, Homo sapiens
ctgtatttccaa

SEQ ID NO: 4273462 - DNA, 15 bp, Homo sapiens
ctgtattttctttta

SEQ ID NO: 4273463 - DNA, 22 bp, Homo sapiens
ctgtattttcttttatatctgt

SEQ ID NO: 4273464 - DNA, 17 bp, Homo sapiens
ctgtcactaaatggcag

SEQ ID NO: 4273465 - DNA, 20 bp, Homo sapiens
ctgtcagagaatatgaccta

SEQ ID NO: 4273466 - DNA, 15 bp, Homo sapiens
ctgtccaatctgcaa

SEQ ID NO: 4273467 - DNA, 19 bp, Homo sapiens
ctgtccacctgtgctgctg

SEQ ID NO: 4273468 - DNA, 18 bp, Homo sapiens
ctgtccagagagagaagt

SEQ ID NO: 4273469 - DNA, 18 bp, Homo sapiens
ctgtccatctgtctgtcc

SEQ ID NO: 4273470 - DNA, 21 bp, Homo sapiens
ctgtcccggagctcaggccct

SEQ ID NO: 4273471 - DNA, 11 bp, Homo sapiens
ctgtccctgtc

SEQ ID NO: 4273472 - DNA, 16 bp, Homo sapiens
ctgtccctgtccctgc

SEQ ID NO: 4273473 - DNA, 15 bp, Homo sapiens
ctgtcctacccgccc

SEQ ID NO: 4273474 - DNA, 17 bp, Homo sapiens
ctgtccttagactcctt

SEQ ID NO: 4273475 - DNA, 20 bp, Homo sapiens
ctgtccttcccacggccact

SEQ ID NO: 4273476 - DNA, 23 bp, Homo sapiens
ctgtccttcccacggccactgca

SEQ ID NO: 4273477 - DNA, 14 bp, Homo sapiens
ctgtctaagaataa

SEQ ID NO: 4273478 - DNA, 20 bp, Homo sapiens
ctgtctaagaataatgacgt

SEQ ID NO: 4273479 - DNA, 19 bp, Homo sapiens
ctgtctcaagagggcactg

SEQ ID NO: 4273480 - DNA, 21 bp, Homo sapiens
ctgtctcaagagggcactggt

SEQ ID NO: 4273481 - DNA, 22 bp, Homo sapiens
ctgtctcaagagggcactggtg

SEQ ID NO: 4273482 - DNA, 17 bp, Homo sapiens
ctgtctctcatgaacct

SEQ ID NO: 4273483 - DNA, 19 bp, Homo sapiens
ctgtctgaaaccagaagac

SEQ ID NO: 4273484 - DNA, 22 bp, Homo sapiens
ctgtctgaaaccagaagactgg

SEQ ID NO: 4273485 - DNA, 17 bp, Homo sapiens
ctgtctgagccctgccc

SEQ ID NO: 4273486 - DNA, 18 bp, Homo sapiens
ctgtctgagccctgccct

SEQ ID NO: 4273487 - DNA, 19 bp, Homo sapiens
ctgtctgagccctgccctc

SEQ ID NO: 4273488 - DNA, 18 bp, Homo sapiens
ctagagaaattcttgtta

SEQ ID NO: 4273489 - DNA, 19 bp, Homo sapiens
ctagagatattttgtaaaa

SEQ ID NO: 4273490 - DNA, 21 bp, Homo sapiens
ctagatctcctgtaattttgt

SEQ ID NO: 4273491 - DNA, 17 bp, Homo sapiens
ctagcaagaagattcta

SEQ ID NO: 4273492 - DNA, 22 bp, Homo sapiens
ctagcaagaagattctaaaaca

SEQ ID NO: 4273493 - DNA, 20 bp, Homo sapiens
ctagcacaaggagtgcccgc

SEQ ID NO: 4273494 - DNA, 18 bp, Homo sapiens
ctagcagtttgcctctgc

SEQ ID NO: 4273495 - DNA, 20 bp, Homo sapiens
ctagcagtttgcctctgcac

SEQ ID NO: 4273496 - DNA, 21 bp, Homo sapiens
ctagcagtttgcctctgcacg

SEQ ID NO: 4273497 - DNA, 23 bp, Homo sapiens
ctagccaggcctcccgcatgctg

SEQ ID NO: 4273498 - DNA, 17 bp, Homo sapiens
ctagccatatattttct

SEQ ID NO: 4273499 - DNA, 21 bp, Homo sapiens
ctagctatgctgtatctgtgc

SEQ ID NO: 4273500 - DNA, 13 bp, Homo sapiens
ctaggagcactgt

SEQ ID NO: 4273501 - DNA, 11 bp, Homo sapiens
ctaggagctgg

SEQ ID NO: 4273502 - DNA, 19 bp, Homo sapiens
ctaggagctggggagggag

SEQ ID NO: 4273503 - DNA, 13 bp, Homo sapiens
ctaggccagctcc

SEQ ID NO: 4273504 - DNA, 14 bp, Homo sapiens
ctaggccagctcct

SEQ ID NO: 4273505 - DNA, 16 bp, Homo sapiens
ctaggccagctcctta

SEQ ID NO: 4273506 - DNA, 18 bp, Homo sapiens
ctagggtcctcaggcagt

SEQ ID NO: 4273507 - DNA, 14 bp, Homo sapiens
ctaggtctccaccc

SEQ ID NO: 4273508 - DNA, 16 bp, Homo sapiens
ctaggtctccacccct

SEQ ID NO: 4273509 - DNA, 19 bp, Homo sapiens
ctaggtgctggcatgtctg

SEQ ID NO: 4273510 - DNA, 13 bp, Homo sapiens
ctaggtgggccag

SEQ ID NO: 4273511 - DNA, 15 bp, Homo sapiens
ctaggtgggccagcc

SEQ ID NO: 4273512 - DNA, 21 bp, Homo sapiens
ctaggtgggccagcccctccc

SEQ ID NO: 4273513 - DNA, 23 bp, Homo sapiens
ctagtattccagacctgaagaat

SEQ ID NO: 4273514 - DNA, 18 bp, Homo sapiens
ctagtcacatatcaagtc

SEQ ID NO: 4273515 - DNA, 18 bp, Homo sapiens
ctagtcctattctattgc

SEQ ID NO: 4273516 - DNA, 17 bp, Homo sapiens
ctagtctctgatttgca

SEQ ID NO: 4273517 - DNA, 21 bp, Homo sapiens
ctagtgatacactgtatctaa

SEQ ID NO: 4273518 - DNA, 19 bp, Homo sapiens
ctagtggcttcagcccctg

SEQ ID NO: 4273519 - DNA, 20 bp, Homo sapiens
ctagtttgcatacttcctgg

SEQ ID NO: 4273520 - DNA, 18 bp, Homo sapiens
ctatatatacatgtatag

SEQ ID NO: 4273521 - DNA, 19 bp, Homo sapiens
ctatatatacatgtatagt

SEQ ID NO: 4273522 - DNA, 20 bp, Homo sapiens
ctatattgctgaatgcaaga

SEQ ID NO: 4273523 - DNA, 17 bp, Homo sapiens
ctatcacctcccctcct

SEQ ID NO: 4273524 - DNA, 19 bp, Homo sapiens
ctatcacctcccctccttg

SEQ ID NO: 4273525 - DNA, 18 bp, Homo sapiens
ctatcagagaagcagcat

SEQ ID NO: 4273526 - DNA, 20 bp, Homo sapiens
ctatcagagaagcagcatca

SEQ ID NO: 4273527 - DNA, 13 bp, Homo sapiens
ctatccagccgca

SEQ ID NO: 4273528 - DNA, 14 bp, Homo sapiens
ctatcctgcaccct

SEQ ID NO: 4273529 - DNA, 18 bp, Homo sapiens
ctatcctgcaccctctgc

SEQ ID NO: 4273530 - DNA, 17 bp, Homo sapiens
ctatctggtattaaatg

SEQ ID NO: 4273531 - DNA, 21 bp, Homo sapiens
ctatctggtattaaatgccaa

SEQ ID NO: 4273532 - DNA, 14 bp, Homo sapiens
ctatcttcatgtaa

SEQ ID NO: 4273533 - DNA, 20 bp, Homo sapiens
ctatcttcatgtaaattgac

SEQ ID NO: 4273534 - DNA, 17 bp, Homo sapiens
ctatgcacctataaata

SEQ ID NO: 4273535 - DNA, 18 bp, Homo sapiens
ctatgcacctataaatac

SEQ ID NO: 4273536 - DNA, 13 bp, Homo sapiens
ctatgccacctgc

SEQ ID NO: 4273537 - DNA, 17 bp, Homo sapiens
ctatgccactaggccct

SEQ ID NO: 4273538 - DNA, 20 bp, Homo sapiens
ctatgccactaggccctggt

SEQ ID NO: 4273539 - DNA, 21 bp, Homo sapiens
ctatgccactaggccctggtc

SEQ ID NO: 4273540 - DNA, 23 bp, Homo sapiens
ctatgccactaggccctggtctg

SEQ ID NO: 4273541 - DNA, 14 bp, Homo sapiens
ctatgcctgtattt

SEQ ID NO: 4273542 - DNA, 18 bp, Homo sapiens
ctatgcctgtatttccaa

SEQ ID NO: 4273543 - DNA, 16 bp, Homo sapiens
ctatgcgtaaatcaac

SEQ ID NO: 4273544 - DNA, 15 bp, Homo sapiens
ctatgctgtatctgt

SEQ ID NO: 4273545 - DNA, 14 bp, Homo sapiens
ctatgtagaactgt

SEQ ID NO: 4273546 - DNA, 16 bp, Homo sapiens
ctatgtcatttcattt

SEQ ID NO: 4273547 - DNA, 22 bp, Homo sapiens
ctatgtccatgaaaaacagcag

SEQ ID NO: 4273548 - DNA, 17 bp, Homo sapiens
ctatgtgtcatgatttc

SEQ ID NO: 4273549 - DNA, 14 bp, Homo sapiens
ctatgtgtgtgctt

SEQ ID NO: 4273550 - DNA, 21 bp, Homo sapiens
ctattaacaattaattgtctt

SEQ ID NO: 4273551 - DNA, 13 bp, Homo sapiens
ctattaagaaact

SEQ ID NO: 4273552 - DNA, 11 bp, Homo sapiens
ctattaatatt

SEQ ID NO: 4273553 - DNA, 13 bp, Homo sapiens
ctattaatatttg

SEQ ID NO: 4273554 - DNA, 17 bp, Homo sapiens
ctattatccccatttct

SEQ ID NO: 4273555 - DNA, 18 bp, Homo sapiens
ctattcccaggcagggag

SEQ ID NO: 4273556 - DNA, 20 bp, Homo sapiens
ctattgtaatatagaaaaaa

SEQ ID NO: 4273557 - DNA, 13 bp, Homo sapiens
ctatttaaaaaat

SEQ ID NO: 4273558 - DNA, 18 bp, Homo sapiens
ctatttagcatgacaagc

SEQ ID NO: 4273559 - DNA, 18 bp, Homo sapiens
ctatttcaacttcaggaa

SEQ ID NO: 4273560 - DNA, 12 bp, Homo sapiens
ctatttctatct

SEQ ID NO: 4273561 - DNA, 14 bp, Homo sapiens
ctatttctatctgc

SEQ ID NO: 4273562 - DNA, 17 bp, Homo sapiens
ctatttttttgttgctg

SEQ ID NO: 4273563 - DNA, 19 bp, Homo sapiens
ctcaaccctccctcagccc

SEQ ID NO: 4273564 - DNA, 22 bp, Homo sapiens
ctcaaccctccctcagcccctc

SEQ ID NO: 4273565 - DNA, 20 bp, Homo sapiens
ctcaacctacagtggaggga

SEQ ID NO: 4273566 - DNA, 13 bp, Homo sapiens
ctcaacctgtgat

SEQ ID NO: 4273567 - DNA, 19 bp, Homo sapiens
ctcaagagggcactggtgg

SEQ ID NO: 4273568 - DNA, 21 bp, Homo sapiens
ctcaagagggcactggtggcc

SEQ ID NO: 4273569 - DNA, 15 bp, Homo sapiens
ctcaagccaggagac

SEQ ID NO: 4273570 - DNA, 19 bp, Homo sapiens
ctcaagccaggagaccctg

SEQ ID NO: 4273571 - DNA, 17 bp, Homo sapiens
ctcaagctgcatctaga

SEQ ID NO: 4273572 - DNA, 19 bp, Homo sapiens
ctcaagtcggtgggcctgc

SEQ ID NO: 4273573 - DNA, 13 bp, Homo sapiens
ctcacaactgttt

SEQ ID NO: 4273574 - DNA, 20 bp, Homo sapiens
ctcacaactgtttttgaaga

SEQ ID NO: 4273575 - DNA, 16 bp, Homo sapiens
ctcacaccagccctgg

SEQ ID NO: 4273576 - DNA, 17 bp, Homo sapiens
ctcacaccagccctggt

SEQ ID NO: 4273577 - DNA, 16 bp, Homo sapiens
ctcacagccaccacct

SEQ ID NO: 4273578 - DNA, 13 bp, Homo sapiens
ctcacatcatgta

SEQ ID NO: 4273579 - DNA, 21 bp, Homo sapiens
ctcaccaaaatatagttaatt

SEQ ID NO: 4273580 - DNA, 14 bp, Homo sapiens
ctcacccagcctgg

SEQ ID NO: 4273581 - DNA, 17 bp, Homo sapiens
ctcacccaggacctctg

SEQ ID NO: 4273582 - DNA, 18 bp, Homo sapiens
ctcacccaggacctctgg

SEQ ID NO: 4273583 - DNA, 16 bp, Homo sapiens
ctcaccctgctcctac

SEQ ID NO: 4273584 - DNA, 17 bp, Homo sapiens
ctcacctgaattcgaga

SEQ ID NO: 4273585 - DNA, 16 bp, Homo sapiens
ctcacctgctggcccc

SEQ ID NO: 4273586 - DNA, 19 bp, Homo sapiens
ctcacctgctggcccctca

SEQ ID NO: 4273587 - DNA, 18 bp, Homo sapiens
ctcacctggcttcccagg

SEQ ID NO: 4273588 - DNA, 20 bp, Homo sapiens
ctcacctggcttcccaggac

SEQ ID NO: 4273589 - DNA, 21 bp, Homo sapiens
ctcacctggcttcccaggacc

SEQ ID NO: 4273590 - DNA, 20 bp, Homo sapiens
ctcacctgggcacctgggga

SEQ ID NO: 4273591 - DNA, 22 bp, Homo sapiens
ctcaccttgcaacacacagaca

SEQ ID NO: 4273592 - DNA, 21 bp, Homo sapiens
ctcacggctgcacctgcaggg

SEQ ID NO: 4273593 - DNA, 15 bp, Homo sapiens
ctcactagaatattc

SEQ ID NO: 4273594 - DNA, 14 bp, Homo sapiens
ctcactccactccc

SEQ ID NO: 4273595 - DNA, 15 bp, Homo sapiens
ctcactccactcccc

SEQ ID NO: 4273596 - DNA, 17 bp, Homo sapiens
ctcactccactcccctc

SEQ ID NO: 4273597 - DNA, 19 bp, Homo sapiens
ctcactcctacctggtaat

SEQ ID NO: 4273598 - DNA, 19 bp, Homo sapiens
ctcactctggcagcctcag

SEQ ID NO: 4273599 - DNA, 12 bp, Homo sapiens
ctcactgccctc

SEQ ID NO: 4273600 - DNA, 20 bp, Homo sapiens
ctcactggctggactggagg

SEQ ID NO: 4273601 - DNA, 18 bp, Homo sapiens
ctcactggtgcatttaaa

SEQ ID NO: 4273602 - DNA, 21 bp, Homo sapiens
ctcactggtgcatttaaaatg

SEQ ID NO: 4273603 - DNA, 15 bp, Homo sapiens
ctcacttcaagctca

SEQ ID NO: 4273604 - DNA, 20 bp, Homo sapiens
ctcacttcaagctcaccctg

SEQ ID NO: 4273605 - DNA, 14 bp, Homo sapiens
ctcacttttctcca

SEQ ID NO: 4273606 - DNA, 19 bp, Homo sapiens
ctcagaagtttcttcttta

SEQ ID NO: 4273607 - DNA, 17 bp, Homo sapiens
ctcagagggtccctagg

SEQ ID NO: 4273608 - DNA, 22 bp, Homo sapiens
ctcagatgctggtcatcctggg

SEQ ID NO: 4273609 - DNA, 14 bp, Homo sapiens
ctcagcaagtgctg

SEQ ID NO: 4273610 - DNA, 20 bp, Homo sapiens
ctcagcacagcctcacccct

SEQ ID NO: 4273611 - DNA, 14 bp, Homo sapiens
ctcagcagaaggcc

SEQ ID NO: 4273612 - DNA, 17 bp, Homo sapiens
ctcagcagaaggccttg

SEQ ID NO: 4273613 - DNA, 13 bp, Homo sapiens
ctcagccacgcct

SEQ ID NO: 4273614 - DNA, 22 bp, Homo sapiens
ctcagccacgcctctctcagcc

SEQ ID NO: 4273615 - DNA, 16 bp, Homo sapiens
ctcagccactcccagg

SEQ ID NO: 4273616 - DNA, 19 bp, Homo sapiens
ctcagcccacatagtgatg

SEQ ID NO: 4273617 - DNA, 23 bp, Homo sapiens
ctcagccccagggccctgctcag

SEQ ID NO: 4273618 - DNA, 14 bp, Homo sapiens
ctcagccctccctg

SEQ ID NO: 4273619 - DNA, 20 bp, Homo sapiens
ctcagccctccctgcccctc

SEQ ID NO: 4273620 - DNA, 15 bp, Homo sapiens
ctcagcctccactcc

SEQ ID NO: 4273621 - DNA, 18 bp, Homo sapiens
ctcagcctccactccctg

SEQ ID NO: 4273622 - DNA, 14 bp, Homo sapiens
cccagggccctgct

SEQ ID NO: 4273623 - DNA, 16 bp, Homo sapiens
cccagggccctgctca

SEQ ID NO: 4273624 - DNA, 21 bp, Homo sapiens
cccaggggcactgtgttctca

SEQ ID NO: 4273625 - DNA, 15 bp, Homo sapiens
cccaggggcctttgc

SEQ ID NO: 4273626 - DNA, 18 bp, Homo sapiens
cccagggttcccccagcc

SEQ ID NO: 4273627 - DNA, 12 bp, Homo sapiens
cccaggtctcct

SEQ ID NO: 4273628 - DNA, 16 bp, Homo sapiens
cccaggtctcctgggc

SEQ ID NO: 4273629 - DNA, 14 bp, Homo sapiens
cccaggtgttgtcc

SEQ ID NO: 4273630 - DNA, 16 bp, Homo sapiens
cccaggtgttgtccgt

SEQ ID NO: 4273631 - DNA, 23 bp, Homo sapiens
cccaggtgttgtccgtgtctgtt

SEQ ID NO: 4273632 - DNA, 14 bp, Homo sapiens
cccagtccccggga

SEQ ID NO: 4273633 - DNA, 15 bp, Homo sapiens
cccagtgtccccagg

SEQ ID NO: 4273634 - DNA, 14 bp, Homo sapiens
cccagtgtggactc

SEQ ID NO: 4273635 - DNA, 20 bp, Homo sapiens
cccagtgtggactctggact

SEQ ID NO: 4273636 - DNA, 11 bp, Homo sapiens
cccatatcatg

SEQ ID NO: 4273637 - DNA, 12 bp, Homo sapiens
cccatccagcgt

SEQ ID NO: 4273638 - DNA, 19 bp, Homo sapiens
cccatccctttctaagcag

SEQ ID NO: 4273639 - DNA, 16 bp, Homo sapiens
cccatcgccttctggg

SEQ ID NO: 4273640 - DNA, 12 bp, Homo sapiens
cccatctcactt

SEQ ID NO: 4273641 - DNA, 15 bp, Homo sapiens
cccatgcatggcctc

SEQ ID NO: 4273642 - DNA, 13 bp, Homo sapiens
cccatgccctccc

SEQ ID NO: 4273643 - DNA, 21 bp, Homo sapiens
cccatgccctccgtcctggca

SEQ ID NO: 4273644 - DNA, 18 bp, Homo sapiens
cccatttgtaatgtatct

SEQ ID NO: 4273645 - DNA, 15 bp, Homo sapiens
ccccaaaaccacagc

SEQ ID NO: 4273646 - DNA, 16 bp, Homo sapiens
ccccaaaaccacagcc

SEQ ID NO: 4273647 - DNA, 23 bp, Homo sapiens
ccccaaaaccacagccctgtcag

SEQ ID NO: 4273648 - DNA, 18 bp, Homo sapiens
ccccaaactgtagtaatt

SEQ ID NO: 4273649 - DNA, 18 bp, Homo sapiens
ccccaaatgttctttcct

SEQ ID NO: 4273650 - DNA, 15 bp, Homo sapiens
ccccaaccctgcccc

SEQ ID NO: 4273651 - DNA, 23 bp, Homo sapiens
ccccaaccctgcccctgccccgt

SEQ ID NO: 4273652 - DNA, 12 bp, Homo sapiens
ccccaaggaaga

SEQ ID NO: 4273653 - DNA, 17 bp, Homo sapiens
ccccaaggaagaacaaa

SEQ ID NO: 4273654 - DNA, 15 bp, Homo sapiens
ccccacacaggcctg

SEQ ID NO: 4273655 - DNA, 21 bp, Homo sapiens
ccccacacaggcctggcccag

SEQ ID NO: 4273656 - DNA, 21 bp, Homo sapiens
aggcctgaactaggtgctggc

SEQ ID NO: 4273657 - DNA, 22 bp, Homo sapiens
aggcctgccccccttcccaccc

SEQ ID NO: 4273658 - DNA, 13 bp, Homo sapiens
aggcctggagttg

SEQ ID NO: 4273659 - DNA, 10 bp, Homo sapiens
aggcctggcc

SEQ ID NO: 4273660 - DNA, 12 bp, Homo sapiens
aggcctggccca

SEQ ID NO: 4273661 - DNA, 16 bp, Homo sapiens
aggcctggcccagcca

SEQ ID NO: 4273662 - DNA, 18 bp, Homo sapiens
aggcctggcccagccagc

SEQ ID NO: 4273663 - DNA, 20 bp, Homo sapiens
aggcctggcccagccagcag

SEQ ID NO: 4273664 - DNA, 15 bp, Homo sapiens
aggcctggtctggag

SEQ ID NO: 4273665 - DNA, 21 bp, Homo sapiens
aggcctggtctggagccccta

SEQ ID NO: 4273666 - DNA, 24 bp, Homo sapiens
aggcctggtctggagcccctatcc

SEQ ID NO: 4273667 - DNA, 15 bp, Homo sapiens
aggcctggtgccctg

SEQ ID NO: 4273668 - DNA, 18 bp, Homo sapiens
aggcctggtgccctggcc

SEQ ID NO: 4273669 - DNA, 22 bp, Homo sapiens
aggcctggtgccctggcccagc

SEQ ID NO: 4273670 - DNA, 12 bp, Homo sapiens
aggccttgcctt

SEQ ID NO: 4273671 - DNA, 14 bp, Homo sapiens
aggccttgccttgt

SEQ ID NO: 4273672 - DNA, 16 bp, Homo sapiens
aggcctttttgagcca

SEQ ID NO: 4273673 - DNA, 22 bp, Homo sapiens
aggcgagccagattaggcctgg

SEQ ID NO: 4273674 - DNA, 23 bp, Homo sapiens
aggcgagccagattaggcctgga

SEQ ID NO: 4273675 - DNA, 14 bp, Homo sapiens
aggcgccccttccc

SEQ ID NO: 4273676 - DNA, 15 bp, Homo sapiens
aggcgccttcctggg

SEQ ID NO: 4273677 - DNA, 17 bp, Homo sapiens
aggcggtatccagaggt

SEQ ID NO: 4273678 - DNA, 16 bp, Homo sapiens
aggcgtagggccaggg

SEQ ID NO: 4273679 - DNA, 18 bp, Homo sapiens
aggcgtagggccagggct

SEQ ID NO: 4273680 - DNA, 22 bp, Homo sapiens
aggcgtagggccagggctctgg

SEQ ID NO: 4273681 - DNA, 16 bp, Homo sapiens
aggcgtcttgtatttt

SEQ ID NO: 4273682 - DNA, 13 bp, Homo sapiens
aggcgtgcagggg

SEQ ID NO: 4273683 - DNA, 17 bp, Homo sapiens
aggctcccactgcccct

SEQ ID NO: 4273684 - DNA, 20 bp, Homo sapiens
aggctccctccctccctgct

SEQ ID NO: 4273685 - DNA, 23 bp, Homo sapiens
aggctctaattctctaggaaagt

SEQ ID NO: 4273686 - DNA, 20 bp, Homo sapiens
aggctctgaaagctgcttct

SEQ ID NO: 4273687 - DNA, 17 bp, Homo sapiens
aggctctgttccacata

SEQ ID NO: 4273688 - DNA, 13 bp, Homo sapiens
aggctcttctcct

SEQ ID NO: 4273689 - DNA, 21 bp, Homo sapiens
aggctgccccacccctccatg

SEQ ID NO: 4273690 - DNA, 12 bp, Homo sapiens
aggctggagctg

SEQ ID NO: 4273691 - DNA, 14 bp, Homo sapiens
aggctggagctggc

SEQ ID NO: 4273692 - DNA, 14 bp, Homo sapiens
aggctggatgctgg

SEQ ID NO: 4273693 - DNA, 21 bp, Homo sapiens
aggctggggcttttgtgccag

SEQ ID NO: 4273694 - DNA, 20 bp, Homo sapiens
aggctgggtggccggccctg

SEQ ID NO: 4273695 - DNA, 19 bp, Homo sapiens
aggctggtggacagaccca

SEQ ID NO: 4273696 - DNA, 20 bp, Homo sapiens
aggctgtattttcttttata

SEQ ID NO: 4273697 - DNA, 23 bp, Homo sapiens
aggctgtattttcttttatatct

SEQ ID NO: 4273698 - DNA, 17 bp, Homo sapiens
aggcttccggctgagct

SEQ ID NO: 4273699 - DNA, 18 bp, Homo sapiens
aggcttccggctgagctg

SEQ ID NO: 4273700 - DNA, 23 bp, Homo sapiens
aggcttccggctgagctgtgcca

SEQ ID NO: 4273701 - DNA, 14 bp, Homo sapiens
aggcttcctgccct

SEQ ID NO: 4273702 - DNA, 14 bp, Homo sapiens
aggcttccttcatt

SEQ ID NO: 4273703 - DNA, 16 bp, Homo sapiens
aggcttccttcatttc

SEQ ID NO: 4273704 - DNA, 12 bp, Homo sapiens
aggcttctccac

SEQ ID NO: 4273705 - DNA, 21 bp, Homo sapiens
aggcttgcattaaaagactgt

SEQ ID NO: 4273706 - DNA, 22 bp, Homo sapiens
aggcttgggaccgccagatggg

SEQ ID NO: 4273707 - DNA, 15 bp, Homo sapiens
aggcttgtcagagct

SEQ ID NO: 4273708 - DNA, 16 bp, Homo sapiens
aggcttgtcagagctg

SEQ ID NO: 4273709 - DNA, 13 bp, Homo sapiens
aggctttttccat

SEQ ID NO: 4273710 - DNA, 20 bp, Homo sapiens
agggaaaacataatatcttg

SEQ ID NO: 4273711 - DNA, 21 bp, Homo sapiens
agggaaacccggggaactggt

SEQ ID NO: 4273712 - DNA, 12 bp, Homo sapiens
agggaaaccttt

SEQ ID NO: 4273713 - DNA, 16 bp, Homo sapiens
agggaaatccaactcc

SEQ ID NO: 4273714 - DNA, 13 bp, Homo sapiens
agggaaatgctgt

SEQ ID NO: 4273715 - DNA, 15 bp, Homo sapiens
agggaaatgctgttg

SEQ ID NO: 4273716 - DNA, 19 bp, Homo sapiens
agggaaatgctgttggtga

SEQ ID NO: 4273717 - DNA, 18 bp, Homo sapiens
agggaacagacctcggct

SEQ ID NO: 4273718 - DNA, 12 bp, Homo sapiens
agggaagaaatc

SEQ ID NO: 4273719 - DNA, 14 bp, Homo sapiens
agggaatgaatcca

SEQ ID NO: 4273720 - DNA, 18 bp, Homo sapiens
agggaattgaggtctgct

SEQ ID NO: 4273721 - DNA, 21 bp, Homo sapiens
agggacagccaaaagtaagtg

SEQ ID NO: 4273722 - DNA, 21 bp, Homo sapiens
agggacagcgggtaaaaagag

SEQ ID NO: 4273723 - DNA, 15 bp, Homo sapiens
agggacagtgggcta

SEQ ID NO: 4273724 - DNA, 21 bp, Homo sapiens
agggaccaaggacccctcacc

SEQ ID NO: 4273725 - DNA, 17 bp, Homo sapiens
agggactaggagcactg

SEQ ID NO: 4273726 - DNA, 17 bp, Homo sapiens
agggactggtccaggca

SEQ ID NO: 4273727 - DNA, 20 bp, Homo sapiens
agggactggtccaggcatgg

SEQ ID NO: 4273728 - DNA, 15 bp, Homo sapiens
agggagaaggagagg

SEQ ID NO: 4273729 - DNA, 22 bp, Homo sapiens
agggagactgacccattcacat

SEQ ID NO: 4273730 - DNA, 19 bp, Homo sapiens
agggagcactggaggcctc

SEQ ID NO: 4273731 - DNA, 22 bp, Homo sapiens
agggaggaatcgaggaaccaga

SEQ ID NO: 4273732 - DNA, 18 bp, Homo sapiens
agggaggcctgaggggca

SEQ ID NO: 4273733 - DNA, 14 bp, Homo sapiens
agggcactggtggc

SEQ ID NO: 4273734 - DNA, 15 bp, Homo sapiens
agggcaggagcctag

SEQ ID NO: 4273735 - DNA, 17 bp, Homo sapiens
agggcaggagcctagag

SEQ ID NO: 4273736 - DNA, 18 bp, Homo sapiens
agggcaggagcctagagg

SEQ ID NO: 4273737 - DNA, 22 bp, Homo sapiens
agggcaggagcctagaggagga

SEQ ID NO: 4273738 - DNA, 15 bp, Homo sapiens
agggcaggcagagct

SEQ ID NO: 4273739 - DNA, 17 bp, Homo sapiens
agggcaggcagagctca

SEQ ID NO: 4273740 - DNA, 19 bp, Homo sapiens
agggcagggttctagaagg

SEQ ID NO: 4273741 - DNA, 20 bp, Homo sapiens
agggcagggttctagaaggg

SEQ ID NO: 4273742 - DNA, 13 bp, Homo sapiens
agggcatctccag

SEQ ID NO: 4273743 - DNA, 14 bp, Homo sapiens
agggcatctccagg

SEQ ID NO: 4273744 - DNA, 16 bp, Homo sapiens
agggcatctccaggaa

SEQ ID NO: 4273745 - DNA, 16 bp, Homo sapiens
agggccagggctctgg

SEQ ID NO: 4273746 - DNA, 17 bp, Homo sapiens
agggccagggctctggc

SEQ ID NO: 4273747 - DNA, 24 bp, Homo sapiens
agggccagtcatggctgtcccctg

SEQ ID NO: 4273748 - DNA, 17 bp, Homo sapiens
agggcccccacaggagc

SEQ ID NO: 4273749 - DNA, 20 bp, Homo sapiens
agggcccctcactggctgga

SEQ ID NO: 4273750 - DNA, 13 bp, Homo sapiens
agggcccctgaag

SEQ ID NO: 4273751 - DNA, 23 bp, Homo sapiens
agggcccctgaagtgaccccagc

SEQ ID NO: 4273752 - DNA, 11 bp, Homo sapiens
agggccctgct

SEQ ID NO: 4273753 - DNA, 15 bp, Homo sapiens
agggccctgctcagg

SEQ ID NO: 4273754 - DNA, 15 bp, Homo sapiens
agggcgggccaggag

SEQ ID NO: 4273755 - DNA, 14 bp, Homo sapiens
agggcggggctggc

SEQ ID NO: 4273756 - DNA, 21 bp, Homo sapiens
agggcggggctggccagctgt

SEQ ID NO: 4273757 - DNA, 22 bp, Homo sapiens
agggctctggcaggtggccagg

SEQ ID NO: 4273758 - DNA, 19 bp, Homo sapiens
agggctggattggcaggtg

SEQ ID NO: 4273759 - DNA, 23 bp, Homo sapiens
aggggaaaccttcacccagcacc

SEQ ID NO: 4273760 - DNA, 22 bp, Homo sapiens
aggggaagtgtgctgaggtggg

SEQ ID NO: 4273761 - DNA, 15 bp, Homo sapiens
aggggacagatcttg

SEQ ID NO: 4273762 - DNA, 12 bp, Homo sapiens
aggggactgcat

SEQ ID NO: 4273763 - DNA, 16 bp, Homo sapiens
aggggactgcatgcaa

SEQ ID NO: 4273764 - DNA, 19 bp, Homo sapiens
aggggactgcatgcaagct

SEQ ID NO: 4273765 - DNA, 23 bp, Homo sapiens
aggggagacttaggccagaggtg

SEQ ID NO: 4273766 - DNA, 13 bp, Homo sapiens
aggggagagaagg

SEQ ID NO: 4273767 - DNA, 23 bp, Homo sapiens
catcaatacttttgtgtattctg

SEQ ID NO: 4273768 - DNA, 14 bp, Homo sapiens
catcagaagtggta

SEQ ID NO: 4273769 - DNA, 14 bp, Homo sapiens
catcagcaagacaa

SEQ ID NO: 4273770 - DNA, 23 bp, Homo sapiens
catcagcagtgattgaagtatct

SEQ ID NO: 4273771 - DNA, 12 bp, Homo sapiens
catcagcccctg

SEQ ID NO: 4273772 - DNA, 18 bp, Homo sapiens
catcagcccctgctgctc

SEQ ID NO: 4273773 - DNA, 23 bp, Homo sapiens
ccacatagtgatggttcccctgt

SEQ ID NO: 4273774 - DNA, 22 bp, Homo sapiens
ccacatccaacatttcctcagg

SEQ ID NO: 4273775 - DNA, 16 bp, Homo sapiens
ccacatccattccaga

SEQ ID NO: 4273776 - DNA, 18 bp, Homo sapiens
ccacatccattccagagc

SEQ ID NO: 4273777 - DNA, 19 bp, Homo sapiens
cccggcccccctctcgggc

SEQ ID NO: 4273778 - DNA, 17 bp, Homo sapiens
cccggctctgaggctgc

SEQ ID NO: 4273779 - DNA, 14 bp, Homo sapiens
cccgggaggaggat

SEQ ID NO: 4273780 - DNA, 20 bp, Homo sapiens
cccggggcatggacagggcc

SEQ ID NO: 4273781 - DNA, 20 bp, Homo sapiens
cccgggtttggcgggccaag

SEQ ID NO: 4273782 - DNA, 18 bp, Homo sapiens
cccggtgcccaagaatag

SEQ ID NO: 4273783 - DNA, 20 bp, Homo sapiens
cccgtgccacgcgctctgca

SEQ ID NO: 4273784 - DNA, 18 bp, Homo sapiens
cccgtgtggccccttcac

SEQ ID NO: 4273785 - DNA, 17 bp, Homo sapiens
cccgtttccaagcctgg

SEQ ID NO: 4273786 - DNA, 22 bp, Homo sapiens
ccctacccggctcgttccccca

SEQ ID NO: 4273787 - DNA, 20 bp, Homo sapiens
ccctagcagtttgcctctgc

SEQ ID NO: 4273788 - DNA, 16 bp, Homo sapiens
ccctaggtctccaccc

SEQ ID NO: 4273789 - DNA, 21 bp, Homo sapiens
ccctaggtctccacccctcaa

SEQ ID NO: 4273790 - DNA, 19 bp, Homo sapiens
ccctaggtgggtcaactcc

SEQ ID NO: 4273791 - DNA, 24 bp, Homo sapiens
ccctaggtgggtcaactccaaggc

SEQ ID NO: 4273792 - DNA, 13 bp, Homo sapiens
ccctagttctttg

SEQ ID NO: 4273793 - DNA, 18 bp, Homo sapiens
ccctatcctgcaccctct

SEQ ID NO: 4273794 - DNA, 20 bp, Homo sapiens
ccctatcctgcaccctctgc

SEQ ID NO: 4273795 - DNA, 23 bp, Homo sapiens
ccctcacctgggcacctggggag

SEQ ID NO: 4273796 - DNA, 18 bp, Homo sapiens
ccctcaccttgcaacaca

SEQ ID NO: 4273797 - DNA, 14 bp, Homo sapiens
ccctcactccactc

SEQ ID NO: 4273798 - DNA, 22 bp, Homo sapiens
ccctcactccactcccctcatc

SEQ ID NO: 4273799 - DNA, 12 bp, Homo sapiens
ccctcactggct

SEQ ID NO: 4273800 - DNA, 14 bp, Homo sapiens
ccctcactggctgg

SEQ ID NO: 4273801 - DNA, 16 bp, Homo sapiens
ccctcactggctggac

SEQ ID NO: 4273802 - DNA, 22 bp, Homo sapiens
ccctcactggctggactggagg

SEQ ID NO: 4273803 - DNA, 13 bp, Homo sapiens
ccctcagagccac

SEQ ID NO: 4273804 - DNA, 16 bp, Homo sapiens
ccctcagccacgcctc

SEQ ID NO: 4273805 - DNA, 22 bp, Homo sapiens
ccctcagccacgcctctctcag

SEQ ID NO: 4273806 - DNA, 12 bp, Homo sapiens
ccctcagcccct

SEQ ID NO: 4273807 - DNA, 17 bp, Homo sapiens
ccctcagcccctcttgc

SEQ ID NO: 4273808 - DNA, 13 bp, Homo sapiens
ccctcaggcttgg

SEQ ID NO: 4273809 - DNA, 18 bp, Homo sapiens
ccctcatcacacgtcaca

SEQ ID NO: 4273810 - DNA, 13 bp, Homo sapiens
ccctcatccacta

SEQ ID NO: 4273811 - DNA, 17 bp, Homo sapiens
ccctccacacctccacc

SEQ ID NO: 4273812 - DNA, 18 bp, Homo sapiens
ccctccacacctccaccc

SEQ ID NO: 4273813 - DNA, 12 bp, Homo sapiens
ccctccactcct

SEQ ID NO: 4273814 - DNA, 14 bp, Homo sapiens
ccctccactcctcc

SEQ ID NO: 4273815 - DNA, 11 bp, Homo sapiens
ccctccagacc

SEQ ID NO: 4273816 - DNA, 19 bp, Homo sapiens
ccctccagacccctaccct

SEQ ID NO: 4273817 - DNA, 22 bp, Homo sapiens
ccctccagacccctaccctttc

SEQ ID NO: 4273818 - DNA, 21 bp, Homo sapiens
ccctccatgtagaagagggag

SEQ ID NO: 4273819 - DNA, 22 bp, Homo sapiens
ccctccatgtagaagagggaga

SEQ ID NO: 4273820 - DNA, 14 bp, Homo sapiens
ccctccccaaggaa

SEQ ID NO: 4273821 - DNA, 23 bp, Homo sapiens
ccctccccatggtgcagtgaaga

SEQ ID NO: 4273822 - DNA, 19 bp, Homo sapiens
ccctcccccggggtctcca

SEQ ID NO: 4273823 - DNA, 20 bp, Homo sapiens
ccctcccccggggtctccac

SEQ ID NO: 4273824 - DNA, 22 bp, Homo sapiens
ccctcccccggggtctccacct

SEQ ID NO: 4273825 - DNA, 13 bp, Homo sapiens
ccctccctcagcc

SEQ ID NO: 4273826 - DNA, 11 bp, Homo sapiens
ccctccctccc

SEQ ID NO: 4273827 - DNA, 17 bp, Homo sapiens
ccctccctggcctgttc

SEQ ID NO: 4273828 - DNA, 20 bp, Homo sapiens
ccctcctatcacctcccctc

SEQ ID NO: 4273829 - DNA, 18 bp, Homo sapiens
ccctcctgaaacttacac

SEQ ID NO: 4273830 - DNA, 14 bp, Homo sapiens
ccctcctggctcac

SEQ ID NO: 4273831 - DNA, 19 bp, Homo sapiens
ccctcctggctcacagcca

SEQ ID NO: 4273832 - DNA, 22 bp, Homo sapiens
ccctcctggctcacagccacca

SEQ ID NO: 4273833 - DNA, 15 bp, Homo sapiens
ccctcggagcctgtg

SEQ ID NO: 4273834 - DNA, 17 bp, Homo sapiens
ccctcggagcctgtgtt

SEQ ID NO: 4273835 - DNA, 17 bp, Homo sapiens
ccctcggggcaggaagt

SEQ ID NO: 4273836 - DNA, 17 bp, Homo sapiens
ccctcgtctccctggcc

SEQ ID NO: 4273837 - DNA, 15 bp, Homo sapiens
ccctctatttagcat

SEQ ID NO: 4273838 - DNA, 16 bp, Homo sapiens
ccctctcaggcatgcc

SEQ ID NO: 4273839 - DNA, 21 bp, Homo sapiens
ccctctcaggcatgcctgtgt

SEQ ID NO: 4273840 - DNA, 13 bp, Homo sapiens
ccctctccccgga

SEQ ID NO: 4273841 - DNA, 19 bp, Homo sapiens
ccctctcgggctctctcac

SEQ ID NO: 4273842 - DNA, 14 bp, Homo sapiens
ccctctctgtccaa

SEQ ID NO: 4273843 - DNA, 22 bp, Homo sapiens
ccctctcttaatgccacggcag

SEQ ID NO: 4273844 - DNA, 20 bp, Homo sapiens
ccctctgagtgaagtccagt

SEQ ID NO: 4273845 - DNA, 18 bp, Homo sapiens
ccctctgcccccagctgc

SEQ ID NO: 4273846 - DNA, 19 bp, Homo sapiens
ccctctgctatgtctgtga

SEQ ID NO: 4273847 - DNA, 13 bp, Homo sapiens
ccctcttccccct

SEQ ID NO: 4273848 - DNA, 14 bp, Homo sapiens
ccctcttccccctt

SEQ ID NO: 4273849 - DNA, 17 bp, Homo sapiens
ccctcttcccccttccc

SEQ ID NO: 4273850 - DNA, 20 bp, Homo sapiens
ccctgaagtgaccccagctc

SEQ ID NO: 4273851 - DNA, 22 bp, Homo sapiens
ccctgaagtgaccccagctcca

SEQ ID NO: 4273852 - DNA, 23 bp, Homo sapiens
ccctgaagtgaccccagctccag

SEQ ID NO: 4273853 - DNA, 16 bp, Homo sapiens
ccctgagaagcctcat

SEQ ID NO: 4273854 - DNA, 16 bp, Homo sapiens
ccctgagggcccttcc

SEQ ID NO: 4273855 - DNA, 18 bp, Homo sapiens
ccctgaggggcctgccac

SEQ ID NO: 4273856 - DNA, 22 bp, Homo sapiens
ccctgagggtttccaccttggc

SEQ ID NO: 4273857 - DNA, 14 bp, Homo sapiens
ccctgcaagtggac

SEQ ID NO: 4273858 - DNA, 13 bp, Homo sapiens
ccctgcacacacc

SEQ ID NO: 4273859 - DNA, 15 bp, Homo sapiens
ccctgcacacacctg

SEQ ID NO: 4273860 - DNA, 22 bp, Homo sapiens
ccctgcaggcggtatccagagg

SEQ ID NO: 4273861 - DNA, 18 bp, Homo sapiens
ccctgccaactttccaga

SEQ ID NO: 4273862 - DNA, 19 bp, Homo sapiens
ccggctgggcccgagggtc

SEQ ID NO: 4273863 - DNA, 17 bp, Homo sapiens
ccgggagatccgccctg

SEQ ID NO: 4273864 - DNA, 14 bp, Homo sapiens
ccggggagctgagg

SEQ ID NO: 4273865 - DNA, 18 bp, Homo sapiens
ccggggagctgaggggca

SEQ ID NO: 4273866 - DNA, 18 bp, Homo sapiens
ccggggcagctgccagag

SEQ ID NO: 4273867 - DNA, 21 bp, Homo sapiens
ccgggtgccccccatgccctc

SEQ ID NO: 4273868 - DNA, 22 bp, Homo sapiens
ccgggtgccccccatgccctcc

SEQ ID NO: 4273869 - DNA, 15 bp, Homo sapiens
ccgggtgcctgtgac

SEQ ID NO: 4273870 - DNA, 16 bp, Homo sapiens
ccgggtgcctgtgacc

SEQ ID NO: 4273871 - DNA, 19 bp, Homo sapiens
ccgtagactcacggctgca

SEQ ID NO: 4273872 - DNA, 14 bp, Homo sapiens
ccgtcatgctccca

SEQ ID NO: 4273873 - DNA, 16 bp, Homo sapiens
ccgtcctggcagggca

SEQ ID NO: 4273874 - DNA, 18 bp, Homo sapiens
ccgtcctggcagggcagg

SEQ ID NO: 4273875 - DNA, 18 bp, Homo sapiens
ccgtgcacggggccagca

SEQ ID NO: 4273876 - DNA, 17 bp, Homo sapiens
ccgtgccttcagctcta

SEQ ID NO: 4273877 - DNA, 11 bp, Homo sapiens
ccgtggcttcc

SEQ ID NO: 4273878 - DNA, 21 bp, Homo sapiens
ccgtggcttcccgctcagccc

SEQ ID NO: 4273879 - DNA, 21 bp, Homo sapiens
ccgtggtgaggttgtgctgcc

SEQ ID NO: 4273880 - DNA, 18 bp, Homo sapiens
ccgtgtctgtggccctct

SEQ ID NO: 4273881 - DNA, 18 bp, Homo sapiens
ccgtgtgctccagtgttt

SEQ ID NO: 4273882 - DNA, 13 bp, Homo sapiens
ccgtgtggcccct

SEQ ID NO: 4273883 - DNA, 14 bp, Homo sapiens
ccgtgtggcccctt

SEQ ID NO: 4273884 - DNA, 17 bp, Homo sapiens
ccgttgcctctctgcca

SEQ ID NO: 4273885 - DNA, 23 bp, Homo sapiens
ccgttgtgtgggtttactctgtg

SEQ ID NO: 4273886 - DNA, 13 bp, Homo sapiens
ccgtttccaagcc

SEQ ID NO: 4273887 - DNA, 14 bp, Homo sapiens
cctacaaatcagta

SEQ ID NO: 4273888 - DNA, 15 bp, Homo sapiens
cctacagtggaggga

SEQ ID NO: 4273889 - DNA, 17 bp, Homo sapiens
cctacccgcccgcgtcc

SEQ ID NO: 4273890 - DNA, 22 bp, Homo sapiens
cctagcacaaggagtgcccgcc

SEQ ID NO: 4273891 - DNA, 21 bp, Homo sapiens
cctagcagtttgcctctgcac

SEQ ID NO: 4273892 - DNA, 21 bp, Homo sapiens
cctaggagcagtgggccctgg

SEQ ID NO: 4273893 - DNA, 22 bp, Homo sapiens
cctaggagcagtgggccctggc

SEQ ID NO: 4273894 - DNA, 23 bp, Homo sapiens
cctaggagcagtgggccctggct

SEQ ID NO: 4273895 - DNA, 14 bp, Homo sapiens
cctaggagctgggg

SEQ ID NO: 4273896 - DNA, 17 bp, Homo sapiens
cctaggcatactctcca

SEQ ID NO: 4273897 - DNA, 15 bp, Homo sapiens
cctaggtctccaccc

SEQ ID NO: 4273898 - DNA, 21 bp, Homo sapiens
cctaggtctccacccctcaag

SEQ ID NO: 4273899 - DNA, 19 bp, Homo sapiens
cctagtggcttcagcccct

SEQ ID NO: 4273900 - DNA, 22 bp, Homo sapiens
cctagtggcttcagcccctggg

SEQ ID NO: 4273901 - DNA, 17 bp, Homo sapiens
cctatcacctcccctcc

SEQ ID NO: 4273902 - DNA, 18 bp, Homo sapiens
cctatcacctcccctcct

SEQ ID NO: 4273903 - DNA, 20 bp, Homo sapiens
cctatcagagaagcagcatc

SEQ ID NO: 4273904 - DNA, 15 bp, Homo sapiens
cctatcatcagttag

SEQ ID NO: 4273905 - DNA, 17 bp, Homo sapiens
cctatcctgcaccctct

SEQ ID NO: 4273906 - DNA, 18 bp, Homo sapiens
cctatgccacctgcagcg

SEQ ID NO: 4273907 - DNA, 18 bp, Homo sapiens
cctatgtcatttcatttc

SEQ ID NO: 4273908 - DNA, 22 bp, Homo sapiens
cctattctattgcagttataga

SEQ ID NO: 4273909 - DNA, 20 bp, Homo sapiens
cctcaaaaagatttccccat

SEQ ID NO: 4273910 - DNA, 22 bp, Homo sapiens
cctcaacaaagaagaaccatct

SEQ ID NO: 4273911 - DNA, 16 bp, Homo sapiens
cctcaaccctccctca

SEQ ID NO: 4273912 - DNA, 19 bp, Homo sapiens
cctcaaccctccctcagcc

SEQ ID NO: 4273913 - DNA, 15 bp, Homo sapiens
cctcaagccaggaga

SEQ ID NO: 4273914 - DNA, 16 bp, Homo sapiens
cctcaagccaggagac

SEQ ID NO: 4273915 - DNA, 23 bp, Homo sapiens
cctcaagccaggagaccctgtct

SEQ ID NO: 4273916 - DNA, 15 bp, Homo sapiens
cctcacctggcttcc

SEQ ID NO: 4273917 - DNA, 13 bp, Homo sapiens
cctgcgcaggccc

SEQ ID NO: 4273918 - DNA, 15 bp, Homo sapiens
cctgcgccctccctc

SEQ ID NO: 4273919 - DNA, 23 bp, Homo sapiens
cctgcgccctccctccctccaca

SEQ ID NO: 4273920 - DNA, 21 bp, Homo sapiens
cctgcgccctgacatgctaac

SEQ ID NO: 4273921 - DNA, 15 bp, Homo sapiens
cctgcgtggcctggg

SEQ ID NO: 4273922 - DNA, 16 bp, Homo sapiens
cctgcgtggcctgggg

SEQ ID NO: 4273923 - DNA, 12 bp, Homo sapiens
cctgctcaggcc

SEQ ID NO: 4273924 - DNA, 19 bp, Homo sapiens
cctgctcaggcctcacctg

SEQ ID NO: 4273925 - DNA, 22 bp, Homo sapiens
cctgctcaggcctcacctggct

SEQ ID NO: 4273926 - DNA, 16 bp, Homo sapiens
cctgctccctgctccc

SEQ ID NO: 4273927 - DNA, 23 bp, Homo sapiens
cctgctgagtggtccacattctg

SEQ ID NO: 4273928 - DNA, 19 bp, Homo sapiens
cctgctgcctccccaaccc

SEQ ID NO: 4273929 - DNA, 16 bp, Homo sapiens
cctgctgtgggtcagt

SEQ ID NO: 4273930 - DNA, 23 bp, Homo sapiens
cctgctttgggctgccctggtgc

SEQ ID NO: 4273931 - DNA, 13 bp, Homo sapiens
cctggaaagccct

SEQ ID NO: 4273932 - DNA, 16 bp, Homo sapiens
cctggacacagtcagg

SEQ ID NO: 4273933 - DNA, 17 bp, Homo sapiens
cctggacacagtcaggg

SEQ ID NO: 4273934 - DNA, 18 bp, Homo sapiens
cctggacccagcaggggc

SEQ ID NO: 4273935 - DNA, 19 bp, Homo sapiens
cctggacgcatgcagggcc

SEQ ID NO: 4273936 - DNA, 13 bp, Homo sapiens
cctggagaactag

SEQ ID NO: 4273937 - DNA, 15 bp, Homo sapiens
cctggagcccggcag

SEQ ID NO: 4273938 - DNA, 21 bp, Homo sapiens
cctggaggacaaaacagcggg

SEQ ID NO: 4273939 - DNA, 22 bp, Homo sapiens
cctggaggacaaaacagcggga

SEQ ID NO: 4273940 - DNA, 13 bp, Homo sapiens
cctggatcccttt

SEQ ID NO: 4273941 - DNA, 19 bp, Homo sapiens
cctggatggatctgctcca

SEQ ID NO: 4273942 - DNA, 20 bp, Homo sapiens
cctggattttctttctatgt

SEQ ID NO: 4273943 - DNA, 21 bp, Homo sapiens
cctggattttctttctatgta

SEQ ID NO: 4273944 - DNA, 17 bp, Homo sapiens
cctggcacagggcagtg

SEQ ID NO: 4273945 - DNA, 17 bp, Homo sapiens
cctggcagaactgagct

SEQ ID NO: 4273946 - DNA, 20 bp, Homo sapiens
cctggcagaactgagctcct

SEQ ID NO: 4273947 - DNA, 12 bp, Homo sapiens
cctggcagccgt

SEQ ID NO: 4273948 - DNA, 13 bp, Homo sapiens
cctggcagggcag

SEQ ID NO: 4273949 - DNA, 14 bp, Homo sapiens
cctggcccagcctg

SEQ ID NO: 4273950 - DNA, 16 bp, Homo sapiens
cctggcccagtgagag

SEQ ID NO: 4273951 - DNA, 20 bp, Homo sapiens
cctggcccctcccacatccc

SEQ ID NO: 4273952 - DNA, 21 bp, Homo sapiens
cctggccctttcacccctctt

SEQ ID NO: 4273953 - DNA, 22 bp, Homo sapiens
cctggccctttcacccctcttc

SEQ ID NO: 4273954 - DNA, 11 bp, Homo sapiens
cctggcctgtt

SEQ ID NO: 4273955 - DNA, 19 bp, Homo sapiens
cctggcctgttctgttttg

SEQ ID NO: 4273956 - DNA, 14 bp, Homo sapiens
cctggctcacagcc

SEQ ID NO: 4273957 - DNA, 17 bp, Homo sapiens
cctggctcacagccacc

SEQ ID NO: 4273958 - DNA, 18 bp, Homo sapiens
cctggctcacagccacca

SEQ ID NO: 4273959 - DNA, 20 bp, Homo sapiens
cctggctcacagccaccacc

SEQ ID NO: 4273960 - DNA, 23 bp, Homo sapiens
cctggctcacagccaccacctgg

SEQ ID NO: 4273961 - DNA, 12 bp, Homo sapiens
cctggctcagcc

SEQ ID NO: 4273962 - DNA, 17 bp, Homo sapiens
cctggctcccacaggcc

SEQ ID NO: 4273963 - DNA, 16 bp, Homo sapiens
cctggctcccagggtc

SEQ ID NO: 4273964 - DNA, 15 bp, Homo sapiens
cctggcttcccagga

SEQ ID NO: 4273965 - DNA, 18 bp, Homo sapiens
cctggcttttcactgctg

SEQ ID NO: 4273966 - DNA, 19 bp, Homo sapiens
cctgggaaaagggcaggag

SEQ ID NO: 4273967 - DNA, 14 bp, Homo sapiens
cctgggagagtgag

SEQ ID NO: 4273968 - DNA, 22 bp, Homo sapiens
cctgggagagtgaggtcatccc

SEQ ID NO: 4273969 - DNA, 15 bp, Homo sapiens
cctgggagatgctgg

SEQ ID NO: 4273970 - DNA, 13 bp, Homo sapiens
cctgggcagccca

SEQ ID NO: 4273971 - DNA, 14 bp, Homo sapiens
cctgggcagcccag

SEQ ID NO: 4273972 - DNA, 19 bp, Homo sapiens
cctgggcagcccagagaga

SEQ ID NO: 4273973 - DNA, 20 bp, Homo sapiens
cctgggcatccccagccccc

SEQ ID NO: 4273974 - DNA, 14 bp, Homo sapiens
cctgggcatctggc

SEQ ID NO: 4273975 - DNA, 21 bp, Homo sapiens
cctgggcatctggccctgctg

SEQ ID NO: 4273976 - DNA, 14 bp, Homo sapiens
cctgggcatgtccc

SEQ ID NO: 4273977 - DNA, 18 bp, Homo sapiens
cctgggcatgtccccagt

SEQ ID NO: 4273978 - DNA, 19 bp, Homo sapiens
cctgggccactggcatctc

SEQ ID NO: 4273979 - DNA, 14 bp, Homo sapiens
cctgggccctaggc

SEQ ID NO: 4273980 - DNA, 18 bp, Homo sapiens
cctgggccctaggcatac

SEQ ID NO: 4273981 - DNA, 16 bp, Homo sapiens
cctgggcctgatggtg

SEQ ID NO: 4273982 - DNA, 15 bp, Homo sapiens
cctggggacggagca

SEQ ID NO: 4273983 - DNA, 18 bp, Homo sapiens
cctggggacggagcactg

SEQ ID NO: 4273984 - DNA, 18 bp, Homo sapiens
cctggggatgtggctgga

SEQ ID NO: 4273985 - DNA, 16 bp, Homo sapiens
cctgggggctgctgca

SEQ ID NO: 4273986 - DNA, 19 bp, Homo sapiens
cctgggggctgctgcactg

SEQ ID NO: 4273987 - DNA, 23 bp, Homo sapiens
cctgggggctgctgcactgccct

SEQ ID NO: 4273988 - DNA, 19 bp, Homo sapiens
cctggggggcacagccaga

SEQ ID NO: 4273989 - DNA, 20 bp, Homo sapiens
cctggggggcacagccagaa

SEQ ID NO: 4273990 - DNA, 19 bp, Homo sapiens
cctggggtggttggaggcc

SEQ ID NO: 4273991 - DNA, 21 bp, Homo sapiens
cctggggtggttggaggcctg

SEQ ID NO: 4273992 - DNA, 22 bp, Homo sapiens
cctggggtggttggaggcctgg

SEQ ID NO: 4273993 - DNA, 14 bp, Homo sapiens
cctgggtgtgctcc

SEQ ID NO: 4273994 - DNA, 22 bp, Homo sapiens
cctgggtgtgctccaggcttcc

SEQ ID NO: 4273995 - DNA, 20 bp, Homo sapiens
cctgggttggccagagggcc

SEQ ID NO: 4273996 - DNA, 17 bp, Homo sapiens
cctggtcctgcactgtc

SEQ ID NO: 4273997 - DNA, 21 bp, Homo sapiens
cctggtctggagcccctatcc

SEQ ID NO: 4273998 - DNA, 17 bp, Homo sapiens
cctggtgccctggccca

SEQ ID NO: 4273999 - DNA, 19 bp, Homo sapiens
cctggtggccaagcctgcc

SEQ ID NO: 4274000 - DNA, 17 bp, Homo sapiens
cctggtgtccctgcctg

SEQ ID NO: 4274001 - DNA, 14 bp, Homo sapiens
cctggtgtctagtt

SEQ ID NO: 4274002 - DNA, 15 bp, Homo sapiens
cctggttcccccagg

SEQ ID NO: 4274003 - DNA, 16 bp, Homo sapiens
cctggttcccccagga

SEQ ID NO: 4274004 - DNA, 23 bp, Homo sapiens
cctgtattgtctgacttctcagg

SEQ ID NO: 4274005 - DNA, 19 bp, Homo sapiens
cctgtcagtgcagcccgtg

SEQ ID NO: 4274006 - DNA, 19 bp, Homo sapiens
cctgtccacctgtgctgct

SEQ ID NO: 4274007 - DNA, 15 bp, Homo sapiens
cctgtccctctcagg

SEQ ID NO: 4274008 - DNA, 23 bp, Homo sapiens
cctgtccctgccccgccccccag

SEQ ID NO: 4274009 - DNA, 10 bp, Homo sapiens
cctgtccttc

SEQ ID NO: 4274010 - DNA, 18 bp, Homo sapiens
cctgtccttcccacggcc

SEQ ID NO: 4274011 - DNA, 14 bp, Homo sapiens
cctgtctttgctgt

SEQ ID NO: 4274012 - DNA, 18 bp, Homo sapiens
cctgtctttgctgtttat

SEQ ID NO: 4274013 - DNA, 19 bp, Homo sapiens
cctgtgaccggggtcctga

SEQ ID NO: 4274014 - DNA, 14 bp, Homo sapiens
cctgtgagatgtgt

SEQ ID NO: 4274015 - DNA, 20 bp, Homo sapiens
cctgtgatcgtgtgttgcca

SEQ ID NO: 4274016 - DNA, 15 bp, Homo sapiens
cctgtggagcccgca

SEQ ID NO: 4274017 - DNA, 17 bp, Homo sapiens
cctgtggagcccgcacc

SEQ ID NO: 4274018 - DNA, 18 bp, Homo sapiens
cctgtggagcccgcaccc

SEQ ID NO: 4274019 - DNA, 16 bp, Homo sapiens
cctgtggcctcagcat

SEQ ID NO: 4274020 - DNA, 17 bp, Homo sapiens
cctgtggcctcagcatc

SEQ ID NO: 4274021 - DNA, 17 bp, Homo sapiens
cctgtggcggtgcagtg

SEQ ID NO: 4274022 - DNA, 21 bp, Homo sapiens
cctgtggcggtgcagtggcaa

SEQ ID NO: 4274023 - DNA, 20 bp, Homo sapiens
cctgtggggatttctcccag

SEQ ID NO: 4274024 - DNA, 22 bp, Homo sapiens
cctgtggggatttctcccagct

SEQ ID NO: 4274025 - DNA, 18 bp, Homo sapiens
cctgtggtgaggtcctgt

SEQ ID NO: 4274026 - DNA, 16 bp, Homo sapiens
cctgttctcagagctc

SEQ ID NO: 4274027 - DNA, 23 bp, Homo sapiens
cctgttctcagagctccacagaa

SEQ ID NO: 4274028 - DNA, 13 bp, Homo sapiens
cctgttctgtgtc

SEQ ID NO: 4274029 - DNA, 14 bp, Homo sapiens
cctgttctgtgtct

SEQ ID NO: 4274030 - DNA, 18 bp, Homo sapiens
cctgttctgtgtctgctg

SEQ ID NO: 4274031 - DNA, 20 bp, Homo sapiens
cctgttctgtgtctgctgta

SEQ ID NO: 4274032 - DNA, 22 bp, Homo sapiens
cctgttgattaatttctgccat

SEQ ID NO: 4274033 - DNA, 23 bp, Homo sapiens
cctgttgattaatttctgccatt

SEQ ID NO: 4274034 - DNA, 23 bp, Homo sapiens
cctgttttattgagttctgaagg

SEQ ID NO: 4274035 - DNA, 15 bp, Homo sapiens
ccttaatatttcttc

SEQ ID NO: 4274036 - DNA, 19 bp, Homo sapiens
ccttaatatttcttcaaat

SEQ ID NO: 4274037 - DNA, 16 bp, Homo sapiens
ccttagaacctttctt

SEQ ID NO: 4274038 - DNA, 18 bp, Homo sapiens
ccttagaacctttcttac

SEQ ID NO: 4274039 - DNA, 22 bp, Homo sapiens
ccttcaaagtctcaatgaaata

SEQ ID NO: 4274040 - DNA, 14 bp, Homo sapiens
ccttcaaccattcc

SEQ ID NO: 4274041 - DNA, 14 bp, Homo sapiens
ccttcacccagcac

SEQ ID NO: 4274042 - DNA, 18 bp, Homo sapiens
ccttcactccctgtcata

SEQ ID NO: 4274043 - DNA, 20 bp, Homo sapiens
ccttcacttctgaccacact

SEQ ID NO: 4274044 - DNA, 22 bp, Homo sapiens
ccttcacttctgaccacacttc

SEQ ID NO: 4274045 - DNA, 16 bp, Homo sapiens
ccttcagtaaacacca

SEQ ID NO: 4274046 - DNA, 14 bp, Homo sapiens
ccttcataaattat

SEQ ID NO: 4274047 - DNA, 17 bp, Homo sapiens
ccttccacacttccacc

SEQ ID NO: 4274048 - DNA, 19 bp, Homo sapiens
ccttccacgctgtctccag

SEQ ID NO: 4274049 - DNA, 20 bp, Homo sapiens
ccttccacgctgtctccaga

SEQ ID NO: 4274050 - DNA, 13 bp, Homo sapiens
ccttccaggcccc

SEQ ID NO: 4274051 - DNA, 16 bp, Homo sapiens
ccttccaggccccagg

SEQ ID NO: 4274052 - DNA, 20 bp, Homo sapiens
ccttccaggcgtagggccag

SEQ ID NO: 4274053 - DNA, 15 bp, Homo sapiens
ccttcccaacctccc

SEQ ID NO: 4274054 - DNA, 15 bp, Homo sapiens
ccttcccacccctat

SEQ ID NO: 4274055 - DNA, 19 bp, Homo sapiens
ccttcccacggccactgca

SEQ ID NO: 4274056 - DNA, 12 bp, Homo sapiens
ccttccccactc

SEQ ID NO: 4274057 - DNA, 20 bp, Homo sapiens
ccttccccactgcctgccca

SEQ ID NO: 4274058 - DNA, 17 bp, Homo sapiens
ccttccctgacactgtc

SEQ ID NO: 4274059 - DNA, 15 bp, Homo sapiens
ccttcctctccactg

SEQ ID NO: 4274060 - DNA, 16 bp, Homo sapiens
ccttcctctccactgc

SEQ ID NO: 4274061 - DNA, 21 bp, Homo sapiens
ccttcctctccactgccttcg

SEQ ID NO: 4274062 - DNA, 12 bp, Homo sapiens
ccttcctgggtt

SEQ ID NO: 4274063 - DNA, 15 bp, Homo sapiens
ccttcctgttctgtg

SEQ ID NO: 4274064 - DNA, 22 bp, Homo sapiens
ccttcctgttctgtgtctgctg

SEQ ID NO: 4274065 - DNA, 20 bp, Homo sapiens
ccttcgatacaccgggcctg

SEQ ID NO: 4274066 - DNA, 22 bp, Homo sapiens
ccttctaatccatgtgctgctg

SEQ ID NO: 4274067 - DNA, 14 bp, Homo sapiens
ccttctacctgcag

SEQ ID NO: 4274068 - DNA, 16 bp, Homo sapiens
ccttctacctgcagga

SEQ ID NO: 4274069 - DNA, 14 bp, Homo sapiens
ccttctcccacact

SEQ ID NO: 4274070 - DNA, 12 bp, Homo sapiens
ccttctcccctc

SEQ ID NO: 4274071 - DNA, 15 bp, Homo sapiens
ccttctcccctccag

SEQ ID NO: 4274072 - DNA, 18 bp, Homo sapiens
ccttctcccctccagacc

SEQ ID NO: 4274073 - DNA, 20 bp, Homo sapiens
ccttctcccctccagacccc

SEQ ID NO: 4274074 - DNA, 21 bp, Homo sapiens
ccttctcccctccagacccct

SEQ ID NO: 4274075 - DNA, 22 bp, Homo sapiens
ccttctcccctccagaccccta

SEQ ID NO: 4274076 - DNA, 18 bp, Homo sapiens
ccttctctgttcatttcc

SEQ ID NO: 4274077 - DNA, 15 bp, Homo sapiens
ccttctgatgaaatg

SEQ ID NO: 4274078 - DNA, 22 bp, Homo sapiens
ccttctgcggagcttctccagc

SEQ ID NO: 4274079 - DNA, 23 bp, Homo sapiens
ccttctgcggagcttctccagcc

SEQ ID NO: 4274080 - DNA, 20 bp, Homo sapiens
ccttctggccgctgcagtca

SEQ ID NO: 4274081 - DNA, 18 bp, Homo sapiens
ccttctggctgctgcagt

SEQ ID NO: 4274082 - DNA, 20 bp, Homo sapiens
ccttctggctgctgcagtca

SEQ ID NO: 4274083 - DNA, 13 bp, Homo sapiens
ccttcttccattc

SEQ ID NO: 4274084 - DNA, 16 bp, Homo sapiens
ccttcttccattccca

SEQ ID NO: 4274085 - DNA, 14 bp, Homo sapiens
ccttgagacagctt

SEQ ID NO: 4274086 - DNA, 22 bp, Homo sapiens
ccttgaggacctccacctggga

SEQ ID NO: 4274087 - DNA, 22 bp, Homo sapiens
ccttgatgtcttgagagcgctg

SEQ ID NO: 4274088 - DNA, 21 bp, Homo sapiens
ccttgattttagccttctctg

SEQ ID NO: 4274089 - DNA, 22 bp, Homo sapiens
ccttgattttagccttctctgt

SEQ ID NO: 4274090 - DNA, 16 bp, Homo sapiens
ccttgcaacacacaga

SEQ ID NO: 4274091 - DNA, 18 bp, Homo sapiens
ccttgccgctgggagagc

SEQ ID NO: 4274092 - DNA, 23 bp, Homo sapiens
ccttgccgctgggagagccaagg

SEQ ID NO: 4274093 - DNA, 15 bp, Homo sapiens
ccttgcctcctgtgt

SEQ ID NO: 4274094 - DNA, 13 bp, Homo sapiens
ccttgctgctggc

SEQ ID NO: 4274095 - DNA, 21 bp, Homo sapiens
ccttggacggggacacggcct

SEQ ID NO: 4274096 - DNA, 21 bp, Homo sapiens
ccttggcccagcagcggccca

SEQ ID NO: 4274097 - DNA, 22 bp, Homo sapiens
ccttggcccagcagcggcccag

SEQ ID NO: 4274098 - DNA, 13 bp, Homo sapiens
ccttggcccctct

SEQ ID NO: 4274099 - DNA, 15 bp, Homo sapiens
ccttggcccctctct

SEQ ID NO: 4274100 - DNA, 19 bp, Homo sapiens
ccttgggatgggcacaggc

SEQ ID NO: 4274101 - DNA, 13 bp, Homo sapiens
ccttggttcctcc

SEQ ID NO: 4274102 - DNA, 17 bp, Homo sapiens
ccttggttcctccagca

SEQ ID NO: 4274103 - DNA, 19 bp, Homo sapiens
ccttgtagacgcacctgct

SEQ ID NO: 4274104 - DNA, 21 bp, Homo sapiens
ccttgtagacgcacctgctga

SEQ ID NO: 4274105 - DNA, 23 bp, Homo sapiens
ccttgtgtatgtgactccatatc

SEQ ID NO: 4274106 - DNA, 23 bp, Homo sapiens
ccttgtgtgagtgtgacgggggt

SEQ ID NO: 4274107 - DNA, 22 bp, Homo sapiens
ccttgtttgcctttaggcagga

SEQ ID NO: 4274108 - DNA, 14 bp, Homo sapiens
cctttaggcaggaa

SEQ ID NO: 4274109 - DNA, 20 bp, Homo sapiens
cctttatcatgtgtttctgt

SEQ ID NO: 4274110 - DNA, 18 bp, Homo sapiens
cctttcatcctcagcaag

SEQ ID NO: 4274111 - DNA, 19 bp, Homo sapiens
cctttcatcctcagcaagt

SEQ ID NO: 4274112 - DNA, 14 bp, Homo sapiens
cctttccctgcatc

SEQ ID NO: 4274113 - DNA, 18 bp, Homo sapiens
cctttccctgcatccctt

SEQ ID NO: 4274114 - DNA, 18 bp, Homo sapiens
cctttccgtgccgggagc

SEQ ID NO: 4274115 - DNA, 19 bp, Homo sapiens
cctttctaagcaggaaggt

SEQ ID NO: 4274116 - DNA, 22 bp, Homo sapiens
cctccctcctggctcacagcca

SEQ ID NO: 4274117 - DNA, 14 bp, Homo sapiens
cctccctgcagggt

SEQ ID NO: 4274118 - DNA, 21 bp, Homo sapiens
cctccctgcccctcccttcaa

SEQ ID NO: 4274119 - DNA, 14 bp, Homo sapiens
cctccctgctgcca

SEQ ID NO: 4274120 - DNA, 14 bp, Homo sapiens
cctccctggcctgt

SEQ ID NO: 4274121 - DNA, 15 bp, Homo sapiens
cctccctggcctgtt

SEQ ID NO: 4274122 - DNA, 21 bp, Homo sapiens
cctccgcgggggacaggaaca

SEQ ID NO: 4274123 - DNA, 14 bp, Homo sapiens
cctccggccctgcc

SEQ ID NO: 4274124 - DNA, 19 bp, Homo sapiens
cctccggccctgccccaca

SEQ ID NO: 4274125 - DNA, 21 bp, Homo sapiens
cctcctccagttctgatgagg

SEQ ID NO: 4274126 - DNA, 14 bp, Homo sapiens
cctcctgctgagtg

SEQ ID NO: 4274127 - DNA, 19 bp, Homo sapiens
cctcctggacccagcaggg

SEQ ID NO: 4274128 - DNA, 21 bp, Homo sapiens
cctcctggacccagcaggggc

SEQ ID NO: 4274129 - DNA, 16 bp, Homo sapiens
cctcctggctcacagc

SEQ ID NO: 4274130 - DNA, 17 bp, Homo sapiens
cctcctggctcacagcc

SEQ ID NO: 4274131 - DNA, 20 bp, Homo sapiens
cctcctggctcacagccacc

SEQ ID NO: 4274132 - DNA, 16 bp, Homo sapiens
cctccttagaaaagac

SEQ ID NO: 4274133 - DNA, 14 bp, Homo sapiens
cctccttccaggcc

SEQ ID NO: 4274134 - DNA, 19 bp, Homo sapiens
cctccttccaggccccagg

SEQ ID NO: 4274135 - DNA, 17 bp, Homo sapiens
cctccttctcccctcca

SEQ ID NO: 4274136 - DNA, 19 bp, Homo sapiens
cctccttgccgctgggaga

SEQ ID NO: 4274137 - DNA, 20 bp, Homo sapiens
cctccttgccgctgggagag

SEQ ID NO: 4274138 - DNA, 14 bp, Homo sapiens
cctccttgcctcct

SEQ ID NO: 4274139 - DNA, 20 bp, Homo sapiens
cctccttgcctcctgtgtaa

SEQ ID NO: 4274140 - DNA, 18 bp, Homo sapiens
cctcgcttcataggcaga

SEQ ID NO: 4274141 - DNA, 12 bp, Homo sapiens
cctcggagcctg

SEQ ID NO: 4274142 - DNA, 13 bp, Homo sapiens
cctcggagcctgt

SEQ ID NO: 4274143 - DNA, 18 bp, Homo sapiens
cctcggccagagctccca

SEQ ID NO: 4274144 - DNA, 20 bp, Homo sapiens
cctcggccagagctcccagg

SEQ ID NO: 4274145 - DNA, 13 bp, Homo sapiens
cctcggctgtgtg

SEQ ID NO: 4274146 - DNA, 18 bp, Homo sapiens
cctcgtctccctggccac

SEQ ID NO: 4274147 - DNA, 19 bp, Homo sapiens
cctcgtctccctggccacc

SEQ ID NO: 4274148 - DNA, 18 bp, Homo sapiens
cctcgtctttgcttgtcc

SEQ ID NO: 4274149 - DNA, 20 bp, Homo sapiens
cctctcaggcatgcctgtgt

SEQ ID NO: 4274150 - DNA, 19 bp, Homo sapiens
cctctccactgccttcgat

SEQ ID NO: 4274151 - DNA, 21 bp, Homo sapiens
cctctccccggacaagcccag

SEQ ID NO: 4274152 - DNA, 23 bp, Homo sapiens
cctctccccggacaagcccagga

SEQ ID NO: 4274153 - DNA, 14 bp, Homo sapiens
cctctcctgcatcc

SEQ ID NO: 4274154 - DNA, 16 bp, Homo sapiens
cctctctcagcccagg

SEQ ID NO: 4274155 - DNA, 13 bp, Homo sapiens
cctctctgccagc

SEQ ID NO: 4274156 - DNA, 14 bp, Homo sapiens
cctctctgccagcc

SEQ ID NO: 4274157 - DNA, 15 bp, Homo sapiens
cctctctgccagccg

SEQ ID NO: 4274158 - DNA, 21 bp, Homo sapiens
cctctctggccactctgctct

SEQ ID NO: 4274159 - DNA, 21 bp, Homo sapiens
cctctctgtttaccctccctg

SEQ ID NO: 4274160 - DNA, 19 bp, Homo sapiens
cctctcttaatgccacggc

SEQ ID NO: 4274161 - DNA, 18 bp, Homo sapiens
cctctgaactgctgctgg

SEQ ID NO: 4274162 - DNA, 18 bp, Homo sapiens
cctctgagtgaagtccag

SEQ ID NO: 4274163 - DNA, 20 bp, Homo sapiens
cctctgcaagattctgtggg

SEQ ID NO: 4274164 - DNA, 17 bp, Homo sapiens
cctctgcacgtgcacac

SEQ ID NO: 4274165 - DNA, 17 bp, Homo sapiens
cctctgccactgacagg

SEQ ID NO: 4274166 - DNA, 19 bp, Homo sapiens
cctctgcctgtccctctca

SEQ ID NO: 4274167 - DNA, 17 bp, Homo sapiens
cctctgcctgtgcccgc

SEQ ID NO: 4274168 - DNA, 16 bp, Homo sapiens
cctctgggcaggacct

SEQ ID NO: 4274169 - DNA, 17 bp, Homo sapiens
cctctgggctcacacca

SEQ ID NO: 4274170 - DNA, 16 bp, Homo sapiens
cctctggtctgggtgc

SEQ ID NO: 4274171 - DNA, 16 bp, Homo sapiens
cctctggtttggggcg

SEQ ID NO: 4274172 - DNA, 18 bp, Homo sapiens
cctctggtttggggcgag

SEQ ID NO: 4274173 - DNA, 21 bp, Homo sapiens
cctctggtttggggcgaggca

SEQ ID NO: 4274174 - DNA, 22 bp, Homo sapiens
cctcttcccaccaactctctct

SEQ ID NO: 4274175 - DNA, 12 bp, Homo sapiens
cctcttccccct

SEQ ID NO: 4274176 - DNA, 14 bp, Homo sapiens
cctcttcccccttc

SEQ ID NO: 4274177 - DNA, 15 bp, Homo sapiens
cctcttcccccttcc

SEQ ID NO: 4274178 - DNA, 15 bp, Homo sapiens
cggctgggcccgagg

SEQ ID NO: 4274179 - DNA, 20 bp, Homo sapiens
cgggaaagccagtgactcca

SEQ ID NO: 4274180 - DNA, 20 bp, Homo sapiens
cgggaaaggccggtgggaag

SEQ ID NO: 4274181 - DNA, 14 bp, Homo sapiens
cgggacctgtggct

SEQ ID NO: 4274182 - DNA, 19 bp, Homo sapiens
cgggagatccgccctgggc

SEQ ID NO: 4274183 - DNA, 21 bp, Homo sapiens
cgggagatccgccctgggctc

SEQ ID NO: 4274184 - DNA, 14 bp, Homo sapiens
cgggagcctgcgtg

SEQ ID NO: 4274185 - DNA, 21 bp, Homo sapiens
cgggcacccccggacgccccc

SEQ ID NO: 4274186 - DNA, 12 bp, Homo sapiens
cgggccaaggac

SEQ ID NO: 4274187 - DNA, 17 bp, Homo sapiens
cgggctaagtccagctc

SEQ ID NO: 4274188 - DNA, 19 bp, Homo sapiens
cgggctaagtccagctctc

SEQ ID NO: 4274189 - DNA, 14 bp, Homo sapiens
cggggcagctgcca

SEQ ID NO: 4274190 - DNA, 13 bp, Homo sapiens
cggggcaggaagt

SEQ ID NO: 4274191 - DNA, 17 bp, Homo sapiens
cggggcaggaagtccct

SEQ ID NO: 4274192 - DNA, 22 bp, Homo sapiens
cggggccagcatccatgcggcc

SEQ ID NO: 4274193 - DNA, 14 bp, Homo sapiens
cggggccaggatgg

SEQ ID NO: 4274194 - DNA, 11 bp, Homo sapiens
cggggccatgg

SEQ ID NO: 4274195 - DNA, 13 bp, Homo sapiens
cgggggacaggaa

SEQ ID NO: 4274196 - DNA, 18 bp, Homo sapiens
cgggggaggccgaggcag

SEQ ID NO: 4274197 - DNA, 19 bp, Homo sapiens
cgggggaggccgaggcagg

SEQ ID NO: 4274198 - DNA, 17 bp, Homo sapiens
cggggtcctgaggctgg

SEQ ID NO: 4274199 - DNA, 11 bp, Homo sapiens
cgggtctgtgg

SEQ ID NO: 4274200 - DNA, 15 bp, Homo sapiens
cgggtgcctgtgacc

SEQ ID NO: 4274201 - DNA, 22 bp, Homo sapiens
cgggtgcctgtgaccggggtcc

SEQ ID NO: 4274202 - DNA, 19 bp, Homo sapiens
cgggtttggcgggccaagg

SEQ ID NO: 4274203 - DNA, 23 bp, Homo sapiens
cgggtttggcgggccaaggactg

SEQ ID NO: 4274204 - DNA, 13 bp, Homo sapiens
cggtgagactctg

SEQ ID NO: 4274205 - DNA, 16 bp, Homo sapiens
cggtgagactctgagg

SEQ ID NO: 4274206 - DNA, 23 bp, Homo sapiens
cggtgcagtggcaaaggatccag

SEQ ID NO: 4274207 - DNA, 21 bp, Homo sapiens
cggtgggagccgtcagcctgt

SEQ ID NO: 4274208 - DNA, 21 bp, Homo sapiens
cggtgtagggaacggcctgag

SEQ ID NO: 4274209 - DNA, 17 bp, Homo sapiens
cggttgtaggactaaat

SEQ ID NO: 4274210 - DNA, 15 bp, Homo sapiens
cgtatgttatacaac

SEQ ID NO: 4274211 - DNA, 21 bp, Homo sapiens
cgtcacagcagtacttgctca

SEQ ID NO: 4274212 - DNA, 18 bp, Homo sapiens
cgtcaccatctcaggcca

SEQ ID NO: 4274213 - DNA, 16 bp, Homo sapiens
cgtccacggctctagg

SEQ ID NO: 4274214 - DNA, 15 bp, Homo sapiens
cgtccctctccccgg

SEQ ID NO: 4274215 - DNA, 20 bp, Homo sapiens
cgtccctgagggcccttccc

SEQ ID NO: 4274216 - DNA, 23 bp, Homo sapiens
cgtccctgagggcccttcccaac

SEQ ID NO: 4274217 - DNA, 15 bp, Homo sapiens
cgtcctggcagggca

SEQ ID NO: 4274218 - DNA, 20 bp, Homo sapiens
cgtctccctggccacccttg

SEQ ID NO: 4274219 - DNA, 22 bp, Homo sapiens
cgtctgagcggccgcctgtcct

SEQ ID NO: 4274220 - DNA, 14 bp, Homo sapiens
cgtctggtgttctc

SEQ ID NO: 4274221 - DNA, 15 bp, Homo sapiens
cgtcttgtattttct

SEQ ID NO: 4274222 - DNA, 19 bp, Homo sapiens
cgtgacttcagactctctc

SEQ ID NO: 4274223 - DNA, 22 bp, Homo sapiens
cgtgacttcagactctctcctc

SEQ ID NO: 4274224 - DNA, 19 bp, Homo sapiens
cgtgagagcccaatcactg

SEQ ID NO: 4274225 - DNA, 12 bp, Homo sapiens
cgtgaggagggg

SEQ ID NO: 4274226 - DNA, 13 bp, Homo sapiens
cgtgaggaggggg

SEQ ID NO: 4274227 - DNA, 12 bp, Homo sapiens
cgtgcacacacc

SEQ ID NO: 4274228 - DNA, 18 bp, Homo sapiens
cgtgcacacacctgcaca

SEQ ID NO: 4274229 - DNA, 17 bp, Homo sapiens
cgtgccaaatcctgggc

SEQ ID NO: 4274230 - DNA, 21 bp, Homo sapiens
accagatgacacataaatctg

SEQ ID NO: 4274231 - DNA, 15 bp, Homo sapiens
accagcagcacaatt

SEQ ID NO: 4274232 - DNA, 12 bp, Homo sapiens
accagccctggt

SEQ ID NO: 4274233 - DNA, 15 bp, Homo sapiens
accagcctcagtgca

SEQ ID NO: 4274234 - DNA, 13 bp, Homo sapiens
accagctggctct

SEQ ID NO: 4274235 - DNA, 14 bp, Homo sapiens
accagctggctctg

SEQ ID NO: 4274236 - DNA, 22 bp, Homo sapiens
accaggaaattctgtttatgtt

SEQ ID NO: 4274237 - DNA, 15 bp, Homo sapiens
accaggaagaaggcc

SEQ ID NO: 4274238 - DNA, 14 bp, Homo sapiens
accaggaaggaaga

SEQ ID NO: 4274239 - DNA, 16 bp, Homo sapiens
accaggaaggaagagc

SEQ ID NO: 4274240 - DNA, 20 bp, Homo sapiens
accaggaaggaagagcaagc

SEQ ID NO: 4274241 - DNA, 22 bp, Homo sapiens
accaggactctgccttccaggc

SEQ ID NO: 4274242 - DNA, 22 bp, Homo sapiens
accagggggaagcaccagcctc

SEQ ID NO: 4274243 - DNA, 14 bp, Homo sapiens
accagggtttagtt

SEQ ID NO: 4274244 - DNA, 15 bp, Homo sapiens
accagtcttttgaaa

SEQ ID NO: 4274245 - DNA, 13 bp, Homo sapiens
accatagaactgt

SEQ ID NO: 4274246 - DNA, 15 bp, Homo sapiens
accatagcttaagaa

SEQ ID NO: 4274247 - DNA, 19 bp, Homo sapiens
accatagcttaagaagtat

SEQ ID NO: 4274248 - DNA, 18 bp, Homo sapiens
accatatgattgaaaaga

SEQ ID NO: 4274249 - DNA, 19 bp, Homo sapiens
accatatgattgaaaagaa

SEQ ID NO: 4274250 - DNA, 21 bp, Homo sapiens
accatccatccctggtgaaag

SEQ ID NO: 4274251 - DNA, 18 bp, Homo sapiens
accatcccctcctagcac

SEQ ID NO: 4274252 - DNA, 13 bp, Homo sapiens
accatctcaggcc

SEQ ID NO: 4274253 - DNA, 15 bp, Homo sapiens
accatctcaggccac

SEQ ID NO: 4274254 - DNA, 16 bp, Homo sapiens
accatctcaggccacc

SEQ ID NO: 4274255 - DNA, 21 bp, Homo sapiens
accatctcaggccacctgccc

SEQ ID NO: 4274256 - DNA, 17 bp, Homo sapiens
accatgaagaacataaa

SEQ ID NO: 4274257 - DNA, 17 bp, Homo sapiens
accatgaagatgccatt

SEQ ID NO: 4274258 - DNA, 18 bp, Homo sapiens
acctgcacaccgtccctc

SEQ ID NO: 4274259 - DNA, 21 bp, Homo sapiens
acctgcacaccgtccctctcc

SEQ ID NO: 4274260 - DNA, 13 bp, Homo sapiens
acctgcagcccca

SEQ ID NO: 4274261 - DNA, 18 bp, Homo sapiens
acctgcagccccaggcct

SEQ ID NO: 4274262 - DNA, 19 bp, Homo sapiens
acctgcagccccaggcctc

SEQ ID NO: 4274263 - DNA, 18 bp, Homo sapiens
acctgcaggactcgggct

SEQ ID NO: 4274264 - DNA, 15 bp, Homo sapiens
acctgcagttggcct

SEQ ID NO: 4274265 - DNA, 20 bp, Homo sapiens
acctgcagttggcctcagca

SEQ ID NO: 4274266 - DNA, 22 bp, Homo sapiens
acctgcagttggcctcagcaga

SEQ ID NO: 4274267 - DNA, 18 bp, Homo sapiens
acctgcccccactcagca

SEQ ID NO: 4274268 - DNA, 15 bp, Homo sapiens
acctgcccccgctct

SEQ ID NO: 4274269 - DNA, 17 bp, Homo sapiens
acctgcccccttctccc

SEQ ID NO: 4274270 - DNA, 19 bp, Homo sapiens
acctgcccccttctcccac

SEQ ID NO: 4274271 - DNA, 23 bp, Homo sapiens
acctgcccccttctcccacactg

SEQ ID NO: 4274272 - DNA, 23 bp, Homo sapiens
acctgctgcccgtgaggaggggg

SEQ ID NO: 4274273 - DNA, 14 bp, Homo sapiens
acctgctggcccct

SEQ ID NO: 4274274 - DNA, 15 bp, Homo sapiens
acctgctggcccctc

SEQ ID NO: 4274275 - DNA, 16 bp, Homo sapiens
acctgctggcccctca

SEQ ID NO: 4274276 - DNA, 19 bp, Homo sapiens
acctgctggcccctcacct

SEQ ID NO: 4274277 - DNA, 21 bp, Homo sapiens
acctgcttgtgttgggcccca

SEQ ID NO: 4274278 - DNA, 15 bp, Homo sapiens
acctggatggatctg

SEQ ID NO: 4274279 - DNA, 21 bp, Homo sapiens
actccagacccctggcttttc

SEQ ID NO: 4274280 - DNA, 13 bp, Homo sapiens
actccaggagagg

SEQ ID NO: 4274281 - DNA, 14 bp, Homo sapiens
actccaggagagga

SEQ ID NO: 4274282 - DNA, 19 bp, Homo sapiens
actccagggttaaagaaag

SEQ ID NO: 4274283 - DNA, 23 bp, Homo sapiens
actccatatcccgggagcagttg

SEQ ID NO: 4274284 - DNA, 14 bp, Homo sapiens
actcccaggggcct

SEQ ID NO: 4274285 - DNA, 17 bp, Homo sapiens
actccccttgagctgag

SEQ ID NO: 4274286 - DNA, 14 bp, Homo sapiens
actcctacctggta

SEQ ID NO: 4274287 - DNA, 14 bp, Homo sapiens
actccttctcccca

SEQ ID NO: 4274288 - DNA, 23 bp, Homo sapiens
actccttgattttagccttctct

SEQ ID NO: 4274289 - DNA, 20 bp, Homo sapiens
actcgggctaagtccagctc

SEQ ID NO: 4274290 - DNA, 21 bp, Homo sapiens
actcgggctaagtccagctct

SEQ ID NO: 4274291 - DNA, 22 bp, Homo sapiens
actctattttttactacataat

SEQ ID NO: 4274292 - DNA, 14 bp, Homo sapiens
actctcctgaggag

SEQ ID NO: 4274293 - DNA, 15 bp, Homo sapiens
actctctcctctctc

SEQ ID NO: 4274294 - DNA, 18 bp, Homo sapiens
aaagaggcgtcttgtatt

SEQ ID NO: 4274295 - DNA, 21 bp, Homo sapiens
aaagatggtaatcttttctga

SEQ ID NO: 4274296 - DNA, 15 bp, Homo sapiens
aaagattaacaacac

SEQ ID NO: 4274297 - DNA, 17 bp, Homo sapiens
aaagattttatgtgctt

SEQ ID NO: 4274298 - DNA, 23 bp, Homo sapiens
aaagattttatgtgcttgaagat

SEQ ID NO: 4274299 - DNA, 12 bp, Homo sapiens
aaagcacatcca

SEQ ID NO: 4274300 - DNA, 17 bp, Homo sapiens
aaagcatattgactttt

SEQ ID NO: 4274301 - DNA, 20 bp, Homo sapiens
aaagcatctattcccaaaga

SEQ ID NO: 4274302 - DNA, 18 bp, Homo sapiens
aaagccacataaccagcg

SEQ ID NO: 4274303 - DNA, 14 bp, Homo sapiens
aaaggaaacctttt

SEQ ID NO: 4274304 - DNA, 22 bp, Homo sapiens
aaaggactgttttttcctgagc

SEQ ID NO: 4274305 - DNA, 21 bp, Homo sapiens
aaaggatccagatagcctagg

SEQ ID NO: 4274306 - DNA, 20 bp, Homo sapiens
aaaggcccaaaccaggggga

SEQ ID NO: 4274307 - DNA, 17 bp, Homo sapiens
aaaggctggtggacaga

SEQ ID NO: 4274308 - DNA, 19 bp, Homo sapiens
aaagggcagcccctcccca

SEQ ID NO: 4274309 - DNA, 11 bp, Homo sapiens
aaagggcagga

SEQ ID NO: 4274310 - DNA, 16 bp, Homo sapiens
aaaggtcatattggaa

SEQ ID NO: 4274311 - DNA, 12 bp, Homo sapiens
aaagtagtactt

SEQ ID NO: 4274312 - DNA, 17 bp, Homo sapiens
aaagtatctctactttc

SEQ ID NO: 4274313 - DNA, 21 bp, Homo sapiens
aaagtatctctactttcctga

SEQ ID NO: 4274314 - DNA, 23 bp, Homo sapiens
aaagtcacagccgtttgaatata

SEQ ID NO: 4274315 - DNA, 14 bp, Homo sapiens
aaagtcagatgttt

SEQ ID NO: 4274316 - DNA, 18 bp, Homo sapiens
aaagtctcaatgaaatag

SEQ ID NO: 4274317 - DNA, 14 bp, Homo sapiens
aaagtctcctgtat

SEQ ID NO: 4274318 - DNA, 17 bp, Homo sapiens
aaagtctcctgtatcat

SEQ ID NO: 4274319 - DNA, 17 bp, Homo sapiens
aaagtctgtctgcactg

SEQ ID NO: 4274320 - DNA, 19 bp, Homo sapiens
aaagtgagaaaactgtgac

SEQ ID NO: 4274321 - DNA, 14 bp, Homo sapiens
aaagtgcactgtgt

SEQ ID NO: 4274322 - DNA, 15 bp, Homo sapiens
aaagtgcactgtgtc

SEQ ID NO: 4274323 - DNA, 21 bp, Homo sapiens
aaagtgctttgctggagtcct

SEQ ID NO: 4274324 - DNA, 23 bp, Homo sapiens
aaagtgctttgctggagtcctgt

SEQ ID NO: 4274325 - DNA, 16 bp, Homo sapiens
aaagtgtaaaatagaa

SEQ ID NO: 4274326 - DNA, 17 bp, Homo sapiens
aaagtgtaaaatagaat

SEQ ID NO: 4274327 - DNA, 16 bp, Homo sapiens
aaagttaatcttcatg

SEQ ID NO: 4274328 - DNA, 20 bp, Homo sapiens
aaagttagggcatttttctt

SEQ ID NO: 4274329 - DNA, 22 bp, Homo sapiens
aaagttagggcatttttcttgg

SEQ ID NO: 4274330 - DNA, 12 bp, Homo sapiens
aaagttttcaga

SEQ ID NO: 4274331 - DNA, 18 bp, Homo sapiens
aaataaaacttgagccca

SEQ ID NO: 4274332 - DNA, 14 bp, Homo sapiens
aaataaaccttaat

SEQ ID NO: 4274333 - DNA, 16 bp, Homo sapiens
aaataaataatctcat

SEQ ID NO: 4274334 - DNA, 19 bp, Homo sapiens
aaataaataatctcatccc

SEQ ID NO: 4274335 - DNA, 14 bp, Homo sapiens
aaataacatattct

SEQ ID NO: 4274336 - DNA, 20 bp, Homo sapiens
aaataacatattcttgcttt

SEQ ID NO: 4274337 - DNA, 16 bp, Homo sapiens
aaataaccaaaaaatg

SEQ ID NO: 4274338 - DNA, 12 bp, Homo sapiens
aaataactgtgc

SEQ ID NO: 4274339 - DNA, 13 bp, Homo sapiens
aaataatgattta

SEQ ID NO: 4274340 - DNA, 21 bp, Homo sapiens
aaatacatgcctttccagtgc

SEQ ID NO: 4274341 - DNA, 13 bp, Homo sapiens
aaatacattccag

SEQ ID NO: 4274342 - DNA, 15 bp, Homo sapiens
aaatagtgttctttt

SEQ ID NO: 4274343 - DNA, 21 bp, Homo sapiens
aaatagtgttctttttaaaaa

SEQ ID NO: 4274344 - DNA, 18 bp, Homo sapiens
aaatagtttcaaatgagt

SEQ ID NO: 4274345 - DNA, 21 bp, Homo sapiens
aaatagtttcaaatgagttta

SEQ ID NO: 4274346 - DNA, 13 bp, Homo sapiens
aaatagttttcta

SEQ ID NO: 4274347 - DNA, 19 bp, Homo sapiens
aaatagttttctaaatgtt

SEQ ID NO: 4274348 - DNA, 21 bp, Homo sapiens
aaatagttttctaaatgtttc

SEQ ID NO: 4274349 - DNA, 16 bp, Homo sapiens
aaatatatatttatca

SEQ ID NO: 4274350 - DNA, 15 bp, Homo sapiens
aaatatctgtgaaat

SEQ ID NO: 4274351 - DNA, 21 bp, Homo sapiens
aaatatctgtgaaatatcatc

SEQ ID NO: 4274352 - DNA, 15 bp, Homo sapiens
aaatatcttgaaagg

SEQ ID NO: 4274353 - DNA, 13 bp, Homo sapiens
aaatatttctaag

SEQ ID NO: 4274354 - DNA, 16 bp, Homo sapiens
aaatatttgcttattt

SEQ ID NO: 4274355 - DNA, 22 bp, Homo sapiens
aaatcaacttgtcacaaagtga

SEQ ID NO: 4274356 - DNA, 16 bp, Homo sapiens
aaatcagaatctttaa

SEQ ID NO: 4274357 - DNA, 14 bp, Homo sapiens
aaatcagtcttgga

SEQ ID NO: 4274358 - DNA, 22 bp, Homo sapiens
aaatcatatttacctgtgaatc

SEQ ID NO: 4274359 - DNA, 11 bp, Homo sapiens
aaatcatcaaa

SEQ ID NO: 4274360 - DNA, 17 bp, Homo sapiens
aaatcatcaaagtgttt

SEQ ID NO: 4274361 - DNA, 21 bp, Homo sapiens
aaatccattttctaaactgtt

SEQ ID NO: 4274362 - DNA, 12 bp, Homo sapiens
aaatctgagcct

SEQ ID NO: 4274363 - DNA, 11 bp, Homo sapiens
aaatgaagaaa

SEQ ID NO: 4274364 - DNA, 14 bp, Homo sapiens
aaatgaatagtaca

SEQ ID NO: 4274365 - DNA, 14 bp, Homo sapiens
aaatgattccaaat

SEQ ID NO: 4274366 - DNA, 15 bp, Homo sapiens
aaatgattccaaata

SEQ ID NO: 4274367 - DNA, 17 bp, Homo sapiens
aaatgcaaagcacacct

SEQ ID NO: 4274368 - DNA, 16 bp, Homo sapiens
aaatgcatgatattgt

SEQ ID NO: 4274369 - DNA, 14 bp, Homo sapiens
aaatgctaatgtaa

SEQ ID NO: 4274370 - DNA, 21 bp, Homo sapiens
aaatgctgatttaaacttctt

SEQ ID NO: 4274371 - DNA, 13 bp, Homo sapiens
aaatgctgtatgt

SEQ ID NO: 4274372 - DNA, 15 bp, Homo sapiens
aaatggaacattaac

SEQ ID NO: 4274373 - DNA, 13 bp, Homo sapiens
aaatgtaactgtc

SEQ ID NO: 4274374 - DNA, 21 bp, Homo sapiens
aaatgtagcttcagtcattaa

SEQ ID NO: 4274375 - DNA, 13 bp, Homo sapiens
aaatgtattatgt

SEQ ID NO: 4274376 - DNA, 23 bp, Homo sapiens
aaatgtattatgtcctgtgagat

SEQ ID NO: 4274377 - DNA, 13 bp, Homo sapiens
aaatgtcctcaga

SEQ ID NO: 4274378 - DNA, 23 bp, Homo sapiens
aaatgttaacaatgcctattgta

SEQ ID NO: 4274379 - DNA, 16 bp, Homo sapiens
aaatgtttctttttct

SEQ ID NO: 4274380 - DNA, 20 bp, Homo sapiens
aaattacagaagaagctcct

SEQ ID NO: 4274381 - DNA, 13 bp, Homo sapiens
aaattagtgagat

SEQ ID NO: 4274382 - DNA, 15 bp, Homo sapiens
aaattagtgagattt

SEQ ID NO: 4274383 - DNA, 17 bp, Homo sapiens
aaattatttctaaaaca

SEQ ID NO: 4274384 - DNA, 21 bp, Homo sapiens
aaattatttctaaaacattaa

SEQ ID NO: 4274385 - DNA, 14 bp, Homo sapiens
aaattcaacaaatg

SEQ ID NO: 4274386 - DNA, 16 bp, Homo sapiens
aaattcaacaaatgat

SEQ ID NO: 4274387 - DNA, 20 bp, Homo sapiens
aaattcaacacttattttct

SEQ ID NO: 4274388 - DNA, 13 bp, Homo sapiens
aaattcacactgt

SEQ ID NO: 4274389 - DNA, 14 bp, Homo sapiens
aaattctagattac

SEQ ID NO: 4274390 - DNA, 16 bp, Homo sapiens
aaattgatgggtgggc

SEQ ID NO: 4274391 - DNA, 18 bp, Homo sapiens
aaattgcatttcctgaca

SEQ ID NO: 4274392 - DNA, 15 bp, Homo sapiens
aaattggtgataagt

SEQ ID NO: 4274393 - DNA, 19 bp, Homo sapiens
aaattggtgataagtggaa

SEQ ID NO: 4274394 - DNA, 14 bp, Homo sapiens
aaatttaatatact

SEQ ID NO: 4274395 - DNA, 21 bp, Homo sapiens
aaatttattcttatcttagga

SEQ ID NO: 4274396 - DNA, 17 bp, Homo sapiens
aaatttcacgattcatt

SEQ ID NO: 4274397 - DNA, 21 bp, Homo sapiens
aaatttcacgattcatttttg

SEQ ID NO: 4274398 - DNA, 13 bp, Homo sapiens
aacaaagaaatat

SEQ ID NO: 4274399 - DNA, 12 bp, Homo sapiens
aacaaattaaaa

SEQ ID NO: 4274400 - DNA, 21 bp, Homo sapiens
aacaactccaggaaaactgtt

SEQ ID NO: 4274401 - DNA, 15 bp, Homo sapiens
aacaagaggagcagg

SEQ ID NO: 4274402 - DNA, 14 bp, Homo sapiens
aacaagatttccct

SEQ ID NO: 4274403 - DNA, 22 bp, Homo sapiens
aacaagccaaacattcttattt

SEQ ID NO: 4274404 - DNA, 19 bp, Homo sapiens
aacaataaaagtgtccatt

SEQ ID NO: 4274405 - DNA, 17 bp, Homo sapiens
aacaatgcctattgtaa

SEQ ID NO: 4274406 - DNA, 15 bp, Homo sapiens
aacaattaattgtct

SEQ ID NO: 4274407 - DNA, 20 bp, Homo sapiens
aacacaagccacgcctgcga

SEQ ID NO: 4274408 - DNA, 12 bp, Homo sapiens
aacacaatcaaa

SEQ ID NO: 4274409 - DNA, 11 bp, Homo sapiens
aacacagctgt

SEQ ID NO: 4274410 - DNA, 12 bp, Homo sapiens
aacacatttcgt

SEQ ID NO: 4274411 - DNA, 15 bp, Homo sapiens
aacacctaagtgact

SEQ ID NO: 4274412 - DNA, 13 bp, Homo sapiens
aacacgtttagaa

SEQ ID NO: 4274413 - DNA, 12 bp, Homo sapiens
aacactggcccc

SEQ ID NO: 4274414 - DNA, 17 bp, Homo sapiens
aacacttattttctgaa

SEQ ID NO: 4274415 - DNA, 15 bp, Homo sapiens
aacagagtatatatg

SEQ ID NO: 4274416 - DNA, 17 bp, Homo sapiens
aacagagtatatatgta

SEQ ID NO: 4274417 - DNA, 16 bp, Homo sapiens
aacagatgtttgtttt

SEQ ID NO: 4274418 - DNA, 23 bp, Homo sapiens
aacagctaggttaataggaggac

SEQ ID NO: 4274419 - DNA, 14 bp, Homo sapiens
aacaggaccaggag

SEQ ID NO: 4274420 - DNA, 18 bp, Homo sapiens
aacaggaccaggagccag

SEQ ID NO: 4274421 - DNA, 21 bp, Homo sapiens
aacaggcgttctcagcctccg

SEQ ID NO: 4274422 - DNA, 14 bp, Homo sapiens
aacagtaatcagtt

SEQ ID NO: 4274423 - DNA, 14 bp, Homo sapiens
aacagtgtttccag

SEQ ID NO: 4274424 - DNA, 15 bp, Homo sapiens
aacagtgtttccagt

SEQ ID NO: 4274425 - DNA, 22 bp, Homo sapiens
aacagttctcccttcaactgta

SEQ ID NO: 4274426 - DNA, 15 bp, Homo sapiens
aacagttgcacagca

SEQ ID NO: 4274427 - DNA, 16 bp, Homo sapiens
aacataatatcttgaa

SEQ ID NO: 4274428 - DNA, 22 bp, Homo sapiens
aacataatatcttgaagaatat

SEQ ID NO: 4274429 - DNA, 18 bp, Homo sapiens
agccgagctctcctgggc

SEQ ID NO: 4274430 - DNA, 23 bp, Homo sapiens
agccggactttcggagttggggg

SEQ ID NO: 4274431 - DNA, 15 bp, Homo sapiens
agccggggagctgag

SEQ ID NO: 4274432 - DNA, 23 bp, Homo sapiens
agccggggagctgaggggcaggg

SEQ ID NO: 4274433 - DNA, 16 bp, Homo sapiens
agccgtgccttcagct

SEQ ID NO: 4274434 - DNA, 13 bp, Homo sapiens
agccgtggcttcc

SEQ ID NO: 4274435 - DNA, 20 bp, Homo sapiens
agcctaggggtcagggacca

SEQ ID NO: 4274436 - DNA, 17 bp, Homo sapiens
agcctagggtgagggtg

SEQ ID NO: 4274437 - DNA, 11 bp, Homo sapiens
agcctatggca

SEQ ID NO: 4274438 - DNA, 14 bp, Homo sapiens
agcctcaaatgcag

SEQ ID NO: 4274439 - DNA, 14 bp, Homo sapiens
agcctcacccctgc

SEQ ID NO: 4274440 - DNA, 11 bp, Homo sapiens
agcctcacctt

SEQ ID NO: 4274441 - DNA, 13 bp, Homo sapiens
agcctcagccact

SEQ ID NO: 4274442 - DNA, 14 bp, Homo sapiens
agcctcaggcctgg

SEQ ID NO: 4274443 - DNA, 16 bp, Homo sapiens
agcctccacctgcagc

SEQ ID NO: 4274444 - DNA, 19 bp, Homo sapiens
agcctccacctgcagcccc

SEQ ID NO: 4274445 - DNA, 18 bp, Homo sapiens
agcctccactccctgtct

SEQ ID NO: 4274446 - DNA, 21 bp, Homo sapiens
agcctccactccctgtctgaa

SEQ ID NO: 4274447 - DNA, 21 bp, Homo sapiens
agcctccctcagccacgcctc

SEQ ID NO: 4274448 - DNA, 14 bp, Homo sapiens
agcctcctgctgag

SEQ ID NO: 4274449 - DNA, 15 bp, Homo sapiens
agcctcgcccctcca

SEQ ID NO: 4274450 - DNA, 21 bp, Homo sapiens
agcctgcgtggcctggggctg

SEQ ID NO: 4274451 - DNA, 18 bp, Homo sapiens
agcctggacacagtcagg

SEQ ID NO: 4274452 - DNA, 18 bp, Homo sapiens
agcctggcacagggcagt

SEQ ID NO: 4274453 - DNA, 20 bp, Homo sapiens
agcctggcacagggcagtgg

SEQ ID NO: 4274454 - DNA, 17 bp, Homo sapiens
agcctggcccagtgaga

SEQ ID NO: 4274455 - DNA, 13 bp, Homo sapiens
agcctgggccact

SEQ ID NO: 4274456 - DNA, 19 bp, Homo sapiens
agcctgggccactggcatc

SEQ ID NO: 4274457 - DNA, 22 bp, Homo sapiens
agcctgggccactggcatctct

SEQ ID NO: 4274458 - DNA, 21 bp, Homo sapiens
agcctggggtgggtgtgagca

SEQ ID NO: 4274459 - DNA, 17 bp, Homo sapiens
agcctgtgaactgccag

SEQ ID NO: 4274460 - DNA, 16 bp, Homo sapiens
agcctgtggcctcagc

SEQ ID NO: 4274461 - DNA, 17 bp, Homo sapiens
agcctgtggcctcagca

SEQ ID NO: 4274462 - DNA, 13 bp, Homo sapiens
agcctgtgggaga

SEQ ID NO: 4274463 - DNA, 15 bp, Homo sapiens
agcctgtgggtcctt

SEQ ID NO: 4274464 - DNA, 17 bp, Homo sapiens
agccttaagtcttactg

SEQ ID NO: 4274465 - DNA, 22 bp, Homo sapiens
agccttaagtcttactgttttg

SEQ ID NO: 4274466 - DNA, 18 bp, Homo sapiens
agccttagtttcagctga

SEQ ID NO: 4274467 - DNA, 23 bp, Homo sapiens
agccttggggattcttccatctg

SEQ ID NO: 4274468 - DNA, 17 bp, Homo sapiens
agccttttattaacata

SEQ ID NO: 4274469 - DNA, 19 bp, Homo sapiens
agccttttattaacatata

SEQ ID NO: 4274470 - DNA, 21 bp, Homo sapiens
agcgaggcagaatggtgggct

SEQ ID NO: 4274471 - DNA, 20 bp, Homo sapiens
agcgcacctcgccgtgtctt

SEQ ID NO: 4274472 - DNA, 15 bp, Homo sapiens
agcgcccctccctag

SEQ ID NO: 4274473 - DNA, 17 bp, Homo sapiens
agcgctcctctgccttg

SEQ ID NO: 4274474 - DNA, 16 bp, Homo sapiens
agcgctggcctcttcc

SEQ ID NO: 4274475 - DNA, 16 bp, Homo sapiens
agcggccgcctgtcct

SEQ ID NO: 4274476 - DNA, 12 bp, Homo sapiens
agcggcctgggg

SEQ ID NO: 4274477 - DNA, 22 bp, Homo sapiens
agcggcttccccattgccttct

SEQ ID NO: 4274478 - DNA, 16 bp, Homo sapiens
agcgggtaaaaagaga

SEQ ID NO: 4274479 - DNA, 17 bp, Homo sapiens
agcgggtaaaaagagaa

SEQ ID NO: 4274480 - DNA, 21 bp, Homo sapiens
agcgtgtcctatccccggacc

SEQ ID NO: 4274481 - DNA, 18 bp, Homo sapiens
agctaaattacaattgtc

SEQ ID NO: 4274482 - DNA, 17 bp, Homo sapiens
agctaacactggcccct

SEQ ID NO: 4274483 - DNA, 16 bp, Homo sapiens
agctaatcagcattct

SEQ ID NO: 4274484 - DNA, 21 bp, Homo sapiens
agctaatcagcattctcactc

SEQ ID NO: 4274485 - DNA, 18 bp, Homo sapiens
agctataaaatgaataca

SEQ ID NO: 4274486 - DNA, 17 bp, Homo sapiens
agctataacaactctat

SEQ ID NO: 4274487 - DNA, 19 bp, Homo sapiens
agctataacaactctattt

SEQ ID NO: 4274488 - DNA, 16 bp, Homo sapiens
agctatatatgaataa

SEQ ID NO: 4274489 - DNA, 21 bp, Homo sapiens
agctatgaagagctagagaaa

SEQ ID NO: 4274490 - DNA, 15 bp, Homo sapiens
agctatgagagatgt

SEQ ID NO: 4274491 - DNA, 22 bp, Homo sapiens
agctatgctgtatctgtgcttt

SEQ ID NO: 4274492 - DNA, 16 bp, Homo sapiens
agctcaccctgctcct

SEQ ID NO: 4274493 - DNA, 17 bp, Homo sapiens
agctcacttcaagctca

SEQ ID NO: 4274494 - DNA, 14 bp, Homo sapiens
agctcagcacagcc

SEQ ID NO: 4274495 - DNA, 11 bp, Homo sapiens
agctcagccca

SEQ ID NO: 4274496 - DNA, 14 bp, Homo sapiens
agctcagcccaccc

SEQ ID NO: 4274497 - DNA, 14 bp, Homo sapiens
agctcaggagaagg

SEQ ID NO: 4274498 - DNA, 16 bp, Homo sapiens
agctcaggccctggtg

SEQ ID NO: 4274499 - DNA, 14 bp, Homo sapiens
agctcagggctgga

SEQ ID NO: 4274500 - DNA, 21 bp, Homo sapiens
agctcagggctggattggcag

SEQ ID NO: 4274501 - DNA, 22 bp, Homo sapiens
agctcagggctggattggcagg

SEQ ID NO: 4274502 - DNA, 23 bp, Homo sapiens
agctcagggctggattggcaggt

SEQ ID NO: 4274503 - DNA, 23 bp, Homo sapiens
agctcagggtgctccctcctcag

SEQ ID NO: 4274504 - DNA, 17 bp, Homo sapiens
agctcatcttcactgca

SEQ ID NO: 4274505 - DNA, 16 bp, Homo sapiens
agctccagacccccag

SEQ ID NO: 4274506 - DNA, 17 bp, Homo sapiens
agctccagacccccagc

SEQ ID NO: 4274507 - DNA, 21 bp, Homo sapiens
agctcccaggacgcagggaga

SEQ ID NO: 4274508 - DNA, 19 bp, Homo sapiens
agctcctgaatccctttca

SEQ ID NO: 4274509 - DNA, 13 bp, Homo sapiens
agctcgtgtgctt

SEQ ID NO: 4274510 - DNA, 17 bp, Homo sapiens
agctcgtgtgcttagaa

SEQ ID NO: 4274511 - DNA, 17 bp, Homo sapiens
agctctagacaaccctg

SEQ ID NO: 4274512 - DNA, 21 bp, Homo sapiens
agctctcccctgcgcaggccc

SEQ ID NO: 4274513 - DNA, 14 bp, Homo sapiens
agctctcctgggcc

SEQ ID NO: 4274514 - DNA, 18 bp, Homo sapiens
agctctcctgggccaggg

SEQ ID NO: 4274515 - DNA, 13 bp, Homo sapiens
agctcttcatgtt

SEQ ID NO: 4274516 - DNA, 16 bp, Homo sapiens
agctcttcatgtttca

SEQ ID NO: 4274517 - DNA, 16 bp, Homo sapiens
agctcttggcaggagt

SEQ ID NO: 4274518 - DNA, 21 bp, Homo sapiens
agctgaccagaagtggcagga

SEQ ID NO: 4274519 - DNA, 22 bp, Homo sapiens
agctgaccagaagtggcaggag

SEQ ID NO: 4274520 - DNA, 14 bp, Homo sapiens
agctgagctggcct

SEQ ID NO: 4274521 - DNA, 10 bp, Homo sapiens
agctgagggg

SEQ ID NO: 4274522 - DNA, 16 bp, Homo sapiens
agctgaggggcagggc

SEQ ID NO: 4274523 - DNA, 16 bp, Homo sapiens
agctgcaggaatcaaa

SEQ ID NO: 4274524 - DNA, 13 bp, Homo sapiens
agctgcttctgcc

SEQ ID NO: 4274525 - DNA, 15 bp, Homo sapiens
agctgcttctgccca

SEQ ID NO: 4274526 - DNA, 15 bp, Homo sapiens
agctggcaggagaca

SEQ ID NO: 4274527 - DNA, 15 bp, Homo sapiens
agctggcaggagggt

SEQ ID NO: 4274528 - DNA, 22 bp, Homo sapiens
agctggccgtggagtcgagctg

SEQ ID NO: 4274529 - DNA, 13 bp, Homo sapiens
agctggctctgca

SEQ ID NO: 4274530 - DNA, 18 bp, Homo sapiens
agctgtacaaagggaagc

SEQ ID NO: 4274531 - DNA, 11 bp, Homo sapiens
agctgtgccag

SEQ ID NO: 4274532 - DNA, 17 bp, Homo sapiens
agctgtgccagctgctt

SEQ ID NO: 4274533 - DNA, 20 bp, Homo sapiens
agctgtgccagctgcttctg

SEQ ID NO: 4274534 - DNA, 16 bp, Homo sapiens
agctgtggggagctgg

SEQ ID NO: 4274535 - DNA, 17 bp, Homo sapiens
agctgttctaatggatt

SEQ ID NO: 4274536 - DNA, 14 bp, Homo sapiens
agctgttctctgct

SEQ ID NO: 4274537 - DNA, 12 bp, Homo sapiens
agcttcaaaaca

SEQ ID NO: 4274538 - DNA, 13 bp, Homo sapiens
agcttcaaaacag

SEQ ID NO: 4274539 - DNA, 14 bp, Homo sapiens
agcttcaaaacaga

SEQ ID NO: 4274540 - DNA, 16 bp, Homo sapiens
agcttcaaaacagaac

SEQ ID NO: 4274541 - DNA, 11 bp, Homo sapiens
agcttccagat

SEQ ID NO: 4274542 - DNA, 14 bp, Homo sapiens
agcttctccagcca

SEQ ID NO: 4274543 - DNA, 13 bp, Homo sapiens
agcttgaatgtcc

SEQ ID NO: 4274544 - DNA, 23 bp, Homo sapiens
agcttgaatgtccccattctata

SEQ ID NO: 4274545 - DNA, 17 bp, Homo sapiens
agcttgatgctgtttct

SEQ ID NO: 4274546 - DNA, 19 bp, Homo sapiens
agcttgtttctatactgtt

SEQ ID NO: 4274547 - DNA, 12 bp, Homo sapiens
agctttcctggg

SEQ ID NO: 4274548 - DNA, 15 bp, Homo sapiens
agctttcctgggtct

SEQ ID NO: 4274549 - DNA, 22 bp, Homo sapiens
agctttgtcactgtttcactac

SEQ ID NO: 4274550 - DNA, 23 bp, Homo sapiens
aggaaaaaggctggtggacagac

SEQ ID NO: 4274551 - DNA, 19 bp, Homo sapiens
aggaaaaccaagccgtggc

SEQ ID NO: 4274552 - DNA, 20 bp, Homo sapiens
aggaaaaccaagccgtggct

SEQ ID NO: 4274553 - DNA, 21 bp, Homo sapiens
agttagggcatttttcttgga

SEQ ID NO: 4274554 - DNA, 12 bp, Homo sapiens
agttattaatag

SEQ ID NO: 4274555 - DNA, 16 bp, Homo sapiens
agttcaatcaaacttt

SEQ ID NO: 4274556 - DNA, 15 bp, Homo sapiens
agttcagcaaaactg

SEQ ID NO: 4274557 - DNA, 23 bp, Homo sapiens
agttcccaagaaaggaaaccttt

SEQ ID NO: 4274558 - DNA, 14 bp, Homo sapiens
agttctatttctat

SEQ ID NO: 4274559 - DNA, 23 bp, Homo sapiens
agttctatttctatctgcaaata

SEQ ID NO: 4274560 - DNA, 13 bp, Homo sapiens
agttctcacattt

SEQ ID NO: 4274561 - DNA, 13 bp, Homo sapiens
agttctgaaaact

SEQ ID NO: 4274562 - DNA, 20 bp, Homo sapiens
agttctgaaggttggaactg

SEQ ID NO: 4274563 - DNA, 13 bp, Homo sapiens
agttctggaggag

SEQ ID NO: 4274564 - DNA, 15 bp, Homo sapiens
agttctggaggagga

SEQ ID NO: 4274565 - DNA, 22 bp, Homo sapiens
agttgaggggcttccctctgct

SEQ ID NO: 4274566 - DNA, 14 bp, Homo sapiens
agttgatgaccaat

SEQ ID NO: 4274567 - DNA, 15 bp, Homo sapiens
agttgcaaagcattt

SEQ ID NO: 4274568 - DNA, 15 bp, Homo sapiens
agttgcacagcatct

SEQ ID NO: 4274569 - DNA, 16 bp, Homo sapiens
agttgcacagcatctc

SEQ ID NO: 4274570 - DNA, 14 bp, Homo sapiens
agttgctgtttact

SEQ ID NO: 4274571 - DNA, 20 bp, Homo sapiens
agttggcctcagcagaaggc

SEQ ID NO: 4274572 - DNA, 21 bp, Homo sapiens
agttgtaacattctatttcaa

SEQ ID NO: 4274573 - DNA, 16 bp, Homo sapiens
agtttaaaaaaataac

SEQ ID NO: 4274574 - DNA, 14 bp, Homo sapiens
agtttaccaatcaa

SEQ ID NO: 4274575 - DNA, 20 bp, Homo sapiens
agtttaccaatcaacagcat

SEQ ID NO: 4274576 - DNA, 22 bp, Homo sapiens
agtttcaagtatccttgttgac

SEQ ID NO: 4274577 - DNA, 17 bp, Homo sapiens
agtttgcaatcttatgt

SEQ ID NO: 4274578 - DNA, 15 bp, Homo sapiens
agtttgcctctgcac

SEQ ID NO: 4274579 - DNA, 16 bp, Homo sapiens
agtttgctaatgtttc

SEQ ID NO: 4274580 - DNA, 20 bp, Homo sapiens
agtttgctgtatacaaacag

SEQ ID NO: 4274581 - DNA, 21 bp, Homo sapiens
agtttgctgtatacaaacagg

SEQ ID NO: 4274582 - DNA, 15 bp, Homo sapiens
agtttgtgcaagaca

SEQ ID NO: 4274583 - DNA, 13 bp, Homo sapiens
agtttgttttctt

SEQ ID NO: 4274584 - DNA, 18 bp, Homo sapiens
agtttgttttctttttct

SEQ ID NO: 4274585 - DNA, 18 bp, Homo sapiens
ataaaaattctagattac

SEQ ID NO: 4274586 - DNA, 14 bp, Homo sapiens
ataaaacagtgttt

SEQ ID NO: 4274587 - DNA, 19 bp, Homo sapiens
ataaaacagtgtttccagt

SEQ ID NO: 4274588 - DNA, 16 bp, Homo sapiens
ataaacaacttaatgt

SEQ ID NO: 4274589 - DNA, 18 bp, Homo sapiens
ataaaccttaatatttct

SEQ ID NO: 4274590 - DNA, 19 bp, Homo sapiens
ataaactcagtcaaatgta

SEQ ID NO: 4274591 - DNA, 22 bp, Homo sapiens
ataaataaagaagaaaataacc

SEQ ID NO: 4274592 - DNA, 21 bp, Homo sapiens
ataaatactaaatatgaaatt

SEQ ID NO: 4274593 - DNA, 16 bp, Homo sapiens
ataaatatctatttat

SEQ ID NO: 4274594 - DNA, 22 bp, Homo sapiens
ataaatatctatttatctgtct

SEQ ID NO: 4274595 - DNA, 22 bp, Homo sapiens
ataaatctgtctgattctatgc

SEQ ID NO: 4274596 - DNA, 18 bp, Homo sapiens
ataaatcttccaaagttt

SEQ ID NO: 4274597 - DNA, 14 bp, Homo sapiens
ataaatgtgtgtat

SEQ ID NO: 4274598 - DNA, 20 bp, Homo sapiens
ataaatgtgtgtatgtgtgt

SEQ ID NO: 4274599 - DNA, 14 bp, Homo sapiens
ataaattatttcta

SEQ ID NO: 4274600 - DNA, 13 bp, Homo sapiens
ataacaactctat

SEQ ID NO: 4274601 - DNA, 15 bp, Homo sapiens
ataacaactctattt

SEQ ID NO: 4274602 - DNA, 22 bp, Homo sapiens
ataacaagccaaacattcttat

SEQ ID NO: 4274603 - DNA, 17 bp, Homo sapiens
ataacaatgtatgtgaa

SEQ ID NO: 4274604 - DNA, 20 bp, Homo sapiens
ataacatattcttgctttca

SEQ ID NO: 4274605 - DNA, 16 bp, Homo sapiens
ataacatctctttcat

SEQ ID NO: 4274606 - DNA, 20 bp, Homo sapiens
ataacatctgaaaagaaatg

SEQ ID NO: 4274607 - DNA, 20 bp, Homo sapiens
ataaccaaaaaatgtgagct

SEQ ID NO: 4274608 - DNA, 12 bp, Homo sapiens
ataaccagcggg

SEQ ID NO: 4274609 - DNA, 20 bp, Homo sapiens
ataactaagcaagtatattt

SEQ ID NO: 4274610 - DNA, 14 bp, Homo sapiens
ataagaagcaaata

SEQ ID NO: 4274611 - DNA, 16 bp, Homo sapiens
ataagcctcaggcctg

SEQ ID NO: 4274612 - DNA, 22 bp, Homo sapiens
ataagcctcaggcctggccctt

SEQ ID NO: 4274613 - DNA, 23 bp, Homo sapiens
ataagcctcaggcctggcccttt

SEQ ID NO: 4274614 - DNA, 22 bp, Homo sapiens
ataagtggaaaaaagagaaaaa

SEQ ID NO: 4274615 - DNA, 13 bp, Homo sapiens
ataataaaaatca

SEQ ID NO: 4274616 - DNA, 21 bp, Homo sapiens
ataataactagatctcctgta

SEQ ID NO: 4274617 - DNA, 21 bp, Homo sapiens
ataatacttaaaaatatgtga

SEQ ID NO: 4274618 - DNA, 17 bp, Homo sapiens
ataatactttgtataca

SEQ ID NO: 4274619 - DNA, 16 bp, Homo sapiens
ataatctcttcttata

SEQ ID NO: 4274620 - DNA, 23 bp, Homo sapiens
ataatgtttccctcaagaacaaa

SEQ ID NO: 4274621 - DNA, 21 bp, Homo sapiens
ataattagatccattaattta

SEQ ID NO: 4274622 - DNA, 22 bp, Homo sapiens
ataattagatccattaatttaa

SEQ ID NO: 4274623 - DNA, 15 bp, Homo sapiens
ataattatgtttacc

SEQ ID NO: 4274624 - DNA, 16 bp, Homo sapiens
ataattgcaagggaag

SEQ ID NO: 4274625 - DNA, 15 bp, Homo sapiens
ataattgtggagagg

SEQ ID NO: 4274626 - DNA, 16 bp, Homo sapiens
ataattgtggagagga

SEQ ID NO: 4274627 - DNA, 18 bp, Homo sapiens
ataatttcttactaaaca

SEQ ID NO: 4274628 - DNA, 19 bp, Homo sapiens
ataattttttagttaaaat

SEQ ID NO: 4274629 - DNA, 20 bp, Homo sapiens
ataattttttagttaaaatc

SEQ ID NO: 4274630 - DNA, 11 bp, Homo sapiens
atacaaacagg

SEQ ID NO: 4274631 - DNA, 19 bp, Homo sapiens
atacaaccttcatttaaaa

SEQ ID NO: 4274632 - DNA, 14 bp, Homo sapiens
atacagaatgaatc

SEQ ID NO: 4274633 - DNA, 15 bp, Homo sapiens
atacagtttttgtaa

SEQ ID NO: 4274634 - DNA, 18 bp, Homo sapiens
atacatcacgttaaagta

SEQ ID NO: 4274635 - DNA, 16 bp, Homo sapiens
atacatgatgatttca

SEQ ID NO: 4274636 - DNA, 19 bp, Homo sapiens
atacatgatgatttcagaa

SEQ ID NO: 4274637 - DNA, 18 bp, Homo sapiens
atacatggtttaaagtca

SEQ ID NO: 4274638 - DNA, 15 bp, Homo sapiens
atacatgtatagtga

SEQ ID NO: 4274639 - DNA, 16 bp, Homo sapiens
atacattaaaataact

SEQ ID NO: 4274640 - DNA, 14 bp, Homo sapiens
ataccccctgcccc

SEQ ID NO: 4274641 - DNA, 20 bp, Homo sapiens
ataccccctgccccagagaa

SEQ ID NO: 4274642 - DNA, 21 bp, Homo sapiens
ataccccctgccccagagaag

SEQ ID NO: 4274643 - DNA, 16 bp, Homo sapiens
ataccctaggtctcca

SEQ ID NO: 4274644 - DNA, 19 bp, Homo sapiens
ataccctaggtctccaccc

SEQ ID NO: 4274645 - DNA, 20 bp, Homo sapiens
ataccctaggtctccacccc

SEQ ID NO: 4274646 - DNA, 21 bp, Homo sapiens
ataccctaggtctccacccct

SEQ ID NO: 4274647 - DNA, 18 bp, Homo sapiens
atacctctctctatatat

SEQ ID NO: 4274648 - DNA, 15 bp, Homo sapiens
atactcaccaaaata

SEQ ID NO: 4274649 - DNA, 17 bp, Homo sapiens
atactcaccaaaatata

SEQ ID NO: 4274650 - DNA, 13 bp, Homo sapiens
atactcattagaa

SEQ ID NO: 4274651 - DNA, 13 bp, Homo sapiens
atactctccagga

SEQ ID NO: 4274652 - DNA, 21 bp, Homo sapiens
atactctgtgtaatctctgat

SEQ ID NO: 4274653 - DNA, 23 bp, Homo sapiens
atactctgtgtaatctctgatta

SEQ ID NO: 4274654 - DNA, 16 bp, Homo sapiens
atactgtctaagaata

SEQ ID NO: 4274655 - DNA, 13 bp, Homo sapiens
atactgtgtgtga

SEQ ID NO: 4274656 - DNA, 21 bp, Homo sapiens
atactgtgtgtgagtgtgaat

SEQ ID NO: 4274657 - DNA, 18 bp, Homo sapiens
atactgtttgtaatatac

SEQ ID NO: 4274658 - DNA, 14 bp, Homo sapiens
atacttggtcctta

SEQ ID NO: 4274659 - DNA, 17 bp, Homo sapiens
atacttggtccttaaaa

SEQ ID NO: 4274660 - DNA, 18 bp, Homo sapiens
atactttgcattgtctgt

SEQ ID NO: 4274661 - DNA, 13 bp, Homo sapiens
atacttttgtgta

SEQ ID NO: 4274662 - DNA, 18 bp, Homo sapiens
atacttttgtgtattctg

SEQ ID NO: 4274663 - DNA, 20 bp, Homo sapiens
atacttttgtgtattctgtg

SEQ ID NO: 4274664 - DNA, 17 bp, Homo sapiens
atagaaaaaaacattct

SEQ ID NO: 4274665 - DNA, 21 bp, Homo sapiens
atagaactgtcccacaaaata

SEQ ID NO: 4274666 - DNA, 17 bp, Homo sapiens
atagatcacggcatgtt

SEQ ID NO: 4274667 - DNA, 14 bp, Homo sapiens
atagatgcctgggc

SEQ ID NO: 4274668 - DNA, 15 bp, Homo sapiens
atagatgcctgggcc

SEQ ID NO: 4274669 - DNA, 23 bp, Homo sapiens
atagcctagggtgagggtgacag

SEQ ID NO: 4274670 - DNA, 12 bp, Homo sapiens
atagcgtgtgta

SEQ ID NO: 4274671 - DNA, 15 bp, Homo sapiens
ataggagcttccaga

SEQ ID NO: 4274672 - DNA, 16 bp, Homo sapiens
ataggagcttccagat

SEQ ID NO: 4274673 - DNA, 23 bp, Homo sapiens
ataggtatttcttccagtgatgt

SEQ ID NO: 4274674 - DNA, 12 bp, Homo sapiens
ataggtttctaa

SEQ ID NO: 4274675 - DNA, 16 bp, Homo sapiens
atagtagcagagtcat

SEQ ID NO: 4274676 - DNA, 20 bp, Homo sapiens
atagtatgcactatatacat

SEQ ID NO: 4274677 - DNA, 15 bp, Homo sapiens
atagtggctttcatt

SEQ ID NO: 4274678 - DNA, 21 bp, Homo sapiens
atagtgtgttgtgctttcaag

SEQ ID NO: 4274679 - DNA, 20 bp, Homo sapiens
atagttaattgtggctttat

SEQ ID NO: 4274680 - DNA, 21 bp, Homo sapiens
atagttaattgtggctttatg

SEQ ID NO: 4274681 - DNA, 20 bp, Homo sapiens
atagttctatttctatctgc

SEQ ID NO: 4274682 - DNA, 14 bp, Homo sapiens
atagttgatatgta

SEQ ID NO: 4274683 - DNA, 20 bp, Homo sapiens
atagttgatatgtaacagtt

SEQ ID NO: 4274684 - DNA, 16 bp, Homo sapiens
atagtttgaattcatg

SEQ ID NO: 4274685 - DNA, 22 bp, Homo sapiens
atagtttgttttctttttctgt

SEQ ID NO: 4274686 - DNA, 15 bp, Homo sapiens
atagttttctaaatg

SEQ ID NO: 4274687 - DNA, 16 bp, Homo sapiens
atagttttctaaatgt

SEQ ID NO: 4274688 - DNA, 17 bp, Homo sapiens
atagttttctaaatgtt

SEQ ID NO: 4274689 - DNA, 21 bp, Homo sapiens
atagttttctaaatgtttctt

SEQ ID NO: 4274690 - DNA, 14 bp, Homo sapiens
atataactttagaa

SEQ ID NO: 4274691 - DNA, 19 bp, Homo sapiens
atataataaatatatattt

SEQ ID NO: 4274692 - DNA, 23 bp, Homo sapiens
atataataaatatatatttatca

SEQ ID NO: 4274693 - DNA, 14 bp, Homo sapiens
atatacatgtatag

SEQ ID NO: 4274694 - DNA, 13 bp, Homo sapiens
atatactcattag

SEQ ID NO: 4274695 - DNA, 12 bp, Homo sapiens
atatactgcata

SEQ ID NO: 4274696 - DNA, 23 bp, Homo sapiens
atatagttgaacaagatttccct

SEQ ID NO: 4274697 - DNA, 16 bp, Homo sapiens
atatagtttgttttct

SEQ ID NO: 4274698 - DNA, 23 bp, Homo sapiens
atatagtttgttttctttttctg

SEQ ID NO: 4274699 - DNA, 12 bp, Homo sapiens
atatatacatgt

SEQ ID NO: 4274700 - DNA, 13 bp, Homo sapiens
atatatacatgta

SEQ ID NO: 4274701 - DNA, 19 bp, Homo sapiens
atatatacccccccatgca

SEQ ID NO: 4274702 - DNA, 12 bp, Homo sapiens
atatatctgaaa

SEQ ID NO: 4274703 - DNA, 19 bp, Homo sapiens
atatatgaaaactaagttc

SEQ ID NO: 4274704 - DNA, 14 bp, Homo sapiens
atatcctatactgg

SEQ ID NO: 4274705 - DNA, 22 bp, Homo sapiens
atatctctatttaattttgaca

SEQ ID NO: 4274706 - DNA, 16 bp, Homo sapiens
atatcttgaagaatat

SEQ ID NO: 4274707 - DNA, 13 bp, Homo sapiens
atatctttcagtt

SEQ ID NO: 4274708 - DNA, 19 bp, Homo sapiens
atatgacaatttcaaaatg

SEQ ID NO: 4274709 - DNA, 21 bp, Homo sapiens
atatgacaatttcaaaatgca

SEQ ID NO: 4274710 - DNA, 18 bp, Homo sapiens
atatggggggccaacacc

SEQ ID NO: 4274711 - DNA, 14 bp, Homo sapiens
atatgtaacagttg

SEQ ID NO: 4274712 - DNA, 13 bp, Homo sapiens
atatgtaacatgt

SEQ ID NO: 4274713 - DNA, 15 bp, Homo sapiens
atatgtaacatgtct

SEQ ID NO: 4274714 - DNA, 23 bp, Homo sapiens
atattaaaaagccaagtgtcctg

SEQ ID NO: 4274715 - DNA, 17 bp, Homo sapiens
atattagagtgccctta

SEQ ID NO: 4274716 - DNA, 12 bp, Homo sapiens
atattataagat

SEQ ID NO: 4274717 - DNA, 23 bp, Homo sapiens
atattatttgctaattaaaaagt

SEQ ID NO: 4274718 - DNA, 17 bp, Homo sapiens
atattcattctttataa

SEQ ID NO: 4274719 - DNA, 20 bp, Homo sapiens
atattccaggtttaagtaga

SEQ ID NO: 4274720 - DNA, 23 bp, Homo sapiens
atattcttgctttcacaaatata

SEQ ID NO: 4274721 - DNA, 14 bp, Homo sapiens
atattgagcaatat

SEQ ID NO: 4274722 - DNA, 22 bp, Homo sapiens
atctgctgcctctgaaaatatt

SEQ ID NO: 4274723 - DNA, 15 bp, Homo sapiens
atctggtattaaatg

SEQ ID NO: 4274724 - DNA, 18 bp, Homo sapiens
atctggtattaaatgcca

SEQ ID NO: 4274725 - DNA, 16 bp, Homo sapiens
atctgtaaatttaact

SEQ ID NO: 4274726 - DNA, 17 bp, Homo sapiens
atctgtaaatttaactg

SEQ ID NO: 4274727 - DNA, 18 bp, Homo sapiens
atctgtctgattctatgc

SEQ ID NO: 4274728 - DNA, 14 bp, Homo sapiens
atctgtctgtccta

SEQ ID NO: 4274729 - DNA, 16 bp, Homo sapiens
atctgtttgcttctaa

SEQ ID NO: 4274730 - DNA, 20 bp, Homo sapiens
atcttaaaagctatcttcat

SEQ ID NO: 4274731 - DNA, 12 bp, Homo sapiens
atcttgaagaat

SEQ ID NO: 4274732 - DNA, 17 bp, Homo sapiens
atcttgagcaaggcaag

SEQ ID NO: 4274733 - DNA, 16 bp, Homo sapiens
atctttactggaaatg

SEQ ID NO: 4274734 - DNA, 15 bp, Homo sapiens
atctttgctcccagt

SEQ ID NO: 4274735 - DNA, 19 bp, Homo sapiens
atgaaaaccaccctatcat

SEQ ID NO: 4274736 - DNA, 22 bp, Homo sapiens
atgaaataaattggtgataagt

SEQ ID NO: 4274737 - DNA, 17 bp, Homo sapiens
atgaaataccaactatg

SEQ ID NO: 4274738 - DNA, 22 bp, Homo sapiens
atgaaataggagggaaaccttt

SEQ ID NO: 4274739 - DNA, 15 bp, Homo sapiens
atgaaatatatgtga

SEQ ID NO: 4274740 - DNA, 22 bp, Homo sapiens
atgaaatatttgcttatttata

SEQ ID NO: 4274741 - DNA, 13 bp, Homo sapiens
atgaacactggct

SEQ ID NO: 4274742 - DNA, 12 bp, Homo sapiens
atgaactagcca

SEQ ID NO: 4274743 - DNA, 13 bp, Homo sapiens
atgaactagccat

SEQ ID NO: 4274744 - DNA, 19 bp, Homo sapiens
atgaagaaaagtgggccag

SEQ ID NO: 4274745 - DNA, 13 bp, Homo sapiens
atgaagaagaaaa

SEQ ID NO: 4274746 - DNA, 17 bp, Homo sapiens
atgaagcaaacacacag

SEQ ID NO: 4274747 - DNA, 16 bp, Homo sapiens
atgaataattatgttt

SEQ ID NO: 4274748 - DNA, 23 bp, Homo sapiens
atgaataattgaggttaggaacc

SEQ ID NO: 4274749 - DNA, 15 bp, Homo sapiens
atgacaatttcaaaa

SEQ ID NO: 4274750 - DNA, 17 bp, Homo sapiens
atgacaatttcaaaatg

SEQ ID NO: 4274751 - DNA, 23 bp, Homo sapiens
atgacccggcccccgccctctgc

SEQ ID NO: 4274752 - DNA, 11 bp, Homo sapiens
atgaccctgga

SEQ ID NO: 4274753 - DNA, 13 bp, Homo sapiens
atgacctaaatcc

SEQ ID NO: 4274754 - DNA, 23 bp, Homo sapiens
atgacctaaatccattttctaaa

SEQ ID NO: 4274755 - DNA, 17 bp, Homo sapiens
atgacgtattgtgaaat

SEQ ID NO: 4274756 - DNA, 16 bp, Homo sapiens
atgactataaacatta

SEQ ID NO: 4274757 - DNA, 23 bp, Homo sapiens
atgactataaacattaaaagaag

SEQ ID NO: 4274758 - DNA, 14 bp, Homo sapiens
atgactctttattg

SEQ ID NO: 4274759 - DNA, 16 bp, Homo sapiens
atgagatactttgcat

SEQ ID NO: 4274760 - DNA, 13 bp, Homo sapiens
atgagccagctct

SEQ ID NO: 4274761 - DNA, 17 bp, Homo sapiens
atgagctccagaccccc

SEQ ID NO: 4274762 - DNA, 20 bp, Homo sapiens
atgagctccagacccccagc

SEQ ID NO: 4274763 - DNA, 20 bp, Homo sapiens
atgaggcacgcctgccttct

SEQ ID NO: 4274764 - DNA, 15 bp, Homo sapiens
atgaggggactgcat

SEQ ID NO: 4274765 - DNA, 16 bp, Homo sapiens
atgagtcccagtggga

SEQ ID NO: 4274766 - DNA, 16 bp, Homo sapiens
atgagttcaaatactt

SEQ ID NO: 4274767 - DNA, 18 bp, Homo sapiens
atgagttcaaatactttt

SEQ ID NO: 4274768 - DNA, 15 bp, Homo sapiens
atgatactgtctaag

SEQ ID NO: 4274769 - DNA, 18 bp, Homo sapiens
atgatataataaatatat

SEQ ID NO: 4274770 - DNA, 20 bp, Homo sapiens
atgatattcaatcttaacaa

SEQ ID NO: 4274771 - DNA, 17 bp, Homo sapiens
atgatattgctgaagaa

SEQ ID NO: 4274772 - DNA, 18 bp, Homo sapiens
atgatattgtatgtacct

SEQ ID NO: 4274773 - DNA, 13 bp, Homo sapiens
atgatcttccaaa

SEQ ID NO: 4274774 - DNA, 17 bp, Homo sapiens
atgatggatgagaaaaa

SEQ ID NO: 4274775 - DNA, 15 bp, Homo sapiens
atgattcataacaat

SEQ ID NO: 4274776 - DNA, 11 bp, Homo sapiens
atgattccaaa

SEQ ID NO: 4274777 - DNA, 12 bp, Homo sapiens
atgattccaaat

SEQ ID NO: 4274778 - DNA, 21 bp, Homo sapiens
atgattccaagggcccagagg

SEQ ID NO: 4274779 - DNA, 23 bp, Homo sapiens
atgattcgcccaaagccagacag

SEQ ID NO: 4274780 - DNA, 13 bp, Homo sapiens
atgattctcctct

SEQ ID NO: 4274781 - DNA, 16 bp, Homo sapiens
atgattctcctctccc

SEQ ID NO: 4274782 - DNA, 12 bp, Homo sapiens
atgatttgcaac

SEQ ID NO: 4274783 - DNA, 16 bp, Homo sapiens
atgatttgcaacttta

SEQ ID NO: 4274784 - DNA, 12 bp, Homo sapiens
atgatttttaac

SEQ ID NO: 4274785 - DNA, 20 bp, Homo sapiens
atgattttttacaaattatg

SEQ ID NO: 4274786 - DNA, 22 bp, Homo sapiens
atgcaaagtaccaactgagcca

SEQ ID NO: 4274787 - DNA, 21 bp, Homo sapiens
atgcacatttgtcactgaata

SEQ ID NO: 4274788 - DNA, 16 bp, Homo sapiens
atgcagatctagccag

SEQ ID NO: 4274789 - DNA, 17 bp, Homo sapiens
atgcagatctagccagg

SEQ ID NO: 4274790 - DNA, 17 bp, Homo sapiens
atgcagcttcaggtgag

SEQ ID NO: 4274791 - DNA, 17 bp, Homo sapiens
atgcaggcagcctgcag

SEQ ID NO: 4274792 - DNA, 21 bp, Homo sapiens
atgcagggcccccacaggagc

SEQ ID NO: 4274793 - DNA, 23 bp, Homo sapiens
atgcagtgtagattttatagtgt

SEQ ID NO: 4274794 - DNA, 20 bp, Homo sapiens
atgcatgatattgtatgtac

SEQ ID NO: 4274795 - DNA, 21 bp, Homo sapiens
atgcatgatattgtatgtacc

SEQ ID NO: 4274796 - DNA, 22 bp, Homo sapiens
atgcatgatattgtatgtacct

SEQ ID NO: 4274797 - DNA, 15 bp, Homo sapiens
atgcatggcctccca

SEQ ID NO: 4274798 - DNA, 17 bp, Homo sapiens
atgcatggcctcccagc

SEQ ID NO: 4274799 - DNA, 20 bp, Homo sapiens
atgcatggcctcccagccac

SEQ ID NO: 4274800 - DNA, 15 bp, Homo sapiens
atgccacctgcagcg

SEQ ID NO: 4274801 - DNA, 15 bp, Homo sapiens
atgccacggcagcca

SEQ ID NO: 4274802 - DNA, 18 bp, Homo sapiens
atgccacggcagccaccc

SEQ ID NO: 4274803 - DNA, 20 bp, Homo sapiens
atgccacggcagccaccctg

SEQ ID NO: 4274804 - DNA, 21 bp, Homo sapiens
atgccacggcagccaccctgc

SEQ ID NO: 4274805 - DNA, 15 bp, Homo sapiens
atgccactaggccct

SEQ ID NO: 4274806 - DNA, 16 bp, Homo sapiens
atgccccactctgctg

SEQ ID NO: 4274807 - DNA, 18 bp, Homo sapiens
atgccccactctgctgag

SEQ ID NO: 4274808 - DNA, 16 bp, Homo sapiens
atgccgctgtgtcccc

SEQ ID NO: 4274809 - DNA, 12 bp, Homo sapiens
atgcctgggcct

SEQ ID NO: 4274810 - DNA, 15 bp, Homo sapiens
atgcctgggcctgat

SEQ ID NO: 4274811 - DNA, 19 bp, Homo sapiens
atgcctgtatttccaacaa

SEQ ID NO: 4274812 - DNA, 21 bp, Homo sapiens
atgccttcataaattatttct

SEQ ID NO: 4274813 - DNA, 22 bp, Homo sapiens
atgcctttctagtcctattcta

SEQ ID NO: 4274814 - DNA, 17 bp, Homo sapiens
atgcctttttggttttg

SEQ ID NO: 4274815 - DNA, 18 bp, Homo sapiens
atgcgctcttcaccagga

SEQ ID NO: 4274816 - DNA, 20 bp, Homo sapiens
atgcgctcttcaccaggaag

SEQ ID NO: 4274817 - DNA, 21 bp, Homo sapiens
atgcgctcttcaccaggaaga

SEQ ID NO: 4274818 - DNA, 15 bp, Homo sapiens
atgcggccggcctgg

SEQ ID NO: 4274819 - DNA, 23 bp, Homo sapiens
atgctaatgtaatcatttatctt

SEQ ID NO: 4274820 - DNA, 16 bp, Homo sapiens
atgctagcacaatatt

SEQ ID NO: 4274821 - DNA, 21 bp, Homo sapiens
atgctatctcgctagccatat

SEQ ID NO: 4274822 - DNA, 12 bp, Homo sapiens
atgctccagcca

SEQ ID NO: 4274823 - DNA, 20 bp, Homo sapiens
atgctccagccaacccctgt

SEQ ID NO: 4274824 - DNA, 21 bp, Homo sapiens
atgctccagccaacccctgtg

SEQ ID NO: 4274825 - DNA, 22 bp, Homo sapiens
atgctcccaaatgcagcttcag

SEQ ID NO: 4274826 - DNA, 15 bp, Homo sapiens
atgctcccccatcct

SEQ ID NO: 4274827 - DNA, 20 bp, Homo sapiens
atgctcccccatcctcccct

SEQ ID NO: 4274828 - DNA, 22 bp, Homo sapiens
atgctcccccatcctccccttc

SEQ ID NO: 4274829 - DNA, 23 bp, Homo sapiens
atgctcccccatcctccccttcc

SEQ ID NO: 4274830 - DNA, 14 bp, Homo sapiens
atgctcctctgcct

SEQ ID NO: 4274831 - DNA, 19 bp, Homo sapiens
atgctcctctgcctgtgcc

SEQ ID NO: 4274832 - DNA, 21 bp, Homo sapiens
atgctcctctgcctgtgcccg

SEQ ID NO: 4274833 - DNA, 22 bp, Homo sapiens
atgctgagtatgttaagctctt

SEQ ID NO: 4274834 - DNA, 12 bp, Homo sapiens
atgctgcctgcc

SEQ ID NO: 4274835 - DNA, 21 bp, Homo sapiens
atgctgcctgcctccggccct

SEQ ID NO: 4274836 - DNA, 22 bp, Homo sapiens
atgctgcctgcctccggccctg

SEQ ID NO: 4274837 - DNA, 23 bp, Homo sapiens
atgctgcctgcctccggccctgc

SEQ ID NO: 4274838 - DNA, 14 bp, Homo sapiens
atgctgctgtgaat

SEQ ID NO: 4274839 - DNA, 16 bp, Homo sapiens
atgctgctgtgaattt

SEQ ID NO: 4274840 - DNA, 19 bp, Homo sapiens
atgctgctgtgaatttttt

SEQ ID NO: 4274841 - DNA, 21 bp, Homo sapiens
atgctgggttctggggctgag

SEQ ID NO: 4274842 - DNA, 22 bp, Homo sapiens
atgctgggttctggggctgaga

SEQ ID NO: 4274843 - DNA, 20 bp, Homo sapiens
atgctggtcatcctgggcat

SEQ ID NO: 4274844 - DNA, 14 bp, Homo sapiens
atgctgtatctgtg

SEQ ID NO: 4274845 - DNA, 19 bp, Homo sapiens
atgctgtatgtcattaaag

SEQ ID NO: 4274846 - DNA, 16 bp, Homo sapiens
atgctttgtgtgattg

SEQ ID NO: 4274847 - DNA, 14 bp, Homo sapiens
atggaagagagaaa

SEQ ID NO: 4274848 - DNA, 23 bp, Homo sapiens
atggaagcctccacctgcagccc

SEQ ID NO: 4274849 - DNA, 19 bp, Homo sapiens
atggaagggccttctccac

SEQ ID NO: 4274850 - DNA, 13 bp, Homo sapiens
atggacagggcca

SEQ ID NO: 4274851 - DNA, 14 bp, Homo sapiens
atggacagggccag

SEQ ID NO: 4274852 - DNA, 15 bp, Homo sapiens
atggacagggccagg

SEQ ID NO: 4274853 - DNA, 17 bp, Homo sapiens
atggacagggccagggt

SEQ ID NO: 4274854 - DNA, 14 bp, Homo sapiens
atggacctgcactt

SEQ ID NO: 4274855 - DNA, 16 bp, Homo sapiens
atggactctacactgt

SEQ ID NO: 4274856 - DNA, 15 bp, Homo sapiens
caggtgtcctgactg

SEQ ID NO: 4274857 - DNA, 20 bp, Homo sapiens
caggtgtcctgactgtccta

SEQ ID NO: 4274858 - DNA, 22 bp, Homo sapiens
caggttgtctgaagtcactgca

SEQ ID NO: 4274859 - DNA, 13 bp, Homo sapiens
cagtaaacaccat

SEQ ID NO: 4274860 - DNA, 14 bp, Homo sapiens
cagtaactcatctg

SEQ ID NO: 4274861 - DNA, 19 bp, Homo sapiens
cagtaagctgctctattgt

SEQ ID NO: 4274862 - DNA, 18 bp, Homo sapiens
cagtaatgtcataaagtg

SEQ ID NO: 4274863 - DNA, 14 bp, Homo sapiens
cagtacttgctcaa

SEQ ID NO: 4274864 - DNA, 19 bp, Homo sapiens
cagtacttgctcaataaag

SEQ ID NO: 4274865 - DNA, 20 bp, Homo sapiens
cagtagaaggtcggaggctt

SEQ ID NO: 4274866 - DNA, 19 bp, Homo sapiens
cagtagctgtggggagctg

SEQ ID NO: 4274867 - DNA, 17 bp, Homo sapiens
cagtagtgcctgtgatc

SEQ ID NO: 4274868 - DNA, 14 bp, Homo sapiens
cagtatattttatt

SEQ ID NO: 4274869 - DNA, 16 bp, Homo sapiens
cagtatattttatttc

SEQ ID NO: 4274870 - DNA, 17 bp, Homo sapiens
cagtatattttatttca

SEQ ID NO: 4274871 - DNA, 24 bp, Homo sapiens
cagtatccgcgagcctgcttgctg

SEQ ID NO: 4274872 - DNA, 15 bp, Homo sapiens
cagtcagcacagaga

SEQ ID NO: 4274873 - DNA, 16 bp, Homo sapiens
cagtcagcacagagag

SEQ ID NO: 4274874 - DNA, 13 bp, Homo sapiens
cagtcagggcggg

SEQ ID NO: 4274875 - DNA, 15 bp, Homo sapiens
ctccctgtctgaaac

SEQ ID NO: 4274876 - DNA, 18 bp, Homo sapiens
ctcccttcaaccattccc

SEQ ID NO: 4274877 - DNA, 19 bp, Homo sapiens
ctcccttcaaccattcccc

SEQ ID NO: 4274878 - DNA, 23 bp, Homo sapiens
ctcccttcaaccattccccatgg

SEQ ID NO: 4274879 - DNA, 19 bp, Homo sapiens
ctccctttatcatgtgttt

SEQ ID NO: 4274880 - DNA, 20 bp, Homo sapiens
ctccgcccttccctgacact

SEQ ID NO: 4274881 - DNA, 20 bp, Homo sapiens
ctccgcgggggacaggaaca

SEQ ID NO: 4274882 - DNA, 16 bp, Homo sapiens
ctccggatgacacaaa

SEQ ID NO: 4274883 - DNA, 21 bp, Homo sapiens
ctcctagcacaaggagtgccc

SEQ ID NO: 4274884 - DNA, 17 bp, Homo sapiens
ctcctccagcaagacct

SEQ ID NO: 4274885 - DNA, 14 bp, Homo sapiens
ctcctcccggtgcc

SEQ ID NO: 4274886 - DNA, 11 bp, Homo sapiens
ctcctccctcc

SEQ ID NO: 4274887 - DNA, 20 bp, Homo sapiens
ctcctccctccgctaaggct

SEQ ID NO: 4274888 - DNA, 13 bp, Homo sapiens
ctcctcggccaga

SEQ ID NO: 4274889 - DNA, 17 bp, Homo sapiens
ctcctcggccagagctc

SEQ ID NO: 4274890 - DNA, 21 bp, Homo sapiens
ctcctcggccagagctcccag

SEQ ID NO: 4274891 - DNA, 23 bp, Homo sapiens
ctcctcggccagagctcccagga

SEQ ID NO: 4274892 - DNA, 19 bp, Homo sapiens
ctcctctctctccctccac

SEQ ID NO: 4274893 - DNA, 12 bp, Homo sapiens
ctcctctgcctg

SEQ ID NO: 4274894 - DNA, 18 bp, Homo sapiens
ctcctctgcctgtgcccg

SEQ ID NO: 4274895 - DNA, 22 bp, Homo sapiens
ctcctctgcctgtgcccgctgc

SEQ ID NO: 4274896 - DNA, 13 bp, Homo sapiens
ctcctctgccttg

SEQ ID NO: 4274897 - DNA, 14 bp, Homo sapiens
ctcctctgccttgg

SEQ ID NO: 4274898 - DNA, 17 bp, Homo sapiens
ctcctgcatccctccac

SEQ ID NO: 4274899 - DNA, 19 bp, Homo sapiens
ctcctgcatccctccaccc

SEQ ID NO: 4274900 - DNA, 14 bp, Homo sapiens
ctcctgccctcgtc

SEQ ID NO: 4274901 - DNA, 22 bp, Homo sapiens
ctcctgccctcgtctccctggc

SEQ ID NO: 4274902 - DNA, 21 bp, Homo sapiens
ctcctgctgaccttctgcggc

SEQ ID NO: 4274903 - DNA, 13 bp, Homo sapiens
ctcctgctgagtg

SEQ ID NO: 4274904 - DNA, 14 bp, Homo sapiens
ctcctgctgagtgg

SEQ ID NO: 4274905 - DNA, 20 bp, Homo sapiens
ctcctggacccagcaggggc

SEQ ID NO: 4274906 - DNA, 14 bp, Homo sapiens
ctcctggctcacag

SEQ ID NO: 4274907 - DNA, 15 bp, Homo sapiens
ctcctggctcacagc

SEQ ID NO: 4274908 - DNA, 21 bp, Homo sapiens
ctcctggctcacagccaccac

SEQ ID NO: 4274909 - DNA, 15 bp, Homo sapiens
ctcctgggcatctgg

SEQ ID NO: 4274910 - DNA, 21 bp, Homo sapiens
ctcctgggcatctggccctgc

SEQ ID NO: 4274911 - DNA, 15 bp, Homo sapiens
ctcctgggccagggt

SEQ ID NO: 4274912 - DNA, 12 bp, Homo sapiens
cctcttgccccc

SEQ ID NO: 4274913 - DNA, 14 bp, Homo sapiens
cctcttgggagacg

SEQ ID NO: 4274914 - DNA, 17 bp, Homo sapiens
cctctttcctctctggc

SEQ ID NO: 4274915 - DNA, 15 bp, Homo sapiens
cctgaaatgtttcca

SEQ ID NO: 4274916 - DNA, 22 bp, Homo sapiens
cctgaactaggtgctggcatgt

SEQ ID NO: 4274917 - DNA, 17 bp, Homo sapiens
cctgaagtgaccccagc

SEQ ID NO: 4274918 - DNA, 23 bp, Homo sapiens
cctgaagtgaccccagctccagg

SEQ ID NO: 4274919 - DNA, 19 bp, Homo sapiens
cctgacactgtctgctgcc

SEQ ID NO: 4274920 - DNA, 20 bp, Homo sapiens
cctgacactgtctgctgccc

SEQ ID NO: 4274921 - DNA, 18 bp, Homo sapiens
cctgagcttggccagaag

SEQ ID NO: 4274922 - DNA, 17 bp, Homo sapiens
cctgaggagcagcccac

SEQ ID NO: 4274923 - DNA, 22 bp, Homo sapiens
cctgaggagcagcccacctgct

SEQ ID NO: 4274924 - DNA, 15 bp, Homo sapiens
cctgagggcccttcc

SEQ ID NO: 4274925 - DNA, 9 bp, Homo sapiens
cctgagggg

SEQ ID NO: 4274926 - DNA, 11 bp, Homo sapiens
cctgaggggca

SEQ ID NO: 4274927 - DNA, 17 bp, Homo sapiens
cctgaggggcctgccac

SEQ ID NO: 4274928 - DNA, 16 bp, Homo sapiens
cctgatggccaggcct

SEQ ID NO: 4274929 - DNA, 23 bp, Homo sapiens
cctgatggccaggcctcagggac

SEQ ID NO: 4274930 - DNA, 17 bp, Homo sapiens
cctgcaagtggacgtgg

SEQ ID NO: 4274931 - DNA, 20 bp, Homo sapiens
cctgcacacacctgcacacc

SEQ ID NO: 4274932 - DNA, 15 bp, Homo sapiens
cctgcacacccctgc

SEQ ID NO: 4274933 - DNA, 20 bp, Homo sapiens
cctgcacacccctgcacaca

SEQ ID NO: 4274934 - DNA, 22 bp, Homo sapiens
cctgcagaccacactctgcctg

SEQ ID NO: 4274935 - DNA, 14 bp, Homo sapiens
cctgcagcagagcc

SEQ ID NO: 4274936 - DNA, 18 bp, Homo sapiens
cctgcagccccaggcctc

SEQ ID NO: 4274937 - DNA, 22 bp, Homo sapiens
cctgcaggcggtatccagaggt

SEQ ID NO: 4274938 - DNA, 14 bp, Homo sapiens
cctgcagggagcag

SEQ ID NO: 4274939 - DNA, 19 bp, Homo sapiens
cctgcagggagcagcacgc

SEQ ID NO: 4274940 - DNA, 14 bp, Homo sapiens
cctgcagggtaggg

SEQ ID NO: 4274941 - DNA, 18 bp, Homo sapiens
cctgcagttggcctcagc

SEQ ID NO: 4274942 - DNA, 14 bp, Homo sapiens
cctgcatcatcttg

SEQ ID NO: 4274943 - DNA, 17 bp, Homo sapiens
cctgcatccctccaccc

SEQ ID NO: 4274944 - DNA, 16 bp, Homo sapiens
cctgcatcccttggcc

SEQ ID NO: 4274945 - DNA, 19 bp, Homo sapiens
cctgcatcccttggcccct

SEQ ID NO: 4274946 - DNA, 16 bp, Homo sapiens
cctgccaactttccag

SEQ ID NO: 4274947 - DNA, 17 bp, Homo sapiens
cctgccactctcctgag

SEQ ID NO: 4274948 - DNA, 12 bp, Homo sapiens
cctgccagaggc

SEQ ID NO: 4274949 - DNA, 15 bp, Homo sapiens
cctgccagaggcctg

SEQ ID NO: 4274950 - DNA, 18 bp, Homo sapiens
cctgccatggaggcgcct

SEQ ID NO: 4274951 - DNA, 14 bp, Homo sapiens
cctgccccacacag

SEQ ID NO: 4274952 - DNA, 17 bp, Homo sapiens
cctgccccacacaggcc

SEQ ID NO: 4274953 - DNA, 11 bp, Homo sapiens
cctgccccaga

SEQ ID NO: 4274954 - DNA, 12 bp, Homo sapiens
cctgccccagag

SEQ ID NO: 4274955 - DNA, 13 bp, Homo sapiens
cctgccccagaga

SEQ ID NO: 4274956 - DNA, 16 bp, Homo sapiens
cctgccccagagaagc

SEQ ID NO: 4274957 - DNA, 23 bp, Homo sapiens
cctgccccagagaagcctcagtc

SEQ ID NO: 4274958 - DNA, 19 bp, Homo sapiens
cctgccccatcccatccct

SEQ ID NO: 4274959 - DNA, 21 bp, Homo sapiens
cctgccccccacattctggct

SEQ ID NO: 4274960 - DNA, 22 bp, Homo sapiens
cctgccccccacattctggctc

SEQ ID NO: 4274961 - DNA, 20 bp, Homo sapiens
cctgccccccttcccacccc

SEQ ID NO: 4274962 - DNA, 22 bp, Homo sapiens
cctgccccccttcccaccccta

SEQ ID NO: 4274963 - DNA, 17 bp, Homo sapiens
cctgcccccgctctgcc

SEQ ID NO: 4274964 - DNA, 18 bp, Homo sapiens
cctgcccccttctcccac

SEQ ID NO: 4274965 - DNA, 18 bp, Homo sapiens
cctgccccgccccccaga

SEQ ID NO: 4274966 - DNA, 21 bp, Homo sapiens
cctgccccgccccccagagcc

SEQ ID NO: 4274967 - DNA, 23 bp, Homo sapiens
cctgccccgccccccagagccag

SEQ ID NO: 4274968 - DNA, 17 bp, Homo sapiens
cctgcccctgccccgtc

SEQ ID NO: 4274969 - DNA, 13 bp, Homo sapiens
cctgccctcactc

SEQ ID NO: 4274970 - DNA, 16 bp, Homo sapiens
cctgcccttcagcatc

SEQ ID NO: 4274971 - DNA, 15 bp, Homo sapiens
cctgcctaggagctg

SEQ ID NO: 4274972 - DNA, 17 bp, Homo sapiens
cctgcctccggccctgc

SEQ ID NO: 4274973 - DNA, 20 bp, Homo sapiens
cctgcctctgaactgctgct

SEQ ID NO: 4274974 - DNA, 12 bp, Homo sapiens
cctgcctggccc

SEQ ID NO: 4274975 - DNA, 20 bp, Homo sapiens
cctgcctggccctcctctgg

SEQ ID NO: 4274976 - DNA, 14 bp, Homo sapiens
cctgccttcatgga

SEQ ID NO: 4274977 - DNA, 20 bp, Homo sapiens
cctgccttttagttcctgtg

SEQ ID NO: 4274978 - DNA, 22 bp, Homo sapiens
cctgccttttagttcctgtgca

SEQ ID NO: 4274979 - DNA, 19 bp, Homo sapiens
cgtgccacgcgctctgcat

SEQ ID NO: 4274980 - DNA, 21 bp, Homo sapiens
cgtgccacgcgctctgcatgc

SEQ ID NO: 4274981 - DNA, 22 bp, Homo sapiens
cgtgccacgcgctctgcatgct

SEQ ID NO: 4274982 - DNA, 21 bp, Homo sapiens
cgtggaaagggtgctgcttcc

SEQ ID NO: 4274983 - DNA, 20 bp, Homo sapiens
cgtggagccacaggcagacg

SEQ ID NO: 4274984 - DNA, 18 bp, Homo sapiens
cgtggaggaatgctcccc

SEQ ID NO: 4274985 - DNA, 21 bp, Homo sapiens
cgtggagtcgagctggccgac

SEQ ID NO: 4274986 - DNA, 16 bp, Homo sapiens
cgtggcatcttaaaag

SEQ ID NO: 4274987 - DNA, 19 bp, Homo sapiens
cgtggcttcccgctcagcc

SEQ ID NO: 4274988 - DNA, 21 bp, Homo sapiens
cgtggcttcccgctcagccct

SEQ ID NO: 4274989 - DNA, 16 bp, Homo sapiens
cgtggctttgtgctta

SEQ ID NO: 4274990 - DNA, 18 bp, Homo sapiens
cgtgggatccagagagaa

SEQ ID NO: 4274991 - DNA, 21 bp, Homo sapiens
cgtgggatccagagagaagca

SEQ ID NO: 4274992 - DNA, 13 bp, Homo sapiens
cgtgggctccagg

SEQ ID NO: 4274993 - DNA, 22 bp, Homo sapiens
cgtggtatgtgaattgaagtca

SEQ ID NO: 4274994 - DNA, 15 bp, Homo sapiens
cgtgtcaatgtgtgc

SEQ ID NO: 4274995 - DNA, 14 bp, Homo sapiens
cgtgtcctatcccc

SEQ ID NO: 4274996 - DNA, 17 bp, Homo sapiens
cgtgtctgtggccctct

SEQ ID NO: 4274997 - DNA, 19 bp, Homo sapiens
cgtgtgctccagtgttttc

SEQ ID NO: 4274998 - DNA, 16 bp, Homo sapiens
cgttatctcattgcaa

SEQ ID NO: 4274999 - DNA, 22 bp, Homo sapiens
cgttatctcattgcaaaaatat

SEQ ID NO: 4275000 - DNA, 19 bp, Homo sapiens
cgttcaacttttcctttga

SEQ ID NO: 4275001 - DNA, 17 bp, Homo sapiens
cgttgttgtccctgcag

SEQ ID NO: 4275002 - DNA, 18 bp, Homo sapiens
ctaaaaagtcagatgttt

SEQ ID NO: 4275003 - DNA, 17 bp, Homo sapiens
ctaaaatactcaccaaa

SEQ ID NO: 4275004 - DNA, 22 bp, Homo sapiens
ctaaaatactcaccaaaatata

SEQ ID NO: 4275005 - DNA, 15 bp, Homo sapiens
ctaaaattcaacaaa

SEQ ID NO: 4275006 - DNA, 22 bp, Homo sapiens
ctaaaattctagtctctgattt

SEQ ID NO: 4275007 - DNA, 17 bp, Homo sapiens
ctaaactgttttcatgt

SEQ ID NO: 4275008 - DNA, 21 bp, Homo sapiens
ctaaaggggacagatcttgag

SEQ ID NO: 4275009 - DNA, 22 bp, Homo sapiens
ctaaatccattttctaaactgt

SEQ ID NO: 4275010 - DNA, 14 bp, Homo sapiens
ctaaatgcaaagca

SEQ ID NO: 4275011 - DNA, 18 bp, Homo sapiens
ctaaatgcctaataaaca

SEQ ID NO: 4275012 - DNA, 13 bp, Homo sapiens
ctaaatgttcatg

SEQ ID NO: 4275013 - DNA, 19 bp, Homo sapiens
ctaaattacaattgtcatt

SEQ ID NO: 4275014 - DNA, 16 bp, Homo sapiens
ctaacactggccccta

SEQ ID NO: 4275015 - DNA, 17 bp, Homo sapiens
ctaacattattactttt

SEQ ID NO: 4275016 - DNA, 18 bp, Homo sapiens
ctaactgattcagggccc

SEQ ID NO: 4275017 - DNA, 13 bp, Homo sapiens
ctaacttttgtgt

SEQ ID NO: 4275018 - DNA, 17 bp, Homo sapiens
ctaacttttgtgtgaaa

SEQ ID NO: 4275019 - DNA, 17 bp, Homo sapiens
ctaagaacccatggaaa

SEQ ID NO: 4275020 - DNA, 13 bp, Homo sapiens
ctaagaataaata

SEQ ID NO: 4275021 - DNA, 16 bp, Homo sapiens
ctaagaataaataaag

SEQ ID NO: 4275022 - DNA, 22 bp, Homo sapiens
ctaagaataaataaagaagaaa

SEQ ID NO: 4275023 - DNA, 14 bp, Homo sapiens
ctaagattgtacat

SEQ ID NO: 4275024 - DNA, 23 bp, Homo sapiens
ctaagcaggaaggtctcatgcct

SEQ ID NO: 4275025 - DNA, 12 bp, Homo sapiens
ctaagcctggac

SEQ ID NO: 4275026 - DNA, 20 bp, Homo sapiens
ctaagcctggacacagtcag

SEQ ID NO: 4275027 - DNA, 22 bp, Homo sapiens
ctaagcctggacacagtcaggg

SEQ ID NO: 4275028 - DNA, 18 bp, Homo sapiens
ctaagctgttggaagggg

SEQ ID NO: 4275029 - DNA, 10 bp, Homo sapiens
ctaagtgact

SEQ ID NO: 4275030 - DNA, 17 bp, Homo sapiens
ctaatcagcattctcac

SEQ ID NO: 4275031 - DNA, 16 bp, Homo sapiens
ctaattaaaaagttaa

SEQ ID NO: 4275032 - DNA, 15 bp, Homo sapiens
ctaattaatttcagt

SEQ ID NO: 4275033 - DNA, 17 bp, Homo sapiens
ctaattaatttcagtaa

SEQ ID NO: 4275034 - DNA, 20 bp, Homo sapiens
ctacactgtgaacttgggga

SEQ ID NO: 4275035 - DNA, 18 bp, Homo sapiens
ctacagccaaattgcaga

SEQ ID NO: 4275036 - DNA, 18 bp, Homo sapiens
ctacagctaatcagcatt

SEQ ID NO: 4275037 - DNA, 20 bp, Homo sapiens
ctacagtagctgtggggagc

SEQ ID NO: 4275038 - DNA, 23 bp, Homo sapiens
ctacagtagctgtggggagctgg

SEQ ID NO: 4275039 - DNA, 19 bp, Homo sapiens
ctacataactaatacagct

SEQ ID NO: 4275040 - DNA, 22 bp, Homo sapiens
ctacataattaaattttaatgt

SEQ ID NO: 4275041 - DNA, 16 bp, Homo sapiens
ctaccacttatttcta

SEQ ID NO: 4275042 - DNA, 20 bp, Homo sapiens
ctaccccaggacgcatgcag

SEQ ID NO: 4275043 - DNA, 22 bp, Homo sapiens
ctacccggctcgttcccccagg

SEQ ID NO: 4275044 - DNA, 23 bp, Homo sapiens
ctacccggctcgttcccccaggg

SEQ ID NO: 4275045 - DNA, 22 bp, Homo sapiens
ctaccgagtctcttctccactg

SEQ ID NO: 4275046 - DNA, 11 bp, Homo sapiens
ctacctgcagg

SEQ ID NO: 4275047 - DNA, 14 bp, Homo sapiens
ctacgcagaagaga

SEQ ID NO: 4275048 - DNA, 22 bp, Homo sapiens
ctacggttccctgcctaggagc

SEQ ID NO: 4275049 - DNA, 13 bp, Homo sapiens
ctactaagaataa

SEQ ID NO: 4275050 - DNA, 21 bp, Homo sapiens
ctactaagaataaataaagaa

SEQ ID NO: 4275051 - DNA, 16 bp, Homo sapiens
ctactgattgaatgtt

SEQ ID NO: 4275052 - DNA, 18 bp, Homo sapiens
ctactttcctgatgttga

SEQ ID NO: 4275053 - DNA, 21 bp, Homo sapiens
ctactttggtttctgtctgta

SEQ ID NO: 4275054 - DNA, 22 bp, Homo sapiens
ctagaaggatgaacagttctcc

SEQ ID NO: 4275055 - DNA, 13 bp, Homo sapiens
ctagacaaccctg

SEQ ID NO: 4275056 - DNA, 16 bp, Homo sapiens
ctagacaaccctgcaa

SEQ ID NO: 4275057 - DNA, 20 bp, Homo sapiens
ctagactgggctggctgcct

SEQ ID NO: 4275058 - DNA, 21 bp, Homo sapiens
ctagactgggctggctgcctt

SEQ ID NO: 4275059 - DNA, 22 bp, Homo sapiens
ctagactgggctggctgccttc

SEQ ID NO: 4275060 - DNA, 21 bp, Homo sapiens
ctctggcactccagaacaaac

SEQ ID NO: 4275061 - DNA, 20 bp, Homo sapiens
ctctggcaggtggccagggc

SEQ ID NO: 4275062 - DNA, 14 bp, Homo sapiens
ctctggccctgttg

SEQ ID NO: 4275063 - DNA, 18 bp, Homo sapiens
ctctggcctgggaaaagg

SEQ ID NO: 4275064 - DNA, 20 bp, Homo sapiens
ctctggccttggttcctcca

SEQ ID NO: 4275065 - DNA, 22 bp, Homo sapiens
ctctggccttggttcctccagc

SEQ ID NO: 4275066 - DNA, 15 bp, Homo sapiens
ctctgggcaggacct

SEQ ID NO: 4275067 - DNA, 22 bp, Homo sapiens
ctctgggctcacaccagccctg

SEQ ID NO: 4275068 - DNA, 23 bp, Homo sapiens
ctctgggctcacaccagccctgg

SEQ ID NO: 4275069 - DNA, 15 bp, Homo sapiens
ctctggggcttgcta

SEQ ID NO: 4275070 - DNA, 14 bp, Homo sapiens
ctctggtccttctg

SEQ ID NO: 4275071 - DNA, 22 bp, Homo sapiens
ctctggtttggggcgaggcaga

SEQ ID NO: 4275072 - DNA, 19 bp, Homo sapiens
ctctgtcactaaatggcag

SEQ ID NO: 4275073 - DNA, 21 bp, Homo sapiens
ctctgtctggctgtacgtctg

SEQ ID NO: 4275074 - DNA, 19 bp, Homo sapiens
ctctgtgctaagttgtctt

SEQ ID NO: 4275075 - DNA, 13 bp, Homo sapiens
ctctgtgtaatct

SEQ ID NO: 4275076 - DNA, 19 bp, Homo sapiens
ctctgtgtaatctctgatt

SEQ ID NO: 4275077 - DNA, 14 bp, Homo sapiens
ctctgttcatttcc

SEQ ID NO: 4275078 - DNA, 22 bp, Homo sapiens
ctctgttgcccaggctggagtg

SEQ ID NO: 4275079 - DNA, 20 bp, Homo sapiens
ctctgtttaccctccctgtc

SEQ ID NO: 4275080 - DNA, 14 bp, Homo sapiens
ctctgtttgctcac

SEQ ID NO: 4275081 - DNA, 17 bp, Homo sapiens
ctctgtttgctcaccca

SEQ ID NO: 4275082 - DNA, 23 bp, Homo sapiens
ctcttaccccgtccctttccctg

SEQ ID NO: 4275083 - DNA, 22 bp, Homo sapiens
ctcttagaagaatattgtattg

SEQ ID NO: 4275084 - DNA, 13 bp, Homo sapiens
ctcttcaccagga

SEQ ID NO: 4275085 - DNA, 12 bp, Homo sapiens
ctcttcccacca

SEQ ID NO: 4275086 - DNA, 17 bp, Homo sapiens
ctcttcccaccaactct

SEQ ID NO: 4275087 - DNA, 15 bp, Homo sapiens
ctcttcccccttccc

SEQ ID NO: 4275088 - DNA, 16 bp, Homo sapiens
ctcttcccccttcccc

SEQ ID NO: 4275089 - DNA, 17 bp, Homo sapiens
ctcttcccccttcccct

SEQ ID NO: 4275090 - DNA, 23 bp, Homo sapiens
cttggcaggagtgggctctgagc

SEQ ID NO: 4275091 - DNA, 22 bp, Homo sapiens
cttggcccagcagcggcccaga

SEQ ID NO: 4275092 - DNA, 12 bp, Homo sapiens
cttggcccctct

SEQ ID NO: 4275093 - DNA, 16 bp, Homo sapiens
cttggcctcttcggga

SEQ ID NO: 4275094 - DNA, 15 bp, Homo sapiens
cttggcctgtccacc

SEQ ID NO: 4275095 - DNA, 20 bp, Homo sapiens
cttgggaccaaaactgccta

SEQ ID NO: 4275096 - DNA, 16 bp, Homo sapiens
cttgggatgggcacag

SEQ ID NO: 4275097 - DNA, 17 bp, Homo sapiens
cttgggatgggcacagg

SEQ ID NO: 4275098 - DNA, 19 bp, Homo sapiens
cttgggatgggcacaggct

SEQ ID NO: 4275099 - DNA, 17 bp, Homo sapiens
cttgggctgagactgga

SEQ ID NO: 4275100 - DNA, 19 bp, Homo sapiens
cttggggtagagaggacag

SEQ ID NO: 4275101 - DNA, 13 bp, Homo sapiens
cttggtccttaaa

SEQ ID NO: 4275102 - DNA, 22 bp, Homo sapiens
cttggtctaacttttgtgtgaa

SEQ ID NO: 4275103 - DNA, 13 bp, Homo sapiens
cttgtagggtgag

SEQ ID NO: 4275104 - DNA, 19 bp, Homo sapiens
cttgtatctggattcaaat

SEQ ID NO: 4275105 - DNA, 15 bp, Homo sapiens
cttgtcagagctggg

SEQ ID NO: 4275106 - DNA, 22 bp, Homo sapiens
cttgtcctgctcagatgctggt

SEQ ID NO: 4275107 - DNA, 17 bp, Homo sapiens
cttcagactctctcctc

SEQ ID NO: 4275108 - DNA, 17 bp, Homo sapiens
cttcaggcaccacagat

SEQ ID NO: 4275109 - DNA, 22 bp, Homo sapiens
cttcaggctcttctcctttcac

SEQ ID NO: 4275110 - DNA, 13 bp, Homo sapiens
cttcagtcattaa

SEQ ID NO: 4275111 - DNA, 15 bp, Homo sapiens
cttcagtcattaaat

SEQ ID NO: 4275112 - DNA, 13 bp, Homo sapiens
cttcataggcaga

SEQ ID NO: 4275113 - DNA, 21 bp, Homo sapiens
cttcatggaactcagctgtct

SEQ ID NO: 4275114 - DNA, 20 bp, Homo sapiens
cttcattttctaattctctt

SEQ ID NO: 4275115 - DNA, 21 bp, Homo sapiens
cttccaaagagtcatcatggg

SEQ ID NO: 4275116 - DNA, 14 bp, Homo sapiens
cttccacccccagc

SEQ ID NO: 4275117 - DNA, 20 bp, Homo sapiens
cttccacgctgtctccagac

SEQ ID NO: 4275118 - DNA, 22 bp, Homo sapiens
cttccacgctgtctccagaccc

SEQ ID NO: 4275119 - DNA, 17 bp, Homo sapiens
ctgctcctcggccagag

SEQ ID NO: 4275120 - DNA, 15 bp, Homo sapiens
ctgctcctgtggcgg

SEQ ID NO: 4275121 - DNA, 20 bp, Homo sapiens
ctgctcctgtggcggtgcag

SEQ ID NO: 4275122 - DNA, 19 bp, Homo sapiens
ctgctgagctctgacctgc

SEQ ID NO: 4275123 - DNA, 17 bp, Homo sapiens
ctgctgaggccagagga

SEQ ID NO: 4275124 - DNA, 21 bp, Homo sapiens
ctgctgaggccagaggaaggg

SEQ ID NO: 4275125 - DNA, 16 bp, Homo sapiens
ctgctgcaccaacctc

SEQ ID NO: 4275126 - DNA, 16 bp, Homo sapiens
ctgctgcactgccctc

SEQ ID NO: 4275127 - DNA, 18 bp, Homo sapiens
ctgctgcactgccctccg

SEQ ID NO: 4275128 - DNA, 17 bp, Homo sapiens
ctgctgcagtcagcaca

SEQ ID NO: 4275129 - DNA, 19 bp, Homo sapiens
ctgctgcagtcagcacaga

SEQ ID NO: 4275130 - DNA, 22 bp, Homo sapiens
ctgctgccaggctcccactgcc

SEQ ID NO: 4275131 - DNA, 18 bp, Homo sapiens
ctgctgccatgattttgg

SEQ ID NO: 4275132 - DNA, 23 bp, Homo sapiens
ctgctgccatgattttggccact

SEQ ID NO: 4275133 - DNA, 17 bp, Homo sapiens
ctgctgcccgtgaggag

SEQ ID NO: 4275134 - DNA, 12 bp, Homo sapiens
ctgctgccctcc

SEQ ID NO: 4275135 - DNA, 16 bp, Homo sapiens
ctgctgcctcaggaat

SEQ ID NO: 4275136 - DNA, 15 bp, Homo sapiens
ctgctgcctctgaaa

SEQ ID NO: 4275137 - DNA, 20 bp, Homo sapiens
ctgctgctcctcggccagag

SEQ ID NO: 4275138 - DNA, 23 bp, Homo sapiens
ctgctgctcctcggccagagctc

SEQ ID NO: 4275139 - DNA, 14 bp, Homo sapiens
ctgctgctggtcac

SEQ ID NO: 4275140 - DNA, 14 bp, Homo sapiens
ctgctggcccctca

SEQ ID NO: 4275141 - DNA, 23 bp, Homo sapiens
ctgctggcccctcacctgggcac

SEQ ID NO: 4275142 - DNA, 17 bp, Homo sapiens
ctgctggctcccatctc

SEQ ID NO: 4275143 - DNA, 15 bp, Homo sapiens
ctgctggtgcccacc

SEQ ID NO: 4275144 - DNA, 16 bp, Homo sapiens
ctgctggtgcccaccc

SEQ ID NO: 4275145 - DNA, 19 bp, Homo sapiens
ctgctgtaagacggccttg

SEQ ID NO: 4275146 - DNA, 18 bp, Homo sapiens
ctgctgtgggtcagtgtg

SEQ ID NO: 4275147 - DNA, 16 bp, Homo sapiens
ctgcttagtgtccctt

SEQ ID NO: 4275148 - DNA, 20 bp, Homo sapiens
ctgcttccctctgcctgtcc

SEQ ID NO: 4275149 - DNA, 21 bp, Homo sapiens
ctgcttccctctgcctgtccc

SEQ ID NO: 4275150 - DNA, 16 bp, Homo sapiens
ctgcttctgcccaccc

SEQ ID NO: 4275151 - DNA, 18 bp, Homo sapiens
ctgcttggatccatacaa

SEQ ID NO: 4275152 - DNA, 19 bp, Homo sapiens
ctgcttgtgttgggcccca

SEQ ID NO: 4275153 - DNA, 19 bp, Homo sapiens
ctgctttgggctgccctgg

SEQ ID NO: 4275154 - DNA, 18 bp, Homo sapiens
ctgcttttccattctggg

SEQ ID NO: 4275155 - DNA, 23 bp, Homo sapiens
ctgcttttgtcactcggctttgg

SEQ ID NO: 4275156 - DNA, 18 bp, Homo sapiens
ctggaactgtctctcatg

SEQ ID NO: 4275157 - DNA, 19 bp, Homo sapiens
ctggaactgtctctcatga

SEQ ID NO: 4275158 - DNA, 13 bp, Homo sapiens
ctggaataagaag

SEQ ID NO: 4275159 - DNA, 19 bp, Homo sapiens
ctggaataagaagcaaata

SEQ ID NO: 4275160 - DNA, 15 bp, Homo sapiens
ctggacacagtcagg

SEQ ID NO: 4275161 - DNA, 19 bp, Homo sapiens
ctggacacagtcagggcgg

SEQ ID NO: 4275162 - DNA, 23 bp, Homo sapiens
ctggacacagtcagggcggggct

SEQ ID NO: 4275163 - DNA, 16 bp, Homo sapiens
ctggacgcatgcaggg

SEQ ID NO: 4275164 - DNA, 20 bp, Homo sapiens
ctggactctgtggggccaca

SEQ ID NO: 4275165 - DNA, 17 bp, Homo sapiens
ctggactgggaaggggg

SEQ ID NO: 4275166 - DNA, 21 bp, Homo sapiens
ctggagcgtgtactaccccag

SEQ ID NO: 4275167 - DNA, 23 bp, Homo sapiens
ctggaggctgggtggccggccct

SEQ ID NO: 4275168 - DNA, 18 bp, Homo sapiens
ctggaggtcccagacatg

SEQ ID NO: 4275169 - DNA, 23 bp, Homo sapiens
ctggaggtcccagacatgctgcc

SEQ ID NO: 4275170 - DNA, 15 bp, Homo sapiens
ctggagtcctgttct

SEQ ID NO: 4275171 - DNA, 17 bp, Homo sapiens
ctggagtcctgttctca

SEQ ID NO: 4275172 - DNA, 19 bp, Homo sapiens
ctggagtcctgttctcaga

SEQ ID NO: 4275173 - DNA, 21 bp, Homo sapiens
ctggagtcctgttctcagagc

SEQ ID NO: 4275174 - DNA, 13 bp, Homo sapiens
ctggatcagtaaa

SEQ ID NO: 4275175 - DNA, 14 bp, Homo sapiens
ctggatcagtaaaa

SEQ ID NO: 4275176 - DNA, 20 bp, Homo sapiens
ctggatccctttcactatgt

SEQ ID NO: 4275177 - DNA, 20 bp, Homo sapiens
ctggatctcttaagacagca

SEQ ID NO: 4275178 - DNA, 22 bp, Homo sapiens
ctggatgagtagcgctatagtt

SEQ ID NO: 4275179 - DNA, 19 bp, Homo sapiens
ctggatggatctgctccat

SEQ ID NO: 4275180 - DNA, 20 bp, Homo sapiens
ctggattcccgtggctttgt

SEQ ID NO: 4275181 - DNA, 20 bp, Homo sapiens
ctggattttctttctatgta

SEQ ID NO: 4275182 - DNA, 17 bp, Homo sapiens
ctggcacagggcagtgg

SEQ ID NO: 4275183 - DNA, 18 bp, Homo sapiens
ctggcagaactgagctcc

SEQ ID NO: 4275184 - DNA, 20 bp, Homo sapiens
ctggcagaactgagctcctc

SEQ ID NO: 4275185 - DNA, 21 bp, Homo sapiens
ctggcagaactgagctcctct

SEQ ID NO: 4275186 - DNA, 17 bp, Homo sapiens
ctggcagccgtgccttc

SEQ ID NO: 4275187 - DNA, 18 bp, Homo sapiens
ctggcagccgtgccttca

SEQ ID NO: 4275188 - DNA, 19 bp, Homo sapiens
ctggcagccgtgccttcag

SEQ ID NO: 4275189 - DNA, 22 bp, Homo sapiens
ctggcagccgtgccttcagctc

SEQ ID NO: 4275190 - DNA, 17 bp, Homo sapiens
ctggcagcctcagaggc

SEQ ID NO: 4275191 - DNA, 13 bp, Homo sapiens
ctggcaggagaca

SEQ ID NO: 4275192 - DNA, 17 bp, Homo sapiens
ctggcaggagacactgg

SEQ ID NO: 4275193 - DNA, 12 bp, Homo sapiens
ctggcagggcag

SEQ ID NO: 4275194 - DNA, 17 bp, Homo sapiens
ctggcagggcaggcaga

SEQ ID NO: 4275195 - DNA, 18 bp, Homo sapiens
ctggcagggcaggcagag

SEQ ID NO: 4275196 - DNA, 22 bp, Homo sapiens
ctggcagggcaggcagagctca

SEQ ID NO: 4275197 - DNA, 14 bp, Homo sapiens
ctggcaggtggcca

SEQ ID NO: 4275198 - DNA, 18 bp, Homo sapiens
ctggcaggtggccagggc

SEQ ID NO: 4275199 - DNA, 19 bp, Homo sapiens
ctggcaggtggccagggct

SEQ ID NO: 4275200 - DNA, 19 bp, Homo sapiens
ctggcatggggaggggaga

SEQ ID NO: 4275201 - DNA, 20 bp, Homo sapiens
ctggcatggggaggggagag

SEQ ID NO: 4275202 - DNA, 13 bp, Homo sapiens
ctggcatgtctgg

SEQ ID NO: 4275203 - DNA, 15 bp, Homo sapiens
ctggcatgtctgggt

SEQ ID NO: 4275204 - DNA, 15 bp, Homo sapiens
ctggccacccttggc

SEQ ID NO: 4275205 - DNA, 22 bp, Homo sapiens
ctggccacccttggcctgtcca

SEQ ID NO: 4275206 - DNA, 13 bp, Homo sapiens
ctggccactctgc

SEQ ID NO: 4275207 - DNA, 15 bp, Homo sapiens
ctggccagctgtgcg

SEQ ID NO: 4275208 - DNA, 13 bp, Homo sapiens
ctggcccacccct

SEQ ID NO: 4275209 - DNA, 15 bp, Homo sapiens
ctggcccacccctct

SEQ ID NO: 4275210 - DNA, 16 bp, Homo sapiens
ctggcccacccctctt

SEQ ID NO: 4275211 - DNA, 22 bp, Homo sapiens
ctggcccacccctcttccccct

SEQ ID NO: 4275212 - DNA, 11 bp, Homo sapiens
ctggcccagcc

SEQ ID NO: 4275213 - DNA, 17 bp, Homo sapiens
ctggcccagccagcagg

SEQ ID NO: 4275214 - DNA, 21 bp, Homo sapiens
ctggcccagcctgtggcctca

SEQ ID NO: 4275215 - DNA, 23 bp, Homo sapiens
ctggcccagcctgtggcctcagc

SEQ ID NO: 4275216 - DNA, 15 bp, Homo sapiens
ctggcccctcacctg

SEQ ID NO: 4275217 - DNA, 19 bp, Homo sapiens
ctggccctcctctggtcac

SEQ ID NO: 4275218 - DNA, 12 bp, Homo sapiens
ctggccctgctg

SEQ ID NO: 4275219 - DNA, 15 bp, Homo sapiens
ctggccctgctgccc

SEQ ID NO: 4275220 - DNA, 16 bp, Homo sapiens
ctggccctgctgcccc

SEQ ID NO: 4275221 - DNA, 18 bp, Homo sapiens
ctggccctgctgccccct

SEQ ID NO: 4275222 - DNA, 14 bp, Homo sapiens
ctggccctttcacc

SEQ ID NO: 4275223 - DNA, 19 bp, Homo sapiens
ctggccctttcacccctct

SEQ ID NO: 4275224 - DNA, 15 bp, Homo sapiens
ctggccgacggaccc

SEQ ID NO: 4275225 - DNA, 14 bp, Homo sapiens
ctggcctctggcct

SEQ ID NO: 4275226 - DNA, 17 bp, Homo sapiens
ctggcctctggcctggg

SEQ ID NO: 4275227 - DNA, 19 bp, Homo sapiens
ctggcctctggcctgggaa

SEQ ID NO: 4275228 - DNA, 21 bp, Homo sapiens
ctggcctgggaaaagggcagg

SEQ ID NO: 4275229 - DNA, 14 bp, Homo sapiens
ctggcgtctgtctt

SEQ ID NO: 4275230 - DNA, 15 bp, Homo sapiens
ctggcgtctgtcttc

SEQ ID NO: 4275231 - DNA, 22 bp, Homo sapiens
ctggcgtctgtcttcaagggct

SEQ ID NO: 4275232 - DNA, 23 bp, Homo sapiens
ctggcgtctgtcttcaagggctt

SEQ ID NO: 4275233 - DNA, 21 bp, Homo sapiens
ctggctcagcctcaaatgcag

SEQ ID NO: 4275234 - DNA, 17 bp, Homo sapiens
ctggctccaccgggagg

SEQ ID NO: 4275235 - DNA, 14 bp, Homo sapiens
ctggctcccagggc

SEQ ID NO: 4275236 - DNA, 16 bp, Homo sapiens
ctggctcccagggcca

SEQ ID NO: 4275237 - DNA, 15 bp, Homo sapiens
ctggctcccagggtc

SEQ ID NO: 4275238 - DNA, 21 bp, Homo sapiens
ctggctcccatctccctccca

SEQ ID NO: 4275239 - DNA, 22 bp, Homo sapiens
ctggctcccatctccctcccat

SEQ ID NO: 4275240 - DNA, 15 bp, Homo sapiens
ctggctcctccagca

SEQ ID NO: 4275241 - DNA, 17 bp, Homo sapiens
ctggctctgcagcacat

SEQ ID NO: 4275242 - DNA, 11 bp, Homo sapiens
ctggctgcctt

SEQ ID NO: 4275243 - DNA, 19 bp, Homo sapiens
ctggctgccttagaacctt

SEQ ID NO: 4275244 - DNA, 12 bp, Homo sapiens
ctggctggactg

SEQ ID NO: 4275245 - DNA, 17 bp, Homo sapiens
ctggctggactggaggc

SEQ ID NO: 4275246 - DNA, 13 bp, Homo sapiens
ctggcttcccagg

SEQ ID NO: 4275247 - DNA, 14 bp, Homo sapiens
ctggcttctccctg

SEQ ID NO: 4275248 - DNA, 16 bp, Homo sapiens
ctggcttctccctgga

SEQ ID NO: 4275249 - DNA, 20 bp, Homo sapiens
atgtgaaaggatatgaatct

SEQ ID NO: 4275250 - DNA, 17 bp, Homo sapiens
atgtgaaatgtaactgt

SEQ ID NO: 4275251 - DNA, 21 bp, Homo sapiens
atgtgactccatatcccggga

SEQ ID NO: 4275252 - DNA, 14 bp, Homo sapiens
atgtgagctataat

SEQ ID NO: 4275253 - DNA, 19 bp, Homo sapiens
atgtgagctataatgtttc

SEQ ID NO: 4275254 - DNA, 15 bp, Homo sapiens
atgtgattggcagct

SEQ ID NO: 4275255 - DNA, 23 bp, Homo sapiens
atgtgattggcagcttcaaaaca

SEQ ID NO: 4275256 - DNA, 21 bp, Homo sapiens
atgtgatttgtgtaatactaa

SEQ ID NO: 4275257 - DNA, 13 bp, Homo sapiens
atgtgctattaat

SEQ ID NO: 4275258 - DNA, 14 bp, Homo sapiens
atgtgctgctgtgg

SEQ ID NO: 4275259 - DNA, 14 bp, Homo sapiens
atgtgctgtgcacc

SEQ ID NO: 4275260 - DNA, 20 bp, Homo sapiens
atgtgcttttccatctaaaa

SEQ ID NO: 4275261 - DNA, 21 bp, Homo sapiens
atgtgcttttccatctaaaat

SEQ ID NO: 4275262 - DNA, 16 bp, Homo sapiens
atgtggagtggggcag

SEQ ID NO: 4275263 - DNA, 16 bp, Homo sapiens
atgtgtatcagtgttt

SEQ ID NO: 4275264 - DNA, 18 bp, Homo sapiens
atgtgtcagctgtagaaa

SEQ ID NO: 4275265 - DNA, 15 bp, Homo sapiens
atgtgtcatgatttc

SEQ ID NO: 4275266 - DNA, 18 bp, Homo sapiens
atgtgtcatgatttcaat

SEQ ID NO: 4275267 - DNA, 23 bp, Homo sapiens
atgtgtcatgatttcaatgattg

SEQ ID NO: 4275268 - DNA, 21 bp, Homo sapiens
atgtgtccatgtgaaatttac

SEQ ID NO: 4275269 - DNA, 14 bp, Homo sapiens
atgtgtgtttctgt

SEQ ID NO: 4275270 - DNA, 13 bp, Homo sapiens
atgtgttaatctt

SEQ ID NO: 4275271 - DNA, 17 bp, Homo sapiens
atgtgttaatcttaatg

SEQ ID NO: 4275272 - DNA, 16 bp, Homo sapiens
atgtgttgcaaattat

SEQ ID NO: 4275273 - DNA, 23 bp, Homo sapiens
atgtgttgcaaattattctagtc

SEQ ID NO: 4275274 - DNA, 17 bp, Homo sapiens
atgtgtttactttatgt

SEQ ID NO: 4275275 - DNA, 21 bp, Homo sapiens
atgttaaagaggcgtcttgta

SEQ ID NO: 4275276 - DNA, 22 bp, Homo sapiens
atgttaacaatgcctattgtaa

SEQ ID NO: 4275277 - DNA, 13 bp, Homo sapiens
atgttaagctctt

SEQ ID NO: 4275278 - DNA, 22 bp, Homo sapiens
atgttatacaaccttcatttaa

SEQ ID NO: 4275279 - DNA, 21 bp, Homo sapiens
atgttcatgtgtaacttctag

SEQ ID NO: 4275280 - DNA, 23 bp, Homo sapiens
atgttcttatttaaattttcaga

SEQ ID NO: 4275281 - DNA, 14 bp, Homo sapiens
atgttgaatgtttg

SEQ ID NO: 4275282 - DNA, 17 bp, Homo sapiens
atgttgataatagtaat

SEQ ID NO: 4275283 - DNA, 19 bp, Homo sapiens
atgtttacctcactggtgc

SEQ ID NO: 4275284 - DNA, 22 bp, Homo sapiens
atgtttacctcactggtgcatt

SEQ ID NO: 4275285 - DNA, 13 bp, Homo sapiens
atgtttgttttca

SEQ ID NO: 4275286 - DNA, 20 bp, Homo sapiens
atgtttgttttcaaaatact

SEQ ID NO: 4275287 - DNA, 12 bp, Homo sapiens
atgttttagcat

SEQ ID NO: 4275288 - DNA, 21 bp, Homo sapiens
attaaaaacacctaagtgact

SEQ ID NO: 4275289 - DNA, 20 bp, Homo sapiens
attaaaataactaagcaagt

SEQ ID NO: 4275290 - DNA, 16 bp, Homo sapiens
attaaaattagtgaga

SEQ ID NO: 4275291 - DNA, 18 bp, Homo sapiens
attaaagtgcactgtgtc

SEQ ID NO: 4275292 - DNA, 21 bp, Homo sapiens
attaaatgtagcttcagtcat

SEQ ID NO: 4275293 - DNA, 19 bp, Homo sapiens
attaaatttaatatactgc

SEQ ID NO: 4275294 - DNA, 16 bp, Homo sapiens
attaacaattaattgt

SEQ ID NO: 4275295 - DNA, 18 bp, Homo sapiens
attaacaattaattgtct

SEQ ID NO: 4275296 - DNA, 13 bp, Homo sapiens
attaaccaaatta

SEQ ID NO: 4275297 - DNA, 12 bp, Homo sapiens
attaagaaaccc

SEQ ID NO: 4275298 - DNA, 18 bp, Homo sapiens
attaagcccacagtatat

SEQ ID NO: 4275299 - DNA, 19 bp, Homo sapiens
attaagcccacagtatatt

SEQ ID NO: 4275300 - DNA, 21 bp, Homo sapiens
attaagtattccttggcccag

SEQ ID NO: 4275301 - DNA, 12 bp, Homo sapiens
attaatatttgt

SEQ ID NO: 4275302 - DNA, 19 bp, Homo sapiens
attaatctctaaaattcta

SEQ ID NO: 4275303 - DNA, 20 bp, Homo sapiens
attaatctctaaaattctag

SEQ ID NO: 4275304 - DNA, 22 bp, Homo sapiens
attaatctctaaaattctagtc

SEQ ID NO: 4275305 - DNA, 12 bp, Homo sapiens
attaattgtctt

SEQ ID NO: 4275306 - DNA, 14 bp, Homo sapiens
attaatttaaatga

SEQ ID NO: 4275307 - DNA, 12 bp, Homo sapiens
attaatttgtgt

SEQ ID NO: 4275308 - DNA, 15 bp, Homo sapiens
attacagaagaagct

SEQ ID NO: 4275309 - DNA, 21 bp, Homo sapiens
cagccattcacaacacaatca

SEQ ID NO: 4275310 - DNA, 11 bp, Homo sapiens
cagcccacccc

SEQ ID NO: 4275311 - DNA, 17 bp, Homo sapiens
cagcccacccccctcat

SEQ ID NO: 4275312 - DNA, 13 bp, Homo sapiens
cagcccacctgct

SEQ ID NO: 4275313 - DNA, 16 bp, Homo sapiens
cagcccacctgctgcc

SEQ ID NO: 4275314 - DNA, 20 bp, Homo sapiens
cagcccagagagaccctgcc

SEQ ID NO: 4275315 - DNA, 22 bp, Homo sapiens
cagcccagagagaccctgccaa

SEQ ID NO: 4275316 - DNA, 23 bp, Homo sapiens
cagcccagagagaccctgccaac

SEQ ID NO: 4275317 - DNA, 20 bp, Homo sapiens
cagcccagatggctccctgg

SEQ ID NO: 4275318 - DNA, 22 bp, Homo sapiens
cagcccagatggctccctgggc

SEQ ID NO: 4275319 - DNA, 11 bp, Homo sapiens
cagcccagggt

SEQ ID NO: 4275320 - DNA, 15 bp, Homo sapiens
cagcccaggtctcct

SEQ ID NO: 4275321 - DNA, 16 bp, Homo sapiens
cagcccaggtctcctg

SEQ ID NO: 4275322 - DNA, 17 bp, Homo sapiens
cagcccaggtctcctgg

SEQ ID NO: 4275323 - DNA, 13 bp, Homo sapiens
cagccccaggcct

SEQ ID NO: 4275324 - DNA, 12 bp, Homo sapiens
cagccccagggc

SEQ ID NO: 4275325 - DNA, 16 bp, Homo sapiens
cagccccagggccctg

SEQ ID NO: 4275326 - DNA, 18 bp, Homo sapiens
cagccccagggccctgct

SEQ ID NO: 4275327 - DNA, 21 bp, Homo sapiens
cagccccccagtgtccccagg

SEQ ID NO: 4275328 - DNA, 17 bp, Homo sapiens
cagccccctcctgaccc

SEQ ID NO: 4275329 - DNA, 16 bp, Homo sapiens
cagccccctggcccct

SEQ ID NO: 4275330 - DNA, 13 bp, Homo sapiens
cagcccctcccac

SEQ ID NO: 4275331 - DNA, 15 bp, Homo sapiens
cagcccctcccacca

SEQ ID NO: 4275332 - DNA, 22 bp, Homo sapiens
cagcccctcccaccacagcagg

SEQ ID NO: 4275333 - DNA, 13 bp, Homo sapiens
cagcccctcccca

SEQ ID NO: 4275334 - DNA, 14 bp, Homo sapiens
cagcccctccccat

SEQ ID NO: 4275335 - DNA, 22 bp, Homo sapiens
cagcccctcttgccccccaccc

SEQ ID NO: 4275336 - DNA, 13 bp, Homo sapiens
cagcccctgctgc

SEQ ID NO: 4275337 - DNA, 12 bp, Homo sapiens
cagcccctgggg

SEQ ID NO: 4275338 - DNA, 22 bp, Homo sapiens
cagcccgggagatccgccctgg

SEQ ID NO: 4275339 - DNA, 18 bp, Homo sapiens
cagcccgtgtggcccctt

SEQ ID NO: 4275340 - DNA, 21 bp, Homo sapiens
cagcccgtgtggccccttcac

SEQ ID NO: 4275341 - DNA, 15 bp, Homo sapiens
cagccctctcactgt

SEQ ID NO: 4275342 - DNA, 13 bp, Homo sapiens
cagccctgccctt

SEQ ID NO: 4275343 - DNA, 23 bp, Homo sapiens
cagccctgctttgggctgccctg

SEQ ID NO: 4275344 - DNA, 19 bp, Homo sapiens
cagccctggtggccaagcc

SEQ ID NO: 4275345 - DNA, 23 bp, Homo sapiens
cagccctggtggccaagcctgcc

SEQ ID NO: 4275346 - DNA, 18 bp, Homo sapiens
cagccctgtcagtgcagc

SEQ ID NO: 4275347 - DNA, 20 bp, Homo sapiens
cagccctgtcagtgcagccc

SEQ ID NO: 4275348 - DNA, 17 bp, Homo sapiens
cagccgctggtgcccac

SEQ ID NO: 4275349 - DNA, 16 bp, Homo sapiens
cagccggggagctgag

SEQ ID NO: 4275350 - DNA, 18 bp, Homo sapiens
cagccgtgccttcagctc

SEQ ID NO: 4275351 - DNA, 16 bp, Homo sapiens
cagcctaagatgaaga

SEQ ID NO: 4275352 - DNA, 17 bp, Homo sapiens
cagcctcagaggcccct

SEQ ID NO: 4275353 - DNA, 14 bp, Homo sapiens
cagcctcagtgcag

SEQ ID NO: 4275354 - DNA, 18 bp, Homo sapiens
cagcctcagtgcagcccc

SEQ ID NO: 4275355 - DNA, 12 bp, Homo sapiens
cagcctccactc

SEQ ID NO: 4275356 - DNA, 13 bp, Homo sapiens
cagcctccactcc

SEQ ID NO: 4275357 - DNA, 20 bp, Homo sapiens
cagcctggcacagggcagtg

SEQ ID NO: 4275358 - DNA, 19 bp, Homo sapiens
cagcctggccccaaatgtt

SEQ ID NO: 4275359 - DNA, 18 bp, Homo sapiens
cagcctgtgaactgccag

SEQ ID NO: 4275360 - DNA, 14 bp, Homo sapiens
cagcctgtggcctc

SEQ ID NO: 4275361 - DNA, 14 bp, Homo sapiens
cagcctgtgggaga

SEQ ID NO: 4275362 - DNA, 19 bp, Homo sapiens
cagcctgtgggagaaggga

SEQ ID NO: 4275363 - DNA, 15 bp, Homo sapiens
cagcctgtgggtcct

SEQ ID NO: 4275364 - DNA, 13 bp, Homo sapiens
cagccttaagaaa

SEQ ID NO: 4275365 - DNA, 13 bp, Homo sapiens
cagcggcccagat

SEQ ID NO: 4275366 - DNA, 12 bp, Homo sapiens
cagcggcctggg

SEQ ID NO: 4275367 - DNA, 21 bp, Homo sapiens
cagcgtctgagcggccgcctg

SEQ ID NO: 4275368 - DNA, 21 bp, Homo sapiens
cagcgtctttttaacctcaga

SEQ ID NO: 4275369 - DNA, 15 bp, Homo sapiens
cagctaagcctgatg

SEQ ID NO: 4275370 - DNA, 18 bp, Homo sapiens
cagctaagcctgatgatg

SEQ ID NO: 4275371 - DNA, 19 bp, Homo sapiens
cagctaatcagcattctca

SEQ ID NO: 4275372 - DNA, 23 bp, Homo sapiens
cagctagatttgtgtccacacta

SEQ ID NO: 4275373 - DNA, 21 bp, Homo sapiens
cagctcagaagtttcttcttt

SEQ ID NO: 4275374 - DNA, 20 bp, Homo sapiens
cagctcaggctactgccact

SEQ ID NO: 4275375 - DNA, 22 bp, Homo sapiens
cagctcaggctactgccactca

SEQ ID NO: 4275376 - DNA, 13 bp, Homo sapiens
cagctccaggcag

SEQ ID NO: 4275377 - DNA, 12 bp, Homo sapiens
cagctcccagcc

SEQ ID NO: 4275378 - DNA, 14 bp, Homo sapiens
cagctccttagaca

SEQ ID NO: 4275379 - DNA, 23 bp, Homo sapiens
cagctccttagacacctatcaga

SEQ ID NO: 4275380 - DNA, 19 bp, Homo sapiens
cagctcctttccctggaag

SEQ ID NO: 4275381 - DNA, 17 bp, Homo sapiens
cagctctagacaaccct

SEQ ID NO: 4275382 - DNA, 16 bp, Homo sapiens
cagctctcccctgcgc

SEQ ID NO: 4275383 - DNA, 19 bp, Homo sapiens
cagctctcccctgcgcagg

SEQ ID NO: 4275384 - DNA, 20 bp, Homo sapiens
cagctgcagttagcacagag

SEQ ID NO: 4275385 - DNA, 23 bp, Homo sapiens
cagctgcagttagcacagaggat

SEQ ID NO: 4275386 - DNA, 15 bp, Homo sapiens
cagctgccagagaag

SEQ ID NO: 4275387 - DNA, 20 bp, Homo sapiens
cagctgctcctcgcagttcg

SEQ ID NO: 4275388 - DNA, 16 bp, Homo sapiens
cagctgcttctgccca

SEQ ID NO: 4275389 - DNA, 22 bp, Homo sapiens
cagctgcttctgcccaccccgc

SEQ ID NO: 4275390 - DNA, 11 bp, Homo sapiens
cagctggctct

SEQ ID NO: 4275391 - DNA, 13 bp, Homo sapiens
cagctggctctga

SEQ ID NO: 4275392 - DNA, 23 bp, Homo sapiens
cagctggctctgaatgtagccag

SEQ ID NO: 4275393 - DNA, 17 bp, Homo sapiens
cagctggctctgcagca

SEQ ID NO: 4275394 - DNA, 15 bp, Homo sapiens
cagctgtagaaaggt

SEQ ID NO: 4275395 - DNA, 23 bp, Homo sapiens
cagcttagaagttcgaaaactca

SEQ ID NO: 4275396 - DNA, 13 bp, Homo sapiens
cagcttcaaaaca

SEQ ID NO: 4275397 - DNA, 23 bp, Homo sapiens
cagcttgaatgtccccattctat

SEQ ID NO: 4275398 - DNA, 14 bp, Homo sapiens
cagcttgtttctat

SEQ ID NO: 4275399 - DNA, 18 bp, Homo sapiens
cagctttgccttccacgc

SEQ ID NO: 4275400 - DNA, 14 bp, Homo sapiens
caggaaaactgttt

SEQ ID NO: 4275401 - DNA, 17 bp, Homo sapiens
caggaaaactgtttttc

SEQ ID NO: 4275402 - DNA, 23 bp, Homo sapiens
caggaaagtatctctactttcct

SEQ ID NO: 4275403 - DNA, 15 bp, Homo sapiens
caggaacacccagcc

SEQ ID NO: 4275404 - DNA, 15 bp, Homo sapiens
caggaaggaagagca

SEQ ID NO: 4275405 - DNA, 19 bp, Homo sapiens
caggaaggaagagcaagct

SEQ ID NO: 4275406 - DNA, 20 bp, Homo sapiens
caggaaggtctcatgcctga

SEQ ID NO: 4275407 - DNA, 16 bp, Homo sapiens
caggaagtcaggagcc

SEQ ID NO: 4275408 - DNA, 17 bp, Homo sapiens
caggaagtcaggagcca

SEQ ID NO: 4275409 - DNA, 20 bp, Homo sapiens
caggaagtcaggagccagca

SEQ ID NO: 4275410 - DNA, 16 bp, Homo sapiens
caggaagtccctgaga

SEQ ID NO: 4275411 - DNA, 21 bp, Homo sapiens
caggaagtccctgagaagcct

SEQ ID NO: 4275412 - DNA, 21 bp, Homo sapiens
caggacactgcctttgctgcc

SEQ ID NO: 4275413 - DNA, 23 bp, Homo sapiens
caggagccaggtgtcctgactgt

SEQ ID NO: 4275414 - DNA, 12 bp, Homo sapiens
caggagcctaga

SEQ ID NO: 4275415 - DNA, 15 bp, Homo sapiens
caggagcctagagga

SEQ ID NO: 4275416 - DNA, 14 bp, Homo sapiens
caggagcgtgtact

SEQ ID NO: 4275417 - DNA, 14 bp, Homo sapiens
caggagcgtgtcct

SEQ ID NO: 4275418 - DNA, 15 bp, Homo sapiens
caggagcgtgtccta

SEQ ID NO: 4275419 - DNA, 16 bp, Homo sapiens
caggagcgtgtcctat

SEQ ID NO: 4275420 - DNA, 14 bp, Homo sapiens
caggaggaactggt

SEQ ID NO: 4275421 - DNA, 21 bp, Homo sapiens
caggaggaactggtccaggcc

SEQ ID NO: 4275422 - DNA, 13 bp, Homo sapiens
caggaggacctgg

SEQ ID NO: 4275423 - DNA, 13 bp, Homo sapiens
caggaggagacag

SEQ ID NO: 4275424 - DNA, 23 bp, Homo sapiens
caggagggcatccctggggatgt

SEQ ID NO: 4275425 - DNA, 16 bp, Homo sapiens
caggagggtggcactt

SEQ ID NO: 4275426 - DNA, 20 bp, Homo sapiens
caggagtgggtgggacacag

SEQ ID NO: 4275427 - DNA, 22 bp, Homo sapiens
caggagtgggtgggacacagag

SEQ ID NO: 4275428 - DNA, 16 bp, Homo sapiens
caggatgaactagcca

SEQ ID NO: 4275429 - DNA, 22 bp, Homo sapiens
caggatgcatgcagggccccca

SEQ ID NO: 4275430 - DNA, 19 bp, Homo sapiens
caggattaatctctaaaat

SEQ ID NO: 4275431 - DNA, 20 bp, Homo sapiens
caggattgtccacaaatgtc

SEQ ID NO: 4275432 - DNA, 21 bp, Homo sapiens
caggattgtccacaaatgtcc

SEQ ID NO: 4275433 - DNA, 12 bp, Homo sapiens
caggcagaatca

SEQ ID NO: 4275434 - DNA, 19 bp, Homo sapiens
caggcagagctcagcacag

SEQ ID NO: 4275435 - DNA, 13 bp, Homo sapiens
caggcaggctgtg

SEQ ID NO: 4275436 - DNA, 17 bp, Homo sapiens
caggcagtggcccaggg

SEQ ID NO: 4275437 - DNA, 18 bp, Homo sapiens
caggcagtggcccaggga

SEQ ID NO: 4275438 - DNA, 16 bp, Homo sapiens
caggcatgaccctgga

SEQ ID NO: 4275439 - DNA, 19 bp, Homo sapiens
caggcatgaccctggagcc

SEQ ID NO: 4275440 - DNA, 14 bp, Homo sapiens
caggcatgcctgtg

SEQ ID NO: 4275441 - DNA, 24 bp, Homo sapiens
caggcatgctggctcccagggcca

SEQ ID NO: 4275442 - DNA, 13 bp, Homo sapiens
caggccacctgcc

SEQ ID NO: 4275443 - DNA, 14 bp, Homo sapiens
caggccagcgtgga

SEQ ID NO: 4275444 - DNA, 17 bp, Homo sapiens
caggcccatgccctccg

SEQ ID NO: 4275445 - DNA, 19 bp, Homo sapiens
caggccccaaaaccacagc

SEQ ID NO: 4275446 - DNA, 15 bp, Homo sapiens
caggccccaggctgg

SEQ ID NO: 4275447 - DNA, 12 bp, Homo sapiens
caggccctccgc

SEQ ID NO: 4275448 - DNA, 15 bp, Homo sapiens
caggcccttcctctc

SEQ ID NO: 4275449 - DNA, 19 bp, Homo sapiens
caggcccttcctctccact

SEQ ID NO: 4275450 - DNA, 15 bp, Homo sapiens
caggcctcacctggc

SEQ ID NO: 4275451 - DNA, 17 bp, Homo sapiens
caggcctcacctggctt

SEQ ID NO: 4275452 - DNA, 19 bp, Homo sapiens
caggcctcacctggcttcc

SEQ ID NO: 4275453 - DNA, 16 bp, Homo sapiens
caggcctcagggacca

SEQ ID NO: 4275454 - DNA, 23 bp, Homo sapiens
caggcctcagggaccaaggagat

SEQ ID NO: 4275455 - DNA, 21 bp, Homo sapiens
caggcctccctcccccggggt

SEQ ID NO: 4275456 - DNA, 12 bp, Homo sapiens
caggcctggccc

SEQ ID NO: 4275457 - DNA, 13 bp, Homo sapiens
caggcctggccca

SEQ ID NO: 4275458 - DNA, 15 bp, Homo sapiens
caggcctggcccagc

SEQ ID NO: 4275459 - DNA, 22 bp, Homo sapiens
caggcctggcccagccagcagg

SEQ ID NO: 4275460 - DNA, 22 bp, Homo sapiens
caggcctggccctttcacccct

SEQ ID NO: 4275461 - DNA, 16 bp, Homo sapiens
caggcggtatccagag

SEQ ID NO: 4275462 - DNA, 17 bp, Homo sapiens
caggcggtatccagagg

SEQ ID NO: 4275463 - DNA, 19 bp, Homo sapiens
caggcggtatccagaggtg

SEQ ID NO: 4275464 - DNA, 18 bp, Homo sapiens
caggcgtagggccagggc

SEQ ID NO: 4275465 - DNA, 19 bp, Homo sapiens
caggcgtagggccagggct

SEQ ID NO: 4275466 - DNA, 14 bp, Homo sapiens
caggcgttctcagc

SEQ ID NO: 4275467 - DNA, 18 bp, Homo sapiens
caggctcttctcctttca

SEQ ID NO: 4275468 - DNA, 18 bp, Homo sapiens
caggctgccccacccctc

SEQ ID NO: 4275469 - DNA, 22 bp, Homo sapiens
caggctgtgcgctgacaaccac

SEQ ID NO: 4275470 - DNA, 16 bp, Homo sapiens
caggcttcctgcccta

SEQ ID NO: 4275471 - DNA, 19 bp, Homo sapiens
caggcttcctgccctagca

SEQ ID NO: 4275472 - DNA, 22 bp, Homo sapiens
caggcttgcattaaaagactgt

SEQ ID NO: 4275473 - DNA, 16 bp, Homo sapiens
cagggaatcagggagc

SEQ ID NO: 4275474 - DNA, 17 bp, Homo sapiens
cagggaatcagggagca

SEQ ID NO: 4275475 - DNA, 20 bp, Homo sapiens
cagggacactacaaacatgg

SEQ ID NO: 4275476 - DNA, 19 bp, Homo sapiens
cagggaccaaggacccctc

SEQ ID NO: 4275477 - DNA, 16 bp, Homo sapiens
cagggagaccctggga

SEQ ID NO: 4275478 - DNA, 19 bp, Homo sapiens
cagggagaccctgggagag

SEQ ID NO: 4275479 - DNA, 12 bp, Homo sapiens
cagggagcactg

SEQ ID NO: 4275480 - DNA, 22 bp, Homo sapiens
cagggagcactggaggcctctg

SEQ ID NO: 4275481 - DNA, 12 bp, Homo sapiens
cagggagcagca

SEQ ID NO: 4275482 - DNA, 19 bp, Homo sapiens
cagggagggaacagacctc

SEQ ID NO: 4275483 - DNA, 23 bp, Homo sapiens
cagggcagcctgtgggagaaggg

SEQ ID NO: 4275484 - DNA, 16 bp, Homo sapiens
cagggcaggcagagct

SEQ ID NO: 4275485 - DNA, 21 bp, Homo sapiens
cagggcaggcagagctcagca

SEQ ID NO: 4275486 - DNA, 13 bp, Homo sapiens
cagggccagggtt

SEQ ID NO: 4275487 - DNA, 14 bp, Homo sapiens
cagggccagggttg

SEQ ID NO: 4275488 - DNA, 15 bp, Homo sapiens
cagggcccccacagg

SEQ ID NO: 4275489 - DNA, 19 bp, Homo sapiens
cagggccctgctcaggcct

SEQ ID NO: 4275490 - DNA, 20 bp, Homo sapiens
cagggccgtagactcacggc

SEQ ID NO: 4275491 - DNA, 23 bp, Homo sapiens
cagggcctccagccctctcactg

SEQ ID NO: 4275492 - DNA, 16 bp, Homo sapiens
cagggctcatgatttt

SEQ ID NO: 4275493 - DNA, 19 bp, Homo sapiens
cagggctctggcaggtggc

SEQ ID NO: 4275494 - DNA, 18 bp, Homo sapiens
cagggctggattggcagg

SEQ ID NO: 4275495 - DNA, 15 bp, Homo sapiens
caggggcagaaggag

SEQ ID NO: 4275496 - DNA, 19 bp, Homo sapiens
caggggccgtgcagggcca

SEQ ID NO: 4275497 - DNA, 21 bp, Homo sapiens
caggggctgcatcctcagccc

SEQ ID NO: 4275498 - DNA, 13 bp, Homo sapiens
caggggctgggca

SEQ ID NO: 4275499 - DNA, 17 bp, Homo sapiens
cagggggaagcaccagc

SEQ ID NO: 4275500 - DNA, 19 bp, Homo sapiens
cagggggaagcaccagcct

SEQ ID NO: 4275501 - DNA, 13 bp, Homo sapiens
caggggggttggg

SEQ ID NO: 4275502 - DNA, 17 bp, Homo sapiens
cagggtagggggcctga

SEQ ID NO: 4275503 - DNA, 22 bp, Homo sapiens
cagggtcctgggggctgctgca

SEQ ID NO: 4275504 - DNA, 13 bp, Homo sapiens
cagggtgacccct

SEQ ID NO: 4275505 - DNA, 17 bp, Homo sapiens
cagggtgctccctcctc

SEQ ID NO: 4275506 - DNA, 20 bp, Homo sapiens
cagggtggtcttcaagcctg

SEQ ID NO: 4275507 - DNA, 21 bp, Homo sapiens
cagggttaaagaaaggcagag

SEQ ID NO: 4275508 - DNA, 13 bp, Homo sapiens
cagggttccagac

SEQ ID NO: 4275509 - DNA, 17 bp, Homo sapiens
cagggttccagacaggg

SEQ ID NO: 4275510 - DNA, 18 bp, Homo sapiens
cagggttcccccagccct

SEQ ID NO: 4275511 - DNA, 21 bp, Homo sapiens
caggtcccgagccccctgtcc

SEQ ID NO: 4275512 - DNA, 23 bp, Homo sapiens
caggtcccgagccccctgtcctt

SEQ ID NO: 4275513 - DNA, 17 bp, Homo sapiens
caggtgaccttctggga

SEQ ID NO: 4275514 - DNA, 21 bp, Homo sapiens
caggtggaacaggaggaactg

SEQ ID NO: 4275515 - DNA, 23 bp, Homo sapiens
caggtggaacaggaggaactggt

SEQ ID NO: 4275516 - DNA, 14 bp, Homo sapiens
caggtggccagggc

SEQ ID NO: 4275517 - DNA, 19 bp, Homo sapiens
caggtggccagggctccac

SEQ ID NO: 4275518 - DNA, 12 bp, Homo sapiens
caggtggggagg

SEQ ID NO: 4275519 - DNA, 21 bp, Homo sapiens
caggtgtactatggctgtatt

SEQ ID NO: 4275520 - DNA, 21 bp, Homo sapiens
caggtgtcatatatggggggc

SEQ ID NO: 4275521 - DNA, 14 bp, Homo sapiens
caggtgtcctgact

SEQ ID NO: 4275522 - DNA, 13 bp, Homo sapiens
ccatcagcccctg

SEQ ID NO: 4275523 - DNA, 18 bp, Homo sapiens
ccatcccctcctagcaca

SEQ ID NO: 4275524 - DNA, 15 bp, Homo sapiens
ccatcctccccttcc

SEQ ID NO: 4275525 - DNA, 18 bp, Homo sapiens
ccatcctccccttccctg

SEQ ID NO: 4275526 - DNA, 13 bp, Homo sapiens
ccatcgccttctg

SEQ ID NO: 4275527 - DNA, 21 bp, Homo sapiens
ccatctcaggccacctgcccc

SEQ ID NO: 4275528 - DNA, 23 bp, Homo sapiens
ccatctcaggccacctgccccct

SEQ ID NO: 4275529 - DNA, 11 bp, Homo sapiens
ccatctgctga

SEQ ID NO: 4275530 - DNA, 16 bp, Homo sapiens
ccatctgtctgtccta

SEQ ID NO: 4275531 - DNA, 23 bp, Homo sapiens
ccatcttttgttaagttcaccgt

SEQ ID NO: 4275532 - DNA, 23 bp, Homo sapiens
ccatgagctccagacccccagca

SEQ ID NO: 4275533 - DNA, 15 bp, Homo sapiens
ccatgatgtggagtg

SEQ ID NO: 4275534 - DNA, 14 bp, Homo sapiens
ccatgattccaagg

SEQ ID NO: 4275535 - DNA, 14 bp, Homo sapiens
ccatgattcgccca

SEQ ID NO: 4275536 - DNA, 16 bp, Homo sapiens
ccatgcagatctagcc

SEQ ID NO: 4275537 - DNA, 20 bp, Homo sapiens
ccatgcaggcagcctgcaga

SEQ ID NO: 4275538 - DNA, 19 bp, Homo sapiens
ccatgcatggcctcccagc

SEQ ID NO: 4275539 - DNA, 23 bp, Homo sapiens
ccatgcatggcctcccagccacc

SEQ ID NO: 4275540 - DNA, 18 bp, Homo sapiens
ccatgccccactctgctg

SEQ ID NO: 4275541 - DNA, 16 bp, Homo sapiens
ccatggaagctggcag

SEQ ID NO: 4275542 - DNA, 18 bp, Homo sapiens
ccatggaagctggcagga

SEQ ID NO: 4275543 - DNA, 22 bp, Homo sapiens
ccatggaagctggcaggagaca

SEQ ID NO: 4275544 - DNA, 23 bp, Homo sapiens
ccatggaagctggcaggagacac

SEQ ID NO: 4275545 - DNA, 16 bp, Homo sapiens
ccatggacctgcactt

SEQ ID NO: 4275546 - DNA, 19 bp, Homo sapiens
ccatggacctgcacttggc

SEQ ID NO: 4275547 - DNA, 22 bp, Homo sapiens
ccatggactctacactgtgaac

SEQ ID NO: 4275548 - DNA, 14 bp, Homo sapiens
cccttcccctgcgc

SEQ ID NO: 4275549 - DNA, 15 bp, Homo sapiens
cccttccctgcaaac

SEQ ID NO: 4275550 - DNA, 16 bp, Homo sapiens
cccttcctctccactg

SEQ ID NO: 4275551 - DNA, 18 bp, Homo sapiens
cccttctctcagcctcca

SEQ ID NO: 4275552 - DNA, 13 bp, Homo sapiens
cccttgctgctgg

SEQ ID NO: 4275553 - DNA, 14 bp, Homo sapiens
cccttgctgctggc

SEQ ID NO: 4275554 - DNA, 20 bp, Homo sapiens
ccctttcacccctcttccca

SEQ ID NO: 4275555 - DNA, 18 bp, Homo sapiens
ccctttcactgaagtgaa

SEQ ID NO: 4275556 - DNA, 13 bp, Homo sapiens
ccctttccctgca

SEQ ID NO: 4275557 - DNA, 14 bp, Homo sapiens
ccctttccctgcat

SEQ ID NO: 4275558 - DNA, 22 bp, Homo sapiens
cccttttggcccccgagctggg

SEQ ID NO: 4275559 - DNA, 15 bp, Homo sapiens
ccgacaaccgatgct

SEQ ID NO: 4275560 - DNA, 18 bp, Homo sapiens
ccgacaaccgatgctcca

SEQ ID NO: 4275561 - DNA, 12 bp, Homo sapiens
ccgacagcctgg

SEQ ID NO: 4275562 - DNA, 13 bp, Homo sapiens
ccgacagtggctc

SEQ ID NO: 4275563 - DNA, 16 bp, Homo sapiens
ccgacagtggctctcc

SEQ ID NO: 4275564 - DNA, 17 bp, Homo sapiens
ccgacagtggctctcca

SEQ ID NO: 4275565 - DNA, 19 bp, Homo sapiens
ccgaccgaggctggagctg

SEQ ID NO: 4275566 - DNA, 16 bp, Homo sapiens
ccgaccttcaccaagc

SEQ ID NO: 4275567 - DNA, 14 bp, Homo sapiens
ccgactctctccat

SEQ ID NO: 4275568 - DNA, 14 bp, Homo sapiens
ccgagaaggaatgg

SEQ ID NO: 4275569 - DNA, 22 bp, Homo sapiens
ccgagaaggaatggtgcttggc

SEQ ID NO: 4275570 - DNA, 16 bp, Homo sapiens
ccgagccccctgtcct

SEQ ID NO: 4275571 - DNA, 17 bp, Homo sapiens
ccgagccccctgtcctt

SEQ ID NO: 4275572 - DNA, 18 bp, Homo sapiens
ccgagccccctgtccttc

SEQ ID NO: 4275573 - DNA, 18 bp, Homo sapiens
ccgagcgacggctcctcc

SEQ ID NO: 4275574 - DNA, 16 bp, Homo sapiens
ccgagctctcctgggc

SEQ ID NO: 4275575 - DNA, 20 bp, Homo sapiens
ccgagctctcctgggccagg

SEQ ID NO: 4275576 - DNA, 22 bp, Homo sapiens
ccgagctctcctgggccagggt

SEQ ID NO: 4275577 - DNA, 11 bp, Homo sapiens
ccgagctgggg

SEQ ID NO: 4275578 - DNA, 14 bp, Homo sapiens
ccgaggcagcaaca

SEQ ID NO: 4275579 - DNA, 12 bp, Homo sapiens
ccgaggcagggg

SEQ ID NO: 4275580 - DNA, 15 bp, Homo sapiens
ccgaggcaggggctg

SEQ ID NO: 4275581 - DNA, 18 bp, Homo sapiens
ccgagtctcttctccact

SEQ ID NO: 4275582 - DNA, 19 bp, Homo sapiens
ccgagtctcttctccactg

SEQ ID NO: 4275583 - DNA, 20 bp, Homo sapiens
ccgagtctcttctccactgg

SEQ ID NO: 4275584 - DNA, 21 bp, Homo sapiens
ccgagtctcttctccactgga

SEQ ID NO: 4275585 - DNA, 13 bp, Homo sapiens
ccgagtgccccag

SEQ ID NO: 4275586 - DNA, 19 bp, Homo sapiens
ccgatgctccagccaaccc

SEQ ID NO: 4275587 - DNA, 22 bp, Homo sapiens
ccgatgctccagccaacccctg

SEQ ID NO: 4275588 - DNA, 15 bp, Homo sapiens
ccgcacccccaccct

SEQ ID NO: 4275589 - DNA, 20 bp, Homo sapiens
ccgcacgcaagcctcagcca

SEQ ID NO: 4275590 - DNA, 21 bp, Homo sapiens
ccgcatgctcttacccacact

SEQ ID NO: 4275591 - DNA, 18 bp, Homo sapiens
ccgcatgctgcctgcctc

SEQ ID NO: 4275592 - DNA, 19 bp, Homo sapiens
ccgcatgctgcctgcctcc

SEQ ID NO: 4275593 - DNA, 21 bp, Homo sapiens
ccgcatgctgcctgcctccgg

SEQ ID NO: 4275594 - DNA, 16 bp, Homo sapiens
ccgccagatggggcct

SEQ ID NO: 4275595 - DNA, 13 bp, Homo sapiens
ccgcccacctggg

SEQ ID NO: 4275596 - DNA, 20 bp, Homo sapiens
ccgcccacctgggccctagg

SEQ ID NO: 4275597 - DNA, 13 bp, Homo sapiens
ccgccccacattc

SEQ ID NO: 4275598 - DNA, 14 bp, Homo sapiens
ccgccccccagagc

SEQ ID NO: 4275599 - DNA, 15 bp, Homo sapiens
ccgccccccagagcc

SEQ ID NO: 4275600 - DNA, 13 bp, Homo sapiens
ccgccctctgccc

SEQ ID NO: 4275601 - DNA, 19 bp, Homo sapiens
ccgccgtgtctgtggccct

SEQ ID NO: 4275602 - DNA, 20 bp, Homo sapiens
ccgccgtgtctgtggccctc

SEQ ID NO: 4275603 - DNA, 22 bp, Homo sapiens
ccgcctctgggctcacaccagc

SEQ ID NO: 4275604 - DNA, 12 bp, Homo sapiens
ccgcctggcaga

SEQ ID NO: 4275605 - DNA, 16 bp, Homo sapiens
ccgcctggcagaactg

SEQ ID NO: 4275606 - DNA, 13 bp, Homo sapiens
ccgctcagccctc

SEQ ID NO: 4275607 - DNA, 19 bp, Homo sapiens
ccgctcagccctccctgcc

SEQ ID NO: 4275608 - DNA, 13 bp, Homo sapiens
ccgctccccagcc

SEQ ID NO: 4275609 - DNA, 19 bp, Homo sapiens
ccgctctgccatcagcccc

SEQ ID NO: 4275610 - DNA, 15 bp, Homo sapiens
ccgctgcagggtggc

SEQ ID NO: 4275611 - DNA, 21 bp, Homo sapiens
ccgctgcgctgccctgcaaac

SEQ ID NO: 4275612 - DNA, 14 bp, Homo sapiens
ccgctggtgcccac

SEQ ID NO: 4275613 - DNA, 23 bp, Homo sapiens
ccggacaagcccaggacactgcc

SEQ ID NO: 4275614 - DNA, 20 bp, Homo sapiens
ccggactttcggagttgggg

SEQ ID NO: 4275615 - DNA, 19 bp, Homo sapiens
ccggagctaacactggccc

SEQ ID NO: 4275616 - DNA, 15 bp, Homo sapiens
ccggatctccaggcc

SEQ ID NO: 4275617 - DNA, 12 bp, Homo sapiens
ccggcagccccc

SEQ ID NO: 4275618 - DNA, 14 bp, Homo sapiens
ccggcatgccgagt

SEQ ID NO: 4275619 - DNA, 19 bp, Homo sapiens
ccggcccccctctcgggct

SEQ ID NO: 4275620 - DNA, 20 bp, Homo sapiens
ccggcccccctctcgggctc

SEQ ID NO: 4275621 - DNA, 19 bp, Homo sapiens
ccggcccccgccctctgcc

SEQ ID NO: 4275622 - DNA, 22 bp, Homo sapiens
ccggccctgccccccacattct

SEQ ID NO: 4275623 - DNA, 20 bp, Homo sapiens
ccggcctgatggccaggcct

SEQ ID NO: 4275624 - DNA, 17 bp, Homo sapiens
ccggctcgttcccccag

SEQ ID NO: 4275625 - DNA, 22 bp, Homo sapiens
ccggctgagctgtgccagctgc

SEQ ID NO: 4275626 - DNA, 13 bp, Homo sapiens
ccggctgggcccg

SEQ ID NO: 4275627 - DNA, 18 bp, Homo sapiens
cctcacctggcttcccag

SEQ ID NO: 4275628 - DNA, 21 bp, Homo sapiens
cctcacctggcttcccaggac

SEQ ID NO: 4275629 - DNA, 19 bp, Homo sapiens
cctcacctgggcacctggg

SEQ ID NO: 4275630 - DNA, 18 bp, Homo sapiens
cctcaccttgcaacacac

SEQ ID NO: 4275631 - DNA, 21 bp, Homo sapiens
cctcaccttgcaacacacaga

SEQ ID NO: 4275632 - DNA, 22 bp, Homo sapiens
cctcactccactcccctcatcc

SEQ ID NO: 4275633 - DNA, 23 bp, Homo sapiens
cctcactgccctccctcggcccc

SEQ ID NO: 4275634 - DNA, 12 bp, Homo sapiens
cctcactggctg

SEQ ID NO: 4275635 - DNA, 18 bp, Homo sapiens
cctcactggtgcatttaa

SEQ ID NO: 4275636 - DNA, 22 bp, Homo sapiens
cctcagaggccccttgctgctg

SEQ ID NO: 4275637 - DNA, 14 bp, Homo sapiens
cctcagagggtccc

SEQ ID NO: 4275638 - DNA, 22 bp, Homo sapiens
cctcagcaagtgctgagtctgt

SEQ ID NO: 4275639 - DNA, 17 bp, Homo sapiens
cctcagcagaaggcctt

SEQ ID NO: 4275640 - DNA, 15 bp, Homo sapiens
cctcagccacgcctc

SEQ ID NO: 4275641 - DNA, 17 bp, Homo sapiens
cctcagccacgcctctc

SEQ ID NO: 4275642 - DNA, 21 bp, Homo sapiens
cctcagccacgcctctctcag

SEQ ID NO: 4275643 - DNA, 20 bp, Homo sapiens
cctcagccccagggccctgc

SEQ ID NO: 4275644 - DNA, 13 bp, Homo sapiens
cctcagcccctct

SEQ ID NO: 4275645 - DNA, 19 bp, Homo sapiens
cctcagcccctcttgcccc

SEQ ID NO: 4275646 - DNA, 23 bp, Homo sapiens
cctcagcccctcttgccccccac

SEQ ID NO: 4275647 - DNA, 16 bp, Homo sapiens
cctcaggcctggccct

SEQ ID NO: 4275648 - DNA, 17 bp, Homo sapiens
cctcaggcctggccctt

SEQ ID NO: 4275649 - DNA, 17 bp, Homo sapiens
cctcagggaccaaggag

SEQ ID NO: 4275650 - DNA, 12 bp, Homo sapiens
cctcaggggaga

SEQ ID NO: 4275651 - DNA, 19 bp, Homo sapiens
cctcaggtttgcctgaggg

SEQ ID NO: 4275652 - DNA, 14 bp, Homo sapiens
cctcagtccctccc

SEQ ID NO: 4275653 - DNA, 15 bp, Homo sapiens
cctcagtgcagcccc

SEQ ID NO: 4275654 - DNA, 22 bp, Homo sapiens
cctcagtgcagccccctcctga

SEQ ID NO: 4275655 - DNA, 13 bp, Homo sapiens
cctcatcctcctg

SEQ ID NO: 4275656 - DNA, 23 bp, Homo sapiens
cctcatcctcctggacccagcag

SEQ ID NO: 4275657 - DNA, 16 bp, Homo sapiens
cctcatctgaaaggcc

SEQ ID NO: 4275658 - DNA, 18 bp, Homo sapiens
cctcatgaacactggctg

SEQ ID NO: 4275659 - DNA, 18 bp, Homo sapiens
cctccacacctccacccg

SEQ ID NO: 4275660 - DNA, 15 bp, Homo sapiens
cctccaccccagtcc

SEQ ID NO: 4275661 - DNA, 19 bp, Homo sapiens
cctccaccccagtccccgg

SEQ ID NO: 4275662 - DNA, 14 bp, Homo sapiens
cctccacccgtcct

SEQ ID NO: 4275663 - DNA, 16 bp, Homo sapiens
cctccacctgggagat

SEQ ID NO: 4275664 - DNA, 14 bp, Homo sapiens
cctccactccctgt

SEQ ID NO: 4275665 - DNA, 13 bp, Homo sapiens
cctccactcctcc

SEQ ID NO: 4275666 - DNA, 17 bp, Homo sapiens
cctccagacccctaccc

SEQ ID NO: 4275667 - DNA, 22 bp, Homo sapiens
cctccagccctctcactgtgtc

SEQ ID NO: 4275668 - DNA, 20 bp, Homo sapiens
cctccagtgttgcctcctcc

SEQ ID NO: 4275669 - DNA, 21 bp, Homo sapiens
cctccagtgttgcctcctccc

SEQ ID NO: 4275670 - DNA, 22 bp, Homo sapiens
cctccagtgttgcctcctccca

SEQ ID NO: 4275671 - DNA, 16 bp, Homo sapiens
cctccagttctgatga

SEQ ID NO: 4275672 - DNA, 23 bp, Homo sapiens
cctccatgtagaagagggagaag

SEQ ID NO: 4275673 - DNA, 17 bp, Homo sapiens
cctcccaactctggcct

SEQ ID NO: 4275674 - DNA, 11 bp, Homo sapiens
cctcccacatc

SEQ ID NO: 4275675 - DNA, 11 bp, Homo sapiens
cctcccagcca

SEQ ID NO: 4275676 - DNA, 23 bp, Homo sapiens
cctcccagccacccggatctcca

SEQ ID NO: 4275677 - DNA, 13 bp, Homo sapiens
cctcccatccagc

SEQ ID NO: 4275678 - DNA, 15 bp, Homo sapiens
cctcccatccagcgt

SEQ ID NO: 4275679 - DNA, 11 bp, Homo sapiens
cctccccagta

SEQ ID NO: 4275680 - DNA, 21 bp, Homo sapiens
cctcccccggggtctccacct

SEQ ID NO: 4275681 - DNA, 18 bp, Homo sapiens
cctccccgatccccgaca

SEQ ID NO: 4275682 - DNA, 20 bp, Homo sapiens
cctcccctccttgcctcctg

SEQ ID NO: 4275683 - DNA, 14 bp, Homo sapiens
cctcccctggtcct

SEQ ID NO: 4275684 - DNA, 17 bp, Homo sapiens
cctccccttccctgcaa

SEQ ID NO: 4275685 - DNA, 20 bp, Homo sapiens
cctcccgcatgctgcctgcc

SEQ ID NO: 4275686 - DNA, 13 bp, Homo sapiens
cctcccggtgccc

SEQ ID NO: 4275687 - DNA, 11 bp, Homo sapiens
cctccctcagc

SEQ ID NO: 4275688 - DNA, 21 bp, Homo sapiens
cctccctcagccacgcctctc

SEQ ID NO: 4275689 - DNA, 16 bp, Homo sapiens
cctccctcagcccctc

SEQ ID NO: 4275690 - DNA, 20 bp, Homo sapiens
cctccctcagcccctcttgc

SEQ ID NO: 4275691 - DNA, 19 bp, Homo sapiens
cctccctccacacctccac

SEQ ID NO: 4275692 - DNA, 15 bp, Homo sapiens
cctccctccctccac

SEQ ID NO: 4275693 - DNA, 16 bp, Homo sapiens
cctccctccctccaca

SEQ ID NO: 4275694 - DNA, 16 bp, Homo sapiens
cctccctccctgcagg

SEQ ID NO: 4275695 - DNA, 14 bp, Homo sapiens
cctccctccctgct

SEQ ID NO: 4275696 - DNA, 13 bp, Homo sapiens
cctccctccgcta

SEQ ID NO: 4275697 - DNA, 19 bp, Homo sapiens
cctccctcctggctcacag

SEQ ID NO: 4275698 - DNA, 21 bp, Homo sapiens
cctccctcctggctcacagcc

SEQ ID NO: 4275699 - DNA, 17 bp, Homo sapiens
cctttgctgccttctgt

SEQ ID NO: 4275700 - DNA, 20 bp, Homo sapiens
cctttgctgccttctgtctc

SEQ ID NO: 4275701 - DNA, 21 bp, Homo sapiens
cctttgctgccttctgtctct

SEQ ID NO: 4275702 - DNA, 16 bp, Homo sapiens
cctttggacctgcagt

SEQ ID NO: 4275703 - DNA, 22 bp, Homo sapiens
cctttggcacaccctctctgtc

SEQ ID NO: 4275704 - DNA, 18 bp, Homo sapiens
cctttggggggggcccgc

SEQ ID NO: 4275705 - DNA, 22 bp, Homo sapiens
ccttttagttcctgtgcacagc

SEQ ID NO: 4275706 - DNA, 12 bp, Homo sapiens
ccttttggcccc

SEQ ID NO: 4275707 - DNA, 21 bp, Homo sapiens
ccttttggcccccgagctggg

SEQ ID NO: 4275708 - DNA, 23 bp, Homo sapiens
ccttttggcccccgagctggggg

SEQ ID NO: 4275709 - DNA, 16 bp, Homo sapiens
cgaagaccttctgaag

SEQ ID NO: 4275710 - DNA, 16 bp, Homo sapiens
cgaagctcagcccacc

SEQ ID NO: 4275711 - DNA, 17 bp, Homo sapiens
cgaatattgagcaatat

SEQ ID NO: 4275712 - DNA, 17 bp, Homo sapiens
cgaatggagtccagacc

SEQ ID NO: 4275713 - DNA, 18 bp, Homo sapiens
cgacaaccgatgctccag

SEQ ID NO: 4275714 - DNA, 21 bp, Homo sapiens
cgacaaccgatgctccagcca

SEQ ID NO: 4275715 - DNA, 14 bp, Homo sapiens
cgacagcctggcac

SEQ ID NO: 4275716 - DNA, 15 bp, Homo sapiens
cgacagtggctctcc

SEQ ID NO: 4275717 - DNA, 15 bp, Homo sapiens
cgaccgaggctggag

SEQ ID NO: 4275718 - DNA, 19 bp, Homo sapiens
cgaccgaggctggagctgg

SEQ ID NO: 4275719 - DNA, 20 bp, Homo sapiens
cgaccgaggctggagctggc

SEQ ID NO: 4275720 - DNA, 15 bp, Homo sapiens
cgaccttcaccaagc

SEQ ID NO: 4275721 - DNA, 20 bp, Homo sapiens
cgacttgggacggaagtggc

SEQ ID NO: 4275722 - DNA, 15 bp, Homo sapiens
cgagatcttccttcc

SEQ ID NO: 4275723 - DNA, 21 bp, Homo sapiens
cgagccagattaggcctggag

SEQ ID NO: 4275724 - DNA, 22 bp, Homo sapiens
cgagccagattaggcctggagt

SEQ ID NO: 4275725 - DNA, 19 bp, Homo sapiens
cgagccatgatgtggagtg

SEQ ID NO: 4275726 - DNA, 15 bp, Homo sapiens
cgagccccctgtcct

SEQ ID NO: 4275727 - DNA, 15 bp, Homo sapiens
cgagcgacggctcct

SEQ ID NO: 4275728 - DNA, 17 bp, Homo sapiens
cgagctctcctgggcca

SEQ ID NO: 4275729 - DNA, 21 bp, Homo sapiens
cgagctctcctgggccagggt

SEQ ID NO: 4275730 - DNA, 13 bp, Homo sapiens
cgagctgggggcc

SEQ ID NO: 4275731 - DNA, 14 bp, Homo sapiens
cgaggaaccagagc

SEQ ID NO: 4275732 - DNA, 15 bp, Homo sapiens
cgaggaaccagagcc

SEQ ID NO: 4275733 - DNA, 19 bp, Homo sapiens
cgaggaaccagagccatgg

SEQ ID NO: 4275734 - DNA, 17 bp, Homo sapiens
cgaggcagaatggtggg

SEQ ID NO: 4275735 - DNA, 19 bp, Homo sapiens
cgaggcagcaacaggacca

SEQ ID NO: 4275736 - DNA, 19 bp, Homo sapiens
cgaggcaggggctgggcag

SEQ ID NO: 4275737 - DNA, 16 bp, Homo sapiens
cgaggctggagctggc

SEQ ID NO: 4275738 - DNA, 20 bp, Homo sapiens
cgagtctcttctccactgga

SEQ ID NO: 4275739 - DNA, 21 bp, Homo sapiens
cgagtctcttctccactggat

SEQ ID NO: 4275740 - DNA, 14 bp, Homo sapiens
cgagtctggagacc

SEQ ID NO: 4275741 - DNA, 16 bp, Homo sapiens
cgagtgtggagctgct

SEQ ID NO: 4275742 - DNA, 21 bp, Homo sapiens
cgatacaccgggcctggagaa

SEQ ID NO: 4275743 - DNA, 20 bp, Homo sapiens
cgatcttggctcactgcaac

SEQ ID NO: 4275744 - DNA, 14 bp, Homo sapiens
cgatgcgtggctcc

SEQ ID NO: 4275745 - DNA, 23 bp, Homo sapiens
cgatgctccagccaacccctgtg

SEQ ID NO: 4275746 - DNA, 13 bp, Homo sapiens
cgatgtgttttat

SEQ ID NO: 4275747 - DNA, 13 bp, Homo sapiens
cgatttcctaagc

SEQ ID NO: 4275748 - DNA, 20 bp, Homo sapiens
cgcaacagctgtgtgtgccc

SEQ ID NO: 4275749 - DNA, 13 bp, Homo sapiens
cgcaagcctcagc

SEQ ID NO: 4275750 - DNA, 23 bp, Homo sapiens
cgcaagcctcagccactcccagg

SEQ ID NO: 4275751 - DNA, 19 bp, Homo sapiens
cgcacccccaccctttggg

SEQ ID NO: 4275752 - DNA, 16 bp, Homo sapiens
cgcacgcaagcctcag

SEQ ID NO: 4275753 - DNA, 13 bp, Homo sapiens
cgcagccctgctt

SEQ ID NO: 4275754 - DNA, 20 bp, Homo sapiens
cgcaggccctccgcggggga

SEQ ID NO: 4275755 - DNA, 13 bp, Homo sapiens
cgcagggagaccc

SEQ ID NO: 4275756 - DNA, 11 bp, Homo sapiens
cgcatgcaggg

SEQ ID NO: 4275757 - DNA, 21 bp, Homo sapiens
cgcatgcagggcccccacagg

SEQ ID NO: 4275758 - DNA, 22 bp, Homo sapiens
cgcatgcagggcccccacagga

SEQ ID NO: 4275759 - DNA, 13 bp, Homo sapiens
cgccaaccccagc

SEQ ID NO: 4275760 - DNA, 15 bp, Homo sapiens
cgccaaccccagcag

SEQ ID NO: 4275761 - DNA, 15 bp, Homo sapiens
cgccagatggggcct

SEQ ID NO: 4275762 - DNA, 16 bp, Homo sapiens
cgccatgtgctgtgca

SEQ ID NO: 4275763 - DNA, 23 bp, Homo sapiens
cgcccccgggtttggcgggccaa

SEQ ID NO: 4275764 - DNA, 13 bp, Homo sapiens
cgccccgccccac

SEQ ID NO: 4275765 - DNA, 14 bp, Homo sapiens
cgcccctccagtgt

SEQ ID NO: 4275766 - DNA, 15 bp, Homo sapiens
cgcccctccagtgtt

SEQ ID NO: 4275767 - DNA, 23 bp, Homo sapiens
cgccctaggaggagaacttgaac

SEQ ID NO: 4275768 - DNA, 18 bp, Homo sapiens
cgccctccccctgccaga

SEQ ID NO: 4275769 - DNA, 11 bp, Homo sapiens
cgccctccctc

SEQ ID NO: 4275770 - DNA, 13 bp, Homo sapiens
cgccctccctccc

SEQ ID NO: 4275771 - DNA, 21 bp, Homo sapiens
cgccctccctccctccacacc

SEQ ID NO: 4275772 - DNA, 15 bp, Homo sapiens
cgccctctgccccca

SEQ ID NO: 4275773 - DNA, 20 bp, Homo sapiens
cgcccttccctgacactgtc

SEQ ID NO: 4275774 - DNA, 15 bp, Homo sapiens
cgcctctcactctgg

SEQ ID NO: 4275775 - DNA, 18 bp, Homo sapiens
cgcctctcactctggcag

SEQ ID NO: 4275776 - DNA, 17 bp, Homo sapiens
cgcctctgggctcacac

SEQ ID NO: 4275777 - DNA, 19 bp, Homo sapiens
cgcctgcgatggtgctgca

SEQ ID NO: 4275778 - DNA, 23 bp, Homo sapiens
cgcctgcgatggtgctgcacccc

SEQ ID NO: 4275779 - DNA, 13 bp, Homo sapiens
cgccttcctgggt

SEQ ID NO: 4275780 - DNA, 22 bp, Homo sapiens
cgccttgagtgacatgcggctg

SEQ ID NO: 4275781 - DNA, 14 bp, Homo sapiens
cgcgcacacacact

SEQ ID NO: 4275782 - DNA, 20 bp, Homo sapiens
cgcgcagcccgggagatccg

SEQ ID NO: 4275783 - DNA, 13 bp, Homo sapiens
cgcgctctgcatg

SEQ ID NO: 4275784 - DNA, 15 bp, Homo sapiens
cgcggctgggagcct

SEQ ID NO: 4275785 - DNA, 15 bp, Homo sapiens
cgcgtccaaccccgg

SEQ ID NO: 4275786 - DNA, 20 bp, Homo sapiens
cgctagatgggcatggggtg

SEQ ID NO: 4275787 - DNA, 18 bp, Homo sapiens
cgctattcccaggcaggg

SEQ ID NO: 4275788 - DNA, 12 bp, Homo sapiens
cgctcagccctc

SEQ ID NO: 4275789 - DNA, 16 bp, Homo sapiens
cgctcagccctccctg

SEQ ID NO: 4275790 - DNA, 13 bp, Homo sapiens
cgctcctctgcct

SEQ ID NO: 4275791 - DNA, 14 bp, Homo sapiens
cgctcctctgcctt

SEQ ID NO: 4275792 - DNA, 17 bp, Homo sapiens
cgctctgcatgctcctc

SEQ ID NO: 4275793 - DNA, 20 bp, Homo sapiens
cgctctgccatcagcccctg

SEQ ID NO: 4275794 - DNA, 17 bp, Homo sapiens
cgctcttcaccaggaag

SEQ ID NO: 4275795 - DNA, 13 bp, Homo sapiens
cgctgccctgcaa

SEQ ID NO: 4275796 - DNA, 15 bp, Homo sapiens
cgctgccctgcaaac

SEQ ID NO: 4275797 - DNA, 16 bp, Homo sapiens
cgctgcgctgccctgc

SEQ ID NO: 4275798 - DNA, 19 bp, Homo sapiens
cgctgggagaaaagccaga

SEQ ID NO: 4275799 - DNA, 15 bp, Homo sapiens
cgctgtctccagacc

SEQ ID NO: 4275800 - DNA, 15 bp, Homo sapiens
cgctgtgctggtctc

SEQ ID NO: 4275801 - DNA, 14 bp, Homo sapiens
cgctgtgtccccgc

SEQ ID NO: 4275802 - DNA, 15 bp, Homo sapiens
cgcttcataggcaga

SEQ ID NO: 4275803 - DNA, 22 bp, Homo sapiens
cgcttcgccatgtgctgtgcac

SEQ ID NO: 4275804 - DNA, 16 bp, Homo sapiens
cggacaagcccaggac

SEQ ID NO: 4275805 - DNA, 21 bp, Homo sapiens
cggacaagcccaggacactgc

SEQ ID NO: 4275806 - DNA, 15 bp, Homo sapiens
cggagacgggaccgg

SEQ ID NO: 4275807 - DNA, 16 bp, Homo sapiens
cggagcactgtgcagc

SEQ ID NO: 4275808 - DNA, 21 bp, Homo sapiens
cggagcctgtgttagtgtctg

SEQ ID NO: 4275809 - DNA, 15 bp, Homo sapiens
cggagcttctccagc

SEQ ID NO: 4275810 - DNA, 18 bp, Homo sapiens
cggagcttctccagccac

SEQ ID NO: 4275811 - DNA, 16 bp, Homo sapiens
cggaggcttgggaccg

SEQ ID NO: 4275812 - DNA, 19 bp, Homo sapiens
cggaggcttgtcagagctg

SEQ ID NO: 4275813 - DNA, 19 bp, Homo sapiens
cggagggaattgaggtctg

SEQ ID NO: 4275814 - DNA, 19 bp, Homo sapiens
cggatctccaggcccagcc

SEQ ID NO: 4275815 - DNA, 21 bp, Homo sapiens
cggatgatttccgtcatgctc

SEQ ID NO: 4275816 - DNA, 19 bp, Homo sapiens
cggcaacagggcttctctt

SEQ ID NO: 4275817 - DNA, 22 bp, Homo sapiens
cggcaacagggcttctcttttt

SEQ ID NO: 4275818 - DNA, 19 bp, Homo sapiens
cggcagccccccagtgtcc

SEQ ID NO: 4275819 - DNA, 21 bp, Homo sapiens
cggcatgccgagtgccccaga

SEQ ID NO: 4275820 - DNA, 11 bp, Homo sapiens
cggccactgca

SEQ ID NO: 4275821 - DNA, 21 bp, Homo sapiens
cggccccacccaccctctggt

SEQ ID NO: 4275822 - DNA, 21 bp, Homo sapiens
cggcccccgccctctgccccc

SEQ ID NO: 4275823 - DNA, 14 bp, Homo sapiens
cggccctgccccac

SEQ ID NO: 4275824 - DNA, 20 bp, Homo sapiens
cggccctgccccacacaggc

SEQ ID NO: 4275825 - DNA, 19 bp, Homo sapiens
cggccgtcttcactcgccc

SEQ ID NO: 4275826 - DNA, 14 bp, Homo sapiens
cggctcctccccga

SEQ ID NO: 4275827 - DNA, 18 bp, Homo sapiens
cggctctaggtggggcgg

SEQ ID NO: 4275828 - DNA, 19 bp, Homo sapiens
cggctctgaggctgcccca

SEQ ID NO: 4275829 - DNA, 14 bp, Homo sapiens
cggctgagctgtgc

SEQ ID NO: 4275830 - DNA, 17 bp, Homo sapiens
cggctgcacctgcaggg

SEQ ID NO: 4275831 - DNA, 20 bp, Homo sapiens
cggctgcacctgcagggagc

SEQ ID NO: 4275832 - DNA, 12 bp, Homo sapiens
cggctgggcccg

SEQ ID NO: 4275833 - DNA, 20 bp, Homo sapiens
gaaagaaattgtttttctga

SEQ ID NO: 4275834 - DNA, 17 bp, Homo sapiens
gaaagacctgtgagggg

SEQ ID NO: 4275835 - DNA, 16 bp, Homo sapiens
gaaagagtaaaaccaa

SEQ ID NO: 4275836 - DNA, 18 bp, Homo sapiens
gaaagatggtaatctttt

SEQ ID NO: 4275837 - DNA, 19 bp, Homo sapiens
gaaagatggtaatcttttc

SEQ ID NO: 4275838 - DNA, 12 bp, Homo sapiens
gaaagattttat

SEQ ID NO: 4275839 - DNA, 16 bp, Homo sapiens
gaaagccagtgactcc

SEQ ID NO: 4275840 - DNA, 17 bp, Homo sapiens
gaaagccagtgactcca

SEQ ID NO: 4275841 - DNA, 19 bp, Homo sapiens
gaaagccagtgactccagg

SEQ ID NO: 4275842 - DNA, 15 bp, Homo sapiens
gaaagctgcttctgg

SEQ ID NO: 4275843 - DNA, 19 bp, Homo sapiens
gaaagctgcttctggggga

SEQ ID NO: 4275844 - DNA, 20 bp, Homo sapiens
gaaagctgcttctgggggat

SEQ ID NO: 4275845 - DNA, 13 bp, Homo sapiens
gaaaggaaacctt

SEQ ID NO: 4275846 - DNA, 20 bp, Homo sapiens
gaaaggcagagattgggggg

SEQ ID NO: 4275847 - DNA, 15 bp, Homo sapiens
gaaagggcagcccct

SEQ ID NO: 4275848 - DNA, 20 bp, Homo sapiens
gaaagggcagcccctcccca

SEQ ID NO: 4275849 - DNA, 16 bp, Homo sapiens
gaaagggtgctgcttc

SEQ ID NO: 4275850 - DNA, 23 bp, Homo sapiens
gaaataaattggtgataagtgga

SEQ ID NO: 4275851 - DNA, 15 bp, Homo sapiens
gaaatatcatcacgt

SEQ ID NO: 4275852 - DNA, 15 bp, Homo sapiens
gaaatatctgtgaaa

SEQ ID NO: 4275853 - DNA, 21 bp, Homo sapiens
gaaatatctgtgaaatatcat

SEQ ID NO: 4275854 - DNA, 16 bp, Homo sapiens
gaaatccaactccagg

SEQ ID NO: 4275855 - DNA, 18 bp, Homo sapiens
gaaatgctgttggtgaga

SEQ ID NO: 4275856 - DNA, 17 bp, Homo sapiens
gaaatggcttgaagcca

SEQ ID NO: 4275857 - DNA, 13 bp, Homo sapiens
gaaattatatctg

SEQ ID NO: 4275858 - DNA, 22 bp, Homo sapiens
gaaattcttgttatggtagaaa

SEQ ID NO: 4275859 - DNA, 19 bp, Homo sapiens
gaaattgcatttcctgaca

SEQ ID NO: 4275860 - DNA, 17 bp, Homo sapiens
gaaattgcctgacgaac

SEQ ID NO: 4275861 - DNA, 20 bp, Homo sapiens
gaaatttacagttactgcct

SEQ ID NO: 4275862 - DNA, 17 bp, Homo sapiens
gaacacaagccacgcct

SEQ ID NO: 4275863 - DNA, 21 bp, Homo sapiens
gaacagagtatatatgtacag

SEQ ID NO: 4275864 - DNA, 17 bp, Homo sapiens
aagacctcgtctttgct

SEQ ID NO: 4275865 - DNA, 16 bp, Homo sapiens
aagacctgtgagggga

SEQ ID NO: 4275866 - DNA, 13 bp, Homo sapiens
aagactcaatcat

SEQ ID NO: 4275867 - DNA, 21 bp, Homo sapiens
aagacttcaaaatattgagca

SEQ ID NO: 4275868 - DNA, 18 bp, Homo sapiens
aagacttttagcggtttg

SEQ ID NO: 4275869 - DNA, 17 bp, Homo sapiens
aagagaaaaaccaatga

SEQ ID NO: 4275870 - DNA, 19 bp, Homo sapiens
aagagaaaaaccaatgatt

SEQ ID NO: 4275871 - DNA, 20 bp, Homo sapiens
aagagagaaagcatattgac

SEQ ID NO: 4275872 - DNA, 17 bp, Homo sapiens
aagagctcaggagaagg

SEQ ID NO: 4275873 - DNA, 19 bp, Homo sapiens
aagagctcaggagaaggcc

SEQ ID NO: 4275874 - DNA, 18 bp, Homo sapiens
aagaggagcctttccaga

SEQ ID NO: 4275875 - DNA, 16 bp, Homo sapiens
aagaggatcggaggct

SEQ ID NO: 4275876 - DNA, 18 bp, Homo sapiens
aagaggcacctgtcccag

SEQ ID NO: 4275877 - DNA, 17 bp, Homo sapiens
aagagggagaaggagag

SEQ ID NO: 4275878 - DNA, 22 bp, Homo sapiens
aagagtcgagtgatatggcttg

SEQ ID NO: 4275879 - DNA, 16 bp, Homo sapiens
aagagtctattgtctc

SEQ ID NO: 4275880 - DNA, 21 bp, Homo sapiens
aagataaaaactgcccattgt

SEQ ID NO: 4275881 - DNA, 21 bp, Homo sapiens
aagatacactcaagcatgaag

SEQ ID NO: 4275882 - DNA, 19 bp, Homo sapiens
aagatcctccttccaggcc

SEQ ID NO: 4275883 - DNA, 20 bp, Homo sapiens
aagatcgtgaacataactga

SEQ ID NO: 4275884 - DNA, 14 bp, Homo sapiens
aagatgaagaggat

SEQ ID NO: 4275885 - DNA, 15 bp, Homo sapiens
aagatgttgtgtctt

SEQ ID NO: 4275886 - DNA, 18 bp, Homo sapiens
aagatgttgtgtcttgtg

SEQ ID NO: 4275887 - DNA, 16 bp, Homo sapiens
aagattaaaattagtg

SEQ ID NO: 4275888 - DNA, 14 bp, Homo sapiens
aagattcagctagt

SEQ ID NO: 4275889 - DNA, 15 bp, Homo sapiens
aagattcagctagtg

SEQ ID NO: 4275890 - DNA, 12 bp, Homo sapiens
aagattctaaaa

SEQ ID NO: 4275891 - DNA, 14 bp, Homo sapiens
aagattctgtgggc

SEQ ID NO: 4275892 - DNA, 20 bp, Homo sapiens
aagattgttattaaatgtag

SEQ ID NO: 4275893 - DNA, 21 bp, Homo sapiens
aagattttatgtgcttgaaga

SEQ ID NO: 4275894 - DNA, 23 bp, Homo sapiens
aagcaaacacacagactctgtga

SEQ ID NO: 4275895 - DNA, 24 bp, Homo sapiens
aagcaagcacctgggtgtgctcca

SEQ ID NO: 4275896 - DNA, 20 bp, Homo sapiens
aagcaagtatatttatttct

SEQ ID NO: 4275897 - DNA, 23 bp, Homo sapiens
aagcacaagcagagtgcacagct

SEQ ID NO: 4275898 - DNA, 14 bp, Homo sapiens
aagcaccagcctca

SEQ ID NO: 4275899 - DNA, 17 bp, Homo sapiens
aagcaccagcctcagtg

SEQ ID NO: 4275900 - DNA, 15 bp, Homo sapiens
aagcagagcctgggg

SEQ ID NO: 4275901 - DNA, 23 bp, Homo sapiens
aagcaggaaggtctcatgcctga

SEQ ID NO: 4275902 - DNA, 13 bp, Homo sapiens
aagcatattgact

SEQ ID NO: 4275903 - DNA, 13 bp, Homo sapiens
aagcatcagcaag

SEQ ID NO: 4275904 - DNA, 17 bp, Homo sapiens
aagcatcagcaagacaa

SEQ ID NO: 4275905 - DNA, 18 bp, Homo sapiens
aagcatcggagggaattg

SEQ ID NO: 4275906 - DNA, 16 bp, Homo sapiens
aagcatgccaatttct

SEQ ID NO: 4275907 - DNA, 14 bp, Homo sapiens
aagcattctcccca

SEQ ID NO: 4275908 - DNA, 18 bp, Homo sapiens
aagccaaacattcttatt

SEQ ID NO: 4275909 - DNA, 15 bp, Homo sapiens
aagccaagtgtcctg

SEQ ID NO: 4275910 - DNA, 17 bp, Homo sapiens
aagccacgcctgcgatg

SEQ ID NO: 4275911 - DNA, 20 bp, Homo sapiens
aagccacgtgctggagagta

SEQ ID NO: 4275912 - DNA, 11 bp, Homo sapiens
aagccaggaga

SEQ ID NO: 4275913 - DNA, 17 bp, Homo sapiens
aagccagtgactccagg

SEQ ID NO: 4275914 - DNA, 22 bp, Homo sapiens
aagccagtgactccaggagagg

SEQ ID NO: 4275915 - DNA, 20 bp, Homo sapiens
aagccatatgacaatttcaa

SEQ ID NO: 4275916 - DNA, 22 bp, Homo sapiens
aagccatatgacaatttcaaaa

SEQ ID NO: 4275917 - DNA, 14 bp, Homo sapiens
aagccccaggcagg

SEQ ID NO: 4275918 - DNA, 15 bp, Homo sapiens
aagccgtggcttccc

SEQ ID NO: 4275919 - DNA, 13 bp, Homo sapiens
aagcctcaggcct

SEQ ID NO: 4275920 - DNA, 15 bp, Homo sapiens
aagcctcaggcctgg

SEQ ID NO: 4275921 - DNA, 14 bp, Homo sapiens
aagcctccacctgc

SEQ ID NO: 4275922 - DNA, 16 bp, Homo sapiens
aagcctgccccggcca

SEQ ID NO: 4275923 - DNA, 12 bp, Homo sapiens
aagcctggagga

SEQ ID NO: 4275924 - DNA, 16 bp, Homo sapiens
aagcctgggccactgg

SEQ ID NO: 4275925 - DNA, 15 bp, Homo sapiens
aagcctgttgtttaa

SEQ ID NO: 4275926 - DNA, 18 bp, Homo sapiens
aagcctgttgtttaagtg

SEQ ID NO: 4275927 - DNA, 16 bp, Homo sapiens
aagctcaccctgctcc

SEQ ID NO: 4275928 - DNA, 13 bp, Homo sapiens
aagctcagcccac

SEQ ID NO: 4275929 - DNA, 22 bp, Homo sapiens
aagctcctgaatccctttcagt

SEQ ID NO: 4275930 - DNA, 21 bp, Homo sapiens
aagctgaaaaattgtagagtg

SEQ ID NO: 4275931 - DNA, 20 bp, Homo sapiens
aagctgtacaaagggaagca

SEQ ID NO: 4275932 - DNA, 18 bp, Homo sapiens
aagctgttctctgctttt

SEQ ID NO: 4275933 - DNA, 20 bp, Homo sapiens
aagctgttctctgcttttcc

SEQ ID NO: 4275934 - DNA, 20 bp, Homo sapiens
aagcttagaagccaccatgt

SEQ ID NO: 4275935 - DNA, 13 bp, Homo sapiens
aagcttatttcta

SEQ ID NO: 4275936 - DNA, 18 bp, Homo sapiens
aaggaaacacgtttagaa

SEQ ID NO: 4275937 - DNA, 14 bp, Homo sapiens
aaggaaaggaatat

SEQ ID NO: 4275938 - DNA, 16 bp, Homo sapiens
aaggaagacagttcta

SEQ ID NO: 4275939 - DNA, 15 bp, Homo sapiens
aaggacccctcacct

SEQ ID NO: 4275940 - DNA, 13 bp, Homo sapiens
aaggagaggagtg

SEQ ID NO: 4275941 - DNA, 21 bp, Homo sapiens
aaggagaggctctgaaagctg

SEQ ID NO: 4275942 - DNA, 18 bp, Homo sapiens
aaggagatggggagggcg

SEQ ID NO: 4275943 - DNA, 19 bp, Homo sapiens
aaggatgaataagttttat

SEQ ID NO: 4275944 - DNA, 23 bp, Homo sapiens
aaggattttaaatgctgtatgtc

SEQ ID NO: 4275945 - DNA, 18 bp, Homo sapiens
aaggcaacatttccgaag

SEQ ID NO: 4275946 - DNA, 16 bp, Homo sapiens
aaggcaagaagtggga

SEQ ID NO: 4275947 - DNA, 14 bp, Homo sapiens
aaggccccagagac

SEQ ID NO: 4275948 - DNA, 16 bp, Homo sapiens
aaggcctatgccacct

SEQ ID NO: 4275949 - DNA, 21 bp, Homo sapiens
aaggcctatgccacctgcagc

SEQ ID NO: 4275950 - DNA, 23 bp, Homo sapiens
aaggctctgttccacatatattt

SEQ ID NO: 4275951 - DNA, 15 bp, Homo sapiens
aaggctgaaaagtgc

SEQ ID NO: 4275952 - DNA, 12 bp, Homo sapiens
aaggctgcctgc

SEQ ID NO: 4275953 - DNA, 22 bp, Homo sapiens
aaggctggtggacagacccagg

SEQ ID NO: 4275954 - DNA, 17 bp, Homo sapiens
aagggaagcagagcctg

SEQ ID NO: 4275955 - DNA, 23 bp, Homo sapiens
aagggacatgtctttggcttcag

SEQ ID NO: 4275956 - DNA, 14 bp, Homo sapiens
aagggactggtcca

SEQ ID NO: 4275957 - DNA, 17 bp, Homo sapiens
aagggaggcctgagggg

SEQ ID NO: 4275958 - DNA, 19 bp, Homo sapiens
aagggagtaggctgtattt

SEQ ID NO: 4275959 - DNA, 14 bp, Homo sapiens
aagggccttctcca

SEQ ID NO: 4275960 - DNA, 12 bp, Homo sapiens
aagggggcaggc

SEQ ID NO: 4275961 - DNA, 13 bp, Homo sapiens
aagggggcaggcc

SEQ ID NO: 4275962 - DNA, 15 bp, Homo sapiens
aagggggcaggcccc

SEQ ID NO: 4275963 - DNA, 20 bp, Homo sapiens
aagggtgctgcttccctctg

SEQ ID NO: 4275964 - DNA, 14 bp, Homo sapiens
aagggtgtggcttg

SEQ ID NO: 4275965 - DNA, 21 bp, Homo sapiens
aagggtgtgggtcagggaggg

SEQ ID NO: 4275966 - DNA, 12 bp, Homo sapiens
aagggttagaca

SEQ ID NO: 4275967 - DNA, 21 bp, Homo sapiens
aagggttagacaagcctggag

SEQ ID NO: 4275968 - DNA, 22 bp, Homo sapiens
aagggttagacaagcctggagg

SEQ ID NO: 4275969 - DNA, 21 bp, Homo sapiens
aaggtacggtgagactctgag

SEQ ID NO: 4275970 - DNA, 18 bp, Homo sapiens
aaggtcggaggcttggga

SEQ ID NO: 4275971 - DNA, 20 bp, Homo sapiens
aaggtcggaggcttgggacc

SEQ ID NO: 4275972 - DNA, 22 bp, Homo sapiens
aaggtcggaggcttgggaccgc

SEQ ID NO: 4275973 - DNA, 16 bp, Homo sapiens
aaggtctcatgcctga

SEQ ID NO: 4275974 - DNA, 17 bp, Homo sapiens
aaggtctcatgcctgag

SEQ ID NO: 4275975 - DNA, 19 bp, Homo sapiens
aaggtctcatgcctgagaa

SEQ ID NO: 4275976 - DNA, 23 bp, Homo sapiens
aaggtggtctgcaccccacagga

SEQ ID NO: 4275977 - DNA, 20 bp, Homo sapiens
aaggtggtcttggagaggag

SEQ ID NO: 4275978 - DNA, 23 bp, Homo sapiens
aaggtggtcttggagaggaggtg

SEQ ID NO: 4275979 - DNA, 20 bp, Homo sapiens
aaggttgattctcatgcact

SEQ ID NO: 4275980 - DNA, 17 bp, Homo sapiens
aaggtttcactgttcat

SEQ ID NO: 4275981 - DNA, 18 bp, Homo sapiens
aagtaaatgctacctctg

SEQ ID NO: 4275982 - DNA, 15 bp, Homo sapiens
aagtaagttctgaaa

SEQ ID NO: 4275983 - DNA, 23 bp, Homo sapiens
aagtactggtaagattgttatta

SEQ ID NO: 4275984 - DNA, 22 bp, Homo sapiens
aagtagtacttcttctgtaata

SEQ ID NO: 4275985 - DNA, 23 bp, Homo sapiens
aagtagtgtctggatcagtaaaa

SEQ ID NO: 4275986 - DNA, 19 bp, Homo sapiens
aagtatctctactttcctg

SEQ ID NO: 4275987 - DNA, 15 bp, Homo sapiens
aagtattccttggcc

SEQ ID NO: 4275988 - DNA, 18 bp, Homo sapiens
aagtcagatgtttgagca

SEQ ID NO: 4275989 - DNA, 18 bp, Homo sapiens
aagtcaggagccagcagg

SEQ ID NO: 4275990 - DNA, 13 bp, Homo sapiens
aagtccaactaca

SEQ ID NO: 4275991 - DNA, 11 bp, Homo sapiens
aagtccctgag

SEQ ID NO: 4275992 - DNA, 13 bp, Homo sapiens
aagtctatgctta

SEQ ID NO: 4275993 - DNA, 15 bp, Homo sapiens
aagtctcctgtatca

SEQ ID NO: 4275994 - DNA, 22 bp, Homo sapiens
aagtcttccatcagcagtgatt

SEQ ID NO: 4275995 - DNA, 13 bp, Homo sapiens
aagtgaccccagc

SEQ ID NO: 4275996 - DNA, 14 bp, Homo sapiens
aagtgagaaaactg

SEQ ID NO: 4275997 - DNA, 16 bp, Homo sapiens
aagtgatgatggatga

SEQ ID NO: 4275998 - DNA, 18 bp, Homo sapiens
aagtgcatttctgggcct

SEQ ID NO: 4275999 - DNA, 22 bp, Homo sapiens
aagtgcccctgctgcctcccca

SEQ ID NO: 4276000 - DNA, 16 bp, Homo sapiens
aagtgctcagttccaa

SEQ ID NO: 4276001 - DNA, 17 bp, Homo sapiens
aagtgctcagttccaat

SEQ ID NO: 4276002 - DNA, 13 bp, Homo sapiens
aagtggaaaaaag

SEQ ID NO: 4276003 - DNA, 19 bp, Homo sapiens
aagtggaaaaaagagaaaa

SEQ ID NO: 4276004 - DNA, 14 bp, Homo sapiens
aagtggcaggagga

SEQ ID NO: 4276005 - DNA, 22 bp, Homo sapiens
aagtggcaggaggacaggtgga

SEQ ID NO: 4276006 - DNA, 18 bp, Homo sapiens
aagtgggagtgggagagg

SEQ ID NO: 4276007 - DNA, 21 bp, Homo sapiens
aagtgggagtgggagaggaag

SEQ ID NO: 4276008 - DNA, 15 bp, Homo sapiens
aagtggggtgttgaa

SEQ ID NO: 4276009 - DNA, 20 bp, Homo sapiens
aagtggttaagaatgtatat

SEQ ID NO: 4276010 - DNA, 14 bp, Homo sapiens
aagtgtaaaataga

SEQ ID NO: 4276011 - DNA, 15 bp, Homo sapiens
aagtgtaaaatagaa

SEQ ID NO: 4276012 - DNA, 22 bp, Homo sapiens
aagtgtcaaggggccctaggaa

SEQ ID NO: 4276013 - DNA, 13 bp, Homo sapiens
aagtgtgcctgct

SEQ ID NO: 4276014 - DNA, 21 bp, Homo sapiens
aagtgtgcctgctatccagcc

SEQ ID NO: 4276015 - DNA, 19 bp, Homo sapiens
aagtgtttaattgtataaa

SEQ ID NO: 4276016 - DNA, 23 bp, Homo sapiens
aagttagggcatttttcttggat

SEQ ID NO: 4276017 - DNA, 22 bp, Homo sapiens
aagttcaccgtagtaacacata

SEQ ID NO: 4276018 - DNA, 18 bp, Homo sapiens
aagttctgaaaactgttt

SEQ ID NO: 4276019 - DNA, 11 bp, Homo sapiens
aagttggctca

SEQ ID NO: 4276020 - DNA, 21 bp, Homo sapiens
aagttgttagtgatttgctat

SEQ ID NO: 4276021 - DNA, 22 bp, Homo sapiens
aagtttcgagagaaaggagggc

SEQ ID NO: 4276022 - DNA, 19 bp, Homo sapiens
aagttttattgaaaatgtg

SEQ ID NO: 4276023 - DNA, 13 bp, Homo sapiens
aataaaatattta

SEQ ID NO: 4276024 - DNA, 11 bp, Homo sapiens
aataaagccac

SEQ ID NO: 4276025 - DNA, 13 bp, Homo sapiens
aataaagccacat

SEQ ID NO: 4276026 - DNA, 21 bp, Homo sapiens
aataaagccttgtgatcactt

SEQ ID NO: 4276027 - DNA, 19 bp, Homo sapiens
aataaattggtgataagtg

SEQ ID NO: 4276028 - DNA, 12 bp, Homo sapiens
aataacatattc

SEQ ID NO: 4276029 - DNA, 15 bp, Homo sapiens
aataacatattcttg

SEQ ID NO: 4276030 - DNA, 14 bp, Homo sapiens
aataacatctgaaa

SEQ ID NO: 4276031 - DNA, 16 bp, Homo sapiens
aataacatctgaaaag

SEQ ID NO: 4276032 - DNA, 17 bp, Homo sapiens
aataacatctgaaaaga

SEQ ID NO: 4276033 - DNA, 16 bp, Homo sapiens
aataaccgtaaaggtt

SEQ ID NO: 4276034 - DNA, 15 bp, Homo sapiens
aataactagatctcc

SEQ ID NO: 4276035 - DNA, 15 bp, Homo sapiens
aataagaagcaaata

SEQ ID NO: 4276036 - DNA, 11 bp, Homo sapiens
aataatgattt

SEQ ID NO: 4276037 - DNA, 12 bp, Homo sapiens
aataatgattta

SEQ ID NO: 4276038 - DNA, 22 bp, Homo sapiens
aataatgcctttgtaaccacaa

SEQ ID NO: 4276039 - DNA, 20 bp, Homo sapiens
aataatggaattatgtataa

SEQ ID NO: 4276040 - DNA, 16 bp, Homo sapiens
aataattgtggagagg

SEQ ID NO: 4276041 - DNA, 17 bp, Homo sapiens
aataattgtggagagga

SEQ ID NO: 4276042 - DNA, 22 bp, Homo sapiens
aataattgtggagaggagagaa

SEQ ID NO: 4276043 - DNA, 23 bp, Homo sapiens
aataatttagatattcatacttt

SEQ ID NO: 4276044 - DNA, 21 bp, Homo sapiens
aatacagtaagctgctctatt

SEQ ID NO: 4276045 - DNA, 12 bp, Homo sapiens
aataccagagca

SEQ ID NO: 4276046 - DNA, 14 bp, Homo sapiens
aatactaaatatga

SEQ ID NO: 4276047 - DNA, 17 bp, Homo sapiens
aatactaaatatgaaat

SEQ ID NO: 4276048 - DNA, 18 bp, Homo sapiens
aatactcaccaaaatata

SEQ ID NO: 4276049 - DNA, 23 bp, Homo sapiens
aatactgactccaaccattcaaa

SEQ ID NO: 4276050 - DNA, 12 bp, Homo sapiens
aatactgtattg

SEQ ID NO: 4276051 - DNA, 18 bp, Homo sapiens
aatactgtattgttacag

SEQ ID NO: 4276052 - DNA, 23 bp, Homo sapiens
aatactgtattgttacagctgaa

SEQ ID NO: 4276053 - DNA, 18 bp, Homo sapiens
aatacttaaaaatatgtg

SEQ ID NO: 4276054 - DNA, 17 bp, Homo sapiens
aatactttgtatacaag

SEQ ID NO: 4276055 - DNA, 19 bp, Homo sapiens
aatacttttgtgtattctg

SEQ ID NO: 4276056 - DNA, 19 bp, Homo sapiens
aatagatcacggcatgttt

SEQ ID NO: 4276057 - DNA, 16 bp, Homo sapiens
aatagatgctgactgt

SEQ ID NO: 4276058 - DNA, 17 bp, Homo sapiens
aataggagggaaacctt

SEQ ID NO: 4276059 - DNA, 14 bp, Homo sapiens
aatagtaatggttc

SEQ ID NO: 4276060 - DNA, 11 bp, Homo sapiens
aatagtacatg

SEQ ID NO: 4276061 - DNA, 17 bp, Homo sapiens
aatagtacatgcagaaa

SEQ ID NO: 4276062 - DNA, 16 bp, Homo sapiens
aatagtgttcttttta

SEQ ID NO: 4276063 - DNA, 16 bp, Homo sapiens
aatagttctatttcta

SEQ ID NO: 4276064 - DNA, 23 bp, Homo sapiens
aatagttctatttctatctgcaa

SEQ ID NO: 4276065 - DNA, 20 bp, Homo sapiens
aatagtttcaaatgagttta

SEQ ID NO: 4276066 - DNA, 20 bp, Homo sapiens
aatatactcattagaattac

SEQ ID NO: 4276067 - DNA, 14 bp, Homo sapiens
aatatactgcatat

SEQ ID NO: 4276068 - DNA, 21 bp, Homo sapiens
aatatagttaattgtggcttt

SEQ ID NO: 4276069 - DNA, 22 bp, Homo sapiens
aatatagttaattgtggcttta

SEQ ID NO: 4276070 - DNA, 12 bp, Homo sapiens
aatatatataat

SEQ ID NO: 4276071 - DNA, 22 bp, Homo sapiens
aatatatatttatcatatttaa

SEQ ID NO: 4276072 - DNA, 14 bp, Homo sapiens
aatatatgtgaaag

SEQ ID NO: 4276073 - DNA, 16 bp, Homo sapiens
aatatcactcattaat

SEQ ID NO: 4276074 - DNA, 19 bp, Homo sapiens
aatatctatttatctgtct

SEQ ID NO: 4276075 - DNA, 23 bp, Homo sapiens
aatatctctatttaattttgaca

SEQ ID NO: 4276076 - DNA, 19 bp, Homo sapiens
aatatctgtgaaatatcat

SEQ ID NO: 4276077 - DNA, 14 bp, Homo sapiens
aatatctttcagtt

SEQ ID NO: 4276078 - DNA, 17 bp, Homo sapiens
aatatgacctaaatcca

SEQ ID NO: 4276079 - DNA, 17 bp, Homo sapiens
aatatgaggggactgca

SEQ ID NO: 4276080 - DNA, 19 bp, Homo sapiens
aatatgaggggactgcatg

SEQ ID NO: 4276081 - DNA, 20 bp, Homo sapiens
aatatgaggggactgcatgc

SEQ ID NO: 4276082 - DNA, 22 bp, Homo sapiens
aatatgaggggactgcatgcaa

SEQ ID NO: 4276083 - DNA, 12 bp, Homo sapiens
aatatgccagtg

SEQ ID NO: 4276084 - DNA, 20 bp, Homo sapiens
aatatgcccctccccagtag

SEQ ID NO: 4276085 - DNA, 21 bp, Homo sapiens
aatatgcttatattgttcact

SEQ ID NO: 4276086 - DNA, 16 bp, Homo sapiens
aatatgtaacatgtct

SEQ ID NO: 4276087 - DNA, 17 bp, Homo sapiens
aatattagccaaagagg

SEQ ID NO: 4276088 - DNA, 15 bp, Homo sapiens
aatattgtattgtta

SEQ ID NO: 4276089 - DNA, 12 bp, Homo sapiens
aatattgttaaa

SEQ ID NO: 4276090 - DNA, 22 bp, Homo sapiens
aatattgttaaaaccttactta

SEQ ID NO: 4276091 - DNA, 23 bp, Homo sapiens
aatatttatgacctcaacaaaga

SEQ ID NO: 4276092 - DNA, 22 bp, Homo sapiens
aatatttctaagcttatttcta

SEQ ID NO: 4276093 - DNA, 15 bp, Homo sapiens
aatatttcttcaaat

SEQ ID NO: 4276094 - DNA, 16 bp, Homo sapiens
aatatttcttcaaata

SEQ ID NO: 4276095 - DNA, 17 bp, Homo sapiens
aatatttttttctagct

SEQ ID NO: 4276096 - DNA, 18 bp, Homo sapiens
aatcaagtctgtgaaagt

SEQ ID NO: 4276097 - DNA, 22 bp, Homo sapiens
aatcaagttaatgtactttcat

SEQ ID NO: 4276098 - DNA, 23 bp, Homo sapiens
aatcaatgttcacgcaacttgaa

SEQ ID NO: 4276099 - DNA, 19 bp, Homo sapiens
aatcacctaattaatttca

SEQ ID NO: 4276100 - DNA, 20 bp, Homo sapiens
aatcacctaattaatttcag

SEQ ID NO: 4276101 - DNA, 19 bp, Homo sapiens
aatcacgagatcttccttc

SEQ ID NO: 4276102 - DNA, 20 bp, Homo sapiens
aatcagggagcactggaggc

SEQ ID NO: 4276103 - DNA, 17 bp, Homo sapiens
aatcagtgatgggagta

SEQ ID NO: 4276104 - DNA, 16 bp, Homo sapiens
aatcatcaaagtgttt

SEQ ID NO: 4276105 - DNA, 19 bp, Homo sapiens
aatcatcaaagtgtttaat

SEQ ID NO: 4276106 - DNA, 14 bp, Homo sapiens
aatcatttatctta

SEQ ID NO: 4276107 - DNA, 21 bp, Homo sapiens
aatcatttcttgggccctcct

SEQ ID NO: 4276108 - DNA, 22 bp, Homo sapiens
aatcatttcttgggccctcctg

SEQ ID NO: 4276109 - DNA, 12 bp, Homo sapiens
aatccaactcca

SEQ ID NO: 4276110 - DNA, 18 bp, Homo sapiens
aatccacatgtttcagag

SEQ ID NO: 4276111 - DNA, 17 bp, Homo sapiens
aatccatgtatctgtat

SEQ ID NO: 4276112 - DNA, 15 bp, Homo sapiens
aatccatgtgctgct

SEQ ID NO: 4276113 - DNA, 19 bp, Homo sapiens
aatccatgtgctgctgtgg

SEQ ID NO: 4276114 - DNA, 23 bp, Homo sapiens
aatccattttctaaactgttttc

SEQ ID NO: 4276115 - DNA, 20 bp, Homo sapiens
aatcctgttacttaaatagc

SEQ ID NO: 4276116 - DNA, 16 bp, Homo sapiens
aatcgacctcactgtc

SEQ ID NO: 4276117 - DNA, 17 bp, Homo sapiens
aatcgaggaaccagagc

SEQ ID NO: 4276118 - DNA, 18 bp, Homo sapiens
aatcgaggaaccagagcc

SEQ ID NO: 4276119 - DNA, 19 bp, Homo sapiens
aatcgaggaaccagagcca

SEQ ID NO: 4276120 - DNA, 14 bp, Homo sapiens
aatcgcattaatga

SEQ ID NO: 4276121 - DNA, 14 bp, Homo sapiens
aatctaacattatt

SEQ ID NO: 4276122 - DNA, 15 bp, Homo sapiens
aatctaacattatta

SEQ ID NO: 4276123 - DNA, 12 bp, Homo sapiens
aatctacttaac

SEQ ID NO: 4276124 - DNA, 19 bp, Homo sapiens
accccagctccaggcagga

SEQ ID NO: 4276125 - DNA, 22 bp, Homo sapiens
accccaggatgcatgcagggcc

SEQ ID NO: 4276126 - DNA, 18 bp, Homo sapiens
accccaggcaatagtcaa

SEQ ID NO: 4276127 - DNA, 14 bp, Homo sapiens
acccccaccccttc

SEQ ID NO: 4276128 - DNA, 20 bp, Homo sapiens
acccccaccccttccccact

SEQ ID NO: 4276129 - DNA, 14 bp, Homo sapiens
acccccgggtgcct

SEQ ID NO: 4276130 - DNA, 15 bp, Homo sapiens
acccccgggtgcctg

SEQ ID NO: 4276131 - DNA, 16 bp, Homo sapiens
acccccgggtgcctgt

SEQ ID NO: 4276132 - DNA, 22 bp, Homo sapiens
acccccgtgccaaatcctgggc

SEQ ID NO: 4276133 - DNA, 20 bp, Homo sapiens
accccctccctggcctgttc

SEQ ID NO: 4276134 - DNA, 14 bp, Homo sapiens
accccctgccccag

SEQ ID NO: 4276135 - DNA, 16 bp, Homo sapiens
accccctgccccagag

SEQ ID NO: 4276136 - DNA, 18 bp, Homo sapiens
accccctgccccagagaa

SEQ ID NO: 4276137 - DNA, 19 bp, Homo sapiens
accccctgccccagagaag

SEQ ID NO: 4276138 - DNA, 19 bp, Homo sapiens
accccctgctggtgcccac

SEQ ID NO: 4276139 - DNA, 13 bp, Homo sapiens
accccgcctctgg

SEQ ID NO: 4276140 - DNA, 20 bp, Homo sapiens
accccgtccctttccctgca

SEQ ID NO: 4276141 - DNA, 18 bp, Homo sapiens
accccgttgttgtccctg

SEQ ID NO: 4276142 - DNA, 22 bp, Homo sapiens
acccctaaagagatactttgat

SEQ ID NO: 4276143 - DNA, 15 bp, Homo sapiens
acccctcaagccagg

SEQ ID NO: 4276144 - DNA, 15 bp, Homo sapiens
acccctcaccttgca

SEQ ID NO: 4276145 - DNA, 14 bp, Homo sapiens
acccctcttccccc

SEQ ID NO: 4276146 - DNA, 13 bp, Homo sapiens
acccctgcacaca

SEQ ID NO: 4276147 - DNA, 14 bp, Homo sapiens
acccctgcacacac

SEQ ID NO: 4276148 - DNA, 12 bp, Homo sapiens
acccctgcaggc

SEQ ID NO: 4276149 - DNA, 12 bp, Homo sapiens
acccctggcttt

SEQ ID NO: 4276150 - DNA, 15 bp, Homo sapiens
acccctggcttttca

SEQ ID NO: 4276151 - DNA, 18 bp, Homo sapiens
acccctggcttttcactg

SEQ ID NO: 4276152 - DNA, 16 bp, Homo sapiens
acccctggtgtccctg

SEQ ID NO: 4276153 - DNA, 21 bp, Homo sapiens
acccctggtgtccctgcctgg

SEQ ID NO: 4276154 - DNA, 15 bp, Homo sapiens
accccttccccactg

SEQ ID NO: 4276155 - DNA, 21 bp, Homo sapiens
accccttccccactgcctgcc

SEQ ID NO: 4276156 - DNA, 22 bp, Homo sapiens
accccttccccactgcctgccc

SEQ ID NO: 4276157 - DNA, 17 bp, Homo sapiens
acccctttggcacaccc

SEQ ID NO: 4276158 - DNA, 12 bp, Homo sapiens
acccggaggcca

SEQ ID NO: 4276159 - DNA, 17 bp, Homo sapiens
acccggatctccaggcc

SEQ ID NO: 4276160 - DNA, 19 bp, Homo sapiens
acccggatctccaggccca

SEQ ID NO: 4276161 - DNA, 21 bp, Homo sapiens
acccggctcgttcccccaggg

SEQ ID NO: 4276162 - DNA, 18 bp, Homo sapiens
acccggggaactggtttt

SEQ ID NO: 4276163 - DNA, 21 bp, Homo sapiens
acccgttcaacttttcctttg

SEQ ID NO: 4276164 - DNA, 19 bp, Homo sapiens
accctaggtctccacccct

SEQ ID NO: 4276165 - DNA, 20 bp, Homo sapiens
accctaggtctccacccctc

SEQ ID NO: 4276166 - DNA, 22 bp, Homo sapiens
accctaggtctccacccctcaa

SEQ ID NO: 4276167 - DNA, 11 bp, Homo sapiens
accctcagagc

SEQ ID NO: 4276168 - DNA, 12 bp, Homo sapiens
accctccctcag

SEQ ID NO: 4276169 - DNA, 14 bp, Homo sapiens
accctccctcagcc

SEQ ID NO: 4276170 - DNA, 14 bp, Homo sapiens
accctccctgtccc

SEQ ID NO: 4276171 - DNA, 19 bp, Homo sapiens
accctccctgtcccctgag

SEQ ID NO: 4276172 - DNA, 17 bp, Homo sapiens
accctcctatcacctcc

SEQ ID NO: 4276173 - DNA, 19 bp, Homo sapiens
accctctctgtccaatctg

SEQ ID NO: 4276174 - DNA, 20 bp, Homo sapiens
accctctctgtccaatctgc

SEQ ID NO: 4276175 - DNA, 20 bp, Homo sapiens
accctctgctatgtctgtga

SEQ ID NO: 4276176 - DNA, 13 bp, Homo sapiens
accctgcccctgc

SEQ ID NO: 4276177 - DNA, 16 bp, Homo sapiens
accctgctcctaccta

SEQ ID NO: 4276178 - DNA, 16 bp, Homo sapiens
accctgggtcaccttc

SEQ ID NO: 4276179 - DNA, 22 bp, Homo sapiens
accctgttttattgagttctga

SEQ ID NO: 4276180 - DNA, 23 bp, Homo sapiens
acccttaaacagttgcacagcat

SEQ ID NO: 4276181 - DNA, 10 bp, Homo sapiens
acccttcccc

SEQ ID NO: 4276182 - DNA, 16 bp, Homo sapiens
acccttccccactccc

SEQ ID NO: 4276183 - DNA, 14 bp, Homo sapiens
acccttctgtctgt

SEQ ID NO: 4276184 - DNA, 12 bp, Homo sapiens
accctttggggg

SEQ ID NO: 4276185 - DNA, 23 bp, Homo sapiens
acccttttggcccccgagctggg

SEQ ID NO: 4276186 - DNA, 18 bp, Homo sapiens
accgaggctggagctggc

SEQ ID NO: 4276187 - DNA, 16 bp, Homo sapiens
accgagtctcttctcc

SEQ ID NO: 4276188 - DNA, 18 bp, Homo sapiens
accgagtctcttctccac

SEQ ID NO: 4276189 - DNA, 18 bp, Homo sapiens
accgagtgtggagctgct

SEQ ID NO: 4276190 - DNA, 17 bp, Homo sapiens
accgctccccagcccag

SEQ ID NO: 4276191 - DNA, 18 bp, Homo sapiens
accgctccccagcccagg

SEQ ID NO: 4276192 - DNA, 19 bp, Homo sapiens
accgctccccagcccaggg

SEQ ID NO: 4276193 - DNA, 18 bp, Homo sapiens
accggacgcatgcagggc

SEQ ID NO: 4276194 - DNA, 19 bp, Homo sapiens
accggacgcatgcagggcc

SEQ ID NO: 4276195 - DNA, 16 bp, Homo sapiens
accgtaaaggtttatt

SEQ ID NO: 4276196 - DNA, 14 bp, Homo sapiens
accgtccctctccc

SEQ ID NO: 4276197 - DNA, 15 bp, Homo sapiens
accgtccctctcccc

SEQ ID NO: 4276198 - DNA, 18 bp, Homo sapiens
accgtccctctccccgga

SEQ ID NO: 4276199 - DNA, 23 bp, Homo sapiens
accgtgtgctccagtgttttctt

SEQ ID NO: 4276200 - DNA, 21 bp, Homo sapiens
acctaaatccattttctaaac

SEQ ID NO: 4276201 - DNA, 19 bp, Homo sapiens
acctaagagccacaataag

SEQ ID NO: 4276202 - DNA, 14 bp, Homo sapiens
acctaattaatttc

SEQ ID NO: 4276203 - DNA, 13 bp, Homo sapiens
acctataaatact

SEQ ID NO: 4276204 - DNA, 16 bp, Homo sapiens
acctatgtcatttcat

SEQ ID NO: 4276205 - DNA, 17 bp, Homo sapiens
acctcaacaagaagaat

SEQ ID NO: 4276206 - DNA, 17 bp, Homo sapiens
acctcactggtgcattt

SEQ ID NO: 4276207 - DNA, 22 bp, Homo sapiens
acctcactggtgcatttaaaat

SEQ ID NO: 4276208 - DNA, 19 bp, Homo sapiens
acctcagagtccaggcccc

SEQ ID NO: 4276209 - DNA, 19 bp, Homo sapiens
acctccaaaagccctgagt

SEQ ID NO: 4276210 - DNA, 15 bp, Homo sapiens
acctcgaagctgttc

SEQ ID NO: 4276211 - DNA, 12 bp, Homo sapiens
acctcgccgtgt

SEQ ID NO: 4276212 - DNA, 18 bp, Homo sapiens
acctcggccgaggcctgc

SEQ ID NO: 4276213 - DNA, 20 bp, Homo sapiens
acctcggctgtgtggggagg

SEQ ID NO: 4276214 - DNA, 20 bp, Homo sapiens
acctctatatgttgctgaaa

SEQ ID NO: 4276215 - DNA, 19 bp, Homo sapiens
acctctctgaactgcaaca

SEQ ID NO: 4276216 - DNA, 17 bp, Homo sapiens
acctctgatttattttg

SEQ ID NO: 4276217 - DNA, 17 bp, Homo sapiens
acctctggccctgttgt

SEQ ID NO: 4276218 - DNA, 12 bp, Homo sapiens
acctcttgtttt

SEQ ID NO: 4276219 - DNA, 12 bp, Homo sapiens
acctgaaaagat

SEQ ID NO: 4276220 - DNA, 22 bp, Homo sapiens
acctgaaaagatgttgtgtctt

SEQ ID NO: 4276221 - DNA, 11 bp, Homo sapiens
acctgaagaat

SEQ ID NO: 4276222 - DNA, 18 bp, Homo sapiens
acctgaagagcgctcctc

SEQ ID NO: 4276223 - DNA, 20 bp, Homo sapiens
acctgaagagcgctcctctg

SEQ ID NO: 4276224 - DNA, 22 bp, Homo sapiens
acctgaagagcgctcctctgcc

SEQ ID NO: 4276225 - DNA, 23 bp, Homo sapiens
acctgaagagcgctcctctgcct

SEQ ID NO: 4276226 - DNA, 18 bp, Homo sapiens
acctgaattcgagacagg

SEQ ID NO: 4276227 - DNA, 19 bp, Homo sapiens
acctgcacacccctgcaca

SEQ ID NO: 4276228 - DNA, 23 bp, Homo sapiens
acctgcacaccgtccctctcccc

SEQ ID NO: 4276229 - DNA, 15 bp, Homo sapiens
acctgcacttggcct

SEQ ID NO: 4276230 - DNA, 17 bp, Homo sapiens
acctgcagccccaggcc

SEQ ID NO: 4276231 - DNA, 14 bp, Homo sapiens
acctgcagggagca

SEQ ID NO: 4276232 - DNA, 15 bp, Homo sapiens
acctgcagggagcag

SEQ ID NO: 4276233 - DNA, 19 bp, Homo sapiens
acctgcccccgctctgcca

SEQ ID NO: 4276234 - DNA, 12 bp, Homo sapiens
acctgccccctt

SEQ ID NO: 4276235 - DNA, 20 bp, Homo sapiens
acctgcccccttctcccaca

SEQ ID NO: 4276236 - DNA, 21 bp, Homo sapiens
acctgcctctgaactgctgct

SEQ ID NO: 4276237 - DNA, 22 bp, Homo sapiens
acctgcctctgaactgctgctg

SEQ ID NO: 4276238 - DNA, 23 bp, Homo sapiens
acctgcctctgaactgctgctgg

SEQ ID NO: 4276239 - DNA, 19 bp, Homo sapiens
acctggatggatctgctcc

SEQ ID NO: 4276240 - DNA, 23 bp, Homo sapiens
acctggatggatctgctccatgc

SEQ ID NO: 4276241 - DNA, 24 bp, Homo sapiens
acctggatggatctgctccatgca

SEQ ID NO: 4276242 - DNA, 18 bp, Homo sapiens
acctggcttcccaggacc

SEQ ID NO: 4276243 - DNA, 21 bp, Homo sapiens
acctggcttcccaggaccctg

SEQ ID NO: 4276244 - DNA, 18 bp, Homo sapiens
acctgggagatgctggga

SEQ ID NO: 4276245 - DNA, 13 bp, Homo sapiens
acctgggccctag

SEQ ID NO: 4276246 - DNA, 13 bp, Homo sapiens
acctgggccctgg

SEQ ID NO: 4276247 - DNA, 14 bp, Homo sapiens
acctgggccctggt

SEQ ID NO: 4276248 - DNA, 15 bp, Homo sapiens
acctggggagtggga

SEQ ID NO: 4276249 - DNA, 14 bp, Homo sapiens
acctgggtgtgctc

SEQ ID NO: 4276250 - DNA, 17 bp, Homo sapiens
acctgggtgtgctccag

SEQ ID NO: 4276251 - DNA, 18 bp, Homo sapiens
acctgggtgtgctccagg

SEQ ID NO: 4276252 - DNA, 21 bp, Homo sapiens
acctgggtgtgctccaggctt

SEQ ID NO: 4276253 - DNA, 13 bp, Homo sapiens
acctgtgagggga

SEQ ID NO: 4276254 - DNA, 12 bp, Homo sapiens
agcaaacacaca

SEQ ID NO: 4276255 - DNA, 19 bp, Homo sapiens
agcaaactgaagcccacag

SEQ ID NO: 4276256 - DNA, 20 bp, Homo sapiens
agcaaagatatctcatctct

SEQ ID NO: 4276257 - DNA, 24 bp, Homo sapiens
agcaaagtagtacttcttctgtaa

SEQ ID NO: 4276258 - DNA, 15 bp, Homo sapiens
agcaaagttttcaga

SEQ ID NO: 4276259 - DNA, 19 bp, Homo sapiens
agcaaatttcatctttcca

SEQ ID NO: 4276260 - DNA, 19 bp, Homo sapiens
agcaacaaaggatttgaaa

SEQ ID NO: 4276261 - DNA, 16 bp, Homo sapiens
agcaacaggaccagga

SEQ ID NO: 4276262 - DNA, 18 bp, Homo sapiens
agcaacaggaccaggagc

SEQ ID NO: 4276263 - DNA, 20 bp, Homo sapiens
agcaacaggaccaggagcca

SEQ ID NO: 4276264 - DNA, 22 bp, Homo sapiens
agcaaccctcctatcacctccc

SEQ ID NO: 4276265 - DNA, 19 bp, Homo sapiens
agcaagaagattctaaaac

SEQ ID NO: 4276266 - DNA, 13 bp, Homo sapiens
agcaagcacctgg

SEQ ID NO: 4276267 - DNA, 23 bp, Homo sapiens
agcaagcacctgggtgtgctcca

SEQ ID NO: 4276268 - DNA, 17 bp, Homo sapiens
agcaaggcaagaagtgg

SEQ ID NO: 4276269 - DNA, 16 bp, Homo sapiens
agcaagtgctgagtct

SEQ ID NO: 4276270 - DNA, 17 bp, Homo sapiens
agcaattaaagacattt

SEQ ID NO: 4276271 - DNA, 14 bp, Homo sapiens
agcacaagaagtgg

SEQ ID NO: 4276272 - DNA, 16 bp, Homo sapiens
agcacaagaagtggga

SEQ ID NO: 4276273 - DNA, 23 bp, Homo sapiens
agcacaagcagagtgcacagctg

SEQ ID NO: 4276274 - DNA, 22 bp, Homo sapiens
agcacagagagcggcttcccca

SEQ ID NO: 4276275 - DNA, 18 bp, Homo sapiens
agcacagcctcacccctg

SEQ ID NO: 4276276 - DNA, 21 bp, Homo sapiens
agcacagcctcacccctgcag

SEQ ID NO: 4276277 - DNA, 19 bp, Homo sapiens
agcacatggaggccctttt

SEQ ID NO: 4276278 - DNA, 17 bp, Homo sapiens
agcacattgccctgagg

SEQ ID NO: 4276279 - DNA, 12 bp, Homo sapiens
agcacctgggtg

SEQ ID NO: 4276280 - DNA, 16 bp, Homo sapiens
agcaccttgaatggaa

SEQ ID NO: 4276281 - DNA, 16 bp, Homo sapiens
agcactggaggcctct

SEQ ID NO: 4276282 - DNA, 14 bp, Homo sapiens
agcactgtgcagcc

SEQ ID NO: 4276283 - DNA, 15 bp, Homo sapiens
agcagaaggccttgc

SEQ ID NO: 4276284 - DNA, 16 bp, Homo sapiens
agcagagccatctgcg

SEQ ID NO: 4276285 - DNA, 12 bp, Homo sapiens
agcagagcctgg

SEQ ID NO: 4276286 - DNA, 13 bp, Homo sapiens
agcagagcctggg

SEQ ID NO: 4276287 - DNA, 18 bp, Homo sapiens
agcagagtgcacagctgt

SEQ ID NO: 4276288 - DNA, 15 bp, Homo sapiens
agcagcacaattctg

SEQ ID NO: 4276289 - DNA, 21 bp, Homo sapiens
agcagcacaattctgtccctg

SEQ ID NO: 4276290 - DNA, 21 bp, Homo sapiens
agcagcacgccaaccccagca

SEQ ID NO: 4276291 - DNA, 24 bp, Homo sapiens
agcagcacgccaaccccagcagtc

SEQ ID NO: 4276292 - DNA, 12 bp, Homo sapiens
agcaggaaatag

SEQ ID NO: 4276293 - DNA, 20 bp, Homo sapiens
agcaggaagcaaggccagcc

SEQ ID NO: 4276294 - DNA, 18 bp, Homo sapiens
agcagggcgggccaggag

SEQ ID NO: 4276295 - DNA, 14 bp, Homo sapiens
agcagggtgacccc

SEQ ID NO: 4276296 - DNA, 19 bp, Homo sapiens
agcaggttctctcctgtga

SEQ ID NO: 4276297 - DNA, 17 bp, Homo sapiens
agcaggttgcttcaaga

SEQ ID NO: 4276298 - DNA, 19 bp, Homo sapiens
agcagtacttgctcaataa

SEQ ID NO: 4276299 - DNA, 14 bp, Homo sapiens
agcagtcctgggcc

SEQ ID NO: 4276300 - DNA, 21 bp, Homo sapiens
agcagtcctgggccccctggg

SEQ ID NO: 4276301 - DNA, 16 bp, Homo sapiens
agcagtgggccctggc

SEQ ID NO: 4276302 - DNA, 15 bp, Homo sapiens
agcagtgtgagggtg

SEQ ID NO: 4276303 - DNA, 17 bp, Homo sapiens
agcagtgtgagggtgca

SEQ ID NO: 4276304 - DNA, 21 bp, Homo sapiens
agcagttgcaataaactcagt

SEQ ID NO: 4276305 - DNA, 18 bp, Homo sapiens
agcagttgttatattcat

SEQ ID NO: 4276306 - DNA, 16 bp, Homo sapiens
agcagtttgcctctgc

SEQ ID NO: 4276307 - DNA, 18 bp, Homo sapiens
agcagtttgcctctgcac

SEQ ID NO: 4276308 - DNA, 14 bp, Homo sapiens
agcagtttgctttg

SEQ ID NO: 4276309 - DNA, 11 bp, Homo sapiens
agcatatataa

SEQ ID NO: 4276310 - DNA, 19 bp, Homo sapiens
agcatcaacctaggagcag

SEQ ID NO: 4276311 - DNA, 22 bp, Homo sapiens
agcatccatgcggccggcctgg

SEQ ID NO: 4276312 - DNA, 16 bp, Homo sapiens
agcatcctcagttcct

SEQ ID NO: 4276313 - DNA, 16 bp, Homo sapiens
agcatcgtgtgggtcc

SEQ ID NO: 4276314 - DNA, 19 bp, Homo sapiens
agcatctggctaaggcatc

SEQ ID NO: 4276315 - DNA, 21 bp, Homo sapiens
agcatgaaaggtaatctgaaa

SEQ ID NO: 4276316 - DNA, 18 bp, Homo sapiens
agcatgacaagccccagg

SEQ ID NO: 4276317 - DNA, 21 bp, Homo sapiens
agcatgacaagccccaggcag

SEQ ID NO: 4276318 - DNA, 16 bp, Homo sapiens
agcatgagccagctct

SEQ ID NO: 4276319 - DNA, 17 bp, Homo sapiens
agcatgagccagctctg

SEQ ID NO: 4276320 - DNA, 16 bp, Homo sapiens
agcatgtgttaatctt

SEQ ID NO: 4276321 - DNA, 22 bp, Homo sapiens
agcatgtgtttggttctggggc

SEQ ID NO: 4276322 - DNA, 18 bp, Homo sapiens
agcattatccttttatct

SEQ ID NO: 4276323 - DNA, 15 bp, Homo sapiens
agcattcaaaatagt

SEQ ID NO: 4276324 - DNA, 13 bp, Homo sapiens
agcattctggggt

SEQ ID NO: 4276325 - DNA, 20 bp, Homo sapiens
agcattctggggtggggctt

SEQ ID NO: 4276326 - DNA, 13 bp, Homo sapiens
agcatttggaagg

SEQ ID NO: 4276327 - DNA, 19 bp, Homo sapiens
agcattttctgcatctcca

SEQ ID NO: 4276328 - DNA, 17 bp, Homo sapiens
agccaaagagaaaagat

SEQ ID NO: 4276329 - DNA, 18 bp, Homo sapiens
agccaaagaggcattcag

SEQ ID NO: 4276330 - DNA, 15 bp, Homo sapiens
agccacacccaggca

SEQ ID NO: 4276331 - DNA, 13 bp, Homo sapiens
agccacaggcaga

SEQ ID NO: 4276332 - DNA, 18 bp, Homo sapiens
agccaccaaggctgcctg

SEQ ID NO: 4276333 - DNA, 23 bp, Homo sapiens
agccaccacctggatggatctgc

SEQ ID NO: 4276334 - DNA, 20 bp, Homo sapiens
agccacccggatctccaggc

SEQ ID NO: 4276335 - DNA, 21 bp, Homo sapiens
agccacccggatctccaggcc

SEQ ID NO: 4276336 - DNA, 15 bp, Homo sapiens
agccaccctgccatg

SEQ ID NO: 4276337 - DNA, 19 bp, Homo sapiens
agccaccctgccatggagg

SEQ ID NO: 4276338 - DNA, 20 bp, Homo sapiens
agccacgcctctctcagccc

SEQ ID NO: 4276339 - DNA, 18 bp, Homo sapiens
agccacgtgctggagagt

SEQ ID NO: 4276340 - DNA, 19 bp, Homo sapiens
agccacgtgctggagagta

SEQ ID NO: 4276341 - DNA, 17 bp, Homo sapiens
agccagatgacagggag

SEQ ID NO: 4276342 - DNA, 18 bp, Homo sapiens
agccagatgacagggagc

SEQ ID NO: 4276343 - DNA, 20 bp, Homo sapiens
agccagatgacagggagctg

SEQ ID NO: 4276344 - DNA, 17 bp, Homo sapiens
agccagattaggcctgg

SEQ ID NO: 4276345 - DNA, 18 bp, Homo sapiens
agccagattaggcctgga

SEQ ID NO: 4276346 - DNA, 20 bp, Homo sapiens
agccagattaggcctggagt

SEQ ID NO: 4276347 - DNA, 13 bp, Homo sapiens
agccagcccacat

SEQ ID NO: 4276348 - DNA, 11 bp, Homo sapiens
agccagctccc

SEQ ID NO: 4276349 - DNA, 17 bp, Homo sapiens
agccagctctgtcccag

SEQ ID NO: 4276350 - DNA, 18 bp, Homo sapiens
agccagctgcaggaatca

SEQ ID NO: 4276351 - DNA, 15 bp, Homo sapiens
agccaggcctcccgc

SEQ ID NO: 4276352 - DNA, 18 bp, Homo sapiens
agccaggcctcccgcatg

SEQ ID NO: 4276353 - DNA, 16 bp, Homo sapiens
agccagggctgtcctt

SEQ ID NO: 4276354 - DNA, 15 bp, Homo sapiens
agccagggttccaga

SEQ ID NO: 4276355 - DNA, 16 bp, Homo sapiens
agccagggttccagac

SEQ ID NO: 4276356 - DNA, 20 bp, Homo sapiens
agccagggttccagacaggg

SEQ ID NO: 4276357 - DNA, 17 bp, Homo sapiens
agccagtgactccagga

SEQ ID NO: 4276358 - DNA, 19 bp, Homo sapiens
agccagtgactccaggaga

SEQ ID NO: 4276359 - DNA, 21 bp, Homo sapiens
agccagtgactccaggagagg

SEQ ID NO: 4276360 - DNA, 22 bp, Homo sapiens
agccagtgactccaggagagga

SEQ ID NO: 4276361 - DNA, 22 bp, Homo sapiens
agccatatgacaatttcaaaat

SEQ ID NO: 4276362 - DNA, 23 bp, Homo sapiens
agccatatgacaatttcaaaatg

SEQ ID NO: 4276363 - DNA, 24 bp, Homo sapiens
agccatgactagggtcctcaggca

SEQ ID NO: 4276364 - DNA, 18 bp, Homo sapiens
agccatggactctacact

SEQ ID NO: 4276365 - DNA, 16 bp, Homo sapiens
agcccacagtatattt

SEQ ID NO: 4276366 - DNA, 16 bp, Homo sapiens
agcccacccccctcat

SEQ ID NO: 4276367 - DNA, 18 bp, Homo sapiens
agcccacctgctgcccgt

SEQ ID NO: 4276368 - DNA, 14 bp, Homo sapiens
agcccagagagacc

SEQ ID NO: 4276369 - DNA, 17 bp, Homo sapiens
agcccagagagaccctg

SEQ ID NO: 4276370 - DNA, 20 bp, Homo sapiens
agcccaggacactgcctttg

SEQ ID NO: 4276371 - DNA, 21 bp, Homo sapiens
agcccaggacactgcctttgc

SEQ ID NO: 4276372 - DNA, 12 bp, Homo sapiens
agcccaggagga

SEQ ID NO: 4276373 - DNA, 16 bp, Homo sapiens
agcccagggttccccc

SEQ ID NO: 4276374 - DNA, 17 bp, Homo sapiens
agcccagggttccccca

SEQ ID NO: 4276375 - DNA, 18 bp, Homo sapiens
agcccagggttcccccag

SEQ ID NO: 4276376 - DNA, 15 bp, Homo sapiens
agccccagcgagtct

SEQ ID NO: 4276377 - DNA, 18 bp, Homo sapiens
agccccagcgagtctgga

SEQ ID NO: 4276378 - DNA, 21 bp, Homo sapiens
agccccagcgagtctggagac

SEQ ID NO: 4276379 - DNA, 16 bp, Homo sapiens
agccccaggcaggctg

SEQ ID NO: 4276380 - DNA, 11 bp, Homo sapiens
agccccaggcc

SEQ ID NO: 4276381 - DNA, 16 bp, Homo sapiens
agccccagggccctgc

SEQ ID NO: 4276382 - DNA, 17 bp, Homo sapiens
agccccagggccctgct

SEQ ID NO: 4276383 - DNA, 20 bp, Homo sapiens
agccccagggccctgctcag

SEQ ID NO: 4276384 - DNA, 18 bp, Homo sapiens
agggtctttgtgtgctgt

SEQ ID NO: 4276385 - DNA, 16 bp, Homo sapiens
agggtgacagagggac

SEQ ID NO: 4276386 - DNA, 19 bp, Homo sapiens
agggtgacagagggacagt

SEQ ID NO: 4276387 - DNA, 13 bp, Homo sapiens
agggtgagggtga

SEQ ID NO: 4276388 - DNA, 18 bp, Homo sapiens
agggtgctccctcctcag

SEQ ID NO: 4276389 - DNA, 15 bp, Homo sapiens
agggtggcatcccag

SEQ ID NO: 4276390 - DNA, 21 bp, Homo sapiens
agggtggcatcccagtggcct

SEQ ID NO: 4276391 - DNA, 19 bp, Homo sapiens
agggtggtcttcaagcctg

SEQ ID NO: 4276392 - DNA, 21 bp, Homo sapiens
agggtggtcttcaagcctggc

SEQ ID NO: 4276393 - DNA, 19 bp, Homo sapiens
agggtgtgggtcagggagg

SEQ ID NO: 4276394 - DNA, 15 bp, Homo sapiens
agggttaaagaaagg

SEQ ID NO: 4276395 - DNA, 21 bp, Homo sapiens
agggttaaagaaaggcagaga

SEQ ID NO: 4276396 - DNA, 23 bp, Homo sapiens
agggttagacaagcctggaggac

SEQ ID NO: 4276397 - DNA, 14 bp, Homo sapiens
agggttccagacag

SEQ ID NO: 4276398 - DNA, 15 bp, Homo sapiens
agggttccagacagg

SEQ ID NO: 4276399 - DNA, 20 bp, Homo sapiens
agggttccagacagggtggg

SEQ ID NO: 4276400 - DNA, 17 bp, Homo sapiens
agggtttccaccttggc

SEQ ID NO: 4276401 - DNA, 12 bp, Homo sapiens
aggtactattat

SEQ ID NO: 4276402 - DNA, 19 bp, Homo sapiens
aggtagacttttatgagaa

SEQ ID NO: 4276403 - DNA, 20 bp, Homo sapiens
aggtagacttttatgagaac

SEQ ID NO: 4276404 - DNA, 15 bp, Homo sapiens
aggtcaatgaaatat

SEQ ID NO: 4276405 - DNA, 19 bp, Homo sapiens
aggtcaatgaaatatttgc

SEQ ID NO: 4276406 - DNA, 13 bp, Homo sapiens
aggtcatcccggg

SEQ ID NO: 4276407 - DNA, 22 bp, Homo sapiens
aggtcccagacatgctgcccac

SEQ ID NO: 4276408 - DNA, 17 bp, Homo sapiens
aggtccgagtcttttta

SEQ ID NO: 4276409 - DNA, 22 bp, Homo sapiens
aggtcctgtcctggctcccagg

SEQ ID NO: 4276410 - DNA, 17 bp, Homo sapiens
aggtcggaggcttggga

SEQ ID NO: 4276411 - DNA, 14 bp, Homo sapiens
aggtctcatgcctg

SEQ ID NO: 4276412 - DNA, 14 bp, Homo sapiens
aggtctccacccct

SEQ ID NO: 4276413 - DNA, 19 bp, Homo sapiens
aggtctccacccctcaagc

SEQ ID NO: 4276414 - DNA, 23 bp, Homo sapiens
aggtctccacccctcaagccagg

SEQ ID NO: 4276415 - DNA, 22 bp, Homo sapiens
aggtctcctgggcatctggccc

SEQ ID NO: 4276416 - DNA, 16 bp, Homo sapiens
aggtgagggaggcctg

SEQ ID NO: 4276417 - DNA, 22 bp, Homo sapiens
aggtgcatgccttcataaatta

SEQ ID NO: 4276418 - DNA, 17 bp, Homo sapiens
aggtgcctgagagcaga

SEQ ID NO: 4276419 - DNA, 21 bp, Homo sapiens
aggtgcctgagagcagaatga

SEQ ID NO: 4276420 - DNA, 13 bp, Homo sapiens
aggtgctggcatg

SEQ ID NO: 4276421 - DNA, 21 bp, Homo sapiens
aggtgctggcatgtctgggtc

SEQ ID NO: 4276422 - DNA, 16 bp, Homo sapiens
aggtggaggcgagcca

SEQ ID NO: 4276423 - DNA, 14 bp, Homo sapiens
aggtggccagggct

SEQ ID NO: 4276424 - DNA, 21 bp, Homo sapiens
aggtgggccagcccctcccac

SEQ ID NO: 4276425 - DNA, 22 bp, Homo sapiens
aggtgggccagcccctcccacc

SEQ ID NO: 4276426 - DNA, 15 bp, Homo sapiens
aggtgggccttccat

SEQ ID NO: 4276427 - DNA, 21 bp, Homo sapiens
aggtggggcgggaaagccagt

SEQ ID NO: 4276428 - DNA, 20 bp, Homo sapiens
aggtggtctgcaccccacag

SEQ ID NO: 4276429 - DNA, 15 bp, Homo sapiens
aggtggtcttggaga

SEQ ID NO: 4276430 - DNA, 18 bp, Homo sapiens
aggtggtcttggagagga

SEQ ID NO: 4276431 - DNA, 19 bp, Homo sapiens
aggtggtcttggagaggag

SEQ ID NO: 4276432 - DNA, 22 bp, Homo sapiens
aggtggtcttggagaggaggtg

SEQ ID NO: 4276433 - DNA, 17 bp, Homo sapiens
aggtgtactatggctgt

SEQ ID NO: 4276434 - DNA, 15 bp, Homo sapiens
aggtgtcatacagat

SEQ ID NO: 4276435 - DNA, 16 bp, Homo sapiens
aggtgtggagtggagg

SEQ ID NO: 4276436 - DNA, 13 bp, Homo sapiens
aggtgtgggctcc

SEQ ID NO: 4276437 - DNA, 13 bp, Homo sapiens
aggttaaggggat

SEQ ID NO: 4276438 - DNA, 23 bp, Homo sapiens
aggttaataggaggacagaacca

SEQ ID NO: 4276439 - DNA, 17 bp, Homo sapiens
aggttggaactgctgcc

SEQ ID NO: 4276440 - DNA, 20 bp, Homo sapiens
aggtttaagtagatttcatg

SEQ ID NO: 4276441 - DNA, 17 bp, Homo sapiens
aggtttagcgttttaag

SEQ ID NO: 4276442 - DNA, 17 bp, Homo sapiens
aggtttatttttctgtt

SEQ ID NO: 4276443 - DNA, 13 bp, Homo sapiens
agtaaaattacag

SEQ ID NO: 4276444 - DNA, 18 bp, Homo sapiens
agtaaaattatactgtgt

SEQ ID NO: 4276445 - DNA, 18 bp, Homo sapiens
agtaaatgctacctctga

SEQ ID NO: 4276446 - DNA, 13 bp, Homo sapiens
agtaacacataaa

SEQ ID NO: 4276447 - DNA, 23 bp, Homo sapiens
agtaagtggagcatttggaagga

SEQ ID NO: 4276448 - DNA, 19 bp, Homo sapiens
agtaagttctgaaaactgt

SEQ ID NO: 4276449 - DNA, 14 bp, Homo sapiens
agtacttcttctgt

SEQ ID NO: 4276450 - DNA, 19 bp, Homo sapiens
agtacttcttctgtaatat

SEQ ID NO: 4276451 - DNA, 13 bp, Homo sapiens
agtacttgctcaa

SEQ ID NO: 4276452 - DNA, 16 bp, Homo sapiens
agtacttgctcaataa

SEQ ID NO: 4276453 - DNA, 22 bp, Homo sapiens
agtacttgtgaaacacagctgt

SEQ ID NO: 4276454 - DNA, 16 bp, Homo sapiens
agtagaaggtcggagg

SEQ ID NO: 4276455 - DNA, 13 bp, Homo sapiens
agtagaatctcag

SEQ ID NO: 4276456 - DNA, 21 bp, Homo sapiens
agtagcgctatagttactgtc

SEQ ID NO: 4276457 - DNA, 19 bp, Homo sapiens
agtagctgtggggagctgg

SEQ ID NO: 4276458 - DNA, 21 bp, Homo sapiens
agtaggctgtattttctttta

SEQ ID NO: 4276459 - DNA, 20 bp, Homo sapiens
agtagtacttcttctgtaat

SEQ ID NO: 4276460 - DNA, 14 bp, Homo sapiens
agtagtgtctggat

SEQ ID NO: 4276461 - DNA, 20 bp, Homo sapiens
agtagtgtctggatcagtaa

SEQ ID NO: 4276462 - DNA, 23 bp, Homo sapiens
agtatcagagatgtccattttta

SEQ ID NO: 4276463 - DNA, 18 bp, Homo sapiens
agtatgcactatatacat

SEQ ID NO: 4276464 - DNA, 21 bp, Homo sapiens
agtatgtcagtccaataaatt

SEQ ID NO: 4276465 - DNA, 19 bp, Homo sapiens
agtatgttaagctctttat

SEQ ID NO: 4276466 - DNA, 16 bp, Homo sapiens
agtatgttttagcatg

SEQ ID NO: 4276467 - DNA, 21 bp, Homo sapiens
agtattactaaattgaccttt

SEQ ID NO: 4276468 - DNA, 17 bp, Homo sapiens
agtattcattttgcaac

SEQ ID NO: 4276469 - DNA, 18 bp, Homo sapiens
agtattccttggcccagc

SEQ ID NO: 4276470 - DNA, 16 bp, Homo sapiens
agtcaagtgtgcctgc

SEQ ID NO: 4276471 - DNA, 17 bp, Homo sapiens
agtcaagtgtgcctgct

SEQ ID NO: 4276472 - DNA, 23 bp, Homo sapiens
agtcacatatcaagtcccgaggc

SEQ ID NO: 4276473 - DNA, 16 bp, Homo sapiens
agtcactaaaaggaag

SEQ ID NO: 4276474 - DNA, 21 bp, Homo sapiens
agtcactaaaaggaagacagt

SEQ ID NO: 4276475 - DNA, 13 bp, Homo sapiens
agtcactgcacag

SEQ ID NO: 4276476 - DNA, 14 bp, Homo sapiens
agtcactgcctgga

SEQ ID NO: 4276477 - DNA, 21 bp, Homo sapiens
agtcagatgtttgagcagtgg

SEQ ID NO: 4276478 - DNA, 19 bp, Homo sapiens
agtcagctttgccttccac

SEQ ID NO: 4276479 - DNA, 22 bp, Homo sapiens
agtcagctttgccttccacgct

SEQ ID NO: 4276480 - DNA, 19 bp, Homo sapiens
agtcaggaagcctcctgct

SEQ ID NO: 4276481 - DNA, 21 bp, Homo sapiens
agtcagggcggggctggccag

SEQ ID NO: 4276482 - DNA, 24 bp, Homo sapiens
agtcagggcggggctggccagctg

SEQ ID NO: 4276483 - DNA, 19 bp, Homo sapiens
agtcagtacacccaatttt

SEQ ID NO: 4276484 - DNA, 15 bp, Homo sapiens
agtcatggctgtccc

SEQ ID NO: 4276485 - DNA, 18 bp, Homo sapiens
agtcatggctgtcccctg

SEQ ID NO: 4276486 - DNA, 18 bp, Homo sapiens
agtcattaaattactata

SEQ ID NO: 4276487 - DNA, 13 bp, Homo sapiens
agtccaactacag

SEQ ID NO: 4276488 - DNA, 13 bp, Homo sapiens
agtccagacctgg

SEQ ID NO: 4276489 - DNA, 15 bp, Homo sapiens
agtccagacctgggc

SEQ ID NO: 4276490 - DNA, 14 bp, Homo sapiens
agtccagctctccc

SEQ ID NO: 4276491 - DNA, 16 bp, Homo sapiens
agtccagctctcccct

SEQ ID NO: 4276492 - DNA, 20 bp, Homo sapiens
agtccagctctcccctgcgc

SEQ ID NO: 4276493 - DNA, 12 bp, Homo sapiens
agtccaggcccc

SEQ ID NO: 4276494 - DNA, 14 bp, Homo sapiens
agtccagtgaccct

SEQ ID NO: 4276495 - DNA, 17 bp, Homo sapiens
agtccagtgaccctgga

SEQ ID NO: 4276496 - DNA, 21 bp, Homo sapiens
agtcccagggagctctgcata

SEQ ID NO: 4276497 - DNA, 13 bp, Homo sapiens
agtcccagtggga

SEQ ID NO: 4276498 - DNA, 15 bp, Homo sapiens
agtccctccctcctg

SEQ ID NO: 4276499 - DNA, 19 bp, Homo sapiens
agtccctccctcctggctc

SEQ ID NO: 4276500 - DNA, 19 bp, Homo sapiens
agtcctgggccccctggga

SEQ ID NO: 4276501 - DNA, 17 bp, Homo sapiens
agtcctgttctcagagc

SEQ ID NO: 4276502 - DNA, 18 bp, Homo sapiens
agtccttaaacagggcat

SEQ ID NO: 4276503 - DNA, 19 bp, Homo sapiens
agtctatctggtattaaat

SEQ ID NO: 4276504 - DNA, 16 bp, Homo sapiens
agtctcaatgaaatag

SEQ ID NO: 4276505 - DNA, 19 bp, Homo sapiens
agtctcactagcacatgga

SEQ ID NO: 4276506 - DNA, 21 bp, Homo sapiens
agtctcagtgctagcttattt

SEQ ID NO: 4276507 - DNA, 18 bp, Homo sapiens
agtctctatgatcttggc

SEQ ID NO: 4276508 - DNA, 23 bp, Homo sapiens
agtctctgatttgcaaatgcaca

SEQ ID NO: 4276509 - DNA, 19 bp, Homo sapiens
agtctcttctccactggat

SEQ ID NO: 4276510 - DNA, 16 bp, Homo sapiens
agtctgaaggagagga

SEQ ID NO: 4276511 - DNA, 17 bp, Homo sapiens
agtctgaaggagaggag

SEQ ID NO: 4276512 - DNA, 19 bp, Homo sapiens
agtctgaaggagaggagtg

SEQ ID NO: 4276513 - DNA, 20 bp, Homo sapiens
atctcagataaagtgaccag

SEQ ID NO: 4276514 - DNA, 12 bp, Homo sapiens
atctcagctcat

SEQ ID NO: 4276515 - DNA, 17 bp, Homo sapiens
atctcataactcatttg

SEQ ID NO: 4276516 - DNA, 16 bp, Homo sapiens
atctcatcatgtctat

SEQ ID NO: 4276517 - DNA, 19 bp, Homo sapiens
atctcatcatgtctattgt

SEQ ID NO: 4276518 - DNA, 13 bp, Homo sapiens
atctccaggccca

SEQ ID NO: 4276519 - DNA, 14 bp, Homo sapiens
atctccaggcccag

SEQ ID NO: 4276520 - DNA, 18 bp, Homo sapiens
atctccaggcccagcctg

SEQ ID NO: 4276521 - DNA, 15 bp, Homo sapiens
atctctaaaattcta

SEQ ID NO: 4276522 - DNA, 16 bp, Homo sapiens
atctctaaaattctag

SEQ ID NO: 4276523 - DNA, 19 bp, Homo sapiens
atctctaaaattctagtct

SEQ ID NO: 4276524 - DNA, 14 bp, Homo sapiens
atctctactttcct

SEQ ID NO: 4276525 - DNA, 23 bp, Homo sapiens
atctctactttcctgatgttgat

SEQ ID NO: 4276526 - DNA, 20 bp, Homo sapiens
atctctgattaaatttaata

SEQ ID NO: 4276527 - DNA, 21 bp, Homo sapiens
atctctgattaaatttaatat

SEQ ID NO: 4276528 - DNA, 22 bp, Homo sapiens
atctcttaagacagcatgtgtt

SEQ ID NO: 4276529 - DNA, 14 bp, Homo sapiens
atctcttcttcctt

SEQ ID NO: 4276530 - DNA, 11 bp, Homo sapiens
atctctttcat

SEQ ID NO: 4276531 - DNA, 13 bp, Homo sapiens
atctgaaaactgg

SEQ ID NO: 4276532 - DNA, 14 bp, Homo sapiens
atctgaaaactgga

SEQ ID NO: 4276533 - DNA, 14 bp, Homo sapiens
atctgaaaagaaat

SEQ ID NO: 4276534 - DNA, 22 bp, Homo sapiens
atctgagaaaagctttgaaccc

SEQ ID NO: 4276535 - DNA, 17 bp, Homo sapiens
atctgattgtgatgtga

SEQ ID NO: 4276536 - DNA, 18 bp, Homo sapiens
atctgcaaatagtttcaa

SEQ ID NO: 4276537 - DNA, 16 bp, Homo sapiens
atctgctccatgcaga

SEQ ID NO: 4276538 - DNA, 15 bp, Homo sapiens
atctgctgagctctg

SEQ ID NO: 4276539 - DNA, 15 bp, Homo sapiens
atctgctgcctctga

SEQ ID NO: 4276540 - DNA, 17 bp, Homo sapiens
atctgctgcctctgaaa

SEQ ID NO: 4276541 - DNA, 21 bp, Homo sapiens
atctgctgcctctgaaaatat

SEQ ID NO: 4276542 - DNA, 22 bp, Homo sapiens
atctggagtctgaaggagagga

SEQ ID NO: 4276543 - DNA, 23 bp, Homo sapiens
atctggagtctgaaggagaggag

SEQ ID NO: 4276544 - DNA, 15 bp, Homo sapiens
atctggccctgctgc

SEQ ID NO: 4276545 - DNA, 16 bp, Homo sapiens
atctggccctgctgcc

SEQ ID NO: 4276546 - DNA, 18 bp, Homo sapiens
atctggccctgctgcccc

SEQ ID NO: 4276547 - DNA, 19 bp, Homo sapiens
atctggccctgctgccccc

SEQ ID NO: 4276548 - DNA, 15 bp, Homo sapiens
atctggctaaggcat

SEQ ID NO: 4276549 - DNA, 15 bp, Homo sapiens
atctggtgatttcta

SEQ ID NO: 4276550 - DNA, 20 bp, Homo sapiens
atctgtataatactttgtat

SEQ ID NO: 4276551 - DNA, 24 bp, Homo sapiens
atctgtataatactttgtatacaa

SEQ ID NO: 4276552 - DNA, 18 bp, Homo sapiens
atctgtatgggtcattct

SEQ ID NO: 4276553 - DNA, 13 bp, Homo sapiens
atctgtctgagcc

SEQ ID NO: 4276554 - DNA, 14 bp, Homo sapiens
atctgtctgagccc

SEQ ID NO: 4276555 - DNA, 21 bp, Homo sapiens
atctgtctgagccctgccctc

SEQ ID NO: 4276556 - DNA, 15 bp, Homo sapiens
atctgtctgattcta

SEQ ID NO: 4276557 - DNA, 16 bp, Homo sapiens
atctgtctgattctat

SEQ ID NO: 4276558 - DNA, 17 bp, Homo sapiens
atctgtctgattctatg

SEQ ID NO: 4276559 - DNA, 13 bp, Homo sapiens
atctgtctgtcct

SEQ ID NO: 4276560 - DNA, 12 bp, Homo sapiens
atctgtgaaata

SEQ ID NO: 4276561 - DNA, 17 bp, Homo sapiens
atctgtgaaatatcatc

SEQ ID NO: 4276562 - DNA, 14 bp, Homo sapiens
atctgtttgcttct

SEQ ID NO: 4276563 - DNA, 15 bp, Homo sapiens
atcttaaaattcttg

SEQ ID NO: 4276564 - DNA, 14 bp, Homo sapiens
atcttaatgtatat

SEQ ID NO: 4276565 - DNA, 16 bp, Homo sapiens
atcttaggatttacca

SEQ ID NO: 4276566 - DNA, 21 bp, Homo sapiens
atcttatgttgatcgatgtta

SEQ ID NO: 4276567 - DNA, 12 bp, Homo sapiens
atcttatttata

SEQ ID NO: 4276568 - DNA, 21 bp, Homo sapiens
atcttccaaatattagccaaa

SEQ ID NO: 4276569 - DNA, 11 bp, Homo sapiens
atcttccttcc

SEQ ID NO: 4276570 - DNA, 22 bp, Homo sapiens
atcttcgttagtaatctgtata

SEQ ID NO: 4276571 - DNA, 19 bp, Homo sapiens
atcttggccctgttaaggc

SEQ ID NO: 4276572 - DNA, 18 bp, Homo sapiens
atcttggtagtacatttt

SEQ ID NO: 4276573 - DNA, 21 bp, Homo sapiens
atctttaaagacttgatgaat

SEQ ID NO: 4276574 - DNA, 12 bp, Homo sapiens
atctttccaaat

SEQ ID NO: 4276575 - DNA, 21 bp, Homo sapiens
atgaaaaatagtgtgtccatg

SEQ ID NO: 4276576 - DNA, 18 bp, Homo sapiens
atgaaaaggtgattgtca

SEQ ID NO: 4276577 - DNA, 20 bp, Homo sapiens
atgaaaggtaatctgaaaca

SEQ ID NO: 4276578 - DNA, 17 bp, Homo sapiens
atgaaatatatgtgaaa

SEQ ID NO: 4276579 - DNA, 17 bp, Homo sapiens
atgaaatatttgcttat

SEQ ID NO: 4276580 - DNA, 22 bp, Homo sapiens
atgaacagttctcccttcaact

SEQ ID NO: 4276581 - DNA, 23 bp, Homo sapiens
atgaacagttctcccttcaactg

SEQ ID NO: 4276582 - DNA, 22 bp, Homo sapiens
atgaactagccatgactagggt

SEQ ID NO: 4276583 - DNA, 21 bp, Homo sapiens
atgaagaaaagtgggccagtg

SEQ ID NO: 4276584 - DNA, 16 bp, Homo sapiens
atgaagaagaaaacat

SEQ ID NO: 4276585 - DNA, 18 bp, Homo sapiens
atgaaggtgtcatacaga

SEQ ID NO: 4276586 - DNA, 17 bp, Homo sapiens
atgaataaagacaccta

SEQ ID NO: 4276587 - DNA, 13 bp, Homo sapiens
atgaataagtttt

SEQ ID NO: 4276588 - DNA, 18 bp, Homo sapiens
atgaataatgcctttgta

SEQ ID NO: 4276589 - DNA, 15 bp, Homo sapiens
atgaataattatgtt

SEQ ID NO: 4276590 - DNA, 20 bp, Homo sapiens
atgaatacgtaaactgcgta

SEQ ID NO: 4276591 - DNA, 13 bp, Homo sapiens
atgaatgctgacc

SEQ ID NO: 4276592 - DNA, 15 bp, Homo sapiens
atgacaagccccagg

SEQ ID NO: 4276593 - DNA, 18 bp, Homo sapiens
atgacaagccccaggcag

SEQ ID NO: 4276594 - DNA, 20 bp, Homo sapiens
atgacacaaataccagagca

SEQ ID NO: 4276595 - DNA, 22 bp, Homo sapiens
atgacactggaagggtccggct

SEQ ID NO: 4276596 - DNA, 12 bp, Homo sapiens
atgacagggagc

SEQ ID NO: 4276597 - DNA, 15 bp, Homo sapiens
atgacatttctcaaa

SEQ ID NO: 4276598 - DNA, 16 bp, Homo sapiens
atgaccaatctctgtg

SEQ ID NO: 4276599 - DNA, 21 bp, Homo sapiens
atgacctaaatccattttcta

SEQ ID NO: 4276600 - DNA, 19 bp, Homo sapiens
atgacctccttagaaaaga

SEQ ID NO: 4276601 - DNA, 14 bp, Homo sapiens
atgactataaacat

SEQ ID NO: 4276602 - DNA, 18 bp, Homo sapiens
atgactctttattgtctg

SEQ ID NO: 4276603 - DNA, 22 bp, Homo sapiens
atgactggatacagaatgaatc

SEQ ID NO: 4276604 - DNA, 15 bp, Homo sapiens
atgagatactttgca

SEQ ID NO: 4276605 - DNA, 13 bp, Homo sapiens
atgagctccagac

SEQ ID NO: 4276606 - DNA, 15 bp, Homo sapiens
atgagctccagaccc

SEQ ID NO: 4276607 - DNA, 16 bp, Homo sapiens
atgagctccagacccc

SEQ ID NO: 4276608 - DNA, 22 bp, Homo sapiens
atgagctccagacccccagcaa

SEQ ID NO: 4276609 - DNA, 17 bp, Homo sapiens
atgagtttaaaaaaata

SEQ ID NO: 4276610 - DNA, 21 bp, Homo sapiens
atgagtttaaaaaaataacat

SEQ ID NO: 4276611 - DNA, 17 bp, Homo sapiens
atgatactgtctaagaa

SEQ ID NO: 4276612 - DNA, 22 bp, Homo sapiens
atgatactgtctaagaataatg

SEQ ID NO: 4276613 - DNA, 20 bp, Homo sapiens
atgatcgttctgggtcagct

SEQ ID NO: 4276614 - DNA, 22 bp, Homo sapiens
atgatggaagggccttctccac

SEQ ID NO: 4276615 - DNA, 16 bp, Homo sapiens
atgatgggaaagtgga

SEQ ID NO: 4276616 - DNA, 13 bp, Homo sapiens
atgattcatttta

SEQ ID NO: 4276617 - DNA, 14 bp, Homo sapiens
atgattccaaataa

SEQ ID NO: 4276618 - DNA, 20 bp, Homo sapiens
atgattgtttaattgtaggt

SEQ ID NO: 4276619 - DNA, 17 bp, Homo sapiens
atgatttaagcatttta

SEQ ID NO: 4276620 - DNA, 21 bp, Homo sapiens
atgatttaagcattttactgt

SEQ ID NO: 4276621 - DNA, 20 bp, Homo sapiens
atgatttcaatgattgttta

SEQ ID NO: 4276622 - DNA, 15 bp, Homo sapiens
atgatttcagaaaca

SEQ ID NO: 4276623 - DNA, 15 bp, Homo sapiens
atgatttgcaacttt

SEQ ID NO: 4276624 - DNA, 15 bp, Homo sapiens
atgcaagaagaatat

SEQ ID NO: 4276625 - DNA, 22 bp, Homo sapiens
atgcaagaagaatataaataaa

SEQ ID NO: 4276626 - DNA, 16 bp, Homo sapiens
atgcacctataaatac

SEQ ID NO: 4276627 - DNA, 18 bp, Homo sapiens
atgcagatctagccaggc

SEQ ID NO: 4276628 - DNA, 20 bp, Homo sapiens
atgcagatctagccaggcct

SEQ ID NO: 4276629 - DNA, 13 bp, Homo sapiens
atgcagcttcagg

SEQ ID NO: 4276630 - DNA, 18 bp, Homo sapiens
atgcagggcccccacagg

SEQ ID NO: 4276631 - DNA, 13 bp, Homo sapiens
atgccacctgcag

SEQ ID NO: 4276632 - DNA, 22 bp, Homo sapiens
atgccacggcagccaccctgcc

SEQ ID NO: 4276633 - DNA, 16 bp, Homo sapiens
atgccactaggccctg

SEQ ID NO: 4276634 - DNA, 20 bp, Homo sapiens
atgccagtccagatgtgcct

SEQ ID NO: 4276635 - DNA, 21 bp, Homo sapiens
atgccagtgactgctgcgctg

SEQ ID NO: 4276636 - DNA, 23 bp, Homo sapiens
atgccattgacaaggtgtttctc

SEQ ID NO: 4276637 - DNA, 17 bp, Homo sapiens
atgccccactctgctga

SEQ ID NO: 4276638 - DNA, 22 bp, Homo sapiens
atgccccactctgctgaggcca

SEQ ID NO: 4276639 - DNA, 14 bp, Homo sapiens
atgcccctccccag

SEQ ID NO: 4276640 - DNA, 17 bp, Homo sapiens
atgcccctccccagtag

SEQ ID NO: 4276641 - DNA, 19 bp, Homo sapiens
atgccctccctgctgccag

SEQ ID NO: 4276642 - DNA, 16 bp, Homo sapiens
atgcctaggccagctc

SEQ ID NO: 4276643 - DNA, 14 bp, Homo sapiens
caagaagattctaa

SEQ ID NO: 4276644 - DNA, 13 bp, Homo sapiens
caagacaatgaca

SEQ ID NO: 4276645 - DNA, 21 bp, Homo sapiens
caagacacccagtggaaccaa

SEQ ID NO: 4276646 - DNA, 17 bp, Homo sapiens
caagacagcagagccat

SEQ ID NO: 4276647 - DNA, 15 bp, Homo sapiens
caagagctcaggaga

SEQ ID NO: 4276648 - DNA, 22 bp, Homo sapiens
caagagctcaggagaaggcctg

SEQ ID NO: 4276649 - DNA, 13 bp, Homo sapiens
caagaggagcagg

SEQ ID NO: 4276650 - DNA, 18 bp, Homo sapiens
caagaggagcaggaagca

SEQ ID NO: 4276651 - DNA, 22 bp, Homo sapiens
caagaggagcaggaagcaaggc

SEQ ID NO: 4276652 - DNA, 22 bp, Homo sapiens
caagaggagttctaacacattt

SEQ ID NO: 4276653 - DNA, 13 bp, Homo sapiens
caagagggcactg

SEQ ID NO: 4276654 - DNA, 14 bp, Homo sapiens
caagagggcactgg

SEQ ID NO: 4276655 - DNA, 20 bp, Homo sapiens
caagagggcactggtggccc

SEQ ID NO: 4276656 - DNA, 13 bp, Homo sapiens
caagatcccattt

SEQ ID NO: 4276657 - DNA, 15 bp, Homo sapiens
caagatcccatttga

SEQ ID NO: 4276658 - DNA, 23 bp, Homo sapiens
caagattctgtgggcagctggct

SEQ ID NO: 4276659 - DNA, 23 bp, Homo sapiens
caagatttccctaaaaattccac

SEQ ID NO: 4276660 - DNA, 21 bp, Homo sapiens
caagcacctgggtgtgctcca

SEQ ID NO: 4276661 - DNA, 23 bp, Homo sapiens
caagcacctgggtgtgctccagg

SEQ ID NO: 4276662 - DNA, 18 bp, Homo sapiens
caagcagagtgcacagct

SEQ ID NO: 4276663 - DNA, 20 bp, Homo sapiens
caagcagagtgcacagctgt

SEQ ID NO: 4276664 - DNA, 21 bp, Homo sapiens
caagcagagtgcacagctgtc

SEQ ID NO: 4276665 - DNA, 21 bp, Homo sapiens
caagccaaacattcttatttt

SEQ ID NO: 4276666 - DNA, 17 bp, Homo sapiens
caagccacgcctgcgat

SEQ ID NO: 4276667 - DNA, 14 bp, Homo sapiens
caagccaggagacc

SEQ ID NO: 4276668 - DNA, 20 bp, Homo sapiens
caagccaggagaccctgtct

SEQ ID NO: 4276669 - DNA, 12 bp, Homo sapiens
caagcccaggac

SEQ ID NO: 4276670 - DNA, 17 bp, Homo sapiens
caagccccaggcaggct

SEQ ID NO: 4276671 - DNA, 18 bp, Homo sapiens
caagccccaggcaggctg

SEQ ID NO: 4276672 - DNA, 12 bp, Homo sapiens
caagcctcagcc

SEQ ID NO: 4276673 - DNA, 22 bp, Homo sapiens
caagcctcagccactcccaggg

SEQ ID NO: 4276674 - DNA, 23 bp, Homo sapiens
caagcctgccccggccactctgt

SEQ ID NO: 4276675 - DNA, 10 bp, Homo sapiens
caagcctgga

SEQ ID NO: 4276676 - DNA, 12 bp, Homo sapiens
caagcctggagg

SEQ ID NO: 4276677 - DNA, 13 bp, Homo sapiens
caagcctggagga

SEQ ID NO: 4276678 - DNA, 11 bp, Homo sapiens
caagcctggcc

SEQ ID NO: 4276679 - DNA, 12 bp, Homo sapiens
caagctggcagg

SEQ ID NO: 4276680 - DNA, 20 bp, Homo sapiens
caagctgtacaaagggaagc

SEQ ID NO: 4276681 - DNA, 16 bp, Homo sapiens
caagcttagaagccac

SEQ ID NO: 4276682 - DNA, 17 bp, Homo sapiens
caaggaagggatgtatt

SEQ ID NO: 4276683 - DNA, 20 bp, Homo sapiens
caaggaagggatgtatttgt

SEQ ID NO: 4276684 - DNA, 22 bp, Homo sapiens
caaggaatgaattttttcctac

SEQ ID NO: 4276685 - DNA, 13 bp, Homo sapiens
caaggacccctca

SEQ ID NO: 4276686 - DNA, 14 bp, Homo sapiens
caaggacccctcac

SEQ ID NO: 4276687 - DNA, 16 bp, Homo sapiens
caaggagtgcccgcct

SEQ ID NO: 4276688 - DNA, 14 bp, Homo sapiens
caaggcaaatgtcc

SEQ ID NO: 4276689 - DNA, 18 bp, Homo sapiens
caaggcaaatgtccaagc

SEQ ID NO: 4276690 - DNA, 20 bp, Homo sapiens
caaggcaaatgtccaagcat

SEQ ID NO: 4276691 - DNA, 12 bp, Homo sapiens
caaggccccaga

SEQ ID NO: 4276692 - DNA, 14 bp, Homo sapiens
caaggccccagaga

SEQ ID NO: 4276693 - DNA, 21 bp, Homo sapiens
caaggccccagagactcagag

SEQ ID NO: 4276694 - DNA, 21 bp, Homo sapiens
caaggcctatgccacctgcag

SEQ ID NO: 4276695 - DNA, 22 bp, Homo sapiens
caaggcctatgccacctgcagc

SEQ ID NO: 4276696 - DNA, 14 bp, Homo sapiens
caaggctgaaaagt

SEQ ID NO: 4276697 - DNA, 13 bp, Homo sapiens
caaggctgcctgc

SEQ ID NO: 4276698 - DNA, 15 bp, Homo sapiens
caagggcccagaggg

SEQ ID NO: 4276699 - DNA, 22 bp, Homo sapiens
caagggcttacacgtggaggaa

SEQ ID NO: 4276700 - DNA, 17 bp, Homo sapiens
caaggggtctgctcctg

SEQ ID NO: 4276701 - DNA, 21 bp, Homo sapiens
caaggtggtcttggagaggag

SEQ ID NO: 4276702 - DNA, 14 bp, Homo sapiens
caagtataaacttt

SEQ ID NO: 4276703 - DNA, 20 bp, Homo sapiens
caagtatatttatttctagc

SEQ ID NO: 4276704 - DNA, 24 bp, Homo sapiens
caagtattactaaattgaccttta

SEQ ID NO: 4276705 - DNA, 19 bp, Homo sapiens
caagtcagctttgccttcc

SEQ ID NO: 4276706 - DNA, 16 bp, Homo sapiens
caagtcccgaggcagc

SEQ ID NO: 4276707 - DNA, 21 bp, Homo sapiens
caagtcccgaggcagcaacag

SEQ ID NO: 4276708 - DNA, 23 bp, Homo sapiens
caagtcccgaggcagcaacagga

SEQ ID NO: 4276709 - DNA, 19 bp, Homo sapiens
caagtgattgaaaatagta

SEQ ID NO: 4276710 - DNA, 16 bp, Homo sapiens
caagtgcaatccatgt

SEQ ID NO: 4276711 - DNA, 23 bp, Homo sapiens
caagtgcaatccatgtatctgta

SEQ ID NO: 4276712 - DNA, 14 bp, Homo sapiens
caagtgcaggctgg

SEQ ID NO: 4276713 - DNA, 20 bp, Homo sapiens
caagtgcaggctggcaccgc

SEQ ID NO: 4276714 - DNA, 17 bp, Homo sapiens
caagtgcatttctgggc

SEQ ID NO: 4276715 - DNA, 17 bp, Homo sapiens
caagtggttaagaatgt

SEQ ID NO: 4276716 - DNA, 11 bp, Homo sapiens
caagtgtcctg

SEQ ID NO: 4276717 - DNA, 18 bp, Homo sapiens
caataaacgaaacacaga

SEQ ID NO: 4276718 - DNA, 16 bp, Homo sapiens
caataaactcagtcaa

SEQ ID NO: 4276719 - DNA, 14 bp, Homo sapiens
caatacattaaaat

SEQ ID NO: 4276720 - DNA, 16 bp, Homo sapiens
caatacattaaaataa

SEQ ID NO: 4276721 - DNA, 18 bp, Homo sapiens
caatatcattttcctggg

SEQ ID NO: 4276722 - DNA, 20 bp, Homo sapiens
caatatcattttcctgggag

SEQ ID NO: 4276723 - DNA, 19 bp, Homo sapiens
caatatgaggggactgcat

SEQ ID NO: 4276724 - DNA, 23 bp, Homo sapiens
caatatgtaacatgtctaaagtt

SEQ ID NO: 4276725 - DNA, 13 bp, Homo sapiens
caatcaaacaggg

SEQ ID NO: 4276726 - DNA, 14 bp, Homo sapiens
caatcaaactttca

SEQ ID NO: 4276727 - DNA, 22 bp, Homo sapiens
caatcaaactttcagctttttt

SEQ ID NO: 4276728 - DNA, 22 bp, Homo sapiens
caatcaacagcatgtctactgc

SEQ ID NO: 4276729 - DNA, 19 bp, Homo sapiens
caatcacgagatcttcctt

SEQ ID NO: 4276730 - DNA, 21 bp, Homo sapiens
caatcacgagatcttccttcc

SEQ ID NO: 4276731 - DNA, 23 bp, Homo sapiens
caatcccaccaaccctcagagcc

SEQ ID NO: 4276732 - DNA, 14 bp, Homo sapiens
caatctctgtgact

SEQ ID NO: 4276733 - DNA, 15 bp, Homo sapiens
caatctctgtgactc

SEQ ID NO: 4276734 - DNA, 23 bp, Homo sapiens
caatgaaatatttgcttatttat

SEQ ID NO: 4276735 - DNA, 20 bp, Homo sapiens
caatgacactggaagggtcc

SEQ ID NO: 4276736 - DNA, 15 bp, Homo sapiens
caatgattcataaca

SEQ ID NO: 4276737 - DNA, 19 bp, Homo sapiens
caatgattcataacaatgt

SEQ ID NO: 4276738 - DNA, 21 bp, Homo sapiens
caatgctagcacaatattcct

SEQ ID NO: 4276739 - DNA, 15 bp, Homo sapiens
caatggccagcccag

SEQ ID NO: 4276740 - DNA, 16 bp, Homo sapiens
caatggccagcccaga

SEQ ID NO: 4276741 - DNA, 18 bp, Homo sapiens
caatggccagcccagatg

SEQ ID NO: 4276742 - DNA, 20 bp, Homo sapiens
caatggccagcccagatggc

SEQ ID NO: 4276743 - DNA, 16 bp, Homo sapiens
caatggcgcagtgcct

SEQ ID NO: 4276744 - DNA, 21 bp, Homo sapiens
caatggctgggtttgggcagt

SEQ ID NO: 4276745 - DNA, 18 bp, Homo sapiens
caatgtaattaaactgtt

SEQ ID NO: 4276746 - DNA, 18 bp, Homo sapiens
caatgtggaaaaaatatt

SEQ ID NO: 4276747 - DNA, 22 bp, Homo sapiens
caatgtggaaaaaatattttaa

SEQ ID NO: 4276748 - DNA, 12 bp, Homo sapiens
caatgtttcaag

SEQ ID NO: 4276749 - DNA, 19 bp, Homo sapiens
caattaactccgtttccaa

SEQ ID NO: 4276750 - DNA, 15 bp, Homo sapiens
caattagatttctca

SEQ ID NO: 4276751 - DNA, 14 bp, Homo sapiens
caattctgtccctg

SEQ ID NO: 4276752 - DNA, 17 bp, Homo sapiens
caattctgtccctgtcc

SEQ ID NO: 4276753 - DNA, 14 bp, Homo sapiens
caattgtcatttat

SEQ ID NO: 4276754 - DNA, 15 bp, Homo sapiens
caattgtcatttata

SEQ ID NO: 4276755 - DNA, 19 bp, Homo sapiens
caatttcaaaatgcatgtg

SEQ ID NO: 4276756 - DNA, 14 bp, Homo sapiens
caattttaaaaaat

SEQ ID NO: 4276757 - DNA, 18 bp, Homo sapiens
caattttaaaaaataaca

SEQ ID NO: 4276758 - DNA, 16 bp, Homo sapiens
cacaaatgtcctcaga

SEQ ID NO: 4276759 - DNA, 17 bp, Homo sapiens
cacaaatgtcctcagag

SEQ ID NO: 4276760 - DNA, 23 bp, Homo sapiens
cacaaccttctgtggctcacaga

SEQ ID NO: 4276761 - DNA, 20 bp, Homo sapiens
cacaaggagtgcccgccttg

SEQ ID NO: 4276762 - DNA, 16 bp, Homo sapiens
cacaaggctgaaaagt

SEQ ID NO: 4276763 - DNA, 20 bp, Homo sapiens
cacaaggctgaaaagtgctt

SEQ ID NO: 4276764 - DNA, 21 bp, Homo sapiens
cacaaggctgaaaagtgcttt

SEQ ID NO: 4276765 - DNA, 19 bp, Homo sapiens
cacaataaaagacatccac

SEQ ID NO: 4276766 - DNA, 15 bp, Homo sapiens
cacaataattttcta

SEQ ID NO: 4276767 - DNA, 17 bp, Homo sapiens
cacaattctgtccctgt

SEQ ID NO: 4276768 - DNA, 20 bp, Homo sapiens
cacaattctgtccctgtccc

SEQ ID NO: 4276769 - DNA, 12 bp, Homo sapiens
cacacaagacag

SEQ ID NO: 4276770 - DNA, 15 bp, Homo sapiens
cacacacacacacag

SEQ ID NO: 4276771 - DNA, 16 bp, Homo sapiens
cacacacacacaggag

SEQ ID NO: 4276772 - DNA, 12 bp, Homo sapiens
cacacacacagg

SEQ ID NO: 4276773 - DNA, 17 bp, Homo sapiens
caggccacctgccccct

SEQ ID NO: 4276774 - DNA, 21 bp, Homo sapiens
caggccacctgcccccttctc

SEQ ID NO: 4276775 - DNA, 12 bp, Homo sapiens
caggccagaaaa

SEQ ID NO: 4276776 - DNA, 12 bp, Homo sapiens
caggcccacatt

SEQ ID NO: 4276777 - DNA, 17 bp, Homo sapiens
caggcccagcctggccc

SEQ ID NO: 4276778 - DNA, 19 bp, Homo sapiens
caggcccagcctggcccca

SEQ ID NO: 4276779 - DNA, 13 bp, Homo sapiens
caggccccaggct

SEQ ID NO: 4276780 - DNA, 14 bp, Homo sapiens
caggccccaggctg

SEQ ID NO: 4276781 - DNA, 17 bp, Homo sapiens
caggccccaggctggat

SEQ ID NO: 4276782 - DNA, 14 bp, Homo sapiens
caggcccctttgga

SEQ ID NO: 4276783 - DNA, 21 bp, Homo sapiens
caggcccctttggacctgcag

SEQ ID NO: 4276784 - DNA, 16 bp, Homo sapiens
caggcccttcctctcc

SEQ ID NO: 4276785 - DNA, 18 bp, Homo sapiens
caggcctcacctggcttc

SEQ ID NO: 4276786 - DNA, 23 bp, Homo sapiens
caggcctcacctggcttcccagg

SEQ ID NO: 4276787 - DNA, 13 bp, Homo sapiens
caggcctcaggga

SEQ ID NO: 4276788 - DNA, 22 bp, Homo sapiens
caggcctcccaaatatgcccct

SEQ ID NO: 4276789 - DNA, 16 bp, Homo sapiens
caggcctggcccagcc

SEQ ID NO: 4276790 - DNA, 20 bp, Homo sapiens
caggcctggcccagccagca

SEQ ID NO: 4276791 - DNA, 21 bp, Homo sapiens
caggcctggcccagccagcag

SEQ ID NO: 4276792 - DNA, 23 bp, Homo sapiens
caggcctggcccagccagcaggt

SEQ ID NO: 4276793 - DNA, 13 bp, Homo sapiens
caggcctggccct

SEQ ID NO: 4276794 - DNA, 18 bp, Homo sapiens
caggcctttttgagccaa

SEQ ID NO: 4276795 - DNA, 17 bp, Homo sapiens
caggcgccccttccccc

SEQ ID NO: 4276796 - DNA, 15 bp, Homo sapiens
caggcgtagggccag

SEQ ID NO: 4276797 - DNA, 16 bp, Homo sapiens
caggcgtagggccagg

SEQ ID NO: 4276798 - DNA, 17 bp, Homo sapiens
caggcgtagggccaggg

SEQ ID NO: 4276799 - DNA, 16 bp, Homo sapiens
caggcgttctcagcct

SEQ ID NO: 4276800 - DNA, 15 bp, Homo sapiens
caggctcccactgcc

SEQ ID NO: 4276801 - DNA, 12 bp, Homo sapiens
caggctcttctc

SEQ ID NO: 4276802 - DNA, 15 bp, Homo sapiens
caggctcttctcctt

SEQ ID NO: 4276803 - DNA, 22 bp, Homo sapiens
caggctcttctcctttcacaac

SEQ ID NO: 4276804 - DNA, 11 bp, Homo sapiens
caggctgcccc

SEQ ID NO: 4276805 - DNA, 15 bp, Homo sapiens
caggctgccccaccc

SEQ ID NO: 4276806 - DNA, 15 bp, Homo sapiens
caggctggatgctgg

SEQ ID NO: 4276807 - DNA, 20 bp, Homo sapiens
caggctggcaccgccttctc

SEQ ID NO: 4276808 - DNA, 20 bp, Homo sapiens
caggcttcctgccctagcag

SEQ ID NO: 4276809 - DNA, 15 bp, Homo sapiens
caggcttgcattaaa

SEQ ID NO: 4276810 - DNA, 17 bp, Homo sapiens
caggcttgcattaaaag

SEQ ID NO: 4276811 - DNA, 15 bp, Homo sapiens
caggctttttccata

SEQ ID NO: 4276812 - DNA, 21 bp, Homo sapiens
cagggaatcagggagcactgg

SEQ ID NO: 4276813 - DNA, 13 bp, Homo sapiens
cagggaccaagat

SEQ ID NO: 4276814 - DNA, 18 bp, Homo sapiens
cagggaccaaggacccct

SEQ ID NO: 4276815 - DNA, 14 bp, Homo sapiens
cagggaccaaggag

SEQ ID NO: 4276816 - DNA, 19 bp, Homo sapiens
cagggaccaaggagatggg

SEQ ID NO: 4276817 - DNA, 13 bp, Homo sapiens
cagggagaccctg

SEQ ID NO: 4276818 - DNA, 19 bp, Homo sapiens
cagggagcactggaggcct

SEQ ID NO: 4276819 - DNA, 14 bp, Homo sapiens
cagggagctgggga

SEQ ID NO: 4276820 - DNA, 20 bp, Homo sapiens
cagggagggaaacccgggga

SEQ ID NO: 4276821 - DNA, 15 bp, Homo sapiens
cagggcagcctgtgg

SEQ ID NO: 4276822 - DNA, 20 bp, Homo sapiens
cagggcagcctgtgggagaa

SEQ ID NO: 4276823 - DNA, 16 bp, Homo sapiens
cagggccagtcatggc

SEQ ID NO: 4276824 - DNA, 23 bp, Homo sapiens
cagggcccctgaagtgaccccag

SEQ ID NO: 4276825 - DNA, 17 bp, Homo sapiens
cagggccctgctcaggc

SEQ ID NO: 4276826 - DNA, 21 bp, Homo sapiens
cagggccctgctcaggcctca

SEQ ID NO: 4276827 - DNA, 13 bp, Homo sapiens
cagggcgggccag

SEQ ID NO: 4276828 - DNA, 14 bp, Homo sapiens
cagggcgggccagg

SEQ ID NO: 4276829 - DNA, 15 bp, Homo sapiens
cagggcgggccagga

SEQ ID NO: 4276830 - DNA, 16 bp, Homo sapiens
cagggcggggctggcc

SEQ ID NO: 4276831 - DNA, 20 bp, Homo sapiens
cagggcggggctggccagct

SEQ ID NO: 4276832 - DNA, 21 bp, Homo sapiens
cagggctccacgggggcctag

SEQ ID NO: 4276833 - DNA, 23 bp, Homo sapiens
cagggctccacgggggcctagtg

SEQ ID NO: 4276834 - DNA, 15 bp, Homo sapiens
cagggctctggcagg

SEQ ID NO: 4276835 - DNA, 18 bp, Homo sapiens
cagggctctggcaggtgg

SEQ ID NO: 4276836 - DNA, 21 bp, Homo sapiens
cagggctctggcaggtggcca

SEQ ID NO: 4276837 - DNA, 12 bp, Homo sapiens
cagggctggatt

SEQ ID NO: 4276838 - DNA, 20 bp, Homo sapiens
cagggctggattggcaggtg

SEQ ID NO: 4276839 - DNA, 14 bp, Homo sapiens
cagggcttctcttt

SEQ ID NO: 4276840 - DNA, 22 bp, Homo sapiens
caggggagacttaggccagagg

SEQ ID NO: 4276841 - DNA, 20 bp, Homo sapiens
caggggcacacttccccttg

SEQ ID NO: 4276842 - DNA, 13 bp, Homo sapiens
caggggcagaagg

SEQ ID NO: 4276843 - DNA, 14 bp, Homo sapiens
caggggcagaagga

SEQ ID NO: 4276844 - DNA, 18 bp, Homo sapiens
caggggcagaaggaggaa

SEQ ID NO: 4276845 - DNA, 19 bp, Homo sapiens
caggggcagaaggaggaag

SEQ ID NO: 4276846 - DNA, 20 bp, Homo sapiens
caggggccgcttcgccatgt

SEQ ID NO: 4276847 - DNA, 16 bp, Homo sapiens
caggggcggtccagag

SEQ ID NO: 4276848 - DNA, 14 bp, Homo sapiens
caggggctgcatcc

SEQ ID NO: 4276849 - DNA, 16 bp, Homo sapiens
caggggctgcatcctc

SEQ ID NO: 4276850 - DNA, 20 bp, Homo sapiens
caggggctgcatcctcagcc

SEQ ID NO: 4276851 - DNA, 16 bp, Homo sapiens
caggggctgggcagag

SEQ ID NO: 4276852 - DNA, 20 bp, Homo sapiens
cagggggaagcaccagcctc

SEQ ID NO: 4276853 - DNA, 21 bp, Homo sapiens
cagggggaagcaccagcctca

SEQ ID NO: 4276854 - DNA, 23 bp, Homo sapiens
cagggggaagcaccagcctcagt

SEQ ID NO: 4276855 - DNA, 15 bp, Homo sapiens
caggggtgagccccg

SEQ ID NO: 4276856 - DNA, 20 bp, Homo sapiens
caggggttccccaggagaga

SEQ ID NO: 4276857 - DNA, 21 bp, Homo sapiens
cagggtcctgggggctgctgc

SEQ ID NO: 4276858 - DNA, 17 bp, Homo sapiens
cagggtctcgtcaggag

SEQ ID NO: 4276859 - DNA, 19 bp, Homo sapiens
cagggtctcgtcaggaggt

SEQ ID NO: 4276860 - DNA, 16 bp, Homo sapiens
cagggtgacccctcat

SEQ ID NO: 4276861 - DNA, 19 bp, Homo sapiens
cagggtgacccctcatctg

SEQ ID NO: 4276862 - DNA, 20 bp, Homo sapiens
cagggtgctccctcctcagt

SEQ ID NO: 4276863 - DNA, 22 bp, Homo sapiens
cagggtggtcttcaagcctggc

SEQ ID NO: 4276864 - DNA, 21 bp, Homo sapiens
cagggttccagacagggtggg

SEQ ID NO: 4276865 - DNA, 15 bp, Homo sapiens
cagggttcccccagc

SEQ ID NO: 4276866 - DNA, 17 bp, Homo sapiens
cagggttcccccagccc

SEQ ID NO: 4276867 - DNA, 20 bp, Homo sapiens
cagggttcccccagccctgt

SEQ ID NO: 4276868 - DNA, 21 bp, Homo sapiens
cagggttcccccagccctgtg

SEQ ID NO: 4276869 - DNA, 17 bp, Homo sapiens
cagggttctagaagggg

SEQ ID NO: 4276870 - DNA, 18 bp, Homo sapiens
caggtcccgagccccctg

SEQ ID NO: 4276871 - DNA, 20 bp, Homo sapiens
caggtcccgagccccctgtc

SEQ ID NO: 4276872 - DNA, 14 bp, Homo sapiens
caggtctcctgggc

SEQ ID NO: 4276873 - DNA, 15 bp, Homo sapiens
caggtctcctgggca

SEQ ID NO: 4276874 - DNA, 21 bp, Homo sapiens
caggtctcctgggcatctggc

SEQ ID NO: 4276875 - DNA, 14 bp, Homo sapiens
caggtgagccaagg

SEQ ID NO: 4276876 - DNA, 15 bp, Homo sapiens
caggtggaacaggag

SEQ ID NO: 4276877 - DNA, 16 bp, Homo sapiens
caggtggaacaggagg

SEQ ID NO: 4276878 - DNA, 11 bp, Homo sapiens
caggtggaggc

SEQ ID NO: 4276879 - DNA, 19 bp, Homo sapiens
caggtggccactccagacc

SEQ ID NO: 4276880 - DNA, 12 bp, Homo sapiens
caggtggccagg

SEQ ID NO: 4276881 - DNA, 16 bp, Homo sapiens
caggtggccagggctc

SEQ ID NO: 4276882 - DNA, 17 bp, Homo sapiens
caggtggccagggctcc

SEQ ID NO: 4276883 - DNA, 17 bp, Homo sapiens
caggtgtgggctcccac

SEQ ID NO: 4276884 - DNA, 19 bp, Homo sapiens
caggtgtgggctcccacgc

SEQ ID NO: 4276885 - DNA, 22 bp, Homo sapiens
caggtgtgggctcccacgccct

SEQ ID NO: 4276886 - DNA, 23 bp, Homo sapiens
caggttgtctgaagtcactgcac

SEQ ID NO: 4276887 - DNA, 21 bp, Homo sapiens
caggtttaagtagatttcatg

SEQ ID NO: 4276888 - DNA, 16 bp, Homo sapiens
cagtaactcatctgtc

SEQ ID NO: 4276889 - DNA, 18 bp, Homo sapiens
cagtacacccaattttaa

SEQ ID NO: 4276890 - DNA, 22 bp, Homo sapiens
cagtacttgtgaaacacagctg

SEQ ID NO: 4276891 - DNA, 23 bp, Homo sapiens
cagtagaaggtcggaggcttggg

SEQ ID NO: 4276892 - DNA, 18 bp, Homo sapiens
cagtagctggagagagag

SEQ ID NO: 4276893 - DNA, 19 bp, Homo sapiens
cagtatattttatttcaat

SEQ ID NO: 4276894 - DNA, 20 bp, Homo sapiens
cagtatattttatttcaatg

SEQ ID NO: 4276895 - DNA, 20 bp, Homo sapiens
cagtattatagatataaata

SEQ ID NO: 4276896 - DNA, 22 bp, Homo sapiens
cagtatttttgttgtgttctgt

SEQ ID NO: 4276897 - DNA, 22 bp, Homo sapiens
cagtcaggaagcctcctgctga

SEQ ID NO: 4276898 - DNA, 22 bp, Homo sapiens
cagtcatggctgtcccctgcaa

SEQ ID NO: 4276899 - DNA, 21 bp, Homo sapiens
cagtccctccctcctggctca

SEQ ID NO: 4276900 - DNA, 17 bp, Homo sapiens
cagtcctagaatgtttc

SEQ ID NO: 4276901 - DNA, 18 bp, Homo sapiens
cagtcctagaatgtttca

SEQ ID NO: 4276902 - DNA, 22 bp, Homo sapiens
cattaaaaatgcatatacttta

SEQ ID NO: 4276903 - DNA, 23 bp, Homo sapiens
cattaagtattccttggcccagc

SEQ ID NO: 4276904 - DNA, 21 bp, Homo sapiens
cattaatccacatgtttcaga

SEQ ID NO: 4276905 - DNA, 13 bp, Homo sapiens
cattactgcatgc

SEQ ID NO: 4276906 - DNA, 16 bp, Homo sapiens
cattactgcatgcact

SEQ ID NO: 4276907 - DNA, 22 bp, Homo sapiens
cattagactgaatttaactact

SEQ ID NO: 4276908 - DNA, 22 bp, Homo sapiens
cattaggaacagagtatatatg

SEQ ID NO: 4276909 - DNA, 15 bp, Homo sapiens
cattatcctgtgtga

SEQ ID NO: 4276910 - DNA, 15 bp, Homo sapiens
cattatccttttatc

SEQ ID NO: 4276911 - DNA, 18 bp, Homo sapiens
cattcaaaatagttctat

SEQ ID NO: 4276912 - DNA, 14 bp, Homo sapiens
cattcaagattccc

SEQ ID NO: 4276913 - DNA, 20 bp, Homo sapiens
cattcacaacacaatcaaaa

SEQ ID NO: 4276914 - DNA, 12 bp, Homo sapiens
cattcacatttt

SEQ ID NO: 4276915 - DNA, 18 bp, Homo sapiens
cattcatacttaaaaatt

SEQ ID NO: 4276916 - DNA, 16 bp, Homo sapiens
cattccagagctgcag

SEQ ID NO: 4276917 - DNA, 17 bp, Homo sapiens
cattccagagctgcaga

SEQ ID NO: 4276918 - DNA, 18 bp, Homo sapiens
cattccagagctgcagaa

SEQ ID NO: 4276919 - DNA, 13 bp, Homo sapiens
cattccccatggg

SEQ ID NO: 4276920 - DNA, 18 bp, Homo sapiens
cattcccttctctcagcc

SEQ ID NO: 4276921 - DNA, 18 bp, Homo sapiens
cattcctcccattcaaga

SEQ ID NO: 4276922 - DNA, 15 bp, Homo sapiens
cattctatctactga

SEQ ID NO: 4276923 - DNA, 15 bp, Homo sapiens
cattctggctccacc

SEQ ID NO: 4276924 - DNA, 18 bp, Homo sapiens
cattctggggtggggctt

SEQ ID NO: 4276925 - DNA, 16 bp, Homo sapiens
cattctgggtgttttc

SEQ ID NO: 4276926 - DNA, 17 bp, Homo sapiens
cattcttaggctttcag

SEQ ID NO: 4276927 - DNA, 12 bp, Homo sapiens
cattcttcaaga

SEQ ID NO: 4276928 - DNA, 23 bp, Homo sapiens
cattcttttcagcttgtttctat

SEQ ID NO: 4276929 - DNA, 12 bp, Homo sapiens
cattgaaataat

SEQ ID NO: 4276930 - DNA, 16 bp, Homo sapiens
cattgaaataataata

SEQ ID NO: 4276931 - DNA, 17 bp, Homo sapiens
cattgaaataataatat

SEQ ID NO: 4276932 - DNA, 23 bp, Homo sapiens
cattgcataagtggacccagctg

SEQ ID NO: 4276933 - DNA, 20 bp, Homo sapiens
cattgcccacacctgcctct

SEQ ID NO: 4276934 - DNA, 15 bp, Homo sapiens
cattgccctgagggg

SEQ ID NO: 4276935 - DNA, 17 bp, Homo sapiens
cattgccctgaggggcc

SEQ ID NO: 4276936 - DNA, 13 bp, Homo sapiens
cattgccttctgg

SEQ ID NO: 4276937 - DNA, 15 bp, Homo sapiens
cattgccttctgggg

SEQ ID NO: 4276938 - DNA, 15 bp, Homo sapiens
cattgtctgtctgca

SEQ ID NO: 4276939 - DNA, 22 bp, Homo sapiens
catttaaaaaggtttaaaacta

SEQ ID NO: 4276940 - DNA, 21 bp, Homo sapiens
catttaaaatagttttctaaa

SEQ ID NO: 4276941 - DNA, 22 bp, Homo sapiens
catttaaaatagttttctaaat

SEQ ID NO: 4276942 - DNA, 14 bp, Homo sapiens
catttagtcctcac

SEQ ID NO: 4276943 - DNA, 17 bp, Homo sapiens
catttagtcctcacctt

SEQ ID NO: 4276944 - DNA, 18 bp, Homo sapiens
catttagtcctcaccttc

SEQ ID NO: 4276945 - DNA, 23 bp, Homo sapiens
catttatgagctcttcatgtttc

SEQ ID NO: 4276946 - DNA, 19 bp, Homo sapiens
catttcctcaggcaattcc

SEQ ID NO: 4276947 - DNA, 13 bp, Homo sapiens
catttcctgacag

SEQ ID NO: 4276948 - DNA, 20 bp, Homo sapiens
catttcttctctctgtgctg

SEQ ID NO: 4276949 - DNA, 22 bp, Homo sapiens
catttcttctctctgtgctggt

SEQ ID NO: 4276950 - DNA, 14 bp, Homo sapiens
catttcttgggccc

SEQ ID NO: 4276951 - DNA, 18 bp, Homo sapiens
catttcttgggccctcct

SEQ ID NO: 4276952 - DNA, 17 bp, Homo sapiens
catttcttggtatgatc

SEQ ID NO: 4276953 - DNA, 16 bp, Homo sapiens
catttggaaggaaagg

SEQ ID NO: 4276954 - DNA, 22 bp, Homo sapiens
catttgtaatgtatcttattta

SEQ ID NO: 4276955 - DNA, 13 bp, Homo sapiens
catttgttaatat

SEQ ID NO: 4276956 - DNA, 15 bp, Homo sapiens
cattttactgtctgt

SEQ ID NO: 4276957 - DNA, 12 bp, Homo sapiens
cattttcacctc

SEQ ID NO: 4276958 - DNA, 23 bp, Homo sapiens
cattttctaattctcttttcaaa

SEQ ID NO: 4276959 - DNA, 14 bp, Homo sapiens
cattttctgcatct

SEQ ID NO: 4276960 - DNA, 16 bp, Homo sapiens
cattttctgcatctcc

SEQ ID NO: 4276961 - DNA, 17 bp, Homo sapiens
cattttctgcatctcca

SEQ ID NO: 4276962 - DNA, 19 bp, Homo sapiens
cattttgcgatgtgtttta

SEQ ID NO: 4276963 - DNA, 14 bp, Homo sapiens
catttttacaagtt

SEQ ID NO: 4276964 - DNA, 12 bp, Homo sapiens
catttttcaata

SEQ ID NO: 4276965 - DNA, 21 bp, Homo sapiens
catttttcttggatctttttg

SEQ ID NO: 4276966 - DNA, 19 bp, Homo sapiens
ccaaaaacaataaacgaaa

SEQ ID NO: 4276967 - DNA, 15 bp, Homo sapiens
ccaaaagctgctttc

SEQ ID NO: 4276968 - DNA, 11 bp, Homo sapiens
ccaaaagtgtc

SEQ ID NO: 4276969 - DNA, 21 bp, Homo sapiens
ccaaaagtgtcaaggggccct

SEQ ID NO: 4276970 - DNA, 23 bp, Homo sapiens
ccaaaagtgtcaaggggccctag

SEQ ID NO: 4276971 - DNA, 17 bp, Homo sapiens
ccaaagcaagcacctgg

SEQ ID NO: 4276972 - DNA, 18 bp, Homo sapiens
ccaaagcaagcacctggg

SEQ ID NO: 4276973 - DNA, 15 bp, Homo sapiens
ccaaagccagacagc

SEQ ID NO: 4276974 - DNA, 17 bp, Homo sapiens
ccaaatcctgggcatcc

SEQ ID NO: 4276975 - DNA, 21 bp, Homo sapiens
ccaaattttccttcctgttct

SEQ ID NO: 4276976 - DNA, 12 bp, Homo sapiens
ccaacaccaggg

SEQ ID NO: 4276977 - DNA, 16 bp, Homo sapiens
ccaacccatgcatggc

SEQ ID NO: 4276978 - DNA, 17 bp, Homo sapiens
ccaacccatgcatggcc

SEQ ID NO: 4276979 - DNA, 23 bp, Homo sapiens
ccaacccatgcatggcctcccag

SEQ ID NO: 4276980 - DNA, 19 bp, Homo sapiens
ccaaccccagcagtcctgg

SEQ ID NO: 4276981 - DNA, 22 bp, Homo sapiens
ccaaccccagcagtcctgggcc

SEQ ID NO: 4276982 - DNA, 14 bp, Homo sapiens
ccaaccccggggca

SEQ ID NO: 4276983 - DNA, 14 bp, Homo sapiens
ccaaccctcagagc

SEQ ID NO: 4276984 - DNA, 15 bp, Homo sapiens
ccaaccctgcccctg

SEQ ID NO: 4276985 - DNA, 21 bp, Homo sapiens
ccaacctcccctggtcctgca

SEQ ID NO: 4276986 - DNA, 24 bp, Homo sapiens
ccaacctcccctggtcctgcactg

SEQ ID NO: 4276987 - DNA, 14 bp, Homo sapiens
ccaacgaaaagcac

SEQ ID NO: 4276988 - DNA, 14 bp, Homo sapiens
ccaactctctctgc

SEQ ID NO: 4276989 - DNA, 17 bp, Homo sapiens
ccaactctctctgcccc

SEQ ID NO: 4276990 - DNA, 17 bp, Homo sapiens
ccaactctggccttggt

SEQ ID NO: 4276991 - DNA, 18 bp, Homo sapiens
ccaactctggccttggtt

SEQ ID NO: 4276992 - DNA, 19 bp, Homo sapiens
ccaagaatagatgctgact

SEQ ID NO: 4276993 - DNA, 17 bp, Homo sapiens
ccaagatgtcaagctgg

SEQ ID NO: 4276994 - DNA, 24 bp, Homo sapiens
ccaagatgtcaagctggccgtgga

SEQ ID NO: 4276995 - DNA, 19 bp, Homo sapiens
ccaagccagggttccagac

SEQ ID NO: 4276996 - DNA, 20 bp, Homo sapiens
ccaagccagggttccagaca

SEQ ID NO: 4276997 - DNA, 23 bp, Homo sapiens
ccaagccagggttccagacaggg

SEQ ID NO: 4276998 - DNA, 14 bp, Homo sapiens
ccaagccgtggctt

SEQ ID NO: 4276999 - DNA, 17 bp, Homo sapiens
ccaagccgtggcttccc

SEQ ID NO: 4277000 - DNA, 15 bp, Homo sapiens
ccaagcctgccccgg

SEQ ID NO: 4277001 - DNA, 17 bp, Homo sapiens
ccaagcctgggccactg

SEQ ID NO: 4277002 - DNA, 23 bp, Homo sapiens
ccaagcctgggccactggcatct

SEQ ID NO: 4277003 - DNA, 16 bp, Homo sapiens
ccaaggacccctcacc

SEQ ID NO: 4277004 - DNA, 18 bp, Homo sapiens
ccaaggacccctcacctt

SEQ ID NO: 4277005 - DNA, 13 bp, Homo sapiens
ccaaggactgccg

SEQ ID NO: 4277006 - DNA, 13 bp, Homo sapiens
ccaaggcaaatgt

SEQ ID NO: 4277007 - DNA, 21 bp, Homo sapiens
ccaaggcaaatgtccaagcat

SEQ ID NO: 4277008 - DNA, 14 bp, Homo sapiens
ccaaggcgtgcagg

SEQ ID NO: 4277009 - DNA, 14 bp, Homo sapiens
ccaaggctgcctgc

SEQ ID NO: 4277010 - DNA, 13 bp, Homo sapiens
ccaagggcccaga

SEQ ID NO: 4277011 - DNA, 14 bp, Homo sapiens
ccaagggcccagag

SEQ ID NO: 4277012 - DNA, 17 bp, Homo sapiens
ccaaggggtctgctcct

SEQ ID NO: 4277013 - DNA, 18 bp, Homo sapiens
ccaaggggtctgctcctg

SEQ ID NO: 4277014 - DNA, 22 bp, Homo sapiens
ccaaggggtctgctcctgtggc

SEQ ID NO: 4277015 - DNA, 18 bp, Homo sapiens
ccaaggtggtcttggaga

SEQ ID NO: 4277016 - DNA, 21 bp, Homo sapiens
ccaaggtggtcttggagagga

SEQ ID NO: 4277017 - DNA, 19 bp, Homo sapiens
ccaagtgcaggctggcacc

SEQ ID NO: 4277018 - DNA, 13 bp, Homo sapiens
ccaagtgtcctgc

SEQ ID NO: 4277019 - DNA, 22 bp, Homo sapiens
ccaatcacgagatcttccttcc

SEQ ID NO: 4277020 - DNA, 13 bp, Homo sapiens
ccaatctctgtga

SEQ ID NO: 4277021 - DNA, 17 bp, Homo sapiens
ccaattttaaaaaataa

SEQ ID NO: 4277022 - DNA, 18 bp, Homo sapiens
ccacaaaatatttctaag

SEQ ID NO: 4277023 - DNA, 14 bp, Homo sapiens
ccacaaatgtcctc

SEQ ID NO: 4277024 - DNA, 16 bp, Homo sapiens
ccacaaatgtcctcag

SEQ ID NO: 4277025 - DNA, 18 bp, Homo sapiens
ccacaaatgtcctcagag

SEQ ID NO: 4277026 - DNA, 17 bp, Homo sapiens
ccacacaagacagcaga

SEQ ID NO: 4277027 - DNA, 15 bp, Homo sapiens
ccacacacacccttc

SEQ ID NO: 4277028 - DNA, 13 bp, Homo sapiens
ccacacaggccca

SEQ ID NO: 4277029 - DNA, 16 bp, Homo sapiens
ccacacaggcctggcc

SEQ ID NO: 4277030 - DNA, 20 bp, Homo sapiens
ccacacaggcctggcccagc

SEQ ID NO: 4277031 - DNA, 21 bp, Homo sapiens
ccacacaggcctggcccagcc

SEQ ID NO: 4277032 - DNA, 13 bp, Homo sapiens
ccccttccccact

SEQ ID NO: 4277033 - DNA, 12 bp, Homo sapiens
ccccttccccct

SEQ ID NO: 4277034 - DNA, 13 bp, Homo sapiens
ccccttccctgca

SEQ ID NO: 4277035 - DNA, 15 bp, Homo sapiens
ccccttgctgctggc

SEQ ID NO: 4277036 - DNA, 22 bp, Homo sapiens
ccccttgggatgggcacaggct

SEQ ID NO: 4277037 - DNA, 14 bp, Homo sapiens
cccctttcacctgg

SEQ ID NO: 4277038 - DNA, 15 bp, Homo sapiens
cccctttggacctgc

SEQ ID NO: 4277039 - DNA, 22 bp, Homo sapiens
cccgaatggagtccagacctgg

SEQ ID NO: 4277040 - DNA, 23 bp, Homo sapiens
cccgacatggacccggagctaac

SEQ ID NO: 4277041 - DNA, 14 bp, Homo sapiens
cccgactctctcca

SEQ ID NO: 4277042 - DNA, 23 bp, Homo sapiens
cccgagaaggaatggtgcttggc

SEQ ID NO: 4277043 - DNA, 18 bp, Homo sapiens
cccgagccccctgtcctt

SEQ ID NO: 4277044 - DNA, 19 bp, Homo sapiens
cccgagccccctgtccttc

SEQ ID NO: 4277045 - DNA, 18 bp, Homo sapiens
cccgagccgagctctcct

SEQ ID NO: 4277046 - DNA, 22 bp, Homo sapiens
cccgagctgggggccatgagct

SEQ ID NO: 4277047 - DNA, 23 bp, Homo sapiens
cccgaggcagcaacaggaccagg

SEQ ID NO: 4277048 - DNA, 20 bp, Homo sapiens
cccgatccccgacagtggct

SEQ ID NO: 4277049 - DNA, 17 bp, Homo sapiens
cccgatgcgtggctccc

SEQ ID NO: 4277050 - DNA, 22 bp, Homo sapiens
cccgcacgcaagcctcagccac

SEQ ID NO: 4277051 - DNA, 16 bp, Homo sapiens
cccgcatgctgcctgc

SEQ ID NO: 4277052 - DNA, 12 bp, Homo sapiens
cccgcccacctg

SEQ ID NO: 4277053 - DNA, 19 bp, Homo sapiens
cccgccccacattccgaca

SEQ ID NO: 4277054 - DNA, 14 bp, Homo sapiens
cccgccccccagag

SEQ ID NO: 4277055 - DNA, 13 bp, Homo sapiens
cccgcccgcgtcc

SEQ ID NO: 4277056 - DNA, 20 bp, Homo sapiens
cccgcctctgggctcacacc

SEQ ID NO: 4277057 - DNA, 22 bp, Homo sapiens
cccgcctggcagaactgagctc

SEQ ID NO: 4277058 - DNA, 15 bp, Homo sapiens
cccgcgtccaacccc

SEQ ID NO: 4277059 - DNA, 21 bp, Homo sapiens
cccgcgtccaaccccggggca

SEQ ID NO: 4277060 - DNA, 13 bp, Homo sapiens
cccgctcagccct

SEQ ID NO: 4277061 - DNA, 15 bp, Homo sapiens
cccgctcagccctcc

SEQ ID NO: 4277062 - DNA, 19 bp, Homo sapiens
cccgctcagccctccctgc

SEQ ID NO: 4277063 - DNA, 16 bp, Homo sapiens
cccggacaagcccagg

SEQ ID NO: 4277064 - DNA, 19 bp, Homo sapiens
cccggacgcatgcagggcc

SEQ ID NO: 4277065 - DNA, 17 bp, Homo sapiens
cccggaggggcctggca

SEQ ID NO: 4277066 - DNA, 18 bp, Homo sapiens
cccggaggggcctggcag

SEQ ID NO: 4277067 - DNA, 14 bp, Homo sapiens
cccggatctccagg

SEQ ID NO: 4277068 - DNA, 15 bp, Homo sapiens
cccggatctccaggc

SEQ ID NO: 4277069 - DNA, 18 bp, Homo sapiens
cccggatctccaggccca

SEQ ID NO: 4277070 - DNA, 13 bp, Homo sapiens
cccggcagtgcac

SEQ ID NO: 4277071 - DNA, 13 bp, Homo sapiens
cccggccactctg

SEQ ID NO: 4277072 - DNA, 19 bp, Homo sapiens
cccggcccccgccctctgc

SEQ ID NO: 4277073 - DNA, 20 bp, Homo sapiens
cccggcccccgccctctgcc

SEQ ID NO: 4277074 - DNA, 15 bp, Homo sapiens
cccggcctgatggcc

SEQ ID NO: 4277075 - DNA, 17 bp, Homo sapiens
cccggctgggcccgagg

SEQ ID NO: 4277076 - DNA, 15 bp, Homo sapiens
cccgggaaaggccgg

SEQ ID NO: 4277077 - DNA, 20 bp, Homo sapiens
cccgggaggaggatccgggc

SEQ ID NO: 4277078 - DNA, 12 bp, Homo sapiens
cccggggcagct

SEQ ID NO: 4277079 - DNA, 20 bp, Homo sapiens
cccggggtctccacctcagg

SEQ ID NO: 4277080 - DNA, 14 bp, Homo sapiens
cccgggtgcctgtg

SEQ ID NO: 4277081 - DNA, 16 bp, Homo sapiens
cccgtccctttccctg

SEQ ID NO: 4277082 - DNA, 19 bp, Homo sapiens
cccgtccctttccctgcat

SEQ ID NO: 4277083 - DNA, 19 bp, Homo sapiens
cccgtgccaaatcctgggc

SEQ ID NO: 4277084 - DNA, 19 bp, Homo sapiens
cccgtgccacgcgctctgc

SEQ ID NO: 4277085 - DNA, 22 bp, Homo sapiens
cccgtgccacgcgctctgcatg

SEQ ID NO: 4277086 - DNA, 17 bp, Homo sapiens
cccgtgctcacagtagc

SEQ ID NO: 4277087 - DNA, 13 bp, Homo sapiens
ccctacccggctc

SEQ ID NO: 4277088 - DNA, 20 bp, Homo sapiens
ccctacgatgggatcattat

SEQ ID NO: 4277089 - DNA, 18 bp, Homo sapiens
ccctagcagtttgcctct

SEQ ID NO: 4277090 - DNA, 19 bp, Homo sapiens
ccctagcagtttgcctctg

SEQ ID NO: 4277091 - DNA, 21 bp, Homo sapiens
ccctagcagtttgcctctgca

SEQ ID NO: 4277092 - DNA, 22 bp, Homo sapiens
ccctagcagtttgcctctgcac

SEQ ID NO: 4277093 - DNA, 15 bp, Homo sapiens
ccctatcctgcaccc

SEQ ID NO: 4277094 - DNA, 17 bp, Homo sapiens
ccctatcctgcaccctc

SEQ ID NO: 4277095 - DNA, 21 bp, Homo sapiens
ccctcaagccaggagaccctg

SEQ ID NO: 4277096 - DNA, 22 bp, Homo sapiens
ccctcaagccaggagaccctgt

SEQ ID NO: 4277097 - DNA, 13 bp, Homo sapiens
ccctcactccact

SEQ ID NO: 4277098 - DNA, 17 bp, Homo sapiens
ccctcactccactcccc

SEQ ID NO: 4277099 - DNA, 23 bp, Homo sapiens
ccctcactggctggactggaggc

SEQ ID NO: 4277100 - DNA, 15 bp, Homo sapiens
ccctcagccacgcct

SEQ ID NO: 4277101 - DNA, 13 bp, Homo sapiens
ccctccacacctc

SEQ ID NO: 4277102 - DNA, 22 bp, Homo sapiens
ccctccactcctcccaactctg

SEQ ID NO: 4277103 - DNA, 13 bp, Homo sapiens
ccctccagacccc

SEQ ID NO: 4277104 - DNA, 16 bp, Homo sapiens
ccctccagacccctac

SEQ ID NO: 4277105 - DNA, 16 bp, Homo sapiens
ccctcccacatccccc

SEQ ID NO: 4277106 - DNA, 12 bp, Homo sapiens
ccctcccaccac

SEQ ID NO: 4277107 - DNA, 17 bp, Homo sapiens
ccctcccaccacagcag

SEQ ID NO: 4277108 - DNA, 15 bp, Homo sapiens
ccctccctccacacc

SEQ ID NO: 4277109 - DNA, 15 bp, Homo sapiens
ccctccctccctcca

SEQ ID NO: 4277110 - DNA, 14 bp, Homo sapiens
ccctccctccctgc

SEQ ID NO: 4277111 - DNA, 15 bp, Homo sapiens
ccctccctccctgct

SEQ ID NO: 4277112 - DNA, 14 bp, Homo sapiens
ccctccctcctggc

SEQ ID NO: 4277113 - DNA, 16 bp, Homo sapiens
ccctccctcctggctc

SEQ ID NO: 4277114 - DNA, 15 bp, Homo sapiens
ccctccctgcagggt

SEQ ID NO: 4277115 - DNA, 14 bp, Homo sapiens
ccctccctgcccct

SEQ ID NO: 4277116 - DNA, 11 bp, Homo sapiens
ccctccctgct

SEQ ID NO: 4277117 - DNA, 15 bp, Homo sapiens
ccctccctggcctgt

SEQ ID NO: 4277118 - DNA, 12 bp, Homo sapiens
ccctccctgtcc

SEQ ID NO: 4277119 - DNA, 14 bp, Homo sapiens
ccctccgcccttcc

SEQ ID NO: 4277120 - DNA, 18 bp, Homo sapiens
ccctccgctaaggcttcc

SEQ ID NO: 4277121 - DNA, 21 bp, Homo sapiens
ccctcctatcacctcccctcc

SEQ ID NO: 4277122 - DNA, 15 bp, Homo sapiens
ccctcctggctcaca

SEQ ID NO: 4277123 - DNA, 17 bp, Homo sapiens
ccctcctggctcacagc

SEQ ID NO: 4277124 - DNA, 15 bp, Homo sapiens
ccctccttctcccct

SEQ ID NO: 4277125 - DNA, 12 bp, Homo sapiens
ccctccttgccg

SEQ ID NO: 4277126 - DNA, 19 bp, Homo sapiens
ccctccttgccgctgggag

SEQ ID NO: 4277127 - DNA, 23 bp, Homo sapiens
ccctcgcttcataggcagagccc

SEQ ID NO: 4277128 - DNA, 21 bp, Homo sapiens
ccctcggggcaggaagtccct

SEQ ID NO: 4277129 - DNA, 23 bp, Homo sapiens
ccctcggggcaggaagtccctga

SEQ ID NO: 4277130 - DNA, 15 bp, Homo sapiens
ccctcgtctccctgg

SEQ ID NO: 4277131 - DNA, 19 bp, Homo sapiens
ccctcgtctccctggccac

SEQ ID NO: 4277132 - DNA, 20 bp, Homo sapiens
ccctcgtctccctggccacc

SEQ ID NO: 4277133 - DNA, 22 bp, Homo sapiens
ccctctcaggcatgcctgtgtg

SEQ ID NO: 4277134 - DNA, 18 bp, Homo sapiens
ccctctcctgcatccctc

SEQ ID NO: 4277135 - DNA, 11 bp, Homo sapiens
ccctctctctg

SEQ ID NO: 4277136 - DNA, 18 bp, Homo sapiens
ccctctctgtttaccctc

SEQ ID NO: 4277137 - DNA, 22 bp, Homo sapiens
ccctctctgtttaccctccctg

SEQ ID NO: 4277138 - DNA, 18 bp, Homo sapiens
ccctctcttaatgccacg

SEQ ID NO: 4277139 - DNA, 21 bp, Homo sapiens
ccctctgcagggcagcctgtg

SEQ ID NO: 4277140 - DNA, 13 bp, Homo sapiens
ccctctgccactg

SEQ ID NO: 4277141 - DNA, 15 bp, Homo sapiens
ccctctgcccccagc

SEQ ID NO: 4277142 - DNA, 14 bp, Homo sapiens
ccctctgcctgtcc

SEQ ID NO: 4277143 - DNA, 21 bp, Homo sapiens
ccctctgctatgtctgtgatg

SEQ ID NO: 4277144 - DNA, 15 bp, Homo sapiens
ccctctgctccacag

SEQ ID NO: 4277145 - DNA, 17 bp, Homo sapiens
ccctctggtccttctga

SEQ ID NO: 4277146 - DNA, 22 bp, Homo sapiens
ccctctggtccttctgacccca

SEQ ID NO: 4277147 - DNA, 20 bp, Homo sapiens
ccctcttcccccttcccctg

SEQ ID NO: 4277148 - DNA, 22 bp, Homo sapiens
ccctcttgccccccaccccagc

SEQ ID NO: 4277149 - DNA, 16 bp, Homo sapiens
ccctgaagtgacccca

SEQ ID NO: 4277150 - DNA, 18 bp, Homo sapiens
ccctgaagtgaccccagc

SEQ ID NO: 4277151 - DNA, 19 bp, Homo sapiens
ccctgaagtgaccccagct

SEQ ID NO: 4277152 - DNA, 15 bp, Homo sapiens
ccctgacatgctaac

SEQ ID NO: 4277153 - DNA, 20 bp, Homo sapiens
ccctgagggcccttcccaac

SEQ ID NO: 4277154 - DNA, 23 bp, Homo sapiens
ccctgagggcccttcccaacctc

SEQ ID NO: 4277155 - DNA, 19 bp, Homo sapiens
ccctgaggggcctgccact

SEQ ID NO: 4277156 - DNA, 19 bp, Homo sapiens
ccctgagggtttccacctt

SEQ ID NO: 4277157 - DNA, 16 bp, Homo sapiens
ccctgcacacacctgc

SEQ ID NO: 4277158 - DNA, 18 bp, Homo sapiens
ccctgcacacacctgcac

SEQ ID NO: 4277159 - DNA, 19 bp, Homo sapiens
ccctgcacacacctgcaca

SEQ ID NO: 4277160 - DNA, 16 bp, Homo sapiens
ccctgcacctgcttct

SEQ ID NO: 4277161 - DNA, 13 bp, Homo sapiens
ccctgcaggcggt

SEQ ID NO: 4277162 - DNA, 17 bp, Homo sapiens
cctgctatccagccgca

SEQ ID NO: 4277163 - DNA, 19 bp, Homo sapiens
cctgctcagatgctggtca

SEQ ID NO: 4277164 - DNA, 14 bp, Homo sapiens
cctgctcaggcctc

SEQ ID NO: 4277165 - DNA, 18 bp, Homo sapiens
cctgctcaggcctcacct

SEQ ID NO: 4277166 - DNA, 23 bp, Homo sapiens
cctgctccatgggcacctctgct

SEQ ID NO: 4277167 - DNA, 12 bp, Homo sapiens
cctgctgccagg

SEQ ID NO: 4277168 - DNA, 17 bp, Homo sapiens
cctgctgcccgtgagga

SEQ ID NO: 4277169 - DNA, 18 bp, Homo sapiens
cctgctgcccgtgaggag

SEQ ID NO: 4277170 - DNA, 16 bp, Homo sapiens
cctgctgcctccccaa

SEQ ID NO: 4277171 - DNA, 17 bp, Homo sapiens
cctgctgcctccccaac

SEQ ID NO: 4277172 - DNA, 20 bp, Homo sapiens
cctgctgcctccccaaccct

SEQ ID NO: 4277173 - DNA, 21 bp, Homo sapiens
cctgctgcctccccaaccctg

SEQ ID NO: 4277174 - DNA, 12 bp, Homo sapiens
cctgctggcccc

SEQ ID NO: 4277175 - DNA, 13 bp, Homo sapiens
cctgctggcccct

SEQ ID NO: 4277176 - DNA, 21 bp, Homo sapiens
cctgctggcccctcacctggg

SEQ ID NO: 4277177 - DNA, 12 bp, Homo sapiens
cctgctggtgcc

SEQ ID NO: 4277178 - DNA, 15 bp, Homo sapiens
cctgctggtgcccac

SEQ ID NO: 4277179 - DNA, 13 bp, Homo sapiens
cctgcttctcagc

SEQ ID NO: 4277180 - DNA, 18 bp, Homo sapiens
cctgcttgtgttgggccc

SEQ ID NO: 4277181 - DNA, 21 bp, Homo sapiens
cctgcttgtgttgggccccag

SEQ ID NO: 4277182 - DNA, 17 bp, Homo sapiens
cctgctttgggctgccc

SEQ ID NO: 4277183 - DNA, 20 bp, Homo sapiens
cctggaactgtctctcatga

SEQ ID NO: 4277184 - DNA, 13 bp, Homo sapiens
cctggacacagtc

SEQ ID NO: 4277185 - DNA, 20 bp, Homo sapiens
cctggacgcatgcagggccc

SEQ ID NO: 4277186 - DNA, 12 bp, Homo sapiens
cctggactctgt

SEQ ID NO: 4277187 - DNA, 12 bp, Homo sapiens
cctggagaacta

SEQ ID NO: 4277188 - DNA, 23 bp, Homo sapiens
cctggaggacaaaacagcgggag

SEQ ID NO: 4277189 - DNA, 13 bp, Homo sapiens
cctggcagaactg

SEQ ID NO: 4277190 - DNA, 18 bp, Homo sapiens
cctggcagaactgagctc

SEQ ID NO: 4277191 - DNA, 23 bp, Homo sapiens
cctggcagaactgagctcctctg

SEQ ID NO: 4277192 - DNA, 22 bp, Homo sapiens
cctggcagccgtgccttcagct

SEQ ID NO: 4277193 - DNA, 12 bp, Homo sapiens
cctggcagggca

SEQ ID NO: 4277194 - DNA, 22 bp, Homo sapiens
cctggcagggcaggcagagctc

SEQ ID NO: 4277195 - DNA, 12 bp, Homo sapiens
cctggcccagcc

SEQ ID NO: 4277196 - DNA, 13 bp, Homo sapiens
cctggcccagcca

SEQ ID NO: 4277197 - DNA, 17 bp, Homo sapiens
cctggcccagccagcag

SEQ ID NO: 4277198 - DNA, 18 bp, Homo sapiens
cctggcccagccagcagg

SEQ ID NO: 4277199 - DNA, 16 bp, Homo sapiens
cctggcccagcctgtg

SEQ ID NO: 4277200 - DNA, 16 bp, Homo sapiens
cctggccccaaatgtt

SEQ ID NO: 4277201 - DNA, 15 bp, Homo sapiens
cctggcccctcccac

SEQ ID NO: 4277202 - DNA, 19 bp, Homo sapiens
cctggcccctcccacatcc

SEQ ID NO: 4277203 - DNA, 18 bp, Homo sapiens
cctggccctcctctggtc

SEQ ID NO: 4277204 - DNA, 13 bp, Homo sapiens
cctggcctgttct

SEQ ID NO: 4277205 - DNA, 12 bp, Homo sapiens
cctggctcacag

SEQ ID NO: 4277206 - DNA, 22 bp, Homo sapiens
cctggctcacagccaccacctg

SEQ ID NO: 4277207 - DNA, 14 bp, Homo sapiens
cctggctcccaggg

SEQ ID NO: 4277208 - DNA, 11 bp, Homo sapiens
cctggctctgt

SEQ ID NO: 4277209 - DNA, 22 bp, Homo sapiens
cctggcttcccaggaccctggg

SEQ ID NO: 4277210 - DNA, 21 bp, Homo sapiens
cctgggaaaagggcaggagcc

SEQ ID NO: 4277211 - DNA, 22 bp, Homo sapiens
cctgggaaaagggcaggagcct

SEQ ID NO: 4277212 - DNA, 14 bp, Homo sapiens
cctgggagatgctg

SEQ ID NO: 4277213 - DNA, 23 bp, Homo sapiens
cctgggagatgctgggaccctcg

SEQ ID NO: 4277214 - DNA, 15 bp, Homo sapiens
cctgggcacctgggg

SEQ ID NO: 4277215 - DNA, 16 bp, Homo sapiens
cctgggcagcccagag

SEQ ID NO: 4277216 - DNA, 17 bp, Homo sapiens
cctgggcagcccagaga

SEQ ID NO: 4277217 - DNA, 14 bp, Homo sapiens
cctgggcatcccca

SEQ ID NO: 4277218 - DNA, 21 bp, Homo sapiens
cctgggcatccccagccccct

SEQ ID NO: 4277219 - DNA, 22 bp, Homo sapiens
cctgggcatccccagccccctg

SEQ ID NO: 4277220 - DNA, 16 bp, Homo sapiens
cctgggcatctggccc

SEQ ID NO: 4277221 - DNA, 24 bp, Homo sapiens
cctgggcatctggccctgctgccc

SEQ ID NO: 4277222 - DNA, 13 bp, Homo sapiens
cctgggcatgtcc

SEQ ID NO: 4277223 - DNA, 20 bp, Homo sapiens
cctgggcatgtccccagtgt

SEQ ID NO: 4277224 - DNA, 23 bp, Homo sapiens
cctgggcatgtccccagtgtgga

SEQ ID NO: 4277225 - DNA, 15 bp, Homo sapiens
cctgggccctaggca

SEQ ID NO: 4277226 - DNA, 14 bp, Homo sapiens
cctgggccctggtt

SEQ ID NO: 4277227 - DNA, 14 bp, Homo sapiens
cctgggctctgggt

SEQ ID NO: 4277228 - DNA, 12 bp, Homo sapiens
cctgggctggca

SEQ ID NO: 4277229 - DNA, 14 bp, Homo sapiens
cctgggctggcatg

SEQ ID NO: 4277230 - DNA, 22 bp, Homo sapiens
cctggggacggagcactgtgca

SEQ ID NO: 4277231 - DNA, 19 bp, Homo sapiens
cctggggagtgggacagag

SEQ ID NO: 4277232 - DNA, 22 bp, Homo sapiens
cctggggagtgggacagagtct

SEQ ID NO: 4277233 - DNA, 13 bp, Homo sapiens
cctgggggctgct

SEQ ID NO: 4277234 - DNA, 18 bp, Homo sapiens
cctgggggctgctgcact

SEQ ID NO: 4277235 - DNA, 14 bp, Homo sapiens
cctggggggcacag

SEQ ID NO: 4277236 - DNA, 18 bp, Homo sapiens
cctggggggcacagccag

SEQ ID NO: 4277237 - DNA, 22 bp, Homo sapiens
cctggggtggaggctaagcctg

SEQ ID NO: 4277238 - DNA, 22 bp, Homo sapiens
cctggggtgggtgtgagcaggg

SEQ ID NO: 4277239 - DNA, 20 bp, Homo sapiens
cctggggtggttggaggcct

SEQ ID NO: 4277240 - DNA, 20 bp, Homo sapiens
cctgggtcaccttcctgggc

SEQ ID NO: 4277241 - DNA, 13 bp, Homo sapiens
cctgggtgtgctc

SEQ ID NO: 4277242 - DNA, 15 bp, Homo sapiens
cctgggtgtgctcca

SEQ ID NO: 4277243 - DNA, 20 bp, Homo sapiens
cctggtatgtctcaccagga

SEQ ID NO: 4277244 - DNA, 20 bp, Homo sapiens
cctggtcctgcactgtcccg

SEQ ID NO: 4277245 - DNA, 13 bp, Homo sapiens
cctggtctggctt

SEQ ID NO: 4277246 - DNA, 14 bp, Homo sapiens
cctggtgccctggc

SEQ ID NO: 4277247 - DNA, 16 bp, Homo sapiens
cctggtgccctggccc

SEQ ID NO: 4277248 - DNA, 19 bp, Homo sapiens
cctggtgccctggcccagc

SEQ ID NO: 4277249 - DNA, 23 bp, Homo sapiens
cctggtggccaagcctgccccgg

SEQ ID NO: 4277250 - DNA, 18 bp, Homo sapiens
cctggtgtccctgcctgg

SEQ ID NO: 4277251 - DNA, 17 bp, Homo sapiens
cctggttcccccaggac

SEQ ID NO: 4277252 - DNA, 21 bp, Homo sapiens
cctggttcccccaggaccctg

SEQ ID NO: 4277253 - DNA, 21 bp, Homo sapiens
cctggttttcattattttccc

SEQ ID NO: 4277254 - DNA, 13 bp, Homo sapiens
cctgtatttccaa

SEQ ID NO: 4277255 - DNA, 14 bp, Homo sapiens
cctgtcagtgcagc

SEQ ID NO: 4277256 - DNA, 17 bp, Homo sapiens
cctgtccacctgtgctg

SEQ ID NO: 4277257 - DNA, 13 bp, Homo sapiens
cctgtccagagag

SEQ ID NO: 4277258 - DNA, 11 bp, Homo sapiens
cctgtccctgc

SEQ ID NO: 4277259 - DNA, 16 bp, Homo sapiens
cctgtccctgccccgc

SEQ ID NO: 4277260 - DNA, 22 bp, Homo sapiens
cctgtccctgccccgcccccca

SEQ ID NO: 4277261 - DNA, 16 bp, Homo sapiens
cctgtctgcgccgctg

SEQ ID NO: 4277262 - DNA, 20 bp, Homo sapiens
cctgtctgcgccgctgtgct

SEQ ID NO: 4277263 - DNA, 19 bp, Homo sapiens
cctgtctttgctgtttata

SEQ ID NO: 4277264 - DNA, 18 bp, Homo sapiens
cctgtgaactgccaggca

SEQ ID NO: 4277265 - DNA, 22 bp, Homo sapiens
cctgtgaccggggtcctgaggc

SEQ ID NO: 4277266 - DNA, 23 bp, Homo sapiens
cctgtgagatgtgtatcagtgtt

SEQ ID NO: 4277267 - DNA, 16 bp, Homo sapiens
cctgtgatcgtgtgtt

SEQ ID NO: 4277268 - DNA, 13 bp, Homo sapiens
cctgtgcacagcc

SEQ ID NO: 4277269 - DNA, 17 bp, Homo sapiens
cctgtgcccgctgcgct

SEQ ID NO: 4277270 - DNA, 19 bp, Homo sapiens
cctgtgcccgctgcgctgc

SEQ ID NO: 4277271 - DNA, 21 bp, Homo sapiens
cctgtgcccgctgcgctgccc

SEQ ID NO: 4277272 - DNA, 13 bp, Homo sapiens
cctgtgctgctgc

SEQ ID NO: 4277273 - DNA, 19 bp, Homo sapiens
cctgtggaagggactagga

SEQ ID NO: 4277274 - DNA, 11 bp, Homo sapiens
cctgtggctct

SEQ ID NO: 4277275 - DNA, 23 bp, Homo sapiens
cctgtggctctacaactgagtcc

SEQ ID NO: 4277276 - DNA, 19 bp, Homo sapiens
cctgtgggagaagggacag

SEQ ID NO: 4277277 - DNA, 19 bp, Homo sapiens
cctgtggggatttctccca

SEQ ID NO: 4277278 - DNA, 15 bp, Homo sapiens
cctgtgggtccttgc

SEQ ID NO: 4277279 - DNA, 21 bp, Homo sapiens
cctgtgttagtgtctgtccat

SEQ ID NO: 4277280 - DNA, 17 bp, Homo sapiens
cctgttacttaaatagc

SEQ ID NO: 4277281 - DNA, 24 bp, Homo sapiens
cctgttacttaaatagcatctgct

SEQ ID NO: 4277282 - DNA, 20 bp, Homo sapiens
cctgttaggggaaaatagta

SEQ ID NO: 4277283 - DNA, 21 bp, Homo sapiens
cctgttcactctacttagcat

SEQ ID NO: 4277284 - DNA, 12 bp, Homo sapiens
cctgttctcaga

SEQ ID NO: 4277285 - DNA, 22 bp, Homo sapiens
cctgttctcagagctccacaga

SEQ ID NO: 4277286 - DNA, 19 bp, Homo sapiens
cctgttctgtgtctgctgt

SEQ ID NO: 4277287 - DNA, 18 bp, Homo sapiens
ccttaaaaaaaaaaatga

SEQ ID NO: 4277288 - DNA, 16 bp, Homo sapiens
ccttaaaataatgatt

SEQ ID NO: 4277289 - DNA, 17 bp, Homo sapiens
ccttaaaataatgattt

SEQ ID NO: 4277290 - DNA, 23 bp, Homo sapiens
ccttaaacagggcatctccagga

SEQ ID NO: 4277291 - DNA, 14 bp, Homo sapiens
ccttaagaaagcta

SEQ ID NO: 4277292 - DNA, 15 bp, Homo sapiens
ctatgccacctgcag

SEQ ID NO: 4277293 - DNA, 20 bp, Homo sapiens
ctatgccacctgcagcgtct

SEQ ID NO: 4277294 - DNA, 16 bp, Homo sapiens
ctatgcctgtatttcc

SEQ ID NO: 4277295 - DNA, 17 bp, Homo sapiens
ctatgcctgtatttcca

SEQ ID NO: 4277296 - DNA, 18 bp, Homo sapiens
ctatgtcatttcatttcc

SEQ ID NO: 4277297 - DNA, 23 bp, Homo sapiens
ctatgtccatgaaaaacagcaga

SEQ ID NO: 4277298 - DNA, 21 bp, Homo sapiens
ctatgtgtcatgatttcaatg

SEQ ID NO: 4277299 - DNA, 14 bp, Homo sapiens
ctattactgatgtg

SEQ ID NO: 4277300 - DNA, 21 bp, Homo sapiens
ctattagcttactgattaact

SEQ ID NO: 4277301 - DNA, 16 bp, Homo sapiens
ctattatccccatttc

SEQ ID NO: 4277302 - DNA, 15 bp, Homo sapiens
ctattcccaaagaac

SEQ ID NO: 4277303 - DNA, 12 bp, Homo sapiens
ctattgtaatat

SEQ ID NO: 4277304 - DNA, 16 bp, Homo sapiens
ctattgtagcatttct

SEQ ID NO: 4277305 - DNA, 12 bp, Homo sapiens
ctatttaatttt

SEQ ID NO: 4277306 - DNA, 16 bp, Homo sapiens
ctatttatctgtctga

SEQ ID NO: 4277307 - DNA, 15 bp, Homo sapiens
ctatttctatctgca

SEQ ID NO: 4277308 - DNA, 16 bp, Homo sapiens
ctcaaaaatcatcaaa

SEQ ID NO: 4277309 - DNA, 18 bp, Homo sapiens
ctcaaagtttttacagtg

SEQ ID NO: 4277310 - DNA, 20 bp, Homo sapiens
ctcaaagtttttacagtgta

SEQ ID NO: 4277311 - DNA, 16 bp, Homo sapiens
ctcaaccctccctcag

SEQ ID NO: 4277312 - DNA, 18 bp, Homo sapiens
ctcaaccctccctcagcc

SEQ ID NO: 4277313 - DNA, 21 bp, Homo sapiens
ctcaacctgtgatgaggggag

SEQ ID NO: 4277314 - DNA, 17 bp, Homo sapiens
ctcaagaacaaacagaa

SEQ ID NO: 4277315 - DNA, 19 bp, Homo sapiens
ctcaagatcctgtcttgct

SEQ ID NO: 4277316 - DNA, 14 bp, Homo sapiens
ctcaagccaggaga

SEQ ID NO: 4277317 - DNA, 18 bp, Homo sapiens
ctcaagccaggagaccct

SEQ ID NO: 4277318 - DNA, 23 bp, Homo sapiens
ctcaagccaggagaccctgtctt

SEQ ID NO: 4277319 - DNA, 14 bp, Homo sapiens
ctcaataaaggtca

SEQ ID NO: 4277320 - DNA, 16 bp, Homo sapiens
ctcaatcatgacttct

SEQ ID NO: 4277321 - DNA, 19 bp, Homo sapiens
ctcacaactgtttttgaag

SEQ ID NO: 4277322 - DNA, 18 bp, Homo sapiens
ctcacaccagccctggtg

SEQ ID NO: 4277323 - DNA, 10 bp, Homo sapiens
ctcacagcca

SEQ ID NO: 4277324 - DNA, 12 bp, Homo sapiens
ctcacccaggac

SEQ ID NO: 4277325 - DNA, 19 bp, Homo sapiens
ctcacccaggacctctggg

SEQ ID NO: 4277326 - DNA, 14 bp, Homo sapiens
ctcaccctgctcct

SEQ ID NO: 4277327 - DNA, 16 bp, Homo sapiens
ctcacctggcttccca

SEQ ID NO: 4277328 - DNA, 17 bp, Homo sapiens
ctcacctggcttcccag

SEQ ID NO: 4277329 - DNA, 19 bp, Homo sapiens
ctcacctggcttcccagga

SEQ ID NO: 4277330 - DNA, 19 bp, Homo sapiens
ctcacctgggcacctgggg

SEQ ID NO: 4277331 - DNA, 19 bp, Homo sapiens
ctcaccttccctagttctt

SEQ ID NO: 4277332 - DNA, 14 bp, Homo sapiens
ctcaccttctgttt

SEQ ID NO: 4277333 - DNA, 15 bp, Homo sapiens
ctcaccttctgtttt

SEQ ID NO: 4277334 - DNA, 19 bp, Homo sapiens
ctcaccttgcaacacacag

SEQ ID NO: 4277335 - DNA, 15 bp, Homo sapiens
ctcacggctgcacct

SEQ ID NO: 4277336 - DNA, 16 bp, Homo sapiens
ctcacggctgcacctg

SEQ ID NO: 4277337 - DNA, 17 bp, Homo sapiens
ctcacggctgcacctgc

SEQ ID NO: 4277338 - DNA, 13 bp, Homo sapiens
ctcactccactcc

SEQ ID NO: 4277339 - DNA, 13 bp, Homo sapiens
ctcactcctacct

SEQ ID NO: 4277340 - DNA, 15 bp, Homo sapiens
ctcactcctacctgg

SEQ ID NO: 4277341 - DNA, 13 bp, Homo sapiens
ctcactctggcag

SEQ ID NO: 4277342 - DNA, 20 bp, Homo sapiens
ctcactctggcagcctcaga

SEQ ID NO: 4277343 - DNA, 13 bp, Homo sapiens
ctcactgccctcc

SEQ ID NO: 4277344 - DNA, 22 bp, Homo sapiens
ctcactggtgcatttaaaatgg

SEQ ID NO: 4277345 - DNA, 15 bp, Homo sapiens
ctcacttttctccat

SEQ ID NO: 4277346 - DNA, 16 bp, Homo sapiens
ctcagaagtttcttct

SEQ ID NO: 4277347 - DNA, 15 bp, Homo sapiens
ctcagagccacccct

SEQ ID NO: 4277348 - DNA, 17 bp, Homo sapiens
ctcagagctccacagaa

SEQ ID NO: 4277349 - DNA, 22 bp, Homo sapiens
ctcagaggccccttgctgctgg

SEQ ID NO: 4277350 - DNA, 19 bp, Homo sapiens
ctcagagggtccctaggtg

SEQ ID NO: 4277351 - DNA, 14 bp, Homo sapiens
ctcagagtccaggc

SEQ ID NO: 4277352 - DNA, 15 bp, Homo sapiens
ctcagcagaaggcct

SEQ ID NO: 4277353 - DNA, 19 bp, Homo sapiens
ctcagccactcccaggggc

SEQ ID NO: 4277354 - DNA, 20 bp, Homo sapiens
ctcagccactcccaggggcc

SEQ ID NO: 4277355 - DNA, 17 bp, Homo sapiens
ctcagcccacccccctc

SEQ ID NO: 4277356 - DNA, 19 bp, Homo sapiens
ctcagcccacccccctcat

SEQ ID NO: 4277357 - DNA, 17 bp, Homo sapiens
ctcagcccaggtctcct

SEQ ID NO: 4277358 - DNA, 20 bp, Homo sapiens
ctcagcccaggtctcctggg

SEQ ID NO: 4277359 - DNA, 15 bp, Homo sapiens
ctcagccccagggcc

SEQ ID NO: 4277360 - DNA, 16 bp, Homo sapiens
ctcagccccagggccc

SEQ ID NO: 4277361 - DNA, 21 bp, Homo sapiens
ctcagccccagggccctgctc

SEQ ID NO: 4277362 - DNA, 13 bp, Homo sapiens
ctcagcccctctt

SEQ ID NO: 4277363 - DNA, 18 bp, Homo sapiens
ctcagcccctcttgcccc

SEQ ID NO: 4277364 - DNA, 19 bp, Homo sapiens
ctcagcccctcttgccccc

SEQ ID NO: 4277365 - DNA, 19 bp, Homo sapiens
ctcagccctccctgcccct

SEQ ID NO: 4277366 - DNA, 21 bp, Homo sapiens
ctcagccctccctgcccctcc

SEQ ID NO: 4277367 - DNA, 13 bp, Homo sapiens
ctcagccttaaga

SEQ ID NO: 4277368 - DNA, 23 bp, Homo sapiens
ctcaggagaaggcctgcccccct

SEQ ID NO: 4277369 - DNA, 16 bp, Homo sapiens
ctcaggcagcctgtgg

SEQ ID NO: 4277370 - DNA, 13 bp, Homo sapiens
ctcaggcagtggc

SEQ ID NO: 4277371 - DNA, 17 bp, Homo sapiens
ctcaggcatgcctgtgt

SEQ ID NO: 4277372 - DNA, 15 bp, Homo sapiens
ctcaggcccacattg

SEQ ID NO: 4277373 - DNA, 21 bp, Homo sapiens
ctcaggcctcacctggcttcc

SEQ ID NO: 4277374 - DNA, 12 bp, Homo sapiens
ctcaggcctggc

SEQ ID NO: 4277375 - DNA, 14 bp, Homo sapiens
ctcaggcctggccc

SEQ ID NO: 4277376 - DNA, 17 bp, Homo sapiens
ctcaggcctggcccttt

SEQ ID NO: 4277377 - DNA, 16 bp, Homo sapiens
ctcagggaccaaggag

SEQ ID NO: 4277378 - DNA, 23 bp, Homo sapiens
ctcagggctggattggcaggtgt

SEQ ID NO: 4277379 - DNA, 12 bp, Homo sapiens
ctcaggggagac

SEQ ID NO: 4277380 - DNA, 20 bp, Homo sapiens
ctcaggtttgcctgagggcg

SEQ ID NO: 4277381 - DNA, 20 bp, Homo sapiens
ctcagtccctccctcctggc

SEQ ID NO: 4277382 - DNA, 22 bp, Homo sapiens
ctcagtccctccctcctggctc

SEQ ID NO: 4277383 - DNA, 23 bp, Homo sapiens
ctcagtccctccctcctggctca

SEQ ID NO: 4277384 - DNA, 13 bp, Homo sapiens
ctcagtccttcca

SEQ ID NO: 4277385 - DNA, 12 bp, Homo sapiens
ctcagtgcagcc

SEQ ID NO: 4277386 - DNA, 17 bp, Homo sapiens
ctcagtgcagccccctc

SEQ ID NO: 4277387 - DNA, 21 bp, Homo sapiens
ctcagtgcagccccctcctga

SEQ ID NO: 4277388 - DNA, 19 bp, Homo sapiens
ctcagtggactttccaccc

SEQ ID NO: 4277389 - DNA, 20 bp, Homo sapiens
ctcagtggactttccacccc

SEQ ID NO: 4277390 - DNA, 14 bp, Homo sapiens
ctcagttccaatgt

SEQ ID NO: 4277391 - DNA, 21 bp, Homo sapiens
ctcagttcctgcagcagagcc

SEQ ID NO: 4277392 - DNA, 15 bp, Homo sapiens
ctcatcaacaaagaa

SEQ ID NO: 4277393 - DNA, 18 bp, Homo sapiens
ctcatcaacaaagaaata

SEQ ID NO: 4277394 - DNA, 22 bp, Homo sapiens
ctcatccactaggtgcccagtc

SEQ ID NO: 4277395 - DNA, 23 bp, Homo sapiens
ctcatccactaggtgcccagtct

SEQ ID NO: 4277396 - DNA, 17 bp, Homo sapiens
ctcatccagaactgtct

SEQ ID NO: 4277397 - DNA, 21 bp, Homo sapiens
ctcatccccaaactgtagtaa

SEQ ID NO: 4277398 - DNA, 12 bp, Homo sapiens
ctcatctcttct

SEQ ID NO: 4277399 - DNA, 17 bp, Homo sapiens
ctcatctgaaaggccca

SEQ ID NO: 4277400 - DNA, 16 bp, Homo sapiens
ctcatgattttttaca

SEQ ID NO: 4277401 - DNA, 23 bp, Homo sapiens
ctcatgattttttacaaattatg

SEQ ID NO: 4277402 - DNA, 21 bp, Homo sapiens
ctcatgccattccgaccttca

SEQ ID NO: 4277403 - DNA, 13 bp, Homo sapiens
ctcatgcctgaga

SEQ ID NO: 4277404 - DNA, 17 bp, Homo sapiens
ctccaaggcaaatgtcc

SEQ ID NO: 4277405 - DNA, 20 bp, Homo sapiens
ctccaaggcaaatgtccaag

SEQ ID NO: 4277406 - DNA, 14 bp, Homo sapiens
ctccacacctccac

SEQ ID NO: 4277407 - DNA, 21 bp, Homo sapiens
ctccacagaagacacgtgttt

SEQ ID NO: 4277408 - DNA, 23 bp, Homo sapiens
ctccacagggacacagtctggtg

SEQ ID NO: 4277409 - DNA, 12 bp, Homo sapiens
ctccacccctca

SEQ ID NO: 4277410 - DNA, 23 bp, Homo sapiens
ctccaccgggagggacagtctgg

SEQ ID NO: 4277411 - DNA, 12 bp, Homo sapiens
ctccacctcagg

SEQ ID NO: 4277412 - DNA, 13 bp, Homo sapiens
ctccacctcaggg

SEQ ID NO: 4277413 - DNA, 13 bp, Homo sapiens
ctccacctgcagc

SEQ ID NO: 4277414 - DNA, 17 bp, Homo sapiens
ctccacctgcagcccca

SEQ ID NO: 4277415 - DNA, 19 bp, Homo sapiens
ctccacctgcagccccagg

SEQ ID NO: 4277416 - DNA, 20 bp, Homo sapiens
ctccacctgcttgtgttggg

SEQ ID NO: 4277417 - DNA, 20 bp, Homo sapiens
ctccacgggggcctagtggc

SEQ ID NO: 4277418 - DNA, 13 bp, Homo sapiens
ctccactcctccc

SEQ ID NO: 4277419 - DNA, 16 bp, Homo sapiens
ctccactcctcccaac

SEQ ID NO: 4277420 - DNA, 16 bp, Homo sapiens
ctccactgccttcgat

SEQ ID NO: 4277421 - DNA, 18 bp, Homo sapiens
ctccagacccccacccct

SEQ ID NO: 4277422 - DNA, 21 bp, Homo sapiens
ctccagacccccaccccttcc

SEQ ID NO: 4277423 - DNA, 18 bp, Homo sapiens
ctgaggagctcagggctg

SEQ ID NO: 4277424 - DNA, 17 bp, Homo sapiens
ctgaggcaaccccctcg

SEQ ID NO: 4277425 - DNA, 22 bp, Homo sapiens
ctgaggcaaccccctcggagcc

SEQ ID NO: 4277426 - DNA, 21 bp, Homo sapiens
ctgaggctgccccaggggcac

SEQ ID NO: 4277427 - DNA, 13 bp, Homo sapiens
ctgaggctggggc

SEQ ID NO: 4277428 - DNA, 15 bp, Homo sapiens
ctgaggctggggctt

SEQ ID NO: 4277429 - DNA, 19 bp, Homo sapiens
ctgagggcagggttctaga

SEQ ID NO: 4277430 - DNA, 12 bp, Homo sapiens
ctgagggccctt

SEQ ID NO: 4277431 - DNA, 16 bp, Homo sapiens
ctgagggcccttccca

SEQ ID NO: 4277432 - DNA, 16 bp, Homo sapiens
ctgagggcgaggggag

SEQ ID NO: 4277433 - DNA, 16 bp, Homo sapiens
ctgaggggcagggccg

SEQ ID NO: 4277434 - DNA, 14 bp, Homo sapiens
ctgagggtttccac

SEQ ID NO: 4277435 - DNA, 14 bp, Homo sapiens
ctgagtctcattcc

SEQ ID NO: 4277436 - DNA, 18 bp, Homo sapiens
ctgagtgaagtccagtga

SEQ ID NO: 4277437 - DNA, 20 bp, Homo sapiens
ctgagtgaagtccagtgacc

SEQ ID NO: 4277438 - DNA, 17 bp, Homo sapiens
ctgagtggtccacattc

SEQ ID NO: 4277439 - DNA, 16 bp, Homo sapiens
ctgagttgaggggctt

SEQ ID NO: 4277440 - DNA, 20 bp, Homo sapiens
ctgagttgaggggcttccct

SEQ ID NO: 4277441 - DNA, 18 bp, Homo sapiens
ctgatagatatccttggc

SEQ ID NO: 4277442 - DNA, 16 bp, Homo sapiens
ctgatatattttccag

SEQ ID NO: 4277443 - DNA, 22 bp, Homo sapiens
ctgatatctgtttgcttctaaa

SEQ ID NO: 4277444 - DNA, 15 bp, Homo sapiens
ctgatcacaactttt

SEQ ID NO: 4277445 - DNA, 13 bp, Homo sapiens
ctgatggtggggc

SEQ ID NO: 4277446 - DNA, 15 bp, Homo sapiens
ctgattattgaatgt

SEQ ID NO: 4277447 - DNA, 15 bp, Homo sapiens
ctgattggacatttt

SEQ ID NO: 4277448 - DNA, 16 bp, Homo sapiens
ctgatttgcaaatgca

SEQ ID NO: 4277449 - DNA, 19 bp, Homo sapiens
ctgatttgggctgaatgta

SEQ ID NO: 4277450 - DNA, 20 bp, Homo sapiens
ctgcaaatagtttcaaatga

SEQ ID NO: 4277451 - DNA, 12 bp, Homo sapiens
ctgcaacactgg

SEQ ID NO: 4277452 - DNA, 23 bp, Homo sapiens
ctgcaagattctgtgggcagctg

SEQ ID NO: 4277453 - DNA, 13 bp, Homo sapiens
ctgcaattcaact

SEQ ID NO: 4277454 - DNA, 20 bp, Homo sapiens
ctgcacacacctgcacaccg

SEQ ID NO: 4277455 - DNA, 21 bp, Homo sapiens
ctgcacacccctgcacacacc

SEQ ID NO: 4277456 - DNA, 21 bp, Homo sapiens
ctgcacaccttgaatctgcct

SEQ ID NO: 4277457 - DNA, 20 bp, Homo sapiens
ctgcaccaacctcactgccc

SEQ ID NO: 4277458 - DNA, 23 bp, Homo sapiens
ctgcacccctggtgtccctgcct

SEQ ID NO: 4277459 - DNA, 20 bp, Homo sapiens
ctgcaccctggatttgcata

SEQ ID NO: 4277460 - DNA, 13 bp, Homo sapiens
ctgcacctgcagg

SEQ ID NO: 4277461 - DNA, 15 bp, Homo sapiens
ctgcacgtgcacaca

SEQ ID NO: 4277462 - DNA, 16 bp, Homo sapiens
ctgcacgtgcacacac

SEQ ID NO: 4277463 - DNA, 17 bp, Homo sapiens
ctgcacgtgcacacacc

SEQ ID NO: 4277464 - DNA, 21 bp, Homo sapiens
ctgcacgtgcacacacctgca

SEQ ID NO: 4277465 - DNA, 13 bp, Homo sapiens
ctgcactgccctc

SEQ ID NO: 4277466 - DNA, 20 bp, Homo sapiens
ctgcagaaccagtccctctg

SEQ ID NO: 4277467 - DNA, 15 bp, Homo sapiens
ctgcagactcactgt

SEQ ID NO: 4277468 - DNA, 22 bp, Homo sapiens
ctgcagcacattgccctgaggg

SEQ ID NO: 4277469 - DNA, 23 bp, Homo sapiens
ctgcagcacattgccctgagggg

SEQ ID NO: 4277470 - DNA, 23 bp, Homo sapiens
ctgcaggccacccagggaccacg

SEQ ID NO: 4277471 - DNA, 19 bp, Homo sapiens
ctgcaggcggtatccagag

SEQ ID NO: 4277472 - DNA, 22 bp, Homo sapiens
ctgcaggcggtatccagaggtg

SEQ ID NO: 4277473 - DNA, 13 bp, Homo sapiens
ctgcagggagcag

SEQ ID NO: 4277474 - DNA, 12 bp, Homo sapiens
ctgcagggcagc

SEQ ID NO: 4277475 - DNA, 22 bp, Homo sapiens
ctgcagggtggcatcttagggt

SEQ ID NO: 4277476 - DNA, 15 bp, Homo sapiens
ctgcagtcacccctg

SEQ ID NO: 4277477 - DNA, 16 bp, Homo sapiens
ctgcagtcacccctgt

SEQ ID NO: 4277478 - DNA, 17 bp, Homo sapiens
ctgcagtcacccctgtc

SEQ ID NO: 4277479 - DNA, 19 bp, Homo sapiens
ctgcagtcacccctgtctg

SEQ ID NO: 4277480 - DNA, 20 bp, Homo sapiens
ctgcagtcacccctgtctgc

SEQ ID NO: 4277481 - DNA, 16 bp, Homo sapiens
ctgcagtcagcacaga

SEQ ID NO: 4277482 - DNA, 17 bp, Homo sapiens
ctgcagtcagcacagag

SEQ ID NO: 4277483 - DNA, 20 bp, Homo sapiens
ctgcagtgggttctccaaac

SEQ ID NO: 4277484 - DNA, 20 bp, Homo sapiens
ctgcagttagcacagaggat

SEQ ID NO: 4277485 - DNA, 17 bp, Homo sapiens
ctgcagttggcctcagc

SEQ ID NO: 4277486 - DNA, 23 bp, Homo sapiens
ctgcagttggcctcagcagaagg

SEQ ID NO: 4277487 - DNA, 12 bp, Homo sapiens
ctgcatcatctt

SEQ ID NO: 4277488 - DNA, 13 bp, Homo sapiens
ctgcatccctcca

SEQ ID NO: 4277489 - DNA, 21 bp, Homo sapiens
ctgcatccctccaccccagtc

SEQ ID NO: 4277490 - DNA, 22 bp, Homo sapiens
ctgcatccctccaccccagtcc

SEQ ID NO: 4277491 - DNA, 12 bp, Homo sapiens
ctgcatcctcag

SEQ ID NO: 4277492 - DNA, 18 bp, Homo sapiens
ctgcatcctcagccccag

SEQ ID NO: 4277493 - DNA, 19 bp, Homo sapiens
ctgcatcctcagccccagg

SEQ ID NO: 4277494 - DNA, 21 bp, Homo sapiens
ctgcatcctcagccccagggc

SEQ ID NO: 4277495 - DNA, 18 bp, Homo sapiens
ctgcatgctcctctgcct

SEQ ID NO: 4277496 - DNA, 20 bp, Homo sapiens
ctgcatgctcctctgcctgt

SEQ ID NO: 4277497 - DNA, 21 bp, Homo sapiens
ctgcatgctcctctgcctgtg

SEQ ID NO: 4277498 - DNA, 18 bp, Homo sapiens
ctgccaactttccagact

SEQ ID NO: 4277499 - DNA, 19 bp, Homo sapiens
ctgccaactttccagactt

SEQ ID NO: 4277500 - DNA, 17 bp, Homo sapiens
ctgccacacttcaggct

SEQ ID NO: 4277501 - DNA, 13 bp, Homo sapiens
ctgccactctcct

SEQ ID NO: 4277502 - DNA, 15 bp, Homo sapiens
ctgccactctcctga

SEQ ID NO: 4277503 - DNA, 21 bp, Homo sapiens
ctgccactgacaggaaagtgg

SEQ ID NO: 4277504 - DNA, 15 bp, Homo sapiens
ctgccagaggcctgg

SEQ ID NO: 4277505 - DNA, 18 bp, Homo sapiens
ctgccagaggcctggtgc

SEQ ID NO: 4277506 - DNA, 13 bp, Homo sapiens
ctgccagccgctg

SEQ ID NO: 4277507 - DNA, 24 bp, Homo sapiens
ctgccatcagcccctgctgctcct

SEQ ID NO: 4277508 - DNA, 20 bp, Homo sapiens
ctgccatgattttggccact

SEQ ID NO: 4277509 - DNA, 21 bp, Homo sapiens
ctgccatggaggcgccttcct

SEQ ID NO: 4277510 - DNA, 23 bp, Homo sapiens
ctgccatggaggcgccttcctgg

SEQ ID NO: 4277511 - DNA, 21 bp, Homo sapiens
ctgccattagactgaatttaa

SEQ ID NO: 4277512 - DNA, 13 bp, Homo sapiens
ctgccatttcatg

SEQ ID NO: 4277513 - DNA, 16 bp, Homo sapiens
ctgcccaccccctgct

SEQ ID NO: 4277514 - DNA, 15 bp, Homo sapiens
ctgcccaccccgcct

SEQ ID NO: 4277515 - DNA, 17 bp, Homo sapiens
ctgcccaccccgcctct

SEQ ID NO: 4277516 - DNA, 12 bp, Homo sapiens
ctgcccacccgt

SEQ ID NO: 4277517 - DNA, 19 bp, Homo sapiens
ctgcccacgctcctgccct

SEQ ID NO: 4277518 - DNA, 20 bp, Homo sapiens
ctgccccacacaggcctggc

SEQ ID NO: 4277519 - DNA, 17 bp, Homo sapiens
ctgccccacccctccat

SEQ ID NO: 4277520 - DNA, 21 bp, Homo sapiens
ctgccccagagaagcctcagt

SEQ ID NO: 4277521 - DNA, 23 bp, Homo sapiens
ctgcccccagctgctcctcgcag

SEQ ID NO: 4277522 - DNA, 13 bp, Homo sapiens
ctgccccccttcc

SEQ ID NO: 4277523 - DNA, 15 bp, Homo sapiens
ctgccccccttccca

SEQ ID NO: 4277524 - DNA, 22 bp, Homo sapiens
ctgccccccttcccacccctat

SEQ ID NO: 4277525 - DNA, 14 bp, Homo sapiens
ctgcccccttctcc

SEQ ID NO: 4277526 - DNA, 16 bp, Homo sapiens
ctgcccccttctccca

SEQ ID NO: 4277527 - DNA, 22 bp, Homo sapiens
ctgcccccttctcccacactgc

SEQ ID NO: 4277528 - DNA, 11 bp, Homo sapiens
ctgccccgccc

SEQ ID NO: 4277529 - DNA, 19 bp, Homo sapiens
ctgccccgccccccagagc

SEQ ID NO: 4277530 - DNA, 20 bp, Homo sapiens
ctgccccgccccccagagcc

SEQ ID NO: 4277531 - DNA, 14 bp, Homo sapiens
ctgccccggccact

SEQ ID NO: 4277532 - DNA, 17 bp, Homo sapiens
ctgccccggccactctg

SEQ ID NO: 4277533 - DNA, 21 bp, Homo sapiens
ctgccccgtcaccatctcagg

SEQ ID NO: 4277534 - DNA, 10 bp, Homo sapiens
ctgcccctgc

SEQ ID NO: 4277535 - DNA, 16 bp, Homo sapiens
ctgcccctgccccgtc

SEQ ID NO: 4277536 - DNA, 13 bp, Homo sapiens
ctgcccggggcag

SEQ ID NO: 4277537 - DNA, 17 bp, Homo sapiens
ctgccctagcagtttgc

SEQ ID NO: 4277538 - DNA, 22 bp, Homo sapiens
ctgccctagcagtttgcctctg

SEQ ID NO: 4277539 - DNA, 14 bp, Homo sapiens
ctgccctccatccc

SEQ ID NO: 4277540 - DNA, 20 bp, Homo sapiens
ctgccctgcaaaccgtgagg

SEQ ID NO: 4277541 - DNA, 12 bp, Homo sapiens
ctgccctggtgc

SEQ ID NO: 4277542 - DNA, 16 bp, Homo sapiens
ctgccctggtgctgcc

SEQ ID NO: 4277543 - DNA, 17 bp, Homo sapiens
ctgccctggtgctgcca

SEQ ID NO: 4277544 - DNA, 21 bp, Homo sapiens
ctgccctggtgctgccacact

SEQ ID NO: 4277545 - DNA, 16 bp, Homo sapiens
ctgccgaccgaggctg

SEQ ID NO: 4277546 - DNA, 21 bp, Homo sapiens
ctgccgaccgaggctggagct

SEQ ID NO: 4277547 - DNA, 14 bp, Homo sapiens
ctgccgtgagagcc

SEQ ID NO: 4277548 - DNA, 20 bp, Homo sapiens
ctgcctaaatccactctgca

SEQ ID NO: 4277549 - DNA, 20 bp, Homo sapiens
ctgcctacccaccccttccc

SEQ ID NO: 4277550 - DNA, 14 bp, Homo sapiens
ctgcctaggagctg

SEQ ID NO: 4277551 - DNA, 19 bp, Homo sapiens
ctgcctccccaaccctgcc

SEQ ID NO: 4277552 - DNA, 15 bp, Homo sapiens
ctgcctccggccctg

SEQ ID NO: 4277553 - DNA, 22 bp, Homo sapiens
ctgttgttcagaagttgttagt

SEQ ID NO: 4277554 - DNA, 16 bp, Homo sapiens
ctgtttaccctccctg

SEQ ID NO: 4277555 - DNA, 19 bp, Homo sapiens
ctgtttacttgaatagtat

SEQ ID NO: 4277556 - DNA, 12 bp, Homo sapiens
ctgtttgctcac

SEQ ID NO: 4277557 - DNA, 16 bp, Homo sapiens
ctgtttgctcacccag

SEQ ID NO: 4277558 - DNA, 21 bp, Homo sapiens
ctgttttatgtcatactctgt

SEQ ID NO: 4277559 - DNA, 22 bp, Homo sapiens
ctgttttgcctgaagttggagt

SEQ ID NO: 4277560 - DNA, 12 bp, Homo sapiens
ctgttttgtgcg

SEQ ID NO: 4277561 - DNA, 18 bp, Homo sapiens
ctgttttttcctgagctt

SEQ ID NO: 4277562 - DNA, 13 bp, Homo sapiens
cttaaaaatatgt

SEQ ID NO: 4277563 - DNA, 17 bp, Homo sapiens
cttaaaataatgattta

SEQ ID NO: 4277564 - DNA, 16 bp, Homo sapiens
cttaaaattagcatct

SEQ ID NO: 4277565 - DNA, 18 bp, Homo sapiens
cttaaacagttgcacagc

SEQ ID NO: 4277566 - DNA, 19 bp, Homo sapiens
cttaaacagttgcacagca

SEQ ID NO: 4277567 - DNA, 20 bp, Homo sapiens
cttaaacagttgcacagcat

SEQ ID NO: 4277568 - DNA, 22 bp, Homo sapiens
cttaaatagcatctgctcttct

SEQ ID NO: 4277569 - DNA, 23 bp, Homo sapiens
cttaacattaagtattccttggc

SEQ ID NO: 4277570 - DNA, 19 bp, Homo sapiens
cttaagaaagctatatatg

SEQ ID NO: 4277571 - DNA, 21 bp, Homo sapiens
cttaagaagtatccctgattt

SEQ ID NO: 4277572 - DNA, 19 bp, Homo sapiens
cttaatatatatatccaga

SEQ ID NO: 4277573 - DNA, 11 bp, Homo sapiens
cttaatatttc

SEQ ID NO: 4277574 - DNA, 15 bp, Homo sapiens
cttaatatttcttca

SEQ ID NO: 4277575 - DNA, 20 bp, Homo sapiens
cttaatatttcttcaaatat

SEQ ID NO: 4277576 - DNA, 20 bp, Homo sapiens
cttaccccgtccctttccct

SEQ ID NO: 4277577 - DNA, 23 bp, Homo sapiens
cttaccccgtccctttccctgca

SEQ ID NO: 4277578 - DNA, 19 bp, Homo sapiens
cttactttacctctctgtc

SEQ ID NO: 4277579 - DNA, 20 bp, Homo sapiens
cttactttacctctctgtca

SEQ ID NO: 4277580 - DNA, 17 bp, Homo sapiens
cttagaaattgcatttc

SEQ ID NO: 4277581 - DNA, 16 bp, Homo sapiens
cttagaagaatattgt

SEQ ID NO: 4277582 - DNA, 21 bp, Homo sapiens
cttagaagaatattgtattgt

SEQ ID NO: 4277583 - DNA, 17 bp, Homo sapiens
cttagaatactgtattg

SEQ ID NO: 4277584 - DNA, 14 bp, Homo sapiens
cttagactccttct

SEQ ID NO: 4277585 - DNA, 15 bp, Homo sapiens
cttagactccttctc

SEQ ID NO: 4277586 - DNA, 16 bp, Homo sapiens
cttagactccttctcc

SEQ ID NO: 4277587 - DNA, 15 bp, Homo sapiens
cttagcgttctgttt

SEQ ID NO: 4277588 - DNA, 20 bp, Homo sapiens
cttagctgaacaatgaatgc

SEQ ID NO: 4277589 - DNA, 21 bp, Homo sapiens
cttagctgccccttctgagga

SEQ ID NO: 4277590 - DNA, 16 bp, Homo sapiens
cttaggatttaccaaa

SEQ ID NO: 4277591 - DNA, 16 bp, Homo sapiens
cttagtttcagctgac

SEQ ID NO: 4277592 - DNA, 17 bp, Homo sapiens
cttataagcaacatgaa

SEQ ID NO: 4277593 - DNA, 15 bp, Homo sapiens
cttatgctgctgtga

SEQ ID NO: 4277594 - DNA, 14 bp, Homo sapiens
cttatgtcatttct

SEQ ID NO: 4277595 - DNA, 22 bp, Homo sapiens
cttatgtggggttgtcaaaact

SEQ ID NO: 4277596 - DNA, 20 bp, Homo sapiens
cttatgttgatcgatgttaa

SEQ ID NO: 4277597 - DNA, 23 bp, Homo sapiens
cttattgatattctaagaaatat

SEQ ID NO: 4277598 - DNA, 13 bp, Homo sapiens
cttatttctaaat

SEQ ID NO: 4277599 - DNA, 16 bp, Homo sapiens
cttatttctaactatt

SEQ ID NO: 4277600 - DNA, 13 bp, Homo sapiens
cttattttctgaa

SEQ ID NO: 4277601 - DNA, 19 bp, Homo sapiens
cttattttctgaattcata

SEQ ID NO: 4277602 - DNA, 22 bp, Homo sapiens
cttattttctgaattcataaaa

SEQ ID NO: 4277603 - DNA, 13 bp, Homo sapiens
cttcaaaacagaa

SEQ ID NO: 4277604 - DNA, 15 bp, Homo sapiens
cttcaaaatcagtga

SEQ ID NO: 4277605 - DNA, 18 bp, Homo sapiens
cttcaaacatgccctcag

SEQ ID NO: 4277606 - DNA, 20 bp, Homo sapiens
cttcaaacatgccctcaggc

SEQ ID NO: 4277607 - DNA, 23 bp, Homo sapiens
cttcaaacatgccctcaggcttg

SEQ ID NO: 4277608 - DNA, 16 bp, Homo sapiens
cttcaaccattcccca

SEQ ID NO: 4277609 - DNA, 13 bp, Homo sapiens
cttcaagcctggc

SEQ ID NO: 4277610 - DNA, 18 bp, Homo sapiens
cttcaagcctggcccagt

SEQ ID NO: 4277611 - DNA, 20 bp, Homo sapiens
cttcaatctacgatgttaaa

SEQ ID NO: 4277612 - DNA, 13 bp, Homo sapiens
cttcacccagcac

SEQ ID NO: 4277613 - DNA, 16 bp, Homo sapiens
cttcacttctgaccac

SEQ ID NO: 4277614 - DNA, 21 bp, Homo sapiens
cttcacttctgaccacacttc

SEQ ID NO: 4277615 - DNA, 21 bp, Homo sapiens
cttcagactctctcctctctc

SEQ ID NO: 4277616 - DNA, 15 bp, Homo sapiens
cttcagcatcctcag

SEQ ID NO: 4277617 - DNA, 13 bp, Homo sapiens
cttcagcccctgg

SEQ ID NO: 4277618 - DNA, 14 bp, Homo sapiens
cttcaggcaccaca

SEQ ID NO: 4277619 - DNA, 14 bp, Homo sapiens
cttcaggctcttct

SEQ ID NO: 4277620 - DNA, 16 bp, Homo sapiens
cttcaggctcttctcc

SEQ ID NO: 4277621 - DNA, 18 bp, Homo sapiens
cttcataaattatttcta

SEQ ID NO: 4277622 - DNA, 17 bp, Homo sapiens
cttcataggcagagccc

SEQ ID NO: 4277623 - DNA, 20 bp, Homo sapiens
cttcataggcagagcccgcc

SEQ ID NO: 4277624 - DNA, 14 bp, Homo sapiens
cttcatgctgtctg

SEQ ID NO: 4277625 - DNA, 14 bp, Homo sapiens
cttcatggaactca

SEQ ID NO: 4277626 - DNA, 19 bp, Homo sapiens
cttcatggccatagctttt

SEQ ID NO: 4277627 - DNA, 12 bp, Homo sapiens
cttcatgtaaat

SEQ ID NO: 4277628 - DNA, 13 bp, Homo sapiens
cttcatgtaaatt

SEQ ID NO: 4277629 - DNA, 12 bp, Homo sapiens
cttcatttaaaa

SEQ ID NO: 4277630 - DNA, 14 bp, Homo sapiens
cttccaaagagtca

SEQ ID NO: 4277631 - DNA, 17 bp, Homo sapiens
cttccacgctgtctcca

SEQ ID NO: 4277632 - DNA, 21 bp, Homo sapiens
cttccacgctgtctccagacc

SEQ ID NO: 4277633 - DNA, 11 bp, Homo sapiens
cttccaggccc

SEQ ID NO: 4277634 - DNA, 18 bp, Homo sapiens
cttccaggccccaggctg

SEQ ID NO: 4277635 - DNA, 19 bp, Homo sapiens
cttccaggccccaggctgg

SEQ ID NO: 4277636 - DNA, 20 bp, Homo sapiens
cttccaggccccaggctgga

SEQ ID NO: 4277637 - DNA, 23 bp, Homo sapiens
cttccaggcgtagggccagggct

SEQ ID NO: 4277638 - DNA, 18 bp, Homo sapiens
cttccagtgatgttgaaa

SEQ ID NO: 4277639 - DNA, 19 bp, Homo sapiens
cttccagttggactgtggc

SEQ ID NO: 4277640 - DNA, 21 bp, Homo sapiens
cttccagttggactgtggcct

SEQ ID NO: 4277641 - DNA, 18 bp, Homo sapiens
cttccatcagcagtgatt

SEQ ID NO: 4277642 - DNA, 23 bp, Homo sapiens
cttccatcagcagtgattgaagt

SEQ ID NO: 4277643 - DNA, 13 bp, Homo sapiens
cttccatggtggt

SEQ ID NO: 4277644 - DNA, 22 bp, Homo sapiens
cttcccaacctcccctggtcct

SEQ ID NO: 4277645 - DNA, 20 bp, Homo sapiens
cttcccaccaactctctctg

SEQ ID NO: 4277646 - DNA, 12 bp, Homo sapiens
cttcccacccct

SEQ ID NO: 4277647 - DNA, 13 bp, Homo sapiens
cttcccatttgta

SEQ ID NO: 4277648 - DNA, 15 bp, Homo sapiens
cttcccatttgtaat

SEQ ID NO: 4277649 - DNA, 11 bp, Homo sapiens
cttccccactc

SEQ ID NO: 4277650 - DNA, 12 bp, Homo sapiens
cttccccactcc

SEQ ID NO: 4277651 - DNA, 19 bp, Homo sapiens
cttccccactgcctgccca

SEQ ID NO: 4277652 - DNA, 13 bp, Homo sapiens
cttccccctccat

SEQ ID NO: 4277653 - DNA, 12 bp, Homo sapiens
cttcccccttcc

SEQ ID NO: 4277654 - DNA, 17 bp, Homo sapiens
cttcccgctcagccctc

SEQ ID NO: 4277655 - DNA, 17 bp, Homo sapiens
cttccctctgcctgtcc

SEQ ID NO: 4277656 - DNA, 12 bp, Homo sapiens
cttccctctgct

SEQ ID NO: 4277657 - DNA, 18 bp, Homo sapiens
cttccctctgctccacag

SEQ ID NO: 4277658 - DNA, 16 bp, Homo sapiens
cttccctgacactgtc

SEQ ID NO: 4277659 - DNA, 24 bp, Homo sapiens
cttccctgacactgtctgctgccc

SEQ ID NO: 4277660 - DNA, 18 bp, Homo sapiens
cttccggctgagctgtgc

SEQ ID NO: 4277661 - DNA, 23 bp, Homo sapiens
cttccggctgagctgtgccagct

SEQ ID NO: 4277662 - DNA, 16 bp, Homo sapiens
cttcctccctccctgc

SEQ ID NO: 4277663 - DNA, 18 bp, Homo sapiens
cttcctccctccctgcag

SEQ ID NO: 4277664 - DNA, 14 bp, Homo sapiens
cttcctctccactg

SEQ ID NO: 4277665 - DNA, 13 bp, Homo sapiens
cttcctgccctag

SEQ ID NO: 4277666 - DNA, 16 bp, Homo sapiens
cttcctgccctagcag

SEQ ID NO: 4277667 - DNA, 16 bp, Homo sapiens
cttcctgggcagccca

SEQ ID NO: 4277668 - DNA, 19 bp, Homo sapiens
cttcctgggcagcccagag

SEQ ID NO: 4277669 - DNA, 17 bp, Homo sapiens
cttcctgttctgtgtct

SEQ ID NO: 4277670 - DNA, 21 bp, Homo sapiens
cttcctgttctgtgtctgctg

SEQ ID NO: 4277671 - DNA, 23 bp, Homo sapiens
cttcctgttctgtgtctgctgta

SEQ ID NO: 4277672 - DNA, 16 bp, Homo sapiens
cttcgatacaccgggc

SEQ ID NO: 4277673 - DNA, 21 bp, Homo sapiens
cttcgatacaccgggcctgga

SEQ ID NO: 4277674 - DNA, 18 bp, Homo sapiens
cttcgccatgtgctgtgc

SEQ ID NO: 4277675 - DNA, 23 bp, Homo sapiens
cttctaaaggtttcactgttcat

SEQ ID NO: 4277676 - DNA, 13 bp, Homo sapiens
cttctccactgga

SEQ ID NO: 4277677 - DNA, 17 bp, Homo sapiens
cttctccactggatgga

SEQ ID NO: 4277678 - DNA, 13 bp, Homo sapiens
cttctcccacact

SEQ ID NO: 4277679 - DNA, 14 bp, Homo sapiens
cttctcccacactg

SEQ ID NO: 4277680 - DNA, 12 bp, Homo sapiens
cttctcccctcc

SEQ ID NO: 4277681 - DNA, 14 bp, Homo sapiens
cttctcccctccag

SEQ ID NO: 4277682 - DNA, 15 bp, Homo sapiens
cttctcccctccaga

SEQ ID NO: 4277683 - DNA, 16 bp, Homo sapiens
cttctccctggactct

SEQ ID NO: 4277684 - DNA, 14 bp, Homo sapiens
gagaaaagattaaa

SEQ ID NO: 4277685 - DNA, 22 bp, Homo sapiens
gagaacacaagccacgcctgcg

SEQ ID NO: 4277686 - DNA, 14 bp, Homo sapiens
gagaacttgaacaa

SEQ ID NO: 4277687 - DNA, 21 bp, Homo sapiens
gagaagcatcggagggaattg

SEQ ID NO: 4277688 - DNA, 19 bp, Homo sapiens
gagaagcctcagtccctcc

SEQ ID NO: 4277689 - DNA, 16 bp, Homo sapiens
gagaagcctcatggga

SEQ ID NO: 4277690 - DNA, 15 bp, Homo sapiens
gagaaggagaggctc

SEQ ID NO: 4277691 - DNA, 18 bp, Homo sapiens
gagaaggcctgcccccct

SEQ ID NO: 4277692 - DNA, 21 bp, Homo sapiens
gagaaggcctgccccccttcc

SEQ ID NO: 4277693 - DNA, 23 bp, Homo sapiens
gagaaggcctgccccccttccca

SEQ ID NO: 4277694 - DNA, 22 bp, Homo sapiens
gagaagggttagacaagcctgg

SEQ ID NO: 4277695 - DNA, 23 bp, Homo sapiens
gagaagggttagacaagcctgga

SEQ ID NO: 4277696 - DNA, 23 bp, Homo sapiens
gagaagtgcccctgctgcctccc

SEQ ID NO: 4277697 - DNA, 21 bp, Homo sapiens
gagaataaatgagcatttttt

SEQ ID NO: 4277698 - DNA, 19 bp, Homo sapiens
gagaatgagagagtgtgga

SEQ ID NO: 4277699 - DNA, 14 bp, Homo sapiens
gagaatggctctgg

SEQ ID NO: 4277700 - DNA, 12 bp, Homo sapiens
gagaattaaaat

SEQ ID NO: 4277701 - DNA, 13 bp, Homo sapiens
gagaattaaaata

SEQ ID NO: 4277702 - DNA, 14 bp, Homo sapiens
gagacactggtctc

SEQ ID NO: 4277703 - DNA, 22 bp, Homo sapiens
gagacactggtctcagaggagg

SEQ ID NO: 4277704 - DNA, 18 bp, Homo sapiens
gagaccacccatatcatg

SEQ ID NO: 4277705 - DNA, 12 bp, Homo sapiens
gagaccaggact

SEQ ID NO: 4277706 - DNA, 15 bp, Homo sapiens
gagaccaggactctg

SEQ ID NO: 4277707 - DNA, 18 bp, Homo sapiens
gagaccctgggagagtga

SEQ ID NO: 4277708 - DNA, 16 bp, Homo sapiens
gagaccgagtgtggag

SEQ ID NO: 4277709 - DNA, 20 bp, Homo sapiens
gagaccgagtgtggagctgc

SEQ ID NO: 4277710 - DNA, 15 bp, Homo sapiens
gagactatgtgtcat

SEQ ID NO: 4277711 - DNA, 12 bp, Homo sapiens
gagactcaggcc

SEQ ID NO: 4277712 - DNA, 23 bp, Homo sapiens
gagactgtctcaagagggcactg

SEQ ID NO: 4277713 - DNA, 20 bp, Homo sapiens
gagacttaggccagaggtga

SEQ ID NO: 4277714 - DNA, 15 bp, Homo sapiens
gagagaagcacccca

SEQ ID NO: 4277715 - DNA, 15 bp, Homo sapiens
gagagaccctgccaa

SEQ ID NO: 4277716 - DNA, 15 bp, Homo sapiens
gagagaccttctctt

SEQ ID NO: 4277717 - DNA, 17 bp, Homo sapiens
gagagatatatctgaaa

SEQ ID NO: 4277718 - DNA, 18 bp, Homo sapiens
gagagatatatctgaaaa

SEQ ID NO: 4277719 - DNA, 19 bp, Homo sapiens
gagagcccaatcactgcct

SEQ ID NO: 4277720 - DNA, 18 bp, Homo sapiens
gagagcccccaccagcag

SEQ ID NO: 4277721 - DNA, 20 bp, Homo sapiens
gagagcccccaccagcagca

SEQ ID NO: 4277722 - DNA, 21 bp, Homo sapiens
gagagcggcttccccatcgcc

SEQ ID NO: 4277723 - DNA, 15 bp, Homo sapiens
gagaggaaaaaggct

SEQ ID NO: 4277724 - DNA, 13 bp, Homo sapiens
gagaggaagccac

SEQ ID NO: 4277725 - DNA, 23 bp, Homo sapiens
gagaggaagccacgtgctggaga

SEQ ID NO: 4277726 - DNA, 13 bp, Homo sapiens
gagaggagagaat

SEQ ID NO: 4277727 - DNA, 19 bp, Homo sapiens
gagaggagcgggacctgtg

SEQ ID NO: 4277728 - DNA, 22 bp, Homo sapiens
gagaggagcgggacctgtggct

SEQ ID NO: 4277729 - DNA, 12 bp, Homo sapiens
gagaggccatga

SEQ ID NO: 4277730 - DNA, 23 bp, Homo sapiens
gagaggctctgaaagctgcttct

SEQ ID NO: 4277731 - DNA, 13 bp, Homo sapiens
gagagtggctcct

SEQ ID NO: 4277732 - DNA, 14 bp, Homo sapiens
gagatattttgtaa

SEQ ID NO: 4277733 - DNA, 19 bp, Homo sapiens
gagatccgccctgggctct

SEQ ID NO: 4277734 - DNA, 23 bp, Homo sapiens
gagatccgccctgggctctgggt

SEQ ID NO: 4277735 - DNA, 12 bp, Homo sapiens
gagatgatttcc

SEQ ID NO: 4277736 - DNA, 16 bp, Homo sapiens
gagatgcagtgccagg

SEQ ID NO: 4277737 - DNA, 23 bp, Homo sapiens
gagatggaacccttttggccccc

SEQ ID NO: 4277738 - DNA, 18 bp, Homo sapiens
gagatggtgccccctggg

SEQ ID NO: 4277739 - DNA, 19 bp, Homo sapiens
gagatggtgccccctgggg

SEQ ID NO: 4277740 - DNA, 18 bp, Homo sapiens
gagatgtaccatgttaaa

SEQ ID NO: 4277741 - DNA, 16 bp, Homo sapiens
gagatgtgtatcagtg

SEQ ID NO: 4277742 - DNA, 15 bp, Homo sapiens
gagatttgtatttat

SEQ ID NO: 4277743 - DNA, 21 bp, Homo sapiens
gagatttgtatttatattaga

SEQ ID NO: 4277744 - DNA, 23 bp, Homo sapiens
gagcaagctgtacaaagggaagc

SEQ ID NO: 4277745 - DNA, 24 bp, Homo sapiens
gagcagcacgccaaccccagcagt

SEQ ID NO: 4277746 - DNA, 18 bp, Homo sapiens
gagcagcccacctgctgc

SEQ ID NO: 4277747 - DNA, 12 bp, Homo sapiens
gagcagggtgac

SEQ ID NO: 4277748 - DNA, 14 bp, Homo sapiens
gagcagtgggccct

SEQ ID NO: 4277749 - DNA, 19 bp, Homo sapiens
gagcagtgggccctggctc

SEQ ID NO: 4277750 - DNA, 17 bp, Homo sapiens
gagcatgagccagctct

SEQ ID NO: 4277751 - DNA, 16 bp, Homo sapiens
gagcattctggggtgg

SEQ ID NO: 4277752 - DNA, 19 bp, Homo sapiens
gagccaaggggtctgctcc

SEQ ID NO: 4277753 - DNA, 22 bp, Homo sapiens
gagccaaggggtctgctcctgt

SEQ ID NO: 4277754 - DNA, 12 bp, Homo sapiens
gagccactctgt

SEQ ID NO: 4277755 - DNA, 18 bp, Homo sapiens
gagccagattaggcctgg

SEQ ID NO: 4277756 - DNA, 12 bp, Homo sapiens
gagccagctccc

SEQ ID NO: 4277757 - DNA, 20 bp, Homo sapiens
gagccagctctgtcccagga

SEQ ID NO: 4277758 - DNA, 12 bp, Homo sapiens
gagccagggctg

SEQ ID NO: 4277759 - DNA, 18 bp, Homo sapiens
gagccagggctgtcctta

SEQ ID NO: 4277760 - DNA, 22 bp, Homo sapiens
gagccatgatgtggagtggggc

SEQ ID NO: 4277761 - DNA, 11 bp, Homo sapiens
gagcccactcc

SEQ ID NO: 4277762 - DNA, 12 bp, Homo sapiens
gagcccactcct

SEQ ID NO: 4277763 - DNA, 12 bp, Homo sapiens
gagcccccacca

SEQ ID NO: 4277764 - DNA, 24 bp, Homo sapiens
gagccccgccgtgtctgtggccct

SEQ ID NO: 4277765 - DNA, 18 bp, Homo sapiens
gagcccctatcctgcacc

SEQ ID NO: 4277766 - DNA, 16 bp, Homo sapiens
gagcccgcccacctgg

SEQ ID NO: 4277767 - DNA, 17 bp, Homo sapiens
gagcccgcccacctggg

SEQ ID NO: 4277768 - DNA, 19 bp, Homo sapiens
gagccctgccctcactcca

SEQ ID NO: 4277769 - DNA, 22 bp, Homo sapiens
gagccctggggtttccacacag

SEQ ID NO: 4277770 - DNA, 15 bp, Homo sapiens
gagccgagctctcct

SEQ ID NO: 4277771 - DNA, 16 bp, Homo sapiens
gagccgagctctcctg

SEQ ID NO: 4277772 - DNA, 21 bp, Homo sapiens
gagccgagctctcctgggcca

SEQ ID NO: 4277773 - DNA, 16 bp, Homo sapiens
gagccgtcagcctgtg

SEQ ID NO: 4277774 - DNA, 22 bp, Homo sapiens
gagccgtgacctccaggaaggg

SEQ ID NO: 4277775 - DNA, 23 bp, Homo sapiens
gagcctatggaaagggtgtggct

SEQ ID NO: 4277776 - DNA, 11 bp, Homo sapiens
gagcctccctc

SEQ ID NO: 4277777 - DNA, 16 bp, Homo sapiens
gagcctgcttgctgat

SEQ ID NO: 4277778 - DNA, 12 bp, Homo sapiens
gagcctggggtg

SEQ ID NO: 4277779 - DNA, 18 bp, Homo sapiens
gagcctgtgttagtgtct

SEQ ID NO: 4277780 - DNA, 20 bp, Homo sapiens
gagcctgtgttagtgtctgt

SEQ ID NO: 4277781 - DNA, 19 bp, Homo sapiens
gagccttagtttcagctga

SEQ ID NO: 4277782 - DNA, 17 bp, Homo sapiens
gagcgacggctcctccc

SEQ ID NO: 4277783 - DNA, 17 bp, Homo sapiens
gagcgctggcctcttcc

SEQ ID NO: 4277784 - DNA, 12 bp, Homo sapiens
gagcggccgcct

SEQ ID NO: 4277785 - DNA, 23 bp, Homo sapiens
gagcggcttccccattgccttct

SEQ ID NO: 4277786 - DNA, 14 bp, Homo sapiens
gagcgggacctgtg

SEQ ID NO: 4277787 - DNA, 17 bp, Homo sapiens
gagcgggacctgtggct

SEQ ID NO: 4277788 - DNA, 18 bp, Homo sapiens
gagcgtgtactaccccag

SEQ ID NO: 4277789 - DNA, 18 bp, Homo sapiens
gagcgtgtcctatccccg

SEQ ID NO: 4277790 - DNA, 15 bp, Homo sapiens
gagctaacactggcc

SEQ ID NO: 4277791 - DNA, 19 bp, Homo sapiens
gagctaacactggccccta

SEQ ID NO: 4277792 - DNA, 18 bp, Homo sapiens
gagctcagcacagcctca

SEQ ID NO: 4277793 - DNA, 18 bp, Homo sapiens
gagctcaggagaaggcct

SEQ ID NO: 4277794 - DNA, 13 bp, Homo sapiens
gagctcagggctg

SEQ ID NO: 4277795 - DNA, 14 bp, Homo sapiens
gagctcagggctgg

SEQ ID NO: 4277796 - DNA, 17 bp, Homo sapiens
gagctcagggctggatt

SEQ ID NO: 4277797 - DNA, 22 bp, Homo sapiens
gagctcagggctggattggcag

SEQ ID NO: 4277798 - DNA, 15 bp, Homo sapiens
gagctcccaggacgc

SEQ ID NO: 4277799 - DNA, 21 bp, Homo sapiens
gagctctcctgggccagggtc

SEQ ID NO: 4277800 - DNA, 15 bp, Homo sapiens
gagctcttggcagga

SEQ ID NO: 4277801 - DNA, 13 bp, Homo sapiens
gagctgagatgga

SEQ ID NO: 4277802 - DNA, 14 bp, Homo sapiens
gagctgaggggcag

SEQ ID NO: 4277803 - DNA, 11 bp, Homo sapiens
gagctgcagaa

SEQ ID NO: 4277804 - DNA, 21 bp, Homo sapiens
gagctggcctattttggacgt

SEQ ID NO: 4277805 - DNA, 16 bp, Homo sapiens
gagctggcgtctgtct

SEQ ID NO: 4277806 - DNA, 21 bp, Homo sapiens
gagctggggagggagagatct

SEQ ID NO: 4277807 - DNA, 13 bp, Homo sapiens
gagcttctccagc

SEQ ID NO: 4277808 - DNA, 18 bp, Homo sapiens
gagcttgattctaaaggg

SEQ ID NO: 4277809 - DNA, 19 bp, Homo sapiens
gagcttgattctaaagggg

SEQ ID NO: 4277810 - DNA, 22 bp, Homo sapiens
gagcttgattctaaaggggaca

SEQ ID NO: 4277811 - DNA, 14 bp, Homo sapiens
gagcttggccagaa

SEQ ID NO: 4277812 - DNA, 15 bp, Homo sapiens
gagcttggccagaag

SEQ ID NO: 4277813 - DNA, 14 bp, Homo sapiens
gaggaaaaaggctg

SEQ ID NO: 4277814 - DNA, 22 bp, Homo sapiens
gcaggttgtgtgtgtgtgcagt

SEQ ID NO: 4277815 - DNA, 15 bp, Homo sapiens
gcagtacttgctcaa

SEQ ID NO: 4277816 - DNA, 14 bp, Homo sapiens
gcagtgagatgtca

SEQ ID NO: 4277817 - DNA, 14 bp, Homo sapiens
gcagtggagagggg

SEQ ID NO: 4277818 - DNA, 15 bp, Homo sapiens
gcagtggagagggga

SEQ ID NO: 4277819 - DNA, 21 bp, Homo sapiens
gcagtggagaggggacttgga

SEQ ID NO: 4277820 - DNA, 19 bp, Homo sapiens
gcagtgggccctggctctg

SEQ ID NO: 4277821 - DNA, 15 bp, Homo sapiens
gcagtgtgagggtgc

SEQ ID NO: 4277822 - DNA, 21 bp, Homo sapiens
gcagttaccgaggagctaaac

SEQ ID NO: 4277823 - DNA, 15 bp, Homo sapiens
gcagttggcctcagc

SEQ ID NO: 4277824 - DNA, 21 bp, Homo sapiens
gcagttgttatattcattctt

SEQ ID NO: 4277825 - DNA, 16 bp, Homo sapiens
gcagtttgcctctgca

SEQ ID NO: 4277826 - DNA, 17 bp, Homo sapiens
gcagtttgcctctgcac

SEQ ID NO: 4277827 - DNA, 18 bp, Homo sapiens
gcagtttgcctctgcacg

SEQ ID NO: 4277828 - DNA, 18 bp, Homo sapiens
gcataagcctcaggcctg

SEQ ID NO: 4277829 - DNA, 23 bp, Homo sapiens
gcatacccagtgtctaccttcat

SEQ ID NO: 4277830 - DNA, 14 bp, Homo sapiens
gcatactctccagg

SEQ ID NO: 4277831 - DNA, 17 bp, Homo sapiens
gcatcaacctaggagca

SEQ ID NO: 4277832 - DNA, 23 bp, Homo sapiens
gcatcaacctaggagcagtgggc

SEQ ID NO: 4277833 - DNA, 21 bp, Homo sapiens
gcatccatgcggccggcctgg

SEQ ID NO: 4277834 - DNA, 12 bp, Homo sapiens
gcatccccagcc

SEQ ID NO: 4277835 - DNA, 15 bp, Homo sapiens
gcatccccagccccc

SEQ ID NO: 4277836 - DNA, 19 bp, Homo sapiens
gcatccccagccccctggc

SEQ ID NO: 4277837 - DNA, 15 bp, Homo sapiens
gcatcctcagcccca

SEQ ID NO: 4277838 - DNA, 16 bp, Homo sapiens
gcatcctcagccccag

SEQ ID NO: 4277839 - DNA, 18 bp, Homo sapiens
gcatcctcagccccaggg

SEQ ID NO: 4277840 - DNA, 20 bp, Homo sapiens
gcatcctcagccccagggcc

SEQ ID NO: 4277841 - DNA, 18 bp, Homo sapiens
gcatctatctggtgattt

SEQ ID NO: 4277842 - DNA, 20 bp, Homo sapiens
gcatctatctggtgatttct

SEQ ID NO: 4277843 - DNA, 13 bp, Homo sapiens
gcatctcagccca

SEQ ID NO: 4277844 - DNA, 16 bp, Homo sapiens
gcatctccaggaaggc

SEQ ID NO: 4277845 - DNA, 15 bp, Homo sapiens
gcatctggccctgct

SEQ ID NO: 4277846 - DNA, 21 bp, Homo sapiens
gcatctggccctgctgccccc

SEQ ID NO: 4277847 - DNA, 22 bp, Homo sapiens
gcatgaaactatgcacctataa

SEQ ID NO: 4277848 - DNA, 15 bp, Homo sapiens
gcatgacaagcccca

SEQ ID NO: 4277849 - DNA, 17 bp, Homo sapiens
gcatgacaagccccagg

SEQ ID NO: 4277850 - DNA, 21 bp, Homo sapiens
gcatgacaagccccaggcagg

SEQ ID NO: 4277851 - DNA, 12 bp, Homo sapiens
gcatgaccctgg

SEQ ID NO: 4277852 - DNA, 16 bp, Homo sapiens
gcatgaccctggagcc

SEQ ID NO: 4277853 - DNA, 13 bp, Homo sapiens
gcatgcctgtgtg

SEQ ID NO: 4277854 - DNA, 18 bp, Homo sapiens
gcatgcggcaaaccgcat

SEQ ID NO: 4277855 - DNA, 14 bp, Homo sapiens
gcatgctcctctgc

SEQ ID NO: 4277856 - DNA, 16 bp, Homo sapiens
gcatgctcctctgcct

SEQ ID NO: 4277857 - DNA, 21 bp, Homo sapiens
gcatgctcttacccacactac

SEQ ID NO: 4277858 - DNA, 17 bp, Homo sapiens
gcatgctgcctgcctcc

SEQ ID NO: 4277859 - DNA, 14 bp, Homo sapiens
gcatggccaggtgg

SEQ ID NO: 4277860 - DNA, 17 bp, Homo sapiens
gcatggccaggtggcca

SEQ ID NO: 4277861 - DNA, 16 bp, Homo sapiens
gcatggcctcccagcc

SEQ ID NO: 4277862 - DNA, 19 bp, Homo sapiens
gcatggcctcccagccacc

SEQ ID NO: 4277863 - DNA, 15 bp, Homo sapiens
gcatggctccagtct

SEQ ID NO: 4277864 - DNA, 18 bp, Homo sapiens
gcatggggtgggcctctg

SEQ ID NO: 4277865 - DNA, 23 bp, Homo sapiens
gcatgtccctaccgagtctcttc

SEQ ID NO: 4277866 - DNA, 18 bp, Homo sapiens
gcatgtcctatccctgga

SEQ ID NO: 4277867 - DNA, 15 bp, Homo sapiens
gcattagctaaaacc

SEQ ID NO: 4277868 - DNA, 24 bp, Homo sapiens
gcattcaaaatagttctatttcta

SEQ ID NO: 4277869 - DNA, 14 bp, Homo sapiens
gcattgaaataata

SEQ ID NO: 4277870 - DNA, 18 bp, Homo sapiens
gcattgaaataataatat

SEQ ID NO: 4277871 - DNA, 14 bp, Homo sapiens
gcatttctgggcct

SEQ ID NO: 4277872 - DNA, 15 bp, Homo sapiens
gcatttgtgagccaa

SEQ ID NO: 4277873 - DNA, 17 bp, Homo sapiens
gcattttctgcatctcc

SEQ ID NO: 4277874 - DNA, 18 bp, Homo sapiens
gcattttctgcatctcca

SEQ ID NO: 4277875 - DNA, 17 bp, Homo sapiens
gcatttttacctttcat

SEQ ID NO: 4277876 - DNA, 22 bp, Homo sapiens
gccaaacactttacagttctgg

SEQ ID NO: 4277877 - DNA, 21 bp, Homo sapiens
gccaaacattcttattttaga

SEQ ID NO: 4277878 - DNA, 22 bp, Homo sapiens
gccaaatcctgggcatccccag

SEQ ID NO: 4277879 - DNA, 16 bp, Homo sapiens
gccaaattgcagaaga

SEQ ID NO: 4277880 - DNA, 18 bp, Homo sapiens
gccaaattgcagaagaaa

SEQ ID NO: 4277881 - DNA, 18 bp, Homo sapiens
gccaaccacctctggccc

SEQ ID NO: 4277882 - DNA, 23 bp, Homo sapiens
gccaaccacctctggccctgttg

SEQ ID NO: 4277883 - DNA, 17 bp, Homo sapiens
gccaaccccagcagtcc

SEQ ID NO: 4277884 - DNA, 16 bp, Homo sapiens
gccaactttccagact

SEQ ID NO: 4277885 - DNA, 15 bp, Homo sapiens
gccaagaattagatt

SEQ ID NO: 4277886 - DNA, 19 bp, Homo sapiens
gccaagccagggttccaga

SEQ ID NO: 4277887 - DNA, 14 bp, Homo sapiens
gccaagcctgcccc

SEQ ID NO: 4277888 - DNA, 15 bp, Homo sapiens
gccaagcctgccccg

SEQ ID NO: 4277889 - DNA, 18 bp, Homo sapiens
gccaaggggtctgctcct

SEQ ID NO: 4277890 - DNA, 16 bp, Homo sapiens
gccaagtgcaggctgg

SEQ ID NO: 4277891 - DNA, 13 bp, Homo sapiens
gccaagtgtcctg

SEQ ID NO: 4277892 - DNA, 15 bp, Homo sapiens
gccaagtgtcctgct

SEQ ID NO: 4277893 - DNA, 23 bp, Homo sapiens
gccacacttcaggctcttctcct

SEQ ID NO: 4277894 - DNA, 23 bp, Homo sapiens
gccacccggatctccaggcccag

SEQ ID NO: 4277895 - DNA, 16 bp, Homo sapiens
gccaccctctgcaggg

SEQ ID NO: 4277896 - DNA, 17 bp, Homo sapiens
gccaccctctgcagggc

SEQ ID NO: 4277897 - DNA, 12 bp, Homo sapiens
gccaccctgcca

SEQ ID NO: 4277898 - DNA, 14 bp, Homo sapiens
gccaccctgccatg

SEQ ID NO: 4277899 - DNA, 13 bp, Homo sapiens
gccacctgccccc

SEQ ID NO: 4277900 - DNA, 16 bp, Homo sapiens
gccacctgcccccttc

SEQ ID NO: 4277901 - DNA, 16 bp, Homo sapiens
gccacgcgctctgcat

SEQ ID NO: 4277902 - DNA, 22 bp, Homo sapiens
gccacgcgctctgcatgctcct

SEQ ID NO: 4277903 - DNA, 11 bp, Homo sapiens
gccacggggga

SEQ ID NO: 4277904 - DNA, 21 bp, Homo sapiens
gccacgggggaggccgaggca

SEQ ID NO: 4277905 - DNA, 19 bp, Homo sapiens
gccactccagacccctggc

SEQ ID NO: 4277906 - DNA, 20 bp, Homo sapiens
gccactccagacccctggct

SEQ ID NO: 4277907 - DNA, 21 bp, Homo sapiens
gccactccagacccctggctt

SEQ ID NO: 4277908 - DNA, 13 bp, Homo sapiens
gccactctgttcc

SEQ ID NO: 4277909 - DNA, 17 bp, Homo sapiens
gccactctgtttgctca

SEQ ID NO: 4277910 - DNA, 18 bp, Homo sapiens
gccactctgtttgctcac

SEQ ID NO: 4277911 - DNA, 21 bp, Homo sapiens
gccactctgtttgctcaccca

SEQ ID NO: 4277912 - DNA, 20 bp, Homo sapiens
gccagagctcccaggacgca

SEQ ID NO: 4277913 - DNA, 17 bp, Homo sapiens
gccagaggaagggaggc

SEQ ID NO: 4277914 - DNA, 22 bp, Homo sapiens
gccagaggaagggaggcctgag

SEQ ID NO: 4277915 - DNA, 23 bp, Homo sapiens
gccagaggaagggaggcctgagg

SEQ ID NO: 4277916 - DNA, 13 bp, Homo sapiens
gccagaggcctgg

SEQ ID NO: 4277917 - DNA, 20 bp, Homo sapiens
gccagaggcctggtgccctg

SEQ ID NO: 4277918 - DNA, 16 bp, Homo sapiens
gccagatgacagggag

SEQ ID NO: 4277919 - DNA, 16 bp, Homo sapiens
gccagattaggcctgg

SEQ ID NO: 4277920 - DNA, 17 bp, Homo sapiens
gccagattaggcctgga

SEQ ID NO: 4277921 - DNA, 21 bp, Homo sapiens
gccagcagggcgggccaggag

SEQ ID NO: 4277922 - DNA, 18 bp, Homo sapiens
gccagcaggttctctcct

SEQ ID NO: 4277923 - DNA, 14 bp, Homo sapiens
gccagcccagatgg

SEQ ID NO: 4277924 - DNA, 15 bp, Homo sapiens
gccagcccagatggc

SEQ ID NO: 4277925 - DNA, 19 bp, Homo sapiens
gccagcccagatggctccc

SEQ ID NO: 4277926 - DNA, 12 bp, Homo sapiens
gccagcccctcc

SEQ ID NO: 4277927 - DNA, 16 bp, Homo sapiens
gccagcccctcccacc

SEQ ID NO: 4277928 - DNA, 17 bp, Homo sapiens
gccagcccctcccacca

SEQ ID NO: 4277929 - DNA, 14 bp, Homo sapiens
gccagctgcttctg

SEQ ID NO: 4277930 - DNA, 11 bp, Homo sapiens
gccaggagacc

SEQ ID NO: 4277931 - DNA, 14 bp, Homo sapiens
gccaggagaccctg

SEQ ID NO: 4277932 - DNA, 16 bp, Homo sapiens
gccaggagaccctgtc

SEQ ID NO: 4277933 - DNA, 16 bp, Homo sapiens
gccaggagtgggtggg

SEQ ID NO: 4277934 - DNA, 15 bp, Homo sapiens
gccaggcctcatcct

SEQ ID NO: 4277935 - DNA, 14 bp, Homo sapiens
gccagggctctggc

SEQ ID NO: 4277936 - DNA, 13 bp, Homo sapiens
gccagggttccag

SEQ ID NO: 4277937 - DNA, 22 bp, Homo sapiens
gccagggttccagacagggtgg

SEQ ID NO: 4277938 - DNA, 18 bp, Homo sapiens
gccaggtggccactccag

SEQ ID NO: 4277939 - DNA, 13 bp, Homo sapiens
gccagtgactcca

SEQ ID NO: 4277940 - DNA, 18 bp, Homo sapiens
gccagtgactccaggaga

SEQ ID NO: 4277941 - DNA, 18 bp, Homo sapiens
gccatcagcccctgctgc

SEQ ID NO: 4277942 - DNA, 22 bp, Homo sapiens
gccatccggcccccagagcgcc

SEQ ID NO: 4277943 - DNA, 16 bp, Homo sapiens
gccatgagctccagac

SEQ ID NO: 4277944 - DNA, 14 bp, Homo sapiens
gctggccagctgtg

SEQ ID NO: 4277945 - DNA, 16 bp, Homo sapiens
gctggccagctgtgcg

SEQ ID NO: 4277946 - DNA, 19 bp, Homo sapiens
gctggcccctcacctgggc

SEQ ID NO: 4277947 - DNA, 19 bp, Homo sapiens
gctggccctggctcccaca

SEQ ID NO: 4277948 - DNA, 19 bp, Homo sapiens
gctggctcccagggccatg

SEQ ID NO: 4277949 - DNA, 15 bp, Homo sapiens
gctggctcccatctc

SEQ ID NO: 4277950 - DNA, 12 bp, Homo sapiens
gctggctctgaa

SEQ ID NO: 4277951 - DNA, 14 bp, Homo sapiens
gctggctctgaatg

SEQ ID NO: 4277952 - DNA, 15 bp, Homo sapiens
gctggctctgcagca

SEQ ID NO: 4277953 - DNA, 19 bp, Homo sapiens
gctgggagaaaagccagat

SEQ ID NO: 4277954 - DNA, 11 bp, Homo sapiens
gctgggagagc

SEQ ID NO: 4277955 - DNA, 13 bp, Homo sapiens
gctgggcagaggg

SEQ ID NO: 4277956 - DNA, 16 bp, Homo sapiens
gctgggggccatgagc

SEQ ID NO: 4277957 - DNA, 18 bp, Homo sapiens
gctgggtggccggccctg

SEQ ID NO: 4277958 - DNA, 21 bp, Homo sapiens
gctgggttctggggctgagag

SEQ ID NO: 4277959 - DNA, 12 bp, Homo sapiens
gctggtcacccc

SEQ ID NO: 4277960 - DNA, 15 bp, Homo sapiens
gctggtcatcctggg

SEQ ID NO: 4277961 - DNA, 16 bp, Homo sapiens
gctggtctctaggcct

SEQ ID NO: 4277962 - DNA, 13 bp, Homo sapiens
gctggtgcccacc

SEQ ID NO: 4277963 - DNA, 18 bp, Homo sapiens
gctggtgcccaccagctg

SEQ ID NO: 4277964 - DNA, 23 bp, Homo sapiens
gctggtgcccaccagctggctct

SEQ ID NO: 4277965 - DNA, 16 bp, Homo sapiens
gctggtgcccaccctt

SEQ ID NO: 4277966 - DNA, 23 bp, Homo sapiens
gctggtgggggcatccttgagga

SEQ ID NO: 4277967 - DNA, 21 bp, Homo sapiens
gctggtttggtggccaggctg

SEQ ID NO: 4277968 - DNA, 18 bp, Homo sapiens
gctgtagacatctgtcct

SEQ ID NO: 4277969 - DNA, 14 bp, Homo sapiens
gctgtatacaaaca

SEQ ID NO: 4277970 - DNA, 20 bp, Homo sapiens
gctgtatacaaacaggtgct

SEQ ID NO: 4277971 - DNA, 16 bp, Homo sapiens
gctgtatgtcattaaa

SEQ ID NO: 4277972 - DNA, 18 bp, Homo sapiens
gctgtatgtcattaaagt

SEQ ID NO: 4277973 - DNA, 22 bp, Homo sapiens
gctgtattttcttttatatctg

SEQ ID NO: 4277974 - DNA, 16 bp, Homo sapiens
gctgtatttttagaga

SEQ ID NO: 4277975 - DNA, 21 bp, Homo sapiens
gctgtccttagactccttctc

SEQ ID NO: 4277976 - DNA, 15 bp, Homo sapiens
gctgtctccagaccc

SEQ ID NO: 4277977 - DNA, 22 bp, Homo sapiens
gctgtctccagacccccacccc

SEQ ID NO: 4277978 - DNA, 18 bp, Homo sapiens
gctgtgcacccgtgccac

SEQ ID NO: 4277979 - DNA, 19 bp, Homo sapiens
gctgtgccagctgcttctg

SEQ ID NO: 4277980 - DNA, 21 bp, Homo sapiens
gctgtgcgctgacaaccaccg

SEQ ID NO: 4277981 - DNA, 15 bp, Homo sapiens
gctgtggcccctcct

SEQ ID NO: 4277982 - DNA, 23 bp, Homo sapiens
gctgtggcccctccttctcccct

SEQ ID NO: 4277983 - DNA, 15 bp, Homo sapiens
gctgtggggagctgg

SEQ ID NO: 4277984 - DNA, 20 bp, Homo sapiens
gctgtgggtcagtgtgccac

SEQ ID NO: 4277985 - DNA, 15 bp, Homo sapiens
gctgttctctgcttt

SEQ ID NO: 4277986 - DNA, 12 bp, Homo sapiens
gctgttcttctg

SEQ ID NO: 4277987 - DNA, 20 bp, Homo sapiens
gctgttgtctgccgtgagag

SEQ ID NO: 4277988 - DNA, 22 bp, Homo sapiens
gctgtttacttgaatagtattg

SEQ ID NO: 4277989 - DNA, 13 bp, Homo sapiens
gcttaagaagtat

SEQ ID NO: 4277990 - DNA, 13 bp, Homo sapiens
gcttagaagccac

SEQ ID NO: 4277991 - DNA, 16 bp, Homo sapiens
gcttaggccagtcagt

SEQ ID NO: 4277992 - DNA, 23 bp, Homo sapiens
gcttagtatctcatcaacaaaga

SEQ ID NO: 4277993 - DNA, 15 bp, Homo sapiens
gcttatattgttcac

SEQ ID NO: 4277994 - DNA, 18 bp, Homo sapiens
gcttatgagatactttgc

SEQ ID NO: 4277995 - DNA, 12 bp, Homo sapiens
gcttatttctaa

SEQ ID NO: 4277996 - DNA, 13 bp, Homo sapiens
gcttatttctaac

SEQ ID NO: 4277997 - DNA, 18 bp, Homo sapiens
gcttcaaccttgagacag

SEQ ID NO: 4277998 - DNA, 13 bp, Homo sapiens
gcttcagaattgt

SEQ ID NO: 4277999 - DNA, 16 bp, Homo sapiens
gcttcaggtgagccaa

SEQ ID NO: 4278000 - DNA, 23 bp, Homo sapiens
gcttcagtacttgtgaaacacag

SEQ ID NO: 4278001 - DNA, 15 bp, Homo sapiens
gcttcataggcagag

SEQ ID NO: 4278002 - DNA, 17 bp, Homo sapiens
gcttcataggcagagcc

SEQ ID NO: 4278003 - DNA, 18 bp, Homo sapiens
gcttcataggcagagccc

SEQ ID NO: 4278004 - DNA, 23 bp, Homo sapiens
gcttccatggtggtttcagaaag

SEQ ID NO: 4278005 - DNA, 13 bp, Homo sapiens
gcttcccaggacc

SEQ ID NO: 4278006 - DNA, 14 bp, Homo sapiens
gcttccccatcgcc

SEQ ID NO: 4278007 - DNA, 18 bp, Homo sapiens
gcttcccgctcagccctc

SEQ ID NO: 4278008 - DNA, 20 bp, Homo sapiens
gcttccggctgagctgtgcc

SEQ ID NO: 4278009 - DNA, 22 bp, Homo sapiens
gcttcggtttctaacttggagc

SEQ ID NO: 4278010 - DNA, 13 bp, Homo sapiens
gcttctccagcca

SEQ ID NO: 4278011 - DNA, 14 bp, Homo sapiens
gcttctccagccac

SEQ ID NO: 4278012 - DNA, 17 bp, Homo sapiens
gcttctccctggactct

SEQ ID NO: 4278013 - DNA, 19 bp, Homo sapiens
gcttgattctaaaggggac

SEQ ID NO: 4278014 - DNA, 23 bp, Homo sapiens
gcttgcaagtatgttttagcatg

SEQ ID NO: 4278015 - DNA, 12 bp, Homo sapiens
gcttgcattaaa

SEQ ID NO: 4278016 - DNA, 17 bp, Homo sapiens
gcttgcctagggcctgg

SEQ ID NO: 4278017 - DNA, 16 bp, Homo sapiens
gcttgctattaagaaa

SEQ ID NO: 4278018 - DNA, 14 bp, Homo sapiens
gcttggggtagaga

SEQ ID NO: 4278019 - DNA, 15 bp, Homo sapiens
gcttgtagggtgagg

SEQ ID NO: 4278020 - DNA, 19 bp, Homo sapiens
gcttgtagggtgaggcgtg

SEQ ID NO: 4278021 - DNA, 16 bp, Homo sapiens
gcttgtcagagctggg

SEQ ID NO: 4278022 - DNA, 17 bp, Homo sapiens
gcttgtcagagctggga

SEQ ID NO: 4278023 - DNA, 22 bp, Homo sapiens
gcttgtgttgggccccagggaa

SEQ ID NO: 4278024 - DNA, 22 bp, Homo sapiens
gcttgtttctatactgtttgta

SEQ ID NO: 4278025 - DNA, 14 bp, Homo sapiens
gctttcagggcctc

SEQ ID NO: 4278026 - DNA, 18 bp, Homo sapiens
gctttcagggcctccagc

SEQ ID NO: 4278027 - DNA, 22 bp, Homo sapiens
gctttgccttccacgctgtctc

SEQ ID NO: 4278028 - DNA, 24 bp, Homo sapiens
gctttgccttccacgctgtctcca

SEQ ID NO: 4278029 - DNA, 16 bp, Homo sapiens
gctttggaaagacctg

SEQ ID NO: 4278030 - DNA, 16 bp, Homo sapiens
gctttgtgtgattgaa

SEQ ID NO: 4278031 - DNA, 12 bp, Homo sapiens
gcttttcactgc

SEQ ID NO: 4278032 - DNA, 22 bp, Homo sapiens
gcttttcactgctggctgcctt

SEQ ID NO: 4278033 - DNA, 19 bp, Homo sapiens
gcttttccattctgggtgt

SEQ ID NO: 4278034 - DNA, 14 bp, Homo sapiens
ggaaaaaatatttt

SEQ ID NO: 4278035 - DNA, 19 bp, Homo sapiens
ggaaaaatgccatcaaatg

SEQ ID NO: 4278036 - DNA, 19 bp, Homo sapiens
ggaaaacataatatcttga

SEQ ID NO: 4278037 - DNA, 19 bp, Homo sapiens
ggaaaccttcacccagcac

SEQ ID NO: 4278038 - DNA, 21 bp, Homo sapiens
ggaaagccagtgactccagga

SEQ ID NO: 4278039 - DNA, 18 bp, Homo sapiens
ggaaaggccggtgggaag

SEQ ID NO: 4278040 - DNA, 17 bp, Homo sapiens
ggaacacccagccccag

SEQ ID NO: 4278041 - DNA, 12 bp, Homo sapiens
ggaacaggagga

SEQ ID NO: 4278042 - DNA, 16 bp, Homo sapiens
ggaacaggaggaactg

SEQ ID NO: 4278043 - DNA, 19 bp, Homo sapiens
ggaaccagagccatggact

SEQ ID NO: 4278044 - DNA, 17 bp, Homo sapiens
ggaaccatggacctgca

SEQ ID NO: 4278045 - DNA, 22 bp, Homo sapiens
ggaactaaagggtgtgggtcag

SEQ ID NO: 4278046 - DNA, 14 bp, Homo sapiens
ggaactggtccagg

SEQ ID NO: 4278047 - DNA, 18 bp, Homo sapiens
ggaactggtccaggccag

SEQ ID NO: 4278048 - DNA, 19 bp, Homo sapiens
ggaactggtccaggccagg

SEQ ID NO: 4278049 - DNA, 21 bp, Homo sapiens
ggaactggtccaggccaggcc

SEQ ID NO: 4278050 - DNA, 19 bp, Homo sapiens
ggaactggtttttctgttc

SEQ ID NO: 4278051 - DNA, 17 bp, Homo sapiens
ggaagaaggcccgggag

SEQ ID NO: 4278052 - DNA, 19 bp, Homo sapiens
ggaagaaggcccgggagga

SEQ ID NO: 4278053 - DNA, 23 bp, Homo sapiens
ggaagaggccgctgcagggtggc

SEQ ID NO: 4278054 - DNA, 18 bp, Homo sapiens
ggaagatcctccttccag

SEQ ID NO: 4278055 - DNA, 20 bp, Homo sapiens
ggaagatcctccttccaggc

SEQ ID NO: 4278056 - DNA, 21 bp, Homo sapiens
ggaagatcctccttccaggcc

SEQ ID NO: 4278057 - DNA, 15 bp, Homo sapiens
ggaagcagagcctgg

SEQ ID NO: 4278058 - DNA, 19 bp, Homo sapiens
ggaagcagagcctggggtg

SEQ ID NO: 4278059 - DNA, 20 bp, Homo sapiens
ggaagcctccacctgcagcc

SEQ ID NO: 4278060 - DNA, 23 bp, Homo sapiens
ggaagcctccacctgcagcccca

SEQ ID NO: 4278061 - DNA, 16 bp, Homo sapiens
ggaagctggcaggaga

SEQ ID NO: 4278062 - DNA, 20 bp, Homo sapiens
ggaagctggcaggagacact

SEQ ID NO: 4278063 - DNA, 17 bp, Homo sapiens
ggaaggagccagctccc

SEQ ID NO: 4278064 - DNA, 19 bp, Homo sapiens
ggaaggagccagctcccag

SEQ ID NO: 4278065 - DNA, 23 bp, Homo sapiens
ggaagggactggtccaggcatgg

SEQ ID NO: 4278066 - DNA, 16 bp, Homo sapiens
ggaagggaggcctgag

SEQ ID NO: 4278067 - DNA, 18 bp, Homo sapiens
ggaagggaggcctgaggg

SEQ ID NO: 4278068 - DNA, 21 bp, Homo sapiens
ggaagggaggcctgaggggca

SEQ ID NO: 4278069 - DNA, 13 bp, Homo sapiens
ggaagtcaggagc

SEQ ID NO: 4278070 - DNA, 19 bp, Homo sapiens
ggaagtcaggagccagcag

SEQ ID NO: 4278071 - DNA, 18 bp, Homo sapiens
ggaagtgacaaggcccca

SEQ ID NO: 4278072 - DNA, 13 bp, Homo sapiens
ggaagtgtgctga

SEQ ID NO: 4278073 - DNA, 19 bp, Homo sapiens
ggaagtgtgctgaggtggg

SEQ ID NO: 4278074 - DNA, 21 bp, Homo sapiens
gggctgcatcctcagccccag

SEQ ID NO: 4278075 - DNA, 15 bp, Homo sapiens
gggctgccctggtgc

SEQ ID NO: 4278076 - DNA, 17 bp, Homo sapiens
gggctggattggcaggt

SEQ ID NO: 4278077 - DNA, 23 bp, Homo sapiens
gggctggcatggggaggggagag

SEQ ID NO: 4278078 - DNA, 22 bp, Homo sapiens
gggctggctgccttctgcggag

SEQ ID NO: 4278079 - DNA, 21 bp, Homo sapiens
gggctgggcagaggggagagg

SEQ ID NO: 4278080 - DNA, 23 bp, Homo sapiens
gggctgggcagaggggagaggaa

SEQ ID NO: 4278081 - DNA, 15 bp, Homo sapiens
gggcttccctctgct

SEQ ID NO: 4278082 - DNA, 18 bp, Homo sapiens
gggcttccctctgctcca

SEQ ID NO: 4278083 - DNA, 19 bp, Homo sapiens
gggcttccctctgctccac

SEQ ID NO: 4278084 - DNA, 20 bp, Homo sapiens
ggggaagtgtgctgaggtgg

SEQ ID NO: 4278085 - DNA, 18 bp, Homo sapiens
ggggacacggcctctggg

SEQ ID NO: 4278086 - DNA, 19 bp, Homo sapiens
ggggacagatcttgagcaa

SEQ ID NO: 4278087 - DNA, 19 bp, Homo sapiens
ggggacaggaacacccagc

SEQ ID NO: 4278088 - DNA, 18 bp, Homo sapiens
ggggactgcatgcaagct

SEQ ID NO: 4278089 - DNA, 19 bp, Homo sapiens
ggggacttacatgattcat

SEQ ID NO: 4278090 - DNA, 14 bp, Homo sapiens
ggggagaatggctc

SEQ ID NO: 4278091 - DNA, 16 bp, Homo sapiens
ggggagaatggctctg

SEQ ID NO: 4278092 - DNA, 14 bp, Homo sapiens
ggggagctggtggg

SEQ ID NO: 4278093 - DNA, 12 bp, Homo sapiens
ggggagggcgct

SEQ ID NO: 4278094 - DNA, 12 bp, Homo sapiens
ggggaggggaga

SEQ ID NO: 4278095 - DNA, 13 bp, Homo sapiens
ggggaggggagag

SEQ ID NO: 4278096 - DNA, 20 bp, Homo sapiens
ggggagtgggacagagtctg

SEQ ID NO: 4278097 - DNA, 18 bp, Homo sapiens
ggggatctaaaaggagga

SEQ ID NO: 4278098 - DNA, 14 bp, Homo sapiens
ggggatttctccca

SEQ ID NO: 4278099 - DNA, 23 bp, Homo sapiens
ggggcaagagctcaggagaaggc

SEQ ID NO: 4278100 - DNA, 13 bp, Homo sapiens
ggggcagaaggag

SEQ ID NO: 4278101 - DNA, 16 bp, Homo sapiens
ggggcagcagcagtgg

SEQ ID NO: 4278102 - DNA, 19 bp, Homo sapiens
ggggcagctgccagagaag

SEQ ID NO: 4278103 - DNA, 22 bp, Homo sapiens
ggggcaggcccctttggacctg

SEQ ID NO: 4278104 - DNA, 18 bp, Homo sapiens
ggggcatccttgaggacc

SEQ ID NO: 4278105 - DNA, 20 bp, Homo sapiens
ggggccaggatggcgtgtcc

SEQ ID NO: 4278106 - DNA, 21 bp, Homo sapiens
ggggccatgagctccagaccc

SEQ ID NO: 4278107 - DNA, 10 bp, Homo sapiens
ggggcccctt

SEQ ID NO: 4278108 - DNA, 17 bp, Homo sapiens
ggggcctagtggcttca

SEQ ID NO: 4278109 - DNA, 11 bp, Homo sapiens
ggggcctggca

SEQ ID NO: 4278110 - DNA, 12 bp, Homo sapiens
ggggcctggcag

SEQ ID NO: 4278111 - DNA, 17 bp, Homo sapiens
ggggcgaggcagaggac

SEQ ID NO: 4278112 - DNA, 19 bp, Homo sapiens
ggggctagactgggctggc

SEQ ID NO: 4278113 - DNA, 20 bp, Homo sapiens
ggggctagactgggctggct

SEQ ID NO: 4278114 - DNA, 19 bp, Homo sapiens
ggggctggccagctgtgcg

SEQ ID NO: 4278115 - DNA, 19 bp, Homo sapiens
ggggcttggggtagagagg

SEQ ID NO: 4278116 - DNA, 22 bp, Homo sapiens
ggggcttttgtgccaggagtgg

SEQ ID NO: 4278117 - DNA, 21 bp, Homo sapiens
gggggaagcaccagcctcagt

SEQ ID NO: 4278118 - DNA, 22 bp, Homo sapiens
gggggacaggaacacccagccc

SEQ ID NO: 4278119 - DNA, 18 bp, Homo sapiens
gggggaggccgaggcagg

SEQ ID NO: 4278120 - DNA, 22 bp, Homo sapiens
gggggcaagagctcaggagaag

SEQ ID NO: 4278121 - DNA, 16 bp, Homo sapiens
gggggcacagccagaa

SEQ ID NO: 4278122 - DNA, 21 bp, Homo sapiens
gggggccatgaggcctcagtg

SEQ ID NO: 4278123 - DNA, 21 bp, Homo sapiens
gggggcctgagttgaggggct

SEQ ID NO: 4278124 - DNA, 13 bp, Homo sapiens
gggggcctgctgt

SEQ ID NO: 4278125 - DNA, 21 bp, Homo sapiens
gggggcttggggtagagagga

SEQ ID NO: 4278126 - DNA, 21 bp, Homo sapiens
gggggtgccaaccacctctgg

SEQ ID NO: 4278127 - DNA, 13 bp, Homo sapiens
ggggtagagagga

SEQ ID NO: 4278128 - DNA, 18 bp, Homo sapiens
ggggtctccacctcaggg

SEQ ID NO: 4278129 - DNA, 18 bp, Homo sapiens
ggggtctgggaggcaggt

SEQ ID NO: 4278130 - DNA, 12 bp, Homo sapiens
ggggtgagcccc

SEQ ID NO: 4278131 - DNA, 19 bp, Homo sapiens
ggggtgccatggtgttgga

SEQ ID NO: 4278132 - DNA, 19 bp, Homo sapiens
ggggttcccactggctcct

SEQ ID NO: 4278133 - DNA, 18 bp, Homo sapiens
ggggttgggttccagaca

SEQ ID NO: 4278134 - DNA, 18 bp, Homo sapiens
ggggtttccacacaggcc

SEQ ID NO: 4278135 - DNA, 18 bp, Homo sapiens
gggtaaaaagagaaggca

SEQ ID NO: 4278136 - DNA, 23 bp, Homo sapiens
gggtaggggaagtgtgctgaggt

SEQ ID NO: 4278137 - DNA, 14 bp, Homo sapiens
gggtagggggcctg

SEQ ID NO: 4278138 - DNA, 17 bp, Homo sapiens
gggtcaactccaaggca

SEQ ID NO: 4278139 - DNA, 12 bp, Homo sapiens
gggtcagtgtgc

SEQ ID NO: 4278140 - DNA, 19 bp, Homo sapiens
gggtcagtgtgccaccctc

SEQ ID NO: 4278141 - DNA, 14 bp, Homo sapiens
gggtcccccttcgt

SEQ ID NO: 4278142 - DNA, 19 bp, Homo sapiens
gggtcccccttcgtggagc

SEQ ID NO: 4278143 - DNA, 21 bp, Homo sapiens
gggtcctcaggcagtggccca

SEQ ID NO: 4278144 - DNA, 20 bp, Homo sapiens
gggtcggcgccttctacctg

SEQ ID NO: 4278145 - DNA, 21 bp, Homo sapiens
gggtctagaggctattcctag

SEQ ID NO: 4278146 - DNA, 22 bp, Homo sapiens
gggtctccacctcaggggagac

SEQ ID NO: 4278147 - DNA, 12 bp, Homo sapiens
gggtctgctcct

SEQ ID NO: 4278148 - DNA, 13 bp, Homo sapiens
gggtctgctcctg

SEQ ID NO: 4278149 - DNA, 13 bp, Homo sapiens
gggtgagccccgc

SEQ ID NO: 4278150 - DNA, 13 bp, Homo sapiens
gggtgagggtgac

SEQ ID NO: 4278151 - DNA, 16 bp, Homo sapiens
gggtggccggccctgc

SEQ ID NO: 4278152 - DNA, 16 bp, Homo sapiens
gggtgggacacagaga

SEQ ID NO: 4278153 - DNA, 20 bp, Homo sapiens
gggtggtcttcaagcctggc

SEQ ID NO: 4278154 - DNA, 19 bp, Homo sapiens
gggtgtcacagaggcagtg

SEQ ID NO: 4278155 - DNA, 12 bp, Homo sapiens
gggtgtgagcag

SEQ ID NO: 4278156 - DNA, 23 bp, Homo sapiens
gggtgtgctccaggcttcctgcc

SEQ ID NO: 4278157 - DNA, 12 bp, Homo sapiens
gggtgtggcttg

SEQ ID NO: 4278158 - DNA, 17 bp, Homo sapiens
gggtgttaaggcagtga

SEQ ID NO: 4278159 - DNA, 14 bp, Homo sapiens
gggttaaagaaagg

SEQ ID NO: 4278160 - DNA, 17 bp, Homo sapiens
gggttaaagaaaggcag

SEQ ID NO: 4278161 - DNA, 16 bp, Homo sapiens
gggttagacaagcctg

SEQ ID NO: 4278162 - DNA, 17 bp, Homo sapiens
gggttagacaagcctgg

SEQ ID NO: 4278163 - DNA, 12 bp, Homo sapiens
gggttccagaca

SEQ ID NO: 4278164 - DNA, 14 bp, Homo sapiens
gggttccagacagg

SEQ ID NO: 4278165 - DNA, 18 bp, Homo sapiens
gggttcccactggctcct

SEQ ID NO: 4278166 - DNA, 19 bp, Homo sapiens
gggttcccactggctcctc

SEQ ID NO: 4278167 - DNA, 13 bp, Homo sapiens
gggttcgggaaga

SEQ ID NO: 4278168 - DNA, 19 bp, Homo sapiens
gggtttacagtgaagaaag

SEQ ID NO: 4278169 - DNA, 15 bp, Homo sapiens
ggtaaaaagagaagg

SEQ ID NO: 4278170 - DNA, 23 bp, Homo sapiens
ggtaacatagatgcctgggcctg

SEQ ID NO: 4278171 - DNA, 14 bp, Homo sapiens
ggtaatctgaaaca

SEQ ID NO: 4278172 - DNA, 19 bp, Homo sapiens
ggtagaagtagaatccttt

SEQ ID NO: 4278173 - DNA, 12 bp, Homo sapiens
ggtagagaggac

SEQ ID NO: 4278174 - DNA, 23 bp, Homo sapiens
ggtaggggaagtgtgctgaggtg

SEQ ID NO: 4278175 - DNA, 14 bp, Homo sapiens
ggtatctctttctc

SEQ ID NO: 4278176 - DNA, 12 bp, Homo sapiens
ggtatgatcatt

SEQ ID NO: 4278177 - DNA, 22 bp, Homo sapiens
ggtatgcactggttccttaagt

SEQ ID NO: 4278178 - DNA, 20 bp, Homo sapiens
ggtattttcgtgcatttgtg

SEQ ID NO: 4278179 - DNA, 14 bp, Homo sapiens
ggtcaactccaagg

SEQ ID NO: 4278180 - DNA, 19 bp, Homo sapiens
ggtcaactccaaggcaaat

SEQ ID NO: 4278181 - DNA, 20 bp, Homo sapiens
ggtcaactccaaggcaaatg

SEQ ID NO: 4278182 - DNA, 22 bp, Homo sapiens
ggtcaactccaaggcaaatgtc

SEQ ID NO: 4278183 - DNA, 16 bp, Homo sapiens
ggtcaataattgtgga

SEQ ID NO: 4278184 - DNA, 20 bp, Homo sapiens
ggtcaataattgtggagagg

SEQ ID NO: 4278185 - DNA, 21 bp, Homo sapiens
ggtcaataattgtggagagga

SEQ ID NO: 4278186 - DNA, 22 bp, Homo sapiens
ggtcaataattgtggagaggag

SEQ ID NO: 4278187 - DNA, 15 bp, Homo sapiens
ggtcaccttcctggg

SEQ ID NO: 4278188 - DNA, 16 bp, Homo sapiens
ggtcaccttcctgggc

SEQ ID NO: 4278189 - DNA, 22 bp, Homo sapiens
ggtcaccttcctgggcagccca

SEQ ID NO: 4278190 - DNA, 17 bp, Homo sapiens
ggtcacttaagggggga

SEQ ID NO: 4278191 - DNA, 17 bp, Homo sapiens
ggtcagcggcctgggga

SEQ ID NO: 4278192 - DNA, 21 bp, Homo sapiens
ggtcagtgaagcccaggagga

SEQ ID NO: 4278193 - DNA, 15 bp, Homo sapiens
ggtcagtgtgccacc

SEQ ID NO: 4278194 - DNA, 19 bp, Homo sapiens
ggtcatcccggggccatgg

SEQ ID NO: 4278195 - DNA, 10 bp, Homo sapiens
ggtccacatt

SEQ ID NO: 4278196 - DNA, 23 bp, Homo sapiens
ggtccaccccgttgttgtccctg

SEQ ID NO: 4278197 - DNA, 12 bp, Homo sapiens
ggtccaggccag

SEQ ID NO: 4278198 - DNA, 15 bp, Homo sapiens
ggtccaggccaggcc

SEQ ID NO: 4278199 - DNA, 16 bp, Homo sapiens
ggtccaggccaggcct

SEQ ID NO: 4278200 - DNA, 23 bp, Homo sapiens
ggtccaggccaggcctcatcctc

SEQ ID NO: 4278201 - DNA, 17 bp, Homo sapiens
ggtcccagacatgctgc

SEQ ID NO: 4278202 - DNA, 21 bp, Homo sapiens
ggtcccgaatggagtccagac

SEQ ID NO: 4278203 - DNA, 19 bp, Homo sapiens
ggtcccgggtgccccccat

SEQ ID NO: 4278204 - DNA, 23 bp, Homo sapiens
gtctaaagttagggcatttttct

SEQ ID NO: 4278205 - DNA, 18 bp, Homo sapiens
gtctacctgaaaattcaa

SEQ ID NO: 4278206 - DNA, 20 bp, Homo sapiens
gtctatctggtattaaatgc

SEQ ID NO: 4278207 - DNA, 22 bp, Homo sapiens
gtctatctggtattaaatgcca

SEQ ID NO: 4278208 - DNA, 13 bp, Homo sapiens
gtctcatgcctga

SEQ ID NO: 4278209 - DNA, 21 bp, Homo sapiens
gtctcatgcctgagaatgcct

SEQ ID NO: 4278210 - DNA, 18 bp, Homo sapiens
gtctcattcctctgtccc

SEQ ID NO: 4278211 - DNA, 16 bp, Homo sapiens
gtctccacccctcaag

SEQ ID NO: 4278212 - DNA, 20 bp, Homo sapiens
gtctccacctcaggggagac

SEQ ID NO: 4278213 - DNA, 15 bp, Homo sapiens
gtctccagaccccca

SEQ ID NO: 4278214 - DNA, 17 bp, Homo sapiens
gtctccagacccccacc

SEQ ID NO: 4278215 - DNA, 13 bp, Homo sapiens
gtctccagctgat

SEQ ID NO: 4278216 - DNA, 21 bp, Homo sapiens
gtctccctggccacccttggc

SEQ ID NO: 4278217 - DNA, 18 bp, Homo sapiens
gtctcctgggcatctggc

SEQ ID NO: 4278218 - DNA, 19 bp, Homo sapiens
gtctcctgggcatctggcc

SEQ ID NO: 4278219 - DNA, 22 bp, Homo sapiens
gtctcctgggcatctggccctg

SEQ ID NO: 4278220 - DNA, 23 bp, Homo sapiens
gtctcctgggcatctggccctgc

SEQ ID NO: 4278221 - DNA, 15 bp, Homo sapiens
gtctcctgtatcatt

SEQ ID NO: 4278222 - DNA, 14 bp, Homo sapiens
gtctctaggcctga

SEQ ID NO: 4278223 - DNA, 23 bp, Homo sapiens
gtctcttgcataagcctcaggcc

SEQ ID NO: 4278224 - DNA, 21 bp, Homo sapiens
gtctgaaaccagaagactgga

SEQ ID NO: 4278225 - DNA, 22 bp, Homo sapiens
gtctgaaggagaggagtgcgct

SEQ ID NO: 4278226 - DNA, 17 bp, Homo sapiens
gtctgaagtcactgcac

SEQ ID NO: 4278227 - DNA, 19 bp, Homo sapiens
gtctgaagtcactgcacag

SEQ ID NO: 4278228 - DNA, 10 bp, Homo sapiens
gtctgagccc

SEQ ID NO: 4278229 - DNA, 16 bp, Homo sapiens
gtctgagccctgccct

SEQ ID NO: 4278230 - DNA, 16 bp, Homo sapiens
gtctgagcggccgcct

SEQ ID NO: 4278231 - DNA, 12 bp, Homo sapiens
gtctgattctat

SEQ ID NO: 4278232 - DNA, 17 bp, Homo sapiens
gtctgcaccccacagga

SEQ ID NO: 4278233 - DNA, 16 bp, Homo sapiens
gtctgccgtgagagcc

SEQ ID NO: 4278234 - DNA, 14 bp, Homo sapiens
gtctggagaccagg

SEQ ID NO: 4278235 - DNA, 18 bp, Homo sapiens
gtctggctgtggcccctc

SEQ ID NO: 4278236 - DNA, 14 bp, Homo sapiens
gtctgggaggcagg

SEQ ID NO: 4278237 - DNA, 17 bp, Homo sapiens
gtctgtccatctgtctg

SEQ ID NO: 4278238 - DNA, 19 bp, Homo sapiens
gtctgtcccagttaactgt

SEQ ID NO: 4278239 - DNA, 21 bp, Homo sapiens
gtctgtgaaagtctcctgtat

SEQ ID NO: 4278240 - DNA, 14 bp, Homo sapiens
gtctgtgaacttga

SEQ ID NO: 4278241 - DNA, 19 bp, Homo sapiens
gtctgtgaataaagccaca

SEQ ID NO: 4278242 - DNA, 20 bp, Homo sapiens
gtctgtgatgtcagtagtgc

SEQ ID NO: 4278243 - DNA, 13 bp, Homo sapiens
gtctgtggccctc

SEQ ID NO: 4278244 - DNA, 16 bp, Homo sapiens
gtctgtggccctctct

SEQ ID NO: 4278245 - DNA, 12 bp, Homo sapiens
gtctgtgggact

SEQ ID NO: 4278246 - DNA, 17 bp, Homo sapiens
gtcttcaagcctggccc

SEQ ID NO: 4278247 - DNA, 15 bp, Homo sapiens
gtcttccatcagcag

SEQ ID NO: 4278248 - DNA, 19 bp, Homo sapiens
gtcttccatcagcagtgat

SEQ ID NO: 4278249 - DNA, 18 bp, Homo sapiens
gtcttgagagcgctggcc

SEQ ID NO: 4278250 - DNA, 14 bp, Homo sapiens
gtcttgagatgtat

SEQ ID NO: 4278251 - DNA, 16 bp, Homo sapiens
gtcttgagtgggcccc

SEQ ID NO: 4278252 - DNA, 12 bp, Homo sapiens
gtcttgtatttt

SEQ ID NO: 4278253 - DNA, 14 bp, Homo sapiens
gtcttgtattttct

SEQ ID NO: 4278254 - DNA, 13 bp, Homo sapiens
gtctttagctatt

SEQ ID NO: 4278255 - DNA, 18 bp, Homo sapiens
gtctttgctgtttatata

SEQ ID NO: 4278256 - DNA, 22 bp, Homo sapiens
gtctttgggggattcaaatgca

SEQ ID NO: 4278257 - DNA, 24 bp, Homo sapiens
gtcttttaatgatactgtctaaga

SEQ ID NO: 4278258 - DNA, 16 bp, Homo sapiens
gtgaaacacagctgtt

SEQ ID NO: 4278259 - DNA, 18 bp, Homo sapiens
gtgaaagtgtaaaataga

SEQ ID NO: 4278260 - DNA, 13 bp, Homo sapiens
gtgaaatttgtta

SEQ ID NO: 4278261 - DNA, 23 bp, Homo sapiens
gtgaacttgatgttcctgggatg

SEQ ID NO: 4278262 - DNA, 15 bp, Homo sapiens
gtgaagcccaggagg

SEQ ID NO: 4278263 - DNA, 23 bp, Homo sapiens
gtgaagtccagtgaccctggagc

SEQ ID NO: 4278264 - DNA, 24 bp, Homo sapiens
gtgaagtccagtgaccctggagct

SEQ ID NO: 4278265 - DNA, 13 bp, Homo sapiens
gtgaatacatggt

SEQ ID NO: 4278266 - DNA, 17 bp, Homo sapiens
gtgaatataaatgtgtg

SEQ ID NO: 4278267 - DNA, 14 bp, Homo sapiens
gtgaattgaagtca

SEQ ID NO: 4278268 - DNA, 19 bp, Homo sapiens
gtgaattgaagtcatcata

SEQ ID NO: 4278269 - DNA, 18 bp, Homo sapiens
gtgacaaggccccagaga

SEQ ID NO: 4278270 - DNA, 20 bp, Homo sapiens
gtgacacagctgagctggcc

SEQ ID NO: 4278271 - DNA, 14 bp, Homo sapiens
gtgacatcagtggc

SEQ ID NO: 4278272 - DNA, 13 bp, Homo sapiens
gtgaccccagctc

SEQ ID NO: 4278273 - DNA, 15 bp, Homo sapiens
gtgaccccagctcca

SEQ ID NO: 4278274 - DNA, 20 bp, Homo sapiens
gtgaccccagctccaggcag

SEQ ID NO: 4278275 - DNA, 18 bp, Homo sapiens
gtgacccggaggccacat

SEQ ID NO: 4278276 - DNA, 17 bp, Homo sapiens
gtgaccctggagctagg

SEQ ID NO: 4278277 - DNA, 21 bp, Homo sapiens
gtgaccctggagctagggtcc

SEQ ID NO: 4278278 - DNA, 15 bp, Homo sapiens
gtgaccggggtcctg

SEQ ID NO: 4278279 - DNA, 15 bp, Homo sapiens
gtgaccttctgggaa

SEQ ID NO: 4278280 - DNA, 19 bp, Homo sapiens
gtgactaccacttatttct

SEQ ID NO: 4278281 - DNA, 12 bp, Homo sapiens
gtgactccagga

SEQ ID NO: 4278282 - DNA, 15 bp, Homo sapiens
gtgactgctgcgctg

SEQ ID NO: 4278283 - DNA, 15 bp, Homo sapiens
gtgagaaaactgtga

SEQ ID NO: 4278284 - DNA, 14 bp, Homo sapiens
gtgagaaatttttt

SEQ ID NO: 4278285 - DNA, 19 bp, Homo sapiens
gtgagaatcgacctcactg

SEQ ID NO: 4278286 - DNA, 22 bp, Homo sapiens
gtgagcatgaaactatgcacct

SEQ ID NO: 4278287 - DNA, 15 bp, Homo sapiens
gtgagccaaagagaa

SEQ ID NO: 4278288 - DNA, 12 bp, Homo sapiens
gtgagccaaggg

SEQ ID NO: 4278289 - DNA, 22 bp, Homo sapiens
gtgagccaaggggtctgctcct

SEQ ID NO: 4278290 - DNA, 15 bp, Homo sapiens
gtgaggcccagggag

SEQ ID NO: 4278291 - DNA, 21 bp, Homo sapiens
gtgaggcgtgggatccagaga

SEQ ID NO: 4278292 - DNA, 21 bp, Homo sapiens
gtgaggctccctccctccctg

SEQ ID NO: 4278293 - DNA, 23 bp, Homo sapiens
gtgaggctccctccctccctgct

SEQ ID NO: 4278294 - DNA, 12 bp, Homo sapiens
gtgagggtgcag

SEQ ID NO: 4278295 - DNA, 21 bp, Homo sapiens
gtgaggtcacaataaagtgta

SEQ ID NO: 4278296 - DNA, 23 bp, Homo sapiens
gtgaggtcatcccggggccatgg

SEQ ID NO: 4278297 - DNA, 21 bp, Homo sapiens
gtgagtgtgacgggggttggg

SEQ ID NO: 4278298 - DNA, 15 bp, Homo sapiens
gtgagtgtggctccc

SEQ ID NO: 4278299 - DNA, 15 bp, Homo sapiens
gtgataagtggaaaa

SEQ ID NO: 4278300 - DNA, 12 bp, Homo sapiens
gtgatacactgt

SEQ ID NO: 4278301 - DNA, 23 bp, Homo sapiens
gtgatcactttctgaaattcaca

SEQ ID NO: 4278302 - DNA, 17 bp, Homo sapiens
gtgattccccggagctg

SEQ ID NO: 4278303 - DNA, 22 bp, Homo sapiens
gtgattgaagtatctgtacctg

SEQ ID NO: 4278304 - DNA, 18 bp, Homo sapiens
gtgatttacgctcattgt

SEQ ID NO: 4278305 - DNA, 12 bp, Homo sapiens
gtgatttgctat

SEQ ID NO: 4278306 - DNA, 15 bp, Homo sapiens
gtgcacacacctgca

SEQ ID NO: 4278307 - DNA, 17 bp, Homo sapiens
gtgcacacacctgcaca

SEQ ID NO: 4278308 - DNA, 19 bp, Homo sapiens
gtgcacacacctgcacacc

SEQ ID NO: 4278309 - DNA, 12 bp, Homo sapiens
gtgcacagctgt

SEQ ID NO: 4278310 - DNA, 13 bp, Homo sapiens
gtgcacagctgtc

SEQ ID NO: 4278311 - DNA, 14 bp, Homo sapiens
gtgcacagctgtcc

SEQ ID NO: 4278312 - DNA, 19 bp, Homo sapiens
gtgcacggggccagcatcc

SEQ ID NO: 4278313 - DNA, 13 bp, Homo sapiens
gtgcactgtgtcc

SEQ ID NO: 4278314 - DNA, 22 bp, Homo sapiens
gtgcactttatcttgggaccaa

SEQ ID NO: 4278315 - DNA, 19 bp, Homo sapiens
gtgcagcccgtgtggcccc

SEQ ID NO: 4278316 - DNA, 21 bp, Homo sapiens
gtgcagccggggagctgaggg

SEQ ID NO: 4278317 - DNA, 15 bp, Homo sapiens
gtgcaggctggcacc

SEQ ID NO: 4278318 - DNA, 19 bp, Homo sapiens
gtgcaggggcggtccagag

SEQ ID NO: 4278319 - DNA, 14 bp, Homo sapiens
gtgcatctcagccc

SEQ ID NO: 4278320 - DNA, 18 bp, Homo sapiens
gtgcatttaaaatggact

SEQ ID NO: 4278321 - DNA, 17 bp, Homo sapiens
gtgcatttctgggcctt

SEQ ID NO: 4278322 - DNA, 15 bp, Homo sapiens
gtgccaaatcctggg

SEQ ID NO: 4278323 - DNA, 17 bp, Homo sapiens
gtgccaaatcctgggca

SEQ ID NO: 4278324 - DNA, 18 bp, Homo sapiens
gtgccaaccacctctggc

SEQ ID NO: 4278325 - DNA, 22 bp, Homo sapiens
gtgccaccctctgcagggcagc

SEQ ID NO: 4278326 - DNA, 17 bp, Homo sapiens
gtgccagctgcttctgc

SEQ ID NO: 4278327 - DNA, 14 bp, Homo sapiens
gtgccaggagtggg

SEQ ID NO: 4278328 - DNA, 23 bp, Homo sapiens
gtgcccaagaatagatgctgact

SEQ ID NO: 4278329 - DNA, 19 bp, Homo sapiens
gtgcccaccagctggctct

SEQ ID NO: 4278330 - DNA, 15 bp, Homo sapiens
gtgcccagtcttgag

SEQ ID NO: 4278331 - DNA, 15 bp, Homo sapiens
gtgccccccatgccc

SEQ ID NO: 4278332 - DNA, 12 bp, Homo sapiens
gtgccccctggg

SEQ ID NO: 4278333 - DNA, 16 bp, Homo sapiens
gtgcccgggcaggggc

SEQ ID NO: 4278334 - DNA, 18 bp, Homo sapiens
taaggggaattaacaatt

SEQ ID NO: 4278335 - DNA, 20 bp, Homo sapiens
taaggtacggtgagactctg

SEQ ID NO: 4278336 - DNA, 22 bp, Homo sapiens
taagtattccttggcccagcag

SEQ ID NO: 4278337 - DNA, 23 bp, Homo sapiens
taagtattccttggcccagcagc

SEQ ID NO: 4278338 - DNA, 12 bp, Homo sapiens
taagtccagctc

SEQ ID NO: 4278339 - DNA, 11 bp, Homo sapiens
taagtcttact

SEQ ID NO: 4278340 - DNA, 22 bp, Homo sapiens
taagtggaaaaaagagaaaaac

SEQ ID NO: 4278341 - DNA, 16 bp, Homo sapiens
taagtggacccagctg

SEQ ID NO: 4278342 - DNA, 24 bp, Homo sapiens
taagtggctgtgattaattattga

SEQ ID NO: 4278343 - DNA, 15 bp, Homo sapiens
taagttgtcttacac

SEQ ID NO: 4278344 - DNA, 16 bp, Homo sapiens
taataactagatctcc

SEQ ID NO: 4278345 - DNA, 19 bp, Homo sapiens
taataactagatctcctgt

SEQ ID NO: 4278346 - DNA, 15 bp, Homo sapiens
taatacagctgagct

SEQ ID NO: 4278347 - DNA, 15 bp, Homo sapiens
taatacttaaaaata

SEQ ID NO: 4278348 - DNA, 20 bp, Homo sapiens
taatacttaaaaatatgtga

SEQ ID NO: 4278349 - DNA, 14 bp, Homo sapiens
taatagcctcacct

SEQ ID NO: 4278350 - DNA, 16 bp, Homo sapiens
taatatactgcatatc

SEQ ID NO: 4278351 - DNA, 21 bp, Homo sapiens
taatatcactcattaattaac

SEQ ID NO: 4278352 - DNA, 12 bp, Homo sapiens
taatatcttgaa

SEQ ID NO: 4278353 - DNA, 19 bp, Homo sapiens
taatatctttcagttatta

SEQ ID NO: 4278354 - DNA, 16 bp, Homo sapiens
taatatttacaatgta

SEQ ID NO: 4278355 - DNA, 20 bp, Homo sapiens
taatatttacaatgtattaa

SEQ ID NO: 4278356 - DNA, 22 bp, Homo sapiens
taatcagaatggaagagagaaa

SEQ ID NO: 4278357 - DNA, 14 bp, Homo sapiens
taatcatttatctt

SEQ ID NO: 4278358 - DNA, 19 bp, Homo sapiens
taatcatttatcttatcta

SEQ ID NO: 4278359 - DNA, 22 bp, Homo sapiens
taatcatttcttgggccctcct

SEQ ID NO: 4278360 - DNA, 20 bp, Homo sapiens
taatccatgtgctgctgtgg

SEQ ID NO: 4278361 - DNA, 21 bp, Homo sapiens
taatcccagcatgctgagatt

SEQ ID NO: 4278362 - DNA, 15 bp, Homo sapiens
taatctctaaaattc

SEQ ID NO: 4278363 - DNA, 21 bp, Homo sapiens
taatctctaaaattctagtct

SEQ ID NO: 4278364 - DNA, 22 bp, Homo sapiens
taatctctgattaaatttaata

SEQ ID NO: 4278365 - DNA, 23 bp, Homo sapiens
taatctctgattaaatttaatat

SEQ ID NO: 4278366 - DNA, 16 bp, Homo sapiens
taatcttaatgtatat

SEQ ID NO: 4278367 - DNA, 21 bp, Homo sapiens
taatgacgtattgtgaaattt

SEQ ID NO: 4278368 - DNA, 16 bp, Homo sapiens
taatgatactgtctaa

SEQ ID NO: 4278369 - DNA, 20 bp, Homo sapiens
taatgatttaagcattttac

SEQ ID NO: 4278370 - DNA, 14 bp, Homo sapiens
taatgcctttttgg

SEQ ID NO: 4278371 - DNA, 15 bp, Homo sapiens
taatggaattatgta

SEQ ID NO: 4278372 - DNA, 16 bp, Homo sapiens
taatggtgccttcatt

SEQ ID NO: 4278373 - DNA, 19 bp, Homo sapiens
taatgtaaaattcatagca

SEQ ID NO: 4278374 - DNA, 16 bp, Homo sapiens
taatgtatcttattta

SEQ ID NO: 4278375 - DNA, 21 bp, Homo sapiens
taatgtatcttatttatatat

SEQ ID NO: 4278376 - DNA, 16 bp, Homo sapiens
taatgtcataaagtga

SEQ ID NO: 4278377 - DNA, 13 bp, Homo sapiens
taatgtgaaatgt

SEQ ID NO: 4278378 - DNA, 23 bp, Homo sapiens
taatgtgaaatgtaactgtccgt

SEQ ID NO: 4278379 - DNA, 19 bp, Homo sapiens
taatgtttccctcaagaac

SEQ ID NO: 4278380 - DNA, 21 bp, Homo sapiens
taattaaacaaattccttccc

SEQ ID NO: 4278381 - DNA, 14 bp, Homo sapiens
taattaaactgtta

SEQ ID NO: 4278382 - DNA, 15 bp, Homo sapiens
taattaaactgttaa

SEQ ID NO: 4278383 - DNA, 11 bp, Homo sapiens
taattaatttc

SEQ ID NO: 4278384 - DNA, 13 bp, Homo sapiens
taattaatttcag

SEQ ID NO: 4278385 - DNA, 20 bp, Homo sapiens
taattagatccattaattta

SEQ ID NO: 4278386 - DNA, 23 bp, Homo sapiens
taattagatccattaatttaaat

SEQ ID NO: 4278387 - DNA, 14 bp, Homo sapiens
taattatgtttacc

SEQ ID NO: 4278388 - DNA, 15 bp, Homo sapiens
taattatgtttacct

SEQ ID NO: 4278389 - DNA, 20 bp, Homo sapiens
taattccaagtgtttctgtt

SEQ ID NO: 4278390 - DNA, 15 bp, Homo sapiens
taattctatgagata

SEQ ID NO: 4278391 - DNA, 16 bp, Homo sapiens
taattctcttttcaaa

SEQ ID NO: 4278392 - DNA, 20 bp, Homo sapiens
taattctcttttcaaacaca

SEQ ID NO: 4278393 - DNA, 23 bp, Homo sapiens
taattgaaaagaagtagtgtctg

SEQ ID NO: 4278394 - DNA, 22 bp, Homo sapiens
taattgagccttttattaacat

SEQ ID NO: 4278395 - DNA, 18 bp, Homo sapiens
taattgtataaaacagtg

SEQ ID NO: 4278396 - DNA, 14 bp, Homo sapiens
taattgtggagagg

SEQ ID NO: 4278397 - DNA, 14 bp, Homo sapiens
taattgtggcttta

SEQ ID NO: 4278398 - DNA, 18 bp, Homo sapiens
taattgttatacattttt

SEQ ID NO: 4278399 - DNA, 18 bp, Homo sapiens
taatttaaatgatttaaa

SEQ ID NO: 4278400 - DNA, 12 bp, Homo sapiens
taattttctacc

SEQ ID NO: 4278401 - DNA, 17 bp, Homo sapiens
taattttgacactgaaa

SEQ ID NO: 4278402 - DNA, 20 bp, Homo sapiens
taattttgacactgaaataa

SEQ ID NO: 4278403 - DNA, 18 bp, Homo sapiens
taattttttagttaaaat

SEQ ID NO: 4278404 - DNA, 14 bp, Homo sapiens
tacaaacaggtgct

SEQ ID NO: 4278405 - DNA, 15 bp, Homo sapiens
tacaaacaggtgcta

SEQ ID NO: 4278406 - DNA, 22 bp, Homo sapiens
tacaaggccccaaggtttacat

SEQ ID NO: 4278407 - DNA, 22 bp, Homo sapiens
tacaagtgctcagttccaatgt

SEQ ID NO: 4278408 - DNA, 15 bp, Homo sapiens
tacaataaaattttg

SEQ ID NO: 4278409 - DNA, 16 bp, Homo sapiens
tacaataattctatga

SEQ ID NO: 4278410 - DNA, 13 bp, Homo sapiens
tacaatggccagc

SEQ ID NO: 4278411 - DNA, 16 bp, Homo sapiens
tacaatggccagccca

SEQ ID NO: 4278412 - DNA, 18 bp, Homo sapiens
tacaatggccagcccaga

SEQ ID NO: 4278413 - DNA, 15 bp, Homo sapiens
tacaccgggcctgga

SEQ ID NO: 4278414 - DNA, 19 bp, Homo sapiens
tacagaaaaacaatggtaa

SEQ ID NO: 4278415 - DNA, 21 bp, Homo sapiens
tacagcatagggtccactttg

SEQ ID NO: 4278416 - DNA, 16 bp, Homo sapiens
tacagctaatcagcat

SEQ ID NO: 4278417 - DNA, 21 bp, Homo sapiens
tacagctcagaagtttcttct

SEQ ID NO: 4278418 - DNA, 16 bp, Homo sapiens
tacagggaagaaatca

SEQ ID NO: 4278419 - DNA, 21 bp, Homo sapiens
tacagtaagctgctctattgt

SEQ ID NO: 4278420 - DNA, 22 bp, Homo sapiens
tacagtagctgtggggagctgg

SEQ ID NO: 4278421 - DNA, 19 bp, Homo sapiens
tacagtggagggagactga

SEQ ID NO: 4278422 - DNA, 17 bp, Homo sapiens
tacagttatacatacct

SEQ ID NO: 4278423 - DNA, 14 bp, Homo sapiens
tacagttctggagg

SEQ ID NO: 4278424 - DNA, 12 bp, Homo sapiens
tacatagtcttt

SEQ ID NO: 4278425 - DNA, 20 bp, Homo sapiens
tacatagtctttgtttacat

SEQ ID NO: 4278426 - DNA, 15 bp, Homo sapiens
tacatatgataaatt

SEQ ID NO: 4278427 - DNA, 14 bp, Homo sapiens
tacatatggaaatc

SEQ ID NO: 4278428 - DNA, 18 bp, Homo sapiens
tacatatggaaatcctgt

SEQ ID NO: 4278429 - DNA, 23 bp, Homo sapiens
tacatatggaaatcctgttactt

SEQ ID NO: 4278430 - DNA, 17 bp, Homo sapiens
tacatctaagtcagttt

SEQ ID NO: 4278431 - DNA, 17 bp, Homo sapiens
tacatgatgatttcaga

SEQ ID NO: 4278432 - DNA, 22 bp, Homo sapiens
tacatgatgatttcagaaacaa

SEQ ID NO: 4278433 - DNA, 21 bp, Homo sapiens
tacatgcacttggctgcataa

SEQ ID NO: 4278434 - DNA, 15 bp, Homo sapiens
tacatgcagaaattg

SEQ ID NO: 4278435 - DNA, 22 bp, Homo sapiens
tacatgcctttccagtgctgct

SEQ ID NO: 4278436 - DNA, 13 bp, Homo sapiens
tacatggtatctc

SEQ ID NO: 4278437 - DNA, 19 bp, Homo sapiens
tacattagcagtttgcttt

SEQ ID NO: 4278438 - DNA, 17 bp, Homo sapiens
tacattcttcaagatcc

SEQ ID NO: 4278439 - DNA, 20 bp, Homo sapiens
taccaatcaacagcatgtct

SEQ ID NO: 4278440 - DNA, 21 bp, Homo sapiens
taccacttatttctaaatcct

SEQ ID NO: 4278441 - DNA, 18 bp, Homo sapiens
taccagagcacagattca

SEQ ID NO: 4278442 - DNA, 19 bp, Homo sapiens
taccaggggttccccagga

SEQ ID NO: 4278443 - DNA, 20 bp, Homo sapiens
taccatagcttaagaagtat

SEQ ID NO: 4278444 - DNA, 20 bp, Homo sapiens
tacccacactacgcagaaga

SEQ ID NO: 4278445 - DNA, 21 bp, Homo sapiens
taccctaggtctccacccctc

SEQ ID NO: 4278446 - DNA, 19 bp, Homo sapiens
taccgaggagctaaacatg

SEQ ID NO: 4278447 - DNA, 21 bp, Homo sapiens
taccgagtctcttctccactg

SEQ ID NO: 4278448 - DNA, 18 bp, Homo sapiens
tacctcaacaagaagaat

SEQ ID NO: 4278449 - DNA, 18 bp, Homo sapiens
tacctcactggtgcattt

SEQ ID NO: 4278450 - DNA, 20 bp, Homo sapiens
tacctggcttagcgttctgt

SEQ ID NO: 4278451 - DNA, 12 bp, Homo sapiens
tacctttctgac

SEQ ID NO: 4278452 - DNA, 17 bp, Homo sapiens
tacgcagaagagaaagt

SEQ ID NO: 4278453 - DNA, 20 bp, Homo sapiens
tacgcagaagagaaagtaca

SEQ ID NO: 4278454 - DNA, 14 bp, Homo sapiens
tacgtgtcaatgtg

SEQ ID NO: 4278455 - DNA, 17 bp, Homo sapiens
tactaaatatgaaattt

SEQ ID NO: 4278456 - DNA, 16 bp, Homo sapiens
tactagaaccttctaa

SEQ ID NO: 4278457 - DNA, 18 bp, Homo sapiens
tactagagatattttgta

SEQ ID NO: 4278458 - DNA, 20 bp, Homo sapiens
tactagagatattttgtaaa

SEQ ID NO: 4278459 - DNA, 23 bp, Homo sapiens
tactagagatattttgtaaaatg

SEQ ID NO: 4278460 - DNA, 17 bp, Homo sapiens
tactatagcaaagtagt

SEQ ID NO: 4278461 - DNA, 23 bp, Homo sapiens
tactatggctgtatttttagaga

SEQ ID NO: 4278462 - DNA, 10 bp, Homo sapiens
tactcccctt

SEQ ID NO: 4278463 - DNA, 16 bp, Homo sapiens
tcatactctgtgtaat

SEQ ID NO: 4278464 - DNA, 14 bp, Homo sapiens
tcatacttaaaaat

SEQ ID NO: 4278465 - DNA, 23 bp, Homo sapiens
tcatactttccaacattatcctg

SEQ ID NO: 4278466 - DNA, 15 bp, Homo sapiens
tcatagtcaatcaaa

SEQ ID NO: 4278467 - DNA, 23 bp, Homo sapiens
tcatattgagatcagcattcaaa

SEQ ID NO: 4278468 - DNA, 17 bp, Homo sapiens
tcatcaaagtgtttaat

SEQ ID NO: 4278469 - DNA, 22 bp, Homo sapiens
tcatcaaagtgtttaattgtat

SEQ ID NO: 4278470 - DNA, 16 bp, Homo sapiens
tcatcaacaaagaaat

SEQ ID NO: 4278471 - DNA, 18 bp, Homo sapiens
tcatcaacaaagaaatat

SEQ ID NO: 4278472 - DNA, 24 bp, Homo sapiens
tcatcaatacttttgtgtattctg

SEQ ID NO: 4278473 - DNA, 21 bp, Homo sapiens
tcatccactaggtgcccagtc

SEQ ID NO: 4278474 - DNA, 19 bp, Homo sapiens
tcatccagaactgtcttag

SEQ ID NO: 4278475 - DNA, 13 bp, Homo sapiens
tcatcctcagcaa

SEQ ID NO: 4278476 - DNA, 14 bp, Homo sapiens
tcatcctcagcaag

SEQ ID NO: 4278477 - DNA, 15 bp, Homo sapiens
tcatcctgccttcat

SEQ ID NO: 4278478 - DNA, 13 bp, Homo sapiens
tcatctttccaaa

SEQ ID NO: 4278479 - DNA, 11 bp, Homo sapiens
tcatgaacact

SEQ ID NO: 4278480 - DNA, 13 bp, Homo sapiens
tcatgaacactgg

SEQ ID NO: 4278481 - DNA, 18 bp, Homo sapiens
tcatgacatttctcaaag

SEQ ID NO: 4278482 - DNA, 15 bp, Homo sapiens
tcatgatttgcaact

SEQ ID NO: 4278483 - DNA, 21 bp, Homo sapiens
tcatgcacacaattagatttc

SEQ ID NO: 4278484 - DNA, 22 bp, Homo sapiens
tcatgcctgagaatgcctaggc

SEQ ID NO: 4278485 - DNA, 15 bp, Homo sapiens
tcatgcttataagca

SEQ ID NO: 4278486 - DNA, 13 bp, Homo sapiens
tcatggctgtccc

SEQ ID NO: 4278487 - DNA, 18 bp, Homo sapiens
tcatgggggatttttcat

SEQ ID NO: 4278488 - DNA, 13 bp, Homo sapiens
tcatgtaaattga

SEQ ID NO: 4278489 - DNA, 21 bp, Homo sapiens
tcatgtaatagtggctttcat

SEQ ID NO: 4278490 - DNA, 13 bp, Homo sapiens
tcatgtctattgt

SEQ ID NO: 4278491 - DNA, 12 bp, Homo sapiens
tcatgtgtagga

SEQ ID NO: 4278492 - DNA, 14 bp, Homo sapiens
tcatgtgtaggaag

SEQ ID NO: 4278493 - DNA, 17 bp, Homo sapiens
tcattacagatttagtt

SEQ ID NO: 4278494 - DNA, 17 bp, Homo sapiens
tcattagaattaccatt

SEQ ID NO: 4278495 - DNA, 13 bp, Homo sapiens
tcattagctgtga

SEQ ID NO: 4278496 - DNA, 18 bp, Homo sapiens
tcattagctgtgattttt

SEQ ID NO: 4278497 - DNA, 19 bp, Homo sapiens
tcattcatacttaaaaatt

SEQ ID NO: 4278498 - DNA, 19 bp, Homo sapiens
tcattcccttctctcagcc

SEQ ID NO: 4278499 - DNA, 22 bp, Homo sapiens
tcattgggccatgtttaagtgt

SEQ ID NO: 4278500 - DNA, 11 bp, Homo sapiens
tcattgttaca

SEQ ID NO: 4278501 - DNA, 22 bp, Homo sapiens
tcattgttacaggtgtactatg

SEQ ID NO: 4278502 - DNA, 22 bp, Homo sapiens
tcatttaaaaaggtttaaaact

SEQ ID NO: 4278503 - DNA, 22 bp, Homo sapiens
tcattttatatatgaaaactaa

SEQ ID NO: 4278504 - DNA, 14 bp, Homo sapiens
tcattttcctggga

SEQ ID NO: 4278505 - DNA, 17 bp, Homo sapiens
tccaaagagtcatcatg

SEQ ID NO: 4278506 - DNA, 19 bp, Homo sapiens
tccaacatttcctcaggca

SEQ ID NO: 4278507 - DNA, 18 bp, Homo sapiens
tccaaccattcaaaaatt

SEQ ID NO: 4278508 - DNA, 13 bp, Homo sapiens
tccaacccatgca

SEQ ID NO: 4278509 - DNA, 22 bp, Homo sapiens
tccaacccatgcatggcctccc

SEQ ID NO: 4278510 - DNA, 14 bp, Homo sapiens
tccaagcatcagca

SEQ ID NO: 4278511 - DNA, 14 bp, Homo sapiens
tccaagcctgggcc

SEQ ID NO: 4278512 - DNA, 21 bp, Homo sapiens
tccaagcctgggccactggca

SEQ ID NO: 4278513 - DNA, 21 bp, Homo sapiens
tccaaggaagggatgtatttg

SEQ ID NO: 4278514 - DNA, 18 bp, Homo sapiens
tccaaggcaaatgtccaa

SEQ ID NO: 4278515 - DNA, 15 bp, Homo sapiens
tccaataattgactg

SEQ ID NO: 4278516 - DNA, 18 bp, Homo sapiens
tccaatcccaccaaccct

SEQ ID NO: 4278517 - DNA, 14 bp, Homo sapiens
tccaatgtttcaag

SEQ ID NO: 4278518 - DNA, 13 bp, Homo sapiens
tccacaaatgtcc

SEQ ID NO: 4278519 - DNA, 19 bp, Homo sapiens
tccacaaatgtcctcagag

SEQ ID NO: 4278520 - DNA, 17 bp, Homo sapiens
tccacaacctcctcctc

SEQ ID NO: 4278521 - DNA, 18 bp, Homo sapiens
tccacacaagacagcaga

SEQ ID NO: 4278522 - DNA, 15 bp, Homo sapiens
tccacacttccaccc

SEQ ID NO: 4278523 - DNA, 22 bp, Homo sapiens
tccacagaagacacgtgttttt

SEQ ID NO: 4278524 - DNA, 20 bp, Homo sapiens
tccacaggagggcatccctg

SEQ ID NO: 4278525 - DNA, 15 bp, Homo sapiens
tccaccccagtcccc

SEQ ID NO: 4278526 - DNA, 15 bp, Homo sapiens
tccacccccagctcc

SEQ ID NO: 4278527 - DNA, 16 bp, Homo sapiens
tccacccccagctcct

SEQ ID NO: 4278528 - DNA, 19 bp, Homo sapiens
tccaccccctccctggcct

SEQ ID NO: 4278529 - DNA, 20 bp, Homo sapiens
tccacctgggagatgctggg

SEQ ID NO: 4278530 - DNA, 23 bp, Homo sapiens
tccacctgggagatgctgggacc

SEQ ID NO: 4278531 - DNA, 17 bp, Homo sapiens
tccacctgtgctgctgc

SEQ ID NO: 4278532 - DNA, 15 bp, Homo sapiens
tccacgctgtctcca

SEQ ID NO: 4278533 - DNA, 18 bp, Homo sapiens
tccacgctgtctccagac

SEQ ID NO: 4278534 - DNA, 23 bp, Homo sapiens
tccacgctgtctccagaccccca

SEQ ID NO: 4278535 - DNA, 14 bp, Homo sapiens
tccacggctctagg

SEQ ID NO: 4278536 - DNA, 20 bp, Homo sapiens
tccacggctctaggtggggc

SEQ ID NO: 4278537 - DNA, 12 bp, Homo sapiens
tccactcctccc

SEQ ID NO: 4278538 - DNA, 13 bp, Homo sapiens
tccactcctccca

SEQ ID NO: 4278539 - DNA, 18 bp, Homo sapiens
tccactcctcccaactct

SEQ ID NO: 4278540 - DNA, 23 bp, Homo sapiens
tccactcctcccaactctggcct

SEQ ID NO: 4278541 - DNA, 19 bp, Homo sapiens
tccagaactaccaaaatga

SEQ ID NO: 4278542 - DNA, 14 bp, Homo sapiens
tccagaactgtctt

SEQ ID NO: 4278543 - DNA, 16 bp, Homo sapiens
tccagaactgtcttag

SEQ ID NO: 4278544 - DNA, 10 bp, Homo sapiens
tccagacaga

SEQ ID NO: 4278545 - DNA, 20 bp, Homo sapiens
tccagacagagtggatctgg

SEQ ID NO: 4278546 - DNA, 23 bp, Homo sapiens
tccagacagagtggatctggagt

SEQ ID NO: 4278547 - DNA, 16 bp, Homo sapiens
tccagacattgtattt

SEQ ID NO: 4278548 - DNA, 16 bp, Homo sapiens
tccagacccccacccc

SEQ ID NO: 4278549 - DNA, 20 bp, Homo sapiens
tccagacccccaccccttcc

SEQ ID NO: 4278550 - DNA, 21 bp, Homo sapiens
tccagacccccaccccttccc

SEQ ID NO: 4278551 - DNA, 14 bp, Homo sapiens
tccagacccccagc

SEQ ID NO: 4278552 - DNA, 16 bp, Homo sapiens
tccagacccccagcaa

SEQ ID NO: 4278553 - DNA, 14 bp, Homo sapiens
tccagacccctacc

SEQ ID NO: 4278554 - DNA, 13 bp, Homo sapiens
tccagacccctgg

SEQ ID NO: 4278555 - DNA, 23 bp, Homo sapiens
tccagacccctggcttttcactg

SEQ ID NO: 4278556 - DNA, 15 bp, Homo sapiens
tccagacctgaagaa

SEQ ID NO: 4278557 - DNA, 18 bp, Homo sapiens
tccagacctgggccctgg

SEQ ID NO: 4278558 - DNA, 19 bp, Homo sapiens
tccagacctgggccctggt

SEQ ID NO: 4278559 - DNA, 21 bp, Homo sapiens
tccagacttcgctattcccag

SEQ ID NO: 4278560 - DNA, 21 bp, Homo sapiens
tccagagagagaagtgcccct

SEQ ID NO: 4278561 - DNA, 19 bp, Homo sapiens
tccagagagtggctcctcc

SEQ ID NO: 4278562 - DNA, 16 bp, Homo sapiens
tccagaggaggtgccc

SEQ ID NO: 4278563 - DNA, 17 bp, Homo sapiens
tccagaggaggtgcccg

SEQ ID NO: 4278564 - DNA, 22 bp, Homo sapiens
tccagagtaggtgggtcttgga

SEQ ID NO: 4278565 - DNA, 16 bp, Homo sapiens
tccagccaacccctgt

SEQ ID NO: 4278566 - DNA, 15 bp, Homo sapiens
tccagccaccaaggc

SEQ ID NO: 4278567 - DNA, 20 bp, Homo sapiens
tccagccaccaaggctgcct

SEQ ID NO: 4278568 - DNA, 22 bp, Homo sapiens
tccagccgcaaatccatacccc

SEQ ID NO: 4278569 - DNA, 22 bp, Homo sapiens
tccagctaagcctgatgatgga

SEQ ID NO: 4278570 - DNA, 20 bp, Homo sapiens
tccaggaaggcggggcttca

SEQ ID NO: 4278571 - DNA, 16 bp, Homo sapiens
tccaggattgtccaca

SEQ ID NO: 4278572 - DNA, 20 bp, Homo sapiens
tccaggattgtccacaaatg

SEQ ID NO: 4278573 - DNA, 21 bp, Homo sapiens
tccaggattgtccacaaatgt

SEQ ID NO: 4278574 - DNA, 16 bp, Homo sapiens
tccaggcatgaccctg

SEQ ID NO: 4278575 - DNA, 23 bp, Homo sapiens
tccaggccaggcctcatcctcct

SEQ ID NO: 4278576 - DNA, 12 bp, Homo sapiens
tccaggcccagc

SEQ ID NO: 4278577 - DNA, 14 bp, Homo sapiens
tccaggcccagcct

SEQ ID NO: 4278578 - DNA, 17 bp, Homo sapiens
tccaggccccaggctgg

SEQ ID NO: 4278579 - DNA, 18 bp, Homo sapiens
tccaggccccaggctgga

SEQ ID NO: 4278580 - DNA, 17 bp, Homo sapiens
tccaggcgtagggccag

SEQ ID NO: 4278581 - DNA, 19 bp, Homo sapiens
tccaggcgtagggccaggg

SEQ ID NO: 4278582 - DNA, 23 bp, Homo sapiens
tccaggcgtagggccagggctct

SEQ ID NO: 4278583 - DNA, 16 bp, Homo sapiens
tccaggcttcctgccc

SEQ ID NO: 4278584 - DNA, 16 bp, Homo sapiens
tccagtctgctgccct

SEQ ID NO: 4278585 - DNA, 22 bp, Homo sapiens
tccagtctgctgccctccatcc

SEQ ID NO: 4278586 - DNA, 16 bp, Homo sapiens
tccagtgaccctggag

SEQ ID NO: 4278587 - DNA, 19 bp, Homo sapiens
tccagtgctgctcccttta

SEQ ID NO: 4278588 - DNA, 21 bp, Homo sapiens
tccagtgttcccttctggctg

SEQ ID NO: 4278589 - DNA, 17 bp, Homo sapiens
tccagtgttgcctcctc

SEQ ID NO: 4278590 - DNA, 19 bp, Homo sapiens
tccagtgttttcttgtgtt

SEQ ID NO: 4278591 - DNA, 23 bp, Homo sapiens
tccagtgttttcttgtgttgttt

SEQ ID NO: 4278592 - DNA, 23 bp, Homo sapiens
tccagttcacaggccagaaaaca

SEQ ID NO: 4278593 - DNA, 16 bp, Homo sapiens
tcttatttaaattttc

SEQ ID NO: 4278594 - DNA, 18 bp, Homo sapiens
tcttatttaaattttcag

SEQ ID NO: 4278595 - DNA, 21 bp, Homo sapiens
tcttatttaaattttcagaaa

SEQ ID NO: 4278596 - DNA, 14 bp, Homo sapiens
tcttatttatatat

SEQ ID NO: 4278597 - DNA, 23 bp, Homo sapiens
tcttcaagcctggcccagtgaga

SEQ ID NO: 4278598 - DNA, 13 bp, Homo sapiens
tcttcaccaggaa

SEQ ID NO: 4278599 - DNA, 14 bp, Homo sapiens
tcttcactcgcccc

SEQ ID NO: 4278600 - DNA, 16 bp, Homo sapiens
tcttcatgtttcagga

SEQ ID NO: 4278601 - DNA, 18 bp, Homo sapiens
tcttccatcagcagtgat

SEQ ID NO: 4278602 - DNA, 17 bp, Homo sapiens
tcttccattcccagaca

SEQ ID NO: 4278603 - DNA, 23 bp, Homo sapiens
tcttcccaaagcaagcacctggg

SEQ ID NO: 4278604 - DNA, 23 bp, Homo sapiens
tcttcccaccaactctctctgcc

SEQ ID NO: 4278605 - DNA, 24 bp, Homo sapiens
tcttcccatttgtaatgtatctta

SEQ ID NO: 4278606 - DNA, 13 bp, Homo sapiens
tcttcctccctcc

SEQ ID NO: 4278607 - DNA, 14 bp, Homo sapiens
tcttcctgtaatct

SEQ ID NO: 4278608 - DNA, 15 bp, Homo sapiens
tcttcctgtaatctt

SEQ ID NO: 4278609 - DNA, 12 bp, Homo sapiens
tcttccttccgc

SEQ ID NO: 4278610 - DNA, 19 bp, Homo sapiens
tcttccttttgtatcctcc

SEQ ID NO: 4278611 - DNA, 12 bp, Homo sapiens
tcttctccactg

SEQ ID NO: 4278612 - DNA, 16 bp, Homo sapiens
tcttctccactggatg

SEQ ID NO: 4278613 - DNA, 13 bp, Homo sapiens
tcttctcctttca

SEQ ID NO: 4278614 - DNA, 16 bp, Homo sapiens
tcttctctctgtgctg

SEQ ID NO: 4278615 - DNA, 22 bp, Homo sapiens
tcttcttatacagataaaacat

SEQ ID NO: 4278616 - DNA, 22 bp, Homo sapiens
tcttcttttaaaccattttctt

SEQ ID NO: 4278617 - DNA, 13 bp, Homo sapiens
tcttgaagaatat

SEQ ID NO: 4278618 - DNA, 14 bp, Homo sapiens
tcttgaagaatatt

SEQ ID NO: 4278619 - DNA, 22 bp, Homo sapiens
tcttgaatgttgaagaactcat

SEQ ID NO: 4278620 - DNA, 18 bp, Homo sapiens
tcttgagagcgctggcct

SEQ ID NO: 4278621 - DNA, 22 bp, Homo sapiens
tcttgagcaaggcaagaagtgg

SEQ ID NO: 4278622 - DNA, 19 bp, Homo sapiens
tcttgagtgggccccctct

SEQ ID NO: 4278623 - DNA, 13 bp, Homo sapiens
tcttggagaggag

SEQ ID NO: 4278624 - DNA, 14 bp, Homo sapiens
tcttggagaggagg

SEQ ID NO: 4278625 - DNA, 19 bp, Homo sapiens
tcttggagaggaggtgtgg

SEQ ID NO: 4278626 - DNA, 18 bp, Homo sapiens
tcttgtattttcttccca

SEQ ID NO: 4278627 - DNA, 20 bp, Homo sapiens
tcttgtattttcttcccatt

SEQ ID NO: 4278628 - DNA, 19 bp, Homo sapiens
tcttgttatggtagaaaaa

SEQ ID NO: 4278629 - DNA, 23 bp, Homo sapiens
tctttaaagaggagcctttccag

SEQ ID NO: 4278630 - DNA, 14 bp, Homo sapiens
tctttactaacact

SEQ ID NO: 4278631 - DNA, 15 bp, Homo sapiens
tctttatgactgttt

SEQ ID NO: 4278632 - DNA, 16 bp, Homo sapiens
tctttattgtctgtaa

SEQ ID NO: 4278633 - DNA, 13 bp, Homo sapiens
tctttcctctctg

SEQ ID NO: 4278634 - DNA, 20 bp, Homo sapiens
tctttcctttcatcctcagc

SEQ ID NO: 4278635 - DNA, 12 bp, Homo sapiens
tctttctatgta

SEQ ID NO: 4278636 - DNA, 17 bp, Homo sapiens
tctttctccaaagttat

SEQ ID NO: 4278637 - DNA, 16 bp, Homo sapiens
tctttgcattcgtcct

SEQ ID NO: 4278638 - DNA, 16 bp, Homo sapiens
tctttgctcccagttt

SEQ ID NO: 4278639 - DNA, 19 bp, Homo sapiens
tctttgctgtttatatata

SEQ ID NO: 4278640 - DNA, 21 bp, Homo sapiens
tctttgggggattcaaatgca

SEQ ID NO: 4278641 - DNA, 19 bp, Homo sapiens
tctttggtgttctggcctc

SEQ ID NO: 4278642 - DNA, 13 bp, Homo sapiens
tctttgtgtgctg

SEQ ID NO: 4278643 - DNA, 15 bp, Homo sapiens
tctttgtttacatga

SEQ ID NO: 4278644 - DNA, 18 bp, Homo sapiens
tcttttatatctgtaaat

SEQ ID NO: 4278645 - DNA, 14 bp, Homo sapiens
tcttttcaaacaca

SEQ ID NO: 4278646 - DNA, 24 bp, Homo sapiens
tcttttcagcttgtttctatactg

SEQ ID NO: 4278647 - DNA, 14 bp, Homo sapiens
tcttttctgaggtt

SEQ ID NO: 4278648 - DNA, 21 bp, Homo sapiens
tgaaaactggaataagaagca

SEQ ID NO: 4278649 - DNA, 18 bp, Homo sapiens
tgaaaagaagaaagtcta

SEQ ID NO: 4278650 - DNA, 15 bp, Homo sapiens
tgaaaagaagtagtg

SEQ ID NO: 4278651 - DNA, 10 bp, Homo sapiens
tgaaaagtgc

SEQ ID NO: 4278652 - DNA, 20 bp, Homo sapiens
tgaaaatatttttttctagc

SEQ ID NO: 4278653 - DNA, 20 bp, Homo sapiens
tgaaacacagtcatgtgtca

SEQ ID NO: 4278654 - DNA, 15 bp, Homo sapiens
tgaaacttggtgtgt

SEQ ID NO: 4278655 - DNA, 20 bp, Homo sapiens
tgaaagctgcttctggggga

SEQ ID NO: 4278656 - DNA, 16 bp, Homo sapiens
tgaaaggtaatctgaa

SEQ ID NO: 4278657 - DNA, 18 bp, Homo sapiens
tgaaagtgtaaaatagaa

SEQ ID NO: 4278658 - DNA, 20 bp, Homo sapiens
tgaaataaattggtgataag

SEQ ID NO: 4278659 - DNA, 21 bp, Homo sapiens
tgaaataaattggtgataagt

SEQ ID NO: 4278660 - DNA, 18 bp, Homo sapiens
tgaaataaccgtaaaggt

SEQ ID NO: 4278661 - DNA, 22 bp, Homo sapiens
tgaaataggagggaaacctttg

SEQ ID NO: 4278662 - DNA, 16 bp, Homo sapiens
tgaaatatatgtgaaa

SEQ ID NO: 4278663 - DNA, 23 bp, Homo sapiens
tgaaatatcatcacgtatgttat

SEQ ID NO: 4278664 - DNA, 19 bp, Homo sapiens
tgaaatatttgcttattta

SEQ ID NO: 4278665 - DNA, 17 bp, Homo sapiens
tgaaatgtttccaggca

SEQ ID NO: 4278666 - DNA, 18 bp, Homo sapiens
tgaaatgtttccaggcat

SEQ ID NO: 4278667 - DNA, 18 bp, Homo sapiens
tgaaattcacaaagttaa

SEQ ID NO: 4278668 - DNA, 20 bp, Homo sapiens
tgaaatttgttaatatatat

SEQ ID NO: 4278669 - DNA, 16 bp, Homo sapiens
tgaactaggtgctggc

SEQ ID NO: 4278670 - DNA, 16 bp, Homo sapiens
tgaactgctgctggtc

SEQ ID NO: 4278671 - DNA, 17 bp, Homo sapiens
tgaacttgatgttcctg

SEQ ID NO: 4278672 - DNA, 20 bp, Homo sapiens
tgaacttgatgttcctggga

SEQ ID NO: 4278673 - DNA, 22 bp, Homo sapiens
tgaagacacgcccgactctctc

SEQ ID NO: 4278674 - DNA, 15 bp, Homo sapiens
tgaagagagatatat

SEQ ID NO: 4278675 - DNA, 13 bp, Homo sapiens
tgaagagcgctcc

SEQ ID NO: 4278676 - DNA, 19 bp, Homo sapiens
tgaagagcgctcctctgcc

SEQ ID NO: 4278677 - DNA, 20 bp, Homo sapiens
tgaagagcgctcctctgcct

SEQ ID NO: 4278678 - DNA, 21 bp, Homo sapiens
tgaagagcgctcctctgcctt

SEQ ID NO: 4278679 - DNA, 11 bp, Homo sapiens
tgaagatctca

SEQ ID NO: 4278680 - DNA, 17 bp, Homo sapiens
tgaagatctcagataaa

SEQ ID NO: 4278681 - DNA, 21 bp, Homo sapiens
tgaagatctcagataaagtga

SEQ ID NO: 4278682 - DNA, 14 bp, Homo sapiens
tgaagattcaggct

SEQ ID NO: 4278683 - DNA, 13 bp, Homo sapiens
tgaagcaaacaca

SEQ ID NO: 4278684 - DNA, 16 bp, Homo sapiens
tgaagcccaggaggac

SEQ ID NO: 4278685 - DNA, 13 bp, Homo sapiens
tgaagcctcccga

SEQ ID NO: 4278686 - DNA, 15 bp, Homo sapiens
tgaaggattttaaat

SEQ ID NO: 4278687 - DNA, 19 bp, Homo sapiens
tgaaggctttcagggcctc

SEQ ID NO: 4278688 - DNA, 22 bp, Homo sapiens
tgaaggttggaactgctgccat

SEQ ID NO: 4278689 - DNA, 21 bp, Homo sapiens
tgaagtcactgcacagtgcat

SEQ ID NO: 4278690 - DNA, 19 bp, Homo sapiens
tgaagtcatcataaaaggt

SEQ ID NO: 4278691 - DNA, 19 bp, Homo sapiens
tgaagtgaccccagctcca

SEQ ID NO: 4278692 - DNA, 22 bp, Homo sapiens
tgaagtgaccccagctccaggc

SEQ ID NO: 4278693 - DNA, 17 bp, Homo sapiens
tgaataaacactttttc

SEQ ID NO: 4278694 - DNA, 16 bp, Homo sapiens
tgaataaagacaccta

SEQ ID NO: 4278695 - DNA, 13 bp, Homo sapiens
tgaataatttctt

SEQ ID NO: 4278696 - DNA, 17 bp, Homo sapiens
tgaatataaatgtgtgt

SEQ ID NO: 4278697 - DNA, 21 bp, Homo sapiens
tgaatataaatgtgtgtatgt

SEQ ID NO: 4278698 - DNA, 15 bp, Homo sapiens
tgaatatactcatta

SEQ ID NO: 4278699 - DNA, 12 bp, Homo sapiens
tgaatccctttc

SEQ ID NO: 4278700 - DNA, 22 bp, Homo sapiens
tgaatgagtttccagctaagcc

SEQ ID NO: 4278701 - DNA, 15 bp, Homo sapiens
tgaatgctgtacctt

SEQ ID NO: 4278702 - DNA, 19 bp, Homo sapiens
tgaatgtagccagcccaca

SEQ ID NO: 4278703 - DNA, 20 bp, Homo sapiens
tgaatgtccccattctataa

SEQ ID NO: 4278704 - DNA, 16 bp, Homo sapiens
tgaatgttatatcatc

SEQ ID NO: 4278705 - DNA, 20 bp, Homo sapiens
tgaattacagggaagaaatc

SEQ ID NO: 4278706 - DNA, 19 bp, Homo sapiens
tgaattcataaaaataacc

SEQ ID NO: 4278707 - DNA, 16 bp, Homo sapiens
tgaattcgagacaggc

SEQ ID NO: 4278708 - DNA, 23 bp, Homo sapiens
tgaattcgagacaggcagaatca

SEQ ID NO: 4278709 - DNA, 18 bp, Homo sapiens
tgaattgaagtcatcata

SEQ ID NO: 4278710 - DNA, 21 bp, Homo sapiens
tgaattgaagtcatcataaaa

SEQ ID NO: 4278711 - DNA, 21 bp, Homo sapiens
tgacaagccccaggcaggctg

SEQ ID NO: 4278712 - DNA, 14 bp, Homo sapiens
tgacaaggccccag

SEQ ID NO: 4278713 - DNA, 18 bp, Homo sapiens
tgacaaggccccagagac

SEQ ID NO: 4278714 - DNA, 15 bp, Homo sapiens
tgacaagtcacaccc

SEQ ID NO: 4278715 - DNA, 19 bp, Homo sapiens
tgacaatttcaaaatgcat

SEQ ID NO: 4278716 - DNA, 20 bp, Homo sapiens
tgacaatttcaaaatgcatg

SEQ ID NO: 4278717 - DNA, 17 bp, Homo sapiens
tgacacaactcatccag

SEQ ID NO: 4278718 - DNA, 15 bp, Homo sapiens
tgacacataaatctg

SEQ ID NO: 4278719 - DNA, 20 bp, Homo sapiens
tgacacttttcatatcattt

SEQ ID NO: 4278720 - DNA, 18 bp, Homo sapiens
tgacaggaattctccctg

SEQ ID NO: 4278721 - DNA, 21 bp, Homo sapiens
tgacatggattggatttcagt

SEQ ID NO: 4278722 - DNA, 13 bp, Homo sapiens
tgacatttctcaa

SEQ ID NO: 4278723 - DNA, 16 bp, Homo sapiens
tgctgaagaatctact

SEQ ID NO: 4278724 - DNA, 19 bp, Homo sapiens
tgctgactgtactcctccc

SEQ ID NO: 4278725 - DNA, 19 bp, Homo sapiens
tgctgaggccagaggaagg

SEQ ID NO: 4278726 - DNA, 16 bp, Homo sapiens
tgctgatttcccctct

SEQ ID NO: 4278727 - DNA, 16 bp, Homo sapiens
tgctgcaatacattaa

SEQ ID NO: 4278728 - DNA, 19 bp, Homo sapiens
tgctgcaatacattaaaat

SEQ ID NO: 4278729 - DNA, 14 bp, Homo sapiens
tgctgcactgccct

SEQ ID NO: 4278730 - DNA, 20 bp, Homo sapiens
tgctgcagtcagcacagaga

SEQ ID NO: 4278731 - DNA, 13 bp, Homo sapiens
tgctgcccacccc

SEQ ID NO: 4278732 - DNA, 14 bp, Homo sapiens
tgctgcccaccccc

SEQ ID NO: 4278733 - DNA, 20 bp, Homo sapiens
tgctgcccaccccctgctgg

SEQ ID NO: 4278734 - DNA, 24 bp, Homo sapiens
tgctgccccacaacacaccttgcc

SEQ ID NO: 4278735 - DNA, 21 bp, Homo sapiens
tgctgcccccagaccccatcc

SEQ ID NO: 4278736 - DNA, 15 bp, Homo sapiens
tgctgcccgtgagga

SEQ ID NO: 4278737 - DNA, 13 bp, Homo sapiens
tgctgcctcccca

SEQ ID NO: 4278738 - DNA, 19 bp, Homo sapiens
tgctgcctccccaaccctg

SEQ ID NO: 4278739 - DNA, 22 bp, Homo sapiens
tgctgcctccccaaccctgccc

SEQ ID NO: 4278740 - DNA, 11 bp, Homo sapiens
tgctgcctgcc

SEQ ID NO: 4278741 - DNA, 12 bp, Homo sapiens
tgctgcctgcct

SEQ ID NO: 4278742 - DNA, 14 bp, Homo sapiens
tgctgcctgcctcc

SEQ ID NO: 4278743 - DNA, 12 bp, Homo sapiens
tgctgccttctg

SEQ ID NO: 4278744 - DNA, 17 bp, Homo sapiens
tgctgccttctgtctct

SEQ ID NO: 4278745 - DNA, 15 bp, Homo sapiens
tgctgcgctgtgctg

SEQ ID NO: 4278746 - DNA, 13 bp, Homo sapiens
tgctgctcctcgg

SEQ ID NO: 4278747 - DNA, 21 bp, Homo sapiens
tgctgctcctcggccagagct

SEQ ID NO: 4278748 - DNA, 12 bp, Homo sapiens
tgctgctggctc

SEQ ID NO: 4278749 - DNA, 14 bp, Homo sapiens
tgctgctttccaac

SEQ ID NO: 4278750 - DNA, 11 bp, Homo sapiens
tgctggagagt

SEQ ID NO: 4278751 - DNA, 23 bp, Homo sapiens
tgctggagtcctgttctcagagc

SEQ ID NO: 4278752 - DNA, 18 bp, Homo sapiens
tgctggcatgtctgggtc

SEQ ID NO: 4278753 - DNA, 13 bp, Homo sapiens
tgctggcccctca

SEQ ID NO: 4278754 - DNA, 15 bp, Homo sapiens
tgctggcccctcacc

SEQ ID NO: 4278755 - DNA, 24 bp, Homo sapiens
tgctggcccctcacctgggcacct

SEQ ID NO: 4278756 - DNA, 15 bp, Homo sapiens
tgctggctcccaggg

SEQ ID NO: 4278757 - DNA, 15 bp, Homo sapiens
tgctggctgccttag

SEQ ID NO: 4278758 - DNA, 14 bp, Homo sapiens
tgctgggtgggaat

SEQ ID NO: 4278759 - DNA, 16 bp, Homo sapiens
tgctgggttctggggc

SEQ ID NO: 4278760 - DNA, 17 bp, Homo sapiens
tgctgggttctggggct

SEQ ID NO: 4278761 - DNA, 22 bp, Homo sapiens
tgctgggttctggggctgagag

SEQ ID NO: 4278762 - DNA, 18 bp, Homo sapiens
tgctggtcacccccaccc

SEQ ID NO: 4278763 - DNA, 17 bp, Homo sapiens
tgctggtcatcctgggc

SEQ ID NO: 4278764 - DNA, 16 bp, Homo sapiens
tgctgtaagacggcct

SEQ ID NO: 4278765 - DNA, 16 bp, Homo sapiens
tgctgtagacatctgt

SEQ ID NO: 4278766 - DNA, 19 bp, Homo sapiens
tgctgtatacaaacaggtg

SEQ ID NO: 4278767 - DNA, 17 bp, Homo sapiens
tgctgtgcacccgtgcc

SEQ ID NO: 4278768 - DNA, 12 bp, Homo sapiens
tgctgtggattt

SEQ ID NO: 4278769 - DNA, 13 bp, Homo sapiens
tgctgtggcatca

SEQ ID NO: 4278770 - DNA, 19 bp, Homo sapiens
tgctgtgggtcagtgtgcc

SEQ ID NO: 4278771 - DNA, 23 bp, Homo sapiens
tgctgtgggtcagtgtgccaccc

SEQ ID NO: 4278772 - DNA, 17 bp, Homo sapiens
tgctgttgtctgccgtg

SEQ ID NO: 4278773 - DNA, 18 bp, Homo sapiens
tgctgttgttcagaagtt

SEQ ID NO: 4278774 - DNA, 15 bp, Homo sapiens
tgctgtttatatata

SEQ ID NO: 4278775 - DNA, 12 bp, Homo sapiens
tgctgttttatg

SEQ ID NO: 4278776 - DNA, 15 bp, Homo sapiens
tgctgttttatgtca

SEQ ID NO: 4278777 - DNA, 23 bp, Homo sapiens
tgcttagtcacttatttcataaa

SEQ ID NO: 4278778 - DNA, 16 bp, Homo sapiens
tgcttatgtcatttct

SEQ ID NO: 4278779 - DNA, 19 bp, Homo sapiens
tgcttatttatattcagag

SEQ ID NO: 4278780 - DNA, 16 bp, Homo sapiens
tgcttgaagattcagg

SEQ ID NO: 4278781 - DNA, 13 bp, Homo sapiens
tgcttgtcctgct

SEQ ID NO: 4278782 - DNA, 14 bp, Homo sapiens
tgcttgtcctgctc

SEQ ID NO: 4278783 - DNA, 16 bp, Homo sapiens
tgcttgtcctgctcag

SEQ ID NO: 4278784 - DNA, 22 bp, Homo sapiens
tgcttgtgttgggccccaggga

SEQ ID NO: 4278785 - DNA, 23 bp, Homo sapiens
tgctttcaagatctaaatcatat

SEQ ID NO: 4278786 - DNA, 15 bp, Homo sapiens
tgctttgggctgccc

SEQ ID NO: 4278787 - DNA, 17 bp, Homo sapiens
tgctttgggctgccctg

SEQ ID NO: 4278788 - DNA, 18 bp, Homo sapiens
tgcttttccatctaaaat

SEQ ID NO: 4278789 - DNA, 15 bp, Homo sapiens
tggaaaaaaaaagaa

SEQ ID NO: 4278790 - DNA, 16 bp, Homo sapiens
tggaaaaaatatttta

SEQ ID NO: 4278791 - DNA, 15 bp, Homo sapiens
tggaaaactcacaga

SEQ ID NO: 4278792 - DNA, 16 bp, Homo sapiens
tggaaagggtgtggct

SEQ ID NO: 4278793 - DNA, 21 bp, Homo sapiens
tggaaagggtgtggcttggaa

SEQ ID NO: 4278794 - DNA, 22 bp, Homo sapiens
tggaaatcctgttacttaaata

SEQ ID NO: 4278795 - DNA, 16 bp, Homo sapiens
tggaacaggaggaact

SEQ ID NO: 4278796 - DNA, 23 bp, Homo sapiens
tggaacaggaggaactggtccag

SEQ ID NO: 4278797 - DNA, 19 bp, Homo sapiens
tggaacccttttggccccc

SEQ ID NO: 4278798 - DNA, 23 bp, Homo sapiens
tggaactgctgccatgattttgg

SEQ ID NO: 4278799 - DNA, 23 bp, Homo sapiens
tggaactgtctctcatgaacctc

SEQ ID NO: 4278800 - DNA, 19 bp, Homo sapiens
tggaagagagaaagcatat

SEQ ID NO: 4278801 - DNA, 23 bp, Homo sapiens
tggaagcactgccattagactga

SEQ ID NO: 4278802 - DNA, 15 bp, Homo sapiens
tggaagggactagga

SEQ ID NO: 4278803 - DNA, 18 bp, Homo sapiens
tggaagggccttctccac

SEQ ID NO: 4278804 - DNA, 20 bp, Homo sapiens
tggaagggcgctgagggcag

SEQ ID NO: 4278805 - DNA, 22 bp, Homo sapiens
tggaaggtccgagtctttttag

SEQ ID NO: 4278806 - DNA, 18 bp, Homo sapiens
tggaatctactagaacct

SEQ ID NO: 4278807 - DNA, 14 bp, Homo sapiens
tggacccagcaggg

SEQ ID NO: 4278808 - DNA, 14 bp, Homo sapiens
tggacgtgtgagga

SEQ ID NO: 4278809 - DNA, 21 bp, Homo sapiens
tggactctacactgtgaactt

SEQ ID NO: 4278810 - DNA, 12 bp, Homo sapiens
tggactctggac

SEQ ID NO: 4278811 - DNA, 18 bp, Homo sapiens
tggactctggactgggaa

SEQ ID NO: 4278812 - DNA, 19 bp, Homo sapiens
tggactctgtggggccaca

SEQ ID NO: 4278813 - DNA, 17 bp, Homo sapiens
tggactggaggctgggt

SEQ ID NO: 4278814 - DNA, 19 bp, Homo sapiens
tggactggaggctgggtgg

SEQ ID NO: 4278815 - DNA, 18 bp, Homo sapiens
tggactgtggcctcagga

SEQ ID NO: 4278816 - DNA, 21 bp, Homo sapiens
tggactgtggcctcaggaggc

SEQ ID NO: 4278817 - DNA, 16 bp, Homo sapiens
tggactttccaccccc

SEQ ID NO: 4278818 - DNA, 18 bp, Homo sapiens
tggactttccaccccctc

SEQ ID NO: 4278819 - DNA, 17 bp, Homo sapiens
tggagaccaggactctg

SEQ ID NO: 4278820 - DNA, 17 bp, Homo sapiens
tggagactgtctcaaga

SEQ ID NO: 4278821 - DNA, 13 bp, Homo sapiens
tggagaggagaga

SEQ ID NO: 4278822 - DNA, 22 bp, Homo sapiens
tggagaggagagaatgagagag

SEQ ID NO: 4278823 - DNA, 14 bp, Homo sapiens
tggagccacaggca

SEQ ID NO: 4278824 - DNA, 15 bp, Homo sapiens
tggagccactctgtt

SEQ ID NO: 4278825 - DNA, 19 bp, Homo sapiens
tggagcccgcacccccacc

SEQ ID NO: 4278826 - DNA, 23 bp, Homo sapiens
tggagccggactttcggagttgg

SEQ ID NO: 4278827 - DNA, 21 bp, Homo sapiens
tggagctgaggactctcacga

SEQ ID NO: 4278828 - DNA, 21 bp, Homo sapiens
tggaggaaaaccaagccgtgg

SEQ ID NO: 4278829 - DNA, 17 bp, Homo sapiens
tggaggaatgctccccc

SEQ ID NO: 4278830 - DNA, 15 bp, Homo sapiens
tggaggcctctgcaa

SEQ ID NO: 4278831 - DNA, 20 bp, Homo sapiens
tggaggcctggtctggagcc

SEQ ID NO: 4278832 - DNA, 14 bp, Homo sapiens
tggaggcgagccag

SEQ ID NO: 4278833 - DNA, 21 bp, Homo sapiens
tggaggcgccttcctgggttg

SEQ ID NO: 4278834 - DNA, 18 bp, Homo sapiens
tggaggctaagcctggac

SEQ ID NO: 4278835 - DNA, 22 bp, Homo sapiens
tggaggctgggtggccggccct

SEQ ID NO: 4278836 - DNA, 12 bp, Homo sapiens
tggagggagact

SEQ ID NO: 4278837 - DNA, 14 bp, Homo sapiens
tggagggagactga

SEQ ID NO: 4278838 - DNA, 18 bp, Homo sapiens
tggagggagactgaccca

SEQ ID NO: 4278839 - DNA, 13 bp, Homo sapiens
tggaggggcaggc

SEQ ID NO: 4278840 - DNA, 15 bp, Homo sapiens
tggaggggcaggcct

SEQ ID NO: 4278841 - DNA, 16 bp, Homo sapiens
tggaggggtcagcagg

SEQ ID NO: 4278842 - DNA, 22 bp, Homo sapiens
tggaggtcccagacatgctgcc

SEQ ID NO: 4278843 - DNA, 17 bp, Homo sapiens
tggagtcctgttctcag

SEQ ID NO: 4278844 - DNA, 23 bp, Homo sapiens
tggagtcctgttctcagagctcc

SEQ ID NO: 4278845 - DNA, 17 bp, Homo sapiens
tggagtctgaaggagag

SEQ ID NO: 4278846 - DNA, 23 bp, Homo sapiens
tggagtctgaaggagaggagtgc

SEQ ID NO: 4278847 - DNA, 20 bp, Homo sapiens
tggagtggaggggtcagcag

SEQ ID NO: 4278848 - DNA, 13 bp, Homo sapiens
tggagttgggctg

SEQ ID NO: 4278849 - DNA, 20 bp, Homo sapiens
tggataataactagatctcc

SEQ ID NO: 4278850 - DNA, 22 bp, Homo sapiens
tggatactgcccggggcagctg

SEQ ID NO: 4278851 - DNA, 16 bp, Homo sapiens
tggatctgctccatgc

SEQ ID NO: 4278852 - DNA, 12 bp, Homo sapiens
tggatctggagt

SEQ ID NO: 4278853 - DNA, 23 bp, Homo sapiens
tgtgcagccggggagctgagggg

SEQ ID NO: 4278854 - DNA, 16 bp, Homo sapiens
tgtgccaccctctgca

SEQ ID NO: 4278855 - DNA, 13 bp, Homo sapiens
tgtgccagctgct

SEQ ID NO: 4278856 - DNA, 17 bp, Homo sapiens
tgtgccagctgcttctg

SEQ ID NO: 4278857 - DNA, 18 bp, Homo sapiens
tgtgccagctgcttctgc

SEQ ID NO: 4278858 - DNA, 12 bp, Homo sapiens
tgtgccaggagt

SEQ ID NO: 4278859 - DNA, 21 bp, Homo sapiens
tgtgcccgctgcgctgccctg

SEQ ID NO: 4278860 - DNA, 15 bp, Homo sapiens
tgtgcctgctatcca

SEQ ID NO: 4278861 - DNA, 20 bp, Homo sapiens
tgtgcgtatgcagtgtagat

SEQ ID NO: 4278862 - DNA, 21 bp, Homo sapiens
tgtgctccaggcttcctgccc

SEQ ID NO: 4278863 - DNA, 23 bp, Homo sapiens
tgtgctccaggcttcctgcccta

SEQ ID NO: 4278864 - DNA, 16 bp, Homo sapiens
tgtgctgaggtgggcc

SEQ ID NO: 4278865 - DNA, 11 bp, Homo sapiens
tgtgctgctgc

SEQ ID NO: 4278866 - DNA, 17 bp, Homo sapiens
tgtgctgtgcacccgtg

SEQ ID NO: 4278867 - DNA, 19 bp, Homo sapiens
tgtgcttgttcttcctctt

SEQ ID NO: 4278868 - DNA, 13 bp, Homo sapiens
tgtgctttcaaga

SEQ ID NO: 4278869 - DNA, 15 bp, Homo sapiens
tgtggagaggagaga

SEQ ID NO: 4278870 - DNA, 17 bp, Homo sapiens
tgtggagaggagagaat

SEQ ID NO: 4278871 - DNA, 19 bp, Homo sapiens
tgtggagcccgcaccccca

SEQ ID NO: 4278872 - DNA, 11 bp, Homo sapiens
tgtggagctgc

SEQ ID NO: 4278873 - DNA, 15 bp, Homo sapiens
tgtggagctgcttcc

SEQ ID NO: 4278874 - DNA, 12 bp, Homo sapiens
tgtggagtggag

SEQ ID NO: 4278875 - DNA, 23 bp, Homo sapiens
tgtggatggaggtgatgaaaacc

SEQ ID NO: 4278876 - DNA, 16 bp, Homo sapiens
tgtggattctatattt

SEQ ID NO: 4278877 - DNA, 22 bp, Homo sapiens
tgtggcccctccttctcccctc

SEQ ID NO: 4278878 - DNA, 12 bp, Homo sapiens
tgtggccctctc

SEQ ID NO: 4278879 - DNA, 14 bp, Homo sapiens
tgtggcctcagcat

SEQ ID NO: 4278880 - DNA, 17 bp, Homo sapiens
tgtggctaaaaaagctg

SEQ ID NO: 4278881 - DNA, 14 bp, Homo sapiens
tgtggctcccctct

SEQ ID NO: 4278882 - DNA, 18 bp, Homo sapiens
tgtgggagaagggacagc

SEQ ID NO: 4278883 - DNA, 16 bp, Homo sapiens
tgtgggcagctggctc

SEQ ID NO: 4278884 - DNA, 17 bp, Homo sapiens
tgtgggctcccacgccc

SEQ ID NO: 4278885 - DNA, 14 bp, Homo sapiens
tgtggggagctggt

SEQ ID NO: 4278886 - DNA, 16 bp, Homo sapiens
tgtggggatttctccc

SEQ ID NO: 4278887 - DNA, 16 bp, Homo sapiens
tgtgggggtctgggag

SEQ ID NO: 4278888 - DNA, 17 bp, Homo sapiens
tgtgggggtctgggagg

SEQ ID NO: 4278889 - DNA, 18 bp, Homo sapiens
tgtgggggtctgggaggc

SEQ ID NO: 4278890 - DNA, 20 bp, Homo sapiens
tgtgggggtctgggaggcag

SEQ ID NO: 4278891 - DNA, 22 bp, Homo sapiens
tgtgggggtctgggaggcaggt

SEQ ID NO: 4278892 - DNA, 22 bp, Homo sapiens
tgtgggggtgtcacagaggcag

SEQ ID NO: 4278893 - DNA, 21 bp, Homo sapiens
tgtggtacaagcattctgtct

SEQ ID NO: 4278894 - DNA, 16 bp, Homo sapiens
tgtggtgtgagcttca

SEQ ID NO: 4278895 - DNA, 21 bp, Homo sapiens
tgtgtaatcatttcttgggcc

SEQ ID NO: 4278896 - DNA, 16 bp, Homo sapiens
tgtgtaatctctgatt

SEQ ID NO: 4278897 - DNA, 14 bp, Homo sapiens
tgtgtaggaagagg

SEQ ID NO: 4278898 - DNA, 15 bp, Homo sapiens
tgtgtaggaagaggc

SEQ ID NO: 4278899 - DNA, 21 bp, Homo sapiens
tgtgtagtagctcgtgtgctt

SEQ ID NO: 4278900 - DNA, 13 bp, Homo sapiens
tgtgtatgtgttt

SEQ ID NO: 4278901 - DNA, 16 bp, Homo sapiens
tgtgtcagctgtagaa

SEQ ID NO: 4278902 - DNA, 14 bp, Homo sapiens
tgtgtcgcctctca

SEQ ID NO: 4278903 - DNA, 16 bp, Homo sapiens
tgtgtctccagctgat

SEQ ID NO: 4278904 - DNA, 18 bp, Homo sapiens
tgtgtctccagctgattt

SEQ ID NO: 4278905 - DNA, 23 bp, Homo sapiens
tgtgtctccagctgattttaact

SEQ ID NO: 4278906 - DNA, 13 bp, Homo sapiens
tgtgtgagtgtga

SEQ ID NO: 4278907 - DNA, 16 bp, Homo sapiens
tgtgtgattgaatctg

SEQ ID NO: 4278908 - DNA, 20 bp, Homo sapiens
tgtgtggctcattcttttca

SEQ ID NO: 4278909 - DNA, 22 bp, Homo sapiens
tgtgtgggggtctgggaggcag

SEQ ID NO: 4278910 - DNA, 21 bp, Homo sapiens
tgtgtgggtttactctgtgct

SEQ ID NO: 4278911 - DNA, 21 bp, Homo sapiens
tgtgttcgtggagccacaggc

SEQ ID NO: 4278912 - DNA, 19 bp, Homo sapiens
tgtgttgcaaattattcta

SEQ ID NO: 4278913 - DNA, 16 bp, Homo sapiens
tgtgttgggccccagg

SEQ ID NO: 4278914 - DNA, 16 bp, Homo sapiens
tgtgttgttttctctg

SEQ ID NO: 4278915 - DNA, 18 bp, Homo sapiens
tgtgtttgaattgatttt

SEQ ID NO: 4278916 - DNA, 14 bp, Homo sapiens
tgtgtttgtatata

SEQ ID NO: 4278917 - DNA, 19 bp, Homo sapiens
tgttaaacgtcacagcagt

SEQ ID NO: 4278918 - DNA, 21 bp, Homo sapiens
tgttaaagaggcgtcttgtat

SEQ ID NO: 4278919 - DNA, 14 bp, Homo sapiens
tgttaacttattca

SEQ ID NO: 4278920 - DNA, 15 bp, Homo sapiens
tgttaacttattcaa

SEQ ID NO: 4278921 - DNA, 17 bp, Homo sapiens
tgttaacttattcaaag

SEQ ID NO: 4278922 - DNA, 16 bp, Homo sapiens
tgttaatatatataat

SEQ ID NO: 4278923 - DNA, 23 bp, Homo sapiens
tgttaatatatataatacttaaa

SEQ ID NO: 4278924 - DNA, 17 bp, Homo sapiens
tgttaatatcactcatt

SEQ ID NO: 4278925 - DNA, 17 bp, Homo sapiens
tgttaatcttaatgtat

SEQ ID NO: 4278926 - DNA, 17 bp, Homo sapiens
tgttacagtaatgtcat

SEQ ID NO: 4278927 - DNA, 15 bp, Homo sapiens
tgttaccttcacatg

SEQ ID NO: 4278928 - DNA, 12 bp, Homo sapiens
tgttacttaaat

SEQ ID NO: 4278929 - DNA, 12 bp, Homo sapiens
tgttaggggaaa

SEQ ID NO: 4278930 - DNA, 22 bp, Homo sapiens
tgttatacaaccttcatttaaa

SEQ ID NO: 4278931 - DNA, 15 bp, Homo sapiens
tgttatacattttta

SEQ ID NO: 4278932 - DNA, 18 bp, Homo sapiens
tgttatattcattcttta

SEQ ID NO: 4278933 - DNA, 14 bp, Homo sapiens
tgttattaaatgta

SEQ ID NO: 4278934 - DNA, 20 bp, Homo sapiens
tgttcaaagaacccccctcc

SEQ ID NO: 4278935 - DNA, 22 bp, Homo sapiens
tgttcaaagaacccccctcccc

SEQ ID NO: 4278936 - DNA, 23 bp, Homo sapiens
tgttcaaagaacccccctcccca

SEQ ID NO: 4278937 - DNA, 17 bp, Homo sapiens
tgttcacgcaacttgaa

SEQ ID NO: 4278938 - DNA, 13 bp, Homo sapiens
tgttcagaagttg

SEQ ID NO: 4278939 - DNA, 14 bp, Homo sapiens
tgttcagtcacttg

SEQ ID NO: 4278940 - DNA, 14 bp, Homo sapiens
tgttcatttcctca

SEQ ID NO: 4278941 - DNA, 19 bp, Homo sapiens
tgttccatcctgtacaagt

SEQ ID NO: 4278942 - DNA, 21 bp, Homo sapiens
tgttcctgggatgtttaatca

SEQ ID NO: 4278943 - DNA, 21 bp, Homo sapiens
tgttctcaatgcttttctagc

SEQ ID NO: 4278944 - DNA, 13 bp, Homo sapiens
tgttctcagagct

SEQ ID NO: 4278945 - DNA, 20 bp, Homo sapiens
tgttctcagagctccacaga

SEQ ID NO: 4278946 - DNA, 21 bp, Homo sapiens
tgttctcagagctccacagaa

SEQ ID NO: 4278947 - DNA, 17 bp, Homo sapiens
tgttctggcctctggcc

SEQ ID NO: 4278948 - DNA, 13 bp, Homo sapiens
tgttgaatgtttg

SEQ ID NO: 4278949 - DNA, 18 bp, Homo sapiens
tgttgcaaattattctag

SEQ ID NO: 4278950 - DNA, 20 bp, Homo sapiens
tgttgcttagtcacttattt

SEQ ID NO: 4278951 - DNA, 12 bp, Homo sapiens
tgttggaggggc

SEQ ID NO: 4278952 - DNA, 14 bp, Homo sapiens
tgttgggaggaggg

SEQ ID NO: 4278953 - DNA, 16 bp, Homo sapiens
tgttgggcctttttcc

SEQ ID NO: 4278954 - DNA, 13 bp, Homo sapiens
tgttgtccctgca

SEQ ID NO: 4278955 - DNA, 13 bp, Homo sapiens
tgttgtttaagtg

SEQ ID NO: 4278956 - DNA, 13 bp, Homo sapiens
tgttgttttctct

SEQ ID NO: 4278957 - DNA, 14 bp, Homo sapiens
tgttgttttctctg

SEQ ID NO: 4278958 - DNA, 15 bp, Homo sapiens
tgtttaattgtaggt

SEQ ID NO: 4278959 - DNA, 15 bp, Homo sapiens
tgtttacttgaatag

SEQ ID NO: 4278960 - DNA, 19 bp, Homo sapiens
tgtttacttgaatagtatt

SEQ ID NO: 4278961 - DNA, 16 bp, Homo sapiens
tgtttagttcagcaaa

SEQ ID NO: 4278962 - DNA, 15 bp, Homo sapiens
tgtttcaccagtttc

SEQ ID NO: 4278963 - DNA, 17 bp, Homo sapiens
tgtttcactactcagca

SEQ ID NO: 4278964 - DNA, 16 bp, Homo sapiens
tgtttcaggtggaaca

SEQ ID NO: 4278965 - DNA, 19 bp, Homo sapiens
tgtttccaggcatgaccct

SEQ ID NO: 4278966 - DNA, 21 bp, Homo sapiens
tgtttccaggcatgaccctgg

SEQ ID NO: 4278967 - DNA, 15 bp, Homo sapiens
tgtttccagtgacac

SEQ ID NO: 4278968 - DNA, 21 bp, Homo sapiens
tgtttccctcaagaacaaaca

SEQ ID NO: 4278969 - DNA, 16 bp, Homo sapiens
tgtttctatactgttt

SEQ ID NO: 4278970 - DNA, 12 bp, Homo sapiens
tgtttctgtcct

SEQ ID NO: 4278971 - DNA, 19 bp, Homo sapiens
tgtttgatgtgtatgtgtt

SEQ ID NO: 4278972 - DNA, 21 bp, Homo sapiens
tgtttgcctttaggcaggaag

SEQ ID NO: 4278973 - DNA, 23 bp, Homo sapiens
tgtttgctcacccaggacctctg

SEQ ID NO: 4278974 - DNA, 16 bp, Homo sapiens
tgtttggttctggggc

SEQ ID NO: 4278975 - DNA, 18 bp, Homo sapiens
tgttttatgtcatactct

SEQ ID NO: 4278976 - DNA, 21 bp, Homo sapiens
tgttttgcaagggaatgaatc

SEQ ID NO: 4278977 - DNA, 14 bp, Homo sapiens
tgtttttgaagaag

SEQ ID NO: 4278978 - DNA, 14 bp, Homo sapiens
tgtttttttttaag

SEQ ID NO: 4278979 - DNA, 18 bp, Homo sapiens
tgttttttttttccactt

SEQ ID NO: 4278980 - DNA, 14 bp, Homo sapiens
ttaaaaaaataaca

SEQ ID NO: 4278981 - DNA, 19 bp, Homo sapiens
ttaaaaaagaaagatttta

SEQ ID NO: 4278982 - DNA, 11 bp, Homo sapiens
ttaaaaaataa

SEQ ID NO: 4278983 - DNA, 20 bp, Homo sapiens
ttaaaaagccaagtgtcctg

SEQ ID NO: 4278984 - DNA, 22 bp, Homo sapiens
ttgaggacctccacctgggaga

SEQ ID NO: 4278985 - DNA, 18 bp, Homo sapiens
ttgagggaaaacataata

SEQ ID NO: 4278986 - DNA, 17 bp, Homo sapiens
ttgaggtctgctcggcc

SEQ ID NO: 4278987 - DNA, 13 bp, Homo sapiens
ttgagtcatttta

SEQ ID NO: 4278988 - DNA, 17 bp, Homo sapiens
ttgagtgggccccctct

SEQ ID NO: 4278989 - DNA, 18 bp, Homo sapiens
ttgagtgggccccctctc

SEQ ID NO: 4278990 - DNA, 22 bp, Homo sapiens
ttgatattttcaacgcagccct

SEQ ID NO: 4278991 - DNA, 20 bp, Homo sapiens
ttgatcgatgttaaacgtca

SEQ ID NO: 4278992 - DNA, 18 bp, Homo sapiens
ttgatgaccaatctctgt

SEQ ID NO: 4278993 - DNA, 19 bp, Homo sapiens
ttgatgaccaatctctgtg

SEQ ID NO: 4278994 - DNA, 19 bp, Homo sapiens
ttgatgctgtttctacatt

SEQ ID NO: 4278995 - DNA, 23 bp, Homo sapiens
ttgatggtagaaattttatctct

SEQ ID NO: 4278996 - DNA, 15 bp, Homo sapiens
ttgatgtgtatgtgt

SEQ ID NO: 4278997 - DNA, 18 bp, Homo sapiens
ttgatgtgtatgtgttta

SEQ ID NO: 4278998 - DNA, 20 bp, Homo sapiens
ttgattttagccttctctgt

SEQ ID NO: 4278999 - DNA, 20 bp, Homo sapiens
ttgcaaacaaaatgatggga

SEQ ID NO: 4279000 - DNA, 18 bp, Homo sapiens
ttgcaaattattctagtc

SEQ ID NO: 4279001 - DNA, 19 bp, Homo sapiens
ttgcaaattattctagtca

SEQ ID NO: 4279002 - DNA, 20 bp, Homo sapiens
ttgcaaattattctagtcaa

SEQ ID NO: 4279003 - DNA, 15 bp, Homo sapiens
ttgcaacacacagac

SEQ ID NO: 4279004 - DNA, 18 bp, Homo sapiens
ttgcaactttagaaagaa

SEQ ID NO: 4279005 - DNA, 22 bp, Homo sapiens
ttgcaagtatgttttagcatgt

SEQ ID NO: 4279006 - DNA, 23 bp, Homo sapiens
ttgcaataaactcagtcaaatgt

SEQ ID NO: 4279007 - DNA, 16 bp, Homo sapiens
ttgcaatcttatgttg

SEQ ID NO: 4279008 - DNA, 20 bp, Homo sapiens
ttgcacacacagtctgttca

SEQ ID NO: 4279009 - DNA, 15 bp, Homo sapiens
ttgcacagcatctca

SEQ ID NO: 4279010 - DNA, 19 bp, Homo sapiens
ttgcacatggattcagttt

SEQ ID NO: 4279011 - DNA, 17 bp, Homo sapiens
ttgcagacctgggactt

SEQ ID NO: 4279012 - DNA, 18 bp, Homo sapiens
ttgcagacctgggacttt

SEQ ID NO: 4279013 - DNA, 20 bp, Homo sapiens
ttgcagacctgggactttag

SEQ ID NO: 4279014 - DNA, 17 bp, Homo sapiens
ttgcaggaagggaagag

SEQ ID NO: 4279015 - DNA, 21 bp, Homo sapiens
ttgcataagtggacccagctg

SEQ ID NO: 4279016 - DNA, 13 bp, Homo sapiens
ttgcattgtctgt

SEQ ID NO: 4279017 - DNA, 22 bp, Homo sapiens
ttgccaggaaaggagagtactt

SEQ ID NO: 4279018 - DNA, 21 bp, Homo sapiens
ttgccagtcttttgtcctgca

SEQ ID NO: 4279019 - DNA, 19 bp, Homo sapiens
ttgcccacacctgcctctg

SEQ ID NO: 4279020 - DNA, 15 bp, Homo sapiens
ttgcccatgatataa

SEQ ID NO: 4279021 - DNA, 16 bp, Homo sapiens
ttgccccccaccccag

SEQ ID NO: 4279022 - DNA, 19 bp, Homo sapiens
ttgccccccaccccagcct

SEQ ID NO: 4279023 - DNA, 15 bp, Homo sapiens
ttgccctgaggggcc

SEQ ID NO: 4279024 - DNA, 12 bp, Homo sapiens
ttgccgctggga

SEQ ID NO: 4279025 - DNA, 24 bp, Homo sapiens
ttgccgctgggagagccaaggcct

SEQ ID NO: 4279026 - DNA, 18 bp, Homo sapiens
ttgccgtggcatcttaaa

SEQ ID NO: 4279027 - DNA, 17 bp, Homo sapiens
ttgcctcatgaacactg

SEQ ID NO: 4279028 - DNA, 12 bp, Homo sapiens
ttgcctcctccc

SEQ ID NO: 4279029 - DNA, 18 bp, Homo sapiens
ttgcctctctgccagccg

SEQ ID NO: 4279030 - DNA, 14 bp, Homo sapiens
ttgccttctgggga

SEQ ID NO: 4279031 - DNA, 15 bp, Homo sapiens
ttgcgatgtgtttta

SEQ ID NO: 4279032 - DNA, 16 bp, Homo sapiens
ttgctaattaaaaagt

SEQ ID NO: 4279033 - DNA, 20 bp, Homo sapiens
ttgctagtgatacactgtat

SEQ ID NO: 4279034 - DNA, 19 bp, Homo sapiens
ttgctatcatatattataa

SEQ ID NO: 4279035 - DNA, 17 bp, Homo sapiens
ttgctcacccaggacct

SEQ ID NO: 4279036 - DNA, 22 bp, Homo sapiens
ttgctcacccaggacctctggg

SEQ ID NO: 4279037 - DNA, 13 bp, Homo sapiens
ttgctcccagttt

SEQ ID NO: 4279038 - DNA, 20 bp, Homo sapiens
ttgctgaggagctcagggct

SEQ ID NO: 4279039 - DNA, 19 bp, Homo sapiens
ttgctggagtcctgttctc

SEQ ID NO: 4279040 - DNA, 20 bp, Homo sapiens
ttgctggagtcctgttctca

SEQ ID NO: 4279041 - DNA, 22 bp, Homo sapiens
ttgctggagtcctgttctcaga

SEQ ID NO: 4279042 - DNA, 16 bp, Homo sapiens
ttgcttgtcctgctca

SEQ ID NO: 4279043 - DNA, 16 bp, Homo sapiens
ttgctttgtatgcact

SEQ ID NO: 4279044 - DNA, 21 bp, Homo sapiens
ttggaagggcgctgagggcag

SEQ ID NO: 4279045 - DNA, 21 bp, Homo sapiens
ttggaatgactataaacatta

SEQ ID NO: 4279046 - DNA, 18 bp, Homo sapiens
ttggacattttcttcaga

SEQ ID NO: 4279047 - DNA, 22 bp, Homo sapiens
ttggacggggacacggcctctg

SEQ ID NO: 4279048 - DNA, 16 bp, Homo sapiens
ttggactgtggcctca

SEQ ID NO: 4279049 - DNA, 19 bp, Homo sapiens
ttggactgtggcctcagga

SEQ ID NO: 4279050 - DNA, 22 bp, Homo sapiens
ttggagtgagtgtggctcccct

SEQ ID NO: 4279051 - DNA, 21 bp, Homo sapiens
ttggataataactagatctcc

SEQ ID NO: 4279052 - DNA, 19 bp, Homo sapiens
ttggataggagcttccaga

SEQ ID NO: 4279053 - DNA, 20 bp, Homo sapiens
ttggattggtaccagagcct

SEQ ID NO: 4279054 - DNA, 16 bp, Homo sapiens
ttggcacaccctctct

SEQ ID NO: 4279055 - DNA, 21 bp, Homo sapiens
ttggccagagggcccctcact

SEQ ID NO: 4279056 - DNA, 11 bp, Homo sapiens
ttggcccagca

SEQ ID NO: 4279057 - DNA, 19 bp, Homo sapiens
ttggcccccgagctggggg

SEQ ID NO: 4279058 - DNA, 12 bp, Homo sapiens
ttggcctcagca

SEQ ID NO: 4279059 - DNA, 16 bp, Homo sapiens
ttggcctcagcagaag

SEQ ID NO: 4279060 - DNA, 22 bp, Homo sapiens
ttggcctcagcagaaggccttg

SEQ ID NO: 4279061 - DNA, 23 bp, Homo sapiens
ttggcctgtccacctgtgctgct

SEQ ID NO: 4279062 - DNA, 14 bp, Homo sapiens
ttggcgggccaagg

SEQ ID NO: 4279063 - DNA, 18 bp, Homo sapiens
ttggctgggcccagaagg

SEQ ID NO: 4279064 - DNA, 15 bp, Homo sapiens
ttgggccccagggaa

SEQ ID NO: 4279065 - DNA, 17 bp, Homo sapiens
ttgggctgaatgtatgt

SEQ ID NO: 4279066 - DNA, 15 bp, Homo sapiens
ttgggctgagactgg

SEQ ID NO: 4279067 - DNA, 21 bp, Homo sapiens
ttggggcgaggcagaggacag

SEQ ID NO: 4279068 - DNA, 16 bp, Homo sapiens
ttgggggattcaaatg

SEQ ID NO: 4279069 - DNA, 15 bp, Homo sapiens
ttggggtagagagga

SEQ ID NO: 4279070 - DNA, 16 bp, Homo sapiens
ttggggtagagaggac

SEQ ID NO: 4279071 - DNA, 11 bp, Homo sapiens
ttggggtgggg

SEQ ID NO: 4279072 - DNA, 12 bp, Homo sapiens
ttgggttccaga

SEQ ID NO: 4279073 - DNA, 15 bp, Homo sapiens
ttggtgataagtgga

SEQ ID NO: 4279074 - DNA, 23 bp, Homo sapiens
ttggtgataagtggaaaaaagag

SEQ ID NO: 4279075 - DNA, 17 bp, Homo sapiens
ttggtggccaggctggt

SEQ ID NO: 4279076 - DNA, 20 bp, Homo sapiens
ttggtgtgttcgtggagcca

SEQ ID NO: 4279077 - DNA, 22 bp, Homo sapiens
ttggttaatcacttaacctgct

SEQ ID NO: 4279078 - DNA, 15 bp, Homo sapiens
ttggttcctccagca

SEQ ID NO: 4279079 - DNA, 13 bp, Homo sapiens
ttggttctggggc

SEQ ID NO: 4279080 - DNA, 14 bp, Homo sapiens
ttggttctggggcc

SEQ ID NO: 4279081 - DNA, 19 bp, Homo sapiens
ttggttttgcatgtctgca

SEQ ID NO: 4279082 - DNA, 15 bp, Homo sapiens
ttgtaaaatgtatta

SEQ ID NO: 4279083 - DNA, 21 bp, Homo sapiens
ttgtaacattctatttcaact

SEQ ID NO: 4279084 - DNA, 15 bp, Homo sapiens
ttgtagggtgaggcg

SEQ ID NO: 4279085 - DNA, 19 bp, Homo sapiens
ttgtaggtcaatgaaatat

SEQ ID NO: 4279086 - DNA, 14 bp, Homo sapiens
ttgtataaaacagt

SEQ ID NO: 4279087 - DNA, 17 bp, Homo sapiens
ttgtataaaacagtgtt

SEQ ID NO: 4279088 - DNA, 13 bp, Homo sapiens
ttgtatacaagta

SEQ ID NO: 4279089 - DNA, 16 bp, Homo sapiens
ttgtatacaagtactg

SEQ ID NO: 4279090 - DNA, 14 bp, Homo sapiens
ttgtatataaatgg

SEQ ID NO: 4279091 - DNA, 18 bp, Homo sapiens
ttgtatctttaaagactt

SEQ ID NO: 4279092 - DNA, 17 bp, Homo sapiens
ttgtatgaaatatatgt

SEQ ID NO: 4279093 - DNA, 22 bp, Homo sapiens
ttgtattttcttcccatttgta

SEQ ID NO: 4279094 - DNA, 18 bp, Homo sapiens
ttgtcaaaactccactca

SEQ ID NO: 4279095 - DNA, 21 bp, Homo sapiens
ttgtcaaaactccactcagca

SEQ ID NO: 4279096 - DNA, 13 bp, Homo sapiens
ttgtcactgaata

SEQ ID NO: 4279097 - DNA, 15 bp, Homo sapiens
ttgtcagagctggga

SEQ ID NO: 4279098 - DNA, 13 bp, Homo sapiens
ttgtcatgtggct

SEQ ID NO: 4279099 - DNA, 20 bp, Homo sapiens
ttgtccacaaatgtcctcag

SEQ ID NO: 4279100 - DNA, 21 bp, Homo sapiens
ttgtccacaaatgtcctcaga

SEQ ID NO: 4279101 - DNA, 13 bp, Homo sapiens
ttgtccacacaag

SEQ ID NO: 4279102 - DNA, 18 bp, Homo sapiens
ttgtccccaatgaatata

SEQ ID NO: 4279103 - DNA, 20 bp, Homo sapiens
ttgtccggtggaaggccttc

SEQ ID NO: 4279104 - DNA, 18 bp, Homo sapiens
ttgtctgaagtcactgca

SEQ ID NO: 4279105 - DNA, 20 bp, Homo sapiens
ttgtctgccgtgagagccca

SEQ ID NO: 4279106 - DNA, 20 bp, Homo sapiens
ttgtctggctgtggcccctc

SEQ ID NO: 4279107 - DNA, 22 bp, Homo sapiens
ttgtctggctgtggcccctcct

SEQ ID NO: 4279108 - DNA, 13 bp, Homo sapiens
ttgtctgtaaatc

SEQ ID NO: 4279109 - DNA, 14 bp, Homo sapiens
ttgtgaaatttgtt

SEQ ID NO: 4279110 - DNA, 16 bp, Homo sapiens
ttgtgaaatttgttaa

SEQ ID NO: 4279111 - DNA, 16 bp, Homo sapiens
ttgtgagccaaagaga

SEQ ID NO: 4279112 - DNA, 18 bp, Homo sapiens
ttgtgatgtgagttgcac

SEQ ID NO: 4279113 - DNA, 16 bp, Homo sapiens
agactggatactgccc

SEQ ID NO: 4279114 - DNA, 15 bp, Homo sapiens
agactgggctggctg

SEQ ID NO: 4279115 - DNA, 22 bp, Homo sapiens
agactgggctggctgccttctg

SEQ ID NO: 4279116 - DNA, 14 bp, Homo sapiens
agactgtctcaaga

SEQ ID NO: 4279117 - DNA, 20 bp, Homo sapiens
tgggcacctggggagtggga

SEQ ID NO: 4279118 - DNA, 14 bp, Homo sapiens
tgggcagaggggag

SEQ ID NO: 4279119 - DNA, 19 bp, Homo sapiens
tgggcagaggggagaggaa

SEQ ID NO: 4279120 - DNA, 12 bp, Homo sapiens
tgggcagcccag

SEQ ID NO: 4279121 - DNA, 13 bp, Homo sapiens
tgggcagcccaga

SEQ ID NO: 4279122 - DNA, 16 bp, Homo sapiens
tgggcagctggctctg

SEQ ID NO: 4279123 - DNA, 13 bp, Homo sapiens
tgggcaggacctc

SEQ ID NO: 4279124 - DNA, 16 bp, Homo sapiens
tgggcatccccagccc

SEQ ID NO: 4279125 - DNA, 22 bp, Homo sapiens
tgggcatccccagccccctggc

SEQ ID NO: 4279126 - DNA, 15 bp, Homo sapiens
tgggcatctggccct

SEQ ID NO: 4279127 - DNA, 16 bp, Homo sapiens
tgggcatctggccctg

SEQ ID NO: 4279128 - DNA, 18 bp, Homo sapiens
tgggcatctggccctgct

SEQ ID NO: 4279129 - DNA, 21 bp, Homo sapiens
tgggcatctggccctgctgcc

SEQ ID NO: 4279130 - DNA, 22 bp, Homo sapiens
tgggcatggggtgggcctctgg

SEQ ID NO: 4279131 - DNA, 16 bp, Homo sapiens
tgggcatgtccccagt

SEQ ID NO: 4279132 - DNA, 13 bp, Homo sapiens
tgggccaagccag

SEQ ID NO: 4279133 - DNA, 14 bp, Homo sapiens
tgggccagcccctc

SEQ ID NO: 4279134 - DNA, 23 bp, Homo sapiens
tgggccagcccctcccaccacag

SEQ ID NO: 4279135 - DNA, 14 bp, Homo sapiens
tgggccagggtctc

SEQ ID NO: 4279136 - DNA, 21 bp, Homo sapiens
tgggccagggtctcgtcagga

SEQ ID NO: 4279137 - DNA, 12 bp, Homo sapiens
tgggccctggct

SEQ ID NO: 4279138 - DNA, 13 bp, Homo sapiens
tgggccctggctc

SEQ ID NO: 4279139 - DNA, 15 bp, Homo sapiens
tgggccctggctctg

SEQ ID NO: 4279140 - DNA, 17 bp, Homo sapiens
tgggccctggctctgtc

SEQ ID NO: 4279141 - DNA, 21 bp, Homo sapiens
tgggccctggttcccccagga

SEQ ID NO: 4279142 - DNA, 16 bp, Homo sapiens
tgggcctctggtttgg

SEQ ID NO: 4279143 - DNA, 21 bp, Homo sapiens
tgggcctctggtttggggcga

SEQ ID NO: 4279144 - DNA, 19 bp, Homo sapiens
tgggcctgatggtggggcc

SEQ ID NO: 4279145 - DNA, 13 bp, Homo sapiens
tgggcgtgacttc

SEQ ID NO: 4279146 - DNA, 11 bp, Homo sapiens
tgggctccaga

SEQ ID NO: 4279147 - DNA, 12 bp, Homo sapiens
tgggctccagag

SEQ ID NO: 4279148 - DNA, 19 bp, Homo sapiens
tgggctcccacgccctcct

SEQ ID NO: 4279149 - DNA, 14 bp, Homo sapiens
tgggctctgcgtcc

SEQ ID NO: 4279150 - DNA, 20 bp, Homo sapiens
tgggctgccctggtgctgcc

SEQ ID NO: 4279151 - DNA, 13 bp, Homo sapiens
tgggctggctgcc

SEQ ID NO: 4279152 - DNA, 21 bp, Homo sapiens
tgggctggtttggtggccagg

SEQ ID NO: 4279153 - DNA, 22 bp, Homo sapiens
tgggctggtttggtggccaggc

SEQ ID NO: 4279154 - DNA, 19 bp, Homo sapiens
tggggaacaagggtggcat

SEQ ID NO: 4279155 - DNA, 23 bp, Homo sapiens
tggggaggagactcaggcccaca

SEQ ID NO: 4279156 - DNA, 13 bp, Homo sapiens
tggggaggggaga

SEQ ID NO: 4279157 - DNA, 13 bp, Homo sapiens
tggggagtgggac

SEQ ID NO: 4279158 - DNA, 16 bp, Homo sapiens
tggggagtgggacaga

SEQ ID NO: 4279159 - DNA, 14 bp, Homo sapiens
tggggatgcccttc

SEQ ID NO: 4279160 - DNA, 17 bp, Homo sapiens
tggggatttctcccagc

SEQ ID NO: 4279161 - DNA, 14 bp, Homo sapiens
tggggcgaggcaga

SEQ ID NO: 4279162 - DNA, 19 bp, Homo sapiens
tggggcgaggcagaggaca

SEQ ID NO: 4279163 - DNA, 17 bp, Homo sapiens
tggggcgggaaagccag

SEQ ID NO: 4279164 - DNA, 19 bp, Homo sapiens
tggggcgggaaagccagtg

SEQ ID NO: 4279165 - DNA, 22 bp, Homo sapiens
tggggcggtcaataattgtgga

SEQ ID NO: 4279166 - DNA, 20 bp, Homo sapiens
tggggctagactgggctggc

SEQ ID NO: 4279167 - DNA, 16 bp, Homo sapiens
tggggctgccgtgcac

SEQ ID NO: 4279168 - DNA, 20 bp, Homo sapiens
tggggcttagaatggggctt

SEQ ID NO: 4279169 - DNA, 20 bp, Homo sapiens
tggggcttttgtgccaggag

SEQ ID NO: 4279170 - DNA, 21 bp, Homo sapiens
tgggggacttacatgattcat

SEQ ID NO: 4279171 - DNA, 17 bp, Homo sapiens
tgggggcctgctgtggg

SEQ ID NO: 4279172 - DNA, 18 bp, Homo sapiens
tgggggcctgctgtgggt

SEQ ID NO: 4279173 - DNA, 22 bp, Homo sapiens
tgggggctgctgcactgccctc

SEQ ID NO: 4279174 - DNA, 16 bp, Homo sapiens
tggggggcacagccag

SEQ ID NO: 4279175 - DNA, 17 bp, Homo sapiens
tggggggcacagccaga

SEQ ID NO: 4279176 - DNA, 17 bp, Homo sapiens
tggggggccaacaccag

SEQ ID NO: 4279177 - DNA, 17 bp, Homo sapiens
tgggggttgttgggagg

SEQ ID NO: 4279178 - DNA, 13 bp, Homo sapiens
tggggtagagagg

SEQ ID NO: 4279179 - DNA, 20 bp, Homo sapiens
tggggtgggcctctggtttg

SEQ ID NO: 4279180 - DNA, 20 bp, Homo sapiens
tggggttcgtggaaagggtg

SEQ ID NO: 4279181 - DNA, 18 bp, Homo sapiens
tggggttggctgggccca

SEQ ID NO: 4279182 - DNA, 21 bp, Homo sapiens
tggggttggctgggcccagaa

SEQ ID NO: 4279183 - DNA, 18 bp, Homo sapiens
tggggtttccacacaggc

SEQ ID NO: 4279184 - DNA, 23 bp, Homo sapiens
tgggtcaactccaaggcaaatgt

SEQ ID NO: 4279185 - DNA, 16 bp, Homo sapiens
tgggtcagtgtgccac

SEQ ID NO: 4279186 - DNA, 18 bp, Homo sapiens
tgggtggccggccctgcc

SEQ ID NO: 4279187 - DNA, 19 bp, Homo sapiens
tgggtggccggccctgccc

SEQ ID NO: 4279188 - DNA, 14 bp, Homo sapiens
tgggtggggaggga

SEQ ID NO: 4279189 - DNA, 16 bp, Homo sapiens
tgggtgtgctccaggc

SEQ ID NO: 4279190 - DNA, 18 bp, Homo sapiens
tgggtgtgctccaggctt

SEQ ID NO: 4279191 - DNA, 20 bp, Homo sapiens
tgggtttgggcagtggagag

SEQ ID NO: 4279192 - DNA, 21 bp, Homo sapiens
tgggtttgggcagtggagagg

SEQ ID NO: 4279193 - DNA, 10 bp, Homo sapiens
tggtaacatt

SEQ ID NO: 4279194 - DNA, 18 bp, Homo sapiens
tggtaactttatttaaaa

SEQ ID NO: 4279195 - DNA, 12 bp, Homo sapiens
tggtaagattgt

SEQ ID NO: 4279196 - DNA, 14 bp, Homo sapiens
tggtaatgtgtcaa

SEQ ID NO: 4279197 - DNA, 18 bp, Homo sapiens
tggtaatgtgtcaaagag

SEQ ID NO: 4279198 - DNA, 20 bp, Homo sapiens
tggtatgtgaattgaagtca

SEQ ID NO: 4279199 - DNA, 15 bp, Homo sapiens
tggtcacccccaccc

SEQ ID NO: 4279200 - DNA, 20 bp, Homo sapiens
tggtcagcggcctggggacg

SEQ ID NO: 4279201 - DNA, 15 bp, Homo sapiens
tggtcatcctgggca

SEQ ID NO: 4279202 - DNA, 15 bp, Homo sapiens
tggtccaggccaggc

SEQ ID NO: 4279203 - DNA, 16 bp, Homo sapiens
tggtctctaggcctga

SEQ ID NO: 4279204 - DNA, 22 bp, Homo sapiens
tggtctgcaccccacaggatga

SEQ ID NO: 4279205 - DNA, 16 bp, Homo sapiens
tggtctggagccccta

SEQ ID NO: 4279206 - DNA, 18 bp, Homo sapiens
tggtcttcaagcctggcc

SEQ ID NO: 4279207 - DNA, 19 bp, Homo sapiens
tggtcttcaagcctggccc

SEQ ID NO: 4279208 - DNA, 14 bp, Homo sapiens
tggtcttggagagg

SEQ ID NO: 4279209 - DNA, 19 bp, Homo sapiens
tggtgaggttgtgctgcct

SEQ ID NO: 4279210 - DNA, 12 bp, Homo sapiens
tggtgcagtgaa

SEQ ID NO: 4279211 - DNA, 16 bp, Homo sapiens
tggtgcatttaaaatg

SEQ ID NO: 4279212 - DNA, 16 bp, Homo sapiens
tggtgcccaccagctg

SEQ ID NO: 4279213 - DNA, 18 bp, Homo sapiens
tggtgcccaccagctggc

SEQ ID NO: 4279214 - DNA, 20 bp, Homo sapiens
tggtgcccaccagctggctc

SEQ ID NO: 4279215 - DNA, 12 bp, Homo sapiens
tggtgccctggc

SEQ ID NO: 4279216 - DNA, 14 bp, Homo sapiens
tggtgccctggccc

SEQ ID NO: 4279217 - DNA, 22 bp, Homo sapiens
tggtggacagacccagggtggt

SEQ ID NO: 4279218 - DNA, 17 bp, Homo sapiens
tggtggccaagcctgcc

SEQ ID NO: 4279219 - DNA, 14 bp, Homo sapiens
tggtggtttcagaa

SEQ ID NO: 4279220 - DNA, 16 bp, Homo sapiens
tggtggtttcagaaag

SEQ ID NO: 4279221 - DNA, 17 bp, Homo sapiens
tggtgtccctgcctggc

SEQ ID NO: 4279222 - DNA, 15 bp, Homo sapiens
tggtgtgaatgctgt

SEQ ID NO: 4279223 - DNA, 19 bp, Homo sapiens
tggtgtgaatgctgtacct

SEQ ID NO: 4279224 - DNA, 17 bp, Homo sapiens
tggtgttcttcccaaag

SEQ ID NO: 4279225 - DNA, 21 bp, Homo sapiens
tggttaagaatgtatatcagg

SEQ ID NO: 4279226 - DNA, 13 bp, Homo sapiens
tggttagaaaagt

SEQ ID NO: 4279227 - DNA, 17 bp, Homo sapiens
tggttcatgcctggggt

SEQ ID NO: 4279228 - DNA, 21 bp, Homo sapiens
tggttcccccaggaccctgag

SEQ ID NO: 4279229 - DNA, 18 bp, Homo sapiens
tggttcccctgttcactc

SEQ ID NO: 4279230 - DNA, 21 bp, Homo sapiens
tggttccttaagtggctgtga

SEQ ID NO: 4279231 - DNA, 22 bp, Homo sapiens
tggtttcagaaagggcagcccc

SEQ ID NO: 4279232 - DNA, 22 bp, Homo sapiens
tggtttggggcgaggcagagga

SEQ ID NO: 4279233 - DNA, 13 bp, Homo sapiens
tgtaaaatgtatt

SEQ ID NO: 4279234 - DNA, 14 bp, Homo sapiens
tgtaaaatgtatta

SEQ ID NO: 4279235 - DNA, 15 bp, Homo sapiens
tgtaaaatgtattat

SEQ ID NO: 4279236 - DNA, 19 bp, Homo sapiens
tgtaaaatgtattatgtcc

SEQ ID NO: 4279237 - DNA, 14 bp, Homo sapiens
tgtaaaattcatag

SEQ ID NO: 4279238 - DNA, 20 bp, Homo sapiens
tgtaaaggtaggtgcatgcc

SEQ ID NO: 4279239 - DNA, 13 bp, Homo sapiens
tgtaaataggttt

SEQ ID NO: 4279240 - DNA, 16 bp, Homo sapiens
tgtaaatctaacatta

SEQ ID NO: 4279241 - DNA, 16 bp, Homo sapiens
tgtaacatgtctaaag

SEQ ID NO: 4279242 - DNA, 19 bp, Homo sapiens
tgtaacatgtctaaagtta

SEQ ID NO: 4279243 - DNA, 17 bp, Homo sapiens
tgtaaccacaactttca

SEQ ID NO: 4279244 - DNA, 12 bp, Homo sapiens
tgtaactgttac

SEQ ID NO: 4279245 - DNA, 14 bp, Homo sapiens
tgtaagaagcccga

SEQ ID NO: 4279246 - DNA, 16 bp, Homo sapiens
tgtaatagcctcacct

SEQ ID NO: 4279247 - DNA, 19 bp, Homo sapiens
tgtaatagtggctttcatt

SEQ ID NO: 4279248 - DNA, 21 bp, Homo sapiens
tgtaatcatttcttgggccct

SEQ ID NO: 4279249 - DNA, 15 bp, Homo sapiens
tgtaatctctgatta

SEQ ID NO: 4279250 - DNA, 14 bp, Homo sapiens
tgtaatcttgttga

SEQ ID NO: 4279251 - DNA, 17 bp, Homo sapiens
tgtaatgtatcttattt

SEQ ID NO: 4279252 - DNA, 22 bp, Homo sapiens
tgtacaaagggaagcagagcct

SEQ ID NO: 4279253 - DNA, 15 bp, Homo sapiens
tgtacagttatacat

SEQ ID NO: 4279254 - DNA, 13 bp, Homo sapiens
tgtaccatgttaa

SEQ ID NO: 4279255 - DNA, 22 bp, Homo sapiens
tgtacctgcccccactcagcat

SEQ ID NO: 4279256 - DNA, 14 bp, Homo sapiens
tgtacgtctggtgt

SEQ ID NO: 4279257 - DNA, 13 bp, Homo sapiens
tgtactcctccca

SEQ ID NO: 4279258 - DNA, 23 bp, Homo sapiens
tgtacttgccctgaccatgcatt

SEQ ID NO: 4279259 - DNA, 19 bp, Homo sapiens
tgtactttcattccctttc

SEQ ID NO: 4279260 - DNA, 20 bp, Homo sapiens
tgtagaaaggttgattctca

SEQ ID NO: 4279261 - DNA, 19 bp, Homo sapiens
tgtagaactgttcatttcc

SEQ ID NO: 4279262 - DNA, 21 bp, Homo sapiens
tgtagaactgttcatttccac

SEQ ID NO: 4279263 - DNA, 22 bp, Homo sapiens
tgtagaactgttcatttccacc

SEQ ID NO: 4279264 - DNA, 14 bp, Homo sapiens
tgtagaagagggag

SEQ ID NO: 4279265 - DNA, 15 bp, Homo sapiens
tgtagaagagggaga

SEQ ID NO: 4279266 - DNA, 19 bp, Homo sapiens
tgtagaagagggagaagga

SEQ ID NO: 4279267 - DNA, 24 bp, Homo sapiens
tgtagaagagggagaaggagaggc

SEQ ID NO: 4279268 - DNA, 15 bp, Homo sapiens
tgtagagtgcccatg

SEQ ID NO: 4279269 - DNA, 17 bp, Homo sapiens
tgtagcatttcttgatg

SEQ ID NO: 4279270 - DNA, 18 bp, Homo sapiens
tgtagcatttcttgatgt

SEQ ID NO: 4279271 - DNA, 15 bp, Homo sapiens
tgtagctagaatatc

SEQ ID NO: 4279272 - DNA, 16 bp, Homo sapiens
tgtagctagaatatcc

SEQ ID NO: 4279273 - DNA, 15 bp, Homo sapiens
tgtaggtcaatgaaa

SEQ ID NO: 4279274 - DNA, 18 bp, Homo sapiens
tgtaggtcaatgaaatat

SEQ ID NO: 4279275 - DNA, 21 bp, Homo sapiens
tgtaggtcaatgaaatatttg

SEQ ID NO: 4279276 - DNA, 15 bp, Homo sapiens
tgtagtagttgatga

SEQ ID NO: 4279277 - DNA, 15 bp, Homo sapiens
tgtataaaacagtgt

SEQ ID NO: 4279278 - DNA, 19 bp, Homo sapiens
tgtatacaagtactggtaa

SEQ ID NO: 4279279 - DNA, 19 bp, Homo sapiens
tgtatagtgagtgtggctt

SEQ ID NO: 4279280 - DNA, 12 bp, Homo sapiens
tgtatatttgta

SEQ ID NO: 4279281 - DNA, 15 bp, Homo sapiens
tgtatatttgtatga

SEQ ID NO: 4279282 - DNA, 13 bp, Homo sapiens
tgtatcagtgttt

SEQ ID NO: 4279283 - DNA, 17 bp, Homo sapiens
tgtatcttatttatata

SEQ ID NO: 4279284 - DNA, 14 bp, Homo sapiens
tgtatgcactttgt

SEQ ID NO: 4279285 - DNA, 13 bp, Homo sapiens
tgtatgtcattaa

SEQ ID NO: 4279286 - DNA, 23 bp, Homo sapiens
tgtatgtgaaagtgtaaaataga

SEQ ID NO: 4279287 - DNA, 11 bp, Homo sapiens
tgtatgtgttt

SEQ ID NO: 4279288 - DNA, 19 bp, Homo sapiens
tgtatgtgtttataattgt

SEQ ID NO: 4279289 - DNA, 22 bp, Homo sapiens
tgtattaagcccacagtatatt

SEQ ID NO: 4279290 - DNA, 18 bp, Homo sapiens
tgtattctgtggattcta

SEQ ID NO: 4279291 - DNA, 19 bp, Homo sapiens
tgtattctgtggattctat

SEQ ID NO: 4279292 - DNA, 16 bp, Homo sapiens
tgtattgttagatgtt

SEQ ID NO: 4279293 - DNA, 19 bp, Homo sapiens
tgtattgttagatgtttgt

SEQ ID NO: 4279294 - DNA, 15 bp, Homo sapiens
tgtatttatattaga

SEQ ID NO: 4279295 - DNA, 18 bp, Homo sapiens
tgtatttattttcctccc

SEQ ID NO: 4279296 - DNA, 20 bp, Homo sapiens
tgtatttattttcctcccca

SEQ ID NO: 4279297 - DNA, 17 bp, Homo sapiens
tgtatttgtagtgttat

SEQ ID NO: 4279298 - DNA, 21 bp, Homo sapiens
tgtattttcttcccatttgta

SEQ ID NO: 4279299 - DNA, 14 bp, Homo sapiens
tgtatttttagaga

SEQ ID NO: 4279300 - DNA, 19 bp, Homo sapiens
tgtcaaaactccactcagc

SEQ ID NO: 4279301 - DNA, 19 bp, Homo sapiens
tgtcaaccttgtgtgagtg

SEQ ID NO: 4279302 - DNA, 22 bp, Homo sapiens
tgtcaaccttgtgtgagtgtga

SEQ ID NO: 4279303 - DNA, 13 bp, Homo sapiens
tgtcaatgtgtgc

SEQ ID NO: 4279304 - DNA, 20 bp, Homo sapiens
tgtcacagaggcagtggcag

SEQ ID NO: 4279305 - DNA, 13 bp, Homo sapiens
tgtcagagctggg

SEQ ID NO: 4279306 - DNA, 15 bp, Homo sapiens
tgtcagagctgggag

SEQ ID NO: 4279307 - DNA, 19 bp, Homo sapiens
tgtcagcgtttctccacct

SEQ ID NO: 4279308 - DNA, 18 bp, Homo sapiens
tgtcataaagtgagaaaa

SEQ ID NO: 4279309 - DNA, 20 bp, Homo sapiens
tgtcataaagtgagaaaact

SEQ ID NO: 4279310 - DNA, 15 bp, Homo sapiens
tgtcatactctgtgt

SEQ ID NO: 4279311 - DNA, 20 bp, Homo sapiens
tgtcatatatggggggccaa

SEQ ID NO: 4279312 - DNA, 14 bp, Homo sapiens
tgtcatgtgcagat

SEQ ID NO: 4279313 - DNA, 12 bp, Homo sapiens
tgtccacaaatg

SEQ ID NO: 4279314 - DNA, 14 bp, Homo sapiens
tgtccacaaatgtc

SEQ ID NO: 4279315 - DNA, 15 bp, Homo sapiens
tgtccacaaatgtcc

SEQ ID NO: 4279316 - DNA, 17 bp, Homo sapiens
tgtccacaaatgtcctc

SEQ ID NO: 4279317 - DNA, 22 bp, Homo sapiens
tgtccacacaagacagcagagc

SEQ ID NO: 4279318 - DNA, 14 bp, Homo sapiens
tgtccatctgtctg

SEQ ID NO: 4279319 - DNA, 20 bp, Homo sapiens
tgtccatgaaaaacagcaga

SEQ ID NO: 4279320 - DNA, 14 bp, Homo sapiens
tgtccatgtgaaat

SEQ ID NO: 4279321 - DNA, 16 bp, Homo sapiens
tgtccatttttacaag

SEQ ID NO: 4279322 - DNA, 19 bp, Homo sapiens
tgtcccacaaaatatttct

SEQ ID NO: 4279323 - DNA, 15 bp, Homo sapiens
tgtccccaggggcac

SEQ ID NO: 4279324 - DNA, 17 bp, Homo sapiens
tgtccccaggggcacac

SEQ ID NO: 4279325 - DNA, 22 bp, Homo sapiens
tgtccccaggggcacacttccc

SEQ ID NO: 4279326 - DNA, 13 bp, Homo sapiens
tgtcccctgcctg

SEQ ID NO: 4279327 - DNA, 20 bp, Homo sapiens
tgtcccggagctcaggccct

SEQ ID NO: 4279328 - DNA, 15 bp, Homo sapiens
tgtccctctctctgg

SEQ ID NO: 4279329 - DNA, 16 bp, Homo sapiens
tgtccctctctctgga

SEQ ID NO: 4279330 - DNA, 14 bp, Homo sapiens
tgtccctgcagggc

SEQ ID NO: 4279331 - DNA, 20 bp, Homo sapiens
tgtccctgccccgcccccca

SEQ ID NO: 4279332 - DNA, 15 bp, Homo sapiens
tgtccctgtccctgc

SEQ ID NO: 4279333 - DNA, 15 bp, Homo sapiens
tgtcccttacctggc

SEQ ID NO: 4279334 - DNA, 16 bp, Homo sapiens
tgtccgtagtatcaga

SEQ ID NO: 4279335 - DNA, 13 bp, Homo sapiens
tgtcctacccgcc

SEQ ID NO: 4279336 - DNA, 14 bp, Homo sapiens
tgtcctacccgccc

SEQ ID NO: 4279337 - DNA, 21 bp, Homo sapiens
tgtcctacccgcccgcgtcca

SEQ ID NO: 4279338 - DNA, 22 bp, Homo sapiens
tgtcctacccgcccgcgtccaa

SEQ ID NO: 4279339 - DNA, 15 bp, Homo sapiens
tgtcctatccctgga

SEQ ID NO: 4279340 - DNA, 14 bp, Homo sapiens
tgtcctgctcagat

SEQ ID NO: 4279341 - DNA, 20 bp, Homo sapiens
tgtcctgtgagatgtgtatc

SEQ ID NO: 4279342 - DNA, 19 bp, Homo sapiens
tgtcctgttgattaatttc

SEQ ID NO: 4279343 - DNA, 19 bp, Homo sapiens
tgtccttagactccttctc

SEQ ID NO: 4279344 - DNA, 23 bp, Homo sapiens
tgtccttagactccttctcccca

SEQ ID NO: 4279345 - DNA, 23 bp, Homo sapiens
tgtccttcccacggccactgcag

SEQ ID NO: 4279346 - DNA, 22 bp, Homo sapiens
tgtctaaagttagggcattttt

SEQ ID NO: 4279347 - DNA, 16 bp, Homo sapiens
tgtctagtttgcatac

SEQ ID NO: 4279348 - DNA, 22 bp, Homo sapiens
tgtctagtttgcatacttcctg

SEQ ID NO: 4279349 - DNA, 12 bp, Homo sapiens
tgtctattgtcc

SEQ ID NO: 4279350 - DNA, 17 bp, Homo sapiens
tgtctcaagagggcact

SEQ ID NO: 4279351 - DNA, 21 bp, Homo sapiens
tgtctcaagagggcactggtg

SEQ ID NO: 4279352 - DNA, 23 bp, Homo sapiens
tgtctcaagagggcactggtggc

SEQ ID NO: 4279353 - DNA, 16 bp, Homo sapiens
tgtctccagaccccca

SEQ ID NO: 4279354 - DNA, 17 bp, Homo sapiens
tgtctccagacccccac

SEQ ID NO: 4279355 - DNA, 23 bp, Homo sapiens
tgtctcttgcataagcctcaggc

SEQ ID NO: 4279356 - DNA, 17 bp, Homo sapiens
tgtctgaaaccagaaga

SEQ ID NO: 4279357 - DNA, 18 bp, Homo sapiens
tgtctgaagtcactgcac

SEQ ID NO: 4279358 - DNA, 19 bp, Homo sapiens
tgtctgaagtcactgcaca

SEQ ID NO: 4279359 - DNA, 20 bp, Homo sapiens
tgtctgacttctcaggaaga

SEQ ID NO: 4279360 - DNA, 19 bp, Homo sapiens
tgtctggctgtggcccctc

SEQ ID NO: 4279361 - DNA, 19 bp, Homo sapiens
tgtctgggtcgtcttttga

SEQ ID NO: 4279362 - DNA, 18 bp, Homo sapiens
tgtctgtaaatctaacat

SEQ ID NO: 4279363 - DNA, 22 bp, Homo sapiens
tgtctgtaaatctaacattatt

SEQ ID NO: 4279364 - DNA, 17 bp, Homo sapiens
tgtctgtccatctgtct

SEQ ID NO: 4279365 - DNA, 18 bp, Homo sapiens
tgtctgtccatctgtctg

SEQ ID NO: 4279366 - DNA, 23 bp, Homo sapiens
tgtctgtccatctgtctgtccta

SEQ ID NO: 4279367 - DNA, 16 bp, Homo sapiens
tgtctgtcccagttaa

SEQ ID NO: 4279368 - DNA, 14 bp, Homo sapiens
tgtctgtggccctc

SEQ ID NO: 4279369 - DNA, 16 bp, Homo sapiens
tgtcttgtgtttttgt

SEQ ID NO: 4279370 - DNA, 19 bp, Homo sapiens
tgtctttctccaaagttat

SEQ ID NO: 4279371 - DNA, 12 bp, Homo sapiens
tgtctttgctgt

SEQ ID NO: 4279372 - DNA, 21 bp, Homo sapiens
tgtctttgctgtttatatata

SEQ ID NO: 4279373 - DNA, 14 bp, Homo sapiens
tgtcttttaatgat

SEQ ID NO: 4279374 - DNA, 16 bp, Homo sapiens
tgtgaaacacagctgt

SEQ ID NO: 4279375 - DNA, 22 bp, Homo sapiens
tgtgaaacagggagctatgaga

SEQ ID NO: 4279376 - DNA, 14 bp, Homo sapiens
tgtgaaatatcatc

SEQ ID NO: 4279377 - DNA, 20 bp, Homo sapiens
tgtgaacttggggaacaagg

SEQ ID NO: 4279378 - DNA, 15 bp, Homo sapiens
tgtgaataaagccac

SEQ ID NO: 4279379 - DNA, 15 bp, Homo sapiens
tgtgaatataaatgt

SEQ ID NO: 4279380 - DNA, 18 bp, Homo sapiens
tgtgaatataaatgtgtg

SEQ ID NO: 4279381 - DNA, 22 bp, Homo sapiens
tgtgaatgctgtacctttctga

SEQ ID NO: 4279382 - DNA, 21 bp, Homo sapiens
tgctcctgtggcggtgcagtg

SEQ ID NO: 4279383 - DNA, 12 bp, Homo sapiens
tgctctattgta

SEQ ID NO: 4279384 - DNA, 14 bp, Homo sapiens
tgctgactgtactc

SEQ ID NO: 4279385 - DNA, 22 bp, Homo sapiens
tgctgactgtactcctcccagg

SEQ ID NO: 4279386 - DNA, 20 bp, Homo sapiens
tgctgagattacaggtgtga

SEQ ID NO: 4279387 - DNA, 16 bp, Homo sapiens
tgctgcactgccctcc

SEQ ID NO: 4279388 - DNA, 21 bp, Homo sapiens
tgctgcagtcagcacagagag

SEQ ID NO: 4279389 - DNA, 15 bp, Homo sapiens
tgctgccacacttca

SEQ ID NO: 4279390 - DNA, 22 bp, Homo sapiens
tgctgccacacttcaggctctt

SEQ ID NO: 4279391 - DNA, 18 bp, Homo sapiens
tgctgccaggctcccact

SEQ ID NO: 4279392 - DNA, 16 bp, Homo sapiens
tgctgcccccagaccc

SEQ ID NO: 4279393 - DNA, 18 bp, Homo sapiens
tgctgcccgtgaggaggg

SEQ ID NO: 4279394 - DNA, 17 bp, Homo sapiens
tgctgcctccccaaccc

SEQ ID NO: 4279395 - DNA, 22 bp, Homo sapiens
tgctgcctgcctccggccctgc

SEQ ID NO: 4279396 - DNA, 13 bp, Homo sapiens
tgctgccttctgt

SEQ ID NO: 4279397 - DNA, 15 bp, Homo sapiens
tgctgccttctgtct

SEQ ID NO: 4279398 - DNA, 16 bp, Homo sapiens
tgctgccttctgtctc

SEQ ID NO: 4279399 - DNA, 18 bp, Homo sapiens
tgctgccttctgtctctt

SEQ ID NO: 4279400 - DNA, 21 bp, Homo sapiens
tgctgccttctgtctcttgca

SEQ ID NO: 4279401 - DNA, 18 bp, Homo sapiens
tgctgctggctcccatct

SEQ ID NO: 4279402 - DNA, 12 bp, Homo sapiens
tgctgctgtgaa

SEQ ID NO: 4279403 - DNA, 14 bp, Homo sapiens
tgctgctgtgaatt

SEQ ID NO: 4279404 - DNA, 15 bp, Homo sapiens
tgctgcttccctctg

SEQ ID NO: 4279405 - DNA, 21 bp, Homo sapiens
tgctgcttccctctgcctgtc

SEQ ID NO: 4279406 - DNA, 19 bp, Homo sapiens
tgctggattctaaattatg

SEQ ID NO: 4279407 - DNA, 12 bp, Homo sapiens
tgctggcccctc

SEQ ID NO: 4279408 - DNA, 16 bp, Homo sapiens
tgctggctcccagggc

SEQ ID NO: 4279409 - DNA, 21 bp, Homo sapiens
tgctggctgccttagaacctt

SEQ ID NO: 4279410 - DNA, 13 bp, Homo sapiens
tgctggtgcccac

SEQ ID NO: 4279411 - DNA, 15 bp, Homo sapiens
tgctgtaagacggcc

SEQ ID NO: 4279412 - DNA, 16 bp, Homo sapiens
tgctgtatacaaacag

SEQ ID NO: 4279413 - DNA, 18 bp, Homo sapiens
tgctgtatacaaacaggt

SEQ ID NO: 4279414 - DNA, 17 bp, Homo sapiens
tgctgtatgtcattaaa

SEQ ID NO: 4279415 - DNA, 14 bp, Homo sapiens
tgctgttgtctgcc

SEQ ID NO: 4279416 - DNA, 17 bp, Homo sapiens
tgctgttgttcagaagt

SEQ ID NO: 4279417 - DNA, 21 bp, Homo sapiens
tgcttagtcacttatttcata

SEQ ID NO: 4279418 - DNA, 15 bp, Homo sapiens
tgcttagtgtccctt

SEQ ID NO: 4279419 - DNA, 20 bp, Homo sapiens
tgcttagtgtcccttacctg

SEQ ID NO: 4279420 - DNA, 16 bp, Homo sapiens
tgcttatattgttcac

SEQ ID NO: 4279421 - DNA, 13 bp, Homo sapiens
tgcttattgatat

SEQ ID NO: 4279422 - DNA, 21 bp, Homo sapiens
tgcttccagttggactgtggc

SEQ ID NO: 4279423 - DNA, 15 bp, Homo sapiens
tgcttccctctgcct

SEQ ID NO: 4279424 - DNA, 13 bp, Homo sapiens
tgcttctgcccac

SEQ ID NO: 4279425 - DNA, 15 bp, Homo sapiens
tgcttctgcccaccc

SEQ ID NO: 4279426 - DNA, 19 bp, Homo sapiens
tgcttctgcccaccccgcc

SEQ ID NO: 4279427 - DNA, 21 bp, Homo sapiens
tgcttctgcccaccccgcctc

SEQ ID NO: 4279428 - DNA, 16 bp, Homo sapiens
tgcttggatccataca

SEQ ID NO: 4279429 - DNA, 18 bp, Homo sapiens
tgcttggatccatacaaa

SEQ ID NO: 4279430 - DNA, 20 bp, Homo sapiens
tgcttggatccatacaaaac

SEQ ID NO: 4279431 - DNA, 21 bp, Homo sapiens
tgcttggatccatacaaaact

SEQ ID NO: 4279432 - DNA, 17 bp, Homo sapiens
tgcttgtgttgggcccc

SEQ ID NO: 4279433 - DNA, 19 bp, Homo sapiens
tgctttcacaaatatagtt

SEQ ID NO: 4279434 - DNA, 15 bp, Homo sapiens
tgctttgctggagtc

SEQ ID NO: 4279435 - DNA, 23 bp, Homo sapiens
tgctttgctggagtcctgttctc

SEQ ID NO: 4279436 - DNA, 20 bp, Homo sapiens
tgctttgggctgccctggtg

SEQ ID NO: 4279437 - DNA, 16 bp, Homo sapiens
tgctttgtgtgattga

SEQ ID NO: 4279438 - DNA, 23 bp, Homo sapiens
tggaaaaaagagaaaaaccaatg

SEQ ID NO: 4279439 - DNA, 14 bp, Homo sapiens
tggaaaactcacag

SEQ ID NO: 4279440 - DNA, 13 bp, Homo sapiens
tggaaacaagatg

SEQ ID NO: 4279441 - DNA, 23 bp, Homo sapiens
tggaaagggtgctgcttccctct

SEQ ID NO: 4279442 - DNA, 13 bp, Homo sapiens
tggaaagggtgtg

SEQ ID NO: 4279443 - DNA, 18 bp, Homo sapiens
tggaaagggtgtggcttg

SEQ ID NO: 4279444 - DNA, 18 bp, Homo sapiens
tggaacaggaggaactgg

SEQ ID NO: 4279445 - DNA, 21 bp, Homo sapiens
tggaacaggaggaactggtcc

SEQ ID NO: 4279446 - DNA, 16 bp, Homo sapiens
tggaactgctgccatg

SEQ ID NO: 4279447 - DNA, 14 bp, Homo sapiens
tggaagagagaaag

SEQ ID NO: 4279448 - DNA, 16 bp, Homo sapiens
tggaagcctccacctg

SEQ ID NO: 4279449 - DNA, 17 bp, Homo sapiens
tggaagcctccacctgc

SEQ ID NO: 4279450 - DNA, 15 bp, Homo sapiens
tggaagctggcagga

SEQ ID NO: 4279451 - DNA, 16 bp, Homo sapiens
tggaaggaaaggaata

SEQ ID NO: 4279452 - DNA, 19 bp, Homo sapiens
tggaatgactataaacatt

SEQ ID NO: 4279453 - DNA, 12 bp, Homo sapiens
tggacagggcca

SEQ ID NO: 4279454 - DNA, 13 bp, Homo sapiens
tggacagggccag

SEQ ID NO: 4279455 - DNA, 20 bp, Homo sapiens
tggacccagcaggggcagaa

SEQ ID NO: 4279456 - DNA, 21 bp, Homo sapiens
tggacctgcagttggcctcag

SEQ ID NO: 4279457 - DNA, 22 bp, Homo sapiens
tggacctgcagttggcctcagc

SEQ ID NO: 4279458 - DNA, 23 bp, Homo sapiens
tggacctgcagttggcctcagca

SEQ ID NO: 4279459 - DNA, 18 bp, Homo sapiens
tggacggggacacggcct

SEQ ID NO: 4279460 - DNA, 17 bp, Homo sapiens
tggacgtgggctccagg

SEQ ID NO: 4279461 - DNA, 14 bp, Homo sapiens
tggactctggactg

SEQ ID NO: 4279462 - DNA, 16 bp, Homo sapiens
tggactgtggcctcag

SEQ ID NO: 4279463 - DNA, 20 bp, Homo sapiens
tggactttccaccccctccc

SEQ ID NO: 4279464 - DNA, 21 bp, Homo sapiens
tggacttttgttcatgggaga

SEQ ID NO: 4279465 - DNA, 14 bp, Homo sapiens
tggagaccaggact

SEQ ID NO: 4279466 - DNA, 15 bp, Homo sapiens
tggagaccaggactc

SEQ ID NO: 4279467 - DNA, 21 bp, Homo sapiens
tggagaggagagaatgagaga

SEQ ID NO: 4279468 - DNA, 17 bp, Homo sapiens
tggagaggggacttgga

SEQ ID NO: 4279469 - DNA, 16 bp, Homo sapiens
tggagatgggatgctt

SEQ ID NO: 4279470 - DNA, 19 bp, Homo sapiens
tggagcatgagccagctct

SEQ ID NO: 4279471 - DNA, 11 bp, Homo sapiens
tggagccacag

SEQ ID NO: 4279472 - DNA, 18 bp, Homo sapiens
tggagcccggcagtgcac

SEQ ID NO: 4279473 - DNA, 14 bp, Homo sapiens
tggagctgcttcca

SEQ ID NO: 4279474 - DNA, 18 bp, Homo sapiens
tggagctggcgtctgtct

SEQ ID NO: 4279475 - DNA, 23 bp, Homo sapiens
tggaggaaaaccaagccgtggct

SEQ ID NO: 4279476 - DNA, 15 bp, Homo sapiens
tggaggaatgctccc

SEQ ID NO: 4279477 - DNA, 16 bp, Homo sapiens
tggaggcctctgcaag

SEQ ID NO: 4279478 - DNA, 15 bp, Homo sapiens
tggaggcgagccaga

SEQ ID NO: 4279479 - DNA, 19 bp, Homo sapiens
tggaggcgccttcctgggt

SEQ ID NO: 4279480 - DNA, 22 bp, Homo sapiens
tggaggcgccttcctgggttgg

SEQ ID NO: 4279481 - DNA, 16 bp, Homo sapiens
tggaggctaagcctgg

SEQ ID NO: 4279482 - DNA, 17 bp, Homo sapiens
tggaggctaagcctgga

SEQ ID NO: 4279483 - DNA, 16 bp, Homo sapiens
tggaggggcaggcctt

SEQ ID NO: 4279484 - DNA, 24 bp, Homo sapiens
tggaggtcccagacatgctgccca

SEQ ID NO: 4279485 - DNA, 22 bp, Homo sapiens
tggagtccagacctgggccctg

SEQ ID NO: 4279486 - DNA, 15 bp, Homo sapiens
tggagtcgagctggc

SEQ ID NO: 4279487 - DNA, 16 bp, Homo sapiens
tggagtcgagctggcc

SEQ ID NO: 4279488 - DNA, 19 bp, Homo sapiens
tggagtctgaaggagagga

SEQ ID NO: 4279489 - DNA, 22 bp, Homo sapiens
tggagtgtgtgggggtctggga

SEQ ID NO: 4279490 - DNA, 14 bp, Homo sapiens
tggagttgggctgg

SEQ ID NO: 4279491 - DNA, 21 bp, Homo sapiens
tggatacgtgtcaatgtgtgc

SEQ ID NO: 4279492 - DNA, 18 bp, Homo sapiens
tggataggagcttccaga

SEQ ID NO: 4279493 - DNA, 12 bp, Homo sapiens
tggatcaggaaa

SEQ ID NO: 4279494 - DNA, 18 bp, Homo sapiens
tggatccttgtcagttgt

SEQ ID NO: 4279495 - DNA, 20 bp, Homo sapiens
tggatctgctccatgcagat

SEQ ID NO: 4279496 - DNA, 14 bp, Homo sapiens
tggatgctgggttc

SEQ ID NO: 4279497 - DNA, 14 bp, Homo sapiens
tggattcccctgga

SEQ ID NO: 4279498 - DNA, 18 bp, Homo sapiens
tggattctatatttcata

SEQ ID NO: 4279499 - DNA, 18 bp, Homo sapiens
tggattttctttctatgt

SEQ ID NO: 4279500 - DNA, 14 bp, Homo sapiens
tggcaattctttga

SEQ ID NO: 4279501 - DNA, 23 bp, Homo sapiens
tggcaattctttgacctcaacct

SEQ ID NO: 4279502 - DNA, 20 bp, Homo sapiens
aacaaattaaaaacacctaa

SEQ ID NO: 4279503 - DNA, 17 bp, Homo sapiens
aacaagaagaatttgaa

SEQ ID NO: 4279504 - DNA, 23 bp, Homo sapiens
aacaagaggagcaggaagcaagg

SEQ ID NO: 4279505 - DNA, 19 bp, Homo sapiens
aacaagggtggcatcccag

SEQ ID NO: 4279506 - DNA, 16 bp, Homo sapiens
aacaataggtatttct

SEQ ID NO: 4279507 - DNA, 13 bp, Homo sapiens
aacaatggtaaca

SEQ ID NO: 4279508 - DNA, 12 bp, Homo sapiens
aacaatgtatgt

SEQ ID NO: 4279509 - DNA, 23 bp, Homo sapiens
aacaatgtatgtgaaagtgtaaa

SEQ ID NO: 4279510 - DNA, 20 bp, Homo sapiens
aacaattcaaagaatcacct

SEQ ID NO: 4279511 - DNA, 12 bp, Homo sapiens
aacacacagaca

SEQ ID NO: 4279512 - DNA, 17 bp, Homo sapiens
aacacacagactctgtg

SEQ ID NO: 4279513 - DNA, 17 bp, Homo sapiens
aacacagctgttcttct

SEQ ID NO: 4279514 - DNA, 15 bp, Homo sapiens
aacactggcccctag

SEQ ID NO: 4279515 - DNA, 18 bp, Homo sapiens
aacagagtatatatgtac

SEQ ID NO: 4279516 - DNA, 21 bp, Homo sapiens
aacagagtatatatgtacagt

SEQ ID NO: 4279517 - DNA, 17 bp, Homo sapiens
aacagatgtttgttttc

SEQ ID NO: 4279518 - DNA, 16 bp, Homo sapiens
aacaggaccaggagcc

SEQ ID NO: 4279519 - DNA, 11 bp, Homo sapiens
aacaggaggaa

SEQ ID NO: 4279520 - DNA, 14 bp, Homo sapiens
aacaggaggaactg

SEQ ID NO: 4279521 - DNA, 15 bp, Homo sapiens
aacaggaggaactgg

SEQ ID NO: 4279522 - DNA, 22 bp, Homo sapiens
aacaggaggaactggtccaggc

SEQ ID NO: 4279523 - DNA, 18 bp, Homo sapiens
aacagggcatctccagga

SEQ ID NO: 4279524 - DNA, 21 bp, Homo sapiens
aacagttctcccttcaactgt

SEQ ID NO: 4279525 - DNA, 14 bp, Homo sapiens
aacagttgcacagc

SEQ ID NO: 4279526 - DNA, 22 bp, Homo sapiens
aacagttgcacagcatctcagc

SEQ ID NO: 4279527 - DNA, 18 bp, Homo sapiens
aacatagatgcctgggcc

SEQ ID NO: 4279528 - DNA, 17 bp, Homo sapiens
aacataggcaagaggag

SEQ ID NO: 4279529 - DNA, 18 bp, Homo sapiens
aacataggcaagaggagt

SEQ ID NO: 4279530 - DNA, 18 bp, Homo sapiens
aacatctcatcatgtcta

SEQ ID NO: 4279531 - DNA, 18 bp, Homo sapiens
aacatctctttcatctag

SEQ ID NO: 4279532 - DNA, 22 bp, Homo sapiens
aacatgaattaagaactgacac

SEQ ID NO: 4279533 - DNA, 20 bp, Homo sapiens
aacatgactctttattgtct

SEQ ID NO: 4279534 - DNA, 15 bp, Homo sapiens
aacatgccctcaggc

SEQ ID NO: 4279535 - DNA, 18 bp, Homo sapiens
aacatgccctcaggcttg

SEQ ID NO: 4279536 - DNA, 19 bp, Homo sapiens
aacattaatccacatgttt

SEQ ID NO: 4279537 - DNA, 15 bp, Homo sapiens
aacattctatttcaa

SEQ ID NO: 4279538 - DNA, 22 bp, Homo sapiens
aacattgtccccaatgaatata

SEQ ID NO: 4279539 - DNA, 23 bp, Homo sapiens
aacatttgggacctggataatta

SEQ ID NO: 4279540 - DNA, 14 bp, Homo sapiens
aacatttgtttatc

SEQ ID NO: 4279541 - DNA, 16 bp, Homo sapiens
aaccaagccgtggctt

SEQ ID NO: 4279542 - DNA, 18 bp, Homo sapiens
aaccaagccgtggcttcc

SEQ ID NO: 4279543 - DNA, 15 bp, Homo sapiens
aaccataaaataaat

SEQ ID NO: 4279544 - DNA, 16 bp, Homo sapiens
aaccatagaactgtcc

SEQ ID NO: 4279545 - DNA, 21 bp, Homo sapiens
aaccatatgattgaaaagaag

SEQ ID NO: 4279546 - DNA, 17 bp, Homo sapiens
aaccattcaaaaatttc

SEQ ID NO: 4279547 - DNA, 19 bp, Homo sapiens
aaccattcaaaaatttcac

SEQ ID NO: 4279548 - DNA, 13 bp, Homo sapiens
aaccattgtgcat

SEQ ID NO: 4279549 - DNA, 16 bp, Homo sapiens
aaccattgtgcattct

SEQ ID NO: 4279550 - DNA, 19 bp, Homo sapiens
aaccccagcagtcctgggc

SEQ ID NO: 4279551 - DNA, 19 bp, Homo sapiens
aaccctcagagccacccct

SEQ ID NO: 4279552 - DNA, 13 bp, Homo sapiens
aaccctccctcag

SEQ ID NO: 4279553 - DNA, 16 bp, Homo sapiens
aaccctccctcagccc

SEQ ID NO: 4279554 - DNA, 18 bp, Homo sapiens
aaccctccctcagcccct

SEQ ID NO: 4279555 - DNA, 23 bp, Homo sapiens
aaccctccctcagcccctcttgc

SEQ ID NO: 4279556 - DNA, 21 bp, Homo sapiens
aaccctcctatcacctcccct

SEQ ID NO: 4279557 - DNA, 21 bp, Homo sapiens
aaccctgacaaattttaatta

SEQ ID NO: 4279558 - DNA, 17 bp, Homo sapiens
aaccctgcaaaggactg

SEQ ID NO: 4279559 - DNA, 18 bp, Homo sapiens
aacctaaggcaacatttc

SEQ ID NO: 4279560 - DNA, 19 bp, Homo sapiens
aacctacagtggagggaga

SEQ ID NO: 4279561 - DNA, 12 bp, Homo sapiens
aacctaggagca

SEQ ID NO: 4279562 - DNA, 22 bp, Homo sapiens
aacctcgaagctgttctctgct

SEQ ID NO: 4279563 - DNA, 17 bp, Homo sapiens
aacctcgttgacatgca

SEQ ID NO: 4279564 - DNA, 20 bp, Homo sapiens
aacctctgatttattttgta

SEQ ID NO: 4279565 - DNA, 21 bp, Homo sapiens
aacctgaaaagatgttgtgtc

SEQ ID NO: 4279566 - DNA, 17 bp, Homo sapiens
aacctgaattattccaa

SEQ ID NO: 4279567 - DNA, 13 bp, Homo sapiens
aacctgcttttgt

SEQ ID NO: 4279568 - DNA, 12 bp, Homo sapiens
aaccttaatatt

SEQ ID NO: 4279569 - DNA, 15 bp, Homo sapiens
aaccttacttaaagc

SEQ ID NO: 4279570 - DNA, 22 bp, Homo sapiens
aaccttcatgatgaattacttc

SEQ ID NO: 4279571 - DNA, 13 bp, Homo sapiens
aaccttttcttgt

SEQ ID NO: 4279572 - DNA, 16 bp, Homo sapiens
aacgaagatccgagcg

SEQ ID NO: 4279573 - DNA, 13 bp, Homo sapiens
aacgggtctgtgg

SEQ ID NO: 4279574 - DNA, 14 bp, Homo sapiens
aactactgattgaa

SEQ ID NO: 4279575 - DNA, 12 bp, Homo sapiens
aactagatctcc

SEQ ID NO: 4279576 - DNA, 15 bp, Homo sapiens
aactagatctcctgt

SEQ ID NO: 4279577 - DNA, 19 bp, Homo sapiens
aactagatctcctgtaatt

SEQ ID NO: 4279578 - DNA, 14 bp, Homo sapiens
aactaggtgctggc

SEQ ID NO: 4279579 - DNA, 19 bp, Homo sapiens
aactatgcgtaaatcaact

SEQ ID NO: 4279580 - DNA, 21 bp, Homo sapiens
aactcagccttaagaaagcta

SEQ ID NO: 4279581 - DNA, 13 bp, Homo sapiens
aactccaaggcaa

SEQ ID NO: 4279582 - DNA, 19 bp, Homo sapiens
aactccaaggcaaatgtcc

SEQ ID NO: 4279583 - DNA, 15 bp, Homo sapiens
aactccactcagcac

SEQ ID NO: 4279584 - DNA, 22 bp, Homo sapiens
aactccagggttaaagaaaggc

SEQ ID NO: 4279585 - DNA, 20 bp, Homo sapiens
aactcctggatccctttcac

SEQ ID NO: 4279586 - DNA, 22 bp, Homo sapiens
aactgagctcctctgggcagga

SEQ ID NO: 4279587 - DNA, 12 bp, Homo sapiens
aactgctgctgg

SEQ ID NO: 4279588 - DNA, 20 bp, Homo sapiens
aactgctgttttatgtcata

SEQ ID NO: 4279589 - DNA, 16 bp, Homo sapiens
aactggtccaggccag

SEQ ID NO: 4279590 - DNA, 17 bp, Homo sapiens
aactggtccaggccagg

SEQ ID NO: 4279591 - DNA, 19 bp, Homo sapiens
aactgtctctcatgaacct

SEQ ID NO: 4279592 - DNA, 13 bp, Homo sapiens
aactgttttcatg

SEQ ID NO: 4279593 - DNA, 14 bp, Homo sapiens
aactgtttttgaag

SEQ ID NO: 4279594 - DNA, 15 bp, Homo sapiens
aactgtttttgaaga

SEQ ID NO: 4279595 - DNA, 16 bp, Homo sapiens
aactgtttttgaagaa

SEQ ID NO: 4279596 - DNA, 20 bp, Homo sapiens
aacttaatgttctgaataat

SEQ ID NO: 4279597 - DNA, 23 bp, Homo sapiens
aacttagcattttctgcatctcc

SEQ ID NO: 4279598 - DNA, 14 bp, Homo sapiens
aacttattcaaaga

SEQ ID NO: 4279599 - DNA, 12 bp, Homo sapiens
aacttgaacaaa

SEQ ID NO: 4279600 - DNA, 14 bp, Homo sapiens
aacttgaacaaagt

SEQ ID NO: 4279601 - DNA, 20 bp, Homo sapiens
aacttgatgttcctgggatg

SEQ ID NO: 4279602 - DNA, 16 bp, Homo sapiens
aacttgtcacaaagtg

SEQ ID NO: 4279603 - DNA, 15 bp, Homo sapiens
aactttagaaataaa

SEQ ID NO: 4279604 - DNA, 22 bp, Homo sapiens
aactttcactataatgtgaaat

SEQ ID NO: 4279605 - DNA, 15 bp, Homo sapiens
aagaaaagtgggcca

SEQ ID NO: 4279606 - DNA, 13 bp, Homo sapiens
aagaaaggcagag

SEQ ID NO: 4279607 - DNA, 14 bp, Homo sapiens
aagaaagtctatgc

SEQ ID NO: 4279608 - DNA, 15 bp, Homo sapiens
aagaaagtctatgct

SEQ ID NO: 4279609 - DNA, 16 bp, Homo sapiens
aagaaagtctatgctt

SEQ ID NO: 4279610 - DNA, 22 bp, Homo sapiens
aagaaagtgagcagtgttagct

SEQ ID NO: 4279611 - DNA, 15 bp, Homo sapiens
aagaaatatctgtga

SEQ ID NO: 4279612 - DNA, 18 bp, Homo sapiens
aagaaatatctgtgaaat

SEQ ID NO: 4279613 - DNA, 19 bp, Homo sapiens
aagaaatatctgtgaaata

SEQ ID NO: 4279614 - DNA, 14 bp, Homo sapiens
aagaaatcaagtta

SEQ ID NO: 4279615 - DNA, 20 bp, Homo sapiens
aagaaatgctaatgtaatca

SEQ ID NO: 4279616 - DNA, 15 bp, Homo sapiens
aagaaattgtttttc

SEQ ID NO: 4279617 - DNA, 22 bp, Homo sapiens
aagaacccatggaaaaatgcca

SEQ ID NO: 4279618 - DNA, 17 bp, Homo sapiens
aagaacccccctcccca

SEQ ID NO: 4279619 - DNA, 21 bp, Homo sapiens
aagaacccccctccccaagga

SEQ ID NO: 4279620 - DNA, 19 bp, Homo sapiens
aagaagctaaaatgaaaaa

SEQ ID NO: 4279621 - DNA, 13 bp, Homo sapiens
aagaagtgggagt

SEQ ID NO: 4279622 - DNA, 20 bp, Homo sapiens
aagaagtgggagtgggagag

SEQ ID NO: 4279623 - DNA, 18 bp, Homo sapiens
aagaagtggggcagcagc

SEQ ID NO: 4279624 - DNA, 12 bp, Homo sapiens
aagaatattgta

SEQ ID NO: 4279625 - DNA, 21 bp, Homo sapiens
aagaatcacctaattaatttc

SEQ ID NO: 4279626 - DNA, 20 bp, Homo sapiens
aagaattgccagtcttttgt

SEQ ID NO: 4279627 - DNA, 20 bp, Homo sapiens
aagaatttgaagacttcaaa

SEQ ID NO: 4279628 - DNA, 13 bp, Homo sapiens
aagacacgtgttt

SEQ ID NO: 4279629 - DNA, 17 bp, Homo sapiens
aagacacgtgtttttgt

SEQ ID NO: 4279630 - DNA, 19 bp, Homo sapiens
aagacaggagagattattt

SEQ ID NO: 4279631 - DNA, 23 bp, Homo sapiens
aagacatttaaaatagttttcta

SEQ ID NO: 4279632 - DNA, 21 bp, Homo sapiens
aatctacttaaccctgacaaa

SEQ ID NO: 4279633 - DNA, 15 bp, Homo sapiens
aatctatgtgatttg

SEQ ID NO: 4279634 - DNA, 19 bp, Homo sapiens
aatctcagcactttgtttc

SEQ ID NO: 4279635 - DNA, 20 bp, Homo sapiens
aatctcagcactttgtttca

SEQ ID NO: 4279636 - DNA, 16 bp, Homo sapiens
aatctctaaaattcta

SEQ ID NO: 4279637 - DNA, 19 bp, Homo sapiens
aatctctaaaattctagtc

SEQ ID NO: 4279638 - DNA, 12 bp, Homo sapiens
aatctctgatta

SEQ ID NO: 4279639 - DNA, 18 bp, Homo sapiens
aatctgaaacacagtcat

SEQ ID NO: 4279640 - DNA, 20 bp, Homo sapiens
aatctgtataatactttgta

SEQ ID NO: 4279641 - DNA, 16 bp, Homo sapiens
aatctgtctgattcta

SEQ ID NO: 4279642 - DNA, 17 bp, Homo sapiens
aatctgtctgattctat

SEQ ID NO: 4279643 - DNA, 15 bp, Homo sapiens
aatgaaatatttgct

SEQ ID NO: 4279644 - DNA, 15 bp, Homo sapiens
aatgaagcaaacaca

SEQ ID NO: 4279645 - DNA, 18 bp, Homo sapiens
aatgaagcaaacacacag

SEQ ID NO: 4279646 - DNA, 16 bp, Homo sapiens
aatgacactggaaggg

SEQ ID NO: 4279647 - DNA, 16 bp, Homo sapiens
aatgactataaacatt

SEQ ID NO: 4279648 - DNA, 19 bp, Homo sapiens
aatgagtttaaaaaaataa

SEQ ID NO: 4279649 - DNA, 21 bp, Homo sapiens
aatgagtttaaaaaaataaca

SEQ ID NO: 4279650 - DNA, 16 bp, Homo sapiens
aatgatactgtctaag

SEQ ID NO: 4279651 - DNA, 20 bp, Homo sapiens
aatgatactgtctaagaata

SEQ ID NO: 4279652 - DNA, 21 bp, Homo sapiens
aatgatattcaatcttaacaa

SEQ ID NO: 4279653 - DNA, 22 bp, Homo sapiens
aatgatattgctgaagaatcta

SEQ ID NO: 4279654 - DNA, 13 bp, Homo sapiens
aatgattcataac

SEQ ID NO: 4279655 - DNA, 16 bp, Homo sapiens
aatgattcataacaat

SEQ ID NO: 4279656 - DNA, 18 bp, Homo sapiens
aatgattcataacaatgt

SEQ ID NO: 4279657 - DNA, 19 bp, Homo sapiens
aatgattcataacaatgta

SEQ ID NO: 4279658 - DNA, 12 bp, Homo sapiens
aatgattccaaa

SEQ ID NO: 4279659 - DNA, 14 bp, Homo sapiens
aatgattccaaata

SEQ ID NO: 4279660 - DNA, 15 bp, Homo sapiens
aatgattccaaataa

SEQ ID NO: 4279661 - DNA, 14 bp, Homo sapiens
aatgatttaaattt

SEQ ID NO: 4279662 - DNA, 23 bp, Homo sapiens
aatgcagcttcaggtgagccaag

SEQ ID NO: 4279663 - DNA, 23 bp, Homo sapiens
aatgcagtatccgcgagcctgct

SEQ ID NO: 4279664 - DNA, 13 bp, Homo sapiens
aatgcatgtgatt

SEQ ID NO: 4279665 - DNA, 16 bp, Homo sapiens
aatgcctaataaacaa

SEQ ID NO: 4279666 - DNA, 14 bp, Homo sapiens
aatgcctaggccag

SEQ ID NO: 4279667 - DNA, 15 bp, Homo sapiens
aatgcctaggccagc

SEQ ID NO: 4279668 - DNA, 18 bp, Homo sapiens
aatgcctaggccagctcc

SEQ ID NO: 4279669 - DNA, 18 bp, Homo sapiens
aatgcgctcttcaccagg

SEQ ID NO: 4279670 - DNA, 20 bp, Homo sapiens
aatgcgctcttcaccaggaa

SEQ ID NO: 4279671 - DNA, 21 bp, Homo sapiens
aatgcgctcttcaccaggaag

SEQ ID NO: 4279672 - DNA, 22 bp, Homo sapiens
aatgctaatgtaatcatttatc

SEQ ID NO: 4279673 - DNA, 14 bp, Homo sapiens
aatgctacctctga

SEQ ID NO: 4279674 - DNA, 11 bp, Homo sapiens
aatgctccccc

SEQ ID NO: 4279675 - DNA, 22 bp, Homo sapiens
aatgctcccccatcctcccctt

SEQ ID NO: 4279676 - DNA, 16 bp, Homo sapiens
aatgctgtacctttct

SEQ ID NO: 4279677 - DNA, 19 bp, Homo sapiens
aatgctttgtgtgattgaa

SEQ ID NO: 4279678 - DNA, 14 bp, Homo sapiens
aatgcttttctagc

SEQ ID NO: 4279679 - DNA, 18 bp, Homo sapiens
aatggcagtgagatgtca

SEQ ID NO: 4279680 - DNA, 19 bp, Homo sapiens
aatggcgcagtgcctctgg

SEQ ID NO: 4279681 - DNA, 20 bp, Homo sapiens
aatggcgcagtgcctctggt

SEQ ID NO: 4279682 - DNA, 17 bp, Homo sapiens
aatggtgggctccagag

SEQ ID NO: 4279683 - DNA, 18 bp, Homo sapiens
aatggtgggctccagagt

SEQ ID NO: 4279684 - DNA, 19 bp, Homo sapiens
aatggtgggctccagagta

SEQ ID NO: 4279685 - DNA, 15 bp, Homo sapiens
aatgtaaaattcata

SEQ ID NO: 4279686 - DNA, 18 bp, Homo sapiens
aatgtaattaaactgtta

SEQ ID NO: 4279687 - DNA, 22 bp, Homo sapiens
aatgtagcttcagtcattaaat

SEQ ID NO: 4279688 - DNA, 12 bp, Homo sapiens
aatgtatcttat

SEQ ID NO: 4279689 - DNA, 13 bp, Homo sapiens
aatgtatcttatt

SEQ ID NO: 4279690 - DNA, 15 bp, Homo sapiens
aatgtatcttattta

SEQ ID NO: 4279691 - DNA, 16 bp, Homo sapiens
aatgtatcttatttat

SEQ ID NO: 4279692 - DNA, 21 bp, Homo sapiens
aatgtccaagcatcagcaaga

SEQ ID NO: 4279693 - DNA, 23 bp, Homo sapiens
aatgtcctcagagggtccctagg

SEQ ID NO: 4279694 - DNA, 18 bp, Homo sapiens
aatgtgagctataatgtt

SEQ ID NO: 4279695 - DNA, 16 bp, Homo sapiens
aatgtgcccagtcatg

SEQ ID NO: 4279696 - DNA, 14 bp, Homo sapiens
aatgtgcttttcca

SEQ ID NO: 4279697 - DNA, 20 bp, Homo sapiens
aatgtggaaaaaatatttta

SEQ ID NO: 4279698 - DNA, 17 bp, Homo sapiens
aatgtggcagctgtctc

SEQ ID NO: 4279699 - DNA, 16 bp, Homo sapiens
aatgtgtcaaagagat

SEQ ID NO: 4279700 - DNA, 15 bp, Homo sapiens
aatgtgtgtatgtgt

SEQ ID NO: 4279701 - DNA, 14 bp, Homo sapiens
aatgtttccaggca

SEQ ID NO: 4279702 - DNA, 15 bp, Homo sapiens
aatgtttctttttct

SEQ ID NO: 4279703 - DNA, 21 bp, Homo sapiens
aattaaaaacacctaagtgac

SEQ ID NO: 4279704 - DNA, 16 bp, Homo sapiens
aattaaagacatttaa

SEQ ID NO: 4279705 - DNA, 15 bp, Homo sapiens
aattaaagctgttat

SEQ ID NO: 4279706 - DNA, 20 bp, Homo sapiens
aattaaccccataattagat

SEQ ID NO: 4279707 - DNA, 17 bp, Homo sapiens
aattaacctttcaggaa

SEQ ID NO: 4279708 - DNA, 21 bp, Homo sapiens
aattaacctttcaggaaagta

SEQ ID NO: 4279709 - DNA, 14 bp, Homo sapiens
aattacagaagaag

SEQ ID NO: 4279710 - DNA, 17 bp, Homo sapiens
aattacagggaagaaat

SEQ ID NO: 4279711 - DNA, 18 bp, Homo sapiens
aattacagggaagaaatc

SEQ ID NO: 4279712 - DNA, 21 bp, Homo sapiens
aattacagggaagaaatcaag

SEQ ID NO: 4279713 - DNA, 18 bp, Homo sapiens
aattaccatttgttaata

SEQ ID NO: 4279714 - DNA, 17 bp, Homo sapiens
aattactatagcaaagt

SEQ ID NO: 4279715 - DNA, 23 bp, Homo sapiens
aattagatccattaatttaaatg

SEQ ID NO: 4279716 - DNA, 13 bp, Homo sapiens
aattagattttaa

SEQ ID NO: 4279717 - DNA, 21 bp, Homo sapiens
aattagattttaaaacttcat

SEQ ID NO: 4279718 - DNA, 18 bp, Homo sapiens
aattagggctctaatttc

SEQ ID NO: 4279719 - DNA, 21 bp, Homo sapiens
aattatatctgtggtcttcaa

SEQ ID NO: 4279720 - DNA, 14 bp, Homo sapiens
aattatgtttacct

SEQ ID NO: 4279721 - DNA, 14 bp, Homo sapiens
aattattctagtca

SEQ ID NO: 4279722 - DNA, 19 bp, Homo sapiens
aattattctagtcaactgc

SEQ ID NO: 4279723 - DNA, 17 bp, Homo sapiens
aattatttaactaatta

SEQ ID NO: 4279724 - DNA, 17 bp, Homo sapiens
aattcaacacttatttt

SEQ ID NO: 4279725 - DNA, 17 bp, Homo sapiens
aattcataaaaataacc

SEQ ID NO: 4279726 - DNA, 17 bp, Homo sapiens
aattccaagtgtttctg

SEQ ID NO: 4279727 - DNA, 14 bp, Homo sapiens
aattcgagacaggc

SEQ ID NO: 4279728 - DNA, 21 bp, Homo sapiens
aattctaagattgtacatatg

SEQ ID NO: 4279729 - DNA, 23 bp, Homo sapiens
aattctccctggcattgtttcca

SEQ ID NO: 4279730 - DNA, 11 bp, Homo sapiens
aattctgtccc

SEQ ID NO: 4279731 - DNA, 18 bp, Homo sapiens
aattctgtccctgtccct

SEQ ID NO: 4279732 - DNA, 20 bp, Homo sapiens
aattctgtccctgtccctgc

SEQ ID NO: 4279733 - DNA, 11 bp, Homo sapiens
aattcttttga

SEQ ID NO: 4279734 - DNA, 15 bp, Homo sapiens
aattgaaaagaagta

SEQ ID NO: 4279735 - DNA, 20 bp, Homo sapiens
aattgacctgatttccattt

SEQ ID NO: 4279736 - DNA, 15 bp, Homo sapiens
aattgaggttaggaa

SEQ ID NO: 4279737 - DNA, 17 bp, Homo sapiens
aattgcatttttacctt

SEQ ID NO: 4279738 - DNA, 19 bp, Homo sapiens
aattgctgaggagctcagg

SEQ ID NO: 4279739 - DNA, 16 bp, Homo sapiens
aattggtgataagtgg

SEQ ID NO: 4279740 - DNA, 17 bp, Homo sapiens
aattggtgataagtgga

SEQ ID NO: 4279741 - DNA, 17 bp, Homo sapiens
aattgtataaaacagtg

SEQ ID NO: 4279742 - DNA, 19 bp, Homo sapiens
aattgtggagaggagagaa

SEQ ID NO: 4279743 - DNA, 12 bp, Homo sapiens
aatttaactgca

SEQ ID NO: 4279744 - DNA, 21 bp, Homo sapiens
aatttaatagataaagtgcct

SEQ ID NO: 4279745 - DNA, 19 bp, Homo sapiens
aatttcaaaatgcatgtga

SEQ ID NO: 4279746 - DNA, 22 bp, Homo sapiens
aatttcaaaatgcatgtgattg

SEQ ID NO: 4279747 - DNA, 23 bp, Homo sapiens
aatttctcttaagtactgaaata

SEQ ID NO: 4279748 - DNA, 20 bp, Homo sapiens
aatttctgccatttcatgtc

SEQ ID NO: 4279749 - DNA, 20 bp, Homo sapiens
aatttcttactaaacatttt

SEQ ID NO: 4279750 - DNA, 13 bp, Homo sapiens
aatttgtgtagat

SEQ ID NO: 4279751 - DNA, 18 bp, Homo sapiens
aattttaaaaaataacat

SEQ ID NO: 4279752 - DNA, 13 bp, Homo sapiens
aattttaatgtaa

SEQ ID NO: 4279753 - DNA, 23 bp, Homo sapiens
aattttaatgtaaaattcatagc

SEQ ID NO: 4279754 - DNA, 18 bp, Homo sapiens
aatttttttccagaattg

SEQ ID NO: 4279755 - DNA, 15 bp, Homo sapiens
acaaaatatttctaa

SEQ ID NO: 4279756 - DNA, 18 bp, Homo sapiens
acaaacagaaacgagatt

SEQ ID NO: 4279757 - DNA, 23 bp, Homo sapiens
acaaacctgaaaagatgttgtgt

SEQ ID NO: 4279758 - DNA, 16 bp, Homo sapiens
acaaagaagaaccatc

SEQ ID NO: 4279759 - DNA, 15 bp, Homo sapiens
acaaataccagagca

SEQ ID NO: 4279760 - DNA, 22 bp, Homo sapiens
acaaatatagttgaacaagatt

SEQ ID NO: 4279761 - DNA, 20 bp, Homo sapiens
acaaatatgattctcctctc

SEQ ID NO: 4279762 - DNA, 19 bp, Homo sapiens
acctgtgatgaggggagga

SEQ ID NO: 4279763 - DNA, 18 bp, Homo sapiens
accttcaccaagcttaga

SEQ ID NO: 4279764 - DNA, 14 bp, Homo sapiens
accttcacccagca

SEQ ID NO: 4279765 - DNA, 20 bp, Homo sapiens
accttccctccacctgcttg

SEQ ID NO: 4279766 - DNA, 22 bp, Homo sapiens
accttcctgggcagcccagaga

SEQ ID NO: 4279767 - DNA, 20 bp, Homo sapiens
accttctaatccatgtgctg

SEQ ID NO: 4279768 - DNA, 12 bp, Homo sapiens
accttctgtggc

SEQ ID NO: 4279769 - DNA, 13 bp, Homo sapiens
accttctgtggct

SEQ ID NO: 4279770 - DNA, 15 bp, Homo sapiens
acctttggcttaatt

SEQ ID NO: 4279771 - DNA, 17 bp, Homo sapiens
acctttgtctgaaggat

SEQ ID NO: 4279772 - DNA, 16 bp, Homo sapiens
acgagatcttccttcc

SEQ ID NO: 4279773 - DNA, 16 bp, Homo sapiens
acgcaagcctcagcca

SEQ ID NO: 4279774 - DNA, 21 bp, Homo sapiens
acgcacacacacgcaaataca

SEQ ID NO: 4279775 - DNA, 12 bp, Homo sapiens
acgcagccctgc

SEQ ID NO: 4279776 - DNA, 17 bp, Homo sapiens
acgcagggagaccctgg

SEQ ID NO: 4279777 - DNA, 13 bp, Homo sapiens
acgccaaccccag

SEQ ID NO: 4279778 - DNA, 15 bp, Homo sapiens
acgccctcctccctc

SEQ ID NO: 4279779 - DNA, 20 bp, Homo sapiens
acgcctctctcagcccaggt

SEQ ID NO: 4279780 - DNA, 21 bp, Homo sapiens
acgcctctctcagcccaggtc

SEQ ID NO: 4279781 - DNA, 21 bp, Homo sapiens
acgcgcgcgcgcgcacacaca

SEQ ID NO: 4279782 - DNA, 16 bp, Homo sapiens
acgcgctctgcatgct

SEQ ID NO: 4279783 - DNA, 12 bp, Homo sapiens
acgctctctgtc

SEQ ID NO: 4279784 - DNA, 17 bp, Homo sapiens
acgctgtctccagaccc

SEQ ID NO: 4279785 - DNA, 21 bp, Homo sapiens
acgctgtctccagacccccac

SEQ ID NO: 4279786 - DNA, 22 bp, Homo sapiens
acgctgtctccagacccccacc

SEQ ID NO: 4279787 - DNA, 21 bp, Homo sapiens
acggaagtggcctgagaagag

SEQ ID NO: 4279788 - DNA, 18 bp, Homo sapiens
acggagcactgtgcagcc

SEQ ID NO: 4279789 - DNA, 16 bp, Homo sapiens
acggcagccaccctgc

SEQ ID NO: 4279790 - DNA, 22 bp, Homo sapiens
acggcttccccatcgccttctg

SEQ ID NO: 4279791 - DNA, 13 bp, Homo sapiens
acgggaccgggcc

SEQ ID NO: 4279792 - DNA, 15 bp, Homo sapiens
acgggaccgggccgc

SEQ ID NO: 4279793 - DNA, 14 bp, Homo sapiens
acggggacacggcc

SEQ ID NO: 4279794 - DNA, 14 bp, Homo sapiens
acggggaggccaag

SEQ ID NO: 4279795 - DNA, 20 bp, Homo sapiens
acgggggaggccgaggcagg

SEQ ID NO: 4279796 - DNA, 21 bp, Homo sapiens
acgggggaggccgaggcaggg

SEQ ID NO: 4279797 - DNA, 22 bp, Homo sapiens
acggttccctgcctaggagctg

SEQ ID NO: 4279798 - DNA, 18 bp, Homo sapiens
acgtccacccgtttccaa

SEQ ID NO: 4279799 - DNA, 17 bp, Homo sapiens
acgtctagctatgctgt

SEQ ID NO: 4279800 - DNA, 17 bp, Homo sapiens
acgtgaagataccataa

SEQ ID NO: 4279801 - DNA, 21 bp, Homo sapiens
acgtgatgtgctcatcagaaa

SEQ ID NO: 4279802 - DNA, 15 bp, Homo sapiens
acgtgcacacacctg

SEQ ID NO: 4279803 - DNA, 17 bp, Homo sapiens
acgtgtctttagaactc

SEQ ID NO: 4279804 - DNA, 23 bp, Homo sapiens
acgttttgcctcatgaacactgg

SEQ ID NO: 4279805 - DNA, 13 bp, Homo sapiens
actaaacattttg

SEQ ID NO: 4279806 - DNA, 15 bp, Homo sapiens
actaaatggcagtga

SEQ ID NO: 4279807 - DNA, 14 bp, Homo sapiens
actaagaataaata

SEQ ID NO: 4279808 - DNA, 22 bp, Homo sapiens
actaaggtacggtgagactctg

SEQ ID NO: 4279809 - DNA, 20 bp, Homo sapiens
actaatgagctttgggcaat

SEQ ID NO: 4279810 - DNA, 23 bp, Homo sapiens
actaatgagctttgggcaataaa

SEQ ID NO: 4279811 - DNA, 16 bp, Homo sapiens
actaattaaaaaatag

SEQ ID NO: 4279812 - DNA, 21 bp, Homo sapiens
actacaaacatggggagccat

SEQ ID NO: 4279813 - DNA, 21 bp, Homo sapiens
actacagccaaattgcagaag

SEQ ID NO: 4279814 - DNA, 22 bp, Homo sapiens
actacataattaaattttaatg

SEQ ID NO: 4279815 - DNA, 23 bp, Homo sapiens
actacataattaaattttaatgt

SEQ ID NO: 4279816 - DNA, 20 bp, Homo sapiens
actaccccagaacgcatgca

SEQ ID NO: 4279817 - DNA, 21 bp, Homo sapiens
actaccccagaacgcatgcag

SEQ ID NO: 4279818 - DNA, 21 bp, Homo sapiens
actaccccaggatgcatgcag

SEQ ID NO: 4279819 - DNA, 19 bp, Homo sapiens
actacctttggcttaattc

SEQ ID NO: 4279820 - DNA, 13 bp, Homo sapiens
actacgcagaaga

SEQ ID NO: 4279821 - DNA, 13 bp, Homo sapiens
actactcagcatg

SEQ ID NO: 4279822 - DNA, 17 bp, Homo sapiens
actactcagcatggaaa

SEQ ID NO: 4279823 - DNA, 17 bp, Homo sapiens
actagagatattttgta

SEQ ID NO: 4279824 - DNA, 11 bp, Homo sapiens
actagatctcc

SEQ ID NO: 4279825 - DNA, 21 bp, Homo sapiens
actagcactttataagccaat

SEQ ID NO: 4279826 - DNA, 18 bp, Homo sapiens
actagccatgactagggt

SEQ ID NO: 4279827 - DNA, 14 bp, Homo sapiens
actaggtgctggca

SEQ ID NO: 4279828 - DNA, 16 bp, Homo sapiens
actaggtgctggcatg

SEQ ID NO: 4279829 - DNA, 23 bp, Homo sapiens
actaggtgctggcatgtctgggt

SEQ ID NO: 4279830 - DNA, 19 bp, Homo sapiens
actataatgtgaaatgtaa

SEQ ID NO: 4279831 - DNA, 20 bp, Homo sapiens
actatagcaaagtagtactt

SEQ ID NO: 4279832 - DNA, 15 bp, Homo sapiens
actatcggttcaagt

SEQ ID NO: 4279833 - DNA, 18 bp, Homo sapiens
actatgcacctataaata

SEQ ID NO: 4279834 - DNA, 19 bp, Homo sapiens
actatgtccatgaaaaaca

SEQ ID NO: 4279835 - DNA, 18 bp, Homo sapiens
actatgtgtcatgatttc

SEQ ID NO: 4279836 - DNA, 18 bp, Homo sapiens
actattatccccatttct

SEQ ID NO: 4279837 - DNA, 19 bp, Homo sapiens
actatttttttgttgctgt

SEQ ID NO: 4279838 - DNA, 15 bp, Homo sapiens
actcaccaaaatata

SEQ ID NO: 4279839 - DNA, 18 bp, Homo sapiens
actcacctgctggcccct

SEQ ID NO: 4279840 - DNA, 20 bp, Homo sapiens
actcacctgctggcccctca

SEQ ID NO: 4279841 - DNA, 22 bp, Homo sapiens
actcacggctgcacctgcaggg

SEQ ID NO: 4279842 - DNA, 14 bp, Homo sapiens
actcagagggagga

SEQ ID NO: 4279843 - DNA, 11 bp, Homo sapiens
actcagcatgg

SEQ ID NO: 4279844 - DNA, 15 bp, Homo sapiens
actcaggcagcctgt

SEQ ID NO: 4279845 - DNA, 12 bp, Homo sapiens
actcaggcccac

SEQ ID NO: 4279846 - DNA, 14 bp, Homo sapiens
actcatgttaattg

SEQ ID NO: 4279847 - DNA, 12 bp, Homo sapiens
actcattaatta

SEQ ID NO: 4279848 - DNA, 13 bp, Homo sapiens
actccaaggcaaa

SEQ ID NO: 4279849 - DNA, 16 bp, Homo sapiens
actccaaggcaaatgt

SEQ ID NO: 4279850 - DNA, 18 bp, Homo sapiens
actccagacccctggctt

SEQ ID NO: 4279851 - DNA, 17 bp, Homo sapiens
actccaggaaaactgtt

SEQ ID NO: 4279852 - DNA, 21 bp, Homo sapiens
actccaggaaaactgtttttc

SEQ ID NO: 4279853 - DNA, 20 bp, Homo sapiens
actccatatcccgggagcag

SEQ ID NO: 4279854 - DNA, 18 bp, Homo sapiens
actccctgtctgaaacca

SEQ ID NO: 4279855 - DNA, 14 bp, Homo sapiens
actccgtttccaaa

SEQ ID NO: 4279856 - DNA, 19 bp, Homo sapiens
actcctcccaactctggcc

SEQ ID NO: 4279857 - DNA, 12 bp, Homo sapiens
actcctcccagg

SEQ ID NO: 4279858 - DNA, 18 bp, Homo sapiens
actcctggatccctttca

SEQ ID NO: 4279859 - DNA, 15 bp, Homo sapiens
actccttctccccaa

SEQ ID NO: 4279860 - DNA, 21 bp, Homo sapiens
actccttgaaaccagctcagg

SEQ ID NO: 4279861 - DNA, 21 bp, Homo sapiens
actctacttagcatgtcccta

SEQ ID NO: 4279862 - DNA, 13 bp, Homo sapiens
actctcctgagga

SEQ ID NO: 4279863 - DNA, 17 bp, Homo sapiens
actctcctgaggagcag

SEQ ID NO: 4279864 - DNA, 22 bp, Homo sapiens
actctcctgaggagcagcccac

SEQ ID NO: 4279865 - DNA, 23 bp, Homo sapiens
actctctcctctctctccctcca

SEQ ID NO: 4279866 - DNA, 15 bp, Homo sapiens
actctctctgccccc

SEQ ID NO: 4279867 - DNA, 17 bp, Homo sapiens
actctctctgcccccaa

SEQ ID NO: 4279868 - DNA, 14 bp, Homo sapiens
actctcttcttact

SEQ ID NO: 4279869 - DNA, 16 bp, Homo sapiens
actctgccttccaggc

SEQ ID NO: 4279870 - DNA, 15 bp, Homo sapiens
actctgctgaggcca

SEQ ID NO: 4279871 - DNA, 17 bp, Homo sapiens
actctgctgaggccaga

SEQ ID NO: 4279872 - DNA, 13 bp, Homo sapiens
actctggactggg

SEQ ID NO: 4279873 - DNA, 18 bp, Homo sapiens
actctggactgggaaggg

SEQ ID NO: 4279874 - DNA, 17 bp, Homo sapiens
actctggcagcctcaga

SEQ ID NO: 4279875 - DNA, 18 bp, Homo sapiens
actctggcagcctcagag

SEQ ID NO: 4279876 - DNA, 14 bp, Homo sapiens
actctgtggggcca

SEQ ID NO: 4279877 - DNA, 14 bp, Homo sapiens
actctgtgtaatct

SEQ ID NO: 4279878 - DNA, 18 bp, Homo sapiens
actctgtgtaatctctga

SEQ ID NO: 4279879 - DNA, 16 bp, Homo sapiens
actctgtttgctcacc

SEQ ID NO: 4279880 - DNA, 14 bp, Homo sapiens
actgaagtgaatac

SEQ ID NO: 4279881 - DNA, 14 bp, Homo sapiens
actgaatttaacta

SEQ ID NO: 4279882 - DNA, 13 bp, Homo sapiens
actgagccaaaaa

SEQ ID NO: 4279883 - DNA, 21 bp, Homo sapiens
actgagctcctctgggcagga

SEQ ID NO: 4279884 - DNA, 15 bp, Homo sapiens
actgaggccattatt

SEQ ID NO: 4279885 - DNA, 22 bp, Homo sapiens
actgagtctcattcctctgtcc

SEQ ID NO: 4279886 - DNA, 12 bp, Homo sapiens
actgcaacactg

SEQ ID NO: 4279887 - DNA, 17 bp, Homo sapiens
actgcatgcaagctcag

SEQ ID NO: 4279888 - DNA, 18 bp, Homo sapiens
actgcatgcacttcttac

SEQ ID NO: 4279889 - DNA, 22 bp, Homo sapiens
actgcccctgcacctgcttctc

SEQ ID NO: 4279890 - DNA, 17 bp, Homo sapiens
actgcccggggcagctg

SEQ ID NO: 4279891 - DNA, 15 bp, Homo sapiens
actgccctctgccac

SEQ ID NO: 4279892 - DNA, 23 bp, Homo sapiens
agagatgtccatttttacaagtt

SEQ ID NO: 4279893 - DNA, 13 bp, Homo sapiens
agagatgtgtcca

SEQ ID NO: 4279894 - DNA, 17 bp, Homo sapiens
agagatgttttgttgat

SEQ ID NO: 4279895 - DNA, 13 bp, Homo sapiens
agagattaatttg

SEQ ID NO: 4279896 - DNA, 16 bp, Homo sapiens
agagattaatttgtgt

SEQ ID NO: 4279897 - DNA, 19 bp, Homo sapiens
agagattaatttgtgtaga

SEQ ID NO: 4279898 - DNA, 20 bp, Homo sapiens
agagattggatcaagtatta

SEQ ID NO: 4279899 - DNA, 13 bp, Homo sapiens
agagattgggggg

SEQ ID NO: 4279900 - DNA, 23 bp, Homo sapiens
agagcaaatttcatctttccaaa

SEQ ID NO: 4279901 - DNA, 11 bp, Homo sapiens
agagccaaggc

SEQ ID NO: 4279902 - DNA, 24 bp, Homo sapiens
agagccaaggcctatgccacctgc

SEQ ID NO: 4279903 - DNA, 14 bp, Homo sapiens
agagccacaataag

SEQ ID NO: 4279904 - DNA, 14 bp, Homo sapiens
agagccatctgcga

SEQ ID NO: 4279905 - DNA, 17 bp, Homo sapiens
agagcccaatcactgcc

SEQ ID NO: 4279906 - DNA, 19 bp, Homo sapiens
agagcccccaccagcagca

SEQ ID NO: 4279907 - DNA, 18 bp, Homo sapiens
agagcccgcccacctggg

SEQ ID NO: 4279908 - DNA, 22 bp, Homo sapiens
agagccctctgctgctttccaa

SEQ ID NO: 4279909 - DNA, 20 bp, Homo sapiens
agagcctccctcagccacgc

SEQ ID NO: 4279910 - DNA, 12 bp, Homo sapiens
agagcctggggt

SEQ ID NO: 4279911 - DNA, 13 bp, Homo sapiens
agagcgcccctcc

SEQ ID NO: 4279912 - DNA, 16 bp, Homo sapiens
agagcgctcctctgcc

SEQ ID NO: 4279913 - DNA, 14 bp, Homo sapiens
agagcgctggcctc

SEQ ID NO: 4279914 - DNA, 15 bp, Homo sapiens
agagcgctggcctct

SEQ ID NO: 4279915 - DNA, 16 bp, Homo sapiens
agagcgctggcctctt

SEQ ID NO: 4279916 - DNA, 14 bp, Homo sapiens
agagctagagaaat

SEQ ID NO: 4279917 - DNA, 16 bp, Homo sapiens
agagctcagcacagcc

SEQ ID NO: 4279918 - DNA, 17 bp, Homo sapiens
agagctcagcacagcct

SEQ ID NO: 4279919 - DNA, 14 bp, Homo sapiens
agagctccacagaa

SEQ ID NO: 4279920 - DNA, 15 bp, Homo sapiens
agagctccacagaag

SEQ ID NO: 4279921 - DNA, 14 bp, Homo sapiens
agagctccccatgg

SEQ ID NO: 4279922 - DNA, 22 bp, Homo sapiens
agaggaagccacgtgctggaga

SEQ ID NO: 4279923 - DNA, 17 bp, Homo sapiens
agaggaagggaggcctg

SEQ ID NO: 4279924 - DNA, 18 bp, Homo sapiens
agaggaagggaggcctga

SEQ ID NO: 4279925 - DNA, 19 bp, Homo sapiens
agaggaagggaggcctgag

SEQ ID NO: 4279926 - DNA, 21 bp, Homo sapiens
agaggaagggaggcctgaggg

SEQ ID NO: 4279927 - DNA, 23 bp, Homo sapiens
agaggacagcttccccatcgcct

SEQ ID NO: 4279928 - DNA, 23 bp, Homo sapiens
agaggacagtttaggacccaagg

SEQ ID NO: 4279929 - DNA, 15 bp, Homo sapiens
agaggacgccttcag

SEQ ID NO: 4279930 - DNA, 23 bp, Homo sapiens
agaggacggcttccccatcgcct

SEQ ID NO: 4279931 - DNA, 15 bp, Homo sapiens
agaggagcaggaagc

SEQ ID NO: 4279932 - DNA, 21 bp, Homo sapiens
agaggagcctttccagaacta

SEQ ID NO: 4279933 - DNA, 21 bp, Homo sapiens
agaggaggaaaaaggctggtg

SEQ ID NO: 4279934 - DNA, 13 bp, Homo sapiens
agaggaggtgccc

SEQ ID NO: 4279935 - DNA, 15 bp, Homo sapiens
agaggaggtgcccgg

SEQ ID NO: 4279936 - DNA, 13 bp, Homo sapiens
agaggaggtgtgg

SEQ ID NO: 4279937 - DNA, 18 bp, Homo sapiens
agaggaggtgtggagtgg

SEQ ID NO: 4279938 - DNA, 21 bp, Homo sapiens
agaggaggtgtggagtggagg

SEQ ID NO: 4279939 - DNA, 21 bp, Homo sapiens
agaggagttctaacacatttc

SEQ ID NO: 4279940 - DNA, 21 bp, Homo sapiens
agaggccccttgctgctggct

SEQ ID NO: 4279941 - DNA, 23 bp, Homo sapiens
agaggccccttgctgctggctcc

SEQ ID NO: 4279942 - DNA, 11 bp, Homo sapiens
agaggcctggt

SEQ ID NO: 4279943 - DNA, 14 bp, Homo sapiens
agaggcgtcttgta

SEQ ID NO: 4279944 - DNA, 23 bp, Homo sapiens
agaggctctgaaagctgcttctg

SEQ ID NO: 4279945 - DNA, 20 bp, Homo sapiens
agaggcttccttcatttcct

SEQ ID NO: 4279946 - DNA, 17 bp, Homo sapiens
agagggagaaggagagg

SEQ ID NO: 4279947 - DNA, 19 bp, Homo sapiens
agagggagaaggagaggct

SEQ ID NO: 4279948 - DNA, 14 bp, Homo sapiens
agaggggagaggaa

SEQ ID NO: 4279949 - DNA, 15 bp, Homo sapiens
agaggggagaggaag

SEQ ID NO: 4279950 - DNA, 16 bp, Homo sapiens
agaggggcggggccag

SEQ ID NO: 4279951 - DNA, 15 bp, Homo sapiens
agagggtccctaggt

SEQ ID NO: 4279952 - DNA, 20 bp, Homo sapiens
agagtatatatgtacagtta

SEQ ID NO: 4279953 - DNA, 18 bp, Homo sapiens
agagtatggtgctgggtc

SEQ ID NO: 4279954 - DNA, 15 bp, Homo sapiens
agagtccaggcccca

SEQ ID NO: 4279955 - DNA, 21 bp, Homo sapiens
agagtcgagtgatatggcttg

SEQ ID NO: 4279956 - DNA, 22 bp, Homo sapiens
agagtcgagtgatatggcttgt

SEQ ID NO: 4279957 - DNA, 12 bp, Homo sapiens
agagtgaggccc

SEQ ID NO: 4279958 - DNA, 19 bp, Homo sapiens
agagtgcccttaaaataat

SEQ ID NO: 4279959 - DNA, 14 bp, Homo sapiens
agagtggctcctcc

SEQ ID NO: 4279960 - DNA, 18 bp, Homo sapiens
agagtggggctagactgg

SEQ ID NO: 4279961 - DNA, 23 bp, Homo sapiens
agagtggggctagactgggctgg

SEQ ID NO: 4279962 - DNA, 18 bp, Homo sapiens
agagtggtctatttctcc

SEQ ID NO: 4279963 - DNA, 21 bp, Homo sapiens
agagtgtggaaaaaaaaagaa

SEQ ID NO: 4279964 - DNA, 16 bp, Homo sapiens
agataagcctgaaaca

SEQ ID NO: 4279965 - DNA, 22 bp, Homo sapiens
agatagcctagggtgagggtga

SEQ ID NO: 4279966 - DNA, 13 bp, Homo sapiens
agatattttgtaa

SEQ ID NO: 4279967 - DNA, 15 bp, Homo sapiens
agatattttgtaaaa

SEQ ID NO: 4279968 - DNA, 20 bp, Homo sapiens
agatattttgtaaaatgtat

SEQ ID NO: 4279969 - DNA, 15 bp, Homo sapiens
agatcaactcatgtt

SEQ ID NO: 4279970 - DNA, 18 bp, Homo sapiens
agatcagcattcaaaata

SEQ ID NO: 4279971 - DNA, 15 bp, Homo sapiens
agatccattaattta

SEQ ID NO: 4279972 - DNA, 20 bp, Homo sapiens
agatccgagcgacggctcct

SEQ ID NO: 4279973 - DNA, 22 bp, Homo sapiens
agatccgagcgacggctcctcc

SEQ ID NO: 4279974 - DNA, 14 bp, Homo sapiens
agatccgccctggg

SEQ ID NO: 4279975 - DNA, 17 bp, Homo sapiens
agatccgccctgggctc

SEQ ID NO: 4279976 - DNA, 17 bp, Homo sapiens
agatcctccttccaggc

SEQ ID NO: 4279977 - DNA, 16 bp, Homo sapiens
agatctcctgtaattt

SEQ ID NO: 4279978 - DNA, 14 bp, Homo sapiens
agatctctttctaa

SEQ ID NO: 4279979 - DNA, 13 bp, Homo sapiens
agatcttccttcc

SEQ ID NO: 4279980 - DNA, 20 bp, Homo sapiens
agatcttgagcaaggcaaga

SEQ ID NO: 4279981 - DNA, 19 bp, Homo sapiens
agatgacacataaatctgt

SEQ ID NO: 4279982 - DNA, 12 bp, Homo sapiens
agatgcctgggc

SEQ ID NO: 4279983 - DNA, 13 bp, Homo sapiens
agatgcctgggcc

SEQ ID NO: 4279984 - DNA, 15 bp, Homo sapiens
agatgcctgggcctg

SEQ ID NO: 4279985 - DNA, 19 bp, Homo sapiens
agatgctggtcatcctggg

SEQ ID NO: 4279986 - DNA, 20 bp, Homo sapiens
agatgctggtcatcctgggc

SEQ ID NO: 4279987 - DNA, 14 bp, Homo sapiens
agatggcgcacccg

SEQ ID NO: 4279988 - DNA, 15 bp, Homo sapiens
agatggcgcacccgg

SEQ ID NO: 4279989 - DNA, 11 bp, Homo sapiens
agatggctccc

SEQ ID NO: 4279990 - DNA, 15 bp, Homo sapiens
agatggctccctggg

SEQ ID NO: 4279991 - DNA, 16 bp, Homo sapiens
agatggctccctgggc

SEQ ID NO: 4279992 - DNA, 19 bp, Homo sapiens
agatggctccctgggctgg

SEQ ID NO: 4279993 - DNA, 22 bp, Homo sapiens
agatggctccctgggctggcat

SEQ ID NO: 4279994 - DNA, 16 bp, Homo sapiens
agatgggacaattaga

SEQ ID NO: 4279995 - DNA, 18 bp, Homo sapiens
agatggggagggcgcttt

SEQ ID NO: 4279996 - DNA, 22 bp, Homo sapiens
agatgggttttgttaggggtgg

SEQ ID NO: 4279997 - DNA, 16 bp, Homo sapiens
agatggtaatcttttc

SEQ ID NO: 4279998 - DNA, 23 bp, Homo sapiens
agatggtaatcttttctgaggtt

SEQ ID NO: 4279999 - DNA, 15 bp, Homo sapiens
agatggtgccccctg

SEQ ID NO: 4280000 - DNA, 20 bp, Homo sapiens
agatgtcaagctggccgtgg

SEQ ID NO: 4280001 - DNA, 21 bp, Homo sapiens
agatgtccatttttacaagtt

SEQ ID NO: 4280002 - DNA, 22 bp, Homo sapiens
agatgtgtatcagtgtttatgt

SEQ ID NO: 4280003 - DNA, 22 bp, Homo sapiens
agatgtgtccatgtgaaattta

SEQ ID NO: 4280004 - DNA, 18 bp, Homo sapiens
agatgttccatcctgtac

SEQ ID NO: 4280005 - DNA, 20 bp, Homo sapiens
agattaaaattagtgagatt

SEQ ID NO: 4280006 - DNA, 18 bp, Homo sapiens
agattaatttgtgtagat

SEQ ID NO: 4280007 - DNA, 14 bp, Homo sapiens
agattaggcctgga

SEQ ID NO: 4280008 - DNA, 15 bp, Homo sapiens
agattaggcctggag

SEQ ID NO: 4280009 - DNA, 12 bp, Homo sapiens
agattatttaca

SEQ ID NO: 4280010 - DNA, 15 bp, Homo sapiens
agattcactttgaca

SEQ ID NO: 4280011 - DNA, 23 bp, Homo sapiens
agattcactttgacacttttcat

SEQ ID NO: 4280012 - DNA, 21 bp, Homo sapiens
agattccagagagtggctcct

SEQ ID NO: 4280013 - DNA, 17 bp, Homo sapiens
agattctaaaacattct

SEQ ID NO: 4280014 - DNA, 15 bp, Homo sapiens
agattctgtgggcag

SEQ ID NO: 4280015 - DNA, 15 bp, Homo sapiens
agattggatcaagta

SEQ ID NO: 4280016 - DNA, 18 bp, Homo sapiens
agattggctttgccttta

SEQ ID NO: 4280017 - DNA, 13 bp, Homo sapiens
agattgtgtaaat

SEQ ID NO: 4280018 - DNA, 16 bp, Homo sapiens
agattgttattaaatg

SEQ ID NO: 4280019 - DNA, 20 bp, Homo sapiens
agatttgtatttatattaga

SEQ ID NO: 4280020 - DNA, 18 bp, Homo sapiens
agattttatgtgcttgaa

SEQ ID NO: 4280021 - DNA, 19 bp, Homo sapiens
agattttatgtgcttgaag

SEQ ID NO: 4280022 - DNA, 19 bp, Homo sapiens
aggccagctccttagacac

SEQ ID NO: 4280023 - DNA, 19 bp, Homo sapiens
aggccatgattcgcccaaa

SEQ ID NO: 4280024 - DNA, 16 bp, Homo sapiens
aggcccaaaccagggg

SEQ ID NO: 4280025 - DNA, 19 bp, Homo sapiens
aggcccacattgcccacac

SEQ ID NO: 4280026 - DNA, 13 bp, Homo sapiens
aggcccagcctgg

SEQ ID NO: 4280027 - DNA, 21 bp, Homo sapiens
aggccccaaaaccacagccct

SEQ ID NO: 4280028 - DNA, 11 bp, Homo sapiens
aggccccaggc

SEQ ID NO: 4280029 - DNA, 13 bp, Homo sapiens
aggccccaggctg

SEQ ID NO: 4280030 - DNA, 15 bp, Homo sapiens
aggccccaggctgga

SEQ ID NO: 4280031 - DNA, 22 bp, Homo sapiens
aggccccaggctggatgctggg

SEQ ID NO: 4280032 - DNA, 17 bp, Homo sapiens
aggcccctttggacctg

SEQ ID NO: 4280033 - DNA, 15 bp, Homo sapiens
aggcccgggaggagg

SEQ ID NO: 4280034 - DNA, 16 bp, Homo sapiens
aggcccgggaggagga

SEQ ID NO: 4280035 - DNA, 17 bp, Homo sapiens
aggccctggtctggctt

SEQ ID NO: 4280036 - DNA, 20 bp, Homo sapiens
aggccctggtctggctttgg

SEQ ID NO: 4280037 - DNA, 17 bp, Homo sapiens
aggcccttcctctccac

SEQ ID NO: 4280038 - DNA, 18 bp, Homo sapiens
aggcccttcctctccact

SEQ ID NO: 4280039 - DNA, 22 bp, Homo sapiens
aggcccttcctctccactgcct

SEQ ID NO: 4280040 - DNA, 14 bp, Homo sapiens
aggccgaggcaggg

SEQ ID NO: 4280041 - DNA, 19 bp, Homo sapiens
aggccgaggcaggggctgg

SEQ ID NO: 4280042 - DNA, 19 bp, Homo sapiens
aggccgctgcagggtggca

SEQ ID NO: 4280043 - DNA, 19 bp, Homo sapiens
aggccggtgggaagagggc

SEQ ID NO: 4280044 - DNA, 23 bp, Homo sapiens
aggcctcacctggcttcccagga

SEQ ID NO: 4280045 - DNA, 16 bp, Homo sapiens
aggcctcagggaccaa

SEQ ID NO: 4280046 - DNA, 23 bp, Homo sapiens
aggcctgaaatgtttccaggcat

SEQ ID NO: 4280047 - DNA, 18 bp, Homo sapiens
aggcctggagttgggctg

SEQ ID NO: 4280048 - DNA, 13 bp, Homo sapiens
aggcctggcccag

SEQ ID NO: 4280049 - DNA, 22 bp, Homo sapiens
aggcctggcccagccagcaggt

SEQ ID NO: 4280050 - DNA, 12 bp, Homo sapiens
aggcctggccct

SEQ ID NO: 4280051 - DNA, 15 bp, Homo sapiens
aggcctggccctttc

SEQ ID NO: 4280052 - DNA, 23 bp, Homo sapiens
aggcctggtctggagcccctatc

SEQ ID NO: 4280053 - DNA, 19 bp, Homo sapiens
aggcctggtgccctggccc

SEQ ID NO: 4280054 - DNA, 13 bp, Homo sapiens
aggcgtagggcca

SEQ ID NO: 4280055 - DNA, 13 bp, Homo sapiens
aggcgtgggatcc

SEQ ID NO: 4280056 - DNA, 22 bp, Homo sapiens
aggcgtgggatccagagagaag

SEQ ID NO: 4280057 - DNA, 13 bp, Homo sapiens
aggctactgccac

SEQ ID NO: 4280058 - DNA, 14 bp, Homo sapiens
aggctactgccact

SEQ ID NO: 4280059 - DNA, 21 bp, Homo sapiens
aggctcacaactgtttttgaa

SEQ ID NO: 4280060 - DNA, 18 bp, Homo sapiens
aggctcccactgcccctg

SEQ ID NO: 4280061 - DNA, 17 bp, Homo sapiens
aggctgaaaagtgcttt

SEQ ID NO: 4280062 - DNA, 17 bp, Homo sapiens
aggctgccccacccctc

SEQ ID NO: 4280063 - DNA, 20 bp, Homo sapiens
aggctgccccacccctccat

SEQ ID NO: 4280064 - DNA, 11 bp, Homo sapiens
aggctgcctgc

SEQ ID NO: 4280065 - DNA, 12 bp, Homo sapiens
aggctgcctgcc

SEQ ID NO: 4280066 - DNA, 17 bp, Homo sapiens
aggctggagctggcgtc

SEQ ID NO: 4280067 - DNA, 18 bp, Homo sapiens
aggctggagctggcgtct

SEQ ID NO: 4280068 - DNA, 17 bp, Homo sapiens
aggctggatgctgggtt

SEQ ID NO: 4280069 - DNA, 22 bp, Homo sapiens
aggctggtggacagacccaggg

SEQ ID NO: 4280070 - DNA, 20 bp, Homo sapiens
aggcttgcattaaaagactg

SEQ ID NO: 4280071 - DNA, 18 bp, Homo sapiens
aggcttgtcagagctggg

SEQ ID NO: 4280072 - DNA, 20 bp, Homo sapiens
agggaaacccggggaactgg

SEQ ID NO: 4280073 - DNA, 16 bp, Homo sapiens
agggaagcagagcctg

SEQ ID NO: 4280074 - DNA, 18 bp, Homo sapiens
agggaagcagagcctggg

SEQ ID NO: 4280075 - DNA, 19 bp, Homo sapiens
agggaagcagagcctgggg

SEQ ID NO: 4280076 - DNA, 19 bp, Homo sapiens
agggaatcagggagcactg

SEQ ID NO: 4280077 - DNA, 13 bp, Homo sapiens
agggacacagagg

SEQ ID NO: 4280078 - DNA, 18 bp, Homo sapiens
agggacacagaggacagc

SEQ ID NO: 4280079 - DNA, 18 bp, Homo sapiens
agggacagtctggaggtc

SEQ ID NO: 4280080 - DNA, 17 bp, Homo sapiens
agggacatgtctttggc

SEQ ID NO: 4280081 - DNA, 18 bp, Homo sapiens
agggaccaaggacccctc

SEQ ID NO: 4280082 - DNA, 13 bp, Homo sapiens
agggaccaaggag

SEQ ID NO: 4280083 - DNA, 14 bp, Homo sapiens
agggagaccctggg

SEQ ID NO: 4280084 - DNA, 14 bp, Homo sapiens
agggagactgaccc

SEQ ID NO: 4280085 - DNA, 15 bp, Homo sapiens
agggagactgaccca

SEQ ID NO: 4280086 - DNA, 16 bp, Homo sapiens
agggagcactggaggc

SEQ ID NO: 4280087 - DNA, 13 bp, Homo sapiens
agggaggcctgag

SEQ ID NO: 4280088 - DNA, 14 bp, Homo sapiens
agggaggcctgagg

SEQ ID NO: 4280089 - DNA, 16 bp, Homo sapiens
agggaggcctgagggg

SEQ ID NO: 4280090 - DNA, 22 bp, Homo sapiens
agggagtaggctgtattttctt

SEQ ID NO: 4280091 - DNA, 22 bp, Homo sapiens
agggatgctatctcgctagcca

SEQ ID NO: 4280092 - DNA, 17 bp, Homo sapiens
agggcactggtggcccg

SEQ ID NO: 4280093 - DNA, 20 bp, Homo sapiens
agggcagcctgtgggagaag

SEQ ID NO: 4280094 - DNA, 19 bp, Homo sapiens
agggcaggagcctagagga

SEQ ID NO: 4280095 - DNA, 23 bp, Homo sapiens
agggcaggggccgtgcagggcca

SEQ ID NO: 4280096 - DNA, 17 bp, Homo sapiens
agggcagggttctagaa

SEQ ID NO: 4280097 - DNA, 18 bp, Homo sapiens
agggcagggttctagaag

SEQ ID NO: 4280098 - DNA, 15 bp, Homo sapiens
agggcatctccagga

SEQ ID NO: 4280099 - DNA, 22 bp, Homo sapiens
agggcatctccaggaaggcggg

SEQ ID NO: 4280100 - DNA, 17 bp, Homo sapiens
agggcatggccaggtgg

SEQ ID NO: 4280101 - DNA, 16 bp, Homo sapiens
agggcatttttcttgg

SEQ ID NO: 4280102 - DNA, 13 bp, Homo sapiens
agggccagggctc

SEQ ID NO: 4280103 - DNA, 13 bp, Homo sapiens
agggccagggttg

SEQ ID NO: 4280104 - DNA, 13 bp, Homo sapiens
agggcccagaggg

SEQ ID NO: 4280105 - DNA, 22 bp, Homo sapiens
agggcccagaggggcggggcca

SEQ ID NO: 4280106 - DNA, 13 bp, Homo sapiens
agggcccctcact

SEQ ID NO: 4280107 - DNA, 16 bp, Homo sapiens
agggcccctcactggc

SEQ ID NO: 4280108 - DNA, 21 bp, Homo sapiens
agggcccctcactggctggac

SEQ ID NO: 4280109 - DNA, 13 bp, Homo sapiens
agggccctgctca

SEQ ID NO: 4280110 - DNA, 18 bp, Homo sapiens
agggccctgctcaggcct

SEQ ID NO: 4280111 - DNA, 22 bp, Homo sapiens
agggccctgctcaggcctcacc

SEQ ID NO: 4280112 - DNA, 15 bp, Homo sapiens
agggcgctgagggca

SEQ ID NO: 4280113 - DNA, 16 bp, Homo sapiens
agggcgggccaggaga

SEQ ID NO: 4280114 - DNA, 12 bp, Homo sapiens
agggcggggctg

SEQ ID NO: 4280115 - DNA, 16 bp, Homo sapiens
agggcggggctggcca

SEQ ID NO: 4280116 - DNA, 20 bp, Homo sapiens
agggctccacgggggcctag

SEQ ID NO: 4280117 - DNA, 15 bp, Homo sapiens
agggctctggcaggt

SEQ ID NO: 4280118 - DNA, 18 bp, Homo sapiens
agggctggattggcaggt

SEQ ID NO: 4280119 - DNA, 21 bp, Homo sapiens
agggctgggcactcctcccct

SEQ ID NO: 4280120 - DNA, 13 bp, Homo sapiens
agggcttctcttt

SEQ ID NO: 4280121 - DNA, 21 bp, Homo sapiens
agggcttttttttgagaatac

SEQ ID NO: 4280122 - DNA, 17 bp, Homo sapiens
aggggaagtgtgctgag

SEQ ID NO: 4280123 - DNA, 19 bp, Homo sapiens
aggggaagtgtgctgaggt

SEQ ID NO: 4280124 - DNA, 21 bp, Homo sapiens
aggggacttggataggagctt

SEQ ID NO: 4280125 - DNA, 20 bp, Homo sapiens
aggggagacttaggccagag

SEQ ID NO: 4280126 - DNA, 21 bp, Homo sapiens
aggggagacttaggccagagg

SEQ ID NO: 4280127 - DNA, 19 bp, Homo sapiens
aggggagggtggcaggtga

SEQ ID NO: 4280128 - DNA, 23 bp, Homo sapiens
aggggatctaaaaggaggacagg

SEQ ID NO: 4280129 - DNA, 22 bp, Homo sapiens
aggggcacacttccccttggga

SEQ ID NO: 4280130 - DNA, 20 bp, Homo sapiens
aggggcagaaggaggaaggg

SEQ ID NO: 4280131 - DNA, 13 bp, Homo sapiens
aggggcaggcctt

SEQ ID NO: 4280132 - DNA, 22 bp, Homo sapiens
aggggcctgccactctcctgag

SEQ ID NO: 4280133 - DNA, 23 bp, Homo sapiens
aggggcctgccactctcctgagg

SEQ ID NO: 4280134 - DNA, 18 bp, Homo sapiens
aggggcctggcagccgtg

SEQ ID NO: 4280135 - DNA, 14 bp, Homo sapiens
aggggcggggccag

SEQ ID NO: 4280136 - DNA, 16 bp, Homo sapiens
aggggctgcatcctca

SEQ ID NO: 4280137 - DNA, 18 bp, Homo sapiens
aggggctgcatcctcagc

SEQ ID NO: 4280138 - DNA, 21 bp, Homo sapiens
aggggctgcatcctcagcccc

SEQ ID NO: 4280139 - DNA, 22 bp, Homo sapiens
aggggctgcatcctcagcccca

SEQ ID NO: 4280140 - DNA, 16 bp, Homo sapiens
aggggctgggcagagg

SEQ ID NO: 4280141 - DNA, 16 bp, Homo sapiens
agggggagactatgtg

SEQ ID NO: 4280142 - DNA, 19 bp, Homo sapiens
agggggcccggctgggccc

SEQ ID NO: 4280143 - DNA, 15 bp, Homo sapiens
aggggtcagcagggg

SEQ ID NO: 4280144 - DNA, 14 bp, Homo sapiens
aggggtctgctcct

SEQ ID NO: 4280145 - DNA, 16 bp, Homo sapiens
aggggtctgctcctgt

SEQ ID NO: 4280146 - DNA, 14 bp, Homo sapiens
aggggtgagccccg

SEQ ID NO: 4280147 - DNA, 14 bp, Homo sapiens
aggggtttacagtg

SEQ ID NO: 4280148 - DNA, 20 bp, Homo sapiens
agggtaggggaagtgtgctg

SEQ ID NO: 4280149 - DNA, 23 bp, Homo sapiens
agggtatctgctgcctctgaaaa

SEQ ID NO: 4280150 - DNA, 22 bp, Homo sapiens
agggtcctcaggcagtggccca

SEQ ID NO: 4280151 - DNA, 19 bp, Homo sapiens
agggtctcgtcaggaggtg

SEQ ID NO: 4280152 - DNA, 12 bp, Homo sapiens
atatgttgctga

SEQ ID NO: 4280153 - DNA, 16 bp, Homo sapiens
atattagagtgccctt

SEQ ID NO: 4280154 - DNA, 23 bp, Homo sapiens
atattagagtgcccttaaaataa

SEQ ID NO: 4280155 - DNA, 13 bp, Homo sapiens
atattagccaaag

SEQ ID NO: 4280156 - DNA, 14 bp, Homo sapiens
atattcatactttc

SEQ ID NO: 4280157 - DNA, 20 bp, Homo sapiens
atattcatactttccaacat

SEQ ID NO: 4280158 - DNA, 22 bp, Homo sapiens
atattcattctttataaaccat

SEQ ID NO: 4280159 - DNA, 22 bp, Homo sapiens
atattctaagaaatatctgtga

SEQ ID NO: 4280160 - DNA, 21 bp, Homo sapiens
atattgagatcagcattcaaa

SEQ ID NO: 4280161 - DNA, 18 bp, Homo sapiens
atattgagcaatatgtca

SEQ ID NO: 4280162 - DNA, 14 bp, Homo sapiens
atattgagcagaat

SEQ ID NO: 4280163 - DNA, 16 bp, Homo sapiens
atattgagcagaattc

SEQ ID NO: 4280164 - DNA, 23 bp, Homo sapiens
atattggtgtgaatgctgtacct

SEQ ID NO: 4280165 - DNA, 22 bp, Homo sapiens
atattgtattgttagatgtttg

SEQ ID NO: 4280166 - DNA, 22 bp, Homo sapiens
atatttaataggataaattaat

SEQ ID NO: 4280167 - DNA, 16 bp, Homo sapiens
atatttacaatgtatt

SEQ ID NO: 4280168 - DNA, 14 bp, Homo sapiens
atatttatttctag

SEQ ID NO: 4280169 - DNA, 20 bp, Homo sapiens
atatttctaagcttatttct

SEQ ID NO: 4280170 - DNA, 16 bp, Homo sapiens
atatttgcttatttat

SEQ ID NO: 4280171 - DNA, 14 bp, Homo sapiens
atatttgtttagtt

SEQ ID NO: 4280172 - DNA, 20 bp, Homo sapiens
atattttaaaatctcctaaa

SEQ ID NO: 4280173 - DNA, 19 bp, Homo sapiens
atattttatttcaatgtaa

SEQ ID NO: 4280174 - DNA, 20 bp, Homo sapiens
atattttcaacgcagccctg

SEQ ID NO: 4280175 - DNA, 17 bp, Homo sapiens
atatttttaatttatga

SEQ ID NO: 4280176 - DNA, 14 bp, Homo sapiens
atatttttttctag

SEQ ID NO: 4280177 - DNA, 19 bp, Homo sapiens
atcaaaaattgaagagaga

SEQ ID NO: 4280178 - DNA, 19 bp, Homo sapiens
atcaaaagattaacaacac

SEQ ID NO: 4280179 - DNA, 22 bp, Homo sapiens
atcaaagtgtttaattgtataa

SEQ ID NO: 4280180 - DNA, 23 bp, Homo sapiens
atcaaagtgtttaattgtataaa

SEQ ID NO: 4280181 - DNA, 19 bp, Homo sapiens
atcaaataaaaattctaga

SEQ ID NO: 4280182 - DNA, 16 bp, Homo sapiens
atcaaatctgagcctt

SEQ ID NO: 4280183 - DNA, 21 bp, Homo sapiens
atcaacagcatgtctactgct

SEQ ID NO: 4280184 - DNA, 16 bp, Homo sapiens
atcaacttgtcacaaa

SEQ ID NO: 4280185 - DNA, 19 bp, Homo sapiens
atcaaggggttcccactgg

SEQ ID NO: 4280186 - DNA, 17 bp, Homo sapiens
atcaagtcccgaggcag

SEQ ID NO: 4280187 - DNA, 20 bp, Homo sapiens
atcaagtgcatttctgggcc

SEQ ID NO: 4280188 - DNA, 21 bp, Homo sapiens
atcaagtgcatttctgggcct

SEQ ID NO: 4280189 - DNA, 14 bp, Homo sapiens
atcaatacttttgt

SEQ ID NO: 4280190 - DNA, 17 bp, Homo sapiens
atcaatacttttgtgta

SEQ ID NO: 4280191 - DNA, 18 bp, Homo sapiens
atcaatacttttgtgtat

SEQ ID NO: 4280192 - DNA, 23 bp, Homo sapiens
atcaatacttttgtgtattctgt

SEQ ID NO: 4280193 - DNA, 22 bp, Homo sapiens
atcaatggcgcagtgcctctgg

SEQ ID NO: 4280194 - DNA, 16 bp, Homo sapiens
atcacacatgttcaga

SEQ ID NO: 4280195 - DNA, 18 bp, Homo sapiens
atcacgagatcttccttc

SEQ ID NO: 4280196 - DNA, 14 bp, Homo sapiens
atcacggcatgttt

SEQ ID NO: 4280197 - DNA, 15 bp, Homo sapiens
atcactcattaatta

SEQ ID NO: 4280198 - DNA, 16 bp, Homo sapiens
atcactcattaattaa

SEQ ID NO: 4280199 - DNA, 18 bp, Homo sapiens
atcagcattcaaaatagt

SEQ ID NO: 4280200 - DNA, 17 bp, Homo sapiens
atcagcccctgctgctc

SEQ ID NO: 4280201 - DNA, 23 bp, Homo sapiens
atcagccctgcccttcagcatcc

SEQ ID NO: 4280202 - DNA, 22 bp, Homo sapiens
atcaggaaaggaagatgtaaga

SEQ ID NO: 4280203 - DNA, 13 bp, Homo sapiens
atcagtaaaatta

SEQ ID NO: 4280204 - DNA, 17 bp, Homo sapiens
atcagtaaaattatact

SEQ ID NO: 4280205 - DNA, 22 bp, Homo sapiens
atcagtgtttatgtgctattaa

SEQ ID NO: 4280206 - DNA, 15 bp, Homo sapiens
atcatcaaagtgttt

SEQ ID NO: 4280207 - DNA, 16 bp, Homo sapiens
atcatcaaagtgttta

SEQ ID NO: 4280208 - DNA, 14 bp, Homo sapiens
atcatcaatacttt

SEQ ID NO: 4280209 - DNA, 20 bp, Homo sapiens
atcatcaatacttttgtgta

SEQ ID NO: 4280210 - DNA, 17 bp, Homo sapiens
atcatcacgtatgttat

SEQ ID NO: 4280211 - DNA, 22 bp, Homo sapiens
atcatcacgtatgttatacaac

SEQ ID NO: 4280212 - DNA, 15 bp, Homo sapiens
atcatcttgaacatt

SEQ ID NO: 4280213 - DNA, 14 bp, Homo sapiens
atcatgtctattgt

SEQ ID NO: 4280214 - DNA, 17 bp, Homo sapiens
atcatgtctattgtcca

SEQ ID NO: 4280215 - DNA, 19 bp, Homo sapiens
atcattggtatctgatatc

SEQ ID NO: 4280216 - DNA, 13 bp, Homo sapiens
atcattttcctgg

SEQ ID NO: 4280217 - DNA, 18 bp, Homo sapiens
atccacatgtttcagagc

SEQ ID NO: 4280218 - DNA, 18 bp, Homo sapiens
atccactctgcaggaaat

SEQ ID NO: 4280219 - DNA, 21 bp, Homo sapiens
atccagagagaagcaccccac

SEQ ID NO: 4280220 - DNA, 22 bp, Homo sapiens
atccagaggtgagggaggcctg

SEQ ID NO: 4280221 - DNA, 18 bp, Homo sapiens
atccagatagcctagggt

SEQ ID NO: 4280222 - DNA, 23 bp, Homo sapiens
atccataccccctgccccagaga

SEQ ID NO: 4280223 - DNA, 22 bp, Homo sapiens
atccatccctggtgaaagagta

SEQ ID NO: 4280224 - DNA, 13 bp, Homo sapiens
atccattaattta

SEQ ID NO: 4280225 - DNA, 14 bp, Homo sapiens
atccattttctaaa

SEQ ID NO: 4280226 - DNA, 15 bp, Homo sapiens
atccattttctaaac

SEQ ID NO: 4280227 - DNA, 15 bp, Homo sapiens
atcccaccaaccctc

SEQ ID NO: 4280228 - DNA, 21 bp, Homo sapiens
atcccggggccatggaagctg

SEQ ID NO: 4280229 - DNA, 18 bp, Homo sapiens
atccctccaccccagtcc

SEQ ID NO: 4280230 - DNA, 22 bp, Homo sapiens
atccctccaccccagtccccgg

SEQ ID NO: 4280231 - DNA, 20 bp, Homo sapiens
atccctggtgaaagagtaaa

SEQ ID NO: 4280232 - DNA, 23 bp, Homo sapiens
atcccttcaaggaagtgataaca

SEQ ID NO: 4280233 - DNA, 16 bp, Homo sapiens
atcccttggcccctct

SEQ ID NO: 4280234 - DNA, 19 bp, Homo sapiens
atcccttggcccctctctg

SEQ ID NO: 4280235 - DNA, 12 bp, Homo sapiens
atccgccctggg

SEQ ID NO: 4280236 - DNA, 17 bp, Homo sapiens
atccgccctgggctctg

SEQ ID NO: 4280237 - DNA, 19 bp, Homo sapiens
atccgccctgggctctggg

SEQ ID NO: 4280238 - DNA, 14 bp, Homo sapiens
atcctatactggtt

SEQ ID NO: 4280239 - DNA, 10 bp, Homo sapiens
atcctcagcc

SEQ ID NO: 4280240 - DNA, 13 bp, Homo sapiens
atcctcagcccca

SEQ ID NO: 4280241 - DNA, 17 bp, Homo sapiens
atcctcagccccagggc

SEQ ID NO: 4280242 - DNA, 18 bp, Homo sapiens
atcctcagccccagggcc

SEQ ID NO: 4280243 - DNA, 21 bp, Homo sapiens
atcctcagccccagggccctg

SEQ ID NO: 4280244 - DNA, 23 bp, Homo sapiens
atcctcagccccagggccctgct

SEQ ID NO: 4280245 - DNA, 14 bp, Homo sapiens
atcctcagttcctg

SEQ ID NO: 4280246 - DNA, 19 bp, Homo sapiens
atcctcagttcctgcagca

SEQ ID NO: 4280247 - DNA, 13 bp, Homo sapiens
atcctccccttcc

SEQ ID NO: 4280248 - DNA, 15 bp, Homo sapiens
atcctccccttccct

SEQ ID NO: 4280249 - DNA, 20 bp, Homo sapiens
atcctcctggacccagcagg

SEQ ID NO: 4280250 - DNA, 15 bp, Homo sapiens
atcctccttccaggc

SEQ ID NO: 4280251 - DNA, 19 bp, Homo sapiens
atcctgattattgaatgtt

SEQ ID NO: 4280252 - DNA, 21 bp, Homo sapiens
atcctgccttcatggaactca

SEQ ID NO: 4280253 - DNA, 16 bp, Homo sapiens
atcctgggcatcccca

SEQ ID NO: 4280254 - DNA, 20 bp, Homo sapiens
atcctgggcatccccagccc

SEQ ID NO: 4280255 - DNA, 24 bp, Homo sapiens
atcctgggcatccccagccccctg

SEQ ID NO: 4280256 - DNA, 16 bp, Homo sapiens
atcctgtcaatgtttg

SEQ ID NO: 4280257 - DNA, 22 bp, Homo sapiens
atccttgaggacctccacctgg

SEQ ID NO: 4280258 - DNA, 15 bp, Homo sapiens
atccttgtcagttgt

SEQ ID NO: 4280259 - DNA, 14 bp, Homo sapiens
atcgacctcactgt

SEQ ID NO: 4280260 - DNA, 15 bp, Homo sapiens
atcgacctcactgtc

SEQ ID NO: 4280261 - DNA, 22 bp, Homo sapiens
atcgcagggctcatgatttttt

SEQ ID NO: 4280262 - DNA, 17 bp, Homo sapiens
atcgcattaatgaaata

SEQ ID NO: 4280263 - DNA, 18 bp, Homo sapiens
atcggaggcttgtcagag

SEQ ID NO: 4280264 - DNA, 20 bp, Homo sapiens
atcggaggcttgtcagagct

SEQ ID NO: 4280265 - DNA, 16 bp, Homo sapiens
atcgtggtatgtgaat

SEQ ID NO: 4280266 - DNA, 20 bp, Homo sapiens
atcgttgcaaccactgcaat

SEQ ID NO: 4280267 - DNA, 13 bp, Homo sapiens
atctaaaaaataa

SEQ ID NO: 4280268 - DNA, 23 bp, Homo sapiens
atctaaaatactcaccaaaatat

SEQ ID NO: 4280269 - DNA, 14 bp, Homo sapiens
atctaacattatta

SEQ ID NO: 4280270 - DNA, 16 bp, Homo sapiens
atctaacattattact

SEQ ID NO: 4280271 - DNA, 19 bp, Homo sapiens
atctaacattattactttt

SEQ ID NO: 4280272 - DNA, 23 bp, Homo sapiens
atctaagtcagtttcacatattt

SEQ ID NO: 4280273 - DNA, 15 bp, Homo sapiens
atctacgatgttaaa

SEQ ID NO: 4280274 - DNA, 19 bp, Homo sapiens
atctagaggcttccttcat

SEQ ID NO: 4280275 - DNA, 20 bp, Homo sapiens
atctagcaagaagattctaa

SEQ ID NO: 4280276 - DNA, 21 bp, Homo sapiens
atctagcaagaagattctaaa

SEQ ID NO: 4280277 - DNA, 20 bp, Homo sapiens
atctagccaggcctcccgca

SEQ ID NO: 4280278 - DNA, 20 bp, Homo sapiens
atctatctggtgatttctag

SEQ ID NO: 4280279 - DNA, 19 bp, Homo sapiens
atctatttatctgtctgag

SEQ ID NO: 4280280 - DNA, 15 bp, Homo sapiens
atctcacttttctcc

SEQ ID NO: 4280281 - DNA, 22 bp, Homo sapiens
attgaaaagaagaaagtctatg

SEQ ID NO: 4280282 - DNA, 14 bp, Homo sapiens
attgaatctgattg

SEQ ID NO: 4280283 - DNA, 14 bp, Homo sapiens
attgagggaaaaca

SEQ ID NO: 4280284 - DNA, 19 bp, Homo sapiens
attgagttcttcctgtaat

SEQ ID NO: 4280285 - DNA, 22 bp, Homo sapiens
attgagttcttcctgtaatctt

SEQ ID NO: 4280286 - DNA, 16 bp, Homo sapiens
attgatattctaagaa

SEQ ID NO: 4280287 - DNA, 14 bp, Homo sapiens
attgatgatccatt

SEQ ID NO: 4280288 - DNA, 20 bp, Homo sapiens
attgcaaaaggttaagccat

SEQ ID NO: 4280289 - DNA, 19 bp, Homo sapiens
attgcataagtggacccag

SEQ ID NO: 4280290 - DNA, 20 bp, Homo sapiens
attgcataagtggacccagc

SEQ ID NO: 4280291 - DNA, 21 bp, Homo sapiens
attgcataagtggacccagct

SEQ ID NO: 4280292 - DNA, 16 bp, Homo sapiens
attgcatttcctgaca

SEQ ID NO: 4280293 - DNA, 17 bp, Homo sapiens
attgcatttcctgacag

SEQ ID NO: 4280294 - DNA, 12 bp, Homo sapiens
attgccctgagg

SEQ ID NO: 4280295 - DNA, 19 bp, Homo sapiens
attgccctgaggggcctgc

SEQ ID NO: 4280296 - DNA, 16 bp, Homo sapiens
attggatcaagtatta

SEQ ID NO: 4280297 - DNA, 20 bp, Homo sapiens
attggcagcttcaaaacaga

SEQ ID NO: 4280298 - DNA, 15 bp, Homo sapiens
attgggggggcttgg

SEQ ID NO: 4280299 - DNA, 19 bp, Homo sapiens
attgtacatatggaaatcc

SEQ ID NO: 4280300 - DNA, 21 bp, Homo sapiens
attgtaggtcaatgaaatatt

SEQ ID NO: 4280301 - DNA, 18 bp, Homo sapiens
attgtctgacttctcagg

SEQ ID NO: 4280302 - DNA, 12 bp, Homo sapiens
attgtctgtaaa

SEQ ID NO: 4280303 - DNA, 14 bp, Homo sapiens
attgtctgtaaatc

SEQ ID NO: 4280304 - DNA, 20 bp, Homo sapiens
attgtgaaatttgttaatat

SEQ ID NO: 4280305 - DNA, 13 bp, Homo sapiens
attgtggctttat

SEQ ID NO: 4280306 - DNA, 19 bp, Homo sapiens
attgttacaggtgtactat

SEQ ID NO: 4280307 - DNA, 15 bp, Homo sapiens
attgttagatgtttg

SEQ ID NO: 4280308 - DNA, 12 bp, Homo sapiens
attgttgcatta

SEQ ID NO: 4280309 - DNA, 14 bp, Homo sapiens
atttaaaaaaaaac

SEQ ID NO: 4280310 - DNA, 20 bp, Homo sapiens
atttaaaaaatgaatagtac

SEQ ID NO: 4280311 - DNA, 21 bp, Homo sapiens
atttaaaatagttttctaaat

SEQ ID NO: 4280312 - DNA, 14 bp, Homo sapiens
atttaaaatggact

SEQ ID NO: 4280313 - DNA, 17 bp, Homo sapiens
atttaaattttcagaaa

SEQ ID NO: 4280314 - DNA, 17 bp, Homo sapiens
atttaactagcacttta

SEQ ID NO: 4280315 - DNA, 15 bp, Homo sapiens
atttaactgcatata

SEQ ID NO: 4280316 - DNA, 18 bp, Homo sapiens
atttaactgcatatagat

SEQ ID NO: 4280317 - DNA, 22 bp, Homo sapiens
atttaatagataaagtgcctat

SEQ ID NO: 4280318 - DNA, 18 bp, Homo sapiens
atttaatatactgcatat

SEQ ID NO: 4280319 - DNA, 20 bp, Homo sapiens
atttaattttgacactgaaa

SEQ ID NO: 4280320 - DNA, 22 bp, Homo sapiens
atttaattttgacactgaaata

SEQ ID NO: 4280321 - DNA, 14 bp, Homo sapiens
atttacaagaagaa

SEQ ID NO: 4280322 - DNA, 13 bp, Homo sapiens
atttacaatgtat

SEQ ID NO: 4280323 - DNA, 14 bp, Homo sapiens
atttacaatgtatt

SEQ ID NO: 4280324 - DNA, 16 bp, Homo sapiens
atttacagttactgcc

SEQ ID NO: 4280325 - DNA, 20 bp, Homo sapiens
atttaggatattacaatggc

SEQ ID NO: 4280326 - DNA, 23 bp, Homo sapiens
atttaggatattacaatggccag

SEQ ID NO: 4280327 - DNA, 14 bp, Homo sapiens
atttaggtttctga

SEQ ID NO: 4280328 - DNA, 17 bp, Homo sapiens
atttaggtttctgagtt

SEQ ID NO: 4280329 - DNA, 16 bp, Homo sapiens
atttatattagagtgc

SEQ ID NO: 4280330 - DNA, 19 bp, Homo sapiens
atttatattcagagatgta

SEQ ID NO: 4280331 - DNA, 14 bp, Homo sapiens
atttatcttatcta

SEQ ID NO: 4280332 - DNA, 20 bp, Homo sapiens
atttatgacctcaacaaaga

SEQ ID NO: 4280333 - DNA, 19 bp, Homo sapiens
atttattagccctgcattt

SEQ ID NO: 4280334 - DNA, 11 bp, Homo sapiens
atttattctgg

SEQ ID NO: 4280335 - DNA, 20 bp, Homo sapiens
atttattgtatatatggata

SEQ ID NO: 4280336 - DNA, 19 bp, Homo sapiens
atttatttccaatgtttca

SEQ ID NO: 4280337 - DNA, 12 bp, Homo sapiens
atttatttctag

SEQ ID NO: 4280338 - DNA, 22 bp, Homo sapiens
atttattttgtatgaaatatat

SEQ ID NO: 4280339 - DNA, 17 bp, Homo sapiens
atttcaaaatgcatgtg

SEQ ID NO: 4280340 - DNA, 20 bp, Homo sapiens
atttcaaaatgcatgtgatt

SEQ ID NO: 4280341 - DNA, 13 bp, Homo sapiens
atttcaatgtaat

SEQ ID NO: 4280342 - DNA, 16 bp, Homo sapiens
atttcatctttccaaa

SEQ ID NO: 4280343 - DNA, 20 bp, Homo sapiens
atttcatgactggtgcgttc

SEQ ID NO: 4280344 - DNA, 21 bp, Homo sapiens
atttccatggattcccctgga

SEQ ID NO: 4280345 - DNA, 23 bp, Homo sapiens
atttccgaagaccttctgaagat

SEQ ID NO: 4280346 - DNA, 19 bp, Homo sapiens
atttcctatttttggaaga

SEQ ID NO: 4280347 - DNA, 13 bp, Homo sapiens
atttctaactatt

SEQ ID NO: 4280348 - DNA, 20 bp, Homo sapiens
atttctaagcttatttctaa

SEQ ID NO: 4280349 - DNA, 13 bp, Homo sapiens
atttctatctgca

SEQ ID NO: 4280350 - DNA, 14 bp, Homo sapiens
atttctcaaagttt

SEQ ID NO: 4280351 - DNA, 23 bp, Homo sapiens
atttctcaaagtttttacagtgt

SEQ ID NO: 4280352 - DNA, 15 bp, Homo sapiens
atttctcttaagtac

SEQ ID NO: 4280353 - DNA, 15 bp, Homo sapiens
atttctgccatttca

SEQ ID NO: 4280354 - DNA, 18 bp, Homo sapiens
atttctgccatttcatgt

SEQ ID NO: 4280355 - DNA, 19 bp, Homo sapiens
atttctgccatttcatgtc

SEQ ID NO: 4280356 - DNA, 16 bp, Homo sapiens
atttcttgggccctcc

SEQ ID NO: 4280357 - DNA, 19 bp, Homo sapiens
atttcttggtatgatcatt

SEQ ID NO: 4280358 - DNA, 21 bp, Homo sapiens
atttcttttttaaatgaagaa

SEQ ID NO: 4280359 - DNA, 22 bp, Homo sapiens
atttcttttttaaatgaagaaa

SEQ ID NO: 4280360 - DNA, 22 bp, Homo sapiens
atttgcaacaggaagacactgg

SEQ ID NO: 4280361 - DNA, 23 bp, Homo sapiens
atttgcaactttagaaagaaatt

SEQ ID NO: 4280362 - DNA, 15 bp, Homo sapiens
atttgccaaaaacta

SEQ ID NO: 4280363 - DNA, 18 bp, Homo sapiens
atttgccaaaaactaaaa

SEQ ID NO: 4280364 - DNA, 22 bp, Homo sapiens
atttgccaaaaactaaaattca

SEQ ID NO: 4280365 - DNA, 20 bp, Homo sapiens
atttgccgatttcctaagct

SEQ ID NO: 4280366 - DNA, 14 bp, Homo sapiens
atttgcttatttat

SEQ ID NO: 4280367 - DNA, 18 bp, Homo sapiens
atttgcttatttatattc

SEQ ID NO: 4280368 - DNA, 22 bp, Homo sapiens
atttgggctgaatgtatgtaaa

SEQ ID NO: 4280369 - DNA, 14 bp, Homo sapiens
atttgtatgatatt

SEQ ID NO: 4280370 - DNA, 13 bp, Homo sapiens
atttgtatttata

SEQ ID NO: 4280371 - DNA, 15 bp, Homo sapiens
atttgtatttatatt

SEQ ID NO: 4280372 - DNA, 21 bp, Homo sapiens
atttgtatttatattagagtg

SEQ ID NO: 4280373 - DNA, 15 bp, Homo sapiens
atttgtcactgaata

SEQ ID NO: 4280374 - DNA, 22 bp, Homo sapiens
atttgtcagtgtagatcaactc

SEQ ID NO: 4280375 - DNA, 20 bp, Homo sapiens
atttgtgagccaaagagaaa

SEQ ID NO: 4280376 - DNA, 22 bp, Homo sapiens
atttgtgagccaaagagaaaag

SEQ ID NO: 4280377 - DNA, 23 bp, Homo sapiens
atttgtgagccaaagagaaaaga

SEQ ID NO: 4280378 - DNA, 13 bp, Homo sapiens
atttgttaatata

SEQ ID NO: 4280379 - DNA, 14 bp, Homo sapiens
atttgttaatatat

SEQ ID NO: 4280380 - DNA, 15 bp, Homo sapiens
atttgttaatatata

SEQ ID NO: 4280381 - DNA, 14 bp, Homo sapiens
attttaaaaaataa

SEQ ID NO: 4280382 - DNA, 22 bp, Homo sapiens
attttaaaaaataacatattct

SEQ ID NO: 4280383 - DNA, 14 bp, Homo sapiens
attttaaatgctgt

SEQ ID NO: 4280384 - DNA, 18 bp, Homo sapiens
attttaacataggcaaga

SEQ ID NO: 4280385 - DNA, 15 bp, Homo sapiens
attttaatgtaaaat

SEQ ID NO: 4280386 - DNA, 21 bp, Homo sapiens
attttagacaaccatagaact

SEQ ID NO: 4280387 - DNA, 15 bp, Homo sapiens
attttagctaattta

SEQ ID NO: 4280388 - DNA, 18 bp, Homo sapiens
attttatagtgtgttgtg

SEQ ID NO: 4280389 - DNA, 19 bp, Homo sapiens
attttatgtgcttgaagat

SEQ ID NO: 4280390 - DNA, 18 bp, Homo sapiens
attttcaacgcagccctg

SEQ ID NO: 4280391 - DNA, 20 bp, Homo sapiens
attttcaacgcagccctgct

SEQ ID NO: 4280392 - DNA, 15 bp, Homo sapiens
attttcaagcaaata

SEQ ID NO: 4280393 - DNA, 17 bp, Homo sapiens
attttcagaaagcatct

SEQ ID NO: 4280394 - DNA, 17 bp, Homo sapiens
attttccagggcaatca

SEQ ID NO: 4280395 - DNA, 13 bp, Homo sapiens
attttcctcccca

SEQ ID NO: 4280396 - DNA, 14 bp, Homo sapiens
attttcctccccag

SEQ ID NO: 4280397 - DNA, 15 bp, Homo sapiens
attttcctccccagc

SEQ ID NO: 4280398 - DNA, 12 bp, Homo sapiens
attttcctggga

SEQ ID NO: 4280399 - DNA, 15 bp, Homo sapiens
attttcgtgcatttg

SEQ ID NO: 4280400 - DNA, 17 bp, Homo sapiens
attttctaaactgtttt

SEQ ID NO: 4280401 - DNA, 15 bp, Homo sapiens
attttctatttaaaa

SEQ ID NO: 4280402 - DNA, 23 bp, Homo sapiens
attttctcccttaggaatataca

SEQ ID NO: 4280403 - DNA, 16 bp, Homo sapiens
attttctgaattcata

SEQ ID NO: 4280404 - DNA, 17 bp, Homo sapiens
attttctgagtagcata

SEQ ID NO: 4280405 - DNA, 17 bp, Homo sapiens
attttcttcccatttgt

SEQ ID NO: 4280406 - DNA, 22 bp, Homo sapiens
attttcttcccatttgtaatgt

SEQ ID NO: 4280407 - DNA, 12 bp, Homo sapiens
attttctttcta

SEQ ID NO: 4280408 - DNA, 13 bp, Homo sapiens
attttctttctat

SEQ ID NO: 4280409 - DNA, 16 bp, Homo sapiens
attttcttttatatct

SEQ ID NO: 4280410 - DNA, 18 bp, Homo sapiens
attttcttttatatctgt

SEQ ID NO: 4280411 - DNA, 15 bp, Homo sapiens
cacctccacccgtcc

SEQ ID NO: 4280412 - DNA, 15 bp, Homo sapiens
cacctcccctccttg

SEQ ID NO: 4280413 - DNA, 18 bp, Homo sapiens
cacctctggccctgttgt

SEQ ID NO: 4280414 - DNA, 22 bp, Homo sapiens
cacctgcacaccgtccctctcc

SEQ ID NO: 4280415 - DNA, 12 bp, Homo sapiens
cacctgcaggga

SEQ ID NO: 4280416 - DNA, 13 bp, Homo sapiens
cacctgccccctt

SEQ ID NO: 4280417 - DNA, 20 bp, Homo sapiens
cacctgcccccttctcccac

SEQ ID NO: 4280418 - DNA, 21 bp, Homo sapiens
cacctgcccccttctcccaca

SEQ ID NO: 4280419 - DNA, 21 bp, Homo sapiens
cacctgcctctgaactgctgc

SEQ ID NO: 4280420 - DNA, 14 bp, Homo sapiens
cacctgcttctcag

SEQ ID NO: 4280421 - DNA, 23 bp, Homo sapiens
cacctgcttgtgttgggccccag

SEQ ID NO: 4280422 - DNA, 14 bp, Homo sapiens
cacctggcttccca

SEQ ID NO: 4280423 - DNA, 23 bp, Homo sapiens
cacctggcttcccaggaccctgg

SEQ ID NO: 4280424 - DNA, 16 bp, Homo sapiens
cacctgggagatgctg

SEQ ID NO: 4280425 - DNA, 11 bp, Homo sapiens
cacctgggcac

SEQ ID NO: 4280426 - DNA, 22 bp, Homo sapiens
cacctggggagtgggacagagt

SEQ ID NO: 4280427 - DNA, 16 bp, Homo sapiens
cacctgggtgtgctcc

SEQ ID NO: 4280428 - DNA, 17 bp, Homo sapiens
cacctgggtgtgctcca

SEQ ID NO: 4280429 - DNA, 18 bp, Homo sapiens
cacctgggtgtgctccag

SEQ ID NO: 4280430 - DNA, 13 bp, Homo sapiens
cacctgtgctgct

SEQ ID NO: 4280431 - DNA, 15 bp, Homo sapiens
cacctgtgctgctgc

SEQ ID NO: 4280432 - DNA, 15 bp, Homo sapiens
caccttccctccacc

SEQ ID NO: 4280433 - DNA, 13 bp, Homo sapiens
caccttcctgggc

SEQ ID NO: 4280434 - DNA, 14 bp, Homo sapiens
caccttcctgggca

SEQ ID NO: 4280435 - DNA, 19 bp, Homo sapiens
caccttcctgggcagccca

SEQ ID NO: 4280436 - DNA, 23 bp, Homo sapiens
caccttcctgggcagcccagaga

SEQ ID NO: 4280437 - DNA, 13 bp, Homo sapiens
caccttctgtttt

SEQ ID NO: 4280438 - DNA, 17 bp, Homo sapiens
caccttgaatctgcctg

SEQ ID NO: 4280439 - DNA, 16 bp, Homo sapiens
caccttgcaacacaca

SEQ ID NO: 4280440 - DNA, 21 bp, Homo sapiens
caccttgcaacacacagacac

SEQ ID NO: 4280441 - DNA, 20 bp, Homo sapiens
caccttggcgcgcagcccgg

SEQ ID NO: 4280442 - DNA, 16 bp, Homo sapiens
cacgcaagcctcagcc

SEQ ID NO: 4280443 - DNA, 22 bp, Homo sapiens
cacgcacacacacacacaggag

SEQ ID NO: 4280444 - DNA, 14 bp, Homo sapiens
cacgccctcctccc

SEQ ID NO: 4280445 - DNA, 13 bp, Homo sapiens
cacgcctctctca

SEQ ID NO: 4280446 - DNA, 12 bp, Homo sapiens
cacgcgctctgc

SEQ ID NO: 4280447 - DNA, 15 bp, Homo sapiens
cacgcgctctgcatg

SEQ ID NO: 4280448 - DNA, 17 bp, Homo sapiens
cacgctgtctccagacc

SEQ ID NO: 4280449 - DNA, 20 bp, Homo sapiens
cacgctgtctccagaccccc

SEQ ID NO: 4280450 - DNA, 15 bp, Homo sapiens
cacggcagccaccct

SEQ ID NO: 4280451 - DNA, 19 bp, Homo sapiens
cacggccactgcagtcacc

SEQ ID NO: 4280452 - DNA, 20 bp, Homo sapiens
cacggctctaggtggggcgg

SEQ ID NO: 4280453 - DNA, 17 bp, Homo sapiens
cacggctgcacctgcag

SEQ ID NO: 4280454 - DNA, 18 bp, Homo sapiens
cacggctgcacctgcagg

SEQ ID NO: 4280455 - DNA, 20 bp, Homo sapiens
cacggctgcacctgcaggga

SEQ ID NO: 4280456 - DNA, 18 bp, Homo sapiens
cacgtgcacacacctgca

SEQ ID NO: 4280457 - DNA, 20 bp, Homo sapiens
cacgtgcacacacctgcaca

SEQ ID NO: 4280458 - DNA, 18 bp, Homo sapiens
cacgtgctctctgctgga

SEQ ID NO: 4280459 - DNA, 15 bp, Homo sapiens
cacgtgctggagagt

SEQ ID NO: 4280460 - DNA, 18 bp, Homo sapiens
cacgtgctggagagtaga

SEQ ID NO: 4280461 - DNA, 20 bp, Homo sapiens
cacgtggaggaatgctcccc

SEQ ID NO: 4280462 - DNA, 15 bp, Homo sapiens
cacgtgtttttgtat

SEQ ID NO: 4280463 - DNA, 22 bp, Homo sapiens
cacgttttgcctcatgaacact

SEQ ID NO: 4280464 - DNA, 15 bp, Homo sapiens
cactacgcagaagag

SEQ ID NO: 4280465 - DNA, 13 bp, Homo sapiens
cactactcagcat

SEQ ID NO: 4280466 - DNA, 14 bp, Homo sapiens
cactactcagcatg

SEQ ID NO: 4280467 - DNA, 16 bp, Homo sapiens
cactaggtgcccagtc

SEQ ID NO: 4280468 - DNA, 23 bp, Homo sapiens
cactcagcatttcggtgcttccc

SEQ ID NO: 4280469 - DNA, 21 bp, Homo sapiens
cactcccaggggcctttgcag

SEQ ID NO: 4280470 - DNA, 14 bp, Homo sapiens
cactcctcccaact

SEQ ID NO: 4280471 - DNA, 16 bp, Homo sapiens
cactctaactgtatat

SEQ ID NO: 4280472 - DNA, 18 bp, Homo sapiens
cactctaactgtatattt

SEQ ID NO: 4280473 - DNA, 13 bp, Homo sapiens
cactctcctgagg

SEQ ID NO: 4280474 - DNA, 17 bp, Homo sapiens
cactctcttcttactgt

SEQ ID NO: 4280475 - DNA, 17 bp, Homo sapiens
cactctggcagcctcag

SEQ ID NO: 4280476 - DNA, 19 bp, Homo sapiens
cactctgtttgctcaccca

SEQ ID NO: 4280477 - DNA, 14 bp, Homo sapiens
cactcttcaagttt

SEQ ID NO: 4280478 - DNA, 23 bp, Homo sapiens
cactgaaataaccgtaaaggttt

SEQ ID NO: 4280479 - DNA, 14 bp, Homo sapiens
cactgaagagtatg

SEQ ID NO: 4280480 - DNA, 20 bp, Homo sapiens
cactgaaggctttcagggcc

SEQ ID NO: 4280481 - DNA, 20 bp, Homo sapiens
cactgaagtgaatacatggt

SEQ ID NO: 4280482 - DNA, 21 bp, Homo sapiens
cactgaagtgaatacatggta

SEQ ID NO: 4280483 - DNA, 18 bp, Homo sapiens
cactgatatattttccag

SEQ ID NO: 4280484 - DNA, 14 bp, Homo sapiens
cactgcaaatactt

SEQ ID NO: 4280485 - DNA, 20 bp, Homo sapiens
cactgcaacttctacctccg

SEQ ID NO: 4280486 - DNA, 15 bp, Homo sapiens
cactgcaatatcttc

SEQ ID NO: 4280487 - DNA, 18 bp, Homo sapiens
cactgcacagtgcatctc

SEQ ID NO: 4280488 - DNA, 21 bp, Homo sapiens
cactgcacagtgcatctcagc

SEQ ID NO: 4280489 - DNA, 22 bp, Homo sapiens
cactgcacagtgcatctcagcc

SEQ ID NO: 4280490 - DNA, 20 bp, Homo sapiens
cactgccttcgatacaccgg

SEQ ID NO: 4280491 - DNA, 22 bp, Homo sapiens
cactgccttcgatacaccgggc

SEQ ID NO: 4280492 - DNA, 16 bp, Homo sapiens
cactgcctttgctgcc

SEQ ID NO: 4280493 - DNA, 18 bp, Homo sapiens
cactgcctttgctgcctt

SEQ ID NO: 4280494 - DNA, 19 bp, Homo sapiens
cactgcctttgctgccttc

SEQ ID NO: 4280495 - DNA, 21 bp, Homo sapiens
cactgcctttgctgccttctg

SEQ ID NO: 4280496 - DNA, 16 bp, Homo sapiens
cactgctaggtgggcc

SEQ ID NO: 4280497 - DNA, 13 bp, Homo sapiens
cactgctggctgc

SEQ ID NO: 4280498 - DNA, 15 bp, Homo sapiens
cactgctggctgcct

SEQ ID NO: 4280499 - DNA, 16 bp, Homo sapiens
cactgctggctgcctt

SEQ ID NO: 4280500 - DNA, 21 bp, Homo sapiens
cactggccttctgatgaaatg

SEQ ID NO: 4280501 - DNA, 14 bp, Homo sapiens
cactggctcctcca

SEQ ID NO: 4280502 - DNA, 17 bp, Homo sapiens
cactggctcctccagca

SEQ ID NO: 4280503 - DNA, 13 bp, Homo sapiens
cactggtggcccg

SEQ ID NO: 4280504 - DNA, 22 bp, Homo sapiens
cactggtggcccgacagcctgg

SEQ ID NO: 4280505 - DNA, 23 bp, Homo sapiens
cactggtggcccgacagcctggc

SEQ ID NO: 4280506 - DNA, 19 bp, Homo sapiens
cactgtcccggagctcagg

SEQ ID NO: 4280507 - DNA, 12 bp, Homo sapiens
cactgtgcagcc

SEQ ID NO: 4280508 - DNA, 19 bp, Homo sapiens
cactgtgcagccggggagc

SEQ ID NO: 4280509 - DNA, 12 bp, Homo sapiens
cactgtggcctt

SEQ ID NO: 4280510 - DNA, 19 bp, Homo sapiens
cacttagaaattgcatttc

SEQ ID NO: 4280511 - DNA, 14 bp, Homo sapiens
cacttatgctgctg

SEQ ID NO: 4280512 - DNA, 15 bp, Homo sapiens
cacttatgctgctgt

SEQ ID NO: 4280513 - DNA, 21 bp, Homo sapiens
cacttcaaacatgccctcagg

SEQ ID NO: 4280514 - DNA, 23 bp, Homo sapiens
cacttcaaacatgccctcaggct

SEQ ID NO: 4280515 - DNA, 16 bp, Homo sapiens
cacttcaggctcttct

SEQ ID NO: 4280516 - DNA, 20 bp, Homo sapiens
cacttccacccccagctcct

SEQ ID NO: 4280517 - DNA, 13 bp, Homo sapiens
cacttcctgtcca

SEQ ID NO: 4280518 - DNA, 13 bp, Homo sapiens
cacttctgaccac

SEQ ID NO: 4280519 - DNA, 19 bp, Homo sapiens
cacttctgaccacacttcc

SEQ ID NO: 4280520 - DNA, 19 bp, Homo sapiens
cacttcttacaataattct

SEQ ID NO: 4280521 - DNA, 15 bp, Homo sapiens
cacttgagatgattt

SEQ ID NO: 4280522 - DNA, 20 bp, Homo sapiens
cacttgctagtgatacactg

SEQ ID NO: 4280523 - DNA, 20 bp, Homo sapiens
cactttacagttctggagga

SEQ ID NO: 4280524 - DNA, 22 bp, Homo sapiens
cactttgtttcatattctcaga

SEQ ID NO: 4280525 - DNA, 17 bp, Homo sapiens
cagaaagcatctattcc

SEQ ID NO: 4280526 - DNA, 22 bp, Homo sapiens
cagaaagcatctattcccaaag

SEQ ID NO: 4280527 - DNA, 20 bp, Homo sapiens
cagaaagggcagcccctccc

SEQ ID NO: 4280528 - DNA, 20 bp, Homo sapiens
cagaacaaacctctatatgt

SEQ ID NO: 4280529 - DNA, 15 bp, Homo sapiens
cagaacgcatgcagg

SEQ ID NO: 4280530 - DNA, 15 bp, Homo sapiens
cagaactcagcctta

SEQ ID NO: 4280531 - DNA, 13 bp, Homo sapiens
cagaactgagctc

SEQ ID NO: 4280532 - DNA, 16 bp, Homo sapiens
cagaagaagctcctga

SEQ ID NO: 4280533 - DNA, 22 bp, Homo sapiens
cagaaggaggaagggactggtc

SEQ ID NO: 4280534 - DNA, 20 bp, Homo sapiens
cagaaggccttgccttgtgt

SEQ ID NO: 4280535 - DNA, 13 bp, Homo sapiens
cagaagtggcagg

SEQ ID NO: 4280536 - DNA, 18 bp, Homo sapiens
cagaagtggcaggaggac

SEQ ID NO: 4280537 - DNA, 18 bp, Homo sapiens
cagaatcaaatctgagcc

SEQ ID NO: 4280538 - DNA, 14 bp, Homo sapiens
cagaattcattcat

SEQ ID NO: 4280539 - DNA, 18 bp, Homo sapiens
cagacacgccttcccctc

SEQ ID NO: 4280540 - DNA, 14 bp, Homo sapiens
cagacagagtggat

SEQ ID NO: 4280541 - DNA, 12 bp, Homo sapiens
cagtcctgggcc

SEQ ID NO: 4280542 - DNA, 13 bp, Homo sapiens
cagtctgctgccc

SEQ ID NO: 4280543 - DNA, 17 bp, Homo sapiens
cagtctggaggtcccag

SEQ ID NO: 4280544 - DNA, 22 bp, Homo sapiens
cagtcttgagtgggccccctct

SEQ ID NO: 4280545 - DNA, 20 bp, Homo sapiens
cagtctttgggggattcaaa

SEQ ID NO: 4280546 - DNA, 17 bp, Homo sapiens
cagtgaaaaactattaa

SEQ ID NO: 4280547 - DNA, 16 bp, Homo sapiens
cagtgaacagcttcac

SEQ ID NO: 4280548 - DNA, 16 bp, Homo sapiens
cagtgaagcccaggag

SEQ ID NO: 4280549 - DNA, 18 bp, Homo sapiens
cagtgaagcccaggagga

SEQ ID NO: 4280550 - DNA, 16 bp, Homo sapiens
cagtgaccctggagct

SEQ ID NO: 4280551 - DNA, 20 bp, Homo sapiens
cagtgaccctggagctaggg

SEQ ID NO: 4280552 - DNA, 17 bp, Homo sapiens
cagtgactccaggagag

SEQ ID NO: 4280553 - DNA, 16 bp, Homo sapiens
cagtgactgctgcgct

SEQ ID NO: 4280554 - DNA, 16 bp, Homo sapiens
cagtgagagtgaggcc

SEQ ID NO: 4280555 - DNA, 18 bp, Homo sapiens
cagtgagatgtcagacaa

SEQ ID NO: 4280556 - DNA, 16 bp, Homo sapiens
cagtgatgttgaaatt

SEQ ID NO: 4280557 - DNA, 23 bp, Homo sapiens
cagtgattgaagtatctgtacct

SEQ ID NO: 4280558 - DNA, 14 bp, Homo sapiens
cagtgcacccccta

SEQ ID NO: 4280559 - DNA, 16 bp, Homo sapiens
cagtgcagcccgtgtg

SEQ ID NO: 4280560 - DNA, 22 bp, Homo sapiens
cagtgcagcccgtgtggcccct

SEQ ID NO: 4280561 - DNA, 12 bp, Homo sapiens
cagtgcatctca

SEQ ID NO: 4280562 - DNA, 17 bp, Homo sapiens
cagtgcatctcagccca

SEQ ID NO: 4280563 - DNA, 14 bp, Homo sapiens
cagtgcttagcaaa

SEQ ID NO: 4280564 - DNA, 24 bp, Homo sapiens
cagtgcttagcaaaaaataatgac

SEQ ID NO: 4280565 - DNA, 23 bp, Homo sapiens
cagtggactttccaccccctccc

SEQ ID NO: 4280566 - DNA, 12 bp, Homo sapiens
cagtggagaggg

SEQ ID NO: 4280567 - DNA, 18 bp, Homo sapiens
cagtggagaggggacttg

SEQ ID NO: 4280568 - DNA, 16 bp, Homo sapiens
cagtggagggagactg

SEQ ID NO: 4280569 - DNA, 17 bp, Homo sapiens
cagtggagggagactga

SEQ ID NO: 4280570 - DNA, 21 bp, Homo sapiens
cagtggagggagactgaccca

SEQ ID NO: 4280571 - DNA, 17 bp, Homo sapiens
cagtggcaaaggatcca

SEQ ID NO: 4280572 - DNA, 13 bp, Homo sapiens
cagtggctctcca

SEQ ID NO: 4280573 - DNA, 18 bp, Homo sapiens
cagtggcttggagcagag

SEQ ID NO: 4280574 - DNA, 21 bp, Homo sapiens
cagtggcttggagcagaggtg

SEQ ID NO: 4280575 - DNA, 16 bp, Homo sapiens
cagtgggacagggcat

SEQ ID NO: 4280576 - DNA, 19 bp, Homo sapiens
cagtgggacagggcatggc

SEQ ID NO: 4280577 - DNA, 12 bp, Homo sapiens
cagtgggaggcg

SEQ ID NO: 4280578 - DNA, 20 bp, Homo sapiens
cagtgtagattttatagtgt

SEQ ID NO: 4280579 - DNA, 17 bp, Homo sapiens
cagtgtattttctgtgt

SEQ ID NO: 4280580 - DNA, 17 bp, Homo sapiens
cagtgtccccaggggca

SEQ ID NO: 4280581 - DNA, 13 bp, Homo sapiens
cagtgtgagggtg

SEQ ID NO: 4280582 - DNA, 14 bp, Homo sapiens
cagtgtgagggtgc

SEQ ID NO: 4280583 - DNA, 15 bp, Homo sapiens
cagtgtgccaccctc

SEQ ID NO: 4280584 - DNA, 16 bp, Homo sapiens
cagtgtgccaccctct

SEQ ID NO: 4280585 - DNA, 21 bp, Homo sapiens
cagtgtgccaccctctgcagg

SEQ ID NO: 4280586 - DNA, 19 bp, Homo sapiens
cagtgtggactctggactg

SEQ ID NO: 4280587 - DNA, 19 bp, Homo sapiens
cagtgttgcctcctcccat

SEQ ID NO: 4280588 - DNA, 19 bp, Homo sapiens
cagtgtttccagtgacaca

SEQ ID NO: 4280589 - DNA, 12 bp, Homo sapiens
cagttcaatcaa

SEQ ID NO: 4280590 - DNA, 17 bp, Homo sapiens
cagttcaatcaaacttt

SEQ ID NO: 4280591 - DNA, 21 bp, Homo sapiens
cagttccaatgtgcccagtca

SEQ ID NO: 4280592 - DNA, 14 bp, Homo sapiens
cagttctctttgta

SEQ ID NO: 4280593 - DNA, 20 bp, Homo sapiens
cagttgcaataaactcagtc

SEQ ID NO: 4280594 - DNA, 15 bp, Homo sapiens
cagttgcacagcatc

SEQ ID NO: 4280595 - DNA, 18 bp, Homo sapiens
cagttgcacagcatctca

SEQ ID NO: 4280596 - DNA, 16 bp, Homo sapiens
cagttggactgtggcc

SEQ ID NO: 4280597 - DNA, 22 bp, Homo sapiens
cagttggactgtggcctcagga

SEQ ID NO: 4280598 - DNA, 16 bp, Homo sapiens
cagttggcctcagcag

SEQ ID NO: 4280599 - DNA, 18 bp, Homo sapiens
cagttggcctcagcagaa

SEQ ID NO: 4280600 - DNA, 14 bp, Homo sapiens
cagttggtgatttt

SEQ ID NO: 4280601 - DNA, 17 bp, Homo sapiens
cagttggtgattttaga

SEQ ID NO: 4280602 - DNA, 23 bp, Homo sapiens
cagttggtgattttagatttctt

SEQ ID NO: 4280603 - DNA, 18 bp, Homo sapiens
cagttggttttgcatgtc

SEQ ID NO: 4280604 - DNA, 19 bp, Homo sapiens
cagttgttatattcattct

SEQ ID NO: 4280605 - DNA, 14 bp, Homo sapiens
cagtttctaaaatt

SEQ ID NO: 4280606 - DNA, 12 bp, Homo sapiens
cagtttgctttg

SEQ ID NO: 4280607 - DNA, 20 bp, Homo sapiens
cataaaaggtgacccttctg

SEQ ID NO: 4280608 - DNA, 15 bp, Homo sapiens
cataaaataaataat

SEQ ID NO: 4280609 - DNA, 17 bp, Homo sapiens
cataaagtgagaaaact

SEQ ID NO: 4280610 - DNA, 14 bp, Homo sapiens
cataaattatttct

SEQ ID NO: 4280611 - DNA, 18 bp, Homo sapiens
cataaattatttctaaaa

SEQ ID NO: 4280612 - DNA, 13 bp, Homo sapiens
cataagcctcagg

SEQ ID NO: 4280613 - DNA, 16 bp, Homo sapiens
cataagcctcaggcct

SEQ ID NO: 4280614 - DNA, 17 bp, Homo sapiens
cataagcctcaggcctg

SEQ ID NO: 4280615 - DNA, 21 bp, Homo sapiens
cataagggacatgtctttggc

SEQ ID NO: 4280616 - DNA, 16 bp, Homo sapiens
cataagtggacccagc

SEQ ID NO: 4280617 - DNA, 17 bp, Homo sapiens
cataatatcttgaagaa

SEQ ID NO: 4280618 - DNA, 19 bp, Homo sapiens
cataatatcttgaagaata

SEQ ID NO: 4280619 - DNA, 21 bp, Homo sapiens
cataatatcttgaagaatatt

SEQ ID NO: 4280620 - DNA, 17 bp, Homo sapiens
cataattaaattttaat

SEQ ID NO: 4280621 - DNA, 18 bp, Homo sapiens
cataattaaattttaatg

SEQ ID NO: 4280622 - DNA, 18 bp, Homo sapiens
cataattagatccattaa

SEQ ID NO: 4280623 - DNA, 13 bp, Homo sapiens
cataattgcaagg

SEQ ID NO: 4280624 - DNA, 20 bp, Homo sapiens
catacacctatgtcatttca

SEQ ID NO: 4280625 - DNA, 18 bp, Homo sapiens
catacattcttcaagatc

SEQ ID NO: 4280626 - DNA, 21 bp, Homo sapiens
catacattcttcaagatccca

SEQ ID NO: 4280627 - DNA, 19 bp, Homo sapiens
cataccaggggttccccag

SEQ ID NO: 4280628 - DNA, 21 bp, Homo sapiens
cataccaggggttccccagga

SEQ ID NO: 4280629 - DNA, 16 bp, Homo sapiens
cataccccctgcccca

SEQ ID NO: 4280630 - DNA, 12 bp, Homo sapiens
catagatgcctg

SEQ ID NO: 4280631 - DNA, 15 bp, Homo sapiens
catagcatcctgatt

SEQ ID NO: 4280632 - DNA, 18 bp, Homo sapiens
catagtcaatcaaacagg

SEQ ID NO: 4280633 - DNA, 17 bp, Homo sapiens
catatacagctcagaag

SEQ ID NO: 4280634 - DNA, 21 bp, Homo sapiens
catatatggggggccaacacc

SEQ ID NO: 4280635 - DNA, 22 bp, Homo sapiens
catatatggggggccaacacca

SEQ ID NO: 4280636 - DNA, 15 bp, Homo sapiens
catatcccgggagca

SEQ ID NO: 4280637 - DNA, 20 bp, Homo sapiens
catatcctggtgtctagttt

SEQ ID NO: 4280638 - DNA, 18 bp, Homo sapiens
catatgacaatttcaaaa

SEQ ID NO: 4280639 - DNA, 17 bp, Homo sapiens
catatgattgaaaagaa

SEQ ID NO: 4280640 - DNA, 21 bp, Homo sapiens
catatgattgaaaagaagaaa

SEQ ID NO: 4280641 - DNA, 22 bp, Homo sapiens
catatgattgaaaagaagaaag

SEQ ID NO: 4280642 - DNA, 14 bp, Homo sapiens
catattatatcaga

SEQ ID NO: 4280643 - DNA, 12 bp, Homo sapiens
catattcttgct

SEQ ID NO: 4280644 - DNA, 22 bp, Homo sapiens
catattgagatcagcattcaaa

SEQ ID NO: 4280645 - DNA, 16 bp, Homo sapiens
catatttacctgtgaa

SEQ ID NO: 4280646 - DNA, 21 bp, Homo sapiens
catcaaatgaataatgccttt

SEQ ID NO: 4280647 - DNA, 16 bp, Homo sapiens
catcaacaaagaaata

SEQ ID NO: 4280648 - DNA, 13 bp, Homo sapiens
catcagcccctgc

SEQ ID NO: 4280649 - DNA, 17 bp, Homo sapiens
catcagcccctgctgct

SEQ ID NO: 4280650 - DNA, 16 bp, Homo sapiens
catcagtggcatggct

SEQ ID NO: 4280651 - DNA, 22 bp, Homo sapiens
catcagtggcatggctccagtc

SEQ ID NO: 4280652 - DNA, 15 bp, Homo sapiens
catcatgtctattgt

SEQ ID NO: 4280653 - DNA, 22 bp, Homo sapiens
catccaaggaagggatgtattt

SEQ ID NO: 4280654 - DNA, 13 bp, Homo sapiens
catcccagtggcc

SEQ ID NO: 4280655 - DNA, 11 bp, Homo sapiens
catccccctcc

SEQ ID NO: 4280656 - DNA, 16 bp, Homo sapiens
catcccctcctagcac

SEQ ID NO: 4280657 - DNA, 16 bp, Homo sapiens
catcccggggccatgg

SEQ ID NO: 4280658 - DNA, 22 bp, Homo sapiens
catcccggggccatggaagctg

SEQ ID NO: 4280659 - DNA, 13 bp, Homo sapiens
catccctggtgaa

SEQ ID NO: 4280660 - DNA, 19 bp, Homo sapiens
catccctggtgaaagagta

SEQ ID NO: 4280661 - DNA, 19 bp, Homo sapiens
catcccttggcccctctct

SEQ ID NO: 4280662 - DNA, 19 bp, Homo sapiens
catccctttctaagcagga

SEQ ID NO: 4280663 - DNA, 11 bp, Homo sapiens
catcctcagca

SEQ ID NO: 4280664 - DNA, 13 bp, Homo sapiens
catcctcagcaag

SEQ ID NO: 4280665 - DNA, 13 bp, Homo sapiens
catcctcagcccc

SEQ ID NO: 4280666 - DNA, 14 bp, Homo sapiens
catcctcagcccca

SEQ ID NO: 4280667 - DNA, 17 bp, Homo sapiens
catcctcagccccaggg

SEQ ID NO: 4280668 - DNA, 20 bp, Homo sapiens
catcctcagccccagggccc

SEQ ID NO: 4280669 - DNA, 22 bp, Homo sapiens
catcctcagccccagggccctg

SEQ ID NO: 4280670 - DNA, 12 bp, Homo sapiens
catcctcccctt

SEQ ID NO: 4280671 - DNA, 15 bp, Homo sapiens
catcctccccttccc

SEQ ID NO: 4280672 - DNA, 23 bp, Homo sapiens
ccagatggctccctgggctggca

SEQ ID NO: 4280673 - DNA, 16 bp, Homo sapiens
ccagatttttacacat

SEQ ID NO: 4280674 - DNA, 17 bp, Homo sapiens
ccagcaaccctcctatc

SEQ ID NO: 4280675 - DNA, 23 bp, Homo sapiens
ccagcagcacaattctgtccctg

SEQ ID NO: 4280676 - DNA, 15 bp, Homo sapiens
ccagcagcggcccag

SEQ ID NO: 4280677 - DNA, 17 bp, Homo sapiens
ccagcagcggcccagat

SEQ ID NO: 4280678 - DNA, 16 bp, Homo sapiens
ccagcagggcgggcca

SEQ ID NO: 4280679 - DNA, 21 bp, Homo sapiens
ccagcagggcgggccaggaga

SEQ ID NO: 4280680 - DNA, 14 bp, Homo sapiens
ccagcaggggcaga

SEQ ID NO: 4280681 - DNA, 18 bp, Homo sapiens
ccagcaggttctctcctg

SEQ ID NO: 4280682 - DNA, 16 bp, Homo sapiens
ccagcagtcctgggcc

SEQ ID NO: 4280683 - DNA, 18 bp, Homo sapiens
ccagccaacccctgtgga

SEQ ID NO: 4280684 - DNA, 17 bp, Homo sapiens
ccagccaccaaggctgc

SEQ ID NO: 4280685 - DNA, 18 bp, Homo sapiens
ccagccaccaaggctgcc

SEQ ID NO: 4280686 - DNA, 21 bp, Homo sapiens
ccagccaccaaggctgcctgc

SEQ ID NO: 4280687 - DNA, 20 bp, Homo sapiens
ccagccacccggatctccag

SEQ ID NO: 4280688 - DNA, 23 bp, Homo sapiens
ccagccacccggatctccaggcc

SEQ ID NO: 4280689 - DNA, 16 bp, Homo sapiens
ccagccagcaggttct

SEQ ID NO: 4280690 - DNA, 12 bp, Homo sapiens
ccagcccagggt

SEQ ID NO: 4280691 - DNA, 17 bp, Homo sapiens
ccagccccctggcccct

SEQ ID NO: 4280692 - DNA, 14 bp, Homo sapiens
ccagcccctcccac

SEQ ID NO: 4280693 - DNA, 21 bp, Homo sapiens
ccagcccctcccaccacagca

SEQ ID NO: 4280694 - DNA, 20 bp, Homo sapiens
ccagccctctcactgtgtcc

SEQ ID NO: 4280695 - DNA, 15 bp, Homo sapiens
ccagccctggtggcc

SEQ ID NO: 4280696 - DNA, 12 bp, Homo sapiens
ccagcctggccc

SEQ ID NO: 4280697 - DNA, 19 bp, Homo sapiens
ccagcctgtggcctcagca

SEQ ID NO: 4280698 - DNA, 20 bp, Homo sapiens
ccagcctgtggcctcagcat

SEQ ID NO: 4280699 - DNA, 13 bp, Homo sapiens
ccagctccaggca

SEQ ID NO: 4280700 - DNA, 11 bp, Homo sapiens
ccagctcccag

SEQ ID NO: 4280701 - DNA, 12 bp, Homo sapiens
ccagctcccagc

SEQ ID NO: 4280702 - DNA, 14 bp, Homo sapiens
ccagctccttagac

SEQ ID NO: 4280703 - DNA, 21 bp, Homo sapiens
ccagctctagacaaccctgca

SEQ ID NO: 4280704 - DNA, 13 bp, Homo sapiens
ccagctctcccct

SEQ ID NO: 4280705 - DNA, 17 bp, Homo sapiens
ccagctctcccctgcgc

SEQ ID NO: 4280706 - DNA, 22 bp, Homo sapiens
ccagctctcccctgcgcaggcc

SEQ ID NO: 4280707 - DNA, 20 bp, Homo sapiens
ccagctgctcctcgcagttc

SEQ ID NO: 4280708 - DNA, 14 bp, Homo sapiens
ccagctgcttctgc

SEQ ID NO: 4280709 - DNA, 17 bp, Homo sapiens
ccagctgcttctgccca

SEQ ID NO: 4280710 - DNA, 22 bp, Homo sapiens
ccagctgtgcgagaacacaagc

SEQ ID NO: 4280711 - DNA, 21 bp, Homo sapiens
ccaggaagaaggcccgggagg

SEQ ID NO: 4280712 - DNA, 22 bp, Homo sapiens
ccaggaaggaagagcaagctgt

SEQ ID NO: 4280713 - DNA, 21 bp, Homo sapiens
ccaggaagtcatcctgcaatg

SEQ ID NO: 4280714 - DNA, 15 bp, Homo sapiens
ccaggacactgcctt

SEQ ID NO: 4280715 - DNA, 16 bp, Homo sapiens
ccaggacactgccttt

SEQ ID NO: 4280716 - DNA, 21 bp, Homo sapiens
ccaggacactgcctttgctgc

SEQ ID NO: 4280717 - DNA, 23 bp, Homo sapiens
ccaggaccctgggtcaccttcct

SEQ ID NO: 4280718 - DNA, 20 bp, Homo sapiens
ccaggacgcagggagaccct

SEQ ID NO: 4280719 - DNA, 21 bp, Homo sapiens
ccaggacgcagggagaccctg

SEQ ID NO: 4280720 - DNA, 16 bp, Homo sapiens
ccaggacgcatgcagg

SEQ ID NO: 4280721 - DNA, 17 bp, Homo sapiens
ccaggacgcatgcaggg

SEQ ID NO: 4280722 - DNA, 18 bp, Homo sapiens
ccaggactctgccttcca

SEQ ID NO: 4280723 - DNA, 22 bp, Homo sapiens
ccaggagaaagaaggcttaaca

SEQ ID NO: 4280724 - DNA, 20 bp, Homo sapiens
ccaggagagaccttctctta

SEQ ID NO: 4280725 - DNA, 14 bp, Homo sapiens
ccaggagccaggtg

SEQ ID NO: 4280726 - DNA, 14 bp, Homo sapiens
ccaggaggacctgg

SEQ ID NO: 4280727 - DNA, 18 bp, Homo sapiens
ccaggagtgggtgggaca

SEQ ID NO: 4280728 - DNA, 17 bp, Homo sapiens
ccaggatgcatgcaggg

SEQ ID NO: 4280729 - DNA, 15 bp, Homo sapiens
ccaggatggtcccag

SEQ ID NO: 4280730 - DNA, 16 bp, Homo sapiens
ccaggattgtccacaa

SEQ ID NO: 4280731 - DNA, 21 bp, Homo sapiens
ccaggattgtccacaaatgtc

SEQ ID NO: 4280732 - DNA, 19 bp, Homo sapiens
ccaggcaatggcctaaact

SEQ ID NO: 4280733 - DNA, 14 bp, Homo sapiens
ccaggcaggctgtg

SEQ ID NO: 4280734 - DNA, 13 bp, Homo sapiens
ccaggcagggagg

SEQ ID NO: 4280735 - DNA, 15 bp, Homo sapiens
ccaggcagggaggga

SEQ ID NO: 4280736 - DNA, 15 bp, Homo sapiens
ccaggcatgaccctg

SEQ ID NO: 4280737 - DNA, 16 bp, Homo sapiens
ccaggcatgaccctgg

SEQ ID NO: 4280738 - DNA, 16 bp, Homo sapiens
ccaggccaggcctcat

SEQ ID NO: 4280739 - DNA, 22 bp, Homo sapiens
ccaggccatccggcccccagag

SEQ ID NO: 4280740 - DNA, 13 bp, Homo sapiens
ccaggcccagcct

SEQ ID NO: 4280741 - DNA, 16 bp, Homo sapiens
ccaggcccagcctggc

SEQ ID NO: 4280742 - DNA, 17 bp, Homo sapiens
ccaggccccaggctgga

SEQ ID NO: 4280743 - DNA, 21 bp, Homo sapiens
ccaggccccaggctggatgct

SEQ ID NO: 4280744 - DNA, 13 bp, Homo sapiens
ccaggcctcccgc

SEQ ID NO: 4280745 - DNA, 14 bp, Homo sapiens
ccaggcctcccgca

SEQ ID NO: 4280746 - DNA, 16 bp, Homo sapiens
ccaggcctcccgcatg

SEQ ID NO: 4280747 - DNA, 21 bp, Homo sapiens
ccaggcctcccgcatgctgcc

SEQ ID NO: 4280748 - DNA, 18 bp, Homo sapiens
ccaggcgccccttccccc

SEQ ID NO: 4280749 - DNA, 18 bp, Homo sapiens
ccaggcgtagggccaggg

SEQ ID NO: 4280750 - DNA, 20 bp, Homo sapiens
ccaggcgtagggccagggct

SEQ ID NO: 4280751 - DNA, 18 bp, Homo sapiens
ccaggctggatgctgggt

SEQ ID NO: 4280752 - DNA, 16 bp, Homo sapiens
ccaggcttcctgccct

SEQ ID NO: 4280753 - DNA, 16 bp, Homo sapiens
ccagggaatcagggag

SEQ ID NO: 4280754 - DNA, 17 bp, Homo sapiens
ccagggaatcagggagc

SEQ ID NO: 4280755 - DNA, 14 bp, Homo sapiens
ccagggagaggcca

SEQ ID NO: 4280756 - DNA, 16 bp, Homo sapiens
ccagggccctgctcag

SEQ ID NO: 4280757 - DNA, 18 bp, Homo sapiens
ccagggccctgctcaggc

SEQ ID NO: 4280758 - DNA, 12 bp, Homo sapiens
ccagggctctgg

SEQ ID NO: 4280759 - DNA, 17 bp, Homo sapiens
ccagggctgtccttaga

SEQ ID NO: 4280760 - DNA, 19 bp, Homo sapiens
ccagggggaagcaccagcc

SEQ ID NO: 4280761 - DNA, 21 bp, Homo sapiens
ccagggggaagcaccagcctc

SEQ ID NO: 4280762 - DNA, 17 bp, Homo sapiens
ccaggggtgagccccgc

SEQ ID NO: 4280763 - DNA, 21 bp, Homo sapiens
ccagggtggtcttcaagcctg

SEQ ID NO: 4280764 - DNA, 23 bp, Homo sapiens
ccagggtggtcttcaagcctggc

SEQ ID NO: 4280765 - DNA, 16 bp, Homo sapiens
ccagggttccagacag

SEQ ID NO: 4280766 - DNA, 22 bp, Homo sapiens
ccagggttccagacagggtggg

SEQ ID NO: 4280767 - DNA, 22 bp, Homo sapiens
ccagggttcccccagccctgtg

SEQ ID NO: 4280768 - DNA, 19 bp, Homo sapiens
ccagtccccgggaaaggcc

SEQ ID NO: 4280769 - DNA, 13 bp, Homo sapiens
ccagtccctctga

SEQ ID NO: 4280770 - DNA, 14 bp, Homo sapiens
ccagtccctctgag

SEQ ID NO: 4280771 - DNA, 18 bp, Homo sapiens
ccagtctgctgccctcca

SEQ ID NO: 4280772 - DNA, 22 bp, Homo sapiens
ccagtcttgagtgggccccctc

SEQ ID NO: 4280773 - DNA, 16 bp, Homo sapiens
ccagtgactccaggag

SEQ ID NO: 4280774 - DNA, 15 bp, Homo sapiens
ccagtgactgctgcg

SEQ ID NO: 4280775 - DNA, 16 bp, Homo sapiens
ccagtgagagtgaggc

SEQ ID NO: 4280776 - DNA, 14 bp, Homo sapiens
ccagtgtccccagg

SEQ ID NO: 4280777 - DNA, 17 bp, Homo sapiens
ccagtgtccccaggggc

SEQ ID NO: 4280778 - DNA, 21 bp, Homo sapiens
ccagtgtggactctggactgg

SEQ ID NO: 4280779 - DNA, 23 bp, Homo sapiens
ccagtgtggactctggactggga

SEQ ID NO: 4280780 - DNA, 13 bp, Homo sapiens
ccagttctgatga

SEQ ID NO: 4280781 - DNA, 16 bp, Homo sapiens
ccagttggactgtggc

SEQ ID NO: 4280782 - DNA, 20 bp, Homo sapiens
ccagttggactgtggcctca

SEQ ID NO: 4280783 - DNA, 14 bp, Homo sapiens
ccataaaataaata

SEQ ID NO: 4280784 - DNA, 16 bp, Homo sapiens
ccataccccctgcccc

SEQ ID NO: 4280785 - DNA, 21 bp, Homo sapiens
ccataccccctgccccagaga

SEQ ID NO: 4280786 - DNA, 23 bp, Homo sapiens
ccatatgacaatttcaaaatgca

SEQ ID NO: 4280787 - DNA, 17 bp, Homo sapiens
ccatatgattgaaaaga

SEQ ID NO: 4280788 - DNA, 15 bp, Homo sapiens
ccatcaaaaatattc

SEQ ID NO: 4280789 - DNA, 14 bp, Homo sapiens
ccatcagcagtgat

SEQ ID NO: 4280790 - DNA, 15 bp, Homo sapiens
ccatcagcagtgatt

SEQ ID NO: 4280791 - DNA, 16 bp, Homo sapiens
ccatcagcccctgctg

SEQ ID NO: 4280792 - DNA, 17 bp, Homo sapiens
ccatcccgacatggacc

SEQ ID NO: 4280793 - DNA, 14 bp, Homo sapiens
ccatccctggtgaa

SEQ ID NO: 4280794 - DNA, 13 bp, Homo sapiens
ccatcctcccctt

SEQ ID NO: 4280795 - DNA, 14 bp, Homo sapiens
ccatcctccccttc

SEQ ID NO: 4280796 - DNA, 22 bp, Homo sapiens
ccatcctgtacaagtgctcagt

SEQ ID NO: 4280797 - DNA, 14 bp, Homo sapiens
ccatctaaaatact

SEQ ID NO: 4280798 - DNA, 18 bp, Homo sapiens
ccatctcaggccacctgc

SEQ ID NO: 4280799 - DNA, 22 bp, Homo sapiens
ccatctcaggccacctgccccc

SEQ ID NO: 4280800 - DNA, 14 bp, Homo sapiens
ccatctccctccca

SEQ ID NO: 4280801 - DNA, 22 bp, Homo sapiens
ccatctgcgacaccaccaacag

SEQ ID NO: 4280802 - DNA, 14 bp, Homo sapiens
ccctgcatcccttg

SEQ ID NO: 4280803 - DNA, 17 bp, Homo sapiens
ccctgccaactttccag

SEQ ID NO: 4280804 - DNA, 18 bp, Homo sapiens
ccctgccagaggcctggt

SEQ ID NO: 4280805 - DNA, 15 bp, Homo sapiens
ccctgccatggaggc

SEQ ID NO: 4280806 - DNA, 12 bp, Homo sapiens
ccctgccccaca

SEQ ID NO: 4280807 - DNA, 19 bp, Homo sapiens
ccctgccccacacaggcct

SEQ ID NO: 4280808 - DNA, 20 bp, Homo sapiens
ccctgccccacacaggcctg

SEQ ID NO: 4280809 - DNA, 22 bp, Homo sapiens
ccctgccccacacaggcctggc

SEQ ID NO: 4280810 - DNA, 21 bp, Homo sapiens
ccctgccccagagaagcctca

SEQ ID NO: 4280811 - DNA, 23 bp, Homo sapiens
ccctgccccccacattctggctc

SEQ ID NO: 4280812 - DNA, 16 bp, Homo sapiens
ccctgccccgcccccc

SEQ ID NO: 4280813 - DNA, 21 bp, Homo sapiens
ccctgccccgccccccagagc

SEQ ID NO: 4280814 - DNA, 23 bp, Homo sapiens
ccctgcccctcccttcaaccatt

SEQ ID NO: 4280815 - DNA, 13 bp, Homo sapiens
ccctgcccctgcc

SEQ ID NO: 4280816 - DNA, 18 bp, Homo sapiens
ccctgcccctgccccgtc

SEQ ID NO: 4280817 - DNA, 19 bp, Homo sapiens
ccctgcccctgccccgtca

SEQ ID NO: 4280818 - DNA, 13 bp, Homo sapiens
ccctgcgcaggcc

SEQ ID NO: 4280819 - DNA, 23 bp, Homo sapiens
ccctgcgccctccctccctccac

SEQ ID NO: 4280820 - DNA, 14 bp, Homo sapiens
ccctgctcaggcct

SEQ ID NO: 4280821 - DNA, 21 bp, Homo sapiens
ccctgctcccggctctgaggc

SEQ ID NO: 4280822 - DNA, 14 bp, Homo sapiens
ccctgctccctgct

SEQ ID NO: 4280823 - DNA, 17 bp, Homo sapiens
ccctgctccctgctccc

SEQ ID NO: 4280824 - DNA, 11 bp, Homo sapiens
ccctgctgcct

SEQ ID NO: 4280825 - DNA, 23 bp, Homo sapiens
ccctgctgggtgggaatgcgctc

SEQ ID NO: 4280826 - DNA, 13 bp, Homo sapiens
ccctgctggtgcc

SEQ ID NO: 4280827 - DNA, 19 bp, Homo sapiens
ccctgctggtgcccaccct

SEQ ID NO: 4280828 - DNA, 18 bp, Homo sapiens
ccctgctttgggctgccc

SEQ ID NO: 4280829 - DNA, 19 bp, Homo sapiens
ccctgctttgggctgccct

SEQ ID NO: 4280830 - DNA, 22 bp, Homo sapiens
ccctgctttgggctgccctggt

SEQ ID NO: 4280831 - DNA, 21 bp, Homo sapiens
ccctggcccctcccacatccc

SEQ ID NO: 4280832 - DNA, 10 bp, Homo sapiens
ccctggctct

SEQ ID NO: 4280833 - DNA, 22 bp, Homo sapiens
ccctggcttttcactgctggct

SEQ ID NO: 4280834 - DNA, 13 bp, Homo sapiens
ccctgggagagtg

SEQ ID NO: 4280835 - DNA, 22 bp, Homo sapiens
ccctgggctggcatggggaggg

SEQ ID NO: 4280836 - DNA, 23 bp, Homo sapiens
ccctggggtttccacacaggccc

SEQ ID NO: 4280837 - DNA, 18 bp, Homo sapiens
ccctgggtcaccttcctg

SEQ ID NO: 4280838 - DNA, 20 bp, Homo sapiens
ccctgggtcaccttcctggg

SEQ ID NO: 4280839 - DNA, 23 bp, Homo sapiens
ccctgggtcaccttcctgggcag

SEQ ID NO: 4280840 - DNA, 13 bp, Homo sapiens
ccctggtctggct

SEQ ID NO: 4280841 - DNA, 23 bp, Homo sapiens
ccctggtgcctgcaggccaccca

SEQ ID NO: 4280842 - DNA, 21 bp, Homo sapiens
ccctggtgctgccacacttca

SEQ ID NO: 4280843 - DNA, 20 bp, Homo sapiens
ccctggtggccaagcctgcc

SEQ ID NO: 4280844 - DNA, 16 bp, Homo sapiens
ccctggtgtccctgcc

SEQ ID NO: 4280845 - DNA, 20 bp, Homo sapiens
ccctggtgtccctgcctggc

SEQ ID NO: 4280846 - DNA, 17 bp, Homo sapiens
ccctggttcccccagga

SEQ ID NO: 4280847 - DNA, 18 bp, Homo sapiens
ccctggttcccccaggac

SEQ ID NO: 4280848 - DNA, 19 bp, Homo sapiens
ccctggttcccccaggacc

SEQ ID NO: 4280849 - DNA, 21 bp, Homo sapiens
ccctggttctccatccccatg

SEQ ID NO: 4280850 - DNA, 17 bp, Homo sapiens
ccctgtcagtgcagccc

SEQ ID NO: 4280851 - DNA, 21 bp, Homo sapiens
ccctgtcagtgcagcccgtgt

SEQ ID NO: 4280852 - DNA, 18 bp, Homo sapiens
ccctgtccctgccccgcc

SEQ ID NO: 4280853 - DNA, 18 bp, Homo sapiens
ccctgtccttcccacggc

SEQ ID NO: 4280854 - DNA, 22 bp, Homo sapiens
ccctgtccttcccacggccact

SEQ ID NO: 4280855 - DNA, 14 bp, Homo sapiens
ccctgtggaaggga

SEQ ID NO: 4280856 - DNA, 13 bp, Homo sapiens
ccctgttcactct

SEQ ID NO: 4280857 - DNA, 22 bp, Homo sapiens
ccctgttcactctacttagcat

SEQ ID NO: 4280858 - DNA, 20 bp, Homo sapiens
cccttaaacagttgcacagc

SEQ ID NO: 4280859 - DNA, 23 bp, Homo sapiens
cccttcaaggaagtgataacact

SEQ ID NO: 4280860 - DNA, 17 bp, Homo sapiens
cccttcacttctgacca

SEQ ID NO: 4280861 - DNA, 22 bp, Homo sapiens
cccttcacttctgaccacactt

SEQ ID NO: 4280862 - DNA, 11 bp, Homo sapiens
cccttcccaac

SEQ ID NO: 4280863 - DNA, 12 bp, Homo sapiens
cccttccccact

SEQ ID NO: 4280864 - DNA, 14 bp, Homo sapiens
cccttccccactcc

SEQ ID NO: 4280865 - DNA, 20 bp, Homo sapiens
cccttcccctgcgccctccc

SEQ ID NO: 4280866 - DNA, 16 bp, Homo sapiens
cccttccctgacactg

SEQ ID NO: 4280867 - DNA, 13 bp, Homo sapiens
cccttcctctcca

SEQ ID NO: 4280868 - DNA, 14 bp, Homo sapiens
cccttggcccctct

SEQ ID NO: 4280869 - DNA, 23 bp, Homo sapiens
ccctttcacccctcttcccacca

SEQ ID NO: 4280870 - DNA, 14 bp, Homo sapiens
ccctttctaagcag

SEQ ID NO: 4280871 - DNA, 14 bp, Homo sapiens
cccttttggccccc

SEQ ID NO: 4280872 - DNA, 20 bp, Homo sapiens
cccttttggcccccgagctg

SEQ ID NO: 4280873 - DNA, 18 bp, Homo sapiens
ccctttttactccccttg

SEQ ID NO: 4280874 - DNA, 23 bp, Homo sapiens
ccctttttactccccttgagctg

SEQ ID NO: 4280875 - DNA, 14 bp, Homo sapiens
ccgacagcctggca

SEQ ID NO: 4280876 - DNA, 15 bp, Homo sapiens
ccgagccccctgtcc

SEQ ID NO: 4280877 - DNA, 17 bp, Homo sapiens
ccgagccgagctctcct

SEQ ID NO: 4280878 - DNA, 17 bp, Homo sapiens
ccgagctctcctgggcc

SEQ ID NO: 4280879 - DNA, 16 bp, Homo sapiens
ccgagctgggggccat

SEQ ID NO: 4280880 - DNA, 21 bp, Homo sapiens
ccgagctgggggccatgagct

SEQ ID NO: 4280881 - DNA, 15 bp, Homo sapiens
ccgaggcagcaacag

SEQ ID NO: 4280882 - DNA, 22 bp, Homo sapiens
ccgaggcagcaacaggaccagg

SEQ ID NO: 4280883 - DNA, 23 bp, Homo sapiens
ccgaggcagcaacaggaccagga

SEQ ID NO: 4280884 - DNA, 14 bp, Homo sapiens
ccgaggctggagct

SEQ ID NO: 4280885 - DNA, 14 bp, Homo sapiens
ccgagggtcccaag

SEQ ID NO: 4280886 - DNA, 14 bp, Homo sapiens
ccgagtctcttctc

SEQ ID NO: 4280887 - DNA, 16 bp, Homo sapiens
ccgagtctcttctcca

SEQ ID NO: 4280888 - DNA, 13 bp, Homo sapiens
ccgatccacattg

SEQ ID NO: 4280889 - DNA, 14 bp, Homo sapiens
ccgatgctccagcc

SEQ ID NO: 4280890 - DNA, 22 bp, Homo sapiens
ccgcaaatccataccccctgcc

SEQ ID NO: 4280891 - DNA, 16 bp, Homo sapiens
ccgcacccccaccctt

SEQ ID NO: 4280892 - DNA, 18 bp, Homo sapiens
ccgcacgcaagcctcagc

SEQ ID NO: 4280893 - DNA, 19 bp, Homo sapiens
ccgcacgcaagcctcagcc

SEQ ID NO: 4280894 - DNA, 16 bp, Homo sapiens
ccgcatgctgcctgcc

SEQ ID NO: 4280895 - DNA, 12 bp, Homo sapiens
ccgcccacctgg

SEQ ID NO: 4280896 - DNA, 16 bp, Homo sapiens
ccgccccccagagcca

SEQ ID NO: 4280897 - DNA, 17 bp, Homo sapiens
ccgccccccagagccag

SEQ ID NO: 4280898 - DNA, 18 bp, Homo sapiens
ccgccccccagagccagg

SEQ ID NO: 4280899 - DNA, 21 bp, Homo sapiens
ccgccctccccctgccagagg

SEQ ID NO: 4280900 - DNA, 16 bp, Homo sapiens
ccgccctgggctctgg

SEQ ID NO: 4280901 - DNA, 22 bp, Homo sapiens
ccgccgtgtctgtggccctctc

SEQ ID NO: 4280902 - DNA, 14 bp, Homo sapiens
ccgcctctgggctc

SEQ ID NO: 4280903 - DNA, 12 bp, Homo sapiens
ccgcctgtcctt

SEQ ID NO: 4280904 - DNA, 13 bp, Homo sapiens
ccgcctgtccttg

SEQ ID NO: 4280905 - DNA, 15 bp, Homo sapiens
ccgcctgtccttggt

SEQ ID NO: 4280906 - DNA, 18 bp, Homo sapiens
ccgcgggggacaggaaca

SEQ ID NO: 4280907 - DNA, 20 bp, Homo sapiens
ccgcgtccaaccccggggca

SEQ ID NO: 4280908 - DNA, 22 bp, Homo sapiens
ccgctcagccctccctgcccct

SEQ ID NO: 4280909 - DNA, 12 bp, Homo sapiens
ccgctccccagc

SEQ ID NO: 4280910 - DNA, 14 bp, Homo sapiens
ccgctccccagccc

SEQ ID NO: 4280911 - DNA, 15 bp, Homo sapiens
ccgctccccagccca

SEQ ID NO: 4280912 - DNA, 18 bp, Homo sapiens
ccgctctgaggcaacccc

SEQ ID NO: 4280913 - DNA, 10 bp, Homo sapiens
ccgctgcagg

SEQ ID NO: 4280914 - DNA, 21 bp, Homo sapiens
ccgctgcagtcagcacagaga

SEQ ID NO: 4280915 - DNA, 13 bp, Homo sapiens
ccgctgcgctgcc

SEQ ID NO: 4280916 - DNA, 14 bp, Homo sapiens
ccgctgcgctgccc

SEQ ID NO: 4280917 - DNA, 15 bp, Homo sapiens
ccgctgcgctgccct

SEQ ID NO: 4280918 - DNA, 19 bp, Homo sapiens
ccgctgcgctgccctgcaa

SEQ ID NO: 4280919 - DNA, 20 bp, Homo sapiens
ccgctgggagaaaagccaga

SEQ ID NO: 4280920 - DNA, 23 bp, Homo sapiens
ccgctgggagaaaagccagatga

SEQ ID NO: 4280921 - DNA, 13 bp, Homo sapiens
ccgctgggagagc

SEQ ID NO: 4280922 - DNA, 20 bp, Homo sapiens
ccgctgggagagccaaggcc

SEQ ID NO: 4280923 - DNA, 23 bp, Homo sapiens
ccgctgggagagccaaggcctat

SEQ ID NO: 4280924 - DNA, 16 bp, Homo sapiens
ccgcttcgccatgtgc

SEQ ID NO: 4280925 - DNA, 21 bp, Homo sapiens
ccgcttcgccatgtgctgtgc

SEQ ID NO: 4280926 - DNA, 17 bp, Homo sapiens
ccggacaagcccaggac

SEQ ID NO: 4280927 - DNA, 22 bp, Homo sapiens
ccggacaagcccaggacactgc

SEQ ID NO: 4280928 - DNA, 14 bp, Homo sapiens
ccggagctgggaag

SEQ ID NO: 4280929 - DNA, 15 bp, Homo sapiens
ccggaggggcctggc

SEQ ID NO: 4280930 - DNA, 18 bp, Homo sapiens
ccggagtcactgcctgga

SEQ ID NO: 4280931 - DNA, 12 bp, Homo sapiens
ccggatctccag

SEQ ID NO: 4280932 - DNA, 11 bp, Homo sapiens
ccttaatattt

SEQ ID NO: 4280933 - DNA, 23 bp, Homo sapiens
ccttagactccttctccccaatc

SEQ ID NO: 4280934 - DNA, 16 bp, Homo sapiens
ccttatcataaattca

SEQ ID NO: 4280935 - DNA, 14 bp, Homo sapiens
ccttcatttcctcc

SEQ ID NO: 4280936 - DNA, 15 bp, Homo sapiens
ccttcatttcctccg

SEQ ID NO: 4280937 - DNA, 18 bp, Homo sapiens
ccttccacgctgtctcca

SEQ ID NO: 4280938 - DNA, 17 bp, Homo sapiens
ccttccaggccccaggc

SEQ ID NO: 4280939 - DNA, 21 bp, Homo sapiens
ccttccaggccccaggctgga

SEQ ID NO: 4280940 - DNA, 17 bp, Homo sapiens
ccttcccaacctcccct

SEQ ID NO: 4280941 - DNA, 13 bp, Homo sapiens
ccttcccacggcc

SEQ ID NO: 4280942 - DNA, 17 bp, Homo sapiens
ccttcccacggccactg

SEQ ID NO: 4280943 - DNA, 15 bp, Homo sapiens
ccttccccactcccg

SEQ ID NO: 4280944 - DNA, 13 bp, Homo sapiens
ccttcccctgcgc

SEQ ID NO: 4280945 - DNA, 16 bp, Homo sapiens
ccttcccctgcgccct

SEQ ID NO: 4280946 - DNA, 17 bp, Homo sapiens
ccttcccctgcgccctc

SEQ ID NO: 4280947 - DNA, 22 bp, Homo sapiens
ccttcccctgcgccctccctcc

SEQ ID NO: 4280948 - DNA, 20 bp, Homo sapiens
ccttccctagttctttgcat

SEQ ID NO: 4280949 - DNA, 21 bp, Homo sapiens
ccttccctgacactgtctgct

SEQ ID NO: 4280950 - DNA, 12 bp, Homo sapiens
ccttccgctctg

SEQ ID NO: 4280951 - DNA, 21 bp, Homo sapiens
ccttcctgggcagcccagaga

SEQ ID NO: 4280952 - DNA, 21 bp, Homo sapiens
ccttcctgttctgtgtctgct

SEQ ID NO: 4280953 - DNA, 23 bp, Homo sapiens
ccttcgatacaccgggcctggag

SEQ ID NO: 4280954 - DNA, 13 bp, Homo sapiens
ccttcgtggagct

SEQ ID NO: 4280955 - DNA, 12 bp, Homo sapiens
ccttctccccaa

SEQ ID NO: 4280956 - DNA, 14 bp, Homo sapiens
ccttctccccaatc

SEQ ID NO: 4280957 - DNA, 13 bp, Homo sapiens
ccttctcccctcc

SEQ ID NO: 4280958 - DNA, 17 bp, Homo sapiens
ccttctcccctccagac

SEQ ID NO: 4280959 - DNA, 14 bp, Homo sapiens
ccttctctcagcct

SEQ ID NO: 4280960 - DNA, 16 bp, Homo sapiens
ccttctgaagatctca

SEQ ID NO: 4280961 - DNA, 14 bp, Homo sapiens
ccttctgaggatgc

SEQ ID NO: 4280962 - DNA, 18 bp, Homo sapiens
ccttctggccgctgcagt

SEQ ID NO: 4280963 - DNA, 17 bp, Homo sapiens
ccttctggctgctgcag

SEQ ID NO: 4280964 - DNA, 23 bp, Homo sapiens
ccttctggggagggacacagagg

SEQ ID NO: 4280965 - DNA, 13 bp, Homo sapiens
ccttctgtctctt

SEQ ID NO: 4280966 - DNA, 21 bp, Homo sapiens
ccttctgtggctcacagaacc

SEQ ID NO: 4280967 - DNA, 20 bp, Homo sapiens
ccttctttctagagagggaa

SEQ ID NO: 4280968 - DNA, 12 bp, Homo sapiens
ccttgagctgag

SEQ ID NO: 4280969 - DNA, 14 bp, Homo sapiens
ccttgagctgagat

SEQ ID NO: 4280970 - DNA, 21 bp, Homo sapiens
ccttgaggacctccacctggg

SEQ ID NO: 4280971 - DNA, 18 bp, Homo sapiens
ccttgatgtcttgagagc

SEQ ID NO: 4280972 - DNA, 20 bp, Homo sapiens
ccttgatgtcttgagagcgc

SEQ ID NO: 4280973 - DNA, 22 bp, Homo sapiens
ccttgcaacacacagacacacg

SEQ ID NO: 4280974 - DNA, 16 bp, Homo sapiens
ccttgccgctgggaga

SEQ ID NO: 4280975 - DNA, 16 bp, Homo sapiens
ccttgcctcctgtgta

SEQ ID NO: 4280976 - DNA, 12 bp, Homo sapiens
ccttgctgctgg

SEQ ID NO: 4280977 - DNA, 15 bp, Homo sapiens
ccttgctgctggctc

SEQ ID NO: 4280978 - DNA, 16 bp, Homo sapiens
ccttgctgctggctcc

SEQ ID NO: 4280979 - DNA, 12 bp, Homo sapiens
ccttggcccagc

SEQ ID NO: 4280980 - DNA, 14 bp, Homo sapiens
ccttggcccagcag

SEQ ID NO: 4280981 - DNA, 14 bp, Homo sapiens
ccttggcccctctc

SEQ ID NO: 4280982 - DNA, 16 bp, Homo sapiens
ccttggcgcgcagccc

SEQ ID NO: 4280983 - DNA, 18 bp, Homo sapiens
ccttggttcctccagcaa

SEQ ID NO: 4280984 - DNA, 22 bp, Homo sapiens
ccttgtagacgcacctgctgag

SEQ ID NO: 4280985 - DNA, 18 bp, Homo sapiens
ccttgtgatcactttctg

SEQ ID NO: 4280986 - DNA, 21 bp, Homo sapiens
ccttgttctgataatgaaaat

SEQ ID NO: 4280987 - DNA, 12 bp, Homo sapiens
cctttaggcagg

SEQ ID NO: 4280988 - DNA, 13 bp, Homo sapiens
cctttaggcagga

SEQ ID NO: 4280989 - DNA, 18 bp, Homo sapiens
cctttatcatgtgtttct

SEQ ID NO: 4280990 - DNA, 15 bp, Homo sapiens
cctttcacaaccttc

SEQ ID NO: 4280991 - DNA, 20 bp, Homo sapiens
cctttcacccctcttcccac

SEQ ID NO: 4280992 - DNA, 13 bp, Homo sapiens
cctttcatcctca

SEQ ID NO: 4280993 - DNA, 16 bp, Homo sapiens
cctttcatcctcagca

SEQ ID NO: 4280994 - DNA, 16 bp, Homo sapiens
cctttccagtgctgct

SEQ ID NO: 4280995 - DNA, 21 bp, Homo sapiens
cctttcccgatgcgtggctcc

SEQ ID NO: 4280996 - DNA, 13 bp, Homo sapiens
cctttccctgcat

SEQ ID NO: 4280997 - DNA, 18 bp, Homo sapiens
cctttctgacaataaata

SEQ ID NO: 4280998 - DNA, 14 bp, Homo sapiens
cctttgaatcctct

SEQ ID NO: 4280999 - DNA, 16 bp, Homo sapiens
cctttgaatcctctct

SEQ ID NO: 4281000 - DNA, 20 bp, Homo sapiens
cctttgaatcctctctctgt

SEQ ID NO: 4281001 - DNA, 19 bp, Homo sapiens
cctttggcacaccctctct

SEQ ID NO: 4281002 - DNA, 16 bp, Homo sapiens
ccttttagttcctgtg

SEQ ID NO: 4281003 - DNA, 20 bp, Homo sapiens
ccttttggcccccgagctgg

SEQ ID NO: 4281004 - DNA, 17 bp, Homo sapiens
ccttttgtatcctccat

SEQ ID NO: 4281005 - DNA, 14 bp, Homo sapiens
cctttttactcccc

SEQ ID NO: 4281006 - DNA, 16 bp, Homo sapiens
cgaaacacagaactca

SEQ ID NO: 4281007 - DNA, 15 bp, Homo sapiens
cgaacaaaccaagga

SEQ ID NO: 4281008 - DNA, 15 bp, Homo sapiens
cgaactccttgattt

SEQ ID NO: 4281009 - DNA, 18 bp, Homo sapiens
cgaagaccttctgaagat

SEQ ID NO: 4281010 - DNA, 18 bp, Homo sapiens
cgaagctgttctctgctt

SEQ ID NO: 4281011 - DNA, 16 bp, Homo sapiens
cgaagtcttccatcag

SEQ ID NO: 4281012 - DNA, 22 bp, Homo sapiens
cgaagtcttccatcagcagtga

SEQ ID NO: 4281013 - DNA, 15 bp, Homo sapiens
cgaatggagtccaga

SEQ ID NO: 4281014 - DNA, 20 bp, Homo sapiens
cgaatggagtccagacctgg

SEQ ID NO: 4281015 - DNA, 12 bp, Homo sapiens
cgacagtggctc

SEQ ID NO: 4281016 - DNA, 20 bp, Homo sapiens
cgactctctccatcagaagg

SEQ ID NO: 4281017 - DNA, 17 bp, Homo sapiens
cgactgtgacctgtggg

SEQ ID NO: 4281018 - DNA, 19 bp, Homo sapiens
cgactgtgacctgtgggga

SEQ ID NO: 4281019 - DNA, 13 bp, Homo sapiens
cgacttctttggt

SEQ ID NO: 4281020 - DNA, 23 bp, Homo sapiens
cgacttgggacggaagtggcctg

SEQ ID NO: 4281021 - DNA, 18 bp, Homo sapiens
cgagccatgatgtggagt

SEQ ID NO: 4281022 - DNA, 16 bp, Homo sapiens
cgagccccctgtcctt

SEQ ID NO: 4281023 - DNA, 17 bp, Homo sapiens
cgagccccctgtccttc

SEQ ID NO: 4281024 - DNA, 19 bp, Homo sapiens
cgagccgagctctcctggg

SEQ ID NO: 4281025 - DNA, 20 bp, Homo sapiens
cgagccgagctctcctgggc

SEQ ID NO: 4281026 - DNA, 17 bp, Homo sapiens
cgagcgacggctcctcc

SEQ ID NO: 4281027 - DNA, 18 bp, Homo sapiens
cgagctctcctgggccag

SEQ ID NO: 4281028 - DNA, 12 bp, Homo sapiens
cgagctgggggc

SEQ ID NO: 4281029 - DNA, 19 bp, Homo sapiens
cgaggacgtgaagcctccc

SEQ ID NO: 4281030 - DNA, 23 bp, Homo sapiens
cgaggagtccagtttgtgcaaga

SEQ ID NO: 4281031 - DNA, 20 bp, Homo sapiens
cgaggcagaatggtgggctc

SEQ ID NO: 4281032 - DNA, 20 bp, Homo sapiens
cgaggcaggggctgggcaga

SEQ ID NO: 4281033 - DNA, 21 bp, Homo sapiens
cgaggcaggggctgggcagag

SEQ ID NO: 4281034 - DNA, 15 bp, Homo sapiens
cgagtctggagacca

SEQ ID NO: 4281035 - DNA, 20 bp, Homo sapiens
cgagtctggagaccaggact

SEQ ID NO: 4281036 - DNA, 18 bp, Homo sapiens
cgatacaccgggcctgga

SEQ ID NO: 4281037 - DNA, 18 bp, Homo sapiens
cgatgctccagccaaccc

SEQ ID NO: 4281038 - DNA, 20 bp, Homo sapiens
cgatgctccagccaacccct

SEQ ID NO: 4281039 - DNA, 21 bp, Homo sapiens
cgatgttaaaacaaattaaaa

SEQ ID NO: 4281040 - DNA, 14 bp, Homo sapiens
cgcaagcctcagcc

SEQ ID NO: 4281041 - DNA, 15 bp, Homo sapiens
cgcacacacacacac

SEQ ID NO: 4281042 - DNA, 13 bp, Homo sapiens
cgcacacacactc

SEQ ID NO: 4281043 - DNA, 14 bp, Homo sapiens
cgcacacacactct

SEQ ID NO: 4281044 - DNA, 17 bp, Homo sapiens
cgcacgcaagcctcagc

SEQ ID NO: 4281045 - DNA, 21 bp, Homo sapiens
cgcatgcagggcccccactgg

SEQ ID NO: 4281046 - DNA, 18 bp, Homo sapiens
cgcatgctgcctgcctcc

SEQ ID NO: 4281047 - DNA, 18 bp, Homo sapiens
cgccagatggggcctctg

SEQ ID NO: 4281048 - DNA, 15 bp, Homo sapiens
cgccatgtgctgtgc

SEQ ID NO: 4281049 - DNA, 18 bp, Homo sapiens
cgccatgtgctgtgcacc

SEQ ID NO: 4281050 - DNA, 13 bp, Homo sapiens
cgccccccagagc

SEQ ID NO: 4281051 - DNA, 22 bp, Homo sapiens
cgccccccagagccagggctgt

SEQ ID NO: 4281052 - DNA, 14 bp, Homo sapiens
cgccccgccccaca

SEQ ID NO: 4281053 - DNA, 17 bp, Homo sapiens
cgccccgccccacattc

SEQ ID NO: 4281054 - DNA, 22 bp, Homo sapiens
cgcccctccagtgttgcctcct

SEQ ID NO: 4281055 - DNA, 16 bp, Homo sapiens
cgccctccccctgcca

SEQ ID NO: 4281056 - DNA, 17 bp, Homo sapiens
cgccctccctccctcca

SEQ ID NO: 4281057 - DNA, 18 bp, Homo sapiens
cgccgtgtctgtggccct

SEQ ID NO: 4281058 - DNA, 21 bp, Homo sapiens
cgccgtgtctgtggccctctc

SEQ ID NO: 4281059 - DNA, 21 bp, Homo sapiens
cgcctctcactctggcagcct

SEQ ID NO: 4281060 - DNA, 18 bp, Homo sapiens
cgcctctgggctcacacc

SEQ ID NO: 4281061 - DNA, 21 bp, Homo sapiens
cgcctctgggctcacaccagc

SEQ ID NO: 4281062 - DNA, 11 bp, Homo sapiens
cgcctggcaga

SEQ ID NO: 4281063 - DNA, 14 bp, Homo sapiens
ctccagacccccag

SEQ ID NO: 4281064 - DNA, 18 bp, Homo sapiens
ctccagacccctggcttt

SEQ ID NO: 4281065 - DNA, 15 bp, Homo sapiens
ctccagagtaggtgg

SEQ ID NO: 4281066 - DNA, 20 bp, Homo sapiens
ctccagagtaggtgggtctt

SEQ ID NO: 4281067 - DNA, 20 bp, Homo sapiens
ctccagccaacccctgtgga

SEQ ID NO: 4281068 - DNA, 22 bp, Homo sapiens
ctccagccaccaaggctgcctg

SEQ ID NO: 4281069 - DNA, 23 bp, Homo sapiens
ctccagccaccaaggctgcctgc

SEQ ID NO: 4281070 - DNA, 18 bp, Homo sapiens
ctccagccacttatttcc

SEQ ID NO: 4281071 - DNA, 22 bp, Homo sapiens
ctccaggattgtccacaaatgt

SEQ ID NO: 4281072 - DNA, 23 bp, Homo sapiens
ctccaggattgtccacaaatgtc

SEQ ID NO: 4281073 - DNA, 20 bp, Homo sapiens
ctccaggcaggaaaccccga

SEQ ID NO: 4281074 - DNA, 13 bp, Homo sapiens
ctccaggcccagc

SEQ ID NO: 4281075 - DNA, 20 bp, Homo sapiens
ctccaggcccagcctggccc

SEQ ID NO: 4281076 - DNA, 22 bp, Homo sapiens
ctccaggcccagcctggcccca

SEQ ID NO: 4281077 - DNA, 12 bp, Homo sapiens
ctccaggcttcc

SEQ ID NO: 4281078 - DNA, 19 bp, Homo sapiens
ctccaggcttcctgcccta

SEQ ID NO: 4281079 - DNA, 21 bp, Homo sapiens
ctccaggcttcctgccctagc

SEQ ID NO: 4281080 - DNA, 15 bp, Homo sapiens
ctccagtctgctgcc

SEQ ID NO: 4281081 - DNA, 16 bp, Homo sapiens
ctccagtgttgcctcc

SEQ ID NO: 4281082 - DNA, 20 bp, Homo sapiens
ctccagtgttgcctcctccc

SEQ ID NO: 4281083 - DNA, 17 bp, Homo sapiens
ctccataattgcaaggg

SEQ ID NO: 4281084 - DNA, 17 bp, Homo sapiens
ctccatgagttttttct

SEQ ID NO: 4281085 - DNA, 19 bp, Homo sapiens
ctccatgattccaagggcc

SEQ ID NO: 4281086 - DNA, 19 bp, Homo sapiens
ctccatgtagaagagggag

SEQ ID NO: 4281087 - DNA, 20 bp, Homo sapiens
ctcccaaataaactccttaa

SEQ ID NO: 4281088 - DNA, 21 bp, Homo sapiens
ctcccaaatgcagcttcaggt

SEQ ID NO: 4281089 - DNA, 16 bp, Homo sapiens
ctcccaactctggcct

SEQ ID NO: 4281090 - DNA, 15 bp, Homo sapiens
ctcccacgccctcct

SEQ ID NO: 4281091 - DNA, 19 bp, Homo sapiens
ctcccacgccctcctccct

SEQ ID NO: 4281092 - DNA, 15 bp, Homo sapiens
ctcccagccacccgg

SEQ ID NO: 4281093 - DNA, 20 bp, Homo sapiens
ctcccagctctagacaaccc

SEQ ID NO: 4281094 - DNA, 17 bp, Homo sapiens
ctcccaggcgccccttc

SEQ ID NO: 4281095 - DNA, 20 bp, Homo sapiens
ctcccaggcgccccttcccc

SEQ ID NO: 4281096 - DNA, 14 bp, Homo sapiens
ctcccagggccatg

SEQ ID NO: 4281097 - DNA, 20 bp, Homo sapiens
ctcccagggccatgaacttt

SEQ ID NO: 4281098 - DNA, 16 bp, Homo sapiens
ctcccagggtcctggg

SEQ ID NO: 4281099 - DNA, 19 bp, Homo sapiens
ctcccatttgcagaccagg

SEQ ID NO: 4281100 - DNA, 15 bp, Homo sapiens
ctccccaaccctgcc

SEQ ID NO: 4281101 - DNA, 15 bp, Homo sapiens
ctccccagcaggtgg

SEQ ID NO: 4281102 - DNA, 16 bp, Homo sapiens
ctccccagcccagggt

SEQ ID NO: 4281103 - DNA, 21 bp, Homo sapiens
ctccccatggtgcagtgaaga

SEQ ID NO: 4281104 - DNA, 15 bp, Homo sapiens
ctcccccatcctccc

SEQ ID NO: 4281105 - DNA, 13 bp, Homo sapiens
ctccccctgccag

SEQ ID NO: 4281106 - DNA, 15 bp, Homo sapiens
ctccccctgccagag

SEQ ID NO: 4281107 - DNA, 22 bp, Homo sapiens
ctccccctgccagaggcctggt

SEQ ID NO: 4281108 - DNA, 24 bp, Homo sapiens
ctccccgatccccgacagtggctc

SEQ ID NO: 4281109 - DNA, 18 bp, Homo sapiens
ctccccggacaagcccag

SEQ ID NO: 4281110 - DNA, 19 bp, Homo sapiens
ctccccggacaagcccagg

SEQ ID NO: 4281111 - DNA, 23 bp, Homo sapiens
ctccccggacaagcccaggacac

SEQ ID NO: 4281112 - DNA, 14 bp, Homo sapiens
ctcccctccagacc

SEQ ID NO: 4281113 - DNA, 17 bp, Homo sapiens
ctcccctccagacccct

SEQ ID NO: 4281114 - DNA, 21 bp, Homo sapiens
ctcccctctatttagcatgac

SEQ ID NO: 4281115 - DNA, 20 bp, Homo sapiens
ctcccctgcgcaggccctcc

SEQ ID NO: 4281116 - DNA, 22 bp, Homo sapiens
ctcccgcatgctgcctgcctcc

SEQ ID NO: 4281117 - DNA, 23 bp, Homo sapiens
ctccctagtgacccggaggccac

SEQ ID NO: 4281118 - DNA, 14 bp, Homo sapiens
ctccctcagccacg

SEQ ID NO: 4281119 - DNA, 15 bp, Homo sapiens
ctccctcagccacgc

SEQ ID NO: 4281120 - DNA, 14 bp, Homo sapiens
ctccctcagcccct

SEQ ID NO: 4281121 - DNA, 16 bp, Homo sapiens
ctccctcagcccctct

SEQ ID NO: 4281122 - DNA, 10 bp, Homo sapiens
ctccctccac

SEQ ID NO: 4281123 - DNA, 15 bp, Homo sapiens
ctccctccacacctc

SEQ ID NO: 4281124 - DNA, 16 bp, Homo sapiens
ctccctccactcctcc

SEQ ID NO: 4281125 - DNA, 19 bp, Homo sapiens
ctccctcccatttgcagac

SEQ ID NO: 4281126 - DNA, 13 bp, Homo sapiens
ctccctccctcca

SEQ ID NO: 4281127 - DNA, 12 bp, Homo sapiens
ctccctcctggc

SEQ ID NO: 4281128 - DNA, 14 bp, Homo sapiens
ctccctcctggctc

SEQ ID NO: 4281129 - DNA, 15 bp, Homo sapiens
ctccctcggccccac

SEQ ID NO: 4281130 - DNA, 12 bp, Homo sapiens
ctccctgcaggg

SEQ ID NO: 4281131 - DNA, 13 bp, Homo sapiens
ctccctgcagggt

SEQ ID NO: 4281132 - DNA, 16 bp, Homo sapiens
ctccctggactctgtg

SEQ ID NO: 4281133 - DNA, 15 bp, Homo sapiens
ctccctggcctgttc

SEQ ID NO: 4281134 - DNA, 19 bp, Homo sapiens
ctccctggcctgttctgtt

SEQ ID NO: 4281135 - DNA, 13 bp, Homo sapiens
ctccctgtcccct

SEQ ID NO: 4281136 - DNA, 18 bp, Homo sapiens
ctcccttcaatcctgtca

SEQ ID NO: 4281137 - DNA, 14 bp, Homo sapiens
ctccgcccttccct

SEQ ID NO: 4281138 - DNA, 13 bp, Homo sapiens
ctccgcgggggac

SEQ ID NO: 4281139 - DNA, 13 bp, Homo sapiens
ctccggccctgcc

SEQ ID NO: 4281140 - DNA, 18 bp, Homo sapiens
ctccggccctgccccaca

SEQ ID NO: 4281141 - DNA, 13 bp, Homo sapiens
ctcctacctggta

SEQ ID NO: 4281142 - DNA, 18 bp, Homo sapiens
ctcctatcacctcccctc

SEQ ID NO: 4281143 - DNA, 21 bp, Homo sapiens
ctcctcagtctttgggggatt

SEQ ID NO: 4281144 - DNA, 20 bp, Homo sapiens
ctcctccagttctgatgagg

SEQ ID NO: 4281145 - DNA, 17 bp, Homo sapiens
ctcctcccaggcgcccc

SEQ ID NO: 4281146 - DNA, 15 bp, Homo sapiens
ctcctcccatccagc

SEQ ID NO: 4281147 - DNA, 14 bp, Homo sapiens
ctcctctgcctgtg

SEQ ID NO: 4281148 - DNA, 17 bp, Homo sapiens
ctcctctgcctgtgccc

SEQ ID NO: 4281149 - DNA, 12 bp, Homo sapiens
ctcctctgcctt

SEQ ID NO: 4281150 - DNA, 15 bp, Homo sapiens
ctcctctgccttgga

SEQ ID NO: 4281151 - DNA, 18 bp, Homo sapiens
ctcctctgccttggacac

SEQ ID NO: 4281152 - DNA, 12 bp, Homo sapiens
ctcctctgggca

SEQ ID NO: 4281153 - DNA, 13 bp, Homo sapiens
ctcctctgggcag

SEQ ID NO: 4281154 - DNA, 23 bp, Homo sapiens
ctcctgaatccctttcagtttgt

SEQ ID NO: 4281155 - DNA, 12 bp, Homo sapiens
ctcctgacccca

SEQ ID NO: 4281156 - DNA, 18 bp, Homo sapiens
ctcctgaggagcagccca

SEQ ID NO: 4281157 - DNA, 16 bp, Homo sapiens
ctcctgcatccctcca

SEQ ID NO: 4281158 - DNA, 18 bp, Homo sapiens
ctcctgcatccctccacc

SEQ ID NO: 4281159 - DNA, 13 bp, Homo sapiens
ctcctgccctcgt

SEQ ID NO: 4281160 - DNA, 18 bp, Homo sapiens
ctcctgctgaccttctgc

SEQ ID NO: 4281161 - DNA, 16 bp, Homo sapiens
ctcctggctcacagcc

SEQ ID NO: 4281162 - DNA, 17 bp, Homo sapiens
ctcctggctcacagcca

SEQ ID NO: 4281163 - DNA, 20 bp, Homo sapiens
ctcctggctcacagccacca

SEQ ID NO: 4281164 - DNA, 19 bp, Homo sapiens
ctcctgggcatctggccct

SEQ ID NO: 4281165 - DNA, 22 bp, Homo sapiens
ctcctgggcatctggccctgct

SEQ ID NO: 4281166 - DNA, 17 bp, Homo sapiens
ctcctgggccagggtct

SEQ ID NO: 4281167 - DNA, 18 bp, Homo sapiens
ctccttagacacctatca

SEQ ID NO: 4281168 - DNA, 13 bp, Homo sapiens
ctccttccaggcc

SEQ ID NO: 4281169 - DNA, 16 bp, Homo sapiens
ctccttctccccaatc

SEQ ID NO: 4281170 - DNA, 16 bp, Homo sapiens
ctccttctcccctcca

SEQ ID NO: 4281171 - DNA, 21 bp, Homo sapiens
ctccttgattttagccttctc

SEQ ID NO: 4281172 - DNA, 19 bp, Homo sapiens
ctccttgccgctgggagag

SEQ ID NO: 4281173 - DNA, 17 bp, Homo sapiens
ctccttgcctcctgtgt

SEQ ID NO: 4281174 - DNA, 18 bp, Homo sapiens
ctccttgcctcctgtgta

SEQ ID NO: 4281175 - DNA, 15 bp, Homo sapiens
ctcgaagctgttctc

SEQ ID NO: 4281176 - DNA, 21 bp, Homo sapiens
ctcgaagtcttccatcagcag

SEQ ID NO: 4281177 - DNA, 16 bp, Homo sapiens
ctcgcccctccagtgt

SEQ ID NO: 4281178 - DNA, 19 bp, Homo sapiens
ctcgcccctccagtgttgc

SEQ ID NO: 4281179 - DNA, 17 bp, Homo sapiens
ctcgcttcataggcaga

SEQ ID NO: 4281180 - DNA, 14 bp, Homo sapiens
ctcggccagagctc

SEQ ID NO: 4281181 - DNA, 22 bp, Homo sapiens
ctcggctttggctcgggacttc

SEQ ID NO: 4281182 - DNA, 21 bp, Homo sapiens
ctcgggctaagtccagctctc

SEQ ID NO: 4281183 - DNA, 22 bp, Homo sapiens
ctcgggctaagtccagctctcc

SEQ ID NO: 4281184 - DNA, 15 bp, Homo sapiens
ctcgggctctctcac

SEQ ID NO: 4281185 - DNA, 17 bp, Homo sapiens
ctcgggctctctcaccc

SEQ ID NO: 4281186 - DNA, 16 bp, Homo sapiens
ctcgtcaggaggtgcc

SEQ ID NO: 4281187 - DNA, 18 bp, Homo sapiens
ctcgtctccctggccacc

SEQ ID NO: 4281188 - DNA, 13 bp, Homo sapiens
ctcgttgacatgc

SEQ ID NO: 4281189 - DNA, 14 bp, Homo sapiens
ctctacactgtgaa

SEQ ID NO: 4281190 - DNA, 17 bp, Homo sapiens
ctctactgaaaacacaa

SEQ ID NO: 4281191 - DNA, 19 bp, Homo sapiens
ctctacttagcatgtccct

SEQ ID NO: 4281192 - DNA, 20 bp, Homo sapiens
ctctacttagcatgtcccta

SEQ ID NO: 4281193 - DNA, 20 bp, Homo sapiens
ctggcccctagaatcagcct

SEQ ID NO: 4281194 - DNA, 12 bp, Homo sapiens
ctggcccctcac

SEQ ID NO: 4281195 - DNA, 22 bp, Homo sapiens
ctggcccctcacctgggcacct

SEQ ID NO: 4281196 - DNA, 15 bp, Homo sapiens
ctggccctcctctgg

SEQ ID NO: 4281197 - DNA, 17 bp, Homo sapiens
ctggccctcctctggtc

SEQ ID NO: 4281198 - DNA, 14 bp, Homo sapiens
ctggccctgctgcc

SEQ ID NO: 4281199 - DNA, 17 bp, Homo sapiens
ctggccctgctgccccc

SEQ ID NO: 4281200 - DNA, 12 bp, Homo sapiens
ctggccctgttg

SEQ ID NO: 4281201 - DNA, 15 bp, Homo sapiens
ctggccgctgggaga

SEQ ID NO: 4281202 - DNA, 22 bp, Homo sapiens
ctggccgtggagtcgagctggc

SEQ ID NO: 4281203 - DNA, 11 bp, Homo sapiens
ctggcctctgg

SEQ ID NO: 4281204 - DNA, 12 bp, Homo sapiens
ctggcctcttcc

SEQ ID NO: 4281205 - DNA, 22 bp, Homo sapiens
ctggcctcttcctccctccctg

SEQ ID NO: 4281206 - DNA, 18 bp, Homo sapiens
ctggccttggttcctcca

SEQ ID NO: 4281207 - DNA, 20 bp, Homo sapiens
ctggccttggttcctccagc

SEQ ID NO: 4281208 - DNA, 22 bp, Homo sapiens
ctggccttggttcctccagcaa

SEQ ID NO: 4281209 - DNA, 17 bp, Homo sapiens
ctggctacgacttggga

SEQ ID NO: 4281210 - DNA, 13 bp, Homo sapiens
ctggctcacagcc

SEQ ID NO: 4281211 - DNA, 15 bp, Homo sapiens
ctggctcacagccac

SEQ ID NO: 4281212 - DNA, 17 bp, Homo sapiens
ctggctcacagccacca

SEQ ID NO: 4281213 - DNA, 19 bp, Homo sapiens
ctggctcccacaggccctt

SEQ ID NO: 4281214 - DNA, 22 bp, Homo sapiens
ctggctcccacaggcccttcct

SEQ ID NO: 4281215 - DNA, 15 bp, Homo sapiens
ctggctcccatctcc

SEQ ID NO: 4281216 - DNA, 17 bp, Homo sapiens
ctggctcctccagcaag

SEQ ID NO: 4281217 - DNA, 20 bp, Homo sapiens
ctggctcctccagcaagacc

SEQ ID NO: 4281218 - DNA, 13 bp, Homo sapiens
ctggctctgcagc

SEQ ID NO: 4281219 - DNA, 14 bp, Homo sapiens
ctggctgtggcccc

SEQ ID NO: 4281220 - DNA, 15 bp, Homo sapiens
ctggcttcccaggac

SEQ ID NO: 4281221 - DNA, 19 bp, Homo sapiens
ctggcttcccaggaccctg

SEQ ID NO: 4281222 - DNA, 15 bp, Homo sapiens
ctggcttctccctgg

SEQ ID NO: 4281223 - DNA, 20 bp, Homo sapiens
ctggctttggaaagacctgt

SEQ ID NO: 4281224 - DNA, 17 bp, Homo sapiens
ctggcttttcactgctg

SEQ ID NO: 4281225 - DNA, 20 bp, Homo sapiens
ctggcttttcactgctggct

SEQ ID NO: 4281226 - DNA, 23 bp, Homo sapiens
ctggcttttcactgctggctgcc

SEQ ID NO: 4281227 - DNA, 20 bp, Homo sapiens
ctgggaaaagggcaggagcc

SEQ ID NO: 4281228 - DNA, 14 bp, Homo sapiens
ctgggaagggggca

SEQ ID NO: 4281229 - DNA, 15 bp, Homo sapiens
ctgggaagggggcag

SEQ ID NO: 4281230 - DNA, 16 bp, Homo sapiens
ctgggaccctcggggc

SEQ ID NO: 4281231 - DNA, 22 bp, Homo sapiens
ctgggaccctcggggcaggaag

SEQ ID NO: 4281232 - DNA, 23 bp, Homo sapiens
ctgggaccctcggggcaggaagt

SEQ ID NO: 4281233 - DNA, 16 bp, Homo sapiens
ctgggagagccaaggc

SEQ ID NO: 4281234 - DNA, 19 bp, Homo sapiens
ctgggagagccaaggccta

SEQ ID NO: 4281235 - DNA, 20 bp, Homo sapiens
ctgggagagccaaggcctat

SEQ ID NO: 4281236 - DNA, 17 bp, Homo sapiens
ctgggagagtgaggtca

SEQ ID NO: 4281237 - DNA, 20 bp, Homo sapiens
ctgggagcctcgcccctcca

SEQ ID NO: 4281238 - DNA, 14 bp, Homo sapiens
ctgggaggcaggtc

SEQ ID NO: 4281239 - DNA, 22 bp, Homo sapiens
ctgggaggcaggtcccgagccc

SEQ ID NO: 4281240 - DNA, 22 bp, Homo sapiens
ctgggaggggttttcgaagctc

SEQ ID NO: 4281241 - DNA, 13 bp, Homo sapiens
ctgggagtgggag

SEQ ID NO: 4281242 - DNA, 17 bp, Homo sapiens
ctgggcacctggggagt

SEQ ID NO: 4281243 - DNA, 20 bp, Homo sapiens
ctgggcacctggggagtggg

SEQ ID NO: 4281244 - DNA, 11 bp, Homo sapiens
ctgggcagagg

SEQ ID NO: 4281245 - DNA, 14 bp, Homo sapiens
ctgggcagagggga

SEQ ID NO: 4281246 - DNA, 22 bp, Homo sapiens
ctgggcagaggggagaggaagc

SEQ ID NO: 4281247 - DNA, 14 bp, Homo sapiens
ctgggcagcccaga

SEQ ID NO: 4281248 - DNA, 17 bp, Homo sapiens
ctgggcagcccagagag

SEQ ID NO: 4281249 - DNA, 16 bp, Homo sapiens
ctgggcatccccagcc

SEQ ID NO: 4281250 - DNA, 20 bp, Homo sapiens
ctgggcatccccagccccct

SEQ ID NO: 4281251 - DNA, 22 bp, Homo sapiens
ctgggcatccccagccccctgg

SEQ ID NO: 4281252 - DNA, 17 bp, Homo sapiens
ctgggcatctggccctg

SEQ ID NO: 4281253 - DNA, 20 bp, Homo sapiens
ctgggcatctggccctgctg

SEQ ID NO: 4281254 - DNA, 14 bp, Homo sapiens
ctgggccactggca

SEQ ID NO: 4281255 - DNA, 16 bp, Homo sapiens
ctgggccactggcatc

SEQ ID NO: 4281256 - DNA, 15 bp, Homo sapiens
ctgggccccctggga

SEQ ID NO: 4281257 - DNA, 18 bp, Homo sapiens
ctgggccccctgggagag

SEQ ID NO: 4281258 - DNA, 13 bp, Homo sapiens
ctgggccctaggc

SEQ ID NO: 4281259 - DNA, 21 bp, Homo sapiens
ctgggccctggttcccccagg

SEQ ID NO: 4281260 - DNA, 15 bp, Homo sapiens
ctgggctcacaccag

SEQ ID NO: 4281261 - DNA, 18 bp, Homo sapiens
ctgggctcacaccagccc

SEQ ID NO: 4281262 - DNA, 23 bp, Homo sapiens
ctggggacggagcactgtgcagc

SEQ ID NO: 4281263 - DNA, 19 bp, Homo sapiens
ctggggagaccgagtgtgg

SEQ ID NO: 4281264 - DNA, 14 bp, Homo sapiens
ctggggagggacac

SEQ ID NO: 4281265 - DNA, 21 bp, Homo sapiens
ctggggagggacacagaggac

SEQ ID NO: 4281266 - DNA, 14 bp, Homo sapiens
ctggggagggagag

SEQ ID NO: 4281267 - DNA, 16 bp, Homo sapiens
ctggggagggagagat

SEQ ID NO: 4281268 - DNA, 17 bp, Homo sapiens
ctggggagtgggacaga

SEQ ID NO: 4281269 - DNA, 20 bp, Homo sapiens
ctggggagtgggacagagtc

SEQ ID NO: 4281270 - DNA, 13 bp, Homo sapiens
ctggggctgccgt

SEQ ID NO: 4281271 - DNA, 14 bp, Homo sapiens
ctggggctgccgtg

SEQ ID NO: 4281272 - DNA, 17 bp, Homo sapiens
ctggggcttttgtgcca

SEQ ID NO: 4281273 - DNA, 19 bp, Homo sapiens
ctggggcttttgtgccagg

SEQ ID NO: 4281274 - DNA, 20 bp, Homo sapiens
ctggggcttttgtgccagga

SEQ ID NO: 4281275 - DNA, 14 bp, Homo sapiens
ctgggggccatgag

SEQ ID NO: 4281276 - DNA, 12 bp, Homo sapiens
ctgggggctgct

SEQ ID NO: 4281277 - DNA, 16 bp, Homo sapiens
ctggggggcacagcca

SEQ ID NO: 4281278 - DNA, 15 bp, Homo sapiens
ctgggggtgccaacc

SEQ ID NO: 4281279 - DNA, 18 bp, Homo sapiens
ctgggggttgttgggagg

SEQ ID NO: 4281280 - DNA, 22 bp, Homo sapiens
ctggggtggaggctaagcctgg

SEQ ID NO: 4281281 - DNA, 14 bp, Homo sapiens
ctggggtggggctt

SEQ ID NO: 4281282 - DNA, 17 bp, Homo sapiens
ctggggtgggtgtgagc

SEQ ID NO: 4281283 - DNA, 17 bp, Homo sapiens
ctggggtggttggaggc

SEQ ID NO: 4281284 - DNA, 20 bp, Homo sapiens
ctggggtttccacacaggcc

SEQ ID NO: 4281285 - DNA, 20 bp, Homo sapiens
ctgggtcaccttcctgggca

SEQ ID NO: 4281286 - DNA, 22 bp, Homo sapiens
ctgggtcaccttcctgggcagc

SEQ ID NO: 4281287 - DNA, 20 bp, Homo sapiens
ctgggtggccggccctgccc

SEQ ID NO: 4281288 - DNA, 21 bp, Homo sapiens
ctgggtggccggccctgcccc

SEQ ID NO: 4281289 - DNA, 22 bp, Homo sapiens
ctgggtggccggccctgccccc

SEQ ID NO: 4281290 - DNA, 20 bp, Homo sapiens
ctgggttggccagagggccc

SEQ ID NO: 4281291 - DNA, 16 bp, Homo sapiens
ctgggtttgggcagtg

SEQ ID NO: 4281292 - DNA, 11 bp, Homo sapiens
ctggtattaaa

SEQ ID NO: 4281293 - DNA, 19 bp, Homo sapiens
ctggtccaggcatgggtcc

SEQ ID NO: 4281294 - DNA, 14 bp, Homo sapiens
ctggtccaggccag

SEQ ID NO: 4281295 - DNA, 20 bp, Homo sapiens
ctggtccaggccaggcctca

SEQ ID NO: 4281296 - DNA, 15 bp, Homo sapiens
ctggtcctgcactgt

SEQ ID NO: 4281297 - DNA, 20 bp, Homo sapiens
ctggtccttctgaccccact

SEQ ID NO: 4281298 - DNA, 14 bp, Homo sapiens
ctggtctcagagga

SEQ ID NO: 4281299 - DNA, 18 bp, Homo sapiens
ctggtctctaggcctgaa

SEQ ID NO: 4281300 - DNA, 17 bp, Homo sapiens
ctggtctggagccccta

SEQ ID NO: 4281301 - DNA, 18 bp, Homo sapiens
ctggtctggagcccctat

SEQ ID NO: 4281302 - DNA, 21 bp, Homo sapiens
ctggtctggagcccctatcct

SEQ ID NO: 4281303 - DNA, 16 bp, Homo sapiens
ctggtctgggtgcccc

SEQ ID NO: 4281304 - DNA, 14 bp, Homo sapiens
ctggtgaaagagta

SEQ ID NO: 4281305 - DNA, 21 bp, Homo sapiens
ctggtgaaagagtaaaaccaa

SEQ ID NO: 4281306 - DNA, 14 bp, Homo sapiens
ctggtgcatttaaa

SEQ ID NO: 4281307 - DNA, 20 bp, Homo sapiens
ctggtgcccaccagctggct

SEQ ID NO: 4281308 - DNA, 22 bp, Homo sapiens
ctggtgcccaccagctggctct

SEQ ID NO: 4281309 - DNA, 23 bp, Homo sapiens
ctggtgcgttcctaaactctgaa

SEQ ID NO: 4281310 - DNA, 21 bp, Homo sapiens
ctggtggacagacccagggtg

SEQ ID NO: 4281311 - DNA, 23 bp, Homo sapiens
ctggtggacagacccagggtggt

SEQ ID NO: 4281312 - DNA, 19 bp, Homo sapiens
ctggtggccaagcctgccc

SEQ ID NO: 4281313 - DNA, 21 bp, Homo sapiens
ctggtggccaagcctgccccg

SEQ ID NO: 4281314 - DNA, 23 bp, Homo sapiens
ctggtggccaagcctgccccggc

SEQ ID NO: 4281315 - DNA, 20 bp, Homo sapiens
ctggtggcccgacagcctgg

SEQ ID NO: 4281316 - DNA, 21 bp, Homo sapiens
ctggtggcccgacagcctggc

SEQ ID NO: 4281317 - DNA, 17 bp, Homo sapiens
ctggtgtccctgcctgg

SEQ ID NO: 4281318 - DNA, 18 bp, Homo sapiens
ctggtgtccctgcctggc

SEQ ID NO: 4281319 - DNA, 19 bp, Homo sapiens
ctggtgtccctgcctggcc

SEQ ID NO: 4281320 - DNA, 18 bp, Homo sapiens
ctggtgtctagtttgcat

SEQ ID NO: 4281321 - DNA, 15 bp, Homo sapiens
ctggttatgagccga

SEQ ID NO: 4281322 - DNA, 21 bp, Homo sapiens
ctttgtaaggacttgtgcctc

SEQ ID NO: 4281323 - DNA, 16 bp, Homo sapiens
ctttgtatacaagtac

SEQ ID NO: 4281324 - DNA, 17 bp, Homo sapiens
ctttgtatacaagtact

SEQ ID NO: 4281325 - DNA, 13 bp, Homo sapiens
ctttgtctgaagg

SEQ ID NO: 4281326 - DNA, 12 bp, Homo sapiens
ctttgtgtgctg

SEQ ID NO: 4281327 - DNA, 23 bp, Homo sapiens
ctttgtttacatgagttcaaata

SEQ ID NO: 4281328 - DNA, 19 bp, Homo sapiens
cttttaatgatactgtcta

SEQ ID NO: 4281329 - DNA, 19 bp, Homo sapiens
cttttagcggtttgcaaac

SEQ ID NO: 4281330 - DNA, 22 bp, Homo sapiens
cttttagcggtttgcaaacaaa

SEQ ID NO: 4281331 - DNA, 21 bp, Homo sapiens
cttttagttcctgtgcacagc

SEQ ID NO: 4281332 - DNA, 13 bp, Homo sapiens
cttttcaaacaca

SEQ ID NO: 4281333 - DNA, 17 bp, Homo sapiens
cttttcaaacacacaca

SEQ ID NO: 4281334 - DNA, 12 bp, Homo sapiens
cttttcactgct

SEQ ID NO: 4281335 - DNA, 16 bp, Homo sapiens
cttttcactgctggct

SEQ ID NO: 4281336 - DNA, 20 bp, Homo sapiens
cttttcactgctggctgcct

SEQ ID NO: 4281337 - DNA, 15 bp, Homo sapiens
cttttcagcttgttt

SEQ ID NO: 4281338 - DNA, 15 bp, Homo sapiens
cttttcatatcattt

SEQ ID NO: 4281339 - DNA, 15 bp, Homo sapiens
cttttcctcttagaa

SEQ ID NO: 4281340 - DNA, 19 bp, Homo sapiens
cttttcctcttagaagaat

SEQ ID NO: 4281341 - DNA, 13 bp, Homo sapiens
cttttggcccccg

SEQ ID NO: 4281342 - DNA, 21 bp, Homo sapiens
cttttgtacgttaattaaaca

SEQ ID NO: 4281343 - DNA, 22 bp, Homo sapiens
cttttgtacgttaattaaacaa

SEQ ID NO: 4281344 - DNA, 14 bp, Homo sapiens
cttttgtgtattct

SEQ ID NO: 4281345 - DNA, 11 bp, Homo sapiens
cttttgttcta

SEQ ID NO: 4281346 - DNA, 15 bp, Homo sapiens
ctttttactcccctt

SEQ ID NO: 4281347 - DNA, 22 bp, Homo sapiens
ctttttcttttttgagtgtgca

SEQ ID NO: 4281348 - DNA, 18 bp, Homo sapiens
cttttttaaatgaagaaa

SEQ ID NO: 4281349 - DNA, 19 bp, Homo sapiens
gaaaaaaaaagaataatga

SEQ ID NO: 4281350 - DNA, 17 bp, Homo sapiens
gaaaaacagcagagtaa

SEQ ID NO: 4281351 - DNA, 23 bp, Homo sapiens
gaaaaaccaatgattcataacaa

SEQ ID NO: 4281352 - DNA, 12 bp, Homo sapiens
gaaaactaagtt

SEQ ID NO: 4281353 - DNA, 21 bp, Homo sapiens
gaaaactgtttatggtatttt

SEQ ID NO: 4281354 - DNA, 20 bp, Homo sapiens
gaaaagaagaaagtctatgc

SEQ ID NO: 4281355 - DNA, 15 bp, Homo sapiens
gaaaagaagtagtgt

SEQ ID NO: 4281356 - DNA, 11 bp, Homo sapiens
gaaaagaattt

SEQ ID NO: 4281357 - DNA, 20 bp, Homo sapiens
gaaaagggcaggagcctaga

SEQ ID NO: 4281358 - DNA, 12 bp, Homo sapiens
gaaaagtgcttt

SEQ ID NO: 4281359 - DNA, 17 bp, Homo sapiens
gaaaatatttttttcta

SEQ ID NO: 4281360 - DNA, 18 bp, Homo sapiens
gaaaatatttttttctag

SEQ ID NO: 4281361 - DNA, 19 bp, Homo sapiens
gaaaatatttttttctagc

SEQ ID NO: 4281362 - DNA, 24 bp, Homo sapiens
gaaacaaagcatttgactttctgt

SEQ ID NO: 4281363 - DNA, 13 bp, Homo sapiens
gaaacacagctgt

SEQ ID NO: 4281364 - DNA, 22 bp, Homo sapiens
gaaacacagtcatgtgtcagct

SEQ ID NO: 4281365 - DNA, 14 bp, Homo sapiens
gaaaccctgtttta

SEQ ID NO: 4281366 - DNA, 18 bp, Homo sapiens
gaaaccttcacccagcac

SEQ ID NO: 4281367 - DNA, 16 bp, Homo sapiens
gaaacgagatttgcca

SEQ ID NO: 4281368 - DNA, 18 bp, Homo sapiens
gaaacgagatttgccaaa

SEQ ID NO: 4281369 - DNA, 15 bp, Homo sapiens
gaaactatgcaccta

SEQ ID NO: 4281370 - DNA, 18 bp, Homo sapiens
gaaactcacctgctggcc

SEQ ID NO: 4281371 - DNA, 20 bp, Homo sapiens
gaaactcacctgctggcccc

SEQ ID NO: 4281372 - DNA, 23 bp, Homo sapiens
gaaactcacctgctggcccctca

SEQ ID NO: 4281373 - DNA, 14 bp, Homo sapiens
gaaagcatattgac

SEQ ID NO: 4281374 - DNA, 15 bp, Homo sapiens
gaaagctatatatga

SEQ ID NO: 4281375 - DNA, 23 bp, Homo sapiens
gaaagctgcttctgggggatttc

SEQ ID NO: 4281376 - DNA, 14 bp, Homo sapiens
gaaaggaaaccttt

SEQ ID NO: 4281377 - DNA, 15 bp, Homo sapiens
gaaaggaaacctttt

SEQ ID NO: 4281378 - DNA, 15 bp, Homo sapiens
gaaaggagagtactt

SEQ ID NO: 4281379 - DNA, 18 bp, Homo sapiens
gaaagggtgtggcttgga

SEQ ID NO: 4281380 - DNA, 16 bp, Homo sapiens
gaaaggtaatctgaaa

SEQ ID NO: 4281381 - DNA, 17 bp, Homo sapiens
gaaaggtaatctgaaac

SEQ ID NO: 4281382 - DNA, 16 bp, Homo sapiens
gaaagtgagcagtgtt

SEQ ID NO: 4281383 - DNA, 22 bp, Homo sapiens
gaaataaaccttaatatttctt

SEQ ID NO: 4281384 - DNA, 14 bp, Homo sapiens
gaaataaattggtg

SEQ ID NO: 4281385 - DNA, 23 bp, Homo sapiens
gaaataattttttagttaaaatc

SEQ ID NO: 4281386 - DNA, 21 bp, Homo sapiens
gaaatatcatcacgtatgtta

SEQ ID NO: 4281387 - DNA, 18 bp, Homo sapiens
gaaatatctgtgaaatat

SEQ ID NO: 4281388 - DNA, 20 bp, Homo sapiens
gaaatatctgtgaaatatca

SEQ ID NO: 4281389 - DNA, 20 bp, Homo sapiens
gaaatatttgcttatttata

SEQ ID NO: 4281390 - DNA, 13 bp, Homo sapiens
gaaatcctgttac

SEQ ID NO: 4281391 - DNA, 15 bp, Homo sapiens
gaaattatatctgtg

SEQ ID NO: 4281392 - DNA, 15 bp, Homo sapiens
gaaattcacactgtg

SEQ ID NO: 4281393 - DNA, 16 bp, Homo sapiens
gaaattcacactgtgc

SEQ ID NO: 4281394 - DNA, 13 bp, Homo sapiens
gaaatttgttaat

SEQ ID NO: 4281395 - DNA, 15 bp, Homo sapiens
gaaattttatctctt

SEQ ID NO: 4281396 - DNA, 16 bp, Homo sapiens
gaaattttatctcttc

SEQ ID NO: 4281397 - DNA, 23 bp, Homo sapiens
gaacaaatatgattctcctctcc

SEQ ID NO: 4281398 - DNA, 13 bp, Homo sapiens
gaacaatgaatgc

SEQ ID NO: 4281399 - DNA, 13 bp, Homo sapiens
gaacacccagccc

SEQ ID NO: 4281400 - DNA, 14 bp, Homo sapiens
gaacacccagcccc

SEQ ID NO: 4281401 - DNA, 16 bp, Homo sapiens
gaacacccagccccag

SEQ ID NO: 4281402 - DNA, 15 bp, Homo sapiens
gaacagacctcggct

SEQ ID NO: 4281403 - DNA, 14 bp, Homo sapiens
gaacagagtatata

SEQ ID NO: 4281404 - DNA, 17 bp, Homo sapiens
gaacaggaggaactggt

SEQ ID NO: 4281405 - DNA, 18 bp, Homo sapiens
gaacatttgggagactga

SEQ ID NO: 4281406 - DNA, 20 bp, Homo sapiens
gaaccagtccctctgagtga

SEQ ID NO: 4281407 - DNA, 14 bp, Homo sapiens
gaacccccctcccc

SEQ ID NO: 4281408 - DNA, 19 bp, Homo sapiens
gaacctcgaagctgttctc

SEQ ID NO: 4281409 - DNA, 20 bp, Homo sapiens
gaacctcgttgacatgcaca

SEQ ID NO: 4281410 - DNA, 16 bp, Homo sapiens
gaacgatccttcaaag

SEQ ID NO: 4281411 - DNA, 14 bp, Homo sapiens
gaactaggtgctgg

SEQ ID NO: 4281412 - DNA, 16 bp, Homo sapiens
gaactaggtgctggca

SEQ ID NO: 4281413 - DNA, 17 bp, Homo sapiens
gaactaggtgctggcat

SEQ ID NO: 4281414 - DNA, 20 bp, Homo sapiens
gaactcagctgtctgtggct

SEQ ID NO: 4281415 - DNA, 21 bp, Homo sapiens
gaactcagctgtctgtggctt

SEQ ID NO: 4281416 - DNA, 17 bp, Homo sapiens
gaactgagctcctctgg

SEQ ID NO: 4281417 - DNA, 21 bp, Homo sapiens
gaactgagctcctctgggcag

SEQ ID NO: 4281418 - DNA, 14 bp, Homo sapiens
gaactgcaacactg

SEQ ID NO: 4281419 - DNA, 16 bp, Homo sapiens
gaactgcaacactgga

SEQ ID NO: 4281420 - DNA, 20 bp, Homo sapiens
gaactgctgctggtcacccc

SEQ ID NO: 4281421 - DNA, 18 bp, Homo sapiens
gaactggccgctgggaga

SEQ ID NO: 4281422 - DNA, 16 bp, Homo sapiens
gaactggtccaggcca

SEQ ID NO: 4281423 - DNA, 17 bp, Homo sapiens
gaactggtccaggccag

SEQ ID NO: 4281424 - DNA, 20 bp, Homo sapiens
gaactgtcccacaaaatatt

SEQ ID NO: 4281425 - DNA, 15 bp, Homo sapiens
gaacttgatgttcct

SEQ ID NO: 4281426 - DNA, 19 bp, Homo sapiens
gaacttgatgttcctggga

SEQ ID NO: 4281427 - DNA, 17 bp, Homo sapiens
gaacttggggaacaagg

SEQ ID NO: 4281428 - DNA, 13 bp, Homo sapiens
gaagaaaataacc

SEQ ID NO: 4281429 - DNA, 16 bp, Homo sapiens
gaagaaaatgagatgg

SEQ ID NO: 4281430 - DNA, 13 bp, Homo sapiens
gaagaatataaat

SEQ ID NO: 4281431 - DNA, 14 bp, Homo sapiens
gaagaatattgtat

SEQ ID NO: 4281432 - DNA, 13 bp, Homo sapiens
gaagacttcaaaa

SEQ ID NO: 4281433 - DNA, 18 bp, Homo sapiens
gaagagagatatatctga

SEQ ID NO: 4281434 - DNA, 19 bp, Homo sapiens
gaagagagtatggtgctgg

SEQ ID NO: 4281435 - DNA, 21 bp, Homo sapiens
gaagagattagcatgaaaggt

SEQ ID NO: 4281436 - DNA, 22 bp, Homo sapiens
gaagaggccgctgcagggtggc

SEQ ID NO: 4281437 - DNA, 13 bp, Homo sapiens
gaagagggagaag

SEQ ID NO: 4281438 - DNA, 15 bp, Homo sapiens
gaagagggagaagga

SEQ ID NO: 4281439 - DNA, 17 bp, Homo sapiens
gaagagtctattgtctc

SEQ ID NO: 4281440 - DNA, 22 bp, Homo sapiens
gaagatccgagcgacggctcct

SEQ ID NO: 4281441 - DNA, 19 bp, Homo sapiens
gaagatcctccttccaggc

SEQ ID NO: 4281442 - DNA, 20 bp, Homo sapiens
gaagatcctccttccaggcc

SEQ ID NO: 4281443 - DNA, 21 bp, Homo sapiens
gaagattctaaaacattcttt

SEQ ID NO: 4281444 - DNA, 16 bp, Homo sapiens
gaagcaccagcctcag

SEQ ID NO: 4281445 - DNA, 14 bp, Homo sapiens
gaagcagagcctgg

SEQ ID NO: 4281446 - DNA, 15 bp, Homo sapiens
gaagcagagcctggg

SEQ ID NO: 4281447 - DNA, 19 bp, Homo sapiens
gaagcagagcctggggtgg

SEQ ID NO: 4281448 - DNA, 19 bp, Homo sapiens
gaagcattctccccagtgt

SEQ ID NO: 4281449 - DNA, 13 bp, Homo sapiens
gaagcccaggagg

SEQ ID NO: 4281450 - DNA, 14 bp, Homo sapiens
gaagcccaggagga

SEQ ID NO: 4281451 - DNA, 20 bp, Homo sapiens
gaagcctccacctgcagccc

SEQ ID NO: 4281452 - DNA, 13 bp, Homo sapiens
gaagctcagccca

SEQ ID NO: 4281453 - DNA, 20 bp, Homo sapiens
gaggaaaaccaagccgtggc

SEQ ID NO: 4281454 - DNA, 17 bp, Homo sapiens
gaggaaactcacctgct

SEQ ID NO: 4281455 - DNA, 22 bp, Homo sapiens
gaggaaactcacctgctggccc

SEQ ID NO: 4281456 - DNA, 23 bp, Homo sapiens
gaggaaactcacctgctggcccc

SEQ ID NO: 4281457 - DNA, 15 bp, Homo sapiens
gaggaaccagagcca

SEQ ID NO: 4281458 - DNA, 14 bp, Homo sapiens
gaggaactggtcca

SEQ ID NO: 4281459 - DNA, 17 bp, Homo sapiens
gaggaactggtccaggc

SEQ ID NO: 4281460 - DNA, 19 bp, Homo sapiens
gaggaactggtccaggcca

SEQ ID NO: 4281461 - DNA, 23 bp, Homo sapiens
gaggaagccacgtgctggagagt

SEQ ID NO: 4281462 - DNA, 17 bp, Homo sapiens
gaggaagggactggtcc

SEQ ID NO: 4281463 - DNA, 18 bp, Homo sapiens
gaggaagggaggcctgag

SEQ ID NO: 4281464 - DNA, 20 bp, Homo sapiens
gaggaagggaggcctgaggg

SEQ ID NO: 4281465 - DNA, 13 bp, Homo sapiens
gaggacagggagg

SEQ ID NO: 4281466 - DNA, 14 bp, Homo sapiens
gaggacagggaggg

SEQ ID NO: 4281467 - DNA, 16 bp, Homo sapiens
gaggacctccacctgg

SEQ ID NO: 4281468 - DNA, 21 bp, Homo sapiens
gaggacctccacctgggagat

SEQ ID NO: 4281469 - DNA, 22 bp, Homo sapiens
gaggacctccacctgggagatg

SEQ ID NO: 4281470 - DNA, 17 bp, Homo sapiens
gaggagaacttgaacaa

SEQ ID NO: 4281471 - DNA, 17 bp, Homo sapiens
gaggagactcaggccca

SEQ ID NO: 4281472 - DNA, 17 bp, Homo sapiens
gaggagattgctctggg

SEQ ID NO: 4281473 - DNA, 19 bp, Homo sapiens
gaggagcagcccacctgct

SEQ ID NO: 4281474 - DNA, 19 bp, Homo sapiens
gaggagcaggaagcaaggc

SEQ ID NO: 4281475 - DNA, 22 bp, Homo sapiens
gaggagcaggaagcaaggccag

SEQ ID NO: 4281476 - DNA, 21 bp, Homo sapiens
gaggagcctttccagaactac

SEQ ID NO: 4281477 - DNA, 15 bp, Homo sapiens
gaggagcgtgtccta

SEQ ID NO: 4281478 - DNA, 20 bp, Homo sapiens
gaggaggtaacatagatgcc

SEQ ID NO: 4281479 - DNA, 17 bp, Homo sapiens
gaggaggtgcccgggca

SEQ ID NO: 4281480 - DNA, 20 bp, Homo sapiens
gaggaggtgtggagtggagg

SEQ ID NO: 4281481 - DNA, 15 bp, Homo sapiens
gaggcagaatggtgg

SEQ ID NO: 4281482 - DNA, 22 bp, Homo sapiens
gaggcagaatggtgggctccag

SEQ ID NO: 4281483 - DNA, 23 bp, Homo sapiens
gaggcagaatggtgggctccaga

SEQ ID NO: 4281484 - DNA, 13 bp, Homo sapiens
gaggcagaggaca

SEQ ID NO: 4281485 - DNA, 19 bp, Homo sapiens
gaggcagcaacaggaccag

SEQ ID NO: 4281486 - DNA, 15 bp, Homo sapiens
gaggcaggggctggg

SEQ ID NO: 4281487 - DNA, 16 bp, Homo sapiens
gaggcaggggctgggc

SEQ ID NO: 4281488 - DNA, 13 bp, Homo sapiens
gaggcagtggcag

SEQ ID NO: 4281489 - DNA, 21 bp, Homo sapiens
gaggcattcagcaattaaaga

SEQ ID NO: 4281490 - DNA, 22 bp, Homo sapiens
gaggccacatgagtcccagtgg

SEQ ID NO: 4281491 - DNA, 23 bp, Homo sapiens
gaggccacatgagtcccagtggg

SEQ ID NO: 4281492 - DNA, 16 bp, Homo sapiens
gaggccagaggaaggg

SEQ ID NO: 4281493 - DNA, 20 bp, Homo sapiens
gaggccatgattcgcccaaa

SEQ ID NO: 4281494 - DNA, 13 bp, Homo sapiens
gaggcccagggag

SEQ ID NO: 4281495 - DNA, 15 bp, Homo sapiens
gaggccccttgctgc

SEQ ID NO: 4281496 - DNA, 19 bp, Homo sapiens
gaggccccttgctgctggc

SEQ ID NO: 4281497 - DNA, 13 bp, Homo sapiens
gaggccgaggcag

SEQ ID NO: 4281498 - DNA, 18 bp, Homo sapiens
gaggccgaggcaggggct

SEQ ID NO: 4281499 - DNA, 15 bp, Homo sapiens
gaggccgctgcaggg

SEQ ID NO: 4281500 - DNA, 16 bp, Homo sapiens
gaggcctcagtggact

SEQ ID NO: 4281501 - DNA, 22 bp, Homo sapiens
gaggcctgaaatgtttccaggc

SEQ ID NO: 4281502 - DNA, 13 bp, Homo sapiens
gaggcctggtgcc

SEQ ID NO: 4281503 - DNA, 16 bp, Homo sapiens
gaggcctggtgccctg

SEQ ID NO: 4281504 - DNA, 15 bp, Homo sapiens
gaggcgccttcctgg

SEQ ID NO: 4281505 - DNA, 19 bp, Homo sapiens
gaggcgccttcctgggttg

SEQ ID NO: 4281506 - DNA, 13 bp, Homo sapiens
gaggcgtcttgta

SEQ ID NO: 4281507 - DNA, 15 bp, Homo sapiens
gaggctaagcctgga

SEQ ID NO: 4281508 - DNA, 22 bp, Homo sapiens
gaggctattcctaggcctcagg

SEQ ID NO: 4281509 - DNA, 22 bp, Homo sapiens
gaggcttgggaccgccagatgg

SEQ ID NO: 4281510 - DNA, 21 bp, Homo sapiens
gaggcttgtcagagctgggag

SEQ ID NO: 4281511 - DNA, 12 bp, Homo sapiens
gagggaaacctt

SEQ ID NO: 4281512 - DNA, 13 bp, Homo sapiens
gagggaaaccttt

SEQ ID NO: 4281513 - DNA, 18 bp, Homo sapiens
gagggaattgaggtctgc

SEQ ID NO: 4281514 - DNA, 21 bp, Homo sapiens
gagggactttgctgatttccc

SEQ ID NO: 4281515 - DNA, 22 bp, Homo sapiens
gagggagaaggagaggctctga

SEQ ID NO: 4281516 - DNA, 14 bp, Homo sapiens
gagggagactgacc

SEQ ID NO: 4281517 - DNA, 15 bp, Homo sapiens
gagggagactgaccc

SEQ ID NO: 4281518 - DNA, 16 bp, Homo sapiens
gagggagactgaccca

SEQ ID NO: 4281519 - DNA, 18 bp, Homo sapiens
gagggcactggtggcccg

SEQ ID NO: 4281520 - DNA, 23 bp, Homo sapiens
gagggcaggggctgcatcctcag

SEQ ID NO: 4281521 - DNA, 14 bp, Homo sapiens
gaggggactgcatg

SEQ ID NO: 4281522 - DNA, 15 bp, Homo sapiens
gaggggagaggaagc

SEQ ID NO: 4281523 - DNA, 13 bp, Homo sapiens
gaggggcctgcca

SEQ ID NO: 4281524 - DNA, 14 bp, Homo sapiens
gaggggcctgccac

SEQ ID NO: 4281525 - DNA, 22 bp, Homo sapiens
gaggggcctgccactctcctga

SEQ ID NO: 4281526 - DNA, 14 bp, Homo sapiens
gaggggcctggcag

SEQ ID NO: 4281527 - DNA, 20 bp, Homo sapiens
gaggggcctggcagccgtgc

SEQ ID NO: 4281528 - DNA, 16 bp, Homo sapiens
gagggtgacagaggga

SEQ ID NO: 4281529 - DNA, 17 bp, Homo sapiens
gagggtgacagagggac

SEQ ID NO: 4281530 - DNA, 21 bp, Homo sapiens
gaggtaacatagatgcctggg

SEQ ID NO: 4281531 - DNA, 22 bp, Homo sapiens
gaggtaacatagatgcctgggc

SEQ ID NO: 4281532 - DNA, 24 bp, Homo sapiens
gaggtaacatagatgcctgggcct

SEQ ID NO: 4281533 - DNA, 18 bp, Homo sapiens
gaggtatcttactttcct

SEQ ID NO: 4281534 - DNA, 19 bp, Homo sapiens
gaggtcacaataaagtgta

SEQ ID NO: 4281535 - DNA, 19 bp, Homo sapiens
gaggtcatcccggggccat

SEQ ID NO: 4281536 - DNA, 22 bp, Homo sapiens
gaggtcatcccggggccatgga

SEQ ID NO: 4281537 - DNA, 14 bp, Homo sapiens
gaggtgtggagtgg

SEQ ID NO: 4281538 - DNA, 17 bp, Homo sapiens
gaggtgtggagtggagg

SEQ ID NO: 4281539 - DNA, 15 bp, Homo sapiens
gagtaaaattacaga

SEQ ID NO: 4281540 - DNA, 15 bp, Homo sapiens
gagtaggctgtattt

SEQ ID NO: 4281541 - DNA, 19 bp, Homo sapiens
gagtaggctgtattttctt

SEQ ID NO: 4281542 - DNA, 15 bp, Homo sapiens
gagtatatatgtaca

SEQ ID NO: 4281543 - DNA, 17 bp, Homo sapiens
gagtatatatgtacagt

SEQ ID NO: 4281544 - DNA, 17 bp, Homo sapiens
gagtatggtgctgggtc

SEQ ID NO: 4281545 - DNA, 18 bp, Homo sapiens
gagtcaagtgtgcctgct

SEQ ID NO: 4281546 - DNA, 14 bp, Homo sapiens
gagtcattgttaca

SEQ ID NO: 4281547 - DNA, 13 bp, Homo sapiens
gagtccagacctg

SEQ ID NO: 4281548 - DNA, 14 bp, Homo sapiens
gagtccattgcaaa

SEQ ID NO: 4281549 - DNA, 15 bp, Homo sapiens
gagtctcttctccac

SEQ ID NO: 4281550 - DNA, 20 bp, Homo sapiens
gagtctgaaggagaggagtg

SEQ ID NO: 4281551 - DNA, 21 bp, Homo sapiens
gagtctggagaccaggactct

SEQ ID NO: 4281552 - DNA, 21 bp, Homo sapiens
gagtctgtgaataaagccaca

SEQ ID NO: 4281553 - DNA, 16 bp, Homo sapiens
gagtgaagtccagtga

SEQ ID NO: 4281554 - DNA, 19 bp, Homo sapiens
gagtgacatcggttcagga

SEQ ID NO: 4281555 - DNA, 20 bp, Homo sapiens
gagtgacatgcggctgccca

SEQ ID NO: 4281556 - DNA, 16 bp, Homo sapiens
gagtgaggtcatcccg

SEQ ID NO: 4281557 - DNA, 19 bp, Homo sapiens
gagtgagtgtggctcccct

SEQ ID NO: 4281558 - DNA, 12 bp, Homo sapiens
gagtgcacagct

SEQ ID NO: 4281559 - DNA, 16 bp, Homo sapiens
gagtgcacagctgtcc

SEQ ID NO: 4281560 - DNA, 13 bp, Homo sapiens
gagtgccccagaa

SEQ ID NO: 4281561 - DNA, 24 bp, Homo sapiens
gagtgctcaacctacagtggaggg

SEQ ID NO: 4281562 - DNA, 18 bp, Homo sapiens
gagtggatctggagtctg

SEQ ID NO: 4281563 - DNA, 17 bp, Homo sapiens
gagtgggtgggacacag

SEQ ID NO: 4281564 - DNA, 22 bp, Homo sapiens
gagtggtaacaagaggagcagg

SEQ ID NO: 4281565 - DNA, 15 bp, Homo sapiens
gagtgtgcaatatgt

SEQ ID NO: 4281566 - DNA, 20 bp, Homo sapiens
gagtgtggaaaaaaaaagaa

SEQ ID NO: 4281567 - DNA, 17 bp, Homo sapiens
gagtgtggctcccctct

SEQ ID NO: 4281568 - DNA, 12 bp, Homo sapiens
gagtgtgtgggg

SEQ ID NO: 4281569 - DNA, 12 bp, Homo sapiens
gagttcctgcat

SEQ ID NO: 4281570 - DNA, 18 bp, Homo sapiens
gagttctaacacatttcg

SEQ ID NO: 4281571 - DNA, 15 bp, Homo sapiens
gagttcttcctgtaa

SEQ ID NO: 4281572 - DNA, 18 bp, Homo sapiens
gagttgaggggcttccct

SEQ ID NO: 4281573 - DNA, 22 bp, Homo sapiens
gagttgggctggtttggtggcc

SEQ ID NO: 4281574 - DNA, 23 bp, Homo sapiens
gagtttaaaaaaataacatctga

SEQ ID NO: 4281575 - DNA, 15 bp, Homo sapiens
gataaagtgaccagg

SEQ ID NO: 4281576 - DNA, 18 bp, Homo sapiens
gataaatccaactctgac

SEQ ID NO: 4281577 - DNA, 22 bp, Homo sapiens
gataagtggaaaaaagagaaaa

SEQ ID NO: 4281578 - DNA, 17 bp, Homo sapiens
gataataactagatctc

SEQ ID NO: 4281579 - DNA, 18 bp, Homo sapiens
gataatagtaatggttct

SEQ ID NO: 4281580 - DNA, 19 bp, Homo sapiens
gataatagtaatggttcta

SEQ ID NO: 4281581 - DNA, 23 bp, Homo sapiens
gataatagtaatggttctagaag

SEQ ID NO: 4281582 - DNA, 21 bp, Homo sapiens
gccctcactccactcccctca

SEQ ID NO: 4281583 - DNA, 19 bp, Homo sapiens
gccctccccctgccagagg

SEQ ID NO: 4281584 - DNA, 10 bp, Homo sapiens
gccctccctc

SEQ ID NO: 4281585 - DNA, 23 bp, Homo sapiens
gccctccctcggccccacccacc

SEQ ID NO: 4281586 - DNA, 16 bp, Homo sapiens
gccctccctgctgcca

SEQ ID NO: 4281587 - DNA, 23 bp, Homo sapiens
gccctccgcgggggacaggaaca

SEQ ID NO: 4281588 - DNA, 18 bp, Homo sapiens
gccctccgtcctggcagg

SEQ ID NO: 4281589 - DNA, 15 bp, Homo sapiens
gccctcctccctccg

SEQ ID NO: 4281590 - DNA, 23 bp, Homo sapiens
gccctcctgaaacttacacacaa

SEQ ID NO: 4281591 - DNA, 21 bp, Homo sapiens
gccctctcttaatgccacggc

SEQ ID NO: 4281592 - DNA, 18 bp, Homo sapiens
gccctctgccactgacag

SEQ ID NO: 4281593 - DNA, 17 bp, Homo sapiens
gccctgaggggcctgcc

SEQ ID NO: 4281594 - DNA, 19 bp, Homo sapiens
gccctgaggggcctgccac

SEQ ID NO: 4281595 - DNA, 10 bp, Homo sapiens
gccctgcccc

SEQ ID NO: 4281596 - DNA, 15 bp, Homo sapiens
gccctgccccccaca

SEQ ID NO: 4281597 - DNA, 19 bp, Homo sapiens
gccctgctcaggcctcacc

SEQ ID NO: 4281598 - DNA, 14 bp, Homo sapiens
gccctgctgccccc

SEQ ID NO: 4281599 - DNA, 16 bp, Homo sapiens
gccctgctttgggctg

SEQ ID NO: 4281600 - DNA, 18 bp, Homo sapiens
gccctgctttgggctgcc

SEQ ID NO: 4281601 - DNA, 19 bp, Homo sapiens
gccctgctttgggctgccc

SEQ ID NO: 4281602 - DNA, 15 bp, Homo sapiens
gccctggcccagcct

SEQ ID NO: 4281603 - DNA, 21 bp, Homo sapiens
gccctggcccagcctgtggcc

SEQ ID NO: 4281604 - DNA, 19 bp, Homo sapiens
gccctggctcccacaggcc

SEQ ID NO: 4281605 - DNA, 15 bp, Homo sapiens
gccctgggctctggg

SEQ ID NO: 4281606 - DNA, 13 bp, Homo sapiens
gccctggtctggc

SEQ ID NO: 4281607 - DNA, 14 bp, Homo sapiens
gccctgtcagtgca

SEQ ID NO: 4281608 - DNA, 17 bp, Homo sapiens
gccctgtggaagggact

SEQ ID NO: 4281609 - DNA, 15 bp, Homo sapiens
gccctgttgtggggg

SEQ ID NO: 4281610 - DNA, 21 bp, Homo sapiens
gcccttcagcatcctcagttc

SEQ ID NO: 4281611 - DNA, 15 bp, Homo sapiens
gcccttcccaacctc

SEQ ID NO: 4281612 - DNA, 15 bp, Homo sapiens
gcccttcctctccac

SEQ ID NO: 4281613 - DNA, 21 bp, Homo sapiens
gccctttcacccctcttccca

SEQ ID NO: 4281614 - DNA, 18 bp, Homo sapiens
gccgagctctcctgggcc

SEQ ID NO: 4281615 - DNA, 21 bp, Homo sapiens
gccgagctctcctgggccagg

SEQ ID NO: 4281616 - DNA, 18 bp, Homo sapiens
gccgaggcaggggctggg

SEQ ID NO: 4281617 - DNA, 13 bp, Homo sapiens
gccgagggaaatg

SEQ ID NO: 4281618 - DNA, 19 bp, Homo sapiens
gccgagggaaatgctgttg

SEQ ID NO: 4281619 - DNA, 22 bp, Homo sapiens
gccgcaaatccataccccctgc

SEQ ID NO: 4281620 - DNA, 13 bp, Homo sapiens
gccgcctgtcctt

SEQ ID NO: 4281621 - DNA, 23 bp, Homo sapiens
gccgctagatgggcatggggtgg

SEQ ID NO: 4281622 - DNA, 13 bp, Homo sapiens
gccgctgcagggt

SEQ ID NO: 4281623 - DNA, 13 bp, Homo sapiens
gccgcttcgccat

SEQ ID NO: 4281624 - DNA, 12 bp, Homo sapiens
gccggccctgcc

SEQ ID NO: 4281625 - DNA, 17 bp, Homo sapiens
gccgggctggcttctcc

SEQ ID NO: 4281626 - DNA, 20 bp, Homo sapiens
gccgggctggcttctccctg

SEQ ID NO: 4281627 - DNA, 15 bp, Homo sapiens
gccggggagctgagg

SEQ ID NO: 4281628 - DNA, 21 bp, Homo sapiens
gccggggagctgaggggcagg

SEQ ID NO: 4281629 - DNA, 14 bp, Homo sapiens
gccgggggtggggg

SEQ ID NO: 4281630 - DNA, 23 bp, Homo sapiens
gccgggggtgggggcctgctgtg

SEQ ID NO: 4281631 - DNA, 19 bp, Homo sapiens
gccgtcttcactcgccccc

SEQ ID NO: 4281632 - DNA, 21 bp, Homo sapiens
gccgtcttcactcgcccccgg

SEQ ID NO: 4281633 - DNA, 22 bp, Homo sapiens
gccgtcttcactcgcccccggg

SEQ ID NO: 4281634 - DNA, 19 bp, Homo sapiens
gccgtgcacggggccagca

SEQ ID NO: 4281635 - DNA, 17 bp, Homo sapiens
gccgtgccttcagctct

SEQ ID NO: 4281636 - DNA, 19 bp, Homo sapiens
gccgtgccttcagctctac

SEQ ID NO: 4281637 - DNA, 18 bp, Homo sapiens
gccgtggagtcgagctgg

SEQ ID NO: 4281638 - DNA, 21 bp, Homo sapiens
gccgtggcttcccgctcagcc

SEQ ID NO: 4281639 - DNA, 22 bp, Homo sapiens
gccgtggcttcccgctcagccc

SEQ ID NO: 4281640 - DNA, 18 bp, Homo sapiens
gccgtgtctgtggccctc

SEQ ID NO: 4281641 - DNA, 21 bp, Homo sapiens
gccgtgtctgtggccctctct

SEQ ID NO: 4281642 - DNA, 20 bp, Homo sapiens
gccgttgcctctctgccagc

SEQ ID NO: 4281643 - DNA, 15 bp, Homo sapiens
gcctaataaacaatt

SEQ ID NO: 4281644 - DNA, 17 bp, Homo sapiens
gcctacaaatcagtaat

SEQ ID NO: 4281645 - DNA, 12 bp, Homo sapiens
gcctaggagctg

SEQ ID NO: 4281646 - DNA, 14 bp, Homo sapiens
gcctaggagctggg

SEQ ID NO: 4281647 - DNA, 12 bp, Homo sapiens
gcctaggccagc

SEQ ID NO: 4281648 - DNA, 14 bp, Homo sapiens
gcctaggccagctc

SEQ ID NO: 4281649 - DNA, 18 bp, Homo sapiens
gcctagtggcttcagccc

SEQ ID NO: 4281650 - DNA, 20 bp, Homo sapiens
gcctagtggcttcagcccct

SEQ ID NO: 4281651 - DNA, 22 bp, Homo sapiens
gcctagtggcttcagcccctgg

SEQ ID NO: 4281652 - DNA, 23 bp, Homo sapiens
gcctagtggcttcagcccctggg

SEQ ID NO: 4281653 - DNA, 16 bp, Homo sapiens
gcctatgccacctgca

SEQ ID NO: 4281654 - DNA, 15 bp, Homo sapiens
gcctatggaaagggt

SEQ ID NO: 4281655 - DNA, 13 bp, Homo sapiens
gcctcaaatgcag

SEQ ID NO: 4281656 - DNA, 15 bp, Homo sapiens
gcctcaaccctccct

SEQ ID NO: 4281657 - DNA, 19 bp, Homo sapiens
gcctcaaccctccctcagc

SEQ ID NO: 4281658 - DNA, 22 bp, Homo sapiens
gcctcaaccctccctcagcccc

SEQ ID NO: 4281659 - DNA, 18 bp, Homo sapiens
gcctcaagtcggtgggcc

SEQ ID NO: 4281660 - DNA, 14 bp, Homo sapiens
gcctcacccctgca

SEQ ID NO: 4281661 - DNA, 15 bp, Homo sapiens
gcctcacccctgcag

SEQ ID NO: 4281662 - DNA, 17 bp, Homo sapiens
gcctcacccctgcaggc

SEQ ID NO: 4281663 - DNA, 12 bp, Homo sapiens
gcctcacctggc

SEQ ID NO: 4281664 - DNA, 13 bp, Homo sapiens
gcctcacctggct

SEQ ID NO: 4281665 - DNA, 14 bp, Homo sapiens
gcctcacctggctt

SEQ ID NO: 4281666 - DNA, 16 bp, Homo sapiens
gcctcacctggcttcc

SEQ ID NO: 4281667 - DNA, 20 bp, Homo sapiens
gcctcacctggcttcccagg

SEQ ID NO: 4281668 - DNA, 22 bp, Homo sapiens
gcctcacctggcttcccaggac

SEQ ID NO: 4281669 - DNA, 22 bp, Homo sapiens
gcctcagaggccccttgctgct

SEQ ID NO: 4281670 - DNA, 15 bp, Homo sapiens
gcctcagcatctcat

SEQ ID NO: 4281671 - DNA, 13 bp, Homo sapiens
gcctcagccactc

SEQ ID NO: 4281672 - DNA, 20 bp, Homo sapiens
gcctcagccactcccagggg

SEQ ID NO: 4281673 - DNA, 16 bp, Homo sapiens
gcctcaggaggcagtg

SEQ ID NO: 4281674 - DNA, 15 bp, Homo sapiens
gcctcaggcctccca

SEQ ID NO: 4281675 - DNA, 12 bp, Homo sapiens
gcctcaggcctg

SEQ ID NO: 4281676 - DNA, 15 bp, Homo sapiens
gcctcagggaccaag

SEQ ID NO: 4281677 - DNA, 11 bp, Homo sapiens
gcctcagtgga

SEQ ID NO: 4281678 - DNA, 12 bp, Homo sapiens
gcctcatcctcc

SEQ ID NO: 4281679 - DNA, 21 bp, Homo sapiens
gcctcatgaacactggctgca

SEQ ID NO: 4281680 - DNA, 20 bp, Homo sapiens
gcctcatgggagtcagggag

SEQ ID NO: 4281681 - DNA, 14 bp, Homo sapiens
gcctccacctgcag

SEQ ID NO: 4281682 - DNA, 15 bp, Homo sapiens
gcctccacctgcagc

SEQ ID NO: 4281683 - DNA, 21 bp, Homo sapiens
gcctccacctgcagccccagg

SEQ ID NO: 4281684 - DNA, 21 bp, Homo sapiens
gcctccagccctctcactgtg

SEQ ID NO: 4281685 - DNA, 14 bp, Homo sapiens
gcctcccagccacc

SEQ ID NO: 4281686 - DNA, 19 bp, Homo sapiens
gcctcccgcatgctgcctg

SEQ ID NO: 4281687 - DNA, 20 bp, Homo sapiens
gcctcccgcatgctgcctgc

SEQ ID NO: 4281688 - DNA, 14 bp, Homo sapiens
gcctccctcagcca

SEQ ID NO: 4281689 - DNA, 19 bp, Homo sapiens
gcctccctcagccacgcct

SEQ ID NO: 4281690 - DNA, 16 bp, Homo sapiens
gcctcctcccatccag

SEQ ID NO: 4281691 - DNA, 22 bp, Homo sapiens
gcctcctgctgagtggtccaca

SEQ ID NO: 4281692 - DNA, 13 bp, Homo sapiens
gcctcctgtgtaa

SEQ ID NO: 4281693 - DNA, 13 bp, Homo sapiens
gcctcgcccctcc

SEQ ID NO: 4281694 - DNA, 14 bp, Homo sapiens
gcctcgcccctcca

SEQ ID NO: 4281695 - DNA, 17 bp, Homo sapiens
gcctctctcagcccagg

SEQ ID NO: 4281696 - DNA, 22 bp, Homo sapiens
gcctctctcagcccaggtctcc

SEQ ID NO: 4281697 - DNA, 14 bp, Homo sapiens
gcctctctgccagc

SEQ ID NO: 4281698 - DNA, 18 bp, Homo sapiens
gcctctctgccagccgct

SEQ ID NO: 4281699 - DNA, 15 bp, Homo sapiens
gcctctgaaaatatt

SEQ ID NO: 4281700 - DNA, 17 bp, Homo sapiens
gcctctgaactgctgct

SEQ ID NO: 4281701 - DNA, 20 bp, Homo sapiens
gcctctgaactgctgctggt

SEQ ID NO: 4281702 - DNA, 21 bp, Homo sapiens
gcctctgcacgtgcacacacc

SEQ ID NO: 4281703 - DNA, 22 bp, Homo sapiens
gcctctgcacgtgcacacacct

SEQ ID NO: 4281704 - DNA, 13 bp, Homo sapiens
gcctctggcctgg

SEQ ID NO: 4281705 - DNA, 13 bp, Homo sapiens
gcctctgggctca

SEQ ID NO: 4281706 - DNA, 12 bp, Homo sapiens
gcctctggggag

SEQ ID NO: 4281707 - DNA, 22 bp, Homo sapiens
gcctgaaatgtttccaggcatg

SEQ ID NO: 4281708 - DNA, 22 bp, Homo sapiens
gcctgaactaggtgctggcatg

SEQ ID NO: 4281709 - DNA, 13 bp, Homo sapiens
gcctgagaagagt

SEQ ID NO: 4281710 - DNA, 18 bp, Homo sapiens
gcctgagaatgcctaggc

SEQ ID NO: 4281711 - DNA, 20 bp, Homo sapiens
gcctgagaatgcctaggcca

SEQ ID NO: 4281712 - DNA, 17 bp, Homo sapiens
ggaataagaagcaaata

SEQ ID NO: 4281713 - DNA, 14 bp, Homo sapiens
ggaatcagggagca

SEQ ID NO: 4281714 - DNA, 19 bp, Homo sapiens
ggaatcgaggaaccagagc

SEQ ID NO: 4281715 - DNA, 13 bp, Homo sapiens
ggaatgctccccc

SEQ ID NO: 4281716 - DNA, 13 bp, Homo sapiens
ggacaagcccagg

SEQ ID NO: 4281717 - DNA, 16 bp, Homo sapiens
ggacaagtaggtaaga

SEQ ID NO: 4281718 - DNA, 15 bp, Homo sapiens
ggacactacaaacat

SEQ ID NO: 4281719 - DNA, 23 bp, Homo sapiens
ggacaggaacacccagccccagc

SEQ ID NO: 4281720 - DNA, 11 bp, Homo sapiens
ggacagggcca

SEQ ID NO: 4281721 - DNA, 16 bp, Homo sapiens
ggacagggccagggtt

SEQ ID NO: 4281722 - DNA, 17 bp, Homo sapiens
ggacagggccagggttg

SEQ ID NO: 4281723 - DNA, 15 bp, Homo sapiens
ggaccaaaactgcct

SEQ ID NO: 4281724 - DNA, 20 bp, Homo sapiens
ggaccaaaactgcctaccca

SEQ ID NO: 4281725 - DNA, 15 bp, Homo sapiens
ggaccaaggacccct

SEQ ID NO: 4281726 - DNA, 14 bp, Homo sapiens
ggaccaggagccag

SEQ ID NO: 4281727 - DNA, 13 bp, Homo sapiens
ggacccagcaggg

SEQ ID NO: 4281728 - DNA, 15 bp, Homo sapiens
ggacccagcaggggc

SEQ ID NO: 4281729 - DNA, 11 bp, Homo sapiens
ggacccagctg

SEQ ID NO: 4281730 - DNA, 20 bp, Homo sapiens
ggaccccatctgctgagctc

SEQ ID NO: 4281731 - DNA, 13 bp, Homo sapiens
ggacccctcacct

SEQ ID NO: 4281732 - DNA, 21 bp, Homo sapiens
ggacccggaggggcctggcag

SEQ ID NO: 4281733 - DNA, 20 bp, Homo sapiens
ggaccctcggggcaggaagt

SEQ ID NO: 4281734 - DNA, 23 bp, Homo sapiens
ggaccgccagatggggcctctgt

SEQ ID NO: 4281735 - DNA, 17 bp, Homo sapiens
ggaccggacgcatgcag

SEQ ID NO: 4281736 - DNA, 23 bp, Homo sapiens
ggaccgggccgctagatgggcat

SEQ ID NO: 4281737 - DNA, 21 bp, Homo sapiens
ggacctcagagtccaggcccc

SEQ ID NO: 4281738 - DNA, 13 bp, Homo sapiens
ggacctccacctg

SEQ ID NO: 4281739 - DNA, 19 bp, Homo sapiens
ggacctccacctgggagat

SEQ ID NO: 4281740 - DNA, 22 bp, Homo sapiens
ggacctccacctgggagatgct

SEQ ID NO: 4281741 - DNA, 19 bp, Homo sapiens
ggacctgcacttggcctct

SEQ ID NO: 4281742 - DNA, 22 bp, Homo sapiens
ggacctgcagttggcctcagca

SEQ ID NO: 4281743 - DNA, 13 bp, Homo sapiens
ggactccagttca

SEQ ID NO: 4281744 - DNA, 13 bp, Homo sapiens
ggactctgccttc

SEQ ID NO: 4281745 - DNA, 16 bp, Homo sapiens
ggactctgccttccag

SEQ ID NO: 4281746 - DNA, 17 bp, Homo sapiens
ggactctgccttccagg

SEQ ID NO: 4281747 - DNA, 18 bp, Homo sapiens
ggactctgccttccaggc

SEQ ID NO: 4281748 - DNA, 19 bp, Homo sapiens
ggactctgccttccaggcg

SEQ ID NO: 4281749 - DNA, 13 bp, Homo sapiens
ggactctggactg

SEQ ID NO: 4281750 - DNA, 16 bp, Homo sapiens
ggactgggaagggggc

SEQ ID NO: 4281751 - DNA, 17 bp, Homo sapiens
ggactgggaagggggca

SEQ ID NO: 4281752 - DNA, 18 bp, Homo sapiens
ggactgggaagggggcag

SEQ ID NO: 4281753 - DNA, 20 bp, Homo sapiens
ggactgttttttcctgagct

SEQ ID NO: 4281754 - DNA, 23 bp, Homo sapiens
ggactgttttttcctgagcttgg

SEQ ID NO: 4281755 - DNA, 13 bp, Homo sapiens
ggacttgtgcctc

SEQ ID NO: 4281756 - DNA, 21 bp, Homo sapiens
ggacttgtgcctcttgggaga

SEQ ID NO: 4281757 - DNA, 16 bp, Homo sapiens
ggactttccaccccct

SEQ ID NO: 4281758 - DNA, 17 bp, Homo sapiens
ggactttccaccccctc

SEQ ID NO: 4281759 - DNA, 20 bp, Homo sapiens
ggactttccaccccctccct

SEQ ID NO: 4281760 - DNA, 13 bp, Homo sapiens
ggagaaaagccag

SEQ ID NO: 4281761 - DNA, 15 bp, Homo sapiens
ggagaaaagccagat

SEQ ID NO: 4281762 - DNA, 22 bp, Homo sapiens
ggagaacctcgttgacatgcac

SEQ ID NO: 4281763 - DNA, 13 bp, Homo sapiens
ggagaactagaga

SEQ ID NO: 4281764 - DNA, 16 bp, Homo sapiens
ggagaaggcctgcccc

SEQ ID NO: 4281765 - DNA, 17 bp, Homo sapiens
ggagaaggcctgccccc

SEQ ID NO: 4281766 - DNA, 22 bp, Homo sapiens
ggagaagggttagacaagcctg

SEQ ID NO: 4281767 - DNA, 17 bp, Homo sapiens
ggagacagtcaggaagc

SEQ ID NO: 4281768 - DNA, 13 bp, Homo sapiens
ggagaccaggact

SEQ ID NO: 4281769 - DNA, 20 bp, Homo sapiens
ggagaccgagtgtggagctg

SEQ ID NO: 4281770 - DNA, 15 bp, Homo sapiens
ggagactatgtgtca

SEQ ID NO: 4281771 - DNA, 15 bp, Homo sapiens
ggagactgagcttga

SEQ ID NO: 4281772 - DNA, 20 bp, Homo sapiens
ggagacttaggccagaggtg

SEQ ID NO: 4281773 - DNA, 22 bp, Homo sapiens
ggagagaatgagagagtgtgga

SEQ ID NO: 4281774 - DNA, 20 bp, Homo sapiens
ggagagagttgaacctaaac

SEQ ID NO: 4281775 - DNA, 13 bp, Homo sapiens
ggagagcccccac

SEQ ID NO: 4281776 - DNA, 12 bp, Homo sapiens
ggagaggaagca

SEQ ID NO: 4281777 - DNA, 17 bp, Homo sapiens
ggagaggagagaatgag

SEQ ID NO: 4281778 - DNA, 14 bp, Homo sapiens
ggagaggagtgcgc

SEQ ID NO: 4281779 - DNA, 18 bp, Homo sapiens
ggagaggctctgaaagct

SEQ ID NO: 4281780 - DNA, 19 bp, Homo sapiens
ggagaggctctgaaagctg

SEQ ID NO: 4281781 - DNA, 16 bp, Homo sapiens
ggagatccgccctggg

SEQ ID NO: 4281782 - DNA, 21 bp, Homo sapiens
ggagatccgccctgggctctg

SEQ ID NO: 4281783 - DNA, 15 bp, Homo sapiens
ggagattgctctggg

SEQ ID NO: 4281784 - DNA, 14 bp, Homo sapiens
ggagcactggaggc

SEQ ID NO: 4281785 - DNA, 19 bp, Homo sapiens
ggagcactggaggcctctg

SEQ ID NO: 4281786 - DNA, 14 bp, Homo sapiens
ggagcactgtgcag

SEQ ID NO: 4281787 - DNA, 19 bp, Homo sapiens
ggagcactgtgcagccggg

SEQ ID NO: 4281788 - DNA, 22 bp, Homo sapiens
ggagcagcacgccaaccccagc

SEQ ID NO: 4281789 - DNA, 17 bp, Homo sapiens
ggagcagcccacctgct

SEQ ID NO: 4281790 - DNA, 18 bp, Homo sapiens
ggagcagcccacctgctg

SEQ ID NO: 4281791 - DNA, 16 bp, Homo sapiens
ggagcaggaagcaagg

SEQ ID NO: 4281792 - DNA, 18 bp, Homo sapiens
ggagcaggaagcaaggcc

SEQ ID NO: 4281793 - DNA, 12 bp, Homo sapiens
ggagcagtgggc

SEQ ID NO: 4281794 - DNA, 15 bp, Homo sapiens
ggagcagtgggccct

SEQ ID NO: 4281795 - DNA, 11 bp, Homo sapiens
ggagcagttga

SEQ ID NO: 4281796 - DNA, 21 bp, Homo sapiens
ggagcatgtcctatccctgga

SEQ ID NO: 4281797 - DNA, 16 bp, Homo sapiens
ggagccaatggagact

SEQ ID NO: 4281798 - DNA, 21 bp, Homo sapiens
ggagccagcagggcgggccag

SEQ ID NO: 4281799 - DNA, 10 bp, Homo sapiens
ggagccaggt

SEQ ID NO: 4281800 - DNA, 13 bp, Homo sapiens
ggagcccccgccc

SEQ ID NO: 4281801 - DNA, 21 bp, Homo sapiens
ggagcccgcacccccaccctt

SEQ ID NO: 4281802 - DNA, 13 bp, Homo sapiens
ggagcctgtgtta

SEQ ID NO: 4281803 - DNA, 19 bp, Homo sapiens
ggagctaacactggcccct

SEQ ID NO: 4281804 - DNA, 17 bp, Homo sapiens
ggagctcagggctggat

SEQ ID NO: 4281805 - DNA, 21 bp, Homo sapiens
ggagctctaactgattcaggg

SEQ ID NO: 4281806 - DNA, 11 bp, Homo sapiens
ggagctgaggg

SEQ ID NO: 4281807 - DNA, 14 bp, Homo sapiens
ggagctgaggggca

SEQ ID NO: 4281808 - DNA, 18 bp, Homo sapiens
ggagctgggaaggtcccg

SEQ ID NO: 4281809 - DNA, 19 bp, Homo sapiens
ggagctgggaaggtcccga

SEQ ID NO: 4281810 - DNA, 12 bp, Homo sapiens
ggagctggtggg

SEQ ID NO: 4281811 - DNA, 13 bp, Homo sapiens
ggagcttccagat

SEQ ID NO: 4281812 - DNA, 15 bp, Homo sapiens
ggagcttccagatgg

SEQ ID NO: 4281813 - DNA, 17 bp, Homo sapiens
ggagcttctccagccac

SEQ ID NO: 4281814 - DNA, 17 bp, Homo sapiens
ggaggaaaaaggctggt

SEQ ID NO: 4281815 - DNA, 18 bp, Homo sapiens
ggaggaaaaaggctggtg

SEQ ID NO: 4281816 - DNA, 23 bp, Homo sapiens
ggaggaaaaaggctggtggacag

SEQ ID NO: 4281817 - DNA, 21 bp, Homo sapiens
ggaggaactggtccaggccag

SEQ ID NO: 4281818 - DNA, 23 bp, Homo sapiens
ggaggaatcgaggaaccagagcc

SEQ ID NO: 4281819 - DNA, 15 bp, Homo sapiens
ggaggaatgctcccc

SEQ ID NO: 4281820 - DNA, 17 bp, Homo sapiens
ggaggaatgctccccca

SEQ ID NO: 4281821 - DNA, 14 bp, Homo sapiens
ggaggacaggtgga

SEQ ID NO: 4281822 - DNA, 19 bp, Homo sapiens
ggaggacaggtggaggcga

SEQ ID NO: 4281823 - DNA, 18 bp, Homo sapiens
ggaggacctggggggggc

SEQ ID NO: 4281824 - DNA, 22 bp, Homo sapiens
ggaggagactcaggcccacatt

SEQ ID NO: 4281825 - DNA, 22 bp, Homo sapiens
ggaggagggggcccggctgggc

SEQ ID NO: 4281826 - DNA, 23 bp, Homo sapiens
ggaggccgaggcaggggctgggc

SEQ ID NO: 4281827 - DNA, 14 bp, Homo sapiens
ggaggcctgagggg

SEQ ID NO: 4281828 - DNA, 20 bp, Homo sapiens
ggaggcctggtctggagccc

SEQ ID NO: 4281829 - DNA, 12 bp, Homo sapiens
ggaggcgagcca

SEQ ID NO: 4281830 - DNA, 19 bp, Homo sapiens
ggaggcgccttcctgggtt

SEQ ID NO: 4281831 - DNA, 22 bp, Homo sapiens
ggaggcgccttcctgggttggc

SEQ ID NO: 4281832 - DNA, 15 bp, Homo sapiens
ggaggctaagcctgg

SEQ ID NO: 4281833 - DNA, 17 bp, Homo sapiens
ggaggctaagcctggac

SEQ ID NO: 4281834 - DNA, 14 bp, Homo sapiens
ggaggctgggtggc

SEQ ID NO: 4281835 - DNA, 22 bp, Homo sapiens
ggaggctgggtggccggccctg

SEQ ID NO: 4281836 - DNA, 16 bp, Homo sapiens
ggaggcttgtcagagc

SEQ ID NO: 4281837 - DNA, 17 bp, Homo sapiens
ggaggcttgtcagagct

SEQ ID NO: 4281838 - DNA, 22 bp, Homo sapiens
ggaggcttgtcagagctgggag

SEQ ID NO: 4281839 - DNA, 16 bp, Homo sapiens
ggagggacagtctgga

SEQ ID NO: 4281840 - DNA, 18 bp, Homo sapiens
ggagggacagtctggagg

SEQ ID NO: 4281841 - DNA, 19 bp, Homo sapiens
ggagggacagtctggaggt

SEQ ID NO: 4281842 - DNA, 13 bp, Homo sapiens
ggaggggagagaa

SEQ ID NO: 4281843 - DNA, 21 bp, Homo sapiens
ggctggcttctccctggactc

SEQ ID NO: 4281844 - DNA, 20 bp, Homo sapiens
ggctgggagcctcgcccctc

SEQ ID NO: 4281845 - DNA, 13 bp, Homo sapiens
ggctgggcagagg

SEQ ID NO: 4281846 - DNA, 16 bp, Homo sapiens
ggctgggcagagggga

SEQ ID NO: 4281847 - DNA, 18 bp, Homo sapiens
ggctgggcccgagggtcc

SEQ ID NO: 4281848 - DNA, 22 bp, Homo sapiens
ggctggggcttttgtgccagga

SEQ ID NO: 4281849 - DNA, 16 bp, Homo sapiens
ggctggtttggtggcc

SEQ ID NO: 4281850 - DNA, 17 bp, Homo sapiens
ggctgtcccctgcaagt

SEQ ID NO: 4281851 - DNA, 13 bp, Homo sapiens
ggctgtggcccct

SEQ ID NO: 4281852 - DNA, 21 bp, Homo sapiens
ggctgtggcccctccttctcc

SEQ ID NO: 4281853 - DNA, 20 bp, Homo sapiens
ggcttagcgttctgtttcac

SEQ ID NO: 4281854 - DNA, 16 bp, Homo sapiens
ggcttagtaatagatc

SEQ ID NO: 4281855 - DNA, 22 bp, Homo sapiens
ggcttcaaccttgagacagctt

SEQ ID NO: 4281856 - DNA, 12 bp, Homo sapiens
ggcttcagcccc

SEQ ID NO: 4281857 - DNA, 22 bp, Homo sapiens
ggcttccatggtggtttcagaa

SEQ ID NO: 4281858 - DNA, 19 bp, Homo sapiens
ggcttcccaggaccctggg

SEQ ID NO: 4281859 - DNA, 15 bp, Homo sapiens
ggcttcccgctcagc

SEQ ID NO: 4281860 - DNA, 17 bp, Homo sapiens
ggcttcccgctcagccc

SEQ ID NO: 4281861 - DNA, 12 bp, Homo sapiens
ggcttcctgccc

SEQ ID NO: 4281862 - DNA, 15 bp, Homo sapiens
ggcttcctgccctag

SEQ ID NO: 4281863 - DNA, 16 bp, Homo sapiens
ggcttcctgccctagc

SEQ ID NO: 4281864 - DNA, 17 bp, Homo sapiens
ggcttctccctggactc

SEQ ID NO: 4281865 - DNA, 21 bp, Homo sapiens
ggcttggggtagagaggacag

SEQ ID NO: 4281866 - DNA, 17 bp, Homo sapiens
ggcttgtcagagctggg

SEQ ID NO: 4281867 - DNA, 14 bp, Homo sapiens
ggcttttcactgct

SEQ ID NO: 4281868 - DNA, 19 bp, Homo sapiens
ggcttttcactgctggctg

SEQ ID NO: 4281869 - DNA, 22 bp, Homo sapiens
ggcttttcactgctggctgcct

SEQ ID NO: 4281870 - DNA, 16 bp, Homo sapiens
gggaactaaagggtgt

SEQ ID NO: 4281871 - DNA, 16 bp, Homo sapiens
gggaagcaccagcctc

SEQ ID NO: 4281872 - DNA, 19 bp, Homo sapiens
gggaagcaccagcctcagt

SEQ ID NO: 4281873 - DNA, 14 bp, Homo sapiens
gggaagcagagcct

SEQ ID NO: 4281874 - DNA, 17 bp, Homo sapiens
gggaagcagagcctggg

SEQ ID NO: 4281875 - DNA, 19 bp, Homo sapiens
gggaagcagagcctggggt

SEQ ID NO: 4281876 - DNA, 15 bp, Homo sapiens
gggaagtgtgctgag

SEQ ID NO: 4281877 - DNA, 21 bp, Homo sapiens
gggaagtgtgctgaggtgggc

SEQ ID NO: 4281878 - DNA, 13 bp, Homo sapiens
gggaatcagggag

SEQ ID NO: 4281879 - DNA, 20 bp, Homo sapiens
gggacaggaacacccagccc

SEQ ID NO: 4281880 - DNA, 21 bp, Homo sapiens
gggaccctcggggcaggaagt

SEQ ID NO: 4281881 - DNA, 23 bp, Homo sapiens
gggaccgccagatggggcctctg

SEQ ID NO: 4281882 - DNA, 22 bp, Homo sapiens
gggacggagcactgtgcagccg

SEQ ID NO: 4281883 - DNA, 16 bp, Homo sapiens
gggactgcatgcaagc

SEQ ID NO: 4281884 - DNA, 16 bp, Homo sapiens
gggactggcccacccc

SEQ ID NO: 4281885 - DNA, 23 bp, Homo sapiens
gggactggcccacccctcttccc

SEQ ID NO: 4281886 - DNA, 19 bp, Homo sapiens
gggactggtccaggcatgg

SEQ ID NO: 4281887 - DNA, 21 bp, Homo sapiens
gggacttcaaaatcagtgatg

SEQ ID NO: 4281888 - DNA, 16 bp, Homo sapiens
gggagaccctgggaga

SEQ ID NO: 4281889 - DNA, 13 bp, Homo sapiens
gggagaggaagca

SEQ ID NO: 4281890 - DNA, 22 bp, Homo sapiens
gggagatccgccctgggctctg

SEQ ID NO: 4281891 - DNA, 18 bp, Homo sapiens
gggagcactggaggcctc

SEQ ID NO: 4281892 - DNA, 20 bp, Homo sapiens
gggagcactggaggcctctg

SEQ ID NO: 4281893 - DNA, 24 bp, Homo sapiens
gggagcctgcgtggcctggggctg

SEQ ID NO: 4281894 - DNA, 15 bp, Homo sapiens
gggagctgaggggca

SEQ ID NO: 4281895 - DNA, 16 bp, Homo sapiens
gggagctgaggggcag

SEQ ID NO: 4281896 - DNA, 11 bp, Homo sapiens
gggaggagggg

SEQ ID NO: 4281897 - DNA, 15 bp, Homo sapiens
gggaggccgaggcag

SEQ ID NO: 4281898 - DNA, 20 bp, Homo sapiens
gggaggccgaggcaggggct

SEQ ID NO: 4281899 - DNA, 11 bp, Homo sapiens
gggaggcctga

SEQ ID NO: 4281900 - DNA, 12 bp, Homo sapiens
gggaggcctgag

SEQ ID NO: 4281901 - DNA, 13 bp, Homo sapiens
gggaggcctgagg

SEQ ID NO: 4281902 - DNA, 14 bp, Homo sapiens
gggaggcctgaggg

SEQ ID NO: 4281903 - DNA, 16 bp, Homo sapiens
gggaggcctgaggggc

SEQ ID NO: 4281904 - DNA, 16 bp, Homo sapiens
gggagggacacagagg

SEQ ID NO: 4281905 - DNA, 15 bp, Homo sapiens
gggagggtgggcgtg

SEQ ID NO: 4281906 - DNA, 18 bp, Homo sapiens
gggagtcaagtgtgcctg

SEQ ID NO: 4281907 - DNA, 19 bp, Homo sapiens
gggagtcaagtgtgcctgc

SEQ ID NO: 4281908 - DNA, 20 bp, Homo sapiens
gggagtcaagtgtgcctgct

SEQ ID NO: 4281909 - DNA, 18 bp, Homo sapiens
gggagtgggacagagtct

SEQ ID NO: 4281910 - DNA, 20 bp, Homo sapiens
gggatctaaaaggaggacag

SEQ ID NO: 4281911 - DNA, 21 bp, Homo sapiens
gggatgctatctcgctagcca

SEQ ID NO: 4281912 - DNA, 13 bp, Homo sapiens
gggatgggcacag

SEQ ID NO: 4281913 - DNA, 23 bp, Homo sapiens
gggatgtttaatcaagagagaca

SEQ ID NO: 4281914 - DNA, 15 bp, Homo sapiens
gggatttctcccagc

SEQ ID NO: 4281915 - DNA, 22 bp, Homo sapiens
gggcacacttccccttgggatg

SEQ ID NO: 4281916 - DNA, 12 bp, Homo sapiens
gggcacagccag

SEQ ID NO: 4281917 - DNA, 16 bp, Homo sapiens
gggcagaggggagagg

SEQ ID NO: 4281918 - DNA, 19 bp, Homo sapiens
gggcagaggggagaggaag

SEQ ID NO: 4281919 - DNA, 12 bp, Homo sapiens
gggcagcccaga

SEQ ID NO: 4281920 - DNA, 22 bp, Homo sapiens
gggcagcccagagagaccctgc

SEQ ID NO: 4281921 - DNA, 16 bp, Homo sapiens
gggcagcctgtgggag

SEQ ID NO: 4281922 - DNA, 16 bp, Homo sapiens
gggcagctggctctga

SEQ ID NO: 4281923 - DNA, 17 bp, Homo sapiens
gggcagctggctctgaa

SEQ ID NO: 4281924 - DNA, 20 bp, Homo sapiens
gggcaggagcctagaggagg

SEQ ID NO: 4281925 - DNA, 22 bp, Homo sapiens
gggcaggcccctttggacctgc

SEQ ID NO: 4281926 - DNA, 17 bp, Homo sapiens
gggcagggttctagaag

SEQ ID NO: 4281927 - DNA, 14 bp, Homo sapiens
gggcagtggagagg

SEQ ID NO: 4281928 - DNA, 17 bp, Homo sapiens
gggcagtggagagggga

SEQ ID NO: 4281929 - DNA, 20 bp, Homo sapiens
gggcatctggccctgctgcc

SEQ ID NO: 4281930 - DNA, 15 bp, Homo sapiens
gggcatggggtgggc

SEQ ID NO: 4281931 - DNA, 17 bp, Homo sapiens
gggcatggggtgggcct

SEQ ID NO: 4281932 - DNA, 22 bp, Homo sapiens
gggccaagccagggttccagac

SEQ ID NO: 4281933 - DNA, 13 bp, Homo sapiens
gggccagcccctc

SEQ ID NO: 4281934 - DNA, 17 bp, Homo sapiens
gggccagcccctcccac

SEQ ID NO: 4281935 - DNA, 20 bp, Homo sapiens
gggccagtcatggctgtccc

SEQ ID NO: 4281936 - DNA, 18 bp, Homo sapiens
gggccatgagctccagac

SEQ ID NO: 4281937 - DNA, 22 bp, Homo sapiens
gggcccagaggggcggggccag

SEQ ID NO: 4281938 - DNA, 20 bp, Homo sapiens
gggcccaggagagcccccac

SEQ ID NO: 4281939 - DNA, 23 bp, Homo sapiens
gggccccctctcttaccccgtcc

SEQ ID NO: 4281940 - DNA, 17 bp, Homo sapiens
gggccccctgggagagt

SEQ ID NO: 4281941 - DNA, 20 bp, Homo sapiens
gggcccgcctggcagaactg

SEQ ID NO: 4281942 - DNA, 15 bp, Homo sapiens
gggcccggctgggcc

SEQ ID NO: 4281943 - DNA, 22 bp, Homo sapiens
gggccctaggcatactctccag

SEQ ID NO: 4281944 - DNA, 23 bp, Homo sapiens
gggccctcctgaaacttacacac

SEQ ID NO: 4281945 - DNA, 15 bp, Homo sapiens
gggccctgctcaggc

SEQ ID NO: 4281946 - DNA, 19 bp, Homo sapiens
gggccctgctcaggcctca

SEQ ID NO: 4281947 - DNA, 20 bp, Homo sapiens
gggcccttcccaacctcccc

SEQ ID NO: 4281948 - DNA, 17 bp, Homo sapiens
gggccgcttcgccatgt

SEQ ID NO: 4281949 - DNA, 22 bp, Homo sapiens
gggccgggctggcttctccctg

SEQ ID NO: 4281950 - DNA, 20 bp, Homo sapiens
gggcctgatggtggggccat

SEQ ID NO: 4281951 - DNA, 18 bp, Homo sapiens
gggcctgccactctcctg

SEQ ID NO: 4281952 - DNA, 10 bp, Homo sapiens
gggcctggca

SEQ ID NO: 4281953 - DNA, 12 bp, Homo sapiens
gggcgaggcaga

SEQ ID NO: 4281954 - DNA, 15 bp, Homo sapiens
gggcgctgagggcag

SEQ ID NO: 4281955 - DNA, 13 bp, Homo sapiens
gggcgggaggcca

SEQ ID NO: 4281956 - DNA, 13 bp, Homo sapiens
gggcgggccagga

SEQ ID NO: 4281957 - DNA, 14 bp, Homo sapiens
gggcgggccaggag

SEQ ID NO: 4281958 - DNA, 15 bp, Homo sapiens
gggcgggccaggaga

SEQ ID NO: 4281959 - DNA, 14 bp, Homo sapiens
gggcggggctggcc

SEQ ID NO: 4281960 - DNA, 16 bp, Homo sapiens
gggcgtgacttcagac

SEQ ID NO: 4281961 - DNA, 19 bp, Homo sapiens
gggctagactgggctggct

SEQ ID NO: 4281962 - DNA, 19 bp, Homo sapiens
gggctcacaccagccctgg

SEQ ID NO: 4281963 - DNA, 20 bp, Homo sapiens
gggctcacaccagccctggt

SEQ ID NO: 4281964 - DNA, 15 bp, Homo sapiens
gggctcccacgccct

SEQ ID NO: 4281965 - DNA, 19 bp, Homo sapiens
gggctcccacgccctcctc

SEQ ID NO: 4281966 - DNA, 20 bp, Homo sapiens
gggctctctcacccagcctg

SEQ ID NO: 4281967 - DNA, 21 bp, Homo sapiens
gggctctctcacccagcctgg

SEQ ID NO: 4281968 - DNA, 15 bp, Homo sapiens
gggctgaatgtatgt

SEQ ID NO: 4281969 - DNA, 10 bp, Homo sapiens
gggctgagac

SEQ ID NO: 4281970 - DNA, 11 bp, Homo sapiens
gggctgagagt

SEQ ID NO: 4281971 - DNA, 13 bp, Homo sapiens
gggctgcatcctc

SEQ ID NO: 4281972 - DNA, 20 bp, Homo sapiens
gggctgcatcctcagcccca

SEQ ID NO: 4281973 - DNA, 18 bp, Homo sapiens
gtgccctggcccagcctg

SEQ ID NO: 4281974 - DNA, 23 bp, Homo sapiens
gtgccctggcccagcctgtggcc

SEQ ID NO: 4281975 - DNA, 20 bp, Homo sapiens
gtgcctgaaggctatccact

SEQ ID NO: 4281976 - DNA, 11 bp, Homo sapiens
gtgccttcatt

SEQ ID NO: 4281977 - DNA, 23 bp, Homo sapiens
gtgctcaacctacagtggaggga

SEQ ID NO: 4281978 - DNA, 20 bp, Homo sapiens
gtgctcacagtagcttccta

SEQ ID NO: 4281979 - DNA, 22 bp, Homo sapiens
gtgctcatcagaaacaatttct

SEQ ID NO: 4281980 - DNA, 14 bp, Homo sapiens
gtgctccaggcttc

SEQ ID NO: 4281981 - DNA, 17 bp, Homo sapiens
gtgctccaggcttcctg

SEQ ID NO: 4281982 - DNA, 24 bp, Homo sapiens
gtgctccaggcttcctgccctagc

SEQ ID NO: 4281983 - DNA, 17 bp, Homo sapiens
gtgctccagtgttttct

SEQ ID NO: 4281984 - DNA, 15 bp, Homo sapiens
gtgctccctcctcag

SEQ ID NO: 4281985 - DNA, 16 bp, Homo sapiens
gtgctgaggtgggcct

SEQ ID NO: 4281986 - DNA, 17 bp, Homo sapiens
gtgctgaggtgggcctt

SEQ ID NO: 4281987 - DNA, 19 bp, Homo sapiens
gtgctgaggtgggccttcc

SEQ ID NO: 4281988 - DNA, 15 bp, Homo sapiens
gtgctgcacccctgg

SEQ ID NO: 4281989 - DNA, 20 bp, Homo sapiens
gtgctgcacccctggtgtcc

SEQ ID NO: 4281990 - DNA, 12 bp, Homo sapiens
gtgctgccacac

SEQ ID NO: 4281991 - DNA, 21 bp, Homo sapiens
gtgctgccacacttcaggctc

SEQ ID NO: 4281992 - DNA, 13 bp, Homo sapiens
gtgctgcttccct

SEQ ID NO: 4281993 - DNA, 12 bp, Homo sapiens
gtgctggagagt

SEQ ID NO: 4281994 - DNA, 19 bp, Homo sapiens
gtgctggcatgtctgggtc

SEQ ID NO: 4281995 - DNA, 18 bp, Homo sapiens
gtgctgttgtctgccgtg

SEQ ID NO: 4281996 - DNA, 22 bp, Homo sapiens
gtgcttagcaaaaaataatgac

SEQ ID NO: 4281997 - DNA, 18 bp, Homo sapiens
gtgcttatgtcatttctt

SEQ ID NO: 4281998 - DNA, 15 bp, Homo sapiens
gtgcttgaagattca

SEQ ID NO: 4281999 - DNA, 20 bp, Homo sapiens
gtgcttgaagattcaggctt

SEQ ID NO: 4282000 - DNA, 17 bp, Homo sapiens
gtgcttttccatctaaa

SEQ ID NO: 4282001 - DNA, 17 bp, Homo sapiens
gtggacgtgggctccag

SEQ ID NO: 4282002 - DNA, 17 bp, Homo sapiens
gtggactttccaccccc

SEQ ID NO: 4282003 - DNA, 16 bp, Homo sapiens
gtggagccacaggcag

SEQ ID NO: 4282004 - DNA, 19 bp, Homo sapiens
gtggagccacaggcagacg

SEQ ID NO: 4282005 - DNA, 13 bp, Homo sapiens
gtggagctgcttc

SEQ ID NO: 4282006 - DNA, 17 bp, Homo sapiens
gtggaggaatgctcccc

SEQ ID NO: 4282007 - DNA, 23 bp, Homo sapiens
gtggaggaatgctcccccatcct

SEQ ID NO: 4282008 - DNA, 15 bp, Homo sapiens
gtggagtggggcagt

SEQ ID NO: 4282009 - DNA, 11 bp, Homo sapiens
gtggcagctgt

SEQ ID NO: 4282010 - DNA, 19 bp, Homo sapiens
gtggccaagcctgccccgg

SEQ ID NO: 4282011 - DNA, 13 bp, Homo sapiens
gtggccaggctgg

SEQ ID NO: 4282012 - DNA, 11 bp, Homo sapiens
gtggcccctcc

SEQ ID NO: 4282013 - DNA, 17 bp, Homo sapiens
gtggcccctccttctcc

SEQ ID NO: 4282014 - DNA, 18 bp, Homo sapiens
gtggcccctccttctccc

SEQ ID NO: 4282015 - DNA, 19 bp, Homo sapiens
gtggcccgacagcctggca

SEQ ID NO: 4282016 - DNA, 12 bp, Homo sapiens
gtggccggccct

SEQ ID NO: 4282017 - DNA, 13 bp, Homo sapiens
gtggccggccctg

SEQ ID NO: 4282018 - DNA, 16 bp, Homo sapiens
gtggccggccctgccc

SEQ ID NO: 4282019 - DNA, 21 bp, Homo sapiens
gtggcctcaaccctccctcag

SEQ ID NO: 4282020 - DNA, 12 bp, Homo sapiens
gtggcctcagca

SEQ ID NO: 4282021 - DNA, 14 bp, Homo sapiens
gtggcctgagaaga

SEQ ID NO: 4282022 - DNA, 14 bp, Homo sapiens
gtggcggtgcagtg

SEQ ID NO: 4282023 - DNA, 12 bp, Homo sapiens
gtggctcccctc

SEQ ID NO: 4282024 - DNA, 14 bp, Homo sapiens
gtggctcccctcta

SEQ ID NO: 4282025 - DNA, 22 bp, Homo sapiens
gtggctcccctctatttagcat

SEQ ID NO: 4282026 - DNA, 13 bp, Homo sapiens
gtggctgtgatta

SEQ ID NO: 4282027 - DNA, 13 bp, Homo sapiens
gtggcttcagccc

SEQ ID NO: 4282028 - DNA, 23 bp, Homo sapiens
gtggcttcagcccctggggtact

SEQ ID NO: 4282029 - DNA, 19 bp, Homo sapiens
gtggcttcccgctcagccc

SEQ ID NO: 4282030 - DNA, 21 bp, Homo sapiens
gtggcttcccgctcagccctc

SEQ ID NO: 4282031 - DNA, 18 bp, Homo sapiens
gtggcttggagcagaggt

SEQ ID NO: 4282032 - DNA, 18 bp, Homo sapiens
gtgggactggcccacccc

SEQ ID NO: 4282033 - DNA, 15 bp, Homo sapiens
gtgggagaagggaca

SEQ ID NO: 4282034 - DNA, 14 bp, Homo sapiens
gtgggagaggaagc

SEQ ID NO: 4282035 - DNA, 19 bp, Homo sapiens
gtgggagcacagctttcct

SEQ ID NO: 4282036 - DNA, 17 bp, Homo sapiens
gtgggagtgggagagga

SEQ ID NO: 4282037 - DNA, 14 bp, Homo sapiens
gtgggatccagaga

SEQ ID NO: 4282038 - DNA, 15 bp, Homo sapiens
gtgggatccagagag

SEQ ID NO: 4282039 - DNA, 15 bp, Homo sapiens
gtgggcagctggctc

SEQ ID NO: 4282040 - DNA, 19 bp, Homo sapiens
gtgggccagcccctcccac

SEQ ID NO: 4282041 - DNA, 13 bp, Homo sapiens
gtgggccctggct

SEQ ID NO: 4282042 - DNA, 16 bp, Homo sapiens
gtgggccctggctctg

SEQ ID NO: 4282043 - DNA, 11 bp, Homo sapiens
gtgggcctctg

SEQ ID NO: 4282044 - DNA, 14 bp, Homo sapiens
gtgggctccagagt

SEQ ID NO: 4282045 - DNA, 17 bp, Homo sapiens
gtgggctccagagtagg

SEQ ID NO: 4282046 - DNA, 12 bp, Homo sapiens
gtggggaggaga

SEQ ID NO: 4282047 - DNA, 14 bp, Homo sapiens
gtggggagggtggg

SEQ ID NO: 4282048 - DNA, 16 bp, Homo sapiens
gtggggatttctccca

SEQ ID NO: 4282049 - DNA, 12 bp, Homo sapiens
gtggggccacac

SEQ ID NO: 4282050 - DNA, 19 bp, Homo sapiens
gtggggctagactgggctg

SEQ ID NO: 4282051 - DNA, 20 bp, Homo sapiens
gtggggcttagaatggggct

SEQ ID NO: 4282052 - DNA, 14 bp, Homo sapiens
gtgggggagaatgg

SEQ ID NO: 4282053 - DNA, 21 bp, Homo sapiens
gtgggggtctgggaggcaggt

SEQ ID NO: 4282054 - DNA, 21 bp, Homo sapiens
gtgggggtgtcacagaggcag

SEQ ID NO: 4282055 - DNA, 16 bp, Homo sapiens
gtggtaacaagaggag

SEQ ID NO: 4282056 - DNA, 22 bp, Homo sapiens
gtggtaacaagaggagcaggaa

SEQ ID NO: 4282057 - DNA, 22 bp, Homo sapiens
gtggtaactttatttaaaatga

SEQ ID NO: 4282058 - DNA, 18 bp, Homo sapiens
gtggtccacattctgctg

SEQ ID NO: 4282059 - DNA, 19 bp, Homo sapiens
gtggtccacattctgctgc

SEQ ID NO: 4282060 - DNA, 22 bp, Homo sapiens
gtggtccacattctgctgcccc

SEQ ID NO: 4282061 - DNA, 13 bp, Homo sapiens
gtggtctatttct

SEQ ID NO: 4282062 - DNA, 19 bp, Homo sapiens
gtggtcttcaaattgtctt

SEQ ID NO: 4282063 - DNA, 16 bp, Homo sapiens
gtggtcttcaagcctg

SEQ ID NO: 4282064 - DNA, 17 bp, Homo sapiens
gtggtcttcaagcctgg

SEQ ID NO: 4282065 - DNA, 20 bp, Homo sapiens
gtggtgaggttgtgctgcct

SEQ ID NO: 4282066 - DNA, 14 bp, Homo sapiens
gtggttaagaatgt

SEQ ID NO: 4282067 - DNA, 15 bp, Homo sapiens
gtggttggaggcctg

SEQ ID NO: 4282068 - DNA, 23 bp, Homo sapiens
gtgtaatcatttcttgggccctc

SEQ ID NO: 4282069 - DNA, 18 bp, Homo sapiens
gtgtagattttatagtgt

SEQ ID NO: 4282070 - DNA, 18 bp, Homo sapiens
gtgtaggaagaggccgct

SEQ ID NO: 4282071 - DNA, 12 bp, Homo sapiens
gtgtattctgtg

SEQ ID NO: 4282072 - DNA, 22 bp, Homo sapiens
gtgtattctgtggattctatat

SEQ ID NO: 4282073 - DNA, 22 bp, Homo sapiens
gtgtatttattttcctccccag

SEQ ID NO: 4282074 - DNA, 12 bp, Homo sapiens
gtgtcaaagaga

SEQ ID NO: 4282075 - DNA, 14 bp, Homo sapiens
gtgtcaaggggccc

SEQ ID NO: 4282076 - DNA, 16 bp, Homo sapiens
gtgtcaaggggcccta

SEQ ID NO: 4282077 - DNA, 16 bp, Homo sapiens
gtgtcacagaggcagt

SEQ ID NO: 4282078 - DNA, 23 bp, Homo sapiens
gtgtcatatatggggggccaaca

SEQ ID NO: 4282079 - DNA, 14 bp, Homo sapiens
gtgtccctgcctgg

SEQ ID NO: 4282080 - DNA, 15 bp, Homo sapiens
gtgtcctaaatgcaa

SEQ ID NO: 4282081 - DNA, 23 bp, Homo sapiens
gtgtctgtccatctgtctgtcct

SEQ ID NO: 4282082 - DNA, 14 bp, Homo sapiens
gtgtctgtggccct

SEQ ID NO: 4282083 - DNA, 15 bp, Homo sapiens
gtgtctgtggccctc

SEQ ID NO: 4282084 - DNA, 15 bp, Homo sapiens
gtgtcttgtgttttt

SEQ ID NO: 4282085 - DNA, 15 bp, Homo sapiens
gtgtcttttaatgat

SEQ ID NO: 4282086 - DNA, 20 bp, Homo sapiens
gtgtgacatcagtggcatgg

SEQ ID NO: 4282087 - DNA, 22 bp, Homo sapiens
gtgtgagatggtgccccctggg

SEQ ID NO: 4282088 - DNA, 14 bp, Homo sapiens
gtgtgagcagggtg

SEQ ID NO: 4282089 - DNA, 17 bp, Homo sapiens
gtgtgagggtgcaggga

SEQ ID NO: 4282090 - DNA, 23 bp, Homo sapiens
gtgtgagtgtgacgggggttggg

SEQ ID NO: 4282091 - DNA, 13 bp, Homo sapiens
gtgtgccaccctc

SEQ ID NO: 4282092 - DNA, 17 bp, Homo sapiens
gtgtgccaccctctgca

SEQ ID NO: 4282093 - DNA, 15 bp, Homo sapiens
gtgtgcctgctatcc

SEQ ID NO: 4282094 - DNA, 20 bp, Homo sapiens
gtgtgcctgctatccagccg

SEQ ID NO: 4282095 - DNA, 23 bp, Homo sapiens
gtgtgctccaggcttcctgccct

SEQ ID NO: 4282096 - DNA, 13 bp, Homo sapiens
gtgtggggagggt

SEQ ID NO: 4282097 - DNA, 16 bp, Homo sapiens
gtgtggggagggtggg

SEQ ID NO: 4282098 - DNA, 21 bp, Homo sapiens
gtgtgggggtctgggaggcag

SEQ ID NO: 4282099 - DNA, 15 bp, Homo sapiens
gtgtgggtcagggag

SEQ ID NO: 4282100 - DNA, 17 bp, Homo sapiens
gtgtgggtttactctgt

SEQ ID NO: 4282101 - DNA, 23 bp, Homo sapiens
gtgttacccagtaactcatctgt

SEQ ID NO: 4282102 - DNA, 21 bp, Homo sapiens
gtgttcgtggagccacaggca

SEQ ID NO: 4282103 - DNA, 15 bp, Homo sapiens
gtgttctggcctctg

SEQ ID NO: 4282104 - DNA, 15 bp, Homo sapiens
tactccccttgagct

SEQ ID NO: 4282105 - DNA, 16 bp, Homo sapiens
tactccccttgagctg

SEQ ID NO: 4282106 - DNA, 21 bp, Homo sapiens
tactgatttgggctgaatgta

SEQ ID NO: 4282107 - DNA, 13 bp, Homo sapiens
tactggtaagatt

SEQ ID NO: 4282108 - DNA, 13 bp, Homo sapiens
tactggttatagt

SEQ ID NO: 4282109 - DNA, 14 bp, Homo sapiens
tactggttggtgtt

SEQ ID NO: 4282110 - DNA, 16 bp, Homo sapiens
tactgtcagagaatat

SEQ ID NO: 4282111 - DNA, 15 bp, Homo sapiens
tactgtttgtaatat

SEQ ID NO: 4282112 - DNA, 19 bp, Homo sapiens
tactgtttgtaatatacag

SEQ ID NO: 4282113 - DNA, 15 bp, Homo sapiens
tacttaaaaatatgt

SEQ ID NO: 4282114 - DNA, 17 bp, Homo sapiens
tacttaaaaatatgtga

SEQ ID NO: 4282115 - DNA, 20 bp, Homo sapiens
tacttaaatagcatctgctc

SEQ ID NO: 4282116 - DNA, 19 bp, Homo sapiens
tacttacatgcattactgc

SEQ ID NO: 4282117 - DNA, 22 bp, Homo sapiens
tacttcgtgtccgactcttctg

SEQ ID NO: 4282118 - DNA, 14 bp, Homo sapiens
tacttcttctgtaa

SEQ ID NO: 4282119 - DNA, 15 bp, Homo sapiens
tacttcttctgtaat

SEQ ID NO: 4282120 - DNA, 15 bp, Homo sapiens
tacttctttttcatt

SEQ ID NO: 4282121 - DNA, 15 bp, Homo sapiens
tacttgaatagtatt

SEQ ID NO: 4282122 - DNA, 15 bp, Homo sapiens
tacttgctcaataaa

SEQ ID NO: 4282123 - DNA, 19 bp, Homo sapiens
tacttgctcaataaaggtc

SEQ ID NO: 4282124 - DNA, 20 bp, Homo sapiens
tacttgtgaaacacagctgt

SEQ ID NO: 4282125 - DNA, 21 bp, Homo sapiens
tacttgtgaaacacagctgtt

SEQ ID NO: 4282126 - DNA, 17 bp, Homo sapiens
tactttacctctctgtc

SEQ ID NO: 4282127 - DNA, 18 bp, Homo sapiens
tactttacctctctgtca

SEQ ID NO: 4282128 - DNA, 17 bp, Homo sapiens
tactttgtgcaatatga

SEQ ID NO: 4282129 - DNA, 13 bp, Homo sapiens
tagaaaaatttca

SEQ ID NO: 4282130 - DNA, 15 bp, Homo sapiens
tagaaataaacctta

SEQ ID NO: 4282131 - DNA, 15 bp, Homo sapiens
tagaaatgatttcaa

SEQ ID NO: 4282132 - DNA, 16 bp, Homo sapiens
tagaaatgatttcaaa

SEQ ID NO: 4282133 - DNA, 21 bp, Homo sapiens
tagaaatttattcttatctta

SEQ ID NO: 4282134 - DNA, 23 bp, Homo sapiens
tagaactgtcccacaaaatattt

SEQ ID NO: 4282135 - DNA, 12 bp, Homo sapiens
tagaactgttca

SEQ ID NO: 4282136 - DNA, 16 bp, Homo sapiens
tagaagaatattgtat

SEQ ID NO: 4282137 - DNA, 17 bp, Homo sapiens
tagaagaatattgtatt

SEQ ID NO: 4282138 - DNA, 22 bp, Homo sapiens
tagaagagggagaaggagaggc

SEQ ID NO: 4282139 - DNA, 21 bp, Homo sapiens
tagaaggtcggaggcttggga

SEQ ID NO: 4282140 - DNA, 14 bp, Homo sapiens
tagaatctcagcac

SEQ ID NO: 4282141 - DNA, 21 bp, Homo sapiens
tagaatgttactttggaatga

SEQ ID NO: 4282142 - DNA, 16 bp, Homo sapiens
tagaattaccatttgt

SEQ ID NO: 4282143 - DNA, 17 bp, Homo sapiens
tagaattaccatttgtt

SEQ ID NO: 4282144 - DNA, 13 bp, Homo sapiens
tagacaaccatag

SEQ ID NO: 4282145 - DNA, 19 bp, Homo sapiens
tagacaaccatagaactgt

SEQ ID NO: 4282146 - DNA, 18 bp, Homo sapiens
tagacatccccctccttg

SEQ ID NO: 4282147 - DNA, 18 bp, Homo sapiens
tagactcacggctgcacc

SEQ ID NO: 4282148 - DNA, 12 bp, Homo sapiens
tagactgggctg

SEQ ID NO: 4282149 - DNA, 13 bp, Homo sapiens
tagactgggctgg

SEQ ID NO: 4282150 - DNA, 20 bp, Homo sapiens
tagactgggctggctgcctt

SEQ ID NO: 4282151 - DNA, 10 bp, Homo sapiens
tagagaggac

SEQ ID NO: 4282152 - DNA, 14 bp, Homo sapiens
tagagattaatttg

SEQ ID NO: 4282153 - DNA, 15 bp, Homo sapiens
tagagattaatttgt

SEQ ID NO: 4282154 - DNA, 23 bp, Homo sapiens
tagagcattctggggtggggctt

SEQ ID NO: 4282155 - DNA, 16 bp, Homo sapiens
tagaggcttccttcat

SEQ ID NO: 4282156 - DNA, 18 bp, Homo sapiens
tagaggcttccttcattt

SEQ ID NO: 4282157 - DNA, 18 bp, Homo sapiens
tagagtatgcaagaagaa

SEQ ID NO: 4282158 - DNA, 20 bp, Homo sapiens
tagatccattaatttaaatg

SEQ ID NO: 4282159 - DNA, 12 bp, Homo sapiens
tagatgcctggg

SEQ ID NO: 4282160 - DNA, 23 bp, Homo sapiens
tagatttctcacactctaactgt

SEQ ID NO: 4282161 - DNA, 13 bp, Homo sapiens
tagattttatagt

SEQ ID NO: 4282162 - DNA, 19 bp, Homo sapiens
tagattttatagtgtgttg

SEQ ID NO: 4282163 - DNA, 14 bp, Homo sapiens
tagattttcatgtt

SEQ ID NO: 4282164 - DNA, 17 bp, Homo sapiens
tagattttcatgttctt

SEQ ID NO: 4282165 - DNA, 18 bp, Homo sapiens
tagcaagaagattctaaa

SEQ ID NO: 4282166 - DNA, 19 bp, Homo sapiens
tagcagagtcattgttaca

SEQ ID NO: 4282167 - DNA, 16 bp, Homo sapiens
tagcagtttgcctctg

SEQ ID NO: 4282168 - DNA, 20 bp, Homo sapiens
tagcatctgctcttctctta

SEQ ID NO: 4282169 - DNA, 22 bp, Homo sapiens
tagcatgaaaggtaatctgaaa

SEQ ID NO: 4282170 - DNA, 21 bp, Homo sapiens
tagcatgtgtttggttctggg

SEQ ID NO: 4282171 - DNA, 13 bp, Homo sapiens
tagcatttcttga

SEQ ID NO: 4282172 - DNA, 19 bp, Homo sapiens
tagcattttctgcatctcc

SEQ ID NO: 4282173 - DNA, 17 bp, Homo sapiens
tagccagaggctctaat

SEQ ID NO: 4282174 - DNA, 11 bp, Homo sapiens
tagccaggcct

SEQ ID NO: 4282175 - DNA, 12 bp, Homo sapiens
tagccaggcctc

SEQ ID NO: 4282176 - DNA, 17 bp, Homo sapiens
tagccaggcctcccgca

SEQ ID NO: 4282177 - DNA, 15 bp, Homo sapiens
tagccatttgaagaa

SEQ ID NO: 4282178 - DNA, 16 bp, Homo sapiens
tagccttctctgttca

SEQ ID NO: 4282179 - DNA, 19 bp, Homo sapiens
tagcgctatagttactgtc

SEQ ID NO: 4282180 - DNA, 15 bp, Homo sapiens
tagctacggttccct

SEQ ID NO: 4282181 - DNA, 19 bp, Homo sapiens
tagctacggttccctgcct

SEQ ID NO: 4282182 - DNA, 16 bp, Homo sapiens
tagctatgctgtatct

SEQ ID NO: 4282183 - DNA, 21 bp, Homo sapiens
tagctatgctgtatctgtgct

SEQ ID NO: 4282184 - DNA, 16 bp, Homo sapiens
tagctgtgacctctcc

SEQ ID NO: 4282185 - DNA, 19 bp, Homo sapiens
taggaaagcctcactgata

SEQ ID NO: 4282186 - DNA, 17 bp, Homo sapiens
taggaacagagtatata

SEQ ID NO: 4282187 - DNA, 19 bp, Homo sapiens
taggaacagagtatatatg

SEQ ID NO: 4282188 - DNA, 22 bp, Homo sapiens
taggaacagagtatatatgtac

SEQ ID NO: 4282189 - DNA, 19 bp, Homo sapiens
taggaacccggcatgccga

SEQ ID NO: 4282190 - DNA, 22 bp, Homo sapiens
taggaatatacatagtctttgt

SEQ ID NO: 4282191 - DNA, 15 bp, Homo sapiens
taggagcttccagat

SEQ ID NO: 4282192 - DNA, 18 bp, Homo sapiens
taggagcttccagatggg

SEQ ID NO: 4282193 - DNA, 19 bp, Homo sapiens
taggagcttccagatgggt

SEQ ID NO: 4282194 - DNA, 22 bp, Homo sapiens
taggaggaatgtgcttttccat

SEQ ID NO: 4282195 - DNA, 20 bp, Homo sapiens
taggaggctctaattctcta

SEQ ID NO: 4282196 - DNA, 12 bp, Homo sapiens
taggcagagccc

SEQ ID NO: 4282197 - DNA, 18 bp, Homo sapiens
taggcaggaagtcaggag

SEQ ID NO: 4282198 - DNA, 19 bp, Homo sapiens
taggcaggaagtcaggagc

SEQ ID NO: 4282199 - DNA, 23 bp, Homo sapiens
taggcaggaagtcaggagccagc

SEQ ID NO: 4282200 - DNA, 12 bp, Homo sapiens
taggccagaggt

SEQ ID NO: 4282201 - DNA, 20 bp, Homo sapiens
taggccagaggtgaacattc

SEQ ID NO: 4282202 - DNA, 12 bp, Homo sapiens
taggccctggtc

SEQ ID NO: 4282203 - DNA, 20 bp, Homo sapiens
tagggaaatccaactccagg

SEQ ID NO: 4282204 - DNA, 18 bp, Homo sapiens
tagggcaaagaatcaaca

SEQ ID NO: 4282205 - DNA, 14 bp, Homo sapiens
tagggccagggctc

SEQ ID NO: 4282206 - DNA, 19 bp, Homo sapiens
tagggccagggctctggca

SEQ ID NO: 4282207 - DNA, 18 bp, Homo sapiens
tagggtccactttggtaa

SEQ ID NO: 4282208 - DNA, 14 bp, Homo sapiens
tagggtcctcaggc

SEQ ID NO: 4282209 - DNA, 19 bp, Homo sapiens
tagggtcctcaggcagtgg

SEQ ID NO: 4282210 - DNA, 23 bp, Homo sapiens
tagggtcctcaggcagtggccca

SEQ ID NO: 4282211 - DNA, 15 bp, Homo sapiens
taggtcaatgaaata

SEQ ID NO: 4282212 - DNA, 13 bp, Homo sapiens
taggtctccaccc

SEQ ID NO: 4282213 - DNA, 16 bp, Homo sapiens
taggtctccacccctc

SEQ ID NO: 4282214 - DNA, 23 bp, Homo sapiens
taggtctccacccctcaagccag

SEQ ID NO: 4282215 - DNA, 23 bp, Homo sapiens
taggtgcccagtcttgagtgggc

SEQ ID NO: 4282216 - DNA, 14 bp, Homo sapiens
taggtgctggcatg

SEQ ID NO: 4282217 - DNA, 19 bp, Homo sapiens
taggtgggccagcccctcc

SEQ ID NO: 4282218 - DNA, 13 bp, Homo sapiens
taggtgtctttta

SEQ ID NO: 4282219 - DNA, 16 bp, Homo sapiens
taggttaataggagga

SEQ ID NO: 4282220 - DNA, 20 bp, Homo sapiens
taggttattatgattagctt

SEQ ID NO: 4282221 - DNA, 22 bp, Homo sapiens
taggttattatgattagctttg

SEQ ID NO: 4282222 - DNA, 21 bp, Homo sapiens
taggtttagaatcaagtctgt

SEQ ID NO: 4282223 - DNA, 18 bp, Homo sapiens
taggtttctaaaaagtca

SEQ ID NO: 4282224 - DNA, 20 bp, Homo sapiens
tagtaacacataaagtaaat

SEQ ID NO: 4282225 - DNA, 23 bp, Homo sapiens
tagtactagagatattttgtaaa

SEQ ID NO: 4282226 - DNA, 19 bp, Homo sapiens
tagtacttcttctgtaata

SEQ ID NO: 4282227 - DNA, 22 bp, Homo sapiens
tagtagaatctcagcactttgt

SEQ ID NO: 4282228 - DNA, 17 bp, Homo sapiens
tagtcaatcaaacaggg

SEQ ID NO: 4282229 - DNA, 17 bp, Homo sapiens
tagtcacttatttcata

SEQ ID NO: 4282230 - DNA, 13 bp, Homo sapiens
tagtctctgattt

SEQ ID NO: 4282231 - DNA, 15 bp, Homo sapiens
tagtctttgtttaca

SEQ ID NO: 4282232 - DNA, 17 bp, Homo sapiens
tagtgacccggaggcca

SEQ ID NO: 4282233 - DNA, 23 bp, Homo sapiens
tagtgactaaaccattgtgcatt

SEQ ID NO: 4282234 - DNA, 17 bp, Homo sapiens
tccagttctgatgaggc

SEQ ID NO: 4282235 - DNA, 17 bp, Homo sapiens
tccagttggactgtggc

SEQ ID NO: 4282236 - DNA, 21 bp, Homo sapiens
tccagttggactgtggcctca

SEQ ID NO: 4282237 - DNA, 16 bp, Homo sapiens
tccatatagtttgttt

SEQ ID NO: 4282238 - DNA, 19 bp, Homo sapiens
tccatatagtttgttttct

SEQ ID NO: 4282239 - DNA, 16 bp, Homo sapiens
tccatatcccgggagc

SEQ ID NO: 4282240 - DNA, 12 bp, Homo sapiens
tccatcagaagg

SEQ ID NO: 4282241 - DNA, 20 bp, Homo sapiens
tccatccctggtgaaagagt

SEQ ID NO: 4282242 - DNA, 17 bp, Homo sapiens
tccatcctgtacaagtg

SEQ ID NO: 4282243 - DNA, 23 bp, Homo sapiens
tccatcctgtacaagtgctcagt

SEQ ID NO: 4282244 - DNA, 16 bp, Homo sapiens
tccatctgtctgtcct

SEQ ID NO: 4282245 - DNA, 17 bp, Homo sapiens
tccatctgtttgataca

SEQ ID NO: 4282246 - DNA, 23 bp, Homo sapiens
tccatgagttttttctcttgggc

SEQ ID NO: 4282247 - DNA, 20 bp, Homo sapiens
tccatgattccaagggccca

SEQ ID NO: 4282248 - DNA, 21 bp, Homo sapiens
tccatgattccaagggcccag

SEQ ID NO: 4282249 - DNA, 23 bp, Homo sapiens
tccatgattccaagggcccagag

SEQ ID NO: 4282250 - DNA, 20 bp, Homo sapiens
tccatgcagatctagccagg

SEQ ID NO: 4282251 - DNA, 22 bp, Homo sapiens
tccatgcagatctagccaggcc

SEQ ID NO: 4282252 - DNA, 23 bp, Homo sapiens
tccatgcagatctagccaggcct

SEQ ID NO: 4282253 - DNA, 14 bp, Homo sapiens
tccatgtcaagatt

SEQ ID NO: 4282254 - DNA, 20 bp, Homo sapiens
tccatgtcaagattcagcta

SEQ ID NO: 4282255 - DNA, 20 bp, Homo sapiens
tccattccagagctgcagaa

SEQ ID NO: 4282256 - DNA, 13 bp, Homo sapiens
tccattgtatctt

SEQ ID NO: 4282257 - DNA, 16 bp, Homo sapiens
tccattttctaaactg

SEQ ID NO: 4282258 - DNA, 19 bp, Homo sapiens
tccattttctaaactgttt

SEQ ID NO: 4282259 - DNA, 22 bp, Homo sapiens
tccatttttacaagttatagta

SEQ ID NO: 4282260 - DNA, 18 bp, Homo sapiens
tcccaaagcaagcacctg

SEQ ID NO: 4282261 - DNA, 19 bp, Homo sapiens
tcccaaagcaagcacctgg

SEQ ID NO: 4282262 - DNA, 20 bp, Homo sapiens
tcccaaatatgcccctcccc

SEQ ID NO: 4282263 - DNA, 22 bp, Homo sapiens
tcccaaatatgcccctccccag

SEQ ID NO: 4282264 - DNA, 23 bp, Homo sapiens
tcccaacctcccctggtcctgca

SEQ ID NO: 4282265 - DNA, 18 bp, Homo sapiens
tcccacaaaatatttcta

SEQ ID NO: 4282266 - DNA, 20 bp, Homo sapiens
tcccacaattcttttgaaag

SEQ ID NO: 4282267 - DNA, 13 bp, Homo sapiens
tcccacatccccc

SEQ ID NO: 4282268 - DNA, 15 bp, Homo sapiens
tcccacatcccccgt

SEQ ID NO: 4282269 - DNA, 14 bp, Homo sapiens
tcccaccaactctc

SEQ ID NO: 4282270 - DNA, 17 bp, Homo sapiens
tcccaccaactctctct

SEQ ID NO: 4282271 - DNA, 21 bp, Homo sapiens
tcccaccaactctctctgccc

SEQ ID NO: 4282272 - DNA, 19 bp, Homo sapiens
tcccacgccctcctccctc

SEQ ID NO: 4282273 - DNA, 22 bp, Homo sapiens
tcccacgccctcctccctccgc

SEQ ID NO: 4282274 - DNA, 23 bp, Homo sapiens
tcccacgccctcctccctccgct

SEQ ID NO: 4282275 - DNA, 14 bp, Homo sapiens
tcccacggccactg

SEQ ID NO: 4282276 - DNA, 15 bp, Homo sapiens
tcccacggccactgc

SEQ ID NO: 4282277 - DNA, 16 bp, Homo sapiens
tcccacggccactgca

SEQ ID NO: 4282278 - DNA, 19 bp, Homo sapiens
tcccactgcccctgcacct

SEQ ID NO: 4282279 - DNA, 18 bp, Homo sapiens
tcccactggctcctccag

SEQ ID NO: 4282280 - DNA, 20 bp, Homo sapiens
tcccactggctcctccagca

SEQ ID NO: 4282281 - DNA, 15 bp, Homo sapiens
tcccagacagcagtg

SEQ ID NO: 4282282 - DNA, 20 bp, Homo sapiens
tcccagacagcagtgtgagg

SEQ ID NO: 4282283 - DNA, 15 bp, Homo sapiens
tcccagacatgctgc

SEQ ID NO: 4282284 - DNA, 20 bp, Homo sapiens
tcccagcaaagttttcagat

SEQ ID NO: 4282285 - DNA, 20 bp, Homo sapiens
tcccagcatgctgagattac

SEQ ID NO: 4282286 - DNA, 20 bp, Homo sapiens
tcccagctctagacaaccct

SEQ ID NO: 4282287 - DNA, 22 bp, Homo sapiens
tcccaggacgcagggagaccct

SEQ ID NO: 4282288 - DNA, 20 bp, Homo sapiens
tcccaggcgccccttccccc

SEQ ID NO: 4282289 - DNA, 14 bp, Homo sapiens
tcccagtggcctca

SEQ ID NO: 4282290 - DNA, 22 bp, Homo sapiens
tcccagtggcctcaaccctccc

SEQ ID NO: 4282291 - DNA, 11 bp, Homo sapiens
tcccatccagc

SEQ ID NO: 4282292 - DNA, 23 bp, Homo sapiens
tcccatgggggctccagacattg

SEQ ID NO: 4282293 - DNA, 17 bp, Homo sapiens
tcccatggtagactgtg

SEQ ID NO: 4282294 - DNA, 20 bp, Homo sapiens
tcccatggtagactgtgaca

SEQ ID NO: 4282295 - DNA, 22 bp, Homo sapiens
tcccatttgcagaccaggaagg

SEQ ID NO: 4282296 - DNA, 17 bp, Homo sapiens
tcccatttgtaatgtat

SEQ ID NO: 4282297 - DNA, 17 bp, Homo sapiens
tccccaaccctgcccct

SEQ ID NO: 4282298 - DNA, 19 bp, Homo sapiens
tccccaaccctgcccctgc

SEQ ID NO: 4282299 - DNA, 20 bp, Homo sapiens
tccccaaccctgcccctgcc

SEQ ID NO: 4282300 - DNA, 15 bp, Homo sapiens
tccccaatccaaccc

SEQ ID NO: 4282301 - DNA, 20 bp, Homo sapiens
tccccaatccaacccatgca

SEQ ID NO: 4282302 - DNA, 12 bp, Homo sapiens
tccccactcccg

SEQ ID NO: 4282303 - DNA, 13 bp, Homo sapiens
tccccactcccgt

SEQ ID NO: 4282304 - DNA, 17 bp, Homo sapiens
tccccactcccgtgatg

SEQ ID NO: 4282305 - DNA, 15 bp, Homo sapiens
tccccagcaggtggg

SEQ ID NO: 4282306 - DNA, 12 bp, Homo sapiens
tccccagccccc

SEQ ID NO: 4282307 - DNA, 20 bp, Homo sapiens
tccccagccccctggcccct

SEQ ID NO: 4282308 - DNA, 22 bp, Homo sapiens
tccccagccccctggcccctcc

SEQ ID NO: 4282309 - DNA, 22 bp, Homo sapiens
tccccagtgtggactctggact

SEQ ID NO: 4282310 - DNA, 24 bp, Homo sapiens
tccccagtgtggactctggactgg

SEQ ID NO: 4282311 - DNA, 20 bp, Homo sapiens
tccccatggtgcagtgaaga

SEQ ID NO: 4282312 - DNA, 18 bp, Homo sapiens
tccccattgccttctggg

SEQ ID NO: 4282313 - DNA, 13 bp, Homo sapiens
tcccccagccctg

SEQ ID NO: 4282314 - DNA, 16 bp, Homo sapiens
tcccccggggtctcca

SEQ ID NO: 4282315 - DNA, 11 bp, Homo sapiens
tcccccttccc

SEQ ID NO: 4282316 - DNA, 17 bp, Homo sapiens
tccccgacagtggctct

SEQ ID NO: 4282317 - DNA, 14 bp, Homo sapiens
tccccgagccgagc

SEQ ID NO: 4282318 - DNA, 20 bp, Homo sapiens
tccccggacaagcccaggac

SEQ ID NO: 4282319 - DNA, 14 bp, Homo sapiens
tccccggagctggg

SEQ ID NO: 4282320 - DNA, 15 bp, Homo sapiens
tccccggagctggga

SEQ ID NO: 4282321 - DNA, 21 bp, Homo sapiens
tcccctccagacccctaccct

SEQ ID NO: 4282322 - DNA, 15 bp, Homo sapiens
tcccctcctagcaca

SEQ ID NO: 4282323 - DNA, 12 bp, Homo sapiens
tcccctccttgc

SEQ ID NO: 4282324 - DNA, 18 bp, Homo sapiens
tcccctccttgcctcctg

SEQ ID NO: 4282325 - DNA, 23 bp, Homo sapiens
tcccctccttgcctcctgtgtaa

SEQ ID NO: 4282326 - DNA, 21 bp, Homo sapiens
tcccctcgcttcataggcaga

SEQ ID NO: 4282327 - DNA, 18 bp, Homo sapiens
tcccctctcctgcatccc

SEQ ID NO: 4282328 - DNA, 20 bp, Homo sapiens
tcccctggaactgtctctca

SEQ ID NO: 4282329 - DNA, 20 bp, Homo sapiens
tcccctggtcctgcactgtc

SEQ ID NO: 4282330 - DNA, 15 bp, Homo sapiens
tccccttccctgcaa

SEQ ID NO: 4282331 - DNA, 19 bp, Homo sapiens
tccccttgggatgggcaca

SEQ ID NO: 4282332 - DNA, 22 bp, Homo sapiens
tccccttgggatgggcacaggc

SEQ ID NO: 4282333 - DNA, 13 bp, Homo sapiens
tcccgagccccct

SEQ ID NO: 4282334 - DNA, 20 bp, Homo sapiens
tcccgagccccctgtccttc

SEQ ID NO: 4282335 - DNA, 12 bp, Homo sapiens
tcccgaggcagc

SEQ ID NO: 4282336 - DNA, 21 bp, Homo sapiens
tcccgcatgctgcctgcctcc

SEQ ID NO: 4282337 - DNA, 15 bp, Homo sapiens
tcccgctcagccctc

SEQ ID NO: 4282338 - DNA, 20 bp, Homo sapiens
tcccgctcagccctccctgc

SEQ ID NO: 4282339 - DNA, 19 bp, Homo sapiens
tcccgtggctttgtgctta

SEQ ID NO: 4282340 - DNA, 18 bp, Homo sapiens
tccctagctgtgacctct

SEQ ID NO: 4282341 - DNA, 19 bp, Homo sapiens
tccctcagccacgcctctc

SEQ ID NO: 4282342 - DNA, 22 bp, Homo sapiens
tccctcagccacgcctctctca

SEQ ID NO: 4282343 - DNA, 15 bp, Homo sapiens
tccctccacacctcc

SEQ ID NO: 4282344 - DNA, 23 bp, Homo sapiens
tccctccaccccagtccccggga

SEQ ID NO: 4282345 - DNA, 11 bp, Homo sapiens
tccctcccccg

SEQ ID NO: 4282346 - DNA, 23 bp, Homo sapiens
tccctcccccggggtctccacct

SEQ ID NO: 4282347 - DNA, 12 bp, Homo sapiens
tccctccctcca

SEQ ID NO: 4282348 - DNA, 14 bp, Homo sapiens
tccctccctcctgg

SEQ ID NO: 4282349 - DNA, 15 bp, Homo sapiens
tccctccctcctggc

SEQ ID NO: 4282350 - DNA, 16 bp, Homo sapiens
tccctccctcctggct

SEQ ID NO: 4282351 - DNA, 14 bp, Homo sapiens
tccctccctgcagg

SEQ ID NO: 4282352 - DNA, 15 bp, Homo sapiens
tccctccctgctccc

SEQ ID NO: 4282353 - DNA, 13 bp, Homo sapiens
tccctcctggctc

SEQ ID NO: 4282354 - DNA, 15 bp, Homo sapiens
tccctcctggctcac

SEQ ID NO: 4282355 - DNA, 16 bp, Homo sapiens
tccctcctggctcaca

SEQ ID NO: 4282356 - DNA, 17 bp, Homo sapiens
tccctcctggctcacag

SEQ ID NO: 4282357 - DNA, 19 bp, Homo sapiens
tccctcctggctcacagcc

SEQ ID NO: 4282358 - DNA, 22 bp, Homo sapiens
tccctcctggctcacagccacc

SEQ ID NO: 4282359 - DNA, 22 bp, Homo sapiens
tccctctcaggcatgcctgtgt

SEQ ID NO: 4282360 - DNA, 23 bp, Homo sapiens
tccctctcaggcatgcctgtgtg

SEQ ID NO: 4282361 - DNA, 12 bp, Homo sapiens
tccctctctctg

SEQ ID NO: 4282362 - DNA, 21 bp, Homo sapiens
tccctgagggcccttcccaac

SEQ ID NO: 4282363 - DNA, 15 bp, Homo sapiens
tctgaagtcactgca

SEQ ID NO: 4282364 - DNA, 19 bp, Homo sapiens
tctgaatgtagccagccca

SEQ ID NO: 4282365 - DNA, 12 bp, Homo sapiens
tctgaccacact

SEQ ID NO: 4282366 - DNA, 13 bp, Homo sapiens
tctgaccacactt

SEQ ID NO: 4282367 - DNA, 18 bp, Homo sapiens
tctgaccccacttatgct

SEQ ID NO: 4282368 - DNA, 21 bp, Homo sapiens
tctgaccccacttatgctgct

SEQ ID NO: 4282369 - DNA, 23 bp, Homo sapiens
tctgaccccacttatgctgctgt

SEQ ID NO: 4282370 - DNA, 16 bp, Homo sapiens
tctgacctgcccccgc

SEQ ID NO: 4282371 - DNA, 15 bp, Homo sapiens
tctgacttctcagga

SEQ ID NO: 4282372 - DNA, 18 bp, Homo sapiens
tctgacttctcaggaaga

SEQ ID NO: 4282373 - DNA, 22 bp, Homo sapiens
tctgagaaaagctttgaaccct

SEQ ID NO: 4282374 - DNA, 19 bp, Homo sapiens
tctgagcaccgaatattga

SEQ ID NO: 4282375 - DNA, 22 bp, Homo sapiens
tctgagcaccgaatattgagca

SEQ ID NO: 4282376 - DNA, 20 bp, Homo sapiens
tctgagccctgccctcactc

SEQ ID NO: 4282377 - DNA, 16 bp, Homo sapiens
tctgagcggccgcctg

SEQ ID NO: 4282378 - DNA, 20 bp, Homo sapiens
tctgagcggccgcctgtcct

SEQ ID NO: 4282379 - DNA, 21 bp, Homo sapiens
tctgagcggccgcctgtcctt

SEQ ID NO: 4282380 - DNA, 18 bp, Homo sapiens
tctgaggcaaccccctcg

SEQ ID NO: 4282381 - DNA, 17 bp, Homo sapiens
tctgagttcctgcatgc

SEQ ID NO: 4282382 - DNA, 15 bp, Homo sapiens
tctgataatgaaaat

SEQ ID NO: 4282383 - DNA, 12 bp, Homo sapiens
tctgatcaaagc

SEQ ID NO: 4282384 - DNA, 17 bp, Homo sapiens
tctgatcacaacttttc

SEQ ID NO: 4282385 - DNA, 13 bp, Homo sapiens
tctgatgaaatgt

SEQ ID NO: 4282386 - DNA, 15 bp, Homo sapiens
tctgatgaaatgtta

SEQ ID NO: 4282387 - DNA, 21 bp, Homo sapiens
tctgattaaatttaatatact

SEQ ID NO: 4282388 - DNA, 13 bp, Homo sapiens
tctgattctatgc

SEQ ID NO: 4282389 - DNA, 16 bp, Homo sapiens
tctgattggacatttt

SEQ ID NO: 4282390 - DNA, 19 bp, Homo sapiens
tctgattggacattttctt

SEQ ID NO: 4282391 - DNA, 14 bp, Homo sapiens
tctgatttgcaaat

SEQ ID NO: 4282392 - DNA, 19 bp, Homo sapiens
tctgcaagattctgtgggc

SEQ ID NO: 4282393 - DNA, 13 bp, Homo sapiens
tctgcaccccaca

SEQ ID NO: 4282394 - DNA, 14 bp, Homo sapiens
tctgcaccccacag

SEQ ID NO: 4282395 - DNA, 18 bp, Homo sapiens
tctgcaccccacaggatg

SEQ ID NO: 4282396 - DNA, 22 bp, Homo sapiens
tctgcacgtgcacacacctgca

SEQ ID NO: 4282397 - DNA, 23 bp, Homo sapiens
tctgcacgtgcacacacctgcac

SEQ ID NO: 4282398 - DNA, 19 bp, Homo sapiens
tctgcagacacgccttccc

SEQ ID NO: 4282399 - DNA, 23 bp, Homo sapiens
tctgcagacacgccttcccctca

SEQ ID NO: 4282400 - DNA, 22 bp, Homo sapiens
tctgcagcacattgccctgagg

SEQ ID NO: 4282401 - DNA, 19 bp, Homo sapiens
tctgcaggaaataggccca

SEQ ID NO: 4282402 - DNA, 17 bp, Homo sapiens
tctgcagggcagcctgt

SEQ ID NO: 4282403 - DNA, 17 bp, Homo sapiens
tctgcatgctcctctgc

SEQ ID NO: 4282404 - DNA, 14 bp, Homo sapiens
tctgccatttcatg

SEQ ID NO: 4282405 - DNA, 17 bp, Homo sapiens
tctgcccaccccgcctc

SEQ ID NO: 4282406 - DNA, 19 bp, Homo sapiens
tctgcccaccccgcctctg

SEQ ID NO: 4282407 - DNA, 17 bp, Homo sapiens
tctgcctgtccctctca

SEQ ID NO: 4282408 - DNA, 12 bp, Homo sapiens
tctgccttggac

SEQ ID NO: 4282409 - DNA, 16 bp, Homo sapiens
tctgccttggacacca

SEQ ID NO: 4282410 - DNA, 13 bp, Homo sapiens
tctgcgccgctgt

SEQ ID NO: 4282411 - DNA, 18 bp, Homo sapiens
tctgcggagcttctccag

SEQ ID NO: 4282412 - DNA, 20 bp, Homo sapiens
tctgcggagcttctccagcc

SEQ ID NO: 4282413 - DNA, 15 bp, Homo sapiens
tctgctacctggttt

SEQ ID NO: 4282414 - DNA, 17 bp, Homo sapiens
tctgctatgtctgtgat

SEQ ID NO: 4282415 - DNA, 13 bp, Homo sapiens
tctgctccatgca

SEQ ID NO: 4282416 - DNA, 23 bp, Homo sapiens
tctgctccatgcagatctagcca

SEQ ID NO: 4282417 - DNA, 20 bp, Homo sapiens
tctgctgagctctgacctgc

SEQ ID NO: 4282418 - DNA, 14 bp, Homo sapiens
tctgctgccctcca

SEQ ID NO: 4282419 - DNA, 21 bp, Homo sapiens
tctgctgtattgatatcacta

SEQ ID NO: 4282420 - DNA, 19 bp, Homo sapiens
tctgcttttccattctggg

SEQ ID NO: 4282421 - DNA, 16 bp, Homo sapiens
tctggagaccaggact

SEQ ID NO: 4282422 - DNA, 20 bp, Homo sapiens
tctggagaccaggactctgc

SEQ ID NO: 4282423 - DNA, 15 bp, Homo sapiens
tctggagtctgaagg

SEQ ID NO: 4282424 - DNA, 20 bp, Homo sapiens
tctggagtctgaaggagagg

SEQ ID NO: 4282425 - DNA, 23 bp, Homo sapiens
tctggagtctgaaggagaggagt

SEQ ID NO: 4282426 - DNA, 13 bp, Homo sapiens
tctggatcagtaa

SEQ ID NO: 4282427 - DNA, 15 bp, Homo sapiens
tctggatcagtaaaa

SEQ ID NO: 4282428 - DNA, 15 bp, Homo sapiens
tctggcagcctcaga

SEQ ID NO: 4282429 - DNA, 12 bp, Homo sapiens
tctggccctgct

SEQ ID NO: 4282430 - DNA, 15 bp, Homo sapiens
tctggccctgctgcc

SEQ ID NO: 4282431 - DNA, 16 bp, Homo sapiens
tctggccctgctgccc

SEQ ID NO: 4282432 - DNA, 21 bp, Homo sapiens
tctggccctgttgtgggggtg

SEQ ID NO: 4282433 - DNA, 14 bp, Homo sapiens
tctggcctctggcc

SEQ ID NO: 4282434 - DNA, 17 bp, Homo sapiens
tctggcctctggcctgg

SEQ ID NO: 4282435 - DNA, 12 bp, Homo sapiens
tctggcctggga

SEQ ID NO: 4282436 - DNA, 15 bp, Homo sapiens
tctggctaaggcatc

SEQ ID NO: 4282437 - DNA, 17 bp, Homo sapiens
tctggctaaggcatcat

SEQ ID NO: 4282438 - DNA, 16 bp, Homo sapiens
tctggctccaccggga

SEQ ID NO: 4282439 - DNA, 18 bp, Homo sapiens
tctggctgctgcagtcag

SEQ ID NO: 4282440 - DNA, 20 bp, Homo sapiens
tctggctgtacgtctggtgt

SEQ ID NO: 4282441 - DNA, 16 bp, Homo sapiens
tctggctgtggcccct

SEQ ID NO: 4282442 - DNA, 22 bp, Homo sapiens
tctgggaaatggcttgaagcca

SEQ ID NO: 4282443 - DNA, 14 bp, Homo sapiens
tctgggaggcaggt

SEQ ID NO: 4282444 - DNA, 14 bp, Homo sapiens
tctgggcaggacct

SEQ ID NO: 4282445 - DNA, 13 bp, Homo sapiens
tctggggcccctt

SEQ ID NO: 4282446 - DNA, 14 bp, Homo sapiens
tctggggctgagag

SEQ ID NO: 4282447 - DNA, 19 bp, Homo sapiens
tctgggggactagaacaca

SEQ ID NO: 4282448 - DNA, 19 bp, Homo sapiens
tctggggtggggcttggaa

SEQ ID NO: 4282449 - DNA, 17 bp, Homo sapiens
tctggtattaaatgcca

SEQ ID NO: 4282450 - DNA, 22 bp, Homo sapiens
tctggtcagtgaagcccaggag

SEQ ID NO: 4282451 - DNA, 14 bp, Homo sapiens
tctggtctgggtgc

SEQ ID NO: 4282452 - DNA, 21 bp, Homo sapiens
tctggtgttctcaatgctttt

SEQ ID NO: 4282453 - DNA, 13 bp, Homo sapiens
tctgtaaatttaa

SEQ ID NO: 4282454 - DNA, 21 bp, Homo sapiens
tctgtaagattttattttcaa

SEQ ID NO: 4282455 - DNA, 16 bp, Homo sapiens
tctgtataatactttg

SEQ ID NO: 4282456 - DNA, 23 bp, Homo sapiens
tctgtcactaaatggcagtgaga

SEQ ID NO: 4282457 - DNA, 16 bp, Homo sapiens
tctgtccaatctgcaa

SEQ ID NO: 4282458 - DNA, 20 bp, Homo sapiens
tctgtccatctgtctgtcct

SEQ ID NO: 4282459 - DNA, 21 bp, Homo sapiens
tctgtccatctgtctgtccta

SEQ ID NO: 4282460 - DNA, 18 bp, Homo sapiens
tctgtcccagttaactgt

SEQ ID NO: 4282461 - DNA, 17 bp, Homo sapiens
tctgtccccgagccgag

SEQ ID NO: 4282462 - DNA, 20 bp, Homo sapiens
tctgtccccgagccgagctc

SEQ ID NO: 4282463 - DNA, 13 bp, Homo sapiens
tctgtctcttgca

SEQ ID NO: 4282464 - DNA, 15 bp, Homo sapiens
tctgtctgagccctg

SEQ ID NO: 4282465 - DNA, 14 bp, Homo sapiens
tctgtctgattcta

SEQ ID NO: 4282466 - DNA, 17 bp, Homo sapiens
tctgtcttcaagggctt

SEQ ID NO: 4282467 - DNA, 22 bp, Homo sapiens
tctgtgaaagtctcctgtatca

SEQ ID NO: 4282468 - DNA, 16 bp, Homo sapiens
tctgtgaacttgatgt

SEQ ID NO: 4282469 - DNA, 17 bp, Homo sapiens
tctgtgaataaagccac

SEQ ID NO: 4282470 - DNA, 21 bp, Homo sapiens
tctgtgactcgcttagctgaa

SEQ ID NO: 4282471 - DNA, 12 bp, Homo sapiens
tctgtgagattc

SEQ ID NO: 4282472 - DNA, 23 bp, Homo sapiens
tctgtgatgtcagtagtgcctgt

SEQ ID NO: 4282473 - DNA, 14 bp, Homo sapiens
tctgtggattctat

SEQ ID NO: 4282474 - DNA, 20 bp, Homo sapiens
tctgtggattctatatttca

SEQ ID NO: 4282475 - DNA, 21 bp, Homo sapiens
tctgtggcttcccatgtcttt

SEQ ID NO: 4282476 - DNA, 23 bp, Homo sapiens
tctgtgggactggcccacccctc

SEQ ID NO: 4282477 - DNA, 18 bp, Homo sapiens
tctgtgggcagctggctc

SEQ ID NO: 4282478 - DNA, 15 bp, Homo sapiens
tctgtggggccacac

SEQ ID NO: 4282479 - DNA, 12 bp, Homo sapiens
tctgtgtctgct

SEQ ID NO: 4282480 - DNA, 23 bp, Homo sapiens
tctgttcctggctcagcctcaaa

SEQ ID NO: 4282481 - DNA, 12 bp, Homo sapiens
tctgttgttttt

SEQ ID NO: 4282482 - DNA, 16 bp, Homo sapiens
tctgtttaccctccct

SEQ ID NO: 4282483 - DNA, 20 bp, Homo sapiens
tctgtttaccctccctgtcc

SEQ ID NO: 4282484 - DNA, 24 bp, Homo sapiens
tctgtttaccctccctgtcccctg

SEQ ID NO: 4282485 - DNA, 20 bp, Homo sapiens
tctgtttgctcacccaggac

SEQ ID NO: 4282486 - DNA, 16 bp, Homo sapiens
tcttaatgccacggca

SEQ ID NO: 4282487 - DNA, 19 bp, Homo sapiens
tcttacaataattctatga

SEQ ID NO: 4282488 - DNA, 14 bp, Homo sapiens
tcttactgtatttg

SEQ ID NO: 4282489 - DNA, 17 bp, Homo sapiens
tcttactgttttgtgcg

SEQ ID NO: 4282490 - DNA, 15 bp, Homo sapiens
tcttagggtagggga

SEQ ID NO: 4282491 - DNA, 18 bp, Homo sapiens
tcttatctagcaagaaga

SEQ ID NO: 4282492 - DNA, 19 bp, Homo sapiens
tcttattaaccaaattaac

SEQ ID NO: 4282493 - DNA, 23 bp, Homo sapiens
tgccccacccctccatgattcca

SEQ ID NO: 4282494 - DNA, 13 bp, Homo sapiens
tgccccagagaag

SEQ ID NO: 4282495 - DNA, 20 bp, Homo sapiens
tgccccagagaagcctcagt

SEQ ID NO: 4282496 - DNA, 16 bp, Homo sapiens
tgcccccaaaagtgtc

SEQ ID NO: 4282497 - DNA, 16 bp, Homo sapiens
tgcccccactcagcat

SEQ ID NO: 4282498 - DNA, 13 bp, Homo sapiens
tgccccccacccc

SEQ ID NO: 4282499 - DNA, 16 bp, Homo sapiens
tgccccccaccccagc

SEQ ID NO: 4282500 - DNA, 14 bp, Homo sapiens
tgccccccatgccc

SEQ ID NO: 4282501 - DNA, 15 bp, Homo sapiens
tgccccccatgccct

SEQ ID NO: 4282502 - DNA, 19 bp, Homo sapiens
tgccccccatgccctccct

SEQ ID NO: 4282503 - DNA, 20 bp, Homo sapiens
tgccccccatgccctccctg

SEQ ID NO: 4282504 - DNA, 11 bp, Homo sapiens
tgccccccttc

SEQ ID NO: 4282505 - DNA, 15 bp, Homo sapiens
tgccccccttcccac

SEQ ID NO: 4282506 - DNA, 20 bp, Homo sapiens
tgccccccttcccaccccta

SEQ ID NO: 4282507 - DNA, 13 bp, Homo sapiens
tgcccccttctcc

SEQ ID NO: 4282508 - DNA, 18 bp, Homo sapiens
tgccccgccccccagagc

SEQ ID NO: 4282509 - DNA, 22 bp, Homo sapiens
tgccccgccccccagagccagg

SEQ ID NO: 4282510 - DNA, 14 bp, Homo sapiens
tgccccggccactc

SEQ ID NO: 4282511 - DNA, 15 bp, Homo sapiens
tgccccggccactct

SEQ ID NO: 4282512 - DNA, 20 bp, Homo sapiens
tgccccgtcaccatctcagg

SEQ ID NO: 4282513 - DNA, 14 bp, Homo sapiens
tgcccctgctgcct

SEQ ID NO: 4282514 - DNA, 17 bp, Homo sapiens
tgcccctgctgcctccc

SEQ ID NO: 4282515 - DNA, 15 bp, Homo sapiens
tgccccttctgagga

SEQ ID NO: 4282516 - DNA, 15 bp, Homo sapiens
tgcccgctgcgctgc

SEQ ID NO: 4282517 - DNA, 16 bp, Homo sapiens
tgcccgctgcgctgcc

SEQ ID NO: 4282518 - DNA, 17 bp, Homo sapiens
tgcccgctgcgctgccc

SEQ ID NO: 4282519 - DNA, 21 bp, Homo sapiens
tgcccgctgcgctgccctgca

SEQ ID NO: 4282520 - DNA, 18 bp, Homo sapiens
tgcccggggcagctgcca

SEQ ID NO: 4282521 - DNA, 23 bp, Homo sapiens
tgcccggggcagctgccagagaa

SEQ ID NO: 4282522 - DNA, 21 bp, Homo sapiens
tgccctagcagtttgcctctg

SEQ ID NO: 4282523 - DNA, 22 bp, Homo sapiens
tgccctcactccactcccctca

SEQ ID NO: 4282524 - DNA, 14 bp, Homo sapiens
tgccctccatcccg

SEQ ID NO: 4282525 - DNA, 17 bp, Homo sapiens
tgccctccatcccgaca

SEQ ID NO: 4282526 - DNA, 20 bp, Homo sapiens
tgccctccatcccgacatgg

SEQ ID NO: 4282527 - DNA, 18 bp, Homo sapiens
tgccctccgcccttccct

SEQ ID NO: 4282528 - DNA, 22 bp, Homo sapiens
tgccctccgtcctggcagggca

SEQ ID NO: 4282529 - DNA, 14 bp, Homo sapiens
tgccctctgccact

SEQ ID NO: 4282530 - DNA, 15 bp, Homo sapiens
tgccctgaggggcct

SEQ ID NO: 4282531 - DNA, 18 bp, Homo sapiens
tgccctgaggggcctgcc

SEQ ID NO: 4282532 - DNA, 13 bp, Homo sapiens
tgccctggcccag

SEQ ID NO: 4282533 - DNA, 18 bp, Homo sapiens
tgccctggcccagcctgt

SEQ ID NO: 4282534 - DNA, 21 bp, Homo sapiens
tgccctggtgctgccacactt

SEQ ID NO: 4282535 - DNA, 14 bp, Homo sapiens
tgcccttaaaataa

SEQ ID NO: 4282536 - DNA, 17 bp, Homo sapiens
tgcccttcttccattcc

SEQ ID NO: 4282537 - DNA, 22 bp, Homo sapiens
tgccgaccgaggctggagctgg

SEQ ID NO: 4282538 - DNA, 17 bp, Homo sapiens
tgccgatttcctaagct

SEQ ID NO: 4282539 - DNA, 15 bp, Homo sapiens
tgccgctgggagagc

SEQ ID NO: 4282540 - DNA, 13 bp, Homo sapiens
tgccgctgtgtcc

SEQ ID NO: 4282541 - DNA, 22 bp, Homo sapiens
tgccgctgtgtccccgcgggca

SEQ ID NO: 4282542 - DNA, 19 bp, Homo sapiens
tgccgtgcacggggccagc

SEQ ID NO: 4282543 - DNA, 13 bp, Homo sapiens
tgcctataaagga

SEQ ID NO: 4282544 - DNA, 16 bp, Homo sapiens
tgcctccccaaccctg

SEQ ID NO: 4282545 - DNA, 16 bp, Homo sapiens
tgcctccggccctgcc

SEQ ID NO: 4282546 - DNA, 13 bp, Homo sapiens
tgcctcctgtgta

SEQ ID NO: 4282547 - DNA, 13 bp, Homo sapiens
tgcctctctgcca

SEQ ID NO: 4282548 - DNA, 20 bp, Homo sapiens
tgcctctctgccagccgctg

SEQ ID NO: 4282549 - DNA, 17 bp, Homo sapiens
tgcctctgaaaatattt

SEQ ID NO: 4282550 - DNA, 20 bp, Homo sapiens
tgcctctgaactgctgctgg

SEQ ID NO: 4282551 - DNA, 12 bp, Homo sapiens
tgcctctgcacg

SEQ ID NO: 4282552 - DNA, 15 bp, Homo sapiens
tgcctctgcacgtgc

SEQ ID NO: 4282553 - DNA, 17 bp, Homo sapiens
tgcctctgcacgtgcac

SEQ ID NO: 4282554 - DNA, 15 bp, Homo sapiens
tgcctcttgggagac

SEQ ID NO: 4282555 - DNA, 21 bp, Homo sapiens
tgcctgagaatgcctaggcca

SEQ ID NO: 4282556 - DNA, 23 bp, Homo sapiens
tgcctgagaatgcctaggccagc

SEQ ID NO: 4282557 - DNA, 19 bp, Homo sapiens
tgcctgagggcgaggggag

SEQ ID NO: 4282558 - DNA, 13 bp, Homo sapiens
tgcctgcctccgg

SEQ ID NO: 4282559 - DNA, 20 bp, Homo sapiens
tgcctgcctccggccctgcc

SEQ ID NO: 4282560 - DNA, 14 bp, Homo sapiens
tgcctgctatccag

SEQ ID NO: 4282561 - DNA, 15 bp, Homo sapiens
tgcctgctatccagc

SEQ ID NO: 4282562 - DNA, 18 bp, Homo sapiens
tgcctggccctcctctgg

SEQ ID NO: 4282563 - DNA, 15 bp, Homo sapiens
tgcctgtatttccaa

SEQ ID NO: 4282564 - DNA, 12 bp, Homo sapiens
tgcctgtgcccg

SEQ ID NO: 4282565 - DNA, 14 bp, Homo sapiens
tgcctgtgcccgct

SEQ ID NO: 4282566 - DNA, 17 bp, Homo sapiens
tgccttagaacctttct

SEQ ID NO: 4282567 - DNA, 18 bp, Homo sapiens
tgccttcagctctacagc

SEQ ID NO: 4282568 - DNA, 14 bp, Homo sapiens
tgccttccacgctg

SEQ ID NO: 4282569 - DNA, 22 bp, Homo sapiens
tgccttccacgctgtctccaga

SEQ ID NO: 4282570 - DNA, 21 bp, Homo sapiens
tgccttccaggcgtagggcca

SEQ ID NO: 4282571 - DNA, 13 bp, Homo sapiens
tgccttctgggga

SEQ ID NO: 4282572 - DNA, 20 bp, Homo sapiens
tgccttctggggagggacac

SEQ ID NO: 4282573 - DNA, 18 bp, Homo sapiens
tgccttctgtctcttgca

SEQ ID NO: 4282574 - DNA, 15 bp, Homo sapiens
tgcctttaggcagga

SEQ ID NO: 4282575 - DNA, 13 bp, Homo sapiens
tgcctttctagtc

SEQ ID NO: 4282576 - DNA, 18 bp, Homo sapiens
tgcgacaccaccaacagg

SEQ ID NO: 4282577 - DNA, 23 bp, Homo sapiens
tgcgcaggccctccgcgggggac

SEQ ID NO: 4282578 - DNA, 11 bp, Homo sapiens
tgcgccctccc

SEQ ID NO: 4282579 - DNA, 15 bp, Homo sapiens
tgcgccctccctccc

SEQ ID NO: 4282580 - DNA, 18 bp, Homo sapiens
tgcgccgctgtgctgttg

SEQ ID NO: 4282581 - DNA, 23 bp, Homo sapiens
tgcgcggatgtagcatgttctat

SEQ ID NO: 4282582 - DNA, 12 bp, Homo sapiens
tgcgctagagca

SEQ ID NO: 4282583 - DNA, 15 bp, Homo sapiens
tgcgctcttcaccag

SEQ ID NO: 4282584 - DNA, 17 bp, Homo sapiens
tgcgctcttcaccagga

SEQ ID NO: 4282585 - DNA, 14 bp, Homo sapiens
tgcgctgccctgca

SEQ ID NO: 4282586 - DNA, 16 bp, Homo sapiens
tgcgctgtgctggtct

SEQ ID NO: 4282587 - DNA, 17 bp, Homo sapiens
tgcggagcttctccagc

SEQ ID NO: 4282588 - DNA, 18 bp, Homo sapiens
tgcggagcttctccagcc

SEQ ID NO: 4282589 - DNA, 15 bp, Homo sapiens
tgcggccggcctggg

SEQ ID NO: 4282590 - DNA, 18 bp, Homo sapiens
tgcggccggcctggggcc

SEQ ID NO: 4282591 - DNA, 13 bp, Homo sapiens
tgcggtgtgtctc

SEQ ID NO: 4282592 - DNA, 14 bp, Homo sapiens
tgcgtaaatcaact

SEQ ID NO: 4282593 - DNA, 12 bp, Homo sapiens
tgcgtggctccc

SEQ ID NO: 4282594 - DNA, 22 bp, Homo sapiens
tgcgttcctaaactctgaaatc

SEQ ID NO: 4282595 - DNA, 17 bp, Homo sapiens
tgctaatacatttggct

SEQ ID NO: 4282596 - DNA, 15 bp, Homo sapiens
tgctaatgtaatcat

SEQ ID NO: 4282597 - DNA, 17 bp, Homo sapiens
tgctaattaaaaagtta

SEQ ID NO: 4282598 - DNA, 19 bp, Homo sapiens
tgctacagtagctgtgggg

SEQ ID NO: 4282599 - DNA, 12 bp, Homo sapiens
tgctacctctga

SEQ ID NO: 4282600 - DNA, 12 bp, Homo sapiens
tgctacctggtt

SEQ ID NO: 4282601 - DNA, 21 bp, Homo sapiens
tgctaggtgggccagcccctc

SEQ ID NO: 4282602 - DNA, 13 bp, Homo sapiens
tgctatccagccg

SEQ ID NO: 4282603 - DNA, 17 bp, Homo sapiens
tgctatctcgctagcca

SEQ ID NO: 4282604 - DNA, 15 bp, Homo sapiens
tgctatgtctgtgat

SEQ ID NO: 4282605 - DNA, 21 bp, Homo sapiens
tgctattaatatttgtttagt

SEQ ID NO: 4282606 - DNA, 15 bp, Homo sapiens
tgctcaataaaggtc

SEQ ID NO: 4282607 - DNA, 21 bp, Homo sapiens
tgctcacccaggacctctggg

SEQ ID NO: 4282608 - DNA, 22 bp, Homo sapiens
tgctcacccaggacctctgggg

SEQ ID NO: 4282609 - DNA, 12 bp, Homo sapiens
tgctcaggcctc

SEQ ID NO: 4282610 - DNA, 20 bp, Homo sapiens
tgctcaggcctcacctggct

SEQ ID NO: 4282611 - DNA, 15 bp, Homo sapiens
tgctcagttccaatg

SEQ ID NO: 4282612 - DNA, 17 bp, Homo sapiens
tgctccagccaacccct

SEQ ID NO: 4282613 - DNA, 18 bp, Homo sapiens
tgctccaggcttcctgcc

SEQ ID NO: 4282614 - DNA, 24 bp, Homo sapiens
tgctccaggcttcctgccctagca

SEQ ID NO: 4282615 - DNA, 16 bp, Homo sapiens
tgctccagtgttttct

SEQ ID NO: 4282616 - DNA, 18 bp, Homo sapiens
tgctcccaaatgcagctt

SEQ ID NO: 4282617 - DNA, 22 bp, Homo sapiens
tgctcccccatcctccccttcc

SEQ ID NO: 4282618 - DNA, 22 bp, Homo sapiens
tgctcctcggccagagctccca

SEQ ID NO: 4282619 - DNA, 23 bp, Homo sapiens
tgctcctcggccagagctcccag

SEQ ID NO: 4282620 - DNA, 12 bp, Homo sapiens
tgctcctctgcc

SEQ ID NO: 4282621 - DNA, 13 bp, Homo sapiens
tgctcctctgcct

SEQ ID NO: 4282622 - DNA, 14 bp, Homo sapiens
tgctctctgctgga

SEQ ID NO: 4282623 - DNA, 23 bp, Homo sapiens
tgctgaaacacacaggccatttc

SEQ ID NO: 4282624 - DNA, 17 bp, Homo sapiens
tgtaacattctatttca

SEQ ID NO: 4282625 - DNA, 15 bp, Homo sapiens
tgtaactgttacagt

SEQ ID NO: 4282626 - DNA, 18 bp, Homo sapiens
tgtaactgttacagtaat

SEQ ID NO: 4282627 - DNA, 13 bp, Homo sapiens
tgtaagagaattc

SEQ ID NO: 4282628 - DNA, 13 bp, Homo sapiens
tgtaatatttaca

SEQ ID NO: 4282629 - DNA, 14 bp, Homo sapiens
tgtaatatttacaa

SEQ ID NO: 4282630 - DNA, 17 bp, Homo sapiens
tgtaatcacactctctt

SEQ ID NO: 4282631 - DNA, 14 bp, Homo sapiens
tgtaatcatttatc

SEQ ID NO: 4282632 - DNA, 15 bp, Homo sapiens
tgtaattttgtagta

SEQ ID NO: 4282633 - DNA, 23 bp, Homo sapiens
tgtacaaagggaagcagagcctg

SEQ ID NO: 4282634 - DNA, 21 bp, Homo sapiens
tgtacaagtgctcagttccaa

SEQ ID NO: 4282635 - DNA, 22 bp, Homo sapiens
tgtacaagtgctcagttccaat

SEQ ID NO: 4282636 - DNA, 17 bp, Homo sapiens
tgtacatatggaaatcc

SEQ ID NO: 4282637 - DNA, 17 bp, Homo sapiens
tgtacatgtggaaaact

SEQ ID NO: 4282638 - DNA, 14 bp, Homo sapiens
tgtaccatgttaaa

SEQ ID NO: 4282639 - DNA, 16 bp, Homo sapiens
tgtaccatgttaaaga

SEQ ID NO: 4282640 - DNA, 17 bp, Homo sapiens
tgtaccatgttaaagag

SEQ ID NO: 4282641 - DNA, 21 bp, Homo sapiens
tgtacctgcccccactcagca

SEQ ID NO: 4282642 - DNA, 16 bp, Homo sapiens
tgtactaccccaggac

SEQ ID NO: 4282643 - DNA, 19 bp, Homo sapiens
tgtactatggctgtatttt

SEQ ID NO: 4282644 - DNA, 14 bp, Homo sapiens
tgtagagtgcccat

SEQ ID NO: 4282645 - DNA, 21 bp, Homo sapiens
tgtagagtggtctatttctcc

SEQ ID NO: 4282646 - DNA, 18 bp, Homo sapiens
tgtagattttatagtgtg

SEQ ID NO: 4282647 - DNA, 18 bp, Homo sapiens
tgtagcttcagtcattaa

SEQ ID NO: 4282648 - DNA, 18 bp, Homo sapiens
tgtaggtaagttggctca

SEQ ID NO: 4282649 - DNA, 19 bp, Homo sapiens
tgtataaaacagtgtttcc

SEQ ID NO: 4282650 - DNA, 20 bp, Homo sapiens
tgtataaaacagtgtttcca

SEQ ID NO: 4282651 - DNA, 19 bp, Homo sapiens
tgtatacaaacaggtgcta

SEQ ID NO: 4282652 - DNA, 20 bp, Homo sapiens
tgtatacaaacaggtgctaa

SEQ ID NO: 4282653 - DNA, 20 bp, Homo sapiens
tgtatagtgagtgtggctta

SEQ ID NO: 4282654 - DNA, 13 bp, Homo sapiens
tgtatatcgttat

SEQ ID NO: 4282655 - DNA, 16 bp, Homo sapiens
tgtatatttgtatgat

SEQ ID NO: 4282656 - DNA, 17 bp, Homo sapiens
tgtatatttgtatgata

SEQ ID NO: 4282657 - DNA, 19 bp, Homo sapiens
tgtatatttgtatgatatt

SEQ ID NO: 4282658 - DNA, 18 bp, Homo sapiens
tgtatcagtgtttatgtg

SEQ ID NO: 4282659 - DNA, 19 bp, Homo sapiens
tgtatcctccattgtatct

SEQ ID NO: 4282660 - DNA, 16 bp, Homo sapiens
tgtatctaaaaaataa

SEQ ID NO: 4282661 - DNA, 20 bp, Homo sapiens
tgtatctaaaaaataactgt

SEQ ID NO: 4282662 - DNA, 21 bp, Homo sapiens
tgtatctaaaaaataactgtg

SEQ ID NO: 4282663 - DNA, 18 bp, Homo sapiens
tgtatcttatttatatat

SEQ ID NO: 4282664 - DNA, 15 bp, Homo sapiens
tgtatgtaaataggt

SEQ ID NO: 4282665 - DNA, 21 bp, Homo sapiens
tgtatgtcattaaagtgcact

SEQ ID NO: 4282666 - DNA, 12 bp, Homo sapiens
tgtatgtgaaag

SEQ ID NO: 4282667 - DNA, 14 bp, Homo sapiens
tgtatgtggaagca

SEQ ID NO: 4282668 - DNA, 19 bp, Homo sapiens
tgtatgtgtgtttctgtcc

SEQ ID NO: 4282669 - DNA, 15 bp, Homo sapiens
tgtattatgtcctgt

SEQ ID NO: 4282670 - DNA, 20 bp, Homo sapiens
tgtattatgtcctgtgagat

SEQ ID NO: 4282671 - DNA, 15 bp, Homo sapiens
tgtatttccaacaaa

SEQ ID NO: 4282672 - DNA, 20 bp, Homo sapiens
tgtattttcttttatatctg

SEQ ID NO: 4282673 - DNA, 23 bp, Homo sapiens
tgtatttttagagattaatttgt

SEQ ID NO: 4282674 - DNA, 21 bp, Homo sapiens
tgtcaaccttgtgtgagtgtg

SEQ ID NO: 4282675 - DNA, 15 bp, Homo sapiens
tgtcaagattcagct

SEQ ID NO: 4282676 - DNA, 15 bp, Homo sapiens
tgtcaagctggccgt

SEQ ID NO: 4282677 - DNA, 14 bp, Homo sapiens
tgtcaaggggccct

SEQ ID NO: 4282678 - DNA, 12 bp, Homo sapiens
tgtcaatgtgtg

SEQ ID NO: 4282679 - DNA, 15 bp, Homo sapiens
tgtcaatgtttgctt

SEQ ID NO: 4282680 - DNA, 14 bp, Homo sapiens
tgtcacagaggcag

SEQ ID NO: 4282681 - DNA, 17 bp, Homo sapiens
tgtcaggagagccctct

SEQ ID NO: 4282682 - DNA, 22 bp, Homo sapiens
tgtcataaagtgagaaaactgt

SEQ ID NO: 4282683 - DNA, 16 bp, Homo sapiens
tgtcatactctgtgta

SEQ ID NO: 4282684 - DNA, 19 bp, Homo sapiens
tgtcatgatttcaatgatt

SEQ ID NO: 4282685 - DNA, 14 bp, Homo sapiens
tgtcatttcatttc

SEQ ID NO: 4282686 - DNA, 13 bp, Homo sapiens
tgtccacctgtgc

SEQ ID NO: 4282687 - DNA, 11 bp, Homo sapiens
tgtccagagag

SEQ ID NO: 4282688 - DNA, 23 bp, Homo sapiens
tgtccagagagagaagtgcccct

SEQ ID NO: 4282689 - DNA, 15 bp, Homo sapiens
tgtccatctgtctgt

SEQ ID NO: 4282690 - DNA, 12 bp, Homo sapiens
tgtcccacaaaa

SEQ ID NO: 4282691 - DNA, 15 bp, Homo sapiens
tgtcccacaaaatat

SEQ ID NO: 4282692 - DNA, 16 bp, Homo sapiens
tgtccccaggggcaca

SEQ ID NO: 4282693 - DNA, 21 bp, Homo sapiens
tgtccctaccgagtctcttct

SEQ ID NO: 4282694 - DNA, 12 bp, Homo sapiens
tgtccctgcccc

SEQ ID NO: 4282695 - DNA, 16 bp, Homo sapiens
tgtccctgcctggccc

SEQ ID NO: 4282696 - DNA, 15 bp, Homo sapiens
tgtccgactcttctg

SEQ ID NO: 4282697 - DNA, 22 bp, Homo sapiens
tgtcctaaatgcaaagcacacc

SEQ ID NO: 4282698 - DNA, 14 bp, Homo sapiens
tgtcctacacttga

SEQ ID NO: 4282699 - DNA, 16 bp, Homo sapiens
tgtcctatccccggac

SEQ ID NO: 4282700 - DNA, 21 bp, Homo sapiens
tgtcctatccccggacgcatg

SEQ ID NO: 4282701 - DNA, 16 bp, Homo sapiens
tgtcctatccctggac

SEQ ID NO: 4282702 - DNA, 11 bp, Homo sapiens
tgtcctgactg

SEQ ID NO: 4282703 - DNA, 15 bp, Homo sapiens
tgtcctgactgtcct

SEQ ID NO: 4282704 - DNA, 16 bp, Homo sapiens
tgtcctgactgtccta

SEQ ID NO: 4282705 - DNA, 18 bp, Homo sapiens
tgtcctgtgagatgtgta

SEQ ID NO: 4282706 - DNA, 23 bp, Homo sapiens
tgtcctgtgagatgtgtatcagt

SEQ ID NO: 4282707 - DNA, 15 bp, Homo sapiens
tgtcctgttgattaa

SEQ ID NO: 4282708 - DNA, 15 bp, Homo sapiens
tgtctagtttgcata

SEQ ID NO: 4282709 - DNA, 18 bp, Homo sapiens
tgtctattacctgttagt

SEQ ID NO: 4282710 - DNA, 14 bp, Homo sapiens
tgtctccagacccc

SEQ ID NO: 4282711 - DNA, 14 bp, Homo sapiens
tgtctccagctgat

SEQ ID NO: 4282712 - DNA, 17 bp, Homo sapiens
tgtctccttggttatat

SEQ ID NO: 4282713 - DNA, 20 bp, Homo sapiens
tgtctcgaaataatttttta

SEQ ID NO: 4282714 - DNA, 17 bp, Homo sapiens
tgtctgaagtcactgca

SEQ ID NO: 4282715 - DNA, 20 bp, Homo sapiens
tgtctgagccctgccctcac

SEQ ID NO: 4282716 - DNA, 21 bp, Homo sapiens
tgtctgagccctgccctcact

SEQ ID NO: 4282717 - DNA, 12 bp, Homo sapiens
tgtctgattcta

SEQ ID NO: 4282718 - DNA, 13 bp, Homo sapiens
tgtctgattctat

SEQ ID NO: 4282719 - DNA, 15 bp, Homo sapiens
tgtctgcgccgctgt

SEQ ID NO: 4282720 - DNA, 18 bp, Homo sapiens
tgtctgcgccgctgtgct

SEQ ID NO: 4282721 - DNA, 19 bp, Homo sapiens
tgtctgcgccgctgtgctg

SEQ ID NO: 4282722 - DNA, 14 bp, Homo sapiens
tgtctggatcagta

SEQ ID NO: 4282723 - DNA, 15 bp, Homo sapiens
tgtctggatcagtaa

SEQ ID NO: 4282724 - DNA, 20 bp, Homo sapiens
tgtctggatcagtaaaatta

SEQ ID NO: 4282725 - DNA, 15 bp, Homo sapiens
tgtctggctgtggcc

SEQ ID NO: 4282726 - DNA, 21 bp, Homo sapiens
tgtctgtaaatctaacattat

SEQ ID NO: 4282727 - DNA, 23 bp, Homo sapiens
tgtctgtaatcacactctcttct

SEQ ID NO: 4282728 - DNA, 18 bp, Homo sapiens
tgtctgtcctacccgccc

SEQ ID NO: 4282729 - DNA, 18 bp, Homo sapiens
tgtcttagtcataccatc

SEQ ID NO: 4282730 - DNA, 22 bp, Homo sapiens
tgtcttgcactggccttctgat

SEQ ID NO: 4282731 - DNA, 20 bp, Homo sapiens
tgtctttggcttcagaattg

SEQ ID NO: 4282732 - DNA, 15 bp, Homo sapiens
tgtgaaagtctcctg

SEQ ID NO: 4282733 - DNA, 18 bp, Homo sapiens
tgtgaaatttacagttac

SEQ ID NO: 4282734 - DNA, 21 bp, Homo sapiens
tgtgaaatttgttaatatata

SEQ ID NO: 4282735 - DNA, 14 bp, Homo sapiens
tgtgaactgccagg

SEQ ID NO: 4282736 - DNA, 15 bp, Homo sapiens
tgtgaccaagtataa

SEQ ID NO: 4282737 - DNA, 15 bp, Homo sapiens
tgtgactccatatcc

SEQ ID NO: 4282738 - DNA, 13 bp, Homo sapiens
tgtgactcgctta

SEQ ID NO: 4282739 - DNA, 21 bp, Homo sapiens
tgtgactcgcttagctgaaac

SEQ ID NO: 4282740 - DNA, 23 bp, Homo sapiens
tgtgactcgcttagctgaaacct

SEQ ID NO: 4282741 - DNA, 17 bp, Homo sapiens
tgtgagcatgaaactat

SEQ ID NO: 4282742 - DNA, 19 bp, Homo sapiens
tgtgagccaaagagaaaag

SEQ ID NO: 4282743 - DNA, 23 bp, Homo sapiens
tgtgaggctccctccctccctgc

SEQ ID NO: 4282744 - DNA, 17 bp, Homo sapiens
tgtgattaattattgaa

SEQ ID NO: 4282745 - DNA, 17 bp, Homo sapiens
tgtgattccccggagct

SEQ ID NO: 4282746 - DNA, 22 bp, Homo sapiens
tgtgattggcagcttcaaaaca

SEQ ID NO: 4282747 - DNA, 13 bp, Homo sapiens
tgtgcaatatgag

SEQ ID NO: 4282748 - DNA, 23 bp, Homo sapiens
tgtgcaatatgaggggactgcat

SEQ ID NO: 4282749 - DNA, 15 bp, Homo sapiens
tgtgcaatatgtaac

SEQ ID NO: 4282750 - DNA, 19 bp, Homo sapiens
tgtgcactttatcttggga

SEQ ID NO: 4282751 - DNA, 13 bp, Homo sapiens
tgtgcagatgaag

SEQ ID NO: 4282752 - DNA, 14 bp, Homo sapiens
tgtgcagccgggga

SEQ ID NO: 4282753 - DNA, 21 bp, Homo sapiens
tgtgcagccggggagctgagg

SEQ ID NO: 4282754 - DNA, 19 bp, Homo sapiens
ttccccctccaatcccacc

SEQ ID NO: 4282755 - DNA, 10 bp, Homo sapiens
ttcccccttc

SEQ ID NO: 4282756 - DNA, 16 bp, Homo sapiens
ttcccccttcccctgc

SEQ ID NO: 4282757 - DNA, 16 bp, Homo sapiens
ttcccctgcgccctcc

SEQ ID NO: 4282758 - DNA, 19 bp, Homo sapiens
ttcccctgcgccctccctc

SEQ ID NO: 4282759 - DNA, 20 bp, Homo sapiens
ttcccctgcgccctccctcc

SEQ ID NO: 4282760 - DNA, 14 bp, Homo sapiens
ttcccctgttcact

SEQ ID NO: 4282761 - DNA, 22 bp, Homo sapiens
ttccccttgggatgggcacagg

SEQ ID NO: 4282762 - DNA, 15 bp, Homo sapiens
ttcccgctcagccct

SEQ ID NO: 4282763 - DNA, 21 bp, Homo sapiens
ttcccgctcagccctccctgc

SEQ ID NO: 4282764 - DNA, 18 bp, Homo sapiens
ttccctctgcctgtccct

SEQ ID NO: 4282765 - DNA, 14 bp, Homo sapiens
ttccctctgctcca

SEQ ID NO: 4282766 - DNA, 16 bp, Homo sapiens
ttccctgcatcccttg

SEQ ID NO: 4282767 - DNA, 20 bp, Homo sapiens
ttccctgcctaggagctggg

SEQ ID NO: 4282768 - DNA, 19 bp, Homo sapiens
ttccgaagaccttctgaag

SEQ ID NO: 4282769 - DNA, 16 bp, Homo sapiens
ttcctaaactctgaaa

SEQ ID NO: 4282770 - DNA, 11 bp, Homo sapiens
ttcctccccag

SEQ ID NO: 4282771 - DNA, 13 bp, Homo sapiens
ttcctctccactg

SEQ ID NO: 4282772 - DNA, 14 bp, Homo sapiens
ttcctctccactgc

SEQ ID NO: 4282773 - DNA, 21 bp, Homo sapiens
ttcctcttagaagaatattgt

SEQ ID NO: 4282774 - DNA, 11 bp, Homo sapiens
ttcctgagctt

SEQ ID NO: 4282775 - DNA, 20 bp, Homo sapiens
ttcctgagcttggccagaag

SEQ ID NO: 4282776 - DNA, 11 bp, Homo sapiens
ttcctgcccta

SEQ ID NO: 4282777 - DNA, 12 bp, Homo sapiens
ttcctgccctag

SEQ ID NO: 4282778 - DNA, 15 bp, Homo sapiens
ttcctgctacagtag

SEQ ID NO: 4282779 - DNA, 18 bp, Homo sapiens
ttcctgctacagtagctg

SEQ ID NO: 4282780 - DNA, 23 bp, Homo sapiens
ttcctggattttctttctatgta

SEQ ID NO: 4282781 - DNA, 18 bp, Homo sapiens
ttcctgggagtgggagtc

SEQ ID NO: 4282782 - DNA, 18 bp, Homo sapiens
ttcctgggcagcccagag

SEQ ID NO: 4282783 - DNA, 19 bp, Homo sapiens
ttcctgggcagcccagaga

SEQ ID NO: 4282784 - DNA, 20 bp, Homo sapiens
ttcctgggcagcccagagag

SEQ ID NO: 4282785 - DNA, 14 bp, Homo sapiens
ttcctgtgcacagc

SEQ ID NO: 4282786 - DNA, 14 bp, Homo sapiens
ttcctgttgtctga

SEQ ID NO: 4282787 - DNA, 18 bp, Homo sapiens
ttccttaagtggctgtga

SEQ ID NO: 4282788 - DNA, 14 bp, Homo sapiens
ttccttcctgttct

SEQ ID NO: 4282789 - DNA, 14 bp, Homo sapiens
ttccttggcccagc

SEQ ID NO: 4282790 - DNA, 14 bp, Homo sapiens
ttcgccatgtgctg

SEQ ID NO: 4282791 - DNA, 17 bp, Homo sapiens
ttcgctattcccaggca

SEQ ID NO: 4282792 - DNA, 18 bp, Homo sapiens
ttcgctattcccaggcag

SEQ ID NO: 4282793 - DNA, 12 bp, Homo sapiens
ttcggtgcttcc

SEQ ID NO: 4282794 - DNA, 17 bp, Homo sapiens
ttcgtgcatttgtgagc

SEQ ID NO: 4282795 - DNA, 12 bp, Homo sapiens
ttcgtggagctc

SEQ ID NO: 4282796 - DNA, 15 bp, Homo sapiens
ttctaaaaagtcaga

SEQ ID NO: 4282797 - DNA, 18 bp, Homo sapiens
ttctaaaaagtcagatgt

SEQ ID NO: 4282798 - DNA, 15 bp, Homo sapiens
ttctaaactgttttc

SEQ ID NO: 4282799 - DNA, 18 bp, Homo sapiens
ttctaagaaatatctgtg

SEQ ID NO: 4282800 - DNA, 22 bp, Homo sapiens
ttctaagattgtacatatggaa

SEQ ID NO: 4282801 - DNA, 21 bp, Homo sapiens
ttctaagcttatttctaacta

SEQ ID NO: 4282802 - DNA, 14 bp, Homo sapiens
ttctaatccatgtg

SEQ ID NO: 4282803 - DNA, 17 bp, Homo sapiens
ttctaattggcatgaag

SEQ ID NO: 4282804 - DNA, 19 bp, Homo sapiens
ttctagaaggatgaacagt

SEQ ID NO: 4282805 - DNA, 15 bp, Homo sapiens
ttctagattaccatg

SEQ ID NO: 4282806 - DNA, 23 bp, Homo sapiens
ttctagctataacaactctattt

SEQ ID NO: 4282807 - DNA, 19 bp, Homo sapiens
ttctagtcaactgctgttt

SEQ ID NO: 4282808 - DNA, 23 bp, Homo sapiens
ttctagtctctgatttgcaaatg

SEQ ID NO: 4282809 - DNA, 12 bp, Homo sapiens
ttctatactgtt

SEQ ID NO: 4282810 - DNA, 13 bp, Homo sapiens
ttctatactgttt

SEQ ID NO: 4282811 - DNA, 14 bp, Homo sapiens
ttctatatttcata

SEQ ID NO: 4282812 - DNA, 15 bp, Homo sapiens
ttctatctactgatt

SEQ ID NO: 4282813 - DNA, 17 bp, Homo sapiens
ttctatctactgatttg

SEQ ID NO: 4282814 - DNA, 14 bp, Homo sapiens
ttctatgcctgtat

SEQ ID NO: 4282815 - DNA, 19 bp, Homo sapiens
ttctatgcctgtatttcca

SEQ ID NO: 4282816 - DNA, 23 bp, Homo sapiens
ttctcaaagtttttacagtgtat

SEQ ID NO: 4282817 - DNA, 16 bp, Homo sapiens
ttctcaaatgctactc

SEQ ID NO: 4282818 - DNA, 20 bp, Homo sapiens
ttctcagagctccacagaag

SEQ ID NO: 4282819 - DNA, 15 bp, Homo sapiens
ttctcagcctccgga

SEQ ID NO: 4282820 - DNA, 13 bp, Homo sapiens
ttctcaggaagat

SEQ ID NO: 4282821 - DNA, 11 bp, Homo sapiens
ttctcatgcac

SEQ ID NO: 4282822 - DNA, 13 bp, Homo sapiens
ttctcccacactg

SEQ ID NO: 4282823 - DNA, 15 bp, Homo sapiens
ttctcccctccagac

SEQ ID NO: 4282824 - DNA, 19 bp, Homo sapiens
ttctcccctccagacccct

SEQ ID NO: 4282825 - DNA, 22 bp, Homo sapiens
ttctcctttcacaaccttctgt

SEQ ID NO: 4282826 - DNA, 22 bp, Homo sapiens
ttctctcaggtgcgtgccacat

SEQ ID NO: 4282827 - DNA, 14 bp, Homo sapiens
ttctctctgtgctg

SEQ ID NO: 4282828 - DNA, 19 bp, Homo sapiens
ttctctgcttttccattct

SEQ ID NO: 4282829 - DNA, 22 bp, Homo sapiens
ttctcttacgctctctgtctgg

SEQ ID NO: 4282830 - DNA, 15 bp, Homo sapiens
ttctcttgggctgag

SEQ ID NO: 4282831 - DNA, 21 bp, Homo sapiens
ttctcttttcaaacacacaca

SEQ ID NO: 4282832 - DNA, 13 bp, Homo sapiens
ttctgaattcata

SEQ ID NO: 4282833 - DNA, 14 bp, Homo sapiens
ttctgaccccactt

SEQ ID NO: 4282834 - DNA, 15 bp, Homo sapiens
ttctgagttcctgca

SEQ ID NO: 4282835 - DNA, 14 bp, Homo sapiens
ttctgatgaaatgt

SEQ ID NO: 4282836 - DNA, 20 bp, Homo sapiens
ttctgcggagcttctccagc

SEQ ID NO: 4282837 - DNA, 21 bp, Homo sapiens
ttctgcggagcttctccagcc

SEQ ID NO: 4282838 - DNA, 19 bp, Homo sapiens
ttctggacccgttcaactt

SEQ ID NO: 4282839 - DNA, 17 bp, Homo sapiens
ttctgggaaatggcttg

SEQ ID NO: 4282840 - DNA, 14 bp, Homo sapiens
ttctggggcccctt

SEQ ID NO: 4282841 - DNA, 23 bp, Homo sapiens
ttctgggggatttcaagggactg

SEQ ID NO: 4282842 - DNA, 22 bp, Homo sapiens
ttctggggtggggcttggaagg

SEQ ID NO: 4282843 - DNA, 23 bp, Homo sapiens
ttctgtaatatttacaatgtatt

SEQ ID NO: 4282844 - DNA, 14 bp, Homo sapiens
ttctgtctgtaaga

SEQ ID NO: 4282845 - DNA, 14 bp, Homo sapiens
ttctgtggattcta

SEQ ID NO: 4282846 - DNA, 16 bp, Homo sapiens
ttctgtggattctata

SEQ ID NO: 4282847 - DNA, 19 bp, Homo sapiens
ttctgtggattctatattt

SEQ ID NO: 4282848 - DNA, 16 bp, Homo sapiens
ttctgtggctcacaga

SEQ ID NO: 4282849 - DNA, 22 bp, Homo sapiens
ttctgtgggcagctggctctga

SEQ ID NO: 4282850 - DNA, 16 bp, Homo sapiens
ttctgtgtctgctgta

SEQ ID NO: 4282851 - DNA, 16 bp, Homo sapiens
ttctgttttgcctgaa

SEQ ID NO: 4282852 - DNA, 21 bp, Homo sapiens
ttcttatacagataaaacatg

SEQ ID NO: 4282853 - DNA, 17 bp, Homo sapiens
ttcttcaagatcccatt

SEQ ID NO: 4282854 - DNA, 15 bp, Homo sapiens
ttcttcccatttgta

SEQ ID NO: 4282855 - DNA, 16 bp, Homo sapiens
ttcttctctctgtgct

SEQ ID NO: 4282856 - DNA, 14 bp, Homo sapiens
ttcttctgtaatat

SEQ ID NO: 4282857 - DNA, 14 bp, Homo sapiens
ttcttgctttcaca

SEQ ID NO: 4282858 - DNA, 17 bp, Homo sapiens
ttcttgctttcacaaat

SEQ ID NO: 4282859 - DNA, 19 bp, Homo sapiens
ttcttggatctttttgcag

SEQ ID NO: 4282860 - DNA, 14 bp, Homo sapiens
ttcttgtatctgga

SEQ ID NO: 4282861 - DNA, 18 bp, Homo sapiens
ttcttgtgttgttttctc

SEQ ID NO: 4282862 - DNA, 19 bp, Homo sapiens
ttcttgtgttgttttctct

SEQ ID NO: 4282863 - DNA, 13 bp, Homo sapiens
ttcttttaatttt

SEQ ID NO: 4282864 - DNA, 14 bp, Homo sapiens
ttcttttatatctg

SEQ ID NO: 4282865 - DNA, 15 bp, Homo sapiens
ttcttttatatctgt

SEQ ID NO: 4282866 - DNA, 22 bp, Homo sapiens
ttcttttcagcttgtttctata

SEQ ID NO: 4282867 - DNA, 18 bp, Homo sapiens
ttgaaaagaagaaagtct

SEQ ID NO: 4282868 - DNA, 22 bp, Homo sapiens
ttgaaaagaagaaagtctatgc

SEQ ID NO: 4282869 - DNA, 22 bp, Homo sapiens
ttgaaagatggtaatcttttct

SEQ ID NO: 4282870 - DNA, 23 bp, Homo sapiens
ttgaaagtggggtgttgaagacc

SEQ ID NO: 4282871 - DNA, 18 bp, Homo sapiens
ttgaagagagatatatct

SEQ ID NO: 4282872 - DNA, 18 bp, Homo sapiens
ttgaagtatctgtacctg

SEQ ID NO: 4282873 - DNA, 24 bp, Homo sapiens
ttgaatctgattggacattttctt

SEQ ID NO: 4282874 - DNA, 19 bp, Homo sapiens
ttgaatgtccccattctat

SEQ ID NO: 4282875 - DNA, 20 bp, Homo sapiens
ttgaatgtccccattctata

SEQ ID NO: 4282876 - DNA, 21 bp, Homo sapiens
ttgaattacagggaagaaatc

SEQ ID NO: 4282877 - DNA, 20 bp, Homo sapiens
ttgacacattgcacacacag

SEQ ID NO: 4282878 - DNA, 11 bp, Homo sapiens
ttgacatgcac

SEQ ID NO: 4282879 - DNA, 13 bp, Homo sapiens
ttgagaataaatg

SEQ ID NO: 4282880 - DNA, 17 bp, Homo sapiens
ttgagagcgctggcctc

SEQ ID NO: 4282881 - DNA, 18 bp, Homo sapiens
ttgagagcgctggcctct

SEQ ID NO: 4282882 - DNA, 14 bp, Homo sapiens
ttgagcagaattca

SEQ ID NO: 4282883 - DNA, 21 bp, Homo sapiens
ttgagcagtggcctacaaatc

SEQ ID NO: 4282884 - DNA, 21 bp, Homo sapiens
ttgaggacctccacctgggag

SEQ ID NO: 4282885 - DNA, 9 bp, Homo sapiens
aaaagtgtc

SEQ ID NO: 4282886 - DNA, 16 bp, Homo sapiens
aaaagttgcacattag

SEQ ID NO: 4282887 - DNA, 13 bp, Homo sapiens
aaaataacatatt

SEQ ID NO: 4282888 - DNA, 20 bp, Homo sapiens
aaaataacatattcttgctt

SEQ ID NO: 4282889 - DNA, 16 bp, Homo sapiens
aaaataacatctgaaa

SEQ ID NO: 4282890 - DNA, 17 bp, Homo sapiens
aaaataacatctgaaaa

SEQ ID NO: 4282891 - DNA, 20 bp, Homo sapiens
aaaataacatctgaaaagaa

SEQ ID NO: 4282892 - DNA, 18 bp, Homo sapiens
aaaataatcaagtgcatt

SEQ ID NO: 4282893 - DNA, 15 bp, Homo sapiens
aaaatactcaccaaa

SEQ ID NO: 4282894 - DNA, 18 bp, Homo sapiens
aaaatagtaaatgctttg

SEQ ID NO: 4282895 - DNA, 19 bp, Homo sapiens
aaaatagttctatttctat

SEQ ID NO: 4282896 - DNA, 12 bp, Homo sapiens
aaaatagttttc

SEQ ID NO: 4282897 - DNA, 15 bp, Homo sapiens
aaaatagttttctaa

SEQ ID NO: 4282898 - DNA, 20 bp, Homo sapiens
aaaatatttctaagcttatt

SEQ ID NO: 4282899 - DNA, 18 bp, Homo sapiens
aaaatcagtgatgggagt

SEQ ID NO: 4282900 - DNA, 22 bp, Homo sapiens
aaaatccaagctgctcatttca

SEQ ID NO: 4282901 - DNA, 13 bp, Homo sapiens
aaaatgattttta

SEQ ID NO: 4282902 - DNA, 21 bp, Homo sapiens
aaaatgatttttaacattatg

SEQ ID NO: 4282903 - DNA, 13 bp, Homo sapiens
aaaattctagtct

SEQ ID NO: 4282904 - DNA, 22 bp, Homo sapiens
aaaattgagttcttcctgtaat

SEQ ID NO: 4282905 - DNA, 15 bp, Homo sapiens
aaaattgcattttta

SEQ ID NO: 4282906 - DNA, 22 bp, Homo sapiens
aaaattgcatttttacctttca

SEQ ID NO: 4282907 - DNA, 20 bp, Homo sapiens
aaacaaattcaagaatgcag

SEQ ID NO: 4282908 - DNA, 15 bp, Homo sapiens
aaacaaattccttcc

SEQ ID NO: 4282909 - DNA, 19 bp, Homo sapiens
aaacaacagtcttcatttt

SEQ ID NO: 4282910 - DNA, 14 bp, Homo sapiens
aaacaataaacgaa

SEQ ID NO: 4282911 - DNA, 13 bp, Homo sapiens
aaacaattcaaag

SEQ ID NO: 4282912 - DNA, 11 bp, Homo sapiens
aaacacacaca

SEQ ID NO: 4282913 - DNA, 13 bp, Homo sapiens
aaacacagctgtt

SEQ ID NO: 4282914 - DNA, 16 bp, Homo sapiens
aaacacctaagtgact

SEQ ID NO: 4282915 - DNA, 14 bp, Homo sapiens
aaacactttttctg

SEQ ID NO: 4282916 - DNA, 22 bp, Homo sapiens
aaacagaaacgagatttgccaa

SEQ ID NO: 4282917 - DNA, 17 bp, Homo sapiens
aaacagggcatctccag

SEQ ID NO: 4282918 - DNA, 17 bp, Homo sapiens
aaacagttgcacagcat

SEQ ID NO: 4282919 - DNA, 20 bp, Homo sapiens
aaacatgactctttattgtc

SEQ ID NO: 4282920 - DNA, 16 bp, Homo sapiens
aaacatgccctcaggc

SEQ ID NO: 4282921 - DNA, 17 bp, Homo sapiens
aaacatgccctcaggct

SEQ ID NO: 4282922 - DNA, 23 bp, Homo sapiens
aaacatggccacatccaacattt

SEQ ID NO: 4282923 - DNA, 17 bp, Homo sapiens
aaacatgtctgtgaact

SEQ ID NO: 4282924 - DNA, 14 bp, Homo sapiens
aaacattaaaagaa

SEQ ID NO: 4282925 - DNA, 16 bp, Homo sapiens
aaaccaagccgtggct

SEQ ID NO: 4282926 - DNA, 12 bp, Homo sapiens
aaaccaatgatt

SEQ ID NO: 4282927 - DNA, 15 bp, Homo sapiens
aaaccaatgattcat

SEQ ID NO: 4282928 - DNA, 16 bp, Homo sapiens
aaaccacagccctgtc

SEQ ID NO: 4282929 - DNA, 17 bp, Homo sapiens
aaaccacagccctgtca

SEQ ID NO: 4282930 - DNA, 20 bp, Homo sapiens
aaacctaaggcaacatttcc

SEQ ID NO: 4282931 - DNA, 15 bp, Homo sapiens
aaaccttaatatttc

SEQ ID NO: 4282932 - DNA, 16 bp, Homo sapiens
aaacgagatttgccaa

SEQ ID NO: 4282933 - DNA, 18 bp, Homo sapiens
aaactcacctgctggccc

SEQ ID NO: 4282934 - DNA, 19 bp, Homo sapiens
aaactcacctgctggcccc

SEQ ID NO: 4282935 - DNA, 22 bp, Homo sapiens
aaactcacctgctggcccctca

SEQ ID NO: 4282936 - DNA, 19 bp, Homo sapiens
aaactgaggccattatttc

SEQ ID NO: 4282937 - DNA, 14 bp, Homo sapiens
aaactgcatttgtg

SEQ ID NO: 4282938 - DNA, 12 bp, Homo sapiens
aaactgtagtaa

SEQ ID NO: 4282939 - DNA, 23 bp, Homo sapiens
aaacttactgtcagagaatatga

SEQ ID NO: 4282940 - DNA, 17 bp, Homo sapiens
aaacttgagcccactcc

SEQ ID NO: 4282941 - DNA, 12 bp, Homo sapiens
aaagaaagattt

SEQ ID NO: 4282942 - DNA, 16 bp, Homo sapiens
aaagaacccccctccc

SEQ ID NO: 4282943 - DNA, 18 bp, Homo sapiens
aaagaacccccctcccca

SEQ ID NO: 4282944 - DNA, 16 bp, Homo sapiens
aaagaagaaaataacc

SEQ ID NO: 4282945 - DNA, 13 bp, Homo sapiens
aaagaagaaagtc

SEQ ID NO: 4282946 - DNA, 19 bp, Homo sapiens
aaagaagaaagtctatgct

SEQ ID NO: 4282947 - DNA, 23 bp, Homo sapiens
aaagacatttaaaatagttttct

SEQ ID NO: 4282948 - DNA, 18 bp, Homo sapiens
aaagacctgtgaggggaa

SEQ ID NO: 4282949 - DNA, 14 bp, Homo sapiens
aaagacttgatgaa

SEQ ID NO: 4282950 - DNA, 15 bp, Homo sapiens
aaagagaaaaaccaa

SEQ ID NO: 4282951 - DNA, 21 bp, Homo sapiens
aactaagcaagtatatttatt

SEQ ID NO: 4282952 - DNA, 13 bp, Homo sapiens
aactaccaaaatg

SEQ ID NO: 4282953 - DNA, 16 bp, Homo sapiens
aactaccaaaatgaag

SEQ ID NO: 4282954 - DNA, 16 bp, Homo sapiens
aactagatctcctgta

SEQ ID NO: 4282955 - DNA, 15 bp, Homo sapiens
aactaggtgctggca

SEQ ID NO: 4282956 - DNA, 16 bp, Homo sapiens
aactatcggttcaagt

SEQ ID NO: 4282957 - DNA, 24 bp, Homo sapiens
aactatgcacctataaatactaaa

SEQ ID NO: 4282958 - DNA, 23 bp, Homo sapiens
aactattaggaggaatgtgcttt

SEQ ID NO: 4282959 - DNA, 12 bp, Homo sapiens
aactcacctgct

SEQ ID NO: 4282960 - DNA, 16 bp, Homo sapiens
aactcacctgctggcc

SEQ ID NO: 4282961 - DNA, 13 bp, Homo sapiens
aactcagccttaa

SEQ ID NO: 4282962 - DNA, 12 bp, Homo sapiens
aactccaaggca

SEQ ID NO: 4282963 - DNA, 15 bp, Homo sapiens
aactccaaggcaaat

SEQ ID NO: 4282964 - DNA, 13 bp, Homo sapiens
aactccactcagc

SEQ ID NO: 4282965 - DNA, 14 bp, Homo sapiens
aactccactcagca

SEQ ID NO: 4282966 - DNA, 10 bp, Homo sapiens
aactctctct

SEQ ID NO: 4282967 - DNA, 13 bp, Homo sapiens
aactctctctgcc

SEQ ID NO: 4282968 - DNA, 17 bp, Homo sapiens
aactctctctgccccca

SEQ ID NO: 4282969 - DNA, 18 bp, Homo sapiens
aactctgaaatcagcctt

SEQ ID NO: 4282970 - DNA, 17 bp, Homo sapiens
aactgagtccttaaaca

SEQ ID NO: 4282971 - DNA, 21 bp, Homo sapiens
aactggaataagaagcaaata

SEQ ID NO: 4282972 - DNA, 14 bp, Homo sapiens
aactgtagtaattg

SEQ ID NO: 4282973 - DNA, 16 bp, Homo sapiens
aactgtatatttgtat

SEQ ID NO: 4282974 - DNA, 15 bp, Homo sapiens
aactgtcattacaga

SEQ ID NO: 4282975 - DNA, 23 bp, Homo sapiens
aactgtcccacaaaatatttcta

SEQ ID NO: 4282976 - DNA, 15 bp, Homo sapiens
aactgttaacttatt

SEQ ID NO: 4282977 - DNA, 14 bp, Homo sapiens
aactgtttatggta

SEQ ID NO: 4282978 - DNA, 13 bp, Homo sapiens
aacttacacacaa

SEQ ID NO: 4282979 - DNA, 20 bp, Homo sapiens
aacttactgtcagagaatat

SEQ ID NO: 4282980 - DNA, 13 bp, Homo sapiens
aacttcaccttaa

SEQ ID NO: 4282981 - DNA, 16 bp, Homo sapiens
aacttcatctgtctgt

SEQ ID NO: 4282982 - DNA, 16 bp, Homo sapiens
aacttctactcttcaa

SEQ ID NO: 4282983 - DNA, 16 bp, Homo sapiens
aacttgaacaaagtct

SEQ ID NO: 4282984 - DNA, 12 bp, Homo sapiens
aacttggagccg

SEQ ID NO: 4282985 - DNA, 17 bp, Homo sapiens
aacttggtgcttattga

SEQ ID NO: 4282986 - DNA, 20 bp, Homo sapiens
aacttggtgcttattgatat

SEQ ID NO: 4282987 - DNA, 11 bp, Homo sapiens
aactttagaaa

SEQ ID NO: 4282988 - DNA, 20 bp, Homo sapiens
aactttagaaataaacctta

SEQ ID NO: 4282989 - DNA, 19 bp, Homo sapiens
aagaaagctatatatgaat

SEQ ID NO: 4282990 - DNA, 13 bp, Homo sapiens
aagaaatgctaat

SEQ ID NO: 4282991 - DNA, 16 bp, Homo sapiens
aagaaatgctaatgta

SEQ ID NO: 4282992 - DNA, 12 bp, Homo sapiens
aagaaccatctt

SEQ ID NO: 4282993 - DNA, 16 bp, Homo sapiens
aagaacccccctcccc

SEQ ID NO: 4282994 - DNA, 20 bp, Homo sapiens
aagaagaaagtctatgctta

SEQ ID NO: 4282995 - DNA, 14 bp, Homo sapiens
aagaagattctaaa

SEQ ID NO: 4282996 - DNA, 14 bp, Homo sapiens
aagaaggaggaatt

SEQ ID NO: 4282997 - DNA, 15 bp, Homo sapiens
aagaaggcccgggag

SEQ ID NO: 4282998 - DNA, 20 bp, Homo sapiens
aagaaggcccgggaggagga

SEQ ID NO: 4282999 - DNA, 17 bp, Homo sapiens
aagaagggaaattcaca

SEQ ID NO: 4283000 - DNA, 21 bp, Homo sapiens
aagaagggaaattcacactgt

SEQ ID NO: 4283001 - DNA, 22 bp, Homo sapiens
aagaagtgggagtgggagagga

SEQ ID NO: 4283002 - DNA, 23 bp, Homo sapiens
aagaagtgggagtgggagaggaa

SEQ ID NO: 4283003 - DNA, 19 bp, Homo sapiens
aagaagtggggcagcagca

SEQ ID NO: 4283004 - DNA, 18 bp, Homo sapiens
aagaatattgtattgtta

SEQ ID NO: 4283005 - DNA, 12 bp, Homo sapiens
aagaatattgtt

SEQ ID NO: 4283006 - DNA, 20 bp, Homo sapiens
aagacacgcccgactctctc

SEQ ID NO: 4283007 - DNA, 19 bp, Homo sapiens
aagacacgtgtttttgtat

SEQ ID NO: 4283008 - DNA, 19 bp, Homo sapiens
aagacagcagagccatctg

SEQ ID NO: 4283009 - DNA, 14 bp, Homo sapiens
aagacatttaaaat

SEQ ID NO: 4283010 - DNA, 21 bp, Homo sapiens
aagacctcgtctttgcttgtc

SEQ ID NO: 4283011 - DNA, 14 bp, Homo sapiens
aagacctgtgaggg

SEQ ID NO: 4283012 - DNA, 17 bp, Homo sapiens
aagacctgtgaggggaa

SEQ ID NO: 4283013 - DNA, 19 bp, Homo sapiens
aagaccttctgaagatctc

SEQ ID NO: 4283014 - DNA, 12 bp, Homo sapiens
aagacggccttg

SEQ ID NO: 4283015 - DNA, 17 bp, Homo sapiens
aagactgttttcagacc

SEQ ID NO: 4283016 - DNA, 12 bp, Homo sapiens
aagagaaaagat

SEQ ID NO: 4283017 - DNA, 11 bp, Homo sapiens
aagagaattca

SEQ ID NO: 4283018 - DNA, 21 bp, Homo sapiens
aagagaattctaagattgtac

SEQ ID NO: 4283019 - DNA, 19 bp, Homo sapiens
aagagcatgtaagaaataa

SEQ ID NO: 4283020 - DNA, 13 bp, Homo sapiens
aagaggagccttt

SEQ ID NO: 4283021 - DNA, 21 bp, Homo sapiens
aagaggagttctaacacattt

SEQ ID NO: 4283022 - DNA, 18 bp, Homo sapiens
aagagggagaaggagagg

SEQ ID NO: 4283023 - DNA, 14 bp, Homo sapiens
aagagtaaaaccaa

SEQ ID NO: 4283024 - DNA, 18 bp, Homo sapiens
aagagtaaaaccaaaggt

SEQ ID NO: 4283025 - DNA, 22 bp, Homo sapiens
aagatgtcaagctggccgtgga

SEQ ID NO: 4283026 - DNA, 17 bp, Homo sapiens
aagattttattttcaag

SEQ ID NO: 4283027 - DNA, 16 bp, Homo sapiens
aagcaaataaatatca

SEQ ID NO: 4283028 - DNA, 18 bp, Homo sapiens
aagcaaatatttatgacc

SEQ ID NO: 4283029 - DNA, 13 bp, Homo sapiens
aattattctagtc

SEQ ID NO: 4283030 - DNA, 20 bp, Homo sapiens
aattatttctaaaacattaa

SEQ ID NO: 4283031 - DNA, 16 bp, Homo sapiens
aattcaaacctaagtt

SEQ ID NO: 4283032 - DNA, 19 bp, Homo sapiens
aattcaacaaatgatgttg

SEQ ID NO: 4283033 - DNA, 14 bp, Homo sapiens
aattcataaaaata

SEQ ID NO: 4283034 - DNA, 16 bp, Homo sapiens
aattcataaaaataac

SEQ ID NO: 4283035 - DNA, 19 bp, Homo sapiens
aattcattcatacttaaaa

SEQ ID NO: 4283036 - DNA, 22 bp, Homo sapiens
aattcattcccttctctcagcc

SEQ ID NO: 4283037 - DNA, 13 bp, Homo sapiens
aattcgagacagg

SEQ ID NO: 4283038 - DNA, 22 bp, Homo sapiens
aattcgagacaggcagaatcag

SEQ ID NO: 4283039 - DNA, 19 bp, Homo sapiens
aattctaagattgtacata

SEQ ID NO: 4283040 - DNA, 17 bp, Homo sapiens
aattctagtctctgatt

SEQ ID NO: 4283041 - DNA, 16 bp, Homo sapiens
aattctctaggaaagt

SEQ ID NO: 4283042 - DNA, 21 bp, Homo sapiens
aattctcttttcaaacacaca

SEQ ID NO: 4283043 - DNA, 15 bp, Homo sapiens
aattctgtccctgtc

SEQ ID NO: 4283044 - DNA, 16 bp, Homo sapiens
aattctgtccctgtcc

SEQ ID NO: 4283045 - DNA, 23 bp, Homo sapiens
aattgaagagagatatatctgaa

SEQ ID NO: 4283046 - DNA, 16 bp, Homo sapiens
aattgaagtcatcata

SEQ ID NO: 4283047 - DNA, 23 bp, Homo sapiens
aattgctgaggagctcagggctg

SEQ ID NO: 4283048 - DNA, 18 bp, Homo sapiens
aattggtgataagtggaa

SEQ ID NO: 4283049 - DNA, 22 bp, Homo sapiens
aattgtagagtgcccatggggt

SEQ ID NO: 4283050 - DNA, 18 bp, Homo sapiens
aattgtataaaacagtgt

SEQ ID NO: 4283051 - DNA, 14 bp, Homo sapiens
aattgttacaattt

SEQ ID NO: 4283052 - DNA, 16 bp, Homo sapiens
aattgttacaattttc

SEQ ID NO: 4283053 - DNA, 15 bp, Homo sapiens
aattgttatacattt

SEQ ID NO: 4283054 - DNA, 15 bp, Homo sapiens
aattgtttgtcctca

SEQ ID NO: 4283055 - DNA, 13 bp, Homo sapiens
aatttaactgcat

SEQ ID NO: 4283056 - DNA, 15 bp, Homo sapiens
aatttaactgcatat

SEQ ID NO: 4283057 - DNA, 22 bp, Homo sapiens
aatttaactgcatatagataat

SEQ ID NO: 4283058 - DNA, 16 bp, Homo sapiens
aatttatgatataata

SEQ ID NO: 4283059 - DNA, 13 bp, Homo sapiens
aatttcaaaatgc

SEQ ID NO: 4283060 - DNA, 14 bp, Homo sapiens
aatttcaaaatgca

SEQ ID NO: 4283061 - DNA, 15 bp, Homo sapiens
aatttcaaaatgcat

SEQ ID NO: 4283062 - DNA, 17 bp, Homo sapiens
aatttcaaaatgcatgt

SEQ ID NO: 4283063 - DNA, 18 bp, Homo sapiens
aatttcaaaatgcatgtg

SEQ ID NO: 4283064 - DNA, 19 bp, Homo sapiens
aatttctcaatctatgtga

SEQ ID NO: 4283065 - DNA, 14 bp, Homo sapiens
aatttctgccattt

SEQ ID NO: 4283066 - DNA, 21 bp, Homo sapiens
aatttcttactaaacattttg

SEQ ID NO: 4283067 - DNA, 14 bp, Homo sapiens
aatttgttaatata

SEQ ID NO: 4283068 - DNA, 15 bp, Homo sapiens
aattttaaaaaataa

SEQ ID NO: 4283069 - DNA, 18 bp, Homo sapiens
aattttttagttaaaatc

SEQ ID NO: 4283070 - DNA, 16 bp, Homo sapiens
acaaaactagagactc

SEQ ID NO: 4283071 - DNA, 18 bp, Homo sapiens
acaaacctctatatgttg

SEQ ID NO: 4283072 - DNA, 14 bp, Homo sapiens
acaaagtctctggg

SEQ ID NO: 4283073 - DNA, 16 bp, Homo sapiens
acaaatatagttgaac

SEQ ID NO: 4283074 - DNA, 21 bp, Homo sapiens
acaaatatgattctcctctcc

SEQ ID NO: 4283075 - DNA, 15 bp, Homo sapiens
acaaatcagtaattt

SEQ ID NO: 4283076 - DNA, 16 bp, Homo sapiens
acaaatcagtaatttt

SEQ ID NO: 4283077 - DNA, 22 bp, Homo sapiens
acaaatggcttgttcagtcact

SEQ ID NO: 4283078 - DNA, 18 bp, Homo sapiens
acaacagtcttcattttt

SEQ ID NO: 4283079 - DNA, 21 bp, Homo sapiens
acaaccacatttctggccatt

SEQ ID NO: 4283080 - DNA, 19 bp, Homo sapiens
acaaccaccgctccccagc

SEQ ID NO: 4283081 - DNA, 14 bp, Homo sapiens
acaaccatagaact

SEQ ID NO: 4283082 - DNA, 19 bp, Homo sapiens
acaaccctgcaaaggactg

SEQ ID NO: 4283083 - DNA, 19 bp, Homo sapiens
acaaccgatgctccagcca

SEQ ID NO: 4283084 - DNA, 23 bp, Homo sapiens
acaaccttcatttaaaaaggttt

SEQ ID NO: 4283085 - DNA, 13 bp, Homo sapiens
acaactgagtcct

SEQ ID NO: 4283086 - DNA, 14 bp, Homo sapiens
acaactgagtcctt

SEQ ID NO: 4283087 - DNA, 19 bp, Homo sapiens
acaactgagtccttaaaca

SEQ ID NO: 4283088 - DNA, 18 bp, Homo sapiens
acaactgtttttgaagaa

SEQ ID NO: 4283089 - DNA, 11 bp, Homo sapiens
acaacttttct

SEQ ID NO: 4283090 - DNA, 13 bp, Homo sapiens
acaacttttctgc

SEQ ID NO: 4283091 - DNA, 19 bp, Homo sapiens
acaagaagaatttgaagac

SEQ ID NO: 4283092 - DNA, 21 bp, Homo sapiens
acaagaagtgggagtgggaga

SEQ ID NO: 4283093 - DNA, 15 bp, Homo sapiens
acaagacagcagagc

SEQ ID NO: 4283094 - DNA, 21 bp, Homo sapiens
acaagacagcagagccatctg

SEQ ID NO: 4283095 - DNA, 19 bp, Homo sapiens
acaagatttccctaaaaat

SEQ ID NO: 4283096 - DNA, 20 bp, Homo sapiens
acaagcagagtgcacagctg

SEQ ID NO: 4283097 - DNA, 22 bp, Homo sapiens
acaagcagagtgcacagctgtc

SEQ ID NO: 4283098 - DNA, 21 bp, Homo sapiens
acaagcattctgtcttgaagg

SEQ ID NO: 4283099 - DNA, 15 bp, Homo sapiens
acaagccacgcctgc

SEQ ID NO: 4283100 - DNA, 11 bp, Homo sapiens
acaagcccagg

SEQ ID NO: 4283101 - DNA, 13 bp, Homo sapiens
acaagcccaggac

SEQ ID NO: 4283102 - DNA, 15 bp, Homo sapiens
acaaggccccagaga

SEQ ID NO: 4283103 - DNA, 11 bp, Homo sapiens
acaagtactgg

SEQ ID NO: 4283104 - DNA, 21 bp, Homo sapiens
acaagtatgaataaagacacc

SEQ ID NO: 4283105 - DNA, 17 bp, Homo sapiens
acaagtgctcagttcca

SEQ ID NO: 4283106 - DNA, 14 bp, Homo sapiens
acaataaaagacat

SEQ ID NO: 4283107 - DNA, 14 bp, Homo sapiens
acaataagccactg

SEQ ID NO: 4283108 - DNA, 20 bp, Homo sapiens
acaatgcctattgtaatata

SEQ ID NO: 4283109 - DNA, 17 bp, Homo sapiens
acaatggccagcccaga

SEQ ID NO: 4283110 - DNA, 16 bp, Homo sapiens
acaattaaagctgtta

SEQ ID NO: 4283111 - DNA, 13 bp, Homo sapiens
acaattagatttc

SEQ ID NO: 4283112 - DNA, 19 bp, Homo sapiens
acaattcaaagaatcacct

SEQ ID NO: 4283113 - DNA, 23 bp, Homo sapiens
acaattctgtccctgtccctgcc

SEQ ID NO: 4283114 - DNA, 13 bp, Homo sapiens
acaatttcaaaat

SEQ ID NO: 4283115 - DNA, 19 bp, Homo sapiens
acaatttcaaaatgcatgt

SEQ ID NO: 4283116 - DNA, 13 bp, Homo sapiens
acaatttctgtgt

SEQ ID NO: 4283117 - DNA, 20 bp, Homo sapiens
acacaaaggacaaaaatata

SEQ ID NO: 4283118 - DNA, 17 bp, Homo sapiens
acacaaataccagagca

SEQ ID NO: 4283119 - DNA, 15 bp, Homo sapiens
acacaagacagcaga

SEQ ID NO: 4283120 - DNA, 19 bp, Homo sapiens
acacaagaccagtgcttag

SEQ ID NO: 4283121 - DNA, 15 bp, Homo sapiens
acacaagccacgcct

SEQ ID NO: 4283122 - DNA, 15 bp, Homo sapiens
acacaattagatttc

SEQ ID NO: 4283123 - DNA, 17 bp, Homo sapiens
acacaattggaagtcta

SEQ ID NO: 4283124 - DNA, 15 bp, Homo sapiens
acacacacacacagg

SEQ ID NO: 4283125 - DNA, 13 bp, Homo sapiens
acacacagacaca

SEQ ID NO: 4283126 - DNA, 13 bp, Homo sapiens
acacacaggagga

SEQ ID NO: 4283127 - DNA, 18 bp, Homo sapiens
acacacaggccatttcat

SEQ ID NO: 4283128 - DNA, 13 bp, Homo sapiens
acacacccttccc

SEQ ID NO: 4283129 - DNA, 19 bp, Homo sapiens
acacacctgcacacccctg

SEQ ID NO: 4283130 - DNA, 19 bp, Homo sapiens
acacagactctgtgagatt

SEQ ID NO: 4283131 - DNA, 20 bp, Homo sapiens
acacagaggacagcttcccc

SEQ ID NO: 4283132 - DNA, 15 bp, Homo sapiens
acacagattatttgt

SEQ ID NO: 4283133 - DNA, 21 bp, Homo sapiens
acacagctgagctggcctatt

SEQ ID NO: 4283134 - DNA, 14 bp, Homo sapiens
acacaggaggagaa

SEQ ID NO: 4283135 - DNA, 16 bp, Homo sapiens
acacaggcccatgccc

SEQ ID NO: 4283136 - DNA, 12 bp, Homo sapiens
acacaggcctgg

SEQ ID NO: 4283137 - DNA, 18 bp, Homo sapiens
acacaggcctggcccagc

SEQ ID NO: 4283138 - DNA, 19 bp, Homo sapiens
acacaggcctggcccagcc

SEQ ID NO: 4283139 - DNA, 20 bp, Homo sapiens
acacaggcctggcccagcca

SEQ ID NO: 4283140 - DNA, 20 bp, Homo sapiens
acacataaatctgtctgatt

SEQ ID NO: 4283141 - DNA, 21 bp, Homo sapiens
acacataaatctgtctgattc

SEQ ID NO: 4283142 - DNA, 14 bp, Homo sapiens
acacattgcacaca

SEQ ID NO: 4283143 - DNA, 12 bp, Homo sapiens
acacccctgcac

SEQ ID NO: 4283144 - DNA, 17 bp, Homo sapiens
acacccctgcacacacc

SEQ ID NO: 4283145 - DNA, 20 bp, Homo sapiens
acacccctgcacacacctgc

SEQ ID NO: 4283146 - DNA, 19 bp, Homo sapiens
acacccttccccactcccg

SEQ ID NO: 4283147 - DNA, 16 bp, Homo sapiens
acaccgggcctggaga

SEQ ID NO: 4283148 - DNA, 15 bp, Homo sapiens
acaccgtccctctcc

SEQ ID NO: 4283149 - DNA, 17 bp, Homo sapiens
acacctatgtcatttca

SEQ ID NO: 4283150 - DNA, 13 bp, Homo sapiens
acacctccacccg

SEQ ID NO: 4283151 - DNA, 17 bp, Homo sapiens
acacctgcacacccctg

SEQ ID NO: 4283152 - DNA, 19 bp, Homo sapiens
acacctgcacacccctgca

SEQ ID NO: 4283153 - DNA, 23 bp, Homo sapiens
acacctgcacacccctgcacaca

SEQ ID NO: 4283154 - DNA, 15 bp, Homo sapiens
acacctgcacaccgt

SEQ ID NO: 4283155 - DNA, 19 bp, Homo sapiens
acacctgcctctgaactgc

SEQ ID NO: 4283156 - DNA, 20 bp, Homo sapiens
acacgcccgactctctccat

SEQ ID NO: 4283157 - DNA, 14 bp, Homo sapiens
acacggcctctggg

SEQ ID NO: 4283158 - DNA, 20 bp, Homo sapiens
acacgtggaggaatgctccc

SEQ ID NO: 4283159 - DNA, 13 bp, Homo sapiens
acactacaaacat

SEQ ID NO: 4283160 - DNA, 17 bp, Homo sapiens
acactctaactgtatat

SEQ ID NO: 4283161 - DNA, 12 bp, Homo sapiens
acactgaaataa

SEQ ID NO: 4283162 - DNA, 17 bp, Homo sapiens
acactgcctttgctgcc

SEQ ID NO: 4283163 - DNA, 18 bp, Homo sapiens
acactgctaggtgggcca

SEQ ID NO: 4283164 - DNA, 23 bp, Homo sapiens
acactgctaggtgggccagcccc

SEQ ID NO: 4283165 - DNA, 16 bp, Homo sapiens
acactgtatctaaaaa

SEQ ID NO: 4283166 - DNA, 18 bp, Homo sapiens
acactgtatctaaaaaat

SEQ ID NO: 4283167 - DNA, 22 bp, Homo sapiens
acacttcaggctcttctccttt

SEQ ID NO: 4283168 - DNA, 14 bp, Homo sapiens
acacttcctgtcca

SEQ ID NO: 4283169 - DNA, 17 bp, Homo sapiens
acactttacagttctgg

SEQ ID NO: 4283170 - DNA, 16 bp, Homo sapiens
acagaagacacgtgtt

SEQ ID NO: 4283171 - DNA, 21 bp, Homo sapiens
acagaagacacgtgtttttgt

SEQ ID NO: 4283172 - DNA, 23 bp, Homo sapiens
acagaagacacgtgtttttgtat

SEQ ID NO: 4283173 - DNA, 23 bp, Homo sapiens
acagaaggaaggagccagctccc

SEQ ID NO: 4283174 - DNA, 15 bp, Homo sapiens
acagaggcagtggca

SEQ ID NO: 4283175 - DNA, 16 bp, Homo sapiens
acagaggcagtggcag

SEQ ID NO: 4283176 - DNA, 19 bp, Homo sapiens
acagagggacagtgggcta

SEQ ID NO: 4283177 - DNA, 23 bp, Homo sapiens
acagagggacagtgggctatgcc

SEQ ID NO: 4283178 - DNA, 14 bp, Homo sapiens
acagagtatatatg

SEQ ID NO: 4283179 - DNA, 17 bp, Homo sapiens
acagagtatatatgtac

SEQ ID NO: 4283180 - DNA, 18 bp, Homo sapiens
acagagtatatatgtaca

SEQ ID NO: 4283181 - DNA, 18 bp, Homo sapiens
acagagtggatctggagt

SEQ ID NO: 4283182 - DNA, 14 bp, Homo sapiens
acagatcttgagca

SEQ ID NO: 4283183 - DNA, 15 bp, Homo sapiens
acagcagagccatct

SEQ ID NO: 4283184 - DNA, 17 bp, Homo sapiens
acagcagagccatctgc

SEQ ID NO: 4283185 - DNA, 19 bp, Homo sapiens
acagcatagggtccacttt

SEQ ID NO: 4283186 - DNA, 15 bp, Homo sapiens
acagccaaattgcag

SEQ ID NO: 4283187 - DNA, 12 bp, Homo sapiens
acagcctcaccc

SEQ ID NO: 4283188 - DNA, 14 bp, Homo sapiens
acagcctggcacag

SEQ ID NO: 4283189 - DNA, 22 bp, Homo sapiens
acagctaatcagcattctcact

SEQ ID NO: 4283190 - DNA, 23 bp, Homo sapiens
acagctgagcacccagctctgtc

SEQ ID NO: 4283191 - DNA, 13 bp, Homo sapiens
acagctgctttct

SEQ ID NO: 4283192 - DNA, 17 bp, Homo sapiens
acagcttcacttaaaat

SEQ ID NO: 4283193 - DNA, 18 bp, Homo sapiens
acaggaaagtggatgcca

SEQ ID NO: 4283194 - DNA, 17 bp, Homo sapiens
acaggaacacccagccc

SEQ ID NO: 4283195 - DNA, 14 bp, Homo sapiens
acaggaccaggagc

SEQ ID NO: 4283196 - DNA, 14 bp, Homo sapiens
acaggaggaactgg

SEQ ID NO: 4283197 - DNA, 18 bp, Homo sapiens
actctctcctctctctcc

SEQ ID NO: 4283198 - DNA, 20 bp, Homo sapiens
actctctcctctctctccct

SEQ ID NO: 4283199 - DNA, 12 bp, Homo sapiens
actctctctgcc

SEQ ID NO: 4283200 - DNA, 14 bp, Homo sapiens
actctctctgcccc

SEQ ID NO: 4283201 - DNA, 16 bp, Homo sapiens
actctctctgccccca

SEQ ID NO: 4283202 - DNA, 15 bp, Homo sapiens
actctgccttccagg

SEQ ID NO: 4283203 - DNA, 19 bp, Homo sapiens
actctgctgaggccagagg

SEQ ID NO: 4283204 - DNA, 20 bp, Homo sapiens
actctgctgaggccagagga

SEQ ID NO: 4283205 - DNA, 21 bp, Homo sapiens
actctgctgaggccagaggaa

SEQ ID NO: 4283206 - DNA, 15 bp, Homo sapiens
actctggactgggaa

SEQ ID NO: 4283207 - DNA, 14 bp, Homo sapiens
actctggcagcctc

SEQ ID NO: 4283208 - DNA, 16 bp, Homo sapiens
actctgtggggccaca

SEQ ID NO: 4283209 - DNA, 17 bp, Homo sapiens
actctgtggggccacac

SEQ ID NO: 4283210 - DNA, 20 bp, Homo sapiens
actctgtgtaatctctgatt

SEQ ID NO: 4283211 - DNA, 21 bp, Homo sapiens
actctgtgtaatctctgatta

SEQ ID NO: 4283212 - DNA, 12 bp, Homo sapiens
actctgttcctg

SEQ ID NO: 4283213 - DNA, 15 bp, Homo sapiens
actctgttcctggct

SEQ ID NO: 4283214 - DNA, 22 bp, Homo sapiens
actctgtttgctcacccaggac

SEQ ID NO: 4283215 - DNA, 14 bp, Homo sapiens
actgaaggctttca

SEQ ID NO: 4283216 - DNA, 20 bp, Homo sapiens
actgaaggctttcagggcct

SEQ ID NO: 4283217 - DNA, 15 bp, Homo sapiens
actgaagtgaataca

SEQ ID NO: 4283218 - DNA, 21 bp, Homo sapiens
actgaataatggaattatgta

SEQ ID NO: 4283219 - DNA, 18 bp, Homo sapiens
actgacccattcacattt

SEQ ID NO: 4283220 - DNA, 13 bp, Homo sapiens
actgagctcctct

SEQ ID NO: 4283221 - DNA, 16 bp, Homo sapiens
actgagtccttaaaca

SEQ ID NO: 4283222 - DNA, 19 bp, Homo sapiens
actgagttagaatgttgaa

SEQ ID NO: 4283223 - DNA, 23 bp, Homo sapiens
actgatttgggctgaatgtatgt

SEQ ID NO: 4283224 - DNA, 12 bp, Homo sapiens
actgcaaatact

SEQ ID NO: 4283225 - DNA, 13 bp, Homo sapiens
actgcaaatactt

SEQ ID NO: 4283226 - DNA, 16 bp, Homo sapiens
actgcacagtgcatct

SEQ ID NO: 4283227 - DNA, 18 bp, Homo sapiens
actgcagtcacccctgtc

SEQ ID NO: 4283228 - DNA, 20 bp, Homo sapiens
actgcagtcacccctgtctg

SEQ ID NO: 4283229 - DNA, 23 bp, Homo sapiens
actgcatatcctggtgtctagtt

SEQ ID NO: 4283230 - DNA, 13 bp, Homo sapiens
actgcatgcaagc

SEQ ID NO: 4283231 - DNA, 15 bp, Homo sapiens
actgcatgcaagctc

SEQ ID NO: 4283232 - DNA, 18 bp, Homo sapiens
actgcatgcaagctcagg

SEQ ID NO: 4283233 - DNA, 18 bp, Homo sapiens
actgccctccgcccttcc

SEQ ID NO: 4283234 - DNA, 22 bp, Homo sapiens
actgccctctgccactgacagg

SEQ ID NO: 4283235 - DNA, 22 bp, Homo sapiens
actgccgaccgaggctggagct

SEQ ID NO: 4283236 - DNA, 12 bp, Homo sapiens
actgcctaccca

SEQ ID NO: 4283237 - DNA, 23 bp, Homo sapiens
actgcctacccaccccttcccgc

SEQ ID NO: 4283238 - DNA, 12 bp, Homo sapiens
actgcctgccca

SEQ ID NO: 4283239 - DNA, 13 bp, Homo sapiens
actgcctgcccac

SEQ ID NO: 4283240 - DNA, 22 bp, Homo sapiens
actgcctgcccacccgtggaga

SEQ ID NO: 4283241 - DNA, 14 bp, Homo sapiens
actgcctttgctgc

SEQ ID NO: 4283242 - DNA, 17 bp, Homo sapiens
actgctaggtgggccag

SEQ ID NO: 4283243 - DNA, 21 bp, Homo sapiens
actgctaggtgggccagcccc

SEQ ID NO: 4283244 - DNA, 17 bp, Homo sapiens
actgctgcgctgtgctg

SEQ ID NO: 4283245 - DNA, 17 bp, Homo sapiens
actggaagggtccggct

SEQ ID NO: 4283246 - DNA, 23 bp, Homo sapiens
actggaataagaagcaaataaat

SEQ ID NO: 4283247 - DNA, 22 bp, Homo sapiens
actggaattttatttctctcag

SEQ ID NO: 4283248 - DNA, 19 bp, Homo sapiens
actggaggcctctgcaaga

SEQ ID NO: 4283249 - DNA, 17 bp, Homo sapiens
actggcatctctggagt

SEQ ID NO: 4283250 - DNA, 16 bp, Homo sapiens
actggcccacccctct

SEQ ID NO: 4283251 - DNA, 20 bp, Homo sapiens
actggcccacccctcttccc

SEQ ID NO: 4283252 - DNA, 21 bp, Homo sapiens
actggcccctagaatcagcct

SEQ ID NO: 4283253 - DNA, 16 bp, Homo sapiens
actggccgctgggaga

SEQ ID NO: 4283254 - DNA, 19 bp, Homo sapiens
actggccttctgatgaaat

SEQ ID NO: 4283255 - DNA, 17 bp, Homo sapiens
actggctagctatatta

SEQ ID NO: 4283256 - DNA, 15 bp, Homo sapiens
actggctcctccagc

SEQ ID NO: 4283257 - DNA, 13 bp, Homo sapiens
actgggctggctg

SEQ ID NO: 4283258 - DNA, 14 bp, Homo sapiens
actgggctggctgc

SEQ ID NO: 4283259 - DNA, 15 bp, Homo sapiens
actgggctggctgcc

SEQ ID NO: 4283260 - DNA, 17 bp, Homo sapiens
actggtaagattgttat

SEQ ID NO: 4283261 - DNA, 18 bp, Homo sapiens
actggtaagattgttatt

SEQ ID NO: 4283262 - DNA, 10 bp, Homo sapiens
actggtccag

SEQ ID NO: 4283263 - DNA, 17 bp, Homo sapiens
actggtccaggccaggc

SEQ ID NO: 4283264 - DNA, 19 bp, Homo sapiens
actggtccaggccaggcct

SEQ ID NO: 4283265 - DNA, 12 bp, Homo sapiens
actggtctcaga

SEQ ID NO: 4283266 - DNA, 21 bp, Homo sapiens
actggtgcatttaaaatggac

SEQ ID NO: 4283267 - DNA, 19 bp, Homo sapiens
actggttatagttgatatg

SEQ ID NO: 4283268 - DNA, 23 bp, Homo sapiens
actggtttttctgttccctgctg

SEQ ID NO: 4283269 - DNA, 14 bp, Homo sapiens
actgtactcctccc

SEQ ID NO: 4283270 - DNA, 14 bp, Homo sapiens
actgtatatttgta

SEQ ID NO: 4283271 - DNA, 19 bp, Homo sapiens
actgtatatttgtatgata

SEQ ID NO: 4283272 - DNA, 19 bp, Homo sapiens
actgtatctaaaaaataac

SEQ ID NO: 4283273 - DNA, 17 bp, Homo sapiens
actgtcagagaatatga

SEQ ID NO: 4283274 - DNA, 19 bp, Homo sapiens
actgtcccggagctcaggc

SEQ ID NO: 4283275 - DNA, 23 bp, Homo sapiens
actgtcccggagctcaggccctg

SEQ ID NO: 4283276 - DNA, 17 bp, Homo sapiens
actgtcctgttgattaa

SEQ ID NO: 4283277 - DNA, 19 bp, Homo sapiens
actgtcttagtcataccat

SEQ ID NO: 4283278 - DNA, 17 bp, Homo sapiens
actgtgacacagctgag

SEQ ID NO: 4283279 - DNA, 20 bp, Homo sapiens
actgtgacacagctgagctg

SEQ ID NO: 4283280 - DNA, 20 bp, Homo sapiens
actgtgcagccggggagctg

SEQ ID NO: 4283281 - DNA, 13 bp, Homo sapiens
actgtggcctcag

SEQ ID NO: 4283282 - DNA, 15 bp, Homo sapiens
actgtggccttggtc

SEQ ID NO: 4283283 - DNA, 21 bp, Homo sapiens
actgtgtccctctctctggaa

SEQ ID NO: 4283284 - DNA, 12 bp, Homo sapiens
actgttacagta

SEQ ID NO: 4283285 - DNA, 22 bp, Homo sapiens
actgttcccagcaaagttttca

SEQ ID NO: 4283286 - DNA, 18 bp, Homo sapiens
actgtttatggtattttc

SEQ ID NO: 4283287 - DNA, 20 bp, Homo sapiens
actgtttgtaatatacagtt

SEQ ID NO: 4283288 - DNA, 13 bp, Homo sapiens
actgttttgtgcg

SEQ ID NO: 4283289 - DNA, 21 bp, Homo sapiens
actgttttgtgcggtgtgtct

SEQ ID NO: 4283290 - DNA, 16 bp, Homo sapiens
acttaaagcttgtttg

SEQ ID NO: 4283291 - DNA, 19 bp, Homo sapiens
acttactgtcagagaatat

SEQ ID NO: 4283292 - DNA, 20 bp, Homo sapiens
acttagcattttctgcatct

SEQ ID NO: 4283293 - DNA, 21 bp, Homo sapiens
acttagcattttctgcatctc

SEQ ID NO: 4283294 - DNA, 21 bp, Homo sapiens
acttatcagtttgctaatgtt

SEQ ID NO: 4283295 - DNA, 13 bp, Homo sapiens
acttatgctgctg

SEQ ID NO: 4283296 - DNA, 15 bp, Homo sapiens
acttattcaaagaga

SEQ ID NO: 4283297 - DNA, 15 bp, Homo sapiens
acttcaaaatattga

SEQ ID NO: 4283298 - DNA, 16 bp, Homo sapiens
acttcaaaatattgag

SEQ ID NO: 4283299 - DNA, 16 bp, Homo sapiens
acttcaaaatcagtga

SEQ ID NO: 4283300 - DNA, 19 bp, Homo sapiens
acttccaaagagtcatcat

SEQ ID NO: 4283301 - DNA, 20 bp, Homo sapiens
acttcctgctacagtagctg

SEQ ID NO: 4283302 - DNA, 17 bp, Homo sapiens
acttcctggattttctt

SEQ ID NO: 4283303 - DNA, 18 bp, Homo sapiens
acttcgctattcccaggc

SEQ ID NO: 4283304 - DNA, 15 bp, Homo sapiens
acttctcaaatgcta

SEQ ID NO: 4283305 - DNA, 16 bp, Homo sapiens
acttctgaccacactt

SEQ ID NO: 4283306 - DNA, 14 bp, Homo sapiens
acttcttctgtaat

SEQ ID NO: 4283307 - DNA, 23 bp, Homo sapiens
acttctttggtgttctggcctct

SEQ ID NO: 4283308 - DNA, 16 bp, Homo sapiens
acttgaatagtattgt

SEQ ID NO: 4283309 - DNA, 16 bp, Homo sapiens
acttgagatgatttcc

SEQ ID NO: 4283310 - DNA, 17 bp, Homo sapiens
acttgatgaataaacac

SEQ ID NO: 4283311 - DNA, 18 bp, Homo sapiens
acttgatgaataaacact

SEQ ID NO: 4283312 - DNA, 16 bp, Homo sapiens
acttgatgttcctggg

SEQ ID NO: 4283313 - DNA, 19 bp, Homo sapiens
acttgatgttcctgggatg

SEQ ID NO: 4283314 - DNA, 16 bp, Homo sapiens
acttgccctgaccatg

SEQ ID NO: 4283315 - DNA, 21 bp, Homo sapiens
acttgccctgaccatgcattt

SEQ ID NO: 4283316 - DNA, 20 bp, Homo sapiens
actttcactataatgtgaaa

SEQ ID NO: 4283317 - DNA, 21 bp, Homo sapiens
actttcactataatgtgaaat

SEQ ID NO: 4283318 - DNA, 23 bp, Homo sapiens
actttcactataatgtgaaatgt

SEQ ID NO: 4283319 - DNA, 20 bp, Homo sapiens
actttcattccctttcatga

SEQ ID NO: 4283320 - DNA, 18 bp, Homo sapiens
actttccaccccctccct

SEQ ID NO: 4283321 - DNA, 18 bp, Homo sapiens
actttgacacttttcata

SEQ ID NO: 4283322 - DNA, 22 bp, Homo sapiens
actttgacacttttcatatcat

SEQ ID NO: 4283323 - DNA, 17 bp, Homo sapiens
actttgagttaagtcta

SEQ ID NO: 4283324 - DNA, 18 bp, Homo sapiens
actttgcagacctgggac

SEQ ID NO: 4283325 - DNA, 15 bp, Homo sapiens
actttgctgatttcc

SEQ ID NO: 4283326 - DNA, 17 bp, Homo sapiens
actttggaatgactata

SEQ ID NO: 4283327 - DNA, 21 bp, Homo sapiens
actttggtaatgtgtcaaaga

SEQ ID NO: 4283328 - DNA, 17 bp, Homo sapiens
acttttaacttcacctt

SEQ ID NO: 4283329 - DNA, 20 bp, Homo sapiens
acttttcctcttagaagaat

SEQ ID NO: 4283330 - DNA, 19 bp, Homo sapiens
acttttcctttgaatcctc

SEQ ID NO: 4283331 - DNA, 18 bp, Homo sapiens
agaaaaaaacattctatc

SEQ ID NO: 4283332 - DNA, 19 bp, Homo sapiens
agaaaaacaatggtaacat

SEQ ID NO: 4283333 - DNA, 16 bp, Homo sapiens
agaaaaaccaatgatt

SEQ ID NO: 4283334 - DNA, 18 bp, Homo sapiens
agaaaaaccaatgattca

SEQ ID NO: 4283335 - DNA, 20 bp, Homo sapiens
agaaaaaccaatgattcata

SEQ ID NO: 4283336 - DNA, 17 bp, Homo sapiens
agaaaacatgtctgtga

SEQ ID NO: 4283337 - DNA, 18 bp, Homo sapiens
agaaaagtatttccaact

SEQ ID NO: 4283338 - DNA, 11 bp, Homo sapiens
agaaaataacc

SEQ ID NO: 4283339 - DNA, 18 bp, Homo sapiens
agaaaatgagatgggttg

SEQ ID NO: 4283340 - DNA, 13 bp, Homo sapiens
agaaacaatttct

SEQ ID NO: 4283341 - DNA, 19 bp, Homo sapiens
agaaactcctggatccctt

SEQ ID NO: 4283342 - DNA, 22 bp, Homo sapiens
agaaactcctggatccctttca

SEQ ID NO: 4283343 - DNA, 13 bp, Homo sapiens
agaaagattttat

SEQ ID NO: 4283344 - DNA, 14 bp, Homo sapiens
agaaagcatctatt

SEQ ID NO: 4283345 - DNA, 17 bp, Homo sapiens
agaaagcatctattccc

SEQ ID NO: 4283346 - DNA, 15 bp, Homo sapiens
agaaaggagggcaac

SEQ ID NO: 4283347 - DNA, 16 bp, Homo sapiens
agaaataaaccttaat

SEQ ID NO: 4283348 - DNA, 14 bp, Homo sapiens
agaaatatctgtga

SEQ ID NO: 4283349 - DNA, 15 bp, Homo sapiens
agaaatatctgtgaa

SEQ ID NO: 4283350 - DNA, 18 bp, Homo sapiens
agaaatctcacttttctc

SEQ ID NO: 4283351 - DNA, 23 bp, Homo sapiens
agaaattagggctctaatttcct

SEQ ID NO: 4283352 - DNA, 23 bp, Homo sapiens
agaaattgacctgatttccattt

SEQ ID NO: 4283353 - DNA, 20 bp, Homo sapiens
agaaattgcatttcctgaca

SEQ ID NO: 4283354 - DNA, 22 bp, Homo sapiens
agaaatttttttccagaattga

SEQ ID NO: 4283355 - DNA, 15 bp, Homo sapiens
agaacaaacctctat

SEQ ID NO: 4283356 - DNA, 22 bp, Homo sapiens
agaacacaagccacgcctgcga

SEQ ID NO: 4283357 - DNA, 16 bp, Homo sapiens
agaaccaacgggtctg

SEQ ID NO: 4283358 - DNA, 16 bp, Homo sapiens
agaaccagtccctctg

SEQ ID NO: 4283359 - DNA, 16 bp, Homo sapiens
agaaccatcttttgtt

SEQ ID NO: 4283360 - DNA, 15 bp, Homo sapiens
agaacccccctcccc

SEQ ID NO: 4283361 - DNA, 13 bp, Homo sapiens
agaaccttctaat

SEQ ID NO: 4283362 - DNA, 14 bp, Homo sapiens
agaacgcatgcagg

SEQ ID NO: 4283363 - DNA, 21 bp, Homo sapiens
agaacgggttctcccatgggg

SEQ ID NO: 4283364 - DNA, 12 bp, Homo sapiens
agaactgagctc

SEQ ID NO: 4283365 - DNA, 15 bp, Homo sapiens
agaactgagctcctc

SEQ ID NO: 4283366 - DNA, 17 bp, Homo sapiens
agaactgtcccacaaaa

SEQ ID NO: 4283367 - DNA, 19 bp, Homo sapiens
agaagaaactcctggatcc

SEQ ID NO: 4283368 - DNA, 15 bp, Homo sapiens
agaagaatataaata

SEQ ID NO: 4283369 - DNA, 14 bp, Homo sapiens
agaagaatattgta

SEQ ID NO: 4283370 - DNA, 17 bp, Homo sapiens
agaagacacgtgttttt

SEQ ID NO: 4283371 - DNA, 18 bp, Homo sapiens
agaagacacgtgtttttg

SEQ ID NO: 4283372 - DNA, 18 bp, Homo sapiens
agaagagggagaaggaga

SEQ ID NO: 4283373 - DNA, 15 bp, Homo sapiens
agaagagtctattgt

SEQ ID NO: 4283374 - DNA, 16 bp, Homo sapiens
agaagcaccccaccac

SEQ ID NO: 4283375 - DNA, 22 bp, Homo sapiens
agaaggaatggtgcttggcagg

SEQ ID NO: 4283376 - DNA, 20 bp, Homo sapiens
agaaggacttcctgctacag

SEQ ID NO: 4283377 - DNA, 14 bp, Homo sapiens
agaaggaggaaggg

SEQ ID NO: 4283378 - DNA, 19 bp, Homo sapiens
agaaggaggaagggactgg

SEQ ID NO: 4283379 - DNA, 16 bp, Homo sapiens
agaaggcccgggagga

SEQ ID NO: 4283380 - DNA, 22 bp, Homo sapiens
agaaggcctgccccccttccca

SEQ ID NO: 4283381 - DNA, 20 bp, Homo sapiens
agaagggttagacaagcctg

SEQ ID NO: 4283382 - DNA, 21 bp, Homo sapiens
agaagggttagacaagcctgg

SEQ ID NO: 4283383 - DNA, 23 bp, Homo sapiens
agaagggttagacaagcctggag

SEQ ID NO: 4283384 - DNA, 20 bp, Homo sapiens
agaaggtcggaggcttggga

SEQ ID NO: 4283385 - DNA, 23 bp, Homo sapiens
agaagtatccctgatttattctg

SEQ ID NO: 4283386 - DNA, 22 bp, Homo sapiens
agaagtgcccctgctgcctccc

SEQ ID NO: 4283387 - DNA, 21 bp, Homo sapiens
agaagtgggagtgggagagga

SEQ ID NO: 4283388 - DNA, 13 bp, Homo sapiens
agaagtgtgtttt

SEQ ID NO: 4283389 - DNA, 14 bp, Homo sapiens
agaataaataaaga

SEQ ID NO: 4283390 - DNA, 19 bp, Homo sapiens
agaataaataaagaagaaa

SEQ ID NO: 4283391 - DNA, 18 bp, Homo sapiens
agaatacagtaagctgct

SEQ ID NO: 4283392 - DNA, 14 bp, Homo sapiens
agaatactgtattg

SEQ ID NO: 4283393 - DNA, 14 bp, Homo sapiens
agaatataaataaa

SEQ ID NO: 4283394 - DNA, 21 bp, Homo sapiens
agaatatgacctaaatccatt

SEQ ID NO: 4283395 - DNA, 18 bp, Homo sapiens
agaatattgtattgttag

SEQ ID NO: 4283396 - DNA, 17 bp, Homo sapiens
agaatcaaatctgagcc

SEQ ID NO: 4283397 - DNA, 14 bp, Homo sapiens
agaatcaagtctgt

SEQ ID NO: 4283398 - DNA, 13 bp, Homo sapiens
agaatcagcctag

SEQ ID NO: 4283399 - DNA, 14 bp, Homo sapiens
agaatggctctggc

SEQ ID NO: 4283400 - DNA, 15 bp, Homo sapiens
agaatggctctggct

SEQ ID NO: 4283401 - DNA, 13 bp, Homo sapiens
agaatgtttcatt

SEQ ID NO: 4283402 - DNA, 15 bp, Homo sapiens
agaatgtttcatttg

SEQ ID NO: 4283403 - DNA, 22 bp, Homo sapiens
agaattaccatttgttaatatc

SEQ ID NO: 4283404 - DNA, 21 bp, Homo sapiens
agaattctaagattgtacata

SEQ ID NO: 4283405 - DNA, 21 bp, Homo sapiens
agaattgtttttagaaattta

SEQ ID NO: 4283406 - DNA, 17 bp, Homo sapiens
agacaaaattgctgagg

SEQ ID NO: 4283407 - DNA, 18 bp, Homo sapiens
agacaaccatagaactgt

SEQ ID NO: 4283408 - DNA, 20 bp, Homo sapiens
agacaaccctgcaaaggact

SEQ ID NO: 4283409 - DNA, 18 bp, Homo sapiens
agacaccctaatgtggca

SEQ ID NO: 4283410 - DNA, 17 bp, Homo sapiens
agacactggtctcagag

SEQ ID NO: 4283411 - DNA, 13 bp, Homo sapiens
agacagagtggat

SEQ ID NO: 4283412 - DNA, 20 bp, Homo sapiens
agacagagtggatctggagt

SEQ ID NO: 4283413 - DNA, 13 bp, Homo sapiens
agacagggtgggg

SEQ ID NO: 4283414 - DNA, 21 bp, Homo sapiens
agacagtcaggaagcctcctg

SEQ ID NO: 4283415 - DNA, 18 bp, Homo sapiens
agacatgctgcccacccc

SEQ ID NO: 4283416 - DNA, 23 bp, Homo sapiens
agacatgctgcccaccccctgct

SEQ ID NO: 4283417 - DNA, 14 bp, Homo sapiens
agacattgtatttt

SEQ ID NO: 4283418 - DNA, 19 bp, Homo sapiens
agaccacccatatcatgca

SEQ ID NO: 4283419 - DNA, 17 bp, Homo sapiens
agacccccaccccttcc

SEQ ID NO: 4283420 - DNA, 21 bp, Homo sapiens
agacccccaccccttccccac

SEQ ID NO: 4283421 - DNA, 21 bp, Homo sapiens
agaccctgccaactttccaga

SEQ ID NO: 4283422 - DNA, 16 bp, Homo sapiens
agaccctgtctttgct

SEQ ID NO: 4283423 - DNA, 23 bp, Homo sapiens
agaccgagtgtggagctgcttcc

SEQ ID NO: 4283424 - DNA, 20 bp, Homo sapiens
agacctcggctgtgtgggga

SEQ ID NO: 4283425 - DNA, 16 bp, Homo sapiens
agacctgggccctggt

SEQ ID NO: 4283426 - DNA, 15 bp, Homo sapiens
agacctgtgagggga

SEQ ID NO: 4283427 - DNA, 19 bp, Homo sapiens
agacctttgtctgaaggat

SEQ ID NO: 4283428 - DNA, 22 bp, Homo sapiens
agacgccctaggaggagaactt

SEQ ID NO: 4283429 - DNA, 19 bp, Homo sapiens
agactagctaattagctct

SEQ ID NO: 4283430 - DNA, 18 bp, Homo sapiens
agactcacggctgcacct

SEQ ID NO: 4283431 - DNA, 19 bp, Homo sapiens
agactcacggctgcacctg

SEQ ID NO: 4283432 - DNA, 13 bp, Homo sapiens
agactcaggccca

SEQ ID NO: 4283433 - DNA, 18 bp, Homo sapiens
agactcctctcttctgac

SEQ ID NO: 4283434 - DNA, 21 bp, Homo sapiens
agactctctcctctctctccc

SEQ ID NO: 4283435 - DNA, 22 bp, Homo sapiens
agactctctcctctctctccct

SEQ ID NO: 4283436 - DNA, 18 bp, Homo sapiens
agactctgtgagattcta

SEQ ID NO: 4283437 - DNA, 12 bp, Homo sapiens
agactgaattta

SEQ ID NO: 4283438 - DNA, 20 bp, Homo sapiens
agactgacccattcacattt

SEQ ID NO: 4283439 - DNA, 15 bp, Homo sapiens
agactggatactgcc

SEQ ID NO: 4283440 - DNA, 20 bp, Homo sapiens
agcaactgttggataataac

SEQ ID NO: 4283441 - DNA, 18 bp, Homo sapiens
agcaagaagattctaaaa

SEQ ID NO: 4283442 - DNA, 20 bp, Homo sapiens
agcaaggcaagaagtgggat

SEQ ID NO: 4283443 - DNA, 22 bp, Homo sapiens
agcaaggcaagaagtgggattc

SEQ ID NO: 4283444 - DNA, 15 bp, Homo sapiens
agcaattctcctaag

SEQ ID NO: 4283445 - DNA, 17 bp, Homo sapiens
agcacaaggagtgcccg

SEQ ID NO: 4283446 - DNA, 18 bp, Homo sapiens
agcacaattctgtccctg

SEQ ID NO: 4283447 - DNA, 19 bp, Homo sapiens
agcacaattctgtccctgt

SEQ ID NO: 4283448 - DNA, 21 bp, Homo sapiens
agcacagagagcggcttcccc

SEQ ID NO: 4283449 - DNA, 22 bp, Homo sapiens
agcacagaggatggcttcccca

SEQ ID NO: 4283450 - DNA, 17 bp, Homo sapiens
agcacagcctcacccct

SEQ ID NO: 4283451 - DNA, 22 bp, Homo sapiens
agcacagcctcacccctgcagg

SEQ ID NO: 4283452 - DNA, 14 bp, Homo sapiens
agcacatccaggca

SEQ ID NO: 4283453 - DNA, 14 bp, Homo sapiens
agcaccagcctcag

SEQ ID NO: 4283454 - DNA, 15 bp, Homo sapiens
agcaccagcctcagt

SEQ ID NO: 4283455 - DNA, 21 bp, Homo sapiens
agcaccagcctcagtgcagcc

SEQ ID NO: 4283456 - DNA, 21 bp, Homo sapiens
agcaccccaccacacacaccc

SEQ ID NO: 4283457 - DNA, 13 bp, Homo sapiens
agcacctgggtgt

SEQ ID NO: 4283458 - DNA, 19 bp, Homo sapiens
agcacctgggtgtgctcca

SEQ ID NO: 4283459 - DNA, 14 bp, Homo sapiens
agcaccttgaatgg

SEQ ID NO: 4283460 - DNA, 15 bp, Homo sapiens
agcaccttgaatgga

SEQ ID NO: 4283461 - DNA, 18 bp, Homo sapiens
agcacgccaaccccagca

SEQ ID NO: 4283462 - DNA, 12 bp, Homo sapiens
agcactggaggc

SEQ ID NO: 4283463 - DNA, 19 bp, Homo sapiens
agcactggaggcctctgca

SEQ ID NO: 4283464 - DNA, 13 bp, Homo sapiens
agcagaaggcctt

SEQ ID NO: 4283465 - DNA, 15 bp, Homo sapiens
agcagaattcattca

SEQ ID NO: 4283466 - DNA, 16 bp, Homo sapiens
agcagaattcattcat

SEQ ID NO: 4283467 - DNA, 22 bp, Homo sapiens
agcagagtaaaattacagaaga

SEQ ID NO: 4283468 - DNA, 16 bp, Homo sapiens
agcagagtgcacagct

SEQ ID NO: 4283469 - DNA, 20 bp, Homo sapiens
agcagcacaattctgtccct

SEQ ID NO: 4283470 - DNA, 20 bp, Homo sapiens
agcagcacgccaaccccagc

SEQ ID NO: 4283471 - DNA, 18 bp, Homo sapiens
agcagcccacctgctgcc

SEQ ID NO: 4283472 - DNA, 15 bp, Homo sapiens
agcagcggcccagat

SEQ ID NO: 4283473 - DNA, 16 bp, Homo sapiens
agcaggaagcaaggcc

SEQ ID NO: 4283474 - DNA, 16 bp, Homo sapiens
agcaggggcagaagga

SEQ ID NO: 4283475 - DNA, 22 bp, Homo sapiens
agcaggggggttgggttccaga

SEQ ID NO: 4283476 - DNA, 14 bp, Homo sapiens
agcaggtggggagg

SEQ ID NO: 4283477 - DNA, 21 bp, Homo sapiens
agcagtgattgaagtatctgt

SEQ ID NO: 4283478 - DNA, 15 bp, Homo sapiens
agcagtttgcctctg

SEQ ID NO: 4283479 - DNA, 17 bp, Homo sapiens
agcagtttgcctctgca

SEQ ID NO: 4283480 - DNA, 22 bp, Homo sapiens
agcagtttgcctctgcacgtgc

SEQ ID NO: 4283481 - DNA, 20 bp, Homo sapiens
agcagttttcttttaatttt

SEQ ID NO: 4283482 - DNA, 15 bp, Homo sapiens
agcatcaacctagga

SEQ ID NO: 4283483 - DNA, 14 bp, Homo sapiens
agcatcagcaagac

SEQ ID NO: 4283484 - DNA, 23 bp, Homo sapiens
agcatccatgcggccggcctggg

SEQ ID NO: 4283485 - DNA, 15 bp, Homo sapiens
agcatcctcagttcc

SEQ ID NO: 4283486 - DNA, 13 bp, Homo sapiens
agcatcggaggga

SEQ ID NO: 4283487 - DNA, 22 bp, Homo sapiens
agcatgacaagccccaggcagg

SEQ ID NO: 4283488 - DNA, 17 bp, Homo sapiens
agcatgccaatttctct

SEQ ID NO: 4283489 - DNA, 19 bp, Homo sapiens
agcatgtaagaaataagtt

SEQ ID NO: 4283490 - DNA, 14 bp, Homo sapiens
agcatgtcctatcc

SEQ ID NO: 4283491 - DNA, 22 bp, Homo sapiens
agcatgtgttaatcttaatgta

SEQ ID NO: 4283492 - DNA, 20 bp, Homo sapiens
agcattctcactcctacctg

SEQ ID NO: 4283493 - DNA, 22 bp, Homo sapiens
agcattctcactcctacctggt

SEQ ID NO: 4283494 - DNA, 13 bp, Homo sapiens
agcattctcccca

SEQ ID NO: 4283495 - DNA, 17 bp, Homo sapiens
agcattctccccagtgt

SEQ ID NO: 4283496 - DNA, 12 bp, Homo sapiens
agcattctgtct

SEQ ID NO: 4283497 - DNA, 17 bp, Homo sapiens
agcattgaaataataat

SEQ ID NO: 4283498 - DNA, 16 bp, Homo sapiens
agcatttcggtgcttc

SEQ ID NO: 4283499 - DNA, 16 bp, Homo sapiens
agcatttgactttctg

SEQ ID NO: 4283500 - DNA, 17 bp, Homo sapiens
agcatttgactttctgt

SEQ ID NO: 4283501 - DNA, 19 bp, Homo sapiens
agcattttactgtctgtaa

SEQ ID NO: 4283502 - DNA, 16 bp, Homo sapiens
agccaaaaacaataaa

SEQ ID NO: 4283503 - DNA, 13 bp, Homo sapiens
agccaaaagtaag

SEQ ID NO: 4283504 - DNA, 17 bp, Homo sapiens
agccaaattgcagaaga

SEQ ID NO: 4283505 - DNA, 19 bp, Homo sapiens
agccaaattgcagaagaaa

SEQ ID NO: 4283506 - DNA, 16 bp, Homo sapiens
agccaaggggtctgct

SEQ ID NO: 4283507 - DNA, 21 bp, Homo sapiens
agccaaggggtctgctcctgt

SEQ ID NO: 4283508 - DNA, 23 bp, Homo sapiens
agccaagtcagctttgccttcca

SEQ ID NO: 4283509 - DNA, 19 bp, Homo sapiens
agccaccaaggctgcctgc

SEQ ID NO: 4283510 - DNA, 18 bp, Homo sapiens
agccacccggatctccag

SEQ ID NO: 4283511 - DNA, 22 bp, Homo sapiens
agccacccggatctccaggccc

SEQ ID NO: 4283512 - DNA, 24 bp, Homo sapiens
agccacccggatctccaggcccag

SEQ ID NO: 4283513 - DNA, 20 bp, Homo sapiens
agccacgtgctggagagtag

SEQ ID NO: 4283514 - DNA, 13 bp, Homo sapiens
agccactctgttc

SEQ ID NO: 4283515 - DNA, 19 bp, Homo sapiens
agccacttatttccatgga

SEQ ID NO: 4283516 - DNA, 13 bp, Homo sapiens
agccagcagggcg

SEQ ID NO: 4283517 - DNA, 22 bp, Homo sapiens
agccagcaggttctctcctgtg

SEQ ID NO: 4283518 - DNA, 13 bp, Homo sapiens
agccagctcccag

SEQ ID NO: 4283519 - DNA, 17 bp, Homo sapiens
agccaggagaccctgtc

SEQ ID NO: 4283520 - DNA, 18 bp, Homo sapiens
agccaggagaccctgtct

SEQ ID NO: 4283521 - DNA, 14 bp, Homo sapiens
agccaggcctcccg

SEQ ID NO: 4283522 - DNA, 13 bp, Homo sapiens
agccagggttcca

SEQ ID NO: 4283523 - DNA, 14 bp, Homo sapiens
agccagggttccag

SEQ ID NO: 4283524 - DNA, 18 bp, Homo sapiens
agccagggttccagacag

SEQ ID NO: 4283525 - DNA, 22 bp, Homo sapiens
agccaggtgtcctgactgtcct

SEQ ID NO: 4283526 - DNA, 23 bp, Homo sapiens
agccaggtgtcctgactgtccta

SEQ ID NO: 4283527 - DNA, 15 bp, Homo sapiens
agccagtgactccag

SEQ ID NO: 4283528 - DNA, 20 bp, Homo sapiens
agccatatattttctgagta

SEQ ID NO: 4283529 - DNA, 18 bp, Homo sapiens
agccatctgcgacaccac

SEQ ID NO: 4283530 - DNA, 23 bp, Homo sapiens
agccatgactagggtcctcaggc

SEQ ID NO: 4283531 - DNA, 14 bp, Homo sapiens
agccattcacaaca

SEQ ID NO: 4283532 - DNA, 15 bp, Homo sapiens
agccattcacaacac

SEQ ID NO: 4283533 - DNA, 13 bp, Homo sapiens
agcccaatcactg

SEQ ID NO: 4283534 - DNA, 16 bp, Homo sapiens
agcccaatcactgcct

SEQ ID NO: 4283535 - DNA, 20 bp, Homo sapiens
agcccacagtatattttatt

SEQ ID NO: 4283536 - DNA, 21 bp, Homo sapiens
agcccacatccattccagagc

SEQ ID NO: 4283537 - DNA, 15 bp, Homo sapiens
agcccacctgctgcc

SEQ ID NO: 4283538 - DNA, 22 bp, Homo sapiens
agcccacctgctgcccgtgagg

SEQ ID NO: 4283539 - DNA, 10 bp, Homo sapiens
agcccagaga

SEQ ID NO: 4283540 - DNA, 18 bp, Homo sapiens
agcccagagagaccctgc

SEQ ID NO: 4283541 - DNA, 16 bp, Homo sapiens
agcccaggaggacctg

SEQ ID NO: 4283542 - DNA, 21 bp, Homo sapiens
agcccagggttcccccagccc

SEQ ID NO: 4283543 - DNA, 23 bp, Homo sapiens
agcccagggttcccccagccctg

SEQ ID NO: 4283544 - DNA, 19 bp, Homo sapiens
agcccatgtggctaaaaaa

SEQ ID NO: 4283545 - DNA, 20 bp, Homo sapiens
agccccaggcaggctgtgcg

SEQ ID NO: 4283546 - DNA, 13 bp, Homo sapiens
agccccagggccc

SEQ ID NO: 4283547 - DNA, 15 bp, Homo sapiens
agccccagggccctg

SEQ ID NO: 4283548 - DNA, 17 bp, Homo sapiens
agccccctcctgacccc

SEQ ID NO: 4283549 - DNA, 12 bp, Homo sapiens
agccccctggcc

SEQ ID NO: 4283550 - DNA, 15 bp, Homo sapiens
agccccctggcccct

SEQ ID NO: 4283551 - DNA, 21 bp, Homo sapiens
agccccctggcccctcccaca

SEQ ID NO: 4283552 - DNA, 13 bp, Homo sapiens
agccccctgtcct

SEQ ID NO: 4283553 - DNA, 14 bp, Homo sapiens
agccccctgtcctt

SEQ ID NO: 4283554 - DNA, 22 bp, Homo sapiens
agccccgccgtgtctgtggccc

SEQ ID NO: 4283555 - DNA, 21 bp, Homo sapiens
agcccctatcctgcaccctct

SEQ ID NO: 4283556 - DNA, 17 bp, Homo sapiens
agcccctcccaccacag

SEQ ID NO: 4283557 - DNA, 18 bp, Homo sapiens
agcccctcccaccacagc

SEQ ID NO: 4283558 - DNA, 10 bp, Homo sapiens
agcccctctt

SEQ ID NO: 4283559 - DNA, 21 bp, Homo sapiens
agcccctcttgccccccaccc

SEQ ID NO: 4283560 - DNA, 13 bp, Homo sapiens
agcccctgctgct

SEQ ID NO: 4283561 - DNA, 22 bp, Homo sapiens
agcccgcccacctgggccctag

SEQ ID NO: 4283562 - DNA, 19 bp, Homo sapiens
agcccggcagtgcaccccc

SEQ ID NO: 4283563 - DNA, 17 bp, Homo sapiens
agcccgtgtggcccctt

SEQ ID NO: 4283564 - DNA, 19 bp, Homo sapiens
agccctccctgcccctccc

SEQ ID NO: 4283565 - DNA, 14 bp, Homo sapiens
agccctgccctcac

SEQ ID NO: 4283566 - DNA, 15 bp, Homo sapiens
agccctgccctcact

SEQ ID NO: 4283567 - DNA, 19 bp, Homo sapiens
agccctgctttgggctgcc

SEQ ID NO: 4283568 - DNA, 18 bp, Homo sapiens
aggccccttgctgctggc

SEQ ID NO: 4283569 - DNA, 20 bp, Homo sapiens
aggccccttgctgctggctc

SEQ ID NO: 4283570 - DNA, 13 bp, Homo sapiens
aggcccgggagga

SEQ ID NO: 4283571 - DNA, 16 bp, Homo sapiens
aggccctggtctggct

SEQ ID NO: 4283572 - DNA, 19 bp, Homo sapiens
aggcccttcctctccactg

SEQ ID NO: 4283573 - DNA, 13 bp, Homo sapiens
aggccgaggcagg

SEQ ID NO: 4283574 - DNA, 24 bp, Homo sapiens
aggccgaggcaggggctgggcaga

SEQ ID NO: 4283575 - DNA, 14 bp, Homo sapiens
aggccgctgcaggg

SEQ ID NO: 4283576 - DNA, 14 bp, Homo sapiens
aggccggtgggaag

SEQ ID NO: 4283577 - DNA, 18 bp, Homo sapiens
aggcctcacctggcttcc

SEQ ID NO: 4283578 - DNA, 22 bp, Homo sapiens
aggcctcacctggcttcccagg

SEQ ID NO: 4283579 - DNA, 17 bp, Homo sapiens
aggcctcaggcctccca

SEQ ID NO: 4283580 - DNA, 15 bp, Homo sapiens
aggcctcagtggact

SEQ ID NO: 4283581 - DNA, 20 bp, Homo sapiens
aggcctccctcccccggggt

SEQ ID NO: 4283582 - DNA, 18 bp, Homo sapiens
aggcctgaaatgtttcca

SEQ ID NO: 4283583 - DNA, 12 bp, Homo sapiens
aggcctgaacta

SEQ ID NO: 4283584 - DNA, 20 bp, Homo sapiens
aggcctgaactaggtgctgg

SEQ ID NO: 4283585 - DNA, 19 bp, Homo sapiens
aataatttagatattcata

SEQ ID NO: 4283586 - DNA, 19 bp, Homo sapiens
aatacagtaagctgctcta

SEQ ID NO: 4283587 - DNA, 12 bp, Homo sapiens
aatacatgcctt

SEQ ID NO: 4283588 - DNA, 22 bp, Homo sapiens
aataccagagcacagattcaag

SEQ ID NO: 4283589 - DNA, 13 bp, Homo sapiens
aatactcaccaaa

SEQ ID NO: 4283590 - DNA, 17 bp, Homo sapiens
aatacttaaaaatatgt

SEQ ID NO: 4283591 - DNA, 23 bp, Homo sapiens
aatacttaaaaatatgtgagcat

SEQ ID NO: 4283592 - DNA, 14 bp, Homo sapiens
aatacttcttttta

SEQ ID NO: 4283593 - DNA, 15 bp, Homo sapiens
aatagcatctgctct

SEQ ID NO: 4283594 - DNA, 14 bp, Homo sapiens
aatagcctcacctt

SEQ ID NO: 4283595 - DNA, 19 bp, Homo sapiens
aataggagggaaacctttg

SEQ ID NO: 4283596 - DNA, 15 bp, Homo sapiens
aatagttctatttct

SEQ ID NO: 4283597 - DNA, 17 bp, Homo sapiens
aatagttctatttctat

SEQ ID NO: 4283598 - DNA, 19 bp, Homo sapiens
aatagttctatttctatct

SEQ ID NO: 4283599 - DNA, 12 bp, Homo sapiens
aatagttttcta

SEQ ID NO: 4283600 - DNA, 14 bp, Homo sapiens
aatagttttctaaa

SEQ ID NO: 4283601 - DNA, 16 bp, Homo sapiens
aatagttttctaaatg

SEQ ID NO: 4283602 - DNA, 20 bp, Homo sapiens
aatagttttctaaatgtttc

SEQ ID NO: 4283603 - DNA, 23 bp, Homo sapiens
aatataaataaataaaaatattc

SEQ ID NO: 4283604 - DNA, 20 bp, Homo sapiens
aatataaatgtgtgtatgtg

SEQ ID NO: 4283605 - DNA, 22 bp, Homo sapiens
aatatacatagtctttgtttac

SEQ ID NO: 4283606 - DNA, 21 bp, Homo sapiens
aatatagaaaaaaacattcta

SEQ ID NO: 4283607 - DNA, 12 bp, Homo sapiens
aatatagttaat

SEQ ID NO: 4283608 - DNA, 15 bp, Homo sapiens
aatatagttaattgt

SEQ ID NO: 4283609 - DNA, 13 bp, Homo sapiens
aatatagttgaac

SEQ ID NO: 4283610 - DNA, 17 bp, Homo sapiens
aatatagttgaacaaga

SEQ ID NO: 4283611 - DNA, 13 bp, Homo sapiens
aatatatgtgaaa

SEQ ID NO: 4283612 - DNA, 18 bp, Homo sapiens
aatatcattttcctggga

SEQ ID NO: 4283613 - DNA, 22 bp, Homo sapiens
aatatcctgccttttaccttca

SEQ ID NO: 4283614 - DNA, 23 bp, Homo sapiens
aatatctatttatctgtctgagc

SEQ ID NO: 4283615 - DNA, 15 bp, Homo sapiens
aatatctctatttaa

SEQ ID NO: 4283616 - DNA, 18 bp, Homo sapiens
aatatcttcgttagtaat

SEQ ID NO: 4283617 - DNA, 13 bp, Homo sapiens
aatatcttgaaga

SEQ ID NO: 4283618 - DNA, 18 bp, Homo sapiens
aatatcttgaagaatatt

SEQ ID NO: 4283619 - DNA, 18 bp, Homo sapiens
aatatgaggggactgcat

SEQ ID NO: 4283620 - DNA, 18 bp, Homo sapiens
aatatgtgagcatgaaac

SEQ ID NO: 4283621 - DNA, 14 bp, Homo sapiens
aatattgagcaata

SEQ ID NO: 4283622 - DNA, 18 bp, Homo sapiens
aatattgagcaatatgtc

SEQ ID NO: 4283623 - DNA, 16 bp, Homo sapiens
aatatttacaatgtat

SEQ ID NO: 4283624 - DNA, 15 bp, Homo sapiens
aatatttctaagctt

SEQ ID NO: 4283625 - DNA, 15 bp, Homo sapiens
aatatttttttctag

SEQ ID NO: 4283626 - DNA, 19 bp, Homo sapiens
aatatttttttctagctat

SEQ ID NO: 4283627 - DNA, 22 bp, Homo sapiens
aatcaaaagattaacaacactg

SEQ ID NO: 4283628 - DNA, 14 bp, Homo sapiens
aatcaaactttcag

SEQ ID NO: 4283629 - DNA, 18 bp, Homo sapiens
aatcaacagcatgtctac

SEQ ID NO: 4283630 - DNA, 18 bp, Homo sapiens
aatcaacttgtcacaaag

SEQ ID NO: 4283631 - DNA, 18 bp, Homo sapiens
aatcacgagatcttcctt

SEQ ID NO: 4283632 - DNA, 16 bp, Homo sapiens
aggggagggtggcagg

SEQ ID NO: 4283633 - DNA, 20 bp, Homo sapiens
aggggatctaaaaggaggac

SEQ ID NO: 4283634 - DNA, 17 bp, Homo sapiens
aggggcacacttcccct

SEQ ID NO: 4283635 - DNA, 17 bp, Homo sapiens
aggggcagaaggaggaa

SEQ ID NO: 4283636 - DNA, 18 bp, Homo sapiens
aggggcagaaggaggaag

SEQ ID NO: 4283637 - DNA, 23 bp, Homo sapiens
aggggcagattggttcatgcctg

SEQ ID NO: 4283638 - DNA, 22 bp, Homo sapiens
aggggcaggcctttttgagcca

SEQ ID NO: 4283639 - DNA, 14 bp, Homo sapiens
aggggccgcttcgc

SEQ ID NO: 4283640 - DNA, 23 bp, Homo sapiens
aggggcctggcagccgtgccttc

SEQ ID NO: 4283641 - DNA, 13 bp, Homo sapiens
aggggcggggcca

SEQ ID NO: 4283642 - DNA, 16 bp, Homo sapiens
agggggcccggctggg

SEQ ID NO: 4283643 - DNA, 19 bp, Homo sapiens
aggggggttgggttccaga

SEQ ID NO: 4283644 - DNA, 13 bp, Homo sapiens
aggggtcagcagg

SEQ ID NO: 4283645 - DNA, 13 bp, Homo sapiens
aggggtgagcccc

SEQ ID NO: 4283646 - DNA, 20 bp, Homo sapiens
aggggttcccactggctcct

SEQ ID NO: 4283647 - DNA, 11 bp, Homo sapiens
aggggtttaca

SEQ ID NO: 4283648 - DNA, 22 bp, Homo sapiens
agggtaggggaagtgtgctgag

SEQ ID NO: 4283649 - DNA, 23 bp, Homo sapiens
agggtcctcaggcagtggcccag

SEQ ID NO: 4283650 - DNA, 23 bp, Homo sapiens
agggtctcgtcaggaggtgcctg

SEQ ID NO: 4283651 - DNA, 16 bp, Homo sapiens
agggtgaggcgtggga

SEQ ID NO: 4283652 - DNA, 12 bp, Homo sapiens
agggtgggcgtg

SEQ ID NO: 4283653 - DNA, 22 bp, Homo sapiens
agggtggtcttcaagcctggcc

SEQ ID NO: 4283654 - DNA, 17 bp, Homo sapiens
agggttagacaagcctg

SEQ ID NO: 4283655 - DNA, 23 bp, Homo sapiens
agtccagctctcccctgcgcagg

SEQ ID NO: 4283656 - DNA, 13 bp, Homo sapiens
agtccaggcccca

SEQ ID NO: 4283657 - DNA, 23 bp, Homo sapiens
agtccaggccccaaaaccacagc

SEQ ID NO: 4283658 - DNA, 19 bp, Homo sapiens
agtccagtgaccctggagc

SEQ ID NO: 4283659 - DNA, 15 bp, Homo sapiens
agtcccagtgggagg

SEQ ID NO: 4283660 - DNA, 19 bp, Homo sapiens
agtccccgggaaaggccgg

SEQ ID NO: 4283661 - DNA, 16 bp, Homo sapiens
agtccctccctcctgg

SEQ ID NO: 4283662 - DNA, 17 bp, Homo sapiens
agtccctccctcctggc

SEQ ID NO: 4283663 - DNA, 21 bp, Homo sapiens
agtccctccctcctggctcac

SEQ ID NO: 4283664 - DNA, 15 bp, Homo sapiens
agtccctgagaagcc

SEQ ID NO: 4283665 - DNA, 19 bp, Homo sapiens
agtcctcaccttctgtttt

SEQ ID NO: 4283666 - DNA, 23 bp, Homo sapiens
agtcctgggccccctgggagagt

SEQ ID NO: 4283667 - DNA, 11 bp, Homo sapiens
agtcctgttct

SEQ ID NO: 4283668 - DNA, 12 bp, Homo sapiens
agtcctgttctc

SEQ ID NO: 4283669 - DNA, 15 bp, Homo sapiens
agtcctgttctcaga

SEQ ID NO: 4283670 - DNA, 19 bp, Homo sapiens
agtcctgttctcagagctc

SEQ ID NO: 4283671 - DNA, 21 bp, Homo sapiens
agtcctgttctcagagctcca

SEQ ID NO: 4283672 - DNA, 17 bp, Homo sapiens
agtccttaaacagggca

SEQ ID NO: 4283673 - DNA, 13 bp, Homo sapiens
agtctattgtctc

SEQ ID NO: 4283674 - DNA, 16 bp, Homo sapiens
agtctcattacagatt

SEQ ID NO: 4283675 - DNA, 13 bp, Homo sapiens
agtctcttctcca

SEQ ID NO: 4283676 - DNA, 14 bp, Homo sapiens
agtctcttctccac

SEQ ID NO: 4283677 - DNA, 15 bp, Homo sapiens
agtctcttctccact

SEQ ID NO: 4283678 - DNA, 18 bp, Homo sapiens
agtctcttctccactgga

SEQ ID NO: 4283679 - DNA, 21 bp, Homo sapiens
agtctcttctccactggatgg

SEQ ID NO: 4283680 - DNA, 15 bp, Homo sapiens
agtctgaaggagagg

SEQ ID NO: 4283681 - DNA, 20 bp, Homo sapiens
agtctgaaggagaggagtgc

SEQ ID NO: 4283682 - DNA, 13 bp, Homo sapiens
agtctgctgccct

SEQ ID NO: 4283683 - DNA, 16 bp, Homo sapiens
agtctgctgccctcca

SEQ ID NO: 4283684 - DNA, 21 bp, Homo sapiens
agtctggagaccaggactctg

SEQ ID NO: 4283685 - DNA, 13 bp, Homo sapiens
atttatttattgt

SEQ ID NO: 4283686 - DNA, 17 bp, Homo sapiens
atttattttcctcccca

SEQ ID NO: 4283687 - DNA, 15 bp, Homo sapiens
atttattttgtatga

SEQ ID NO: 4283688 - DNA, 16 bp, Homo sapiens
atttattttgtatgaa

SEQ ID NO: 4283689 - DNA, 15 bp, Homo sapiens
atttcaaaatgcatg

SEQ ID NO: 4283690 - DNA, 18 bp, Homo sapiens
atttcaaaatgcatgtga

SEQ ID NO: 4283691 - DNA, 19 bp, Homo sapiens
atttcaaaatgcatgtgat

SEQ ID NO: 4283692 - DNA, 18 bp, Homo sapiens
atttcaaccgcttgccat

SEQ ID NO: 4283693 - DNA, 20 bp, Homo sapiens
atttcaatgtaattaaactg

SEQ ID NO: 4283694 - DNA, 22 bp, Homo sapiens
atttcaatgtaattaaactgtt

SEQ ID NO: 4283695 - DNA, 23 bp, Homo sapiens
atttcaccccatccctccttaag

SEQ ID NO: 4283696 - DNA, 18 bp, Homo sapiens
atttcataaacaacttaa

SEQ ID NO: 4283697 - DNA, 15 bp, Homo sapiens
atttcatattgagat

SEQ ID NO: 4283698 - DNA, 15 bp, Homo sapiens
atttcatctttccaa

SEQ ID NO: 4283699 - DNA, 13 bp, Homo sapiens
atttcatgtccat

SEQ ID NO: 4283700 - DNA, 15 bp, Homo sapiens
atttccaccaagggt

SEQ ID NO: 4283701 - DNA, 21 bp, Homo sapiens
atttccaccaagggtatctgc

SEQ ID NO: 4283702 - DNA, 14 bp, Homo sapiens
atttccctaaaaat

SEQ ID NO: 4283703 - DNA, 20 bp, Homo sapiens
atttcctccgtcacctcaga

SEQ ID NO: 4283704 - DNA, 20 bp, Homo sapiens
atttctaaaacattaattga

SEQ ID NO: 4283705 - DNA, 23 bp, Homo sapiens
atttctagcaaacagatgtttgt

SEQ ID NO: 4283706 - DNA, 17 bp, Homo sapiens
atttctatctgcaaata

SEQ ID NO: 4283707 - DNA, 15 bp, Homo sapiens
atttctcaaagtttt

SEQ ID NO: 4283708 - DNA, 23 bp, Homo sapiens
atttctcacactctaactgtata

SEQ ID NO: 4283709 - DNA, 18 bp, Homo sapiens
atttctcatttagcattg

SEQ ID NO: 4283710 - DNA, 18 bp, Homo sapiens
atttctgtgtcctgtttt

SEQ ID NO: 4283711 - DNA, 17 bp, Homo sapiens
atttcttattaaccaaa

SEQ ID NO: 4283712 - DNA, 18 bp, Homo sapiens
atttcttctctctgtgct

SEQ ID NO: 4283713 - DNA, 20 bp, Homo sapiens
atttcttgggccctcctgaa

SEQ ID NO: 4283714 - DNA, 17 bp, Homo sapiens
atttctttgattgtgaa

SEQ ID NO: 4283715 - DNA, 18 bp, Homo sapiens
atttcttttttaaatgaa

SEQ ID NO: 4283716 - DNA, 16 bp, Homo sapiens
atttgaagacttcaaa

SEQ ID NO: 4283717 - DNA, 17 bp, Homo sapiens
atttgcatacattcttc

SEQ ID NO: 4283718 - DNA, 15 bp, Homo sapiens
atttgccgatttcct

SEQ ID NO: 4283719 - DNA, 17 bp, Homo sapiens
atttgccgatttcctaa

SEQ ID NO: 4283720 - DNA, 22 bp, Homo sapiens
atttgccgatttcctaagctgt

SEQ ID NO: 4283721 - DNA, 15 bp, Homo sapiens
atttgcttatttata

SEQ ID NO: 4283722 - DNA, 13 bp, Homo sapiens
atttggaaggaaa

SEQ ID NO: 4283723 - DNA, 20 bp, Homo sapiens
atttgggctgaatgtatgta

SEQ ID NO: 4283724 - DNA, 22 bp, Homo sapiens
atttgtaatgtatcttatttat

SEQ ID NO: 4283725 - DNA, 23 bp, Homo sapiens
atttgtaatgtatcttatttata

SEQ ID NO: 4283726 - DNA, 16 bp, Homo sapiens
atttgtatttatatta

SEQ ID NO: 4283727 - DNA, 18 bp, Homo sapiens
atttgtgagccaaagaga

SEQ ID NO: 4283728 - DNA, 19 bp, Homo sapiens
atttgtgagccaaagagaa

SEQ ID NO: 4283729 - DNA, 18 bp, Homo sapiens
atttgtttatccttaaga

SEQ ID NO: 4283730 - DNA, 15 bp, Homo sapiens
attttaaaaaataac

SEQ ID NO: 4283731 - DNA, 23 bp, Homo sapiens
attttaaaacttcatctgtctgt

SEQ ID NO: 4283732 - DNA, 20 bp, Homo sapiens
attttaaaatctcctaaatg

SEQ ID NO: 4283733 - DNA, 12 bp, Homo sapiens
attttaatgtaa

SEQ ID NO: 4283734 - DNA, 19 bp, Homo sapiens
attttaatgtaaaattcat

SEQ ID NO: 4283735 - DNA, 20 bp, Homo sapiens
attttaatgtaaaattcata

SEQ ID NO: 4283736 - DNA, 18 bp, Homo sapiens
attttaccattttgcgat

SEQ ID NO: 4283737 - DNA, 13 bp, Homo sapiens
attttagaagagg

SEQ ID NO: 4283738 - DNA, 16 bp, Homo sapiens
attttagacaaccata

SEQ ID NO: 4283739 - DNA, 14 bp, Homo sapiens
attttagatttctt

SEQ ID NO: 4283740 - DNA, 17 bp, Homo sapiens
attttagatttctttga

SEQ ID NO: 4283741 - DNA, 19 bp, Homo sapiens
attttagatttctttgatt

SEQ ID NO: 4283742 - DNA, 14 bp, Homo sapiens
attttatctcttct

SEQ ID NO: 4283743 - DNA, 12 bp, Homo sapiens
attttatgtgct

SEQ ID NO: 4283744 - DNA, 16 bp, Homo sapiens
attttatgtgcttgaa

SEQ ID NO: 4283745 - DNA, 17 bp, Homo sapiens
attttatgtgcttgaag

SEQ ID NO: 4283746 - DNA, 16 bp, Homo sapiens
attttatttcaatgta

SEQ ID NO: 4283747 - DNA, 18 bp, Homo sapiens
attttatttcaatgtaat

SEQ ID NO: 4283748 - DNA, 21 bp, Homo sapiens
attttatttcaatgtaattaa

SEQ ID NO: 4283749 - DNA, 16 bp, Homo sapiens
attttatttctctcag

SEQ ID NO: 4283750 - DNA, 11 bp, Homo sapiens
attttcatgtt

SEQ ID NO: 4283751 - DNA, 22 bp, Homo sapiens
attttccagggcaatcaatgtt

SEQ ID NO: 4283752 - DNA, 23 bp, Homo sapiens
attttcccacaattcttttgaaa

SEQ ID NO: 4283753 - DNA, 16 bp, Homo sapiens
attttcgtgcatttgt

SEQ ID NO: 4283754 - DNA, 17 bp, Homo sapiens
attttcgtgcatttgtg

SEQ ID NO: 4283755 - DNA, 13 bp, Homo sapiens
attttctaaactg

SEQ ID NO: 4283756 - DNA, 21 bp, Homo sapiens
attttctacctggtctctcct

SEQ ID NO: 4283757 - DNA, 18 bp, Homo sapiens
attttctgaattcataaa

SEQ ID NO: 4283758 - DNA, 18 bp, Homo sapiens
attttctgagtagcatat

SEQ ID NO: 4283759 - DNA, 19 bp, Homo sapiens
attttctgcatctccactt

SEQ ID NO: 4283760 - DNA, 18 bp, Homo sapiens
attttctgtgttgttcat

SEQ ID NO: 4283761 - DNA, 16 bp, Homo sapiens
attttcttcccatttg

SEQ ID NO: 4283762 - DNA, 15 bp, Homo sapiens
attttctttctatgt

SEQ ID NO: 4283763 - DNA, 20 bp, Homo sapiens
attttcttttatatctgtaa

SEQ ID NO: 4283764 - DNA, 21 bp, Homo sapiens
attttcttttatatctgtaaa

SEQ ID NO: 4283765 - DNA, 22 bp, Homo sapiens
attttcttttatatctgtaaat

SEQ ID NO: 4283766 - DNA, 15 bp, Homo sapiens
attttgcgatgtgtt

SEQ ID NO: 4283767 - DNA, 16 bp, Homo sapiens
attttgcgatgtgttt

SEQ ID NO: 4283768 - DNA, 17 bp, Homo sapiens
attttgcgatgtgtttt

SEQ ID NO: 4283769 - DNA, 16 bp, Homo sapiens
attttggacgtgtgag

SEQ ID NO: 4283770 - DNA, 18 bp, Homo sapiens
attttggacgtgtgagga

SEQ ID NO: 4283771 - DNA, 17 bp, Homo sapiens
attttgtaaaatgtatt

SEQ ID NO: 4283772 - DNA, 16 bp, Homo sapiens
attttgtggcttcaat

SEQ ID NO: 4283773 - DNA, 19 bp, Homo sapiens
atttttctgggaagaaaat

SEQ ID NO: 4283774 - DNA, 22 bp, Homo sapiens
atttttcttggatctttttgca

SEQ ID NO: 4283775 - DNA, 18 bp, Homo sapiens
atttttgaaactgcattt

SEQ ID NO: 4283776 - DNA, 20 bp, Homo sapiens
atttttgaaactgcatttgt

SEQ ID NO: 4283777 - DNA, 20 bp, Homo sapiens
attttttacaaattatgttt

SEQ ID NO: 4283778 - DNA, 16 bp, Homo sapiens
atttttttccagaatt

SEQ ID NO: 4283779 - DNA, 13 bp, Homo sapiens
atttttttctagc

SEQ ID NO: 4283780 - DNA, 21 bp, Homo sapiens
atttttttctagctataacaa

SEQ ID NO: 4283781 - DNA, 22 bp, Homo sapiens
attttttttaattgaaaagaag

SEQ ID NO: 4283782 - DNA, 20 bp, Homo sapiens
atttttttttttttcctgtc

SEQ ID NO: 4283783 - DNA, 13 bp, Homo sapiens
caaaaatcatcaa

SEQ ID NO: 4283784 - DNA, 14 bp, Homo sapiens
caaaaatcatcaaa

SEQ ID NO: 4283785 - DNA, 18 bp, Homo sapiens
caaaaccacagccctgtc

SEQ ID NO: 4283786 - DNA, 19 bp, Homo sapiens
caaaaccacagccctgtca

SEQ ID NO: 4283787 - DNA, 21 bp, Homo sapiens
caaaaccacagccctgtcagt

SEQ ID NO: 4283788 - DNA, 23 bp, Homo sapiens
caaaacccatcgtggtatgtgaa

SEQ ID NO: 4283789 - DNA, 14 bp, Homo sapiens
caaaactccactca

SEQ ID NO: 4283790 - DNA, 18 bp, Homo sapiens
caaaagctagaggagatt

SEQ ID NO: 4283791 - DNA, 17 bp, Homo sapiens
caaaaggttaagccata

SEQ ID NO: 4283792 - DNA, 10 bp, Homo sapiens
caaaagtgtc

SEQ ID NO: 4283793 - DNA, 19 bp, Homo sapiens
caaaatagttctatttcta

SEQ ID NO: 4283794 - DNA, 17 bp, Homo sapiens
caaaatatttctaagct

SEQ ID NO: 4283795 - DNA, 14 bp, Homo sapiens
caaacaaaatgatg

SEQ ID NO: 4283796 - DNA, 22 bp, Homo sapiens
caaacagggacactacaaacat

SEQ ID NO: 4283797 - DNA, 15 bp, Homo sapiens
caaacattcttattt

SEQ ID NO: 4283798 - DNA, 18 bp, Homo sapiens
caaacctccaaaagccct

SEQ ID NO: 4283799 - DNA, 19 bp, Homo sapiens
caaactgtagtaattgtta

SEQ ID NO: 4283800 - DNA, 23 bp, Homo sapiens
caaactgtagtaattgttacaat

SEQ ID NO: 4283801 - DNA, 15 bp, Homo sapiens
caaagacggtagaga

SEQ ID NO: 4283802 - DNA, 15 bp, Homo sapiens
caaagaggcattcag

SEQ ID NO: 4283803 - DNA, 13 bp, Homo sapiens
caaagagtcatca

SEQ ID NO: 4283804 - DNA, 22 bp, Homo sapiens
caaagcaccttgaatggaaggt

SEQ ID NO: 4283805 - DNA, 14 bp, Homo sapiens
caaagccagacagc

SEQ ID NO: 4283806 - DNA, 15 bp, Homo sapiens
caaagccagacagca

SEQ ID NO: 4283807 - DNA, 22 bp, Homo sapiens
caaaggatccagatagcctagg

SEQ ID NO: 4283808 - DNA, 14 bp, Homo sapiens
caaagtcctttccc

SEQ ID NO: 4283809 - DNA, 19 bp, Homo sapiens
caaagtctcaatgaaatag

SEQ ID NO: 4283810 - DNA, 20 bp, Homo sapiens
caaagtgagaaattatgaaa

SEQ ID NO: 4283811 - DNA, 13 bp, Homo sapiens
caaagttttcaga

SEQ ID NO: 4283812 - DNA, 16 bp, Homo sapiens
caaagtttttacagtg

SEQ ID NO: 4283813 - DNA, 17 bp, Homo sapiens
caaagtttttacagtgt

SEQ ID NO: 4283814 - DNA, 22 bp, Homo sapiens
caaataagtaatatctttcagt

SEQ ID NO: 4283815 - DNA, 14 bp, Homo sapiens
caaatacatgcctt

SEQ ID NO: 4283816 - DNA, 15 bp, Homo sapiens
caaataccagagcac

SEQ ID NO: 4283817 - DNA, 16 bp, Homo sapiens
caaatagggcaaagaa

SEQ ID NO: 4283818 - DNA, 14 bp, Homo sapiens
caaatatagttgaa

SEQ ID NO: 4283819 - DNA, 21 bp, Homo sapiens
caaatatgattctcctctccc

SEQ ID NO: 4283820 - DNA, 22 bp, Homo sapiens
caaatatgattctcctctccca

SEQ ID NO: 4283821 - DNA, 18 bp, Homo sapiens
caaatatttatgacctca

SEQ ID NO: 4283822 - DNA, 22 bp, Homo sapiens
caaatgaataatgcctttgtaa

SEQ ID NO: 4283823 - DNA, 23 bp, Homo sapiens
caaatgcagcttcaggtgagcca

SEQ ID NO: 4283824 - DNA, 11 bp, Homo sapiens
caaatgcatga

SEQ ID NO: 4283825 - DNA, 16 bp, Homo sapiens
caaattattctagtca

SEQ ID NO: 4283826 - DNA, 17 bp, Homo sapiens
caaatttcatctttcca

SEQ ID NO: 4283827 - DNA, 19 bp, Homo sapiens
caaatttcatctttccaaa

SEQ ID NO: 4283828 - DNA, 13 bp, Homo sapiens
caacaaagaaata

SEQ ID NO: 4283829 - DNA, 20 bp, Homo sapiens
caacaaagaagaaccatctt

SEQ ID NO: 4283830 - DNA, 12 bp, Homo sapiens
caacaagaagaa

SEQ ID NO: 4283831 - DNA, 17 bp, Homo sapiens
caacacaatcaaaagat

SEQ ID NO: 4283832 - DNA, 20 bp, Homo sapiens
caacacaatcaaaagattaa

SEQ ID NO: 4283833 - DNA, 11 bp, Homo sapiens
caacacacaga

SEQ ID NO: 4283834 - DNA, 17 bp, Homo sapiens
caacagcatgtctactg

SEQ ID NO: 4283835 - DNA, 22 bp, Homo sapiens
caacattatcctgtgtgattac

SEQ ID NO: 4283836 - DNA, 14 bp, Homo sapiens
caaccaccgctccc

SEQ ID NO: 4283837 - DNA, 19 bp, Homo sapiens
caaccaccgctccccagcc

SEQ ID NO: 4283838 - DNA, 16 bp, Homo sapiens
caaccacctctggccc

SEQ ID NO: 4283839 - DNA, 18 bp, Homo sapiens
caaccacctctggccctg

SEQ ID NO: 4283840 - DNA, 18 bp, Homo sapiens
caaccactatcttttgtt

SEQ ID NO: 4283841 - DNA, 20 bp, Homo sapiens
caacccatgcatggcctccc

SEQ ID NO: 4283842 - DNA, 23 bp, Homo sapiens
caacccatgcatggcctcccagc

SEQ ID NO: 4283843 - DNA, 24 bp, Homo sapiens
caacccatgcatggcctcccagcc

SEQ ID NO: 4283844 - DNA, 19 bp, Homo sapiens
caaccccagcagtcctggg

SEQ ID NO: 4283845 - DNA, 21 bp, Homo sapiens
caaccccagcagtcctgggcc

SEQ ID NO: 4283846 - DNA, 15 bp, Homo sapiens
caaccccctcggagc

SEQ ID NO: 4283847 - DNA, 14 bp, Homo sapiens
caacccctgtggag

SEQ ID NO: 4283848 - DNA, 19 bp, Homo sapiens
caaccctccctcagcccct

SEQ ID NO: 4283849 - DNA, 22 bp, Homo sapiens
caaccctgcaaaggactgtttt

SEQ ID NO: 4283850 - DNA, 15 bp, Homo sapiens
caacctcactgccct

SEQ ID NO: 4283851 - DNA, 23 bp, Homo sapiens
caacctcactgccctccctcggc

SEQ ID NO: 4283852 - DNA, 17 bp, Homo sapiens
caaccttctgtggctca

SEQ ID NO: 4283853 - DNA, 18 bp, Homo sapiens
caacgaaaagcacatcca

SEQ ID NO: 4283854 - DNA, 13 bp, Homo sapiens
caacgcagccctg

SEQ ID NO: 4283855 - DNA, 15 bp, Homo sapiens
caacgcagccctgct

SEQ ID NO: 4283856 - DNA, 14 bp, Homo sapiens
caacggcagtgaag

SEQ ID NO: 4283857 - DNA, 15 bp, Homo sapiens
caacgggtctgtggg

SEQ ID NO: 4283858 - DNA, 20 bp, Homo sapiens
caactacagccaaattgcag

SEQ ID NO: 4283859 - DNA, 13 bp, Homo sapiens
caactccaaggca

SEQ ID NO: 4283860 - DNA, 16 bp, Homo sapiens
caactccaaggcaaat

SEQ ID NO: 4283861 - DNA, 19 bp, Homo sapiens
caactccaaggcaaatgtc

SEQ ID NO: 4283862 - DNA, 20 bp, Homo sapiens
caactccaaggcaaatgtcc

SEQ ID NO: 4283863 - DNA, 22 bp, Homo sapiens
caactccaaggcaaatgtccaa

SEQ ID NO: 4283864 - DNA, 14 bp, Homo sapiens
caactctctctgcc

SEQ ID NO: 4283865 - DNA, 17 bp, Homo sapiens
caactctctctgccccc

SEQ ID NO: 4283866 - DNA, 19 bp, Homo sapiens
caactctctctgcccccaa

SEQ ID NO: 4283867 - DNA, 22 bp, Homo sapiens
caactctggccttggttcctcc

SEQ ID NO: 4283868 - DNA, 15 bp, Homo sapiens
caactgagccaaaaa

SEQ ID NO: 4283869 - DNA, 22 bp, Homo sapiens
caactgtataccgtgtgctcca

SEQ ID NO: 4283870 - DNA, 22 bp, Homo sapiens
caactgtttttgaagaagggaa

SEQ ID NO: 4283871 - DNA, 15 bp, Homo sapiens
caacttaatgttctg

SEQ ID NO: 4283872 - DNA, 18 bp, Homo sapiens
caactttagaaagaaatt

SEQ ID NO: 4283873 - DNA, 14 bp, Homo sapiens
caactttccagact

SEQ ID NO: 4283874 - DNA, 12 bp, Homo sapiens
caagaagaatat

SEQ ID NO: 4283875 - DNA, 14 bp, Homo sapiens
caagaagtgggagt

SEQ ID NO: 4283876 - DNA, 20 bp, Homo sapiens
caagaagtgggagtgggaga

SEQ ID NO: 4283877 - DNA, 22 bp, Homo sapiens
caagaagtgggagtgggagagg

SEQ ID NO: 4283878 - DNA, 14 bp, Homo sapiens
caagaagtgggatt

SEQ ID NO: 4283879 - DNA, 18 bp, Homo sapiens
caagaatagatgctgact

SEQ ID NO: 4283880 - DNA, 12 bp, Homo sapiens
caagaatgcagt

SEQ ID NO: 4283881 - DNA, 16 bp, Homo sapiens
caagacacccagtgga

SEQ ID NO: 4283882 - DNA, 23 bp, Homo sapiens
caagaccttacaaccacatttct

SEQ ID NO: 4283883 - DNA, 14 bp, Homo sapiens
caagagctcaggag

SEQ ID NO: 4283884 - DNA, 16 bp, Homo sapiens
caagagctcaggagaa

SEQ ID NO: 4283885 - DNA, 23 bp, Homo sapiens
caagaggagttctaacacatttc

SEQ ID NO: 4283886 - DNA, 17 bp, Homo sapiens
caagagggcactggtgg

SEQ ID NO: 4283887 - DNA, 20 bp, Homo sapiens
caagatgaaattccatttgt

SEQ ID NO: 4283888 - DNA, 15 bp, Homo sapiens
caagattctgtgggc

SEQ ID NO: 4283889 - DNA, 22 bp, Homo sapiens
caagattctgtgggcagctggc

SEQ ID NO: 4283890 - DNA, 18 bp, Homo sapiens
caagatttccctaaaaat

SEQ ID NO: 4283891 - DNA, 14 bp, Homo sapiens
caagcacctgggtg

SEQ ID NO: 4283892 - DNA, 20 bp, Homo sapiens
caagcacctgggtgtgctcc

SEQ ID NO: 4283893 - DNA, 19 bp, Homo sapiens
caagcagagtgcacagctg

SEQ ID NO: 4283894 - DNA, 23 bp, Homo sapiens
caagcagtggatacgtgtcaatg

SEQ ID NO: 4283895 - DNA, 18 bp, Homo sapiens
caagcatcagcaagacaa

SEQ ID NO: 4283896 - DNA, 21 bp, Homo sapiens
caagcatgaagataaacacag

SEQ ID NO: 4283897 - DNA, 14 bp, Homo sapiens
caagccacgcctgc

SEQ ID NO: 4283898 - DNA, 13 bp, Homo sapiens
caagccccaggca

SEQ ID NO: 4283899 - DNA, 17 bp, Homo sapiens
caagccgtggcttcccg

SEQ ID NO: 4283900 - DNA, 18 bp, Homo sapiens
caagccgtggcttcccgc

SEQ ID NO: 4283901 - DNA, 11 bp, Homo sapiens
caagcctggag

SEQ ID NO: 4283902 - DNA, 12 bp, Homo sapiens
caagcctggccc

SEQ ID NO: 4283903 - DNA, 13 bp, Homo sapiens
caagcctggccca

SEQ ID NO: 4283904 - DNA, 14 bp, Homo sapiens
caagcctggcccag

SEQ ID NO: 4283905 - DNA, 20 bp, Homo sapiens
caagcctggcccagtgagag

SEQ ID NO: 4283906 - DNA, 17 bp, Homo sapiens
caagcctgggccactgg

SEQ ID NO: 4283907 - DNA, 19 bp, Homo sapiens
caagcctgggccactggca

SEQ ID NO: 4283908 - DNA, 14 bp, Homo sapiens
caagctcacttgct

SEQ ID NO: 4283909 - DNA, 18 bp, Homo sapiens
caagctcacttgctttag

SEQ ID NO: 4283910 - DNA, 18 bp, Homo sapiens
caagctggcaggagggtg

SEQ ID NO: 4283911 - DNA, 19 bp, Homo sapiens
caagctgtacaaagggaag

SEQ ID NO: 4283912 - DNA, 22 bp, Homo sapiens
caagctgtacaaagggaagcag

SEQ ID NO: 4283913 - DNA, 15 bp, Homo sapiens
caaggcaaatgtcca

SEQ ID NO: 4283914 - DNA, 16 bp, Homo sapiens
caaggcaagaagtggg

SEQ ID NO: 4283915 - DNA, 15 bp, Homo sapiens
caaggccccagagac

SEQ ID NO: 4283916 - DNA, 16 bp, Homo sapiens
caaggccccagagact

SEQ ID NO: 4283917 - DNA, 14 bp, Homo sapiens
caaggcctatgcca

SEQ ID NO: 4283918 - DNA, 15 bp, Homo sapiens
caaggcctatgccac

SEQ ID NO: 4283919 - DNA, 17 bp, Homo sapiens
caaggctgcctgcccca

SEQ ID NO: 4283920 - DNA, 21 bp, Homo sapiens
caagggcttacacgtggagga

SEQ ID NO: 4283921 - DNA, 16 bp, Homo sapiens
caaggggtctgctcct

SEQ ID NO: 4283922 - DNA, 21 bp, Homo sapiens
caaggggttcccactggctcc

SEQ ID NO: 4283923 - DNA, 22 bp, Homo sapiens
caaggggttcccactggctcct

SEQ ID NO: 4283924 - DNA, 17 bp, Homo sapiens
caaggtggtcttggaga

SEQ ID NO: 4283925 - DNA, 16 bp, Homo sapiens
caaggtgtttctctgt

SEQ ID NO: 4283926 - DNA, 16 bp, Homo sapiens
caagtatgaataaaga

SEQ ID NO: 4283927 - DNA, 17 bp, Homo sapiens
caagtattactaaattg

SEQ ID NO: 4283928 - DNA, 19 bp, Homo sapiens
caagtattactaaattgac

SEQ ID NO: 4283929 - DNA, 12 bp, Homo sapiens
caagtctgtgaa

SEQ ID NO: 4283930 - DNA, 20 bp, Homo sapiens
caagtgctcagttccaatgt

SEQ ID NO: 4283931 - DNA, 13 bp, Homo sapiens
caagtgtgcctgc

SEQ ID NO: 4283932 - DNA, 14 bp, Homo sapiens
caagtgtgcctgct

SEQ ID NO: 4283933 - DNA, 20 bp, Homo sapiens
caataaactcagtcaaatgt

SEQ ID NO: 4283934 - DNA, 13 bp, Homo sapiens
caataaaggtcat

SEQ ID NO: 4283935 - DNA, 12 bp, Homo sapiens
caataaagtgta

SEQ ID NO: 4283936 - DNA, 15 bp, Homo sapiens
caataattgtggaga

SEQ ID NO: 4283937 - DNA, 18 bp, Homo sapiens
caataattgtggagagga

SEQ ID NO: 4283938 - DNA, 23 bp, Homo sapiens
caatatcttcgttagtaatctgt

SEQ ID NO: 4283939 - DNA, 16 bp, Homo sapiens
caatatgtaacatgtc

SEQ ID NO: 4283940 - DNA, 15 bp, Homo sapiens
caatcaaactttcag

SEQ ID NO: 4283941 - DNA, 24 bp, Homo sapiens
caatcacgagatcttccttccgct

SEQ ID NO: 4283942 - DNA, 15 bp, Homo sapiens
caatccaacccatgc

SEQ ID NO: 4283943 - DNA, 15 bp, Homo sapiens
caatcctgtcaatgt

SEQ ID NO: 4283944 - DNA, 20 bp, Homo sapiens
caatctacgatgttaaaaca

SEQ ID NO: 4283945 - DNA, 15 bp, Homo sapiens
caatcttatgttgat

SEQ ID NO: 4283946 - DNA, 16 bp, Homo sapiens
caatcttatgttgatc

SEQ ID NO: 4283947 - DNA, 19 bp, Homo sapiens
caatgaaaaggtgattgtc

SEQ ID NO: 4283948 - DNA, 17 bp, Homo sapiens
caatgaaatatttgctt

SEQ ID NO: 4283949 - DNA, 17 bp, Homo sapiens
caatgaatatactcatt

SEQ ID NO: 4283950 - DNA, 18 bp, Homo sapiens
caatgaatatactcatta

SEQ ID NO: 4283951 - DNA, 15 bp, Homo sapiens
caatgcctgcctgaa

SEQ ID NO: 4283952 - DNA, 22 bp, Homo sapiens
caatgcttttctagcaactgtt

SEQ ID NO: 4283953 - DNA, 18 bp, Homo sapiens
cacacaggcccatgccct

SEQ ID NO: 4283954 - DNA, 14 bp, Homo sapiens
cacacaggcctggc

SEQ ID NO: 4283955 - DNA, 17 bp, Homo sapiens
cacacaggcctggccca

SEQ ID NO: 4283956 - DNA, 15 bp, Homo sapiens
cacaccagccctggt

SEQ ID NO: 4283957 - DNA, 23 bp, Homo sapiens
cacacccaggcacttaagcacaa

SEQ ID NO: 4283958 - DNA, 14 bp, Homo sapiens
cacacccctgcaca

SEQ ID NO: 4283959 - DNA, 17 bp, Homo sapiens
cacacccctgcacacac

SEQ ID NO: 4283960 - DNA, 12 bp, Homo sapiens
cacacccttccc

SEQ ID NO: 4283961 - DNA, 19 bp, Homo sapiens
cacaccgtccctctccccg

SEQ ID NO: 4283962 - DNA, 14 bp, Homo sapiens
cacacctgcacacc

SEQ ID NO: 4283963 - DNA, 17 bp, Homo sapiens
cacacctgcacaccgtc

SEQ ID NO: 4283964 - DNA, 18 bp, Homo sapiens
cacactgccctctgccac

SEQ ID NO: 4283965 - DNA, 20 bp, Homo sapiens
cacacttcaggctcttctcc

SEQ ID NO: 4283966 - DNA, 14 bp, Homo sapiens
cacagaaaccctgt

SEQ ID NO: 4283967 - DNA, 13 bp, Homo sapiens
cacagaacccttg

SEQ ID NO: 4283968 - DNA, 12 bp, Homo sapiens
cacagactctgt

SEQ ID NO: 4283969 - DNA, 10 bp, Homo sapiens
cacagagacc

SEQ ID NO: 4283970 - DNA, 19 bp, Homo sapiens
cacagagacccccgtgcca

SEQ ID NO: 4283971 - DNA, 19 bp, Homo sapiens
cacagagagcggcttcccc

SEQ ID NO: 4283972 - DNA, 19 bp, Homo sapiens
cacagaggacagcttcccc

SEQ ID NO: 4283973 - DNA, 16 bp, Homo sapiens
cacagaggacggcttc

SEQ ID NO: 4283974 - DNA, 12 bp, Homo sapiens
cacagaggcagt

SEQ ID NO: 4283975 - DNA, 14 bp, Homo sapiens
cacagattatttgt

SEQ ID NO: 4283976 - DNA, 18 bp, Homo sapiens
cacagcagtacttgctca

SEQ ID NO: 4283977 - DNA, 13 bp, Homo sapiens
cacagcatctcag

SEQ ID NO: 4283978 - DNA, 17 bp, Homo sapiens
cacagccaccacctgga

SEQ ID NO: 4283979 - DNA, 18 bp, Homo sapiens
cacagccctgtcagtgca

SEQ ID NO: 4283980 - DNA, 23 bp, Homo sapiens
cacagccctgtcagtgcagcccg

SEQ ID NO: 4283981 - DNA, 23 bp, Homo sapiens
cacagccgtttgaatatatttta

SEQ ID NO: 4283982 - DNA, 19 bp, Homo sapiens
cacagcctcacccctgcag

SEQ ID NO: 4283983 - DNA, 21 bp, Homo sapiens
cacagcctcacccctgcaggc

SEQ ID NO: 4283984 - DNA, 12 bp, Homo sapiens
cacagctatgaa

SEQ ID NO: 4283985 - DNA, 22 bp, Homo sapiens
cacagctgttcttctgttctgc

SEQ ID NO: 4283986 - DNA, 16 bp, Homo sapiens
cacaggaaaagaattt

SEQ ID NO: 4283987 - DNA, 18 bp, Homo sapiens
cacaggagcatgtcctat

SEQ ID NO: 4283988 - DNA, 21 bp, Homo sapiens
cacaggagcgtgtactacccc

SEQ ID NO: 4283989 - DNA, 16 bp, Homo sapiens
cacaggagcgtgtcct

SEQ ID NO: 4283990 - DNA, 17 bp, Homo sapiens
cacaggagcgtgtccta

SEQ ID NO: 4283991 - DNA, 23 bp, Homo sapiens
cacaggcccttcctctccactgc

SEQ ID NO: 4283992 - DNA, 19 bp, Homo sapiens
cacaggcctggcccagcca

SEQ ID NO: 4283993 - DNA, 21 bp, Homo sapiens
cacaggcctggcccagccagc

SEQ ID NO: 4283994 - DNA, 19 bp, Homo sapiens
cacaggctgccccacccct

SEQ ID NO: 4283995 - DNA, 20 bp, Homo sapiens
cacaggctgccccacccctc

SEQ ID NO: 4283996 - DNA, 19 bp, Homo sapiens
cacagtatattttatttca

SEQ ID NO: 4283997 - DNA, 24 bp, Homo sapiens
cacagtcagggcggggctggccag

SEQ ID NO: 4283998 - DNA, 14 bp, Homo sapiens
cacagtgcatctca

SEQ ID NO: 4283999 - DNA, 17 bp, Homo sapiens
cacagtgcatctcagcc

SEQ ID NO: 4284000 - DNA, 14 bp, Homo sapiens
cacagtttgcaatc

SEQ ID NO: 4284001 - DNA, 23 bp, Homo sapiens
cacatcatgtaatagtggctttc

SEQ ID NO: 4284002 - DNA, 21 bp, Homo sapiens
cacatccaacatttcctcagg

SEQ ID NO: 4284003 - DNA, 15 bp, Homo sapiens
cacatgagtcccagt

SEQ ID NO: 4284004 - DNA, 18 bp, Homo sapiens
cacatgagtcccagtggg

SEQ ID NO: 4284005 - DNA, 17 bp, Homo sapiens
cacattgcacacacagt

SEQ ID NO: 4284006 - DNA, 14 bp, Homo sapiens
cacattgccctgag

SEQ ID NO: 4284007 - DNA, 20 bp, Homo sapiens
cacatttctggccatttaac

SEQ ID NO: 4284008 - DNA, 20 bp, Homo sapiens
cacatttgtcactgaataat

SEQ ID NO: 4284009 - DNA, 18 bp, Homo sapiens
caccaacctcactgccct

SEQ ID NO: 4284010 - DNA, 20 bp, Homo sapiens
caccaactctctctgccccc

SEQ ID NO: 4284011 - DNA, 13 bp, Homo sapiens
caccacagcaggt

SEQ ID NO: 4284012 - DNA, 20 bp, Homo sapiens
caccagagcctccctcagcc

SEQ ID NO: 4284013 - DNA, 22 bp, Homo sapiens
caccagagcctccctcagccac

SEQ ID NO: 4284014 - DNA, 16 bp, Homo sapiens
caccagcagcacaatt

SEQ ID NO: 4284015 - DNA, 18 bp, Homo sapiens
caccagcagcacaattct

SEQ ID NO: 4284016 - DNA, 12 bp, Homo sapiens
caccagccctgg

SEQ ID NO: 4284017 - DNA, 20 bp, Homo sapiens
caccagccctggtggccaag

SEQ ID NO: 4284018 - DNA, 11 bp, Homo sapiens
caccagcctca

SEQ ID NO: 4284019 - DNA, 12 bp, Homo sapiens
caccagcctcag

SEQ ID NO: 4284020 - DNA, 13 bp, Homo sapiens
caccagcctcagt

SEQ ID NO: 4284021 - DNA, 20 bp, Homo sapiens
caccagcctcagtgcagccc

SEQ ID NO: 4284022 - DNA, 13 bp, Homo sapiens
caccagctggctc

SEQ ID NO: 4284023 - DNA, 14 bp, Homo sapiens
caccagctggctct

SEQ ID NO: 4284024 - DNA, 17 bp, Homo sapiens
caccagctggctctgca

SEQ ID NO: 4284025 - DNA, 17 bp, Homo sapiens
caccaggaagaaggccc

SEQ ID NO: 4284026 - DNA, 16 bp, Homo sapiens
caccagggatggtact

SEQ ID NO: 4284027 - DNA, 17 bp, Homo sapiens
caccatcccctcctagc

SEQ ID NO: 4284028 - DNA, 19 bp, Homo sapiens
caccatctcaggccacctg

SEQ ID NO: 4284029 - DNA, 22 bp, Homo sapiens
caccatctcaggccacctgccc

SEQ ID NO: 4284030 - DNA, 23 bp, Homo sapiens
cacccaattttaaaaaataacat

SEQ ID NO: 4284031 - DNA, 12 bp, Homo sapiens
cacccagcaccc

SEQ ID NO: 4284032 - DNA, 14 bp, Homo sapiens
cacccagccccagc

SEQ ID NO: 4284033 - DNA, 15 bp, Homo sapiens
cacccagccccagcg

SEQ ID NO: 4284034 - DNA, 18 bp, Homo sapiens
cacccagccccagcgagt

SEQ ID NO: 4284035 - DNA, 23 bp, Homo sapiens
cacccagccccagcgagtctgga

SEQ ID NO: 4284036 - DNA, 11 bp, Homo sapiens
cacccagcctg

SEQ ID NO: 4284037 - DNA, 12 bp, Homo sapiens
cacccagcctgg

SEQ ID NO: 4284038 - DNA, 14 bp, Homo sapiens
cacccatgccatag

SEQ ID NO: 4284039 - DNA, 21 bp, Homo sapiens
cacccatgccccactctgctg

SEQ ID NO: 4284040 - DNA, 19 bp, Homo sapiens
cacctgcccccttctccca

SEQ ID NO: 4284041 - DNA, 22 bp, Homo sapiens
cacctgcccccttctcccacac

SEQ ID NO: 4284042 - DNA, 13 bp, Homo sapiens
cacctgcctctga

SEQ ID NO: 4284043 - DNA, 20 bp, Homo sapiens
cacctgctgcccgtgaggag

SEQ ID NO: 4284044 - DNA, 15 bp, Homo sapiens
cacctgctggcccct

SEQ ID NO: 4284045 - DNA, 16 bp, Homo sapiens
cacctgctggcccctc

SEQ ID NO: 4284046 - DNA, 18 bp, Homo sapiens
cacctgctggcccctcac

SEQ ID NO: 4284047 - DNA, 13 bp, Homo sapiens
cacctgcttctca

SEQ ID NO: 4284048 - DNA, 18 bp, Homo sapiens
cacctggatggatctgct

SEQ ID NO: 4284049 - DNA, 21 bp, Homo sapiens
cacctggatggatctgctcca

SEQ ID NO: 4284050 - DNA, 23 bp, Homo sapiens
cacctggatggatctgctccatg

SEQ ID NO: 4284051 - DNA, 15 bp, Homo sapiens
cacctggcttcccag

SEQ ID NO: 4284052 - DNA, 16 bp, Homo sapiens
cacctggcttcccagg

SEQ ID NO: 4284053 - DNA, 17 bp, Homo sapiens
cacctgggagatgctgg

SEQ ID NO: 4284054 - DNA, 16 bp, Homo sapiens
cacctgggccctaggc

SEQ ID NO: 4284055 - DNA, 20 bp, Homo sapiens
cacctgggccctaggcatac

SEQ ID NO: 4284056 - DNA, 23 bp, Homo sapiens
cacctgggtgtgctccaggcttc

SEQ ID NO: 4284057 - DNA, 15 bp, Homo sapiens
cacctgtcccagaaa

SEQ ID NO: 4284058 - DNA, 14 bp, Homo sapiens
cacctgtgctgctg

SEQ ID NO: 4284059 - DNA, 16 bp, Homo sapiens
cacctgtgctgctgca

SEQ ID NO: 4284060 - DNA, 21 bp, Homo sapiens
cacctgtgctgctgcaccaac

SEQ ID NO: 4284061 - DNA, 12 bp, Homo sapiens
caccttcctggg

SEQ ID NO: 4284062 - DNA, 15 bp, Homo sapiens
caccttcctgggcag

SEQ ID NO: 4284063 - DNA, 21 bp, Homo sapiens
cacgagatcttccttccgctc

SEQ ID NO: 4284064 - DNA, 13 bp, Homo sapiens
cacgcaacttgaa

SEQ ID NO: 4284065 - DNA, 15 bp, Homo sapiens
cacgcacacacacac

SEQ ID NO: 4284066 - DNA, 20 bp, Homo sapiens
cacgcacacacacacacagg

SEQ ID NO: 4284067 - DNA, 16 bp, Homo sapiens
cacgccaaccccagca

SEQ ID NO: 4284068 - DNA, 18 bp, Homo sapiens
cacgccaaccccagcagt

SEQ ID NO: 4284069 - DNA, 23 bp, Homo sapiens
cacgccaaccccagcagtcctgg

SEQ ID NO: 4284070 - DNA, 22 bp, Homo sapiens
cacgcccgactctctccatcag

SEQ ID NO: 4284071 - DNA, 21 bp, Homo sapiens
cacgccctcctccctccgcta

SEQ ID NO: 4284072 - DNA, 21 bp, Homo sapiens
cacgcctctctcagcccaggt

SEQ ID NO: 4284073 - DNA, 21 bp, Homo sapiens
cacgcctgcgatggtgctgca

SEQ ID NO: 4284074 - DNA, 23 bp, Homo sapiens
cacgcctgcgatggtgctgcacc

SEQ ID NO: 4284075 - DNA, 16 bp, Homo sapiens
cacgccttcccctcag

SEQ ID NO: 4284076 - DNA, 14 bp, Homo sapiens
cacgcgctctgcat

SEQ ID NO: 4284077 - DNA, 16 bp, Homo sapiens
cacgcgctctgcatgc

SEQ ID NO: 4284078 - DNA, 17 bp, Homo sapiens
cacgcgctctgcatgct

SEQ ID NO: 4284079 - DNA, 15 bp, Homo sapiens
cacgctcctgccctc

SEQ ID NO: 4284080 - DNA, 16 bp, Homo sapiens
cacgctgtctccagac

SEQ ID NO: 4284081 - DNA, 23 bp, Homo sapiens
cacgctgtctccagacccccacc

SEQ ID NO: 4284082 - DNA, 13 bp, Homo sapiens
cacggcagccacc

SEQ ID NO: 4284083 - DNA, 14 bp, Homo sapiens
cacggcagccaccc

SEQ ID NO: 4284084 - DNA, 17 bp, Homo sapiens
cacggcagccaccctgc

SEQ ID NO: 4284085 - DNA, 18 bp, Homo sapiens
cacggcagccaccctgcc

SEQ ID NO: 4284086 - DNA, 20 bp, Homo sapiens
cacggcagccaccctgccat

SEQ ID NO: 4284087 - DNA, 22 bp, Homo sapiens
cacggcagccaccctgccatgg

SEQ ID NO: 4284088 - DNA, 16 bp, Homo sapiens
cacggccactgcagtc

SEQ ID NO: 4284089 - DNA, 14 bp, Homo sapiens
cacggccatgacca

SEQ ID NO: 4284090 - DNA, 12 bp, Homo sapiens
cacggcctctgg

SEQ ID NO: 4284091 - DNA, 16 bp, Homo sapiens
cacggcctctggggag

SEQ ID NO: 4284092 - DNA, 12 bp, Homo sapiens
cacggctgcacc

SEQ ID NO: 4284093 - DNA, 22 bp, Homo sapiens
cacgggggaggccgaggcaggg

SEQ ID NO: 4284094 - DNA, 15 bp, Homo sapiens
cacgtgcacacacct

SEQ ID NO: 4284095 - DNA, 14 bp, Homo sapiens
cacgtgctggagag

SEQ ID NO: 4284096 - DNA, 19 bp, Homo sapiens
cacgtttagaaatgatttc

SEQ ID NO: 4284097 - DNA, 16 bp, Homo sapiens
cactaggccctggtct

SEQ ID NO: 4284098 - DNA, 20 bp, Homo sapiens
cactaggtgcccagtcttga

SEQ ID NO: 4284099 - DNA, 16 bp, Homo sapiens
cactataatgtgaaat

SEQ ID NO: 4284100 - DNA, 13 bp, Homo sapiens
cactccactcccc

SEQ ID NO: 4284101 - DNA, 14 bp, Homo sapiens
cactccactcccct

SEQ ID NO: 4284102 - DNA, 16 bp, Homo sapiens
cactccactcccctca

SEQ ID NO: 4284103 - DNA, 17 bp, Homo sapiens
cactccactcccctcat

SEQ ID NO: 4284104 - DNA, 12 bp, Homo sapiens
cactcccctcat

SEQ ID NO: 4284105 - DNA, 16 bp, Homo sapiens
cactcccctcatccac

SEQ ID NO: 4284106 - DNA, 14 bp, Homo sapiens
cactccctgtctga

SEQ ID NO: 4284107 - DNA, 13 bp, Homo sapiens
cactcctacctgg

SEQ ID NO: 4284108 - DNA, 14 bp, Homo sapiens
cactctcctgagga

SEQ ID NO: 4284109 - DNA, 17 bp, Homo sapiens
cactctgcctggccttg

SEQ ID NO: 4284110 - DNA, 13 bp, Homo sapiens
cactctgctgagg

SEQ ID NO: 4284111 - DNA, 15 bp, Homo sapiens
cactctgctgaggcc

SEQ ID NO: 4284112 - DNA, 21 bp, Homo sapiens
cactctgctgaggccagagga

SEQ ID NO: 4284113 - DNA, 23 bp, Homo sapiens
cactctgctgaggccagaggaag

SEQ ID NO: 4284114 - DNA, 17 bp, Homo sapiens
cactctgtttgctcacc

SEQ ID NO: 4284115 - DNA, 21 bp, Homo sapiens
cactctgtttgctcacccagg

SEQ ID NO: 4284116 - DNA, 21 bp, Homo sapiens
cactgaaggctttcagggcct

SEQ ID NO: 4284117 - DNA, 16 bp, Homo sapiens
cactgaagtgaataca

SEQ ID NO: 4284118 - DNA, 19 bp, Homo sapiens
cactgaagtgaatacatgg

SEQ ID NO: 4284119 - DNA, 21 bp, Homo sapiens
cactgagtctcattcctctgt

SEQ ID NO: 4284120 - DNA, 19 bp, Homo sapiens
cactgcacagtgcatctca

SEQ ID NO: 4284121 - DNA, 23 bp, Homo sapiens
cactgcacagtgcatctcagccc

SEQ ID NO: 4284122 - DNA, 18 bp, Homo sapiens
cactgcagtcacccctgt

SEQ ID NO: 4284123 - DNA, 21 bp, Homo sapiens
cactgccattagactgaattt

SEQ ID NO: 4284124 - DNA, 18 bp, Homo sapiens
cactgccctctgccactg

SEQ ID NO: 4284125 - DNA, 14 bp, Homo sapiens
cactgcctgcccac

SEQ ID NO: 4284126 - DNA, 15 bp, Homo sapiens
cactgcctgcccacc

SEQ ID NO: 4284127 - DNA, 12 bp, Homo sapiens
cactgcctttgc

SEQ ID NO: 4284128 - DNA, 14 bp, Homo sapiens
cactgcctttgctg

SEQ ID NO: 4284129 - DNA, 17 bp, Homo sapiens
cactgcctttgctgcct

SEQ ID NO: 4284130 - DNA, 12 bp, Homo sapiens
cactgctggctg

SEQ ID NO: 4284131 - DNA, 15 bp, Homo sapiens
cactggagcgtgtac

SEQ ID NO: 4284132 - DNA, 18 bp, Homo sapiens
cactggagcgtgtactac

SEQ ID NO: 4284133 - DNA, 15 bp, Homo sapiens
cagaactgtcttagt

SEQ ID NO: 4284134 - DNA, 17 bp, Homo sapiens
cagaactgtcttagtca

SEQ ID NO: 4284135 - DNA, 20 bp, Homo sapiens
cagaagacacgtgtttttgt

SEQ ID NO: 4284136 - DNA, 16 bp, Homo sapiens
cagaagagaaagtaca

SEQ ID NO: 4284137 - DNA, 23 bp, Homo sapiens
cagaaggaaggagccagctccca

SEQ ID NO: 4284138 - DNA, 18 bp, Homo sapiens
cagaaggccttgccttgt

SEQ ID NO: 4284139 - DNA, 14 bp, Homo sapiens
cagaagggggccat

SEQ ID NO: 4284140 - DNA, 18 bp, Homo sapiens
cagaagggggccatgagg

SEQ ID NO: 4284141 - DNA, 16 bp, Homo sapiens
cagaaggttgtgatga

SEQ ID NO: 4284142 - DNA, 15 bp, Homo sapiens
cagaagtggcaggag

SEQ ID NO: 4284143 - DNA, 19 bp, Homo sapiens
cagaatcaaatctgagcct

SEQ ID NO: 4284144 - DNA, 15 bp, Homo sapiens
cagaatctttaaaga

SEQ ID NO: 4284145 - DNA, 15 bp, Homo sapiens
cagaatggaagagag

SEQ ID NO: 4284146 - DNA, 19 bp, Homo sapiens
cagaatggtgggctccaga

SEQ ID NO: 4284147 - DNA, 20 bp, Homo sapiens
cagaatggtgggctccagag

SEQ ID NO: 4284148 - DNA, 22 bp, Homo sapiens
cagaattcattcatacttaaaa

SEQ ID NO: 4284149 - DNA, 19 bp, Homo sapiens
cagacacgccttcccctca

SEQ ID NO: 4284150 - DNA, 17 bp, Homo sapiens
cagacagggtggggctt

SEQ ID NO: 4284151 - DNA, 19 bp, Homo sapiens
cagacagggtggggcttag

SEQ ID NO: 4284152 - DNA, 16 bp, Homo sapiens
cagacatgctgcccac

SEQ ID NO: 4284153 - DNA, 18 bp, Homo sapiens
cagacatgctgcccaccc

SEQ ID NO: 4284154 - DNA, 20 bp, Homo sapiens
cagaccacactctgcctggc

SEQ ID NO: 4284155 - DNA, 18 bp, Homo sapiens
cagaccaggaaggaagag

SEQ ID NO: 4284156 - DNA, 20 bp, Homo sapiens
cagaccccatccagccaggg

SEQ ID NO: 4284157 - DNA, 21 bp, Homo sapiens
cagaccccatccagccagggg

SEQ ID NO: 4284158 - DNA, 15 bp, Homo sapiens
cagacccccacccct

SEQ ID NO: 4284159 - DNA, 13 bp, Homo sapiens
cagacccccagca

SEQ ID NO: 4284160 - DNA, 18 bp, Homo sapiens
cagacccccagcaaccct

SEQ ID NO: 4284161 - DNA, 15 bp, Homo sapiens
cagacccctggcttt

SEQ ID NO: 4284162 - DNA, 21 bp, Homo sapiens
cagacccctggcttttcactg

SEQ ID NO: 4284163 - DNA, 22 bp, Homo sapiens
cagacccctggcttttcactgc

SEQ ID NO: 4284164 - DNA, 14 bp, Homo sapiens
cagacctgggactt

SEQ ID NO: 4284165 - DNA, 16 bp, Homo sapiens
cagacctgggacttta

SEQ ID NO: 4284166 - DNA, 22 bp, Homo sapiens
cagactctgtgagattctaaat

SEQ ID NO: 4284167 - DNA, 19 bp, Homo sapiens
cagacttcgctattcccag

SEQ ID NO: 4284168 - DNA, 14 bp, Homo sapiens
cagagaagcctcag

SEQ ID NO: 4284169 - DNA, 15 bp, Homo sapiens
cagagacccccgtgc

SEQ ID NO: 4284170 - DNA, 16 bp, Homo sapiens
cagagagaagcacccc

SEQ ID NO: 4284171 - DNA, 21 bp, Homo sapiens
cagagagagaagtgcccctgc

SEQ ID NO: 4284172 - DNA, 22 bp, Homo sapiens
cagagagagaagtgcccctgct

SEQ ID NO: 4284173 - DNA, 24 bp, Homo sapiens
cagagagagaagtgcccctgctgc

SEQ ID NO: 4284174 - DNA, 18 bp, Homo sapiens
cagagagtggctcctccc

SEQ ID NO: 4284175 - DNA, 11 bp, Homo sapiens
cagagatgtac

SEQ ID NO: 4284176 - DNA, 17 bp, Homo sapiens
cagagccagggctgtcc

SEQ ID NO: 4284177 - DNA, 19 bp, Homo sapiens
cagagccagggctgtcctt

SEQ ID NO: 4284178 - DNA, 11 bp, Homo sapiens
cagagccatgg

SEQ ID NO: 4284179 - DNA, 14 bp, Homo sapiens
cagagccatggact

SEQ ID NO: 4284180 - DNA, 16 bp, Homo sapiens
cagagcccgcccacct

SEQ ID NO: 4284181 - DNA, 18 bp, Homo sapiens
cagagcccgcccacctgg

SEQ ID NO: 4284182 - DNA, 22 bp, Homo sapiens
cagagcccgcccacctgggccc

SEQ ID NO: 4284183 - DNA, 14 bp, Homo sapiens
cagagcctccctca

SEQ ID NO: 4284184 - DNA, 19 bp, Homo sapiens
cagagcgcccctccctagt

SEQ ID NO: 4284185 - DNA, 15 bp, Homo sapiens
cagagctcccaggac

SEQ ID NO: 4284186 - DNA, 16 bp, Homo sapiens
cagagctcccaggacg

SEQ ID NO: 4284187 - DNA, 17 bp, Homo sapiens
cagagctcccaggacgc

SEQ ID NO: 4284188 - DNA, 22 bp, Homo sapiens
cagagctcccaggacgcaggga

SEQ ID NO: 4284189 - DNA, 18 bp, Homo sapiens
cagaggaagggaggcctg

SEQ ID NO: 4284190 - DNA, 22 bp, Homo sapiens
cagaggaagggaggcctgaggg

SEQ ID NO: 4284191 - DNA, 20 bp, Homo sapiens
cagaggacagcttccccatc

SEQ ID NO: 4284192 - DNA, 15 bp, Homo sapiens
cagaggaggtgcccg

SEQ ID NO: 4284193 - DNA, 14 bp, Homo sapiens
cagaggcagtggca

SEQ ID NO: 4284194 - DNA, 15 bp, Homo sapiens
cagaggcagtggcag

SEQ ID NO: 4284195 - DNA, 20 bp, Homo sapiens
cagaggcattggaggatggg

SEQ ID NO: 4284196 - DNA, 22 bp, Homo sapiens
cagaggccccttgctgctggct

SEQ ID NO: 4284197 - DNA, 14 bp, Homo sapiens
cagaggcctggtgc

SEQ ID NO: 4284198 - DNA, 15 bp, Homo sapiens
cagaggcctggtgcc

SEQ ID NO: 4284199 - DNA, 16 bp, Homo sapiens
cagagggacagtgggc

SEQ ID NO: 4284200 - DNA, 19 bp, Homo sapiens
cagagggacagtgggctat

SEQ ID NO: 4284201 - DNA, 23 bp, Homo sapiens
cagagggacagtgggctatgcca

SEQ ID NO: 4284202 - DNA, 22 bp, Homo sapiens
cagagggcccctcactggctgg

SEQ ID NO: 4284203 - DNA, 13 bp, Homo sapiens
cagaggggagagg

SEQ ID NO: 4284204 - DNA, 21 bp, Homo sapiens
cagaggggcggggccaggatg

SEQ ID NO: 4284205 - DNA, 17 bp, Homo sapiens
cagagggttgtgatttt

SEQ ID NO: 4284206 - DNA, 15 bp, Homo sapiens
cagagtaggtgggtc

SEQ ID NO: 4284207 - DNA, 16 bp, Homo sapiens
cagagtaggtgggtct

SEQ ID NO: 4284208 - DNA, 15 bp, Homo sapiens
cagagtatatatgta

SEQ ID NO: 4284209 - DNA, 19 bp, Homo sapiens
cagagtggatctggagtct

SEQ ID NO: 4284210 - DNA, 18 bp, Homo sapiens
cagatgacacataaatct

SEQ ID NO: 4284211 - DNA, 23 bp, Homo sapiens
cagatgctggtcatcctgggcat

SEQ ID NO: 4284212 - DNA, 12 bp, Homo sapiens
cagatggctccc

SEQ ID NO: 4284213 - DNA, 19 bp, Homo sapiens
cagatggctccctgggctg

SEQ ID NO: 4284214 - DNA, 14 bp, Homo sapiens
cagatggggcctct

SEQ ID NO: 4284215 - DNA, 15 bp, Homo sapiens
cagatggggcctctg

SEQ ID NO: 4284216 - DNA, 14 bp, Homo sapiens
cagattaggcctgg

SEQ ID NO: 4284217 - DNA, 17 bp, Homo sapiens
cagattaggcctggagt

SEQ ID NO: 4284218 - DNA, 18 bp, Homo sapiens
cagcaacaggaccaggag

SEQ ID NO: 4284219 - DNA, 14 bp, Homo sapiens
cagcaaccctccta

SEQ ID NO: 4284220 - DNA, 15 bp, Homo sapiens
cagcaagacctcgtc

SEQ ID NO: 4284221 - DNA, 23 bp, Homo sapiens
cagcaagtgctgagtctgtgaat

SEQ ID NO: 4284222 - DNA, 20 bp, Homo sapiens
cagcaattaaagacatttaa

SEQ ID NO: 4284223 - DNA, 23 bp, Homo sapiens
cagcacaattatgtgtgaagctg

SEQ ID NO: 4284224 - DNA, 17 bp, Homo sapiens
cagcacaattctgtccc

SEQ ID NO: 4284225 - DNA, 23 bp, Homo sapiens
cagcacaattctgtccctgtccc

SEQ ID NO: 4284226 - DNA, 24 bp, Homo sapiens
cagcacaattctgtccctgtccct

SEQ ID NO: 4284227 - DNA, 15 bp, Homo sapiens
cagcacagagagcgg

SEQ ID NO: 4284228 - DNA, 16 bp, Homo sapiens
cagcacccatgcccca

SEQ ID NO: 4284229 - DNA, 20 bp, Homo sapiens
cagcacccatgccccactct

SEQ ID NO: 4284230 - DNA, 22 bp, Homo sapiens
cagcacccatgccccactctgc

SEQ ID NO: 4284231 - DNA, 21 bp, Homo sapiens
catcagcccctgctgctcctc

SEQ ID NO: 4284232 - DNA, 15 bp, Homo sapiens
catcatggctatctg

SEQ ID NO: 4284233 - DNA, 23 bp, Homo sapiens
catcatgggggatttttcattct

SEQ ID NO: 4284234 - DNA, 22 bp, Homo sapiens
catcattttcacctccatttct

SEQ ID NO: 4284235 - DNA, 13 bp, Homo sapiens
catccaacctctt

SEQ ID NO: 4284236 - DNA, 15 bp, Homo sapiens
catccagaactgtct

SEQ ID NO: 4284237 - DNA, 16 bp, Homo sapiens
catccattccagagct

SEQ ID NO: 4284238 - DNA, 15 bp, Homo sapiens
catccccctccttgc

SEQ ID NO: 4284239 - DNA, 20 bp, Homo sapiens
catccccctccttgccgctg

SEQ ID NO: 4284240 - DNA, 23 bp, Homo sapiens
catcccgacatggacccggagct

SEQ ID NO: 4284241 - DNA, 23 bp, Homo sapiens
catccctccaccccagtccccgg

SEQ ID NO: 4284242 - DNA, 14 bp, Homo sapiens
catccctccttaag

SEQ ID NO: 4284243 - DNA, 16 bp, Homo sapiens
catccctccttaagag

SEQ ID NO: 4284244 - DNA, 18 bp, Homo sapiens
catcccttggcccctctc

SEQ ID NO: 4284245 - DNA, 14 bp, Homo sapiens
catcctcagcaagt

SEQ ID NO: 4284246 - DNA, 16 bp, Homo sapiens
catcctcagcaagtgc

SEQ ID NO: 4284247 - DNA, 11 bp, Homo sapiens
catcctcagcc

SEQ ID NO: 4284248 - DNA, 12 bp, Homo sapiens
catcctcagccc

SEQ ID NO: 4284249 - DNA, 18 bp, Homo sapiens
catcctcagccccagggc

SEQ ID NO: 4284250 - DNA, 19 bp, Homo sapiens
catcctcagccccagggcc

SEQ ID NO: 4284251 - DNA, 21 bp, Homo sapiens
catcctcagccccagggccct

SEQ ID NO: 4284252 - DNA, 13 bp, Homo sapiens
catcctccccttc

SEQ ID NO: 4284253 - DNA, 15 bp, Homo sapiens
catcctcctggaccc

SEQ ID NO: 4284254 - DNA, 19 bp, Homo sapiens
catcctgattattgaatgt

SEQ ID NO: 4284255 - DNA, 14 bp, Homo sapiens
catcctgtacaagt

SEQ ID NO: 4284256 - DNA, 16 bp, Homo sapiens
catcgtggtatgtgaa

SEQ ID NO: 4284257 - DNA, 14 bp, Homo sapiens
catctaaaatactc

SEQ ID NO: 4284258 - DNA, 20 bp, Homo sapiens
catctagaggcttccttcat

SEQ ID NO: 4284259 - DNA, 19 bp, Homo sapiens
catctatctggtgatttct

SEQ ID NO: 4284260 - DNA, 14 bp, Homo sapiens
catctattcccaaa

SEQ ID NO: 4284261 - DNA, 14 bp, Homo sapiens
catctcaggccacc

SEQ ID NO: 4284262 - DNA, 15 bp, Homo sapiens
catctcaggccacct

SEQ ID NO: 4284263 - DNA, 20 bp, Homo sapiens
catctcaggccacctgcccc

SEQ ID NO: 4284264 - DNA, 21 bp, Homo sapiens
catctcatcatgtctattgtc

SEQ ID NO: 4284265 - DNA, 22 bp, Homo sapiens
catctgcgacaccaccaacagg

SEQ ID NO: 4284266 - DNA, 23 bp, Homo sapiens
catctgcgacaccaccaacaggc

SEQ ID NO: 4284267 - DNA, 13 bp, Homo sapiens
catctgctcttct

SEQ ID NO: 4284268 - DNA, 14 bp, Homo sapiens
catctgctcttctc

SEQ ID NO: 4284269 - DNA, 17 bp, Homo sapiens
catctgctcttctctta

SEQ ID NO: 4284270 - DNA, 14 bp, Homo sapiens
catctgctgagctc

SEQ ID NO: 4284271 - DNA, 14 bp, Homo sapiens
catctggccctgct

SEQ ID NO: 4284272 - DNA, 15 bp, Homo sapiens
catctggccctgctg

SEQ ID NO: 4284273 - DNA, 17 bp, Homo sapiens
catctggccctgctgcc

SEQ ID NO: 4284274 - DNA, 18 bp, Homo sapiens
catctggccctgctgccc

SEQ ID NO: 4284275 - DNA, 15 bp, Homo sapiens
catctgtctgtccta

SEQ ID NO: 4284276 - DNA, 23 bp, Homo sapiens
catctgtctgtcctacccgcccg

SEQ ID NO: 4284277 - DNA, 15 bp, Homo sapiens
catctgtttgataca

SEQ ID NO: 4284278 - DNA, 20 bp, Homo sapiens
catcttaaaagctatcttca

SEQ ID NO: 4284279 - DNA, 20 bp, Homo sapiens
catgaacactggctgcaagt

SEQ ID NO: 4284280 - DNA, 20 bp, Homo sapiens
catgaagataaacacagctg

SEQ ID NO: 4284281 - DNA, 15 bp, Homo sapiens
catgaattaagaact

SEQ ID NO: 4284282 - DNA, 15 bp, Homo sapiens
catgacaagccccag

SEQ ID NO: 4284283 - DNA, 17 bp, Homo sapiens
catgacaagccccaggc

SEQ ID NO: 4284284 - DNA, 19 bp, Homo sapiens
catgacaagccccaggcag

SEQ ID NO: 4284285 - DNA, 17 bp, Homo sapiens
catgacatttctcaaag

SEQ ID NO: 4284286 - DNA, 15 bp, Homo sapiens
catgactagggtcct

SEQ ID NO: 4284287 - DNA, 20 bp, Homo sapiens
catgactagggtcctcaggc

SEQ ID NO: 4284288 - DNA, 14 bp, Homo sapiens
catgagccagctct

SEQ ID NO: 4284289 - DNA, 17 bp, Homo sapiens
catgagctccagacccc

SEQ ID NO: 4284290 - DNA, 21 bp, Homo sapiens
catgaggcctcagtggacttt

SEQ ID NO: 4284291 - DNA, 15 bp, Homo sapiens
catgagtcccagtgg

SEQ ID NO: 4284292 - DNA, 18 bp, Homo sapiens
catgagtcccagtgggag

SEQ ID NO: 4284293 - DNA, 12 bp, Homo sapiens
catgatgtggag

SEQ ID NO: 4284294 - DNA, 20 bp, Homo sapiens
catgatgtggagtggggcag

SEQ ID NO: 4284295 - DNA, 18 bp, Homo sapiens
catgattcattttaacat

SEQ ID NO: 4284296 - DNA, 19 bp, Homo sapiens
catgattccaagggcccag

SEQ ID NO: 4284297 - DNA, 23 bp, Homo sapiens
catgattccaagggcccagaggg

SEQ ID NO: 4284298 - DNA, 23 bp, Homo sapiens
catgatttgcaactttagaaaga

SEQ ID NO: 4284299 - DNA, 21 bp, Homo sapiens
catgattttttacaaattatg

SEQ ID NO: 4284300 - DNA, 16 bp, Homo sapiens
catgcaaagtcctttc

SEQ ID NO: 4284301 - DNA, 17 bp, Homo sapiens
catgcacttggctgcat

SEQ ID NO: 4284302 - DNA, 23 bp, Homo sapiens
catgcagatctagccaggcctcc

SEQ ID NO: 4284303 - DNA, 17 bp, Homo sapiens
catgcagggcccccaca

SEQ ID NO: 4284304 - DNA, 14 bp, Homo sapiens
catgcatggcctcc

SEQ ID NO: 4284305 - DNA, 15 bp, Homo sapiens
catgcatggcctccc

SEQ ID NO: 4284306 - DNA, 16 bp, Homo sapiens
catgcatggcctccca

SEQ ID NO: 4284307 - DNA, 19 bp, Homo sapiens
catgcatggcctcccagcc

SEQ ID NO: 4284308 - DNA, 20 bp, Homo sapiens
catgcattactgcatgcact

SEQ ID NO: 4284309 - DNA, 15 bp, Homo sapiens
catgccccactctgc

SEQ ID NO: 4284310 - DNA, 14 bp, Homo sapiens
catgccctcaggct

SEQ ID NO: 4284311 - DNA, 17 bp, Homo sapiens
catgccctcaggcttgg

SEQ ID NO: 4284312 - DNA, 21 bp, Homo sapiens
catgcctgagaatgcctaggc

SEQ ID NO: 4284313 - DNA, 23 bp, Homo sapiens
catgcctgagaatgcctaggcca

SEQ ID NO: 4284314 - DNA, 17 bp, Homo sapiens
catgccttcataaatta

SEQ ID NO: 4284315 - DNA, 16 bp, Homo sapiens
catgcggccggcctgg

SEQ ID NO: 4284316 - DNA, 13 bp, Homo sapiens
catgcggctgccc

SEQ ID NO: 4284317 - DNA, 23 bp, Homo sapiens
catgcgtgggtggggagggaggt

SEQ ID NO: 4284318 - DNA, 17 bp, Homo sapiens
catgctaacctctctga

SEQ ID NO: 4284319 - DNA, 19 bp, Homo sapiens
catgctaacctctctgaac

SEQ ID NO: 4284320 - DNA, 14 bp, Homo sapiens
catgctcaatgaaa

SEQ ID NO: 4284321 - DNA, 12 bp, Homo sapiens
catgctcctctg

SEQ ID NO: 4284322 - DNA, 16 bp, Homo sapiens
catgctcctctgcctg

SEQ ID NO: 4284323 - DNA, 13 bp, Homo sapiens
catgctccttaat

SEQ ID NO: 4284324 - DNA, 12 bp, Homo sapiens
catgctgcccac

SEQ ID NO: 4284325 - DNA, 16 bp, Homo sapiens
catgctgcccaccccc

SEQ ID NO: 4284326 - DNA, 18 bp, Homo sapiens
catgctgcccaccccctg

SEQ ID NO: 4284327 - DNA, 19 bp, Homo sapiens
catgctgcccaccccctgc

SEQ ID NO: 4284328 - DNA, 21 bp, Homo sapiens
catgctgcccaccccctgctg

SEQ ID NO: 4284329 - DNA, 12 bp, Homo sapiens
catgctgcctgc

SEQ ID NO: 4284330 - DNA, 13 bp, Homo sapiens
catgctgcctgcc

SEQ ID NO: 4284331 - DNA, 14 bp, Homo sapiens
catgctgcctgcct

SEQ ID NO: 4284332 - DNA, 16 bp, Homo sapiens
catgctgcctgcctcc

SEQ ID NO: 4284333 - DNA, 20 bp, Homo sapiens
catgctggctcccagggcca

SEQ ID NO: 4284334 - DNA, 22 bp, Homo sapiens
catgctggctcccagggccatg

SEQ ID NO: 4284335 - DNA, 12 bp, Homo sapiens
catggaagctgg

SEQ ID NO: 4284336 - DNA, 15 bp, Homo sapiens
catggacagggccag

SEQ ID NO: 4284337 - DNA, 16 bp, Homo sapiens
catggacagggccagg

SEQ ID NO: 4284338 - DNA, 21 bp, Homo sapiens
catggacagggccagggttgc

SEQ ID NO: 4284339 - DNA, 14 bp, Homo sapiens
catggacctgcact

SEQ ID NO: 4284340 - DNA, 16 bp, Homo sapiens
catggaggcgccttcc

SEQ ID NO: 4284341 - DNA, 18 bp, Homo sapiens
catggaggcgccttcctg

SEQ ID NO: 4284342 - DNA, 14 bp, Homo sapiens
catggccaggtggc

SEQ ID NO: 4284343 - DNA, 15 bp, Homo sapiens
catggccaggtggcc

SEQ ID NO: 4284344 - DNA, 16 bp, Homo sapiens
catggcctcccagcca

SEQ ID NO: 4284345 - DNA, 12 bp, Homo sapiens
catggctatctg

SEQ ID NO: 4284346 - DNA, 13 bp, Homo sapiens
catggctgtcccc

SEQ ID NO: 4284347 - DNA, 15 bp, Homo sapiens
catggggaggggaga

SEQ ID NO: 4284348 - DNA, 13 bp, Homo sapiens
catggggtgggcc

SEQ ID NO: 4284349 - DNA, 15 bp, Homo sapiens
catggggtgggcctc

SEQ ID NO: 4284350 - DNA, 20 bp, Homo sapiens
catggggttggctgggccca

SEQ ID NO: 4284351 - DNA, 14 bp, Homo sapiens
catggtatctcttt

SEQ ID NO: 4284352 - DNA, 17 bp, Homo sapiens
catggtgttggaggggc

SEQ ID NO: 4284353 - DNA, 18 bp, Homo sapiens
catggtgttggaggggca

SEQ ID NO: 4284354 - DNA, 17 bp, Homo sapiens
catgtaaattgactgta

SEQ ID NO: 4284355 - DNA, 13 bp, Homo sapiens
catgtatagtgag

SEQ ID NO: 4284356 - DNA, 15 bp, Homo sapiens
catgtatagtgagtg

SEQ ID NO: 4284357 - DNA, 14 bp, Homo sapiens
catgtctaaagtta

SEQ ID NO: 4284358 - DNA, 13 bp, Homo sapiens
catgtctattgtc

SEQ ID NO: 4284359 - DNA, 21 bp, Homo sapiens
catgtctttctccaaagttat

SEQ ID NO: 4284360 - DNA, 15 bp, Homo sapiens
ccagcacccatgccc

SEQ ID NO: 4284361 - DNA, 13 bp, Homo sapiens
ccagcagcacaat

SEQ ID NO: 4284362 - DNA, 15 bp, Homo sapiens
ccagcagcacaattc

SEQ ID NO: 4284363 - DNA, 20 bp, Homo sapiens
ccagcagcacaattctgtcc

SEQ ID NO: 4284364 - DNA, 24 bp, Homo sapiens
ccagcagcacaattctgtccctgt

SEQ ID NO: 4284365 - DNA, 14 bp, Homo sapiens
ccagcagcggccca

SEQ ID NO: 4284366 - DNA, 16 bp, Homo sapiens
ccagcagcggcccaga

SEQ ID NO: 4284367 - DNA, 19 bp, Homo sapiens
ccagcagggcgggccagga

SEQ ID NO: 4284368 - DNA, 22 bp, Homo sapiens
ccagcaggggcagaaggaggaa

SEQ ID NO: 4284369 - DNA, 15 bp, Homo sapiens
ccagcaggtggggag

SEQ ID NO: 4284370 - DNA, 19 bp, Homo sapiens
ccagcagtcctgggccccc

SEQ ID NO: 4284371 - DNA, 13 bp, Homo sapiens
ccatggtgcagtg

SEQ ID NO: 4284372 - DNA, 17 bp, Homo sapiens
ccatggtggtttcagaa

SEQ ID NO: 4284373 - DNA, 22 bp, Homo sapiens
ccatggtggtttcagaaagggc

SEQ ID NO: 4284374 - DNA, 13 bp, Homo sapiens
ccatggtgttgga

SEQ ID NO: 4284375 - DNA, 16 bp, Homo sapiens
ccatggtgttggaggg

SEQ ID NO: 4284376 - DNA, 16 bp, Homo sapiens
ccatgtagaagaggga

SEQ ID NO: 4284377 - DNA, 20 bp, Homo sapiens
ccatgtagaagagggagaag

SEQ ID NO: 4284378 - DNA, 15 bp, Homo sapiens
ccatgtcaagattca

SEQ ID NO: 4284379 - DNA, 22 bp, Homo sapiens
ccatgtcctaggggccgaggga

SEQ ID NO: 4284380 - DNA, 15 bp, Homo sapiens
ccatgtgctgtgcac

SEQ ID NO: 4284381 - DNA, 12 bp, Homo sapiens
ccattaatttaa

SEQ ID NO: 4284382 - DNA, 15 bp, Homo sapiens
ccattaatttaaatg

SEQ ID NO: 4284383 - DNA, 17 bp, Homo sapiens
ccattccagagctgcag

SEQ ID NO: 4284384 - DNA, 13 bp, Homo sapiens
ccattctgggtgt

SEQ ID NO: 4284385 - DNA, 15 bp, Homo sapiens
ccattgccttctggg

SEQ ID NO: 4284386 - DNA, 20 bp, Homo sapiens
ccatttcattgagggaaaac

SEQ ID NO: 4284387 - DNA, 18 bp, Homo sapiens
ccatttgcagaccaggaa

SEQ ID NO: 4284388 - DNA, 12 bp, Homo sapiens
ccatttgtaatg

SEQ ID NO: 4284389 - DNA, 12 bp, Homo sapiens
ccattttctaaa

SEQ ID NO: 4284390 - DNA, 16 bp, Homo sapiens
ccattttctaaactgt

SEQ ID NO: 4284391 - DNA, 21 bp, Homo sapiens
ccattttgtctggctgtggcc

SEQ ID NO: 4284392 - DNA, 21 bp, Homo sapiens
cccaaaaccacagccctgtca

SEQ ID NO: 4284393 - DNA, 12 bp, Homo sapiens
cccaaaagtgtc

SEQ ID NO: 4284394 - DNA, 23 bp, Homo sapiens
cccaaatatgcccctccccagta

SEQ ID NO: 4284395 - DNA, 13 bp, Homo sapiens
cccaaccctgccc

SEQ ID NO: 4284396 - DNA, 16 bp, Homo sapiens
cccaacgaaaagcaca

SEQ ID NO: 4284397 - DNA, 19 bp, Homo sapiens
cccaacgaaaagcacatcc

SEQ ID NO: 4284398 - DNA, 19 bp, Homo sapiens
cccaattatcctccttcac

SEQ ID NO: 4284399 - DNA, 21 bp, Homo sapiens
cccaattttaaaaaataacat

SEQ ID NO: 4284400 - DNA, 15 bp, Homo sapiens
cccacaattcttttg

SEQ ID NO: 4284401 - DNA, 22 bp, Homo sapiens
cccacactacgcagaagagaaa

SEQ ID NO: 4284402 - DNA, 19 bp, Homo sapiens
cccacaggagcatgtccta

SEQ ID NO: 4284403 - DNA, 16 bp, Homo sapiens
cccacaggatgaacta

SEQ ID NO: 4284404 - DNA, 19 bp, Homo sapiens
cccacatccattccagagc

SEQ ID NO: 4284405 - DNA, 12 bp, Homo sapiens
cccacatccccc

SEQ ID NO: 4284406 - DNA, 19 bp, Homo sapiens
cccacattctggctccacc

SEQ ID NO: 4284407 - DNA, 15 bp, Homo sapiens
cccacattgcccaca

SEQ ID NO: 4284408 - DNA, 20 bp, Homo sapiens
cccacattgcccacacctgc

SEQ ID NO: 4284409 - DNA, 15 bp, Homo sapiens
cccaccaactctctc

SEQ ID NO: 4284410 - DNA, 20 bp, Homo sapiens
cccaccaactctctctgccc

SEQ ID NO: 4284411 - DNA, 23 bp, Homo sapiens
cccaccaactctctctgccccca

SEQ ID NO: 4284412 - DNA, 15 bp, Homo sapiens
cccaccacacacacc

SEQ ID NO: 4284413 - DNA, 19 bp, Homo sapiens
cccaccacacacacccttc

SEQ ID NO: 4284414 - DNA, 12 bp, Homo sapiens
cccaccagctgg

SEQ ID NO: 4284415 - DNA, 21 bp, Homo sapiens
cccaccagctggctctgcagc

SEQ ID NO: 4284416 - DNA, 14 bp, Homo sapiens
cccacccccctcat

SEQ ID NO: 4284417 - DNA, 18 bp, Homo sapiens
cccacccccgggtgcctg

SEQ ID NO: 4284418 - DNA, 18 bp, Homo sapiens
cccacccctcttccccct

SEQ ID NO: 4284419 - DNA, 17 bp, Homo sapiens
cccaccccttccccact

SEQ ID NO: 4284420 - DNA, 12 bp, Homo sapiens
cccaccctctgg

SEQ ID NO: 4284421 - DNA, 16 bp, Homo sapiens
cccacctgctgcccgt

SEQ ID NO: 4284422 - DNA, 13 bp, Homo sapiens
cccacgctcctgc

SEQ ID NO: 4284423 - DNA, 22 bp, Homo sapiens
cccacgctcctgccctcgtctc

SEQ ID NO: 4284424 - DNA, 12 bp, Homo sapiens
cccacggccact

SEQ ID NO: 4284425 - DNA, 13 bp, Homo sapiens
cccacggccactg

SEQ ID NO: 4284426 - DNA, 15 bp, Homo sapiens
cccacggccactgca

SEQ ID NO: 4284427 - DNA, 18 bp, Homo sapiens
cccacggccactgcagtc

SEQ ID NO: 4284428 - DNA, 22 bp, Homo sapiens
cccactcagcatttcggtgctt

SEQ ID NO: 4284429 - DNA, 13 bp, Homo sapiens
cccactctgctga

SEQ ID NO: 4284430 - DNA, 15 bp, Homo sapiens
cccactctgctgagg

SEQ ID NO: 4284431 - DNA, 15 bp, Homo sapiens
cccactgcctgccca

SEQ ID NO: 4284432 - DNA, 15 bp, Homo sapiens
cccacttatgctgct

SEQ ID NO: 4284433 - DNA, 16 bp, Homo sapiens
cccacttatgctgctg

SEQ ID NO: 4284434 - DNA, 19 bp, Homo sapiens
cccacttatgctgctgtga

SEQ ID NO: 4284435 - DNA, 22 bp, Homo sapiens
cccacttatgctgctgtgaatt

SEQ ID NO: 4284436 - DNA, 16 bp, Homo sapiens
cccagaaatgccgctg

SEQ ID NO: 4284437 - DNA, 17 bp, Homo sapiens
cccagaacgcatgcagg

SEQ ID NO: 4284438 - DNA, 14 bp, Homo sapiens
cccagacatgctgc

SEQ ID NO: 4284439 - DNA, 16 bp, Homo sapiens
cccagacatgctgccc

SEQ ID NO: 4284440 - DNA, 18 bp, Homo sapiens
cccagacatgctgcccac

SEQ ID NO: 4284441 - DNA, 14 bp, Homo sapiens
cccagaccccatcc

SEQ ID NO: 4284442 - DNA, 13 bp, Homo sapiens
cccagagccaggg

SEQ ID NO: 4284443 - DNA, 15 bp, Homo sapiens
cccagagccagggct

SEQ ID NO: 4284444 - DNA, 16 bp, Homo sapiens
cccagagccagggctg

SEQ ID NO: 4284445 - DNA, 19 bp, Homo sapiens
cccagagccagggctgtcc

SEQ ID NO: 4284446 - DNA, 22 bp, Homo sapiens
cccagagccagggctgtcctta

SEQ ID NO: 4284447 - DNA, 13 bp, Homo sapiens
cccagcaaccctc

SEQ ID NO: 4284448 - DNA, 15 bp, Homo sapiens
cccagcacccatgcc

SEQ ID NO: 4284449 - DNA, 16 bp, Homo sapiens
cccagcaggtggggag

SEQ ID NO: 4284450 - DNA, 15 bp, Homo sapiens
cccagcagtcctggg

SEQ ID NO: 4284451 - DNA, 17 bp, Homo sapiens
cccagcagtcctgggcc

SEQ ID NO: 4284452 - DNA, 21 bp, Homo sapiens
cccagccccagcgagtctgga

SEQ ID NO: 4284453 - DNA, 16 bp, Homo sapiens
cccagccctgtggaag

SEQ ID NO: 4284454 - DNA, 14 bp, Homo sapiens
cccagcctggcccc

SEQ ID NO: 4284455 - DNA, 21 bp, Homo sapiens
cccagcctggccccaaatgtt

SEQ ID NO: 4284456 - DNA, 13 bp, Homo sapiens
cccagcctgtggc

SEQ ID NO: 4284457 - DNA, 23 bp, Homo sapiens
cccagctctagacaaccctgcaa

SEQ ID NO: 4284458 - DNA, 17 bp, Homo sapiens
cccagctgctcctcgca

SEQ ID NO: 4284459 - DNA, 19 bp, Homo sapiens
cccaggaagtcatcctgca

SEQ ID NO: 4284460 - DNA, 18 bp, Homo sapiens
cccaggacactgcctttg

SEQ ID NO: 4284461 - DNA, 13 bp, Homo sapiens
cccaggacgcagg

SEQ ID NO: 4284462 - DNA, 17 bp, Homo sapiens
cccaggacgcagggaga

SEQ ID NO: 4284463 - DNA, 20 bp, Homo sapiens
cccaggagagaccttctctt

SEQ ID NO: 4284464 - DNA, 16 bp, Homo sapiens
cccaggagagccccca

SEQ ID NO: 4284465 - DNA, 20 bp, Homo sapiens
cccaggagagcccccaccag

SEQ ID NO: 4284466 - DNA, 17 bp, Homo sapiens
cccaggatgcatgcagg

SEQ ID NO: 4284467 - DNA, 20 bp, Homo sapiens
cccaggatgcatgcagggcc

SEQ ID NO: 4284468 - DNA, 22 bp, Homo sapiens
cccaggcagggagggaaacccg

SEQ ID NO: 4284469 - DNA, 14 bp, Homo sapiens
cccaggctggatgc

SEQ ID NO: 4284470 - DNA, 17 bp, Homo sapiens
cccaggctggatgctgg

SEQ ID NO: 4284471 - DNA, 22 bp, Homo sapiens
cccagggaatcagggagcactg

SEQ ID NO: 4284472 - DNA, 21 bp, Homo sapiens
cccctgccagaggcctggtgc

SEQ ID NO: 4284473 - DNA, 17 bp, Homo sapiens
cccctgccccagagaag

SEQ ID NO: 4284474 - DNA, 17 bp, Homo sapiens
cccctgcgcaggccctc

SEQ ID NO: 4284475 - DNA, 18 bp, Homo sapiens
cccctgctgcctccccaa

SEQ ID NO: 4284476 - DNA, 20 bp, Homo sapiens
cccctgctgcctccccaacc

SEQ ID NO: 4284477 - DNA, 23 bp, Homo sapiens
cccctgctgctcctcggccagag

SEQ ID NO: 4284478 - DNA, 21 bp, Homo sapiens
cccctggggtacttctgtgtt

SEQ ID NO: 4284479 - DNA, 19 bp, Homo sapiens
cccctggtgtccctgcctg

SEQ ID NO: 4284480 - DNA, 15 bp, Homo sapiens
cccctgttcactcta

SEQ ID NO: 4284481 - DNA, 22 bp, Homo sapiens
ccccttcacttctgaccacact

SEQ ID NO: 4284482 - DNA, 23 bp, Homo sapiens
ccccttcacttctgaccacactt

SEQ ID NO: 4284483 - DNA, 23 bp, Homo sapiens
ccccttccccactgcctgcccac

SEQ ID NO: 4284484 - DNA, 14 bp, Homo sapiens
ccccttgctgctgg

SEQ ID NO: 4284485 - DNA, 19 bp, Homo sapiens
ccccttgctgctggctccc

SEQ ID NO: 4284486 - DNA, 20 bp, Homo sapiens
ccccttgggatgggcacagg

SEQ ID NO: 4284487 - DNA, 15 bp, Homo sapiens
cccgacagcctggca

SEQ ID NO: 4284488 - DNA, 12 bp, Homo sapiens
cccgactctctc

SEQ ID NO: 4284489 - DNA, 15 bp, Homo sapiens
cccgagccccctgtc

SEQ ID NO: 4284490 - DNA, 11 bp, Homo sapiens
cccgagctggg

SEQ ID NO: 4284491 - DNA, 20 bp, Homo sapiens
cccgagctgggggccatgag

SEQ ID NO: 4284492 - DNA, 23 bp, Homo sapiens
cccgagctgggggccatgagctc

SEQ ID NO: 4284493 - DNA, 19 bp, Homo sapiens
cccgaggcagcaacaggac

SEQ ID NO: 4284494 - DNA, 13 bp, Homo sapiens
cccgcacccccac

SEQ ID NO: 4284495 - DNA, 17 bp, Homo sapiens
cccgcacccccaccctt

SEQ ID NO: 4284496 - DNA, 19 bp, Homo sapiens
cccgcacgcaagcctcagc

SEQ ID NO: 4284497 - DNA, 15 bp, Homo sapiens
cccgcatgctgcctg

SEQ ID NO: 4284498 - DNA, 13 bp, Homo sapiens
cccgcccacctgg

SEQ ID NO: 4284499 - DNA, 19 bp, Homo sapiens
cccgccccccagagccagg

SEQ ID NO: 4284500 - DNA, 20 bp, Homo sapiens
cccgccccccagagccaggg

SEQ ID NO: 4284501 - DNA, 13 bp, Homo sapiens
cccgccctctgcc

SEQ ID NO: 4284502 - DNA, 18 bp, Homo sapiens
cccgcgtccaaccccggg

SEQ ID NO: 4284503 - DNA, 14 bp, Homo sapiens
cccgctcagccctc

SEQ ID NO: 4284504 - DNA, 15 bp, Homo sapiens
cccgctctgccatca

SEQ ID NO: 4284505 - DNA, 17 bp, Homo sapiens
cccgctgcgctgccctg

SEQ ID NO: 4284506 - DNA, 18 bp, Homo sapiens
cccgctgcgctgccctgc

SEQ ID NO: 4284507 - DNA, 19 bp, Homo sapiens
cccgctgcgctgccctgca

SEQ ID NO: 4284508 - DNA, 17 bp, Homo sapiens
cccggacaagcccagga

SEQ ID NO: 4284509 - DNA, 12 bp, Homo sapiens
cccggagctggg

SEQ ID NO: 4284510 - DNA, 16 bp, Homo sapiens
cccggatctccaggcc

SEQ ID NO: 4284511 - DNA, 17 bp, Homo sapiens
cccggatctccaggccc

SEQ ID NO: 4284512 - DNA, 15 bp, Homo sapiens
cccggcagcccccca

SEQ ID NO: 4284513 - DNA, 15 bp, Homo sapiens
cccggccactctgtt

SEQ ID NO: 4284514 - DNA, 17 bp, Homo sapiens
tttttgttgtgttctgt

SEQ ID NO: 4284515 - DNA, 13 bp, Homo sapiens
tttcagctgacca

SEQ ID NO: 4284516 - DNA, 19 bp, Homo sapiens
tttcatctttccaaattga

SEQ ID NO: 4284517 - DNA, 23 bp, Homo sapiens
tttcatgatttgcaactttagaa

SEQ ID NO: 4284518 - DNA, 21 bp, Homo sapiens
tttcatgtgttgcaaattatt

SEQ ID NO: 4284519 - DNA, 16 bp, Homo sapiens
tttcattattttccca

SEQ ID NO: 4284520 - DNA, 17 bp, Homo sapiens
tttccaacattatcctg

SEQ ID NO: 4284521 - DNA, 17 bp, Homo sapiens
tttccaagcctgggcca

SEQ ID NO: 4284522 - DNA, 20 bp, Homo sapiens
tttccaagtttattgccctc

SEQ ID NO: 4284523 - DNA, 15 bp, Homo sapiens
tttccaccccctccc

SEQ ID NO: 4284524 - DNA, 21 bp, Homo sapiens
tttccagaattgagagatgtt

SEQ ID NO: 4284525 - DNA, 18 bp, Homo sapiens
tttccatatagtttgttt

SEQ ID NO: 4284526 - DNA, 16 bp, Homo sapiens
tttccattctgggtgt

SEQ ID NO: 4284527 - DNA, 17 bp, Homo sapiens
tttcccacaattctttt

SEQ ID NO: 4284528 - DNA, 14 bp, Homo sapiens
tttccctgcatccc

SEQ ID NO: 4284529 - DNA, 23 bp, Homo sapiens
tttcctctgaggatgatgtactt

SEQ ID NO: 4284530 - DNA, 17 bp, Homo sapiens
tttcctcttagaagaat

SEQ ID NO: 4284531 - DNA, 14 bp, Homo sapiens
tttcgtgcatttgt

SEQ ID NO: 4284532 - DNA, 20 bp, Homo sapiens
tttctaaaaagtcagatgtt

SEQ ID NO: 4284533 - DNA, 18 bp, Homo sapiens
tttctaaaacattaattg

SEQ ID NO: 4284534 - DNA, 21 bp, Homo sapiens
tttctaaactgttttcatgtg

SEQ ID NO: 4284535 - DNA, 17 bp, Homo sapiens
tttctaaatgtttcttt

SEQ ID NO: 4284536 - DNA, 18 bp, Homo sapiens
tttctagctataacaact

SEQ ID NO: 4284537 - DNA, 12 bp, Homo sapiens
tttctctgtaaa

SEQ ID NO: 4284538 - DNA, 13 bp, Homo sapiens
tttctctgtaaaa

SEQ ID NO: 4284539 - DNA, 16 bp, Homo sapiens
tttctctgtaaaatga

SEQ ID NO: 4284540 - DNA, 11 bp, Homo sapiens
tttctctgtgg

SEQ ID NO: 4284541 - DNA, 12 bp, Homo sapiens
tttctcttgggc

SEQ ID NO: 4284542 - DNA, 21 bp, Homo sapiens
tttctgagtagcatatataat

SEQ ID NO: 4284543 - DNA, 16 bp, Homo sapiens
tttctgcatctccact

SEQ ID NO: 4284544 - DNA, 18 bp, Homo sapiens
tttctgtcctgtaactgt

SEQ ID NO: 4284545 - DNA, 17 bp, Homo sapiens
tttcttattaaccaaat

SEQ ID NO: 4284546 - DNA, 16 bp, Homo sapiens
tttcttccagtgatgt

SEQ ID NO: 4284547 - DNA, 22 bp, Homo sapiens
tttcttgtgttgttttctctga

SEQ ID NO: 4284548 - DNA, 17 bp, Homo sapiens
tttgaagaagggaaatt

SEQ ID NO: 4284549 - DNA, 19 bp, Homo sapiens
tttgaatatattttatctt

SEQ ID NO: 4284550 - DNA, 19 bp, Homo sapiens
tttgaatcctctctctgtg

SEQ ID NO: 4284551 - DNA, 15 bp, Homo sapiens
tttgcaatcttatgt

SEQ ID NO: 4284552 - DNA, 19 bp, Homo sapiens
tttgcagacctgggacttt

SEQ ID NO: 4284553 - DNA, 15 bp, Homo sapiens
tttgcatgtctgcat

SEQ ID NO: 4284554 - DNA, 13 bp, Homo sapiens
tttgcatttaaga

SEQ ID NO: 4284555 - DNA, 21 bp, Homo sapiens
tttgcatttaagaattgccag

SEQ ID NO: 4284556 - DNA, 22 bp, Homo sapiens
tttgcctcatgaacactggctg

SEQ ID NO: 4284557 - DNA, 17 bp, Homo sapiens
tttgcctttaggcagga

SEQ ID NO: 4284558 - DNA, 19 bp, Homo sapiens
tttgcctttaggcaggaag

SEQ ID NO: 4284559 - DNA, 17 bp, Homo sapiens
tttgcgatgtgttttat

SEQ ID NO: 4284560 - DNA, 19 bp, Homo sapiens
tttgctaattaaaaagtta

SEQ ID NO: 4284561 - DNA, 21 bp, Homo sapiens
tttgctgatttcccctcttcc

SEQ ID NO: 4284562 - DNA, 20 bp, Homo sapiens
tttgctggagtcctgttctc

SEQ ID NO: 4284563 - DNA, 18 bp, Homo sapiens
tttgctgtatacaaacag

SEQ ID NO: 4284564 - DNA, 13 bp, Homo sapiens
tttgcttatttat

SEQ ID NO: 4284565 - DNA, 18 bp, Homo sapiens
tttggaaagacctgtgag

SEQ ID NO: 4284566 - DNA, 21 bp, Homo sapiens
tttggcccccgagctgggggc

SEQ ID NO: 4284567 - DNA, 17 bp, Homo sapiens
tttggcgggccaaggac

SEQ ID NO: 4284568 - DNA, 17 bp, Homo sapiens
tttggcttcagaattgt

SEQ ID NO: 4284569 - DNA, 18 bp, Homo sapiens
tttggggcgaggcagagg

SEQ ID NO: 4284570 - DNA, 19 bp, Homo sapiens
tttggggcgaggcagagga

SEQ ID NO: 4284571 - DNA, 22 bp, Homo sapiens
tttgggggattcaaatgcatga

SEQ ID NO: 4284572 - DNA, 13 bp, Homo sapiens
tttgtaaaatgta

SEQ ID NO: 4284573 - DNA, 15 bp, Homo sapiens
tttgtaaccatatga

SEQ ID NO: 4284574 - DNA, 22 bp, Homo sapiens
tttgtatcctccattgtatctt

SEQ ID NO: 4284575 - DNA, 20 bp, Homo sapiens
tttgtatctttaaagacttg

SEQ ID NO: 4284576 - DNA, 13 bp, Homo sapiens
tttgtatttatat

SEQ ID NO: 4284577 - DNA, 23 bp, Homo sapiens
tttgtcagtgtagatcaactcat

SEQ ID NO: 4284578 - DNA, 12 bp, Homo sapiens
tttgtcctcaaa

SEQ ID NO: 4284579 - DNA, 15 bp, Homo sapiens
tttgtctgaaggatt

SEQ ID NO: 4284580 - DNA, 18 bp, Homo sapiens
tttgtgagccaaagagaa

SEQ ID NO: 4284581 - DNA, 18 bp, Homo sapiens
tttgtgcttgttcttcct

SEQ ID NO: 4284582 - DNA, 12 bp, Homo sapiens
tttgtgtattct

SEQ ID NO: 4284583 - DNA, 13 bp, Homo sapiens
tttgtgtgattga

SEQ ID NO: 4284584 - DNA, 14 bp, Homo sapiens
tttgtgtgattgaa

SEQ ID NO: 4284585 - DNA, 12 bp, Homo sapiens
tttgtgtgctgt

SEQ ID NO: 4284586 - DNA, 14 bp, Homo sapiens
tttgtgtgctgtgg

SEQ ID NO: 4284587 - DNA, 13 bp, Homo sapiens
tttgttaatatat

SEQ ID NO: 4284588 - DNA, 23 bp, Homo sapiens
tttgttgagctggtaacatcgtt

SEQ ID NO: 4284589 - DNA, 15 bp, Homo sapiens
tttgttttctttttc

SEQ ID NO: 4284590 - DNA, 21 bp, Homo sapiens
ttttaaaaaataacatattct

SEQ ID NO: 4284591 - DNA, 23 bp, Homo sapiens
ttttaaaaaataacatattcttg

SEQ ID NO: 4284592 - DNA, 17 bp, Homo sapiens
ttttaaaaagttgcaca

SEQ ID NO: 4284593 - DNA, 15 bp, Homo sapiens
ttttaacttcacctt

SEQ ID NO: 4284594 - DNA, 22 bp, Homo sapiens
ttttaatgatactgtctaagaa

SEQ ID NO: 4284595 - DNA, 18 bp, Homo sapiens
ttttacaataaaattttg

SEQ ID NO: 4284596 - DNA, 22 bp, Homo sapiens
ttttaccattttgcgatgtgtt

SEQ ID NO: 4284597 - DNA, 13 bp, Homo sapiens
ttttactgtctgt

SEQ ID NO: 4284598 - DNA, 18 bp, Homo sapiens
ttttagagattaatttgt

SEQ ID NO: 4284599 - DNA, 21 bp, Homo sapiens
ttttagagattaatttgtgta

SEQ ID NO: 4284600 - DNA, 11 bp, Homo sapiens
ttttagcatgt

SEQ ID NO: 4284601 - DNA, 16 bp, Homo sapiens
ttttagccttctctgt

SEQ ID NO: 4284602 - DNA, 21 bp, Homo sapiens
ttttaggtcatccaacctctt

SEQ ID NO: 4284603 - DNA, 13 bp, Homo sapiens
ttttatctcttct

SEQ ID NO: 4284604 - DNA, 17 bp, Homo sapiens
ttttatgtcatactctg

SEQ ID NO: 4284605 - DNA, 21 bp, Homo sapiens
ttttatgtcatactctgtgta

SEQ ID NO: 4284606 - DNA, 22 bp, Homo sapiens
ttttatgtcatactctgtgtaa

SEQ ID NO: 4284607 - DNA, 15 bp, Homo sapiens
ttttattttcaagca

SEQ ID NO: 4284608 - DNA, 18 bp, Homo sapiens
ttttcaaaatacttcttt

SEQ ID NO: 4284609 - DNA, 17 bp, Homo sapiens
ttttcaacgcagccctg

SEQ ID NO: 4284610 - DNA, 16 bp, Homo sapiens
ttttcagaaagatgaa

SEQ ID NO: 4284611 - DNA, 20 bp, Homo sapiens
ttttcagcttgtttctatac

SEQ ID NO: 4284612 - DNA, 21 bp, Homo sapiens
ttttcagcttgtttctatact

SEQ ID NO: 4284613 - DNA, 16 bp, Homo sapiens
ttttcataggaagaca

SEQ ID NO: 4284614 - DNA, 13 bp, Homo sapiens
ttttcatatcatt

SEQ ID NO: 4284615 - DNA, 20 bp, Homo sapiens
ttttccagggcaatcaatgt

SEQ ID NO: 4284616 - DNA, 14 bp, Homo sapiens
ttttccatctaaaa

SEQ ID NO: 4284617 - DNA, 14 bp, Homo sapiens
ttttccctctggca

SEQ ID NO: 4284618 - DNA, 17 bp, Homo sapiens
ttttcgtgcatttgtga

SEQ ID NO: 4284619 - DNA, 12 bp, Homo sapiens
ttttctaaactg

SEQ ID NO: 4284620 - DNA, 13 bp, Homo sapiens
ttttctaaatgtt

SEQ ID NO: 4284621 - DNA, 19 bp, Homo sapiens
ttttctctgatcacaactt

SEQ ID NO: 4284622 - DNA, 22 bp, Homo sapiens
ttttctcttgggctgagactgg

SEQ ID NO: 4284623 - DNA, 12 bp, Homo sapiens
ttttctgtcttg

SEQ ID NO: 4284624 - DNA, 15 bp, Homo sapiens
ttttcttttaatttt

SEQ ID NO: 4284625 - DNA, 15 bp, Homo sapiens
ttttgaaactgcatt

SEQ ID NO: 4284626 - DNA, 11 bp, Homo sapiens
ttttgagccaa

SEQ ID NO: 4284627 - DNA, 14 bp, Homo sapiens
ttttgcaagggaat

SEQ ID NO: 4284628 - DNA, 15 bp, Homo sapiens
ttttgcatgtctgca

SEQ ID NO: 4284629 - DNA, 14 bp, Homo sapiens
ttttgcgatgtgtt

SEQ ID NO: 4284630 - DNA, 22 bp, Homo sapiens
ttttggaaaacgatttaattta

SEQ ID NO: 4284631 - DNA, 13 bp, Homo sapiens
ttttgtaaccata

SEQ ID NO: 4284632 - DNA, 23 bp, Homo sapiens
ttttgtatgaaatatatgtgaaa

SEQ ID NO: 4284633 - DNA, 16 bp, Homo sapiens
ttttgtattgtttaaa

SEQ ID NO: 4284634 - DNA, 15 bp, Homo sapiens
ttttgtctcgaaata

SEQ ID NO: 4284635 - DNA, 19 bp, Homo sapiens
ttttgttaagttcaccgta

SEQ ID NO: 4284636 - DNA, 14 bp, Homo sapiens
ttttgttgattaaa

SEQ ID NO: 4284637 - DNA, 19 bp, Homo sapiens
ttttgttgattaaaacatt

SEQ ID NO: 4284638 - DNA, 19 bp, Homo sapiens
tttttaaatgattccaaat

SEQ ID NO: 4284639 - DNA, 21 bp, Homo sapiens
tttttacaaattatgttttaa

SEQ ID NO: 4284640 - DNA, 20 bp, Homo sapiens
tttttacaagttatagtact

SEQ ID NO: 4284641 - DNA, 17 bp, Homo sapiens
tttttagatgtagcact

SEQ ID NO: 4284642 - DNA, 21 bp, Homo sapiens
tttttcaaaacgccatgtcct

SEQ ID NO: 4284643 - DNA, 14 bp, Homo sapiens
tttttccagaattg

SEQ ID NO: 4284644 - DNA, 15 bp, Homo sapiens
tttttccagaattga

SEQ ID NO: 4284645 - DNA, 11 bp, Homo sapiens
tttttcctgtc

SEQ ID NO: 4284646 - DNA, 14 bp, Homo sapiens
tttttctagctata

SEQ ID NO: 4284647 - DNA, 22 bp, Homo sapiens
tttttgagtgtgcaatatgtaa

SEQ ID NO: 4284648 - DNA, 22 bp, Homo sapiens
tttttggaagaggactccttaa

SEQ ID NO: 4284649 - DNA, 17 bp, Homo sapiens
ttgctgtttatatatat

SEQ ID NO: 4284650 - DNA, 22 bp, Homo sapiens
ttgcttagtcacttatttcata

SEQ ID NO: 4284651 - DNA, 14 bp, Homo sapiens
ttgcttatttatat

SEQ ID NO: 4284652 - DNA, 13 bp, Homo sapiens
ttgcttgtcctgc

SEQ ID NO: 4284653 - DNA, 20 bp, Homo sapiens
ttggaaaacgatttaattta

SEQ ID NO: 4284654 - DNA, 20 bp, Homo sapiens
ttggaacagtaatcagtttg

SEQ ID NO: 4284655 - DNA, 21 bp, Homo sapiens
ttggacctgcagttggcctca

SEQ ID NO: 4284656 - DNA, 12 bp, Homo sapiens
ttggagaggagg

SEQ ID NO: 4284657 - DNA, 15 bp, Homo sapiens
ttggagaggaggtgt

SEQ ID NO: 4284658 - DNA, 19 bp, Homo sapiens
ttggagaggaggtgtggag

SEQ ID NO: 4284659 - DNA, 17 bp, Homo sapiens
ttggaggggcaggcctt

SEQ ID NO: 4284660 - DNA, 12 bp, Homo sapiens
ttggatcttttt

SEQ ID NO: 4284661 - DNA, 20 bp, Homo sapiens
ttggatttagagactgtaaa

SEQ ID NO: 4284662 - DNA, 17 bp, Homo sapiens
ttggcagcttcaaaaca

SEQ ID NO: 4284663 - DNA, 22 bp, Homo sapiens
ttggcaggagtgggctctgagc

SEQ ID NO: 4284664 - DNA, 18 bp, Homo sapiens
ttggcaggtgtgggctcc

SEQ ID NO: 4284665 - DNA, 20 bp, Homo sapiens
ttggcaggtgtgggctccca

SEQ ID NO: 4284666 - DNA, 17 bp, Homo sapiens
ttggccagagggcccct

SEQ ID NO: 4284667 - DNA, 20 bp, Homo sapiens
ttggccagagggcccctcac

SEQ ID NO: 4284668 - DNA, 15 bp, Homo sapiens
ttggctcgggacttc

SEQ ID NO: 4284669 - DNA, 21 bp, Homo sapiens
ttggctcgggacttcaaaatc

SEQ ID NO: 4284670 - DNA, 16 bp, Homo sapiens
ttggctgggcccagaa

SEQ ID NO: 4284671 - DNA, 16 bp, Homo sapiens
ttgggaccgccagatg

SEQ ID NO: 4284672 - DNA, 22 bp, Homo sapiens
ttgggaccgccagatggggcct

SEQ ID NO: 4284673 - DNA, 20 bp, Homo sapiens
ttgggacggaagtggcctga

SEQ ID NO: 4284674 - DNA, 22 bp, Homo sapiens
ttgggaggagggggcccggctg

SEQ ID NO: 4284675 - DNA, 12 bp, Homo sapiens
ttgggctctgcg

SEQ ID NO: 4284676 - DNA, 17 bp, Homo sapiens
ttggggcgaggcagagg

SEQ ID NO: 4284677 - DNA, 19 bp, Homo sapiens
ttggggtggggcgggaggc

SEQ ID NO: 4284678 - DNA, 21 bp, Homo sapiens
ttggggtggggcgggaggcca

SEQ ID NO: 4284679 - DNA, 13 bp, Homo sapiens
ttgggttccagac

SEQ ID NO: 4284680 - DNA, 17 bp, Homo sapiens
ttggtgataagtggaaa

SEQ ID NO: 4284681 - DNA, 18 bp, Homo sapiens
ttggtggccgggggtggg

SEQ ID NO: 4284682 - DNA, 21 bp, Homo sapiens
ttggtgtgaatgctgtacctt

SEQ ID NO: 4284683 - DNA, 23 bp, Homo sapiens
ttggtgtgttcgtggagccacag

SEQ ID NO: 4284684 - DNA, 17 bp, Homo sapiens
ttggttcatgcctgggg

SEQ ID NO: 4284685 - DNA, 18 bp, Homo sapiens
ttggttcatgcctggggt

SEQ ID NO: 4284686 - DNA, 18 bp, Homo sapiens
ttgtaaaatgtattatgt

SEQ ID NO: 4284687 - DNA, 21 bp, Homo sapiens
ttgtaatatagaaaaaaacat

SEQ ID NO: 4284688 - DNA, 14 bp, Homo sapiens
ttgtaatgtatctt

SEQ ID NO: 4284689 - DNA, 16 bp, Homo sapiens
ttgtagcatttcttga

SEQ ID NO: 4284690 - DNA, 14 bp, Homo sapiens
ttgtagctagaata

SEQ ID NO: 4284691 - DNA, 18 bp, Homo sapiens
ttgtaggactaaataatg

SEQ ID NO: 4284692 - DNA, 16 bp, Homo sapiens
ttgtataaaacagtgt

SEQ ID NO: 4284693 - DNA, 13 bp, Homo sapiens
ttgtatgtacctg

SEQ ID NO: 4284694 - DNA, 20 bp, Homo sapiens
ttgtattgttagatgtttgt

SEQ ID NO: 4284695 - DNA, 13 bp, Homo sapiens
ttgtcatttataa

SEQ ID NO: 4284696 - DNA, 21 bp, Homo sapiens
ttgtccaaagttacctggaat

SEQ ID NO: 4284697 - DNA, 17 bp, Homo sapiens
ttgtccacaaatgtcct

SEQ ID NO: 4284698 - DNA, 22 bp, Homo sapiens
ttgtccacaaatgtcctcagag

SEQ ID NO: 4284699 - DNA, 20 bp, Homo sapiens
ttgtccacacaagacagcag

SEQ ID NO: 4284700 - DNA, 17 bp, Homo sapiens
ttgtccccaatgaatat

SEQ ID NO: 4284701 - DNA, 15 bp, Homo sapiens
ttgtctgaaggattt

SEQ ID NO: 4284702 - DNA, 20 bp, Homo sapiens
ttgtctgaagtcactgcaca

SEQ ID NO: 4284703 - DNA, 21 bp, Homo sapiens
ttgtctggctgtggcccctcc

SEQ ID NO: 4284704 - DNA, 17 bp, Homo sapiens
ttgtgaaacacagctgt

SEQ ID NO: 4284705 - DNA, 11 bp, Homo sapiens
ttgtgaagagg

SEQ ID NO: 4284706 - DNA, 15 bp, Homo sapiens
ttgtggagaggagag

SEQ ID NO: 4284707 - DNA, 14 bp, Homo sapiens
ttgtgtagattgtg

SEQ ID NO: 4284708 - DNA, 20 bp, Homo sapiens
ttgtgtagattgtgtaaatt

SEQ ID NO: 4284709 - DNA, 13 bp, Homo sapiens
ttgtgtgattgaa

SEQ ID NO: 4284710 - DNA, 17 bp, Homo sapiens
ttgtgtgggtttactct

SEQ ID NO: 4284711 - DNA, 20 bp, Homo sapiens
ttgtgtgggtttactctgtg

SEQ ID NO: 4284712 - DNA, 23 bp, Homo sapiens
ttgtgttgttttctctgatcaca

SEQ ID NO: 4284713 - DNA, 12 bp, Homo sapiens
ttgtgtttgtat

SEQ ID NO: 4284714 - DNA, 14 bp, Homo sapiens
ttgtgtttgtatat

SEQ ID NO: 4284715 - DNA, 16 bp, Homo sapiens
ttgtgtttgtatataa

SEQ ID NO: 4284716 - DNA, 18 bp, Homo sapiens
ttgttaatatcactcatt

SEQ ID NO: 4284717 - DNA, 20 bp, Homo sapiens
ttgttaatatcactcattaa

SEQ ID NO: 4284718 - DNA, 13 bp, Homo sapiens
ttgttaggggtgg

SEQ ID NO: 4284719 - DNA, 16 bp, Homo sapiens
ttgttagtgatttgct

SEQ ID NO: 4284720 - DNA, 23 bp, Homo sapiens
ttgttattgggcaagtgattgaa

SEQ ID NO: 4284721 - DNA, 21 bp, Homo sapiens
ttgttcaaagaacccccctcc

SEQ ID NO: 4284722 - DNA, 18 bp, Homo sapiens
ttgttcagtcacttgttt

SEQ ID NO: 4284723 - DNA, 12 bp, Homo sapiens
ttgtttaattgt

SEQ ID NO: 4284724 - DNA, 16 bp, Homo sapiens
ttgtttctatactgtt

SEQ ID NO: 4284725 - DNA, 18 bp, Homo sapiens
ttgttttttttttccact

SEQ ID NO: 4284726 - DNA, 19 bp, Homo sapiens
ttgttttttttttccactt

SEQ ID NO: 4284727 - DNA, 21 bp, Homo sapiens
tttaaaaaaataacatctctt

SEQ ID NO: 4284728 - DNA, 14 bp, Homo sapiens
tttaaaaaatgaat

SEQ ID NO: 4284729 - DNA, 17 bp, Homo sapiens
tttaaaaagttgcacat

SEQ ID NO: 4284730 - DNA, 20 bp, Homo sapiens
tttaaaactagttagattca

SEQ ID NO: 4284731 - DNA, 18 bp, Homo sapiens
tttaaaatctcctaaatg

SEQ ID NO: 4284732 - DNA, 13 bp, Homo sapiens
tttaaacaaatgg

SEQ ID NO: 4284733 - DNA, 12 bp, Homo sapiens
tttaaatgattc

SEQ ID NO: 4284734 - DNA, 16 bp, Homo sapiens
tttaaatgattccaaa

SEQ ID NO: 4284735 - DNA, 20 bp, Homo sapiens
tttaaatgctgtatgtcatt

SEQ ID NO: 4284736 - DNA, 16 bp, Homo sapiens
tttaactagcacttta

SEQ ID NO: 4284737 - DNA, 18 bp, Homo sapiens
tttaactagcactttata

SEQ ID NO: 4284738 - DNA, 23 bp, Homo sapiens
tttaactttaccatgctcaatga

SEQ ID NO: 4284739 - DNA, 14 bp, Homo sapiens
tttaagctcaaaat

SEQ ID NO: 4284740 - DNA, 15 bp, Homo sapiens
tttaatatactgcat

SEQ ID NO: 4284741 - DNA, 13 bp, Homo sapiens
tttacaatgtatt

SEQ ID NO: 4284742 - DNA, 17 bp, Homo sapiens
tttacagtgaagaaagc

SEQ ID NO: 4284743 - DNA, 13 bp, Homo sapiens
tttaccctccctg

SEQ ID NO: 4284744 - DNA, 18 bp, Homo sapiens
tttacctcactggtgcat

SEQ ID NO: 4284745 - DNA, 16 bp, Homo sapiens
tttaccttcagcagtt

SEQ ID NO: 4284746 - DNA, 16 bp, Homo sapiens
tttactaacactggct

SEQ ID NO: 4284747 - DNA, 13 bp, Homo sapiens
tttactccccttg

SEQ ID NO: 4284748 - DNA, 18 bp, Homo sapiens
tttactccccttgagctg

SEQ ID NO: 4284749 - DNA, 14 bp, Homo sapiens
tttactgtctgtaa

SEQ ID NO: 4284750 - DNA, 21 bp, Homo sapiens
tttagagtatgcaagaagaat

SEQ ID NO: 4284751 - DNA, 16 bp, Homo sapiens
tttagccttctctgtt

SEQ ID NO: 4284752 - DNA, 10 bp, Homo sapiens
tttaggcagg

SEQ ID NO: 4284753 - DNA, 22 bp, Homo sapiens
tttaggcaggaagtcaggagcc

SEQ ID NO: 4284754 - DNA, 16 bp, Homo sapiens
tttagtcctcaccttc

SEQ ID NO: 4284755 - DNA, 12 bp, Homo sapiens
tttagttcctgt

SEQ ID NO: 4284756 - DNA, 13 bp, Homo sapiens
tttagttcctgtg

SEQ ID NO: 4284757 - DNA, 19 bp, Homo sapiens
tttatatatgaagtaagtt

SEQ ID NO: 4284758 - DNA, 16 bp, Homo sapiens
tttatatctgtaaatt

SEQ ID NO: 4284759 - DNA, 23 bp, Homo sapiens
tttatattcagagatgtaccatg

SEQ ID NO: 4284760 - DNA, 20 bp, Homo sapiens
tttatggcagacattgtgct

SEQ ID NO: 4284761 - DNA, 21 bp, Homo sapiens
tttatggcagacattgtgcta

SEQ ID NO: 4284762 - DNA, 16 bp, Homo sapiens
tttattcattagctgt

SEQ ID NO: 4284763 - DNA, 14 bp, Homo sapiens
tttattgtctgtaa

SEQ ID NO: 4284764 - DNA, 16 bp, Homo sapiens
tttattttcctcccca

SEQ ID NO: 4284765 - DNA, 15 bp, Homo sapiens
tttatttttctgtta

SEQ ID NO: 4284766 - DNA, 12 bp, Homo sapiens
tttcaaaatgca

SEQ ID NO: 4284767 - DNA, 13 bp, Homo sapiens
tttcaaaatgcat

SEQ ID NO: 4284768 - DNA, 14 bp, Homo sapiens
tttcaaaatgcatg

SEQ ID NO: 4284769 - DNA, 11 bp, Homo sapiens
tttcaaatgag

SEQ ID NO: 4284770 - DNA, 22 bp, Homo sapiens
tttcaagatctaaatcatatat

SEQ ID NO: 4284771 - DNA, 20 bp, Homo sapiens
tttcaatagcgtgtgtagat

SEQ ID NO: 4284772 - DNA, 20 bp, Homo sapiens
tttcaatgtaattaaactgt

SEQ ID NO: 4284773 - DNA, 17 bp, Homo sapiens
tttcacagctatgaaga

SEQ ID NO: 4284774 - DNA, 15 bp, Homo sapiens
tttcacccctcttcc

SEQ ID NO: 4284775 - DNA, 16 bp, Homo sapiens
tttcacccctcttccc

SEQ ID NO: 4284776 - DNA, 16 bp, Homo sapiens
tttcacgattcatttt

SEQ ID NO: 4284777 - DNA, 21 bp, Homo sapiens
tttcactgaagtgaatacatg

SEQ ID NO: 4284778 - DNA, 18 bp, Homo sapiens
tttcactgctggctgcct

SEQ ID NO: 4284779 - DNA, 20 bp, Homo sapiens
tttcactgctggctgcctta

SEQ ID NO: 4284780 - DNA, 24 bp, Homo sapiens
tttcactgctggctgccttagaac

SEQ ID NO: 4284781 - DNA, 20 bp, Homo sapiens
tttcagacctttgtctgaag

SEQ ID NO: 4284782 - DNA, 20 bp, Homo sapiens
tttcagccattcacaacaca

SEQ ID NO: 4284783 - DNA, 22 bp, Homo sapiens
ttcgctattcccaggcagggag

SEQ ID NO: 4284784 - DNA, 15 bp, Homo sapiens
ttcggagttgggggt

SEQ ID NO: 4284785 - DNA, 11 bp, Homo sapiens
ttcgggaagaa

SEQ ID NO: 4284786 - DNA, 14 bp, Homo sapiens
ttcggtttctaact

SEQ ID NO: 4284787 - DNA, 14 bp, Homo sapiens
ttctaaaaagtcag

SEQ ID NO: 4284788 - DNA, 20 bp, Homo sapiens
ttctaaaaagtcagatgttt

SEQ ID NO: 4284789 - DNA, 14 bp, Homo sapiens
ttctaaactgtttt

SEQ ID NO: 4284790 - DNA, 19 bp, Homo sapiens
ttctaaactgttttcatgt

SEQ ID NO: 4284791 - DNA, 21 bp, Homo sapiens
ttctaaactgttttcatgtgt

SEQ ID NO: 4284792 - DNA, 21 bp, Homo sapiens
ttctaaatgtttctttttctt

SEQ ID NO: 4284793 - DNA, 14 bp, Homo sapiens
ttctaacacatttc

SEQ ID NO: 4284794 - DNA, 16 bp, Homo sapiens
ttctaagattgtacat

SEQ ID NO: 4284795 - DNA, 17 bp, Homo sapiens
ttctacagaaaaacaat

SEQ ID NO: 4284796 - DNA, 14 bp, Homo sapiens
ttctacctgcagga

SEQ ID NO: 4284797 - DNA, 22 bp, Homo sapiens
ttctagaaggatgaacagttct

SEQ ID NO: 4284798 - DNA, 23 bp, Homo sapiens
ttctagaaggatgaacagttctc

SEQ ID NO: 4284799 - DNA, 22 bp, Homo sapiens
ttctagctataacaactctatt

SEQ ID NO: 4284800 - DNA, 16 bp, Homo sapiens
ttctagtcaactgctg

SEQ ID NO: 4284801 - DNA, 21 bp, Homo sapiens
ttctagtcaactgctgtttta

SEQ ID NO: 4284802 - DNA, 14 bp, Homo sapiens
ttctagtctctgat

SEQ ID NO: 4284803 - DNA, 24 bp, Homo sapiens
ttctatactgtttgtaatatacag

SEQ ID NO: 4284804 - DNA, 15 bp, Homo sapiens
ttctatgcctgtatt

SEQ ID NO: 4284805 - DNA, 14 bp, Homo sapiens
ttctatttctatct

SEQ ID NO: 4284806 - DNA, 16 bp, Homo sapiens
ttctatttctatctgc

SEQ ID NO: 4284807 - DNA, 20 bp, Homo sapiens
ttctcaaagtttttacagtg

SEQ ID NO: 4284808 - DNA, 16 bp, Homo sapiens
ttctcaatgcttttct

SEQ ID NO: 4284809 - DNA, 22 bp, Homo sapiens
ttctcacactctaactgtatat

SEQ ID NO: 4284810 - DNA, 18 bp, Homo sapiens
ttctcactcctacctggt

SEQ ID NO: 4284811 - DNA, 23 bp, Homo sapiens
ttctcagagctccacagaagaca

SEQ ID NO: 4284812 - DNA, 12 bp, Homo sapiens
ttctccactgga

SEQ ID NO: 4284813 - DNA, 22 bp, Homo sapiens
ttctcccttaggaatatacata

SEQ ID NO: 4284814 - DNA, 12 bp, Homo sapiens
ttctcctctccc

SEQ ID NO: 4284815 - DNA, 13 bp, Homo sapiens
ttctcctctccca

SEQ ID NO: 4284816 - DNA, 15 bp, Homo sapiens
ttctctgcttttcca

SEQ ID NO: 4284817 - DNA, 16 bp, Homo sapiens
ttctcttggctggctt

SEQ ID NO: 4284818 - DNA, 15 bp, Homo sapiens
ttctgaaaactgttt

SEQ ID NO: 4284819 - DNA, 16 bp, Homo sapiens
ttctgaagatctcaga

SEQ ID NO: 4284820 - DNA, 18 bp, Homo sapiens
ttctgaaggttggaactg

SEQ ID NO: 4284821 - DNA, 21 bp, Homo sapiens
ttctgaaggttggaactgctg

SEQ ID NO: 4284822 - DNA, 23 bp, Homo sapiens
ttctgaaggttggaactgctgcc

SEQ ID NO: 4284823 - DNA, 16 bp, Homo sapiens
ttctgaataatttctt

SEQ ID NO: 4284824 - DNA, 22 bp, Homo sapiens
ttctgaccacacttcctgtcca

SEQ ID NO: 4284825 - DNA, 18 bp, Homo sapiens
ttctgatgaaatgttaac

SEQ ID NO: 4284826 - DNA, 16 bp, Homo sapiens
ttctgcatctccactt

SEQ ID NO: 4284827 - DNA, 21 bp, Homo sapiens
ttctgcccaccccgcctctgg

SEQ ID NO: 4284828 - DNA, 18 bp, Homo sapiens
ttctgctacctggttttc

SEQ ID NO: 4284829 - DNA, 18 bp, Homo sapiens
ttctggcctctggcctgg

SEQ ID NO: 4284830 - DNA, 19 bp, Homo sapiens
ttctggcctctggcctggg

SEQ ID NO: 4284831 - DNA, 20 bp, Homo sapiens
ttctggcctctggcctggga

SEQ ID NO: 4284832 - DNA, 13 bp, Homo sapiens
ttctgggaagaaa

SEQ ID NO: 4284833 - DNA, 22 bp, Homo sapiens
ttctgggaagaaaatgagatgg

SEQ ID NO: 4284834 - DNA, 19 bp, Homo sapiens
ttctggggagggacacaga

SEQ ID NO: 4284835 - DNA, 21 bp, Homo sapiens
ttctggggagggacacagagg

SEQ ID NO: 4284836 - DNA, 21 bp, Homo sapiens
ttctggggcccctttttactc

SEQ ID NO: 4284837 - DNA, 23 bp, Homo sapiens
ttctggggcccctttttactccc

SEQ ID NO: 4284838 - DNA, 16 bp, Homo sapiens
ttctggggtggggctt

SEQ ID NO: 4284839 - DNA, 11 bp, Homo sapiens
ttctgtccctg

SEQ ID NO: 4284840 - DNA, 16 bp, Homo sapiens
ttctgtccctgtccct

SEQ ID NO: 4284841 - DNA, 18 bp, Homo sapiens
ttctgtccctgtccctgc

SEQ ID NO: 4284842 - DNA, 13 bp, Homo sapiens
ttctgtcttgtag

SEQ ID NO: 4284843 - DNA, 15 bp, Homo sapiens
ttctgttttagagtt

SEQ ID NO: 4284844 - DNA, 13 bp, Homo sapiens
ttcttattaacca

SEQ ID NO: 4284845 - DNA, 22 bp, Homo sapiens
ttcttatttaaattttcagaaa

SEQ ID NO: 4284846 - DNA, 12 bp, Homo sapiens
ttcttcaagatc

SEQ ID NO: 4284847 - DNA, 18 bp, Homo sapiens
ttcttcctcttacctgta

SEQ ID NO: 4284848 - DNA, 17 bp, Homo sapiens
ttcttgagatctgctga

SEQ ID NO: 4284849 - DNA, 14 bp, Homo sapiens
ttcttggtatgatc

SEQ ID NO: 4284850 - DNA, 22 bp, Homo sapiens
ttcttgtatctggattcaaatt

SEQ ID NO: 4284851 - DNA, 16 bp, Homo sapiens
ttctttataaaccata

SEQ ID NO: 4284852 - DNA, 13 bp, Homo sapiens
ttctttattcaca

SEQ ID NO: 4284853 - DNA, 17 bp, Homo sapiens
ttctttctatgtagaac

SEQ ID NO: 4284854 - DNA, 16 bp, Homo sapiens
ttcttttatatctgta

SEQ ID NO: 4284855 - DNA, 17 bp, Homo sapiens
ttcttttcagcttgttt

SEQ ID NO: 4284856 - DNA, 23 bp, Homo sapiens
ttcttttcagcttgtttctatac

SEQ ID NO: 4284857 - DNA, 22 bp, Homo sapiens
ttctttttaaaaagttgcacat

SEQ ID NO: 4284858 - DNA, 19 bp, Homo sapiens
ttgaaaagaagaaagtcta

SEQ ID NO: 4284859 - DNA, 17 bp, Homo sapiens
ttgaaactgcatttgtg

SEQ ID NO: 4284860 - DNA, 21 bp, Homo sapiens
ttgaaaggggttgtgaagagg

SEQ ID NO: 4284861 - DNA, 16 bp, Homo sapiens
ttgaaattatatctgt

SEQ ID NO: 4284862 - DNA, 19 bp, Homo sapiens
ttgaaattatatctgtggt

SEQ ID NO: 4284863 - DNA, 20 bp, Homo sapiens
ttgaagagagatatatctga

SEQ ID NO: 4284864 - DNA, 23 bp, Homo sapiens
ttgaagccaagtcagctttgcct

SEQ ID NO: 4284865 - DNA, 15 bp, Homo sapiens
ttgaatcctctctct

SEQ ID NO: 4284866 - DNA, 23 bp, Homo sapiens
ttgaattacagggaagaaatcaa

SEQ ID NO: 4284867 - DNA, 21 bp, Homo sapiens
ttgacaaggtgtttctctgta

SEQ ID NO: 4284868 - DNA, 21 bp, Homo sapiens
ttgacacattgcacacacagt

SEQ ID NO: 4284869 - DNA, 15 bp, Homo sapiens
ttgacactgaaataa

SEQ ID NO: 4284870 - DNA, 18 bp, Homo sapiens
ttgacacttttcatatca

SEQ ID NO: 4284871 - DNA, 20 bp, Homo sapiens
ttgactgttatttgttgaga

SEQ ID NO: 4284872 - DNA, 17 bp, Homo sapiens
ttgagaataaatgagca

SEQ ID NO: 4284873 - DNA, 20 bp, Homo sapiens
ttgagaataaatgagcattt

SEQ ID NO: 4284874 - DNA, 21 bp, Homo sapiens
ttgagagcgctggcctcttcc

SEQ ID NO: 4284875 - DNA, 14 bp, Homo sapiens
ttgagctgagatgg

SEQ ID NO: 4284876 - DNA, 14 bp, Homo sapiens
ttgagctggtaaca

SEQ ID NO: 4284877 - DNA, 17 bp, Homo sapiens
ttgagtccattgcaaaa

SEQ ID NO: 4284878 - DNA, 15 bp, Homo sapiens
ttgagtgggccccct

SEQ ID NO: 4284879 - DNA, 20 bp, Homo sapiens
ttgagttaagtctatctggt

SEQ ID NO: 4284880 - DNA, 23 bp, Homo sapiens
ttgagttcttcctgtaatcttgt

SEQ ID NO: 4284881 - DNA, 23 bp, Homo sapiens
ttgagtttgctgtatacaaacag

SEQ ID NO: 4284882 - DNA, 12 bp, Homo sapiens
ttgatatgtaac

SEQ ID NO: 4284883 - DNA, 17 bp, Homo sapiens
ttgatgaataaacactt

SEQ ID NO: 4284884 - DNA, 20 bp, Homo sapiens
ttgatgaccaatctctgtga

SEQ ID NO: 4284885 - DNA, 22 bp, Homo sapiens
ttgatgaccaatctctgtgact

SEQ ID NO: 4284886 - DNA, 17 bp, Homo sapiens
ttgcaaaaatattttat

SEQ ID NO: 4284887 - DNA, 13 bp, Homo sapiens
ttgcaaaaggtta

SEQ ID NO: 4284888 - DNA, 15 bp, Homo sapiens
ttgcaaattattcta

SEQ ID NO: 4284889 - DNA, 13 bp, Homo sapiens
ttgcaacacacag

SEQ ID NO: 4284890 - DNA, 18 bp, Homo sapiens
ttgcacagcatctcagct

SEQ ID NO: 4284891 - DNA, 13 bp, Homo sapiens
ttgcacattagga

SEQ ID NO: 4284892 - DNA, 19 bp, Homo sapiens
ttgcagacctgggacttta

SEQ ID NO: 4284893 - DNA, 18 bp, Homo sapiens
ttgcataagcctcaggcc

SEQ ID NO: 4284894 - DNA, 22 bp, Homo sapiens
ttgcatacattcttcaagatcc

SEQ ID NO: 4284895 - DNA, 17 bp, Homo sapiens
ttgcattaaaagactgt

SEQ ID NO: 4284896 - DNA, 12 bp, Homo sapiens
ttgccccccacc

SEQ ID NO: 4284897 - DNA, 16 bp, Homo sapiens
ttgccctgaggggcct

SEQ ID NO: 4284898 - DNA, 13 bp, Homo sapiens
ttgcctcatgaac

SEQ ID NO: 4284899 - DNA, 20 bp, Homo sapiens
ttgcctgaagttggagtgag

SEQ ID NO: 4284900 - DNA, 16 bp, Homo sapiens
ttgcctttaggcagga

SEQ ID NO: 4284901 - DNA, 19 bp, Homo sapiens
ttgcctttaggcaggaagt

SEQ ID NO: 4284902 - DNA, 23 bp, Homo sapiens
ttgcctttaggcaggaagtcagg

SEQ ID NO: 4284903 - DNA, 14 bp, Homo sapiens
ttgcgatgtgtttt

SEQ ID NO: 4284904 - DNA, 23 bp, Homo sapiens
ttgctagtgatacactgtatcta

SEQ ID NO: 4284905 - DNA, 14 bp, Homo sapiens
ttgctcacccagga

SEQ ID NO: 4284906 - DNA, 15 bp, Homo sapiens
ttgctcacccaggac

SEQ ID NO: 4284907 - DNA, 20 bp, Homo sapiens
ttgctcacccaggacctctg

SEQ ID NO: 4284908 - DNA, 12 bp, Homo sapiens
ttgctgaaacac

SEQ ID NO: 4284909 - DNA, 19 bp, Homo sapiens
ttgctgaggagctcagggc

SEQ ID NO: 4284910 - DNA, 17 bp, Homo sapiens
ttgctgatttcccctct

SEQ ID NO: 4284911 - DNA, 13 bp, Homo sapiens
ttgctgctggctc

SEQ ID NO: 4284912 - DNA, 20 bp, Homo sapiens
ttgctgctggctcccatctc

SEQ ID NO: 4284913 - DNA, 19 bp, Homo sapiens
ttgctggaatctactagaa

SEQ ID NO: 4284914 - DNA, 14 bp, Homo sapiens
ttgctggagtcctg

SEQ ID NO: 4284915 - DNA, 17 bp, Homo sapiens
ttgctgtatacaaacag

SEQ ID NO: 4284916 - DNA, 12 bp, Homo sapiens
ttattgaatgtt

SEQ ID NO: 4284917 - DNA, 18 bp, Homo sapiens
ttattgagttctgaaggt

SEQ ID NO: 4284918 - DNA, 14 bp, Homo sapiens
ttattgtctgtaaa

SEQ ID NO: 4284919 - DNA, 18 bp, Homo sapiens
ttatttatattcagagat

SEQ ID NO: 4284920 - DNA, 24 bp, Homo sapiens
ttatttcaatgtaattaaactgtt

SEQ ID NO: 4284921 - DNA, 15 bp, Homo sapiens
ttatttctaaatcct

SEQ ID NO: 4284922 - DNA, 13 bp, Homo sapiens
ttcaaaaatttca

SEQ ID NO: 4284923 - DNA, 12 bp, Homo sapiens
ttcaaaatactt

SEQ ID NO: 4284924 - DNA, 15 bp, Homo sapiens
ttcaaaatacttctt

SEQ ID NO: 4284925 - DNA, 17 bp, Homo sapiens
ttcaaaatagttctatt

SEQ ID NO: 4284926 - DNA, 21 bp, Homo sapiens
ttcaaaatagttctatttcta

SEQ ID NO: 4284927 - DNA, 12 bp, Homo sapiens
ttcaaaatgcat

SEQ ID NO: 4284928 - DNA, 21 bp, Homo sapiens
ttcaaaatgcatgtgattggc

SEQ ID NO: 4284929 - DNA, 14 bp, Homo sapiens
ttcaaacacacaca

SEQ ID NO: 4284930 - DNA, 20 bp, Homo sapiens
ttcaaacatgccctcaggct

SEQ ID NO: 4284931 - DNA, 19 bp, Homo sapiens
ttcaaagaacccccctccc

SEQ ID NO: 4284932 - DNA, 20 bp, Homo sapiens
ttcaaagaacccccctcccc

SEQ ID NO: 4284933 - DNA, 15 bp, Homo sapiens
ttcaaagagaaaaca

SEQ ID NO: 4284934 - DNA, 13 bp, Homo sapiens
ttcaaatgcatga

SEQ ID NO: 4284935 - DNA, 14 bp, Homo sapiens
ttcaacgcagccct

SEQ ID NO: 4284936 - DNA, 20 bp, Homo sapiens
ttcaacgcagccctgctttg

SEQ ID NO: 4284937 - DNA, 23 bp, Homo sapiens
ttcaagatctaaatcatatataa

SEQ ID NO: 4284938 - DNA, 11 bp, Homo sapiens
ttcaagattcc

SEQ ID NO: 4284939 - DNA, 12 bp, Homo sapiens
ttcaagcaaata

SEQ ID NO: 4284940 - DNA, 11 bp, Homo sapiens
ttcaagcctgg

SEQ ID NO: 4284941 - DNA, 18 bp, Homo sapiens
ttcaagctcaccctgctc

SEQ ID NO: 4284942 - DNA, 21 bp, Homo sapiens
ttcaaggaagtgataacactg

SEQ ID NO: 4284943 - DNA, 14 bp, Homo sapiens
ttcaagtgcaatcc

SEQ ID NO: 4284944 - DNA, 13 bp, Homo sapiens
ttcacaaatatag

SEQ ID NO: 4284945 - DNA, 17 bp, Homo sapiens
ttcacaacacaatcaaa

SEQ ID NO: 4284946 - DNA, 12 bp, Homo sapiens
ttcaccaggaag

SEQ ID NO: 4284947 - DNA, 13 bp, Homo sapiens
ttcaccaggaaga

SEQ ID NO: 4284948 - DNA, 18 bp, Homo sapiens
ttcaccaggaagaaggcc

SEQ ID NO: 4284949 - DNA, 16 bp, Homo sapiens
ttcacccctcttccca

SEQ ID NO: 4284950 - DNA, 15 bp, Homo sapiens
ttcactactcagcat

SEQ ID NO: 4284951 - DNA, 16 bp, Homo sapiens
ttcactgctggctgcc

SEQ ID NO: 4284952 - DNA, 17 bp, Homo sapiens
ttcactgctggctgcct

SEQ ID NO: 4284953 - DNA, 19 bp, Homo sapiens
ttcactgctggctgcctta

SEQ ID NO: 4284954 - DNA, 15 bp, Homo sapiens
ttcacttaaaatcaa

SEQ ID NO: 4284955 - DNA, 13 bp, Homo sapiens
ttcagaagttgtt

SEQ ID NO: 4284956 - DNA, 21 bp, Homo sapiens
ttcagaagttgttagtgattt

SEQ ID NO: 4284957 - DNA, 15 bp, Homo sapiens
ttcagactctctcct

SEQ ID NO: 4284958 - DNA, 19 bp, Homo sapiens
ttcagagagctaaattaca

SEQ ID NO: 4284959 - DNA, 14 bp, Homo sapiens
ttcagattgtaaag

SEQ ID NO: 4284960 - DNA, 11 bp, Homo sapiens
ttcagcccctg

SEQ ID NO: 4284961 - DNA, 19 bp, Homo sapiens
ttcaggaccccatctgctg

SEQ ID NO: 4284962 - DNA, 19 bp, Homo sapiens
ttcaggaggagacagtcag

SEQ ID NO: 4284963 - DNA, 22 bp, Homo sapiens
ttcaggcttgcattaaaagact

SEQ ID NO: 4284964 - DNA, 14 bp, Homo sapiens
ttcaggtgagccaa

SEQ ID NO: 4284965 - DNA, 16 bp, Homo sapiens
ttcagtaaacaccatg

SEQ ID NO: 4284966 - DNA, 17 bp, Homo sapiens
ttcagttattaaatgat

SEQ ID NO: 4284967 - DNA, 18 bp, Homo sapiens
ttcagttattaaatgata

SEQ ID NO: 4284968 - DNA, 18 bp, Homo sapiens
ttcagtttctaaaattga

SEQ ID NO: 4284969 - DNA, 12 bp, Homo sapiens
ttcataggcaga

SEQ ID NO: 4284970 - DNA, 13 bp, Homo sapiens
ttcataggcagag

SEQ ID NO: 4284971 - DNA, 18 bp, Homo sapiens
ttcataggcagagcccgc

SEQ ID NO: 4284972 - DNA, 16 bp, Homo sapiens
ttcatcctcagcaagt

SEQ ID NO: 4284973 - DNA, 18 bp, Homo sapiens
ttcatgatgaattacttc

SEQ ID NO: 4284974 - DNA, 14 bp, Homo sapiens
ttcatgcctggggt

SEQ ID NO: 4284975 - DNA, 15 bp, Homo sapiens
ttcatgcctggggtg

SEQ ID NO: 4284976 - DNA, 20 bp, Homo sapiens
ttcatgcctggggtggaggc

SEQ ID NO: 4284977 - DNA, 17 bp, Homo sapiens
ttcattcatacttaaaa

SEQ ID NO: 4284978 - DNA, 16 bp, Homo sapiens
ttcatttcctccgtca

SEQ ID NO: 4284979 - DNA, 13 bp, Homo sapiens
ttccaaataaaac

SEQ ID NO: 4284980 - DNA, 19 bp, Homo sapiens
ttccaaatattagccaaag

SEQ ID NO: 4284981 - DNA, 15 bp, Homo sapiens
ttccaaattgatggg

SEQ ID NO: 4284982 - DNA, 14 bp, Homo sapiens
ttccaagcctgggc

SEQ ID NO: 4284983 - DNA, 15 bp, Homo sapiens
ttccaagcctgggcc

SEQ ID NO: 4284984 - DNA, 19 bp, Homo sapiens
ttccaagcctgggccactg

SEQ ID NO: 4284985 - DNA, 20 bp, Homo sapiens
ttccaagcctgggccactgg

SEQ ID NO: 4284986 - DNA, 18 bp, Homo sapiens
ttccaatgtgcccagtca

SEQ ID NO: 4284987 - DNA, 20 bp, Homo sapiens
ttccaatgtgcccagtcatg

SEQ ID NO: 4284988 - DNA, 12 bp, Homo sapiens
ttccacacaggc

SEQ ID NO: 4284989 - DNA, 17 bp, Homo sapiens
ttccacccccagctcct

SEQ ID NO: 4284990 - DNA, 13 bp, Homo sapiens
ttccaccccctcc

SEQ ID NO: 4284991 - DNA, 15 bp, Homo sapiens
ttccaccccctccct

SEQ ID NO: 4284992 - DNA, 23 bp, Homo sapiens
ttccaccttggcgcgcagcccgg

SEQ ID NO: 4284993 - DNA, 21 bp, Homo sapiens
ttccacttagaaattgcattt

SEQ ID NO: 4284994 - DNA, 15 bp, Homo sapiens
ttccagaattgagag

SEQ ID NO: 4284995 - DNA, 23 bp, Homo sapiens
ttccagacttcgctattcccagg

SEQ ID NO: 4284996 - DNA, 20 bp, Homo sapiens
ttccagagagtggctcctcc

SEQ ID NO: 4284997 - DNA, 19 bp, Homo sapiens
ttccagctaagcctgatga

SEQ ID NO: 4284998 - DNA, 21 bp, Homo sapiens
ttccagctaagcctgatgatg

SEQ ID NO: 4284999 - DNA, 18 bp, Homo sapiens
ttccaggcatgaccctgg

SEQ ID NO: 4285000 - DNA, 15 bp, Homo sapiens
ttccaggccccaggc

SEQ ID NO: 4285001 - DNA, 16 bp, Homo sapiens
ttccaggccccaggct

SEQ ID NO: 4285002 - DNA, 18 bp, Homo sapiens
ttccaggccccaggctgg

SEQ ID NO: 4285003 - DNA, 24 bp, Homo sapiens
ttccaggccccaggctggatgctg

SEQ ID NO: 4285004 - DNA, 18 bp, Homo sapiens
ttccaggcgtagggccag

SEQ ID NO: 4285005 - DNA, 19 bp, Homo sapiens
ttccaggcgtagggccagg

SEQ ID NO: 4285006 - DNA, 22 bp, Homo sapiens
ttccaggcgtagggccagggct

SEQ ID NO: 4285007 - DNA, 15 bp, Homo sapiens
ttccagtgtattttc

SEQ ID NO: 4285008 - DNA, 19 bp, Homo sapiens
ttccagtgtattttctgtg

SEQ ID NO: 4285009 - DNA, 23 bp, Homo sapiens
ttccagttggactgtggcctcag

SEQ ID NO: 4285010 - DNA, 24 bp, Homo sapiens
ttccagttggactgtggcctcagg

SEQ ID NO: 4285011 - DNA, 21 bp, Homo sapiens
ttccatatagtttgttttctt

SEQ ID NO: 4285012 - DNA, 15 bp, Homo sapiens
ttccatctaaaatac

SEQ ID NO: 4285013 - DNA, 15 bp, Homo sapiens
ttccatgtcaagatt

SEQ ID NO: 4285014 - DNA, 21 bp, Homo sapiens
ttcccaagaaaggaaaccttt

SEQ ID NO: 4285015 - DNA, 23 bp, Homo sapiens
ttcccaccaactctctctgcccc

SEQ ID NO: 4285016 - DNA, 16 bp, Homo sapiens
ttcccacggccactgc

SEQ ID NO: 4285017 - DNA, 16 bp, Homo sapiens
ttccccaacgaaaagc

SEQ ID NO: 4285018 - DNA, 12 bp, Homo sapiens
ttccccactccc

SEQ ID NO: 4285019 - DNA, 19 bp, Homo sapiens
ttccccatcgccttctggg

SEQ ID NO: 4285020 - DNA, 13 bp, Homo sapiens
ttcccccagccct

SEQ ID NO: 4285021 - DNA, 14 bp, Homo sapiens
ttcccccagccctg

SEQ ID NO: 4285022 - DNA, 14 bp, Homo sapiens
ttccccctccatgt

SEQ ID NO: 4285023 - DNA, 21 bp, Homo sapiens
ttcccctgcgccctccctccc

SEQ ID NO: 4285024 - DNA, 17 bp, Homo sapiens
ttcccctgttcactcta

SEQ ID NO: 4285025 - DNA, 16 bp, Homo sapiens
ttcccgctcagccctc

SEQ ID NO: 4285026 - DNA, 13 bp, Homo sapiens
ttccctctgcctg

SEQ ID NO: 4285027 - DNA, 14 bp, Homo sapiens
ttccctctgcctgt

SEQ ID NO: 4285028 - DNA, 21 bp, Homo sapiens
ttccctgacactgtctgctgc

SEQ ID NO: 4285029 - DNA, 21 bp, Homo sapiens
ttccgaagaccttctgaagat

SEQ ID NO: 4285030 - DNA, 20 bp, Homo sapiens
ttccgacaaccgatgctcca

SEQ ID NO: 4285031 - DNA, 23 bp, Homo sapiens
ttccgacaaccgatgctccagcc

SEQ ID NO: 4285032 - DNA, 18 bp, Homo sapiens
ttcctcccattcaagatt

SEQ ID NO: 4285033 - DNA, 12 bp, Homo sapiens
ttcctccccagc

SEQ ID NO: 4285034 - DNA, 17 bp, Homo sapiens
ttcctccctccctgcag

SEQ ID NO: 4285035 - DNA, 15 bp, Homo sapiens
ttcctctccactgcc

SEQ ID NO: 4285036 - DNA, 19 bp, Homo sapiens
ttcctctccactgccttcg

SEQ ID NO: 4285037 - DNA, 22 bp, Homo sapiens
ttcctgctacagtagctgtggg

SEQ ID NO: 4285038 - DNA, 14 bp, Homo sapiens
ttcctggattttct

SEQ ID NO: 4285039 - DNA, 20 bp, Homo sapiens
ttcctggattttctttctat

SEQ ID NO: 4285040 - DNA, 22 bp, Homo sapiens
ttcctggattttctttctatgt

SEQ ID NO: 4285041 - DNA, 16 bp, Homo sapiens
ttcctgggcagcccag

SEQ ID NO: 4285042 - DNA, 17 bp, Homo sapiens
ttccttccgctctgagg

SEQ ID NO: 4285043 - DNA, 13 bp, Homo sapiens
ttccttggcccag

SEQ ID NO: 4285044 - DNA, 15 bp, Homo sapiens
ttccttggcccagca

SEQ ID NO: 4285045 - DNA, 22 bp, Homo sapiens
ttcgaagctcagcccacccccc

SEQ ID NO: 4285046 - DNA, 19 bp, Homo sapiens
ttcgactgtgacctgtggg

SEQ ID NO: 4285047 - DNA, 20 bp, Homo sapiens
ttcgatacaccgggcctgga

SEQ ID NO: 4285048 - DNA, 18 bp, Homo sapiens
ttcgccatgtgctgtgca

SEQ ID NO: 4285049 - DNA, 19 bp, Homo sapiens
ttcgcccaaagccagacag

SEQ ID NO: 4285050 - DNA, 15 bp, Homo sapiens
ttcgctattcccagg

SEQ ID NO: 4285051 - DNA, 19 bp, Homo sapiens
ttaaaaaaataacatctga

SEQ ID NO: 4285052 - DNA, 22 bp, Homo sapiens
ttaaaaaaataacatctgaaaa

SEQ ID NO: 4285053 - DNA, 19 bp, Homo sapiens
ttaaaaaataacatattct

SEQ ID NO: 4285054 - DNA, 20 bp, Homo sapiens
ttaaaaaataacatattctt

SEQ ID NO: 4285055 - DNA, 18 bp, Homo sapiens
ttaaaaaatgaatagtac

SEQ ID NO: 4285056 - DNA, 13 bp, Homo sapiens
ttaaaaattgcat

SEQ ID NO: 4285057 - DNA, 14 bp, Homo sapiens
ttaaaacttcatct

SEQ ID NO: 4285058 - DNA, 17 bp, Homo sapiens
ttaaaagaagactggaa

SEQ ID NO: 4285059 - DNA, 18 bp, Homo sapiens
ttaaaagactgttttcag

SEQ ID NO: 4285060 - DNA, 16 bp, Homo sapiens
ttaaaagctatcttca

SEQ ID NO: 4285061 - DNA, 19 bp, Homo sapiens
ttaaaagctatcttcatgt

SEQ ID NO: 4285062 - DNA, 23 bp, Homo sapiens
ttaaaagctatcttcatgtaaat

SEQ ID NO: 4285063 - DNA, 18 bp, Homo sapiens
ttaaaatagttttctaaa

SEQ ID NO: 4285064 - DNA, 13 bp, Homo sapiens
ttaaacagttgca

SEQ ID NO: 4285065 - DNA, 17 bp, Homo sapiens
ttaaacagttgcacagc

SEQ ID NO: 4285066 - DNA, 23 bp, Homo sapiens
ttaaacagttgcacagcatctca

SEQ ID NO: 4285067 - DNA, 17 bp, Homo sapiens
ttaaacgtcacagcagt

SEQ ID NO: 4285068 - DNA, 22 bp, Homo sapiens
ttaaagacttgatgaataaaca

SEQ ID NO: 4285069 - DNA, 21 bp, Homo sapiens
ttaaagaggcgtcttgtattt

SEQ ID NO: 4285070 - DNA, 22 bp, Homo sapiens
ttaaagaggcgtcttgtatttt

SEQ ID NO: 4285071 - DNA, 17 bp, Homo sapiens
ttaaagtgcactgtgtc

SEQ ID NO: 4285072 - DNA, 15 bp, Homo sapiens
ttaaatagcatctgc

SEQ ID NO: 4285073 - DNA, 20 bp, Homo sapiens
ttaaatagcatctgctcttc

SEQ ID NO: 4285074 - DNA, 23 bp, Homo sapiens
ttaaatagcatctgctcttctct

SEQ ID NO: 4285075 - DNA, 13 bp, Homo sapiens
ttaaatcagaatc

SEQ ID NO: 4285076 - DNA, 14 bp, Homo sapiens
ttaaatgattccaa

SEQ ID NO: 4285077 - DNA, 17 bp, Homo sapiens
ttaaattggcttgttta

SEQ ID NO: 4285078 - DNA, 16 bp, Homo sapiens
ttaaatttaatatact

SEQ ID NO: 4285079 - DNA, 21 bp, Homo sapiens
ttaaatttaatatactgcata

SEQ ID NO: 4285080 - DNA, 21 bp, Homo sapiens
ttaacaatgcctattgtaata

SEQ ID NO: 4285081 - DNA, 15 bp, Homo sapiens
ttaacctcagaaaat

SEQ ID NO: 4285082 - DNA, 17 bp, Homo sapiens
ttaactactaagaataa

SEQ ID NO: 4285083 - DNA, 16 bp, Homo sapiens
ttaactccgtttccaa

SEQ ID NO: 4285084 - DNA, 14 bp, Homo sapiens
ttaacttcacctta

SEQ ID NO: 4285085 - DNA, 13 bp, Homo sapiens
ttaagaaagctat

SEQ ID NO: 4285086 - DNA, 14 bp, Homo sapiens
ttaagaaagctata

SEQ ID NO: 4285087 - DNA, 23 bp, Homo sapiens
ttaagcttaaaaaagaaagattt

SEQ ID NO: 4285088 - DNA, 18 bp, Homo sapiens
ttaaggggggatgtcttg

SEQ ID NO: 4285089 - DNA, 12 bp, Homo sapiens
ttaagtagattt

SEQ ID NO: 4285090 - DNA, 22 bp, Homo sapiens
ttaagtattccttggcccagca

SEQ ID NO: 4285091 - DNA, 18 bp, Homo sapiens
ttaagtcttactgttttg

SEQ ID NO: 4285092 - DNA, 20 bp, Homo sapiens
ttaagtggctgtgattaatt

SEQ ID NO: 4285093 - DNA, 16 bp, Homo sapiens
ttaatatcactcatta

SEQ ID NO: 4285094 - DNA, 20 bp, Homo sapiens
ttaatatcactcattaatta

SEQ ID NO: 4285095 - DNA, 12 bp, Homo sapiens
ttaatatttctt

SEQ ID NO: 4285096 - DNA, 18 bp, Homo sapiens
ttaatctctaaaattcta

SEQ ID NO: 4285097 - DNA, 22 bp, Homo sapiens
ttaatgttctgaataatttctt

SEQ ID NO: 4285098 - DNA, 15 bp, Homo sapiens
ttaattaaacaaatt

SEQ ID NO: 4285099 - DNA, 19 bp, Homo sapiens
ttaattagccagtgaaaaa

SEQ ID NO: 4285100 - DNA, 17 bp, Homo sapiens
ttaattgatagaataaa

SEQ ID NO: 4285101 - DNA, 13 bp, Homo sapiens
ttaattgtataaa

SEQ ID NO: 4285102 - DNA, 15 bp, Homo sapiens
ttaattgtggcttta

SEQ ID NO: 4285103 - DNA, 23 bp, Homo sapiens
ttaatttaaatgatttaaattta

SEQ ID NO: 4285104 - DNA, 13 bp, Homo sapiens
ttaatttctgcca

SEQ ID NO: 4285105 - DNA, 16 bp, Homo sapiens
ttacaagaagaactca

SEQ ID NO: 4285106 - DNA, 11 bp, Homo sapiens
ttacaatggcc

SEQ ID NO: 4285107 - DNA, 16 bp, Homo sapiens
ttacaatggccagccc

SEQ ID NO: 4285108 - DNA, 14 bp, Homo sapiens
ttacaatgtattaa

SEQ ID NO: 4285109 - DNA, 18 bp, Homo sapiens
ttacagttctggaggagg

SEQ ID NO: 4285110 - DNA, 19 bp, Homo sapiens
ttacagttctggaggagga

SEQ ID NO: 4285111 - DNA, 22 bp, Homo sapiens
ttaccattttgcgatgtgtttt

SEQ ID NO: 4285112 - DNA, 23 bp, Homo sapiens
ttacccacactacgcagaagaga

SEQ ID NO: 4285113 - DNA, 17 bp, Homo sapiens
ttacctcactggtgcat

SEQ ID NO: 4285114 - DNA, 19 bp, Homo sapiens
ttacctgtaatagcctcac

SEQ ID NO: 4285115 - DNA, 20 bp, Homo sapiens
ttacctgtaatagcctcacc

SEQ ID NO: 4285116 - DNA, 21 bp, Homo sapiens
ttacctgtaatagcctcacct

SEQ ID NO: 4285117 - DNA, 13 bp, Homo sapiens
ttacgctctctgt

SEQ ID NO: 4285118 - DNA, 14 bp, Homo sapiens
ttacgctctctgtc

SEQ ID NO: 4285119 - DNA, 16 bp, Homo sapiens
ttactaaacattttgt

SEQ ID NO: 4285120 - DNA, 13 bp, Homo sapiens
ttactacatgcac

SEQ ID NO: 4285121 - DNA, 14 bp, Homo sapiens
ttactacatgcact

SEQ ID NO: 4285122 - DNA, 23 bp, Homo sapiens
ttactctgtgctaagttgtctta

SEQ ID NO: 4285123 - DNA, 15 bp, Homo sapiens
ttactgatgtgtgca

SEQ ID NO: 4285124 - DNA, 22 bp, Homo sapiens
ttactggttggtgttcttccca

SEQ ID NO: 4285125 - DNA, 14 bp, Homo sapiens
ttactgtctgtaag

SEQ ID NO: 4285126 - DNA, 14 bp, Homo sapiens
ttactttcctctga

SEQ ID NO: 4285127 - DNA, 18 bp, Homo sapiens
ttactttgtgcaatatga

SEQ ID NO: 4285128 - DNA, 13 bp, Homo sapiens
ttagaacctttct

SEQ ID NO: 4285129 - DNA, 20 bp, Homo sapiens
ttagaatcaagtctgtgaaa

SEQ ID NO: 4285130 - DNA, 13 bp, Homo sapiens
ttagaatgtcagt

SEQ ID NO: 4285131 - DNA, 18 bp, Homo sapiens
ttagacaaccatagaact

SEQ ID NO: 4285132 - DNA, 21 bp, Homo sapiens
ttagagtatgcaagaagaata

SEQ ID NO: 4285133 - DNA, 20 bp, Homo sapiens
ttagagtgcccttaaaataa

SEQ ID NO: 4285134 - DNA, 14 bp, Homo sapiens
ttagatccattaat

SEQ ID NO: 4285135 - DNA, 15 bp, Homo sapiens
ttagatccattaatt

SEQ ID NO: 4285136 - DNA, 16 bp, Homo sapiens
ttagatgtagcactga

SEQ ID NO: 4285137 - DNA, 21 bp, Homo sapiens
ttagcatgacaagccccaggc

SEQ ID NO: 4285138 - DNA, 24 bp, Homo sapiens
ttagcatgacaagccccaggcagg

SEQ ID NO: 4285139 - DNA, 17 bp, Homo sapiens
ttagccttctctgttca

SEQ ID NO: 4285140 - DNA, 16 bp, Homo sapiens
ttagcggtttgcaaac

SEQ ID NO: 4285141 - DNA, 22 bp, Homo sapiens
ttagctctcgcctcaggctttt

SEQ ID NO: 4285142 - DNA, 14 bp, Homo sapiens
ttagcttttctgca

SEQ ID NO: 4285143 - DNA, 14 bp, Homo sapiens
ttaggaacagagta

SEQ ID NO: 4285144 - DNA, 21 bp, Homo sapiens
ttaggaacagagtatatatgt

SEQ ID NO: 4285145 - DNA, 15 bp, Homo sapiens
ttaggagttttgaga

SEQ ID NO: 4285146 - DNA, 10 bp, Homo sapiens
ttaggcctgg

SEQ ID NO: 4285147 - DNA, 17 bp, Homo sapiens
ttaggggaaaatagtag

SEQ ID NO: 4285148 - DNA, 23 bp, Homo sapiens
ttaggtagtagaatctcagcact

SEQ ID NO: 4285149 - DNA, 22 bp, Homo sapiens
ttaggtcatccaacctctttcc

SEQ ID NO: 4285150 - DNA, 14 bp, Homo sapiens
ttagtaatctgtat

SEQ ID NO: 4285151 - DNA, 17 bp, Homo sapiens
ttagtaatctgtataat

SEQ ID NO: 4285152 - DNA, 19 bp, Homo sapiens
ttagtcctcaccttctgtt

SEQ ID NO: 4285153 - DNA, 23 bp, Homo sapiens
ttagtgactaaaccattgtgcat

SEQ ID NO: 4285154 - DNA, 14 bp, Homo sapiens
ttagtgagatttgt

SEQ ID NO: 4285155 - DNA, 14 bp, Homo sapiens
ttagtgtctgtcca

SEQ ID NO: 4285156 - DNA, 15 bp, Homo sapiens
ttagttcctgtgcac

SEQ ID NO: 4285157 - DNA, 23 bp, Homo sapiens
ttataagatttttaggtgtcttt

SEQ ID NO: 4285158 - DNA, 20 bp, Homo sapiens
ttataagcaacatgaattaa

SEQ ID NO: 4285159 - DNA, 23 bp, Homo sapiens
ttataatcagaatggaagagaga

SEQ ID NO: 4285160 - DNA, 17 bp, Homo sapiens
ttatagtactagagata

SEQ ID NO: 4285161 - DNA, 17 bp, Homo sapiens
ttatagttgatatgtaa

SEQ ID NO: 4285162 - DNA, 12 bp, Homo sapiens
ttatatatgaag

SEQ ID NO: 4285163 - DNA, 14 bp, Homo sapiens
ttatatatgaagta

SEQ ID NO: 4285164 - DNA, 22 bp, Homo sapiens
ttatatcagactgctttgagaa

SEQ ID NO: 4285165 - DNA, 23 bp, Homo sapiens
ttatattcagagatgtaccatgt

SEQ ID NO: 4285166 - DNA, 19 bp, Homo sapiens
ttatcagtttgctaatgtt

SEQ ID NO: 4285167 - DNA, 21 bp, Homo sapiens
ttatctagcaagaagattcta

SEQ ID NO: 4285168 - DNA, 17 bp, Homo sapiens
ttatctgtctgagccct

SEQ ID NO: 4285169 - DNA, 22 bp, Homo sapiens
ttatcttctggactatagctgt

SEQ ID NO: 4285170 - DNA, 16 bp, Homo sapiens
ttatgagatactttgc

SEQ ID NO: 4285171 - DNA, 21 bp, Homo sapiens
ttatgagccgacttctttggt

SEQ ID NO: 4285172 - DNA, 14 bp, Homo sapiens
ttatgctgagtatg

SEQ ID NO: 4285173 - DNA, 12 bp, Homo sapiens
ttatgctgctgt

SEQ ID NO: 4285174 - DNA, 13 bp, Homo sapiens
ttatgctgctgtg

SEQ ID NO: 4285175 - DNA, 23 bp, Homo sapiens
ttatgtcatactctgtgtaatct

SEQ ID NO: 4285176 - DNA, 21 bp, Homo sapiens
ttatgtgctattaatatttgt

SEQ ID NO: 4285177 - DNA, 14 bp, Homo sapiens
ttatgtgcttgaag

SEQ ID NO: 4285178 - DNA, 15 bp, Homo sapiens
ttatgtgtgaagctg

SEQ ID NO: 4285179 - DNA, 15 bp, Homo sapiens
ttattaaatcagaat

SEQ ID NO: 4285180 - DNA, 15 bp, Homo sapiens
ttattaaatcggcaa

SEQ ID NO: 4285181 - DNA, 15 bp, Homo sapiens
ttattaaccaaatta

SEQ ID NO: 4285182 - DNA, 23 bp, Homo sapiens
ttattagccctgcattttcatag

SEQ ID NO: 4285183 - DNA, 23 bp, Homo sapiens
ttattcaaagagaaaacatctca

SEQ ID NO: 4285184 - DNA, 21 bp, Homo sapiens
tgtgaccggggtcctgaggct

SEQ ID NO: 4285185 - DNA, 22 bp, Homo sapiens
tgtgaccggggtcctgaggctg

SEQ ID NO: 4285186 - DNA, 19 bp, Homo sapiens
tgtgacgggggttggggtg

SEQ ID NO: 4285187 - DNA, 22 bp, Homo sapiens
tgtgacgggggttggggtgggg

SEQ ID NO: 4285188 - DNA, 13 bp, Homo sapiens
tgtgagatgtgta

SEQ ID NO: 4285189 - DNA, 18 bp, Homo sapiens
tgtgagatgtgtatcagt

SEQ ID NO: 4285190 - DNA, 14 bp, Homo sapiens
tgtgagcagggtga

SEQ ID NO: 4285191 - DNA, 22 bp, Homo sapiens
tgtgagccaaagagaaaagatt

SEQ ID NO: 4285192 - DNA, 12 bp, Homo sapiens
tgtgattacagc

SEQ ID NO: 4285193 - DNA, 22 bp, Homo sapiens
tgtgcaatatgaggggactgca

SEQ ID NO: 4285194 - DNA, 23 bp, Homo sapiens
tgtgcactttatcttgggaccaa

SEQ ID NO: 4285195 - DNA, 20 bp, Homo sapiens
tgtgcagccggggagctgag

SEQ ID NO: 4285196 - DNA, 22 bp, Homo sapiens
tgtgcagccggggagctgaggg

SEQ ID NO: 4285197 - DNA, 13 bp, Homo sapiens
tgtgccaccctct

SEQ ID NO: 4285198 - DNA, 19 bp, Homo sapiens
tgtgccaccctctgcaggg

SEQ ID NO: 4285199 - DNA, 22 bp, Homo sapiens
tgtgccaccctctgcagggcag

SEQ ID NO: 4285200 - DNA, 22 bp, Homo sapiens
tgtgccagctgcttctgcccac

SEQ ID NO: 4285201 - DNA, 13 bp, Homo sapiens
tgtgcccagtcat

SEQ ID NO: 4285202 - DNA, 20 bp, Homo sapiens
tgtgcccagtcatgacattt

SEQ ID NO: 4285203 - DNA, 18 bp, Homo sapiens
tgtgcctcttgggagacg

SEQ ID NO: 4285204 - DNA, 15 bp, Homo sapiens
tgtgcgttttagagt

SEQ ID NO: 4285205 - DNA, 17 bp, Homo sapiens
tgtgctattaatatttg

SEQ ID NO: 4285206 - DNA, 16 bp, Homo sapiens
tgtgctcatcagaaac

SEQ ID NO: 4285207 - DNA, 17 bp, Homo sapiens
tgtgctccaggcttcct

SEQ ID NO: 4285208 - DNA, 15 bp, Homo sapiens
tgtgctgaggtgggc

SEQ ID NO: 4285209 - DNA, 18 bp, Homo sapiens
tgtgctgaggtgggcctt

SEQ ID NO: 4285210 - DNA, 22 bp, Homo sapiens
tgtgctggtctctaggcctgaa

SEQ ID NO: 4285211 - DNA, 12 bp, Homo sapiens
tgtgcttgttct

SEQ ID NO: 4285212 - DNA, 18 bp, Homo sapiens
tgtgcttttccatctaaa

SEQ ID NO: 4285213 - DNA, 17 bp, Homo sapiens
tgtggaaaaaaaaagaa

SEQ ID NO: 4285214 - DNA, 18 bp, Homo sapiens
tgtggaagggactaggag

SEQ ID NO: 4285215 - DNA, 19 bp, Homo sapiens
tgtggagctgcttccagtt

SEQ ID NO: 4285216 - DNA, 18 bp, Homo sapiens
tgtggagtggggcagtag

SEQ ID NO: 4285217 - DNA, 13 bp, Homo sapiens
tgtggattctata

SEQ ID NO: 4285218 - DNA, 21 bp, Homo sapiens
tgtggattctatatttcatat

SEQ ID NO: 4285219 - DNA, 19 bp, Homo sapiens
tgtggattttgtggcttca

SEQ ID NO: 4285220 - DNA, 16 bp, Homo sapiens
tgtggcagctgtctca

SEQ ID NO: 4285221 - DNA, 13 bp, Homo sapiens
tgtggccccttca

SEQ ID NO: 4285222 - DNA, 16 bp, Homo sapiens
tgtggcggtgcagtgg

SEQ ID NO: 4285223 - DNA, 10 bp, Homo sapiens
tgtggctcac

SEQ ID NO: 4285224 - DNA, 12 bp, Homo sapiens
tgtggcttggaa

SEQ ID NO: 4285225 - DNA, 13 bp, Homo sapiens
tgtggctttatga

SEQ ID NO: 4285226 - DNA, 20 bp, Homo sapiens
tgtgggactggcccacccct

SEQ ID NO: 4285227 - DNA, 12 bp, Homo sapiens
tgtgggagaagg

SEQ ID NO: 4285228 - DNA, 17 bp, Homo sapiens
tgtgggagaagggacag

SEQ ID NO: 4285229 - DNA, 13 bp, Homo sapiens
tgtgggctcccac

SEQ ID NO: 4285230 - DNA, 14 bp, Homo sapiens
tgtgggctcccacg

SEQ ID NO: 4285231 - DNA, 13 bp, Homo sapiens
tgtggggagctgg

SEQ ID NO: 4285232 - DNA, 13 bp, Homo sapiens
tgtggggagggtg

SEQ ID NO: 4285233 - DNA, 16 bp, Homo sapiens
tgtgggtccctaagca

SEQ ID NO: 4285234 - DNA, 22 bp, Homo sapiens
tgtggtgaggtcctgtcctggc

SEQ ID NO: 4285235 - DNA, 14 bp, Homo sapiens
tgtgtatgtgttta

SEQ ID NO: 4285236 - DNA, 23 bp, Homo sapiens
tgtgtattctgtggattctatat

SEQ ID NO: 4285237 - DNA, 22 bp, Homo sapiens
tgtgtcaaagagatgaggaaat

SEQ ID NO: 4285238 - DNA, 14 bp, Homo sapiens
tgtgtcatgatttc

SEQ ID NO: 4285239 - DNA, 22 bp, Homo sapiens
tgtgtcgcctctcactctggca

SEQ ID NO: 4285240 - DNA, 12 bp, Homo sapiens
tgtgtctgctgt

SEQ ID NO: 4285241 - DNA, 16 bp, Homo sapiens
tgtgtcttgtgttttt

SEQ ID NO: 4285242 - DNA, 17 bp, Homo sapiens
tgtgtgagtgtgaatat

SEQ ID NO: 4285243 - DNA, 19 bp, Homo sapiens
tgtgtgcactttttttcta

SEQ ID NO: 4285244 - DNA, 19 bp, Homo sapiens
tgtgtgggggtctgggagg

SEQ ID NO: 4285245 - DNA, 18 bp, Homo sapiens
tgtgtgggtttactctgt

SEQ ID NO: 4285246 - DNA, 19 bp, Homo sapiens
tgtgttagtgtctgtccat

SEQ ID NO: 4285247 - DNA, 21 bp, Homo sapiens
tgtgttgcaaattattctagt

SEQ ID NO: 4285248 - DNA, 14 bp, Homo sapiens
tgtgttgggcccca

SEQ ID NO: 4285249 - DNA, 13 bp, Homo sapiens
tgtgttgtgcttt

SEQ ID NO: 4285250 - DNA, 15 bp, Homo sapiens
tgtgttgttttctct

SEQ ID NO: 4285251 - DNA, 17 bp, Homo sapiens
tgtgtttataattgtta

SEQ ID NO: 4285252 - DNA, 18 bp, Homo sapiens
tgtgtttggttctggggc

SEQ ID NO: 4285253 - DNA, 22 bp, Homo sapiens
tgtgtttgtatataaatggtga

SEQ ID NO: 4285254 - DNA, 20 bp, Homo sapiens
tgtgttttattcacttgtgt

SEQ ID NO: 4285255 - DNA, 21 bp, Homo sapiens
tgttaaaacaaattaaaaaca

SEQ ID NO: 4285256 - DNA, 22 bp, Homo sapiens
tgttaaagaggcgtcttgtatt

SEQ ID NO: 4285257 - DNA, 14 bp, Homo sapiens
tgttaacaatgcct

SEQ ID NO: 4285258 - DNA, 23 bp, Homo sapiens
tgttaacaatgcctattgtaata

SEQ ID NO: 4285259 - DNA, 23 bp, Homo sapiens
tgttaacttattcaaagagaaaa

SEQ ID NO: 4285260 - DNA, 22 bp, Homo sapiens
tgttaatatcactcattaatta

SEQ ID NO: 4285261 - DNA, 19 bp, Homo sapiens
tgttaatcttaatgtatat

SEQ ID NO: 4285262 - DNA, 13 bp, Homo sapiens
tgttacttaaata

SEQ ID NO: 4285263 - DNA, 15 bp, Homo sapiens
tgttacttaaatagc

SEQ ID NO: 4285264 - DNA, 17 bp, Homo sapiens
tgttagatgtttgttga

SEQ ID NO: 4285265 - DNA, 16 bp, Homo sapiens
tgttagtgatttgcta

SEQ ID NO: 4285266 - DNA, 12 bp, Homo sapiens
tgttagtgtctg

SEQ ID NO: 4285267 - DNA, 20 bp, Homo sapiens
tgttatacaaccttcattta

SEQ ID NO: 4285268 - DNA, 21 bp, Homo sapiens
tgttatacaaccttcatttaa

SEQ ID NO: 4285269 - DNA, 13 bp, Homo sapiens
tgttattaaatgt

SEQ ID NO: 4285270 - DNA, 19 bp, Homo sapiens
tgttcaaagaacccccctc

SEQ ID NO: 4285271 - DNA, 18 bp, Homo sapiens
tgttcacgcaacttgaaa

SEQ ID NO: 4285272 - DNA, 12 bp, Homo sapiens
tgttccctgctg

SEQ ID NO: 4285273 - DNA, 21 bp, Homo sapiens
tgttccctgctgggtgggaat

SEQ ID NO: 4285274 - DNA, 21 bp, Homo sapiens
tgttcctatattccaggttta

SEQ ID NO: 4285275 - DNA, 19 bp, Homo sapiens
tgttcgtggagccacaggc

SEQ ID NO: 4285276 - DNA, 14 bp, Homo sapiens
tgttctcagagctc

SEQ ID NO: 4285277 - DNA, 15 bp, Homo sapiens
tgttctgataatgaa

SEQ ID NO: 4285278 - DNA, 12 bp, Homo sapiens
tgttctggcctc

SEQ ID NO: 4285279 - DNA, 17 bp, Homo sapiens
tgttctgtgtctgctgt

SEQ ID NO: 4285280 - DNA, 21 bp, Homo sapiens
tgttgagctggtaacatcgtt

SEQ ID NO: 4285281 - DNA, 19 bp, Homo sapiens
tgttgataaaaatactgac

SEQ ID NO: 4285282 - DNA, 13 bp, Homo sapiens
tgttgattaaaac

SEQ ID NO: 4285283 - DNA, 14 bp, Homo sapiens
tgttgcctcctccc

SEQ ID NO: 4285284 - DNA, 16 bp, Homo sapiens
tgttgcctcctcccat

SEQ ID NO: 4285285 - DNA, 18 bp, Homo sapiens
tgttgctgttgttcagaa

SEQ ID NO: 4285286 - DNA, 16 bp, Homo sapiens
tgttgcttagtcactt

SEQ ID NO: 4285287 - DNA, 19 bp, Homo sapiens
tgttggaggggcaggcctt

SEQ ID NO: 4285288 - DNA, 23 bp, Homo sapiens
tgttggataataactagatctcc

SEQ ID NO: 4285289 - DNA, 20 bp, Homo sapiens
tgttgggccccagggaacta

SEQ ID NO: 4285290 - DNA, 12 bp, Homo sapiens
tgttgtccctgc

SEQ ID NO: 4285291 - DNA, 15 bp, Homo sapiens
tgttgtccctgcagg

SEQ ID NO: 4285292 - DNA, 22 bp, Homo sapiens
tgttgtgggggtgtcacagagg

SEQ ID NO: 4285293 - DNA, 24 bp, Homo sapiens
tgttgtgggggtgtcacagaggca

SEQ ID NO: 4285294 - DNA, 17 bp, Homo sapiens
tgttgttcagaagttgt

SEQ ID NO: 4285295 - DNA, 15 bp, Homo sapiens
tgttgtttgatgtgt

SEQ ID NO: 4285296 - DNA, 19 bp, Homo sapiens
tgtttaaaaaaataacatc

SEQ ID NO: 4285297 - DNA, 19 bp, Homo sapiens
tgtttaattgtataaaaca

SEQ ID NO: 4285298 - DNA, 13 bp, Homo sapiens
tgtttaccctccc

SEQ ID NO: 4285299 - DNA, 22 bp, Homo sapiens
tgtttaccctccctgtcccctg

SEQ ID NO: 4285300 - DNA, 12 bp, Homo sapiens
tgtttacctcac

SEQ ID NO: 4285301 - DNA, 17 bp, Homo sapiens
tgtttacctcactggtg

SEQ ID NO: 4285302 - DNA, 22 bp, Homo sapiens
tgtttccaccccctggtgcctg

SEQ ID NO: 4285303 - DNA, 23 bp, Homo sapiens
tgtttccaggcatgaccctggag

SEQ ID NO: 4285304 - DNA, 22 bp, Homo sapiens
tgtttctatactgtttgtaata

SEQ ID NO: 4285305 - DNA, 23 bp, Homo sapiens
tgtttctatactgtttgtaatat

SEQ ID NO: 4285306 - DNA, 16 bp, Homo sapiens
tgtttgaattgatttt

SEQ ID NO: 4285307 - DNA, 20 bp, Homo sapiens
tgtttgatgtgtatgtgttt

SEQ ID NO: 4285308 - DNA, 18 bp, Homo sapiens
tgtttgcctttaggcagg

SEQ ID NO: 4285309 - DNA, 20 bp, Homo sapiens
tgtttggttctggggcccct

SEQ ID NO: 4285310 - DNA, 15 bp, Homo sapiens
tgtttgtatataaat

SEQ ID NO: 4285311 - DNA, 22 bp, Homo sapiens
tgttttattcacttgtgtttgt

SEQ ID NO: 4285312 - DNA, 22 bp, Homo sapiens
tgttttgtgcggtgtgtctcca

SEQ ID NO: 4285313 - DNA, 12 bp, Homo sapiens
tgtttttgtatc

SEQ ID NO: 4285314 - DNA, 19 bp, Homo sapiens
tgttttttttttccactta

SEQ ID NO: 4285315 - DNA, 14 bp, Homo sapiens
ttaaaaaaaaacat

SEQ ID NO: 4285316 - DNA, 15 bp, Homo sapiens
ttaaaaaaataacat

SEQ ID NO: 4285317 - DNA, 22 bp, Homo sapiens
tgctcattttttttttatcaga

SEQ ID NO: 4285318 - DNA, 17 bp, Homo sapiens
tgctccaggcttcctgc

SEQ ID NO: 4285319 - DNA, 20 bp, Homo sapiens
tgctccaggcttcctgccct

SEQ ID NO: 4285320 - DNA, 21 bp, Homo sapiens
tgctccaggcttcctgcccta

SEQ ID NO: 4285321 - DNA, 22 bp, Homo sapiens
tgctccaggcttcctgccctag

SEQ ID NO: 4285322 - DNA, 17 bp, Homo sapiens
tgctccagtgttttctt

SEQ ID NO: 4285323 - DNA, 13 bp, Homo sapiens
tgctccatgcaga

SEQ ID NO: 4285324 - DNA, 16 bp, Homo sapiens
tgctccatgggcacct

SEQ ID NO: 4285325 - DNA, 22 bp, Homo sapiens
tgctccatgggcacctctgctg

SEQ ID NO: 4285326 - DNA, 22 bp, Homo sapiens
tgctcccaaatgcagcttcagg

SEQ ID NO: 4285327 - DNA, 15 bp, Homo sapiens
tgctcctcggccaga

SEQ ID NO: 4285328 - DNA, 20 bp, Homo sapiens
tgctcctctgcctgtgcccg

SEQ ID NO: 4285329 - DNA, 22 bp, Homo sapiens
tgctcctctgcctgtgcccgct

SEQ ID NO: 4285330 - DNA, 12 bp, Homo sapiens
tgctcctgtggc

SEQ ID NO: 4285331 - DNA, 19 bp, Homo sapiens
tgccatggaggcgccttcc

SEQ ID NO: 4285332 - DNA, 22 bp, Homo sapiens
tgccatggtgttggaggggcag

SEQ ID NO: 4285333 - DNA, 16 bp, Homo sapiens
tgcccaccccctgctg

SEQ ID NO: 4285334 - DNA, 16 bp, Homo sapiens
tgcccaccccgcctct

SEQ ID NO: 4285335 - DNA, 22 bp, Homo sapiens
tgcccaccccgcctctgggctc

SEQ ID NO: 4285336 - DNA, 23 bp, Homo sapiens
tgcccaccccgcctctgggctca

SEQ ID NO: 4285337 - DNA, 14 bp, Homo sapiens
tgcccacccttcgc

SEQ ID NO: 4285338 - DNA, 20 bp, Homo sapiens
tgcccaggctggagtgcagt

SEQ ID NO: 4285339 - DNA, 15 bp, Homo sapiens
tgcccagtcttgagt

SEQ ID NO: 4285340 - DNA, 19 bp, Homo sapiens
tgcccagtcttgagtgggc

SEQ ID NO: 4285341 - DNA, 22 bp, Homo sapiens
tgccccacacaggcctggccca

SEQ ID NO: 4285342 - DNA, 23 bp, Homo sapiens
tgccccacacaggcctggcccag

SEQ ID NO: 4285343 - DNA, 16 bp, Homo sapiens
tgccccacccctccat

SEQ ID NO: 4285344 - DNA, 11 bp, Homo sapiens
tgccccagaga

SEQ ID NO: 4285345 - DNA, 17 bp, Homo sapiens
tgcccccagctgctcct

SEQ ID NO: 4285346 - DNA, 17 bp, Homo sapiens
tgccccccacattctgg

SEQ ID NO: 4285347 - DNA, 18 bp, Homo sapiens
tgccccccacattctggc

SEQ ID NO: 4285348 - DNA, 14 bp, Homo sapiens
tgccccccacccca

SEQ ID NO: 4285349 - DNA, 13 bp, Homo sapiens
tgccccccttccc

SEQ ID NO: 4285350 - DNA, 17 bp, Homo sapiens
tgccccctacccggctc

SEQ ID NO: 4285351 - DNA, 17 bp, Homo sapiens
tgcccccttctcccaca

SEQ ID NO: 4285352 - DNA, 19 bp, Homo sapiens
tgcccccttctcccacact

SEQ ID NO: 4285353 - DNA, 15 bp, Homo sapiens
tgccccgccccccag

SEQ ID NO: 4285354 - DNA, 19 bp, Homo sapiens
tgccccgccccccagagcc

SEQ ID NO: 4285355 - DNA, 21 bp, Homo sapiens
tgccccgccccccagagccag

SEQ ID NO: 4285356 - DNA, 19 bp, Homo sapiens
tgccccgtcaccatctcag

SEQ ID NO: 4285357 - DNA, 14 bp, Homo sapiens
tgcccctccccagt

SEQ ID NO: 4285358 - DNA, 15 bp, Homo sapiens
tgcccctcccttcaa

SEQ ID NO: 4285359 - DNA, 18 bp, Homo sapiens
tgcccctgcacctgcttc

SEQ ID NO: 4285360 - DNA, 22 bp, Homo sapiens
tgcccgctgcgctgccctgcaa

SEQ ID NO: 4285361 - DNA, 16 bp, Homo sapiens
tgcccgtgaggagggg

SEQ ID NO: 4285362 - DNA, 23 bp, Homo sapiens
tgcccgtggtgaggttgtgctgc

SEQ ID NO: 4285363 - DNA, 15 bp, Homo sapiens
tgccctcactccact

SEQ ID NO: 4285364 - DNA, 16 bp, Homo sapiens
tgccctcactccactc

SEQ ID NO: 4285365 - DNA, 19 bp, Homo sapiens
tgccctcactccactcccc

SEQ ID NO: 4285366 - DNA, 13 bp, Homo sapiens
tgccctcaggctt

SEQ ID NO: 4285367 - DNA, 14 bp, Homo sapiens
tgccctccctgctg

SEQ ID NO: 4285368 - DNA, 16 bp, Homo sapiens
tgccctccctgctgcc

SEQ ID NO: 4285369 - DNA, 19 bp, Homo sapiens
tgccctccctgctgccagg

SEQ ID NO: 4285370 - DNA, 17 bp, Homo sapiens
tgccctccgtcctggca

SEQ ID NO: 4285371 - DNA, 19 bp, Homo sapiens
tgccctccgtcctggcagg

SEQ ID NO: 4285372 - DNA, 19 bp, Homo sapiens
tgccctcgtctccctggcc

SEQ ID NO: 4285373 - DNA, 15 bp, Homo sapiens
tgccctggcccagcc

SEQ ID NO: 4285374 - DNA, 17 bp, Homo sapiens
tgccctggcccagcctg

SEQ ID NO: 4285375 - DNA, 20 bp, Homo sapiens
tgccctggcccagcctgtgg

SEQ ID NO: 4285376 - DNA, 24 bp, Homo sapiens
tgccctggcccagcctgtggcctc

SEQ ID NO: 4285377 - DNA, 12 bp, Homo sapiens
tgccctggtgct

SEQ ID NO: 4285378 - DNA, 14 bp, Homo sapiens
tgccctggtgctgc

SEQ ID NO: 4285379 - DNA, 17 bp, Homo sapiens
tgccctggtgctgccac

SEQ ID NO: 4285380 - DNA, 20 bp, Homo sapiens
tgccctggtgctgccacact

SEQ ID NO: 4285381 - DNA, 16 bp, Homo sapiens
tgccgaccgaggctgg

SEQ ID NO: 4285382 - DNA, 14 bp, Homo sapiens
tgccgctgggagag

SEQ ID NO: 4285383 - DNA, 22 bp, Homo sapiens
tgccgctgggagagccaaggcc

SEQ ID NO: 4285384 - DNA, 18 bp, Homo sapiens
tgccgtgcacggggccag

SEQ ID NO: 4285385 - DNA, 18 bp, Homo sapiens
tgcctaaatccactctgc

SEQ ID NO: 4285386 - DNA, 17 bp, Homo sapiens
tgcctagggcctggtcc

SEQ ID NO: 4285387 - DNA, 18 bp, Homo sapiens
tgcctagggcctggtcca

SEQ ID NO: 4285388 - DNA, 12 bp, Homo sapiens
tgcctcatgaac

SEQ ID NO: 4285389 - DNA, 15 bp, Homo sapiens
tgcctcatgaacact

SEQ ID NO: 4285390 - DNA, 15 bp, Homo sapiens
tgcctccccaaccct

SEQ ID NO: 4285391 - DNA, 18 bp, Homo sapiens
tgcctccccaaccctgcc

SEQ ID NO: 4285392 - DNA, 21 bp, Homo sapiens
tgcctccccaaccctgcccct

SEQ ID NO: 4285393 - DNA, 23 bp, Homo sapiens
tgcctccccaaccctgcccctgc

SEQ ID NO: 4285394 - DNA, 15 bp, Homo sapiens
tgcctcctcccatcc

SEQ ID NO: 4285395 - DNA, 14 bp, Homo sapiens
tgcctctctgccag

SEQ ID NO: 4285396 - DNA, 19 bp, Homo sapiens
tgcctctgaactgctgctg

SEQ ID NO: 4285397 - DNA, 21 bp, Homo sapiens
tgcctctgaactgctgctggt

SEQ ID NO: 4285398 - DNA, 19 bp, Homo sapiens
tgcctctgcacgtgcacac

SEQ ID NO: 4285399 - DNA, 21 bp, Homo sapiens
tgcctctgcacgtgcacacac

SEQ ID NO: 4285400 - DNA, 17 bp, Homo sapiens
tgcctgagaatgcctag

SEQ ID NO: 4285401 - DNA, 13 bp, Homo sapiens
tgcctgcccaccc

SEQ ID NO: 4285402 - DNA, 14 bp, Homo sapiens
tgcctgcctccggc

SEQ ID NO: 4285403 - DNA, 16 bp, Homo sapiens
tgcctgcctccggccc

SEQ ID NO: 4285404 - DNA, 21 bp, Homo sapiens
tgcctgcctccggccctgccc

SEQ ID NO: 4285405 - DNA, 14 bp, Homo sapiens
tgcctggccctcct

SEQ ID NO: 4285406 - DNA, 17 bp, Homo sapiens
tgcctggccctcctctg

SEQ ID NO: 4285407 - DNA, 17 bp, Homo sapiens
tgcctggggtggaggct

SEQ ID NO: 4285408 - DNA, 11 bp, Homo sapiens
tgcctgtccct

SEQ ID NO: 4285409 - DNA, 23 bp, Homo sapiens
tgcctgtgaccggggtcctgagg

SEQ ID NO: 4285410 - DNA, 19 bp, Homo sapiens
tgcctgtgcccgctgcgct

SEQ ID NO: 4285411 - DNA, 20 bp, Homo sapiens
tgcctgtggtgaggtcctgt

SEQ ID NO: 4285412 - DNA, 21 bp, Homo sapiens
tgcctgtggtgaggtcctgtc

SEQ ID NO: 4285413 - DNA, 22 bp, Homo sapiens
tgcctgtggtgaggtcctgtcc

SEQ ID NO: 4285414 - DNA, 21 bp, Homo sapiens
tgcctgtgtgacatcagtggc

SEQ ID NO: 4285415 - DNA, 13 bp, Homo sapiens
tgccttccacgct

SEQ ID NO: 4285416 - DNA, 19 bp, Homo sapiens
tgccttccacgctgtctcc

SEQ ID NO: 4285417 - DNA, 13 bp, Homo sapiens
tgccttccaggcg

SEQ ID NO: 4285418 - DNA, 12 bp, Homo sapiens
tgccttctgggg

SEQ ID NO: 4285419 - DNA, 14 bp, Homo sapiens
tgccttctggggag

SEQ ID NO: 4285420 - DNA, 22 bp, Homo sapiens
tgccttctggggagggacacag

SEQ ID NO: 4285421 - DNA, 15 bp, Homo sapiens
tgccttctgtctctt

SEQ ID NO: 4285422 - DNA, 18 bp, Homo sapiens
tgcctttagcgtgtaaat

SEQ ID NO: 4285423 - DNA, 14 bp, Homo sapiens
tgcctttaggcagg

SEQ ID NO: 4285424 - DNA, 15 bp, Homo sapiens
tgcctttgctgcctt

SEQ ID NO: 4285425 - DNA, 17 bp, Homo sapiens
tgcctttgctgccttct

SEQ ID NO: 4285426 - DNA, 18 bp, Homo sapiens
tgcctttgctgccttctg

SEQ ID NO: 4285427 - DNA, 19 bp, Homo sapiens
tgcctttgctgccttctgt

SEQ ID NO: 4285428 - DNA, 18 bp, Homo sapiens
tgccttttagttcctgtg

SEQ ID NO: 4285429 - DNA, 15 bp, Homo sapiens
tgccttttccctctg

SEQ ID NO: 4285430 - DNA, 21 bp, Homo sapiens
tgcgagaacacaagccacgcc

SEQ ID NO: 4285431 - DNA, 11 bp, Homo sapiens
tgcgatgtgtt

SEQ ID NO: 4285432 - DNA, 12 bp, Homo sapiens
tgcgatgtgttt

SEQ ID NO: 4285433 - DNA, 14 bp, Homo sapiens
tgcgccctccctcc

SEQ ID NO: 4285434 - DNA, 19 bp, Homo sapiens
tgcgccctccctccctcca

SEQ ID NO: 4285435 - DNA, 17 bp, Homo sapiens
tgcgccctgacatgcta

SEQ ID NO: 4285436 - DNA, 21 bp, Homo sapiens
tgcgctagagcattctggggt

SEQ ID NO: 4285437 - DNA, 22 bp, Homo sapiens
tgcgctagagcattctggggtg

SEQ ID NO: 4285438 - DNA, 19 bp, Homo sapiens
tgcgctcttcaccaggaag

SEQ ID NO: 4285439 - DNA, 20 bp, Homo sapiens
tgcgctcttcaccaggaaga

SEQ ID NO: 4285440 - DNA, 17 bp, Homo sapiens
tgcgctgccctgcaaac

SEQ ID NO: 4285441 - DNA, 23 bp, Homo sapiens
tgcgctgtgctggtctctaggcc

SEQ ID NO: 4285442 - DNA, 19 bp, Homo sapiens
tgcggagcttctccagcca

SEQ ID NO: 4285443 - DNA, 16 bp, Homo sapiens
tgcggctgcccacgct

SEQ ID NO: 4285444 - DNA, 17 bp, Homo sapiens
tgcgtggcctggggctg

SEQ ID NO: 4285445 - DNA, 21 bp, Homo sapiens
tgcgtgggtggggagggaggt

SEQ ID NO: 4285446 - DNA, 14 bp, Homo sapiens
tgctaatgtaatca

SEQ ID NO: 4285447 - DNA, 21 bp, Homo sapiens
tgctaatgtaatcatttatct

SEQ ID NO: 4285448 - DNA, 18 bp, Homo sapiens
tgctacagtagctgtggg

SEQ ID NO: 4285449 - DNA, 14 bp, Homo sapiens
tgctaggtgggcca

SEQ ID NO: 4285450 - DNA, 15 bp, Homo sapiens
tgctaggtgggccag

SEQ ID NO: 4285451 - DNA, 17 bp, Homo sapiens
tgctaggtgggccagcc

SEQ ID NO: 4285452 - DNA, 22 bp, Homo sapiens
tgctagtgatacactgtatcta

SEQ ID NO: 4285453 - DNA, 22 bp, Homo sapiens
tgctatcatatattataagatt

SEQ ID NO: 4285454 - DNA, 12 bp, Homo sapiens
tgctatccagcc

SEQ ID NO: 4285455 - DNA, 15 bp, Homo sapiens
tgctatccagccgca

SEQ ID NO: 4285456 - DNA, 17 bp, Homo sapiens
tgctatgtctgtgatgt

SEQ ID NO: 4285457 - DNA, 12 bp, Homo sapiens
tgctattaatat

SEQ ID NO: 4285458 - DNA, 16 bp, Homo sapiens
tgctattaatatttgt

SEQ ID NO: 4285459 - DNA, 15 bp, Homo sapiens
tgctcaacctacagt

SEQ ID NO: 4285460 - DNA, 16 bp, Homo sapiens
tgctcaataaaggtca

SEQ ID NO: 4285461 - DNA, 13 bp, Homo sapiens
tgctcacccagga

SEQ ID NO: 4285462 - DNA, 15 bp, Homo sapiens
tgctcagatgctggt

SEQ ID NO: 4285463 - DNA, 22 bp, Homo sapiens
tgctcagatgctggtcatcctg

SEQ ID NO: 4285464 - DNA, 17 bp, Homo sapiens
tgctcaggcctcacctg

SEQ ID NO: 4285465 - DNA, 22 bp, Homo sapiens
tgattctcatgcactgcaaata

SEQ ID NO: 4285466 - DNA, 13 bp, Homo sapiens
tgattctcctctc

SEQ ID NO: 4285467 - DNA, 17 bp, Homo sapiens
tgattgaaaagaagaaa

SEQ ID NO: 4285468 - DNA, 20 bp, Homo sapiens
tgattgaagtatctgtacct

SEQ ID NO: 4285469 - DNA, 23 bp, Homo sapiens
tgattggacattttcttcagaga

SEQ ID NO: 4285470 - DNA, 20 bp, Homo sapiens
tgattggcagcttcaaaaca

SEQ ID NO: 4285471 - DNA, 16 bp, Homo sapiens
tgattgtttaattgta

SEQ ID NO: 4285472 - DNA, 13 bp, Homo sapiens
tgattttaacttt

SEQ ID NO: 4285473 - DNA, 12 bp, Homo sapiens
tgcaaaggactg

SEQ ID NO: 4285474 - DNA, 20 bp, Homo sapiens
tgcaaatacttccaaagagt

SEQ ID NO: 4285475 - DNA, 13 bp, Homo sapiens
tgcaaattattct

SEQ ID NO: 4285476 - DNA, 19 bp, Homo sapiens
tgcaaattattctagtcaa

SEQ ID NO: 4285477 - DNA, 14 bp, Homo sapiens
tgcaacacacagac

SEQ ID NO: 4285478 - DNA, 15 bp, Homo sapiens
tgcaaccttttatgt

SEQ ID NO: 4285479 - DNA, 13 bp, Homo sapiens
tgcaactttagaa

SEQ ID NO: 4285480 - DNA, 16 bp, Homo sapiens
tgcaactttagaaaga

SEQ ID NO: 4285481 - DNA, 18 bp, Homo sapiens
tgcaactttagaaagaaa

SEQ ID NO: 4285482 - DNA, 20 bp, Homo sapiens
tgcaactttagaaagaaatt

SEQ ID NO: 4285483 - DNA, 22 bp, Homo sapiens
tgcaagtatgttttagcatgtg

SEQ ID NO: 4285484 - DNA, 22 bp, Homo sapiens
tgcaatatgaggggactgcatg

SEQ ID NO: 4285485 - DNA, 17 bp, Homo sapiens
tgcacacacctgcacac

SEQ ID NO: 4285486 - DNA, 14 bp, Homo sapiens
tgcacacccctgca

SEQ ID NO: 4285487 - DNA, 15 bp, Homo sapiens
tgcacacccctgcac

SEQ ID NO: 4285488 - DNA, 22 bp, Homo sapiens
tgcacaccgtccctctccccgg

SEQ ID NO: 4285489 - DNA, 15 bp, Homo sapiens
tgcacagcatctcag

SEQ ID NO: 4285490 - DNA, 11 bp, Homo sapiens
tgcacagctgt

SEQ ID NO: 4285491 - DNA, 14 bp, Homo sapiens
tgcacagctgtcca

SEQ ID NO: 4285492 - DNA, 15 bp, Homo sapiens
tgcacagtgcatctc

SEQ ID NO: 4285493 - DNA, 16 bp, Homo sapiens
tgcacagtgcatctca

SEQ ID NO: 4285494 - DNA, 20 bp, Homo sapiens
tgcacagtgcatctcagccc

SEQ ID NO: 4285495 - DNA, 23 bp, Homo sapiens
tgcacattaggaacagagtatat

SEQ ID NO: 4285496 - DNA, 14 bp, Homo sapiens
tgcaccccacagga

SEQ ID NO: 4285497 - DNA, 15 bp, Homo sapiens
tgcacccctggtgtc

SEQ ID NO: 4285498 - DNA, 22 bp, Homo sapiens
tgcacccgtgccacgcgctctg

SEQ ID NO: 4285499 - DNA, 20 bp, Homo sapiens
tgcaccctctgctatgtctg

SEQ ID NO: 4285500 - DNA, 23 bp, Homo sapiens
tgcaccctctgctatgtctgtga

SEQ ID NO: 4285501 - DNA, 12 bp, Homo sapiens
tgcacctgcagg

SEQ ID NO: 4285502 - DNA, 15 bp, Homo sapiens
tgcacctgcagggag

SEQ ID NO: 4285503 - DNA, 19 bp, Homo sapiens
tgcacctgcagggagcagc

SEQ ID NO: 4285504 - DNA, 13 bp, Homo sapiens
tgcacctgcttct

SEQ ID NO: 4285505 - DNA, 14 bp, Homo sapiens
tgcacctgcttctc

SEQ ID NO: 4285506 - DNA, 20 bp, Homo sapiens
tgcacgtgcacacacctgca

SEQ ID NO: 4285507 - DNA, 17 bp, Homo sapiens
tgcactgccctccgccc

SEQ ID NO: 4285508 - DNA, 17 bp, Homo sapiens
tgcactggccttctgat

SEQ ID NO: 4285509 - DNA, 22 bp, Homo sapiens
tgcactgtcccggagctcaggc

SEQ ID NO: 4285510 - DNA, 15 bp, Homo sapiens
tgcacttggcctctt

SEQ ID NO: 4285511 - DNA, 18 bp, Homo sapiens
tgcactttttttctatat

SEQ ID NO: 4285512 - DNA, 14 bp, Homo sapiens
tgcagaaccagtcc

SEQ ID NO: 4285513 - DNA, 15 bp, Homo sapiens
tgcagaccaggaagg

SEQ ID NO: 4285514 - DNA, 15 bp, Homo sapiens
tgcagacctgggact

SEQ ID NO: 4285515 - DNA, 17 bp, Homo sapiens
tgcagacctgggacttt

SEQ ID NO: 4285516 - DNA, 14 bp, Homo sapiens
tgcagatctagcca

SEQ ID NO: 4285517 - DNA, 15 bp, Homo sapiens
tgcagatctagccag

SEQ ID NO: 4285518 - DNA, 16 bp, Homo sapiens
tgcagatctagccagg

SEQ ID NO: 4285519 - DNA, 18 bp, Homo sapiens
tgcagatctagccaggcc

SEQ ID NO: 4285520 - DNA, 21 bp, Homo sapiens
tgcagcacattgccctgaggg

SEQ ID NO: 4285521 - DNA, 15 bp, Homo sapiens
tgcagccccaggcct

SEQ ID NO: 4285522 - DNA, 16 bp, Homo sapiens
tgcagccccaggcctc

SEQ ID NO: 4285523 - DNA, 19 bp, Homo sapiens
tgcagccggggagctgagg

SEQ ID NO: 4285524 - DNA, 15 bp, Homo sapiens
tgcagcgaggtccac

SEQ ID NO: 4285525 - DNA, 18 bp, Homo sapiens
tgcagcttcaggtgagcc

SEQ ID NO: 4285526 - DNA, 20 bp, Homo sapiens
tgcagcttcaggtgagccaa

SEQ ID NO: 4285527 - DNA, 12 bp, Homo sapiens
tgcaggaatcaa

SEQ ID NO: 4285528 - DNA, 14 bp, Homo sapiens
tgcaggactcgggc

SEQ ID NO: 4285529 - DNA, 21 bp, Homo sapiens
tgcaggctggcaccgccttct

SEQ ID NO: 4285530 - DNA, 13 bp, Homo sapiens
tgcagggagcagc

SEQ ID NO: 4285531 - DNA, 21 bp, Homo sapiens
tgcagggcagcctgtgggaga

SEQ ID NO: 4285532 - DNA, 22 bp, Homo sapiens
tgcagggcagcctgtgggagaa

SEQ ID NO: 4285533 - DNA, 22 bp, Homo sapiens
tgcagggtagggggcctgagtt

SEQ ID NO: 4285534 - DNA, 13 bp, Homo sapiens
tgcagggtggcat

SEQ ID NO: 4285535 - DNA, 16 bp, Homo sapiens
tgcagtcagcacagag

SEQ ID NO: 4285536 - DNA, 17 bp, Homo sapiens
tgcagtcagcacagaga

SEQ ID NO: 4285537 - DNA, 17 bp, Homo sapiens
tgcagttagcacagagg

SEQ ID NO: 4285538 - DNA, 18 bp, Homo sapiens
tgcagttagcacagagga

SEQ ID NO: 4285539 - DNA, 15 bp, Homo sapiens
tgcataagcctcagg

SEQ ID NO: 4285540 - DNA, 16 bp, Homo sapiens
tgcataagcctcaggc

SEQ ID NO: 4285541 - DNA, 20 bp, Homo sapiens
tgcataagcctcaggcctgg

SEQ ID NO: 4285542 - DNA, 22 bp, Homo sapiens
tgcataagcctcaggcctggcc

SEQ ID NO: 4285543 - DNA, 22 bp, Homo sapiens
tgcatacttcctggattttctt

SEQ ID NO: 4285544 - DNA, 21 bp, Homo sapiens
tgcatatcctggtgtctagtt

SEQ ID NO: 4285545 - DNA, 16 bp, Homo sapiens
tgcatccctccacccc

SEQ ID NO: 4285546 - DNA, 19 bp, Homo sapiens
tgcatcccttggcccctct

SEQ ID NO: 4285547 - DNA, 22 bp, Homo sapiens
tgcatcccttggcccctctctg

SEQ ID NO: 4285548 - DNA, 13 bp, Homo sapiens
tgcatcctcagcc

SEQ ID NO: 4285549 - DNA, 17 bp, Homo sapiens
tgcatcctcagccccag

SEQ ID NO: 4285550 - DNA, 21 bp, Homo sapiens
tgcatcctcagccccagggcc

SEQ ID NO: 4285551 - DNA, 18 bp, Homo sapiens
tgcatgaaggtctacctg

SEQ ID NO: 4285552 - DNA, 16 bp, Homo sapiens
tgcatgatattgtatg

SEQ ID NO: 4285553 - DNA, 18 bp, Homo sapiens
tgcatgatattgtatgta

SEQ ID NO: 4285554 - DNA, 20 bp, Homo sapiens
tgcatgctcctctgcctgtg

SEQ ID NO: 4285555 - DNA, 20 bp, Homo sapiens
tgcatggcctcccagccacc

SEQ ID NO: 4285556 - DNA, 12 bp, Homo sapiens
tgcatgtctgca

SEQ ID NO: 4285557 - DNA, 22 bp, Homo sapiens
tgcatgtgattggcagcttcaa

SEQ ID NO: 4285558 - DNA, 16 bp, Homo sapiens
tgcattaaaagactgt

SEQ ID NO: 4285559 - DNA, 15 bp, Homo sapiens
tgcattactgcatgc

SEQ ID NO: 4285560 - DNA, 15 bp, Homo sapiens
tgcatttaaaatgga

SEQ ID NO: 4285561 - DNA, 16 bp, Homo sapiens
tgcatttaaaatggac

SEQ ID NO: 4285562 - DNA, 20 bp, Homo sapiens
tgcatttatgagctcttcat

SEQ ID NO: 4285563 - DNA, 13 bp, Homo sapiens
tgcatttctgggc

SEQ ID NO: 4285564 - DNA, 14 bp, Homo sapiens
tgcatttctgggcc

SEQ ID NO: 4285565 - DNA, 22 bp, Homo sapiens
tgcatttgtgcgtatgcagtgt

SEQ ID NO: 4285566 - DNA, 17 bp, Homo sapiens
tgccaaatcctgggcat

SEQ ID NO: 4285567 - DNA, 22 bp, Homo sapiens
tgccaaatcctgggcatcccca

SEQ ID NO: 4285568 - DNA, 15 bp, Homo sapiens
tgccaaccacctctg

SEQ ID NO: 4285569 - DNA, 16 bp, Homo sapiens
tgccaaccacctctgg

SEQ ID NO: 4285570 - DNA, 13 bp, Homo sapiens
tgccacacttcag

SEQ ID NO: 4285571 - DNA, 16 bp, Homo sapiens
tgccacacttcaggct

SEQ ID NO: 4285572 - DNA, 20 bp, Homo sapiens
tgccaccctctgcagggcag

SEQ ID NO: 4285573 - DNA, 18 bp, Homo sapiens
tgccacgcgctctgcatg

SEQ ID NO: 4285574 - DNA, 19 bp, Homo sapiens
tgccacgcgctctgcatgc

SEQ ID NO: 4285575 - DNA, 18 bp, Homo sapiens
tgccacggcagccaccct

SEQ ID NO: 4285576 - DNA, 15 bp, Homo sapiens
tgccactaggccctg

SEQ ID NO: 4285577 - DNA, 16 bp, Homo sapiens
tgccactaggccctgg

SEQ ID NO: 4285578 - DNA, 21 bp, Homo sapiens
tgccactctcctgaggagcag

SEQ ID NO: 4285579 - DNA, 18 bp, Homo sapiens
tgccagaagtgtgttttg

SEQ ID NO: 4285580 - DNA, 14 bp, Homo sapiens
tgccagaggcctgg

SEQ ID NO: 4285581 - DNA, 15 bp, Homo sapiens
tgccagaggcctggt

SEQ ID NO: 4285582 - DNA, 17 bp, Homo sapiens
tgccagaggcctggtgc

SEQ ID NO: 4285583 - DNA, 23 bp, Homo sapiens
tgccagaggcctggtgccctggc

SEQ ID NO: 4285584 - DNA, 16 bp, Homo sapiens
tgccagccgctggtgc

SEQ ID NO: 4285585 - DNA, 16 bp, Homo sapiens
tgccagctgcttctgc

SEQ ID NO: 4285586 - DNA, 22 bp, Homo sapiens
tgccaggaaaggagagtacttt

SEQ ID NO: 4285587 - DNA, 12 bp, Homo sapiens
tgccaggagtgg

SEQ ID NO: 4285588 - DNA, 17 bp, Homo sapiens
tgccaggagtgggtggg

SEQ ID NO: 4285589 - DNA, 23 bp, Homo sapiens
tgccaggagtgggtgggacacag

SEQ ID NO: 4285590 - DNA, 16 bp, Homo sapiens
tgccaggcagctgcag

SEQ ID NO: 4285591 - DNA, 21 bp, Homo sapiens
tgccaggctcccactgcccct

SEQ ID NO: 4285592 - DNA, 15 bp, Homo sapiens
tgccagtgactgctg

SEQ ID NO: 4285593 - DNA, 13 bp, Homo sapiens
tgccatcagcccc

SEQ ID NO: 4285594 - DNA, 15 bp, Homo sapiens
tgccatcagcccctg

SEQ ID NO: 4285595 - DNA, 16 bp, Homo sapiens
tgccatcagcccctgc

SEQ ID NO: 4285596 - DNA, 18 bp, Homo sapiens
tgccatcagcccctgctg

SEQ ID NO: 4285597 - DNA, 20 bp, Homo sapiens
tgccatcagcccctgctgct

SEQ ID NO: 4285598 - DNA, 16 bp, Homo sapiens
tgccatggaggcgcct

SEQ ID NO: 4285599 - DNA, 16 bp, Homo sapiens
tgaccccagctccagg

SEQ ID NO: 4285600 - DNA, 18 bp, Homo sapiens
tgaccccagctccaggca

SEQ ID NO: 4285601 - DNA, 21 bp, Homo sapiens
tgaccccagctccaggcagga

SEQ ID NO: 4285602 - DNA, 20 bp, Homo sapiens
tgacccggaggccacatgag

SEQ ID NO: 4285603 - DNA, 13 bp, Homo sapiens
tgaccctggagct

SEQ ID NO: 4285604 - DNA, 15 bp, Homo sapiens
tgaccctggagctag

SEQ ID NO: 4285605 - DNA, 20 bp, Homo sapiens
tgaccggggtcctgaggctg

SEQ ID NO: 4285606 - DNA, 18 bp, Homo sapiens
tgacctaaatccattttc

SEQ ID NO: 4285607 - DNA, 15 bp, Homo sapiens
tgacctcaacaaaga

SEQ ID NO: 4285608 - DNA, 17 bp, Homo sapiens
tgacctcaacctgtgat

SEQ ID NO: 4285609 - DNA, 18 bp, Homo sapiens
tgacctcaacctgtgatg

SEQ ID NO: 4285610 - DNA, 19 bp, Homo sapiens
tgacctgtggggatttctc

SEQ ID NO: 4285611 - DNA, 14 bp, Homo sapiens
tgaccttctgggaa

SEQ ID NO: 4285612 - DNA, 16 bp, Homo sapiens
tgaccttgatgtcttg

SEQ ID NO: 4285613 - DNA, 15 bp, Homo sapiens
tgacctttaggtatt

SEQ ID NO: 4285614 - DNA, 17 bp, Homo sapiens
tgacgtattgtgaaatt

SEQ ID NO: 4285615 - DNA, 17 bp, Homo sapiens
tgactaggaagaaaaca

SEQ ID NO: 4285616 - DNA, 18 bp, Homo sapiens
tgactagggtcctcaggc

SEQ ID NO: 4285617 - DNA, 19 bp, Homo sapiens
tgactagggtcctcaggca

SEQ ID NO: 4285618 - DNA, 21 bp, Homo sapiens
tgactataaacattaaaagaa

SEQ ID NO: 4285619 - DNA, 22 bp, Homo sapiens
tgactccaaccattcaaaaatt

SEQ ID NO: 4285620 - DNA, 12 bp, Homo sapiens
tgactccaggag

SEQ ID NO: 4285621 - DNA, 21 bp, Homo sapiens
tgactcgcttagctgaaacct

SEQ ID NO: 4285622 - DNA, 16 bp, Homo sapiens
tgactctttattgtct

SEQ ID NO: 4285623 - DNA, 21 bp, Homo sapiens
tgactctttattgtctgtaaa

SEQ ID NO: 4285624 - DNA, 21 bp, Homo sapiens
tgactgaacgatccttcaaag

SEQ ID NO: 4285625 - DNA, 20 bp, Homo sapiens
tgactgctgcgctgtgctgg

SEQ ID NO: 4285626 - DNA, 16 bp, Homo sapiens
tgactgtactcctccc

SEQ ID NO: 4285627 - DNA, 17 bp, Homo sapiens
tgactgtttttgtagtg

SEQ ID NO: 4285628 - DNA, 20 bp, Homo sapiens
tgacttcgactgtgacctgt

SEQ ID NO: 4285629 - DNA, 16 bp, Homo sapiens
tgacttctcaggaaga

SEQ ID NO: 4285630 - DNA, 20 bp, Homo sapiens
tgacttctttactaacactg

SEQ ID NO: 4285631 - DNA, 22 bp, Homo sapiens
tgacttctttactaacactggc

SEQ ID NO: 4285632 - DNA, 23 bp, Homo sapiens
tgacttctttactaacactggct

SEQ ID NO: 4285633 - DNA, 22 bp, Homo sapiens
tgagaaaactgtgaccaagtat

SEQ ID NO: 4285634 - DNA, 20 bp, Homo sapiens
tgagaaatttttttccagaa

SEQ ID NO: 4285635 - DNA, 13 bp, Homo sapiens
tgagaagataaaa

SEQ ID NO: 4285636 - DNA, 20 bp, Homo sapiens
tgagaagcctcatgggagtc

SEQ ID NO: 4285637 - DNA, 21 bp, Homo sapiens
tgagaataaatgagcattttt

SEQ ID NO: 4285638 - DNA, 14 bp, Homo sapiens
tgagaatgcctagg

SEQ ID NO: 4285639 - DNA, 15 bp, Homo sapiens
tgagaatgcctaggc

SEQ ID NO: 4285640 - DNA, 20 bp, Homo sapiens
tgagaatgcctaggccagct

SEQ ID NO: 4285641 - DNA, 13 bp, Homo sapiens
tgagactctgagg

SEQ ID NO: 4285642 - DNA, 11 bp, Homo sapiens
tgagagagtgt

SEQ ID NO: 4285643 - DNA, 14 bp, Homo sapiens
tgagagcgctggcc

SEQ ID NO: 4285644 - DNA, 23 bp, Homo sapiens
tgagagtggggctagactgggct

SEQ ID NO: 4285645 - DNA, 21 bp, Homo sapiens
tgagatactttgcattgtctg

SEQ ID NO: 4285646 - DNA, 21 bp, Homo sapiens
tgagatcctcaaaaatcatca

SEQ ID NO: 4285647 - DNA, 23 bp, Homo sapiens
tgagatcctcaaaaatcatcaaa

SEQ ID NO: 4285648 - DNA, 21 bp, Homo sapiens
tgagatggaacccttttggcc

SEQ ID NO: 4285649 - DNA, 18 bp, Homo sapiens
tgagatgtgtatcagtgt

SEQ ID NO: 4285650 - DNA, 19 bp, Homo sapiens
tgagatgtgtatcagtgtt

SEQ ID NO: 4285651 - DNA, 12 bp, Homo sapiens
tgagatttgtat

SEQ ID NO: 4285652 - DNA, 19 bp, Homo sapiens
tgagatttgtatttatatt

SEQ ID NO: 4285653 - DNA, 21 bp, Homo sapiens
tgagcaaactgaagcccacag

SEQ ID NO: 4285654 - DNA, 16 bp, Homo sapiens
tgagcaaggcaagaag

SEQ ID NO: 4285655 - DNA, 15 bp, Homo sapiens
tgagcagaattcatt

SEQ ID NO: 4285656 - DNA, 21 bp, Homo sapiens
tgagccaaggggtctgctcct

SEQ ID NO: 4285657 - DNA, 22 bp, Homo sapiens
tgagccctgccctcactccact

SEQ ID NO: 4285658 - DNA, 19 bp, Homo sapiens
tgagcggccgcctgtcctt

SEQ ID NO: 4285659 - DNA, 14 bp, Homo sapiens
tgagctccagaccc

SEQ ID NO: 4285660 - DNA, 19 bp, Homo sapiens
tgagctccccaatccaacc

SEQ ID NO: 4285661 - DNA, 16 bp, Homo sapiens
tgagctcctctgggca

SEQ ID NO: 4285662 - DNA, 18 bp, Homo sapiens
tgagctcctctgggcagg

SEQ ID NO: 4285663 - DNA, 12 bp, Homo sapiens
tgagctcttcat

SEQ ID NO: 4285664 - DNA, 16 bp, Homo sapiens
tgagctcttcatgttt

SEQ ID NO: 4285665 - DNA, 12 bp, Homo sapiens
tgagctgtgcca

SEQ ID NO: 4285666 - DNA, 17 bp, Homo sapiens
tgagctgtgccagctgc

SEQ ID NO: 4285667 - DNA, 21 bp, Homo sapiens
tgagcttggccagaagggggc

SEQ ID NO: 4285668 - DNA, 18 bp, Homo sapiens
tgaggaacggatcagatg

SEQ ID NO: 4285669 - DNA, 17 bp, Homo sapiens
tgaggacataaatcttc

SEQ ID NO: 4285670 - DNA, 15 bp, Homo sapiens
tgaggacctccacct

SEQ ID NO: 4285671 - DNA, 16 bp, Homo sapiens
tgaggacctccacctg

SEQ ID NO: 4285672 - DNA, 22 bp, Homo sapiens
tgaggacctccacctgggagat

SEQ ID NO: 4285673 - DNA, 23 bp, Homo sapiens
tgaggacctccacctgggagatg

SEQ ID NO: 4285674 - DNA, 12 bp, Homo sapiens
tgaggagcagcc

SEQ ID NO: 4285675 - DNA, 22 bp, Homo sapiens
tgaggagcagcccacctgctgc

SEQ ID NO: 4285676 - DNA, 19 bp, Homo sapiens
tgaggagctcagggctgga

SEQ ID NO: 4285677 - DNA, 17 bp, Homo sapiens
tgaggagggggagaagg

SEQ ID NO: 4285678 - DNA, 14 bp, Homo sapiens
tgaggatgatgtac

SEQ ID NO: 4285679 - DNA, 16 bp, Homo sapiens
tgaggcaaccccctcg

SEQ ID NO: 4285680 - DNA, 17 bp, Homo sapiens
tgaggccagaggaaggg

SEQ ID NO: 4285681 - DNA, 15 bp, Homo sapiens
tgaggccattatttc

SEQ ID NO: 4285682 - DNA, 22 bp, Homo sapiens
tgaggcccccgcacgcaagcct

SEQ ID NO: 4285683 - DNA, 19 bp, Homo sapiens
tgaggcgtgggatccagag

SEQ ID NO: 4285684 - DNA, 14 bp, Homo sapiens
tgagggaaaacata

SEQ ID NO: 4285685 - DNA, 15 bp, Homo sapiens
tgaggggactgcatg

SEQ ID NO: 4285686 - DNA, 17 bp, Homo sapiens
tgagggtgacagaggga

SEQ ID NO: 4285687 - DNA, 13 bp, Homo sapiens
tgagggtgcaggg

SEQ ID NO: 4285688 - DNA, 14 bp, Homo sapiens
tgagggtgcaggga

SEQ ID NO: 4285689 - DNA, 15 bp, Homo sapiens
tgagggtttccacct

SEQ ID NO: 4285690 - DNA, 12 bp, Homo sapiens
tgagtagcatat

SEQ ID NO: 4285691 - DNA, 15 bp, Homo sapiens
tgagtagcatatata

SEQ ID NO: 4285692 - DNA, 17 bp, Homo sapiens
tgagtattcattttgca

SEQ ID NO: 4285693 - DNA, 18 bp, Homo sapiens
tgagtccttaaacagggc

SEQ ID NO: 4285694 - DNA, 23 bp, Homo sapiens
tgagtctcattcctctgtccccg

SEQ ID NO: 4285695 - DNA, 22 bp, Homo sapiens
tgagtctgtgaataaagccaca

SEQ ID NO: 4285696 - DNA, 17 bp, Homo sapiens
tgagtgaagtccagtga

SEQ ID NO: 4285697 - DNA, 16 bp, Homo sapiens
tgagtgacatgcggct

SEQ ID NO: 4285698 - DNA, 16 bp, Homo sapiens
tgagtgtggctcccct

SEQ ID NO: 4285699 - DNA, 14 bp, Homo sapiens
tgagttaagtctat

SEQ ID NO: 4285700 - DNA, 18 bp, Homo sapiens
tgagtttccagctaagcc

SEQ ID NO: 4285701 - DNA, 18 bp, Homo sapiens
tgagttttttctcttggg

SEQ ID NO: 4285702 - DNA, 14 bp, Homo sapiens
tgataacactggag

SEQ ID NO: 4285703 - DNA, 18 bp, Homo sapiens
tgatacactgtatctaaa

SEQ ID NO: 4285704 - DNA, 21 bp, Homo sapiens
tgatacactgtatctaaaaaa

SEQ ID NO: 4285705 - DNA, 15 bp, Homo sapiens
tgatatctgtttgct

SEQ ID NO: 4285706 - DNA, 17 bp, Homo sapiens
tgatattgtatgtacct

SEQ ID NO: 4285707 - DNA, 22 bp, Homo sapiens
tgatattttcaacgcagccctg

SEQ ID NO: 4285708 - DNA, 16 bp, Homo sapiens
tgatcacaacttttct

SEQ ID NO: 4285709 - DNA, 16 bp, Homo sapiens
tgatcacttatcagtt

SEQ ID NO: 4285710 - DNA, 24 bp, Homo sapiens
tgatcactttctgaaattcacaaa

SEQ ID NO: 4285711 - DNA, 20 bp, Homo sapiens
tgatcgatgttaaacgtcac

SEQ ID NO: 4285712 - DNA, 16 bp, Homo sapiens
tgatcgtgtgttgcca

SEQ ID NO: 4285713 - DNA, 22 bp, Homo sapiens
tgatgaataaacactttttctg

SEQ ID NO: 4285714 - DNA, 14 bp, Homo sapiens
tgatgatggaaggg

SEQ ID NO: 4285715 - DNA, 15 bp, Homo sapiens
tgatggaagggcctt

SEQ ID NO: 4285716 - DNA, 13 bp, Homo sapiens
tgatggccaggcc

SEQ ID NO: 4285717 - DNA, 13 bp, Homo sapiens
tgatggtggggcc

SEQ ID NO: 4285718 - DNA, 19 bp, Homo sapiens
tgatgtcttgagagcgctg

SEQ ID NO: 4285719 - DNA, 19 bp, Homo sapiens
tgatgtgacaggaattctc

SEQ ID NO: 4285720 - DNA, 14 bp, Homo sapiens
tgatgttcctggga

SEQ ID NO: 4285721 - DNA, 18 bp, Homo sapiens
tgatgttgataatagtaa

SEQ ID NO: 4285722 - DNA, 13 bp, Homo sapiens
tgattcataacaa

SEQ ID NO: 4285723 - DNA, 15 bp, Homo sapiens
tgattcataacaatg

SEQ ID NO: 4285724 - DNA, 16 bp, Homo sapiens
tgattcataacaatgt

SEQ ID NO: 4285725 - DNA, 17 bp, Homo sapiens
tgattcataacaatgta

SEQ ID NO: 4285726 - DNA, 17 bp, Homo sapiens
tgattcattttaacatc

SEQ ID NO: 4285727 - DNA, 13 bp, Homo sapiens
tgattccaaataa

SEQ ID NO: 4285728 - DNA, 14 bp, Homo sapiens
tgattccaaataaa

SEQ ID NO: 4285729 - DNA, 16 bp, Homo sapiens
tgattccaaataaaac

SEQ ID NO: 4285730 - DNA, 16 bp, Homo sapiens
tgattccaagggccca

SEQ ID NO: 4285731 - DNA, 17 bp, Homo sapiens
tgattccaagggcccag

SEQ ID NO: 4285732 - DNA, 14 bp, Homo sapiens
tgattctcatgcac

SEQ ID NO: 4285733 - DNA, 20 bp, Homo sapiens
tcttcaagtttttttcaaag

SEQ ID NO: 4285734 - DNA, 21 bp, Homo sapiens
tcttcaagtttttttcaaagt

SEQ ID NO: 4285735 - DNA, 14 bp, Homo sapiens
tcttcatacaaagg

SEQ ID NO: 4285736 - DNA, 19 bp, Homo sapiens
tcttcattttttttaattg

SEQ ID NO: 4285737 - DNA, 18 bp, Homo sapiens
tcttccagtgatgttgaa

SEQ ID NO: 4285738 - DNA, 13 bp, Homo sapiens
tcttccatcagca

SEQ ID NO: 4285739 - DNA, 14 bp, Homo sapiens
tcttccatcagcag

SEQ ID NO: 4285740 - DNA, 15 bp, Homo sapiens
tcttccatcagcagt

SEQ ID NO: 4285741 - DNA, 21 bp, Homo sapiens
tcttcccaccaactctctctg

SEQ ID NO: 4285742 - DNA, 13 bp, Homo sapiens
tcttcccatttgt

SEQ ID NO: 4285743 - DNA, 15 bp, Homo sapiens
tcttcccatttgtaa

SEQ ID NO: 4285744 - DNA, 18 bp, Homo sapiens
tcttcccatttgtaatgt

SEQ ID NO: 4285745 - DNA, 19 bp, Homo sapiens
tcttcccatttgtaatgta

SEQ ID NO: 4285746 - DNA, 20 bp, Homo sapiens
tcttccccaacgaaaagcac

SEQ ID NO: 4285747 - DNA, 23 bp, Homo sapiens
tcttcccccttcccctgcgccct

SEQ ID NO: 4285748 - DNA, 20 bp, Homo sapiens
tcttcctccctccctgcagg

SEQ ID NO: 4285749 - DNA, 21 bp, Homo sapiens
tcttcctccctccctgcaggg

SEQ ID NO: 4285750 - DNA, 13 bp, Homo sapiens
tcttcctgtaatc

SEQ ID NO: 4285751 - DNA, 15 bp, Homo sapiens
tcttctctctgtgct

SEQ ID NO: 4285752 - DNA, 20 bp, Homo sapiens
tcttctcttacgctctctgt

SEQ ID NO: 4285753 - DNA, 21 bp, Homo sapiens
tcttcttttaaaccattttct

SEQ ID NO: 4285754 - DNA, 11 bp, Homo sapiens
tcttgaagaat

SEQ ID NO: 4285755 - DNA, 19 bp, Homo sapiens
tcttgagagcgctggcctc

SEQ ID NO: 4285756 - DNA, 14 bp, Homo sapiens
tcttgagatctgct

SEQ ID NO: 4285757 - DNA, 17 bp, Homo sapiens
tcttgagtgggccccct

SEQ ID NO: 4285758 - DNA, 21 bp, Homo sapiens
tcttgagtgggccccctctct

SEQ ID NO: 4285759 - DNA, 18 bp, Homo sapiens
tcttgagtttttcaggta

SEQ ID NO: 4285760 - DNA, 18 bp, Homo sapiens
tcttgcataagcctcagg

SEQ ID NO: 4285761 - DNA, 21 bp, Homo sapiens
tcttgcataagcctcaggcct

SEQ ID NO: 4285762 - DNA, 23 bp, Homo sapiens
tcttgcataagcctcaggcctgg

SEQ ID NO: 4285763 - DNA, 12 bp, Homo sapiens
tcttgcccccca

SEQ ID NO: 4285764 - DNA, 14 bp, Homo sapiens
tcttgctttcacaa

SEQ ID NO: 4285765 - DNA, 16 bp, Homo sapiens
tcttggatctttttgc

SEQ ID NO: 4285766 - DNA, 21 bp, Homo sapiens
tcttggattggtaccagagcc

SEQ ID NO: 4285767 - DNA, 11 bp, Homo sapiens
tcttgggccct

SEQ ID NO: 4285768 - DNA, 18 bp, Homo sapiens
tcttgttttttttttcca

SEQ ID NO: 4285769 - DNA, 20 bp, Homo sapiens
tctttaaagaggagcctttc

SEQ ID NO: 4285770 - DNA, 16 bp, Homo sapiens
tctttaacatacatct

SEQ ID NO: 4285771 - DNA, 17 bp, Homo sapiens
tctttaacatacatcta

SEQ ID NO: 4285772 - DNA, 19 bp, Homo sapiens
tctttaacatacatctaag

SEQ ID NO: 4285773 - DNA, 22 bp, Homo sapiens
tctttaacatacatctaagtca

SEQ ID NO: 4285774 - DNA, 15 bp, Homo sapiens
tctttactaacactg

SEQ ID NO: 4285775 - DNA, 13 bp, Homo sapiens
tctttattgtctg

SEQ ID NO: 4285776 - DNA, 21 bp, Homo sapiens
tctttcctttcatcctcagca

SEQ ID NO: 4285777 - DNA, 21 bp, Homo sapiens
tctttctccaaagttatccag

SEQ ID NO: 4285778 - DNA, 14 bp, Homo sapiens
tctttgcttgtcct

SEQ ID NO: 4285779 - DNA, 17 bp, Homo sapiens
tctttgcttgtcctgct

SEQ ID NO: 4285780 - DNA, 14 bp, Homo sapiens
tctttgtgtgctgt

SEQ ID NO: 4285781 - DNA, 15 bp, Homo sapiens
tcttttaatgatact

SEQ ID NO: 4285782 - DNA, 17 bp, Homo sapiens
tcttttatatctgtaaa

SEQ ID NO: 4285783 - DNA, 23 bp, Homo sapiens
tcttttatatctgtaaatttaac

SEQ ID NO: 4285784 - DNA, 15 bp, Homo sapiens
tcttttcaaacacac

SEQ ID NO: 4285785 - DNA, 16 bp, Homo sapiens
tcttttcagcttgttt

SEQ ID NO: 4285786 - DNA, 19 bp, Homo sapiens
tcttttcagcttgtttcta

SEQ ID NO: 4285787 - DNA, 15 bp, Homo sapiens
tcttttctgaggttt

SEQ ID NO: 4285788 - DNA, 18 bp, Homo sapiens
tctttttaaaaagttgca

SEQ ID NO: 4285789 - DNA, 21 bp, Homo sapiens
tctttttaaaaagttgcacat

SEQ ID NO: 4285790 - DNA, 19 bp, Homo sapiens
tcttttttaaatgaagaaa

SEQ ID NO: 4285791 - DNA, 20 bp, Homo sapiens
tgaaaaatagtgtgtccatg

SEQ ID NO: 4285792 - DNA, 23 bp, Homo sapiens
tgaaaactggaataagaagcaaa

SEQ ID NO: 4285793 - DNA, 17 bp, Homo sapiens
tgaaaactgtttatggt

SEQ ID NO: 4285794 - DNA, 23 bp, Homo sapiens
tgaaaactgtttatggtattttc

SEQ ID NO: 4285795 - DNA, 12 bp, Homo sapiens
tgaaaagaagaa

SEQ ID NO: 4285796 - DNA, 13 bp, Homo sapiens
tgaaaattcaaca

SEQ ID NO: 4285797 - DNA, 17 bp, Homo sapiens
tgaaacacagctgttct

SEQ ID NO: 4285798 - DNA, 21 bp, Homo sapiens
tgaaacacagctgttcttctg

SEQ ID NO: 4285799 - DNA, 14 bp, Homo sapiens
tgaaagagtaaaac

SEQ ID NO: 4285800 - DNA, 14 bp, Homo sapiens
tgaaagtcagttta

SEQ ID NO: 4285801 - DNA, 14 bp, Homo sapiens
tgaaataataatat

SEQ ID NO: 4285802 - DNA, 17 bp, Homo sapiens
tgaaatatatgtgaaag

SEQ ID NO: 4285803 - DNA, 15 bp, Homo sapiens
tgaaatgttaacaat

SEQ ID NO: 4285804 - DNA, 15 bp, Homo sapiens
tgaaattccatttgt

SEQ ID NO: 4285805 - DNA, 18 bp, Homo sapiens
tgaaatttgttaatatat

SEQ ID NO: 4285806 - DNA, 15 bp, Homo sapiens
tgaacaagatttccc

SEQ ID NO: 4285807 - DNA, 16 bp, Homo sapiens
tgaacagcttcactta

SEQ ID NO: 4285808 - DNA, 22 bp, Homo sapiens
tgaacattaatccacatgtttc

SEQ ID NO: 4285809 - DNA, 19 bp, Homo sapiens
tgaactggccgctgggaga

SEQ ID NO: 4285810 - DNA, 21 bp, Homo sapiens
tgaagaaagcctgttgtttaa

SEQ ID NO: 4285811 - DNA, 20 bp, Homo sapiens
tgaagaagaaaacatgtctg

SEQ ID NO: 4285812 - DNA, 13 bp, Homo sapiens
tgaagaatattgt

SEQ ID NO: 4285813 - DNA, 20 bp, Homo sapiens
tgaagaatctacttaaccct

SEQ ID NO: 4285814 - DNA, 18 bp, Homo sapiens
tgaagagcgctcctctgc

SEQ ID NO: 4285815 - DNA, 22 bp, Homo sapiens
tgaagagcgctcctctgccttg

SEQ ID NO: 4285816 - DNA, 14 bp, Homo sapiens
tgaagcaaacacac

SEQ ID NO: 4285817 - DNA, 21 bp, Homo sapiens
tgaagcattctccccagtgta

SEQ ID NO: 4285818 - DNA, 15 bp, Homo sapiens
tgaagcccaggagga

SEQ ID NO: 4285819 - DNA, 12 bp, Homo sapiens
tgaagcctcccg

SEQ ID NO: 4285820 - DNA, 15 bp, Homo sapiens
tgaagggcaggtgct

SEQ ID NO: 4285821 - DNA, 18 bp, Homo sapiens
tgaaggttggaactgctg

SEQ ID NO: 4285822 - DNA, 16 bp, Homo sapiens
tgaagtatctgtacct

SEQ ID NO: 4285823 - DNA, 18 bp, Homo sapiens
tgaagtccagtgaccctg

SEQ ID NO: 4285824 - DNA, 14 bp, Homo sapiens
tgaagtgaatacat

SEQ ID NO: 4285825 - DNA, 13 bp, Homo sapiens
tgaagtgacccca

SEQ ID NO: 4285826 - DNA, 13 bp, Homo sapiens
tgaataaagccac

SEQ ID NO: 4285827 - DNA, 13 bp, Homo sapiens
tgaataagtttta

SEQ ID NO: 4285828 - DNA, 16 bp, Homo sapiens
tgaataattatgttta

SEQ ID NO: 4285829 - DNA, 13 bp, Homo sapiens
tgaatataaatgt

SEQ ID NO: 4285830 - DNA, 18 bp, Homo sapiens
tgaatataaatgtgtgta

SEQ ID NO: 4285831 - DNA, 19 bp, Homo sapiens
tgaatatactcattagaat

SEQ ID NO: 4285832 - DNA, 17 bp, Homo sapiens
tgaatcagacagtggat

SEQ ID NO: 4285833 - DNA, 15 bp, Homo sapiens
tgaatccctttcagt

SEQ ID NO: 4285834 - DNA, 23 bp, Homo sapiens
tgaatctgattggacattttctt

SEQ ID NO: 4285835 - DNA, 14 bp, Homo sapiens
tgaatgctgtacct

SEQ ID NO: 4285836 - DNA, 22 bp, Homo sapiens
tgaatgctgtacctttctgaca

SEQ ID NO: 4285837 - DNA, 14 bp, Homo sapiens
tgaatgtatgtaaa

SEQ ID NO: 4285838 - DNA, 17 bp, Homo sapiens
tgaatgtccccattcta

SEQ ID NO: 4285839 - DNA, 18 bp, Homo sapiens
tgaatgtccccattctat

SEQ ID NO: 4285840 - DNA, 19 bp, Homo sapiens
tgaattacagggaagaaat

SEQ ID NO: 4285841 - DNA, 13 bp, Homo sapiens
tgaattcataaaa

SEQ ID NO: 4285842 - DNA, 15 bp, Homo sapiens
tgaattcataaaaat

SEQ ID NO: 4285843 - DNA, 17 bp, Homo sapiens
tgacaaattttaattat

SEQ ID NO: 4285844 - DNA, 20 bp, Homo sapiens
tgacaaccaccgctccccag

SEQ ID NO: 4285845 - DNA, 21 bp, Homo sapiens
tgacaaccaccgctccccagc

SEQ ID NO: 4285846 - DNA, 15 bp, Homo sapiens
tgacaagccccaggc

SEQ ID NO: 4285847 - DNA, 20 bp, Homo sapiens
tgacaaggtgtttctctgta

SEQ ID NO: 4285848 - DNA, 14 bp, Homo sapiens
tgacaataaataat

SEQ ID NO: 4285849 - DNA, 16 bp, Homo sapiens
tgacaataaataatat

SEQ ID NO: 4285850 - DNA, 22 bp, Homo sapiens
tgacacaaataccagagcacag

SEQ ID NO: 4285851 - DNA, 18 bp, Homo sapiens
tgacacaactcatccaga

SEQ ID NO: 4285852 - DNA, 16 bp, Homo sapiens
tgacacataaatctgt

SEQ ID NO: 4285853 - DNA, 16 bp, Homo sapiens
tgacacggccatgacc

SEQ ID NO: 4285854 - DNA, 16 bp, Homo sapiens
tgacactgtctgctgc

SEQ ID NO: 4285855 - DNA, 14 bp, Homo sapiens
tgacagatgttcca

SEQ ID NO: 4285856 - DNA, 23 bp, Homo sapiens
tgacatcagtggcatggctccag

SEQ ID NO: 4285857 - DNA, 18 bp, Homo sapiens
tgacatgcacagtttgca

SEQ ID NO: 4285858 - DNA, 18 bp, Homo sapiens
tgaccaagtataaacttt

SEQ ID NO: 4285859 - DNA, 13 bp, Homo sapiens
tgaccaatctctg

SEQ ID NO: 4285860 - DNA, 15 bp, Homo sapiens
tgaccaatctctgtg

SEQ ID NO: 4285861 - DNA, 17 bp, Homo sapiens
tgaccaatctctgtgac

SEQ ID NO: 4285862 - DNA, 20 bp, Homo sapiens
tgaccaggctcacaactgtt

SEQ ID NO: 4285863 - DNA, 21 bp, Homo sapiens
tgaccaggctcacaactgttt

SEQ ID NO: 4285864 - DNA, 15 bp, Homo sapiens
tgaccatgcatttta

SEQ ID NO: 4285865 - DNA, 17 bp, Homo sapiens
tgacccattcacatttt

SEQ ID NO: 4285866 - DNA, 21 bp, Homo sapiens
tgaccccacttatgctgctgt

SEQ ID NO: 4285867 - DNA, 11 bp, Homo sapiens
tctcttctcca

SEQ ID NO: 4285868 - DNA, 14 bp, Homo sapiens
tctcttctccactg

SEQ ID NO: 4285869 - DNA, 17 bp, Homo sapiens
tctcttcttactgtatt

SEQ ID NO: 4285870 - DNA, 17 bp, Homo sapiens
tctcttgcataagcctc

SEQ ID NO: 4285871 - DNA, 19 bp, Homo sapiens
tctcttgcataagcctcag

SEQ ID NO: 4285872 - DNA, 18 bp, Homo sapiens
tctcttggctggcttcct

SEQ ID NO: 4285873 - DNA, 13 bp, Homo sapiens
tctgaaaactgtt

SEQ ID NO: 4285874 - DNA, 15 bp, Homo sapiens
tctgaaaactgttta

SEQ ID NO: 4285875 - DNA, 17 bp, Homo sapiens
tctgaaaagaaatgcta

SEQ ID NO: 4285876 - DNA, 14 bp, Homo sapiens
tctgaaaatatttt

SEQ ID NO: 4285877 - DNA, 22 bp, Homo sapiens
tctgaaaatatttttttctagc

SEQ ID NO: 4285878 - DNA, 22 bp, Homo sapiens
tctgaaacacagtcatgtgtca

SEQ ID NO: 4285879 - DNA, 23 bp, Homo sapiens
tctgaaagtatcaccaaaaaatc

SEQ ID NO: 4285880 - DNA, 14 bp, Homo sapiens
tctgaactgctgct

SEQ ID NO: 4285881 - DNA, 20 bp, Homo sapiens
tctgaaggattttaaatgct

SEQ ID NO: 4285882 - DNA, 20 bp, Homo sapiens
tctgaaggccttgttaaaat

SEQ ID NO: 4285883 - DNA, 23 bp, Homo sapiens
tctgaaggttggaactgctgcca

SEQ ID NO: 4285884 - DNA, 18 bp, Homo sapiens
tctgaagtcactgcacag

SEQ ID NO: 4285885 - DNA, 16 bp, Homo sapiens
tctgaatgtagccagc

SEQ ID NO: 4285886 - DNA, 17 bp, Homo sapiens
tctgaatgtagccagcc

SEQ ID NO: 4285887 - DNA, 21 bp, Homo sapiens
tctgaatgtagccagcccaca

SEQ ID NO: 4285888 - DNA, 18 bp, Homo sapiens
tctgaccacacttcctgt

SEQ ID NO: 4285889 - DNA, 22 bp, Homo sapiens
tctgaccacacttcctgtccag

SEQ ID NO: 4285890 - DNA, 17 bp, Homo sapiens
tctgacttctcaggaag

SEQ ID NO: 4285891 - DNA, 17 bp, Homo sapiens
tctgagcagttgttata

SEQ ID NO: 4285892 - DNA, 16 bp, Homo sapiens
tctgagccctgccctc

SEQ ID NO: 4285893 - DNA, 22 bp, Homo sapiens
tctgagccctgccctcactcca

SEQ ID NO: 4285894 - DNA, 23 bp, Homo sapiens
tctgagccttagtttcagctgac

SEQ ID NO: 4285895 - DNA, 17 bp, Homo sapiens
tctgagcggccgcctgt

SEQ ID NO: 4285896 - DNA, 16 bp, Homo sapiens
tctgagtattcatttt

SEQ ID NO: 4285897 - DNA, 20 bp, Homo sapiens
tctgagtgaagtccagtgac

SEQ ID NO: 4285898 - DNA, 13 bp, Homo sapiens
tctgatcaaagca

SEQ ID NO: 4285899 - DNA, 19 bp, Homo sapiens
tctgatcacaacttttctg

SEQ ID NO: 4285900 - DNA, 22 bp, Homo sapiens
tctgattctatgcctgtatttc

SEQ ID NO: 4285901 - DNA, 15 bp, Homo sapiens
tctgattggacattt

SEQ ID NO: 4285902 - DNA, 16 bp, Homo sapiens
tctgatttattttgta

SEQ ID NO: 4285903 - DNA, 22 bp, Homo sapiens
tctgatttattttgtatgaaat

SEQ ID NO: 4285904 - DNA, 17 bp, Homo sapiens
tctgatttgcaaatgca

SEQ ID NO: 4285905 - DNA, 16 bp, Homo sapiens
tctgcaagattctgtg

SEQ ID NO: 4285906 - DNA, 12 bp, Homo sapiens
tctgcaccccac

SEQ ID NO: 4285907 - DNA, 18 bp, Homo sapiens
tctgcacgtgcacacacc

SEQ ID NO: 4285908 - DNA, 19 bp, Homo sapiens
tctgcacgtgcacacacct

SEQ ID NO: 4285909 - DNA, 15 bp, Homo sapiens
tctgcagggcagcct

SEQ ID NO: 4285910 - DNA, 21 bp, Homo sapiens
tctgcagggcagcctgtggga

SEQ ID NO: 4285911 - DNA, 22 bp, Homo sapiens
tctgcagggcagcctgtgggag

SEQ ID NO: 4285912 - DNA, 11 bp, Homo sapiens
tctgcatctcc

SEQ ID NO: 4285913 - DNA, 18 bp, Homo sapiens
tctgcatgctcctctgcc

SEQ ID NO: 4285914 - DNA, 21 bp, Homo sapiens
tctgcatgctcctctgcctgt

SEQ ID NO: 4285915 - DNA, 20 bp, Homo sapiens
tctgccatcagcccctgctg

SEQ ID NO: 4285916 - DNA, 22 bp, Homo sapiens
tctgccatcagcccctgctgct

SEQ ID NO: 4285917 - DNA, 12 bp, Homo sapiens
tctgcccacccc

SEQ ID NO: 4285918 - DNA, 15 bp, Homo sapiens
tctgcccccagctgc

SEQ ID NO: 4285919 - DNA, 18 bp, Homo sapiens
tctgcctgtccctctcag

SEQ ID NO: 4285920 - DNA, 17 bp, Homo sapiens
tctgcctgtgcccgctg

SEQ ID NO: 4285921 - DNA, 15 bp, Homo sapiens
tctgcgccgctgtgc

SEQ ID NO: 4285922 - DNA, 16 bp, Homo sapiens
tctgcgccgctgtgct

SEQ ID NO: 4285923 - DNA, 19 bp, Homo sapiens
tctgcgcggatgtagcatg

SEQ ID NO: 4285924 - DNA, 13 bp, Homo sapiens
tctgcgtcccact

SEQ ID NO: 4285925 - DNA, 13 bp, Homo sapiens
tctgctatgtctg

SEQ ID NO: 4285926 - DNA, 16 bp, Homo sapiens
tctgctatgtctgtga

SEQ ID NO: 4285927 - DNA, 21 bp, Homo sapiens
tctgctccacagaaaccctgt

SEQ ID NO: 4285928 - DNA, 13 bp, Homo sapiens
tctgctcctgtgg

SEQ ID NO: 4285929 - DNA, 21 bp, Homo sapiens
tctgctctgttttgcatggag

SEQ ID NO: 4285930 - DNA, 19 bp, Homo sapiens
tctgctgagctctgacctg

SEQ ID NO: 4285931 - DNA, 12 bp, Homo sapiens
tctgctgaggcc

SEQ ID NO: 4285932 - DNA, 15 bp, Homo sapiens
tctgctgaggccaga

SEQ ID NO: 4285933 - DNA, 18 bp, Homo sapiens
tctgctgaggccagagga

SEQ ID NO: 4285934 - DNA, 22 bp, Homo sapiens
tctgctgaggccagaggaaggg

SEQ ID NO: 4285935 - DNA, 15 bp, Homo sapiens
tctgctgccctccat

SEQ ID NO: 4285936 - DNA, 15 bp, Homo sapiens
tctgctgcctctgaa

SEQ ID NO: 4285937 - DNA, 22 bp, Homo sapiens
tctgctgtaagacggccttgga

SEQ ID NO: 4285938 - DNA, 20 bp, Homo sapiens
tctgctgtattgatatcact

SEQ ID NO: 4285939 - DNA, 14 bp, Homo sapiens
tctggaaaggagga

SEQ ID NO: 4285940 - DNA, 12 bp, Homo sapiens
tctggagcccct

SEQ ID NO: 4285941 - DNA, 13 bp, Homo sapiens
tctggagccccta

SEQ ID NO: 4285942 - DNA, 13 bp, Homo sapiens
tctggaggaggag

SEQ ID NO: 4285943 - DNA, 12 bp, Homo sapiens
tctggagtgtgt

SEQ ID NO: 4285944 - DNA, 14 bp, Homo sapiens
tctggccactctgc

SEQ ID NO: 4285945 - DNA, 17 bp, Homo sapiens
tctggccctgctgcccc

SEQ ID NO: 4285946 - DNA, 18 bp, Homo sapiens
tctggccctgttgtgggg

SEQ ID NO: 4285947 - DNA, 18 bp, Homo sapiens
tctggccgctgcagtcag

SEQ ID NO: 4285948 - DNA, 16 bp, Homo sapiens
tctggcctctggcctg

SEQ ID NO: 4285949 - DNA, 18 bp, Homo sapiens
tctggcctctggcctggg

SEQ ID NO: 4285950 - DNA, 18 bp, Homo sapiens
tctggctaaggcatcatt

SEQ ID NO: 4285951 - DNA, 14 bp, Homo sapiens
tctggctgtggccc

SEQ ID NO: 4285952 - DNA, 15 bp, Homo sapiens
tctggctgtggcccc

SEQ ID NO: 4285953 - DNA, 18 bp, Homo sapiens
tctggctgtggcccctcc

SEQ ID NO: 4285954 - DNA, 21 bp, Homo sapiens
tctggctttggaaagacctgt

SEQ ID NO: 4285955 - DNA, 19 bp, Homo sapiens
tctgggcaggacctcagag

SEQ ID NO: 4285956 - DNA, 13 bp, Homo sapiens
tctgggctcacac

SEQ ID NO: 4285957 - DNA, 19 bp, Homo sapiens
tctgggctcacaccagccc

SEQ ID NO: 4285958 - DNA, 20 bp, Homo sapiens
tctggggagggacacagagg

SEQ ID NO: 4285959 - DNA, 20 bp, Homo sapiens
tctggggtggggcttggaag

SEQ ID NO: 4285960 - DNA, 14 bp, Homo sapiens
tctggtattaaatg

SEQ ID NO: 4285961 - DNA, 15 bp, Homo sapiens
tctgtaaatttaact

SEQ ID NO: 4285962 - DNA, 16 bp, Homo sapiens
tctgtaaatttaactg

SEQ ID NO: 4285963 - DNA, 20 bp, Homo sapiens
tctgtaatatttacaatgta

SEQ ID NO: 4285964 - DNA, 23 bp, Homo sapiens
tctgtaatatttacaatgtatta

SEQ ID NO: 4285965 - DNA, 21 bp, Homo sapiens
tctgtaatcacactctcttct

SEQ ID NO: 4285966 - DNA, 20 bp, Homo sapiens
tctgtatgggtcattctcac

SEQ ID NO: 4285967 - DNA, 17 bp, Homo sapiens
tctgtccatctgtctgt

SEQ ID NO: 4285968 - DNA, 23 bp, Homo sapiens
tctgtcccaggatggtcccagcg

SEQ ID NO: 4285969 - DNA, 12 bp, Homo sapiens
tctgtccctgtc

SEQ ID NO: 4285970 - DNA, 14 bp, Homo sapiens
tctgtccctgtccc

SEQ ID NO: 4285971 - DNA, 18 bp, Homo sapiens
tctgtccctgtccctgcc

SEQ ID NO: 4285972 - DNA, 11 bp, Homo sapiens
tctgtctgagc

SEQ ID NO: 4285973 - DNA, 19 bp, Homo sapiens
tctgtctgagccctgccct

SEQ ID NO: 4285974 - DNA, 14 bp, Homo sapiens
tctgtctgtaagat

SEQ ID NO: 4285975 - DNA, 16 bp, Homo sapiens
tctgtctgtcctaccc

SEQ ID NO: 4285976 - DNA, 12 bp, Homo sapiens
tctgtcttgaag

SEQ ID NO: 4285977 - DNA, 23 bp, Homo sapiens
tctgtgaaagtctcctgtatcat

SEQ ID NO: 4285978 - DNA, 16 bp, Homo sapiens
tctgtgaaatatcatc

SEQ ID NO: 4285979 - DNA, 15 bp, Homo sapiens
tctgtgaacttgatg

SEQ ID NO: 4285980 - DNA, 18 bp, Homo sapiens
tctgtgactcgcttagct

SEQ ID NO: 4285981 - DNA, 22 bp, Homo sapiens
tctgtggattctatatttcata

SEQ ID NO: 4285982 - DNA, 15 bp, Homo sapiens
tctgtggccctctct

SEQ ID NO: 4285983 - DNA, 15 bp, Homo sapiens
tctgtgggcagctgg

SEQ ID NO: 4285984 - DNA, 22 bp, Homo sapiens
tctgtgggcagctggctctgaa

SEQ ID NO: 4285985 - DNA, 16 bp, Homo sapiens
tctgtgtaatctctga

SEQ ID NO: 4285986 - DNA, 17 bp, Homo sapiens
tctgtgtaatctctgat

SEQ ID NO: 4285987 - DNA, 14 bp, Homo sapiens
tctgtgtctgctgt

SEQ ID NO: 4285988 - DNA, 18 bp, Homo sapiens
tctgttcatttcctcaaa

SEQ ID NO: 4285989 - DNA, 12 bp, Homo sapiens
tctgttccacat

SEQ ID NO: 4285990 - DNA, 14 bp, Homo sapiens
tctgttccctgctg

SEQ ID NO: 4285991 - DNA, 22 bp, Homo sapiens
tctgttgaccaatctctattca

SEQ ID NO: 4285992 - DNA, 12 bp, Homo sapiens
tctgtttatgtt

SEQ ID NO: 4285993 - DNA, 16 bp, Homo sapiens
tctgttttgcctgaag

SEQ ID NO: 4285994 - DNA, 16 bp, Homo sapiens
tcttactgttttgtgc

SEQ ID NO: 4285995 - DNA, 13 bp, Homo sapiens
tcttagaagaata

SEQ ID NO: 4285996 - DNA, 16 bp, Homo sapiens
tcttagcttttctgca

SEQ ID NO: 4285997 - DNA, 23 bp, Homo sapiens
tcttatctagcaagaagattcta

SEQ ID NO: 4285998 - DNA, 12 bp, Homo sapiens
tcttatgttgat

SEQ ID NO: 4285999 - DNA, 15 bp, Homo sapiens
tcttcaaatatctct

SEQ ID NO: 4286000 - DNA, 12 bp, Homo sapiens
tcttcaagcctg

SEQ ID NO: 4286001 - DNA, 14 bp, Homo sapiens
tcttcaagcctggc

SEQ ID NO: 4286002 - DNA, 13 bp, Homo sapiens
tcggccgaggcct

SEQ ID NO: 4286003 - DNA, 22 bp, Homo sapiens
tcgggaagatcctccttccagg

SEQ ID NO: 4286004 - DNA, 21 bp, Homo sapiens
tcgggctctctcacccagcct

SEQ ID NO: 4286005 - DNA, 12 bp, Homo sapiens
tcggtcagcagg

SEQ ID NO: 4286006 - DNA, 14 bp, Homo sapiens
tcgtgcatttgtga

SEQ ID NO: 4286007 - DNA, 24 bp, Homo sapiens
tcgtggaaagggtgctgcttccct

SEQ ID NO: 4286008 - DNA, 16 bp, Homo sapiens
tcgtggagccacaggc

SEQ ID NO: 4286009 - DNA, 22 bp, Homo sapiens
tcgttcccccaggggtgagccc

SEQ ID NO: 4286010 - DNA, 15 bp, Homo sapiens
tcgttgacatgcaca

SEQ ID NO: 4286011 - DNA, 14 bp, Homo sapiens
tctaaaaaataact

SEQ ID NO: 4286012 - DNA, 15 bp, Homo sapiens
tctaaaaagtcagat

SEQ ID NO: 4286013 - DNA, 19 bp, Homo sapiens
tctaaaacattaattgagg

SEQ ID NO: 4286014 - DNA, 22 bp, Homo sapiens
tctaaaggtttcactgttcatg

SEQ ID NO: 4286015 - DNA, 21 bp, Homo sapiens
tctaaagttagggcatttttc

SEQ ID NO: 4286016 - DNA, 23 bp, Homo sapiens
tctaaagttagggcatttttctt

SEQ ID NO: 4286017 - DNA, 17 bp, Homo sapiens
tctaaatcatatataat

SEQ ID NO: 4286018 - DNA, 19 bp, Homo sapiens
tctaaatgtttctttttct

SEQ ID NO: 4286019 - DNA, 12 bp, Homo sapiens
tctaacacattt

SEQ ID NO: 4286020 - DNA, 12 bp, Homo sapiens
tctaactgtata

SEQ ID NO: 4286021 - DNA, 16 bp, Homo sapiens
tctaagaaatatctgt

SEQ ID NO: 4286022 - DNA, 15 bp, Homo sapiens
tctaaggcaggatgt

SEQ ID NO: 4286023 - DNA, 20 bp, Homo sapiens
tctaagtcagtttcacatat

SEQ ID NO: 4286024 - DNA, 21 bp, Homo sapiens
tctaatggattataatcagaa

SEQ ID NO: 4286025 - DNA, 13 bp, Homo sapiens
tctacagaaaaac

SEQ ID NO: 4286026 - DNA, 20 bp, Homo sapiens
tctacagctaatcagcattc

SEQ ID NO: 4286027 - DNA, 23 bp, Homo sapiens
tctacagctaatcagcattctca

SEQ ID NO: 4286028 - DNA, 15 bp, Homo sapiens
tctacctgcaggact

SEQ ID NO: 4286029 - DNA, 21 bp, Homo sapiens
tctacctggtctctccttgtt

SEQ ID NO: 4286030 - DNA, 18 bp, Homo sapiens
tctacctgtattgtctga

SEQ ID NO: 4286031 - DNA, 19 bp, Homo sapiens
tctactccatgcacatagt

SEQ ID NO: 4286032 - DNA, 17 bp, Homo sapiens
tctactgagacatgact

SEQ ID NO: 4286033 - DNA, 17 bp, Homo sapiens
tctactttcctgatgtt

SEQ ID NO: 4286034 - DNA, 21 bp, Homo sapiens
tctagaagagtctattgtctc

SEQ ID NO: 4286035 - DNA, 21 bp, Homo sapiens
tctagaaggatgaacagttct

SEQ ID NO: 4286036 - DNA, 21 bp, Homo sapiens
tctagaggcttccttcatttc

SEQ ID NO: 4286037 - DNA, 19 bp, Homo sapiens
tctagcaagaagattctaa

SEQ ID NO: 4286038 - DNA, 15 bp, Homo sapiens
tctagccaggcctcc

SEQ ID NO: 4286039 - DNA, 16 bp, Homo sapiens
tctagccaggcctccc

SEQ ID NO: 4286040 - DNA, 20 bp, Homo sapiens
tctagccaggcctcccgcat

SEQ ID NO: 4286041 - DNA, 21 bp, Homo sapiens
tctagctataacaactctatt

SEQ ID NO: 4286042 - DNA, 22 bp, Homo sapiens
tctagctataacaactctattt

SEQ ID NO: 4286043 - DNA, 15 bp, Homo sapiens
tctagctatgctgta

SEQ ID NO: 4286044 - DNA, 13 bp, Homo sapiens
tctaggcctgaac

SEQ ID NO: 4286045 - DNA, 24 bp, Homo sapiens
tctagtattccagacctgaagaat

SEQ ID NO: 4286046 - DNA, 12 bp, Homo sapiens
tctagtctctga

SEQ ID NO: 4286047 - DNA, 14 bp, Homo sapiens
tctagtctctgatt

SEQ ID NO: 4286048 - DNA, 21 bp, Homo sapiens
tctagttagcaggaaatagtg

SEQ ID NO: 4286049 - DNA, 13 bp, Homo sapiens
tctagtttgcata

SEQ ID NO: 4286050 - DNA, 15 bp, Homo sapiens
tctagtttgcatact

SEQ ID NO: 4286051 - DNA, 14 bp, Homo sapiens
tctatataaatcgc

SEQ ID NO: 4286052 - DNA, 15 bp, Homo sapiens
tctatatatacatgt

SEQ ID NO: 4286053 - DNA, 14 bp, Homo sapiens
tctatatttcatat

SEQ ID NO: 4286054 - DNA, 15 bp, Homo sapiens
tctatatttcatatt

SEQ ID NO: 4286055 - DNA, 17 bp, Homo sapiens
tctatatttcatattga

SEQ ID NO: 4286056 - DNA, 10 bp, Homo sapiens
tctatctact

SEQ ID NO: 4286057 - DNA, 15 bp, Homo sapiens
tctatgcattttctg

SEQ ID NO: 4286058 - DNA, 18 bp, Homo sapiens
tctatgcctgtatttcca

SEQ ID NO: 4286059 - DNA, 18 bp, Homo sapiens
tctattagcttactgatt

SEQ ID NO: 4286060 - DNA, 20 bp, Homo sapiens
tctattagcttactgattaa

SEQ ID NO: 4286061 - DNA, 14 bp, Homo sapiens
tctattgtagcatt

SEQ ID NO: 4286062 - DNA, 18 bp, Homo sapiens
tctattgtagcatttctt

SEQ ID NO: 4286063 - DNA, 15 bp, Homo sapiens
tctatttaaaaaatg

SEQ ID NO: 4286064 - DNA, 16 bp, Homo sapiens
tctatttcataccatg

SEQ ID NO: 4286065 - DNA, 19 bp, Homo sapiens
tctatttctatctgcaaat

SEQ ID NO: 4286066 - DNA, 13 bp, Homo sapiens
tctcaaacctcca

SEQ ID NO: 4286067 - DNA, 18 bp, Homo sapiens
tctcaaacctccaaaagc

SEQ ID NO: 4286068 - DNA, 19 bp, Homo sapiens
tctcaaagtttttacagtg

SEQ ID NO: 4286069 - DNA, 14 bp, Homo sapiens
tctcaatgaaatag

SEQ ID NO: 4286070 - DNA, 15 bp, Homo sapiens
tctcaatgcttttct

SEQ ID NO: 4286071 - DNA, 23 bp, Homo sapiens
tctcacaaataagtaatatcttt

SEQ ID NO: 4286072 - DNA, 22 bp, Homo sapiens
tctcacctgaattcgagacagg

SEQ ID NO: 4286073 - DNA, 16 bp, Homo sapiens
tctcactcctacctgg

SEQ ID NO: 4286074 - DNA, 18 bp, Homo sapiens
tctcactcctacctggta

SEQ ID NO: 4286075 - DNA, 13 bp, Homo sapiens
tctcactctggca

SEQ ID NO: 4286076 - DNA, 21 bp, Homo sapiens
tctcactctggcagcctcaga

SEQ ID NO: 4286077 - DNA, 21 bp, Homo sapiens
tctcactgtgtccctctctct

SEQ ID NO: 4286078 - DNA, 20 bp, Homo sapiens
tctcacttttctccatgagt

SEQ ID NO: 4286079 - DNA, 17 bp, Homo sapiens
tctcagagctccacaga

SEQ ID NO: 4286080 - DNA, 12 bp, Homo sapiens
tctcagcccagg

SEQ ID NO: 4286081 - DNA, 23 bp, Homo sapiens
tctcagcccaggtctcctgggca

SEQ ID NO: 4286082 - DNA, 18 bp, Homo sapiens
tctcaggcatgcctgtgt

SEQ ID NO: 4286083 - DNA, 19 bp, Homo sapiens
tctcaggccacctgccccc

SEQ ID NO: 4286084 - DNA, 10 bp, Homo sapiens
tctcatcatg

SEQ ID NO: 4286085 - DNA, 18 bp, Homo sapiens
tctcatccccaaactgta

SEQ ID NO: 4286086 - DNA, 13 bp, Homo sapiens
tctcattcctctg

SEQ ID NO: 4286087 - DNA, 22 bp, Homo sapiens
tctccacagggacacagtctgg

SEQ ID NO: 4286088 - DNA, 13 bp, Homo sapiens
tctccacccctca

SEQ ID NO: 4286089 - DNA, 16 bp, Homo sapiens
tctccacccctcaagc

SEQ ID NO: 4286090 - DNA, 17 bp, Homo sapiens
tctccacccctcaagcc

SEQ ID NO: 4286091 - DNA, 16 bp, Homo sapiens
tctccacctgaagtga

SEQ ID NO: 4286092 - DNA, 14 bp, Homo sapiens
tctccactgccttc

SEQ ID NO: 4286093 - DNA, 20 bp, Homo sapiens
tctccagacccccacccctt

SEQ ID NO: 4286094 - DNA, 15 bp, Homo sapiens
tctccagctgatttt

SEQ ID NO: 4286095 - DNA, 22 bp, Homo sapiens
tctccaggcccagcctggcccc

SEQ ID NO: 4286096 - DNA, 13 bp, Homo sapiens
tctccatccccat

SEQ ID NO: 4286097 - DNA, 22 bp, Homo sapiens
tctcccatgggggctccagaca

SEQ ID NO: 4286098 - DNA, 20 bp, Homo sapiens
tctccccggacaagcccagg

SEQ ID NO: 4286099 - DNA, 16 bp, Homo sapiens
tctcccctccagaccc

SEQ ID NO: 4286100 - DNA, 17 bp, Homo sapiens
tctcccctgcgcaggcc

SEQ ID NO: 4286101 - DNA, 19 bp, Homo sapiens
tctccctccactcctccca

SEQ ID NO: 4286102 - DNA, 20 bp, Homo sapiens
tctccctccactcctcccaa

SEQ ID NO: 4286103 - DNA, 16 bp, Homo sapiens
tctccctggactctgt

SEQ ID NO: 4286104 - DNA, 23 bp, Homo sapiens
tctccctggactctgtggggcca

SEQ ID NO: 4286105 - DNA, 19 bp, Homo sapiens
tctccctggccacccttgg

SEQ ID NO: 4286106 - DNA, 22 bp, Homo sapiens
tctccctggccacccttggcct

SEQ ID NO: 4286107 - DNA, 18 bp, Homo sapiens
tctcctctctctccctcc

SEQ ID NO: 4286108 - DNA, 21 bp, Homo sapiens
tctcctgggcatctggccctg

SEQ ID NO: 4286109 - DNA, 20 bp, Homo sapiens
tctcctgggccagggtctcg

SEQ ID NO: 4286110 - DNA, 19 bp, Homo sapiens
tctcctgtaattttgtagt

SEQ ID NO: 4286111 - DNA, 15 bp, Homo sapiens
tctctactttcctga

SEQ ID NO: 4286112 - DNA, 13 bp, Homo sapiens
tctctaggcctga

SEQ ID NO: 4286113 - DNA, 15 bp, Homo sapiens
tctctatatatacat

SEQ ID NO: 4286114 - DNA, 17 bp, Homo sapiens
tctctcacccagcctgg

SEQ ID NO: 4286115 - DNA, 14 bp, Homo sapiens
tctctcagcccagg

SEQ ID NO: 4286116 - DNA, 15 bp, Homo sapiens
tctctcagcccaggt

SEQ ID NO: 4286117 - DNA, 15 bp, Homo sapiens
tctctcatgaacctc

SEQ ID NO: 4286118 - DNA, 16 bp, Homo sapiens
tctctccctccactcc

SEQ ID NO: 4286119 - DNA, 17 bp, Homo sapiens
tctctcctctctctccc

SEQ ID NO: 4286120 - DNA, 15 bp, Homo sapiens
tctctccttgttctg

SEQ ID NO: 4286121 - DNA, 19 bp, Homo sapiens
tctctccttgttctgataa

SEQ ID NO: 4286122 - DNA, 14 bp, Homo sapiens
tctctctatatata

SEQ ID NO: 4286123 - DNA, 12 bp, Homo sapiens
tctctctccctc

SEQ ID NO: 4286124 - DNA, 13 bp, Homo sapiens
tctctctgccccc

SEQ ID NO: 4286125 - DNA, 14 bp, Homo sapiens
tctctctgccccca

SEQ ID NO: 4286126 - DNA, 21 bp, Homo sapiens
tctctctgcccccaaaagtgt

SEQ ID NO: 4286127 - DNA, 14 bp, Homo sapiens
tctctgattaaatt

SEQ ID NO: 4286128 - DNA, 14 bp, Homo sapiens
tctctgatttgcaa

SEQ ID NO: 4286129 - DNA, 15 bp, Homo sapiens
tctctggcactttga

SEQ ID NO: 4286130 - DNA, 16 bp, Homo sapiens
tctctggccactctgc

SEQ ID NO: 4286131 - DNA, 13 bp, Homo sapiens
tctctgttcattt

SEQ ID NO: 4286132 - DNA, 17 bp, Homo sapiens
tctctgttcatttcctc

SEQ ID NO: 4286133 - DNA, 18 bp, Homo sapiens
tctctgttcatttcctca

SEQ ID NO: 4286134 - DNA, 20 bp, Homo sapiens
tctcttaccccgtccctttc

SEQ ID NO: 4286135 - DNA, 21 bp, Homo sapiens
tctcttaccccgtccctttcc

SEQ ID NO: 4286136 - DNA, 17 bp, Homo sapiens
tccctgctgccaggctc

SEQ ID NO: 4286137 - DNA, 20 bp, Homo sapiens
tccctggacgcatgcagggc

SEQ ID NO: 4286138 - DNA, 17 bp, Homo sapiens
tccctggactctgtggg

SEQ ID NO: 4286139 - DNA, 11 bp, Homo sapiens
tccctgggctg

SEQ ID NO: 4286140 - DNA, 21 bp, Homo sapiens
tccctgggctggcatggggag

SEQ ID NO: 4286141 - DNA, 23 bp, Homo sapiens
tccctgggctggcatggggaggg

SEQ ID NO: 4286142 - DNA, 13 bp, Homo sapiens
tccctggtgaaag

SEQ ID NO: 4286143 - DNA, 22 bp, Homo sapiens
tcccttcaaccattccccatgg

SEQ ID NO: 4286144 - DNA, 19 bp, Homo sapiens
tcccttcaatcctgtcaat

SEQ ID NO: 4286145 - DNA, 15 bp, Homo sapiens
tcccttctctcagcc

SEQ ID NO: 4286146 - DNA, 20 bp, Homo sapiens
tcccttctctcagcctccac

SEQ ID NO: 4286147 - DNA, 13 bp, Homo sapiens
tcccttggcccct

SEQ ID NO: 4286148 - DNA, 14 bp, Homo sapiens
tccctttccctgca

SEQ ID NO: 4286149 - DNA, 20 bp, Homo sapiens
tccgagcgacggctcctccc

SEQ ID NO: 4286150 - DNA, 15 bp, Homo sapiens
tccgccctgggctct

SEQ ID NO: 4286151 - DNA, 14 bp, Homo sapiens
tccgctaaggcttc

SEQ ID NO: 4286152 - DNA, 19 bp, Homo sapiens
tccgctaaggcttccggct

SEQ ID NO: 4286153 - DNA, 13 bp, Homo sapiens
tccggccctgccc

SEQ ID NO: 4286154 - DNA, 14 bp, Homo sapiens
tccggccctgcccc

SEQ ID NO: 4286155 - DNA, 18 bp, Homo sapiens
tccggtggaaggccttct

SEQ ID NO: 4286156 - DNA, 20 bp, Homo sapiens
tccgtaccatcggtcagcag

SEQ ID NO: 4286157 - DNA, 15 bp, Homo sapiens
tccgtcctggcaggg

SEQ ID NO: 4286158 - DNA, 16 bp, Homo sapiens
tcctaaactctgaaat

SEQ ID NO: 4286159 - DNA, 15 bp, Homo sapiens
tcctaagctgttgga

SEQ ID NO: 4286160 - DNA, 23 bp, Homo sapiens
tcctacaatatcattttcctggg

SEQ ID NO: 4286161 - DNA, 15 bp, Homo sapiens
tcctaccattatggc

SEQ ID NO: 4286162 - DNA, 20 bp, Homo sapiens
tcctagcacaaggagtgccc

SEQ ID NO: 4286163 - DNA, 13 bp, Homo sapiens
tcctaggcctcag

SEQ ID NO: 4286164 - DNA, 13 bp, Homo sapiens
tcctatccctgga

SEQ ID NO: 4286165 - DNA, 15 bp, Homo sapiens
tcctcagccccaggg

SEQ ID NO: 4286166 - DNA, 16 bp, Homo sapiens
tcctcagccccagggc

SEQ ID NO: 4286167 - DNA, 18 bp, Homo sapiens
tcctcaggcagtggccca

SEQ ID NO: 4286168 - DNA, 18 bp, Homo sapiens
tcctcagtctttggggga

SEQ ID NO: 4286169 - DNA, 18 bp, Homo sapiens
tcctcagttcctgcagca

SEQ ID NO: 4286170 - DNA, 13 bp, Homo sapiens
tcctcccaggcgc

SEQ ID NO: 4286171 - DNA, 16 bp, Homo sapiens
tcctccccagcaggtg

SEQ ID NO: 4286172 - DNA, 18 bp, Homo sapiens
tcctccccgatccccgac

SEQ ID NO: 4286173 - DNA, 14 bp, Homo sapiens
tcctccccttccct

SEQ ID NO: 4286174 - DNA, 17 bp, Homo sapiens
tcctccctccctgcagg

SEQ ID NO: 4286175 - DNA, 18 bp, Homo sapiens
tcctccctccctgcaggg

SEQ ID NO: 4286176 - DNA, 14 bp, Homo sapiens
tcctcctggaccca

SEQ ID NO: 4286177 - DNA, 20 bp, Homo sapiens
tcctcctggacccagcaggg

SEQ ID NO: 4286178 - DNA, 16 bp, Homo sapiens
tcctccttccaggccc

SEQ ID NO: 4286179 - DNA, 21 bp, Homo sapiens
tcctccttccaggccccaggc

SEQ ID NO: 4286180 - DNA, 23 bp, Homo sapiens
tcctccttccaggccccaggctg

SEQ ID NO: 4286181 - DNA, 21 bp, Homo sapiens
tcctcggccagagctcccagg

SEQ ID NO: 4286182 - DNA, 22 bp, Homo sapiens
tcctcggccagagctcccagga

SEQ ID NO: 4286183 - DNA, 15 bp, Homo sapiens
tcctctccactgcct

SEQ ID NO: 4286184 - DNA, 17 bp, Homo sapiens
tcctctctctccctcca

SEQ ID NO: 4286185 - DNA, 12 bp, Homo sapiens
tcctctgccttg

SEQ ID NO: 4286186 - DNA, 14 bp, Homo sapiens
tcctctgccttgga

SEQ ID NO: 4286187 - DNA, 20 bp, Homo sapiens
tcctctgggcaggacctcag

SEQ ID NO: 4286188 - DNA, 13 bp, Homo sapiens
tcctcttacctgt

SEQ ID NO: 4286189 - DNA, 20 bp, Homo sapiens
tcctcttagaagaatattgt

SEQ ID NO: 4286190 - DNA, 14 bp, Homo sapiens
tcctgaatcccttt

SEQ ID NO: 4286191 - DNA, 14 bp, Homo sapiens
tcctgactgtccta

SEQ ID NO: 4286192 - DNA, 19 bp, Homo sapiens
tcctgagcttggccagaag

SEQ ID NO: 4286193 - DNA, 19 bp, Homo sapiens
tcctgaggagcagcccacc

SEQ ID NO: 4286194 - DNA, 21 bp, Homo sapiens
tcctgattattgaatgttata

SEQ ID NO: 4286195 - DNA, 15 bp, Homo sapiens
tcctgcaatgggaga

SEQ ID NO: 4286196 - DNA, 13 bp, Homo sapiens
tcctgcaccctct

SEQ ID NO: 4286197 - DNA, 15 bp, Homo sapiens
tcctgcactgtcccg

SEQ ID NO: 4286198 - DNA, 16 bp, Homo sapiens
tcctgcagcagagcct

SEQ ID NO: 4286199 - DNA, 20 bp, Homo sapiens
tcctgccctcgtctccctgg

SEQ ID NO: 4286200 - DNA, 21 bp, Homo sapiens
tcctgctacagtagctgtggg

SEQ ID NO: 4286201 - DNA, 15 bp, Homo sapiens
tcctggacccagcag

SEQ ID NO: 4286202 - DNA, 14 bp, Homo sapiens
tcctggcagggcag

SEQ ID NO: 4286203 - DNA, 20 bp, Homo sapiens
tcctggcagggcaggcagag

SEQ ID NO: 4286204 - DNA, 12 bp, Homo sapiens
tcctggctcaca

SEQ ID NO: 4286205 - DNA, 16 bp, Homo sapiens
tcctggctcacagcca

SEQ ID NO: 4286206 - DNA, 16 bp, Homo sapiens
tcctggctcagcctca

SEQ ID NO: 4286207 - DNA, 22 bp, Homo sapiens
tcctgggatgtttaatcaagag

SEQ ID NO: 4286208 - DNA, 14 bp, Homo sapiens
tcctgggcagccca

SEQ ID NO: 4286209 - DNA, 18 bp, Homo sapiens
tcctgggcagcccagaga

SEQ ID NO: 4286210 - DNA, 20 bp, Homo sapiens
tcctgggcatctggccctgc

SEQ ID NO: 4286211 - DNA, 21 bp, Homo sapiens
tcctgggcatctggccctgct

SEQ ID NO: 4286212 - DNA, 22 bp, Homo sapiens
tcctgggcatctggccctgctg

SEQ ID NO: 4286213 - DNA, 15 bp, Homo sapiens
tcctgggccagggtc

SEQ ID NO: 4286214 - DNA, 22 bp, Homo sapiens
tcctgggccccctgggagagtg

SEQ ID NO: 4286215 - DNA, 14 bp, Homo sapiens
tcctgggggctgct

SEQ ID NO: 4286216 - DNA, 19 bp, Homo sapiens
tcctgggggctgctgcact

SEQ ID NO: 4286217 - DNA, 18 bp, Homo sapiens
tcctggggtggttggagg

SEQ ID NO: 4286218 - DNA, 13 bp, Homo sapiens
tcctgggttggcc

SEQ ID NO: 4286219 - DNA, 15 bp, Homo sapiens
tcctggtgtctagtt

SEQ ID NO: 4286220 - DNA, 18 bp, Homo sapiens
tcctgtaactgttacagt

SEQ ID NO: 4286221 - DNA, 17 bp, Homo sapiens
tcctgtacaagtgctca

SEQ ID NO: 4286222 - DNA, 12 bp, Homo sapiens
tcctgtcaatgt

SEQ ID NO: 4286223 - DNA, 19 bp, Homo sapiens
tcctgtcaatgtttgcttt

SEQ ID NO: 4286224 - DNA, 13 bp, Homo sapiens
tcctgtcctggct

SEQ ID NO: 4286225 - DNA, 19 bp, Homo sapiens
tcctgtcctggctcccagg

SEQ ID NO: 4286226 - DNA, 22 bp, Homo sapiens
tcctgtgagatgtgtatcagtg

SEQ ID NO: 4286227 - DNA, 19 bp, Homo sapiens
tccttaaaaaaaaaaatga

SEQ ID NO: 4286228 - DNA, 15 bp, Homo sapiens
tccttaaacagggca

SEQ ID NO: 4286229 - DNA, 22 bp, Homo sapiens
tccttagacacctatcagagaa

SEQ ID NO: 4286230 - DNA, 21 bp, Homo sapiens
tccttagactccttctcccca

SEQ ID NO: 4286231 - DNA, 13 bp, Homo sapiens
tccttcaaagtct

SEQ ID NO: 4286232 - DNA, 18 bp, Homo sapiens
tccttcaaagtctcaatg

SEQ ID NO: 4286233 - DNA, 15 bp, Homo sapiens
tccttcactccctgt

SEQ ID NO: 4286234 - DNA, 11 bp, Homo sapiens
tccttcatttc

SEQ ID NO: 4286235 - DNA, 12 bp, Homo sapiens
tccttccaggcc

SEQ ID NO: 4286236 - DNA, 14 bp, Homo sapiens
tccttccaggcccc

SEQ ID NO: 4286237 - DNA, 19 bp, Homo sapiens
tccttccaggccccaggct

SEQ ID NO: 4286238 - DNA, 22 bp, Homo sapiens
tccttccaggccccaggctgga

SEQ ID NO: 4286239 - DNA, 13 bp, Homo sapiens
tccttctccccaa

SEQ ID NO: 4286240 - DNA, 12 bp, Homo sapiens
tccttctcccct

SEQ ID NO: 4286241 - DNA, 14 bp, Homo sapiens
tccttctcccctcc

SEQ ID NO: 4286242 - DNA, 16 bp, Homo sapiens
tccttgaggacctcca

SEQ ID NO: 4286243 - DNA, 23 bp, Homo sapiens
tccttgattttagccttctctgt

SEQ ID NO: 4286244 - DNA, 18 bp, Homo sapiens
tccttgcctcctgtgtaa

SEQ ID NO: 4286245 - DNA, 13 bp, Homo sapiens
tccttggcccagc

SEQ ID NO: 4286246 - DNA, 15 bp, Homo sapiens
tccttggcccagcag

SEQ ID NO: 4286247 - DNA, 20 bp, Homo sapiens
tccttggcccagcagcggcc

SEQ ID NO: 4286248 - DNA, 21 bp, Homo sapiens
tccttggtggccgggggtggg

SEQ ID NO: 4286249 - DNA, 22 bp, Homo sapiens
tccttggtggccgggggtgggg

SEQ ID NO: 4286250 - DNA, 21 bp, Homo sapiens
tccttggttatatttttttaa

SEQ ID NO: 4286251 - DNA, 13 bp, Homo sapiens
tcctttcatcctc

SEQ ID NO: 4286252 - DNA, 18 bp, Homo sapiens
tcctttcatcctcagcaa

SEQ ID NO: 4286253 - DNA, 19 bp, Homo sapiens
tcgaagctgttctctgctt

SEQ ID NO: 4286254 - DNA, 16 bp, Homo sapiens
tcgactgtgacctgtg

SEQ ID NO: 4286255 - DNA, 21 bp, Homo sapiens
tcgagacaggcagaatcagta

SEQ ID NO: 4286256 - DNA, 17 bp, Homo sapiens
tcgaggaaccagagcca

SEQ ID NO: 4286257 - DNA, 17 bp, Homo sapiens
tcgcagttactggttgg

SEQ ID NO: 4286258 - DNA, 14 bp, Homo sapiens
tcgcattaatgaaa

SEQ ID NO: 4286259 - DNA, 17 bp, Homo sapiens
tcgccatgtgctgtgca

SEQ ID NO: 4286260 - DNA, 12 bp, Homo sapiens
tcgcccctccag

SEQ ID NO: 4286261 - DNA, 16 bp, Homo sapiens
tcgcctctcactctgg

SEQ ID NO: 4286262 - DNA, 20 bp, Homo sapiens
tcgcctctcactctggcagc

SEQ ID NO: 4286263 - DNA, 20 bp, Homo sapiens
tcgcggctgggagcctcgcc

SEQ ID NO: 4286264 - DNA, 17 bp, Homo sapiens
tcgctattcccaggcag

SEQ ID NO: 4286265 - DNA, 16 bp, Homo sapiens
tcgctgccttgccatg

SEQ ID NO: 4286266 - DNA, 23 bp, Homo sapiens
tcgcttcataggcagagcccgcc

SEQ ID NO: 4286267 - DNA, 14 bp, Homo sapiens
tcggaggcttggga

SEQ ID NO: 4286268 - DNA, 22 bp, Homo sapiens
tcggaggcttgtcagagctggg

SEQ ID NO: 4286269 - DNA, 19 bp, Homo sapiens
tcggcaacagggcttctct

SEQ ID NO: 4286270 - DNA, 17 bp, Homo sapiens
tcggccagagctcccag

SEQ ID NO: 4286271 - DNA, 15 bp, Homo sapiens
tccatgaaaaacagc

SEQ ID NO: 4286272 - DNA, 17 bp, Homo sapiens
tccatgaaaaacagcag

SEQ ID NO: 4286273 - DNA, 15 bp, Homo sapiens
tccatgatggagtca

SEQ ID NO: 4286274 - DNA, 22 bp, Homo sapiens
tccatgattccaagggcccaga

SEQ ID NO: 4286275 - DNA, 19 bp, Homo sapiens
tccatgcggccggcctggg

SEQ ID NO: 4286276 - DNA, 21 bp, Homo sapiens
tccatgcggccggcctggggc

SEQ ID NO: 4286277 - DNA, 17 bp, Homo sapiens
tccatgggcacctctgc

SEQ ID NO: 4286278 - DNA, 13 bp, Homo sapiens
tccatggtggttt

SEQ ID NO: 4286279 - DNA, 18 bp, Homo sapiens
tccatggtggtttcagaa

SEQ ID NO: 4286280 - DNA, 23 bp, Homo sapiens
tccatggtggtttcagaaagggc

SEQ ID NO: 4286281 - DNA, 17 bp, Homo sapiens
tccatgtgaaatttaca

SEQ ID NO: 4286282 - DNA, 15 bp, Homo sapiens
tccattaatttaaat

SEQ ID NO: 4286283 - DNA, 22 bp, Homo sapiens
tccattaatttaaatgatttaa

SEQ ID NO: 4286284 - DNA, 18 bp, Homo sapiens
tccattccagagctgcag

SEQ ID NO: 4286285 - DNA, 13 bp, Homo sapiens
tccattcccagac

SEQ ID NO: 4286286 - DNA, 23 bp, Homo sapiens
tccattctccaggggtttacagt

SEQ ID NO: 4286287 - DNA, 14 bp, Homo sapiens
tccattctgggtgt

SEQ ID NO: 4286288 - DNA, 15 bp, Homo sapiens
tccattctgggtgtt

SEQ ID NO: 4286289 - DNA, 12 bp, Homo sapiens
tccattttctaa

SEQ ID NO: 4286290 - DNA, 17 bp, Homo sapiens
tccattttctaaactgt

SEQ ID NO: 4286291 - DNA, 17 bp, Homo sapiens
tcccaaagaaccccagg

SEQ ID NO: 4286292 - DNA, 20 bp, Homo sapiens
tcccaaagcaagcacctggg

SEQ ID NO: 4286293 - DNA, 16 bp, Homo sapiens
tcccaacctcccctgg

SEQ ID NO: 4286294 - DNA, 20 bp, Homo sapiens
tcccaactctggccttggtt

SEQ ID NO: 4286295 - DNA, 20 bp, Homo sapiens
tcccaagaaaggaaaccttt

SEQ ID NO: 4286296 - DNA, 19 bp, Homo sapiens
tcccacaaaatatttctaa

SEQ ID NO: 4286297 - DNA, 19 bp, Homo sapiens
tcccacaattcttttgaaa

SEQ ID NO: 4286298 - DNA, 15 bp, Homo sapiens
tcccacaggcccttc

SEQ ID NO: 4286299 - DNA, 22 bp, Homo sapiens
tcccacaggcccttcctctcca

SEQ ID NO: 4286300 - DNA, 18 bp, Homo sapiens
tcccaccaactctctctg

SEQ ID NO: 4286301 - DNA, 19 bp, Homo sapiens
tcccaccaactctctctgc

SEQ ID NO: 4286302 - DNA, 22 bp, Homo sapiens
tcccaccaactctctctgcccc

SEQ ID NO: 4286303 - DNA, 17 bp, Homo sapiens
tcccaccacagcaggtg

SEQ ID NO: 4286304 - DNA, 22 bp, Homo sapiens
tcccacccctataccctaggtc

SEQ ID NO: 4286305 - DNA, 19 bp, Homo sapiens
tcccacggccactgcagtc

SEQ ID NO: 4286306 - DNA, 15 bp, Homo sapiens
tcccactgcccctgc

SEQ ID NO: 4286307 - DNA, 18 bp, Homo sapiens
tcccagacagcagtgtga

SEQ ID NO: 4286308 - DNA, 18 bp, Homo sapiens
tcccagacatgctgccca

SEQ ID NO: 4286309 - DNA, 19 bp, Homo sapiens
tcccagacatgctgcccac

SEQ ID NO: 4286310 - DNA, 20 bp, Homo sapiens
tcccagacatgctgcccacc

SEQ ID NO: 4286311 - DNA, 21 bp, Homo sapiens
tcccagctctagacaaccctg

SEQ ID NO: 4286312 - DNA, 13 bp, Homo sapiens
tcccaggaccctg

SEQ ID NO: 4286313 - DNA, 18 bp, Homo sapiens
tcccaggaccctgggtca

SEQ ID NO: 4286314 - DNA, 20 bp, Homo sapiens
tcccaggaccctgggtcacc

SEQ ID NO: 4286315 - DNA, 18 bp, Homo sapiens
tcccaggacgcagggaga

SEQ ID NO: 4286316 - DNA, 18 bp, Homo sapiens
tcccaggatggtcccagc

SEQ ID NO: 4286317 - DNA, 12 bp, Homo sapiens
tcccaggcaggg

SEQ ID NO: 4286318 - DNA, 20 bp, Homo sapiens
tcccaggggcctttgcagcg

SEQ ID NO: 4286319 - DNA, 15 bp, Homo sapiens
tcccatccagcgtct

SEQ ID NO: 4286320 - DNA, 18 bp, Homo sapiens
tcccatgggggctccaga

SEQ ID NO: 4286321 - DNA, 20 bp, Homo sapiens
tcccatgggggctccagaca

SEQ ID NO: 4286322 - DNA, 23 bp, Homo sapiens
tcccatggtagactgtgacacag

SEQ ID NO: 4286323 - DNA, 22 bp, Homo sapiens
tccccaatccaacccatgcatg

SEQ ID NO: 4286324 - DNA, 22 bp, Homo sapiens
tccccactgcctgcccacccgt

SEQ ID NO: 4286325 - DNA, 10 bp, Homo sapiens
tccccagcag

SEQ ID NO: 4286326 - DNA, 14 bp, Homo sapiens
tccccagcccaggg

SEQ ID NO: 4286327 - DNA, 23 bp, Homo sapiens
tccccagcccagggttcccccag

SEQ ID NO: 4286328 - DNA, 21 bp, Homo sapiens
tccccaggagagaccttctct

SEQ ID NO: 4286329 - DNA, 13 bp, Homo sapiens
tccccaggggcac

SEQ ID NO: 4286330 - DNA, 16 bp, Homo sapiens
tccccagtgtggactc

SEQ ID NO: 4286331 - DNA, 20 bp, Homo sapiens
tccccatggctcctcaccac

SEQ ID NO: 4286332 - DNA, 15 bp, Homo sapiens
tccccattagtatcc

SEQ ID NO: 4286333 - DNA, 13 bp, Homo sapiens
tccccattctata

SEQ ID NO: 4286334 - DNA, 19 bp, Homo sapiens
tccccattgccttctgggg

SEQ ID NO: 4286335 - DNA, 14 bp, Homo sapiens
tcccccagccctgt

SEQ ID NO: 4286336 - DNA, 15 bp, Homo sapiens
tcccccagccctgtg

SEQ ID NO: 4286337 - DNA, 17 bp, Homo sapiens
tcccccatcctcccctt

SEQ ID NO: 4286338 - DNA, 21 bp, Homo sapiens
tcccccatcctccccttccct

SEQ ID NO: 4286339 - DNA, 13 bp, Homo sapiens
tccccctccttgc

SEQ ID NO: 4286340 - DNA, 22 bp, Homo sapiens
tccccctgctccatgggcacct

SEQ ID NO: 4286341 - DNA, 15 bp, Homo sapiens
tcccccttcccctgc

SEQ ID NO: 4286342 - DNA, 16 bp, Homo sapiens
tcccccttcgtggagc

SEQ ID NO: 4286343 - DNA, 17 bp, Homo sapiens
tcccccttcgtggagct

SEQ ID NO: 4286344 - DNA, 14 bp, Homo sapiens
tccccgacagtggc

SEQ ID NO: 4286345 - DNA, 15 bp, Homo sapiens
tccccgatccccgac

SEQ ID NO: 4286346 - DNA, 15 bp, Homo sapiens
tccccgcgggcagtg

SEQ ID NO: 4286347 - DNA, 17 bp, Homo sapiens
tccccggacaagcccag

SEQ ID NO: 4286348 - DNA, 18 bp, Homo sapiens
tccccggacgcatgcagg

SEQ ID NO: 4286349 - DNA, 20 bp, Homo sapiens
tccccggacgcatgcagggc

SEQ ID NO: 4286350 - DNA, 21 bp, Homo sapiens
tcccctcagccacacccaggc

SEQ ID NO: 4286351 - DNA, 13 bp, Homo sapiens
tcccctccagacc

SEQ ID NO: 4286352 - DNA, 14 bp, Homo sapiens
tcccctccagaccc

SEQ ID NO: 4286353 - DNA, 17 bp, Homo sapiens
tcccctctatttagcat

SEQ ID NO: 4286354 - DNA, 20 bp, Homo sapiens
tcccctctcctgcatccctc

SEQ ID NO: 4286355 - DNA, 17 bp, Homo sapiens
tcccctcttcccttcaa

SEQ ID NO: 4286356 - DNA, 17 bp, Homo sapiens
tcccctgcctgtgagtg

SEQ ID NO: 4286357 - DNA, 16 bp, Homo sapiens
tcccctgcgcaggccc

SEQ ID NO: 4286358 - DNA, 17 bp, Homo sapiens
tcccctgcgccctccct

SEQ ID NO: 4286359 - DNA, 20 bp, Homo sapiens
tcccctgcgccctccctccc

SEQ ID NO: 4286360 - DNA, 14 bp, Homo sapiens
tcccctggtcctgc

SEQ ID NO: 4286361 - DNA, 15 bp, Homo sapiens
tcccctggtcctgca

SEQ ID NO: 4286362 - DNA, 13 bp, Homo sapiens
tccccttccctgc

SEQ ID NO: 4286363 - DNA, 17 bp, Homo sapiens
tccccttgggatgggca

SEQ ID NO: 4286364 - DNA, 20 bp, Homo sapiens
tccccttgggatgggcacag

SEQ ID NO: 4286365 - DNA, 16 bp, Homo sapiens
tcccgaatggagtcca

SEQ ID NO: 4286366 - DNA, 21 bp, Homo sapiens
tcccgaatggagtccagacct

SEQ ID NO: 4286367 - DNA, 22 bp, Homo sapiens
tcccgaggcagcaacaggacca

SEQ ID NO: 4286368 - DNA, 23 bp, Homo sapiens
tcccgaggcagcaacaggaccag

SEQ ID NO: 4286369 - DNA, 17 bp, Homo sapiens
tcccgcatgctgcctgc

SEQ ID NO: 4286370 - DNA, 23 bp, Homo sapiens
tcccgccctccccctgccagagg

SEQ ID NO: 4286371 - DNA, 16 bp, Homo sapiens
tcccgctcagccctcc

SEQ ID NO: 4286372 - DNA, 13 bp, Homo sapiens
tcccggggccatg

SEQ ID NO: 4286373 - DNA, 24 bp, Homo sapiens
tcccggggccatggaagctggcag

SEQ ID NO: 4286374 - DNA, 22 bp, Homo sapiens
tcccgggtgccccccatgccct

SEQ ID NO: 4286375 - DNA, 13 bp, Homo sapiens
tccctcagccacg

SEQ ID NO: 4286376 - DNA, 14 bp, Homo sapiens
tccctcagccacgc

SEQ ID NO: 4286377 - DNA, 17 bp, Homo sapiens
tccctcagcccctcttg

SEQ ID NO: 4286378 - DNA, 9 bp, Homo sapiens
tccctccac

SEQ ID NO: 4286379 - DNA, 18 bp, Homo sapiens
tccctccacacctccacc

SEQ ID NO: 4286380 - DNA, 14 bp, Homo sapiens
tccctccaccccag

SEQ ID NO: 4286381 - DNA, 20 bp, Homo sapiens
tccctccaccccagtccccg

SEQ ID NO: 4286382 - DNA, 19 bp, Homo sapiens
tccctccctcctggctcac

SEQ ID NO: 4286383 - DNA, 20 bp, Homo sapiens
tccctccgctaaggcttccg

SEQ ID NO: 4286384 - DNA, 20 bp, Homo sapiens
tccctcctggctcacagcca

SEQ ID NO: 4286385 - DNA, 23 bp, Homo sapiens
tccctcctggctcacagccacca

SEQ ID NO: 4286386 - DNA, 20 bp, Homo sapiens
tccctctcaggcatgcctgt

SEQ ID NO: 4286387 - DNA, 14 bp, Homo sapiens
tccctctccccgga

SEQ ID NO: 4286388 - DNA, 14 bp, Homo sapiens
tccctctctctgga

SEQ ID NO: 4286389 - DNA, 16 bp, Homo sapiens
tccctctctctggaaa

SEQ ID NO: 4286390 - DNA, 13 bp, Homo sapiens
tccctctgctcca

SEQ ID NO: 4286391 - DNA, 21 bp, Homo sapiens
tccctgagaagcctcatggga

SEQ ID NO: 4286392 - DNA, 19 bp, Homo sapiens
tccctgagggcccttccca

SEQ ID NO: 4286393 - DNA, 10 bp, Homo sapiens
tccctgcagg

SEQ ID NO: 4286394 - DNA, 11 bp, Homo sapiens
tccctgcaggg

SEQ ID NO: 4286395 - DNA, 21 bp, Homo sapiens
tccctgcatcccttggcccct

SEQ ID NO: 4286396 - DNA, 14 bp, Homo sapiens
tccctgccccgccc

SEQ ID NO: 4286397 - DNA, 19 bp, Homo sapiens
tccctgccccgccccccag

SEQ ID NO: 4286398 - DNA, 20 bp, Homo sapiens
tccctgccccgccccccaga

SEQ ID NO: 4286399 - DNA, 23 bp, Homo sapiens
tccctgccccgccccccagagcc

SEQ ID NO: 4286400 - DNA, 19 bp, Homo sapiens
tccctgcccctcccttcaa

SEQ ID NO: 4286401 - DNA, 17 bp, Homo sapiens
tccctgcctaggagctg

SEQ ID NO: 4286402 - DNA, 14 bp, Homo sapiens
tccctgcctggccc

SEQ ID NO: 4286403 - DNA, 16 bp, Homo sapiens
tccctgcctggccctc

SEQ ID NO: 4286404 - DNA, 16 bp, Homo sapiens
tccctgctgccaggct

SEQ ID NO: 4286405 - DNA, 18 bp, Homo sapiens
tcagtagtgcctgtgatc

SEQ ID NO: 4286406 - DNA, 20 bp, Homo sapiens
tcagtcactaaaaggaagac

SEQ ID NO: 4286407 - DNA, 21 bp, Homo sapiens
tcagtccctccctcctggctc

SEQ ID NO: 4286408 - DNA, 22 bp, Homo sapiens
tcagtccctccctcctggctca

SEQ ID NO: 4286409 - DNA, 23 bp, Homo sapiens
tcagtctttgggggattcaaatg

SEQ ID NO: 4286410 - DNA, 14 bp, Homo sapiens
tcagtgatgggagt

SEQ ID NO: 4286411 - DNA, 12 bp, Homo sapiens
tcagtgcagccc

SEQ ID NO: 4286412 - DNA, 20 bp, Homo sapiens
tcagtgtgccaccctctgca

SEQ ID NO: 4286413 - DNA, 20 bp, Homo sapiens
tcagttcctgcagcagagcc

SEQ ID NO: 4286414 - DNA, 13 bp, Homo sapiens
tcataaagtgaga

SEQ ID NO: 4286415 - DNA, 13 bp, Homo sapiens
tcataacaatgta

SEQ ID NO: 4286416 - DNA, 18 bp, Homo sapiens
tcatagcatcctgattat

SEQ ID NO: 4286417 - DNA, 15 bp, Homo sapiens
tcataggcagagccc

SEQ ID NO: 4286418 - DNA, 22 bp, Homo sapiens
tcatatatggggggccaacacc

SEQ ID NO: 4286419 - DNA, 13 bp, Homo sapiens
tcatatcatttct

SEQ ID NO: 4286420 - DNA, 15 bp, Homo sapiens
tcatatttacctgtg

SEQ ID NO: 4286421 - DNA, 20 bp, Homo sapiens
tcatcatgggggatttttca

SEQ ID NO: 4286422 - DNA, 16 bp, Homo sapiens
tcatcatgtctattgt

SEQ ID NO: 4286423 - DNA, 18 bp, Homo sapiens
tcatcatgtctattgtcc

SEQ ID NO: 4286424 - DNA, 14 bp, Homo sapiens
tcatccaacctctt

SEQ ID NO: 4286425 - DNA, 16 bp, Homo sapiens
tcatccagaactgtct

SEQ ID NO: 4286426 - DNA, 16 bp, Homo sapiens
tcatcccggggccatg

SEQ ID NO: 4286427 - DNA, 11 bp, Homo sapiens
tcatcctcagc

SEQ ID NO: 4286428 - DNA, 14 bp, Homo sapiens
tcatgaacactggc

SEQ ID NO: 4286429 - DNA, 16 bp, Homo sapiens
tcatgatttgcaactt

SEQ ID NO: 4286430 - DNA, 16 bp, Homo sapiens
tcatgcactgcaaata

SEQ ID NO: 4286431 - DNA, 17 bp, Homo sapiens
tcatgcactgcaaatac

SEQ ID NO: 4286432 - DNA, 21 bp, Homo sapiens
tcatgccattccgaccttcac

SEQ ID NO: 4286433 - DNA, 13 bp, Homo sapiens
tcatgcctgagaa

SEQ ID NO: 4286434 - DNA, 23 bp, Homo sapiens
tcatgcctgagaatgcctaggcc

SEQ ID NO: 4286435 - DNA, 12 bp, Homo sapiens
tcatgcctgggg

SEQ ID NO: 4286436 - DNA, 13 bp, Homo sapiens
tcatgcctggggt

SEQ ID NO: 4286437 - DNA, 14 bp, Homo sapiens
tcatgctgtctgtg

SEQ ID NO: 4286438 - DNA, 22 bp, Homo sapiens
tcatgtaaattgactgtactag

SEQ ID NO: 4286439 - DNA, 23 bp, Homo sapiens
tcatgtgttgcaaattattctag

SEQ ID NO: 4286440 - DNA, 15 bp, Homo sapiens
tcattaattaacccc

SEQ ID NO: 4286441 - DNA, 13 bp, Homo sapiens
tcattatttcatg

SEQ ID NO: 4286442 - DNA, 12 bp, Homo sapiens
tcattcctctgt

SEQ ID NO: 4286443 - DNA, 11 bp, Homo sapiens
tcattcttttc

SEQ ID NO: 4286444 - DNA, 15 bp, Homo sapiens
tcattcttttcagct

SEQ ID NO: 4286445 - DNA, 23 bp, Homo sapiens
tcattcttttcagcttgtttcta

SEQ ID NO: 4286446 - DNA, 14 bp, Homo sapiens
tcattgtagaaaag

SEQ ID NO: 4286447 - DNA, 15 bp, Homo sapiens
tcattgttaaagtaa

SEQ ID NO: 4286448 - DNA, 21 bp, Homo sapiens
tcatttataaaaccatcaaaa

SEQ ID NO: 4286449 - DNA, 22 bp, Homo sapiens
tcatttccaccaagggtatctg

SEQ ID NO: 4286450 - DNA, 13 bp, Homo sapiens
tcatttcctcaaa

SEQ ID NO: 4286451 - DNA, 13 bp, Homo sapiens
tcatttcttgggc

SEQ ID NO: 4286452 - DNA, 14 bp, Homo sapiens
tcattttgcaactt

SEQ ID NO: 4286453 - DNA, 17 bp, Homo sapiens
tcattttttttaattga

SEQ ID NO: 4286454 - DNA, 21 bp, Homo sapiens
tccaaataaaacttgagccca

SEQ ID NO: 4286455 - DNA, 19 bp, Homo sapiens
tccaaattgatgggtgggc

SEQ ID NO: 4286456 - DNA, 20 bp, Homo sapiens
tccaacaactccaggaaaac

SEQ ID NO: 4286457 - DNA, 18 bp, Homo sapiens
tccaacccatgcatggcc

SEQ ID NO: 4286458 - DNA, 21 bp, Homo sapiens
tccaacccatgcatggcctcc

SEQ ID NO: 4286459 - DNA, 15 bp, Homo sapiens
tccaaccccggggca

SEQ ID NO: 4286460 - DNA, 23 bp, Homo sapiens
tccaacctctttcctctctggcc

SEQ ID NO: 4286461 - DNA, 20 bp, Homo sapiens
tccaagaccttacaaccaca

SEQ ID NO: 4286462 - DNA, 16 bp, Homo sapiens
tccaagcatcagcaag

SEQ ID NO: 4286463 - DNA, 17 bp, Homo sapiens
tccaagcatcagcaaga

SEQ ID NO: 4286464 - DNA, 23 bp, Homo sapiens
tccaagcctctctggcactttga

SEQ ID NO: 4286465 - DNA, 16 bp, Homo sapiens
tccaagcctgggccac

SEQ ID NO: 4286466 - DNA, 13 bp, Homo sapiens
tccaaggcaaatg

SEQ ID NO: 4286467 - DNA, 15 bp, Homo sapiens
tccaaggcaaatgtc

SEQ ID NO: 4286468 - DNA, 16 bp, Homo sapiens
tccaaggcaaatgtcc

SEQ ID NO: 4286469 - DNA, 13 bp, Homo sapiens
tccaagggcccag

SEQ ID NO: 4286470 - DNA, 15 bp, Homo sapiens
tccaatgtgcccagt

SEQ ID NO: 4286471 - DNA, 20 bp, Homo sapiens
tccaatgtgcccagtcatga

SEQ ID NO: 4286472 - DNA, 14 bp, Homo sapiens
tccacaaatgtcct

SEQ ID NO: 4286473 - DNA, 20 bp, Homo sapiens
tccacaaatgtcctcagagg

SEQ ID NO: 4286474 - DNA, 13 bp, Homo sapiens
tccacacaggccc

SEQ ID NO: 4286475 - DNA, 19 bp, Homo sapiens
tccacagaaaccctgtttt

SEQ ID NO: 4286476 - DNA, 20 bp, Homo sapiens
tccacagaaaccctgtttta

SEQ ID NO: 4286477 - DNA, 16 bp, Homo sapiens
tccaccaggattaatc

SEQ ID NO: 4286478 - DNA, 21 bp, Homo sapiens
tccaccccctccctggcctgt

SEQ ID NO: 4286479 - DNA, 15 bp, Homo sapiens
tccaccccctggtgc

SEQ ID NO: 4286480 - DNA, 13 bp, Homo sapiens
tccacctgcagcc

SEQ ID NO: 4286481 - DNA, 14 bp, Homo sapiens
tccacctgcagccc

SEQ ID NO: 4286482 - DNA, 20 bp, Homo sapiens
tccacctgcagccccaggcc

SEQ ID NO: 4286483 - DNA, 16 bp, Homo sapiens
tccacctgggagatgc

SEQ ID NO: 4286484 - DNA, 17 bp, Homo sapiens
tccacctgggagatgct

SEQ ID NO: 4286485 - DNA, 16 bp, Homo sapiens
tccacctgtgctgctg

SEQ ID NO: 4286486 - DNA, 12 bp, Homo sapiens
tccacgctgtct

SEQ ID NO: 4286487 - DNA, 20 bp, Homo sapiens
tccacgctgtctccagaccc

SEQ ID NO: 4286488 - DNA, 21 bp, Homo sapiens
tccacgctgtctccagacccc

SEQ ID NO: 4286489 - DNA, 17 bp, Homo sapiens
tccactaggtgcccagt

SEQ ID NO: 4286490 - DNA, 14 bp, Homo sapiens
tccactcccctcat

SEQ ID NO: 4286491 - DNA, 15 bp, Homo sapiens
tccactcccctcatc

SEQ ID NO: 4286492 - DNA, 23 bp, Homo sapiens
tccacttagaaattgcatttcct

SEQ ID NO: 4286493 - DNA, 13 bp, Homo sapiens
tccagaactgtct

SEQ ID NO: 4286494 - DNA, 14 bp, Homo sapiens
tccagacattgtat

SEQ ID NO: 4286495 - DNA, 12 bp, Homo sapiens
tccagaccccca

SEQ ID NO: 4286496 - DNA, 14 bp, Homo sapiens
tccagacccccacc

SEQ ID NO: 4286497 - DNA, 17 bp, Homo sapiens
tccagacccccacccct

SEQ ID NO: 4286498 - DNA, 22 bp, Homo sapiens
tccagacccccaccccttcccc

SEQ ID NO: 4286499 - DNA, 11 bp, Homo sapiens
tccagacccct

SEQ ID NO: 4286500 - DNA, 20 bp, Homo sapiens
tccagacccctaccctttcc

SEQ ID NO: 4286501 - DNA, 22 bp, Homo sapiens
tccagacccctaccctttccca

SEQ ID NO: 4286502 - DNA, 15 bp, Homo sapiens
tccagacccctggct

SEQ ID NO: 4286503 - DNA, 17 bp, Homo sapiens
tccagacccctggcttt

SEQ ID NO: 4286504 - DNA, 16 bp, Homo sapiens
tccagacctgggccct

SEQ ID NO: 4286505 - DNA, 23 bp, Homo sapiens
tccagacttcgctattcccaggc

SEQ ID NO: 4286506 - DNA, 16 bp, Homo sapiens
tccagagagtggctcc

SEQ ID NO: 4286507 - DNA, 14 bp, Homo sapiens
tccagaggaggtgc

SEQ ID NO: 4286508 - DNA, 19 bp, Homo sapiens
tccagaggaggtgcccggg

SEQ ID NO: 4286509 - DNA, 21 bp, Homo sapiens
tccagaggaggtgcccgggca

SEQ ID NO: 4286510 - DNA, 20 bp, Homo sapiens
tccagagggttgtgattttg

SEQ ID NO: 4286511 - DNA, 13 bp, Homo sapiens
tccagaggtgagg

SEQ ID NO: 4286512 - DNA, 15 bp, Homo sapiens
tccagctctcccctg

SEQ ID NO: 4286513 - DNA, 13 bp, Homo sapiens
tccaggagaggag

SEQ ID NO: 4286514 - DNA, 22 bp, Homo sapiens
tccaggattgtccacaaatgtc

SEQ ID NO: 4286515 - DNA, 22 bp, Homo sapiens
tccaggcaatggcctaaacttc

SEQ ID NO: 4286516 - DNA, 17 bp, Homo sapiens
tccaggcatgaccctgg

SEQ ID NO: 4286517 - DNA, 21 bp, Homo sapiens
tccaggcatgaccctggagcc

SEQ ID NO: 4286518 - DNA, 21 bp, Homo sapiens
tccaggcatgggtcccttccc

SEQ ID NO: 4286519 - DNA, 13 bp, Homo sapiens
tccaggcccagcc

SEQ ID NO: 4286520 - DNA, 15 bp, Homo sapiens
tccaggcccagcctg

SEQ ID NO: 4286521 - DNA, 18 bp, Homo sapiens
tccaggcccagcctggcc

SEQ ID NO: 4286522 - DNA, 20 bp, Homo sapiens
tccaggcccagcctggcccc

SEQ ID NO: 4286523 - DNA, 21 bp, Homo sapiens
tccaggccccaggctggatgc

SEQ ID NO: 4286524 - DNA, 20 bp, Homo sapiens
tccaggcgtagggccagggc

SEQ ID NO: 4286525 - DNA, 17 bp, Homo sapiens
tccaggggtttacagtg

SEQ ID NO: 4286526 - DNA, 15 bp, Homo sapiens
tccagtctgctgccc

SEQ ID NO: 4286527 - DNA, 18 bp, Homo sapiens
tccagtgaccctggagct

SEQ ID NO: 4286528 - DNA, 16 bp, Homo sapiens
tccagtgtattttctg

SEQ ID NO: 4286529 - DNA, 19 bp, Homo sapiens
tccagtgttgcctcctccc

SEQ ID NO: 4286530 - DNA, 22 bp, Homo sapiens
tccagttggactgtggcctcag

SEQ ID NO: 4286531 - DNA, 17 bp, Homo sapiens
tccataccccctgcccc

SEQ ID NO: 4286532 - DNA, 19 bp, Homo sapiens
tccataccccctgccccag

SEQ ID NO: 4286533 - DNA, 21 bp, Homo sapiens
tccataccccctgccccagag

SEQ ID NO: 4286534 - DNA, 23 bp, Homo sapiens
tccataccccctgccccagagaa

SEQ ID NO: 4286535 - DNA, 23 bp, Homo sapiens
tccatatagtttgttttcttttt

SEQ ID NO: 4286536 - DNA, 12 bp, Homo sapiens
tccatcagcagt

SEQ ID NO: 4286537 - DNA, 14 bp, Homo sapiens
tccatcagcagtga

SEQ ID NO: 4286538 - DNA, 16 bp, Homo sapiens
tccatcctgtacaagt

SEQ ID NO: 4286539 - DNA, 17 bp, Homo sapiens
tatgtaacatgtctaaa

SEQ ID NO: 4286540 - DNA, 17 bp, Homo sapiens
tatgtacagttatacat

SEQ ID NO: 4286541 - DNA, 23 bp, Homo sapiens
tatgtagaaaaaagtaaatgtga

SEQ ID NO: 4286542 - DNA, 14 bp, Homo sapiens
tatgtagaactgtt

SEQ ID NO: 4286543 - DNA, 20 bp, Homo sapiens
tatgtcagtccaataaatta

SEQ ID NO: 4286544 - DNA, 17 bp, Homo sapiens
tatgtgaaagtgtaaaa

SEQ ID NO: 4286545 - DNA, 19 bp, Homo sapiens
tatgtgaattgaagtcatc

SEQ ID NO: 4286546 - DNA, 18 bp, Homo sapiens
tatgtgagcatgaaacta

SEQ ID NO: 4286547 - DNA, 23 bp, Homo sapiens
tatgtgctattaatatttgttta

SEQ ID NO: 4286548 - DNA, 16 bp, Homo sapiens
tatgtgcttgaagatt

SEQ ID NO: 4286549 - DNA, 16 bp, Homo sapiens
tatgtgtgtttctgtc

SEQ ID NO: 4286550 - DNA, 21 bp, Homo sapiens
tatgttatacaaccttcattt

SEQ ID NO: 4286551 - DNA, 22 bp, Homo sapiens
tatgttatacaaccttcattta

SEQ ID NO: 4286552 - DNA, 16 bp, Homo sapiens
tatgttttagcatgtg

SEQ ID NO: 4286553 - DNA, 14 bp, Homo sapiens
tattaaatcagaat

SEQ ID NO: 4286554 - DNA, 21 bp, Homo sapiens
tattaaatcagaatctttaaa

SEQ ID NO: 4286555 - DNA, 19 bp, Homo sapiens
tattaacaattaattgtct

SEQ ID NO: 4286556 - DNA, 20 bp, Homo sapiens
tattaacaattaattgtctt

SEQ ID NO: 4286557 - DNA, 20 bp, Homo sapiens
tattaacatatattgttatt

SEQ ID NO: 4286558 - DNA, 16 bp, Homo sapiens
tattactgatgtgtgc

SEQ ID NO: 4286559 - DNA, 16 bp, Homo sapiens
tattagagtgccctta

SEQ ID NO: 4286560 - DNA, 24 bp, Homo sapiens
tattagagtgcccttaaaataatg

SEQ ID NO: 4286561 - DNA, 17 bp, Homo sapiens
tattagccctgcatttt

SEQ ID NO: 4286562 - DNA, 15 bp, Homo sapiens
tattatagatataaa

SEQ ID NO: 4286563 - DNA, 14 bp, Homo sapiens
tattatgcaaagta

SEQ ID NO: 4286564 - DNA, 19 bp, Homo sapiens
tattatgtcctgtgagatg

SEQ ID NO: 4286565 - DNA, 22 bp, Homo sapiens
tattatgtcctgtgagatgtgt

SEQ ID NO: 4286566 - DNA, 21 bp, Homo sapiens
tattcacttgtgtttgtatat

SEQ ID NO: 4286567 - DNA, 13 bp, Homo sapiens
tattcaggacccc

SEQ ID NO: 4286568 - DNA, 21 bp, Homo sapiens
tattcaggaccccatctgctg

SEQ ID NO: 4286569 - DNA, 11 bp, Homo sapiens
tattcccaggc

SEQ ID NO: 4286570 - DNA, 22 bp, Homo sapiens
tattctagtcaactgctgtttt

SEQ ID NO: 4286571 - DNA, 18 bp, Homo sapiens
tattctattttagacttt

SEQ ID NO: 4286572 - DNA, 11 bp, Homo sapiens
tattctccatg

SEQ ID NO: 4286573 - DNA, 18 bp, Homo sapiens
tattctgtggattctata

SEQ ID NO: 4286574 - DNA, 16 bp, Homo sapiens
tattcttgctttcaca

SEQ ID NO: 4286575 - DNA, 20 bp, Homo sapiens
tattgctgaagaatctactt

SEQ ID NO: 4286576 - DNA, 18 bp, Homo sapiens
tattgctggaatctacta

SEQ ID NO: 4286577 - DNA, 17 bp, Homo sapiens
tattggttttaaaaaag

SEQ ID NO: 4286578 - DNA, 23 bp, Homo sapiens
tattgtaatatagaaaaaaacat

SEQ ID NO: 4286579 - DNA, 18 bp, Homo sapiens
tattgtatatatggatat

SEQ ID NO: 4286580 - DNA, 13 bp, Homo sapiens
tattgtctgtaaa

SEQ ID NO: 4286581 - DNA, 14 bp, Homo sapiens
tattgtctgtaaat

SEQ ID NO: 4286582 - DNA, 17 bp, Homo sapiens
tattgtgaaatttgtta

SEQ ID NO: 4286583 - DNA, 22 bp, Homo sapiens
tatttaaaaaatgaatagtaca

SEQ ID NO: 4286584 - DNA, 15 bp, Homo sapiens
tatttacaagaagaa

SEQ ID NO: 4286585 - DNA, 16 bp, Homo sapiens
tatttacaagaagaac

SEQ ID NO: 4286586 - DNA, 14 bp, Homo sapiens
tatttacaatgtat

SEQ ID NO: 4286587 - DNA, 15 bp, Homo sapiens
tatttacaatgtatt

SEQ ID NO: 4286588 - DNA, 15 bp, Homo sapiens
tatttatattagagt

SEQ ID NO: 4286589 - DNA, 19 bp, Homo sapiens
tatttatctgtctgagccc

SEQ ID NO: 4286590 - DNA, 11 bp, Homo sapiens
tatttatttct

SEQ ID NO: 4286591 - DNA, 19 bp, Homo sapiens
tatttcaatgtaattaaac

SEQ ID NO: 4286592 - DNA, 22 bp, Homo sapiens
tatttctaagcttatttctaac

SEQ ID NO: 4286593 - DNA, 17 bp, Homo sapiens
tatttctatctgcaaat

SEQ ID NO: 4286594 - DNA, 23 bp, Homo sapiens
tatttcttcaaatatctctattt

SEQ ID NO: 4286595 - DNA, 23 bp, Homo sapiens
tatttgctaattaaaaagttaat

SEQ ID NO: 4286596 - DNA, 14 bp, Homo sapiens
tatttgcttattta

SEQ ID NO: 4286597 - DNA, 16 bp, Homo sapiens
tatttgcttatttata

SEQ ID NO: 4286598 - DNA, 22 bp, Homo sapiens
tatttgtagctagaatatccta

SEQ ID NO: 4286599 - DNA, 19 bp, Homo sapiens
tattttaaaatctcctaaa

SEQ ID NO: 4286600 - DNA, 15 bp, Homo sapiens
tattttcaagcaaat

SEQ ID NO: 4286601 - DNA, 12 bp, Homo sapiens
tattttcctccc

SEQ ID NO: 4286602 - DNA, 16 bp, Homo sapiens
tattttcctccccagc

SEQ ID NO: 4286603 - DNA, 18 bp, Homo sapiens
tattttcgtgcatttgtg

SEQ ID NO: 4286604 - DNA, 19 bp, Homo sapiens
tattttcgtgcatttgtga

SEQ ID NO: 4286605 - DNA, 23 bp, Homo sapiens
tattttcgtgcatttgtgagcca

SEQ ID NO: 4286606 - DNA, 22 bp, Homo sapiens
tattttctgagtagcatatata

SEQ ID NO: 4286607 - DNA, 18 bp, Homo sapiens
tattttcttcccatttgt

SEQ ID NO: 4286608 - DNA, 22 bp, Homo sapiens
tattttcttttatatctgtaaa

SEQ ID NO: 4286609 - DNA, 19 bp, Homo sapiens
tattttggacgtgtgagga

SEQ ID NO: 4286610 - DNA, 19 bp, Homo sapiens
tattttggggaactgttgt

SEQ ID NO: 4286611 - DNA, 14 bp, Homo sapiens
tattttgtaaaatg

SEQ ID NO: 4286612 - DNA, 18 bp, Homo sapiens
tatttttaatttatgata

SEQ ID NO: 4286613 - DNA, 23 bp, Homo sapiens
tatttttagagattaatttgtgt

SEQ ID NO: 4286614 - DNA, 21 bp, Homo sapiens
tatttttatcagttacacatg

SEQ ID NO: 4286615 - DNA, 14 bp, Homo sapiens
tatttttctgttac

SEQ ID NO: 4286616 - DNA, 19 bp, Homo sapiens
tatttttgttgtgttctgt

SEQ ID NO: 4286617 - DNA, 18 bp, Homo sapiens
tatttttttgttgctgtt

SEQ ID NO: 4286618 - DNA, 16 bp, Homo sapiens
tcaaaaacatggccac

SEQ ID NO: 4286619 - DNA, 19 bp, Homo sapiens
tcaaaaatcatcaaagtgt

SEQ ID NO: 4286620 - DNA, 19 bp, Homo sapiens
tcaaaactccactcagcac

SEQ ID NO: 4286621 - DNA, 12 bp, Homo sapiens
tcaaaatacttc

SEQ ID NO: 4286622 - DNA, 19 bp, Homo sapiens
tcaaaatacttctttttca

SEQ ID NO: 4286623 - DNA, 16 bp, Homo sapiens
tcaaaatagttctatt

SEQ ID NO: 4286624 - DNA, 18 bp, Homo sapiens
tcaaaatagttctatttc

SEQ ID NO: 4286625 - DNA, 21 bp, Homo sapiens
tcaaaatagttctatttctat

SEQ ID NO: 4286626 - DNA, 22 bp, Homo sapiens
tcaaaatattgagcagaattca

SEQ ID NO: 4286627 - DNA, 12 bp, Homo sapiens
tcaaaatgcatg

SEQ ID NO: 4286628 - DNA, 18 bp, Homo sapiens
tcaaaatgcatgtgattg

SEQ ID NO: 4286629 - DNA, 12 bp, Homo sapiens
tcaaacacacac

SEQ ID NO: 4286630 - DNA, 13 bp, Homo sapiens
tcaaacacacaca

SEQ ID NO: 4286631 - DNA, 22 bp, Homo sapiens
tcaaacagggacactacaaaca

SEQ ID NO: 4286632 - DNA, 15 bp, Homo sapiens
tcaaagaacccccct

SEQ ID NO: 4286633 - DNA, 23 bp, Homo sapiens
tcaaagcaccttgaatggaaggt

SEQ ID NO: 4286634 - DNA, 20 bp, Homo sapiens
tcaaagtccaactacagcca

SEQ ID NO: 4286635 - DNA, 13 bp, Homo sapiens
tcaaagtgtttaa

SEQ ID NO: 4286636 - DNA, 18 bp, Homo sapiens
tcaaatatctctatttaa

SEQ ID NO: 4286637 - DNA, 22 bp, Homo sapiens
tcaaatgaataatgcctttgta

SEQ ID NO: 4286638 - DNA, 20 bp, Homo sapiens
tcaaatgagtttaaaaaaat

SEQ ID NO: 4286639 - DNA, 22 bp, Homo sapiens
tcaaatgagtttaaaaaaataa

SEQ ID NO: 4286640 - DNA, 16 bp, Homo sapiens
tcaacaaagaaatatt

SEQ ID NO: 4286641 - DNA, 21 bp, Homo sapiens
tcaacaaagaagaaccatctt

SEQ ID NO: 4286642 - DNA, 15 bp, Homo sapiens
tcaacaagaagaatt

SEQ ID NO: 4286643 - DNA, 16 bp, Homo sapiens
tcaacacttattttct

SEQ ID NO: 4286644 - DNA, 18 bp, Homo sapiens
tcaacacttattttctga

SEQ ID NO: 4286645 - DNA, 19 bp, Homo sapiens
tcaacacttattttctgaa

SEQ ID NO: 4286646 - DNA, 17 bp, Homo sapiens
tcaaccctccctcagcc

SEQ ID NO: 4286647 - DNA, 18 bp, Homo sapiens
tcaaccctccctcagccc

SEQ ID NO: 4286648 - DNA, 20 bp, Homo sapiens
tcaaccctccctcagcccct

SEQ ID NO: 4286649 - DNA, 21 bp, Homo sapiens
tcaaccctccctcagcccctc

SEQ ID NO: 4286650 - DNA, 15 bp, Homo sapiens
tcaacctaggagcag

SEQ ID NO: 4286651 - DNA, 16 bp, Homo sapiens
tcaacctaggagcagt

SEQ ID NO: 4286652 - DNA, 15 bp, Homo sapiens
tcaacctgtgatgag

SEQ ID NO: 4286653 - DNA, 14 bp, Homo sapiens
tcaacgcagccctg

SEQ ID NO: 4286654 - DNA, 18 bp, Homo sapiens
tcaacgcagccctgcttt

SEQ ID NO: 4286655 - DNA, 13 bp, Homo sapiens
tcaactccaaggc

SEQ ID NO: 4286656 - DNA, 14 bp, Homo sapiens
tcaactccaaggca

SEQ ID NO: 4286657 - DNA, 17 bp, Homo sapiens
tcaactccaaggcaaat

SEQ ID NO: 4286658 - DNA, 15 bp, Homo sapiens
tcaagagagacaaaa

SEQ ID NO: 4286659 - DNA, 21 bp, Homo sapiens
tcaagagggcactggtggccc

SEQ ID NO: 4286660 - DNA, 15 bp, Homo sapiens
tcaagattcagctag

SEQ ID NO: 4286661 - DNA, 14 bp, Homo sapiens
tcaagcatgaagat

SEQ ID NO: 4286662 - DNA, 16 bp, Homo sapiens
tcaagcatgaagataa

SEQ ID NO: 4286663 - DNA, 19 bp, Homo sapiens
tcaagccaggagaccctgt

SEQ ID NO: 4286664 - DNA, 20 bp, Homo sapiens
tcaagcctggcccagtgaga

SEQ ID NO: 4286665 - DNA, 19 bp, Homo sapiens
tcaagctcaccctgctcct

SEQ ID NO: 4286666 - DNA, 15 bp, Homo sapiens
tcaagctggccgtgg

SEQ ID NO: 4286667 - DNA, 12 bp, Homo sapiens
tcaagtattact

SEQ ID NO: 4286668 - DNA, 15 bp, Homo sapiens
tcaagtcccgaggca

SEQ ID NO: 4286669 - DNA, 12 bp, Homo sapiens
tcaagtctgtga

SEQ ID NO: 4286670 - DNA, 14 bp, Homo sapiens
tcaagtctgtgaaa

SEQ ID NO: 4286671 - DNA, 19 bp, Homo sapiens
tcaagtgcatttctgggcc

SEQ ID NO: 4286672 - DNA, 13 bp, Homo sapiens
tcaataaaggtca

SEQ ID NO: 4286673 - DNA, 14 bp, Homo sapiens
tcaataaaggtcat

SEQ ID NO: 4286674 - DNA, 23 bp, Homo sapiens
tcaataacaacagtttttatgtt

SEQ ID NO: 4286675 - DNA, 19 bp, Homo sapiens
tcaataattgtggagagga

SEQ ID NO: 4286676 - DNA, 21 bp, Homo sapiens
tcaataattgtggagaggaga

SEQ ID NO: 4286677 - DNA, 15 bp, Homo sapiens
tcaatacttttgtgt

SEQ ID NO: 4286678 - DNA, 22 bp, Homo sapiens
tcaatacttttgtgtattctgt

SEQ ID NO: 4286679 - DNA, 23 bp, Homo sapiens
tcaatacttttgtgtattctgtg

SEQ ID NO: 4286680 - DNA, 17 bp, Homo sapiens
tcaatagcgtgtgtaga

SEQ ID NO: 4286681 - DNA, 18 bp, Homo sapiens
tcaatgaaatatttgctt

SEQ ID NO: 4286682 - DNA, 19 bp, Homo sapiens
tcaatgaaatatttgctta

SEQ ID NO: 4286683 - DNA, 19 bp, Homo sapiens
tcaatgcttttctagcaac

SEQ ID NO: 4286684 - DNA, 22 bp, Homo sapiens
tcaatgtggaaaaaatatttta

SEQ ID NO: 4286685 - DNA, 20 bp, Homo sapiens
tcaatgttcacgcaacttga

SEQ ID NO: 4286686 - DNA, 17 bp, Homo sapiens
tcaattggacaattatt

SEQ ID NO: 4286687 - DNA, 20 bp, Homo sapiens
tcacaaataagtaatatctt

SEQ ID NO: 4286688 - DNA, 22 bp, Homo sapiens
tcacaaatatagttgaacaaga

SEQ ID NO: 4286689 - DNA, 16 bp, Homo sapiens
tcacaacacaatcaaa

SEQ ID NO: 4286690 - DNA, 14 bp, Homo sapiens
tcacaaccttctgt

SEQ ID NO: 4286691 - DNA, 20 bp, Homo sapiens
tcacaactgtttttgaagaa

SEQ ID NO: 4286692 - DNA, 21 bp, Homo sapiens
tcacaactgtttttgaagaag

SEQ ID NO: 4286693 - DNA, 15 bp, Homo sapiens
tcacaacttttctgc

SEQ ID NO: 4286694 - DNA, 13 bp, Homo sapiens
tcacaccagccct

SEQ ID NO: 4286695 - DNA, 15 bp, Homo sapiens
tcacaccagccctgg

SEQ ID NO: 4286696 - DNA, 18 bp, Homo sapiens
tcacaccagccctggtgg

SEQ ID NO: 4286697 - DNA, 16 bp, Homo sapiens
tcacactctaactgta

SEQ ID NO: 4286698 - DNA, 18 bp, Homo sapiens
tcacactctcttcttact

SEQ ID NO: 4286699 - DNA, 16 bp, Homo sapiens
tcacagccgtttgaat

SEQ ID NO: 4286700 - DNA, 13 bp, Homo sapiens
tcacatcatgtaa

SEQ ID NO: 4286701 - DNA, 23 bp, Homo sapiens
tcaccaggaagaaggcccgggag

SEQ ID NO: 4286702 - DNA, 14 bp, Homo sapiens
tcaccatctcaggc

SEQ ID NO: 4286703 - DNA, 17 bp, Homo sapiens
tcaccatctcaggccac

SEQ ID NO: 4286704 - DNA, 21 bp, Homo sapiens
tcaccatctcaggccacctgc

SEQ ID NO: 4286705 - DNA, 14 bp, Homo sapiens
tcacccctcttccc

SEQ ID NO: 4286706 - DNA, 12 bp, Homo sapiens
tcacccctgtct

SEQ ID NO: 4286707 - DNA, 13 bp, Homo sapiens
tcacccctgtctg

SEQ ID NO: 4286708 - DNA, 17 bp, Homo sapiens
tcaccgtcacaataaaa

SEQ ID NO: 4286709 - DNA, 13 bp, Homo sapiens
tcacctcccctcc

SEQ ID NO: 4286710 - DNA, 14 bp, Homo sapiens
tcacctcccctcct

SEQ ID NO: 4286711 - DNA, 17 bp, Homo sapiens
tcacctgctggcccctc

SEQ ID NO: 4286712 - DNA, 19 bp, Homo sapiens
tcacctggttatgagccga

SEQ ID NO: 4286713 - DNA, 14 bp, Homo sapiens
tcaccttcctgggc

SEQ ID NO: 4286714 - DNA, 15 bp, Homo sapiens
tcaccttcctgggca

SEQ ID NO: 4286715 - DNA, 15 bp, Homo sapiens
tcaccttctgtttta

SEQ ID NO: 4286716 - DNA, 19 bp, Homo sapiens
tcacgagatcttccttccg

SEQ ID NO: 4286717 - DNA, 15 bp, Homo sapiens
tcactactcagcatg

SEQ ID NO: 4286718 - DNA, 13 bp, Homo sapiens
tcactatgtccat

SEQ ID NO: 4286719 - DNA, 21 bp, Homo sapiens
tcactatttttttgttgctgt

SEQ ID NO: 4286720 - DNA, 13 bp, Homo sapiens
tcactccactccc

SEQ ID NO: 4286721 - DNA, 18 bp, Homo sapiens
tcactccactcccctcat

SEQ ID NO: 4286722 - DNA, 15 bp, Homo sapiens
tcactcctacctggt

SEQ ID NO: 4286723 - DNA, 15 bp, Homo sapiens
tcactcgcccccggg

SEQ ID NO: 4286724 - DNA, 13 bp, Homo sapiens
tcactctggcagc

SEQ ID NO: 4286725 - DNA, 17 bp, Homo sapiens
tcactctggcagcctca

SEQ ID NO: 4286726 - DNA, 16 bp, Homo sapiens
tcactgaagtgaatac

SEQ ID NO: 4286727 - DNA, 20 bp, Homo sapiens
tcactgcacagtgcatctca

SEQ ID NO: 4286728 - DNA, 22 bp, Homo sapiens
tcactgcacagtgcatctcagc

SEQ ID NO: 4286729 - DNA, 17 bp, Homo sapiens
tcactgcctatacccct

SEQ ID NO: 4286730 - DNA, 15 bp, Homo sapiens
tcactgctggctgcc

SEQ ID NO: 4286731 - DNA, 22 bp, Homo sapiens
tcactgctggctgccttagaac

SEQ ID NO: 4286732 - DNA, 18 bp, Homo sapiens
tcactggtgcatttaaaa

SEQ ID NO: 4286733 - DNA, 22 bp, Homo sapiens
tcacttaaggggggatgtcttg

SEQ ID NO: 4286734 - DNA, 20 bp, Homo sapiens
tcacttcaaacatgccctca

SEQ ID NO: 4286735 - DNA, 18 bp, Homo sapiens
tcacttctgaccacactt

SEQ ID NO: 4286736 - DNA, 16 bp, Homo sapiens
tcacttgtgtttgtat

SEQ ID NO: 4286737 - DNA, 23 bp, Homo sapiens
tcacttgtgtttgtatataaatg

SEQ ID NO: 4286738 - DNA, 16 bp, Homo sapiens
tcacttgtttgtgttt

SEQ ID NO: 4286739 - DNA, 16 bp, Homo sapiens
tcagaaaatttctcaa

SEQ ID NO: 4286740 - DNA, 23 bp, Homo sapiens
tcagaaagggcagcccctcccca

SEQ ID NO: 4286741 - DNA, 19 bp, Homo sapiens
tcagaagttgttagtgatt

SEQ ID NO: 4286742 - DNA, 22 bp, Homo sapiens
tcagaattgtttttagaaattt

SEQ ID NO: 4286743 - DNA, 15 bp, Homo sapiens
tcagactctctcctc

SEQ ID NO: 4286744 - DNA, 23 bp, Homo sapiens
tcagagatgtccatttttacaag

SEQ ID NO: 4286745 - DNA, 19 bp, Homo sapiens
tcagaggccccttgctgct

SEQ ID NO: 4286746 - DNA, 20 bp, Homo sapiens
tcagaggccccttgctgctg

SEQ ID NO: 4286747 - DNA, 14 bp, Homo sapiens
tcagagggaggaat

SEQ ID NO: 4286748 - DNA, 15 bp, Homo sapiens
tcagagggtccctag

SEQ ID NO: 4286749 - DNA, 13 bp, Homo sapiens
tcagagtccaggc

SEQ ID NO: 4286750 - DNA, 14 bp, Homo sapiens
tcagagtccaggcc

SEQ ID NO: 4286751 - DNA, 17 bp, Homo sapiens
tcagagtccaggcccca

SEQ ID NO: 4286752 - DNA, 17 bp, Homo sapiens
tcagataaagtgaccag

SEQ ID NO: 4286753 - DNA, 12 bp, Homo sapiens
tcagattgtaaa

SEQ ID NO: 4286754 - DNA, 21 bp, Homo sapiens
tcagcaattaaagacatttaa

SEQ ID NO: 4286755 - DNA, 18 bp, Homo sapiens
tcagcatcctcagttcct

SEQ ID NO: 4286756 - DNA, 23 bp, Homo sapiens
tcagcattcaaaatagttctatt

SEQ ID NO: 4286757 - DNA, 20 bp, Homo sapiens
tcagcattctcactcctacc

SEQ ID NO: 4286758 - DNA, 23 bp, Homo sapiens
tcagcattctcactcctacctgg

SEQ ID NO: 4286759 - DNA, 18 bp, Homo sapiens
tcagccacgcctctctca

SEQ ID NO: 4286760 - DNA, 15 bp, Homo sapiens
tcagccactcccagg

SEQ ID NO: 4286761 - DNA, 11 bp, Homo sapiens
tcagcccaggt

SEQ ID NO: 4286762 - DNA, 16 bp, Homo sapiens
tcagcccaggtctcct

SEQ ID NO: 4286763 - DNA, 19 bp, Homo sapiens
tcagccccagggccctgct

SEQ ID NO: 4286764 - DNA, 21 bp, Homo sapiens
tcagccccagggccctgctca

SEQ ID NO: 4286765 - DNA, 21 bp, Homo sapiens
tcagcccctgctgctcctcgg

SEQ ID NO: 4286766 - DNA, 13 bp, Homo sapiens
tcagccctccctg

SEQ ID NO: 4286767 - DNA, 15 bp, Homo sapiens
tcagccctccctgcc

SEQ ID NO: 4286768 - DNA, 17 bp, Homo sapiens
tcagccctccctgcccc

SEQ ID NO: 4286769 - DNA, 14 bp, Homo sapiens
tcagccctgccctt

SEQ ID NO: 4286770 - DNA, 18 bp, Homo sapiens
tcagcctaggggtcaggg

SEQ ID NO: 4286771 - DNA, 14 bp, Homo sapiens
tcagcctccactcc

SEQ ID NO: 4286772 - DNA, 12 bp, Homo sapiens
tcagcctgtgaa

SEQ ID NO: 4286773 - DNA, 21 bp, Homo sapiens
tcagcttgtttctatactgtt

SEQ ID NO: 4286774 - DNA, 16 bp, Homo sapiens
tcagctttgccttcca

SEQ ID NO: 4286775 - DNA, 22 bp, Homo sapiens
tcagctttgccttccacgctgt

SEQ ID NO: 4286776 - DNA, 20 bp, Homo sapiens
tcaggaagcctcctgctgag

SEQ ID NO: 4286777 - DNA, 12 bp, Homo sapiens
tcaggaatgggc

SEQ ID NO: 4286778 - DNA, 21 bp, Homo sapiens
tcaggaatgggccaagccagg

SEQ ID NO: 4286779 - DNA, 19 bp, Homo sapiens
tcaggaccccatctgctga

SEQ ID NO: 4286780 - DNA, 23 bp, Homo sapiens
tcaggaccccatctgctgagctc

SEQ ID NO: 4286781 - DNA, 21 bp, Homo sapiens
tcaggagaaggcctgcccccc

SEQ ID NO: 4286782 - DNA, 13 bp, Homo sapiens
tcaggaggcagtg

SEQ ID NO: 4286783 - DNA, 20 bp, Homo sapiens
tcaggaggcagtggcttgga

SEQ ID NO: 4286784 - DNA, 19 bp, Homo sapiens
tcaggcagtggcccaggga

SEQ ID NO: 4286785 - DNA, 13 bp, Homo sapiens
tcaggcccacatt

SEQ ID NO: 4286786 - DNA, 17 bp, Homo sapiens
tcaggcttgcattaaaa

SEQ ID NO: 4286787 - DNA, 21 bp, Homo sapiens
tcaggcttgcattaaaagact

SEQ ID NO: 4286788 - DNA, 14 bp, Homo sapiens
tcaggctttttcca

SEQ ID NO: 4286789 - DNA, 14 bp, Homo sapiens
tcagggaccaagga

SEQ ID NO: 4286790 - DNA, 20 bp, Homo sapiens
tcagggaccaaggacccctc

SEQ ID NO: 4286791 - DNA, 23 bp, Homo sapiens
tcagggaccaaggacccctcacc

SEQ ID NO: 4286792 - DNA, 23 bp, Homo sapiens
tcagggagcactggaggcctctg

SEQ ID NO: 4286793 - DNA, 13 bp, Homo sapiens
tcagggagccctg

SEQ ID NO: 4286794 - DNA, 18 bp, Homo sapiens
tcagggcccctgaagtga

SEQ ID NO: 4286795 - DNA, 16 bp, Homo sapiens
tcagggcggggctggc

SEQ ID NO: 4286796 - DNA, 11 bp, Homo sapiens
tcaggggagac

SEQ ID NO: 4286797 - DNA, 16 bp, Homo sapiens
tcaggtgcgtgccaca

SEQ ID NO: 4286798 - DNA, 19 bp, Homo sapiens
tcaggtggaacaggaggaa

SEQ ID NO: 4286799 - DNA, 22 bp, Homo sapiens
tcaggtggaacaggaggaactg

SEQ ID NO: 4286800 - DNA, 23 bp, Homo sapiens
tcaggtggaacaggaggaactgg

SEQ ID NO: 4286801 - DNA, 22 bp, Homo sapiens
tcaggttgtctgaagtcactgc

SEQ ID NO: 4286802 - DNA, 18 bp, Homo sapiens
tcaggtttgcctgagggc

SEQ ID NO: 4286803 - DNA, 21 bp, Homo sapiens
tcagtaaaattatactgtgtg

SEQ ID NO: 4286804 - DNA, 23 bp, Homo sapiens
tcagtacttgtgaaacacagctg

SEQ ID NO: 4286805 - DNA, 20 bp, Homo sapiens
taggtgggccagcccctccc

SEQ ID NO: 4286806 - DNA, 22 bp, Homo sapiens
taggtgggtcaactccaaggca

SEQ ID NO: 4286807 - DNA, 20 bp, Homo sapiens
taggtttctaaaaagtcaga

SEQ ID NO: 4286808 - DNA, 21 bp, Homo sapiens
tagtaacacataaagtaaatg

SEQ ID NO: 4286809 - DNA, 14 bp, Homo sapiens
tagtaagatctctt

SEQ ID NO: 4286810 - DNA, 21 bp, Homo sapiens
tagtaagatctctttctaaag

SEQ ID NO: 4286811 - DNA, 13 bp, Homo sapiens
tagtaatctgtat

SEQ ID NO: 4286812 - DNA, 16 bp, Homo sapiens
tagtacatgcagaaat

SEQ ID NO: 4286813 - DNA, 18 bp, Homo sapiens
tagtacttcttctgtaat

SEQ ID NO: 4286814 - DNA, 17 bp, Homo sapiens
tagtagaatctcagcac

SEQ ID NO: 4286815 - DNA, 22 bp, Homo sapiens
tagtagcagagtcattgttaca

SEQ ID NO: 4286816 - DNA, 13 bp, Homo sapiens
tagtatcctgtta

SEQ ID NO: 4286817 - DNA, 18 bp, Homo sapiens
tagtcaactgctgtttta

SEQ ID NO: 4286818 - DNA, 19 bp, Homo sapiens
tagtctttagctattactg

SEQ ID NO: 4286819 - DNA, 24 bp, Homo sapiens
tagtctttgtttacatgagttcaa

SEQ ID NO: 4286820 - DNA, 18 bp, Homo sapiens
tagtgacccggaggccac

SEQ ID NO: 4286821 - DNA, 15 bp, Homo sapiens
tagtgagatttgtat

SEQ ID NO: 4286822 - DNA, 17 bp, Homo sapiens
tagtgagatttgtattt

SEQ ID NO: 4286823 - DNA, 20 bp, Homo sapiens
tagtgagatttgtatttata

SEQ ID NO: 4286824 - DNA, 14 bp, Homo sapiens
tagtgatacactgt

SEQ ID NO: 4286825 - DNA, 15 bp, Homo sapiens
tagtgtcccttacct

SEQ ID NO: 4286826 - DNA, 13 bp, Homo sapiens
tagtgtctgtcca

SEQ ID NO: 4286827 - DNA, 20 bp, Homo sapiens
tagtgtgttgtgctttcaag

SEQ ID NO: 4286828 - DNA, 16 bp, Homo sapiens
tagttagcaggaaata

SEQ ID NO: 4286829 - DNA, 16 bp, Homo sapiens
tagttctatttctatc

SEQ ID NO: 4286830 - DNA, 17 bp, Homo sapiens
tagttgaacaagatttc

SEQ ID NO: 4286831 - DNA, 21 bp, Homo sapiens
tagttgaacaagatttcccta

SEQ ID NO: 4286832 - DNA, 23 bp, Homo sapiens
tagttgatgaccaatctctgtga

SEQ ID NO: 4286833 - DNA, 14 bp, Homo sapiens
tagtttcagctgac

SEQ ID NO: 4286834 - DNA, 20 bp, Homo sapiens
tagtttcagctgaccagaag

SEQ ID NO: 4286835 - DNA, 16 bp, Homo sapiens
tagtttgcatacttcc

SEQ ID NO: 4286836 - DNA, 13 bp, Homo sapiens
tagttttctaaat

SEQ ID NO: 4286837 - DNA, 17 bp, Homo sapiens
tagttttctaaatgttt

SEQ ID NO: 4286838 - DNA, 17 bp, Homo sapiens
tataaaacagtgtttcc

SEQ ID NO: 4286839 - DNA, 12 bp, Homo sapiens
tataaactttta

SEQ ID NO: 4286840 - DNA, 23 bp, Homo sapiens
tataaatactaaatatgaaattt

SEQ ID NO: 4286841 - DNA, 12 bp, Homo sapiens
tataaatatcta

SEQ ID NO: 4286842 - DNA, 12 bp, Homo sapiens
tataaatgtgtg

SEQ ID NO: 4286843 - DNA, 13 bp, Homo sapiens
tataaatgtgtgt

SEQ ID NO: 4286844 - DNA, 15 bp, Homo sapiens
tataagccaatgaag

SEQ ID NO: 4286845 - DNA, 18 bp, Homo sapiens
tataagggagtaggctgt

SEQ ID NO: 4286846 - DNA, 17 bp, Homo sapiens
tataatacttaaaaata

SEQ ID NO: 4286847 - DNA, 22 bp, Homo sapiens
tataatacttaaaaatatgtga

SEQ ID NO: 4286848 - DNA, 19 bp, Homo sapiens
tataatactttgtatacaa

SEQ ID NO: 4286849 - DNA, 20 bp, Homo sapiens
tataatactttgtatacaag

SEQ ID NO: 4286850 - DNA, 21 bp, Homo sapiens
tataatctcttcttatacaga

SEQ ID NO: 4286851 - DNA, 16 bp, Homo sapiens
tatacaaacaggtgct

SEQ ID NO: 4286852 - DNA, 18 bp, Homo sapiens
tatacaaccttcatttaa

SEQ ID NO: 4286853 - DNA, 20 bp, Homo sapiens
tatacaaccttcatttaaaa

SEQ ID NO: 4286854 - DNA, 16 bp, Homo sapiens
tatacaagtactggta

SEQ ID NO: 4286855 - DNA, 19 bp, Homo sapiens
tatacaagtactggtaaga

SEQ ID NO: 4286856 - DNA, 23 bp, Homo sapiens
tatacaagtactggtaagattgt

SEQ ID NO: 4286857 - DNA, 21 bp, Homo sapiens
tatacagtttttgtaaccata

SEQ ID NO: 4286858 - DNA, 16 bp, Homo sapiens
tatacatcacgttaaa

SEQ ID NO: 4286859 - DNA, 14 bp, Homo sapiens
tatacatgtatagt

SEQ ID NO: 4286860 - DNA, 21 bp, Homo sapiens
tataccctaggtctccacccc

SEQ ID NO: 4286861 - DNA, 22 bp, Homo sapiens
tatactcattagaattaccatt

SEQ ID NO: 4286862 - DNA, 11 bp, Homo sapiens
tatactgcata

SEQ ID NO: 4286863 - DNA, 22 bp, Homo sapiens
tatactgcatatcctggtgtct

SEQ ID NO: 4286864 - DNA, 19 bp, Homo sapiens
tatactggttatagttgat

SEQ ID NO: 4286865 - DNA, 16 bp, Homo sapiens
tatactgtttgtaata

SEQ ID NO: 4286866 - DNA, 15 bp, Homo sapiens
tatagttgaacaaga

SEQ ID NO: 4286867 - DNA, 19 bp, Homo sapiens
tatataaatatctatttat

SEQ ID NO: 4286868 - DNA, 12 bp, Homo sapiens
tatataaatggt

SEQ ID NO: 4286869 - DNA, 13 bp, Homo sapiens
tatataaatggtg

SEQ ID NO: 4286870 - DNA, 18 bp, Homo sapiens
tatataattttattgctg

SEQ ID NO: 4286871 - DNA, 15 bp, Homo sapiens
tatatacatgtatag

SEQ ID NO: 4286872 - DNA, 18 bp, Homo sapiens
tatatacatgtatagtga

SEQ ID NO: 4286873 - DNA, 18 bp, Homo sapiens
tatatataaatatctatt

SEQ ID NO: 4286874 - DNA, 15 bp, Homo sapiens
tatatatacatgtat

SEQ ID NO: 4286875 - DNA, 14 bp, Homo sapiens
tatatatgtacagt

SEQ ID NO: 4286876 - DNA, 12 bp, Homo sapiens
tatatctgaaaa

SEQ ID NO: 4286877 - DNA, 17 bp, Homo sapiens
tatatctgaaaactgga

SEQ ID NO: 4286878 - DNA, 14 bp, Homo sapiens
tatatctgtggtct

SEQ ID NO: 4286879 - DNA, 18 bp, Homo sapiens
tatatctgtggtcttcaa

SEQ ID NO: 4286880 - DNA, 12 bp, Homo sapiens
tatatgtacagt

SEQ ID NO: 4286881 - DNA, 13 bp, Homo sapiens
tatatgtacagtt

SEQ ID NO: 4286882 - DNA, 13 bp, Homo sapiens
tatattatatata

SEQ ID NO: 4286883 - DNA, 23 bp, Homo sapiens
tatattcagagatgtaccatgtt

SEQ ID NO: 4286884 - DNA, 18 bp, Homo sapiens
tatattccaggtttaagt

SEQ ID NO: 4286885 - DNA, 21 bp, Homo sapiens
tatattccaggtttaagtaga

SEQ ID NO: 4286886 - DNA, 13 bp, Homo sapiens
tatatttatcata

SEQ ID NO: 4286887 - DNA, 12 bp, Homo sapiens
tatatttatttc

SEQ ID NO: 4286888 - DNA, 15 bp, Homo sapiens
tatatttcatattga

SEQ ID NO: 4286889 - DNA, 18 bp, Homo sapiens
tatattttatttcaatgt

SEQ ID NO: 4286890 - DNA, 17 bp, Homo sapiens
tatcaagtcccgaggca

SEQ ID NO: 4286891 - DNA, 20 bp, Homo sapiens
tatcactgtgcagttgctgt

SEQ ID NO: 4286892 - DNA, 13 bp, Homo sapiens
tatcatatttaat

SEQ ID NO: 4286893 - DNA, 16 bp, Homo sapiens
tatccccatttctttt

SEQ ID NO: 4286894 - DNA, 14 bp, Homo sapiens
tatcctgcaccctc

SEQ ID NO: 4286895 - DNA, 17 bp, Homo sapiens
tatcctggtgtctagtt

SEQ ID NO: 4286896 - DNA, 14 bp, Homo sapiens
tatccttttatctc

SEQ ID NO: 4286897 - DNA, 15 bp, Homo sapiens
tatcgttatcactgt

SEQ ID NO: 4286898 - DNA, 15 bp, Homo sapiens
tatctaaaaaataac

SEQ ID NO: 4286899 - DNA, 19 bp, Homo sapiens
tatctaaaaaataactgtg

SEQ ID NO: 4286900 - DNA, 15 bp, Homo sapiens
tatctatttatctgt

SEQ ID NO: 4286901 - DNA, 17 bp, Homo sapiens
tatctatttatctgtct

SEQ ID NO: 4286902 - DNA, 19 bp, Homo sapiens
tatctatttatctgtctga

SEQ ID NO: 4286903 - DNA, 14 bp, Homo sapiens
tatctgaaaactgg

SEQ ID NO: 4286904 - DNA, 15 bp, Homo sapiens
tatctgatatctgtt

SEQ ID NO: 4286905 - DNA, 18 bp, Homo sapiens
tatctgtaaatttaactg

SEQ ID NO: 4286906 - DNA, 12 bp, Homo sapiens
tatctgtacctg

SEQ ID NO: 4286907 - DNA, 24 bp, Homo sapiens
tatctgtacctgcccccactcagc

SEQ ID NO: 4286908 - DNA, 22 bp, Homo sapiens
tatctgtctgagccctgccctc

SEQ ID NO: 4286909 - DNA, 17 bp, Homo sapiens
tatctgtttgcttctaa

SEQ ID NO: 4286910 - DNA, 15 bp, Homo sapiens
tatcttatctagcaa

SEQ ID NO: 4286911 - DNA, 14 bp, Homo sapiens
tatcttatttatat

SEQ ID NO: 4286912 - DNA, 16 bp, Homo sapiens
tatcttcatgtaaatt

SEQ ID NO: 4286913 - DNA, 18 bp, Homo sapiens
tatcttcatgtaaattga

SEQ ID NO: 4286914 - DNA, 18 bp, Homo sapiens
tatcttgaagaatattgt

SEQ ID NO: 4286915 - DNA, 13 bp, Homo sapiens
tatcttgggacca

SEQ ID NO: 4286916 - DNA, 12 bp, Homo sapiens
tatctttcagtt

SEQ ID NO: 4286917 - DNA, 13 bp, Homo sapiens
tatgaagtaagtt

SEQ ID NO: 4286918 - DNA, 18 bp, Homo sapiens
tatgaataaagacaccta

SEQ ID NO: 4286919 - DNA, 23 bp, Homo sapiens
tatgacaatttcaaaatgcatgt

SEQ ID NO: 4286920 - DNA, 22 bp, Homo sapiens
tatgacctaaatccattttcta

SEQ ID NO: 4286921 - DNA, 23 bp, Homo sapiens
tatgacctaaatccattttctaa

SEQ ID NO: 4286922 - DNA, 16 bp, Homo sapiens
tatgagctcttcatgt

SEQ ID NO: 4286923 - DNA, 19 bp, Homo sapiens
tatgaggggactgcatgca

SEQ ID NO: 4286924 - DNA, 21 bp, Homo sapiens
tatgaggggactgcatgcaag

SEQ ID NO: 4286925 - DNA, 14 bp, Homo sapiens
tatgattctcctct

SEQ ID NO: 4286926 - DNA, 17 bp, Homo sapiens
tatgcaagaagaatata

SEQ ID NO: 4286927 - DNA, 18 bp, Homo sapiens
tatgcacctataaatact

SEQ ID NO: 4286928 - DNA, 18 bp, Homo sapiens
tatgcagtgtagatttta

SEQ ID NO: 4286929 - DNA, 14 bp, Homo sapiens
tatgccacctgcag

SEQ ID NO: 4286930 - DNA, 13 bp, Homo sapiens
tatgcctgtattt

SEQ ID NO: 4286931 - DNA, 21 bp, Homo sapiens
tatgcctgtatttccaacaaa

SEQ ID NO: 4286932 - DNA, 14 bp, Homo sapiens
tatgctgtatctgt

SEQ ID NO: 4286933 - DNA, 19 bp, Homo sapiens
tatggcttgtagggtgagg

SEQ ID NO: 4286934 - DNA, 23 bp, Homo sapiens
tatggggggccaacaccagggat

SEQ ID NO: 4286935 - DNA, 14 bp, Homo sapiens
tatggtagaaaaat

SEQ ID NO: 4286936 - DNA, 19 bp, Homo sapiens
tatggtagaaaaatttcac

SEQ ID NO: 4286937 - DNA, 22 bp, Homo sapiens
tatggtagaaaaatttcacgat

SEQ ID NO: 4286938 - DNA, 22 bp, Homo sapiens
tatggtattttcgtgcatttgt

SEQ ID NO: 4286939 - DNA, 20 bp, Homo sapiens
tatggtgctgggtccttaaa

SEQ ID NO: 4286940 - DNA, 15 bp, Homo sapiens
taccatgttaaagag

SEQ ID NO: 4286941 - DNA, 21 bp, Homo sapiens
taccattttgcgatgtgtttt

SEQ ID NO: 4286942 - DNA, 19 bp, Homo sapiens
tacccagtaactcatctgt

SEQ ID NO: 4286943 - DNA, 22 bp, Homo sapiens
tacccagtaactcatctgtcac

SEQ ID NO: 4286944 - DNA, 17 bp, Homo sapiens
tacccatgtgtcgcctc

SEQ ID NO: 4286945 - DNA, 14 bp, Homo sapiens
taccccctgcccca

SEQ ID NO: 4286946 - DNA, 15 bp, Homo sapiens
taccccctgccccag

SEQ ID NO: 4286947 - DNA, 18 bp, Homo sapiens
tacccctttggcacaccc

SEQ ID NO: 4286948 - DNA, 18 bp, Homo sapiens
taccgagtctcttctcca

SEQ ID NO: 4286949 - DNA, 22 bp, Homo sapiens
taccgagtctcttctccactgg

SEQ ID NO: 4286950 - DNA, 19 bp, Homo sapiens
tacctcaacaagaagaatt

SEQ ID NO: 4286951 - DNA, 16 bp, Homo sapiens
tacctgtattgtctga

SEQ ID NO: 4286952 - DNA, 17 bp, Homo sapiens
tacctgtgaatcaaaac

SEQ ID NO: 4286953 - DNA, 21 bp, Homo sapiens
tacctttctgacaataaataa

SEQ ID NO: 4286954 - DNA, 15 bp, Homo sapiens
tacgatgttaaaaca

SEQ ID NO: 4286955 - DNA, 16 bp, Homo sapiens
tacgatgttaaaacaa

SEQ ID NO: 4286956 - DNA, 13 bp, Homo sapiens
tacgctctctgtc

SEQ ID NO: 4286957 - DNA, 14 bp, Homo sapiens
tacgtctggtgttc

SEQ ID NO: 4286958 - DNA, 18 bp, Homo sapiens
tactaaacattttgttat

SEQ ID NO: 4286959 - DNA, 16 bp, Homo sapiens
tactaagaataaataa

SEQ ID NO: 4286960 - DNA, 22 bp, Homo sapiens
tactagaaccttctaatccatg

SEQ ID NO: 4286961 - DNA, 24 bp, Homo sapiens
tactagagatattttgtaaaatgt

SEQ ID NO: 4286962 - DNA, 15 bp, Homo sapiens
tactcaccaaaatat

SEQ ID NO: 4286963 - DNA, 12 bp, Homo sapiens
tactctccagga

SEQ ID NO: 4286964 - DNA, 19 bp, Homo sapiens
tactctccaggattgtcca

SEQ ID NO: 4286965 - DNA, 15 bp, Homo sapiens
tactctgtgtaatct

SEQ ID NO: 4286966 - DNA, 20 bp, Homo sapiens
tactgactccaaccattcaa

SEQ ID NO: 4286967 - DNA, 22 bp, Homo sapiens
tactgatttgggctgaatgtat

SEQ ID NO: 4286968 - DNA, 23 bp, Homo sapiens
tactgatttgggctgaatgtatg

SEQ ID NO: 4286969 - DNA, 17 bp, Homo sapiens
tactgcagaatacagta

SEQ ID NO: 4286970 - DNA, 22 bp, Homo sapiens
tactgcagaatacagtaagctg

SEQ ID NO: 4286971 - DNA, 13 bp, Homo sapiens
tactgcatgcact

SEQ ID NO: 4286972 - DNA, 22 bp, Homo sapiens
tactgcccggggcagctgccag

SEQ ID NO: 4286973 - DNA, 22 bp, Homo sapiens
tactgcttggatccatacaaaa

SEQ ID NO: 4286974 - DNA, 17 bp, Homo sapiens
tactggtaagattgtta

SEQ ID NO: 4286975 - DNA, 21 bp, Homo sapiens
tactggtaagattgttattaa

SEQ ID NO: 4286976 - DNA, 14 bp, Homo sapiens
tactggttatagtt

SEQ ID NO: 4286977 - DNA, 23 bp, Homo sapiens
tactggttatagttgatatgtaa

SEQ ID NO: 4286978 - DNA, 21 bp, Homo sapiens
tactggttggtgttcttccca

SEQ ID NO: 4286979 - DNA, 17 bp, Homo sapiens
tactgtgtgtgagtgtg

SEQ ID NO: 4286980 - DNA, 14 bp, Homo sapiens
tactgttttgtgcg

SEQ ID NO: 4286981 - DNA, 12 bp, Homo sapiens
tacttgagaata

SEQ ID NO: 4286982 - DNA, 22 bp, Homo sapiens
tacttgccctgaccatgcattt

SEQ ID NO: 4286983 - DNA, 18 bp, Homo sapiens
tacttgtgaaacacagct

SEQ ID NO: 4286984 - DNA, 19 bp, Homo sapiens
tactttacctctctgtcat

SEQ ID NO: 4286985 - DNA, 22 bp, Homo sapiens
tactttacctctctgtcatgtg

SEQ ID NO: 4286986 - DNA, 20 bp, Homo sapiens
tactttatgttactacatgc

SEQ ID NO: 4286987 - DNA, 12 bp, Homo sapiens
tactttgcattg

SEQ ID NO: 4286988 - DNA, 16 bp, Homo sapiens
tactttgcattgtctg

SEQ ID NO: 4286989 - DNA, 18 bp, Homo sapiens
tactttggtttctgagca

SEQ ID NO: 4286990 - DNA, 19 bp, Homo sapiens
tactttggtttctgtctgt

SEQ ID NO: 4286991 - DNA, 15 bp, Homo sapiens
tactttgtgcaatat

SEQ ID NO: 4286992 - DNA, 17 bp, Homo sapiens
tagaaaaatttcacgat

SEQ ID NO: 4286993 - DNA, 12 bp, Homo sapiens
tagaaagaaatt

SEQ ID NO: 4286994 - DNA, 23 bp, Homo sapiens
tagaaattttatctcttcttcct

SEQ ID NO: 4286995 - DNA, 20 bp, Homo sapiens
tagaactgtcccacaaaata

SEQ ID NO: 4286996 - DNA, 22 bp, Homo sapiens
tagaactgtcccacaaaatatt

SEQ ID NO: 4286997 - DNA, 19 bp, Homo sapiens
tagaactgttcatttccac

SEQ ID NO: 4286998 - DNA, 17 bp, Homo sapiens
tagaagagggagaagga

SEQ ID NO: 4286999 - DNA, 18 bp, Homo sapiens
tagaagagggagaaggag

SEQ ID NO: 4287000 - DNA, 20 bp, Homo sapiens
tagaatactgtattgttaca

SEQ ID NO: 4287001 - DNA, 18 bp, Homo sapiens
tagaatatcctatactgg

SEQ ID NO: 4287002 - DNA, 13 bp, Homo sapiens
tagaatggggctt

SEQ ID NO: 4287003 - DNA, 15 bp, Homo sapiens
tagacaaccctgcaa

SEQ ID NO: 4287004 - DNA, 12 bp, Homo sapiens
tagacaagcctg

SEQ ID NO: 4287005 - DNA, 17 bp, Homo sapiens
tagacaagcctggagga

SEQ ID NO: 4287006 - DNA, 14 bp, Homo sapiens
tagactgggctggc

SEQ ID NO: 4287007 - DNA, 16 bp, Homo sapiens
tagactgggctggctg

SEQ ID NO: 4287008 - DNA, 21 bp, Homo sapiens
tagagaaaatggaacattaac

SEQ ID NO: 4287009 - DNA, 22 bp, Homo sapiens
tagagaaggacccggaggggcc

SEQ ID NO: 4287010 - DNA, 16 bp, Homo sapiens
tagagatattttgtaa

SEQ ID NO: 4287011 - DNA, 20 bp, Homo sapiens
tagagattaatttgtgtaga

SEQ ID NO: 4287012 - DNA, 17 bp, Homo sapiens
tagagcattctggggtg

SEQ ID NO: 4287013 - DNA, 20 bp, Homo sapiens
tagagcattctggggtgggg

SEQ ID NO: 4287014 - DNA, 17 bp, Homo sapiens
tagaggcttccttcatt

SEQ ID NO: 4287015 - DNA, 20 bp, Homo sapiens
tagagtgcccttaaaataat

SEQ ID NO: 4287016 - DNA, 17 bp, Homo sapiens
tagatattcatactttc

SEQ ID NO: 4287017 - DNA, 19 bp, Homo sapiens
tagatattcatactttcca

SEQ ID NO: 4287018 - DNA, 12 bp, Homo sapiens
tagatctcctgt

SEQ ID NO: 4287019 - DNA, 14 bp, Homo sapiens
tagatgcctgggcc

SEQ ID NO: 4287020 - DNA, 16 bp, Homo sapiens
tagatgcctgggcctg

SEQ ID NO: 4287021 - DNA, 13 bp, Homo sapiens
tagatttctttga

SEQ ID NO: 4287022 - DNA, 15 bp, Homo sapiens
tagattttatagtgt

SEQ ID NO: 4287023 - DNA, 17 bp, Homo sapiens
tagcaagaagattctaa

SEQ ID NO: 4287024 - DNA, 16 bp, Homo sapiens
tagcacagaggatggc

SEQ ID NO: 4287025 - DNA, 22 bp, Homo sapiens
tagcacagaggatggcttcccc

SEQ ID NO: 4287026 - DNA, 15 bp, Homo sapiens
tagcaggaaatagtg

SEQ ID NO: 4287027 - DNA, 22 bp, Homo sapiens
tagcagggtctttgtgtgctgt

SEQ ID NO: 4287028 - DNA, 18 bp, Homo sapiens
tagcatatataattttat

SEQ ID NO: 4287029 - DNA, 15 bp, Homo sapiens
tagcatcctgattat

SEQ ID NO: 4287030 - DNA, 18 bp, Homo sapiens
tagcatcctgattattga

SEQ ID NO: 4287031 - DNA, 20 bp, Homo sapiens
tagcatcctgattattgaat

SEQ ID NO: 4287032 - DNA, 15 bp, Homo sapiens
tagcatctgctcttc

SEQ ID NO: 4287033 - DNA, 21 bp, Homo sapiens
tagcatgaaaggtaatctgaa

SEQ ID NO: 4287034 - DNA, 16 bp, Homo sapiens
tagcatgacaagcccc

SEQ ID NO: 4287035 - DNA, 14 bp, Homo sapiens
tagcattgaaataa

SEQ ID NO: 4287036 - DNA, 15 bp, Homo sapiens
tagcattgaaataat

SEQ ID NO: 4287037 - DNA, 12 bp, Homo sapiens
tagcatttcttg

SEQ ID NO: 4287038 - DNA, 16 bp, Homo sapiens
tagcatttcttgatgt

SEQ ID NO: 4287039 - DNA, 11 bp, Homo sapiens
tagccaaagag

SEQ ID NO: 4287040 - DNA, 15 bp, Homo sapiens
tagccagcccacatc

SEQ ID NO: 4287041 - DNA, 22 bp, Homo sapiens
tagccatgactagggtcctcag

SEQ ID NO: 4287042 - DNA, 14 bp, Homo sapiens
tagcctagggtgag

SEQ ID NO: 4287043 - DNA, 14 bp, Homo sapiens
tagccttctctgtt

SEQ ID NO: 4287044 - DNA, 15 bp, Homo sapiens
tagccttctctgttc

SEQ ID NO: 4287045 - DNA, 14 bp, Homo sapiens
tagcgtgtgtagat

SEQ ID NO: 4287046 - DNA, 18 bp, Homo sapiens
tagcgtgtgtagatagta

SEQ ID NO: 4287047 - DNA, 20 bp, Homo sapiens
tagctataacaactctattt

SEQ ID NO: 4287048 - DNA, 14 bp, Homo sapiens
tagctatgctgtat

SEQ ID NO: 4287049 - DNA, 15 bp, Homo sapiens
tagctattactggat

SEQ ID NO: 4287050 - DNA, 20 bp, Homo sapiens
tagctctcgcctcaggcttt

SEQ ID NO: 4287051 - DNA, 19 bp, Homo sapiens
tagctgaaacctaaggcaa

SEQ ID NO: 4287052 - DNA, 17 bp, Homo sapiens
tagctgaacaatgaatg

SEQ ID NO: 4287053 - DNA, 21 bp, Homo sapiens
tagctggagagagagttctca

SEQ ID NO: 4287054 - DNA, 14 bp, Homo sapiens
tagcttcagtcatt

SEQ ID NO: 4287055 - DNA, 18 bp, Homo sapiens
taggaacagagtatatat

SEQ ID NO: 4287056 - DNA, 21 bp, Homo sapiens
taggaagacacattatcttct

SEQ ID NO: 4287057 - DNA, 14 bp, Homo sapiens
taggagcagtgggc

SEQ ID NO: 4287058 - DNA, 14 bp, Homo sapiens
taggcaggaagtca

SEQ ID NO: 4287059 - DNA, 16 bp, Homo sapiens
taggcatactctccag

SEQ ID NO: 4287060 - DNA, 19 bp, Homo sapiens
taggcatactctccaggat

SEQ ID NO: 4287061 - DNA, 14 bp, Homo sapiens
taggccagaggtga

SEQ ID NO: 4287062 - DNA, 21 bp, Homo sapiens
taggcctggagttgggctggt

SEQ ID NO: 4287063 - DNA, 20 bp, Homo sapiens
tagggcatttttcttggatc

SEQ ID NO: 4287064 - DNA, 20 bp, Homo sapiens
taggggaagtgtgctgaggt

SEQ ID NO: 4287065 - DNA, 18 bp, Homo sapiens
taggggccgagggaaatg

SEQ ID NO: 4287066 - DNA, 19 bp, Homo sapiens
taggggtgggggagaatgg

SEQ ID NO: 4287067 - DNA, 14 bp, Homo sapiens
tagggtaggggaag

SEQ ID NO: 4287068 - DNA, 20 bp, Homo sapiens
tagggtcctcaggcagtggc

SEQ ID NO: 4287069 - DNA, 14 bp, Homo sapiens
tagggtgaggcgtg

SEQ ID NO: 4287070 - DNA, 14 bp, Homo sapiens
taggtcagtgaggc

SEQ ID NO: 4287071 - DNA, 15 bp, Homo sapiens
taggtctccacccct

SEQ ID NO: 4287072 - DNA, 20 bp, Homo sapiens
taggtctccacccctcaagc

SEQ ID NO: 4287073 - DNA, 22 bp, Homo sapiens
taggtgctggcatgtctgggtc

SEQ ID NO: 4287074 - DNA, 11 bp, Homo sapiens
taacacatttc

SEQ ID NO: 4287075 - DNA, 15 bp, Homo sapiens
taacactggccccta

SEQ ID NO: 4287076 - DNA, 20 bp, Homo sapiens
taacagttggtgattttaga

SEQ ID NO: 4287077 - DNA, 18 bp, Homo sapiens
taacatagatgcctgggc

SEQ ID NO: 4287078 - DNA, 14 bp, Homo sapiens
taacataggcaaga

SEQ ID NO: 4287079 - DNA, 19 bp, Homo sapiens
taacataggcaagaggagt

SEQ ID NO: 4287080 - DNA, 16 bp, Homo sapiens
taacatatattgttat

SEQ ID NO: 4287081 - DNA, 22 bp, Homo sapiens
taacatattcttgctttcacaa

SEQ ID NO: 4287082 - DNA, 14 bp, Homo sapiens
taacatctctttca

SEQ ID NO: 4287083 - DNA, 15 bp, Homo sapiens
taacatctgaaaaga

SEQ ID NO: 4287084 - DNA, 16 bp, Homo sapiens
taacatctgaaaagaa

SEQ ID NO: 4287085 - DNA, 16 bp, Homo sapiens
taacatgtctaaagtt

SEQ ID NO: 4287086 - DNA, 22 bp, Homo sapiens
taaccatatgattgaaaagaag

SEQ ID NO: 4287087 - DNA, 21 bp, Homo sapiens
taaccttaccagatttttaca

SEQ ID NO: 4287088 - DNA, 14 bp, Homo sapiens
taacctttcaggaa

SEQ ID NO: 4287089 - DNA, 20 bp, Homo sapiens
taactaatacagctgagcta

SEQ ID NO: 4287090 - DNA, 17 bp, Homo sapiens
taactacctttggctta

SEQ ID NO: 4287091 - DNA, 14 bp, Homo sapiens
taactactaagaat

SEQ ID NO: 4287092 - DNA, 16 bp, Homo sapiens
taactactaagaataa

SEQ ID NO: 4287093 - DNA, 17 bp, Homo sapiens
taactagatctcctgta

SEQ ID NO: 4287094 - DNA, 16 bp, Homo sapiens
taactccgtttccaaa

SEQ ID NO: 4287095 - DNA, 20 bp, Homo sapiens
taactgtatatttgtatgat

SEQ ID NO: 4287096 - DNA, 14 bp, Homo sapiens
taactgttacagta

SEQ ID NO: 4287097 - DNA, 21 bp, Homo sapiens
taactgttacagtaatgtcat

SEQ ID NO: 4287098 - DNA, 16 bp, Homo sapiens
taagaaagctatatat

SEQ ID NO: 4287099 - DNA, 20 bp, Homo sapiens
taagaataaataaagaagaa

SEQ ID NO: 4287100 - DNA, 23 bp, Homo sapiens
taagaataatgacgtattgtgaa

SEQ ID NO: 4287101 - DNA, 16 bp, Homo sapiens
taagaatgtatatcag

SEQ ID NO: 4287102 - DNA, 22 bp, Homo sapiens
taagagattggatcaagtatta

SEQ ID NO: 4287103 - DNA, 12 bp, Homo sapiens
taagagccacaa

SEQ ID NO: 4287104 - DNA, 12 bp, Homo sapiens
taagattgtaca

SEQ ID NO: 4287105 - DNA, 15 bp, Homo sapiens
taagattgtacatat

SEQ ID NO: 4287106 - DNA, 23 bp, Homo sapiens
taagcaggaaggtctcatgcctg

SEQ ID NO: 4287107 - DNA, 15 bp, Homo sapiens
taagcattttactgt

SEQ ID NO: 4287108 - DNA, 20 bp, Homo sapiens
taagcattttactgtctgta

SEQ ID NO: 4287109 - DNA, 14 bp, Homo sapiens
taagcctcaggcct

SEQ ID NO: 4287110 - DNA, 23 bp, Homo sapiens
taagcttaaaaaagaaagatttt

SEQ ID NO: 4287111 - DNA, 16 bp, Homo sapiens
taaggacttgtgcctc

SEQ ID NO: 4287112 - DNA, 12 bp, Homo sapiens
taaggtcttatt

SEQ ID NO: 4287113 - DNA, 13 bp, Homo sapiens
taaggttcttgct

SEQ ID NO: 4287114 - DNA, 16 bp, Homo sapiens
taagtaatatctttca

SEQ ID NO: 4287115 - DNA, 12 bp, Homo sapiens
taagtagatttc

SEQ ID NO: 4287116 - DNA, 15 bp, Homo sapiens
taagtagatttcatg

SEQ ID NO: 4287117 - DNA, 20 bp, Homo sapiens
taagtattccttggcccagc

SEQ ID NO: 4287118 - DNA, 21 bp, Homo sapiens
taagtattccttggcccagca

SEQ ID NO: 4287119 - DNA, 17 bp, Homo sapiens
taagtcagtttcacata

SEQ ID NO: 4287120 - DNA, 22 bp, Homo sapiens
taagtctatctggtattaaatg

SEQ ID NO: 4287121 - DNA, 12 bp, Homo sapiens
taagtgactacc

SEQ ID NO: 4287122 - DNA, 20 bp, Homo sapiens
taagtggaaaaaagagaaaa

SEQ ID NO: 4287123 - DNA, 20 bp, Homo sapiens
taagtggctgtgattaatta

SEQ ID NO: 4287124 - DNA, 12 bp, Homo sapiens
taagttcaccgt

SEQ ID NO: 4287125 - DNA, 18 bp, Homo sapiens
taagttctgaaaactgtt

SEQ ID NO: 4287126 - DNA, 20 bp, Homo sapiens
taataactagatctcctgta

SEQ ID NO: 4287127 - DNA, 21 bp, Homo sapiens
taataactagatctcctgtaa

SEQ ID NO: 4287128 - DNA, 14 bp, Homo sapiens
taatacttaaaaat

SEQ ID NO: 4287129 - DNA, 13 bp, Homo sapiens
taatactttgtat

SEQ ID NO: 4287130 - DNA, 20 bp, Homo sapiens
taatactttgtatacaagta

SEQ ID NO: 4287131 - DNA, 15 bp, Homo sapiens
taatatactgcatat

SEQ ID NO: 4287132 - DNA, 18 bp, Homo sapiens
taatatatataatactta

SEQ ID NO: 4287133 - DNA, 14 bp, Homo sapiens
taatatcactcatt

SEQ ID NO: 4287134 - DNA, 16 bp, Homo sapiens
taatatcactcattaa

SEQ ID NO: 4287135 - DNA, 18 bp, Homo sapiens
taatatcactcattaatt

SEQ ID NO: 4287136 - DNA, 14 bp, Homo sapiens
taatatcttgaaga

SEQ ID NO: 4287137 - DNA, 18 bp, Homo sapiens
taatatcttgaagaatat

SEQ ID NO: 4287138 - DNA, 22 bp, Homo sapiens
taatatcttgaagaatattgtt

SEQ ID NO: 4287139 - DNA, 13 bp, Homo sapiens
taatatctttcag

SEQ ID NO: 4287140 - DNA, 13 bp, Homo sapiens
taatatttacaat

SEQ ID NO: 4287141 - DNA, 15 bp, Homo sapiens
taatatttacaatgt

SEQ ID NO: 4287142 - DNA, 14 bp, Homo sapiens
taatcaagtgcatt

SEQ ID NO: 4287143 - DNA, 13 bp, Homo sapiens
taatctctaaaat

SEQ ID NO: 4287144 - DNA, 18 bp, Homo sapiens
taatctctaaaattctag

SEQ ID NO: 4287145 - DNA, 19 bp, Homo sapiens
taatctctaaaattctagt

SEQ ID NO: 4287146 - DNA, 13 bp, Homo sapiens
taatctctgatta

SEQ ID NO: 4287147 - DNA, 14 bp, Homo sapiens
taatctcttcttat

SEQ ID NO: 4287148 - DNA, 15 bp, Homo sapiens
taatctcttcttata

SEQ ID NO: 4287149 - DNA, 17 bp, Homo sapiens
taatgacgtattgtgaa

SEQ ID NO: 4287150 - DNA, 18 bp, Homo sapiens
taatgacgtattgtgaaa

SEQ ID NO: 4287151 - DNA, 19 bp, Homo sapiens
taatgacgtattgtgaaat

SEQ ID NO: 4287152 - DNA, 19 bp, Homo sapiens
taatgatttaagcatttta

SEQ ID NO: 4287153 - DNA, 15 bp, Homo sapiens
taatgtaatcattta

SEQ ID NO: 4287154 - DNA, 14 bp, Homo sapiens
taatgtatcttatt

SEQ ID NO: 4287155 - DNA, 17 bp, Homo sapiens
taatgtcataaagtgag

SEQ ID NO: 4287156 - DNA, 20 bp, Homo sapiens
taatgtgaatatgccagtga

SEQ ID NO: 4287157 - DNA, 18 bp, Homo sapiens
taatgtttccctcaagaa

SEQ ID NO: 4287158 - DNA, 15 bp, Homo sapiens
taattaaaaagttaa

SEQ ID NO: 4287159 - DNA, 16 bp, Homo sapiens
taattaaattttaatg

SEQ ID NO: 4287160 - DNA, 14 bp, Homo sapiens
taattagatccatt

SEQ ID NO: 4287161 - DNA, 17 bp, Homo sapiens
taattagatccattaat

SEQ ID NO: 4287162 - DNA, 15 bp, Homo sapiens
taattataatctctt

SEQ ID NO: 4287163 - DNA, 20 bp, Homo sapiens
taattatgtttacctcactg

SEQ ID NO: 4287164 - DNA, 22 bp, Homo sapiens
taattctcttttcaaacacaca

SEQ ID NO: 4287165 - DNA, 17 bp, Homo sapiens
taattgtataaaacagt

SEQ ID NO: 4287166 - DNA, 23 bp, Homo sapiens
taattgtataaaacagtgtttcc

SEQ ID NO: 4287167 - DNA, 16 bp, Homo sapiens
taattgtggagaggag

SEQ ID NO: 4287168 - DNA, 16 bp, Homo sapiens
taattgttacaatttt

SEQ ID NO: 4287169 - DNA, 22 bp, Homo sapiens
taattgttatacatttttaatt

SEQ ID NO: 4287170 - DNA, 17 bp, Homo sapiens
taatttccttaaagcaa

SEQ ID NO: 4287171 - DNA, 19 bp, Homo sapiens
taatttctgccatttcatg

SEQ ID NO: 4287172 - DNA, 22 bp, Homo sapiens
tacaaagggaagcagagcctgg

SEQ ID NO: 4287173 - DNA, 14 bp, Homo sapiens
tacaaccacatttc

SEQ ID NO: 4287174 - DNA, 14 bp, Homo sapiens
tacaactgagtcct

SEQ ID NO: 4287175 - DNA, 20 bp, Homo sapiens
tacaactgagtccttaaaca

SEQ ID NO: 4287176 - DNA, 21 bp, Homo sapiens
tacaagcattctgtcttgaag

SEQ ID NO: 4287177 - DNA, 18 bp, Homo sapiens
tacaagtactggtaagat

SEQ ID NO: 4287178 - DNA, 18 bp, Homo sapiens
tacaagtgctcagttcca

SEQ ID NO: 4287179 - DNA, 21 bp, Homo sapiens
tacaatatcattttcctggga

SEQ ID NO: 4287180 - DNA, 15 bp, Homo sapiens
tacaatggccagccc

SEQ ID NO: 4287181 - DNA, 19 bp, Homo sapiens
tacaatggccagcccagat

SEQ ID NO: 4287182 - DNA, 17 bp, Homo sapiens
tacacctatgtcatttc

SEQ ID NO: 4287183 - DNA, 19 bp, Homo sapiens
tacactcaagcatgaagat

SEQ ID NO: 4287184 - DNA, 19 bp, Homo sapiens
tacagaagaagctcctgaa

SEQ ID NO: 4287185 - DNA, 13 bp, Homo sapiens
tacagaatgaatc

SEQ ID NO: 4287186 - DNA, 18 bp, Homo sapiens
tacagctaatcagcattc

SEQ ID NO: 4287187 - DNA, 14 bp, Homo sapiens
tacagggaagaaat

SEQ ID NO: 4287188 - DNA, 18 bp, Homo sapiens
tacagtaagctgctctat

SEQ ID NO: 4287189 - DNA, 15 bp, Homo sapiens
tacagtaatgtcata

SEQ ID NO: 4287190 - DNA, 17 bp, Homo sapiens
tacagtaatgtcataaa

SEQ ID NO: 4287191 - DNA, 23 bp, Homo sapiens
tacagtagctgtggggagctggt

SEQ ID NO: 4287192 - DNA, 24 bp, Homo sapiens
tacagtgtatctcgaagtcttcca

SEQ ID NO: 4287193 - DNA, 17 bp, Homo sapiens
tacataattaaatttta

SEQ ID NO: 4287194 - DNA, 19 bp, Homo sapiens
tacatagtctttgtttaca

SEQ ID NO: 4287195 - DNA, 14 bp, Homo sapiens
tacatctaagtcag

SEQ ID NO: 4287196 - DNA, 15 bp, Homo sapiens
tacatctaagtcagt

SEQ ID NO: 4287197 - DNA, 15 bp, Homo sapiens
tacatgattcatttt

SEQ ID NO: 4287198 - DNA, 14 bp, Homo sapiens
tacatgtatagtga

SEQ ID NO: 4287199 - DNA, 16 bp, Homo sapiens
tacatgtatagtgagt

SEQ ID NO: 4287200 - DNA, 23 bp, Homo sapiens
tacatgtatagtgagtgtggctt

SEQ ID NO: 4287201 - DNA, 21 bp, Homo sapiens
tacatgtggaaaactcacaga

SEQ ID NO: 4287202 - DNA, 17 bp, Homo sapiens
tacattaaaataactaa

SEQ ID NO: 4287203 - DNA, 22 bp, Homo sapiens
tacattctgaaggccttgttaa

SEQ ID NO: 4287204 - DNA, 16 bp, Homo sapiens
tacattcttcaagatc

SEQ ID NO: 4287205 - DNA, 15 bp, Homo sapiens
taccacttatttcta

SEQ ID NO: 4287206 - DNA, 16 bp, Homo sapiens
taccacttatttctaa

SEQ ID NO: 4287207 - DNA, 17 bp, Homo sapiens
taccatcggtcagcagg

SEQ ID NO: 4287208 - DNA, 14 bp, Homo sapiens
taccatgttaaaga

SEQ ID NO: 4287209 - DNA, 20 bp, Homo sapiens
ccctgccaactttccagact

SEQ ID NO: 4287210 - DNA, 17 bp, Homo sapiens
ccctgccagaggcctgg

SEQ ID NO: 4287211 - DNA, 20 bp, Homo sapiens
ccctgccagaggcctggtgc

SEQ ID NO: 4287212 - DNA, 14 bp, Homo sapiens
ccctgccatggagg

SEQ ID NO: 4287213 - DNA, 22 bp, Homo sapiens
ccctgccatggaggcgccttcc

SEQ ID NO: 4287214 - DNA, 18 bp, Homo sapiens
ccctgccccacacaggcc

SEQ ID NO: 4287215 - DNA, 13 bp, Homo sapiens
ccctgccccagag

SEQ ID NO: 4287216 - DNA, 22 bp, Homo sapiens
ccctgccccagagaagcctcag

SEQ ID NO: 4287217 - DNA, 22 bp, Homo sapiens
ccctgccccccacattctggct

SEQ ID NO: 4287218 - DNA, 22 bp, Homo sapiens
ccctgccccgccccccagagcc

SEQ ID NO: 4287219 - DNA, 13 bp, Homo sapiens
ccctgccctcact

SEQ ID NO: 4287220 - DNA, 14 bp, Homo sapiens
ccctgccctcactc

SEQ ID NO: 4287221 - DNA, 17 bp, Homo sapiens
ccctgccctcactccac

SEQ ID NO: 4287222 - DNA, 18 bp, Homo sapiens
ccctgccctcactccact

SEQ ID NO: 4287223 - DNA, 20 bp, Homo sapiens
ccctgcctggccctcctctg

SEQ ID NO: 4287224 - DNA, 13 bp, Homo sapiens
ccctgcgccctcc

SEQ ID NO: 4287225 - DNA, 17 bp, Homo sapiens
ccctgcgccctccctcc

SEQ ID NO: 4287226 - DNA, 15 bp, Homo sapiens
ccctgctcaggcctc

SEQ ID NO: 4287227 - DNA, 16 bp, Homo sapiens
ccctgctcaggcctca

SEQ ID NO: 4287228 - DNA, 20 bp, Homo sapiens
ccctgctccatgggcacctc

SEQ ID NO: 4287229 - DNA, 12 bp, Homo sapiens
ccctgctgcctc

SEQ ID NO: 4287230 - DNA, 14 bp, Homo sapiens
ccctgctgcctccc

SEQ ID NO: 4287231 - DNA, 16 bp, Homo sapiens
ccctgctgcctcccca

SEQ ID NO: 4287232 - DNA, 19 bp, Homo sapiens
ccctgctgctcctcggcca

SEQ ID NO: 4287233 - DNA, 20 bp, Homo sapiens
ccctgctttgggctgccctg

SEQ ID NO: 4287234 - DNA, 23 bp, Homo sapiens
ccctgctttgggctgccctggtg

SEQ ID NO: 4287235 - DNA, 14 bp, Homo sapiens
ccctggactctgtg

SEQ ID NO: 4287236 - DNA, 14 bp, Homo sapiens
ccctggagcccggc

SEQ ID NO: 4287237 - DNA, 14 bp, Homo sapiens
ccctggcccagcct

SEQ ID NO: 4287238 - DNA, 19 bp, Homo sapiens
ccctggcctgttctgtttt

SEQ ID NO: 4287239 - DNA, 11 bp, Homo sapiens
ccctgggagag

SEQ ID NO: 4287240 - DNA, 14 bp, Homo sapiens
ccctgggagagtga

SEQ ID NO: 4287241 - DNA, 16 bp, Homo sapiens
ccctgggagagtgagg

SEQ ID NO: 4287242 - DNA, 19 bp, Homo sapiens
ccctgggctggcatgggga

SEQ ID NO: 4287243 - DNA, 20 bp, Homo sapiens
ccctgggctggcatggggag

SEQ ID NO: 4287244 - DNA, 19 bp, Homo sapiens
ccctggggggcacagccag

SEQ ID NO: 4287245 - DNA, 21 bp, Homo sapiens
ccctggggggcacagccagaa

SEQ ID NO: 4287246 - DNA, 12 bp, Homo sapiens
ccctggtcctgc

SEQ ID NO: 4287247 - DNA, 17 bp, Homo sapiens
ccctggtgctgccacac

SEQ ID NO: 4287248 - DNA, 21 bp, Homo sapiens
ccctggtggccaagcctgccc

SEQ ID NO: 4287249 - DNA, 23 bp, Homo sapiens
ccctggtggccaagcctgccccg

SEQ ID NO: 4287250 - DNA, 18 bp, Homo sapiens
ccctggtgtccctgcctg

SEQ ID NO: 4287251 - DNA, 12 bp, Homo sapiens
ccctgtcccctg

SEQ ID NO: 4287252 - DNA, 14 bp, Homo sapiens
ccctgtcccctgag

SEQ ID NO: 4287253 - DNA, 13 bp, Homo sapiens
ccctgtccctgcc

SEQ ID NO: 4287254 - DNA, 23 bp, Homo sapiens
ccctgtccttcccacggccactg

SEQ ID NO: 4287255 - DNA, 13 bp, Homo sapiens
cccttcccacccc

SEQ ID NO: 4287256 - DNA, 13 bp, Homo sapiens
cccttccccactc

SEQ ID NO: 4287257 - DNA, 18 bp, Homo sapiens
cccttccccactcccgtg

SEQ ID NO: 4287258 - DNA, 10 bp, Homo sapiens
aaaaaaagaa

SEQ ID NO: 4287259 - DNA, 12 bp, Homo sapiens
aaaaaaataaca

SEQ ID NO: 4287260 - DNA, 13 bp, Homo sapiens
aaaaaagctgaat

SEQ ID NO: 4287261 - DNA, 12 bp, Homo sapiens
aaaaaataattt

SEQ ID NO: 4287262 - DNA, 12 bp, Homo sapiens
aaaaacagcaga

SEQ ID NO: 4287263 - DNA, 23 bp, Homo sapiens
aaaaacattctatctactgattt

SEQ ID NO: 4287264 - DNA, 16 bp, Homo sapiens
aaaaagtcagatgttt

SEQ ID NO: 4287265 - DNA, 22 bp, Homo sapiens
aaaaataacatctctttcatct

SEQ ID NO: 4287266 - DNA, 13 bp, Homo sapiens
aaaaatattccat

SEQ ID NO: 4287267 - DNA, 13 bp, Homo sapiens
aaaaatttcacga

SEQ ID NO: 4287268 - DNA, 16 bp, Homo sapiens
aaaacacctaagtgac

SEQ ID NO: 4287269 - DNA, 20 bp, Homo sapiens
aaaacagaacgggttctccc

SEQ ID NO: 4287270 - DNA, 22 bp, Homo sapiens
aaaacattgtccccaatgaata

SEQ ID NO: 4287271 - DNA, 22 bp, Homo sapiens
aaaaccttccatgtcaagattc

SEQ ID NO: 4287272 - DNA, 17 bp, Homo sapiens
aaaacgatttaatttat

SEQ ID NO: 4287273 - DNA, 19 bp, Homo sapiens
aaaactatcggttcaagtt

SEQ ID NO: 4287274 - DNA, 19 bp, Homo sapiens
aaaactgtgaccaagtata

SEQ ID NO: 4287275 - DNA, 21 bp, Homo sapiens
aaaactgtgaccaagtataaa

SEQ ID NO: 4287276 - DNA, 19 bp, Homo sapiens
aaaagaaatgctaatgtaa

SEQ ID NO: 4287277 - DNA, 21 bp, Homo sapiens
aaaataacatctgaaaagaaa

SEQ ID NO: 4287278 - DNA, 22 bp, Homo sapiens
aaaatactgactccaaccattc

SEQ ID NO: 4287279 - DNA, 19 bp, Homo sapiens
aaaatacttctttttcatt

SEQ ID NO: 4287280 - DNA, 19 bp, Homo sapiens
aaaatagtaaatgctttgt

SEQ ID NO: 4287281 - DNA, 14 bp, Homo sapiens
aaaatagttctatt

SEQ ID NO: 4287282 - DNA, 13 bp, Homo sapiens
aaaatagttttct

SEQ ID NO: 4287283 - DNA, 23 bp, Homo sapiens
aaaatagttttctaaatgtttct

SEQ ID NO: 4287284 - DNA, 21 bp, Homo sapiens
aaaatatagttaattgtggct

SEQ ID NO: 4287285 - DNA, 13 bp, Homo sapiens
aaaatatttctaa

SEQ ID NO: 4287286 - DNA, 20 bp, Homo sapiens
aaaatatttttttctagcta

SEQ ID NO: 4287287 - DNA, 18 bp, Homo sapiens
aaaatcaaatttttctgg

SEQ ID NO: 4287288 - DNA, 20 bp, Homo sapiens
aaaatcatcaaagtgtttaa

SEQ ID NO: 4287289 - DNA, 16 bp, Homo sapiens
aaaatctattttgtct

SEQ ID NO: 4287290 - DNA, 14 bp, Homo sapiens
aaaatctcctaaat

SEQ ID NO: 4287291 - DNA, 14 bp, Homo sapiens
aaaatggaacatta

SEQ ID NO: 4287292 - DNA, 21 bp, Homo sapiens
aaaattacagaagaagctcct

SEQ ID NO: 4287293 - DNA, 22 bp, Homo sapiens
aaaattagtgagatttgtattt

SEQ ID NO: 4287294 - DNA, 23 bp, Homo sapiens
aaaattagtgagatttgtattta

SEQ ID NO: 4287295 - DNA, 13 bp, Homo sapiens
aaaattcaacaaa

SEQ ID NO: 4287296 - DNA, 20 bp, Homo sapiens
aaaattctagtctctgattt

SEQ ID NO: 4287297 - DNA, 22 bp, Homo sapiens
aaaattgaagagagatatatct

SEQ ID NO: 4287298 - DNA, 23 bp, Homo sapiens
aaaatttctcaatctatgtgatt

SEQ ID NO: 4287299 - DNA, 21 bp, Homo sapiens
aaacaataaacgaaacacaga

SEQ ID NO: 4287300 - DNA, 19 bp, Homo sapiens
aaacacctaagtgactacc

SEQ ID NO: 4287301 - DNA, 15 bp, Homo sapiens
aaacacgtttagaaa

SEQ ID NO: 4287302 - DNA, 23 bp, Homo sapiens
aaacactttacagttctggagga

SEQ ID NO: 4287303 - DNA, 20 bp, Homo sapiens
aaacagggacactacaaaca

SEQ ID NO: 4287304 - DNA, 18 bp, Homo sapiens
aaacaggtgctaacactg

SEQ ID NO: 4287305 - DNA, 14 bp, Homo sapiens
aaacagtgtttcca

SEQ ID NO: 4287306 - DNA, 15 bp, Homo sapiens
aaacagttgcacagc

SEQ ID NO: 4287307 - DNA, 18 bp, Homo sapiens
aaacagttgcacagcatc

SEQ ID NO: 4287308 - DNA, 20 bp, Homo sapiens
aaacataatatcttgaagaa

SEQ ID NO: 4287309 - DNA, 15 bp, Homo sapiens
aaacatctcatcatg

SEQ ID NO: 4287310 - DNA, 15 bp, Homo sapiens
aaacattaaaagaag

SEQ ID NO: 4287311 - DNA, 20 bp, Homo sapiens
aaacattatagattttcatg

SEQ ID NO: 4287312 - DNA, 23 bp, Homo sapiens
aaacattcaaaaacatggccaca

SEQ ID NO: 4287313 - DNA, 19 bp, Homo sapiens
aaacattctatctactgat

SEQ ID NO: 4287314 - DNA, 21 bp, Homo sapiens
aaacattctatctactgattt

SEQ ID NO: 4287315 - DNA, 15 bp, Homo sapiens
aaaccacagccctgt

SEQ ID NO: 4287316 - DNA, 18 bp, Homo sapiens
aaaccacagccctgtcag

SEQ ID NO: 4287317 - DNA, 19 bp, Homo sapiens
aaaccttaatatttcttca

SEQ ID NO: 4287318 - DNA, 16 bp, Homo sapiens
aaaccttttcttgtat

SEQ ID NO: 4287319 - DNA, 12 bp, Homo sapiens
aaacgccatgtc

SEQ ID NO: 4287320 - DNA, 16 bp, Homo sapiens
aaactaaaattcaaca

SEQ ID NO: 4287321 - DNA, 18 bp, Homo sapiens
aaactatcggttcaagtt

SEQ ID NO: 4287322 - DNA, 21 bp, Homo sapiens
aaactatcggttcaagttgat

SEQ ID NO: 4287323 - DNA, 18 bp, Homo sapiens
aaactatgcacctataaa

SEQ ID NO: 4287324 - DNA, 20 bp, Homo sapiens
aaactcacctgctggcccct

SEQ ID NO: 4287325 - DNA, 17 bp, Homo sapiens
aacagttgcacagcatc

SEQ ID NO: 4287326 - DNA, 20 bp, Homo sapiens
aacagttgcacagcatctca

SEQ ID NO: 4287327 - DNA, 17 bp, Homo sapiens
aacagttggtgatttta

SEQ ID NO: 4287328 - DNA, 22 bp, Homo sapiens
aacatagaaattgcctgacgaa

SEQ ID NO: 4287329 - DNA, 16 bp, Homo sapiens
aacatagatgcctggg

SEQ ID NO: 4287330 - DNA, 17 bp, Homo sapiens
aacatagatgcctgggc

SEQ ID NO: 4287331 - DNA, 21 bp, Homo sapiens
aacatattcttgctttcacaa

SEQ ID NO: 4287332 - DNA, 12 bp, Homo sapiens
aacatctgaaaa

SEQ ID NO: 4287333 - DNA, 14 bp, Homo sapiens
aacatctgaaaaga

SEQ ID NO: 4287334 - DNA, 22 bp, Homo sapiens
aacatctgaaaagaaatgctaa

SEQ ID NO: 4287335 - DNA, 14 bp, Homo sapiens
aacatgaattaaga

SEQ ID NO: 4287336 - DNA, 23 bp, Homo sapiens
aacatggggttggctgggcccag

SEQ ID NO: 4287337 - DNA, 21 bp, Homo sapiens
aacattaaaagaagactggaa

SEQ ID NO: 4287338 - DNA, 18 bp, Homo sapiens
aacattctttaacataca

SEQ ID NO: 4287339 - DNA, 16 bp, Homo sapiens
aaccaaaacccatcgt

SEQ ID NO: 4287340 - DNA, 19 bp, Homo sapiens
aaccaatgattcataacaa

SEQ ID NO: 4287341 - DNA, 22 bp, Homo sapiens
aaccaatgattcataacaatgt

SEQ ID NO: 4287342 - DNA, 23 bp, Homo sapiens
aaccactatcttttgttctacct

SEQ ID NO: 4287343 - DNA, 22 bp, Homo sapiens
aaccagggggaagcaccagcct

SEQ ID NO: 4287344 - DNA, 23 bp, Homo sapiens
aaccagggggaagcaccagcctc

SEQ ID NO: 4287345 - DNA, 16 bp, Homo sapiens
aaccagtccctctgag

SEQ ID NO: 4287346 - DNA, 16 bp, Homo sapiens
aaccataaaataaata

SEQ ID NO: 4287347 - DNA, 17 bp, Homo sapiens
aaccataaaataaataa

SEQ ID NO: 4287348 - DNA, 23 bp, Homo sapiens
aaccatatgattgaaaagaagaa

SEQ ID NO: 4287349 - DNA, 17 bp, Homo sapiens
aaccatggacctgcact

SEQ ID NO: 4287350 - DNA, 22 bp, Homo sapiens
aacccatgcatggcctcccagc

SEQ ID NO: 4287351 - DNA, 17 bp, Homo sapiens
aaccccagcagtcctgg

SEQ ID NO: 4287352 - DNA, 14 bp, Homo sapiens
aacccccctcccca

SEQ ID NO: 4287353 - DNA, 13 bp, Homo sapiens
aacccctgtggag

SEQ ID NO: 4287354 - DNA, 15 bp, Homo sapiens
aaccctccctcagcc

SEQ ID NO: 4287355 - DNA, 12 bp, Homo sapiens
aaccctgcccct

SEQ ID NO: 4287356 - DNA, 22 bp, Homo sapiens
aacccttaaacagttgcacagc

SEQ ID NO: 4287357 - DNA, 21 bp, Homo sapiens
aaccgatgctccagccaaccc

SEQ ID NO: 4287358 - DNA, 16 bp, Homo sapiens
aacctacagtggaggg

SEQ ID NO: 4287359 - DNA, 23 bp, Homo sapiens
aacctcactgccctccctcggcc

SEQ ID NO: 4287360 - DNA, 16 bp, Homo sapiens
aacctcatttaccata

SEQ ID NO: 4287361 - DNA, 17 bp, Homo sapiens
aacctcccctggtcctg

SEQ ID NO: 4287362 - DNA, 19 bp, Homo sapiens
aacctcccctggtcctgca

SEQ ID NO: 4287363 - DNA, 23 bp, Homo sapiens
aacctcgaagctgttctctgctt

SEQ ID NO: 4287364 - DNA, 19 bp, Homo sapiens
aacctctctgaactgcaac

SEQ ID NO: 4287365 - DNA, 22 bp, Homo sapiens
aacctgaaaagatgttgtgtct

SEQ ID NO: 4287366 - DNA, 18 bp, Homo sapiens
aaccttaatatttcttca

SEQ ID NO: 4287367 - DNA, 16 bp, Homo sapiens
aaccttcacccagcac

SEQ ID NO: 4287368 - DNA, 15 bp, Homo sapiens
aaccttgagacagct

SEQ ID NO: 4287369 - DNA, 22 bp, Homo sapiens
aacctttcaggaaagtatctct

SEQ ID NO: 4287370 - DNA, 16 bp, Homo sapiens
aacgaaacacagaact

SEQ ID NO: 4287371 - DNA, 20 bp, Homo sapiens
aacgagatttgccaaaaact

SEQ ID NO: 4287372 - DNA, 15 bp, Homo sapiens
aacgatttaatttat

SEQ ID NO: 4287373 - DNA, 23 bp, Homo sapiens
aacgtgatgtgctcatcagaaac

SEQ ID NO: 4287374 - DNA, 23 bp, Homo sapiens
aactacagccaaattgcagaaga

SEQ ID NO: 4287375 - DNA, 14 bp, Homo sapiens
aactactaagaata

SEQ ID NO: 4287376 - DNA, 17 bp, Homo sapiens
aactaggtgctggcatg

SEQ ID NO: 4287377 - DNA, 17 bp, Homo sapiens
aactatcggttcaagtt

SEQ ID NO: 4287378 - DNA, 15 bp, Homo sapiens
aactatgcacctata

SEQ ID NO: 4287379 - DNA, 20 bp, Homo sapiens
aactcacctgctggcccctc

SEQ ID NO: 4287380 - DNA, 22 bp, Homo sapiens
aactcacctgctggcccctcac

SEQ ID NO: 4287381 - DNA, 17 bp, Homo sapiens
aactcatctgtcaccaa

SEQ ID NO: 4287382 - DNA, 18 bp, Homo sapiens
aactccaaggcaaatgtc

SEQ ID NO: 4287383 - DNA, 13 bp, Homo sapiens
aactccaggaaaa

SEQ ID NO: 4287384 - DNA, 21 bp, Homo sapiens
aactccagtgttcccttctgg

SEQ ID NO: 4287385 - DNA, 15 bp, Homo sapiens
aactccgtttccaaa

SEQ ID NO: 4287386 - DNA, 12 bp, Homo sapiens
aactctctctgc

SEQ ID NO: 4287387 - DNA, 14 bp, Homo sapiens
aactctctctgccc

SEQ ID NO: 4287388 - DNA, 23 bp, Homo sapiens
aactctggccttggttcctccag

SEQ ID NO: 4287389 - DNA, 13 bp, Homo sapiens
aactgacttgctg

SEQ ID NO: 4287390 - DNA, 18 bp, Homo sapiens
aactgagccaaaaacaat

SEQ ID NO: 4287391 - DNA, 21 bp, Homo sapiens
aactgagggcatgagtctcac

SEQ ID NO: 4287392 - DNA, 18 bp, Homo sapiens
aactgcccattgtaactt

SEQ ID NO: 4287393 - DNA, 15 bp, Homo sapiens
aactgctgttttatg

SEQ ID NO: 4287394 - DNA, 19 bp, Homo sapiens
aactgctgttttatgtcat

SEQ ID NO: 4287395 - DNA, 14 bp, Homo sapiens
aactggaataagaa

SEQ ID NO: 4287396 - DNA, 11 bp, Homo sapiens
aactggtccag

SEQ ID NO: 4287397 - DNA, 15 bp, Homo sapiens
aactggtccaggcca

SEQ ID NO: 4287398 - DNA, 15 bp, Homo sapiens
aactgtagtaattgt

SEQ ID NO: 4287399 - DNA, 14 bp, Homo sapiens
aactgtatatttgt

SEQ ID NO: 4287400 - DNA, 17 bp, Homo sapiens
aactgtcccacaaaata

SEQ ID NO: 4287401 - DNA, 17 bp, Homo sapiens
aactgttggataataac

SEQ ID NO: 4287402 - DNA, 19 bp, Homo sapiens
aactgttgtttgatgtgta

SEQ ID NO: 4287403 - DNA, 22 bp, Homo sapiens
aactgttgtttgatgtgtatgt

SEQ ID NO: 4287404 - DNA, 19 bp, Homo sapiens
aactgtttatggtattttc

SEQ ID NO: 4287405 - DNA, 12 bp, Homo sapiens
aacttacacaca

SEQ ID NO: 4287406 - DNA, 21 bp, Homo sapiens
aacttagcattttctgcatct

SEQ ID NO: 4287407 - DNA, 15 bp, Homo sapiens
aacttcaccttaaaa

SEQ ID NO: 4287408 - DNA, 13 bp, Homo sapiens
aacttggggaaca

SEQ ID NO: 4287409 - DNA, 17 bp, Homo sapiens
aactttagaaagaaatt

SEQ ID NO: 4287410 - DNA, 16 bp, Homo sapiens
aagaaaagtgggccag

SEQ ID NO: 4287411 - DNA, 12 bp, Homo sapiens
aagaaaataacc

SEQ ID NO: 4287412 - DNA, 14 bp, Homo sapiens
aagaaagattttat

SEQ ID NO: 4287413 - DNA, 19 bp, Homo sapiens
aagaaagattttatgtgct

SEQ ID NO: 4287414 - DNA, 13 bp, Homo sapiens
aagaaccccaggc

SEQ ID NO: 4287415 - DNA, 14 bp, Homo sapiens
aagaacccccctcc

SEQ ID NO: 4287416 - DNA, 18 bp, Homo sapiens
aagaacccccctccccaa

SEQ ID NO: 4287417 - DNA, 13 bp, Homo sapiens
aagaagattctaa

SEQ ID NO: 4287418 - DNA, 19 bp, Homo sapiens
aagaagcccgatccacatt

SEQ ID NO: 4287419 - DNA, 17 bp, Homo sapiens
aagaaggcccgggagga

SEQ ID NO: 4287420 - DNA, 19 bp, Homo sapiens
aagaagggaaattcacact

SEQ ID NO: 4287421 - DNA, 17 bp, Homo sapiens
aagaataaataaagaag

SEQ ID NO: 4287422 - DNA, 19 bp, Homo sapiens
aagaataaataaagaagaa

SEQ ID NO: 4287423 - DNA, 13 bp, Homo sapiens
aagaatataaata

SEQ ID NO: 4287424 - DNA, 13 bp, Homo sapiens
aagaatattgtat

SEQ ID NO: 4287425 - DNA, 12 bp, Homo sapiens
aagaatctactt

SEQ ID NO: 4287426 - DNA, 17 bp, Homo sapiens
aagaattccatctatat

SEQ ID NO: 4287427 - DNA, 17 bp, Homo sapiens
aagaattgccagtcttt

SEQ ID NO: 4287428 - DNA, 17 bp, Homo sapiens
aagaatttgaagacttc

SEQ ID NO: 4287429 - DNA, 12 bp, Homo sapiens
aagacacccagt

SEQ ID NO: 4287430 - DNA, 22 bp, Homo sapiens
aagacaggagagattatttaca

SEQ ID NO: 4287431 - DNA, 22 bp, Homo sapiens
aagaccatttagtcctcacctt

SEQ ID NO: 4287432 - DNA, 14 bp, Homo sapiens
aagaccttctgaag

SEQ ID NO: 4287433 - DNA, 15 bp, Homo sapiens
aagaccttctgaaga

SEQ ID NO: 4287434 - DNA, 20 bp, Homo sapiens
aagaccttctgaagatctca

SEQ ID NO: 4287435 - DNA, 13 bp, Homo sapiens
aagactggaagca

SEQ ID NO: 4287436 - DNA, 14 bp, Homo sapiens
aagacttgatgaat

SEQ ID NO: 4287437 - DNA, 23 bp, Homo sapiens
aagacttttagcggtttgcaaac

SEQ ID NO: 4287438 - DNA, 20 bp, Homo sapiens
aagagaaaaaccaatgattc

SEQ ID NO: 4287439 - DNA, 18 bp, Homo sapiens
aagagaaagtacaaccac

SEQ ID NO: 4287440 - DNA, 11 bp, Homo sapiens
aagagaattct

SEQ ID NO: 4287441 - DNA, 14 bp, Homo sapiens
aagagagacaaaat

SEQ ID NO: 4287442 - DNA, 16 bp, Homo sapiens
aagagagatatatctg

SEQ ID NO: 4287443 - DNA, 17 bp, Homo sapiens
aagagcgctcctctgcc

SEQ ID NO: 4287444 - DNA, 15 bp, Homo sapiens
aagagctagagaaat

SEQ ID NO: 4287445 - DNA, 21 bp, Homo sapiens
aagagctcaggagaaggcctg

SEQ ID NO: 4287446 - DNA, 19 bp, Homo sapiens
aagaggaaaatattgacaa

SEQ ID NO: 4287447 - DNA, 14 bp, Homo sapiens
aagaggagcaggaa

SEQ ID NO: 4287448 - DNA, 17 bp, Homo sapiens
aagaggagcctttccag

SEQ ID NO: 4287449 - DNA, 20 bp, Homo sapiens
aagataaatccaactctgac

SEQ ID NO: 4287450 - DNA, 14 bp, Homo sapiens
aagatcccatttga

SEQ ID NO: 4287451 - DNA, 21 bp, Homo sapiens
aagatcctccttccaggcccc

SEQ ID NO: 4287452 - DNA, 18 bp, Homo sapiens
aagatctcagataaagtg

SEQ ID NO: 4287453 - DNA, 19 bp, Homo sapiens
aagatgaagaagaaaacat

SEQ ID NO: 4287454 - DNA, 21 bp, Homo sapiens
aagatgtcaagctggccgtgg

SEQ ID NO: 4287455 - DNA, 14 bp, Homo sapiens
aagattaacaacac

SEQ ID NO: 4287456 - DNA, 13 bp, Homo sapiens
aagattcagctag

SEQ ID NO: 4287457 - DNA, 18 bp, Homo sapiens
aagattctaaaacattct

SEQ ID NO: 4287458 - DNA, 13 bp, Homo sapiens
aagattgtacata

SEQ ID NO: 4287459 - DNA, 11 bp, Homo sapiens
aaactgcattt

SEQ ID NO: 4287460 - DNA, 12 bp, Homo sapiens
aaactgcatttg

SEQ ID NO: 4287461 - DNA, 18 bp, Homo sapiens
aaactgcgtaggagagaa

SEQ ID NO: 4287462 - DNA, 14 bp, Homo sapiens
aaacttactgtcag

SEQ ID NO: 4287463 - DNA, 21 bp, Homo sapiens
aaacttactgtcagagaatat

SEQ ID NO: 4287464 - DNA, 16 bp, Homo sapiens
aaacttttctgctgat

SEQ ID NO: 4287465 - DNA, 15 bp, Homo sapiens
aaagaaagattttat

SEQ ID NO: 4287466 - DNA, 21 bp, Homo sapiens
aaagaaatgctaatgtaatca

SEQ ID NO: 4287467 - DNA, 17 bp, Homo sapiens
aaagaagaaagtctatg

SEQ ID NO: 4287468 - DNA, 13 bp, Homo sapiens
aaagacatccaca

SEQ ID NO: 4287469 - DNA, 12 bp, Homo sapiens
aaagagaaaaac

SEQ ID NO: 4287470 - DNA, 18 bp, Homo sapiens
aaagagtaaaaccaaagg

SEQ ID NO: 4287471 - DNA, 20 bp, Homo sapiens
aaagatggcgcacccggcag

SEQ ID NO: 4287472 - DNA, 20 bp, Homo sapiens
aaagcatcatggctatctgt

SEQ ID NO: 4287473 - DNA, 17 bp, Homo sapiens
aaagcatgccaatttct

SEQ ID NO: 4287474 - DNA, 20 bp, Homo sapiens
aaagcatttgagctgtggtt

SEQ ID NO: 4287475 - DNA, 16 bp, Homo sapiens
aaagccagtgactcca

SEQ ID NO: 4287476 - DNA, 17 bp, Homo sapiens
aaagccagtgactccag

SEQ ID NO: 4287477 - DNA, 19 bp, Homo sapiens
aaagccagtgactccagga

SEQ ID NO: 4287478 - DNA, 21 bp, Homo sapiens
aaagcctgttgtttaagtgac

SEQ ID NO: 4287479 - DNA, 18 bp, Homo sapiens
aaagctagaggagattgc

SEQ ID NO: 4287480 - DNA, 15 bp, Homo sapiens
aaagctatatatgaa

SEQ ID NO: 4287481 - DNA, 19 bp, Homo sapiens
aaagctgctttccatggca

SEQ ID NO: 4287482 - DNA, 23 bp, Homo sapiens
aaaggatttgaaacttggtgtgt

SEQ ID NO: 4287483 - DNA, 16 bp, Homo sapiens
aaaggcagagattggg

SEQ ID NO: 4287484 - DNA, 15 bp, Homo sapiens
aaaggtagactttta

SEQ ID NO: 4287485 - DNA, 20 bp, Homo sapiens
aaagtagtacttcttctgta

SEQ ID NO: 4287486 - DNA, 23 bp, Homo sapiens
aaagtgaccaggctcacaactgt

SEQ ID NO: 4287487 - DNA, 19 bp, Homo sapiens
aaagtgttattttgtataa

SEQ ID NO: 4287488 - DNA, 13 bp, Homo sapiens
aaagttttgccta

SEQ ID NO: 4287489 - DNA, 13 bp, Homo sapiens
aaataaaaatatt

SEQ ID NO: 4287490 - DNA, 16 bp, Homo sapiens
aaataaagaagaaaat

SEQ ID NO: 4287491 - DNA, 12 bp, Homo sapiens
aaataaatatca

SEQ ID NO: 4287492 - DNA, 19 bp, Homo sapiens
aaataaattggtgataagt

SEQ ID NO: 4287493 - DNA, 23 bp, Homo sapiens
aaataaattggtgataagtggaa

SEQ ID NO: 4287494 - DNA, 14 bp, Homo sapiens
aaatactcaccaaa

SEQ ID NO: 4287495 - DNA, 18 bp, Homo sapiens
aaatagggcaaagaatca

SEQ ID NO: 4287496 - DNA, 16 bp, Homo sapiens
aaatagttctatttct

SEQ ID NO: 4287497 - DNA, 18 bp, Homo sapiens
aaatagttctatttctat

SEQ ID NO: 4287498 - DNA, 17 bp, Homo sapiens
aaatagtttcaaatgag

SEQ ID NO: 4287499 - DNA, 21 bp, Homo sapiens
aaatatagttgaacaagattt

SEQ ID NO: 4287500 - DNA, 21 bp, Homo sapiens
aaatatgattctcctctccca

SEQ ID NO: 4287501 - DNA, 21 bp, Homo sapiens
aaatattgagcagaattcatt

SEQ ID NO: 4287502 - DNA, 19 bp, Homo sapiens
aaatatttaaaaaaaaaca

SEQ ID NO: 4287503 - DNA, 22 bp, Homo sapiens
aaatatttatgacctcaacaaa

SEQ ID NO: 4287504 - DNA, 16 bp, Homo sapiens
aaatatttttttctag

SEQ ID NO: 4287505 - DNA, 21 bp, Homo sapiens
aaatatttttttctagctata

SEQ ID NO: 4287506 - DNA, 17 bp, Homo sapiens
aaatcaaatttttctgg

SEQ ID NO: 4287507 - DNA, 16 bp, Homo sapiens
aaatcagttatgtcaa

SEQ ID NO: 4287508 - DNA, 14 bp, Homo sapiens
aaatcatcaaagtg

SEQ ID NO: 4287509 - DNA, 16 bp, Homo sapiens
aaatccataccccctg

SEQ ID NO: 4287510 - DNA, 22 bp, Homo sapiens
aaatccataccccctgccccag

SEQ ID NO: 4287511 - DNA, 23 bp, Homo sapiens
aaatcctgggcatccccagcccc

SEQ ID NO: 4287512 - DNA, 19 bp, Homo sapiens
aaatctgtctgattctatg

SEQ ID NO: 4287513 - DNA, 20 bp, Homo sapiens
aaatctgtctgattctatgc

SEQ ID NO: 4287514 - DNA, 23 bp, Homo sapiens
aaatctgtctgattctatgcctg

SEQ ID NO: 4287515 - DNA, 21 bp, Homo sapiens
aaatgaatagtacatgcagaa

SEQ ID NO: 4287516 - DNA, 16 bp, Homo sapiens
aaatgagtttaaaaaa

SEQ ID NO: 4287517 - DNA, 12 bp, Homo sapiens
aaatgattccaa

SEQ ID NO: 4287518 - DNA, 13 bp, Homo sapiens
aaatgattccaaa

SEQ ID NO: 4287519 - DNA, 21 bp, Homo sapiens
aaatgatttaaatttaagtaa

SEQ ID NO: 4287520 - DNA, 18 bp, Homo sapiens
aaatgcacatttgtcact

SEQ ID NO: 4287521 - DNA, 23 bp, Homo sapiens
aaatgcagcttcaggtgagccaa

SEQ ID NO: 4287522 - DNA, 21 bp, Homo sapiens
aaatgcatgatattgtatgta

SEQ ID NO: 4287523 - DNA, 15 bp, Homo sapiens
aaatgcctaataaac

SEQ ID NO: 4287524 - DNA, 15 bp, Homo sapiens
aaatgctactcagta

SEQ ID NO: 4287525 - DNA, 14 bp, Homo sapiens
aaatgctgatttaa

SEQ ID NO: 4287526 - DNA, 21 bp, Homo sapiens
aaatgctgtatgtcattaaag

SEQ ID NO: 4287527 - DNA, 19 bp, Homo sapiens
aaatggacttttgttcatg

SEQ ID NO: 4287528 - DNA, 18 bp, Homo sapiens
aaatggaggaaaccacaa

SEQ ID NO: 4287529 - DNA, 19 bp, Homo sapiens
aaatggaggaaaccacaaa

SEQ ID NO: 4287530 - DNA, 18 bp, Homo sapiens
aaatggtgagaattaaaa

SEQ ID NO: 4287531 - DNA, 22 bp, Homo sapiens
aaatgtagcttcagtcattaaa

SEQ ID NO: 4287532 - DNA, 11 bp, Homo sapiens
aaatgtattat

SEQ ID NO: 4287533 - DNA, 14 bp, Homo sapiens
aaatgtattatgtc

SEQ ID NO: 4287534 - DNA, 21 bp, Homo sapiens
aaatgttttacaatggctggg

SEQ ID NO: 4287535 - DNA, 21 bp, Homo sapiens
aaattacagaagaagctcctg

SEQ ID NO: 4287536 - DNA, 15 bp, Homo sapiens
aaattactatagcaa

SEQ ID NO: 4287537 - DNA, 19 bp, Homo sapiens
aaattactatagcaaagta

SEQ ID NO: 4287538 - DNA, 18 bp, Homo sapiens
aaattagggctctaattt

SEQ ID NO: 4287539 - DNA, 19 bp, Homo sapiens
aaattagggctctaatttc

SEQ ID NO: 4287540 - DNA, 20 bp, Homo sapiens
aaattagggctctaatttcc

SEQ ID NO: 4287541 - DNA, 13 bp, Homo sapiens
aaattattctagt

SEQ ID NO: 4287542 - DNA, 14 bp, Homo sapiens
aaattatttctaaa

SEQ ID NO: 4287543 - DNA, 17 bp, Homo sapiens
aaattcaacacttattt

SEQ ID NO: 4287544 - DNA, 12 bp, Homo sapiens
aaattcctgttg

SEQ ID NO: 4287545 - DNA, 12 bp, Homo sapiens
aaattgaagaga

SEQ ID NO: 4287546 - DNA, 17 bp, Homo sapiens
aaattgaagagagatat

SEQ ID NO: 4287547 - DNA, 22 bp, Homo sapiens
aaattgcatttttacctttcat

SEQ ID NO: 4287548 - DNA, 20 bp, Homo sapiens
aaattggtgataagtggaaa

SEQ ID NO: 4287549 - DNA, 22 bp, Homo sapiens
aaattggtgataagtggaaaaa

SEQ ID NO: 4287550 - DNA, 17 bp, Homo sapiens
aaatttaactgcatata

SEQ ID NO: 4287551 - DNA, 16 bp, Homo sapiens
aaatttaatatactgc

SEQ ID NO: 4287552 - DNA, 21 bp, Homo sapiens
aaatttattagccctgcattt

SEQ ID NO: 4287553 - DNA, 19 bp, Homo sapiens
aaatttatttccaatgttt

SEQ ID NO: 4287554 - DNA, 15 bp, Homo sapiens
aaattttcagaaagc

SEQ ID NO: 4287555 - DNA, 16 bp, Homo sapiens
aaattttcagaaagca

SEQ ID NO: 4287556 - DNA, 20 bp, Homo sapiens
aaatttttctgggaagaaaa

SEQ ID NO: 4287557 - DNA, 21 bp, Homo sapiens
aacaaacagaaacgagatttg

SEQ ID NO: 4287558 - DNA, 21 bp, Homo sapiens
aacaaacctctatatgttgct

SEQ ID NO: 4287559 - DNA, 19 bp, Homo sapiens
aacaaacttactgtcagag

SEQ ID NO: 4287560 - DNA, 14 bp, Homo sapiens
aacaaagaaatatt

SEQ ID NO: 4287561 - DNA, 11 bp, Homo sapiens
aacaaagaaga

SEQ ID NO: 4287562 - DNA, 19 bp, Homo sapiens
aacaaagaagaaccatctt

SEQ ID NO: 4287563 - DNA, 14 bp, Homo sapiens
aacaaatggcttgt

SEQ ID NO: 4287564 - DNA, 13 bp, Homo sapiens
aacaactctattt

SEQ ID NO: 4287565 - DNA, 22 bp, Homo sapiens
aacaacttaatgttctgaataa

SEQ ID NO: 4287566 - DNA, 11 bp, Homo sapiens
aacaagaggag

SEQ ID NO: 4287567 - DNA, 20 bp, Homo sapiens
aacaagaggagcaggaagca

SEQ ID NO: 4287568 - DNA, 17 bp, Homo sapiens
aacaagatgaaattcca

SEQ ID NO: 4287569 - DNA, 21 bp, Homo sapiens
aacaagccaaacattcttatt

SEQ ID NO: 4287570 - DNA, 23 bp, Homo sapiens
aacaatgcctattgtaatataga

SEQ ID NO: 4287571 - DNA, 13 bp, Homo sapiens
aacacagattatt

SEQ ID NO: 4287572 - DNA, 18 bp, Homo sapiens
aacacagctgttcttctg

SEQ ID NO: 4287573 - DNA, 20 bp, Homo sapiens
aacacagtcatgtgtcagct

SEQ ID NO: 4287574 - DNA, 17 bp, Homo sapiens
aacacataaagtaaatg

SEQ ID NO: 4287575 - DNA, 23 bp, Homo sapiens
aacacataaagtaaatgctacct

SEQ ID NO: 4287576 - DNA, 14 bp, Homo sapiens
aacacgcacagaag

SEQ ID NO: 4287577 - DNA, 13 bp, Homo sapiens
aacactggcccct

SEQ ID NO: 4287578 - DNA, 18 bp, Homo sapiens
aacacttattttctgaat

SEQ ID NO: 4287579 - DNA, 23 bp, Homo sapiens
aacacttattttctgaattcata

SEQ ID NO: 4287580 - DNA, 20 bp, Homo sapiens
aacagaaacgagatttgcca

SEQ ID NO: 4287581 - DNA, 13 bp, Homo sapiens
aacagagtatata

SEQ ID NO: 4287582 - DNA, 15 bp, Homo sapiens
aacagcaggttgtgt

SEQ ID NO: 4287583 - DNA, 17 bp, Homo sapiens
aacagcatgtctactgc

SEQ ID NO: 4287584 - DNA, 18 bp, Homo sapiens
aacagcatgtctactgct

SEQ ID NO: 4287585 - DNA, 24 bp, Homo sapiens
aacagctaggttaataggaggaca

SEQ ID NO: 4287586 - DNA, 20 bp, Homo sapiens
aacaggaccaggagccaggt

SEQ ID NO: 4287587 - DNA, 18 bp, Homo sapiens
aacaggaggaactggtcc

SEQ ID NO: 4287588 - DNA, 20 bp, Homo sapiens
aacagggacactacaaacat

SEQ ID NO: 4287589 - DNA, 21 bp, Homo sapiens
aacagtctcattacagattta

SEQ ID NO: 4287590 - DNA, 11 bp, Homo sapiens
aacagtgtttc

SEQ ID NO: 4287591 - DNA, 13 bp, Homo sapiens
aacagtgtttcca

SEQ ID NO: 4287592 - DNA, 14 bp, Homo sapiens
acactgtatctaaa

SEQ ID NO: 4287593 - DNA, 15 bp, Homo sapiens
acactgtatctaaaa

SEQ ID NO: 4287594 - DNA, 16 bp, Homo sapiens
acactgtctgctgccc

SEQ ID NO: 4287595 - DNA, 19 bp, Homo sapiens
acactgtgcgttttagagt

SEQ ID NO: 4287596 - DNA, 14 bp, Homo sapiens
acacttattttctg

SEQ ID NO: 4287597 - DNA, 15 bp, Homo sapiens
acacttcaggctctt

SEQ ID NO: 4287598 - DNA, 16 bp, Homo sapiens
acacttcctgtccaga

SEQ ID NO: 4287599 - DNA, 19 bp, Homo sapiens
acacttcctgtccagagag

SEQ ID NO: 4287600 - DNA, 16 bp, Homo sapiens
acacttgagatgattt

SEQ ID NO: 4287601 - DNA, 21 bp, Homo sapiens
acagaaccaacgggtctgtgg

SEQ ID NO: 4287602 - DNA, 15 bp, Homo sapiens
acagaagacacgtgt

SEQ ID NO: 4287603 - DNA, 19 bp, Homo sapiens
acagaagacacgtgttttt

SEQ ID NO: 4287604 - DNA, 15 bp, Homo sapiens
acagagtatatatgt

SEQ ID NO: 4287605 - DNA, 22 bp, Homo sapiens
acagagtatatatgtacagtta

SEQ ID NO: 4287606 - DNA, 13 bp, Homo sapiens
acagagtctgggt

SEQ ID NO: 4287607 - DNA, 12 bp, Homo sapiens
acagatcttgag

SEQ ID NO: 4287608 - DNA, 14 bp, Homo sapiens
acagatgttccatc

SEQ ID NO: 4287609 - DNA, 17 bp, Homo sapiens
acagcagtacttgctca

SEQ ID NO: 4287610 - DNA, 23 bp, Homo sapiens
acagcagtacttgctcaataaag

SEQ ID NO: 4287611 - DNA, 16 bp, Homo sapiens
acagcagtgtgagggt

SEQ ID NO: 4287612 - DNA, 14 bp, Homo sapiens
acagcatctcagct

SEQ ID NO: 4287613 - DNA, 14 bp, Homo sapiens
acagcatgtgttaa

SEQ ID NO: 4287614 - DNA, 16 bp, Homo sapiens
acagccaaattgcaga

SEQ ID NO: 4287615 - DNA, 16 bp, Homo sapiens
acagccaccacctgga

SEQ ID NO: 4287616 - DNA, 18 bp, Homo sapiens
acagccaccacctggatg

SEQ ID NO: 4287617 - DNA, 15 bp, Homo sapiens
acagcctcacccctg

SEQ ID NO: 4287618 - DNA, 18 bp, Homo sapiens
acagcctcacccctgcag

SEQ ID NO: 4287619 - DNA, 11 bp, Homo sapiens
acagcctggca

SEQ ID NO: 4287620 - DNA, 17 bp, Homo sapiens
acagcgggtaaaaagag

SEQ ID NO: 4287621 - DNA, 19 bp, Homo sapiens
acagctgaaagacagtaaa

SEQ ID NO: 4287622 - DNA, 21 bp, Homo sapiens
acagcttcacttaaaatcaaa

SEQ ID NO: 4287623 - DNA, 14 bp, Homo sapiens
acaggaacacccag

SEQ ID NO: 4287624 - DNA, 16 bp, Homo sapiens
acaggaacacccagcc

SEQ ID NO: 4287625 - DNA, 19 bp, Homo sapiens
acaggaggaactggtccag

SEQ ID NO: 4287626 - DNA, 13 bp, Homo sapiens
acaggcagaatca

SEQ ID NO: 4287627 - DNA, 18 bp, Homo sapiens
acaggcctggcccagcca

SEQ ID NO: 4287628 - DNA, 20 bp, Homo sapiens
acaggcctggcccagccagc

SEQ ID NO: 4287629 - DNA, 20 bp, Homo sapiens
acaggcgttctcagcctccg

SEQ ID NO: 4287630 - DNA, 19 bp, Homo sapiens
acaggctgccccacccctc

SEQ ID NO: 4287631 - DNA, 21 bp, Homo sapiens
acagggcatctccaggaaggc

SEQ ID NO: 4287632 - DNA, 14 bp, Homo sapiens
acagggccagggtt

SEQ ID NO: 4287633 - DNA, 13 bp, Homo sapiens
acagggtggggct

SEQ ID NO: 4287634 - DNA, 21 bp, Homo sapiens
acagggtggggcttagaatgg

SEQ ID NO: 4287635 - DNA, 24 bp, Homo sapiens
acaggtgtactatggctgtatttt

SEQ ID NO: 4287636 - DNA, 13 bp, Homo sapiens
acagtaaactcac

SEQ ID NO: 4287637 - DNA, 13 bp, Homo sapiens
acagtagctgtgg

SEQ ID NO: 4287638 - DNA, 18 bp, Homo sapiens
acagtagcttcctagacc

SEQ ID NO: 4287639 - DNA, 20 bp, Homo sapiens
acagtcagggcggggctggc

SEQ ID NO: 4287640 - DNA, 20 bp, Homo sapiens
acagtctcattacagattta

SEQ ID NO: 4287641 - DNA, 20 bp, Homo sapiens
acagtctggaggtcccagac

SEQ ID NO: 4287642 - DNA, 16 bp, Homo sapiens
acagtgaacagcttca

SEQ ID NO: 4287643 - DNA, 17 bp, Homo sapiens
acagtgcatctcagccc

SEQ ID NO: 4287644 - DNA, 15 bp, Homo sapiens
acagtggagggagac

SEQ ID NO: 4287645 - DNA, 16 bp, Homo sapiens
acagtggagggagact

SEQ ID NO: 4287646 - DNA, 19 bp, Homo sapiens
acagtggagggagactgac

SEQ ID NO: 4287647 - DNA, 22 bp, Homo sapiens
acagtggagggagactgaccca

SEQ ID NO: 4287648 - DNA, 22 bp, Homo sapiens
acagtgggctatgccactaggc

SEQ ID NO: 4287649 - DNA, 16 bp, Homo sapiens
acagtgtttccagtga

SEQ ID NO: 4287650 - DNA, 13 bp, Homo sapiens
acagttatacata

SEQ ID NO: 4287651 - DNA, 18 bp, Homo sapiens
acagttctacagaaaaac

SEQ ID NO: 4287652 - DNA, 17 bp, Homo sapiens
acagttctggaggagga

SEQ ID NO: 4287653 - DNA, 18 bp, Homo sapiens
acagttctggaggaggag

SEQ ID NO: 4287654 - DNA, 13 bp, Homo sapiens
acagttgcacagc

SEQ ID NO: 4287655 - DNA, 14 bp, Homo sapiens
acagttgcacagca

SEQ ID NO: 4287656 - DNA, 15 bp, Homo sapiens
acagttgcacagcat

SEQ ID NO: 4287657 - DNA, 20 bp, Homo sapiens
acagttgcacagcatctcag

SEQ ID NO: 4287658 - DNA, 20 bp, Homo sapiens
acataaatctgtctgattct

SEQ ID NO: 4287659 - DNA, 15 bp, Homo sapiens
acataatatcttgaa

SEQ ID NO: 4287660 - DNA, 19 bp, Homo sapiens
acataatatcttgaagaat

SEQ ID NO: 4287661 - DNA, 21 bp, Homo sapiens
acatacacctatgtcatttca

SEQ ID NO: 4287662 - DNA, 22 bp, Homo sapiens
acatacctctctctatatatac

SEQ ID NO: 4287663 - DNA, 16 bp, Homo sapiens
acatagaaattgcctg

SEQ ID NO: 4287664 - DNA, 21 bp, Homo sapiens
acatagaaattgcctgacgaa

SEQ ID NO: 4287665 - DNA, 15 bp, Homo sapiens
acatagatgcctggg

SEQ ID NO: 4287666 - DNA, 17 bp, Homo sapiens
acatagtctttgtttac

SEQ ID NO: 4287667 - DNA, 18 bp, Homo sapiens
acatatcaagtcccgagg

SEQ ID NO: 4287668 - DNA, 19 bp, Homo sapiens
acatatggaaatcctgtta

SEQ ID NO: 4287669 - DNA, 23 bp, Homo sapiens
acatcagtggcatggctccagtc

SEQ ID NO: 4287670 - DNA, 21 bp, Homo sapiens
acatccaacatttcctcaggc

SEQ ID NO: 4287671 - DNA, 18 bp, Homo sapiens
acatccattccagagctg

SEQ ID NO: 4287672 - DNA, 14 bp, Homo sapiens
acatcggttcagga

SEQ ID NO: 4287673 - DNA, 17 bp, Homo sapiens
acatctctttcatctag

SEQ ID NO: 4287674 - DNA, 11 bp, Homo sapiens
acatctgaaaa

SEQ ID NO: 4287675 - DNA, 15 bp, Homo sapiens
acatgactctttatt

SEQ ID NO: 4287676 - DNA, 22 bp, Homo sapiens
acatgactctttattgtctgta

SEQ ID NO: 4287677 - DNA, 23 bp, Homo sapiens
acatgactctttattgtctgtaa

SEQ ID NO: 4287678 - DNA, 18 bp, Homo sapiens
acatgagtcccagtggga

SEQ ID NO: 4287679 - DNA, 13 bp, Homo sapiens
acatgagttcaaa

SEQ ID NO: 4287680 - DNA, 16 bp, Homo sapiens
acatgatgatttcaga

SEQ ID NO: 4287681 - DNA, 12 bp, Homo sapiens
acatgcacagtt

SEQ ID NO: 4287682 - DNA, 20 bp, Homo sapiens
acatgcacagtttgcaatct

SEQ ID NO: 4287683 - DNA, 20 bp, Homo sapiens
acatgcagaaattgacctga

SEQ ID NO: 4287684 - DNA, 21 bp, Homo sapiens
acatgcagaaattgacctgat

SEQ ID NO: 4287685 - DNA, 16 bp, Homo sapiens
acatgcattactgcat

SEQ ID NO: 4287686 - DNA, 17 bp, Homo sapiens
acatgcctttccagtgc

SEQ ID NO: 4287687 - DNA, 19 bp, Homo sapiens
acatgctcatcccaaaagc

SEQ ID NO: 4287688 - DNA, 16 bp, Homo sapiens
acatgctgcccacccc

SEQ ID NO: 4287689 - DNA, 21 bp, Homo sapiens
acatgctgcccaccccctgct

SEQ ID NO: 4287690 - DNA, 12 bp, Homo sapiens
acatggacccgg

SEQ ID NO: 4287691 - DNA, 13 bp, Homo sapiens
acatggacccgga

SEQ ID NO: 4287692 - DNA, 16 bp, Homo sapiens
acatggacccggagct

SEQ ID NO: 4287693 - DNA, 19 bp, Homo sapiens
acatggacccggagctaac

SEQ ID NO: 4287694 - DNA, 11 bp, Homo sapiens
acatggccaca

SEQ ID NO: 4287695 - DNA, 17 bp, Homo sapiens
acatggggttggctggg

SEQ ID NO: 4287696 - DNA, 15 bp, Homo sapiens
acatgggttcaattg

SEQ ID NO: 4287697 - DNA, 14 bp, Homo sapiens
acatggtagcaggg

SEQ ID NO: 4287698 - DNA, 15 bp, Homo sapiens
acatggtagcagggt

SEQ ID NO: 4287699 - DNA, 20 bp, Homo sapiens
acatggttacctctgcataa

SEQ ID NO: 4287700 - DNA, 20 bp, Homo sapiens
acatgtggaaaactcacaga

SEQ ID NO: 4287701 - DNA, 12 bp, Homo sapiens
acattaaaagaa

SEQ ID NO: 4287702 - DNA, 19 bp, Homo sapiens
acattaagtattccttggc

SEQ ID NO: 4287703 - DNA, 22 bp, Homo sapiens
acattaagtattccttggccca

SEQ ID NO: 4287704 - DNA, 19 bp, Homo sapiens
acattaatccacatgtttc

SEQ ID NO: 4287705 - DNA, 22 bp, Homo sapiens
acattaatccacatgtttcaga

SEQ ID NO: 4287706 - DNA, 22 bp, Homo sapiens
acattaattgaggcttacagta

SEQ ID NO: 4287707 - DNA, 13 bp, Homo sapiens
acattatcctgtg

SEQ ID NO: 4287708 - DNA, 16 bp, Homo sapiens
acattatcctgtgtga

SEQ ID NO: 4287709 - DNA, 14 bp, Homo sapiens
acattatcttctgg

SEQ ID NO: 4287710 - DNA, 21 bp, Homo sapiens
acattctgctgcccccagacc

SEQ ID NO: 4287711 - DNA, 21 bp, Homo sapiens
acattcttcaagatcccattt

SEQ ID NO: 4287712 - DNA, 19 bp, Homo sapiens
acattgcccacacctgcct

SEQ ID NO: 4287713 - DNA, 19 bp, Homo sapiens
acattgccgtggcatctta

SEQ ID NO: 4287714 - DNA, 22 bp, Homo sapiens
acattgtattttactttgtgca

SEQ ID NO: 4287715 - DNA, 14 bp, Homo sapiens
acatttaaaatagt

SEQ ID NO: 4287716 - DNA, 17 bp, Homo sapiens
acatttaaaatagtttt

SEQ ID NO: 4287717 - DNA, 19 bp, Homo sapiens
acatttaaaatagttttct

SEQ ID NO: 4287718 - DNA, 18 bp, Homo sapiens
acatttaatatcctgcct

SEQ ID NO: 4287719 - DNA, 14 bp, Homo sapiens
acatttggctccac

SEQ ID NO: 4287720 - DNA, 14 bp, Homo sapiens
accaaaaaatgtga

SEQ ID NO: 4287721 - DNA, 15 bp, Homo sapiens
accaaaacccatcgt

SEQ ID NO: 4287722 - DNA, 16 bp, Homo sapiens
accaactctctctgcc

SEQ ID NO: 4287723 - DNA, 19 bp, Homo sapiens
accaactctctctgccccc

SEQ ID NO: 4287724 - DNA, 14 bp, Homo sapiens
accaagccgtggct

SEQ ID NO: 4287725 - DNA, 16 bp, Homo sapiens
accaaggacccctcac

SEQ ID NO: 4287726 - DNA, 18 bp, Homo sapiens
aatgttgaatgtttgaat

SEQ ID NO: 4287727 - DNA, 13 bp, Homo sapiens
aatgtttccaggc

SEQ ID NO: 4287728 - DNA, 22 bp, Homo sapiens
aatgtttgctttacgtattttg

SEQ ID NO: 4287729 - DNA, 20 bp, Homo sapiens
aattaaacaaattccttccc

SEQ ID NO: 4287730 - DNA, 14 bp, Homo sapiens
aattaaagacattt

SEQ ID NO: 4287731 - DNA, 23 bp, Homo sapiens
aattaactccgtttccaaataca

SEQ ID NO: 4287732 - DNA, 18 bp, Homo sapiens
aattaagttattaacatt

SEQ ID NO: 4287733 - DNA, 14 bp, Homo sapiens
aattacaattgtca

SEQ ID NO: 4287734 - DNA, 15 bp, Homo sapiens
aattaccatttgtta

SEQ ID NO: 4287735 - DNA, 19 bp, Homo sapiens
aattacctaagagccacaa

SEQ ID NO: 4287736 - DNA, 17 bp, Homo sapiens
aattagatccattaatt

SEQ ID NO: 4287737 - DNA, 18 bp, Homo sapiens
aattagtgagatttgtat

SEQ ID NO: 4287738 - DNA, 18 bp, Homo sapiens
aattatccaggatgtgtg

SEQ ID NO: 4287739 - DNA, 12 bp, Homo sapiens
aattattctagt

SEQ ID NO: 4287740 - DNA, 18 bp, Homo sapiens
aattattctagtcaactg

SEQ ID NO: 4287741 - DNA, 23 bp, Homo sapiens
aattatttaactaattaaaaaat

SEQ ID NO: 4287742 - DNA, 13 bp, Homo sapiens
aattcaaacctaa

SEQ ID NO: 4287743 - DNA, 14 bp, Homo sapiens
aattcaaagaatca

SEQ ID NO: 4287744 - DNA, 15 bp, Homo sapiens
aattcaacaaatgat

SEQ ID NO: 4287745 - DNA, 16 bp, Homo sapiens
aattcaacaaatgatg

SEQ ID NO: 4287746 - DNA, 16 bp, Homo sapiens
aattcaacacttattt

SEQ ID NO: 4287747 - DNA, 15 bp, Homo sapiens
aattcataaaaataa

SEQ ID NO: 4287748 - DNA, 19 bp, Homo sapiens
aattcatagcatcctgatt

SEQ ID NO: 4287749 - DNA, 16 bp, Homo sapiens
aattcattcatactta

SEQ ID NO: 4287750 - DNA, 14 bp, Homo sapiens
aattccaccaggat

SEQ ID NO: 4287751 - DNA, 14 bp, Homo sapiens
aattccatctatat

SEQ ID NO: 4287752 - DNA, 15 bp, Homo sapiens
aattctagtctctga

SEQ ID NO: 4287753 - DNA, 16 bp, Homo sapiens
aattctagtctctgat

SEQ ID NO: 4287754 - DNA, 15 bp, Homo sapiens
aattctctaggaaag

SEQ ID NO: 4287755 - DNA, 22 bp, Homo sapiens
aattctcttttcaaacacacac

SEQ ID NO: 4287756 - DNA, 12 bp, Homo sapiens
aattctgtccct

SEQ ID NO: 4287757 - DNA, 22 bp, Homo sapiens
aattctgtccctgtccctgccc

SEQ ID NO: 4287758 - DNA, 15 bp, Homo sapiens
aattctgtttatgtt

SEQ ID NO: 4287759 - DNA, 17 bp, Homo sapiens
aattgaagagagatata

SEQ ID NO: 4287760 - DNA, 18 bp, Homo sapiens
aattgacttcgactgtga

SEQ ID NO: 4287761 - DNA, 15 bp, Homo sapiens
aattgagagatgttt

SEQ ID NO: 4287762 - DNA, 17 bp, Homo sapiens
aattgaggcttacagta

SEQ ID NO: 4287763 - DNA, 21 bp, Homo sapiens
aattgatttttaaacagcagg

SEQ ID NO: 4287764 - DNA, 15 bp, Homo sapiens
aattgcaagggaaga

SEQ ID NO: 4287765 - DNA, 20 bp, Homo sapiens
aattgcagaagaaactcctg

SEQ ID NO: 4287766 - DNA, 18 bp, Homo sapiens
aattgcatttttaccttt

SEQ ID NO: 4287767 - DNA, 18 bp, Homo sapiens
aattggaagtctaagaac

SEQ ID NO: 4287768 - DNA, 16 bp, Homo sapiens
aattggttaatcactt

SEQ ID NO: 4287769 - DNA, 12 bp, Homo sapiens
aattgtataaaa

SEQ ID NO: 4287770 - DNA, 18 bp, Homo sapiens
aatttaaatgatttaaat

SEQ ID NO: 4287771 - DNA, 17 bp, Homo sapiens
aatttagatattcatac

SEQ ID NO: 4287772 - DNA, 20 bp, Homo sapiens
aatttattagccctgcattt

SEQ ID NO: 4287773 - DNA, 23 bp, Homo sapiens
aatttatttccaatgtttcaagc

SEQ ID NO: 4287774 - DNA, 16 bp, Homo sapiens
aatttcaaaatgcatg

SEQ ID NO: 4287775 - DNA, 18 bp, Homo sapiens
aatttcacgattcatttt

SEQ ID NO: 4287776 - DNA, 17 bp, Homo sapiens
aatttctgccatttcat

SEQ ID NO: 4287777 - DNA, 18 bp, Homo sapiens
aatttctgccatttcatg

SEQ ID NO: 4287778 - DNA, 17 bp, Homo sapiens
aatttgaagacttcaaa

SEQ ID NO: 4287779 - DNA, 18 bp, Homo sapiens
aatttgggggacttacat

SEQ ID NO: 4287780 - DNA, 21 bp, Homo sapiens
aatttgggggacttacatgat

SEQ ID NO: 4287781 - DNA, 20 bp, Homo sapiens
aattttaaaaaataacatat

SEQ ID NO: 4287782 - DNA, 12 bp, Homo sapiens
aattttgacact

SEQ ID NO: 4287783 - DNA, 21 bp, Homo sapiens
aattttttttttaaatgattc

SEQ ID NO: 4287784 - DNA, 13 bp, Homo sapiens
acaaaaactaaaa

SEQ ID NO: 4287785 - DNA, 13 bp, Homo sapiens
acaaaatatttct

SEQ ID NO: 4287786 - DNA, 19 bp, Homo sapiens
acaaaatatttctaagctt

SEQ ID NO: 4287787 - DNA, 16 bp, Homo sapiens
acaaacaacaaagcag

SEQ ID NO: 4287788 - DNA, 22 bp, Homo sapiens
acaaagggaagcagagcctggg

SEQ ID NO: 4287789 - DNA, 16 bp, Homo sapiens
acaaagtgagaaatta

SEQ ID NO: 4287790 - DNA, 19 bp, Homo sapiens
acaaataagtaatatcttt

SEQ ID NO: 4287791 - DNA, 12 bp, Homo sapiens
acaaatcagtaa

SEQ ID NO: 4287792 - DNA, 15 bp, Homo sapiens
acaaatgtcctcaga

SEQ ID NO: 4287793 - DNA, 17 bp, Homo sapiens
acaaatgtcctcagagg

SEQ ID NO: 4287794 - DNA, 14 bp, Homo sapiens
acaaattccttccc

SEQ ID NO: 4287795 - DNA, 15 bp, Homo sapiens
acaaccacatttctg

SEQ ID NO: 4287796 - DNA, 15 bp, Homo sapiens
acaaccaccgctccc

SEQ ID NO: 4287797 - DNA, 20 bp, Homo sapiens
acaaccaccgctccccagcc

SEQ ID NO: 4287798 - DNA, 15 bp, Homo sapiens
acaactccaggaaaa

SEQ ID NO: 4287799 - DNA, 20 bp, Homo sapiens
acaactccaggaaaactgtt

SEQ ID NO: 4287800 - DNA, 13 bp, Homo sapiens
acaactctatttt

SEQ ID NO: 4287801 - DNA, 14 bp, Homo sapiens
acaactctattttt

SEQ ID NO: 4287802 - DNA, 17 bp, Homo sapiens
acaactgtttttgaaga

SEQ ID NO: 4287803 - DNA, 22 bp, Homo sapiens
acaacttgtctattacctgtta

SEQ ID NO: 4287804 - DNA, 20 bp, Homo sapiens
acaagacagcagagccatct

SEQ ID NO: 4287805 - DNA, 14 bp, Homo sapiens
acaagaggagcagg

SEQ ID NO: 4287806 - DNA, 23 bp, Homo sapiens
acaagaggagcaggaagcaaggc

SEQ ID NO: 4287807 - DNA, 20 bp, Homo sapiens
acaagcccaggacactgcct

SEQ ID NO: 4287808 - DNA, 15 bp, Homo sapiens
acaagccccaggcag

SEQ ID NO: 4287809 - DNA, 13 bp, Homo sapiens
acaagcctggagg

SEQ ID NO: 4287810 - DNA, 14 bp, Homo sapiens
acaagcctggagga

SEQ ID NO: 4287811 - DNA, 13 bp, Homo sapiens
acaaggccccaga

SEQ ID NO: 4287812 - DNA, 16 bp, Homo sapiens
acaaggccccagagac

SEQ ID NO: 4287813 - DNA, 18 bp, Homo sapiens
acaaggccccagagactc

SEQ ID NO: 4287814 - DNA, 18 bp, Homo sapiens
acaaggctgaaaagtgct

SEQ ID NO: 4287815 - DNA, 18 bp, Homo sapiens
acaagtactggtaagatt

SEQ ID NO: 4287816 - DNA, 14 bp, Homo sapiens
acaagtgctcagtt

SEQ ID NO: 4287817 - DNA, 18 bp, Homo sapiens
acaagtgctcagttccaa

SEQ ID NO: 4287818 - DNA, 22 bp, Homo sapiens
acaataaaagtgtccattgaaa

SEQ ID NO: 4287819 - DNA, 14 bp, Homo sapiens
acaataaagtgtat

SEQ ID NO: 4287820 - DNA, 17 bp, Homo sapiens
acaatatcattttcctg

SEQ ID NO: 4287821 - DNA, 13 bp, Homo sapiens
acaatattcctat

SEQ ID NO: 4287822 - DNA, 16 bp, Homo sapiens
acaatgcctattgtaa

SEQ ID NO: 4287823 - DNA, 14 bp, Homo sapiens
acaatggccagccc

SEQ ID NO: 4287824 - DNA, 14 bp, Homo sapiens
acaatggtaacatt

SEQ ID NO: 4287825 - DNA, 19 bp, Homo sapiens
acaattaaagctgttattt

SEQ ID NO: 4287826 - DNA, 14 bp, Homo sapiens
acaattagatttct

SEQ ID NO: 4287827 - DNA, 17 bp, Homo sapiens
acaattctgtccctgtc

SEQ ID NO: 4287828 - DNA, 18 bp, Homo sapiens
acaattcttttgaaagat

SEQ ID NO: 4287829 - DNA, 15 bp, Homo sapiens
acaatttcaaaatgc

SEQ ID NO: 4287830 - DNA, 17 bp, Homo sapiens
acacaacggcagtgaag

SEQ ID NO: 4287831 - DNA, 14 bp, Homo sapiens
acacacacacagga

SEQ ID NO: 4287832 - DNA, 11 bp, Homo sapiens
acacacacagg

SEQ ID NO: 4287833 - DNA, 12 bp, Homo sapiens
acacacccttcc

SEQ ID NO: 4287834 - DNA, 20 bp, Homo sapiens
acacacccttccccactccc

SEQ ID NO: 4287835 - DNA, 15 bp, Homo sapiens
acacacctgcacacc

SEQ ID NO: 4287836 - DNA, 21 bp, Homo sapiens
acacacctgcacacccctgca

SEQ ID NO: 4287837 - DNA, 17 bp, Homo sapiens
acacacctgcacaccgt

SEQ ID NO: 4287838 - DNA, 20 bp, Homo sapiens
acacacctgcacaccgtccc

SEQ ID NO: 4287839 - DNA, 23 bp, Homo sapiens
acacacgcacacacacacacagg

SEQ ID NO: 4287840 - DNA, 11 bp, Homo sapiens
acacagctgtt

SEQ ID NO: 4287841 - DNA, 18 bp, Homo sapiens
acacagctgttcttctgt

SEQ ID NO: 4287842 - DNA, 11 bp, Homo sapiens
acacaggccca

SEQ ID NO: 4287843 - DNA, 21 bp, Homo sapiens
acacaggcctggcccagccag

SEQ ID NO: 4287844 - DNA, 22 bp, Homo sapiens
acacaggcctggcccagccagc

SEQ ID NO: 4287845 - DNA, 13 bp, Homo sapiens
acacattatcttc

SEQ ID NO: 4287846 - DNA, 15 bp, Homo sapiens
acacattatcttctg

SEQ ID NO: 4287847 - DNA, 14 bp, Homo sapiens
acaccaccaacagg

SEQ ID NO: 4287848 - DNA, 15 bp, Homo sapiens
acaccctctctgtcc

SEQ ID NO: 4287849 - DNA, 13 bp, Homo sapiens
acacccttcccca

SEQ ID NO: 4287850 - DNA, 14 bp, Homo sapiens
acaccgggcctgga

SEQ ID NO: 4287851 - DNA, 20 bp, Homo sapiens
acacctaagtgactaccact

SEQ ID NO: 4287852 - DNA, 20 bp, Homo sapiens
acacctatgtcatttcattt

SEQ ID NO: 4287853 - DNA, 21 bp, Homo sapiens
acacctgcacaccgtccctct

SEQ ID NO: 4287854 - DNA, 16 bp, Homo sapiens
acacgtttagaaatga

SEQ ID NO: 4287855 - DNA, 22 bp, Homo sapiens
acactacgcagaagagaaagta

SEQ ID NO: 4287856 - DNA, 22 bp, Homo sapiens
acactctcttcttactgtattt

SEQ ID NO: 4287857 - DNA, 16 bp, Homo sapiens
acactgccagaagtgt

SEQ ID NO: 4287858 - DNA, 21 bp, Homo sapiens
acactgccagaagtgtgtttt

SEQ ID NO: 4287859 - DNA, 13 bp, Homo sapiens
acactggccccta

SEQ ID NO: 4287860 - DNA, 16 bp, Homo sapiens
acactggtctcagagg

SEQ ID NO: 4287861 - DNA, 13 bp, Homo sapiens
aataaaaattcta

SEQ ID NO: 4287862 - DNA, 16 bp, Homo sapiens
aataaaaattctagat

SEQ ID NO: 4287863 - DNA, 12 bp, Homo sapiens
aataaacacaga

SEQ ID NO: 4287864 - DNA, 12 bp, Homo sapiens
aataaagaagaa

SEQ ID NO: 4287865 - DNA, 11 bp, Homo sapiens
aataaagtgta

SEQ ID NO: 4287866 - DNA, 14 bp, Homo sapiens
aataaataaagaag

SEQ ID NO: 4287867 - DNA, 13 bp, Homo sapiens
aataaataatatt

SEQ ID NO: 4287868 - DNA, 18 bp, Homo sapiens
aataaattggtgataagt

SEQ ID NO: 4287869 - DNA, 20 bp, Homo sapiens
aataaattggtgataagtgg

SEQ ID NO: 4287870 - DNA, 14 bp, Homo sapiens
aataacatattctt

SEQ ID NO: 4287871 - DNA, 19 bp, Homo sapiens
aataactagatctcctgta

SEQ ID NO: 4287872 - DNA, 14 bp, Homo sapiens
aataatgatttaag

SEQ ID NO: 4287873 - DNA, 14 bp, Homo sapiens
aataattgtggaga

SEQ ID NO: 4287874 - DNA, 12 bp, Homo sapiens
aataatttagat

SEQ ID NO: 4287875 - DNA, 16 bp, Homo sapiens
aataatttagatattc

SEQ ID NO: 4287876 - DNA, 20 bp, Homo sapiens
aataattttttagttaaaat

SEQ ID NO: 4287877 - DNA, 17 bp, Homo sapiens
aatacatgatgatttca

SEQ ID NO: 4287878 - DNA, 16 bp, Homo sapiens
aatactaaatatgaaa

SEQ ID NO: 4287879 - DNA, 19 bp, Homo sapiens
aatactaaatatgaaattt

SEQ ID NO: 4287880 - DNA, 16 bp, Homo sapiens
aatactcaccaaaata

SEQ ID NO: 4287881 - DNA, 12 bp, Homo sapiens
aatactttgtat

SEQ ID NO: 4287882 - DNA, 21 bp, Homo sapiens
aatacttttgtgtattctgtg

SEQ ID NO: 4287883 - DNA, 18 bp, Homo sapiens
aataggaggacagaacca

SEQ ID NO: 4287884 - DNA, 22 bp, Homo sapiens
aatagtggctttcatttcttat

SEQ ID NO: 4287885 - DNA, 13 bp, Homo sapiens
aatagttctattt

SEQ ID NO: 4287886 - DNA, 20 bp, Homo sapiens
aatagttctatttctatctg

SEQ ID NO: 4287887 - DNA, 19 bp, Homo sapiens
aatataaataaataaaaat

SEQ ID NO: 4287888 - DNA, 12 bp, Homo sapiens
aatataaatgtg

SEQ ID NO: 4287889 - DNA, 22 bp, Homo sapiens
aatatagaaaaaaacattctat

SEQ ID NO: 4287890 - DNA, 16 bp, Homo sapiens
aatatagttgaacaag

SEQ ID NO: 4287891 - DNA, 22 bp, Homo sapiens
aatatagttgaacaagatttcc

SEQ ID NO: 4287892 - DNA, 23 bp, Homo sapiens
aatatagttgaacaagatttccc

SEQ ID NO: 4287893 - DNA, 13 bp, Homo sapiens
aatatatataata

SEQ ID NO: 4287894 - DNA, 14 bp, Homo sapiens
aatatatataatac

SEQ ID NO: 4287895 - DNA, 14 bp, Homo sapiens
aatatatatttatc

SEQ ID NO: 4287896 - DNA, 19 bp, Homo sapiens
aatatattttatcttggta

SEQ ID NO: 4287897 - DNA, 13 bp, Homo sapiens
aatatcactcatt

SEQ ID NO: 4287898 - DNA, 17 bp, Homo sapiens
aatatcactcattaatt

SEQ ID NO: 4287899 - DNA, 19 bp, Homo sapiens
aatatcattttcctgggag

SEQ ID NO: 4287900 - DNA, 14 bp, Homo sapiens
aatatcctatactg

SEQ ID NO: 4287901 - DNA, 22 bp, Homo sapiens
aatatcctatactggttatagt

SEQ ID NO: 4287902 - DNA, 23 bp, Homo sapiens
aatatcctatactggttatagtt

SEQ ID NO: 4287903 - DNA, 22 bp, Homo sapiens
aatatctatttatctgtctgag

SEQ ID NO: 4287904 - DNA, 16 bp, Homo sapiens
aatatctctatttaat

SEQ ID NO: 4287905 - DNA, 14 bp, Homo sapiens
aatatctgtgaaat

SEQ ID NO: 4287906 - DNA, 17 bp, Homo sapiens
aatatcttgaagaatat

SEQ ID NO: 4287907 - DNA, 11 bp, Homo sapiens
aatatgaaatt

SEQ ID NO: 4287908 - DNA, 21 bp, Homo sapiens
aatatgaggggactgcatgca

SEQ ID NO: 4287909 - DNA, 20 bp, Homo sapiens
aatatgattctcctctccca

SEQ ID NO: 4287910 - DNA, 21 bp, Homo sapiens
aatattatacttctttattca

SEQ ID NO: 4287911 - DNA, 19 bp, Homo sapiens
aatattgagcagaattcat

SEQ ID NO: 4287912 - DNA, 22 bp, Homo sapiens
aatattgtattgttagatgttt

SEQ ID NO: 4287913 - DNA, 24 bp, Homo sapiens
aatatttaaaaaaaaacattcaaa

SEQ ID NO: 4287914 - DNA, 15 bp, Homo sapiens
aatatttacaatgta

SEQ ID NO: 4287915 - DNA, 18 bp, Homo sapiens
aatatttttttctagcta

SEQ ID NO: 4287916 - DNA, 17 bp, Homo sapiens
aatcaaaaattgaagag

SEQ ID NO: 4287917 - DNA, 15 bp, Homo sapiens
aatcaaactttcagc

SEQ ID NO: 4287918 - DNA, 22 bp, Homo sapiens
aatcaaataaaaattctagatt

SEQ ID NO: 4287919 - DNA, 13 bp, Homo sapiens
aatcaacttgtca

SEQ ID NO: 4287920 - DNA, 12 bp, Homo sapiens
aatcaagtgcat

SEQ ID NO: 4287921 - DNA, 15 bp, Homo sapiens
aatcaagtgcatttc

SEQ ID NO: 4287922 - DNA, 14 bp, Homo sapiens
aatcagaatggaag

SEQ ID NO: 4287923 - DNA, 18 bp, Homo sapiens
aatcagcattctcactcc

SEQ ID NO: 4287924 - DNA, 19 bp, Homo sapiens
aatcagcattctcactcct

SEQ ID NO: 4287925 - DNA, 11 bp, Homo sapiens
aatcagtaatt

SEQ ID NO: 4287926 - DNA, 17 bp, Homo sapiens
aatcatttatcttatct

SEQ ID NO: 4287927 - DNA, 19 bp, Homo sapiens
aatcatttatcttatctag

SEQ ID NO: 4287928 - DNA, 14 bp, Homo sapiens
aatccaactccagg

SEQ ID NO: 4287929 - DNA, 16 bp, Homo sapiens
aatccatgtatctgta

SEQ ID NO: 4287930 - DNA, 13 bp, Homo sapiens
aatccattttcta

SEQ ID NO: 4287931 - DNA, 21 bp, Homo sapiens
aatccccgtgctcacagtagc

SEQ ID NO: 4287932 - DNA, 13 bp, Homo sapiens
aatccctttcagt

SEQ ID NO: 4287933 - DNA, 18 bp, Homo sapiens
aatcctctctctgtgtta

SEQ ID NO: 4287934 - DNA, 22 bp, Homo sapiens
aatcggcaacagggcttctctt

SEQ ID NO: 4287935 - DNA, 18 bp, Homo sapiens
aatctacgatgttaaaac

SEQ ID NO: 4287936 - DNA, 17 bp, Homo sapiens
aatctctgattaaattt

SEQ ID NO: 4287937 - DNA, 11 bp, Homo sapiens
aatctctgtga

SEQ ID NO: 4287938 - DNA, 13 bp, Homo sapiens
aatctgagcctta

SEQ ID NO: 4287939 - DNA, 21 bp, Homo sapiens
aatctgtataatactttgtat

SEQ ID NO: 4287940 - DNA, 19 bp, Homo sapiens
aatctgtctgattctatgc

SEQ ID NO: 4287941 - DNA, 13 bp, Homo sapiens
aatcttatgttga

SEQ ID NO: 4287942 - DNA, 23 bp, Homo sapiens
aatgaaataggagggaaaccttt

SEQ ID NO: 4287943 - DNA, 17 bp, Homo sapiens
aatgaagcaaacacaca

SEQ ID NO: 4287944 - DNA, 20 bp, Homo sapiens
aatgaataatgcctttgtaa

SEQ ID NO: 4287945 - DNA, 19 bp, Homo sapiens
aatgacgtattgtgaaatt

SEQ ID NO: 4287946 - DNA, 20 bp, Homo sapiens
aatgacgtattgtgaaattt

SEQ ID NO: 4287947 - DNA, 10 bp, Homo sapiens
aatgagagag

SEQ ID NO: 4287948 - DNA, 20 bp, Homo sapiens
aatgagtttccagctaagcc

SEQ ID NO: 4287949 - DNA, 15 bp, Homo sapiens
aatgatactgtctaa

SEQ ID NO: 4287950 - DNA, 18 bp, Homo sapiens
aatgatagataatgcctt

SEQ ID NO: 4287951 - DNA, 16 bp, Homo sapiens
aatgatattgctgaag

SEQ ID NO: 4287952 - DNA, 22 bp, Homo sapiens
aatgatcgttctgggtcagctt

SEQ ID NO: 4287953 - DNA, 16 bp, Homo sapiens
aatgatcttccaaata

SEQ ID NO: 4287954 - DNA, 20 bp, Homo sapiens
aatgatttaagcattttact

SEQ ID NO: 4287955 - DNA, 21 bp, Homo sapiens
aatgcagcttcaggtgagcca

SEQ ID NO: 4287956 - DNA, 14 bp, Homo sapiens
aatgcatgatattg

SEQ ID NO: 4287957 - DNA, 15 bp, Homo sapiens
aatgccatcaaatga

SEQ ID NO: 4287958 - DNA, 19 bp, Homo sapiens
aatgctacctctgatcaaa

SEQ ID NO: 4287959 - DNA, 20 bp, Homo sapiens
aatgctacctctgatcaaag

SEQ ID NO: 4287960 - DNA, 21 bp, Homo sapiens
aatgctacctctgatcaaagc

SEQ ID NO: 4287961 - DNA, 23 bp, Homo sapiens
aatgctacctctgatcaaagcac

SEQ ID NO: 4287962 - DNA, 14 bp, Homo sapiens
aatgctcccccatc

SEQ ID NO: 4287963 - DNA, 12 bp, Homo sapiens
aatgctgtacct

SEQ ID NO: 4287964 - DNA, 20 bp, Homo sapiens
aatgctgtatgtcattaaag

SEQ ID NO: 4287965 - DNA, 19 bp, Homo sapiens
aatgctgttggtgagaatc

SEQ ID NO: 4287966 - DNA, 17 bp, Homo sapiens
aatggaagcactgccat

SEQ ID NO: 4287967 - DNA, 21 bp, Homo sapiens
aatggaagcctccacctgcag

SEQ ID NO: 4287968 - DNA, 22 bp, Homo sapiens
aatggaagcctccacctgcagc

SEQ ID NO: 4287969 - DNA, 13 bp, Homo sapiens
aatggccagccca

SEQ ID NO: 4287970 - DNA, 18 bp, Homo sapiens
aatggcgcagtgcctctg

SEQ ID NO: 4287971 - DNA, 15 bp, Homo sapiens
aatggctgggtttgg

SEQ ID NO: 4287972 - DNA, 16 bp, Homo sapiens
aatggtgccttcattt

SEQ ID NO: 4287973 - DNA, 14 bp, Homo sapiens
aatgtaaaattcat

SEQ ID NO: 4287974 - DNA, 17 bp, Homo sapiens
aatgtaaaattcatagc

SEQ ID NO: 4287975 - DNA, 14 bp, Homo sapiens
aatgtaatcattta

SEQ ID NO: 4287976 - DNA, 19 bp, Homo sapiens
aatgtaattaaactgttaa

SEQ ID NO: 4287977 - DNA, 21 bp, Homo sapiens
aatgtactttcattccctttc

SEQ ID NO: 4287978 - DNA, 19 bp, Homo sapiens
aatgtatcttatttatata

SEQ ID NO: 4287979 - DNA, 20 bp, Homo sapiens
aatgtatcttatttatatat

SEQ ID NO: 4287980 - DNA, 21 bp, Homo sapiens
aatgtatcttatttatatatg

SEQ ID NO: 4287981 - DNA, 22 bp, Homo sapiens
aatgtatcttatttatatatga

SEQ ID NO: 4287982 - DNA, 14 bp, Homo sapiens
aatgtatgtaaata

SEQ ID NO: 4287983 - DNA, 12 bp, Homo sapiens
aatgtatgtgaa

SEQ ID NO: 4287984 - DNA, 18 bp, Homo sapiens
aatgtatgtgaaagtgta

SEQ ID NO: 4287985 - DNA, 21 bp, Homo sapiens
aatgtatgtgaaagtgtaaaa

SEQ ID NO: 4287986 - DNA, 22 bp, Homo sapiens
aatgtattatgtcctgtgagat

SEQ ID NO: 4287987 - DNA, 21 bp, Homo sapiens
aatgtcataaagtgagaaaac

SEQ ID NO: 4287988 - DNA, 19 bp, Homo sapiens
aatgtccccattctataaa

SEQ ID NO: 4287989 - DNA, 23 bp, Homo sapiens
aatgtccccattctataaattca

SEQ ID NO: 4287990 - DNA, 20 bp, Homo sapiens
aatgtgatttacgctcattg

SEQ ID NO: 4287991 - DNA, 20 bp, Homo sapiens
aatgtgtcaaagagatgagg

SEQ ID NO: 4287992 - DNA, 23 bp, Homo sapiens
aatgttctttcctttcatcctca

SEQ ID NO: 4287993 - DNA, 16 bp, Homo sapiens
aatgttgaagaactca

SEQ ID NO: 4287994 - DNA, 23 bp, Homo sapiens
aatgttgaagaactcatgtgatt

SEQ ID NO: 4287995 - DNA, 19 bp, Homo sapiens
aagattgttattaaatgta

SEQ ID NO: 4287996 - DNA, 22 bp, Homo sapiens
aagattttatgtgcttgaagat

SEQ ID NO: 4287997 - DNA, 13 bp, Homo sapiens
aagcaaataaata

SEQ ID NO: 4287998 - DNA, 17 bp, Homo sapiens
aagcaagcacctgggtg

SEQ ID NO: 4287999 - DNA, 13 bp, Homo sapiens
aagcacctgggtg

SEQ ID NO: 4288000 - DNA, 17 bp, Homo sapiens
aagcaccttgaatggaa

SEQ ID NO: 4288001 - DNA, 22 bp, Homo sapiens
aagcactgtttaactgggagtg

SEQ ID NO: 4288002 - DNA, 14 bp, Homo sapiens
aagcagagcctggg

SEQ ID NO: 4288003 - DNA, 16 bp, Homo sapiens
aagcagagcctggggt

SEQ ID NO: 4288004 - DNA, 18 bp, Homo sapiens
aagcagagtgcacagctg

SEQ ID NO: 4288005 - DNA, 20 bp, Homo sapiens
aagcagagtgcacagctgtc

SEQ ID NO: 4288006 - DNA, 21 bp, Homo sapiens
aagcagagtgcacagctgtcc

SEQ ID NO: 4288007 - DNA, 16 bp, Homo sapiens
aagcatcagcaagaca

SEQ ID NO: 4288008 - DNA, 22 bp, Homo sapiens
aagcatctattcccaaagaacc

SEQ ID NO: 4288009 - DNA, 18 bp, Homo sapiens
aagcattttactgtctgt

SEQ ID NO: 4288010 - DNA, 20 bp, Homo sapiens
aagcattttactgtctgtaa

SEQ ID NO: 4288011 - DNA, 21 bp, Homo sapiens
aagcattttactgtctgtaag

SEQ ID NO: 4288012 - DNA, 19 bp, Homo sapiens
aagccaaacattcttattt

SEQ ID NO: 4288013 - DNA, 22 bp, Homo sapiens
aagccaagtcagctttgccttc

SEQ ID NO: 4288014 - DNA, 15 bp, Homo sapiens
aagccacataaccag

SEQ ID NO: 4288015 - DNA, 21 bp, Homo sapiens
aagccacgtgctggagagtag

SEQ ID NO: 4288016 - DNA, 14 bp, Homo sapiens
aagccaggagaccc

SEQ ID NO: 4288017 - DNA, 19 bp, Homo sapiens
aagccaggagaccctgtct

SEQ ID NO: 4288018 - DNA, 17 bp, Homo sapiens
aagccagggttccagac

SEQ ID NO: 4288019 - DNA, 18 bp, Homo sapiens
aagccagggttccagaca

SEQ ID NO: 4288020 - DNA, 18 bp, Homo sapiens
aagccatatgacaatttc

SEQ ID NO: 4288021 - DNA, 11 bp, Homo sapiens
aagcccaggac

SEQ ID NO: 4288022 - DNA, 18 bp, Homo sapiens
aagcccaggacactgcct

SEQ ID NO: 4288023 - DNA, 13 bp, Homo sapiens
aagcccaggagga

SEQ ID NO: 4288024 - DNA, 12 bp, Homo sapiens
aagccccaggca

SEQ ID NO: 4288025 - DNA, 18 bp, Homo sapiens
aagcccccaccttccctc

SEQ ID NO: 4288026 - DNA, 18 bp, Homo sapiens
aagccctacgatgggatc

SEQ ID NO: 4288027 - DNA, 15 bp, Homo sapiens
aagcctcctgctgag

SEQ ID NO: 4288028 - DNA, 11 bp, Homo sapiens
aagcctgcccc

SEQ ID NO: 4288029 - DNA, 12 bp, Homo sapiens
aagcctgccccg

SEQ ID NO: 4288030 - DNA, 15 bp, Homo sapiens
aagcctggaggacaa

SEQ ID NO: 4288031 - DNA, 13 bp, Homo sapiens
aagcctggcccag

SEQ ID NO: 4288032 - DNA, 17 bp, Homo sapiens
aagctaaaatgaaaaat

SEQ ID NO: 4288033 - DNA, 15 bp, Homo sapiens
aagctatatatgaat

SEQ ID NO: 4288034 - DNA, 22 bp, Homo sapiens
aagctatcttcatgtaaattga

SEQ ID NO: 4288035 - DNA, 16 bp, Homo sapiens
aagctcacttgcttta

SEQ ID NO: 4288036 - DNA, 15 bp, Homo sapiens
aagctcagcccaccc

SEQ ID NO: 4288037 - DNA, 21 bp, Homo sapiens
aagctcagcccacccccctca

SEQ ID NO: 4288038 - DNA, 21 bp, Homo sapiens
aagctgaatcagacagtggat

SEQ ID NO: 4288039 - DNA, 18 bp, Homo sapiens
aagctgcatctagaggct

SEQ ID NO: 4288040 - DNA, 18 bp, Homo sapiens
aagctgtacaaagggaag

SEQ ID NO: 4288041 - DNA, 14 bp, Homo sapiens
aagctgttctctgc

SEQ ID NO: 4288042 - DNA, 15 bp, Homo sapiens
aagcttagaagccac

SEQ ID NO: 4288043 - DNA, 22 bp, Homo sapiens
aaggaaacacgtttagaaatga

SEQ ID NO: 4288044 - DNA, 21 bp, Homo sapiens
aaggaatataccacaccgagg

SEQ ID NO: 4288045 - DNA, 20 bp, Homo sapiens
aaggacccctcaccttgcaa

SEQ ID NO: 4288046 - DNA, 22 bp, Homo sapiens
aaggacccggaggggcctggca

SEQ ID NO: 4288047 - DNA, 14 bp, Homo sapiens
aaggacttgtgcct

SEQ ID NO: 4288048 - DNA, 15 bp, Homo sapiens
aaggacttgtgcctc

SEQ ID NO: 4288049 - DNA, 23 bp, Homo sapiens
aaggagaggagtgcgctagagca

SEQ ID NO: 4288050 - DNA, 17 bp, Homo sapiens
aaggagccagctcccag

SEQ ID NO: 4288051 - DNA, 21 bp, Homo sapiens
aaggaggaagggactggtcca

SEQ ID NO: 4288052 - DNA, 19 bp, Homo sapiens
aaggatccagatagcctag

SEQ ID NO: 4288053 - DNA, 16 bp, Homo sapiens
aaggcatcattttcac

SEQ ID NO: 4288054 - DNA, 18 bp, Homo sapiens
aaggccccaaggtttaca

SEQ ID NO: 4288055 - DNA, 15 bp, Homo sapiens
aaggccccagagact

SEQ ID NO: 4288056 - DNA, 15 bp, Homo sapiens
aaggccggtgggaag

SEQ ID NO: 4288057 - DNA, 18 bp, Homo sapiens
aaggccggtgggaagagg

SEQ ID NO: 4288058 - DNA, 18 bp, Homo sapiens
aaggcctgccccccttcc

SEQ ID NO: 4288059 - DNA, 19 bp, Homo sapiens
aaggcctgccccccttccc

SEQ ID NO: 4288060 - DNA, 15 bp, Homo sapiens
aaggccttgccttgt

SEQ ID NO: 4288061 - DNA, 14 bp, Homo sapiens
aaggcttccggctg

SEQ ID NO: 4288062 - DNA, 22 bp, Homo sapiens
aaggctttcagggcctccagcc

SEQ ID NO: 4288063 - DNA, 13 bp, Homo sapiens
aagggaggcctga

SEQ ID NO: 4288064 - DNA, 16 bp, Homo sapiens
aagggaggcctgaggg

SEQ ID NO: 4288065 - DNA, 15 bp, Homo sapiens
aagggcagcccctcc

SEQ ID NO: 4288066 - DNA, 17 bp, Homo sapiens
aagggcagcccctcccc

SEQ ID NO: 4288067 - DNA, 18 bp, Homo sapiens
aagggcagcccctcccca

SEQ ID NO: 4288068 - DNA, 15 bp, Homo sapiens
aagggcaggagccta

SEQ ID NO: 4288069 - DNA, 16 bp, Homo sapiens
aagggcaggagcctag

SEQ ID NO: 4288070 - DNA, 19 bp, Homo sapiens
aagggcaggagcctagagg

SEQ ID NO: 4288071 - DNA, 21 bp, Homo sapiens
aagggcttacacgtggaggaa

SEQ ID NO: 4288072 - DNA, 17 bp, Homo sapiens
aaggggtctgctcctgt

SEQ ID NO: 4288073 - DNA, 15 bp, Homo sapiens
aagggtatctgctgc

SEQ ID NO: 4288074 - DNA, 18 bp, Homo sapiens
aagggttagacaagcctg

SEQ ID NO: 4288075 - DNA, 23 bp, Homo sapiens
aagggttagacaagcctggagga

SEQ ID NO: 4288076 - DNA, 14 bp, Homo sapiens
aaggtagactttta

SEQ ID NO: 4288077 - DNA, 18 bp, Homo sapiens
aaggtctcatgcctgaga

SEQ ID NO: 4288078 - DNA, 14 bp, Homo sapiens
aaggtggtcttgga

SEQ ID NO: 4288079 - DNA, 16 bp, Homo sapiens
aaggtgtttctctgta

SEQ ID NO: 4288080 - DNA, 18 bp, Homo sapiens
aaggttggaactgctgcc

SEQ ID NO: 4288081 - DNA, 21 bp, Homo sapiens
aaggttggaactgctgccatg

SEQ ID NO: 4288082 - DNA, 23 bp, Homo sapiens
aaggttggaactgctgccatgat

SEQ ID NO: 4288083 - DNA, 19 bp, Homo sapiens
aagtaaatgctacctctga

SEQ ID NO: 4288084 - DNA, 21 bp, Homo sapiens
aagtaagtggagcatttggaa

SEQ ID NO: 4288085 - DNA, 13 bp, Homo sapiens
aagtagatttcat

SEQ ID NO: 4288086 - DNA, 18 bp, Homo sapiens
aagtagtacttcttctgt

SEQ ID NO: 4288087 - DNA, 19 bp, Homo sapiens
aagtagtacttcttctgta

SEQ ID NO: 4288088 - DNA, 20 bp, Homo sapiens
aagtagtacttcttctgtaa

SEQ ID NO: 4288089 - DNA, 22 bp, Homo sapiens
aagtagtgtctggatcagtaaa

SEQ ID NO: 4288090 - DNA, 15 bp, Homo sapiens
aagtataaactttta

SEQ ID NO: 4288091 - DNA, 22 bp, Homo sapiens
aagtatccctgatttattctgg

SEQ ID NO: 4288092 - DNA, 20 bp, Homo sapiens
aagtatctctactttcctga

SEQ ID NO: 4288093 - DNA, 22 bp, Homo sapiens
aagtatctctactttcctgatg

SEQ ID NO: 4288094 - DNA, 13 bp, Homo sapiens
aagtatctgtacc

SEQ ID NO: 4288095 - DNA, 17 bp, Homo sapiens
aagtattactaaattga

SEQ ID NO: 4288096 - DNA, 19 bp, Homo sapiens
aagtattccttggcccagc

SEQ ID NO: 4288097 - DNA, 22 bp, Homo sapiens
aagtattccttggcccagcagc

SEQ ID NO: 4288098 - DNA, 15 bp, Homo sapiens
aagtcaacttagcat

SEQ ID NO: 4288099 - DNA, 14 bp, Homo sapiens
aagtcactgcacag

SEQ ID NO: 4288100 - DNA, 19 bp, Homo sapiens
aagtcagctttgccttcca

SEQ ID NO: 4288101 - DNA, 13 bp, Homo sapiens
aagtcaggagcca

SEQ ID NO: 4288102 - DNA, 15 bp, Homo sapiens
aagtccagctctccc

SEQ ID NO: 4288103 - DNA, 21 bp, Homo sapiens
aagtccagtgaccctggagct

SEQ ID NO: 4288104 - DNA, 14 bp, Homo sapiens
aagtcccgaggcag

SEQ ID NO: 4288105 - DNA, 22 bp, Homo sapiens
aagtcctttcccgatgcgtggc

SEQ ID NO: 4288106 - DNA, 17 bp, Homo sapiens
aagtctcaatgaaatag

SEQ ID NO: 4288107 - DNA, 19 bp, Homo sapiens
aagtctctgggtcacgttt

SEQ ID NO: 4288108 - DNA, 16 bp, Homo sapiens
aagtgacaaggcccca

SEQ ID NO: 4288109 - DNA, 18 bp, Homo sapiens
aagtgacaaggccccaga

SEQ ID NO: 4288110 - DNA, 16 bp, Homo sapiens
aagtgaccccagctcc

SEQ ID NO: 4288111 - DNA, 19 bp, Homo sapiens
aagtgaccccagctccagg

SEQ ID NO: 4288112 - DNA, 22 bp, Homo sapiens
aagtgaccccagctccaggcag

SEQ ID NO: 4288113 - DNA, 19 bp, Homo sapiens
aagtgagaaattatgaaag

SEQ ID NO: 4288114 - DNA, 14 bp, Homo sapiens
aagtgattgaaaat

SEQ ID NO: 4288115 - DNA, 19 bp, Homo sapiens
aagtgcatttctgggcctt

SEQ ID NO: 4288116 - DNA, 16 bp, Homo sapiens
aagtgcctataaagga

SEQ ID NO: 4288117 - DNA, 22 bp, Homo sapiens
aagtgcctgcttttaggtcatc

SEQ ID NO: 4288118 - DNA, 21 bp, Homo sapiens
aagtgctttgctggagtcctg

SEQ ID NO: 4288119 - DNA, 10 bp, Homo sapiens
aagtggaaaa

SEQ ID NO: 4288120 - DNA, 15 bp, Homo sapiens
aagtggctgtgatta

SEQ ID NO: 4288121 - DNA, 19 bp, Homo sapiens
aagtgggattcaggaatgg

SEQ ID NO: 4288122 - DNA, 14 bp, Homo sapiens
aagtggggtgttga

SEQ ID NO: 4288123 - DNA, 15 bp, Homo sapiens
aagtgtactggattt

SEQ ID NO: 4288124 - DNA, 13 bp, Homo sapiens
aagtgtgctgagg

SEQ ID NO: 4288125 - DNA, 23 bp, Homo sapiens
aagtgtttaattgtataaaacag

SEQ ID NO: 4288126 - DNA, 15 bp, Homo sapiens
aagttattaacattt

SEQ ID NO: 4288127 - DNA, 13 bp, Homo sapiens
aagttttcagatt

SEQ ID NO: 4288128 - DNA, 19 bp, Homo sapiens
aagtttttacagtgtatct

SEQ ID NO: 4288129 - DNA, 16 bp, Homo sapiens
acttgatgaataaaca

SEQ ID NO: 4288130 - DNA, 17 bp, Homo sapiens
acttgatgttcctggga

SEQ ID NO: 4288131 - DNA, 17 bp, Homo sapiens
acttgccagtcactccg

SEQ ID NO: 4288132 - DNA, 14 bp, Homo sapiens
acttgctcaataaa

SEQ ID NO: 4288133 - DNA, 15 bp, Homo sapiens
acttgctcaataaag

SEQ ID NO: 4288134 - DNA, 14 bp, Homo sapiens
acttgctgtgactt

SEQ ID NO: 4288135 - DNA, 23 bp, Homo sapiens
acttggataggagcttccagatg

SEQ ID NO: 4288136 - DNA, 17 bp, Homo sapiens
acttgtagggatgcctt

SEQ ID NO: 4288137 - DNA, 16 bp, Homo sapiens
acttgtctattacctg

SEQ ID NO: 4288138 - DNA, 11 bp, Homo sapiens
actttaataat

SEQ ID NO: 4288139 - DNA, 22 bp, Homo sapiens
actttacctctctgtcatgtgc

SEQ ID NO: 4288140 - DNA, 15 bp, Homo sapiens
actttataagccaat

SEQ ID NO: 4288141 - DNA, 12 bp, Homo sapiens
actttccaacat

SEQ ID NO: 4288142 - DNA, 20 bp, Homo sapiens
actttccaccccctccctgg

SEQ ID NO: 4288143 - DNA, 22 bp, Homo sapiens
actttccccgtgggccatggca

SEQ ID NO: 4288144 - DNA, 13 bp, Homo sapiens
actttcctgatgt

SEQ ID NO: 4288145 - DNA, 22 bp, Homo sapiens
actttcctgatgttgataatag

SEQ ID NO: 4288146 - DNA, 17 bp, Homo sapiens
actttgcagacctggga

SEQ ID NO: 4288147 - DNA, 13 bp, Homo sapiens
actttgcattgtc

SEQ ID NO: 4288148 - DNA, 16 bp, Homo sapiens
actttgcattgtctgt

SEQ ID NO: 4288149 - DNA, 17 bp, Homo sapiens
actttggtaatgtgtca

SEQ ID NO: 4288150 - DNA, 16 bp, Homo sapiens
actttgtatacaagta

SEQ ID NO: 4288151 - DNA, 14 bp, Homo sapiens
actttgtgcaatat

SEQ ID NO: 4288152 - DNA, 17 bp, Homo sapiens
acttttcatatcatttc

SEQ ID NO: 4288153 - DNA, 13 bp, Homo sapiens
acttttcctctta

SEQ ID NO: 4288154 - DNA, 15 bp, Homo sapiens
acttttctccatgag

SEQ ID NO: 4288155 - DNA, 17 bp, Homo sapiens
acttttgtgtattctgt

SEQ ID NO: 4288156 - DNA, 22 bp, Homo sapiens
agaaaaacaatggtaacatttt

SEQ ID NO: 4288157 - DNA, 19 bp, Homo sapiens
agaaaacatgtctgtgaac

SEQ ID NO: 4288158 - DNA, 20 bp, Homo sapiens
agaaaacatgtctgtgaact

SEQ ID NO: 4288159 - DNA, 21 bp, Homo sapiens
agaaaagattaaaattagtga

SEQ ID NO: 4288160 - DNA, 11 bp, Homo sapiens
agaaaagccag

SEQ ID NO: 4288161 - DNA, 11 bp, Homo sapiens
agaaagaaatt

SEQ ID NO: 4288162 - DNA, 17 bp, Homo sapiens
agaaagatgaagaagaa

SEQ ID NO: 4288163 - DNA, 18 bp, Homo sapiens
agaaagattttatgtgct

SEQ ID NO: 4288164 - DNA, 16 bp, Homo sapiens
agaaagcatattgact

SEQ ID NO: 4288165 - DNA, 17 bp, Homo sapiens
agaaagcatattgactt

SEQ ID NO: 4288166 - DNA, 18 bp, Homo sapiens
agaaagcctgttgtttaa

SEQ ID NO: 4288167 - DNA, 18 bp, Homo sapiens
agaaagctatatatgaat

SEQ ID NO: 4288168 - DNA, 21 bp, Homo sapiens
agaaaggaaaccttttcttgt

SEQ ID NO: 4288169 - DNA, 13 bp, Homo sapiens
agaaaggagggca

SEQ ID NO: 4288170 - DNA, 13 bp, Homo sapiens
agaaaggcagaga

SEQ ID NO: 4288171 - DNA, 17 bp, Homo sapiens
agaaaggcagagattgg

SEQ ID NO: 4288172 - DNA, 17 bp, Homo sapiens
agaaagggcagcccctc

SEQ ID NO: 4288173 - DNA, 20 bp, Homo sapiens
agaaagggcagcccctcccc

SEQ ID NO: 4288174 - DNA, 21 bp, Homo sapiens
agaaagggcagcccctcccca

SEQ ID NO: 4288175 - DNA, 14 bp, Homo sapiens
agaaagtgagcagt

SEQ ID NO: 4288176 - DNA, 16 bp, Homo sapiens
agaaagtgagcagtgt

SEQ ID NO: 4288177 - DNA, 12 bp, Homo sapiens
agaaatatctgt

SEQ ID NO: 4288178 - DNA, 17 bp, Homo sapiens
agaaatatctgtgaaat

SEQ ID NO: 4288179 - DNA, 19 bp, Homo sapiens
agaaatatctgtgaaatat

SEQ ID NO: 4288180 - DNA, 19 bp, Homo sapiens
agaaatgatttcaaaatga

SEQ ID NO: 4288181 - DNA, 21 bp, Homo sapiens
agaaatgatttcaaaatgata

SEQ ID NO: 4288182 - DNA, 17 bp, Homo sapiens
agaaatgccgctgtgtc

SEQ ID NO: 4288183 - DNA, 22 bp, Homo sapiens
agaaattagggctctaatttcc

SEQ ID NO: 4288184 - DNA, 23 bp, Homo sapiens
agaaatttattcttatcttagga

SEQ ID NO: 4288185 - DNA, 16 bp, Homo sapiens
agaaatttttttccag

SEQ ID NO: 4288186 - DNA, 18 bp, Homo sapiens
agaaatttttttccagaa

SEQ ID NO: 4288187 - DNA, 14 bp, Homo sapiens
agaacaaacagaaa

SEQ ID NO: 4288188 - DNA, 22 bp, Homo sapiens
agaacaaatatgattctcctct

SEQ ID NO: 4288189 - DNA, 20 bp, Homo sapiens
agaacacaagccacgcctgc

SEQ ID NO: 4288190 - DNA, 21 bp, Homo sapiens
agaacacaagccacgcctgcg

SEQ ID NO: 4288191 - DNA, 21 bp, Homo sapiens
agaacatgagtttatgggaat

SEQ ID NO: 4288192 - DNA, 19 bp, Homo sapiens
agaaccaacgggtctgtgg

SEQ ID NO: 4288193 - DNA, 21 bp, Homo sapiens
agaaccagtccctctgagtga

SEQ ID NO: 4288194 - DNA, 19 bp, Homo sapiens
agaacccccctccccaagg

SEQ ID NO: 4288195 - DNA, 20 bp, Homo sapiens
agaacctcgttgacatgcac

SEQ ID NO: 4288196 - DNA, 17 bp, Homo sapiens
agaactgttcatttcca

SEQ ID NO: 4288197 - DNA, 13 bp, Homo sapiens
agaacttgaacaa

SEQ ID NO: 4288198 - DNA, 16 bp, Homo sapiens
agaagaaagtctatgc

SEQ ID NO: 4288199 - DNA, 13 bp, Homo sapiens
agaagaagctcct

SEQ ID NO: 4288200 - DNA, 22 bp, Homo sapiens
agaagaatttgaagacttcaaa

SEQ ID NO: 4288201 - DNA, 20 bp, Homo sapiens
agaagacacgtgtttttgta

SEQ ID NO: 4288202 - DNA, 14 bp, Homo sapiens
agaagagaaagtac

SEQ ID NO: 4288203 - DNA, 15 bp, Homo sapiens
agaagagaaagtaca

SEQ ID NO: 4288204 - DNA, 16 bp, Homo sapiens
agaagagggagaagga

SEQ ID NO: 4288205 - DNA, 21 bp, Homo sapiens
agaagagggagaaggagaggc

SEQ ID NO: 4288206 - DNA, 22 bp, Homo sapiens
agaagagggagaaggagaggct

SEQ ID NO: 4288207 - DNA, 12 bp, Homo sapiens
agaagataaaaa

SEQ ID NO: 4288208 - DNA, 15 bp, Homo sapiens
agaagattctaaaac

SEQ ID NO: 4288209 - DNA, 20 bp, Homo sapiens
agaagccaccatgtatgtgg

SEQ ID NO: 4288210 - DNA, 17 bp, Homo sapiens
agaaggaggaagggact

SEQ ID NO: 4288211 - DNA, 22 bp, Homo sapiens
agaaggaggaagggactggtcc

SEQ ID NO: 4288212 - DNA, 19 bp, Homo sapiens
agaaggaggaattttagaa

SEQ ID NO: 4288213 - DNA, 17 bp, Homo sapiens
agaaggcaagctggcag

SEQ ID NO: 4288214 - DNA, 21 bp, Homo sapiens
agaaggcaagctggcaggagg

SEQ ID NO: 4288215 - DNA, 13 bp, Homo sapiens
agaaggcccggga

SEQ ID NO: 4288216 - DNA, 22 bp, Homo sapiens
agaagggaaattcacactgtgc

SEQ ID NO: 4288217 - DNA, 17 bp, Homo sapiens
agaagggggccatgagg

SEQ ID NO: 4288218 - DNA, 22 bp, Homo sapiens
agaagggttagacaagcctgga

SEQ ID NO: 4288219 - DNA, 17 bp, Homo sapiens
agaaggtgaaatggagg

SEQ ID NO: 4288220 - DNA, 14 bp, Homo sapiens
agaagtgcccctgc

SEQ ID NO: 4288221 - DNA, 16 bp, Homo sapiens
agaagtgcccctgctg

SEQ ID NO: 4288222 - DNA, 19 bp, Homo sapiens
agaagtgcccctgctgcct

SEQ ID NO: 4288223 - DNA, 13 bp, Homo sapiens
agaagtggcagga

SEQ ID NO: 4288224 - DNA, 22 bp, Homo sapiens
agaagtgggattcaggaatggg

SEQ ID NO: 4288225 - DNA, 20 bp, Homo sapiens
agaagttgttagtgatttgc

SEQ ID NO: 4288226 - DNA, 20 bp, Homo sapiens
agaataatgacgtattgtga

SEQ ID NO: 4288227 - DNA, 20 bp, Homo sapiens
agaatagttaaattggcttg

SEQ ID NO: 4288228 - DNA, 13 bp, Homo sapiens
agaatattgtatt

SEQ ID NO: 4288229 - DNA, 16 bp, Homo sapiens
agaatattgtattgtt

SEQ ID NO: 4288230 - DNA, 16 bp, Homo sapiens
agaatcaagtctgtga

SEQ ID NO: 4288231 - DNA, 18 bp, Homo sapiens
agaatccccgtgctcaca

SEQ ID NO: 4288232 - DNA, 22 bp, Homo sapiens
agaatccccgtgctcacagtag

SEQ ID NO: 4288233 - DNA, 17 bp, Homo sapiens
agaatcgacctcactgt

SEQ ID NO: 4288234 - DNA, 20 bp, Homo sapiens
agaatcgacctcactgtcag

SEQ ID NO: 4288235 - DNA, 18 bp, Homo sapiens
agaatggaagagagaaag

SEQ ID NO: 4288236 - DNA, 15 bp, Homo sapiens
agaatggaagcctcc

SEQ ID NO: 4288237 - DNA, 21 bp, Homo sapiens
agaatggaagcctccacctgc

SEQ ID NO: 4288238 - DNA, 23 bp, Homo sapiens
agaatggaagcctccacctgcag

SEQ ID NO: 4288239 - DNA, 12 bp, Homo sapiens
agaattaaaata

SEQ ID NO: 4288240 - DNA, 19 bp, Homo sapiens
agaattaccatttgttaat

SEQ ID NO: 4288241 - DNA, 18 bp, Homo sapiens
agaattcattcatactta

SEQ ID NO: 4288242 - DNA, 10 bp, Homo sapiens
agaattgaga

SEQ ID NO: 4288243 - DNA, 14 bp, Homo sapiens
agacaaccctgcaa

SEQ ID NO: 4288244 - DNA, 21 bp, Homo sapiens
agacaaccctgcaaaggactg

SEQ ID NO: 4288245 - DNA, 10 bp, Homo sapiens
agacaagcct

SEQ ID NO: 4288246 - DNA, 15 bp, Homo sapiens
agacaagcctggagg

SEQ ID NO: 4288247 - DNA, 16 bp, Homo sapiens
agacaagcctggagga

SEQ ID NO: 4288248 - DNA, 19 bp, Homo sapiens
agacaatgacactggaagg

SEQ ID NO: 4288249 - DNA, 18 bp, Homo sapiens
agacacacgcacacacac

SEQ ID NO: 4288250 - DNA, 18 bp, Homo sapiens
agacacgccttcccctca

SEQ ID NO: 4288251 - DNA, 22 bp, Homo sapiens
agacacgccttcccctcagcca

SEQ ID NO: 4288252 - DNA, 14 bp, Homo sapiens
agacacgtgttttt

SEQ ID NO: 4288253 - DNA, 16 bp, Homo sapiens
agacacgtgtttttgt

SEQ ID NO: 4288254 - DNA, 19 bp, Homo sapiens
agacacgtgtttttgtatc

SEQ ID NO: 4288255 - DNA, 18 bp, Homo sapiens
agacactggtctcagagg

SEQ ID NO: 4288256 - DNA, 14 bp, Homo sapiens
agacagagtggatc

SEQ ID NO: 4288257 - DNA, 16 bp, Homo sapiens
agacagcatgtgttaa

SEQ ID NO: 4288258 - DNA, 17 bp, Homo sapiens
agacagggtggggctta

SEQ ID NO: 4288259 - DNA, 15 bp, Homo sapiens
agacagtcaggaagc

SEQ ID NO: 4288260 - DNA, 20 bp, Homo sapiens
agacagttggttttgcatgt

SEQ ID NO: 4288261 - DNA, 16 bp, Homo sapiens
agacatccacaatgga

SEQ ID NO: 4288262 - DNA, 13 bp, Homo sapiens
agacatgctgccc

SEQ ID NO: 4288263 - DNA, 16 bp, Homo sapiens
actcagccttaagaaa

SEQ ID NO: 4288264 - DNA, 14 bp, Homo sapiens
actcaggcccacat

SEQ ID NO: 4288265 - DNA, 17 bp, Homo sapiens
actcatccagaactgtc

SEQ ID NO: 4288266 - DNA, 18 bp, Homo sapiens
actcatccagaactgtct

SEQ ID NO: 4288267 - DNA, 17 bp, Homo sapiens
actcattagaattacca

SEQ ID NO: 4288268 - DNA, 20 bp, Homo sapiens
actccaaggcaaatgtccaa

SEQ ID NO: 4288269 - DNA, 13 bp, Homo sapiens
actccagacccct

SEQ ID NO: 4288270 - DNA, 19 bp, Homo sapiens
actccagacccctggcttt

SEQ ID NO: 4288271 - DNA, 20 bp, Homo sapiens
actccagggttaaagaaagg

SEQ ID NO: 4288272 - DNA, 15 bp, Homo sapiens
actccccttgagctg

SEQ ID NO: 4288273 - DNA, 19 bp, Homo sapiens
actccttaaccacctagtc

SEQ ID NO: 4288274 - DNA, 16 bp, Homo sapiens
actccttctccccaat

SEQ ID NO: 4288275 - DNA, 19 bp, Homo sapiens
actcgcttagctgaaacct

SEQ ID NO: 4288276 - DNA, 15 bp, Homo sapiens
actctaactgtatat

SEQ ID NO: 4288277 - DNA, 18 bp, Homo sapiens
actctaactgtatatttg

SEQ ID NO: 4288278 - DNA, 16 bp, Homo sapiens
actctacactgtgaac

SEQ ID NO: 4288279 - DNA, 20 bp, Homo sapiens
actctccaggattgtccaca

SEQ ID NO: 4288280 - DNA, 14 bp, Homo sapiens
actctctccatcag

SEQ ID NO: 4288281 - DNA, 18 bp, Homo sapiens
actctctccatcagaagg

SEQ ID NO: 4288282 - DNA, 19 bp, Homo sapiens
actctctcctctctctccc

SEQ ID NO: 4288283 - DNA, 22 bp, Homo sapiens
actctctcctctctctccctcc

SEQ ID NO: 4288284 - DNA, 13 bp, Homo sapiens
actctctctgccc

SEQ ID NO: 4288285 - DNA, 13 bp, Homo sapiens
actctgctgaggc

SEQ ID NO: 4288286 - DNA, 14 bp, Homo sapiens
actctgctgaggcc

SEQ ID NO: 4288287 - DNA, 16 bp, Homo sapiens
actctgctgaggccag

SEQ ID NO: 4288288 - DNA, 15 bp, Homo sapiens
actctggcagcctca

SEQ ID NO: 4288289 - DNA, 21 bp, Homo sapiens
actctggccttggttcctcca

SEQ ID NO: 4288290 - DNA, 23 bp, Homo sapiens
actctggccttggttcctccagc

SEQ ID NO: 4288291 - DNA, 16 bp, Homo sapiens
actctgttcctggctc

SEQ ID NO: 4288292 - DNA, 21 bp, Homo sapiens
actctgtttgctcacccagga

SEQ ID NO: 4288293 - DNA, 15 bp, Homo sapiens
actctttattgtctg

SEQ ID NO: 4288294 - DNA, 16 bp, Homo sapiens
actctttattgtctgt

SEQ ID NO: 4288295 - DNA, 19 bp, Homo sapiens
actctttattgtctgtaaa

SEQ ID NO: 4288296 - DNA, 19 bp, Homo sapiens
actgaacgatccttcaaag

SEQ ID NO: 4288297 - DNA, 13 bp, Homo sapiens
actgaagtgaata

SEQ ID NO: 4288298 - DNA, 17 bp, Homo sapiens
actgaagtgaatacatg

SEQ ID NO: 4288299 - DNA, 18 bp, Homo sapiens
actgaagtgaatacatgg

SEQ ID NO: 4288300 - DNA, 19 bp, Homo sapiens
actgaagtgaatacatggt

SEQ ID NO: 4288301 - DNA, 20 bp, Homo sapiens
actgaagtgaatacatggta

SEQ ID NO: 4288302 - DNA, 19 bp, Homo sapiens
actgacccattcacatttt

SEQ ID NO: 4288303 - DNA, 16 bp, Homo sapiens
actgagctcctctggg

SEQ ID NO: 4288304 - DNA, 19 bp, Homo sapiens
actgcaacttctacctccg

SEQ ID NO: 4288305 - DNA, 23 bp, Homo sapiens
actgcacagtgcatctcagccca

SEQ ID NO: 4288306 - DNA, 21 bp, Homo sapiens
actgcagaatacagtaagctg

SEQ ID NO: 4288307 - DNA, 17 bp, Homo sapiens
actgcagtcacccctgt

SEQ ID NO: 4288308 - DNA, 19 bp, Homo sapiens
actgcagtcacccctgtct

SEQ ID NO: 4288309 - DNA, 19 bp, Homo sapiens
actgcatatagataattat

SEQ ID NO: 4288310 - DNA, 16 bp, Homo sapiens
actgcatgcaagctca

SEQ ID NO: 4288311 - DNA, 12 bp, Homo sapiens
actgcatttgtg

SEQ ID NO: 4288312 - DNA, 18 bp, Homo sapiens
actgccagaagtgtgttt

SEQ ID NO: 4288313 - DNA, 21 bp, Homo sapiens
actgcccctgcacctgcttct

SEQ ID NO: 4288314 - DNA, 23 bp, Homo sapiens
actgcccctgcacctgcttctca

SEQ ID NO: 4288315 - DNA, 20 bp, Homo sapiens
actgcccggggcagctgcca

SEQ ID NO: 4288316 - DNA, 21 bp, Homo sapiens
actgcccggggcagctgccag

SEQ ID NO: 4288317 - DNA, 22 bp, Homo sapiens
actgcccggggcagctgccaga

SEQ ID NO: 4288318 - DNA, 18 bp, Homo sapiens
actgccgaccgaggctgg

SEQ ID NO: 4288319 - DNA, 19 bp, Homo sapiens
actgccgaccgaggctgga

SEQ ID NO: 4288320 - DNA, 19 bp, Homo sapiens
actgcctgcccacccgtgg

SEQ ID NO: 4288321 - DNA, 23 bp, Homo sapiens
actgcctgcccacccgtggagat

SEQ ID NO: 4288322 - DNA, 15 bp, Homo sapiens
actgcctttgctgcc

SEQ ID NO: 4288323 - DNA, 22 bp, Homo sapiens
actgctaggtgggccagcccct

SEQ ID NO: 4288324 - DNA, 21 bp, Homo sapiens
actgctcagattctaagttgt

SEQ ID NO: 4288325 - DNA, 19 bp, Homo sapiens
actgctgcgctgtgctggt

SEQ ID NO: 4288326 - DNA, 14 bp, Homo sapiens
actgctggctgcct

SEQ ID NO: 4288327 - DNA, 15 bp, Homo sapiens
actgctggctgcctt

SEQ ID NO: 4288328 - DNA, 19 bp, Homo sapiens
actgctgttttatgtcata

SEQ ID NO: 4288329 - DNA, 20 bp, Homo sapiens
actgcttggatccatacaaa

SEQ ID NO: 4288330 - DNA, 23 bp, Homo sapiens
actgcttggatccatacaaaact

SEQ ID NO: 4288331 - DNA, 13 bp, Homo sapiens
actggaggcctct

SEQ ID NO: 4288332 - DNA, 14 bp, Homo sapiens
actggaggcctctg

SEQ ID NO: 4288333 - DNA, 21 bp, Homo sapiens
actggagtggtaacaagagga

SEQ ID NO: 4288334 - DNA, 18 bp, Homo sapiens
actggatctcttaagaca

SEQ ID NO: 4288335 - DNA, 15 bp, Homo sapiens
actggcccacccctc

SEQ ID NO: 4288336 - DNA, 16 bp, Homo sapiens
actggctcctccagca

SEQ ID NO: 4288337 - DNA, 18 bp, Homo sapiens
actggctggactggaggc

SEQ ID NO: 4288338 - DNA, 19 bp, Homo sapiens
actgggaagggggcaggcc

SEQ ID NO: 4288339 - DNA, 22 bp, Homo sapiens
actgggaagggggcaggcccct

SEQ ID NO: 4288340 - DNA, 17 bp, Homo sapiens
actgggctggctgcctt

SEQ ID NO: 4288341 - DNA, 21 bp, Homo sapiens
actgggggtgccaaccacctc

SEQ ID NO: 4288342 - DNA, 22 bp, Homo sapiens
actggtccaggcatgggtccct

SEQ ID NO: 4288343 - DNA, 14 bp, Homo sapiens
actggtctcagagg

SEQ ID NO: 4288344 - DNA, 20 bp, Homo sapiens
actggttatagttgatatgt

SEQ ID NO: 4288345 - DNA, 23 bp, Homo sapiens
actggttccttaagtggctgtga

SEQ ID NO: 4288346 - DNA, 16 bp, Homo sapiens
actggttggtgttctt

SEQ ID NO: 4288347 - DNA, 22 bp, Homo sapiens
actggtttttctgttccctgct

SEQ ID NO: 4288348 - DNA, 17 bp, Homo sapiens
actgtaaaatacttctt

SEQ ID NO: 4288349 - DNA, 17 bp, Homo sapiens
actgtaaatttaataga

SEQ ID NO: 4288350 - DNA, 17 bp, Homo sapiens
actgtatctaaaaaata

SEQ ID NO: 4288351 - DNA, 21 bp, Homo sapiens
actgtatctaaaaaataactg

SEQ ID NO: 4288352 - DNA, 19 bp, Homo sapiens
actgtcccacaaaatattt

SEQ ID NO: 4288353 - DNA, 23 bp, Homo sapiens
actgtctcaagagggcactggtg

SEQ ID NO: 4288354 - DNA, 18 bp, Homo sapiens
actgtctctcatgaacct

SEQ ID NO: 4288355 - DNA, 20 bp, Homo sapiens
actgtgcgttttagagtatg

SEQ ID NO: 4288356 - DNA, 14 bp, Homo sapiens
actgtggcctcagg

SEQ ID NO: 4288357 - DNA, 18 bp, Homo sapiens
actgtggcctcaggaggc

SEQ ID NO: 4288358 - DNA, 22 bp, Homo sapiens
actgtggccttggtctaacttt

SEQ ID NO: 4288359 - DNA, 19 bp, Homo sapiens
actgtgtccctctctctgg

SEQ ID NO: 4288360 - DNA, 21 bp, Homo sapiens
actgttgtttgatgtgtatgt

SEQ ID NO: 4288361 - DNA, 20 bp, Homo sapiens
actgtttcactactcagcat

SEQ ID NO: 4288362 - DNA, 15 bp, Homo sapiens
acttaaaaatatgtg

SEQ ID NO: 4288363 - DNA, 21 bp, Homo sapiens
acttaaaatcaaatttttctg

SEQ ID NO: 4288364 - DNA, 20 bp, Homo sapiens
acttaaatagcatctgctct

SEQ ID NO: 4288365 - DNA, 13 bp, Homo sapiens
acttaacctgctt

SEQ ID NO: 4288366 - DNA, 14 bp, Homo sapiens
acttacatgattca

SEQ ID NO: 4288367 - DNA, 17 bp, Homo sapiens
acttacatgattcattt

SEQ ID NO: 4288368 - DNA, 11 bp, Homo sapiens
acttaggccag

SEQ ID NO: 4288369 - DNA, 12 bp, Homo sapiens
acttaggccaga

SEQ ID NO: 4288370 - DNA, 12 bp, Homo sapiens
acttatgctgct

SEQ ID NO: 4288371 - DNA, 14 bp, Homo sapiens
acttatgctgctgt

SEQ ID NO: 4288372 - DNA, 15 bp, Homo sapiens
acttatgctgctgtg

SEQ ID NO: 4288373 - DNA, 19 bp, Homo sapiens
acttatgctgctgtgaatt

SEQ ID NO: 4288374 - DNA, 13 bp, Homo sapiens
acttattcaaaga

SEQ ID NO: 4288375 - DNA, 13 bp, Homo sapiens
acttatttctaaa

SEQ ID NO: 4288376 - DNA, 14 bp, Homo sapiens
acttattttctgaa

SEQ ID NO: 4288377 - DNA, 20 bp, Homo sapiens
acttcaaacatgccctcagg

SEQ ID NO: 4288378 - DNA, 14 bp, Homo sapiens
acttcaggctcttc

SEQ ID NO: 4288379 - DNA, 18 bp, Homo sapiens
acttcatgctgtctgtgt

SEQ ID NO: 4288380 - DNA, 14 bp, Homo sapiens
acttccccttggga

SEQ ID NO: 4288381 - DNA, 23 bp, Homo sapiens
acttccccttgggatgggcacag

SEQ ID NO: 4288382 - DNA, 23 bp, Homo sapiens
acttcctggattttctttctatg

SEQ ID NO: 4288383 - DNA, 13 bp, Homo sapiens
acttcctgtccag

SEQ ID NO: 4288384 - DNA, 14 bp, Homo sapiens
acttcctgtccaga

SEQ ID NO: 4288385 - DNA, 14 bp, Homo sapiens
acttcgactgtgac

SEQ ID NO: 4288386 - DNA, 20 bp, Homo sapiens
acttcgctattcccaggcag

SEQ ID NO: 4288387 - DNA, 21 bp, Homo sapiens
acttctcaaatgctactcagt

SEQ ID NO: 4288388 - DNA, 20 bp, Homo sapiens
acttctttactaacactggc

SEQ ID NO: 4288389 - DNA, 15 bp, Homo sapiens
acttctttttcatta

SEQ ID NO: 4288390 - DNA, 16 bp, Homo sapiens
acttgaaattatatct

SEQ ID NO: 4288391 - DNA, 23 bp, Homo sapiens
acttgaaattatatctgtggtct

SEQ ID NO: 4288392 - DNA, 15 bp, Homo sapiens
acttgaacaaagtct

SEQ ID NO: 4288393 - DNA, 22 bp, Homo sapiens
acttgaacaaagtctctgggtc

SEQ ID NO: 4288394 - DNA, 18 bp, Homo sapiens
acttgaatagtattgtgt

SEQ ID NO: 4288395 - DNA, 11 bp, Homo sapiens
acttgagccca

SEQ ID NO: 4288396 - DNA, 20 bp, Homo sapiens
accgccagatggggcctctg

SEQ ID NO: 4288397 - DNA, 13 bp, Homo sapiens
accgctccccagc

SEQ ID NO: 4288398 - DNA, 20 bp, Homo sapiens
accgctccccagcccagggt

SEQ ID NO: 4288399 - DNA, 22 bp, Homo sapiens
accgtaaaggtttatttttctg

SEQ ID NO: 4288400 - DNA, 23 bp, Homo sapiens
accgtaaaggtttatttttctgt

SEQ ID NO: 4288401 - DNA, 17 bp, Homo sapiens
acctaaatccattttct

SEQ ID NO: 4288402 - DNA, 19 bp, Homo sapiens
acctaaatccattttctaa

SEQ ID NO: 4288403 - DNA, 20 bp, Homo sapiens
acctaaatccattttctaaa

SEQ ID NO: 4288404 - DNA, 14 bp, Homo sapiens
acctataaatacta

SEQ ID NO: 4288405 - DNA, 22 bp, Homo sapiens
acctataaatactaaatatgaa

SEQ ID NO: 4288406 - DNA, 12 bp, Homo sapiens
acctatgtcatt

SEQ ID NO: 4288407 - DNA, 18 bp, Homo sapiens
acctatgtcatttcattt

SEQ ID NO: 4288408 - DNA, 14 bp, Homo sapiens
acctcaagctgcat

SEQ ID NO: 4288409 - DNA, 16 bp, Homo sapiens
acctcactgccctccc

SEQ ID NO: 4288410 - DNA, 20 bp, Homo sapiens
acctcactgccctccctcgg

SEQ ID NO: 4288411 - DNA, 17 bp, Homo sapiens
acctcagagtccaggcc

SEQ ID NO: 4288412 - DNA, 14 bp, Homo sapiens
acctcaggggagac

SEQ ID NO: 4288413 - DNA, 10 bp, Homo sapiens
acctccaccc

SEQ ID NO: 4288414 - DNA, 23 bp, Homo sapiens
acctccaggaagggaccccactg

SEQ ID NO: 4288415 - DNA, 13 bp, Homo sapiens
acctcccctcctt

SEQ ID NO: 4288416 - DNA, 22 bp, Homo sapiens
acctcgaagctgttctctgctt

SEQ ID NO: 4288417 - DNA, 20 bp, Homo sapiens
acctcgtctttgcttgtcct

SEQ ID NO: 4288418 - DNA, 20 bp, Homo sapiens
acctcgttgacatgcacagt

SEQ ID NO: 4288419 - DNA, 21 bp, Homo sapiens
acctctcccctggaactgtct

SEQ ID NO: 4288420 - DNA, 16 bp, Homo sapiens
acctctctgtcatgtg

SEQ ID NO: 4288421 - DNA, 15 bp, Homo sapiens
acctctgatcaaagc

SEQ ID NO: 4288422 - DNA, 16 bp, Homo sapiens
acctctgatcaaagca

SEQ ID NO: 4288423 - DNA, 23 bp, Homo sapiens
acctctgatttattttgtatgaa

SEQ ID NO: 4288424 - DNA, 17 bp, Homo sapiens
acctcttagcttttctg

SEQ ID NO: 4288425 - DNA, 16 bp, Homo sapiens
acctgaaaattcaaca

SEQ ID NO: 4288426 - DNA, 15 bp, Homo sapiens
acctgcacacccctg

SEQ ID NO: 4288427 - DNA, 22 bp, Homo sapiens
acctgcacacccctgcacacac

SEQ ID NO: 4288428 - DNA, 19 bp, Homo sapiens
acctgcccccactcagcat

SEQ ID NO: 4288429 - DNA, 16 bp, Homo sapiens
acctgcccccttctcc

SEQ ID NO: 4288430 - DNA, 18 bp, Homo sapiens
acctgcccccttctccca

SEQ ID NO: 4288431 - DNA, 22 bp, Homo sapiens
acctgcccccttctcccacact

SEQ ID NO: 4288432 - DNA, 13 bp, Homo sapiens
acctgctggcccc

SEQ ID NO: 4288433 - DNA, 17 bp, Homo sapiens
acctgctggcccctcac

SEQ ID NO: 4288434 - DNA, 22 bp, Homo sapiens
acctgcttctcagcgcaacagc

SEQ ID NO: 4288435 - DNA, 20 bp, Homo sapiens
acctgcttgtgttgggcccc

SEQ ID NO: 4288436 - DNA, 22 bp, Homo sapiens
acctgcttgtgttgggccccag

SEQ ID NO: 4288437 - DNA, 18 bp, Homo sapiens
acctggatggatctgctc

SEQ ID NO: 4288438 - DNA, 22 bp, Homo sapiens
acctggatggatctgctccatg

SEQ ID NO: 4288439 - DNA, 14 bp, Homo sapiens
acctggcttcccag

SEQ ID NO: 4288440 - DNA, 16 bp, Homo sapiens
acctggcttcccagga

SEQ ID NO: 4288441 - DNA, 22 bp, Homo sapiens
acctggcttcccaggaccctgg

SEQ ID NO: 4288442 - DNA, 15 bp, Homo sapiens
acctgggagatgctg

SEQ ID NO: 4288443 - DNA, 22 bp, Homo sapiens
acctgggagatgctgggaccct

SEQ ID NO: 4288444 - DNA, 15 bp, Homo sapiens
acctgggccctaggc

SEQ ID NO: 4288445 - DNA, 13 bp, Homo sapiens
acctggggagtgg

SEQ ID NO: 4288446 - DNA, 13 bp, Homo sapiens
acctgggtgtgct

SEQ ID NO: 4288447 - DNA, 18 bp, Homo sapiens
acctggttatgagccgac

SEQ ID NO: 4288448 - DNA, 14 bp, Homo sapiens
acctggttttcatt

SEQ ID NO: 4288449 - DNA, 15 bp, Homo sapiens
acctgtggctctaca

SEQ ID NO: 4288450 - DNA, 23 bp, Homo sapiens
acctgtggggatttctcccagct

SEQ ID NO: 4288451 - DNA, 14 bp, Homo sapiens
accttaatatttct

SEQ ID NO: 4288452 - DNA, 14 bp, Homo sapiens
accttacaaccaca

SEQ ID NO: 4288453 - DNA, 21 bp, Homo sapiens
accttacaaccacatttctgg

SEQ ID NO: 4288454 - DNA, 15 bp, Homo sapiens
accttcacccagcac

SEQ ID NO: 4288455 - DNA, 23 bp, Homo sapiens
accttcacccagcacccatgccc

SEQ ID NO: 4288456 - DNA, 15 bp, Homo sapiens
accttcatttaaaaa

SEQ ID NO: 4288457 - DNA, 20 bp, Homo sapiens
accttcctgggcagcccaga

SEQ ID NO: 4288458 - DNA, 21 bp, Homo sapiens
accttcctgggcagcccagag

SEQ ID NO: 4288459 - DNA, 23 bp, Homo sapiens
accttctaatccatgtgctgctg

SEQ ID NO: 4288460 - DNA, 11 bp, Homo sapiens
accttctctta

SEQ ID NO: 4288461 - DNA, 17 bp, Homo sapiens
accttctgaagatctca

SEQ ID NO: 4288462 - DNA, 15 bp, Homo sapiens
accttgcaacacaca

SEQ ID NO: 4288463 - DNA, 23 bp, Homo sapiens
accttggcgcgcagcccgggaga

SEQ ID NO: 4288464 - DNA, 17 bp, Homo sapiens
accttgtgtgagtgtga

SEQ ID NO: 4288465 - DNA, 18 bp, Homo sapiens
acctttggcttaattcca

SEQ ID NO: 4288466 - DNA, 15 bp, Homo sapiens
acctttgtctgaagg

SEQ ID NO: 4288467 - DNA, 15 bp, Homo sapiens
acgatccttcaaagt

SEQ ID NO: 4288468 - DNA, 16 bp, Homo sapiens
acgatccttcaaagtc

SEQ ID NO: 4288469 - DNA, 18 bp, Homo sapiens
acgatgggatcattattt

SEQ ID NO: 4288470 - DNA, 22 bp, Homo sapiens
acgatgttaaaacaaattaaaa

SEQ ID NO: 4288471 - DNA, 19 bp, Homo sapiens
acgattcatttttgaaact

SEQ ID NO: 4288472 - DNA, 15 bp, Homo sapiens
acgcaagcctcagcc

SEQ ID NO: 4288473 - DNA, 20 bp, Homo sapiens
acgcacacacacacacagga

SEQ ID NO: 4288474 - DNA, 21 bp, Homo sapiens
acgcacacacacacacaggag

SEQ ID NO: 4288475 - DNA, 16 bp, Homo sapiens
acgcagaagagaaagt

SEQ ID NO: 4288476 - DNA, 22 bp, Homo sapiens
acgcagccctgctttgggctgc

SEQ ID NO: 4288477 - DNA, 19 bp, Homo sapiens
acgccctaggaggagaact

SEQ ID NO: 4288478 - DNA, 19 bp, Homo sapiens
acgcgctctgcatgctcct

SEQ ID NO: 4288479 - DNA, 21 bp, Homo sapiens
acgcgctctgcatgctcctct

SEQ ID NO: 4288480 - DNA, 13 bp, Homo sapiens
acgctcctgccct

SEQ ID NO: 4288481 - DNA, 15 bp, Homo sapiens
acgctctctgtctgg

SEQ ID NO: 4288482 - DNA, 12 bp, Homo sapiens
acgctgtctcca

SEQ ID NO: 4288483 - DNA, 15 bp, Homo sapiens
acgctgtctccagac

SEQ ID NO: 4288484 - DNA, 20 bp, Homo sapiens
acgctgtctccagaccccca

SEQ ID NO: 4288485 - DNA, 17 bp, Homo sapiens
acggaagtggcctgaga

SEQ ID NO: 4288486 - DNA, 16 bp, Homo sapiens
acggcactgtggcctt

SEQ ID NO: 4288487 - DNA, 12 bp, Homo sapiens
acggccactgca

SEQ ID NO: 4288488 - DNA, 21 bp, Homo sapiens
acggccactgcagtcacccct

SEQ ID NO: 4288489 - DNA, 13 bp, Homo sapiens
acggcctctgggg

SEQ ID NO: 4288490 - DNA, 23 bp, Homo sapiens
acggcctgagaggagcgtgtcct

SEQ ID NO: 4288491 - DNA, 13 bp, Homo sapiens
acggctcctcccc

SEQ ID NO: 4288492 - DNA, 18 bp, Homo sapiens
acggctcctccccgatcc

SEQ ID NO: 4288493 - DNA, 19 bp, Homo sapiens
acggctctaggtggggcgg

SEQ ID NO: 4288494 - DNA, 17 bp, Homo sapiens
acggggccagcatccat

SEQ ID NO: 4288495 - DNA, 12 bp, Homo sapiens
acgggtctgtgg

SEQ ID NO: 4288496 - DNA, 22 bp, Homo sapiens
acgggtctgtgggactggccca

SEQ ID NO: 4288497 - DNA, 23 bp, Homo sapiens
acggttccctgcctaggagctgg

SEQ ID NO: 4288498 - DNA, 14 bp, Homo sapiens
acgtgaagcctccc

SEQ ID NO: 4288499 - DNA, 13 bp, Homo sapiens
acgtgctggagag

SEQ ID NO: 4288500 - DNA, 15 bp, Homo sapiens
acgtgctggagagta

SEQ ID NO: 4288501 - DNA, 21 bp, Homo sapiens
acgtggaggaatgctccccca

SEQ ID NO: 4288502 - DNA, 13 bp, Homo sapiens
acgttaaagtagg

SEQ ID NO: 4288503 - DNA, 14 bp, Homo sapiens
acgtttagaaatga

SEQ ID NO: 4288504 - DNA, 22 bp, Homo sapiens
acgtttagaaatgatttcaaaa

SEQ ID NO: 4288505 - DNA, 13 bp, Homo sapiens
actaaaattcaac

SEQ ID NO: 4288506 - DNA, 14 bp, Homo sapiens
actaaaattcaaca

SEQ ID NO: 4288507 - DNA, 20 bp, Homo sapiens
actaaaattcaacaaatgat

SEQ ID NO: 4288508 - DNA, 22 bp, Homo sapiens
actaaaattcaacaaatgatgt

SEQ ID NO: 4288509 - DNA, 14 bp, Homo sapiens
actaaacattttgt

SEQ ID NO: 4288510 - DNA, 16 bp, Homo sapiens
actaaataatgatctt

SEQ ID NO: 4288511 - DNA, 21 bp, Homo sapiens
actaaataatgatcttccaaa

SEQ ID NO: 4288512 - DNA, 16 bp, Homo sapiens
actaaatatgaaattt

SEQ ID NO: 4288513 - DNA, 17 bp, Homo sapiens
actaaatatgaaatttt

SEQ ID NO: 4288514 - DNA, 22 bp, Homo sapiens
actaaatggcagtgagatgtca

SEQ ID NO: 4288515 - DNA, 12 bp, Homo sapiens
actaacactggc

SEQ ID NO: 4288516 - DNA, 20 bp, Homo sapiens
actaagaataaataaagaag

SEQ ID NO: 4288517 - DNA, 17 bp, Homo sapiens
actaataaagtctgtct

SEQ ID NO: 4288518 - DNA, 18 bp, Homo sapiens
actaataaagtctgtctg

SEQ ID NO: 4288519 - DNA, 20 bp, Homo sapiens
actacagccaaattgcagaa

SEQ ID NO: 4288520 - DNA, 18 bp, Homo sapiens
actaccacttatttctaa

SEQ ID NO: 4288521 - DNA, 14 bp, Homo sapiens
actactaagaataa

SEQ ID NO: 4288522 - DNA, 14 bp, Homo sapiens
actagatctcctgt

SEQ ID NO: 4288523 - DNA, 14 bp, Homo sapiens
actagctaattagc

SEQ ID NO: 4288524 - DNA, 19 bp, Homo sapiens
actaggccctggtctggct

SEQ ID NO: 4288525 - DNA, 16 bp, Homo sapiens
actagggtcctcaggc

SEQ ID NO: 4288526 - DNA, 15 bp, Homo sapiens
actaggtgcccagtc

SEQ ID NO: 4288527 - DNA, 19 bp, Homo sapiens
actaggtgctggcatgtct

SEQ ID NO: 4288528 - DNA, 18 bp, Homo sapiens
actatgcgtaaatcaact

SEQ ID NO: 4288529 - DNA, 14 bp, Homo sapiens
actcaccaaaatat

SEQ ID NO: 4288530 - DNA, 18 bp, Homo sapiens
accaaggacccctcacct

SEQ ID NO: 4288531 - DNA, 13 bp, Homo sapiens
accaatctctgtg

SEQ ID NO: 4288532 - DNA, 19 bp, Homo sapiens
accacacacacccttcccc

SEQ ID NO: 4288533 - DNA, 22 bp, Homo sapiens
accacacttcctgtccagagag

SEQ ID NO: 4288534 - DNA, 21 bp, Homo sapiens
accacagataagcctgaaaca

SEQ ID NO: 4288535 - DNA, 13 bp, Homo sapiens
accacagccctgt

SEQ ID NO: 4288536 - DNA, 14 bp, Homo sapiens
accacagccctgtc

SEQ ID NO: 4288537 - DNA, 17 bp, Homo sapiens
accacagccctgtcagt

SEQ ID NO: 4288538 - DNA, 13 bp, Homo sapiens
accaccaaatgac

SEQ ID NO: 4288539 - DNA, 15 bp, Homo sapiens
accaccaacaggcgt

SEQ ID NO: 4288540 - DNA, 17 bp, Homo sapiens
accacccatatcatgca

SEQ ID NO: 4288541 - DNA, 13 bp, Homo sapiens
accaccgctcccc

SEQ ID NO: 4288542 - DNA, 16 bp, Homo sapiens
accacctctggccctg

SEQ ID NO: 4288543 - DNA, 16 bp, Homo sapiens
accacttatttctaaa

SEQ ID NO: 4288544 - DNA, 15 bp, Homo sapiens
accagaagactggat

SEQ ID NO: 4288545 - DNA, 19 bp, Homo sapiens
accagaagtggcaggagga

SEQ ID NO: 4288546 - DNA, 14 bp, Homo sapiens
accagagccatgga

SEQ ID NO: 4288547 - DNA, 23 bp, Homo sapiens
accagagccatggactctacact

SEQ ID NO: 4288548 - DNA, 14 bp, Homo sapiens
accagccctggtgg

SEQ ID NO: 4288549 - DNA, 19 bp, Homo sapiens
accagcctcagtgcagccc

SEQ ID NO: 4288550 - DNA, 12 bp, Homo sapiens
accagctggctc

SEQ ID NO: 4288551 - DNA, 15 bp, Homo sapiens
accagctggctctgc

SEQ ID NO: 4288552 - DNA, 19 bp, Homo sapiens
accagctggctctgcagca

SEQ ID NO: 4288553 - DNA, 23 bp, Homo sapiens
accaggaagaaggcccgggagga

SEQ ID NO: 4288554 - DNA, 15 bp, Homo sapiens
accaggaaggaagag

SEQ ID NO: 4288555 - DNA, 15 bp, Homo sapiens
accaggactctgcct

SEQ ID NO: 4288556 - DNA, 16 bp, Homo sapiens
accaggactctgcctt

SEQ ID NO: 4288557 - DNA, 20 bp, Homo sapiens
accaggactctgccttccag

SEQ ID NO: 4288558 - DNA, 21 bp, Homo sapiens
accagggggaagcaccagcct

SEQ ID NO: 4288559 - DNA, 23 bp, Homo sapiens
accagggggaagcaccagcctca

SEQ ID NO: 4288560 - DNA, 18 bp, Homo sapiens
accaggggttccccagga

SEQ ID NO: 4288561 - DNA, 15 bp, Homo sapiens
accagtccctctgag

SEQ ID NO: 4288562 - DNA, 19 bp, Homo sapiens
accagttctctttgtaagg

SEQ ID NO: 4288563 - DNA, 22 bp, Homo sapiens
accataaaataaataatctcat

SEQ ID NO: 4288564 - DNA, 14 bp, Homo sapiens
accatagaactgtc

SEQ ID NO: 4288565 - DNA, 15 bp, Homo sapiens
accatccatccctgg

SEQ ID NO: 4288566 - DNA, 17 bp, Homo sapiens
accatccatccctggtg

SEQ ID NO: 4288567 - DNA, 14 bp, Homo sapiens
accatctcaggcca

SEQ ID NO: 4288568 - DNA, 17 bp, Homo sapiens
accatctcaggccacct

SEQ ID NO: 4288569 - DNA, 20 bp, Homo sapiens
accatgatcacttatcagtt

SEQ ID NO: 4288570 - DNA, 22 bp, Homo sapiens
accatgctcaatgaaaaggtga

SEQ ID NO: 4288571 - DNA, 12 bp, Homo sapiens
accattccccat

SEQ ID NO: 4288572 - DNA, 14 bp, Homo sapiens
acccaattttaaaa

SEQ ID NO: 4288573 - DNA, 14 bp, Homo sapiens
acccaccctctggt

SEQ ID NO: 4288574 - DNA, 18 bp, Homo sapiens
acccaccctctggtcctt

SEQ ID NO: 4288575 - DNA, 13 bp, Homo sapiens
acccagcaggggc

SEQ ID NO: 4288576 - DNA, 22 bp, Homo sapiens
acccagccccagcgagtctgga

SEQ ID NO: 4288577 - DNA, 17 bp, Homo sapiens
acccaggacctctgggg

SEQ ID NO: 4288578 - DNA, 22 bp, Homo sapiens
acccagggtggtcttcaagcct

SEQ ID NO: 4288579 - DNA, 23 bp, Homo sapiens
acccagggtggtcttcaagcctg

SEQ ID NO: 4288580 - DNA, 17 bp, Homo sapiens
acccagtaactcatctg

SEQ ID NO: 4288581 - DNA, 18 bp, Homo sapiens
acccagtaactcatctgt

SEQ ID NO: 4288582 - DNA, 18 bp, Homo sapiens
acccagtgtctaccttca

SEQ ID NO: 4288583 - DNA, 16 bp, Homo sapiens
acccatgcatggcctc

SEQ ID NO: 4288584 - DNA, 18 bp, Homo sapiens
acccatgcatggcctccc

SEQ ID NO: 4288585 - DNA, 19 bp, Homo sapiens
acccatgcatggcctccca

SEQ ID NO: 4288586 - DNA, 21 bp, Homo sapiens
acccatgcatggcctcccagc

SEQ ID NO: 4288587 - DNA, 13 bp, Homo sapiens
acccatgccatag

SEQ ID NO: 4288588 - DNA, 21 bp, Homo sapiens
acccatgccccactctgctga

SEQ ID NO: 4288589 - DNA, 23 bp, Homo sapiens
accccaccacacacacccttccc

SEQ ID NO: 4288590 - DNA, 23 bp, Homo sapiens
accccacttatgctgctgtgaat

SEQ ID NO: 4288591 - DNA, 17 bp, Homo sapiens
accccagcagtcctggg

SEQ ID NO: 4288592 - DNA, 18 bp, Homo sapiens
accccagctccaggcagg

SEQ ID NO: 4288593 - DNA, 15 bp, Homo sapiens
accccagtccccggg

SEQ ID NO: 4288594 - DNA, 22 bp, Homo sapiens
accccagtccccgggaaaggcc

SEQ ID NO: 4288595 - DNA, 13 bp, Homo sapiens
accccatccagcc

SEQ ID NO: 4288596 - DNA, 16 bp, Homo sapiens
accccatccagccagg

SEQ ID NO: 4288597 - DNA, 18 bp, Homo sapiens
accccatccctccttaag

SEQ ID NO: 4288598 - DNA, 11 bp, Homo sapiens
acccccaccct

SEQ ID NO: 4288599 - DNA, 12 bp, Homo sapiens
acccccaccctt

SEQ ID NO: 4288600 - DNA, 15 bp, Homo sapiens
acccccgtgccaaat

SEQ ID NO: 4288601 - DNA, 14 bp, Homo sapiens
accccctccctggc

SEQ ID NO: 4288602 - DNA, 17 bp, Homo sapiens
accccctccctggcctg

SEQ ID NO: 4288603 - DNA, 22 bp, Homo sapiens
accccctccctggcctgttctg

SEQ ID NO: 4288604 - DNA, 18 bp, Homo sapiens
accccctcggagcctgtg

SEQ ID NO: 4288605 - DNA, 17 bp, Homo sapiens
accccctgccccagaga

SEQ ID NO: 4288606 - DNA, 13 bp, Homo sapiens
accccctgctggt

SEQ ID NO: 4288607 - DNA, 17 bp, Homo sapiens
accccctgctggtgccc

SEQ ID NO: 4288608 - DNA, 15 bp, Homo sapiens
accccgcctctgggc

SEQ ID NO: 4288609 - DNA, 15 bp, Homo sapiens
accccgttgttgtcc

SEQ ID NO: 4288610 - DNA, 22 bp, Homo sapiens
accccgttgttgtccctgcagg

SEQ ID NO: 4288611 - DNA, 18 bp, Homo sapiens
acccctcaagccaggaga

SEQ ID NO: 4288612 - DNA, 20 bp, Homo sapiens
acccctcaagccaggagacc

SEQ ID NO: 4288613 - DNA, 23 bp, Homo sapiens
acccctcaagccaggagaccctg

SEQ ID NO: 4288614 - DNA, 23 bp, Homo sapiens
acccctcaccttgcaacacacag

SEQ ID NO: 4288615 - DNA, 13 bp, Homo sapiens
acccctcatctga

SEQ ID NO: 4288616 - DNA, 22 bp, Homo sapiens
acccctcttcccccttcccctg

SEQ ID NO: 4288617 - DNA, 17 bp, Homo sapiens
acccctgcacacacctg

SEQ ID NO: 4288618 - DNA, 19 bp, Homo sapiens
acccctgcacacacctgca

SEQ ID NO: 4288619 - DNA, 19 bp, Homo sapiens
acccctggcttttcactgc

SEQ ID NO: 4288620 - DNA, 21 bp, Homo sapiens
acccctggcttttcactgctg

SEQ ID NO: 4288621 - DNA, 20 bp, Homo sapiens
acccctggtgtccctgcctg

SEQ ID NO: 4288622 - DNA, 22 bp, Homo sapiens
acccctggtgtccctgcctggc

SEQ ID NO: 4288623 - DNA, 13 bp, Homo sapiens
acccctgtggagc

SEQ ID NO: 4288624 - DNA, 18 bp, Homo sapiens
acccctgtggagcccgca

SEQ ID NO: 4288625 - DNA, 19 bp, Homo sapiens
acccctgtggagcccgcac

SEQ ID NO: 4288626 - DNA, 14 bp, Homo sapiens
accccttccccact

SEQ ID NO: 4288627 - DNA, 20 bp, Homo sapiens
acccgcccgcgtccaacccc

SEQ ID NO: 4288628 - DNA, 21 bp, Homo sapiens
acccggaggggcctggcagcc

SEQ ID NO: 4288629 - DNA, 15 bp, Homo sapiens
acccggatctccagg

SEQ ID NO: 4288630 - DNA, 17 bp, Homo sapiens
acccggcagccccccag

SEQ ID NO: 4288631 - DNA, 20 bp, Homo sapiens
acccggcatgccgagtgccc

SEQ ID NO: 4288632 - DNA, 18 bp, Homo sapiens
acccggcccccgccctct

SEQ ID NO: 4288633 - DNA, 20 bp, Homo sapiens
acccggcccccgccctctgc

SEQ ID NO: 4288634 - DNA, 21 bp, Homo sapiens
acccggcccccgccctctgcc

SEQ ID NO: 4288635 - DNA, 22 bp, Homo sapiens
acccggcccccgccctctgccc

SEQ ID NO: 4288636 - DNA, 14 bp, Homo sapiens
acccgtttccaagc

SEQ ID NO: 4288637 - DNA, 23 bp, Homo sapiens
acccgtttccaagcctgggccac

SEQ ID NO: 4288638 - DNA, 24 bp, Homo sapiens
accctaggtctccacccctcaagc

SEQ ID NO: 4288639 - DNA, 14 bp, Homo sapiens
accctatcatcagt

SEQ ID NO: 4288640 - DNA, 19 bp, Homo sapiens
accctccctcagcccctct

SEQ ID NO: 4288641 - DNA, 23 bp, Homo sapiens
accctccctcagcccctcttgcc

SEQ ID NO: 4288642 - DNA, 13 bp, Homo sapiens
accctccctgtcc

SEQ ID NO: 4288643 - DNA, 18 bp, Homo sapiens
accctccctgtcccctga

SEQ ID NO: 4288644 - DNA, 22 bp, Homo sapiens
accctctctgtccaatctgcaa

SEQ ID NO: 4288645 - DNA, 14 bp, Homo sapiens
accctctgcagggc

SEQ ID NO: 4288646 - DNA, 23 bp, Homo sapiens
accctctgcagggcagcctgtgg

SEQ ID NO: 4288647 - DNA, 19 bp, Homo sapiens
accctctgctatgtctgtg

SEQ ID NO: 4288648 - DNA, 14 bp, Homo sapiens
accctctggtcctt

SEQ ID NO: 4288649 - DNA, 15 bp, Homo sapiens
accctctggtccttc

SEQ ID NO: 4288650 - DNA, 18 bp, Homo sapiens
accctctggtccttctga

SEQ ID NO: 4288651 - DNA, 15 bp, Homo sapiens
accctgcccctgccc

SEQ ID NO: 4288652 - DNA, 18 bp, Homo sapiens
accctgcccctgccccgt

SEQ ID NO: 4288653 - DNA, 22 bp, Homo sapiens
accctggagcccggcagtgcac

SEQ ID NO: 4288654 - DNA, 21 bp, Homo sapiens
accctgggtcaccttcctggg

SEQ ID NO: 4288655 - DNA, 13 bp, Homo sapiens
acccttccccact

SEQ ID NO: 4288656 - DNA, 17 bp, Homo sapiens
acccttccccactcccg

SEQ ID NO: 4288657 - DNA, 15 bp, Homo sapiens
acccttggcctgtcc

SEQ ID NO: 4288658 - DNA, 23 bp, Homo sapiens
accctttggggggggcccgcctg

SEQ ID NO: 4288659 - DNA, 19 bp, Homo sapiens
accgagtgtggagctgctt

SEQ ID NO: 4288660 - DNA, 23 bp, Homo sapiens
accgagtgtggagctgcttccag

SEQ ID NO: 4288661 - DNA, 13 bp, Homo sapiens
accgatgctccag

SEQ ID NO: 4288662 - DNA, 17 bp, Homo sapiens
accgccagatggggcct

SEQ ID NO: 4288663 - DNA, 13 bp, Homo sapiens
agcccacccccct

SEQ ID NO: 4288664 - DNA, 14 bp, Homo sapiens
agcccacccccctc

SEQ ID NO: 4288665 - DNA, 13 bp, Homo sapiens
agcccacctgctg

SEQ ID NO: 4288666 - DNA, 14 bp, Homo sapiens
agcccacctgctgc

SEQ ID NO: 4288667 - DNA, 20 bp, Homo sapiens
agcccagagagaccctgcca

SEQ ID NO: 4288668 - DNA, 21 bp, Homo sapiens
agcccagagagaccctgccaa

SEQ ID NO: 4288669 - DNA, 19 bp, Homo sapiens
agcccagatggctccctgg

SEQ ID NO: 4288670 - DNA, 22 bp, Homo sapiens
agcccagatggctccctgggct

SEQ ID NO: 4288671 - DNA, 23 bp, Homo sapiens
agcccagatggctccctgggctg

SEQ ID NO: 4288672 - DNA, 17 bp, Homo sapiens
agcccaggacactgcct

SEQ ID NO: 4288673 - DNA, 10 bp, Homo sapiens
agcccagggt

SEQ ID NO: 4288674 - DNA, 19 bp, Homo sapiens
agcccagggttcccccagc

SEQ ID NO: 4288675 - DNA, 22 bp, Homo sapiens
agcccagggttcccccagccct

SEQ ID NO: 4288676 - DNA, 14 bp, Homo sapiens
agcccaggtctcct

SEQ ID NO: 4288677 - DNA, 16 bp, Homo sapiens
agcccaggtctcctgg

SEQ ID NO: 4288678 - DNA, 12 bp, Homo sapiens
agccccaggcct

SEQ ID NO: 4288679 - DNA, 14 bp, Homo sapiens
agccccagggccct

SEQ ID NO: 4288680 - DNA, 20 bp, Homo sapiens
agcccccaccagcagcacaa

SEQ ID NO: 4288681 - DNA, 22 bp, Homo sapiens
agcccccgccccgccccacatt

SEQ ID NO: 4288682 - DNA, 18 bp, Homo sapiens
agccccctcctgacccca

SEQ ID NO: 4288683 - DNA, 15 bp, Homo sapiens
agccccctgtccttc

SEQ ID NO: 4288684 - DNA, 23 bp, Homo sapiens
agccccctgtccttcccacggcc

SEQ ID NO: 4288685 - DNA, 16 bp, Homo sapiens
agcccctcccaccaca

SEQ ID NO: 4288686 - DNA, 12 bp, Homo sapiens
agcccctcccca

SEQ ID NO: 4288687 - DNA, 21 bp, Homo sapiens
agcccctccccatggtgcagt

SEQ ID NO: 4288688 - DNA, 22 bp, Homo sapiens
agcccctcttgccccccacccc

SEQ ID NO: 4288689 - DNA, 23 bp, Homo sapiens
agcccctcttgccccccacccca

SEQ ID NO: 4288690 - DNA, 17 bp, Homo sapiens
agcccgatccacattgc

SEQ ID NO: 4288691 - DNA, 15 bp, Homo sapiens
agcccgcacccccac

SEQ ID NO: 4288692 - DNA, 17 bp, Homo sapiens
agcccgcacccccaccc

SEQ ID NO: 4288693 - DNA, 16 bp, Homo sapiens
agcccgcccacctggg

SEQ ID NO: 4288694 - DNA, 19 bp, Homo sapiens
agcccgtgtggccccttca

SEQ ID NO: 4288695 - DNA, 16 bp, Homo sapiens
agccctacgatgggat

SEQ ID NO: 4288696 - DNA, 23 bp, Homo sapiens
agccctgagtttcaagtatcctt

SEQ ID NO: 4288697 - DNA, 11 bp, Homo sapiens
agccctgccct

SEQ ID NO: 4288698 - DNA, 16 bp, Homo sapiens
agccctgccctcactc

SEQ ID NO: 4288699 - DNA, 17 bp, Homo sapiens
agccctgccctcactcc

SEQ ID NO: 4288700 - DNA, 22 bp, Homo sapiens
agccctgccctcactccactcc

SEQ ID NO: 4288701 - DNA, 23 bp, Homo sapiens
agccctgccctcactccactccc

SEQ ID NO: 4288702 - DNA, 21 bp, Homo sapiens
agccctgctttgggctgccct

SEQ ID NO: 4288703 - DNA, 23 bp, Homo sapiens
agccctgctttgggctgccctgg

SEQ ID NO: 4288704 - DNA, 21 bp, Homo sapiens
agccctggtggccaagcctgc

SEQ ID NO: 4288705 - DNA, 14 bp, Homo sapiens
agccctgtcagtgc

SEQ ID NO: 4288706 - DNA, 16 bp, Homo sapiens
agccctgtcagtgcag

SEQ ID NO: 4288707 - DNA, 17 bp, Homo sapiens
agccctgtcagtgcagc

SEQ ID NO: 4288708 - DNA, 20 bp, Homo sapiens
agccgagctctcctgggcca

SEQ ID NO: 4288709 - DNA, 16 bp, Homo sapiens
agccgctggtgcccac

SEQ ID NO: 4288710 - DNA, 20 bp, Homo sapiens
agccgctggtgcccaccagc

SEQ ID NO: 4288711 - DNA, 21 bp, Homo sapiens
agccggagtcactgcctggag

SEQ ID NO: 4288712 - DNA, 13 bp, Homo sapiens
agccggggagctg

SEQ ID NO: 4288713 - DNA, 18 bp, Homo sapiens
agccggggagctgagggg

SEQ ID NO: 4288714 - DNA, 21 bp, Homo sapiens
agccggggagctgaggggcag

SEQ ID NO: 4288715 - DNA, 15 bp, Homo sapiens
agccgtcagcctgtg

SEQ ID NO: 4288716 - DNA, 17 bp, Homo sapiens
agccgtgccttcagctc

SEQ ID NO: 4288717 - DNA, 14 bp, Homo sapiens
agccgtggcttccc

SEQ ID NO: 4288718 - DNA, 21 bp, Homo sapiens
agccgtggcttcccgctcagc

SEQ ID NO: 4288719 - DNA, 22 bp, Homo sapiens
agccgtggcttcccgctcagcc

SEQ ID NO: 4288720 - DNA, 23 bp, Homo sapiens
agccgtggcttcccgctcagccc

SEQ ID NO: 4288721 - DNA, 18 bp, Homo sapiens
agcctaagatgaagagga

SEQ ID NO: 4288722 - DNA, 15 bp, Homo sapiens
agcctagaggaggaa

SEQ ID NO: 4288723 - DNA, 23 bp, Homo sapiens
agcctaggggtcagggaccaagg

SEQ ID NO: 4288724 - DNA, 15 bp, Homo sapiens
agcctagggtgaggg

SEQ ID NO: 4288725 - DNA, 18 bp, Homo sapiens
agcctagggtgagggtga

SEQ ID NO: 4288726 - DNA, 13 bp, Homo sapiens
agcctcactgata

SEQ ID NO: 4288727 - DNA, 15 bp, Homo sapiens
agcctcagccactcc

SEQ ID NO: 4288728 - DNA, 19 bp, Homo sapiens
agcctcagccactcccagg

SEQ ID NO: 4288729 - DNA, 13 bp, Homo sapiens
agcctcaggcctg

SEQ ID NO: 4288730 - DNA, 16 bp, Homo sapiens
agcctcaggcctggcc

SEQ ID NO: 4288731 - DNA, 17 bp, Homo sapiens
agcctcaggcctggccc

SEQ ID NO: 4288732 - DNA, 18 bp, Homo sapiens
agcctcaggcctggccct

SEQ ID NO: 4288733 - DNA, 23 bp, Homo sapiens
agcctcagtccctccctcctggc

SEQ ID NO: 4288734 - DNA, 15 bp, Homo sapiens
agcctcagtgcagcc

SEQ ID NO: 4288735 - DNA, 19 bp, Homo sapiens
agcctcagtgcagccccct

SEQ ID NO: 4288736 - DNA, 12 bp, Homo sapiens
agcctccacctg

SEQ ID NO: 4288737 - DNA, 18 bp, Homo sapiens
agcctccacctgcagccc

SEQ ID NO: 4288738 - DNA, 23 bp, Homo sapiens
agcctccacctgcagccccaggc

SEQ ID NO: 4288739 - DNA, 16 bp, Homo sapiens
agcctccactccctgt

SEQ ID NO: 4288740 - DNA, 18 bp, Homo sapiens
agcctccctcagccacgc

SEQ ID NO: 4288741 - DNA, 13 bp, Homo sapiens
agcctcctgctga

SEQ ID NO: 4288742 - DNA, 14 bp, Homo sapiens
agcctcgcccctcc

SEQ ID NO: 4288743 - DNA, 16 bp, Homo sapiens
agcctcgcccctccag

SEQ ID NO: 4288744 - DNA, 20 bp, Homo sapiens
agcctgccccggccactctg

SEQ ID NO: 4288745 - DNA, 16 bp, Homo sapiens
agcctgcgtggcctgg

SEQ ID NO: 4288746 - DNA, 17 bp, Homo sapiens
agcctgcgtggcctggg

SEQ ID NO: 4288747 - DNA, 12 bp, Homo sapiens
agcctggaggac

SEQ ID NO: 4288748 - DNA, 12 bp, Homo sapiens
agcctggcccca

SEQ ID NO: 4288749 - DNA, 18 bp, Homo sapiens
agcctggccccaaatgtt

SEQ ID NO: 4288750 - DNA, 14 bp, Homo sapiens
agcctgggccactg

SEQ ID NO: 4288751 - DNA, 15 bp, Homo sapiens
agcctgggccactgg

SEQ ID NO: 4288752 - DNA, 20 bp, Homo sapiens
agcctgtggcctcagcatct

SEQ ID NO: 4288753 - DNA, 16 bp, Homo sapiens
agcctgtgggagaagg

SEQ ID NO: 4288754 - DNA, 17 bp, Homo sapiens
agcctgtgggagaaggg

SEQ ID NO: 4288755 - DNA, 21 bp, Homo sapiens
agcctgtgttagtgtctgtcc

SEQ ID NO: 4288756 - DNA, 22 bp, Homo sapiens
agcctgtgttagtgtctgtcca

SEQ ID NO: 4288757 - DNA, 12 bp, Homo sapiens
agccttctctgt

SEQ ID NO: 4288758 - DNA, 15 bp, Homo sapiens
agccttctctgttca

SEQ ID NO: 4288759 - DNA, 19 bp, Homo sapiens
agccttctctgttcatttc

SEQ ID NO: 4288760 - DNA, 23 bp, Homo sapiens
agccttctctgttcatttcctca

SEQ ID NO: 4288761 - DNA, 23 bp, Homo sapiens
agccttgtgatcactttctgaaa

SEQ ID NO: 4288762 - DNA, 17 bp, Homo sapiens
agcgacggctcctcccc

SEQ ID NO: 4288763 - DNA, 19 bp, Homo sapiens
agcgacggctcctccccga

SEQ ID NO: 4288764 - DNA, 15 bp, Homo sapiens
agcgaggcagaatgg

SEQ ID NO: 4288765 - DNA, 19 bp, Homo sapiens
agcgaggcagaatggtggg

SEQ ID NO: 4288766 - DNA, 21 bp, Homo sapiens
agcgagtctggagaccaggac

SEQ ID NO: 4288767 - DNA, 21 bp, Homo sapiens
agcgatgatgtccccttccct

SEQ ID NO: 4288768 - DNA, 16 bp, Homo sapiens
agcgcccctccctagt

SEQ ID NO: 4288769 - DNA, 15 bp, Homo sapiens
agcgctcctctgcct

SEQ ID NO: 4288770 - DNA, 14 bp, Homo sapiens
agcgggacctgtgg

SEQ ID NO: 4288771 - DNA, 15 bp, Homo sapiens
agcgggacctgtggc

SEQ ID NO: 4288772 - DNA, 16 bp, Homo sapiens
agcgggacctgtggct

SEQ ID NO: 4288773 - DNA, 23 bp, Homo sapiens
agcgggagtgtgggggtgccatg

SEQ ID NO: 4288774 - DNA, 20 bp, Homo sapiens
agcgtctttttaacctcaga

SEQ ID NO: 4288775 - DNA, 19 bp, Homo sapiens
agcgtgtactaccccagaa

SEQ ID NO: 4288776 - DNA, 16 bp, Homo sapiens
agctaacactggcccc

SEQ ID NO: 4288777 - DNA, 18 bp, Homo sapiens
agctaacactggccccta

SEQ ID NO: 4288778 - DNA, 15 bp, Homo sapiens
agctaagcctgatga

SEQ ID NO: 4288779 - DNA, 17 bp, Homo sapiens
agctaagcctgatgatg

SEQ ID NO: 4288780 - DNA, 16 bp, Homo sapiens
agctataatgtttccc

SEQ ID NO: 4288781 - DNA, 15 bp, Homo sapiens
agctatcttcatgta

SEQ ID NO: 4288782 - DNA, 18 bp, Homo sapiens
agctatgagagatgtgtc

SEQ ID NO: 4288783 - DNA, 20 bp, Homo sapiens
agctatgagagatgtgtcca

SEQ ID NO: 4288784 - DNA, 16 bp, Homo sapiens
agctcagcacagcctc

SEQ ID NO: 4288785 - DNA, 16 bp, Homo sapiens
agctcagcccaccccc

SEQ ID NO: 4288786 - DNA, 20 bp, Homo sapiens
agctcagcccacccccctca

SEQ ID NO: 4288787 - DNA, 19 bp, Homo sapiens
agctcaggagaaggcctgc

SEQ ID NO: 4288788 - DNA, 21 bp, Homo sapiens
agctcaggagaaggcctgccc

SEQ ID NO: 4288789 - DNA, 22 bp, Homo sapiens
agctcagggtgctccctcctca

SEQ ID NO: 4288790 - DNA, 12 bp, Homo sapiens
agctccaggcag

SEQ ID NO: 4288791 - DNA, 19 bp, Homo sapiens
agctccataattgcaaggg

SEQ ID NO: 4288792 - DNA, 19 bp, Homo sapiens
agctcccaggacgcaggga

SEQ ID NO: 4288793 - DNA, 12 bp, Homo sapiens
agctcctctggg

SEQ ID NO: 4288794 - DNA, 15 bp, Homo sapiens
agctcctctgggcag

SEQ ID NO: 4288795 - DNA, 16 bp, Homo sapiens
agctctagacaaccct

SEQ ID NO: 4288796 - DNA, 19 bp, Homo sapiens
agctctagacaaccctgca

SEQ ID NO: 4288797 - DNA, 20 bp, Homo sapiens
agattgtaaaggtaggtgca

SEQ ID NO: 4288798 - DNA, 20 bp, Homo sapiens
agattgtgtaaattcctgtt

SEQ ID NO: 4288799 - DNA, 16 bp, Homo sapiens
agatttgtatttatat

SEQ ID NO: 4288800 - DNA, 20 bp, Homo sapiens
agattttaaaacttcatctg

SEQ ID NO: 4288801 - DNA, 14 bp, Homo sapiens
agattttatagtgt

SEQ ID NO: 4288802 - DNA, 22 bp, Homo sapiens
agattttatgtgcttgaagatt

SEQ ID NO: 4288803 - DNA, 21 bp, Homo sapiens
agattttattttcaagcaaat

SEQ ID NO: 4288804 - DNA, 21 bp, Homo sapiens
agcaaacagatgtttgttttc

SEQ ID NO: 4288805 - DNA, 20 bp, Homo sapiens
agcaaagcatgccaatttct

SEQ ID NO: 4288806 - DNA, 17 bp, Homo sapiens
agcaacaggaccaggag

SEQ ID NO: 4288807 - DNA, 22 bp, Homo sapiens
agcaacaggaccaggagccagg

SEQ ID NO: 4288808 - DNA, 22 bp, Homo sapiens
agcaacccaggtgttgtccgtg

SEQ ID NO: 4288809 - DNA, 16 bp, Homo sapiens
agcaagaagattctaa

SEQ ID NO: 4288810 - DNA, 15 bp, Homo sapiens
agcaagacctcgtct

SEQ ID NO: 4288811 - DNA, 14 bp, Homo sapiens
agcaagcacctggg

SEQ ID NO: 4288812 - DNA, 15 bp, Homo sapiens
agcaaggccagccct

SEQ ID NO: 4288813 - DNA, 14 bp, Homo sapiens
agcaagtatattta

SEQ ID NO: 4288814 - DNA, 22 bp, Homo sapiens
agcaattaaagacatttaaaat

SEQ ID NO: 4288815 - DNA, 18 bp, Homo sapiens
agcacaagaagtgggagt

SEQ ID NO: 4288816 - DNA, 22 bp, Homo sapiens
agcacaagaagtgggagtggga

SEQ ID NO: 4288817 - DNA, 16 bp, Homo sapiens
agcacaaggagtgccc

SEQ ID NO: 4288818 - DNA, 16 bp, Homo sapiens
agcacaattctgtccc

SEQ ID NO: 4288819 - DNA, 17 bp, Homo sapiens
agcacaattctgtccct

SEQ ID NO: 4288820 - DNA, 16 bp, Homo sapiens
agcacagagagcggct

SEQ ID NO: 4288821 - DNA, 21 bp, Homo sapiens
agcacagaggatggcttcccc

SEQ ID NO: 4288822 - DNA, 15 bp, Homo sapiens
agcacagctttcctg

SEQ ID NO: 4288823 - DNA, 23 bp, Homo sapiens
agcacattgccctgaggggcctg

SEQ ID NO: 4288824 - DNA, 23 bp, Homo sapiens
agcaccagcctcagtgcagcccc

SEQ ID NO: 4288825 - DNA, 17 bp, Homo sapiens
agcaccccaccacacac

SEQ ID NO: 4288826 - DNA, 15 bp, Homo sapiens
agcacctacttacat

SEQ ID NO: 4288827 - DNA, 18 bp, Homo sapiens
agcacctgggtgtgctcc

SEQ ID NO: 4288828 - DNA, 20 bp, Homo sapiens
agcacctgggtgtgctccag

SEQ ID NO: 4288829 - DNA, 19 bp, Homo sapiens
agcactaaacttggtgctt

SEQ ID NO: 4288830 - DNA, 14 bp, Homo sapiens
agcactggaggcct

SEQ ID NO: 4288831 - DNA, 20 bp, Homo sapiens
agcactggaggcctctgcaa

SEQ ID NO: 4288832 - DNA, 21 bp, Homo sapiens
agcactggaggcctctgcaag

SEQ ID NO: 4288833 - DNA, 12 bp, Homo sapiens
agcactgtgcag

SEQ ID NO: 4288834 - DNA, 16 bp, Homo sapiens
agcactgtgcagccgg

SEQ ID NO: 4288835 - DNA, 14 bp, Homo sapiens
agcagaaggccttg

SEQ ID NO: 4288836 - DNA, 17 bp, Homo sapiens
agcagaaggccttgcct

SEQ ID NO: 4288837 - DNA, 13 bp, Homo sapiens
agcagagccatct

SEQ ID NO: 4288838 - DNA, 15 bp, Homo sapiens
agcagagcctggggt

SEQ ID NO: 4288839 - DNA, 15 bp, Homo sapiens
agcagagtcattgtt

SEQ ID NO: 4288840 - DNA, 17 bp, Homo sapiens
agcagagtgcacagctg

SEQ ID NO: 4288841 - DNA, 23 bp, Homo sapiens
agcagagtgcacagctgtccact

SEQ ID NO: 4288842 - DNA, 18 bp, Homo sapiens
agcagcacaattctgtcc

SEQ ID NO: 4288843 - DNA, 15 bp, Homo sapiens
agcagcccacctgct

SEQ ID NO: 4288844 - DNA, 20 bp, Homo sapiens
agcagcccacctgctgcccg

SEQ ID NO: 4288845 - DNA, 22 bp, Homo sapiens
agcagcccacctgctgcccgtg

SEQ ID NO: 4288846 - DNA, 17 bp, Homo sapiens
agcaggaagcaaggcca

SEQ ID NO: 4288847 - DNA, 19 bp, Homo sapiens
agcaggaagcaaggccagc

SEQ ID NO: 4288848 - DNA, 21 bp, Homo sapiens
agcaggaagcaaggccagccc

SEQ ID NO: 4288849 - DNA, 21 bp, Homo sapiens
agcaggaaggtctcatgcctg

SEQ ID NO: 4288850 - DNA, 22 bp, Homo sapiens
agcaggaaggtctcatgcctga

SEQ ID NO: 4288851 - DNA, 23 bp, Homo sapiens
agcaggaaggtctcatgcctgag

SEQ ID NO: 4288852 - DNA, 17 bp, Homo sapiens
agcagggcgggccagga

SEQ ID NO: 4288853 - DNA, 20 bp, Homo sapiens
agcagggcgggccaggagaa

SEQ ID NO: 4288854 - DNA, 15 bp, Homo sapiens
agcaggggcagaagg

SEQ ID NO: 4288855 - DNA, 20 bp, Homo sapiens
agcaggggggttgggttcca

SEQ ID NO: 4288856 - DNA, 13 bp, Homo sapiens
agcaggtggggag

SEQ ID NO: 4288857 - DNA, 15 bp, Homo sapiens
agcagtcctgggccc

SEQ ID NO: 4288858 - DNA, 23 bp, Homo sapiens
agcagtggcctacaaatcagtaa

SEQ ID NO: 4288859 - DNA, 19 bp, Homo sapiens
agcagtgggccctggctct

SEQ ID NO: 4288860 - DNA, 16 bp, Homo sapiens
agcagtgtgagggtgc

SEQ ID NO: 4288861 - DNA, 21 bp, Homo sapiens
agcagtgtgagggtgcaggga

SEQ ID NO: 4288862 - DNA, 13 bp, Homo sapiens
agcagtgttagct

SEQ ID NO: 4288863 - DNA, 17 bp, Homo sapiens
agcagtgttagcttagt

SEQ ID NO: 4288864 - DNA, 19 bp, Homo sapiens
agcagttaccgaggagcta

SEQ ID NO: 4288865 - DNA, 13 bp, Homo sapiens
agcatcagcaaga

SEQ ID NO: 4288866 - DNA, 18 bp, Homo sapiens
agcatcgtgtgggtccct

SEQ ID NO: 4288867 - DNA, 15 bp, Homo sapiens
agcatctcagctcat

SEQ ID NO: 4288868 - DNA, 18 bp, Homo sapiens
agcatctgctcttctctt

SEQ ID NO: 4288869 - DNA, 17 bp, Homo sapiens
agcatgacaagccccag

SEQ ID NO: 4288870 - DNA, 19 bp, Homo sapiens
agcatgacaagccccaggc

SEQ ID NO: 4288871 - DNA, 19 bp, Homo sapiens
agcatgtcctatccctgga

SEQ ID NO: 4288872 - DNA, 15 bp, Homo sapiens
agcatgtctactgct

SEQ ID NO: 4288873 - DNA, 17 bp, Homo sapiens
agcatgtctactgcttg

SEQ ID NO: 4288874 - DNA, 17 bp, Homo sapiens
agcatgtgttaatctta

SEQ ID NO: 4288875 - DNA, 13 bp, Homo sapiens
agcattcaaaata

SEQ ID NO: 4288876 - DNA, 20 bp, Homo sapiens
agcattcaaaatagttctat

SEQ ID NO: 4288877 - DNA, 18 bp, Homo sapiens
agcattctcactcctacc

SEQ ID NO: 4288878 - DNA, 16 bp, Homo sapiens
agcattctggggtggg

SEQ ID NO: 4288879 - DNA, 18 bp, Homo sapiens
agcatttggaaggaaagg

SEQ ID NO: 4288880 - DNA, 20 bp, Homo sapiens
agcatttggaaggaaaggaa

SEQ ID NO: 4288881 - DNA, 17 bp, Homo sapiens
agcattttactgtctgt

SEQ ID NO: 4288882 - DNA, 23 bp, Homo sapiens
agcattttactgtctgtaagaga

SEQ ID NO: 4288883 - DNA, 15 bp, Homo sapiens
agcattttctgcatc

SEQ ID NO: 4288884 - DNA, 18 bp, Homo sapiens
agcattttctgcatctcc

SEQ ID NO: 4288885 - DNA, 20 bp, Homo sapiens
agcattttctgcatctccac

SEQ ID NO: 4288886 - DNA, 20 bp, Homo sapiens
agccaaaaacaataaacgaa

SEQ ID NO: 4288887 - DNA, 17 bp, Homo sapiens
agccaaacattcttatt

SEQ ID NO: 4288888 - DNA, 18 bp, Homo sapiens
agccaaacattcttattt

SEQ ID NO: 4288889 - DNA, 13 bp, Homo sapiens
agccaaagagaaa

SEQ ID NO: 4288890 - DNA, 21 bp, Homo sapiens
agccaaagagaaaagattaaa

SEQ ID NO: 4288891 - DNA, 11 bp, Homo sapiens
agccaaagagg

SEQ ID NO: 4288892 - DNA, 16 bp, Homo sapiens
agccaaagaggcattc

SEQ ID NO: 4288893 - DNA, 14 bp, Homo sapiens
agccaacccctgtg

SEQ ID NO: 4288894 - DNA, 16 bp, Homo sapiens
agccaacccctgtgga

SEQ ID NO: 4288895 - DNA, 22 bp, Homo sapiens
agccaaggcctatgccacctgc

SEQ ID NO: 4288896 - DNA, 19 bp, Homo sapiens
agccaaggggtctgctcct

SEQ ID NO: 4288897 - DNA, 20 bp, Homo sapiens
agccaaggggtctgctcctg

SEQ ID NO: 4288898 - DNA, 21 bp, Homo sapiens
agccaagtcagctttgccttc

SEQ ID NO: 4288899 - DNA, 18 bp, Homo sapiens
agccaatgaagcaaacac

SEQ ID NO: 4288900 - DNA, 14 bp, Homo sapiens
agccacataaccag

SEQ ID NO: 4288901 - DNA, 16 bp, Homo sapiens
agccaccaaggctgcc

SEQ ID NO: 4288902 - DNA, 23 bp, Homo sapiens
agccaccaaggctgcctgcccca

SEQ ID NO: 4288903 - DNA, 14 bp, Homo sapiens
agccaccacctgga

SEQ ID NO: 4288904 - DNA, 19 bp, Homo sapiens
agccaccatgtatgtggaa

SEQ ID NO: 4288905 - DNA, 13 bp, Homo sapiens
agccaccctgcca

SEQ ID NO: 4288906 - DNA, 14 bp, Homo sapiens
agccaccctgccat

SEQ ID NO: 4288907 - DNA, 13 bp, Homo sapiens
agccacgcctctc

SEQ ID NO: 4288908 - DNA, 14 bp, Homo sapiens
agccacgcctgcga

SEQ ID NO: 4288909 - DNA, 24 bp, Homo sapiens
agccacgcctgcgatggtgctgca

SEQ ID NO: 4288910 - DNA, 16 bp, Homo sapiens
agccacgtgctggaga

SEQ ID NO: 4288911 - DNA, 17 bp, Homo sapiens
agccagaaactgaactg

SEQ ID NO: 4288912 - DNA, 16 bp, Homo sapiens
agccagattaggcctg

SEQ ID NO: 4288913 - DNA, 23 bp, Homo sapiens
agccagcagggcgggccaggaga

SEQ ID NO: 4288914 - DNA, 20 bp, Homo sapiens
agccagcaggttctctcctg

SEQ ID NO: 4288915 - DNA, 21 bp, Homo sapiens
agccagcaggttctctcctgt

SEQ ID NO: 4288916 - DNA, 14 bp, Homo sapiens
agccagcccacatc

SEQ ID NO: 4288917 - DNA, 12 bp, Homo sapiens
agccaggagacc

SEQ ID NO: 4288918 - DNA, 15 bp, Homo sapiens
agccaggagaccctg

SEQ ID NO: 4288919 - DNA, 10 bp, Homo sapiens
agccagggct

SEQ ID NO: 4288920 - DNA, 17 bp, Homo sapiens
agccaggggtggggatg

SEQ ID NO: 4288921 - DNA, 17 bp, Homo sapiens
agccagggttccagaca

SEQ ID NO: 4288922 - DNA, 14 bp, Homo sapiens
agccaggtgtcctg

SEQ ID NO: 4288923 - DNA, 17 bp, Homo sapiens
agccaggtgtcctgact

SEQ ID NO: 4288924 - DNA, 13 bp, Homo sapiens
agccagtgactcc

SEQ ID NO: 4288925 - DNA, 16 bp, Homo sapiens
agccagtgactccagg

SEQ ID NO: 4288926 - DNA, 23 bp, Homo sapiens
agccatgatgtggagtggggcag

SEQ ID NO: 4288927 - DNA, 21 bp, Homo sapiens
agccattcacaacacaatcaa

SEQ ID NO: 4288928 - DNA, 17 bp, Homo sapiens
agcccaatcactgccta

SEQ ID NO: 4288929 - DNA, 19 bp, Homo sapiens
agcccacagtatattttat

SEQ ID NO: 4288930 - DNA, 14 bp, Homo sapiens
agacatttaaaata

SEQ ID NO: 4288931 - DNA, 21 bp, Homo sapiens
agacatttaaaatagttttct

SEQ ID NO: 4288932 - DNA, 19 bp, Homo sapiens
agaccacaaggctgaaaag

SEQ ID NO: 4288933 - DNA, 14 bp, Homo sapiens
agaccaggactctg

SEQ ID NO: 4288934 - DNA, 18 bp, Homo sapiens
agaccaggactctgcctt

SEQ ID NO: 4288935 - DNA, 12 bp, Homo sapiens
agacccccaccc

SEQ ID NO: 4288936 - DNA, 14 bp, Homo sapiens
agacccccacccct

SEQ ID NO: 4288937 - DNA, 12 bp, Homo sapiens
agaccctgtctt

SEQ ID NO: 4288938 - DNA, 21 bp, Homo sapiens
agaccctgtctttgctgttta

SEQ ID NO: 4288939 - DNA, 16 bp, Homo sapiens
agacctcggctgtgtg

SEQ ID NO: 4288940 - DNA, 13 bp, Homo sapiens
agacctgaagaat

SEQ ID NO: 4288941 - DNA, 13 bp, Homo sapiens
agacctgggccct

SEQ ID NO: 4288942 - DNA, 12 bp, Homo sapiens
agaccttctctt

SEQ ID NO: 4288943 - DNA, 18 bp, Homo sapiens
agaccttctgaagatctc

SEQ ID NO: 4288944 - DNA, 15 bp, Homo sapiens
agacctttgtctgaa

SEQ ID NO: 4288945 - DNA, 17 bp, Homo sapiens
agacctttgtctgaagg

SEQ ID NO: 4288946 - DNA, 23 bp, Homo sapiens
agactatgtgtcatgatttcaat

SEQ ID NO: 4288947 - DNA, 17 bp, Homo sapiens
agactctctcctctctc

SEQ ID NO: 4288948 - DNA, 11 bp, Homo sapiens
agactgaccca

SEQ ID NO: 4288949 - DNA, 16 bp, Homo sapiens
agactgctttgagaaa

SEQ ID NO: 4288950 - DNA, 13 bp, Homo sapiens
agactgggctggc

SEQ ID NO: 4288951 - DNA, 18 bp, Homo sapiens
agactgggctggctgcct

SEQ ID NO: 4288952 - DNA, 14 bp, Homo sapiens
agacttaggccaga

SEQ ID NO: 4288953 - DNA, 20 bp, Homo sapiens
agacttcaaaatattgagca

SEQ ID NO: 4288954 - DNA, 18 bp, Homo sapiens
agacttcgctattcccag

SEQ ID NO: 4288955 - DNA, 22 bp, Homo sapiens
agacttcgctattcccaggcag

SEQ ID NO: 4288956 - DNA, 18 bp, Homo sapiens
agagaaaaaccaatgatt

SEQ ID NO: 4288957 - DNA, 22 bp, Homo sapiens
agagaaaagattaaaattagtg

SEQ ID NO: 4288958 - DNA, 14 bp, Homo sapiens
agagaagtgcccct

SEQ ID NO: 4288959 - DNA, 15 bp, Homo sapiens
agagaatgagagagt

SEQ ID NO: 4288960 - DNA, 19 bp, Homo sapiens
agagaatgagagagtgtgg

SEQ ID NO: 4288961 - DNA, 22 bp, Homo sapiens
agagaattctaagattgtacat

SEQ ID NO: 4288962 - DNA, 12 bp, Homo sapiens
agagaggacagt

SEQ ID NO: 4288963 - DNA, 18 bp, Homo sapiens
agagaggacagtttagga

SEQ ID NO: 4288964 - DNA, 17 bp, Homo sapiens
agagagggaattctctt

SEQ ID NO: 4288965 - DNA, 14 bp, Homo sapiens
agagagtggctcct

SEQ ID NO: 4288966 - DNA, 16 bp, Homo sapiens
agagatatatctgaaa

SEQ ID NO: 4288967 - DNA, 20 bp, Homo sapiens
agagatgtaccatgttaaag

SEQ ID NO: 4288968 - DNA, 17 bp, Homo sapiens
agagattaatttgtgta

SEQ ID NO: 4288969 - DNA, 17 bp, Homo sapiens
agagattggatcaagta

SEQ ID NO: 4288970 - DNA, 22 bp, Homo sapiens
agagccaaggcctatgccacct

SEQ ID NO: 4288971 - DNA, 13 bp, Homo sapiens
agagccagggctg

SEQ ID NO: 4288972 - DNA, 15 bp, Homo sapiens
agagccagggctgtc

SEQ ID NO: 4288973 - DNA, 16 bp, Homo sapiens
agagccagggctgtcc

SEQ ID NO: 4288974 - DNA, 18 bp, Homo sapiens
agagccagggctgtcctt

SEQ ID NO: 4288975 - DNA, 19 bp, Homo sapiens
agagccagggctgtcctta

SEQ ID NO: 4288976 - DNA, 18 bp, Homo sapiens
agagcccccaccagcagc

SEQ ID NO: 4288977 - DNA, 23 bp, Homo sapiens
agagccctctgctgctttccaac

SEQ ID NO: 4288978 - DNA, 16 bp, Homo sapiens
agagcctatggaaagg

SEQ ID NO: 4288979 - DNA, 19 bp, Homo sapiens
agagcgctcctctgccttg

SEQ ID NO: 4288980 - DNA, 18 bp, Homo sapiens
agagctcagcacagcctc

SEQ ID NO: 4288981 - DNA, 18 bp, Homo sapiens
agagctcccaggacgcag

SEQ ID NO: 4288982 - DNA, 20 bp, Homo sapiens
agaggaagcacaagaagtgg

SEQ ID NO: 4288983 - DNA, 18 bp, Homo sapiens
agaggacagatcaatggc

SEQ ID NO: 4288984 - DNA, 11 bp, Homo sapiens
agaggagagaa

SEQ ID NO: 4288985 - DNA, 21 bp, Homo sapiens
agaggagcgggacctgtggct

SEQ ID NO: 4288986 - DNA, 14 bp, Homo sapiens
agaggaggtgtgga

SEQ ID NO: 4288987 - DNA, 20 bp, Homo sapiens
agaggaggtgtggagtggag

SEQ ID NO: 4288988 - DNA, 20 bp, Homo sapiens
agaggagttctaacacattt

SEQ ID NO: 4288989 - DNA, 18 bp, Homo sapiens
agaggcacctgtcccaga

SEQ ID NO: 4288990 - DNA, 16 bp, Homo sapiens
agaggcagtggcagca

SEQ ID NO: 4288991 - DNA, 19 bp, Homo sapiens
agaggccatgattcgccca

SEQ ID NO: 4288992 - DNA, 17 bp, Homo sapiens
agaggccccttgctgct

SEQ ID NO: 4288993 - DNA, 18 bp, Homo sapiens
agaggccccttgctgctg

SEQ ID NO: 4288994 - DNA, 20 bp, Homo sapiens
agaggccccttgctgctggc

SEQ ID NO: 4288995 - DNA, 22 bp, Homo sapiens
agaggccccttgctgctggctc

SEQ ID NO: 4288996 - DNA, 21 bp, Homo sapiens
agaggccgctgcagggtggca

SEQ ID NO: 4288997 - DNA, 17 bp, Homo sapiens
agaggcgtcttgtattt

SEQ ID NO: 4288998 - DNA, 19 bp, Homo sapiens
agaggcgtcttgtattttc

SEQ ID NO: 4288999 - DNA, 12 bp, Homo sapiens
agaggggagagg

SEQ ID NO: 4289000 - DNA, 15 bp, Homo sapiens
agaggggcggggcca

SEQ ID NO: 4289001 - DNA, 18 bp, Homo sapiens
agaggggcggggccagga

SEQ ID NO: 4289002 - DNA, 17 bp, Homo sapiens
agaggtgagggaggcct

SEQ ID NO: 4289003 - DNA, 16 bp, Homo sapiens
agagtaaaaccaaagg

SEQ ID NO: 4289004 - DNA, 18 bp, Homo sapiens
agagtaaaattacagaag

SEQ ID NO: 4289005 - DNA, 12 bp, Homo sapiens
agagtactttgg

SEQ ID NO: 4289006 - DNA, 19 bp, Homo sapiens
agagtactttggtttctga

SEQ ID NO: 4289007 - DNA, 15 bp, Homo sapiens
agagtagacatcccc

SEQ ID NO: 4289008 - DNA, 14 bp, Homo sapiens
agagtatatatgta

SEQ ID NO: 4289009 - DNA, 17 bp, Homo sapiens
agagtctattgtctcct

SEQ ID NO: 4289010 - DNA, 23 bp, Homo sapiens
agagtgaggtcatcccggggcca

SEQ ID NO: 4289011 - DNA, 16 bp, Homo sapiens
agagtgcacagctgtc

SEQ ID NO: 4289012 - DNA, 16 bp, Homo sapiens
agagtggatctggagt

SEQ ID NO: 4289013 - DNA, 22 bp, Homo sapiens
agagtggatctggagtctgaag

SEQ ID NO: 4289014 - DNA, 19 bp, Homo sapiens
agagtggctcctcccggtg

SEQ ID NO: 4289015 - DNA, 19 bp, Homo sapiens
agagtggggctagactggg

SEQ ID NO: 4289016 - DNA, 12 bp, Homo sapiens
agagttgaacct

SEQ ID NO: 4289017 - DNA, 21 bp, Homo sapiens
agataaacacagctgctttct

SEQ ID NO: 4289018 - DNA, 18 bp, Homo sapiens
agataaatccaactctga

SEQ ID NO: 4289019 - DNA, 22 bp, Homo sapiens
agataagcctgaaacagcctct

SEQ ID NO: 4289020 - DNA, 17 bp, Homo sapiens
agatatatctgaaaact

SEQ ID NO: 4289021 - DNA, 20 bp, Homo sapiens
agatatatctgaaaactgga

SEQ ID NO: 4289022 - DNA, 17 bp, Homo sapiens
agatattcatactttcc

SEQ ID NO: 4289023 - DNA, 21 bp, Homo sapiens
agatattttgtaaaatgtatt

SEQ ID NO: 4289024 - DNA, 18 bp, Homo sapiens
agatcctccttccaggcc

SEQ ID NO: 4289025 - DNA, 16 bp, Homo sapiens
agatctagccaggcct

SEQ ID NO: 4289026 - DNA, 13 bp, Homo sapiens
agatctcctgtaa

SEQ ID NO: 4289027 - DNA, 23 bp, Homo sapiens
agatctcctgtaattttgtagta

SEQ ID NO: 4289028 - DNA, 12 bp, Homo sapiens
agatcttgagca

SEQ ID NO: 4289029 - DNA, 16 bp, Homo sapiens
agatcttgagcaaggc

SEQ ID NO: 4289030 - DNA, 17 bp, Homo sapiens
agatgaaattccatttg

SEQ ID NO: 4289031 - DNA, 14 bp, Homo sapiens
agatgacacataaa

SEQ ID NO: 4289032 - DNA, 13 bp, Homo sapiens
agatgagaattag

SEQ ID NO: 4289033 - DNA, 23 bp, Homo sapiens
agatgaggaaataagacttttag

SEQ ID NO: 4289034 - DNA, 16 bp, Homo sapiens
agatggcgcacccggc

SEQ ID NO: 4289035 - DNA, 19 bp, Homo sapiens
agatggcgcacccggcagc

SEQ ID NO: 4289036 - DNA, 21 bp, Homo sapiens
agatggcgcacccggcagccc

SEQ ID NO: 4289037 - DNA, 22 bp, Homo sapiens
agatggcgcacccggcagcccc

SEQ ID NO: 4289038 - DNA, 23 bp, Homo sapiens
agatggcgcacccggcagccccc

SEQ ID NO: 4289039 - DNA, 18 bp, Homo sapiens
agatggctccctgggctg

SEQ ID NO: 4289040 - DNA, 22 bp, Homo sapiens
agatgggcatggggtgggcctc

SEQ ID NO: 4289041 - DNA, 18 bp, Homo sapiens
agatgggttgagtttgct

SEQ ID NO: 4289042 - DNA, 22 bp, Homo sapiens
agatggtgaagcattctcccca

SEQ ID NO: 4289043 - DNA, 23 bp, Homo sapiens
agatgtaagaagcccgatccaca

SEQ ID NO: 4289044 - DNA, 20 bp, Homo sapiens
agatgtaccatgttaaagag

SEQ ID NO: 4289045 - DNA, 18 bp, Homo sapiens
agatgtattatgcaaagt

SEQ ID NO: 4289046 - DNA, 22 bp, Homo sapiens
agatgtcaagctggccgtggag

SEQ ID NO: 4289047 - DNA, 14 bp, Homo sapiens
agatgtttgttttc

SEQ ID NO: 4289048 - DNA, 14 bp, Homo sapiens
agattaacaacact

SEQ ID NO: 4289049 - DNA, 13 bp, Homo sapiens
agattaatttgtg

SEQ ID NO: 4289050 - DNA, 19 bp, Homo sapiens
agattaatttgtgtagatt

SEQ ID NO: 4289051 - DNA, 17 bp, Homo sapiens
agattagcatgaaaggt

SEQ ID NO: 4289052 - DNA, 14 bp, Homo sapiens
agattatttacaag

SEQ ID NO: 4289053 - DNA, 17 bp, Homo sapiens
agattcactttgacact

SEQ ID NO: 4289054 - DNA, 21 bp, Homo sapiens
agattcaggcttgcattaaaa

SEQ ID NO: 4289055 - DNA, 19 bp, Homo sapiens
agattcatggctttaacag

SEQ ID NO: 4289056 - DNA, 18 bp, Homo sapiens
agattccagagagtggct

SEQ ID NO: 4289057 - DNA, 22 bp, Homo sapiens
agattccagagagtggctcctc

SEQ ID NO: 4289058 - DNA, 19 bp, Homo sapiens
agattctgtgggcagctgg

SEQ ID NO: 4289059 - DNA, 21 bp, Homo sapiens
agattctgtgggcagctggct

SEQ ID NO: 4289060 - DNA, 19 bp, Homo sapiens
agattggttcatgcctggg

SEQ ID NO: 4289061 - DNA, 21 bp, Homo sapiens
agattggttcatgcctggggt

SEQ ID NO: 4289062 - DNA, 15 bp, Homo sapiens
agattgtaaaggtag

SEQ ID NO: 4289063 - DNA, 18 bp, Homo sapiens
aggttggaactgctgcca

SEQ ID NO: 4289064 - DNA, 16 bp, Homo sapiens
aggttgtctgaagtca

SEQ ID NO: 4289065 - DNA, 20 bp, Homo sapiens
aggttgtctgaagtcactgc

SEQ ID NO: 4289066 - DNA, 13 bp, Homo sapiens
aggtttaaaacta

SEQ ID NO: 4289067 - DNA, 19 bp, Homo sapiens
aggtttaagtagatttcat

SEQ ID NO: 4289068 - DNA, 16 bp, Homo sapiens
aggtttcactgttcat

SEQ ID NO: 4289069 - DNA, 17 bp, Homo sapiens
aggtttcactgttcatg

SEQ ID NO: 4289070 - DNA, 19 bp, Homo sapiens
aggtttcactgttcatgaa

SEQ ID NO: 4289071 - DNA, 19 bp, Homo sapiens
aggtttctgagttcctgca

SEQ ID NO: 4289072 - DNA, 15 bp, Homo sapiens
agtaaaattacagaa

SEQ ID NO: 4289073 - DNA, 16 bp, Homo sapiens
agtaaaattacagaag

SEQ ID NO: 4289074 - DNA, 11 bp, Homo sapiens
agtaaacacca

SEQ ID NO: 4289075 - DNA, 11 bp, Homo sapiens
agtaaatgcta

SEQ ID NO: 4289076 - DNA, 14 bp, Homo sapiens
agtaacacataaag

SEQ ID NO: 4289077 - DNA, 14 bp, Homo sapiens
agtaactcatctgt

SEQ ID NO: 4289078 - DNA, 18 bp, Homo sapiens
agtaagatctctttctaa

SEQ ID NO: 4289079 - DNA, 18 bp, Homo sapiens
agtaagctgctctattgt

SEQ ID NO: 4289080 - DNA, 20 bp, Homo sapiens
agtaagctgctctattgtag

SEQ ID NO: 4289081 - DNA, 18 bp, Homo sapiens
agtaaggaatgatattgc

SEQ ID NO: 4289082 - DNA, 21 bp, Homo sapiens
agtaagttctgaaaactgttt

SEQ ID NO: 4289083 - DNA, 13 bp, Homo sapiens
agtaatctgtata

SEQ ID NO: 4289084 - DNA, 19 bp, Homo sapiens
agtaatctgtataatactt

SEQ ID NO: 4289085 - DNA, 23 bp, Homo sapiens
agtaatgtcataaagtgagaaaa

SEQ ID NO: 4289086 - DNA, 18 bp, Homo sapiens
agtacaaccactatcttt

SEQ ID NO: 4289087 - DNA, 19 bp, Homo sapiens
agtactagagatattttgt

SEQ ID NO: 4289088 - DNA, 19 bp, Homo sapiens
agtactggtaagattgtta

SEQ ID NO: 4289089 - DNA, 20 bp, Homo sapiens
agtactggtaagattgttat

SEQ ID NO: 4289090 - DNA, 17 bp, Homo sapiens
agtacttcttctgtaat

SEQ ID NO: 4289091 - DNA, 21 bp, Homo sapiens
agtacttgtgaaacacagctg

SEQ ID NO: 4289092 - DNA, 23 bp, Homo sapiens
agtacttgtgaaacacagctgtt

SEQ ID NO: 4289093 - DNA, 21 bp, Homo sapiens
agtagaaggtcggaggcttgg

SEQ ID NO: 4289094 - DNA, 16 bp, Homo sapiens
agtaggtgggtcttgg

SEQ ID NO: 4289095 - DNA, 20 bp, Homo sapiens
agtaggtgggtcttggattg

SEQ ID NO: 4289096 - DNA, 17 bp, Homo sapiens
agtagtacttcttctgt

SEQ ID NO: 4289097 - DNA, 19 bp, Homo sapiens
agtagtgcctgtgatcgtg

SEQ ID NO: 4289098 - DNA, 21 bp, Homo sapiens
agtagttgatgaccaatctct

SEQ ID NO: 4289099 - DNA, 22 bp, Homo sapiens
agtagttgatgaccaatctctg

SEQ ID NO: 4289100 - DNA, 23 bp, Homo sapiens
agtagttgatgaccaatctctgt

SEQ ID NO: 4289101 - DNA, 12 bp, Homo sapiens
agtatatatgta

SEQ ID NO: 4289102 - DNA, 14 bp, Homo sapiens
agtatatatgtaca

SEQ ID NO: 4289103 - DNA, 16 bp, Homo sapiens
agtatatatgtacagt

SEQ ID NO: 4289104 - DNA, 22 bp, Homo sapiens
agtatctcatcaacaaagaaat

SEQ ID NO: 4289105 - DNA, 17 bp, Homo sapiens
agtatctctactttcct

SEQ ID NO: 4289106 - DNA, 13 bp, Homo sapiens
agtatctgtacct

SEQ ID NO: 4289107 - DNA, 17 bp, Homo sapiens
agtatctgtacctgccc

SEQ ID NO: 4289108 - DNA, 16 bp, Homo sapiens
agtatgttaagctctt

SEQ ID NO: 4289109 - DNA, 17 bp, Homo sapiens
agtattactaaattgac

SEQ ID NO: 4289110 - DNA, 20 bp, Homo sapiens
agtattccagacctgaagaa

SEQ ID NO: 4289111 - DNA, 14 bp, Homo sapiens
agtattccttggcc

SEQ ID NO: 4289112 - DNA, 21 bp, Homo sapiens
agtcaactgctgttttatgtc

SEQ ID NO: 4289113 - DNA, 16 bp, Homo sapiens
agtcaatcaaacaggg

SEQ ID NO: 4289114 - DNA, 21 bp, Homo sapiens
agtcacagccgtttgaatata

SEQ ID NO: 4289115 - DNA, 12 bp, Homo sapiens
agtcagatgttt

SEQ ID NO: 4289116 - DNA, 12 bp, Homo sapiens
agtcagcacaga

SEQ ID NO: 4289117 - DNA, 14 bp, Homo sapiens
agtcagcacagaga

SEQ ID NO: 4289118 - DNA, 13 bp, Homo sapiens
agtcaggagccag

SEQ ID NO: 4289119 - DNA, 18 bp, Homo sapiens
agtcagggcggggctggc

SEQ ID NO: 4289120 - DNA, 18 bp, Homo sapiens
agtcatgacatttctcaa

SEQ ID NO: 4289121 - DNA, 17 bp, Homo sapiens
agtcatggctgtcccct

SEQ ID NO: 4289122 - DNA, 22 bp, Homo sapiens
agtcatgtgtcagctgtagaaa

SEQ ID NO: 4289123 - DNA, 17 bp, Homo sapiens
agtcattaaattactat

SEQ ID NO: 4289124 - DNA, 13 bp, Homo sapiens
agtccagctctcc

SEQ ID NO: 4289125 - DNA, 15 bp, Homo sapiens
agtccagctctcccc

SEQ ID NO: 4289126 - DNA, 18 bp, Homo sapiens
agtccaggccccaaaacc

SEQ ID NO: 4289127 - DNA, 20 bp, Homo sapiens
agtccagtgaccctggagct

SEQ ID NO: 4289128 - DNA, 19 bp, Homo sapiens
agtcccagggagctctgca

SEQ ID NO: 4289129 - DNA, 18 bp, Homo sapiens
agtcccgaggcagcaaca

SEQ ID NO: 4289130 - DNA, 18 bp, Homo sapiens
agtccctccctcctggct

SEQ ID NO: 4289131 - DNA, 20 bp, Homo sapiens
agtccctccctcctggctca

SEQ ID NO: 4289132 - DNA, 12 bp, Homo sapiens
agtccctctgag

SEQ ID NO: 4289133 - DNA, 19 bp, Homo sapiens
agtcctagaatgtttcatt

SEQ ID NO: 4289134 - DNA, 16 bp, Homo sapiens
agtcctattctattgc

SEQ ID NO: 4289135 - DNA, 18 bp, Homo sapiens
agtcctgttctcagagct

SEQ ID NO: 4289136 - DNA, 21 bp, Homo sapiens
agtctaagaacccatggaaaa

SEQ ID NO: 4289137 - DNA, 15 bp, Homo sapiens
agtctcattcctctg

SEQ ID NO: 4289138 - DNA, 19 bp, Homo sapiens
agtctctgatttgcaaatg

SEQ ID NO: 4289139 - DNA, 16 bp, Homo sapiens
agtctcttctccactg

SEQ ID NO: 4289140 - DNA, 17 bp, Homo sapiens
agtctcttctccactgg

SEQ ID NO: 4289141 - DNA, 17 bp, Homo sapiens
agtctgctgccctccat

SEQ ID NO: 4289142 - DNA, 20 bp, Homo sapiens
agtctgctgccctccatccc

SEQ ID NO: 4289143 - DNA, 14 bp, Homo sapiens
agtctggagaccag

SEQ ID NO: 4289144 - DNA, 15 bp, Homo sapiens
agtctggagaccagg

SEQ ID NO: 4289145 - DNA, 17 bp, Homo sapiens
agtctggaggtcccaga

SEQ ID NO: 4289146 - DNA, 15 bp, Homo sapiens
agtctgtctgcactg

SEQ ID NO: 4289147 - DNA, 14 bp, Homo sapiens
agtcttccatcagc

SEQ ID NO: 4289148 - DNA, 14 bp, Homo sapiens
agtcttgagtgggc

SEQ ID NO: 4289149 - DNA, 17 bp, Homo sapiens
agtcttgagtgggcccc

SEQ ID NO: 4289150 - DNA, 23 bp, Homo sapiens
agtcttgagtgggccccctctct

SEQ ID NO: 4289151 - DNA, 16 bp, Homo sapiens
agtcttggaatacttg

SEQ ID NO: 4289152 - DNA, 19 bp, Homo sapiens
agtctttgggggattcaaa

SEQ ID NO: 4289153 - DNA, 15 bp, Homo sapiens
agtgaacagcttcac

SEQ ID NO: 4289154 - DNA, 16 bp, Homo sapiens
agtgaatacatggtag

SEQ ID NO: 4289155 - DNA, 14 bp, Homo sapiens
agtgacaaggcccc

SEQ ID NO: 4289156 - DNA, 20 bp, Homo sapiens
agtgacaaggccccagagac

SEQ ID NO: 4289157 - DNA, 23 bp, Homo sapiens
agtgacaaggccccagagactca

SEQ ID NO: 4289158 - DNA, 15 bp, Homo sapiens
agtgaccccagctcc

SEQ ID NO: 4289159 - DNA, 16 bp, Homo sapiens
agtgaccctggagcta

SEQ ID NO: 4289160 - DNA, 16 bp, Homo sapiens
agtgactaaaccattg

SEQ ID NO: 4289161 - DNA, 23 bp, Homo sapiens
agtgactaccacttatttctaaa

SEQ ID NO: 4289162 - DNA, 13 bp, Homo sapiens
agtgactccagga

SEQ ID NO: 4289163 - DNA, 17 bp, Homo sapiens
agtgactccaggagagg

SEQ ID NO: 4289164 - DNA, 15 bp, Homo sapiens
agtgactgctgcgct

SEQ ID NO: 4289165 - DNA, 17 bp, Homo sapiens
agtgactgctgcgctgt

SEQ ID NO: 4289166 - DNA, 21 bp, Homo sapiens
agtgagaaatttttttccaga

SEQ ID NO: 4289167 - DNA, 16 bp, Homo sapiens
agtgagatttgtattt

SEQ ID NO: 4289168 - DNA, 17 bp, Homo sapiens
agtgagatttgtattta

SEQ ID NO: 4289169 - DNA, 17 bp, Homo sapiens
agtgagcagtgttagct

SEQ ID NO: 4289170 - DNA, 17 bp, Homo sapiens
agtgaggtcatcccggg

SEQ ID NO: 4289171 - DNA, 18 bp, Homo sapiens
agtgagtgtggctcccct

SEQ ID NO: 4289172 - DNA, 15 bp, Homo sapiens
agtgatacactgtat

SEQ ID NO: 4289173 - DNA, 15 bp, Homo sapiens
agtgatatggcttgt

SEQ ID NO: 4289174 - DNA, 12 bp, Homo sapiens
agtgatgggagt

SEQ ID NO: 4289175 - DNA, 14 bp, Homo sapiens
agtgatgttgaaat

SEQ ID NO: 4289176 - DNA, 13 bp, Homo sapiens
agtgatttgctat

SEQ ID NO: 4289177 - DNA, 15 bp, Homo sapiens
agtgcacagctgtcc

SEQ ID NO: 4289178 - DNA, 13 bp, Homo sapiens
agtgcaggctggc

SEQ ID NO: 4289179 - DNA, 11 bp, Homo sapiens
agtgcccctgc

SEQ ID NO: 4289180 - DNA, 21 bp, Homo sapiens
agtgcccctgctgcctcccca

SEQ ID NO: 4289181 - DNA, 23 bp, Homo sapiens
agtgcccttaaaataatgattta

SEQ ID NO: 4289182 - DNA, 14 bp, Homo sapiens
agtgcctctggtct

SEQ ID NO: 4289183 - DNA, 16 bp, Homo sapiens
agtgctcagttccaat

SEQ ID NO: 4289184 - DNA, 20 bp, Homo sapiens
agtgctttgctggagtcctg

SEQ ID NO: 4289185 - DNA, 12 bp, Homo sapiens
agtggaaaaaag

SEQ ID NO: 4289186 - DNA, 14 bp, Homo sapiens
agtggacccagctg

SEQ ID NO: 4289187 - DNA, 19 bp, Homo sapiens
agtggactttccaccccct

SEQ ID NO: 4289188 - DNA, 14 bp, Homo sapiens
agtggagaggggac

SEQ ID NO: 4289189 - DNA, 12 bp, Homo sapiens
agtggagggaga

SEQ ID NO: 4289190 - DNA, 16 bp, Homo sapiens
agtggagggagactga

SEQ ID NO: 4289191 - DNA, 18 bp, Homo sapiens
agtggaggggtcagcagg

SEQ ID NO: 4289192 - DNA, 18 bp, Homo sapiens
agtggcatggctccagtc

SEQ ID NO: 4289193 - DNA, 21 bp, Homo sapiens
agtggccaagagatgcagtgc

SEQ ID NO: 4289194 - DNA, 13 bp, Homo sapiens
agtggcccaggga

SEQ ID NO: 4289195 - DNA, 15 bp, Homo sapiens
agtggcctcaaccct

SEQ ID NO: 4289196 - DNA, 20 bp, Homo sapiens
agtggcctcaaccctccctc

SEQ ID NO: 4289197 - DNA, 21 bp, Homo sapiens
agtggcctcaaccctccctca

SEQ ID NO: 4289198 - DNA, 19 bp, Homo sapiens
agggagggaaacccgggga

SEQ ID NO: 4289199 - DNA, 22 bp, Homo sapiens
agggagggaacagacctcggct

SEQ ID NO: 4289200 - DNA, 23 bp, Homo sapiens
agggatgctatctcgctagccat

SEQ ID NO: 4289201 - DNA, 12 bp, Homo sapiens
agggatgtattt

SEQ ID NO: 4289202 - DNA, 14 bp, Homo sapiens
agggatgtatttgt

SEQ ID NO: 4289203 - DNA, 16 bp, Homo sapiens
agggcactggtggccc

SEQ ID NO: 4289204 - DNA, 14 bp, Homo sapiens
agggcagcccctcc

SEQ ID NO: 4289205 - DNA, 15 bp, Homo sapiens
agggcagcccctccc

SEQ ID NO: 4289206 - DNA, 16 bp, Homo sapiens
agggcagcctgtggga

SEQ ID NO: 4289207 - DNA, 17 bp, Homo sapiens
agggcagcctgtgggag

SEQ ID NO: 4289208 - DNA, 21 bp, Homo sapiens
agggcagcctgtgggagaagg

SEQ ID NO: 4289209 - DNA, 16 bp, Homo sapiens
agggcaggcagagctc

SEQ ID NO: 4289210 - DNA, 22 bp, Homo sapiens
agggcaggggctgcatcctcag

SEQ ID NO: 4289211 - DNA, 16 bp, Homo sapiens
agggcaggtgcttcag

SEQ ID NO: 4289212 - DNA, 15 bp, Homo sapiens
agggcatttttcttg

SEQ ID NO: 4289213 - DNA, 12 bp, Homo sapiens
agggccagggtt

SEQ ID NO: 4289214 - DNA, 19 bp, Homo sapiens
agggccagtcatggctgtc

SEQ ID NO: 4289215 - DNA, 15 bp, Homo sapiens
agggccatgaacttt

SEQ ID NO: 4289216 - DNA, 23 bp, Homo sapiens
agggcccagaggggcggggccag

SEQ ID NO: 4289217 - DNA, 13 bp, Homo sapiens
agggcccccactg

SEQ ID NO: 4289218 - DNA, 17 bp, Homo sapiens
agggcccctcactggct

SEQ ID NO: 4289219 - DNA, 21 bp, Homo sapiens
agggcccctgaagtgacccca

SEQ ID NO: 4289220 - DNA, 16 bp, Homo sapiens
agggccctgctcaggc

SEQ ID NO: 4289221 - DNA, 17 bp, Homo sapiens
agggccctgctcaggcc

SEQ ID NO: 4289222 - DNA, 19 bp, Homo sapiens
agggccctgctcaggcctc

SEQ ID NO: 4289223 - DNA, 14 bp, Homo sapiens
agggcccttcccaa

SEQ ID NO: 4289224 - DNA, 18 bp, Homo sapiens
agggcccttcccaacctc

SEQ ID NO: 4289225 - DNA, 20 bp, Homo sapiens
agggcccttcccaacctccc

SEQ ID NO: 4289226 - DNA, 18 bp, Homo sapiens
agggcgctgagggcaggg

SEQ ID NO: 4289227 - DNA, 13 bp, Homo sapiens
agggcggggctgg

SEQ ID NO: 4289228 - DNA, 17 bp, Homo sapiens
agggcggggctggccag

SEQ ID NO: 4289229 - DNA, 16 bp, Homo sapiens
agggctaaccagttct

SEQ ID NO: 4289230 - DNA, 13 bp, Homo sapiens
agggctcatgatt

SEQ ID NO: 4289231 - DNA, 12 bp, Homo sapiens
agggctgtcctt

SEQ ID NO: 4289232 - DNA, 14 bp, Homo sapiens
aggggaaaatagta

SEQ ID NO: 4289233 - DNA, 23 bp, Homo sapiens
aggggaagtgtgctgaggtgggc

SEQ ID NO: 4289234 - DNA, 20 bp, Homo sapiens
aggggactgcatgcaagctc

SEQ ID NO: 4289235 - DNA, 24 bp, Homo sapiens
aggggatctaaaaggaggacaggg

SEQ ID NO: 4289236 - DNA, 17 bp, Homo sapiens
aggggcactgtgttctc

SEQ ID NO: 4289237 - DNA, 14 bp, Homo sapiens
aggggcaggccttt

SEQ ID NO: 4289238 - DNA, 12 bp, Homo sapiens
aggggccctagg

SEQ ID NO: 4289239 - DNA, 19 bp, Homo sapiens
aggggccgcttcgccatgt

SEQ ID NO: 4289240 - DNA, 13 bp, Homo sapiens
aggggcctgccac

SEQ ID NO: 4289241 - DNA, 16 bp, Homo sapiens
aggggcctgccactct

SEQ ID NO: 4289242 - DNA, 13 bp, Homo sapiens
aggggcctggcag

SEQ ID NO: 4289243 - DNA, 15 bp, Homo sapiens
aggggcggggccagg

SEQ ID NO: 4289244 - DNA, 19 bp, Homo sapiens
aggggctgcatcctcagcc

SEQ ID NO: 4289245 - DNA, 23 bp, Homo sapiens
aggggctgggcagaggggagagg

SEQ ID NO: 4289246 - DNA, 16 bp, Homo sapiens
aggggcttccctctgc

SEQ ID NO: 4289247 - DNA, 19 bp, Homo sapiens
aggggcttccctctgctcc

SEQ ID NO: 4289248 - DNA, 18 bp, Homo sapiens
agggggaagcaccagcct

SEQ ID NO: 4289249 - DNA, 19 bp, Homo sapiens
agggggaagcaccagcctc

SEQ ID NO: 4289250 - DNA, 22 bp, Homo sapiens
agggggaagcaccagcctcagt

SEQ ID NO: 4289251 - DNA, 21 bp, Homo sapiens
agggggcccggctgggcccga

SEQ ID NO: 4289252 - DNA, 22 bp, Homo sapiens
agggggcccggctgggcccgag

SEQ ID NO: 4289253 - DNA, 14 bp, Homo sapiens
aggggtcagggacc

SEQ ID NO: 4289254 - DNA, 24 bp, Homo sapiens
aggggtcagggaccaaggacccct

SEQ ID NO: 4289255 - DNA, 15 bp, Homo sapiens
aggggtctgctcctg

SEQ ID NO: 4289256 - DNA, 17 bp, Homo sapiens
aggggtctgctcctgtg

SEQ ID NO: 4289257 - DNA, 23 bp, Homo sapiens
aggggtgggggagaatggctctg

SEQ ID NO: 4289258 - DNA, 21 bp, Homo sapiens
aggggttttcgaagctcagcc

SEQ ID NO: 4289259 - DNA, 22 bp, Homo sapiens
agggtatctgctgcctctgaaa

SEQ ID NO: 4289260 - DNA, 21 bp, Homo sapiens
agggtccactttggtaatgtg

SEQ ID NO: 4289261 - DNA, 22 bp, Homo sapiens
agggtccctaggtgggtcaact

SEQ ID NO: 4289262 - DNA, 17 bp, Homo sapiens
agggtcctcaggcagtg

SEQ ID NO: 4289263 - DNA, 23 bp, Homo sapiens
agggtcctgggggctgctgcact

SEQ ID NO: 4289264 - DNA, 13 bp, Homo sapiens
agggtgaggcgtg

SEQ ID NO: 4289265 - DNA, 23 bp, Homo sapiens
agggtgaggcgtgggatccagag

SEQ ID NO: 4289266 - DNA, 13 bp, Homo sapiens
agggtgcagggac

SEQ ID NO: 4289267 - DNA, 19 bp, Homo sapiens
agggtgctccctcctcagt

SEQ ID NO: 4289268 - DNA, 21 bp, Homo sapiens
agggtgctgcttccctctgcc

SEQ ID NO: 4289269 - DNA, 22 bp, Homo sapiens
agggtgggcgtgacttcagact

SEQ ID NO: 4289270 - DNA, 23 bp, Homo sapiens
agggtggtcttcaagcctggccc

SEQ ID NO: 4289271 - DNA, 13 bp, Homo sapiens
agggtgtggcttg

SEQ ID NO: 4289272 - DNA, 15 bp, Homo sapiens
agggtgtggcttgga

SEQ ID NO: 4289273 - DNA, 20 bp, Homo sapiens
agggtgtggcttggaacatt

SEQ ID NO: 4289274 - DNA, 16 bp, Homo sapiens
agggttaaagaaaggc

SEQ ID NO: 4289275 - DNA, 19 bp, Homo sapiens
agggttaaagaaaggcaga

SEQ ID NO: 4289276 - DNA, 19 bp, Homo sapiens
agggttagacaagcctgga

SEQ ID NO: 4289277 - DNA, 22 bp, Homo sapiens
agggttagacaagcctggagga

SEQ ID NO: 4289278 - DNA, 19 bp, Homo sapiens
agggttcccccagccctgt

SEQ ID NO: 4289279 - DNA, 13 bp, Homo sapiens
agggttctagaag

SEQ ID NO: 4289280 - DNA, 19 bp, Homo sapiens
agggttgtgattttgtctg

SEQ ID NO: 4289281 - DNA, 24 bp, Homo sapiens
aggtaacatagatgcctgggcctg

SEQ ID NO: 4289282 - DNA, 19 bp, Homo sapiens
aggtagtagaatctcagca

SEQ ID NO: 4289283 - DNA, 20 bp, Homo sapiens
aggtccaccccgttgttgtc

SEQ ID NO: 4289284 - DNA, 16 bp, Homo sapiens
aggtcccagacatgct

SEQ ID NO: 4289285 - DNA, 21 bp, Homo sapiens
aggtcccgagccccctgtcct

SEQ ID NO: 4289286 - DNA, 23 bp, Homo sapiens
aggtcccgagccccctgtccttc

SEQ ID NO: 4289287 - DNA, 13 bp, Homo sapiens
aggtcctgtcctg

SEQ ID NO: 4289288 - DNA, 21 bp, Homo sapiens
aggtcctgtcctggctcccag

SEQ ID NO: 4289289 - DNA, 23 bp, Homo sapiens
aggtcctgtcctggctcccaggg

SEQ ID NO: 4289290 - DNA, 13 bp, Homo sapiens
aggtctccacccc

SEQ ID NO: 4289291 - DNA, 15 bp, Homo sapiens
aggtctccacccctc

SEQ ID NO: 4289292 - DNA, 16 bp, Homo sapiens
aggtctccacccctca

SEQ ID NO: 4289293 - DNA, 14 bp, Homo sapiens
aggtctcctgggca

SEQ ID NO: 4289294 - DNA, 19 bp, Homo sapiens
aggtctcctgggcatctgg

SEQ ID NO: 4289295 - DNA, 14 bp, Homo sapiens
aggtgaaatggagg

SEQ ID NO: 4289296 - DNA, 22 bp, Homo sapiens
aggtgaacattcatgtgtagga

SEQ ID NO: 4289297 - DNA, 16 bp, Homo sapiens
aggtgaccttctggga

SEQ ID NO: 4289298 - DNA, 15 bp, Homo sapiens
aggtgagggaggcct

SEQ ID NO: 4289299 - DNA, 16 bp, Homo sapiens
aggtgcccagtcttga

SEQ ID NO: 4289300 - DNA, 18 bp, Homo sapiens
aggtgcccagtcttgagt

SEQ ID NO: 4289301 - DNA, 22 bp, Homo sapiens
aggtgcccagtcttgagtgggc

SEQ ID NO: 4289302 - DNA, 16 bp, Homo sapiens
aggtgcctgagagcag

SEQ ID NO: 4289303 - DNA, 19 bp, Homo sapiens
aggtgctggcatgtctggg

SEQ ID NO: 4289304 - DNA, 20 bp, Homo sapiens
aggtgctggcatgtctgggt

SEQ ID NO: 4289305 - DNA, 15 bp, Homo sapiens
aggtggaacaggagg

SEQ ID NO: 4289306 - DNA, 17 bp, Homo sapiens
aggtggccactccagac

SEQ ID NO: 4289307 - DNA, 15 bp, Homo sapiens
aggtggccagggctc

SEQ ID NO: 4289308 - DNA, 17 bp, Homo sapiens
aggtggccagggctcca

SEQ ID NO: 4289309 - DNA, 19 bp, Homo sapiens
aggtggccagggctccacg

SEQ ID NO: 4289310 - DNA, 17 bp, Homo sapiens
aggtgggccagcccctc

SEQ ID NO: 4289311 - DNA, 19 bp, Homo sapiens
aggtgggccagcccctccc

SEQ ID NO: 4289312 - DNA, 16 bp, Homo sapiens
aggtgggccttccatg

SEQ ID NO: 4289313 - DNA, 11 bp, Homo sapiens
aggtggggagg

SEQ ID NO: 4289314 - DNA, 17 bp, Homo sapiens
aggtggggcgggaaagc

SEQ ID NO: 4289315 - DNA, 18 bp, Homo sapiens
aggtgggggtcggcgcct

SEQ ID NO: 4289316 - DNA, 21 bp, Homo sapiens
aggtgggtcaactccaaggca

SEQ ID NO: 4289317 - DNA, 14 bp, Homo sapiens
aggtgggtcttgga

SEQ ID NO: 4289318 - DNA, 12 bp, Homo sapiens
aggtggtctgca

SEQ ID NO: 4289319 - DNA, 21 bp, Homo sapiens
aggtggtctgcaccccacagg

SEQ ID NO: 4289320 - DNA, 13 bp, Homo sapiens
aggtggtcttgga

SEQ ID NO: 4289321 - DNA, 20 bp, Homo sapiens
aggtggtcttggagaggagg

SEQ ID NO: 4289322 - DNA, 21 bp, Homo sapiens
aggtggtcttggagaggaggt

SEQ ID NO: 4289323 - DNA, 15 bp, Homo sapiens
aggtgtcctgactgt

SEQ ID NO: 4289324 - DNA, 16 bp, Homo sapiens
aggtgtgggctcccac

SEQ ID NO: 4289325 - DNA, 14 bp, Homo sapiens
aggtgtttctctgt

SEQ ID NO: 4289326 - DNA, 14 bp, Homo sapiens
aggttaagccatat

SEQ ID NO: 4289327 - DNA, 18 bp, Homo sapiens
aggttattatgattagct

SEQ ID NO: 4289328 - DNA, 14 bp, Homo sapiens
aggttctctcctgt

SEQ ID NO: 4289329 - DNA, 14 bp, Homo sapiens
aggttgattctcat

SEQ ID NO: 4289330 - DNA, 16 bp, Homo sapiens
aggttggaactgctgc

SEQ ID NO: 4289331 - DNA, 18 bp, Homo sapiens
aggaggtgtggagtggag

SEQ ID NO: 4289332 - DNA, 21 bp, Homo sapiens
aggaggtgtggagtggagggg

SEQ ID NO: 4289333 - DNA, 23 bp, Homo sapiens
aggaggtgtggagtggaggggtc

SEQ ID NO: 4289334 - DNA, 14 bp, Homo sapiens
aggagtgggctctg

SEQ ID NO: 4289335 - DNA, 18 bp, Homo sapiens
aggagttctaacacattt

SEQ ID NO: 4289336 - DNA, 19 bp, Homo sapiens
aggatccagatagcctagg

SEQ ID NO: 4289337 - DNA, 21 bp, Homo sapiens
aggatccgggctttggactcc

SEQ ID NO: 4289338 - DNA, 20 bp, Homo sapiens
aggatgaactagccatgact

SEQ ID NO: 4289339 - DNA, 18 bp, Homo sapiens
aggatgcatgcagggccc

SEQ ID NO: 4289340 - DNA, 19 bp, Homo sapiens
aggattaggtttagaatca

SEQ ID NO: 4289341 - DNA, 10 bp, Homo sapiens
aggattttaa

SEQ ID NO: 4289342 - DNA, 18 bp, Homo sapiens
aggattttaaatgctgta

SEQ ID NO: 4289343 - DNA, 12 bp, Homo sapiens
aggcaaatgtcc

SEQ ID NO: 4289344 - DNA, 17 bp, Homo sapiens
aggcaagaagtgggatt

SEQ ID NO: 4289345 - DNA, 16 bp, Homo sapiens
aggcacttaagcacaa

SEQ ID NO: 4289346 - DNA, 16 bp, Homo sapiens
aggcagacgatgtcaa

SEQ ID NO: 4289347 - DNA, 23 bp, Homo sapiens
aggcagagattgggggggcttgg

SEQ ID NO: 4289348 - DNA, 16 bp, Homo sapiens
aggcagcctgcagacc

SEQ ID NO: 4289349 - DNA, 19 bp, Homo sapiens
aggcagcctgtgggtcctt

SEQ ID NO: 4289350 - DNA, 13 bp, Homo sapiens
aggcagctgcagt

SEQ ID NO: 4289351 - DNA, 11 bp, Homo sapiens
aggcaggaagt

SEQ ID NO: 4289352 - DNA, 20 bp, Homo sapiens
aggcaggaagtcaggagcca

SEQ ID NO: 4289353 - DNA, 11 bp, Homo sapiens
aggcagggagg

SEQ ID NO: 4289354 - DNA, 12 bp, Homo sapiens
aggcagggaggg

SEQ ID NO: 4289355 - DNA, 23 bp, Homo sapiens
aggcagggagggaaacccgggga

SEQ ID NO: 4289356 - DNA, 14 bp, Homo sapiens
aggcagtggcttgg

SEQ ID NO: 4289357 - DNA, 11 bp, Homo sapiens
aggcatgagct

SEQ ID NO: 4289358 - DNA, 13 bp, Homo sapiens
aggcatgcctgtg

SEQ ID NO: 4289359 - DNA, 14 bp, Homo sapiens
aggcatgcctgtgt

SEQ ID NO: 4289360 - DNA, 14 bp, Homo sapiens
aggcattaaatttt

SEQ ID NO: 4289361 - DNA, 15 bp, Homo sapiens
aggccaagtgcaggc

SEQ ID NO: 4289362 - DNA, 21 bp, Homo sapiens
aggccaagtgcaggctggcac

SEQ ID NO: 4289363 - DNA, 18 bp, Homo sapiens
aggccacatgagtcccag

SEQ ID NO: 4289364 - DNA, 13 bp, Homo sapiens
aggccacctgccc

SEQ ID NO: 4289365 - DNA, 17 bp, Homo sapiens
aggccacctgccccctt

SEQ ID NO: 4289366 - DNA, 19 bp, Homo sapiens
aggccacctgcccccttct

SEQ ID NO: 4289367 - DNA, 14 bp, Homo sapiens
aggccacgggggag

SEQ ID NO: 4289368 - DNA, 11 bp, Homo sapiens
aggccagagga

SEQ ID NO: 4289369 - DNA, 16 bp, Homo sapiens
aggccagaggaaggga

SEQ ID NO: 4289370 - DNA, 16 bp, Homo sapiens
aggccagccctggttc

SEQ ID NO: 4289371 - DNA, 17 bp, Homo sapiens
aggccagccctggttct

SEQ ID NO: 4289372 - DNA, 11 bp, Homo sapiens
aggccagctcc

SEQ ID NO: 4289373 - DNA, 21 bp, Homo sapiens
aggccatgattcgcccaaagc

SEQ ID NO: 4289374 - DNA, 18 bp, Homo sapiens
aggcccaaaccaggggga

SEQ ID NO: 4289375 - DNA, 18 bp, Homo sapiens
aggccccaaaaccacagc

SEQ ID NO: 4289376 - DNA, 14 bp, Homo sapiens
aggccccagagact

SEQ ID NO: 4289377 - DNA, 14 bp, Homo sapiens
aggccccaggctgg

SEQ ID NO: 4289378 - DNA, 21 bp, Homo sapiens
aggcccccgcacgcaagcctc

SEQ ID NO: 4289379 - DNA, 23 bp, Homo sapiens
aggcccccgcacgcaagcctcag

SEQ ID NO: 4289380 - DNA, 16 bp, Homo sapiens
aggccccttgctgctg

SEQ ID NO: 4289381 - DNA, 21 bp, Homo sapiens
aggccccttgctgctggctcc

SEQ ID NO: 4289382 - DNA, 22 bp, Homo sapiens
aggccccttgctgctggctccc

SEQ ID NO: 4289383 - DNA, 13 bp, Homo sapiens
aggccctggtctg

SEQ ID NO: 4289384 - DNA, 15 bp, Homo sapiens
aggccctggtctggc

SEQ ID NO: 4289385 - DNA, 13 bp, Homo sapiens
aggcccttcctct

SEQ ID NO: 4289386 - DNA, 13 bp, Homo sapiens
aggccgctgcagg

SEQ ID NO: 4289387 - DNA, 15 bp, Homo sapiens
aggcctcaggcctcc

SEQ ID NO: 4289388 - DNA, 16 bp, Homo sapiens
aggcctcaggcctccc

SEQ ID NO: 4289389 - DNA, 18 bp, Homo sapiens
aggcctcagggaccaagg

SEQ ID NO: 4289390 - DNA, 21 bp, Homo sapiens
aggcctcagggaccaaggaga

SEQ ID NO: 4289391 - DNA, 22 bp, Homo sapiens
aggcctcagggaccaaggagat

SEQ ID NO: 4289392 - DNA, 13 bp, Homo sapiens
aggcctcagtgga

SEQ ID NO: 4289393 - DNA, 16 bp, Homo sapiens
aggcctcagtggactt

SEQ ID NO: 4289394 - DNA, 23 bp, Homo sapiens
aggcctcagtggactttccaccc

SEQ ID NO: 4289395 - DNA, 14 bp, Homo sapiens
aggcctcatcctcc

SEQ ID NO: 4289396 - DNA, 22 bp, Homo sapiens
aggcctcccgcatgctgcctgc

SEQ ID NO: 4289397 - DNA, 23 bp, Homo sapiens
aggcctcccgcatgctgcctgcc

SEQ ID NO: 4289398 - DNA, 19 bp, Homo sapiens
aggcctgaaatgtttccag

SEQ ID NO: 4289399 - DNA, 22 bp, Homo sapiens
aggcctgaaatgtttccaggca

SEQ ID NO: 4289400 - DNA, 12 bp, Homo sapiens
aggcctgagggg

SEQ ID NO: 4289401 - DNA, 14 bp, Homo sapiens
aggcctgaggggca

SEQ ID NO: 4289402 - DNA, 19 bp, Homo sapiens
aggcctgccccccttccca

SEQ ID NO: 4289403 - DNA, 23 bp, Homo sapiens
aggcctgccccccttcccacccc

SEQ ID NO: 4289404 - DNA, 15 bp, Homo sapiens
aggcctggcccagcc

SEQ ID NO: 4289405 - DNA, 17 bp, Homo sapiens
aggcctggcccagccag

SEQ ID NO: 4289406 - DNA, 13 bp, Homo sapiens
aggcctggccctt

SEQ ID NO: 4289407 - DNA, 17 bp, Homo sapiens
aggcctggccctttcac

SEQ ID NO: 4289408 - DNA, 16 bp, Homo sapiens
aggcctggtctggagc

SEQ ID NO: 4289409 - DNA, 16 bp, Homo sapiens
aggcctggtgccctgg

SEQ ID NO: 4289410 - DNA, 17 bp, Homo sapiens
aggcctggtgccctggc

SEQ ID NO: 4289411 - DNA, 21 bp, Homo sapiens
aggcgagccagattaggcctg

SEQ ID NO: 4289412 - DNA, 14 bp, Homo sapiens
aggcgccttcctgg

SEQ ID NO: 4289413 - DNA, 17 bp, Homo sapiens
aggcgccttcctgggtt

SEQ ID NO: 4289414 - DNA, 16 bp, Homo sapiens
aggcggtatccagagg

SEQ ID NO: 4289415 - DNA, 15 bp, Homo sapiens
aggcgtagggccagg

SEQ ID NO: 4289416 - DNA, 17 bp, Homo sapiens
aggcgtagggccagggc

SEQ ID NO: 4289417 - DNA, 19 bp, Homo sapiens
aggcgtagggccagggctc

SEQ ID NO: 4289418 - DNA, 15 bp, Homo sapiens
aggcgtcttgtattt

SEQ ID NO: 4289419 - DNA, 17 bp, Homo sapiens
aggcgtcttgtattttc

SEQ ID NO: 4289420 - DNA, 17 bp, Homo sapiens
aggcgtgggatccagag

SEQ ID NO: 4289421 - DNA, 18 bp, Homo sapiens
aggcgtgggatccagaga

SEQ ID NO: 4289422 - DNA, 14 bp, Homo sapiens
aggctaagcctgga

SEQ ID NO: 4289423 - DNA, 17 bp, Homo sapiens
aggctaagcctggacac

SEQ ID NO: 4289424 - DNA, 16 bp, Homo sapiens
aggctcacaactgttt

SEQ ID NO: 4289425 - DNA, 20 bp, Homo sapiens
aggctcccactgcccctgca

SEQ ID NO: 4289426 - DNA, 14 bp, Homo sapiens
aggctcttctcctt

SEQ ID NO: 4289427 - DNA, 13 bp, Homo sapiens
aggctgaaaagtg

SEQ ID NO: 4289428 - DNA, 16 bp, Homo sapiens
aggctgaaaagtgctt

SEQ ID NO: 4289429 - DNA, 22 bp, Homo sapiens
aggctgccccaggggcactgtg

SEQ ID NO: 4289430 - DNA, 15 bp, Homo sapiens
aggctgcctgcccca

SEQ ID NO: 4289431 - DNA, 16 bp, Homo sapiens
aggctggatgctgggt

SEQ ID NO: 4289432 - DNA, 16 bp, Homo sapiens
aggctgggtggccggc

SEQ ID NO: 4289433 - DNA, 21 bp, Homo sapiens
aggctgggtggccggccctgc

SEQ ID NO: 4289434 - DNA, 22 bp, Homo sapiens
aggctgggtggccggccctgcc

SEQ ID NO: 4289435 - DNA, 23 bp, Homo sapiens
aggctgggtggccggccctgccc

SEQ ID NO: 4289436 - DNA, 18 bp, Homo sapiens
aggctgtattttctttta

SEQ ID NO: 4289437 - DNA, 13 bp, Homo sapiens
aggcttcctgccc

SEQ ID NO: 4289438 - DNA, 15 bp, Homo sapiens
aggcttcctgcccta

SEQ ID NO: 4289439 - DNA, 17 bp, Homo sapiens
aggcttcctgccctagc

SEQ ID NO: 4289440 - DNA, 19 bp, Homo sapiens
aggcttccttcatttcctc

SEQ ID NO: 4289441 - DNA, 21 bp, Homo sapiens
aggcttccttcatttcctccg

SEQ ID NO: 4289442 - DNA, 17 bp, Homo sapiens
aggcttgtcagagctgg

SEQ ID NO: 4289443 - DNA, 20 bp, Homo sapiens
aggcttgtcagagctgggag

SEQ ID NO: 4289444 - DNA, 14 bp, Homo sapiens
aggctttcagggcc

SEQ ID NO: 4289445 - DNA, 19 bp, Homo sapiens
agggaaacccggggaactg

SEQ ID NO: 4289446 - DNA, 11 bp, Homo sapiens
agggaaacctt

SEQ ID NO: 4289447 - DNA, 17 bp, Homo sapiens
agggaaattcacactgt

SEQ ID NO: 4289448 - DNA, 23 bp, Homo sapiens
agggaaattcacactgtgcgttt

SEQ ID NO: 4289449 - DNA, 17 bp, Homo sapiens
agggaagcagagcctgg

SEQ ID NO: 4289450 - DNA, 14 bp, Homo sapiens
agggaatcagggag

SEQ ID NO: 4289451 - DNA, 16 bp, Homo sapiens
agggaatcagggagca

SEQ ID NO: 4289452 - DNA, 17 bp, Homo sapiens
agggacactacaaacat

SEQ ID NO: 4289453 - DNA, 20 bp, Homo sapiens
agggacagccaaaagtaagt

SEQ ID NO: 4289454 - DNA, 16 bp, Homo sapiens
agggacagtctggagg

SEQ ID NO: 4289455 - DNA, 13 bp, Homo sapiens
agggactggtcca

SEQ ID NO: 4289456 - DNA, 14 bp, Homo sapiens
agggactggtccag

SEQ ID NO: 4289457 - DNA, 16 bp, Homo sapiens
agggactggtccaggc

SEQ ID NO: 4289458 - DNA, 19 bp, Homo sapiens
agggactggtccaggcatg

SEQ ID NO: 4289459 - DNA, 12 bp, Homo sapiens
agggagaccctg

SEQ ID NO: 4289460 - DNA, 20 bp, Homo sapiens
agggagcactggaggcctct

SEQ ID NO: 4289461 - DNA, 21 bp, Homo sapiens
agggagcactggaggcctctg

SEQ ID NO: 4289462 - DNA, 13 bp, Homo sapiens
agggagcagcacg

SEQ ID NO: 4289463 - DNA, 23 bp, Homo sapiens
agggaggaatcgaggaaccagag

SEQ ID NO: 4289464 - DNA, 15 bp, Homo sapiens
agggaggcctgaggg

SEQ ID NO: 4289465 - DNA, 17 bp, Homo sapiens
agggagggaaacccggg

SEQ ID NO: 4289466 - DNA, 20 bp, Homo sapiens
agctctagacaaccctgcaa

SEQ ID NO: 4289467 - DNA, 22 bp, Homo sapiens
agctctcccctgcgcaggccct

SEQ ID NO: 4289468 - DNA, 21 bp, Homo sapiens
agctctcctgggccagggtct

SEQ ID NO: 4289469 - DNA, 21 bp, Homo sapiens
agctctcgcctcaggcttttt

SEQ ID NO: 4289470 - DNA, 21 bp, Homo sapiens
agctctgacctgcccccgctc

SEQ ID NO: 4289471 - DNA, 16 bp, Homo sapiens
agctgaacaatgaatg

SEQ ID NO: 4289472 - DNA, 16 bp, Homo sapiens
agctgaccagaagtgg

SEQ ID NO: 4289473 - DNA, 17 bp, Homo sapiens
agctgaccagaagtggc

SEQ ID NO: 4289474 - DNA, 13 bp, Homo sapiens
agctgagctggcc

SEQ ID NO: 4289475 - DNA, 23 bp, Homo sapiens
agctgcagaaccagtccctctga

SEQ ID NO: 4289476 - DNA, 17 bp, Homo sapiens
agctgcaggaatcaaaa

SEQ ID NO: 4289477 - DNA, 18 bp, Homo sapiens
agctgcagttagcacaga

SEQ ID NO: 4289478 - DNA, 14 bp, Homo sapiens
agctgccagagaag

SEQ ID NO: 4289479 - DNA, 19 bp, Homo sapiens
agctgcttccagttggact

SEQ ID NO: 4289480 - DNA, 14 bp, Homo sapiens
agctgcttctgccc

SEQ ID NO: 4289481 - DNA, 16 bp, Homo sapiens
agctgcttctgcccac

SEQ ID NO: 4289482 - DNA, 17 bp, Homo sapiens
agctgcttctgcccacc

SEQ ID NO: 4289483 - DNA, 14 bp, Homo sapiens
agctgctttcttct

SEQ ID NO: 4289484 - DNA, 21 bp, Homo sapiens
agctggagagagagttctcac

SEQ ID NO: 4289485 - DNA, 19 bp, Homo sapiens
agctggcaggagacactgg

SEQ ID NO: 4289486 - DNA, 17 bp, Homo sapiens
agctggcaggagggtgg

SEQ ID NO: 4289487 - DNA, 21 bp, Homo sapiens
agctggcaggagggtggcact

SEQ ID NO: 4289488 - DNA, 11 bp, Homo sapiens
agctggctctg

SEQ ID NO: 4289489 - DNA, 21 bp, Homo sapiens
agctggctctgcagcacattg

SEQ ID NO: 4289490 - DNA, 13 bp, Homo sapiens
agctggtaacatc

SEQ ID NO: 4289491 - DNA, 14 bp, Homo sapiens
agctgtagaaaggt

SEQ ID NO: 4289492 - DNA, 19 bp, Homo sapiens
agctgtctcaaacctccaa

SEQ ID NO: 4289493 - DNA, 15 bp, Homo sapiens
agctgtgccagctgc

SEQ ID NO: 4289494 - DNA, 21 bp, Homo sapiens
agctgtgccagctgcttctgc

SEQ ID NO: 4289495 - DNA, 20 bp, Homo sapiens
agctgtgcgagaacacaagc

SEQ ID NO: 4289496 - DNA, 17 bp, Homo sapiens
agctgtggggagctggt

SEQ ID NO: 4289497 - DNA, 13 bp, Homo sapiens
agctgttctctgc

SEQ ID NO: 4289498 - DNA, 15 bp, Homo sapiens
agctgttctctgctt

SEQ ID NO: 4289499 - DNA, 17 bp, Homo sapiens
agcttaaaaaagaaaga

SEQ ID NO: 4289500 - DNA, 14 bp, Homo sapiens
agcttagaagccac

SEQ ID NO: 4289501 - DNA, 15 bp, Homo sapiens
agcttatttctaact

SEQ ID NO: 4289502 - DNA, 16 bp, Homo sapiens
agcttatttctaacta

SEQ ID NO: 4289503 - DNA, 18 bp, Homo sapiens
agcttcaggtgagccaag

SEQ ID NO: 4289504 - DNA, 13 bp, Homo sapiens
agcttccagatgg

SEQ ID NO: 4289505 - DNA, 11 bp, Homo sapiens
agcttgaatgt

SEQ ID NO: 4289506 - DNA, 15 bp, Homo sapiens
aggaaaaaggctggt

SEQ ID NO: 4289507 - DNA, 16 bp, Homo sapiens
aggaaaaaggctggtg

SEQ ID NO: 4289508 - DNA, 22 bp, Homo sapiens
aggaaaaccaagccgtggcttc

SEQ ID NO: 4289509 - DNA, 21 bp, Homo sapiens
aggaaacacgtttagaaatga

SEQ ID NO: 4289510 - DNA, 22 bp, Homo sapiens
aggaaactcacctgctggcccc

SEQ ID NO: 4289511 - DNA, 15 bp, Homo sapiens
aggaaagtatctcta

SEQ ID NO: 4289512 - DNA, 21 bp, Homo sapiens
aggaaagtatctctactttcc

SEQ ID NO: 4289513 - DNA, 16 bp, Homo sapiens
aggaaagtggatgcca

SEQ ID NO: 4289514 - DNA, 14 bp, Homo sapiens
aggaaatagtgttc

SEQ ID NO: 4289515 - DNA, 13 bp, Homo sapiens
aggaacacccagc

SEQ ID NO: 4289516 - DNA, 14 bp, Homo sapiens
aggaacacccagcc

SEQ ID NO: 4289517 - DNA, 13 bp, Homo sapiens
aggaactggtcca

SEQ ID NO: 4289518 - DNA, 14 bp, Homo sapiens
aggaactggtccag

SEQ ID NO: 4289519 - DNA, 18 bp, Homo sapiens
aggaactggtccaggcca

SEQ ID NO: 4289520 - DNA, 21 bp, Homo sapiens
aggaactggtccaggccaggc

SEQ ID NO: 4289521 - DNA, 22 bp, Homo sapiens
aggaactggtccaggccaggcc

SEQ ID NO: 4289522 - DNA, 14 bp, Homo sapiens
aggaagcaaggcca

SEQ ID NO: 4289523 - DNA, 17 bp, Homo sapiens
aggaagcaaggccagcc

SEQ ID NO: 4289524 - DNA, 12 bp, Homo sapiens
aggaagcacaag

SEQ ID NO: 4289525 - DNA, 21 bp, Homo sapiens
aggaagcacaagaagtgggag

SEQ ID NO: 4289526 - DNA, 22 bp, Homo sapiens
aggaagcacaagaagtgggagt

SEQ ID NO: 4289527 - DNA, 22 bp, Homo sapiens
aggaagccacgtgctggagagt

SEQ ID NO: 4289528 - DNA, 13 bp, Homo sapiens
aggaagggactgg

SEQ ID NO: 4289529 - DNA, 14 bp, Homo sapiens
aggaagggactggt

SEQ ID NO: 4289530 - DNA, 15 bp, Homo sapiens
aggaagggactggtc

SEQ ID NO: 4289531 - DNA, 16 bp, Homo sapiens
aggaagggactggtcc

SEQ ID NO: 4289532 - DNA, 17 bp, Homo sapiens
aggaagggactggtcca

SEQ ID NO: 4289533 - DNA, 24 bp, Homo sapiens
aggaagggactggtccaggcatgg

SEQ ID NO: 4289534 - DNA, 13 bp, Homo sapiens
aggaagggaggcc

SEQ ID NO: 4289535 - DNA, 16 bp, Homo sapiens
aggaagggaggcctga

SEQ ID NO: 4289536 - DNA, 18 bp, Homo sapiens
aggaagggaggcctgagg

SEQ ID NO: 4289537 - DNA, 21 bp, Homo sapiens
aggaagggaggcctgaggggc

SEQ ID NO: 4289538 - DNA, 19 bp, Homo sapiens
aggaagggatgtatttgta

SEQ ID NO: 4289539 - DNA, 21 bp, Homo sapiens
aggaaggtctcatgcctgaga

SEQ ID NO: 4289540 - DNA, 16 bp, Homo sapiens
aggaagtcaggagcca

SEQ ID NO: 4289541 - DNA, 17 bp, Homo sapiens
aggaagtcaggagccag

SEQ ID NO: 4289542 - DNA, 11 bp, Homo sapiens
aggaatataca

SEQ ID NO: 4289543 - DNA, 14 bp, Homo sapiens
aggaatgctccccc

SEQ ID NO: 4289544 - DNA, 15 bp, Homo sapiens
aggaatgctccccca

SEQ ID NO: 4289545 - DNA, 19 bp, Homo sapiens
aggaatgggccaagccagg

SEQ ID NO: 4289546 - DNA, 20 bp, Homo sapiens
aggaatgggccaagccaggg

SEQ ID NO: 4289547 - DNA, 17 bp, Homo sapiens
aggaatgtgcttttcca

SEQ ID NO: 4289548 - DNA, 15 bp, Homo sapiens
aggacaaaaatataa

SEQ ID NO: 4289549 - DNA, 14 bp, Homo sapiens
aggacactgccttt

SEQ ID NO: 4289550 - DNA, 18 bp, Homo sapiens
aggacactgcctttgctg

SEQ ID NO: 4289551 - DNA, 20 bp, Homo sapiens
aggacactgcctttgctgcc

SEQ ID NO: 4289552 - DNA, 15 bp, Homo sapiens
aggacagcttcccca

SEQ ID NO: 4289553 - DNA, 12 bp, Homo sapiens
aggacagggagg

SEQ ID NO: 4289554 - DNA, 17 bp, Homo sapiens
aggacagggagggaaca

SEQ ID NO: 4289555 - DNA, 12 bp, Homo sapiens
aggaccaggagc

SEQ ID NO: 4289556 - DNA, 15 bp, Homo sapiens
aggaccaggagccag

SEQ ID NO: 4289557 - DNA, 13 bp, Homo sapiens
aggacccaaggtg

SEQ ID NO: 4289558 - DNA, 18 bp, Homo sapiens
aggaccccatctgctgag

SEQ ID NO: 4289559 - DNA, 20 bp, Homo sapiens
aggacccggaggggcctggc

SEQ ID NO: 4289560 - DNA, 19 bp, Homo sapiens
aggacctccacctgggaga

SEQ ID NO: 4289561 - DNA, 13 bp, Homo sapiens
aggacgcatgcag

SEQ ID NO: 4289562 - DNA, 21 bp, Homo sapiens
aggactgttttttcctgagct

SEQ ID NO: 4289563 - DNA, 14 bp, Homo sapiens
aggacttcctgcta

SEQ ID NO: 4289564 - DNA, 23 bp, Homo sapiens
aggacttcctgctacagtagctg

SEQ ID NO: 4289565 - DNA, 13 bp, Homo sapiens
aggacttgtgcct

SEQ ID NO: 4289566 - DNA, 15 bp, Homo sapiens
aggacttgtgcctct

SEQ ID NO: 4289567 - DNA, 23 bp, Homo sapiens
aggacttgtgcctcttgggagac

SEQ ID NO: 4289568 - DNA, 16 bp, Homo sapiens
aggagaacttgaacaa

SEQ ID NO: 4289569 - DNA, 13 bp, Homo sapiens
aggagacactggt

SEQ ID NO: 4289570 - DNA, 15 bp, Homo sapiens
aggagaccctgtctt

SEQ ID NO: 4289571 - DNA, 16 bp, Homo sapiens
aggagactcaggccca

SEQ ID NO: 4289572 - DNA, 18 bp, Homo sapiens
aggagagaatgagagagt

SEQ ID NO: 4289573 - DNA, 17 bp, Homo sapiens
aggagagattatttaca

SEQ ID NO: 4289574 - DNA, 14 bp, Homo sapiens
aggagagcccccac

SEQ ID NO: 4289575 - DNA, 22 bp, Homo sapiens
aggagagcccccaccagcagca

SEQ ID NO: 4289576 - DNA, 17 bp, Homo sapiens
aggagagccctctgctg

SEQ ID NO: 4289577 - DNA, 13 bp, Homo sapiens
aggagaggagtgc

SEQ ID NO: 4289578 - DNA, 14 bp, Homo sapiens
aggagaggctctga

SEQ ID NO: 4289579 - DNA, 16 bp, Homo sapiens
aggagattgctctggg

SEQ ID NO: 4289580 - DNA, 13 bp, Homo sapiens
aggagcaggaagc

SEQ ID NO: 4289581 - DNA, 14 bp, Homo sapiens
aggagcaggaagca

SEQ ID NO: 4289582 - DNA, 17 bp, Homo sapiens
aggagcaggaagcaagg

SEQ ID NO: 4289583 - DNA, 13 bp, Homo sapiens
aggagcagtgggc

SEQ ID NO: 4289584 - DNA, 21 bp, Homo sapiens
aggagcagtgggccctggctc

SEQ ID NO: 4289585 - DNA, 20 bp, Homo sapiens
aggagcatgtcctatccctg

SEQ ID NO: 4289586 - DNA, 22 bp, Homo sapiens
aggagcatgtcctatccctgga

SEQ ID NO: 4289587 - DNA, 15 bp, Homo sapiens
aggagccagcagggc

SEQ ID NO: 4289588 - DNA, 16 bp, Homo sapiens
aggagccagctcccag

SEQ ID NO: 4289589 - DNA, 14 bp, Homo sapiens
aggagcctagagga

SEQ ID NO: 4289590 - DNA, 16 bp, Homo sapiens
aggagcgggacctgtg

SEQ ID NO: 4289591 - DNA, 14 bp, Homo sapiens
aggagcgtgtccta

SEQ ID NO: 4289592 - DNA, 20 bp, Homo sapiens
aggagctcagggctggattg

SEQ ID NO: 4289593 - DNA, 14 bp, Homo sapiens
aggagcttccagat

SEQ ID NO: 4289594 - DNA, 22 bp, Homo sapiens
aggaggaactggtccaggccag

SEQ ID NO: 4289595 - DNA, 15 bp, Homo sapiens
aggaggaagggactg

SEQ ID NO: 4289596 - DNA, 12 bp, Homo sapiens
aggaggacaggg

SEQ ID NO: 4289597 - DNA, 15 bp, Homo sapiens
aggaggacagggagg

SEQ ID NO: 4289598 - DNA, 16 bp, Homo sapiens
aggaggacctgggggg

SEQ ID NO: 4289599 - DNA, 16 bp, Homo sapiens
aggagggggcccggct

SEQ ID NO: 4289600 - DNA, 22 bp, Homo sapiens
aggaggtaacatagatgcctgg

SEQ ID NO: 4289601 - DNA, 15 bp, Homo sapiens
agtggcctgagaaga

SEQ ID NO: 4289602 - DNA, 17 bp, Homo sapiens
agtggcctgagaagagt

SEQ ID NO: 4289603 - DNA, 17 bp, Homo sapiens
agtggcttcagcccctg

SEQ ID NO: 4289604 - DNA, 23 bp, Homo sapiens
agtggcttggagcagaggtgggg

SEQ ID NO: 4289605 - DNA, 15 bp, Homo sapiens
agtgggacagagtct

SEQ ID NO: 4289606 - DNA, 17 bp, Homo sapiens
agtgggacagagtctgg

SEQ ID NO: 4289607 - DNA, 21 bp, Homo sapiens
agtgggacagggcatggccag

SEQ ID NO: 4289608 - DNA, 11 bp, Homo sapiens
agtgggagagg

SEQ ID NO: 4289609 - DNA, 17 bp, Homo sapiens
agtgggagtgggagagg

SEQ ID NO: 4289610 - DNA, 18 bp, Homo sapiens
agtgggattcaggaatgg

SEQ ID NO: 4289611 - DNA, 16 bp, Homo sapiens
agtgggccctggctct

SEQ ID NO: 4289612 - DNA, 20 bp, Homo sapiens
agtgggccctggctctgtca

SEQ ID NO: 4289613 - DNA, 16 bp, Homo sapiens
agtgggtgggacacag

SEQ ID NO: 4289614 - DNA, 19 bp, Homo sapiens
agtgggtgggacacagaga

SEQ ID NO: 4289615 - DNA, 16 bp, Homo sapiens
agtgggttctccaaac

SEQ ID NO: 4289616 - DNA, 19 bp, Homo sapiens
agtggtccacattctgctg

SEQ ID NO: 4289617 - DNA, 21 bp, Homo sapiens
agtggtccacattctgctgcc

SEQ ID NO: 4289618 - DNA, 13 bp, Homo sapiens
agtgtaaaataga

SEQ ID NO: 4289619 - DNA, 17 bp, Homo sapiens
agtgtaaaatagaatgt

SEQ ID NO: 4289620 - DNA, 16 bp, Homo sapiens
agtgtactggatttaa

SEQ ID NO: 4289621 - DNA, 13 bp, Homo sapiens
agtgtatgtcttg

SEQ ID NO: 4289622 - DNA, 19 bp, Homo sapiens
agtgtccccaggggcacac

SEQ ID NO: 4289623 - DNA, 21 bp, Homo sapiens
agtgtctggatcagtaaaatt

SEQ ID NO: 4289624 - DNA, 20 bp, Homo sapiens
agtgtctgtccatctgtctg

SEQ ID NO: 4289625 - DNA, 14 bp, Homo sapiens
agtgtgaatataaa

SEQ ID NO: 4289626 - DNA, 21 bp, Homo sapiens
agtgtgacgggggttggggtg

SEQ ID NO: 4289627 - DNA, 14 bp, Homo sapiens
agtgtgccaccctc

SEQ ID NO: 4289628 - DNA, 15 bp, Homo sapiens
agtgtgccaccctct

SEQ ID NO: 4289629 - DNA, 22 bp, Homo sapiens
agtgtgccaccctctgcagggc

SEQ ID NO: 4289630 - DNA, 20 bp, Homo sapiens
agtgtgcctgctatccagcc

SEQ ID NO: 4289631 - DNA, 18 bp, Homo sapiens
agtgtggactctggactg

SEQ ID NO: 4289632 - DNA, 21 bp, Homo sapiens
agtgtggctcccctctattta

SEQ ID NO: 4289633 - DNA, 21 bp, Homo sapiens
agtgtgtgggggtctgggagg

SEQ ID NO: 4289634 - DNA, 20 bp, Homo sapiens
agtgtgttttggtatgcact

SEQ ID NO: 4289635 - DNA, 18 bp, Homo sapiens
agtgttcccttctggctg

SEQ ID NO: 4289636 - DNA, 17 bp, Homo sapiens
agtgttgcctcctccca

SEQ ID NO: 4289637 - DNA, 12 bp, Homo sapiens
agtgtttccagt

SEQ ID NO: 4289638 - DNA, 17 bp, Homo sapiens
agttaatgtactttcat

SEQ ID NO: 4289639 - DNA, 14 bp, Homo sapiens
agttagcacagagg

SEQ ID NO: 4289640 - DNA, 17 bp, Homo sapiens
agttagcaggaaatagt

SEQ ID NO: 4289641 - DNA, 18 bp, Homo sapiens
agttagcaggaaatagtg

SEQ ID NO: 4289642 - DNA, 19 bp, Homo sapiens
agttcaatcaaactttcag

SEQ ID NO: 4289643 - DNA, 14 bp, Homo sapiens
agttcccaagaaag

SEQ ID NO: 4289644 - DNA, 17 bp, Homo sapiens
agttcctgtgcacagcc

SEQ ID NO: 4289645 - DNA, 16 bp, Homo sapiens
agttctaacacatttc

SEQ ID NO: 4289646 - DNA, 20 bp, Homo sapiens
agttctatttctatctgcaa

SEQ ID NO: 4289647 - DNA, 17 bp, Homo sapiens
agttctcccttcaactg

SEQ ID NO: 4289648 - DNA, 17 bp, Homo sapiens
agttctgaaaactgttt

SEQ ID NO: 4289649 - DNA, 14 bp, Homo sapiens
agttcttcctgtaa

SEQ ID NO: 4289650 - DNA, 15 bp, Homo sapiens
agttcttcctgtaat

SEQ ID NO: 4289651 - DNA, 18 bp, Homo sapiens
agttgaggggcttccctc

SEQ ID NO: 4289652 - DNA, 21 bp, Homo sapiens
agttgaggggcttccctctgc

SEQ ID NO: 4289653 - DNA, 12 bp, Homo sapiens
agttgcacagca

SEQ ID NO: 4289654 - DNA, 17 bp, Homo sapiens
agttgcacagctatgaa

SEQ ID NO: 4289655 - DNA, 13 bp, Homo sapiens
agttgcagtaaag

SEQ ID NO: 4289656 - DNA, 15 bp, Homo sapiens
agttggactgtggcc

SEQ ID NO: 4289657 - DNA, 13 bp, Homo sapiens
agttggcctcagc

SEQ ID NO: 4289658 - DNA, 15 bp, Homo sapiens
agttggcctcagcag

SEQ ID NO: 4289659 - DNA, 21 bp, Homo sapiens
agttggctcacatcatgtaat

SEQ ID NO: 4289660 - DNA, 20 bp, Homo sapiens
agttggtgattttagatttc

SEQ ID NO: 4289661 - DNA, 13 bp, Homo sapiens
agttgtcttacac

SEQ ID NO: 4289662 - DNA, 19 bp, Homo sapiens
agttgttagtgatttgcta

SEQ ID NO: 4289663 - DNA, 16 bp, Homo sapiens
agtttaccaatcaaca

SEQ ID NO: 4289664 - DNA, 22 bp, Homo sapiens
agtttattgccctcaaaatctt

SEQ ID NO: 4289665 - DNA, 13 bp, Homo sapiens
agtttcaaatgag

SEQ ID NO: 4289666 - DNA, 17 bp, Homo sapiens
agtttcagctgaccaga

SEQ ID NO: 4289667 - DNA, 13 bp, Homo sapiens
agtttctaaaatt

SEQ ID NO: 4289668 - DNA, 20 bp, Homo sapiens
agtttctaaaattgagttct

SEQ ID NO: 4289669 - DNA, 21 bp, Homo sapiens
agtttgcaatcttatgttgat

SEQ ID NO: 4289670 - DNA, 14 bp, Homo sapiens
agtttgcctctgca

SEQ ID NO: 4289671 - DNA, 12 bp, Homo sapiens
agtttgttttct

SEQ ID NO: 4289672 - DNA, 16 bp, Homo sapiens
agttttattgaaaatg

SEQ ID NO: 4289673 - DNA, 15 bp, Homo sapiens
agttttctaaatgtt

SEQ ID NO: 4289674 - DNA, 13 bp, Homo sapiens
agtttttacagtg

SEQ ID NO: 4289675 - DNA, 16 bp, Homo sapiens
agtttttacagtgtat

SEQ ID NO: 4289676 - DNA, 18 bp, Homo sapiens
agtttttttcaaagtcca

SEQ ID NO: 4289677 - DNA, 20 bp, Homo sapiens
ataaaaggtgacccttctgt

SEQ ID NO: 4289678 - DNA, 13 bp, Homo sapiens
ataaaataaataa

SEQ ID NO: 4289679 - DNA, 19 bp, Homo sapiens
ataaacaacttaatgttct

SEQ ID NO: 4289680 - DNA, 18 bp, Homo sapiens
ataaacacagattatttg

SEQ ID NO: 4289681 - DNA, 20 bp, Homo sapiens
ataaacattaaaagaagact

SEQ ID NO: 4289682 - DNA, 12 bp, Homo sapiens
ataaagccacat

SEQ ID NO: 4289683 - DNA, 23 bp, Homo sapiens
ataaaggtcatattggaaacata

SEQ ID NO: 4289684 - DNA, 13 bp, Homo sapiens
ataaagttattaa

SEQ ID NO: 4289685 - DNA, 15 bp, Homo sapiens
ataaatatctattta

SEQ ID NO: 4289686 - DNA, 12 bp, Homo sapiens
ataaatctgtct

SEQ ID NO: 4289687 - DNA, 19 bp, Homo sapiens
ataaatctgtctgattcta

SEQ ID NO: 4289688 - DNA, 20 bp, Homo sapiens
ataaatctgtctgattctat

SEQ ID NO: 4289689 - DNA, 14 bp, Homo sapiens
ataaatgagcattt

SEQ ID NO: 4289690 - DNA, 13 bp, Homo sapiens
ataaatgcaaatg

SEQ ID NO: 4289691 - DNA, 22 bp, Homo sapiens
ataaatggtgagaattaaaata

SEQ ID NO: 4289692 - DNA, 16 bp, Homo sapiens
ataaattaatgagttt

SEQ ID NO: 4289693 - DNA, 22 bp, Homo sapiens
ataaattaatgagttttatcca

SEQ ID NO: 4289694 - DNA, 16 bp, Homo sapiens
ataaattatttctaaa

SEQ ID NO: 4289695 - DNA, 20 bp, Homo sapiens
ataaattatttctaaaacat

SEQ ID NO: 4289696 - DNA, 18 bp, Homo sapiens
ataaattggtgataagtg

SEQ ID NO: 4289697 - DNA, 20 bp, Homo sapiens
ataacaagccaaacattctt

SEQ ID NO: 4289698 - DNA, 14 bp, Homo sapiens
ataacaatgtatgt

SEQ ID NO: 4289699 - DNA, 15 bp, Homo sapiens
ataacatattcttgc

SEQ ID NO: 4289700 - DNA, 17 bp, Homo sapiens
ataacatattcttgctt

SEQ ID NO: 4289701 - DNA, 16 bp, Homo sapiens
ataaccttcatgatga

SEQ ID NO: 4289702 - DNA, 14 bp, Homo sapiens
ataactagatctcc

SEQ ID NO: 4289703 - DNA, 21 bp, Homo sapiens
ataactagatctcctgtaatt

SEQ ID NO: 4289704 - DNA, 15 bp, Homo sapiens
ataagatttttaggt

SEQ ID NO: 4289705 - DNA, 17 bp, Homo sapiens
ataagcctcaggcctgg

SEQ ID NO: 4289706 - DNA, 15 bp, Homo sapiens
ataagtaatatcttt

SEQ ID NO: 4289707 - DNA, 14 bp, Homo sapiens
ataagtggaaaaaa

SEQ ID NO: 4289708 - DNA, 15 bp, Homo sapiens
ataagtggaaaaaag

SEQ ID NO: 4289709 - DNA, 18 bp, Homo sapiens
ataagtggaaaaaagaga

SEQ ID NO: 4289710 - DNA, 20 bp, Homo sapiens
ataataaaaatcatgcttat

SEQ ID NO: 4289711 - DNA, 16 bp, Homo sapiens
ataataaatatatatt

SEQ ID NO: 4289712 - DNA, 16 bp, Homo sapiens
ataataactagatctc

SEQ ID NO: 4289713 - DNA, 22 bp, Homo sapiens
ataatacttaaaaatatgtgag

SEQ ID NO: 4289714 - DNA, 18 bp, Homo sapiens
ataatactttgtatacaa

SEQ ID NO: 4289715 - DNA, 17 bp, Homo sapiens
ataatatcttgaagaat

SEQ ID NO: 4289716 - DNA, 22 bp, Homo sapiens
ataatatcttgaagaatattgt

SEQ ID NO: 4289717 - DNA, 23 bp, Homo sapiens
ataatatcttgaagaatattgtt

SEQ ID NO: 4289718 - DNA, 20 bp, Homo sapiens
ataatatttaggcatgagct

SEQ ID NO: 4289719 - DNA, 17 bp, Homo sapiens
ataatcaagtgcatttc

SEQ ID NO: 4289720 - DNA, 18 bp, Homo sapiens
ataatcaagtgcatttct

SEQ ID NO: 4289721 - DNA, 16 bp, Homo sapiens
ataatctcatccccaa

SEQ ID NO: 4289722 - DNA, 19 bp, Homo sapiens
ataatgacgtattgtgaaa

SEQ ID NO: 4289723 - DNA, 16 bp, Homo sapiens
ataatgcctttgtaac

SEQ ID NO: 4289724 - DNA, 18 bp, Homo sapiens
ataattaaattttaatgt

SEQ ID NO: 4289725 - DNA, 19 bp, Homo sapiens
ataattaaattttaatgta

SEQ ID NO: 4289726 - DNA, 13 bp, Homo sapiens
ataattatgttta

SEQ ID NO: 4289727 - DNA, 20 bp, Homo sapiens
ataattgactggtggaagga

SEQ ID NO: 4289728 - DNA, 17 bp, Homo sapiens
ataattttattgctgga

SEQ ID NO: 4289729 - DNA, 21 bp, Homo sapiens
ataattttttagttaaaatct

SEQ ID NO: 4289730 - DNA, 23 bp, Homo sapiens
ataattttttagttaaaatctat

SEQ ID NO: 4289731 - DNA, 12 bp, Homo sapiens
atacaaacaggt

SEQ ID NO: 4289732 - DNA, 16 bp, Homo sapiens
atacaaccttcattta

SEQ ID NO: 4289733 - DNA, 15 bp, Homo sapiens
atacactgtatctaa

SEQ ID NO: 4289734 - DNA, 18 bp, Homo sapiens
atacagtattatagatat

SEQ ID NO: 4289735 - DNA, 17 bp, Homo sapiens
atacatagtctttgttt

SEQ ID NO: 4289736 - DNA, 16 bp, Homo sapiens
atacatggtagcaggg

SEQ ID NO: 4289737 - DNA, 15 bp, Homo sapiens
atacattaaaataac

SEQ ID NO: 4289738 - DNA, 17 bp, Homo sapiens
atacattaaaataacta

SEQ ID NO: 4289739 - DNA, 21 bp, Homo sapiens
ataccatccatccctggtgaa

SEQ ID NO: 4289740 - DNA, 18 bp, Homo sapiens
ataccctaggtctccacc

SEQ ID NO: 4289741 - DNA, 23 bp, Homo sapiens
ataccctaggtctccacccctca

SEQ ID NO: 4289742 - DNA, 14 bp, Homo sapiens
atacctctctctat

SEQ ID NO: 4289743 - DNA, 20 bp, Homo sapiens
atactaaatatgaaatttta

SEQ ID NO: 4289744 - DNA, 21 bp, Homo sapiens
atactgcatatcctggtgtct

SEQ ID NO: 4289745 - DNA, 21 bp, Homo sapiens
atactggttatagttgatatg

SEQ ID NO: 4289746 - DNA, 22 bp, Homo sapiens
atactgtatgccggctccttca

SEQ ID NO: 4289747 - DNA, 19 bp, Homo sapiens
atactgtttgtaatataca

SEQ ID NO: 4289748 - DNA, 19 bp, Homo sapiens
atacttaaaaatatgtgag

SEQ ID NO: 4289749 - DNA, 21 bp, Homo sapiens
atacttaaaaatatgtgagca

SEQ ID NO: 4289750 - DNA, 16 bp, Homo sapiens
atacttaaaaatttat

SEQ ID NO: 4289751 - DNA, 22 bp, Homo sapiens
atacttcctggattttctttct

SEQ ID NO: 4289752 - DNA, 12 bp, Homo sapiens
atactttccaac

SEQ ID NO: 4289753 - DNA, 17 bp, Homo sapiens
atacttttgtgtattct

SEQ ID NO: 4289754 - DNA, 22 bp, Homo sapiens
atacttttgtgtattctgtgga

SEQ ID NO: 4289755 - DNA, 16 bp, Homo sapiens
atagaatgttactttg

SEQ ID NO: 4289756 - DNA, 14 bp, Homo sapiens
atagatataaatat

SEQ ID NO: 4289757 - DNA, 18 bp, Homo sapiens
atagatcacggcatgttt

SEQ ID NO: 4289758 - DNA, 13 bp, Homo sapiens
atagatgcctggg

SEQ ID NO: 4289759 - DNA, 16 bp, Homo sapiens
atagatgcctgggcct

SEQ ID NO: 4289760 - DNA, 18 bp, Homo sapiens
atagatgcctgggcctga

SEQ ID NO: 4289761 - DNA, 14 bp, Homo sapiens
atagcaaagtagta

SEQ ID NO: 4289762 - DNA, 15 bp, Homo sapiens
atagcgtgtgtagat

SEQ ID NO: 4289763 - DNA, 16 bp, Homo sapiens
atagcttaagaagtat

SEQ ID NO: 4289764 - DNA, 18 bp, Homo sapiens
ataggagcttccagatgg

SEQ ID NO: 4289765 - DNA, 17 bp, Homo sapiens
ataggataaattaatga

SEQ ID NO: 4289766 - DNA, 23 bp, Homo sapiens
ataggtcagtgaggcccagggag

SEQ ID NO: 4289767 - DNA, 23 bp, Homo sapiens
atagtagcagagtcattgttaca

SEQ ID NO: 4289768 - DNA, 18 bp, Homo sapiens
atagttctatttctatct

SEQ ID NO: 4289769 - DNA, 18 bp, Homo sapiens
atataaatggtgagaatt

SEQ ID NO: 4289770 - DNA, 23 bp, Homo sapiens
atataaatggtgagaattaaaat

SEQ ID NO: 4289771 - DNA, 12 bp, Homo sapiens
atataaatgtgt

SEQ ID NO: 4289772 - DNA, 15 bp, Homo sapiens
atataactttagaaa

SEQ ID NO: 4289773 - DNA, 21 bp, Homo sapiens
atataataaatatatatttat

SEQ ID NO: 4289774 - DNA, 15 bp, Homo sapiens
atataatacttaaaa

SEQ ID NO: 4289775 - DNA, 17 bp, Homo sapiens
atataatacttaaaaat

SEQ ID NO: 4289776 - DNA, 15 bp, Homo sapiens
atatactcattagaa

SEQ ID NO: 4289777 - DNA, 19 bp, Homo sapiens
atatactcattagaattac

SEQ ID NO: 4289778 - DNA, 14 bp, Homo sapiens
atatactgcatatc

SEQ ID NO: 4289779 - DNA, 15 bp, Homo sapiens
atatagttgaacaag

SEQ ID NO: 4289780 - DNA, 15 bp, Homo sapiens
atatagtttgttttc

SEQ ID NO: 4289781 - DNA, 20 bp, Homo sapiens
atatagtttgttttcttttt

SEQ ID NO: 4289782 - DNA, 15 bp, Homo sapiens
atatataaatatcta

SEQ ID NO: 4289783 - DNA, 14 bp, Homo sapiens
atatatacatgtat

SEQ ID NO: 4289784 - DNA, 14 bp, Homo sapiens
atatatatttatca

SEQ ID NO: 4289785 - DNA, 15 bp, Homo sapiens
atatatatttatcat

SEQ ID NO: 4289786 - DNA, 14 bp, Homo sapiens
atatcactcattaa

SEQ ID NO: 4289787 - DNA, 20 bp, Homo sapiens
atatcatcacgtatgttata

SEQ ID NO: 4289788 - DNA, 19 bp, Homo sapiens
atatcctggtgtctagttt

SEQ ID NO: 4289789 - DNA, 23 bp, Homo sapiens
atatctatttatctgtctgagcc

SEQ ID NO: 4289790 - DNA, 11 bp, Homo sapiens
atatctgaaaa

SEQ ID NO: 4289791 - DNA, 17 bp, Homo sapiens
atatctgtttgcttcta

SEQ ID NO: 4289792 - DNA, 23 bp, Homo sapiens
atatcttcgttagtaatctgtat

SEQ ID NO: 4289793 - DNA, 15 bp, Homo sapiens
atatcttgaagaata

SEQ ID NO: 4289794 - DNA, 16 bp, Homo sapiens
atatgaaaactaagtt

SEQ ID NO: 4289795 - DNA, 19 bp, Homo sapiens
atatgaagtaagttctgaa

SEQ ID NO: 4289796 - DNA, 22 bp, Homo sapiens
atatgacaatttcaaaatgcat

SEQ ID NO: 4289797 - DNA, 22 bp, Homo sapiens
atatgacctaaatccattttct

SEQ ID NO: 4289798 - DNA, 21 bp, Homo sapiens
atatgaggggactgcatgcaa

SEQ ID NO: 4289799 - DNA, 16 bp, Homo sapiens
atatgattctcctctc

SEQ ID NO: 4289800 - DNA, 17 bp, Homo sapiens
atatgattctcctctcc

SEQ ID NO: 4289801 - DNA, 18 bp, Homo sapiens
atatgattctcctctccc

SEQ ID NO: 4289802 - DNA, 16 bp, Homo sapiens
atatgcccctccccag

SEQ ID NO: 4289803 - DNA, 19 bp, Homo sapiens
atatggaaatcctgttact

SEQ ID NO: 4289804 - DNA, 12 bp, Homo sapiens
atatggatattt

SEQ ID NO: 4289805 - DNA, 17 bp, Homo sapiens
atatggggggccaacac

SEQ ID NO: 4289806 - DNA, 19 bp, Homo sapiens
atatgtaacatgtctaaag

SEQ ID NO: 4289807 - DNA, 21 bp, Homo sapiens
atatgtaacatgtctaaagtt

SEQ ID NO: 4289808 - DNA, 18 bp, Homo sapiens
atatgtcagtcactaaaa

SEQ ID NO: 4289809 - DNA, 14 bp, Homo sapiens
atatgtgagcatga

SEQ ID NO: 4289810 - DNA, 13 bp, Homo sapiens
atatgttgctgaa

SEQ ID NO: 4289811 - DNA, 20 bp, Homo sapiens
atattagagtgcccttaaaa

SEQ ID NO: 4289812 - DNA, 12 bp, Homo sapiens
atattatatata

SEQ ID NO: 4289813 - DNA, 18 bp, Homo sapiens
atattcaatcttaacaaa

SEQ ID NO: 4289814 - DNA, 14 bp, Homo sapiens
atattcagagatgt

SEQ ID NO: 4289815 - DNA, 19 bp, Homo sapiens
atattcagagatgtaccat

SEQ ID NO: 4289816 - DNA, 14 bp, Homo sapiens
atattcccatggta

SEQ ID NO: 4289817 - DNA, 18 bp, Homo sapiens
atattctaagaaatatct

SEQ ID NO: 4289818 - DNA, 23 bp, Homo sapiens
atattctaagaaatatctgtgaa

SEQ ID NO: 4289819 - DNA, 18 bp, Homo sapiens
atattcttgctttcacaa

SEQ ID NO: 4289820 - DNA, 22 bp, Homo sapiens
atattgagatcagcattcaaaa

SEQ ID NO: 4289821 - DNA, 13 bp, Homo sapiens
atattgagcagaa

SEQ ID NO: 4289822 - DNA, 17 bp, Homo sapiens
atattggttctatttat

SEQ ID NO: 4289823 - DNA, 12 bp, Homo sapiens
atattgtatgta

SEQ ID NO: 4289824 - DNA, 18 bp, Homo sapiens
atatttctaagcttattt

SEQ ID NO: 4289825 - DNA, 14 bp, Homo sapiens
atatttcttcaaat

SEQ ID NO: 4289826 - DNA, 14 bp, Homo sapiens
atatttgcttattt

SEQ ID NO: 4289827 - DNA, 15 bp, Homo sapiens
atatttgcttattta

SEQ ID NO: 4289828 - DNA, 17 bp, Homo sapiens
atatttgcttatttata

SEQ ID NO: 4289829 - DNA, 18 bp, Homo sapiens
atatttgcttatttatat

SEQ ID NO: 4289830 - DNA, 19 bp, Homo sapiens
atatttgcttatttatatt

SEQ ID NO: 4289831 - DNA, 20 bp, Homo sapiens
atattttatttcaatgtaat

SEQ ID NO: 4289832 - DNA, 19 bp, Homo sapiens
atattttctgagtagcata

SEQ ID NO: 4289833 - DNA, 15 bp, Homo sapiens
atcaaatctgagcct

SEQ ID NO: 4289834 - DNA, 15 bp, Homo sapiens
atcaacaaagaaata

SEQ ID NO: 4289835 - DNA, 20 bp, Homo sapiens
atcaacagcatgtctactgc

SEQ ID NO: 4289836 - DNA, 18 bp, Homo sapiens
atcaacctaggagcagtg

SEQ ID NO: 4289837 - DNA, 13 bp, Homo sapiens
atcaactcatgtt

SEQ ID NO: 4289838 - DNA, 23 bp, Homo sapiens
atcaaggggttcccactggctcc

SEQ ID NO: 4289839 - DNA, 12 bp, Homo sapiens
atcaagtattac

SEQ ID NO: 4289840 - DNA, 15 bp, Homo sapiens
atcaagtcccgaggc

SEQ ID NO: 4289841 - DNA, 16 bp, Homo sapiens
atcaagtcccgaggca

SEQ ID NO: 4289842 - DNA, 14 bp, Homo sapiens
atcaagtctgtgaa

SEQ ID NO: 4289843 - DNA, 14 bp, Homo sapiens
atcacaacttttct

SEQ ID NO: 4289844 - DNA, 15 bp, Homo sapiens
atcacaacttttctg

SEQ ID NO: 4289845 - DNA, 21 bp, Homo sapiens
atcacacccagcccatgtggc

SEQ ID NO: 4289846 - DNA, 17 bp, Homo sapiens
atcacctaattaatttc

SEQ ID NO: 4289847 - DNA, 12 bp, Homo sapiens
atcacctcccct

SEQ ID NO: 4289848 - DNA, 13 bp, Homo sapiens
atcactcattaat

SEQ ID NO: 4289849 - DNA, 22 bp, Homo sapiens
atcactgtgcagttgctgttta

SEQ ID NO: 4289850 - DNA, 17 bp, Homo sapiens
atcagaatctttaaaga

SEQ ID NO: 4289851 - DNA, 17 bp, Homo sapiens
atcagagaagcagcatc

SEQ ID NO: 4289852 - DNA, 15 bp, Homo sapiens
atcagaggtatctta

SEQ ID NO: 4289853 - DNA, 11 bp, Homo sapiens
atcagcagtga

SEQ ID NO: 4289854 - DNA, 22 bp, Homo sapiens
atcagcattcaaaatagttcta

SEQ ID NO: 4289855 - DNA, 13 bp, Homo sapiens
atcagctagattt

SEQ ID NO: 4289856 - DNA, 19 bp, Homo sapiens
atcagtaaaattatactgt

SEQ ID NO: 4289857 - DNA, 21 bp, Homo sapiens
atcagtaaaattatactgtgt

SEQ ID NO: 4289858 - DNA, 16 bp, Homo sapiens
atcagtcctagaatgt

SEQ ID NO: 4289859 - DNA, 22 bp, Homo sapiens
atcagtcctagaatgtttcatt

SEQ ID NO: 4289860 - DNA, 15 bp, Homo sapiens
atcagtgatgggagt

SEQ ID NO: 4289861 - DNA, 14 bp, Homo sapiens
atcagtgtttatgt

SEQ ID NO: 4289862 - DNA, 23 bp, Homo sapiens
atcataaaaggtgacccttctgt

SEQ ID NO: 4289863 - DNA, 16 bp, Homo sapiens
atcataaggtcttatt

SEQ ID NO: 4289864 - DNA, 21 bp, Homo sapiens
atcatcttgaacattaatcca

SEQ ID NO: 4289865 - DNA, 18 bp, Homo sapiens
atcatgacttctttacta

SEQ ID NO: 4289866 - DNA, 18 bp, Homo sapiens
atcatgcacacaattaga

SEQ ID NO: 4289867 - DNA, 18 bp, Homo sapiens
atcatgggggatttttca

SEQ ID NO: 4289868 - DNA, 23 bp, Homo sapiens
atcatgtaatagtggctttcatt

SEQ ID NO: 4289869 - DNA, 16 bp, Homo sapiens
atcatgtctattgtcc

SEQ ID NO: 4289870 - DNA, 15 bp, Homo sapiens
atcattatttcatga

SEQ ID NO: 4289871 - DNA, 15 bp, Homo sapiens
atcatttcttgggcc

SEQ ID NO: 4289872 - DNA, 18 bp, Homo sapiens
atcatttcttgggccctc

SEQ ID NO: 4289873 - DNA, 22 bp, Homo sapiens
atcatttcttgggccctcctga

SEQ ID NO: 4289874 - DNA, 14 bp, Homo sapiens
atcattttcctggg

SEQ ID NO: 4289875 - DNA, 21 bp, Homo sapiens
atccaacctctttcctctctg

SEQ ID NO: 4289876 - DNA, 16 bp, Homo sapiens
atccacatgtttcaga

SEQ ID NO: 4289877 - DNA, 16 bp, Homo sapiens
atccactaggtgccca

SEQ ID NO: 4289878 - DNA, 23 bp, Homo sapiens
atccactaggtgcccagtcttga

SEQ ID NO: 4289879 - DNA, 20 bp, Homo sapiens
atccagagggttgtgatttt

SEQ ID NO: 4289880 - DNA, 11 bp, Homo sapiens
atccatacaaa

SEQ ID NO: 4289881 - DNA, 16 bp, Homo sapiens
atccatacaaaactat

SEQ ID NO: 4289882 - DNA, 15 bp, Homo sapiens
atccataccccctgc

SEQ ID NO: 4289883 - DNA, 17 bp, Homo sapiens
atccataccccctgccc

SEQ ID NO: 4289884 - DNA, 19 bp, Homo sapiens
atccataccccctgcccca

SEQ ID NO: 4289885 - DNA, 20 bp, Homo sapiens
atccatccctggtgaaagag

SEQ ID NO: 4289886 - DNA, 19 bp, Homo sapiens
atccatgcggccggcctgg

SEQ ID NO: 4289887 - DNA, 17 bp, Homo sapiens
atccatgtgctgctgtg

SEQ ID NO: 4289888 - DNA, 12 bp, Homo sapiens
atccattttcta

SEQ ID NO: 4289889 - DNA, 15 bp, Homo sapiens
atcccatccctttct

SEQ ID NO: 4289890 - DNA, 23 bp, Homo sapiens
atccccagccccctggcccctcc

SEQ ID NO: 4289891 - DNA, 14 bp, Homo sapiens
atccccctccttgc

SEQ ID NO: 4289892 - DNA, 16 bp, Homo sapiens
atccccgacagtggct

SEQ ID NO: 4289893 - DNA, 17 bp, Homo sapiens
atccccgacagtggctc

SEQ ID NO: 4289894 - DNA, 19 bp, Homo sapiens
atccccgacagtggctctc

SEQ ID NO: 4289895 - DNA, 16 bp, Homo sapiens
atccccgtgctcacag

SEQ ID NO: 4289896 - DNA, 19 bp, Homo sapiens
atccccgtgctcacagtag

SEQ ID NO: 4289897 - DNA, 15 bp, Homo sapiens
atcccctcctagcac

SEQ ID NO: 4289898 - DNA, 15 bp, Homo sapiens
atcccggggccatgg

SEQ ID NO: 4289899 - DNA, 22 bp, Homo sapiens
atcccggggccatggaagctgg

SEQ ID NO: 4289900 - DNA, 14 bp, Homo sapiens
atccctagctgtga

SEQ ID NO: 4289901 - DNA, 17 bp, Homo sapiens
atccctccaccccagtc

SEQ ID NO: 4289902 - DNA, 15 bp, Homo sapiens
atccctccttaagag

SEQ ID NO: 4289903 - DNA, 18 bp, Homo sapiens
atcccttggcccctctct

SEQ ID NO: 4289904 - DNA, 21 bp, Homo sapiens
atccctttctaagcaggaagg

SEQ ID NO: 4289905 - DNA, 20 bp, Homo sapiens
atccgtaccatcggtcagca

SEQ ID NO: 4289906 - DNA, 16 bp, Homo sapiens
atcctcagccccaggg

SEQ ID NO: 4289907 - DNA, 19 bp, Homo sapiens
atcctcagccccagggccc

SEQ ID NO: 4289908 - DNA, 22 bp, Homo sapiens
atcctcagccccagggccctgc

SEQ ID NO: 4289909 - DNA, 11 bp, Homo sapiens
atcctcccctt

SEQ ID NO: 4289910 - DNA, 13 bp, Homo sapiens
atcctccttccag

SEQ ID NO: 4289911 - DNA, 17 bp, Homo sapiens
atcctccttccaggccc

SEQ ID NO: 4289912 - DNA, 23 bp, Homo sapiens
atcctccttccaggccccaggct

SEQ ID NO: 4289913 - DNA, 14 bp, Homo sapiens
atcctgcaccctct

SEQ ID NO: 4289914 - DNA, 15 bp, Homo sapiens
atcctgcaccctctg

SEQ ID NO: 4289915 - DNA, 22 bp, Homo sapiens
atcctgggcatccccagccccc

SEQ ID NO: 4289916 - DNA, 16 bp, Homo sapiens
atcctggtgtctagtt

SEQ ID NO: 4289917 - DNA, 18 bp, Homo sapiens
atcctgtcaatgtttgct

SEQ ID NO: 4289918 - DNA, 19 bp, Homo sapiens
atcctgttaggggaaaata

SEQ ID NO: 4289919 - DNA, 23 bp, Homo sapiens
atccttcaaagtctcaatgaaat

SEQ ID NO: 4289920 - DNA, 17 bp, Homo sapiens
atcgatgttaaacgtca

SEQ ID NO: 4289921 - DNA, 21 bp, Homo sapiens
atcgatgttaaacgtcacagc

SEQ ID NO: 4289922 - DNA, 21 bp, Homo sapiens
atcggaggcttgtcagagctg

SEQ ID NO: 4289923 - DNA, 22 bp, Homo sapiens
atcggaggcttgtcagagctgg

SEQ ID NO: 4289924 - DNA, 21 bp, Homo sapiens
atcggcaacagggcttctctt

SEQ ID NO: 4289925 - DNA, 15 bp, Homo sapiens
atcgttatcactgtg

SEQ ID NO: 4289926 - DNA, 14 bp, Homo sapiens
atctaaaaaataac

SEQ ID NO: 4289927 - DNA, 22 bp, Homo sapiens
atctagcaagaagattctaaaa

SEQ ID NO: 4289928 - DNA, 17 bp, Homo sapiens
atctatataaatcgcat

SEQ ID NO: 4289929 - DNA, 21 bp, Homo sapiens
atctatctggtgatttctagc

SEQ ID NO: 4289930 - DNA, 16 bp, Homo sapiens
atctatgcattttctg

SEQ ID NO: 4289931 - DNA, 18 bp, Homo sapiens
atctatttatctgtctga

SEQ ID NO: 4289932 - DNA, 17 bp, Homo sapiens
atctcactttaataata

SEQ ID NO: 4289933 - DNA, 19 bp, Homo sapiens
atctcacttttctccatga

SEQ ID NO: 4289934 - DNA, 14 bp, Homo sapiens
atctcaggccacct

SEQ ID NO: 4289935 - DNA, 19 bp, Homo sapiens
atctcaggccacctgcccc

SEQ ID NO: 4289936 - DNA, 20 bp, Homo sapiens
atctcaggccacctgccccc

SEQ ID NO: 4289937 - DNA, 10 bp, Homo sapiens
atctccaggc

SEQ ID NO: 4289938 - DNA, 11 bp, Homo sapiens
atctccaggcc

SEQ ID NO: 4289939 - DNA, 16 bp, Homo sapiens
atctccaggcccagcc

SEQ ID NO: 4289940 - DNA, 23 bp, Homo sapiens
atctccaggcccagcctggcccc

SEQ ID NO: 4289941 - DNA, 21 bp, Homo sapiens
atctctaaaattctagtctct

SEQ ID NO: 4289942 - DNA, 22 bp, Homo sapiens
atctctactttcctgatgttga

SEQ ID NO: 4289943 - DNA, 20 bp, Homo sapiens
atctcttaagacagcatgtg

SEQ ID NO: 4289944 - DNA, 21 bp, Homo sapiens
atctcttaagacagcatgtgt

SEQ ID NO: 4289945 - DNA, 17 bp, Homo sapiens
atctcttcttatacaga

SEQ ID NO: 4289946 - DNA, 14 bp, Homo sapiens
atctcttcttttaa

SEQ ID NO: 4289947 - DNA, 15 bp, Homo sapiens
atctctttctaaaga

SEQ ID NO: 4289948 - DNA, 12 bp, Homo sapiens
atctgaaaagaa

SEQ ID NO: 4289949 - DNA, 15 bp, Homo sapiens
atctgaaaagaaatg

SEQ ID NO: 4289950 - DNA, 17 bp, Homo sapiens
atctgaaacacagtcat

SEQ ID NO: 4289951 - DNA, 18 bp, Homo sapiens
atctgattggacattttc

SEQ ID NO: 4289952 - DNA, 19 bp, Homo sapiens
atctgattggacattttct

SEQ ID NO: 4289953 - DNA, 13 bp, Homo sapiens
atctgcaaatagt

SEQ ID NO: 4289954 - DNA, 21 bp, Homo sapiens
atctgctgacagatgttccat

SEQ ID NO: 4289955 - DNA, 20 bp, Homo sapiens
atctgctgagctctgacctg

SEQ ID NO: 4289956 - DNA, 20 bp, Homo sapiens
atctgctgcctctgaaaata

SEQ ID NO: 4289957 - DNA, 15 bp, Homo sapiens
atctggattcaaatt

SEQ ID NO: 4289958 - DNA, 12 bp, Homo sapiens
atctggccctgc

SEQ ID NO: 4289959 - DNA, 13 bp, Homo sapiens
atctggccctgct

SEQ ID NO: 4289960 - DNA, 17 bp, Homo sapiens
atctggccctgctgccc

SEQ ID NO: 4289961 - DNA, 16 bp, Homo sapiens
atctggtattaaatgc

SEQ ID NO: 4289962 - DNA, 14 bp, Homo sapiens
atctggtgatttct

SEQ ID NO: 4289963 - DNA, 21 bp, Homo sapiens
atctgtaaatttaactgcata

SEQ ID NO: 4289964 - DNA, 23 bp, Homo sapiens
atctgtaaatttaactgcatata

SEQ ID NO: 4289965 - DNA, 15 bp, Homo sapiens
atctgtataatactt

SEQ ID NO: 4289966 - DNA, 16 bp, Homo sapiens
atctgtataatacttt

SEQ ID NO: 4289967 - DNA, 18 bp, Homo sapiens
atctgtataatactttgt

SEQ ID NO: 4289968 - DNA, 16 bp, Homo sapiens
atctgtctgagccctg

SEQ ID NO: 4289969 - DNA, 17 bp, Homo sapiens
atctgtctgagccctgc

SEQ ID NO: 4289970 - DNA, 18 bp, Homo sapiens
atctgtctgagccctgcc

SEQ ID NO: 4289971 - DNA, 22 bp, Homo sapiens
atctgtctgagccctgccctca

SEQ ID NO: 4289972 - DNA, 12 bp, Homo sapiens
atctgtctgatt

SEQ ID NO: 4289973 - DNA, 11 bp, Homo sapiens
atctgtgaaat

SEQ ID NO: 4289974 - DNA, 16 bp, Homo sapiens
atctgtgaaatatcat

SEQ ID NO: 4289975 - DNA, 13 bp, Homo sapiens
atcttatttatat

SEQ ID NO: 4289976 - DNA, 17 bp, Homo sapiens
atcttatttatatatga

SEQ ID NO: 4289977 - DNA, 14 bp, Homo sapiens
atcttcatgtaaat

SEQ ID NO: 4289978 - DNA, 21 bp, Homo sapiens
atcttcgttagtaatctgtat

SEQ ID NO: 4289979 - DNA, 17 bp, Homo sapiens
atcttgaagaatattgt

SEQ ID NO: 4289980 - DNA, 22 bp, Homo sapiens
atcttgggaccaaaactgccta

SEQ ID NO: 4289981 - DNA, 14 bp, Homo sapiens
atctttcagttatt

SEQ ID NO: 4289982 - DNA, 15 bp, Homo sapiens
atcttttctgaggtt

SEQ ID NO: 4289983 - DNA, 16 bp, Homo sapiens
atgaaagtcagtttaa

SEQ ID NO: 4289984 - DNA, 18 bp, Homo sapiens
atgaaagttaatttgaat

SEQ ID NO: 4289985 - DNA, 20 bp, Homo sapiens
atgaaataaattggtgataa

SEQ ID NO: 4289986 - DNA, 23 bp, Homo sapiens
atgaaattttaccattttgcgat

SEQ ID NO: 4289987 - DNA, 15 bp, Homo sapiens
atgaagaacataaaa

SEQ ID NO: 4289988 - DNA, 21 bp, Homo sapiens
atgaagaagaaaacatgtctg

SEQ ID NO: 4289989 - DNA, 17 bp, Homo sapiens
atgaagagctagagaaa

SEQ ID NO: 4289990 - DNA, 18 bp, Homo sapiens
atgaagagctagagaaat

SEQ ID NO: 4289991 - DNA, 20 bp, Homo sapiens
atgaataatgcctttgtaac

SEQ ID NO: 4289992 - DNA, 23 bp, Homo sapiens
atgaataattatgtttacctcac

SEQ ID NO: 4289993 - DNA, 17 bp, Homo sapiens
atgaatagtacatgcag

SEQ ID NO: 4289994 - DNA, 16 bp, Homo sapiens
atgacaagccccaggc

SEQ ID NO: 4289995 - DNA, 23 bp, Homo sapiens
atgacaatttcaaaatgcatgtg

SEQ ID NO: 4289996 - DNA, 16 bp, Homo sapiens
atgacacataaatctg

SEQ ID NO: 4289997 - DNA, 16 bp, Homo sapiens
atgacagggagctggg

SEQ ID NO: 4289998 - DNA, 17 bp, Homo sapiens
atgacatttctcaaagt

SEQ ID NO: 4289999 - DNA, 20 bp, Homo sapiens
atgaccataaaattagacat

SEQ ID NO: 4290000 - DNA, 14 bp, Homo sapiens
atgacctaaatcca

SEQ ID NO: 4290001 - DNA, 16 bp, Homo sapiens
atgacctcaacaaaga

SEQ ID NO: 4290002 - DNA, 19 bp, Homo sapiens
atgacgtattgtgaaattt

SEQ ID NO: 4290003 - DNA, 20 bp, Homo sapiens
atgactggtgcgttcctaaa

SEQ ID NO: 4290004 - DNA, 20 bp, Homo sapiens
caacttttcctttgaatcct

SEQ ID NO: 4290005 - DNA, 13 bp, Homo sapiens
caagaacaaacag

SEQ ID NO: 4290006 - DNA, 17 bp, Homo sapiens
caagaagaatataaata

SEQ ID NO: 4290007 - DNA, 18 bp, Homo sapiens
caagaagaatataaataa

SEQ ID NO: 4290008 - DNA, 15 bp, Homo sapiens
caagaagattctaaa

SEQ ID NO: 4290009 - DNA, 18 bp, Homo sapiens
caagaagattctaaaaca

SEQ ID NO: 4290010 - DNA, 19 bp, Homo sapiens
caagaagattctaaaacat

SEQ ID NO: 4290011 - DNA, 12 bp, Homo sapiens
caagacacccag

SEQ ID NO: 4290012 - DNA, 13 bp, Homo sapiens
caagacacccagt

SEQ ID NO: 4290013 - DNA, 22 bp, Homo sapiens
caagacagcagagccatctgcg

SEQ ID NO: 4290014 - DNA, 15 bp, Homo sapiens
caagagaattcactt

SEQ ID NO: 4290015 - DNA, 15 bp, Homo sapiens
caagagggcactggt

SEQ ID NO: 4290016 - DNA, 18 bp, Homo sapiens
caagagggcactggtggc

SEQ ID NO: 4290017 - DNA, 13 bp, Homo sapiens
caagattcagcta

SEQ ID NO: 4290018 - DNA, 22 bp, Homo sapiens
caagcacctgggtgtgctccag

SEQ ID NO: 4290019 - DNA, 15 bp, Homo sapiens
caagcatcagcaaga

SEQ ID NO: 4290020 - DNA, 15 bp, Homo sapiens
caagccaaacattct

SEQ ID NO: 4290021 - DNA, 12 bp, Homo sapiens
caagccaggaga

SEQ ID NO: 4290022 - DNA, 13 bp, Homo sapiens
caagccaggagac

SEQ ID NO: 4290023 - DNA, 16 bp, Homo sapiens
caagccagggttccag

SEQ ID NO: 4290024 - DNA, 19 bp, Homo sapiens
caagccagggttccagaca

SEQ ID NO: 4290025 - DNA, 20 bp, Homo sapiens
caagccagggttccagacag

SEQ ID NO: 4290026 - DNA, 22 bp, Homo sapiens
caagcccaggacactgcctttg

SEQ ID NO: 4290027 - DNA, 16 bp, Homo sapiens
caagccgtggcttccc

SEQ ID NO: 4290028 - DNA, 11 bp, Homo sapiens
caagcctcagc

SEQ ID NO: 4290029 - DNA, 13 bp, Homo sapiens
caagcctcagcca

SEQ ID NO: 4290030 - DNA, 15 bp, Homo sapiens
caagcctcagccact

SEQ ID NO: 4290031 - DNA, 13 bp, Homo sapiens
caagcctgccccg

SEQ ID NO: 4290032 - DNA, 16 bp, Homo sapiens
caagcctgccccggcc

SEQ ID NO: 4290033 - DNA, 18 bp, Homo sapiens
caagcctgccccggccac

SEQ ID NO: 4290034 - DNA, 19 bp, Homo sapiens
caagcctgccccggccact

SEQ ID NO: 4290035 - DNA, 14 bp, Homo sapiens
caagcctgggccac

SEQ ID NO: 4290036 - DNA, 16 bp, Homo sapiens
caagcctgggccactg

SEQ ID NO: 4290037 - DNA, 22 bp, Homo sapiens
caagcctgggccactggcatct

SEQ ID NO: 4290038 - DNA, 13 bp, Homo sapiens
caagctcaccctg

SEQ ID NO: 4290039 - DNA, 17 bp, Homo sapiens
caagctcaccctgctcc

SEQ ID NO: 4290040 - DNA, 18 bp, Homo sapiens
caagctcaccctgctcct

SEQ ID NO: 4290041 - DNA, 17 bp, Homo sapiens
caagctggcaggagggt

SEQ ID NO: 4290042 - DNA, 18 bp, Homo sapiens
caagctggccgtggagtc

SEQ ID NO: 4290043 - DNA, 15 bp, Homo sapiens
caagcttagaagcca

SEQ ID NO: 4290044 - DNA, 18 bp, Homo sapiens
caaggaagggatgtattt

SEQ ID NO: 4290045 - DNA, 15 bp, Homo sapiens
caaggacccctcacc

SEQ ID NO: 4290046 - DNA, 20 bp, Homo sapiens
caaggacccctcaccttgca

SEQ ID NO: 4290047 - DNA, 18 bp, Homo sapiens
caaggagtgcccgccttg

SEQ ID NO: 4290048 - DNA, 16 bp, Homo sapiens
caaggcaaatgtccaa

SEQ ID NO: 4290049 - DNA, 15 bp, Homo sapiens
caaggcaagaagtgg

SEQ ID NO: 4290050 - DNA, 17 bp, Homo sapiens
caaggccccagagactc

SEQ ID NO: 4290051 - DNA, 18 bp, Homo sapiens
caaggcctatgccacctg

SEQ ID NO: 4290052 - DNA, 23 bp, Homo sapiens
caaggcctatgccacctgcagcg

SEQ ID NO: 4290053 - DNA, 16 bp, Homo sapiens
caaggcctccagccac

SEQ ID NO: 4290054 - DNA, 16 bp, Homo sapiens
caaggctgaaaagtgc

SEQ ID NO: 4290055 - DNA, 12 bp, Homo sapiens
caaggctgcctg

SEQ ID NO: 4290056 - DNA, 15 bp, Homo sapiens
caaggggccctagga

SEQ ID NO: 4290057 - DNA, 18 bp, Homo sapiens
caaggggtctgctcctgt

SEQ ID NO: 4290058 - DNA, 21 bp, Homo sapiens
caaggggtctgctcctgtggc

SEQ ID NO: 4290059 - DNA, 21 bp, Homo sapiens
caagggtggcatcccagtggc

SEQ ID NO: 4290060 - DNA, 15 bp, Homo sapiens
caaggtggtcttgga

SEQ ID NO: 4290061 - DNA, 19 bp, Homo sapiens
caaggtggtcttggagagg

SEQ ID NO: 4290062 - DNA, 20 bp, Homo sapiens
caaggtggtcttggagagga

SEQ ID NO: 4290063 - DNA, 22 bp, Homo sapiens
caaggtggtcttggagaggagg

SEQ ID NO: 4290064 - DNA, 19 bp, Homo sapiens
caagtatgaataaagacac

SEQ ID NO: 4290065 - DNA, 21 bp, Homo sapiens
caagtatgaataaagacacct

SEQ ID NO: 4290066 - DNA, 17 bp, Homo sapiens
caagtatgttttagcat

SEQ ID NO: 4290067 - DNA, 23 bp, Homo sapiens
caagtattactaaattgaccttt

SEQ ID NO: 4290068 - DNA, 19 bp, Homo sapiens
caagtcccagggagctctg

SEQ ID NO: 4290069 - DNA, 17 bp, Homo sapiens
caagtcccgaggcagca

SEQ ID NO: 4290070 - DNA, 13 bp, Homo sapiens
caagtctgtgaaa

SEQ ID NO: 4290071 - DNA, 17 bp, Homo sapiens
caagtgacgaaaacatt

SEQ ID NO: 4290072 - DNA, 13 bp, Homo sapiens
caagtgcaggctg

SEQ ID NO: 4290073 - DNA, 21 bp, Homo sapiens
caagtggttaagaatgtatat

SEQ ID NO: 4290074 - DNA, 22 bp, Homo sapiens
caagtggttaagaatgtatatc

SEQ ID NO: 4290075 - DNA, 16 bp, Homo sapiens
caagtgtgcctgctat

SEQ ID NO: 4290076 - DNA, 21 bp, Homo sapiens
caagtgtgcctgctatccagc

SEQ ID NO: 4290077 - DNA, 22 bp, Homo sapiens
caagttaatgtactttcattcc

SEQ ID NO: 4290078 - DNA, 21 bp, Homo sapiens
caagtttattgccctcaaaat

SEQ ID NO: 4290079 - DNA, 22 bp, Homo sapiens
caataattgtggagaggagaga

SEQ ID NO: 4290080 - DNA, 19 bp, Homo sapiens
caatacttttgtgtattct

SEQ ID NO: 4290081 - DNA, 18 bp, Homo sapiens
caatagcgtgtgtagata

SEQ ID NO: 4290082 - DNA, 10 bp, Homo sapiens
caatatgagg

SEQ ID NO: 4290083 - DNA, 22 bp, Homo sapiens
caatatgaggggactgcatgca

SEQ ID NO: 4290084 - DNA, 18 bp, Homo sapiens
caatccaacccatgcatg

SEQ ID NO: 4290085 - DNA, 22 bp, Homo sapiens
caatcccaccaaccctcagagc

SEQ ID NO: 4290086 - DNA, 20 bp, Homo sapiens
caatcttaacaaaagtgaac

SEQ ID NO: 4290087 - DNA, 12 bp, Homo sapiens
caatcttatgtt

SEQ ID NO: 4290088 - DNA, 22 bp, Homo sapiens
caatgaaatatttgcttattta

SEQ ID NO: 4290089 - DNA, 19 bp, Homo sapiens
caatgattgtttaattgta

SEQ ID NO: 4290090 - DNA, 20 bp, Homo sapiens
caatgcctattgtaatatag

SEQ ID NO: 4290091 - DNA, 22 bp, Homo sapiens
caatgctagcacaatattccta

SEQ ID NO: 4290092 - DNA, 12 bp, Homo sapiens
caatggccagcc

SEQ ID NO: 4290093 - DNA, 14 bp, Homo sapiens
caatggccagccca

SEQ ID NO: 4290094 - DNA, 18 bp, Homo sapiens
caatggcgcagtgcctct

SEQ ID NO: 4290095 - DNA, 23 bp, Homo sapiens
caatggtgaactgtcattacaga

SEQ ID NO: 4290096 - DNA, 20 bp, Homo sapiens
caatgtggaaaaaatatttt

SEQ ID NO: 4290097 - DNA, 14 bp, Homo sapiens
caatgtttgcttta

SEQ ID NO: 4290098 - DNA, 21 bp, Homo sapiens
caattaagttattaacatttg

SEQ ID NO: 4290099 - DNA, 19 bp, Homo sapiens
caattcaactttttatttt

SEQ ID NO: 4290100 - DNA, 14 bp, Homo sapiens
caattcttttgaaa

SEQ ID NO: 4290101 - DNA, 16 bp, Homo sapiens
caattcttttgaaaga

SEQ ID NO: 4290102 - DNA, 12 bp, Homo sapiens
caatttcaaaat

SEQ ID NO: 4290103 - DNA, 18 bp, Homo sapiens
caatttcaaaatgcatgt

SEQ ID NO: 4290104 - DNA, 15 bp, Homo sapiens
caattttaaaaaata

SEQ ID NO: 4290105 - DNA, 22 bp, Homo sapiens
caatttttacacaaacctgaaa

SEQ ID NO: 4290106 - DNA, 17 bp, Homo sapiens
cacaaataccagagcac

SEQ ID NO: 4290107 - DNA, 18 bp, Homo sapiens
cacaaataccagagcaca

SEQ ID NO: 4290108 - DNA, 11 bp, Homo sapiens
cacaaatgtcc

SEQ ID NO: 4290109 - DNA, 18 bp, Homo sapiens
cacaaccttctgtggctc

SEQ ID NO: 4290110 - DNA, 22 bp, Homo sapiens
cacaagaagtgggagtgggaga

SEQ ID NO: 4290111 - DNA, 23 bp, Homo sapiens
cacaagcagagtgcacagctgtc

SEQ ID NO: 4290112 - DNA, 13 bp, Homo sapiens
cacaagccacgcc

SEQ ID NO: 4290113 - DNA, 15 bp, Homo sapiens
cacaagccacgcctg

SEQ ID NO: 4290114 - DNA, 18 bp, Homo sapiens
cacaagccacgcctgcga

SEQ ID NO: 4290115 - DNA, 16 bp, Homo sapiens
cacaaggagtgcccgc

SEQ ID NO: 4290116 - DNA, 18 bp, Homo sapiens
cacaaggctgaaaagtgc

SEQ ID NO: 4290117 - DNA, 22 bp, Homo sapiens
cacaaggctgaaaagtgctttg

SEQ ID NO: 4290118 - DNA, 17 bp, Homo sapiens
cacaattagatttctca

SEQ ID NO: 4290119 - DNA, 13 bp, Homo sapiens
cacaattctgtcc

SEQ ID NO: 4290120 - DNA, 16 bp, Homo sapiens
cacaattctgtccctg

SEQ ID NO: 4290121 - DNA, 18 bp, Homo sapiens
cacaattctgtccctgtc

SEQ ID NO: 4290122 - DNA, 14 bp, Homo sapiens
cacacaagacagca

SEQ ID NO: 4290123 - DNA, 13 bp, Homo sapiens
cacacacacacac

SEQ ID NO: 4290124 - DNA, 14 bp, Homo sapiens
cacacacacaggag

SEQ ID NO: 4290125 - DNA, 11 bp, Homo sapiens
cacacacactc

SEQ ID NO: 4290126 - DNA, 12 bp, Homo sapiens
cacacacactct

SEQ ID NO: 4290127 - DNA, 14 bp, Homo sapiens
cacacacccttccc

SEQ ID NO: 4290128 - DNA, 12 bp, Homo sapiens
cacacacctgca

SEQ ID NO: 4290129 - DNA, 22 bp, Homo sapiens
cacacacctgcacacccctgca

SEQ ID NO: 4290130 - DNA, 17 bp, Homo sapiens
cacacaggcccatgccc

SEQ ID NO: 4290131 - DNA, 16 bp, Homo sapiens
cacacaggcctggccc

SEQ ID NO: 4290132 - DNA, 21 bp, Homo sapiens
cacacaggcctggcccagcca

SEQ ID NO: 4290133 - DNA, 22 bp, Homo sapiens
cacacaggcctggcccagccag

SEQ ID NO: 4290134 - DNA, 23 bp, Homo sapiens
cacacaggcctggcccagccagc

SEQ ID NO: 4290135 - DNA, 14 bp, Homo sapiens
cacaccagccctgg

SEQ ID NO: 4290136 - DNA, 16 bp, Homo sapiens
cacacccctgcacaca

SEQ ID NO: 4290137 - DNA, 22 bp, Homo sapiens
cacacccctgcacacacctgca

SEQ ID NO: 4290138 - DNA, 17 bp, Homo sapiens
attcttaggctttcagt

SEQ ID NO: 4290139 - DNA, 23 bp, Homo sapiens
attcttccatctgattgtgatgt

SEQ ID NO: 4290140 - DNA, 18 bp, Homo sapiens
attcttttcagcttgttt

SEQ ID NO: 4290141 - DNA, 21 bp, Homo sapiens
attgaaaatagtaaatgcttt

SEQ ID NO: 4290142 - DNA, 23 bp, Homo sapiens
attgaagagagatatatctgaaa

SEQ ID NO: 4290143 - DNA, 14 bp, Homo sapiens
attgaagtcatcat

SEQ ID NO: 4290144 - DNA, 17 bp, Homo sapiens
attgaagtcatcataaa

SEQ ID NO: 4290145 - DNA, 14 bp, Homo sapiens
attgaatgttatat

SEQ ID NO: 4290146 - DNA, 16 bp, Homo sapiens
attgaatgttatatca

SEQ ID NO: 4290147 - DNA, 20 bp, Homo sapiens
attgacctttaggtattaca

SEQ ID NO: 4290148 - DNA, 18 bp, Homo sapiens
attgagcagaattcattc

SEQ ID NO: 4290149 - DNA, 22 bp, Homo sapiens
attgagggaaaacataatatct

SEQ ID NO: 4290150 - DNA, 18 bp, Homo sapiens
attgagttctgaaggttg

SEQ ID NO: 4290151 - DNA, 17 bp, Homo sapiens
attgagttcttcctgta

SEQ ID NO: 4290152 - DNA, 13 bp, Homo sapiens
attgatagaataa

SEQ ID NO: 4290153 - DNA, 19 bp, Homo sapiens
attgcaaaaggttaagcca

SEQ ID NO: 4290154 - DNA, 19 bp, Homo sapiens
attgcacacacagtctgtt

SEQ ID NO: 4290155 - DNA, 20 bp, Homo sapiens
attgcacacacagtctgttc

SEQ ID NO: 4290156 - DNA, 14 bp, Homo sapiens
attgcagaagaaac

SEQ ID NO: 4290157 - DNA, 15 bp, Homo sapiens
attgcagaagaaact

SEQ ID NO: 4290158 - DNA, 19 bp, Homo sapiens
attgcagaagaaactcctg

SEQ ID NO: 4290159 - DNA, 20 bp, Homo sapiens
attgcccacacctgcctctg

SEQ ID NO: 4290160 - DNA, 22 bp, Homo sapiens
attgcccacacctgcctctgaa

SEQ ID NO: 4290161 - DNA, 17 bp, Homo sapiens
attgccctgaggggcct

SEQ ID NO: 4290162 - DNA, 16 bp, Homo sapiens
attggcagcttcaaaa

SEQ ID NO: 4290163 - DNA, 23 bp, Homo sapiens
attggcagcttcaaaacagaacg

SEQ ID NO: 4290164 - DNA, 17 bp, Homo sapiens
attggcaggtgtgggct

SEQ ID NO: 4290165 - DNA, 20 bp, Homo sapiens
attggcaggtgtgggctccc

SEQ ID NO: 4290166 - DNA, 18 bp, Homo sapiens
attgggcaagtgattgaa

SEQ ID NO: 4290167 - DNA, 13 bp, Homo sapiens
attggtgataagt

SEQ ID NO: 4290168 - DNA, 18 bp, Homo sapiens
attggtgtgaatgctgta

SEQ ID NO: 4290169 - DNA, 21 bp, Homo sapiens
attggtgtgaatgctgtacct

SEQ ID NO: 4290170 - DNA, 15 bp, Homo sapiens
attggttaatcactt

SEQ ID NO: 4290171 - DNA, 16 bp, Homo sapiens
attgtaacttatttca

SEQ ID NO: 4290172 - DNA, 15 bp, Homo sapiens
attgtaatatagaaa

SEQ ID NO: 4290173 - DNA, 22 bp, Homo sapiens
attgtaatatagaaaaaaacat

SEQ ID NO: 4290174 - DNA, 21 bp, Homo sapiens
attgtagagtgcccatggggt

SEQ ID NO: 4290175 - DNA, 17 bp, Homo sapiens
attgtataaaacagtgt

SEQ ID NO: 4290176 - DNA, 20 bp, Homo sapiens
attgtataaaacagtgtttc

SEQ ID NO: 4290177 - DNA, 22 bp, Homo sapiens
attgtataaaacagtgtttcca

SEQ ID NO: 4290178 - DNA, 16 bp, Homo sapiens
attgtatatatggata

SEQ ID NO: 4290179 - DNA, 13 bp, Homo sapiens
attgtattgttag

SEQ ID NO: 4290180 - DNA, 13 bp, Homo sapiens
attgtattttact

SEQ ID NO: 4290181 - DNA, 20 bp, Homo sapiens
attgtattttactttgtgca

SEQ ID NO: 4290182 - DNA, 21 bp, Homo sapiens
attgtattttactttgtgcaa

SEQ ID NO: 4290183 - DNA, 22 bp, Homo sapiens
attgtattttactttgtgcaat

SEQ ID NO: 4290184 - DNA, 17 bp, Homo sapiens
attgtccacaaatgtcc

SEQ ID NO: 4290185 - DNA, 13 bp, Homo sapiens
attgtctgtaaat

SEQ ID NO: 4290186 - DNA, 18 bp, Homo sapiens
attgtcttttgtcatgtg

SEQ ID NO: 4290187 - DNA, 20 bp, Homo sapiens
attgtcttttgtcatgtggc

SEQ ID NO: 4290188 - DNA, 14 bp, Homo sapiens
attgtgaaatttgt

SEQ ID NO: 4290189 - DNA, 17 bp, Homo sapiens
attgtgaaatttgttaa

SEQ ID NO: 4290190 - DNA, 18 bp, Homo sapiens
attgtggagaggagagaa

SEQ ID NO: 4290191 - DNA, 18 bp, Homo sapiens
attgtggtgtgagcttca

SEQ ID NO: 4290192 - DNA, 24 bp, Homo sapiens
attgtgtaaattcctgttgtctga

SEQ ID NO: 4290193 - DNA, 13 bp, Homo sapiens
attgttaaaacct

SEQ ID NO: 4290194 - DNA, 19 bp, Homo sapiens
attgttaaaaccttactta

SEQ ID NO: 4290195 - DNA, 16 bp, Homo sapiens
attgttagatgtttgt

SEQ ID NO: 4290196 - DNA, 23 bp, Homo sapiens
attgtttttagaaatttattctt

SEQ ID NO: 4290197 - DNA, 19 bp, Homo sapiens
atttaaaaaatgaatagta

SEQ ID NO: 4290198 - DNA, 17 bp, Homo sapiens
atttaaaatagttttct

SEQ ID NO: 4290199 - DNA, 22 bp, Homo sapiens
atttaaaatagttttctaaatg

SEQ ID NO: 4290200 - DNA, 16 bp, Homo sapiens
atttaaatttaagtaa

SEQ ID NO: 4290201 - DNA, 21 bp, Homo sapiens
atttaaattttcagaaagcat

SEQ ID NO: 4290202 - DNA, 18 bp, Homo sapiens
atttaactactaagaata

SEQ ID NO: 4290203 - DNA, 22 bp, Homo sapiens
atttaactactaagaataaata

SEQ ID NO: 4290204 - DNA, 14 bp, Homo sapiens
atttaactgcatat

SEQ ID NO: 4290205 - DNA, 22 bp, Homo sapiens
atttaagaattgccagtctttt

SEQ ID NO: 4290206 - DNA, 20 bp, Homo sapiens
atttaatagataaagtgcct

SEQ ID NO: 4290207 - DNA, 14 bp, Homo sapiens
atttaatatactgc

SEQ ID NO: 4290208 - DNA, 16 bp, Homo sapiens
atttaatatactgcat

SEQ ID NO: 4290209 - DNA, 15 bp, Homo sapiens
atttacaatgtatta

SEQ ID NO: 4290210 - DNA, 17 bp, Homo sapiens
atttacagttactgcct

SEQ ID NO: 4290211 - DNA, 18 bp, Homo sapiens
atttagatattcatactt

SEQ ID NO: 4290212 - DNA, 18 bp, Homo sapiens
atttaggcatgagctctt

SEQ ID NO: 4290213 - DNA, 21 bp, Homo sapiens
atttaggtttctgagttcctg

SEQ ID NO: 4290214 - DNA, 16 bp, Homo sapiens
atttagtcctcacctt

SEQ ID NO: 4290215 - DNA, 20 bp, Homo sapiens
atttatattagagtgccctt

SEQ ID NO: 4290216 - DNA, 23 bp, Homo sapiens
atttatattcagagatgtaccat

SEQ ID NO: 4290217 - DNA, 23 bp, Homo sapiens
atttatcttatctagcaagaaga

SEQ ID NO: 4290218 - DNA, 18 bp, Homo sapiens
atttatgacctcaacaaa

SEQ ID NO: 4290219 - DNA, 21 bp, Homo sapiens
atttatgacctcaacaaagaa

SEQ ID NO: 4290220 - DNA, 17 bp, Homo sapiens
atttatgagctcttcat

SEQ ID NO: 4290221 - DNA, 22 bp, Homo sapiens
atttattagccctgcattttca

SEQ ID NO: 4290222 - DNA, 14 bp, Homo sapiens
atttattctaatta

SEQ ID NO: 4290223 - DNA, 13 bp, Homo sapiens
atttattgtatat

SEQ ID NO: 4290224 - DNA, 20 bp, Homo sapiens
atttattttcctccccagca

SEQ ID NO: 4290225 - DNA, 22 bp, Homo sapiens
atttcaaaatgatattcaatct

SEQ ID NO: 4290226 - DNA, 14 bp, Homo sapiens
atttcaaaatgcat

SEQ ID NO: 4290227 - DNA, 17 bp, Homo sapiens
atttcaatgattgttta

SEQ ID NO: 4290228 - DNA, 16 bp, Homo sapiens
atttcaatgtaattaa

SEQ ID NO: 4290229 - DNA, 22 bp, Homo sapiens
atttcaggttaaattaaaccaa

SEQ ID NO: 4290230 - DNA, 19 bp, Homo sapiens
atttcattgagggaaaaca

SEQ ID NO: 4290231 - DNA, 21 bp, Homo sapiens
atttccgaagaccttctgaag

SEQ ID NO: 4290232 - DNA, 16 bp, Homo sapiens
atttcggtgcttccct

SEQ ID NO: 4290233 - DNA, 13 bp, Homo sapiens
atttctaaaacat

SEQ ID NO: 4290234 - DNA, 17 bp, Homo sapiens
atttctaaaacattaat

SEQ ID NO: 4290235 - DNA, 17 bp, Homo sapiens
atttctaaatcctcact

SEQ ID NO: 4290236 - DNA, 19 bp, Homo sapiens
atttctaagcttatttcta

SEQ ID NO: 4290237 - DNA, 21 bp, Homo sapiens
atttctaagcttatttctaac

SEQ ID NO: 4290238 - DNA, 14 bp, Homo sapiens
atttctatctgcaa

SEQ ID NO: 4290239 - DNA, 16 bp, Homo sapiens
atttctatctgcaaat

SEQ ID NO: 4290240 - DNA, 13 bp, Homo sapiens
atttctcaaagtt

SEQ ID NO: 4290241 - DNA, 11 bp, Homo sapiens
atttctcccag

SEQ ID NO: 4290242 - DNA, 15 bp, Homo sapiens
atttctcccttcaat

SEQ ID NO: 4290243 - DNA, 16 bp, Homo sapiens
atttctgccatttcat

SEQ ID NO: 4290244 - DNA, 17 bp, Homo sapiens
atttctggccatttaac

SEQ ID NO: 4290245 - DNA, 16 bp, Homo sapiens
atttcttccagtgatg

SEQ ID NO: 4290246 - DNA, 14 bp, Homo sapiens
atttcttgggccct

SEQ ID NO: 4290247 - DNA, 18 bp, Homo sapiens
atttcttgggccctcctg

SEQ ID NO: 4290248 - DNA, 22 bp, Homo sapiens
atttgaagaaggaggaatttta

SEQ ID NO: 4290249 - DNA, 18 bp, Homo sapiens
atttgactttctgtctgt

SEQ ID NO: 4290250 - DNA, 18 bp, Homo sapiens
atttgcaactttagaaag

SEQ ID NO: 4290251 - DNA, 20 bp, Homo sapiens
atttgcagaccaggaaggaa

SEQ ID NO: 4290252 - DNA, 18 bp, Homo sapiens
atttggctccactgtaaa

SEQ ID NO: 4290253 - DNA, 18 bp, Homo sapiens
atttgggctgaatgtatg

SEQ ID NO: 4290254 - DNA, 19 bp, Homo sapiens
atttgggctgaatgtatgt

SEQ ID NO: 4290255 - DNA, 21 bp, Homo sapiens
atttgggctgaatgtatgtaa

SEQ ID NO: 4290256 - DNA, 15 bp, Homo sapiens
atttgtatgatattt

SEQ ID NO: 4290257 - DNA, 14 bp, Homo sapiens
atttgtatttatat

SEQ ID NO: 4290258 - DNA, 20 bp, Homo sapiens
atttgtatttatattagagt

SEQ ID NO: 4290259 - DNA, 21 bp, Homo sapiens
atttgtgagccaaagagaaaa

SEQ ID NO: 4290260 - DNA, 15 bp, Homo sapiens
atttgtgatacttcc

SEQ ID NO: 4290261 - DNA, 21 bp, Homo sapiens
atttgtgtagattgtgtaaat

SEQ ID NO: 4290262 - DNA, 21 bp, Homo sapiens
atttgttaatatatataatac

SEQ ID NO: 4290263 - DNA, 22 bp, Homo sapiens
atttgtttatccttaagaattc

SEQ ID NO: 4290264 - DNA, 16 bp, Homo sapiens
attttaaaaaataaca

SEQ ID NO: 4290265 - DNA, 17 bp, Homo sapiens
attttaaaaaataacat

SEQ ID NO: 4290266 - DNA, 17 bp, Homo sapiens
attttaaatgctgtatg

SEQ ID NO: 4290267 - DNA, 21 bp, Homo sapiens
attttaccatcacacatgttc

SEQ ID NO: 4290268 - DNA, 18 bp, Homo sapiens
attttactgtctgtaaga

SEQ ID NO: 4290269 - DNA, 23 bp, Homo sapiens
attttactgtctgtaagagaatt

SEQ ID NO: 4290270 - DNA, 11 bp, Homo sapiens
cacacccttcc

SEQ ID NO: 4290271 - DNA, 16 bp, Homo sapiens
cacacccttccccact

SEQ ID NO: 4290272 - DNA, 18 bp, Homo sapiens
cacacctgcacaccgtcc

SEQ ID NO: 4290273 - DNA, 19 bp, Homo sapiens
cacacctgcacaccgtccc

SEQ ID NO: 4290274 - DNA, 22 bp, Homo sapiens
cacacgcgcgcgcgcgcacaca

SEQ ID NO: 4290275 - DNA, 16 bp, Homo sapiens
cacactacgcagaaga

SEQ ID NO: 4290276 - DNA, 19 bp, Homo sapiens
cacactgccctctgccact

SEQ ID NO: 4290277 - DNA, 18 bp, Homo sapiens
cacacttcaggctcttct

SEQ ID NO: 4290278 - DNA, 23 bp, Homo sapiens
cacacttccccttgggatgggca

SEQ ID NO: 4290279 - DNA, 13 bp, Homo sapiens
cacacttcctgtc

SEQ ID NO: 4290280 - DNA, 19 bp, Homo sapiens
cacacttcctgtccagaga

SEQ ID NO: 4290281 - DNA, 16 bp, Homo sapiens
cacagaactcagcctt

SEQ ID NO: 4290282 - DNA, 22 bp, Homo sapiens
cacagaaggaaggagccagctc

SEQ ID NO: 4290283 - DNA, 19 bp, Homo sapiens
cacagatgggcaaggcctt

SEQ ID NO: 4290284 - DNA, 16 bp, Homo sapiens
cacagattcaagtgca

SEQ ID NO: 4290285 - DNA, 19 bp, Homo sapiens
cacagcagtacttgctcaa

SEQ ID NO: 4290286 - DNA, 15 bp, Homo sapiens
cacagcatctcagct

SEQ ID NO: 4290287 - DNA, 19 bp, Homo sapiens
cacagcatctcagctcatc

SEQ ID NO: 4290288 - DNA, 16 bp, Homo sapiens
cacagccaccacctgg

SEQ ID NO: 4290289 - DNA, 23 bp, Homo sapiens
cacagccagaaactgaactggcc

SEQ ID NO: 4290290 - DNA, 11 bp, Homo sapiens
cacagccctgt

SEQ ID NO: 4290291 - DNA, 13 bp, Homo sapiens
cacagccctgtca

SEQ ID NO: 4290292 - DNA, 20 bp, Homo sapiens
cacagcctcacccctgcagg

SEQ ID NO: 4290293 - DNA, 18 bp, Homo sapiens
cacagctgagctggccta

SEQ ID NO: 4290294 - DNA, 19 bp, Homo sapiens
cacagctttcctgggtctg

SEQ ID NO: 4290295 - DNA, 18 bp, Homo sapiens
cacaggagcgtgtcctat

SEQ ID NO: 4290296 - DNA, 18 bp, Homo sapiens
cacaggatgaactagcca

SEQ ID NO: 4290297 - DNA, 22 bp, Homo sapiens
cacaggatgaactagccatgac

SEQ ID NO: 4290298 - DNA, 17 bp, Homo sapiens
cacaggcccttcctctc

SEQ ID NO: 4290299 - DNA, 18 bp, Homo sapiens
cacaggcccttcctctcc

SEQ ID NO: 4290300 - DNA, 21 bp, Homo sapiens
cacaggcccttcctctccact

SEQ ID NO: 4290301 - DNA, 16 bp, Homo sapiens
cacaggcctggcccag

SEQ ID NO: 4290302 - DNA, 17 bp, Homo sapiens
cacaggcctggcccagc

SEQ ID NO: 4290303 - DNA, 12 bp, Homo sapiens
cacaggctgccc

SEQ ID NO: 4290304 - DNA, 16 bp, Homo sapiens
cacagtatattttatt

SEQ ID NO: 4290305 - DNA, 18 bp, Homo sapiens
cacagtgcatctcagccc

SEQ ID NO: 4290306 - DNA, 22 bp, Homo sapiens
cacagtttgcaatcttatgttg

SEQ ID NO: 4290307 - DNA, 18 bp, Homo sapiens
cacataaatctgtctgat

SEQ ID NO: 4290308 - DNA, 21 bp, Homo sapiens
cacatagtgatggttcccctg

SEQ ID NO: 4290309 - DNA, 18 bp, Homo sapiens
cacatccaggcaatggcc

SEQ ID NO: 4290310 - DNA, 13 bp, Homo sapiens
cacatccattcca

SEQ ID NO: 4290311 - DNA, 17 bp, Homo sapiens
cacatccattccagagc

SEQ ID NO: 4290312 - DNA, 22 bp, Homo sapiens
cacatcccccgtgtattcagga

SEQ ID NO: 4290313 - DNA, 15 bp, Homo sapiens
cacatgcatggcatt

SEQ ID NO: 4290314 - DNA, 21 bp, Homo sapiens
cacattaggaacagagtatat

SEQ ID NO: 4290315 - DNA, 22 bp, Homo sapiens
cacattctgctgcccccagacc

SEQ ID NO: 4290316 - DNA, 15 bp, Homo sapiens
cacattctggctcca

SEQ ID NO: 4290317 - DNA, 16 bp, Homo sapiens
cacattgccctgaggg

SEQ ID NO: 4290318 - DNA, 22 bp, Homo sapiens
caccaaaaaatctatagtttga

SEQ ID NO: 4290319 - DNA, 13 bp, Homo sapiens
caccaaccctcag

SEQ ID NO: 4290320 - DNA, 16 bp, Homo sapiens
caccaacctcactgcc

SEQ ID NO: 4290321 - DNA, 17 bp, Homo sapiens
caccaacctcactgccc

SEQ ID NO: 4290322 - DNA, 16 bp, Homo sapiens
caccaaggctgcctgc

SEQ ID NO: 4290323 - DNA, 17 bp, Homo sapiens
caccaaggctgcctgcc

SEQ ID NO: 4290324 - DNA, 21 bp, Homo sapiens
caccaagggtatctgctgcct

SEQ ID NO: 4290325 - DNA, 15 bp, Homo sapiens
caccacacacaccct

SEQ ID NO: 4290326 - DNA, 17 bp, Homo sapiens
caccacacacacccttc

SEQ ID NO: 4290327 - DNA, 19 bp, Homo sapiens
caccacacacacccttccc

SEQ ID NO: 4290328 - DNA, 14 bp, Homo sapiens
caccagagcctccc

SEQ ID NO: 4290329 - DNA, 15 bp, Homo sapiens
caccagagcctccct

SEQ ID NO: 4290330 - DNA, 16 bp, Homo sapiens
caccagagcctccctc

SEQ ID NO: 4290331 - DNA, 22 bp, Homo sapiens
caccagcagcacaattctgtcc

SEQ ID NO: 4290332 - DNA, 13 bp, Homo sapiens
caccagccctggt

SEQ ID NO: 4290333 - DNA, 15 bp, Homo sapiens
caccagcctcagtgc

SEQ ID NO: 4290334 - DNA, 15 bp, Homo sapiens
caccagctggctctg

SEQ ID NO: 4290335 - DNA, 16 bp, Homo sapiens
caccaggaagaaggcc

SEQ ID NO: 4290336 - DNA, 23 bp, Homo sapiens
caccagggtttagtttgcattta

SEQ ID NO: 4290337 - DNA, 14 bp, Homo sapiens
caccatctcaggcc

SEQ ID NO: 4290338 - DNA, 18 bp, Homo sapiens
caccatctcaggccacct

SEQ ID NO: 4290339 - DNA, 20 bp, Homo sapiens
caccatctcaggccacctgc

SEQ ID NO: 4290340 - DNA, 15 bp, Homo sapiens
cacccaggacctctg

SEQ ID NO: 4290341 - DNA, 16 bp, Homo sapiens
cacccaggacctctgg

SEQ ID NO: 4290342 - DNA, 20 bp, Homo sapiens
cacccatgccccactctgct

SEQ ID NO: 4290343 - DNA, 22 bp, Homo sapiens
cacccatgccccactctgctga

SEQ ID NO: 4290344 - DNA, 17 bp, Homo sapiens
caccccagtccccggga

SEQ ID NO: 4290345 - DNA, 15 bp, Homo sapiens
cacccccgggtgcct

SEQ ID NO: 4290346 - DNA, 12 bp, Homo sapiens
caccccctgctg

SEQ ID NO: 4290347 - DNA, 20 bp, Homo sapiens
caccccctgctggtgcccac

SEQ ID NO: 4290348 - DNA, 14 bp, Homo sapiens
caccccgcctctgg

SEQ ID NO: 4290349 - DNA, 15 bp, Homo sapiens
caccccgttgttgtc

SEQ ID NO: 4290350 - DNA, 19 bp, Homo sapiens
caccccgttgttgtccctg

SEQ ID NO: 4290351 - DNA, 18 bp, Homo sapiens
cacccctcaagccaggag

SEQ ID NO: 4290352 - DNA, 13 bp, Homo sapiens
cacccctgcacac

SEQ ID NO: 4290353 - DNA, 19 bp, Homo sapiens
cacccctgcacacacctgc

SEQ ID NO: 4290354 - DNA, 13 bp, Homo sapiens
caccccttcccca

SEQ ID NO: 4290355 - DNA, 14 bp, Homo sapiens
caccccttccccac

SEQ ID NO: 4290356 - DNA, 20 bp, Homo sapiens
cacccggatctccaggccca

SEQ ID NO: 4290357 - DNA, 13 bp, Homo sapiens
cacccggcagccc

SEQ ID NO: 4290358 - DNA, 20 bp, Homo sapiens
caccctaatgtggcagctgt

SEQ ID NO: 4290359 - DNA, 18 bp, Homo sapiens
caccctctctgtccaatc

SEQ ID NO: 4290360 - DNA, 15 bp, Homo sapiens
caccctctgcagggc

SEQ ID NO: 4290361 - DNA, 17 bp, Homo sapiens
caccctctgcagggcag

SEQ ID NO: 4290362 - DNA, 19 bp, Homo sapiens
caccctctgcagggcagcc

SEQ ID NO: 4290363 - DNA, 23 bp, Homo sapiens
caccctctgctatgtctgtgatg

SEQ ID NO: 4290364 - DNA, 11 bp, Homo sapiens
cacccttcccc

SEQ ID NO: 4290365 - DNA, 21 bp, Homo sapiens
cacccttcgcagttactggtt

SEQ ID NO: 4290366 - DNA, 17 bp, Homo sapiens
cacccttggcctgtcca

SEQ ID NO: 4290367 - DNA, 22 bp, Homo sapiens
caccgagaggaaaaaggcttct

SEQ ID NO: 4290368 - DNA, 17 bp, Homo sapiens
caccgctccccagccca

SEQ ID NO: 4290369 - DNA, 20 bp, Homo sapiens
caccgctccccagcccaggg

SEQ ID NO: 4290370 - DNA, 19 bp, Homo sapiens
caccgtccctctccccgga

SEQ ID NO: 4290371 - DNA, 12 bp, Homo sapiens
cacctaagtgac

SEQ ID NO: 4290372 - DNA, 15 bp, Homo sapiens
cacctaattaatttc

SEQ ID NO: 4290373 - DNA, 21 bp, Homo sapiens
cacctataaatactaaatatg

SEQ ID NO: 4290374 - DNA, 14 bp, Homo sapiens
cacctcaggggaga

SEQ ID NO: 4290375 - DNA, 12 bp, Homo sapiens
cacctccacccg

SEQ ID NO: 4290376 - DNA, 14 bp, Homo sapiens
cacctccacccgtc

SEQ ID NO: 4290377 - DNA, 11 bp, Homo sapiens
cacctcccctc

SEQ ID NO: 4290378 - DNA, 21 bp, Homo sapiens
cacctgaattcgagacaggca

SEQ ID NO: 4290379 - DNA, 19 bp, Homo sapiens
cacctgcacacccctgcac

SEQ ID NO: 4290380 - DNA, 14 bp, Homo sapiens
cacctgcagcccca

SEQ ID NO: 4290381 - DNA, 15 bp, Homo sapiens
cacctgcagccccag

SEQ ID NO: 4290382 - DNA, 17 bp, Homo sapiens
cacctgcagccccaggc

SEQ ID NO: 4290383 - DNA, 14 bp, Homo sapiens
cacctgcagcgtct

SEQ ID NO: 4290384 - DNA, 17 bp, Homo sapiens
cacctgcctctgaactg

SEQ ID NO: 4290385 - DNA, 13 bp, Homo sapiens
cacctgctggccc

SEQ ID NO: 4290386 - DNA, 14 bp, Homo sapiens
cacctgctggcccc

SEQ ID NO: 4290387 - DNA, 17 bp, Homo sapiens
cacctgctggcccctca

SEQ ID NO: 4290388 - DNA, 22 bp, Homo sapiens
cacctgctggcccctcacctgg

SEQ ID NO: 4290389 - DNA, 15 bp, Homo sapiens
cacctgcttctcagc

SEQ ID NO: 4290390 - DNA, 20 bp, Homo sapiens
cacctggatggatctgctcc

SEQ ID NO: 4290391 - DNA, 18 bp, Homo sapiens
cacctggcttcccaggac

SEQ ID NO: 4290392 - DNA, 22 bp, Homo sapiens
cacctggcttcccaggaccctg

SEQ ID NO: 4290393 - DNA, 18 bp, Homo sapiens
cacctgggagatgctggg

SEQ ID NO: 4290394 - DNA, 12 bp, Homo sapiens
cacctgggcacc

SEQ ID NO: 4290395 - DNA, 15 bp, Homo sapiens
cacctgggcacctgg

SEQ ID NO: 4290396 - DNA, 17 bp, Homo sapiens
cacctgggccctaggca

SEQ ID NO: 4290397 - DNA, 18 bp, Homo sapiens
cacctggttatgagccga

SEQ ID NO: 4290398 - DNA, 20 bp, Homo sapiens
caccttaaaattagcatctg

SEQ ID NO: 4290399 - DNA, 20 bp, Homo sapiens
caccttcctgggcagcccag

SEQ ID NO: 4290400 - DNA, 22 bp, Homo sapiens
caccttcctgggcagcccagag

SEQ ID NO: 4290401 - DNA, 17 bp, Homo sapiens
caccttgcaacacacag

SEQ ID NO: 4290402 - DNA, 18 bp, Homo sapiens
caccttgcaacacacaga

SEQ ID NO: 4290403 - DNA, 17 bp, Homo sapiens
cacgagatcttccttcc

SEQ ID NO: 4290404 - DNA, 15 bp, Homo sapiens
attttactttgtgca

SEQ ID NO: 4290405 - DNA, 18 bp, Homo sapiens
attttagccttctctgtt

SEQ ID NO: 4290406 - DNA, 13 bp, Homo sapiens
attttatctcttc

SEQ ID NO: 4290407 - DNA, 18 bp, Homo sapiens
attttatgtgcttgaaga

SEQ ID NO: 4290408 - DNA, 14 bp, Homo sapiens
attttatttcaatg

SEQ ID NO: 4290409 - DNA, 16 bp, Homo sapiens
attttattttcaagca

SEQ ID NO: 4290410 - DNA, 16 bp, Homo sapiens
attttcctccccagca

SEQ ID NO: 4290411 - DNA, 14 bp, Homo sapiens
attttcctgggagt

SEQ ID NO: 4290412 - DNA, 23 bp, Homo sapiens
attttccttcctgttctgtgtct

SEQ ID NO: 4290413 - DNA, 13 bp, Homo sapiens
attttcgtgcatt

SEQ ID NO: 4290414 - DNA, 17 bp, Homo sapiens
attttctaattctcttt

SEQ ID NO: 4290415 - DNA, 15 bp, Homo sapiens
attttctgcatctcc

SEQ ID NO: 4290416 - DNA, 15 bp, Homo sapiens
attttcttcccattt

SEQ ID NO: 4290417 - DNA, 14 bp, Homo sapiens
attttctttctatg

SEQ ID NO: 4290418 - DNA, 21 bp, Homo sapiens
attttctttctatgtagaact

SEQ ID NO: 4290419 - DNA, 19 bp, Homo sapiens
attttcttttatatctgta

SEQ ID NO: 4290420 - DNA, 12 bp, Homo sapiens
attttggccact

SEQ ID NO: 4290421 - DNA, 16 bp, Homo sapiens
attttggccactttgc

SEQ ID NO: 4290422 - DNA, 16 bp, Homo sapiens
attttggggaactgtt

SEQ ID NO: 4290423 - DNA, 14 bp, Homo sapiens
attttgtaaaatgt

SEQ ID NO: 4290424 - DNA, 21 bp, Homo sapiens
attttgtatgaaatatatgtg

SEQ ID NO: 4290425 - DNA, 15 bp, Homo sapiens
atttttaatttatga

SEQ ID NO: 4290426 - DNA, 16 bp, Homo sapiens
atttttacaagttata

SEQ ID NO: 4290427 - DNA, 13 bp, Homo sapiens
atttttagagatt

SEQ ID NO: 4290428 - DNA, 20 bp, Homo sapiens
atttttagagattaatttgt

SEQ ID NO: 4290429 - DNA, 17 bp, Homo sapiens
atttttaggtgtctttt

SEQ ID NO: 4290430 - DNA, 13 bp, Homo sapiens
atttttatttcta

SEQ ID NO: 4290431 - DNA, 14 bp, Homo sapiens
attttttcctacca

SEQ ID NO: 4290432 - DNA, 18 bp, Homo sapiens
atttttttccagaattga

SEQ ID NO: 4290433 - DNA, 15 bp, Homo sapiens
atttttttctagcta

SEQ ID NO: 4290434 - DNA, 23 bp, Homo sapiens
attttttttttaaatgattccaa

SEQ ID NO: 4290435 - DNA, 18 bp, Homo sapiens
caaaaacaataaacgaaa

SEQ ID NO: 4290436 - DNA, 20 bp, Homo sapiens
caaaaatcatcaaagtgttt

SEQ ID NO: 4290437 - DNA, 11 bp, Homo sapiens
caaaacagaac

SEQ ID NO: 4290438 - DNA, 23 bp, Homo sapiens
caaaacagcgggagtgtgggggt

SEQ ID NO: 4290439 - DNA, 19 bp, Homo sapiens
caaaactatcggttcaagt

SEQ ID NO: 4290440 - DNA, 12 bp, Homo sapiens
caaaactgccta

SEQ ID NO: 4290441 - DNA, 16 bp, Homo sapiens
caaaaggttaagccat

SEQ ID NO: 4290442 - DNA, 18 bp, Homo sapiens
caaaaggttaagccatat

SEQ ID NO: 4290443 - DNA, 22 bp, Homo sapiens
caaaatacatgatgatttcaga

SEQ ID NO: 4290444 - DNA, 14 bp, Homo sapiens
caaaatacttcttt

SEQ ID NO: 4290445 - DNA, 13 bp, Homo sapiens
caaaatagttcta

SEQ ID NO: 4290446 - DNA, 14 bp, Homo sapiens
caaaatagttctat

SEQ ID NO: 4290447 - DNA, 15 bp, Homo sapiens
caaaatagttctatt

SEQ ID NO: 4290448 - DNA, 23 bp, Homo sapiens
caaaatagttctatttctatctg

SEQ ID NO: 4290449 - DNA, 14 bp, Homo sapiens
caaaatatagttaa

SEQ ID NO: 4290450 - DNA, 18 bp, Homo sapiens
caaaatattgagcagaat

SEQ ID NO: 4290451 - DNA, 13 bp, Homo sapiens
caaaatatttcta

SEQ ID NO: 4290452 - DNA, 21 bp, Homo sapiens
caaaatatttctaagcttatt

SEQ ID NO: 4290453 - DNA, 19 bp, Homo sapiens
caaaatgatattcaatctt

SEQ ID NO: 4290454 - DNA, 13 bp, Homo sapiens
caaaatgcatgtg

SEQ ID NO: 4290455 - DNA, 14 bp, Homo sapiens
caaacaacaaagca

SEQ ID NO: 4290456 - DNA, 11 bp, Homo sapiens
caaacacacac

SEQ ID NO: 4290457 - DNA, 12 bp, Homo sapiens
caaacacacaca

SEQ ID NO: 4290458 - DNA, 14 bp, Homo sapiens
caaacacacacaca

SEQ ID NO: 4290459 - DNA, 13 bp, Homo sapiens
caaacagatgttt

SEQ ID NO: 4290460 - DNA, 13 bp, Homo sapiens
caaacaggtgcta

SEQ ID NO: 4290461 - DNA, 16 bp, Homo sapiens
caaacaggtgctaaca

SEQ ID NO: 4290462 - DNA, 17 bp, Homo sapiens
caaacatgccctcaggc

SEQ ID NO: 4290463 - DNA, 20 bp, Homo sapiens
caaacatggggttggctggg

SEQ ID NO: 4290464 - DNA, 13 bp, Homo sapiens
caaacctaagttg

SEQ ID NO: 4290465 - DNA, 16 bp, Homo sapiens
caaacctctatatgtt

SEQ ID NO: 4290466 - DNA, 13 bp, Homo sapiens
caaactagattca

SEQ ID NO: 4290467 - DNA, 17 bp, Homo sapiens
caaagaacccccctccc

SEQ ID NO: 4290468 - DNA, 16 bp, Homo sapiens
caaagaagaaccatct

SEQ ID NO: 4290469 - DNA, 22 bp, Homo sapiens
caaagaatcacctaattaattt

SEQ ID NO: 4290470 - DNA, 16 bp, Homo sapiens
caaagaggcattcagc

SEQ ID NO: 4290471 - DNA, 17 bp, Homo sapiens
caaagcaccttgaatgg

SEQ ID NO: 4290472 - DNA, 23 bp, Homo sapiens
caaaggactgttttttcctgagc

SEQ ID NO: 4290473 - DNA, 20 bp, Homo sapiens
caaagtaccaactgagccaa

SEQ ID NO: 4290474 - DNA, 21 bp, Homo sapiens
caaagtagtacttcttctgta

SEQ ID NO: 4290475 - DNA, 22 bp, Homo sapiens
caaagtagtacttcttctgtaa

SEQ ID NO: 4290476 - DNA, 14 bp, Homo sapiens
caaagtgagaaatt

SEQ ID NO: 4290477 - DNA, 13 bp, Homo sapiens
caaagtgtttaat

SEQ ID NO: 4290478 - DNA, 19 bp, Homo sapiens
caaagtgtttaattgtata

SEQ ID NO: 4290479 - DNA, 14 bp, Homo sapiens
caaagttttcagat

SEQ ID NO: 4290480 - DNA, 15 bp, Homo sapiens
caaagttttcagatt

SEQ ID NO: 4290481 - DNA, 20 bp, Homo sapiens
caaagttttcagattgtaaa

SEQ ID NO: 4290482 - DNA, 18 bp, Homo sapiens
caaataccagagcacaga

SEQ ID NO: 4290483 - DNA, 20 bp, Homo sapiens
caaatagggcaaagaatcaa

SEQ ID NO: 4290484 - DNA, 19 bp, Homo sapiens
caaatatagttgaacaaga

SEQ ID NO: 4290485 - DNA, 17 bp, Homo sapiens
caaatatctctatttaa

SEQ ID NO: 4290486 - DNA, 15 bp, Homo sapiens
caaatattagccaaa

SEQ ID NO: 4290487 - DNA, 23 bp, Homo sapiens
caaatccaacgcttttcccacct

SEQ ID NO: 4290488 - DNA, 22 bp, Homo sapiens
caaatccataccccctgcccca

SEQ ID NO: 4290489 - DNA, 16 bp, Homo sapiens
caaatctgagccttag

SEQ ID NO: 4290490 - DNA, 18 bp, Homo sapiens
caaatgaataatgccttt

SEQ ID NO: 4290491 - DNA, 23 bp, Homo sapiens
caaatgaataatgcctttgtaac

SEQ ID NO: 4290492 - DNA, 21 bp, Homo sapiens
caaatgcatgatattgtatgt

SEQ ID NO: 4290493 - DNA, 14 bp, Homo sapiens
caaatgtccaagca

SEQ ID NO: 4290494 - DNA, 16 bp, Homo sapiens
caaattaacctttcag

SEQ ID NO: 4290495 - DNA, 17 bp, Homo sapiens
caaattattctagtcaa

SEQ ID NO: 4290496 - DNA, 19 bp, Homo sapiens
caaattcattcccttctct

SEQ ID NO: 4290497 - DNA, 13 bp, Homo sapiens
caaattccttccc

SEQ ID NO: 4290498 - DNA, 18 bp, Homo sapiens
caaattttccttcctgtt

SEQ ID NO: 4290499 - DNA, 13 bp, Homo sapiens
caacaaagaagaa

SEQ ID NO: 4290500 - DNA, 14 bp, Homo sapiens
caacaactccagga

SEQ ID NO: 4290501 - DNA, 14 bp, Homo sapiens
caacactcagtcct

SEQ ID NO: 4290502 - DNA, 19 bp, Homo sapiens
caacagcatgtctactgct

SEQ ID NO: 4290503 - DNA, 20 bp, Homo sapiens
caacaggaccaggagccagg

SEQ ID NO: 4290504 - DNA, 14 bp, Homo sapiens
caacatttgctttt

SEQ ID NO: 4290505 - DNA, 21 bp, Homo sapiens
caaccaccgctccccagccca

SEQ ID NO: 4290506 - DNA, 22 bp, Homo sapiens
caaccaccgctccccagcccag

SEQ ID NO: 4290507 - DNA, 13 bp, Homo sapiens
caaccacttgcta

SEQ ID NO: 4290508 - DNA, 15 bp, Homo sapiens
caaccatagaactgt

SEQ ID NO: 4290509 - DNA, 15 bp, Homo sapiens
caacccatgcatggc

SEQ ID NO: 4290510 - DNA, 16 bp, Homo sapiens
caacccatgcatggcc

SEQ ID NO: 4290511 - DNA, 17 bp, Homo sapiens
caacccatgcatggcct

SEQ ID NO: 4290512 - DNA, 22 bp, Homo sapiens
caacccatgcatggcctcccag

SEQ ID NO: 4290513 - DNA, 17 bp, Homo sapiens
caaccccctcggagcct

SEQ ID NO: 4290514 - DNA, 18 bp, Homo sapiens
caaccccctcggagcctg

SEQ ID NO: 4290515 - DNA, 22 bp, Homo sapiens
caacccctgtggagcccgcacc

SEQ ID NO: 4290516 - DNA, 20 bp, Homo sapiens
caaccctccctcagcccctc

SEQ ID NO: 4290517 - DNA, 21 bp, Homo sapiens
caaccctccctcagcccctct

SEQ ID NO: 4290518 - DNA, 13 bp, Homo sapiens
caaccctgcccct

SEQ ID NO: 4290519 - DNA, 22 bp, Homo sapiens
caaccctgcccctgccccgtca

SEQ ID NO: 4290520 - DNA, 22 bp, Homo sapiens
caaccgatgctccagccaaccc

SEQ ID NO: 4290521 - DNA, 16 bp, Homo sapiens
caaccgcttgccatat

SEQ ID NO: 4290522 - DNA, 20 bp, Homo sapiens
caaccggggagcccccgccc

SEQ ID NO: 4290523 - DNA, 19 bp, Homo sapiens
caacctacagtggagggag

SEQ ID NO: 4290524 - DNA, 19 bp, Homo sapiens
caacctaggagcagtgggc

SEQ ID NO: 4290525 - DNA, 16 bp, Homo sapiens
caacctcactgccctc

SEQ ID NO: 4290526 - DNA, 17 bp, Homo sapiens
caacctcccctggtcct

SEQ ID NO: 4290527 - DNA, 20 bp, Homo sapiens
caaccttctgtggctcacag

SEQ ID NO: 4290528 - DNA, 17 bp, Homo sapiens
caactacagccaaattg

SEQ ID NO: 4290529 - DNA, 11 bp, Homo sapiens
caactccaagg

SEQ ID NO: 4290530 - DNA, 19 bp, Homo sapiens
caactccaggaaaactgtt

SEQ ID NO: 4290531 - DNA, 23 bp, Homo sapiens
caactccagggttaaagaaaggc

SEQ ID NO: 4290532 - DNA, 18 bp, Homo sapiens
caactctctctgccccca

SEQ ID NO: 4290533 - DNA, 17 bp, Homo sapiens
caactgctgttttatgt

SEQ ID NO: 4290534 - DNA, 19 bp, Homo sapiens
caactgtataccgtgtgct

SEQ ID NO: 4290535 - DNA, 23 bp, Homo sapiens
caactgtataccgtgtgctccag

SEQ ID NO: 4290536 - DNA, 15 bp, Homo sapiens
caactgtttttgaag

SEQ ID NO: 4290537 - DNA, 23 bp, Homo sapiens
caacttgaaattatatctgtggt

SEQ ID NO: 4290538 - DNA, 24 bp, Homo sapiens
caactttcactataatgtgaaatg

SEQ ID NO: 4290539 - DNA, 18 bp, Homo sapiens
atgactgtttttgtagtg

SEQ ID NO: 4290540 - DNA, 12 bp, Homo sapiens
atgagaaaaaac

SEQ ID NO: 4290541 - DNA, 14 bp, Homo sapiens
atgagctccagacc

SEQ ID NO: 4290542 - DNA, 21 bp, Homo sapiens
atgagctccagacccccagca

SEQ ID NO: 4290543 - DNA, 16 bp, Homo sapiens
atgaggggactgcatg

SEQ ID NO: 4290544 - DNA, 15 bp, Homo sapiens
atgagtcccagtggg

SEQ ID NO: 4290545 - DNA, 14 bp, Homo sapiens
atgagtctcactag

SEQ ID NO: 4290546 - DNA, 15 bp, Homo sapiens
atgagttcaaatact

SEQ ID NO: 4290547 - DNA, 19 bp, Homo sapiens
atgagttcaaatacttttg

SEQ ID NO: 4290548 - DNA, 20 bp, Homo sapiens
atgagtttaaaaaaataaca

SEQ ID NO: 4290549 - DNA, 13 bp, Homo sapiens
atgagtttatggg

SEQ ID NO: 4290550 - DNA, 15 bp, Homo sapiens
atgatacttggtcct

SEQ ID NO: 4290551 - DNA, 17 bp, Homo sapiens
atgatattttaaaatct

SEQ ID NO: 4290552 - DNA, 19 bp, Homo sapiens
atgatcttccaaatattag

SEQ ID NO: 4290553 - DNA, 15 bp, Homo sapiens
atgatggagtcaggt

SEQ ID NO: 4290554 - DNA, 14 bp, Homo sapiens
atgattcataacaa

SEQ ID NO: 4290555 - DNA, 13 bp, Homo sapiens
atgattccaaata

SEQ ID NO: 4290556 - DNA, 16 bp, Homo sapiens
atgattgaaaagaaga

SEQ ID NO: 4290557 - DNA, 20 bp, Homo sapiens
atgattgaaaagaagaaagt

SEQ ID NO: 4290558 - DNA, 17 bp, Homo sapiens
atgattgtttaattgta

SEQ ID NO: 4290559 - DNA, 16 bp, Homo sapiens
atgatttaagcatttt

SEQ ID NO: 4290560 - DNA, 13 bp, Homo sapiens
atgatttcagaaa

SEQ ID NO: 4290561 - DNA, 22 bp, Homo sapiens
atgatttgcaactttagaaaga

SEQ ID NO: 4290562 - DNA, 15 bp, Homo sapiens
atgattttggccact

SEQ ID NO: 4290563 - DNA, 15 bp, Homo sapiens
atgcaagctcagggt

SEQ ID NO: 4290564 - DNA, 17 bp, Homo sapiens
atgcactgcaaatactt

SEQ ID NO: 4290565 - DNA, 21 bp, Homo sapiens
atgcagatctagccaggcctc

SEQ ID NO: 4290566 - DNA, 20 bp, Homo sapiens
atgcagcttcaggtgagcca

SEQ ID NO: 4290567 - DNA, 21 bp, Homo sapiens
atgcagcttcaggtgagccaa

SEQ ID NO: 4290568 - DNA, 19 bp, Homo sapiens
atgcagtgtagattttata

SEQ ID NO: 4290569 - DNA, 14 bp, Homo sapiens
atgcatggcctccc

SEQ ID NO: 4290570 - DNA, 22 bp, Homo sapiens
atgccaaggaccttttgctgcc

SEQ ID NO: 4290571 - DNA, 14 bp, Homo sapiens
atgccacctgcagc

SEQ ID NO: 4290572 - DNA, 17 bp, Homo sapiens
atgccactaggccctgg

SEQ ID NO: 4290573 - DNA, 20 bp, Homo sapiens
atgccagtgactgctgcgct

SEQ ID NO: 4290574 - DNA, 22 bp, Homo sapiens
atgccagtgactgctgcgctgt

SEQ ID NO: 4290575 - DNA, 21 bp, Homo sapiens
atgccccactctgctgaggcc

SEQ ID NO: 4290576 - DNA, 13 bp, Homo sapiens
atgcccctcccca

SEQ ID NO: 4290577 - DNA, 16 bp, Homo sapiens
atgccctcaggcttgg

SEQ ID NO: 4290578 - DNA, 15 bp, Homo sapiens
atgcccttcttccat

SEQ ID NO: 4290579 - DNA, 14 bp, Homo sapiens
atgccgctgtgtcc

SEQ ID NO: 4290580 - DNA, 13 bp, Homo sapiens
atgcctaataaac

SEQ ID NO: 4290581 - DNA, 14 bp, Homo sapiens
atgcctaggccagc

SEQ ID NO: 4290582 - DNA, 23 bp, Homo sapiens
atgcctgagaatgcctaggccag

SEQ ID NO: 4290583 - DNA, 12 bp, Homo sapiens
atgcctgcctga

SEQ ID NO: 4290584 - DNA, 11 bp, Homo sapiens
atgcctgggcc

SEQ ID NO: 4290585 - DNA, 15 bp, Homo sapiens
atgcctgtatttcca

SEQ ID NO: 4290586 - DNA, 20 bp, Homo sapiens
atgcctgtatttccaacaaa

SEQ ID NO: 4290587 - DNA, 13 bp, Homo sapiens
atgcctttctagt

SEQ ID NO: 4290588 - DNA, 16 bp, Homo sapiens
atgcggccggcctggg

SEQ ID NO: 4290589 - DNA, 16 bp, Homo sapiens
atgctaacctctctga

SEQ ID NO: 4290590 - DNA, 19 bp, Homo sapiens
atgctaacctctctgaact

SEQ ID NO: 4290591 - DNA, 20 bp, Homo sapiens
atgctacctctgatcaaagc

SEQ ID NO: 4290592 - DNA, 18 bp, Homo sapiens
atgctatctcgctagcca

SEQ ID NO: 4290593 - DNA, 23 bp, Homo sapiens
atgctcccaaatgcagcttcagg

SEQ ID NO: 4290594 - DNA, 18 bp, Homo sapiens
atgctcccccatcctccc

SEQ ID NO: 4290595 - DNA, 13 bp, Homo sapiens
atgctcctctgcc

SEQ ID NO: 4290596 - DNA, 15 bp, Homo sapiens
atgctcctctgcctg

SEQ ID NO: 4290597 - DNA, 18 bp, Homo sapiens
atgctcctctgcctgtgc

SEQ ID NO: 4290598 - DNA, 20 bp, Homo sapiens
atgctgactgtactcctccc

SEQ ID NO: 4290599 - DNA, 21 bp, Homo sapiens
atgctgcaatacattaaaata

SEQ ID NO: 4290600 - DNA, 15 bp, Homo sapiens
atgctgcccaccccc

SEQ ID NO: 4290601 - DNA, 15 bp, Homo sapiens
atgctgcctgcctcc

SEQ ID NO: 4290602 - DNA, 18 bp, Homo sapiens
atgctggctcccagggcc

SEQ ID NO: 4290603 - DNA, 14 bp, Homo sapiens
atgctgggttctgg

SEQ ID NO: 4290604 - DNA, 18 bp, Homo sapiens
atgctgggttctggggct

SEQ ID NO: 4290605 - DNA, 17 bp, Homo sapiens
atgctggtcatcctggg

SEQ ID NO: 4290606 - DNA, 20 bp, Homo sapiens
atgcttatattgttcacttc

SEQ ID NO: 4290607 - DNA, 11 bp, Homo sapiens
atgcttgccta

SEQ ID NO: 4290608 - DNA, 16 bp, Homo sapiens
atgcttgcctagggcc

SEQ ID NO: 4290609 - DNA, 23 bp, Homo sapiens
atgcttgcctagggcctggtcca

SEQ ID NO: 4290610 - DNA, 22 bp, Homo sapiens
atggaaaaatgccatcaaatga

SEQ ID NO: 4290611 - DNA, 15 bp, Homo sapiens
atggaaagggtgtgg

SEQ ID NO: 4290612 - DNA, 15 bp, Homo sapiens
atggaaatcctgtta

SEQ ID NO: 4290613 - DNA, 22 bp, Homo sapiens
atggaactcagctgtctgtggc

SEQ ID NO: 4290614 - DNA, 23 bp, Homo sapiens
atggaactcagctgtctgtggct

SEQ ID NO: 4290615 - DNA, 21 bp, Homo sapiens
atggaagcctccacctgcagc

SEQ ID NO: 4290616 - DNA, 15 bp, Homo sapiens
atggaattatgtata

SEQ ID NO: 4290617 - DNA, 19 bp, Homo sapiens
atggaattatgtataacaa

SEQ ID NO: 4290618 - DNA, 19 bp, Homo sapiens
atggacctgcacttggcct

SEQ ID NO: 4290619 - DNA, 20 bp, Homo sapiens
atggacttttgttcatggga

SEQ ID NO: 4290620 - DNA, 21 bp, Homo sapiens
atggacttttgttcatgggag

SEQ ID NO: 4290621 - DNA, 17 bp, Homo sapiens
atggagtccagacctgg

SEQ ID NO: 4290622 - DNA, 14 bp, Homo sapiens
atggatctgctcca

SEQ ID NO: 4290623 - DNA, 18 bp, Homo sapiens
atggattataatcagaat

SEQ ID NO: 4290624 - DNA, 18 bp, Homo sapiens
atggccagcccagatggc

SEQ ID NO: 4290625 - DNA, 18 bp, Homo sapiens
atggccaggcctcaggga

SEQ ID NO: 4290626 - DNA, 22 bp, Homo sapiens
atggccgttgcctctctgccag

SEQ ID NO: 4290627 - DNA, 15 bp, Homo sapiens
atggcctcccagcca

SEQ ID NO: 4290628 - DNA, 20 bp, Homo sapiens
atggcgcacccggcagcccc

SEQ ID NO: 4290629 - DNA, 16 bp, Homo sapiens
atggcgcagtgcctct

SEQ ID NO: 4290630 - DNA, 16 bp, Homo sapiens
atggctccctgggctg

SEQ ID NO: 4290631 - DNA, 19 bp, Homo sapiens
atggctccctgggctggca

SEQ ID NO: 4290632 - DNA, 13 bp, Homo sapiens
atggctgtatttt

SEQ ID NO: 4290633 - DNA, 19 bp, Homo sapiens
atggctgtatttttagaga

SEQ ID NO: 4290634 - DNA, 21 bp, Homo sapiens
atggcttccccattgccttct

SEQ ID NO: 4290635 - DNA, 19 bp, Homo sapiens
atggcttgtagggtgaggc

SEQ ID NO: 4290636 - DNA, 13 bp, Homo sapiens
atgggcacaggct

SEQ ID NO: 4290637 - DNA, 16 bp, Homo sapiens
atgggcacctctgctg

SEQ ID NO: 4290638 - DNA, 21 bp, Homo sapiens
atggggttggctgggcccaga

SEQ ID NO: 4290639 - DNA, 21 bp, Homo sapiens
atgggttttgttaggggtggg

SEQ ID NO: 4290640 - DNA, 18 bp, Homo sapiens
atggtaatcttttctgag

SEQ ID NO: 4290641 - DNA, 19 bp, Homo sapiens
atggtactagggggaagtg

SEQ ID NO: 4290642 - DNA, 12 bp, Homo sapiens
atggtattttcg

SEQ ID NO: 4290643 - DNA, 21 bp, Homo sapiens
atggtattttcgtgcatttgt

SEQ ID NO: 4290644 - DNA, 14 bp, Homo sapiens
atggtgagaattaa

SEQ ID NO: 4290645 - DNA, 17 bp, Homo sapiens
atggtgagaattaaaat

SEQ ID NO: 4290646 - DNA, 11 bp, Homo sapiens
atggtgcagtg

SEQ ID NO: 4290647 - DNA, 16 bp, Homo sapiens
atggtgccccctgggg

SEQ ID NO: 4290648 - DNA, 14 bp, Homo sapiens
atggtgccttcatt

SEQ ID NO: 4290649 - DNA, 17 bp, Homo sapiens
atggtggtttcagaaag

SEQ ID NO: 4290650 - DNA, 16 bp, Homo sapiens
atggtgttggaggggc

SEQ ID NO: 4290651 - DNA, 18 bp, Homo sapiens
atgtaaattgactgtact

SEQ ID NO: 4290652 - DNA, 18 bp, Homo sapiens
atgtaacagttggtgatt

SEQ ID NO: 4290653 - DNA, 16 bp, Homo sapiens
atgtaacatgtctaaa

SEQ ID NO: 4290654 - DNA, 14 bp, Homo sapiens
atgtagaactgttc

SEQ ID NO: 4290655 - DNA, 15 bp, Homo sapiens
atgtagaactgttca

SEQ ID NO: 4290656 - DNA, 16 bp, Homo sapiens
atgtagaactgttcat

SEQ ID NO: 4290657 - DNA, 22 bp, Homo sapiens
atgtagaactgttcatttccac

SEQ ID NO: 4290658 - DNA, 18 bp, Homo sapiens
atgtagaagagggagaag

SEQ ID NO: 4290659 - DNA, 21 bp, Homo sapiens
atgtagaagagggagaaggag

SEQ ID NO: 4290660 - DNA, 20 bp, Homo sapiens
atgtagtatgctatgattaa

SEQ ID NO: 4290661 - DNA, 17 bp, Homo sapiens
atgtatcttatttatat

SEQ ID NO: 4290662 - DNA, 19 bp, Homo sapiens
atgtatcttatttatatat

SEQ ID NO: 4290663 - DNA, 22 bp, Homo sapiens
atgtatgtaaataggtttctaa

SEQ ID NO: 4290664 - DNA, 21 bp, Homo sapiens
atgtcagtagtgcctgtgatc

SEQ ID NO: 4290665 - DNA, 14 bp, Homo sapiens
atgtcataaagtga

SEQ ID NO: 4290666 - DNA, 23 bp, Homo sapiens
atgtcataaagtgagaaaactgt

SEQ ID NO: 4290667 - DNA, 17 bp, Homo sapiens
atgtcatactctgtgta

SEQ ID NO: 4290668 - DNA, 22 bp, Homo sapiens
atgtcattaaagtgcactgtgt

SEQ ID NO: 4290669 - DNA, 15 bp, Homo sapiens
atgtcatttcatttc

SEQ ID NO: 4290670 - DNA, 16 bp, Homo sapiens
atgtccataaaagaga

SEQ ID NO: 4290671 - DNA, 23 bp, Homo sapiens
atgtccccagtgtggactctgga

SEQ ID NO: 4290672 - DNA, 16 bp, Homo sapiens
atgtccccattctata

SEQ ID NO: 4290673 - DNA, 24 bp, Homo sapiens
atgtccctaccgagtctcttctcc

SEQ ID NO: 4290674 - DNA, 23 bp, Homo sapiens
atgtcctaggggccgagggaaat

SEQ ID NO: 4290675 - DNA, 14 bp, Homo sapiens
atgtcctatccctg

SEQ ID NO: 4290676 - DNA, 23 bp, Homo sapiens
atgtcctattactgatgtgtgca

SEQ ID NO: 4290677 - DNA, 19 bp, Homo sapiens
atgtcctgtgagatgtgta

SEQ ID NO: 4290678 - DNA, 14 bp, Homo sapiens
atgtcttgagatgt

SEQ ID NO: 4290679 - DNA, 17 bp, Homo sapiens
atgtcttgagatgtatt

SEQ ID NO: 4290680 - DNA, 18 bp, Homo sapiens
atgtcttgagatgtatta

SEQ ID NO: 4290681 - DNA, 19 bp, Homo sapiens
atgtctttggcttcagaat

SEQ ID NO: 4290682 - DNA, 19 bp, Homo sapiens
atgtgaatatgccagtgac

SEQ ID NO: 4290683 - DNA, 16 bp, Homo sapiens
atgtgcccagtcatga

SEQ ID NO: 4290684 - DNA, 18 bp, Homo sapiens
atgtgcccagtcatgaca

SEQ ID NO: 4290685 - DNA, 18 bp, Homo sapiens
atgtgctattaatatttg

SEQ ID NO: 4290686 - DNA, 19 bp, Homo sapiens
atgtgctattaatatttgt

SEQ ID NO: 4290687 - DNA, 16 bp, Homo sapiens
atgtgctcatcagaaa

SEQ ID NO: 4290688 - DNA, 13 bp, Homo sapiens
atgtgcttgaaga

SEQ ID NO: 4290689 - DNA, 14 bp, Homo sapiens
atgtgcttgaagat

SEQ ID NO: 4290690 - DNA, 22 bp, Homo sapiens
atgtgcttgaagattcaggctt

SEQ ID NO: 4290691 - DNA, 18 bp, Homo sapiens
atgtggatggaggtgatg

SEQ ID NO: 4290692 - DNA, 14 bp, Homo sapiens
atgtgtatgtgttt

SEQ ID NO: 4290693 - DNA, 15 bp, Homo sapiens
atgtgtatgtgttta

SEQ ID NO: 4290694 - DNA, 14 bp, Homo sapiens
atgtgtcaaagaga

SEQ ID NO: 4290695 - DNA, 20 bp, Homo sapiens
atgtgtcaaagagatgagga

SEQ ID NO: 4290696 - DNA, 22 bp, Homo sapiens
atgtgtcgcctctcactctggc

SEQ ID NO: 4290697 - DNA, 13 bp, Homo sapiens
atgtgtgtatgtg

SEQ ID NO: 4290698 - DNA, 20 bp, Homo sapiens
atgtgttaatcttaatgtat

SEQ ID NO: 4290699 - DNA, 22 bp, Homo sapiens
atgtgttaatcttaatgtatat

SEQ ID NO: 4290700 - DNA, 19 bp, Homo sapiens
atgtgttgcaaattattct

SEQ ID NO: 4290701 - DNA, 20 bp, Homo sapiens
atgtgttgcaaattattcta

SEQ ID NO: 4290702 - DNA, 18 bp, Homo sapiens
atgtgtttggttctgggg

SEQ ID NO: 4290703 - DNA, 13 bp, Homo sapiens
atgtgtttttaaa

SEQ ID NO: 4290704 - DNA, 18 bp, Homo sapiens
atgttaaaacaaattaaa

SEQ ID NO: 4290705 - DNA, 17 bp, Homo sapiens
atgttaaacgtcacagc

SEQ ID NO: 4290706 - DNA, 21 bp, Homo sapiens
atgttaacaatgcctattgta

SEQ ID NO: 4290707 - DNA, 18 bp, Homo sapiens
atgttccatcctgtacaa

SEQ ID NO: 4290708 - DNA, 19 bp, Homo sapiens
atgttcttgcagtcatcag

SEQ ID NO: 4290709 - DNA, 23 bp, Homo sapiens
atgttctttcctttcatcctcag

SEQ ID NO: 4290710 - DNA, 16 bp, Homo sapiens
atgttgatcgatgtta

SEQ ID NO: 4290711 - DNA, 22 bp, Homo sapiens
atgttgatcgatgttaaacgtc

SEQ ID NO: 4290712 - DNA, 22 bp, Homo sapiens
atgtttaatcaagagagacaaa

SEQ ID NO: 4290713 - DNA, 20 bp, Homo sapiens
atgtttacctcactggtgca

SEQ ID NO: 4290714 - DNA, 22 bp, Homo sapiens
atgtttccaggcatgaccctgg

SEQ ID NO: 4290715 - DNA, 15 bp, Homo sapiens
attaaaaacacctaa

SEQ ID NO: 4290716 - DNA, 15 bp, Homo sapiens
attaaaaagttaatc

SEQ ID NO: 4290717 - DNA, 22 bp, Homo sapiens
attaaaataaaacgttatctca

SEQ ID NO: 4290718 - DNA, 17 bp, Homo sapiens
attaaactgttaactta

SEQ ID NO: 4290719 - DNA, 17 bp, Homo sapiens
attaaagacatttaaaa

SEQ ID NO: 4290720 - DNA, 21 bp, Homo sapiens
attaaataacagtgtgtgacc

SEQ ID NO: 4290721 - DNA, 21 bp, Homo sapiens
attaaatcagaatctttaaag

SEQ ID NO: 4290722 - DNA, 22 bp, Homo sapiens
attaaattactatagcaaagta

SEQ ID NO: 4290723 - DNA, 17 bp, Homo sapiens
attaaatttaatatact

SEQ ID NO: 4290724 - DNA, 15 bp, Homo sapiens
attaaattttaatgt

SEQ ID NO: 4290725 - DNA, 19 bp, Homo sapiens
attaaattttaatgtaaaa

SEQ ID NO: 4290726 - DNA, 19 bp, Homo sapiens
attaaccaaattaaccttt

SEQ ID NO: 4290727 - DNA, 18 bp, Homo sapiens
attaaccccataattaga

SEQ ID NO: 4290728 - DNA, 20 bp, Homo sapiens
attaagcccacagtatattt

SEQ ID NO: 4290729 - DNA, 22 bp, Homo sapiens
attaagcttaaaaaagaaagat

SEQ ID NO: 4290730 - DNA, 22 bp, Homo sapiens
attaagtattccttggcccagc

SEQ ID NO: 4290731 - DNA, 16 bp, Homo sapiens
attaagttattaacat

SEQ ID NO: 4290732 - DNA, 17 bp, Homo sapiens
attaatccacatgtttc

SEQ ID NO: 4290733 - DNA, 12 bp, Homo sapiens
attaatctctaa

SEQ ID NO: 4290734 - DNA, 13 bp, Homo sapiens
attaatctctaaa

SEQ ID NO: 4290735 - DNA, 11 bp, Homo sapiens
attaattgagg

SEQ ID NO: 4290736 - DNA, 13 bp, Homo sapiens
attaatttctgcc

SEQ ID NO: 4290737 - DNA, 20 bp, Homo sapiens
attaatttctgccatttcat

SEQ ID NO: 4290738 - DNA, 22 bp, Homo sapiens
attaatttctgccatttcatgt

SEQ ID NO: 4290739 - DNA, 17 bp, Homo sapiens
attacaatggccagccc

SEQ ID NO: 4290740 - DNA, 18 bp, Homo sapiens
attacagggaagaaatca

SEQ ID NO: 4290741 - DNA, 19 bp, Homo sapiens
attagaattaccatttgtt

SEQ ID NO: 4290742 - DNA, 17 bp, Homo sapiens
attagactgaatttaac

SEQ ID NO: 4290743 - DNA, 14 bp, Homo sapiens
attagccaaagagg

SEQ ID NO: 4290744 - DNA, 22 bp, Homo sapiens
attaggaacagagtatatatgt

SEQ ID NO: 4290745 - DNA, 11 bp, Homo sapiens
attaggcctgg

SEQ ID NO: 4290746 - DNA, 16 bp, Homo sapiens
attaggtttagaatca

SEQ ID NO: 4290747 - DNA, 15 bp, Homo sapiens
attatactgtgtgtg

SEQ ID NO: 4290748 - DNA, 16 bp, Homo sapiens
attatactgtgtgtga

SEQ ID NO: 4290749 - DNA, 15 bp, Homo sapiens
attatacttctttat

SEQ ID NO: 4290750 - DNA, 18 bp, Homo sapiens
attatacttctttattca

SEQ ID NO: 4290751 - DNA, 11 bp, Homo sapiens
attatatataa

SEQ ID NO: 4290752 - DNA, 18 bp, Homo sapiens
attatatctgtggtcttc

SEQ ID NO: 4290753 - DNA, 17 bp, Homo sapiens
attattattttaaaaat

SEQ ID NO: 4290754 - DNA, 22 bp, Homo sapiens
attattctagtcaactgctgtt

SEQ ID NO: 4290755 - DNA, 18 bp, Homo sapiens
attattgttgcattaaaa

SEQ ID NO: 4290756 - DNA, 14 bp, Homo sapiens
attatttaactaat

SEQ ID NO: 4290757 - DNA, 22 bp, Homo sapiens
attatttcaaccgcttgccata

SEQ ID NO: 4290758 - DNA, 16 bp, Homo sapiens
attattttcccacaat

SEQ ID NO: 4290759 - DNA, 15 bp, Homo sapiens
attcaaaaatttcac

SEQ ID NO: 4290760 - DNA, 15 bp, Homo sapiens
attcaaacctaagtt

SEQ ID NO: 4290761 - DNA, 14 bp, Homo sapiens
attcaaagaatcac

SEQ ID NO: 4290762 - DNA, 21 bp, Homo sapiens
attcaaagaatcacctaatta

SEQ ID NO: 4290763 - DNA, 13 bp, Homo sapiens
attcaaatgcatg

SEQ ID NO: 4290764 - DNA, 18 bp, Homo sapiens
attcaacacttattttct

SEQ ID NO: 4290765 - DNA, 20 bp, Homo sapiens
attcaggaccccatctgctg

SEQ ID NO: 4290766 - DNA, 16 bp, Homo sapiens
attcagggcccctgaa

SEQ ID NO: 4290767 - DNA, 16 bp, Homo sapiens
attcataaaaataacc

SEQ ID NO: 4290768 - DNA, 17 bp, Homo sapiens
attcatagcatcctgat

SEQ ID NO: 4290769 - DNA, 19 bp, Homo sapiens
attcatgtgtaggaagagg

SEQ ID NO: 4290770 - DNA, 18 bp, Homo sapiens
attcattttaacatctga

SEQ ID NO: 4290771 - DNA, 21 bp, Homo sapiens
attcattttaacatctgagaa

SEQ ID NO: 4290772 - DNA, 18 bp, Homo sapiens
attccaaatagcccacac

SEQ ID NO: 4290773 - DNA, 18 bp, Homo sapiens
attccaagggcccagagg

SEQ ID NO: 4290774 - DNA, 19 bp, Homo sapiens
attccagagagtggctcct

SEQ ID NO: 4290775 - DNA, 21 bp, Homo sapiens
attccagagagtggctcctcc

SEQ ID NO: 4290776 - DNA, 15 bp, Homo sapiens
attccagagctgcag

SEQ ID NO: 4290777 - DNA, 16 bp, Homo sapiens
attccagagctgcaga

SEQ ID NO: 4290778 - DNA, 18 bp, Homo sapiens
attccagtgtattttctg

SEQ ID NO: 4290779 - DNA, 14 bp, Homo sapiens
attccatccatata

SEQ ID NO: 4290780 - DNA, 14 bp, Homo sapiens
attcccaggcaggg

SEQ ID NO: 4290781 - DNA, 21 bp, Homo sapiens
attcccatggtagactgtgac

SEQ ID NO: 4290782 - DNA, 22 bp, Homo sapiens
attcccatggtagactgtgaca

SEQ ID NO: 4290783 - DNA, 18 bp, Homo sapiens
attcccttcaatgcaaaa

SEQ ID NO: 4290784 - DNA, 18 bp, Homo sapiens
attcccttctctcagcct

SEQ ID NO: 4290785 - DNA, 21 bp, Homo sapiens
attccgacaaccgatgctcca

SEQ ID NO: 4290786 - DNA, 14 bp, Homo sapiens
attcctaggcctca

SEQ ID NO: 4290787 - DNA, 14 bp, Homo sapiens
attcctctgtcccc

SEQ ID NO: 4290788 - DNA, 17 bp, Homo sapiens
attccttggcccagcag

SEQ ID NO: 4290789 - DNA, 19 bp, Homo sapiens
attcgcccaaagccagaca

SEQ ID NO: 4290790 - DNA, 21 bp, Homo sapiens
attcgcccaaagccagacagc

SEQ ID NO: 4290791 - DNA, 18 bp, Homo sapiens
attctaaaacattcttta

SEQ ID NO: 4290792 - DNA, 23 bp, Homo sapiens
attctaagaaatatctgtgaaat

SEQ ID NO: 4290793 - DNA, 24 bp, Homo sapiens
attctaagaaatatctgtgaaata

SEQ ID NO: 4290794 - DNA, 14 bp, Homo sapiens
attctagtcaactg

SEQ ID NO: 4290795 - DNA, 22 bp, Homo sapiens
attctagtcaactgctgtttta

SEQ ID NO: 4290796 - DNA, 17 bp, Homo sapiens
attctataaattcaaca

SEQ ID NO: 4290797 - DNA, 16 bp, Homo sapiens
attctatatttcatat

SEQ ID NO: 4290798 - DNA, 20 bp, Homo sapiens
attctatgcctgtatttcca

SEQ ID NO: 4290799 - DNA, 21 bp, Homo sapiens
attctccaggggtttacagtg

SEQ ID NO: 4290800 - DNA, 20 bp, Homo sapiens
attctcttggctggcttcct

SEQ ID NO: 4290801 - DNA, 16 bp, Homo sapiens
attctggggtggggct

SEQ ID NO: 4290802 - DNA, 18 bp, Homo sapiens
attctggggtggggcttg

SEQ ID NO: 4290803 - DNA, 14 bp, Homo sapiens
attctgtcttgaag

SEQ ID NO: 4290804 - DNA, 17 bp, Homo sapiens
attctgtggattctata

SEQ ID NO: 4290805 - DNA, 13 bp, Homo sapiens
attctgtgggcag

SEQ ID NO: 4290806 - DNA, 19 bp, Homo sapiens
ccatgtagaagagggagaa

SEQ ID NO: 4290807 - DNA, 21 bp, Homo sapiens
ccatgtagaagagggagaagg

SEQ ID NO: 4290808 - DNA, 12 bp, Homo sapiens
ccatgtgctgct

SEQ ID NO: 4290809 - DNA, 14 bp, Homo sapiens
ccatgtgctgtgca

SEQ ID NO: 4290810 - DNA, 17 bp, Homo sapiens
ccatgtgctgtgcaccc

SEQ ID NO: 4290811 - DNA, 18 bp, Homo sapiens
ccattatggctttgtgct

SEQ ID NO: 4290812 - DNA, 19 bp, Homo sapiens
ccattcacattttaacata

SEQ ID NO: 4290813 - DNA, 22 bp, Homo sapiens
ccattctccaggggtttacagt

SEQ ID NO: 4290814 - DNA, 16 bp, Homo sapiens
ccattgccttctgggg

SEQ ID NO: 4290815 - DNA, 19 bp, Homo sapiens
ccatttcttggttttgtat

SEQ ID NO: 4290816 - DNA, 18 bp, Homo sapiens
ccatttgcaacaggaaga

SEQ ID NO: 4290817 - DNA, 14 bp, Homo sapiens
ccatttgtaatgta

SEQ ID NO: 4290818 - DNA, 17 bp, Homo sapiens
ccatttgtaatgtatct

SEQ ID NO: 4290819 - DNA, 14 bp, Homo sapiens
ccatttttacaagt

SEQ ID NO: 4290820 - DNA, 14 bp, Homo sapiens
cccaaaaccacagc

SEQ ID NO: 4290821 - DNA, 23 bp, Homo sapiens
cccaaaccagggggaagcaccag

SEQ ID NO: 4290822 - DNA, 16 bp, Homo sapiens
cccaaccctgcccctg

SEQ ID NO: 4290823 - DNA, 20 bp, Homo sapiens
cccaacctcccctggtcctg

SEQ ID NO: 4290824 - DNA, 15 bp, Homo sapiens
cccaacgaaaagcac

SEQ ID NO: 4290825 - DNA, 19 bp, Homo sapiens
cccaagaaaggaaaccttt

SEQ ID NO: 4290826 - DNA, 20 bp, Homo sapiens
cccaagaatagatgctgact

SEQ ID NO: 4290827 - DNA, 18 bp, Homo sapiens
cccaaggtggtcttggag

SEQ ID NO: 4290828 - DNA, 23 bp, Homo sapiens
cccaaggtggtcttggagaggag

SEQ ID NO: 4290829 - DNA, 13 bp, Homo sapiens
cccacacaggcct

SEQ ID NO: 4290830 - DNA, 14 bp, Homo sapiens
cccacacaggcctg

SEQ ID NO: 4290831 - DNA, 17 bp, Homo sapiens
cccacacaggcctggcc

SEQ ID NO: 4290832 - DNA, 18 bp, Homo sapiens
cccacactacgcagaaga

SEQ ID NO: 4290833 - DNA, 17 bp, Homo sapiens
cccacaggagcgtgtcc

SEQ ID NO: 4290834 - DNA, 19 bp, Homo sapiens
cccacatagtgatggttcc

SEQ ID NO: 4290835 - DNA, 15 bp, Homo sapiens
cccacattctggctc

SEQ ID NO: 4290836 - DNA, 17 bp, Homo sapiens
cccacattctggctcca

SEQ ID NO: 4290837 - DNA, 17 bp, Homo sapiens
cccacattgcccacacc

SEQ ID NO: 4290838 - DNA, 17 bp, Homo sapiens
cccaccacacacaccct

SEQ ID NO: 4290839 - DNA, 12 bp, Homo sapiens
cccaccacagca

SEQ ID NO: 4290840 - DNA, 18 bp, Homo sapiens
cccaccagagcctccctc

SEQ ID NO: 4290841 - DNA, 12 bp, Homo sapiens
cccaccagcagc

SEQ ID NO: 4290842 - DNA, 13 bp, Homo sapiens
cccaccagcagca

SEQ ID NO: 4290843 - DNA, 22 bp, Homo sapiens
cccaccagctggctctgcagca

SEQ ID NO: 4290844 - DNA, 14 bp, Homo sapiens
cccaccccagccta

SEQ ID NO: 4290845 - DNA, 14 bp, Homo sapiens
cccaccccctgctg

SEQ ID NO: 4290846 - DNA, 18 bp, Homo sapiens
cccaccccctgctggtgc

SEQ ID NO: 4290847 - DNA, 13 bp, Homo sapiens
cccaccccttccc

SEQ ID NO: 4290848 - DNA, 15 bp, Homo sapiens
cccaccccttcccca

SEQ ID NO: 4290849 - DNA, 22 bp, Homo sapiens
cccaccccttccccactgcctg

SEQ ID NO: 4290850 - DNA, 13 bp, Homo sapiens
cccacctgggccc

SEQ ID NO: 4290851 - DNA, 21 bp, Homo sapiens
cccacctgggccctaggcata

SEQ ID NO: 4290852 - DNA, 18 bp, Homo sapiens
cccacgccctcctccctc

SEQ ID NO: 4290853 - DNA, 16 bp, Homo sapiens
cccactgcccctgcac

SEQ ID NO: 4290854 - DNA, 13 bp, Homo sapiens
cccactgcctgcc

SEQ ID NO: 4290855 - DNA, 16 bp, Homo sapiens
cccactgcctgcccac

SEQ ID NO: 4290856 - DNA, 20 bp, Homo sapiens
cccagaaatgccgctgtgtc

SEQ ID NO: 4290857 - DNA, 15 bp, Homo sapiens
cccagacatgctgcc

SEQ ID NO: 4290858 - DNA, 19 bp, Homo sapiens
cccagacatgctgcccacc

SEQ ID NO: 4290859 - DNA, 17 bp, Homo sapiens
cccagaccccatccagc

SEQ ID NO: 4290860 - DNA, 17 bp, Homo sapiens
cccagagaagcctcagt

SEQ ID NO: 4290861 - DNA, 20 bp, Homo sapiens
cccagagaagcctcagtccc

SEQ ID NO: 4290862 - DNA, 15 bp, Homo sapiens
cccagagagaccctg

SEQ ID NO: 4290863 - DNA, 17 bp, Homo sapiens
cccagaggggcggggcc

SEQ ID NO: 4290864 - DNA, 18 bp, Homo sapiens
cccagaggggcggggcca

SEQ ID NO: 4290865 - DNA, 23 bp, Homo sapiens
cccagaggggcggggccaggatg

SEQ ID NO: 4290866 - DNA, 17 bp, Homo sapiens
cccagatggctccctgg

SEQ ID NO: 4290867 - DNA, 23 bp, Homo sapiens
cccagatggctccctgggctggc

SEQ ID NO: 4290868 - DNA, 17 bp, Homo sapiens
cccagcaaccctcctat

SEQ ID NO: 4290869 - DNA, 21 bp, Homo sapiens
cccagcacccatgccccactc

SEQ ID NO: 4290870 - DNA, 16 bp, Homo sapiens
cccagcagcggcccag

SEQ ID NO: 4290871 - DNA, 12 bp, Homo sapiens
cccagcagtcct

SEQ ID NO: 4290872 - DNA, 14 bp, Homo sapiens
cccagcagtcctgg

SEQ ID NO: 4290873 - DNA, 23 bp, Homo sapiens
cccagccacccggatctccaggc

SEQ ID NO: 4290874 - DNA, 12 bp, Homo sapiens
cccagccagcag

SEQ ID NO: 4290875 - DNA, 13 bp, Homo sapiens
cccagccagcagg

SEQ ID NO: 4290876 - DNA, 21 bp, Homo sapiens
cccagcccagggttcccccag

SEQ ID NO: 4290877 - DNA, 12 bp, Homo sapiens
cccagccccagc

SEQ ID NO: 4290878 - DNA, 14 bp, Homo sapiens
cccagccccagcga

SEQ ID NO: 4290879 - DNA, 13 bp, Homo sapiens
cccagccccctgg

SEQ ID NO: 4290880 - DNA, 15 bp, Homo sapiens
cccagccctgtggaa

SEQ ID NO: 4290881 - DNA, 15 bp, Homo sapiens
cccagcctggcccca

SEQ ID NO: 4290882 - DNA, 18 bp, Homo sapiens
cccagcctgtggcctcag

SEQ ID NO: 4290883 - DNA, 20 bp, Homo sapiens
cccagcctgtggcctcagca

SEQ ID NO: 4290884 - DNA, 22 bp, Homo sapiens
cccagcctgtggcctcagcatc

SEQ ID NO: 4290885 - DNA, 24 bp, Homo sapiens
cccagcctgtggcctcagcatctc

SEQ ID NO: 4290886 - DNA, 15 bp, Homo sapiens
cccagcgagtctgga

SEQ ID NO: 4290887 - DNA, 21 bp, Homo sapiens
cccagcgagtctggagaccag

SEQ ID NO: 4290888 - DNA, 17 bp, Homo sapiens
cccaggacactgccttt

SEQ ID NO: 4290889 - DNA, 15 bp, Homo sapiens
cccaggacgcaggga

SEQ ID NO: 4290890 - DNA, 18 bp, Homo sapiens
cccaggacgcagggagac

SEQ ID NO: 4290891 - DNA, 21 bp, Homo sapiens
cccaggacgcagggagaccct

SEQ ID NO: 4290892 - DNA, 23 bp, Homo sapiens
cccaggacgcagggagaccctgg

SEQ ID NO: 4290893 - DNA, 19 bp, Homo sapiens
cccaggaggacctgggggg

SEQ ID NO: 4290894 - DNA, 16 bp, Homo sapiens
cccaggatggtcccag

SEQ ID NO: 4290895 - DNA, 13 bp, Homo sapiens
cccaggcaggctg

SEQ ID NO: 4290896 - DNA, 11 bp, Homo sapiens
cccaggcaggg

SEQ ID NO: 4290897 - DNA, 18 bp, Homo sapiens
cccaggcgccccttcccc

SEQ ID NO: 4290898 - DNA, 18 bp, Homo sapiens
cccagggagaggccatga

SEQ ID NO: 4290899 - DNA, 17 bp, Homo sapiens
cccagggccctgctcag

SEQ ID NO: 4290900 - DNA, 20 bp, Homo sapiens
cccagggccctgctcaggcc

SEQ ID NO: 4290901 - DNA, 19 bp, Homo sapiens
cccaggggtgagccccgcc

SEQ ID NO: 4290902 - DNA, 13 bp, Homo sapiens
cccaggtctcctg

SEQ ID NO: 4290903 - DNA, 18 bp, Homo sapiens
cccaggtctcctgggcat

SEQ ID NO: 4290904 - DNA, 23 bp, Homo sapiens
cccaggtctcctgggcatctggc

SEQ ID NO: 4290905 - DNA, 16 bp, Homo sapiens
cccagtgagagtgagg

SEQ ID NO: 4290906 - DNA, 20 bp, Homo sapiens
cccagtgagagtgaggcccc

SEQ ID NO: 4290907 - DNA, 20 bp, Homo sapiens
cccagtgggaggcgcgagcc

SEQ ID NO: 4290908 - DNA, 14 bp, Homo sapiens
cccagtgtccccag

SEQ ID NO: 4290909 - DNA, 16 bp, Homo sapiens
cccagtgtccccaggg

SEQ ID NO: 4290910 - DNA, 18 bp, Homo sapiens
cccagtgtggactctgga

SEQ ID NO: 4290911 - DNA, 14 bp, Homo sapiens
cccatccagccagg

SEQ ID NO: 4290912 - DNA, 18 bp, Homo sapiens
cccatcctccccttccct

SEQ ID NO: 4290913 - DNA, 13 bp, Homo sapiens
cccatgcatggcc

SEQ ID NO: 4290914 - DNA, 19 bp, Homo sapiens
cccatgcatggcctcccag

SEQ ID NO: 4290915 - DNA, 20 bp, Homo sapiens
cccatgcatggcctcccagc

SEQ ID NO: 4290916 - DNA, 20 bp, Homo sapiens
cccatgccccactctgctga

SEQ ID NO: 4290917 - DNA, 22 bp, Homo sapiens
cccatgccccactctgctgagg

SEQ ID NO: 4290918 - DNA, 23 bp, Homo sapiens
cccatgccccactctgctgaggc

SEQ ID NO: 4290919 - DNA, 12 bp, Homo sapiens
cccatgccctcc

SEQ ID NO: 4290920 - DNA, 20 bp, Homo sapiens
cccatgccctccctgctgcc

SEQ ID NO: 4290921 - DNA, 17 bp, Homo sapiens
cccatggtagactgtga

SEQ ID NO: 4290922 - DNA, 23 bp, Homo sapiens
cccatgtgtcgcctctcactctg

SEQ ID NO: 4290923 - DNA, 19 bp, Homo sapiens
cccattctataaattcaac

SEQ ID NO: 4290924 - DNA, 14 bp, Homo sapiens
cccattgccttctg

SEQ ID NO: 4290925 - DNA, 16 bp, Homo sapiens
cccattgccttctggg

SEQ ID NO: 4290926 - DNA, 22 bp, Homo sapiens
cccatttgcagaccaggaagga

SEQ ID NO: 4290927 - DNA, 17 bp, Homo sapiens
ccccaaaagtacttacc

SEQ ID NO: 4290928 - DNA, 21 bp, Homo sapiens
ccccaatcacgagatcttcct

SEQ ID NO: 4290929 - DNA, 14 bp, Homo sapiens
ccccacacaggcct

SEQ ID NO: 4290930 - DNA, 17 bp, Homo sapiens
ccccacacaggcctggc

SEQ ID NO: 4290931 - DNA, 19 bp, Homo sapiens
ccccacaggagcgtgtcct

SEQ ID NO: 4290932 - DNA, 23 bp, Homo sapiens
ccccacaggatgaactagccatg

SEQ ID NO: 4290933 - DNA, 14 bp, Homo sapiens
ccccaccagcagca

SEQ ID NO: 4290934 - DNA, 23 bp, Homo sapiens
ccccacccccgggtgcctgtgac

SEQ ID NO: 4290935 - DNA, 12 bp, Homo sapiens
ccccacccctcc

SEQ ID NO: 4290936 - DNA, 18 bp, Homo sapiens
ccccaccccttccccact

SEQ ID NO: 4290937 - DNA, 14 bp, Homo sapiens
ccccaccctttggg

SEQ ID NO: 4290938 - DNA, 15 bp, Homo sapiens
ccccaccttccctcc

SEQ ID NO: 4290939 - DNA, 19 bp, Homo sapiens
ccccactctgctgaggcca

SEQ ID NO: 4290940 - DNA, 12 bp, Homo sapiens
ccccactgcctg

SEQ ID NO: 4290941 - DNA, 16 bp, Homo sapiens
ccccacttatgctgct

SEQ ID NO: 4290942 - DNA, 21 bp, Homo sapiens
ccccagagactcagagggagg

SEQ ID NO: 4290943 - DNA, 15 bp, Homo sapiens
ccccagagccagggc

SEQ ID NO: 4290944 - DNA, 16 bp, Homo sapiens
ccccagagccagggct

SEQ ID NO: 4290945 - DNA, 11 bp, Homo sapiens
ccccagcaggt

SEQ ID NO: 4290946 - DNA, 18 bp, Homo sapiens
ccccagcagtcctgggcc

SEQ ID NO: 4290947 - DNA, 12 bp, Homo sapiens
ccccagccctgt

SEQ ID NO: 4290948 - DNA, 13 bp, Homo sapiens
ccccagccctgtg

SEQ ID NO: 4290949 - DNA, 19 bp, Homo sapiens
ccccagcgagtctggagac

SEQ ID NO: 4290950 - DNA, 12 bp, Homo sapiens
ccccagctccag

SEQ ID NO: 4290951 - DNA, 13 bp, Homo sapiens
ccccagctccagg

SEQ ID NO: 4290952 - DNA, 20 bp, Homo sapiens
ccccaggaagtcatcctgca

SEQ ID NO: 4290953 - DNA, 19 bp, Homo sapiens
ccccaggatgcatgcaggg

SEQ ID NO: 4290954 - DNA, 11 bp, Homo sapiens
ccccaggcagg

SEQ ID NO: 4290955 - DNA, 20 bp, Homo sapiens
ccccagggccctgctcaggc

SEQ ID NO: 4290956 - DNA, 20 bp, Homo sapiens
ccccaggggcacacttcccc

SEQ ID NO: 4290957 - DNA, 18 bp, Homo sapiens
ccccagtgtccccagggg

SEQ ID NO: 4290958 - DNA, 23 bp, Homo sapiens
ccccagtgtggactctggactgg

SEQ ID NO: 4290959 - DNA, 19 bp, Homo sapiens
ccccatcctccccttccct

SEQ ID NO: 4290960 - DNA, 17 bp, Homo sapiens
ccccatcgccttctggc

SEQ ID NO: 4290961 - DNA, 21 bp, Homo sapiens
ccccatcgccttctggctgct

SEQ ID NO: 4290962 - DNA, 13 bp, Homo sapiens
ccccatgcagtct

SEQ ID NO: 4290963 - DNA, 15 bp, Homo sapiens
ccccatgccctccct

SEQ ID NO: 4290964 - DNA, 21 bp, Homo sapiens
ccccatgccctccctgctgcc

SEQ ID NO: 4290965 - DNA, 20 bp, Homo sapiens
cccccacattctggctccac

SEQ ID NO: 4290966 - DNA, 21 bp, Homo sapiens
cccccacattctggctccacc

SEQ ID NO: 4290967 - DNA, 17 bp, Homo sapiens
cccccaccccttcccca

SEQ ID NO: 4290968 - DNA, 12 bp, Homo sapiens
cccccagagcca

SEQ ID NO: 4290969 - DNA, 19 bp, Homo sapiens
cccccagagccagggctgt

SEQ ID NO: 4290970 - DNA, 21 bp, Homo sapiens
cccccagagccagggctgtcc

SEQ ID NO: 4290971 - DNA, 22 bp, Homo sapiens
cccccagagccagggctgtcct

SEQ ID NO: 4290972 - DNA, 13 bp, Homo sapiens
cccccagccctgt

SEQ ID NO: 4290973 - DNA, 12 bp, Homo sapiens
cccccaggaccc

SEQ ID NO: 4290974 - DNA, 19 bp, Homo sapiens
cccccaggggtgagccccg

SEQ ID NO: 4290975 - DNA, 19 bp, Homo sapiens
cccccatcctccccttccc

SEQ ID NO: 4290976 - DNA, 15 bp, Homo sapiens
cccccgagctggggg

SEQ ID NO: 4290977 - DNA, 18 bp, Homo sapiens
cccccgccccgccccaca

SEQ ID NO: 4290978 - DNA, 15 bp, Homo sapiens
cccccgccctctgcc

SEQ ID NO: 4290979 - DNA, 20 bp, Homo sapiens
cccccgctctgccatcagcc

SEQ ID NO: 4290980 - DNA, 12 bp, Homo sapiens
cccccggacgcc

SEQ ID NO: 4290981 - DNA, 14 bp, Homo sapiens
ccccctccctggcc

SEQ ID NO: 4290982 - DNA, 14 bp, Homo sapiens
ccccctcggagcct

SEQ ID NO: 4290983 - DNA, 13 bp, Homo sapiens
ccccctctcgggc

SEQ ID NO: 4290984 - DNA, 12 bp, Homo sapiens
ccccctgcccca

SEQ ID NO: 4290985 - DNA, 16 bp, Homo sapiens
ccccctggggggcaca

SEQ ID NO: 4290986 - DNA, 21 bp, Homo sapiens
ccccctgtccttcccacggcc

SEQ ID NO: 4290987 - DNA, 17 bp, Homo sapiens
cccccttctcccacact

SEQ ID NO: 4290988 - DNA, 22 bp, Homo sapiens
ccccgagccgagctctcctggg

SEQ ID NO: 4290989 - DNA, 19 bp, Homo sapiens
ccccgcacgcaagcctcag

SEQ ID NO: 4290990 - DNA, 21 bp, Homo sapiens
ccccgcacgcaagcctcagcc

SEQ ID NO: 4290991 - DNA, 17 bp, Homo sapiens
ccccgccccacattccg

SEQ ID NO: 4290992 - DNA, 20 bp, Homo sapiens
ccccgccccacattccgaca

SEQ ID NO: 4290993 - DNA, 15 bp, Homo sapiens
ccccgccccccagag

SEQ ID NO: 4290994 - DNA, 18 bp, Homo sapiens
ccccgccccccagagcca

SEQ ID NO: 4290995 - DNA, 19 bp, Homo sapiens
ccccgccccccagagccag

SEQ ID NO: 4290996 - DNA, 16 bp, Homo sapiens
ccccgccccgccccac

SEQ ID NO: 4290997 - DNA, 13 bp, Homo sapiens
ccccgccctctgc

SEQ ID NO: 4290998 - DNA, 22 bp, Homo sapiens
ccccgccgtgtctgtggccctc

SEQ ID NO: 4290999 - DNA, 23 bp, Homo sapiens
ccccgccgtgtctgtggccctct

SEQ ID NO: 4291000 - DNA, 12 bp, Homo sapiens
ccccgcctctgg

SEQ ID NO: 4291001 - DNA, 20 bp, Homo sapiens
ccccgctctgccatcagccc

SEQ ID NO: 4291002 - DNA, 16 bp, Homo sapiens
ccccggacaagcccag

SEQ ID NO: 4291003 - DNA, 14 bp, Homo sapiens
ccccggcctgatgg

SEQ ID NO: 4291004 - DNA, 23 bp, Homo sapiens
ccccgggtttggcgggccaagga

SEQ ID NO: 4291005 - DNA, 15 bp, Homo sapiens
ccccgtccctttccc

SEQ ID NO: 4291006 - DNA, 17 bp, Homo sapiens
ccccgtccctttccctg

SEQ ID NO: 4291007 - DNA, 18 bp, Homo sapiens
ccccgttgttgtccctgc

SEQ ID NO: 4291008 - DNA, 19 bp, Homo sapiens
ccccgttgttgtccctgca

SEQ ID NO: 4291009 - DNA, 14 bp, Homo sapiens
cccctatcctgcac

SEQ ID NO: 4291010 - DNA, 16 bp, Homo sapiens
cccctatcctgcaccc

SEQ ID NO: 4291011 - DNA, 11 bp, Homo sapiens
cccctccagac

SEQ ID NO: 4291012 - DNA, 16 bp, Homo sapiens
cccctccctggcctgt

SEQ ID NO: 4291013 - DNA, 23 bp, Homo sapiens
cccctccctttttaaacaaatgg

SEQ ID NO: 4291014 - DNA, 12 bp, Homo sapiens
cccctccttctc

SEQ ID NO: 4291015 - DNA, 13 bp, Homo sapiens
cccctccttctcc

SEQ ID NO: 4291016 - DNA, 22 bp, Homo sapiens
cccctccttctcccctccagac

SEQ ID NO: 4291017 - DNA, 21 bp, Homo sapiens
cccctccttgccgctgggaga

SEQ ID NO: 4291018 - DNA, 18 bp, Homo sapiens
cccctccttgcctcctgt

SEQ ID NO: 4291019 - DNA, 14 bp, Homo sapiens
cccctcggagcctg

SEQ ID NO: 4291020 - DNA, 18 bp, Homo sapiens
cccctcggagcctgtgtt

SEQ ID NO: 4291021 - DNA, 16 bp, Homo sapiens
cccctctcctgcatcc

SEQ ID NO: 4291022 - DNA, 19 bp, Homo sapiens
cccctgaagtgaccccagc

SEQ ID NO: 4291023 - DNA, 20 bp, Homo sapiens
cccctgaagtgaccccagct

SEQ ID NO: 4291024 - DNA, 23 bp, Homo sapiens
cccctgaagtgaccccagctcca

SEQ ID NO: 4291025 - DNA, 13 bp, Homo sapiens
cccctgcacacac

SEQ ID NO: 4291026 - DNA, 16 bp, Homo sapiens
cccctgccagaggcct

SEQ ID NO: 4291027 - DNA, 23 bp, Homo sapiens
cccctgccagaggcctggtgccc

SEQ ID NO: 4291028 - DNA, 15 bp, Homo sapiens
cccctgccccgtcac

SEQ ID NO: 4291029 - DNA, 12 bp, Homo sapiens
cccctgcctgtg

SEQ ID NO: 4291030 - DNA, 14 bp, Homo sapiens
cccctgcgccctcc

SEQ ID NO: 4291031 - DNA, 13 bp, Homo sapiens
cccctgctgcctc

SEQ ID NO: 4291032 - DNA, 18 bp, Homo sapiens
cccctggcttttcactgc

SEQ ID NO: 4291033 - DNA, 23 bp, Homo sapiens
cccctggcttttcactgctggct

SEQ ID NO: 4291034 - DNA, 13 bp, Homo sapiens
cccctgggagagt

SEQ ID NO: 4291035 - DNA, 18 bp, Homo sapiens
cccctggggggcacagcc

SEQ ID NO: 4291036 - DNA, 19 bp, Homo sapiens
cccctggggtacttctgtg

SEQ ID NO: 4291037 - DNA, 21 bp, Homo sapiens
cccctggtgtccctgcctggc

SEQ ID NO: 4291038 - DNA, 12 bp, Homo sapiens
cccctgtccttc

SEQ ID NO: 4291039 - DNA, 20 bp, Homo sapiens
cccctgtccttcccacggcc

SEQ ID NO: 4291040 - DNA, 13 bp, Homo sapiens
ccccttcccaccc

SEQ ID NO: 4291041 - DNA, 21 bp, Homo sapiens
ccccttccccactgcctgccc

SEQ ID NO: 4291042 - DNA, 13 bp, Homo sapiens
ccccttcccctgc

SEQ ID NO: 4291043 - DNA, 18 bp, Homo sapiens
ccccttcccctgcgccct

SEQ ID NO: 4291044 - DNA, 14 bp, Homo sapiens
ccccttccctgcaa

SEQ ID NO: 4291045 - DNA, 13 bp, Homo sapiens
ccccttgctgctg

SEQ ID NO: 4291046 - DNA, 18 bp, Homo sapiens
ccccttgctgctggctcc

SEQ ID NO: 4291047 - DNA, 21 bp, Homo sapiens
ccccttgctgctggctcccat

SEQ ID NO: 4291048 - DNA, 15 bp, Homo sapiens
cccctttggcacacc

SEQ ID NO: 4291049 - DNA, 14 bp, Homo sapiens
cccgacagcctggc

SEQ ID NO: 4291050 - DNA, 18 bp, Homo sapiens
cccgacagcctggcacag

SEQ ID NO: 4291051 - DNA, 14 bp, Homo sapiens
cccgacagtggctc

SEQ ID NO: 4291052 - DNA, 17 bp, Homo sapiens
cccgacagtggctctcc

SEQ ID NO: 4291053 - DNA, 20 bp, Homo sapiens
cccgacatggacccggagct

SEQ ID NO: 4291054 - DNA, 17 bp, Homo sapiens
cccgagccccctgtcct

SEQ ID NO: 4291055 - DNA, 12 bp, Homo sapiens
cccgaggcagca

SEQ ID NO: 4291056 - DNA, 16 bp, Homo sapiens
cccgaggcagcaacag

SEQ ID NO: 4291057 - DNA, 21 bp, Homo sapiens
cccgaggcagcaacaggacca

SEQ ID NO: 4291058 - DNA, 16 bp, Homo sapiens
cccgcacccccaccct

SEQ ID NO: 4291059 - DNA, 17 bp, Homo sapiens
cccgcacgcaagcctca

SEQ ID NO: 4291060 - DNA, 17 bp, Homo sapiens
cccgcatgctgcctgcc

SEQ ID NO: 4291061 - DNA, 18 bp, Homo sapiens
cccgcatgctgcctgcct

SEQ ID NO: 4291062 - DNA, 22 bp, Homo sapiens
cccgcatgctgcctgcctccgg

SEQ ID NO: 4291063 - DNA, 14 bp, Homo sapiens
cccgcccacctggg

SEQ ID NO: 4291064 - DNA, 16 bp, Homo sapiens
cccgccccccagagcc

SEQ ID NO: 4291065 - DNA, 22 bp, Homo sapiens
cccgccccccagagccagggct

SEQ ID NO: 4291066 - DNA, 21 bp, Homo sapiens
cccgccgtgtctgtggccctc

SEQ ID NO: 4291067 - DNA, 22 bp, Homo sapiens
cccgccgtgtctgtggccctct

SEQ ID NO: 4291068 - DNA, 23 bp, Homo sapiens
cccgctcagccctccctgcccct

SEQ ID NO: 4291069 - DNA, 16 bp, Homo sapiens
cccgctgcgctgccct

SEQ ID NO: 4291070 - DNA, 20 bp, Homo sapiens
cccggagctaacactggccc

SEQ ID NO: 4291071 - DNA, 17 bp, Homo sapiens
cccggagctcaggccct

SEQ ID NO: 4291072 - DNA, 20 bp, Homo sapiens
cccggagctgggaaggtccc

SEQ ID NO: 4291073 - DNA, 22 bp, Homo sapiens
cccggatctccaggcccagcct

SEQ ID NO: 4291074 - DNA, 18 bp, Homo sapiens
cacgagatcttccttccg

SEQ ID NO: 4291075 - DNA, 12 bp, Homo sapiens
cacgcaagcctc

SEQ ID NO: 4291076 - DNA, 15 bp, Homo sapiens
cacgccaaccccagc

SEQ ID NO: 4291077 - DNA, 24 bp, Homo sapiens
cacgccaaccccagcagtcctggg

SEQ ID NO: 4291078 - DNA, 19 bp, Homo sapiens
cacgcccgactctctccat

SEQ ID NO: 4291079 - DNA, 13 bp, Homo sapiens
cacgccctcctcc

SEQ ID NO: 4291080 - DNA, 15 bp, Homo sapiens
cacgccctcctccct

SEQ ID NO: 4291081 - DNA, 16 bp, Homo sapiens
cacgccctcctccctc

SEQ ID NO: 4291082 - DNA, 15 bp, Homo sapiens
cacgccttcccctca

SEQ ID NO: 4291083 - DNA, 15 bp, Homo sapiens
cacgctgtctccaga

SEQ ID NO: 4291084 - DNA, 19 bp, Homo sapiens
cacggcagccaccctgcca

SEQ ID NO: 4291085 - DNA, 21 bp, Homo sapiens
cacggcagccaccctgccatg

SEQ ID NO: 4291086 - DNA, 14 bp, Homo sapiens
cacggccactgcag

SEQ ID NO: 4291087 - DNA, 15 bp, Homo sapiens
cacggccactgcagt

SEQ ID NO: 4291088 - DNA, 13 bp, Homo sapiens
cacggcctctggg

SEQ ID NO: 4291089 - DNA, 21 bp, Homo sapiens
cacggcgtccctgagggccct

SEQ ID NO: 4291090 - DNA, 21 bp, Homo sapiens
cacggctgcacctgcagggag

SEQ ID NO: 4291091 - DNA, 22 bp, Homo sapiens
cacggctgcacctgcagggagc

SEQ ID NO: 4291092 - DNA, 13 bp, Homo sapiens
cacgtgcacacac

SEQ ID NO: 4291093 - DNA, 14 bp, Homo sapiens
cacgtgcacacacc

SEQ ID NO: 4291094 - DNA, 16 bp, Homo sapiens
cacgtgcacacacctg

SEQ ID NO: 4291095 - DNA, 17 bp, Homo sapiens
cacgtgcacacacctgc

SEQ ID NO: 4291096 - DNA, 19 bp, Homo sapiens
cacgtgcacacacctgcac

SEQ ID NO: 4291097 - DNA, 16 bp, Homo sapiens
cacgtgtttttgtatc

SEQ ID NO: 4291098 - DNA, 17 bp, Homo sapiens
cactataatgtgaaatg

SEQ ID NO: 4291099 - DNA, 22 bp, Homo sapiens
cactatgtccatgaaaaacagc

SEQ ID NO: 4291100 - DNA, 12 bp, Homo sapiens
cactcagcacaa

SEQ ID NO: 4291101 - DNA, 15 bp, Homo sapiens
cactccactcccctc

SEQ ID NO: 4291102 - DNA, 14 bp, Homo sapiens
cactccagacccct

SEQ ID NO: 4291103 - DNA, 13 bp, Homo sapiens
cactccctgtctg

SEQ ID NO: 4291104 - DNA, 14 bp, Homo sapiens
cactctacttagca

SEQ ID NO: 4291105 - DNA, 16 bp, Homo sapiens
cactctgctgaggcca

SEQ ID NO: 4291106 - DNA, 15 bp, Homo sapiens
cactctggcagcctc

SEQ ID NO: 4291107 - DNA, 12 bp, Homo sapiens
cactctgttcct

SEQ ID NO: 4291108 - DNA, 22 bp, Homo sapiens
cactgaaggctttcagggcctc

SEQ ID NO: 4291109 - DNA, 22 bp, Homo sapiens
cactgaataatggaattatgta

SEQ ID NO: 4291110 - DNA, 20 bp, Homo sapiens
cactgagtctcattcctctg

SEQ ID NO: 4291111 - DNA, 20 bp, Homo sapiens
cactgcatgcggcaaaccgc

SEQ ID NO: 4291112 - DNA, 20 bp, Homo sapiens
cactgccctccgcccttccc

SEQ ID NO: 4291113 - DNA, 13 bp, Homo sapiens
cactgcctttgct

SEQ ID NO: 4291114 - DNA, 17 bp, Homo sapiens
cactgctaggtgggcca

SEQ ID NO: 4291115 - DNA, 14 bp, Homo sapiens
cactgctggctgcc

SEQ ID NO: 4291116 - DNA, 21 bp, Homo sapiens
cactgctggctgccttagaac

SEQ ID NO: 4291117 - DNA, 14 bp, Homo sapiens
cactggaagggtcc

SEQ ID NO: 4291118 - DNA, 18 bp, Homo sapiens
cactggaagggtccggct

SEQ ID NO: 4291119 - DNA, 16 bp, Homo sapiens
cactggaggcctctgc

SEQ ID NO: 4291120 - DNA, 22 bp, Homo sapiens
cactggaggcctctgcaagatt

SEQ ID NO: 4291121 - DNA, 16 bp, Homo sapiens
cactggcatctctgga

SEQ ID NO: 4291122 - DNA, 18 bp, Homo sapiens
cactggcatctctggagt

SEQ ID NO: 4291123 - DNA, 20 bp, Homo sapiens
cactggctcctccagcaaga

SEQ ID NO: 4291124 - DNA, 14 bp, Homo sapiens
cactggtctcagag

SEQ ID NO: 4291125 - DNA, 17 bp, Homo sapiens
cactggtctcagaggag

SEQ ID NO: 4291126 - DNA, 14 bp, Homo sapiens
cactggtgcattta

SEQ ID NO: 4291127 - DNA, 21 bp, Homo sapiens
cactggtggcccgacagcctg

SEQ ID NO: 4291128 - DNA, 19 bp, Homo sapiens
cactgtatctaaaaaataa

SEQ ID NO: 4291129 - DNA, 22 bp, Homo sapiens
cactgtatctaaaaaataactg

SEQ ID NO: 4291130 - DNA, 14 bp, Homo sapiens
cactgtctgctgcc

SEQ ID NO: 4291131 - DNA, 23 bp, Homo sapiens
cactgttcccagcaaagttttca

SEQ ID NO: 4291132 - DNA, 19 bp, Homo sapiens
cactgtttaactgggagtg

SEQ ID NO: 4291133 - DNA, 21 bp, Homo sapiens
cactgtttcactactcagcat

SEQ ID NO: 4291134 - DNA, 24 bp, Homo sapiens
cacttagaaattgcatttcctgac

SEQ ID NO: 4291135 - DNA, 13 bp, Homo sapiens
cacttatgctgct

SEQ ID NO: 4291136 - DNA, 17 bp, Homo sapiens
cacttatgctgctgtga

SEQ ID NO: 4291137 - DNA, 14 bp, Homo sapiens
cacttatttcataa

SEQ ID NO: 4291138 - DNA, 17 bp, Homo sapiens
cacttatttcataaaca

SEQ ID NO: 4291139 - DNA, 15 bp, Homo sapiens
cacttatttctaaat

SEQ ID NO: 4291140 - DNA, 12 bp, Homo sapiens
cacttattttct

SEQ ID NO: 4291141 - DNA, 22 bp, Homo sapiens
cacttcaaacatgccctcaggc

SEQ ID NO: 4291142 - DNA, 23 bp, Homo sapiens
cacttcaagctcaccctgctcct

SEQ ID NO: 4291143 - DNA, 14 bp, Homo sapiens
cacttcctgtccag

SEQ ID NO: 4291144 - DNA, 18 bp, Homo sapiens
cacttggcctcttcggga

SEQ ID NO: 4291145 - DNA, 12 bp, Homo sapiens
cacttgtgtttg

SEQ ID NO: 4291146 - DNA, 23 bp, Homo sapiens
cacttgtgtttgtatataaatgg

SEQ ID NO: 4291147 - DNA, 17 bp, Homo sapiens
cactttgcagacctggg

SEQ ID NO: 4291148 - DNA, 20 bp, Homo sapiens
cactttgcagacctgggact

SEQ ID NO: 4291149 - DNA, 18 bp, Homo sapiens
cactttggtaatgtgtca

SEQ ID NO: 4291150 - DNA, 15 bp, Homo sapiens
cacttttcatatcat

SEQ ID NO: 4291151 - DNA, 17 bp, Homo sapiens
cacttttcatatcattt

SEQ ID NO: 4291152 - DNA, 16 bp, Homo sapiens
cagaaagggcagcccc

SEQ ID NO: 4291153 - DNA, 19 bp, Homo sapiens
cagaaatgccgctgtgtcc

SEQ ID NO: 4291154 - DNA, 13 bp, Homo sapiens
cagaacatgagtt

SEQ ID NO: 4291155 - DNA, 16 bp, Homo sapiens
cagaaccaacgggtct

SEQ ID NO: 4291156 - DNA, 22 bp, Homo sapiens
cagaacccttggagccaatgga

SEQ ID NO: 4291157 - DNA, 19 bp, Homo sapiens
cagaacgcatgcagggccc

SEQ ID NO: 4291158 - DNA, 18 bp, Homo sapiens
cagaacgggttctcccat

SEQ ID NO: 4291159 - DNA, 17 bp, Homo sapiens
cagaactaccaaaatga

SEQ ID NO: 4291160 - DNA, 16 bp, Homo sapiens
cagaactcagccttaa

SEQ ID NO: 4291161 - DNA, 15 bp, Homo sapiens
cagaactgagctcct

SEQ ID NO: 4291162 - DNA, 16 bp, Homo sapiens
cagaactgtcttagtc

SEQ ID NO: 4291163 - DNA, 18 bp, Homo sapiens
cagaagaaactcctggat

SEQ ID NO: 4291164 - DNA, 18 bp, Homo sapiens
cagaagaagctcctgaat

SEQ ID NO: 4291165 - DNA, 12 bp, Homo sapiens
cagaagagaaag

SEQ ID NO: 4291166 - DNA, 13 bp, Homo sapiens
cagaagagaaagt

SEQ ID NO: 4291167 - DNA, 16 bp, Homo sapiens
cagaagcagttgcaat

SEQ ID NO: 4291168 - DNA, 22 bp, Homo sapiens
cagaaggaaggagccagctccc

SEQ ID NO: 4291169 - DNA, 14 bp, Homo sapiens
cagaaggaggaagg

SEQ ID NO: 4291170 - DNA, 16 bp, Homo sapiens
cagaagggggccatga

SEQ ID NO: 4291171 - DNA, 18 bp, Homo sapiens
cagaagttgttagtgatt

SEQ ID NO: 4291172 - DNA, 23 bp, Homo sapiens
cagaatacagtaagctgctctat

SEQ ID NO: 4291173 - DNA, 20 bp, Homo sapiens
cagaatcaaatctgagcctt

SEQ ID NO: 4291174 - DNA, 19 bp, Homo sapiens
cagaatggaagagagaaag

SEQ ID NO: 4291175 - DNA, 15 bp, Homo sapiens
cagacagcagtgtga

SEQ ID NO: 4291176 - DNA, 16 bp, Homo sapiens
cagacagggtggggct

SEQ ID NO: 4291177 - DNA, 18 bp, Homo sapiens
cagacagtggatgagaca

SEQ ID NO: 4291178 - DNA, 20 bp, Homo sapiens
cagacattgacaagcacgca

SEQ ID NO: 4291179 - DNA, 13 bp, Homo sapiens
cagacattgtatt

SEQ ID NO: 4291180 - DNA, 14 bp, Homo sapiens
cagacccagggtgg

SEQ ID NO: 4291181 - DNA, 13 bp, Homo sapiens
cagacccccaccc

SEQ ID NO: 4291182 - DNA, 18 bp, Homo sapiens
cagacccccaccccttcc

SEQ ID NO: 4291183 - DNA, 20 bp, Homo sapiens
cagacccccaccccttcccc

SEQ ID NO: 4291184 - DNA, 21 bp, Homo sapiens
cagacccccaccccttcccca

SEQ ID NO: 4291185 - DNA, 22 bp, Homo sapiens
cagacccccaccccttccccac

SEQ ID NO: 4291186 - DNA, 18 bp, Homo sapiens
cagacccctaccctttcc

SEQ ID NO: 4291187 - DNA, 14 bp, Homo sapiens
cagacccctggctt

SEQ ID NO: 4291188 - DNA, 16 bp, Homo sapiens
cagacccctggctttt

SEQ ID NO: 4291189 - DNA, 18 bp, Homo sapiens
cagacccctggcttttca

SEQ ID NO: 4291190 - DNA, 23 bp, Homo sapiens
cagacccctggcttttcactgct

SEQ ID NO: 4291191 - DNA, 13 bp, Homo sapiens
cagacctgggact

SEQ ID NO: 4291192 - DNA, 18 bp, Homo sapiens
cagacctgggccctggtt

SEQ ID NO: 4291193 - DNA, 17 bp, Homo sapiens
cagactagctaattagc

SEQ ID NO: 4291194 - DNA, 22 bp, Homo sapiens
cagactctctcctctctctccc

SEQ ID NO: 4291195 - DNA, 12 bp, Homo sapiens
cagactctgtga

SEQ ID NO: 4291196 - DNA, 20 bp, Homo sapiens
cagacttcgctattcccagg

SEQ ID NO: 4291197 - DNA, 22 bp, Homo sapiens
cagacttcgctattcccaggca

SEQ ID NO: 4291198 - DNA, 13 bp, Homo sapiens
cagagaagcagca

SEQ ID NO: 4291199 - DNA, 17 bp, Homo sapiens
cagagaagcagcatcaa

SEQ ID NO: 4291200 - DNA, 16 bp, Homo sapiens
cagagagaccctgcca

SEQ ID NO: 4291201 - DNA, 17 bp, Homo sapiens
cagagagaccctgccaa

SEQ ID NO: 4291202 - DNA, 19 bp, Homo sapiens
cagagagagaagtgcccct

SEQ ID NO: 4291203 - DNA, 20 bp, Homo sapiens
cagagagagaagtgcccctg

SEQ ID NO: 4291204 - DNA, 13 bp, Homo sapiens
cagagagtggctc

SEQ ID NO: 4291205 - DNA, 15 bp, Homo sapiens
cagagagtggctcct

SEQ ID NO: 4291206 - DNA, 14 bp, Homo sapiens
cagagatgtaccat

SEQ ID NO: 4291207 - DNA, 13 bp, Homo sapiens
cagagccagggct

SEQ ID NO: 4291208 - DNA, 14 bp, Homo sapiens
cagagccagggctg

SEQ ID NO: 4291209 - DNA, 15 bp, Homo sapiens
cagagccagggctgt

SEQ ID NO: 4291210 - DNA, 15 bp, Homo sapiens
cagagccatctgcga

SEQ ID NO: 4291211 - DNA, 16 bp, Homo sapiens
cagagccatctgcgac

SEQ ID NO: 4291212 - DNA, 18 bp, Homo sapiens
cagagcctccctcagcca

SEQ ID NO: 4291213 - DNA, 12 bp, Homo sapiens
cagagcctgggg

SEQ ID NO: 4291214 - DNA, 13 bp, Homo sapiens
cagagcctggggt

SEQ ID NO: 4291215 - DNA, 19 bp, Homo sapiens
cagagcctggggtgggtgt

SEQ ID NO: 4291216 - DNA, 14 bp, Homo sapiens
cagagctccacaga

SEQ ID NO: 4291217 - DNA, 15 bp, Homo sapiens
cagagctccacagaa

SEQ ID NO: 4291218 - DNA, 16 bp, Homo sapiens
cagagctccacagaag

SEQ ID NO: 4291219 - DNA, 12 bp, Homo sapiens
cagagctgcaga

SEQ ID NO: 4291220 - DNA, 13 bp, Homo sapiens
cagagctgggagg

SEQ ID NO: 4291221 - DNA, 14 bp, Homo sapiens
cagagctgggaggg

SEQ ID NO: 4291222 - DNA, 20 bp, Homo sapiens
cagaggaagggaggcctgag

SEQ ID NO: 4291223 - DNA, 23 bp, Homo sapiens
cagaggacagatcaatggcgcag

SEQ ID NO: 4291224 - DNA, 22 bp, Homo sapiens
cagaggagggatagagacgcag

SEQ ID NO: 4291225 - DNA, 22 bp, Homo sapiens
cagaggaggtgcccgggcaggg

SEQ ID NO: 4291226 - DNA, 14 bp, Homo sapiens
cagaggatggcttc

SEQ ID NO: 4291227 - DNA, 19 bp, Homo sapiens
cagaggcattggaggatgg

SEQ ID NO: 4291228 - DNA, 21 bp, Homo sapiens
cagaggccccttgctgctggc

SEQ ID NO: 4291229 - DNA, 12 bp, Homo sapiens
cagaggcctggt

SEQ ID NO: 4291230 - DNA, 18 bp, Homo sapiens
cagaggcctggtgccctg

SEQ ID NO: 4291231 - DNA, 20 bp, Homo sapiens
cagaggcctggtgccctggc

SEQ ID NO: 4291232 - DNA, 22 bp, Homo sapiens
cagaggcctggtgccctggccc

SEQ ID NO: 4291233 - DNA, 22 bp, Homo sapiens
cagagggacagtgggctatgcc

SEQ ID NO: 4291234 - DNA, 16 bp, Homo sapiens
cagaggggagaggaag

SEQ ID NO: 4291235 - DNA, 21 bp, Homo sapiens
cagagtaggtgggtcttggat

SEQ ID NO: 4291236 - DNA, 14 bp, Homo sapiens
cagagtatatatgt

SEQ ID NO: 4291237 - DNA, 17 bp, Homo sapiens
cagagtatatatgtaca

SEQ ID NO: 4291238 - DNA, 18 bp, Homo sapiens
cagagtatatatgtacag

SEQ ID NO: 4291239 - DNA, 16 bp, Homo sapiens
cagagtccaggcccca

SEQ ID NO: 4291240 - DNA, 16 bp, Homo sapiens
cagagtgcacagctgt

SEQ ID NO: 4291241 - DNA, 15 bp, Homo sapiens
cagagtggatctgga

SEQ ID NO: 4291242 - DNA, 17 bp, Homo sapiens
cagataagcctgaaaca

SEQ ID NO: 4291243 - DNA, 14 bp, Homo sapiens
cagatagcctaggg

SEQ ID NO: 4291244 - DNA, 13 bp, Homo sapiens
cagatctagccag

SEQ ID NO: 4291245 - DNA, 21 bp, Homo sapiens
cagatgacagggagctgggga

SEQ ID NO: 4291246 - DNA, 20 bp, Homo sapiens
cagatgctggtcatcctggg

SEQ ID NO: 4291247 - DNA, 24 bp, Homo sapiens
cagatgctggtcatcctgggcatg

SEQ ID NO: 4291248 - DNA, 16 bp, Homo sapiens
cagatggcatgtgttt

SEQ ID NO: 4291249 - DNA, 16 bp, Homo sapiens
cagatggctccctggg

SEQ ID NO: 4291250 - DNA, 22 bp, Homo sapiens
cagatggctccctgggctggca

SEQ ID NO: 4291251 - DNA, 23 bp, Homo sapiens
cagatgggttttgttaggggtgg

SEQ ID NO: 4291252 - DNA, 16 bp, Homo sapiens
cagatggtgaagcatt

SEQ ID NO: 4291253 - DNA, 20 bp, Homo sapiens
cagatgtaagaagcccgatc

SEQ ID NO: 4291254 - DNA, 22 bp, Homo sapiens
cagatgtttgttttcaaaatac

SEQ ID NO: 4291255 - DNA, 15 bp, Homo sapiens
cagattaggcctgga

SEQ ID NO: 4291256 - DNA, 16 bp, Homo sapiens
cagattaggcctggag

SEQ ID NO: 4291257 - DNA, 19 bp, Homo sapiens
cagattggttcatgcctgg

SEQ ID NO: 4291258 - DNA, 16 bp, Homo sapiens
cagatttttacacatg

SEQ ID NO: 4291259 - DNA, 16 bp, Homo sapiens
cagcaaagttttcaga

SEQ ID NO: 4291260 - DNA, 20 bp, Homo sapiens
cagcaacggggaggccaagt

SEQ ID NO: 4291261 - DNA, 24 bp, Homo sapiens
cagcacaattatgtgtgaagctga

SEQ ID NO: 4291262 - DNA, 18 bp, Homo sapiens
cagcacaattctgtccct

SEQ ID NO: 4291263 - DNA, 19 bp, Homo sapiens
cagcacaattctgtccctg

SEQ ID NO: 4291264 - DNA, 19 bp, Homo sapiens
cagcacattgccctgaggg

SEQ ID NO: 4291265 - DNA, 16 bp, Homo sapiens
cagcagaaggccttgc

SEQ ID NO: 4291266 - DNA, 17 bp, Homo sapiens
cagcagaaggccttgcc

SEQ ID NO: 4291267 - DNA, 16 bp, Homo sapiens
cagcagagccatctgc

SEQ ID NO: 4291268 - DNA, 12 bp, Homo sapiens
cagcagcacaat

SEQ ID NO: 4291269 - DNA, 13 bp, Homo sapiens
cagcagcacaatt

SEQ ID NO: 4291270 - DNA, 20 bp, Homo sapiens
cagcagcacaattctgtccc

SEQ ID NO: 4291271 - DNA, 14 bp, Homo sapiens
cagcagcggcccag

SEQ ID NO: 4291272 - DNA, 18 bp, Homo sapiens
cagcagggcgggccagga

SEQ ID NO: 4291273 - DNA, 21 bp, Homo sapiens
cagcagggcgggccaggagaa

SEQ ID NO: 4291274 - DNA, 20 bp, Homo sapiens
cagcaggggcagaaggagga

SEQ ID NO: 4291275 - DNA, 13 bp, Homo sapiens
cagcagtcctggg

SEQ ID NO: 4291276 - DNA, 14 bp, Homo sapiens
cagcagtcctgggc

SEQ ID NO: 4291277 - DNA, 16 bp, Homo sapiens
cagcagtgtgagggtg

SEQ ID NO: 4291278 - DNA, 17 bp, Homo sapiens
cagcatcgtgtgggtcc

SEQ ID NO: 4291279 - DNA, 12 bp, Homo sapiens
cagcattcaaaa

SEQ ID NO: 4291280 - DNA, 18 bp, Homo sapiens
cagccaacccctgtggag

SEQ ID NO: 4291281 - DNA, 21 bp, Homo sapiens
cagccaacccctgtggagccc

SEQ ID NO: 4291282 - DNA, 19 bp, Homo sapiens
cagccacacccaggcactt

SEQ ID NO: 4291283 - DNA, 13 bp, Homo sapiens
cagccaccacctg

SEQ ID NO: 4291284 - DNA, 15 bp, Homo sapiens
cagccaccacctgga

SEQ ID NO: 4291285 - DNA, 16 bp, Homo sapiens
cagccaccctgccatg

SEQ ID NO: 4291286 - DNA, 19 bp, Homo sapiens
cagccagcaggttctctcc

SEQ ID NO: 4291287 - DNA, 17 bp, Homo sapiens
cagccattcacaacaca

SEQ ID NO: 4291288 - DNA, 19 bp, Homo sapiens
cagcccacatccattccag

SEQ ID NO: 4291289 - DNA, 19 bp, Homo sapiens
cagcccacccccctcattt

SEQ ID NO: 4291290 - DNA, 19 bp, Homo sapiens
cagcccacctgctgcccgt

SEQ ID NO: 4291291 - DNA, 23 bp, Homo sapiens
cagcccacctgctgcccgtgagg

SEQ ID NO: 4291292 - DNA, 11 bp, Homo sapiens
cagcccagaga

SEQ ID NO: 4291293 - DNA, 12 bp, Homo sapiens
cagcccagagag

SEQ ID NO: 4291294 - DNA, 21 bp, Homo sapiens
cagcccagagagaccctgcca

SEQ ID NO: 4291295 - DNA, 17 bp, Homo sapiens
cagcccagatggctccc

SEQ ID NO: 4291296 - DNA, 17 bp, Homo sapiens
cagcccagggttccccc

SEQ ID NO: 4291297 - DNA, 19 bp, Homo sapiens
cagcccagggttcccccag

SEQ ID NO: 4291298 - DNA, 19 bp, Homo sapiens
cagccccagcgagtctgga

SEQ ID NO: 4291299 - DNA, 21 bp, Homo sapiens
cagccccagggccctgctcag

SEQ ID NO: 4291300 - DNA, 22 bp, Homo sapiens
cagccccagggccctgctcagg

SEQ ID NO: 4291301 - DNA, 21 bp, Homo sapiens
cagccccctcctgaccccacc

SEQ ID NO: 4291302 - DNA, 17 bp, Homo sapiens
cagcccctcttgccccc

SEQ ID NO: 4291303 - DNA, 14 bp, Homo sapiens
cagcccctgctgct

SEQ ID NO: 4291304 - DNA, 23 bp, Homo sapiens
cagcccctgctgctcctcggcca

SEQ ID NO: 4291305 - DNA, 23 bp, Homo sapiens
cagcccgggagatccgccctggg

SEQ ID NO: 4291306 - DNA, 18 bp, Homo sapiens
cagccctccctgcccctc

SEQ ID NO: 4291307 - DNA, 11 bp, Homo sapiens
cagccctgctt

SEQ ID NO: 4291308 - DNA, 13 bp, Homo sapiens
cagccctgctttg

SEQ ID NO: 4291309 - DNA, 20 bp, Homo sapiens
cagccctgctttgggctgcc

SEQ ID NO: 4291310 - DNA, 22 bp, Homo sapiens
cagccctgctttgggctgccct

SEQ ID NO: 4291311 - DNA, 19 bp, Homo sapiens
cagccctggttctccatcc

SEQ ID NO: 4291312 - DNA, 22 bp, Homo sapiens
cagccgcaaatccataccccct

SEQ ID NO: 4291313 - DNA, 13 bp, Homo sapiens
cagccgctggtgc

SEQ ID NO: 4291314 - DNA, 21 bp, Homo sapiens
cagccgctggtgcccaccagc

SEQ ID NO: 4291315 - DNA, 22 bp, Homo sapiens
cagccgctggtgcccaccagct

SEQ ID NO: 4291316 - DNA, 22 bp, Homo sapiens
cagccggagtcactgcctggag

SEQ ID NO: 4291317 - DNA, 18 bp, Homo sapiens
cagccggggagctgaggg

SEQ ID NO: 4291318 - DNA, 21 bp, Homo sapiens
cagccggggagctgaggggca

SEQ ID NO: 4291319 - DNA, 23 bp, Homo sapiens
cagccggggagctgaggggcagg

SEQ ID NO: 4291320 - DNA, 14 bp, Homo sapiens
cagccgtgccttca

SEQ ID NO: 4291321 - DNA, 16 bp, Homo sapiens
cagcctcacccctgca

SEQ ID NO: 4291322 - DNA, 14 bp, Homo sapiens
cagcctccactccc

SEQ ID NO: 4291323 - DNA, 16 bp, Homo sapiens
cagcctccactccctg

SEQ ID NO: 4291324 - DNA, 20 bp, Homo sapiens
cagcctccactccctgtctg

SEQ ID NO: 4291325 - DNA, 23 bp, Homo sapiens
cagcctccactccctgtctgaaa

SEQ ID NO: 4291326 - DNA, 20 bp, Homo sapiens
cagcctccggatgacacaaa

SEQ ID NO: 4291327 - DNA, 10 bp, Homo sapiens
cagcctggca

SEQ ID NO: 4291328 - DNA, 12 bp, Homo sapiens
cagcctggcccc

SEQ ID NO: 4291329 - DNA, 13 bp, Homo sapiens
cagcctggcccca

SEQ ID NO: 4291330 - DNA, 18 bp, Homo sapiens
cagcctggccccaaatgt

SEQ ID NO: 4291331 - DNA, 19 bp, Homo sapiens
cagcctgtgaactgccagg

SEQ ID NO: 4291332 - DNA, 13 bp, Homo sapiens
cagcctgtggcct

SEQ ID NO: 4291333 - DNA, 17 bp, Homo sapiens
cagcctgtggcctcagc

SEQ ID NO: 4291334 - DNA, 18 bp, Homo sapiens
cagcctgtggcctcagca

SEQ ID NO: 4291335 - DNA, 19 bp, Homo sapiens
cagcctgtggcctcagcat

SEQ ID NO: 4291336 - DNA, 16 bp, Homo sapiens
cagcctgtgggagaag

SEQ ID NO: 4291337 - DNA, 18 bp, Homo sapiens
cagcctgtgggtccttgc

SEQ ID NO: 4291338 - DNA, 16 bp, Homo sapiens
cagcgagtctggagac

SEQ ID NO: 4291339 - DNA, 15 bp, Homo sapiens
cagcgggtaaaaaga

SEQ ID NO: 4291340 - DNA, 15 bp, Homo sapiens
cagcgtttctccacc

SEQ ID NO: 4291341 - DNA, 17 bp, Homo sapiens
cagctaagcctgatgat

SEQ ID NO: 4291342 - DNA, 22 bp, Homo sapiens
cagctcagaagtttcttcttta

SEQ ID NO: 4291343 - DNA, 16 bp, Homo sapiens
cctctgcctgtccctc

SEQ ID NO: 4291344 - DNA, 22 bp, Homo sapiens
cctctgcctgtccctctcaggc

SEQ ID NO: 4291345 - DNA, 15 bp, Homo sapiens
cctctgcctgtgccc

SEQ ID NO: 4291346 - DNA, 16 bp, Homo sapiens
cctctgcctgtgcccg

SEQ ID NO: 4291347 - DNA, 18 bp, Homo sapiens
cctctgcctgtgcccgct

SEQ ID NO: 4291348 - DNA, 13 bp, Homo sapiens
cctctgccttgga

SEQ ID NO: 4291349 - DNA, 11 bp, Homo sapiens
cctctgctcca

SEQ ID NO: 4291350 - DNA, 15 bp, Homo sapiens
cctctgggctcacac

SEQ ID NO: 4291351 - DNA, 22 bp, Homo sapiens
cctctgggctcacaccagccct

SEQ ID NO: 4291352 - DNA, 23 bp, Homo sapiens
cctctggtttggggcgaggcaga

SEQ ID NO: 4291353 - DNA, 21 bp, Homo sapiens
cctcttcccccttcccctgcg

SEQ ID NO: 4291354 - DNA, 21 bp, Homo sapiens
cctcttgccccccaccccagc

SEQ ID NO: 4291355 - DNA, 12 bp, Homo sapiens
cctctttcctct

SEQ ID NO: 4291356 - DNA, 18 bp, Homo sapiens
cctgaaacttacacacaa

SEQ ID NO: 4291357 - DNA, 19 bp, Homo sapiens
cctgaaatgtttccaggca

SEQ ID NO: 4291358 - DNA, 21 bp, Homo sapiens
cctgaaatgtttccaggcatg

SEQ ID NO: 4291359 - DNA, 22 bp, Homo sapiens
cctgaagagcgctcctctgcct

SEQ ID NO: 4291360 - DNA, 18 bp, Homo sapiens
cctgaagtgaccccagct

SEQ ID NO: 4291361 - DNA, 20 bp, Homo sapiens
cctgaagtgaccccagctcc

SEQ ID NO: 4291362 - DNA, 13 bp, Homo sapiens
cctgaatcccttt

SEQ ID NO: 4291363 - DNA, 14 bp, Homo sapiens
cctgaatccctttc

SEQ ID NO: 4291364 - DNA, 13 bp, Homo sapiens
cctgacaaatttt

SEQ ID NO: 4291365 - DNA, 15 bp, Homo sapiens
cctgacatgctaacc

SEQ ID NO: 4291366 - DNA, 22 bp, Homo sapiens
cctgacatgctaacctctctga

SEQ ID NO: 4291367 - DNA, 19 bp, Homo sapiens
cctgaccccacctagaatg

SEQ ID NO: 4291368 - DNA, 21 bp, Homo sapiens
cctgagaatgcctaggccagc

SEQ ID NO: 4291369 - DNA, 22 bp, Homo sapiens
cctgagaatgcctaggccagct

SEQ ID NO: 4291370 - DNA, 23 bp, Homo sapiens
cctgagaatgcctaggccagctc

SEQ ID NO: 4291371 - DNA, 20 bp, Homo sapiens
cctgagaggagcgtgtccta

SEQ ID NO: 4291372 - DNA, 17 bp, Homo sapiens
cctgagcttggccagaa

SEQ ID NO: 4291373 - DNA, 21 bp, Homo sapiens
cctgagcttggccagaagggg

SEQ ID NO: 4291374 - DNA, 16 bp, Homo sapiens
cctgaggagcagccca

SEQ ID NO: 4291375 - DNA, 19 bp, Homo sapiens
cctgaggagcagcccacct

SEQ ID NO: 4291376 - DNA, 17 bp, Homo sapiens
cctgagggcccttccca

SEQ ID NO: 4291377 - DNA, 17 bp, Homo sapiens
cctgagggtttccacct

SEQ ID NO: 4291378 - DNA, 18 bp, Homo sapiens
cctgattattgaatgtta

SEQ ID NO: 4291379 - DNA, 12 bp, Homo sapiens
cctgcacacacc

SEQ ID NO: 4291380 - DNA, 14 bp, Homo sapiens
cctgcacacacctg

SEQ ID NO: 4291381 - DNA, 15 bp, Homo sapiens
cctgcacacacctgc

SEQ ID NO: 4291382 - DNA, 18 bp, Homo sapiens
cctgcacacacctgcaca

SEQ ID NO: 4291383 - DNA, 14 bp, Homo sapiens
cctgcacacccctg

SEQ ID NO: 4291384 - DNA, 15 bp, Homo sapiens
cctgcacaccgtccc

SEQ ID NO: 4291385 - DNA, 21 bp, Homo sapiens
cctgcacaccgtccctctccc

SEQ ID NO: 4291386 - DNA, 17 bp, Homo sapiens
cctgcaccctctgctat

SEQ ID NO: 4291387 - DNA, 15 bp, Homo sapiens
cctgcagcagagcct

SEQ ID NO: 4291388 - DNA, 14 bp, Homo sapiens
cctgcagccccagg

SEQ ID NO: 4291389 - DNA, 16 bp, Homo sapiens
cctgcagccccaggcc

SEQ ID NO: 4291390 - DNA, 16 bp, Homo sapiens
cctgcaggactcgggc

SEQ ID NO: 4291391 - DNA, 20 bp, Homo sapiens
cctgcaggcggtatccagag

SEQ ID NO: 4291392 - DNA, 13 bp, Homo sapiens
cctgcagggagca

SEQ ID NO: 4291393 - DNA, 16 bp, Homo sapiens
cctgcagggtaggggg

SEQ ID NO: 4291394 - DNA, 23 bp, Homo sapiens
cctgcagggtagggggcctgagt

SEQ ID NO: 4291395 - DNA, 20 bp, Homo sapiens
cctgcagttggcctcagcag

SEQ ID NO: 4291396 - DNA, 21 bp, Homo sapiens
cctgcagttggcctcagcaga

SEQ ID NO: 4291397 - DNA, 21 bp, Homo sapiens
cctgcatcccttggcccctct

SEQ ID NO: 4291398 - DNA, 16 bp, Homo sapiens
cctgccactctcctga

SEQ ID NO: 4291399 - DNA, 16 bp, Homo sapiens
cctgccagaggcctgg

SEQ ID NO: 4291400 - DNA, 19 bp, Homo sapiens
cctgccagaggcctggtgc

SEQ ID NO: 4291401 - DNA, 18 bp, Homo sapiens
cctgccccacacaggcct

SEQ ID NO: 4291402 - DNA, 19 bp, Homo sapiens
cctgccccacacaggcctg

SEQ ID NO: 4291403 - DNA, 20 bp, Homo sapiens
cctgccccacacaggcctgg

SEQ ID NO: 4291404 - DNA, 22 bp, Homo sapiens
cctgccccacacaggcctggcc

SEQ ID NO: 4291405 - DNA, 23 bp, Homo sapiens
cctgccccacacaggcctggccc

SEQ ID NO: 4291406 - DNA, 17 bp, Homo sapiens
cctgccccagagaagcc

SEQ ID NO: 4291407 - DNA, 21 bp, Homo sapiens
cctgccccagagaagcctcag

SEQ ID NO: 4291408 - DNA, 12 bp, Homo sapiens
cctgcccccctt

SEQ ID NO: 4291409 - DNA, 13 bp, Homo sapiens
cctgccccccttc

SEQ ID NO: 4291410 - DNA, 14 bp, Homo sapiens
cctgccccccttcc

SEQ ID NO: 4291411 - DNA, 19 bp, Homo sapiens
cctgccccccttcccaccc

SEQ ID NO: 4291412 - DNA, 12 bp, Homo sapiens
cctgcccccttc

SEQ ID NO: 4291413 - DNA, 17 bp, Homo sapiens
cctgcccccttctccca

SEQ ID NO: 4291414 - DNA, 20 bp, Homo sapiens
cctgcccccttctcccacac

SEQ ID NO: 4291415 - DNA, 21 bp, Homo sapiens
cctgcccccttctcccacact

SEQ ID NO: 4291416 - DNA, 22 bp, Homo sapiens
cctgcccccttctcccacactg

SEQ ID NO: 4291417 - DNA, 13 bp, Homo sapiens
cctgccccgcccc

SEQ ID NO: 4291418 - DNA, 17 bp, Homo sapiens
cctgccccgccccccag

SEQ ID NO: 4291419 - DNA, 19 bp, Homo sapiens
cctgccccgccccccagag

SEQ ID NO: 4291420 - DNA, 22 bp, Homo sapiens
cctgccccgccccccagagcca

SEQ ID NO: 4291421 - DNA, 19 bp, Homo sapiens
cctgccccggccactctgt

SEQ ID NO: 4291422 - DNA, 15 bp, Homo sapiens
cctgcccctcccttc

SEQ ID NO: 4291423 - DNA, 16 bp, Homo sapiens
cctgcccctcccttca

SEQ ID NO: 4291424 - DNA, 22 bp, Homo sapiens
cctgccctagcagtttgcctct

SEQ ID NO: 4291425 - DNA, 15 bp, Homo sapiens
cctgccctcactcca

SEQ ID NO: 4291426 - DNA, 16 bp, Homo sapiens
cctgccctcactccac

SEQ ID NO: 4291427 - DNA, 17 bp, Homo sapiens
cctgcctaggagctggg

SEQ ID NO: 4291428 - DNA, 20 bp, Homo sapiens
cctgcctaggagctggggag

SEQ ID NO: 4291429 - DNA, 13 bp, Homo sapiens
cctgcctccggcc

SEQ ID NO: 4291430 - DNA, 18 bp, Homo sapiens
cctgcctccggccctgcc

SEQ ID NO: 4291431 - DNA, 16 bp, Homo sapiens
cctgcgatggtgctgc

SEQ ID NO: 4291432 - DNA, 19 bp, Homo sapiens
cctgcgatggtgctgcacc

SEQ ID NO: 4291433 - DNA, 14 bp, Homo sapiens
cctgcgcaggccct

SEQ ID NO: 4291434 - DNA, 14 bp, Homo sapiens
cctgcgccctccct

SEQ ID NO: 4291435 - DNA, 22 bp, Homo sapiens
cctgcgccctccctccctccac

SEQ ID NO: 4291436 - DNA, 23 bp, Homo sapiens
cctgcgtggcctggggctgccgt

SEQ ID NO: 4291437 - DNA, 17 bp, Homo sapiens
cctgctcagatgctggt

SEQ ID NO: 4291438 - DNA, 15 bp, Homo sapiens
cctgctcaggcctca

SEQ ID NO: 4291439 - DNA, 16 bp, Homo sapiens
cctgctcaggcctcac

SEQ ID NO: 4291440 - DNA, 21 bp, Homo sapiens
cctgctcaggcctcacctggc

SEQ ID NO: 4291441 - DNA, 11 bp, Homo sapiens
cctgctccctg

SEQ ID NO: 4291442 - DNA, 14 bp, Homo sapiens
cctgctcctaccta

SEQ ID NO: 4291443 - DNA, 23 bp, Homo sapiens
cctgctgagaatccccgtgctca

SEQ ID NO: 4291444 - DNA, 21 bp, Homo sapiens
cctgctgagtggtccacattc

SEQ ID NO: 4291445 - DNA, 20 bp, Homo sapiens
cctgctgccaggctcccact

SEQ ID NO: 4291446 - DNA, 14 bp, Homo sapiens
cctgctgcccccta

SEQ ID NO: 4291447 - DNA, 15 bp, Homo sapiens
cctgctgccccctac

SEQ ID NO: 4291448 - DNA, 15 bp, Homo sapiens
cctgctgcctcccca

SEQ ID NO: 4291449 - DNA, 16 bp, Homo sapiens
cctgctgctcctcggc

SEQ ID NO: 4291450 - DNA, 21 bp, Homo sapiens
cctgctgctcctcggccagag

SEQ ID NO: 4291451 - DNA, 22 bp, Homo sapiens
cctgctgctcctcggccagagc

SEQ ID NO: 4291452 - DNA, 17 bp, Homo sapiens
cctgctggcccctcacc

SEQ ID NO: 4291453 - DNA, 18 bp, Homo sapiens
cctgctggcccctcacct

SEQ ID NO: 4291454 - DNA, 22 bp, Homo sapiens
cctgctgggtgggaatgcgctc

SEQ ID NO: 4291455 - DNA, 23 bp, Homo sapiens
cctgctggtgcccacccttcgca

SEQ ID NO: 4291456 - DNA, 19 bp, Homo sapiens
cctgctgtgggtcagtgtg

SEQ ID NO: 4291457 - DNA, 22 bp, Homo sapiens
cctgcttgtgttgggccccagg

SEQ ID NO: 4291458 - DNA, 18 bp, Homo sapiens
cctgctttgggctgccct

SEQ ID NO: 4291459 - DNA, 19 bp, Homo sapiens
cctgctttgggctgccctg

SEQ ID NO: 4291460 - DNA, 20 bp, Homo sapiens
cctgctttgggctgccctgg

SEQ ID NO: 4291461 - DNA, 21 bp, Homo sapiens
cctgctttgggctgccctggt

SEQ ID NO: 4291462 - DNA, 18 bp, Homo sapiens
cctggaactgtctctcat

SEQ ID NO: 4291463 - DNA, 16 bp, Homo sapiens
cctggacatattccca

SEQ ID NO: 4291464 - DNA, 14 bp, Homo sapiens
cctggagcccggca

SEQ ID NO: 4291465 - DNA, 16 bp, Homo sapiens
cctggagttgggctgg

SEQ ID NO: 4291466 - DNA, 14 bp, Homo sapiens
cctggataattata

SEQ ID NO: 4291467 - DNA, 14 bp, Homo sapiens
cctggatccctttc

SEQ ID NO: 4291468 - DNA, 17 bp, Homo sapiens
cctggatccctttcact

SEQ ID NO: 4291469 - DNA, 21 bp, Homo sapiens
cctggatggatctgctccatg

SEQ ID NO: 4291470 - DNA, 22 bp, Homo sapiens
cctggatggatctgctccatgc

SEQ ID NO: 4291471 - DNA, 23 bp, Homo sapiens
cctggatggatctgctccatgca

SEQ ID NO: 4291472 - DNA, 14 bp, Homo sapiens
cctggatttgcata

SEQ ID NO: 4291473 - DNA, 18 bp, Homo sapiens
cctggcacagggcagtgg

SEQ ID NO: 4291474 - DNA, 18 bp, Homo sapiens
cctggcagccgtgccttc

SEQ ID NO: 4291475 - DNA, 19 bp, Homo sapiens
cctggcagccgtgccttca

SEQ ID NO: 4291476 - DNA, 16 bp, Homo sapiens
cctatcctgcaccctc

SEQ ID NO: 4291477 - DNA, 16 bp, Homo sapiens
cctatgaccataaaat

SEQ ID NO: 4291478 - DNA, 15 bp, Homo sapiens
cctatgagagaagag

SEQ ID NO: 4291479 - DNA, 16 bp, Homo sapiens
cctatgccacctgcag

SEQ ID NO: 4291480 - DNA, 17 bp, Homo sapiens
cctatgccacctgcagc

SEQ ID NO: 4291481 - DNA, 19 bp, Homo sapiens
cctatgccacctgcagcgt

SEQ ID NO: 4291482 - DNA, 21 bp, Homo sapiens
cctatggaaagggtgtggctt

SEQ ID NO: 4291483 - DNA, 17 bp, Homo sapiens
cctcaaaaatcatcaaa

SEQ ID NO: 4291484 - DNA, 18 bp, Homo sapiens
cctcaaccctccctcagc

SEQ ID NO: 4291485 - DNA, 21 bp, Homo sapiens
cctcaaccctccctcagcccc

SEQ ID NO: 4291486 - DNA, 14 bp, Homo sapiens
cctcaacctgtgat

SEQ ID NO: 4291487 - DNA, 19 bp, Homo sapiens
cctcaagccaggagaccct

SEQ ID NO: 4291488 - DNA, 13 bp, Homo sapiens
cctcacctggctt

SEQ ID NO: 4291489 - DNA, 20 bp, Homo sapiens
cctcacctggcttcccagga

SEQ ID NO: 4291490 - DNA, 24 bp, Homo sapiens
cctcacctggcttcccaggaccct

SEQ ID NO: 4291491 - DNA, 18 bp, Homo sapiens
cctcacctgggcacctgg

SEQ ID NO: 4291492 - DNA, 17 bp, Homo sapiens
cctcaccttgcaacaca

SEQ ID NO: 4291493 - DNA, 23 bp, Homo sapiens
cctcactatttttttgttgctgt

SEQ ID NO: 4291494 - DNA, 17 bp, Homo sapiens
cctcactccactcccct

SEQ ID NO: 4291495 - DNA, 23 bp, Homo sapiens
cctcactccactcccctcatcca

SEQ ID NO: 4291496 - DNA, 20 bp, Homo sapiens
cctcactgccctccctcggc

SEQ ID NO: 4291497 - DNA, 11 bp, Homo sapiens
cctcactggct

SEQ ID NO: 4291498 - DNA, 13 bp, Homo sapiens
cctcactggctgg

SEQ ID NO: 4291499 - DNA, 22 bp, Homo sapiens
cctcactggctggactggaggc

SEQ ID NO: 4291500 - DNA, 22 bp, Homo sapiens
cctcactgtcagcgtttctcca

SEQ ID NO: 4291501 - DNA, 16 bp, Homo sapiens
cctcagagccacccct

SEQ ID NO: 4291502 - DNA, 13 bp, Homo sapiens
cctcagagtccag

SEQ ID NO: 4291503 - DNA, 17 bp, Homo sapiens
cctcagagtccaggccc

SEQ ID NO: 4291504 - DNA, 18 bp, Homo sapiens
cctcagccacgcctctct

SEQ ID NO: 4291505 - DNA, 13 bp, Homo sapiens
cctcagccactcc

SEQ ID NO: 4291506 - DNA, 19 bp, Homo sapiens
cctcagccactcccagggg

SEQ ID NO: 4291507 - DNA, 13 bp, Homo sapiens
cctcagccccagg

SEQ ID NO: 4291508 - DNA, 19 bp, Homo sapiens
cctcagccccagggccctg

SEQ ID NO: 4291509 - DNA, 22 bp, Homo sapiens
cctcagccccagggccctgctc

SEQ ID NO: 4291510 - DNA, 23 bp, Homo sapiens
cctcagccccagggccctgctca

SEQ ID NO: 4291511 - DNA, 16 bp, Homo sapiens
cctcagcccctcttgc

SEQ ID NO: 4291512 - DNA, 20 bp, Homo sapiens
cctcagcccctcttgccccc

SEQ ID NO: 4291513 - DNA, 17 bp, Homo sapiens
cctcaggcagtggccca

SEQ ID NO: 4291514 - DNA, 21 bp, Homo sapiens
cctcaggcagtggcccaggga

SEQ ID NO: 4291515 - DNA, 13 bp, Homo sapiens
cctcaggcctccc

SEQ ID NO: 4291516 - DNA, 15 bp, Homo sapiens
cctcaggcctggccc

SEQ ID NO: 4291517 - DNA, 22 bp, Homo sapiens
cctcaggcctggccctttcacc

SEQ ID NO: 4291518 - DNA, 23 bp, Homo sapiens
cctcagggaccaaggagatgggg

SEQ ID NO: 4291519 - DNA, 23 bp, Homo sapiens
cctcagtccctccctcctggctc

SEQ ID NO: 4291520 - DNA, 19 bp, Homo sapiens
cctcagtctttgggggatt

SEQ ID NO: 4291521 - DNA, 21 bp, Homo sapiens
cctcagtgcagccccctcctg

SEQ ID NO: 4291522 - DNA, 23 bp, Homo sapiens
cctcagtgcagccccctcctgac

SEQ ID NO: 4291523 - DNA, 16 bp, Homo sapiens
cctcagtggactttcc

SEQ ID NO: 4291524 - DNA, 18 bp, Homo sapiens
cctcagtggactttccac

SEQ ID NO: 4291525 - DNA, 20 bp, Homo sapiens
cctcagtggactttccaccc

SEQ ID NO: 4291526 - DNA, 23 bp, Homo sapiens
cctcagtggactttccaccccct

SEQ ID NO: 4291527 - DNA, 14 bp, Homo sapiens
cctcatgggagtca

SEQ ID NO: 4291528 - DNA, 13 bp, Homo sapiens
cctccacacctcc

SEQ ID NO: 4291529 - DNA, 12 bp, Homo sapiens
cctccaccccag

SEQ ID NO: 4291530 - DNA, 17 bp, Homo sapiens
cctccacctgggagatg

SEQ ID NO: 4291531 - DNA, 9 bp, Homo sapiens
cctccagac

SEQ ID NO: 4291532 - DNA, 10 bp, Homo sapiens
cctccagacc

SEQ ID NO: 4291533 - DNA, 14 bp, Homo sapiens
cctccagaccccta

SEQ ID NO: 4291534 - DNA, 15 bp, Homo sapiens
cctccagacccctac

SEQ ID NO: 4291535 - DNA, 17 bp, Homo sapiens
cctccagcaatgcctgc

SEQ ID NO: 4291536 - DNA, 14 bp, Homo sapiens
cctccatcccgaca

SEQ ID NO: 4291537 - DNA, 15 bp, Homo sapiens
cctccatcccgacat

SEQ ID NO: 4291538 - DNA, 17 bp, Homo sapiens
cctccatgattccaagg

SEQ ID NO: 4291539 - DNA, 23 bp, Homo sapiens
cctccatgattccaagggcccag

SEQ ID NO: 4291540 - DNA, 15 bp, Homo sapiens
cctcccacatccccc

SEQ ID NO: 4291541 - DNA, 14 bp, Homo sapiens
cctcccaccacagc

SEQ ID NO: 4291542 - DNA, 13 bp, Homo sapiens
cctcccagccacc

SEQ ID NO: 4291543 - DNA, 14 bp, Homo sapiens
cctcccaggcgccc

SEQ ID NO: 4291544 - DNA, 16 bp, Homo sapiens
cctcccatccagcgtc

SEQ ID NO: 4291545 - DNA, 17 bp, Homo sapiens
cctcccatccagcgtct

SEQ ID NO: 4291546 - DNA, 16 bp, Homo sapiens
cctccccaaccctgcc

SEQ ID NO: 4291547 - DNA, 20 bp, Homo sapiens
cctccccagcaggtggggag

SEQ ID NO: 4291548 - DNA, 15 bp, Homo sapiens
cctccccctgccaga

SEQ ID NO: 4291549 - DNA, 22 bp, Homo sapiens
cctccccctgccagaggcctgg

SEQ ID NO: 4291550 - DNA, 19 bp, Homo sapiens
cctcccctggtcctgcact

SEQ ID NO: 4291551 - DNA, 22 bp, Homo sapiens
cctcccctggtcctgcactgtc

SEQ ID NO: 4291552 - DNA, 23 bp, Homo sapiens
cctcccgcatgctgcctgcctcc

SEQ ID NO: 4291553 - DNA, 14 bp, Homo sapiens
cctccctcagccac

SEQ ID NO: 4291554 - DNA, 19 bp, Homo sapiens
cctccctcagccacgcctc

SEQ ID NO: 4291555 - DNA, 20 bp, Homo sapiens
cctccctcagccacgcctct

SEQ ID NO: 4291556 - DNA, 22 bp, Homo sapiens
cctccctcagccacgcctctct

SEQ ID NO: 4291557 - DNA, 14 bp, Homo sapiens
cctccctcagcccc

SEQ ID NO: 4291558 - DNA, 14 bp, Homo sapiens
cctccctccctgca

SEQ ID NO: 4291559 - DNA, 17 bp, Homo sapiens
cctccctccctgcaggg

SEQ ID NO: 4291560 - DNA, 18 bp, Homo sapiens
cctccctcctggctcaca

SEQ ID NO: 4291561 - DNA, 11 bp, Homo sapiens
cctccctgcag

SEQ ID NO: 4291562 - DNA, 13 bp, Homo sapiens
cctccctgctgcc

SEQ ID NO: 4291563 - DNA, 15 bp, Homo sapiens
cctccctgctgccag

SEQ ID NO: 4291564 - DNA, 22 bp, Homo sapiens
cctccctgctgccaggctccca

SEQ ID NO: 4291565 - DNA, 20 bp, Homo sapiens
cctccctgtcccctgaggtt

SEQ ID NO: 4291566 - DNA, 13 bp, Homo sapiens
cctccgcccttcc

SEQ ID NO: 4291567 - DNA, 23 bp, Homo sapiens
cctccgctaaggcttccggctga

SEQ ID NO: 4291568 - DNA, 23 bp, Homo sapiens
cctccgtcctggcagggcaggca

SEQ ID NO: 4291569 - DNA, 22 bp, Homo sapiens
cctcctagcacaaggagtgccc

SEQ ID NO: 4291570 - DNA, 21 bp, Homo sapiens
cctcctcccatccagcgtctg

SEQ ID NO: 4291571 - DNA, 13 bp, Homo sapiens
cctcctggctcac

SEQ ID NO: 4291572 - DNA, 15 bp, Homo sapiens
cctccttagaaaaga

SEQ ID NO: 4291573 - DNA, 21 bp, Homo sapiens
cctccttcactccctgtcata

SEQ ID NO: 4291574 - DNA, 17 bp, Homo sapiens
cctccttccaggcccca

SEQ ID NO: 4291575 - DNA, 22 bp, Homo sapiens
cctccttccaggccccaggctg

SEQ ID NO: 4291576 - DNA, 13 bp, Homo sapiens
cctccttctcccc

SEQ ID NO: 4291577 - DNA, 21 bp, Homo sapiens
cctccttctcccctccagacc

SEQ ID NO: 4291578 - DNA, 17 bp, Homo sapiens
cctccttgcctcctgtg

SEQ ID NO: 4291579 - DNA, 19 bp, Homo sapiens
cctcgcttcataggcagag

SEQ ID NO: 4291580 - DNA, 14 bp, Homo sapiens
cctcggccagagct

SEQ ID NO: 4291581 - DNA, 21 bp, Homo sapiens
cctcggccagagctcccagga

SEQ ID NO: 4291582 - DNA, 22 bp, Homo sapiens
cctcggccagagctcccaggac

SEQ ID NO: 4291583 - DNA, 22 bp, Homo sapiens
cctcggccccacccaccctctg

SEQ ID NO: 4291584 - DNA, 21 bp, Homo sapiens
cctcgtctttgcttgtcctgc

SEQ ID NO: 4291585 - DNA, 22 bp, Homo sapiens
cctctcactctggcagcctcag

SEQ ID NO: 4291586 - DNA, 14 bp, Homo sapiens
cctctcactgtgtc

SEQ ID NO: 4291587 - DNA, 14 bp, Homo sapiens
cctctcaggcatgc

SEQ ID NO: 4291588 - DNA, 21 bp, Homo sapiens
cctctcaggcatgcctgtgtg

SEQ ID NO: 4291589 - DNA, 13 bp, Homo sapiens
cctctccactgcc

SEQ ID NO: 4291590 - DNA, 14 bp, Homo sapiens
cctctccactgcct

SEQ ID NO: 4291591 - DNA, 16 bp, Homo sapiens
cctctccactgccttc

SEQ ID NO: 4291592 - DNA, 20 bp, Homo sapiens
cctctccccggacaagccca

SEQ ID NO: 4291593 - DNA, 17 bp, Homo sapiens
cctctctcagcccaggt

SEQ ID NO: 4291594 - DNA, 13 bp, Homo sapiens
cctctctctccct

SEQ ID NO: 4291595 - DNA, 16 bp, Homo sapiens
cctctctctccctcca

SEQ ID NO: 4291596 - DNA, 17 bp, Homo sapiens
cctctctctccctccac

SEQ ID NO: 4291597 - DNA, 18 bp, Homo sapiens
cctctctctccctccact

SEQ ID NO: 4291598 - DNA, 15 bp, Homo sapiens
cctctctctggaaag

SEQ ID NO: 4291599 - DNA, 21 bp, Homo sapiens
cctctctgaactgcaacactg

SEQ ID NO: 4291600 - DNA, 18 bp, Homo sapiens
cctctcttaccccgtccc

SEQ ID NO: 4291601 - DNA, 15 bp, Homo sapiens
cctctcttctgactg

SEQ ID NO: 4291602 - DNA, 19 bp, Homo sapiens
cctctgaactgctgctggt

SEQ ID NO: 4291603 - DNA, 21 bp, Homo sapiens
cctctgatcaaagcaccttga

SEQ ID NO: 4291604 - DNA, 20 bp, Homo sapiens
cctctgcacgtgcacacacc

SEQ ID NO: 4291605 - DNA, 22 bp, Homo sapiens
cctctgcacgtgcacacacctg

SEQ ID NO: 4291606 - DNA, 24 bp, Homo sapiens
cctctgcacgtgcacacacctgca

SEQ ID NO: 4291607 - DNA, 20 bp, Homo sapiens
cctctgcagggcagcctgtg

SEQ ID NO: 4291608 - DNA, 14 bp, Homo sapiens
cctctgcctgtccc

SEQ ID NO: 4291609 - DNA, 23 bp, Homo sapiens
cccttcacttctgaccacacttc

SEQ ID NO: 4291610 - DNA, 16 bp, Homo sapiens
cccttccccactcccg

SEQ ID NO: 4291611 - DNA, 17 bp, Homo sapiens
cccttcccctgcgccct

SEQ ID NO: 4291612 - DNA, 21 bp, Homo sapiens
cccttcccctgcgccctccct

SEQ ID NO: 4291613 - DNA, 22 bp, Homo sapiens
cccttcggtattgttcaaagaa

SEQ ID NO: 4291614 - DNA, 16 bp, Homo sapiens
cccttctgtctgtaag

SEQ ID NO: 4291615 - DNA, 13 bp, Homo sapiens
cccttggcccctc

SEQ ID NO: 4291616 - DNA, 12 bp, Homo sapiens
cccttgggatgg

SEQ ID NO: 4291617 - DNA, 17 bp, Homo sapiens
cccttgggatgggcaca

SEQ ID NO: 4291618 - DNA, 19 bp, Homo sapiens
cccttgggatgggcacagg

SEQ ID NO: 4291619 - DNA, 22 bp, Homo sapiens
cccttgggatgggcacaggctg

SEQ ID NO: 4291620 - DNA, 17 bp, Homo sapiens
ccctttccctgcatccc

SEQ ID NO: 4291621 - DNA, 18 bp, Homo sapiens
ccctttccctgcatccct

SEQ ID NO: 4291622 - DNA, 23 bp, Homo sapiens
ccgaagaccttctgaagatctca

SEQ ID NO: 4291623 - DNA, 22 bp, Homo sapiens
ccgaatattgagcaatatgtca

SEQ ID NO: 4291624 - DNA, 17 bp, Homo sapiens
ccgaatggagtccagac

SEQ ID NO: 4291625 - DNA, 20 bp, Homo sapiens
ccgacaaccgatgctccagc

SEQ ID NO: 4291626 - DNA, 15 bp, Homo sapiens
ccgacagcctggcac

SEQ ID NO: 4291627 - DNA, 22 bp, Homo sapiens
ccgacagcctggcacagggcag

SEQ ID NO: 4291628 - DNA, 21 bp, Homo sapiens
ccgaccgaggctggagctggc

SEQ ID NO: 4291629 - DNA, 20 bp, Homo sapiens
ccgacttctttggtgttctg

SEQ ID NO: 4291630 - DNA, 13 bp, Homo sapiens
ccgagccgagctc

SEQ ID NO: 4291631 - DNA, 19 bp, Homo sapiens
ccgagccgagctctcctgg

SEQ ID NO: 4291632 - DNA, 19 bp, Homo sapiens
ccgagcgacggctcctccc

SEQ ID NO: 4291633 - DNA, 20 bp, Homo sapiens
ccgagcgacggctcctcccc

SEQ ID NO: 4291634 - DNA, 21 bp, Homo sapiens
ccgagcgacggctcctccccg

SEQ ID NO: 4291635 - DNA, 18 bp, Homo sapiens
ccgagctctcctgggcca

SEQ ID NO: 4291636 - DNA, 21 bp, Homo sapiens
ccgagctctcctgggccaggg

SEQ ID NO: 4291637 - DNA, 18 bp, Homo sapiens
ccgagctgggggccatga

SEQ ID NO: 4291638 - DNA, 20 bp, Homo sapiens
ccgaggcaggggctgggcag

SEQ ID NO: 4291639 - DNA, 21 bp, Homo sapiens
ccgaggcaggggctgggcaga

SEQ ID NO: 4291640 - DNA, 18 bp, Homo sapiens
ccgagtgtggagctgctt

SEQ ID NO: 4291641 - DNA, 20 bp, Homo sapiens
ccgatccccgacagtggctc

SEQ ID NO: 4291642 - DNA, 15 bp, Homo sapiens
ccgcaaatccatacc

SEQ ID NO: 4291643 - DNA, 16 bp, Homo sapiens
ccgcaaatccataccc

SEQ ID NO: 4291644 - DNA, 15 bp, Homo sapiens
ccgcaaccacttgct

SEQ ID NO: 4291645 - DNA, 22 bp, Homo sapiens
ccgcatgctgcctgcctccggc

SEQ ID NO: 4291646 - DNA, 21 bp, Homo sapiens
ccgccccccagagccagggct

SEQ ID NO: 4291647 - DNA, 14 bp, Homo sapiens
ccgccccgccccac

SEQ ID NO: 4291648 - DNA, 20 bp, Homo sapiens
ccgccctccccctgccagag

SEQ ID NO: 4291649 - DNA, 12 bp, Homo sapiens
ccgccctctgcc

SEQ ID NO: 4291650 - DNA, 17 bp, Homo sapiens
ccgccctgggctctggg

SEQ ID NO: 4291651 - DNA, 11 bp, Homo sapiens
ccgcctgtcct

SEQ ID NO: 4291652 - DNA, 11 bp, Homo sapiens
ccgctcagccc

SEQ ID NO: 4291653 - DNA, 16 bp, Homo sapiens
ccgctccccagcccag

SEQ ID NO: 4291654 - DNA, 22 bp, Homo sapiens
ccgctctgccatcagcccctgc

SEQ ID NO: 4291655 - DNA, 16 bp, Homo sapiens
ccgctgcgctgccctg

SEQ ID NO: 4291656 - DNA, 17 bp, Homo sapiens
ccgctgcgctgccctgc

SEQ ID NO: 4291657 - DNA, 18 bp, Homo sapiens
ccgctgcgctgccctgca

SEQ ID NO: 4291658 - DNA, 19 bp, Homo sapiens
ccgctgggagaaaagccag

SEQ ID NO: 4291659 - DNA, 22 bp, Homo sapiens
ccgctgggagaaaagccagatg

SEQ ID NO: 4291660 - DNA, 18 bp, Homo sapiens
ccgctggtgcccaccagc

SEQ ID NO: 4291661 - DNA, 19 bp, Homo sapiens
ccgctggtgcccaccagct

SEQ ID NO: 4291662 - DNA, 12 bp, Homo sapiens
ccgcttcgccat

SEQ ID NO: 4291663 - DNA, 18 bp, Homo sapiens
ccgcttcgccatgtgctg

SEQ ID NO: 4291664 - DNA, 22 bp, Homo sapiens
ccgcttcgccatgtgctgtgca

SEQ ID NO: 4291665 - DNA, 15 bp, Homo sapiens
ccggacaagcccagg

SEQ ID NO: 4291666 - DNA, 18 bp, Homo sapiens
ccggacgcatgcagggcc

SEQ ID NO: 4291667 - DNA, 23 bp, Homo sapiens
ccggactttcggagttgggggtc

SEQ ID NO: 4291668 - DNA, 16 bp, Homo sapiens
ccggagctaacactgg

SEQ ID NO: 4291669 - DNA, 20 bp, Homo sapiens
ccggagctaacactggcccc

SEQ ID NO: 4291670 - DNA, 10 bp, Homo sapiens
ccggagctgg

SEQ ID NO: 4291671 - DNA, 11 bp, Homo sapiens
ccggagctggg

SEQ ID NO: 4291672 - DNA, 15 bp, Homo sapiens
ccggagctgggaagg

SEQ ID NO: 4291673 - DNA, 14 bp, Homo sapiens
ccggaggggcctgg

SEQ ID NO: 4291674 - DNA, 16 bp, Homo sapiens
ccggaggggcctggca

SEQ ID NO: 4291675 - DNA, 21 bp, Homo sapiens
ccggatctccaggcccagcct

SEQ ID NO: 4291676 - DNA, 19 bp, Homo sapiens
ccggcatgccgagtgcccc

SEQ ID NO: 4291677 - DNA, 18 bp, Homo sapiens
ccggccactctgtttgct

SEQ ID NO: 4291678 - DNA, 17 bp, Homo sapiens
ccggcccccagagcgcc

SEQ ID NO: 4291679 - DNA, 16 bp, Homo sapiens
ccggcccccctctcgg

SEQ ID NO: 4291680 - DNA, 16 bp, Homo sapiens
ccggccctgccccaca

SEQ ID NO: 4291681 - DNA, 15 bp, Homo sapiens
ccggctgggcccgag

SEQ ID NO: 4291682 - DNA, 16 bp, Homo sapiens
ccggctgggcccgagg

SEQ ID NO: 4291683 - DNA, 13 bp, Homo sapiens
ccggcttggctag

SEQ ID NO: 4291684 - DNA, 13 bp, Homo sapiens
ccgggaaaggccg

SEQ ID NO: 4291685 - DNA, 20 bp, Homo sapiens
ccgggagatccgccctgggc

SEQ ID NO: 4291686 - DNA, 20 bp, Homo sapiens
ccgggagcctgcgtggcctg

SEQ ID NO: 4291687 - DNA, 22 bp, Homo sapiens
ccgggagcctgcgtggcctggg

SEQ ID NO: 4291688 - DNA, 22 bp, Homo sapiens
ccgggagcgcacctcgccgtgt

SEQ ID NO: 4291689 - DNA, 21 bp, Homo sapiens
ccgggagggacagtctggagg

SEQ ID NO: 4291690 - DNA, 22 bp, Homo sapiens
ccgggagggacagtctggaggt

SEQ ID NO: 4291691 - DNA, 20 bp, Homo sapiens
ccgggcaggggccgcttcgc

SEQ ID NO: 4291692 - DNA, 19 bp, Homo sapiens
ccgggcctggagaactaga

SEQ ID NO: 4291693 - DNA, 14 bp, Homo sapiens
ccggggcatggaca

SEQ ID NO: 4291694 - DNA, 22 bp, Homo sapiens
ccggggcatggacagggccagg

SEQ ID NO: 4291695 - DNA, 19 bp, Homo sapiens
ccggggccatggaagctgg

SEQ ID NO: 4291696 - DNA, 19 bp, Homo sapiens
ccgggggtgggggcctgct

SEQ ID NO: 4291697 - DNA, 21 bp, Homo sapiens
ccgggggtgggggcctgctgt

SEQ ID NO: 4291698 - DNA, 22 bp, Homo sapiens
ccgggtttggcgggccaaggac

SEQ ID NO: 4291699 - DNA, 19 bp, Homo sapiens
ccgtaccatcggtcagcag

SEQ ID NO: 4291700 - DNA, 22 bp, Homo sapiens
ccgtagtatcagagatgtccat

SEQ ID NO: 4291701 - DNA, 15 bp, Homo sapiens
ccgtccctttccctg

SEQ ID NO: 4291702 - DNA, 24 bp, Homo sapiens
ccgtcctggggtggttggaggcct

SEQ ID NO: 4291703 - DNA, 19 bp, Homo sapiens
ccgtgaggagggggagaag

SEQ ID NO: 4291704 - DNA, 15 bp, Homo sapiens
ccgtgcacggggcca

SEQ ID NO: 4291705 - DNA, 21 bp, Homo sapiens
ccgtgccacgcgctctgcatg

SEQ ID NO: 4291706 - DNA, 22 bp, Homo sapiens
ccgtgccacgcgctctgcatgc

SEQ ID NO: 4291707 - DNA, 15 bp, Homo sapiens
ccgtgccttcagctc

SEQ ID NO: 4291708 - DNA, 23 bp, Homo sapiens
ccgtggagatgggatgcttgcct

SEQ ID NO: 4291709 - DNA, 15 bp, Homo sapiens
ccgtggcttcccgct

SEQ ID NO: 4291710 - DNA, 23 bp, Homo sapiens
ccgtggcttcccgctcagccctc

SEQ ID NO: 4291711 - DNA, 23 bp, Homo sapiens
ccgttagggaaatccaactccag

SEQ ID NO: 4291712 - DNA, 18 bp, Homo sapiens
ccgttgttgtccctgcag

SEQ ID NO: 4291713 - DNA, 12 bp, Homo sapiens
cctaaagagata

SEQ ID NO: 4291714 - DNA, 21 bp, Homo sapiens
cctaaatccactctgcaggaa

SEQ ID NO: 4291715 - DNA, 18 bp, Homo sapiens
cctaaatccattttctaa

SEQ ID NO: 4291716 - DNA, 13 bp, Homo sapiens
cctaaatgcaaag

SEQ ID NO: 4291717 - DNA, 14 bp, Homo sapiens
cctaaatgcaaagc

SEQ ID NO: 4291718 - DNA, 17 bp, Homo sapiens
cctaatgtggcagctgt

SEQ ID NO: 4291719 - DNA, 15 bp, Homo sapiens
cctacaaatcagtaa

SEQ ID NO: 4291720 - DNA, 16 bp, Homo sapiens
cctaccgagtctcttc

SEQ ID NO: 4291721 - DNA, 20 bp, Homo sapiens
cctaccgagtctcttctcca

SEQ ID NO: 4291722 - DNA, 20 bp, Homo sapiens
cctagaatggaagcctccac

SEQ ID NO: 4291723 - DNA, 19 bp, Homo sapiens
cctagaatgtttcatttgc

SEQ ID NO: 4291724 - DNA, 11 bp, Homo sapiens
cctagaggagg

SEQ ID NO: 4291725 - DNA, 13 bp, Homo sapiens
cctagaggaggaa

SEQ ID NO: 4291726 - DNA, 18 bp, Homo sapiens
cctagcagtttgcctctg

SEQ ID NO: 4291727 - DNA, 20 bp, Homo sapiens
cctaggcatactctccagga

SEQ ID NO: 4291728 - DNA, 15 bp, Homo sapiens
cctaggccagctcct

SEQ ID NO: 4291729 - DNA, 15 bp, Homo sapiens
cctaggggtcaggga

SEQ ID NO: 4291730 - DNA, 19 bp, Homo sapiens
cctagggtgagggtgacag

SEQ ID NO: 4291731 - DNA, 18 bp, Homo sapiens
cctaggtctccacccctc

SEQ ID NO: 4291732 - DNA, 19 bp, Homo sapiens
cctaggtctccacccctca

SEQ ID NO: 4291733 - DNA, 19 bp, Homo sapiens
cctaggtgggtcaactcca

SEQ ID NO: 4291734 - DNA, 23 bp, Homo sapiens
cctaggtgggtcaactccaaggc

SEQ ID NO: 4291735 - DNA, 19 bp, Homo sapiens
cctagtgacccggaggcca

SEQ ID NO: 4291736 - DNA, 18 bp, Homo sapiens
cctagtggcttcagcccc

SEQ ID NO: 4291737 - DNA, 18 bp, Homo sapiens
cctataaaggaaacacgt

SEQ ID NO: 4291738 - DNA, 23 bp, Homo sapiens
cctataaaggaaacacgtttaga

SEQ ID NO: 4291739 - DNA, 18 bp, Homo sapiens
cctatactggttatagtt

SEQ ID NO: 4291740 - DNA, 14 bp, Homo sapiens
cctatcagagaagc

SEQ ID NO: 4291741 - DNA, 12 bp, Homo sapiens
cccggcagcccc

SEQ ID NO: 4291742 - DNA, 17 bp, Homo sapiens
cccggcagccccccagt

SEQ ID NO: 4291743 - DNA, 12 bp, Homo sapiens
cccggcctgatg

SEQ ID NO: 4291744 - DNA, 19 bp, Homo sapiens
cccggcctgatggccaggc

SEQ ID NO: 4291745 - DNA, 18 bp, Homo sapiens
cccggctcgttcccccag

SEQ ID NO: 4291746 - DNA, 21 bp, Homo sapiens
cccgggagatccgccctgggc

SEQ ID NO: 4291747 - DNA, 16 bp, Homo sapiens
cccggggaactggttt

SEQ ID NO: 4291748 - DNA, 19 bp, Homo sapiens
cccggggcagctgccagag

SEQ ID NO: 4291749 - DNA, 20 bp, Homo sapiens
cccggggcagctgccagaga

SEQ ID NO: 4291750 - DNA, 14 bp, Homo sapiens
cccggggtctccac

SEQ ID NO: 4291751 - DNA, 18 bp, Homo sapiens
cccgtcaccatctcaggc

SEQ ID NO: 4291752 - DNA, 18 bp, Homo sapiens
cccgtccctttccctgca

SEQ ID NO: 4291753 - DNA, 19 bp, Homo sapiens
cccgtgaggagggggagaa

SEQ ID NO: 4291754 - DNA, 15 bp, Homo sapiens
cccgtggctttgtgc

SEQ ID NO: 4291755 - DNA, 18 bp, Homo sapiens
cccgtgtattcaggaccc

SEQ ID NO: 4291756 - DNA, 22 bp, Homo sapiens
cccgtgtggccccttcacttct

SEQ ID NO: 4291757 - DNA, 23 bp, Homo sapiens
cccgttgtgtgggtttactctgt

SEQ ID NO: 4291758 - DNA, 16 bp, Homo sapiens
cccgttgttgtccctg

SEQ ID NO: 4291759 - DNA, 22 bp, Homo sapiens
ccctaagcacaataaaagacat

SEQ ID NO: 4291760 - DNA, 18 bp, Homo sapiens
ccctaccgagtctcttct

SEQ ID NO: 4291761 - DNA, 21 bp, Homo sapiens
ccctaccgagtctcttctcca

SEQ ID NO: 4291762 - DNA, 19 bp, Homo sapiens
ccctagaatcagcctaggg

SEQ ID NO: 4291763 - DNA, 23 bp, Homo sapiens
ccctaggaggagaacttgaacaa

SEQ ID NO: 4291764 - DNA, 20 bp, Homo sapiens
ccctaggcatactctccagg

SEQ ID NO: 4291765 - DNA, 21 bp, Homo sapiens
ccctataccctaggtctccac

SEQ ID NO: 4291766 - DNA, 16 bp, Homo sapiens
ccctatcctgcaccct

SEQ ID NO: 4291767 - DNA, 16 bp, Homo sapiens
ccctcactccactccc

SEQ ID NO: 4291768 - DNA, 21 bp, Homo sapiens
ccctcactccactcccctcat

SEQ ID NO: 4291769 - DNA, 21 bp, Homo sapiens
ccctcagccacgcctctctca

SEQ ID NO: 4291770 - DNA, 13 bp, Homo sapiens
ccctcagcccctc

SEQ ID NO: 4291771 - DNA, 21 bp, Homo sapiens
ccctcagcccctcttgccccc

SEQ ID NO: 4291772 - DNA, 19 bp, Homo sapiens
ccctccacacctccacccg

SEQ ID NO: 4291773 - DNA, 13 bp, Homo sapiens
ccctccaccccag

SEQ ID NO: 4291774 - DNA, 14 bp, Homo sapiens
ccctccaccccagt

SEQ ID NO: 4291775 - DNA, 13 bp, Homo sapiens
ccctccactcctc

SEQ ID NO: 4291776 - DNA, 22 bp, Homo sapiens
ccctccatgattccaagggccc

SEQ ID NO: 4291777 - DNA, 23 bp, Homo sapiens
ccctccatgattccaagggccca

SEQ ID NO: 4291778 - DNA, 14 bp, Homo sapiens
ccctcccacatccc

SEQ ID NO: 4291779 - DNA, 14 bp, Homo sapiens
ccctcccaccacag

SEQ ID NO: 4291780 - DNA, 16 bp, Homo sapiens
ccctccccaaggaaga

SEQ ID NO: 4291781 - DNA, 11 bp, Homo sapiens
ccctccccagt

SEQ ID NO: 4291782 - DNA, 13 bp, Homo sapiens
ccctccccagtag

SEQ ID NO: 4291783 - DNA, 15 bp, Homo sapiens
ccctccccctgccag

SEQ ID NO: 4291784 - DNA, 23 bp, Homo sapiens
ccctccccctgccagaggcctgg

SEQ ID NO: 4291785 - DNA, 13 bp, Homo sapiens
ccctccctccaca

SEQ ID NO: 4291786 - DNA, 16 bp, Homo sapiens
ccctccctccctccac

SEQ ID NO: 4291787 - DNA, 13 bp, Homo sapiens
ccctccctcctgg

SEQ ID NO: 4291788 - DNA, 17 bp, Homo sapiens
ccctccctgcagggtag

SEQ ID NO: 4291789 - DNA, 13 bp, Homo sapiens
ccctccctgtccc

SEQ ID NO: 4291790 - DNA, 14 bp, Homo sapiens
ccctcccttcaacc

SEQ ID NO: 4291791 - DNA, 16 bp, Homo sapiens
ccctccgcgggggaca

SEQ ID NO: 4291792 - DNA, 16 bp, Homo sapiens
ccctccgtcctggcag

SEQ ID NO: 4291793 - DNA, 17 bp, Homo sapiens
ccctccgtcctggcagg

SEQ ID NO: 4291794 - DNA, 12 bp, Homo sapiens
ccctcctgaccc

SEQ ID NO: 4291795 - DNA, 18 bp, Homo sapiens
ccctcctggctcacagcc

SEQ ID NO: 4291796 - DNA, 20 bp, Homo sapiens
ccctcctggctcacagccac

SEQ ID NO: 4291797 - DNA, 17 bp, Homo sapiens
ccctccttctcccctcc

SEQ ID NO: 4291798 - DNA, 19 bp, Homo sapiens
ccctccttctcccctccag

SEQ ID NO: 4291799 - DNA, 20 bp, Homo sapiens
ccctccttctcccctccaga

SEQ ID NO: 4291800 - DNA, 21 bp, Homo sapiens
ccctccttctcccctccagac

SEQ ID NO: 4291801 - DNA, 22 bp, Homo sapiens
ccctccttctcccctccagacc

SEQ ID NO: 4291802 - DNA, 20 bp, Homo sapiens
ccctccttgccgctgggaga

SEQ ID NO: 4291803 - DNA, 18 bp, Homo sapiens
ccctccttgcctcctgtg

SEQ ID NO: 4291804 - DNA, 16 bp, Homo sapiens
ccctcgcttcataggc

SEQ ID NO: 4291805 - DNA, 19 bp, Homo sapiens
ccctcgcttcataggcaga

SEQ ID NO: 4291806 - DNA, 13 bp, Homo sapiens
ccctcggagcctg

SEQ ID NO: 4291807 - DNA, 16 bp, Homo sapiens
ccctcggagcctgtgt

SEQ ID NO: 4291808 - DNA, 20 bp, Homo sapiens
ccctctcttaatgccacggc

SEQ ID NO: 4291809 - DNA, 17 bp, Homo sapiens
ccctctcttaccccgtc

SEQ ID NO: 4291810 - DNA, 14 bp, Homo sapiens
ccctctgcccccag

SEQ ID NO: 4291811 - DNA, 13 bp, Homo sapiens
ccctctgcctgtc

SEQ ID NO: 4291812 - DNA, 16 bp, Homo sapiens
ccctctgcctgtccct

SEQ ID NO: 4291813 - DNA, 13 bp, Homo sapiens
ccctctgctgctt

SEQ ID NO: 4291814 - DNA, 14 bp, Homo sapiens
ccctctgctgcttt

SEQ ID NO: 4291815 - DNA, 12 bp, Homo sapiens
ccctcttccccc

SEQ ID NO: 4291816 - DNA, 16 bp, Homo sapiens
ccctcttgccccccac

SEQ ID NO: 4291817 - DNA, 17 bp, Homo sapiens
ccctgaagtgaccccag

SEQ ID NO: 4291818 - DNA, 20 bp, Homo sapiens
ccctgacatgctaacctctc

SEQ ID NO: 4291819 - DNA, 18 bp, Homo sapiens
ccctgagggcccttccca

SEQ ID NO: 4291820 - DNA, 16 bp, Homo sapiens
ccctgaggggcctgcc

SEQ ID NO: 4291821 - DNA, 16 bp, Homo sapiens
ccctgatttattctgg

SEQ ID NO: 4291822 - DNA, 15 bp, Homo sapiens
ccctgcaaaggactg

SEQ ID NO: 4291823 - DNA, 16 bp, Homo sapiens
ccctgcaaaggactgt

SEQ ID NO: 4291824 - DNA, 17 bp, Homo sapiens
ccctgcacacacctgca

SEQ ID NO: 4291825 - DNA, 16 bp, Homo sapiens
ccctgcatcccttggc

SEQ ID NO: 4291826 - DNA, 22 bp, Homo sapiens
ccctgcatcccttggcccctct

SEQ ID NO: 4291827 - DNA, 21 bp, Homo sapiens
ccctgccccacacaggcctgg

SEQ ID NO: 4291828 - DNA, 14 bp, Homo sapiens
ccctgccccagaga

SEQ ID NO: 4291829 - DNA, 17 bp, Homo sapiens
ccctgccccgcccccca

SEQ ID NO: 4291830 - DNA, 23 bp, Homo sapiens
ccctgccccgccccccagagcca

SEQ ID NO: 4291831 - DNA, 19 bp, Homo sapiens
ccctgcccctcccttcaac

SEQ ID NO: 4291832 - DNA, 12 bp, Homo sapiens
ccctgcccctgc

SEQ ID NO: 4291833 - DNA, 17 bp, Homo sapiens
ccctgcccctgccccgt

SEQ ID NO: 4291834 - DNA, 19 bp, Homo sapiens
ccctgcccttcagcatcct

SEQ ID NO: 4291835 - DNA, 15 bp, Homo sapiens
ccctgcctggccctc

SEQ ID NO: 4291836 - DNA, 16 bp, Homo sapiens
ccctgcgccctccctc

SEQ ID NO: 4291837 - DNA, 22 bp, Homo sapiens
ccctgcgccctccctccctcca

SEQ ID NO: 4291838 - DNA, 18 bp, Homo sapiens
ccctgctcaggcctcacc

SEQ ID NO: 4291839 - DNA, 19 bp, Homo sapiens
ccctgctcccggctctgag

SEQ ID NO: 4291840 - DNA, 21 bp, Homo sapiens
ccctgctgccaggctcccact

SEQ ID NO: 4291841 - DNA, 23 bp, Homo sapiens
ccctgctgccaggctcccactgc

SEQ ID NO: 4291842 - DNA, 12 bp, Homo sapiens
ccctgctgcccc

SEQ ID NO: 4291843 - DNA, 13 bp, Homo sapiens
ccctgctgccccc

SEQ ID NO: 4291844 - DNA, 23 bp, Homo sapiens
ccctgctggtgcccacccttcgc

SEQ ID NO: 4291845 - DNA, 17 bp, Homo sapiens
ccctgctttgggctgcc

SEQ ID NO: 4291846 - DNA, 18 bp, Homo sapiens
ccctggaactgtctctca

SEQ ID NO: 4291847 - DNA, 18 bp, Homo sapiens
ccctggagcccggcagtg

SEQ ID NO: 4291848 - DNA, 13 bp, Homo sapiens
ccctggagctagg

SEQ ID NO: 4291849 - DNA, 18 bp, Homo sapiens
ccctggcccagcctgtgg

SEQ ID NO: 4291850 - DNA, 15 bp, Homo sapiens
ccctggcctgttctg

SEQ ID NO: 4291851 - DNA, 17 bp, Homo sapiens
ccctggctcccacaggc

SEQ ID NO: 4291852 - DNA, 17 bp, Homo sapiens
ccctggcttttcactgc

SEQ ID NO: 4291853 - DNA, 19 bp, Homo sapiens
ccctggcttttcactgctg

SEQ ID NO: 4291854 - DNA, 23 bp, Homo sapiens
ccctgggagagtgaggtcatccc

SEQ ID NO: 4291855 - DNA, 21 bp, Homo sapiens
ccctgggagagtgctcaacct

SEQ ID NO: 4291856 - DNA, 16 bp, Homo sapiens
ccctggggggcacagc

SEQ ID NO: 4291857 - DNA, 18 bp, Homo sapiens
ccctggggggcacagcca

SEQ ID NO: 4291858 - DNA, 20 bp, Homo sapiens
ccctggggtttccacacagg

SEQ ID NO: 4291859 - DNA, 22 bp, Homo sapiens
ccctggggtttccacacaggcc

SEQ ID NO: 4291860 - DNA, 13 bp, Homo sapiens
ccctggtcctgca

SEQ ID NO: 4291861 - DNA, 13 bp, Homo sapiens
ccctggtgctgcc

SEQ ID NO: 4291862 - DNA, 15 bp, Homo sapiens
ccctggtgctgccac

SEQ ID NO: 4291863 - DNA, 19 bp, Homo sapiens
ccctggtggccaagcctgc

SEQ ID NO: 4291864 - DNA, 21 bp, Homo sapiens
ccctggttcccccaggaccct

SEQ ID NO: 4291865 - DNA, 15 bp, Homo sapiens
ccctggttctccatc

SEQ ID NO: 4291866 - DNA, 18 bp, Homo sapiens
ccctggttctccatcccc

SEQ ID NO: 4291867 - DNA, 14 bp, Homo sapiens
ccctgtcagtgcag

SEQ ID NO: 4291868 - DNA, 12 bp, Homo sapiens
ccctgtccctgc

SEQ ID NO: 4291869 - DNA, 19 bp, Homo sapiens
ccctgtctgaaaccagaag

SEQ ID NO: 4291870 - DNA, 23 bp, Homo sapiens
ccctgtctttgctgtttatatat

SEQ ID NO: 4291871 - DNA, 21 bp, Homo sapiens
ccctgtggaagggactaggag

SEQ ID NO: 4291872 - DNA, 14 bp, Homo sapiens
ccctgttcactcta

SEQ ID NO: 4291873 - DNA, 21 bp, Homo sapiens
cccttaaacagttgcacagca

SEQ ID NO: 4291874 - DNA, 13 bp, Homo sapiens
cccttacctggct

SEQ ID NO: 4291875 - DNA, 23 bp, Homo sapiens
catgggagtcagggagccctggg

SEQ ID NO: 4291876 - DNA, 18 bp, Homo sapiens
catggggaggggagagaa

SEQ ID NO: 4291877 - DNA, 14 bp, Homo sapiens
catgggtcccttcc

SEQ ID NO: 4291878 - DNA, 17 bp, Homo sapiens
catggtagactgtgaca

SEQ ID NO: 4291879 - DNA, 14 bp, Homo sapiens
catgtaagaaataa

SEQ ID NO: 4291880 - DNA, 21 bp, Homo sapiens
catgtaatagtggctttcatt

SEQ ID NO: 4291881 - DNA, 17 bp, Homo sapiens
catgtagaagagggaga

SEQ ID NO: 4291882 - DNA, 21 bp, Homo sapiens
catgtagaagagggagaagga

SEQ ID NO: 4291883 - DNA, 19 bp, Homo sapiens
catgtcaagattcagctag

SEQ ID NO: 4291884 - DNA, 16 bp, Homo sapiens
catgtccccagtgtgg

SEQ ID NO: 4291885 - DNA, 17 bp, Homo sapiens
catgtccccagtgtgga

SEQ ID NO: 4291886 - DNA, 19 bp, Homo sapiens
catgtccccagtgtggact

SEQ ID NO: 4291887 - DNA, 14 bp, Homo sapiens
catgtctattgtcc

SEQ ID NO: 4291888 - DNA, 20 bp, Homo sapiens
catgtctgtgaacttgatgt

SEQ ID NO: 4291889 - DNA, 20 bp, Homo sapiens
catgtgattggcagcttcaa

SEQ ID NO: 4291890 - DNA, 17 bp, Homo sapiens
catgtgctgtgcacccg

SEQ ID NO: 4291891 - DNA, 24 bp, Homo sapiens
catgtgttgcaaattattctagtc

SEQ ID NO: 4291892 - DNA, 18 bp, Homo sapiens
catgtgtttactttatgt

SEQ ID NO: 4291893 - DNA, 15 bp, Homo sapiens
catgttctatgtgtt

SEQ ID NO: 4291894 - DNA, 17 bp, Homo sapiens
catgttctcaataccca

SEQ ID NO: 4291895 - DNA, 22 bp, Homo sapiens
cattaaattactatagcaaagt

SEQ ID NO: 4291896 - DNA, 22 bp, Homo sapiens
cattaagtattccttggcccag

SEQ ID NO: 4291897 - DNA, 12 bp, Homo sapiens
cattaatttaaa

SEQ ID NO: 4291898 - DNA, 14 bp, Homo sapiens
cattaatttaaatg

SEQ ID NO: 4291899 - DNA, 18 bp, Homo sapiens
cattaatttaaatgattt

SEQ ID NO: 4291900 - DNA, 23 bp, Homo sapiens
cattactgcatgcacttcttaca

SEQ ID NO: 4291901 - DNA, 16 bp, Homo sapiens
cattagactgaattta

SEQ ID NO: 4291902 - DNA, 17 bp, Homo sapiens
cattagcagtttgcttt

SEQ ID NO: 4291903 - DNA, 22 bp, Homo sapiens
cattatcctgtgtgattacagc

SEQ ID NO: 4291904 - DNA, 18 bp, Homo sapiens
cattattaaatcagaatc

SEQ ID NO: 4291905 - DNA, 12 bp, Homo sapiens
cattattttccc

SEQ ID NO: 4291906 - DNA, 13 bp, Homo sapiens
cattattttccca

SEQ ID NO: 4291907 - DNA, 23 bp, Homo sapiens
cattcaaaaacatggccacatcc

SEQ ID NO: 4291908 - DNA, 13 bp, Homo sapiens
cattcaaaaattt

SEQ ID NO: 4291909 - DNA, 16 bp, Homo sapiens
cattcaaaatagttct

SEQ ID NO: 4291910 - DNA, 17 bp, Homo sapiens
cattcacaacacaatca

SEQ ID NO: 4291911 - DNA, 15 bp, Homo sapiens
cattcatacttaaaa

SEQ ID NO: 4291912 - DNA, 14 bp, Homo sapiens
cattcccagacagc

SEQ ID NO: 4291913 - DNA, 17 bp, Homo sapiens
cattcccagacagcagt

SEQ ID NO: 4291914 - DNA, 14 bp, Homo sapiens
cattctatctactg

SEQ ID NO: 4291915 - DNA, 16 bp, Homo sapiens
cattctcactcctacc

SEQ ID NO: 4291916 - DNA, 17 bp, Homo sapiens
cattcttcaagatccca

SEQ ID NO: 4291917 - DNA, 20 bp, Homo sapiens
cattctttaacatacatcta

SEQ ID NO: 4291918 - DNA, 22 bp, Homo sapiens
cattcttttcagcttgtttcta

SEQ ID NO: 4291919 - DNA, 14 bp, Homo sapiens
cattgaaataataa

SEQ ID NO: 4291920 - DNA, 13 bp, Homo sapiens
cattgcaaaaggt

SEQ ID NO: 4291921 - DNA, 14 bp, Homo sapiens
cattgcccacacct

SEQ ID NO: 4291922 - DNA, 22 bp, Homo sapiens
cattgcccacacctgcctctga

SEQ ID NO: 4291923 - DNA, 21 bp, Homo sapiens
cattgccctgaggggcctgcc

SEQ ID NO: 4291924 - DNA, 22 bp, Homo sapiens
cattgccctgaggggcctgcca

SEQ ID NO: 4291925 - DNA, 12 bp, Homo sapiens
cattgccttctg

SEQ ID NO: 4291926 - DNA, 22 bp, Homo sapiens
cattgccttctggggagggaca

SEQ ID NO: 4291927 - DNA, 17 bp, Homo sapiens
cattgggccatgtttaa

SEQ ID NO: 4291928 - DNA, 14 bp, Homo sapiens
cattgtagaaaagc

SEQ ID NO: 4291929 - DNA, 19 bp, Homo sapiens
cattgttacaggtgtacta

SEQ ID NO: 4291930 - DNA, 13 bp, Homo sapiens
cattgtttccacc

SEQ ID NO: 4291931 - DNA, 19 bp, Homo sapiens
catttaaaatagttttcta

SEQ ID NO: 4291932 - DNA, 20 bp, Homo sapiens
catttaaaatagttttctaa

SEQ ID NO: 4291933 - DNA, 13 bp, Homo sapiens
catttaaaatgga

SEQ ID NO: 4291934 - DNA, 14 bp, Homo sapiens
catttaaaatggac

SEQ ID NO: 4291935 - DNA, 19 bp, Homo sapiens
catttaactagcactttat

SEQ ID NO: 4291936 - DNA, 18 bp, Homo sapiens
catttaagaattgccagt

SEQ ID NO: 4291937 - DNA, 15 bp, Homo sapiens
catttagtcctcacc

SEQ ID NO: 4291938 - DNA, 20 bp, Homo sapiens
catttatgagctcttcatgt

SEQ ID NO: 4291939 - DNA, 14 bp, Homo sapiens
catttcatttccta

SEQ ID NO: 4291940 - DNA, 22 bp, Homo sapiens
catttccaccaagggtatctgc

SEQ ID NO: 4291941 - DNA, 23 bp, Homo sapiens
catttccaccaagggtatctgct

SEQ ID NO: 4291942 - DNA, 20 bp, Homo sapiens
catttcctgacagaaggact

SEQ ID NO: 4291943 - DNA, 16 bp, Homo sapiens
catttctcaaagtttt

SEQ ID NO: 4291944 - DNA, 20 bp, Homo sapiens
catttctcaaagtttttaca

SEQ ID NO: 4291945 - DNA, 15 bp, Homo sapiens
catttcttgggccct

SEQ ID NO: 4291946 - DNA, 22 bp, Homo sapiens
catttgcagaccaggaaggaag

SEQ ID NO: 4291947 - DNA, 15 bp, Homo sapiens
catttgtaatgtatc

SEQ ID NO: 4291948 - DNA, 17 bp, Homo sapiens
catttgtaatgtatctt

SEQ ID NO: 4291949 - DNA, 18 bp, Homo sapiens
catttgtaatgtatctta

SEQ ID NO: 4291950 - DNA, 21 bp, Homo sapiens
catttgtaatgtatcttattt

SEQ ID NO: 4291951 - DNA, 16 bp, Homo sapiens
catttgtgcgtatgca

SEQ ID NO: 4291952 - DNA, 22 bp, Homo sapiens
catttgttaatatcactcatta

SEQ ID NO: 4291953 - DNA, 17 bp, Homo sapiens
cattttactgtctgtaa

SEQ ID NO: 4291954 - DNA, 17 bp, Homo sapiens
cattttgcgatgtgttt

SEQ ID NO: 4291955 - DNA, 18 bp, Homo sapiens
cattttgcgatgtgtttt

SEQ ID NO: 4291956 - DNA, 18 bp, Homo sapiens
cattttgtctggctgtgg

SEQ ID NO: 4291957 - DNA, 12 bp, Homo sapiens
catttttcttgg

SEQ ID NO: 4291958 - DNA, 19 bp, Homo sapiens
catttttgaaactgcattt

SEQ ID NO: 4291959 - DNA, 15 bp, Homo sapiens
ccaaaaccacagccc

SEQ ID NO: 4291960 - DNA, 24 bp, Homo sapiens
ccaaaagtgtcaaggggccctagg

SEQ ID NO: 4291961 - DNA, 17 bp, Homo sapiens
ccaaaatgaagacacgc

SEQ ID NO: 4291962 - DNA, 21 bp, Homo sapiens
ccaaatcctgggcatccccag

SEQ ID NO: 4291963 - DNA, 14 bp, Homo sapiens
ccaaattgatgggt

SEQ ID NO: 4291964 - DNA, 14 bp, Homo sapiens
ccaaattgcagaag

SEQ ID NO: 4291965 - DNA, 18 bp, Homo sapiens
ccaacaactccaggaaaa

SEQ ID NO: 4291966 - DNA, 15 bp, Homo sapiens
ccaaccacctctggc

SEQ ID NO: 4291967 - DNA, 19 bp, Homo sapiens
ccaaccacctctggccctg

SEQ ID NO: 4291968 - DNA, 21 bp, Homo sapiens
ccaaccccagcagtcctgggc

SEQ ID NO: 4291969 - DNA, 12 bp, Homo sapiens
ccaacccctgtg

SEQ ID NO: 4291970 - DNA, 15 bp, Homo sapiens
ccaaccctcagagcc

SEQ ID NO: 4291971 - DNA, 16 bp, Homo sapiens
ccaacctcactgccct

SEQ ID NO: 4291972 - DNA, 16 bp, Homo sapiens
ccaacctctttcctct

SEQ ID NO: 4291973 - DNA, 19 bp, Homo sapiens
ccaacgaaaagcacatcca

SEQ ID NO: 4291974 - DNA, 15 bp, Homo sapiens
ccaactttccagact

SEQ ID NO: 4291975 - DNA, 20 bp, Homo sapiens
ccaagaatagatgctgactg

SEQ ID NO: 4291976 - DNA, 21 bp, Homo sapiens
ccaagccagggttccagacag

SEQ ID NO: 4291977 - DNA, 13 bp, Homo sapiens
ccaagccgtggct

SEQ ID NO: 4291978 - DNA, 15 bp, Homo sapiens
ccaagccgtggcttc

SEQ ID NO: 4291979 - DNA, 21 bp, Homo sapiens
ccaagccgtggcttcccgctc

SEQ ID NO: 4291980 - DNA, 23 bp, Homo sapiens
ccaagccgtggcttcccgctcag

SEQ ID NO: 4291981 - DNA, 12 bp, Homo sapiens
ccaagcctgccc

SEQ ID NO: 4291982 - DNA, 14 bp, Homo sapiens
ccaagcctgccccg

SEQ ID NO: 4291983 - DNA, 15 bp, Homo sapiens
ccaagcctgggccac

SEQ ID NO: 4291984 - DNA, 19 bp, Homo sapiens
ccaagcctgggccactggc

SEQ ID NO: 4291985 - DNA, 15 bp, Homo sapiens
ccaaggacccctcac

SEQ ID NO: 4291986 - DNA, 22 bp, Homo sapiens
ccaaggacccctcaccttgcaa

SEQ ID NO: 4291987 - DNA, 15 bp, Homo sapiens
ccaaggactgccgac

SEQ ID NO: 4291988 - DNA, 22 bp, Homo sapiens
ccaaggagtctgattgcaggaa

SEQ ID NO: 4291989 - DNA, 14 bp, Homo sapiens
ccaaggcaaatgtc

SEQ ID NO: 4291990 - DNA, 15 bp, Homo sapiens
ccaaggcaaatgtcc

SEQ ID NO: 4291991 - DNA, 12 bp, Homo sapiens
ccaagggcccag

SEQ ID NO: 4291992 - DNA, 20 bp, Homo sapiens
ccaagggtatctgctgcctc

SEQ ID NO: 4291993 - DNA, 20 bp, Homo sapiens
ccaagtcagctttgccttcc

SEQ ID NO: 4291994 - DNA, 14 bp, Homo sapiens
ccaagtgcaggctg

SEQ ID NO: 4291995 - DNA, 17 bp, Homo sapiens
ccaagtgtttctgtttc

SEQ ID NO: 4291996 - DNA, 22 bp, Homo sapiens
ccaatcaacagcatgtctactg

SEQ ID NO: 4291997 - DNA, 23 bp, Homo sapiens
ccaatcaacagcatgtctactgc

SEQ ID NO: 4291998 - DNA, 16 bp, Homo sapiens
ccaatctctgtgactc

SEQ ID NO: 4291999 - DNA, 20 bp, Homo sapiens
ccaatgaagcaaacacacag

SEQ ID NO: 4292000 - DNA, 20 bp, Homo sapiens
ccaatgattcataacaatgt

SEQ ID NO: 4292001 - DNA, 20 bp, Homo sapiens
ccacaaatgtcctcagaggg

SEQ ID NO: 4292002 - DNA, 17 bp, Homo sapiens
ccacaaggctgaaaagt

SEQ ID NO: 4292003 - DNA, 20 bp, Homo sapiens
ccacaaggctgaaaagtgct

SEQ ID NO: 4292004 - DNA, 14 bp, Homo sapiens
ccacacacaccctt

SEQ ID NO: 4292005 - DNA, 17 bp, Homo sapiens
ccacacacacccttccc

SEQ ID NO: 4292006 - DNA, 15 bp, Homo sapiens
ccacacaggcctggc

SEQ ID NO: 4292007 - DNA, 18 bp, Homo sapiens
ccacacaggcctggccca

SEQ ID NO: 4292008 - DNA, 19 bp, Homo sapiens
ccacacaggcctggcccag

SEQ ID NO: 4292009 - DNA, 18 bp, Homo sapiens
ccacactacgcagaagag

SEQ ID NO: 4292010 - DNA, 21 bp, Homo sapiens
ccacacttcaggctcttctcc

SEQ ID NO: 4292011 - DNA, 23 bp, Homo sapiens
ccacacttccacccccagctcct

SEQ ID NO: 4292012 - DNA, 12 bp, Homo sapiens
ccacacttcctg

SEQ ID NO: 4292013 - DNA, 18 bp, Homo sapiens
ccacagaaaccctgtttt

SEQ ID NO: 4292014 - DNA, 16 bp, Homo sapiens
ccacaggagcgtgtac

SEQ ID NO: 4292015 - DNA, 20 bp, Homo sapiens
ccacaggagcgtgtcctatc

SEQ ID NO: 4292016 - DNA, 22 bp, Homo sapiens
ccacaggagcgtgtcctatccc

SEQ ID NO: 4292017 - DNA, 23 bp, Homo sapiens
ccacaggagcgtgtcctatcccc

SEQ ID NO: 4292018 - DNA, 15 bp, Homo sapiens
ccacaggcccttcct

SEQ ID NO: 4292019 - DNA, 19 bp, Homo sapiens
ccacaggcccttcctctcc

SEQ ID NO: 4292020 - DNA, 21 bp, Homo sapiens
ccacatagtgatggttcccct

SEQ ID NO: 4292021 - DNA, 18 bp, Homo sapiens
ccacatccaacatttcct

SEQ ID NO: 4292022 - DNA, 23 bp, Homo sapiens
ccacatccaacatttcctcaggc

SEQ ID NO: 4292023 - DNA, 23 bp, Homo sapiens
ccacatccattccagagctgcag

SEQ ID NO: 4292024 - DNA, 17 bp, Homo sapiens
ccacattctgctgcccc

SEQ ID NO: 4292025 - DNA, 21 bp, Homo sapiens
ccacattctgctgcccccaga

SEQ ID NO: 4292026 - DNA, 15 bp, Homo sapiens
ccaccaaccctcaga

SEQ ID NO: 4292027 - DNA, 17 bp, Homo sapiens
ccaccacacacaccctt

SEQ ID NO: 4292028 - DNA, 14 bp, Homo sapiens
ccaccacctggatg

SEQ ID NO: 4292029 - DNA, 20 bp, Homo sapiens
ccaccagagcctccctcagc

SEQ ID NO: 4292030 - DNA, 12 bp, Homo sapiens
ccaccagcagca

SEQ ID NO: 4292031 - DNA, 15 bp, Homo sapiens
ccaccagctggctct

SEQ ID NO: 4292032 - DNA, 22 bp, Homo sapiens
ccaccagctggctctgcagcac

SEQ ID NO: 4292033 - DNA, 14 bp, Homo sapiens
ccaccccagcctaa

SEQ ID NO: 4292034 - DNA, 13 bp, Homo sapiens
ccacccccgggtg

SEQ ID NO: 4292035 - DNA, 14 bp, Homo sapiens
ccaccccgcctctg

SEQ ID NO: 4292036 - DNA, 17 bp, Homo sapiens
ccacccggatctccagg

SEQ ID NO: 4292037 - DNA, 15 bp, Homo sapiens
ccacccgtttccaag

SEQ ID NO: 4292038 - DNA, 17 bp, Homo sapiens
ccacccgtttccaagcc

SEQ ID NO: 4292039 - DNA, 11 bp, Homo sapiens
ccaccctctgc

SEQ ID NO: 4292040 - DNA, 12 bp, Homo sapiens
ccaccctctgca

SEQ ID NO: 4292041 - DNA, 19 bp, Homo sapiens
ccaccctctgcagggcagc

SEQ ID NO: 4292042 - DNA, 12 bp, Homo sapiens
ccaccctgccat

SEQ ID NO: 4292043 - DNA, 13 bp, Homo sapiens
ccaccctgccatg

SEQ ID NO: 4292044 - DNA, 14 bp, Homo sapiens
ccaccctgccatgg

SEQ ID NO: 4292045 - DNA, 12 bp, Homo sapiens
ccacccttcgca

SEQ ID NO: 4292046 - DNA, 15 bp, Homo sapiens
ccaccgctccccagc

SEQ ID NO: 4292047 - DNA, 22 bp, Homo sapiens
ccacctagaatggaagcctcca

SEQ ID NO: 4292048 - DNA, 14 bp, Homo sapiens
ccacctcaggggag

SEQ ID NO: 4292049 - DNA, 13 bp, Homo sapiens
ccacctgcagccc

SEQ ID NO: 4292050 - DNA, 18 bp, Homo sapiens
ccacctgcccccttctcc

SEQ ID NO: 4292051 - DNA, 20 bp, Homo sapiens
ccacctgcccccttctccca

SEQ ID NO: 4292052 - DNA, 14 bp, Homo sapiens
ccacctgctgcccg

SEQ ID NO: 4292053 - DNA, 22 bp, Homo sapiens
ccacctggatggatctgctcca

SEQ ID NO: 4292054 - DNA, 12 bp, Homo sapiens
ccacctgggaga

SEQ ID NO: 4292055 - DNA, 13 bp, Homo sapiens
ccacctgggagat

SEQ ID NO: 4292056 - DNA, 15 bp, Homo sapiens
ccacctgtgctgctg

SEQ ID NO: 4292057 - DNA, 15 bp, Homo sapiens
ccacgcctctctcag

SEQ ID NO: 4292058 - DNA, 22 bp, Homo sapiens
ccacgcctgcgatggtgctgca

SEQ ID NO: 4292059 - DNA, 14 bp, Homo sapiens
ccacgcgctctgca

SEQ ID NO: 4292060 - DNA, 16 bp, Homo sapiens
ccacgcgctctgcatg

SEQ ID NO: 4292061 - DNA, 17 bp, Homo sapiens
ccacgcgctctgcatgc

SEQ ID NO: 4292062 - DNA, 12 bp, Homo sapiens
ccacgctcctgc

SEQ ID NO: 4292063 - DNA, 16 bp, Homo sapiens
ccacgctcctgccctc

SEQ ID NO: 4292064 - DNA, 16 bp, Homo sapiens
ccacggcagccaccct

SEQ ID NO: 4292065 - DNA, 19 bp, Homo sapiens
ccacggcagccaccctgcc

SEQ ID NO: 4292066 - DNA, 13 bp, Homo sapiens
ccacggccactgc

SEQ ID NO: 4292067 - DNA, 18 bp, Homo sapiens
ccacggctctaggtgggg

SEQ ID NO: 4292068 - DNA, 13 bp, Homo sapiens
ccacgggggaggc

SEQ ID NO: 4292069 - DNA, 18 bp, Homo sapiens
ccacgggggcctagtggc

SEQ ID NO: 4292070 - DNA, 17 bp, Homo sapiens
ccacgtgctggagagta

SEQ ID NO: 4292071 - DNA, 18 bp, Homo sapiens
ccacgtgctggagagtag

SEQ ID NO: 4292072 - DNA, 18 bp, Homo sapiens
ccactaggtgcccagtct

SEQ ID NO: 4292073 - DNA, 20 bp, Homo sapiens
ccactccagacccctggctt

SEQ ID NO: 4292074 - DNA, 21 bp, Homo sapiens
ccactccagacccctggcttt

SEQ ID NO: 4292075 - DNA, 13 bp, Homo sapiens
ccactcccagggg

SEQ ID NO: 4292076 - DNA, 12 bp, Homo sapiens
ccactcccctca

SEQ ID NO: 4292077 - DNA, 18 bp, Homo sapiens
ccactcccctcatccact

SEQ ID NO: 4292078 - DNA, 14 bp, Homo sapiens
ccactccctgtctg

SEQ ID NO: 4292079 - DNA, 13 bp, Homo sapiens
ccactcctcccaa

SEQ ID NO: 4292080 - DNA, 12 bp, Homo sapiens
ccactctcctga

SEQ ID NO: 4292081 - DNA, 16 bp, Homo sapiens
ccactctcctgaggag

SEQ ID NO: 4292082 - DNA, 22 bp, Homo sapiens
ccactctgctgaggccagagga

SEQ ID NO: 4292083 - DNA, 23 bp, Homo sapiens
ccactctgctgaggccagaggaa

SEQ ID NO: 4292084 - DNA, 20 bp, Homo sapiens
ccactgcagtcacccctgtc

SEQ ID NO: 4292085 - DNA, 12 bp, Homo sapiens
ccactgcctgcc

SEQ ID NO: 4292086 - DNA, 16 bp, Homo sapiens
ccactgcctgcccacc

SEQ ID NO: 4292087 - DNA, 23 bp, Homo sapiens
ccactgcctgcccacccgtggag

SEQ ID NO: 4292088 - DNA, 15 bp, Homo sapiens
ccactggcatctctg

SEQ ID NO: 4292089 - DNA, 11 bp, Homo sapiens
ccactggctcc

SEQ ID NO: 4292090 - DNA, 21 bp, Homo sapiens
ccacttagaaattgcatttcc

SEQ ID NO: 4292091 - DNA, 16 bp, Homo sapiens
ccacttatgctgctgt

SEQ ID NO: 4292092 - DNA, 18 bp, Homo sapiens
ccacttatgctgctgtga

SEQ ID NO: 4292093 - DNA, 20 bp, Homo sapiens
ccacttatgctgctgtgaat

SEQ ID NO: 4292094 - DNA, 14 bp, Homo sapiens
ccacttatttccat

SEQ ID NO: 4292095 - DNA, 23 bp, Homo sapiens
ccactttgcagacctgggacttt

SEQ ID NO: 4292096 - DNA, 16 bp, Homo sapiens
ccagaaatgccgctgt

SEQ ID NO: 4292097 - DNA, 15 bp, Homo sapiens
ccagaagtggcagga

SEQ ID NO: 4292098 - DNA, 17 bp, Homo sapiens
ccagaagtggcaggagg

SEQ ID NO: 4292099 - DNA, 12 bp, Homo sapiens
ccagaattgaga

SEQ ID NO: 4292100 - DNA, 19 bp, Homo sapiens
ccagacagcagtgtgaggg

SEQ ID NO: 4292101 - DNA, 16 bp, Homo sapiens
ccagacatgctgccca

SEQ ID NO: 4292102 - DNA, 17 bp, Homo sapiens
ccagacatgctgcccac

SEQ ID NO: 4292103 - DNA, 15 bp, Homo sapiens
ccagacattgtattt

SEQ ID NO: 4292104 - DNA, 9 bp, Homo sapiens
ccagacccc

SEQ ID NO: 4292105 - DNA, 12 bp, Homo sapiens
ccagaccccatc

SEQ ID NO: 4292106 - DNA, 15 bp, Homo sapiens
ccagaccccatccag

SEQ ID NO: 4292107 - DNA, 12 bp, Homo sapiens
ccagacccccac

SEQ ID NO: 4292108 - DNA, 15 bp, Homo sapiens
ccagacccccacccc

SEQ ID NO: 4292109 - DNA, 16 bp, Homo sapiens
ccagacccccacccct

SEQ ID NO: 4292110 - DNA, 21 bp, Homo sapiens
ccagacccccaccccttcccc

SEQ ID NO: 4292111 - DNA, 14 bp, Homo sapiens
ccagacccccagca

SEQ ID NO: 4292112 - DNA, 21 bp, Homo sapiens
ccagacccctaccctttccca

SEQ ID NO: 4292113 - DNA, 14 bp, Homo sapiens
ccagacccctggct

SEQ ID NO: 4292114 - DNA, 16 bp, Homo sapiens
ccagacccctggcttt

SEQ ID NO: 4292115 - DNA, 21 bp, Homo sapiens
ccagacctgggccctggttcc

SEQ ID NO: 4292116 - DNA, 20 bp, Homo sapiens
ccagacttcgctattcccag

SEQ ID NO: 4292117 - DNA, 24 bp, Homo sapiens
ccagacttcgctattcccaggcag

SEQ ID NO: 4292118 - DNA, 22 bp, Homo sapiens
ccagagaaatgaaagtcagttt

SEQ ID NO: 4292119 - DNA, 19 bp, Homo sapiens
ccagagagaagcaccccac

SEQ ID NO: 4292120 - DNA, 14 bp, Homo sapiens
ccagagagagaagt

SEQ ID NO: 4292121 - DNA, 23 bp, Homo sapiens
ccagagagagaagtgcccctgct

SEQ ID NO: 4292122 - DNA, 14 bp, Homo sapiens
ccagagagtggctc

SEQ ID NO: 4292123 - DNA, 22 bp, Homo sapiens
ccagagagtggctcctcccggt

SEQ ID NO: 4292124 - DNA, 14 bp, Homo sapiens
ccagagccagggct

SEQ ID NO: 4292125 - DNA, 23 bp, Homo sapiens
ccagagccagggctgtccttaga

SEQ ID NO: 4292126 - DNA, 15 bp, Homo sapiens
ccagagccatggact

SEQ ID NO: 4292127 - DNA, 16 bp, Homo sapiens
ccagagcctccctcag

SEQ ID NO: 4292128 - DNA, 20 bp, Homo sapiens
ccagagcctccctcagccac

SEQ ID NO: 4292129 - DNA, 22 bp, Homo sapiens
ccagagcctccctcagccacgc

SEQ ID NO: 4292130 - DNA, 14 bp, Homo sapiens
ccagagctcccagg

SEQ ID NO: 4292131 - DNA, 16 bp, Homo sapiens
ccagaggaagggaggc

SEQ ID NO: 4292132 - DNA, 21 bp, Homo sapiens
ccagaggaagggaggcctgag

SEQ ID NO: 4292133 - DNA, 22 bp, Homo sapiens
ccagaggaagggaggcctgagg

SEQ ID NO: 4292134 - DNA, 23 bp, Homo sapiens
ccagaggaagggaggcctgaggg

SEQ ID NO: 4292135 - DNA, 12 bp, Homo sapiens
ccagaggcctgg

SEQ ID NO: 4292136 - DNA, 13 bp, Homo sapiens
ccagaggcctggt

SEQ ID NO: 4292137 - DNA, 15 bp, Homo sapiens
ccagaggcctggtgc

SEQ ID NO: 4292138 - DNA, 21 bp, Homo sapiens
ccagaggcctggtgccctggc

SEQ ID NO: 4292139 - DNA, 17 bp, Homo sapiens
ccagaggggcggggcca

SEQ ID NO: 4292140 - DNA, 18 bp, Homo sapiens
ccagaggggcggggccag

SEQ ID NO: 4292141 - DNA, 15 bp, Homo sapiens
ccagatggctccctg

SEQ ID NO: 4292142 - DNA, 18 bp, Homo sapiens
ccagcaaagttttcagat

SEQ ID NO: 4292143 - DNA, 18 bp, Homo sapiens
ccagcaaccctcctatca

SEQ ID NO: 4292144 - DNA, 20 bp, Homo sapiens
ccagcacccatgccccactc

SEQ ID NO: 4292145 - DNA, 11 bp, Homo sapiens
ccagcagcaca

SEQ ID NO: 4292146 - DNA, 21 bp, Homo sapiens
ccagcagcacaattctgtccc

SEQ ID NO: 4292147 - DNA, 22 bp, Homo sapiens
ccagcagcacaattctgtccct

SEQ ID NO: 4292148 - DNA, 22 bp, Homo sapiens
ccagcagggcgggccaggagaa

SEQ ID NO: 4292149 - DNA, 13 bp, Homo sapiens
ccagcagtcctgg

SEQ ID NO: 4292150 - DNA, 14 bp, Homo sapiens
ccagcagtcctggg

SEQ ID NO: 4292151 - DNA, 13 bp, Homo sapiens
ccagccaacccct

SEQ ID NO: 4292152 - DNA, 21 bp, Homo sapiens
ccagccacccggatctccagg

SEQ ID NO: 4292153 - DNA, 22 bp, Homo sapiens
ccagcccacatccattccagag

SEQ ID NO: 4292154 - DNA, 21 bp, Homo sapiens
ccagcccagatggctccctgg

SEQ ID NO: 4292155 - DNA, 23 bp, Homo sapiens
ccagcccagatggctccctgggc

SEQ ID NO: 4292156 - DNA, 18 bp, Homo sapiens
ccagcccagggttccccc

SEQ ID NO: 4292157 - DNA, 20 bp, Homo sapiens
ccagccctggtggccaagcc

SEQ ID NO: 4292158 - DNA, 22 bp, Homo sapiens
ccagccctggttctccatcccc

SEQ ID NO: 4292159 - DNA, 14 bp, Homo sapiens
ccagccctgtggaa

SEQ ID NO: 4292160 - DNA, 15 bp, Homo sapiens
ccagccctgtggaag

SEQ ID NO: 4292161 - DNA, 14 bp, Homo sapiens
ccagccgctggtgc

SEQ ID NO: 4292162 - DNA, 18 bp, Homo sapiens
ccagccgctggtgcccac

SEQ ID NO: 4292163 - DNA, 17 bp, Homo sapiens
ccagcctaagatgaaga

SEQ ID NO: 4292164 - DNA, 14 bp, Homo sapiens
ccagcctcagtgca

SEQ ID NO: 4292165 - DNA, 15 bp, Homo sapiens
ccagcctcagtgcag

SEQ ID NO: 4292166 - DNA, 13 bp, Homo sapiens
ccagcctggcccc

SEQ ID NO: 4292167 - DNA, 18 bp, Homo sapiens
ccagcctgtggcctcagc

SEQ ID NO: 4292168 - DNA, 20 bp, Homo sapiens
ccagcgagtctggagaccag

SEQ ID NO: 4292169 - DNA, 21 bp, Homo sapiens
ccagctcaggctactgccact

SEQ ID NO: 4292170 - DNA, 14 bp, Homo sapiens
ccagctcccagccc

SEQ ID NO: 4292171 - DNA, 18 bp, Homo sapiens
ccagctctagacaaccct

SEQ ID NO: 4292172 - DNA, 16 bp, Homo sapiens
ccagctctcccctgcg

SEQ ID NO: 4292173 - DNA, 16 bp, Homo sapiens
ccagctgcaggaatca

SEQ ID NO: 4292174 - DNA, 19 bp, Homo sapiens
ccagctgcaggaatcaaaa

SEQ ID NO: 4292175 - DNA, 16 bp, Homo sapiens
ccagctgcttctgccc

SEQ ID NO: 4292176 - DNA, 19 bp, Homo sapiens
ccagctgcttctgcccacc

SEQ ID NO: 4292177 - DNA, 15 bp, Homo sapiens
ccagctggctctgca

SEQ ID NO: 4292178 - DNA, 19 bp, Homo sapiens
ccagctggctctgcagcac

SEQ ID NO: 4292179 - DNA, 15 bp, Homo sapiens
ccaggaaggcggggc

SEQ ID NO: 4292180 - DNA, 18 bp, Homo sapiens
ccaggaagtcatcctgca

SEQ ID NO: 4292181 - DNA, 13 bp, Homo sapiens
ccaggacactgcc

SEQ ID NO: 4292182 - DNA, 17 bp, Homo sapiens
ccaggacactgcctttg

SEQ ID NO: 4292183 - DNA, 14 bp, Homo sapiens
ccaggacctctggg

SEQ ID NO: 4292184 - DNA, 15 bp, Homo sapiens
ccaggactctgcctt

SEQ ID NO: 4292185 - DNA, 19 bp, Homo sapiens
ccaggagagaccttctctt

SEQ ID NO: 4292186 - DNA, 19 bp, Homo sapiens
ccaggagagcccccaccag

SEQ ID NO: 4292187 - DNA, 11 bp, Homo sapiens
ccaggagccag

SEQ ID NO: 4292188 - DNA, 20 bp, Homo sapiens
ccaggatggcgtgtcccctg

SEQ ID NO: 4292189 - DNA, 20 bp, Homo sapiens
ccaggattgtccacaaatgt

SEQ ID NO: 4292190 - DNA, 23 bp, Homo sapiens
ccaggattgtccacaaatgtcct

SEQ ID NO: 4292191 - DNA, 17 bp, Homo sapiens
ccaggcatgaccctgga

SEQ ID NO: 4292192 - DNA, 21 bp, Homo sapiens
ccaggcatgaccctggagccc

SEQ ID NO: 4292193 - DNA, 21 bp, Homo sapiens
ccaggccatccggcccccaga

SEQ ID NO: 4292194 - DNA, 14 bp, Homo sapiens
ccaggcccagcctg

SEQ ID NO: 4292195 - DNA, 21 bp, Homo sapiens
ccaggccccaaaaccacagcc

SEQ ID NO: 4292196 - DNA, 15 bp, Homo sapiens
ccaggccccaggctg

SEQ ID NO: 4292197 - DNA, 15 bp, Homo sapiens
ccaggcgtagggcca

SEQ ID NO: 4292198 - DNA, 16 bp, Homo sapiens
ccaggcgtagggccag

SEQ ID NO: 4292199 - DNA, 17 bp, Homo sapiens
ccaggcgtagggccagg

SEQ ID NO: 4292200 - DNA, 19 bp, Homo sapiens
ccaggcgtagggccagggc

SEQ ID NO: 4292201 - DNA, 19 bp, Homo sapiens
ccaggctcacaactgtttt

SEQ ID NO: 4292202 - DNA, 13 bp, Homo sapiens
ccaggcttcctgc

SEQ ID NO: 4292203 - DNA, 14 bp, Homo sapiens
ccaggcttcctgcc

SEQ ID NO: 4292204 - DNA, 15 bp, Homo sapiens
ccaggcttcctgccc

SEQ ID NO: 4292205 - DNA, 18 bp, Homo sapiens
ccaggcttcctgccctag

SEQ ID NO: 4292206 - DNA, 15 bp, Homo sapiens
ccagggaatcaggga

SEQ ID NO: 4292207 - DNA, 13 bp, Homo sapiens
ccagggagctctg

SEQ ID NO: 4292208 - DNA, 17 bp, Homo sapiens
ccagggagctctgcata

SEQ ID NO: 4292209 - DNA, 13 bp, Homo sapiens
ccagggccctgct

SEQ ID NO: 4292210 - DNA, 17 bp, Homo sapiens
ccagggccctgctcagg

SEQ ID NO: 4292211 - DNA, 15 bp, Homo sapiens
ccagggctctggcag

SEQ ID NO: 4292212 - DNA, 16 bp, Homo sapiens
ccagggctctggcagg

SEQ ID NO: 4292213 - DNA, 17 bp, Homo sapiens
ccaggggttccccagga

SEQ ID NO: 4292214 - DNA, 20 bp, Homo sapiens
ccagggtctcgtcaggaggt

SEQ ID NO: 4292215 - DNA, 22 bp, Homo sapiens
ccagggtggtcttcaagcctgg

SEQ ID NO: 4292216 - DNA, 22 bp, Homo sapiens
ccagggttaaagaaaggcagag

SEQ ID NO: 4292217 - DNA, 14 bp, Homo sapiens
ccagggttccagac

SEQ ID NO: 4292218 - DNA, 17 bp, Homo sapiens
ccaggtctcctgggcat

SEQ ID NO: 4292219 - DNA, 21 bp, Homo sapiens
ccaggtctcctgggcatctgg

SEQ ID NO: 4292220 - DNA, 22 bp, Homo sapiens
ccagtcatggctgtcccctgca

SEQ ID NO: 4292221 - DNA, 14 bp, Homo sapiens
ccagtccccgggaa

SEQ ID NO: 4292222 - DNA, 15 bp, Homo sapiens
ccagtccccgggaaa

SEQ ID NO: 4292223 - DNA, 17 bp, Homo sapiens
ccagtgacacaactcat

SEQ ID NO: 4292224 - DNA, 18 bp, Homo sapiens
ccagtgaccctggagcta

SEQ ID NO: 4292225 - DNA, 14 bp, Homo sapiens
ccagtgactgctgc

SEQ ID NO: 4292226 - DNA, 19 bp, Homo sapiens
ccagtgcttagcaaaaaat

SEQ ID NO: 4292227 - DNA, 23 bp, Homo sapiens
ccagtggcctcaaccctccctca

SEQ ID NO: 4292228 - DNA, 22 bp, Homo sapiens
ccagtgtctaccttcattttct

SEQ ID NO: 4292229 - DNA, 18 bp, Homo sapiens
ccagtgtggactctggac

SEQ ID NO: 4292230 - DNA, 19 bp, Homo sapiens
ccagtgtggactctggact

SEQ ID NO: 4292231 - DNA, 19 bp, Homo sapiens
ccagtgttgcctcctccca

SEQ ID NO: 4292232 - DNA, 12 bp, Homo sapiens
ccagtgttttct

SEQ ID NO: 4292233 - DNA, 16 bp, Homo sapiens
ccagttctctttgtaa

SEQ ID NO: 4292234 - DNA, 21 bp, Homo sapiens
ccagttggactgtggcctcag

SEQ ID NO: 4292235 - DNA, 17 bp, Homo sapiens
ccataccccctgcccca

SEQ ID NO: 4292236 - DNA, 15 bp, Homo sapiens
ccatatagtttgttt

SEQ ID NO: 4292237 - DNA, 21 bp, Homo sapiens
ccatatagtttgttttctttt

SEQ ID NO: 4292238 - DNA, 22 bp, Homo sapiens
ccatatagtttgttttcttttt

SEQ ID NO: 4292239 - DNA, 14 bp, Homo sapiens
ccatatcccgggag

SEQ ID NO: 4292240 - DNA, 20 bp, Homo sapiens
ccatatgacaatttcaaaat

SEQ ID NO: 4292241 - DNA, 22 bp, Homo sapiens
ccatattctgtagtatttttct

SEQ ID NO: 4292242 - DNA, 17 bp, Homo sapiens
ccatcagcccctgctgc

SEQ ID NO: 4292243 - DNA, 19 bp, Homo sapiens
ccatcagcccctgctgctc

SEQ ID NO: 4292244 - DNA, 13 bp, Homo sapiens
ccatccagccagg

SEQ ID NO: 4292245 - DNA, 15 bp, Homo sapiens
ccatccagccagggg

SEQ ID NO: 4292246 - DNA, 14 bp, Homo sapiens
ccatcccctcctag

SEQ ID NO: 4292247 - DNA, 20 bp, Homo sapiens
ccatccctggtgaaagagta

SEQ ID NO: 4292248 - DNA, 22 bp, Homo sapiens
ccatccctggtgaaagagtaaa

SEQ ID NO: 4292249 - DNA, 16 bp, Homo sapiens
ccatctcaggccacct

SEQ ID NO: 4292250 - DNA, 17 bp, Homo sapiens
ccatctgtctgtcctac

SEQ ID NO: 4292251 - DNA, 13 bp, Homo sapiens
ccatgaaaaacag

SEQ ID NO: 4292252 - DNA, 17 bp, Homo sapiens
ccatgaaaaacagcaga

SEQ ID NO: 4292253 - DNA, 15 bp, Homo sapiens
ccatgaactttgtcc

SEQ ID NO: 4292254 - DNA, 13 bp, Homo sapiens
ccatgagctccag

SEQ ID NO: 4292255 - DNA, 19 bp, Homo sapiens
ccatgagctccagaccccc

SEQ ID NO: 4292256 - DNA, 19 bp, Homo sapiens
ccatgattccaagggccca

SEQ ID NO: 4292257 - DNA, 20 bp, Homo sapiens
ccatgattccaagggcccag

SEQ ID NO: 4292258 - DNA, 17 bp, Homo sapiens
ccatgattttggccact

SEQ ID NO: 4292259 - DNA, 18 bp, Homo sapiens
ccatgattttggccactt

SEQ ID NO: 4292260 - DNA, 21 bp, Homo sapiens
ccatgcagatctagccaggcc

SEQ ID NO: 4292261 - DNA, 16 bp, Homo sapiens
ccatgcaggcagcctg

SEQ ID NO: 4292262 - DNA, 12 bp, Homo sapiens
ccatgcatggcc

SEQ ID NO: 4292263 - DNA, 15 bp, Homo sapiens
ccatgcatggcctcc

SEQ ID NO: 4292264 - DNA, 16 bp, Homo sapiens
ccatgcatggcctccc

SEQ ID NO: 4292265 - DNA, 21 bp, Homo sapiens
ccatgcatggcctcccagcca

SEQ ID NO: 4292266 - DNA, 20 bp, Homo sapiens
ccatgccccactctgctgag

SEQ ID NO: 4292267 - DNA, 12 bp, Homo sapiens
ccatgccctccg

SEQ ID NO: 4292268 - DNA, 18 bp, Homo sapiens
ccatgccctccgtcctgg

SEQ ID NO: 4292269 - DNA, 21 bp, Homo sapiens
ccatggaagctggcaggagac

SEQ ID NO: 4292270 - DNA, 15 bp, Homo sapiens
ccatggactctacac

SEQ ID NO: 4292271 - DNA, 16 bp, Homo sapiens
ccatggattcccctgg

SEQ ID NO: 4292272 - DNA, 18 bp, Homo sapiens
ccatggtagactgtgaca

SEQ ID NO: 4292273 - DNA, 22 bp, Homo sapiens
ccatggtgcagtgaagaaaatg

SEQ ID NO: 4292274 - DNA, 20 bp, Homo sapiens
ccatggtggtttcagaaagg

SEQ ID NO: 4292275 - DNA, 17 bp, Homo sapiens
ccatggtgttggagggg

SEQ ID NO: 4292276 - DNA, 18 bp, Homo sapiens
ccatggtgttggaggggc

SEQ ID NO: 4292277 - DNA, 17 bp, Homo sapiens
ccatgtagaagagggag

SEQ ID NO: 4292278 - DNA, 17 bp, Homo sapiens
cagctcctttccctgga

SEQ ID NO: 4292279 - DNA, 21 bp, Homo sapiens
cagctctagacaaccctgcaa

SEQ ID NO: 4292280 - DNA, 18 bp, Homo sapiens
cagctctcccctgcgcag

SEQ ID NO: 4292281 - DNA, 15 bp, Homo sapiens
cagctgaccagaagt

SEQ ID NO: 4292282 - DNA, 11 bp, Homo sapiens
cagctgctcct

SEQ ID NO: 4292283 - DNA, 12 bp, Homo sapiens
cagctgcttctg

SEQ ID NO: 4292284 - DNA, 14 bp, Homo sapiens
cagctgcttctgcc

SEQ ID NO: 4292285 - DNA, 22 bp, Homo sapiens
cagctggctctgaatgtagcca

SEQ ID NO: 4292286 - DNA, 16 bp, Homo sapiens
cagctggctctgcagc

SEQ ID NO: 4292287 - DNA, 21 bp, Homo sapiens
cagctgtagaaaggttgattc

SEQ ID NO: 4292288 - DNA, 23 bp, Homo sapiens
cagctgtgcgagaacacaagcca

SEQ ID NO: 4292289 - DNA, 12 bp, Homo sapiens
cagcttcaaaac

SEQ ID NO: 4292290 - DNA, 16 bp, Homo sapiens
cagcttcaaaacagaa

SEQ ID NO: 4292291 - DNA, 13 bp, Homo sapiens
cagcttcaggtga

SEQ ID NO: 4292292 - DNA, 17 bp, Homo sapiens
cagcttcaggtgagcca

SEQ ID NO: 4292293 - DNA, 18 bp, Homo sapiens
cagcttcaggtgagccaa

SEQ ID NO: 4292294 - DNA, 21 bp, Homo sapiens
cagcttccccatcgccttctg

SEQ ID NO: 4292295 - DNA, 18 bp, Homo sapiens
cagcttgatgctgtttct

SEQ ID NO: 4292296 - DNA, 13 bp, Homo sapiens
cagcttgtccaac

SEQ ID NO: 4292297 - DNA, 23 bp, Homo sapiens
cagcttgtccaacaactccagga

SEQ ID NO: 4292298 - DNA, 15 bp, Homo sapiens
cagcttgtttctata

SEQ ID NO: 4292299 - DNA, 16 bp, Homo sapiens
cagctttgccttccac

SEQ ID NO: 4292300 - DNA, 18 bp, Homo sapiens
caggaaaccccgagaagg

SEQ ID NO: 4292301 - DNA, 16 bp, Homo sapiens
caggaacacccagccc

SEQ ID NO: 4292302 - DNA, 20 bp, Homo sapiens
caggaacacccagccccagc

SEQ ID NO: 4292303 - DNA, 16 bp, Homo sapiens
caggaaggtctcatgc

SEQ ID NO: 4292304 - DNA, 23 bp, Homo sapiens
caggaaggtctcatgcctgagaa

SEQ ID NO: 4292305 - DNA, 13 bp, Homo sapiens
caggaagtcagga

SEQ ID NO: 4292306 - DNA, 15 bp, Homo sapiens
caggaagtcaggagc

SEQ ID NO: 4292307 - DNA, 18 bp, Homo sapiens
caggaagtcaggagccag

SEQ ID NO: 4292308 - DNA, 19 bp, Homo sapiens
caggaagtcatcctgcaat

SEQ ID NO: 4292309 - DNA, 13 bp, Homo sapiens
caggaagtccctg

SEQ ID NO: 4292310 - DNA, 20 bp, Homo sapiens
caggaagtccctgagaagcc

SEQ ID NO: 4292311 - DNA, 18 bp, Homo sapiens
caggaatcaaaaattgaa

SEQ ID NO: 4292312 - DNA, 15 bp, Homo sapiens
caggaatgggccaag

SEQ ID NO: 4292313 - DNA, 20 bp, Homo sapiens
caggaattctccctggcatt

SEQ ID NO: 4292314 - DNA, 15 bp, Homo sapiens
caggacactgccttt

SEQ ID NO: 4292315 - DNA, 17 bp, Homo sapiens
caggacactgcctttgc

SEQ ID NO: 4292316 - DNA, 22 bp, Homo sapiens
caggaccccatctgctgagctc

SEQ ID NO: 4292317 - DNA, 20 bp, Homo sapiens
caggacctcagagtccaggc

SEQ ID NO: 4292318 - DNA, 21 bp, Homo sapiens
caggacctcagagtccaggcc

SEQ ID NO: 4292319 - DNA, 12 bp, Homo sapiens
caggagaggagc

SEQ ID NO: 4292320 - DNA, 16 bp, Homo sapiens
caggagcatgtcctat

SEQ ID NO: 4292321 - DNA, 17 bp, Homo sapiens
caggagcatgtcctatc

SEQ ID NO: 4292322 - DNA, 22 bp, Homo sapiens
caggagccagcagggcgggcca

SEQ ID NO: 4292323 - DNA, 23 bp, Homo sapiens
caggagccagcagggcgggccag

SEQ ID NO: 4292324 - DNA, 17 bp, Homo sapiens
caggagcctagaggagg

SEQ ID NO: 4292325 - DNA, 16 bp, Homo sapiens
caggagcgtgtactac

SEQ ID NO: 4292326 - DNA, 17 bp, Homo sapiens
caggagcgtgtcctatc

SEQ ID NO: 4292327 - DNA, 16 bp, Homo sapiens
caggaggaactggtcc

SEQ ID NO: 4292328 - DNA, 17 bp, Homo sapiens
caggaggaactggtcca

SEQ ID NO: 4292329 - DNA, 16 bp, Homo sapiens
caggaggacaggtgga

SEQ ID NO: 4292330 - DNA, 22 bp, Homo sapiens
caggaggacaggtggaggcgag

SEQ ID NO: 4292331 - DNA, 23 bp, Homo sapiens
caggaggacaggtggaggcgagc

SEQ ID NO: 4292332 - DNA, 19 bp, Homo sapiens
caggaggcagtggcttgga

SEQ ID NO: 4292333 - DNA, 15 bp, Homo sapiens
caggaggtgcctgag

SEQ ID NO: 4292334 - DNA, 19 bp, Homo sapiens
caggaggtgcctgagagca

SEQ ID NO: 4292335 - DNA, 20 bp, Homo sapiens
caggaggtgcctgagagcag

SEQ ID NO: 4292336 - DNA, 18 bp, Homo sapiens
caggagtgggtgggacac

SEQ ID NO: 4292337 - DNA, 18 bp, Homo sapiens
caggatgaactagccatg

SEQ ID NO: 4292338 - DNA, 16 bp, Homo sapiens
caggatgcatgcaggg

SEQ ID NO: 4292339 - DNA, 17 bp, Homo sapiens
caggatgcatgcagggc

SEQ ID NO: 4292340 - DNA, 18 bp, Homo sapiens
caggatggcgtgtcccct

SEQ ID NO: 4292341 - DNA, 21 bp, Homo sapiens
caggatggcgtgtcccctgcc

SEQ ID NO: 4292342 - DNA, 21 bp, Homo sapiens
caggatgtggcttatgagata

SEQ ID NO: 4292343 - DNA, 19 bp, Homo sapiens
caggcaatagtcaaaaaca

SEQ ID NO: 4292344 - DNA, 17 bp, Homo sapiens
caggcagagctcagcac

SEQ ID NO: 4292345 - DNA, 22 bp, Homo sapiens
caggcagagctcagcacagcct

SEQ ID NO: 4292346 - DNA, 14 bp, Homo sapiens
caggcagcctgcag

SEQ ID NO: 4292347 - DNA, 18 bp, Homo sapiens
caggcagcctgtgggtcc

SEQ ID NO: 4292348 - DNA, 12 bp, Homo sapiens
caggcaggctgt

SEQ ID NO: 4292349 - DNA, 13 bp, Homo sapiens
caggcagggaggg

SEQ ID NO: 4292350 - DNA, 15 bp, Homo sapiens
caggcatgaccctgg

SEQ ID NO: 4292351 - DNA, 20 bp, Homo sapiens
caggcatgaccctggagccc

SEQ ID NO: 4292352 - DNA, 15 bp, Homo sapiens
caggccacctgcccc

SEQ ID NO: 4292353 - DNA, 19 bp, Homo sapiens
caggccacctgcccccttc

SEQ ID NO: 4292354 - DNA, 14 bp, Homo sapiens
caggccaggcctca

SEQ ID NO: 4292355 - DNA, 18 bp, Homo sapiens
caggccatccggccccca

SEQ ID NO: 4292356 - DNA, 13 bp, Homo sapiens
caggcccagcctg

SEQ ID NO: 4292357 - DNA, 15 bp, Homo sapiens
caggcccagcctggc

SEQ ID NO: 4292358 - DNA, 17 bp, Homo sapiens
caggccccaaaaccaca

SEQ ID NO: 4292359 - DNA, 22 bp, Homo sapiens
caggccccaaaaccacagccct

SEQ ID NO: 4292360 - DNA, 16 bp, Homo sapiens
caggccccaggctgga

SEQ ID NO: 4292361 - DNA, 19 bp, Homo sapiens
caggccccaggctggatgc

SEQ ID NO: 4292362 - DNA, 19 bp, Homo sapiens
caggcccctttggacctgc

SEQ ID NO: 4292363 - DNA, 20 bp, Homo sapiens
caggcccttcctctccactg

SEQ ID NO: 4292364 - DNA, 21 bp, Homo sapiens
caggcccttcctctccactgc

SEQ ID NO: 4292365 - DNA, 21 bp, Homo sapiens
caggcctcacctggcttccca

SEQ ID NO: 4292366 - DNA, 14 bp, Homo sapiens
caggcctcagggac

SEQ ID NO: 4292367 - DNA, 15 bp, Homo sapiens
caggcctcatcctcc

SEQ ID NO: 4292368 - DNA, 20 bp, Homo sapiens
caggcctcccgcatgctgcc

SEQ ID NO: 4292369 - DNA, 18 bp, Homo sapiens
caggcctggcccagccag

SEQ ID NO: 4292370 - DNA, 19 bp, Homo sapiens
caggcctggcccagccagc

SEQ ID NO: 4292371 - DNA, 17 bp, Homo sapiens
caggcctggccctttca

SEQ ID NO: 4292372 - DNA, 17 bp, Homo sapiens
caggcctttttgagcca

SEQ ID NO: 4292373 - DNA, 21 bp, Homo sapiens
caggcgtagggccagggctct

SEQ ID NO: 4292374 - DNA, 22 bp, Homo sapiens
caggcgtagggccagggctctg

SEQ ID NO: 4292375 - DNA, 15 bp, Homo sapiens
caggctcacaactgt

SEQ ID NO: 4292376 - DNA, 18 bp, Homo sapiens
caggctcccactgcccct

SEQ ID NO: 4292377 - DNA, 21 bp, Homo sapiens
caggctcccactgcccctgca

SEQ ID NO: 4292378 - DNA, 22 bp, Homo sapiens
caggctcccactgcccctgcac

SEQ ID NO: 4292379 - DNA, 14 bp, Homo sapiens
caggctcttctcct

SEQ ID NO: 4292380 - DNA, 13 bp, Homo sapiens
caggctgccccac

SEQ ID NO: 4292381 - DNA, 13 bp, Homo sapiens
caggctggatgct

SEQ ID NO: 4292382 - DNA, 13 bp, Homo sapiens
caggcttcctgcc

SEQ ID NO: 4292383 - DNA, 16 bp, Homo sapiens
caggcttgcattaaaa

SEQ ID NO: 4292384 - DNA, 21 bp, Homo sapiens
caggcttggggatgcccttct

SEQ ID NO: 4292385 - DNA, 13 bp, Homo sapiens
cagggaagaaatc

SEQ ID NO: 4292386 - DNA, 14 bp, Homo sapiens
cagggaagaaatca

SEQ ID NO: 4292387 - DNA, 18 bp, Homo sapiens
cagggaatcagggagcac

SEQ ID NO: 4292388 - DNA, 15 bp, Homo sapiens
cagggaccaaggaga

SEQ ID NO: 4292389 - DNA, 16 bp, Homo sapiens
cagggagaggccatga

SEQ ID NO: 4292390 - DNA, 14 bp, Homo sapiens
cagggagcactgga

SEQ ID NO: 4292391 - DNA, 17 bp, Homo sapiens
cagggagcactggaggc

SEQ ID NO: 4292392 - DNA, 12 bp, Homo sapiens
cagggagccctg

SEQ ID NO: 4292393 - DNA, 22 bp, Homo sapiens
cagggagccctggggtttccac

SEQ ID NO: 4292394 - DNA, 18 bp, Homo sapiens
cagggagggaaacccggg

SEQ ID NO: 4292395 - DNA, 12 bp, Homo sapiens
cagggagggaac

SEQ ID NO: 4292396 - DNA, 19 bp, Homo sapiens
cagggatgctatctcgcta

SEQ ID NO: 4292397 - DNA, 18 bp, Homo sapiens
cagggcagcctgtgggag

SEQ ID NO: 4292398 - DNA, 19 bp, Homo sapiens
cagggcagcctgtgggaga

SEQ ID NO: 4292399 - DNA, 22 bp, Homo sapiens
cagggcagcctgtgggagaagg

SEQ ID NO: 4292400 - DNA, 15 bp, Homo sapiens
cagggcatctccagg

SEQ ID NO: 4292401 - DNA, 16 bp, Homo sapiens
cagggcatctccagga

SEQ ID NO: 4292402 - DNA, 17 bp, Homo sapiens
cagggcatctccaggaa

SEQ ID NO: 4292403 - DNA, 18 bp, Homo sapiens
cagggcatctccaggaag

SEQ ID NO: 4292404 - DNA, 21 bp, Homo sapiens
cagggcatctccaggaaggcg

SEQ ID NO: 4292405 - DNA, 20 bp, Homo sapiens
cagggcatggccaggtggcc

SEQ ID NO: 4292406 - DNA, 12 bp, Homo sapiens
cagggccagggt

SEQ ID NO: 4292407 - DNA, 17 bp, Homo sapiens
cagggcccccacaggag

SEQ ID NO: 4292408 - DNA, 18 bp, Homo sapiens
cagggcccccacaggagc

SEQ ID NO: 4292409 - DNA, 15 bp, Homo sapiens
cagggcccctgaagt

SEQ ID NO: 4292410 - DNA, 19 bp, Homo sapiens
cagggcccctgaagtgacc

SEQ ID NO: 4292411 - DNA, 22 bp, Homo sapiens
cagggcccctgaagtgacccca

SEQ ID NO: 4292412 - DNA, 12 bp, Homo sapiens
cagggccctgct

SEQ ID NO: 4292413 - DNA, 13 bp, Homo sapiens
cagggccctgctc

SEQ ID NO: 4292414 - DNA, 16 bp, Homo sapiens
cagggcgggccaggag

SEQ ID NO: 4292415 - DNA, 17 bp, Homo sapiens
cagggcgggccaggaga

SEQ ID NO: 4292416 - DNA, 15 bp, Homo sapiens
cagggcggggctggc

SEQ ID NO: 4292417 - DNA, 17 bp, Homo sapiens
cagggcggggctggcca

SEQ ID NO: 4292418 - DNA, 22 bp, Homo sapiens
cagggctccacgggggcctagt

SEQ ID NO: 4292419 - DNA, 16 bp, Homo sapiens
cagggctctggcaggt

SEQ ID NO: 4292420 - DNA, 16 bp, Homo sapiens
caggggagacttaggc

SEQ ID NO: 4292421 - DNA, 19 bp, Homo sapiens
caggggagacttaggccag

SEQ ID NO: 4292422 - DNA, 17 bp, Homo sapiens
caggggcactgtgttct

SEQ ID NO: 4292423 - DNA, 19 bp, Homo sapiens
caggggccgcttcgccatg

SEQ ID NO: 4292424 - DNA, 23 bp, Homo sapiens
caggggctgcatcctcagcccca

SEQ ID NO: 4292425 - DNA, 17 bp, Homo sapiens
caggggctgggcagagg

SEQ ID NO: 4292426 - DNA, 20 bp, Homo sapiens
caggggctgggcagagggga

SEQ ID NO: 4292427 - DNA, 15 bp, Homo sapiens
cagggggaagcacca

SEQ ID NO: 4292428 - DNA, 22 bp, Homo sapiens
caggggggttgggttccagaca

SEQ ID NO: 4292429 - DNA, 13 bp, Homo sapiens
caggggtgagccc

SEQ ID NO: 4292430 - DNA, 18 bp, Homo sapiens
cagggtagggggcctgag

SEQ ID NO: 4292431 - DNA, 19 bp, Homo sapiens
cagggtcctgggggctgct

SEQ ID NO: 4292432 - DNA, 15 bp, Homo sapiens
cagggtctcgtcagg

SEQ ID NO: 4292433 - DNA, 16 bp, Homo sapiens
cagggtctcgtcagga

SEQ ID NO: 4292434 - DNA, 18 bp, Homo sapiens
cagggtctttgtgtgctg

SEQ ID NO: 4292435 - DNA, 18 bp, Homo sapiens
cagggtgctccctcctca

SEQ ID NO: 4292436 - DNA, 13 bp, Homo sapiens
cagggtggggctt

SEQ ID NO: 4292437 - DNA, 21 bp, Homo sapiens
cagggtggtcttcaagcctgg

SEQ ID NO: 4292438 - DNA, 14 bp, Homo sapiens
cagggttccagaca

SEQ ID NO: 4292439 - DNA, 18 bp, Homo sapiens
cagggttccagacagggt

SEQ ID NO: 4292440 - DNA, 20 bp, Homo sapiens
cagggttccagacagggtgg

SEQ ID NO: 4292441 - DNA, 22 bp, Homo sapiens
cagggttcccccagccctgtgg

SEQ ID NO: 4292442 - DNA, 15 bp, Homo sapiens
cagggtttaacaata

SEQ ID NO: 4292443 - DNA, 14 bp, Homo sapiens
caggtaggaggcaa

SEQ ID NO: 4292444 - DNA, 23 bp, Homo sapiens
caggtaggaggcaaatatcttga

SEQ ID NO: 4292445 - DNA, 19 bp, Homo sapiens
caggtctcctgggcatctg

SEQ ID NO: 4292446 - DNA, 13 bp, Homo sapiens
caggtgagccaag

SEQ ID NO: 4292447 - DNA, 16 bp, Homo sapiens
caggtgcgtgccacat

SEQ ID NO: 4292448 - DNA, 18 bp, Homo sapiens
caggtggaggcgagccag

SEQ ID NO: 4292449 - DNA, 16 bp, Homo sapiens
caggtggccactccag

SEQ ID NO: 4292450 - DNA, 21 bp, Homo sapiens
caggtggccactccagacccc

SEQ ID NO: 4292451 - DNA, 15 bp, Homo sapiens
caggtggccagggct

SEQ ID NO: 4292452 - DNA, 15 bp, Homo sapiens
caggtggggaggggg

SEQ ID NO: 4292453 - DNA, 21 bp, Homo sapiens
caggtgtcctgactgtcctac

SEQ ID NO: 4292454 - DNA, 14 bp, Homo sapiens
caggtgtgggctcc

SEQ ID NO: 4292455 - DNA, 15 bp, Homo sapiens
caggtgtgggctccc

SEQ ID NO: 4292456 - DNA, 20 bp, Homo sapiens
caggtgtgggctcccacgcc

SEQ ID NO: 4292457 - DNA, 21 bp, Homo sapiens
caggtgtgggctcccacgccc

SEQ ID NO: 4292458 - DNA, 14 bp, Homo sapiens
caggttctctcctg

SEQ ID NO: 4292459 - DNA, 17 bp, Homo sapiens
cagtacttgctcaataa

SEQ ID NO: 4292460 - DNA, 21 bp, Homo sapiens
cagtacttgtgaaacacagct

SEQ ID NO: 4292461 - DNA, 23 bp, Homo sapiens
cagtacttgtgaaacacagctgt

SEQ ID NO: 4292462 - DNA, 20 bp, Homo sapiens
cagtagctacggttccctgc

SEQ ID NO: 4292463 - DNA, 13 bp, Homo sapiens
cagtagctgtggg

SEQ ID NO: 4292464 - DNA, 21 bp, Homo sapiens
cagtagctgtggggagctggt

SEQ ID NO: 4292465 - DNA, 23 bp, Homo sapiens
cagtagctgtggggagctggtgg

SEQ ID NO: 4292466 - DNA, 15 bp, Homo sapiens
cagtagtgcctgtga

SEQ ID NO: 4292467 - DNA, 16 bp, Homo sapiens
cagtcacccctgtctg

SEQ ID NO: 4292468 - DNA, 19 bp, Homo sapiens
cagtcagcacagagagcgg

SEQ ID NO: 4292469 - DNA, 23 bp, Homo sapiens
cagtcagggcggggctggccagc

SEQ ID NO: 4292470 - DNA, 20 bp, Homo sapiens
cagtcatggctgtcccctgc

SEQ ID NO: 4292471 - DNA, 15 bp, Homo sapiens
cagtccctccctcct

SEQ ID NO: 4292472 - DNA, 16 bp, Homo sapiens
cagtccctccctcctg

SEQ ID NO: 4292473 - DNA, 18 bp, Homo sapiens
cagtccctccctcctggc

SEQ ID NO: 4292474 - DNA, 20 bp, Homo sapiens
cagtccctccctcctggctc

SEQ ID NO: 4292475 - DNA, 14 bp, Homo sapiens
cagtccctctgagt

SEQ ID NO: 4292476 - DNA, 19 bp, Homo sapiens
cagtccttccacacttcca

SEQ ID NO: 4292477 - DNA, 22 bp, Homo sapiens
cagtctcattacagatttagtt

SEQ ID NO: 4292478 - DNA, 12 bp, Homo sapiens
cagtctgctgcc

SEQ ID NO: 4292479 - DNA, 21 bp, Homo sapiens
cagtctgctgccctccatccc

SEQ ID NO: 4292480 - DNA, 22 bp, Homo sapiens
cagtctgctgccctccatcccg

SEQ ID NO: 4292481 - DNA, 14 bp, Homo sapiens
cagtgaaaaactat

SEQ ID NO: 4292482 - DNA, 22 bp, Homo sapiens
cagtgaagcccaggaggacctg

SEQ ID NO: 4292483 - DNA, 19 bp, Homo sapiens
cagtgaccctggagctagg

SEQ ID NO: 4292484 - DNA, 14 bp, Homo sapiens
cagtgactccagga

SEQ ID NO: 4292485 - DNA, 15 bp, Homo sapiens
cagtgactccaggag

SEQ ID NO: 4292486 - DNA, 21 bp, Homo sapiens
cagtgactccaggagaggagc

SEQ ID NO: 4292487 - DNA, 17 bp, Homo sapiens
cagtgactgctgcgctg

SEQ ID NO: 4292488 - DNA, 15 bp, Homo sapiens
cagtgagagtgaggc

SEQ ID NO: 4292489 - DNA, 16 bp, Homo sapiens
cagtgaggcccaggga

SEQ ID NO: 4292490 - DNA, 14 bp, Homo sapiens
cagtgatgggagta

SEQ ID NO: 4292491 - DNA, 21 bp, Homo sapiens
cagtgatgggagtaagagcaa

SEQ ID NO: 4292492 - DNA, 22 bp, Homo sapiens
cagtgcagccccctcctgaccc

SEQ ID NO: 4292493 - DNA, 18 bp, Homo sapiens
cagtgccaggaaccctta

SEQ ID NO: 4292494 - DNA, 16 bp, Homo sapiens
cagtgcttagcaaaaa

SEQ ID NO: 4292495 - DNA, 21 bp, Homo sapiens
cagtggactttccaccccctc

SEQ ID NO: 4292496 - DNA, 13 bp, Homo sapiens
cagtggagagggg

SEQ ID NO: 4292497 - DNA, 14 bp, Homo sapiens
cagtggagagggga

SEQ ID NO: 4292498 - DNA, 17 bp, Homo sapiens
cagtggagaggggactt

SEQ ID NO: 4292499 - DNA, 21 bp, Homo sapiens
cagtggagaggggacttggat

SEQ ID NO: 4292500 - DNA, 13 bp, Homo sapiens
cagtggagggaga

SEQ ID NO: 4292501 - DNA, 20 bp, Homo sapiens
cagtggagggagactgaccc

SEQ ID NO: 4292502 - DNA, 22 bp, Homo sapiens
cagtggcagcaacaaaggattt

SEQ ID NO: 4292503 - DNA, 17 bp, Homo sapiens
cagtggcatggctccag

SEQ ID NO: 4292504 - DNA, 23 bp, Homo sapiens
cagtggcccagggaatcagggag

SEQ ID NO: 4292505 - DNA, 22 bp, Homo sapiens
cagtggcctacaaatcagtaat

SEQ ID NO: 4292506 - DNA, 21 bp, Homo sapiens
cagtggcctcaaccctccctc

SEQ ID NO: 4292507 - DNA, 17 bp, Homo sapiens
cagtggcttggagcaga

SEQ ID NO: 4292508 - DNA, 16 bp, Homo sapiens
cagtgggccctggctc

SEQ ID NO: 4292509 - DNA, 20 bp, Homo sapiens
cagtgggccctggctctgtc

SEQ ID NO: 4292510 - DNA, 17 bp, Homo sapiens
cagtgggctatgccact

SEQ ID NO: 4292511 - DNA, 16 bp, Homo sapiens
cagtgtagattttata

SEQ ID NO: 4292512 - DNA, 14 bp, Homo sapiens
cagtgtccccaggg

SEQ ID NO: 4292513 - DNA, 15 bp, Homo sapiens
cagtgtgagggtgca

SEQ ID NO: 4292514 - DNA, 19 bp, Homo sapiens
cagtgtgagggtgcaggga

SEQ ID NO: 4292515 - DNA, 11 bp, Homo sapiens
cagtgtgccac

SEQ ID NO: 4292516 - DNA, 14 bp, Homo sapiens
cagtgtgccaccct

SEQ ID NO: 4292517 - DNA, 21 bp, Homo sapiens
cagtgtgggaatgcggcaaga

SEQ ID NO: 4292518 - DNA, 23 bp, Homo sapiens
cagtgtgggaatgcggcaagaag

SEQ ID NO: 4292519 - DNA, 21 bp, Homo sapiens
cagtgttcccttctggctgtc

SEQ ID NO: 4292520 - DNA, 23 bp, Homo sapiens
cagtgtttatgtgctattaatat

SEQ ID NO: 4292521 - DNA, 14 bp, Homo sapiens
cagtgtttccagtg

SEQ ID NO: 4292522 - DNA, 15 bp, Homo sapiens
cagtgtttccagtga

SEQ ID NO: 4292523 - DNA, 12 bp, Homo sapiens
cagtgttttctt

SEQ ID NO: 4292524 - DNA, 16 bp, Homo sapiens
cagtgttttcttgtgt

SEQ ID NO: 4292525 - DNA, 14 bp, Homo sapiens
cagttattaaatga

SEQ ID NO: 4292526 - DNA, 21 bp, Homo sapiens
cagttcaatcaaactttcagc

SEQ ID NO: 4292527 - DNA, 16 bp, Homo sapiens
cagttccaatgtgccc

SEQ ID NO: 4292528 - DNA, 16 bp, Homo sapiens
cagttcctgcagcaga

SEQ ID NO: 4292529 - DNA, 19 bp, Homo sapiens
cagttctcccttcaactgt

SEQ ID NO: 4292530 - DNA, 13 bp, Homo sapiens
cagttctggagga

SEQ ID NO: 4292531 - DNA, 17 bp, Homo sapiens
cagttctggaggaggag

SEQ ID NO: 4292532 - DNA, 17 bp, Homo sapiens
cagttgcacagcatctc

SEQ ID NO: 4292533 - DNA, 22 bp, Homo sapiens
cagttgcacagcatctcagctc

SEQ ID NO: 4292534 - DNA, 23 bp, Homo sapiens
cagttggcctcagcagaaggcct

SEQ ID NO: 4292535 - DNA, 21 bp, Homo sapiens
cagttggttttgcatgtctgc

SEQ ID NO: 4292536 - DNA, 22 bp, Homo sapiens
cagttgtaacattctatttcaa

SEQ ID NO: 4292537 - DNA, 17 bp, Homo sapiens
cagtttgtccacacaag

SEQ ID NO: 4292538 - DNA, 22 bp, Homo sapiens
cagtttgtccacacaagacagc

SEQ ID NO: 4292539 - DNA, 13 bp, Homo sapiens
cagtttgtgcaag

SEQ ID NO: 4292540 - DNA, 21 bp, Homo sapiens
cataaaaggtgacccttctgt

SEQ ID NO: 4292541 - DNA, 21 bp, Homo sapiens
cataaattatttctaaaacat

SEQ ID NO: 4292542 - DNA, 17 bp, Homo sapiens
cataactaatacagctg

SEQ ID NO: 4292543 - DNA, 18 bp, Homo sapiens
cataagcctcaggcctgg

SEQ ID NO: 4292544 - DNA, 16 bp, Homo sapiens
cataagctttttctct

SEQ ID NO: 4292545 - DNA, 19 bp, Homo sapiens
cataattagatccattaat

SEQ ID NO: 4292546 - DNA, 19 bp, Homo sapiens
cataattgcaagggaagag

SEQ ID NO: 4292547 - DNA, 17 bp, Homo sapiens
cataccccctgccccag

SEQ ID NO: 4292548 - DNA, 19 bp, Homo sapiens
cataccccctgccccagag

SEQ ID NO: 4292549 - DNA, 21 bp, Homo sapiens
cataccccctgccccagagaa

SEQ ID NO: 4292550 - DNA, 15 bp, Homo sapiens
catacctctctctat

SEQ ID NO: 4292551 - DNA, 12 bp, Homo sapiens
catactctccag

SEQ ID NO: 4292552 - DNA, 14 bp, Homo sapiens
catactctccagga

SEQ ID NO: 4292553 - DNA, 14 bp, Homo sapiens
catactctgtgtaa

SEQ ID NO: 4292554 - DNA, 23 bp, Homo sapiens
catactctgtgtaatctctgatt

SEQ ID NO: 4292555 - DNA, 15 bp, Homo sapiens
catacttcctggatt

SEQ ID NO: 4292556 - DNA, 19 bp, Homo sapiens
catactttgttaggaaggg

SEQ ID NO: 4292557 - DNA, 21 bp, Homo sapiens
catagaactgtcccacaaaat

SEQ ID NO: 4292558 - DNA, 20 bp, Homo sapiens
catagatgcctgggcctgat

SEQ ID NO: 4292559 - DNA, 21 bp, Homo sapiens
catagatgcctgggcctgatg

SEQ ID NO: 4292560 - DNA, 13 bp, Homo sapiens
cataggcagagcc

SEQ ID NO: 4292561 - DNA, 16 bp, Homo sapiens
catagtctttgtttac

SEQ ID NO: 4292562 - DNA, 18 bp, Homo sapiens
catagtgatggttcccct

SEQ ID NO: 4292563 - DNA, 21 bp, Homo sapiens
catagtttgaattcatgcctc

SEQ ID NO: 4292564 - DNA, 21 bp, Homo sapiens
catatattataagatttttag

SEQ ID NO: 4292565 - DNA, 21 bp, Homo sapiens
catatattgttatttttgtct

SEQ ID NO: 4292566 - DNA, 15 bp, Homo sapiens
catatcatttcttaa

SEQ ID NO: 4292567 - DNA, 17 bp, Homo sapiens
catatgacaatttcaaa

SEQ ID NO: 4292568 - DNA, 14 bp, Homo sapiens
catatgattgaaaa

SEQ ID NO: 4292569 - DNA, 19 bp, Homo sapiens
catatgattgaaaagaaga

SEQ ID NO: 4292570 - DNA, 16 bp, Homo sapiens
catattatatcagact

SEQ ID NO: 4292571 - DNA, 23 bp, Homo sapiens
catattatatcagactgctttga

SEQ ID NO: 4292572 - DNA, 23 bp, Homo sapiens
catattcttgctttcacaaatat

SEQ ID NO: 4292573 - DNA, 13 bp, Homo sapiens
catattgactttt

SEQ ID NO: 4292574 - DNA, 14 bp, Homo sapiens
catcaaagtgttta

SEQ ID NO: 4292575 - DNA, 15 bp, Homo sapiens
catcaaagtgtttaa

SEQ ID NO: 4292576 - DNA, 16 bp, Homo sapiens
catcaaagtgtttaat

SEQ ID NO: 4292577 - DNA, 17 bp, Homo sapiens
catcaacctaggagcag

SEQ ID NO: 4292578 - DNA, 22 bp, Homo sapiens
catcaacctaggagcagtgggc

SEQ ID NO: 4292579 - DNA, 14 bp, Homo sapiens
catcatgtctattg

SEQ ID NO: 4292580 - DNA, 22 bp, Homo sapiens
catccatgcggccggcctgggg

SEQ ID NO: 4292581 - DNA, 21 bp, Homo sapiens
catccattccagagctgcaga

SEQ ID NO: 4292582 - DNA, 23 bp, Homo sapiens
catcccagtggcctcaaccctcc

SEQ ID NO: 4292583 - DNA, 12 bp, Homo sapiens
catccccagccc

SEQ ID NO: 4292584 - DNA, 15 bp, Homo sapiens
catccccagccccct

SEQ ID NO: 4292585 - DNA, 13 bp, Homo sapiens
catccccctcctt

SEQ ID NO: 4292586 - DNA, 16 bp, Homo sapiens
catccctccaccccag

SEQ ID NO: 4292587 - DNA, 23 bp, Homo sapiens
catccctggtgaaagagtaaaac

SEQ ID NO: 4292588 - DNA, 15 bp, Homo sapiens
catcccttggcccct

SEQ ID NO: 4292589 - DNA, 20 bp, Homo sapiens
catcccttggcccctctctg

SEQ ID NO: 4292590 - DNA, 22 bp, Homo sapiens
catccgtaccatcggtcagcag

SEQ ID NO: 4292591 - DNA, 23 bp, Homo sapiens
catcctcagccccagggccctgc

SEQ ID NO: 4292592 - DNA, 14 bp, Homo sapiens
catcctccccttcc

SEQ ID NO: 4292593 - DNA, 16 bp, Homo sapiens
catcctccccttccct

SEQ ID NO: 4292594 - DNA, 20 bp, Homo sapiens
catcctccccttccctgcaa

SEQ ID NO: 4292595 - DNA, 21 bp, Homo sapiens
catcctccccttccctgcaaa

SEQ ID NO: 4292596 - DNA, 20 bp, Homo sapiens
catcctgattattgaatgtt

SEQ ID NO: 4292597 - DNA, 17 bp, Homo sapiens
catcgtggtatgtgaat

SEQ ID NO: 4292598 - DNA, 23 bp, Homo sapiens
catcgttgcaaccactgcaatat

SEQ ID NO: 4292599 - DNA, 21 bp, Homo sapiens
catctagaggcttccttcatt

SEQ ID NO: 4292600 - DNA, 17 bp, Homo sapiens
catctattcccaaagaa

SEQ ID NO: 4292601 - DNA, 18 bp, Homo sapiens
catctattcccaaagaac

SEQ ID NO: 4292602 - DNA, 21 bp, Homo sapiens
catctcagctcatcttcactg

SEQ ID NO: 4292603 - DNA, 21 bp, Homo sapiens
catctcaggccacctgccccc

SEQ ID NO: 4292604 - DNA, 18 bp, Homo sapiens
catctcatcatgtctatt

SEQ ID NO: 4292605 - DNA, 13 bp, Homo sapiens
catctctggagtg

SEQ ID NO: 4292606 - DNA, 12 bp, Homo sapiens
catctctttcat

SEQ ID NO: 4292607 - DNA, 13 bp, Homo sapiens
catctgaaaagaa

SEQ ID NO: 4292608 - DNA, 14 bp, Homo sapiens
catctgaaaagaaa

SEQ ID NO: 4292609 - DNA, 19 bp, Homo sapiens
catctgctgagctctgacc

SEQ ID NO: 4292610 - DNA, 13 bp, Homo sapiens
catctggccctgc

SEQ ID NO: 4292611 - DNA, 16 bp, Homo sapiens
catctggccctgctgc

SEQ ID NO: 4292612 - DNA, 19 bp, Homo sapiens
catctggccctgctgcccc

SEQ ID NO: 4292613 - DNA, 20 bp, Homo sapiens
catctggccctgctgccccc

SEQ ID NO: 4292614 - DNA, 13 bp, Homo sapiens
catctgtctgtcc

SEQ ID NO: 4292615 - DNA, 18 bp, Homo sapiens
catctgtctgtcctaccc

SEQ ID NO: 4292616 - DNA, 20 bp, Homo sapiens
catgaaggtctacctgaaaa

SEQ ID NO: 4292617 - DNA, 16 bp, Homo sapiens
catgacaagccccagg

SEQ ID NO: 4292618 - DNA, 14 bp, Homo sapiens
catgacatttctca

SEQ ID NO: 4292619 - DNA, 15 bp, Homo sapiens
catgacatttctcaa

SEQ ID NO: 4292620 - DNA, 16 bp, Homo sapiens
catgacatttctcaaa

SEQ ID NO: 4292621 - DNA, 22 bp, Homo sapiens
catgacatttctcaaagttttt

SEQ ID NO: 4292622 - DNA, 19 bp, Homo sapiens
catgactagggtcctcagg

SEQ ID NO: 4292623 - DNA, 18 bp, Homo sapiens
catgactctttattgtct

SEQ ID NO: 4292624 - DNA, 19 bp, Homo sapiens
catgactctttattgtctg

SEQ ID NO: 4292625 - DNA, 13 bp, Homo sapiens
catgagctccaga

SEQ ID NO: 4292626 - DNA, 17 bp, Homo sapiens
catgagtcccagtggga

SEQ ID NO: 4292627 - DNA, 14 bp, Homo sapiens
catgatataacttt

SEQ ID NO: 4292628 - DNA, 18 bp, Homo sapiens
catgatataactttagaa

SEQ ID NO: 4292629 - DNA, 13 bp, Homo sapiens
catgatattgtat

SEQ ID NO: 4292630 - DNA, 12 bp, Homo sapiens
catgatggagtc

SEQ ID NO: 4292631 - DNA, 17 bp, Homo sapiens
catgatttcaatgattg

SEQ ID NO: 4292632 - DNA, 13 bp, Homo sapiens
catgatttgcaac

SEQ ID NO: 4292633 - DNA, 21 bp, Homo sapiens
catgatttgcaactttagaaa

SEQ ID NO: 4292634 - DNA, 16 bp, Homo sapiens
catgcagatctagcca

SEQ ID NO: 4292635 - DNA, 18 bp, Homo sapiens
catgcagatctagccagg

SEQ ID NO: 4292636 - DNA, 20 bp, Homo sapiens
catgcagatctagccaggcc

SEQ ID NO: 4292637 - DNA, 22 bp, Homo sapiens
catgcagatctagccaggcctc

SEQ ID NO: 4292638 - DNA, 22 bp, Homo sapiens
catgcagggcccccacaggagc

SEQ ID NO: 4292639 - DNA, 19 bp, Homo sapiens
catgcagggcccccatgca

SEQ ID NO: 4292640 - DNA, 18 bp, Homo sapiens
catgcatggcctcccagc

SEQ ID NO: 4292641 - DNA, 20 bp, Homo sapiens
catgcatggcctcccagcca

SEQ ID NO: 4292642 - DNA, 15 bp, Homo sapiens
catgcattactgcat

SEQ ID NO: 4292643 - DNA, 14 bp, Homo sapiens
catgccccactctg

SEQ ID NO: 4292644 - DNA, 17 bp, Homo sapiens
catgccccactctgctg

SEQ ID NO: 4292645 - DNA, 20 bp, Homo sapiens
catgccccactctgctgagg

SEQ ID NO: 4292646 - DNA, 12 bp, Homo sapiens
catgccctcagg

SEQ ID NO: 4292647 - DNA, 21 bp, Homo sapiens
catgccctccctgctgccagg

SEQ ID NO: 4292648 - DNA, 18 bp, Homo sapiens
catgccgagtgccccaga

SEQ ID NO: 4292649 - DNA, 22 bp, Homo sapiens
catgccgagtgccccagaaatg

SEQ ID NO: 4292650 - DNA, 11 bp, Homo sapiens
catgcctgggg

SEQ ID NO: 4292651 - DNA, 18 bp, Homo sapiens
catgcggccggcctgggg

SEQ ID NO: 4292652 - DNA, 21 bp, Homo sapiens
catgcggccggcctggggccg

SEQ ID NO: 4292653 - DNA, 23 bp, Homo sapiens
catgcggctgcccacgctcctgc

SEQ ID NO: 4292654 - DNA, 19 bp, Homo sapiens
catgctcccaaatgcagct

SEQ ID NO: 4292655 - DNA, 14 bp, Homo sapiens
catgctcctctgcc

SEQ ID NO: 4292656 - DNA, 15 bp, Homo sapiens
catgctcctctgcct

SEQ ID NO: 4292657 - DNA, 18 bp, Homo sapiens
catgctcctctgcctgtg

SEQ ID NO: 4292658 - DNA, 22 bp, Homo sapiens
catgctcctctgcctgtgcccg

SEQ ID NO: 4292659 - DNA, 22 bp, Homo sapiens
catgctccttaatggcgccatg

SEQ ID NO: 4292660 - DNA, 15 bp, Homo sapiens
catgctgcccacccc

SEQ ID NO: 4292661 - DNA, 20 bp, Homo sapiens
catgctgcctgcctccggcc

SEQ ID NO: 4292662 - DNA, 15 bp, Homo sapiens
catggaaaaatgcca

SEQ ID NO: 4292663 - DNA, 16 bp, Homo sapiens
catggaaaaatgccat

SEQ ID NO: 4292664 - DNA, 16 bp, Homo sapiens
catggaagctggcagg

SEQ ID NO: 4292665 - DNA, 12 bp, Homo sapiens
catggacagggc

SEQ ID NO: 4292666 - DNA, 14 bp, Homo sapiens
catggacagggcca

SEQ ID NO: 4292667 - DNA, 19 bp, Homo sapiens
catggacagggccagggtt

SEQ ID NO: 4292668 - DNA, 15 bp, Homo sapiens
catggacccggagct

SEQ ID NO: 4292669 - DNA, 21 bp, Homo sapiens
catggactctacactgtgaac

SEQ ID NO: 4292670 - DNA, 15 bp, Homo sapiens
catggcctcccagcc

SEQ ID NO: 4292671 - DNA, 20 bp, Homo sapiens
catggcctcccagccacccg

SEQ ID NO: 4292672 - DNA, 14 bp, Homo sapiens
catggctccagtct

SEQ ID NO: 4292673 - DNA, 17 bp, Homo sapiens
catggctgtcccctgca

SEQ ID NO: 4292674 - DNA, 18 bp, Homo sapiens
catggctgtcccctgcaa

SEQ ID NO: 4292675 - DNA, 21 bp, Homo sapiens
catggctgtcccctgcaagtg

SEQ ID NO: 4292676 - DNA, 17 bp, Homo sapiens
catgggagtcagggagc

SEQ ID NO: 4292677 - DNA, 19 bp, Homo sapiens
catgggagtcagggagccc

SEQ ID NO: 4292678 - DNA, 13 bp, Homo sapiens
ttttacagtgtat

SEQ ID NO: 4292679 - DNA, 21 bp, Homo sapiens
ttttaccttcagtaaacacca

SEQ ID NO: 4292680 - DNA, 23 bp, Homo sapiens
ttttagagattaatttgtgtaga

SEQ ID NO: 4292681 - DNA, 23 bp, Homo sapiens
ttttagcaaagatatctcatctc

SEQ ID NO: 4292682 - DNA, 20 bp, Homo sapiens
ttttaggtcatccaacctct

SEQ ID NO: 4292683 - DNA, 19 bp, Homo sapiens
ttttagtgttttgcaaggg

SEQ ID NO: 4292684 - DNA, 18 bp, Homo sapiens
ttttagttcctgtgcaca

SEQ ID NO: 4292685 - DNA, 15 bp, Homo sapiens
ttttatatctgtaaa

SEQ ID NO: 4292686 - DNA, 22 bp, Homo sapiens
ttttatcttggtagtacatttt

SEQ ID NO: 4292687 - DNA, 15 bp, Homo sapiens
ttttatgtgcttgaa

SEQ ID NO: 4292688 - DNA, 16 bp, Homo sapiens
ttttattgaaaatgtg

SEQ ID NO: 4292689 - DNA, 13 bp, Homo sapiens
ttttattgctgga

SEQ ID NO: 4292690 - DNA, 18 bp, Homo sapiens
ttttattttcaagcaaat

SEQ ID NO: 4292691 - DNA, 10 bp, Homo sapiens
ttttcaaaat

SEQ ID NO: 4292692 - DNA, 12 bp, Homo sapiens
ttttcagaaaga

SEQ ID NO: 4292693 - DNA, 12 bp, Homo sapiens
ttttcagattgt

SEQ ID NO: 4292694 - DNA, 16 bp, Homo sapiens
ttttccatctaaaata

SEQ ID NO: 4292695 - DNA, 18 bp, Homo sapiens
ttttccatctaaaatact

SEQ ID NO: 4292696 - DNA, 14 bp, Homo sapiens
ttttccattctggg

SEQ ID NO: 4292697 - DNA, 16 bp, Homo sapiens
ttttcccacaattctt

SEQ ID NO: 4292698 - DNA, 17 bp, Homo sapiens
ttttcccacctctttgg

SEQ ID NO: 4292699 - DNA, 19 bp, Homo sapiens
ttttccccaattatcctcc

SEQ ID NO: 4292700 - DNA, 17 bp, Homo sapiens
ttttcctttgaatcctc

SEQ ID NO: 4292701 - DNA, 19 bp, Homo sapiens
ttttcgaagctcagcccac

SEQ ID NO: 4292702 - DNA, 15 bp, Homo sapiens
ttttcgtgcatttgt

SEQ ID NO: 4292703 - DNA, 16 bp, Homo sapiens
ttttcgtgcatttgtg

SEQ ID NO: 4292704 - DNA, 23 bp, Homo sapiens
ttttctaaactgttttcatgtgt

SEQ ID NO: 4292705 - DNA, 16 bp, Homo sapiens
ttttctaaatgtttct

SEQ ID NO: 4292706 - DNA, 14 bp, Homo sapiens
ttttctctgatcac

SEQ ID NO: 4292707 - DNA, 21 bp, Homo sapiens
ttttctgaattcataaaaata

SEQ ID NO: 4292708 - DNA, 15 bp, Homo sapiens
ttttcttcccatttg

SEQ ID NO: 4292709 - DNA, 22 bp, Homo sapiens
ttttcttcccatttgtaatgta

SEQ ID NO: 4292710 - DNA, 19 bp, Homo sapiens
ttttcttgtatctggattc

SEQ ID NO: 4292711 - DNA, 13 bp, Homo sapiens
ttttctttctatg

SEQ ID NO: 4292712 - DNA, 15 bp, Homo sapiens
ttttctttctatgta

SEQ ID NO: 4292713 - DNA, 18 bp, Homo sapiens
ttttctttctatgtagaa

SEQ ID NO: 4292714 - DNA, 18 bp, Homo sapiens
ttttcttttttgagtgtg

SEQ ID NO: 4292715 - DNA, 18 bp, Homo sapiens
ttttgaagaagggaaatt

SEQ ID NO: 4292716 - DNA, 22 bp, Homo sapiens
ttttgaagaagggaaattcaca

SEQ ID NO: 4292717 - DNA, 16 bp, Homo sapiens
ttttgacactgaaata

SEQ ID NO: 4292718 - DNA, 13 bp, Homo sapiens
ttttgagtgtgca

SEQ ID NO: 4292719 - DNA, 19 bp, Homo sapiens
ttttggcccccgagctggg

SEQ ID NO: 4292720 - DNA, 23 bp, Homo sapiens
ttttgtaaccatatgattgaaaa

SEQ ID NO: 4292721 - DNA, 21 bp, Homo sapiens
ttttgtagtagttgatgacca

SEQ ID NO: 4292722 - DNA, 13 bp, Homo sapiens
ttttgtatcctcc

SEQ ID NO: 4292723 - DNA, 22 bp, Homo sapiens
ttttgtatctttaaagacttga

SEQ ID NO: 4292724 - DNA, 22 bp, Homo sapiens
ttttgtggcttcaatctacgat

SEQ ID NO: 4292725 - DNA, 16 bp, Homo sapiens
ttttgtgtattctgtg

SEQ ID NO: 4292726 - DNA, 16 bp, Homo sapiens
tttttaaatgattcca

SEQ ID NO: 4292727 - DNA, 14 bp, Homo sapiens
tttttaatttatga

SEQ ID NO: 4292728 - DNA, 12 bp, Homo sapiens
tttttacagtgt

SEQ ID NO: 4292729 - DNA, 19 bp, Homo sapiens
tttttagagattaatttgt

SEQ ID NO: 4292730 - DNA, 15 bp, Homo sapiens
tttttctatattatt

SEQ ID NO: 4292731 - DNA, 23 bp, Homo sapiens
ttttttaaatgattccaaataaa

SEQ ID NO: 4292732 - DNA, 17 bp, Homo sapiens
ttttttacaaattatgt

SEQ ID NO: 4292733 - DNA, 13 bp, Homo sapiens
ttttttccactta

SEQ ID NO: 4292734 - DNA, 13 bp, Homo sapiens
ttttttttcctgt

SEQ ID NO: 4292735 - DNA, 12 bp, Homo sapiens
ctgagcttggcc

SEQ ID NO: 4292736 - DNA, 15 bp, Homo sapiens
ctgagcttggccaga

SEQ ID NO: 4292737 - DNA, 18 bp, Homo sapiens
ctgagcttggccagaagg

SEQ ID NO: 4292738 - DNA, 19 bp, Homo sapiens
ctgaggagcagcccacctg

SEQ ID NO: 4292739 - DNA, 17 bp, Homo sapiens
ctgaggagctcagggct

SEQ ID NO: 4292740 - DNA, 18 bp, Homo sapiens
ctgaggccagaggaaggg

SEQ ID NO: 4292741 - DNA, 22 bp, Homo sapiens
ctgaggccagaggaagggaggc

SEQ ID NO: 4292742 - DNA, 14 bp, Homo sapiens
ctgaggctggggct

SEQ ID NO: 4292743 - DNA, 13 bp, Homo sapiens
ctgagggcagggt

SEQ ID NO: 4292744 - DNA, 21 bp, Homo sapiens
ctgagggcagggttctagaag

SEQ ID NO: 4292745 - DNA, 11 bp, Homo sapiens
ctgaggggcag

SEQ ID NO: 4292746 - DNA, 13 bp, Homo sapiens
ctgaggggcaggg

SEQ ID NO: 4292747 - DNA, 20 bp, Homo sapiens
ctgagggtttccaccttggc

SEQ ID NO: 4292748 - DNA, 18 bp, Homo sapiens
ctgaggtgggccttccat

SEQ ID NO: 4292749 - DNA, 15 bp, Homo sapiens
ctgaggttaagggga

SEQ ID NO: 4292750 - DNA, 21 bp, Homo sapiens
ctgagtccttaaacagggcat

SEQ ID NO: 4292751 - DNA, 22 bp, Homo sapiens
ctgagtccttaaacagggcatc

SEQ ID NO: 4292752 - DNA, 21 bp, Homo sapiens
ctgagtctcattcctctgtcc

SEQ ID NO: 4292753 - DNA, 23 bp, Homo sapiens
ctgagtctgtgaataaagccaca

SEQ ID NO: 4292754 - DNA, 16 bp, Homo sapiens
ctgagtgaagtccagt

SEQ ID NO: 4292755 - DNA, 23 bp, Homo sapiens
ctgagtgaagtccagtgaccctg

SEQ ID NO: 4292756 - DNA, 16 bp, Homo sapiens
ctgagttcctgcatgc

SEQ ID NO: 4292757 - DNA, 19 bp, Homo sapiens
ctgatatctgtttgcttct

SEQ ID NO: 4292758 - DNA, 20 bp, Homo sapiens
ctgatatctgtttgcttcta

SEQ ID NO: 4292759 - DNA, 17 bp, Homo sapiens
ctgatcacaacttttct

SEQ ID NO: 4292760 - DNA, 15 bp, Homo sapiens
ctgatgatggaaggg

SEQ ID NO: 4292761 - DNA, 21 bp, Homo sapiens
ctgattaaatttaatatactg

SEQ ID NO: 4292762 - DNA, 22 bp, Homo sapiens
ctgattaaatttaatatactgc

SEQ ID NO: 4292763 - DNA, 13 bp, Homo sapiens
ctgattctatgcc

SEQ ID NO: 4292764 - DNA, 23 bp, Homo sapiens
ctgattctatgcctgtatttcca

SEQ ID NO: 4292765 - DNA, 23 bp, Homo sapiens
ctgatttattttgtatgaaatat

SEQ ID NO: 4292766 - DNA, 23 bp, Homo sapiens
ctgatttgggctgaatgtatgta

SEQ ID NO: 4292767 - DNA, 15 bp, Homo sapiens
ctgcaagattctgtg

SEQ ID NO: 4292768 - DNA, 18 bp, Homo sapiens
ctgcaagattctgtgggc

SEQ ID NO: 4292769 - DNA, 20 bp, Homo sapiens
ctgcaatacattaaaataac

SEQ ID NO: 4292770 - DNA, 13 bp, Homo sapiens
ctgcaatgggaga

SEQ ID NO: 4292771 - DNA, 16 bp, Homo sapiens
ctgcacacacctgcac

SEQ ID NO: 4292772 - DNA, 18 bp, Homo sapiens
ctgcacacacctgcacac

SEQ ID NO: 4292773 - DNA, 14 bp, Homo sapiens
ctgcacacccctgc

SEQ ID NO: 4292774 - DNA, 20 bp, Homo sapiens
ctgcacaccgtccctctccc

SEQ ID NO: 4292775 - DNA, 22 bp, Homo sapiens
ctgcacagtgcatctcagccca

SEQ ID NO: 4292776 - DNA, 23 bp, Homo sapiens
ctgcacattagagggacagccaa

SEQ ID NO: 4292777 - DNA, 22 bp, Homo sapiens
ctgcaccaacctcactgccctc

SEQ ID NO: 4292778 - DNA, 15 bp, Homo sapiens
ctgcaccccacagga

SEQ ID NO: 4292779 - DNA, 16 bp, Homo sapiens
ctgcaccccacaggat

SEQ ID NO: 4292780 - DNA, 18 bp, Homo sapiens
ctgcaccccacaggatga

SEQ ID NO: 4292781 - DNA, 14 bp, Homo sapiens
ctgcacctgcaggg

SEQ ID NO: 4292782 - DNA, 17 bp, Homo sapiens
ctgcacctgcagggagc

SEQ ID NO: 4292783 - DNA, 12 bp, Homo sapiens
ctgcactgccct

SEQ ID NO: 4292784 - DNA, 14 bp, Homo sapiens
ctgcactgccctcc

SEQ ID NO: 4292785 - DNA, 15 bp, Homo sapiens
ctgcactgccctccg

SEQ ID NO: 4292786 - DNA, 15 bp, Homo sapiens
ctgcacttggcctct

SEQ ID NO: 4292787 - DNA, 14 bp, Homo sapiens
ctgcagaaccagtc

SEQ ID NO: 4292788 - DNA, 17 bp, Homo sapiens
ctgcagaaccagtccct

SEQ ID NO: 4292789 - DNA, 14 bp, Homo sapiens
ctgcagacacgcct

SEQ ID NO: 4292790 - DNA, 13 bp, Homo sapiens
ctgcagcagagcc

SEQ ID NO: 4292791 - DNA, 15 bp, Homo sapiens
ctgcagcagagcctg

SEQ ID NO: 4292792 - DNA, 17 bp, Homo sapiens
ctgcagccccaggcctc

SEQ ID NO: 4292793 - DNA, 12 bp, Homo sapiens
ctgcagggagca

SEQ ID NO: 4292794 - DNA, 15 bp, Homo sapiens
ctgcagggagcagca

SEQ ID NO: 4292795 - DNA, 17 bp, Homo sapiens
ctgcagggcagcctgtg

SEQ ID NO: 4292796 - DNA, 22 bp, Homo sapiens
ctgcagggcagcctgtgggaga

SEQ ID NO: 4292797 - DNA, 16 bp, Homo sapiens
ctgcagggtggcatct

SEQ ID NO: 4292798 - DNA, 21 bp, Homo sapiens
ctgcagtcacccctgtctgcg

SEQ ID NO: 4292799 - DNA, 18 bp, Homo sapiens
ctgcagttagcacagagg

SEQ ID NO: 4292800 - DNA, 18 bp, Homo sapiens
ctgcagttggcctcagca

SEQ ID NO: 4292801 - DNA, 20 bp, Homo sapiens
ctgcatatcctggtgtctag

SEQ ID NO: 4292802 - DNA, 14 bp, Homo sapiens
ctgcatccctccac

SEQ ID NO: 4292803 - DNA, 16 bp, Homo sapiens
ctgcatccctccaccc

SEQ ID NO: 4292804 - DNA, 18 bp, Homo sapiens
ctgcatccctccacccca

SEQ ID NO: 4292805 - DNA, 20 bp, Homo sapiens
ctgcatcccttggcccctct

SEQ ID NO: 4292806 - DNA, 21 bp, Homo sapiens
ctgcatcccttggcccctctc

SEQ ID NO: 4292807 - DNA, 22 bp, Homo sapiens
ctgcatcccttggcccctctct

SEQ ID NO: 4292808 - DNA, 23 bp, Homo sapiens
ctgcatcccttggcccctctctg

SEQ ID NO: 4292809 - DNA, 13 bp, Homo sapiens
ctgcatcctcagc

SEQ ID NO: 4292810 - DNA, 14 bp, Homo sapiens
ctgcatcctcagcc

SEQ ID NO: 4292811 - DNA, 15 bp, Homo sapiens
ctgcatcctcagccc

SEQ ID NO: 4292812 - DNA, 20 bp, Homo sapiens
ctgcatcctcagccccaggg

SEQ ID NO: 4292813 - DNA, 21 bp, Homo sapiens
ctgcatctagaggcttccttc

SEQ ID NO: 4292814 - DNA, 16 bp, Homo sapiens
ctgcatgcaagctcag

SEQ ID NO: 4292815 - DNA, 22 bp, Homo sapiens
ctgcatgctcctctgcctgtgc

SEQ ID NO: 4292816 - DNA, 17 bp, Homo sapiens
ctgccacacatgctcat

SEQ ID NO: 4292817 - DNA, 17 bp, Homo sapiens
ctgccactctcctgagg

SEQ ID NO: 4292818 - DNA, 22 bp, Homo sapiens
ctgccactctcctgaggagcag

SEQ ID NO: 4292819 - DNA, 21 bp, Homo sapiens
ctgccagaagtgtgttttggt

SEQ ID NO: 4292820 - DNA, 13 bp, Homo sapiens
ctgccagagaagc

SEQ ID NO: 4292821 - DNA, 24 bp, Homo sapiens
ctgccagaggcctggtgccctggc

SEQ ID NO: 4292822 - DNA, 18 bp, Homo sapiens
ctgccagccgctggtgcc

SEQ ID NO: 4292823 - DNA, 21 bp, Homo sapiens
ctgccagccgctggtgcccac

SEQ ID NO: 4292824 - DNA, 15 bp, Homo sapiens
ctgccatcagcccct

SEQ ID NO: 4292825 - DNA, 19 bp, Homo sapiens
ctgccatcagcccctgctg

SEQ ID NO: 4292826 - DNA, 19 bp, Homo sapiens
ctgccatgattttggccac

SEQ ID NO: 4292827 - DNA, 12 bp, Homo sapiens
ctgcccaccccc

SEQ ID NO: 4292828 - DNA, 13 bp, Homo sapiens
ctgcccaccccct

SEQ ID NO: 4292829 - DNA, 20 bp, Homo sapiens
ctgcccaccccgcctctggg

SEQ ID NO: 4292830 - DNA, 22 bp, Homo sapiens
ctgcccaccccgcctctgggct

SEQ ID NO: 4292831 - DNA, 23 bp, Homo sapiens
ctgcccaccccgcctctgggctc

SEQ ID NO: 4292832 - DNA, 21 bp, Homo sapiens
ctgccccacacaggcctggcc

SEQ ID NO: 4292833 - DNA, 12 bp, Homo sapiens
ctgccccagaga

SEQ ID NO: 4292834 - DNA, 19 bp, Homo sapiens
ctgccccaggggcactgtg

SEQ ID NO: 4292835 - DNA, 21 bp, Homo sapiens
ctgcccccaaaagtgtcaagg

SEQ ID NO: 4292836 - DNA, 17 bp, Homo sapiens
ctgcccccactcagcat

SEQ ID NO: 4292837 - DNA, 13 bp, Homo sapiens
ctgcccccagctg

SEQ ID NO: 4292838 - DNA, 20 bp, Homo sapiens
ctgccccccacattctggct

SEQ ID NO: 4292839 - DNA, 12 bp, Homo sapiens
ctgccccccttc

SEQ ID NO: 4292840 - DNA, 14 bp, Homo sapiens
ctgccccccttccc

SEQ ID NO: 4292841 - DNA, 18 bp, Homo sapiens
ctgccccctacccggctc

SEQ ID NO: 4292842 - DNA, 17 bp, Homo sapiens
ctgcccccttctcccac

SEQ ID NO: 4292843 - DNA, 18 bp, Homo sapiens
ctgcccccttctcccaca

SEQ ID NO: 4292844 - DNA, 12 bp, Homo sapiens
ctgccccgcccc

SEQ ID NO: 4292845 - DNA, 21 bp, Homo sapiens
ctgccccgccccccagagcca

SEQ ID NO: 4292846 - DNA, 22 bp, Homo sapiens
ctgccccgccccccagagccag

SEQ ID NO: 4292847 - DNA, 16 bp, Homo sapiens
ctgccccggccactct

SEQ ID NO: 4292848 - DNA, 18 bp, Homo sapiens
ctgccccgtcaccatctc

SEQ ID NO: 4292849 - DNA, 23 bp, Homo sapiens
ctgccccgtcaccatctcaggcc

SEQ ID NO: 4292850 - DNA, 17 bp, Homo sapiens
ctgcccctcccttcaac

SEQ ID NO: 4292851 - DNA, 13 bp, Homo sapiens
ctgcccctgcacc

SEQ ID NO: 4292852 - DNA, 11 bp, Homo sapiens
ctgcccctgcc

SEQ ID NO: 4292853 - DNA, 13 bp, Homo sapiens
ctgcccctgcccc

SEQ ID NO: 4292854 - DNA, 16 bp, Homo sapiens
ctgcccggggcagctg

SEQ ID NO: 4292855 - DNA, 20 bp, Homo sapiens
ctgcccggggcagctgccag

SEQ ID NO: 4292856 - DNA, 21 bp, Homo sapiens
ctgcccggggcagctgccaga

SEQ ID NO: 4292857 - DNA, 23 bp, Homo sapiens
ctgcccggggcagctgccagaga

SEQ ID NO: 4292858 - DNA, 16 bp, Homo sapiens
ctgcccgtgaggaggg

SEQ ID NO: 4292859 - DNA, 18 bp, Homo sapiens
ctgccctcactccactcc

SEQ ID NO: 4292860 - DNA, 15 bp, Homo sapiens
ctgccctccatcccg

SEQ ID NO: 4292861 - DNA, 14 bp, Homo sapiens
ctgccctccctcgg

SEQ ID NO: 4292862 - DNA, 15 bp, Homo sapiens
ctgccctgcaaaccg

SEQ ID NO: 4292863 - DNA, 18 bp, Homo sapiens
ctgccctggtgctgccac

SEQ ID NO: 4292864 - DNA, 22 bp, Homo sapiens
ctgccgaccgaggctggagctg

SEQ ID NO: 4292865 - DNA, 23 bp, Homo sapiens
ctgccgaccgaggctggagctgg

SEQ ID NO: 4292866 - DNA, 18 bp, Homo sapiens
ctgccgtgagagcccaat

SEQ ID NO: 4292867 - DNA, 19 bp, Homo sapiens
ctgccgtgcacggggccag

SEQ ID NO: 4292868 - DNA, 14 bp, Homo sapiens
ctgcctccccaacc

SEQ ID NO: 4292869 - DNA, 16 bp, Homo sapiens
ctgcctccccaaccct

SEQ ID NO: 4292870 - DNA, 18 bp, Homo sapiens
ctgcctccccaaccctgc

SEQ ID NO: 4292871 - DNA, 21 bp, Homo sapiens
ctgcctccggccctgccccac

SEQ ID NO: 4292872 - DNA, 14 bp, Homo sapiens
ctgcctctgaaaat

SEQ ID NO: 4292873 - DNA, 17 bp, Homo sapiens
ctgcctctgaaaatatt

SEQ ID NO: 4292874 - DNA, 22 bp, Homo sapiens
ctgcctctgaactgctgctggt

SEQ ID NO: 4292875 - DNA, 13 bp, Homo sapiens
ctgcctgcccacc

SEQ ID NO: 4292876 - DNA, 18 bp, Homo sapiens
ctgcctgtccctctcagg

SEQ ID NO: 4292877 - DNA, 16 bp, Homo sapiens
ctgcctgtgcccgctg

SEQ ID NO: 4292878 - DNA, 13 bp, Homo sapiens
ctgccttccaggc

SEQ ID NO: 4292879 - DNA, 14 bp, Homo sapiens
ctgccttccaggcg

SEQ ID NO: 4292880 - DNA, 17 bp, Homo sapiens
ctgccttctgcggagct

SEQ ID NO: 4292881 - DNA, 23 bp, Homo sapiens
ctgccttctgcggagcttctcca

SEQ ID NO: 4292882 - DNA, 19 bp, Homo sapiens
ctgccttctgtctcttgca

SEQ ID NO: 4292883 - DNA, 16 bp, Homo sapiens
ctgcgccctccctccc

SEQ ID NO: 4292884 - DNA, 12 bp, Homo sapiens
ctgcgctgtgct

SEQ ID NO: 4292885 - DNA, 15 bp, Homo sapiens
ctgcgctgtgctggt

SEQ ID NO: 4292886 - DNA, 13 bp, Homo sapiens
ctgcgtcccactg

SEQ ID NO: 4292887 - DNA, 14 bp, Homo sapiens
ctgcgtggcctggg

SEQ ID NO: 4292888 - DNA, 15 bp, Homo sapiens
ctgcgtggcctgggg

SEQ ID NO: 4292889 - DNA, 18 bp, Homo sapiens
ctgctacagtagctgtgg

SEQ ID NO: 4292890 - DNA, 22 bp, Homo sapiens
ctgctacctggttttcattatt

SEQ ID NO: 4292891 - DNA, 14 bp, Homo sapiens
ctgctatccagccg

SEQ ID NO: 4292892 - DNA, 15 bp, Homo sapiens
ctgctatgtctgtga

SEQ ID NO: 4292893 - DNA, 20 bp, Homo sapiens
ctgctcagatgctggtcatc

SEQ ID NO: 4292894 - DNA, 14 bp, Homo sapiens
ctgctcaggcctca

SEQ ID NO: 4292895 - DNA, 17 bp, Homo sapiens
ctgctccacagaaaccc

SEQ ID NO: 4292896 - DNA, 20 bp, Homo sapiens
ctgctccacagaaaccctgt

SEQ ID NO: 4292897 - DNA, 12 bp, Homo sapiens
ctgctccatgca

SEQ ID NO: 4292898 - DNA, 22 bp, Homo sapiens
ctgctccatgcagatctagcca

SEQ ID NO: 4292899 - DNA, 11 bp, Homo sapiens
ctgctccatgg

SEQ ID NO: 4292900 - DNA, 17 bp, Homo sapiens
ctgctcctcgcagttcg

SEQ ID NO: 4292901 - DNA, 14 bp, Homo sapiens
ctgctcctcggcca

SEQ ID NO: 4292902 - DNA, 23 bp, Homo sapiens
ctgctcctcggccagagctccca

SEQ ID NO: 4292903 - DNA, 17 bp, Homo sapiens
ctgctcctgtggcggtg

SEQ ID NO: 4292904 - DNA, 15 bp, Homo sapiens
ctgctctattgtagc

SEQ ID NO: 4292905 - DNA, 14 bp, Homo sapiens
ctgctgaggccaga

SEQ ID NO: 4292906 - DNA, 18 bp, Homo sapiens
ctgctgaggccagaggaa

SEQ ID NO: 4292907 - DNA, 17 bp, Homo sapiens
ctgctgcactgccctcc

SEQ ID NO: 4292908 - DNA, 21 bp, Homo sapiens
ctgctgccatgattttggcca

SEQ ID NO: 4292909 - DNA, 16 bp, Homo sapiens
ctgctgcccgtgagga

SEQ ID NO: 4292910 - DNA, 23 bp, Homo sapiens
ctgctgcccgtgaggagggggag

SEQ ID NO: 4292911 - DNA, 14 bp, Homo sapiens
ctgctgccctccat

SEQ ID NO: 4292912 - DNA, 15 bp, Homo sapiens
ctgctgcctccccaa

SEQ ID NO: 4292913 - DNA, 19 bp, Homo sapiens
ctgctgcctccccaaccct

SEQ ID NO: 4292914 - DNA, 17 bp, Homo sapiens
ctgctgcgctgtgctgg

SEQ ID NO: 4292915 - DNA, 18 bp, Homo sapiens
ctgctgcgctgtgctggt

SEQ ID NO: 4292916 - DNA, 13 bp, Homo sapiens
ctgctgctggtca

SEQ ID NO: 4292917 - DNA, 18 bp, Homo sapiens
ctgctgctggtcaccccc

SEQ ID NO: 4292918 - DNA, 11 bp, Homo sapiens
ctgctggcccc

SEQ ID NO: 4292919 - DNA, 17 bp, Homo sapiens
ctgctggcccctcacct

SEQ ID NO: 4292920 - DNA, 13 bp, Homo sapiens
ctgctggctgcct

SEQ ID NO: 4292921 - DNA, 15 bp, Homo sapiens
ctgctggctgcctta

SEQ ID NO: 4292922 - DNA, 21 bp, Homo sapiens
ctgctgtaagacggccttgga

SEQ ID NO: 4292923 - DNA, 13 bp, Homo sapiens
ctgctgtgaattt

SEQ ID NO: 4292924 - DNA, 19 bp, Homo sapiens
ctgctgtgggtcagtgtgc

SEQ ID NO: 4292925 - DNA, 14 bp, Homo sapiens
ctgctgttttatgt

SEQ ID NO: 4292926 - DNA, 16 bp, Homo sapiens
ctgctgttttatgtca

SEQ ID NO: 4292927 - DNA, 12 bp, Homo sapiens
ctgcttagtgtc

SEQ ID NO: 4292928 - DNA, 17 bp, Homo sapiens
ctgcttagtgtccctta

SEQ ID NO: 4292929 - DNA, 22 bp, Homo sapiens
ctgcttccagttggactgtggc

SEQ ID NO: 4292930 - DNA, 14 bp, Homo sapiens
ctgcttccctctgc

SEQ ID NO: 4292931 - DNA, 18 bp, Homo sapiens
ctgcttccctctgcctgt

SEQ ID NO: 4292932 - DNA, 22 bp, Homo sapiens
ctgcttccctctgcctgtccct

SEQ ID NO: 4292933 - DNA, 13 bp, Homo sapiens
ctgcttctgccca

SEQ ID NO: 4292934 - DNA, 14 bp, Homo sapiens
ctgcttctgcccac

SEQ ID NO: 4292935 - DNA, 15 bp, Homo sapiens
ctgcttctgcccacc

SEQ ID NO: 4292936 - DNA, 18 bp, Homo sapiens
ctgcttctgcccaccccg

SEQ ID NO: 4292937 - DNA, 19 bp, Homo sapiens
ctgcttggatccatacaaa

SEQ ID NO: 4292938 - DNA, 22 bp, Homo sapiens
ctgcttggatccatacaaaact

SEQ ID NO: 4292939 - DNA, 21 bp, Homo sapiens
ctgcttgtgttgggccccagg

SEQ ID NO: 4292940 - DNA, 16 bp, Homo sapiens
ctgctttgggctgccc

SEQ ID NO: 4292941 - DNA, 17 bp, Homo sapiens
ctgctttgggctgccct

SEQ ID NO: 4292942 - DNA, 22 bp, Homo sapiens
ctgctttgggctgccctggtgc

SEQ ID NO: 4292943 - DNA, 21 bp, Homo sapiens
ctgcttttccattctgggtgt

SEQ ID NO: 4292944 - DNA, 16 bp, Homo sapiens
ctggaactgtctctca

SEQ ID NO: 4292945 - DNA, 20 bp, Homo sapiens
ctggaagggtccggcttggc

SEQ ID NO: 4292946 - DNA, 21 bp, Homo sapiens
ctggaataagaagcaaataaa

SEQ ID NO: 4292947 - DNA, 15 bp, Homo sapiens
ctggactatagctgt

SEQ ID NO: 4292948 - DNA, 13 bp, Homo sapiens
ctggactggaggc

SEQ ID NO: 4292949 - DNA, 20 bp, Homo sapiens
ctggactggaggctgggtgg

SEQ ID NO: 4292950 - DNA, 18 bp, Homo sapiens
ctggactgggaagggggc

SEQ ID NO: 4292951 - DNA, 22 bp, Homo sapiens
ctggactgggaagggggcaggc

SEQ ID NO: 4292952 - DNA, 14 bp, Homo sapiens
ctggagaccaggac

SEQ ID NO: 4292953 - DNA, 19 bp, Homo sapiens
ctggagcccctatcctgca

SEQ ID NO: 4292954 - DNA, 23 bp, Homo sapiens
ctggagcccctatcctgcaccct

SEQ ID NO: 4292955 - DNA, 19 bp, Homo sapiens
ctggagcccggcagtgcac

SEQ ID NO: 4292956 - DNA, 11 bp, Homo sapiens
ctggagctggc

SEQ ID NO: 4292957 - DNA, 16 bp, Homo sapiens
ctggaggcctctgcaa

SEQ ID NO: 4292958 - DNA, 15 bp, Homo sapiens
ctggaggctgggtgg

SEQ ID NO: 4292959 - DNA, 23 bp, Homo sapiens
ctggagtcctgttctcagagctc

SEQ ID NO: 4292960 - DNA, 17 bp, Homo sapiens
ctggagtctgaaggaga

SEQ ID NO: 4292961 - DNA, 14 bp, Homo sapiens
ctggatccctttca

SEQ ID NO: 4292962 - DNA, 23 bp, Homo sapiens
ctggatgctgggttctggggctg

SEQ ID NO: 4292963 - DNA, 17 bp, Homo sapiens
ctggatggatctgctcc

SEQ ID NO: 4292964 - DNA, 17 bp, Homo sapiens
ctggattttctttctat

SEQ ID NO: 4292965 - DNA, 16 bp, Homo sapiens
ctggcacagggcagtg

SEQ ID NO: 4292966 - DNA, 13 bp, Homo sapiens
ctggcagaactga

SEQ ID NO: 4292967 - DNA, 16 bp, Homo sapiens
ctggcagaactgagct

SEQ ID NO: 4292968 - DNA, 20 bp, Homo sapiens
ctggcagccgtgccttcagc

SEQ ID NO: 4292969 - DNA, 13 bp, Homo sapiens
ctggcagcctcag

SEQ ID NO: 4292970 - DNA, 21 bp, Homo sapiens
ctggcagcctcagaggcccct

SEQ ID NO: 4292971 - DNA, 14 bp, Homo sapiens
ctggcaggagacac

SEQ ID NO: 4292972 - DNA, 16 bp, Homo sapiens
ctggcaggagacactg

SEQ ID NO: 4292973 - DNA, 21 bp, Homo sapiens
ctggcaggagacactggtctc

SEQ ID NO: 4292974 - DNA, 14 bp, Homo sapiens
ctggcaggagggtg

SEQ ID NO: 4292975 - DNA, 16 bp, Homo sapiens
ctggcaggagggtggc

SEQ ID NO: 4292976 - DNA, 16 bp, Homo sapiens
ctggcagggcaggcag

SEQ ID NO: 4292977 - DNA, 20 bp, Homo sapiens
ctggcaggtggccagggctc

SEQ ID NO: 4292978 - DNA, 14 bp, Homo sapiens
ctggcatctctgga

SEQ ID NO: 4292979 - DNA, 17 bp, Homo sapiens
ctggcatggggagggga

SEQ ID NO: 4292980 - DNA, 23 bp, Homo sapiens
ctggcatggggaggggagagaag

SEQ ID NO: 4292981 - DNA, 16 bp, Homo sapiens
ctggcatgtctgggtc

SEQ ID NO: 4292982 - DNA, 12 bp, Homo sapiens
ctggccagctgt

SEQ ID NO: 4292983 - DNA, 13 bp, Homo sapiens
ctggccagctgtg

SEQ ID NO: 4292984 - DNA, 19 bp, Homo sapiens
ctggcccacccctcttccc

SEQ ID NO: 4292985 - DNA, 14 bp, Homo sapiens
ctggcccagccagc

SEQ ID NO: 4292986 - DNA, 13 bp, Homo sapiens
ctggcccagcctg

SEQ ID NO: 4292987 - DNA, 14 bp, Homo sapiens
ctggcccagcctgt

SEQ ID NO: 4292988 - DNA, 12 bp, Homo sapiens
ctggcccagtga

SEQ ID NO: 4292989 - DNA, 15 bp, Homo sapiens
ctggccccaaatgtt

SEQ ID NO: 4292990 - DNA, 18 bp, Homo sapiens
ctggcccctagaatcagc

SEQ ID NO: 4292991 - DNA, 13 bp, Homo sapiens
ctggccctgctgc

SEQ ID NO: 4292992 - DNA, 14 bp, Homo sapiens
ctggccctgttgtg

SEQ ID NO: 4292993 - DNA, 15 bp, Homo sapiens
ctggccctgttgtgg

SEQ ID NO: 4292994 - DNA, 22 bp, Homo sapiens
ctggccctttcacccctcttcc

SEQ ID NO: 4292995 - DNA, 23 bp, Homo sapiens
ctggccgtggagtcgagctggcc

SEQ ID NO: 4292996 - DNA, 15 bp, Homo sapiens
ctggcctctggcctg

SEQ ID NO: 4292997 - DNA, 14 bp, Homo sapiens
ctggcctcttcctc

SEQ ID NO: 4292998 - DNA, 22 bp, Homo sapiens
ctggcctgggaaaagggcagga

SEQ ID NO: 4292999 - DNA, 17 bp, Homo sapiens
ctggccttggttcctcc

SEQ ID NO: 4293000 - DNA, 19 bp, Homo sapiens
ctggccttggttcctccag

SEQ ID NO: 4293001 - DNA, 21 bp, Homo sapiens
ctggccttggttcctccagca

SEQ ID NO: 4293002 - DNA, 13 bp, Homo sapiens
ctggcgtctgtct

SEQ ID NO: 4293003 - DNA, 22 bp, Homo sapiens
ctcccctccttgcctcctgtgt

SEQ ID NO: 4293004 - DNA, 22 bp, Homo sapiens
ctcccctggaactgtctctcat

SEQ ID NO: 4293005 - DNA, 11 bp, Homo sapiens
ctccccttccc

SEQ ID NO: 4293006 - DNA, 16 bp, Homo sapiens
ctccccttccctgcaa

SEQ ID NO: 4293007 - DNA, 18 bp, Homo sapiens
ctcccgcatgctgcctgc

SEQ ID NO: 4293008 - DNA, 21 bp, Homo sapiens
ctccctagtgacccggaggcc

SEQ ID NO: 4293009 - DNA, 16 bp, Homo sapiens
ctccctcagccacgcc

SEQ ID NO: 4293010 - DNA, 20 bp, Homo sapiens
ctccctcagccacgcctctc

SEQ ID NO: 4293011 - DNA, 23 bp, Homo sapiens
ctccctcagccacgcctctctca

SEQ ID NO: 4293012 - DNA, 13 bp, Homo sapiens
ctccctcagcccc

SEQ ID NO: 4293013 - DNA, 18 bp, Homo sapiens
ctccctcagcccctcttg

SEQ ID NO: 4293014 - DNA, 14 bp, Homo sapiens
ctccctccacacct

SEQ ID NO: 4293015 - DNA, 17 bp, Homo sapiens
ctccctccactcctccc

SEQ ID NO: 4293016 - DNA, 14 bp, Homo sapiens
ctccctcccatttg

SEQ ID NO: 4293017 - DNA, 14 bp, Homo sapiens
ctccctccctccac

SEQ ID NO: 4293018 - DNA, 14 bp, Homo sapiens
ctccctccctgcag

SEQ ID NO: 4293019 - DNA, 15 bp, Homo sapiens
ctccctccctgcagg

SEQ ID NO: 4293020 - DNA, 15 bp, Homo sapiens
ctccctcctggctca

SEQ ID NO: 4293021 - DNA, 20 bp, Homo sapiens
ctccctcctggctcacagcc

SEQ ID NO: 4293022 - DNA, 23 bp, Homo sapiens
ctccctcctggctcacagccacc

SEQ ID NO: 4293023 - DNA, 11 bp, Homo sapiens
ctccctgcagg

SEQ ID NO: 4293024 - DNA, 13 bp, Homo sapiens
ctccctgcccctc

SEQ ID NO: 4293025 - DNA, 14 bp, Homo sapiens
ctccctgcccctcc

SEQ ID NO: 4293026 - DNA, 17 bp, Homo sapiens
ctccctgcccctccctt

SEQ ID NO: 4293027 - DNA, 21 bp, Homo sapiens
ctccctgcccctcccttcaac

SEQ ID NO: 4293028 - DNA, 13 bp, Homo sapiens
ctccctgctgcca

SEQ ID NO: 4293029 - DNA, 22 bp, Homo sapiens
ctccctgctgccaggctcccac

SEQ ID NO: 4293030 - DNA, 18 bp, Homo sapiens
ctccctggactctgtggg

SEQ ID NO: 4293031 - DNA, 21 bp, Homo sapiens
ctccctggcctgttctgtttt

SEQ ID NO: 4293032 - DNA, 12 bp, Homo sapiens
ctcccttcaacc

SEQ ID NO: 4293033 - DNA, 20 bp, Homo sapiens
ctcccttcaaccattcccca

SEQ ID NO: 4293034 - DNA, 16 bp, Homo sapiens
ctccgcgggggacagg

SEQ ID NO: 4293035 - DNA, 17 bp, Homo sapiens
ctccgcgggggacagga

SEQ ID NO: 4293036 - DNA, 21 bp, Homo sapiens
ctccgctaaggcttccggctg

SEQ ID NO: 4293037 - DNA, 14 bp, Homo sapiens
ctccggccctgccc

SEQ ID NO: 4293038 - DNA, 16 bp, Homo sapiens
ctccggccctgcccca

SEQ ID NO: 4293039 - DNA, 17 bp, Homo sapiens
ctccggccctgccccac

SEQ ID NO: 4293040 - DNA, 14 bp, Homo sapiens
ctccgtcctggcag

SEQ ID NO: 4293041 - DNA, 17 bp, Homo sapiens
ctcctatcacctcccct

SEQ ID NO: 4293042 - DNA, 19 bp, Homo sapiens
ctcctcagtctttggggga

SEQ ID NO: 4293043 - DNA, 13 bp, Homo sapiens
ctcctcccaactc

SEQ ID NO: 4293044 - DNA, 18 bp, Homo sapiens
ctcctcccaactctggcc

SEQ ID NO: 4293045 - DNA, 22 bp, Homo sapiens
ctcctcccaggcgccccttccc

SEQ ID NO: 4293046 - DNA, 13 bp, Homo sapiens
ctcctcccatcca

SEQ ID NO: 4293047 - DNA, 14 bp, Homo sapiens
ctcctcccatccag

SEQ ID NO: 4293048 - DNA, 13 bp, Homo sapiens
ctcctccccgatc

SEQ ID NO: 4293049 - DNA, 17 bp, Homo sapiens
ctcctcccggtgcccaa

SEQ ID NO: 4293050 - DNA, 10 bp, Homo sapiens
ctcctccctc

SEQ ID NO: 4293051 - DNA, 13 bp, Homo sapiens
ctcctcctccagt

SEQ ID NO: 4293052 - DNA, 15 bp, Homo sapiens
ctcctcggccagagc

SEQ ID NO: 4293053 - DNA, 20 bp, Homo sapiens
ctcctcggccagagctccca

SEQ ID NO: 4293054 - DNA, 13 bp, Homo sapiens
ctcctctcccaaa

SEQ ID NO: 4293055 - DNA, 15 bp, Homo sapiens
ctcctctctctccct

SEQ ID NO: 4293056 - DNA, 16 bp, Homo sapiens
ctcctctctctccctc

SEQ ID NO: 4293057 - DNA, 18 bp, Homo sapiens
ctcctctctctccctcca

SEQ ID NO: 4293058 - DNA, 20 bp, Homo sapiens
ctcctctctctccctccact

SEQ ID NO: 4293059 - DNA, 22 bp, Homo sapiens
ctcctctctctccctccactcc

SEQ ID NO: 4293060 - DNA, 13 bp, Homo sapiens
ctcctctgcctgt

SEQ ID NO: 4293061 - DNA, 15 bp, Homo sapiens
ctcctctgcctgtgc

SEQ ID NO: 4293062 - DNA, 20 bp, Homo sapiens
ctcctctgcctgtgcccgct

SEQ ID NO: 4293063 - DNA, 23 bp, Homo sapiens
ctcctctgggcaggacctcagag

SEQ ID NO: 4293064 - DNA, 17 bp, Homo sapiens
ctcctgaatccctttca

SEQ ID NO: 4293065 - DNA, 14 bp, Homo sapiens
ctcctgaggagcag

SEQ ID NO: 4293066 - DNA, 19 bp, Homo sapiens
ctcctgaggagcagcccac

SEQ ID NO: 4293067 - DNA, 22 bp, Homo sapiens
ctcctgaggagcagcccacctg

SEQ ID NO: 4293068 - DNA, 20 bp, Homo sapiens
ctcctgctgagtggtccaca

SEQ ID NO: 4293069 - DNA, 21 bp, Homo sapiens
ctcctggacccagcaggggca

SEQ ID NO: 4293070 - DNA, 17 bp, Homo sapiens
ctcctggatccctttca

SEQ ID NO: 4293071 - DNA, 14 bp, Homo sapiens
ctcctgggcatctg

SEQ ID NO: 4293072 - DNA, 16 bp, Homo sapiens
ctcctgggcatctggc

SEQ ID NO: 4293073 - DNA, 16 bp, Homo sapiens
ctcctgggccagggtc

SEQ ID NO: 4293074 - DNA, 15 bp, Homo sapiens
ctcctgtgagctccc

SEQ ID NO: 4293075 - DNA, 18 bp, Homo sapiens
ctccttaaccacctagtc

SEQ ID NO: 4293076 - DNA, 22 bp, Homo sapiens
ctccttagaaaagactgacctt

SEQ ID NO: 4293077 - DNA, 18 bp, Homo sapiens
ctccttccaggccccagg

SEQ ID NO: 4293078 - DNA, 21 bp, Homo sapiens
ctccttccaggccccaggctg

SEQ ID NO: 4293079 - DNA, 14 bp, Homo sapiens
ctccttctcccctc

SEQ ID NO: 4293080 - DNA, 15 bp, Homo sapiens
ctccttctcccctcc

SEQ ID NO: 4293081 - DNA, 17 bp, Homo sapiens
ctccttctcccctccag

SEQ ID NO: 4293082 - DNA, 19 bp, Homo sapiens
ctccttctcccctccagac

SEQ ID NO: 4293083 - DNA, 20 bp, Homo sapiens
ctccttctcccctccagacc

SEQ ID NO: 4293084 - DNA, 20 bp, Homo sapiens
ctccttgaaaccagctcagg

SEQ ID NO: 4293085 - DNA, 17 bp, Homo sapiens
ctccttgccgctgggag

SEQ ID NO: 4293086 - DNA, 18 bp, Homo sapiens
ctccttgccgctgggaga

SEQ ID NO: 4293087 - DNA, 19 bp, Homo sapiens
ctccttgtttgcctttagg

SEQ ID NO: 4293088 - DNA, 13 bp, Homo sapiens
ctcctttcacaac

SEQ ID NO: 4293089 - DNA, 16 bp, Homo sapiens
ctcgaagctgttctct

SEQ ID NO: 4293090 - DNA, 18 bp, Homo sapiens
ctcgaagctgttctctgc

SEQ ID NO: 4293091 - DNA, 15 bp, Homo sapiens
ctcgcccctccagtg

SEQ ID NO: 4293092 - DNA, 18 bp, Homo sapiens
ctcgcccctccagtgttg

SEQ ID NO: 4293093 - DNA, 18 bp, Homo sapiens
ctcgcctcaggctttttc

SEQ ID NO: 4293094 - DNA, 15 bp, Homo sapiens
ctcgcttcataggca

SEQ ID NO: 4293095 - DNA, 20 bp, Homo sapiens
ctcgcttcataggcagagcc

SEQ ID NO: 4293096 - DNA, 21 bp, Homo sapiens
ctcgcttcataggcagagccc

SEQ ID NO: 4293097 - DNA, 13 bp, Homo sapiens
ctcggccagagct

SEQ ID NO: 4293098 - DNA, 16 bp, Homo sapiens
ctcggccagagctccc

SEQ ID NO: 4293099 - DNA, 19 bp, Homo sapiens
ctcggccagagctcccagg

SEQ ID NO: 4293100 - DNA, 16 bp, Homo sapiens
ctcggccccacccacc

SEQ ID NO: 4293101 - DNA, 24 bp, Homo sapiens
ctcggccccacccaccctctggtc

SEQ ID NO: 4293102 - DNA, 15 bp, Homo sapiens
ctcggggcaggaagt

SEQ ID NO: 4293103 - DNA, 18 bp, Homo sapiens
ctcgtcaggaggtgcctg

SEQ ID NO: 4293104 - DNA, 22 bp, Homo sapiens
ctcgtctttgcttgtcctgctc

SEQ ID NO: 4293105 - DNA, 14 bp, Homo sapiens
ctctaaaattctag

SEQ ID NO: 4293106 - DNA, 15 bp, Homo sapiens
ctctaaaattctagt

SEQ ID NO: 4293107 - DNA, 16 bp, Homo sapiens
ctctaaaattctagtc

SEQ ID NO: 4293108 - DNA, 21 bp, Homo sapiens
ctctaactgtatatttgtatg

SEQ ID NO: 4293109 - DNA, 14 bp, Homo sapiens
ctctaattctctag

SEQ ID NO: 4293110 - DNA, 11 bp, Homo sapiens
ctctaatttcc

SEQ ID NO: 4293111 - DNA, 23 bp, Homo sapiens
ctctacaactgagtccttaaaca

SEQ ID NO: 4293112 - DNA, 13 bp, Homo sapiens
ctctactttcctg

SEQ ID NO: 4293113 - DNA, 21 bp, Homo sapiens
ctctactttcctgatgttgat

SEQ ID NO: 4293114 - DNA, 12 bp, Homo sapiens
ctctaggcctga

SEQ ID NO: 4293115 - DNA, 14 bp, Homo sapiens
ctctaggcctgaac

SEQ ID NO: 4293116 - DNA, 14 bp, Homo sapiens
ctctaggtggggcg

SEQ ID NO: 4293117 - DNA, 15 bp, Homo sapiens
ctctatatatacatg

SEQ ID NO: 4293118 - DNA, 21 bp, Homo sapiens
ctctatatatacatgtatagt

SEQ ID NO: 4293119 - DNA, 13 bp, Homo sapiens
ctctatttagcat

SEQ ID NO: 4293120 - DNA, 14 bp, Homo sapiens
ctctattttttact

SEQ ID NO: 4293121 - DNA, 12 bp, Homo sapiens
ctctcagcccag

SEQ ID NO: 4293122 - DNA, 16 bp, Homo sapiens
ctctcaggcatgcctg

SEQ ID NO: 4293123 - DNA, 17 bp, Homo sapiens
ctctccaggattgtcca

SEQ ID NO: 4293124 - DNA, 19 bp, Homo sapiens
ctctccaggattgtccaca

SEQ ID NO: 4293125 - DNA, 20 bp, Homo sapiens
ctctccaggattgtccacaa

SEQ ID NO: 4293126 - DNA, 24 bp, Homo sapiens
ctctccaggattgtccacaaatgt

SEQ ID NO: 4293127 - DNA, 23 bp, Homo sapiens
ctctccccggacaagcccaggac

SEQ ID NO: 4293128 - DNA, 19 bp, Homo sapiens
ctctcccctgcgcaggccc

SEQ ID NO: 4293129 - DNA, 12 bp, Homo sapiens
ctctccctccac

SEQ ID NO: 4293130 - DNA, 14 bp, Homo sapiens
ctctccctccactc

SEQ ID NO: 4293131 - DNA, 16 bp, Homo sapiens
ctctccctccactcct

SEQ ID NO: 4293132 - DNA, 12 bp, Homo sapiens
ctctcctgagga

SEQ ID NO: 4293133 - DNA, 14 bp, Homo sapiens
ctctcctgaggagc

SEQ ID NO: 4293134 - DNA, 13 bp, Homo sapiens
ctctcctgcatcc

SEQ ID NO: 4293135 - DNA, 13 bp, Homo sapiens
ctctcctgggcca

SEQ ID NO: 4293136 - DNA, 18 bp, Homo sapiens
ctctcgcctcaggctttt

SEQ ID NO: 4293137 - DNA, 16 bp, Homo sapiens
ctctctatatatacat

SEQ ID NO: 4293138 - DNA, 19 bp, Homo sapiens
ctcagcaagtgctgagtct

SEQ ID NO: 4293139 - DNA, 13 bp, Homo sapiens
ctcagcacagcct

SEQ ID NO: 4293140 - DNA, 14 bp, Homo sapiens
ctcagcacagcctc

SEQ ID NO: 4293141 - DNA, 13 bp, Homo sapiens
ctcagcagaaggc

SEQ ID NO: 4293142 - DNA, 18 bp, Homo sapiens
ctcagcagaaggccttgc

SEQ ID NO: 4293143 - DNA, 17 bp, Homo sapiens
ctcagcatctcataact

SEQ ID NO: 4293144 - DNA, 19 bp, Homo sapiens
ctcagccacacccaggcac

SEQ ID NO: 4293145 - DNA, 14 bp, Homo sapiens
ctcagccacgcctc

SEQ ID NO: 4293146 - DNA, 16 bp, Homo sapiens
ctcagccacgcctctc

SEQ ID NO: 4293147 - DNA, 18 bp, Homo sapiens
ctcagccacgcctctctc

SEQ ID NO: 4293148 - DNA, 11 bp, Homo sapiens
ctcagcccacc

SEQ ID NO: 4293149 - DNA, 16 bp, Homo sapiens
ctcagcccacccccct

SEQ ID NO: 4293150 - DNA, 12 bp, Homo sapiens
ctcagccccagg

SEQ ID NO: 4293151 - DNA, 13 bp, Homo sapiens
ctcagccccaggg

SEQ ID NO: 4293152 - DNA, 16 bp, Homo sapiens
ctcagcccctcttgcc

SEQ ID NO: 4293153 - DNA, 22 bp, Homo sapiens
ctcagcctccggatgacacaaa

SEQ ID NO: 4293154 - DNA, 18 bp, Homo sapiens
ctcagctgtctgtggctt

SEQ ID NO: 4293155 - DNA, 19 bp, Homo sapiens
ctcaggagaaggcctgccc

SEQ ID NO: 4293156 - DNA, 13 bp, Homo sapiens
ctcaggaggcagt

SEQ ID NO: 4293157 - DNA, 21 bp, Homo sapiens
ctcaggaggcagtggcttgga

SEQ ID NO: 4293158 - DNA, 14 bp, Homo sapiens
ctcaggcagtggcc

SEQ ID NO: 4293159 - DNA, 20 bp, Homo sapiens
ctcaggcagtggcccaggga

SEQ ID NO: 4293160 - DNA, 15 bp, Homo sapiens
ctcaggcatgcctgt

SEQ ID NO: 4293161 - DNA, 17 bp, Homo sapiens
ctcaggcccacattgcc

SEQ ID NO: 4293162 - DNA, 11 bp, Homo sapiens
ctcaggcctca

SEQ ID NO: 4293163 - DNA, 13 bp, Homo sapiens
ctcaggcctcacc

SEQ ID NO: 4293164 - DNA, 14 bp, Homo sapiens
ctcaggcctcacct

SEQ ID NO: 4293165 - DNA, 20 bp, Homo sapiens
ctcaggcctcacctggcttc

SEQ ID NO: 4293166 - DNA, 23 bp, Homo sapiens
ctcaggcctcacctggcttccca

SEQ ID NO: 4293167 - DNA, 12 bp, Homo sapiens
ctcaggcctccc

SEQ ID NO: 4293168 - DNA, 13 bp, Homo sapiens
ctcaggcctccca

SEQ ID NO: 4293169 - DNA, 16 bp, Homo sapiens
ctcaggcctggccctt

SEQ ID NO: 4293170 - DNA, 18 bp, Homo sapiens
ctcaggcctggccctttc

SEQ ID NO: 4293171 - DNA, 16 bp, Homo sapiens
ctcaggcggggatcac

SEQ ID NO: 4293172 - DNA, 13 bp, Homo sapiens
ctcaggctttttc

SEQ ID NO: 4293173 - DNA, 20 bp, Homo sapiens
ctcagggctggattggcagg

SEQ ID NO: 4293174 - DNA, 21 bp, Homo sapiens
ctcaggggagacttaggccag

SEQ ID NO: 4293175 - DNA, 23 bp, Homo sapiens
ctcaggggagacttaggccagag

SEQ ID NO: 4293176 - DNA, 21 bp, Homo sapiens
ctcagggtgctccctcctcag

SEQ ID NO: 4293177 - DNA, 16 bp, Homo sapiens
ctcaggtgcgtgccac

SEQ ID NO: 4293178 - DNA, 19 bp, Homo sapiens
ctcatatacttgaatatta

SEQ ID NO: 4293179 - DNA, 20 bp, Homo sapiens
ctcatcagaaacaatttctg

SEQ ID NO: 4293180 - DNA, 17 bp, Homo sapiens
ctcatcatgtctattgt

SEQ ID NO: 4293181 - DNA, 22 bp, Homo sapiens
ctcatcattattacatagactg

SEQ ID NO: 4293182 - DNA, 21 bp, Homo sapiens
ctcatccactaggtgcccagt

SEQ ID NO: 4293183 - DNA, 20 bp, Homo sapiens
ctcatccagaactgtcttag

SEQ ID NO: 4293184 - DNA, 22 bp, Homo sapiens
ctcatccagaactgtcttagtc

SEQ ID NO: 4293185 - DNA, 22 bp, Homo sapiens
ctcatcctcctggacccagcag

SEQ ID NO: 4293186 - DNA, 17 bp, Homo sapiens
ctcatgaacactggctg

SEQ ID NO: 4293187 - DNA, 14 bp, Homo sapiens
ctcatgtgatttac

SEQ ID NO: 4293188 - DNA, 19 bp, Homo sapiens
ctcattagaattaccattt

SEQ ID NO: 4293189 - DNA, 20 bp, Homo sapiens
ctcattcctctgtccccgag

SEQ ID NO: 4293190 - DNA, 22 bp, Homo sapiens
ctcatttagcattgaaataata

SEQ ID NO: 4293191 - DNA, 11 bp, Homo sapiens
ctccaaggcaa

SEQ ID NO: 4293192 - DNA, 19 bp, Homo sapiens
ctccaaggcaaatgtccaa

SEQ ID NO: 4293193 - DNA, 18 bp, Homo sapiens
ctccacagaaaccctgtt

SEQ ID NO: 4293194 - DNA, 20 bp, Homo sapiens
ctccaccccagtccccggga

SEQ ID NO: 4293195 - DNA, 14 bp, Homo sapiens
ctccacccctcaag

SEQ ID NO: 4293196 - DNA, 16 bp, Homo sapiens
ctccacccgtcctggg

SEQ ID NO: 4293197 - DNA, 15 bp, Homo sapiens
ctccacctgcagccc

SEQ ID NO: 4293198 - DNA, 20 bp, Homo sapiens
ctccacctgcagccccaggc

SEQ ID NO: 4293199 - DNA, 18 bp, Homo sapiens
ctccacctgggagatgct

SEQ ID NO: 4293200 - DNA, 11 bp, Homo sapiens
ctccactcagc

SEQ ID NO: 4293201 - DNA, 14 bp, Homo sapiens
ctccactcagcaca

SEQ ID NO: 4293202 - DNA, 9 bp, Homo sapiens
ctccactcc

SEQ ID NO: 4293203 - DNA, 14 bp, Homo sapiens
ctccactcccctca

SEQ ID NO: 4293204 - DNA, 14 bp, Homo sapiens
ctccactccctgtc

SEQ ID NO: 4293205 - DNA, 14 bp, Homo sapiens
ctccactcctccca

SEQ ID NO: 4293206 - DNA, 11 bp, Homo sapiens
ctccactgcct

SEQ ID NO: 4293207 - DNA, 14 bp, Homo sapiens
ctccactgccttcg

SEQ ID NO: 4293208 - DNA, 13 bp, Homo sapiens
ctccactggatgg

SEQ ID NO: 4293209 - DNA, 14 bp, Homo sapiens
ctccactggatgga

SEQ ID NO: 4293210 - DNA, 15 bp, Homo sapiens
ctccagacattgtat

SEQ ID NO: 4293211 - DNA, 17 bp, Homo sapiens
ctccagacattgtattt

SEQ ID NO: 4293212 - DNA, 16 bp, Homo sapiens
ctccagacccccaccc

SEQ ID NO: 4293213 - DNA, 22 bp, Homo sapiens
ctccagacccccaccccttccc

SEQ ID NO: 4293214 - DNA, 20 bp, Homo sapiens
ctccagacccctaccctttc

SEQ ID NO: 4293215 - DNA, 20 bp, Homo sapiens
ctccagacccctggcttttc

SEQ ID NO: 4293216 - DNA, 23 bp, Homo sapiens
ctccagagtaggtgggtcttgga

SEQ ID NO: 4293217 - DNA, 14 bp, Homo sapiens
ctccagccaacccc

SEQ ID NO: 4293218 - DNA, 18 bp, Homo sapiens
ctccagccaacccctgtg

SEQ ID NO: 4293219 - DNA, 19 bp, Homo sapiens
ctccagccaacccctgtgg

SEQ ID NO: 4293220 - DNA, 21 bp, Homo sapiens
ctccagccaacccctgtggag

SEQ ID NO: 4293221 - DNA, 17 bp, Homo sapiens
ctccagccaccaaggct

SEQ ID NO: 4293222 - DNA, 19 bp, Homo sapiens
ctccagccaccaaggctgc

SEQ ID NO: 4293223 - DNA, 22 bp, Homo sapiens
ctccaggaagggaccccactgg

SEQ ID NO: 4293224 - DNA, 12 bp, Homo sapiens
ctccaggcccag

SEQ ID NO: 4293225 - DNA, 15 bp, Homo sapiens
ctccaggcccagcct

SEQ ID NO: 4293226 - DNA, 16 bp, Homo sapiens
ctccaggcccagcctg

SEQ ID NO: 4293227 - DNA, 17 bp, Homo sapiens
ctccaggcccagcctgg

SEQ ID NO: 4293228 - DNA, 13 bp, Homo sapiens
ctccaggcttcct

SEQ ID NO: 4293229 - DNA, 17 bp, Homo sapiens
ctccaggggtttacagt

SEQ ID NO: 4293230 - DNA, 17 bp, Homo sapiens
ctccagtctgctgccct

SEQ ID NO: 4293231 - DNA, 21 bp, Homo sapiens
ctccagtctgctgccctccat

SEQ ID NO: 4293232 - DNA, 19 bp, Homo sapiens
ctccagtgttgcctcctcc

SEQ ID NO: 4293233 - DNA, 22 bp, Homo sapiens
ctccagtgttgcctcctcccat

SEQ ID NO: 4293234 - DNA, 23 bp, Homo sapiens
ctccagtgttgcctcctcccatc

SEQ ID NO: 4293235 - DNA, 14 bp, Homo sapiens
ctccagtgttttct

SEQ ID NO: 4293236 - DNA, 17 bp, Homo sapiens
ctccatatcccgggagc

SEQ ID NO: 4293237 - DNA, 18 bp, Homo sapiens
ctccatatcccgggagca

SEQ ID NO: 4293238 - DNA, 13 bp, Homo sapiens
ctccatccccatg

SEQ ID NO: 4293239 - DNA, 19 bp, Homo sapiens
ctccatgcagatctagcca

SEQ ID NO: 4293240 - DNA, 22 bp, Homo sapiens
ctccatttcttggttttgtatt

SEQ ID NO: 4293241 - DNA, 19 bp, Homo sapiens
ctcccaaataaactcctta

SEQ ID NO: 4293242 - DNA, 18 bp, Homo sapiens
ctcccaaatatgcccctc

SEQ ID NO: 4293243 - DNA, 18 bp, Homo sapiens
ctcccaaatgcagcttca

SEQ ID NO: 4293244 - DNA, 20 bp, Homo sapiens
ctcccaaatgcagcttcagg

SEQ ID NO: 4293245 - DNA, 15 bp, Homo sapiens
ctcccaactctggcc

SEQ ID NO: 4293246 - DNA, 14 bp, Homo sapiens
ctcccacaggccct

SEQ ID NO: 4293247 - DNA, 15 bp, Homo sapiens
ctcccacaggccctt

SEQ ID NO: 4293248 - DNA, 14 bp, Homo sapiens
ctcccacatccccc

SEQ ID NO: 4293249 - DNA, 11 bp, Homo sapiens
ctcccacgccc

SEQ ID NO: 4293250 - DNA, 13 bp, Homo sapiens
ctcccacgccctc

SEQ ID NO: 4293251 - DNA, 18 bp, Homo sapiens
ctcccacgccctcctccc

SEQ ID NO: 4293252 - DNA, 21 bp, Homo sapiens
ctcccacgccctcctccctcc

SEQ ID NO: 4293253 - DNA, 12 bp, Homo sapiens
ctcccagccacc

SEQ ID NO: 4293254 - DNA, 22 bp, Homo sapiens
ctcccagccacccggatctcca

SEQ ID NO: 4293255 - DNA, 18 bp, Homo sapiens
ctcccagctctagacaac

SEQ ID NO: 4293256 - DNA, 23 bp, Homo sapiens
ctcccagctctagacaaccctgc

SEQ ID NO: 4293257 - DNA, 20 bp, Homo sapiens
ctcccaggacgcagggagac

SEQ ID NO: 4293258 - DNA, 19 bp, Homo sapiens
ctcccaggcgccccttccc

SEQ ID NO: 4293259 - DNA, 19 bp, Homo sapiens
ctcccaggggcctttgcag

SEQ ID NO: 4293260 - DNA, 13 bp, Homo sapiens
ctcccagggtcct

SEQ ID NO: 4293261 - DNA, 22 bp, Homo sapiens
ctcccagggtcctgggggctgc

SEQ ID NO: 4293262 - DNA, 14 bp, Homo sapiens
ctccccaaggaaga

SEQ ID NO: 4293263 - DNA, 15 bp, Homo sapiens
ctccccaatccaacc

SEQ ID NO: 4293264 - DNA, 20 bp, Homo sapiens
ctccccaatccaacccatgc

SEQ ID NO: 4293265 - DNA, 16 bp, Homo sapiens
ctccccagcaggtggg

SEQ ID NO: 4293266 - DNA, 22 bp, Homo sapiens
ctccccagcccagggttccccc

SEQ ID NO: 4293267 - DNA, 11 bp, Homo sapiens
ctccccagtgt

SEQ ID NO: 4293268 - DNA, 11 bp, Homo sapiens
ctcccccatcc

SEQ ID NO: 4293269 - DNA, 17 bp, Homo sapiens
ctcccccatcctcccct

SEQ ID NO: 4293270 - DNA, 20 bp, Homo sapiens
ctccccctgccagaggcctg

SEQ ID NO: 4293271 - DNA, 21 bp, Homo sapiens
ctccccctgccagaggcctgg

SEQ ID NO: 4293272 - DNA, 20 bp, Homo sapiens
ctcccctccttgcctcctgt

SEQ ID NO: 4293273 - DNA, 21 bp, Homo sapiens
ccttgcattttagctaattta

SEQ ID NO: 4293274 - DNA, 17 bp, Homo sapiens
ccttgccgctgggagag

SEQ ID NO: 4293275 - DNA, 12 bp, Homo sapiens
ccttgcctcctg

SEQ ID NO: 4293276 - DNA, 22 bp, Homo sapiens
ccttgctgctggctcccatctc

SEQ ID NO: 4293277 - DNA, 11 bp, Homo sapiens
ccttggcccag

SEQ ID NO: 4293278 - DNA, 15 bp, Homo sapiens
ccttggcccagcagc

SEQ ID NO: 4293279 - DNA, 18 bp, Homo sapiens
ccttggcccctctctgtt

SEQ ID NO: 4293280 - DNA, 14 bp, Homo sapiens
ccttggcctgtcca

SEQ ID NO: 4293281 - DNA, 17 bp, Homo sapiens
ccttgggatgggcacag

SEQ ID NO: 4293282 - DNA, 22 bp, Homo sapiens
ccttggggattcttccatctga

SEQ ID NO: 4293283 - DNA, 15 bp, Homo sapiens
ccttggttcctccag

SEQ ID NO: 4293284 - DNA, 16 bp, Homo sapiens
ccttggttcctccagc

SEQ ID NO: 4293285 - DNA, 19 bp, Homo sapiens
ccttgtgtatgtgactcca

SEQ ID NO: 4293286 - DNA, 17 bp, Homo sapiens
cctttcatcctcagcaa

SEQ ID NO: 4293287 - DNA, 17 bp, Homo sapiens
cctttccctgcatccct

SEQ ID NO: 4293288 - DNA, 16 bp, Homo sapiens
cctttctaagcaggaa

SEQ ID NO: 4293289 - DNA, 22 bp, Homo sapiens
cctttctagtcctattctattg

SEQ ID NO: 4293290 - DNA, 12 bp, Homo sapiens
cctttgtaacca

SEQ ID NO: 4293291 - DNA, 20 bp, Homo sapiens
ccttttattaacatatattg

SEQ ID NO: 4293292 - DNA, 23 bp, Homo sapiens
cctttttactccccttgagctga

SEQ ID NO: 4293293 - DNA, 13 bp, Homo sapiens
cctttttgagcca

SEQ ID NO: 4293294 - DNA, 12 bp, Homo sapiens
cgaaaacattgt

SEQ ID NO: 4293295 - DNA, 17 bp, Homo sapiens
cgaaacacagaactcag

SEQ ID NO: 4293296 - DNA, 22 bp, Homo sapiens
cgaagaccttctgaagatctca

SEQ ID NO: 4293297 - DNA, 13 bp, Homo sapiens
cgaagctcagccc

SEQ ID NO: 4293298 - DNA, 17 bp, Homo sapiens
cgaagctcagcccaccc

SEQ ID NO: 4293299 - DNA, 18 bp, Homo sapiens
cgaagctcagcccacccc

SEQ ID NO: 4293300 - DNA, 14 bp, Homo sapiens
cgaagtcttccatc

SEQ ID NO: 4293301 - DNA, 12 bp, Homo sapiens
cgaatggctttt

SEQ ID NO: 4293302 - DNA, 15 bp, Homo sapiens
cgacaaccgatgctc

SEQ ID NO: 4293303 - DNA, 13 bp, Homo sapiens
cgacagcctggca

SEQ ID NO: 4293304 - DNA, 16 bp, Homo sapiens
cgacagtggctctcca

SEQ ID NO: 4293305 - DNA, 16 bp, Homo sapiens
cgacggacccctttca

SEQ ID NO: 4293306 - DNA, 14 bp, Homo sapiens
cgacggctcctccc

SEQ ID NO: 4293307 - DNA, 18 bp, Homo sapiens
cgactctctccatcagaa

SEQ ID NO: 4293308 - DNA, 19 bp, Homo sapiens
cgactctctccatcagaag

SEQ ID NO: 4293309 - DNA, 19 bp, Homo sapiens
cgagaacacaagccacgcc

SEQ ID NO: 4293310 - DNA, 17 bp, Homo sapiens
cgagacaggcagaatca

SEQ ID NO: 4293311 - DNA, 18 bp, Homo sapiens
cgagccagattaggcctg

SEQ ID NO: 4293312 - DNA, 19 bp, Homo sapiens
cgagccagattaggcctgg

SEQ ID NO: 4293313 - DNA, 16 bp, Homo sapiens
cgagccgagctctcct

SEQ ID NO: 4293314 - DNA, 20 bp, Homo sapiens
cgagcgacggctcctccccg

SEQ ID NO: 4293315 - DNA, 22 bp, Homo sapiens
cgagcgacggctcctccccgat

SEQ ID NO: 4293316 - DNA, 23 bp, Homo sapiens
cgagcgacggctcctccccgatc

SEQ ID NO: 4293317 - DNA, 14 bp, Homo sapiens
cgagctctcctggg

SEQ ID NO: 4293318 - DNA, 15 bp, Homo sapiens
cgagctctcctgggc

SEQ ID NO: 4293319 - DNA, 15 bp, Homo sapiens
cgagctgggggccat

SEQ ID NO: 4293320 - DNA, 23 bp, Homo sapiens
cgagctgggggccatgagctcca

SEQ ID NO: 4293321 - DNA, 16 bp, Homo sapiens
cgaggaaccagagcca

SEQ ID NO: 4293322 - DNA, 17 bp, Homo sapiens
cgaggacgtgaagcctc

SEQ ID NO: 4293323 - DNA, 19 bp, Homo sapiens
cgaggcagaatggtgggct

SEQ ID NO: 4293324 - DNA, 13 bp, Homo sapiens
cgaggcagaggac

SEQ ID NO: 4293325 - DNA, 15 bp, Homo sapiens
cgaggcagaggacag

SEQ ID NO: 4293326 - DNA, 14 bp, Homo sapiens
cgaggcaggggctg

SEQ ID NO: 4293327 - DNA, 16 bp, Homo sapiens
cgaggcaggggctggg

SEQ ID NO: 4293328 - DNA, 18 bp, Homo sapiens
cgaggggagggtggcagg

SEQ ID NO: 4293329 - DNA, 16 bp, Homo sapiens
cgagtctcttctccac

SEQ ID NO: 4293330 - DNA, 17 bp, Homo sapiens
cgagtctcttctccact

SEQ ID NO: 4293331 - DNA, 18 bp, Homo sapiens
cgagtctcttctccactg

SEQ ID NO: 4293332 - DNA, 13 bp, Homo sapiens
cgagtctggagac

SEQ ID NO: 4293333 - DNA, 21 bp, Homo sapiens
cgagtgtggagctgcttccag

SEQ ID NO: 4293334 - DNA, 20 bp, Homo sapiens
cgatacaccgggcctggaga

SEQ ID NO: 4293335 - DNA, 15 bp, Homo sapiens
cgatccttcaaagtc

SEQ ID NO: 4293336 - DNA, 15 bp, Homo sapiens
cgatttcctaagctg

SEQ ID NO: 4293337 - DNA, 21 bp, Homo sapiens
cgatttcctaagctgttggaa

SEQ ID NO: 4293338 - DNA, 10 bp, Homo sapiens
cgcacacaca

SEQ ID NO: 4293339 - DNA, 20 bp, Homo sapiens
cgcacacacacacacaggag

SEQ ID NO: 4293340 - DNA, 12 bp, Homo sapiens
cgcacacacact

SEQ ID NO: 4293341 - DNA, 14 bp, Homo sapiens
cgcacccccaccct

SEQ ID NO: 4293342 - DNA, 15 bp, Homo sapiens
cgcacccccaccctt

SEQ ID NO: 4293343 - DNA, 18 bp, Homo sapiens
cgcacccggcagcccccc

SEQ ID NO: 4293344 - DNA, 18 bp, Homo sapiens
cgcacgcaagcctcagcc

SEQ ID NO: 4293345 - DNA, 15 bp, Homo sapiens
cgcagccctgctttg

SEQ ID NO: 4293346 - DNA, 24 bp, Homo sapiens
cgcagccctgctttgggctgccct

SEQ ID NO: 4293347 - DNA, 15 bp, Homo sapiens
cgcagggagaccctg

SEQ ID NO: 4293348 - DNA, 17 bp, Homo sapiens
cgcagggagaccctggg

SEQ ID NO: 4293349 - DNA, 15 bp, Homo sapiens
cgcatgctgcctgcc

SEQ ID NO: 4293350 - DNA, 17 bp, Homo sapiens
cgcatgctgcctgcctc

SEQ ID NO: 4293351 - DNA, 14 bp, Homo sapiens
cgccatgtgctgtg

SEQ ID NO: 4293352 - DNA, 15 bp, Homo sapiens
cgcccacctgggccc

SEQ ID NO: 4293353 - DNA, 16 bp, Homo sapiens
cgcccacctgggccct

SEQ ID NO: 4293354 - DNA, 21 bp, Homo sapiens
cgcccacctgggccctaggca

SEQ ID NO: 4293355 - DNA, 15 bp, Homo sapiens
cgccccccagagcca

SEQ ID NO: 4293356 - DNA, 16 bp, Homo sapiens
cgccccccagagccag

SEQ ID NO: 4293357 - DNA, 19 bp, Homo sapiens
cgccccccagagccagggc

SEQ ID NO: 4293358 - DNA, 21 bp, Homo sapiens
cgccctccccctgccagaggc

SEQ ID NO: 4293359 - DNA, 14 bp, Homo sapiens
cgccctcctccctc

SEQ ID NO: 4293360 - DNA, 13 bp, Homo sapiens
cgccctgggctct

SEQ ID NO: 4293361 - DNA, 18 bp, Homo sapiens
cgccctgggctctgggtt

SEQ ID NO: 4293362 - DNA, 14 bp, Homo sapiens
cgccgtgtctgtgg

SEQ ID NO: 4293363 - DNA, 17 bp, Homo sapiens
cgccgtgtctgtggccc

SEQ ID NO: 4293364 - DNA, 16 bp, Homo sapiens
cgcctctctcagccca

SEQ ID NO: 4293365 - DNA, 19 bp, Homo sapiens
cgcctctctcagcccaggt

SEQ ID NO: 4293366 - DNA, 23 bp, Homo sapiens
cgcctctctcagcccaggtctcc

SEQ ID NO: 4293367 - DNA, 14 bp, Homo sapiens
cgcctctgggctca

SEQ ID NO: 4293368 - DNA, 20 bp, Homo sapiens
cgcctggcagaactgagctc

SEQ ID NO: 4293369 - DNA, 12 bp, Homo sapiens
cgcctgtccttg

SEQ ID NO: 4293370 - DNA, 15 bp, Homo sapiens
cgccttcaggcacca

SEQ ID NO: 4293371 - DNA, 14 bp, Homo sapiens
cgccttcctgggtt

SEQ ID NO: 4293372 - DNA, 16 bp, Homo sapiens
cgcgcgcgcgcacaca

SEQ ID NO: 4293373 - DNA, 22 bp, Homo sapiens
cgctaaggcttccggctgagct

SEQ ID NO: 4293374 - DNA, 23 bp, Homo sapiens
cgctagatgggcatggggtgggc

SEQ ID NO: 4293375 - DNA, 20 bp, Homo sapiens
cgctatagttactgtcctgt

SEQ ID NO: 4293376 - DNA, 13 bp, Homo sapiens
cgctattcccagg

SEQ ID NO: 4293377 - DNA, 14 bp, Homo sapiens
cgctattcccaggc

SEQ ID NO: 4293378 - DNA, 16 bp, Homo sapiens
cgctattcccaggcag

SEQ ID NO: 4293379 - DNA, 16 bp, Homo sapiens
cgctcctctgccttgg

SEQ ID NO: 4293380 - DNA, 14 bp, Homo sapiens
cgctctctgtctgg

SEQ ID NO: 4293381 - DNA, 12 bp, Homo sapiens
cgctctgaggca

SEQ ID NO: 4293382 - DNA, 16 bp, Homo sapiens
cgctctgcatgctcct

SEQ ID NO: 4293383 - DNA, 15 bp, Homo sapiens
cgctctgccatcagc

SEQ ID NO: 4293384 - DNA, 19 bp, Homo sapiens
cgctctgccatcagcccct

SEQ ID NO: 4293385 - DNA, 13 bp, Homo sapiens
cgctcttcaccag

SEQ ID NO: 4293386 - DNA, 11 bp, Homo sapiens
cgctgcagggt

SEQ ID NO: 4293387 - DNA, 16 bp, Homo sapiens
cgctgcagtcagcaca

SEQ ID NO: 4293388 - DNA, 18 bp, Homo sapiens
cgctgcagtcagcacaga

SEQ ID NO: 4293389 - DNA, 12 bp, Homo sapiens
cgctgccctgca

SEQ ID NO: 4293390 - DNA, 14 bp, Homo sapiens
cgctgcgctgccct

SEQ ID NO: 4293391 - DNA, 17 bp, Homo sapiens
cgctgcgctgccctgca

SEQ ID NO: 4293392 - DNA, 20 bp, Homo sapiens
cgctgggagaaaagccagat

SEQ ID NO: 4293393 - DNA, 13 bp, Homo sapiens
cgctgggagagcc

SEQ ID NO: 4293394 - DNA, 22 bp, Homo sapiens
cgctggtgcccaccagctggct

SEQ ID NO: 4293395 - DNA, 14 bp, Homo sapiens
cgctgtctccagac

SEQ ID NO: 4293396 - DNA, 16 bp, Homo sapiens
cgctgtctccagaccc

SEQ ID NO: 4293397 - DNA, 22 bp, Homo sapiens
cgctgtctccagacccccaccc

SEQ ID NO: 4293398 - DNA, 14 bp, Homo sapiens
cgcttcgccatgtg

SEQ ID NO: 4293399 - DNA, 15 bp, Homo sapiens
cgcttcgccatgtgc

SEQ ID NO: 4293400 - DNA, 14 bp, Homo sapiens
cggaagtggcctga

SEQ ID NO: 4293401 - DNA, 20 bp, Homo sapiens
cggaagtggcctgagaagag

SEQ ID NO: 4293402 - DNA, 21 bp, Homo sapiens
cggaagtggcctgagaagagt

SEQ ID NO: 4293403 - DNA, 14 bp, Homo sapiens
cggacgccccccgg

SEQ ID NO: 4293404 - DNA, 18 bp, Homo sapiens
cggagcactgtgcagccg

SEQ ID NO: 4293405 - DNA, 18 bp, Homo sapiens
cggagctaacactggccc

SEQ ID NO: 4293406 - DNA, 19 bp, Homo sapiens
cggagctgggaaggtcccg

SEQ ID NO: 4293407 - DNA, 20 bp, Homo sapiens
cggaggcttgtcagagctgg

SEQ ID NO: 4293408 - DNA, 21 bp, Homo sapiens
cggaggcttgtcagagctggg

SEQ ID NO: 4293409 - DNA, 16 bp, Homo sapiens
cggaggggcctggcag

SEQ ID NO: 4293410 - DNA, 12 bp, Homo sapiens
cggatctccagg

SEQ ID NO: 4293411 - DNA, 20 bp, Homo sapiens
cggatctccaggcccagcct

SEQ ID NO: 4293412 - DNA, 21 bp, Homo sapiens
cggatctccaggcccagcctg

SEQ ID NO: 4293413 - DNA, 17 bp, Homo sapiens
cggcagccaccctgcca

SEQ ID NO: 4293414 - DNA, 18 bp, Homo sapiens
cggcagccaccctgccat

SEQ ID NO: 4293415 - DNA, 12 bp, Homo sapiens
cggcatgtttcc

SEQ ID NO: 4293416 - DNA, 15 bp, Homo sapiens
cggccactctgtttg

SEQ ID NO: 4293417 - DNA, 16 bp, Homo sapiens
cggccagagctcccag

SEQ ID NO: 4293418 - DNA, 20 bp, Homo sapiens
cggccccacccaccctctgg

SEQ ID NO: 4293419 - DNA, 17 bp, Homo sapiens
cggcccccgccctctgc

SEQ ID NO: 4293420 - DNA, 14 bp, Homo sapiens
cggccgcctgtcct

SEQ ID NO: 4293421 - DNA, 14 bp, Homo sapiens
cggcctctggggag

SEQ ID NO: 4293422 - DNA, 21 bp, Homo sapiens
cggcctggggccgggctggct

SEQ ID NO: 4293423 - DNA, 22 bp, Homo sapiens
cggcctggggccgggctggctt

SEQ ID NO: 4293424 - DNA, 19 bp, Homo sapiens
cggcgtccctgagggccct

SEQ ID NO: 4293425 - DNA, 23 bp, Homo sapiens
cggcgtccctgagggcccttccc

SEQ ID NO: 4293426 - DNA, 18 bp, Homo sapiens
cggctgcacctgcaggga

SEQ ID NO: 4293427 - DNA, 21 bp, Homo sapiens
cggctgcacctgcagggagca

SEQ ID NO: 4293428 - DNA, 16 bp, Homo sapiens
cggctgggagcctcgc

SEQ ID NO: 4293429 - DNA, 19 bp, Homo sapiens
cggctgtgtggggagggtg

SEQ ID NO: 4293430 - DNA, 21 bp, Homo sapiens
cggcttccccatcgccttctg

SEQ ID NO: 4293431 - DNA, 22 bp, Homo sapiens
cgggaaagccagtgactccagg

SEQ ID NO: 4293432 - DNA, 23 bp, Homo sapiens
cgggaagatcctccttccaggcc

SEQ ID NO: 4293433 - DNA, 15 bp, Homo sapiens
cgggagatccgccct

SEQ ID NO: 4293434 - DNA, 17 bp, Homo sapiens
cgggagatccgccctgg

SEQ ID NO: 4293435 - DNA, 22 bp, Homo sapiens
cgggagcagttgacctttgcca

SEQ ID NO: 4293436 - DNA, 23 bp, Homo sapiens
cgggaggccacgggggaggccga

SEQ ID NO: 4293437 - DNA, 21 bp, Homo sapiens
cgggagggacagtctggaggt

SEQ ID NO: 4293438 - DNA, 20 bp, Homo sapiens
cgggagtgtgggggtgccat

SEQ ID NO: 4293439 - DNA, 13 bp, Homo sapiens
cgggctggcttct

SEQ ID NO: 4293440 - DNA, 16 bp, Homo sapiens
cggggagcccccgccc

SEQ ID NO: 4293441 - DNA, 13 bp, Homo sapiens
cggggagctgagg

SEQ ID NO: 4293442 - DNA, 14 bp, Homo sapiens
cggggagctgaggg

SEQ ID NO: 4293443 - DNA, 15 bp, Homo sapiens
cggggagctgagggg

SEQ ID NO: 4293444 - DNA, 13 bp, Homo sapiens
cggggaggccaag

SEQ ID NO: 4293445 - DNA, 19 bp, Homo sapiens
cggggaggccaagtgcagg

SEQ ID NO: 4293446 - DNA, 21 bp, Homo sapiens
cggggaggccaagtgcaggct

SEQ ID NO: 4293447 - DNA, 23 bp, Homo sapiens
cggggaggccaagtgcaggctgg

SEQ ID NO: 4293448 - DNA, 19 bp, Homo sapiens
cggggcatggacagggcca

SEQ ID NO: 4293449 - DNA, 22 bp, Homo sapiens
cggggcatggacagggccaggg

SEQ ID NO: 4293450 - DNA, 13 bp, Homo sapiens
cggggctggccag

SEQ ID NO: 4293451 - DNA, 16 bp, Homo sapiens
cggggctggccagctg

SEQ ID NO: 4293452 - DNA, 17 bp, Homo sapiens
cggggctggccagctgt

SEQ ID NO: 4293453 - DNA, 20 bp, Homo sapiens
cgggggaggccgaggcaggg

SEQ ID NO: 4293454 - DNA, 19 bp, Homo sapiens
cgggggcctagtggcttca

SEQ ID NO: 4293455 - DNA, 20 bp, Homo sapiens
cgggggtgggggcctgctgt

SEQ ID NO: 4293456 - DNA, 16 bp, Homo sapiens
cggggtcctgaggctg

SEQ ID NO: 4293457 - DNA, 19 bp, Homo sapiens
cggggtcctgaggctgggg

SEQ ID NO: 4293458 - DNA, 17 bp, Homo sapiens
cgggtaaaaagagaagg

SEQ ID NO: 4293459 - DNA, 14 bp, Homo sapiens
cggtatccagaggt

SEQ ID NO: 4293460 - DNA, 14 bp, Homo sapiens
cggtcaataattgt

SEQ ID NO: 4293461 - DNA, 23 bp, Homo sapiens
cgtaaaggtttatttttctgtta

SEQ ID NO: 4293462 - DNA, 13 bp, Homo sapiens
cgtagggccaggg

SEQ ID NO: 4293463 - DNA, 16 bp, Homo sapiens
cgtagggccagggctc

SEQ ID NO: 4293464 - DNA, 19 bp, Homo sapiens
cgtattgtgaaatttgtta

SEQ ID NO: 4293465 - DNA, 14 bp, Homo sapiens
cgtcagcctgtgaa

SEQ ID NO: 4293466 - DNA, 15 bp, Homo sapiens
cgtcaggaggtgcct

SEQ ID NO: 4293467 - DNA, 16 bp, Homo sapiens
cgtcaggaggtgcctg

SEQ ID NO: 4293468 - DNA, 18 bp, Homo sapiens
cgtccacccgtttccaag

SEQ ID NO: 4293469 - DNA, 12 bp, Homo sapiens
cgtccctctccc

SEQ ID NO: 4293470 - DNA, 18 bp, Homo sapiens
cgtccctgagggcccttc

SEQ ID NO: 4293471 - DNA, 19 bp, Homo sapiens
cgtccctgagggcccttcc

SEQ ID NO: 4293472 - DNA, 22 bp, Homo sapiens
cgtccctgagggcccttcccaa

SEQ ID NO: 4293473 - DNA, 17 bp, Homo sapiens
cgtccctttccctgcat

SEQ ID NO: 4293474 - DNA, 15 bp, Homo sapiens
cgtctccctggccac

SEQ ID NO: 4293475 - DNA, 17 bp, Homo sapiens
cgtctgagcggccgcct

SEQ ID NO: 4293476 - DNA, 21 bp, Homo sapiens
cgtgagagcccaatcactgcc

SEQ ID NO: 4293477 - DNA, 13 bp, Homo sapiens
cgtgcacacacct

SEQ ID NO: 4293478 - DNA, 19 bp, Homo sapiens
cgtgcacggggccagcatc

SEQ ID NO: 4293479 - DNA, 12 bp, Homo sapiens
cgtgcatttgtg

SEQ ID NO: 4293480 - DNA, 13 bp, Homo sapiens
cgtgcatttgtga

SEQ ID NO: 4293481 - DNA, 15 bp, Homo sapiens
cgtgcatttgtgagc

SEQ ID NO: 4293482 - DNA, 17 bp, Homo sapiens
cgtgccacgcgctctgc

SEQ ID NO: 4293483 - DNA, 18 bp, Homo sapiens
cgtgccacgcgctctgca

SEQ ID NO: 4293484 - DNA, 20 bp, Homo sapiens
cgtgccacgcgctctgcatg

SEQ ID NO: 4293485 - DNA, 17 bp, Homo sapiens
cgtgctctctgctggat

SEQ ID NO: 4293486 - DNA, 15 bp, Homo sapiens
cgtggaaagggtgct

SEQ ID NO: 4293487 - DNA, 12 bp, Homo sapiens
cgtggagccaca

SEQ ID NO: 4293488 - DNA, 17 bp, Homo sapiens
cgtggagccacaggcag

SEQ ID NO: 4293489 - DNA, 22 bp, Homo sapiens
cgtggaggaatgctcccccatc

SEQ ID NO: 4293490 - DNA, 15 bp, Homo sapiens
cgtggagtcgagctg

SEQ ID NO: 4293491 - DNA, 20 bp, Homo sapiens
cgtggctcccagcagaggcc

SEQ ID NO: 4293492 - DNA, 18 bp, Homo sapiens
cgtggcttcccgctcagc

SEQ ID NO: 4293493 - DNA, 20 bp, Homo sapiens
cgtggcttcccgctcagccc

SEQ ID NO: 4293494 - DNA, 14 bp, Homo sapiens
cgtgggatccagag

SEQ ID NO: 4293495 - DNA, 15 bp, Homo sapiens
cgtgtactaccccag

SEQ ID NO: 4293496 - DNA, 17 bp, Homo sapiens
cgtgtccgactcttctg

SEQ ID NO: 4293497 - DNA, 16 bp, Homo sapiens
cgtgtctgtggccctc

SEQ ID NO: 4293498 - DNA, 17 bp, Homo sapiens
cgtgtcttgtgttgctg

SEQ ID NO: 4293499 - DNA, 16 bp, Homo sapiens
cgtgtgctccagtgtt

SEQ ID NO: 4293500 - DNA, 23 bp, Homo sapiens
cgtgtgttgccattttgtctggc

SEQ ID NO: 4293501 - DNA, 18 bp, Homo sapiens
cgttgcctctctgccagc

SEQ ID NO: 4293502 - DNA, 15 bp, Homo sapiens
cgttgttgtccctgc

SEQ ID NO: 4293503 - DNA, 10 bp, Homo sapiens
cgtttccaag

SEQ ID NO: 4293504 - DNA, 16 bp, Homo sapiens
ctaaaaaataactgtg

SEQ ID NO: 4293505 - DNA, 22 bp, Homo sapiens
ctaaaaaataactgtgcactat

SEQ ID NO: 4293506 - DNA, 23 bp, Homo sapiens
ctaaaacattctttaacatacat

SEQ ID NO: 4293507 - DNA, 23 bp, Homo sapiens
ctaaaaccttccatgtcaagatt

SEQ ID NO: 4293508 - DNA, 12 bp, Homo sapiens
ctaaaaggagga

SEQ ID NO: 4293509 - DNA, 12 bp, Homo sapiens
ctaaaatgcttc

SEQ ID NO: 4293510 - DNA, 13 bp, Homo sapiens
ctaaaatgcttca

SEQ ID NO: 4293511 - DNA, 17 bp, Homo sapiens
ctaaaattcaacaaatg

SEQ ID NO: 4293512 - DNA, 19 bp, Homo sapiens
ctaaaattcaacaaatgat

SEQ ID NO: 4293513 - DNA, 19 bp, Homo sapiens
ctaaaattgagttcttcct

SEQ ID NO: 4293514 - DNA, 15 bp, Homo sapiens
ctaaaccattgtgca

SEQ ID NO: 4293515 - DNA, 14 bp, Homo sapiens
ctaaactgttttca

SEQ ID NO: 4293516 - DNA, 22 bp, Homo sapiens
ctaaagatggcgcacccggcag

SEQ ID NO: 4293517 - DNA, 18 bp, Homo sapiens
ctaaagggtgtgggtcag

SEQ ID NO: 4293518 - DNA, 21 bp, Homo sapiens
ctaaagttagggcatttttct

SEQ ID NO: 4293519 - DNA, 15 bp, Homo sapiens
ctaaatatgaaattt

SEQ ID NO: 4293520 - DNA, 19 bp, Homo sapiens
ctaaatccattttctaaac

SEQ ID NO: 4293521 - DNA, 12 bp, Homo sapiens
ctaaatgcaaag

SEQ ID NO: 4293522 - DNA, 17 bp, Homo sapiens
ctaaatgcctaataaac

SEQ ID NO: 4293523 - DNA, 14 bp, Homo sapiens
ctaaatgttcatgt

SEQ ID NO: 4293524 - DNA, 12 bp, Homo sapiens
ctaaatgtttct

SEQ ID NO: 4293525 - DNA, 13 bp, Homo sapiens
ctaacacatttcg

SEQ ID NO: 4293526 - DNA, 14 bp, Homo sapiens
ctaacactggcccc

SEQ ID NO: 4293527 - DNA, 15 bp, Homo sapiens
ctaacactggcccct

SEQ ID NO: 4293528 - DNA, 19 bp, Homo sapiens
ctaaccagttctctttgta

SEQ ID NO: 4293529 - DNA, 16 bp, Homo sapiens
ctaactgtatatttgt

SEQ ID NO: 4293530 - DNA, 20 bp, Homo sapiens
ctaagaaatatctgtgaaat

SEQ ID NO: 4293531 - DNA, 21 bp, Homo sapiens
ctaagaaatatctgtgaaata

SEQ ID NO: 4293532 - DNA, 11 bp, Homo sapiens
ctaagcctgga

SEQ ID NO: 4293533 - DNA, 18 bp, Homo sapiens
ctaagcctggacacagtc

SEQ ID NO: 4293534 - DNA, 12 bp, Homo sapiens
ctaagcttattt

SEQ ID NO: 4293535 - DNA, 15 bp, Homo sapiens
ctaagcttatttcta

SEQ ID NO: 4293536 - DNA, 16 bp, Homo sapiens
ctaagcttatttctaa

SEQ ID NO: 4293537 - DNA, 17 bp, Homo sapiens
ctaagtcaacttagcat

SEQ ID NO: 4293538 - DNA, 21 bp, Homo sapiens
ctaagtgactaccacttattt

SEQ ID NO: 4293539 - DNA, 20 bp, Homo sapiens
ctaatcagcattctcactcc

SEQ ID NO: 4293540 - DNA, 18 bp, Homo sapiens
ctaatccatgtgctgctg

SEQ ID NO: 4293541 - DNA, 16 bp, Homo sapiens
ctaatgagctttgggc

SEQ ID NO: 4293542 - DNA, 21 bp, Homo sapiens
ctaatggattataatcagaat

SEQ ID NO: 4293543 - DNA, 21 bp, Homo sapiens
cctggcagccgtgccttcagc

SEQ ID NO: 4293544 - DNA, 18 bp, Homo sapiens
cctggcagggcaggcaga

SEQ ID NO: 4293545 - DNA, 14 bp, Homo sapiens
cctggccacccttg

SEQ ID NO: 4293546 - DNA, 15 bp, Homo sapiens
cctggcccagccagc

SEQ ID NO: 4293547 - DNA, 16 bp, Homo sapiens
cctggcccagccagca

SEQ ID NO: 4293548 - DNA, 13 bp, Homo sapiens
cctggcccagcct

SEQ ID NO: 4293549 - DNA, 22 bp, Homo sapiens
cctggcccagtgagagtgaggc

SEQ ID NO: 4293550 - DNA, 18 bp, Homo sapiens
cctggcccctcccacatc

SEQ ID NO: 4293551 - DNA, 19 bp, Homo sapiens
cctggccctttcacccctc

SEQ ID NO: 4293552 - DNA, 13 bp, Homo sapiens
cctggctcacagc

SEQ ID NO: 4293553 - DNA, 16 bp, Homo sapiens
cctggctcacagccac

SEQ ID NO: 4293554 - DNA, 23 bp, Homo sapiens
cctggctcccacaggcccttcct

SEQ ID NO: 4293555 - DNA, 14 bp, Homo sapiens
cctggcttcccagg

SEQ ID NO: 4293556 - DNA, 16 bp, Homo sapiens
cctggcttcccaggac

SEQ ID NO: 4293557 - DNA, 18 bp, Homo sapiens
cctggcttcccaggaccc

SEQ ID NO: 4293558 - DNA, 20 bp, Homo sapiens
cctggcttttcactgctggc

SEQ ID NO: 4293559 - DNA, 22 bp, Homo sapiens
cctggcttttcactgctggctg

SEQ ID NO: 4293560 - DNA, 24 bp, Homo sapiens
cctggcttttcactgctggctgcc

SEQ ID NO: 4293561 - DNA, 17 bp, Homo sapiens
cctgggcacctggggag

SEQ ID NO: 4293562 - DNA, 19 bp, Homo sapiens
cctgggcatctggccctgc

SEQ ID NO: 4293563 - DNA, 20 bp, Homo sapiens
cctgggcatctggccctgct

SEQ ID NO: 4293564 - DNA, 22 bp, Homo sapiens
cctgggcatctggccctgctgc

SEQ ID NO: 4293565 - DNA, 17 bp, Homo sapiens
cctgggcatgtccccag

SEQ ID NO: 4293566 - DNA, 19 bp, Homo sapiens
cctgggcatgtccccagtg

SEQ ID NO: 4293567 - DNA, 21 bp, Homo sapiens
cctgggcatgtccccagtgtg

SEQ ID NO: 4293568 - DNA, 14 bp, Homo sapiens
cctgggccactggc

SEQ ID NO: 4293569 - DNA, 14 bp, Homo sapiens
cctgggccagggtc

SEQ ID NO: 4293570 - DNA, 15 bp, Homo sapiens
cctgggccagggtct

SEQ ID NO: 4293571 - DNA, 16 bp, Homo sapiens
cctgggccccctggga

SEQ ID NO: 4293572 - DNA, 20 bp, Homo sapiens
cctgggccccctgggagagt

SEQ ID NO: 4293573 - DNA, 12 bp, Homo sapiens
cctgggccctgg

SEQ ID NO: 4293574 - DNA, 13 bp, Homo sapiens
cctgggccctggt

SEQ ID NO: 4293575 - DNA, 12 bp, Homo sapiens
cctgggctctgg

SEQ ID NO: 4293576 - DNA, 15 bp, Homo sapiens
cctgggctggcatgg

SEQ ID NO: 4293577 - DNA, 18 bp, Homo sapiens
cctgggctggcatgggga

SEQ ID NO: 4293578 - DNA, 24 bp, Homo sapiens
cctggggacggagcactgtgcagc

SEQ ID NO: 4293579 - DNA, 23 bp, Homo sapiens
cctggggagtgggacagagtctg

SEQ ID NO: 4293580 - DNA, 24 bp, Homo sapiens
cctggggagtgggacagagtctgg

SEQ ID NO: 4293581 - DNA, 13 bp, Homo sapiens
cctggggggggca

SEQ ID NO: 4293582 - DNA, 15 bp, Homo sapiens
cctggggggggcaag

SEQ ID NO: 4293583 - DNA, 16 bp, Homo sapiens
cctggggtacttctgt

SEQ ID NO: 4293584 - DNA, 15 bp, Homo sapiens
cctggggtggaggct

SEQ ID NO: 4293585 - DNA, 17 bp, Homo sapiens
cctggggtttccacaca

SEQ ID NO: 4293586 - DNA, 15 bp, Homo sapiens
cctgggtcaccttcc

SEQ ID NO: 4293587 - DNA, 19 bp, Homo sapiens
cctgggtcaccttcctggg

SEQ ID NO: 4293588 - DNA, 17 bp, Homo sapiens
cctgggtgtgctccagg

SEQ ID NO: 4293589 - DNA, 18 bp, Homo sapiens
cctgggtgtgctccaggc

SEQ ID NO: 4293590 - DNA, 21 bp, Homo sapiens
cctgggtgtgctccaggcttc

SEQ ID NO: 4293591 - DNA, 14 bp, Homo sapiens
cctggtcctgcact

SEQ ID NO: 4293592 - DNA, 20 bp, Homo sapiens
cctggtctggagcccctatc

SEQ ID NO: 4293593 - DNA, 15 bp, Homo sapiens
cctggtgaaagagta

SEQ ID NO: 4293594 - DNA, 18 bp, Homo sapiens
cctggtgccctggcccag

SEQ ID NO: 4293595 - DNA, 18 bp, Homo sapiens
cctggtgctgccacactt

SEQ ID NO: 4293596 - DNA, 15 bp, Homo sapiens
cctggtgtccctgcc

SEQ ID NO: 4293597 - DNA, 19 bp, Homo sapiens
cctggtgtccctgcctggc

SEQ ID NO: 4293598 - DNA, 20 bp, Homo sapiens
cctggtgtccctgcctggcc

SEQ ID NO: 4293599 - DNA, 16 bp, Homo sapiens
cctggttatgagccga

SEQ ID NO: 4293600 - DNA, 20 bp, Homo sapiens
cctggttcccccaggaccct

SEQ ID NO: 4293601 - DNA, 18 bp, Homo sapiens
cctggttctccatcccca

SEQ ID NO: 4293602 - DNA, 19 bp, Homo sapiens
cctgtaatagcctcacctt

SEQ ID NO: 4293603 - DNA, 16 bp, Homo sapiens
cctgtcagtgcagccc

SEQ ID NO: 4293604 - DNA, 16 bp, Homo sapiens
cctgtccacctgtgct

SEQ ID NO: 4293605 - DNA, 16 bp, Homo sapiens
cctgtccctctcaggc

SEQ ID NO: 4293606 - DNA, 22 bp, Homo sapiens
cctgtccctctcaggcatgcct

SEQ ID NO: 4293607 - DNA, 12 bp, Homo sapiens
cctgtcctggct

SEQ ID NO: 4293608 - DNA, 16 bp, Homo sapiens
cctgtcctggctccca

SEQ ID NO: 4293609 - DNA, 22 bp, Homo sapiens
cctgtccttcccacggccactg

SEQ ID NO: 4293610 - DNA, 23 bp, Homo sapiens
cctgtctgaaaccagaagactgg

SEQ ID NO: 4293611 - DNA, 20 bp, Homo sapiens
cctgtgaccggggtcctgag

SEQ ID NO: 4293612 - DNA, 23 bp, Homo sapiens
cctgtgaccggggtcctgaggct

SEQ ID NO: 4293613 - DNA, 15 bp, Homo sapiens
cctgtgagctcccca

SEQ ID NO: 4293614 - DNA, 20 bp, Homo sapiens
cctgtgagctccccaatcca

SEQ ID NO: 4293615 - DNA, 14 bp, Homo sapiens
cctgtgaggggaaa

SEQ ID NO: 4293616 - DNA, 12 bp, Homo sapiens
cctgtgcacagc

SEQ ID NO: 4293617 - DNA, 14 bp, Homo sapiens
cctgtgcccgctgc

SEQ ID NO: 4293618 - DNA, 18 bp, Homo sapiens
cctgtgcccgctgcgctg

SEQ ID NO: 4293619 - DNA, 14 bp, Homo sapiens
cctgtggcctcagc

SEQ ID NO: 4293620 - DNA, 15 bp, Homo sapiens
cctgtggcggtgcag

SEQ ID NO: 4293621 - DNA, 14 bp, Homo sapiens
cctgtgggagaagg

SEQ ID NO: 4293622 - DNA, 15 bp, Homo sapiens
cctgtgggagaaggg

SEQ ID NO: 4293623 - DNA, 16 bp, Homo sapiens
cctgtgttagtgtctg

SEQ ID NO: 4293624 - DNA, 22 bp, Homo sapiens
cctgttacttaaatagcatctg

SEQ ID NO: 4293625 - DNA, 18 bp, Homo sapiens
cctgttaggggaaaatag

SEQ ID NO: 4293626 - DNA, 13 bp, Homo sapiens
cctgttctcagag

SEQ ID NO: 4293627 - DNA, 15 bp, Homo sapiens
cctgttctcagagct

SEQ ID NO: 4293628 - DNA, 19 bp, Homo sapiens
cctgttttattgagttctg

SEQ ID NO: 4293629 - DNA, 19 bp, Homo sapiens
ccttaaacagttgcacagc

SEQ ID NO: 4293630 - DNA, 20 bp, Homo sapiens
ccttaaacagttgcacagca

SEQ ID NO: 4293631 - DNA, 15 bp, Homo sapiens
ccttaagaaagctat

SEQ ID NO: 4293632 - DNA, 14 bp, Homo sapiens
ccttaagtggctgt

SEQ ID NO: 4293633 - DNA, 12 bp, Homo sapiens
ccttaatatttc

SEQ ID NO: 4293634 - DNA, 19 bp, Homo sapiens
ccttacaaccacatttctg

SEQ ID NO: 4293635 - DNA, 20 bp, Homo sapiens
ccttacaaccacatttctgg

SEQ ID NO: 4293636 - DNA, 20 bp, Homo sapiens
ccttagaaaagactgacctt

SEQ ID NO: 4293637 - DNA, 16 bp, Homo sapiens
ccttagactccttctc

SEQ ID NO: 4293638 - DNA, 21 bp, Homo sapiens
ccttcagcatcctcagttcct

SEQ ID NO: 4293639 - DNA, 12 bp, Homo sapiens
ccttccaggccc

SEQ ID NO: 4293640 - DNA, 19 bp, Homo sapiens
ccttccaggccccaggctg

SEQ ID NO: 4293641 - DNA, 20 bp, Homo sapiens
ccttccaggccccaggctgg

SEQ ID NO: 4293642 - DNA, 24 bp, Homo sapiens
ccttccaggcgtagggccagggct

SEQ ID NO: 4293643 - DNA, 14 bp, Homo sapiens
ccttcccaccccta

SEQ ID NO: 4293644 - DNA, 18 bp, Homo sapiens
ccttcccacggccactgc

SEQ ID NO: 4293645 - DNA, 11 bp, Homo sapiens
ccttccccact

SEQ ID NO: 4293646 - DNA, 14 bp, Homo sapiens
ccttccccactccc

SEQ ID NO: 4293647 - DNA, 12 bp, Homo sapiens
ccttccccactg

SEQ ID NO: 4293648 - DNA, 22 bp, Homo sapiens
ccttccccactgcctgcccacc

SEQ ID NO: 4293649 - DNA, 19 bp, Homo sapiens
ccttccccctccaatccca

SEQ ID NO: 4293650 - DNA, 19 bp, Homo sapiens
ccttccctccacctgcttg

SEQ ID NO: 4293651 - DNA, 12 bp, Homo sapiens
ccttccctgcaa

SEQ ID NO: 4293652 - DNA, 15 bp, Homo sapiens
ccttccgctctgagg

SEQ ID NO: 4293653 - DNA, 14 bp, Homo sapiens
ccttcctctccact

SEQ ID NO: 4293654 - DNA, 20 bp, Homo sapiens
ccttcctctccactgccttc

SEQ ID NO: 4293655 - DNA, 18 bp, Homo sapiens
ccttcctgggcagcccag

SEQ ID NO: 4293656 - DNA, 19 bp, Homo sapiens
ccttcctgggcagcccaga

SEQ ID NO: 4293657 - DNA, 20 bp, Homo sapiens
ccttcctgggcagcccagag

SEQ ID NO: 4293658 - DNA, 20 bp, Homo sapiens
ccttcctgttctgtgtctgc

SEQ ID NO: 4293659 - DNA, 19 bp, Homo sapiens
ccttctacctgcaggactc

SEQ ID NO: 4293660 - DNA, 12 bp, Homo sapiens
ccttctccacag

SEQ ID NO: 4293661 - DNA, 16 bp, Homo sapiens
ccttctcccacactgc

SEQ ID NO: 4293662 - DNA, 16 bp, Homo sapiens
ccttctcccctccaga

SEQ ID NO: 4293663 - DNA, 20 bp, Homo sapiens
ccttctctcagcctccactc

SEQ ID NO: 4293664 - DNA, 13 bp, Homo sapiens
ccttctctgttca

SEQ ID NO: 4293665 - DNA, 17 bp, Homo sapiens
ccttctctgttcatttc

SEQ ID NO: 4293666 - DNA, 19 bp, Homo sapiens
ccttctctgttcatttcct

SEQ ID NO: 4293667 - DNA, 21 bp, Homo sapiens
ccttctctgttcatttcctca

SEQ ID NO: 4293668 - DNA, 21 bp, Homo sapiens
ccttctgatgaaatgttaaca

SEQ ID NO: 4293669 - DNA, 14 bp, Homo sapiens
ccttctgcggagct

SEQ ID NO: 4293670 - DNA, 12 bp, Homo sapiens
ccttctgggaaa

SEQ ID NO: 4293671 - DNA, 20 bp, Homo sapiens
ccttctggggaggggctccg

SEQ ID NO: 4293672 - DNA, 21 bp, Homo sapiens
ccttctggggaggggctccgt

SEQ ID NO: 4293673 - DNA, 14 bp, Homo sapiens
ccttctgtggctca

SEQ ID NO: 4293674 - DNA, 18 bp, Homo sapiens
ccttgaaaccagctcagg

SEQ ID NO: 4293675 - DNA, 18 bp, Homo sapiens
ccttgagccgtgacctcc

SEQ ID NO: 4293676 - DNA, 18 bp, Homo sapiens
ccttgcaacacacagaca

SEQ ID NO: 4293677 - DNA, 19 bp, Homo sapiens
ctaatgtaatcatttatct

SEQ ID NO: 4293678 - DNA, 21 bp, Homo sapiens
ctaatgtaatcatttatctta

SEQ ID NO: 4293679 - DNA, 10 bp, Homo sapiens
ctacaaacat

SEQ ID NO: 4293680 - DNA, 14 bp, Homo sapiens
ctacaactgagtcc

SEQ ID NO: 4293681 - DNA, 22 bp, Homo sapiens
ctacaatatcattttcctggga

SEQ ID NO: 4293682 - DNA, 22 bp, Homo sapiens
ctacagctaatcagcattctca

SEQ ID NO: 4293683 - DNA, 15 bp, Homo sapiens
ctacagtagctgtgg

SEQ ID NO: 4293684 - DNA, 23 bp, Homo sapiens
ctacccgcccgcgtccaaccccg

SEQ ID NO: 4293685 - DNA, 16 bp, Homo sapiens
ctacccggctcgttcc

SEQ ID NO: 4293686 - DNA, 21 bp, Homo sapiens
ctacccggctcgttcccccag

SEQ ID NO: 4293687 - DNA, 13 bp, Homo sapiens
ctaccctttccca

SEQ ID NO: 4293688 - DNA, 19 bp, Homo sapiens
ctaccctttcccaaaccct

SEQ ID NO: 4293689 - DNA, 21 bp, Homo sapiens
ctaccgagtctcttctccact

SEQ ID NO: 4293690 - DNA, 16 bp, Homo sapiens
ctacctggtctctcct

SEQ ID NO: 4293691 - DNA, 21 bp, Homo sapiens
ctacctttggcttaattccaa

SEQ ID NO: 4293692 - DNA, 19 bp, Homo sapiens
ctacgatgggatcattatt

SEQ ID NO: 4293693 - DNA, 17 bp, Homo sapiens
ctactaagaataaataa

SEQ ID NO: 4293694 - DNA, 17 bp, Homo sapiens
ctacttagcatgtccct

SEQ ID NO: 4293695 - DNA, 14 bp, Homo sapiens
ctactttcctgatg

SEQ ID NO: 4293696 - DNA, 20 bp, Homo sapiens
ctactttggtttctgtctgt

SEQ ID NO: 4293697 - DNA, 16 bp, Homo sapiens
ctagaagagtctattg

SEQ ID NO: 4293698 - DNA, 22 bp, Homo sapiens
ctagaatcagcctaggggtcag

SEQ ID NO: 4293699 - DNA, 13 bp, Homo sapiens
ctagaatggaagc

SEQ ID NO: 4293700 - DNA, 22 bp, Homo sapiens
ctagaatggaagcctccacctg

SEQ ID NO: 4293701 - DNA, 15 bp, Homo sapiens
ctagacaaccctgca

SEQ ID NO: 4293702 - DNA, 12 bp, Homo sapiens
ctagactgggct

SEQ ID NO: 4293703 - DNA, 16 bp, Homo sapiens
ctagagaaattcttgt

SEQ ID NO: 4293704 - DNA, 17 bp, Homo sapiens
ctagagatattttgtaa

SEQ ID NO: 4293705 - DNA, 18 bp, Homo sapiens
ctagagatattttgtaaa

SEQ ID NO: 4293706 - DNA, 13 bp, Homo sapiens
ctagagcattctg

SEQ ID NO: 4293707 - DNA, 20 bp, Homo sapiens
ctagagcattctggggtggg

SEQ ID NO: 4293708 - DNA, 23 bp, Homo sapiens
ctagagcattctggggtggggct

SEQ ID NO: 4293709 - DNA, 22 bp, Homo sapiens
ctagaggaggaaaaaggctggt

SEQ ID NO: 4293710 - DNA, 21 bp, Homo sapiens
ctagaggcttccttcatttcc

SEQ ID NO: 4293711 - DNA, 21 bp, Homo sapiens
ctagattcatggctttaacag

SEQ ID NO: 4293712 - DNA, 21 bp, Homo sapiens
ctagcaaacagatgtttgttt

SEQ ID NO: 4293713 - DNA, 13 bp, Homo sapiens
ctagcaagaagat

SEQ ID NO: 4293714 - DNA, 18 bp, Homo sapiens
ctagcaagaagattctaa

SEQ ID NO: 4293715 - DNA, 19 bp, Homo sapiens
ctagcacaaggagtgcccg

SEQ ID NO: 4293716 - DNA, 17 bp, Homo sapiens
ctagcagtttgcctctg

SEQ ID NO: 4293717 - DNA, 19 bp, Homo sapiens
ctagcagtttgcctctgca

SEQ ID NO: 4293718 - DNA, 12 bp, Homo sapiens
ctagccaggcct

SEQ ID NO: 4293719 - DNA, 14 bp, Homo sapiens
ctagccaggcctcc

SEQ ID NO: 4293720 - DNA, 15 bp, Homo sapiens
ctagccaggcctccc

SEQ ID NO: 4293721 - DNA, 17 bp, Homo sapiens
ctagccaggcctcccgc

SEQ ID NO: 4293722 - DNA, 17 bp, Homo sapiens
ctagctataacaactct

SEQ ID NO: 4293723 - DNA, 21 bp, Homo sapiens
ctaggagcagtgggccctggc

SEQ ID NO: 4293724 - DNA, 22 bp, Homo sapiens
ctaggagcagtgggccctggct

SEQ ID NO: 4293725 - DNA, 23 bp, Homo sapiens
ctaggagcagtgggccctggctc

SEQ ID NO: 4293726 - DNA, 12 bp, Homo sapiens
ctaggagctggg

SEQ ID NO: 4293727 - DNA, 20 bp, Homo sapiens
ctaggcatactctccaggat

SEQ ID NO: 4293728 - DNA, 12 bp, Homo sapiens
ctaggccagctc

SEQ ID NO: 4293729 - DNA, 15 bp, Homo sapiens
ctaggccctggtctg

SEQ ID NO: 4293730 - DNA, 16 bp, Homo sapiens
ctaggccctggtctgg

SEQ ID NO: 4293731 - DNA, 19 bp, Homo sapiens
ctaggccctggtctggctt

SEQ ID NO: 4293732 - DNA, 23 bp, Homo sapiens
ctaggggccgagggaaatgctgt

SEQ ID NO: 4293733 - DNA, 14 bp, Homo sapiens
ctagggggaagtga

SEQ ID NO: 4293734 - DNA, 15 bp, Homo sapiens
ctagggtcctcaggc

SEQ ID NO: 4293735 - DNA, 20 bp, Homo sapiens
ctagggtcctcaggcagtgg

SEQ ID NO: 4293736 - DNA, 21 bp, Homo sapiens
ctagggtcctcaggcagtggc

SEQ ID NO: 4293737 - DNA, 14 bp, Homo sapiens
ctagggtgagggtg

SEQ ID NO: 4293738 - DNA, 17 bp, Homo sapiens
ctaggtctccacccctc

SEQ ID NO: 4293739 - DNA, 18 bp, Homo sapiens
ctaggtgcccagtcttga

SEQ ID NO: 4293740 - DNA, 20 bp, Homo sapiens
ctaggtgctggcatgtctgg

SEQ ID NO: 4293741 - DNA, 23 bp, Homo sapiens
ctaggtgggccagcccctcccac

SEQ ID NO: 4293742 - DNA, 22 bp, Homo sapiens
ctaggtgggtcaactccaaggc

SEQ ID NO: 4293743 - DNA, 17 bp, Homo sapiens
ctaggttaataggagga

SEQ ID NO: 4293744 - DNA, 18 bp, Homo sapiens
ctagtcaactgctgtttt

SEQ ID NO: 4293745 - DNA, 23 bp, Homo sapiens
ctagtctctgatttgcaaatgca

SEQ ID NO: 4293746 - DNA, 14 bp, Homo sapiens
ctagtggcttcagc

SEQ ID NO: 4293747 - DNA, 16 bp, Homo sapiens
ctagttagcaggaaat

SEQ ID NO: 4293748 - DNA, 20 bp, Homo sapiens
ctagttagcaggaaatagtg

SEQ ID NO: 4293749 - DNA, 18 bp, Homo sapiens
ctataaacattaaaagaa

SEQ ID NO: 4293750 - DNA, 21 bp, Homo sapiens
ctataaattcaacacttattt

SEQ ID NO: 4293751 - DNA, 22 bp, Homo sapiens
ctataaattcaacacttatttt

SEQ ID NO: 4293752 - DNA, 14 bp, Homo sapiens
ctataatgtgaaat

SEQ ID NO: 4293753 - DNA, 21 bp, Homo sapiens
ctataccctaggtctccaccc

SEQ ID NO: 4293754 - DNA, 22 bp, Homo sapiens
ctataccctaggtctccacccc

SEQ ID NO: 4293755 - DNA, 16 bp, Homo sapiens
ctatactggttatagt

SEQ ID NO: 4293756 - DNA, 13 bp, Homo sapiens
ctatagttactgt

SEQ ID NO: 4293757 - DNA, 13 bp, Homo sapiens
ctatatatacatg

SEQ ID NO: 4293758 - DNA, 16 bp, Homo sapiens
ctatatatacatgtat

SEQ ID NO: 4293759 - DNA, 22 bp, Homo sapiens
ctatatatgaataattatgttt

SEQ ID NO: 4293760 - DNA, 23 bp, Homo sapiens
ctatatatgaataattatgttta

SEQ ID NO: 4293761 - DNA, 15 bp, Homo sapiens
ctatatttcatattg

SEQ ID NO: 4293762 - DNA, 16 bp, Homo sapiens
ctatatttcatattga

SEQ ID NO: 4293763 - DNA, 11 bp, Homo sapiens
ctatccagccg

SEQ ID NO: 4293764 - DNA, 22 bp, Homo sapiens
ctatccccggacgcatgcaggg

SEQ ID NO: 4293765 - DNA, 23 bp, Homo sapiens
ctatccccggacgcatgcagggc

SEQ ID NO: 4293766 - DNA, 23 bp, Homo sapiens
ctatccctggacgcatgcagggc

SEQ ID NO: 4293767 - DNA, 21 bp, Homo sapiens
ctatcctgcaccctctgctat

SEQ ID NO: 4293768 - DNA, 17 bp, Homo sapiens
ctatcttcatgtaaatt

SEQ ID NO: 4293769 - DNA, 15 bp, Homo sapiens
ctatgtagaactgtt

SEQ ID NO: 4293770 - DNA, 19 bp, Homo sapiens
ctatgtagaactgttcatt

SEQ ID NO: 4293771 - DNA, 20 bp, Homo sapiens
ctatgtccatgaaaaacagc

SEQ ID NO: 4293772 - DNA, 22 bp, Homo sapiens
ctattaatatttgtttagttca

SEQ ID NO: 4293773 - DNA, 16 bp, Homo sapiens
ctattcccaggcaggg

SEQ ID NO: 4293774 - DNA, 16 bp, Homo sapiens
ctattcctaggcctca

SEQ ID NO: 4293775 - DNA, 18 bp, Homo sapiens
ctattgcagttatagaaa

SEQ ID NO: 4293776 - DNA, 13 bp, Homo sapiens
ctatttagcatga

SEQ ID NO: 4293777 - DNA, 11 bp, Homo sapiens
ctatttatctg

SEQ ID NO: 4293778 - DNA, 17 bp, Homo sapiens
ctcaaactccattctcc

SEQ ID NO: 4293779 - DNA, 22 bp, Homo sapiens
ctcaacaaagaagaaccatctt

SEQ ID NO: 4293780 - DNA, 18 bp, Homo sapiens
ctcaacctacagtggagg

SEQ ID NO: 4293781 - DNA, 17 bp, Homo sapiens
ctcaagagggcactggt

SEQ ID NO: 4293782 - DNA, 13 bp, Homo sapiens
ctcaagccaggag

SEQ ID NO: 4293783 - DNA, 14 bp, Homo sapiens
ctcaaggcctccag

SEQ ID NO: 4293784 - DNA, 14 bp, Homo sapiens
ctcaatgcttttct

SEQ ID NO: 4293785 - DNA, 15 bp, Homo sapiens
ctcaatgcttttcta

SEQ ID NO: 4293786 - DNA, 17 bp, Homo sapiens
ctcaatgcttttctagc

SEQ ID NO: 4293787 - DNA, 14 bp, Homo sapiens
ctcacaccagccct

SEQ ID NO: 4293788 - DNA, 12 bp, Homo sapiens
ctcacagccacc

SEQ ID NO: 4293789 - DNA, 18 bp, Homo sapiens
ctcacagccaccacctgg

SEQ ID NO: 4293790 - DNA, 14 bp, Homo sapiens
ctcacatcatgtaa

SEQ ID NO: 4293791 - DNA, 17 bp, Homo sapiens
ctcaccaggaaattctg

SEQ ID NO: 4293792 - DNA, 20 bp, Homo sapiens
ctcacccaggacctctgggg

SEQ ID NO: 4293793 - DNA, 13 bp, Homo sapiens
ctcacccctgcag

SEQ ID NO: 4293794 - DNA, 15 bp, Homo sapiens
ctcaccctgctccta

SEQ ID NO: 4293795 - DNA, 18 bp, Homo sapiens
ctcacctgctggcccctc

SEQ ID NO: 4293796 - DNA, 21 bp, Homo sapiens
ctcacctgggcacctggggag

SEQ ID NO: 4293797 - DNA, 20 bp, Homo sapiens
ctcaccttgcaacacacaga

SEQ ID NO: 4293798 - DNA, 21 bp, Homo sapiens
ctcaccttgcaacacacagac

SEQ ID NO: 4293799 - DNA, 16 bp, Homo sapiens
ctcactcctacctggt

SEQ ID NO: 4293800 - DNA, 17 bp, Homo sapiens
ctcactcctacctggta

SEQ ID NO: 4293801 - DNA, 14 bp, Homo sapiens
ctcactctggcagc

SEQ ID NO: 4293802 - DNA, 21 bp, Homo sapiens
ctcactctggcagcctcagag

SEQ ID NO: 4293803 - DNA, 15 bp, Homo sapiens
ctcactgatatattt

SEQ ID NO: 4293804 - DNA, 17 bp, Homo sapiens
ctcactgccctccctcg

SEQ ID NO: 4293805 - DNA, 12 bp, Homo sapiens
ctcactggctgg

SEQ ID NO: 4293806 - DNA, 14 bp, Homo sapiens
ctcactggctggac

SEQ ID NO: 4293807 - DNA, 17 bp, Homo sapiens
ctcactggtgcatttaa

SEQ ID NO: 4293808 - DNA, 16 bp, Homo sapiens
ctcagagctccacaga

SEQ ID NO: 4293809 - DNA, 15 bp, Homo sapiens
ctcagagtccaggcc

SEQ ID NO: 4293810 - DNA, 18 bp, Homo sapiens
ctcagagtccaggcccca

SEQ ID NO: 4293811 - DNA, 14 bp, Homo sapiens
cttggttttgtatt

SEQ ID NO: 4293812 - DNA, 18 bp, Homo sapiens
cttgtagacgcacctgct

SEQ ID NO: 4293813 - DNA, 19 bp, Homo sapiens
cttgtagggtgaggcgtgg

SEQ ID NO: 4293814 - DNA, 22 bp, Homo sapiens
cttgtaggtaagttggctcaca

SEQ ID NO: 4293815 - DNA, 19 bp, Homo sapiens
cttgtattttcttcccatt

SEQ ID NO: 4293816 - DNA, 22 bp, Homo sapiens
cttgtattttcttcccatttgt

SEQ ID NO: 4293817 - DNA, 14 bp, Homo sapiens
cttgtcagagctgg

SEQ ID NO: 4293818 - DNA, 21 bp, Homo sapiens
cttgtcagagctgggaggggt

SEQ ID NO: 4293819 - DNA, 20 bp, Homo sapiens
cttgtgaaacacagctgttc

SEQ ID NO: 4293820 - DNA, 16 bp, Homo sapiens
cttgtgcctcttggga

SEQ ID NO: 4293821 - DNA, 12 bp, Homo sapiens
cttgtgttgttt

SEQ ID NO: 4293822 - DNA, 16 bp, Homo sapiens
cttgtgttgttttctc

SEQ ID NO: 4293823 - DNA, 20 bp, Homo sapiens
cttgtgttgttttctctgat

SEQ ID NO: 4293824 - DNA, 19 bp, Homo sapiens
cttgtgtttgtatataaat

SEQ ID NO: 4293825 - DNA, 15 bp, Homo sapiens
cttgtgtttttgtct

SEQ ID NO: 4293826 - DNA, 19 bp, Homo sapiens
cttgttatggtagaaaaat

SEQ ID NO: 4293827 - DNA, 19 bp, Homo sapiens
cttgttttttttttccact

SEQ ID NO: 4293828 - DNA, 16 bp, Homo sapiens
ctttaaagacttgatg

SEQ ID NO: 4293829 - DNA, 21 bp, Homo sapiens
ctttaaagacttgatgaataa

SEQ ID NO: 4293830 - DNA, 19 bp, Homo sapiens
ctttaacagtaatgttctt

SEQ ID NO: 4293831 - DNA, 18 bp, Homo sapiens
ctttacagttctggagga

SEQ ID NO: 4293832 - DNA, 13 bp, Homo sapiens
ctttacgtatttt

SEQ ID NO: 4293833 - DNA, 15 bp, Homo sapiens
ctttagaaagaaatt

SEQ ID NO: 4293834 - DNA, 20 bp, Homo sapiens
ctttagaaagaaattgtttt

SEQ ID NO: 4293835 - DNA, 15 bp, Homo sapiens
ctttaggcattaaat

SEQ ID NO: 4293836 - DNA, 18 bp, Homo sapiens
ctttataaaccataaaat

SEQ ID NO: 4293837 - DNA, 13 bp, Homo sapiens
ctttattgtctgt

SEQ ID NO: 4293838 - DNA, 19 bp, Homo sapiens
ctttatttaaaatgatttt

SEQ ID NO: 4293839 - DNA, 17 bp, Homo sapiens
ctttcaagatctaaatc

SEQ ID NO: 4293840 - DNA, 16 bp, Homo sapiens
ctttcacaaccttctg

SEQ ID NO: 4293841 - DNA, 16 bp, Homo sapiens
ctttcacccctcttcc

SEQ ID NO: 4293842 - DNA, 17 bp, Homo sapiens
ctttcacccctcttccc

SEQ ID NO: 4293843 - DNA, 22 bp, Homo sapiens
ctttcacctggttatgagccga

SEQ ID NO: 4293844 - DNA, 15 bp, Homo sapiens
ctttcagggcctcca

SEQ ID NO: 4293845 - DNA, 17 bp, Homo sapiens
ctttcagttattaaatg

SEQ ID NO: 4293846 - DNA, 22 bp, Homo sapiens
ctttcagtttgtccacacaaga

SEQ ID NO: 4293847 - DNA, 13 bp, Homo sapiens
ctttcatcctcag

SEQ ID NO: 4293848 - DNA, 14 bp, Homo sapiens
ctttcatcctcagc

SEQ ID NO: 4293849 - DNA, 15 bp, Homo sapiens
ctttcatcctcagca

SEQ ID NO: 4293850 - DNA, 14 bp, Homo sapiens
ctttccaacacaca

SEQ ID NO: 4293851 - DNA, 15 bp, Homo sapiens
ctttccaacacacaa

SEQ ID NO: 4293852 - DNA, 23 bp, Homo sapiens
ctttccaccccctccctggcctg

SEQ ID NO: 4293853 - DNA, 14 bp, Homo sapiens
ctttccctgcatcc

SEQ ID NO: 4293854 - DNA, 17 bp, Homo sapiens
ctttccctgcatccctt

SEQ ID NO: 4293855 - DNA, 12 bp, Homo sapiens
ctttcctctctg

SEQ ID NO: 4293856 - DNA, 15 bp, Homo sapiens
ctttcctgatgttga

SEQ ID NO: 4293857 - DNA, 17 bp, Homo sapiens
ctttcctttcatcctca

SEQ ID NO: 4293858 - DNA, 19 bp, Homo sapiens
ctttcctttcatcctcagc

SEQ ID NO: 4293859 - DNA, 20 bp, Homo sapiens
ctttctatgtagaactgttc

SEQ ID NO: 4293860 - DNA, 15 bp, Homo sapiens
ctttctccaaagtta

SEQ ID NO: 4293861 - DNA, 22 bp, Homo sapiens
ctttgatattttcaacgcagcc

SEQ ID NO: 4293862 - DNA, 16 bp, Homo sapiens
ctttgcagacctggga

SEQ ID NO: 4293863 - DNA, 19 bp, Homo sapiens
ctttgcagacctgggactt

SEQ ID NO: 4293864 - DNA, 20 bp, Homo sapiens
ctttgccaaacactttacag

SEQ ID NO: 4293865 - DNA, 11 bp, Homo sapiens
ctttgctgcct

SEQ ID NO: 4293866 - DNA, 14 bp, Homo sapiens
ctttgctgccttct

SEQ ID NO: 4293867 - DNA, 14 bp, Homo sapiens
ctttgctggagtcc

SEQ ID NO: 4293868 - DNA, 15 bp, Homo sapiens
ctttgctgtttatat

SEQ ID NO: 4293869 - DNA, 20 bp, Homo sapiens
ctttggaaagacctgtgagg

SEQ ID NO: 4293870 - DNA, 18 bp, Homo sapiens
ctttggcacaccctctct

SEQ ID NO: 4293871 - DNA, 21 bp, Homo sapiens
ctttggcacaccctctctgtc

SEQ ID NO: 4293872 - DNA, 15 bp, Homo sapiens
ctttggctcgggact

SEQ ID NO: 4293873 - DNA, 14 bp, Homo sapiens
ctttgggctgccct

SEQ ID NO: 4293874 - DNA, 15 bp, Homo sapiens
ctttgggctgccctg

SEQ ID NO: 4293875 - DNA, 19 bp, Homo sapiens
ctttgggctgccctggtgc

SEQ ID NO: 4293876 - DNA, 21 bp, Homo sapiens
ctttgggctgccctggtgctg

SEQ ID NO: 4293877 - DNA, 21 bp, Homo sapiens
ctttgggggattcaaatgcat

SEQ ID NO: 4293878 - DNA, 23 bp, Homo sapiens
ctttgggggattcaaatgcatga

SEQ ID NO: 4293879 - DNA, 16 bp, Homo sapiens
ctttgtaaggacttgt

SEQ ID NO: 4293880 - DNA, 20 bp, Homo sapiens
ctttgtaaggacttgtgcct

SEQ ID NO: 4293881 - DNA, 12 bp, Homo sapiens
ctttgtatgcac

SEQ ID NO: 4293882 - DNA, 16 bp, Homo sapiens
ctttgtcactgtttca

SEQ ID NO: 4293883 - DNA, 15 bp, Homo sapiens
ctttgtgcttgttct

SEQ ID NO: 4293884 - DNA, 15 bp, Homo sapiens
ctttgtgtgattgaa

SEQ ID NO: 4293885 - DNA, 15 bp, Homo sapiens
ctttgtgtgctgtgg

SEQ ID NO: 4293886 - DNA, 14 bp, Homo sapiens
cttttaacttcacc

SEQ ID NO: 4293887 - DNA, 17 bp, Homo sapiens
cttttaacttcacctta

SEQ ID NO: 4293888 - DNA, 24 bp, Homo sapiens
cttttaatgatactgtctaagaat

SEQ ID NO: 4293889 - DNA, 11 bp, Homo sapiens
cttttaatttt

SEQ ID NO: 4293890 - DNA, 13 bp, Homo sapiens
cttttatatctgt

SEQ ID NO: 4293891 - DNA, 14 bp, Homo sapiens
cttttatatctgta

SEQ ID NO: 4293892 - DNA, 15 bp, Homo sapiens
cttttatctcacaaa

SEQ ID NO: 4293893 - DNA, 17 bp, Homo sapiens
cttttcactgctggctg

SEQ ID NO: 4293894 - DNA, 20 bp, Homo sapiens
cttttcagcttgtttctata

SEQ ID NO: 4293895 - DNA, 14 bp, Homo sapiens
cttttcatatcatt

SEQ ID NO: 4293896 - DNA, 17 bp, Homo sapiens
cttttccattctgggtg

SEQ ID NO: 4293897 - DNA, 18 bp, Homo sapiens
cttttcccacctctttgg

SEQ ID NO: 4293898 - DNA, 15 bp, Homo sapiens
cttttctccatgagt

SEQ ID NO: 4293899 - DNA, 14 bp, Homo sapiens
cttttctgaggttt

SEQ ID NO: 4293900 - DNA, 15 bp, Homo sapiens
cttttgggaaatgct

SEQ ID NO: 4293901 - DNA, 15 bp, Homo sapiens
cttttgtgccaggag

SEQ ID NO: 4293902 - DNA, 19 bp, Homo sapiens
ctttttaaacaaatggctt

SEQ ID NO: 4293903 - DNA, 18 bp, Homo sapiens
ctttttttctatattatt

SEQ ID NO: 4293904 - DNA, 19 bp, Homo sapiens
ctttttttctatattattg

SEQ ID NO: 4293905 - DNA, 12 bp, Homo sapiens
gaaaaaatattt

SEQ ID NO: 4293906 - DNA, 15 bp, Homo sapiens
gaaaaaatattttaa

SEQ ID NO: 4293907 - DNA, 22 bp, Homo sapiens
gaaaaacagcagagtaaaatta

SEQ ID NO: 4293908 - DNA, 13 bp, Homo sapiens
gaaaaaggctggt

SEQ ID NO: 4293909 - DNA, 14 bp, Homo sapiens
gaaaaatttcacga

SEQ ID NO: 4293910 - DNA, 21 bp, Homo sapiens
gaaaacataatatcttgaaga

SEQ ID NO: 4293911 - DNA, 12 bp, Homo sapiens
gaaaagactgac

SEQ ID NO: 4293912 - DNA, 21 bp, Homo sapiens
gaaaagattaaaattagtgag

SEQ ID NO: 4293913 - DNA, 22 bp, Homo sapiens
gaaaagccagatgacagggagc

SEQ ID NO: 4293914 - DNA, 15 bp, Homo sapiens
gaaaagtatttccaa

SEQ ID NO: 4293915 - DNA, 14 bp, Homo sapiens
gaaaatggaacatt

SEQ ID NO: 4293916 - DNA, 14 bp, Homo sapiens
gaaacaatttctgt

SEQ ID NO: 4293917 - DNA, 17 bp, Homo sapiens
gaaaccttcacccagca

SEQ ID NO: 4293918 - DNA, 21 bp, Homo sapiens
gaaactatgcacctataaata

SEQ ID NO: 4293919 - DNA, 22 bp, Homo sapiens
gaaactcacctgctggcccctc

SEQ ID NO: 4293920 - DNA, 20 bp, Homo sapiens
gaaactcctggatccctttc

SEQ ID NO: 4293921 - DNA, 14 bp, Homo sapiens
gaaacttacacaca

SEQ ID NO: 4293922 - DNA, 12 bp, Homo sapiens
gaaagacagtaa

SEQ ID NO: 4293923 - DNA, 20 bp, Homo sapiens
gaaagacctgtgaggggaaa

SEQ ID NO: 4293924 - DNA, 13 bp, Homo sapiens
gaaagatggtaat

SEQ ID NO: 4293925 - DNA, 17 bp, Homo sapiens
gaaagatggtaatcttt

SEQ ID NO: 4293926 - DNA, 14 bp, Homo sapiens
gaaagattttatgt

SEQ ID NO: 4293927 - DNA, 18 bp, Homo sapiens
gaaagcatattgactttt

SEQ ID NO: 4293928 - DNA, 21 bp, Homo sapiens
gaaaggaagatgtaagaagct

SEQ ID NO: 4293929 - DNA, 18 bp, Homo sapiens
gaaagggcagcccctccc

SEQ ID NO: 4293930 - DNA, 19 bp, Homo sapiens
gaaagggtgctgcttccct

SEQ ID NO: 4293931 - DNA, 21 bp, Homo sapiens
gaaaggttgattctcatgcac

SEQ ID NO: 4293932 - DNA, 13 bp, Homo sapiens
gaaagtatctcta

SEQ ID NO: 4293933 - DNA, 20 bp, Homo sapiens
gaaagtatctctactttcct

SEQ ID NO: 4293934 - DNA, 20 bp, Homo sapiens
gaaataaattggtgataagt

SEQ ID NO: 4293935 - DNA, 15 bp, Homo sapiens
gaaataataatattt

SEQ ID NO: 4293936 - DNA, 20 bp, Homo sapiens
gaaataggagggaaaccttt

SEQ ID NO: 4293937 - DNA, 15 bp, Homo sapiens
gaaatagtgttcttt

SEQ ID NO: 4293938 - DNA, 21 bp, Homo sapiens
gaaatagtgttctttttaaaa

SEQ ID NO: 4293939 - DNA, 22 bp, Homo sapiens
gaaatatcatcacgtatgttat

SEQ ID NO: 4293940 - DNA, 16 bp, Homo sapiens
gaaatatctgtgaaat

SEQ ID NO: 4293941 - DNA, 15 bp, Homo sapiens
gaaatatttgcttat

SEQ ID NO: 4293942 - DNA, 21 bp, Homo sapiens
gaaatatttgcttatttatat

SEQ ID NO: 4293943 - DNA, 14 bp, Homo sapiens
gaaatcctgttact

SEQ ID NO: 4293944 - DNA, 19 bp, Homo sapiens
gaaatctcacttttctcca

SEQ ID NO: 4293945 - DNA, 15 bp, Homo sapiens
gaaatgctaatgtaa

SEQ ID NO: 4293946 - DNA, 22 bp, Homo sapiens
gaaatgctgatttaaacttctt

SEQ ID NO: 4293947 - DNA, 19 bp, Homo sapiens
gaaattatatctgtggtct

SEQ ID NO: 4293948 - DNA, 18 bp, Homo sapiens
gaaatttacagttactgc

SEQ ID NO: 4293949 - DNA, 11 bp, Homo sapiens
gaaatttattc

SEQ ID NO: 4293950 - DNA, 17 bp, Homo sapiens
gaaatttgttaatatat

SEQ ID NO: 4293951 - DNA, 24 bp, Homo sapiens
gaacaaatatgattctcctctccc

SEQ ID NO: 4293952 - DNA, 17 bp, Homo sapiens
gaacacccagccccagc

SEQ ID NO: 4293953 - DNA, 16 bp, Homo sapiens
gaacaggaggaactgg

SEQ ID NO: 4293954 - DNA, 18 bp, Homo sapiens
gaacaggaggaactggtc

SEQ ID NO: 4293955 - DNA, 19 bp, Homo sapiens
gaacaggaggaactggtcc

SEQ ID NO: 4293956 - DNA, 21 bp, Homo sapiens
gaacatgagtttatgggaatg

SEQ ID NO: 4293957 - DNA, 21 bp, Homo sapiens
gaaccaacgggtctgtgggac

SEQ ID NO: 4293958 - DNA, 12 bp, Homo sapiens
gaaccagagcca

SEQ ID NO: 4293959 - DNA, 23 bp, Homo sapiens
gaacccttaaacagttgcacagc

SEQ ID NO: 4293960 - DNA, 18 bp, Homo sapiens
gaacccttttggcccccg

SEQ ID NO: 4293961 - DNA, 23 bp, Homo sapiens
gaacccttttggcccccgagctg

SEQ ID NO: 4293962 - DNA, 17 bp, Homo sapiens
gaacctcgaagctgttc

SEQ ID NO: 4293963 - DNA, 17 bp, Homo sapiens
gaacgcatgcagggccc

SEQ ID NO: 4293964 - DNA, 15 bp, Homo sapiens
gaactaccaaaatga

SEQ ID NO: 4293965 - DNA, 17 bp, Homo sapiens
gaactcagccttaagaa

SEQ ID NO: 4293966 - DNA, 16 bp, Homo sapiens
gaactcagctgtctgt

SEQ ID NO: 4293967 - DNA, 22 bp, Homo sapiens
gaactccttgattttagccttc

SEQ ID NO: 4293968 - DNA, 14 bp, Homo sapiens
gaactgctgctggt

SEQ ID NO: 4293969 - DNA, 15 bp, Homo sapiens
gaactgctgctggtc

SEQ ID NO: 4293970 - DNA, 21 bp, Homo sapiens
gaactgctgctggtcaccccc

SEQ ID NO: 4293971 - DNA, 23 bp, Homo sapiens
gaactggtttttctgttccctgc

SEQ ID NO: 4293972 - DNA, 18 bp, Homo sapiens
gaactgtcccacaaaata

SEQ ID NO: 4293973 - DNA, 16 bp, Homo sapiens
gaactgttcatttcca

SEQ ID NO: 4293974 - DNA, 12 bp, Homo sapiens
gaacttgaacaa

SEQ ID NO: 4293975 - DNA, 13 bp, Homo sapiens
gaacttgaacaaa

SEQ ID NO: 4293976 - DNA, 17 bp, Homo sapiens
gaacttgaacaaagtct

SEQ ID NO: 4293977 - DNA, 14 bp, Homo sapiens
gaacttgatgttcc

SEQ ID NO: 4293978 - DNA, 19 bp, Homo sapiens
gaacttggtgcctaatgtt

SEQ ID NO: 4293979 - DNA, 14 bp, Homo sapiens
gaagaaactcctgg

SEQ ID NO: 4293980 - DNA, 15 bp, Homo sapiens
gaagaaactcctgga

SEQ ID NO: 4293981 - DNA, 13 bp, Homo sapiens
gaagaaccatctt

SEQ ID NO: 4293982 - DNA, 17 bp, Homo sapiens
gaagaactcatgtgatt

SEQ ID NO: 4293983 - DNA, 22 bp, Homo sapiens
gaagaagaaaacatgtctgtga

SEQ ID NO: 4293984 - DNA, 18 bp, Homo sapiens
gaagaagctcctgaatcc

SEQ ID NO: 4293985 - DNA, 15 bp, Homo sapiens
gaagaaggacttcct

SEQ ID NO: 4293986 - DNA, 16 bp, Homo sapiens
gaagaaggcccgggag

SEQ ID NO: 4293987 - DNA, 17 bp, Homo sapiens
gaagaaggcccgggagg

SEQ ID NO: 4293988 - DNA, 18 bp, Homo sapiens
gaagaaggcccgggagga

SEQ ID NO: 4293989 - DNA, 15 bp, Homo sapiens
gaagaatattgtatt

SEQ ID NO: 4293990 - DNA, 14 bp, Homo sapiens
gaagaatattgtta

SEQ ID NO: 4293991 - DNA, 13 bp, Homo sapiens
gaagaatttgaag

SEQ ID NO: 4293992 - DNA, 12 bp, Homo sapiens
gaagactggaag

SEQ ID NO: 4293993 - DNA, 23 bp, Homo sapiens
gaagagagatatatctgaaaact

SEQ ID NO: 4293994 - DNA, 17 bp, Homo sapiens
gaagagcgctcctctgc

SEQ ID NO: 4293995 - DNA, 12 bp, Homo sapiens
gaagagggagaa

SEQ ID NO: 4293996 - DNA, 14 bp, Homo sapiens
gaagagtatggatt

SEQ ID NO: 4293997 - DNA, 22 bp, Homo sapiens
gaagcaaacacacagactctgt

SEQ ID NO: 4293998 - DNA, 14 bp, Homo sapiens
gaagcaaggccagc

SEQ ID NO: 4293999 - DNA, 15 bp, Homo sapiens
gaagcacaagaagtg

SEQ ID NO: 4294000 - DNA, 17 bp, Homo sapiens
gaagcacaagaagtggg

SEQ ID NO: 4294001 - DNA, 21 bp, Homo sapiens
gaagcacaagaagtgggagtg

SEQ ID NO: 4294002 - DNA, 16 bp, Homo sapiens
gaagcaccccaccaca

SEQ ID NO: 4294003 - DNA, 17 bp, Homo sapiens
gaagcagagcctggggt

SEQ ID NO: 4294004 - DNA, 22 bp, Homo sapiens
gaagcagcatcaacctaggagc

SEQ ID NO: 4294005 - DNA, 15 bp, Homo sapiens
gaagcattctcccca

SEQ ID NO: 4294006 - DNA, 17 bp, Homo sapiens
gaagcattctccccagt

SEQ ID NO: 4294007 - DNA, 21 bp, Homo sapiens
gaagccaccatgtatgtggaa

SEQ ID NO: 4294008 - DNA, 17 bp, Homo sapiens
gaagccacgtgctggag

SEQ ID NO: 4294009 - DNA, 20 bp, Homo sapiens
gaagcccaggaggacctggg

SEQ ID NO: 4294010 - DNA, 18 bp, Homo sapiens
gaagcctccacctgcagc

SEQ ID NO: 4294011 - DNA, 14 bp, Homo sapiens
gaagcctcctgctg

SEQ ID NO: 4294012 - DNA, 15 bp, Homo sapiens
gaagcctcctgctga

SEQ ID NO: 4294013 - DNA, 20 bp, Homo sapiens
gaagcctcctgctgagtggt

SEQ ID NO: 4294014 - DNA, 14 bp, Homo sapiens
gaagctcagcccac

SEQ ID NO: 4294015 - DNA, 22 bp, Homo sapiens
gaagctgttctctgcttttcca

SEQ ID NO: 4294016 - DNA, 22 bp, Homo sapiens
gaaggaatggtgcttggcagga

SEQ ID NO: 4294017 - DNA, 22 bp, Homo sapiens
gaaggacccggaggggcctggc

SEQ ID NO: 4294018 - DNA, 13 bp, Homo sapiens
gaaggagaggagt

SEQ ID NO: 4294019 - DNA, 14 bp, Homo sapiens
gaaggagaggagtg

SEQ ID NO: 4294020 - DNA, 15 bp, Homo sapiens
gaaggagaggagtgc

SEQ ID NO: 4294021 - DNA, 15 bp, Homo sapiens
gaaggagccagctcc

SEQ ID NO: 4294022 - DNA, 17 bp, Homo sapiens
gaaggaggaagggactg

SEQ ID NO: 4294023 - DNA, 20 bp, Homo sapiens
gaaggattttaaatgctgta

SEQ ID NO: 4294024 - DNA, 15 bp, Homo sapiens
gaaggcaagctggca

SEQ ID NO: 4294025 - DNA, 18 bp, Homo sapiens
gaaggcaagctggcagga

SEQ ID NO: 4294026 - DNA, 14 bp, Homo sapiens
gaaggcctgccccc

SEQ ID NO: 4294027 - DNA, 23 bp, Homo sapiens
gaaggctttcagggcctccagcc

SEQ ID NO: 4294028 - DNA, 24 bp, Homo sapiens
gaaggctttcagggcctccagccc

SEQ ID NO: 4294029 - DNA, 16 bp, Homo sapiens
gaagggactggtccag

SEQ ID NO: 4294030 - DNA, 17 bp, Homo sapiens
gaagggaggcctgaggg

SEQ ID NO: 4294031 - DNA, 19 bp, Homo sapiens
gaagggaggcctgaggggc

SEQ ID NO: 4294032 - DNA, 22 bp, Homo sapiens
gaagggggccatgaggcctcag

SEQ ID NO: 4294033 - DNA, 14 bp, Homo sapiens
gaagggtccggctt

SEQ ID NO: 4294034 - DNA, 17 bp, Homo sapiens
gaaggtctcatgcctga

SEQ ID NO: 4294035 - DNA, 13 bp, Homo sapiens
gaaggtggtctgc

SEQ ID NO: 4294036 - DNA, 19 bp, Homo sapiens
gaaggtggtctgcacccca

SEQ ID NO: 4294037 - DNA, 17 bp, Homo sapiens
gaagtaagttctgaaaa

SEQ ID NO: 4294038 - DNA, 23 bp, Homo sapiens
gaagtagtgtctggatcagtaaa

SEQ ID NO: 4294039 - DNA, 16 bp, Homo sapiens
gaagtcatcataaaag

SEQ ID NO: 4294040 - DNA, 19 bp, Homo sapiens
gaagtccagtgaccctgga

SEQ ID NO: 4294041 - DNA, 23 bp, Homo sapiens
gaagtgaatacatggtagcaggg

SEQ ID NO: 4294042 - DNA, 23 bp, Homo sapiens
gaagtgacaaggccccagagact

SEQ ID NO: 4294043 - DNA, 18 bp, Homo sapiens
gaagtgaccccagctcca

SEQ ID NO: 4294044 - DNA, 20 bp, Homo sapiens
gaagtgaccccagctccagg

SEQ ID NO: 4294045 - DNA, 22 bp, Homo sapiens
gaagtgaccccagctccaggca

SEQ ID NO: 4294046 - DNA, 15 bp, Homo sapiens
gaagtgcccctgctg

SEQ ID NO: 4294047 - DNA, 23 bp, Homo sapiens
gaagtgcccctgctgcctcccca

SEQ ID NO: 4294048 - DNA, 16 bp, Homo sapiens
gaagtgggagtgggag

SEQ ID NO: 4294049 - DNA, 20 bp, Homo sapiens
gaagtgggattcaggaatgg

SEQ ID NO: 4294050 - DNA, 21 bp, Homo sapiens
gaagtgggattcaggaatggg

SEQ ID NO: 4294051 - DNA, 19 bp, Homo sapiens
gaataaacactttttctgg

SEQ ID NO: 4294052 - DNA, 17 bp, Homo sapiens
gaataaataaagaagaa

SEQ ID NO: 4294053 - DNA, 15 bp, Homo sapiens
gaataaatgagcatt

SEQ ID NO: 4294054 - DNA, 22 bp, Homo sapiens
gaataatgacgtattgtgaaat

SEQ ID NO: 4294055 - DNA, 19 bp, Homo sapiens
gaatacatggtagcagggt

SEQ ID NO: 4294056 - DNA, 20 bp, Homo sapiens
gaatcacctaattaatttca

SEQ ID NO: 4294057 - DNA, 21 bp, Homo sapiens
gaatcagggagcactggaggc

SEQ ID NO: 4294058 - DNA, 19 bp, Homo sapiens
gaatcgaggaaccagagcc

SEQ ID NO: 4294059 - DNA, 17 bp, Homo sapiens
gaatgactataaacatt

SEQ ID NO: 4294060 - DNA, 16 bp, Homo sapiens
gaatgagagagtgtgg

SEQ ID NO: 4294061 - DNA, 15 bp, Homo sapiens
gaatgcctaggccag

SEQ ID NO: 4294062 - DNA, 19 bp, Homo sapiens
gaatgcctaggccagctcc

SEQ ID NO: 4294063 - DNA, 21 bp, Homo sapiens
gaatgcgctcttcaccaggaa

SEQ ID NO: 4294064 - DNA, 23 bp, Homo sapiens
gaatgcggcaagaaggaattgac

SEQ ID NO: 4294065 - DNA, 11 bp, Homo sapiens
gaatgctcccc

SEQ ID NO: 4294066 - DNA, 19 bp, Homo sapiens
gaatgctcccccatcctcc

SEQ ID NO: 4294067 - DNA, 18 bp, Homo sapiens
gaatggagtccagacctg

SEQ ID NO: 4294068 - DNA, 20 bp, Homo sapiens
gaatgggccaagccagggtt

SEQ ID NO: 4294069 - DNA, 17 bp, Homo sapiens
gaatggggcttccatgg

SEQ ID NO: 4294070 - DNA, 18 bp, Homo sapiens
gaatggtgcttggcagga

SEQ ID NO: 4294071 - DNA, 22 bp, Homo sapiens
gaatggtgggctccagagtagg

SEQ ID NO: 4294072 - DNA, 15 bp, Homo sapiens
gaatgtagccagccc

SEQ ID NO: 4294073 - DNA, 22 bp, Homo sapiens
gaatgtgcttttccatctaaaa

SEQ ID NO: 4294074 - DNA, 17 bp, Homo sapiens
gaatgttatatcatcaa

SEQ ID NO: 4294075 - DNA, 22 bp, Homo sapiens
gaattcgagacaggcagaatca

SEQ ID NO: 4294076 - DNA, 18 bp, Homo sapiens
gaattgccagtcttttgt

SEQ ID NO: 4294077 - DNA, 15 bp, Homo sapiens
gaatttgaagacttc

SEQ ID NO: 4294078 - DNA, 22 bp, Homo sapiens
gaattttttttttaaatgattc

SEQ ID NO: 4294079 - DNA, 14 bp, Homo sapiens
ctggctcacagcca

SEQ ID NO: 4294080 - DNA, 18 bp, Homo sapiens
ctggctcccacaggccct

SEQ ID NO: 4294081 - DNA, 15 bp, Homo sapiens
ctggctcccagggcc

SEQ ID NO: 4294082 - DNA, 18 bp, Homo sapiens
ctggctcccagggccatg

SEQ ID NO: 4294083 - DNA, 22 bp, Homo sapiens
ctggctctgaatgtagccagcc

SEQ ID NO: 4294084 - DNA, 14 bp, Homo sapiens
ctggctctgcagca

SEQ ID NO: 4294085 - DNA, 16 bp, Homo sapiens
ctggctctgcagcaca

SEQ ID NO: 4294086 - DNA, 23 bp, Homo sapiens
ctggctgcaagtggttaagaatg

SEQ ID NO: 4294087 - DNA, 14 bp, Homo sapiens
ctggctgccttaga

SEQ ID NO: 4294088 - DNA, 23 bp, Homo sapiens
ctggctgccttctgcggagcttc

SEQ ID NO: 4294089 - DNA, 15 bp, Homo sapiens
ctggctgtggcccct

SEQ ID NO: 4294090 - DNA, 17 bp, Homo sapiens
ctggctgtggcccctcc

SEQ ID NO: 4294091 - DNA, 22 bp, Homo sapiens
ctggctgtggcccctccttctc

SEQ ID NO: 4294092 - DNA, 14 bp, Homo sapiens
ctggcttcccagga

SEQ ID NO: 4294093 - DNA, 16 bp, Homo sapiens
ctggcttcccaggacc

SEQ ID NO: 4294094 - DNA, 19 bp, Homo sapiens
ctggctttggaaagacctg

SEQ ID NO: 4294095 - DNA, 22 bp, Homo sapiens
ctgggaaaagggcaggagccta

SEQ ID NO: 4294096 - DNA, 18 bp, Homo sapiens
ctgggaagggggcaggcc

SEQ ID NO: 4294097 - DNA, 19 bp, Homo sapiens
ctgggaagggggcaggccc

SEQ ID NO: 4294098 - DNA, 16 bp, Homo sapiens
ctgggagaaaagccag

SEQ ID NO: 4294099 - DNA, 21 bp, Homo sapiens
ctgggagaaaagccagatgac

SEQ ID NO: 4294100 - DNA, 12 bp, Homo sapiens
ctgggagagcca

SEQ ID NO: 4294101 - DNA, 14 bp, Homo sapiens
ctgggagagccaag

SEQ ID NO: 4294102 - DNA, 14 bp, Homo sapiens
ctgggagagtgagg

SEQ ID NO: 4294103 - DNA, 15 bp, Homo sapiens
ctgggagatgctggg

SEQ ID NO: 4294104 - DNA, 16 bp, Homo sapiens
ctgggagatgctggga

SEQ ID NO: 4294105 - DNA, 21 bp, Homo sapiens
ctgggagcctcgcccctccag

SEQ ID NO: 4294106 - DNA, 15 bp, Homo sapiens
ctgggcactcctccc

SEQ ID NO: 4294107 - DNA, 15 bp, Homo sapiens
ctgggcagcccagag

SEQ ID NO: 4294108 - DNA, 21 bp, Homo sapiens
ctgggcatctggccctgctgc

SEQ ID NO: 4294109 - DNA, 23 bp, Homo sapiens
ctgggcatctggccctgctgccc

SEQ ID NO: 4294110 - DNA, 17 bp, Homo sapiens
ctgggccactggcatct

SEQ ID NO: 4294111 - DNA, 13 bp, Homo sapiens
ctgggccagggtc

SEQ ID NO: 4294112 - DNA, 14 bp, Homo sapiens
ctgggccagggtct

SEQ ID NO: 4294113 - DNA, 16 bp, Homo sapiens
ctgggccagggtctcg

SEQ ID NO: 4294114 - DNA, 21 bp, Homo sapiens
ctgggccagggtctcgtcagg

SEQ ID NO: 4294115 - DNA, 12 bp, Homo sapiens
ctgggccctggt

SEQ ID NO: 4294116 - DNA, 14 bp, Homo sapiens
ctgggccctggttc

SEQ ID NO: 4294117 - DNA, 15 bp, Homo sapiens
ctgggccctggttcc

SEQ ID NO: 4294118 - DNA, 20 bp, Homo sapiens
ctgggccctggttcccccag

SEQ ID NO: 4294119 - DNA, 15 bp, Homo sapiens
ctgggccttatgtgg

SEQ ID NO: 4294120 - DNA, 19 bp, Homo sapiens
ctgggctcacaccagccct

SEQ ID NO: 4294121 - DNA, 20 bp, Homo sapiens
ctgggctcacaccagccctg

SEQ ID NO: 4294122 - DNA, 23 bp, Homo sapiens
ctgggctcacaccagccctggtg

SEQ ID NO: 4294123 - DNA, 17 bp, Homo sapiens
ctgggctggcatgggga

SEQ ID NO: 4294124 - DNA, 22 bp, Homo sapiens
ctgggctggcatggggagggga

SEQ ID NO: 4294125 - DNA, 16 bp, Homo sapiens
ctgggctggctgcctt

SEQ ID NO: 4294126 - DNA, 22 bp, Homo sapiens
ctgggctggctgccttctgcgg

SEQ ID NO: 4294127 - DNA, 22 bp, Homo sapiens
ctggggacggagcactgtgcag

SEQ ID NO: 4294128 - DNA, 15 bp, Homo sapiens
ctggggagaccgagt

SEQ ID NO: 4294129 - DNA, 12 bp, Homo sapiens
ctggggagggag

SEQ ID NO: 4294130 - DNA, 14 bp, Homo sapiens
ctggggctgagagt

SEQ ID NO: 4294131 - DNA, 20 bp, Homo sapiens
ctgggggccatgagctccag

SEQ ID NO: 4294132 - DNA, 14 bp, Homo sapiens
ctggggggcacagc

SEQ ID NO: 4294133 - DNA, 18 bp, Homo sapiens
ctggggggcacagccaga

SEQ ID NO: 4294134 - DNA, 16 bp, Homo sapiens
ctggggtggggcttgg

SEQ ID NO: 4294135 - DNA, 20 bp, Homo sapiens
ctggggtggttggaggcctg

SEQ ID NO: 4294136 - DNA, 19 bp, Homo sapiens
ctggggtttccacacaggc

SEQ ID NO: 4294137 - DNA, 21 bp, Homo sapiens
ctggggtttccacacaggccc

SEQ ID NO: 4294138 - DNA, 24 bp, Homo sapiens
ctggggtttccacacaggcccatg

SEQ ID NO: 4294139 - DNA, 16 bp, Homo sapiens
ctgggtcaccttcctg

SEQ ID NO: 4294140 - DNA, 19 bp, Homo sapiens
ctgggtcaccttcctgggc

SEQ ID NO: 4294141 - DNA, 21 bp, Homo sapiens
ctgggtgccccgtccacggct

SEQ ID NO: 4294142 - DNA, 15 bp, Homo sapiens
ctgggtggccggccc

SEQ ID NO: 4294143 - DNA, 17 bp, Homo sapiens
ctgggtggccggccctg

SEQ ID NO: 4294144 - DNA, 19 bp, Homo sapiens
ctgggtggccggccctgcc

SEQ ID NO: 4294145 - DNA, 21 bp, Homo sapiens
ctgggtgtgctccaggcttcc

SEQ ID NO: 4294146 - DNA, 19 bp, Homo sapiens
ctgggtgttttcagaaaga

SEQ ID NO: 4294147 - DNA, 12 bp, Homo sapiens
ctgggttctggg

SEQ ID NO: 4294148 - DNA, 13 bp, Homo sapiens
ctgggttctgggg

SEQ ID NO: 4294149 - DNA, 17 bp, Homo sapiens
ctgggttctggggctga

SEQ ID NO: 4294150 - DNA, 21 bp, Homo sapiens
ctgggtttgggcagtggagag

SEQ ID NO: 4294151 - DNA, 22 bp, Homo sapiens
ctgggtttgggcagtggagagg

SEQ ID NO: 4294152 - DNA, 15 bp, Homo sapiens
ctggtaagattgtta

SEQ ID NO: 4294153 - DNA, 16 bp, Homo sapiens
ctggtattaaatgcca

SEQ ID NO: 4294154 - DNA, 16 bp, Homo sapiens
ctggtcacccccaccc

SEQ ID NO: 4294155 - DNA, 22 bp, Homo sapiens
ctggtcagtgaagcccaggagg

SEQ ID NO: 4294156 - DNA, 23 bp, Homo sapiens
ctggtcagtgaagcccaggagga

SEQ ID NO: 4294157 - DNA, 12 bp, Homo sapiens
ctggtcatcctg

SEQ ID NO: 4294158 - DNA, 15 bp, Homo sapiens
ctggtcatcctgggc

SEQ ID NO: 4294159 - DNA, 16 bp, Homo sapiens
ctggtcatcctgggca

SEQ ID NO: 4294160 - DNA, 13 bp, Homo sapiens
ctggtccaggcat

SEQ ID NO: 4294161 - DNA, 19 bp, Homo sapiens
ctggtccatgatggagtca

SEQ ID NO: 4294162 - DNA, 14 bp, Homo sapiens
ctggtcctgcactg

SEQ ID NO: 4294163 - DNA, 17 bp, Homo sapiens
ctggtctctaggcctga

SEQ ID NO: 4294164 - DNA, 19 bp, Homo sapiens
ctggtctctaggcctgaac

SEQ ID NO: 4294165 - DNA, 14 bp, Homo sapiens
ctggtctggagccc

SEQ ID NO: 4294166 - DNA, 16 bp, Homo sapiens
ctggtctggagcccct

SEQ ID NO: 4294167 - DNA, 18 bp, Homo sapiens
ctggtgcccaccagctgg

SEQ ID NO: 4294168 - DNA, 19 bp, Homo sapiens
ctggtgcccaccagctggc

SEQ ID NO: 4294169 - DNA, 21 bp, Homo sapiens
ctggtgcccaccagctggctc

SEQ ID NO: 4294170 - DNA, 23 bp, Homo sapiens
ctggtgcccaccagctggctctg

SEQ ID NO: 4294171 - DNA, 13 bp, Homo sapiens
ctggtgcccaccc

SEQ ID NO: 4294172 - DNA, 19 bp, Homo sapiens
ctggtgccctggcccagcc

SEQ ID NO: 4294173 - DNA, 20 bp, Homo sapiens
ctggtgccctggcccagcct

SEQ ID NO: 4294174 - DNA, 13 bp, Homo sapiens
ctggtgcctgcag

SEQ ID NO: 4294175 - DNA, 17 bp, Homo sapiens
ctggtggacagacccag

SEQ ID NO: 4294176 - DNA, 19 bp, Homo sapiens
ctggtggacagacccaggg

SEQ ID NO: 4294177 - DNA, 20 bp, Homo sapiens
ctggtggccaagcctgcccc

SEQ ID NO: 4294178 - DNA, 15 bp, Homo sapiens
ctggtgggggcatcc

SEQ ID NO: 4294179 - DNA, 16 bp, Homo sapiens
ctggtgtccctgcctg

SEQ ID NO: 4294180 - DNA, 22 bp, Homo sapiens
ctggtgttctcaatgcttttct

SEQ ID NO: 4294181 - DNA, 17 bp, Homo sapiens
ctggttatagttgatat

SEQ ID NO: 4294182 - DNA, 23 bp, Homo sapiens
ctggttatagttgatatgtaaca

SEQ ID NO: 4294183 - DNA, 21 bp, Homo sapiens
ctggttcccccaggaccctga

SEQ ID NO: 4294184 - DNA, 22 bp, Homo sapiens
ctggttcccccaggaccctgag

SEQ ID NO: 4294185 - DNA, 23 bp, Homo sapiens
ctggttcccccaggaccctgagg

SEQ ID NO: 4294186 - DNA, 19 bp, Homo sapiens
ctggttctccatccccatg

SEQ ID NO: 4294187 - DNA, 20 bp, Homo sapiens
ctggtttggtggccaggctg

SEQ ID NO: 4294188 - DNA, 12 bp, Homo sapiens
ctggttttcatt

SEQ ID NO: 4294189 - DNA, 16 bp, Homo sapiens
ctggtttttctgttcc

SEQ ID NO: 4294190 - DNA, 20 bp, Homo sapiens
ctgtaaatttaactgcatat

SEQ ID NO: 4294191 - DNA, 22 bp, Homo sapiens
ctgtaaatttaatagataaagt

SEQ ID NO: 4294192 - DNA, 18 bp, Homo sapiens
ctgtaagacggccttgga

SEQ ID NO: 4294193 - DNA, 17 bp, Homo sapiens
ctgtaatagcctcacct

SEQ ID NO: 4294194 - DNA, 14 bp, Homo sapiens
ctgtaatatttaca

SEQ ID NO: 4294195 - DNA, 15 bp, Homo sapiens
ctgtaatatttacaa

SEQ ID NO: 4294196 - DNA, 18 bp, Homo sapiens
ctgtaatatttacaatgt

SEQ ID NO: 4294197 - DNA, 14 bp, Homo sapiens
ctgtaattttgtag

SEQ ID NO: 4294198 - DNA, 14 bp, Homo sapiens
ctgtagacatctgt

SEQ ID NO: 4294199 - DNA, 17 bp, Homo sapiens
ctgtagacatctgtcct

SEQ ID NO: 4294200 - DNA, 17 bp, Homo sapiens
ctgtatacaaacaggtg

SEQ ID NO: 4294201 - DNA, 20 bp, Homo sapiens
ctgtatacaaacaggtgcta

SEQ ID NO: 4294202 - DNA, 14 bp, Homo sapiens
ctgtatcatttctt

SEQ ID NO: 4294203 - DNA, 17 bp, Homo sapiens
ctgtatctaaaaaataa

SEQ ID NO: 4294204 - DNA, 18 bp, Homo sapiens
ctgtatctaaaaaataac

SEQ ID NO: 4294205 - DNA, 19 bp, Homo sapiens
ctgtattgttacagctgaa

SEQ ID NO: 4294206 - DNA, 11 bp, Homo sapiens
ctgtattttct

SEQ ID NO: 4294207 - DNA, 21 bp, Homo sapiens
ctgtccatctgtctgtcctac

SEQ ID NO: 4294208 - DNA, 12 bp, Homo sapiens
ctgtccattcca

SEQ ID NO: 4294209 - DNA, 21 bp, Homo sapiens
ctgtcccacaaaatatttcta

SEQ ID NO: 4294210 - DNA, 21 bp, Homo sapiens
ctgtcccaggatggtcccagc

SEQ ID NO: 4294211 - DNA, 18 bp, Homo sapiens
ctgtccccgagccgagct

SEQ ID NO: 4294212 - DNA, 23 bp, Homo sapiens
ctgtccccgagccgagctctcct

SEQ ID NO: 4294213 - DNA, 16 bp, Homo sapiens
ctgtccctgccccgcc

SEQ ID NO: 4294214 - DNA, 17 bp, Homo sapiens
ctgtccctgccccgccc

SEQ ID NO: 4294215 - DNA, 18 bp, Homo sapiens
ctgtccctgccccgcccc

SEQ ID NO: 4294216 - DNA, 22 bp, Homo sapiens
ctgtccctgccccgccccccag

SEQ ID NO: 4294217 - DNA, 12 bp, Homo sapiens
ctgtccctgtcc

SEQ ID NO: 4294218 - DNA, 16 bp, Homo sapiens
ctgtcctggctcccag

SEQ ID NO: 4294219 - DNA, 16 bp, Homo sapiens
ctgtcctgttgattaa

SEQ ID NO: 4294220 - DNA, 18 bp, Homo sapiens
ctgtccttagactccttc

SEQ ID NO: 4294221 - DNA, 19 bp, Homo sapiens
ctgtccttcccacggccac

SEQ ID NO: 4294222 - DNA, 23 bp, Homo sapiens
ctgtctgaaaccagaagactgga

SEQ ID NO: 4294223 - DNA, 12 bp, Homo sapiens
ctgtctgagccc

SEQ ID NO: 4294224 - DNA, 14 bp, Homo sapiens
ctgtctgagccctg

SEQ ID NO: 4294225 - DNA, 24 bp, Homo sapiens
ctgtctgagccctgccctcactcc

SEQ ID NO: 4294226 - DNA, 18 bp, Homo sapiens
ctgtctgcgccgctgtgc

SEQ ID NO: 4294227 - DNA, 12 bp, Homo sapiens
ctgtctgtccta

SEQ ID NO: 4294228 - DNA, 13 bp, Homo sapiens
ctgtctgtcctac

SEQ ID NO: 4294229 - DNA, 19 bp, Homo sapiens
ctgtctgtgtgaggctccc

SEQ ID NO: 4294230 - DNA, 21 bp, Homo sapiens
ctgtcttagtcataccatcca

SEQ ID NO: 4294231 - DNA, 16 bp, Homo sapiens
ctgtctttgctgttta

SEQ ID NO: 4294232 - DNA, 22 bp, Homo sapiens
ctgtgaaagtctcctgtatcat

SEQ ID NO: 4294233 - DNA, 15 bp, Homo sapiens
ctgtgaacttgatgt

SEQ ID NO: 4294234 - DNA, 18 bp, Homo sapiens
ctgtgaacttgatgttcc

SEQ ID NO: 4294235 - DNA, 20 bp, Homo sapiens
ctgtgaacttgatgttcctg

SEQ ID NO: 4294236 - DNA, 16 bp, Homo sapiens
ctgtgaataaagccac

SEQ ID NO: 4294237 - DNA, 18 bp, Homo sapiens
ctgtgacacagctgagct

SEQ ID NO: 4294238 - DNA, 14 bp, Homo sapiens
ctgtgaccggggtc

SEQ ID NO: 4294239 - DNA, 23 bp, Homo sapiens
ctgtgaccggggtcctgaggctg

SEQ ID NO: 4294240 - DNA, 13 bp, Homo sapiens
ctgtgagatgtgt

SEQ ID NO: 4294241 - DNA, 14 bp, Homo sapiens
ctgtgattaattat

SEQ ID NO: 4294242 - DNA, 14 bp, Homo sapiens
ctgtgcagccgggg

SEQ ID NO: 4294243 - DNA, 19 bp, Homo sapiens
ctgtgcagccggggagctg

SEQ ID NO: 4294244 - DNA, 15 bp, Homo sapiens
ctgtgccagctgctt

SEQ ID NO: 4294245 - DNA, 17 bp, Homo sapiens
ctgtgccagctgcttct

SEQ ID NO: 4294246 - DNA, 19 bp, Homo sapiens
ctgtgccagctgcttctgc

SEQ ID NO: 4294247 - DNA, 22 bp, Homo sapiens
ctgtgccagctgcttctgccca

SEQ ID NO: 4294248 - DNA, 16 bp, Homo sapiens
ctgtgcccgctgcgct

SEQ ID NO: 4294249 - DNA, 21 bp, Homo sapiens
ctgtgcgagaacacaagccac

SEQ ID NO: 4294250 - DNA, 22 bp, Homo sapiens
ctgtgcgagaacacaagccacg

SEQ ID NO: 4294251 - DNA, 14 bp, Homo sapiens
ctgtgcgctgacaa

SEQ ID NO: 4294252 - DNA, 18 bp, Homo sapiens
ctgtgctaagttgtctta

SEQ ID NO: 4294253 - DNA, 20 bp, Homo sapiens
ctgtgctaagttgtcttaca

SEQ ID NO: 4294254 - DNA, 21 bp, Homo sapiens
ctgtgctggtctctaggcctg

SEQ ID NO: 4294255 - DNA, 22 bp, Homo sapiens
ctgtgctggtctctaggcctga

SEQ ID NO: 4294256 - DNA, 22 bp, Homo sapiens
ctgtgctggtgggggcctcttt

SEQ ID NO: 4294257 - DNA, 13 bp, Homo sapiens
ctgtggaagggac

SEQ ID NO: 4294258 - DNA, 14 bp, Homo sapiens
ctgtggaagggact

SEQ ID NO: 4294259 - DNA, 22 bp, Homo sapiens
ctgtggattttgtggcttcaat

SEQ ID NO: 4294260 - DNA, 13 bp, Homo sapiens
ctgtggcccctcc

SEQ ID NO: 4294261 - DNA, 14 bp, Homo sapiens
ctgtggccctctct

SEQ ID NO: 4294262 - DNA, 13 bp, Homo sapiens
ctgtggcctcagg

SEQ ID NO: 4294263 - DNA, 16 bp, Homo sapiens
ctgtggcctcaggagg

SEQ ID NO: 4294264 - DNA, 18 bp, Homo sapiens
ctgtggcggtgcagtggc

SEQ ID NO: 4294265 - DNA, 12 bp, Homo sapiens
ctgtgggactgg

SEQ ID NO: 4294266 - DNA, 22 bp, Homo sapiens
ctgtgggactggcccacccctc

SEQ ID NO: 4294267 - DNA, 18 bp, Homo sapiens
ctgtgggagaagggacag

SEQ ID NO: 4294268 - DNA, 13 bp, Homo sapiens
ctgtggggagctg

SEQ ID NO: 4294269 - DNA, 17 bp, Homo sapiens
ctgtggggatttctccc

SEQ ID NO: 4294270 - DNA, 18 bp, Homo sapiens
ctgtggggatttctccca

SEQ ID NO: 4294271 - DNA, 13 bp, Homo sapiens
ctgtggggccaca

SEQ ID NO: 4294272 - DNA, 17 bp, Homo sapiens
ctgtggtgaggtcctgt

SEQ ID NO: 4294273 - DNA, 19 bp, Homo sapiens
ctgtgtaatcatttcttgg

SEQ ID NO: 4294274 - DNA, 22 bp, Homo sapiens
ctgtgtccccgcgggcagtgac

SEQ ID NO: 4294275 - DNA, 15 bp, Homo sapiens
ctgtgtccctctctc

SEQ ID NO: 4294276 - DNA, 19 bp, Homo sapiens
ctgtgtcctaaatgcaaag

SEQ ID NO: 4294277 - DNA, 16 bp, Homo sapiens
ctgtgtggggagggtg

SEQ ID NO: 4294278 - DNA, 16 bp, Homo sapiens
ctgtgtgtgagtgtga

SEQ ID NO: 4294279 - DNA, 14 bp, Homo sapiens
ctgtgttagtgtct

SEQ ID NO: 4294280 - DNA, 18 bp, Homo sapiens
ctgtgttagtgtctgtcc

SEQ ID NO: 4294281 - DNA, 19 bp, Homo sapiens
ctgttaacttattcaaaga

SEQ ID NO: 4294282 - DNA, 21 bp, Homo sapiens
ctgttacctcaacaagaagaa

SEQ ID NO: 4294283 - DNA, 15 bp, Homo sapiens
ctgttacttaaatag

SEQ ID NO: 4294284 - DNA, 13 bp, Homo sapiens
ctgttcagaggca

SEQ ID NO: 4294285 - DNA, 17 bp, Homo sapiens
ctgttcatttcctcaaa

SEQ ID NO: 4294286 - DNA, 13 bp, Homo sapiens
ctgttccctgctg

SEQ ID NO: 4294287 - DNA, 21 bp, Homo sapiens
ctgttcctggctcagcctcaa

SEQ ID NO: 4294288 - DNA, 15 bp, Homo sapiens
ctgttctcagagctc

SEQ ID NO: 4294289 - DNA, 19 bp, Homo sapiens
ctgttctcagagctccaca

SEQ ID NO: 4294290 - DNA, 14 bp, Homo sapiens
ctgttctgcagaca

SEQ ID NO: 4294291 - DNA, 12 bp, Homo sapiens
ctgttctgtgtc

SEQ ID NO: 4294292 - DNA, 14 bp, Homo sapiens
ctgttctgtgtctg

SEQ ID NO: 4294293 - DNA, 17 bp, Homo sapiens
ctgttctgtgtctgctg

SEQ ID NO: 4294294 - DNA, 20 bp, Homo sapiens
ctgttgtctgccgtgagagc

SEQ ID NO: 4294295 - DNA, 17 bp, Homo sapiens
ctgttgtttgatgtgta

SEQ ID NO: 4294296 - DNA, 15 bp, Homo sapiens
ctgtttatatatata

SEQ ID NO: 4294297 - DNA, 14 bp, Homo sapiens
ctgtttatgttctt

SEQ ID NO: 4294298 - DNA, 17 bp, Homo sapiens
ctgtttgctcacccagg

SEQ ID NO: 4294299 - DNA, 22 bp, Homo sapiens
ctgtttgctcacccaggacctc

SEQ ID NO: 4294300 - DNA, 22 bp, Homo sapiens
ctgttttatgtcatactctgtg

SEQ ID NO: 4294301 - DNA, 19 bp, Homo sapiens
ctgttttattgagttctga

SEQ ID NO: 4294302 - DNA, 22 bp, Homo sapiens
ctgttttattgagttctgaagg

SEQ ID NO: 4294303 - DNA, 14 bp, Homo sapiens
ctgtttttgaagaa

SEQ ID NO: 4294304 - DNA, 12 bp, Homo sapiens
cttaaaaatatg

SEQ ID NO: 4294305 - DNA, 15 bp, Homo sapiens
cttaaaaatatgtga

SEQ ID NO: 4294306 - DNA, 24 bp, Homo sapiens
cttaaaagctatcttcatgtaaat

SEQ ID NO: 4294307 - DNA, 22 bp, Homo sapiens
cttaaacagttgcacagcatct

SEQ ID NO: 4294308 - DNA, 14 bp, Homo sapiens
cttaaatagcatct

SEQ ID NO: 4294309 - DNA, 22 bp, Homo sapiens
cttaaccctgacaaattttaat

SEQ ID NO: 4294310 - DNA, 22 bp, Homo sapiens
cttaagaaagctatatatgaat

SEQ ID NO: 4294311 - DNA, 12 bp, Homo sapiens
cttaagaagtat

SEQ ID NO: 4294312 - DNA, 11 bp, Homo sapiens
cttaagcacaa

SEQ ID NO: 4294313 - DNA, 22 bp, Homo sapiens
cttaatgttctgaataatttct

SEQ ID NO: 4294314 - DNA, 23 bp, Homo sapiens
cttacagtaggagtgagaaattt

SEQ ID NO: 4294315 - DNA, 12 bp, Homo sapiens
cttacatgattc

SEQ ID NO: 4294316 - DNA, 19 bp, Homo sapiens
cttacatgcattactgcat

SEQ ID NO: 4294317 - DNA, 22 bp, Homo sapiens
cttacattagcagtttgctttg

SEQ ID NO: 4294318 - DNA, 16 bp, Homo sapiens
cttactgttttgtgcg

SEQ ID NO: 4294319 - DNA, 15 bp, Homo sapiens
cttagaacctttctt

SEQ ID NO: 4294320 - DNA, 16 bp, Homo sapiens
cttagaagccaccatg

SEQ ID NO: 4294321 - DNA, 17 bp, Homo sapiens
cttagacacctatcaga

SEQ ID NO: 4294322 - DNA, 20 bp, Homo sapiens
cttagactccttctccccaa

SEQ ID NO: 4294323 - DNA, 19 bp, Homo sapiens
cttagcattttctgcatct

SEQ ID NO: 4294324 - DNA, 23 bp, Homo sapiens
cttaggcaatggtgaactgtcat

SEQ ID NO: 4294325 - DNA, 17 bp, Homo sapiens
cttagtatctcatcaac

SEQ ID NO: 4294326 - DNA, 19 bp, Homo sapiens
cttagtatctcatcaacaa

SEQ ID NO: 4294327 - DNA, 15 bp, Homo sapiens
cttataagcaacatg

SEQ ID NO: 4294328 - DNA, 22 bp, Homo sapiens
cttattaaccaaattaaccttt

SEQ ID NO: 4294329 - DNA, 23 bp, Homo sapiens
cttatttatattcagagatgtac

SEQ ID NO: 4294330 - DNA, 15 bp, Homo sapiens
cttcaaaacagaacg

SEQ ID NO: 4294331 - DNA, 20 bp, Homo sapiens
cttcaaagtctcaatgaaat

SEQ ID NO: 4294332 - DNA, 17 bp, Homo sapiens
cttcaaattgtcttttg

SEQ ID NO: 4294333 - DNA, 15 bp, Homo sapiens
cttcaagcctggccc

SEQ ID NO: 4294334 - DNA, 17 bp, Homo sapiens
cttcaagcctggcccag

SEQ ID NO: 4294335 - DNA, 22 bp, Homo sapiens
cttcaagcctggcccagtgaga

SEQ ID NO: 4294336 - DNA, 18 bp, Homo sapiens
cttcaatcctgtcaatgt

SEQ ID NO: 4294337 - DNA, 21 bp, Homo sapiens
cttcaccaagcttagaagcca

SEQ ID NO: 4294338 - DNA, 13 bp, Homo sapiens
cttcaccaggaag

SEQ ID NO: 4294339 - DNA, 15 bp, Homo sapiens
cttcaccaggaagaa

SEQ ID NO: 4294340 - DNA, 22 bp, Homo sapiens
cttcaccaggaagaaggcccgg

SEQ ID NO: 4294341 - DNA, 15 bp, Homo sapiens
cttcacttaaaatca

SEQ ID NO: 4294342 - DNA, 17 bp, Homo sapiens
cttcacttctgaccaca

SEQ ID NO: 4294343 - DNA, 19 bp, Homo sapiens
cttcacttctgaccacact

SEQ ID NO: 4294344 - DNA, 23 bp, Homo sapiens
cttcagaattgtttttagaaatt

SEQ ID NO: 4294345 - DNA, 14 bp, Homo sapiens
cttcagactctctc

SEQ ID NO: 4294346 - DNA, 16 bp, Homo sapiens
cttcagactctctcct

SEQ ID NO: 4294347 - DNA, 20 bp, Homo sapiens
cttcagactctctcctctct

SEQ ID NO: 4294348 - DNA, 21 bp, Homo sapiens
cttcaggaaagcagcagtttt

SEQ ID NO: 4294349 - DNA, 16 bp, Homo sapiens
cttcaggcaccacaga

SEQ ID NO: 4294350 - DNA, 19 bp, Homo sapiens
cttcaggctcttctccttt

SEQ ID NO: 4294351 - DNA, 14 bp, Homo sapiens
cttcaggtgagcca

SEQ ID NO: 4294352 - DNA, 16 bp, Homo sapiens
cttcataaattatttc

SEQ ID NO: 4294353 - DNA, 23 bp, Homo sapiens
cttcatacaaaggacagtacaca

SEQ ID NO: 4294354 - DNA, 15 bp, Homo sapiens
cttcataggcagagc

SEQ ID NO: 4294355 - DNA, 13 bp, Homo sapiens
cttcatgctgtct

SEQ ID NO: 4294356 - DNA, 22 bp, Homo sapiens
cttcatgtaaattgactgtact

SEQ ID NO: 4294357 - DNA, 14 bp, Homo sapiens
cttcatttcctccg

SEQ ID NO: 4294358 - DNA, 18 bp, Homo sapiens
cttcatttgggatgctac

SEQ ID NO: 4294359 - DNA, 19 bp, Homo sapiens
cttccaaagagtcatcatg

SEQ ID NO: 4294360 - DNA, 18 bp, Homo sapiens
cttccacccccagctcct

SEQ ID NO: 4294361 - DNA, 17 bp, Homo sapiens
cttccagttggactgtg

SEQ ID NO: 4294362 - DNA, 13 bp, Homo sapiens
cttccatcagcag

SEQ ID NO: 4294363 - DNA, 14 bp, Homo sapiens
cttccatcagcagt

SEQ ID NO: 4294364 - DNA, 22 bp, Homo sapiens
cttccatgggcatggccgttgc

SEQ ID NO: 4294365 - DNA, 22 bp, Homo sapiens
cttcccaaagcaagcacctggg

SEQ ID NO: 4294366 - DNA, 21 bp, Homo sapiens
cttcccaccaactctctctgc

SEQ ID NO: 4294367 - DNA, 22 bp, Homo sapiens
cttcccaccaactctctctgcc

SEQ ID NO: 4294368 - DNA, 13 bp, Homo sapiens
cttcccaccccta

SEQ ID NO: 4294369 - DNA, 17 bp, Homo sapiens
cttcccacggccactgc

SEQ ID NO: 4294370 - DNA, 21 bp, Homo sapiens
cttcccatttgtaatgtatct

SEQ ID NO: 4294371 - DNA, 13 bp, Homo sapiens
cttccccactccc

SEQ ID NO: 4294372 - DNA, 15 bp, Homo sapiens
cttccccctccaatc

SEQ ID NO: 4294373 - DNA, 13 bp, Homo sapiens
cttcccccttccc

SEQ ID NO: 4294374 - DNA, 15 bp, Homo sapiens
cttcccctgcgccct

SEQ ID NO: 4294375 - DNA, 17 bp, Homo sapiens
cttcccctgcgccctcc

SEQ ID NO: 4294376 - DNA, 23 bp, Homo sapiens
cttcccgccctccccctgccaga

SEQ ID NO: 4294377 - DNA, 16 bp, Homo sapiens
cttcccgctcagccct

SEQ ID NO: 4294378 - DNA, 16 bp, Homo sapiens
cttccctctgcctgtc

SEQ ID NO: 4294379 - DNA, 14 bp, Homo sapiens
cttccctctgctcc

SEQ ID NO: 4294380 - DNA, 14 bp, Homo sapiens
cttccgctctgagg

SEQ ID NO: 4294381 - DNA, 16 bp, Homo sapiens
cttccgctctgaggca

SEQ ID NO: 4294382 - DNA, 19 bp, Homo sapiens
cttccggctgagctgtgcc

SEQ ID NO: 4294383 - DNA, 22 bp, Homo sapiens
cttccggctgagctgtgccagc

SEQ ID NO: 4294384 - DNA, 13 bp, Homo sapiens
cttcctctccact

SEQ ID NO: 4294385 - DNA, 21 bp, Homo sapiens
cttcctctccactgccttcga

SEQ ID NO: 4294386 - DNA, 13 bp, Homo sapiens
cttcctcttacct

SEQ ID NO: 4294387 - DNA, 21 bp, Homo sapiens
cttcctggattttctttctat

SEQ ID NO: 4294388 - DNA, 23 bp, Homo sapiens
cttcctggattttctttctatgt

SEQ ID NO: 4294389 - DNA, 17 bp, Homo sapiens
cttcctgtccagagaga

SEQ ID NO: 4294390 - DNA, 19 bp, Homo sapiens
cttcctgtccagagagaga

SEQ ID NO: 4294391 - DNA, 15 bp, Homo sapiens
cttccttcatttcct

SEQ ID NO: 4294392 - DNA, 15 bp, Homo sapiens
cttcgctattcccag

SEQ ID NO: 4294393 - DNA, 17 bp, Homo sapiens
cttcgctattcccaggc

SEQ ID NO: 4294394 - DNA, 19 bp, Homo sapiens
cttcgctattcccaggcag

SEQ ID NO: 4294395 - DNA, 20 bp, Homo sapiens
cttcgctattcccaggcagg

SEQ ID NO: 4294396 - DNA, 21 bp, Homo sapiens
cttcgctattcccaggcaggg

SEQ ID NO: 4294397 - DNA, 12 bp, Homo sapiens
cttcgggaagat

SEQ ID NO: 4294398 - DNA, 21 bp, Homo sapiens
cttcgttagtaatctgtataa

SEQ ID NO: 4294399 - DNA, 20 bp, Homo sapiens
cttctcaaatgctactcagt

SEQ ID NO: 4294400 - DNA, 15 bp, Homo sapiens
cttctccactggatg

SEQ ID NO: 4294401 - DNA, 18 bp, Homo sapiens
cttctccagccaccaagg

SEQ ID NO: 4294402 - DNA, 16 bp, Homo sapiens
cttctcccctccagac

SEQ ID NO: 4294403 - DNA, 17 bp, Homo sapiens
cttctcccctccagacc

SEQ ID NO: 4294404 - DNA, 19 bp, Homo sapiens
cttctcccctccagacccc

SEQ ID NO: 4294405 - DNA, 20 bp, Homo sapiens
cttctcccctccagacccct

SEQ ID NO: 4294406 - DNA, 14 bp, Homo sapiens
cttctctctgtgct

SEQ ID NO: 4294407 - DNA, 14 bp, Homo sapiens
cttctctgttcatt

SEQ ID NO: 4294408 - DNA, 15 bp, Homo sapiens
cttctgaagatctca

SEQ ID NO: 4294409 - DNA, 15 bp, Homo sapiens
cttctgaccacactt

SEQ ID NO: 4294410 - DNA, 20 bp, Homo sapiens
cttctgatgaaatgttaaca

SEQ ID NO: 4294411 - DNA, 18 bp, Homo sapiens
cttctggccgctgcagtc

SEQ ID NO: 4294412 - DNA, 14 bp, Homo sapiens
cttctggctgctgc

SEQ ID NO: 4294413 - DNA, 16 bp, Homo sapiens
cttctggctgctgcag

SEQ ID NO: 4294414 - DNA, 13 bp, Homo sapiens
cttctgtggctca

SEQ ID NO: 4294415 - DNA, 15 bp, Homo sapiens
cttcttccattccca

SEQ ID NO: 4294416 - DNA, 19 bp, Homo sapiens
cttcttccattcccagaca

SEQ ID NO: 4294417 - DNA, 19 bp, Homo sapiens
cttctttggtgttctggcc

SEQ ID NO: 4294418 - DNA, 22 bp, Homo sapiens
cttgaaaacctcatttaccata

SEQ ID NO: 4294419 - DNA, 20 bp, Homo sapiens
cttgaaattatatctgtggt

SEQ ID NO: 4294420 - DNA, 21 bp, Homo sapiens
cttgaaattatatctgtggtc

SEQ ID NO: 4294421 - DNA, 14 bp, Homo sapiens
cttgaacaaagtct

SEQ ID NO: 4294422 - DNA, 12 bp, Homo sapiens
cttgaagaatat

SEQ ID NO: 4294423 - DNA, 14 bp, Homo sapiens
cttgaagaatattg

SEQ ID NO: 4294424 - DNA, 18 bp, Homo sapiens
cttgaagaatattgttaa

SEQ ID NO: 4294425 - DNA, 17 bp, Homo sapiens
cttgaatagtattgtgt

SEQ ID NO: 4294426 - DNA, 19 bp, Homo sapiens
cttgaatattatacttctt

SEQ ID NO: 4294427 - DNA, 20 bp, Homo sapiens
cttgaatgtccccattctat

SEQ ID NO: 4294428 - DNA, 20 bp, Homo sapiens
cttgagaataaatgagcatt

SEQ ID NO: 4294429 - DNA, 13 bp, Homo sapiens
cttgagacagctt

SEQ ID NO: 4294430 - DNA, 14 bp, Homo sapiens
cttgagagcgctgg

SEQ ID NO: 4294431 - DNA, 16 bp, Homo sapiens
cttgagctgagatgga

SEQ ID NO: 4294432 - DNA, 18 bp, Homo sapiens
cttgagtgacatgcggct

SEQ ID NO: 4294433 - DNA, 16 bp, Homo sapiens
cttgatgttcctggga

SEQ ID NO: 4294434 - DNA, 16 bp, Homo sapiens
cttgattctaaagggg

SEQ ID NO: 4294435 - DNA, 20 bp, Homo sapiens
cttgattctaaaggggacag

SEQ ID NO: 4294436 - DNA, 15 bp, Homo sapiens
cttgcaacacacaga

SEQ ID NO: 4294437 - DNA, 17 bp, Homo sapiens
cttgcaacacacagaca

SEQ ID NO: 4294438 - DNA, 19 bp, Homo sapiens
cttgcaacacacagacaca

SEQ ID NO: 4294439 - DNA, 19 bp, Homo sapiens
cttgcactggccttctgat

SEQ ID NO: 4294440 - DNA, 17 bp, Homo sapiens
cttgcagtcatcagaag

SEQ ID NO: 4294441 - DNA, 15 bp, Homo sapiens
cttgcataagcctca

SEQ ID NO: 4294442 - DNA, 16 bp, Homo sapiens
cttgcataagcctcag

SEQ ID NO: 4294443 - DNA, 19 bp, Homo sapiens
cttgcataagcctcaggcc

SEQ ID NO: 4294444 - DNA, 20 bp, Homo sapiens
cttgcattttagctaattta

SEQ ID NO: 4294445 - DNA, 16 bp, Homo sapiens
cttgccagtcactccg

SEQ ID NO: 4294446 - DNA, 15 bp, Homo sapiens
cttgccgctgggaga

SEQ ID NO: 4294447 - DNA, 19 bp, Homo sapiens
cttgccgctgggagagcca

SEQ ID NO: 4294448 - DNA, 12 bp, Homo sapiens
cttgcctcctgt

SEQ ID NO: 4294449 - DNA, 15 bp, Homo sapiens
cttgcctcctgtgta

SEQ ID NO: 4294450 - DNA, 16 bp, Homo sapiens
cttgctagtgatacac

SEQ ID NO: 4294451 - DNA, 14 bp, Homo sapiens
cttgctcaataaag

SEQ ID NO: 4294452 - DNA, 19 bp, Homo sapiens
cttgctcaataaaggtcat

SEQ ID NO: 4294453 - DNA, 21 bp, Homo sapiens
cttgctgcactcttgcacatg

SEQ ID NO: 4294454 - DNA, 23 bp, Homo sapiens
cttgctgcactcttgcacatgga

SEQ ID NO: 4294455 - DNA, 13 bp, Homo sapiens
cttgctgctggct

SEQ ID NO: 4294456 - DNA, 14 bp, Homo sapiens
cttgctgctggctc

SEQ ID NO: 4294457 - DNA, 15 bp, Homo sapiens
cttgctgctggctcc

SEQ ID NO: 4294458 - DNA, 16 bp, Homo sapiens
cttgctgctggctccc

SEQ ID NO: 4294459 - DNA, 18 bp, Homo sapiens
cttgctttcacaaatata

SEQ ID NO: 4294460 - DNA, 17 bp, Homo sapiens
cttggacaccatcccct

SEQ ID NO: 4294461 - DNA, 19 bp, Homo sapiens
cttggacggggacacggcc

SEQ ID NO: 4294462 - DNA, 19 bp, Homo sapiens
cttggagaggaggtgtgga

SEQ ID NO: 4294463 - DNA, 15 bp, Homo sapiens
cttggagcagaggtg

SEQ ID NO: 4294464 - DNA, 14 bp, Homo sapiens
cttggagccggact

SEQ ID NO: 4294465 - DNA, 21 bp, Homo sapiens
cttggagccggactttcggag

SEQ ID NO: 4294466 - DNA, 20 bp, Homo sapiens
cttggataggagcttccaga

SEQ ID NO: 4294467 - DNA, 21 bp, Homo sapiens
cttggataggagcttccagat

SEQ ID NO: 4294468 - DNA, 20 bp, Homo sapiens
cttggatccatacaaaacta

SEQ ID NO: 4294469 - DNA, 14 bp, Homo sapiens
cttggcaggaacca

SEQ ID NO: 4294470 - DNA, 14 bp, Homo sapiens
cttggcctgtccac

SEQ ID NO: 4294471 - DNA, 15 bp, Homo sapiens
cttggctagtcacat

SEQ ID NO: 4294472 - DNA, 21 bp, Homo sapiens
cttgggaccaaaactgcctac

SEQ ID NO: 4294473 - DNA, 20 bp, Homo sapiens
cttgggatgggcacaggctg

SEQ ID NO: 4294474 - DNA, 19 bp, Homo sapiens
cttggggattcttccatct

SEQ ID NO: 4294475 - DNA, 16 bp, Homo sapiens
cttggggtagagagga

SEQ ID NO: 4294476 - DNA, 17 bp, Homo sapiens
cttggggtagagaggac

SEQ ID NO: 4294477 - DNA, 19 bp, Homo sapiens
cttggtgcctaatgttcca

SEQ ID NO: 4294478 - DNA, 13 bp, Homo sapiens
cttggttcctcca

SEQ ID NO: 4294479 - DNA, 16 bp, Homo sapiens
cttggttcctccagca

SEQ ID NO: 4294480 - DNA, 17 bp, Homo sapiens
gacaaccaccgctcccc

SEQ ID NO: 4294481 - DNA, 13 bp, Homo sapiens
gacaaccctgcaa

SEQ ID NO: 4294482 - DNA, 20 bp, Homo sapiens
gacaaccgatgctccagcca

SEQ ID NO: 4294483 - DNA, 12 bp, Homo sapiens
gacaagcccagg

SEQ ID NO: 4294484 - DNA, 13 bp, Homo sapiens
gacaagcccagga

SEQ ID NO: 4294485 - DNA, 17 bp, Homo sapiens
gacaagccccaggcagg

SEQ ID NO: 4294486 - DNA, 14 bp, Homo sapiens
gacaaggccccaga

SEQ ID NO: 4294487 - DNA, 16 bp, Homo sapiens
gacaaggccccagaga

SEQ ID NO: 4294488 - DNA, 18 bp, Homo sapiens
gacaaggtgtttctctgt

SEQ ID NO: 4294489 - DNA, 20 bp, Homo sapiens
gacaatttcaaaatgcatgt

SEQ ID NO: 4294490 - DNA, 21 bp, Homo sapiens
gacacaaaggacaaaaatata

SEQ ID NO: 4294491 - DNA, 11 bp, Homo sapiens
gacacaactca

SEQ ID NO: 4294492 - DNA, 19 bp, Homo sapiens
gacacagtcagggcggggc

SEQ ID NO: 4294493 - DNA, 22 bp, Homo sapiens
gacacagtcagggcggggctgg

SEQ ID NO: 4294494 - DNA, 20 bp, Homo sapiens
gacacataaatctgtctgat

SEQ ID NO: 4294495 - DNA, 17 bp, Homo sapiens
gacacctatcagagaag

SEQ ID NO: 4294496 - DNA, 18 bp, Homo sapiens
gacacctatcagagaagc

SEQ ID NO: 4294497 - DNA, 18 bp, Homo sapiens
gacacgcccgactctctc

SEQ ID NO: 4294498 - DNA, 21 bp, Homo sapiens
gacacgcccgactctctccat

SEQ ID NO: 4294499 - DNA, 15 bp, Homo sapiens
gacacggcctctggg

SEQ ID NO: 4294500 - DNA, 22 bp, Homo sapiens
gacacggcctctggggagaccg

SEQ ID NO: 4294501 - DNA, 13 bp, Homo sapiens
gacacgtgttttt

SEQ ID NO: 4294502 - DNA, 14 bp, Homo sapiens
gacactggtctcag

SEQ ID NO: 4294503 - DNA, 18 bp, Homo sapiens
gacactgtctgctgcccc

SEQ ID NO: 4294504 - DNA, 21 bp, Homo sapiens
gacacttttcatatcatttct

SEQ ID NO: 4294505 - DNA, 17 bp, Homo sapiens
gacagacccagggtggt

SEQ ID NO: 4294506 - DNA, 13 bp, Homo sapiens
gacagagtctggg

SEQ ID NO: 4294507 - DNA, 18 bp, Homo sapiens
gacagatcaatggcgcag

SEQ ID NO: 4294508 - DNA, 15 bp, Homo sapiens
gacagatcttgagca

SEQ ID NO: 4294509 - DNA, 18 bp, Homo sapiens
gacagatcttgagcaagg

SEQ ID NO: 4294510 - DNA, 23 bp, Homo sapiens
gacagatgttccatcctgtacaa

SEQ ID NO: 4294511 - DNA, 16 bp, Homo sapiens
gacagcagtgtgaggg

SEQ ID NO: 4294512 - DNA, 20 bp, Homo sapiens
gacagcagtgtgagggtgca

SEQ ID NO: 4294513 - DNA, 19 bp, Homo sapiens
gacagcctggcacagggca

SEQ ID NO: 4294514 - DNA, 18 bp, Homo sapiens
gacagcgggtaaaaagag

SEQ ID NO: 4294515 - DNA, 23 bp, Homo sapiens
gacagcgggtaaaaagagaaggc

SEQ ID NO: 4294516 - DNA, 12 bp, Homo sapiens
gacagcttcccc

SEQ ID NO: 4294517 - DNA, 15 bp, Homo sapiens
gacaggaacacccag

SEQ ID NO: 4294518 - DNA, 14 bp, Homo sapiens
gacagggagctggg

SEQ ID NO: 4294519 - DNA, 13 bp, Homo sapiens
gacagggagggaa

SEQ ID NO: 4294520 - DNA, 20 bp, Homo sapiens
gacagggcatggccaggtgg

SEQ ID NO: 4294521 - DNA, 16 bp, Homo sapiens
gacagggccagggttg

SEQ ID NO: 4294522 - DNA, 14 bp, Homo sapiens
gacagtcaggaagc

SEQ ID NO: 4294523 - DNA, 23 bp, Homo sapiens
gacagtcaggaagcctcctgctg

SEQ ID NO: 4294524 - DNA, 22 bp, Homo sapiens
gacagtctggaggtcccagaca

SEQ ID NO: 4294525 - DNA, 20 bp, Homo sapiens
gacatcagtggcatggctcc

SEQ ID NO: 4294526 - DNA, 18 bp, Homo sapiens
gacatccccctccttgcc

SEQ ID NO: 4294527 - DNA, 19 bp, Homo sapiens
gacatccccctccttgccg

SEQ ID NO: 4294528 - DNA, 18 bp, Homo sapiens
gacatcggttcaggagga

SEQ ID NO: 4294529 - DNA, 21 bp, Homo sapiens
gacatgctaacctctctgaac

SEQ ID NO: 4294530 - DNA, 21 bp, Homo sapiens
gacatgctgcccaccccctgc

SEQ ID NO: 4294531 - DNA, 21 bp, Homo sapiens
gacatgtctttggcttcagaa

SEQ ID NO: 4294532 - DNA, 13 bp, Homo sapiens
gacatttctcaaa

SEQ ID NO: 4294533 - DNA, 21 bp, Homo sapiens
gaccaacgatcctatgagaga

SEQ ID NO: 4294534 - DNA, 17 bp, Homo sapiens
gaccaaggacccctcac

SEQ ID NO: 4294535 - DNA, 19 bp, Homo sapiens
gaccaaggacccctcacct

SEQ ID NO: 4294536 - DNA, 13 bp, Homo sapiens
gaccaatctctgt

SEQ ID NO: 4294537 - DNA, 20 bp, Homo sapiens
gaccacaaggctgaaaagtg

SEQ ID NO: 4294538 - DNA, 20 bp, Homo sapiens
gaccacactctgcctggcct

SEQ ID NO: 4294539 - DNA, 20 bp, Homo sapiens
gaccacacttcctgtccaga

SEQ ID NO: 4294540 - DNA, 23 bp, Homo sapiens
gaccacacttcctgtccagagag

SEQ ID NO: 4294541 - DNA, 13 bp, Homo sapiens
gaccaggagccag

SEQ ID NO: 4294542 - DNA, 18 bp, Homo sapiens
gaccaggctcacaactgt

SEQ ID NO: 4294543 - DNA, 22 bp, Homo sapiens
gacccagggtggtcttcaagcc

SEQ ID NO: 4294544 - DNA, 20 bp, Homo sapiens
gaccccacttatgctgctgt

SEQ ID NO: 4294545 - DNA, 12 bp, Homo sapiens
gaccccagctcc

SEQ ID NO: 4294546 - DNA, 18 bp, Homo sapiens
gaccccagctccaggcag

SEQ ID NO: 4294547 - DNA, 12 bp, Homo sapiens
gacccccacccc

SEQ ID NO: 4294548 - DNA, 16 bp, Homo sapiens
gacccccaccccttcc

SEQ ID NO: 4294549 - DNA, 17 bp, Homo sapiens
gacccccaccccttccc

SEQ ID NO: 4294550 - DNA, 14 bp, Homo sapiens
gacccctcaccttg

SEQ ID NO: 4294551 - DNA, 13 bp, Homo sapiens
gacccctggcttt

SEQ ID NO: 4294552 - DNA, 14 bp, Homo sapiens
gacccggaggccac

SEQ ID NO: 4294553 - DNA, 19 bp, Homo sapiens
gacccggcccccgccctct

SEQ ID NO: 4294554 - DNA, 19 bp, Homo sapiens
gaccctcggggcaggaagt

SEQ ID NO: 4294555 - DNA, 18 bp, Homo sapiens
gaccctggagcccggcag

SEQ ID NO: 4294556 - DNA, 16 bp, Homo sapiens
gaccctgggtcacctt

SEQ ID NO: 4294557 - DNA, 22 bp, Homo sapiens
gaccgagtgtggagctgcttcc

SEQ ID NO: 4294558 - DNA, 20 bp, Homo sapiens
gaccgccagatggggcctct

SEQ ID NO: 4294559 - DNA, 14 bp, Homo sapiens
gaccgggagcctgc

SEQ ID NO: 4294560 - DNA, 20 bp, Homo sapiens
gacctaaatccattttctaa

SEQ ID NO: 4294561 - DNA, 18 bp, Homo sapiens
gacctccacctgggagat

SEQ ID NO: 4294562 - DNA, 20 bp, Homo sapiens
gacctccacctgggagatgc

SEQ ID NO: 4294563 - DNA, 16 bp, Homo sapiens
gacctccttagaaaag

SEQ ID NO: 4294564 - DNA, 22 bp, Homo sapiens
gacctgaagagcgctcctctgc

SEQ ID NO: 4294565 - DNA, 17 bp, Homo sapiens
gacctgcagttggcctc

SEQ ID NO: 4294566 - DNA, 19 bp, Homo sapiens
gacctgcccccgctctgcc

SEQ ID NO: 4294567 - DNA, 12 bp, Homo sapiens
gacctgtgaggg

SEQ ID NO: 4294568 - DNA, 13 bp, Homo sapiens
gaccttctgaaga

SEQ ID NO: 4294569 - DNA, 18 bp, Homo sapiens
gaccttctgaagatctca

SEQ ID NO: 4294570 - DNA, 12 bp, Homo sapiens
gaccttctggga

SEQ ID NO: 4294571 - DNA, 16 bp, Homo sapiens
gaccttgatgtcttga

SEQ ID NO: 4294572 - DNA, 21 bp, Homo sapiens
gaccttgatgtcttgagagcg

SEQ ID NO: 4294573 - DNA, 19 bp, Homo sapiens
gacctttgtctgaaggatt

SEQ ID NO: 4294574 - DNA, 17 bp, Homo sapiens
gacgcagggagaccctg

SEQ ID NO: 4294575 - DNA, 20 bp, Homo sapiens
gacgcagggagaccctggga

SEQ ID NO: 4294576 - DNA, 21 bp, Homo sapiens
gacgcagggagaccctgggag

SEQ ID NO: 4294577 - DNA, 23 bp, Homo sapiens
gacgcagggagaccctgggagag

SEQ ID NO: 4294578 - DNA, 21 bp, Homo sapiens
gacgccttcaggcaccacaga

SEQ ID NO: 4294579 - DNA, 18 bp, Homo sapiens
gacggagcactgtgcagc

SEQ ID NO: 4294580 - DNA, 14 bp, Homo sapiens
gacggctcctcccc

SEQ ID NO: 4294581 - DNA, 19 bp, Homo sapiens
gacggggacacggcctctg

SEQ ID NO: 4294582 - DNA, 22 bp, Homo sapiens
gactaaaccattgtgcattcta

SEQ ID NO: 4294583 - DNA, 18 bp, Homo sapiens
gactaaataatgatcttc

SEQ ID NO: 4294584 - DNA, 19 bp, Homo sapiens
gactatgtgtcatgatttc

SEQ ID NO: 4294585 - DNA, 21 bp, Homo sapiens
gactcacggctgcacctgcag

SEQ ID NO: 4294586 - DNA, 22 bp, Homo sapiens
gactcacggctgcacctgcagg

SEQ ID NO: 4294587 - DNA, 23 bp, Homo sapiens
gactcacggctgcacctgcaggg

SEQ ID NO: 4294588 - DNA, 13 bp, Homo sapiens
gactcaggcccac

SEQ ID NO: 4294589 - DNA, 12 bp, Homo sapiens
gactccttctcc

SEQ ID NO: 4294590 - DNA, 16 bp, Homo sapiens
gactccttctccccaa

SEQ ID NO: 4294591 - DNA, 23 bp, Homo sapiens
gactcgggctaagtccagctctc

SEQ ID NO: 4294592 - DNA, 19 bp, Homo sapiens
gactctctccatcagaagg

SEQ ID NO: 4294593 - DNA, 15 bp, Homo sapiens
gactctctcctctct

SEQ ID NO: 4294594 - DNA, 14 bp, Homo sapiens
gactctggactggg

SEQ ID NO: 4294595 - DNA, 16 bp, Homo sapiens
gactctggactgggaa

SEQ ID NO: 4294596 - DNA, 16 bp, Homo sapiens
gactctgtggggccac

SEQ ID NO: 4294597 - DNA, 17 bp, Homo sapiens
gactctgtggggccaca

SEQ ID NO: 4294598 - DNA, 16 bp, Homo sapiens
gactgccgaccgaggc

SEQ ID NO: 4294599 - DNA, 22 bp, Homo sapiens
gactgctgcgctgtgctggtct

SEQ ID NO: 4294600 - DNA, 15 bp, Homo sapiens
gactggatactgccc

SEQ ID NO: 4294601 - DNA, 22 bp, Homo sapiens
gactggatactgcccggggcag

SEQ ID NO: 4294602 - DNA, 14 bp, Homo sapiens
gactggcccacccc

SEQ ID NO: 4294603 - DNA, 15 bp, Homo sapiens
gactggcccacccct

SEQ ID NO: 4294604 - DNA, 17 bp, Homo sapiens
gactggcccacccctct

SEQ ID NO: 4294605 - DNA, 21 bp, Homo sapiens
gactggcccacccctcttccc

SEQ ID NO: 4294606 - DNA, 22 bp, Homo sapiens
gactggcccacccctcttcccc

SEQ ID NO: 4294607 - DNA, 9 bp, Homo sapiens
gactggtcc

SEQ ID NO: 4294608 - DNA, 11 bp, Homo sapiens
gactggtccag

SEQ ID NO: 4294609 - DNA, 22 bp, Homo sapiens
gactgtctcaagagggcactgg

SEQ ID NO: 4294610 - DNA, 17 bp, Homo sapiens
gactgttttcagacctt

SEQ ID NO: 4294611 - DNA, 20 bp, Homo sapiens
gactgttttttcctgagctt

SEQ ID NO: 4294612 - DNA, 18 bp, Homo sapiens
gacttacatgattcattt

SEQ ID NO: 4294613 - DNA, 19 bp, Homo sapiens
gacttacatgattcatttt

SEQ ID NO: 4294614 - DNA, 15 bp, Homo sapiens
gacttaggccagagg

SEQ ID NO: 4294615 - DNA, 15 bp, Homo sapiens
gacttcagactctct

SEQ ID NO: 4294616 - DNA, 21 bp, Homo sapiens
gacttcctgctacagtagctg

SEQ ID NO: 4294617 - DNA, 18 bp, Homo sapiens
gacttcgctattcccagg

SEQ ID NO: 4294618 - DNA, 19 bp, Homo sapiens
gacttcgctattcccaggc

SEQ ID NO: 4294619 - DNA, 23 bp, Homo sapiens
gacttcgctattcccaggcaggg

SEQ ID NO: 4294620 - DNA, 22 bp, Homo sapiens
gacttctttggtgttctggcct

SEQ ID NO: 4294621 - DNA, 17 bp, Homo sapiens
gacttgatgaataaaca

SEQ ID NO: 4294622 - DNA, 15 bp, Homo sapiens
gacttgtgcctcttg

SEQ ID NO: 4294623 - DNA, 15 bp, Homo sapiens
gactttccaccccct

SEQ ID NO: 4294624 - DNA, 21 bp, Homo sapiens
gactttgctgatttcccctct

SEQ ID NO: 4294625 - DNA, 21 bp, Homo sapiens
gacttttagcggtttgcaaac

SEQ ID NO: 4294626 - DNA, 14 bp, Homo sapiens
gagaaaaaccaatg

SEQ ID NO: 4294627 - DNA, 14 bp, Homo sapiens
gagaaaagccagat

SEQ ID NO: 4294628 - DNA, 16 bp, Homo sapiens
gagaaagcatattgac

SEQ ID NO: 4294629 - DNA, 24 bp, Homo sapiens
gagaagcagcatcaacctaggagc

SEQ ID NO: 4294630 - DNA, 21 bp, Homo sapiens
gagaagcctcagtccctccct

SEQ ID NO: 4294631 - DNA, 18 bp, Homo sapiens
gagaagcctcatgggagt

SEQ ID NO: 4294632 - DNA, 17 bp, Homo sapiens
gagaaggcaagctggca

SEQ ID NO: 4294633 - DNA, 14 bp, Homo sapiens
gagaaggcctgccc

SEQ ID NO: 4294634 - DNA, 20 bp, Homo sapiens
gagaagggttagacaagcct

SEQ ID NO: 4294635 - DNA, 16 bp, Homo sapiens
gagaaggtggtctgca

SEQ ID NO: 4294636 - DNA, 17 bp, Homo sapiens
gagaaggtggtctgcac

SEQ ID NO: 4294637 - DNA, 18 bp, Homo sapiens
gagaaggtggtctgcacc

SEQ ID NO: 4294638 - DNA, 14 bp, Homo sapiens
gagaatgcctaggc

SEQ ID NO: 4294639 - DNA, 19 bp, Homo sapiens
gagaatgcctaggccagct

SEQ ID NO: 4294640 - DNA, 19 bp, Homo sapiens
gagacactggtctcagagg

SEQ ID NO: 4294641 - DNA, 13 bp, Homo sapiens
gagaccaggactc

SEQ ID NO: 4294642 - DNA, 14 bp, Homo sapiens
gagaccaggactct

SEQ ID NO: 4294643 - DNA, 12 bp, Homo sapiens
gagaccctgcca

SEQ ID NO: 4294644 - DNA, 20 bp, Homo sapiens
gagaccctgccaactttcca

SEQ ID NO: 4294645 - DNA, 23 bp, Homo sapiens
gagaccgagtgtggagctgcttc

SEQ ID NO: 4294646 - DNA, 14 bp, Homo sapiens
gagaccttctctta

SEQ ID NO: 4294647 - DNA, 16 bp, Homo sapiens
gagactcaggcccaca

SEQ ID NO: 4294648 - DNA, 17 bp, Homo sapiens
gagacttaggccagagg

SEQ ID NO: 4294649 - DNA, 15 bp, Homo sapiens
gagagaaaggagggc

SEQ ID NO: 4294650 - DNA, 13 bp, Homo sapiens
gagagaagtgccc

SEQ ID NO: 4294651 - DNA, 21 bp, Homo sapiens
gagagaatgagagagtgtgga

SEQ ID NO: 4294652 - DNA, 23 bp, Homo sapiens
gagagagaagtgcccctgctgcc

SEQ ID NO: 4294653 - DNA, 16 bp, Homo sapiens
gagagagttgaaccta

SEQ ID NO: 4294654 - DNA, 14 bp, Homo sapiens
gagagatatatctg

SEQ ID NO: 4294655 - DNA, 14 bp, Homo sapiens
gagagcccccacca

SEQ ID NO: 4294656 - DNA, 21 bp, Homo sapiens
gagagcggcttccccattgcc

SEQ ID NO: 4294657 - DNA, 21 bp, Homo sapiens
gagaggagcgggacctgtggc

SEQ ID NO: 4294658 - DNA, 19 bp, Homo sapiens
gagaggaggtgtggagtgg

SEQ ID NO: 4294659 - DNA, 22 bp, Homo sapiens
gagaggaggtgtggagtggagg

SEQ ID NO: 4294660 - DNA, 22 bp, Homo sapiens
gagaggggacttggataggagc

SEQ ID NO: 4294661 - DNA, 22 bp, Homo sapiens
gagagtgaggtcatcccggggc

SEQ ID NO: 4294662 - DNA, 23 bp, Homo sapiens
gagagtgctcaacctacagtgga

SEQ ID NO: 4294663 - DNA, 21 bp, Homo sapiens
gagagtggctcctcccggtgc

SEQ ID NO: 4294664 - DNA, 22 bp, Homo sapiens
gagagtgtggaaaaaaaaagaa

SEQ ID NO: 4294665 - DNA, 18 bp, Homo sapiens
gagatatatctgaaaact

SEQ ID NO: 4294666 - DNA, 17 bp, Homo sapiens
gagatattttgtaaaat

SEQ ID NO: 4294667 - DNA, 20 bp, Homo sapiens
gagatattttgtaaaatgta

SEQ ID NO: 4294668 - DNA, 17 bp, Homo sapiens
gagatccgccctgggct

SEQ ID NO: 4294669 - DNA, 17 bp, Homo sapiens
gagatcctcaaaaatca

SEQ ID NO: 4294670 - DNA, 22 bp, Homo sapiens
gagatcctcaaaaatcatcaaa

SEQ ID NO: 4294671 - DNA, 13 bp, Homo sapiens
gagatcttccttc

SEQ ID NO: 4294672 - DNA, 17 bp, Homo sapiens
gagatgtgtatcagtgt

SEQ ID NO: 4294673 - DNA, 21 bp, Homo sapiens
gagattggatcaagtattact

SEQ ID NO: 4294674 - DNA, 17 bp, Homo sapiens
gagattgggggggcttg

SEQ ID NO: 4294675 - DNA, 19 bp, Homo sapiens
gagattgggggggcttggg

SEQ ID NO: 4294676 - DNA, 16 bp, Homo sapiens
gagatttgtatttata

SEQ ID NO: 4294677 - DNA, 22 bp, Homo sapiens
gagcaaatttcatctttccaaa

SEQ ID NO: 4294678 - DNA, 17 bp, Homo sapiens
gagcaaggcaagaagtg

SEQ ID NO: 4294679 - DNA, 20 bp, Homo sapiens
gagcaaggcaagaagtggga

SEQ ID NO: 4294680 - DNA, 20 bp, Homo sapiens
gagcacagctttcctgggtc

SEQ ID NO: 4294681 - DNA, 21 bp, Homo sapiens
gagcactggaggcctctgcaa

SEQ ID NO: 4294682 - DNA, 16 bp, Homo sapiens
gagcactgtgcagccg

SEQ ID NO: 4294683 - DNA, 19 bp, Homo sapiens
gagcagagacgaagacccc

SEQ ID NO: 4294684 - DNA, 11 bp, Homo sapiens
gagcaggaagc

SEQ ID NO: 4294685 - DNA, 11 bp, Homo sapiens
gagcagggtga

SEQ ID NO: 4294686 - DNA, 17 bp, Homo sapiens
gagcagtgggccctggc

SEQ ID NO: 4294687 - DNA, 20 bp, Homo sapiens
gagcagtgggccctggctct

SEQ ID NO: 4294688 - DNA, 19 bp, Homo sapiens
gagcattctggggtggggc

SEQ ID NO: 4294689 - DNA, 13 bp, Homo sapiens
gagccaaggccta

SEQ ID NO: 4294690 - DNA, 17 bp, Homo sapiens
gagccaaggggtctgct

SEQ ID NO: 4294691 - DNA, 20 bp, Homo sapiens
gagccaaggggtctgctcct

SEQ ID NO: 4294692 - DNA, 14 bp, Homo sapiens
gagccacaggcaga

SEQ ID NO: 4294693 - DNA, 17 bp, Homo sapiens
gagccagattaggcctg

SEQ ID NO: 4294694 - DNA, 12 bp, Homo sapiens
gagccagcaggg

SEQ ID NO: 4294695 - DNA, 20 bp, Homo sapiens
gagccagcagggcgggccag

SEQ ID NO: 4294696 - DNA, 23 bp, Homo sapiens
gagccagcagggcgggccaggag

SEQ ID NO: 4294697 - DNA, 17 bp, Homo sapiens
gagccagggctgtcctt

SEQ ID NO: 4294698 - DNA, 17 bp, Homo sapiens
gagcccccaccagcagc

SEQ ID NO: 4294699 - DNA, 15 bp, Homo sapiens
gagccccctgtcctt

SEQ ID NO: 4294700 - DNA, 22 bp, Homo sapiens
gagccccgccgtgtctgtggcc

SEQ ID NO: 4294701 - DNA, 17 bp, Homo sapiens
gagcccgcacccccacc

SEQ ID NO: 4294702 - DNA, 19 bp, Homo sapiens
gagcccgcacccccaccct

SEQ ID NO: 4294703 - DNA, 21 bp, Homo sapiens
gagcccggcagtgcaccccct

SEQ ID NO: 4294704 - DNA, 23 bp, Homo sapiens
gagccctgccctcactccactcc

SEQ ID NO: 4294705 - DNA, 18 bp, Homo sapiens
gagccgagctctcctggg

SEQ ID NO: 4294706 - DNA, 22 bp, Homo sapiens
gagccgagctctcctgggccag

SEQ ID NO: 4294707 - DNA, 22 bp, Homo sapiens
gagccggactttcggagttggg

SEQ ID NO: 4294708 - DNA, 13 bp, Homo sapiens
gagcctccctcag

SEQ ID NO: 4294709 - DNA, 17 bp, Homo sapiens
gagcctcgcccctccag

SEQ ID NO: 4294710 - DNA, 21 bp, Homo sapiens
gagcctcgcccctccagtgtt

SEQ ID NO: 4294711 - DNA, 22 bp, Homo sapiens
gagcctcgcccctccagtgttg

SEQ ID NO: 4294712 - DNA, 16 bp, Homo sapiens
gagcctgcgtggcctg

SEQ ID NO: 4294713 - DNA, 16 bp, Homo sapiens
gagcctggggtgggtg

SEQ ID NO: 4294714 - DNA, 14 bp, Homo sapiens
gagcgacggctcct

SEQ ID NO: 4294715 - DNA, 12 bp, Homo sapiens
gagcgcccctcc

SEQ ID NO: 4294716 - DNA, 14 bp, Homo sapiens
gagcgctggcctct

SEQ ID NO: 4294717 - DNA, 17 bp, Homo sapiens
gagcggccgcctgtcct

SEQ ID NO: 4294718 - DNA, 19 bp, Homo sapiens
gagcggccgcctgtccttg

SEQ ID NO: 4294719 - DNA, 16 bp, Homo sapiens
gagcgtgtcctatccc

SEQ ID NO: 4294720 - DNA, 21 bp, Homo sapiens
gagctaaattacaattgtcat

SEQ ID NO: 4294721 - DNA, 13 bp, Homo sapiens
gagctagagaaat

SEQ ID NO: 4294722 - DNA, 17 bp, Homo sapiens
gagctcagcacagcctc

SEQ ID NO: 4294723 - DNA, 13 bp, Homo sapiens
gagctcaggagaa

SEQ ID NO: 4294724 - DNA, 16 bp, Homo sapiens
gagctcaggagaaggc

SEQ ID NO: 4294725 - DNA, 20 bp, Homo sapiens
gagctccacagaagacacgt

SEQ ID NO: 4294726 - DNA, 15 bp, Homo sapiens
gagctccagaccccc

SEQ ID NO: 4294727 - DNA, 20 bp, Homo sapiens
gagctccagacccccagcaa

SEQ ID NO: 4294728 - DNA, 15 bp, Homo sapiens
gagctcctctgggca

SEQ ID NO: 4294729 - DNA, 17 bp, Homo sapiens
gagctctgacctgcccc

SEQ ID NO: 4294730 - DNA, 13 bp, Homo sapiens
gagctgaggggca

SEQ ID NO: 4294731 - DNA, 16 bp, Homo sapiens
gagctgaggggcaggg

SEQ ID NO: 4294732 - DNA, 18 bp, Homo sapiens
gagctgcagaaccagtcc

SEQ ID NO: 4294733 - DNA, 20 bp, Homo sapiens
gagctggggaatcccctcgc

SEQ ID NO: 4294734 - DNA, 22 bp, Homo sapiens
gagctggggaatcccctcgctt

SEQ ID NO: 4294735 - DNA, 19 bp, Homo sapiens
gagctgggggccatgagct

SEQ ID NO: 4294736 - DNA, 14 bp, Homo sapiens
gagctgtgccagct

SEQ ID NO: 4294737 - DNA, 17 bp, Homo sapiens
gagctgtgccagctgct

SEQ ID NO: 4294738 - DNA, 21 bp, Homo sapiens
gagctgtgccagctgcttctg

SEQ ID NO: 4294739 - DNA, 23 bp, Homo sapiens
gagctgtgccagctgcttctgcc

SEQ ID NO: 4294740 - DNA, 23 bp, Homo sapiens
gagcttctccagccaccaaggct

SEQ ID NO: 4294741 - DNA, 21 bp, Homo sapiens
gagcttgattctaaaggggac

SEQ ID NO: 4294742 - DNA, 20 bp, Homo sapiens
gaggaaactcacctgctggc

SEQ ID NO: 4294743 - DNA, 22 bp, Homo sapiens
gaggaaccagagccatggactc

SEQ ID NO: 4294744 - DNA, 18 bp, Homo sapiens
gaggaacctctgatttat

SEQ ID NO: 4294745 - DNA, 15 bp, Homo sapiens
gaggaactggtccag

SEQ ID NO: 4294746 - DNA, 18 bp, Homo sapiens
gaggaagggactggtcca

SEQ ID NO: 4294747 - DNA, 19 bp, Homo sapiens
gaggaagggactggtccag

SEQ ID NO: 4294748 - DNA, 16 bp, Homo sapiens
gaggaagggaggcctg

SEQ ID NO: 4294749 - DNA, 19 bp, Homo sapiens
gaggaagggaggcctgagg

SEQ ID NO: 4294750 - DNA, 21 bp, Homo sapiens
gaggaagggaggcctgagggg

SEQ ID NO: 4294751 - DNA, 14 bp, Homo sapiens
gaggaagtggtgtt

SEQ ID NO: 4294752 - DNA, 18 bp, Homo sapiens
gaggaatgtgcttttcca

SEQ ID NO: 4294753 - DNA, 21 bp, Homo sapiens
gaggacaggtggaggcgagcc

SEQ ID NO: 4294754 - DNA, 14 bp, Homo sapiens
gaggacctgggggg

SEQ ID NO: 4294755 - DNA, 22 bp, Homo sapiens
gaggagactcaggcccacattg

SEQ ID NO: 4294756 - DNA, 19 bp, Homo sapiens
gaggagagaatgagagagt

SEQ ID NO: 4294757 - DNA, 19 bp, Homo sapiens
gaggaggaaaaaggctggt

SEQ ID NO: 4294758 - DNA, 22 bp, Homo sapiens
gaggaggtaacatagatgcctg

SEQ ID NO: 4294759 - DNA, 16 bp, Homo sapiens
gaggaggtgcccgggc

SEQ ID NO: 4294760 - DNA, 19 bp, Homo sapiens
gaggaggtgtggagtggag

SEQ ID NO: 4294761 - DNA, 22 bp, Homo sapiens
gaggagtccagtttgtgcaaga

SEQ ID NO: 4294762 - DNA, 20 bp, Homo sapiens
gaggcaaccccctcggagcc

SEQ ID NO: 4294763 - DNA, 13 bp, Homo sapiens
gaggcagcaacag

SEQ ID NO: 4294764 - DNA, 18 bp, Homo sapiens
gaggcagcaacaggacca

SEQ ID NO: 4294765 - DNA, 16 bp, Homo sapiens
gaggccacatgagtcc

SEQ ID NO: 4294766 - DNA, 16 bp, Homo sapiens
gaggccacgggggagg

SEQ ID NO: 4294767 - DNA, 14 bp, Homo sapiens
gaggccagaggaag

SEQ ID NO: 4294768 - DNA, 15 bp, Homo sapiens
gaggccagaggaagg

SEQ ID NO: 4294769 - DNA, 20 bp, Homo sapiens
gaggccagaggaagggaggc

SEQ ID NO: 4294770 - DNA, 18 bp, Homo sapiens
gaggccccttgctgctgg

SEQ ID NO: 4294771 - DNA, 20 bp, Homo sapiens
gaggccccttgctgctggct

SEQ ID NO: 4294772 - DNA, 22 bp, Homo sapiens
gaggccccttgctgctggctcc

SEQ ID NO: 4294773 - DNA, 23 bp, Homo sapiens
gaggccccttgctgctggctccc

SEQ ID NO: 4294774 - DNA, 15 bp, Homo sapiens
gaggccgaggcaggg

SEQ ID NO: 4294775 - DNA, 14 bp, Homo sapiens
gaggcctctgcaag

SEQ ID NO: 4294776 - DNA, 16 bp, Homo sapiens
gaggcctgaggggcag

SEQ ID NO: 4294777 - DNA, 17 bp, Homo sapiens
gaggcctggtgccctgg

SEQ ID NO: 4294778 - DNA, 13 bp, Homo sapiens
gaggcgagccaga

SEQ ID NO: 4294779 - DNA, 17 bp, Homo sapiens
gaggcgccttcctgggt

SEQ ID NO: 4294780 - DNA, 21 bp, Homo sapiens
gaggcgtgggatccagagaga

SEQ ID NO: 4294781 - DNA, 22 bp, Homo sapiens
gaggcgtgggatccagagagaa

SEQ ID NO: 4294782 - DNA, 18 bp, Homo sapiens
gaggcttgggaccgccag

SEQ ID NO: 4294783 - DNA, 18 bp, Homo sapiens
gaggcttgtcagagctgg

SEQ ID NO: 4294784 - DNA, 12 bp, Homo sapiens
gagggagaagga

SEQ ID NO: 4294785 - DNA, 15 bp, Homo sapiens
gagggagaaggagag

SEQ ID NO: 4294786 - DNA, 19 bp, Homo sapiens
gagggagaaggagaggctc

SEQ ID NO: 4294787 - DNA, 13 bp, Homo sapiens
gagggaggaatcg

SEQ ID NO: 4294788 - DNA, 13 bp, Homo sapiens
gagggaggcctga

SEQ ID NO: 4294789 - DNA, 19 bp, Homo sapiens
gagggcccctcactggctg

SEQ ID NO: 4294790 - DNA, 20 bp, Homo sapiens
gagggcccctcactggctgg

SEQ ID NO: 4294791 - DNA, 19 bp, Homo sapiens
gaggggactgcatgcaagc

SEQ ID NO: 4294792 - DNA, 17 bp, Homo sapiens
gaggggagagaaggtgg

SEQ ID NO: 4294793 - DNA, 14 bp, Homo sapiens
gaggggagaggaag

SEQ ID NO: 4294794 - DNA, 14 bp, Homo sapiens
gaggggcaggcctt

SEQ ID NO: 4294795 - DNA, 23 bp, Homo sapiens
gaggggcctgccactctcctgag

SEQ ID NO: 4294796 - DNA, 18 bp, Homo sapiens
gaggggcctggcagccgt

SEQ ID NO: 4294797 - DNA, 17 bp, Homo sapiens
gaggggcttccctctgc

SEQ ID NO: 4294798 - DNA, 13 bp, Homo sapiens
gagggtgcaggga

SEQ ID NO: 4294799 - DNA, 20 bp, Homo sapiens
gaggtcccagacatgctgcc

SEQ ID NO: 4294800 - DNA, 22 bp, Homo sapiens
gaggtcccagacatgctgccca

SEQ ID NO: 4294801 - DNA, 24 bp, Homo sapiens
gaggtcccagacatgctgcccacc

SEQ ID NO: 4294802 - DNA, 22 bp, Homo sapiens
gaggtcctgtcctggctcccag

SEQ ID NO: 4294803 - DNA, 23 bp, Homo sapiens
gaggtgggccttccatgggcatg

SEQ ID NO: 4294804 - DNA, 17 bp, Homo sapiens
gaggttaggaacccggc

SEQ ID NO: 4294805 - DNA, 12 bp, Homo sapiens
gagtatatatgt

SEQ ID NO: 4294806 - DNA, 22 bp, Homo sapiens
gagtatgttaagctctttatga

SEQ ID NO: 4294807 - DNA, 16 bp, Homo sapiens
gagtcagggagccctg

SEQ ID NO: 4294808 - DNA, 18 bp, Homo sapiens
gagtcagggagccctggg

SEQ ID NO: 4294809 - DNA, 19 bp, Homo sapiens
gagtcagggagccctgggg

SEQ ID NO: 4294810 - DNA, 18 bp, Homo sapiens
gagtcaggtttggggttc

SEQ ID NO: 4294811 - DNA, 11 bp, Homo sapiens
gagtcatcatg

SEQ ID NO: 4294812 - DNA, 21 bp, Homo sapiens
gagtccagacctgggccctgg

SEQ ID NO: 4294813 - DNA, 13 bp, Homo sapiens
gagtccaggcccc

SEQ ID NO: 4294814 - DNA, 14 bp, Homo sapiens
gagtccaggcccca

SEQ ID NO: 4294815 - DNA, 19 bp, Homo sapiens
gagtccattgcaaaaggtt

SEQ ID NO: 4294816 - DNA, 14 bp, Homo sapiens
gagtcccagtggga

SEQ ID NO: 4294817 - DNA, 17 bp, Homo sapiens
gagtcctgttctcagag

SEQ ID NO: 4294818 - DNA, 19 bp, Homo sapiens
gagtcctgttctcagagct

SEQ ID NO: 4294819 - DNA, 12 bp, Homo sapiens
gagtctcttctc

SEQ ID NO: 4294820 - DNA, 16 bp, Homo sapiens
gagtctgaaggagagg

SEQ ID NO: 4294821 - DNA, 17 bp, Homo sapiens
gagtctgaaggagagga

SEQ ID NO: 4294822 - DNA, 18 bp, Homo sapiens
gagtctgaaggagaggag

SEQ ID NO: 4294823 - DNA, 19 bp, Homo sapiens
gagtctgaaggagaggagt

SEQ ID NO: 4294824 - DNA, 16 bp, Homo sapiens
gagtctgattgcagga

SEQ ID NO: 4294825 - DNA, 12 bp, Homo sapiens
gagtctggagac

SEQ ID NO: 4294826 - DNA, 19 bp, Homo sapiens
gagtctggagaccaggact

SEQ ID NO: 4294827 - DNA, 22 bp, Homo sapiens
gagtctggagaccaggactctg

SEQ ID NO: 4294828 - DNA, 18 bp, Homo sapiens
gagtgaagtccagtgacc

SEQ ID NO: 4294829 - DNA, 22 bp, Homo sapiens
gagtgaagtccagtgaccctgg

SEQ ID NO: 4294830 - DNA, 22 bp, Homo sapiens
gagtgacatcggttcaggagga

SEQ ID NO: 4294831 - DNA, 13 bp, Homo sapiens
gagtgcacagctg

SEQ ID NO: 4294832 - DNA, 15 bp, Homo sapiens
gagtgcacagctgtc

SEQ ID NO: 4294833 - DNA, 14 bp, Homo sapiens
gagtgcgctagagc

SEQ ID NO: 4294834 - DNA, 19 bp, Homo sapiens
gagtggaggggtcagcagg

SEQ ID NO: 4294835 - DNA, 20 bp, Homo sapiens
gagtggaggggtcagcaggg

SEQ ID NO: 4294836 - DNA, 13 bp, Homo sapiens
gagtggctcctcc

SEQ ID NO: 4294837 - DNA, 17 bp, Homo sapiens
gagtgggacagagtctg

SEQ ID NO: 4294838 - DNA, 14 bp, Homo sapiens
gagtgggagaggaa

SEQ ID NO: 4294839 - DNA, 15 bp, Homo sapiens
gagtgggagaggaag

SEQ ID NO: 4294840 - DNA, 14 bp, Homo sapiens
gagtggggcagtag

SEQ ID NO: 4294841 - DNA, 23 bp, Homo sapiens
gagtggggctagactgggctggc

SEQ ID NO: 4294842 - DNA, 21 bp, Homo sapiens
gagtgggtgggacacagagac

SEQ ID NO: 4294843 - DNA, 20 bp, Homo sapiens
gagtggtccacattctgctg

SEQ ID NO: 4294844 - DNA, 23 bp, Homo sapiens
gagtggtccacattctgctgccc

SEQ ID NO: 4294845 - DNA, 18 bp, Homo sapiens
gagtgtgaatataaatgt

SEQ ID NO: 4294846 - DNA, 22 bp, Homo sapiens
gagtgtgaatataaatgtgtgt

SEQ ID NO: 4294847 - DNA, 10 bp, Homo sapiens
gagtgtgcaa

SEQ ID NO: 4294848 - DNA, 16 bp, Homo sapiens
gagtgtggctcccctc

SEQ ID NO: 4294849 - DNA, 21 bp, Homo sapiens
gagtgtgtgggggtctgggag

SEQ ID NO: 4294850 - DNA, 13 bp, Homo sapiens
gagttaagtctat

SEQ ID NO: 4294851 - DNA, 15 bp, Homo sapiens
gagttcccaagaaag

SEQ ID NO: 4294852 - DNA, 21 bp, Homo sapiens
gagttcttcctgtaatcttgt

SEQ ID NO: 4294853 - DNA, 19 bp, Homo sapiens
gagtttaaaaaaataacat

SEQ ID NO: 4294854 - DNA, 13 bp, Homo sapiens
gataagtggaaaa

SEQ ID NO: 4294855 - DNA, 23 bp, Homo sapiens
gatacactcaagcatgaagataa

SEQ ID NO: 4294856 - DNA, 15 bp, Homo sapiens
gatacagaatgaatc

SEQ ID NO: 4294857 - DNA, 18 bp, Homo sapiens
gatactttgatattttca

SEQ ID NO: 4294858 - DNA, 16 bp, Homo sapiens
gatagcctagggtgag

SEQ ID NO: 4294859 - DNA, 16 bp, Homo sapiens
gataggagcttccaga

SEQ ID NO: 4294860 - DNA, 17 bp, Homo sapiens
gataggagcttccagat

SEQ ID NO: 4294861 - DNA, 23 bp, Homo sapiens
gatataataaatatatatttatc

SEQ ID NO: 4294862 - DNA, 18 bp, Homo sapiens
gatatatctgaaaactgg

SEQ ID NO: 4294863 - DNA, 18 bp, Homo sapiens
gatatcactaataaagtc

SEQ ID NO: 4294864 - DNA, 13 bp, Homo sapiens
gatatctcatctc

SEQ ID NO: 4294865 - DNA, 14 bp, Homo sapiens
gatatctcatctct

SEQ ID NO: 4294866 - DNA, 24 bp, Homo sapiens
gatattgctgaagaatctacttaa

SEQ ID NO: 4294867 - DNA, 20 bp, Homo sapiens
gatattggttctatttattt

SEQ ID NO: 4294868 - DNA, 16 bp, Homo sapiens
gatattgtatgtacct

SEQ ID NO: 4294869 - DNA, 22 bp, Homo sapiens
gatattttcaacgcagccctgc

SEQ ID NO: 4294870 - DNA, 17 bp, Homo sapiens
gatattttgtaaaatgt

SEQ ID NO: 4294871 - DNA, 18 bp, Homo sapiens
gatattttgtaaaatgta

SEQ ID NO: 4294872 - DNA, 22 bp, Homo sapiens
gatcaaggggttcccactggct

SEQ ID NO: 4294873 - DNA, 14 bp, Homo sapiens
gatcacaacttttc

SEQ ID NO: 4294874 - DNA, 15 bp, Homo sapiens
gatcagcattcaaaa

SEQ ID NO: 4294875 - DNA, 12 bp, Homo sapiens
gatccagagaga

SEQ ID NO: 4294876 - DNA, 14 bp, Homo sapiens
gatccagagagaag

SEQ ID NO: 4294877 - DNA, 23 bp, Homo sapiens
gatccagagagaagcaccccacc

SEQ ID NO: 4294878 - DNA, 21 bp, Homo sapiens
gatccctagctgtgacctctc

SEQ ID NO: 4294879 - DNA, 18 bp, Homo sapiens
gggaagcaccagcctcag

SEQ ID NO: 4294880 - DNA, 14 bp, Homo sapiens
gggaagtgtgctga

SEQ ID NO: 4294881 - DNA, 12 bp, Homo sapiens
gggacacagaga

SEQ ID NO: 4294882 - DNA, 16 bp, Homo sapiens
gggacacggcctctgg

SEQ ID NO: 4294883 - DNA, 20 bp, Homo sapiens
gggacacggcctctggggag

SEQ ID NO: 4294884 - DNA, 15 bp, Homo sapiens
gggacagagtctggg

SEQ ID NO: 4294885 - DNA, 16 bp, Homo sapiens
gggacagtctggaggt

SEQ ID NO: 4294886 - DNA, 21 bp, Homo sapiens
gggaccaagatgtcaagctgg

SEQ ID NO: 4294887 - DNA, 13 bp, Homo sapiens
gggaccaaggacc

SEQ ID NO: 4294888 - DNA, 15 bp, Homo sapiens
gggactggcccaccc

SEQ ID NO: 4294889 - DNA, 19 bp, Homo sapiens
gggactggcccacccctct

SEQ ID NO: 4294890 - DNA, 24 bp, Homo sapiens
gggacttcaaaatcagtgatggga

SEQ ID NO: 4294891 - DNA, 23 bp, Homo sapiens
gggactttgctgatttcccctct

SEQ ID NO: 4294892 - DNA, 15 bp, Homo sapiens
gggagaaaagccaga

SEQ ID NO: 4294893 - DNA, 16 bp, Homo sapiens
gggagaaaagccagat

SEQ ID NO: 4294894 - DNA, 20 bp, Homo sapiens
gggagaacctcgttgacatg

SEQ ID NO: 4294895 - DNA, 23 bp, Homo sapiens
gggagaacctcgttgacatgcac

SEQ ID NO: 4294896 - DNA, 15 bp, Homo sapiens
gggagaagggacagc

SEQ ID NO: 4294897 - DNA, 15 bp, Homo sapiens
gggagaatggctctg

SEQ ID NO: 4294898 - DNA, 18 bp, Homo sapiens
gggagaatggctctggct

SEQ ID NO: 4294899 - DNA, 19 bp, Homo sapiens
gggagaccgagtgtggagc

SEQ ID NO: 4294900 - DNA, 22 bp, Homo sapiens
gggagaggccatgattcgccca

SEQ ID NO: 4294901 - DNA, 12 bp, Homo sapiens
gggagagtgagg

SEQ ID NO: 4294902 - DNA, 23 bp, Homo sapiens
gggagatccgccctgggctctgg

SEQ ID NO: 4294903 - DNA, 14 bp, Homo sapiens
gggagatgctggga

SEQ ID NO: 4294904 - DNA, 12 bp, Homo sapiens
gggagcccccgc

SEQ ID NO: 4294905 - DNA, 16 bp, Homo sapiens
gggagcccccgccccg

SEQ ID NO: 4294906 - DNA, 17 bp, Homo sapiens
gggagcctcgcccctcc

SEQ ID NO: 4294907 - DNA, 18 bp, Homo sapiens
gggagcctcgcccctcca

SEQ ID NO: 4294908 - DNA, 19 bp, Homo sapiens
gggagcctgcgtggcctgg

SEQ ID NO: 4294909 - DNA, 13 bp, Homo sapiens
gggagctgagggg

SEQ ID NO: 4294910 - DNA, 14 bp, Homo sapiens
gggagctgaggggc

SEQ ID NO: 4294911 - DNA, 19 bp, Homo sapiens
gggaggaatcgaggaacca

SEQ ID NO: 4294912 - DNA, 17 bp, Homo sapiens
gggaggaggatccgggc

SEQ ID NO: 4294913 - DNA, 16 bp, Homo sapiens
gggaggccgaggcagg

SEQ ID NO: 4294914 - DNA, 16 bp, Homo sapiens
gggagggaacagacct

SEQ ID NO: 4294915 - DNA, 12 bp, Homo sapiens
gggaggggagag

SEQ ID NO: 4294916 - DNA, 13 bp, Homo sapiens
gggaggggagaga

SEQ ID NO: 4294917 - DNA, 16 bp, Homo sapiens
gggagtcaagtgtgcc

SEQ ID NO: 4294918 - DNA, 20 bp, Homo sapiens
gggagtgggacagagtctgg

SEQ ID NO: 4294919 - DNA, 21 bp, Homo sapiens
gggagtgggacagagtctggg

SEQ ID NO: 4294920 - DNA, 13 bp, Homo sapiens
gggagtgggagag

SEQ ID NO: 4294921 - DNA, 17 bp, Homo sapiens
gggagtgggagaggaag

SEQ ID NO: 4294922 - DNA, 15 bp, Homo sapiens
gggatgggcacaggc

SEQ ID NO: 4294923 - DNA, 16 bp, Homo sapiens
gggatgggcacaggct

SEQ ID NO: 4294924 - DNA, 15 bp, Homo sapiens
gggatgtcttgagat

SEQ ID NO: 4294925 - DNA, 15 bp, Homo sapiens
gggattcaaatgcat

SEQ ID NO: 4294926 - DNA, 17 bp, Homo sapiens
gggatttctcccagctc

SEQ ID NO: 4294927 - DNA, 23 bp, Homo sapiens
gggcaagagctcaggagaaggcc

SEQ ID NO: 4294928 - DNA, 23 bp, Homo sapiens
gggcacacttccccttgggatgg

SEQ ID NO: 4294929 - DNA, 13 bp, Homo sapiens
gggcacctctgct

SEQ ID NO: 4294930 - DNA, 18 bp, Homo sapiens
gggcacctggggagtggg

SEQ ID NO: 4294931 - DNA, 16 bp, Homo sapiens
gggcactggtggcccg

SEQ ID NO: 4294932 - DNA, 21 bp, Homo sapiens
gggcagaaggaggaagggact

SEQ ID NO: 4294933 - DNA, 12 bp, Homo sapiens
gggcagagggga

SEQ ID NO: 4294934 - DNA, 14 bp, Homo sapiens
gggcagaggggaga

SEQ ID NO: 4294935 - DNA, 20 bp, Homo sapiens
gggcagaggggagaggaagc

SEQ ID NO: 4294936 - DNA, 23 bp, Homo sapiens
gggcagattggttcatgcctggg

SEQ ID NO: 4294937 - DNA, 14 bp, Homo sapiens
gggcagcccagaga

SEQ ID NO: 4294938 - DNA, 17 bp, Homo sapiens
gggcagcctgtgggaga

SEQ ID NO: 4294939 - DNA, 13 bp, Homo sapiens
gggcagctggctc

SEQ ID NO: 4294940 - DNA, 15 bp, Homo sapiens
gggcagctggctctg

SEQ ID NO: 4294941 - DNA, 18 bp, Homo sapiens
gggcaggagcctagagga

SEQ ID NO: 4294942 - DNA, 11 bp, Homo sapiens
gggcaggcctt

SEQ ID NO: 4294943 - DNA, 20 bp, Homo sapiens
gggcagtagaaggtcggagg

SEQ ID NO: 4294944 - DNA, 19 bp, Homo sapiens
gggcagtgacgtgagtggg

SEQ ID NO: 4294945 - DNA, 20 bp, Homo sapiens
gggcagtgacgtgagtgggg

SEQ ID NO: 4294946 - DNA, 12 bp, Homo sapiens
gggcagtggaga

SEQ ID NO: 4294947 - DNA, 16 bp, Homo sapiens
gggcagtggagagggg

SEQ ID NO: 4294948 - DNA, 19 bp, Homo sapiens
gggcagtggagaggggact

SEQ ID NO: 4294949 - DNA, 17 bp, Homo sapiens
gggcatccccagccccc

SEQ ID NO: 4294950 - DNA, 23 bp, Homo sapiens
gggcatctggccctgctgccccc

SEQ ID NO: 4294951 - DNA, 18 bp, Homo sapiens
gggcatggacagggccag

SEQ ID NO: 4294952 - DNA, 21 bp, Homo sapiens
gggcatggacagggccagggt

SEQ ID NO: 4294953 - DNA, 23 bp, Homo sapiens
gggcatggacagggccagggttg

SEQ ID NO: 4294954 - DNA, 20 bp, Homo sapiens
gggcatggggtgggcctctg

SEQ ID NO: 4294955 - DNA, 20 bp, Homo sapiens
gggccaagccagggttccag

SEQ ID NO: 4294956 - DNA, 24 bp, Homo sapiens
gggccaagccagggttccagacag

SEQ ID NO: 4294957 - DNA, 12 bp, Homo sapiens
gggccagggctc

SEQ ID NO: 4294958 - DNA, 19 bp, Homo sapiens
gggccatggaagctggcag

SEQ ID NO: 4294959 - DNA, 22 bp, Homo sapiens
gggcccaggagagcccccacca

SEQ ID NO: 4294960 - DNA, 23 bp, Homo sapiens
gggcccaggagagcccccaccag

SEQ ID NO: 4294961 - DNA, 14 bp, Homo sapiens
gggcccccatgcag

SEQ ID NO: 4294962 - DNA, 13 bp, Homo sapiens
gggccccctctct

SEQ ID NO: 4294963 - DNA, 13 bp, Homo sapiens
gggccccctggga

SEQ ID NO: 4294964 - DNA, 16 bp, Homo sapiens
gggccccctgggagag

SEQ ID NO: 4294965 - DNA, 14 bp, Homo sapiens
gggcccctcactgg

SEQ ID NO: 4294966 - DNA, 18 bp, Homo sapiens
gggcccctcactggctgg

SEQ ID NO: 4294967 - DNA, 21 bp, Homo sapiens
gggcccctgaagtgaccccag

SEQ ID NO: 4294968 - DNA, 16 bp, Homo sapiens
gggcccgcctggcaga

SEQ ID NO: 4294969 - DNA, 16 bp, Homo sapiens
gggcccggctgggccc

SEQ ID NO: 4294970 - DNA, 16 bp, Homo sapiens
gggccctgctcaggcc

SEQ ID NO: 4294971 - DNA, 16 bp, Homo sapiens
gggccgcttcgccatg

SEQ ID NO: 4294972 - DNA, 19 bp, Homo sapiens
gggccgcttcgccatgtgc

SEQ ID NO: 4294973 - DNA, 22 bp, Homo sapiens
gggcctagtggcttcagcccct

SEQ ID NO: 4294974 - DNA, 23 bp, Homo sapiens
gggcctagtggcttcagcccctg

SEQ ID NO: 4294975 - DNA, 22 bp, Homo sapiens
gggcctgccactctcctgagga

SEQ ID NO: 4294976 - DNA, 15 bp, Homo sapiens
gggcctgctgtgggt

SEQ ID NO: 4294977 - DNA, 22 bp, Homo sapiens
gggcctggcagccgtgccttca

SEQ ID NO: 4294978 - DNA, 22 bp, Homo sapiens
gggcggtcaataattgtggaga

SEQ ID NO: 4294979 - DNA, 20 bp, Homo sapiens
gggcggtccagaggaggtgc

SEQ ID NO: 4294980 - DNA, 14 bp, Homo sapiens
gggctaaccagttc

SEQ ID NO: 4294981 - DNA, 17 bp, Homo sapiens
gggctaagtccagctct

SEQ ID NO: 4294982 - DNA, 17 bp, Homo sapiens
gggctagactgggctgg

SEQ ID NO: 4294983 - DNA, 23 bp, Homo sapiens
gggctagactgggctggctgcct

SEQ ID NO: 4294984 - DNA, 19 bp, Homo sapiens
gggctccacgggggcctag

SEQ ID NO: 4294985 - DNA, 16 bp, Homo sapiens
gggctgagagtggggc

SEQ ID NO: 4294986 - DNA, 16 bp, Homo sapiens
gggctgcatcctcagc

SEQ ID NO: 4294987 - DNA, 17 bp, Homo sapiens
gggctgcatcctcagcc

SEQ ID NO: 4294988 - DNA, 22 bp, Homo sapiens
gggctgcatcctcagccccagg

SEQ ID NO: 4294989 - DNA, 13 bp, Homo sapiens
gggctgccctggt

SEQ ID NO: 4294990 - DNA, 14 bp, Homo sapiens
gggctgccctggtg

SEQ ID NO: 4294991 - DNA, 21 bp, Homo sapiens
gggctgccctggtgctgccac

SEQ ID NO: 4294992 - DNA, 22 bp, Homo sapiens
gggctgccgtgcacggggccag

SEQ ID NO: 4294993 - DNA, 18 bp, Homo sapiens
gggctggattggcaggtg

SEQ ID NO: 4294994 - DNA, 13 bp, Homo sapiens
gggctggccagct

SEQ ID NO: 4294995 - DNA, 22 bp, Homo sapiens
gggctggtttggtggccaggct

SEQ ID NO: 4294996 - DNA, 23 bp, Homo sapiens
gggctgtccttagactccttctc

SEQ ID NO: 4294997 - DNA, 16 bp, Homo sapiens
gggcttagaatggggc

SEQ ID NO: 4294998 - DNA, 21 bp, Homo sapiens
gggcttcaaccttgagacagc

SEQ ID NO: 4294999 - DNA, 20 bp, Homo sapiens
gggcttggggtagagaggac

SEQ ID NO: 4295000 - DNA, 21 bp, Homo sapiens
gggcttggggtagagaggaca

SEQ ID NO: 4295001 - DNA, 22 bp, Homo sapiens
gggcttggggtagagaggacag

SEQ ID NO: 4295002 - DNA, 22 bp, Homo sapiens
ggggacaggaacacccagcccc

SEQ ID NO: 4295003 - DNA, 16 bp, Homo sapiens
ggggacttggatagga

SEQ ID NO: 4295004 - DNA, 21 bp, Homo sapiens
ggggagaccgagtgtggagct

SEQ ID NO: 4295005 - DNA, 13 bp, Homo sapiens
ggggagaggaagc

SEQ ID NO: 4295006 - DNA, 15 bp, Homo sapiens
ggggagctgaggggc

SEQ ID NO: 4295007 - DNA, 19 bp, Homo sapiens
ggggagctgaggggcaggg

SEQ ID NO: 4295008 - DNA, 13 bp, Homo sapiens
ggggaggccaagt

SEQ ID NO: 4295009 - DNA, 19 bp, Homo sapiens
ggggaggccgaggcagggg

SEQ ID NO: 4295010 - DNA, 19 bp, Homo sapiens
ggggagtgggacagagtct

SEQ ID NO: 4295011 - DNA, 18 bp, Homo sapiens
ggggattcaaatgcatga

SEQ ID NO: 4295012 - DNA, 15 bp, Homo sapiens
ggggatttctcccag

SEQ ID NO: 4295013 - DNA, 20 bp, Homo sapiens
ggggcaagagctcaggagaa

SEQ ID NO: 4295014 - DNA, 22 bp, Homo sapiens
ggggcaagagctcaggagaagg

SEQ ID NO: 4295015 - DNA, 23 bp, Homo sapiens
ggggcaggaagtccctgagaagc

SEQ ID NO: 4295016 - DNA, 12 bp, Homo sapiens
ggggcaggcctt

SEQ ID NO: 4295017 - DNA, 20 bp, Homo sapiens
ggggccatgagctccagacc

SEQ ID NO: 4295018 - DNA, 22 bp, Homo sapiens
ggggccatgagctccagacccc

SEQ ID NO: 4295019 - DNA, 16 bp, Homo sapiens
ggggccatgaggcctc

SEQ ID NO: 4295020 - DNA, 14 bp, Homo sapiens
ggggccatggaagc

SEQ ID NO: 4295021 - DNA, 17 bp, Homo sapiens
ggggccatggaagctgg

SEQ ID NO: 4295022 - DNA, 16 bp, Homo sapiens
ggggcccgcctggcag

SEQ ID NO: 4295023 - DNA, 13 bp, Homo sapiens
ggggccgggctgg

SEQ ID NO: 4295024 - DNA, 23 bp, Homo sapiens
ggggccgggctggcttctccctg

SEQ ID NO: 4295025 - DNA, 16 bp, Homo sapiens
ggggccgtgcagggcc

SEQ ID NO: 4295026 - DNA, 13 bp, Homo sapiens
ggggcgaggcaga

SEQ ID NO: 4295027 - DNA, 13 bp, Homo sapiens
ggggcgggaggcc

SEQ ID NO: 4295028 - DNA, 13 bp, Homo sapiens
ggggcggggccag

SEQ ID NO: 4295029 - DNA, 22 bp, Homo sapiens
ggggctagactgggctggctgc

SEQ ID NO: 4295030 - DNA, 22 bp, Homo sapiens
ggggcttcaaccttgagacagc

SEQ ID NO: 4295031 - DNA, 14 bp, Homo sapiens
ggggcttccctctg

SEQ ID NO: 4295032 - DNA, 20 bp, Homo sapiens
ggggcttggggtagagagga

SEQ ID NO: 4295033 - DNA, 23 bp, Homo sapiens
ggggcttggggtagagaggacag

SEQ ID NO: 4295034 - DNA, 16 bp, Homo sapiens
gggggaagcaccagcc

SEQ ID NO: 4295035 - DNA, 17 bp, Homo sapiens
gggggattcaaatgcat

SEQ ID NO: 4295036 - DNA, 13 bp, Homo sapiens
gggggcacagcca

SEQ ID NO: 4295037 - DNA, 14 bp, Homo sapiens
gggggccatgagct

SEQ ID NO: 4295038 - DNA, 17 bp, Homo sapiens
gggggcctagtggcttc

SEQ ID NO: 4295039 - DNA, 15 bp, Homo sapiens
gggggcctgctgtgg

SEQ ID NO: 4295040 - DNA, 23 bp, Homo sapiens
ggggggcccgcctggcagaactg

SEQ ID NO: 4295041 - DNA, 22 bp, Homo sapiens
ggggtgccatggtgttggaggg

SEQ ID NO: 4295042 - DNA, 22 bp, Homo sapiens
ggggtggaggctaagcctggac

SEQ ID NO: 4295043 - DNA, 15 bp, Homo sapiens
ggggtgggcctctgg

SEQ ID NO: 4295044 - DNA, 14 bp, Homo sapiens
ggggtgggggcctg

SEQ ID NO: 4295045 - DNA, 19 bp, Homo sapiens
ggggtgtcacagaggcagt

SEQ ID NO: 4295046 - DNA, 14 bp, Homo sapiens
gggtaaaaagagaa

SEQ ID NO: 4295047 - DNA, 15 bp, Homo sapiens
gggtcaactccaagg

SEQ ID NO: 4295048 - DNA, 16 bp, Homo sapiens
gggtcaactccaaggc

SEQ ID NO: 4295049 - DNA, 16 bp, Homo sapiens
gggtcaccttcctggg

SEQ ID NO: 4295050 - DNA, 21 bp, Homo sapiens
gggtcacgttttgcctcatga

SEQ ID NO: 4295051 - DNA, 18 bp, Homo sapiens
gggtcagggaccaaggac

SEQ ID NO: 4295052 - DNA, 12 bp, Homo sapiens
gggtcctcaggc

SEQ ID NO: 4295053 - DNA, 13 bp, Homo sapiens
gggtcctcaggca

SEQ ID NO: 4295054 - DNA, 16 bp, Homo sapiens
gggtcctcaggcagtg

SEQ ID NO: 4295055 - DNA, 22 bp, Homo sapiens
gggtcggcgccttctacctgca

SEQ ID NO: 4295056 - DNA, 16 bp, Homo sapiens
gggtctgctcctgtgg

SEQ ID NO: 4295057 - DNA, 15 bp, Homo sapiens
gggtctgggaggcag

SEQ ID NO: 4295058 - DNA, 16 bp, Homo sapiens
gggtctgggaggcagg

SEQ ID NO: 4295059 - DNA, 18 bp, Homo sapiens
gggtgccaaccacctctg

SEQ ID NO: 4295060 - DNA, 16 bp, Homo sapiens
gggtgccccccatgcc

SEQ ID NO: 4295061 - DNA, 20 bp, Homo sapiens
gggtggcatcttagggtagg

SEQ ID NO: 4295062 - DNA, 15 bp, Homo sapiens
gggtggccggccctg

SEQ ID NO: 4295063 - DNA, 19 bp, Homo sapiens
gggtggccggccctgcccc

SEQ ID NO: 4295064 - DNA, 13 bp, Homo sapiens
gggtgggacacag

SEQ ID NO: 4295065 - DNA, 13 bp, Homo sapiens
gggtgggcctctg

SEQ ID NO: 4295066 - DNA, 11 bp, Homo sapiens
gggtggggatg

SEQ ID NO: 4295067 - DNA, 13 bp, Homo sapiens
gggtggggcggga

SEQ ID NO: 4295068 - DNA, 14 bp, Homo sapiens
gggtgggggcctgc

SEQ ID NO: 4295069 - DNA, 16 bp, Homo sapiens
gggtgggtgtgagcag

SEQ ID NO: 4295070 - DNA, 23 bp, Homo sapiens
gggtggtcttcaagcctggccca

SEQ ID NO: 4295071 - DNA, 18 bp, Homo sapiens
gggtgtgagcagggtgac

SEQ ID NO: 4295072 - DNA, 22 bp, Homo sapiens
gggtgtgctccaggcttcctgc

SEQ ID NO: 4295073 - DNA, 20 bp, Homo sapiens
gggttaaagaaaggcagaga

SEQ ID NO: 4295074 - DNA, 19 bp, Homo sapiens
gggttagacaagcctggag

SEQ ID NO: 4295075 - DNA, 20 bp, Homo sapiens
gggttagacaagcctggagg

SEQ ID NO: 4295076 - DNA, 16 bp, Homo sapiens
gggttccagacagagt

SEQ ID NO: 4295077 - DNA, 16 bp, Homo sapiens
gggttcccactggctc

SEQ ID NO: 4295078 - DNA, 14 bp, Homo sapiens
gggttcccccagcc

SEQ ID NO: 4295079 - DNA, 22 bp, Homo sapiens
gggttctggggctgagagtggg

SEQ ID NO: 4295080 - DNA, 15 bp, Homo sapiens
gggttgggttccaga

SEQ ID NO: 4295081 - DNA, 17 bp, Homo sapiens
gggttgttgggaggagg

SEQ ID NO: 4295082 - DNA, 20 bp, Homo sapiens
ggtaaaaagagaaggcaagc

SEQ ID NO: 4295083 - DNA, 16 bp, Homo sapiens
ggtaacatagatgcct

SEQ ID NO: 4295084 - DNA, 17 bp, Homo sapiens
ggtaactttatttaaaa

SEQ ID NO: 4295085 - DNA, 19 bp, Homo sapiens
ggtaccagagcctatggaa

SEQ ID NO: 4295086 - DNA, 18 bp, Homo sapiens
ggtagtagaatctcagca

SEQ ID NO: 4295087 - DNA, 21 bp, Homo sapiens
ggtatctgctgcctctgaaaa

SEQ ID NO: 4295088 - DNA, 16 bp, Homo sapiens
ggtcaactccaaggca

SEQ ID NO: 4295089 - DNA, 19 bp, Homo sapiens
ggtcaataattgtggagag

SEQ ID NO: 4295090 - DNA, 17 bp, Homo sapiens
ggtcacaataaagtgta

SEQ ID NO: 4295091 - DNA, 19 bp, Homo sapiens
ggtcacttcaaacatgccc

SEQ ID NO: 4295092 - DNA, 15 bp, Homo sapiens
ggtcagcggcctggg

SEQ ID NO: 4295093 - DNA, 17 bp, Homo sapiens
ggtcagggaccaaggac

SEQ ID NO: 4295094 - DNA, 17 bp, Homo sapiens
ggtcagtgtgccaccct

SEQ ID NO: 4295095 - DNA, 15 bp, Homo sapiens
ggtcatccaacctct

SEQ ID NO: 4295096 - DNA, 16 bp, Homo sapiens
ggtcatccaacctctt

SEQ ID NO: 4295097 - DNA, 16 bp, Homo sapiens
ggtcatcccggggcca

SEQ ID NO: 4295098 - DNA, 21 bp, Homo sapiens
ggtccaggccaggcctcatcc

SEQ ID NO: 4295099 - DNA, 18 bp, Homo sapiens
ggtcccagacatgctgcc

SEQ ID NO: 4295100 - DNA, 19 bp, Homo sapiens
ggtcccagacatgctgccc

SEQ ID NO: 4295101 - DNA, 18 bp, Homo sapiens
ggtcccccttcgtggagc

SEQ ID NO: 4295102 - DNA, 21 bp, Homo sapiens
ggtcctcaggcagtggcccag

SEQ ID NO: 4295103 - DNA, 15 bp, Homo sapiens
ggtcctgggggctgc

SEQ ID NO: 4295104 - DNA, 17 bp, Homo sapiens
ggtcctgggggctgctg

SEQ ID NO: 4295105 - DNA, 23 bp, Homo sapiens
ggtcgtcttttgaaaagctcact

SEQ ID NO: 4295106 - DNA, 13 bp, Homo sapiens
ggtctaacttttg

SEQ ID NO: 4295107 - DNA, 18 bp, Homo sapiens
ggtctatttctcccttca

SEQ ID NO: 4295108 - DNA, 20 bp, Homo sapiens
ggtctatttctcccttcaat

SEQ ID NO: 4295109 - DNA, 15 bp, Homo sapiens
ggtctcagaggaggg

SEQ ID NO: 4295110 - DNA, 13 bp, Homo sapiens
ggtctcatgcctg

SEQ ID NO: 4295111 - DNA, 18 bp, Homo sapiens
ggtctcatgctccttaat

SEQ ID NO: 4295112 - DNA, 14 bp, Homo sapiens
ggtctccacccctc

SEQ ID NO: 4295113 - DNA, 15 bp, Homo sapiens
ggtctccacccctca

SEQ ID NO: 4295114 - DNA, 17 bp, Homo sapiens
ggtctccacccctcaag

SEQ ID NO: 4295115 - DNA, 11 bp, Homo sapiens
ggtctccacct

SEQ ID NO: 4295116 - DNA, 23 bp, Homo sapiens
ggtctcctgggcatctggccctg

SEQ ID NO: 4295117 - DNA, 17 bp, Homo sapiens
ggtctgctcctgtggcg

SEQ ID NO: 4295118 - DNA, 16 bp, Homo sapiens
ggtctggagcccctat

SEQ ID NO: 4295119 - DNA, 11 bp, Homo sapiens
ggtctgggagg

SEQ ID NO: 4295120 - DNA, 18 bp, Homo sapiens
ggtcttcaagcctggccc

SEQ ID NO: 4295121 - DNA, 22 bp, Homo sapiens
ggtcttcaagcctggcccagtg

SEQ ID NO: 4295122 - DNA, 16 bp, Homo sapiens
ggtgagaatagaatct

SEQ ID NO: 4295123 - DNA, 18 bp, Homo sapiens
ggtgaggcgtgggatcca

SEQ ID NO: 4295124 - DNA, 13 bp, Homo sapiens
ggtgagggaggcc

SEQ ID NO: 4295125 - DNA, 15 bp, Homo sapiens
ggtgagggaggcctg

SEQ ID NO: 4295126 - DNA, 11 bp, Homo sapiens
ggtgagggtga

SEQ ID NO: 4295127 - DNA, 18 bp, Homo sapiens
ggtgcccaccagctggct

SEQ ID NO: 4295128 - DNA, 21 bp, Homo sapiens
ggtgcccaccagctggctctg

SEQ ID NO: 4295129 - DNA, 21 bp, Homo sapiens
ggtgcccagactcaaggcctc

SEQ ID NO: 4295130 - DNA, 22 bp, Homo sapiens
ggtgccccccatgccctccctg

SEQ ID NO: 4295131 - DNA, 19 bp, Homo sapiens
ggtgccctggcccagcctg

SEQ ID NO: 4295132 - DNA, 11 bp, Homo sapiens
ggtgcctgcag

SEQ ID NO: 4295133 - DNA, 14 bp, Homo sapiens
ggtgctgcttccct

SEQ ID NO: 4295134 - DNA, 18 bp, Homo sapiens
ggtgctgggtccttaaaa

SEQ ID NO: 4295135 - DNA, 14 bp, Homo sapiens
ggtggaacaggagg

SEQ ID NO: 4295136 - DNA, 15 bp, Homo sapiens
ggtggacagacccag

SEQ ID NO: 4295137 - DNA, 20 bp, Homo sapiens
ggtggacagacccagggtgg

SEQ ID NO: 4295138 - DNA, 20 bp, Homo sapiens
ggtggaggctaagcctggac

SEQ ID NO: 4295139 - DNA, 16 bp, Homo sapiens
ggtggccaagcctgcc

SEQ ID NO: 4295140 - DNA, 17 bp, Homo sapiens
ggtggccaagcctgccc

SEQ ID NO: 4295141 - DNA, 18 bp, Homo sapiens
ggtggccaagcctgcccc

SEQ ID NO: 4295142 - DNA, 20 bp, Homo sapiens
ggtggccactccagacccct

SEQ ID NO: 4295143 - DNA, 14 bp, Homo sapiens
ggtggccaggctgg

SEQ ID NO: 4295144 - DNA, 13 bp, Homo sapiens
ggtggccagggct

SEQ ID NO: 4295145 - DNA, 14 bp, Homo sapiens
ggtggccagggctc

SEQ ID NO: 4295146 - DNA, 19 bp, Homo sapiens
ggtggcccgacagcctggc

SEQ ID NO: 4295147 - DNA, 15 bp, Homo sapiens
ggtggccggccctgc

SEQ ID NO: 4295148 - DNA, 17 bp, Homo sapiens
ggtggccggccctgccc

SEQ ID NO: 4295149 - DNA, 14 bp, Homo sapiens
ggtgggacacagag

SEQ ID NO: 4295150 - DNA, 13 bp, Homo sapiens
ggtgggcctctgg

SEQ ID NO: 4295151 - DNA, 14 bp, Homo sapiens
ggtgggcctctggt

SEQ ID NO: 4295152 - DNA, 15 bp, Homo sapiens
ggtggggcttggaag

SEQ ID NO: 4295153 - DNA, 20 bp, Homo sapiens
ggtgggtcaactccaaggca

SEQ ID NO: 4295154 - DNA, 17 bp, Homo sapiens
ggtgggtgtgagcaggg

SEQ ID NO: 4295155 - DNA, 16 bp, Homo sapiens
ggtggtcttggagagg

SEQ ID NO: 4295156 - DNA, 13 bp, Homo sapiens
ggtggttggaggc

SEQ ID NO: 4295157 - DNA, 14 bp, Homo sapiens
ggtggttggaggcc

SEQ ID NO: 4295158 - DNA, 15 bp, Homo sapiens
ggtggttggaggcct

SEQ ID NO: 4295159 - DNA, 17 bp, Homo sapiens
ggtgtcacagaggcagt

SEQ ID NO: 4295160 - DNA, 19 bp, Homo sapiens
ggtgtcacagaggcagtgg

SEQ ID NO: 4295161 - DNA, 15 bp, Homo sapiens
ggtgtccctgcctgg

SEQ ID NO: 4295162 - DNA, 16 bp, Homo sapiens
ggtgtccctgcctggc

SEQ ID NO: 4295163 - DNA, 18 bp, Homo sapiens
ggtgtccctgcctggccc

SEQ ID NO: 4295164 - DNA, 24 bp, Homo sapiens
ggtgtcttttaatgatactgtcta

SEQ ID NO: 4295165 - DNA, 18 bp, Homo sapiens
ggtgtgagcagggtgacc

SEQ ID NO: 4295166 - DNA, 19 bp, Homo sapiens
ggtgtgaggacataaatct

SEQ ID NO: 4295167 - DNA, 12 bp, Homo sapiens
ggtgtgggctcc

SEQ ID NO: 4295168 - DNA, 16 bp, Homo sapiens
ggtgtgttcgtggagc

SEQ ID NO: 4295169 - DNA, 21 bp, Homo sapiens
ggtgtgttcgtggagccacag

SEQ ID NO: 4295170 - DNA, 13 bp, Homo sapiens
ggtgttctggcct

SEQ ID NO: 4295171 - DNA, 21 bp, Homo sapiens
ggtgttctggcctctggcctg

SEQ ID NO: 4295172 - DNA, 23 bp, Homo sapiens
ggtgttctggcctctggcctggg

SEQ ID NO: 4295173 - DNA, 19 bp, Homo sapiens
ggttaaagaaaggcagaga

SEQ ID NO: 4295174 - DNA, 12 bp, Homo sapiens
ggttaagccata

SEQ ID NO: 4295175 - DNA, 12 bp, Homo sapiens
ggttaaggggat

SEQ ID NO: 4295176 - DNA, 18 bp, Homo sapiens
ggttaaggggatctaaaa

SEQ ID NO: 4295177 - DNA, 18 bp, Homo sapiens
ggttagacaagcctggag

SEQ ID NO: 4295178 - DNA, 20 bp, Homo sapiens
ggttagacaagcctggagga

SEQ ID NO: 4295179 - DNA, 13 bp, Homo sapiens
ggttcatgcctgg

SEQ ID NO: 4295180 - DNA, 14 bp, Homo sapiens
ggttcatgcctggg

SEQ ID NO: 4295181 - DNA, 12 bp, Homo sapiens
ggttccagacag

SEQ ID NO: 4295182 - DNA, 19 bp, Homo sapiens
ggttccagacagagtggat

SEQ ID NO: 4295183 - DNA, 23 bp, Homo sapiens
ggttccagacagggtggggctta

SEQ ID NO: 4295184 - DNA, 20 bp, Homo sapiens
ggttcccactggctcctcca

SEQ ID NO: 4295185 - DNA, 13 bp, Homo sapiens
ggttcccccagcc

SEQ ID NO: 4295186 - DNA, 14 bp, Homo sapiens
ggttcccccagccc

SEQ ID NO: 4295187 - DNA, 16 bp, Homo sapiens
ggttcccccagccctg

SEQ ID NO: 4295188 - DNA, 19 bp, Homo sapiens
ggttcccccaggaccctga

SEQ ID NO: 4295189 - DNA, 15 bp, Homo sapiens
ggttcccctgttcac

SEQ ID NO: 4295190 - DNA, 20 bp, Homo sapiens
ggttccctgcctaggagctg

SEQ ID NO: 4295191 - DNA, 23 bp, Homo sapiens
ggttcgtggaaagggtgctgctt

SEQ ID NO: 4295192 - DNA, 16 bp, Homo sapiens
ggttctccatccccat

SEQ ID NO: 4295193 - DNA, 17 bp, Homo sapiens
ggttctggggccccttt

SEQ ID NO: 4295194 - DNA, 13 bp, Homo sapiens
ggttctggggctg

SEQ ID NO: 4295195 - DNA, 15 bp, Homo sapiens
ggttctggggctgag

SEQ ID NO: 4295196 - DNA, 17 bp, Homo sapiens
ggttggaactgctgcca

SEQ ID NO: 4295197 - DNA, 18 bp, Homo sapiens
ggttggaactgctgccat

SEQ ID NO: 4295198 - DNA, 19 bp, Homo sapiens
ggttggctgggcccagaag

SEQ ID NO: 4295199 - DNA, 13 bp, Homo sapiens
ggttggggtgggg

SEQ ID NO: 4295200 - DNA, 15 bp, Homo sapiens
ggttgggttccagac

SEQ ID NO: 4295201 - DNA, 19 bp, Homo sapiens
ggttgtaggactaaataat

SEQ ID NO: 4295202 - DNA, 15 bp, Homo sapiens
ggtttagctgtgcag

SEQ ID NO: 4295203 - DNA, 18 bp, Homo sapiens
ggtttccacacaggccca

SEQ ID NO: 4295204 - DNA, 14 bp, Homo sapiens
ggtttggcgggcca

SEQ ID NO: 4295205 - DNA, 17 bp, Homo sapiens
ggtttggcgggccaagg

SEQ ID NO: 4295206 - DNA, 19 bp, Homo sapiens
ggtttggcgggccaaggac

SEQ ID NO: 4295207 - DNA, 18 bp, Homo sapiens
ggtttgggcagtggagag

SEQ ID NO: 4295208 - DNA, 19 bp, Homo sapiens
ggtttgggcagtggagagg

SEQ ID NO: 4295209 - DNA, 14 bp, Homo sapiens
gtaaaatgtattat

SEQ ID NO: 4295210 - DNA, 19 bp, Homo sapiens
gtaaaatgtattatgtcct

SEQ ID NO: 4295211 - DNA, 17 bp, Homo sapiens
gtaaaattacagaagaa

SEQ ID NO: 4295212 - DNA, 13 bp, Homo sapiens
gtaaataggtttc

SEQ ID NO: 4295213 - DNA, 14 bp, Homo sapiens
gtaaattcctgttg

SEQ ID NO: 4295214 - DNA, 15 bp, Homo sapiens
gtaacatttttcaat

SEQ ID NO: 4295215 - DNA, 13 bp, Homo sapiens
gtaactcatctgt

SEQ ID NO: 4295216 - DNA, 15 bp, Homo sapiens
gtaactcatctgtca

SEQ ID NO: 4295217 - DNA, 13 bp, Homo sapiens
gtaagattgttat

SEQ ID NO: 4295218 - DNA, 22 bp, Homo sapiens
gtaagattttattttcaagcaa

SEQ ID NO: 4295219 - DNA, 22 bp, Homo sapiens
gtaagttctgaaaactgtttat

SEQ ID NO: 4295220 - DNA, 17 bp, Homo sapiens
gtaatatttacaatgta

SEQ ID NO: 4295221 - DNA, 21 bp, Homo sapiens
gtaatatttacaatgtattaa

SEQ ID NO: 4295222 - DNA, 20 bp, Homo sapiens
gtaatcacactctcttctta

SEQ ID NO: 4295223 - DNA, 22 bp, Homo sapiens
gtaatcatttcttgggccctcc

SEQ ID NO: 4295224 - DNA, 23 bp, Homo sapiens
gtaatcatttcttgggccctcct

SEQ ID NO: 4295225 - DNA, 23 bp, Homo sapiens
gtaatctctgattaaatttaata

SEQ ID NO: 4295226 - DNA, 22 bp, Homo sapiens
gtaatctgtataatactttgta

SEQ ID NO: 4295227 - DNA, 19 bp, Homo sapiens
gtaatgtatcttatttata

SEQ ID NO: 4295228 - DNA, 13 bp, Homo sapiens
gtaattaaactgt

SEQ ID NO: 4295229 - DNA, 23 bp, Homo sapiens
gtaattttcggatgggagagttt

SEQ ID NO: 4295230 - DNA, 21 bp, Homo sapiens
gtaattttgtagtagttgatg

SEQ ID NO: 4295231 - DNA, 14 bp, Homo sapiens
gtacaaagggaagc

SEQ ID NO: 4295232 - DNA, 16 bp, Homo sapiens
gtacatatggaaatcc

SEQ ID NO: 4295233 - DNA, 19 bp, Homo sapiens
gtacatatggaaatcctgt

SEQ ID NO: 4295234 - DNA, 15 bp, Homo sapiens
gtaccaactgagcca

SEQ ID NO: 4295235 - DNA, 16 bp, Homo sapiens
gtaccaactgagccaa

SEQ ID NO: 4295236 - DNA, 22 bp, Homo sapiens
gtaccagagcctatggaaaggg

SEQ ID NO: 4295237 - DNA, 19 bp, Homo sapiens
gtacctgcccccactcagc

SEQ ID NO: 4295238 - DNA, 14 bp, Homo sapiens
gtacctttctgaca

SEQ ID NO: 4295239 - DNA, 14 bp, Homo sapiens
gtactaccccagga

SEQ ID NO: 4295240 - DNA, 22 bp, Homo sapiens
gtactaccccaggatgcatgca

SEQ ID NO: 4295241 - DNA, 14 bp, Homo sapiens
gtactagagatatt

SEQ ID NO: 4295242 - DNA, 21 bp, Homo sapiens
gtactagagatattttgtaaa

SEQ ID NO: 4295243 - DNA, 22 bp, Homo sapiens
gtactagggggaagtgacaagg

SEQ ID NO: 4295244 - DNA, 15 bp, Homo sapiens
gtactggtaagattg

SEQ ID NO: 4295245 - DNA, 18 bp, Homo sapiens
gtacttcttctgtaatat

SEQ ID NO: 4295246 - DNA, 22 bp, Homo sapiens
gtacttgccctgaccatgcatt

SEQ ID NO: 4295247 - DNA, 19 bp, Homo sapiens
gtacttgctcaataaaggt

SEQ ID NO: 4295248 - DNA, 21 bp, Homo sapiens
gtacttgtgaaacacagctgt

SEQ ID NO: 4295249 - DNA, 14 bp, Homo sapiens
gtagaactgttcat

SEQ ID NO: 4295250 - DNA, 15 bp, Homo sapiens
gtagaagagggagaa

SEQ ID NO: 4295251 - DNA, 15 bp, Homo sapiens
gtagaaggtcggagg

SEQ ID NO: 4295252 - DNA, 15 bp, Homo sapiens
gtagaatctcagcac

SEQ ID NO: 4295253 - DNA, 16 bp, Homo sapiens
gtagactcacggctgc

SEQ ID NO: 4295254 - DNA, 12 bp, Homo sapiens
gtagacttttat

SEQ ID NO: 4295255 - DNA, 23 bp, Homo sapiens
gtagcatgttctatgtgttttta

SEQ ID NO: 4295256 - DNA, 17 bp, Homo sapiens
gtagctcgtgtgcttag

SEQ ID NO: 4295257 - DNA, 15 bp, Homo sapiens
gtagctgtggggagc

SEQ ID NO: 4295258 - DNA, 19 bp, Homo sapiens
gtagctgtggggagctggt

SEQ ID NO: 4295259 - DNA, 16 bp, Homo sapiens
gtagcttcagtcatta

SEQ ID NO: 4295260 - DNA, 20 bp, Homo sapiens
gtaggaagaggccgctgcag

SEQ ID NO: 4295261 - DNA, 21 bp, Homo sapiens
gtaggaagaggccgctgcagg

SEQ ID NO: 4295262 - DNA, 13 bp, Homo sapiens
gtaggctgtattt

SEQ ID NO: 4295263 - DNA, 19 bp, Homo sapiens
gtaggggaagtgtgctgag

SEQ ID NO: 4295264 - DNA, 16 bp, Homo sapiens
gtagtaacacataaag

SEQ ID NO: 4295265 - DNA, 20 bp, Homo sapiens
gtagtaacacataaagtaaa

SEQ ID NO: 4295266 - DNA, 19 bp, Homo sapiens
gtagtacttcttctgtaat

SEQ ID NO: 4295267 - DNA, 18 bp, Homo sapiens
gtagtagctcgtgtgctt

SEQ ID NO: 4295268 - DNA, 19 bp, Homo sapiens
gtagtagttgatgaccaat

SEQ ID NO: 4295269 - DNA, 13 bp, Homo sapiens
gtataaaacagtg

SEQ ID NO: 4295270 - DNA, 17 bp, Homo sapiens
gtataaaacagtgtttc

SEQ ID NO: 4295271 - DNA, 18 bp, Homo sapiens
gtataacaagccaaacat

SEQ ID NO: 4295272 - DNA, 22 bp, Homo sapiens
gtataacaagccaaacattctt

SEQ ID NO: 4295273 - DNA, 12 bp, Homo sapiens
gtatacaaacag

SEQ ID NO: 4295274 - DNA, 18 bp, Homo sapiens
gtatacaaacaggtgcta

SEQ ID NO: 4295275 - DNA, 11 bp, Homo sapiens
gtatataaatg

SEQ ID NO: 4295276 - DNA, 12 bp, Homo sapiens
gtatatcgttat

SEQ ID NO: 4295277 - DNA, 15 bp, Homo sapiens
gtatatttgtatgat

SEQ ID NO: 4295278 - DNA, 15 bp, Homo sapiens
gtatattttatttca

SEQ ID NO: 4295279 - DNA, 16 bp, Homo sapiens
gtatccagaggtgagg

SEQ ID NO: 4295280 - DNA, 16 bp, Homo sapiens
gtatctaaaaaataac

SEQ ID NO: 4295281 - DNA, 17 bp, Homo sapiens
gtatctaaaaaataact

SEQ ID NO: 4295282 - DNA, 19 bp, Homo sapiens
gcttcagcccctggggtac

SEQ ID NO: 4295283 - DNA, 17 bp, Homo sapiens
gcttcaggtgagccaag

SEQ ID NO: 4295284 - DNA, 18 bp, Homo sapiens
gcttcaggtgagccaagg

SEQ ID NO: 4295285 - DNA, 15 bp, Homo sapiens
gcttcccaggaccct

SEQ ID NO: 4295286 - DNA, 15 bp, Homo sapiens
gcttccccattgcct

SEQ ID NO: 4295287 - DNA, 20 bp, Homo sapiens
gcttccccattgccttctgg

SEQ ID NO: 4295288 - DNA, 15 bp, Homo sapiens
gcttcccgctcagcc

SEQ ID NO: 4295289 - DNA, 16 bp, Homo sapiens
gcttcccgctcagccc

SEQ ID NO: 4295290 - DNA, 23 bp, Homo sapiens
gcttcccgctcagccctccctgc

SEQ ID NO: 4295291 - DNA, 18 bp, Homo sapiens
gcttccctctgctccaca

SEQ ID NO: 4295292 - DNA, 21 bp, Homo sapiens
gcttccggctgagctgtgcca

SEQ ID NO: 4295293 - DNA, 13 bp, Homo sapiens
gcttccttcattt

SEQ ID NO: 4295294 - DNA, 17 bp, Homo sapiens
gcttccttcatttcctc

SEQ ID NO: 4295295 - DNA, 22 bp, Homo sapiens
gcttctccctggactctgtggg

SEQ ID NO: 4295296 - DNA, 18 bp, Homo sapiens
gcttctgcccaccccgcc

SEQ ID NO: 4295297 - DNA, 19 bp, Homo sapiens
gcttctgcccaccccgcct

SEQ ID NO: 4295298 - DNA, 22 bp, Homo sapiens
gcttgaatgtccccattctata

SEQ ID NO: 4295299 - DNA, 13 bp, Homo sapiens
gcttgcctagggc

SEQ ID NO: 4295300 - DNA, 18 bp, Homo sapiens
gcttggggtagagaggac

SEQ ID NO: 4295301 - DNA, 20 bp, Homo sapiens
gcttggggtagagaggacag

SEQ ID NO: 4295302 - DNA, 22 bp, Homo sapiens
gcttggtttagctgtgcagaag

SEQ ID NO: 4295303 - DNA, 18 bp, Homo sapiens
gcttgtagggtgaggcgt

SEQ ID NO: 4295304 - DNA, 13 bp, Homo sapiens
gcttgtcagagct

SEQ ID NO: 4295305 - DNA, 14 bp, Homo sapiens
gcttgtcagagctg

SEQ ID NO: 4295306 - DNA, 23 bp, Homo sapiens
gcttgtcctgctcagatgctggt

SEQ ID NO: 4295307 - DNA, 19 bp, Homo sapiens
gcttgtgttgggccccagg

SEQ ID NO: 4295308 - DNA, 21 bp, Homo sapiens
gcttgtttaaggttcttgctg

SEQ ID NO: 4295309 - DNA, 11 bp, Homo sapiens
gcttgtttcta

SEQ ID NO: 4295310 - DNA, 13 bp, Homo sapiens
gcttgtttctata

SEQ ID NO: 4295311 - DNA, 18 bp, Homo sapiens
gcttgtttctatactgtt

SEQ ID NO: 4295312 - DNA, 14 bp, Homo sapiens
gctttcacaaatat

SEQ ID NO: 4295313 - DNA, 14 bp, Homo sapiens
gctttcctgggtct

SEQ ID NO: 4295314 - DNA, 13 bp, Homo sapiens
gctttgccttcca

SEQ ID NO: 4295315 - DNA, 22 bp, Homo sapiens
gctttgctggagtcctgttctc

SEQ ID NO: 4295316 - DNA, 17 bp, Homo sapiens
gctttggaaagacctgt

SEQ ID NO: 4295317 - DNA, 18 bp, Homo sapiens
gctttgggctgccctggt

SEQ ID NO: 4295318 - DNA, 19 bp, Homo sapiens
gctttgggctgccctggtg

SEQ ID NO: 4295319 - DNA, 15 bp, Homo sapiens
gctttgtatgcactt

SEQ ID NO: 4295320 - DNA, 13 bp, Homo sapiens
gctttgtgcttat

SEQ ID NO: 4295321 - DNA, 14 bp, Homo sapiens
gcttttcactgctg

SEQ ID NO: 4295322 - DNA, 18 bp, Homo sapiens
gcttttcactgctggctg

SEQ ID NO: 4295323 - DNA, 17 bp, Homo sapiens
gcttttcccacctcttt

SEQ ID NO: 4295324 - DNA, 19 bp, Homo sapiens
gcttttgtacgttaattaa

SEQ ID NO: 4295325 - DNA, 20 bp, Homo sapiens
gcttttgtacgttaattaaa

SEQ ID NO: 4295326 - DNA, 13 bp, Homo sapiens
ggaaaaaggctgg

SEQ ID NO: 4295327 - DNA, 13 bp, Homo sapiens
ggaaaaaggcttc

SEQ ID NO: 4295328 - DNA, 17 bp, Homo sapiens
ggaaacacgtttagaaa

SEQ ID NO: 4295329 - DNA, 22 bp, Homo sapiens
ggaaactcacctgctggcccct

SEQ ID NO: 4295330 - DNA, 20 bp, Homo sapiens
ggaaagacctgtgaggggaa

SEQ ID NO: 4295331 - DNA, 18 bp, Homo sapiens
ggaaagccagtgactcca

SEQ ID NO: 4295332 - DNA, 15 bp, Homo sapiens
ggaaagggtgctgct

SEQ ID NO: 4295333 - DNA, 17 bp, Homo sapiens
ggaaatgtcaacaagta

SEQ ID NO: 4295334 - DNA, 16 bp, Homo sapiens
ggaacacccagcccca

SEQ ID NO: 4295335 - DNA, 16 bp, Homo sapiens
ggaacagacctcggct

SEQ ID NO: 4295336 - DNA, 17 bp, Homo sapiens
ggaacatttgggagact

SEQ ID NO: 4295337 - DNA, 12 bp, Homo sapiens
ggaaccagagcc

SEQ ID NO: 4295338 - DNA, 19 bp, Homo sapiens
ggaaccatggacctgcact

SEQ ID NO: 4295339 - DNA, 18 bp, Homo sapiens
ggaacctcgaagctgttc

SEQ ID NO: 4295340 - DNA, 19 bp, Homo sapiens
ggaacctcgaagctgttct

SEQ ID NO: 4295341 - DNA, 17 bp, Homo sapiens
ggaacggatcagatgtc

SEQ ID NO: 4295342 - DNA, 17 bp, Homo sapiens
ggaactggtccaggcca

SEQ ID NO: 4295343 - DNA, 23 bp, Homo sapiens
ggaactggtccaggccaggcctc

SEQ ID NO: 4295344 - DNA, 23 bp, Homo sapiens
ggaactggtttttctgttccctg

SEQ ID NO: 4295345 - DNA, 23 bp, Homo sapiens
ggaagacagttctacagaaaaac

SEQ ID NO: 4295346 - DNA, 22 bp, Homo sapiens
ggaagaggccgctgcagggtgg

SEQ ID NO: 4295347 - DNA, 22 bp, Homo sapiens
ggaagatcctccttccaggccc

SEQ ID NO: 4295348 - DNA, 21 bp, Homo sapiens
ggaagcacaagaagtgggagt

SEQ ID NO: 4295349 - DNA, 14 bp, Homo sapiens
ggaagcaccagcct

SEQ ID NO: 4295350 - DNA, 20 bp, Homo sapiens
ggaagcaggttgcttcaaga

SEQ ID NO: 4295351 - DNA, 20 bp, Homo sapiens
ggaagccacgtgctggagag

SEQ ID NO: 4295352 - DNA, 19 bp, Homo sapiens
ggaagcctcctgctgagtg

SEQ ID NO: 4295353 - DNA, 19 bp, Homo sapiens
ggaaggcggggcttcaacc

SEQ ID NO: 4295354 - DNA, 18 bp, Homo sapiens
ggaagggactggtccagg

SEQ ID NO: 4295355 - DNA, 13 bp, Homo sapiens
ggaagggaggcct

SEQ ID NO: 4295356 - DNA, 15 bp, Homo sapiens
ggaagggaggcctga

SEQ ID NO: 4295357 - DNA, 15 bp, Homo sapiens
ggaagtcaggagcca

SEQ ID NO: 4295358 - DNA, 16 bp, Homo sapiens
ggaagtcaggagccag

SEQ ID NO: 4295359 - DNA, 15 bp, Homo sapiens
ggaagtcatcctgca

SEQ ID NO: 4295360 - DNA, 20 bp, Homo sapiens
ggaagtgtgctgaggtgggc

SEQ ID NO: 4295361 - DNA, 23 bp, Homo sapiens
ggaagtgtgctgaggtgggcctt

SEQ ID NO: 4295362 - DNA, 20 bp, Homo sapiens
ggaataagaagcaaataaat

SEQ ID NO: 4295363 - DNA, 21 bp, Homo sapiens
ggaatcgaggaaccagagcca

SEQ ID NO: 4295364 - DNA, 21 bp, Homo sapiens
ggaatgcgctcttcaccagga

SEQ ID NO: 4295365 - DNA, 14 bp, Homo sapiens
ggaatgcggcaaga

SEQ ID NO: 4295366 - DNA, 16 bp, Homo sapiens
ggaatgcggcaagaag

SEQ ID NO: 4295367 - DNA, 22 bp, Homo sapiens
ggaattctcttggctggcttcc

SEQ ID NO: 4295368 - DNA, 20 bp, Homo sapiens
ggaattgacttcgactgtga

SEQ ID NO: 4295369 - DNA, 14 bp, Homo sapiens
ggacaagcccagga

SEQ ID NO: 4295370 - DNA, 14 bp, Homo sapiens
ggacacagtcaggg

SEQ ID NO: 4295371 - DNA, 17 bp, Homo sapiens
ggacacagtcagggcgg

SEQ ID NO: 4295372 - DNA, 13 bp, Homo sapiens
ggacacggcctct

SEQ ID NO: 4295373 - DNA, 19 bp, Homo sapiens
ggacacggcctctggggag

SEQ ID NO: 4295374 - DNA, 21 bp, Homo sapiens
ggacacggcctctggggagac

SEQ ID NO: 4295375 - DNA, 14 bp, Homo sapiens
ggacactgcctttg

SEQ ID NO: 4295376 - DNA, 20 bp, Homo sapiens
ggacagaaccaacgggtctg

SEQ ID NO: 4295377 - DNA, 23 bp, Homo sapiens
ggacagaaccaacgggtctgtgg

SEQ ID NO: 4295378 - DNA, 12 bp, Homo sapiens
ggacagacccag

SEQ ID NO: 4295379 - DNA, 15 bp, Homo sapiens
ggacagatcaatggc

SEQ ID NO: 4295380 - DNA, 19 bp, Homo sapiens
ggacagatcaatggcgcag

SEQ ID NO: 4295381 - DNA, 23 bp, Homo sapiens
ggacagatcaatggcgcagtgcc

SEQ ID NO: 4295382 - DNA, 22 bp, Homo sapiens
ggacagggcatggccaggtggc

SEQ ID NO: 4295383 - DNA, 13 bp, Homo sapiens
ggacagggccagg

SEQ ID NO: 4295384 - DNA, 21 bp, Homo sapiens
ggacaggtggaggcgagccag

SEQ ID NO: 4295385 - DNA, 12 bp, Homo sapiens
ggacagtgggct

SEQ ID NO: 4295386 - DNA, 16 bp, Homo sapiens
ggacagtgggctatgc

SEQ ID NO: 4295387 - DNA, 22 bp, Homo sapiens
ggaccaagatgtcaagctggcc

SEQ ID NO: 4295388 - DNA, 22 bp, Homo sapiens
ggacccagcaggggcagaagga

SEQ ID NO: 4295389 - DNA, 16 bp, Homo sapiens
ggaccccatctgctga

SEQ ID NO: 4295390 - DNA, 13 bp, Homo sapiens
ggaccctgagggt

SEQ ID NO: 4295391 - DNA, 15 bp, Homo sapiens
ggaccgccagatggg

SEQ ID NO: 4295392 - DNA, 17 bp, Homo sapiens
ggaccgccagatggggc

SEQ ID NO: 4295393 - DNA, 11 bp, Homo sapiens
ggaccggacgc

SEQ ID NO: 4295394 - DNA, 15 bp, Homo sapiens
ggaccgggagcctgc

SEQ ID NO: 4295395 - DNA, 18 bp, Homo sapiens
ggacctccacctgggaga

SEQ ID NO: 4295396 - DNA, 14 bp, Homo sapiens
ggacctgcagttgg

SEQ ID NO: 4295397 - DNA, 17 bp, Homo sapiens
ggacgcagggagaccct

SEQ ID NO: 4295398 - DNA, 17 bp, Homo sapiens
ggacgcatgcagggccc

SEQ ID NO: 4295399 - DNA, 18 bp, Homo sapiens
ggacgcatgcagggcccc

SEQ ID NO: 4295400 - DNA, 13 bp, Homo sapiens
ggacggaagtggc

SEQ ID NO: 4295401 - DNA, 21 bp, Homo sapiens
ggacggagcactgtgcagccg

SEQ ID NO: 4295402 - DNA, 13 bp, Homo sapiens
ggactctgtgggg

SEQ ID NO: 4295403 - DNA, 16 bp, Homo sapiens
ggactctgtggggcca

SEQ ID NO: 4295404 - DNA, 22 bp, Homo sapiens
ggactgggaagggggcaggccc

SEQ ID NO: 4295405 - DNA, 18 bp, Homo sapiens
ggactggtccaggcatgg

SEQ ID NO: 4295406 - DNA, 11 bp, Homo sapiens
ggactgtggcc

SEQ ID NO: 4295407 - DNA, 21 bp, Homo sapiens
ggactgttttttcctgagctt

SEQ ID NO: 4295408 - DNA, 10 bp, Homo sapiens
ggacttcaaa

SEQ ID NO: 4295409 - DNA, 13 bp, Homo sapiens
ggagaaggagagg

SEQ ID NO: 4295410 - DNA, 15 bp, Homo sapiens
ggagaaggagaggct

SEQ ID NO: 4295411 - DNA, 23 bp, Homo sapiens
ggagaaggcctgccccccttccc

SEQ ID NO: 4295412 - DNA, 15 bp, Homo sapiens
ggagaagggacagcg

SEQ ID NO: 4295413 - DNA, 14 bp, Homo sapiens
ggagactcaggccc

SEQ ID NO: 4295414 - DNA, 15 bp, Homo sapiens
ggagactcaggccca

SEQ ID NO: 4295415 - DNA, 22 bp, Homo sapiens
ggagacttaggccagaggtgaa

SEQ ID NO: 4295416 - DNA, 21 bp, Homo sapiens
ctctctcagcccaggtctcct

SEQ ID NO: 4295417 - DNA, 19 bp, Homo sapiens
ctctctccctccactcctc

SEQ ID NO: 4295418 - DNA, 18 bp, Homo sapiens
ctctctcctctctctccc

SEQ ID NO: 4295419 - DNA, 14 bp, Homo sapiens
ctctctctatatat

SEQ ID NO: 4295420 - DNA, 20 bp, Homo sapiens
ctctctctatatatacatgt

SEQ ID NO: 4295421 - DNA, 14 bp, Homo sapiens
ctctctctccctcc

SEQ ID NO: 4295422 - DNA, 15 bp, Homo sapiens
ctctctctgccccca

SEQ ID NO: 4295423 - DNA, 20 bp, Homo sapiens
ctctctgaactgcaacactg

SEQ ID NO: 4295424 - DNA, 21 bp, Homo sapiens
ctctctgaactgcaacactgg

SEQ ID NO: 4295425 - DNA, 15 bp, Homo sapiens
ctctctgccagccgc

SEQ ID NO: 4295426 - DNA, 17 bp, Homo sapiens
ctctctggccactctgc

SEQ ID NO: 4295427 - DNA, 15 bp, Homo sapiens
ctctcttcttactgt

SEQ ID NO: 4295428 - DNA, 21 bp, Homo sapiens
ctctgaaaatatttttttcta

SEQ ID NO: 4295429 - DNA, 24 bp, Homo sapiens
ctctgaaaatatttttttctagct

SEQ ID NO: 4295430 - DNA, 18 bp, Homo sapiens
ctctgaactgcaacactg

SEQ ID NO: 4295431 - DNA, 15 bp, Homo sapiens
ctctgaactgctgct

SEQ ID NO: 4295432 - DNA, 16 bp, Homo sapiens
ctctgaactgctgctg

SEQ ID NO: 4295433 - DNA, 21 bp, Homo sapiens
ctctgaatgtagccagcccac

SEQ ID NO: 4295434 - DNA, 23 bp, Homo sapiens
ctctgacctgcccccgctctgcc

SEQ ID NO: 4295435 - DNA, 17 bp, Homo sapiens
ctctgatcaaagcacct

SEQ ID NO: 4295436 - DNA, 20 bp, Homo sapiens
ctctgatcacaacttttctg

SEQ ID NO: 4295437 - DNA, 18 bp, Homo sapiens
ctctgatttattttgtat

SEQ ID NO: 4295438 - DNA, 16 bp, Homo sapiens
ctctgcacgtgcacac

SEQ ID NO: 4295439 - DNA, 17 bp, Homo sapiens
ctctgcacgtgcacaca

SEQ ID NO: 4295440 - DNA, 24 bp, Homo sapiens
ctctgcacgtgcacacacctgcac

SEQ ID NO: 4295441 - DNA, 13 bp, Homo sapiens
ctctgcagcacat

SEQ ID NO: 4295442 - DNA, 22 bp, Homo sapiens
ctctgcagcacattgccctgag

SEQ ID NO: 4295443 - DNA, 23 bp, Homo sapiens
ctctgcagggcagcctgtgggag

SEQ ID NO: 4295444 - DNA, 21 bp, Homo sapiens
ctctgcatgctcctctgcctg

SEQ ID NO: 4295445 - DNA, 22 bp, Homo sapiens
ctctgccatcagcccctgctgc

SEQ ID NO: 4295446 - DNA, 13 bp, Homo sapiens
ctctgcctgtccc

SEQ ID NO: 4295447 - DNA, 17 bp, Homo sapiens
ctctgcctgtgcccgct

SEQ ID NO: 4295448 - DNA, 13 bp, Homo sapiens
ctctgccttccag

SEQ ID NO: 4295449 - DNA, 20 bp, Homo sapiens
ctctgcgtcccactgagtct

SEQ ID NO: 4295450 - DNA, 17 bp, Homo sapiens
ctctgctatgtctgtga

SEQ ID NO: 4295451 - DNA, 19 bp, Homo sapiens
ctctgctgaggccagagga

SEQ ID NO: 4295452 - DNA, 21 bp, Homo sapiens
ctctgctgtattgatatcact

SEQ ID NO: 4295453 - DNA, 19 bp, Homo sapiens
ctctgcttttccattctgg

SEQ ID NO: 4295454 - DNA, 22 bp, Homo sapiens
ctctgcttttccattctgggtg

SEQ ID NO: 4295455 - DNA, 23 bp, Homo sapiens
ctctgcttttccattctgggtgt

SEQ ID NO: 4295456 - DNA, 14 bp, Homo sapiens
ctctggactgggaa

SEQ ID NO: 4295457 - DNA, 16 bp, Homo sapiens
ctctggactgggaagg

SEQ ID NO: 4295458 - DNA, 13 bp, Homo sapiens
ctctggcagcctc

SEQ ID NO: 4295459 - DNA, 14 bp, Homo sapiens
ctctggcagcctca

SEQ ID NO: 4295460 - DNA, 15 bp, Homo sapiens
ctctggcagcctcag

SEQ ID NO: 4295461 - DNA, 16 bp, Homo sapiens
ctctggcagcctcaga

SEQ ID NO: 4295462 - DNA, 19 bp, Homo sapiens
ctctggcagcctcagaggc

SEQ ID NO: 4295463 - DNA, 16 bp, Homo sapiens
ctctggcaggtggcca

SEQ ID NO: 4295464 - DNA, 21 bp, Homo sapiens
ctctggcaggtggccagggct

SEQ ID NO: 4295465 - DNA, 14 bp, Homo sapiens
ctctggccactctg

SEQ ID NO: 4295466 - DNA, 13 bp, Homo sapiens
ctctggcctggga

SEQ ID NO: 4295467 - DNA, 18 bp, Homo sapiens
ctctgggctcacaccagc

SEQ ID NO: 4295468 - DNA, 21 bp, Homo sapiens
ctctgggctcacaccagccct

SEQ ID NO: 4295469 - DNA, 15 bp, Homo sapiens
ctctgtccccgagcc

SEQ ID NO: 4295470 - DNA, 13 bp, Homo sapiens
ctctgtggggcca

SEQ ID NO: 4295471 - DNA, 16 bp, Homo sapiens
ctctgtggggccacac

SEQ ID NO: 4295472 - DNA, 16 bp, Homo sapiens
ctctgttcatttcctc

SEQ ID NO: 4295473 - DNA, 17 bp, Homo sapiens
ctctgttcatttcctca

SEQ ID NO: 4295474 - DNA, 14 bp, Homo sapiens
ctctgttcctggct

SEQ ID NO: 4295475 - DNA, 15 bp, Homo sapiens
ctctgttcctggctc

SEQ ID NO: 4295476 - DNA, 17 bp, Homo sapiens
ctctgtttaccctccct

SEQ ID NO: 4295477 - DNA, 18 bp, Homo sapiens
ctctgtttaccctccctg

SEQ ID NO: 4295478 - DNA, 16 bp, Homo sapiens
ctctgtttgctcaccc

SEQ ID NO: 4295479 - DNA, 22 bp, Homo sapiens
ctcttaatgccacggcagccac

SEQ ID NO: 4295480 - DNA, 21 bp, Homo sapiens
ctcttcccaccaactctctct

SEQ ID NO: 4295481 - DNA, 13 bp, Homo sapiens
ctcttcccccttc

SEQ ID NO: 4295482 - DNA, 17 bp, Homo sapiens
ctcttctccactggatg

SEQ ID NO: 4295483 - DNA, 13 bp, Homo sapiens
ctcttctcctttc

SEQ ID NO: 4295484 - DNA, 11 bp, Homo sapiens
ctcttcttcct

SEQ ID NO: 4295485 - DNA, 20 bp, Homo sapiens
ctcttcttccttttgtatcc

SEQ ID NO: 4295486 - DNA, 23 bp, Homo sapiens
ctcttcttttaaaccattttctt

SEQ ID NO: 4295487 - DNA, 18 bp, Homo sapiens
ctcttgcataagcctcag

SEQ ID NO: 4295488 - DNA, 19 bp, Homo sapiens
ctcttgcataagcctcagg

SEQ ID NO: 4295489 - DNA, 16 bp, Homo sapiens
ctcttgccccccaccc

SEQ ID NO: 4295490 - DNA, 19 bp, Homo sapiens
ctcttgccccccaccccag

SEQ ID NO: 4295491 - DNA, 20 bp, Homo sapiens
ctcttgggagacgtccaccc

SEQ ID NO: 4295492 - DNA, 15 bp, Homo sapiens
ctcttgggctgagac

SEQ ID NO: 4295493 - DNA, 17 bp, Homo sapiens
ctctttatgactgtttt

SEQ ID NO: 4295494 - DNA, 14 bp, Homo sapiens
ctctttattgtctg

SEQ ID NO: 4295495 - DNA, 19 bp, Homo sapiens
ctctttgtaaggacttgtg

SEQ ID NO: 4295496 - DNA, 22 bp, Homo sapiens
ctctttgtaaggacttgtgcct

SEQ ID NO: 4295497 - DNA, 18 bp, Homo sapiens
ctcttttcaaacacacac

SEQ ID NO: 4295498 - DNA, 19 bp, Homo sapiens
ctgaaaacacaaacaacaa

SEQ ID NO: 4295499 - DNA, 21 bp, Homo sapiens
ctgaaaactggaataagaagc

SEQ ID NO: 4295500 - DNA, 23 bp, Homo sapiens
ctgaaaactggaataagaagcaa

SEQ ID NO: 4295501 - DNA, 13 bp, Homo sapiens
ctgaaaactgttt

SEQ ID NO: 4295502 - DNA, 11 bp, Homo sapiens
ctgaaaatatt

SEQ ID NO: 4295503 - DNA, 22 bp, Homo sapiens
ctgaaaatatttttttctagct

SEQ ID NO: 4295504 - DNA, 23 bp, Homo sapiens
ctgaaaatatttttttctagcta

SEQ ID NO: 4295505 - DNA, 14 bp, Homo sapiens
ctgaaacagcctct

SEQ ID NO: 4295506 - DNA, 17 bp, Homo sapiens
ctgaaacttacacacaa

SEQ ID NO: 4295507 - DNA, 15 bp, Homo sapiens
ctgaaagctgcttct

SEQ ID NO: 4295508 - DNA, 17 bp, Homo sapiens
ctgaaagctgcttctgg

SEQ ID NO: 4295509 - DNA, 17 bp, Homo sapiens
ctgaaaggtagactttt

SEQ ID NO: 4295510 - DNA, 18 bp, Homo sapiens
ctgaaagtatcaccaaaa

SEQ ID NO: 4295511 - DNA, 20 bp, Homo sapiens
ctgaacgatccttcaaagtc

SEQ ID NO: 4295512 - DNA, 18 bp, Homo sapiens
ctgaactaggtgctggca

SEQ ID NO: 4295513 - DNA, 18 bp, Homo sapiens
ctgaactgctgctggtca

SEQ ID NO: 4295514 - DNA, 21 bp, Homo sapiens
ctgaactggccgctgggagaa

SEQ ID NO: 4295515 - DNA, 19 bp, Homo sapiens
ctgaagagcgctcctctgc

SEQ ID NO: 4295516 - DNA, 23 bp, Homo sapiens
ctgaagagcgctcctctgccttg

SEQ ID NO: 4295517 - DNA, 14 bp, Homo sapiens
ctgaagcaacactg

SEQ ID NO: 4295518 - DNA, 15 bp, Homo sapiens
ctgaaggagaggagt

SEQ ID NO: 4295519 - DNA, 19 bp, Homo sapiens
ctgaaggattttaaatgct

SEQ ID NO: 4295520 - DNA, 23 bp, Homo sapiens
ctgaaggttggaactgctgccat

SEQ ID NO: 4295521 - DNA, 13 bp, Homo sapiens
ctgaagtcactgc

SEQ ID NO: 4295522 - DNA, 14 bp, Homo sapiens
ctgaagtgacccca

SEQ ID NO: 4295523 - DNA, 15 bp, Homo sapiens
ctgaagtgaccccag

SEQ ID NO: 4295524 - DNA, 23 bp, Homo sapiens
ctgaagtgaccccagctccaggc

SEQ ID NO: 4295525 - DNA, 23 bp, Homo sapiens
ctgaagtgatgatggatgagaaa

SEQ ID NO: 4295526 - DNA, 16 bp, Homo sapiens
ctgaataatttcttac

SEQ ID NO: 4295527 - DNA, 16 bp, Homo sapiens
ctgaatccctttcagt

SEQ ID NO: 4295528 - DNA, 22 bp, Homo sapiens
ctgacaaccaccgctccccagc

SEQ ID NO: 4295529 - DNA, 14 bp, Homo sapiens
ctgacagaaggact

SEQ ID NO: 4295530 - DNA, 13 bp, Homo sapiens
ctgacatgctaac

SEQ ID NO: 4295531 - DNA, 19 bp, Homo sapiens
ctgaccacacttcctgtcc

SEQ ID NO: 4295532 - DNA, 17 bp, Homo sapiens
ctgaccagaagtggcag

SEQ ID NO: 4295533 - DNA, 19 bp, Homo sapiens
ctgaccagaagtggcagga

SEQ ID NO: 4295534 - DNA, 22 bp, Homo sapiens
ctgaccccacttatgctgctgt

SEQ ID NO: 4295535 - DNA, 15 bp, Homo sapiens
ctgacctgcccccgc

SEQ ID NO: 4295536 - DNA, 22 bp, Homo sapiens
ctgacctgcccccgctctgcca

SEQ ID NO: 4295537 - DNA, 24 bp, Homo sapiens
ctgacctgcccccgctctgccatc

SEQ ID NO: 4295538 - DNA, 21 bp, Homo sapiens
ctgagaaaagctttgaaccct

SEQ ID NO: 4295539 - DNA, 15 bp, Homo sapiens
ctgagaagcctcatg

SEQ ID NO: 4295540 - DNA, 14 bp, Homo sapiens
ctgagaatgcctag

SEQ ID NO: 4295541 - DNA, 14 bp, Homo sapiens
ctgagagtggggct

SEQ ID NO: 4295542 - DNA, 20 bp, Homo sapiens
ctgagcggccgcctgtcctt

SEQ ID NO: 4295543 - DNA, 13 bp, Homo sapiens
ctgagctctgacc

SEQ ID NO: 4295544 - DNA, 13 bp, Homo sapiens
ctgagctggccta

SEQ ID NO: 4295545 - DNA, 17 bp, Homo sapiens
ctgagctgtgccagctg

SEQ ID NO: 4295546 - DNA, 21 bp, Homo sapiens
ctgagcttgattctaaagggg

SEQ ID NO: 4295547 - DNA, 22 bp, Homo sapiens
ctgagcttgattctaaagggga

SEQ ID NO: 4295548 - DNA, 23 bp, Homo sapiens
ctgagcttgattctaaaggggac

SEQ ID NO: 4295549 - DNA, 17 bp, Homo sapiens
gcctttgctgccttctg

SEQ ID NO: 4295550 - DNA, 22 bp, Homo sapiens
gcctttgctgccttctgtctct

SEQ ID NO: 4295551 - DNA, 18 bp, Homo sapiens
gcgacatctctgactttc

SEQ ID NO: 4295552 - DNA, 20 bp, Homo sapiens
gcgagaacacaagccacgcc

SEQ ID NO: 4295553 - DNA, 19 bp, Homo sapiens
gcgagccagattaggcctg

SEQ ID NO: 4295554 - DNA, 21 bp, Homo sapiens
gcgagccagattaggcctgga

SEQ ID NO: 4295555 - DNA, 14 bp, Homo sapiens
gcgaggcagaatgg

SEQ ID NO: 4295556 - DNA, 21 bp, Homo sapiens
gcgagtctggagaccaggact

SEQ ID NO: 4295557 - DNA, 13 bp, Homo sapiens
gcgatgtgtttta

SEQ ID NO: 4295558 - DNA, 11 bp, Homo sapiens
gcgcacacaca

SEQ ID NO: 4295559 - DNA, 21 bp, Homo sapiens
gcgcacccggcagccccccag

SEQ ID NO: 4295560 - DNA, 14 bp, Homo sapiens
gcgcagtgcctctg

SEQ ID NO: 4295561 - DNA, 15 bp, Homo sapiens
gcgcagtgcctctgg

SEQ ID NO: 4295562 - DNA, 21 bp, Homo sapiens
gcgcagtgcctctggtctggg

SEQ ID NO: 4295563 - DNA, 13 bp, Homo sapiens
gcgccctccctcc

SEQ ID NO: 4295564 - DNA, 20 bp, Homo sapiens
gcgcggatgtagcatgttct

SEQ ID NO: 4295565 - DNA, 13 bp, Homo sapiens
gcgctctgcatgc

SEQ ID NO: 4295566 - DNA, 16 bp, Homo sapiens
gcgctcttcaccagga

SEQ ID NO: 4295567 - DNA, 23 bp, Homo sapiens
gcgctgagggcagggttctagaa

SEQ ID NO: 4295568 - DNA, 11 bp, Homo sapiens
gcgctgccctg

SEQ ID NO: 4295569 - DNA, 12 bp, Homo sapiens
gcgctgccctgc

SEQ ID NO: 4295570 - DNA, 17 bp, Homo sapiens
gcgctgccctgcaaacc

SEQ ID NO: 4295571 - DNA, 16 bp, Homo sapiens
gcgctgtgctggtctc

SEQ ID NO: 4295572 - DNA, 16 bp, Homo sapiens
gcggagcttctccagc

SEQ ID NO: 4295573 - DNA, 16 bp, Homo sapiens
gcggccgcctgtcctt

SEQ ID NO: 4295574 - DNA, 14 bp, Homo sapiens
gcggccggcctggg

SEQ ID NO: 4295575 - DNA, 19 bp, Homo sapiens
gcggccggcctggggccgg

SEQ ID NO: 4295576 - DNA, 23 bp, Homo sapiens
gcggccggcctggggccgggctg

SEQ ID NO: 4295577 - DNA, 18 bp, Homo sapiens
gcggcctggggacggagc

SEQ ID NO: 4295578 - DNA, 22 bp, Homo sapiens
gcggcctggggacggagcactg

SEQ ID NO: 4295579 - DNA, 19 bp, Homo sapiens
gcggctgggagcctcgccc

SEQ ID NO: 4295580 - DNA, 17 bp, Homo sapiens
gcgggaaagccagtgac

SEQ ID NO: 4295581 - DNA, 12 bp, Homo sapiens
gcgggaggccac

SEQ ID NO: 4295582 - DNA, 17 bp, Homo sapiens
gcgggccaaggactgcc

SEQ ID NO: 4295583 - DNA, 13 bp, Homo sapiens
gcgggccaggaga

SEQ ID NO: 4295584 - DNA, 19 bp, Homo sapiens
gcgggtaaaaagagaaggc

SEQ ID NO: 4295585 - DNA, 23 bp, Homo sapiens
gcgggtaaaaagagaaggcaagc

SEQ ID NO: 4295586 - DNA, 22 bp, Homo sapiens
gcggtgtgagatggtgccccct

SEQ ID NO: 4295587 - DNA, 16 bp, Homo sapiens
gcgtagggccagggct

SEQ ID NO: 4295588 - DNA, 20 bp, Homo sapiens
gcgtagggccagggctctgg

SEQ ID NO: 4295589 - DNA, 18 bp, Homo sapiens
gcgtctgagcggccgcct

SEQ ID NO: 4295590 - DNA, 14 bp, Homo sapiens
gcgtcttgtatttt

SEQ ID NO: 4295591 - DNA, 16 bp, Homo sapiens
gcgtcttgtattttct

SEQ ID NO: 4295592 - DNA, 21 bp, Homo sapiens
gcgtgacttcagactctctcc

SEQ ID NO: 4295593 - DNA, 12 bp, Homo sapiens
gcgtggcctggg

SEQ ID NO: 4295594 - DNA, 17 bp, Homo sapiens
gcgtggcctggggctgc

SEQ ID NO: 4295595 - DNA, 12 bp, Homo sapiens
gcgttttagagt

SEQ ID NO: 4295596 - DNA, 14 bp, Homo sapiens
gctaacctctctga

SEQ ID NO: 4295597 - DNA, 12 bp, Homo sapiens
gctaagcctgga

SEQ ID NO: 4295598 - DNA, 13 bp, Homo sapiens
gctaagcctggac

SEQ ID NO: 4295599 - DNA, 14 bp, Homo sapiens
gctaagcctggaca

SEQ ID NO: 4295600 - DNA, 15 bp, Homo sapiens
gctaagcctggacac

SEQ ID NO: 4295601 - DNA, 17 bp, Homo sapiens
gctaagttgtcttacac

SEQ ID NO: 4295602 - DNA, 23 bp, Homo sapiens
gctaagttgtcttacacttctca

SEQ ID NO: 4295603 - DNA, 17 bp, Homo sapiens
gctaatcagcattctca

SEQ ID NO: 4295604 - DNA, 22 bp, Homo sapiens
gctaatcagcattctcactcct

SEQ ID NO: 4295605 - DNA, 15 bp, Homo sapiens
gctaattaaaaagtt

SEQ ID NO: 4295606 - DNA, 19 bp, Homo sapiens
gctactctagtattccaga

SEQ ID NO: 4295607 - DNA, 22 bp, Homo sapiens
gctactttggtttctgtctgta

SEQ ID NO: 4295608 - DNA, 14 bp, Homo sapiens
gctagactgggctg

SEQ ID NO: 4295609 - DNA, 15 bp, Homo sapiens
gctagagcattctgg

SEQ ID NO: 4295610 - DNA, 17 bp, Homo sapiens
gctagagcattctgggg

SEQ ID NO: 4295611 - DNA, 19 bp, Homo sapiens
gctagagcattctggggtg

SEQ ID NO: 4295612 - DNA, 20 bp, Homo sapiens
gctaggttaataggaggaca

SEQ ID NO: 4295613 - DNA, 23 bp, Homo sapiens
gctataacaactctattttttac

SEQ ID NO: 4295614 - DNA, 22 bp, Homo sapiens
gctataatgtttccctcaagaa

SEQ ID NO: 4295615 - DNA, 12 bp, Homo sapiens
gctatatatgaa

SEQ ID NO: 4295616 - DNA, 15 bp, Homo sapiens
gctatccagccgcaa

SEQ ID NO: 4295617 - DNA, 19 bp, Homo sapiens
gctatcttcatgtaaattg

SEQ ID NO: 4295618 - DNA, 23 bp, Homo sapiens
gctatgccactaggccctggtct

SEQ ID NO: 4295619 - DNA, 13 bp, Homo sapiens
gctatgtctgtga

SEQ ID NO: 4295620 - DNA, 12 bp, Homo sapiens
gctattcccagg

SEQ ID NO: 4295621 - DNA, 19 bp, Homo sapiens
gctcacagccaccacctgg

SEQ ID NO: 4295622 - DNA, 12 bp, Homo sapiens
gctcaccctgct

SEQ ID NO: 4295623 - DNA, 14 bp, Homo sapiens
gctcaccctgctcc

SEQ ID NO: 4295624 - DNA, 15 bp, Homo sapiens
gctcaccctgctcct

SEQ ID NO: 4295625 - DNA, 15 bp, Homo sapiens
gctcacttcaagctc

SEQ ID NO: 4295626 - DNA, 18 bp, Homo sapiens
gctcagaagtttcttctt

SEQ ID NO: 4295627 - DNA, 17 bp, Homo sapiens
gctcagatgctggtcat

SEQ ID NO: 4295628 - DNA, 14 bp, Homo sapiens
gctcagcccacccc

SEQ ID NO: 4295629 - DNA, 15 bp, Homo sapiens
gctcagcccaccccc

SEQ ID NO: 4295630 - DNA, 15 bp, Homo sapiens
gctcagccctccctg

SEQ ID NO: 4295631 - DNA, 16 bp, Homo sapiens
gctcagccctccctgc

SEQ ID NO: 4295632 - DNA, 22 bp, Homo sapiens
gctcagggtgctagaggattag

SEQ ID NO: 4295633 - DNA, 22 bp, Homo sapiens
gctcatcagaaacaatttctgt

SEQ ID NO: 4295634 - DNA, 13 bp, Homo sapiens
gctcattcttttc

SEQ ID NO: 4295635 - DNA, 13 bp, Homo sapiens
gctccaagagaat

SEQ ID NO: 4295636 - DNA, 23 bp, Homo sapiens
gctccagacccccagcaaccctc

SEQ ID NO: 4295637 - DNA, 19 bp, Homo sapiens
gctccagagtaggtgggtc

SEQ ID NO: 4295638 - DNA, 13 bp, Homo sapiens
gctccaggcagga

SEQ ID NO: 4295639 - DNA, 13 bp, Homo sapiens
gctccaggcttcc

SEQ ID NO: 4295640 - DNA, 18 bp, Homo sapiens
gctccaggcttcctgccc

SEQ ID NO: 4295641 - DNA, 21 bp, Homo sapiens
gctccagtctgctgccctcca

SEQ ID NO: 4295642 - DNA, 15 bp, Homo sapiens
gctcccacaggccct

SEQ ID NO: 4295643 - DNA, 22 bp, Homo sapiens
gctcccacaggcccttcctctc

SEQ ID NO: 4295644 - DNA, 19 bp, Homo sapiens
gctcccactgcccctgcac

SEQ ID NO: 4295645 - DNA, 16 bp, Homo sapiens
gctcccagcagaggcc

SEQ ID NO: 4295646 - DNA, 17 bp, Homo sapiens
gctccccaatccaaccc

SEQ ID NO: 4295647 - DNA, 22 bp, Homo sapiens
gctccccaatccaacccatgca

SEQ ID NO: 4295648 - DNA, 13 bp, Homo sapiens
gctccccagccca

SEQ ID NO: 4295649 - DNA, 17 bp, Homo sapiens
gctcccccatcctcccc

SEQ ID NO: 4295650 - DNA, 19 bp, Homo sapiens
gctcccctctatttagcat

SEQ ID NO: 4295651 - DNA, 23 bp, Homo sapiens
gctcctccagcaagacctcgtct

SEQ ID NO: 4295652 - DNA, 14 bp, Homo sapiens
gctcctcccggtgc

SEQ ID NO: 4295653 - DNA, 17 bp, Homo sapiens
gctcctcggccagagct

SEQ ID NO: 4295654 - DNA, 17 bp, Homo sapiens
gctcctctgcctgtgcc

SEQ ID NO: 4295655 - DNA, 18 bp, Homo sapiens
gctcctctgcctgtgccc

SEQ ID NO: 4295656 - DNA, 18 bp, Homo sapiens
gctcctctgccttggaca

SEQ ID NO: 4295657 - DNA, 18 bp, Homo sapiens
gctcctgaatccctttca

SEQ ID NO: 4295658 - DNA, 16 bp, Homo sapiens
gctcgttcccccaggg

SEQ ID NO: 4295659 - DNA, 22 bp, Homo sapiens
gctctacagctaatcagcattc

SEQ ID NO: 4295660 - DNA, 14 bp, Homo sapiens
gctctaggtggggc

SEQ ID NO: 4295661 - DNA, 17 bp, Homo sapiens
gctctcccctgcgcagg

SEQ ID NO: 4295662 - DNA, 19 bp, Homo sapiens
gctctcccctgcgcaggcc

SEQ ID NO: 4295663 - DNA, 20 bp, Homo sapiens
gctctcccctgcgcaggccc

SEQ ID NO: 4295664 - DNA, 23 bp, Homo sapiens
gctctcccctgcgcaggccctcc

SEQ ID NO: 4295665 - DNA, 20 bp, Homo sapiens
gctctcctgggccagggtct

SEQ ID NO: 4295666 - DNA, 16 bp, Homo sapiens
gctctctcacccagcc

SEQ ID NO: 4295667 - DNA, 19 bp, Homo sapiens
gctctctcacccagcctgg

SEQ ID NO: 4295668 - DNA, 23 bp, Homo sapiens
gctctctcacccagcctggtact

SEQ ID NO: 4295669 - DNA, 13 bp, Homo sapiens
gctctctgtctgg

SEQ ID NO: 4295670 - DNA, 19 bp, Homo sapiens
gctctgaatgtagccagcc

SEQ ID NO: 4295671 - DNA, 18 bp, Homo sapiens
gctctgagcagttgttat

SEQ ID NO: 4295672 - DNA, 14 bp, Homo sapiens
gctctgaggcaacc

SEQ ID NO: 4295673 - DNA, 19 bp, Homo sapiens
gctctgaggcaaccccctc

SEQ ID NO: 4295674 - DNA, 23 bp, Homo sapiens
gctctgaggctgccccaggggca

SEQ ID NO: 4295675 - DNA, 22 bp, Homo sapiens
gctctgcagcacattgccctga

SEQ ID NO: 4295676 - DNA, 23 bp, Homo sapiens
gctctgcagcacattgccctgag

SEQ ID NO: 4295677 - DNA, 19 bp, Homo sapiens
gctctgcatgctcctctgc

SEQ ID NO: 4295678 - DNA, 23 bp, Homo sapiens
gctctgcatgctcctctgcctgt

SEQ ID NO: 4295679 - DNA, 17 bp, Homo sapiens
gctctgccatcagcccc

SEQ ID NO: 4295680 - DNA, 16 bp, Homo sapiens
gctctgcgtcccactg

SEQ ID NO: 4295681 - DNA, 14 bp, Homo sapiens
gctctggcaggtgg

SEQ ID NO: 4295682 - DNA, 17 bp, Homo sapiens
gctctggcaggtggcca

SEQ ID NO: 4295683 - DNA, 14 bp, Homo sapiens
gctctgggttcggg

SEQ ID NO: 4295684 - DNA, 21 bp, Homo sapiens
gctcttctcctttcacaacct

SEQ ID NO: 4295685 - DNA, 16 bp, Homo sapiens
gctgaacaatgaatgc

SEQ ID NO: 4295686 - DNA, 21 bp, Homo sapiens
gctgacaaccaccgctcccca

SEQ ID NO: 4295687 - DNA, 23 bp, Homo sapiens
gctgacaaccaccgctccccagc

SEQ ID NO: 4295688 - DNA, 18 bp, Homo sapiens
gctgactgtactcctccc

SEQ ID NO: 4295689 - DNA, 19 bp, Homo sapiens
gctgactgtactcctccca

SEQ ID NO: 4295690 - DNA, 21 bp, Homo sapiens
gctgagcacccagctctgtct

SEQ ID NO: 4295691 - DNA, 18 bp, Homo sapiens
gctgagctctgacctgcc

SEQ ID NO: 4295692 - DNA, 18 bp, Homo sapiens
gctgagctgtgccagctg

SEQ ID NO: 4295693 - DNA, 19 bp, Homo sapiens
gctgagctgtgccagctgc

SEQ ID NO: 4295694 - DNA, 18 bp, Homo sapiens
gctgaggagctcagggct

SEQ ID NO: 4295695 - DNA, 13 bp, Homo sapiens
gctgaggccagag

SEQ ID NO: 4295696 - DNA, 17 bp, Homo sapiens
gctgaggccagaggaag

SEQ ID NO: 4295697 - DNA, 18 bp, Homo sapiens
gctgaggccagaggaagg

SEQ ID NO: 4295698 - DNA, 19 bp, Homo sapiens
gctgaggccagaggaaggg

SEQ ID NO: 4295699 - DNA, 23 bp, Homo sapiens
gctgaggccagaggaagggaggc

SEQ ID NO: 4295700 - DNA, 21 bp, Homo sapiens
gctgagtatgttaagctcttt

SEQ ID NO: 4295701 - DNA, 15 bp, Homo sapiens
gctgatttcccctct

SEQ ID NO: 4295702 - DNA, 22 bp, Homo sapiens
gctgcaccaacctcactgccct

SEQ ID NO: 4295703 - DNA, 15 bp, Homo sapiens
gctgcacccctggtg

SEQ ID NO: 4295704 - DNA, 21 bp, Homo sapiens
gctgcacccctggtgtccctg

SEQ ID NO: 4295705 - DNA, 17 bp, Homo sapiens
gctgcagaaccagtccc

SEQ ID NO: 4295706 - DNA, 23 bp, Homo sapiens
gctgcagaaccagtccctctgag

SEQ ID NO: 4295707 - DNA, 16 bp, Homo sapiens
gctgcaggaatcaaaa

SEQ ID NO: 4295708 - DNA, 12 bp, Homo sapiens
gctgcagggtgg

SEQ ID NO: 4295709 - DNA, 19 bp, Homo sapiens
gctgcagtcagcacagaga

SEQ ID NO: 4295710 - DNA, 12 bp, Homo sapiens
gctgcatcctca

SEQ ID NO: 4295711 - DNA, 14 bp, Homo sapiens
gctgcatcctcagc

SEQ ID NO: 4295712 - DNA, 22 bp, Homo sapiens
gctgccacacttcaggctcttc

SEQ ID NO: 4295713 - DNA, 16 bp, Homo sapiens
gctgccaggctcccac

SEQ ID NO: 4295714 - DNA, 18 bp, Homo sapiens
gctgccaggctcccactg

SEQ ID NO: 4295715 - DNA, 20 bp, Homo sapiens
gctgcccaccccctgctggt

SEQ ID NO: 4295716 - DNA, 20 bp, Homo sapiens
gctgccccacccctccatga

SEQ ID NO: 4295717 - DNA, 15 bp, Homo sapiens
gctgccctccatccc

SEQ ID NO: 4295718 - DNA, 19 bp, Homo sapiens
gctgccctccatcccgaca

SEQ ID NO: 4295719 - DNA, 12 bp, Homo sapiens
gctgccctgcaa

SEQ ID NO: 4295720 - DNA, 15 bp, Homo sapiens
gctgccctggtgctg

SEQ ID NO: 4295721 - DNA, 18 bp, Homo sapiens
gctgccctggtgctgcca

SEQ ID NO: 4295722 - DNA, 22 bp, Homo sapiens
gctgccctggtgctgccacact

SEQ ID NO: 4295723 - DNA, 23 bp, Homo sapiens
gctgccctggtgctgccacactt

SEQ ID NO: 4295724 - DNA, 14 bp, Homo sapiens
gctgcctaaatcca

SEQ ID NO: 4295725 - DNA, 17 bp, Homo sapiens
gctgcctccccaaccct

SEQ ID NO: 4295726 - DNA, 19 bp, Homo sapiens
gctgcctccccaaccctgc

SEQ ID NO: 4295727 - DNA, 14 bp, Homo sapiens
gctgcctctgaaaa

SEQ ID NO: 4295728 - DNA, 17 bp, Homo sapiens
gctgcctgccccatccc

SEQ ID NO: 4295729 - DNA, 15 bp, Homo sapiens
gctgcctgcctccgg

SEQ ID NO: 4295730 - DNA, 19 bp, Homo sapiens
gctgcctgcctccggccct

SEQ ID NO: 4295731 - DNA, 23 bp, Homo sapiens
gctgcctgcctccggccctgccc

SEQ ID NO: 4295732 - DNA, 20 bp, Homo sapiens
gctgccttagaacctttctt

SEQ ID NO: 4295733 - DNA, 16 bp, Homo sapiens
gctgccttctgcggag

SEQ ID NO: 4295734 - DNA, 16 bp, Homo sapiens
gctgccttctgtctct

SEQ ID NO: 4295735 - DNA, 14 bp, Homo sapiens
gctgccttgccatg

SEQ ID NO: 4295736 - DNA, 13 bp, Homo sapiens
gctgcgctgccct

SEQ ID NO: 4295737 - DNA, 13 bp, Homo sapiens
gctgctcctcgca

SEQ ID NO: 4295738 - DNA, 19 bp, Homo sapiens
gctgctcctcggccagagc

SEQ ID NO: 4295739 - DNA, 21 bp, Homo sapiens
gctgctcctcggccagagctc

SEQ ID NO: 4295740 - DNA, 22 bp, Homo sapiens
gctgctgcagtcagcacagaga

SEQ ID NO: 4295741 - DNA, 12 bp, Homo sapiens
gctgctgtgaat

SEQ ID NO: 4295742 - DNA, 14 bp, Homo sapiens
gctgcttccagttg

SEQ ID NO: 4295743 - DNA, 21 bp, Homo sapiens
gctgcttccctctgcctgtcc

SEQ ID NO: 4295744 - DNA, 22 bp, Homo sapiens
gctgcttccctctgcctgtccc

SEQ ID NO: 4295745 - DNA, 23 bp, Homo sapiens
gctgcttccctctgcctgtccct

SEQ ID NO: 4295746 - DNA, 13 bp, Homo sapiens
gctgcttctgccc

SEQ ID NO: 4295747 - DNA, 21 bp, Homo sapiens
gctggagcatgagccagctct

SEQ ID NO: 4295748 - DNA, 12 bp, Homo sapiens
gctggagctggc

SEQ ID NO: 4295749 - DNA, 16 bp, Homo sapiens
gctggagtcctgttct

SEQ ID NO: 4295750 - DNA, 22 bp, Homo sapiens
gctggagtcctgttctcagagc

SEQ ID NO: 4295751 - DNA, 22 bp, Homo sapiens
gctggatgctgggttctggggc

SEQ ID NO: 4295752 - DNA, 16 bp, Homo sapiens
gctggattggcaggtg

SEQ ID NO: 4295753 - DNA, 23 bp, Homo sapiens
gctggcaggagacactggtctca

SEQ ID NO: 4295754 - DNA, 21 bp, Homo sapiens
gctggcatggggaggggagag

SEQ ID NO: 4295755 - DNA, 12 bp, Homo sapiens
gctggccagctg

SEQ ID NO: 4295756 - DNA, 14 bp, Homo sapiens
gctggcccctcacc

SEQ ID NO: 4295757 - DNA, 20 bp, Homo sapiens
gctggcccctcacctgggca

SEQ ID NO: 4295758 - DNA, 14 bp, Homo sapiens
gctggcctcttcct

SEQ ID NO: 4295759 - DNA, 14 bp, Homo sapiens
gctggctctgcagc

SEQ ID NO: 4295760 - DNA, 18 bp, Homo sapiens
gctggctgccttctgcgg

SEQ ID NO: 4295761 - DNA, 14 bp, Homo sapiens
gctgggagagccaa

SEQ ID NO: 4295762 - DNA, 16 bp, Homo sapiens
gctgggagcctcgccc

SEQ ID NO: 4295763 - DNA, 21 bp, Homo sapiens
gctgggagcctcgcccctcca

SEQ ID NO: 4295764 - DNA, 19 bp, Homo sapiens
gctgggcagaggggagagg

SEQ ID NO: 4295765 - DNA, 20 bp, Homo sapiens
gctgggcagaggggagagga

SEQ ID NO: 4295766 - DNA, 16 bp, Homo sapiens
gctggggagggagaga

SEQ ID NO: 4295767 - DNA, 20 bp, Homo sapiens
gctgggtggccggccctgcc

SEQ ID NO: 4295768 - DNA, 22 bp, Homo sapiens
gctgggtggccggccctgcccc

SEQ ID NO: 4295769 - DNA, 18 bp, Homo sapiens
gctgggttctggggctga

SEQ ID NO: 4295770 - DNA, 19 bp, Homo sapiens
gctgggttctggggctgag

SEQ ID NO: 4295771 - DNA, 21 bp, Homo sapiens
gctgggtttgggcagtggaga

SEQ ID NO: 4295772 - DNA, 18 bp, Homo sapiens
gctggtctctaggcctga

SEQ ID NO: 4295773 - DNA, 12 bp, Homo sapiens
gctggtgcccac

SEQ ID NO: 4295774 - DNA, 21 bp, Homo sapiens
gctggtggacagacccagggt

SEQ ID NO: 4295775 - DNA, 20 bp, Homo sapiens
gctggtttggtggccaggct

SEQ ID NO: 4295776 - DNA, 22 bp, Homo sapiens
gctggtttggtggccaggctgg

SEQ ID NO: 4295777 - DNA, 17 bp, Homo sapiens
gctgtaagacggccttg

SEQ ID NO: 4295778 - DNA, 18 bp, Homo sapiens
gctgtacaaagggaagca

SEQ ID NO: 4295779 - DNA, 20 bp, Homo sapiens
gctgtacaaagggaagcaga

SEQ ID NO: 4295780 - DNA, 12 bp, Homo sapiens
gctgtacactgc

SEQ ID NO: 4295781 - DNA, 18 bp, Homo sapiens
gctgtatacaaacaggtg

SEQ ID NO: 4295782 - DNA, 16 bp, Homo sapiens
gctgtattttctttta

SEQ ID NO: 4295783 - DNA, 21 bp, Homo sapiens
gctgtattttcttttatatct

SEQ ID NO: 4295784 - DNA, 23 bp, Homo sapiens
gctgtattttcttttatatctgt

SEQ ID NO: 4295785 - DNA, 13 bp, Homo sapiens
gctgtcccctgca

SEQ ID NO: 4295786 - DNA, 19 bp, Homo sapiens
gctgtccttagactccttc

SEQ ID NO: 4295787 - DNA, 13 bp, Homo sapiens
gctgtctccagac

SEQ ID NO: 4295788 - DNA, 15 bp, Homo sapiens
gctgtctgtggcttc

SEQ ID NO: 4295789 - DNA, 18 bp, Homo sapiens
gctgtgccagctgcttct

SEQ ID NO: 4295790 - DNA, 20 bp, Homo sapiens
gctgtgccagctgcttctgc

SEQ ID NO: 4295791 - DNA, 23 bp, Homo sapiens
gctgtgccagctgcttctgccca

SEQ ID NO: 4295792 - DNA, 19 bp, Homo sapiens
gctgtggattttgtggctt

SEQ ID NO: 4295793 - DNA, 21 bp, Homo sapiens
gctgtggattttgtggcttca

SEQ ID NO: 4295794 - DNA, 19 bp, Homo sapiens
gctgtggcatcaggaaagg

SEQ ID NO: 4295795 - DNA, 21 bp, Homo sapiens
gctgtggcccctccttctccc

SEQ ID NO: 4295796 - DNA, 22 bp, Homo sapiens
gctgtggcccctccttctcccc

SEQ ID NO: 4295797 - DNA, 16 bp, Homo sapiens
gctgtggggagctggt

SEQ ID NO: 4295798 - DNA, 15 bp, Homo sapiens
gctgtgggtcagtgt

SEQ ID NO: 4295799 - DNA, 19 bp, Homo sapiens
gctgtgtggggagggtggg

SEQ ID NO: 4295800 - DNA, 19 bp, Homo sapiens
gctgttctctgcttttcca

SEQ ID NO: 4295801 - DNA, 13 bp, Homo sapiens
gctgttgttcaga

SEQ ID NO: 4295802 - DNA, 21 bp, Homo sapiens
gctgttgttcagaagttgtta

SEQ ID NO: 4295803 - DNA, 19 bp, Homo sapiens
gcttaaaaaagaaagattt

SEQ ID NO: 4295804 - DNA, 23 bp, Homo sapiens
gcttaacattaagtattccttgg

SEQ ID NO: 4295805 - DNA, 16 bp, Homo sapiens
gcttagaatggggctt

SEQ ID NO: 4295806 - DNA, 17 bp, Homo sapiens
gcttagcgttctgtttc

SEQ ID NO: 4295807 - DNA, 13 bp, Homo sapiens
gcttagctgaaac

SEQ ID NO: 4295808 - DNA, 17 bp, Homo sapiens
gcttagctgaaacctaa

SEQ ID NO: 4295809 - DNA, 22 bp, Homo sapiens
gcttagtaatagatcacggcat

SEQ ID NO: 4295810 - DNA, 14 bp, Homo sapiens
gcttagtatctcat

SEQ ID NO: 4295811 - DNA, 22 bp, Homo sapiens
gcttagtatctcatcaacaaag

SEQ ID NO: 4295812 - DNA, 17 bp, Homo sapiens
gcttatgagatactttg

SEQ ID NO: 4295813 - DNA, 22 bp, Homo sapiens
gcttatttatattcagagatgt

SEQ ID NO: 4295814 - DNA, 13 bp, Homo sapiens
gcttcagcccctg

SEQ ID NO: 4295815 - DNA, 22 bp, Homo sapiens
gccactgcagtcacccctgtct

SEQ ID NO: 4295816 - DNA, 17 bp, Homo sapiens
gccactttgcagacctg

SEQ ID NO: 4295817 - DNA, 16 bp, Homo sapiens
gccagagctcccagga

SEQ ID NO: 4295818 - DNA, 16 bp, Homo sapiens
gccagaggaagggagg

SEQ ID NO: 4295819 - DNA, 18 bp, Homo sapiens
gccagaggaagggaggcc

SEQ ID NO: 4295820 - DNA, 21 bp, Homo sapiens
gccagaggaagggaggcctga

SEQ ID NO: 4295821 - DNA, 11 bp, Homo sapiens
gccagaggcct

SEQ ID NO: 4295822 - DNA, 14 bp, Homo sapiens
gccagaggcctggt

SEQ ID NO: 4295823 - DNA, 23 bp, Homo sapiens
gccagaggcctggtgccctggcc

SEQ ID NO: 4295824 - DNA, 15 bp, Homo sapiens
gccagagggcccctc

SEQ ID NO: 4295825 - DNA, 15 bp, Homo sapiens
gccagattaggcctg

SEQ ID NO: 4295826 - DNA, 13 bp, Homo sapiens
gccagcagggcgg

SEQ ID NO: 4295827 - DNA, 20 bp, Homo sapiens
gccagcagggcgggccagga

SEQ ID NO: 4295828 - DNA, 22 bp, Homo sapiens
gccagcagggcgggccaggaga

SEQ ID NO: 4295829 - DNA, 23 bp, Homo sapiens
gccagcagggcgggccaggagaa

SEQ ID NO: 4295830 - DNA, 22 bp, Homo sapiens
gccagcaggttctctcctgtga

SEQ ID NO: 4295831 - DNA, 13 bp, Homo sapiens
gccagctcccagc

SEQ ID NO: 4295832 - DNA, 20 bp, Homo sapiens
gccagctgcaggaatcaaaa

SEQ ID NO: 4295833 - DNA, 16 bp, Homo sapiens
gccagctgcttctgcc

SEQ ID NO: 4295834 - DNA, 17 bp, Homo sapiens
gccagctgcttctgccc

SEQ ID NO: 4295835 - DNA, 18 bp, Homo sapiens
gccagctgcttctgccca

SEQ ID NO: 4295836 - DNA, 17 bp, Homo sapiens
gccaggatggcgtgtcc

SEQ ID NO: 4295837 - DNA, 22 bp, Homo sapiens
gccaggatggcgtgtcccctgc

SEQ ID NO: 4295838 - DNA, 18 bp, Homo sapiens
gccaggcctcagggacca

SEQ ID NO: 4295839 - DNA, 14 bp, Homo sapiens
gccaggcctcccgc

SEQ ID NO: 4295840 - DNA, 11 bp, Homo sapiens
gccaggctggt

SEQ ID NO: 4295841 - DNA, 23 bp, Homo sapiens
gccagggctccacgggggcctag

SEQ ID NO: 4295842 - DNA, 13 bp, Homo sapiens
gccagggctgtcc

SEQ ID NO: 4295843 - DNA, 14 bp, Homo sapiens
gccagggttccaga

SEQ ID NO: 4295844 - DNA, 16 bp, Homo sapiens
gccagggttccagaca

SEQ ID NO: 4295845 - DNA, 13 bp, Homo sapiens
gccaggtgtcctg

SEQ ID NO: 4295846 - DNA, 16 bp, Homo sapiens
gccagtgactccagga

SEQ ID NO: 4295847 - DNA, 17 bp, Homo sapiens
gccagtgactccaggag

SEQ ID NO: 4295848 - DNA, 15 bp, Homo sapiens
gccagtgactgctgc

SEQ ID NO: 4295849 - DNA, 17 bp, Homo sapiens
gccagtgactgctgcgc

SEQ ID NO: 4295850 - DNA, 14 bp, Homo sapiens
gccatcagcccctg

SEQ ID NO: 4295851 - DNA, 20 bp, Homo sapiens
gccatcagcccctgctgctc

SEQ ID NO: 4295852 - DNA, 17 bp, Homo sapiens
gccatgactagggtcct

SEQ ID NO: 4295853 - DNA, 24 bp, Homo sapiens
gccatgactagggtcctcaggcag

SEQ ID NO: 4295854 - DNA, 23 bp, Homo sapiens
gccatgagctccagacccccagc

SEQ ID NO: 4295855 - DNA, 19 bp, Homo sapiens
gccatgaggcctcagtgga

SEQ ID NO: 4295856 - DNA, 15 bp, Homo sapiens
gccatgatgtggagt

SEQ ID NO: 4295857 - DNA, 15 bp, Homo sapiens
gccatgattttggcc

SEQ ID NO: 4295858 - DNA, 17 bp, Homo sapiens
gccatgattttggccac

SEQ ID NO: 4295859 - DNA, 21 bp, Homo sapiens
gccatgattttggccactttg

SEQ ID NO: 4295860 - DNA, 22 bp, Homo sapiens
gccatggactctacactgtgaa

SEQ ID NO: 4295861 - DNA, 17 bp, Homo sapiens
gccatggtgttggaggg

SEQ ID NO: 4295862 - DNA, 18 bp, Homo sapiens
gccatggtgttggagggg

SEQ ID NO: 4295863 - DNA, 15 bp, Homo sapiens
gccatgtcttgttca

SEQ ID NO: 4295864 - DNA, 16 bp, Homo sapiens
gccattccgaccttca

SEQ ID NO: 4295865 - DNA, 11 bp, Homo sapiens
gccatttcatg

SEQ ID NO: 4295866 - DNA, 21 bp, Homo sapiens
gcccaaaccagggggaagcac

SEQ ID NO: 4295867 - DNA, 17 bp, Homo sapiens
gcccaaagccagacagc

SEQ ID NO: 4295868 - DNA, 22 bp, Homo sapiens
gcccaagaatagatgctgactg

SEQ ID NO: 4295869 - DNA, 12 bp, Homo sapiens
gcccacacctgc

SEQ ID NO: 4295870 - DNA, 20 bp, Homo sapiens
gcccacatagtgatggttcc

SEQ ID NO: 4295871 - DNA, 21 bp, Homo sapiens
gcccacattgcccacacctgc

SEQ ID NO: 4295872 - DNA, 18 bp, Homo sapiens
gcccaccagagcctccct

SEQ ID NO: 4295873 - DNA, 20 bp, Homo sapiens
gcccaccagagcctccctca

SEQ ID NO: 4295874 - DNA, 19 bp, Homo sapiens
gcccaccagctggctctgc

SEQ ID NO: 4295875 - DNA, 24 bp, Homo sapiens
gcccaccagctggctctgcagcac

SEQ ID NO: 4295876 - DNA, 14 bp, Homo sapiens
gcccacccccctca

SEQ ID NO: 4295877 - DNA, 19 bp, Homo sapiens
gcccaccccctgctggtgc

SEQ ID NO: 4295878 - DNA, 21 bp, Homo sapiens
gcccacccctcttcccccttc

SEQ ID NO: 4295879 - DNA, 23 bp, Homo sapiens
gcccacccctcttcccccttccc

SEQ ID NO: 4295880 - DNA, 17 bp, Homo sapiens
gcccacctgggccctag

SEQ ID NO: 4295881 - DNA, 18 bp, Homo sapiens
gcccacctgggccctagg

SEQ ID NO: 4295882 - DNA, 22 bp, Homo sapiens
gcccacctgggccctaggcata

SEQ ID NO: 4295883 - DNA, 14 bp, Homo sapiens
gcccacgctcctgc

SEQ ID NO: 4295884 - DNA, 19 bp, Homo sapiens
gcccagagagaccctgcca

SEQ ID NO: 4295885 - DNA, 23 bp, Homo sapiens
gcccagatggctccctgggctgg

SEQ ID NO: 4295886 - DNA, 17 bp, Homo sapiens
gcccagcagcggcccag

SEQ ID NO: 4295887 - DNA, 18 bp, Homo sapiens
gcccagcagcggcccaga

SEQ ID NO: 4295888 - DNA, 20 bp, Homo sapiens
gcccagcagcggcccagatt

SEQ ID NO: 4295889 - DNA, 12 bp, Homo sapiens
gcccagccagca

SEQ ID NO: 4295890 - DNA, 19 bp, Homo sapiens
gcccagcctgtggcctcag

SEQ ID NO: 4295891 - DNA, 16 bp, Homo sapiens
gcccaggacactgcct

SEQ ID NO: 4295892 - DNA, 20 bp, Homo sapiens
gcccaggagagcccccacca

SEQ ID NO: 4295893 - DNA, 19 bp, Homo sapiens
gcccaggctggagtgcagt

SEQ ID NO: 4295894 - DNA, 18 bp, Homo sapiens
gcccagggaatcagggag

SEQ ID NO: 4295895 - DNA, 19 bp, Homo sapiens
gcccagggaatcagggagc

SEQ ID NO: 4295896 - DNA, 19 bp, Homo sapiens
gcccagggagaggccatga

SEQ ID NO: 4295897 - DNA, 16 bp, Homo sapiens
gcccagggttccccca

SEQ ID NO: 4295898 - DNA, 20 bp, Homo sapiens
gcccagggttcccccagccc

SEQ ID NO: 4295899 - DNA, 17 bp, Homo sapiens
gcccaggtctcctgggc

SEQ ID NO: 4295900 - DNA, 14 bp, Homo sapiens
gcccagtcttgagt

SEQ ID NO: 4295901 - DNA, 21 bp, Homo sapiens
gcccatgccctccgtcctggc

SEQ ID NO: 4295902 - DNA, 15 bp, Homo sapiens
gccccaaaaccacag

SEQ ID NO: 4295903 - DNA, 16 bp, Homo sapiens
gccccaaaaccacagc

SEQ ID NO: 4295904 - DNA, 19 bp, Homo sapiens
gccccaaaaccacagccct

SEQ ID NO: 4295905 - DNA, 19 bp, Homo sapiens
gccccaaggtttacatagt

SEQ ID NO: 4295906 - DNA, 14 bp, Homo sapiens
gccccacacaggcc

SEQ ID NO: 4295907 - DNA, 15 bp, Homo sapiens
gccccacacaggcct

SEQ ID NO: 4295908 - DNA, 16 bp, Homo sapiens
gccccacacaggcctg

SEQ ID NO: 4295909 - DNA, 18 bp, Homo sapiens
gccccacacaggcctggc

SEQ ID NO: 4295910 - DNA, 19 bp, Homo sapiens
gccccacccaccctctggt

SEQ ID NO: 4295911 - DNA, 18 bp, Homo sapiens
gccccactctgctgaggc

SEQ ID NO: 4295912 - DNA, 20 bp, Homo sapiens
gccccactctgctgaggcca

SEQ ID NO: 4295913 - DNA, 20 bp, Homo sapiens
gccccagaaatgccgctgtg

SEQ ID NO: 4295914 - DNA, 23 bp, Homo sapiens
gccccagagaagcctcagtccct

SEQ ID NO: 4295915 - DNA, 17 bp, Homo sapiens
gccccagagactcagag

SEQ ID NO: 4295916 - DNA, 15 bp, Homo sapiens
gccccaggcaggctg

SEQ ID NO: 4295917 - DNA, 16 bp, Homo sapiens
gccccaggctggatgc

SEQ ID NO: 4295918 - DNA, 20 bp, Homo sapiens
gccccagggccctgctcagg

SEQ ID NO: 4295919 - DNA, 21 bp, Homo sapiens
gccccagggccctgctcaggc

SEQ ID NO: 4295920 - DNA, 15 bp, Homo sapiens
gcccccaaaagtgtc

SEQ ID NO: 4295921 - DNA, 14 bp, Homo sapiens
gcccccaccagcag

SEQ ID NO: 4295922 - DNA, 23 bp, Homo sapiens
gcccccaccagcagcacaattct

SEQ ID NO: 4295923 - DNA, 15 bp, Homo sapiens
gcccccactcagcat

SEQ ID NO: 4295924 - DNA, 18 bp, Homo sapiens
gcccccagagcgcccctc

SEQ ID NO: 4295925 - DNA, 21 bp, Homo sapiens
gccccccacattctggctcca

SEQ ID NO: 4295926 - DNA, 19 bp, Homo sapiens
gccccccagagccagggct

SEQ ID NO: 4295927 - DNA, 12 bp, Homo sapiens
gccccccagtgt

SEQ ID NO: 4295928 - DNA, 22 bp, Homo sapiens
gccccccagtgtccccaggggc

SEQ ID NO: 4295929 - DNA, 17 bp, Homo sapiens
gccccccggcctgatgg

SEQ ID NO: 4295930 - DNA, 13 bp, Homo sapiens
gccccccttccca

SEQ ID NO: 4295931 - DNA, 14 bp, Homo sapiens
gccccccttcccac

SEQ ID NO: 4295932 - DNA, 14 bp, Homo sapiens
gcccccgagctggg

SEQ ID NO: 4295933 - DNA, 22 bp, Homo sapiens
gcccccgagctgggggccatga

SEQ ID NO: 4295934 - DNA, 22 bp, Homo sapiens
gcccccgcacgcaagcctcagc

SEQ ID NO: 4295935 - DNA, 13 bp, Homo sapiens
gcccccgccccgc

SEQ ID NO: 4295936 - DNA, 14 bp, Homo sapiens
gcccccgccctctg

SEQ ID NO: 4295937 - DNA, 13 bp, Homo sapiens
gccccctcctgac

SEQ ID NO: 4295938 - DNA, 21 bp, Homo sapiens
gccccctctcttaccccgtcc

SEQ ID NO: 4295939 - DNA, 16 bp, Homo sapiens
gccccctggcccctcc

SEQ ID NO: 4295940 - DNA, 15 bp, Homo sapiens
gccccctgggagagt

SEQ ID NO: 4295941 - DNA, 21 bp, Homo sapiens
gccccctggggggcacagcca

SEQ ID NO: 4295942 - DNA, 14 bp, Homo sapiens
gccccctgtccttc

SEQ ID NO: 4295943 - DNA, 21 bp, Homo sapiens
gccccctgtccttcccacggc

SEQ ID NO: 4295944 - DNA, 18 bp, Homo sapiens
gcccccttctcccacact

SEQ ID NO: 4295945 - DNA, 22 bp, Homo sapiens
gcccccttctcccacactgcta

SEQ ID NO: 4295946 - DNA, 14 bp, Homo sapiens
gccccgccccacat

SEQ ID NO: 4295947 - DNA, 15 bp, Homo sapiens
gccccgccccacatt

SEQ ID NO: 4295948 - DNA, 23 bp, Homo sapiens
gccccgccccccagagccagggc

SEQ ID NO: 4295949 - DNA, 14 bp, Homo sapiens
gccccggccactct

SEQ ID NO: 4295950 - DNA, 16 bp, Homo sapiens
gccccggccactctgt

SEQ ID NO: 4295951 - DNA, 20 bp, Homo sapiens
gccccggccactctgtttgc

SEQ ID NO: 4295952 - DNA, 23 bp, Homo sapiens
gccccggccactctgtttgctca

SEQ ID NO: 4295953 - DNA, 18 bp, Homo sapiens
gccccgtcaccatctcag

SEQ ID NO: 4295954 - DNA, 22 bp, Homo sapiens
gccccgtcaccatctcaggcca

SEQ ID NO: 4295955 - DNA, 23 bp, Homo sapiens
gccccgtcaccatctcaggccac

SEQ ID NO: 4295956 - DNA, 14 bp, Homo sapiens
gcccctatcctgca

SEQ ID NO: 4295957 - DNA, 17 bp, Homo sapiens
gcccctatcctgcaccc

SEQ ID NO: 4295958 - DNA, 16 bp, Homo sapiens
gcccctcactggctgg

SEQ ID NO: 4295959 - DNA, 23 bp, Homo sapiens
gcccctccagtgttgcctcctcc

SEQ ID NO: 4295960 - DNA, 18 bp, Homo sapiens
gcccctcccacatccccc

SEQ ID NO: 4295961 - DNA, 12 bp, Homo sapiens
gcccctcccacc

SEQ ID NO: 4295962 - DNA, 14 bp, Homo sapiens
gcccctcccaccac

SEQ ID NO: 4295963 - DNA, 16 bp, Homo sapiens
gcccctcccaccacag

SEQ ID NO: 4295964 - DNA, 17 bp, Homo sapiens
gcccctccccatggtgc

SEQ ID NO: 4295965 - DNA, 14 bp, Homo sapiens
gcccctcccttcaa

SEQ ID NO: 4295966 - DNA, 15 bp, Homo sapiens
gcccctccttctccc

SEQ ID NO: 4295967 - DNA, 18 bp, Homo sapiens
gcccctccttctcccctc

SEQ ID NO: 4295968 - DNA, 23 bp, Homo sapiens
gcccctctctgtttaccctccct

SEQ ID NO: 4295969 - DNA, 13 bp, Homo sapiens
gcccctcttgccc

SEQ ID NO: 4295970 - DNA, 16 bp, Homo sapiens
gcccctcttgcccccc

SEQ ID NO: 4295971 - DNA, 19 bp, Homo sapiens
gcccctcttgccccccacc

SEQ ID NO: 4295972 - DNA, 23 bp, Homo sapiens
gcccctgaagtgaccccagctcc

SEQ ID NO: 4295973 - DNA, 15 bp, Homo sapiens
gcccctgctgcctcc

SEQ ID NO: 4295974 - DNA, 21 bp, Homo sapiens
gcccctgctgctcctcggcca

SEQ ID NO: 4295975 - DNA, 21 bp, Homo sapiens
gccccttcacttctgaccaca

SEQ ID NO: 4295976 - DNA, 14 bp, Homo sapiens
gccccttgctgctg

SEQ ID NO: 4295977 - DNA, 19 bp, Homo sapiens
gccccttgctgctggctcc

SEQ ID NO: 4295978 - DNA, 18 bp, Homo sapiens
gcccctttttactcccct

SEQ ID NO: 4295979 - DNA, 17 bp, Homo sapiens
gcccgacagcctggcac

SEQ ID NO: 4295980 - DNA, 16 bp, Homo sapiens
gcccgactctctccat

SEQ ID NO: 4295981 - DNA, 16 bp, Homo sapiens
gcccgcacccccaccc

SEQ ID NO: 4295982 - DNA, 17 bp, Homo sapiens
gcccgcacccccaccct

SEQ ID NO: 4295983 - DNA, 21 bp, Homo sapiens
gcccgcacccccaccctttgg

SEQ ID NO: 4295984 - DNA, 14 bp, Homo sapiens
gcccgcccacctgg

SEQ ID NO: 4295985 - DNA, 15 bp, Homo sapiens
gcccgcccacctggg

SEQ ID NO: 4295986 - DNA, 21 bp, Homo sapiens
gcccgcccacctgggccctag

SEQ ID NO: 4295987 - DNA, 13 bp, Homo sapiens
gcccgcctggcag

SEQ ID NO: 4295988 - DNA, 13 bp, Homo sapiens
gcccgctgcgctg

SEQ ID NO: 4295989 - DNA, 14 bp, Homo sapiens
gcccgctgcgctgc

SEQ ID NO: 4295990 - DNA, 15 bp, Homo sapiens
gcccgctgcgctgcc

SEQ ID NO: 4295991 - DNA, 17 bp, Homo sapiens
gcccgctgcgctgccct

SEQ ID NO: 4295992 - DNA, 16 bp, Homo sapiens
gcccggctgggcccga

SEQ ID NO: 4295993 - DNA, 17 bp, Homo sapiens
gcccgggagatccgccc

SEQ ID NO: 4295994 - DNA, 13 bp, Homo sapiens
gcccgggcagggg

SEQ ID NO: 4295995 - DNA, 18 bp, Homo sapiens
gcccggggcagctgccag

SEQ ID NO: 4295996 - DNA, 13 bp, Homo sapiens
gcccgtgtggccc

SEQ ID NO: 4295997 - DNA, 19 bp, Homo sapiens
gccctagcagtttgcctct

SEQ ID NO: 4295998 - DNA, 16 bp, Homo sapiens
gccctaggaacctcga

SEQ ID NO: 4295999 - DNA, 22 bp, Homo sapiens
gccctaggaggagaacttgaac

SEQ ID NO: 4296000 - DNA, 19 bp, Homo sapiens
gccctaggcatactctcca

SEQ ID NO: 4296001 - DNA, 20 bp, Homo sapiens
gccctaggcatactctccag

SEQ ID NO: 4296002 - DNA, 22 bp, Homo sapiens
gccctaggcatactctccagga

SEQ ID NO: 4296003 - DNA, 14 bp, Homo sapiens
gccctcactccact

SEQ ID NO: 4296004 - DNA, 16 bp, Homo sapiens
gccctcactccactcc

SEQ ID NO: 4296005 - DNA, 19 bp, Homo sapiens
gccctcactccactcccct

SEQ ID NO: 4296006 - DNA, 20 bp, Homo sapiens
gccctcactccactcccctc

SEQ ID NO: 4296007 - DNA, 22 bp, Homo sapiens
gccctccatcccgacatggacc

SEQ ID NO: 4296008 - DNA, 17 bp, Homo sapiens
gccctccccctgccaga

SEQ ID NO: 4296009 - DNA, 11 bp, Homo sapiens
gccctccctcc

SEQ ID NO: 4296010 - DNA, 14 bp, Homo sapiens
gccctccctccctc

SEQ ID NO: 4296011 - DNA, 16 bp, Homo sapiens
gccctccctccctcca

SEQ ID NO: 4296012 - DNA, 19 bp, Homo sapiens
gccctccctccctccacac

SEQ ID NO: 4296013 - DNA, 13 bp, Homo sapiens
gccctccctgctg

SEQ ID NO: 4296014 - DNA, 14 bp, Homo sapiens
gccctccgcccttc

SEQ ID NO: 4296015 - DNA, 15 bp, Homo sapiens
gccctccgtcctggc

SEQ ID NO: 4296016 - DNA, 19 bp, Homo sapiens
gccctccgtcctggcaggg

SEQ ID NO: 4296017 - DNA, 11 bp, Homo sapiens
gccctctctta

SEQ ID NO: 4296018 - DNA, 10 bp, Homo sapiens
gccctctgcc

SEQ ID NO: 4296019 - DNA, 23 bp, Homo sapiens
gccctctgcccccagctgctcct

SEQ ID NO: 4296020 - DNA, 18 bp, Homo sapiens
gccctgaggggcctgcca

SEQ ID NO: 4296021 - DNA, 13 bp, Homo sapiens
gccctgccccaca

SEQ ID NO: 4296022 - DNA, 15 bp, Homo sapiens
gccctgccccacaca

SEQ ID NO: 4296023 - DNA, 20 bp, Homo sapiens
gccctgccccccacattctg

SEQ ID NO: 4296024 - DNA, 21 bp, Homo sapiens
gccctgccccccacattctgg

SEQ ID NO: 4296025 - DNA, 14 bp, Homo sapiens
gccctgccctcact

SEQ ID NO: 4296026 - DNA, 15 bp, Homo sapiens
gccctgccctcactc

SEQ ID NO: 4296027 - DNA, 15 bp, Homo sapiens
gccctgcccttcagc

SEQ ID NO: 4296028 - DNA, 14 bp, Homo sapiens
gccctgctcaggcc

SEQ ID NO: 4296029 - DNA, 15 bp, Homo sapiens
gccctgctcaggcct

SEQ ID NO: 4296030 - DNA, 22 bp, Homo sapiens
gccctgctcaggcctcacctgg

SEQ ID NO: 4296031 - DNA, 11 bp, Homo sapiens
gccctgctgcc

SEQ ID NO: 4296032 - DNA, 12 bp, Homo sapiens
gccctgctgccc

SEQ ID NO: 4296033 - DNA, 13 bp, Homo sapiens
gccctgctgcccc

SEQ ID NO: 4296034 - DNA, 19 bp, Homo sapiens
gccctgctgccccctaccc

SEQ ID NO: 4296035 - DNA, 21 bp, Homo sapiens
gccctgctttgggctgccctg

SEQ ID NO: 4296036 - DNA, 23 bp, Homo sapiens
gccctgctttgggctgccctggt

SEQ ID NO: 4296037 - DNA, 11 bp, Homo sapiens
gccctggctct

SEQ ID NO: 4296038 - DNA, 13 bp, Homo sapiens
gccctgggctctg

SEQ ID NO: 4296039 - DNA, 22 bp, Homo sapiens
gccctggggtttccacacaggc

SEQ ID NO: 4296040 - DNA, 23 bp, Homo sapiens
gccctggggtttccacacaggcc

SEQ ID NO: 4296041 - DNA, 15 bp, Homo sapiens
gccctggtctggctt

SEQ ID NO: 4296042 - DNA, 15 bp, Homo sapiens
gccctggtgctgcca

SEQ ID NO: 4296043 - DNA, 20 bp, Homo sapiens
gccctggtggccaagcctgc

SEQ ID NO: 4296044 - DNA, 23 bp, Homo sapiens
gccctggttcccccaggaccctg

SEQ ID NO: 4296045 - DNA, 15 bp, Homo sapiens
gccctgtcagtgcag

SEQ ID NO: 4296046 - DNA, 20 bp, Homo sapiens
gcccttaaaataatgattta

SEQ ID NO: 4296047 - DNA, 14 bp, Homo sapiens
gcccttcccaacct

SEQ ID NO: 4296048 - DNA, 14 bp, Homo sapiens
gcccttcctctcca

SEQ ID NO: 4296049 - DNA, 16 bp, Homo sapiens
gcccttcctctccact

SEQ ID NO: 4296050 - DNA, 18 bp, Homo sapiens
gcccttcctctccactgc

SEQ ID NO: 4296051 - DNA, 20 bp, Homo sapiens
gcccttcctctccactgcct

SEQ ID NO: 4296052 - DNA, 16 bp, Homo sapiens
gcccttcttccattcc

SEQ ID NO: 4296053 - DNA, 18 bp, Homo sapiens
gcccttcttccattccca

SEQ ID NO: 4296054 - DNA, 22 bp, Homo sapiens
gccctttcacccctcttcccac

SEQ ID NO: 4296055 - DNA, 22 bp, Homo sapiens
gccgaccgaggctggagctggc

SEQ ID NO: 4296056 - DNA, 23 bp, Homo sapiens
gccgacggacccctttcacctgg

SEQ ID NO: 4296057 - DNA, 12 bp, Homo sapiens
gccgagctctcc

SEQ ID NO: 4296058 - DNA, 16 bp, Homo sapiens
gccgagctctcctggg

SEQ ID NO: 4296059 - DNA, 19 bp, Homo sapiens
gccgagctctcctgggcca

SEQ ID NO: 4296060 - DNA, 20 bp, Homo sapiens
gccgaggcaggggctgggca

SEQ ID NO: 4296061 - DNA, 14 bp, Homo sapiens
gccgagtgccccag

SEQ ID NO: 4296062 - DNA, 21 bp, Homo sapiens
gccgcaaatccataccccctg

SEQ ID NO: 4296063 - DNA, 14 bp, Homo sapiens
gccgcctgtccttg

SEQ ID NO: 4296064 - DNA, 12 bp, Homo sapiens
gccgctgcaggg

SEQ ID NO: 4296065 - DNA, 21 bp, Homo sapiens
gccgctgggagaaaagccaga

SEQ ID NO: 4296066 - DNA, 21 bp, Homo sapiens
gccgctgggagagccaaggcc

SEQ ID NO: 4296067 - DNA, 11 bp, Homo sapiens
gccggccctgc

SEQ ID NO: 4296068 - DNA, 13 bp, Homo sapiens
gccggccctgccc

SEQ ID NO: 4296069 - DNA, 14 bp, Homo sapiens
gccggccctgcccc

SEQ ID NO: 4296070 - DNA, 18 bp, Homo sapiens
gccgggctggcttctccc

SEQ ID NO: 4296071 - DNA, 16 bp, Homo sapiens
gccggggagctgaggg

SEQ ID NO: 4296072 - DNA, 17 bp, Homo sapiens
gccggggagctgagggg

SEQ ID NO: 4296073 - DNA, 13 bp, Homo sapiens
gccgtcagcctgt

SEQ ID NO: 4296074 - DNA, 23 bp, Homo sapiens
gccgtgagagcccaatcactgcc

SEQ ID NO: 4296075 - DNA, 14 bp, Homo sapiens
gccgtgcagggcca

SEQ ID NO: 4296076 - DNA, 14 bp, Homo sapiens
gccgtgccttcagc

SEQ ID NO: 4296077 - DNA, 15 bp, Homo sapiens
gccgtgccttcagct

SEQ ID NO: 4296078 - DNA, 19 bp, Homo sapiens
gccgtggagtcgagctggc

SEQ ID NO: 4296079 - DNA, 13 bp, Homo sapiens
gccgtggcttccc

SEQ ID NO: 4296080 - DNA, 22 bp, Homo sapiens
gccgttagggaaatccaactcc

SEQ ID NO: 4296081 - DNA, 18 bp, Homo sapiens
gccgttgcctctctgcca

SEQ ID NO: 4296082 - DNA, 23 bp, Homo sapiens
gccgtttgaatatattttatctt

SEQ ID NO: 4296083 - DNA, 21 bp, Homo sapiens
gcctacccaccccttcccgcc

SEQ ID NO: 4296084 - DNA, 13 bp, Homo sapiens
gcctagaggagga

SEQ ID NO: 4296085 - DNA, 19 bp, Homo sapiens
gcctagaggaggaaaaagg

SEQ ID NO: 4296086 - DNA, 13 bp, Homo sapiens
gcctaggagctgg

SEQ ID NO: 4296087 - DNA, 17 bp, Homo sapiens
gcctaggggtcagggac

SEQ ID NO: 4296088 - DNA, 16 bp, Homo sapiens
gcctagggtgagggtg

SEQ ID NO: 4296089 - DNA, 21 bp, Homo sapiens
gcctagtggcttcagcccctg

SEQ ID NO: 4296090 - DNA, 14 bp, Homo sapiens
gcctcaaccctccc

SEQ ID NO: 4296091 - DNA, 17 bp, Homo sapiens
gcctcaaccctccctca

SEQ ID NO: 4296092 - DNA, 23 bp, Homo sapiens
gcctcaaccctccctcagcccct

SEQ ID NO: 4296093 - DNA, 18 bp, Homo sapiens
gcctcacccctgcaggcg

SEQ ID NO: 4296094 - DNA, 22 bp, Homo sapiens
gcctcaccttccctagttcttt

SEQ ID NO: 4296095 - DNA, 22 bp, Homo sapiens
gcctcactgatatattttccag

SEQ ID NO: 4296096 - DNA, 18 bp, Homo sapiens
gcctcagaggccccttgc

SEQ ID NO: 4296097 - DNA, 23 bp, Homo sapiens
gcctcagaggccccttgctgctg

SEQ ID NO: 4296098 - DNA, 16 bp, Homo sapiens
gcctcagcagaaggcc

SEQ ID NO: 4296099 - DNA, 22 bp, Homo sapiens
gcctcagcagaaggccttgcct

SEQ ID NO: 4296100 - DNA, 21 bp, Homo sapiens
gcctcagccactcccaggggc

SEQ ID NO: 4296101 - DNA, 22 bp, Homo sapiens
gcctcagccactcccaggggcc

SEQ ID NO: 4296102 - DNA, 23 bp, Homo sapiens
gcctcaggaggcagtggcttgga

SEQ ID NO: 4296103 - DNA, 16 bp, Homo sapiens
gcctcaggcctggccc

SEQ ID NO: 4296104 - DNA, 17 bp, Homo sapiens
gcctcaggcctggccct

SEQ ID NO: 4296105 - DNA, 21 bp, Homo sapiens
gcctcagggaccaaggagatg

SEQ ID NO: 4296106 - DNA, 12 bp, Homo sapiens
gcctcagtccct

SEQ ID NO: 4296107 - DNA, 16 bp, Homo sapiens
gcctcagtccctccct

SEQ ID NO: 4296108 - DNA, 14 bp, Homo sapiens
gcctcatgaacact

SEQ ID NO: 4296109 - DNA, 20 bp, Homo sapiens
gcctcatgaacactggctgc

SEQ ID NO: 4296110 - DNA, 13 bp, Homo sapiens
gcctccacctgca

SEQ ID NO: 4296111 - DNA, 20 bp, Homo sapiens
gcctccacctgcagccccag

SEQ ID NO: 4296112 - DNA, 17 bp, Homo sapiens
gcctccactccctgtct

SEQ ID NO: 4296113 - DNA, 14 bp, Homo sapiens
gcctccagccctct

SEQ ID NO: 4296114 - DNA, 22 bp, Homo sapiens
gcctcccgcatgctgcctgcct

SEQ ID NO: 4296115 - DNA, 15 bp, Homo sapiens
gcctccggccctgcc

SEQ ID NO: 4296116 - DNA, 23 bp, Homo sapiens
gcctccggccctgccccacacag

SEQ ID NO: 4296117 - DNA, 17 bp, Homo sapiens
gcctcctcccatccagc

SEQ ID NO: 4296118 - DNA, 21 bp, Homo sapiens
gcctcctcccatccagcgtct

SEQ ID NO: 4296119 - DNA, 15 bp, Homo sapiens
gcctcgcccctccag

SEQ ID NO: 4296120 - DNA, 19 bp, Homo sapiens
gcctcgcccctccagtgtt

SEQ ID NO: 4296121 - DNA, 18 bp, Homo sapiens
gcctctcactctggcagc

SEQ ID NO: 4296122 - DNA, 13 bp, Homo sapiens
gcctctctgccag

SEQ ID NO: 4296123 - DNA, 16 bp, Homo sapiens
gcctctctgccagccg

SEQ ID NO: 4296124 - DNA, 13 bp, Homo sapiens
gcctctgaaaata

SEQ ID NO: 4296125 - DNA, 21 bp, Homo sapiens
gcctctgaactgctgctggtc

SEQ ID NO: 4296126 - DNA, 22 bp, Homo sapiens
gcctctgcaagattctgtgggc

SEQ ID NO: 4296127 - DNA, 17 bp, Homo sapiens
gcctctgcacgtgcaca

SEQ ID NO: 4296128 - DNA, 19 bp, Homo sapiens
gcctctgcacgtgcacaca

SEQ ID NO: 4296129 - DNA, 16 bp, Homo sapiens
gcctctggcctgggaa

SEQ ID NO: 4296130 - DNA, 21 bp, Homo sapiens
gcctctgggctcacaccagcc

SEQ ID NO: 4296131 - DNA, 22 bp, Homo sapiens
gcctctgggctcacaccagccc

SEQ ID NO: 4296132 - DNA, 23 bp, Homo sapiens
gcctctgggctcacaccagccct

SEQ ID NO: 4296133 - DNA, 15 bp, Homo sapiens
gcctctggggagacc

SEQ ID NO: 4296134 - DNA, 17 bp, Homo sapiens
gcctctggtctgggtgc

SEQ ID NO: 4296135 - DNA, 21 bp, Homo sapiens
gcctcttcctccctccctgca

SEQ ID NO: 4296136 - DNA, 14 bp, Homo sapiens
gcctcttcgggaag

SEQ ID NO: 4296137 - DNA, 14 bp, Homo sapiens
gcctcttgggagac

SEQ ID NO: 4296138 - DNA, 21 bp, Homo sapiens
gcctgaaacagcctctccaag

SEQ ID NO: 4296139 - DNA, 18 bp, Homo sapiens
gcctgaaatgtttccagg

SEQ ID NO: 4296140 - DNA, 20 bp, Homo sapiens
gcctgaaatgtttccaggca

SEQ ID NO: 4296141 - DNA, 18 bp, Homo sapiens
gcctgaactaggtgctgg

SEQ ID NO: 4296142 - DNA, 23 bp, Homo sapiens
gcctgaactaggtgctggcatgt

SEQ ID NO: 4296143 - DNA, 22 bp, Homo sapiens
gcctgagaatgcctaggccagc

SEQ ID NO: 4296144 - DNA, 13 bp, Homo sapiens
gcctgaggggcag

SEQ ID NO: 4296145 - DNA, 13 bp, Homo sapiens
gcctgatggccag

SEQ ID NO: 4296146 - DNA, 14 bp, Homo sapiens
gcctgatggccagg

SEQ ID NO: 4296147 - DNA, 15 bp, Homo sapiens
gcctgatggtggggc

SEQ ID NO: 4296148 - DNA, 17 bp, Homo sapiens
gcctgccactctcctga

SEQ ID NO: 4296149 - DNA, 19 bp, Homo sapiens
gcctgccactctcctgagg

SEQ ID NO: 4296150 - DNA, 24 bp, Homo sapiens
gcctgccactctcctgaggagcag

SEQ ID NO: 4296151 - DNA, 10 bp, Homo sapiens
gcctgcccac

SEQ ID NO: 4296152 - DNA, 20 bp, Homo sapiens
gcctgccccatcccatccct

SEQ ID NO: 4296153 - DNA, 15 bp, Homo sapiens
gcctgccccccttcc

SEQ ID NO: 4296154 - DNA, 22 bp, Homo sapiens
gcctgccccccttcccacccct

SEQ ID NO: 4296155 - DNA, 15 bp, Homo sapiens
gcctgcctccggccc

SEQ ID NO: 4296156 - DNA, 20 bp, Homo sapiens
gcctgcctccggccctgccc

SEQ ID NO: 4296157 - DNA, 15 bp, Homo sapiens
gcctgcgtggcctgg

SEQ ID NO: 4296158 - DNA, 16 bp, Homo sapiens
gcctgcgtggcctggg

SEQ ID NO: 4296159 - DNA, 21 bp, Homo sapiens
gcctgcgtggcctggggctgc

SEQ ID NO: 4296160 - DNA, 15 bp, Homo sapiens
gcctgctatccagcc

SEQ ID NO: 4296161 - DNA, 16 bp, Homo sapiens
gcctgctatccagccg

SEQ ID NO: 4296162 - DNA, 13 bp, Homo sapiens
gcctgctgtgggt

SEQ ID NO: 4296163 - DNA, 20 bp, Homo sapiens
gcctggacacagtcagggcg

SEQ ID NO: 4296164 - DNA, 13 bp, Homo sapiens
gcctggcacaggg

SEQ ID NO: 4296165 - DNA, 22 bp, Homo sapiens
gcctggcagaactgagctcctc

SEQ ID NO: 4296166 - DNA, 20 bp, Homo sapiens
gcctggcagccgtgccttca

SEQ ID NO: 4296167 - DNA, 13 bp, Homo sapiens
gcctggcccagcc

SEQ ID NO: 4296168 - DNA, 18 bp, Homo sapiens
gcctggcccagccagcag

SEQ ID NO: 4296169 - DNA, 19 bp, Homo sapiens
gcctggcccagccagcagg

SEQ ID NO: 4296170 - DNA, 13 bp, Homo sapiens
gcctggcccagtg

SEQ ID NO: 4296171 - DNA, 21 bp, Homo sapiens
gcctggccctttcacccctct

SEQ ID NO: 4296172 - DNA, 22 bp, Homo sapiens
gcctggccctttcacccctctt

SEQ ID NO: 4296173 - DNA, 23 bp, Homo sapiens
gcctggccttgagccgtgacctc

SEQ ID NO: 4296174 - DNA, 14 bp, Homo sapiens
gcctggggctgccg

SEQ ID NO: 4296175 - DNA, 22 bp, Homo sapiens
gcctggtccatgatggagtcag

SEQ ID NO: 4296176 - DNA, 12 bp, Homo sapiens
gcctggtctgga

SEQ ID NO: 4296177 - DNA, 13 bp, Homo sapiens
gcctggtctggag

SEQ ID NO: 4296178 - DNA, 16 bp, Homo sapiens
gcctggtctggagccc

SEQ ID NO: 4296179 - DNA, 19 bp, Homo sapiens
gcctggtgccctggcccag

SEQ ID NO: 4296180 - DNA, 20 bp, Homo sapiens
gcctgtatttccaacaaact

SEQ ID NO: 4296181 - DNA, 20 bp, Homo sapiens
gcctgtccacctgtgctgct

SEQ ID NO: 4296182 - DNA, 18 bp, Homo sapiens
gcctgtccttggtggccg

SEQ ID NO: 4296183 - DNA, 17 bp, Homo sapiens
gcctgtgatcgtgtgtt

SEQ ID NO: 4296184 - DNA, 14 bp, Homo sapiens
gcctgtgcccgctg

SEQ ID NO: 4296185 - DNA, 17 bp, Homo sapiens
gcctgtgcccgctgcgc

SEQ ID NO: 4296186 - DNA, 23 bp, Homo sapiens
gcctgtgcccgctgcgctgccct

SEQ ID NO: 4296187 - DNA, 14 bp, Homo sapiens
gcctgtggcctcag

SEQ ID NO: 4296188 - DNA, 22 bp, Homo sapiens
gcctgtgggagaagggacagcg

SEQ ID NO: 4296189 - DNA, 19 bp, Homo sapiens
gcctgtggtgaggtcctgt

SEQ ID NO: 4296190 - DNA, 22 bp, Homo sapiens
gcctgtgttagtgtctgtccat

SEQ ID NO: 4296191 - DNA, 18 bp, Homo sapiens
gccttaagaaagctatat

SEQ ID NO: 4296192 - DNA, 23 bp, Homo sapiens
gccttaagaaagctatatatgaa

SEQ ID NO: 4296193 - DNA, 16 bp, Homo sapiens
gccttagaacctttct

SEQ ID NO: 4296194 - DNA, 21 bp, Homo sapiens
gccttagtttcagctgaccag

SEQ ID NO: 4296195 - DNA, 13 bp, Homo sapiens
gccttcagctcta

SEQ ID NO: 4296196 - DNA, 18 bp, Homo sapiens
gccttcaggcaccacaga

SEQ ID NO: 4296197 - DNA, 12 bp, Homo sapiens
gccttccaggcg

SEQ ID NO: 4296198 - DNA, 21 bp, Homo sapiens
gccttccaggcgtagggccag

SEQ ID NO: 4296199 - DNA, 17 bp, Homo sapiens
gccttctacctgcagga

SEQ ID NO: 4296200 - DNA, 20 bp, Homo sapiens
gccttctacctgcaggactc

SEQ ID NO: 4296201 - DNA, 16 bp, Homo sapiens
gccttctctgttcatt

SEQ ID NO: 4296202 - DNA, 16 bp, Homo sapiens
gccttctgatgaaatg

SEQ ID NO: 4296203 - DNA, 13 bp, Homo sapiens
gccttctgcggag

SEQ ID NO: 4296204 - DNA, 14 bp, Homo sapiens
gccttctgtctctt

SEQ ID NO: 4296205 - DNA, 15 bp, Homo sapiens
gccttctgtctcttg

SEQ ID NO: 4296206 - DNA, 18 bp, Homo sapiens
gccttctgtctcttgcat

SEQ ID NO: 4296207 - DNA, 15 bp, Homo sapiens
gccttggttcctcca

SEQ ID NO: 4296208 - DNA, 17 bp, Homo sapiens
gccttggttcctccagc

SEQ ID NO: 4296209 - DNA, 20 bp, Homo sapiens
gccttgtgtatgtgactcca

SEQ ID NO: 4296210 - DNA, 18 bp, Homo sapiens
gcctttagcgtgtaaatg

SEQ ID NO: 4296211 - DNA, 14 bp, Homo sapiens
gcctttaggcagga

SEQ ID NO: 4296212 - DNA, 17 bp, Homo sapiens
gcctttaggcaggaagt

SEQ ID NO: 4296213 - DNA, 17 bp, Homo sapiens
gcctttccagtgctgct

SEQ ID NO: 4296214 - DNA, 14 bp, Homo sapiens
gcctttgctgcctt

SEQ ID NO: 4296215 - DNA, 15 bp, Homo sapiens
gcctttgctgccttc

SEQ ID NO: 4296216 - DNA, 13 bp, Homo sapiens
gatccgccctggg

SEQ ID NO: 4296217 - DNA, 16 bp, Homo sapiens
gatccgccctgggctc

SEQ ID NO: 4296218 - DNA, 17 bp, Homo sapiens
gatccgccctgggctct

SEQ ID NO: 4296219 - DNA, 15 bp, Homo sapiens
gatcctccttccagg

SEQ ID NO: 4296220 - DNA, 18 bp, Homo sapiens
gatcctccttccaggccc

SEQ ID NO: 4296221 - DNA, 16 bp, Homo sapiens
gatccttcaaagtctc

SEQ ID NO: 4296222 - DNA, 21 bp, Homo sapiens
gatccttcaaagtctcaatga

SEQ ID NO: 4296223 - DNA, 23 bp, Homo sapiens
gatccttcaaagtctcaatgaaa

SEQ ID NO: 4296224 - DNA, 18 bp, Homo sapiens
gatctaaaaggaggacag

SEQ ID NO: 4296225 - DNA, 14 bp, Homo sapiens
gatctagccaggcc

SEQ ID NO: 4296226 - DNA, 15 bp, Homo sapiens
gatctagccaggcct

SEQ ID NO: 4296227 - DNA, 21 bp, Homo sapiens
gatctcagataaagtgaccag

SEQ ID NO: 4296228 - DNA, 12 bp, Homo sapiens
gatctccaggcc

SEQ ID NO: 4296229 - DNA, 13 bp, Homo sapiens
gatctccaggccc

SEQ ID NO: 4296230 - DNA, 14 bp, Homo sapiens
gatctccaggccca

SEQ ID NO: 4296231 - DNA, 15 bp, Homo sapiens
gatctccaggcccag

SEQ ID NO: 4296232 - DNA, 16 bp, Homo sapiens
gatctccaggcccagc

SEQ ID NO: 4296233 - DNA, 17 bp, Homo sapiens
gatctccaggcccagcc

SEQ ID NO: 4296234 - DNA, 22 bp, Homo sapiens
gatctccaggcccagcctggcc

SEQ ID NO: 4296235 - DNA, 20 bp, Homo sapiens
gatctcctgtaattttgtag

SEQ ID NO: 4296236 - DNA, 15 bp, Homo sapiens
gatctgctccatgca

SEQ ID NO: 4296237 - DNA, 17 bp, Homo sapiens
gatctgctccatgcaga

SEQ ID NO: 4296238 - DNA, 14 bp, Homo sapiens
gatctggagtctga

SEQ ID NO: 4296239 - DNA, 17 bp, Homo sapiens
gatctggagtctgaagg

SEQ ID NO: 4296240 - DNA, 15 bp, Homo sapiens
gatcttccaaatatt

SEQ ID NO: 4296241 - DNA, 12 bp, Homo sapiens
gatgaataaaca

SEQ ID NO: 4296242 - DNA, 19 bp, Homo sapiens
gatgacagggagctgggga

SEQ ID NO: 4296243 - DNA, 17 bp, Homo sapiens
gatgaccaatctctgtg

SEQ ID NO: 4296244 - DNA, 20 bp, Homo sapiens
gatgacctccttagaaaaga

SEQ ID NO: 4296245 - DNA, 14 bp, Homo sapiens
gatgaggggaggaa

SEQ ID NO: 4296246 - DNA, 16 bp, Homo sapiens
gatgcatgcagggccc

SEQ ID NO: 4296247 - DNA, 11 bp, Homo sapiens
gatgcctgggc

SEQ ID NO: 4296248 - DNA, 12 bp, Homo sapiens
gatgcctgggcc

SEQ ID NO: 4296249 - DNA, 14 bp, Homo sapiens
gatgcctgggcctg

SEQ ID NO: 4296250 - DNA, 16 bp, Homo sapiens
gatgcctgggcctgat

SEQ ID NO: 4296251 - DNA, 15 bp, Homo sapiens
gatgcgtggctccca

SEQ ID NO: 4296252 - DNA, 15 bp, Homo sapiens
gatgctgggaccctc

SEQ ID NO: 4296253 - DNA, 22 bp, Homo sapiens
gatgctgggttctggggctgag

SEQ ID NO: 4296254 - DNA, 19 bp, Homo sapiens
gatgctggtcatcctgggc

SEQ ID NO: 4296255 - DNA, 18 bp, Homo sapiens
gatgctgtagacatctgt

SEQ ID NO: 4296256 - DNA, 23 bp, Homo sapiens
gatggaggaaaaccaagccgtgg

SEQ ID NO: 4296257 - DNA, 12 bp, Homo sapiens
gatggccaggcc

SEQ ID NO: 4296258 - DNA, 15 bp, Homo sapiens
gatggcgcacccggc

SEQ ID NO: 4296259 - DNA, 19 bp, Homo sapiens
gatggcgtgtcccctgcct

SEQ ID NO: 4296260 - DNA, 22 bp, Homo sapiens
gatggcgtgtcccctgcctgtg

SEQ ID NO: 4296261 - DNA, 20 bp, Homo sapiens
gatggctccctgggctggca

SEQ ID NO: 4296262 - DNA, 22 bp, Homo sapiens
gatgggttttgttaggggtggg

SEQ ID NO: 4296263 - DNA, 15 bp, Homo sapiens
gatggtgccccctgg

SEQ ID NO: 4296264 - DNA, 18 bp, Homo sapiens
gatggttcccctgttcac

SEQ ID NO: 4296265 - DNA, 21 bp, Homo sapiens
gatggttcccctgttcactct

SEQ ID NO: 4296266 - DNA, 14 bp, Homo sapiens
gatgtaagaagccc

SEQ ID NO: 4296267 - DNA, 17 bp, Homo sapiens
gatgtattatgcaaagt

SEQ ID NO: 4296268 - DNA, 23 bp, Homo sapiens
gatgtcaaccttgtgtgagtgtg

SEQ ID NO: 4296269 - DNA, 16 bp, Homo sapiens
gatgtcaagctggccg

SEQ ID NO: 4296270 - DNA, 18 bp, Homo sapiens
gatgtcttgagatgtatt

SEQ ID NO: 4296271 - DNA, 14 bp, Homo sapiens
gatgttcctgggat

SEQ ID NO: 4296272 - DNA, 20 bp, Homo sapiens
gatgtttaatcaagagagac

SEQ ID NO: 4296273 - DNA, 22 bp, Homo sapiens
gatgtttgttttcaaaatactt

SEQ ID NO: 4296274 - DNA, 22 bp, Homo sapiens
gattaaatttaatatactgcat

SEQ ID NO: 4296275 - DNA, 21 bp, Homo sapiens
gattaatctctaaaattctag

SEQ ID NO: 4296276 - DNA, 22 bp, Homo sapiens
gattaatctctaaaattctagt

SEQ ID NO: 4296277 - DNA, 19 bp, Homo sapiens
gattagctttgtcactgtt

SEQ ID NO: 4296278 - DNA, 13 bp, Homo sapiens
gattaggcctgga

SEQ ID NO: 4296279 - DNA, 15 bp, Homo sapiens
gattagtaagatctc

SEQ ID NO: 4296280 - DNA, 14 bp, Homo sapiens
gattataatcagaa

SEQ ID NO: 4296281 - DNA, 18 bp, Homo sapiens
gattatttacaagaagaa

SEQ ID NO: 4296282 - DNA, 21 bp, Homo sapiens
gattatttacaagaagaactc

SEQ ID NO: 4296283 - DNA, 15 bp, Homo sapiens
gattcataacaatgt

SEQ ID NO: 4296284 - DNA, 19 bp, Homo sapiens
gattcattttaacatctga

SEQ ID NO: 4296285 - DNA, 12 bp, Homo sapiens
gattccaaataa

SEQ ID NO: 4296286 - DNA, 17 bp, Homo sapiens
gattccccggagctggg

SEQ ID NO: 4296287 - DNA, 21 bp, Homo sapiens
gattcccgtggctttgtgctt

SEQ ID NO: 4296288 - DNA, 12 bp, Homo sapiens
gattctaaaaca

SEQ ID NO: 4296289 - DNA, 16 bp, Homo sapiens
gattctaaaacattct

SEQ ID NO: 4296290 - DNA, 19 bp, Homo sapiens
gattctaaaacattcttta

SEQ ID NO: 4296291 - DNA, 18 bp, Homo sapiens
gattctaaaggggacaga

SEQ ID NO: 4296292 - DNA, 19 bp, Homo sapiens
gattctaaaggggacagat

SEQ ID NO: 4296293 - DNA, 18 bp, Homo sapiens
gattctatgcctgtattt

SEQ ID NO: 4296294 - DNA, 15 bp, Homo sapiens
gattctcctctccca

SEQ ID NO: 4296295 - DNA, 18 bp, Homo sapiens
gattctgtgggcagctgg

SEQ ID NO: 4296296 - DNA, 16 bp, Homo sapiens
gattgaaaagaagaaa

SEQ ID NO: 4296297 - DNA, 22 bp, Homo sapiens
gattgaaaagaagaaagtctat

SEQ ID NO: 4296298 - DNA, 24 bp, Homo sapiens
gattgcggtgtgagatggtgcccc

SEQ ID NO: 4296299 - DNA, 22 bp, Homo sapiens
gattggcagcttcaaaacagaa

SEQ ID NO: 4296300 - DNA, 16 bp, Homo sapiens
gattggttcatgcctg

SEQ ID NO: 4296301 - DNA, 20 bp, Homo sapiens
gattggttcatgcctggggt

SEQ ID NO: 4296302 - DNA, 17 bp, Homo sapiens
gattgtccacaaatgtc

SEQ ID NO: 4296303 - DNA, 19 bp, Homo sapiens
gattgtccacaaatgtcct

SEQ ID NO: 4296304 - DNA, 15 bp, Homo sapiens
gatttccctaaaaat

SEQ ID NO: 4296305 - DNA, 12 bp, Homo sapiens
gatttcctaagc

SEQ ID NO: 4296306 - DNA, 23 bp, Homo sapiens
gatttgagtccattgcaaaaggt

SEQ ID NO: 4296307 - DNA, 13 bp, Homo sapiens
gatttgcaacttt

SEQ ID NO: 4296308 - DNA, 23 bp, Homo sapiens
gatttgccaaaaactaaaattca

SEQ ID NO: 4296309 - DNA, 17 bp, Homo sapiens
gatttgggctgaatgta

SEQ ID NO: 4296310 - DNA, 16 bp, Homo sapiens
gattttatgtgcttga

SEQ ID NO: 4296311 - DNA, 21 bp, Homo sapiens
gattttatgtgcttgaagatt

SEQ ID NO: 4296312 - DNA, 18 bp, Homo sapiens
gattttattttcaagcaa

SEQ ID NO: 4296313 - DNA, 13 bp, Homo sapiens
gattttctttcta

SEQ ID NO: 4296314 - DNA, 15 bp, Homo sapiens
gcaaaaaataatgac

SEQ ID NO: 4296315 - DNA, 18 bp, Homo sapiens
gcaaaaggttaagccata

SEQ ID NO: 4296316 - DNA, 15 bp, Homo sapiens
gcaaacaaaatgatg

SEQ ID NO: 4296317 - DNA, 19 bp, Homo sapiens
gcaaacaaaatgatgggaa

SEQ ID NO: 4296318 - DNA, 21 bp, Homo sapiens
gcaaacacacagactctgtga

SEQ ID NO: 4296319 - DNA, 19 bp, Homo sapiens
gcaaagcatttgagctgtg

SEQ ID NO: 4296320 - DNA, 23 bp, Homo sapiens
gcaaaggactgttttttcctgag

SEQ ID NO: 4296321 - DNA, 22 bp, Homo sapiens
gcaaagtaccaactgagccaaa

SEQ ID NO: 4296322 - DNA, 14 bp, Homo sapiens
gcaaagtagtactt

SEQ ID NO: 4296323 - DNA, 23 bp, Homo sapiens
gcaaagtagtacttcttctgtaa

SEQ ID NO: 4296324 - DNA, 14 bp, Homo sapiens
gcaaagttttcaga

SEQ ID NO: 4296325 - DNA, 15 bp, Homo sapiens
gcaaatagtttcaaa

SEQ ID NO: 4296326 - DNA, 16 bp, Homo sapiens
gcaaatagtttcaaat

SEQ ID NO: 4296327 - DNA, 13 bp, Homo sapiens
gcaaatgtccaag

SEQ ID NO: 4296328 - DNA, 11 bp, Homo sapiens
gcaacactgga

SEQ ID NO: 4296329 - DNA, 16 bp, Homo sapiens
gcaacaggaccaggag

SEQ ID NO: 4296330 - DNA, 16 bp, Homo sapiens
gcaacagggcttctct

SEQ ID NO: 4296331 - DNA, 16 bp, Homo sapiens
gcaaccccctcggagc

SEQ ID NO: 4296332 - DNA, 12 bp, Homo sapiens
gcaaccctccta

SEQ ID NO: 4296333 - DNA, 13 bp, Homo sapiens
gcaactttagaaa

SEQ ID NO: 4296334 - DNA, 14 bp, Homo sapiens
gcaagaagaatata

SEQ ID NO: 4296335 - DNA, 17 bp, Homo sapiens
gcaagacaatgacactg

SEQ ID NO: 4296336 - DNA, 17 bp, Homo sapiens
gcaagacacccagtgga

SEQ ID NO: 4296337 - DNA, 16 bp, Homo sapiens
gcaagagctcaggaga

SEQ ID NO: 4296338 - DNA, 23 bp, Homo sapiens
gcaagattctgtgggcagctggc

SEQ ID NO: 4296339 - DNA, 15 bp, Homo sapiens
gcaagcacctgggtg

SEQ ID NO: 4296340 - DNA, 16 bp, Homo sapiens
gcaagcacctgggtgt

SEQ ID NO: 4296341 - DNA, 22 bp, Homo sapiens
gcaagcacctgggtgtgctcca

SEQ ID NO: 4296342 - DNA, 11 bp, Homo sapiens
gcaagcctcag

SEQ ID NO: 4296343 - DNA, 12 bp, Homo sapiens
gcaagcctcagc

SEQ ID NO: 4296344 - DNA, 13 bp, Homo sapiens
gcaagctggcagg

SEQ ID NO: 4296345 - DNA, 17 bp, Homo sapiens
gcaagctggcaggaggg

SEQ ID NO: 4296346 - DNA, 16 bp, Homo sapiens
gcaaggcaagaagtgg

SEQ ID NO: 4296347 - DNA, 19 bp, Homo sapiens
gcaaggcaagaagtgggat

SEQ ID NO: 4296348 - DNA, 23 bp, Homo sapiens
gcaagtatgttttagcatgtgtt

SEQ ID NO: 4296349 - DNA, 21 bp, Homo sapiens
gcaataaactcagtcaaatgt

SEQ ID NO: 4296350 - DNA, 17 bp, Homo sapiens
gcacaagaagtgggagt

SEQ ID NO: 4296351 - DNA, 23 bp, Homo sapiens
gcacaagaagtgggagtgggaga

SEQ ID NO: 4296352 - DNA, 21 bp, Homo sapiens
gcacaagcagagtgcacagct

SEQ ID NO: 4296353 - DNA, 22 bp, Homo sapiens
gcacaagcagagtgcacagctg

SEQ ID NO: 4296354 - DNA, 22 bp, Homo sapiens
gcacaaggagtgcccgccttga

SEQ ID NO: 4296355 - DNA, 15 bp, Homo sapiens
gcacaattctgtccc

SEQ ID NO: 4296356 - DNA, 18 bp, Homo sapiens
gcacacaattagatttct

SEQ ID NO: 4296357 - DNA, 19 bp, Homo sapiens
gcacacacacgcaaataca

SEQ ID NO: 4296358 - DNA, 19 bp, Homo sapiens
gcacacacactcttcaagt

SEQ ID NO: 4296359 - DNA, 13 bp, Homo sapiens
gcacacccctgca

SEQ ID NO: 4296360 - DNA, 15 bp, Homo sapiens
gcacacccctgcaca

SEQ ID NO: 4296361 - DNA, 20 bp, Homo sapiens
gcacacccctgcacacacct

SEQ ID NO: 4296362 - DNA, 17 bp, Homo sapiens
gcacaccgtccctctcc

SEQ ID NO: 4296363 - DNA, 14 bp, Homo sapiens
gcacacttcccctt

SEQ ID NO: 4296364 - DNA, 19 bp, Homo sapiens
gcacacttccccttgggat

SEQ ID NO: 4296365 - DNA, 20 bp, Homo sapiens
gcacagagagcggcttcccc

SEQ ID NO: 4296366 - DNA, 13 bp, Homo sapiens
gcacagcatctca

SEQ ID NO: 4296367 - DNA, 12 bp, Homo sapiens
gcacagccagaa

SEQ ID NO: 4296368 - DNA, 14 bp, Homo sapiens
gcacagccagaaac

SEQ ID NO: 4296369 - DNA, 20 bp, Homo sapiens
gcacagcctcacccctgcag

SEQ ID NO: 4296370 - DNA, 13 bp, Homo sapiens
gcacaggctgccc

SEQ ID NO: 4296371 - DNA, 18 bp, Homo sapiens
gcacaggctgccccaccc

SEQ ID NO: 4296372 - DNA, 13 bp, Homo sapiens
gcacagtgcatct

SEQ ID NO: 4296373 - DNA, 15 bp, Homo sapiens
gcacagtttgcaatc

SEQ ID NO: 4296374 - DNA, 19 bp, Homo sapiens
gcacatccaggcaatggcc

SEQ ID NO: 4296375 - DNA, 20 bp, Homo sapiens
gcacattagagggacagcca

SEQ ID NO: 4296376 - DNA, 16 bp, Homo sapiens
gcacattgccctgagg

SEQ ID NO: 4296377 - DNA, 21 bp, Homo sapiens
gcacatttgtcactgaataat

SEQ ID NO: 4296378 - DNA, 16 bp, Homo sapiens
gcaccagatgacacat

SEQ ID NO: 4296379 - DNA, 14 bp, Homo sapiens
gcaccagcctcagt

SEQ ID NO: 4296380 - DNA, 18 bp, Homo sapiens
gcacccatgccccactct

SEQ ID NO: 4296381 - DNA, 18 bp, Homo sapiens
gcacccccaccctttggg

SEQ ID NO: 4296382 - DNA, 15 bp, Homo sapiens
gcacccccggacgcc

SEQ ID NO: 4296383 - DNA, 20 bp, Homo sapiens
gcacccctggtgtccctgcc

SEQ ID NO: 4296384 - DNA, 15 bp, Homo sapiens
gcacccggcagcccc

SEQ ID NO: 4296385 - DNA, 16 bp, Homo sapiens
gcacccggcagccccc

SEQ ID NO: 4296386 - DNA, 15 bp, Homo sapiens
gcaccgaatattgag

SEQ ID NO: 4296387 - DNA, 14 bp, Homo sapiens
gcacctacttacat

SEQ ID NO: 4296388 - DNA, 13 bp, Homo sapiens
gcacctataaata

SEQ ID NO: 4296389 - DNA, 17 bp, Homo sapiens
gcacctgggtgtgctcc

SEQ ID NO: 4296390 - DNA, 19 bp, Homo sapiens
gcacctgtcccagaaaaag

SEQ ID NO: 4296391 - DNA, 13 bp, Homo sapiens
gcacgcaagcctc

SEQ ID NO: 4296392 - DNA, 18 bp, Homo sapiens
gcacgcaagcctcagcca

SEQ ID NO: 4296393 - DNA, 24 bp, Homo sapiens
gcacgcaagcctcagccactccca

SEQ ID NO: 4296394 - DNA, 14 bp, Homo sapiens
gcacgccaacccca

SEQ ID NO: 4296395 - DNA, 23 bp, Homo sapiens
gcacgccaaccccagcagtcctg

SEQ ID NO: 4296396 - DNA, 13 bp, Homo sapiens
gcacggggccagc

SEQ ID NO: 4296397 - DNA, 15 bp, Homo sapiens
gcacgtgcacacacc

SEQ ID NO: 4296398 - DNA, 17 bp, Homo sapiens
gcacgtgcacacacctg

SEQ ID NO: 4296399 - DNA, 21 bp, Homo sapiens
gcacgtgcacacacctgcaca

SEQ ID NO: 4296400 - DNA, 21 bp, Homo sapiens
gcactgaaggctttcagggcc

SEQ ID NO: 4296401 - DNA, 22 bp, Homo sapiens
gcactgaaggctttcagggcct

SEQ ID NO: 4296402 - DNA, 14 bp, Homo sapiens
gcactggaggcctc

SEQ ID NO: 4296403 - DNA, 14 bp, Homo sapiens
gcactgtgcagccg

SEQ ID NO: 4296404 - DNA, 13 bp, Homo sapiens
gcactgtggcctt

SEQ ID NO: 4296405 - DNA, 23 bp, Homo sapiens
gcagaaccagtccctctgagtga

SEQ ID NO: 4296406 - DNA, 14 bp, Homo sapiens
gcagaaggccttgc

SEQ ID NO: 4296407 - DNA, 19 bp, Homo sapiens
gcagaatggtgggctccag

SEQ ID NO: 4296408 - DNA, 13 bp, Homo sapiens
gcagaattcattc

SEQ ID NO: 4296409 - DNA, 14 bp, Homo sapiens
gcagaattcattca

SEQ ID NO: 4296410 - DNA, 20 bp, Homo sapiens
gcagacacgccttcccctca

SEQ ID NO: 4296411 - DNA, 16 bp, Homo sapiens
gcagaggggagaggaa

SEQ ID NO: 4296412 - DNA, 15 bp, Homo sapiens
gcagagtaaaattac

SEQ ID NO: 4296413 - DNA, 22 bp, Homo sapiens
gcagagtaaaattacagaagaa

SEQ ID NO: 4296414 - DNA, 16 bp, Homo sapiens
gcagatctagccaggc

SEQ ID NO: 4296415 - DNA, 22 bp, Homo sapiens
gcagatctagccaggcctcccg

SEQ ID NO: 4296416 - DNA, 20 bp, Homo sapiens
gcagattggttcatgcctgg

SEQ ID NO: 4296417 - DNA, 21 bp, Homo sapiens
gcagattggttcatgcctggg

SEQ ID NO: 4296418 - DNA, 16 bp, Homo sapiens
gcagatttcagatgta

SEQ ID NO: 4296419 - DNA, 16 bp, Homo sapiens
gcagcaacaggaccag

SEQ ID NO: 4296420 - DNA, 11 bp, Homo sapiens
gcagcacaatt

SEQ ID NO: 4296421 - DNA, 20 bp, Homo sapiens
gcagcagagagaaataaaac

SEQ ID NO: 4296422 - DNA, 13 bp, Homo sapiens
gcagcagagcctg

SEQ ID NO: 4296423 - DNA, 18 bp, Homo sapiens
gcagcagagcctggaaga

SEQ ID NO: 4296424 - DNA, 14 bp, Homo sapiens
gcagcatcaaccta

SEQ ID NO: 4296425 - DNA, 24 bp, Homo sapiens
gcagcatcaacctaggagcagtgg

SEQ ID NO: 4296426 - DNA, 22 bp, Homo sapiens
gcagccaccctgccatggaggc

SEQ ID NO: 4296427 - DNA, 13 bp, Homo sapiens
gcagcccacctgc

SEQ ID NO: 4296428 - DNA, 14 bp, Homo sapiens
gcagcccacctgct

SEQ ID NO: 4296429 - DNA, 20 bp, Homo sapiens
gcagcccacctgctgcccgt

SEQ ID NO: 4296430 - DNA, 11 bp, Homo sapiens
gcagcccagag

SEQ ID NO: 4296431 - DNA, 15 bp, Homo sapiens
gcagcccagagagac

SEQ ID NO: 4296432 - DNA, 12 bp, Homo sapiens
gcagccccaggc

SEQ ID NO: 4296433 - DNA, 13 bp, Homo sapiens
gcagccccaggcc

SEQ ID NO: 4296434 - DNA, 22 bp, Homo sapiens
gcagccccccagtgtccccagg

SEQ ID NO: 4296435 - DNA, 15 bp, Homo sapiens
gcagcccgggagatc

SEQ ID NO: 4296436 - DNA, 15 bp, Homo sapiens
gcagccggggagctg

SEQ ID NO: 4296437 - DNA, 15 bp, Homo sapiens
gcagccgtgccttca

SEQ ID NO: 4296438 - DNA, 11 bp, Homo sapiens
gcagcctcaga

SEQ ID NO: 4296439 - DNA, 16 bp, Homo sapiens
gcagcctgtgggagaa

SEQ ID NO: 4296440 - DNA, 17 bp, Homo sapiens
gcagcctgtgggagaag

SEQ ID NO: 4296441 - DNA, 18 bp, Homo sapiens
gcagcctgtgggagaagg

SEQ ID NO: 4296442 - DNA, 19 bp, Homo sapiens
gcagcctgtgggagaaggg

SEQ ID NO: 4296443 - DNA, 20 bp, Homo sapiens
gcagcctgtgggagaaggga

SEQ ID NO: 4296444 - DNA, 14 bp, Homo sapiens
gcagcgaggtccac

SEQ ID NO: 4296445 - DNA, 14 bp, Homo sapiens
gcagcggcccagat

SEQ ID NO: 4296446 - DNA, 16 bp, Homo sapiens
gcagcgtctgagcggc

SEQ ID NO: 4296447 - DNA, 12 bp, Homo sapiens
gcagctggctct

SEQ ID NO: 4296448 - DNA, 21 bp, Homo sapiens
gcagcttcaggtgagccaagg

SEQ ID NO: 4296449 - DNA, 17 bp, Homo sapiens
gcaggaaccatggacct

SEQ ID NO: 4296450 - DNA, 16 bp, Homo sapiens
gcaggaagcaaggcca

SEQ ID NO: 4296451 - DNA, 17 bp, Homo sapiens
gcaggaagcaaggccag

SEQ ID NO: 4296452 - DNA, 20 bp, Homo sapiens
gcaggaagcaaggccagccc

SEQ ID NO: 4296453 - DNA, 23 bp, Homo sapiens
gcaggaaggtctcatgcctgaga

SEQ ID NO: 4296454 - DNA, 17 bp, Homo sapiens
gcaggaagtcaggagcc

SEQ ID NO: 4296455 - DNA, 19 bp, Homo sapiens
gcaggaagtcaggagccag

SEQ ID NO: 4296456 - DNA, 20 bp, Homo sapiens
gcaggaagtcaggagccagc

SEQ ID NO: 4296457 - DNA, 15 bp, Homo sapiens
gcaggacctcagagt

SEQ ID NO: 4296458 - DNA, 14 bp, Homo sapiens
gcaggagacactgg

SEQ ID NO: 4296459 - DNA, 18 bp, Homo sapiens
gcaggagacactggtctc

SEQ ID NO: 4296460 - DNA, 16 bp, Homo sapiens
gcaggagcctagagga

SEQ ID NO: 4296461 - DNA, 17 bp, Homo sapiens
gcaggagcctagaggag

SEQ ID NO: 4296462 - DNA, 18 bp, Homo sapiens
gcaggagcctagaggagg

SEQ ID NO: 4296463 - DNA, 17 bp, Homo sapiens
gcaggaggacaggtgga

SEQ ID NO: 4296464 - DNA, 15 bp, Homo sapiens
gcaggagggtggcac

SEQ ID NO: 4296465 - DNA, 16 bp, Homo sapiens
gcaggagggtggcact

SEQ ID NO: 4296466 - DNA, 21 bp, Homo sapiens
gcaggcagagctcagcacagc

SEQ ID NO: 4296467 - DNA, 15 bp, Homo sapiens
gcaggcagcctgcag

SEQ ID NO: 4296468 - DNA, 23 bp, Homo sapiens
gcaggccctccgcgggggacagg

SEQ ID NO: 4296469 - DNA, 18 bp, Homo sapiens
gcaggcggtatccagagg

SEQ ID NO: 4296470 - DNA, 18 bp, Homo sapiens
gcaggctggcaccgcctt

SEQ ID NO: 4296471 - DNA, 19 bp, Homo sapiens
gcaggctggcaccgccttc

SEQ ID NO: 4296472 - DNA, 18 bp, Homo sapiens
gcagggagaccctgggag

SEQ ID NO: 4296473 - DNA, 15 bp, Homo sapiens
gcagggagcagcacg

SEQ ID NO: 4296474 - DNA, 21 bp, Homo sapiens
gcagggagggaaacccgggga

SEQ ID NO: 4296475 - DNA, 15 bp, Homo sapiens
gcagggcagcctgtg

SEQ ID NO: 4296476 - DNA, 20 bp, Homo sapiens
gcagggcagcctgtgggaga

SEQ ID NO: 4296477 - DNA, 18 bp, Homo sapiens
gcagggcaggcagagctc

SEQ ID NO: 4296478 - DNA, 17 bp, Homo sapiens
gcagggcccccactgga

SEQ ID NO: 4296479 - DNA, 22 bp, Homo sapiens
gcaggggccgcttcgccatgtg

SEQ ID NO: 4296480 - DNA, 23 bp, Homo sapiens
gcaggggcggtccagaggaggtg

SEQ ID NO: 4296481 - DNA, 21 bp, Homo sapiens
gcaggggctgcatcctcagcc

SEQ ID NO: 4296482 - DNA, 12 bp, Homo sapiens
gcaggggctggg

SEQ ID NO: 4296483 - DNA, 16 bp, Homo sapiens
gcaggggctgggcaga

SEQ ID NO: 4296484 - DNA, 19 bp, Homo sapiens
gcagggtctttgtgtgctg

SEQ ID NO: 4296485 - DNA, 13 bp, Homo sapiens
gcaggtggccagg

SEQ ID NO: 4296486 - DNA, 15 bp, Homo sapiens
gcaggtggccagggc

SEQ ID NO: 4296487 - DNA, 13 bp, Homo sapiens
gcaggtggggagg

SEQ ID NO: 4296488 - DNA, 17 bp, Homo sapiens
gcaggtggggagggggt

SEQ ID NO: 4296489 - DNA, 15 bp, Homo sapiens
gcaggtgtgggctcc

SEQ ID NO: 4296490 - DNA, 23 bp, Homo sapiens
gcaggtgtgggctcccacgccct

SEQ ID NO: 4296491 - DNA, 16 bp, Homo sapiens
gcagtcagcacagaga

SEQ ID NO: 4296492 - DNA, 15 bp, Homo sapiens
gcagtcctgggcccc

SEQ ID NO: 4296493 - DNA, 20 bp, Homo sapiens
gcagtcctgggccccctggg

SEQ ID NO: 4296494 - DNA, 16 bp, Homo sapiens
gcagtgacgtgagtgg

SEQ ID NO: 4296495 - DNA, 17 bp, Homo sapiens
gcagtgacgtgagtggg

SEQ ID NO: 4296496 - DNA, 20 bp, Homo sapiens
gcagtgattgaagtatctgt

SEQ ID NO: 4296497 - DNA, 18 bp, Homo sapiens
gcagtggcaaaggatcca

SEQ ID NO: 4296498 - DNA, 15 bp, Homo sapiens
gcagtgggccctggc

SEQ ID NO: 4296499 - DNA, 14 bp, Homo sapiens
gcagtgtgagggtg

SEQ ID NO: 4296500 - DNA, 18 bp, Homo sapiens
gcagtgtgagggtgcagg

SEQ ID NO: 4296501 - DNA, 13 bp, Homo sapiens
gcagtgttagctt

SEQ ID NO: 4296502 - DNA, 14 bp, Homo sapiens
gcagtgttagctta

SEQ ID NO: 4296503 - DNA, 16 bp, Homo sapiens
gcagttagcacagagg

SEQ ID NO: 4296504 - DNA, 18 bp, Homo sapiens
gcagttagcacagaggat

SEQ ID NO: 4296505 - DNA, 14 bp, Homo sapiens
gcagttatagaaaa

SEQ ID NO: 4296506 - DNA, 16 bp, Homo sapiens
gcagttggcctcagca

SEQ ID NO: 4296507 - DNA, 13 bp, Homo sapiens
gcagtttgcctct

SEQ ID NO: 4296508 - DNA, 15 bp, Homo sapiens
gcagtttgcctctgc

SEQ ID NO: 4296509 - DNA, 22 bp, Homo sapiens
gcataagcctcaggcctggccc

SEQ ID NO: 4296510 - DNA, 16 bp, Homo sapiens
gcataagtggacccag

SEQ ID NO: 4296511 - DNA, 22 bp, Homo sapiens
gcatagggtccactttggtaat

SEQ ID NO: 4296512 - DNA, 21 bp, Homo sapiens
gcatcatcttgaacattaatc

SEQ ID NO: 4296513 - DNA, 22 bp, Homo sapiens
gcatccatgcggccggcctggg

SEQ ID NO: 4296514 - DNA, 14 bp, Homo sapiens
gcatcccagtggcc

SEQ ID NO: 4296515 - DNA, 23 bp, Homo sapiens
gcatcccagtggcctcaaccctc

SEQ ID NO: 4296516 - DNA, 17 bp, Homo sapiens
gcatccctccaccccag

SEQ ID NO: 4296517 - DNA, 22 bp, Homo sapiens
gcatcccttggcccctctctgt

SEQ ID NO: 4296518 - DNA, 13 bp, Homo sapiens
gcatcctcagccc

SEQ ID NO: 4296519 - DNA, 17 bp, Homo sapiens
gcatcctcagccccagg

SEQ ID NO: 4296520 - DNA, 18 bp, Homo sapiens
gcatcgtgtgggtcccta

SEQ ID NO: 4296521 - DNA, 22 bp, Homo sapiens
gcatctagaggcttccttcatt

SEQ ID NO: 4296522 - DNA, 23 bp, Homo sapiens
gcatctagaggcttccttcattt

SEQ ID NO: 4296523 - DNA, 14 bp, Homo sapiens
gcatctcagctcat

SEQ ID NO: 4296524 - DNA, 14 bp, Homo sapiens
gcatctccaggaag

SEQ ID NO: 4296525 - DNA, 13 bp, Homo sapiens
gcatctctggagt

SEQ ID NO: 4296526 - DNA, 13 bp, Homo sapiens
gcatctggccctg

SEQ ID NO: 4296527 - DNA, 16 bp, Homo sapiens
gcatctggccctgctg

SEQ ID NO: 4296528 - DNA, 17 bp, Homo sapiens
gcatctggccctgctgc

SEQ ID NO: 4296529 - DNA, 19 bp, Homo sapiens
gcatctggccctgctgccc

SEQ ID NO: 4296530 - DNA, 20 bp, Homo sapiens
gcatctggccctgctgcccc

SEQ ID NO: 4296531 - DNA, 19 bp, Homo sapiens
gcatgaaactatgcaccta

SEQ ID NO: 4296532 - DNA, 11 bp, Homo sapiens
gcatgaaaggt

SEQ ID NO: 4296533 - DNA, 16 bp, Homo sapiens
gcatgacaagccccag

SEQ ID NO: 4296534 - DNA, 11 bp, Homo sapiens
gcatgaccctg

SEQ ID NO: 4296535 - DNA, 12 bp, Homo sapiens
gcatgatattgt

SEQ ID NO: 4296536 - DNA, 15 bp, Homo sapiens
gcatgcaagctcagg

SEQ ID NO: 4296537 - DNA, 13 bp, Homo sapiens
gcatgcagggccc

SEQ ID NO: 4296538 - DNA, 21 bp, Homo sapiens
gcatgcagggcccccacagga

SEQ ID NO: 4296539 - DNA, 23 bp, Homo sapiens
gcatgcagggcccccacaggagc

SEQ ID NO: 4296540 - DNA, 19 bp, Homo sapiens
gcatgccgagtgccccaga

SEQ ID NO: 4296541 - DNA, 18 bp, Homo sapiens
gcatgctcctctgcctgt

SEQ ID NO: 4296542 - DNA, 22 bp, Homo sapiens
gcatgctcctctgcctgtgccc

SEQ ID NO: 4296543 - DNA, 15 bp, Homo sapiens
gcatgctgcctgcct

SEQ ID NO: 4296544 - DNA, 14 bp, Homo sapiens
gcatggacagggcc

SEQ ID NO: 4296545 - DNA, 15 bp, Homo sapiens
gcatggacagggcca

SEQ ID NO: 4296546 - DNA, 22 bp, Homo sapiens
gcatggacagggccagggttgc

SEQ ID NO: 4296547 - DNA, 15 bp, Homo sapiens
gcatggcctcccagc

SEQ ID NO: 4296548 - DNA, 21 bp, Homo sapiens
gcatggctccagtctgctgcc

SEQ ID NO: 4296549 - DNA, 16 bp, Homo sapiens
gcatggggaggggaga

SEQ ID NO: 4296550 - DNA, 17 bp, Homo sapiens
gcatggggaggggagag

SEQ ID NO: 4296551 - DNA, 15 bp, Homo sapiens
gcatggggtgggcct

SEQ ID NO: 4296552 - DNA, 18 bp, Homo sapiens
gcatgtccccagtgtgga

SEQ ID NO: 4296553 - DNA, 19 bp, Homo sapiens
gcatgtccccagtgtggac

SEQ ID NO: 4296554 - DNA, 19 bp, Homo sapiens
gcatgtgtttggttctggg

SEQ ID NO: 4296555 - DNA, 14 bp, Homo sapiens
gcattactgcatgc

SEQ ID NO: 4296556 - DNA, 17 bp, Homo sapiens
gcattactgcatgcact

SEQ ID NO: 4296557 - DNA, 18 bp, Homo sapiens
gcattatccttttatctc

SEQ ID NO: 4296558 - DNA, 21 bp, Homo sapiens
gcattcaaaatagttctattt

SEQ ID NO: 4296559 - DNA, 22 bp, Homo sapiens
gcattcaaaatagttctatttc

SEQ ID NO: 4296560 - DNA, 18 bp, Homo sapiens
gcattctcactcctacct

SEQ ID NO: 4296561 - DNA, 13 bp, Homo sapiens
gcattgaaataat

SEQ ID NO: 4296562 - DNA, 23 bp, Homo sapiens
gcatttaagaattgccagtcttt

SEQ ID NO: 4296563 - DNA, 15 bp, Homo sapiens
gcatttctgggcctt

SEQ ID NO: 4296564 - DNA, 16 bp, Homo sapiens
gccaaacattcttatt

SEQ ID NO: 4296565 - DNA, 21 bp, Homo sapiens
gccaaatcctgggcatcccca

SEQ ID NO: 4296566 - DNA, 15 bp, Homo sapiens
gccaaattgcagaag

SEQ ID NO: 4296567 - DNA, 17 bp, Homo sapiens
gccaaattgcagaagaa

SEQ ID NO: 4296568 - DNA, 14 bp, Homo sapiens
gccaacaccaggga

SEQ ID NO: 4296569 - DNA, 15 bp, Homo sapiens
gccaaccagcttgtc

SEQ ID NO: 4296570 - DNA, 23 bp, Homo sapiens
gccaaccccagcagtcctgggcc

SEQ ID NO: 4296571 - DNA, 14 bp, Homo sapiens
gccaacccctgtgg

SEQ ID NO: 4296572 - DNA, 17 bp, Homo sapiens
gccaactttccagactt

SEQ ID NO: 4296573 - DNA, 21 bp, Homo sapiens
gccaagccagggttccagaca

SEQ ID NO: 4296574 - DNA, 13 bp, Homo sapiens
gccaagcctgccc

SEQ ID NO: 4296575 - DNA, 16 bp, Homo sapiens
gccaagcctgccccgg

SEQ ID NO: 4296576 - DNA, 14 bp, Homo sapiens
gccaaggactgccg

SEQ ID NO: 4296577 - DNA, 17 bp, Homo sapiens
gccaaggactgccgacc

SEQ ID NO: 4296578 - DNA, 19 bp, Homo sapiens
gccaaggcctatgccacct

SEQ ID NO: 4296579 - DNA, 20 bp, Homo sapiens
gccaaggggtctgctcctgt

SEQ ID NO: 4296580 - DNA, 21 bp, Homo sapiens
gccaaggggtctgctcctgtg

SEQ ID NO: 4296581 - DNA, 21 bp, Homo sapiens
gccaatgaagcaaacacacag

SEQ ID NO: 4296582 - DNA, 21 bp, Homo sapiens
gccaatggagactgtctcaag

SEQ ID NO: 4296583 - DNA, 14 bp, Homo sapiens
gccacatgagtccc

SEQ ID NO: 4296584 - DNA, 22 bp, Homo sapiens
gccaccaaggctgcctgcccca

SEQ ID NO: 4296585 - DNA, 15 bp, Homo sapiens
gccacccagggacca

SEQ ID NO: 4296586 - DNA, 21 bp, Homo sapiens
gccacccggatctccaggccc

SEQ ID NO: 4296587 - DNA, 24 bp, Homo sapiens
gccacccggatctccaggcccagc

SEQ ID NO: 4296588 - DNA, 15 bp, Homo sapiens
gccaccctgccatgg

SEQ ID NO: 4296589 - DNA, 12 bp, Homo sapiens
gccacctgcagc

SEQ ID NO: 4296590 - DNA, 14 bp, Homo sapiens
gccacctgccccct

SEQ ID NO: 4296591 - DNA, 17 bp, Homo sapiens
gccacctgcccccttct

SEQ ID NO: 4296592 - DNA, 18 bp, Homo sapiens
gccacctgcccccttctc

SEQ ID NO: 4296593 - DNA, 20 bp, Homo sapiens
gccacctgcccccttctccc

SEQ ID NO: 4296594 - DNA, 12 bp, Homo sapiens
gccacgcctctc

SEQ ID NO: 4296595 - DNA, 13 bp, Homo sapiens
gccacgcctctct

SEQ ID NO: 4296596 - DNA, 15 bp, Homo sapiens
gccacgcctctctca

SEQ ID NO: 4296597 - DNA, 21 bp, Homo sapiens
gccacgcctctctcagcccag

SEQ ID NO: 4296598 - DNA, 22 bp, Homo sapiens
gccacgcctctctcagcccagg

SEQ ID NO: 4296599 - DNA, 13 bp, Homo sapiens
gccacgcctgcga

SEQ ID NO: 4296600 - DNA, 22 bp, Homo sapiens
gccacgcctgcgatggtgctgc

SEQ ID NO: 4296601 - DNA, 13 bp, Homo sapiens
gccacgcgctctg

SEQ ID NO: 4296602 - DNA, 14 bp, Homo sapiens
gccacgcgctctgc

SEQ ID NO: 4296603 - DNA, 19 bp, Homo sapiens
gccacgcgctctgcatgct

SEQ ID NO: 4296604 - DNA, 14 bp, Homo sapiens
gccacggcagccac

SEQ ID NO: 4296605 - DNA, 19 bp, Homo sapiens
gccacggcagccaccctgc

SEQ ID NO: 4296606 - DNA, 21 bp, Homo sapiens
gccacggcagccaccctgcca

SEQ ID NO: 4296607 - DNA, 12 bp, Homo sapiens
gccacgggggag

SEQ ID NO: 4296608 - DNA, 17 bp, Homo sapiens
gccacgtgctggagagt

SEQ ID NO: 4296609 - DNA, 18 bp, Homo sapiens
gccacgtgctggagagta

SEQ ID NO: 4296610 - DNA, 13 bp, Homo sapiens
gccactaggccct

SEQ ID NO: 4296611 - DNA, 19 bp, Homo sapiens
gccactaggccctggtctg

SEQ ID NO: 4296612 - DNA, 15 bp, Homo sapiens
gccactcccaggggc

SEQ ID NO: 4296613 - DNA, 18 bp, Homo sapiens
gccactctcctgaggagc

SEQ ID NO: 4296614 - DNA, 17 bp, Homo sapiens
gccactctgctctgcac

SEQ ID NO: 4296615 - DNA, 20 bp, Homo sapiens
gccactctgctctgcacatt

SEQ ID NO: 4296616 - DNA, 23 bp, Homo sapiens
gccactctgttcctggctcagcc

SEQ ID NO: 4296617 - DNA, 20 bp, Homo sapiens
gccactctgtttgctcaccc

SEQ ID NO: 4296618 - DNA, 14 bp, Homo sapiens
ggcagcctgtggga

SEQ ID NO: 4296619 - DNA, 21 bp, Homo sapiens
ggcagcctgtgggagaaggga

SEQ ID NO: 4296620 - DNA, 11 bp, Homo sapiens
ggcagctggct

SEQ ID NO: 4296621 - DNA, 22 bp, Homo sapiens
ggcaggaaaccccgagaaggaa

SEQ ID NO: 4296622 - DNA, 19 bp, Homo sapiens
ggcaggaaccatggacctg

SEQ ID NO: 4296623 - DNA, 15 bp, Homo sapiens
ggcaggaagtcagga

SEQ ID NO: 4296624 - DNA, 18 bp, Homo sapiens
ggcaggaagtcaggagcc

SEQ ID NO: 4296625 - DNA, 19 bp, Homo sapiens
ggcaggaagtcaggagcca

SEQ ID NO: 4296626 - DNA, 21 bp, Homo sapiens
ggcaggacctcagagtccagg

SEQ ID NO: 4296627 - DNA, 15 bp, Homo sapiens
ggcaggagacactgg

SEQ ID NO: 4296628 - DNA, 12 bp, Homo sapiens
ggcaggagccta

SEQ ID NO: 4296629 - DNA, 21 bp, Homo sapiens
ggcaggagcctagaggaggaa

SEQ ID NO: 4296630 - DNA, 20 bp, Homo sapiens
ggcaggaggacaggtggagg

SEQ ID NO: 4296631 - DNA, 14 bp, Homo sapiens
ggcaggagggtggc

SEQ ID NO: 4296632 - DNA, 19 bp, Homo sapiens
ggcaggagtgggctctgag

SEQ ID NO: 4296633 - DNA, 21 bp, Homo sapiens
ggcaggcagagctcagcacag

SEQ ID NO: 4296634 - DNA, 21 bp, Homo sapiens
ggcaggcccctttggacctgc

SEQ ID NO: 4296635 - DNA, 22 bp, Homo sapiens
ggcaggcccctttggacctgca

SEQ ID NO: 4296636 - DNA, 14 bp, Homo sapiens
ggcaggcctttttg

SEQ ID NO: 4296637 - DNA, 15 bp, Homo sapiens
ggcagggagggaaac

SEQ ID NO: 4296638 - DNA, 15 bp, Homo sapiens
ggcagggcaggcaga

SEQ ID NO: 4296639 - DNA, 21 bp, Homo sapiens
ggcaggggccgtgcagggcca

SEQ ID NO: 4296640 - DNA, 16 bp, Homo sapiens
ggcaggggctgggcag

SEQ ID NO: 4296641 - DNA, 18 bp, Homo sapiens
ggcaggggctgggcagag

SEQ ID NO: 4296642 - DNA, 18 bp, Homo sapiens
ggcaggtcccgagccccc

SEQ ID NO: 4296643 - DNA, 17 bp, Homo sapiens
ggcaggtgtgggctccc

SEQ ID NO: 4296644 - DNA, 23 bp, Homo sapiens
ggcaggtgtgggctcccacgccc

SEQ ID NO: 4296645 - DNA, 19 bp, Homo sapiens
ggcagtgacgtgagtgggg

SEQ ID NO: 4296646 - DNA, 12 bp, Homo sapiens
ggcagtggccca

SEQ ID NO: 4296647 - DNA, 14 bp, Homo sapiens
ggcagtggcccagg

SEQ ID NO: 4296648 - DNA, 15 bp, Homo sapiens
ggcagtggcccaggg

SEQ ID NO: 4296649 - DNA, 16 bp, Homo sapiens
ggcatactctccagga

SEQ ID NO: 4296650 - DNA, 18 bp, Homo sapiens
ggcatactctccaggatt

SEQ ID NO: 4296651 - DNA, 14 bp, Homo sapiens
ggcatcattttcac

SEQ ID NO: 4296652 - DNA, 15 bp, Homo sapiens
ggcatctccaggaag

SEQ ID NO: 4296653 - DNA, 15 bp, Homo sapiens
ggcatctctggagtg

SEQ ID NO: 4296654 - DNA, 22 bp, Homo sapiens
ggcatctctggagtgtgtgggg

SEQ ID NO: 4296655 - DNA, 18 bp, Homo sapiens
ggcatctggccctgctgc

SEQ ID NO: 4296656 - DNA, 21 bp, Homo sapiens
ggcatgaccctggagcccggc

SEQ ID NO: 4296657 - DNA, 13 bp, Homo sapiens
ggcatgagctctt

SEQ ID NO: 4296658 - DNA, 17 bp, Homo sapiens
ggcatgagctcttggca

SEQ ID NO: 4296659 - DNA, 13 bp, Homo sapiens
ggcatgcctgtgt

SEQ ID NO: 4296660 - DNA, 14 bp, Homo sapiens
ggcatgcctgtgtg

SEQ ID NO: 4296661 - DNA, 21 bp, Homo sapiens
ggcatggacagggccagggtt

SEQ ID NO: 4296662 - DNA, 17 bp, Homo sapiens
ggcatggccaggtggcc

SEQ ID NO: 4296663 - DNA, 22 bp, Homo sapiens
ggcatggggaggggagagaagg

SEQ ID NO: 4296664 - DNA, 19 bp, Homo sapiens
ggcatggggtgggcctctg

SEQ ID NO: 4296665 - DNA, 23 bp, Homo sapiens
ggcatgggtcccttccccctgct

SEQ ID NO: 4296666 - DNA, 23 bp, Homo sapiens
ggcattggaggatgggggtcctg

SEQ ID NO: 4296667 - DNA, 14 bp, Homo sapiens
ggcatttttcttgg

SEQ ID NO: 4296668 - DNA, 22 bp, Homo sapiens
ggcatttttcttggatcttttt

SEQ ID NO: 4296669 - DNA, 15 bp, Homo sapiens
ggccaacaccaggga

SEQ ID NO: 4296670 - DNA, 22 bp, Homo sapiens
ggccaagagatgcagtgccagg

SEQ ID NO: 4296671 - DNA, 13 bp, Homo sapiens
ggccaagcctgcc

SEQ ID NO: 4296672 - DNA, 14 bp, Homo sapiens
ggccaagcctgccc

SEQ ID NO: 4296673 - DNA, 11 bp, Homo sapiens
ggccaaggact

SEQ ID NO: 4296674 - DNA, 13 bp, Homo sapiens
ggccaaggactgc

SEQ ID NO: 4296675 - DNA, 16 bp, Homo sapiens
ggccaagtgcaggctg

SEQ ID NO: 4296676 - DNA, 20 bp, Homo sapiens
ggccaagtgcaggctggcac

SEQ ID NO: 4296677 - DNA, 16 bp, Homo sapiens
ggccacatgagtccca

SEQ ID NO: 4296678 - DNA, 13 bp, Homo sapiens
ggccacctgcccc

SEQ ID NO: 4296679 - DNA, 14 bp, Homo sapiens
ggccacctgccccc

SEQ ID NO: 4296680 - DNA, 22 bp, Homo sapiens
ggccacctgcccccttctccca

SEQ ID NO: 4296681 - DNA, 17 bp, Homo sapiens
ggccactgcagtcaccc

SEQ ID NO: 4296682 - DNA, 20 bp, Homo sapiens
ggccactgcagtcacccctg

SEQ ID NO: 4296683 - DNA, 21 bp, Homo sapiens
ggccactgcagtcacccctgt

SEQ ID NO: 4296684 - DNA, 16 bp, Homo sapiens
ggccagagctcccagg

SEQ ID NO: 4296685 - DNA, 16 bp, Homo sapiens
ggccagaggaagggag

SEQ ID NO: 4296686 - DNA, 17 bp, Homo sapiens
ggccagaggaagggagg

SEQ ID NO: 4296687 - DNA, 18 bp, Homo sapiens
ggccagaggaagggaggc

SEQ ID NO: 4296688 - DNA, 12 bp, Homo sapiens
ggccagagggcc

SEQ ID NO: 4296689 - DNA, 13 bp, Homo sapiens
ggccagaggtgaa

SEQ ID NO: 4296690 - DNA, 12 bp, Homo sapiens
ggccagcccctc

SEQ ID NO: 4296691 - DNA, 15 bp, Homo sapiens
ggccagcccctccca

SEQ ID NO: 4296692 - DNA, 16 bp, Homo sapiens
ggccagcccctcccac

SEQ ID NO: 4296693 - DNA, 11 bp, Homo sapiens
ggccagctcct

SEQ ID NO: 4296694 - DNA, 13 bp, Homo sapiens
ggccagggctctg

SEQ ID NO: 4296695 - DNA, 19 bp, Homo sapiens
ggccagggtctcgtcagga

SEQ ID NO: 4296696 - DNA, 19 bp, Homo sapiens
ggccaggtggccactccag

SEQ ID NO: 4296697 - DNA, 22 bp, Homo sapiens
ggccatccggcccccagagcgc

SEQ ID NO: 4296698 - DNA, 23 bp, Homo sapiens
ggccatccggcccccagagcgcc

SEQ ID NO: 4296699 - DNA, 17 bp, Homo sapiens
ggccatgagctccagac

SEQ ID NO: 4296700 - DNA, 20 bp, Homo sapiens
ggcccaaccaccagatgaga

SEQ ID NO: 4296701 - DNA, 21 bp, Homo sapiens
ggcccacattgcccacacctg

SEQ ID NO: 4296702 - DNA, 12 bp, Homo sapiens
ggcccacccctc

SEQ ID NO: 4296703 - DNA, 23 bp, Homo sapiens
ggcccacccctcttcccccttcc

SEQ ID NO: 4296704 - DNA, 11 bp, Homo sapiens
ggcccagcagc

SEQ ID NO: 4296705 - DNA, 17 bp, Homo sapiens
ggcccagcagcggccca

SEQ ID NO: 4296706 - DNA, 11 bp, Homo sapiens
ggcccagccag

SEQ ID NO: 4296707 - DNA, 14 bp, Homo sapiens
ggcccagccagcag

SEQ ID NO: 4296708 - DNA, 12 bp, Homo sapiens
ggcccagcctgg

SEQ ID NO: 4296709 - DNA, 17 bp, Homo sapiens
ggcccagcctggcccca

SEQ ID NO: 4296710 - DNA, 18 bp, Homo sapiens
ggcccagcctggccccaa

SEQ ID NO: 4296711 - DNA, 14 bp, Homo sapiens
ggcccagcctgtgg

SEQ ID NO: 4296712 - DNA, 16 bp, Homo sapiens
ggcccagcctgtggcc

SEQ ID NO: 4296713 - DNA, 17 bp, Homo sapiens
ggcccaggagagccccc

SEQ ID NO: 4296714 - DNA, 19 bp, Homo sapiens
ggcccagggaatcagggag

SEQ ID NO: 4296715 - DNA, 20 bp, Homo sapiens
ggcccagggaatcagggagc

SEQ ID NO: 4296716 - DNA, 17 bp, Homo sapiens
ggcccagtgagagtgag

SEQ ID NO: 4296717 - DNA, 20 bp, Homo sapiens
ggccccaaaaccacagccct

SEQ ID NO: 4296718 - DNA, 12 bp, Homo sapiens
ggccccagagac

SEQ ID NO: 4296719 - DNA, 13 bp, Homo sapiens
ggccccagggaac

SEQ ID NO: 4296720 - DNA, 19 bp, Homo sapiens
ggcccccagagcgcccctc

SEQ ID NO: 4296721 - DNA, 15 bp, Homo sapiens
ggcccccgagctggg

SEQ ID NO: 4296722 - DNA, 17 bp, Homo sapiens
ggcccctcactggctgg

SEQ ID NO: 4296723 - DNA, 23 bp, Homo sapiens
ggcccctccttctcccctccaga

SEQ ID NO: 4296724 - DNA, 11 bp, Homo sapiens
ggcccctctct

SEQ ID NO: 4296725 - DNA, 20 bp, Homo sapiens
ggccccttcacttctgacca

SEQ ID NO: 4296726 - DNA, 22 bp, Homo sapiens
ggccccttcacttctgaccaca

SEQ ID NO: 4296727 - DNA, 20 bp, Homo sapiens
ggccccttgctgctggctcc

SEQ ID NO: 4296728 - DNA, 18 bp, Homo sapiens
ggcccctttggacctgca

SEQ ID NO: 4296729 - DNA, 19 bp, Homo sapiens
ggcccctttttactcccct

SEQ ID NO: 4296730 - DNA, 16 bp, Homo sapiens
ggcccggctgggcccg

SEQ ID NO: 4296731 - DNA, 13 bp, Homo sapiens
ggcccgggaggag

SEQ ID NO: 4296732 - DNA, 15 bp, Homo sapiens
ggcccgggaggagga

SEQ ID NO: 4296733 - DNA, 14 bp, Homo sapiens
ggccctaggcatac

SEQ ID NO: 4296734 - DNA, 21 bp, Homo sapiens
ggccctctcttaatgccacgg

SEQ ID NO: 4296735 - DNA, 14 bp, Homo sapiens
ggccctgccccaca

SEQ ID NO: 4296736 - DNA, 20 bp, Homo sapiens
ggccctgccccacacaggcc

SEQ ID NO: 4296737 - DNA, 21 bp, Homo sapiens
ggccctgccccacacaggcct

SEQ ID NO: 4296738 - DNA, 22 bp, Homo sapiens
ggccctgctcaggcctcacctg

SEQ ID NO: 4296739 - DNA, 15 bp, Homo sapiens
ggccctgctgccccc

SEQ ID NO: 4296740 - DNA, 20 bp, Homo sapiens
ggccctgctgccccctaccc

SEQ ID NO: 4296741 - DNA, 13 bp, Homo sapiens
ggccctggctccc

SEQ ID NO: 4296742 - DNA, 22 bp, Homo sapiens
ggccctggctcccacaggccct

SEQ ID NO: 4296743 - DNA, 18 bp, Homo sapiens
ggccctggctctgtcact

SEQ ID NO: 4296744 - DNA, 14 bp, Homo sapiens
ggccctggtctggc

SEQ ID NO: 4296745 - DNA, 22 bp, Homo sapiens
ggcccttcctctccactgcctt

SEQ ID NO: 4296746 - DNA, 15 bp, Homo sapiens
ggccctttcacccct

SEQ ID NO: 4296747 - DNA, 21 bp, Homo sapiens
ggccctttcacccctcttccc

SEQ ID NO: 4296748 - DNA, 13 bp, Homo sapiens
ggccgaggcaggg

SEQ ID NO: 4296749 - DNA, 14 bp, Homo sapiens
ggccgcctgtcctt

SEQ ID NO: 4296750 - DNA, 23 bp, Homo sapiens
ggccgctgggagaaaagccagat

SEQ ID NO: 4296751 - DNA, 18 bp, Homo sapiens
ggccgcttcgccatgtgc

SEQ ID NO: 4296752 - DNA, 13 bp, Homo sapiens
ggccggccctgcc

SEQ ID NO: 4296753 - DNA, 20 bp, Homo sapiens
ggagagaaggtggtctgcac

SEQ ID NO: 4296754 - DNA, 17 bp, Homo sapiens
ggagagaatgagagagt

SEQ ID NO: 4296755 - DNA, 21 bp, Homo sapiens
ggagagaatgagagagtgtgg

SEQ ID NO: 4296756 - DNA, 16 bp, Homo sapiens
ggagagagagttctca

SEQ ID NO: 4296757 - DNA, 21 bp, Homo sapiens
ggagagcccccaccagcagca

SEQ ID NO: 4296758 - DNA, 14 bp, Homo sapiens
ggagaggaagcaca

SEQ ID NO: 4296759 - DNA, 13 bp, Homo sapiens
ggagaggccatga

SEQ ID NO: 4296760 - DNA, 12 bp, Homo sapiens
ggagagtgaggt

SEQ ID NO: 4296761 - DNA, 13 bp, Homo sapiens
ggagcactggagg

SEQ ID NO: 4296762 - DNA, 21 bp, Homo sapiens
ggagcagcacgccaaccccag

SEQ ID NO: 4296763 - DNA, 15 bp, Homo sapiens
ggagcagcccacctg

SEQ ID NO: 4296764 - DNA, 14 bp, Homo sapiens
ggagcagtgggccc

SEQ ID NO: 4296765 - DNA, 16 bp, Homo sapiens
ggagcagtgggccctg

SEQ ID NO: 4296766 - DNA, 17 bp, Homo sapiens
ggagcagtgggccctgg

SEQ ID NO: 4296767 - DNA, 18 bp, Homo sapiens
ggagcagtgggccctggc

SEQ ID NO: 4296768 - DNA, 14 bp, Homo sapiens
ggagccacaggcag

SEQ ID NO: 4296769 - DNA, 15 bp, Homo sapiens
ggagccacaggcaga

SEQ ID NO: 4296770 - DNA, 15 bp, Homo sapiens
ggagccactctgttc

SEQ ID NO: 4296771 - DNA, 23 bp, Homo sapiens
ggagccagcagggcgggccagga

SEQ ID NO: 4296772 - DNA, 13 bp, Homo sapiens
ggagccagctccc

SEQ ID NO: 4296773 - DNA, 20 bp, Homo sapiens
ggagcccgcacccccaccct

SEQ ID NO: 4296774 - DNA, 16 bp, Homo sapiens
ggagcctagaggagga

SEQ ID NO: 4296775 - DNA, 16 bp, Homo sapiens
ggagcctcgcccctcc

SEQ ID NO: 4296776 - DNA, 19 bp, Homo sapiens
ggagcctgcgtggcctggg

SEQ ID NO: 4296777 - DNA, 21 bp, Homo sapiens
ggagcctgcgtggcctggggc

SEQ ID NO: 4296778 - DNA, 17 bp, Homo sapiens
ggagcgggacctgtggc

SEQ ID NO: 4296779 - DNA, 13 bp, Homo sapiens
ggagcgtgtccta

SEQ ID NO: 4296780 - DNA, 18 bp, Homo sapiens
ggagctaacactggcccc

SEQ ID NO: 4296781 - DNA, 22 bp, Homo sapiens
ggagctagggtcccccttcgtg

SEQ ID NO: 4296782 - DNA, 14 bp, Homo sapiens
ggagctcagggctg

SEQ ID NO: 4296783 - DNA, 16 bp, Homo sapiens
ggagctcagggctgga

SEQ ID NO: 4296784 - DNA, 18 bp, Homo sapiens
ggagctcagggctggatt

SEQ ID NO: 4296785 - DNA, 13 bp, Homo sapiens
ggagctctaactg

SEQ ID NO: 4296786 - DNA, 16 bp, Homo sapiens
ggagctgaggggcagg

SEQ ID NO: 4296787 - DNA, 13 bp, Homo sapiens
ggagctgcttcca

SEQ ID NO: 4296788 - DNA, 15 bp, Homo sapiens
ggagcttctccagcc

SEQ ID NO: 4296789 - DNA, 21 bp, Homo sapiens
ggaggaaaaccaagccgtggc

SEQ ID NO: 4296790 - DNA, 23 bp, Homo sapiens
ggaggaactggtccaggccaggc

SEQ ID NO: 4296791 - DNA, 20 bp, Homo sapiens
ggaggaatcgaggaaccaga

SEQ ID NO: 4296792 - DNA, 21 bp, Homo sapiens
ggaggaatcgaggaaccagag

SEQ ID NO: 4296793 - DNA, 16 bp, Homo sapiens
ggaggaatgctccccc

SEQ ID NO: 4296794 - DNA, 18 bp, Homo sapiens
ggaggaatgctcccccat

SEQ ID NO: 4296795 - DNA, 13 bp, Homo sapiens
ggaggacagggag

SEQ ID NO: 4296796 - DNA, 14 bp, Homo sapiens
ggaggacagggagg

SEQ ID NO: 4296797 - DNA, 14 bp, Homo sapiens
ggaggaggatccgg

SEQ ID NO: 4296798 - DNA, 23 bp, Homo sapiens
ggaggaggtaacatagatgcctg

SEQ ID NO: 4296799 - DNA, 10 bp, Homo sapiens
ggaggcaggt

SEQ ID NO: 4296800 - DNA, 22 bp, Homo sapiens
ggaggcaggtcccgagccccct

SEQ ID NO: 4296801 - DNA, 16 bp, Homo sapiens
ggaggccacgggggag

SEQ ID NO: 4296802 - DNA, 22 bp, Homo sapiens
ggaggccacgggggaggccgag

SEQ ID NO: 4296803 - DNA, 13 bp, Homo sapiens
ggaggcctgaggg

SEQ ID NO: 4296804 - DNA, 16 bp, Homo sapiens
ggaggcctggtctgga

SEQ ID NO: 4296805 - DNA, 17 bp, Homo sapiens
ggaggcctggtctggag

SEQ ID NO: 4296806 - DNA, 14 bp, Homo sapiens
ggaggcgccttcct

SEQ ID NO: 4296807 - DNA, 16 bp, Homo sapiens
ggaggctaagcctgga

SEQ ID NO: 4296808 - DNA, 20 bp, Homo sapiens
ggaggcttgtcagagctggg

SEQ ID NO: 4296809 - DNA, 19 bp, Homo sapiens
ggagggaaacccggggaac

SEQ ID NO: 4296810 - DNA, 15 bp, Homo sapiens
ggagggaattgaggt

SEQ ID NO: 4296811 - DNA, 19 bp, Homo sapiens
ggagggaattgaggtctgc

SEQ ID NO: 4296812 - DNA, 15 bp, Homo sapiens
ggaggggagagaagg

SEQ ID NO: 4296813 - DNA, 15 bp, Homo sapiens
ggaggggcaggcctt

SEQ ID NO: 4296814 - DNA, 21 bp, Homo sapiens
ggaggggcctggcagccgtgc

SEQ ID NO: 4296815 - DNA, 20 bp, Homo sapiens
ggagggtggcacttcgtgga

SEQ ID NO: 4296816 - DNA, 22 bp, Homo sapiens
ggaggtaacatagatgcctggg

SEQ ID NO: 4296817 - DNA, 23 bp, Homo sapiens
ggaggtaacatagatgcctgggc

SEQ ID NO: 4296818 - DNA, 19 bp, Homo sapiens
ggagtcaagtgtgcctgct

SEQ ID NO: 4296819 - DNA, 17 bp, Homo sapiens
ggagtcagggagccctg

SEQ ID NO: 4296820 - DNA, 14 bp, Homo sapiens
ggagtccagacctg

SEQ ID NO: 4296821 - DNA, 18 bp, Homo sapiens
ggagtccagacctgggcc

SEQ ID NO: 4296822 - DNA, 23 bp, Homo sapiens
ggagtccagacctgggccctggt

SEQ ID NO: 4296823 - DNA, 16 bp, Homo sapiens
ggagtcctgttctcag

SEQ ID NO: 4296824 - DNA, 20 bp, Homo sapiens
ggagtcctgttctcagagct

SEQ ID NO: 4296825 - DNA, 17 bp, Homo sapiens
ggagtcgagctggccga

SEQ ID NO: 4296826 - DNA, 16 bp, Homo sapiens
ggagtctgaaggagag

SEQ ID NO: 4296827 - DNA, 17 bp, Homo sapiens
ggagtctgaaggagagg

SEQ ID NO: 4296828 - DNA, 19 bp, Homo sapiens
ggagtctgaaggagaggag

SEQ ID NO: 4296829 - DNA, 21 bp, Homo sapiens
ggagtgagtgtggctcccctc

SEQ ID NO: 4296830 - DNA, 17 bp, Homo sapiens
ggagtgggacagagtct

SEQ ID NO: 4296831 - DNA, 18 bp, Homo sapiens
ggagtgggacagagtctg

SEQ ID NO: 4296832 - DNA, 14 bp, Homo sapiens
ggagtgggagagga

SEQ ID NO: 4296833 - DNA, 17 bp, Homo sapiens
ggagtgggagaggaagc

SEQ ID NO: 4296834 - DNA, 24 bp, Homo sapiens
ggagtggtaacaagaggagcagga

SEQ ID NO: 4296835 - DNA, 20 bp, Homo sapiens
ggagtgtgggggtgccatgg

SEQ ID NO: 4296836 - DNA, 16 bp, Homo sapiens
ggagttctaacacatt

SEQ ID NO: 4296837 - DNA, 16 bp, Homo sapiens
ggatactgcccggggc

SEQ ID NO: 4296838 - DNA, 11 bp, Homo sapiens
ggatccagaga

SEQ ID NO: 4296839 - DNA, 15 bp, Homo sapiens
ggatccagagagaag

SEQ ID NO: 4296840 - DNA, 15 bp, Homo sapiens
ggatctccaggccca

SEQ ID NO: 4296841 - DNA, 18 bp, Homo sapiens
ggatctcttaagacagca

SEQ ID NO: 4296842 - DNA, 13 bp, Homo sapiens
ggatgcatgcagg

SEQ ID NO: 4296843 - DNA, 22 bp, Homo sapiens
ggatggatctgctccatgcaga

SEQ ID NO: 4296844 - DNA, 21 bp, Homo sapiens
ggatggcgtgtcccctgcctg

SEQ ID NO: 4296845 - DNA, 12 bp, Homo sapiens
ggatgggcacag

SEQ ID NO: 4296846 - DNA, 16 bp, Homo sapiens
ggatgggcacaggctg

SEQ ID NO: 4296847 - DNA, 17 bp, Homo sapiens
ggatgggcacaggctgc

SEQ ID NO: 4296848 - DNA, 20 bp, Homo sapiens
ggatggggttgggctctgcg

SEQ ID NO: 4296849 - DNA, 20 bp, Homo sapiens
ggatgtttaatcaagagaga

SEQ ID NO: 4296850 - DNA, 15 bp, Homo sapiens
ggattcaaatgcatg

SEQ ID NO: 4296851 - DNA, 11 bp, Homo sapiens
ggattcaaatt

SEQ ID NO: 4296852 - DNA, 12 bp, Homo sapiens
ggattcaggaat

SEQ ID NO: 4296853 - DNA, 15 bp, Homo sapiens
ggattctaaattatg

SEQ ID NO: 4296854 - DNA, 21 bp, Homo sapiens
ggattggcaggtgtgggctcc

SEQ ID NO: 4296855 - DNA, 19 bp, Homo sapiens
ggattgtccacaaatgtcc

SEQ ID NO: 4296856 - DNA, 17 bp, Homo sapiens
ggatttcaagggactgg

SEQ ID NO: 4296857 - DNA, 13 bp, Homo sapiens
ggatttctcccag

SEQ ID NO: 4296858 - DNA, 18 bp, Homo sapiens
ggcaagaaggaattgact

SEQ ID NO: 4296859 - DNA, 21 bp, Homo sapiens
ggcaagagctcaggagaaggc

SEQ ID NO: 4296860 - DNA, 13 bp, Homo sapiens
ggcaagtgattga

SEQ ID NO: 4296861 - DNA, 17 bp, Homo sapiens
ggcacaccctctctgtc

SEQ ID NO: 4296862 - DNA, 14 bp, Homo sapiens
ggcacaggctgccc

SEQ ID NO: 4296863 - DNA, 21 bp, Homo sapiens
ggcacaggctgccccacccct

SEQ ID NO: 4296864 - DNA, 17 bp, Homo sapiens
ggcacctggggagtggg

SEQ ID NO: 4296865 - DNA, 13 bp, Homo sapiens
ggcactgtggcct

SEQ ID NO: 4296866 - DNA, 15 bp, Homo sapiens
ggcacttaagcacaa

SEQ ID NO: 4296867 - DNA, 13 bp, Homo sapiens
ggcagaactgagc

SEQ ID NO: 4296868 - DNA, 22 bp, Homo sapiens
ggcagaaggaggaagggactgg

SEQ ID NO: 4296869 - DNA, 20 bp, Homo sapiens
ggcagacattgtgctagtgc

SEQ ID NO: 4296870 - DNA, 23 bp, Homo sapiens
ggcagagattgggggggcttggg

SEQ ID NO: 4296871 - DNA, 19 bp, Homo sapiens
ggcagagctcagcacagcc

SEQ ID NO: 4296872 - DNA, 15 bp, Homo sapiens
ggcagaggggagagg

SEQ ID NO: 4296873 - DNA, 21 bp, Homo sapiens
ggcagattggttcatgcctgg

SEQ ID NO: 4296874 - DNA, 21 bp, Homo sapiens
ggcagcaacaaaggatttgaa

SEQ ID NO: 4296875 - DNA, 20 bp, Homo sapiens
ggcagcaacaggaccaggag

SEQ ID NO: 4296876 - DNA, 21 bp, Homo sapiens
ggcagcaacaggaccaggagc

SEQ ID NO: 4296877 - DNA, 23 bp, Homo sapiens
ggcagcaacaggaccaggagcca

SEQ ID NO: 4296878 - DNA, 13 bp, Homo sapiens
ggcagcccagaga

SEQ ID NO: 4296879 - DNA, 14 bp, Homo sapiens
ggcagcccagagag

SEQ ID NO: 4296880 - DNA, 23 bp, Homo sapiens
ggcagccccccagtgtccccagg

SEQ ID NO: 4296881 - DNA, 13 bp, Homo sapiens
ggcagcccctccc

SEQ ID NO: 4296882 - DNA, 18 bp, Homo sapiens
ggcagccgtgccttcagc

SEQ ID NO: 4296883 - DNA, 22 bp, Homo sapiens
ggcagccgtgccttcagctcta

SEQ ID NO: 4296884 - DNA, 12 bp, Homo sapiens
ggcagcctcaga

SEQ ID NO: 4296885 - DNA, 17 bp, Homo sapiens
ggcagcctcagaggccc

SEQ ID NO: 4296886 - DNA, 12 bp, Homo sapiens
ggcagcctgtgg

SEQ ID NO: 4296887 - DNA, 16 bp, Homo sapiens
gttcacgcaacttgaa

SEQ ID NO: 4296888 - DNA, 24 bp, Homo sapiens
gttcactctacttagcatgtccct

SEQ ID NO: 4296889 - DNA, 16 bp, Homo sapiens
gttcatgcctggggtg

SEQ ID NO: 4296890 - DNA, 12 bp, Homo sapiens
gttccagacaga

SEQ ID NO: 4296891 - DNA, 13 bp, Homo sapiens
gttccagacagag

SEQ ID NO: 4296892 - DNA, 16 bp, Homo sapiens
gttccagacagggtgg

SEQ ID NO: 4296893 - DNA, 16 bp, Homo sapiens
gttccatgaagacaaa

SEQ ID NO: 4296894 - DNA, 17 bp, Homo sapiens
gttcccactggctcctc

SEQ ID NO: 4296895 - DNA, 18 bp, Homo sapiens
gttcccccaggaccctga

SEQ ID NO: 4296896 - DNA, 20 bp, Homo sapiens
gttcccccaggaccctgagg

SEQ ID NO: 4296897 - DNA, 12 bp, Homo sapiens
gttcctgcatgc

SEQ ID NO: 4296898 - DNA, 16 bp, Homo sapiens
gttctaacacatttcg

SEQ ID NO: 4296899 - DNA, 21 bp, Homo sapiens
gttctagaaggggcgaggctt

SEQ ID NO: 4296900 - DNA, 21 bp, Homo sapiens
gttctagttagcaggaaatag

SEQ ID NO: 4296901 - DNA, 13 bp, Homo sapiens
gttctcagagctc

SEQ ID NO: 4296902 - DNA, 15 bp, Homo sapiens
gttctcagagctcca

SEQ ID NO: 4296903 - DNA, 16 bp, Homo sapiens
gttctgaataatttct

SEQ ID NO: 4296904 - DNA, 18 bp, Homo sapiens
gttctgaataatttctta

SEQ ID NO: 4296905 - DNA, 11 bp, Homo sapiens
gttctggagga

SEQ ID NO: 4296906 - DNA, 13 bp, Homo sapiens
gttctggaggagg

SEQ ID NO: 4296907 - DNA, 13 bp, Homo sapiens
gttctggcctctg

SEQ ID NO: 4296908 - DNA, 14 bp, Homo sapiens
gttctggcctctgg

SEQ ID NO: 4296909 - DNA, 16 bp, Homo sapiens
gttctgttttgcctga

SEQ ID NO: 4296910 - DNA, 15 bp, Homo sapiens
gttcttgcagcagag

SEQ ID NO: 4296911 - DNA, 17 bp, Homo sapiens
gttcttgcagcagagag

SEQ ID NO: 4296912 - DNA, 21 bp, Homo sapiens
gttcttgcagtcatcagaagt

SEQ ID NO: 4296913 - DNA, 21 bp, Homo sapiens
gttcttttttaagactcaatc

SEQ ID NO: 4296914 - DNA, 13 bp, Homo sapiens
gttgaaattaagc

SEQ ID NO: 4296915 - DNA, 21 bp, Homo sapiens
gttgacacattgcacacacag

SEQ ID NO: 4296916 - DNA, 20 bp, Homo sapiens
gttgacacggccatgaccac

SEQ ID NO: 4296917 - DNA, 20 bp, Homo sapiens
gttgaggggcttccctctgc

SEQ ID NO: 4296918 - DNA, 21 bp, Homo sapiens
gttgaggggcttccctctgct

SEQ ID NO: 4296919 - DNA, 15 bp, Homo sapiens
gttgataaaaatact

SEQ ID NO: 4296920 - DNA, 20 bp, Homo sapiens
gttgataatagtaatggttc

SEQ ID NO: 4296921 - DNA, 19 bp, Homo sapiens
gttgattaatttctgccat

SEQ ID NO: 4296922 - DNA, 21 bp, Homo sapiens
gttgattctcatgcactgcaa

SEQ ID NO: 4296923 - DNA, 16 bp, Homo sapiens
gttgcacagcatctca

SEQ ID NO: 4296924 - DNA, 15 bp, Homo sapiens
gttgcctctctgcca

SEQ ID NO: 4296925 - DNA, 16 bp, Homo sapiens
gttgcctctctgccag

SEQ ID NO: 4296926 - DNA, 14 bp, Homo sapiens
gttggaactgctgc

SEQ ID NO: 4296927 - DNA, 13 bp, Homo sapiens
gttggactgtggc

SEQ ID NO: 4296928 - DNA, 15 bp, Homo sapiens
gttggactgtggcct

SEQ ID NO: 4296929 - DNA, 13 bp, Homo sapiens
gttggaggcctgg

SEQ ID NO: 4296930 - DNA, 19 bp, Homo sapiens
gttggaggcctggtctgga

SEQ ID NO: 4296931 - DNA, 13 bp, Homo sapiens
gttggctgggccc

SEQ ID NO: 4296932 - DNA, 16 bp, Homo sapiens
gttggctgggcccaga

SEQ ID NO: 4296933 - DNA, 19 bp, Homo sapiens
gttgggccccagggaacta

SEQ ID NO: 4296934 - DNA, 12 bp, Homo sapiens
gttggggtgggg

SEQ ID NO: 4296935 - DNA, 16 bp, Homo sapiens
gttggtgttcttccca

SEQ ID NO: 4296936 - DNA, 20 bp, Homo sapiens
gttggtgttcttcccaaagc

SEQ ID NO: 4296937 - DNA, 20 bp, Homo sapiens
gttggttttgcatgtctgca

SEQ ID NO: 4296938 - DNA, 22 bp, Homo sapiens
gttgtaggactaaataatgatc

SEQ ID NO: 4296939 - DNA, 12 bp, Homo sapiens
gttgtccctgca

SEQ ID NO: 4296940 - DNA, 13 bp, Homo sapiens
gttgtccctgcag

SEQ ID NO: 4296941 - DNA, 14 bp, Homo sapiens
gttgtccctgcagg

SEQ ID NO: 4296942 - DNA, 20 bp, Homo sapiens
gttgtgattccccggagctg

SEQ ID NO: 4296943 - DNA, 16 bp, Homo sapiens
gttgttgtccctgcag

SEQ ID NO: 4296944 - DNA, 13 bp, Homo sapiens
gttgttttctctg

SEQ ID NO: 4296945 - DNA, 15 bp, Homo sapiens
gttgttttctctgat

SEQ ID NO: 4296946 - DNA, 17 bp, Homo sapiens
gtttaaaaaaataacat

SEQ ID NO: 4296947 - DNA, 20 bp, Homo sapiens
gtttaaaactagttagattc

SEQ ID NO: 4296948 - DNA, 20 bp, Homo sapiens
gtttaattgtataaaacagt

SEQ ID NO: 4296949 - DNA, 23 bp, Homo sapiens
gtttaattgtataaaacagtgtt

SEQ ID NO: 4296950 - DNA, 19 bp, Homo sapiens
gtttaattgtttgtcctca

SEQ ID NO: 4296951 - DNA, 23 bp, Homo sapiens
gtttacatgagttcaaatacttt

SEQ ID NO: 4296952 - DNA, 13 bp, Homo sapiens
gtttaccctccct

SEQ ID NO: 4296953 - DNA, 17 bp, Homo sapiens
gtttaccctccctgtcc

SEQ ID NO: 4296954 - DNA, 15 bp, Homo sapiens
gtttagaatgtcagt

SEQ ID NO: 4296955 - DNA, 22 bp, Homo sapiens
gtttatggtattttcgtgcatt

SEQ ID NO: 4296956 - DNA, 22 bp, Homo sapiens
gtttatgtgctattaatatttg

SEQ ID NO: 4296957 - DNA, 15 bp, Homo sapiens
gtttcactgttcatg

SEQ ID NO: 4296958 - DNA, 21 bp, Homo sapiens
gtttcagaaagggcagcccct

SEQ ID NO: 4296959 - DNA, 18 bp, Homo sapiens
gtttcagctgaccagaag

SEQ ID NO: 4296960 - DNA, 17 bp, Homo sapiens
gtttcaggtggaacagg

SEQ ID NO: 4296961 - DNA, 23 bp, Homo sapiens
gtttccaagcctgggccactggc

SEQ ID NO: 4296962 - DNA, 14 bp, Homo sapiens
gtttccacacaggc

SEQ ID NO: 4296963 - DNA, 19 bp, Homo sapiens
gtttccagctaagcctgat

SEQ ID NO: 4296964 - DNA, 18 bp, Homo sapiens
gtttccaggcatgaccct

SEQ ID NO: 4296965 - DNA, 19 bp, Homo sapiens
gtttccaggcatgaccctg

SEQ ID NO: 4296966 - DNA, 20 bp, Homo sapiens
gtttctatactgtttgtaat

SEQ ID NO: 4296967 - DNA, 21 bp, Homo sapiens
gtttctatactgtttgtaata

SEQ ID NO: 4296968 - DNA, 11 bp, Homo sapiens
gtttgcctctg

SEQ ID NO: 4296969 - DNA, 12 bp, Homo sapiens
gtttgcctctgc

SEQ ID NO: 4296970 - DNA, 17 bp, Homo sapiens
gtttgctcacccaggac

SEQ ID NO: 4296971 - DNA, 18 bp, Homo sapiens
gtttgctcacccaggacc

SEQ ID NO: 4296972 - DNA, 23 bp, Homo sapiens
gtttgctcacccaggacctctgg

SEQ ID NO: 4296973 - DNA, 19 bp, Homo sapiens
gtttgctgtatacaaacag

SEQ ID NO: 4296974 - DNA, 21 bp, Homo sapiens
gtttggcgggccaaggactgc

SEQ ID NO: 4296975 - DNA, 11 bp, Homo sapiens
gtttggggcga

SEQ ID NO: 4296976 - DNA, 17 bp, Homo sapiens
gtttggggcgaggcaga

SEQ ID NO: 4296977 - DNA, 15 bp, Homo sapiens
gtttgtaatatacag

SEQ ID NO: 4296978 - DNA, 15 bp, Homo sapiens
gtttgtatataaatg

SEQ ID NO: 4296979 - DNA, 23 bp, Homo sapiens
gttttaattccaagtgtttctgt

SEQ ID NO: 4296980 - DNA, 17 bp, Homo sapiens
gttttcgaagctcagcc

SEQ ID NO: 4296981 - DNA, 19 bp, Homo sapiens
gttttcgaagctcagccca

SEQ ID NO: 4296982 - DNA, 13 bp, Homo sapiens
gttttctaaatgt

SEQ ID NO: 4296983 - DNA, 20 bp, Homo sapiens
gttttctaaatgtttctttt

SEQ ID NO: 4296984 - DNA, 19 bp, Homo sapiens
gttttgcctcatgaacact

SEQ ID NO: 4296985 - DNA, 23 bp, Homo sapiens
gtttttcaggtatatacctccat

SEQ ID NO: 4296986 - DNA, 11 bp, Homo sapiens
gtttttgtaac

SEQ ID NO: 4296987 - DNA, 19 bp, Homo sapiens
gtttttgtatctttaaaga

SEQ ID NO: 4296988 - DNA, 15 bp, Homo sapiens
taaaaaaaaaaatga

SEQ ID NO: 4296989 - DNA, 13 bp, Homo sapiens
taaaaaataacat

SEQ ID NO: 4296990 - DNA, 14 bp, Homo sapiens
taaaaaataactgt

SEQ ID NO: 4296991 - DNA, 18 bp, Homo sapiens
taaaaacacctaagtgac

SEQ ID NO: 4296992 - DNA, 14 bp, Homo sapiens
taaaaatatgtgag

SEQ ID NO: 4296993 - DNA, 18 bp, Homo sapiens
taaaaatatgtgagcatg

SEQ ID NO: 4296994 - DNA, 10 bp, Homo sapiens
taaaaatatt

SEQ ID NO: 4296995 - DNA, 20 bp, Homo sapiens
taaaacattatagattttca

SEQ ID NO: 4296996 - DNA, 14 bp, Homo sapiens
taaaaccttactta

SEQ ID NO: 4296997 - DNA, 18 bp, Homo sapiens
taaaaccttacttaaagc

SEQ ID NO: 4296998 - DNA, 22 bp, Homo sapiens
taaaagagaccacccatatcat

SEQ ID NO: 4296999 - DNA, 14 bp, Homo sapiens
taaaaggaggacag

SEQ ID NO: 4297000 - DNA, 21 bp, Homo sapiens
taaaaggaggacagggaggga

SEQ ID NO: 4297001 - DNA, 14 bp, Homo sapiens
taaaataatgattt

SEQ ID NO: 4297002 - DNA, 22 bp, Homo sapiens
taaaataatgatttaagcattt

SEQ ID NO: 4297003 - DNA, 19 bp, Homo sapiens
taaaatactcaccaaaata

SEQ ID NO: 4297004 - DNA, 13 bp, Homo sapiens
taaaatagttttc

SEQ ID NO: 4297005 - DNA, 17 bp, Homo sapiens
taaaatagttttctaaa

SEQ ID NO: 4297006 - DNA, 21 bp, Homo sapiens
taaaatagttttctaaatgtt

SEQ ID NO: 4297007 - DNA, 17 bp, Homo sapiens
taaaatctcctaaatgc

SEQ ID NO: 4297008 - DNA, 12 bp, Homo sapiens
taaaatgtatta

SEQ ID NO: 4297009 - DNA, 13 bp, Homo sapiens
taaaattacagaa

SEQ ID NO: 4297010 - DNA, 21 bp, Homo sapiens
taaaattagtgagatttgtat

SEQ ID NO: 4297011 - DNA, 15 bp, Homo sapiens
taaaattatactgtg

SEQ ID NO: 4297012 - DNA, 20 bp, Homo sapiens
taaaattatactgtgtgtga

SEQ ID NO: 4297013 - DNA, 14 bp, Homo sapiens
taaaattcaacaaa

SEQ ID NO: 4297014 - DNA, 15 bp, Homo sapiens
taaaattcaacaaat

SEQ ID NO: 4297015 - DNA, 11 bp, Homo sapiens
taaacaaatgg

SEQ ID NO: 4297016 - DNA, 16 bp, Homo sapiens
taaacaattcaagtga

SEQ ID NO: 4297017 - DNA, 18 bp, Homo sapiens
taaacacagattatttgt

SEQ ID NO: 4297018 - DNA, 20 bp, Homo sapiens
taaacaccatgaagatgcca

SEQ ID NO: 4297019 - DNA, 16 bp, Homo sapiens
taaacagttgcacagc

SEQ ID NO: 4297020 - DNA, 17 bp, Homo sapiens
taaacagttgcacagca

SEQ ID NO: 4297021 - DNA, 18 bp, Homo sapiens
taaacagttgcacagcat

SEQ ID NO: 4297022 - DNA, 19 bp, Homo sapiens
taaacagttgcacagcatc

SEQ ID NO: 4297023 - DNA, 12 bp, Homo sapiens
taaaccttaata

SEQ ID NO: 4297024 - DNA, 15 bp, Homo sapiens
taaacgaaacacaga

SEQ ID NO: 4297025 - DNA, 14 bp, Homo sapiens
taaactctgaaatc

SEQ ID NO: 4297026 - DNA, 16 bp, Homo sapiens
taaactgttttcatgt

SEQ ID NO: 4297027 - DNA, 17 bp, Homo sapiens
taaactgttttcatgtg

SEQ ID NO: 4297028 - DNA, 18 bp, Homo sapiens
taaactgttttcatgtgt

SEQ ID NO: 4297029 - DNA, 20 bp, Homo sapiens
taaagaaaggcagagattgg

SEQ ID NO: 4297030 - DNA, 21 bp, Homo sapiens
taaagacatttaaaatagttt

SEQ ID NO: 4297031 - DNA, 22 bp, Homo sapiens
taaagacatttaaaatagtttt

SEQ ID NO: 4297032 - DNA, 12 bp, Homo sapiens
taaagacttgat

SEQ ID NO: 4297033 - DNA, 18 bp, Homo sapiens
taaagacttgatgaataa

SEQ ID NO: 4297034 - DNA, 20 bp, Homo sapiens
taaagaggagcctttccaga

SEQ ID NO: 4297035 - DNA, 18 bp, Homo sapiens
taaagaggcgtcttgtat

SEQ ID NO: 4297036 - DNA, 22 bp, Homo sapiens
taaagaggcgtcttgtattttc

SEQ ID NO: 4297037 - DNA, 17 bp, Homo sapiens
taaagtaaatgctacct

SEQ ID NO: 4297038 - DNA, 18 bp, Homo sapiens
taaagtgagaaaactgtg

SEQ ID NO: 4297039 - DNA, 20 bp, Homo sapiens
taaagttagggcatttttct

SEQ ID NO: 4297040 - DNA, 14 bp, Homo sapiens
taaataaagaagaa

SEQ ID NO: 4297041 - DNA, 15 bp, Homo sapiens
taaataaagaagaaa

SEQ ID NO: 4297042 - DNA, 16 bp, Homo sapiens
taaataaataaaaata

SEQ ID NO: 4297043 - DNA, 13 bp, Homo sapiens
taaataatctcat

SEQ ID NO: 4297044 - DNA, 16 bp, Homo sapiens
taaatatatatttatc

SEQ ID NO: 4297045 - DNA, 18 bp, Homo sapiens
taaatatatatttatcat

SEQ ID NO: 4297046 - DNA, 23 bp, Homo sapiens
taaatatctatttatctgtctga

SEQ ID NO: 4297047 - DNA, 14 bp, Homo sapiens
taaatatgaaattt

SEQ ID NO: 4297048 - DNA, 14 bp, Homo sapiens
taaatccattttct

SEQ ID NO: 4297049 - DNA, 15 bp, Homo sapiens
taaatctgtctgatt

SEQ ID NO: 4297050 - DNA, 17 bp, Homo sapiens
taaatgaggggcctcag

SEQ ID NO: 4297051 - DNA, 14 bp, Homo sapiens
taaatgattccaaa

SEQ ID NO: 4297052 - DNA, 15 bp, Homo sapiens
taaatgatttaaatt

SEQ ID NO: 4297053 - DNA, 15 bp, Homo sapiens
taaatgctacctctg

SEQ ID NO: 4297054 - DNA, 17 bp, Homo sapiens
taaatggtgagaattaa

SEQ ID NO: 4297055 - DNA, 18 bp, Homo sapiens
taaatggtgagaattaaa

SEQ ID NO: 4297056 - DNA, 23 bp, Homo sapiens
taaatggtgagaattaaaataaa

SEQ ID NO: 4297057 - DNA, 11 bp, Homo sapiens
taaatgtgtgt

SEQ ID NO: 4297058 - DNA, 21 bp, Homo sapiens
taaattaatgagttttatcca

SEQ ID NO: 4297059 - DNA, 16 bp, Homo sapiens
taaattactatagcaa

SEQ ID NO: 4297060 - DNA, 18 bp, Homo sapiens
taaattcaacacttattt

SEQ ID NO: 4297061 - DNA, 22 bp, Homo sapiens
taaattcaacacttattttctg

SEQ ID NO: 4297062 - DNA, 16 bp, Homo sapiens
taaatttaactgcata

SEQ ID NO: 4297063 - DNA, 22 bp, Homo sapiens
taaatttaagtaagttttataa

SEQ ID NO: 4297064 - DNA, 15 bp, Homo sapiens
taaattttaatgtaa

SEQ ID NO: 4297065 - DNA, 17 bp, Homo sapiens
taaattttaatgtaaaa

SEQ ID NO: 4297066 - DNA, 16 bp, Homo sapiens
taacacataaagtaaa

SEQ ID NO: 4297067 - DNA, 12 bp, Homo sapiens
taacacatttcg

SEQ ID NO: 4297068 - DNA, 20 bp, Homo sapiens
taacatacatctaagtcagt

SEQ ID NO: 4297069 - DNA, 12 bp, Homo sapiens
taacatattctt

SEQ ID NO: 4297070 - DNA, 17 bp, Homo sapiens
taacatattcttgcttt

SEQ ID NO: 4297071 - DNA, 15 bp, Homo sapiens
taacatgtctaaagt

SEQ ID NO: 4297072 - DNA, 23 bp, Homo sapiens
taacattaagtattccttggccc

SEQ ID NO: 4297073 - DNA, 14 bp, Homo sapiens
taaccacaactttc

SEQ ID NO: 4297074 - DNA, 22 bp, Homo sapiens
taacctttcaggaaagtatctc

SEQ ID NO: 4297075 - DNA, 21 bp, Homo sapiens
taactacctttggcttaattc

SEQ ID NO: 4297076 - DNA, 22 bp, Homo sapiens
taactacctttggcttaattcc

SEQ ID NO: 4297077 - DNA, 22 bp, Homo sapiens
taactactaagaataaataaag

SEQ ID NO: 4297078 - DNA, 16 bp, Homo sapiens
taactagatctcctgt

SEQ ID NO: 4297079 - DNA, 15 bp, Homo sapiens
taacttattcaaaga

SEQ ID NO: 4297080 - DNA, 17 bp, Homo sapiens
taacttattcaaagaga

SEQ ID NO: 4297081 - DNA, 12 bp, Homo sapiens
taacttcacctt

SEQ ID NO: 4297082 - DNA, 21 bp, Homo sapiens
taactttagaaataaacctta

SEQ ID NO: 4297083 - DNA, 13 bp, Homo sapiens
taagaaagctata

SEQ ID NO: 4297084 - DNA, 15 bp, Homo sapiens
taagaaatatctgtg

SEQ ID NO: 4297085 - DNA, 23 bp, Homo sapiens
taagaacccatggaaaaatgcca

SEQ ID NO: 4297086 - DNA, 14 bp, Homo sapiens
taagaagcaaataa

SEQ ID NO: 4297087 - DNA, 21 bp, Homo sapiens
taagaataaataaagaagaaa

SEQ ID NO: 4297088 - DNA, 14 bp, Homo sapiens
taagacagcatgtg

SEQ ID NO: 4297089 - DNA, 14 bp, Homo sapiens
taagattccagaga

SEQ ID NO: 4297090 - DNA, 20 bp, Homo sapiens
taagattgttattaaatgta

SEQ ID NO: 4297091 - DNA, 23 bp, Homo sapiens
taagattttattttcaagcaaat

SEQ ID NO: 4297092 - DNA, 16 bp, Homo sapiens
taagcaacatgaatta

SEQ ID NO: 4297093 - DNA, 20 bp, Homo sapiens
taagccaatgaagcaaacac

SEQ ID NO: 4297094 - DNA, 12 bp, Homo sapiens
taagcctcaggc

SEQ ID NO: 4297095 - DNA, 15 bp, Homo sapiens
taagcctcaggcctg

SEQ ID NO: 4297096 - DNA, 22 bp, Homo sapiens
taaggggaattaacaattgcca

SEQ ID NO: 4297097 - DNA, 17 bp, Homo sapiens
taagtccagctctcccc

SEQ ID NO: 4297098 - DNA, 21 bp, Homo sapiens
taagtctatctggtattaaat

SEQ ID NO: 4297099 - DNA, 16 bp, Homo sapiens
taagtcttactgtttt

SEQ ID NO: 4297100 - DNA, 13 bp, Homo sapiens
taagtggaaaaaa

SEQ ID NO: 4297101 - DNA, 17 bp, Homo sapiens
taagtggaaaaaagaga

SEQ ID NO: 4297102 - DNA, 18 bp, Homo sapiens
taagtggaaaaaagagaa

SEQ ID NO: 4297103 - DNA, 11 bp, Homo sapiens
taagtggagca

SEQ ID NO: 4297104 - DNA, 22 bp, Homo sapiens
taagttggctcacatcatgtaa

SEQ ID NO: 4297105 - DNA, 19 bp, Homo sapiens
taatagtaatggttctaga

SEQ ID NO: 4297106 - DNA, 19 bp, Homo sapiens
taatatagaaaaaaacatt

SEQ ID NO: 4297107 - DNA, 16 bp, Homo sapiens
taatatcttgaagaat

SEQ ID NO: 4297108 - DNA, 17 bp, Homo sapiens
taatatcttgaagaata

SEQ ID NO: 4297109 - DNA, 14 bp, Homo sapiens
taatatctttcagt

SEQ ID NO: 4297110 - DNA, 21 bp, Homo sapiens
taatatttaggcatgagctct

SEQ ID NO: 4297111 - DNA, 18 bp, Homo sapiens
taatcacactctcttctt

SEQ ID NO: 4297112 - DNA, 19 bp, Homo sapiens
taatcacttaacctgcttt

SEQ ID NO: 4297113 - DNA, 19 bp, Homo sapiens
taatcatttcttgggccct

SEQ ID NO: 4297114 - DNA, 22 bp, Homo sapiens
taatccatgtgctgctgtggca

SEQ ID NO: 4297115 - DNA, 12 bp, Homo sapiens
taatctgaaaca

SEQ ID NO: 4297116 - DNA, 19 bp, Homo sapiens
taatcttgttgataaaaat

SEQ ID NO: 4297117 - DNA, 13 bp, Homo sapiens
taatcttttctga

SEQ ID NO: 4297118 - DNA, 16 bp, Homo sapiens
taatgacccggccccc

SEQ ID NO: 4297119 - DNA, 19 bp, Homo sapiens
taatgatcttccaaatatt

SEQ ID NO: 4297120 - DNA, 22 bp, Homo sapiens
taatgccacggcagccaccctg

SEQ ID NO: 4297121 - DNA, 15 bp, Homo sapiens
taatgcctttgtaac

SEQ ID NO: 4297122 - DNA, 22 bp, Homo sapiens
taatggattataatcagaatgg

SEQ ID NO: 4297123 - DNA, 19 bp, Homo sapiens
taatgtaatcatttatctt

SEQ ID NO: 4297124 - DNA, 18 bp, Homo sapiens
taatgtatcttatttata

SEQ ID NO: 4297125 - DNA, 20 bp, Homo sapiens
taatgtcataaagtgagaaa

SEQ ID NO: 4297126 - DNA, 14 bp, Homo sapiens
taattaaaaaatag

SEQ ID NO: 4297127 - DNA, 18 bp, Homo sapiens
taattaaaaagttaatct

SEQ ID NO: 4297128 - DNA, 18 bp, Homo sapiens
taattagatccattaatt

SEQ ID NO: 4297129 - DNA, 21 bp, Homo sapiens
taattccaagtgtttctgttt

SEQ ID NO: 4297130 - DNA, 21 bp, Homo sapiens
taattctcttttcaaacacac

SEQ ID NO: 4297131 - DNA, 12 bp, Homo sapiens
taattgtataaa

SEQ ID NO: 4297132 - DNA, 20 bp, Homo sapiens
taatttaggagttttgagaa

SEQ ID NO: 4297133 - DNA, 18 bp, Homo sapiens
taatttctgccatttcat

SEQ ID NO: 4297134 - DNA, 19 bp, Homo sapiens
taatttcttactaaacatt

SEQ ID NO: 4297135 - DNA, 15 bp, Homo sapiens
taattttgtagtagt

SEQ ID NO: 4297136 - DNA, 19 bp, Homo sapiens
taattttgtagtagttgat

SEQ ID NO: 4297137 - DNA, 19 bp, Homo sapiens
taattttttagttaaaatc

SEQ ID NO: 4297138 - DNA, 9 bp, Homo sapiens
tacaaacat

SEQ ID NO: 4297139 - DNA, 23 bp, Homo sapiens
tacaaagggaagcagagcctggg

SEQ ID NO: 4297140 - DNA, 15 bp, Homo sapiens
tacaaatcagtaatt

SEQ ID NO: 4297141 - DNA, 12 bp, Homo sapiens
tacaaccttcat

SEQ ID NO: 4297142 - DNA, 15 bp, Homo sapiens
tacaaccttcattta

SEQ ID NO: 4297143 - DNA, 20 bp, Homo sapiens
tacaagtgctcagttccaat

SEQ ID NO: 4297144 - DNA, 13 bp, Homo sapiens
tacaatgtattaa

SEQ ID NO: 4297145 - DNA, 21 bp, Homo sapiens
tacacatgtatctatgcattt

SEQ ID NO: 4297146 - DNA, 17 bp, Homo sapiens
tacaccgggcctggaga

SEQ ID NO: 4297147 - DNA, 16 bp, Homo sapiens
tacactgtatctaaaa

SEQ ID NO: 4297148 - DNA, 17 bp, Homo sapiens
tacactgtatctaaaaa

SEQ ID NO: 4297149 - DNA, 23 bp, Homo sapiens
tacactgtatctaaaaaataact

SEQ ID NO: 4297150 - DNA, 20 bp, Homo sapiens
tacacttctcaaatgctact

SEQ ID NO: 4297151 - DNA, 18 bp, Homo sapiens
tacacttgagatgatttc

SEQ ID NO: 4297152 - DNA, 14 bp, Homo sapiens
tacagatttagttt

SEQ ID NO: 4297153 - DNA, 19 bp, Homo sapiens
tacagatttagtttaccaa

SEQ ID NO: 4297154 - DNA, 20 bp, Homo sapiens
tacagctgaaagacagtaaa

SEQ ID NO: 4297155 - DNA, 18 bp, Homo sapiens
tacagtaatgtcataaag

SEQ ID NO: 4297156 - DNA, 18 bp, Homo sapiens
gtatctcgaagtcttcca

SEQ ID NO: 4297157 - DNA, 18 bp, Homo sapiens
gtatctctactttcctga

SEQ ID NO: 4297158 - DNA, 21 bp, Homo sapiens
gtatctgctgcctctgaaaat

SEQ ID NO: 4297159 - DNA, 18 bp, Homo sapiens
gtatcttatttatatatg

SEQ ID NO: 4297160 - DNA, 19 bp, Homo sapiens
gtatctttaaagacttgat

SEQ ID NO: 4297161 - DNA, 20 bp, Homo sapiens
gtatgaaatatatgtgaaag

SEQ ID NO: 4297162 - DNA, 19 bp, Homo sapiens
gtatgaataaagacaccta

SEQ ID NO: 4297163 - DNA, 15 bp, Homo sapiens
gtatgcagtgtagat

SEQ ID NO: 4297164 - DNA, 15 bp, Homo sapiens
gtatggtgctgggtc

SEQ ID NO: 4297165 - DNA, 16 bp, Homo sapiens
gtatgtaaataggttt

SEQ ID NO: 4297166 - DNA, 23 bp, Homo sapiens
gtatgtgaaagtgtaaaatagaa

SEQ ID NO: 4297167 - DNA, 18 bp, Homo sapiens
gtatgtgaattgaagtca

SEQ ID NO: 4297168 - DNA, 23 bp, Homo sapiens
gtatgtgaattgaagtcatcata

SEQ ID NO: 4297169 - DNA, 16 bp, Homo sapiens
gtatgttttagcatgt

SEQ ID NO: 4297170 - DNA, 19 bp, Homo sapiens
gtattaagcccacagtata

SEQ ID NO: 4297171 - DNA, 21 bp, Homo sapiens
gtattaagcccacagtatatt

SEQ ID NO: 4297172 - DNA, 23 bp, Homo sapiens
gtattacacaagaccagtgctta

SEQ ID NO: 4297173 - DNA, 21 bp, Homo sapiens
gtattcaggaccccatctgct

SEQ ID NO: 4297174 - DNA, 19 bp, Homo sapiens
gtattccttggcccagcag

SEQ ID NO: 4297175 - DNA, 16 bp, Homo sapiens
gtatttatattagagt

SEQ ID NO: 4297176 - DNA, 19 bp, Homo sapiens
gtatttattttcctcccca

SEQ ID NO: 4297177 - DNA, 23 bp, Homo sapiens
gtatttattttcctccccagcag

SEQ ID NO: 4297178 - DNA, 15 bp, Homo sapiens
gtatttccaacaaac

SEQ ID NO: 4297179 - DNA, 22 bp, Homo sapiens
gtatttccaacaaacttactgt

SEQ ID NO: 4297180 - DNA, 22 bp, Homo sapiens
gtatttcttccagtgatgttga

SEQ ID NO: 4297181 - DNA, 17 bp, Homo sapiens
gtattttactttgtgca

SEQ ID NO: 4297182 - DNA, 18 bp, Homo sapiens
gtatttttagagattaat

SEQ ID NO: 4297183 - DNA, 16 bp, Homo sapiens
gtcaaaactccactca

SEQ ID NO: 4297184 - DNA, 19 bp, Homo sapiens
gtcaaaactccactcagca

SEQ ID NO: 4297185 - DNA, 21 bp, Homo sapiens
gtcaaaactccactcagcaca

SEQ ID NO: 4297186 - DNA, 21 bp, Homo sapiens
gtcaacaagtatgaataaaga

SEQ ID NO: 4297187 - DNA, 23 bp, Homo sapiens
gtcaacatttgttagaaccagtc

SEQ ID NO: 4297188 - DNA, 21 bp, Homo sapiens
gtcaaccttgtgtgagtgtga

SEQ ID NO: 4297189 - DNA, 13 bp, Homo sapiens
gtcaactccaagg

SEQ ID NO: 4297190 - DNA, 14 bp, Homo sapiens
gtcaactccaaggc

SEQ ID NO: 4297191 - DNA, 20 bp, Homo sapiens
gtcaactccaaggcaaatgt

SEQ ID NO: 4297192 - DNA, 16 bp, Homo sapiens
gtcaagattcagctag

SEQ ID NO: 4297193 - DNA, 15 bp, Homo sapiens
gtcaaggggccctag

SEQ ID NO: 4297194 - DNA, 17 bp, Homo sapiens
gtcaaggggccctagga

SEQ ID NO: 4297195 - DNA, 19 bp, Homo sapiens
gtcaataattgtggagagg

SEQ ID NO: 4297196 - DNA, 22 bp, Homo sapiens
gtcaataattgtggagaggaga

SEQ ID NO: 4297197 - DNA, 14 bp, Homo sapiens
gtcaatgtttgctt

SEQ ID NO: 4297198 - DNA, 21 bp, Homo sapiens
gtcacaccctccccattagta

SEQ ID NO: 4297199 - DNA, 17 bp, Homo sapiens
gtcacagaggcagtggc

SEQ ID NO: 4297200 - DNA, 19 bp, Homo sapiens
gtcacagaggcagtggcag

SEQ ID NO: 4297201 - DNA, 20 bp, Homo sapiens
gtcacagcagtacttgctca

SEQ ID NO: 4297202 - DNA, 13 bp, Homo sapiens
gtcacatatcaag

SEQ ID NO: 4297203 - DNA, 21 bp, Homo sapiens
gtcaccatctcaggccacctg

SEQ ID NO: 4297204 - DNA, 16 bp, Homo sapiens
gtcacctcagagacat

SEQ ID NO: 4297205 - DNA, 21 bp, Homo sapiens
gtcaccttcctgggcagccca

SEQ ID NO: 4297206 - DNA, 21 bp, Homo sapiens
gtcacgttttgcctcatgaac

SEQ ID NO: 4297207 - DNA, 15 bp, Homo sapiens
gtcactgcctggagt

SEQ ID NO: 4297208 - DNA, 19 bp, Homo sapiens
gtcacttcaaacatgccct

SEQ ID NO: 4297209 - DNA, 14 bp, Homo sapiens
gtcagagctgggag

SEQ ID NO: 4297210 - DNA, 13 bp, Homo sapiens
gtcagcagggggg

SEQ ID NO: 4297211 - DNA, 15 bp, Homo sapiens
gtcagcggcctgggg

SEQ ID NO: 4297212 - DNA, 17 bp, Homo sapiens
gtcagcggcctggggac

SEQ ID NO: 4297213 - DNA, 13 bp, Homo sapiens
gtcaggagccagc

SEQ ID NO: 4297214 - DNA, 14 bp, Homo sapiens
gtcagggaccaagg

SEQ ID NO: 4297215 - DNA, 16 bp, Homo sapiens
gtcagggagccctggg

SEQ ID NO: 4297216 - DNA, 14 bp, Homo sapiens
gtcagggcggggct

SEQ ID NO: 4297217 - DNA, 15 bp, Homo sapiens
gtcagggcggggctg

SEQ ID NO: 4297218 - DNA, 15 bp, Homo sapiens
gtcagtcgtgttgct

SEQ ID NO: 4297219 - DNA, 22 bp, Homo sapiens
gtcagtgtgccaccctctgcag

SEQ ID NO: 4297220 - DNA, 21 bp, Homo sapiens
gtcataaagtgagaaaactgt

SEQ ID NO: 4297221 - DNA, 12 bp, Homo sapiens
gtcataccatcc

SEQ ID NO: 4297222 - DNA, 22 bp, Homo sapiens
gtcatcccggggccatggaagc

SEQ ID NO: 4297223 - DNA, 16 bp, Homo sapiens
gtcatcctgggcatgt

SEQ ID NO: 4297224 - DNA, 21 bp, Homo sapiens
gtcattaaagtgcactgtgtc

SEQ ID NO: 4297225 - DNA, 24 bp, Homo sapiens
gtcattaaattactatagcaaagt

SEQ ID NO: 4297226 - DNA, 14 bp, Homo sapiens
gtcatttataaaac

SEQ ID NO: 4297227 - DNA, 15 bp, Homo sapiens
gtcatttcatttcct

SEQ ID NO: 4297228 - DNA, 22 bp, Homo sapiens
gtccaaccccggggcatggaca

SEQ ID NO: 4297229 - DNA, 22 bp, Homo sapiens
gtccacattctgctgcccccag

SEQ ID NO: 4297230 - DNA, 22 bp, Homo sapiens
gtccaccccgttgttgtccctg

SEQ ID NO: 4297231 - DNA, 17 bp, Homo sapiens
gtccacccgtttccaag

SEQ ID NO: 4297232 - DNA, 16 bp, Homo sapiens
gtccacctgtgctgct

SEQ ID NO: 4297233 - DNA, 17 bp, Homo sapiens
gtccagaggaggtgccc

SEQ ID NO: 4297234 - DNA, 22 bp, Homo sapiens
gtccagaggaggtgcccgggca

SEQ ID NO: 4297235 - DNA, 23 bp, Homo sapiens
gtccaggcatgggtcccttcccc

SEQ ID NO: 4297236 - DNA, 18 bp, Homo sapiens
gtccagtgaccctggagc

SEQ ID NO: 4297237 - DNA, 13 bp, Homo sapiens
gtccatctgtctg

SEQ ID NO: 4297238 - DNA, 18 bp, Homo sapiens
gtccatctgtctgtccta

SEQ ID NO: 4297239 - DNA, 18 bp, Homo sapiens
gtccatgtgaaatttaca

SEQ ID NO: 4297240 - DNA, 16 bp, Homo sapiens
gtccattgcaaaaggt

SEQ ID NO: 4297241 - DNA, 16 bp, Homo sapiens
gtccatttttacaagt

SEQ ID NO: 4297242 - DNA, 23 bp, Homo sapiens
gtccatttttacaagttatagta

SEQ ID NO: 4297243 - DNA, 16 bp, Homo sapiens
gtcccacaaaatattt

SEQ ID NO: 4297244 - DNA, 17 bp, Homo sapiens
gtcccacaaaatatttc

SEQ ID NO: 4297245 - DNA, 22 bp, Homo sapiens
gtcccacaaaatatttctaagc

SEQ ID NO: 4297246 - DNA, 14 bp, Homo sapiens
gtcccactgagtct

SEQ ID NO: 4297247 - DNA, 22 bp, Homo sapiens
gtcccagaaaaagcatcatggc

SEQ ID NO: 4297248 - DNA, 21 bp, Homo sapiens
gtccccagtgtggactctgga

SEQ ID NO: 4297249 - DNA, 22 bp, Homo sapiens
gtcccccttcgtggagctctaa

SEQ ID NO: 4297250 - DNA, 20 bp, Homo sapiens
gtcccgaatggagtccagac

SEQ ID NO: 4297251 - DNA, 23 bp, Homo sapiens
gtcccgaatggagtccagacctg

SEQ ID NO: 4297252 - DNA, 19 bp, Homo sapiens
gtcccggagctcaggccct

SEQ ID NO: 4297253 - DNA, 22 bp, Homo sapiens
gtccctaccgagtctcttctcc

SEQ ID NO: 4297254 - DNA, 23 bp, Homo sapiens
gtccctaccgagtctcttctcca

SEQ ID NO: 4297255 - DNA, 21 bp, Homo sapiens
gtccctccctcctggctcaca

SEQ ID NO: 4297256 - DNA, 14 bp, Homo sapiens
gtccctctcaggca

SEQ ID NO: 4297257 - DNA, 18 bp, Homo sapiens
gtccctgagaagcctcat

SEQ ID NO: 4297258 - DNA, 13 bp, Homo sapiens
gtccctgcagggc

SEQ ID NO: 4297259 - DNA, 12 bp, Homo sapiens
gtccctgccccg

SEQ ID NO: 4297260 - DNA, 14 bp, Homo sapiens
gtccctgccccgcc

SEQ ID NO: 4297261 - DNA, 15 bp, Homo sapiens
gtccctgccccgccc

SEQ ID NO: 4297262 - DNA, 19 bp, Homo sapiens
gtccctgccccgcccccca

SEQ ID NO: 4297263 - DNA, 15 bp, Homo sapiens
gtccctgcctggccc

SEQ ID NO: 4297264 - DNA, 19 bp, Homo sapiens
gtccctgtccctgccccgc

SEQ ID NO: 4297265 - DNA, 15 bp, Homo sapiens
gtccggcttggctag

SEQ ID NO: 4297266 - DNA, 14 bp, Homo sapiens
gtcctaaatgcaaa

SEQ ID NO: 4297267 - DNA, 16 bp, Homo sapiens
gtcctacccgcccgcg

SEQ ID NO: 4297268 - DNA, 18 bp, Homo sapiens
gtcctagaatgtttcatt

SEQ ID NO: 4297269 - DNA, 22 bp, Homo sapiens
gtcctatccccggaccggacgc

SEQ ID NO: 4297270 - DNA, 22 bp, Homo sapiens
gtcctatccccggacgcatgca

SEQ ID NO: 4297271 - DNA, 14 bp, Homo sapiens
gtcctatccctgga

SEQ ID NO: 4297272 - DNA, 21 bp, Homo sapiens
gtcctcagagggtccctaggt

SEQ ID NO: 4297273 - DNA, 13 bp, Homo sapiens
gtcctcaggcagt

SEQ ID NO: 4297274 - DNA, 13 bp, Homo sapiens
gtcctgcactgtc

SEQ ID NO: 4297275 - DNA, 18 bp, Homo sapiens
gtcctgctcagatgctgg

SEQ ID NO: 4297276 - DNA, 10 bp, Homo sapiens
gtcctgggcc

SEQ ID NO: 4297277 - DNA, 15 bp, Homo sapiens
gtcctgggggctgct

SEQ ID NO: 4297278 - DNA, 12 bp, Homo sapiens
gtcctggggtgg

SEQ ID NO: 4297279 - DNA, 23 bp, Homo sapiens
gtcctggggtggttggaggcctg

SEQ ID NO: 4297280 - DNA, 21 bp, Homo sapiens
gtcctgtcctggctcccaggg

SEQ ID NO: 4297281 - DNA, 14 bp, Homo sapiens
gtcctgttctcaga

SEQ ID NO: 4297282 - DNA, 15 bp, Homo sapiens
gtcctgttctcagag

SEQ ID NO: 4297283 - DNA, 16 bp, Homo sapiens
gtcctgttctcagagc

SEQ ID NO: 4297284 - DNA, 23 bp, Homo sapiens
gtccttaaacagggcatctccag

SEQ ID NO: 4297285 - DNA, 14 bp, Homo sapiens
gtcggaggcttggg

SEQ ID NO: 4297286 - DNA, 18 bp, Homo sapiens
gtctaacttttgtgtgaa

SEQ ID NO: 4297287 - DNA, 11 bp, Homo sapiens
gtctattgtct

SEQ ID NO: 4297288 - DNA, 20 bp, Homo sapiens
gtctcaaacctccaaaagcc

SEQ ID NO: 4297289 - DNA, 15 bp, Homo sapiens
gtctcaagagggcac

SEQ ID NO: 4297290 - DNA, 22 bp, Homo sapiens
gtctcaagagggcactggtggc

SEQ ID NO: 4297291 - DNA, 14 bp, Homo sapiens
gtctcaatgaaata

SEQ ID NO: 4297292 - DNA, 15 bp, Homo sapiens
gtctcatgcctgaga

SEQ ID NO: 4297293 - DNA, 19 bp, Homo sapiens
gtctcatgctccttaatgg

SEQ ID NO: 4297294 - DNA, 17 bp, Homo sapiens
gtctcattcctctgtcc

SEQ ID NO: 4297295 - DNA, 14 bp, Homo sapiens
gtctccacccctca

SEQ ID NO: 4297296 - DNA, 17 bp, Homo sapiens
gtctccacccctcaagc

SEQ ID NO: 4297297 - DNA, 19 bp, Homo sapiens
gtctccacctcaggggaga

SEQ ID NO: 4297298 - DNA, 21 bp, Homo sapiens
gtctccacctcaggggagact

SEQ ID NO: 4297299 - DNA, 13 bp, Homo sapiens
gtctccctggcca

SEQ ID NO: 4297300 - DNA, 14 bp, Homo sapiens
gtctccctggccac

SEQ ID NO: 4297301 - DNA, 16 bp, Homo sapiens
gtctcctgggcatctg

SEQ ID NO: 4297302 - DNA, 13 bp, Homo sapiens
gtctcgtcaggag

SEQ ID NO: 4297303 - DNA, 18 bp, Homo sapiens
gtctcgtcaggaggtgcc

SEQ ID NO: 4297304 - DNA, 17 bp, Homo sapiens
gtctcttctccactgga

SEQ ID NO: 4297305 - DNA, 18 bp, Homo sapiens
gtctcttctccactggat

SEQ ID NO: 4297306 - DNA, 15 bp, Homo sapiens
gtctgaaaccagaag

SEQ ID NO: 4297307 - DNA, 16 bp, Homo sapiens
gtctgaaaccagaaga

SEQ ID NO: 4297308 - DNA, 15 bp, Homo sapiens
gtctgaaggagagga

SEQ ID NO: 4297309 - DNA, 16 bp, Homo sapiens
gtctgaaggagaggag

SEQ ID NO: 4297310 - DNA, 20 bp, Homo sapiens
gtctgagccctgccctcact

SEQ ID NO: 4297311 - DNA, 19 bp, Homo sapiens
gtctgagcggccgcctgtc

SEQ ID NO: 4297312 - DNA, 15 bp, Homo sapiens
gtctgatattggtgt

SEQ ID NO: 4297313 - DNA, 22 bp, Homo sapiens
gtctgattctatgcctgtattt

SEQ ID NO: 4297314 - DNA, 11 bp, Homo sapiens
gtctgcacccc

SEQ ID NO: 4297315 - DNA, 15 bp, Homo sapiens
gtctgccgtgagagc

SEQ ID NO: 4297316 - DNA, 18 bp, Homo sapiens
gtctgcgccgctgtgctg

SEQ ID NO: 4297317 - DNA, 12 bp, Homo sapiens
gtctgctgcccc

SEQ ID NO: 4297318 - DNA, 13 bp, Homo sapiens
gtctgctgccctc

SEQ ID NO: 4297319 - DNA, 19 bp, Homo sapiens
gtctgctgccctccatccc

SEQ ID NO: 4297320 - DNA, 17 bp, Homo sapiens
gtctggagaccaggact

SEQ ID NO: 4297321 - DNA, 22 bp, Homo sapiens
gtctggagaccaggactctgcc

SEQ ID NO: 4297322 - DNA, 15 bp, Homo sapiens
gtctggagcccctat

SEQ ID NO: 4297323 - DNA, 14 bp, Homo sapiens
gtctggatcagtaa

SEQ ID NO: 4297324 - DNA, 16 bp, Homo sapiens
gtctggctgtggcccc

SEQ ID NO: 4297325 - DNA, 13 bp, Homo sapiens
gtctggctttgga

SEQ ID NO: 4297326 - DNA, 13 bp, Homo sapiens
gtctgggaggcag

SEQ ID NO: 4297327 - DNA, 15 bp, Homo sapiens
gtctgggaggcaggt

SEQ ID NO: 4297328 - DNA, 16 bp, Homo sapiens
gtctgtcctacccgcc

SEQ ID NO: 4297329 - DNA, 18 bp, Homo sapiens
gtctgtgaataaagccac

SEQ ID NO: 4297330 - DNA, 18 bp, Homo sapiens
gtctgtgggactggccca

SEQ ID NO: 4297331 - DNA, 21 bp, Homo sapiens
gtcttattcttgtgcacttta

SEQ ID NO: 4297332 - DNA, 20 bp, Homo sapiens
gtcttcaaattgtcttttgt

SEQ ID NO: 4297333 - DNA, 14 bp, Homo sapiens
gtcttcaagcctgg

SEQ ID NO: 4297334 - DNA, 18 bp, Homo sapiens
gtcttcaagcctggccca

SEQ ID NO: 4297335 - DNA, 23 bp, Homo sapiens
gtcttcaagcctggcccagtgag

SEQ ID NO: 4297336 - DNA, 13 bp, Homo sapiens
gtcttccatcagc

SEQ ID NO: 4297337 - DNA, 14 bp, Homo sapiens
gtcttccatcagca

SEQ ID NO: 4297338 - DNA, 16 bp, Homo sapiens
gtcttccatcagcagt

SEQ ID NO: 4297339 - DNA, 19 bp, Homo sapiens
gtcttgagagcgctggcct

SEQ ID NO: 4297340 - DNA, 18 bp, Homo sapiens
gtcttgagtgggccccct

SEQ ID NO: 4297341 - DNA, 22 bp, Homo sapiens
gtcttgagtgggccccctctct

SEQ ID NO: 4297342 - DNA, 14 bp, Homo sapiens
gtcttggagaggag

SEQ ID NO: 4297343 - DNA, 16 bp, Homo sapiens
gtctttgtgtgctgtg

SEQ ID NO: 4297344 - DNA, 18 bp, Homo sapiens
gtgaaagagtaaaaccaa

SEQ ID NO: 4297345 - DNA, 19 bp, Homo sapiens
gtgaaaggatatgaatctg

SEQ ID NO: 4297346 - DNA, 13 bp, Homo sapiens
gtgaaagtgtaaa

SEQ ID NO: 4297347 - DNA, 15 bp, Homo sapiens
gtgaaagtgtaaaat

SEQ ID NO: 4297348 - DNA, 20 bp, Homo sapiens
gtgaaagtgtaaaatagaat

SEQ ID NO: 4297349 - DNA, 15 bp, Homo sapiens
gtgaaatttgttaat

SEQ ID NO: 4297350 - DNA, 20 bp, Homo sapiens
gtgaaatttgttaatatata

SEQ ID NO: 4297351 - DNA, 23 bp, Homo sapiens
gtgaacattattaaatcagaatc

SEQ ID NO: 4297352 - DNA, 16 bp, Homo sapiens
gtgaagcccaggagga

SEQ ID NO: 4297353 - DNA, 21 bp, Homo sapiens
gtgaagcccaggaggacctgg

SEQ ID NO: 4297354 - DNA, 19 bp, Homo sapiens
gtgaagtccagtgaccctg

SEQ ID NO: 4297355 - DNA, 14 bp, Homo sapiens
gtgaatataaatgt

SEQ ID NO: 4297356 - DNA, 16 bp, Homo sapiens
gtgaatatgccagtga

SEQ ID NO: 4297357 - DNA, 19 bp, Homo sapiens
gtgacaaggccccagagac

SEQ ID NO: 4297358 - DNA, 21 bp, Homo sapiens
gtgacagagggacagtgggct

SEQ ID NO: 4297359 - DNA, 15 bp, Homo sapiens
gtgacatcagtggca

SEQ ID NO: 4297360 - DNA, 18 bp, Homo sapiens
gtgacatcggttcaggag

SEQ ID NO: 4297361 - DNA, 21 bp, Homo sapiens
gtgacatgcggctgcccacgc

SEQ ID NO: 4297362 - DNA, 20 bp, Homo sapiens
gtgaccaggctcacaactgt

SEQ ID NO: 4297363 - DNA, 17 bp, Homo sapiens
gtgaccccagctccagg

SEQ ID NO: 4297364 - DNA, 21 bp, Homo sapiens
gtgaccccagctccaggcagg

SEQ ID NO: 4297365 - DNA, 15 bp, Homo sapiens
gtgacccggaggcca

SEQ ID NO: 4297366 - DNA, 15 bp, Homo sapiens
gtgaccctggagcta

SEQ ID NO: 4297367 - DNA, 13 bp, Homo sapiens
gtgaccggggtcc

SEQ ID NO: 4297368 - DNA, 23 bp, Homo sapiens
gtgacctgtggggatttctccca

SEQ ID NO: 4297369 - DNA, 14 bp, Homo sapiens
gtgacgaaaacatt

SEQ ID NO: 4297370 - DNA, 15 bp, Homo sapiens
gtgacgaaaacattg

SEQ ID NO: 4297371 - DNA, 19 bp, Homo sapiens
gtgacgggggttggggtgg

SEQ ID NO: 4297372 - DNA, 16 bp, Homo sapiens
gtgactaccacttatt

SEQ ID NO: 4297373 - DNA, 21 bp, Homo sapiens
gtgactaccacttatttctaa

SEQ ID NO: 4297374 - DNA, 23 bp, Homo sapiens
gtgactccatatcccgggagcag

SEQ ID NO: 4297375 - DNA, 21 bp, Homo sapiens
gtgagatggtgccccctgggg

SEQ ID NO: 4297376 - DNA, 14 bp, Homo sapiens
gtgagatttgtatt

SEQ ID NO: 4297377 - DNA, 16 bp, Homo sapiens
gtgagatttgtattta

SEQ ID NO: 4297378 - DNA, 13 bp, Homo sapiens
gtgagcagggtga

SEQ ID NO: 4297379 - DNA, 22 bp, Homo sapiens
gtgagccccgccgtgtctgtgg

SEQ ID NO: 4297380 - DNA, 19 bp, Homo sapiens
gtgaggcgtgggatccaga

SEQ ID NO: 4297381 - DNA, 14 bp, Homo sapiens
gtgagggaggcctg

SEQ ID NO: 4297382 - DNA, 24 bp, Homo sapiens
gtgaggtcatcccggggccatgga

SEQ ID NO: 4297383 - DNA, 16 bp, Homo sapiens
gtgaggttgtgctgcc

SEQ ID NO: 4297384 - DNA, 20 bp, Homo sapiens
gtgagtgtgaatataaatgt

SEQ ID NO: 4297385 - DNA, 15 bp, Homo sapiens
gtgagtgtggcttag

SEQ ID NO: 4297386 - DNA, 14 bp, Homo sapiens
gtgataagtggaaa

SEQ ID NO: 4297387 - DNA, 16 bp, Homo sapiens
gtgataagtggaaaaa

SEQ ID NO: 4297388 - DNA, 14 bp, Homo sapiens
gtgatacactgtat

SEQ ID NO: 4297389 - DNA, 14 bp, Homo sapiens
gtgatcactttctg

SEQ ID NO: 4297390 - DNA, 22 bp, Homo sapiens
gtgatccctagctgtgacctct

SEQ ID NO: 4297391 - DNA, 14 bp, Homo sapiens
gtgatggttcccct

SEQ ID NO: 4297392 - DNA, 23 bp, Homo sapiens
gtgatggttcccctgttcactct

SEQ ID NO: 4297393 - DNA, 12 bp, Homo sapiens
gtgcaatatgag

SEQ ID NO: 4297394 - DNA, 20 bp, Homo sapiens
gtgcacacacctgcacaccc

SEQ ID NO: 4297395 - DNA, 21 bp, Homo sapiens
gtgcagaaggtgaaatggagg

SEQ ID NO: 4297396 - DNA, 20 bp, Homo sapiens
gtgcagcccgtgtggcccct

SEQ ID NO: 4297397 - DNA, 21 bp, Homo sapiens
gtgcagcccgtgtggcccctt

SEQ ID NO: 4297398 - DNA, 22 bp, Homo sapiens
gtgcagccggggagctgagggg

SEQ ID NO: 4297399 - DNA, 16 bp, Homo sapiens
gtgcagttgctgttta

SEQ ID NO: 4297400 - DNA, 15 bp, Homo sapiens
gtgcatctcagccca

SEQ ID NO: 4297401 - DNA, 20 bp, Homo sapiens
gtgcatgccttcataaatta

SEQ ID NO: 4297402 - DNA, 16 bp, Homo sapiens
gtgccaaccacctctg

SEQ ID NO: 4297403 - DNA, 22 bp, Homo sapiens
gtgccaaccacctctggccctg

SEQ ID NO: 4297404 - DNA, 17 bp, Homo sapiens
gtgccaccctctgcagg

SEQ ID NO: 4297405 - DNA, 15 bp, Homo sapiens
gtgccacgcgctctg

SEQ ID NO: 4297406 - DNA, 12 bp, Homo sapiens
gtgccagctgct

SEQ ID NO: 4297407 - DNA, 21 bp, Homo sapiens
gtgccatggtgttggaggggc

SEQ ID NO: 4297408 - DNA, 22 bp, Homo sapiens
gtgccatggtgttggaggggca

SEQ ID NO: 4297409 - DNA, 23 bp, Homo sapiens
gtgccatggtgttggaggggcag

SEQ ID NO: 4297410 - DNA, 12 bp, Homo sapiens
gtgcccaccctt

SEQ ID NO: 4297411 - DNA, 20 bp, Homo sapiens
gtgcccagtcttgagtgggc

SEQ ID NO: 4297412 - DNA, 19 bp, Homo sapiens
gtgccccccatgccctccc

SEQ ID NO: 4297413 - DNA, 20 bp, Homo sapiens
gtgcccctgctgcctcccca

SEQ ID NO: 4297414 - DNA, 13 bp, Homo sapiens
gtgcccgctgcgc

SEQ ID NO: 4297415 - DNA, 19 bp, Homo sapiens
gtgccctggcccagcctgt

SEQ ID NO: 4297416 - DNA, 21 bp, Homo sapiens
gtgccctggcccagcctgtgg

SEQ ID NO: 4297417 - DNA, 19 bp, Homo sapiens
gtgcctgagagcagaatga

SEQ ID NO: 4297418 - DNA, 16 bp, Homo sapiens
gtgcctgctatccagc

SEQ ID NO: 4297419 - DNA, 12 bp, Homo sapiens
gtgccttcattt

SEQ ID NO: 4297420 - DNA, 14 bp, Homo sapiens
gtgccttcatttgg

SEQ ID NO: 4297421 - DNA, 19 bp, Homo sapiens
gtgcgagaacacaagccac

SEQ ID NO: 4297422 - DNA, 21 bp, Homo sapiens
gtgctagaggattagtaagat

SEQ ID NO: 4297423 - DNA, 14 bp, Homo sapiens
gtgctcagttccaa

SEQ ID NO: 4297424 - DNA, 15 bp, Homo sapiens
gtgctcatcagaaac

SEQ ID NO: 4297425 - DNA, 12 bp, Homo sapiens
gtgctccaggct

SEQ ID NO: 4297426 - DNA, 20 bp, Homo sapiens
gtgctccaggcttcctgccc

SEQ ID NO: 4297427 - DNA, 19 bp, Homo sapiens
gtgctccagtgttttcttg

SEQ ID NO: 4297428 - DNA, 15 bp, Homo sapiens
gtgctcctgctgacc

SEQ ID NO: 4297429 - DNA, 14 bp, Homo sapiens
gtgctgaggtgggc

SEQ ID NO: 4297430 - DNA, 17 bp, Homo sapiens
gtgctgctgcaccaacc

SEQ ID NO: 4297431 - DNA, 17 bp, Homo sapiens
gtgctgctgtggcatca

SEQ ID NO: 4297432 - DNA, 16 bp, Homo sapiens
gtgctgcttccctctg

SEQ ID NO: 4297433 - DNA, 15 bp, Homo sapiens
gtgctggcatgtctg

SEQ ID NO: 4297434 - DNA, 14 bp, Homo sapiens
gtgctgggtcctta

SEQ ID NO: 4297435 - DNA, 20 bp, Homo sapiens
gtgctgtgcacccgtgccac

SEQ ID NO: 4297436 - DNA, 13 bp, Homo sapiens
gtggaaagggtgc

SEQ ID NO: 4297437 - DNA, 19 bp, Homo sapiens
gtggacagacccagggtgg

SEQ ID NO: 4297438 - DNA, 15 bp, Homo sapiens
gtggactctggactg

SEQ ID NO: 4297439 - DNA, 16 bp, Homo sapiens
gtggactctggactgg

SEQ ID NO: 4297440 - DNA, 16 bp, Homo sapiens
gtggaggaatgctccc

SEQ ID NO: 4297441 - DNA, 18 bp, Homo sapiens
gtggaggctaagcctgga

SEQ ID NO: 4297442 - DNA, 20 bp, Homo sapiens
gtggaggctaagcctggaca

SEQ ID NO: 4297443 - DNA, 12 bp, Homo sapiens
gtggagtggagg

SEQ ID NO: 4297444 - DNA, 17 bp, Homo sapiens
gtggatacgtgtcaatg

SEQ ID NO: 4297445 - DNA, 13 bp, Homo sapiens
gtggattctatat

SEQ ID NO: 4297446 - DNA, 23 bp, Homo sapiens
gtggcacttcgtggatgacctcc

SEQ ID NO: 4297447 - DNA, 22 bp, Homo sapiens
gtggcagcaacaaaggatttga

SEQ ID NO: 4297448 - DNA, 19 bp, Homo sapiens
gtggcaggaggacaggtgg

SEQ ID NO: 4297449 - DNA, 21 bp, Homo sapiens
gtggcaggtgaccttctggga

SEQ ID NO: 4297450 - DNA, 22 bp, Homo sapiens
gtggcatcttagggtaggggaa

SEQ ID NO: 4297451 - DNA, 16 bp, Homo sapiens
gtggccaagcctgccc

SEQ ID NO: 4297452 - DNA, 21 bp, Homo sapiens
gtggccaagcctgccccggcc

SEQ ID NO: 4297453 - DNA, 21 bp, Homo sapiens
gtggccactccagacccctgg

SEQ ID NO: 4297454 - DNA, 21 bp, Homo sapiens
gtggcccaccagagcctccct

SEQ ID NO: 4297455 - DNA, 22 bp, Homo sapiens
gtggcccagggaatcagggagc

SEQ ID NO: 4297456 - DNA, 22 bp, Homo sapiens
gtggcccctccttctcccctcc

SEQ ID NO: 4297457 - DNA, 16 bp, Homo sapiens
gtggcccgacagcctg

SEQ ID NO: 4297458 - DNA, 17 bp, Homo sapiens
gtggcccgacagcctgg

SEQ ID NO: 4297459 - DNA, 15 bp, Homo sapiens
gtggccggccctgcc

SEQ ID NO: 4297460 - DNA, 18 bp, Homo sapiens
gtggccggccctgccccc

SEQ ID NO: 4297461 - DNA, 21 bp, Homo sapiens
gtggccggccctgccccccac

SEQ ID NO: 4297462 - DNA, 15 bp, Homo sapiens
gtggcggtgcagtgg

SEQ ID NO: 4297463 - DNA, 22 bp, Homo sapiens
gtggctaaatgcctaataaaca

SEQ ID NO: 4297464 - DNA, 19 bp, Homo sapiens
gtggctggagcatgagcca

SEQ ID NO: 4297465 - DNA, 16 bp, Homo sapiens
gtggcttcagcccctg

SEQ ID NO: 4297466 - DNA, 15 bp, Homo sapiens
gtggctttcatttct

SEQ ID NO: 4297467 - DNA, 17 bp, Homo sapiens
gtggctttcatttctta

SEQ ID NO: 4297468 - DNA, 14 bp, Homo sapiens
gtggctttgtgctt

SEQ ID NO: 4297469 - DNA, 16 bp, Homo sapiens
gtgggagaggaagcca

SEQ ID NO: 4297470 - DNA, 22 bp, Homo sapiens
gtgggagtcaagtgtgcctgct

SEQ ID NO: 4297471 - DNA, 12 bp, Homo sapiens
gtgggagtggga

SEQ ID NO: 4297472 - DNA, 15 bp, Homo sapiens
gtgggagtgggagag

SEQ ID NO: 4297473 - DNA, 16 bp, Homo sapiens
gtgggagtgggagagg

SEQ ID NO: 4297474 - DNA, 19 bp, Homo sapiens
gtgggagtgggagaggaag

SEQ ID NO: 4297475 - DNA, 14 bp, Homo sapiens
gtgggcagctggct

SEQ ID NO: 4297476 - DNA, 17 bp, Homo sapiens
gtgggcagctggctctg

SEQ ID NO: 4297477 - DNA, 17 bp, Homo sapiens
gtgggccagtgtgggaa

SEQ ID NO: 4297478 - DNA, 22 bp, Homo sapiens
gtgggcctctggtttggggcga

SEQ ID NO: 4297479 - DNA, 23 bp, Homo sapiens
gtgggcctctggtttggggcgag

SEQ ID NO: 4297480 - DNA, 24 bp, Homo sapiens
gtgggctatgccactaggccctgg

SEQ ID NO: 4297481 - DNA, 17 bp, Homo sapiens
gtgggctccagggactg

SEQ ID NO: 4297482 - DNA, 23 bp, Homo sapiens
gtggggctagactgggctggctg

SEQ ID NO: 4297483 - DNA, 14 bp, Homo sapiens
gtgggggcctgctg

SEQ ID NO: 4297484 - DNA, 15 bp, Homo sapiens
gtgggggcctgctgt

SEQ ID NO: 4297485 - DNA, 14 bp, Homo sapiens
gtgggggtctggga

SEQ ID NO: 4297486 - DNA, 15 bp, Homo sapiens
gtgggggtctgggag

SEQ ID NO: 4297487 - DNA, 20 bp, Homo sapiens
gtgggggtctgggaggcagg

SEQ ID NO: 4297488 - DNA, 22 bp, Homo sapiens
gtgggggtgtcacagaggcagt

SEQ ID NO: 4297489 - DNA, 17 bp, Homo sapiens
gtgggtcaactccaagg

SEQ ID NO: 4297490 - DNA, 19 bp, Homo sapiens
gtgggtcaactccaaggca

SEQ ID NO: 4297491 - DNA, 15 bp, Homo sapiens
gtgggtgtgagcagg

SEQ ID NO: 4297492 - DNA, 18 bp, Homo sapiens
gtggtaacaagaggagca

SEQ ID NO: 4297493 - DNA, 20 bp, Homo sapiens
gtggtaacaagaggagcagg

SEQ ID NO: 4297494 - DNA, 16 bp, Homo sapiens
gtggtcagcggcctgg

SEQ ID NO: 4297495 - DNA, 17 bp, Homo sapiens
gtggtcagcggcctggg

SEQ ID NO: 4297496 - DNA, 21 bp, Homo sapiens
gtggtcttcaagcctggccca

SEQ ID NO: 4297497 - DNA, 14 bp, Homo sapiens
gtggtgaggtcctg

SEQ ID NO: 4297498 - DNA, 21 bp, Homo sapiens
gtgtaatcatttcttgggccc

SEQ ID NO: 4297499 - DNA, 20 bp, Homo sapiens
gtgtagattttatagtgtgt

SEQ ID NO: 4297500 - DNA, 15 bp, Homo sapiens
gtgtatcagtgttta

SEQ ID NO: 4297501 - DNA, 13 bp, Homo sapiens
gtgtatgtgttta

SEQ ID NO: 4297502 - DNA, 14 bp, Homo sapiens
gtgtattcaggacc

SEQ ID NO: 4297503 - DNA, 21 bp, Homo sapiens
gtgtatttattttcctcccca

SEQ ID NO: 4297504 - DNA, 15 bp, Homo sapiens
gtgtcacagaggcag

SEQ ID NO: 4297505 - DNA, 13 bp, Homo sapiens
gtgtcatgatttc

SEQ ID NO: 4297506 - DNA, 22 bp, Homo sapiens
gtgtcttttaatgatactgtct

SEQ ID NO: 4297507 - DNA, 17 bp, Homo sapiens
gtgtgacgggggttggg

SEQ ID NO: 4297508 - DNA, 14 bp, Homo sapiens
gtgtgagggtgcag

SEQ ID NO: 4297509 - DNA, 22 bp, Homo sapiens
gtgtgccaccctctgcagggca

SEQ ID NO: 4297510 - DNA, 19 bp, Homo sapiens
gtgtgcctgctatccagcc

SEQ ID NO: 4297511 - DNA, 16 bp, Homo sapiens
gtgtgctgaggtgggc

SEQ ID NO: 4297512 - DNA, 19 bp, Homo sapiens
gtgtggactctggactggg

SEQ ID NO: 4297513 - DNA, 17 bp, Homo sapiens
gtgtggagtggaggggt

SEQ ID NO: 4297514 - DNA, 13 bp, Homo sapiens
gtgtggcttggaa

SEQ ID NO: 4297515 - DNA, 14 bp, Homo sapiens
gtgtggcttggaac

SEQ ID NO: 4297516 - DNA, 23 bp, Homo sapiens
gtgtggcttggaacatttgggag

SEQ ID NO: 4297517 - DNA, 14 bp, Homo sapiens
gtgtggggagggtg

SEQ ID NO: 4297518 - DNA, 23 bp, Homo sapiens
gtgtgggggtctgggaggcaggt

SEQ ID NO: 4297519 - DNA, 18 bp, Homo sapiens
gtgtgggtttactctgtg

SEQ ID NO: 4297520 - DNA, 13 bp, Homo sapiens
gtgttagtgtctg

SEQ ID NO: 4297521 - DNA, 14 bp, Homo sapiens
gtgttagtgtctgt

SEQ ID NO: 4297522 - DNA, 17 bp, Homo sapiens
gtgttagtgtctgtcca

SEQ ID NO: 4297523 - DNA, 21 bp, Homo sapiens
gtgttctggcctctggcctgg

SEQ ID NO: 4297524 - DNA, 22 bp, Homo sapiens
gtgttctggcctctggcctggg

SEQ ID NO: 4297525 - DNA, 23 bp, Homo sapiens
gtgttctggcctctggcctggga

SEQ ID NO: 4297526 - DNA, 15 bp, Homo sapiens
gtgttcttcccaaag

SEQ ID NO: 4297527 - DNA, 12 bp, Homo sapiens
gtgttgcaaatt

SEQ ID NO: 4297528 - DNA, 21 bp, Homo sapiens
gtgttgcaaattattctagtc

SEQ ID NO: 4297529 - DNA, 15 bp, Homo sapiens
gtgttgggccccagg

SEQ ID NO: 4297530 - DNA, 12 bp, Homo sapiens
gtgttgttttct

SEQ ID NO: 4297531 - DNA, 12 bp, Homo sapiens
gtgtttaactga

SEQ ID NO: 4297532 - DNA, 15 bp, Homo sapiens
gtgtttaattgtata

SEQ ID NO: 4297533 - DNA, 17 bp, Homo sapiens
gtgtttaattgtataaa

SEQ ID NO: 4297534 - DNA, 18 bp, Homo sapiens
gtgtttataattgttata

SEQ ID NO: 4297535 - DNA, 14 bp, Homo sapiens
gtgtttgtatataa

SEQ ID NO: 4297536 - DNA, 20 bp, Homo sapiens
gttaaaacaaattaaaaaca

SEQ ID NO: 4297537 - DNA, 21 bp, Homo sapiens
gttaaagaggcgtcttgtatt

SEQ ID NO: 4297538 - DNA, 21 bp, Homo sapiens
gttaacttattcaaagagaaa

SEQ ID NO: 4297539 - DNA, 12 bp, Homo sapiens
gttaagccatat

SEQ ID NO: 4297540 - DNA, 15 bp, Homo sapiens
gttaaggggatctaa

SEQ ID NO: 4297541 - DNA, 21 bp, Homo sapiens
gttaagtctatctggtattaa

SEQ ID NO: 4297542 - DNA, 18 bp, Homo sapiens
gttaatatcactcattaa

SEQ ID NO: 4297543 - DNA, 19 bp, Homo sapiens
gttaatcttaatgtatatc

SEQ ID NO: 4297544 - DNA, 12 bp, Homo sapiens
gttacagctgaa

SEQ ID NO: 4297545 - DNA, 18 bp, Homo sapiens
gttactggttggtgttct

SEQ ID NO: 4297546 - DNA, 22 bp, Homo sapiens
gttaggaacccggcatgccgag

SEQ ID NO: 4297547 - DNA, 19 bp, Homo sapiens
gttaggattaggtttagaa

SEQ ID NO: 4297548 - DNA, 17 bp, Homo sapiens
gttaggggaaaatagta

SEQ ID NO: 4297549 - DNA, 15 bp, Homo sapiens
gttagtaatctgtat

SEQ ID NO: 4297550 - DNA, 23 bp, Homo sapiens
gttagtgtctgtccatctgtctg

SEQ ID NO: 4297551 - DNA, 20 bp, Homo sapiens
gttatacaaccttcatttaa

SEQ ID NO: 4297552 - DNA, 16 bp, Homo sapiens
gttatagttgatatgt

SEQ ID NO: 4297553 - DNA, 15 bp, Homo sapiens
gttatggtagaaaaa

SEQ ID NO: 4297554 - DNA, 13 bp, Homo sapiens
gttattaaatgat

SEQ ID NO: 4297555 - DNA, 20 bp, Homo sapiens
gttattaatagccatttgaa

SEQ ID NO: 4297556 - DNA, 19 bp, Homo sapiens
gttatttttgtctcgaaat

SEQ ID NO: 4297557 - DNA, 19 bp, Homo sapiens
tccccctgctccatgggca

SEQ ID NO: 4297558 - DNA, 10 bp, Homo sapiens
tcccccttcc

SEQ ID NO: 4297559 - DNA, 20 bp, Homo sapiens
tccccgacagtggctctcca

SEQ ID NO: 4297560 - DNA, 22 bp, Homo sapiens
tccccgatccccgacagtggct

SEQ ID NO: 4297561 - DNA, 18 bp, Homo sapiens
tccccggacaagcccagg

SEQ ID NO: 4297562 - DNA, 19 bp, Homo sapiens
tccccgtgctcacagtagc

SEQ ID NO: 4297563 - DNA, 17 bp, Homo sapiens
tccccgtgggccatggc

SEQ ID NO: 4297564 - DNA, 20 bp, Homo sapiens
tcccctccttgcctcctgtg

SEQ ID NO: 4297565 - DNA, 18 bp, Homo sapiens
tcccctcttcccttcaac

SEQ ID NO: 4297566 - DNA, 16 bp, Homo sapiens
tcccctgcaagtggac

SEQ ID NO: 4297567 - DNA, 15 bp, Homo sapiens
tcccctgcgcaggcc

SEQ ID NO: 4297568 - DNA, 20 bp, Homo sapiens
tcccctgcgcaggccctccg

SEQ ID NO: 4297569 - DNA, 16 bp, Homo sapiens
tcccctggtcctgcac

SEQ ID NO: 4297570 - DNA, 16 bp, Homo sapiens
tccccttgagctgaga

SEQ ID NO: 4297571 - DNA, 23 bp, Homo sapiens
tccccttgggatgggcacaggct

SEQ ID NO: 4297572 - DNA, 23 bp, Homo sapiens
tcccgaatggagtccagacctgg

SEQ ID NO: 4297573 - DNA, 18 bp, Homo sapiens
tcccgagccccctgtcct

SEQ ID NO: 4297574 - DNA, 19 bp, Homo sapiens
tcccgagccccctgtcctt

SEQ ID NO: 4297575 - DNA, 16 bp, Homo sapiens
tcccgaggcagcaaca

SEQ ID NO: 4297576 - DNA, 14 bp, Homo sapiens
tcccgcatgctgcc

SEQ ID NO: 4297577 - DNA, 18 bp, Homo sapiens
tcccgcatgctgcctgcc

SEQ ID NO: 4297578 - DNA, 20 bp, Homo sapiens
tcccgcatgctgcctgcctc

SEQ ID NO: 4297579 - DNA, 21 bp, Homo sapiens
tcccgccctccccctgccaga

SEQ ID NO: 4297580 - DNA, 22 bp, Homo sapiens
tcccgccctccccctgccagag

SEQ ID NO: 4297581 - DNA, 13 bp, Homo sapiens
tcccgctcagccc

SEQ ID NO: 4297582 - DNA, 18 bp, Homo sapiens
tcccggagctcaggccct

SEQ ID NO: 4297583 - DNA, 18 bp, Homo sapiens
tcccgtggctttgtgctt

SEQ ID NO: 4297584 - DNA, 22 bp, Homo sapiens
tccctaccgagtctcttctcca

SEQ ID NO: 4297585 - DNA, 23 bp, Homo sapiens
tccctaccgagtctcttctccac

SEQ ID NO: 4297586 - DNA, 16 bp, Homo sapiens
tccctaggtgggtcaa

SEQ ID NO: 4297587 - DNA, 20 bp, Homo sapiens
tccctagtgacccggaggcc

SEQ ID NO: 4297588 - DNA, 16 bp, Homo sapiens
tccctcagccacgcct

SEQ ID NO: 4297589 - DNA, 14 bp, Homo sapiens
tccctcagcccctc

SEQ ID NO: 4297590 - DNA, 15 bp, Homo sapiens
tccctcagcccctct

SEQ ID NO: 4297591 - DNA, 20 bp, Homo sapiens
tccctccacacctccacccg

SEQ ID NO: 4297592 - DNA, 22 bp, Homo sapiens
tccctccacacctccacccgtc

SEQ ID NO: 4297593 - DNA, 13 bp, Homo sapiens
tccctccactcct

SEQ ID NO: 4297594 - DNA, 14 bp, Homo sapiens
tccctccactcctc

SEQ ID NO: 4297595 - DNA, 17 bp, Homo sapiens
tccctccactcctccca

SEQ ID NO: 4297596 - DNA, 18 bp, Homo sapiens
tccctccactcctcccaa

SEQ ID NO: 4297597 - DNA, 22 bp, Homo sapiens
tccctccactcctcccaactct

SEQ ID NO: 4297598 - DNA, 22 bp, Homo sapiens
tccctcccatttgcagaccagg

SEQ ID NO: 4297599 - DNA, 21 bp, Homo sapiens
tccctcccccggggtctccac

SEQ ID NO: 4297600 - DNA, 16 bp, Homo sapiens
tccctccctccacacc

SEQ ID NO: 4297601 - DNA, 17 bp, Homo sapiens
tccctccctccacacct

SEQ ID NO: 4297602 - DNA, 16 bp, Homo sapiens
tccctccctccctgct

SEQ ID NO: 4297603 - DNA, 18 bp, Homo sapiens
tccctccctgcagggtag

SEQ ID NO: 4297604 - DNA, 18 bp, Homo sapiens
tccctccgctaaggcttc

SEQ ID NO: 4297605 - DNA, 15 bp, Homo sapiens
tccctcggccccacc

SEQ ID NO: 4297606 - DNA, 17 bp, Homo sapiens
tccctcggccccaccca

SEQ ID NO: 4297607 - DNA, 19 bp, Homo sapiens
tccctctcaggcatgcctg

SEQ ID NO: 4297608 - DNA, 23 bp, Homo sapiens
tccctctccccggacaagcccag

SEQ ID NO: 4297609 - DNA, 16 bp, Homo sapiens
tccctctgcctgtccc

SEQ ID NO: 4297610 - DNA, 18 bp, Homo sapiens
tccctctgcctgtccctc

SEQ ID NO: 4297611 - DNA, 20 bp, Homo sapiens
tccctctgcctgtccctctc

SEQ ID NO: 4297612 - DNA, 19 bp, Homo sapiens
tccctctggcactccagaa

SEQ ID NO: 4297613 - DNA, 22 bp, Homo sapiens
tccctgacactgtctgctgccc

SEQ ID NO: 4297614 - DNA, 14 bp, Homo sapiens
tccctgagggccct

SEQ ID NO: 4297615 - DNA, 17 bp, Homo sapiens
tccctgccccgcccccc

SEQ ID NO: 4297616 - DNA, 18 bp, Homo sapiens
tccctgccccgcccccca

SEQ ID NO: 4297617 - DNA, 22 bp, Homo sapiens
tccctgccccgccccccagagc

SEQ ID NO: 4297618 - DNA, 20 bp, Homo sapiens
tccctgcccctcccttcaac

SEQ ID NO: 4297619 - DNA, 18 bp, Homo sapiens
tccctgcctaggagctgg

SEQ ID NO: 4297620 - DNA, 19 bp, Homo sapiens
tccctgcctaggagctggg

SEQ ID NO: 4297621 - DNA, 20 bp, Homo sapiens
tccctgcctaggagctgggg

SEQ ID NO: 4297622 - DNA, 15 bp, Homo sapiens
tccctgctgccaggc

SEQ ID NO: 4297623 - DNA, 22 bp, Homo sapiens
tccctgctgccaggctcccact

SEQ ID NO: 4297624 - DNA, 22 bp, Homo sapiens
tccctggactctgtggggccac

SEQ ID NO: 4297625 - DNA, 13 bp, Homo sapiens
tccctggcctgtt

SEQ ID NO: 4297626 - DNA, 18 bp, Homo sapiens
tccctgggctggcatggg

SEQ ID NO: 4297627 - DNA, 19 bp, Homo sapiens
tccctggtgaaagagtaaa

SEQ ID NO: 4297628 - DNA, 14 bp, Homo sapiens
tccctgtccctgcc

SEQ ID NO: 4297629 - DNA, 15 bp, Homo sapiens
tccctgtccctgccc

SEQ ID NO: 4297630 - DNA, 17 bp, Homo sapiens
tccctgtccctgccccg

SEQ ID NO: 4297631 - DNA, 18 bp, Homo sapiens
tccctgtccctgccccgc

SEQ ID NO: 4297632 - DNA, 13 bp, Homo sapiens
tcccttccccctg

SEQ ID NO: 4297633 - DNA, 15 bp, Homo sapiens
tcccttggcccctct

SEQ ID NO: 4297634 - DNA, 17 bp, Homo sapiens
tcccttggcccctctct

SEQ ID NO: 4297635 - DNA, 20 bp, Homo sapiens
tccctttatcatgtgtttct

SEQ ID NO: 4297636 - DNA, 23 bp, Homo sapiens
tccctttatcatgtgtttctgtg

SEQ ID NO: 4297637 - DNA, 18 bp, Homo sapiens
tccctttcactgaagtga

SEQ ID NO: 4297638 - DNA, 13 bp, Homo sapiens
tccctttccctgc

SEQ ID NO: 4297639 - DNA, 20 bp, Homo sapiens
tccctttccctgcatccctt

SEQ ID NO: 4297640 - DNA, 15 bp, Homo sapiens
tccctttctaagcag

SEQ ID NO: 4297641 - DNA, 19 bp, Homo sapiens
tccgaagaccttctgaaga

SEQ ID NO: 4297642 - DNA, 21 bp, Homo sapiens
tccgacaaccgatgctccagc

SEQ ID NO: 4297643 - DNA, 22 bp, Homo sapiens
tccgacaaccgatgctccagcc

SEQ ID NO: 4297644 - DNA, 23 bp, Homo sapiens
tccgacaaccgatgctccagcca

SEQ ID NO: 4297645 - DNA, 13 bp, Homo sapiens
tccgcgagcctgc

SEQ ID NO: 4297646 - DNA, 14 bp, Homo sapiens
tccgctctgaggca

SEQ ID NO: 4297647 - DNA, 20 bp, Homo sapiens
tccgctctgaggcaaccccc

SEQ ID NO: 4297648 - DNA, 14 bp, Homo sapiens
tccggcccccagag

SEQ ID NO: 4297649 - DNA, 16 bp, Homo sapiens
tccggctgagctgtgc

SEQ ID NO: 4297650 - DNA, 21 bp, Homo sapiens
tccggctgagctgtgccagct

SEQ ID NO: 4297651 - DNA, 18 bp, Homo sapiens
tccgtcctggcagggcag

SEQ ID NO: 4297652 - DNA, 22 bp, Homo sapiens
tcctaggggccgagggaaatgc

SEQ ID NO: 4297653 - DNA, 13 bp, Homo sapiens
tcctatactggtt

SEQ ID NO: 4297654 - DNA, 15 bp, Homo sapiens
tcctcaaaaatcatc

SEQ ID NO: 4297655 - DNA, 18 bp, Homo sapiens
tcctcaaaaatcatcaaa

SEQ ID NO: 4297656 - DNA, 19 bp, Homo sapiens
tcctcactatttttttgtt

SEQ ID NO: 4297657 - DNA, 14 bp, Homo sapiens
tcctcagccccagg

SEQ ID NO: 4297658 - DNA, 16 bp, Homo sapiens
tcctcaggcagtggcc

SEQ ID NO: 4297659 - DNA, 18 bp, Homo sapiens
tcctcccaactctggcct

SEQ ID NO: 4297660 - DNA, 21 bp, Homo sapiens
tcctcccaggcgccccttccc

SEQ ID NO: 4297661 - DNA, 13 bp, Homo sapiens
tcctcctggaccc

SEQ ID NO: 4297662 - DNA, 16 bp, Homo sapiens
tcctcctggacccagc

SEQ ID NO: 4297663 - DNA, 14 bp, Homo sapiens
tcctccttccaggc

SEQ ID NO: 4297664 - DNA, 15 bp, Homo sapiens
tcctccttccaggcc

SEQ ID NO: 4297665 - DNA, 14 bp, Homo sapiens
tcctctccactgcc

SEQ ID NO: 4297666 - DNA, 16 bp, Homo sapiens
tcctctccactgcctt

SEQ ID NO: 4297667 - DNA, 13 bp, Homo sapiens
tcctctctctccc

SEQ ID NO: 4297668 - DNA, 14 bp, Homo sapiens
tcctctctctccct

SEQ ID NO: 4297669 - DNA, 16 bp, Homo sapiens
tcctctctctccctcc

SEQ ID NO: 4297670 - DNA, 18 bp, Homo sapiens
tcctctctctccctccac

SEQ ID NO: 4297671 - DNA, 15 bp, Homo sapiens
tcctctgcctgtgcc

SEQ ID NO: 4297672 - DNA, 21 bp, Homo sapiens
tcctctgcctgtgcccgctgc

SEQ ID NO: 4297673 - DNA, 11 bp, Homo sapiens
tcctctgcctt

SEQ ID NO: 4297674 - DNA, 13 bp, Homo sapiens
tcctctgccttgg

SEQ ID NO: 4297675 - DNA, 15 bp, Homo sapiens
tcctctgccttggac

SEQ ID NO: 4297676 - DNA, 16 bp, Homo sapiens
tcctctgtccccgagc

SEQ ID NO: 4297677 - DNA, 12 bp, Homo sapiens
tcctcttacctg

SEQ ID NO: 4297678 - DNA, 12 bp, Homo sapiens
tcctgagcttgg

SEQ ID NO: 4297679 - DNA, 15 bp, Homo sapiens
tcctgagcttggcca

SEQ ID NO: 4297680 - DNA, 20 bp, Homo sapiens
tcctgagcttggccagaagg

SEQ ID NO: 4297681 - DNA, 22 bp, Homo sapiens
tcctgagcttggccagaagggg

SEQ ID NO: 4297682 - DNA, 15 bp, Homo sapiens
tcctgcaccctctgc

SEQ ID NO: 4297683 - DNA, 14 bp, Homo sapiens
tcctgcactgtccc

SEQ ID NO: 4297684 - DNA, 15 bp, Homo sapiens
tcctgcatccctcca

SEQ ID NO: 4297685 - DNA, 16 bp, Homo sapiens
tcctgcatccctccac

SEQ ID NO: 4297686 - DNA, 22 bp, Homo sapiens
tcctgccctagcagtttgcctc

SEQ ID NO: 4297687 - DNA, 23 bp, Homo sapiens
tcctgccctagcagtttgcctct

SEQ ID NO: 4297688 - DNA, 18 bp, Homo sapiens
tcctgctcagatgctggt

SEQ ID NO: 4297689 - DNA, 19 bp, Homo sapiens
tcctgctcagatgctggtc

SEQ ID NO: 4297690 - DNA, 17 bp, Homo sapiens
tcctggacccagcaggg

SEQ ID NO: 4297691 - DNA, 16 bp, Homo sapiens
tccactcccctcatcc

SEQ ID NO: 4297692 - DNA, 19 bp, Homo sapiens
tccactcccctcatccact

SEQ ID NO: 4297693 - DNA, 16 bp, Homo sapiens
tccactccctgtctga

SEQ ID NO: 4297694 - DNA, 9 bp, Homo sapiens
tccactcct

SEQ ID NO: 4297695 - DNA, 22 bp, Homo sapiens
tccactcctcccaactctggcc

SEQ ID NO: 4297696 - DNA, 15 bp, Homo sapiens
tccactgccttcgat

SEQ ID NO: 4297697 - DNA, 21 bp, Homo sapiens
tccacttagaaattgcatttc

SEQ ID NO: 4297698 - DNA, 20 bp, Homo sapiens
tccactttggtaatgtgtca

SEQ ID NO: 4297699 - DNA, 20 bp, Homo sapiens
tccagaacaaacctctatat

SEQ ID NO: 4297700 - DNA, 13 bp, Homo sapiens
tccagaattgaga

SEQ ID NO: 4297701 - DNA, 22 bp, Homo sapiens
tccagacagagtggatctggag

SEQ ID NO: 4297702 - DNA, 21 bp, Homo sapiens
tccagacccccagcaaccctc

SEQ ID NO: 4297703 - DNA, 18 bp, Homo sapiens
tccagacccctggctttt

SEQ ID NO: 4297704 - DNA, 16 bp, Homo sapiens
tccagacctgaagaat

SEQ ID NO: 4297705 - DNA, 14 bp, Homo sapiens
tccagacctgggcc

SEQ ID NO: 4297706 - DNA, 10 bp, Homo sapiens
tccagagaga

SEQ ID NO: 4297707 - DNA, 13 bp, Homo sapiens
tccagagagaagc

SEQ ID NO: 4297708 - DNA, 18 bp, Homo sapiens
tccagagagaagcacccc

SEQ ID NO: 4297709 - DNA, 21 bp, Homo sapiens
tccagagagaagcaccccacc

SEQ ID NO: 4297710 - DNA, 22 bp, Homo sapiens
tccagagagaagcaccccacca

SEQ ID NO: 4297711 - DNA, 23 bp, Homo sapiens
tccagagagagaagtgcccctgc

SEQ ID NO: 4297712 - DNA, 17 bp, Homo sapiens
tccagagagtggctcct

SEQ ID NO: 4297713 - DNA, 14 bp, Homo sapiens
tccagagctgcaga

SEQ ID NO: 4297714 - DNA, 14 bp, Homo sapiens
tccagaggtgaggg

SEQ ID NO: 4297715 - DNA, 15 bp, Homo sapiens
tccagatagcctagg

SEQ ID NO: 4297716 - DNA, 17 bp, Homo sapiens
tccagcaatgcctgcct

SEQ ID NO: 4297717 - DNA, 13 bp, Homo sapiens
tccagccaacccc

SEQ ID NO: 4297718 - DNA, 14 bp, Homo sapiens
tccagccaacccct

SEQ ID NO: 4297719 - DNA, 20 bp, Homo sapiens
tccagccaacccctgtggag

SEQ ID NO: 4297720 - DNA, 23 bp, Homo sapiens
tccagccaccaaggctgcctgcc

SEQ ID NO: 4297721 - DNA, 21 bp, Homo sapiens
tccagccgcaaatccataccc

SEQ ID NO: 4297722 - DNA, 22 bp, Homo sapiens
tccagctgattttaactttttt

SEQ ID NO: 4297723 - DNA, 15 bp, Homo sapiens
tccaggaaaactgtt

SEQ ID NO: 4297724 - DNA, 16 bp, Homo sapiens
tccaggaaaactgttt

SEQ ID NO: 4297725 - DNA, 17 bp, Homo sapiens
tccaggattgtccacaa

SEQ ID NO: 4297726 - DNA, 23 bp, Homo sapiens
tccaggattgtccacaaatgtcc

SEQ ID NO: 4297727 - DNA, 22 bp, Homo sapiens
tccaggcaggaaaccccgagaa

SEQ ID NO: 4297728 - DNA, 15 bp, Homo sapiens
tccaggcatgaccct

SEQ ID NO: 4297729 - DNA, 22 bp, Homo sapiens
tccaggccaggcctcatcctcc

SEQ ID NO: 4297730 - DNA, 15 bp, Homo sapiens
tccaggccccaggct

SEQ ID NO: 4297731 - DNA, 22 bp, Homo sapiens
tccaggccccaggctggatgct

SEQ ID NO: 4297732 - DNA, 21 bp, Homo sapiens
tccaggcgtagggccagggct

SEQ ID NO: 4297733 - DNA, 22 bp, Homo sapiens
tccaggcgtagggccagggctc

SEQ ID NO: 4297734 - DNA, 17 bp, Homo sapiens
tccaggcttcctgccct

SEQ ID NO: 4297735 - DNA, 18 bp, Homo sapiens
tccagtaaggaatgatat

SEQ ID NO: 4297736 - DNA, 20 bp, Homo sapiens
tccagtctgctgccctccat

SEQ ID NO: 4297737 - DNA, 15 bp, Homo sapiens
tccagtgaccctgga

SEQ ID NO: 4297738 - DNA, 17 bp, Homo sapiens
tccagtgaccctggagc

SEQ ID NO: 4297739 - DNA, 12 bp, Homo sapiens
tccagtgatgtt

SEQ ID NO: 4297740 - DNA, 18 bp, Homo sapiens
tccagtgatgttgaaatt

SEQ ID NO: 4297741 - DNA, 15 bp, Homo sapiens
tccagtgttgcctcc

SEQ ID NO: 4297742 - DNA, 14 bp, Homo sapiens
tccagtgttttctt

SEQ ID NO: 4297743 - DNA, 16 bp, Homo sapiens
tccagtgttttcttgt

SEQ ID NO: 4297744 - DNA, 22 bp, Homo sapiens
tccagtgttttcttgtgttgtt

SEQ ID NO: 4297745 - DNA, 14 bp, Homo sapiens
tccagttctgatga

SEQ ID NO: 4297746 - DNA, 15 bp, Homo sapiens
tccagttctgatgag

SEQ ID NO: 4297747 - DNA, 13 bp, Homo sapiens
tccataccccctg

SEQ ID NO: 4297748 - DNA, 18 bp, Homo sapiens
tccataccccctgcccca

SEQ ID NO: 4297749 - DNA, 22 bp, Homo sapiens
tccataccccctgccccagaga

SEQ ID NO: 4297750 - DNA, 15 bp, Homo sapiens
tccatatagtttgtt

SEQ ID NO: 4297751 - DNA, 22 bp, Homo sapiens
tccatctaaaatactcaccaaa

SEQ ID NO: 4297752 - DNA, 17 bp, Homo sapiens
tccatctgtctgtccta

SEQ ID NO: 4297753 - DNA, 18 bp, Homo sapiens
tccatgaaaaacagcaga

SEQ ID NO: 4297754 - DNA, 15 bp, Homo sapiens
tccatgattccaagg

SEQ ID NO: 4297755 - DNA, 22 bp, Homo sapiens
tccatgcggccggcctggggcc

SEQ ID NO: 4297756 - DNA, 19 bp, Homo sapiens
tccatgggcacctctgctg

SEQ ID NO: 4297757 - DNA, 18 bp, Homo sapiens
tccatgtagaagagggag

SEQ ID NO: 4297758 - DNA, 23 bp, Homo sapiens
tccatgtcaagattcagctagtg

SEQ ID NO: 4297759 - DNA, 17 bp, Homo sapiens
tccatgtgctgctgtgg

SEQ ID NO: 4297760 - DNA, 13 bp, Homo sapiens
tccattaatttaa

SEQ ID NO: 4297761 - DNA, 21 bp, Homo sapiens
tccattaatttaaatgattta

SEQ ID NO: 4297762 - DNA, 12 bp, Homo sapiens
tccattgcaaaa

SEQ ID NO: 4297763 - DNA, 19 bp, Homo sapiens
tccattgcaaaaggttaag

SEQ ID NO: 4297764 - DNA, 11 bp, Homo sapiens
tccattttcta

SEQ ID NO: 4297765 - DNA, 23 bp, Homo sapiens
tccattttctaaactgttttcat

SEQ ID NO: 4297766 - DNA, 24 bp, Homo sapiens
tccatttttacaagttatagtact

SEQ ID NO: 4297767 - DNA, 14 bp, Homo sapiens
tcccaaacccttcg

SEQ ID NO: 4297768 - DNA, 21 bp, Homo sapiens
tcccaaagcaagcacctgggt

SEQ ID NO: 4297769 - DNA, 23 bp, Homo sapiens
tcccaaagcaagcacctgggtgt

SEQ ID NO: 4297770 - DNA, 16 bp, Homo sapiens
tcccaaataaactcct

SEQ ID NO: 4297771 - DNA, 17 bp, Homo sapiens
tcccaaataaactcctt

SEQ ID NO: 4297772 - DNA, 15 bp, Homo sapiens
tcccaaatgcagctt

SEQ ID NO: 4297773 - DNA, 16 bp, Homo sapiens
tcccaaatgcagcttc

SEQ ID NO: 4297774 - DNA, 14 bp, Homo sapiens
tcccaacctcccct

SEQ ID NO: 4297775 - DNA, 15 bp, Homo sapiens
tcccaacctcccctg

SEQ ID NO: 4297776 - DNA, 20 bp, Homo sapiens
tcccaacctcccctggtcct

SEQ ID NO: 4297777 - DNA, 15 bp, Homo sapiens
tcccaactctggcct

SEQ ID NO: 4297778 - DNA, 15 bp, Homo sapiens
tcccaaggcgtgcag

SEQ ID NO: 4297779 - DNA, 12 bp, Homo sapiens
tcccacaaaata

SEQ ID NO: 4297780 - DNA, 17 bp, Homo sapiens
tcccacaaaatatttct

SEQ ID NO: 4297781 - DNA, 17 bp, Homo sapiens
tcccacaggcccttcct

SEQ ID NO: 4297782 - DNA, 17 bp, Homo sapiens
tcccacatcccccgtgt

SEQ ID NO: 4297783 - DNA, 19 bp, Homo sapiens
tcccaccaaccctcagagc

SEQ ID NO: 4297784 - DNA, 13 bp, Homo sapiens
tcccaccaactct

SEQ ID NO: 4297785 - DNA, 20 bp, Homo sapiens
tcccaccaactctctctgcc

SEQ ID NO: 4297786 - DNA, 15 bp, Homo sapiens
tcccaccacagcagg

SEQ ID NO: 4297787 - DNA, 12 bp, Homo sapiens
tcccacccctat

SEQ ID NO: 4297788 - DNA, 15 bp, Homo sapiens
tcccacctctttgga

SEQ ID NO: 4297789 - DNA, 15 bp, Homo sapiens
tcccacgccctcctc

SEQ ID NO: 4297790 - DNA, 18 bp, Homo sapiens
tcccacgccctcctccct

SEQ ID NO: 4297791 - DNA, 20 bp, Homo sapiens
tcccacgccctcctccctcc

SEQ ID NO: 4297792 - DNA, 21 bp, Homo sapiens
tcccacgccctcctccctccg

SEQ ID NO: 4297793 - DNA, 15 bp, Homo sapiens
tcccactgagtctca

SEQ ID NO: 4297794 - DNA, 13 bp, Homo sapiens
tcccactggctcc

SEQ ID NO: 4297795 - DNA, 16 bp, Homo sapiens
tcccagacatgctgcc

SEQ ID NO: 4297796 - DNA, 17 bp, Homo sapiens
tcccagacatgctgccc

SEQ ID NO: 4297797 - DNA, 19 bp, Homo sapiens
tcccagcggatgctgccag

SEQ ID NO: 4297798 - DNA, 16 bp, Homo sapiens
tcccaggaccctgggt

SEQ ID NO: 4297799 - DNA, 14 bp, Homo sapiens
tcccaggcagggag

SEQ ID NO: 4297800 - DNA, 18 bp, Homo sapiens
tcccaggcgccccttccc

SEQ ID NO: 4297801 - DNA, 21 bp, Homo sapiens
tcccaggcgccccttccccct

SEQ ID NO: 4297802 - DNA, 12 bp, Homo sapiens
tcccagggtcct

SEQ ID NO: 4297803 - DNA, 18 bp, Homo sapiens
tcccagtggcctcaaccc

SEQ ID NO: 4297804 - DNA, 19 bp, Homo sapiens
tcccagtggcctcaaccct

SEQ ID NO: 4297805 - DNA, 15 bp, Homo sapiens
tcccagtgggaggcg

SEQ ID NO: 4297806 - DNA, 20 bp, Homo sapiens
tcccatccctttctaagcag

SEQ ID NO: 4297807 - DNA, 17 bp, Homo sapiens
tcccatgggggctccag

SEQ ID NO: 4297808 - DNA, 16 bp, Homo sapiens
tcccattcaagattcc

SEQ ID NO: 4297809 - DNA, 19 bp, Homo sapiens
tcccatttgtaatgtatct

SEQ ID NO: 4297810 - DNA, 14 bp, Homo sapiens
tccccactgcctgc

SEQ ID NO: 4297811 - DNA, 15 bp, Homo sapiens
tccccagcccagggt

SEQ ID NO: 4297812 - DNA, 22 bp, Homo sapiens
tccccagcccagggttccccca

SEQ ID NO: 4297813 - DNA, 17 bp, Homo sapiens
tccccagccccctggcc

SEQ ID NO: 4297814 - DNA, 18 bp, Homo sapiens
tccccatcgccttctggc

SEQ ID NO: 4297815 - DNA, 16 bp, Homo sapiens
tccccattgccttctg

SEQ ID NO: 4297816 - DNA, 11 bp, Homo sapiens
tcccccagccc

SEQ ID NO: 4297817 - DNA, 12 bp, Homo sapiens
tcccccagccct

SEQ ID NO: 4297818 - DNA, 17 bp, Homo sapiens
tcccccagccctgtgga

SEQ ID NO: 4297819 - DNA, 12 bp, Homo sapiens
tcccccaggacc

SEQ ID NO: 4297820 - DNA, 16 bp, Homo sapiens
tcccccaggaccctga

SEQ ID NO: 4297821 - DNA, 18 bp, Homo sapiens
tcccccatcctccccttc

SEQ ID NO: 4297822 - DNA, 16 bp, Homo sapiens
tccccctgccagaggc

SEQ ID NO: 4297823 - DNA, 22 bp, Homo sapiens
tccccctgccagaggcctggtg

SEQ ID NO: 4297824 - DNA, 23 bp, Homo sapiens
tccccctgccagaggcctggtgc

SEQ ID NO: 4297825 - DNA, 22 bp, Homo sapiens
tcaggaatgggccaagccaggg

SEQ ID NO: 4297826 - DNA, 18 bp, Homo sapiens
tcaggaccccatctgctg

SEQ ID NO: 4297827 - DNA, 21 bp, Homo sapiens
tcaggaccccatctgctgagc

SEQ ID NO: 4297828 - DNA, 13 bp, Homo sapiens
tcaggagccagca

SEQ ID NO: 4297829 - DNA, 14 bp, Homo sapiens
tcaggagccagcag

SEQ ID NO: 4297830 - DNA, 23 bp, Homo sapiens
tcaggaggagacagtcaggaagc

SEQ ID NO: 4297831 - DNA, 16 bp, Homo sapiens
tcaggcatgcctgtgt

SEQ ID NO: 4297832 - DNA, 17 bp, Homo sapiens
tcaggcatgcctgtgtg

SEQ ID NO: 4297833 - DNA, 19 bp, Homo sapiens
tcaggcccacattgcccac

SEQ ID NO: 4297834 - DNA, 20 bp, Homo sapiens
tcaggcccacattgcccaca

SEQ ID NO: 4297835 - DNA, 18 bp, Homo sapiens
tcaggcctcacctggctt

SEQ ID NO: 4297836 - DNA, 18 bp, Homo sapiens
tcaggcctggccctttca

SEQ ID NO: 4297837 - DNA, 21 bp, Homo sapiens
tcaggctcttctcctttcaca

SEQ ID NO: 4297838 - DNA, 23 bp, Homo sapiens
tcaggcttgcattaaaagactgt

SEQ ID NO: 4297839 - DNA, 15 bp, Homo sapiens
tcagggaccaaggac

SEQ ID NO: 4297840 - DNA, 18 bp, Homo sapiens
tcagggagcactggaggc

SEQ ID NO: 4297841 - DNA, 23 bp, Homo sapiens
tcagggcggggctggccagctgt

SEQ ID NO: 4297842 - DNA, 23 bp, Homo sapiens
tcaggggagacttaggccagagg

SEQ ID NO: 4297843 - DNA, 13 bp, Homo sapiens
tcaggtgagccaa

SEQ ID NO: 4297844 - DNA, 22 bp, Homo sapiens
tcagtacttgtgaaacacagct

SEQ ID NO: 4297845 - DNA, 24 bp, Homo sapiens
tcagtacttgtgaaacacagctgt

SEQ ID NO: 4297846 - DNA, 16 bp, Homo sapiens
tcagtagtgcctgtga

SEQ ID NO: 4297847 - DNA, 13 bp, Homo sapiens
tcagtcattaaat

SEQ ID NO: 4297848 - DNA, 18 bp, Homo sapiens
tcagtccctccctcctgg

SEQ ID NO: 4297849 - DNA, 19 bp, Homo sapiens
tcagtccctccctcctggc

SEQ ID NO: 4297850 - DNA, 17 bp, Homo sapiens
tcagtgaagcccaggag

SEQ ID NO: 4297851 - DNA, 18 bp, Homo sapiens
tcagtgaagcccaggagg

SEQ ID NO: 4297852 - DNA, 13 bp, Homo sapiens
tcagtgcagcccc

SEQ ID NO: 4297853 - DNA, 17 bp, Homo sapiens
tcagtgctagcttattt

SEQ ID NO: 4297854 - DNA, 19 bp, Homo sapiens
tcagtggactttccacccc

SEQ ID NO: 4297855 - DNA, 19 bp, Homo sapiens
tcagtggcatggctccagt

SEQ ID NO: 4297856 - DNA, 20 bp, Homo sapiens
tcagtggcatggctccagtc

SEQ ID NO: 4297857 - DNA, 23 bp, Homo sapiens
tcagtgtgccaccctctgcaggg

SEQ ID NO: 4297858 - DNA, 24 bp, Homo sapiens
tcagtgtgccaccctctgcagggc

SEQ ID NO: 4297859 - DNA, 13 bp, Homo sapiens
tcagttattaaat

SEQ ID NO: 4297860 - DNA, 22 bp, Homo sapiens
tcagttcaatcaaactttcagc

SEQ ID NO: 4297861 - DNA, 19 bp, Homo sapiens
tcagtttcacatatttgta

SEQ ID NO: 4297862 - DNA, 14 bp, Homo sapiens
tcataaaaataacc

SEQ ID NO: 4297863 - DNA, 17 bp, Homo sapiens
tcataaaaataaccaaa

SEQ ID NO: 4297864 - DNA, 22 bp, Homo sapiens
tcataaaaggtgacccttctgt

SEQ ID NO: 4297865 - DNA, 21 bp, Homo sapiens
tcataaattatttctaaaaca

SEQ ID NO: 4297866 - DNA, 13 bp, Homo sapiens
tcataaattcaaa

SEQ ID NO: 4297867 - DNA, 15 bp, Homo sapiens
tcataccatccatcc

SEQ ID NO: 4297868 - DNA, 15 bp, Homo sapiens
tcatacttaaaaatt

SEQ ID NO: 4297869 - DNA, 16 bp, Homo sapiens
tcatacttaaaaattt

SEQ ID NO: 4297870 - DNA, 19 bp, Homo sapiens
tcatacttaaaaatttatt

SEQ ID NO: 4297871 - DNA, 14 bp, Homo sapiens
tcatactttccaac

SEQ ID NO: 4297872 - DNA, 18 bp, Homo sapiens
tcatagtcaatcaaacag

SEQ ID NO: 4297873 - DNA, 18 bp, Homo sapiens
tcatatatggggggccaa

SEQ ID NO: 4297874 - DNA, 15 bp, Homo sapiens
tcatatattataaga

SEQ ID NO: 4297875 - DNA, 14 bp, Homo sapiens
tcatatcatttctt

SEQ ID NO: 4297876 - DNA, 13 bp, Homo sapiens
tcatattctcaga

SEQ ID NO: 4297877 - DNA, 14 bp, Homo sapiens
tcatcaaagtgttt

SEQ ID NO: 4297878 - DNA, 13 bp, Homo sapiens
tcatcagaagtgg

SEQ ID NO: 4297879 - DNA, 22 bp, Homo sapiens
tcatcagaagtggtaggaaagc

SEQ ID NO: 4297880 - DNA, 14 bp, Homo sapiens
tcatcataaaaggt

SEQ ID NO: 4297881 - DNA, 17 bp, Homo sapiens
tcatcctgccttcatgg

SEQ ID NO: 4297882 - DNA, 12 bp, Homo sapiens
tcatcctgggca

SEQ ID NO: 4297883 - DNA, 23 bp, Homo sapiens
tcatcgcagggctcatgattttt

SEQ ID NO: 4297884 - DNA, 14 bp, Homo sapiens
tcatctcttctttt

SEQ ID NO: 4297885 - DNA, 13 bp, Homo sapiens
tcatcttcactgc

SEQ ID NO: 4297886 - DNA, 11 bp, Homo sapiens
tcatgaacctc

SEQ ID NO: 4297887 - DNA, 22 bp, Homo sapiens
tcatgaacctcaagctgcatct

SEQ ID NO: 4297888 - DNA, 15 bp, Homo sapiens
tcatgacatttctca

SEQ ID NO: 4297889 - DNA, 22 bp, Homo sapiens
tcatgactggtgcgttcctaaa

SEQ ID NO: 4297890 - DNA, 22 bp, Homo sapiens
tcatgattttttacaaattatg

SEQ ID NO: 4297891 - DNA, 18 bp, Homo sapiens
tcatgcctgagaatgcct

SEQ ID NO: 4297892 - DNA, 11 bp, Homo sapiens
tcatgcctggg

SEQ ID NO: 4297893 - DNA, 23 bp, Homo sapiens
tcatgctcccaaatgcagcttca

SEQ ID NO: 4297894 - DNA, 14 bp, Homo sapiens
tcatgctccttaat

SEQ ID NO: 4297895 - DNA, 21 bp, Homo sapiens
tcatgcttataagcaacatga

SEQ ID NO: 4297896 - DNA, 18 bp, Homo sapiens
tcatggctgtcccctgca

SEQ ID NO: 4297897 - DNA, 18 bp, Homo sapiens
tcatgggagtcagggagc

SEQ ID NO: 4297898 - DNA, 15 bp, Homo sapiens
tcatgtgtcagctgt

SEQ ID NO: 4297899 - DNA, 15 bp, Homo sapiens
tcatgtgttgcaaat

SEQ ID NO: 4297900 - DNA, 13 bp, Homo sapiens
tcattaaagtgca

SEQ ID NO: 4297901 - DNA, 17 bp, Homo sapiens
tcattaaagtgcactgt

SEQ ID NO: 4297902 - DNA, 22 bp, Homo sapiens
tcattaaccttatcataaattc

SEQ ID NO: 4297903 - DNA, 17 bp, Homo sapiens
tcattagctgtgatttt

SEQ ID NO: 4297904 - DNA, 14 bp, Homo sapiens
tcattattttccca

SEQ ID NO: 4297905 - DNA, 15 bp, Homo sapiens
tcattcatacttaaa

SEQ ID NO: 4297906 - DNA, 23 bp, Homo sapiens
tcattgagggaaaacataatatc

SEQ ID NO: 4297907 - DNA, 21 bp, Homo sapiens
tcattgttacaggtgtactat

SEQ ID NO: 4297908 - DNA, 12 bp, Homo sapiens
tcatttatctta

SEQ ID NO: 4297909 - DNA, 15 bp, Homo sapiens
tcatttcatttccta

SEQ ID NO: 4297910 - DNA, 22 bp, Homo sapiens
tcattttaacatctgagaaaag

SEQ ID NO: 4297911 - DNA, 13 bp, Homo sapiens
tcattttcctggg

SEQ ID NO: 4297912 - DNA, 16 bp, Homo sapiens
tcattttcctgggagt

SEQ ID NO: 4297913 - DNA, 12 bp, Homo sapiens
tcattttgcaac

SEQ ID NO: 4297914 - DNA, 22 bp, Homo sapiens
tcatttttgaaactgcatttgt

SEQ ID NO: 4297915 - DNA, 18 bp, Homo sapiens
tcattttttttttatcag

SEQ ID NO: 4297916 - DNA, 22 bp, Homo sapiens
tccaaataaaacttgagcccac

SEQ ID NO: 4297917 - DNA, 15 bp, Homo sapiens
tccaacccatgcatg

SEQ ID NO: 4297918 - DNA, 20 bp, Homo sapiens
tccaaccccggggcatggac

SEQ ID NO: 4297919 - DNA, 12 bp, Homo sapiens
tccaagagaatt

SEQ ID NO: 4297920 - DNA, 19 bp, Homo sapiens
tccaagagaattcacttta

SEQ ID NO: 4297921 - DNA, 12 bp, Homo sapiens
tccaagcctggg

SEQ ID NO: 4297922 - DNA, 13 bp, Homo sapiens
tccaagcctgggc

SEQ ID NO: 4297923 - DNA, 19 bp, Homo sapiens
tccaagcctgggccactgg

SEQ ID NO: 4297924 - DNA, 21 bp, Homo sapiens
tccaaggcaaatgtccaagca

SEQ ID NO: 4297925 - DNA, 17 bp, Homo sapiens
tccaatgtgcccagtca

SEQ ID NO: 4297926 - DNA, 18 bp, Homo sapiens
tccaatgtgcccagtcat

SEQ ID NO: 4297927 - DNA, 15 bp, Homo sapiens
tccaatgtttcaagc

SEQ ID NO: 4297928 - DNA, 12 bp, Homo sapiens
tccacaaatgtc

SEQ ID NO: 4297929 - DNA, 17 bp, Homo sapiens
tccacaaatgtcctcag

SEQ ID NO: 4297930 - DNA, 22 bp, Homo sapiens
tccacacaagacagcagagcca

SEQ ID NO: 4297931 - DNA, 12 bp, Homo sapiens
tccacacaggcc

SEQ ID NO: 4297932 - DNA, 23 bp, Homo sapiens
tccacacaggcccatgccctccg

SEQ ID NO: 4297933 - DNA, 19 bp, Homo sapiens
tccacacctccacccgtcc

SEQ ID NO: 4297934 - DNA, 21 bp, Homo sapiens
tccacacctccacccgtcctg

SEQ ID NO: 4297935 - DNA, 18 bp, Homo sapiens
tccacagaaaccctgttt

SEQ ID NO: 4297936 - DNA, 23 bp, Homo sapiens
tccacagggacacagtctggtgc

SEQ ID NO: 4297937 - DNA, 18 bp, Homo sapiens
tccacattctgctgcccc

SEQ ID NO: 4297938 - DNA, 19 bp, Homo sapiens
tccacattctgctgccccc

SEQ ID NO: 4297939 - DNA, 20 bp, Homo sapiens
tccacattctgctgccccca

SEQ ID NO: 4297940 - DNA, 23 bp, Homo sapiens
tccacattgcataagtggaccca

SEQ ID NO: 4297941 - DNA, 13 bp, Homo sapiens
tccaccccctccc

SEQ ID NO: 4297942 - DNA, 15 bp, Homo sapiens
tccaccccctccctg

SEQ ID NO: 4297943 - DNA, 20 bp, Homo sapiens
tccaccccctccctggcctg

SEQ ID NO: 4297944 - DNA, 15 bp, Homo sapiens
tccacccctcaagcc

SEQ ID NO: 4297945 - DNA, 20 bp, Homo sapiens
tccacccctcaagccaggag

SEQ ID NO: 4297946 - DNA, 21 bp, Homo sapiens
tccacccgtttccaagcctgg

SEQ ID NO: 4297947 - DNA, 23 bp, Homo sapiens
tccacccgtttccaagcctgggc

SEQ ID NO: 4297948 - DNA, 12 bp, Homo sapiens
tccacctcaggg

SEQ ID NO: 4297949 - DNA, 14 bp, Homo sapiens
tccacctcagggga

SEQ ID NO: 4297950 - DNA, 18 bp, Homo sapiens
tccacctgcagccccagg

SEQ ID NO: 4297951 - DNA, 14 bp, Homo sapiens
tccacctgggagat

SEQ ID NO: 4297952 - DNA, 21 bp, Homo sapiens
tccacctgggagatgctggga

SEQ ID NO: 4297953 - DNA, 14 bp, Homo sapiens
tccacctgtgctgc

SEQ ID NO: 4297954 - DNA, 22 bp, Homo sapiens
tccaccttggcgcgcagcccgg

SEQ ID NO: 4297955 - DNA, 23 bp, Homo sapiens
tccaccttggcgcgcagcccggg

SEQ ID NO: 4297956 - DNA, 19 bp, Homo sapiens
tccacgctgtctccagacc

SEQ ID NO: 4297957 - DNA, 12 bp, Homo sapiens
tccactcagcac

SEQ ID NO: 4297958 - DNA, 20 bp, Homo sapiens
tcaacaaagaagaaccatct

SEQ ID NO: 4297959 - DNA, 16 bp, Homo sapiens
tcaacaagaagaattt

SEQ ID NO: 4297960 - DNA, 17 bp, Homo sapiens
tcaacaagaagaatttg

SEQ ID NO: 4297961 - DNA, 16 bp, Homo sapiens
tcaacagcatgtctac

SEQ ID NO: 4297962 - DNA, 17 bp, Homo sapiens
tcaacagtgaacagctt

SEQ ID NO: 4297963 - DNA, 14 bp, Homo sapiens
tcaaccctccctca

SEQ ID NO: 4297964 - DNA, 15 bp, Homo sapiens
tcaaccctccctcag

SEQ ID NO: 4297965 - DNA, 19 bp, Homo sapiens
tcaaccctccctcagcccc

SEQ ID NO: 4297966 - DNA, 23 bp, Homo sapiens
tcaaccctccctcagcccctctt

SEQ ID NO: 4297967 - DNA, 21 bp, Homo sapiens
tcaacctacagtggagggaga

SEQ ID NO: 4297968 - DNA, 16 bp, Homo sapiens
tcaaccttgagacagc

SEQ ID NO: 4297969 - DNA, 17 bp, Homo sapiens
tcaaccttgagacagct

SEQ ID NO: 4297970 - DNA, 15 bp, Homo sapiens
tcaactccaaggcaa

SEQ ID NO: 4297971 - DNA, 17 bp, Homo sapiens
tcaactgctgttttatg

SEQ ID NO: 4297972 - DNA, 22 bp, Homo sapiens
tcaactgtataccgtgtgctcc

SEQ ID NO: 4297973 - DNA, 15 bp, Homo sapiens
tcaacttttcctttg

SEQ ID NO: 4297974 - DNA, 16 bp, Homo sapiens
tcaagaacaaacagaa

SEQ ID NO: 4297975 - DNA, 17 bp, Homo sapiens
tcaagactcaatgtgga

SEQ ID NO: 4297976 - DNA, 19 bp, Homo sapiens
tcaagatctaaatcatata

SEQ ID NO: 4297977 - DNA, 14 bp, Homo sapiens
tcaagattcagcta

SEQ ID NO: 4297978 - DNA, 12 bp, Homo sapiens
tcaagcatgaag

SEQ ID NO: 4297979 - DNA, 14 bp, Homo sapiens
tcaagccaggagac

SEQ ID NO: 4297980 - DNA, 17 bp, Homo sapiens
tcaagctcaccctgctc

SEQ ID NO: 4297981 - DNA, 16 bp, Homo sapiens
tcaagctggccgtgga

SEQ ID NO: 4297982 - DNA, 20 bp, Homo sapiens
tcaagggactgggggtgcca

SEQ ID NO: 4297983 - DNA, 17 bp, Homo sapiens
tcaaggggccctaggaa

SEQ ID NO: 4297984 - DNA, 18 bp, Homo sapiens
tcaaggggttcccactgg

SEQ ID NO: 4297985 - DNA, 11 bp, Homo sapiens
tcaagtctgtg

SEQ ID NO: 4297986 - DNA, 17 bp, Homo sapiens
tcaagtgcaatccatgt

SEQ ID NO: 4297987 - DNA, 17 bp, Homo sapiens
tcaagtgcatttctggg

SEQ ID NO: 4297988 - DNA, 15 bp, Homo sapiens
tcaagtgtgcctgct

SEQ ID NO: 4297989 - DNA, 22 bp, Homo sapiens
tcaagtgtgcctgctatccagc

SEQ ID NO: 4297990 - DNA, 15 bp, Homo sapiens
tcaataaaggtcata

SEQ ID NO: 4297991 - DNA, 21 bp, Homo sapiens
tcaatacttttgtgtattctg

SEQ ID NO: 4297992 - DNA, 13 bp, Homo sapiens
tcaatcctgtcaa

SEQ ID NO: 4297993 - DNA, 12 bp, Homo sapiens
tcaatgaaatat

SEQ ID NO: 4297994 - DNA, 13 bp, Homo sapiens
tcaatgcttttct

SEQ ID NO: 4297995 - DNA, 12 bp, Homo sapiens
tcaatgtgtgca

SEQ ID NO: 4297996 - DNA, 22 bp, Homo sapiens
tcacaaataagtaatatctttc

SEQ ID NO: 4297997 - DNA, 12 bp, Homo sapiens
tcacaactgttt

SEQ ID NO: 4297998 - DNA, 15 bp, Homo sapiens
tcacaataattttct

SEQ ID NO: 4297999 - DNA, 16 bp, Homo sapiens
tcacaccagccctggt

SEQ ID NO: 4298000 - DNA, 18 bp, Homo sapiens
tcacactctaactgtata

SEQ ID NO: 4298001 - DNA, 19 bp, Homo sapiens
tcacactctcttcttactg

SEQ ID NO: 4298002 - DNA, 11 bp, Homo sapiens
tcacactgtgc

SEQ ID NO: 4298003 - DNA, 21 bp, Homo sapiens
tcacactgtgcgttttagagt

SEQ ID NO: 4298004 - DNA, 13 bp, Homo sapiens
tcacagaggcagt

SEQ ID NO: 4298005 - DNA, 18 bp, Homo sapiens
tcacagaggcagtggcag

SEQ ID NO: 4298006 - DNA, 20 bp, Homo sapiens
tcacagaggcagtggcagca

SEQ ID NO: 4298007 - DNA, 12 bp, Homo sapiens
tcaccaggaaga

SEQ ID NO: 4298008 - DNA, 17 bp, Homo sapiens
tcaccaggaagaaggcc

SEQ ID NO: 4298009 - DNA, 15 bp, Homo sapiens
tcaccatctcaggcc

SEQ ID NO: 4298010 - DNA, 16 bp, Homo sapiens
tcaccatctcaggcca

SEQ ID NO: 4298011 - DNA, 16 bp, Homo sapiens
tcaccatgatcactta

SEQ ID NO: 4298012 - DNA, 23 bp, Homo sapiens
tcaccgagaggaaaaaggcttct

SEQ ID NO: 4298013 - DNA, 15 bp, Homo sapiens
tcacctgctggcccc

SEQ ID NO: 4298014 - DNA, 16 bp, Homo sapiens
tcacctgctggcccct

SEQ ID NO: 4298015 - DNA, 19 bp, Homo sapiens
tcacctgctggcccctcac

SEQ ID NO: 4298016 - DNA, 21 bp, Homo sapiens
tcacctgctggcccctcacct

SEQ ID NO: 4298017 - DNA, 13 bp, Homo sapiens
tcacctggcttcc

SEQ ID NO: 4298018 - DNA, 16 bp, Homo sapiens
tcacctggcttcccag

SEQ ID NO: 4298019 - DNA, 17 bp, Homo sapiens
tcacctggcttcccagg

SEQ ID NO: 4298020 - DNA, 21 bp, Homo sapiens
tcacctggcttcccaggaccc

SEQ ID NO: 4298021 - DNA, 17 bp, Homo sapiens
tcacctgggcacctggg

SEQ ID NO: 4298022 - DNA, 20 bp, Homo sapiens
tcacctgggcacctggggag

SEQ ID NO: 4298023 - DNA, 21 bp, Homo sapiens
tcaccttcctgggcagcccag

SEQ ID NO: 4298024 - DNA, 22 bp, Homo sapiens
tcaccttcctgggcagcccaga

SEQ ID NO: 4298025 - DNA, 23 bp, Homo sapiens
tcaccttcctgggcagcccagag

SEQ ID NO: 4298026 - DNA, 18 bp, Homo sapiens
tcaccttgcaacacacag

SEQ ID NO: 4298027 - DNA, 13 bp, Homo sapiens
tcacgattcattt

SEQ ID NO: 4298028 - DNA, 14 bp, Homo sapiens
tcacgattcatttt

SEQ ID NO: 4298029 - DNA, 16 bp, Homo sapiens
tcacgcaacttgaaat

SEQ ID NO: 4298030 - DNA, 13 bp, Homo sapiens
tcacggcatgttt

SEQ ID NO: 4298031 - DNA, 19 bp, Homo sapiens
tcactaaaaggaagacagt

SEQ ID NO: 4298032 - DNA, 17 bp, Homo sapiens
tcactaataaagtctgt

SEQ ID NO: 4298033 - DNA, 20 bp, Homo sapiens
tcactaataaagtctgtctg

SEQ ID NO: 4298034 - DNA, 12 bp, Homo sapiens
tcactccactcc

SEQ ID NO: 4298035 - DNA, 14 bp, Homo sapiens
tcactccactcccc

SEQ ID NO: 4298036 - DNA, 23 bp, Homo sapiens
tcactcggctttggctcgggact

SEQ ID NO: 4298037 - DNA, 20 bp, Homo sapiens
tcactctacttagcatgtcc

SEQ ID NO: 4298038 - DNA, 20 bp, Homo sapiens
tcactctggcagcctcagag

SEQ ID NO: 4298039 - DNA, 22 bp, Homo sapiens
tcactgaataatggaattatgt

SEQ ID NO: 4298040 - DNA, 17 bp, Homo sapiens
tcactgccctccctcgg

SEQ ID NO: 4298041 - DNA, 22 bp, Homo sapiens
tcactgccctccctcggcccca

SEQ ID NO: 4298042 - DNA, 14 bp, Homo sapiens
tcactgcctggagt

SEQ ID NO: 4298043 - DNA, 13 bp, Homo sapiens
tcactgctggctg

SEQ ID NO: 4298044 - DNA, 16 bp, Homo sapiens
tcactgctggctgcct

SEQ ID NO: 4298045 - DNA, 17 bp, Homo sapiens
tcactgctggctgcctt

SEQ ID NO: 4298046 - DNA, 20 bp, Homo sapiens
tcactggctggactggaggc

SEQ ID NO: 4298047 - DNA, 14 bp, Homo sapiens
tcactggtgcattt

SEQ ID NO: 4298048 - DNA, 23 bp, Homo sapiens
tcactggtgcatttaaaatggac

SEQ ID NO: 4298049 - DNA, 15 bp, Homo sapiens
tcactgtccattcca

SEQ ID NO: 4298050 - DNA, 14 bp, Homo sapiens
tcactgttcatgaa

SEQ ID NO: 4298051 - DNA, 14 bp, Homo sapiens
tcactgtttcacta

SEQ ID NO: 4298052 - DNA, 21 bp, Homo sapiens
tcactgtttcactactcagca

SEQ ID NO: 4298053 - DNA, 13 bp, Homo sapiens
tcacttatcagtt

SEQ ID NO: 4298054 - DNA, 23 bp, Homo sapiens
tcacttcaaacatgccctcaggc

SEQ ID NO: 4298055 - DNA, 24 bp, Homo sapiens
tcacttcaaacatgccctcaggct

SEQ ID NO: 4298056 - DNA, 23 bp, Homo sapiens
tcacttcaagctcaccctgctcc

SEQ ID NO: 4298057 - DNA, 15 bp, Homo sapiens
tcacttgtgtttgta

SEQ ID NO: 4298058 - DNA, 20 bp, Homo sapiens
tcacttgtgtttgtatataa

SEQ ID NO: 4298059 - DNA, 21 bp, Homo sapiens
tcactttaccttcagcagtta

SEQ ID NO: 4298060 - DNA, 22 bp, Homo sapiens
tcagaaacaaagcatttgactt

SEQ ID NO: 4298061 - DNA, 24 bp, Homo sapiens
tcagaaacaaagcatttgactttc

SEQ ID NO: 4298062 - DNA, 22 bp, Homo sapiens
tcagaaagggcagcccctcccc

SEQ ID NO: 4298063 - DNA, 13 bp, Homo sapiens
tcagaatctttaa

SEQ ID NO: 4298064 - DNA, 16 bp, Homo sapiens
tcagactgctttgaga

SEQ ID NO: 4298065 - DNA, 17 bp, Homo sapiens
tcagaggccccttgctg

SEQ ID NO: 4298066 - DNA, 22 bp, Homo sapiens
tcagaggccccttgctgctggc

SEQ ID NO: 4298067 - DNA, 20 bp, Homo sapiens
tcagagttcccaagaaagga

SEQ ID NO: 4298068 - DNA, 13 bp, Homo sapiens
tcagatgctggtc

SEQ ID NO: 4298069 - DNA, 23 bp, Homo sapiens
tcagatgctggtcatcctgggca

SEQ ID NO: 4298070 - DNA, 16 bp, Homo sapiens
tcagattgtaaaggta

SEQ ID NO: 4298071 - DNA, 14 bp, Homo sapiens
tcagcaattaaaga

SEQ ID NO: 4298072 - DNA, 18 bp, Homo sapiens
tcagcacagcctcacccc

SEQ ID NO: 4298073 - DNA, 17 bp, Homo sapiens
tcagcagttaccgagga

SEQ ID NO: 4298074 - DNA, 12 bp, Homo sapiens
tcagccacgcct

SEQ ID NO: 4298075 - DNA, 16 bp, Homo sapiens
tcagccacgcctctct

SEQ ID NO: 4298076 - DNA, 17 bp, Homo sapiens
tcagccacgcctctctc

SEQ ID NO: 4298077 - DNA, 13 bp, Homo sapiens
tcagcccaccccc

SEQ ID NO: 4298078 - DNA, 14 bp, Homo sapiens
tcagcccacccccc

SEQ ID NO: 4298079 - DNA, 18 bp, Homo sapiens
tcagcccacccccctcat

SEQ ID NO: 4298080 - DNA, 14 bp, Homo sapiens
tcagcccaggtctc

SEQ ID NO: 4298081 - DNA, 17 bp, Homo sapiens
tcagcccaggtctcctg

SEQ ID NO: 4298082 - DNA, 14 bp, Homo sapiens
tcagccccagggcc

SEQ ID NO: 4298083 - DNA, 20 bp, Homo sapiens
tcagccccagggccctgctc

SEQ ID NO: 4298084 - DNA, 20 bp, Homo sapiens
tcagcccctcttgcccccca

SEQ ID NO: 4298085 - DNA, 21 bp, Homo sapiens
tcagcccctcttgccccccac

SEQ ID NO: 4298086 - DNA, 14 bp, Homo sapiens
tcagccctccctgc

SEQ ID NO: 4298087 - DNA, 16 bp, Homo sapiens
tcagccctccctgccc

SEQ ID NO: 4298088 - DNA, 15 bp, Homo sapiens
tcagcggcctgggga

SEQ ID NO: 4298089 - DNA, 12 bp, Homo sapiens
tcagctgaccag

SEQ ID NO: 4298090 - DNA, 17 bp, Homo sapiens
tcagctgtctgtggctt

SEQ ID NO: 4298091 - DNA, 18 bp, Homo sapiens
tcaggaagcctcctgctg

SEQ ID NO: 4298092 - DNA, 14 bp, Homo sapiens
ggccggccctgccc

SEQ ID NO: 4298093 - DNA, 15 bp, Homo sapiens
ggccggccctgcccc

SEQ ID NO: 4298094 - DNA, 21 bp, Homo sapiens
ggccgggctggcttctccctg

SEQ ID NO: 4298095 - DNA, 15 bp, Homo sapiens
ggccgggggtggggg

SEQ ID NO: 4298096 - DNA, 19 bp, Homo sapiens
ggccgggggtgggggcctg

SEQ ID NO: 4298097 - DNA, 23 bp, Homo sapiens
ggccgggggtgggggcctgctgt

SEQ ID NO: 4298098 - DNA, 15 bp, Homo sapiens
ggccgtgcagggcca

SEQ ID NO: 4298099 - DNA, 18 bp, Homo sapiens
ggccgtggagtcgagctg

SEQ ID NO: 4298100 - DNA, 21 bp, Homo sapiens
ggccgttgcctctctgccagc

SEQ ID NO: 4298101 - DNA, 14 bp, Homo sapiens
ggcctagtggcttc

SEQ ID NO: 4298102 - DNA, 23 bp, Homo sapiens
ggcctagtggcttcagcccctgg

SEQ ID NO: 4298103 - DNA, 15 bp, Homo sapiens
ggcctcaaccctccc

SEQ ID NO: 4298104 - DNA, 16 bp, Homo sapiens
ggcctcaaccctccct

SEQ ID NO: 4298105 - DNA, 18 bp, Homo sapiens
ggcctcaaccctccctca

SEQ ID NO: 4298106 - DNA, 21 bp, Homo sapiens
ggcctcaaccctccctcagcc

SEQ ID NO: 4298107 - DNA, 22 bp, Homo sapiens
ggcctcaaccctccctcagccc

SEQ ID NO: 4298108 - DNA, 13 bp, Homo sapiens
ggcctcacctggc

SEQ ID NO: 4298109 - DNA, 16 bp, Homo sapiens
ggcctcacctggcttc

SEQ ID NO: 4298110 - DNA, 21 bp, Homo sapiens
ggcctcacctggcttcccagg

SEQ ID NO: 4298111 - DNA, 23 bp, Homo sapiens
ggcctcacctggcttcccaggac

SEQ ID NO: 4298112 - DNA, 18 bp, Homo sapiens
ggcctcagcagaaggcct

SEQ ID NO: 4298113 - DNA, 22 bp, Homo sapiens
ggcctcagcagaaggccttgcc

SEQ ID NO: 4298114 - DNA, 22 bp, Homo sapiens
ggcctcagtggactttccaccc

SEQ ID NO: 4298115 - DNA, 20 bp, Homo sapiens
ggcctccagccctctcactg

SEQ ID NO: 4298116 - DNA, 19 bp, Homo sapiens
ggcctcccagccacccgga

SEQ ID NO: 4298117 - DNA, 17 bp, Homo sapiens
ggcctgaaatgtttcca

SEQ ID NO: 4298118 - DNA, 10 bp, Homo sapiens
ggcctgaggg

SEQ ID NO: 4298119 - DNA, 19 bp, Homo sapiens
ggcctgagttgaggggctt

SEQ ID NO: 4298120 - DNA, 13 bp, Homo sapiens
ggcctgatggcca

SEQ ID NO: 4298121 - DNA, 18 bp, Homo sapiens
ggcctgatggccaggcct

SEQ ID NO: 4298122 - DNA, 20 bp, Homo sapiens
ggcctgccactctcctgagg

SEQ ID NO: 4298123 - DNA, 18 bp, Homo sapiens
ggcctgccccccttccca

SEQ ID NO: 4298124 - DNA, 12 bp, Homo sapiens
ggcctgctgtgg

SEQ ID NO: 4298125 - DNA, 12 bp, Homo sapiens
ggcctggcccag

SEQ ID NO: 4298126 - DNA, 18 bp, Homo sapiens
ggcctggcccagccagca

SEQ ID NO: 4298127 - DNA, 19 bp, Homo sapiens
ggcctggcccagccagcag

SEQ ID NO: 4298128 - DNA, 20 bp, Homo sapiens
ggcctggcccagccagcagg

SEQ ID NO: 4298129 - DNA, 22 bp, Homo sapiens
ggcctgggaaaagggcaggagc

SEQ ID NO: 4298130 - DNA, 19 bp, Homo sapiens
ggcctggtgccctggccca

SEQ ID NO: 4298131 - DNA, 20 bp, Homo sapiens
ggcctggtgccctggcccag

SEQ ID NO: 4298132 - DNA, 23 bp, Homo sapiens
ggcctgtccacctgtgctgctgc

SEQ ID NO: 4298133 - DNA, 20 bp, Homo sapiens
ggcgagccagattaggcctg

SEQ ID NO: 4298134 - DNA, 23 bp, Homo sapiens
ggcgagccagattaggcctggag

SEQ ID NO: 4298135 - DNA, 19 bp, Homo sapiens
ggcgcacccggcagccccc

SEQ ID NO: 4298136 - DNA, 15 bp, Homo sapiens
ggcgctgagggcagg

SEQ ID NO: 4298137 - DNA, 16 bp, Homo sapiens
ggcggggccaggatgg

SEQ ID NO: 4298138 - DNA, 14 bp, Homo sapiens
ggcggggctggcca

SEQ ID NO: 4298139 - DNA, 15 bp, Homo sapiens
ggcggggctggccag

SEQ ID NO: 4298140 - DNA, 15 bp, Homo sapiens
ggcggtatccagagg

SEQ ID NO: 4298141 - DNA, 21 bp, Homo sapiens
ggcgtagggccagggctctgg

SEQ ID NO: 4298142 - DNA, 21 bp, Homo sapiens
ggcgtccctgagggcccttcc

SEQ ID NO: 4298143 - DNA, 22 bp, Homo sapiens
ggcgtgggatccagagagaagc

SEQ ID NO: 4298144 - DNA, 22 bp, Homo sapiens
ggctaaaaaagctgaatcagac

SEQ ID NO: 4298145 - DNA, 14 bp, Homo sapiens
ggctaagcctggac

SEQ ID NO: 4298146 - DNA, 13 bp, Homo sapiens
ggctactgccact

SEQ ID NO: 4298147 - DNA, 16 bp, Homo sapiens
ggctagactgggctgg

SEQ ID NO: 4298148 - DNA, 22 bp, Homo sapiens
ggctagactgggctggctgcct

SEQ ID NO: 4298149 - DNA, 18 bp, Homo sapiens
ggctatgccactaggccc

SEQ ID NO: 4298150 - DNA, 19 bp, Homo sapiens
ggctattcctaggcctcag

SEQ ID NO: 4298151 - DNA, 18 bp, Homo sapiens
ggctcacaccagccctgg

SEQ ID NO: 4298152 - DNA, 14 bp, Homo sapiens
ggctcacagccacc

SEQ ID NO: 4298153 - DNA, 15 bp, Homo sapiens
ggctcacagccacca

SEQ ID NO: 4298154 - DNA, 23 bp, Homo sapiens
ggctcatgattttttacaaatta

SEQ ID NO: 4298155 - DNA, 22 bp, Homo sapiens
ggctccacgggggcctagtggc

SEQ ID NO: 4298156 - DNA, 17 bp, Homo sapiens
ggctcccacaggccctt

SEQ ID NO: 4298157 - DNA, 18 bp, Homo sapiens
ggctcccacgccctcctc

SEQ ID NO: 4298158 - DNA, 21 bp, Homo sapiens
ggctcccacgccctcctccct

SEQ ID NO: 4298159 - DNA, 15 bp, Homo sapiens
ggctcccagcagagg

SEQ ID NO: 4298160 - DNA, 13 bp, Homo sapiens
ggctcccatctcc

SEQ ID NO: 4298161 - DNA, 19 bp, Homo sapiens
ggctccctccctccctgct

SEQ ID NO: 4298162 - DNA, 23 bp, Homo sapiens
ggctccctccctccctgctccct

SEQ ID NO: 4298163 - DNA, 13 bp, Homo sapiens
ggctccctgggct

SEQ ID NO: 4298164 - DNA, 18 bp, Homo sapiens
ggctccgggctgtgtcct

SEQ ID NO: 4298165 - DNA, 12 bp, Homo sapiens
ggctcctccagc

SEQ ID NO: 4298166 - DNA, 13 bp, Homo sapiens
ggctcctccagca

SEQ ID NO: 4298167 - DNA, 21 bp, Homo sapiens
ggctctgaatgtagccagccc

SEQ ID NO: 4298168 - DNA, 13 bp, Homo sapiens
ggctctgcagcac

SEQ ID NO: 4298169 - DNA, 13 bp, Homo sapiens
ggctcttctcctt

SEQ ID NO: 4298170 - DNA, 16 bp, Homo sapiens
ggctcttctcctttca

SEQ ID NO: 4298171 - DNA, 13 bp, Homo sapiens
ggctgagctgtgc

SEQ ID NO: 4298172 - DNA, 14 bp, Homo sapiens
ggctgagctgtgcc

SEQ ID NO: 4298173 - DNA, 16 bp, Homo sapiens
ggctgagctgtgccag

SEQ ID NO: 4298174 - DNA, 19 bp, Homo sapiens
ggctgagctgtgccagctg

SEQ ID NO: 4298175 - DNA, 15 bp, Homo sapiens
ggctgcacctgcagg

SEQ ID NO: 4298176 - DNA, 21 bp, Homo sapiens
ggctgcatcctcagccccagg

SEQ ID NO: 4298177 - DNA, 22 bp, Homo sapiens
ggctgcatcctcagccccaggg

SEQ ID NO: 4298178 - DNA, 13 bp, Homo sapiens
ggctgccctggtg

SEQ ID NO: 4298179 - DNA, 19 bp, Homo sapiens
ggctgccctggtgctgcca

SEQ ID NO: 4298180 - DNA, 19 bp, Homo sapiens
ggctgctgcactgccctcc

SEQ ID NO: 4298181 - DNA, 20 bp, Homo sapiens
ggctggagtgcagtggtgcg

SEQ ID NO: 4298182 - DNA, 15 bp, Homo sapiens
ggctggcatggggag

SEQ ID NO: 4298183 - DNA, 21 bp, Homo sapiens
ggctggcatggggaggggaga

SEQ ID NO: 4298184 - DNA, 15 bp, Homo sapiens
ggctggctgccttct

SEQ ID NO: 4298185 - DNA, 16 bp, Homo sapiens
ggctggctgccttctg

SEQ ID NO: 4298186 - DNA, 17 bp, Homo sapiens
ggctgggagcctcgccc

SEQ ID NO: 4298187 - DNA, 12 bp, Homo sapiens
ggctgggcagag

SEQ ID NO: 4298188 - DNA, 14 bp, Homo sapiens
ggctgggcccagaa

SEQ ID NO: 4298189 - DNA, 17 bp, Homo sapiens
ggctgggcccgagggtc

SEQ ID NO: 4298190 - DNA, 14 bp, Homo sapiens
ggctgggtggccgg

SEQ ID NO: 4298191 - DNA, 21 bp, Homo sapiens
ggctgggtggccggccctgcc

SEQ ID NO: 4298192 - DNA, 19 bp, Homo sapiens
ggctggtttggtggccagg

SEQ ID NO: 4298193 - DNA, 14 bp, Homo sapiens
ggctgtattttctt

SEQ ID NO: 4298194 - DNA, 17 bp, Homo sapiens
ggctgtatttttagaga

SEQ ID NO: 4298195 - DNA, 19 bp, Homo sapiens
ggctgtcagtcgtgttgct

SEQ ID NO: 4298196 - DNA, 14 bp, Homo sapiens
ggctgtcccctgca

SEQ ID NO: 4298197 - DNA, 10 bp, Homo sapiens
ggctgtcctt

SEQ ID NO: 4298198 - DNA, 22 bp, Homo sapiens
ggctgtccttagactccttctc

SEQ ID NO: 4298199 - DNA, 15 bp, Homo sapiens
ggctgtggcccctcc

SEQ ID NO: 4298200 - DNA, 17 bp, Homo sapiens
ggctgtggcccctcctt

SEQ ID NO: 4298201 - DNA, 17 bp, Homo sapiens
ggcttacacgtggagga

SEQ ID NO: 4298202 - DNA, 14 bp, Homo sapiens
ggcttcagcccctg

SEQ ID NO: 4298203 - DNA, 14 bp, Homo sapiens
ggcttccatggtgg

SEQ ID NO: 4298204 - DNA, 13 bp, Homo sapiens
ggcttcccaggac

SEQ ID NO: 4298205 - DNA, 21 bp, Homo sapiens
ggcttcccgctcagccctccc

SEQ ID NO: 4298206 - DNA, 15 bp, Homo sapiens
ggcttccctctgctc

SEQ ID NO: 4298207 - DNA, 16 bp, Homo sapiens
ggcttccctctgctcc

SEQ ID NO: 4298208 - DNA, 13 bp, Homo sapiens
ggcttcctgccct

SEQ ID NO: 4298209 - DNA, 16 bp, Homo sapiens
ggcttggaagggcgct

SEQ ID NO: 4298210 - DNA, 17 bp, Homo sapiens
ggcttggggtagagagg

SEQ ID NO: 4298211 - DNA, 19 bp, Homo sapiens
ggcttggggtagagaggac

SEQ ID NO: 4298212 - DNA, 20 bp, Homo sapiens
ggcttggggtagagaggaca

SEQ ID NO: 4298213 - DNA, 15 bp, Homo sapiens
ggcttgtcagagctg

SEQ ID NO: 4298214 - DNA, 16 bp, Homo sapiens
ggcttgtcagagctgg

SEQ ID NO: 4298215 - DNA, 15 bp, Homo sapiens
ggcttttcactgctg

SEQ ID NO: 4298216 - DNA, 17 bp, Homo sapiens
ggcttttcactgctggc

SEQ ID NO: 4298217 - DNA, 23 bp, Homo sapiens
ggctttttccatatagtttgttt

SEQ ID NO: 4298218 - DNA, 16 bp, Homo sapiens
gggaaaacataatatc

SEQ ID NO: 4298219 - DNA, 13 bp, Homo sapiens
gggaaaagggcag

SEQ ID NO: 4298220 - DNA, 19 bp, Homo sapiens
gggaaagccagtgactcca

SEQ ID NO: 4298221 - DNA, 12 bp, Homo sapiens
gggaaaggccgg

SEQ ID NO: 4298222 - DNA, 19 bp, Homo sapiens
gggaaaggccggtgggaag

SEQ ID NO: 4298223 - DNA, 18 bp, Homo sapiens
gggaaatccaactccagg

SEQ ID NO: 4298224 - DNA, 22 bp, Homo sapiens
gggaagatcctccttccaggcc

SEQ ID NO: 4298225 - DNA, 23 bp, Homo sapiens
gggaagatcctccttccaggccc

SEQ ID NO: 4298226 - DNA, 20 bp, Homo sapiens
tacagtagctgtggggagct

SEQ ID NO: 4298227 - DNA, 15 bp, Homo sapiens
tacagtggagggaga

SEQ ID NO: 4298228 - DNA, 16 bp, Homo sapiens
tacagtgtatctcgaa

SEQ ID NO: 4298229 - DNA, 14 bp, Homo sapiens
tacagttatacata

SEQ ID NO: 4298230 - DNA, 15 bp, Homo sapiens
tacagttctggagga

SEQ ID NO: 4298231 - DNA, 16 bp, Homo sapiens
tacagttctggaggag

SEQ ID NO: 4298232 - DNA, 17 bp, Homo sapiens
tacagttctggaggagg

SEQ ID NO: 4298233 - DNA, 23 bp, Homo sapiens
tacatacctctctctatatatac

SEQ ID NO: 4298234 - DNA, 16 bp, Homo sapiens
tacatagtctgaagtg

SEQ ID NO: 4298235 - DNA, 13 bp, Homo sapiens
tacatagtctttg

SEQ ID NO: 4298236 - DNA, 22 bp, Homo sapiens
tacatatggaaatcctgttact

SEQ ID NO: 4298237 - DNA, 21 bp, Homo sapiens
tacatctaagtcagtttcaca

SEQ ID NO: 4298238 - DNA, 20 bp, Homo sapiens
tacatgcattactgcatgca

SEQ ID NO: 4298239 - DNA, 16 bp, Homo sapiens
tacatggtagcagggt

SEQ ID NO: 4298240 - DNA, 20 bp, Homo sapiens
tacattagcagtttgctttg

SEQ ID NO: 4298241 - DNA, 20 bp, Homo sapiens
tacattcttcaagatcccat

SEQ ID NO: 4298242 - DNA, 21 bp, Homo sapiens
tacatttggctccactgtaaa

SEQ ID NO: 4298243 - DNA, 22 bp, Homo sapiens
taccaatcaacagcatgtctac

SEQ ID NO: 4298244 - DNA, 16 bp, Homo sapiens
taccatatacagctca

SEQ ID NO: 4298245 - DNA, 16 bp, Homo sapiens
taccatcggtcagcag

SEQ ID NO: 4298246 - DNA, 22 bp, Homo sapiens
tacccaccccttcccgccctcc

SEQ ID NO: 4298247 - DNA, 19 bp, Homo sapiens
taccccagaacgcatgcag

SEQ ID NO: 4298248 - DNA, 19 bp, Homo sapiens
taccccaggatgcatgcag

SEQ ID NO: 4298249 - DNA, 12 bp, Homo sapiens
taccccctgccc

SEQ ID NO: 4298250 - DNA, 18 bp, Homo sapiens
taccccctgccccagaga

SEQ ID NO: 4298251 - DNA, 20 bp, Homo sapiens
tacccggctcgttcccccag

SEQ ID NO: 4298252 - DNA, 17 bp, Homo sapiens
taccctaggtctccacc

SEQ ID NO: 4298253 - DNA, 11 bp, Homo sapiens
taccctccctg

SEQ ID NO: 4298254 - DNA, 15 bp, Homo sapiens
taccctccctgtccc

SEQ ID NO: 4298255 - DNA, 12 bp, Homo sapiens
taccctttccca

SEQ ID NO: 4298256 - DNA, 17 bp, Homo sapiens
taccgagtctcttctcc

SEQ ID NO: 4298257 - DNA, 20 bp, Homo sapiens
tacctcactggtgcatttaa

SEQ ID NO: 4298258 - DNA, 20 bp, Homo sapiens
tacctctctctatatataca

SEQ ID NO: 4298259 - DNA, 14 bp, Homo sapiens
tacctctctgtcat

SEQ ID NO: 4298260 - DNA, 18 bp, Homo sapiens
tacctctgcataaatatt

SEQ ID NO: 4298261 - DNA, 21 bp, Homo sapiens
tacctgcccccactcagcatt

SEQ ID NO: 4298262 - DNA, 15 bp, Homo sapiens
tacctggaatcaaat

SEQ ID NO: 4298263 - DNA, 22 bp, Homo sapiens
tacctggcttagcgttctgttt

SEQ ID NO: 4298264 - DNA, 17 bp, Homo sapiens
tacctgggaaatttgcc

SEQ ID NO: 4298265 - DNA, 19 bp, Homo sapiens
tacctggttttcattattt

SEQ ID NO: 4298266 - DNA, 19 bp, Homo sapiens
taccttcagtaaacaccat

SEQ ID NO: 4298267 - DNA, 21 bp, Homo sapiens
tacctttaaaaaataatttag

SEQ ID NO: 4298268 - DNA, 22 bp, Homo sapiens
tacctttaaaaaataatttaga

SEQ ID NO: 4298269 - DNA, 15 bp, Homo sapiens
tacggtgagactctg

SEQ ID NO: 4298270 - DNA, 14 bp, Homo sapiens
tactaaatatgaaa

SEQ ID NO: 4298271 - DNA, 13 bp, Homo sapiens
tactaagaataaa

SEQ ID NO: 4298272 - DNA, 16 bp, Homo sapiens
tactaatgagctttgg

SEQ ID NO: 4298273 - DNA, 14 bp, Homo sapiens
tactattatttgtt

SEQ ID NO: 4298274 - DNA, 17 bp, Homo sapiens
tactcaccaaaatatag

SEQ ID NO: 4298275 - DNA, 14 bp, Homo sapiens
tactgattgaatgt

SEQ ID NO: 4298276 - DNA, 23 bp, Homo sapiens
tactgtgtgtgagtgtgaatata

SEQ ID NO: 4298277 - DNA, 17 bp, Homo sapiens
tactgtttgtaatatac

SEQ ID NO: 4298278 - DNA, 20 bp, Homo sapiens
tactgtttgtaatatacagt

SEQ ID NO: 4298279 - DNA, 22 bp, Homo sapiens
tactgtttgtaatatacagttt

SEQ ID NO: 4298280 - DNA, 21 bp, Homo sapiens
tactgttttgtgcggtgtgtc

SEQ ID NO: 4298281 - DNA, 23 bp, Homo sapiens
tactgttttgtgcggtgtgtctc

SEQ ID NO: 4298282 - DNA, 16 bp, Homo sapiens
tacttaaaaatatgtg

SEQ ID NO: 4298283 - DNA, 18 bp, Homo sapiens
tacttaaaaatttattag

SEQ ID NO: 4298284 - DNA, 13 bp, Homo sapiens
tacttaaagcttg

SEQ ID NO: 4298285 - DNA, 23 bp, Homo sapiens
tacttacatgcattactgcatgc

SEQ ID NO: 4298286 - DNA, 17 bp, Homo sapiens
tacttcctggattttct

SEQ ID NO: 4298287 - DNA, 12 bp, Homo sapiens
tacttcttctgt

SEQ ID NO: 4298288 - DNA, 17 bp, Homo sapiens
tacttcttctgtaatat

SEQ ID NO: 4298289 - DNA, 14 bp, Homo sapiens
tacttctttttcat

SEQ ID NO: 4298290 - DNA, 18 bp, Homo sapiens
tacttgagaataaatgag

SEQ ID NO: 4298291 - DNA, 19 bp, Homo sapiens
tacttgtgaaacacagctg

SEQ ID NO: 4298292 - DNA, 22 bp, Homo sapiens
tactttaggtagtagaatctca

SEQ ID NO: 4298293 - DNA, 17 bp, Homo sapiens
tactttatgttactaca

SEQ ID NO: 4298294 - DNA, 20 bp, Homo sapiens
tactttccaacattatcctg

SEQ ID NO: 4298295 - DNA, 17 bp, Homo sapiens
tactttcctgatgttga

SEQ ID NO: 4298296 - DNA, 22 bp, Homo sapiens
tactttcctgatgttgataata

SEQ ID NO: 4298297 - DNA, 23 bp, Homo sapiens
tactttgatattttcaacgcagc

SEQ ID NO: 4298298 - DNA, 18 bp, Homo sapiens
tactttgcattgtctgtc

SEQ ID NO: 4298299 - DNA, 16 bp, Homo sapiens
tactttgtatacaagt

SEQ ID NO: 4298300 - DNA, 16 bp, Homo sapiens
tacttttgtgtattct

SEQ ID NO: 4298301 - DNA, 23 bp, Homo sapiens
tagaaaggttgattctcatgcac

SEQ ID NO: 4298302 - DNA, 13 bp, Homo sapiens
tagaaccttctaa

SEQ ID NO: 4298303 - DNA, 18 bp, Homo sapiens
tagaactgttcatttcca

SEQ ID NO: 4298304 - DNA, 17 bp, Homo sapiens
tagaagagtctattgtc

SEQ ID NO: 4298305 - DNA, 16 bp, Homo sapiens
tagaaggtcggaggct

SEQ ID NO: 4298306 - DNA, 17 bp, Homo sapiens
tagaatatcctatactg

SEQ ID NO: 4298307 - DNA, 22 bp, Homo sapiens
tagaatatcctatactggttat

SEQ ID NO: 4298308 - DNA, 21 bp, Homo sapiens
tagaatcagcctaggggtcag

SEQ ID NO: 4298309 - DNA, 15 bp, Homo sapiens
tagaattaccatttg

SEQ ID NO: 4298310 - DNA, 19 bp, Homo sapiens
tagaattaccatttgttaa

SEQ ID NO: 4298311 - DNA, 11 bp, Homo sapiens
tagacaagcct

SEQ ID NO: 4298312 - DNA, 13 bp, Homo sapiens
tagacaagcctgg

SEQ ID NO: 4298313 - DNA, 14 bp, Homo sapiens
tagacatctgtcct

SEQ ID NO: 4298314 - DNA, 16 bp, Homo sapiens
tagactgaatttaact

SEQ ID NO: 4298315 - DNA, 20 bp, Homo sapiens
tagagaaaatggaacattaa

SEQ ID NO: 4298316 - DNA, 22 bp, Homo sapiens
tagagtgcccttaaaataatga

SEQ ID NO: 4298317 - DNA, 19 bp, Homo sapiens
tagagtggtctatttctcc

SEQ ID NO: 4298318 - DNA, 16 bp, Homo sapiens
tagatattcatacttt

SEQ ID NO: 4298319 - DNA, 20 bp, Homo sapiens
tagatctcctgtaattttgt

SEQ ID NO: 4298320 - DNA, 23 bp, Homo sapiens
tagatctcctgtaattttgtagt

SEQ ID NO: 4298321 - DNA, 18 bp, Homo sapiens
tagatgcctgggcctgat

SEQ ID NO: 4298322 - DNA, 14 bp, Homo sapiens
tagatgctgactgt

SEQ ID NO: 4298323 - DNA, 18 bp, Homo sapiens
tagcaaacagatgtttgt

SEQ ID NO: 4298324 - DNA, 16 bp, Homo sapiens
tagcaaagatatctca

SEQ ID NO: 4298325 - DNA, 19 bp, Homo sapiens
tagcaaagatatctcatct

SEQ ID NO: 4298326 - DNA, 19 bp, Homo sapiens
tagcaagaagattctaaaa

SEQ ID NO: 4298327 - DNA, 20 bp, Homo sapiens
tagcacagaggatggcttcc

SEQ ID NO: 4298328 - DNA, 12 bp, Homo sapiens
tagcactttata

SEQ ID NO: 4298329 - DNA, 15 bp, Homo sapiens
tagcagagtcattgt

SEQ ID NO: 4298330 - DNA, 13 bp, Homo sapiens
tagcaggaaatag

SEQ ID NO: 4298331 - DNA, 15 bp, Homo sapiens
tagcagtttgcctct

SEQ ID NO: 4298332 - DNA, 17 bp, Homo sapiens
tagcagtttgcctctgc

SEQ ID NO: 4298333 - DNA, 18 bp, Homo sapiens
tagcagtttgcctctgca

SEQ ID NO: 4298334 - DNA, 20 bp, Homo sapiens
tagcagtttgcctctgcacg

SEQ ID NO: 4298335 - DNA, 23 bp, Homo sapiens
tagcagtttgcctctgcacgtgc

SEQ ID NO: 4298336 - DNA, 14 bp, Homo sapiens
tagcatcctgatta

SEQ ID NO: 4298337 - DNA, 19 bp, Homo sapiens
tagcatcctgattattgaa

SEQ ID NO: 4298338 - DNA, 13 bp, Homo sapiens
tagcatgaaaggt

SEQ ID NO: 4298339 - DNA, 18 bp, Homo sapiens
tagcatgacaagccccag

SEQ ID NO: 4298340 - DNA, 20 bp, Homo sapiens
tagcatgacaagccccaggc

SEQ ID NO: 4298341 - DNA, 22 bp, Homo sapiens
tagcatgacaagccccaggcag

SEQ ID NO: 4298342 - DNA, 13 bp, Homo sapiens
tagccttctctgt

SEQ ID NO: 4298343 - DNA, 20 bp, Homo sapiens
tagccttctctgttcatttc

SEQ ID NO: 4298344 - DNA, 22 bp, Homo sapiens
tagccttctctgttcatttcct

SEQ ID NO: 4298345 - DNA, 13 bp, Homo sapiens
tagcggtttgcaa

SEQ ID NO: 4298346 - DNA, 13 bp, Homo sapiens
tagctaattagct

SEQ ID NO: 4298347 - DNA, 15 bp, Homo sapiens
tagctaattagctct

SEQ ID NO: 4298348 - DNA, 13 bp, Homo sapiens
tagctagaatatc

SEQ ID NO: 4298349 - DNA, 14 bp, Homo sapiens
tagctcgtgtgctt

SEQ ID NO: 4298350 - DNA, 17 bp, Homo sapiens
tagctgtggggagctgg

SEQ ID NO: 4298351 - DNA, 18 bp, Homo sapiens
tagctgtggggagctggt

SEQ ID NO: 4298352 - DNA, 16 bp, Homo sapiens
tagcttcagtcattaa

SEQ ID NO: 4298353 - DNA, 21 bp, Homo sapiens
tagcttcagtcattaaattac

SEQ ID NO: 4298354 - DNA, 22 bp, Homo sapiens
taggacccaaggtggtcttgga

SEQ ID NO: 4298355 - DNA, 21 bp, Homo sapiens
taggagcagtgggccctggct

SEQ ID NO: 4298356 - DNA, 22 bp, Homo sapiens
taggagcagtgggccctggctc

SEQ ID NO: 4298357 - DNA, 17 bp, Homo sapiens
taggagcttccagatgg

SEQ ID NO: 4298358 - DNA, 18 bp, Homo sapiens
taggaggaatgtgctttt

SEQ ID NO: 4298359 - DNA, 21 bp, Homo sapiens
tatcttcgttagtaatctgta

SEQ ID NO: 4298360 - DNA, 15 bp, Homo sapiens
tatcttctggactat

SEQ ID NO: 4298361 - DNA, 12 bp, Homo sapiens
tatcttgaagaa

SEQ ID NO: 4298362 - DNA, 15 bp, Homo sapiens
tatgaaatatatgtg

SEQ ID NO: 4298363 - DNA, 21 bp, Homo sapiens
tatgaaggctgtacactgcac

SEQ ID NO: 4298364 - DNA, 17 bp, Homo sapiens
tatgaagttaacagtct

SEQ ID NO: 4298365 - DNA, 22 bp, Homo sapiens
tatgaataattatgtttacctc

SEQ ID NO: 4298366 - DNA, 15 bp, Homo sapiens
tatgaatctgagaga

SEQ ID NO: 4298367 - DNA, 17 bp, Homo sapiens
tatgacaatttcaaaat

SEQ ID NO: 4298368 - DNA, 20 bp, Homo sapiens
tatgacaatttcaaaatgca

SEQ ID NO: 4298369 - DNA, 18 bp, Homo sapiens
tatgacctcaacaaagaa

SEQ ID NO: 4298370 - DNA, 16 bp, Homo sapiens
tatgagatactttgca

SEQ ID NO: 4298371 - DNA, 16 bp, Homo sapiens
tatgaggggactgcat

SEQ ID NO: 4298372 - DNA, 19 bp, Homo sapiens
tatgatataataaatatat

SEQ ID NO: 4298373 - DNA, 21 bp, Homo sapiens
tatgattagctttgtcactgt

SEQ ID NO: 4298374 - DNA, 15 bp, Homo sapiens
tatgattctcctctc

SEQ ID NO: 4298375 - DNA, 18 bp, Homo sapiens
tatgattctcctctccca

SEQ ID NO: 4298376 - DNA, 15 bp, Homo sapiens
tatgattgaaaagaa

SEQ ID NO: 4298377 - DNA, 16 bp, Homo sapiens
tatgattgaaaagaag

SEQ ID NO: 4298378 - DNA, 19 bp, Homo sapiens
tatgattgaaaagaagaaa

SEQ ID NO: 4298379 - DNA, 16 bp, Homo sapiens
tatgcacctataaata

SEQ ID NO: 4298380 - DNA, 17 bp, Homo sapiens
tatgcacctataaatac

SEQ ID NO: 4298381 - DNA, 16 bp, Homo sapiens
tatgcccctccccagt

SEQ ID NO: 4298382 - DNA, 17 bp, Homo sapiens
tatgcctgtatttccaa

SEQ ID NO: 4298383 - DNA, 22 bp, Homo sapiens
tatgctgagtatgttaagctct

SEQ ID NO: 4298384 - DNA, 15 bp, Homo sapiens
tatgctgcaatacat

SEQ ID NO: 4298385 - DNA, 12 bp, Homo sapiens
tatgctgctgtg

SEQ ID NO: 4298386 - DNA, 18 bp, Homo sapiens
tatgctgctgtgaatttt

SEQ ID NO: 4298387 - DNA, 20 bp, Homo sapiens
tatggatatttttaatttat

SEQ ID NO: 4298388 - DNA, 13 bp, Homo sapiens
tatggctgtattt

SEQ ID NO: 4298389 - DNA, 18 bp, Homo sapiens
tatggcttgtagggtgag

SEQ ID NO: 4298390 - DNA, 22 bp, Homo sapiens
tatggctttgtgcttgttcttc

SEQ ID NO: 4298391 - DNA, 19 bp, Homo sapiens
tatggggggccaacaccag

SEQ ID NO: 4298392 - DNA, 14 bp, Homo sapiens
tatgtacagttata

SEQ ID NO: 4298393 - DNA, 16 bp, Homo sapiens
tatgtcagtcactaaa

SEQ ID NO: 4298394 - DNA, 14 bp, Homo sapiens
tatgtcattaaagt

SEQ ID NO: 4298395 - DNA, 11 bp, Homo sapiens
tatgtctgtga

SEQ ID NO: 4298396 - DNA, 14 bp, Homo sapiens
tatgtgaaaggata

SEQ ID NO: 4298397 - DNA, 22 bp, Homo sapiens
tatgtgaaaggatatgaatctg

SEQ ID NO: 4298398 - DNA, 16 bp, Homo sapiens
tatgtgaaagtgtaaa

SEQ ID NO: 4298399 - DNA, 21 bp, Homo sapiens
tatgtgaattgaagtcatcat

SEQ ID NO: 4298400 - DNA, 17 bp, Homo sapiens
tatgtgagcatgaaact

SEQ ID NO: 4298401 - DNA, 14 bp, Homo sapiens
tatgtgcttgaaga

SEQ ID NO: 4298402 - DNA, 12 bp, Homo sapiens
tatgtgtcatga

SEQ ID NO: 4298403 - DNA, 16 bp, Homo sapiens
tatgtgtcatgatttc

SEQ ID NO: 4298404 - DNA, 18 bp, Homo sapiens
tatgttaagctctttatg

SEQ ID NO: 4298405 - DNA, 18 bp, Homo sapiens
tatgttactacatgcact

SEQ ID NO: 4298406 - DNA, 20 bp, Homo sapiens
tatgttatacaaccttcatt

SEQ ID NO: 4298407 - DNA, 15 bp, Homo sapiens
tatgttgctgaaaca

SEQ ID NO: 4298408 - DNA, 14 bp, Homo sapiens
tatgttttagcatg

SEQ ID NO: 4298409 - DNA, 12 bp, Homo sapiens
tattaaatcaga

SEQ ID NO: 4298410 - DNA, 21 bp, Homo sapiens
tattaaatcggcaacagggct

SEQ ID NO: 4298411 - DNA, 22 bp, Homo sapiens
tattaaccaaattaacctttca

SEQ ID NO: 4298412 - DNA, 14 bp, Homo sapiens
tattactaaattga

SEQ ID NO: 4298413 - DNA, 18 bp, Homo sapiens
tattactgatgtgtgcaa

SEQ ID NO: 4298414 - DNA, 22 bp, Homo sapiens
tattagccctgcattttcatag

SEQ ID NO: 4298415 - DNA, 14 bp, Homo sapiens
tattatgattagct

SEQ ID NO: 4298416 - DNA, 20 bp, Homo sapiens
tattcaactaatacatggtt

SEQ ID NO: 4298417 - DNA, 20 bp, Homo sapiens
tattcagagatgtaccatgt

SEQ ID NO: 4298418 - DNA, 19 bp, Homo sapiens
tattcaggaccccatctgc

SEQ ID NO: 4298419 - DNA, 18 bp, Homo sapiens
tattccatccatatactt

SEQ ID NO: 4298420 - DNA, 21 bp, Homo sapiens
tattcccatggtagactgtga

SEQ ID NO: 4298421 - DNA, 18 bp, Homo sapiens
tattccttggcccagcag

SEQ ID NO: 4298422 - DNA, 19 bp, Homo sapiens
tattctagtcaactgctgt

SEQ ID NO: 4298423 - DNA, 12 bp, Homo sapiens
tattctattgca

SEQ ID NO: 4298424 - DNA, 17 bp, Homo sapiens
tattctgtggattctat

SEQ ID NO: 4298425 - DNA, 19 bp, Homo sapiens
tattctgtggattctatat

SEQ ID NO: 4298426 - DNA, 21 bp, Homo sapiens
tattctgtggattctatattt

SEQ ID NO: 4298427 - DNA, 19 bp, Homo sapiens
tattcttgctttcacaaat

SEQ ID NO: 4298428 - DNA, 13 bp, Homo sapiens
tattgaatgttat

SEQ ID NO: 4298429 - DNA, 17 bp, Homo sapiens
tattgagcagaattcat

SEQ ID NO: 4298430 - DNA, 18 bp, Homo sapiens
tattgagcagaattcatt

SEQ ID NO: 4298431 - DNA, 20 bp, Homo sapiens
tattgcccatgatataactt

SEQ ID NO: 4298432 - DNA, 21 bp, Homo sapiens
tattgcccatgatataacttt

SEQ ID NO: 4298433 - DNA, 15 bp, Homo sapiens
tattgctgaagaatc

SEQ ID NO: 4298434 - DNA, 20 bp, Homo sapiens
tattggttttaaaaaagcat

SEQ ID NO: 4298435 - DNA, 11 bp, Homo sapiens
tattgtaatat

SEQ ID NO: 4298436 - DNA, 15 bp, Homo sapiens
tattgtagcatttct

SEQ ID NO: 4298437 - DNA, 14 bp, Homo sapiens
tattgtatgtacct

SEQ ID NO: 4298438 - DNA, 18 bp, Homo sapiens
tattgtattgttagatgt

SEQ ID NO: 4298439 - DNA, 20 bp, Homo sapiens
tattgttaaaaccttactta

SEQ ID NO: 4298440 - DNA, 16 bp, Homo sapiens
tattgttacagctgaa

SEQ ID NO: 4298441 - DNA, 22 bp, Homo sapiens
tatttaaaaaaaaacattcaaa

SEQ ID NO: 4298442 - DNA, 21 bp, Homo sapiens
tatttagcatgacaagcccca

SEQ ID NO: 4298443 - DNA, 23 bp, Homo sapiens
tatttatattcagagatgtacca

SEQ ID NO: 4298444 - DNA, 17 bp, Homo sapiens
tatttatcatatttaat

SEQ ID NO: 4298445 - DNA, 17 bp, Homo sapiens
tatttatctgtctgagc

SEQ ID NO: 4298446 - DNA, 23 bp, Homo sapiens
tatttatttctagcaaacagatg

SEQ ID NO: 4298447 - DNA, 18 bp, Homo sapiens
tatttattttcctcccca

SEQ ID NO: 4298448 - DNA, 20 bp, Homo sapiens
tatttcataaacaacttaat

SEQ ID NO: 4298449 - DNA, 14 bp, Homo sapiens
tatttccaacaaac

SEQ ID NO: 4298450 - DNA, 13 bp, Homo sapiens
tatttccacttct

SEQ ID NO: 4298451 - DNA, 23 bp, Homo sapiens
tatttctaagcttatttctaact

SEQ ID NO: 4298452 - DNA, 13 bp, Homo sapiens
tatttctatctgc

SEQ ID NO: 4298453 - DNA, 17 bp, Homo sapiens
tatttcttccagtgatg

SEQ ID NO: 4298454 - DNA, 14 bp, Homo sapiens
tatttgtagtgtta

SEQ ID NO: 4298455 - DNA, 20 bp, Homo sapiens
tatttgtatgatattttaaa

SEQ ID NO: 4298456 - DNA, 19 bp, Homo sapiens
tatttgtttagttcagcaa

SEQ ID NO: 4298457 - DNA, 14 bp, Homo sapiens
tattttaaactact

SEQ ID NO: 4298458 - DNA, 13 bp, Homo sapiens
tattttactttgt

SEQ ID NO: 4298459 - DNA, 14 bp, Homo sapiens
tattttactttgtg

SEQ ID NO: 4298460 - DNA, 19 bp, Homo sapiens
tattttactttgtgcaata

SEQ ID NO: 4298461 - DNA, 19 bp, Homo sapiens
tattttcaacgcagccctg

SEQ ID NO: 4298462 - DNA, 15 bp, Homo sapiens
tattttcctccccag

SEQ ID NO: 4298463 - DNA, 14 bp, Homo sapiens
tattttctgaattc

SEQ ID NO: 4298464 - DNA, 20 bp, Homo sapiens
tattttctgaattcataaaa

SEQ ID NO: 4298465 - DNA, 19 bp, Homo sapiens
tattttcttcccatttgta

SEQ ID NO: 4298466 - DNA, 16 bp, Homo sapiens
tattttgtaaaatgta

SEQ ID NO: 4298467 - DNA, 18 bp, Homo sapiens
tattttgtaaaatgtatt

SEQ ID NO: 4298468 - DNA, 15 bp, Homo sapiens
tattttgtatgaaat

SEQ ID NO: 4298469 - DNA, 23 bp, Homo sapiens
tatttttgttggagccactctgt

SEQ ID NO: 4298470 - DNA, 15 bp, Homo sapiens
tatttttttaacttt

SEQ ID NO: 4298471 - DNA, 14 bp, Homo sapiens
tatttttttctagc

SEQ ID NO: 4298472 - DNA, 22 bp, Homo sapiens
tatttttttctagctataacaa

SEQ ID NO: 4298473 - DNA, 15 bp, Homo sapiens
tatttttttgttgct

SEQ ID NO: 4298474 - DNA, 17 bp, Homo sapiens
tatttttttgttgctgt

SEQ ID NO: 4298475 - DNA, 15 bp, Homo sapiens
tcaaaaatcatcaaa

SEQ ID NO: 4298476 - DNA, 14 bp, Homo sapiens
tcaaaatacttctt

SEQ ID NO: 4298477 - DNA, 21 bp, Homo sapiens
tcaaaatacttctttttcatt

SEQ ID NO: 4298478 - DNA, 13 bp, Homo sapiens
tcaaaatattgag

SEQ ID NO: 4298479 - DNA, 23 bp, Homo sapiens
tcaaaatgatattcaatcttaac

SEQ ID NO: 4298480 - DNA, 13 bp, Homo sapiens
tcaaaatgcatgt

SEQ ID NO: 4298481 - DNA, 14 bp, Homo sapiens
tcaaaatgcatgtg

SEQ ID NO: 4298482 - DNA, 16 bp, Homo sapiens
tcaaacatgccctcag

SEQ ID NO: 4298483 - DNA, 18 bp, Homo sapiens
tcaaagaacccccctccc

SEQ ID NO: 4298484 - DNA, 23 bp, Homo sapiens
tcaaagaatcacctaattaattt

SEQ ID NO: 4298485 - DNA, 14 bp, Homo sapiens
tcaaagtgtttaat

SEQ ID NO: 4298486 - DNA, 16 bp, Homo sapiens
tcaaagtgtttaattg

SEQ ID NO: 4298487 - DNA, 18 bp, Homo sapiens
tcaaagtttttacagtgt

SEQ ID NO: 4298488 - DNA, 15 bp, Homo sapiens
tcaaataaaaattct

SEQ ID NO: 4298489 - DNA, 20 bp, Homo sapiens
tcaaataaaaattctagatt

SEQ ID NO: 4298490 - DNA, 17 bp, Homo sapiens
tcaaatgagtttaaaaa

SEQ ID NO: 4298491 - DNA, 20 bp, Homo sapiens
tcaaatgcatgatattgtat

SEQ ID NO: 4298492 - DNA, 18 bp, Homo sapiens
tcaacaaagaaatattat

SEQ ID NO: 4298493 - DNA, 16 bp, Homo sapiens
taggagggaaaccttt

SEQ ID NO: 4298494 - DNA, 21 bp, Homo sapiens
taggcagagcccgcccacctg

SEQ ID NO: 4298495 - DNA, 12 bp, Homo sapiens
taggcaggaagt

SEQ ID NO: 4298496 - DNA, 20 bp, Homo sapiens
taggcaggaagtcaggagcc

SEQ ID NO: 4298497 - DNA, 18 bp, Homo sapiens
taggcatactctccagga

SEQ ID NO: 4298498 - DNA, 21 bp, Homo sapiens
taggccagaggtgaacattca

SEQ ID NO: 4298499 - DNA, 13 bp, Homo sapiens
taggccctggtct

SEQ ID NO: 4298500 - DNA, 22 bp, Homo sapiens
taggcctactggggatcagagt

SEQ ID NO: 4298501 - DNA, 11 bp, Homo sapiens
taggcctggag

SEQ ID NO: 4298502 - DNA, 12 bp, Homo sapiens
taggcctggagt

SEQ ID NO: 4298503 - DNA, 19 bp, Homo sapiens
taggcctggagttgggctg

SEQ ID NO: 4298504 - DNA, 17 bp, Homo sapiens
tagggaaatccaactcc

SEQ ID NO: 4298505 - DNA, 19 bp, Homo sapiens
tagggaaatccaactccag

SEQ ID NO: 4298506 - DNA, 11 bp, Homo sapiens
taggggtgggg

SEQ ID NO: 4298507 - DNA, 20 bp, Homo sapiens
taggggtgggggagaatggc

SEQ ID NO: 4298508 - DNA, 18 bp, Homo sapiens
tagggtcctcaggcagtg

SEQ ID NO: 4298509 - DNA, 16 bp, Homo sapiens
taggtcaatgaaatat

SEQ ID NO: 4298510 - DNA, 12 bp, Homo sapiens
taggtctccacc

SEQ ID NO: 4298511 - DNA, 14 bp, Homo sapiens
taggtctccacccc

SEQ ID NO: 4298512 - DNA, 19 bp, Homo sapiens
taggtgcccagtcttgagt

SEQ ID NO: 4298513 - DNA, 16 bp, Homo sapiens
taggtgggccagcccc

SEQ ID NO: 4298514 - DNA, 21 bp, Homo sapiens
taggtgggccagcccctccca

SEQ ID NO: 4298515 - DNA, 23 bp, Homo sapiens
taggtgggccagcccctcccacc

SEQ ID NO: 4298516 - DNA, 16 bp, Homo sapiens
taggtgggtcttggat

SEQ ID NO: 4298517 - DNA, 17 bp, Homo sapiens
taggttaataggaggac

SEQ ID NO: 4298518 - DNA, 19 bp, Homo sapiens
taggttaataggaggacag

SEQ ID NO: 4298519 - DNA, 23 bp, Homo sapiens
taggtttagaatcaagtctgtga

SEQ ID NO: 4298520 - DNA, 14 bp, Homo sapiens
tagtaatctgtata

SEQ ID NO: 4298521 - DNA, 22 bp, Homo sapiens
tagtactagagatattttgtaa

SEQ ID NO: 4298522 - DNA, 17 bp, Homo sapiens
tagtacttcttctgtaa

SEQ ID NO: 4298523 - DNA, 22 bp, Homo sapiens
tagtagttgatgaccaatctct

SEQ ID NO: 4298524 - DNA, 15 bp, Homo sapiens
tagtcaactgctgtt

SEQ ID NO: 4298525 - DNA, 18 bp, Homo sapiens
tagtctttagctattact

SEQ ID NO: 4298526 - DNA, 22 bp, Homo sapiens
tagtgagtgtggcttagtaata

SEQ ID NO: 4298527 - DNA, 18 bp, Homo sapiens
tagtgatacactgtatct

SEQ ID NO: 4298528 - DNA, 13 bp, Homo sapiens
tagtgatggttcc

SEQ ID NO: 4298529 - DNA, 13 bp, Homo sapiens
tagtgatttgcta

SEQ ID NO: 4298530 - DNA, 24 bp, Homo sapiens
tagtgcctgtgatcgtgtgttgcc

SEQ ID NO: 4298531 - DNA, 17 bp, Homo sapiens
tagtggcttcagcccct

SEQ ID NO: 4298532 - DNA, 18 bp, Homo sapiens
tagtggcttcagcccctg

SEQ ID NO: 4298533 - DNA, 19 bp, Homo sapiens
tagtggcttcagcccctgg

SEQ ID NO: 4298534 - DNA, 18 bp, Homo sapiens
tagtgtctgtccatctgt

SEQ ID NO: 4298535 - DNA, 14 bp, Homo sapiens
tagtgttattgcca

SEQ ID NO: 4298536 - DNA, 15 bp, Homo sapiens
tagtgttttgcaagg

SEQ ID NO: 4298537 - DNA, 11 bp, Homo sapiens
tagttaaaatc

SEQ ID NO: 4298538 - DNA, 18 bp, Homo sapiens
tagttagcaggaaatagt

SEQ ID NO: 4298539 - DNA, 14 bp, Homo sapiens
tagttcagcaaaac

SEQ ID NO: 4298540 - DNA, 17 bp, Homo sapiens
tagttcctgtgcacagc

SEQ ID NO: 4298541 - DNA, 12 bp, Homo sapiens
tagttctatttc

SEQ ID NO: 4298542 - DNA, 23 bp, Homo sapiens
tagttctatttctatctgcaaat

SEQ ID NO: 4298543 - DNA, 21 bp, Homo sapiens
tagttgatgaccaatctctgt

SEQ ID NO: 4298544 - DNA, 22 bp, Homo sapiens
tagttgatgaccaatctctgtg

SEQ ID NO: 4298545 - DNA, 15 bp, Homo sapiens
tagttgcaaagcatt

SEQ ID NO: 4298546 - DNA, 15 bp, Homo sapiens
tagtttgcatttaag

SEQ ID NO: 4298547 - DNA, 14 bp, Homo sapiens
tagtttgttttctt

SEQ ID NO: 4298548 - DNA, 20 bp, Homo sapiens
tagtttgttttctttttctg

SEQ ID NO: 4298549 - DNA, 20 bp, Homo sapiens
tataaaacagtgtttccagt

SEQ ID NO: 4298550 - DNA, 20 bp, Homo sapiens
tataaaccataaaataaata

SEQ ID NO: 4298551 - DNA, 13 bp, Homo sapiens
tataaagttatta

SEQ ID NO: 4298552 - DNA, 20 bp, Homo sapiens
tataaataaataaaaatatt

SEQ ID NO: 4298553 - DNA, 15 bp, Homo sapiens
tataaatggtgagaa

SEQ ID NO: 4298554 - DNA, 14 bp, Homo sapiens
tataaatgtgtgta

SEQ ID NO: 4298555 - DNA, 18 bp, Homo sapiens
tataacaagccaaacatt

SEQ ID NO: 4298556 - DNA, 13 bp, Homo sapiens
tataactttagaa

SEQ ID NO: 4298557 - DNA, 16 bp, Homo sapiens
tataagcaacatgaat

SEQ ID NO: 4298558 - DNA, 22 bp, Homo sapiens
tataagggagtaggctgtattt

SEQ ID NO: 4298559 - DNA, 14 bp, Homo sapiens
tataatcagaatgg

SEQ ID NO: 4298560 - DNA, 15 bp, Homo sapiens
tataatctcttctta

SEQ ID NO: 4298561 - DNA, 15 bp, Homo sapiens
tataatgtgaaatgt

SEQ ID NO: 4298562 - DNA, 19 bp, Homo sapiens
tataatgtgaaatgtaact

SEQ ID NO: 4298563 - DNA, 22 bp, Homo sapiens
tataatgtttccctcaagaaca

SEQ ID NO: 4298564 - DNA, 12 bp, Homo sapiens
tataattgttat

SEQ ID NO: 4298565 - DNA, 17 bp, Homo sapiens
tatacaaacaggtgcta

SEQ ID NO: 4298566 - DNA, 19 bp, Homo sapiens
tatacaaccttcatttaaa

SEQ ID NO: 4298567 - DNA, 13 bp, Homo sapiens
tatacaagtactg

SEQ ID NO: 4298568 - DNA, 16 bp, Homo sapiens
tatacatagtctttgt

SEQ ID NO: 4298569 - DNA, 13 bp, Homo sapiens
tatactgcatatc

SEQ ID NO: 4298570 - DNA, 14 bp, Homo sapiens
tatactgtgtgtga

SEQ ID NO: 4298571 - DNA, 23 bp, Homo sapiens
tatactgtgtgtgagtgtgaata

SEQ ID NO: 4298572 - DNA, 14 bp, Homo sapiens
tatagatataaata

SEQ ID NO: 4298573 - DNA, 14 bp, Homo sapiens
tatagtgtgttgtg

SEQ ID NO: 4298574 - DNA, 16 bp, Homo sapiens
tatagtgtgttgtgct

SEQ ID NO: 4298575 - DNA, 17 bp, Homo sapiens
tatagttactgtcctgt

SEQ ID NO: 4298576 - DNA, 15 bp, Homo sapiens
tatagtttgttttct

SEQ ID NO: 4298577 - DNA, 23 bp, Homo sapiens
tatatacatcacgttaaagtagg

SEQ ID NO: 4298578 - DNA, 16 bp, Homo sapiens
tatatacatgtatagt

SEQ ID NO: 4298579 - DNA, 14 bp, Homo sapiens
tatatataaatatc

SEQ ID NO: 4298580 - DNA, 14 bp, Homo sapiens
tatatatacatgta

SEQ ID NO: 4298581 - DNA, 15 bp, Homo sapiens
tatatatgtacagtt

SEQ ID NO: 4298582 - DNA, 22 bp, Homo sapiens
tatatatgtacagttatacata

SEQ ID NO: 4298583 - DNA, 15 bp, Homo sapiens
tatatcagactgctt

SEQ ID NO: 4298584 - DNA, 19 bp, Homo sapiens
tatatcagggtttaacaat

SEQ ID NO: 4298585 - DNA, 12 bp, Homo sapiens
tatatctgtaaa

SEQ ID NO: 4298586 - DNA, 14 bp, Homo sapiens
tatatgtacagtta

SEQ ID NO: 4298587 - DNA, 18 bp, Homo sapiens
tatatgtgaaaggatatg

SEQ ID NO: 4298588 - DNA, 22 bp, Homo sapiens
tatattccaggtttaagtagat

SEQ ID NO: 4298589 - DNA, 17 bp, Homo sapiens
tatattgttcacttctt

SEQ ID NO: 4298590 - DNA, 20 bp, Homo sapiens
tatatttatcatatttaata

SEQ ID NO: 4298591 - DNA, 13 bp, Homo sapiens
tatattttatctt

SEQ ID NO: 4298592 - DNA, 14 bp, Homo sapiens
tatattttgcctgt

SEQ ID NO: 4298593 - DNA, 16 bp, Homo sapiens
tatatttttttaactt

SEQ ID NO: 4298594 - DNA, 15 bp, Homo sapiens
tatcacctcccctcc

SEQ ID NO: 4298595 - DNA, 20 bp, Homo sapiens
tatcacctcccctccttgcc

SEQ ID NO: 4298596 - DNA, 19 bp, Homo sapiens
tatcactaataaagtctgt

SEQ ID NO: 4298597 - DNA, 13 bp, Homo sapiens
tatcactcattaa

SEQ ID NO: 4298598 - DNA, 19 bp, Homo sapiens
tatcactcattaattaacc

SEQ ID NO: 4298599 - DNA, 15 bp, Homo sapiens
tatcagtgtttatgt

SEQ ID NO: 4298600 - DNA, 17 bp, Homo sapiens
tatcatttcttaaccca

SEQ ID NO: 4298601 - DNA, 21 bp, Homo sapiens
tatccccggacgcatgcaggg

SEQ ID NO: 4298602 - DNA, 15 bp, Homo sapiens
tatcccgggagcagt

SEQ ID NO: 4298603 - DNA, 19 bp, Homo sapiens
tatccctggacgcatgcag

SEQ ID NO: 4298604 - DNA, 16 bp, Homo sapiens
tatcctgcaccctctg

SEQ ID NO: 4298605 - DNA, 16 bp, Homo sapiens
tatctaaaaaataact

SEQ ID NO: 4298606 - DNA, 21 bp, Homo sapiens
tatctagcaagaagattctaa

SEQ ID NO: 4298607 - DNA, 23 bp, Homo sapiens
tatctcatcaacaaagaaatatt

SEQ ID NO: 4298608 - DNA, 11 bp, Homo sapiens
tatctcatctc

SEQ ID NO: 4298609 - DNA, 13 bp, Homo sapiens
tatctcattgcaa

SEQ ID NO: 4298610 - DNA, 22 bp, Homo sapiens
tatctcgaagtcttccatcagc

SEQ ID NO: 4298611 - DNA, 23 bp, Homo sapiens
tatctcgaagtcttccatcagca

SEQ ID NO: 4298612 - DNA, 17 bp, Homo sapiens
tatctcgctagccatat

SEQ ID NO: 4298613 - DNA, 17 bp, Homo sapiens
tatctctactttcctga

SEQ ID NO: 4298614 - DNA, 13 bp, Homo sapiens
tatctgaaaactg

SEQ ID NO: 4298615 - DNA, 20 bp, Homo sapiens
tatctgcaaatagtttcaaa

SEQ ID NO: 4298616 - DNA, 19 bp, Homo sapiens
tatctgctgcctctgaaaa

SEQ ID NO: 4298617 - DNA, 21 bp, Homo sapiens
tatctgctgcctctgaaaata

SEQ ID NO: 4298618 - DNA, 22 bp, Homo sapiens
tatctgctgcctctgaaaatat

SEQ ID NO: 4298619 - DNA, 18 bp, Homo sapiens
tatctggattcaaattta

SEQ ID NO: 4298620 - DNA, 19 bp, Homo sapiens
tatctggtattaaatgcca

SEQ ID NO: 4298621 - DNA, 15 bp, Homo sapiens
tatctgtctgagccc

SEQ ID NO: 4298622 - DNA, 19 bp, Homo sapiens
tatctgtctgagccctgcc

SEQ ID NO: 4298623 - DNA, 16 bp, Homo sapiens
tatctgtgaaatatca

SEQ ID NO: 4298624 - DNA, 13 bp, Homo sapiens
tatctgtggtctt

SEQ ID NO: 4298625 - DNA, 12 bp, Homo sapiens
tatcttatttat

SEQ ID NO: 4298626 - DNA, 23 bp, Homo sapiens
tatcttcatgtaaattgactgta

SEQ ID NO: 4298627 - DNA, 20 bp, Homo sapiens
tatcttcgttagtaatctgt

SEQ ID NO: 4298628 - DNA, 21 bp, Homo sapiens
tttaatgatactgtctaagaa

SEQ ID NO: 4298629 - DNA, 21 bp, Homo sapiens
tttaattgtaggtcaatgaaa

SEQ ID NO: 4298630 - DNA, 14 bp, Homo sapiens
tttaattgtataaa

SEQ ID NO: 4298631 - DNA, 20 bp, Homo sapiens
tttacagtgaagaaagcctg

SEQ ID NO: 4298632 - DNA, 13 bp, Homo sapiens
tttacatagtctg

SEQ ID NO: 4298633 - DNA, 21 bp, Homo sapiens
tttaccatgctcaatgaaaag

SEQ ID NO: 4298634 - DNA, 12 bp, Homo sapiens
tttactcccctt

SEQ ID NO: 4298635 - DNA, 19 bp, Homo sapiens
tttactgtctgtaagagaa

SEQ ID NO: 4298636 - DNA, 14 bp, Homo sapiens
tttactttgtgcaa

SEQ ID NO: 4298637 - DNA, 20 bp, Homo sapiens
tttactttgtgcaatatgag

SEQ ID NO: 4298638 - DNA, 19 bp, Homo sapiens
tttagaatcaagtctgtga

SEQ ID NO: 4298639 - DNA, 22 bp, Homo sapiens
tttagagattaatttgtgtaga

SEQ ID NO: 4298640 - DNA, 18 bp, Homo sapiens
tttagatattcatacttt

SEQ ID NO: 4298641 - DNA, 14 bp, Homo sapiens
tttagctattactg

SEQ ID NO: 4298642 - DNA, 13 bp, Homo sapiens
tttagctgtgcag

SEQ ID NO: 4298643 - DNA, 14 bp, Homo sapiens
tttaggcaggaagt

SEQ ID NO: 4298644 - DNA, 20 bp, Homo sapiens
tttaggtcatccaacctctt

SEQ ID NO: 4298645 - DNA, 19 bp, Homo sapiens
tttaggtgtcttttaatga

SEQ ID NO: 4298646 - DNA, 12 bp, Homo sapiens
tttagtgactaa

SEQ ID NO: 4298647 - DNA, 21 bp, Homo sapiens
tttataaaccataaaataaat

SEQ ID NO: 4298648 - DNA, 17 bp, Homo sapiens
tttatagtgtgttgtgc

SEQ ID NO: 4298649 - DNA, 16 bp, Homo sapiens
tttatctcttcttcct

SEQ ID NO: 4298650 - DNA, 19 bp, Homo sapiens
tttatcttgggaccaaaac

SEQ ID NO: 4298651 - DNA, 18 bp, Homo sapiens
tttatcttggtagtacat

SEQ ID NO: 4298652 - DNA, 15 bp, Homo sapiens
tttatgaagttaaca

SEQ ID NO: 4298653 - DNA, 19 bp, Homo sapiens
tttatggtattttcgtgca

SEQ ID NO: 4298654 - DNA, 18 bp, Homo sapiens
tttattcattagctgtga

SEQ ID NO: 4298655 - DNA, 14 bp, Homo sapiens
tttatttcaatgta

SEQ ID NO: 4298656 - DNA, 20 bp, Homo sapiens
tttatttccaatgtttcaag

SEQ ID NO: 4298657 - DNA, 20 bp, Homo sapiens
tttatttctagcaaacagat

SEQ ID NO: 4298658 - DNA, 20 bp, Homo sapiens
tttcaaatgagtttaaaaaa

SEQ ID NO: 4298659 - DNA, 23 bp, Homo sapiens
tttcaaatgagtttaaaaaaata

SEQ ID NO: 4298660 - DNA, 16 bp, Homo sapiens
tttcaacgcagccctg

SEQ ID NO: 4298661 - DNA, 21 bp, Homo sapiens
tttcaacgcagccctgctttg

SEQ ID NO: 4298662 - DNA, 12 bp, Homo sapiens
tttcaatgattg

SEQ ID NO: 4298663 - DNA, 16 bp, Homo sapiens
tttcacaaccttctgt

SEQ ID NO: 4298664 - DNA, 14 bp, Homo sapiens
tttcacatatttgt

SEQ ID NO: 4298665 - DNA, 21 bp, Homo sapiens
tttcaccccatccctccttaa

SEQ ID NO: 4298666 - DNA, 14 bp, Homo sapiens
tttcacccctcttc

SEQ ID NO: 4298667 - DNA, 16 bp, Homo sapiens
tttcactactcagcat

SEQ ID NO: 4298668 - DNA, 19 bp, Homo sapiens
tttcagaaagggcagcccc

SEQ ID NO: 4298669 - DNA, 21 bp, Homo sapiens
tttcagacctttgtctgaagg

SEQ ID NO: 4298670 - DNA, 18 bp, Homo sapiens
tttcagcttgtttctata

SEQ ID NO: 4298671 - DNA, 19 bp, Homo sapiens
tttcagcttgtttctatac

SEQ ID NO: 4298672 - DNA, 22 bp, Homo sapiens
tttcagcttgtttctatactgt

SEQ ID NO: 4298673 - DNA, 17 bp, Homo sapiens
tttcaggttaaattaaa

SEQ ID NO: 4298674 - DNA, 15 bp, Homo sapiens
tttcatatcatttct

SEQ ID NO: 4298675 - DNA, 20 bp, Homo sapiens
tttcatgactggtgcgttcc

SEQ ID NO: 4298676 - DNA, 19 bp, Homo sapiens
tttcatgatttgcaacttt

SEQ ID NO: 4298677 - DNA, 15 bp, Homo sapiens
tttcatgtccataaa

SEQ ID NO: 4298678 - DNA, 17 bp, Homo sapiens
tttcatgtgttgcaaat

SEQ ID NO: 4298679 - DNA, 15 bp, Homo sapiens
tttcattattttccc

SEQ ID NO: 4298680 - DNA, 21 bp, Homo sapiens
tttccaaattgatgggtgggc

SEQ ID NO: 4298681 - DNA, 22 bp, Homo sapiens
tttccaagcctgggccactggc

SEQ ID NO: 4298682 - DNA, 22 bp, Homo sapiens
tttccaccaagggtatctgctg

SEQ ID NO: 4298683 - DNA, 20 bp, Homo sapiens
tttccagctaagcctgatga

SEQ ID NO: 4298684 - DNA, 14 bp, Homo sapiens
tttccagtgctgct

SEQ ID NO: 4298685 - DNA, 14 bp, Homo sapiens
tttccatctaaaat

SEQ ID NO: 4298686 - DNA, 21 bp, Homo sapiens
tttcccacaattcttttgaaa

SEQ ID NO: 4298687 - DNA, 19 bp, Homo sapiens
tttccccaattatcctcct

SEQ ID NO: 4298688 - DNA, 12 bp, Homo sapiens
tttcctccccag

SEQ ID NO: 4298689 - DNA, 14 bp, Homo sapiens
tttcctccccagca

SEQ ID NO: 4298690 - DNA, 23 bp, Homo sapiens
tttcctgacagaaggactcaggt

SEQ ID NO: 4298691 - DNA, 13 bp, Homo sapiens
tttcctgagcttg

SEQ ID NO: 4298692 - DNA, 12 bp, Homo sapiens
tttctaaaacat

SEQ ID NO: 4298693 - DNA, 12 bp, Homo sapiens
tttctaaactgt

SEQ ID NO: 4298694 - DNA, 14 bp, Homo sapiens
tttctaaactgttt

SEQ ID NO: 4298695 - DNA, 15 bp, Homo sapiens
tttctaaactgtttt

SEQ ID NO: 4298696 - DNA, 13 bp, Homo sapiens
tttctaaatgttt

SEQ ID NO: 4298697 - DNA, 15 bp, Homo sapiens
tttctaaatgtttct

SEQ ID NO: 4298698 - DNA, 19 bp, Homo sapiens
tttctaaatgtttcttttt

SEQ ID NO: 4298699 - DNA, 23 bp, Homo sapiens
tttctagctataacaactctatt

SEQ ID NO: 4298700 - DNA, 15 bp, Homo sapiens
tttctatctgcaaat

SEQ ID NO: 4298701 - DNA, 21 bp, Homo sapiens
tttctatgtagaactgttcat

SEQ ID NO: 4298702 - DNA, 14 bp, Homo sapiens
tttctcaaagtttt

SEQ ID NO: 4298703 - DNA, 20 bp, Homo sapiens
tttctcaaagtttttacagt

SEQ ID NO: 4298704 - DNA, 22 bp, Homo sapiens
tttctcacactctaactgtata

SEQ ID NO: 4298705 - DNA, 20 bp, Homo sapiens
tttctgaaagtatcaccaaa

SEQ ID NO: 4298706 - DNA, 20 bp, Homo sapiens
tttcttcccatttgtaatgt

SEQ ID NO: 4298707 - DNA, 22 bp, Homo sapiens
tttcttcccatttgtaatgtat

SEQ ID NO: 4298708 - DNA, 17 bp, Homo sapiens
tttcttctctctgtgct

SEQ ID NO: 4298709 - DNA, 21 bp, Homo sapiens
tttcttggatctttttgcaga

SEQ ID NO: 4298710 - DNA, 21 bp, Homo sapiens
tttcttgtgttgttttctctg

SEQ ID NO: 4298711 - DNA, 13 bp, Homo sapiens
tttctttctatgt

SEQ ID NO: 4298712 - DNA, 16 bp, Homo sapiens
tttcttttatatctgt

SEQ ID NO: 4298713 - DNA, 13 bp, Homo sapiens
tttctttttctgt

SEQ ID NO: 4298714 - DNA, 19 bp, Homo sapiens
tttcttttttgagtgtgca

SEQ ID NO: 4298715 - DNA, 20 bp, Homo sapiens
tttcttttttgagtgtgcaa

SEQ ID NO: 4298716 - DNA, 19 bp, Homo sapiens
tttgaaagaaaagtatttc

SEQ ID NO: 4298717 - DNA, 23 bp, Homo sapiens
tttgaagacttcaaaatattgag

SEQ ID NO: 4298718 - DNA, 22 bp, Homo sapiens
tttgaattacagggaagaaatc

SEQ ID NO: 4298719 - DNA, 15 bp, Homo sapiens
tttgagtgtgcaata

SEQ ID NO: 4298720 - DNA, 13 bp, Homo sapiens
tttgatgtgtatg

SEQ ID NO: 4298721 - DNA, 14 bp, Homo sapiens
tttgattgtgaaac

SEQ ID NO: 4298722 - DNA, 19 bp, Homo sapiens
tttgcaatcttatgttgat

SEQ ID NO: 4298723 - DNA, 16 bp, Homo sapiens
tttgcagacctgggac

SEQ ID NO: 4298724 - DNA, 17 bp, Homo sapiens
tttgcatacattcttca

SEQ ID NO: 4298725 - DNA, 18 bp, Homo sapiens
tttgcatacattcttcaa

SEQ ID NO: 4298726 - DNA, 14 bp, Homo sapiens
tttgcatgtctgca

SEQ ID NO: 4298727 - DNA, 13 bp, Homo sapiens
tttgcattgtctg

SEQ ID NO: 4298728 - DNA, 14 bp, Homo sapiens
tttgcctcatgaac

SEQ ID NO: 4298729 - DNA, 13 bp, Homo sapiens
tttgcctctgcac

SEQ ID NO: 4298730 - DNA, 14 bp, Homo sapiens
tttgcctgagggcg

SEQ ID NO: 4298731 - DNA, 13 bp, Homo sapiens
tttgctaattaaa

SEQ ID NO: 4298732 - DNA, 14 bp, Homo sapiens
tttgctaattaaaa

SEQ ID NO: 4298733 - DNA, 15 bp, Homo sapiens
tttgctgccttctgt

SEQ ID NO: 4298734 - DNA, 16 bp, Homo sapiens
tttgctggagtcctgt

SEQ ID NO: 4298735 - DNA, 19 bp, Homo sapiens
tttgctggagtcctgttct

SEQ ID NO: 4298736 - DNA, 21 bp, Homo sapiens
tttgctgtatacaaacaggtg

SEQ ID NO: 4298737 - DNA, 14 bp, Homo sapiens
tttgctttttgctt

SEQ ID NO: 4298738 - DNA, 23 bp, Homo sapiens
tttggaaagacctgtgaggggaa

SEQ ID NO: 4298739 - DNA, 14 bp, Homo sapiens
tttggcgggccaag

SEQ ID NO: 4298740 - DNA, 19 bp, Homo sapiens
tttgggggattcaaatgca

SEQ ID NO: 4298741 - DNA, 15 bp, Homo sapiens
tttggtaatgtgtca

SEQ ID NO: 4298742 - DNA, 16 bp, Homo sapiens
tttgtaaaatgtatta

SEQ ID NO: 4298743 - DNA, 15 bp, Homo sapiens
tttgtaatgtatctt

SEQ ID NO: 4298744 - DNA, 21 bp, Homo sapiens
tttgtacgttaattaaacaaa

SEQ ID NO: 4298745 - DNA, 16 bp, Homo sapiens
tttgtatataaatggt

SEQ ID NO: 4298746 - DNA, 21 bp, Homo sapiens
tttgtatctttaaagacttga

SEQ ID NO: 4298747 - DNA, 18 bp, Homo sapiens
tttgtatttatattagag

SEQ ID NO: 4298748 - DNA, 13 bp, Homo sapiens
tttgtcactgaat

SEQ ID NO: 4298749 - DNA, 15 bp, Homo sapiens
tttgtccacacaaga

SEQ ID NO: 4298750 - DNA, 18 bp, Homo sapiens
tttgtcctgcatcatctt

SEQ ID NO: 4298751 - DNA, 14 bp, Homo sapiens
tttgtgcaagacac

SEQ ID NO: 4298752 - DNA, 22 bp, Homo sapiens
tttgtgtattctgtggattcta

SEQ ID NO: 4298753 - DNA, 23 bp, Homo sapiens
tttgtgtattctgtggattctat

SEQ ID NO: 4298754 - DNA, 15 bp, Homo sapiens
tttgtgtgaaataat

SEQ ID NO: 4298755 - DNA, 17 bp, Homo sapiens
tttgttgctgttgttca

SEQ ID NO: 4298756 - DNA, 16 bp, Homo sapiens
ttttaaaaaataacat

SEQ ID NO: 4298757 - DNA, 19 bp, Homo sapiens
ttttaaaaagttgcacatt

SEQ ID NO: 4298758 - DNA, 18 bp, Homo sapiens
ttttaaatgattccaaat

SEQ ID NO: 4298759 - DNA, 19 bp, Homo sapiens
ttttaaatgattccaaata

SEQ ID NO: 4298760 - DNA, 20 bp, Homo sapiens
ttttaaatgctgtatgtcat

SEQ ID NO: 4298761 - DNA, 13 bp, Homo sapiens
ttttaacctcaga

SEQ ID NO: 4298762 - DNA, 17 bp, Homo sapiens
ttctgtgggcagctggc

SEQ ID NO: 4298763 - DNA, 14 bp, Homo sapiens
ttctgtgtctgctg

SEQ ID NO: 4298764 - DNA, 14 bp, Homo sapiens
ttctgttccctgct

SEQ ID NO: 4298765 - DNA, 17 bp, Homo sapiens
ttctgttttgcctgaag

SEQ ID NO: 4298766 - DNA, 19 bp, Homo sapiens
ttcttccagtgatgttgaa

SEQ ID NO: 4298767 - DNA, 20 bp, Homo sapiens
ttcttccagtgatgttgaaa

SEQ ID NO: 4298768 - DNA, 13 bp, Homo sapiens
ttcttccatctga

SEQ ID NO: 4298769 - DNA, 20 bp, Homo sapiens
ttcttcccatttgtaatgta

SEQ ID NO: 4298770 - DNA, 21 bp, Homo sapiens
ttcttcccatttgtaatgtat

SEQ ID NO: 4298771 - DNA, 15 bp, Homo sapiens
ttcttctgtaatatt

SEQ ID NO: 4298772 - DNA, 23 bp, Homo sapiens
ttcttctgtaatatttacaatgt

SEQ ID NO: 4298773 - DNA, 16 bp, Homo sapiens
ttcttgatgttgctta

SEQ ID NO: 4298774 - DNA, 18 bp, Homo sapiens
ttcttgcagtcatcagaa

SEQ ID NO: 4298775 - DNA, 19 bp, Homo sapiens
ttcttgcagtcatcagaag

SEQ ID NO: 4298776 - DNA, 19 bp, Homo sapiens
ttcttgctttcacaaatat

SEQ ID NO: 4298777 - DNA, 14 bp, Homo sapiens
ttcttgggccctcc

SEQ ID NO: 4298778 - DNA, 23 bp, Homo sapiens
ttcttggttttgtattgtttaaa

SEQ ID NO: 4298779 - DNA, 17 bp, Homo sapiens
ttcttgtgttgttttct

SEQ ID NO: 4298780 - DNA, 20 bp, Homo sapiens
ttcttgtgttgttttctctg

SEQ ID NO: 4298781 - DNA, 21 bp, Homo sapiens
ttcttgtgttgttttctctga

SEQ ID NO: 4298782 - DNA, 19 bp, Homo sapiens
ttctttaacatacatctaa

SEQ ID NO: 4298783 - DNA, 12 bp, Homo sapiens
ttctttctatgt

SEQ ID NO: 4298784 - DNA, 13 bp, Homo sapiens
ttgaaaagaagaa

SEQ ID NO: 4298785 - DNA, 23 bp, Homo sapiens
ttgaaaagaagaaagtctatgct

SEQ ID NO: 4298786 - DNA, 18 bp, Homo sapiens
ttgaaactgcatttgtgc

SEQ ID NO: 4298787 - DNA, 21 bp, Homo sapiens
ttgaagagagatatatctgaa

SEQ ID NO: 4298788 - DNA, 14 bp, Homo sapiens
ttgaatatatttta

SEQ ID NO: 4298789 - DNA, 23 bp, Homo sapiens
ttgaatctgattggacattttct

SEQ ID NO: 4298790 - DNA, 21 bp, Homo sapiens
ttgaatgtccccattctataa

SEQ ID NO: 4298791 - DNA, 15 bp, Homo sapiens
ttgaatgttatatca

SEQ ID NO: 4298792 - DNA, 18 bp, Homo sapiens
ttgagcaaggcaagaagt

SEQ ID NO: 4298793 - DNA, 23 bp, Homo sapiens
ttgagcaaggcaagaagtgggat

SEQ ID NO: 4298794 - DNA, 22 bp, Homo sapiens
ttgagcagtggcctacaaatca

SEQ ID NO: 4298795 - DNA, 20 bp, Homo sapiens
ttgaggggcttccctctgct

SEQ ID NO: 4298796 - DNA, 16 bp, Homo sapiens
ttgagtgtgcaatatg

SEQ ID NO: 4298797 - DNA, 15 bp, Homo sapiens
ttgagtttgctgtat

SEQ ID NO: 4298798 - DNA, 15 bp, Homo sapiens
ttgataaaaatactg

SEQ ID NO: 4298799 - DNA, 13 bp, Homo sapiens
ttgatatgtaaca

SEQ ID NO: 4298800 - DNA, 22 bp, Homo sapiens
ttgatattctaagaaatatctg

SEQ ID NO: 4298801 - DNA, 15 bp, Homo sapiens
ttgcaactttagaaa

SEQ ID NO: 4298802 - DNA, 21 bp, Homo sapiens
ttgcaactttagaaagaaatt

SEQ ID NO: 4298803 - DNA, 19 bp, Homo sapiens
ttgcacagcatctcagctc

SEQ ID NO: 4298804 - DNA, 14 bp, Homo sapiens
ttgcacatggattc

SEQ ID NO: 4298805 - DNA, 11 bp, Homo sapiens
ttgcagaagaa

SEQ ID NO: 4298806 - DNA, 12 bp, Homo sapiens
ttgcagacctgg

SEQ ID NO: 4298807 - DNA, 11 bp, Homo sapiens
ttgcaggaagg

SEQ ID NO: 4298808 - DNA, 13 bp, Homo sapiens
ttgccccccaccc

SEQ ID NO: 4298809 - DNA, 13 bp, Homo sapiens
ttgccctgagggg

SEQ ID NO: 4298810 - DNA, 15 bp, Homo sapiens
ttgccgctgggagag

SEQ ID NO: 4298811 - DNA, 15 bp, Homo sapiens
ttgcctcatgaacac

SEQ ID NO: 4298812 - DNA, 13 bp, Homo sapiens
ttgcctctgcacg

SEQ ID NO: 4298813 - DNA, 21 bp, Homo sapiens
ttgcctctgcacgtgcacaca

SEQ ID NO: 4298814 - DNA, 22 bp, Homo sapiens
ttgcctctgcacgtgcacacac

SEQ ID NO: 4298815 - DNA, 23 bp, Homo sapiens
ttgcctctgcacgtgcacacacc

SEQ ID NO: 4298816 - DNA, 18 bp, Homo sapiens
ttgcctttaggcaggaag

SEQ ID NO: 4298817 - DNA, 12 bp, Homo sapiens
ttgcgatgtgtt

SEQ ID NO: 4298818 - DNA, 13 bp, Homo sapiens
ttgcgatgtgttt

SEQ ID NO: 4298819 - DNA, 18 bp, Homo sapiens
ttgctagtgatacactgt

SEQ ID NO: 4298820 - DNA, 21 bp, Homo sapiens
ttgctagtgatacactgtatc

SEQ ID NO: 4298821 - DNA, 19 bp, Homo sapiens
ttgctcaataaaggtcata

SEQ ID NO: 4298822 - DNA, 21 bp, Homo sapiens
ttgctcacccaggacctctgg

SEQ ID NO: 4298823 - DNA, 15 bp, Homo sapiens
ttgctgaatgcaaga

SEQ ID NO: 4298824 - DNA, 18 bp, Homo sapiens
ttgctgaggagctcaggg

SEQ ID NO: 4298825 - DNA, 12 bp, Homo sapiens
ttgctgccttct

SEQ ID NO: 4298826 - DNA, 22 bp, Homo sapiens
ttgctgccttctgtctcttgca

SEQ ID NO: 4298827 - DNA, 16 bp, Homo sapiens
ttgctggagtcctgtt

SEQ ID NO: 4298828 - DNA, 18 bp, Homo sapiens
ttggaaggaaaggaatat

SEQ ID NO: 4298829 - DNA, 23 bp, Homo sapiens
ttggacctgcagttggcctcagc

SEQ ID NO: 4298830 - DNA, 15 bp, Homo sapiens
ttggatctttttgca

SEQ ID NO: 4298831 - DNA, 16 bp, Homo sapiens
ttggcagcttcaaaac

SEQ ID NO: 4298832 - DNA, 22 bp, Homo sapiens
ttggccactttgcagacctggg

SEQ ID NO: 4298833 - DNA, 15 bp, Homo sapiens
ttggcccccgagctg

SEQ ID NO: 4298834 - DNA, 16 bp, Homo sapiens
ttggcccccgagctgg

SEQ ID NO: 4298835 - DNA, 13 bp, Homo sapiens
ttggctgggccca

SEQ ID NO: 4298836 - DNA, 17 bp, Homo sapiens
ttggctgggcccagaag

SEQ ID NO: 4298837 - DNA, 15 bp, Homo sapiens
ttggcttcagaattg

SEQ ID NO: 4298838 - DNA, 13 bp, Homo sapiens
ttgggatgggcac

SEQ ID NO: 4298839 - DNA, 22 bp, Homo sapiens
ttgggctgaatgtatgtaaata

SEQ ID NO: 4298840 - DNA, 13 bp, Homo sapiens
ttgggctgagact

SEQ ID NO: 4298841 - DNA, 14 bp, Homo sapiens
ttgggttccagaca

SEQ ID NO: 4298842 - DNA, 15 bp, Homo sapiens
ttgggttccagacag

SEQ ID NO: 4298843 - DNA, 23 bp, Homo sapiens
ttggtggccgcaaccacttgcta

SEQ ID NO: 4298844 - DNA, 13 bp, Homo sapiens
ttggtgttcttcc

SEQ ID NO: 4298845 - DNA, 15 bp, Homo sapiens
ttggttcatgcctgg

SEQ ID NO: 4298846 - DNA, 16 bp, Homo sapiens
ttggttcatgcctggg

SEQ ID NO: 4298847 - DNA, 20 bp, Homo sapiens
ttggttttaaaaaagcatta

SEQ ID NO: 4298848 - DNA, 20 bp, Homo sapiens
ttgtaaccatatgattgaaa

SEQ ID NO: 4298849 - DNA, 19 bp, Homo sapiens
ttgtaatatacagtttttg

SEQ ID NO: 4298850 - DNA, 15 bp, Homo sapiens
ttgtaatgtatctta

SEQ ID NO: 4298851 - DNA, 18 bp, Homo sapiens
ttgtaatgtatcttattt

SEQ ID NO: 4298852 - DNA, 17 bp, Homo sapiens
ttgtacatatggaaatc

SEQ ID NO: 4298853 - DNA, 18 bp, Homo sapiens
ttgtacgttaattaaaca

SEQ ID NO: 4298854 - DNA, 19 bp, Homo sapiens
ttgtactcttgctttttca

SEQ ID NO: 4298855 - DNA, 18 bp, Homo sapiens
ttgtattgttagatgttt

SEQ ID NO: 4298856 - DNA, 23 bp, Homo sapiens
ttgtattttcttcccatttgtaa

SEQ ID NO: 4298857 - DNA, 16 bp, Homo sapiens
ttgtcactcggctttg

SEQ ID NO: 4298858 - DNA, 13 bp, Homo sapiens
ttgtcagagctgg

SEQ ID NO: 4298859 - DNA, 15 bp, Homo sapiens
ttgtccacaaatgtc

SEQ ID NO: 4298860 - DNA, 23 bp, Homo sapiens
ttgtccacaaatgtcctcagagg

SEQ ID NO: 4298861 - DNA, 21 bp, Homo sapiens
ttgtctgaagtcactgcacag

SEQ ID NO: 4298862 - DNA, 16 bp, Homo sapiens
ttgtgaaacacagctg

SEQ ID NO: 4298863 - DNA, 18 bp, Homo sapiens
ttgtgaaacacagctgtt

SEQ ID NO: 4298864 - DNA, 11 bp, Homo sapiens
ttgtgaaattt

SEQ ID NO: 4298865 - DNA, 19 bp, Homo sapiens
ttgtgaaatttgttaatat

SEQ ID NO: 4298866 - DNA, 23 bp, Homo sapiens
ttgtgaaatttgttaatatatat

SEQ ID NO: 4298867 - DNA, 23 bp, Homo sapiens
ttgtgggggtgtcacagaggcag

SEQ ID NO: 4298868 - DNA, 18 bp, Homo sapiens
ttgtgtagattgtgtaaa

SEQ ID NO: 4298869 - DNA, 15 bp, Homo sapiens
ttgtgtggtattcaa

SEQ ID NO: 4298870 - DNA, 18 bp, Homo sapiens
ttgttaaaaccttactta

SEQ ID NO: 4298871 - DNA, 13 bp, Homo sapiens
ttgttacaatttt

SEQ ID NO: 4298872 - DNA, 17 bp, Homo sapiens
ttgttaggggtggggga

SEQ ID NO: 4298873 - DNA, 22 bp, Homo sapiens
ttgttaggggtgggggagaatg

SEQ ID NO: 4298874 - DNA, 15 bp, Homo sapiens
ttgttattaaatgta

SEQ ID NO: 4298875 - DNA, 20 bp, Homo sapiens
ttgttcaaagaacccccctc

SEQ ID NO: 4298876 - DNA, 22 bp, Homo sapiens
ttgttcaaagaacccccctccc

SEQ ID NO: 4298877 - DNA, 16 bp, Homo sapiens
ttgttcagaagttgtt

SEQ ID NO: 4298878 - DNA, 21 bp, Homo sapiens
ttgtttaaaaaaataacatct

SEQ ID NO: 4298879 - DNA, 14 bp, Homo sapiens
ttgtttaattgtag

SEQ ID NO: 4298880 - DNA, 20 bp, Homo sapiens
ttgtttacatgagttcaaat

SEQ ID NO: 4298881 - DNA, 12 bp, Homo sapiens
ttgtttctatac

SEQ ID NO: 4298882 - DNA, 13 bp, Homo sapiens
ttgtttgatgtgt

SEQ ID NO: 4298883 - DNA, 16 bp, Homo sapiens
ttgtttgatgtgtatg

SEQ ID NO: 4298884 - DNA, 20 bp, Homo sapiens
tttaaaaaagcattatcctt

SEQ ID NO: 4298885 - DNA, 14 bp, Homo sapiens
tttaaaaaataaca

SEQ ID NO: 4298886 - DNA, 21 bp, Homo sapiens
tttaaaaaataacatattctt

SEQ ID NO: 4298887 - DNA, 19 bp, Homo sapiens
tttaaaagccctttccaaa

SEQ ID NO: 4298888 - DNA, 20 bp, Homo sapiens
tttaaaatctcctaaatgct

SEQ ID NO: 4298889 - DNA, 14 bp, Homo sapiens
tttaaatgaagaaa

SEQ ID NO: 4298890 - DNA, 17 bp, Homo sapiens
tttaaatgattccaaat

SEQ ID NO: 4298891 - DNA, 18 bp, Homo sapiens
tttaaatgattccaaata

SEQ ID NO: 4298892 - DNA, 13 bp, Homo sapiens
tttaagcatttta

SEQ ID NO: 4298893 - DNA, 21 bp, Homo sapiens
tttaagcattttactgtctgt

SEQ ID NO: 4298894 - DNA, 19 bp, Homo sapiens
tttaagcgaggcagaatgg

SEQ ID NO: 4298895 - DNA, 13 bp, Homo sapiens
tttaataataaaa

SEQ ID NO: 4298896 - DNA, 22 bp, Homo sapiens
ttcaggtggaacaggaggaact

SEQ ID NO: 4298897 - DNA, 20 bp, Homo sapiens
ttcagtcacttgtttgtgtt

SEQ ID NO: 4298898 - DNA, 22 bp, Homo sapiens
ttcagtcacttgtttgtgtttg

SEQ ID NO: 4298899 - DNA, 15 bp, Homo sapiens
ttcagttcaatcaaa

SEQ ID NO: 4298900 - DNA, 19 bp, Homo sapiens
ttcagtttctaaaattgag

SEQ ID NO: 4298901 - DNA, 19 bp, Homo sapiens
ttcataaacaacttaatgt

SEQ ID NO: 4298902 - DNA, 17 bp, Homo sapiens
ttcatagcatcctgatt

SEQ ID NO: 4298903 - DNA, 15 bp, Homo sapiens
ttcatattgagatca

SEQ ID NO: 4298904 - DNA, 14 bp, Homo sapiens
ttcatgatttgcaa

SEQ ID NO: 4298905 - DNA, 17 bp, Homo sapiens
ttcatgtgttgcaaatt

SEQ ID NO: 4298906 - DNA, 13 bp, Homo sapiens
ttcattattttcc

SEQ ID NO: 4298907 - DNA, 19 bp, Homo sapiens
ttcattcccttctctcagc

SEQ ID NO: 4298908 - DNA, 14 bp, Homo sapiens
ttcatttccaccaa

SEQ ID NO: 4298909 - DNA, 16 bp, Homo sapiens
ttcatttgcacaagta

SEQ ID NO: 4298910 - DNA, 21 bp, Homo sapiens
ttcattttaacatctgagaaa

SEQ ID NO: 4298911 - DNA, 12 bp, Homo sapiens
ttccaagggccc

SEQ ID NO: 4298912 - DNA, 22 bp, Homo sapiens
ttccaagggtcttcctcctaaa

SEQ ID NO: 4298913 - DNA, 17 bp, Homo sapiens
ttccacacaggcccatg

SEQ ID NO: 4298914 - DNA, 22 bp, Homo sapiens
ttccaccaggattaatctctaa

SEQ ID NO: 4298915 - DNA, 12 bp, Homo sapiens
ttccaccccctc

SEQ ID NO: 4298916 - DNA, 14 bp, Homo sapiens
ttccaccccctccc

SEQ ID NO: 4298917 - DNA, 18 bp, Homo sapiens
ttccacgctgtctccaga

SEQ ID NO: 4298918 - DNA, 17 bp, Homo sapiens
ttccagagagtggctcc

SEQ ID NO: 4298919 - DNA, 18 bp, Homo sapiens
ttccagagagtggctcct

SEQ ID NO: 4298920 - DNA, 19 bp, Homo sapiens
ttccagagagtggctcctc

SEQ ID NO: 4298921 - DNA, 21 bp, Homo sapiens
ttccagagagtggctcctccc

SEQ ID NO: 4298922 - DNA, 19 bp, Homo sapiens
ttccaggccccaggctgga

SEQ ID NO: 4298923 - DNA, 22 bp, Homo sapiens
ttccaggccccaggctggatgc

SEQ ID NO: 4298924 - DNA, 21 bp, Homo sapiens
ttccaggcgtagggccagggc

SEQ ID NO: 4298925 - DNA, 14 bp, Homo sapiens
ttccagtgctgctc

SEQ ID NO: 4298926 - DNA, 22 bp, Homo sapiens
ttccatagtttaggtactcaaa

SEQ ID NO: 4298927 - DNA, 17 bp, Homo sapiens
ttccatatagtttgttt

SEQ ID NO: 4298928 - DNA, 15 bp, Homo sapiens
ttccatcagcagtga

SEQ ID NO: 4298929 - DNA, 20 bp, Homo sapiens
ttccatcctgtacaagtgct

SEQ ID NO: 4298930 - DNA, 21 bp, Homo sapiens
ttccatctatataaatcgcat

SEQ ID NO: 4298931 - DNA, 17 bp, Homo sapiens
ttccatgtcaagattca

SEQ ID NO: 4298932 - DNA, 20 bp, Homo sapiens
ttccattctgggtgttttca

SEQ ID NO: 4298933 - DNA, 21 bp, Homo sapiens
ttcccaacctcccctggtcct

SEQ ID NO: 4298934 - DNA, 15 bp, Homo sapiens
ttcccacaattcttt

SEQ ID NO: 4298935 - DNA, 21 bp, Homo sapiens
ttcccaccaactctctctgcc

SEQ ID NO: 4298936 - DNA, 12 bp, Homo sapiens
ttcccaccccta

SEQ ID NO: 4298937 - DNA, 13 bp, Homo sapiens
ttcccactggctc

SEQ ID NO: 4298938 - DNA, 18 bp, Homo sapiens
ttcccagcaaagttttca

SEQ ID NO: 4298939 - DNA, 12 bp, Homo sapiens
ttcccaggcagg

SEQ ID NO: 4298940 - DNA, 13 bp, Homo sapiens
ttcccaggcaggg

SEQ ID NO: 4298941 - DNA, 19 bp, Homo sapiens
ttcccatggtagactgtga

SEQ ID NO: 4298942 - DNA, 20 bp, Homo sapiens
ttcccatggtagactgtgac

SEQ ID NO: 4298943 - DNA, 15 bp, Homo sapiens
ttcccatttgtaatg

SEQ ID NO: 4298944 - DNA, 18 bp, Homo sapiens
ttccccaacgaaaagcac

SEQ ID NO: 4298945 - DNA, 14 bp, Homo sapiens
ttccccactgcctg

SEQ ID NO: 4298946 - DNA, 23 bp, Homo sapiens
ttccccatcgccttctggctgct

SEQ ID NO: 4298947 - DNA, 11 bp, Homo sapiens
ttccccatggg

SEQ ID NO: 4298948 - DNA, 11 bp, Homo sapiens
ttcccccttcc

SEQ ID NO: 4298949 - DNA, 15 bp, Homo sapiens
ttcccccttcccctg

SEQ ID NO: 4298950 - DNA, 19 bp, Homo sapiens
ttcccctcttcccttcaac

SEQ ID NO: 4298951 - DNA, 16 bp, Homo sapiens
ttcccgccctccccct

SEQ ID NO: 4298952 - DNA, 14 bp, Homo sapiens
ttcccgctcagccc

SEQ ID NO: 4298953 - DNA, 14 bp, Homo sapiens
ttccctagttcttt

SEQ ID NO: 4298954 - DNA, 17 bp, Homo sapiens
ttccctagttctttgca

SEQ ID NO: 4298955 - DNA, 17 bp, Homo sapiens
ttccctctgcctgtccc

SEQ ID NO: 4298956 - DNA, 11 bp, Homo sapiens
ttccctctgct

SEQ ID NO: 4298957 - DNA, 15 bp, Homo sapiens
ttccctgacactgtc

SEQ ID NO: 4298958 - DNA, 22 bp, Homo sapiens
ttccctgacactgtctgctgcc

SEQ ID NO: 4298959 - DNA, 10 bp, Homo sapiens
ttccctgcaa

SEQ ID NO: 4298960 - DNA, 14 bp, Homo sapiens
ttccctgcatccct

SEQ ID NO: 4298961 - DNA, 16 bp, Homo sapiens
ttcccttctctcagcc

SEQ ID NO: 4298962 - DNA, 19 bp, Homo sapiens
ttccctttcactgaagtga

SEQ ID NO: 4298963 - DNA, 22 bp, Homo sapiens
ttccgacaaccgatgctccagc

SEQ ID NO: 4298964 - DNA, 22 bp, Homo sapiens
ttccggctgagctgtgccagct

SEQ ID NO: 4298965 - DNA, 13 bp, Homo sapiens
ttccgtcatgctc

SEQ ID NO: 4298966 - DNA, 17 bp, Homo sapiens
ttcctaaactctgaaat

SEQ ID NO: 4298967 - DNA, 23 bp, Homo sapiens
ttcctaccattatggctttgtgc

SEQ ID NO: 4298968 - DNA, 13 bp, Homo sapiens
ttcctccccagca

SEQ ID NO: 4298969 - DNA, 14 bp, Homo sapiens
ttcctccccagcag

SEQ ID NO: 4298970 - DNA, 15 bp, Homo sapiens
ttcctccctccctgc

SEQ ID NO: 4298971 - DNA, 18 bp, Homo sapiens
ttcctccctccctgcagg

SEQ ID NO: 4298972 - DNA, 19 bp, Homo sapiens
ttcctccctccctgcaggg

SEQ ID NO: 4298973 - DNA, 16 bp, Homo sapiens
ttcctctccactgcct

SEQ ID NO: 4298974 - DNA, 18 bp, Homo sapiens
ttcctctccactgccttc

SEQ ID NO: 4298975 - DNA, 16 bp, Homo sapiens
ttcctgagcttggcca

SEQ ID NO: 4298976 - DNA, 21 bp, Homo sapiens
ttcctgcagcagagcctggaa

SEQ ID NO: 4298977 - DNA, 18 bp, Homo sapiens
ttcctggattttctttct

SEQ ID NO: 4298978 - DNA, 21 bp, Homo sapiens
ttcctggattttctttctatg

SEQ ID NO: 4298979 - DNA, 15 bp, Homo sapiens
ttcctgggcagccca

SEQ ID NO: 4298980 - DNA, 17 bp, Homo sapiens
ttcctgggcagcccaga

SEQ ID NO: 4298981 - DNA, 16 bp, Homo sapiens
ttccttggcccagcag

SEQ ID NO: 4298982 - DNA, 16 bp, Homo sapiens
ttcctttcatcctcag

SEQ ID NO: 4298983 - DNA, 18 bp, Homo sapiens
ttcctttcatcctcagca

SEQ ID NO: 4298984 - DNA, 20 bp, Homo sapiens
ttcgctattcccaggcaggg

SEQ ID NO: 4298985 - DNA, 13 bp, Homo sapiens
ttcggtgcttccc

SEQ ID NO: 4298986 - DNA, 20 bp, Homo sapiens
ttcggtttctaacttggagc

SEQ ID NO: 4298987 - DNA, 12 bp, Homo sapiens
ttcgtgcatttg

SEQ ID NO: 4298988 - DNA, 14 bp, Homo sapiens
ttcgtgcatttgtg

SEQ ID NO: 4298989 - DNA, 11 bp, Homo sapiens
ttcgtggagct

SEQ ID NO: 4298990 - DNA, 20 bp, Homo sapiens
ttcgttagtaatctgtataa

SEQ ID NO: 4298991 - DNA, 15 bp, Homo sapiens
ttctaaaacattctt

SEQ ID NO: 4298992 - DNA, 13 bp, Homo sapiens
ttctaaactgttt

SEQ ID NO: 4298993 - DNA, 13 bp, Homo sapiens
ttctaaagacagg

SEQ ID NO: 4298994 - DNA, 18 bp, Homo sapiens
ttctaaaggtttcactgt

SEQ ID NO: 4298995 - DNA, 12 bp, Homo sapiens
ttctaaatgttt

SEQ ID NO: 4298996 - DNA, 14 bp, Homo sapiens
ttctaaatgtttct

SEQ ID NO: 4298997 - DNA, 15 bp, Homo sapiens
ttctaaatgtttctt

SEQ ID NO: 4298998 - DNA, 17 bp, Homo sapiens
ttctaagattgtacata

SEQ ID NO: 4298999 - DNA, 17 bp, Homo sapiens
ttctaagcttatttcta

SEQ ID NO: 4299000 - DNA, 16 bp, Homo sapiens
ttctaattagattaac

SEQ ID NO: 4299001 - DNA, 20 bp, Homo sapiens
ttctagctataacaactcta

SEQ ID NO: 4299002 - DNA, 13 bp, Homo sapiens
ttctagtctctga

SEQ ID NO: 4299003 - DNA, 16 bp, Homo sapiens
ttctagtctctgattt

SEQ ID NO: 4299004 - DNA, 19 bp, Homo sapiens
ttctagttagcaggaaata

SEQ ID NO: 4299005 - DNA, 22 bp, Homo sapiens
ttctataaattcaacacttatt

SEQ ID NO: 4299006 - DNA, 16 bp, Homo sapiens
ttctatgtagaactgt

SEQ ID NO: 4299007 - DNA, 17 bp, Homo sapiens
ttctatgtagaactgtt

SEQ ID NO: 4299008 - DNA, 18 bp, Homo sapiens
ttctattgcagttataga

SEQ ID NO: 4299009 - DNA, 21 bp, Homo sapiens
ttctcaaagtttttacagtgt

SEQ ID NO: 4299010 - DNA, 20 bp, Homo sapiens
ttctcaaatgctactcagta

SEQ ID NO: 4299011 - DNA, 20 bp, Homo sapiens
ttctcacactctaactgtat

SEQ ID NO: 4299012 - DNA, 21 bp, Homo sapiens
ttctcacactctaactgtata

SEQ ID NO: 4299013 - DNA, 21 bp, Homo sapiens
ttctcagagctccacagaaga

SEQ ID NO: 4299014 - DNA, 16 bp, Homo sapiens
ttctcccctccaagtg

SEQ ID NO: 4299015 - DNA, 14 bp, Homo sapiens
ttctcccctccaga

SEQ ID NO: 4299016 - DNA, 17 bp, Homo sapiens
ttctcctttcacaacct

SEQ ID NO: 4299017 - DNA, 23 bp, Homo sapiens
ttctctaaatgaggggcctcagg

SEQ ID NO: 4299018 - DNA, 15 bp, Homo sapiens
ttctctcctgtgagc

SEQ ID NO: 4299019 - DNA, 22 bp, Homo sapiens
ttctctgatcacaacttttctg

SEQ ID NO: 4299020 - DNA, 19 bp, Homo sapiens
ttctctttgtaaggacttg

SEQ ID NO: 4299021 - DNA, 14 bp, Homo sapiens
ttctgaaaactgtt

SEQ ID NO: 4299022 - DNA, 17 bp, Homo sapiens
ttctgaataatttctta

SEQ ID NO: 4299023 - DNA, 21 bp, Homo sapiens
ttctgagcaccgaatattgag

SEQ ID NO: 4299024 - DNA, 14 bp, Homo sapiens
ttctggcctctggc

SEQ ID NO: 4299025 - DNA, 23 bp, Homo sapiens
ttctgggaaatggcttgaagcca

SEQ ID NO: 4299026 - DNA, 21 bp, Homo sapiens
ttctggggctgagagtggggc

SEQ ID NO: 4299027 - DNA, 15 bp, Homo sapiens
ttctgggtgttttca

SEQ ID NO: 4299028 - DNA, 21 bp, Homo sapiens
ttctgtaatatttacaatgta

SEQ ID NO: 4299029 - DNA, 15 bp, Homo sapiens
ttctgtcctgtaact

SEQ ID NO: 4299030 - DNA, 12 bp, Homo sapiens
ttctgtggctca

SEQ ID NO: 4299031 - DNA, 18 bp, Homo sapiens
ttacagtaatgtcataaa

SEQ ID NO: 4299032 - DNA, 13 bp, Homo sapiens
ttacagtgtatct

SEQ ID NO: 4299033 - DNA, 13 bp, Homo sapiens
ttacatagtctga

SEQ ID NO: 4299034 - DNA, 16 bp, Homo sapiens
ttacatgattcatttt

SEQ ID NO: 4299035 - DNA, 22 bp, Homo sapiens
ttacatgcattactgcatgcac

SEQ ID NO: 4299036 - DNA, 21 bp, Homo sapiens
ttaccattttgcgatgtgttt

SEQ ID NO: 4299037 - DNA, 13 bp, Homo sapiens
ttaccctccctgt

SEQ ID NO: 4299038 - DNA, 16 bp, Homo sapiens
ttaccctccctgtccc

SEQ ID NO: 4299039 - DNA, 17 bp, Homo sapiens
ttacctcaacaagaaga

SEQ ID NO: 4299040 - DNA, 22 bp, Homo sapiens
ttactacataattaaattttaa

SEQ ID NO: 4299041 - DNA, 15 bp, Homo sapiens
ttactatagcaaagt

SEQ ID NO: 4299042 - DNA, 16 bp, Homo sapiens
ttactttatgttacta

SEQ ID NO: 4299043 - DNA, 13 bp, Homo sapiens
ttactttgcccat

SEQ ID NO: 4299044 - DNA, 23 bp, Homo sapiens
ttagaaacaaatttttttcttgt

SEQ ID NO: 4299045 - DNA, 21 bp, Homo sapiens
ttagaaatttattcttatctt

SEQ ID NO: 4299046 - DNA, 13 bp, Homo sapiens
ttagaatgttgaa

SEQ ID NO: 4299047 - DNA, 17 bp, Homo sapiens
ttagaattaccatttgt

SEQ ID NO: 4299048 - DNA, 14 bp, Homo sapiens
ttagacaagcctgg

SEQ ID NO: 4299049 - DNA, 19 bp, Homo sapiens
ttagacaagcctggaggac

SEQ ID NO: 4299050 - DNA, 16 bp, Homo sapiens
ttagagattaatttgt

SEQ ID NO: 4299051 - DNA, 21 bp, Homo sapiens
ttagatattcatactttccaa

SEQ ID NO: 4299052 - DNA, 20 bp, Homo sapiens
ttagatccattaatttaaat

SEQ ID NO: 4299053 - DNA, 23 bp, Homo sapiens
ttagatccattaatttaaatgat

SEQ ID NO: 4299054 - DNA, 21 bp, Homo sapiens
ttagatttctcacactctaac

SEQ ID NO: 4299055 - DNA, 14 bp, Homo sapiens
ttagcatgaaaggt

SEQ ID NO: 4299056 - DNA, 22 bp, Homo sapiens
ttagcatgacaagccccaggca

SEQ ID NO: 4299057 - DNA, 12 bp, Homo sapiens
ttagccttctct

SEQ ID NO: 4299058 - DNA, 14 bp, Homo sapiens
ttagccttctctgt

SEQ ID NO: 4299059 - DNA, 21 bp, Homo sapiens
ttagccttctctgttcatttc

SEQ ID NO: 4299060 - DNA, 17 bp, Homo sapiens
ttaggaacagagtatat

SEQ ID NO: 4299061 - DNA, 21 bp, Homo sapiens
ttaggcaggaagtcaggagcc

SEQ ID NO: 4299062 - DNA, 13 bp, Homo sapiens
ttaggccagaggt

SEQ ID NO: 4299063 - DNA, 19 bp, Homo sapiens
ttaggcctggagttgggct

SEQ ID NO: 4299064 - DNA, 21 bp, Homo sapiens
ttaggcctggagttgggctgg

SEQ ID NO: 4299065 - DNA, 15 bp, Homo sapiens
ttagggcatttttct

SEQ ID NO: 4299066 - DNA, 18 bp, Homo sapiens
ttagggcatttttcttgg

SEQ ID NO: 4299067 - DNA, 20 bp, Homo sapiens
ttagggctaaccagttctct

SEQ ID NO: 4299068 - DNA, 15 bp, Homo sapiens
ttagggctctaattt

SEQ ID NO: 4299069 - DNA, 14 bp, Homo sapiens
ttaggggaaaatag

SEQ ID NO: 4299070 - DNA, 19 bp, Homo sapiens
ttaggtagtagaatctcag

SEQ ID NO: 4299071 - DNA, 12 bp, Homo sapiens
ttagtaatagat

SEQ ID NO: 4299072 - DNA, 17 bp, Homo sapiens
ttagtgagatttgtatt

SEQ ID NO: 4299073 - DNA, 12 bp, Homo sapiens
ttagtgtgattg

SEQ ID NO: 4299074 - DNA, 17 bp, Homo sapiens
ttagtttcagctgacca

SEQ ID NO: 4299075 - DNA, 16 bp, Homo sapiens
ttataagcaacatgaa

SEQ ID NO: 4299076 - DNA, 16 bp, Homo sapiens
ttataatcagaatgga

SEQ ID NO: 4299077 - DNA, 19 bp, Homo sapiens
ttatacaaccttcatttaa

SEQ ID NO: 4299078 - DNA, 12 bp, Homo sapiens
ttatatcatcaa

SEQ ID NO: 4299079 - DNA, 14 bp, Homo sapiens
ttatatctgtaaat

SEQ ID NO: 4299080 - DNA, 22 bp, Homo sapiens
ttatatctgtggtcttcaaatt

SEQ ID NO: 4299081 - DNA, 15 bp, Homo sapiens
ttatattgttcactt

SEQ ID NO: 4299082 - DNA, 21 bp, Homo sapiens
ttatcagaatcaaatctgagc

SEQ ID NO: 4299083 - DNA, 17 bp, Homo sapiens
ttatctagcaagaagat

SEQ ID NO: 4299084 - DNA, 13 bp, Homo sapiens
ttatctcttcttc

SEQ ID NO: 4299085 - DNA, 14 bp, Homo sapiens
ttatgattagcttt

SEQ ID NO: 4299086 - DNA, 13 bp, Homo sapiens
ttatgcaaagtac

SEQ ID NO: 4299087 - DNA, 18 bp, Homo sapiens
ttatgggaatgccttttc

SEQ ID NO: 4299088 - DNA, 13 bp, Homo sapiens
ttatggtagaaaa

SEQ ID NO: 4299089 - DNA, 19 bp, Homo sapiens
ttatggtagaaaaatttca

SEQ ID NO: 4299090 - DNA, 21 bp, Homo sapiens
ttatggtattttcgtgcattt

SEQ ID NO: 4299091 - DNA, 23 bp, Homo sapiens
ttatggtattttcgtgcatttgt

SEQ ID NO: 4299092 - DNA, 15 bp, Homo sapiens
ttatgtgctattaat

SEQ ID NO: 4299093 - DNA, 18 bp, Homo sapiens
ttatgtgcttgaagattc

SEQ ID NO: 4299094 - DNA, 15 bp, Homo sapiens
ttatgtttacctcac

SEQ ID NO: 4299095 - DNA, 13 bp, Homo sapiens
ttattaaatcaga

SEQ ID NO: 4299096 - DNA, 12 bp, Homo sapiens
ttattaaatgta

SEQ ID NO: 4299097 - DNA, 18 bp, Homo sapiens
ttattaaatgtagcttca

SEQ ID NO: 4299098 - DNA, 13 bp, Homo sapiens
ttattaaccaaat

SEQ ID NO: 4299099 - DNA, 18 bp, Homo sapiens
ttattagccctgcatttt

SEQ ID NO: 4299100 - DNA, 15 bp, Homo sapiens
ttattcaaagagaaa

SEQ ID NO: 4299101 - DNA, 21 bp, Homo sapiens
ttattcacttgtgtttgtata

SEQ ID NO: 4299102 - DNA, 14 bp, Homo sapiens
ttattgagttctga

SEQ ID NO: 4299103 - DNA, 21 bp, Homo sapiens
ttattgatattctaagaaata

SEQ ID NO: 4299104 - DNA, 19 bp, Homo sapiens
ttattgggcaagtgattga

SEQ ID NO: 4299105 - DNA, 20 bp, Homo sapiens
ttattgggcaagtgattgaa

SEQ ID NO: 4299106 - DNA, 11 bp, Homo sapiens
ttatttacaag

SEQ ID NO: 4299107 - DNA, 17 bp, Homo sapiens
ttatttacaagaagaac

SEQ ID NO: 4299108 - DNA, 14 bp, Homo sapiens
ttatttatatatga

SEQ ID NO: 4299109 - DNA, 22 bp, Homo sapiens
ttatttcaaccgcttgccatat

SEQ ID NO: 4299110 - DNA, 12 bp, Homo sapiens
ttatttcaatgt

SEQ ID NO: 4299111 - DNA, 18 bp, Homo sapiens
ttatttcataaacaactt

SEQ ID NO: 4299112 - DNA, 11 bp, Homo sapiens
ttatttcatga

SEQ ID NO: 4299113 - DNA, 22 bp, Homo sapiens
ttatttctaaaacattaattga

SEQ ID NO: 4299114 - DNA, 15 bp, Homo sapiens
ttatttgtcagtgta

SEQ ID NO: 4299115 - DNA, 14 bp, Homo sapiens
ttattttctgaatt

SEQ ID NO: 4299116 - DNA, 15 bp, Homo sapiens
ttatttttctgttac

SEQ ID NO: 4299117 - DNA, 15 bp, Homo sapiens
ttcaaaatagttcta

SEQ ID NO: 4299118 - DNA, 18 bp, Homo sapiens
ttcaaaatagttctattt

SEQ ID NO: 4299119 - DNA, 22 bp, Homo sapiens
ttcaaaatagttctatttctat

SEQ ID NO: 4299120 - DNA, 16 bp, Homo sapiens
ttcaaaatattgagca

SEQ ID NO: 4299121 - DNA, 23 bp, Homo sapiens
ttcaaaatattgagcagaattca

SEQ ID NO: 4299122 - DNA, 16 bp, Homo sapiens
ttcaaacacacacaca

SEQ ID NO: 4299123 - DNA, 23 bp, Homo sapiens
ttcaaagagaaaacatctcatca

SEQ ID NO: 4299124 - DNA, 20 bp, Homo sapiens
ttcaaagtctcaatgaaata

SEQ ID NO: 4299125 - DNA, 13 bp, Homo sapiens
ttcaaatactttt

SEQ ID NO: 4299126 - DNA, 14 bp, Homo sapiens
ttcaaatgcatgat

SEQ ID NO: 4299127 - DNA, 13 bp, Homo sapiens
ttcaacaaatgat

SEQ ID NO: 4299128 - DNA, 15 bp, Homo sapiens
ttcaacacttatttt

SEQ ID NO: 4299129 - DNA, 15 bp, Homo sapiens
ttcaaccattcccca

SEQ ID NO: 4299130 - DNA, 17 bp, Homo sapiens
ttcaaccattccccatg

SEQ ID NO: 4299131 - DNA, 20 bp, Homo sapiens
ttcaaccattccccatggga

SEQ ID NO: 4299132 - DNA, 14 bp, Homo sapiens
ttcaactgtatacc

SEQ ID NO: 4299133 - DNA, 22 bp, Homo sapiens
ttcaactgtataccgtgtgctc

SEQ ID NO: 4299134 - DNA, 14 bp, Homo sapiens
ttcaagctcaccct

SEQ ID NO: 4299135 - DNA, 20 bp, Homo sapiens
ttcaagctcaccctgctcct

SEQ ID NO: 4299136 - DNA, 14 bp, Homo sapiens
ttcacaaatatagt

SEQ ID NO: 4299137 - DNA, 16 bp, Homo sapiens
ttcacactgtgcgttt

SEQ ID NO: 4299138 - DNA, 22 bp, Homo sapiens
ttcacactgtgcgttttagagt

SEQ ID NO: 4299139 - DNA, 20 bp, Homo sapiens
ttcaccaagcttagaagcca

SEQ ID NO: 4299140 - DNA, 20 bp, Homo sapiens
ttcaccaggaagaaggcccg

SEQ ID NO: 4299141 - DNA, 22 bp, Homo sapiens
ttcaccagtttccaagtttatt

SEQ ID NO: 4299142 - DNA, 19 bp, Homo sapiens
ttcacccagcacccatgcc

SEQ ID NO: 4299143 - DNA, 20 bp, Homo sapiens
ttcaccccatccctccttaa

SEQ ID NO: 4299144 - DNA, 16 bp, Homo sapiens
ttcacgcaacttgaaa

SEQ ID NO: 4299145 - DNA, 14 bp, Homo sapiens
ttcactactcagca

SEQ ID NO: 4299146 - DNA, 21 bp, Homo sapiens
ttcactgaagtgaatacatgg

SEQ ID NO: 4299147 - DNA, 15 bp, Homo sapiens
ttcactgctggctgc

SEQ ID NO: 4299148 - DNA, 18 bp, Homo sapiens
ttcactgctggctgcctt

SEQ ID NO: 4299149 - DNA, 23 bp, Homo sapiens
ttcacttcgatgactggatacag

SEQ ID NO: 4299150 - DNA, 18 bp, Homo sapiens
ttcagaaagatgaagaag

SEQ ID NO: 4299151 - DNA, 20 bp, Homo sapiens
ttcagaaagggcagcccctc

SEQ ID NO: 4299152 - DNA, 18 bp, Homo sapiens
ttcagacctttgtctgaa

SEQ ID NO: 4299153 - DNA, 17 bp, Homo sapiens
ttcagactctctcctct

SEQ ID NO: 4299154 - DNA, 20 bp, Homo sapiens
ttcagcatcgtgtgggtccc

SEQ ID NO: 4299155 - DNA, 19 bp, Homo sapiens
ttcagcttgtttctatact

SEQ ID NO: 4299156 - DNA, 23 bp, Homo sapiens
ttcagcttttttttcagccattc

SEQ ID NO: 4299157 - DNA, 19 bp, Homo sapiens
ttcaggaaagcagcagttt

SEQ ID NO: 4299158 - DNA, 17 bp, Homo sapiens
ttcaggaccccatctgc

SEQ ID NO: 4299159 - DNA, 20 bp, Homo sapiens
ttcaggaccccatctgctga

SEQ ID NO: 4299160 - DNA, 22 bp, Homo sapiens
ttcaggaccccatctgctgagc

SEQ ID NO: 4299161 - DNA, 15 bp, Homo sapiens
ttcaggctcttctcc

SEQ ID NO: 4299162 - DNA, 16 bp, Homo sapiens
ttcaggctcttctcct

SEQ ID NO: 4299163 - DNA, 18 bp, Homo sapiens
ttcaggcttgcattaaaa

SEQ ID NO: 4299164 - DNA, 23 bp, Homo sapiens
ttcaggcttgcattaaaagactg

SEQ ID NO: 4299165 - DNA, 16 bp, Homo sapiens
tgtgtccatgtgaaat

SEQ ID NO: 4299166 - DNA, 15 bp, Homo sapiens
tgtgtccctctctct

SEQ ID NO: 4299167 - DNA, 16 bp, Homo sapiens
tgtgtccctctctctg

SEQ ID NO: 4299168 - DNA, 17 bp, Homo sapiens
tgtgtccctctctctgg

SEQ ID NO: 4299169 - DNA, 15 bp, Homo sapiens
tgtgtgtttctgtcc

SEQ ID NO: 4299170 - DNA, 18 bp, Homo sapiens
tgtgttagtgtctgtcca

SEQ ID NO: 4299171 - DNA, 23 bp, Homo sapiens
tgtgttgatgactcactcataaa

SEQ ID NO: 4299172 - DNA, 18 bp, Homo sapiens
tgtgttgcaaattattct

SEQ ID NO: 4299173 - DNA, 19 bp, Homo sapiens
tgtgttgccattttgtctg

SEQ ID NO: 4299174 - DNA, 22 bp, Homo sapiens
tgtgttgccattttgtctggct

SEQ ID NO: 4299175 - DNA, 24 bp, Homo sapiens
tgtgttgccattttgtctggctgt

SEQ ID NO: 4299176 - DNA, 13 bp, Homo sapiens
tgtgttgggcccc

SEQ ID NO: 4299177 - DNA, 20 bp, Homo sapiens
tgtgtttactttatgttact

SEQ ID NO: 4299178 - DNA, 21 bp, Homo sapiens
tgtgtttctgtcctgtaactg

SEQ ID NO: 4299179 - DNA, 18 bp, Homo sapiens
tgtgttttggtatgcact

SEQ ID NO: 4299180 - DNA, 18 bp, Homo sapiens
tgttaaacgtcacagcag

SEQ ID NO: 4299181 - DNA, 19 bp, Homo sapiens
tgttaacaatgcctattgt

SEQ ID NO: 4299182 - DNA, 13 bp, Homo sapiens
tgttaatatcact

SEQ ID NO: 4299183 - DNA, 19 bp, Homo sapiens
tgttaatatcactcattaa

SEQ ID NO: 4299184 - DNA, 22 bp, Homo sapiens
tgttaatcttaatgtatatcgt

SEQ ID NO: 4299185 - DNA, 17 bp, Homo sapiens
tgttacaggtgtactat

SEQ ID NO: 4299186 - DNA, 13 bp, Homo sapiens
tgttactttggaa

SEQ ID NO: 4299187 - DNA, 12 bp, Homo sapiens
tgttagatgttt

SEQ ID NO: 4299188 - DNA, 17 bp, Homo sapiens
tgttagtgatttgctat

SEQ ID NO: 4299189 - DNA, 15 bp, Homo sapiens
tgttagtgtctgtcc

SEQ ID NO: 4299190 - DNA, 16 bp, Homo sapiens
tgttagtgtctgtcca

SEQ ID NO: 4299191 - DNA, 21 bp, Homo sapiens
tgttcaaagaacccccctccc

SEQ ID NO: 4299192 - DNA, 13 bp, Homo sapiens
tgttcatttcctc

SEQ ID NO: 4299193 - DNA, 18 bp, Homo sapiens
tgttccatcctgtacaag

SEQ ID NO: 4299194 - DNA, 15 bp, Homo sapiens
tgttctaatggatta

SEQ ID NO: 4299195 - DNA, 12 bp, Homo sapiens
tgttctcagagc

SEQ ID NO: 4299196 - DNA, 16 bp, Homo sapiens
tgttctcagagctcca

SEQ ID NO: 4299197 - DNA, 22 bp, Homo sapiens
tgttctcagagctccacagaag

SEQ ID NO: 4299198 - DNA, 15 bp, Homo sapiens
tgttctctgcttttc

SEQ ID NO: 4299199 - DNA, 18 bp, Homo sapiens
tgttctgaataatttctt

SEQ ID NO: 4299200 - DNA, 16 bp, Homo sapiens
tgttctggcctctggc

SEQ ID NO: 4299201 - DNA, 21 bp, Homo sapiens
tgttctggcctctggcctggg

SEQ ID NO: 4299202 - DNA, 22 bp, Homo sapiens
tgttctggcctctggcctggga

SEQ ID NO: 4299203 - DNA, 18 bp, Homo sapiens
tgttctgtgtctgctgta

SEQ ID NO: 4299204 - DNA, 13 bp, Homo sapiens
tgttcttcccaaa

SEQ ID NO: 4299205 - DNA, 16 bp, Homo sapiens
tgttcttgcagcagag

SEQ ID NO: 4299206 - DNA, 19 bp, Homo sapiens
tgttctttttaaaaagttg

SEQ ID NO: 4299207 - DNA, 22 bp, Homo sapiens
tgttgatcgatgttaaacgtca

SEQ ID NO: 4299208 - DNA, 20 bp, Homo sapiens
tgttgattaatttctgccat

SEQ ID NO: 4299209 - DNA, 16 bp, Homo sapiens
tgttgcaaattattct

SEQ ID NO: 4299210 - DNA, 18 bp, Homo sapiens
tgttgccattttgtctgg

SEQ ID NO: 4299211 - DNA, 14 bp, Homo sapiens
tgttgctgaaacac

SEQ ID NO: 4299212 - DNA, 13 bp, Homo sapiens
tgttggaggggca

SEQ ID NO: 4299213 - DNA, 20 bp, Homo sapiens
tgttggaggggcaggccttt

SEQ ID NO: 4299214 - DNA, 12 bp, Homo sapiens
tgttgggcccca

SEQ ID NO: 4299215 - DNA, 15 bp, Homo sapiens
tgttgtgctttcaag

SEQ ID NO: 4299216 - DNA, 15 bp, Homo sapiens
tgttgttcagaagtt

SEQ ID NO: 4299217 - DNA, 20 bp, Homo sapiens
tgtttaaaaaaataacatct

SEQ ID NO: 4299218 - DNA, 12 bp, Homo sapiens
tgtttacatgag

SEQ ID NO: 4299219 - DNA, 15 bp, Homo sapiens
tgtttaccctccctg

SEQ ID NO: 4299220 - DNA, 20 bp, Homo sapiens
tgtttacctcactggtgcat

SEQ ID NO: 4299221 - DNA, 21 bp, Homo sapiens
tgtttacctcactggtgcatt

SEQ ID NO: 4299222 - DNA, 23 bp, Homo sapiens
tgtttacctcactggtgcattta

SEQ ID NO: 4299223 - DNA, 22 bp, Homo sapiens
tgtttacttgaatagtattgtg

SEQ ID NO: 4299224 - DNA, 22 bp, Homo sapiens
tgtttcaggtggaacaggagga

SEQ ID NO: 4299225 - DNA, 22 bp, Homo sapiens
tgtttcggagacgggaccgggc

SEQ ID NO: 4299226 - DNA, 14 bp, Homo sapiens
tgtttctatactgt

SEQ ID NO: 4299227 - DNA, 22 bp, Homo sapiens
tgtttctgtcctgtaactgtta

SEQ ID NO: 4299228 - DNA, 12 bp, Homo sapiens
tgtttgatgtgt

SEQ ID NO: 4299229 - DNA, 19 bp, Homo sapiens
tgtttgcctttaggcagga

SEQ ID NO: 4299230 - DNA, 17 bp, Homo sapiens
tgtttgctcacccagga

SEQ ID NO: 4299231 - DNA, 18 bp, Homo sapiens
tgtttgctcacccaggac

SEQ ID NO: 4299232 - DNA, 20 bp, Homo sapiens
tgttttatgtcatactctgt

SEQ ID NO: 4299233 - DNA, 21 bp, Homo sapiens
tgttttatgtcatactctgtg

SEQ ID NO: 4299234 - DNA, 21 bp, Homo sapiens
tgttttattgagttctgaagg

SEQ ID NO: 4299235 - DNA, 12 bp, Homo sapiens
tgttttcaaaat

SEQ ID NO: 4299236 - DNA, 15 bp, Homo sapiens
tgttttctttttctg

SEQ ID NO: 4299237 - DNA, 21 bp, Homo sapiens
ttaaaaaagaaagattttatg

SEQ ID NO: 4299238 - DNA, 13 bp, Homo sapiens
ttaaaaaataaca

SEQ ID NO: 4299239 - DNA, 14 bp, Homo sapiens
ttaaaaaataacat

SEQ ID NO: 4299240 - DNA, 23 bp, Homo sapiens
ttaaaaacacctaagtgactacc

SEQ ID NO: 4299241 - DNA, 19 bp, Homo sapiens
ttaaaaagttgcacattag

SEQ ID NO: 4299242 - DNA, 22 bp, Homo sapiens
ttaaaactagttagattcactt

SEQ ID NO: 4299243 - DNA, 14 bp, Homo sapiens
ttaaaagaagactg

SEQ ID NO: 4299244 - DNA, 13 bp, Homo sapiens
ttaaaataaaacg

SEQ ID NO: 4299245 - DNA, 18 bp, Homo sapiens
ttaaacagttgcacagca

SEQ ID NO: 4299246 - DNA, 16 bp, Homo sapiens
ttaaagaaaggcagag

SEQ ID NO: 4299247 - DNA, 19 bp, Homo sapiens
ttaaagacatttaaaatag

SEQ ID NO: 4299248 - DNA, 17 bp, Homo sapiens
ttaaagacttgatgaat

SEQ ID NO: 4299249 - DNA, 16 bp, Homo sapiens
ttaaagaggagccttt

SEQ ID NO: 4299250 - DNA, 14 bp, Homo sapiens
ttaaagctgttatt

SEQ ID NO: 4299251 - DNA, 14 bp, Homo sapiens
ttaaatcagaatct

SEQ ID NO: 4299252 - DNA, 12 bp, Homo sapiens
ttaaatgattcc

SEQ ID NO: 4299253 - DNA, 13 bp, Homo sapiens
ttaaatgattcca

SEQ ID NO: 4299254 - DNA, 17 bp, Homo sapiens
ttaaatgattccaaata

SEQ ID NO: 4299255 - DNA, 16 bp, Homo sapiens
ttaaatgatttaaatt

SEQ ID NO: 4299256 - DNA, 17 bp, Homo sapiens
ttaaattttcagaaagc

SEQ ID NO: 4299257 - DNA, 14 bp, Homo sapiens
ttaacaacttgtct

SEQ ID NO: 4299258 - DNA, 15 bp, Homo sapiens
ttaacaatgcctatt

SEQ ID NO: 4299259 - DNA, 20 bp, Homo sapiens
ttaacaatgcctattgtaat

SEQ ID NO: 4299260 - DNA, 17 bp, Homo sapiens
ttaacataggcaagagg

SEQ ID NO: 4299261 - DNA, 16 bp, Homo sapiens
ttaacatatattgtta

SEQ ID NO: 4299262 - DNA, 19 bp, Homo sapiens
ttaacatatattgttattt

SEQ ID NO: 4299263 - DNA, 16 bp, Homo sapiens
ttaacctgaattattc

SEQ ID NO: 4299264 - DNA, 18 bp, Homo sapiens
ttaacctgaattattcca

SEQ ID NO: 4299265 - DNA, 13 bp, Homo sapiens
ttaactgcatata

SEQ ID NO: 4299266 - DNA, 15 bp, Homo sapiens
ttaactgcatataga

SEQ ID NO: 4299267 - DNA, 13 bp, Homo sapiens
ttaactttaccat

SEQ ID NO: 4299268 - DNA, 21 bp, Homo sapiens
ttaagcattttactgtctgta

SEQ ID NO: 4299269 - DNA, 22 bp, Homo sapiens
ttaagcattttactgtctgtaa

SEQ ID NO: 4299270 - DNA, 19 bp, Homo sapiens
ttaagcccacagtatattt

SEQ ID NO: 4299271 - DNA, 13 bp, Homo sapiens
ttaagtagatttc

SEQ ID NO: 4299272 - DNA, 16 bp, Homo sapiens
ttaagtgatgaacatt

SEQ ID NO: 4299273 - DNA, 14 bp, Homo sapiens
ttaatatactgcat

SEQ ID NO: 4299274 - DNA, 20 bp, Homo sapiens
ttaatatactgcatatcctg

SEQ ID NO: 4299275 - DNA, 13 bp, Homo sapiens
ttaatatatataa

SEQ ID NO: 4299276 - DNA, 14 bp, Homo sapiens
ttaatatttcttca

SEQ ID NO: 4299277 - DNA, 12 bp, Homo sapiens
ttaatatttgtt

SEQ ID NO: 4299278 - DNA, 16 bp, Homo sapiens
ttaatatttgtttagt

SEQ ID NO: 4299279 - DNA, 18 bp, Homo sapiens
ttaatcaagagagacaaa

SEQ ID NO: 4299280 - DNA, 19 bp, Homo sapiens
ttaatctctaaaattctag

SEQ ID NO: 4299281 - DNA, 20 bp, Homo sapiens
ttaatctctaaaattctagt

SEQ ID NO: 4299282 - DNA, 17 bp, Homo sapiens
ttaatcttaatgtatat

SEQ ID NO: 4299283 - DNA, 15 bp, Homo sapiens
ttaatgaaataccaa

SEQ ID NO: 4299284 - DNA, 17 bp, Homo sapiens
ttaatggtgccttcatt

SEQ ID NO: 4299285 - DNA, 19 bp, Homo sapiens
ttaatggtgccttcatttg

SEQ ID NO: 4299286 - DNA, 23 bp, Homo sapiens
ttaatgttctgaataatttctta

SEQ ID NO: 4299287 - DNA, 22 bp, Homo sapiens
ttaattaaccccataattagat

SEQ ID NO: 4299288 - DNA, 13 bp, Homo sapiens
ttaattgaaaaga

SEQ ID NO: 4299289 - DNA, 23 bp, Homo sapiens
ttaattgtaggtcaatgaaatat

SEQ ID NO: 4299290 - DNA, 18 bp, Homo sapiens
ttaattgtggctttatga

SEQ ID NO: 4299291 - DNA, 16 bp, Homo sapiens
ttaatttaaatgattt

SEQ ID NO: 4299292 - DNA, 14 bp, Homo sapiens
ttaatttcagtaag

SEQ ID NO: 4299293 - DNA, 20 bp, Homo sapiens
ttaatttctgccatttcatg

SEQ ID NO: 4299294 - DNA, 21 bp, Homo sapiens
ttaatttctgccatttcatgt

SEQ ID NO: 4299295 - DNA, 11 bp, Homo sapiens
ttacagctgaa

SEQ ID NO: 4299296 - DNA, 16 bp, Homo sapiens
ttacaggtgtactatg

SEQ ID NO: 4299297 - DNA, 14 bp, Homo sapiens
ttacagtaatgtca

SEQ ID NO: 4299298 - DNA, 17 bp, Homo sapiens
ttacagtaatgtcataa

SEQ ID NO: 4299299 - DNA, 23 bp, Homo sapiens
tgtccctgccccgccccccagag

SEQ ID NO: 4299300 - DNA, 13 bp, Homo sapiens
tgtccctgcctgg

SEQ ID NO: 4299301 - DNA, 15 bp, Homo sapiens
tgtccctgcctggcc

SEQ ID NO: 4299302 - DNA, 13 bp, Homo sapiens
tgtccctgtccct

SEQ ID NO: 4299303 - DNA, 16 bp, Homo sapiens
tgtccctgtccctgcc

SEQ ID NO: 4299304 - DNA, 18 bp, Homo sapiens
tgtccctgtccctgcccc

SEQ ID NO: 4299305 - DNA, 16 bp, Homo sapiens
tgtcctacccgcccgc

SEQ ID NO: 4299306 - DNA, 21 bp, Homo sapiens
tgtcctaggggccgagggaaa

SEQ ID NO: 4299307 - DNA, 23 bp, Homo sapiens
tgtcctaggggccgagggaaatg

SEQ ID NO: 4299308 - DNA, 22 bp, Homo sapiens
tgtcctattactgatgtgtgca

SEQ ID NO: 4299309 - DNA, 21 bp, Homo sapiens
tgtcctcagagggtccctagg

SEQ ID NO: 4299310 - DNA, 12 bp, Homo sapiens
tgtcctgctcag

SEQ ID NO: 4299311 - DNA, 18 bp, Homo sapiens
tgtcctgctcagatgctg

SEQ ID NO: 4299312 - DNA, 14 bp, Homo sapiens
tgtcctggctccca

SEQ ID NO: 4299313 - DNA, 16 bp, Homo sapiens
tgtcctgtaactgtta

SEQ ID NO: 4299314 - DNA, 20 bp, Homo sapiens
tgtccttcccacggccactg

SEQ ID NO: 4299315 - DNA, 21 bp, Homo sapiens
tgtcgcctctcactctggcag

SEQ ID NO: 4299316 - DNA, 18 bp, Homo sapiens
tgtctcaagagggcactg

SEQ ID NO: 4299317 - DNA, 20 bp, Homo sapiens
tgtctcaagagggcactggt

SEQ ID NO: 4299318 - DNA, 19 bp, Homo sapiens
tgtctccagacccccaccc

SEQ ID NO: 4299319 - DNA, 23 bp, Homo sapiens
tgtctccagacccccaccccttc

SEQ ID NO: 4299320 - DNA, 16 bp, Homo sapiens
tgtctccagctgattt

SEQ ID NO: 4299321 - DNA, 12 bp, Homo sapiens
tgtctctcatga

SEQ ID NO: 4299322 - DNA, 12 bp, Homo sapiens
tgtctgaaggat

SEQ ID NO: 4299323 - DNA, 16 bp, Homo sapiens
tgtctgaagtcactgc

SEQ ID NO: 4299324 - DNA, 13 bp, Homo sapiens
tgtctgagccctg

SEQ ID NO: 4299325 - DNA, 19 bp, Homo sapiens
tgtctgagccctgccctca

SEQ ID NO: 4299326 - DNA, 22 bp, Homo sapiens
tgtctgagccctgccctcactc

SEQ ID NO: 4299327 - DNA, 14 bp, Homo sapiens
tgtctgattctatg

SEQ ID NO: 4299328 - DNA, 15 bp, Homo sapiens
tgtctgattctatgc

SEQ ID NO: 4299329 - DNA, 21 bp, Homo sapiens
tgtctgcacaccttgaatctg

SEQ ID NO: 4299330 - DNA, 21 bp, Homo sapiens
tgtctgcgccgctgtgctgtt

SEQ ID NO: 4299331 - DNA, 23 bp, Homo sapiens
tgtctgcttagtatctcatcaac

SEQ ID NO: 4299332 - DNA, 21 bp, Homo sapiens
tgtctggatcagtaaaattat

SEQ ID NO: 4299333 - DNA, 14 bp, Homo sapiens
tgtctggctgtacg

SEQ ID NO: 4299334 - DNA, 15 bp, Homo sapiens
tgtctggctgtacgt

SEQ ID NO: 4299335 - DNA, 18 bp, Homo sapiens
tgtctggctgtggcccct

SEQ ID NO: 4299336 - DNA, 20 bp, Homo sapiens
tgtctggctgtggcccctcc

SEQ ID NO: 4299337 - DNA, 13 bp, Homo sapiens
tgtctgtaagaga

SEQ ID NO: 4299338 - DNA, 14 bp, Homo sapiens
tgtctgtaagagaa

SEQ ID NO: 4299339 - DNA, 14 bp, Homo sapiens
tgtctgtcctaccc

SEQ ID NO: 4299340 - DNA, 19 bp, Homo sapiens
tgtctgtcctacccgcccg

SEQ ID NO: 4299341 - DNA, 17 bp, Homo sapiens
tgtctgtggccctctct

SEQ ID NO: 4299342 - DNA, 20 bp, Homo sapiens
tgtcttagtcataccatcca

SEQ ID NO: 4299343 - DNA, 14 bp, Homo sapiens
tgtcttgagatgta

SEQ ID NO: 4299344 - DNA, 23 bp, Homo sapiens
tgtcttgtaggtaagttggctca

SEQ ID NO: 4299345 - DNA, 21 bp, Homo sapiens
tgtcttgtgtttttgtcttat

SEQ ID NO: 4299346 - DNA, 17 bp, Homo sapiens
tgtctttctccaaagtt

SEQ ID NO: 4299347 - DNA, 23 bp, Homo sapiens
tgtcttttaatgatactgtctaa

SEQ ID NO: 4299348 - DNA, 13 bp, Homo sapiens
tgtcttttgtcat

SEQ ID NO: 4299349 - DNA, 15 bp, Homo sapiens
tgtgaaacacagctg

SEQ ID NO: 4299350 - DNA, 12 bp, Homo sapiens
tgtgaagctgaa

SEQ ID NO: 4299351 - DNA, 17 bp, Homo sapiens
tgtgaatataaatgtgt

SEQ ID NO: 4299352 - DNA, 20 bp, Homo sapiens
tgtgaatataaatgtgtgta

SEQ ID NO: 4299353 - DNA, 16 bp, Homo sapiens
tgtgaatgctgtacct

SEQ ID NO: 4299354 - DNA, 19 bp, Homo sapiens
tgtgaattgaagtcatcat

SEQ ID NO: 4299355 - DNA, 19 bp, Homo sapiens
tgtgaccaagtataaactt

SEQ ID NO: 4299356 - DNA, 20 bp, Homo sapiens
tgtgactcgcttagctgaaa

SEQ ID NO: 4299357 - DNA, 16 bp, Homo sapiens
tgtgagccaaagagaa

SEQ ID NO: 4299358 - DNA, 19 bp, Homo sapiens
tgtgaggatgtggatggag

SEQ ID NO: 4299359 - DNA, 20 bp, Homo sapiens
tgtgagtgtgaatataaatg

SEQ ID NO: 4299360 - DNA, 16 bp, Homo sapiens
tgtgatcgtgtgttgc

SEQ ID NO: 4299361 - DNA, 14 bp, Homo sapiens
tgtgatgaggggag

SEQ ID NO: 4299362 - DNA, 19 bp, Homo sapiens
tgtgattccccggagctgg

SEQ ID NO: 4299363 - DNA, 19 bp, Homo sapiens
tgtgattggcagcttcaaa

SEQ ID NO: 4299364 - DNA, 23 bp, Homo sapiens
tgtgattggcagcttcaaaacag

SEQ ID NO: 4299365 - DNA, 19 bp, Homo sapiens
tgtgcaatatgtaacatgt

SEQ ID NO: 4299366 - DNA, 20 bp, Homo sapiens
tgtgcactttttttctatat

SEQ ID NO: 4299367 - DNA, 19 bp, Homo sapiens
tgtgcagccggggagctga

SEQ ID NO: 4299368 - DNA, 16 bp, Homo sapiens
tgtgcagttgctgttt

SEQ ID NO: 4299369 - DNA, 15 bp, Homo sapiens
tgtgccaccctctgc

SEQ ID NO: 4299370 - DNA, 17 bp, Homo sapiens
tgtgccaccctctgcag

SEQ ID NO: 4299371 - DNA, 18 bp, Homo sapiens
tgtgccaccctctgcagg

SEQ ID NO: 4299372 - DNA, 19 bp, Homo sapiens
tgtgccagctgcttctgcc

SEQ ID NO: 4299373 - DNA, 22 bp, Homo sapiens
tgtgccaggagtgggtgggaca

SEQ ID NO: 4299374 - DNA, 17 bp, Homo sapiens
tgtgcccgctgcgctgc

SEQ ID NO: 4299375 - DNA, 19 bp, Homo sapiens
tgtgcccgctgcgctgccc

SEQ ID NO: 4299376 - DNA, 16 bp, Homo sapiens
tgtgcccgtggtgagg

SEQ ID NO: 4299377 - DNA, 16 bp, Homo sapiens
tgtgcctcttgggaga

SEQ ID NO: 4299378 - DNA, 17 bp, Homo sapiens
tgtgcctgctatccagc

SEQ ID NO: 4299379 - DNA, 20 bp, Homo sapiens
tgtgcctgctatccagccgc

SEQ ID NO: 4299380 - DNA, 16 bp, Homo sapiens
tgtgctaagttgtctt

SEQ ID NO: 4299381 - DNA, 15 bp, Homo sapiens
tgtgctccaggcttc

SEQ ID NO: 4299382 - DNA, 19 bp, Homo sapiens
tgtgctccaggcttcctgc

SEQ ID NO: 4299383 - DNA, 22 bp, Homo sapiens
tgtgctccaggcttcctgccct

SEQ ID NO: 4299384 - DNA, 21 bp, Homo sapiens
tgtgctccagtgttttcttgt

SEQ ID NO: 4299385 - DNA, 11 bp, Homo sapiens
tgtgctgaggt

SEQ ID NO: 4299386 - DNA, 23 bp, Homo sapiens
tgtgctgaggtgggccttccatg

SEQ ID NO: 4299387 - DNA, 18 bp, Homo sapiens
tgtgctgctgtggcatca

SEQ ID NO: 4299388 - DNA, 19 bp, Homo sapiens
tgtgctggtctctaggcct

SEQ ID NO: 4299389 - DNA, 12 bp, Homo sapiens
tgtgctgtgcac

SEQ ID NO: 4299390 - DNA, 16 bp, Homo sapiens
tgtgcttatgtcattt

SEQ ID NO: 4299391 - DNA, 16 bp, Homo sapiens
tgtgcttgttcttcct

SEQ ID NO: 4299392 - DNA, 12 bp, Homo sapiens
tgtgcttttcca

SEQ ID NO: 4299393 - DNA, 20 bp, Homo sapiens
tgtgcttttccatctaaaat

SEQ ID NO: 4299394 - DNA, 15 bp, Homo sapiens
tgtggaaaaaatatt

SEQ ID NO: 4299395 - DNA, 23 bp, Homo sapiens
tgtggaagcaggttgcttcaaga

SEQ ID NO: 4299396 - DNA, 15 bp, Homo sapiens
tgtggaagggactag

SEQ ID NO: 4299397 - DNA, 15 bp, Homo sapiens
tgtggactctggact

SEQ ID NO: 4299398 - DNA, 14 bp, Homo sapiens
tgtggagaggagag

SEQ ID NO: 4299399 - DNA, 19 bp, Homo sapiens
tgtggagaggagagaatga

SEQ ID NO: 4299400 - DNA, 17 bp, Homo sapiens
tgtggagctgcttccag

SEQ ID NO: 4299401 - DNA, 16 bp, Homo sapiens
tgtggagtggaggggt

SEQ ID NO: 4299402 - DNA, 12 bp, Homo sapiens
tgtggagtgggg

SEQ ID NO: 4299403 - DNA, 16 bp, Homo sapiens
tgtggagtggggcagt

SEQ ID NO: 4299404 - DNA, 18 bp, Homo sapiens
tgtggattctatatttca

SEQ ID NO: 4299405 - DNA, 12 bp, Homo sapiens
tgtggcccctcc

SEQ ID NO: 4299406 - DNA, 15 bp, Homo sapiens
tgtggcccctccttc

SEQ ID NO: 4299407 - DNA, 17 bp, Homo sapiens
tgtggcccctccttctc

SEQ ID NO: 4299408 - DNA, 19 bp, Homo sapiens
tgtggcccctccttctccc

SEQ ID NO: 4299409 - DNA, 12 bp, Homo sapiens
tgtggccccttc

SEQ ID NO: 4299410 - DNA, 12 bp, Homo sapiens
tgtggcctcagc

SEQ ID NO: 4299411 - DNA, 16 bp, Homo sapiens
tgtggcctcagcatct

SEQ ID NO: 4299412 - DNA, 17 bp, Homo sapiens
tgtggctcattcttttc

SEQ ID NO: 4299413 - DNA, 15 bp, Homo sapiens
tgtggctcccctcta

SEQ ID NO: 4299414 - DNA, 23 bp, Homo sapiens
tgtggctcccctctatttagcat

SEQ ID NO: 4299415 - DNA, 14 bp, Homo sapiens
tgtggcttggaaca

SEQ ID NO: 4299416 - DNA, 19 bp, Homo sapiens
tgtgggaatgcggcaagaa

SEQ ID NO: 4299417 - DNA, 14 bp, Homo sapiens
tgtgggactggccc

SEQ ID NO: 4299418 - DNA, 16 bp, Homo sapiens
tgtgggactggcccac

SEQ ID NO: 4299419 - DNA, 18 bp, Homo sapiens
tgtgggactggcccaccc

SEQ ID NO: 4299420 - DNA, 16 bp, Homo sapiens
tgtgggagaagggaca

SEQ ID NO: 4299421 - DNA, 18 bp, Homo sapiens
tgtgggcagctggctctg

SEQ ID NO: 4299422 - DNA, 20 bp, Homo sapiens
tgtgggctcccacgccctcc

SEQ ID NO: 4299423 - DNA, 12 bp, Homo sapiens
tgtggggccaca

SEQ ID NO: 4299424 - DNA, 13 bp, Homo sapiens
tgtggggccacac

SEQ ID NO: 4299425 - DNA, 21 bp, Homo sapiens
tgtggtattcaactaatacat

SEQ ID NO: 4299426 - DNA, 18 bp, Homo sapiens
tgtggtcagcggcctggg

SEQ ID NO: 4299427 - DNA, 23 bp, Homo sapiens
tgtgtaatcatttcttgggccct

SEQ ID NO: 4299428 - DNA, 15 bp, Homo sapiens
tgtgtagatagtatg

SEQ ID NO: 4299429 - DNA, 13 bp, Homo sapiens
tgtgtatgtgtgt

SEQ ID NO: 4299430 - DNA, 13 bp, Homo sapiens
tgtgtattctgtg

SEQ ID NO: 4299431 - DNA, 21 bp, Homo sapiens
tgtgtattctgtggattctat

SEQ ID NO: 4299432 - DNA, 19 bp, Homo sapiens
tgtgtccacactaccagtt

SEQ ID NO: 4299433 - DNA, 14 bp, Homo sapiens
tggtggccaggctg

SEQ ID NO: 4299434 - DNA, 19 bp, Homo sapiens
tggtggcccgacagcctgg

SEQ ID NO: 4299435 - DNA, 21 bp, Homo sapiens
tggtgggagcacagctttcct

SEQ ID NO: 4299436 - DNA, 14 bp, Homo sapiens
tggtgggctccaga

SEQ ID NO: 4299437 - DNA, 21 bp, Homo sapiens
tggtggggccatacccatgtg

SEQ ID NO: 4299438 - DNA, 18 bp, Homo sapiens
tggtgtccctgcctggcc

SEQ ID NO: 4299439 - DNA, 21 bp, Homo sapiens
tggtgtctaataaacacagat

SEQ ID NO: 4299440 - DNA, 15 bp, Homo sapiens
tggtgtgttcgtgga

SEQ ID NO: 4299441 - DNA, 15 bp, Homo sapiens
tggtgttctggcctc

SEQ ID NO: 4299442 - DNA, 16 bp, Homo sapiens
tggtgttctggcctct

SEQ ID NO: 4299443 - DNA, 20 bp, Homo sapiens
tggtgttctggcctctggcc

SEQ ID NO: 4299444 - DNA, 16 bp, Homo sapiens
tggtgttggaggggca

SEQ ID NO: 4299445 - DNA, 17 bp, Homo sapiens
tggtgttggaggggcag

SEQ ID NO: 4299446 - DNA, 22 bp, Homo sapiens
tggtgttggaggggcaggcctt

SEQ ID NO: 4299447 - DNA, 23 bp, Homo sapiens
tggttaatcacttaacctgcttt

SEQ ID NO: 4299448 - DNA, 13 bp, Homo sapiens
tggttcatgcctg

SEQ ID NO: 4299449 - DNA, 16 bp, Homo sapiens
tggttcatgcctgggg

SEQ ID NO: 4299450 - DNA, 19 bp, Homo sapiens
tggttcatgcctggggtgg

SEQ ID NO: 4299451 - DNA, 23 bp, Homo sapiens
tggttcatgcctggggtggaggc

SEQ ID NO: 4299452 - DNA, 20 bp, Homo sapiens
tggttcccccaggaccctga

SEQ ID NO: 4299453 - DNA, 20 bp, Homo sapiens
tggttcccctgttcactcta

SEQ ID NO: 4299454 - DNA, 13 bp, Homo sapiens
tggttcctccagc

SEQ ID NO: 4299455 - DNA, 14 bp, Homo sapiens
tggttcctccagca

SEQ ID NO: 4299456 - DNA, 13 bp, Homo sapiens
tggttctccatcc

SEQ ID NO: 4299457 - DNA, 12 bp, Homo sapiens
tggttctggggc

SEQ ID NO: 4299458 - DNA, 15 bp, Homo sapiens
tggttggaggcctgg

SEQ ID NO: 4299459 - DNA, 22 bp, Homo sapiens
tggttggaggcctggtctggag

SEQ ID NO: 4299460 - DNA, 20 bp, Homo sapiens
tggtttggtggccaggctgg

SEQ ID NO: 4299461 - DNA, 12 bp, Homo sapiens
tggttttcatta

SEQ ID NO: 4299462 - DNA, 15 bp, Homo sapiens
tgtaaaggtaggtgc

SEQ ID NO: 4299463 - DNA, 18 bp, Homo sapiens
tgtaaaggtaggtgcatg

SEQ ID NO: 4299464 - DNA, 18 bp, Homo sapiens
tgtaaatttaactgcata

SEQ ID NO: 4299465 - DNA, 17 bp, Homo sapiens
tgtaacagttggtgatt

SEQ ID NO: 4299466 - DNA, 18 bp, Homo sapiens
tgtaaccacaactttcac

SEQ ID NO: 4299467 - DNA, 23 bp, Homo sapiens
tgtaaccatatgattgaaaagaa

SEQ ID NO: 4299468 - DNA, 16 bp, Homo sapiens
tgtaactgttacagta

SEQ ID NO: 4299469 - DNA, 16 bp, Homo sapiens
tgtaagacggccttgg

SEQ ID NO: 4299470 - DNA, 15 bp, Homo sapiens
tgtaatatttacaat

SEQ ID NO: 4299471 - DNA, 17 bp, Homo sapiens
tgtaatatttacaatgt

SEQ ID NO: 4299472 - DNA, 19 bp, Homo sapiens
tgtaatatttacaatgtat

SEQ ID NO: 4299473 - DNA, 21 bp, Homo sapiens
tgtaatcatttatcttatcta

SEQ ID NO: 4299474 - DNA, 19 bp, Homo sapiens
tgtaatcttgttgataaaa

SEQ ID NO: 4299475 - DNA, 14 bp, Homo sapiens
tgtaatgtatctta

SEQ ID NO: 4299476 - DNA, 21 bp, Homo sapiens
tgtaatgtatcttatttatat

SEQ ID NO: 4299477 - DNA, 17 bp, Homo sapiens
tgtaattttgtagtagt

SEQ ID NO: 4299478 - DNA, 14 bp, Homo sapiens
tgtacaaagggaag

SEQ ID NO: 4299479 - DNA, 21 bp, Homo sapiens
tgtacatatggaaatcctgtt

SEQ ID NO: 4299480 - DNA, 23 bp, Homo sapiens
tgtactttcattccctttcatga

SEQ ID NO: 4299481 - DNA, 18 bp, Homo sapiens
tgtagaactgttcatttc

SEQ ID NO: 4299482 - DNA, 13 bp, Homo sapiens
tgtagaagaggga

SEQ ID NO: 4299483 - DNA, 16 bp, Homo sapiens
tgtagaagagggagaa

SEQ ID NO: 4299484 - DNA, 14 bp, Homo sapiens
tgtagcatgttcta

SEQ ID NO: 4299485 - DNA, 13 bp, Homo sapiens
tgtagccagccca

SEQ ID NO: 4299486 - DNA, 16 bp, Homo sapiens
tgtagcttcagtcatt

SEQ ID NO: 4299487 - DNA, 23 bp, Homo sapiens
tgtaggaagaggccgctgcaggg

SEQ ID NO: 4299488 - DNA, 21 bp, Homo sapiens
tgtagggaacggcctgagagg

SEQ ID NO: 4299489 - DNA, 22 bp, Homo sapiens
tgtaggttattatgattagctt

SEQ ID NO: 4299490 - DNA, 18 bp, Homo sapiens
tgtagtaattgttacaat

SEQ ID NO: 4299491 - DNA, 16 bp, Homo sapiens
tgtataaaacagtgtt

SEQ ID NO: 4299492 - DNA, 18 bp, Homo sapiens
tgtataaaacagtgtttc

SEQ ID NO: 4299493 - DNA, 23 bp, Homo sapiens
tgtataacaagccaaacattctt

SEQ ID NO: 4299494 - DNA, 15 bp, Homo sapiens
tgtataatactttgt

SEQ ID NO: 4299495 - DNA, 17 bp, Homo sapiens
tgtatacaaacaggtgc

SEQ ID NO: 4299496 - DNA, 18 bp, Homo sapiens
tgtatacaagtactggta

SEQ ID NO: 4299497 - DNA, 17 bp, Homo sapiens
tgtataccgtgtgctcc

SEQ ID NO: 4299498 - DNA, 13 bp, Homo sapiens
tgtatatttgtat

SEQ ID NO: 4299499 - DNA, 23 bp, Homo sapiens
tgtatcagtgtttatgtgctatt

SEQ ID NO: 4299500 - DNA, 18 bp, Homo sapiens
tgtatctaaaaaataact

SEQ ID NO: 4299501 - DNA, 23 bp, Homo sapiens
tgtatctaaaaaataactgtgca

SEQ ID NO: 4299502 - DNA, 19 bp, Homo sapiens
tgtatctatgcattttctg

SEQ ID NO: 4299503 - DNA, 13 bp, Homo sapiens
tgtatcttattta

SEQ ID NO: 4299504 - DNA, 16 bp, Homo sapiens
tgtatgaaatatatgt

SEQ ID NO: 4299505 - DNA, 18 bp, Homo sapiens
tgtatgggtcattctcac

SEQ ID NO: 4299506 - DNA, 22 bp, Homo sapiens
tgtatgtcattaaagtgcactg

SEQ ID NO: 4299507 - DNA, 13 bp, Homo sapiens
tgtatgtgaaagt

SEQ ID NO: 4299508 - DNA, 19 bp, Homo sapiens
tgtatgtgaaagtgtaaaa

SEQ ID NO: 4299509 - DNA, 20 bp, Homo sapiens
tgtatgtgtgtttctgtcct

SEQ ID NO: 4299510 - DNA, 20 bp, Homo sapiens
tgtatgtgtttataattgtt

SEQ ID NO: 4299511 - DNA, 15 bp, Homo sapiens
tgtattatgcaaagt

SEQ ID NO: 4299512 - DNA, 17 bp, Homo sapiens
tgtattgttagatgttt

SEQ ID NO: 4299513 - DNA, 14 bp, Homo sapiens
tgtatttgtagtgt

SEQ ID NO: 4299514 - DNA, 18 bp, Homo sapiens
tgtattttactttgtgca

SEQ ID NO: 4299515 - DNA, 21 bp, Homo sapiens
tgtattttctgtgttgttcat

SEQ ID NO: 4299516 - DNA, 20 bp, Homo sapiens
tgtattttcttcccatttgt

SEQ ID NO: 4299517 - DNA, 22 bp, Homo sapiens
tgtattttcttcccatttgtaa

SEQ ID NO: 4299518 - DNA, 19 bp, Homo sapiens
tgtattttcttttatatct

SEQ ID NO: 4299519 - DNA, 21 bp, Homo sapiens
tgtattttcttttatatctgt

SEQ ID NO: 4299520 - DNA, 23 bp, Homo sapiens
tgtattttcttttatatctgtaa

SEQ ID NO: 4299521 - DNA, 21 bp, Homo sapiens
tgtcaaaactccactcagcac

SEQ ID NO: 4299522 - DNA, 16 bp, Homo sapiens
tgtcaagattcagcta

SEQ ID NO: 4299523 - DNA, 18 bp, Homo sapiens
tgtcaagctggccgtgga

SEQ ID NO: 4299524 - DNA, 15 bp, Homo sapiens
tgtcaaggggcccta

SEQ ID NO: 4299525 - DNA, 17 bp, Homo sapiens
tgtcacaaagtgagaaa

SEQ ID NO: 4299526 - DNA, 19 bp, Homo sapiens
tgtcacaaagtgagaaatt

SEQ ID NO: 4299527 - DNA, 20 bp, Homo sapiens
tgtcacaaagtgagaaatta

SEQ ID NO: 4299528 - DNA, 14 bp, Homo sapiens
tgtcagagaatatg

SEQ ID NO: 4299529 - DNA, 11 bp, Homo sapiens
tgtcagagctg

SEQ ID NO: 4299530 - DNA, 14 bp, Homo sapiens
tgtcagagctggga

SEQ ID NO: 4299531 - DNA, 13 bp, Homo sapiens
tgtcagcgtttct

SEQ ID NO: 4299532 - DNA, 18 bp, Homo sapiens
tgtcagctgtagaaaggt

SEQ ID NO: 4299533 - DNA, 17 bp, Homo sapiens
tgtcagtagtgcctgtg

SEQ ID NO: 4299534 - DNA, 14 bp, Homo sapiens
tgtcagtcactaaa

SEQ ID NO: 4299535 - DNA, 16 bp, Homo sapiens
tgtcagtcgtgttgct

SEQ ID NO: 4299536 - DNA, 16 bp, Homo sapiens
tgtcagtgcagcccgt

SEQ ID NO: 4299537 - DNA, 13 bp, Homo sapiens
tgtcatactctgt

SEQ ID NO: 4299538 - DNA, 18 bp, Homo sapiens
tgtcatactctgtgtaat

SEQ ID NO: 4299539 - DNA, 20 bp, Homo sapiens
tgtcatactctgtgtaatct

SEQ ID NO: 4299540 - DNA, 22 bp, Homo sapiens
tgtcatatatggggggccaaca

SEQ ID NO: 4299541 - DNA, 20 bp, Homo sapiens
tgtcatgatttcaatgattg

SEQ ID NO: 4299542 - DNA, 16 bp, Homo sapiens
tgtcatttcatttcct

SEQ ID NO: 4299543 - DNA, 17 bp, Homo sapiens
tgtcatttcatttccta

SEQ ID NO: 4299544 - DNA, 21 bp, Homo sapiens
tgtccaacaactccaggaaaa

SEQ ID NO: 4299545 - DNA, 11 bp, Homo sapiens
tgtccaagcat

SEQ ID NO: 4299546 - DNA, 16 bp, Homo sapiens
tgtccaagcatcagca

SEQ ID NO: 4299547 - DNA, 19 bp, Homo sapiens
tgtccaagcatcagcaaga

SEQ ID NO: 4299548 - DNA, 20 bp, Homo sapiens
tgtccacaaatgtcctcaga

SEQ ID NO: 4299549 - DNA, 21 bp, Homo sapiens
tgtccacacaagacagcagag

SEQ ID NO: 4299550 - DNA, 17 bp, Homo sapiens
tgtccacactaccagtt

SEQ ID NO: 4299551 - DNA, 19 bp, Homo sapiens
tgtccacctgtgctgctgc

SEQ ID NO: 4299552 - DNA, 18 bp, Homo sapiens
tgtccatctgtctgtcct

SEQ ID NO: 4299553 - DNA, 19 bp, Homo sapiens
tgtccatctgtctgtccta

SEQ ID NO: 4299554 - DNA, 21 bp, Homo sapiens
tgtccatctgtctgtcctacc

SEQ ID NO: 4299555 - DNA, 18 bp, Homo sapiens
tgtccatgaaaaacagca

SEQ ID NO: 4299556 - DNA, 16 bp, Homo sapiens
tgtccatgtgaaattt

SEQ ID NO: 4299557 - DNA, 22 bp, Homo sapiens
tgtccccagtgtggactctgga

SEQ ID NO: 4299558 - DNA, 24 bp, Homo sapiens
tgtccccagtgtggactctggact

SEQ ID NO: 4299559 - DNA, 15 bp, Homo sapiens
tgtccccattctata

SEQ ID NO: 4299560 - DNA, 22 bp, Homo sapiens
tgtccccattctataaattcaa

SEQ ID NO: 4299561 - DNA, 20 bp, Homo sapiens
tgtccctaccgagtctcttc

SEQ ID NO: 4299562 - DNA, 11 bp, Homo sapiens
tgtccctctca

SEQ ID NO: 4299563 - DNA, 15 bp, Homo sapiens
tgtccctctcaggca

SEQ ID NO: 4299564 - DNA, 11 bp, Homo sapiens
tgtccctgccc

SEQ ID NO: 4299565 - DNA, 17 bp, Homo sapiens
tgtccctgccccgcccc

SEQ ID NO: 4299566 - DNA, 18 bp, Homo sapiens
tggcttttcactgctggc

SEQ ID NO: 4299567 - DNA, 16 bp, Homo sapiens
tgggaaaagggcagga

SEQ ID NO: 4299568 - DNA, 15 bp, Homo sapiens
tgggaaatggcttga

SEQ ID NO: 4299569 - DNA, 13 bp, Homo sapiens
tgggaagggggca

SEQ ID NO: 4299570 - DNA, 15 bp, Homo sapiens
tgggaagggggcagg

SEQ ID NO: 4299571 - DNA, 16 bp, Homo sapiens
tgggacagggcatggc

SEQ ID NO: 4299572 - DNA, 19 bp, Homo sapiens
tgggaccaaaactgcctac

SEQ ID NO: 4299573 - DNA, 19 bp, Homo sapiens
tgggaccgccagatggggc

SEQ ID NO: 4299574 - DNA, 22 bp, Homo sapiens
tgggacggaagtggcctgagaa

SEQ ID NO: 4299575 - DNA, 17 bp, Homo sapiens
tgggactggcccacccc

SEQ ID NO: 4299576 - DNA, 13 bp, Homo sapiens
tgggagagccaag

SEQ ID NO: 4299577 - DNA, 13 bp, Homo sapiens
tgggagaggaagc

SEQ ID NO: 4299578 - DNA, 15 bp, Homo sapiens
tgggagattggcttt

SEQ ID NO: 4299579 - DNA, 17 bp, Homo sapiens
tgggagccgtcagcctg

SEQ ID NO: 4299580 - DNA, 16 bp, Homo sapiens
tgggaggagggggccc

SEQ ID NO: 4299581 - DNA, 14 bp, Homo sapiens
tgggaggcgcgagc

SEQ ID NO: 4299582 - DNA, 20 bp, Homo sapiens
tgggagtcagggagccctgg

SEQ ID NO: 4299583 - DNA, 12 bp, Homo sapiens
tgggagtgggag

SEQ ID NO: 4299584 - DNA, 13 bp, Homo sapiens
tgggagtgggaga

SEQ ID NO: 4299585 - DNA, 15 bp, Homo sapiens
tgggatcattatttc

SEQ ID NO: 4299586 - DNA, 18 bp, Homo sapiens
tgggatccagagagaagc

SEQ ID NO: 4299587 - DNA, 19 bp, Homo sapiens
tgggatgcttgcctagggc

SEQ ID NO: 4299588 - DNA, 16 bp, Homo sapiens
tgggcacctctgctgt

SEQ ID NO: 4299589 - DNA, 19 bp, Homo sapiens
tgggcacctggggagtggg

SEQ ID NO: 4299590 - DNA, 16 bp, Homo sapiens
tgggcagaggggagag

SEQ ID NO: 4299591 - DNA, 16 bp, Homo sapiens
tgggcagcccagagag

SEQ ID NO: 4299592 - DNA, 17 bp, Homo sapiens
tgggcatccccagcccc

SEQ ID NO: 4299593 - DNA, 20 bp, Homo sapiens
tgggcatccccagccccctg

SEQ ID NO: 4299594 - DNA, 14 bp, Homo sapiens
tgggcatctggccc

SEQ ID NO: 4299595 - DNA, 19 bp, Homo sapiens
tgggcatctggccctgctg

SEQ ID NO: 4299596 - DNA, 20 bp, Homo sapiens
tgggcatctggccctgctgc

SEQ ID NO: 4299597 - DNA, 20 bp, Homo sapiens
tgggcatggggtgggcctct

SEQ ID NO: 4299598 - DNA, 21 bp, Homo sapiens
tgggcatggggtgggcctctg

SEQ ID NO: 4299599 - DNA, 14 bp, Homo sapiens
tgggccaagccagg

SEQ ID NO: 4299600 - DNA, 15 bp, Homo sapiens
tgggccaagccaggg

SEQ ID NO: 4299601 - DNA, 22 bp, Homo sapiens
tgggccaagccagggttccaga

SEQ ID NO: 4299602 - DNA, 19 bp, Homo sapiens
tgggccactggcatctctg

SEQ ID NO: 4299603 - DNA, 13 bp, Homo sapiens
tgggccagcccct

SEQ ID NO: 4299604 - DNA, 13 bp, Homo sapiens
tgggccagggtct

SEQ ID NO: 4299605 - DNA, 12 bp, Homo sapiens
tgggcccagaag

SEQ ID NO: 4299606 - DNA, 11 bp, Homo sapiens
tgggccccagg

SEQ ID NO: 4299607 - DNA, 18 bp, Homo sapiens
tgggccccctctcttacc

SEQ ID NO: 4299608 - DNA, 14 bp, Homo sapiens
tgggccctaggcat

SEQ ID NO: 4299609 - DNA, 11 bp, Homo sapiens
tgggccctcct

SEQ ID NO: 4299610 - DNA, 20 bp, Homo sapiens
tgggccctggttcccccagg

SEQ ID NO: 4299611 - DNA, 23 bp, Homo sapiens
tgggccctggttcccccaggacc

SEQ ID NO: 4299612 - DNA, 20 bp, Homo sapiens
tgggcctgatggtggggcca

SEQ ID NO: 4299613 - DNA, 16 bp, Homo sapiens
tgggctccagagtagg

SEQ ID NO: 4299614 - DNA, 15 bp, Homo sapiens
tgggctcccacgccc

SEQ ID NO: 4299615 - DNA, 22 bp, Homo sapiens
tgggctcccacgccctcctccc

SEQ ID NO: 4299616 - DNA, 11 bp, Homo sapiens
tgggctctgcg

SEQ ID NO: 4299617 - DNA, 18 bp, Homo sapiens
tgggctgaatgtatgtaa

SEQ ID NO: 4299618 - DNA, 14 bp, Homo sapiens
tgggctgccctggt

SEQ ID NO: 4299619 - DNA, 16 bp, Homo sapiens
tgggctgccctggtgc

SEQ ID NO: 4299620 - DNA, 17 bp, Homo sapiens
tgggctgccctggtgct

SEQ ID NO: 4299621 - DNA, 15 bp, Homo sapiens
tggggaacaagggtg

SEQ ID NO: 4299622 - DNA, 19 bp, Homo sapiens
tggggaggagactcaggcc

SEQ ID NO: 4299623 - DNA, 13 bp, Homo sapiens
tggggagggagag

SEQ ID NO: 4299624 - DNA, 17 bp, Homo sapiens
tggggagggcgcttttg

SEQ ID NO: 4299625 - DNA, 17 bp, Homo sapiens
tggggagggtgggcgtg

SEQ ID NO: 4299626 - DNA, 19 bp, Homo sapiens
tggggagtgggacagagtc

SEQ ID NO: 4299627 - DNA, 14 bp, Homo sapiens
tggggccgggctgg

SEQ ID NO: 4299628 - DNA, 13 bp, Homo sapiens
tggggcgaggcag

SEQ ID NO: 4299629 - DNA, 18 bp, Homo sapiens
tggggctagactgggctg

SEQ ID NO: 4299630 - DNA, 19 bp, Homo sapiens
tggggctagactgggctgg

SEQ ID NO: 4299631 - DNA, 17 bp, Homo sapiens
tggggctgagagtgggg

SEQ ID NO: 4299632 - DNA, 21 bp, Homo sapiens
tggggcttagaatggggcttc

SEQ ID NO: 4299633 - DNA, 15 bp, Homo sapiens
tggggcttggaaggg

SEQ ID NO: 4299634 - DNA, 22 bp, Homo sapiens
tggggcttggaagggcgctgag

SEQ ID NO: 4299635 - DNA, 19 bp, Homo sapiens
tgggggagaatggctctgg

SEQ ID NO: 4299636 - DNA, 16 bp, Homo sapiens
tgggggattcaaatgc

SEQ ID NO: 4299637 - DNA, 18 bp, Homo sapiens
tgggggattcaaatgcat

SEQ ID NO: 4299638 - DNA, 19 bp, Homo sapiens
tgggggattcaaatgcatg

SEQ ID NO: 4299639 - DNA, 15 bp, Homo sapiens
tgggggcctgctgtg

SEQ ID NO: 4299640 - DNA, 16 bp, Homo sapiens
tgggggctgctgcact

SEQ ID NO: 4299641 - DNA, 15 bp, Homo sapiens
tggggggcacagcca

SEQ ID NO: 4299642 - DNA, 18 bp, Homo sapiens
tggggggcacagccagaa

SEQ ID NO: 4299643 - DNA, 21 bp, Homo sapiens
tggggggccaacaccagggat

SEQ ID NO: 4299644 - DNA, 21 bp, Homo sapiens
tgggggtgtcacagaggcagt

SEQ ID NO: 4299645 - DNA, 13 bp, Homo sapiens
tggggtggaggct

SEQ ID NO: 4299646 - DNA, 15 bp, Homo sapiens
tggggtggggcggga

SEQ ID NO: 4299647 - DNA, 16 bp, Homo sapiens
tggggtggggcttgga

SEQ ID NO: 4299648 - DNA, 17 bp, Homo sapiens
tggggtggggcttggaa

SEQ ID NO: 4299649 - DNA, 19 bp, Homo sapiens
tggggtggggcttggaagg

SEQ ID NO: 4299650 - DNA, 17 bp, Homo sapiens
tgggtcaccttcctggg

SEQ ID NO: 4299651 - DNA, 15 bp, Homo sapiens
tgggtcagtgtgcca

SEQ ID NO: 4299652 - DNA, 22 bp, Homo sapiens
tgggtcagtgtgccaccctctg

SEQ ID NO: 4299653 - DNA, 23 bp, Homo sapiens
tgggtccctaagcacaataaaag

SEQ ID NO: 4299654 - DNA, 15 bp, Homo sapiens
tgggtggccggccct

SEQ ID NO: 4299655 - DNA, 17 bp, Homo sapiens
tgggtggccggccctgc

SEQ ID NO: 4299656 - DNA, 14 bp, Homo sapiens
tgggtgggacacag

SEQ ID NO: 4299657 - DNA, 17 bp, Homo sapiens
tgggtgggacacagaga

SEQ ID NO: 4299658 - DNA, 20 bp, Homo sapiens
tgggtgtatttattttcctc

SEQ ID NO: 4299659 - DNA, 14 bp, Homo sapiens
tgggtgtgagcagg

SEQ ID NO: 4299660 - DNA, 13 bp, Homo sapiens
tgggtgtgctcca

SEQ ID NO: 4299661 - DNA, 17 bp, Homo sapiens
tgggtgtgctccaggct

SEQ ID NO: 4299662 - DNA, 15 bp, Homo sapiens
tgggttccagacaga

SEQ ID NO: 4299663 - DNA, 15 bp, Homo sapiens
tgggttctggggctg

SEQ ID NO: 4299664 - DNA, 15 bp, Homo sapiens
tgggtttactctgtg

SEQ ID NO: 4299665 - DNA, 15 bp, Homo sapiens
tgggtttgggcagtg

SEQ ID NO: 4299666 - DNA, 21 bp, Homo sapiens
tggtaacaagaggagcaggaa

SEQ ID NO: 4299667 - DNA, 20 bp, Homo sapiens
tggtaagattgttattaaat

SEQ ID NO: 4299668 - DNA, 13 bp, Homo sapiens
tggtaatgtgtca

SEQ ID NO: 4299669 - DNA, 12 bp, Homo sapiens
tggtatgtgaat

SEQ ID NO: 4299670 - DNA, 20 bp, Homo sapiens
tggtattcaactaatacatg

SEQ ID NO: 4299671 - DNA, 20 bp, Homo sapiens
tggtattttcgtgcatttgt

SEQ ID NO: 4299672 - DNA, 24 bp, Homo sapiens
tggtcagtgaagcccaggaggacc

SEQ ID NO: 4299673 - DNA, 14 bp, Homo sapiens
tggtcatcctgggc

SEQ ID NO: 4299674 - DNA, 20 bp, Homo sapiens
tggtcatcctgggcatgtcc

SEQ ID NO: 4299675 - DNA, 18 bp, Homo sapiens
tggtccacattctgctgc

SEQ ID NO: 4299676 - DNA, 20 bp, Homo sapiens
tggtccacattctgctgccc

SEQ ID NO: 4299677 - DNA, 13 bp, Homo sapiens
tggtcctgcactg

SEQ ID NO: 4299678 - DNA, 19 bp, Homo sapiens
tggtccttctgaccccact

SEQ ID NO: 4299679 - DNA, 13 bp, Homo sapiens
tggtctctaggcc

SEQ ID NO: 4299680 - DNA, 15 bp, Homo sapiens
tggtctctaggcctg

SEQ ID NO: 4299681 - DNA, 19 bp, Homo sapiens
tggtctgcaccccacagga

SEQ ID NO: 4299682 - DNA, 16 bp, Homo sapiens
tggtcttcaagcctgg

SEQ ID NO: 4299683 - DNA, 12 bp, Homo sapiens
tggtcttggaga

SEQ ID NO: 4299684 - DNA, 15 bp, Homo sapiens
tggtcttggagagga

SEQ ID NO: 4299685 - DNA, 18 bp, Homo sapiens
tggtcttggagaggaggt

SEQ ID NO: 4299686 - DNA, 12 bp, Homo sapiens
tggtgaaagagt

SEQ ID NO: 4299687 - DNA, 21 bp, Homo sapiens
tggtgaaagagtaaaaccaaa

SEQ ID NO: 4299688 - DNA, 14 bp, Homo sapiens
tggtgagaattaaa

SEQ ID NO: 4299689 - DNA, 17 bp, Homo sapiens
tggtgagaattaaaata

SEQ ID NO: 4299690 - DNA, 23 bp, Homo sapiens
tggtgagaattaaaataaaacgt

SEQ ID NO: 4299691 - DNA, 18 bp, Homo sapiens
tggtgataagtggaaaaa

SEQ ID NO: 4299692 - DNA, 18 bp, Homo sapiens
tggtgcatttaaaatgga

SEQ ID NO: 4299693 - DNA, 19 bp, Homo sapiens
tggtgcccaccagctggct

SEQ ID NO: 4299694 - DNA, 22 bp, Homo sapiens
tggtgcccaccagctggctctg

SEQ ID NO: 4299695 - DNA, 14 bp, Homo sapiens
tggtgccccctggg

SEQ ID NO: 4299696 - DNA, 12 bp, Homo sapiens
tggtgctgcacc

SEQ ID NO: 4299697 - DNA, 21 bp, Homo sapiens
tggtgctgcacccctggtgtc

SEQ ID NO: 4299698 - DNA, 15 bp, Homo sapiens
tggtgcttggcagga

SEQ ID NO: 4299699 - DNA, 19 bp, Homo sapiens
tggtggacagacccagggt

SEQ ID NO: 4299700 - DNA, 18 bp, Homo sapiens
tggtggccaagcctgccc

SEQ ID NO: 4299701 - DNA, 13 bp, Homo sapiens
tctggccactctg

SEQ ID NO: 4299702 - DNA, 22 bp, Homo sapiens
tctggccactctgctctgcaca

SEQ ID NO: 4299703 - DNA, 15 bp, Homo sapiens
tctggccctgttgtg

SEQ ID NO: 4299704 - DNA, 12 bp, Homo sapiens
tctggcctctgg

SEQ ID NO: 4299705 - DNA, 19 bp, Homo sapiens
tctggcctctggcctggga

SEQ ID NO: 4299706 - DNA, 21 bp, Homo sapiens
tctggccttggttcctccagc

SEQ ID NO: 4299707 - DNA, 22 bp, Homo sapiens
tctggccttggttcctccagca

SEQ ID NO: 4299708 - DNA, 19 bp, Homo sapiens
tctggctgtggcccctcct

SEQ ID NO: 4299709 - DNA, 14 bp, Homo sapiens
tctgggaagaaaat

SEQ ID NO: 4299710 - DNA, 13 bp, Homo sapiens
tctgggaggcagg

SEQ ID NO: 4299711 - DNA, 18 bp, Homo sapiens
tctgggcaggacctcaga

SEQ ID NO: 4299712 - DNA, 20 bp, Homo sapiens
tctgggctcacaccagccct

SEQ ID NO: 4299713 - DNA, 21 bp, Homo sapiens
tctgggctcacaccagccctg

SEQ ID NO: 4299714 - DNA, 14 bp, Homo sapiens
tctggggtggggct

SEQ ID NO: 4299715 - DNA, 15 bp, Homo sapiens
tctggtattaaatgc

SEQ ID NO: 4299716 - DNA, 23 bp, Homo sapiens
tctggtcagtgaagcccaggagg

SEQ ID NO: 4299717 - DNA, 11 bp, Homo sapiens
tctggtccttc

SEQ ID NO: 4299718 - DNA, 17 bp, Homo sapiens
tctggtgtctaataaac

SEQ ID NO: 4299719 - DNA, 16 bp, Homo sapiens
tctggtgttctcaatg

SEQ ID NO: 4299720 - DNA, 19 bp, Homo sapiens
tctgtaaatttaactgcat

SEQ ID NO: 4299721 - DNA, 19 bp, Homo sapiens
tctgtaatatttacaatgt

SEQ ID NO: 4299722 - DNA, 22 bp, Homo sapiens
tctgtaatatttacaatgtatt

SEQ ID NO: 4299723 - DNA, 23 bp, Homo sapiens
tctgtacctgcccccactcagca

SEQ ID NO: 4299724 - DNA, 17 bp, Homo sapiens
tctgtctgagccctgcc

SEQ ID NO: 4299725 - DNA, 20 bp, Homo sapiens
tctgtctgagccctgccctc

SEQ ID NO: 4299726 - DNA, 22 bp, Homo sapiens
tctgtctgagccctgccctcac

SEQ ID NO: 4299727 - DNA, 18 bp, Homo sapiens
tctgtctggctgtacgtc

SEQ ID NO: 4299728 - DNA, 17 bp, Homo sapiens
tctgtctgtaagatttt

SEQ ID NO: 4299729 - DNA, 20 bp, Homo sapiens
tctgtctgtcctacccgccc

SEQ ID NO: 4299730 - DNA, 17 bp, Homo sapiens
tctgtgctaagttgtct

SEQ ID NO: 4299731 - DNA, 12 bp, Homo sapiens
tctgtggccctc

SEQ ID NO: 4299732 - DNA, 17 bp, Homo sapiens
tctgtggccctctctta

SEQ ID NO: 4299733 - DNA, 17 bp, Homo sapiens
tctgtgggactggccca

SEQ ID NO: 4299734 - DNA, 21 bp, Homo sapiens
tctgtgggactggcccacccc

SEQ ID NO: 4299735 - DNA, 14 bp, Homo sapiens
tctgtggggccaca

SEQ ID NO: 4299736 - DNA, 18 bp, Homo sapiens
tctgtgtaatctctgatt

SEQ ID NO: 4299737 - DNA, 23 bp, Homo sapiens
tctgtgtagtagctcgtgtgctt

SEQ ID NO: 4299738 - DNA, 13 bp, Homo sapiens
tctgtgtctgctg

SEQ ID NO: 4299739 - DNA, 12 bp, Homo sapiens
tctgttccctgc

SEQ ID NO: 4299740 - DNA, 23 bp, Homo sapiens
tctgttccctgctgggtgggaat

SEQ ID NO: 4299741 - DNA, 18 bp, Homo sapiens
tctgtttaccctccctgt

SEQ ID NO: 4299742 - DNA, 18 bp, Homo sapiens
tctgtttgctcacccagg

SEQ ID NO: 4299743 - DNA, 22 bp, Homo sapiens
tctgtttgctcacccaggacct

SEQ ID NO: 4299744 - DNA, 17 bp, Homo sapiens
tcttaacaaaagtgaac

SEQ ID NO: 4299745 - DNA, 16 bp, Homo sapiens
tcttaagacagcatgt

SEQ ID NO: 4299746 - DNA, 23 bp, Homo sapiens
tcttacccacactacgcagaaga

SEQ ID NO: 4299747 - DNA, 15 bp, Homo sapiens
tcttacgctctctgt

SEQ ID NO: 4299748 - DNA, 14 bp, Homo sapiens
tcttactaaacatt

SEQ ID NO: 4299749 - DNA, 16 bp, Homo sapiens
tcttactaaacatttt

SEQ ID NO: 4299750 - DNA, 13 bp, Homo sapiens
tcttactgttttg

SEQ ID NO: 4299751 - DNA, 15 bp, Homo sapiens
tcttagaagaatatt

SEQ ID NO: 4299752 - DNA, 17 bp, Homo sapiens
tcttagaagaatattgt

SEQ ID NO: 4299753 - DNA, 19 bp, Homo sapiens
tcttagggtaggggaagtg

SEQ ID NO: 4299754 - DNA, 16 bp, Homo sapiens
tcttattaaccaaatt

SEQ ID NO: 4299755 - DNA, 16 bp, Homo sapiens
tcttcaagatcccatt

SEQ ID NO: 4299756 - DNA, 17 bp, Homo sapiens
tcttcaagcctggccca

SEQ ID NO: 4299757 - DNA, 14 bp, Homo sapiens
tcttcaccaggaag

SEQ ID NO: 4299758 - DNA, 13 bp, Homo sapiens
tcttccaaatatt

SEQ ID NO: 4299759 - DNA, 20 bp, Homo sapiens
tcttcccaccaactctctct

SEQ ID NO: 4299760 - DNA, 14 bp, Homo sapiens
tcttcccatttgta

SEQ ID NO: 4299761 - DNA, 12 bp, Homo sapiens
tcttcccccttc

SEQ ID NO: 4299762 - DNA, 13 bp, Homo sapiens
tcttcccccttcc

SEQ ID NO: 4299763 - DNA, 14 bp, Homo sapiens
tcttcctcttacct

SEQ ID NO: 4299764 - DNA, 11 bp, Homo sapiens
tcttccttccg

SEQ ID NO: 4299765 - DNA, 13 bp, Homo sapiens
tcttctccactgg

SEQ ID NO: 4299766 - DNA, 14 bp, Homo sapiens
tcttctcctttcac

SEQ ID NO: 4299767 - DNA, 15 bp, Homo sapiens
tcttctgtaatattt

SEQ ID NO: 4299768 - DNA, 20 bp, Homo sapiens
tcttgagagcgctggcctct

SEQ ID NO: 4299769 - DNA, 22 bp, Homo sapiens
tcttgagatgtattatgcaaag

SEQ ID NO: 4299770 - DNA, 23 bp, Homo sapiens
tcttgagatgtattatgcaaagt

SEQ ID NO: 4299771 - DNA, 15 bp, Homo sapiens
tcttgagtgggcccc

SEQ ID NO: 4299772 - DNA, 16 bp, Homo sapiens
tcttgatgttgcttag

SEQ ID NO: 4299773 - DNA, 15 bp, Homo sapiens
tcttgcagcagagag

SEQ ID NO: 4299774 - DNA, 19 bp, Homo sapiens
tcttgcataagcctcaggc

SEQ ID NO: 4299775 - DNA, 21 bp, Homo sapiens
tcttgccccccaccccagcct

SEQ ID NO: 4299776 - DNA, 12 bp, Homo sapiens
tcttggagagga

SEQ ID NO: 4299777 - DNA, 13 bp, Homo sapiens
tcttgggccctcc

SEQ ID NO: 4299778 - DNA, 15 bp, Homo sapiens
tcttggtatgatcat

SEQ ID NO: 4299779 - DNA, 20 bp, Homo sapiens
tcttgtatctggattcaaat

SEQ ID NO: 4299780 - DNA, 14 bp, Homo sapiens
tcttgtattttctt

SEQ ID NO: 4299781 - DNA, 21 bp, Homo sapiens
tcttgtgcactttatcttggg

SEQ ID NO: 4299782 - DNA, 22 bp, Homo sapiens
tcttgtgcactttatcttggga

SEQ ID NO: 4299783 - DNA, 16 bp, Homo sapiens
tcttgttgataaaaat

SEQ ID NO: 4299784 - DNA, 21 bp, Homo sapiens
tcttgttttttttttccactt

SEQ ID NO: 4299785 - DNA, 18 bp, Homo sapiens
tctttactaacactggct

SEQ ID NO: 4299786 - DNA, 12 bp, Homo sapiens
tctttattgtct

SEQ ID NO: 4299787 - DNA, 17 bp, Homo sapiens
tctttattgtctgtaaa

SEQ ID NO: 4299788 - DNA, 22 bp, Homo sapiens
tctttccaaattgatgggtggg

SEQ ID NO: 4299789 - DNA, 23 bp, Homo sapiens
tctttgacctcaacctgtgatga

SEQ ID NO: 4299790 - DNA, 22 bp, Homo sapiens
tctttgggggattcaaatgcat

SEQ ID NO: 4299791 - DNA, 23 bp, Homo sapiens
tctttgggggattcaaatgcatg

SEQ ID NO: 4299792 - DNA, 18 bp, Homo sapiens
tctttggtgttctggcct

SEQ ID NO: 4299793 - DNA, 17 bp, Homo sapiens
tctttgtttacatgagt

SEQ ID NO: 4299794 - DNA, 14 bp, Homo sapiens
tcttttatatctgt

SEQ ID NO: 4299795 - DNA, 22 bp, Homo sapiens
tctttttaaaaagttgcacatt

SEQ ID NO: 4299796 - DNA, 17 bp, Homo sapiens
tcttttttgagtgtgca

SEQ ID NO: 4299797 - DNA, 13 bp, Homo sapiens
tgaaaaacagcag

SEQ ID NO: 4299798 - DNA, 16 bp, Homo sapiens
tgaaaactaagttctc

SEQ ID NO: 4299799 - DNA, 13 bp, Homo sapiens
tgaaaactggaat

SEQ ID NO: 4299800 - DNA, 14 bp, Homo sapiens
tgaaaactggaata

SEQ ID NO: 4299801 - DNA, 15 bp, Homo sapiens
tgaaaagaaatgcta

SEQ ID NO: 4299802 - DNA, 16 bp, Homo sapiens
tgaaaagaaatgctaa

SEQ ID NO: 4299803 - DNA, 19 bp, Homo sapiens
tgaaaagaagaaagtctat

SEQ ID NO: 4299804 - DNA, 21 bp, Homo sapiens
tgaaaagaagaaagtctatgc

SEQ ID NO: 4299805 - DNA, 19 bp, Homo sapiens
tgaaaatatttttttctag

SEQ ID NO: 4299806 - DNA, 22 bp, Homo sapiens
tgaaaatatttttttctagcta

SEQ ID NO: 4299807 - DNA, 21 bp, Homo sapiens
tgaaacacacaggccatttca

SEQ ID NO: 4299808 - DNA, 13 bp, Homo sapiens
tgaaacacagctg

SEQ ID NO: 4299809 - DNA, 15 bp, Homo sapiens
tgaaacacagctgtt

SEQ ID NO: 4299810 - DNA, 18 bp, Homo sapiens
tgaaacacagctgttctt

SEQ ID NO: 4299811 - DNA, 19 bp, Homo sapiens
tgaaacacagctgttcttc

SEQ ID NO: 4299812 - DNA, 16 bp, Homo sapiens
tgaaacctaaggcaac

SEQ ID NO: 4299813 - DNA, 17 bp, Homo sapiens
tgaaactgacttgctgt

SEQ ID NO: 4299814 - DNA, 15 bp, Homo sapiens
tgaaactgcatttgt

SEQ ID NO: 4299815 - DNA, 16 bp, Homo sapiens
tgaaactgcatttgtg

SEQ ID NO: 4299816 - DNA, 17 bp, Homo sapiens
tgaaagagtaaaaccaa

SEQ ID NO: 4299817 - DNA, 15 bp, Homo sapiens
tgaaagatggtaatc

SEQ ID NO: 4299818 - DNA, 20 bp, Homo sapiens
tgaaagatggtaatcttttc

SEQ ID NO: 4299819 - DNA, 21 bp, Homo sapiens
tgaaagatggtaatcttttct

SEQ ID NO: 4299820 - DNA, 17 bp, Homo sapiens
tgaaaggtaatctgaaa

SEQ ID NO: 4299821 - DNA, 19 bp, Homo sapiens
tgaaaggtaatctgaaaca

SEQ ID NO: 4299822 - DNA, 15 bp, Homo sapiens
tgaaaggtagacttt

SEQ ID NO: 4299823 - DNA, 20 bp, Homo sapiens
tgaaagtctcctgtatcatt

SEQ ID NO: 4299824 - DNA, 22 bp, Homo sapiens
tgaaagtggggtgttgaagacc

SEQ ID NO: 4299825 - DNA, 23 bp, Homo sapiens
tgaaataaccgtaaaggtttatt

SEQ ID NO: 4299826 - DNA, 16 bp, Homo sapiens
tgaaatatttgcttat

SEQ ID NO: 4299827 - DNA, 18 bp, Homo sapiens
tgaaatatttgcttattt

SEQ ID NO: 4299828 - DNA, 22 bp, Homo sapiens
tgaaatatttgcttatttatat

SEQ ID NO: 4299829 - DNA, 14 bp, Homo sapiens
tgaaattcacaaag

SEQ ID NO: 4299830 - DNA, 16 bp, Homo sapiens
tgaaattccatttgta

SEQ ID NO: 4299831 - DNA, 15 bp, Homo sapiens
tgaaatttgttaata

SEQ ID NO: 4299832 - DNA, 19 bp, Homo sapiens
tgaacaaagtctctgggtc

SEQ ID NO: 4299833 - DNA, 18 bp, Homo sapiens
tgaacaagatttccctaa

SEQ ID NO: 4299834 - DNA, 15 bp, Homo sapiens
tgaacagcttcactt

SEQ ID NO: 4299835 - DNA, 18 bp, Homo sapiens
tgaacagttctcccttca

SEQ ID NO: 4299836 - DNA, 23 bp, Homo sapiens
tgaacattattaaatcagaatct

SEQ ID NO: 4299837 - DNA, 14 bp, Homo sapiens
tgaactgcaacact

SEQ ID NO: 4299838 - DNA, 14 bp, Homo sapiens
tgaactgctgctgg

SEQ ID NO: 4299839 - DNA, 15 bp, Homo sapiens
tgaactgctgctggt

SEQ ID NO: 4299840 - DNA, 15 bp, Homo sapiens
tgaagaaaagtgggc

SEQ ID NO: 4299841 - DNA, 18 bp, Homo sapiens
tgaagaaaagtgggccag

SEQ ID NO: 4299842 - DNA, 21 bp, Homo sapiens
tgaagaaggaggaattttaga

SEQ ID NO: 4299843 - DNA, 22 bp, Homo sapiens
tgaagagagatatatctgaaaa

SEQ ID NO: 4299844 - DNA, 18 bp, Homo sapiens
tgaagaggatcggaggct

SEQ ID NO: 4299845 - DNA, 22 bp, Homo sapiens
tgaagcaaacacacagactctg

SEQ ID NO: 4299846 - DNA, 23 bp, Homo sapiens
tgaagcaaacacacagactctgt

SEQ ID NO: 4299847 - DNA, 13 bp, Homo sapiens
tgaagcccaggag

SEQ ID NO: 4299848 - DNA, 13 bp, Homo sapiens
tgaaggagaggag

SEQ ID NO: 4299849 - DNA, 15 bp, Homo sapiens
tgaaggccttgttaa

SEQ ID NO: 4299850 - DNA, 23 bp, Homo sapiens
tgaaggttggaactgctgccatg

SEQ ID NO: 4299851 - DNA, 17 bp, Homo sapiens
tgaagtaagttctgaaa

SEQ ID NO: 4299852 - DNA, 14 bp, Homo sapiens
tgaagtcactgcac

SEQ ID NO: 4299853 - DNA, 16 bp, Homo sapiens
tgaagtcactgcacag

SEQ ID NO: 4299854 - DNA, 13 bp, Homo sapiens
tgaagtccagtga

SEQ ID NO: 4299855 - DNA, 17 bp, Homo sapiens
tgaagtccagtgaccct

SEQ ID NO: 4299856 - DNA, 17 bp, Homo sapiens
tgaagtgaatacatggt

SEQ ID NO: 4299857 - DNA, 16 bp, Homo sapiens
tgaagtgaccccagct

SEQ ID NO: 4299858 - DNA, 18 bp, Homo sapiens
tgaagtgaccccagctcc

SEQ ID NO: 4299859 - DNA, 21 bp, Homo sapiens
tgaagtgaccccagctccagg

SEQ ID NO: 4299860 - DNA, 23 bp, Homo sapiens
tgaagtgaccccagctccaggca

SEQ ID NO: 4299861 - DNA, 15 bp, Homo sapiens
tgaagttaacagtct

SEQ ID NO: 4299862 - DNA, 16 bp, Homo sapiens
tgaataaacacttttt

SEQ ID NO: 4299863 - DNA, 14 bp, Homo sapiens
tgaataaagacacc

SEQ ID NO: 4299864 - DNA, 15 bp, Homo sapiens
tgaataaagacacct

SEQ ID NO: 4299865 - DNA, 17 bp, Homo sapiens
tgaataatgcctttgta

SEQ ID NO: 4299866 - DNA, 15 bp, Homo sapiens
tgaatagtattgtgt

SEQ ID NO: 4299867 - DNA, 13 bp, Homo sapiens
tgaatatatttta

SEQ ID NO: 4299868 - DNA, 16 bp, Homo sapiens
tgaatcctctctctgt

SEQ ID NO: 4299869 - DNA, 15 bp, Homo sapiens
tgaatgtagccagcc

SEQ ID NO: 4299870 - DNA, 22 bp, Homo sapiens
tgaatgtccccattctataaat

SEQ ID NO: 4299871 - DNA, 19 bp, Homo sapiens
tgaatgttatatcatcaat

SEQ ID NO: 4299872 - DNA, 19 bp, Homo sapiens
tgaatgtttgaattacagg

SEQ ID NO: 4299873 - DNA, 21 bp, Homo sapiens
tgaattacagggaagaaatca

SEQ ID NO: 4299874 - DNA, 19 bp, Homo sapiens
tgaattgaagtcatcataa

SEQ ID NO: 4299875 - DNA, 18 bp, Homo sapiens
tgaattttttcctaccat

SEQ ID NO: 4299876 - DNA, 19 bp, Homo sapiens
tgacaaccaccgctcccca

SEQ ID NO: 4299877 - DNA, 13 bp, Homo sapiens
tgacaagccccag

SEQ ID NO: 4299878 - DNA, 17 bp, Homo sapiens
tgacaagccccaggcag

SEQ ID NO: 4299879 - DNA, 13 bp, Homo sapiens
tgacaaggcccca

SEQ ID NO: 4299880 - DNA, 16 bp, Homo sapiens
tgacaaggccccagag

SEQ ID NO: 4299881 - DNA, 22 bp, Homo sapiens
tgacaaggccccagagactcag

SEQ ID NO: 4299882 - DNA, 19 bp, Homo sapiens
tgacaaggtgtttctctgt

SEQ ID NO: 4299883 - DNA, 17 bp, Homo sapiens
tgacaagtttaaaggct

SEQ ID NO: 4299884 - DNA, 18 bp, Homo sapiens
tgacaatttcaaaatgca

SEQ ID NO: 4299885 - DNA, 23 bp, Homo sapiens
tgacacaaaggacaaaaatataa

SEQ ID NO: 4299886 - DNA, 20 bp, Homo sapiens
tgacacaaataccagagcac

SEQ ID NO: 4299887 - DNA, 14 bp, Homo sapiens
tgacacaactcatc

SEQ ID NO: 4299888 - DNA, 22 bp, Homo sapiens
tgacacataaatctgtctgatt

SEQ ID NO: 4299889 - DNA, 16 bp, Homo sapiens
tgacacattgcacaca

SEQ ID NO: 4299890 - DNA, 18 bp, Homo sapiens
tgacactgtctgctgccc

SEQ ID NO: 4299891 - DNA, 19 bp, Homo sapiens
tgacacttttcatatcatt

SEQ ID NO: 4299892 - DNA, 19 bp, Homo sapiens
tgacagagggacagtgggc

SEQ ID NO: 4299893 - DNA, 22 bp, Homo sapiens
tgacaggaattctccctggcat

SEQ ID NO: 4299894 - DNA, 18 bp, Homo sapiens
tgacagggagctggggaa

SEQ ID NO: 4299895 - DNA, 17 bp, Homo sapiens
tgacatcagtggcatgg

SEQ ID NO: 4299896 - DNA, 22 bp, Homo sapiens
tgacatgctaacctctctgaac

SEQ ID NO: 4299897 - DNA, 22 bp, Homo sapiens
tgacatggattggatttcagtt

SEQ ID NO: 4299898 - DNA, 14 bp, Homo sapiens
tgacatttctcaaa

SEQ ID NO: 4299899 - DNA, 14 bp, Homo sapiens
tgaccaagtataaa

SEQ ID NO: 4299900 - DNA, 14 bp, Homo sapiens
tgaccaatctctgt

SEQ ID NO: 4299901 - DNA, 23 bp, Homo sapiens
tgaccacacttcctgtccagaga

SEQ ID NO: 4299902 - DNA, 19 bp, Homo sapiens
tgaccagaagtggcaggag

SEQ ID NO: 4299903 - DNA, 21 bp, Homo sapiens
tgaccagaagtggcaggagga

SEQ ID NO: 4299904 - DNA, 15 bp, Homo sapiens
tgaccccacctagaa

SEQ ID NO: 4299905 - DNA, 19 bp, Homo sapiens
tgaccccagctccaggcag

SEQ ID NO: 4299906 - DNA, 19 bp, Homo sapiens
tgacccctcatctgaaagg

SEQ ID NO: 4299907 - DNA, 18 bp, Homo sapiens
tgaccctggagcccggca

SEQ ID NO: 4299908 - DNA, 14 bp, Homo sapiens
tgaccggggtcctg

SEQ ID NO: 4299909 - DNA, 21 bp, Homo sapiens
tgacctgcccccgctctgcca

SEQ ID NO: 4299910 - DNA, 13 bp, Homo sapiens
tgaccttctggga

SEQ ID NO: 4299911 - DNA, 19 bp, Homo sapiens
tgacgggggttggggtggg

SEQ ID NO: 4299912 - DNA, 15 bp, Homo sapiens
tgacgtattgtgaaa

SEQ ID NO: 4299913 - DNA, 19 bp, Homo sapiens
tgactaaaccattgtgcat

SEQ ID NO: 4299914 - DNA, 17 bp, Homo sapiens
tgactagggtcctcagg

SEQ ID NO: 4299915 - DNA, 15 bp, Homo sapiens
tgactataaacatta

SEQ ID NO: 4299916 - DNA, 22 bp, Homo sapiens
tgactataaacattaaaagaag

SEQ ID NO: 4299917 - DNA, 18 bp, Homo sapiens
tgactccaggagaggagc

SEQ ID NO: 4299918 - DNA, 20 bp, Homo sapiens
tgactccatatcccgggagc

SEQ ID NO: 4299919 - DNA, 22 bp, Homo sapiens
tgactccatatcccgggagcag

SEQ ID NO: 4299920 - DNA, 20 bp, Homo sapiens
tgactctttattgtctgtaa

SEQ ID NO: 4299921 - DNA, 19 bp, Homo sapiens
tgactgaacgatccttcaa

SEQ ID NO: 4299922 - DNA, 15 bp, Homo sapiens
tgactgctgcgctgt

SEQ ID NO: 4299923 - DNA, 17 bp, Homo sapiens
tgactgtactcctccca

SEQ ID NO: 4299924 - DNA, 20 bp, Homo sapiens
tgacttcagactctctcctc

SEQ ID NO: 4299925 - DNA, 20 bp, Homo sapiens
tgagaaattatgaaagttaa

SEQ ID NO: 4299926 - DNA, 18 bp, Homo sapiens
tgagaattaaaataaaac

SEQ ID NO: 4299927 - DNA, 21 bp, Homo sapiens
tgagactggatactgcccggg

SEQ ID NO: 4299928 - DNA, 13 bp, Homo sapiens
tgagagagtgtgg

SEQ ID NO: 4299929 - DNA, 14 bp, Homo sapiens
tgagagatgctgta

SEQ ID NO: 4299930 - DNA, 23 bp, Homo sapiens
tgagagatgctgtagacatctgt

SEQ ID NO: 4299931 - DNA, 15 bp, Homo sapiens
tgagagcgctggcct

SEQ ID NO: 4299932 - DNA, 18 bp, Homo sapiens
tgagaggagcgtgtccta

SEQ ID NO: 4299933 - DNA, 15 bp, Homo sapiens
tgagatactttgcat

SEQ ID NO: 4299934 - DNA, 18 bp, Homo sapiens
tgagatactttgcattgt

SEQ ID NO: 4299935 - DNA, 19 bp, Homo sapiens
tgagatcagcattcaaaat

SEQ ID NO: 4299936 - DNA, 21 bp, Homo sapiens
tgagatcagcattcaaaatag

SEQ ID NO: 4299937 - DNA, 19 bp, Homo sapiens
tgagatcctcaaaaatcat

SEQ ID NO: 4299938 - DNA, 21 bp, Homo sapiens
tgagatgatttccaagcctct

SEQ ID NO: 4299939 - DNA, 20 bp, Homo sapiens
tgagatggtgccccctgggg

SEQ ID NO: 4299940 - DNA, 20 bp, Homo sapiens
tgagatttgtatttatatta

SEQ ID NO: 4299941 - DNA, 19 bp, Homo sapiens
tgagcagggtgacccctca

SEQ ID NO: 4299942 - DNA, 23 bp, Homo sapiens
tgagccaaagagaaaagattaaa

SEQ ID NO: 4299943 - DNA, 18 bp, Homo sapiens
tgagcccaagcacacatg

SEQ ID NO: 4299944 - DNA, 15 bp, Homo sapiens
tgagccctgccctca

SEQ ID NO: 4299945 - DNA, 17 bp, Homo sapiens
tgagccctgccctcact

SEQ ID NO: 4299946 - DNA, 23 bp, Homo sapiens
tgagccgtgacctccaggaaggg

SEQ ID NO: 4299947 - DNA, 22 bp, Homo sapiens
tgagccttagtttcagctgacc

SEQ ID NO: 4299948 - DNA, 22 bp, Homo sapiens
tgagcgacatctctgactttct

SEQ ID NO: 4299949 - DNA, 18 bp, Homo sapiens
tgagcggccgcctgtcct

SEQ ID NO: 4299950 - DNA, 20 bp, Homo sapiens
tgagcggccgcctgtccttg

SEQ ID NO: 4299951 - DNA, 21 bp, Homo sapiens
tgagcgttcagttgacacatt

SEQ ID NO: 4299952 - DNA, 18 bp, Homo sapiens
tgagctataatgtttccc

SEQ ID NO: 4299953 - DNA, 21 bp, Homo sapiens
tgagctccagacccccagcaa

SEQ ID NO: 4299954 - DNA, 15 bp, Homo sapiens
tgagctcctctgggc

SEQ ID NO: 4299955 - DNA, 18 bp, Homo sapiens
tgagctctgacctgcccc

SEQ ID NO: 4299956 - DNA, 18 bp, Homo sapiens
tgagctgtgccagctgct

SEQ ID NO: 4299957 - DNA, 15 bp, Homo sapiens
tgagcttgattctaa

SEQ ID NO: 4299958 - DNA, 22 bp, Homo sapiens
tgagcttgattctaaaggggac

SEQ ID NO: 4299959 - DNA, 16 bp, Homo sapiens
tgagcttggccagaag

SEQ ID NO: 4299960 - DNA, 17 bp, Homo sapiens
tgaggacctccacctgg

SEQ ID NO: 4299961 - DNA, 20 bp, Homo sapiens
tgaggagctcagggctggat

SEQ ID NO: 4299962 - DNA, 14 bp, Homo sapiens
tgaggagggggaga

SEQ ID NO: 4299963 - DNA, 15 bp, Homo sapiens
tgaggcaaccccctc

SEQ ID NO: 4299964 - DNA, 24 bp, Homo sapiens
tgaggccagaggaagggaggcctg

SEQ ID NO: 4299965 - DNA, 23 bp, Homo sapiens
tgaggcccccgcacgcaagcctc

SEQ ID NO: 4299966 - DNA, 15 bp, Homo sapiens
tgaggcctcagtgga

SEQ ID NO: 4299967 - DNA, 14 bp, Homo sapiens
tctcatgaacctca

SEQ ID NO: 4299968 - DNA, 11 bp, Homo sapiens
tctcatgcctg

SEQ ID NO: 4299969 - DNA, 12 bp, Homo sapiens
tctcatgcctga

SEQ ID NO: 4299970 - DNA, 15 bp, Homo sapiens
tctcatgctccttaa

SEQ ID NO: 4299971 - DNA, 12 bp, Homo sapiens
tctccacccctc

SEQ ID NO: 4299972 - DNA, 22 bp, Homo sapiens
tctccacccctcaagccaggag

SEQ ID NO: 4299973 - DNA, 23 bp, Homo sapiens
tctccacccctcaagccaggaga

SEQ ID NO: 4299974 - DNA, 14 bp, Homo sapiens
tctccacctcaggg

SEQ ID NO: 4299975 - DNA, 23 bp, Homo sapiens
tctccagccaccaaggctgcctg

SEQ ID NO: 4299976 - DNA, 12 bp, Homo sapiens
tctccagctgat

SEQ ID NO: 4299977 - DNA, 11 bp, Homo sapiens
tctccaggccc

SEQ ID NO: 4299978 - DNA, 18 bp, Homo sapiens
tctccaggcccagcctgg

SEQ ID NO: 4299979 - DNA, 19 bp, Homo sapiens
tctccaggcccagcctggc

SEQ ID NO: 4299980 - DNA, 20 bp, Homo sapiens
tctccaggcccagcctggcc

SEQ ID NO: 4299981 - DNA, 23 bp, Homo sapiens
tctccaggcccagcctggcccca

SEQ ID NO: 4299982 - DNA, 12 bp, Homo sapiens
tctcccacactg

SEQ ID NO: 4299983 - DNA, 17 bp, Homo sapiens
tctcccagctctagaca

SEQ ID NO: 4299984 - DNA, 13 bp, Homo sapiens
tctcccatggggg

SEQ ID NO: 4299985 - DNA, 12 bp, Homo sapiens
tctccccagtgt

SEQ ID NO: 4299986 - DNA, 21 bp, Homo sapiens
tctccccggacaagcccagga

SEQ ID NO: 4299987 - DNA, 12 bp, Homo sapiens
tctcccctccag

SEQ ID NO: 4299988 - DNA, 13 bp, Homo sapiens
tctcccctccaga

SEQ ID NO: 4299989 - DNA, 14 bp, Homo sapiens
tctcccctccagac

SEQ ID NO: 4299990 - DNA, 15 bp, Homo sapiens
tctcccctccagacc

SEQ ID NO: 4299991 - DNA, 19 bp, Homo sapiens
tctcccctccagaccccta

SEQ ID NO: 4299992 - DNA, 12 bp, Homo sapiens
tctccctccact

SEQ ID NO: 4299993 - DNA, 14 bp, Homo sapiens
tctccctccactcc

SEQ ID NO: 4299994 - DNA, 16 bp, Homo sapiens
tctccctccactcctc

SEQ ID NO: 4299995 - DNA, 20 bp, Homo sapiens
tctccctggccacccttggc

SEQ ID NO: 4299996 - DNA, 16 bp, Homo sapiens
tctcctctctctccct

SEQ ID NO: 4299997 - DNA, 19 bp, Homo sapiens
tctcctgaggagcagccca

SEQ ID NO: 4299998 - DNA, 14 bp, Homo sapiens
tctcctgcatccct

SEQ ID NO: 4299999 - DNA, 19 bp, Homo sapiens
tctcctgcatccctccacc

SEQ ID NO: 4300000 - DNA, 19 bp, Homo sapiens
tctcctgggcatctggccc

SEQ ID NO: 4300001 - DNA, 22 bp, Homo sapiens
tctcctgggcatctggccctgc

SEQ ID NO: 4300002 - DNA, 23 bp, Homo sapiens
tctcctgggcatctggccctgct

SEQ ID NO: 4300003 - DNA, 12 bp, Homo sapiens
tctcctgggcca

SEQ ID NO: 4300004 - DNA, 13 bp, Homo sapiens
tctcctgggccag

SEQ ID NO: 4300005 - DNA, 16 bp, Homo sapiens
tctcctgtaattttgt

SEQ ID NO: 4300006 - DNA, 14 bp, Homo sapiens
tctcctgtatcatt

SEQ ID NO: 4300007 - DNA, 16 bp, Homo sapiens
tctcctgtgagctccc

SEQ ID NO: 4300008 - DNA, 18 bp, Homo sapiens
tctcctgtgagctcccca

SEQ ID NO: 4300009 - DNA, 14 bp, Homo sapiens
tctccttgttctga

SEQ ID NO: 4300010 - DNA, 18 bp, Homo sapiens
tctccttgttctgataat

SEQ ID NO: 4300011 - DNA, 16 bp, Homo sapiens
tctcctttcacaacct

SEQ ID NO: 4300012 - DNA, 14 bp, Homo sapiens
tctctaaaattcta

SEQ ID NO: 4300013 - DNA, 23 bp, Homo sapiens
tctctaaaattctagtctctgat

SEQ ID NO: 4300014 - DNA, 23 bp, Homo sapiens
tctctaaatgaggggcctcaggt

SEQ ID NO: 4300015 - DNA, 13 bp, Homo sapiens
tctctactttcct

SEQ ID NO: 4300016 - DNA, 14 bp, Homo sapiens
tctctactttcctg

SEQ ID NO: 4300017 - DNA, 12 bp, Homo sapiens
tctctcacccag

SEQ ID NO: 4300018 - DNA, 19 bp, Homo sapiens
tctctcagcctccactccc

SEQ ID NO: 4300019 - DNA, 22 bp, Homo sapiens
tctctcagcctccactccctgt

SEQ ID NO: 4300020 - DNA, 12 bp, Homo sapiens
tctctcatgaac

SEQ ID NO: 4300021 - DNA, 13 bp, Homo sapiens
tctctccctccac

SEQ ID NO: 4300022 - DNA, 20 bp, Homo sapiens
tctctccctccactcctccc

SEQ ID NO: 4300023 - DNA, 17 bp, Homo sapiens
tctctcctgtgagctcc

SEQ ID NO: 4300024 - DNA, 17 bp, Homo sapiens
tctctctatatatacat

SEQ ID NO: 4300025 - DNA, 18 bp, Homo sapiens
tctctctatatatacatg

SEQ ID NO: 4300026 - DNA, 21 bp, Homo sapiens
tctctctatatatacatgtat

SEQ ID NO: 4300027 - DNA, 13 bp, Homo sapiens
tctctctccctcc

SEQ ID NO: 4300028 - DNA, 16 bp, Homo sapiens
tctctctccctccact

SEQ ID NO: 4300029 - DNA, 12 bp, Homo sapiens
tctctctgcccc

SEQ ID NO: 4300030 - DNA, 15 bp, Homo sapiens
tctctgattaaattt

SEQ ID NO: 4300031 - DNA, 20 bp, Homo sapiens
tctctgcccccaaaagtgtc

SEQ ID NO: 4300032 - DNA, 16 bp, Homo sapiens
tctctggaaaggagga

SEQ ID NO: 4300033 - DNA, 14 bp, Homo sapiens
tctctggagtgtgt

SEQ ID NO: 4300034 - DNA, 16 bp, Homo sapiens
tctctgtaaaatgaac

SEQ ID NO: 4300035 - DNA, 14 bp, Homo sapiens
tctctgtccaatct

SEQ ID NO: 4300036 - DNA, 20 bp, Homo sapiens
tctctgtgactcgcttagct

SEQ ID NO: 4300037 - DNA, 18 bp, Homo sapiens
tctcttaatgccacggca

SEQ ID NO: 4300038 - DNA, 11 bp, Homo sapiens
tctgaaaagaa

SEQ ID NO: 4300039 - DNA, 13 bp, Homo sapiens
tctgaaaatattt

SEQ ID NO: 4300040 - DNA, 20 bp, Homo sapiens
tctgaaaatatttttttcta

SEQ ID NO: 4300041 - DNA, 15 bp, Homo sapiens
tctgaaagctgcttc

SEQ ID NO: 4300042 - DNA, 16 bp, Homo sapiens
tctgaaagctgcttct

SEQ ID NO: 4300043 - DNA, 20 bp, Homo sapiens
tctgaaagctgcttctgggg

SEQ ID NO: 4300044 - DNA, 16 bp, Homo sapiens
tctgaactgcaacact

SEQ ID NO: 4300045 - DNA, 19 bp, Homo sapiens
tctgaactgcaacactgga

SEQ ID NO: 4300046 - DNA, 16 bp, Homo sapiens
tctgaactgctgctgg

SEQ ID NO: 4300047 - DNA, 17 bp, Homo sapiens
tctgaactgctgctggt

SEQ ID NO: 4300048 - DNA, 13 bp, Homo sapiens
tctgaagatctca

SEQ ID NO: 4300049 - DNA, 13 bp, Homo sapiens
tctgaaggagagg

SEQ ID NO: 4300050 - DNA, 16 bp, Homo sapiens
tctgaagtcactgcac

SEQ ID NO: 4300051 - DNA, 18 bp, Homo sapiens
tctgaatgtagccagccc

SEQ ID NO: 4300052 - DNA, 18 bp, Homo sapiens
tctgaattcataaaaata

SEQ ID NO: 4300053 - DNA, 19 bp, Homo sapiens
tctgaattcataaaaataa

SEQ ID NO: 4300054 - DNA, 18 bp, Homo sapiens
tctgagcggccgcctgtc

SEQ ID NO: 4300055 - DNA, 15 bp, Homo sapiens
tctgaggcaaccccc

SEQ ID NO: 4300056 - DNA, 17 bp, Homo sapiens
tctgaggctgccccagg

SEQ ID NO: 4300057 - DNA, 23 bp, Homo sapiens
tctgatcaaagcaccttgaatgg

SEQ ID NO: 4300058 - DNA, 14 bp, Homo sapiens
tctgatcacaactt

SEQ ID NO: 4300059 - DNA, 15 bp, Homo sapiens
tctgatcacaacttt

SEQ ID NO: 4300060 - DNA, 18 bp, Homo sapiens
tctgatcacaacttttct

SEQ ID NO: 4300061 - DNA, 20 bp, Homo sapiens
tctgatgaaatgttaacaat

SEQ ID NO: 4300062 - DNA, 21 bp, Homo sapiens
tctgattggacattttcttca

SEQ ID NO: 4300063 - DNA, 20 bp, Homo sapiens
tctgatttattttgtatgaa

SEQ ID NO: 4300064 - DNA, 23 bp, Homo sapiens
tctgcaagattctgtgggcagct

SEQ ID NO: 4300065 - DNA, 13 bp, Homo sapiens
tctgcacattaga

SEQ ID NO: 4300066 - DNA, 15 bp, Homo sapiens
tctgcaccccacagg

SEQ ID NO: 4300067 - DNA, 16 bp, Homo sapiens
tctgcaccccacagga

SEQ ID NO: 4300068 - DNA, 21 bp, Homo sapiens
tctgcacgtgcacacacctgc

SEQ ID NO: 4300069 - DNA, 14 bp, Homo sapiens
tctgcagggcagcc

SEQ ID NO: 4300070 - DNA, 19 bp, Homo sapiens
tctgcatgctcctctgcct

SEQ ID NO: 4300071 - DNA, 20 bp, Homo sapiens
tctgcatgctcctctgcctg

SEQ ID NO: 4300072 - DNA, 16 bp, Homo sapiens
tctgccatcagcccct

SEQ ID NO: 4300073 - DNA, 17 bp, Homo sapiens
tctgccatcagcccctg

SEQ ID NO: 4300074 - DNA, 20 bp, Homo sapiens
tctgcccaccccgcctctgg

SEQ ID NO: 4300075 - DNA, 21 bp, Homo sapiens
tctgcccaccccgcctctggg

SEQ ID NO: 4300076 - DNA, 14 bp, Homo sapiens
tctgcccccagctg

SEQ ID NO: 4300077 - DNA, 20 bp, Homo sapiens
tctgcccccagctgctcctc

SEQ ID NO: 4300078 - DNA, 17 bp, Homo sapiens
tctgccgtgagagccca

SEQ ID NO: 4300079 - DNA, 18 bp, Homo sapiens
tctgcctgtgcccgctgc

SEQ ID NO: 4300080 - DNA, 13 bp, Homo sapiens
tctgccttccagg

SEQ ID NO: 4300081 - DNA, 14 bp, Homo sapiens
tctgccttggacac

SEQ ID NO: 4300082 - DNA, 19 bp, Homo sapiens
tctgctacctggttttcat

SEQ ID NO: 4300083 - DNA, 18 bp, Homo sapiens
tctgctccatgcagatct

SEQ ID NO: 4300084 - DNA, 22 bp, Homo sapiens
tctgctccatgcagatctagcc

SEQ ID NO: 4300085 - DNA, 15 bp, Homo sapiens
tctgctcggccgtct

SEQ ID NO: 4300086 - DNA, 11 bp, Homo sapiens
tctgctgaggc

SEQ ID NO: 4300087 - DNA, 13 bp, Homo sapiens
tctgctgaggcca

SEQ ID NO: 4300088 - DNA, 17 bp, Homo sapiens
tctgctgaggccagagg

SEQ ID NO: 4300089 - DNA, 13 bp, Homo sapiens
tctgctgccccca

SEQ ID NO: 4300090 - DNA, 13 bp, Homo sapiens
tctgctgccctcc

SEQ ID NO: 4300091 - DNA, 17 bp, Homo sapiens
tctgctgcctctgaaaa

SEQ ID NO: 4300092 - DNA, 20 bp, Homo sapiens
tctgctgcctctgaaaatat

SEQ ID NO: 4300093 - DNA, 21 bp, Homo sapiens
tctgctggattctaaattatg

SEQ ID NO: 4300094 - DNA, 16 bp, Homo sapiens
tctgcttttccattct

SEQ ID NO: 4300095 - DNA, 22 bp, Homo sapiens
tctgcttttccattctgggtgt

SEQ ID NO: 4300096 - DNA, 17 bp, Homo sapiens
tctggagaccaggactc

SEQ ID NO: 4300097 - DNA, 23 bp, Homo sapiens
tctggagaccaggactctgcctt

SEQ ID NO: 4300098 - DNA, 13 bp, Homo sapiens
tctggattcaaat

SEQ ID NO: 4300099 - DNA, 13 bp, Homo sapiens
tctggcagcctca

SEQ ID NO: 4300100 - DNA, 16 bp, Homo sapiens
tctggcagcctcagag

SEQ ID NO: 4300101 - DNA, 19 bp, Homo sapiens
tctggcagcctcagaggcc

SEQ ID NO: 4300102 - DNA, 20 bp, Homo sapiens
tctggcaggtggccagggct

SEQ ID NO: 4300103 - DNA, 18 bp, Homo sapiens
tcctggacccagcagggg

SEQ ID NO: 4300104 - DNA, 15 bp, Homo sapiens
tcctggctcacagcc

SEQ ID NO: 4300105 - DNA, 18 bp, Homo sapiens
tcctggctcacagccacc

SEQ ID NO: 4300106 - DNA, 19 bp, Homo sapiens
tcctggctcacagccacca

SEQ ID NO: 4300107 - DNA, 15 bp, Homo sapiens
tcctggctcccaggg

SEQ ID NO: 4300108 - DNA, 20 bp, Homo sapiens
tcctgggagtgggagtcaag

SEQ ID NO: 4300109 - DNA, 15 bp, Homo sapiens
tcctgggcagcccag

SEQ ID NO: 4300110 - DNA, 16 bp, Homo sapiens
tcctgggcatccccag

SEQ ID NO: 4300111 - DNA, 17 bp, Homo sapiens
tcctgggcatccccagc

SEQ ID NO: 4300112 - DNA, 18 bp, Homo sapiens
tcctgggcatctggccct

SEQ ID NO: 4300113 - DNA, 19 bp, Homo sapiens
tcctgggcatctggccctg

SEQ ID NO: 4300114 - DNA, 17 bp, Homo sapiens
tcctgggcatgtcccca

SEQ ID NO: 4300115 - DNA, 20 bp, Homo sapiens
tcctgggcatgtccccagtg

SEQ ID NO: 4300116 - DNA, 14 bp, Homo sapiens
tcctgggccagggt

SEQ ID NO: 4300117 - DNA, 16 bp, Homo sapiens
tcctgggccagggtct

SEQ ID NO: 4300118 - DNA, 23 bp, Homo sapiens
tcctgggccagggtctcgtcagg

SEQ ID NO: 4300119 - DNA, 18 bp, Homo sapiens
tcctgggccccctgggag

SEQ ID NO: 4300120 - DNA, 20 bp, Homo sapiens
tcctgggggctgctgcactg

SEQ ID NO: 4300121 - DNA, 22 bp, Homo sapiens
tcctgggggctgctgcactgcc

SEQ ID NO: 4300122 - DNA, 22 bp, Homo sapiens
tcctggggtggttggaggcctg

SEQ ID NO: 4300123 - DNA, 16 bp, Homo sapiens
tcctgtaattttgtag

SEQ ID NO: 4300124 - DNA, 14 bp, Homo sapiens
tcctgtcaatgttt

SEQ ID NO: 4300125 - DNA, 14 bp, Homo sapiens
tcctgtgagctccc

SEQ ID NO: 4300126 - DNA, 18 bp, Homo sapiens
tcctgtggcggtgcagtg

SEQ ID NO: 4300127 - DNA, 22 bp, Homo sapiens
tcctgtgtaatcatttcttggg

SEQ ID NO: 4300128 - DNA, 12 bp, Homo sapiens
tcctgttctcag

SEQ ID NO: 4300129 - DNA, 23 bp, Homo sapiens
tccttaaacagggcatctccagg

SEQ ID NO: 4300130 - DNA, 13 bp, Homo sapiens
tccttagaaaaga

SEQ ID NO: 4300131 - DNA, 15 bp, Homo sapiens
tccttcatttcctcc

SEQ ID NO: 4300132 - DNA, 16 bp, Homo sapiens
tccttccgctctgagg

SEQ ID NO: 4300133 - DNA, 18 bp, Homo sapiens
tccttcctgttctgtgtc

SEQ ID NO: 4300134 - DNA, 13 bp, Homo sapiens
tccttctcccctc

SEQ ID NO: 4300135 - DNA, 19 bp, Homo sapiens
tccttgaggacctccacct

SEQ ID NO: 4300136 - DNA, 21 bp, Homo sapiens
tccttgaggacctccacctgg

SEQ ID NO: 4300137 - DNA, 16 bp, Homo sapiens
tccttgcctcctgtgt

SEQ ID NO: 4300138 - DNA, 14 bp, Homo sapiens
tccttggcccagca

SEQ ID NO: 4300139 - DNA, 16 bp, Homo sapiens
tccttggttatatttt

SEQ ID NO: 4300140 - DNA, 20 bp, Homo sapiens
tccttgtagacgcacctgct

SEQ ID NO: 4300141 - DNA, 16 bp, Homo sapiens
tcctttcacaaccttc

SEQ ID NO: 4300142 - DNA, 20 bp, Homo sapiens
tcctttcacaaccttctgtg

SEQ ID NO: 4300143 - DNA, 16 bp, Homo sapiens
tcctttcatcctcagc

SEQ ID NO: 4300144 - DNA, 17 bp, Homo sapiens
tcctttcatcctcagca

SEQ ID NO: 4300145 - DNA, 20 bp, Homo sapiens
tcctttgaatcctctctctg

SEQ ID NO: 4300146 - DNA, 21 bp, Homo sapiens
tcctttgaatcctctctctgt

SEQ ID NO: 4300147 - DNA, 15 bp, Homo sapiens
tcgaagctcagccca

SEQ ID NO: 4300148 - DNA, 16 bp, Homo sapiens
tcgaagctcagcccac

SEQ ID NO: 4300149 - DNA, 18 bp, Homo sapiens
tcgaagctcagcccaccc

SEQ ID NO: 4300150 - DNA, 17 bp, Homo sapiens
tcgaagctgttctctgc

SEQ ID NO: 4300151 - DNA, 17 bp, Homo sapiens
tcgactgtgacctgtgg

SEQ ID NO: 4300152 - DNA, 18 bp, Homo sapiens
tcgagacaggcagaatca

SEQ ID NO: 4300153 - DNA, 21 bp, Homo sapiens
tcgagtgatatggcttgtagg

SEQ ID NO: 4300154 - DNA, 15 bp, Homo sapiens
tcgccatgtgctgtg

SEQ ID NO: 4300155 - DNA, 16 bp, Homo sapiens
tcgccatgtgctgtgc

SEQ ID NO: 4300156 - DNA, 17 bp, Homo sapiens
tcgcccaaagccagaca

SEQ ID NO: 4300157 - DNA, 14 bp, Homo sapiens
tcgccttctggctg

SEQ ID NO: 4300158 - DNA, 16 bp, Homo sapiens
tcgctattcccaggca

SEQ ID NO: 4300159 - DNA, 17 bp, Homo sapiens
tcgcttagctgaaacct

SEQ ID NO: 4300160 - DNA, 16 bp, Homo sapiens
tcgcttcataggcaga

SEQ ID NO: 4300161 - DNA, 20 bp, Homo sapiens
tcgcttcataggcagagccc

SEQ ID NO: 4300162 - DNA, 20 bp, Homo sapiens
tcggagggaattgaggtctg

SEQ ID NO: 4300163 - DNA, 22 bp, Homo sapiens
tcggagggaattgaggtctgct

SEQ ID NO: 4300164 - DNA, 17 bp, Homo sapiens
tcggccccacccaccct

SEQ ID NO: 4300165 - DNA, 23 bp, Homo sapiens
tcgggaagaaggacttcctgcta

SEQ ID NO: 4300166 - DNA, 18 bp, Homo sapiens
tcgggctaagtccagctc

SEQ ID NO: 4300167 - DNA, 14 bp, Homo sapiens
tcggggcaggaagt

SEQ ID NO: 4300168 - DNA, 21 bp, Homo sapiens
tcggttcaagttgatgtgaca

SEQ ID NO: 4300169 - DNA, 14 bp, Homo sapiens
tcggttcaggagga

SEQ ID NO: 4300170 - DNA, 19 bp, Homo sapiens
tcggttgtaggactaaata

SEQ ID NO: 4300171 - DNA, 19 bp, Homo sapiens
tcggtttctaacttggagc

SEQ ID NO: 4300172 - DNA, 16 bp, Homo sapiens
tcgtctccctggccac

SEQ ID NO: 4300173 - DNA, 18 bp, Homo sapiens
tcgtctttgcttgtcctg

SEQ ID NO: 4300174 - DNA, 13 bp, Homo sapiens
tcgtgcatttgtg

SEQ ID NO: 4300175 - DNA, 17 bp, Homo sapiens
tcgtgcatttgtgagcc

SEQ ID NO: 4300176 - DNA, 16 bp, Homo sapiens
tcgtgtgcttagaaac

SEQ ID NO: 4300177 - DNA, 16 bp, Homo sapiens
tctaaaaggaggacag

SEQ ID NO: 4300178 - DNA, 22 bp, Homo sapiens
tctaaaattgagttcttcctgt

SEQ ID NO: 4300179 - DNA, 12 bp, Homo sapiens
tctaaactgttt

SEQ ID NO: 4300180 - DNA, 22 bp, Homo sapiens
tctaaagttagggcatttttct

SEQ ID NO: 4300181 - DNA, 13 bp, Homo sapiens
tctaaatgtttct

SEQ ID NO: 4300182 - DNA, 13 bp, Homo sapiens
tctaacacatttc

SEQ ID NO: 4300183 - DNA, 16 bp, Homo sapiens
tctaacacatttcgta

SEQ ID NO: 4300184 - DNA, 15 bp, Homo sapiens
tctaactgattcagg

SEQ ID NO: 4300185 - DNA, 17 bp, Homo sapiens
tctaactgtatatttgt

SEQ ID NO: 4300186 - DNA, 21 bp, Homo sapiens
tctaagaaatatctgtgaaat

SEQ ID NO: 4300187 - DNA, 19 bp, Homo sapiens
tctaagcttatttctaact

SEQ ID NO: 4300188 - DNA, 16 bp, Homo sapiens
tctaattctctaggaa

SEQ ID NO: 4300189 - DNA, 14 bp, Homo sapiens
tctacactgtgaac

SEQ ID NO: 4300190 - DNA, 14 bp, Homo sapiens
tctaccttcatttt

SEQ ID NO: 4300191 - DNA, 12 bp, Homo sapiens
tctactttcctg

SEQ ID NO: 4300192 - DNA, 17 bp, Homo sapiens
tctagaaggatgaacag

SEQ ID NO: 4300193 - DNA, 14 bp, Homo sapiens
tctagagagggaat

SEQ ID NO: 4300194 - DNA, 23 bp, Homo sapiens
tctagagagggaattctcttggc

SEQ ID NO: 4300195 - DNA, 16 bp, Homo sapiens
tctagaggcttccttc

SEQ ID NO: 4300196 - DNA, 17 bp, Homo sapiens
tctagattaccatgaag

SEQ ID NO: 4300197 - DNA, 16 bp, Homo sapiens
tctagcaaacagatgt

SEQ ID NO: 4300198 - DNA, 21 bp, Homo sapiens
tctagcaagaagattctaaaa

SEQ ID NO: 4300199 - DNA, 22 bp, Homo sapiens
tctagcaagaagattctaaaac

SEQ ID NO: 4300200 - DNA, 11 bp, Homo sapiens
tctagccaggc

SEQ ID NO: 4300201 - DNA, 23 bp, Homo sapiens
tctagctataacaactctatttt

SEQ ID NO: 4300202 - DNA, 19 bp, Homo sapiens
tctagctatgctgtatctg

SEQ ID NO: 4300203 - DNA, 17 bp, Homo sapiens
tctagtcaactgctgtt

SEQ ID NO: 4300204 - DNA, 22 bp, Homo sapiens
tctagtcaactgctgttttatg

SEQ ID NO: 4300205 - DNA, 16 bp, Homo sapiens
tctagtctctgatttg

SEQ ID NO: 4300206 - DNA, 17 bp, Homo sapiens
tctatactgtttgtaat

SEQ ID NO: 4300207 - DNA, 22 bp, Homo sapiens
tctatactgtttgtaatataca

SEQ ID NO: 4300208 - DNA, 21 bp, Homo sapiens
tctatatatacatgtatagtg

SEQ ID NO: 4300209 - DNA, 22 bp, Homo sapiens
tctatattattgcccatgatat

SEQ ID NO: 4300210 - DNA, 11 bp, Homo sapiens
tctatatttca

SEQ ID NO: 4300211 - DNA, 12 bp, Homo sapiens
tctatatttcat

SEQ ID NO: 4300212 - DNA, 21 bp, Homo sapiens
tctatatttcatattgagatc

SEQ ID NO: 4300213 - DNA, 20 bp, Homo sapiens
tctatctgcaaatagtttca

SEQ ID NO: 4300214 - DNA, 14 bp, Homo sapiens
tctatctggtatta

SEQ ID NO: 4300215 - DNA, 21 bp, Homo sapiens
tctatctggtattaaatgcca

SEQ ID NO: 4300216 - DNA, 14 bp, Homo sapiens
tctatgcctgtatt

SEQ ID NO: 4300217 - DNA, 15 bp, Homo sapiens
tctatgtagaactgt

SEQ ID NO: 4300218 - DNA, 17 bp, Homo sapiens
tctatgtagaactgttc

SEQ ID NO: 4300219 - DNA, 19 bp, Homo sapiens
tctatgtagaactgttcat

SEQ ID NO: 4300220 - DNA, 20 bp, Homo sapiens
tctatgtagaactgttcatt

SEQ ID NO: 4300221 - DNA, 15 bp, Homo sapiens
tctattgtccaaagt

SEQ ID NO: 4300222 - DNA, 23 bp, Homo sapiens
tctatttaattttgacactgaaa

SEQ ID NO: 4300223 - DNA, 19 bp, Homo sapiens
tctatttatctgtctgagc

SEQ ID NO: 4300224 - DNA, 14 bp, Homo sapiens
tctatttctatctg

SEQ ID NO: 4300225 - DNA, 16 bp, Homo sapiens
tctatttctatctgca

SEQ ID NO: 4300226 - DNA, 20 bp, Homo sapiens
tctcaaagtttttacagtgt

SEQ ID NO: 4300227 - DNA, 17 bp, Homo sapiens
tctcaagagggcactgg

SEQ ID NO: 4300228 - DNA, 14 bp, Homo sapiens
tctcacccagcctg

SEQ ID NO: 4300229 - DNA, 15 bp, Homo sapiens
tctcacccagcctgg

SEQ ID NO: 4300230 - DNA, 13 bp, Homo sapiens
tctcactcctacc

SEQ ID NO: 4300231 - DNA, 15 bp, Homo sapiens
tctcactctggcagc

SEQ ID NO: 4300232 - DNA, 18 bp, Homo sapiens
tctcactctggcagcctc

SEQ ID NO: 4300233 - DNA, 14 bp, Homo sapiens
tctcagcctccact

SEQ ID NO: 4300234 - DNA, 13 bp, Homo sapiens
tctcaggccacct

SEQ ID NO: 4300235 - DNA, 21 bp, Homo sapiens
tctcaggccacctgccccctt

SEQ ID NO: 4300236 - DNA, 18 bp, Homo sapiens
tctcatctcttcttttaa

SEQ ID NO: 4300237 - DNA, 20 bp, Homo sapiens
tggacttttgttcatgggag

SEQ ID NO: 4300238 - DNA, 14 bp, Homo sapiens
tggagactgtctca

SEQ ID NO: 4300239 - DNA, 23 bp, Homo sapiens
tggagaggagagaatgagagagt

SEQ ID NO: 4300240 - DNA, 20 bp, Homo sapiens
tggagaggaggtgtggagtg

SEQ ID NO: 4300241 - DNA, 13 bp, Homo sapiens
tggagagtagaca

SEQ ID NO: 4300242 - DNA, 18 bp, Homo sapiens
tggagatgggatgcttgc

SEQ ID NO: 4300243 - DNA, 20 bp, Homo sapiens
tggagattttgctaatacat

SEQ ID NO: 4300244 - DNA, 17 bp, Homo sapiens
tggagccacaggcagac

SEQ ID NO: 4300245 - DNA, 15 bp, Homo sapiens
tggagcccctatcct

SEQ ID NO: 4300246 - DNA, 16 bp, Homo sapiens
tggagcccgcaccccc

SEQ ID NO: 4300247 - DNA, 17 bp, Homo sapiens
tggagcccgcaccccca

SEQ ID NO: 4300248 - DNA, 22 bp, Homo sapiens
tggagctctaactgattcaggg

SEQ ID NO: 4300249 - DNA, 22 bp, Homo sapiens
tggaggaatgctcccccatcct

SEQ ID NO: 4300250 - DNA, 11 bp, Homo sapiens
tggaggcctct

SEQ ID NO: 4300251 - DNA, 21 bp, Homo sapiens
tggaggcctggtctggagccc

SEQ ID NO: 4300252 - DNA, 22 bp, Homo sapiens
tggaggcgagccagattaggcc

SEQ ID NO: 4300253 - DNA, 19 bp, Homo sapiens
tggaggctaagcctggaca

SEQ ID NO: 4300254 - DNA, 14 bp, Homo sapiens
tggaggctgggtgg

SEQ ID NO: 4300255 - DNA, 13 bp, Homo sapiens
tggagggagactg

SEQ ID NO: 4300256 - DNA, 23 bp, Homo sapiens
tggaggtcccagacatgctgccc

SEQ ID NO: 4300257 - DNA, 12 bp, Homo sapiens
tggaggtgatga

SEQ ID NO: 4300258 - DNA, 19 bp, Homo sapiens
tggagtattattattttaa

SEQ ID NO: 4300259 - DNA, 19 bp, Homo sapiens
tggagtccagacctgggcc

SEQ ID NO: 4300260 - DNA, 15 bp, Homo sapiens
tggagtcctgttctc

SEQ ID NO: 4300261 - DNA, 18 bp, Homo sapiens
tggagtcctgttctcaga

SEQ ID NO: 4300262 - DNA, 22 bp, Homo sapiens
tggagtcctgttctcagagctc

SEQ ID NO: 4300263 - DNA, 18 bp, Homo sapiens
tggagtctgaaggagagg

SEQ ID NO: 4300264 - DNA, 21 bp, Homo sapiens
tggagtctgaaggagaggagt

SEQ ID NO: 4300265 - DNA, 11 bp, Homo sapiens
tggagtggagg

SEQ ID NO: 4300266 - DNA, 13 bp, Homo sapiens
tggagtggagggg

SEQ ID NO: 4300267 - DNA, 13 bp, Homo sapiens
tggagtggggcag

SEQ ID NO: 4300268 - DNA, 19 bp, Homo sapiens
tggagtggtaacaagagga

SEQ ID NO: 4300269 - DNA, 19 bp, Homo sapiens
tggataggagcttccagat

SEQ ID NO: 4300270 - DNA, 14 bp, Homo sapiens
tggatcaagtatta

SEQ ID NO: 4300271 - DNA, 20 bp, Homo sapiens
tggatccatacaaaactatc

SEQ ID NO: 4300272 - DNA, 15 bp, Homo sapiens
tggatctgctccatg

SEQ ID NO: 4300273 - DNA, 23 bp, Homo sapiens
tggatgctgggttctggggctga

SEQ ID NO: 4300274 - DNA, 21 bp, Homo sapiens
tggattctatatttcatattg

SEQ ID NO: 4300275 - DNA, 16 bp, Homo sapiens
tggcaaaggatccaga

SEQ ID NO: 4300276 - DNA, 18 bp, Homo sapiens
tggcacagggcagtggga

SEQ ID NO: 4300277 - DNA, 14 bp, Homo sapiens
tggcacttcgtgga

SEQ ID NO: 4300278 - DNA, 21 bp, Homo sapiens
tggcagaactgagctcctctg

SEQ ID NO: 4300279 - DNA, 18 bp, Homo sapiens
tggcagccgtgccttcag

SEQ ID NO: 4300280 - DNA, 23 bp, Homo sapiens
tggcagccgtgccttcagctcta

SEQ ID NO: 4300281 - DNA, 12 bp, Homo sapiens
tggcagcctcag

SEQ ID NO: 4300282 - DNA, 14 bp, Homo sapiens
tggcagcctcagag

SEQ ID NO: 4300283 - DNA, 14 bp, Homo sapiens
tggcagcttcaaaa

SEQ ID NO: 4300284 - DNA, 16 bp, Homo sapiens
tggcaggaaccatgga

SEQ ID NO: 4300285 - DNA, 23 bp, Homo sapiens
tggcaggaggacaggtggaggcg

SEQ ID NO: 4300286 - DNA, 19 bp, Homo sapiens
tggcagggcaggcagagct

SEQ ID NO: 4300287 - DNA, 17 bp, Homo sapiens
tggcaggtggccagggc

SEQ ID NO: 4300288 - DNA, 18 bp, Homo sapiens
tggcaggtggccagggct

SEQ ID NO: 4300289 - DNA, 18 bp, Homo sapiens
tggcaggtgtgggctccc

SEQ ID NO: 4300290 - DNA, 20 bp, Homo sapiens
tggcaggtgtgggctcccac

SEQ ID NO: 4300291 - DNA, 21 bp, Homo sapiens
tggcaggtgtgggctcccacg

SEQ ID NO: 4300292 - DNA, 15 bp, Homo sapiens
tggcatggctccagt

SEQ ID NO: 4300293 - DNA, 14 bp, Homo sapiens
tggccaagcctgcc

SEQ ID NO: 4300294 - DNA, 20 bp, Homo sapiens
tggccacccttggcctgtcc

SEQ ID NO: 4300295 - DNA, 17 bp, Homo sapiens
tggccactccagacccc

SEQ ID NO: 4300296 - DNA, 22 bp, Homo sapiens
tggccactccagacccctggct

SEQ ID NO: 4300297 - DNA, 12 bp, Homo sapiens
tggccactctgc

SEQ ID NO: 4300298 - DNA, 18 bp, Homo sapiens
tggccactttgcagacct

SEQ ID NO: 4300299 - DNA, 12 bp, Homo sapiens
tggccaggctgg

SEQ ID NO: 4300300 - DNA, 21 bp, Homo sapiens
tggcccaccagagcctccctc

SEQ ID NO: 4300301 - DNA, 12 bp, Homo sapiens
tggcccacccct

SEQ ID NO: 4300302 - DNA, 21 bp, Homo sapiens
tggcccacccctcttccccct

SEQ ID NO: 4300303 - DNA, 18 bp, Homo sapiens
tggcccagcagcggccca

SEQ ID NO: 4300304 - DNA, 20 bp, Homo sapiens
tggcccagcagcggcccaga

SEQ ID NO: 4300305 - DNA, 21 bp, Homo sapiens
tggcccagcagcggcccagat

SEQ ID NO: 4300306 - DNA, 10 bp, Homo sapiens
tggcccagcc

SEQ ID NO: 4300307 - DNA, 13 bp, Homo sapiens
tggcccagccagc

SEQ ID NO: 4300308 - DNA, 16 bp, Homo sapiens
tggcccagccagcagg

SEQ ID NO: 4300309 - DNA, 20 bp, Homo sapiens
tggcccagcctgtggcctca

SEQ ID NO: 4300310 - DNA, 22 bp, Homo sapiens
tggcccagcctgtggcctcagc

SEQ ID NO: 4300311 - DNA, 14 bp, Homo sapiens
tggccccaaatgtt

SEQ ID NO: 4300312 - DNA, 19 bp, Homo sapiens
tggcccccgagctgggggc

SEQ ID NO: 4300313 - DNA, 19 bp, Homo sapiens
tggcccctagaatcagcct

SEQ ID NO: 4300314 - DNA, 17 bp, Homo sapiens
tggcccctcccacatcc

SEQ ID NO: 4300315 - DNA, 19 bp, Homo sapiens
tggcccctcccacatcccc

SEQ ID NO: 4300316 - DNA, 20 bp, Homo sapiens
tggcccctccttctcccctc

SEQ ID NO: 4300317 - DNA, 10 bp, Homo sapiens
tggcccctct

SEQ ID NO: 4300318 - DNA, 14 bp, Homo sapiens
tggcccctctctgt

SEQ ID NO: 4300319 - DNA, 11 bp, Homo sapiens
tggccccttca

SEQ ID NO: 4300320 - DNA, 16 bp, Homo sapiens
tggccccttcacttct

SEQ ID NO: 4300321 - DNA, 14 bp, Homo sapiens
tggcccgacagcct

SEQ ID NO: 4300322 - DNA, 17 bp, Homo sapiens
tggcccgacagcctggc

SEQ ID NO: 4300323 - DNA, 16 bp, Homo sapiens
tggccctcctctggtc

SEQ ID NO: 4300324 - DNA, 21 bp, Homo sapiens
tggccctctcttaatgccacg

SEQ ID NO: 4300325 - DNA, 21 bp, Homo sapiens
tggccggccctgccccccaca

SEQ ID NO: 4300326 - DNA, 23 bp, Homo sapiens
tggccgttgcctctctgccagcc

SEQ ID NO: 4300327 - DNA, 18 bp, Homo sapiens
tggcctacaaatcagtaa

SEQ ID NO: 4300328 - DNA, 19 bp, Homo sapiens
tggcctacaaatcagtaat

SEQ ID NO: 4300329 - DNA, 15 bp, Homo sapiens
tggcctcaaccctcc

SEQ ID NO: 4300330 - DNA, 21 bp, Homo sapiens
tggcctcaaccctccctcagc

SEQ ID NO: 4300331 - DNA, 22 bp, Homo sapiens
tggcctcaaccctccctcagcc

SEQ ID NO: 4300332 - DNA, 12 bp, Homo sapiens
tggcctcagcat

SEQ ID NO: 4300333 - DNA, 16 bp, Homo sapiens
tggcctctggcctggg

SEQ ID NO: 4300334 - DNA, 22 bp, Homo sapiens
tggcctcttcctccctccctgc

SEQ ID NO: 4300335 - DNA, 16 bp, Homo sapiens
tggcctcttcgggaag

SEQ ID NO: 4300336 - DNA, 19 bp, Homo sapiens
tggcctgagaagagtcgag

SEQ ID NO: 4300337 - DNA, 17 bp, Homo sapiens
tggcgcagtgcctctgg

SEQ ID NO: 4300338 - DNA, 17 bp, Homo sapiens
tggcgggccaaggactg

SEQ ID NO: 4300339 - DNA, 17 bp, Homo sapiens
tggcgtctgtcttcaag

SEQ ID NO: 4300340 - DNA, 20 bp, Homo sapiens
tggcgtctgtcttcaagggc

SEQ ID NO: 4300341 - DNA, 22 bp, Homo sapiens
tggcgtctgtcttcaagggctt

SEQ ID NO: 4300342 - DNA, 23 bp, Homo sapiens
tggctaaggcatcattttcacct

SEQ ID NO: 4300343 - DNA, 22 bp, Homo sapiens
tggctactttggtttctgtctg

SEQ ID NO: 4300344 - DNA, 12 bp, Homo sapiens
tggctcacagcc

SEQ ID NO: 4300345 - DNA, 13 bp, Homo sapiens
tggctcacagcca

SEQ ID NO: 4300346 - DNA, 20 bp, Homo sapiens
tggctcccacaggcccttcc

SEQ ID NO: 4300347 - DNA, 14 bp, Homo sapiens
tggctcccagcaga

SEQ ID NO: 4300348 - DNA, 17 bp, Homo sapiens
tggctcccagggccatg

SEQ ID NO: 4300349 - DNA, 14 bp, Homo sapiens
tggctcccatctcc

SEQ ID NO: 4300350 - DNA, 14 bp, Homo sapiens
tggctcccctctat

SEQ ID NO: 4300351 - DNA, 15 bp, Homo sapiens
tggctccctgggctg

SEQ ID NO: 4300352 - DNA, 21 bp, Homo sapiens
tggctccctgggctggcatgg

SEQ ID NO: 4300353 - DNA, 14 bp, Homo sapiens
tggctcctcaccac

SEQ ID NO: 4300354 - DNA, 14 bp, Homo sapiens
tggctcctccagca

SEQ ID NO: 4300355 - DNA, 20 bp, Homo sapiens
tggctctgaatgtagccagc

SEQ ID NO: 4300356 - DNA, 13 bp, Homo sapiens
tggctctgcagca

SEQ ID NO: 4300357 - DNA, 13 bp, Homo sapiens
tggctggactgga

SEQ ID NO: 4300358 - DNA, 18 bp, Homo sapiens
tggctgtatttttagaga

SEQ ID NO: 4300359 - DNA, 17 bp, Homo sapiens
tggctgtgattaattat

SEQ ID NO: 4300360 - DNA, 23 bp, Homo sapiens
tggctgtggcccctccttctccc

SEQ ID NO: 4300361 - DNA, 13 bp, Homo sapiens
tggcttcagcccc

SEQ ID NO: 4300362 - DNA, 17 bp, Homo sapiens
tggcttcccatgtcttt

SEQ ID NO: 4300363 - DNA, 15 bp, Homo sapiens
tggcttcccgctcag

SEQ ID NO: 4300364 - DNA, 16 bp, Homo sapiens
tggcttcccgctcagc

SEQ ID NO: 4300365 - DNA, 17 bp, Homo sapiens
tggcttcccgctcagcc

SEQ ID NO: 4300366 - DNA, 20 bp, Homo sapiens
tggcttcccgctcagccctc

SEQ ID NO: 4300367 - DNA, 22 bp, Homo sapiens
tggcttcccgctcagccctccc

SEQ ID NO: 4300368 - DNA, 20 bp, Homo sapiens
tggcttgaagccaagtcagc

SEQ ID NO: 4300369 - DNA, 22 bp, Homo sapiens
tggcttgtagggtgaggcgtgg

SEQ ID NO: 4300370 - DNA, 12 bp, Homo sapiens
tggctttgtgct

SEQ ID NO: 4300371 - DNA, 21 bp, Homo sapiens
tgccttccacgctgtctccag

SEQ ID NO: 4300372 - DNA, 23 bp, Homo sapiens
tgccttccacgctgtctccagac

SEQ ID NO: 4300373 - DNA, 22 bp, Homo sapiens
tgccttccaggcgtagggccag

SEQ ID NO: 4300374 - DNA, 14 bp, Homo sapiens
tgccttctgtctct

SEQ ID NO: 4300375 - DNA, 17 bp, Homo sapiens
tgccttctgtctcttgc

SEQ ID NO: 4300376 - DNA, 21 bp, Homo sapiens
tgccttgtgtatgtgactcca

SEQ ID NO: 4300377 - DNA, 21 bp, Homo sapiens
tgcctttagcgtgtaaatgga

SEQ ID NO: 4300378 - DNA, 17 bp, Homo sapiens
tgcctttaggcaggaag

SEQ ID NO: 4300379 - DNA, 18 bp, Homo sapiens
tgcctttaggcaggaagt

SEQ ID NO: 4300380 - DNA, 12 bp, Homo sapiens
tgcctttgctgc

SEQ ID NO: 4300381 - DNA, 13 bp, Homo sapiens
tgcctttgctgcc

SEQ ID NO: 4300382 - DNA, 14 bp, Homo sapiens
tgcctttgctgcct

SEQ ID NO: 4300383 - DNA, 12 bp, Homo sapiens
tgcctttgtaac

SEQ ID NO: 4300384 - DNA, 16 bp, Homo sapiens
tgccttttagttcctg

SEQ ID NO: 4300385 - DNA, 17 bp, Homo sapiens
tgcgccctccctccctc

SEQ ID NO: 4300386 - DNA, 21 bp, Homo sapiens
tgcgccctccctccctccaca

SEQ ID NO: 4300387 - DNA, 19 bp, Homo sapiens
tgcgccctgacatgctaac

SEQ ID NO: 4300388 - DNA, 18 bp, Homo sapiens
tgcgctcttcaccaggaa

SEQ ID NO: 4300389 - DNA, 17 bp, Homo sapiens
tgcgctgacaaccaccg

SEQ ID NO: 4300390 - DNA, 15 bp, Homo sapiens
tgcgctgccctgcaa

SEQ ID NO: 4300391 - DNA, 14 bp, Homo sapiens
tgcgctgtgctggt

SEQ ID NO: 4300392 - DNA, 22 bp, Homo sapiens
tgcgctgtgctggtctctaggc

SEQ ID NO: 4300393 - DNA, 16 bp, Homo sapiens
tgcggagcttctccag

SEQ ID NO: 4300394 - DNA, 16 bp, Homo sapiens
tgcgtatgcagtgtag

SEQ ID NO: 4300395 - DNA, 21 bp, Homo sapiens
tgcgttcctaaactctgaaat

SEQ ID NO: 4300396 - DNA, 18 bp, Homo sapiens
tgctaatgtaatcattta

SEQ ID NO: 4300397 - DNA, 22 bp, Homo sapiens
tgctaatgtaatcatttatctt

SEQ ID NO: 4300398 - DNA, 15 bp, Homo sapiens
tgctaattaaaaagt

SEQ ID NO: 4300399 - DNA, 14 bp, Homo sapiens
tgctacctctgatc

SEQ ID NO: 4300400 - DNA, 18 bp, Homo sapiens
tgctacctggttttcatt

SEQ ID NO: 4300401 - DNA, 22 bp, Homo sapiens
tgctacctggttttcattattt

SEQ ID NO: 4300402 - DNA, 13 bp, Homo sapiens
tgctactcagtat

SEQ ID NO: 4300403 - DNA, 20 bp, Homo sapiens
tgctaggtgggccagcccct

SEQ ID NO: 4300404 - DNA, 16 bp, Homo sapiens
tgctatccagccgcaa

SEQ ID NO: 4300405 - DNA, 14 bp, Homo sapiens
tgctatgtctgtga

SEQ ID NO: 4300406 - DNA, 13 bp, Homo sapiens
tgctattaatatt

SEQ ID NO: 4300407 - DNA, 14 bp, Homo sapiens
tgctcacccaggac

SEQ ID NO: 4300408 - DNA, 16 bp, Homo sapiens
tgctcacccaggacct

SEQ ID NO: 4300409 - DNA, 14 bp, Homo sapiens
tgctcaggcctcac

SEQ ID NO: 4300410 - DNA, 19 bp, Homo sapiens
tgctcaggcctcacctggc

SEQ ID NO: 4300411 - DNA, 20 bp, Homo sapiens
tgctcagttccaatgtgccc

SEQ ID NO: 4300412 - DNA, 15 bp, Homo sapiens
tgctccagccaaccc

SEQ ID NO: 4300413 - DNA, 20 bp, Homo sapiens
tgctccagccaacccctgtg

SEQ ID NO: 4300414 - DNA, 23 bp, Homo sapiens
tgctccagccaacccctgtggag

SEQ ID NO: 4300415 - DNA, 16 bp, Homo sapiens
tgctccaggcttcctg

SEQ ID NO: 4300416 - DNA, 20 bp, Homo sapiens
tgctccagtgttttcttgtg

SEQ ID NO: 4300417 - DNA, 13 bp, Homo sapiens
tgctcccccatcc

SEQ ID NO: 4300418 - DNA, 18 bp, Homo sapiens
tgctcccccatcctcccc

SEQ ID NO: 4300419 - DNA, 20 bp, Homo sapiens
tgctcccccatcctcccctt

SEQ ID NO: 4300420 - DNA, 23 bp, Homo sapiens
tgctcccccatcctccccttccc

SEQ ID NO: 4300421 - DNA, 14 bp, Homo sapiens
tgctccctgctccc

SEQ ID NO: 4300422 - DNA, 12 bp, Homo sapiens
tgctcctaccta

SEQ ID NO: 4300423 - DNA, 13 bp, Homo sapiens
tgctcctcggcca

SEQ ID NO: 4300424 - DNA, 16 bp, Homo sapiens
tgctcctcggccagag

SEQ ID NO: 4300425 - DNA, 19 bp, Homo sapiens
tgctcctcggccagagctc

SEQ ID NO: 4300426 - DNA, 14 bp, Homo sapiens
tgctcctctgcctg

SEQ ID NO: 4300427 - DNA, 16 bp, Homo sapiens
tgctcctctgcctgtg

SEQ ID NO: 4300428 - DNA, 17 bp, Homo sapiens
tgctcctctgcctgtgc

SEQ ID NO: 4300429 - DNA, 23 bp, Homo sapiens
tgctcctgtggcggtgcagtggc

SEQ ID NO: 4300430 - DNA, 18 bp, Homo sapiens
tgctctgttttgcatgga

SEQ ID NO: 4300431 - DNA, 13 bp, Homo sapiens
tgctcttctctta

SEQ ID NO: 4300432 - DNA, 21 bp, Homo sapiens
tgctgactgtactcctcccag

SEQ ID NO: 4300433 - DNA, 18 bp, Homo sapiens
tgctgaggagctcagggc

SEQ ID NO: 4300434 - DNA, 16 bp, Homo sapiens
tgctgaggtgggcctt

SEQ ID NO: 4300435 - DNA, 19 bp, Homo sapiens
tgctgagtctgtgaataaa

SEQ ID NO: 4300436 - DNA, 14 bp, Homo sapiens
tgctgcaatacatt

SEQ ID NO: 4300437 - DNA, 18 bp, Homo sapiens
tgctgcacccctggtgtc

SEQ ID NO: 4300438 - DNA, 17 bp, Homo sapiens
tgctgcactgccctccg

SEQ ID NO: 4300439 - DNA, 19 bp, Homo sapiens
tgctgccacacttcaggct

SEQ ID NO: 4300440 - DNA, 16 bp, Homo sapiens
tgctgccaggctccca

SEQ ID NO: 4300441 - DNA, 10 bp, Homo sapiens
tgctgcccac

SEQ ID NO: 4300442 - DNA, 17 bp, Homo sapiens
tgctgcccaccccctgc

SEQ ID NO: 4300443 - DNA, 18 bp, Homo sapiens
tgctgcccaccccctgct

SEQ ID NO: 4300444 - DNA, 22 bp, Homo sapiens
tgctgcccaccccctgctggtg

SEQ ID NO: 4300445 - DNA, 24 bp, Homo sapiens
tgctgcccaccccctgctggtgcc

SEQ ID NO: 4300446 - DNA, 13 bp, Homo sapiens
tgctgcctcagga

SEQ ID NO: 4300447 - DNA, 15 bp, Homo sapiens
tgctgcctcaggaat

SEQ ID NO: 4300448 - DNA, 12 bp, Homo sapiens
tgctgcctcccc

SEQ ID NO: 4300449 - DNA, 14 bp, Homo sapiens
tgctgcctctgaaa

SEQ ID NO: 4300450 - DNA, 20 bp, Homo sapiens
tgctgctcctcggccagagc

SEQ ID NO: 4300451 - DNA, 13 bp, Homo sapiens
tgctgctggctcc

SEQ ID NO: 4300452 - DNA, 13 bp, Homo sapiens
tgctgctgtggca

SEQ ID NO: 4300453 - DNA, 22 bp, Homo sapiens
tgctggcccctcacctgggcac

SEQ ID NO: 4300454 - DNA, 18 bp, Homo sapiens
tgctggctcccagggcca

SEQ ID NO: 4300455 - DNA, 17 bp, Homo sapiens
tgctggctcccatctcc

SEQ ID NO: 4300456 - DNA, 16 bp, Homo sapiens
tgctgggtccttaaaa

SEQ ID NO: 4300457 - DNA, 23 bp, Homo sapiens
tgctgggttctggggctgagagt

SEQ ID NO: 4300458 - DNA, 19 bp, Homo sapiens
tgctggtctctaggcctga

SEQ ID NO: 4300459 - DNA, 18 bp, Homo sapiens
tgctgtacctttctgaca

SEQ ID NO: 4300460 - DNA, 21 bp, Homo sapiens
tgctgtggattttgtggcttc

SEQ ID NO: 4300461 - DNA, 16 bp, Homo sapiens
tgctgtttatatatat

SEQ ID NO: 4300462 - DNA, 17 bp, Homo sapiens
tgctgttttatgtcata

SEQ ID NO: 4300463 - DNA, 21 bp, Homo sapiens
tgcttagtatctcatcaacaa

SEQ ID NO: 4300464 - DNA, 23 bp, Homo sapiens
tgcttataagcaacatgaattaa

SEQ ID NO: 4300465 - DNA, 13 bp, Homo sapiens
tgcttatttatat

SEQ ID NO: 4300466 - DNA, 20 bp, Homo sapiens
tgcttatttatattcagaga

SEQ ID NO: 4300467 - DNA, 20 bp, Homo sapiens
tgcttccctctgcctgtccc

SEQ ID NO: 4300468 - DNA, 21 bp, Homo sapiens
tgcttccctctgcctgtccct

SEQ ID NO: 4300469 - DNA, 13 bp, Homo sapiens
tgcttctggggga

SEQ ID NO: 4300470 - DNA, 20 bp, Homo sapiens
tgcttgaagattcaggcttg

SEQ ID NO: 4300471 - DNA, 14 bp, Homo sapiens
tgcttgcctagggc

SEQ ID NO: 4300472 - DNA, 22 bp, Homo sapiens
tgcttgcctagggcctggtcca

SEQ ID NO: 4300473 - DNA, 15 bp, Homo sapiens
tgcttgtcctgctca

SEQ ID NO: 4300474 - DNA, 18 bp, Homo sapiens
tgcttgtgttgggcccca

SEQ ID NO: 4300475 - DNA, 14 bp, Homo sapiens
tgcttgttcttcct

SEQ ID NO: 4300476 - DNA, 16 bp, Homo sapiens
tgctttccaacacaca

SEQ ID NO: 4300477 - DNA, 17 bp, Homo sapiens
tgctttgcccacatgcc

SEQ ID NO: 4300478 - DNA, 18 bp, Homo sapiens
tgctttgggctgccctgg

SEQ ID NO: 4300479 - DNA, 21 bp, Homo sapiens
tgctttgggctgccctggtgc

SEQ ID NO: 4300480 - DNA, 17 bp, Homo sapiens
tgctttgtgtgattgaa

SEQ ID NO: 4300481 - DNA, 14 bp, Homo sapiens
tgcttttccatcta

SEQ ID NO: 4300482 - DNA, 15 bp, Homo sapiens
tggaaaaaatatttt

SEQ ID NO: 4300483 - DNA, 13 bp, Homo sapiens
tggaaaaatgcca

SEQ ID NO: 4300484 - DNA, 13 bp, Homo sapiens
tggaacaggagga

SEQ ID NO: 4300485 - DNA, 14 bp, Homo sapiens
tggaacaggaggaa

SEQ ID NO: 4300486 - DNA, 14 bp, Homo sapiens
tggaactgctgcca

SEQ ID NO: 4300487 - DNA, 23 bp, Homo sapiens
tggaagagagaaagcatattgac

SEQ ID NO: 4300488 - DNA, 20 bp, Homo sapiens
tggaagcctccacctgcagc

SEQ ID NO: 4300489 - DNA, 22 bp, Homo sapiens
tggaatgactataaacattaaa

SEQ ID NO: 4300490 - DNA, 14 bp, Homo sapiens
tggaattatgtata

SEQ ID NO: 4300491 - DNA, 16 bp, Homo sapiens
tggaattatgtataac

SEQ ID NO: 4300492 - DNA, 14 bp, Homo sapiens
tggacagggccagg

SEQ ID NO: 4300493 - DNA, 15 bp, Homo sapiens
tggacagggccaggg

SEQ ID NO: 4300494 - DNA, 16 bp, Homo sapiens
tggacagggccagggt

SEQ ID NO: 4300495 - DNA, 23 bp, Homo sapiens
tggacccagcaggggcagaagga

SEQ ID NO: 4300496 - DNA, 19 bp, Homo sapiens
tggacctgcagttggcctc

SEQ ID NO: 4300497 - DNA, 19 bp, Homo sapiens
tggacggggacacggcctc

SEQ ID NO: 4300498 - DNA, 21 bp, Homo sapiens
tggacggggacacggcctctg

SEQ ID NO: 4300499 - DNA, 16 bp, Homo sapiens
tggacgtgggctccag

SEQ ID NO: 4300500 - DNA, 16 bp, Homo sapiens
tggactctggactggg

SEQ ID NO: 4300501 - DNA, 17 bp, Homo sapiens
tggactctgtggggcca

SEQ ID NO: 4300502 - DNA, 21 bp, Homo sapiens
tggactggaggctgggtggcc

SEQ ID NO: 4300503 - DNA, 22 bp, Homo sapiens
tggactgggaagggggcaggcc

SEQ ID NO: 4300504 - DNA, 13 bp, Homo sapiens
tggactgtggcct

SEQ ID NO: 4300505 - DNA, 19 bp, Homo sapiens
tgaggcctcagtggacttt

SEQ ID NO: 4300506 - DNA, 20 bp, Homo sapiens
tgaggcgtgggatccagaga

SEQ ID NO: 4300507 - DNA, 22 bp, Homo sapiens
tgaggcgtgggatccagagaga

SEQ ID NO: 4300508 - DNA, 13 bp, Homo sapiens
tgaggctggggct

SEQ ID NO: 4300509 - DNA, 17 bp, Homo sapiens
tgagggcgaggggaggg

SEQ ID NO: 4300510 - DNA, 21 bp, Homo sapiens
tgaggggaggaaactcacctg

SEQ ID NO: 4300511 - DNA, 12 bp, Homo sapiens
tgaggggcaggg

SEQ ID NO: 4300512 - DNA, 20 bp, Homo sapiens
tgaggggcctgccactctcc

SEQ ID NO: 4300513 - DNA, 18 bp, Homo sapiens
tgaggggcttccctctgc

SEQ ID NO: 4300514 - DNA, 22 bp, Homo sapiens
tgaggggcttccctctgctcca

SEQ ID NO: 4300515 - DNA, 23 bp, Homo sapiens
tgaggtcatcccggggccatgga

SEQ ID NO: 4300516 - DNA, 16 bp, Homo sapiens
tgaggtctgctcggcc

SEQ ID NO: 4300517 - DNA, 18 bp, Homo sapiens
tgaggttaaggggatcta

SEQ ID NO: 4300518 - DNA, 19 bp, Homo sapiens
tgagtcccagtgggaggcg

SEQ ID NO: 4300519 - DNA, 21 bp, Homo sapiens
tgagtctgtgaataaagccac

SEQ ID NO: 4300520 - DNA, 12 bp, Homo sapiens
tgagtgggcccc

SEQ ID NO: 4300521 - DNA, 15 bp, Homo sapiens
tgagtgggccccctc

SEQ ID NO: 4300522 - DNA, 16 bp, Homo sapiens
tgagtgggccccctct

SEQ ID NO: 4300523 - DNA, 18 bp, Homo sapiens
tgagtgtgcaatatgtaa

SEQ ID NO: 4300524 - DNA, 17 bp, Homo sapiens
tgagttcttcctgtaat

SEQ ID NO: 4300525 - DNA, 22 bp, Homo sapiens
tgagttgaggggcttccctctg

SEQ ID NO: 4300526 - DNA, 20 bp, Homo sapiens
tgagtttaaaaaaataacat

SEQ ID NO: 4300527 - DNA, 21 bp, Homo sapiens
tgagtttaaaaaaataacatc

SEQ ID NO: 4300528 - DNA, 17 bp, Homo sapiens
tgagttttatccaagac

SEQ ID NO: 4300529 - DNA, 17 bp, Homo sapiens
tgagttttttctcttgg

SEQ ID NO: 4300530 - DNA, 19 bp, Homo sapiens
tgagttttttctcttgggc

SEQ ID NO: 4300531 - DNA, 14 bp, Homo sapiens
tgataagtggaaaa

SEQ ID NO: 4300532 - DNA, 20 bp, Homo sapiens
tgataagtggaaaaaagaga

SEQ ID NO: 4300533 - DNA, 16 bp, Homo sapiens
tgatacactgtatcta

SEQ ID NO: 4300534 - DNA, 20 bp, Homo sapiens
tgatactgtctaagaataat

SEQ ID NO: 4300535 - DNA, 22 bp, Homo sapiens
tgatattctaagaaatatctgt

SEQ ID NO: 4300536 - DNA, 16 bp, Homo sapiens
tgatattgctgaagaa

SEQ ID NO: 4300537 - DNA, 17 bp, Homo sapiens
tgatattggtgtgaatg

SEQ ID NO: 4300538 - DNA, 18 bp, Homo sapiens
tgatcgatgttaaacgtc

SEQ ID NO: 4300539 - DNA, 16 bp, Homo sapiens
tgatgaataaacactt

SEQ ID NO: 4300540 - DNA, 19 bp, Homo sapiens
tgatgaccaatctctgtga

SEQ ID NO: 4300541 - DNA, 11 bp, Homo sapiens
tgatgggagta

SEQ ID NO: 4300542 - DNA, 14 bp, Homo sapiens
tgatggtggggcca

SEQ ID NO: 4300543 - DNA, 14 bp, Homo sapiens
tgatggttcccctg

SEQ ID NO: 4300544 - DNA, 22 bp, Homo sapiens
tgatgtcttgagagcgctggcc

SEQ ID NO: 4300545 - DNA, 18 bp, Homo sapiens
tgatgtgctcatcagaaa

SEQ ID NO: 4300546 - DNA, 18 bp, Homo sapiens
tgattaaatttaatatac

SEQ ID NO: 4300547 - DNA, 19 bp, Homo sapiens
tgattaaatttaatatact

SEQ ID NO: 4300548 - DNA, 17 bp, Homo sapiens
tgattaactcagtcctg

SEQ ID NO: 4300549 - DNA, 14 bp, Homo sapiens
tgattattgaatgt

SEQ ID NO: 4300550 - DNA, 22 bp, Homo sapiens
tgattattgaatgttatatcat

SEQ ID NO: 4300551 - DNA, 15 bp, Homo sapiens
tgattccaagggccc

SEQ ID NO: 4300552 - DNA, 17 bp, Homo sapiens
tgattccccggagctgg

SEQ ID NO: 4300553 - DNA, 21 bp, Homo sapiens
tgattcgcccaaagccagaca

SEQ ID NO: 4300554 - DNA, 22 bp, Homo sapiens
tgattcgcccaaagccagacag

SEQ ID NO: 4300555 - DNA, 16 bp, Homo sapiens
tgattctaaaggggac

SEQ ID NO: 4300556 - DNA, 15 bp, Homo sapiens
tgattctcatgcact

SEQ ID NO: 4300557 - DNA, 11 bp, Homo sapiens
tgattctcctc

SEQ ID NO: 4300558 - DNA, 15 bp, Homo sapiens
tgattctcctctccc

SEQ ID NO: 4300559 - DNA, 22 bp, Homo sapiens
tgattgaaaatagtaaatgctt

SEQ ID NO: 4300560 - DNA, 18 bp, Homo sapiens
tgattggcagcttcaaaa

SEQ ID NO: 4300561 - DNA, 15 bp, Homo sapiens
tgattgtttaattgt

SEQ ID NO: 4300562 - DNA, 18 bp, Homo sapiens
tgatttattctggtgtct

SEQ ID NO: 4300563 - DNA, 15 bp, Homo sapiens
tgatttcaatgattg

SEQ ID NO: 4300564 - DNA, 17 bp, Homo sapiens
tgatttcaatgattgtt

SEQ ID NO: 4300565 - DNA, 13 bp, Homo sapiens
tgatttcagaaac

SEQ ID NO: 4300566 - DNA, 13 bp, Homo sapiens
tgatttcccctct

SEQ ID NO: 4300567 - DNA, 12 bp, Homo sapiens
tgatttgctatc

SEQ ID NO: 4300568 - DNA, 20 bp, Homo sapiens
tgatttgggctgaatgtatg

SEQ ID NO: 4300569 - DNA, 19 bp, Homo sapiens
tgattttagatttctttga

SEQ ID NO: 4300570 - DNA, 15 bp, Homo sapiens
tgattttagccttct

SEQ ID NO: 4300571 - DNA, 21 bp, Homo sapiens
tgattttggccactttgcaga

SEQ ID NO: 4300572 - DNA, 22 bp, Homo sapiens
tgatttttttttttttcctgtc

SEQ ID NO: 4300573 - DNA, 22 bp, Homo sapiens
tgcaaatacttccaaagagtca

SEQ ID NO: 4300574 - DNA, 19 bp, Homo sapiens
tgcaaatagtttcaaatga

SEQ ID NO: 4300575 - DNA, 15 bp, Homo sapiens
tgcaaatgcacattt

SEQ ID NO: 4300576 - DNA, 16 bp, Homo sapiens
tgcaaattattctagt

SEQ ID NO: 4300577 - DNA, 21 bp, Homo sapiens
tgcaaattattctagtcaact

SEQ ID NO: 4300578 - DNA, 15 bp, Homo sapiens
tgcaacacacagaca

SEQ ID NO: 4300579 - DNA, 12 bp, Homo sapiens
tgcaacactgga

SEQ ID NO: 4300580 - DNA, 15 bp, Homo sapiens
tgcaaccactgcaat

SEQ ID NO: 4300581 - DNA, 14 bp, Homo sapiens
tgcaactttagaaa

SEQ ID NO: 4300582 - DNA, 21 bp, Homo sapiens
tgcaactttagaaagaaattg

SEQ ID NO: 4300583 - DNA, 14 bp, Homo sapiens
tgcaagaagaatat

SEQ ID NO: 4300584 - DNA, 15 bp, Homo sapiens
tgcaagacacccagt

SEQ ID NO: 4300585 - DNA, 17 bp, Homo sapiens
tgcaagattctgtgggc

SEQ ID NO: 4300586 - DNA, 22 bp, Homo sapiens
tgcaagattctgtgggcagctg

SEQ ID NO: 4300587 - DNA, 12 bp, Homo sapiens
tgcaagggaatg

SEQ ID NO: 4300588 - DNA, 18 bp, Homo sapiens
tgcaagggaatgaatcca

SEQ ID NO: 4300589 - DNA, 19 bp, Homo sapiens
tgcaagtatgttttagcat

SEQ ID NO: 4300590 - DNA, 16 bp, Homo sapiens
tgcaataaactcagtc

SEQ ID NO: 4300591 - DNA, 22 bp, Homo sapiens
tgcaataaactcagtcaaatgt

SEQ ID NO: 4300592 - DNA, 21 bp, Homo sapiens
tgcaatatcttcgttagtaat

SEQ ID NO: 4300593 - DNA, 23 bp, Homo sapiens
tgcaatatgaggggactgcatgc

SEQ ID NO: 4300594 - DNA, 19 bp, Homo sapiens
tgcaatatgtaacatgtct

SEQ ID NO: 4300595 - DNA, 16 bp, Homo sapiens
tgcaatcttatgttga

SEQ ID NO: 4300596 - DNA, 12 bp, Homo sapiens
tgcaattcaact

SEQ ID NO: 4300597 - DNA, 23 bp, Homo sapiens
tgcacacacagtctgttcagagg

SEQ ID NO: 4300598 - DNA, 13 bp, Homo sapiens
tgcacacacctgc

SEQ ID NO: 4300599 - DNA, 18 bp, Homo sapiens
tgcacaccgtccctctcc

SEQ ID NO: 4300600 - DNA, 14 bp, Homo sapiens
tgcacagcatctca

SEQ ID NO: 4300601 - DNA, 18 bp, Homo sapiens
tgcacagtgcatctcagc

SEQ ID NO: 4300602 - DNA, 19 bp, Homo sapiens
tgcacagtgcatctcagcc

SEQ ID NO: 4300603 - DNA, 22 bp, Homo sapiens
tgcacagtttgcaatcttatgt

SEQ ID NO: 4300604 - DNA, 21 bp, Homo sapiens
tgcaccaacctcactgccctc

SEQ ID NO: 4300605 - DNA, 14 bp, Homo sapiens
tgcacccgtgccac

SEQ ID NO: 4300606 - DNA, 15 bp, Homo sapiens
tgcacccgtgccacg

SEQ ID NO: 4300607 - DNA, 18 bp, Homo sapiens
tgcacccgtgccacgcgc

SEQ ID NO: 4300608 - DNA, 13 bp, Homo sapiens
tgcacctgcaggg

SEQ ID NO: 4300609 - DNA, 13 bp, Homo sapiens
tgcacggggccag

SEQ ID NO: 4300610 - DNA, 15 bp, Homo sapiens
tgcacggggccagca

SEQ ID NO: 4300611 - DNA, 15 bp, Homo sapiens
tgcacgtgcacacac

SEQ ID NO: 4300612 - DNA, 18 bp, Homo sapiens
tgcacgtgcacacacctg

SEQ ID NO: 4300613 - DNA, 19 bp, Homo sapiens
tgcacgtgcacacacctgc

SEQ ID NO: 4300614 - DNA, 22 bp, Homo sapiens
tgcacgtgcacacacctgcaca

SEQ ID NO: 4300615 - DNA, 14 bp, Homo sapiens
tgcacttggcctct

SEQ ID NO: 4300616 - DNA, 16 bp, Homo sapiens
tgcacttggctgcata

SEQ ID NO: 4300617 - DNA, 13 bp, Homo sapiens
tgcagaaccagtc

SEQ ID NO: 4300618 - DNA, 21 bp, Homo sapiens
tgcagaaccagtccctctgag

SEQ ID NO: 4300619 - DNA, 17 bp, Homo sapiens
tgcagaagaaactcctg

SEQ ID NO: 4300620 - DNA, 21 bp, Homo sapiens
tgcagacacgccttcccctca

SEQ ID NO: 4300621 - DNA, 16 bp, Homo sapiens
tgcagaccaggaagga

SEQ ID NO: 4300622 - DNA, 18 bp, Homo sapiens
tgcagaccaggaaggaag

SEQ ID NO: 4300623 - DNA, 14 bp, Homo sapiens
tgcagaccctcaga

SEQ ID NO: 4300624 - DNA, 15 bp, Homo sapiens
tgcagactagctaat

SEQ ID NO: 4300625 - DNA, 21 bp, Homo sapiens
tgcagcagagagaaataaaac

SEQ ID NO: 4300626 - DNA, 13 bp, Homo sapiens
tgcagcagagcct

SEQ ID NO: 4300627 - DNA, 19 bp, Homo sapiens
tgcagccccctcctgaccc

SEQ ID NO: 4300628 - DNA, 19 bp, Homo sapiens
tgcagcccgtgtggcccct

SEQ ID NO: 4300629 - DNA, 23 bp, Homo sapiens
tgcagcccgtgtggccccttcac

SEQ ID NO: 4300630 - DNA, 23 bp, Homo sapiens
tgcagccggggagctgaggggca

SEQ ID NO: 4300631 - DNA, 13 bp, Homo sapiens
tgcagcgtctttt

SEQ ID NO: 4300632 - DNA, 14 bp, Homo sapiens
tgcagcttcaggtg

SEQ ID NO: 4300633 - DNA, 15 bp, Homo sapiens
tgcagcttcaggtga

SEQ ID NO: 4300634 - DNA, 13 bp, Homo sapiens
tgcaggcagcctg

SEQ ID NO: 4300635 - DNA, 14 bp, Homo sapiens
tgcaggcagcctgc

SEQ ID NO: 4300636 - DNA, 22 bp, Homo sapiens
tgcaggctggcaccgccttctc

SEQ ID NO: 4300637 - DNA, 16 bp, Homo sapiens
tgcagggagcagcacg

SEQ ID NO: 4300638 - DNA, 19 bp, Homo sapiens
tgcagggcagcctgtggga

SEQ ID NO: 4300639 - DNA, 19 bp, Homo sapiens
tgcagtcacccctgtctgc

SEQ ID NO: 4300640 - DNA, 20 bp, Homo sapiens
tgcagtcacccctgtctgcg

SEQ ID NO: 4300641 - DNA, 18 bp, Homo sapiens
tgcagtgggttctccaaa

SEQ ID NO: 4300642 - DNA, 14 bp, Homo sapiens
tgcagtgtagattt

SEQ ID NO: 4300643 - DNA, 16 bp, Homo sapiens
tgcagttagcacagag

SEQ ID NO: 4300644 - DNA, 16 bp, Homo sapiens
tgcagttggcctcagc

SEQ ID NO: 4300645 - DNA, 18 bp, Homo sapiens
tgcatacttcctggattt

SEQ ID NO: 4300646 - DNA, 19 bp, Homo sapiens
tgcatcatcttgaacatta

SEQ ID NO: 4300647 - DNA, 20 bp, Homo sapiens
tgcatcccttggcccctctc

SEQ ID NO: 4300648 - DNA, 16 bp, Homo sapiens
tgcatcctcagcccca

SEQ ID NO: 4300649 - DNA, 21 bp, Homo sapiens
tgcatctagaggcttccttca

SEQ ID NO: 4300650 - DNA, 13 bp, Homo sapiens
tgcatctcagccc

SEQ ID NO: 4300651 - DNA, 15 bp, Homo sapiens
tgcatgatattgtat

SEQ ID NO: 4300652 - DNA, 21 bp, Homo sapiens
tgcatgatattgtatgtacct

SEQ ID NO: 4300653 - DNA, 14 bp, Homo sapiens
tgcatgcagggccc

SEQ ID NO: 4300654 - DNA, 14 bp, Homo sapiens
tgcatgctcctctg

SEQ ID NO: 4300655 - DNA, 18 bp, Homo sapiens
tgcatgctcctctgcctg

SEQ ID NO: 4300656 - DNA, 13 bp, Homo sapiens
tgcatggcctccc

SEQ ID NO: 4300657 - DNA, 16 bp, Homo sapiens
tgcatggcctcccagc

SEQ ID NO: 4300658 - DNA, 17 bp, Homo sapiens
tgcattactgcatgcac

SEQ ID NO: 4300659 - DNA, 17 bp, Homo sapiens
tgcattgtctgtctgca

SEQ ID NO: 4300660 - DNA, 14 bp, Homo sapiens
tgcattttaccatc

SEQ ID NO: 4300661 - DNA, 17 bp, Homo sapiens
tgccaaaaactaaaatt

SEQ ID NO: 4300662 - DNA, 19 bp, Homo sapiens
tgccaaaaactaaaattca

SEQ ID NO: 4300663 - DNA, 23 bp, Homo sapiens
tgccaaatcctgggcatccccag

SEQ ID NO: 4300664 - DNA, 14 bp, Homo sapiens
tgccaactttccag

SEQ ID NO: 4300665 - DNA, 23 bp, Homo sapiens
tgccacacttcaggctcttctcc

SEQ ID NO: 4300666 - DNA, 13 bp, Homo sapiens
tgccaccctctgc

SEQ ID NO: 4300667 - DNA, 19 bp, Homo sapiens
tgccaccctctgcagggca

SEQ ID NO: 4300668 - DNA, 13 bp, Homo sapiens
tgccacctgcagc

SEQ ID NO: 4300669 - DNA, 17 bp, Homo sapiens
tgccacgcgctctgcat

SEQ ID NO: 4300670 - DNA, 16 bp, Homo sapiens
tgccacggcagccacc

SEQ ID NO: 4300671 - DNA, 21 bp, Homo sapiens
tgccacggcagccaccctgcc

SEQ ID NO: 4300672 - DNA, 18 bp, Homo sapiens
tgccactaggccctggtc

SEQ ID NO: 4300673 - DNA, 19 bp, Homo sapiens
tgccactaggccctggtct

SEQ ID NO: 4300674 - DNA, 20 bp, Homo sapiens
tgccactaggccctggtctg

SEQ ID NO: 4300675 - DNA, 18 bp, Homo sapiens
tgccactcaggcagcctg

SEQ ID NO: 4300676 - DNA, 22 bp, Homo sapiens
tgccactctcctgaggagcagc

SEQ ID NO: 4300677 - DNA, 22 bp, Homo sapiens
tgccagccgctggtgcccacca

SEQ ID NO: 4300678 - DNA, 19 bp, Homo sapiens
tgccagctgcttctgccca

SEQ ID NO: 4300679 - DNA, 20 bp, Homo sapiens
tgccagctgcttctgcccac

SEQ ID NO: 4300680 - DNA, 19 bp, Homo sapiens
tgccaggaacccttaaaca

SEQ ID NO: 4300681 - DNA, 15 bp, Homo sapiens
tgccaggcagctgca

SEQ ID NO: 4300682 - DNA, 19 bp, Homo sapiens
tgccaggctcccactgccc

SEQ ID NO: 4300683 - DNA, 20 bp, Homo sapiens
tgccagtgactgctgcgctg

SEQ ID NO: 4300684 - DNA, 12 bp, Homo sapiens
tgccatggaggc

SEQ ID NO: 4300685 - DNA, 17 bp, Homo sapiens
tgccatggaggcgcctt

SEQ ID NO: 4300686 - DNA, 15 bp, Homo sapiens
tgccatggtgttgga

SEQ ID NO: 4300687 - DNA, 22 bp, Homo sapiens
tgccatgtcttgttcagaagac

SEQ ID NO: 4300688 - DNA, 14 bp, Homo sapiens
tgccattttgtctg

SEQ ID NO: 4300689 - DNA, 18 bp, Homo sapiens
tgccattttgtctggctg

SEQ ID NO: 4300690 - DNA, 13 bp, Homo sapiens
tgcccaccagctg

SEQ ID NO: 4300691 - DNA, 17 bp, Homo sapiens
tgcccaccagctggctc

SEQ ID NO: 4300692 - DNA, 20 bp, Homo sapiens
tgcccaccagctggctctgc

SEQ ID NO: 4300693 - DNA, 14 bp, Homo sapiens
tgcccaccccctgc

SEQ ID NO: 4300694 - DNA, 20 bp, Homo sapiens
tgcccaccccctgctggtgc

SEQ ID NO: 4300695 - DNA, 17 bp, Homo sapiens
tgcccaccccgcctctg

SEQ ID NO: 4300696 - DNA, 20 bp, Homo sapiens
tgccccacacaggcctggcc

SEQ ID NO: 4300697 - DNA, 16 bp, Homo sapiens
tgccccactctgctga

SEQ ID NO: 4300698 - DNA, 20 bp, Homo sapiens
tgccccactctgctgaggcc

SEQ ID NO: 4300699 - DNA, 12 bp, Homo sapiens
tgccccagagaa

SEQ ID NO: 4300700 - DNA, 15 bp, Homo sapiens
tgcccccagacccca

SEQ ID NO: 4300701 - DNA, 20 bp, Homo sapiens
tgccccccacattctggctc

SEQ ID NO: 4300702 - DNA, 21 bp, Homo sapiens
tgccccccacattctggctcc

SEQ ID NO: 4300703 - DNA, 15 bp, Homo sapiens
tgccccccaccccag

SEQ ID NO: 4300704 - DNA, 17 bp, Homo sapiens
tgccccccaccccagcc

SEQ ID NO: 4300705 - DNA, 18 bp, Homo sapiens
tgccccccatgccctccc

SEQ ID NO: 4300706 - DNA, 23 bp, Homo sapiens
tgcccccgctctgccatcagccc

SEQ ID NO: 4300707 - DNA, 22 bp, Homo sapiens
tgccccctggggggcacagcca

SEQ ID NO: 4300708 - DNA, 15 bp, Homo sapiens
tgcccccttctccca

SEQ ID NO: 4300709 - DNA, 20 bp, Homo sapiens
tgcccccttctcccacactg

SEQ ID NO: 4300710 - DNA, 17 bp, Homo sapiens
tgccccgccccccagag

SEQ ID NO: 4300711 - DNA, 23 bp, Homo sapiens
tgccccgccccccagagccaggg

SEQ ID NO: 4300712 - DNA, 18 bp, Homo sapiens
tgccccggccactctgtt

SEQ ID NO: 4300713 - DNA, 22 bp, Homo sapiens
tgccccgtccacggctctaggt

SEQ ID NO: 4300714 - DNA, 19 bp, Homo sapiens
tgcccctgcacctgcttct

SEQ ID NO: 4300715 - DNA, 20 bp, Homo sapiens
tgcccctgcacctgcttctc

SEQ ID NO: 4300716 - DNA, 13 bp, Homo sapiens
tgcccctgctgcc

SEQ ID NO: 4300717 - DNA, 23 bp, Homo sapiens
tgcccctgctgcctccccaaccc

SEQ ID NO: 4300718 - DNA, 18 bp, Homo sapiens
tgcccgctgcgctgccct

SEQ ID NO: 4300719 - DNA, 20 bp, Homo sapiens
tgcccgctgcgctgccctgc

SEQ ID NO: 4300720 - DNA, 20 bp, Homo sapiens
tgcccggggcagctgccaga

SEQ ID NO: 4300721 - DNA, 17 bp, Homo sapiens
tgcccgtgaggaggggg

SEQ ID NO: 4300722 - DNA, 23 bp, Homo sapiens
tgccctagcagtttgcctctgca

SEQ ID NO: 4300723 - DNA, 16 bp, Homo sapiens
tgccctcaggcttggg

SEQ ID NO: 4300724 - DNA, 13 bp, Homo sapiens
tgccctccatccc

SEQ ID NO: 4300725 - DNA, 20 bp, Homo sapiens
tgccctccctcggccccacc

SEQ ID NO: 4300726 - DNA, 15 bp, Homo sapiens
tgccctccctgctgc

SEQ ID NO: 4300727 - DNA, 20 bp, Homo sapiens
tgccctccctgctgccaggc

SEQ ID NO: 4300728 - DNA, 22 bp, Homo sapiens
tgccctccctgctgccaggctc

SEQ ID NO: 4300729 - DNA, 18 bp, Homo sapiens
tgccctccgtcctggcag

SEQ ID NO: 4300730 - DNA, 16 bp, Homo sapiens
tgccctggcccagcct

SEQ ID NO: 4300731 - DNA, 16 bp, Homo sapiens
tgccctggtgctgcca

SEQ ID NO: 4300732 - DNA, 18 bp, Homo sapiens
tgccctggtgctgccaca

SEQ ID NO: 4300733 - DNA, 21 bp, Homo sapiens
tgcccttaaaataatgattta

SEQ ID NO: 4300734 - DNA, 15 bp, Homo sapiens
tgccgaccgaggctg

SEQ ID NO: 4300735 - DNA, 23 bp, Homo sapiens
tgccgaccgaggctggagctggc

SEQ ID NO: 4300736 - DNA, 16 bp, Homo sapiens
tgccgagtgccccaga

SEQ ID NO: 4300737 - DNA, 13 bp, Homo sapiens
tgccgctgggaga

SEQ ID NO: 4300738 - DNA, 21 bp, Homo sapiens
tgccgtgcacggggccagcat

SEQ ID NO: 4300739 - DNA, 14 bp, Homo sapiens
tgcctaggagctgg

SEQ ID NO: 4300740 - DNA, 15 bp, Homo sapiens
tgcctaggccagctc

SEQ ID NO: 4300741 - DNA, 17 bp, Homo sapiens
tgcctataaaggaaaca

SEQ ID NO: 4300742 - DNA, 14 bp, Homo sapiens
tgcctcatgaacac

SEQ ID NO: 4300743 - DNA, 17 bp, Homo sapiens
tgcctccggccctgccc

SEQ ID NO: 4300744 - DNA, 20 bp, Homo sapiens
tgcctccggccctgccccac

SEQ ID NO: 4300745 - DNA, 21 bp, Homo sapiens
tgcctccggccctgccccaca

SEQ ID NO: 4300746 - DNA, 13 bp, Homo sapiens
tgcctcctcccat

SEQ ID NO: 4300747 - DNA, 17 bp, Homo sapiens
tgcctctgaactgctgc

SEQ ID NO: 4300748 - DNA, 16 bp, Homo sapiens
tgcctctgcacgtgca

SEQ ID NO: 4300749 - DNA, 14 bp, Homo sapiens
tgcctcttgggaga

SEQ ID NO: 4300750 - DNA, 16 bp, Homo sapiens
tgcctgagaatgccta

SEQ ID NO: 4300751 - DNA, 20 bp, Homo sapiens
tgcctgagaatgcctaggcc

SEQ ID NO: 4300752 - DNA, 17 bp, Homo sapiens
tgcctgagagcagaatg

SEQ ID NO: 4300753 - DNA, 14 bp, Homo sapiens
tgcctgcccacccg

SEQ ID NO: 4300754 - DNA, 15 bp, Homo sapiens
tgcctgcccacccgt

SEQ ID NO: 4300755 - DNA, 23 bp, Homo sapiens
tgcctgcctccggccctgcccca

SEQ ID NO: 4300756 - DNA, 18 bp, Homo sapiens
tgcctgctatccagccgc

SEQ ID NO: 4300757 - DNA, 19 bp, Homo sapiens
tgcctgctatccagccgca

SEQ ID NO: 4300758 - DNA, 12 bp, Homo sapiens
tgcctgggcctg

SEQ ID NO: 4300759 - DNA, 23 bp, Homo sapiens
tgcctggggtggaggctaagcct

SEQ ID NO: 4300760 - DNA, 14 bp, Homo sapiens
tgcctgtatttcca

SEQ ID NO: 4300761 - DNA, 14 bp, Homo sapiens
tgcctgtccctctc

SEQ ID NO: 4300762 - DNA, 17 bp, Homo sapiens
tgcctgtgaccggggtc

SEQ ID NO: 4300763 - DNA, 20 bp, Homo sapiens
tgcctgtgaccggggtcctg

SEQ ID NO: 4300764 - DNA, 13 bp, Homo sapiens
tgcctgtgcccgc

SEQ ID NO: 4300765 - DNA, 16 bp, Homo sapiens
tgcctgtgcccgctgc

SEQ ID NO: 4300766 - DNA, 14 bp, Homo sapiens
tgccttagaacctt

SEQ ID NO: 4300767 - DNA, 21 bp, Homo sapiens
tgccttagaacctttcttaca

SEQ ID NO: 4300768 - DNA, 17 bp, Homo sapiens
tgccttcagctctacag

SEQ ID NO: 4300769 - DNA, 16 bp, Homo sapiens
tgccttcataaattat

SEQ ID NO: 4300770 - DNA, 21 bp, Homo sapiens
tgccttcataaattatttcta

SEQ ID NO: 4300771 - DNA, 12 bp, Homo sapiens
tgccttcatttg

SEQ ID NO: 4300772 - DNA, 13 bp, Homo sapiens
aaaaaaaatgata

SEQ ID NO: 4300773 - DNA, 13 bp, Homo sapiens
aaaaaaacattct

SEQ ID NO: 4300774 - DNA, 12 bp, Homo sapiens
aaaaaaataata

SEQ ID NO: 4300775 - DNA, 21 bp, Homo sapiens
aaaaaataacatattcttgct

SEQ ID NO: 4300776 - DNA, 12 bp, Homo sapiens
aaaaaatgaata

SEQ ID NO: 4300777 - DNA, 14 bp, Homo sapiens
aaaaagtcagatgt

SEQ ID NO: 4300778 - DNA, 13 bp, Homo sapiens
aaaaatgatactt

SEQ ID NO: 4300779 - DNA, 18 bp, Homo sapiens
aaaaatgccatcaaatga

SEQ ID NO: 4300780 - DNA, 19 bp, Homo sapiens
aaaaattgaagagagatat

SEQ ID NO: 4300781 - DNA, 11 bp, Homo sapiens
aaaaatttcac

SEQ ID NO: 4300782 - DNA, 17 bp, Homo sapiens
aaaacacctaagtgact

SEQ ID NO: 4300783 - DNA, 17 bp, Homo sapiens
aaaacagtgtttccagt

SEQ ID NO: 4300784 - DNA, 14 bp, Homo sapiens
aaaacataatatct

SEQ ID NO: 4300785 - DNA, 12 bp, Homo sapiens
aaaacattctat

SEQ ID NO: 4300786 - DNA, 19 bp, Homo sapiens
aaaaccaagccgtggcttc

SEQ ID NO: 4300787 - DNA, 14 bp, Homo sapiens
aaaaccaatgattc

SEQ ID NO: 4300788 - DNA, 23 bp, Homo sapiens
aaaaccaatgattcataacaatg

SEQ ID NO: 4300789 - DNA, 19 bp, Homo sapiens
aaaaccacagccctgtcag

SEQ ID NO: 4300790 - DNA, 12 bp, Homo sapiens
aaaacccatcgt

SEQ ID NO: 4300791 - DNA, 15 bp, Homo sapiens
aaaacgatttaattt

SEQ ID NO: 4300792 - DNA, 15 bp, Homo sapiens
aaaacttttctgctg

SEQ ID NO: 4300793 - DNA, 14 bp, Homo sapiens
aaaagaagaaagtc

SEQ ID NO: 4300794 - DNA, 13 bp, Homo sapiens
aaaagaagactgg

SEQ ID NO: 4300795 - DNA, 14 bp, Homo sapiens
aaaagaagtagtgt

SEQ ID NO: 4300796 - DNA, 15 bp, Homo sapiens
aaaagactgaccttg

SEQ ID NO: 4300797 - DNA, 12 bp, Homo sapiens
aaaagagaaggc

SEQ ID NO: 4300798 - DNA, 17 bp, Homo sapiens
aaaagccaagtgtcctg

SEQ ID NO: 4300799 - DNA, 11 bp, Homo sapiens
aaaagccagat

SEQ ID NO: 4300800 - DNA, 19 bp, Homo sapiens
aaaagctatcttcatgtaa

SEQ ID NO: 4300801 - DNA, 21 bp, Homo sapiens
aaaagctttgaaccctgggac

SEQ ID NO: 4300802 - DNA, 13 bp, Homo sapiens
aaaaggtgaccct

SEQ ID NO: 4300803 - DNA, 14 bp, Homo sapiens
aaaaggttaagcca

SEQ ID NO: 4300804 - DNA, 15 bp, Homo sapiens
aaaagtcagatgttt

SEQ ID NO: 4300805 - DNA, 21 bp, Homo sapiens
aaaagtgggccagtgtgggaa

SEQ ID NO: 4300806 - DNA, 20 bp, Homo sapiens
aaaagtgtcaaggggcccta

SEQ ID NO: 4300807 - DNA, 14 bp, Homo sapiens
aaaagttgcacatt

SEQ ID NO: 4300808 - DNA, 19 bp, Homo sapiens
aaaataacatctgaaaaga

SEQ ID NO: 4300809 - DNA, 16 bp, Homo sapiens
aaaataactgtgcact

SEQ ID NO: 4300810 - DNA, 14 bp, Homo sapiens
aaaataatgattta

SEQ ID NO: 4300811 - DNA, 16 bp, Homo sapiens
aaaataatttagatat

SEQ ID NO: 4300812 - DNA, 12 bp, Homo sapiens
aaaatacttctt

SEQ ID NO: 4300813 - DNA, 15 bp, Homo sapiens
aaaatagttctattt

SEQ ID NO: 4300814 - DNA, 18 bp, Homo sapiens
aaaatagttctatttcta

SEQ ID NO: 4300815 - DNA, 23 bp, Homo sapiens
aaaatagttctatttctatctgc

SEQ ID NO: 4300816 - DNA, 18 bp, Homo sapiens
aaaatatataccccccca

SEQ ID NO: 4300817 - DNA, 18 bp, Homo sapiens
aaaatatgtgagcatgaa

SEQ ID NO: 4300818 - DNA, 21 bp, Homo sapiens
aaaatatgtgagcatgaaact

SEQ ID NO: 4300819 - DNA, 14 bp, Homo sapiens
aaaatattctccat

SEQ ID NO: 4300820 - DNA, 21 bp, Homo sapiens
aaaatattgagcagaattcat

SEQ ID NO: 4300821 - DNA, 19 bp, Homo sapiens
aaaatatttttttctagct

SEQ ID NO: 4300822 - DNA, 12 bp, Homo sapiens
aaaatcatcaaa

SEQ ID NO: 4300823 - DNA, 17 bp, Homo sapiens
aaaatcatgcttataag

SEQ ID NO: 4300824 - DNA, 22 bp, Homo sapiens
aaaatcatgcttataagcaaca

SEQ ID NO: 4300825 - DNA, 11 bp, Homo sapiens
aaaatctccta

SEQ ID NO: 4300826 - DNA, 13 bp, Homo sapiens
aaaatgcatgtga

SEQ ID NO: 4300827 - DNA, 15 bp, Homo sapiens
aaaatgcatgtgatt

SEQ ID NO: 4300828 - DNA, 17 bp, Homo sapiens
aaaatgccatcaaatga

SEQ ID NO: 4300829 - DNA, 13 bp, Homo sapiens
aaaattacagaag

SEQ ID NO: 4300830 - DNA, 14 bp, Homo sapiens
aaaattacagaaga

SEQ ID NO: 4300831 - DNA, 14 bp, Homo sapiens
aaaattagcatctg

SEQ ID NO: 4300832 - DNA, 12 bp, Homo sapiens
aaaattctagtc

SEQ ID NO: 4300833 - DNA, 23 bp, Homo sapiens
aaaattgagttcttcctgtaatc

SEQ ID NO: 4300834 - DNA, 17 bp, Homo sapiens
aaacaacactcagtcct

SEQ ID NO: 4300835 - DNA, 16 bp, Homo sapiens
aaacacacagactctg

SEQ ID NO: 4300836 - DNA, 11 bp, Homo sapiens
aaacacagctg

SEQ ID NO: 4300837 - DNA, 12 bp, Homo sapiens
aaacagtgtttc

SEQ ID NO: 4300838 - DNA, 21 bp, Homo sapiens
aaacagttgcacagcatctca

SEQ ID NO: 4300839 - DNA, 14 bp, Homo sapiens
aaacataatatctt

SEQ ID NO: 4300840 - DNA, 19 bp, Homo sapiens
aaacatgactctttattgt

SEQ ID NO: 4300841 - DNA, 12 bp, Homo sapiens
aaacatgccctc

SEQ ID NO: 4300842 - DNA, 21 bp, Homo sapiens
aaacattaaaagaagactgga

SEQ ID NO: 4300843 - DNA, 17 bp, Homo sapiens
aaaccataaaataaata

SEQ ID NO: 4300844 - DNA, 21 bp, Homo sapiens
aaaccttaatatttcttcaaa

SEQ ID NO: 4300845 - DNA, 23 bp, Homo sapiens
aaaccttaatatttcttcaaata

SEQ ID NO: 4300846 - DNA, 17 bp, Homo sapiens
aaacgtctaacttcatg

SEQ ID NO: 4300847 - DNA, 22 bp, Homo sapiens
aaactaaaattcaacaaatgat

SEQ ID NO: 4300848 - DNA, 20 bp, Homo sapiens
aaactactgattgaatgtta

SEQ ID NO: 4300849 - DNA, 21 bp, Homo sapiens
aaactactgattgaatgttaa

SEQ ID NO: 4300850 - DNA, 16 bp, Homo sapiens
aaactcacctgctggc

SEQ ID NO: 4300851 - DNA, 20 bp, Homo sapiens
aaactgaggccattatttca

SEQ ID NO: 4300852 - DNA, 22 bp, Homo sapiens
aaactgttaacttattcaaaga

SEQ ID NO: 4300853 - DNA, 15 bp, Homo sapiens
aaactgttttcatgt

SEQ ID NO: 4300854 - DNA, 13 bp, Homo sapiens
aaacttttctgct

SEQ ID NO: 4300855 - DNA, 15 bp, Homo sapiens
aaagaaaggcagaga

SEQ ID NO: 4300856 - DNA, 17 bp, Homo sapiens
aaagaacccccctcccc

SEQ ID NO: 4300857 - DNA, 22 bp, Homo sapiens
aaagaatcacctaattaatttc

SEQ ID NO: 4300858 - DNA, 13 bp, Homo sapiens
aaagacacctact

SEQ ID NO: 4300859 - DNA, 15 bp, Homo sapiens
aaagacatttaaaat

SEQ ID NO: 4300860 - DNA, 20 bp, Homo sapiens
aaagacatttaaaatagttt

SEQ ID NO: 4300861 - DNA, 18 bp, Homo sapiens
aaagacttgatgaataaa

SEQ ID NO: 4300862 - DNA, 20 bp, Homo sapiens
aaagacttgatgaataaaca

SEQ ID NO: 4300863 - DNA, 18 bp, Homo sapiens
aaagagaaaacatctcat

SEQ ID NO: 4300864 - DNA, 20 bp, Homo sapiens
aaagagaccacccatatcat

SEQ ID NO: 4300865 - DNA, 14 bp, Homo sapiens
aaagaggagccttt

SEQ ID NO: 4300866 - DNA, 21 bp, Homo sapiens
aaagaggcgtcttgtattttc

SEQ ID NO: 4300867 - DNA, 16 bp, Homo sapiens
aaagatgaagaagaaa

SEQ ID NO: 4300868 - DNA, 22 bp, Homo sapiens
aaagattttatgtgcttgaaga

SEQ ID NO: 4300869 - DNA, 24 bp, Homo sapiens
aaagattttatgtgcttgaagatt

SEQ ID NO: 4300870 - DNA, 15 bp, Homo sapiens
aaagcaagcacctgg

SEQ ID NO: 4300871 - DNA, 18 bp, Homo sapiens
aaagcatctattcccaaa

SEQ ID NO: 4300872 - DNA, 20 bp, Homo sapiens
aaagccacataaccagcggg

SEQ ID NO: 4300873 - DNA, 16 bp, Homo sapiens
aaagcctgttgtttaa

SEQ ID NO: 4300874 - DNA, 14 bp, Homo sapiens
aaagctatatatga

SEQ ID NO: 4300875 - DNA, 12 bp, Homo sapiens
aaaggaaacctt

SEQ ID NO: 4300876 - DNA, 20 bp, Homo sapiens
aaaggactgttttttcctga

SEQ ID NO: 4300877 - DNA, 14 bp, Homo sapiens
aaaggcttctccac

SEQ ID NO: 4300878 - DNA, 17 bp, Homo sapiens
aaagggtgtgggtcagg

SEQ ID NO: 4300879 - DNA, 15 bp, Homo sapiens
aaaggtaatctgaaa

SEQ ID NO: 4300880 - DNA, 15 bp, Homo sapiens
aaaggtgattgtcac

SEQ ID NO: 4300881 - DNA, 21 bp, Homo sapiens
aaaggtttatttttctgttac

SEQ ID NO: 4300882 - DNA, 19 bp, Homo sapiens
aaaggtttcactgttcatg

SEQ ID NO: 4300883 - DNA, 22 bp, Homo sapiens
aaaggtttcactgttcatgaat

SEQ ID NO: 4300884 - DNA, 20 bp, Homo sapiens
aaagtaccaactgagccaaa

SEQ ID NO: 4300885 - DNA, 19 bp, Homo sapiens
aaagtagtacttcttctgt

SEQ ID NO: 4300886 - DNA, 21 bp, Homo sapiens
aaagtagtacttcttctgtaa

SEQ ID NO: 4300887 - DNA, 20 bp, Homo sapiens
aaagtatctctactttcctg

SEQ ID NO: 4300888 - DNA, 14 bp, Homo sapiens
aaagtctatgctta

SEQ ID NO: 4300889 - DNA, 13 bp, Homo sapiens
aaagtctctgggt

SEQ ID NO: 4300890 - DNA, 14 bp, Homo sapiens
aaagtgagaaatta

SEQ ID NO: 4300891 - DNA, 15 bp, Homo sapiens
aaagtgtaaaataga

SEQ ID NO: 4300892 - DNA, 20 bp, Homo sapiens
aaagtgtttaattgtataaa

SEQ ID NO: 4300893 - DNA, 21 bp, Homo sapiens
aaagttacctggaatcaaata

SEQ ID NO: 4300894 - DNA, 17 bp, Homo sapiens
aaagttagggcattttt

SEQ ID NO: 4300895 - DNA, 24 bp, Homo sapiens
aaagttagggcatttttcttggat

SEQ ID NO: 4300896 - DNA, 22 bp, Homo sapiens
aaagttttcagattgtaaaggt

SEQ ID NO: 4300897 - DNA, 16 bp, Homo sapiens
aaagtttttacagtgt

SEQ ID NO: 4300898 - DNA, 14 bp, Homo sapiens
aaataaaaatattc

SEQ ID NO: 4300899 - DNA, 16 bp, Homo sapiens
aaataaaaatattctc

SEQ ID NO: 4300900 - DNA, 18 bp, Homo sapiens
aaataaaacgttatctca

SEQ ID NO: 4300901 - DNA, 19 bp, Homo sapiens
aaataaagaagaaaataac

SEQ ID NO: 4300902 - DNA, 15 bp, Homo sapiens
aaataaataatctca

SEQ ID NO: 4300903 - DNA, 19 bp, Homo sapiens
aaataacatctgaaaagaa

SEQ ID NO: 4300904 - DNA, 15 bp, Homo sapiens
aaataagtaatatct

SEQ ID NO: 4300905 - DNA, 15 bp, Homo sapiens
aaataataatattta

SEQ ID NO: 4300906 - DNA, 19 bp, Homo sapiens
aaataatgatcttccaaat

SEQ ID NO: 4300907 - DNA, 12 bp, Homo sapiens
aaataatgattt

SEQ ID NO: 4300908 - DNA, 22 bp, Homo sapiens
aaataatgatttaagcatttta

SEQ ID NO: 4300909 - DNA, 20 bp, Homo sapiens
aaatacatgatgatttcaga

SEQ ID NO: 4300910 - DNA, 13 bp, Homo sapiens
aaataccagagca

SEQ ID NO: 4300911 - DNA, 21 bp, Homo sapiens
aaatagaatgttactttggaa

SEQ ID NO: 4300912 - DNA, 19 bp, Homo sapiens
aaataggagggaaaccttt

SEQ ID NO: 4300913 - DNA, 15 bp, Homo sapiens
aaatagttctatttc

SEQ ID NO: 4300914 - DNA, 14 bp, Homo sapiens
aaatagttttctaa

SEQ ID NO: 4300915 - DNA, 15 bp, Homo sapiens
aaatagttttctaaa

SEQ ID NO: 4300916 - DNA, 13 bp, Homo sapiens
aaatatatatata

SEQ ID NO: 4300917 - DNA, 17 bp, Homo sapiens
aaatatctctatttaat

SEQ ID NO: 4300918 - DNA, 13 bp, Homo sapiens
aaatatgaaattt

SEQ ID NO: 4300919 - DNA, 15 bp, Homo sapiens
aaatatgaaatttta

SEQ ID NO: 4300920 - DNA, 19 bp, Homo sapiens
aaatatgattctcctctcc

SEQ ID NO: 4300921 - DNA, 22 bp, Homo sapiens
aaatatgcccctccccagtagc

SEQ ID NO: 4300922 - DNA, 23 bp, Homo sapiens
aaatatgctctcccctccctttt

SEQ ID NO: 4300923 - DNA, 21 bp, Homo sapiens
aaatatgtgagcatgaaacta

SEQ ID NO: 4300924 - DNA, 18 bp, Homo sapiens
aaatatttttttctagct

SEQ ID NO: 4300925 - DNA, 19 bp, Homo sapiens
aaatatttttttctagcta

SEQ ID NO: 4300926 - DNA, 23 bp, Homo sapiens
aaatatttttttctagctataac

SEQ ID NO: 4300927 - DNA, 17 bp, Homo sapiens
aaatcagaatctttaaa

SEQ ID NO: 4300928 - DNA, 23 bp, Homo sapiens
aaatcagccttgcacaagtactt

SEQ ID NO: 4300929 - DNA, 18 bp, Homo sapiens
aaatctagaagagtctat

SEQ ID NO: 4300930 - DNA, 15 bp, Homo sapiens
aaatctgtctgattc

SEQ ID NO: 4300931 - DNA, 16 bp, Homo sapiens
aaatctgtctgattct

SEQ ID NO: 4300932 - DNA, 20 bp, Homo sapiens
aaatgagtttaaaaaaataa

SEQ ID NO: 4300933 - DNA, 21 bp, Homo sapiens
aaatgagtttaaaaaaataac

SEQ ID NO: 4300934 - DNA, 19 bp, Homo sapiens
aaatgatacttggtcctta

SEQ ID NO: 4300935 - DNA, 14 bp, Homo sapiens
aaatgcatgtgatt

SEQ ID NO: 4300936 - DNA, 18 bp, Homo sapiens
aaatgctacctctgatca

SEQ ID NO: 4300937 - DNA, 20 bp, Homo sapiens
aaatgctacctctgatcaaa

SEQ ID NO: 4300938 - DNA, 14 bp, Homo sapiens
aaatgctgtatgtc

SEQ ID NO: 4300939 - DNA, 19 bp, Homo sapiens
aaatgctttgtgtgattga

SEQ ID NO: 4300940 - DNA, 21 bp, Homo sapiens
aaatgtaactgtccgtagtat

SEQ ID NO: 4300941 - DNA, 17 bp, Homo sapiens
aaatgtagcttcagtca

SEQ ID NO: 4300942 - DNA, 19 bp, Homo sapiens
aaatgtagcttcagtcatt

SEQ ID NO: 4300943 - DNA, 17 bp, Homo sapiens
aaatgtgagctataatg

SEQ ID NO: 4300944 - DNA, 14 bp, Homo sapiens
aaatgtgtgtatgt

SEQ ID NO: 4300945 - DNA, 13 bp, Homo sapiens
aaatgtttctttt

SEQ ID NO: 4300946 - DNA, 23 bp, Homo sapiens
aaatgtttctttttcttttttga

SEQ ID NO: 4300947 - DNA, 21 bp, Homo sapiens
aaattagggctctaatttcct

SEQ ID NO: 4300948 - DNA, 16 bp, Homo sapiens
aaattcacaaagttaa

SEQ ID NO: 4300949 - DNA, 19 bp, Homo sapiens
aaattcccaacctgctcat

SEQ ID NO: 4300950 - DNA, 13 bp, Homo sapiens
aaattcctgttgt

SEQ ID NO: 4300951 - DNA, 14 bp, Homo sapiens
aaattcctgttgtc

SEQ ID NO: 4300952 - DNA, 21 bp, Homo sapiens
aaattgaagagagatatatct

SEQ ID NO: 4300953 - DNA, 16 bp, Homo sapiens
aaattggtgataagtg

SEQ ID NO: 4300954 - DNA, 18 bp, Homo sapiens
aaattgtcttttgtcatg

SEQ ID NO: 4300955 - DNA, 21 bp, Homo sapiens
aaattgtcttttgtcatgtgg

SEQ ID NO: 4300956 - DNA, 20 bp, Homo sapiens
aaatttaatatactgcatat

SEQ ID NO: 4300957 - DNA, 19 bp, Homo sapiens
aaatttttttccagaattg

SEQ ID NO: 4300958 - DNA, 14 bp, Homo sapiens
aacaaaatgatggg

SEQ ID NO: 4300959 - DNA, 23 bp, Homo sapiens
aacaaatatgattctcctctccc

SEQ ID NO: 4300960 - DNA, 20 bp, Homo sapiens
aacaacagtcttcatttttt

SEQ ID NO: 4300961 - DNA, 14 bp, Homo sapiens
aacaagaagaattt

SEQ ID NO: 4300962 - DNA, 20 bp, Homo sapiens
aacaagatttccctaaaaat

SEQ ID NO: 4300963 - DNA, 11 bp, Homo sapiens
aacaatgaatg

SEQ ID NO: 4300964 - DNA, 18 bp, Homo sapiens
aacaatgcctattgtaat

SEQ ID NO: 4300965 - DNA, 20 bp, Homo sapiens
aacaatggtaacatttttca

SEQ ID NO: 4300966 - DNA, 24 bp, Homo sapiens
aacacagctgttcttctgttctgc

SEQ ID NO: 4300967 - DNA, 13 bp, Homo sapiens
aacacccagcccc

SEQ ID NO: 4300968 - DNA, 15 bp, Homo sapiens
aacacccagccccag

SEQ ID NO: 4300969 - DNA, 17 bp, Homo sapiens
aacacgtttagaaatga

SEQ ID NO: 4300970 - DNA, 18 bp, Homo sapiens
aacacgtttagaaatgat

SEQ ID NO: 4300971 - DNA, 15 bp, Homo sapiens
aacacttattttctg

SEQ ID NO: 4300972 - DNA, 21 bp, Homo sapiens
aacacttattttctgaattca

SEQ ID NO: 4300973 - DNA, 18 bp, Homo sapiens
aacagacctcggctgtgt

SEQ ID NO: 4300974 - DNA, 14 bp, Homo sapiens
aacagagtatatat

SEQ ID NO: 4300975 - DNA, 20 bp, Homo sapiens
aacagcagagtaaaattaca

SEQ ID NO: 4300976 - DNA, 23 bp, Homo sapiens
aacagcagagtaaaattacagaa

SEQ ID NO: 4300977 - DNA, 15 bp, Homo sapiens
aacagcatgtctact

SEQ ID NO: 4300978 - DNA, 17 bp, Homo sapiens
aacaggaccaggagcca

SEQ ID NO: 4300979 - DNA, 20 bp, Homo sapiens
aacaggaggaactggtccag

SEQ ID NO: 4300980 - DNA, 21 bp, Homo sapiens
aacaggaggaactggtccagg

SEQ ID NO: 4300981 - DNA, 17 bp, Homo sapiens
aacagggcatctccagg

SEQ ID NO: 4300982 - DNA, 23 bp, Homo sapiens
aacagtgtttccagtgacacaac

SEQ ID NO: 4300983 - DNA, 18 bp, Homo sapiens
aacagttgcacagcatct

SEQ ID NO: 4300984 - DNA, 15 bp, Homo sapiens
aacagtttttatgtt

SEQ ID NO: 4300985 - DNA, 11 bp, Homo sapiens
aacatattctt

SEQ ID NO: 4300986 - DNA, 22 bp, Homo sapiens
aacatattcttgctttcacaaa

SEQ ID NO: 4300987 - DNA, 13 bp, Homo sapiens
aacatctgaaaag

SEQ ID NO: 4300988 - DNA, 16 bp, Homo sapiens
aacatctgaaaagaaa

SEQ ID NO: 4300989 - DNA, 18 bp, Homo sapiens
aacatctgaaaagaaatg

SEQ ID NO: 4300990 - DNA, 21 bp, Homo sapiens
aacatctgagaaaagctttga

SEQ ID NO: 4300991 - DNA, 14 bp, Homo sapiens
aacatgagtttatg

SEQ ID NO: 4300992 - DNA, 17 bp, Homo sapiens
aacatgagtttatggga

SEQ ID NO: 4300993 - DNA, 23 bp, Homo sapiens
aacatggccacatccaacatttc

SEQ ID NO: 4300994 - DNA, 13 bp, Homo sapiens
aacatgtctaaag

SEQ ID NO: 4300995 - DNA, 14 bp, Homo sapiens
aacattaaaagaag

SEQ ID NO: 4300996 - DNA, 21 bp, Homo sapiens
aacattatagattttcatgtt

SEQ ID NO: 4300997 - DNA, 17 bp, Homo sapiens
aacattattacttttcc

SEQ ID NO: 4300998 - DNA, 20 bp, Homo sapiens
aacattcatgtgtaggaaga

SEQ ID NO: 4300999 - DNA, 14 bp, Homo sapiens
aacattctatttca

SEQ ID NO: 4301000 - DNA, 20 bp, Homo sapiens
aacatttgggagactgagct

SEQ ID NO: 4301001 - DNA, 21 bp, Homo sapiens
aacatttgtttatccttaaga

SEQ ID NO: 4301002 - DNA, 19 bp, Homo sapiens
aaccaaattaacctttcag

SEQ ID NO: 4301003 - DNA, 17 bp, Homo sapiens
aaccaacgggtctgtgg

SEQ ID NO: 4301004 - DNA, 18 bp, Homo sapiens
aaccaatgattcataaca

SEQ ID NO: 4301005 - DNA, 12 bp, Homo sapiens
aaccacagccct

SEQ ID NO: 4301006 - DNA, 15 bp, Homo sapiens
aaccacagccctgtc

SEQ ID NO: 4301007 - DNA, 17 bp, Homo sapiens
aaccaccgctccccagc

SEQ ID NO: 4301008 - DNA, 19 bp, Homo sapiens
aaccaccgctccccagccc

SEQ ID NO: 4301009 - DNA, 20 bp, Homo sapiens
aaccaccgctccccagccca

SEQ ID NO: 4301010 - DNA, 19 bp, Homo sapiens
aaccactgcaatatcttcg

SEQ ID NO: 4301011 - DNA, 17 bp, Homo sapiens
aaccagctcaggctact

SEQ ID NO: 4301012 - DNA, 19 bp, Homo sapiens
aaccagggggaagcaccag

SEQ ID NO: 4301013 - DNA, 17 bp, Homo sapiens
aaccagtccctctgagt

SEQ ID NO: 4301014 - DNA, 18 bp, Homo sapiens
aaccagtccctctgagtg

SEQ ID NO: 4301015 - DNA, 14 bp, Homo sapiens
aaccatagaactgt

SEQ ID NO: 4301016 - DNA, 19 bp, Homo sapiens
aaccatatgattgaaaaga

SEQ ID NO: 4301017 - DNA, 23 bp, Homo sapiens
aaccatggacctgcacttggcct

SEQ ID NO: 4301018 - DNA, 15 bp, Homo sapiens
aacccaggtgttgtc

SEQ ID NO: 4301019 - DNA, 21 bp, Homo sapiens
aacccatgcatggcctcccag

SEQ ID NO: 4301020 - DNA, 18 bp, Homo sapiens
aaccccagcagtcctggg

SEQ ID NO: 4301021 - DNA, 21 bp, Homo sapiens
aaccccctcggagcctgtgtt

SEQ ID NO: 4301022 - DNA, 16 bp, Homo sapiens
aaccctacactcggaa

SEQ ID NO: 4301023 - DNA, 17 bp, Homo sapiens
aaccctccctcagcccc

SEQ ID NO: 4301024 - DNA, 19 bp, Homo sapiens
aaccctccctcagcccctc

SEQ ID NO: 4301025 - DNA, 21 bp, Homo sapiens
aaccctccctcagcccctctt

SEQ ID NO: 4301026 - DNA, 19 bp, Homo sapiens
aaccctcctatcacctccc

SEQ ID NO: 4301027 - DNA, 11 bp, Homo sapiens
aaccctgcccc

SEQ ID NO: 4301028 - DNA, 18 bp, Homo sapiens
aacccttaaacagttgca

SEQ ID NO: 4301029 - DNA, 23 bp, Homo sapiens
aacccttaaacagttgcacagca

SEQ ID NO: 4301030 - DNA, 16 bp, Homo sapiens
aacccttttggccccc

SEQ ID NO: 4301031 - DNA, 22 bp, Homo sapiens
aacccttttggcccccgagctg

SEQ ID NO: 4301032 - DNA, 13 bp, Homo sapiens
aaccgatgctcca

SEQ ID NO: 4301033 - DNA, 17 bp, Homo sapiens
aaccgatgctccagcca

SEQ ID NO: 4301034 - DNA, 14 bp, Homo sapiens
aaccgcttgccata

SEQ ID NO: 4301035 - DNA, 22 bp, Homo sapiens
aacctaaggcaacatttccgaa

SEQ ID NO: 4301036 - DNA, 15 bp, Homo sapiens
aacctacagtggagg

SEQ ID NO: 4301037 - DNA, 18 bp, Homo sapiens
aacctacagtggagggag

SEQ ID NO: 4301038 - DNA, 21 bp, Homo sapiens
aacctcgaagctgttctctgc

SEQ ID NO: 4301039 - DNA, 19 bp, Homo sapiens
aacctcgttgacatgcaca

SEQ ID NO: 4301040 - DNA, 16 bp, Homo sapiens
aaccttgagacagctt

SEQ ID NO: 4301041 - DNA, 22 bp, Homo sapiens
aaccttttcttgtatctggatt

SEQ ID NO: 4301042 - DNA, 12 bp, Homo sapiens
aacgaaaagcac

SEQ ID NO: 4301043 - DNA, 15 bp, Homo sapiens
aacgatccttcaaag

SEQ ID NO: 4301044 - DNA, 16 bp, Homo sapiens
aacgcagccctgcttt

SEQ ID NO: 4301045 - DNA, 16 bp, Homo sapiens
aactaaaattcaacaa

SEQ ID NO: 4301046 - DNA, 20 bp, Homo sapiens
aactaaaattcaacaaatga

SEQ ID NO: 4301047 - DNA, 15 bp, Homo sapiens
aactaagcaagtata

SEQ ID NO: 4301048 - DNA, 20 bp, Homo sapiens
aactaaggtacggtgagact

SEQ ID NO: 4301049 - DNA, 16 bp, Homo sapiens
aactacagccaaattg

SEQ ID NO: 4301050 - DNA, 18 bp, Homo sapiens
aactactaagaataaata

SEQ ID NO: 4301051 - DNA, 21 bp, Homo sapiens
aactactaagaataaataaag

SEQ ID NO: 4301052 - DNA, 21 bp, Homo sapiens
aactagatctcctgtaatttt

SEQ ID NO: 4301053 - DNA, 22 bp, Homo sapiens
aactagatctcctgtaattttg

SEQ ID NO: 4301054 - DNA, 21 bp, Homo sapiens
aactcacctgctggcccctca

SEQ ID NO: 4301055 - DNA, 19 bp, Homo sapiens
aactcatccagaactgtct

SEQ ID NO: 4301056 - DNA, 17 bp, Homo sapiens
aactccaaggcaaatgt

SEQ ID NO: 4301057 - DNA, 15 bp, Homo sapiens
aactctattttttac

SEQ ID NO: 4301058 - DNA, 15 bp, Homo sapiens
aactctctctgcccc

SEQ ID NO: 4301059 - DNA, 16 bp, Homo sapiens
aactctctctgccccc

SEQ ID NO: 4301060 - DNA, 10 bp, Homo sapiens
aactctggcc

SEQ ID NO: 4301061 - DNA, 14 bp, Homo sapiens
aactgagctcctct

SEQ ID NO: 4301062 - DNA, 18 bp, Homo sapiens
aactgagctcctctgggc

SEQ ID NO: 4301063 - DNA, 12 bp, Homo sapiens
aactgcaacact

SEQ ID NO: 4301064 - DNA, 15 bp, Homo sapiens
aactgcaacactgga

SEQ ID NO: 4301065 - DNA, 20 bp, Homo sapiens
aactgcagtgggttctccaa

SEQ ID NO: 4301066 - DNA, 16 bp, Homo sapiens
aactgcatatagataa

SEQ ID NO: 4301067 - DNA, 20 bp, Homo sapiens
aactgccaggcagctgcagt

SEQ ID NO: 4301068 - DNA, 21 bp, Homo sapiens
aactgctgttttatgtcatac

SEQ ID NO: 4301069 - DNA, 15 bp, Homo sapiens
aactggaataagaag

SEQ ID NO: 4301070 - DNA, 13 bp, Homo sapiens
aactggtccaggc

SEQ ID NO: 4301071 - DNA, 22 bp, Homo sapiens
aactggtccaggccaggcctca

SEQ ID NO: 4301072 - DNA, 15 bp, Homo sapiens
aactgtaaaatactt

SEQ ID NO: 4301073 - DNA, 22 bp, Homo sapiens
aactgtagtaattgttacaatt

SEQ ID NO: 4301074 - DNA, 14 bp, Homo sapiens
aactgttacagtaa

SEQ ID NO: 4301075 - DNA, 15 bp, Homo sapiens
aactgttacagtaat

SEQ ID NO: 4301076 - DNA, 13 bp, Homo sapiens
aactgttgtttga

SEQ ID NO: 4301077 - DNA, 18 bp, Homo sapiens
aactgttgtttgatgtgt

SEQ ID NO: 4301078 - DNA, 10 bp, Homo sapiens
aactgtttat

SEQ ID NO: 4301079 - DNA, 22 bp, Homo sapiens
aacttattcaaagagaaaacat

SEQ ID NO: 4301080 - DNA, 12 bp, Homo sapiens
aacttcacctta

SEQ ID NO: 4301081 - DNA, 12 bp, Homo sapiens
aacttcaggaaa

SEQ ID NO: 4301082 - DNA, 18 bp, Homo sapiens
aacttcatgctgtctgtg

SEQ ID NO: 4301083 - DNA, 19 bp, Homo sapiens
aacttgaaattatatctgt

SEQ ID NO: 4301084 - DNA, 12 bp, Homo sapiens
aacttgagccca

SEQ ID NO: 4301085 - DNA, 13 bp, Homo sapiens
aacttgatgttcc

SEQ ID NO: 4301086 - DNA, 19 bp, Homo sapiens
aacttggggaacaagggtg

SEQ ID NO: 4301087 - DNA, 12 bp, Homo sapiens
aactttaccatg

SEQ ID NO: 4301088 - DNA, 19 bp, Homo sapiens
aactttatttaaaatgatt

SEQ ID NO: 4301089 - DNA, 15 bp, Homo sapiens
aacttttgtgtgaaa

SEQ ID NO: 4301090 - DNA, 19 bp, Homo sapiens
aagaaaacatgtctgtgaa

SEQ ID NO: 4301091 - DNA, 21 bp, Homo sapiens
aagaaagctatatatgaataa

SEQ ID NO: 4301092 - DNA, 16 bp, Homo sapiens
aagaaaggaaaccttt

SEQ ID NO: 4301093 - DNA, 12 bp, Homo sapiens
aagaaatatctg

SEQ ID NO: 4301094 - DNA, 17 bp, Homo sapiens
aagaaatatctgtgaaa

SEQ ID NO: 4301095 - DNA, 13 bp, Homo sapiens
aagaaatctattt

SEQ ID NO: 4301096 - DNA, 19 bp, Homo sapiens
aagaaatgctaatgtaatc

SEQ ID NO: 4301097 - DNA, 21 bp, Homo sapiens
aagaaattagggctctaattt

SEQ ID NO: 4301098 - DNA, 22 bp, Homo sapiens
aagaacccccctccccaaggaa

SEQ ID NO: 4301099 - DNA, 18 bp, Homo sapiens
aagaactcaccagggttt

SEQ ID NO: 4301100 - DNA, 21 bp, Homo sapiens
aagaagaaagtctatgcttag

SEQ ID NO: 4301101 - DNA, 21 bp, Homo sapiens
aagaagaactcaccagggttt

SEQ ID NO: 4301102 - DNA, 12 bp, Homo sapiens
aagaagaatata

SEQ ID NO: 4301103 - DNA, 16 bp, Homo sapiens
aagaagcaaataaata

SEQ ID NO: 4301104 - DNA, 14 bp, Homo sapiens
aagaagggaaattc

SEQ ID NO: 4301105 - DNA, 15 bp, Homo sapiens
aagaagggaaattca

SEQ ID NO: 4301106 - DNA, 19 bp, Homo sapiens
aagaagtgggagtgggaga

SEQ ID NO: 4301107 - DNA, 21 bp, Homo sapiens
aagaataaataaagaagaaaa

SEQ ID NO: 4301108 - DNA, 11 bp, Homo sapiens
aagaatattgt

SEQ ID NO: 4301109 - DNA, 21 bp, Homo sapiens
aagaatcacaataattttcta

SEQ ID NO: 4301110 - DNA, 13 bp, Homo sapiens
aagaatctactta

SEQ ID NO: 4301111 - DNA, 14 bp, Homo sapiens
aagaatgtatatca

SEQ ID NO: 4301112 - DNA, 14 bp, Homo sapiens
aagacacgtgtttt

SEQ ID NO: 4301113 - DNA, 14 bp, Homo sapiens
aagacagcagagcc

SEQ ID NO: 4301114 - DNA, 18 bp, Homo sapiens
aagaccccaggaagtcat

SEQ ID NO: 4301115 - DNA, 24 bp, Homo sapiens
aagacctcgtctttgcttgtcctg

SEQ ID NO: 4301116 - DNA, 12 bp, Homo sapiens
aagacttcaaaa

SEQ ID NO: 4301117 - DNA, 19 bp, Homo sapiens
aagacttgatgaataaaca

SEQ ID NO: 4301118 - DNA, 18 bp, Homo sapiens
aagagaaaacatctcatc

SEQ ID NO: 4301119 - DNA, 13 bp, Homo sapiens
aagagagacaaaa

SEQ ID NO: 4301120 - DNA, 17 bp, Homo sapiens
aagagagatatatctga

SEQ ID NO: 4301121 - DNA, 20 bp, Homo sapiens
aagagagatatatctgaaaa

SEQ ID NO: 4301122 - DNA, 19 bp, Homo sapiens
aagagatgaggaaataaga

SEQ ID NO: 4301123 - DNA, 16 bp, Homo sapiens
aagagcaagctgtaca

SEQ ID NO: 4301124 - DNA, 18 bp, Homo sapiens
aagagcgctcctctgcct

SEQ ID NO: 4301125 - DNA, 20 bp, Homo sapiens
aagagcgctcctctgccttg

SEQ ID NO: 4301126 - DNA, 14 bp, Homo sapiens
aagagctcaggaga

SEQ ID NO: 4301127 - DNA, 22 bp, Homo sapiens
aagaggagttctaacacatttc

SEQ ID NO: 4301128 - DNA, 16 bp, Homo sapiens
aagaggcattcagcaa

SEQ ID NO: 4301129 - DNA, 16 bp, Homo sapiens
aagaggccgctgcagg

SEQ ID NO: 4301130 - DNA, 17 bp, Homo sapiens
aagaggccgctgcaggg

SEQ ID NO: 4301131 - DNA, 12 bp, Homo sapiens
aagagggagaag

SEQ ID NO: 4301132 - DNA, 17 bp, Homo sapiens
aagaggtgttttttcta

SEQ ID NO: 4301133 - DNA, 15 bp, Homo sapiens
aagagtctattgtct

SEQ ID NO: 4301134 - DNA, 12 bp, Homo sapiens
aagatctaaatc

SEQ ID NO: 4301135 - DNA, 19 bp, Homo sapiens
aagatctcagataaagtga

SEQ ID NO: 4301136 - DNA, 14 bp, Homo sapiens
aagatctctttcta

SEQ ID NO: 4301137 - DNA, 15 bp, Homo sapiens
aagatctctttctaa

SEQ ID NO: 4301138 - DNA, 19 bp, Homo sapiens
aagatctctttctaaagac

SEQ ID NO: 4301139 - DNA, 16 bp, Homo sapiens
aagatgaagaagaaaa

SEQ ID NO: 4301140 - DNA, 15 bp, Homo sapiens
aagatgtaagaagct

SEQ ID NO: 4301141 - DNA, 19 bp, Homo sapiens
aagatgtcaagctggccgt

SEQ ID NO: 4301142 - DNA, 17 bp, Homo sapiens
aagattaaaattagtga

SEQ ID NO: 4301143 - DNA, 18 bp, Homo sapiens
aagattaaaattagtgag

SEQ ID NO: 4301144 - DNA, 13 bp, Homo sapiens
aagattcaggctt

SEQ ID NO: 4301145 - DNA, 22 bp, Homo sapiens
aagattcaggcttgcattaaaa

SEQ ID NO: 4301146 - DNA, 11 bp, Homo sapiens
aagattctaaa

SEQ ID NO: 4301147 - DNA, 23 bp, Homo sapiens
aagattctgtgggcagctggctc

SEQ ID NO: 4301148 - DNA, 19 bp, Homo sapiens
aagatttccctaaaaattc

SEQ ID NO: 4301149 - DNA, 13 bp, Homo sapiens
aagattttatgtg

SEQ ID NO: 4301150 - DNA, 15 bp, Homo sapiens
aagattttatgtgct

SEQ ID NO: 4301151 - DNA, 14 bp, Homo sapiens
aagcaaataaatat

SEQ ID NO: 4301152 - DNA, 19 bp, Homo sapiens
aagcaaatatttatgacct

SEQ ID NO: 4301153 - DNA, 21 bp, Homo sapiens
aagcaaatatttatgacctca

SEQ ID NO: 4301154 - DNA, 20 bp, Homo sapiens
aagcaacatgaattaagaac

SEQ ID NO: 4301155 - DNA, 14 bp, Homo sapiens
aagcaagcacctgg

SEQ ID NO: 4301156 - DNA, 14 bp, Homo sapiens
aagcaaggccagcc

SEQ ID NO: 4301157 - DNA, 15 bp, Homo sapiens
aagcaagtatattta

SEQ ID NO: 4301158 - DNA, 20 bp, Homo sapiens
aagcacaataaaagacatcc

SEQ ID NO: 4301159 - DNA, 16 bp, Homo sapiens
aagcaccagcctcagt

SEQ ID NO: 4301160 - DNA, 19 bp, Homo sapiens
aagcaccagcctcagtgca

SEQ ID NO: 4301161 - DNA, 14 bp, Homo sapiens
aagcacctgggtgt

SEQ ID NO: 4301162 - DNA, 17 bp, Homo sapiens
aagcacctgggtgtgct

SEQ ID NO: 4301163 - DNA, 22 bp, Homo sapiens
aagcacctgggtgtgctccagg

SEQ ID NO: 4301164 - DNA, 17 bp, Homo sapiens
aagcagagtgcacagct

SEQ ID NO: 4301165 - DNA, 19 bp, Homo sapiens
aagcagagtgcacagctgt

SEQ ID NO: 4301166 - DNA, 17 bp, Homo sapiens
aagcagtggatacgtgt

SEQ ID NO: 4301167 - DNA, 15 bp, Homo sapiens
aagcatcagcaagac

SEQ ID NO: 4301168 - DNA, 13 bp, Homo sapiens
aagcattctgtct

SEQ ID NO: 4301169 - DNA, 22 bp, Homo sapiens
aagcattttactgtctgtaaga

SEQ ID NO: 4301170 - DNA, 19 bp, Homo sapiens
aagccacgtgctggagagt

SEQ ID NO: 4301171 - DNA, 12 bp, Homo sapiens
aagccaggagac

SEQ ID NO: 4301172 - DNA, 20 bp, Homo sapiens
aagccaggagaccctgtctt

SEQ ID NO: 4301173 - DNA, 18 bp, Homo sapiens
aagccagtgactccagga

SEQ ID NO: 4301174 - DNA, 17 bp, Homo sapiens
aagccccaggcaggctg

SEQ ID NO: 4301175 - DNA, 13 bp, Homo sapiens
aagccgtggcttc

SEQ ID NO: 4301176 - DNA, 14 bp, Homo sapiens
aagccgtggcttcc

SEQ ID NO: 4301177 - DNA, 19 bp, Homo sapiens
aagcctcaggcctggccct

SEQ ID NO: 4301178 - DNA, 20 bp, Homo sapiens
aagcctcaggcctggccctt

SEQ ID NO: 4301179 - DNA, 14 bp, Homo sapiens
aagcctcagtccct

SEQ ID NO: 4301180 - DNA, 22 bp, Homo sapiens
aagcctcagtccctccctcctg

SEQ ID NO: 4301181 - DNA, 23 bp, Homo sapiens
aagcctcatgggagtcagggagc

SEQ ID NO: 4301182 - DNA, 14 bp, Homo sapiens
aagcctcctgctga

SEQ ID NO: 4301183 - DNA, 21 bp, Homo sapiens
aagcctgccccggccactctg

SEQ ID NO: 4301184 - DNA, 13 bp, Homo sapiens
aagcctggacaca

SEQ ID NO: 4301185 - DNA, 11 bp, Homo sapiens
aagcctggccc

SEQ ID NO: 4301186 - DNA, 15 bp, Homo sapiens
aagctatcttcatgt

SEQ ID NO: 4301187 - DNA, 17 bp, Homo sapiens
aagctcaccctgctcct

SEQ ID NO: 4301188 - DNA, 14 bp, Homo sapiens
aagctcagcccacc

SEQ ID NO: 4301189 - DNA, 16 bp, Homo sapiens
aagctcagcccacccc

SEQ ID NO: 4301190 - DNA, 16 bp, Homo sapiens
aagctccatcttattt

SEQ ID NO: 4301191 - DNA, 18 bp, Homo sapiens
aagctgcttctgggggat

SEQ ID NO: 4301192 - DNA, 12 bp, Homo sapiens
aagctggcagga

SEQ ID NO: 4301193 - DNA, 15 bp, Homo sapiens
aagctgttctctgct

SEQ ID NO: 4301194 - DNA, 16 bp, Homo sapiens
aagctgttctctgctt

SEQ ID NO: 4301195 - DNA, 20 bp, Homo sapiens
aagcttaaaaaagaaagatt

SEQ ID NO: 4301196 - DNA, 18 bp, Homo sapiens
aaggaaaccttttcttgt

SEQ ID NO: 4301197 - DNA, 19 bp, Homo sapiens
aaggaaaccttttcttgta

SEQ ID NO: 4301198 - DNA, 19 bp, Homo sapiens
aaggaaggagccagctccc

SEQ ID NO: 4301199 - DNA, 13 bp, Homo sapiens
aaggacccctcac

SEQ ID NO: 4301200 - DNA, 18 bp, Homo sapiens
aaggacccggaggggcct

SEQ ID NO: 4301201 - DNA, 21 bp, Homo sapiens
aaggacccggaggggcctggc

SEQ ID NO: 4301202 - DNA, 23 bp, Homo sapiens
aaggactgttttttcctgagctt

SEQ ID NO: 4301203 - DNA, 16 bp, Homo sapiens
aaggacttcctgctac

SEQ ID NO: 4301204 - DNA, 24 bp, Homo sapiens
aaggacttcctgctacagtagctg

SEQ ID NO: 4301205 - DNA, 23 bp, Homo sapiens
aaggacttgtgcctcttgggaga

SEQ ID NO: 4301206 - DNA, 11 bp, Homo sapiens
aaggagaggag

SEQ ID NO: 4301207 - DNA, 12 bp, Homo sapiens
aaggagaggagt

SEQ ID NO: 4301208 - DNA, 15 bp, Homo sapiens
aaggagccagctccc

SEQ ID NO: 4301209 - DNA, 16 bp, Homo sapiens
aaggaggaagggactg

SEQ ID NO: 4301210 - DNA, 17 bp, Homo sapiens
aaggagtgcccgccttg

SEQ ID NO: 4301211 - DNA, 20 bp, Homo sapiens
aaggatccagatagcctagg

SEQ ID NO: 4301212 - DNA, 12 bp, Homo sapiens
aaggcaaatgtc

SEQ ID NO: 4301213 - DNA, 13 bp, Homo sapiens
aaggcaaatgtcc

SEQ ID NO: 4301214 - DNA, 14 bp, Homo sapiens
aaggcaaatgtcca

SEQ ID NO: 4301215 - DNA, 17 bp, Homo sapiens
aaggcaaatgtccaagc

SEQ ID NO: 4301216 - DNA, 16 bp, Homo sapiens
aaggcctgcccccctt

SEQ ID NO: 4301217 - DNA, 20 bp, Homo sapiens
aaggcctgccccccttccca

SEQ ID NO: 4301218 - DNA, 13 bp, Homo sapiens
aaggccttgcctt

SEQ ID NO: 4301219 - DNA, 13 bp, Homo sapiens
aaggcttctccac

SEQ ID NO: 4301220 - DNA, 16 bp, Homo sapiens
aaggctttcagggcct

SEQ ID NO: 4301221 - DNA, 18 bp, Homo sapiens
aagggaagcagagcctgg

SEQ ID NO: 4301222 - DNA, 19 bp, Homo sapiens
aagggaagcagagcctggg

SEQ ID NO: 4301223 - DNA, 18 bp, Homo sapiens
aagggaatgaatccatta

SEQ ID NO: 4301224 - DNA, 13 bp, Homo sapiens
aagggactggtcc

SEQ ID NO: 4301225 - DNA, 15 bp, Homo sapiens
aagggactggtccag

SEQ ID NO: 4301226 - DNA, 14 bp, Homo sapiens
aagggaggcctgag

SEQ ID NO: 4301227 - DNA, 20 bp, Homo sapiens
aagggaggcctgaggggcag

SEQ ID NO: 4301228 - DNA, 16 bp, Homo sapiens
aagggatgtatttgta

SEQ ID NO: 4301229 - DNA, 18 bp, Homo sapiens
aagggcgctgagggcagg

SEQ ID NO: 4301230 - DNA, 15 bp, Homo sapiens
aaggggaattaacaa

SEQ ID NO: 4301231 - DNA, 21 bp, Homo sapiens
aaggggttcccactggctcct

SEQ ID NO: 4301232 - DNA, 16 bp, Homo sapiens
aagggtgctgcttccc

SEQ ID NO: 4301233 - DNA, 19 bp, Homo sapiens
aagggtgctgcttccctct

SEQ ID NO: 4301234 - DNA, 23 bp, Homo sapiens
aagggtgctgcttccctctgcct

SEQ ID NO: 4301235 - DNA, 19 bp, Homo sapiens
aagggtgtgggtcagggag

SEQ ID NO: 4301236 - DNA, 20 bp, Homo sapiens
aagggtgtgggtcagggagg

SEQ ID NO: 4301237 - DNA, 20 bp, Homo sapiens
aagggttagacaagcctgga

SEQ ID NO: 4301238 - DNA, 14 bp, Homo sapiens
aaggtaatctgaaa

SEQ ID NO: 4301239 - DNA, 22 bp, Homo sapiens
aaggtacggtgagactctgagg

SEQ ID NO: 4301240 - DNA, 18 bp, Homo sapiens
aaggtaggtgcatgcctt

SEQ ID NO: 4301241 - DNA, 13 bp, Homo sapiens
aaggtctcatgcc

SEQ ID NO: 4301242 - DNA, 12 bp, Homo sapiens
aaggtggtctgc

SEQ ID NO: 4301243 - DNA, 19 bp, Homo sapiens
aaggttggaactgctgcca

SEQ ID NO: 4301244 - DNA, 19 bp, Homo sapiens
aagtaccaactgagccaaa

SEQ ID NO: 4301245 - DNA, 20 bp, Homo sapiens
aagtactggtaagattgtta

SEQ ID NO: 4301246 - DNA, 21 bp, Homo sapiens
aagtactggtaagattgttat

SEQ ID NO: 4301247 - DNA, 21 bp, Homo sapiens
aagtacttgagaataaatgag

SEQ ID NO: 4301248 - DNA, 14 bp, Homo sapiens
aagtagatttcatg

SEQ ID NO: 4301249 - DNA, 16 bp, Homo sapiens
aagtattactaaattg

SEQ ID NO: 4301250 - DNA, 18 bp, Homo sapiens
aagtattccttggcccag

SEQ ID NO: 4301251 - DNA, 18 bp, Homo sapiens
aagtcacagccgtttgaa

SEQ ID NO: 4301252 - DNA, 12 bp, Homo sapiens
aagtcactgcac

SEQ ID NO: 4301253 - DNA, 22 bp, Homo sapiens
aagtcactgcacagtgcatctc

SEQ ID NO: 4301254 - DNA, 14 bp, Homo sapiens
aagtcagatgtttg

SEQ ID NO: 4301255 - DNA, 15 bp, Homo sapiens
aagtcaggagccagc

SEQ ID NO: 4301256 - DNA, 13 bp, Homo sapiens
aagtcatcataaa

SEQ ID NO: 4301257 - DNA, 14 bp, Homo sapiens
aagtcatcataaaa

SEQ ID NO: 4301258 - DNA, 17 bp, Homo sapiens
aagtccagctctcccct

SEQ ID NO: 4301259 - DNA, 21 bp, Homo sapiens
aagtccagctctcccctgcgc

SEQ ID NO: 4301260 - DNA, 21 bp, Homo sapiens
aagtcccagggagctctgcat

SEQ ID NO: 4301261 - DNA, 15 bp, Homo sapiens
aagtcccgaggcagc

SEQ ID NO: 4301262 - DNA, 16 bp, Homo sapiens
aagtcccgaggcagca

SEQ ID NO: 4301263 - DNA, 18 bp, Homo sapiens
aagtctatctggtattaa

SEQ ID NO: 4301264 - DNA, 15 bp, Homo sapiens
aagtcttactgtttt

SEQ ID NO: 4301265 - DNA, 19 bp, Homo sapiens
aagtgacaaggccccagag

SEQ ID NO: 4301266 - DNA, 21 bp, Homo sapiens
aagtgacaaggccccagagac

SEQ ID NO: 4301267 - DNA, 15 bp, Homo sapiens
aagtgaccccagctc

SEQ ID NO: 4301268 - DNA, 21 bp, Homo sapiens
aagtgaccccagctccaggca

SEQ ID NO: 4301269 - DNA, 12 bp, Homo sapiens
aagtgcaggctg

SEQ ID NO: 4301270 - DNA, 13 bp, Homo sapiens
aagtgcaggctgg

SEQ ID NO: 4301271 - DNA, 21 bp, Homo sapiens
aagtgcaggctggcaccgcct

SEQ ID NO: 4301272 - DNA, 17 bp, Homo sapiens
aagtgcatttctgggcc

SEQ ID NO: 4301273 - DNA, 12 bp, Homo sapiens
aagtgcccctgc

SEQ ID NO: 4301274 - DNA, 13 bp, Homo sapiens
aagtgcccctgct

SEQ ID NO: 4301275 - DNA, 23 bp, Homo sapiens
aagtgcccctgctgcctccccaa

SEQ ID NO: 4301276 - DNA, 14 bp, Homo sapiens
aagtgcctataaag

SEQ ID NO: 4301277 - DNA, 14 bp, Homo sapiens
aagtggaaaaaaga

SEQ ID NO: 4301278 - DNA, 21 bp, Homo sapiens
aagtggcctgagaagagtcga

SEQ ID NO: 4301279 - DNA, 16 bp, Homo sapiens
aagtgggagtgggaga

SEQ ID NO: 4301280 - DNA, 17 bp, Homo sapiens
aagtgggagtgggagag

SEQ ID NO: 4301281 - DNA, 20 bp, Homo sapiens
aagtggggcagcagcagtgg

SEQ ID NO: 4301282 - DNA, 13 bp, Homo sapiens
aagtggttaagaa

SEQ ID NO: 4301283 - DNA, 14 bp, Homo sapiens
aagtgtgcctgcta

SEQ ID NO: 4301284 - DNA, 16 bp, Homo sapiens
aagttagggcattttt

SEQ ID NO: 4301285 - DNA, 13 bp, Homo sapiens
aagttatagtact

SEQ ID NO: 4301286 - DNA, 15 bp, Homo sapiens
aagtttttacagtgt

SEQ ID NO: 4301287 - DNA, 23 bp, Homo sapiens
aataaaacgttatctcattgcaa

SEQ ID NO: 4301288 - DNA, 12 bp, Homo sapiens
aataaaccagac

SEQ ID NO: 4301289 - DNA, 18 bp, Homo sapiens
aataaagaagaaaataac

SEQ ID NO: 4301290 - DNA, 11 bp, Homo sapiens
aataaataatc

SEQ ID NO: 4301291 - DNA, 21 bp, Homo sapiens
aataaattggtgataagtgga

SEQ ID NO: 4301292 - DNA, 22 bp, Homo sapiens
aataaattggtgataagtggaa

SEQ ID NO: 4301293 - DNA, 21 bp, Homo sapiens
aataacaacagtttttatgtt

SEQ ID NO: 4301294 - DNA, 18 bp, Homo sapiens
aataacatattcttgctt

SEQ ID NO: 4301295 - DNA, 13 bp, Homo sapiens
aataacatctctt

SEQ ID NO: 4301296 - DNA, 22 bp, Homo sapiens
aataactagatctcctgtaatt

SEQ ID NO: 4301297 - DNA, 21 bp, Homo sapiens
aataatgacgtattgtgaaat

SEQ ID NO: 4301298 - DNA, 23 bp, Homo sapiens
aataatgacgtattgtgaaattt

SEQ ID NO: 4301299 - DNA, 20 bp, Homo sapiens
aataattgtggagaggagag

SEQ ID NO: 4301300 - DNA, 21 bp, Homo sapiens
aataattttttagttaaaatc

SEQ ID NO: 4301301 - DNA, 18 bp, Homo sapiens
aatactaaatatgaaatt

SEQ ID NO: 4301302 - DNA, 22 bp, Homo sapiens
aatactcaccaaaatatagtta

SEQ ID NO: 4301303 - DNA, 23 bp, Homo sapiens
aatactttgtatacaagtactgg

SEQ ID NO: 4301304 - DNA, 22 bp, Homo sapiens
aatagataaagtgcctataaag

SEQ ID NO: 4301305 - DNA, 21 bp, Homo sapiens
aatagtaatggttctagaagg

SEQ ID NO: 4301306 - DNA, 18 bp, Homo sapiens
aatagttctatttctatc

SEQ ID NO: 4301307 - DNA, 13 bp, Homo sapiens
aatagttttctaa

SEQ ID NO: 4301308 - DNA, 18 bp, Homo sapiens
aatagttttctaaatgtt

SEQ ID NO: 4301309 - DNA, 21 bp, Homo sapiens
aatagttttctaaatgtttct

SEQ ID NO: 4301310 - DNA, 22 bp, Homo sapiens
aatagttttctaaatgtttctt

SEQ ID NO: 4301311 - DNA, 13 bp, Homo sapiens
aatataaatgtgt

SEQ ID NO: 4301312 - DNA, 16 bp, Homo sapiens
aatataaatgtgtgta

SEQ ID NO: 4301313 - DNA, 22 bp, Homo sapiens
aatatacagtttttgtaaccat

SEQ ID NO: 4301314 - DNA, 13 bp, Homo sapiens
aatatagaaaaaa

SEQ ID NO: 4301315 - DNA, 18 bp, Homo sapiens
aatatagttgaacaagat

SEQ ID NO: 4301316 - DNA, 20 bp, Homo sapiens
aatatatataatacttaaaa

SEQ ID NO: 4301317 - DNA, 15 bp, Homo sapiens
aatatatatttatca

SEQ ID NO: 4301318 - DNA, 15 bp, Homo sapiens
aatatcactcattaa

SEQ ID NO: 4301319 - DNA, 21 bp, Homo sapiens
aatatgaaattttaccatttt

SEQ ID NO: 4301320 - DNA, 19 bp, Homo sapiens
aatatgattctcctctccc

SEQ ID NO: 4301321 - DNA, 21 bp, Homo sapiens
aatatgattctcctctcccaa

SEQ ID NO: 4301322 - DNA, 23 bp, Homo sapiens
aatatgccagtgactgctgcgct

SEQ ID NO: 4301323 - DNA, 14 bp, Homo sapiens
aatattatacttct

SEQ ID NO: 4301324 - DNA, 18 bp, Homo sapiens
aatattatacttctttat

SEQ ID NO: 4301325 - DNA, 17 bp, Homo sapiens
aatatttacaatgtatt

SEQ ID NO: 4301326 - DNA, 19 bp, Homo sapiens
aatatttacaatgtattaa

SEQ ID NO: 4301327 - DNA, 15 bp, Homo sapiens
aatatttatgacctc

SEQ ID NO: 4301328 - DNA, 21 bp, Homo sapiens
aatatttctaagcttatttct

SEQ ID NO: 4301329 - DNA, 14 bp, Homo sapiens
aatatttcttcaaa

SEQ ID NO: 4301330 - DNA, 20 bp, Homo sapiens
aatatttcttcaaatatctc

SEQ ID NO: 4301331 - DNA, 15 bp, Homo sapiens
aatatttgcttattt

SEQ ID NO: 4301332 - DNA, 16 bp, Homo sapiens
aatatttgcttattta

SEQ ID NO: 4301333 - DNA, 14 bp, Homo sapiens
aatcaaaaattgaa

SEQ ID NO: 4301334 - DNA, 16 bp, Homo sapiens
aatcaaatctgagcct

SEQ ID NO: 4301335 - DNA, 19 bp, Homo sapiens
aatcaacagtgaacagctt

SEQ ID NO: 4301336 - DNA, 20 bp, Homo sapiens
aatcaagtctgtgaaagtct

SEQ ID NO: 4301337 - DNA, 18 bp, Homo sapiens
aatcaagtgcatttctgg

SEQ ID NO: 4301338 - DNA, 21 bp, Homo sapiens
aatcaagtgcatttctgggcc

SEQ ID NO: 4301339 - DNA, 18 bp, Homo sapiens
aatcagaatctttaaaga

SEQ ID NO: 4301340 - DNA, 12 bp, Homo sapiens
aatcagcattct

SEQ ID NO: 4301341 - DNA, 23 bp, Homo sapiens
aatcagcctaggggtcagggacc

SEQ ID NO: 4301342 - DNA, 17 bp, Homo sapiens
aatcatatataataaat

SEQ ID NO: 4301343 - DNA, 17 bp, Homo sapiens
aatccaacccatgcatg

SEQ ID NO: 4301344 - DNA, 17 bp, Homo sapiens
aatccataccccctgcc

SEQ ID NO: 4301345 - DNA, 18 bp, Homo sapiens
aatccataccccctgccc

SEQ ID NO: 4301346 - DNA, 20 bp, Homo sapiens
aatccataccccctgcccca

SEQ ID NO: 4301347 - DNA, 19 bp, Homo sapiens
aatccattttctaaactgt

SEQ ID NO: 4301348 - DNA, 18 bp, Homo sapiens
aatcctgggcatccccag

SEQ ID NO: 4301349 - DNA, 12 bp, Homo sapiens
aatcctgtcaat

SEQ ID NO: 4301350 - DNA, 19 bp, Homo sapiens
aatctcttcttatacagat

SEQ ID NO: 4301351 - DNA, 15 bp, Homo sapiens
aatctgaaacacagt

SEQ ID NO: 4301352 - DNA, 11 bp, Homo sapiens
aatctgagcct

SEQ ID NO: 4301353 - DNA, 19 bp, Homo sapiens
aatctgattggacattttc

SEQ ID NO: 4301354 - DNA, 18 bp, Homo sapiens
aatctgtctgattctatg

SEQ ID NO: 4301355 - DNA, 12 bp, Homo sapiens
aatcttttctga

SEQ ID NO: 4301356 - DNA, 13 bp, Homo sapiens
aatcttttctgag

SEQ ID NO: 4301357 - DNA, 17 bp, Homo sapiens
aatgaaataccaactat

SEQ ID NO: 4301358 - DNA, 14 bp, Homo sapiens
aatgaagcaaacac

SEQ ID NO: 4301359 - DNA, 23 bp, Homo sapiens
aatgacgtattgtgaaatttgtt

SEQ ID NO: 4301360 - DNA, 17 bp, Homo sapiens
aatgactataaacatta

SEQ ID NO: 4301361 - DNA, 18 bp, Homo sapiens
aatgagtttaaaaaaata

SEQ ID NO: 4301362 - DNA, 14 bp, Homo sapiens
aatgatattgctga

SEQ ID NO: 4301363 - DNA, 14 bp, Homo sapiens
aatgatcttccaaa

SEQ ID NO: 4301364 - DNA, 11 bp, Homo sapiens
aatgattccaa

SEQ ID NO: 4301365 - DNA, 13 bp, Homo sapiens
aatgattccaaat

SEQ ID NO: 4301366 - DNA, 18 bp, Homo sapiens
aatgattgtttaattgta

SEQ ID NO: 4301367 - DNA, 18 bp, Homo sapiens
aatgatttaagcatttta

SEQ ID NO: 4301368 - DNA, 24 bp, Homo sapiens
aatgcacatttgtcactgaataat

SEQ ID NO: 4301369 - DNA, 20 bp, Homo sapiens
aatgcagcttcaggtgagcc

SEQ ID NO: 4301370 - DNA, 19 bp, Homo sapiens
aatgcatgatattgtatgt

SEQ ID NO: 4301371 - DNA, 23 bp, Homo sapiens
aatgcatgatattgtatgtacct

SEQ ID NO: 4301372 - DNA, 23 bp, Homo sapiens
aatgccacggcagccaccctgcc

SEQ ID NO: 4301373 - DNA, 17 bp, Homo sapiens
aatgcctattgtaatat

SEQ ID NO: 4301374 - DNA, 22 bp, Homo sapiens
aatgcgctcttcaccaggaaga

SEQ ID NO: 4301375 - DNA, 13 bp, Homo sapiens
aatgctgatttaa

SEQ ID NO: 4301376 - DNA, 19 bp, Homo sapiens
aatgctgtatgtcattaaa

SEQ ID NO: 4301377 - DNA, 21 bp, Homo sapiens
aatgctgtatgtcattaaagt

SEQ ID NO: 4301378 - DNA, 12 bp, Homo sapiens
aatgcttttcta

SEQ ID NO: 4301379 - DNA, 23 bp, Homo sapiens
aatgcttttctagcaactgttgg

SEQ ID NO: 4301380 - DNA, 16 bp, Homo sapiens
aatggaagagagaaag

SEQ ID NO: 4301381 - DNA, 15 bp, Homo sapiens
aatggagtccagacc

SEQ ID NO: 4301382 - DNA, 16 bp, Homo sapiens
aatggctgggtttggg

SEQ ID NO: 4301383 - DNA, 17 bp, Homo sapiens
aatggtgagaattaaaa

SEQ ID NO: 4301384 - DNA, 19 bp, Homo sapiens
aatggtgagaattaaaata

SEQ ID NO: 4301385 - DNA, 15 bp, Homo sapiens
aatgtactttcattc

SEQ ID NO: 4301386 - DNA, 17 bp, Homo sapiens
aatgtagcttcagtcat

SEQ ID NO: 4301387 - DNA, 18 bp, Homo sapiens
aatgtatcttatttatat

SEQ ID NO: 4301388 - DNA, 15 bp, Homo sapiens
aatgtatgtaaatag

SEQ ID NO: 4301389 - DNA, 15 bp, Homo sapiens
aatgtatgtgaaagt

SEQ ID NO: 4301390 - DNA, 19 bp, Homo sapiens
aatgtatgtgaaagtgtaa

SEQ ID NO: 4301391 - DNA, 20 bp, Homo sapiens
aatgtatgtgaaagtgtaaa

SEQ ID NO: 4301392 - DNA, 23 bp, Homo sapiens
aatgtcataaagtgagaaaactg

SEQ ID NO: 4301393 - DNA, 16 bp, Homo sapiens
aatgtccccattctat

SEQ ID NO: 4301394 - DNA, 14 bp, Homo sapiens
aatgtcctcagagg

SEQ ID NO: 4301395 - DNA, 16 bp, Homo sapiens
aatgtgaaatgtaact

SEQ ID NO: 4301396 - DNA, 20 bp, Homo sapiens
aatgtgcccagtcatgacat

SEQ ID NO: 4301397 - DNA, 20 bp, Homo sapiens
aatgtgcttttccatctaaa

SEQ ID NO: 4301398 - DNA, 21 bp, Homo sapiens
aatgtgcttttccatctaaaa

SEQ ID NO: 4301399 - DNA, 22 bp, Homo sapiens
aatgtgcttttccatctaaaat

SEQ ID NO: 4301400 - DNA, 16 bp, Homo sapiens
aatgtggcagctgtct

SEQ ID NO: 4301401 - DNA, 16 bp, Homo sapiens
aatgttatatcatcaa

SEQ ID NO: 4301402 - DNA, 19 bp, Homo sapiens
aatgttcacgcaacttgaa

SEQ ID NO: 4301403 - DNA, 21 bp, Homo sapiens
aatgttctgaataatttctta

SEQ ID NO: 4301404 - DNA, 15 bp, Homo sapiens
aatgtttcatttgca

SEQ ID NO: 4301405 - DNA, 23 bp, Homo sapiens
aatgtttccaggcatgaccctgg

SEQ ID NO: 4301406 - DNA, 12 bp, Homo sapiens
aatgtttctttt

SEQ ID NO: 4301407 - DNA, 11 bp, Homo sapiens
aattaaaaaat

SEQ ID NO: 4301408 - DNA, 19 bp, Homo sapiens
aattaaacaaattccttcc

SEQ ID NO: 4301409 - DNA, 23 bp, Homo sapiens
aattaacctttcaggaaagtatc

SEQ ID NO: 4301410 - DNA, 23 bp, Homo sapiens
aattacaattgtcatttataaaa

SEQ ID NO: 4301411 - DNA, 20 bp, Homo sapiens
aattacagaagaagctcctg

SEQ ID NO: 4301412 - DNA, 16 bp, Homo sapiens
aattaccatttgttaa

SEQ ID NO: 4301413 - DNA, 23 bp, Homo sapiens
aattaccatttgttaatatcact

SEQ ID NO: 4301414 - DNA, 16 bp, Homo sapiens
aattagatccattaat

SEQ ID NO: 4301415 - DNA, 20 bp, Homo sapiens
aattagatccattaatttaa

SEQ ID NO: 4301416 - DNA, 21 bp, Homo sapiens
aattagatccattaatttaaa

SEQ ID NO: 4301417 - DNA, 13 bp, Homo sapiens
aattagatttctc

SEQ ID NO: 4301418 - DNA, 22 bp, Homo sapiens
aattagctctcgcctcaggctt

SEQ ID NO: 4301419 - DNA, 19 bp, Homo sapiens
aattagggctctaatttcc

SEQ ID NO: 4301420 - DNA, 14 bp, Homo sapiens
aattagtgagattt

SEQ ID NO: 4301421 - DNA, 16 bp, Homo sapiens
aattagtgagatttgt

SEQ ID NO: 4301422 - DNA, 22 bp, Homo sapiens
aattatatcagagtatgtcagt

SEQ ID NO: 4301423 - DNA, 22 bp, Homo sapiens
aattattctagtcaactgctgt

SEQ ID NO: 4301424 - DNA, 15 bp, Homo sapiens
aattcacaaagttaa

SEQ ID NO: 4301425 - DNA, 21 bp, Homo sapiens
aattcgagacaggcagaatca

SEQ ID NO: 4301426 - DNA, 18 bp, Homo sapiens
aattctaagattgtacat

SEQ ID NO: 4301427 - DNA, 19 bp, Homo sapiens
aattctcttttcaaacaca

SEQ ID NO: 4301428 - DNA, 23 bp, Homo sapiens
aattctcttttcaaacacacaca

SEQ ID NO: 4301429 - DNA, 13 bp, Homo sapiens
aattctgtccctg

SEQ ID NO: 4301430 - DNA, 23 bp, Homo sapiens
aattctgtccctgtccctgcccc

SEQ ID NO: 4301431 - DNA, 16 bp, Homo sapiens
aattcttttgaaagat

SEQ ID NO: 4301432 - DNA, 17 bp, Homo sapiens
aattcttttgaaagatg

SEQ ID NO: 4301433 - DNA, 23 bp, Homo sapiens
aattcttttgaaagatggtaatc

SEQ ID NO: 4301434 - DNA, 16 bp, Homo sapiens
aattgaaaagaagtag

SEQ ID NO: 4301435 - DNA, 20 bp, Homo sapiens
aattgaagtcatcataaaag

SEQ ID NO: 4301436 - DNA, 19 bp, Homo sapiens
aattgacctgatttccatt

SEQ ID NO: 4301437 - DNA, 14 bp, Homo sapiens
aattgaggtctgct

SEQ ID NO: 4301438 - DNA, 19 bp, Homo sapiens
aattgaggtctgctcggcc

SEQ ID NO: 4301439 - DNA, 15 bp, Homo sapiens
aattgatgggtgggc

SEQ ID NO: 4301440 - DNA, 21 bp, Homo sapiens
aattgatgggtgggctagtaa

SEQ ID NO: 4301441 - DNA, 15 bp, Homo sapiens
aattgcctgacgaac

SEQ ID NO: 4301442 - DNA, 23 bp, Homo sapiens
aattgcctgacgaactccttgat

SEQ ID NO: 4301443 - DNA, 13 bp, Homo sapiens
aattggcttgttt

SEQ ID NO: 4301444 - DNA, 23 bp, Homo sapiens
aattggcttgtttaaggttcttg

SEQ ID NO: 4301445 - DNA, 19 bp, Homo sapiens
aattggtgataagtggaaa

SEQ ID NO: 4301446 - DNA, 20 bp, Homo sapiens
aattggtgataagtggaaaa

SEQ ID NO: 4301447 - DNA, 20 bp, Homo sapiens
aattgtcttttgtcatgtgg

SEQ ID NO: 4301448 - DNA, 13 bp, Homo sapiens
aattgtggagagg

SEQ ID NO: 4301449 - DNA, 16 bp, Homo sapiens
aattgtggagaggaga

SEQ ID NO: 4301450 - DNA, 18 bp, Homo sapiens
aattgtggagaggagaga

SEQ ID NO: 4301451 - DNA, 13 bp, Homo sapiens
aattgttacaatt

SEQ ID NO: 4301452 - DNA, 22 bp, Homo sapiens
aattgtttttagaaatttattc

SEQ ID NO: 4301453 - DNA, 20 bp, Homo sapiens
aatttaactactaagaataa

SEQ ID NO: 4301454 - DNA, 18 bp, Homo sapiens
aatttaactgcatataga

SEQ ID NO: 4301455 - DNA, 15 bp, Homo sapiens
aatttaatatactgc

SEQ ID NO: 4301456 - DNA, 16 bp, Homo sapiens
aatttaatatactgca

SEQ ID NO: 4301457 - DNA, 17 bp, Homo sapiens
aatttaatatactgcat

SEQ ID NO: 4301458 - DNA, 13 bp, Homo sapiens
aatttattcttat

SEQ ID NO: 4301459 - DNA, 16 bp, Homo sapiens
aatttcagtaagatca

SEQ ID NO: 4301460 - DNA, 17 bp, Homo sapiens
aatttcatctttccaaa

SEQ ID NO: 4301461 - DNA, 18 bp, Homo sapiens
aatttcatctttccaaat

SEQ ID NO: 4301462 - DNA, 18 bp, Homo sapiens
aatttgaagacttcaaaa

SEQ ID NO: 4301463 - DNA, 16 bp, Homo sapiens
aatttgttaatatata

SEQ ID NO: 4301464 - DNA, 14 bp, Homo sapiens
aattttaaaaaata

SEQ ID NO: 4301465 - DNA, 17 bp, Homo sapiens
aattttaaaaaataaca

SEQ ID NO: 4301466 - DNA, 13 bp, Homo sapiens
aattttattgctg

SEQ ID NO: 4301467 - DNA, 15 bp, Homo sapiens
acaaacaaataaata

SEQ ID NO: 4301468 - DNA, 17 bp, Homo sapiens
acaaacctctatatgtt

SEQ ID NO: 4301469 - DNA, 22 bp, Homo sapiens
acaaacctctatatgttgctga

SEQ ID NO: 4301470 - DNA, 15 bp, Homo sapiens
acaaacttactgtca

SEQ ID NO: 4301471 - DNA, 12 bp, Homo sapiens
acaaagaaatat

SEQ ID NO: 4301472 - DNA, 14 bp, Homo sapiens
acaaaggacaaaaa

SEQ ID NO: 4301473 - DNA, 16 bp, Homo sapiens
acaaatgtcctcagag

SEQ ID NO: 4301474 - DNA, 14 bp, Homo sapiens
acaaattaaaaaca

SEQ ID NO: 4301475 - DNA, 18 bp, Homo sapiens
acaaattaaaaacaccta

SEQ ID NO: 4301476 - DNA, 15 bp, Homo sapiens
acaaccatagaactg

SEQ ID NO: 4301477 - DNA, 16 bp, Homo sapiens
acaaccatagaactgt

SEQ ID NO: 4301478 - DNA, 14 bp, Homo sapiens
acaaccctgcaaag

SEQ ID NO: 4301479 - DNA, 20 bp, Homo sapiens
acaaccgatgctccagccaa

SEQ ID NO: 4301480 - DNA, 23 bp, Homo sapiens
acaactcatccagaactgtctta

SEQ ID NO: 4301481 - DNA, 21 bp, Homo sapiens
acaactccaggaaaactgttt

SEQ ID NO: 4301482 - DNA, 19 bp, Homo sapiens
acaactgtttttgaagaag

SEQ ID NO: 4301483 - DNA, 22 bp, Homo sapiens
acaactttcactataatgtgaa

SEQ ID NO: 4301484 - DNA, 22 bp, Homo sapiens
acaagaagtgggagtgggagag

SEQ ID NO: 4301485 - DNA, 18 bp, Homo sapiens
acaagaggagcaggaagc

SEQ ID NO: 4301486 - DNA, 19 bp, Homo sapiens
acaagcccaggacactgcc

SEQ ID NO: 4301487 - DNA, 14 bp, Homo sapiens
acaagccccaggca

SEQ ID NO: 4301488 - DNA, 17 bp, Homo sapiens
acaagccccaggcaggc

SEQ ID NO: 4301489 - DNA, 19 bp, Homo sapiens
acaagccccaggcaggctg

SEQ ID NO: 4301490 - DNA, 12 bp, Homo sapiens
acaagcctggag

SEQ ID NO: 4301491 - DNA, 17 bp, Homo sapiens
acaaggccccagagact

SEQ ID NO: 4301492 - DNA, 16 bp, Homo sapiens
acaaggctgaaaagtg

SEQ ID NO: 4301493 - DNA, 18 bp, Homo sapiens
acaagggtggcatcccag

SEQ ID NO: 4301494 - DNA, 23 bp, Homo sapiens
acaataaacgaaacacagaactc

SEQ ID NO: 4301495 - DNA, 13 bp, Homo sapiens
acaataaagtgta

SEQ ID NO: 4301496 - DNA, 14 bp, Homo sapiens
acaataattttcta

SEQ ID NO: 4301497 - DNA, 20 bp, Homo sapiens
acaatatcattttcctggga

SEQ ID NO: 4301498 - DNA, 15 bp, Homo sapiens
acaatggccagccca

SEQ ID NO: 4301499 - DNA, 16 bp, Homo sapiens
acaatggctgggtttg

SEQ ID NO: 4301500 - DNA, 21 bp, Homo sapiens
acaattagataaatgtccatt

SEQ ID NO: 4301501 - DNA, 19 bp, Homo sapiens
acaattatttttgctctgc

SEQ ID NO: 4301502 - DNA, 11 bp, Homo sapiens
acaattctgtc

SEQ ID NO: 4301503 - DNA, 13 bp, Homo sapiens
acaattctgtccc

SEQ ID NO: 4301504 - DNA, 19 bp, Homo sapiens
acaattcttttgaaagatg

SEQ ID NO: 4301505 - DNA, 16 bp, Homo sapiens
acaatttcaaaatgca

SEQ ID NO: 4301506 - DNA, 17 bp, Homo sapiens
acaatttcaaaatgcat

SEQ ID NO: 4301507 - DNA, 20 bp, Homo sapiens
acaatttcaaaatgcatgtg

SEQ ID NO: 4301508 - DNA, 21 bp, Homo sapiens
acaattttctatttaaaaaat

SEQ ID NO: 4301509 - DNA, 18 bp, Homo sapiens
acacaaataccagagcac

SEQ ID NO: 4301510 - DNA, 17 bp, Homo sapiens
acacaactcatccagaa

SEQ ID NO: 4301511 - DNA, 12 bp, Homo sapiens
acacaatcaaaa

SEQ ID NO: 4301512 - DNA, 13 bp, Homo sapiens
acacacacacaca

SEQ ID NO: 4301513 - DNA, 14 bp, Homo sapiens
acacacacccttcc

SEQ ID NO: 4301514 - DNA, 15 bp, Homo sapiens
acacacacccttccc

SEQ ID NO: 4301515 - DNA, 11 bp, Homo sapiens
acacacactct

SEQ ID NO: 4301516 - DNA, 14 bp, Homo sapiens
acacacactcttca

SEQ ID NO: 4301517 - DNA, 14 bp, Homo sapiens
acacactcttcaag

SEQ ID NO: 4301518 - DNA, 16 bp, Homo sapiens
acacagaactcagcct

SEQ ID NO: 4301519 - DNA, 12 bp, Homo sapiens
acacagactctg

SEQ ID NO: 4301520 - DNA, 20 bp, Homo sapiens
acacagaggacggcttcccc

SEQ ID NO: 4301521 - DNA, 14 bp, Homo sapiens
acacagattatttg

SEQ ID NO: 4301522 - DNA, 13 bp, Homo sapiens
acacataaatctg

SEQ ID NO: 4301523 - DNA, 23 bp, Homo sapiens
acacattgcacacacagtctgtt

SEQ ID NO: 4301524 - DNA, 23 bp, Homo sapiens
acaccaccaaatgacaagtcaca

SEQ ID NO: 4301525 - DNA, 12 bp, Homo sapiens
acaccagccctg

SEQ ID NO: 4301526 - DNA, 13 bp, Homo sapiens
acaccagccctgg

SEQ ID NO: 4301527 - DNA, 14 bp, Homo sapiens
acaccagccctggt

SEQ ID NO: 4301528 - DNA, 17 bp, Homo sapiens
acacccagtggaaccaa

SEQ ID NO: 4301529 - DNA, 19 bp, Homo sapiens
acaccccctttccatctgt

SEQ ID NO: 4301530 - DNA, 14 bp, Homo sapiens
acaccctctctgtc

SEQ ID NO: 4301531 - DNA, 11 bp, Homo sapiens
acacccttccc

SEQ ID NO: 4301532 - DNA, 17 bp, Homo sapiens
acacccttccccactcc

SEQ ID NO: 4301533 - DNA, 16 bp, Homo sapiens
acacctaagtgactac

SEQ ID NO: 4301534 - DNA, 20 bp, Homo sapiens
acacctgcacacccctgcac

SEQ ID NO: 4301535 - DNA, 22 bp, Homo sapiens
acacctgcacacccctgcacac

SEQ ID NO: 4301536 - DNA, 16 bp, Homo sapiens
acacctgcacaccgtc

SEQ ID NO: 4301537 - DNA, 20 bp, Homo sapiens
acacgcacacacacacacag

SEQ ID NO: 4301538 - DNA, 23 bp, Homo sapiens
acacgcacacacacacacaggag

SEQ ID NO: 4301539 - DNA, 19 bp, Homo sapiens
acacgcccgactctctcca

SEQ ID NO: 4301540 - DNA, 16 bp, Homo sapiens
acacgccttcccctca

SEQ ID NO: 4301541 - DNA, 12 bp, Homo sapiens
acacggcctctg

SEQ ID NO: 4301542 - DNA, 17 bp, Homo sapiens
acacgtggaggaatgct

SEQ ID NO: 4301543 - DNA, 21 bp, Homo sapiens
acacgtggaggaatgctcccc

SEQ ID NO: 4301544 - DNA, 22 bp, Homo sapiens
acacgtggaggaatgctccccc

SEQ ID NO: 4301545 - DNA, 24 bp, Homo sapiens
acacgtggaggaatgctcccccat

SEQ ID NO: 4301546 - DNA, 15 bp, Homo sapiens
acacgttggagtata

SEQ ID NO: 4301547 - DNA, 14 bp, Homo sapiens
acactacgcagaag

SEQ ID NO: 4301548 - DNA, 17 bp, Homo sapiens
acactcaccgagaggaa

SEQ ID NO: 4301549 - DNA, 16 bp, Homo sapiens
acactctaactgtata

SEQ ID NO: 4301550 - DNA, 12 bp, Homo sapiens
acactcttcaag

SEQ ID NO: 4301551 - DNA, 20 bp, Homo sapiens
acactgcctttgctgccttc

SEQ ID NO: 4301552 - DNA, 21 bp, Homo sapiens
acactgcctttgctgccttct

SEQ ID NO: 4301553 - DNA, 16 bp, Homo sapiens
acactggcccctagaa

SEQ ID NO: 4301554 - DNA, 19 bp, Homo sapiens
acactgtatctaaaaaata

SEQ ID NO: 4301555 - DNA, 23 bp, Homo sapiens
acactgtatctaaaaaataactg

SEQ ID NO: 4301556 - DNA, 15 bp, Homo sapiens
acacttattttctga

SEQ ID NO: 4301557 - DNA, 17 bp, Homo sapiens
acacttattttctgaat

SEQ ID NO: 4301558 - DNA, 19 bp, Homo sapiens
acacttcaggctcttctcc

SEQ ID NO: 4301559 - DNA, 13 bp, Homo sapiens
acacttcctgtcc

SEQ ID NO: 4301560 - DNA, 23 bp, Homo sapiens
acacttgggtaattaaaaataaa

SEQ ID NO: 4301561 - DNA, 20 bp, Homo sapiens
acactttacagttctggagg

SEQ ID NO: 4301562 - DNA, 16 bp, Homo sapiens
acacttttcatatcat

SEQ ID NO: 4301563 - DNA, 17 bp, Homo sapiens
acacttttcatatcatt

SEQ ID NO: 4301564 - DNA, 18 bp, Homo sapiens
acacttttcatatcattt

SEQ ID NO: 4301565 - DNA, 16 bp, Homo sapiens
acagaaacgagatttg

SEQ ID NO: 4301566 - DNA, 13 bp, Homo sapiens
acagacctcggct

SEQ ID NO: 4301567 - DNA, 23 bp, Homo sapiens
acagacctcggctgtgtggggag

SEQ ID NO: 4301568 - DNA, 19 bp, Homo sapiens
acagactctgtgagattct

SEQ ID NO: 4301569 - DNA, 17 bp, Homo sapiens
acagaggcagtggcagc

SEQ ID NO: 4301570 - DNA, 13 bp, Homo sapiens
acagagtatatat

SEQ ID NO: 4301571 - DNA, 20 bp, Homo sapiens
acagagtatatatgtacagt

SEQ ID NO: 4301572 - DNA, 17 bp, Homo sapiens
acagagtggatctggag

SEQ ID NO: 4301573 - DNA, 20 bp, Homo sapiens
acagagtggatctggagtct

SEQ ID NO: 4301574 - DNA, 17 bp, Homo sapiens
acagatcttgagcaagg

SEQ ID NO: 4301575 - DNA, 13 bp, Homo sapiens
acagattatttgt

SEQ ID NO: 4301576 - DNA, 16 bp, Homo sapiens
acagcagagccatctg

SEQ ID NO: 4301577 - DNA, 23 bp, Homo sapiens
acagcagagtaaaattacagaag

SEQ ID NO: 4301578 - DNA, 15 bp, Homo sapiens
acagcagtgtgaggg

SEQ ID NO: 4301579 - DNA, 15 bp, Homo sapiens
acagcatctcagctc

SEQ ID NO: 4301580 - DNA, 16 bp, Homo sapiens
acagcatgtgttaatc

SEQ ID NO: 4301581 - DNA, 21 bp, Homo sapiens
acagcatgtgttaatcttaat

SEQ ID NO: 4301582 - DNA, 10 bp, Homo sapiens
acagccagaa

SEQ ID NO: 4301583 - DNA, 12 bp, Homo sapiens
acagccctgtca

SEQ ID NO: 4301584 - DNA, 13 bp, Homo sapiens
acagccctgtcag

SEQ ID NO: 4301585 - DNA, 19 bp, Homo sapiens
acagcctcacccctgcagg

SEQ ID NO: 4301586 - DNA, 20 bp, Homo sapiens
acagctaatcagcattctca

SEQ ID NO: 4301587 - DNA, 23 bp, Homo sapiens
acagctaggttaataggaggaca

SEQ ID NO: 4301588 - DNA, 18 bp, Homo sapiens
acagctcagaagtttctt

SEQ ID NO: 4301589 - DNA, 19 bp, Homo sapiens
acagcttcacttaaaatca

SEQ ID NO: 4301590 - DNA, 18 bp, Homo sapiens
acagcttgatgctgtttc

SEQ ID NO: 4301591 - DNA, 18 bp, Homo sapiens
acaggaacacccagcccc

SEQ ID NO: 4301592 - DNA, 21 bp, Homo sapiens
acaggaacacccagccccagc

SEQ ID NO: 4301593 - DNA, 16 bp, Homo sapiens
acaggaccaggagcca

SEQ ID NO: 4301594 - DNA, 16 bp, Homo sapiens
acaggagcgtgtacta

SEQ ID NO: 4301595 - DNA, 17 bp, Homo sapiens
acaggatgaactagcca

SEQ ID NO: 4301596 - DNA, 15 bp, Homo sapiens
acaggccatttcatt

SEQ ID NO: 4301597 - DNA, 16 bp, Homo sapiens
acaggcccatgccctc

SEQ ID NO: 4301598 - DNA, 15 bp, Homo sapiens
acaggcccttcctct

SEQ ID NO: 4301599 - DNA, 13 bp, Homo sapiens
acaggcctggccc

SEQ ID NO: 4301600 - DNA, 14 bp, Homo sapiens
acaggcctggccca

SEQ ID NO: 4301601 - DNA, 16 bp, Homo sapiens
acaggcctggcccagc

SEQ ID NO: 4301602 - DNA, 23 bp, Homo sapiens
acaggcctggcccagccagcagg

SEQ ID NO: 4301603 - DNA, 23 bp, Homo sapiens
acaggctgccccacccctccatg

SEQ ID NO: 4301604 - DNA, 17 bp, Homo sapiens
acagggacacagtctgg

SEQ ID NO: 4301605 - DNA, 20 bp, Homo sapiens
acaggtggaggcgagccaga

SEQ ID NO: 4301606 - DNA, 17 bp, Homo sapiens
acagtaaagaccattta

SEQ ID NO: 4301607 - DNA, 13 bp, Homo sapiens
acagtaatcagtt

SEQ ID NO: 4301608 - DNA, 22 bp, Homo sapiens
acagtagctgtggggagctggt

SEQ ID NO: 4301609 - DNA, 18 bp, Homo sapiens
acagtctcattacagatt

SEQ ID NO: 4301610 - DNA, 19 bp, Homo sapiens
acagtctggaggtcccaga

SEQ ID NO: 4301611 - DNA, 14 bp, Homo sapiens
acagtcttcatttt

SEQ ID NO: 4301612 - DNA, 13 bp, Homo sapiens
acagtgaacagct

SEQ ID NO: 4301613 - DNA, 18 bp, Homo sapiens
acagtgcatctcagccca

SEQ ID NO: 4301614 - DNA, 20 bp, Homo sapiens
acagtgtatctcgaagtctt

SEQ ID NO: 4301615 - DNA, 19 bp, Homo sapiens
acagttctcccttcaactg

SEQ ID NO: 4301616 - DNA, 18 bp, Homo sapiens
acataaagtaaatgctac

SEQ ID NO: 4301617 - DNA, 17 bp, Homo sapiens
acataaatctgtctgat

SEQ ID NO: 4301618 - DNA, 18 bp, Homo sapiens
acataaatctgtctgatt

SEQ ID NO: 4301619 - DNA, 21 bp, Homo sapiens
acataatatcttgaagaatat

SEQ ID NO: 4301620 - DNA, 22 bp, Homo sapiens
acataatatcttgaagaatatt

SEQ ID NO: 4301621 - DNA, 20 bp, Homo sapiens
acatacctctctctatatat

SEQ ID NO: 4301622 - DNA, 21 bp, Homo sapiens
acatagtgatggttcccctgt

SEQ ID NO: 4301623 - DNA, 22 bp, Homo sapiens
acatatttgtagctagaatatc

SEQ ID NO: 4301624 - DNA, 20 bp, Homo sapiens
acatcagtggcatggctcca

SEQ ID NO: 4301625 - DNA, 16 bp, Homo sapiens
acatccattccagagc

SEQ ID NO: 4301626 - DNA, 22 bp, Homo sapiens
acatccattccagagctgcaga

SEQ ID NO: 4301627 - DNA, 21 bp, Homo sapiens
acatcggttcaggaggagaca

SEQ ID NO: 4301628 - DNA, 12 bp, Homo sapiens
acatctgaaaag

SEQ ID NO: 4301629 - DNA, 18 bp, Homo sapiens
acatctgaaaagaaatgc

SEQ ID NO: 4301630 - DNA, 19 bp, Homo sapiens
acatgactctttattgtct

SEQ ID NO: 4301631 - DNA, 13 bp, Homo sapiens
acatgagtcccag

SEQ ID NO: 4301632 - DNA, 19 bp, Homo sapiens
acatgagttcaaatacttt

SEQ ID NO: 4301633 - DNA, 13 bp, Homo sapiens
acatgattcattt

SEQ ID NO: 4301634 - DNA, 22 bp, Homo sapiens
acatgcacttggctgcataaat

SEQ ID NO: 4301635 - DNA, 14 bp, Homo sapiens
acatgccctcaggc

SEQ ID NO: 4301636 - DNA, 17 bp, Homo sapiens
acatgccctcaggcttg

SEQ ID NO: 4301637 - DNA, 23 bp, Homo sapiens
acatgccctcaggcttggggatg

SEQ ID NO: 4301638 - DNA, 13 bp, Homo sapiens
acatgctgcccac

SEQ ID NO: 4301639 - DNA, 17 bp, Homo sapiens
acatgctgcccaccccc

SEQ ID NO: 4301640 - DNA, 22 bp, Homo sapiens
acatgctgcccaccccctgctg

SEQ ID NO: 4301641 - DNA, 19 bp, Homo sapiens
acatggattcagtttctaa

SEQ ID NO: 4301642 - DNA, 21 bp, Homo sapiens
acatggggttggctgggccca

SEQ ID NO: 4301643 - DNA, 18 bp, Homo sapiens
acatggtagcagggtctt

SEQ ID NO: 4301644 - DNA, 23 bp, Homo sapiens
acatggtagcagggtctttgtgt

SEQ ID NO: 4301645 - DNA, 13 bp, Homo sapiens
acatgtctaaagt

SEQ ID NO: 4301646 - DNA, 12 bp, Homo sapiens
acatgtttcaga

SEQ ID NO: 4301647 - DNA, 18 bp, Homo sapiens
acattaaaagaagactgg

SEQ ID NO: 4301648 - DNA, 19 bp, Homo sapiens
acattaaaagaagactgga

SEQ ID NO: 4301649 - DNA, 20 bp, Homo sapiens
acattaaaagaagactggaa

SEQ ID NO: 4301650 - DNA, 21 bp, Homo sapiens
acattaaaagaagactggaag

SEQ ID NO: 4301651 - DNA, 19 bp, Homo sapiens
acattaggaacagagtata

SEQ ID NO: 4301652 - DNA, 15 bp, Homo sapiens
acattatagattttc

SEQ ID NO: 4301653 - DNA, 21 bp, Homo sapiens
acattcaaaaacatggccaca

SEQ ID NO: 4301654 - DNA, 23 bp, Homo sapiens
acattccgacaaccgatgctcca

SEQ ID NO: 4301655 - DNA, 18 bp, Homo sapiens
acattctatttcaacttc

SEQ ID NO: 4301656 - DNA, 21 bp, Homo sapiens
acattgccctgaggggcctgc

SEQ ID NO: 4301657 - DNA, 23 bp, Homo sapiens
acattgtattttactttgtgcaa

SEQ ID NO: 4301658 - DNA, 24 bp, Homo sapiens
acattgtccccaatgaatatactc

SEQ ID NO: 4301659 - DNA, 15 bp, Homo sapiens
acatttcgtacaaaa

SEQ ID NO: 4301660 - DNA, 24 bp, Homo sapiens
acatttctggccatttaactagca

SEQ ID NO: 4301661 - DNA, 19 bp, Homo sapiens
acatttgctttttgcttgt

SEQ ID NO: 4301662 - DNA, 15 bp, Homo sapiens
accaaaaaatctata

SEQ ID NO: 4301663 - DNA, 13 bp, Homo sapiens
accaaaactgcct

SEQ ID NO: 4301664 - DNA, 17 bp, Homo sapiens
accaaattaacctttca

SEQ ID NO: 4301665 - DNA, 13 bp, Homo sapiens
accaactctctct

SEQ ID NO: 4301666 - DNA, 15 bp, Homo sapiens
accaactctctctgc

SEQ ID NO: 4301667 - DNA, 15 bp, Homo sapiens
accaactgagccaaa

SEQ ID NO: 4301668 - DNA, 12 bp, Homo sapiens
accaagatgtca

SEQ ID NO: 4301669 - DNA, 18 bp, Homo sapiens
accaagcttagaagccac

SEQ ID NO: 4301670 - DNA, 16 bp, Homo sapiens
accaaggctgcctgcc

SEQ ID NO: 4301671 - DNA, 17 bp, Homo sapiens
accacacttcctgtcca

SEQ ID NO: 4301672 - DNA, 21 bp, Homo sapiens
accacacttcctgtccagaga

SEQ ID NO: 4301673 - DNA, 12 bp, Homo sapiens
accaccaacagg

SEQ ID NO: 4301674 - DNA, 15 bp, Homo sapiens
accacccatatcatg

SEQ ID NO: 4301675 - DNA, 14 bp, Homo sapiens
accaccgctcccca

SEQ ID NO: 4301676 - DNA, 17 bp, Homo sapiens
accaccgctccccagcc

SEQ ID NO: 4301677 - DNA, 18 bp, Homo sapiens
accaccgctccccagccc

SEQ ID NO: 4301678 - DNA, 13 bp, Homo sapiens
accagagcacaga

SEQ ID NO: 4301679 - DNA, 20 bp, Homo sapiens
accagagcctccctcagcca

SEQ ID NO: 4301680 - DNA, 13 bp, Homo sapiens
accagatgagaat

SEQ ID NO: 4301681 - DNA, 16 bp, Homo sapiens
accagatgagaattag

SEQ ID NO: 4301682 - DNA, 12 bp, Homo sapiens
accagcagcaca

SEQ ID NO: 4301683 - DNA, 13 bp, Homo sapiens
accagcagcacaa

SEQ ID NO: 4301684 - DNA, 14 bp, Homo sapiens
accagcagcacaat

SEQ ID NO: 4301685 - DNA, 22 bp, Homo sapiens
accagcagcacaattctgtccc

SEQ ID NO: 4301686 - DNA, 22 bp, Homo sapiens
accagctcaggctactgccact

SEQ ID NO: 4301687 - DNA, 21 bp, Homo sapiens
accaggaagaaggcccgggag

SEQ ID NO: 4301688 - DNA, 21 bp, Homo sapiens
accaggactctgccttccagg

SEQ ID NO: 4301689 - DNA, 11 bp, Homo sapiens
accaggagcca

SEQ ID NO: 4301690 - DNA, 12 bp, Homo sapiens
accaggagccag

SEQ ID NO: 4301691 - DNA, 13 bp, Homo sapiens
accaggagccagg

SEQ ID NO: 4301692 - DNA, 14 bp, Homo sapiens
accaggagccaggt

SEQ ID NO: 4301693 - DNA, 19 bp, Homo sapiens
accaggctcacaactgttt

SEQ ID NO: 4301694 - DNA, 19 bp, Homo sapiens
accagggggaagcaccagc

SEQ ID NO: 4301695 - DNA, 18 bp, Homo sapiens
accagtccctctgagtga

SEQ ID NO: 4301696 - DNA, 20 bp, Homo sapiens
accagtccctctgagtgaag

SEQ ID NO: 4301697 - DNA, 18 bp, Homo sapiens
accataaaataaataatc

SEQ ID NO: 4301698 - DNA, 15 bp, Homo sapiens
accatatgattgaaa

SEQ ID NO: 4301699 - DNA, 23 bp, Homo sapiens
accatatgattgaaaagaagaaa

SEQ ID NO: 4301700 - DNA, 18 bp, Homo sapiens
accatgcattttaccatc

SEQ ID NO: 4301701 - DNA, 16 bp, Homo sapiens
accatggacctgcact

SEQ ID NO: 4301702 - DNA, 19 bp, Homo sapiens
accattatggctttgtgct

SEQ ID NO: 4301703 - DNA, 15 bp, Homo sapiens
accattccccatggg

SEQ ID NO: 4301704 - DNA, 19 bp, Homo sapiens
accatttagtcctcacctt

SEQ ID NO: 4301705 - DNA, 15 bp, Homo sapiens
accatttgttaatat

SEQ ID NO: 4301706 - DNA, 18 bp, Homo sapiens
accattttgcgatgtgtt

SEQ ID NO: 4301707 - DNA, 18 bp, Homo sapiens
acccacactacgcagaag

SEQ ID NO: 4301708 - DNA, 19 bp, Homo sapiens
acccacactacgcagaaga

SEQ ID NO: 4301709 - DNA, 13 bp, Homo sapiens
acccaccctctgg

SEQ ID NO: 4301710 - DNA, 20 bp, Homo sapiens
acccagcaggggcagaagga

SEQ ID NO: 4301711 - DNA, 21 bp, Homo sapiens
acccagggtggtcttcaagcc

SEQ ID NO: 4301712 - DNA, 15 bp, Homo sapiens
acccagtgtctacct

SEQ ID NO: 4301713 - DNA, 15 bp, Homo sapiens
acccattcacatttt

SEQ ID NO: 4301714 - DNA, 22 bp, Homo sapiens
accccacaggatgaactagcca

SEQ ID NO: 4301715 - DNA, 13 bp, Homo sapiens
accccaccacaca

SEQ ID NO: 4301716 - DNA, 20 bp, Homo sapiens
accccagcagtcctgggccc

SEQ ID NO: 4301717 - DNA, 11 bp, Homo sapiens
accccagctcc

SEQ ID NO: 4301718 - DNA, 15 bp, Homo sapiens
accccagctccaggc

SEQ ID NO: 4301719 - DNA, 16 bp, Homo sapiens
accccagctccaggca

SEQ ID NO: 4301720 - DNA, 21 bp, Homo sapiens
accccaggaagtcatcctgca

SEQ ID NO: 4301721 - DNA, 22 bp, Homo sapiens
accccaggacgcatgcagggcc

SEQ ID NO: 4301722 - DNA, 18 bp, Homo sapiens
accccagtccccgggaaa

SEQ ID NO: 4301723 - DNA, 20 bp, Homo sapiens
accccatccagccaggggtg

SEQ ID NO: 4301724 - DNA, 13 bp, Homo sapiens
acccccacccctt

SEQ ID NO: 4301725 - DNA, 13 bp, Homo sapiens
acccccagcaacc

SEQ ID NO: 4301726 - DNA, 16 bp, Homo sapiens
acccccagcaaccctc

SEQ ID NO: 4301727 - DNA, 14 bp, Homo sapiens
acccccctccccaa

SEQ ID NO: 4301728 - DNA, 16 bp, Homo sapiens
accccctccctggcct

SEQ ID NO: 4301729 - DNA, 14 bp, Homo sapiens
accccctcggagcc

SEQ ID NO: 4301730 - DNA, 14 bp, Homo sapiens
accccgcctctggg

SEQ ID NO: 4301731 - DNA, 22 bp, Homo sapiens
accccggggcatggacagggcc

SEQ ID NO: 4301732 - DNA, 23 bp, Homo sapiens
accccggggcatggacagggcca

SEQ ID NO: 4301733 - DNA, 17 bp, Homo sapiens
accccgtccctttccct

SEQ ID NO: 4301734 - DNA, 18 bp, Homo sapiens
accccgtccctttccctg

SEQ ID NO: 4301735 - DNA, 21 bp, Homo sapiens
accccgtccctttccctgcat

SEQ ID NO: 4301736 - DNA, 22 bp, Homo sapiens
accccgtccctttccctgcatc

SEQ ID NO: 4301737 - DNA, 15 bp, Homo sapiens
acccctaccctttcc

SEQ ID NO: 4301738 - DNA, 19 bp, Homo sapiens
acccctcaccttgcaacac

SEQ ID NO: 4301739 - DNA, 14 bp, Homo sapiens
acccctcttcccac

SEQ ID NO: 4301740 - DNA, 15 bp, Homo sapiens
acccctcttcccacc

SEQ ID NO: 4301741 - DNA, 13 bp, Homo sapiens
acccctcttcccc

SEQ ID NO: 4301742 - DNA, 18 bp, Homo sapiens
acccctcttcccccttcc

SEQ ID NO: 4301743 - DNA, 16 bp, Homo sapiens
acccctgcacacacct

SEQ ID NO: 4301744 - DNA, 17 bp, Homo sapiens
acccctggcttttcact

SEQ ID NO: 4301745 - DNA, 20 bp, Homo sapiens
acccctggcttttcactgct

SEQ ID NO: 4301746 - DNA, 21 bp, Homo sapiens
acccctgtctgcgccgctgtg

SEQ ID NO: 4301747 - DNA, 16 bp, Homo sapiens
accccttccccactgc

SEQ ID NO: 4301748 - DNA, 18 bp, Homo sapiens
accccttccccactgcct

SEQ ID NO: 4301749 - DNA, 18 bp, Homo sapiens
acccctttggcacaccct

SEQ ID NO: 4301750 - DNA, 23 bp, Homo sapiens
acccggagctaacactggcccct

SEQ ID NO: 4301751 - DNA, 15 bp, Homo sapiens
acccggaggggcctg

SEQ ID NO: 4301752 - DNA, 16 bp, Homo sapiens
acccggatctccaggc

SEQ ID NO: 4301753 - DNA, 22 bp, Homo sapiens
acccggatctccaggcccagcc

SEQ ID NO: 4301754 - DNA, 22 bp, Homo sapiens
acccggcatgccgagtgcccca

SEQ ID NO: 4301755 - DNA, 19 bp, Homo sapiens
acccggcccccgccctctg

SEQ ID NO: 4301756 - DNA, 19 bp, Homo sapiens
acccgtcctggggtggttg

SEQ ID NO: 4301757 - DNA, 18 bp, Homo sapiens
acccgtgccacgcgctct

SEQ ID NO: 4301758 - DNA, 20 bp, Homo sapiens
acccgtgccacgcgctctgc

SEQ ID NO: 4301759 - DNA, 21 bp, Homo sapiens
acccgtgccacgcgctctgca

SEQ ID NO: 4301760 - DNA, 13 bp, Homo sapiens
acccgttcaactt

SEQ ID NO: 4301761 - DNA, 15 bp, Homo sapiens
acccgtttccaagcc

SEQ ID NO: 4301762 - DNA, 17 bp, Homo sapiens
accctaggtctccaccc

SEQ ID NO: 4301763 - DNA, 21 bp, Homo sapiens
accctaggtctccacccctca

SEQ ID NO: 4301764 - DNA, 23 bp, Homo sapiens
accctaggtctccacccctcaag

SEQ ID NO: 4301765 - DNA, 18 bp, Homo sapiens
accctcagagccacccct

SEQ ID NO: 4301766 - DNA, 18 bp, Homo sapiens
accctccctcagcccctc

SEQ ID NO: 4301767 - DNA, 20 bp, Homo sapiens
accctccctcagcccctctt

SEQ ID NO: 4301768 - DNA, 17 bp, Homo sapiens
accctccctgtcccctg

SEQ ID NO: 4301769 - DNA, 18 bp, Homo sapiens
accctcggggcaggaagt

SEQ ID NO: 4301770 - DNA, 14 bp, Homo sapiens
accctctctgtcca

SEQ ID NO: 4301771 - DNA, 16 bp, Homo sapiens
accctctgcagggcag

SEQ ID NO: 4301772 - DNA, 15 bp, Homo sapiens
accctctgctatgtc

SEQ ID NO: 4301773 - DNA, 17 bp, Homo sapiens
accctctggtccttctg

SEQ ID NO: 4301774 - DNA, 22 bp, Homo sapiens
accctgagggtttccaccttgg

SEQ ID NO: 4301775 - DNA, 18 bp, Homo sapiens
accctgcaaaggactgtt

SEQ ID NO: 4301776 - DNA, 18 bp, Homo sapiens
accctgccaactttccag

SEQ ID NO: 4301777 - DNA, 12 bp, Homo sapiens
accctgcccctg

SEQ ID NO: 4301778 - DNA, 14 bp, Homo sapiens
accctgcccctgcc

SEQ ID NO: 4301779 - DNA, 14 bp, Homo sapiens
acccttccccactc

SEQ ID NO: 4301780 - DNA, 14 bp, Homo sapiens
acccttttggcccc

SEQ ID NO: 4301781 - DNA, 12 bp, Homo sapiens
accgaatattga

SEQ ID NO: 4301782 - DNA, 17 bp, Homo sapiens
accgaggctggagctgg

SEQ ID NO: 4301783 - DNA, 21 bp, Homo sapiens
accgagtctcttctccactgg

SEQ ID NO: 4301784 - DNA, 24 bp, Homo sapiens
accgagtctcttctccactggatg

SEQ ID NO: 4301785 - DNA, 21 bp, Homo sapiens
accgagtgtggagctgcttcc

SEQ ID NO: 4301786 - DNA, 14 bp, Homo sapiens
accgctccccagcc

SEQ ID NO: 4301787 - DNA, 20 bp, Homo sapiens
accggacgcatgcagggccc

SEQ ID NO: 4301788 - DNA, 19 bp, Homo sapiens
accgggagcctgcgtggcc

SEQ ID NO: 4301789 - DNA, 16 bp, Homo sapiens
accgggccgctagatg

SEQ ID NO: 4301790 - DNA, 22 bp, Homo sapiens
accggggagcccccgccccgcc

SEQ ID NO: 4301791 - DNA, 23 bp, Homo sapiens
accggggtcctgaggctggggct

SEQ ID NO: 4301792 - DNA, 13 bp, Homo sapiens
accgtccctctcc

SEQ ID NO: 4301793 - DNA, 22 bp, Homo sapiens
accgtgtgctccagtgttttct

SEQ ID NO: 4301794 - DNA, 23 bp, Homo sapiens
acctaaacatagaaattgcctga

SEQ ID NO: 4301795 - DNA, 15 bp, Homo sapiens
acctaattaatttca

SEQ ID NO: 4301796 - DNA, 17 bp, Homo sapiens
acctacagtggagggag

SEQ ID NO: 4301797 - DNA, 18 bp, Homo sapiens
acctacagtggagggaga

SEQ ID NO: 4301798 - DNA, 20 bp, Homo sapiens
acctaggagcagtgggccct

SEQ ID NO: 4301799 - DNA, 15 bp, Homo sapiens
acctatgtcatttca

SEQ ID NO: 4301800 - DNA, 22 bp, Homo sapiens
acctatgtcatttcatttccta

SEQ ID NO: 4301801 - DNA, 17 bp, Homo sapiens
acctcaacaaagaagaa

SEQ ID NO: 4301802 - DNA, 16 bp, Homo sapiens
acctcaacctgtgatg

SEQ ID NO: 4301803 - DNA, 16 bp, Homo sapiens
acctcaagctgcatct

SEQ ID NO: 4301804 - DNA, 14 bp, Homo sapiens
acctcactgccctc

SEQ ID NO: 4301805 - DNA, 18 bp, Homo sapiens
acctcactggtgcattta

SEQ ID NO: 4301806 - DNA, 19 bp, Homo sapiens
acctcactggtgcatttaa

SEQ ID NO: 4301807 - DNA, 20 bp, Homo sapiens
acctcagagtccaggcccca

SEQ ID NO: 4301808 - DNA, 13 bp, Homo sapiens
acctcaggggaga

SEQ ID NO: 4301809 - DNA, 11 bp, Homo sapiens
acctccacccg

SEQ ID NO: 4301810 - DNA, 14 bp, Homo sapiens
acctccacctggga

SEQ ID NO: 4301811 - DNA, 19 bp, Homo sapiens
acctcccctccttgcctcc

SEQ ID NO: 4301812 - DNA, 22 bp, Homo sapiens
acctcccctccttgcctcctgt

SEQ ID NO: 4301813 - DNA, 16 bp, Homo sapiens
acctcccctggtcctg

SEQ ID NO: 4301814 - DNA, 18 bp, Homo sapiens
acctcccctggtcctgca

SEQ ID NO: 4301815 - DNA, 20 bp, Homo sapiens
acctcgaagctgttctctgc

SEQ ID NO: 4301816 - DNA, 15 bp, Homo sapiens
acctcgccgtgtctt

SEQ ID NO: 4301817 - DNA, 13 bp, Homo sapiens
acctcggctgtgt

SEQ ID NO: 4301818 - DNA, 17 bp, Homo sapiens
acctctctctatatata

SEQ ID NO: 4301819 - DNA, 12 bp, Homo sapiens
acctctggccct

SEQ ID NO: 4301820 - DNA, 15 bp, Homo sapiens
acctctggccctgtt

SEQ ID NO: 4301821 - DNA, 14 bp, Homo sapiens
acctgaagaatcac

SEQ ID NO: 4301822 - DNA, 21 bp, Homo sapiens
acctgaagagcgctcctctgc

SEQ ID NO: 4301823 - DNA, 18 bp, Homo sapiens
acctgcacacccctgcac

SEQ ID NO: 4301824 - DNA, 20 bp, Homo sapiens
acctgcacaccgtccctctc

SEQ ID NO: 4301825 - DNA, 17 bp, Homo sapiens
acctgcacttggcctct

SEQ ID NO: 4301826 - DNA, 14 bp, Homo sapiens
acctgcagccccag

SEQ ID NO: 4301827 - DNA, 15 bp, Homo sapiens
acctgcagccccagg

SEQ ID NO: 4301828 - DNA, 16 bp, Homo sapiens
acctgcagccccaggc

SEQ ID NO: 4301829 - DNA, 13 bp, Homo sapiens
acctgcaggactc

SEQ ID NO: 4301830 - DNA, 19 bp, Homo sapiens
acctgcaggactcgggcta

SEQ ID NO: 4301831 - DNA, 13 bp, Homo sapiens
acctgcagggagc

SEQ ID NO: 4301832 - DNA, 17 bp, Homo sapiens
acctgcagttggcctca

SEQ ID NO: 4301833 - DNA, 19 bp, Homo sapiens
acctgcagttggcctcagc

SEQ ID NO: 4301834 - DNA, 21 bp, Homo sapiens
acctgcagttggcctcagcag

SEQ ID NO: 4301835 - DNA, 17 bp, Homo sapiens
acctgcccccactcagc

SEQ ID NO: 4301836 - DNA, 15 bp, Homo sapiens
acctgcccccttctc

SEQ ID NO: 4301837 - DNA, 17 bp, Homo sapiens
acctgctgcccgtgagg

SEQ ID NO: 4301838 - DNA, 19 bp, Homo sapiens
acctgctgcccgtgaggag

SEQ ID NO: 4301839 - DNA, 21 bp, Homo sapiens
acctgctggcccctcacctgg

SEQ ID NO: 4301840 - DNA, 19 bp, Homo sapiens
acctgcttgtgttgggccc

SEQ ID NO: 4301841 - DNA, 23 bp, Homo sapiens
acctgcttgtgttgggccccagg

SEQ ID NO: 4301842 - DNA, 17 bp, Homo sapiens
acctgggagatgctggg

SEQ ID NO: 4301843 - DNA, 13 bp, Homo sapiens
acctgggcacctg

SEQ ID NO: 4301844 - DNA, 17 bp, Homo sapiens
acctgggccctaggcat

SEQ ID NO: 4301845 - DNA, 19 bp, Homo sapiens
acctgggtgtgctccaggc

SEQ ID NO: 4301846 - DNA, 23 bp, Homo sapiens
acctgggtgtgctccaggcttcc

SEQ ID NO: 4301847 - DNA, 14 bp, Homo sapiens
acctggtctctcct

SEQ ID NO: 4301848 - DNA, 20 bp, Homo sapiens
acctgtaatagcctcacctt

SEQ ID NO: 4301849 - DNA, 20 bp, Homo sapiens
acctgtattgtctgacttct

SEQ ID NO: 4301850 - DNA, 13 bp, Homo sapiens
acctgtgctgctg

SEQ ID NO: 4301851 - DNA, 19 bp, Homo sapiens
acctgtggggatttctccc

SEQ ID NO: 4301852 - DNA, 15 bp, Homo sapiens
accttaatatttctt

SEQ ID NO: 4301853 - DNA, 19 bp, Homo sapiens
accttacttaaagcttgtt

SEQ ID NO: 4301854 - DNA, 20 bp, Homo sapiens
accttacttaaagcttgttt

SEQ ID NO: 4301855 - DNA, 20 bp, Homo sapiens
accttcaccaagcttagaag

SEQ ID NO: 4301856 - DNA, 14 bp, Homo sapiens
accttcagcagtta

SEQ ID NO: 4301857 - DNA, 23 bp, Homo sapiens
accttcattttctaattctcttt

SEQ ID NO: 4301858 - DNA, 20 bp, Homo sapiens
accttccatgtcaagattca

SEQ ID NO: 4301859 - DNA, 17 bp, Homo sapiens
accttccctagttcttt

SEQ ID NO: 4301860 - DNA, 18 bp, Homo sapiens
accttcctgggcagccca

SEQ ID NO: 4301861 - DNA, 21 bp, Homo sapiens
accttgcattttagctaattt

SEQ ID NO: 4301862 - DNA, 22 bp, Homo sapiens
acctttaaaaaataatttagat

SEQ ID NO: 4301863 - DNA, 17 bp, Homo sapiens
accttttcttgtatctg

SEQ ID NO: 4301864 - DNA, 13 bp, Homo sapiens
acgagatcttcct

SEQ ID NO: 4301865 - DNA, 15 bp, Homo sapiens
acgagatcttccttc

SEQ ID NO: 4301866 - DNA, 20 bp, Homo sapiens
acgattcatttttgaaactg

SEQ ID NO: 4301867 - DNA, 13 bp, Homo sapiens
acgatttaattta

SEQ ID NO: 4301868 - DNA, 14 bp, Homo sapiens
acgatttaatttat

SEQ ID NO: 4301869 - DNA, 24 bp, Homo sapiens
acgcaagcctcagccactcccagg

SEQ ID NO: 4301870 - DNA, 12 bp, Homo sapiens
acgcacacacac

SEQ ID NO: 4301871 - DNA, 19 bp, Homo sapiens
acgcacacacacacacagg

SEQ ID NO: 4301872 - DNA, 14 bp, Homo sapiens
acgcagaagagaaa

SEQ ID NO: 4301873 - DNA, 20 bp, Homo sapiens
acgcagaagagaaagtacaa

SEQ ID NO: 4301874 - DNA, 15 bp, Homo sapiens
acgcagggagaccct

SEQ ID NO: 4301875 - DNA, 16 bp, Homo sapiens
acgcagggagaccctg

SEQ ID NO: 4301876 - DNA, 20 bp, Homo sapiens
acgcagggagaccctgggag

SEQ ID NO: 4301877 - DNA, 15 bp, Homo sapiens
acgcatgcagggccc

SEQ ID NO: 4301878 - DNA, 14 bp, Homo sapiens
acgccaaccccagc

SEQ ID NO: 4301879 - DNA, 18 bp, Homo sapiens
acgccccccggcctgatg

SEQ ID NO: 4301880 - DNA, 18 bp, Homo sapiens
acgcctgcgatggtgctg

SEQ ID NO: 4301881 - DNA, 21 bp, Homo sapiens
acgcctgcgatggtgctgcac

SEQ ID NO: 4301882 - DNA, 14 bp, Homo sapiens
acgccttcccctca

SEQ ID NO: 4301883 - DNA, 17 bp, Homo sapiens
acgccttcccctcagcc

SEQ ID NO: 4301884 - DNA, 14 bp, Homo sapiens
acgcgctctgcatg

SEQ ID NO: 4301885 - DNA, 22 bp, Homo sapiens
acgctctaaggcaggatgtggc

SEQ ID NO: 4301886 - DNA, 13 bp, Homo sapiens
acgctctctgtct

SEQ ID NO: 4301887 - DNA, 20 bp, Homo sapiens
acgctctctgtctggctgta

SEQ ID NO: 4301888 - DNA, 11 bp, Homo sapiens
acgctgtctcc

SEQ ID NO: 4301889 - DNA, 19 bp, Homo sapiens
acgctgtctccagaccccc

SEQ ID NO: 4301890 - DNA, 23 bp, Homo sapiens
acgctgtctccagacccccaccc

SEQ ID NO: 4301891 - DNA, 22 bp, Homo sapiens
acggaagtggcctgagaagagt

SEQ ID NO: 4301892 - DNA, 16 bp, Homo sapiens
acggctcctccccgat

SEQ ID NO: 4301893 - DNA, 17 bp, Homo sapiens
acggctcctccccgatc

SEQ ID NO: 4301894 - DNA, 18 bp, Homo sapiens
acggctctaggtggggcg

SEQ ID NO: 4301895 - DNA, 12 bp, Homo sapiens
acggctgcacct

SEQ ID NO: 4301896 - DNA, 20 bp, Homo sapiens
acggctgcacctgcagggag

SEQ ID NO: 4301897 - DNA, 15 bp, Homo sapiens
acggggacacggcct

SEQ ID NO: 4301898 - DNA, 23 bp, Homo sapiens
acggggaggccaagtgcaggctg

SEQ ID NO: 4301899 - DNA, 17 bp, Homo sapiens
acgtattgtgaaatttg

SEQ ID NO: 4301900 - DNA, 19 bp, Homo sapiens
acgtctaacttcatgctgt

SEQ ID NO: 4301901 - DNA, 19 bp, Homo sapiens
acgtctagctatgctgtat

SEQ ID NO: 4301902 - DNA, 23 bp, Homo sapiens
acgtctagctatgctgtatctgt

SEQ ID NO: 4301903 - DNA, 18 bp, Homo sapiens
acgtctggtgttctcaat

SEQ ID NO: 4301904 - DNA, 15 bp, Homo sapiens
acgtgaagcctcccg

SEQ ID NO: 4301905 - DNA, 12 bp, Homo sapiens
acgtgtgaggat

SEQ ID NO: 4301906 - DNA, 13 bp, Homo sapiens
acgttaattaaac

SEQ ID NO: 4301907 - DNA, 14 bp, Homo sapiens
acgttatctcattg

SEQ ID NO: 4301908 - DNA, 16 bp, Homo sapiens
acgtttagaaatgatt

SEQ ID NO: 4301909 - DNA, 19 bp, Homo sapiens
acgtttagaaatgatttca

SEQ ID NO: 4301910 - DNA, 21 bp, Homo sapiens
acgttttgcctcatgaacact

SEQ ID NO: 4301911 - DNA, 19 bp, Homo sapiens
actaaaattcaacaaatga

SEQ ID NO: 4301912 - DNA, 18 bp, Homo sapiens
actaaacttggtgcttat

SEQ ID NO: 4301913 - DNA, 22 bp, Homo sapiens
actaaacttggtgcttattgat

SEQ ID NO: 4301914 - DNA, 23 bp, Homo sapiens
actaaacttggtgcttattgata

SEQ ID NO: 4301915 - DNA, 19 bp, Homo sapiens
actaaagggtgtgggtcag

SEQ ID NO: 4301916 - DNA, 17 bp, Homo sapiens
actaatacagctgagct

SEQ ID NO: 4301917 - DNA, 14 bp, Homo sapiens
actaattaaaaaat

SEQ ID NO: 4301918 - DNA, 14 bp, Homo sapiens
actacatgcacttg

SEQ ID NO: 4301919 - DNA, 14 bp, Homo sapiens
actaccaaaatgaa

SEQ ID NO: 4301920 - DNA, 21 bp, Homo sapiens
actaccaaaatgaagacacgc

SEQ ID NO: 4301921 - DNA, 12 bp, Homo sapiens
actactcagcat

SEQ ID NO: 4301922 - DNA, 16 bp, Homo sapiens
actagagatattttgt

SEQ ID NO: 4301923 - DNA, 18 bp, Homo sapiens
actagagatattttgtaa

SEQ ID NO: 4301924 - DNA, 19 bp, Homo sapiens
actagagatattttgtaaa

SEQ ID NO: 4301925 - DNA, 13 bp, Homo sapiens
actagatctcctg

SEQ ID NO: 4301926 - DNA, 15 bp, Homo sapiens
actagatctcctgta

SEQ ID NO: 4301927 - DNA, 16 bp, Homo sapiens
actagatctcctgtaa

SEQ ID NO: 4301928 - DNA, 17 bp, Homo sapiens
actagatctcctgtaat

SEQ ID NO: 4301929 - DNA, 18 bp, Homo sapiens
actagatctcctgtaatt

SEQ ID NO: 4301930 - DNA, 16 bp, Homo sapiens
actaggccctggtctg

SEQ ID NO: 4301931 - DNA, 17 bp, Homo sapiens
actaggccctggtctgg

SEQ ID NO: 4301932 - DNA, 17 bp, Homo sapiens
actagggtcctcaggca

SEQ ID NO: 4301933 - DNA, 18 bp, Homo sapiens
actagggtcctcaggcag

SEQ ID NO: 4301934 - DNA, 19 bp, Homo sapiens
actaggtgcccagtcttga

SEQ ID NO: 4301935 - DNA, 20 bp, Homo sapiens
actaggtgcccagtcttgag

SEQ ID NO: 4301936 - DNA, 13 bp, Homo sapiens
actaggtgctggc

SEQ ID NO: 4301937 - DNA, 17 bp, Homo sapiens
actaggtgctggcatgt

SEQ ID NO: 4301938 - DNA, 13 bp, Homo sapiens
actataaacatta

SEQ ID NO: 4301939 - DNA, 21 bp, Homo sapiens
actataatgtgaaatgtaact

SEQ ID NO: 4301940 - DNA, 16 bp, Homo sapiens
actatagcaaagtagt

SEQ ID NO: 4301941 - DNA, 19 bp, Homo sapiens
actatcggttcaagttgat

SEQ ID NO: 4301942 - DNA, 16 bp, Homo sapiens
actatggctgtatttt

SEQ ID NO: 4301943 - DNA, 22 bp, Homo sapiens
actatggctgtatttttagaga

SEQ ID NO: 4301944 - DNA, 15 bp, Homo sapiens
actatgtgtcatgat

SEQ ID NO: 4301945 - DNA, 17 bp, Homo sapiens
actattaggaggaatgt

SEQ ID NO: 4301946 - DNA, 14 bp, Homo sapiens
actattgtagagtg

SEQ ID NO: 4301947 - DNA, 17 bp, Homo sapiens
actatttttttgttgct

SEQ ID NO: 4301948 - DNA, 19 bp, Homo sapiens
actcaatgtggaaaaaata

SEQ ID NO: 4301949 - DNA, 22 bp, Homo sapiens
actcaatgtggaaaaaatattt

SEQ ID NO: 4301950 - DNA, 17 bp, Homo sapiens
actcaccaaaatatagt

SEQ ID NO: 4301951 - DNA, 13 bp, Homo sapiens
actcacctgctgg

SEQ ID NO: 4301952 - DNA, 23 bp, Homo sapiens
actcacggctgcacctgcaggga

SEQ ID NO: 4301953 - DNA, 22 bp, Homo sapiens
actcaggcagcctgtgggtcct

SEQ ID NO: 4301954 - DNA, 15 bp, Homo sapiens
actcaggcccacatt

SEQ ID NO: 4301955 - DNA, 18 bp, Homo sapiens
actcataaaggtttttgt

SEQ ID NO: 4301956 - DNA, 23 bp, Homo sapiens
actcattagaattaccatttgtt

SEQ ID NO: 4301957 - DNA, 19 bp, Homo sapiens
actccaaggcaaatgtcca

SEQ ID NO: 4301958 - DNA, 23 bp, Homo sapiens
actccaaggcaaatgtccaagca

SEQ ID NO: 4301959 - DNA, 12 bp, Homo sapiens
actccactcagc

SEQ ID NO: 4301960 - DNA, 13 bp, Homo sapiens
actccactcagca

SEQ ID NO: 4301961 - DNA, 14 bp, Homo sapiens
actccactcagcac

SEQ ID NO: 4301962 - DNA, 18 bp, Homo sapiens
actccactcagcacaatt

SEQ ID NO: 4301963 - DNA, 15 bp, Homo sapiens
actccagacccctgg

SEQ ID NO: 4301964 - DNA, 18 bp, Homo sapiens
actccaggaaaactgttt

SEQ ID NO: 4301965 - DNA, 21 bp, Homo sapiens
actccagggttaaagaaaggc

SEQ ID NO: 4301966 - DNA, 19 bp, Homo sapiens
actccagtgttcccttctg

SEQ ID NO: 4301967 - DNA, 12 bp, Homo sapiens
actccattctcc

SEQ ID NO: 4301968 - DNA, 20 bp, Homo sapiens
actccccttgagctgagatg

SEQ ID NO: 4301969 - DNA, 20 bp, Homo sapiens
actcctcccaactctggcct

SEQ ID NO: 4301970 - DNA, 14 bp, Homo sapiens
actctaactgtata

SEQ ID NO: 4301971 - DNA, 21 bp, Homo sapiens
actctaactgtatatttgtat

SEQ ID NO: 4301972 - DNA, 20 bp, Homo sapiens
actctacttagcatgtccct

SEQ ID NO: 4301973 - DNA, 18 bp, Homo sapiens
actctccaggattgtcca

SEQ ID NO: 4301974 - DNA, 16 bp, Homo sapiens
actctcctgaggagca

SEQ ID NO: 4301975 - DNA, 17 bp, Homo sapiens
actctctccatcagaag

SEQ ID NO: 4301976 - DNA, 14 bp, Homo sapiens
actctctcctctct

SEQ ID NO: 4301977 - DNA, 20 bp, Homo sapiens
actctcttcttactgtattt

SEQ ID NO: 4301978 - DNA, 14 bp, Homo sapiens
actctgaaatcagc

SEQ ID NO: 4301979 - DNA, 14 bp, Homo sapiens
actctgccttccag

SEQ ID NO: 4301980 - DNA, 18 bp, Homo sapiens
actctgccttccaggcgt

SEQ ID NO: 4301981 - DNA, 19 bp, Homo sapiens
actctgccttccaggcgta

SEQ ID NO: 4301982 - DNA, 13 bp, Homo sapiens
actctggcagcct

SEQ ID NO: 4301983 - DNA, 20 bp, Homo sapiens
actctggcagcctcagaggc

SEQ ID NO: 4301984 - DNA, 11 bp, Homo sapiens
actctggcctt

SEQ ID NO: 4301985 - DNA, 22 bp, Homo sapiens
actctggccttggttcctccag

SEQ ID NO: 4301986 - DNA, 23 bp, Homo sapiens
actcttctgagcacctacttaca

SEQ ID NO: 4301987 - DNA, 20 bp, Homo sapiens
actctttattgtctgtaaat

SEQ ID NO: 4301988 - DNA, 19 bp, Homo sapiens
actgaaaggtagactttta

SEQ ID NO: 4301989 - DNA, 20 bp, Homo sapiens
actgaacgatccttcaaagt

SEQ ID NO: 4301990 - DNA, 13 bp, Homo sapiens
actgaatttaact

SEQ ID NO: 4301991 - DNA, 23 bp, Homo sapiens
actgacacaaaggacaaaaatat

SEQ ID NO: 4301992 - DNA, 14 bp, Homo sapiens
actgagctcctctg

SEQ ID NO: 4301993 - DNA, 19 bp, Homo sapiens
actgagctcctctgggcag

SEQ ID NO: 4301994 - DNA, 14 bp, Homo sapiens
actgatatattttc

SEQ ID NO: 4301995 - DNA, 14 bp, Homo sapiens
actgcaacactgga

SEQ ID NO: 4301996 - DNA, 18 bp, Homo sapiens
actgcacagtgcatctca

SEQ ID NO: 4301997 - DNA, 22 bp, Homo sapiens
actgcacagtgcatctcagccc

SEQ ID NO: 4301998 - DNA, 14 bp, Homo sapiens
actgcatgcaagct

SEQ ID NO: 4301999 - DNA, 12 bp, Homo sapiens
actgcatgcact

SEQ ID NO: 4302000 - DNA, 14 bp, Homo sapiens
actgcatgcacttc

SEQ ID NO: 4302001 - DNA, 16 bp, Homo sapiens
actgccattagactga

SEQ ID NO: 4302002 - DNA, 19 bp, Homo sapiens
actgccattagactgaatt

SEQ ID NO: 4302003 - DNA, 20 bp, Homo sapiens
actgccattagactgaattt

SEQ ID NO: 4302004 - DNA, 16 bp, Homo sapiens
actgcccattgtaact

SEQ ID NO: 4302005 - DNA, 23 bp, Homo sapiens
actgccgaccgaggctggagctg

SEQ ID NO: 4302006 - DNA, 17 bp, Homo sapiens
actgcctacccacccct

SEQ ID NO: 4302007 - DNA, 17 bp, Homo sapiens
actgcctatacccctca

SEQ ID NO: 4302008 - DNA, 9 bp, Homo sapiens
actgcctgc

SEQ ID NO: 4302009 - DNA, 14 bp, Homo sapiens
actgcctggaaagc

SEQ ID NO: 4302010 - DNA, 16 bp, Homo sapiens
actgcctttgctgcct

SEQ ID NO: 4302011 - DNA, 20 bp, Homo sapiens
actgcctttgctgccttctg

SEQ ID NO: 4302012 - DNA, 21 bp, Homo sapiens
actgcctttgctgccttctgt

SEQ ID NO: 4302013 - DNA, 16 bp, Homo sapiens
actgctaggtgggcca

SEQ ID NO: 4302014 - DNA, 20 bp, Homo sapiens
actgctaggtgggccagccc

SEQ ID NO: 4302015 - DNA, 23 bp, Homo sapiens
actgctaggtgggccagcccctc

SEQ ID NO: 4302016 - DNA, 13 bp, Homo sapiens
actgctggctgcc

SEQ ID NO: 4302017 - DNA, 12 bp, Homo sapiens
actgctgtttta

SEQ ID NO: 4302018 - DNA, 14 bp, Homo sapiens
actggaggctgggt

SEQ ID NO: 4302019 - DNA, 15 bp, Homo sapiens
actggaggctgggtg

SEQ ID NO: 4302020 - DNA, 16 bp, Homo sapiens
actggaggctgggtgg

SEQ ID NO: 4302021 - DNA, 17 bp, Homo sapiens
actggaggctgggtggc

SEQ ID NO: 4302022 - DNA, 14 bp, Homo sapiens
actggcccacccct

SEQ ID NO: 4302023 - DNA, 19 bp, Homo sapiens
actggcccacccctcttcc

SEQ ID NO: 4302024 - DNA, 23 bp, Homo sapiens
actggcccacccctcttccccct

SEQ ID NO: 4302025 - DNA, 21 bp, Homo sapiens
actggctgcaagtggttaaga

SEQ ID NO: 4302026 - DNA, 12 bp, Homo sapiens
actgggctggct

SEQ ID NO: 4302027 - DNA, 21 bp, Homo sapiens
actggtccaggccaggcctca

SEQ ID NO: 4302028 - DNA, 15 bp, Homo sapiens
actggtctcagagga

SEQ ID NO: 4302029 - DNA, 15 bp, Homo sapiens
actggtgcatttaaa

SEQ ID NO: 4302030 - DNA, 20 bp, Homo sapiens
actggtgcatttaaaatgga

SEQ ID NO: 4302031 - DNA, 20 bp, Homo sapiens
actggtggcccgacagcctg

SEQ ID NO: 4302032 - DNA, 22 bp, Homo sapiens
actggtggcccgacagcctggc

SEQ ID NO: 4302033 - DNA, 23 bp, Homo sapiens
actggttatagttgatatgtaac

SEQ ID NO: 4302034 - DNA, 13 bp, Homo sapiens
actgtactcctcc

SEQ ID NO: 4302035 - DNA, 15 bp, Homo sapiens
actgtactcctccca

SEQ ID NO: 4302036 - DNA, 14 bp, Homo sapiens
actgtagtaattgt

SEQ ID NO: 4302037 - DNA, 13 bp, Homo sapiens
actgtatatttgt

SEQ ID NO: 4302038 - DNA, 12 bp, Homo sapiens
actgtatctaaa

SEQ ID NO: 4302039 - DNA, 18 bp, Homo sapiens
actgtatctaaaaaataa

SEQ ID NO: 4302040 - DNA, 22 bp, Homo sapiens
actgtatctaaaaaataactgt

SEQ ID NO: 4302041 - DNA, 16 bp, Homo sapiens
actgtcccacaaaata

SEQ ID NO: 4302042 - DNA, 22 bp, Homo sapiens
actgtcctgttgattaatttct

SEQ ID NO: 4302043 - DNA, 17 bp, Homo sapiens
actgtctctcatgaacc

SEQ ID NO: 4302044 - DNA, 17 bp, Homo sapiens
actgtctgtaagagaat

SEQ ID NO: 4302045 - DNA, 13 bp, Homo sapiens
actgtgcactata

SEQ ID NO: 4302046 - DNA, 16 bp, Homo sapiens
actgtgcagttgctgt

SEQ ID NO: 4302047 - DNA, 18 bp, Homo sapiens
actgtgcgttttagagta

SEQ ID NO: 4302048 - DNA, 15 bp, Homo sapiens
actgtggcctcagga

SEQ ID NO: 4302049 - DNA, 12 bp, Homo sapiens
actgtggccttg

SEQ ID NO: 4302050 - DNA, 22 bp, Homo sapiens
actgtgtccctctctctggaaa

SEQ ID NO: 4302051 - DNA, 20 bp, Homo sapiens
actgttcatgaatacgtaaa

SEQ ID NO: 4302052 - DNA, 20 bp, Homo sapiens
actgttcccagcaaagtttt

SEQ ID NO: 4302053 - DNA, 12 bp, Homo sapiens
actgtttgtaat

SEQ ID NO: 4302054 - DNA, 13 bp, Homo sapiens
actgtttgtaata

SEQ ID NO: 4302055 - DNA, 17 bp, Homo sapiens
actgtttgtaatataca

SEQ ID NO: 4302056 - DNA, 18 bp, Homo sapiens
actgtttgtaatatacag

SEQ ID NO: 4302057 - DNA, 14 bp, Homo sapiens
actgttttcatgtg

SEQ ID NO: 4302058 - DNA, 14 bp, Homo sapiens
actgtttttgaaga

SEQ ID NO: 4302059 - DNA, 15 bp, Homo sapiens
actgtttttgaagaa

SEQ ID NO: 4302060 - DNA, 16 bp, Homo sapiens
actgtttttgaagaag

SEQ ID NO: 4302061 - DNA, 22 bp, Homo sapiens
actgtttttgaagaagggaaat

SEQ ID NO: 4302062 - DNA, 17 bp, Homo sapiens
actgttttttcctgagc

SEQ ID NO: 4302063 - DNA, 19 bp, Homo sapiens
actgttttttcctgagctt

SEQ ID NO: 4302064 - DNA, 15 bp, Homo sapiens
acttaaagcttgttt

SEQ ID NO: 4302065 - DNA, 15 bp, Homo sapiens
acttaagcacaagca

SEQ ID NO: 4302066 - DNA, 20 bp, Homo sapiens
acttaaggggggatgtcttg

SEQ ID NO: 4302067 - DNA, 12 bp, Homo sapiens
acttacatgatt

SEQ ID NO: 4302068 - DNA, 18 bp, Homo sapiens
acttacatgattcatttt

SEQ ID NO: 4302069 - DNA, 19 bp, Homo sapiens
acttacatgattcatttta

SEQ ID NO: 4302070 - DNA, 22 bp, Homo sapiens
acttagcattttctgcatctcc

SEQ ID NO: 4302071 - DNA, 17 bp, Homo sapiens
acttatgctgctgtgaa

SEQ ID NO: 4302072 - DNA, 15 bp, Homo sapiens
acttattttctgaat

SEQ ID NO: 4302073 - DNA, 21 bp, Homo sapiens
acttattttctgaattcataa

SEQ ID NO: 4302074 - DNA, 22 bp, Homo sapiens
acttattttctgaattcataaa

SEQ ID NO: 4302075 - DNA, 22 bp, Homo sapiens
acttcaaacatgccctcaggct

SEQ ID NO: 4302076 - DNA, 18 bp, Homo sapiens
acttcagactctctcctc

SEQ ID NO: 4302077 - DNA, 17 bp, Homo sapiens
acttcaggctcttctcc

SEQ ID NO: 4302078 - DNA, 20 bp, Homo sapiens
acttcaggctcttctccttt

SEQ ID NO: 4302079 - DNA, 19 bp, Homo sapiens
acttccacccccagctcct

SEQ ID NO: 4302080 - DNA, 22 bp, Homo sapiens
acttcctggattttctttctat

SEQ ID NO: 4302081 - DNA, 12 bp, Homo sapiens
acttcctgtcca

SEQ ID NO: 4302082 - DNA, 17 bp, Homo sapiens
acttcgctattcccagg

SEQ ID NO: 4302083 - DNA, 19 bp, Homo sapiens
acttcgctattcccaggca

SEQ ID NO: 4302084 - DNA, 17 bp, Homo sapiens
acttcgtggatgacctc

SEQ ID NO: 4302085 - DNA, 13 bp, Homo sapiens
acttcttctgtaa

SEQ ID NO: 4302086 - DNA, 15 bp, Homo sapiens
acttgaatagtattg

SEQ ID NO: 4302087 - DNA, 14 bp, Homo sapiens
acttgagaataaat

SEQ ID NO: 4302088 - DNA, 13 bp, Homo sapiens
acttgagcccact

SEQ ID NO: 4302089 - DNA, 15 bp, Homo sapiens
acttgagcccactcc

SEQ ID NO: 4302090 - DNA, 15 bp, Homo sapiens
acttgatgaataaac

SEQ ID NO: 4302091 - DNA, 19 bp, Homo sapiens
acttgatgaataaacactt

SEQ ID NO: 4302092 - DNA, 20 bp, Homo sapiens
acttgatgaataaacacttt

SEQ ID NO: 4302093 - DNA, 21 bp, Homo sapiens
acttgatgaataaacactttt

SEQ ID NO: 4302094 - DNA, 17 bp, Homo sapiens
acttgctcaataaaggt

SEQ ID NO: 4302095 - DNA, 19 bp, Homo sapiens
acttgctcaataaaggtca

SEQ ID NO: 4302096 - DNA, 11 bp, Homo sapiens
acttggagccg

SEQ ID NO: 4302097 - DNA, 18 bp, Homo sapiens
acttgtgaaacacagctg

SEQ ID NO: 4302098 - DNA, 20 bp, Homo sapiens
acttgtgcctcttgggagac

SEQ ID NO: 4302099 - DNA, 16 bp, Homo sapiens
acttgtttgtgtttga

SEQ ID NO: 4302100 - DNA, 15 bp, Homo sapiens
actttaataataaaa

SEQ ID NO: 4302101 - DNA, 22 bp, Homo sapiens
actttacagttctggaggagga

SEQ ID NO: 4302102 - DNA, 24 bp, Homo sapiens
actttaggtagtagaatctcagca

SEQ ID NO: 4302103 - DNA, 17 bp, Homo sapiens
actttataagccaatga

SEQ ID NO: 4302104 - DNA, 14 bp, Homo sapiens
actttcctgatgtt

SEQ ID NO: 4302105 - DNA, 19 bp, Homo sapiens
actttctgaaattcacaaa

SEQ ID NO: 4302106 - DNA, 16 bp, Homo sapiens
actttctttagtcttt

SEQ ID NO: 4302107 - DNA, 17 bp, Homo sapiens
actttgacacttttcat

SEQ ID NO: 4302108 - DNA, 20 bp, Homo sapiens
actttgctgatttcccctct

SEQ ID NO: 4302109 - DNA, 14 bp, Homo sapiens
actttggtttctga

SEQ ID NO: 4302110 - DNA, 14 bp, Homo sapiens
actttgtatacaag

SEQ ID NO: 4302111 - DNA, 20 bp, Homo sapiens
acttttagcggtttgcaaac

SEQ ID NO: 4302112 - DNA, 19 bp, Homo sapiens
acttttgtgtattctgtgg

SEQ ID NO: 4302113 - DNA, 14 bp, Homo sapiens
agaaaaaccaatga

SEQ ID NO: 4302114 - DNA, 19 bp, Homo sapiens
agaaaaaccaatgattcat

SEQ ID NO: 4302115 - DNA, 23 bp, Homo sapiens
agaaaaaccaatgattcataaca

SEQ ID NO: 4302116 - DNA, 13 bp, Homo sapiens
agaaaagccagat

SEQ ID NO: 4302117 - DNA, 18 bp, Homo sapiens
agaaaagccagatgacag

SEQ ID NO: 4302118 - DNA, 22 bp, Homo sapiens
agaaaagccagatgacagggag

SEQ ID NO: 4302119 - DNA, 23 bp, Homo sapiens
agaaaagccagatgacagggagc

SEQ ID NO: 4302120 - DNA, 13 bp, Homo sapiens
agaaaagctataa

SEQ ID NO: 4302121 - DNA, 21 bp, Homo sapiens
agaaaagctataaaatgaata

SEQ ID NO: 4302122 - DNA, 14 bp, Homo sapiens
agaaacaatttctg

SEQ ID NO: 4302123 - DNA, 15 bp, Homo sapiens
agaaacaatttctgt

SEQ ID NO: 4302124 - DNA, 21 bp, Homo sapiens
agaaagaaattgtttttctga

SEQ ID NO: 4302125 - DNA, 14 bp, Homo sapiens
agaaaggaaacctt

SEQ ID NO: 4302126 - DNA, 15 bp, Homo sapiens
agaaaggaaaccttt

SEQ ID NO: 4302127 - DNA, 19 bp, Homo sapiens
agaaagggcagcccctccc

SEQ ID NO: 4302128 - DNA, 18 bp, Homo sapiens
agaaaggttgattctcat

SEQ ID NO: 4302129 - DNA, 15 bp, Homo sapiens
agaaagtctatgctt

SEQ ID NO: 4302130 - DNA, 14 bp, Homo sapiens
agaaataaacctta

SEQ ID NO: 4302131 - DNA, 23 bp, Homo sapiens
agaaataaaccttaatatttctt

SEQ ID NO: 4302132 - DNA, 14 bp, Homo sapiens
agaaatgccgctgt

SEQ ID NO: 4302133 - DNA, 21 bp, Homo sapiens
agaaatgctaatgtaatcatt

SEQ ID NO: 4302134 - DNA, 20 bp, Homo sapiens
agaaattagggctctaattt

SEQ ID NO: 4302135 - DNA, 21 bp, Homo sapiens
agaaattagggctctaatttc

SEQ ID NO: 4302136 - DNA, 13 bp, Homo sapiens
agaaattatgaaa

SEQ ID NO: 4302137 - DNA, 12 bp, Homo sapiens
agaaattcttgt

SEQ ID NO: 4302138 - DNA, 18 bp, Homo sapiens
agaaattcttgttatggt

SEQ ID NO: 4302139 - DNA, 17 bp, Homo sapiens
agaaattgcatttcctg

SEQ ID NO: 4302140 - DNA, 15 bp, Homo sapiens
agaaattttatctct

SEQ ID NO: 4302141 - DNA, 17 bp, Homo sapiens
agaaatttttttccaga

SEQ ID NO: 4302142 - DNA, 19 bp, Homo sapiens
agaacaaacctctatatgt

SEQ ID NO: 4302143 - DNA, 13 bp, Homo sapiens
agaacagggatgc

SEQ ID NO: 4302144 - DNA, 17 bp, Homo sapiens
agaaccaacgggtctgt

SEQ ID NO: 4302145 - DNA, 21 bp, Homo sapiens
agaacccatggaaaaatgcca

SEQ ID NO: 4302146 - DNA, 13 bp, Homo sapiens
agaacccccctcc

SEQ ID NO: 4302147 - DNA, 16 bp, Homo sapiens
agaacccccctcccca

SEQ ID NO: 4302148 - DNA, 18 bp, Homo sapiens
agaacgcatgcagggccc

SEQ ID NO: 4302149 - DNA, 16 bp, Homo sapiens
agaactaccaaaatga

SEQ ID NO: 4302150 - DNA, 15 bp, Homo sapiens
agaactcatgtgatt

SEQ ID NO: 4302151 - DNA, 22 bp, Homo sapiens
agaactgagctcctctgggcag

SEQ ID NO: 4302152 - DNA, 22 bp, Homo sapiens
agaactgtcccacaaaatattt

SEQ ID NO: 4302153 - DNA, 16 bp, Homo sapiens
agaacttgaacaaagt

SEQ ID NO: 4302154 - DNA, 13 bp, Homo sapiens
agaagaaactcct

SEQ ID NO: 4302155 - DNA, 16 bp, Homo sapiens
agaagaatattgtatt

SEQ ID NO: 4302156 - DNA, 14 bp, Homo sapiens
agaagattctaaaa

SEQ ID NO: 4302157 - DNA, 19 bp, Homo sapiens
agaagcctcatgggagtca

SEQ ID NO: 4302158 - DNA, 16 bp, Homo sapiens
agaagctcctgaatcc

SEQ ID NO: 4302159 - DNA, 13 bp, Homo sapiens
agaaggaggaatt

SEQ ID NO: 4302160 - DNA, 18 bp, Homo sapiens
agaaggcaagctggcagg

SEQ ID NO: 4302161 - DNA, 15 bp, Homo sapiens
agaaggcccgggagg

SEQ ID NO: 4302162 - DNA, 23 bp, Homo sapiens
agaaggcccgggaggaggatccg

SEQ ID NO: 4302163 - DNA, 15 bp, Homo sapiens
agaaggcctgccccc

SEQ ID NO: 4302164 - DNA, 16 bp, Homo sapiens
agaaggcctgcccccc

SEQ ID NO: 4302165 - DNA, 19 bp, Homo sapiens
agaaggcctgccccccttc

SEQ ID NO: 4302166 - DNA, 14 bp, Homo sapiens
agaagggaaattca

SEQ ID NO: 4302167 - DNA, 13 bp, Homo sapiens
agaaggggcgagg

SEQ ID NO: 4302168 - DNA, 16 bp, Homo sapiens
agaaggtggtctgcac

SEQ ID NO: 4302169 - DNA, 17 bp, Homo sapiens
agaaggtggtctgcacc

SEQ ID NO: 4302170 - DNA, 13 bp, Homo sapiens
agaagtgcccctg

SEQ ID NO: 4302171 - DNA, 13 bp, Homo sapiens
agaagtgggagtg

SEQ ID NO: 4302172 - DNA, 19 bp, Homo sapiens
agaagtgggagtgggagag

SEQ ID NO: 4302173 - DNA, 20 bp, Homo sapiens
agaagtgggagtgggagagg

SEQ ID NO: 4302174 - DNA, 17 bp, Homo sapiens
agaagtgggattcagga

SEQ ID NO: 4302175 - DNA, 14 bp, Homo sapiens
agaagtgtgttttg

SEQ ID NO: 4302176 - DNA, 15 bp, Homo sapiens
agaatattgttaaaa

SEQ ID NO: 4302177 - DNA, 18 bp, Homo sapiens
agaatattgttaaaacct

SEQ ID NO: 4302178 - DNA, 18 bp, Homo sapiens
agaatcaaatctgagcct

SEQ ID NO: 4302179 - DNA, 18 bp, Homo sapiens
agaatctcagcactttgt

SEQ ID NO: 4302180 - DNA, 16 bp, Homo sapiens
agaatgagagagtgtg

SEQ ID NO: 4302181 - DNA, 17 bp, Homo sapiens
agaatgagagagtgtgg

SEQ ID NO: 4302182 - DNA, 19 bp, Homo sapiens
agaatgcctaggccagctc

SEQ ID NO: 4302183 - DNA, 17 bp, Homo sapiens
agaatggaagcctccac

SEQ ID NO: 4302184 - DNA, 19 bp, Homo sapiens
agaatggtgggctccagag

SEQ ID NO: 4302185 - DNA, 21 bp, Homo sapiens
agaatggtgggctccagagta

SEQ ID NO: 4302186 - DNA, 23 bp, Homo sapiens
agaatgttactttggaatgacta

SEQ ID NO: 4302187 - DNA, 23 bp, Homo sapiens
agaatgttgaaactgacttgctg

SEQ ID NO: 4302188 - DNA, 18 bp, Homo sapiens
agaattaccatttgttaa

SEQ ID NO: 4302189 - DNA, 12 bp, Homo sapiens
agaattcacttt

SEQ ID NO: 4302190 - DNA, 13 bp, Homo sapiens
agaattcattcat

SEQ ID NO: 4302191 - DNA, 21 bp, Homo sapiens
agaattcattcatacttaaaa

SEQ ID NO: 4302192 - DNA, 22 bp, Homo sapiens
agaatttgaagacttcaaaata

SEQ ID NO: 4302193 - DNA, 18 bp, Homo sapiens
agacacattatcttctgg

SEQ ID NO: 4302194 - DNA, 11 bp, Homo sapiens
agacacccagt

SEQ ID NO: 4302195 - DNA, 15 bp, Homo sapiens
agacacgtgtttttg

SEQ ID NO: 4302196 - DNA, 20 bp, Homo sapiens
agacacgtgtttttgtatct

SEQ ID NO: 4302197 - DNA, 13 bp, Homo sapiens
agacactggtctc

SEQ ID NO: 4302198 - DNA, 19 bp, Homo sapiens
agacactggtctcagagga

SEQ ID NO: 4302199 - DNA, 16 bp, Homo sapiens
agacagagtggatctg

SEQ ID NO: 4302200 - DNA, 19 bp, Homo sapiens
agacagagtggatctggag

SEQ ID NO: 4302201 - DNA, 17 bp, Homo sapiens
agacagcagagccatct

SEQ ID NO: 4302202 - DNA, 14 bp, Homo sapiens
agacagcagtgtga

SEQ ID NO: 4302203 - DNA, 14 bp, Homo sapiens
agacagggtggggc

SEQ ID NO: 4302204 - DNA, 19 bp, Homo sapiens
agacagggtggggcttaga

SEQ ID NO: 4302205 - DNA, 22 bp, Homo sapiens
agaccacaaggctgaaaagtgc

SEQ ID NO: 4302206 - DNA, 16 bp, Homo sapiens
agaccagtgcttagca

SEQ ID NO: 4302207 - DNA, 19 bp, Homo sapiens
agaccccatccagccaggg

SEQ ID NO: 4302208 - DNA, 11 bp, Homo sapiens
agacccccacc

SEQ ID NO: 4302209 - DNA, 13 bp, Homo sapiens
agacccccacccc

SEQ ID NO: 4302210 - DNA, 19 bp, Homo sapiens
agacccccaccccttcccc

SEQ ID NO: 4302211 - DNA, 20 bp, Homo sapiens
agacccccaccccttcccca

SEQ ID NO: 4302212 - DNA, 20 bp, Homo sapiens
agacccccagcaaccctcct

SEQ ID NO: 4302213 - DNA, 17 bp, Homo sapiens
agacccctaccctttcc

SEQ ID NO: 4302214 - DNA, 21 bp, Homo sapiens
agacccctggcttttcactgc

SEQ ID NO: 4302215 - DNA, 13 bp, Homo sapiens
agaccctgggaga

SEQ ID NO: 4302216 - DNA, 13 bp, Homo sapiens
agaccctgtcttt

SEQ ID NO: 4302217 - DNA, 18 bp, Homo sapiens
agaccgagtgtggagctg

SEQ ID NO: 4302218 - DNA, 19 bp, Homo sapiens
agaccgagtgtggagctgc

SEQ ID NO: 4302219 - DNA, 13 bp, Homo sapiens
agacctgggactt

SEQ ID NO: 4302220 - DNA, 22 bp, Homo sapiens
agaccttacaaccacatttctg

SEQ ID NO: 4302221 - DNA, 19 bp, Homo sapiens
agaccttctgaagatctca

SEQ ID NO: 4302222 - DNA, 14 bp, Homo sapiens
agactcaatgtgga

SEQ ID NO: 4302223 - DNA, 21 bp, Homo sapiens
agactcacggctgcacctgca

SEQ ID NO: 4302224 - DNA, 20 bp, Homo sapiens
agactcaggcccacattgcc

SEQ ID NO: 4302225 - DNA, 12 bp, Homo sapiens
agactccttctc

SEQ ID NO: 4302226 - DNA, 14 bp, Homo sapiens
agactctctcctct

SEQ ID NO: 4302227 - DNA, 21 bp, Homo sapiens
agactgagcttgattctaaag

SEQ ID NO: 4302228 - DNA, 12 bp, Homo sapiens
agactgggctgg

SEQ ID NO: 4302229 - DNA, 14 bp, Homo sapiens
agactgggctggct

SEQ ID NO: 4302230 - DNA, 17 bp, Homo sapiens
agactgggctggctgcc

SEQ ID NO: 4302231 - DNA, 17 bp, Homo sapiens
agactgttttcagacct

SEQ ID NO: 4302232 - DNA, 18 bp, Homo sapiens
agactgttttcagacctt

SEQ ID NO: 4302233 - DNA, 21 bp, Homo sapiens
agacttcgctattcccaggca

SEQ ID NO: 4302234 - DNA, 23 bp, Homo sapiens
agacttcgctattcccaggcagg

SEQ ID NO: 4302235 - DNA, 14 bp, Homo sapiens
agacttgatgaata

SEQ ID NO: 4302236 - DNA, 19 bp, Homo sapiens
agacttgatgaataaacac

SEQ ID NO: 4302237 - DNA, 21 bp, Homo sapiens
agacttttagcggtttgcaaa

SEQ ID NO: 4302238 - DNA, 14 bp, Homo sapiens
agagaaaggagggc

SEQ ID NO: 4302239 - DNA, 14 bp, Homo sapiens
agagaagcacccca

SEQ ID NO: 4302240 - DNA, 15 bp, Homo sapiens
agagaaggtggtctg

SEQ ID NO: 4302241 - DNA, 17 bp, Homo sapiens
agagaaggtggtctgca

SEQ ID NO: 4302242 - DNA, 19 bp, Homo sapiens
agagaaggtggtctgcacc

SEQ ID NO: 4302243 - DNA, 17 bp, Homo sapiens
agagaagtgcccctgct

SEQ ID NO: 4302244 - DNA, 14 bp, Homo sapiens
agagaatgagagag

SEQ ID NO: 4302245 - DNA, 14 bp, Homo sapiens
agagaattctaaga

SEQ ID NO: 4302246 - DNA, 14 bp, Homo sapiens
agagacccccgtgc

SEQ ID NO: 4302247 - DNA, 14 bp, Homo sapiens
agagaccctgccaa

SEQ ID NO: 4302248 - DNA, 14 bp, Homo sapiens
agagaccttctctt

SEQ ID NO: 4302249 - DNA, 22 bp, Homo sapiens
agagagatatatctgaaaactg

SEQ ID NO: 4302250 - DNA, 17 bp, Homo sapiens
agagagcggcttcccca

SEQ ID NO: 4302251 - DNA, 16 bp, Homo sapiens
agagagtatggtgctg

SEQ ID NO: 4302252 - DNA, 16 bp, Homo sapiens
agagagtggctcctcc

SEQ ID NO: 4302253 - DNA, 15 bp, Homo sapiens
agagatatatctgaa

SEQ ID NO: 4302254 - DNA, 14 bp, Homo sapiens
agagatattttgta

SEQ ID NO: 4302255 - DNA, 15 bp, Homo sapiens
agagatattttgtaa

SEQ ID NO: 4302256 - DNA, 22 bp, Homo sapiens
agagatgaggaaataagacttt

SEQ ID NO: 4302257 - DNA, 18 bp, Homo sapiens
agagattagcatgaaagg

SEQ ID NO: 4302258 - DNA, 21 bp, Homo sapiens
agagattggatcaagtattac

SEQ ID NO: 4302259 - DNA, 14 bp, Homo sapiens
agagcattctgggg

SEQ ID NO: 4302260 - DNA, 20 bp, Homo sapiens
agagcattctggggtggggc

SEQ ID NO: 4302261 - DNA, 10 bp, Homo sapiens
agagccacaa

SEQ ID NO: 4302262 - DNA, 10 bp, Homo sapiens
agagccaggg

SEQ ID NO: 4302263 - DNA, 11 bp, Homo sapiens
agagccagggc

SEQ ID NO: 4302264 - DNA, 12 bp, Homo sapiens
agagccagggct

SEQ ID NO: 4302265 - DNA, 17 bp, Homo sapiens
agagccagggctgtcct

SEQ ID NO: 4302266 - DNA, 19 bp, Homo sapiens
agagccatggactctacac

SEQ ID NO: 4302267 - DNA, 19 bp, Homo sapiens
agagcccaatcactgccta

SEQ ID NO: 4302268 - DNA, 14 bp, Homo sapiens
agagcccccaccag

SEQ ID NO: 4302269 - DNA, 24 bp, Homo sapiens
agagcccgcccacctgggccctag

SEQ ID NO: 4302270 - DNA, 17 bp, Homo sapiens
agagcctatggaaaggg

SEQ ID NO: 4302271 - DNA, 20 bp, Homo sapiens
agagcctatggaaagggtgt

SEQ ID NO: 4302272 - DNA, 21 bp, Homo sapiens
agagcctatggaaagggtgtg

SEQ ID NO: 4302273 - DNA, 14 bp, Homo sapiens
agagcctccctcag

SEQ ID NO: 4302274 - DNA, 16 bp, Homo sapiens
agagcctccctcagcc

SEQ ID NO: 4302275 - DNA, 18 bp, Homo sapiens
agagctcaggagaaggcc

SEQ ID NO: 4302276 - DNA, 13 bp, Homo sapiens
agagctccacaga

SEQ ID NO: 4302277 - DNA, 12 bp, Homo sapiens
agagctcccagg

SEQ ID NO: 4302278 - DNA, 14 bp, Homo sapiens
agagctcccaggac

SEQ ID NO: 4302279 - DNA, 12 bp, Homo sapiens
agagctgcagaa

SEQ ID NO: 4302280 - DNA, 13 bp, Homo sapiens
agagctgggaggg

SEQ ID NO: 4302281 - DNA, 23 bp, Homo sapiens
agaggacagatcaatggcgcagt

SEQ ID NO: 4302282 - DNA, 18 bp, Homo sapiens
agaggagagaatgagaga

SEQ ID NO: 4302283 - DNA, 20 bp, Homo sapiens
agaggagagaatgagagagt

SEQ ID NO: 4302284 - DNA, 21 bp, Homo sapiens
agaggagagaatgagagagtg

SEQ ID NO: 4302285 - DNA, 20 bp, Homo sapiens
agaggagcaggaagcaaggc

SEQ ID NO: 4302286 - DNA, 15 bp, Homo sapiens
agaggagcgtgtcct

SEQ ID NO: 4302287 - DNA, 16 bp, Homo sapiens
agaggagcgtgtccta

SEQ ID NO: 4302288 - DNA, 17 bp, Homo sapiens
agaggagggatagagac

SEQ ID NO: 4302289 - DNA, 17 bp, Homo sapiens
agaggaggtgtggagtg

SEQ ID NO: 4302290 - DNA, 16 bp, Homo sapiens
agaggagtgcgctaga

SEQ ID NO: 4302291 - DNA, 18 bp, Homo sapiens
agaggagttctaacacat

SEQ ID NO: 4302292 - DNA, 16 bp, Homo sapiens
agagggacagtgggct

SEQ ID NO: 4302293 - DNA, 19 bp, Homo sapiens
agagggacagtgggctatg

SEQ ID NO: 4302294 - DNA, 22 bp, Homo sapiens
agagggcccctcactggctgga

SEQ ID NO: 4302295 - DNA, 24 bp, Homo sapiens
agagggcccctcactggctggact

SEQ ID NO: 4302296 - DNA, 22 bp, Homo sapiens
agaggggacttggataggagct

SEQ ID NO: 4302297 - DNA, 21 bp, Homo sapiens
agaggtatcttactttcctct

SEQ ID NO: 4302298 - DNA, 13 bp, Homo sapiens
agagtatatatgt

SEQ ID NO: 4302299 - DNA, 15 bp, Homo sapiens
agagtatatatgtac

SEQ ID NO: 4302300 - DNA, 16 bp, Homo sapiens
agagtatatatgtaca

SEQ ID NO: 4302301 - DNA, 17 bp, Homo sapiens
agagtatgcaagaagaa

SEQ ID NO: 4302302 - DNA, 18 bp, Homo sapiens
agagtatgcaagaagaat

SEQ ID NO: 4302303 - DNA, 15 bp, Homo sapiens
agagtcattgttaca

SEQ ID NO: 4302304 - DNA, 14 bp, Homo sapiens
agagtccaggcccc

SEQ ID NO: 4302305 - DNA, 16 bp, Homo sapiens
agagtccaggccccaa

SEQ ID NO: 4302306 - DNA, 14 bp, Homo sapiens
agagtgcacagctg

SEQ ID NO: 4302307 - DNA, 11 bp, Homo sapiens
agagtgcccat

SEQ ID NO: 4302308 - DNA, 22 bp, Homo sapiens
agagtgctcaacctacagtgga

SEQ ID NO: 4302309 - DNA, 12 bp, Homo sapiens
agagtggctcct

SEQ ID NO: 4302310 - DNA, 15 bp, Homo sapiens
agagtggctcctccc

SEQ ID NO: 4302311 - DNA, 23 bp, Homo sapiens
agagtggctcctcccggtgccca

SEQ ID NO: 4302312 - DNA, 17 bp, Homo sapiens
agagtttctttacattg

SEQ ID NO: 4302313 - DNA, 20 bp, Homo sapiens
agataattatccaggatgtg

SEQ ID NO: 4302314 - DNA, 14 bp, Homo sapiens
agatactttgcatt

SEQ ID NO: 4302315 - DNA, 21 bp, Homo sapiens
agatagtatgcactatataca

SEQ ID NO: 4302316 - DNA, 18 bp, Homo sapiens
agatatatctgaaaactg

SEQ ID NO: 4302317 - DNA, 15 bp, Homo sapiens
agatattcatacttt

SEQ ID NO: 4302318 - DNA, 22 bp, Homo sapiens
agatattttgtaaaatgtatta

SEQ ID NO: 4302319 - DNA, 16 bp, Homo sapiens
agatcagcattcaaaa

SEQ ID NO: 4302320 - DNA, 17 bp, Homo sapiens
agatcagcattcaaaat

SEQ ID NO: 4302321 - DNA, 20 bp, Homo sapiens
agatcagcattcaaaatagt

SEQ ID NO: 4302322 - DNA, 18 bp, Homo sapiens
agatccattaatttaaat

SEQ ID NO: 4302323 - DNA, 20 bp, Homo sapiens
agatccgccctgggctctgg

SEQ ID NO: 4302324 - DNA, 21 bp, Homo sapiens
agatccgccctgggctctggg

SEQ ID NO: 4302325 - DNA, 15 bp, Homo sapiens
agatcctccttccag

SEQ ID NO: 4302326 - DNA, 16 bp, Homo sapiens
agatcctccttccagg

SEQ ID NO: 4302327 - DNA, 19 bp, Homo sapiens
agatcctccttccaggccc

SEQ ID NO: 4302328 - DNA, 22 bp, Homo sapiens
agatcctccttccaggccccag

SEQ ID NO: 4302329 - DNA, 13 bp, Homo sapiens
agatctagccagg

SEQ ID NO: 4302330 - DNA, 14 bp, Homo sapiens
agatctagccaggc

SEQ ID NO: 4302331 - DNA, 15 bp, Homo sapiens
agatctagccaggcc

SEQ ID NO: 4302332 - DNA, 22 bp, Homo sapiens
agatctcagataaagtgaccag

SEQ ID NO: 4302333 - DNA, 11 bp, Homo sapiens
agatcttcctt

SEQ ID NO: 4302334 - DNA, 15 bp, Homo sapiens
agatgaaattccatt

SEQ ID NO: 4302335 - DNA, 18 bp, Homo sapiens
agatgaaattccatttgt

SEQ ID NO: 4302336 - DNA, 21 bp, Homo sapiens
agatgacacataaatctgtct

SEQ ID NO: 4302337 - DNA, 23 bp, Homo sapiens
agatgacacataaatctgtctga

SEQ ID NO: 4302338 - DNA, 17 bp, Homo sapiens
agatgacagggagctgg

SEQ ID NO: 4302339 - DNA, 19 bp, Homo sapiens
agatgaggaaataagactt

SEQ ID NO: 4302340 - DNA, 20 bp, Homo sapiens
agatgaggaaataagacttt

SEQ ID NO: 4302341 - DNA, 21 bp, Homo sapiens
agatgaggaaataagactttt

SEQ ID NO: 4302342 - DNA, 11 bp, Homo sapiens
agatgcctggg

SEQ ID NO: 4302343 - DNA, 20 bp, Homo sapiens
agatgctgactgtactcctc

SEQ ID NO: 4302344 - DNA, 23 bp, Homo sapiens
agatgctgactgtactcctccca

SEQ ID NO: 4302345 - DNA, 22 bp, Homo sapiens
agatgctggtcatcctgggcat

SEQ ID NO: 4302346 - DNA, 17 bp, Homo sapiens
agatggctccctgggct

SEQ ID NO: 4302347 - DNA, 21 bp, Homo sapiens
agatggctccctgggctggca

SEQ ID NO: 4302348 - DNA, 19 bp, Homo sapiens
agatgggcaaggcctttgg

SEQ ID NO: 4302349 - DNA, 20 bp, Homo sapiens
agatggggagggcgcttttg

SEQ ID NO: 4302350 - DNA, 14 bp, Homo sapiens
agatggggcctctg

SEQ ID NO: 4302351 - DNA, 15 bp, Homo sapiens
agatggggcctctgt

SEQ ID NO: 4302352 - DNA, 15 bp, Homo sapiens
agatggtaatctttt

SEQ ID NO: 4302353 - DNA, 19 bp, Homo sapiens
agatggtgccccctggggg

SEQ ID NO: 4302354 - DNA, 17 bp, Homo sapiens
agatgtaagaagctaaa

SEQ ID NO: 4302355 - DNA, 14 bp, Homo sapiens
agatgtaccatgtt

SEQ ID NO: 4302356 - DNA, 16 bp, Homo sapiens
agatgtattatgcaaa

SEQ ID NO: 4302357 - DNA, 15 bp, Homo sapiens
agatgtcaagctggc

SEQ ID NO: 4302358 - DNA, 14 bp, Homo sapiens
agatgtctatattg

SEQ ID NO: 4302359 - DNA, 16 bp, Homo sapiens
agattaaaattagtga

SEQ ID NO: 4302360 - DNA, 12 bp, Homo sapiens
agattaggcctg

SEQ ID NO: 4302361 - DNA, 13 bp, Homo sapiens
agattaggcctgg

SEQ ID NO: 4302362 - DNA, 16 bp, Homo sapiens
agattaggcctggagt

SEQ ID NO: 4302363 - DNA, 23 bp, Homo sapiens
agattaggcctggagttgggctg

SEQ ID NO: 4302364 - DNA, 13 bp, Homo sapiens
agattcagctagt

SEQ ID NO: 4302365 - DNA, 12 bp, Homo sapiens
agattcaggctt

SEQ ID NO: 4302366 - DNA, 15 bp, Homo sapiens
agattcaggcttgca

SEQ ID NO: 4302367 - DNA, 20 bp, Homo sapiens
agattcaggcttgcattaaa

SEQ ID NO: 4302368 - DNA, 16 bp, Homo sapiens
agattctgtgggcagc

SEQ ID NO: 4302369 - DNA, 23 bp, Homo sapiens
agattctgtgggcagctggctct

SEQ ID NO: 4302370 - DNA, 13 bp, Homo sapiens
agattgctctggg

SEQ ID NO: 4302371 - DNA, 20 bp, Homo sapiens
agattggttcatgcctgggg

SEQ ID NO: 4302372 - DNA, 21 bp, Homo sapiens
agattgtaaaggtaggtgcat

SEQ ID NO: 4302373 - DNA, 15 bp, Homo sapiens
agatttgtatttata

SEQ ID NO: 4302374 - DNA, 17 bp, Homo sapiens
agatttgtatttatatt

SEQ ID NO: 4302375 - DNA, 18 bp, Homo sapiens
agatttgtatttatatta

SEQ ID NO: 4302376 - DNA, 14 bp, Homo sapiens
agattttatgtgct

SEQ ID NO: 4302377 - DNA, 20 bp, Homo sapiens
agattttatgtgcttgaaga

SEQ ID NO: 4302378 - DNA, 16 bp, Homo sapiens
agcaaaaaataatgac

SEQ ID NO: 4302379 - DNA, 22 bp, Homo sapiens
agcaaagtagtacttcttctgt

SEQ ID NO: 4302380 - DNA, 18 bp, Homo sapiens
agcaaatatttatgacct

SEQ ID NO: 4302381 - DNA, 12 bp, Homo sapiens
agcaaatttcat

SEQ ID NO: 4302382 - DNA, 20 bp, Homo sapiens
agcaaatttcatctttccaa

SEQ ID NO: 4302383 - DNA, 21 bp, Homo sapiens
agcaaatttcatctttccaaa

SEQ ID NO: 4302384 - DNA, 13 bp, Homo sapiens
agcaacaggacca

SEQ ID NO: 4302385 - DNA, 15 bp, Homo sapiens
agcaacaggaccagg

SEQ ID NO: 4302386 - DNA, 19 bp, Homo sapiens
agcaacatgaattaagaac

SEQ ID NO: 4302387 - DNA, 12 bp, Homo sapiens
agcaactgttgg

SEQ ID NO: 4302388 - DNA, 15 bp, Homo sapiens
agcaagaagattcta

SEQ ID NO: 4302389 - DNA, 20 bp, Homo sapiens
agcaagacaatgacactgga

SEQ ID NO: 4302390 - DNA, 16 bp, Homo sapiens
agcaagcacctgggtg

SEQ ID NO: 4302391 - DNA, 18 bp, Homo sapiens
agcaaggcaagaagtggg

SEQ ID NO: 4302392 - DNA, 12 bp, Homo sapiens
agcaatatgtca

SEQ ID NO: 4302393 - DNA, 14 bp, Homo sapiens
agcaatgcctgcct

SEQ ID NO: 4302394 - DNA, 15 bp, Homo sapiens
agcacaattctgtcc

SEQ ID NO: 4302395 - DNA, 22 bp, Homo sapiens
agcacaattctgtccctgtccc

SEQ ID NO: 4302396 - DNA, 23 bp, Homo sapiens
agcacacctcggccgaggcctgc

SEQ ID NO: 4302397 - DNA, 22 bp, Homo sapiens
agcacatccaggcaatggccta

SEQ ID NO: 4302398 - DNA, 16 bp, Homo sapiens
agcacattgccctgag

SEQ ID NO: 4302399 - DNA, 18 bp, Homo sapiens
agcacattgccctgaggg

SEQ ID NO: 4302400 - DNA, 19 bp, Homo sapiens
agcacattgccctgagggg

SEQ ID NO: 4302401 - DNA, 19 bp, Homo sapiens
agcacccatgccccactct

SEQ ID NO: 4302402 - DNA, 20 bp, Homo sapiens
agcacccatgccccactctg

SEQ ID NO: 4302403 - DNA, 21 bp, Homo sapiens
agcacccatgccccactctgc

SEQ ID NO: 4302404 - DNA, 16 bp, Homo sapiens
agcaccgaatattgag

SEQ ID NO: 4302405 - DNA, 18 bp, Homo sapiens
agcaccgaatattgagca

SEQ ID NO: 4302406 - DNA, 17 bp, Homo sapiens
agcacctgggtgtgctc

SEQ ID NO: 4302407 - DNA, 21 bp, Homo sapiens
agcacctgggtgtgctccagg

SEQ ID NO: 4302408 - DNA, 19 bp, Homo sapiens
agcactgccattagactga

SEQ ID NO: 4302409 - DNA, 17 bp, Homo sapiens
agcactggaggcctctg

SEQ ID NO: 4302410 - DNA, 17 bp, Homo sapiens
agcactgtgcagccggg

SEQ ID NO: 4302411 - DNA, 17 bp, Homo sapiens
agcactttataagccaa

SEQ ID NO: 4302412 - DNA, 14 bp, Homo sapiens
agcagaattcattc

SEQ ID NO: 4302413 - DNA, 14 bp, Homo sapiens
agcagagcctgggg

SEQ ID NO: 4302414 - DNA, 20 bp, Homo sapiens
agcagagcctggggtgggtg

SEQ ID NO: 4302415 - DNA, 23 bp, Homo sapiens
agcagagtaaaattacagaagaa

SEQ ID NO: 4302416 - DNA, 19 bp, Homo sapiens
agcagagtgcacagctgtc

SEQ ID NO: 4302417 - DNA, 12 bp, Homo sapiens
agcagcacaatt

SEQ ID NO: 4302418 - DNA, 14 bp, Homo sapiens
agcagcacaattct

SEQ ID NO: 4302419 - DNA, 22 bp, Homo sapiens
agcagcacaattctgtccctgt

SEQ ID NO: 4302420 - DNA, 23 bp, Homo sapiens
agcagcacgccaaccccagcagt

SEQ ID NO: 4302421 - DNA, 22 bp, Homo sapiens
agcagcatcaacctaggagcag

SEQ ID NO: 4302422 - DNA, 17 bp, Homo sapiens
agcagcggcccagattg

SEQ ID NO: 4302423 - DNA, 19 bp, Homo sapiens
agcagggcgggccaggaga

SEQ ID NO: 4302424 - DNA, 23 bp, Homo sapiens
agcaggggggttgggttccagac

SEQ ID NO: 4302425 - DNA, 14 bp, Homo sapiens
agcagggtctttgt

SEQ ID NO: 4302426 - DNA, 19 bp, Homo sapiens
agcagggtctttgtgtgct

SEQ ID NO: 4302427 - DNA, 15 bp, Homo sapiens
agcagtacttgctca

SEQ ID NO: 4302428 - DNA, 16 bp, Homo sapiens
agcagtacttgctcaa

SEQ ID NO: 4302429 - DNA, 20 bp, Homo sapiens
agcagtacttgctcaataaa

SEQ ID NO: 4302430 - DNA, 13 bp, Homo sapiens
agcagtcctgggc

SEQ ID NO: 4302431 - DNA, 14 bp, Homo sapiens
agcagtgggccctg

SEQ ID NO: 4302432 - DNA, 15 bp, Homo sapiens
agcagtgggccctgg

SEQ ID NO: 4302433 - DNA, 17 bp, Homo sapiens
agcagtgggccctggct

SEQ ID NO: 4302434 - DNA, 18 bp, Homo sapiens
agcagtgtgagggtgcag

SEQ ID NO: 4302435 - DNA, 22 bp, Homo sapiens
agcagttgttatattcattctt

SEQ ID NO: 4302436 - DNA, 21 bp, Homo sapiens
agcatcctgattattgaatgt

SEQ ID NO: 4302437 - DNA, 13 bp, Homo sapiens
agcatctgctctt

SEQ ID NO: 4302438 - DNA, 14 bp, Homo sapiens
agcatgaaaggtaa

SEQ ID NO: 4302439 - DNA, 22 bp, Homo sapiens
agcatgaagataaacacagctg

SEQ ID NO: 4302440 - DNA, 20 bp, Homo sapiens
agcatgacaagccccaggca

SEQ ID NO: 4302441 - DNA, 15 bp, Homo sapiens
agcatgtcctatccc

SEQ ID NO: 4302442 - DNA, 14 bp, Homo sapiens
agcatgtctactgc

SEQ ID NO: 4302443 - DNA, 21 bp, Homo sapiens
agcattcaaaatagttctatt

SEQ ID NO: 4302444 - DNA, 22 bp, Homo sapiens
agcattcaaaatagttctattt

SEQ ID NO: 4302445 - DNA, 16 bp, Homo sapiens
agcattgaaataataa

SEQ ID NO: 4302446 - DNA, 19 bp, Homo sapiens
agcattgaaataataatat

SEQ ID NO: 4302447 - DNA, 21 bp, Homo sapiens
agcatttgactttctgtctgt

SEQ ID NO: 4302448 - DNA, 14 bp, Homo sapiens
agcatttggaagga

SEQ ID NO: 4302449 - DNA, 17 bp, Homo sapiens
agcatttggaaggaaag

SEQ ID NO: 4302450 - DNA, 18 bp, Homo sapiens
agcattttactgtctgta

SEQ ID NO: 4302451 - DNA, 17 bp, Homo sapiens
agccaaaaacaataaac

SEQ ID NO: 4302452 - DNA, 20 bp, Homo sapiens
agccaaagagaaaagattaa

SEQ ID NO: 4302453 - DNA, 18 bp, Homo sapiens
agccaaattgcagaagaa

SEQ ID NO: 4302454 - DNA, 20 bp, Homo sapiens
agccaaggcctatgccacct

SEQ ID NO: 4302455 - DNA, 14 bp, Homo sapiens
agccaagtgtcctg

SEQ ID NO: 4302456 - DNA, 14 bp, Homo sapiens
agccacaggcagac

SEQ ID NO: 4302457 - DNA, 15 bp, Homo sapiens
agccaccaaggctgc

SEQ ID NO: 4302458 - DNA, 17 bp, Homo sapiens
agccaccaaggctgcct

SEQ ID NO: 4302459 - DNA, 13 bp, Homo sapiens
agccaccacctgg

SEQ ID NO: 4302460 - DNA, 16 bp, Homo sapiens
agccaccacctggatg

SEQ ID NO: 4302461 - DNA, 19 bp, Homo sapiens
agccacccggatctccagg

SEQ ID NO: 4302462 - DNA, 23 bp, Homo sapiens
agccacccggatctccaggccca

SEQ ID NO: 4302463 - DNA, 17 bp, Homo sapiens
agccaccctgccatgga

SEQ ID NO: 4302464 - DNA, 15 bp, Homo sapiens
agccacgcctctctc

SEQ ID NO: 4302465 - DNA, 16 bp, Homo sapiens
agccacgcctctctca

SEQ ID NO: 4302466 - DNA, 21 bp, Homo sapiens
agccacgcctctctcagccca

SEQ ID NO: 4302467 - DNA, 23 bp, Homo sapiens
agccacgcctctctcagcccagg

SEQ ID NO: 4302468 - DNA, 15 bp, Homo sapiens
agccacgcctgcgat

SEQ ID NO: 4302469 - DNA, 17 bp, Homo sapiens
agccacgtgctggagag

SEQ ID NO: 4302470 - DNA, 15 bp, Homo sapiens
agccactctgttcct

SEQ ID NO: 4302471 - DNA, 21 bp, Homo sapiens
agccagacagcaacggggagg

SEQ ID NO: 4302472 - DNA, 14 bp, Homo sapiens
agccagatgacagg

SEQ ID NO: 4302473 - DNA, 19 bp, Homo sapiens
agccagattaggcctggag

SEQ ID NO: 4302474 - DNA, 21 bp, Homo sapiens
agccagcagggcgggccagga

SEQ ID NO: 4302475 - DNA, 22 bp, Homo sapiens
agccagcagggcgggccaggag

SEQ ID NO: 4302476 - DNA, 24 bp, Homo sapiens
agccagcagggcgggccaggagaa

SEQ ID NO: 4302477 - DNA, 11 bp, Homo sapiens
agccagcaggt

SEQ ID NO: 4302478 - DNA, 11 bp, Homo sapiens
agccaggagac

SEQ ID NO: 4302479 - DNA, 19 bp, Homo sapiens
agccaggagaccctgtctt

SEQ ID NO: 4302480 - DNA, 11 bp, Homo sapiens
agccaggcctc

SEQ ID NO: 4302481 - DNA, 13 bp, Homo sapiens
agccaggcctccc

SEQ ID NO: 4302482 - DNA, 21 bp, Homo sapiens
agccaggcctcccgcatgctg

SEQ ID NO: 4302483 - DNA, 11 bp, Homo sapiens
agccagggctg

SEQ ID NO: 4302484 - DNA, 15 bp, Homo sapiens
agccagggctgtcct

SEQ ID NO: 4302485 - DNA, 19 bp, Homo sapiens
agccagggttccagacagg

SEQ ID NO: 4302486 - DNA, 18 bp, Homo sapiens
agccaggtgtcctgactg

SEQ ID NO: 4302487 - DNA, 18 bp, Homo sapiens
agccagtgactccaggag

SEQ ID NO: 4302488 - DNA, 20 bp, Homo sapiens
agccatatgacaatttcaaa

SEQ ID NO: 4302489 - DNA, 22 bp, Homo sapiens
agcccacatccattccagagct

SEQ ID NO: 4302490 - DNA, 14 bp, Homo sapiens
agcccactgcctgg

SEQ ID NO: 4302491 - DNA, 11 bp, Homo sapiens
agcccagagag

SEQ ID NO: 4302492 - DNA, 12 bp, Homo sapiens
agcccagagaga

SEQ ID NO: 4302493 - DNA, 16 bp, Homo sapiens
agcccagatggctccc

SEQ ID NO: 4302494 - DNA, 20 bp, Homo sapiens
agcccagatggctccctggg

SEQ ID NO: 4302495 - DNA, 15 bp, Homo sapiens
agcccaggacactgc

SEQ ID NO: 4302496 - DNA, 16 bp, Homo sapiens
agcccaggacactgcc

SEQ ID NO: 4302497 - DNA, 13 bp, Homo sapiens
agccccaggcagg

SEQ ID NO: 4302498 - DNA, 13 bp, Homo sapiens
agccccaggcctc

SEQ ID NO: 4302499 - DNA, 18 bp, Homo sapiens
agccccagggccctgctc

SEQ ID NO: 4302500 - DNA, 19 bp, Homo sapiens
agccccagggccctgctca

SEQ ID NO: 4302501 - DNA, 11 bp, Homo sapiens
agcccccacca

SEQ ID NO: 4302502 - DNA, 15 bp, Homo sapiens
agcccccaccagcag

SEQ ID NO: 4302503 - DNA, 17 bp, Homo sapiens
agcccccaccagcagca

SEQ ID NO: 4302504 - DNA, 23 bp, Homo sapiens
agcccccgccccgccccacattc

SEQ ID NO: 4302505 - DNA, 16 bp, Homo sapiens
agccccctcctgaccc

SEQ ID NO: 4302506 - DNA, 16 bp, Homo sapiens
agccccctggcccctc

SEQ ID NO: 4302507 - DNA, 14 bp, Homo sapiens
agccccgccgtgtc

SEQ ID NO: 4302508 - DNA, 23 bp, Homo sapiens
agccccgccgtgtctgtggccct

SEQ ID NO: 4302509 - DNA, 20 bp, Homo sapiens
agcccctatcctgcaccctc

SEQ ID NO: 4302510 - DNA, 23 bp, Homo sapiens
agcccctatcctgcaccctctgc

SEQ ID NO: 4302511 - DNA, 22 bp, Homo sapiens
agcccctccccatggtgcagtg

SEQ ID NO: 4302512 - DNA, 16 bp, Homo sapiens
agcccctcttgccccc

SEQ ID NO: 4302513 - DNA, 17 bp, Homo sapiens
agcccctcttgcccccc

SEQ ID NO: 4302514 - DNA, 16 bp, Homo sapiens
agcccgcacccccacc

SEQ ID NO: 4302515 - DNA, 19 bp, Homo sapiens
agcccgcacccccaccctt

SEQ ID NO: 4302516 - DNA, 21 bp, Homo sapiens
agcccgcacccccaccctttg

SEQ ID NO: 4302517 - DNA, 18 bp, Homo sapiens
agcccgcccacctgggcc

SEQ ID NO: 4302518 - DNA, 24 bp, Homo sapiens
agcccgggagatccgccctgggct

SEQ ID NO: 4302519 - DNA, 15 bp, Homo sapiens
agcccgtgtggcccc

SEQ ID NO: 4302520 - DNA, 16 bp, Homo sapiens
agcccgtgtggcccct

SEQ ID NO: 4302521 - DNA, 12 bp, Homo sapiens
agccctccctgc

SEQ ID NO: 4302522 - DNA, 15 bp, Homo sapiens
agccctccctgcccc

SEQ ID NO: 4302523 - DNA, 17 bp, Homo sapiens
agccctccctgcccctc

SEQ ID NO: 4302524 - DNA, 22 bp, Homo sapiens
agccctccctgcccctcccttc

SEQ ID NO: 4302525 - DNA, 17 bp, Homo sapiens
agccctctcactgtgtc

SEQ ID NO: 4302526 - DNA, 17 bp, Homo sapiens
agccctgctttgggctg

SEQ ID NO: 4302527 - DNA, 20 bp, Homo sapiens
agccctggtggccaagcctg

SEQ ID NO: 4302528 - DNA, 20 bp, Homo sapiens
agccctggttctccatcccc

SEQ ID NO: 4302529 - DNA, 21 bp, Homo sapiens
agccctggttctccatcccca

SEQ ID NO: 4302530 - DNA, 19 bp, Homo sapiens
agccctgtcagtgcagccc

SEQ ID NO: 4302531 - DNA, 20 bp, Homo sapiens
agccctgtcagtgcagcccg

SEQ ID NO: 4302532 - DNA, 15 bp, Homo sapiens
agccgagctctcctg

SEQ ID NO: 4302533 - DNA, 21 bp, Homo sapiens
agccgagctctcctgggccag

SEQ ID NO: 4302534 - DNA, 22 bp, Homo sapiens
agccgagctctcctgggccagg

SEQ ID NO: 4302535 - DNA, 20 bp, Homo sapiens
agccgtttgaatatatttta

SEQ ID NO: 4302536 - DNA, 21 bp, Homo sapiens
agccgtttgaatatattttat

SEQ ID NO: 4302537 - DNA, 12 bp, Homo sapiens
agcctagaggag

SEQ ID NO: 4302538 - DNA, 14 bp, Homo sapiens
agcctagaggagga

SEQ ID NO: 4302539 - DNA, 14 bp, Homo sapiens
agcctaggggtcag

SEQ ID NO: 4302540 - DNA, 12 bp, Homo sapiens
agcctagggtga

SEQ ID NO: 4302541 - DNA, 16 bp, Homo sapiens
agcctcagccactccc

SEQ ID NO: 4302542 - DNA, 24 bp, Homo sapiens
agcctcagtccctccctcctggct

SEQ ID NO: 4302543 - DNA, 19 bp, Homo sapiens
agcctcatgggagtcaggg

SEQ ID NO: 4302544 - DNA, 22 bp, Homo sapiens
agcctccacctgcagccccagg

SEQ ID NO: 4302545 - DNA, 20 bp, Homo sapiens
agcctccactccctgtctga

SEQ ID NO: 4302546 - DNA, 12 bp, Homo sapiens
agcctccctcag

SEQ ID NO: 4302547 - DNA, 12 bp, Homo sapiens
agcctcctgctg

SEQ ID NO: 4302548 - DNA, 18 bp, Homo sapiens
agcctgccccggccactc

SEQ ID NO: 4302549 - DNA, 15 bp, Homo sapiens
agcctggacacagtc

SEQ ID NO: 4302550 - DNA, 17 bp, Homo sapiens
agcctggcacagggcag

SEQ ID NO: 4302551 - DNA, 16 bp, Homo sapiens
agcctgggccactggc

SEQ ID NO: 4302552 - DNA, 17 bp, Homo sapiens
agcctgggccactggca

SEQ ID NO: 4302553 - DNA, 18 bp, Homo sapiens
agcctgggccactggcat

SEQ ID NO: 4302554 - DNA, 23 bp, Homo sapiens
agcctgggccactggcatctctg

SEQ ID NO: 4302555 - DNA, 22 bp, Homo sapiens
agcctgtgaactgccaggcagc

SEQ ID NO: 4302556 - DNA, 14 bp, Homo sapiens
agcctgtggcctca

SEQ ID NO: 4302557 - DNA, 15 bp, Homo sapiens
agcctgtggcctcag

SEQ ID NO: 4302558 - DNA, 18 bp, Homo sapiens
agcctgtggcctcagcat

SEQ ID NO: 4302559 - DNA, 14 bp, Homo sapiens
agcctgtgggagaa

SEQ ID NO: 4302560 - DNA, 19 bp, Homo sapiens
agcctgtgttagtgtctgt

SEQ ID NO: 4302561 - DNA, 16 bp, Homo sapiens
agcctgttgtttaagt

SEQ ID NO: 4302562 - DNA, 18 bp, Homo sapiens
agccttaagaaagctata

SEQ ID NO: 4302563 - DNA, 21 bp, Homo sapiens
agccttaagtcttactgtttt

SEQ ID NO: 4302564 - DNA, 14 bp, Homo sapiens
agccttctctgttc

SEQ ID NO: 4302565 - DNA, 21 bp, Homo sapiens
agccttctctgttcatttcct

SEQ ID NO: 4302566 - DNA, 14 bp, Homo sapiens
agcctttccagaac

SEQ ID NO: 4302567 - DNA, 17 bp, Homo sapiens
agcgacatctctgactt

SEQ ID NO: 4302568 - DNA, 18 bp, Homo sapiens
agcgagtctggagaccag

SEQ ID NO: 4302569 - DNA, 11 bp, Homo sapiens
agcgcccctcc

SEQ ID NO: 4302570 - DNA, 13 bp, Homo sapiens
agcgctggcctct

SEQ ID NO: 4302571 - DNA, 23 bp, Homo sapiens
agcggcctggggacggagcactg

SEQ ID NO: 4302572 - DNA, 16 bp, Homo sapiens
agcgggagtgtggggg

SEQ ID NO: 4302573 - DNA, 15 bp, Homo sapiens
agcgggtaaaaagag

SEQ ID NO: 4302574 - DNA, 22 bp, Homo sapiens
agcgtctgagcggccgcctgtc

SEQ ID NO: 4302575 - DNA, 22 bp, Homo sapiens
agcgtctttttaacctcagaaa

SEQ ID NO: 4302576 - DNA, 12 bp, Homo sapiens
agcgtgtcctat

SEQ ID NO: 4302577 - DNA, 15 bp, Homo sapiens
agcgtgtcctatccc

SEQ ID NO: 4302578 - DNA, 15 bp, Homo sapiens
agctagagaaattct

SEQ ID NO: 4302579 - DNA, 22 bp, Homo sapiens
agctagaggagattgctctggg

SEQ ID NO: 4302580 - DNA, 18 bp, Homo sapiens
agctataacaactctatt

SEQ ID NO: 4302581 - DNA, 17 bp, Homo sapiens
agctatcttcatgtaaa

SEQ ID NO: 4302582 - DNA, 15 bp, Homo sapiens
agctatgctgtatct

SEQ ID NO: 4302583 - DNA, 17 bp, Homo sapiens
agctatgctgtatctgt

SEQ ID NO: 4302584 - DNA, 15 bp, Homo sapiens
agctcaccctgctcc

SEQ ID NO: 4302585 - DNA, 17 bp, Homo sapiens
agctcagcacagcctca

SEQ ID NO: 4302586 - DNA, 15 bp, Homo sapiens
agctcagcccacccc

SEQ ID NO: 4302587 - DNA, 21 bp, Homo sapiens
agctcagcccacccccctcat

SEQ ID NO: 4302588 - DNA, 22 bp, Homo sapiens
agctcagcccacccccctcatt

SEQ ID NO: 4302589 - DNA, 18 bp, Homo sapiens
agctcaggagaaggcctg

SEQ ID NO: 4302590 - DNA, 22 bp, Homo sapiens
agctcaggagaaggcctgcccc

SEQ ID NO: 4302591 - DNA, 16 bp, Homo sapiens
agctcagggctggatt

SEQ ID NO: 4302592 - DNA, 16 bp, Homo sapiens
agctccacagaagaca

SEQ ID NO: 4302593 - DNA, 14 bp, Homo sapiens
agctccagaccccc

SEQ ID NO: 4302594 - DNA, 19 bp, Homo sapiens
agctccagacccccagcaa

SEQ ID NO: 4302595 - DNA, 13 bp, Homo sapiens
agctccaggcagg

SEQ ID NO: 4302596 - DNA, 19 bp, Homo sapiens
agctcctctgggcaggacc

SEQ ID NO: 4302597 - DNA, 18 bp, Homo sapiens
agctcgtgtgcttagaaa

SEQ ID NO: 4302598 - DNA, 13 bp, Homo sapiens
agctctcccctgc

SEQ ID NO: 4302599 - DNA, 20 bp, Homo sapiens
agctctcccctgcgcaggcc

SEQ ID NO: 4302600 - DNA, 16 bp, Homo sapiens
agctctgacctgcccc

SEQ ID NO: 4302601 - DNA, 20 bp, Homo sapiens
agctgagcacccagctctgt

SEQ ID NO: 4302602 - DNA, 13 bp, Homo sapiens
agctgaggggcag

SEQ ID NO: 4302603 - DNA, 18 bp, Homo sapiens
agctgcagaaccagtccc

SEQ ID NO: 4302604 - DNA, 19 bp, Homo sapiens
agctgcagaaccagtccct

SEQ ID NO: 4302605 - DNA, 20 bp, Homo sapiens
agctgcaggaatcaaaaatt

SEQ ID NO: 4302606 - DNA, 23 bp, Homo sapiens
agctgcaggaatcaaaaattgaa

SEQ ID NO: 4302607 - DNA, 19 bp, Homo sapiens
agctgcagttagcacagag

SEQ ID NO: 4302608 - DNA, 12 bp, Homo sapiens
agctgccagaga

SEQ ID NO: 4302609 - DNA, 14 bp, Homo sapiens
agctgctctattgt

SEQ ID NO: 4302610 - DNA, 14 bp, Homo sapiens
agctgcttccagtt

SEQ ID NO: 4302611 - DNA, 22 bp, Homo sapiens
agctggagagagagttctcaca

SEQ ID NO: 4302612 - DNA, 16 bp, Homo sapiens
agctggcaggagggtg

SEQ ID NO: 4302613 - DNA, 15 bp, Homo sapiens
agctggcgtctgtct

SEQ ID NO: 4302614 - DNA, 18 bp, Homo sapiens
agctggcgtctgtcttca

SEQ ID NO: 4302615 - DNA, 16 bp, Homo sapiens
agctggctctgcagca

SEQ ID NO: 4302616 - DNA, 19 bp, Homo sapiens
agctggctctgcagcacat

SEQ ID NO: 4302617 - DNA, 20 bp, Homo sapiens
agctggggaatcccctcgct

SEQ ID NO: 4302618 - DNA, 15 bp, Homo sapiens
agctggggagggaga

SEQ ID NO: 4302619 - DNA, 16 bp, Homo sapiens
agctgggggccatgag

SEQ ID NO: 4302620 - DNA, 20 bp, Homo sapiens
agctgtacaaagggaagcag

SEQ ID NO: 4302621 - DNA, 22 bp, Homo sapiens
agctgtacaaagggaagcagag

SEQ ID NO: 4302622 - DNA, 16 bp, Homo sapiens
agctgtctgtggcttc

SEQ ID NO: 4302623 - DNA, 12 bp, Homo sapiens
agctgtgatttt

SEQ ID NO: 4302624 - DNA, 13 bp, Homo sapiens
agctgtgccagct

SEQ ID NO: 4302625 - DNA, 14 bp, Homo sapiens
agctgtgccagctg

SEQ ID NO: 4302626 - DNA, 16 bp, Homo sapiens
agctgtgccagctgct

SEQ ID NO: 4302627 - DNA, 23 bp, Homo sapiens
agctgtgcgagaacacaagccac

SEQ ID NO: 4302628 - DNA, 19 bp, Homo sapiens
agcttaagaagtatccctg

SEQ ID NO: 4302629 - DNA, 21 bp, Homo sapiens
agcttcagatggtgaagcatt

SEQ ID NO: 4302630 - DNA, 19 bp, Homo sapiens
agcttcaggtgagccaagg

SEQ ID NO: 4302631 - DNA, 13 bp, Homo sapiens
agcttctccagcc

SEQ ID NO: 4302632 - DNA, 15 bp, Homo sapiens
agcttctccagccac

SEQ ID NO: 4302633 - DNA, 17 bp, Homo sapiens
agcttctccagccacca

SEQ ID NO: 4302634 - DNA, 12 bp, Homo sapiens
agcttgaatgtc

SEQ ID NO: 4302635 - DNA, 14 bp, Homo sapiens
agcttggccagaag

SEQ ID NO: 4302636 - DNA, 12 bp, Homo sapiens
agcttgtttcta

SEQ ID NO: 4302637 - DNA, 14 bp, Homo sapiens
agcttgtttctata

SEQ ID NO: 4302638 - DNA, 17 bp, Homo sapiens
agcttgtttctatactg

SEQ ID NO: 4302639 - DNA, 17 bp, Homo sapiens
agcttgtttgttctagt

SEQ ID NO: 4302640 - DNA, 21 bp, Homo sapiens
agcttttttttcagccattca

SEQ ID NO: 4302641 - DNA, 18 bp, Homo sapiens
aggaaaaaggctggtgga

SEQ ID NO: 4302642 - DNA, 21 bp, Homo sapiens
aggaaaaccaagccgtggctt

SEQ ID NO: 4302643 - DNA, 12 bp, Homo sapiens
aggaaaactgtt

SEQ ID NO: 4302644 - DNA, 16 bp, Homo sapiens
aggaaaccttttcttg

SEQ ID NO: 4302645 - DNA, 20 bp, Homo sapiens
aggaaaggagagtactttgg

SEQ ID NO: 4302646 - DNA, 22 bp, Homo sapiens
aggaaagtatctctactttcct

SEQ ID NO: 4302647 - DNA, 18 bp, Homo sapiens
aggaaataagacttttag

SEQ ID NO: 4302648 - DNA, 16 bp, Homo sapiens
aggaacagagtatata

SEQ ID NO: 4302649 - DNA, 19 bp, Homo sapiens
aggaacagagtatatatgt

SEQ ID NO: 4302650 - DNA, 23 bp, Homo sapiens
aggaacctcgaagctgttctctg

SEQ ID NO: 4302651 - DNA, 14 bp, Homo sapiens
aggaacctctgatt

SEQ ID NO: 4302652 - DNA, 21 bp, Homo sapiens
aggaacctctgatttattttg

SEQ ID NO: 4302653 - DNA, 22 bp, Homo sapiens
aggaacctctgatttattttgt

SEQ ID NO: 4302654 - DNA, 23 bp, Homo sapiens
aggaactggtccaggccaggcct

SEQ ID NO: 4302655 - DNA, 13 bp, Homo sapiens
aggaagaggccgc

SEQ ID NO: 4302656 - DNA, 19 bp, Homo sapiens
aggaagcaaggccagccct

SEQ ID NO: 4302657 - DNA, 16 bp, Homo sapiens
aggaagcctcctgctg

SEQ ID NO: 4302658 - DNA, 18 bp, Homo sapiens
aggaagcctcctgctgag

SEQ ID NO: 4302659 - DNA, 13 bp, Homo sapiens
aggaaggcggggc

SEQ ID NO: 4302660 - DNA, 15 bp, Homo sapiens
aggaagggaggcctg

SEQ ID NO: 4302661 - DNA, 20 bp, Homo sapiens
aggaagggaggcctgagggg

SEQ ID NO: 4302662 - DNA, 19 bp, Homo sapiens
aggaaggtctcatgcctga

SEQ ID NO: 4302663 - DNA, 18 bp, Homo sapiens
aggaagtcaggagccagc

SEQ ID NO: 4302664 - DNA, 19 bp, Homo sapiens
aggaagtcaggagccagca

SEQ ID NO: 4302665 - DNA, 21 bp, Homo sapiens
aggaagtcaggagccagcagg

SEQ ID NO: 4302666 - DNA, 16 bp, Homo sapiens
aggaagtcatcctgca

SEQ ID NO: 4302667 - DNA, 17 bp, Homo sapiens
aggaagtcatcctgcaa

SEQ ID NO: 4302668 - DNA, 20 bp, Homo sapiens
aggaagtccctgagaagcct

SEQ ID NO: 4302669 - DNA, 15 bp, Homo sapiens
aggaagtgataacac

SEQ ID NO: 4302670 - DNA, 12 bp, Homo sapiens
aggaatgctccc

SEQ ID NO: 4302671 - DNA, 21 bp, Homo sapiens
aggaatggtgcttggcaggaa

SEQ ID NO: 4302672 - DNA, 16 bp, Homo sapiens
aggacactgcctttgc

SEQ ID NO: 4302673 - DNA, 17 bp, Homo sapiens
aggacagtaaactcact

SEQ ID NO: 4302674 - DNA, 13 bp, Homo sapiens
aggaccaggagcc

SEQ ID NO: 4302675 - DNA, 16 bp, Homo sapiens
aggaccaggagccagg

SEQ ID NO: 4302676 - DNA, 16 bp, Homo sapiens
aggaccccatctgctg

SEQ ID NO: 4302677 - DNA, 17 bp, Homo sapiens
aggacccggaggggcct

SEQ ID NO: 4302678 - DNA, 18 bp, Homo sapiens
aggacccggaggggcctg

SEQ ID NO: 4302679 - DNA, 21 bp, Homo sapiens
aggacccggaggggcctggca

SEQ ID NO: 4302680 - DNA, 19 bp, Homo sapiens
aggaccctgagggtttcca

SEQ ID NO: 4302681 - DNA, 12 bp, Homo sapiens
aggaccctgggt

SEQ ID NO: 4302682 - DNA, 13 bp, Homo sapiens
aggacctccacct

SEQ ID NO: 4302683 - DNA, 16 bp, Homo sapiens
aggacctccacctggg

SEQ ID NO: 4302684 - DNA, 20 bp, Homo sapiens
aggacctccacctgggagat

SEQ ID NO: 4302685 - DNA, 18 bp, Homo sapiens
aggacgcagggagaccct

SEQ ID NO: 4302686 - DNA, 20 bp, Homo sapiens
aggacgcagggagaccctgg

SEQ ID NO: 4302687 - DNA, 21 bp, Homo sapiens
aggacgcagggagaccctggg

SEQ ID NO: 4302688 - DNA, 12 bp, Homo sapiens
aggacgcatgca

SEQ ID NO: 4302689 - DNA, 14 bp, Homo sapiens
aggacgcatgcagg

SEQ ID NO: 4302690 - DNA, 16 bp, Homo sapiens
aggacgcatgcagggc

SEQ ID NO: 4302691 - DNA, 16 bp, Homo sapiens
aggacgtgaagcctcc

SEQ ID NO: 4302692 - DNA, 23 bp, Homo sapiens
aggactcgggctaagtccagctc

SEQ ID NO: 4302693 - DNA, 13 bp, Homo sapiens
aggactctgcctt

SEQ ID NO: 4302694 - DNA, 22 bp, Homo sapiens
aggactgccgaccgaggctgga

SEQ ID NO: 4302695 - DNA, 18 bp, Homo sapiens
aggactgttttttcctga

SEQ ID NO: 4302696 - DNA, 14 bp, Homo sapiens
aggacttgtgcctc

SEQ ID NO: 4302697 - DNA, 16 bp, Homo sapiens
aggacttgtgcctctt

SEQ ID NO: 4302698 - DNA, 21 bp, Homo sapiens
aggacttgtgcctcttgggag

SEQ ID NO: 4302699 - DNA, 19 bp, Homo sapiens
aggagaaggcctgcccccc

SEQ ID NO: 4302700 - DNA, 21 bp, Homo sapiens
aggagacactggtctcagagg

SEQ ID NO: 4302701 - DNA, 16 bp, Homo sapiens
aggagaccctgtcttt

SEQ ID NO: 4302702 - DNA, 17 bp, Homo sapiens
aggagaccctgtctttg

SEQ ID NO: 4302703 - DNA, 14 bp, Homo sapiens
aggagactcaggcc

SEQ ID NO: 4302704 - DNA, 14 bp, Homo sapiens
aggagagaatgaga

SEQ ID NO: 4302705 - DNA, 22 bp, Homo sapiens
aggagagaatgagagagtgtgg

SEQ ID NO: 4302706 - DNA, 21 bp, Homo sapiens
aggagagcccccaccagcagc

SEQ ID NO: 4302707 - DNA, 21 bp, Homo sapiens
aggagcagcccacctgctgcc

SEQ ID NO: 4302708 - DNA, 21 bp, Homo sapiens
aggagcaggaagcaaggccag

SEQ ID NO: 4302709 - DNA, 23 bp, Homo sapiens
aggagcaggaagcaaggccagcc

SEQ ID NO: 4302710 - DNA, 22 bp, Homo sapiens
aggagcagtgggccctggctct

SEQ ID NO: 4302711 - DNA, 21 bp, Homo sapiens
aggagccagcagggcgggcca

SEQ ID NO: 4302712 - DNA, 14 bp, Homo sapiens
aggagccagctccc

SEQ ID NO: 4302713 - DNA, 17 bp, Homo sapiens
aggagccagctcccagc

SEQ ID NO: 4302714 - DNA, 15 bp, Homo sapiens
aggagcctagaggag

SEQ ID NO: 4302715 - DNA, 13 bp, Homo sapiens
aggagcttccaga

SEQ ID NO: 4302716 - DNA, 19 bp, Homo sapiens
aggaggaaaaaggctggtg

SEQ ID NO: 4302717 - DNA, 16 bp, Homo sapiens
aggaggaactggtcca

SEQ ID NO: 4302718 - DNA, 20 bp, Homo sapiens
aggaggaagggactggtcca

SEQ ID NO: 4302719 - DNA, 18 bp, Homo sapiens
aggaggacaggtggaggc

SEQ ID NO: 4302720 - DNA, 19 bp, Homo sapiens
aggaggacaggtggaggcg

SEQ ID NO: 4302721 - DNA, 15 bp, Homo sapiens
aggaggatccgggct

SEQ ID NO: 4302722 - DNA, 18 bp, Homo sapiens
aggaggcagtggcttgga

SEQ ID NO: 4302723 - DNA, 16 bp, Homo sapiens
aggagggatagagacg

SEQ ID NO: 4302724 - DNA, 17 bp, Homo sapiens
aggagggggcccggctg

SEQ ID NO: 4302725 - DNA, 17 bp, Homo sapiens
aggaggtgtggagtgga

SEQ ID NO: 4302726 - DNA, 19 bp, Homo sapiens
aggaggtgtggagtggagg

SEQ ID NO: 4302727 - DNA, 16 bp, Homo sapiens
aggagtctgattgcag

SEQ ID NO: 4302728 - DNA, 16 bp, Homo sapiens
aggagtgcccgccttg

SEQ ID NO: 4302729 - DNA, 18 bp, Homo sapiens
aggagtgggctctgagca

SEQ ID NO: 4302730 - DNA, 20 bp, Homo sapiens
aggataaattaatgagtttt

SEQ ID NO: 4302731 - DNA, 15 bp, Homo sapiens
aggataccatataca

SEQ ID NO: 4302732 - DNA, 22 bp, Homo sapiens
aggataccatatacagctcaga

SEQ ID NO: 4302733 - DNA, 20 bp, Homo sapiens
aggatattacaatggccagc

SEQ ID NO: 4302734 - DNA, 22 bp, Homo sapiens
aggatattacaatggccagccc

SEQ ID NO: 4302735 - DNA, 18 bp, Homo sapiens
aggatgaactagccatga

SEQ ID NO: 4302736 - DNA, 19 bp, Homo sapiens
aggatgcatgcagggcccc

SEQ ID NO: 4302737 - DNA, 16 bp, Homo sapiens
aggatgtggatggagg

SEQ ID NO: 4302738 - DNA, 19 bp, Homo sapiens
aggattgtccacaaatgtc

SEQ ID NO: 4302739 - DNA, 20 bp, Homo sapiens
aggattgtccacaaatgtcc

SEQ ID NO: 4302740 - DNA, 11 bp, Homo sapiens
aggcaaatgtc

SEQ ID NO: 4302741 - DNA, 14 bp, Homo sapiens
aggcaagctggcag

SEQ ID NO: 4302742 - DNA, 14 bp, Homo sapiens
aggcagaatggtgg

SEQ ID NO: 4302743 - DNA, 20 bp, Homo sapiens
aggcagaatggtgggctcca

SEQ ID NO: 4302744 - DNA, 21 bp, Homo sapiens
aggcagaatggtgggctccag

SEQ ID NO: 4302745 - DNA, 22 bp, Homo sapiens
aggcagagattgggggggcttg

SEQ ID NO: 4302746 - DNA, 21 bp, Homo sapiens
aggcagagctcagcacagcct

SEQ ID NO: 4302747 - DNA, 15 bp, Homo sapiens
aggcagcaacaggac

SEQ ID NO: 4302748 - DNA, 12 bp, Homo sapiens
aggcagcctgtg

SEQ ID NO: 4302749 - DNA, 18 bp, Homo sapiens
aggcagcctgtgggtcct

SEQ ID NO: 4302750 - DNA, 16 bp, Homo sapiens
aggcaggaagtcagga

SEQ ID NO: 4302751 - DNA, 18 bp, Homo sapiens
aggcaggaagtcaggagc

SEQ ID NO: 4302752 - DNA, 21 bp, Homo sapiens
aggcaggaagtcaggagccag

SEQ ID NO: 4302753 - DNA, 17 bp, Homo sapiens
aggcaggggctgggcag

SEQ ID NO: 4302754 - DNA, 21 bp, Homo sapiens
aggcaggggctgggcagaggg

SEQ ID NO: 4302755 - DNA, 14 bp, Homo sapiens
aggcagtggcagca

SEQ ID NO: 4302756 - DNA, 14 bp, Homo sapiens
aggcagtggcccag

SEQ ID NO: 4302757 - DNA, 15 bp, Homo sapiens
aggcagtggcccagg

SEQ ID NO: 4302758 - DNA, 17 bp, Homo sapiens
aggcatactctccagga

SEQ ID NO: 4302759 - DNA, 13 bp, Homo sapiens
aggcatgaccctg

SEQ ID NO: 4302760 - DNA, 21 bp, Homo sapiens
aggcatgaccctggagcccgg

SEQ ID NO: 4302761 - DNA, 15 bp, Homo sapiens
aggcatgcctgtgtg

SEQ ID NO: 4302762 - DNA, 22 bp, Homo sapiens
aggcattaaattttagcaaaga

SEQ ID NO: 4302763 - DNA, 16 bp, Homo sapiens
aggcattcagcaatta

SEQ ID NO: 4302764 - DNA, 14 bp, Homo sapiens
aggccaagtgcagg

SEQ ID NO: 4302765 - DNA, 15 bp, Homo sapiens
aggccacctgccccc

SEQ ID NO: 4302766 - DNA, 16 bp, Homo sapiens
aggccacctgccccct

SEQ ID NO: 4302767 - DNA, 21 bp, Homo sapiens
aggccacctgcccccttctcc

SEQ ID NO: 4302768 - DNA, 13 bp, Homo sapiens
aggccagaggaag

SEQ ID NO: 4302769 - DNA, 15 bp, Homo sapiens
aggccagaggaaggg

SEQ ID NO: 4302770 - DNA, 14 bp, Homo sapiens
aggccagaggtgaa

SEQ ID NO: 4302771 - DNA, 15 bp, Homo sapiens
aggccagctccttag

SEQ ID NO: 4302772 - DNA, 17 bp, Homo sapiens
aggcccaaaccaggggg

SEQ ID NO: 4302773 - DNA, 18 bp, Homo sapiens
aggcccaaccaccagatg

SEQ ID NO: 4302774 - DNA, 19 bp, Homo sapiens
aggcccaaccaccagatga

SEQ ID NO: 4302775 - DNA, 15 bp, Homo sapiens
aggcccagcctggcc

SEQ ID NO: 4302776 - DNA, 18 bp, Homo sapiens
aggcccagcctggcccca

SEQ ID NO: 4302777 - DNA, 12 bp, Homo sapiens
aggccccaggct

SEQ ID NO: 4302778 - DNA, 20 bp, Homo sapiens
aggccccaggctggatgctg

SEQ ID NO: 4302779 - DNA, 24 bp, Homo sapiens
aggcccccgcacgcaagcctcagc

SEQ ID NO: 4302780 - DNA, 13 bp, Homo sapiens
aggccccttgctg

SEQ ID NO: 4302781 - DNA, 19 bp, Homo sapiens
aggccccttgctgctggct

SEQ ID NO: 4302782 - DNA, 14 bp, Homo sapiens
aggccctggtctgg

SEQ ID NO: 4302783 - DNA, 15 bp, Homo sapiens
aggcccttcctctcc

SEQ ID NO: 4302784 - DNA, 22 bp, Homo sapiens
aggccggtgggaagagggcagg

SEQ ID NO: 4302785 - DNA, 20 bp, Homo sapiens
aggcctatgccacctgcagc

SEQ ID NO: 4302786 - DNA, 13 bp, Homo sapiens
aggcctcacctgg

SEQ ID NO: 4302787 - DNA, 15 bp, Homo sapiens
aggcctcacctggct

SEQ ID NO: 4302788 - DNA, 16 bp, Homo sapiens
aggcctcacctggctt

SEQ ID NO: 4302789 - DNA, 17 bp, Homo sapiens
aggcctcacctggcttc

SEQ ID NO: 4302790 - DNA, 21 bp, Homo sapiens
aggcctcacctggcttcccag

SEQ ID NO: 4302791 - DNA, 23 bp, Homo sapiens
aggcctcatcctcctggacccag

SEQ ID NO: 4302792 - DNA, 17 bp, Homo sapiens
aggcctcccgcatgctg

SEQ ID NO: 4302793 - DNA, 21 bp, Homo sapiens
aggcctcccgcatgctgcctg

SEQ ID NO: 4302794 - DNA, 13 bp, Homo sapiens
aggcctctgcaag

SEQ ID NO: 4302795 - DNA, 21 bp, Homo sapiens
aggcctgaaatgtttccaggc

SEQ ID NO: 4302796 - DNA, 13 bp, Homo sapiens
aggcctgaggggc

SEQ ID NO: 4302797 - DNA, 16 bp, Homo sapiens
aggcctgaggggcaga

SEQ ID NO: 4302798 - DNA, 15 bp, Homo sapiens
aggcctgcccccctt

SEQ ID NO: 4302799 - DNA, 16 bp, Homo sapiens
aggcctgccccccttc

SEQ ID NO: 4302800 - DNA, 17 bp, Homo sapiens
aggcctgccccccttcc

SEQ ID NO: 4302801 - DNA, 18 bp, Homo sapiens
aggcctgccccccttccc

SEQ ID NO: 4302802 - DNA, 19 bp, Homo sapiens
aggcctggagttgggctgg

SEQ ID NO: 4302803 - DNA, 14 bp, Homo sapiens
aggcctggcccagc

SEQ ID NO: 4302804 - DNA, 19 bp, Homo sapiens
aggcctggcccagccagca

SEQ ID NO: 4302805 - DNA, 22 bp, Homo sapiens
aggcctggccctttcacccctc

SEQ ID NO: 4302806 - DNA, 12 bp, Homo sapiens
aggcctggtctg

SEQ ID NO: 4302807 - DNA, 14 bp, Homo sapiens
aggcctggtctgga

SEQ ID NO: 4302808 - DNA, 22 bp, Homo sapiens
aggcctggtctggagcccctat

SEQ ID NO: 4302809 - DNA, 20 bp, Homo sapiens
aggcctggtgccctggccca

SEQ ID NO: 4302810 - DNA, 21 bp, Homo sapiens
aggcctggtgccctggcccag

SEQ ID NO: 4302811 - DNA, 17 bp, Homo sapiens
aggcctttttgagccaa

SEQ ID NO: 4302812 - DNA, 18 bp, Homo sapiens
aggcggtatccagaggtg

SEQ ID NO: 4302813 - DNA, 14 bp, Homo sapiens
aggcgtagggccag

SEQ ID NO: 4302814 - DNA, 21 bp, Homo sapiens
aggcgtagggccagggctctg

SEQ ID NO: 4302815 - DNA, 13 bp, Homo sapiens
aggcgtcttgtat

SEQ ID NO: 4302816 - DNA, 23 bp, Homo sapiens
aggcgtgggatccagagagaagc

SEQ ID NO: 4302817 - DNA, 13 bp, Homo sapiens
aggctaagcctgg

SEQ ID NO: 4302818 - DNA, 15 bp, Homo sapiens
aggctaagcctggac

SEQ ID NO: 4302819 - DNA, 16 bp, Homo sapiens
aggctaagcctggaca

SEQ ID NO: 4302820 - DNA, 16 bp, Homo sapiens
aggctattcctaggcc

SEQ ID NO: 4302821 - DNA, 19 bp, Homo sapiens
aggctattcctaggcctca

SEQ ID NO: 4302822 - DNA, 23 bp, Homo sapiens
aggctcacaactgtttttgaaga

SEQ ID NO: 4302823 - DNA, 18 bp, Homo sapiens
aggctctgaaagctgctt

SEQ ID NO: 4302824 - DNA, 14 bp, Homo sapiens
aggctgaaaagtgc

SEQ ID NO: 4302825 - DNA, 14 bp, Homo sapiens
aggctgccccaccc

SEQ ID NO: 4302826 - DNA, 17 bp, Homo sapiens
aggctgccccaggggca

SEQ ID NO: 4302827 - DNA, 18 bp, Homo sapiens
aggctggatgctgggttc

SEQ ID NO: 4302828 - DNA, 19 bp, Homo sapiens
aggctggcaccgccttctc

SEQ ID NO: 4302829 - DNA, 20 bp, Homo sapiens
aggctggcaccgccttctct

SEQ ID NO: 4302830 - DNA, 15 bp, Homo sapiens
aggctggtggacaga

SEQ ID NO: 4302831 - DNA, 20 bp, Homo sapiens
aggctggtggacagacccag

SEQ ID NO: 4302832 - DNA, 14 bp, Homo sapiens
aggctgtattttct

SEQ ID NO: 4302833 - DNA, 22 bp, Homo sapiens
aggctgtattttcttttatatc

SEQ ID NO: 4302834 - DNA, 21 bp, Homo sapiens
aggcttccggctgagctgtgc

SEQ ID NO: 4302835 - DNA, 22 bp, Homo sapiens
aggcttccggctgagctgtgcc

SEQ ID NO: 4302836 - DNA, 18 bp, Homo sapiens
aggcttccttcatttcct

SEQ ID NO: 4302837 - DNA, 14 bp, Homo sapiens
agggaaatccaact

SEQ ID NO: 4302838 - DNA, 19 bp, Homo sapiens
agggaaatccaactccagg

SEQ ID NO: 4302839 - DNA, 14 bp, Homo sapiens
agggaattctcttg

SEQ ID NO: 4302840 - DNA, 15 bp, Homo sapiens
agggaattctcttgg

SEQ ID NO: 4302841 - DNA, 13 bp, Homo sapiens
agggacagtgggc

SEQ ID NO: 4302842 - DNA, 14 bp, Homo sapiens
agggaccaaggacc

SEQ ID NO: 4302843 - DNA, 19 bp, Homo sapiens
agggaccaaggacccctca

SEQ ID NO: 4302844 - DNA, 14 bp, Homo sapiens
agggaccaaggaga

SEQ ID NO: 4302845 - DNA, 17 bp, Homo sapiens
agggaccgggagcctgc

SEQ ID NO: 4302846 - DNA, 14 bp, Homo sapiens
agggactgggggtg

SEQ ID NO: 4302847 - DNA, 16 bp, Homo sapiens
agggagaaggagaggc

SEQ ID NO: 4302848 - DNA, 21 bp, Homo sapiens
agggagaaggagaggctctga

SEQ ID NO: 4302849 - DNA, 13 bp, Homo sapiens
agggagaccctgg

SEQ ID NO: 4302850 - DNA, 15 bp, Homo sapiens
agggagcactggagg

SEQ ID NO: 4302851 - DNA, 21 bp, Homo sapiens
agggaggaatcgaggaaccag

SEQ ID NO: 4302852 - DNA, 17 bp, Homo sapiens
agggaggcctgaggggc

SEQ ID NO: 4302853 - DNA, 16 bp, Homo sapiens
agggatagagacgcag

SEQ ID NO: 4302854 - DNA, 18 bp, Homo sapiens
agggatcagccctgccct

SEQ ID NO: 4302855 - DNA, 13 bp, Homo sapiens
agggcagcccctc

SEQ ID NO: 4302856 - DNA, 17 bp, Homo sapiens
agggcagcccctcccca

SEQ ID NO: 4302857 - DNA, 18 bp, Homo sapiens
agggcagcctgtgggaga

SEQ ID NO: 4302858 - DNA, 19 bp, Homo sapiens
agggcagcctgtgggagaa

SEQ ID NO: 4302859 - DNA, 23 bp, Homo sapiens
agggcagcctgtgggagaaggga

SEQ ID NO: 4302860 - DNA, 14 bp, Homo sapiens
agggcaggagccta

SEQ ID NO: 4302861 - DNA, 16 bp, Homo sapiens
agggcaggagcctaga

SEQ ID NO: 4302862 - DNA, 11 bp, Homo sapiens
agggcaggcag

SEQ ID NO: 4302863 - DNA, 22 bp, Homo sapiens
agggcagggttctagaaggggc

SEQ ID NO: 4302864 - DNA, 19 bp, Homo sapiens
agggcatctccaggaaggc

SEQ ID NO: 4302865 - DNA, 18 bp, Homo sapiens
agggcatttttcttggat

SEQ ID NO: 4302866 - DNA, 15 bp, Homo sapiens
agggccagggctctg

SEQ ID NO: 4302867 - DNA, 18 bp, Homo sapiens
agggccagggctctggca

SEQ ID NO: 4302868 - DNA, 21 bp, Homo sapiens
agggcccagaggggcggggcc

SEQ ID NO: 4302869 - DNA, 14 bp, Homo sapiens
agggcccctcactg

SEQ ID NO: 4302870 - DNA, 18 bp, Homo sapiens
agggcccctcactggctg

SEQ ID NO: 4302871 - DNA, 16 bp, Homo sapiens
agggcccctgaagtga

SEQ ID NO: 4302872 - DNA, 20 bp, Homo sapiens
agggccctgctcaggcctca

SEQ ID NO: 4302873 - DNA, 23 bp, Homo sapiens
agggcccttcccaacctcccctg

SEQ ID NO: 4302874 - DNA, 15 bp, Homo sapiens
agggcctccagccct

SEQ ID NO: 4302875 - DNA, 13 bp, Homo sapiens
agggcgaggggag

SEQ ID NO: 4302876 - DNA, 23 bp, Homo sapiens
agggcgaggggagggtggcaggt

SEQ ID NO: 4302877 - DNA, 14 bp, Homo sapiens
agggcgggccagga

SEQ ID NO: 4302878 - DNA, 17 bp, Homo sapiens
agggctccacgggggcc

SEQ ID NO: 4302879 - DNA, 18 bp, Homo sapiens
aggggaagtgtgctgagg

SEQ ID NO: 4302880 - DNA, 21 bp, Homo sapiens
aggggacagatcttgagcaag

SEQ ID NO: 4302881 - DNA, 22 bp, Homo sapiens
aggggagacttaggccagaggt

SEQ ID NO: 4302882 - DNA, 17 bp, Homo sapiens
aggggagaggaagcaca

SEQ ID NO: 4302883 - DNA, 16 bp, Homo sapiens
aggggatctaaaagga

SEQ ID NO: 4302884 - DNA, 21 bp, Homo sapiens
aggggatctaaaaggaggaca

SEQ ID NO: 4302885 - DNA, 22 bp, Homo sapiens
aggggatctaaaaggaggacag

SEQ ID NO: 4302886 - DNA, 12 bp, Homo sapiens
aggggcagaagg

SEQ ID NO: 4302887 - DNA, 15 bp, Homo sapiens
aggggcagaaggagg

SEQ ID NO: 4302888 - DNA, 12 bp, Homo sapiens
aggggcctggca

SEQ ID NO: 4302889 - DNA, 15 bp, Homo sapiens
aggggcctggcagcc

SEQ ID NO: 4302890 - DNA, 23 bp, Homo sapiens
aggggctgcatcctcagccccag

SEQ ID NO: 4302891 - DNA, 13 bp, Homo sapiens
aggggctgggcag

SEQ ID NO: 4302892 - DNA, 14 bp, Homo sapiens
aggggctgggcaga

SEQ ID NO: 4302893 - DNA, 17 bp, Homo sapiens
aggggcttccctctgct

SEQ ID NO: 4302894 - DNA, 21 bp, Homo sapiens
agggggaagcaccagcctcag

SEQ ID NO: 4302895 - DNA, 13 bp, Homo sapiens
agggggcaggccc

SEQ ID NO: 4302896 - DNA, 18 bp, Homo sapiens
agggggcccggctgggcc

SEQ ID NO: 4302897 - DNA, 17 bp, Homo sapiens
agggggcctgagttgag

SEQ ID NO: 4302898 - DNA, 12 bp, Homo sapiens
aggggggttggg

SEQ ID NO: 4302899 - DNA, 21 bp, Homo sapiens
aggggggttgggttccagaca

SEQ ID NO: 4302900 - DNA, 16 bp, Homo sapiens
agggggtttgggggct

SEQ ID NO: 4302901 - DNA, 22 bp, Homo sapiens
agggggtttgggggcttgcaag

SEQ ID NO: 4302902 - DNA, 22 bp, Homo sapiens
aggggtcagcaggggggttggg

SEQ ID NO: 4302903 - DNA, 20 bp, Homo sapiens
aggggtcagggaccaaggac

SEQ ID NO: 4302904 - DNA, 15 bp, Homo sapiens
aggggtgagccccgc

SEQ ID NO: 4302905 - DNA, 17 bp, Homo sapiens
aggggtgagccccgccg

SEQ ID NO: 4302906 - DNA, 17 bp, Homo sapiens
aggggtgggggagaatg

SEQ ID NO: 4302907 - DNA, 19 bp, Homo sapiens
aggggttcccactggctcc

SEQ ID NO: 4302908 - DNA, 15 bp, Homo sapiens
aggggtttacagtga

SEQ ID NO: 4302909 - DNA, 22 bp, Homo sapiens
aggggttttcgaagctcagccc

SEQ ID NO: 4302910 - DNA, 14 bp, Homo sapiens
agggtaggggaagt

SEQ ID NO: 4302911 - DNA, 15 bp, Homo sapiens
agggtagggggcctg

SEQ ID NO: 4302912 - DNA, 16 bp, Homo sapiens
agggtagggggcctga

SEQ ID NO: 4302913 - DNA, 20 bp, Homo sapiens
agggtcccccttcgtggagc

SEQ ID NO: 4302914 - DNA, 21 bp, Homo sapiens
agggtcccccttcgtggagct

SEQ ID NO: 4302915 - DNA, 18 bp, Homo sapiens
agggtcctgggggctgct

SEQ ID NO: 4302916 - DNA, 22 bp, Homo sapiens
agggtctcgtcaggaggtgcct

SEQ ID NO: 4302917 - DNA, 14 bp, Homo sapiens
agggtgaggcgtgg

SEQ ID NO: 4302918 - DNA, 15 bp, Homo sapiens
agggtgaggcgtggg

SEQ ID NO: 4302919 - DNA, 22 bp, Homo sapiens
agggtgaggcgtgggatccaga

SEQ ID NO: 4302920 - DNA, 17 bp, Homo sapiens
agggtgctgcttccctc

SEQ ID NO: 4302921 - DNA, 14 bp, Homo sapiens
agggtggcaggtga

SEQ ID NO: 4302922 - DNA, 15 bp, Homo sapiens
agggtggggcttaga

SEQ ID NO: 4302923 - DNA, 20 bp, Homo sapiens
agggtggtcttcaagcctgg

SEQ ID NO: 4302924 - DNA, 14 bp, Homo sapiens
agggtgtggcttgg

SEQ ID NO: 4302925 - DNA, 20 bp, Homo sapiens
agggtgtgggtcagggaggg

SEQ ID NO: 4302926 - DNA, 15 bp, Homo sapiens
agggttcccccagcc

SEQ ID NO: 4302927 - DNA, 18 bp, Homo sapiens
agggttcccccagccctg

SEQ ID NO: 4302928 - DNA, 14 bp, Homo sapiens
agggttctagaagg

SEQ ID NO: 4302929 - DNA, 14 bp, Homo sapiens
agggttgtgatttt

SEQ ID NO: 4302930 - DNA, 19 bp, Homo sapiens
aggtaacatagatgcctgg

SEQ ID NO: 4302931 - DNA, 15 bp, Homo sapiens
aggtaatctgaaaca

SEQ ID NO: 4302932 - DNA, 17 bp, Homo sapiens
aggtaatctgaaacaca

SEQ ID NO: 4302933 - DNA, 17 bp, Homo sapiens
aggtacggtgagactct

SEQ ID NO: 4302934 - DNA, 21 bp, Homo sapiens
aggtacggtgagactctgagg

SEQ ID NO: 4302935 - DNA, 18 bp, Homo sapiens
aggtcaatgaaatatttg

SEQ ID NO: 4302936 - DNA, 18 bp, Homo sapiens
aggtcacaataaagtgta

SEQ ID NO: 4302937 - DNA, 21 bp, Homo sapiens
aggtccaccccgttgttgtcc

SEQ ID NO: 4302938 - DNA, 19 bp, Homo sapiens
aggtcccagacatgctgcc

SEQ ID NO: 4302939 - DNA, 20 bp, Homo sapiens
aggtcccagacatgctgccc

SEQ ID NO: 4302940 - DNA, 18 bp, Homo sapiens
aggtcccgaatggagtcc

SEQ ID NO: 4302941 - DNA, 19 bp, Homo sapiens
aggtcccgagccccctgtc

SEQ ID NO: 4302942 - DNA, 20 bp, Homo sapiens
aggtcccgagccccctgtcc

SEQ ID NO: 4302943 - DNA, 15 bp, Homo sapiens
aggtcctgtcctggc

SEQ ID NO: 4302944 - DNA, 22 bp, Homo sapiens
aggtctacctgaaaattcaaca

SEQ ID NO: 4302945 - DNA, 15 bp, Homo sapiens
aggtctcatgcctga

SEQ ID NO: 4302946 - DNA, 16 bp, Homo sapiens
aggtctcatgcctgag

SEQ ID NO: 4302947 - DNA, 17 bp, Homo sapiens
aggtctcatgcctgaga

SEQ ID NO: 4302948 - DNA, 18 bp, Homo sapiens
aggtctcatgcctgagaa

SEQ ID NO: 4302949 - DNA, 12 bp, Homo sapiens
aggtctccaccc

SEQ ID NO: 4302950 - DNA, 17 bp, Homo sapiens
aggtctccacccctcaa

SEQ ID NO: 4302951 - DNA, 23 bp, Homo sapiens
aggtctcctgggcatctggccct

SEQ ID NO: 4302952 - DNA, 23 bp, Homo sapiens
aggtgacccttctgtctgtaaga

SEQ ID NO: 4302953 - DNA, 20 bp, Homo sapiens
aggtgcccagtcttgagtgg

SEQ ID NO: 4302954 - DNA, 21 bp, Homo sapiens
aggtgcttcaggataccatat

SEQ ID NO: 4302955 - DNA, 17 bp, Homo sapiens
aggtggaacaggaggaa

SEQ ID NO: 4302956 - DNA, 20 bp, Homo sapiens
aggtggaacaggaggaactg

SEQ ID NO: 4302957 - DNA, 21 bp, Homo sapiens
aggtggaacaggaggaactgg

SEQ ID NO: 4302958 - DNA, 15 bp, Homo sapiens
aggtggaggcgagcc

SEQ ID NO: 4302959 - DNA, 18 bp, Homo sapiens
aggtggccagggctccac

SEQ ID NO: 4302960 - DNA, 20 bp, Homo sapiens
aggtggccagggctccacgg

SEQ ID NO: 4302961 - DNA, 16 bp, Homo sapiens
aggtgggccagcccct

SEQ ID NO: 4302962 - DNA, 18 bp, Homo sapiens
aggtgggccagcccctcc

SEQ ID NO: 4302963 - DNA, 22 bp, Homo sapiens
aggtgggtcaactccaaggcaa

SEQ ID NO: 4302964 - DNA, 15 bp, Homo sapiens
aggtgggtcttggat

SEQ ID NO: 4302965 - DNA, 22 bp, Homo sapiens
aggtggtctgcaccccacagga

SEQ ID NO: 4302966 - DNA, 13 bp, Homo sapiens
aggtgtggagtgg

SEQ ID NO: 4302967 - DNA, 14 bp, Homo sapiens
aggtgtggagtgga

SEQ ID NO: 4302968 - DNA, 15 bp, Homo sapiens
aggtgtggagtggag

SEQ ID NO: 4302969 - DNA, 15 bp, Homo sapiens
aggtgtgggctccca

SEQ ID NO: 4302970 - DNA, 20 bp, Homo sapiens
aggtgtgggctcccacgccc

SEQ ID NO: 4302971 - DNA, 21 bp, Homo sapiens
aggtgtgggctcccacgccct

SEQ ID NO: 4302972 - DNA, 14 bp, Homo sapiens
aggtgttgtccgtg

SEQ ID NO: 4302973 - DNA, 23 bp, Homo sapiens
aggtgtttaacggcactgtggcc

SEQ ID NO: 4302974 - DNA, 13 bp, Homo sapiens
aggtgtttctctg

SEQ ID NO: 4302975 - DNA, 13 bp, Homo sapiens
aggttcttgctgc

SEQ ID NO: 4302976 - DNA, 15 bp, Homo sapiens
aggttgtgctgcctg

SEQ ID NO: 4302977 - DNA, 20 bp, Homo sapiens
aggtttagaatcaagtctgt

SEQ ID NO: 4302978 - DNA, 22 bp, Homo sapiens
aggtttagaatcaagtctgtga

SEQ ID NO: 4302979 - DNA, 21 bp, Homo sapiens
aggtttctgagttcctgcatg

SEQ ID NO: 4302980 - DNA, 15 bp, Homo sapiens
agtaaaaccaaaggt

SEQ ID NO: 4302981 - DNA, 21 bp, Homo sapiens
agtaaaattatactgtgtgtg

SEQ ID NO: 4302982 - DNA, 20 bp, Homo sapiens
agtaagttctgaaaactgtt

SEQ ID NO: 4302983 - DNA, 22 bp, Homo sapiens
agtaatctgtataatactttgt

SEQ ID NO: 4302984 - DNA, 15 bp, Homo sapiens
agtaatggttctaga

SEQ ID NO: 4302985 - DNA, 15 bp, Homo sapiens
agtaattgttacaat

SEQ ID NO: 4302986 - DNA, 17 bp, Homo sapiens
agtaattgttacaattt

SEQ ID NO: 4302987 - DNA, 13 bp, Homo sapiens
agtacatgcagaa

SEQ ID NO: 4302988 - DNA, 16 bp, Homo sapiens
agtaccaactgagcca

SEQ ID NO: 4302989 - DNA, 21 bp, Homo sapiens
agtactagagatattttgtaa

SEQ ID NO: 4302990 - DNA, 23 bp, Homo sapiens
agtactggtaagattgttattaa

SEQ ID NO: 4302991 - DNA, 18 bp, Homo sapiens
agtacttcttctgtaata

SEQ ID NO: 4302992 - DNA, 14 bp, Homo sapiens
agtacttgagaata

SEQ ID NO: 4302993 - DNA, 18 bp, Homo sapiens
agtacttgtgaaacacag

SEQ ID NO: 4302994 - DNA, 24 bp, Homo sapiens
agtacttgtgaaacacagctgttc

SEQ ID NO: 4302995 - DNA, 13 bp, Homo sapiens
agtagatttcatg

SEQ ID NO: 4302996 - DNA, 13 bp, Homo sapiens
agtagctgtgggg

SEQ ID NO: 4302997 - DNA, 14 bp, Homo sapiens
agtaggctgtattt

SEQ ID NO: 4302998 - DNA, 18 bp, Homo sapiens
agtaggctgtattttctt

SEQ ID NO: 4302999 - DNA, 18 bp, Homo sapiens
agtagtacttcttctgta

SEQ ID NO: 4303000 - DNA, 23 bp, Homo sapiens
agtagtacttcttctgtaatatt

SEQ ID NO: 4303001 - DNA, 14 bp, Homo sapiens
agtagtgcctgtga

SEQ ID NO: 4303002 - DNA, 16 bp, Homo sapiens
agtagtgcctgtgatc

SEQ ID NO: 4303003 - DNA, 16 bp, Homo sapiens
agtatatttatttcta

SEQ ID NO: 4303004 - DNA, 17 bp, Homo sapiens
agtatatttatttctag

SEQ ID NO: 4303005 - DNA, 13 bp, Homo sapiens
agtatattttatt

SEQ ID NO: 4303006 - DNA, 19 bp, Homo sapiens
agtatattttatttcaatg

SEQ ID NO: 4303007 - DNA, 18 bp, Homo sapiens
agtatcagagatgtccat

SEQ ID NO: 4303008 - DNA, 10 bp, Homo sapiens
agtatctcat

SEQ ID NO: 4303009 - DNA, 18 bp, Homo sapiens
agtatctctactttcctg

SEQ ID NO: 4303010 - DNA, 19 bp, Homo sapiens
agtatctctactttcctga

SEQ ID NO: 4303011 - DNA, 16 bp, Homo sapiens
agtatgaataaagaca

SEQ ID NO: 4303012 - DNA, 18 bp, Homo sapiens
agtatgcaagaagaatat

SEQ ID NO: 4303013 - DNA, 23 bp, Homo sapiens
agtatgcaagaagaatataaata

SEQ ID NO: 4303014 - DNA, 19 bp, Homo sapiens
agtatgttttagcatgtgt

SEQ ID NO: 4303015 - DNA, 20 bp, Homo sapiens
agtatgttttagcatgtgtt

SEQ ID NO: 4303016 - DNA, 21 bp, Homo sapiens
agtattccttggcccagcagc

SEQ ID NO: 4303017 - DNA, 13 bp, Homo sapiens
agtcaactgctgt

SEQ ID NO: 4303018 - DNA, 15 bp, Homo sapiens
agtcaagtgtgcctg

SEQ ID NO: 4303019 - DNA, 18 bp, Homo sapiens
agtcaagtgtgcctgcta

SEQ ID NO: 4303020 - DNA, 15 bp, Homo sapiens
agtcaatcaaacagg

SEQ ID NO: 4303021 - DNA, 16 bp, Homo sapiens
agtcacttatttcata

SEQ ID NO: 4303022 - DNA, 20 bp, Homo sapiens
agtcaggaagcctcctgctg

SEQ ID NO: 4303023 - DNA, 14 bp, Homo sapiens
agtcaggagccagc

SEQ ID NO: 4303024 - DNA, 15 bp, Homo sapiens
agtcagggagccctg

SEQ ID NO: 4303025 - DNA, 16 bp, Homo sapiens
agtcagggagccctgg

SEQ ID NO: 4303026 - DNA, 17 bp, Homo sapiens
agtcagggagccctggg

SEQ ID NO: 4303027 - DNA, 13 bp, Homo sapiens
agtcatgacattt

SEQ ID NO: 4303028 - DNA, 20 bp, Homo sapiens
agtcatgacatttctcaaag

SEQ ID NO: 4303029 - DNA, 23 bp, Homo sapiens
agtcatggctgtcccctgcaagt

SEQ ID NO: 4303030 - DNA, 23 bp, Homo sapiens
agtcattaaattactatagcaaa

SEQ ID NO: 4303031 - DNA, 23 bp, Homo sapiens
agtcattgttacaggtgtactat

SEQ ID NO: 4303032 - DNA, 17 bp, Homo sapiens
agtccaactacagccaa

SEQ ID NO: 4303033 - DNA, 15 bp, Homo sapiens
agtccaataaattat

SEQ ID NO: 4303034 - DNA, 16 bp, Homo sapiens
agtccagacctgggcc

SEQ ID NO: 4303035 - DNA, 22 bp, Homo sapiens
agtccagtgaccctggagctag

SEQ ID NO: 4303036 - DNA, 19 bp, Homo sapiens
agtccagtttgtgcaagac

SEQ ID NO: 4303037 - DNA, 15 bp, Homo sapiens
agtcccgaggcagca

SEQ ID NO: 4303038 - DNA, 22 bp, Homo sapiens
agtccctccctcctggctcaca

SEQ ID NO: 4303039 - DNA, 18 bp, Homo sapiens
agtccctgagaagcctca

SEQ ID NO: 4303040 - DNA, 23 bp, Homo sapiens
agtccctgagaagcctcatggga

SEQ ID NO: 4303041 - DNA, 16 bp, Homo sapiens
agtcctagaatgtttc

SEQ ID NO: 4303042 - DNA, 14 bp, Homo sapiens
agtcctgttctcag

SEQ ID NO: 4303043 - DNA, 23 bp, Homo sapiens
agtctatctggtattaaatgcca

SEQ ID NO: 4303044 - DNA, 17 bp, Homo sapiens
agtctcactagcacatg

SEQ ID NO: 4303045 - DNA, 18 bp, Homo sapiens
agtctcattcctctgtcc

SEQ ID NO: 4303046 - DNA, 14 bp, Homo sapiens
agtctcctgtatca

SEQ ID NO: 4303047 - DNA, 16 bp, Homo sapiens
agtctcctgtatcatt

SEQ ID NO: 4303048 - DNA, 23 bp, Homo sapiens
agtctggaggtcccagacatgct

SEQ ID NO: 4303049 - DNA, 19 bp, Homo sapiens
agtctgtgaataaagccac

SEQ ID NO: 4303050 - DNA, 21 bp, Homo sapiens
agtctgtgaataaagccacat

SEQ ID NO: 4303051 - DNA, 17 bp, Homo sapiens
agtcttccatcagcagt

SEQ ID NO: 4303052 - DNA, 18 bp, Homo sapiens
agtcttccatcagcagtg

SEQ ID NO: 4303053 - DNA, 20 bp, Homo sapiens
agtcttccatcagcagtgat

SEQ ID NO: 4303054 - DNA, 15 bp, Homo sapiens
agtcttgagtgggcc

SEQ ID NO: 4303055 - DNA, 18 bp, Homo sapiens
agtctttagctattactg

SEQ ID NO: 4303056 - DNA, 20 bp, Homo sapiens
agtctttgggggattcaaat

SEQ ID NO: 4303057 - DNA, 23 bp, Homo sapiens
agtctttgggggattcaaatgca

SEQ ID NO: 4303058 - DNA, 13 bp, Homo sapiens
agtctttgtttac

SEQ ID NO: 4303059 - DNA, 23 bp, Homo sapiens
agtctttttagtgttttgcaagg

SEQ ID NO: 4303060 - DNA, 15 bp, Homo sapiens
agtgaagcccaggag

SEQ ID NO: 4303061 - DNA, 17 bp, Homo sapiens
agtgacatcggttcagg

SEQ ID NO: 4303062 - DNA, 14 bp, Homo sapiens
agtgacatgcggct

SEQ ID NO: 4303063 - DNA, 23 bp, Homo sapiens
agtgaccaggctcacaactgttt

SEQ ID NO: 4303064 - DNA, 23 bp, Homo sapiens
agtgaccccagctccaggcagga

SEQ ID NO: 4303065 - DNA, 19 bp, Homo sapiens
agtgacccggaggccacat

SEQ ID NO: 4303066 - DNA, 14 bp, Homo sapiens
agtgaccctggagc

SEQ ID NO: 4303067 - DNA, 15 bp, Homo sapiens
agtgaccctggagct

SEQ ID NO: 4303068 - DNA, 17 bp, Homo sapiens
agtgaccctggagctag

SEQ ID NO: 4303069 - DNA, 19 bp, Homo sapiens
agtgacgaaaacattgtcc

SEQ ID NO: 4303070 - DNA, 21 bp, Homo sapiens
agtgactaccacttatttcta

SEQ ID NO: 4303071 - DNA, 19 bp, Homo sapiens
agtgactgctgcgctgtgc

SEQ ID NO: 4303072 - DNA, 14 bp, Homo sapiens
agtgagaaattttt

SEQ ID NO: 4303073 - DNA, 15 bp, Homo sapiens
agtgagagtgaggcc

SEQ ID NO: 4303074 - DNA, 17 bp, Homo sapiens
agtgagatgtcagacaa

SEQ ID NO: 4303075 - DNA, 19 bp, Homo sapiens
agtgagtgtggctcccctc

SEQ ID NO: 4303076 - DNA, 21 bp, Homo sapiens
agtgatacactgtatctaaaa

SEQ ID NO: 4303077 - DNA, 23 bp, Homo sapiens
agtgatgtggtgggagcacagct

SEQ ID NO: 4303078 - DNA, 12 bp, Homo sapiens
agtgatttgcta

SEQ ID NO: 4303079 - DNA, 19 bp, Homo sapiens
agtgatttgctatcatata

SEQ ID NO: 4303080 - DNA, 22 bp, Homo sapiens
agtgatttgctatcatatatta

SEQ ID NO: 4303081 - DNA, 13 bp, Homo sapiens
agtgcacagctgt

SEQ ID NO: 4303082 - DNA, 14 bp, Homo sapiens
agtgcatctcagcc

SEQ ID NO: 4303083 - DNA, 15 bp, Homo sapiens
agtgcatctcagccc

SEQ ID NO: 4303084 - DNA, 22 bp, Homo sapiens
agtgcatttatgagctcttcat

SEQ ID NO: 4303085 - DNA, 14 bp, Homo sapiens
agtgcccatggggt

SEQ ID NO: 4303086 - DNA, 16 bp, Homo sapiens
agtgccccagaaatgc

SEQ ID NO: 4303087 - DNA, 20 bp, Homo sapiens
agtgccccagaaatgccgct

SEQ ID NO: 4303088 - DNA, 12 bp, Homo sapiens
agtgcccctgct

SEQ ID NO: 4303089 - DNA, 14 bp, Homo sapiens
agtgcccctgctgc

SEQ ID NO: 4303090 - DNA, 17 bp, Homo sapiens
agtgctcaacctacagt

SEQ ID NO: 4303091 - DNA, 23 bp, Homo sapiens
agtgctcaacctacagtggaggg

SEQ ID NO: 4303092 - DNA, 14 bp, Homo sapiens
agtgctcagttcca

SEQ ID NO: 4303093 - DNA, 15 bp, Homo sapiens
agtgctcagttccaa

SEQ ID NO: 4303094 - DNA, 16 bp, Homo sapiens
agtgctgctcccttta

SEQ ID NO: 4303095 - DNA, 23 bp, Homo sapiens
agtgctttgctggagtcctgttc

SEQ ID NO: 4303096 - DNA, 19 bp, Homo sapiens
agtggaaaaaagagaaaaa

SEQ ID NO: 4303097 - DNA, 18 bp, Homo sapiens
agtggacgtgggctccag

SEQ ID NO: 4303098 - DNA, 15 bp, Homo sapiens
agtggactttccacc

SEQ ID NO: 4303099 - DNA, 18 bp, Homo sapiens
agtggactttccaccccc

SEQ ID NO: 4303100 - DNA, 17 bp, Homo sapiens
agtggaggggtcagcag

SEQ ID NO: 4303101 - DNA, 23 bp, Homo sapiens
agtggaggggtcagcaggggggt

SEQ ID NO: 4303102 - DNA, 21 bp, Homo sapiens
agtggatctggagtctgaagg

SEQ ID NO: 4303103 - DNA, 13 bp, Homo sapiens
agtggcaggagga

SEQ ID NO: 4303104 - DNA, 14 bp, Homo sapiens
agtggcaggaggac

SEQ ID NO: 4303105 - DNA, 19 bp, Homo sapiens
agtggcaggaggacaggtg

SEQ ID NO: 4303106 - DNA, 15 bp, Homo sapiens
agtggcatggctcca

SEQ ID NO: 4303107 - DNA, 23 bp, Homo sapiens
agtggcccagggaatcagggagc

SEQ ID NO: 4303108 - DNA, 18 bp, Homo sapiens
agtggcctacaaatcagt

SEQ ID NO: 4303109 - DNA, 16 bp, Homo sapiens
agtggcctgagaagag

SEQ ID NO: 4303110 - DNA, 21 bp, Homo sapiens
agtggctcctcccggtgccca

SEQ ID NO: 4303111 - DNA, 14 bp, Homo sapiens
agtgggagaggaag

SEQ ID NO: 4303112 - DNA, 14 bp, Homo sapiens
agtgggagtgggag

SEQ ID NO: 4303113 - DNA, 19 bp, Homo sapiens
agtgggagtgggagaggaa

SEQ ID NO: 4303114 - DNA, 14 bp, Homo sapiens
agtgggccagtgtg

SEQ ID NO: 4303115 - DNA, 16 bp, Homo sapiens
agtggggaggagactc

SEQ ID NO: 4303116 - DNA, 17 bp, Homo sapiens
agtggggctagactggg

SEQ ID NO: 4303117 - DNA, 21 bp, Homo sapiens
agtggggctagactgggctgg

SEQ ID NO: 4303118 - DNA, 15 bp, Homo sapiens
agtggtccacattct

SEQ ID NO: 4303119 - DNA, 22 bp, Homo sapiens
agtggtccacattctgctgccc

SEQ ID NO: 4303120 - DNA, 15 bp, Homo sapiens
agtggtctatttctc

SEQ ID NO: 4303121 - DNA, 20 bp, Homo sapiens
agtggttaagaatgtatatc

SEQ ID NO: 4303122 - DNA, 14 bp, Homo sapiens
agtgtagattttat

SEQ ID NO: 4303123 - DNA, 13 bp, Homo sapiens
agtgtatctcgaa

SEQ ID NO: 4303124 - DNA, 23 bp, Homo sapiens
agtgtatctcgaagtcttccatc

SEQ ID NO: 4303125 - DNA, 16 bp, Homo sapiens
agtgtatgtcttgtat

SEQ ID NO: 4303126 - DNA, 16 bp, Homo sapiens
agtgtcaaggggccct

SEQ ID NO: 4303127 - DNA, 13 bp, Homo sapiens
agtgtccccaggg

SEQ ID NO: 4303128 - DNA, 16 bp, Homo sapiens
agtgtccccaggggca

SEQ ID NO: 4303129 - DNA, 23 bp, Homo sapiens
agtgtccccaggggcacacttcc

SEQ ID NO: 4303130 - DNA, 18 bp, Homo sapiens
agtgtctggatcagtaaa

SEQ ID NO: 4303131 - DNA, 23 bp, Homo sapiens
agtgtctggatcagtaaaattat

SEQ ID NO: 4303132 - DNA, 13 bp, Homo sapiens
agtgtctgtccat

SEQ ID NO: 4303133 - DNA, 18 bp, Homo sapiens
agtgtgagggtgcaggga

SEQ ID NO: 4303134 - DNA, 22 bp, Homo sapiens
agtgtgagggtgcagggaccaa

SEQ ID NO: 4303135 - DNA, 18 bp, Homo sapiens
agtgtgccaccctctgca

SEQ ID NO: 4303136 - DNA, 21 bp, Homo sapiens
agtgtgccaccctctgcaggg

SEQ ID NO: 4303137 - DNA, 12 bp, Homo sapiens
agtgtgcctgct

SEQ ID NO: 4303138 - DNA, 16 bp, Homo sapiens
agtgtgcctgctatcc

SEQ ID NO: 4303139 - DNA, 19 bp, Homo sapiens
agtgtggactctggactgg

SEQ ID NO: 4303140 - DNA, 19 bp, Homo sapiens
agtgtggagctgcttccag

SEQ ID NO: 4303141 - DNA, 16 bp, Homo sapiens
agtgtggctcccctct

SEQ ID NO: 4303142 - DNA, 15 bp, Homo sapiens
agtgtgttttggtat

SEQ ID NO: 4303143 - DNA, 18 bp, Homo sapiens
agtgtttaattgtataaa

SEQ ID NO: 4303144 - DNA, 19 bp, Homo sapiens
agtgtttaattgtataaaa

SEQ ID NO: 4303145 - DNA, 19 bp, Homo sapiens
agtgttttcttgtgttgtt

SEQ ID NO: 4303146 - DNA, 10 bp, Homo sapiens
agttaaaatc

SEQ ID NO: 4303147 - DNA, 20 bp, Homo sapiens
agttaatgtactttcattcc

SEQ ID NO: 4303148 - DNA, 21 bp, Homo sapiens
agttaatgtactttcattccc

SEQ ID NO: 4303149 - DNA, 20 bp, Homo sapiens
agttacctggaatcaaataa

SEQ ID NO: 4303150 - DNA, 21 bp, Homo sapiens
agttactgtcctgttgattaa

SEQ ID NO: 4303151 - DNA, 17 bp, Homo sapiens
agttagattcactttga

SEQ ID NO: 4303152 - DNA, 14 bp, Homo sapiens
agttagcaggaaat

SEQ ID NO: 4303153 - DNA, 20 bp, Homo sapiens
agttagggcatttttcttgg

SEQ ID NO: 4303154 - DNA, 14 bp, Homo sapiens
agttcctgtgcaca

SEQ ID NO: 4303155 - DNA, 16 bp, Homo sapiens
agttcctgtgcacagc

SEQ ID NO: 4303156 - DNA, 16 bp, Homo sapiens
agttctatttctatct

SEQ ID NO: 4303157 - DNA, 19 bp, Homo sapiens
agttctgaaaactgtttat

SEQ ID NO: 4303158 - DNA, 22 bp, Homo sapiens
agttctgaaaactgtttatggt

SEQ ID NO: 4303159 - DNA, 12 bp, Homo sapiens
agttctgaaggt

SEQ ID NO: 4303160 - DNA, 19 bp, Homo sapiens
agttgaacaagatttccct

SEQ ID NO: 4303161 - DNA, 13 bp, Homo sapiens
agttgaggggctt

SEQ ID NO: 4303162 - DNA, 16 bp, Homo sapiens
agttgatatgtaacag

SEQ ID NO: 4303163 - DNA, 22 bp, Homo sapiens
agttgatgaccaatctctgtga

SEQ ID NO: 4303164 - DNA, 11 bp, Homo sapiens
agttgcacagc

SEQ ID NO: 4303165 - DNA, 13 bp, Homo sapiens
agttgcacagcat

SEQ ID NO: 4303166 - DNA, 20 bp, Homo sapiens
agttgcacagcatctcagct

SEQ ID NO: 4303167 - DNA, 16 bp, Homo sapiens
agttgcacagctatga

SEQ ID NO: 4303168 - DNA, 22 bp, Homo sapiens
agttgccgcatattatatcaga

SEQ ID NO: 4303169 - DNA, 18 bp, Homo sapiens
agttggactgtggcctca

SEQ ID NO: 4303170 - DNA, 19 bp, Homo sapiens
agttggactgtggcctcag

SEQ ID NO: 4303171 - DNA, 14 bp, Homo sapiens
agttggcctcagca

SEQ ID NO: 4303172 - DNA, 23 bp, Homo sapiens
agttggttttgcatgtctgcatg

SEQ ID NO: 4303173 - DNA, 16 bp, Homo sapiens
agttgttagtgatttg

SEQ ID NO: 4303174 - DNA, 20 bp, Homo sapiens
agttgttagtgatttgctat

SEQ ID NO: 4303175 - DNA, 14 bp, Homo sapiens
agtttaaaaaaata

SEQ ID NO: 4303176 - DNA, 20 bp, Homo sapiens
agtttaatggtgccttcatt

SEQ ID NO: 4303177 - DNA, 19 bp, Homo sapiens
agtttcacatatttgtagc

SEQ ID NO: 4303178 - DNA, 19 bp, Homo sapiens
agtttccagctaagcctga

SEQ ID NO: 4303179 - DNA, 16 bp, Homo sapiens
agtttgcctctgcacg

SEQ ID NO: 4303180 - DNA, 22 bp, Homo sapiens
agtttgcctctgcacgtgcaca

SEQ ID NO: 4303181 - DNA, 16 bp, Homo sapiens
agtttgtgcaagacac

SEQ ID NO: 4303182 - DNA, 12 bp, Homo sapiens
agttttcagatt

SEQ ID NO: 4303183 - DNA, 13 bp, Homo sapiens
agttttctaaatg

SEQ ID NO: 4303184 - DNA, 17 bp, Homo sapiens
agttttctaaatgtttc

SEQ ID NO: 4303185 - DNA, 17 bp, Homo sapiens
agttttcttttaatttt

SEQ ID NO: 4303186 - DNA, 14 bp, Homo sapiens
agtttttacagtgt

SEQ ID NO: 4303187 - DNA, 17 bp, Homo sapiens
agttttttctcttgggc

SEQ ID NO: 4303188 - DNA, 14 bp, Homo sapiens
ataaaaatactgac

SEQ ID NO: 4303189 - DNA, 16 bp, Homo sapiens
ataaaaattctagatt

SEQ ID NO: 4303190 - DNA, 11 bp, Homo sapiens
ataaaacagtg

SEQ ID NO: 4303191 - DNA, 23 bp, Homo sapiens
ataaacacagctgctttcttctt

SEQ ID NO: 4303192 - DNA, 15 bp, Homo sapiens
ataaacactttttct

SEQ ID NO: 4303193 - DNA, 14 bp, Homo sapiens
ataaacgaaacaca

SEQ ID NO: 4303194 - DNA, 16 bp, Homo sapiens
ataaacgaaacacaga

SEQ ID NO: 4303195 - DNA, 14 bp, Homo sapiens
ataaactcagtcaa

SEQ ID NO: 4303196 - DNA, 13 bp, Homo sapiens
ataaactccttaa

SEQ ID NO: 4303197 - DNA, 12 bp, Homo sapiens
ataaagaagaaa

SEQ ID NO: 4303198 - DNA, 15 bp, Homo sapiens
ataaagaagaaaata

SEQ ID NO: 4303199 - DNA, 12 bp, Homo sapiens
ataaagacacct

SEQ ID NO: 4303200 - DNA, 20 bp, Homo sapiens
ataaagccacataaccagcg

SEQ ID NO: 4303201 - DNA, 22 bp, Homo sapiens
ataaagtaaatgctacctctga

SEQ ID NO: 4303202 - DNA, 19 bp, Homo sapiens
ataaagtctgtctgcactg

SEQ ID NO: 4303203 - DNA, 18 bp, Homo sapiens
ataaagtgcctataaagg

SEQ ID NO: 4303204 - DNA, 14 bp, Homo sapiens
ataaataaaaatat

SEQ ID NO: 4303205 - DNA, 18 bp, Homo sapiens
ataaataaaaatattctc

SEQ ID NO: 4303206 - DNA, 15 bp, Homo sapiens
ataaataaagaagaa

SEQ ID NO: 4303207 - DNA, 16 bp, Homo sapiens
ataaataaagaagaaa

SEQ ID NO: 4303208 - DNA, 18 bp, Homo sapiens
ataaataaagaagaaaat

SEQ ID NO: 4303209 - DNA, 20 bp, Homo sapiens
ataaataaagaagaaaataa

SEQ ID NO: 4303210 - DNA, 13 bp, Homo sapiens
ataaataatctca

SEQ ID NO: 4303211 - DNA, 17 bp, Homo sapiens
ataaatactaaatatga

SEQ ID NO: 4303212 - DNA, 22 bp, Homo sapiens
ataaatcgcattaatgaaatac

SEQ ID NO: 4303213 - DNA, 23 bp, Homo sapiens
ataaatgcaaatggctaccgttt

SEQ ID NO: 4303214 - DNA, 21 bp, Homo sapiens
ataaatggtgagaattaaaat

SEQ ID NO: 4303215 - DNA, 17 bp, Homo sapiens
ataaatgtgtgtatgtg

SEQ ID NO: 4303216 - DNA, 19 bp, Homo sapiens
ataaattatttctaaaaca

SEQ ID NO: 4303217 - DNA, 22 bp, Homo sapiens
ataaattggtgataagtggaaa

SEQ ID NO: 4303218 - DNA, 18 bp, Homo sapiens
ataacaatgtatgtgaaa

SEQ ID NO: 4303219 - DNA, 14 bp, Homo sapiens
ataacatctgaaaa

SEQ ID NO: 4303220 - DNA, 21 bp, Homo sapiens
ataacatctgaaaagaaatgc

SEQ ID NO: 4303221 - DNA, 13 bp, Homo sapiens
ataactagatctc

SEQ ID NO: 4303222 - DNA, 16 bp, Homo sapiens
ataactagatctcctg

SEQ ID NO: 4303223 - DNA, 17 bp, Homo sapiens
ataactagatctcctgt

SEQ ID NO: 4303224 - DNA, 20 bp, Homo sapiens
ataactagatctcctgtaat

SEQ ID NO: 4303225 - DNA, 22 bp, Homo sapiens
ataactagatctcctgtaattt

SEQ ID NO: 4303226 - DNA, 13 bp, Homo sapiens
ataagtaatatct

SEQ ID NO: 4303227 - DNA, 11 bp, Homo sapiens
ataagtggaaa

SEQ ID NO: 4303228 - DNA, 21 bp, Homo sapiens
ataagtggaaaaaagagaaaa

SEQ ID NO: 4303229 - DNA, 17 bp, Homo sapiens
ataataactagatctcc

SEQ ID NO: 4303230 - DNA, 14 bp, Homo sapiens
ataatactttgtat

SEQ ID NO: 4303231 - DNA, 19 bp, Homo sapiens
ataatactttgtatacaag

SEQ ID NO: 4303232 - DNA, 21 bp, Homo sapiens
ataatactttgtatacaagta

SEQ ID NO: 4303233 - DNA, 14 bp, Homo sapiens
ataatatttaggca

SEQ ID NO: 4303234 - DNA, 19 bp, Homo sapiens
ataatcagaatggaagaga

SEQ ID NO: 4303235 - DNA, 11 bp, Homo sapiens
ataatctcatc

SEQ ID NO: 4303236 - DNA, 22 bp, Homo sapiens
ataatgacgtattgtgaaattt

SEQ ID NO: 4303237 - DNA, 11 bp, Homo sapiens
ataatgattta

SEQ ID NO: 4303238 - DNA, 19 bp, Homo sapiens
ataatgatttaagcatttt

SEQ ID NO: 4303239 - DNA, 15 bp, Homo sapiens
ataatgcctttgtaa

SEQ ID NO: 4303240 - DNA, 21 bp, Homo sapiens
ataatgcctttttggttttgt

SEQ ID NO: 4303241 - DNA, 12 bp, Homo sapiens
ataatgtgaaat

SEQ ID NO: 4303242 - DNA, 22 bp, Homo sapiens
ataatgtttccctcaagaacaa

SEQ ID NO: 4303243 - DNA, 17 bp, Homo sapiens
ataattgcaagggaaga

SEQ ID NO: 4303244 - DNA, 21 bp, Homo sapiens
ataattgtggagaggagagaa

SEQ ID NO: 4303245 - DNA, 17 bp, Homo sapiens
ataattttttagttaaa

SEQ ID NO: 4303246 - DNA, 22 bp, Homo sapiens
ataattttttagttaaaatcta

SEQ ID NO: 4303247 - DNA, 14 bp, Homo sapiens
atacactgtatcta

SEQ ID NO: 4303248 - DNA, 13 bp, Homo sapiens
atacagctcagaa

SEQ ID NO: 4303249 - DNA, 17 bp, Homo sapiens
atacatacctctctcta

SEQ ID NO: 4303250 - DNA, 23 bp, Homo sapiens
atacatctaagtcagtttcacat

SEQ ID NO: 4303251 - DNA, 16 bp, Homo sapiens
atacatggtttaaagt

SEQ ID NO: 4303252 - DNA, 12 bp, Homo sapiens
atacatgtatag

SEQ ID NO: 4303253 - DNA, 23 bp, Homo sapiens
atacattccagtgtattttctgt

SEQ ID NO: 4303254 - DNA, 20 bp, Homo sapiens
atacattcttcaagatccca

SEQ ID NO: 4303255 - DNA, 19 bp, Homo sapiens
ataccaggggttccccagg

SEQ ID NO: 4303256 - DNA, 17 bp, Homo sapiens
atacccccccatgcagt

SEQ ID NO: 4303257 - DNA, 15 bp, Homo sapiens
ataccccctgcccca

SEQ ID NO: 4303258 - DNA, 17 bp, Homo sapiens
ataccccctgccccaga

SEQ ID NO: 4303259 - DNA, 15 bp, Homo sapiens
atacccctcatcaca

SEQ ID NO: 4303260 - DNA, 20 bp, Homo sapiens
atacctctctctatatatac

SEQ ID NO: 4303261 - DNA, 21 bp, Homo sapiens
atacctctctctatatataca

SEQ ID NO: 4303262 - DNA, 18 bp, Homo sapiens
atacgtgtcaatgtgtgc

SEQ ID NO: 4303263 - DNA, 18 bp, Homo sapiens
atactaaatatgaaattt

SEQ ID NO: 4303264 - DNA, 23 bp, Homo sapiens
atactcattagaattaccatttg

SEQ ID NO: 4303265 - DNA, 18 bp, Homo sapiens
atactctgtgtaatctct

SEQ ID NO: 4303266 - DNA, 22 bp, Homo sapiens
atactgcccggggcagctgcca

SEQ ID NO: 4303267 - DNA, 13 bp, Homo sapiens
atactgtttgtaa

SEQ ID NO: 4303268 - DNA, 16 bp, Homo sapiens
atactgtttgtaatat

SEQ ID NO: 4303269 - DNA, 16 bp, Homo sapiens
atacttaaaaatatgt

SEQ ID NO: 4303270 - DNA, 18 bp, Homo sapiens
atactttccaacattatc

SEQ ID NO: 4303271 - DNA, 22 bp, Homo sapiens
atagaactgtcccacaaaatat

SEQ ID NO: 4303272 - DNA, 23 bp, Homo sapiens
atagaactgtcccacaaaatatt

SEQ ID NO: 4303273 - DNA, 13 bp, Homo sapiens
atagataattatc

SEQ ID NO: 4303274 - DNA, 15 bp, Homo sapiens
atagataattatcca

SEQ ID NO: 4303275 - DNA, 23 bp, Homo sapiens
atagcatcctgattattgaatgt

SEQ ID NO: 4303276 - DNA, 14 bp, Homo sapiens
atagcatctgctct

SEQ ID NO: 4303277 - DNA, 19 bp, Homo sapiens
atagcatctgctcttctct

SEQ ID NO: 4303278 - DNA, 19 bp, Homo sapiens
atagccatttgaagaagga

SEQ ID NO: 4303279 - DNA, 18 bp, Homo sapiens
atagctgttctaatggat

SEQ ID NO: 4303280 - DNA, 13 bp, Homo sapiens
ataggaagacaca

SEQ ID NO: 4303281 - DNA, 13 bp, Homo sapiens
ataggaggacaga

SEQ ID NO: 4303282 - DNA, 17 bp, Homo sapiens
ataggagggaaaccttt

SEQ ID NO: 4303283 - DNA, 18 bp, Homo sapiens
atagtaatggttctagaa

SEQ ID NO: 4303284 - DNA, 19 bp, Homo sapiens
atagtagcagagtcattgt

SEQ ID NO: 4303285 - DNA, 17 bp, Homo sapiens
atagtcaatcaaacagg

SEQ ID NO: 4303286 - DNA, 21 bp, Homo sapiens
atagtcaatcaaacagggaca

SEQ ID NO: 4303287 - DNA, 13 bp, Homo sapiens
atagttctatttc

SEQ ID NO: 4303288 - DNA, 14 bp, Homo sapiens
atagtttgttttct

SEQ ID NO: 4303289 - DNA, 15 bp, Homo sapiens
atagtttgttttctt

SEQ ID NO: 4303290 - DNA, 19 bp, Homo sapiens
atagtttgttttctttttc

SEQ ID NO: 4303291 - DNA, 13 bp, Homo sapiens
atagttttctaaa

SEQ ID NO: 4303292 - DNA, 16 bp, Homo sapiens
atataaatggtgagaa

SEQ ID NO: 4303293 - DNA, 11 bp, Homo sapiens
atataaatgtg

SEQ ID NO: 4303294 - DNA, 14 bp, Homo sapiens
atataaatgtgtgt

SEQ ID NO: 4303295 - DNA, 22 bp, Homo sapiens
atataataaatatatatttatc

SEQ ID NO: 4303296 - DNA, 17 bp, Homo sapiens
atatacccccccatgca

SEQ ID NO: 4303297 - DNA, 11 bp, Homo sapiens
atatagtttgt

SEQ ID NO: 4303298 - DNA, 17 bp, Homo sapiens
atatatacatgtatagt

SEQ ID NO: 4303299 - DNA, 15 bp, Homo sapiens
atatataccccccca

SEQ ID NO: 4303300 - DNA, 18 bp, Homo sapiens
atatatctgaaaactgga

SEQ ID NO: 4303301 - DNA, 18 bp, Homo sapiens
atatatgaataattatgt

SEQ ID NO: 4303302 - DNA, 13 bp, Homo sapiens
atatatgtgaaag

SEQ ID NO: 4303303 - DNA, 15 bp, Homo sapiens
atatattataagatt

SEQ ID NO: 4303304 - DNA, 15 bp, Homo sapiens
atatcactcattaat

SEQ ID NO: 4303305 - DNA, 17 bp, Homo sapiens
atatcatcaatactttt

SEQ ID NO: 4303306 - DNA, 12 bp, Homo sapiens
atatcatttctt

SEQ ID NO: 4303307 - DNA, 17 bp, Homo sapiens
atatcctggtgtctagt

SEQ ID NO: 4303308 - DNA, 13 bp, Homo sapiens
atatctatttatc

SEQ ID NO: 4303309 - DNA, 12 bp, Homo sapiens
atatctcatctc

SEQ ID NO: 4303310 - DNA, 23 bp, Homo sapiens
atatctgaaaactggaataagaa

SEQ ID NO: 4303311 - DNA, 21 bp, Homo sapiens
atatctgtaaatttaactgca

SEQ ID NO: 4303312 - DNA, 23 bp, Homo sapiens
atatctgtaaatttaactgcata

SEQ ID NO: 4303313 - DNA, 13 bp, Homo sapiens
atatctgtgaaat

SEQ ID NO: 4303314 - DNA, 15 bp, Homo sapiens
atatctgtgaaatat

SEQ ID NO: 4303315 - DNA, 18 bp, Homo sapiens
atatcttcgttagtaatc

SEQ ID NO: 4303316 - DNA, 12 bp, Homo sapiens
atatcttgaaga

SEQ ID NO: 4303317 - DNA, 13 bp, Homo sapiens
atatcttgaagaa

SEQ ID NO: 4303318 - DNA, 14 bp, Homo sapiens
atatcttgaagaat

SEQ ID NO: 4303319 - DNA, 18 bp, Homo sapiens
atatgaagtaagttctga

SEQ ID NO: 4303320 - DNA, 23 bp, Homo sapiens
atatgacctaaatccattttcta

SEQ ID NO: 4303321 - DNA, 19 bp, Homo sapiens
atatgaggggactgcatgc

SEQ ID NO: 4303322 - DNA, 19 bp, Homo sapiens
atatgattctcctctccca

SEQ ID NO: 4303323 - DNA, 14 bp, Homo sapiens
atatgattgaaaag

SEQ ID NO: 4303324 - DNA, 16 bp, Homo sapiens
atatgattgaaaagaa

SEQ ID NO: 4303325 - DNA, 19 bp, Homo sapiens
atatgccagtgactgctgc

SEQ ID NO: 4303326 - DNA, 20 bp, Homo sapiens
atatgccagtgactgctgcg

SEQ ID NO: 4303327 - DNA, 23 bp, Homo sapiens
atatggatatttttaatttatga

SEQ ID NO: 4303328 - DNA, 12 bp, Homo sapiens
atatgtacagtt

SEQ ID NO: 4303329 - DNA, 19 bp, Homo sapiens
atatgtgagcatgaaacta

SEQ ID NO: 4303330 - DNA, 15 bp, Homo sapiens
atatgttgctgaaac

SEQ ID NO: 4303331 - DNA, 16 bp, Homo sapiens
atatgttgctgaaaca

SEQ ID NO: 4303332 - DNA, 19 bp, Homo sapiens
atattacaatggccagccc

SEQ ID NO: 4303333 - DNA, 20 bp, Homo sapiens
atattacaatggccagccca

SEQ ID NO: 4303334 - DNA, 11 bp, Homo sapiens
atattatatat

SEQ ID NO: 4303335 - DNA, 13 bp, Homo sapiens
atattatatcaga

SEQ ID NO: 4303336 - DNA, 23 bp, Homo sapiens
atattcagagatgtaccatgtta

SEQ ID NO: 4303337 - DNA, 16 bp, Homo sapiens
atattcatactttcca

SEQ ID NO: 4303338 - DNA, 19 bp, Homo sapiens
atattcttgctttcacaaa

SEQ ID NO: 4303339 - DNA, 22 bp, Homo sapiens
atattcttgctttcacaaatat

SEQ ID NO: 4303340 - DNA, 21 bp, Homo sapiens
atattgacaagtttaaaggct

SEQ ID NO: 4303341 - DNA, 16 bp, Homo sapiens
atattgagatcagcat

SEQ ID NO: 4303342 - DNA, 21 bp, Homo sapiens
atattgctgaagaatctactt

SEQ ID NO: 4303343 - DNA, 14 bp, Homo sapiens
atattggaaacata

SEQ ID NO: 4303344 - DNA, 13 bp, Homo sapiens
atatttaaagtct

SEQ ID NO: 4303345 - DNA, 21 bp, Homo sapiens
atatttacaatgtattaagcc

SEQ ID NO: 4303346 - DNA, 18 bp, Homo sapiens
atatttatcatatttaat

SEQ ID NO: 4303347 - DNA, 21 bp, Homo sapiens
atatttatgacctcaacaaag

SEQ ID NO: 4303348 - DNA, 18 bp, Homo sapiens
atatttatttctagcaaa

SEQ ID NO: 4303349 - DNA, 21 bp, Homo sapiens
atatttctaagcttatttcta

SEQ ID NO: 4303350 - DNA, 13 bp, Homo sapiens
atatttcttcaaa

SEQ ID NO: 4303351 - DNA, 20 bp, Homo sapiens
atatttgcttatttatattc

SEQ ID NO: 4303352 - DNA, 19 bp, Homo sapiens
atatttgtagctagaatat

SEQ ID NO: 4303353 - DNA, 13 bp, Homo sapiens
atatttgtatgat

SEQ ID NO: 4303354 - DNA, 23 bp, Homo sapiens
atatttgtttagttcagcaaaac

SEQ ID NO: 4303355 - DNA, 15 bp, Homo sapiens
atattttatttcaat

SEQ ID NO: 4303356 - DNA, 15 bp, Homo sapiens
atattttatttttat

SEQ ID NO: 4303357 - DNA, 19 bp, Homo sapiens
atattttgtaaaatgtatt

SEQ ID NO: 4303358 - DNA, 20 bp, Homo sapiens
atattttgtaaaatgtatta

SEQ ID NO: 4303359 - DNA, 14 bp, Homo sapiens
atcaaagtgtttaa

SEQ ID NO: 4303360 - DNA, 19 bp, Homo sapiens
atcaaagtgtttaattgta

SEQ ID NO: 4303361 - DNA, 21 bp, Homo sapiens
atcaaagtgtttaattgtata

SEQ ID NO: 4303362 - DNA, 17 bp, Homo sapiens
atcaaataaaaattcta

SEQ ID NO: 4303363 - DNA, 14 bp, Homo sapiens
atcaaatctgagcc

SEQ ID NO: 4303364 - DNA, 13 bp, Homo sapiens
atcaaatttttct

SEQ ID NO: 4303365 - DNA, 15 bp, Homo sapiens
atcaaatttttctgg

SEQ ID NO: 4303366 - DNA, 20 bp, Homo sapiens
atcaagtattactaaattga

SEQ ID NO: 4303367 - DNA, 21 bp, Homo sapiens
atcaagtattactaaattgac

SEQ ID NO: 4303368 - DNA, 15 bp, Homo sapiens
atcaatacttttgtg

SEQ ID NO: 4303369 - DNA, 21 bp, Homo sapiens
atcaatgttcacgcaacttga

SEQ ID NO: 4303370 - DNA, 22 bp, Homo sapiens
atcaatgttcacgcaacttgaa

SEQ ID NO: 4303371 - DNA, 20 bp, Homo sapiens
atcacctaattaatttcagt

SEQ ID NO: 4303372 - DNA, 13 bp, Homo sapiens
atcacctcccctc

SEQ ID NO: 4303373 - DNA, 15 bp, Homo sapiens
atcacctcccctcct

SEQ ID NO: 4303374 - DNA, 21 bp, Homo sapiens
atcagaatcaaatctgagcct

SEQ ID NO: 4303375 - DNA, 23 bp, Homo sapiens
atcagaatctttaaagaggagcc

SEQ ID NO: 4303376 - DNA, 18 bp, Homo sapiens
atcagaatggaagagaga

SEQ ID NO: 4303377 - DNA, 20 bp, Homo sapiens
atcagaatggaagagagaaa

SEQ ID NO: 4303378 - DNA, 14 bp, Homo sapiens
atcagagaagcagc

SEQ ID NO: 4303379 - DNA, 14 bp, Homo sapiens
atcagcattcaaaa

SEQ ID NO: 4303380 - DNA, 11 bp, Homo sapiens
atcagcccctg

SEQ ID NO: 4303381 - DNA, 15 bp, Homo sapiens
atcagcccctgctgc

SEQ ID NO: 4303382 - DNA, 15 bp, Homo sapiens
atcagggagcactgg

SEQ ID NO: 4303383 - DNA, 22 bp, Homo sapiens
atcagtggcatggctccagtct

SEQ ID NO: 4303384 - DNA, 16 bp, Homo sapiens
atcatatttaatagga

SEQ ID NO: 4303385 - DNA, 23 bp, Homo sapiens
atcatatttaataggataaatta

SEQ ID NO: 4303386 - DNA, 23 bp, Homo sapiens
atcatcaaagtgtttaattgtat

SEQ ID NO: 4303387 - DNA, 21 bp, Homo sapiens
atcatcacgtatgttatacaa

SEQ ID NO: 4303388 - DNA, 15 bp, Homo sapiens
atcatggctatctgt

SEQ ID NO: 4303389 - DNA, 20 bp, Homo sapiens
atcatgtaatagtggctttc

SEQ ID NO: 4303390 - DNA, 21 bp, Homo sapiens
atcatgtctattgtccaaagt

SEQ ID NO: 4303391 - DNA, 17 bp, Homo sapiens
atcatgtgtttctgtgt

SEQ ID NO: 4303392 - DNA, 18 bp, Homo sapiens
atcatgtgtttctgtgta

SEQ ID NO: 4303393 - DNA, 21 bp, Homo sapiens
atcatttatcttatctagcaa

SEQ ID NO: 4303394 - DNA, 14 bp, Homo sapiens
atcattttcacctc

SEQ ID NO: 4303395 - DNA, 17 bp, Homo sapiens
atcattttcctgggagt

SEQ ID NO: 4303396 - DNA, 14 bp, Homo sapiens
atccaacatttcct

SEQ ID NO: 4303397 - DNA, 18 bp, Homo sapiens
atccaacccatgcatggc

SEQ ID NO: 4303398 - DNA, 22 bp, Homo sapiens
atccaacctctttcctctctgg

SEQ ID NO: 4303399 - DNA, 21 bp, Homo sapiens
atccaaggaagggatgtattt

SEQ ID NO: 4303400 - DNA, 15 bp, Homo sapiens
atccagatagcctag

SEQ ID NO: 4303401 - DNA, 15 bp, Homo sapiens
atccagccaggggtg

SEQ ID NO: 4303402 - DNA, 15 bp, Homo sapiens
atccaggcaatggcc

SEQ ID NO: 4303403 - DNA, 13 bp, Homo sapiens
atccataccccct

SEQ ID NO: 4303404 - DNA, 20 bp, Homo sapiens
atccataccccctgccccag

SEQ ID NO: 4303405 - DNA, 22 bp, Homo sapiens
atccataccccctgccccagag

SEQ ID NO: 4303406 - DNA, 20 bp, Homo sapiens
atccatgcggccggcctggg

SEQ ID NO: 4303407 - DNA, 21 bp, Homo sapiens
atccatgcggccggcctgggg

SEQ ID NO: 4303408 - DNA, 23 bp, Homo sapiens
atccatgcggccggcctggggcc

SEQ ID NO: 4303409 - DNA, 15 bp, Homo sapiens
atccattaatttaaa

SEQ ID NO: 4303410 - DNA, 21 bp, Homo sapiens
atccattttctaaactgtttt

SEQ ID NO: 4303411 - DNA, 15 bp, Homo sapiens
atcccatctcacttt

SEQ ID NO: 4303412 - DNA, 22 bp, Homo sapiens
atcccccgtgtattcaggaccc

SEQ ID NO: 4303413 - DNA, 17 bp, Homo sapiens
atccctccttaagagat

SEQ ID NO: 4303414 - DNA, 15 bp, Homo sapiens
atcccttggcccctc

SEQ ID NO: 4303415 - DNA, 18 bp, Homo sapiens
atccctttctaagcagga

SEQ ID NO: 4303416 - DNA, 14 bp, Homo sapiens
atccgccctgggct

SEQ ID NO: 4303417 - DNA, 20 bp, Homo sapiens
atccgccctgggctctgggt

SEQ ID NO: 4303418 - DNA, 14 bp, Homo sapiens
atcctcagccccag

SEQ ID NO: 4303419 - DNA, 15 bp, Homo sapiens
atcctcagccccagg

SEQ ID NO: 4303420 - DNA, 22 bp, Homo sapiens
atcctcagttcctgcagcagag

SEQ ID NO: 4303421 - DNA, 18 bp, Homo sapiens
atcctccccttccctgca

SEQ ID NO: 4303422 - DNA, 16 bp, Homo sapiens
atcctcctggacccag

SEQ ID NO: 4303423 - DNA, 17 bp, Homo sapiens
atcctcctggacccagc

SEQ ID NO: 4303424 - DNA, 21 bp, Homo sapiens
atcctcctggacccagcaggg

SEQ ID NO: 4303425 - DNA, 16 bp, Homo sapiens
atcctccttccaggcc

SEQ ID NO: 4303426 - DNA, 21 bp, Homo sapiens
atcctccttccaggccccagg

SEQ ID NO: 4303427 - DNA, 22 bp, Homo sapiens
atcctccttccaggccccaggc

SEQ ID NO: 4303428 - DNA, 18 bp, Homo sapiens
atcctgattattgaatgt

SEQ ID NO: 4303429 - DNA, 16 bp, Homo sapiens
atcctgcaccctctgc

SEQ ID NO: 4303430 - DNA, 17 bp, Homo sapiens
atcctgcaccctctgct

SEQ ID NO: 4303431 - DNA, 17 bp, Homo sapiens
atcctgccttcatggaa

SEQ ID NO: 4303432 - DNA, 21 bp, Homo sapiens
atcctgccttttaccttcagt

SEQ ID NO: 4303433 - DNA, 17 bp, Homo sapiens
atcctgggcatccccag

SEQ ID NO: 4303434 - DNA, 20 bp, Homo sapiens
atcctgtacaagtgctcagt

SEQ ID NO: 4303435 - DNA, 15 bp, Homo sapiens
atcgaggaaccagag

SEQ ID NO: 4303436 - DNA, 20 bp, Homo sapiens
atcgatgttaaacgtcacag

SEQ ID NO: 4303437 - DNA, 23 bp, Homo sapiens
atcggaggcttgtcagagctggg

SEQ ID NO: 4303438 - DNA, 13 bp, Homo sapiens
atcggtcagcagg

SEQ ID NO: 4303439 - DNA, 17 bp, Homo sapiens
atcggttcaagttgatg

SEQ ID NO: 4303440 - DNA, 15 bp, Homo sapiens
atctaaaaaataact

SEQ ID NO: 4303441 - DNA, 19 bp, Homo sapiens
atctagaagagtctattgt

SEQ ID NO: 4303442 - DNA, 20 bp, Homo sapiens
atctagaagagtctattgtc

SEQ ID NO: 4303443 - DNA, 21 bp, Homo sapiens
atctagaagagtctattgtct

SEQ ID NO: 4303444 - DNA, 17 bp, Homo sapiens
atctagaggcttccttc

SEQ ID NO: 4303445 - DNA, 23 bp, Homo sapiens
atctagaggcttccttcatttcc

SEQ ID NO: 4303446 - DNA, 14 bp, Homo sapiens
atctagccaggcct

SEQ ID NO: 4303447 - DNA, 15 bp, Homo sapiens
atctagccaggcctc

SEQ ID NO: 4303448 - DNA, 19 bp, Homo sapiens
atctagccaggcctcccgc

SEQ ID NO: 4303449 - DNA, 22 bp, Homo sapiens
atctagctccataattgcaagg

SEQ ID NO: 4303450 - DNA, 16 bp, Homo sapiens
atctatctggtgattt

SEQ ID NO: 4303451 - DNA, 20 bp, Homo sapiens
atctcactttaataataaaa

SEQ ID NO: 4303452 - DNA, 10 bp, Homo sapiens
atctcagcac

SEQ ID NO: 4303453 - DNA, 16 bp, Homo sapiens
atctcagctcatcttc

SEQ ID NO: 4303454 - DNA, 17 bp, Homo sapiens
atctcaggccacctgcc

SEQ ID NO: 4303455 - DNA, 16 bp, Homo sapiens
atctcatcaacaaaga

SEQ ID NO: 4303456 - DNA, 13 bp, Homo sapiens
atctcatcatgtc

SEQ ID NO: 4303457 - DNA, 19 bp, Homo sapiens
atctcatccccaaactgta

SEQ ID NO: 4303458 - DNA, 15 bp, Homo sapiens
atctccaggcccagc

SEQ ID NO: 4303459 - DNA, 20 bp, Homo sapiens
atctccaggcccagcctggc

SEQ ID NO: 4303460 - DNA, 23 bp, Homo sapiens
atctccctcccatttgcagacca

SEQ ID NO: 4303461 - DNA, 13 bp, Homo sapiens
atctcctgtaatt

SEQ ID NO: 4303462 - DNA, 20 bp, Homo sapiens
atctcctgtaattttgtagt

SEQ ID NO: 4303463 - DNA, 18 bp, Homo sapiens
atctctgattaaatttaa

SEQ ID NO: 4303464 - DNA, 19 bp, Homo sapiens
atctctgattaaatttaat

SEQ ID NO: 4303465 - DNA, 15 bp, Homo sapiens
atctctggagtgtgt

SEQ ID NO: 4303466 - DNA, 21 bp, Homo sapiens
atctctgtgactcgcttagct

SEQ ID NO: 4303467 - DNA, 13 bp, Homo sapiens
atctcttcttcct

SEQ ID NO: 4303468 - DNA, 22 bp, Homo sapiens
atctctttctaaagacaggaga

SEQ ID NO: 4303469 - DNA, 19 bp, Homo sapiens
atctgaaaagaaatgctaa

SEQ ID NO: 4303470 - DNA, 15 bp, Homo sapiens
atctgcaaatagttt

SEQ ID NO: 4303471 - DNA, 18 bp, Homo sapiens
atctgctgagctctgacc

SEQ ID NO: 4303472 - DNA, 18 bp, Homo sapiens
atctgctgcctctgaaaa

SEQ ID NO: 4303473 - DNA, 21 bp, Homo sapiens
atctggagtctgaaggagagg

SEQ ID NO: 4303474 - DNA, 14 bp, Homo sapiens
atctggccctgctg

SEQ ID NO: 4303475 - DNA, 16 bp, Homo sapiens
atctggctaaggcatc

SEQ ID NO: 4303476 - DNA, 17 bp, Homo sapiens
atctggtgatttctagc

SEQ ID NO: 4303477 - DNA, 21 bp, Homo sapiens
atctgtataatactttgtata

SEQ ID NO: 4303478 - DNA, 15 bp, Homo sapiens
atctgtctgagccct

SEQ ID NO: 4303479 - DNA, 19 bp, Homo sapiens
atctgtctgagccctgccc

SEQ ID NO: 4303480 - DNA, 13 bp, Homo sapiens
atctgtctgattc

SEQ ID NO: 4303481 - DNA, 16 bp, Homo sapiens
atctgtggtcttcaaa

SEQ ID NO: 4303482 - DNA, 15 bp, Homo sapiens
atctgtttgcttcta

SEQ ID NO: 4303483 - DNA, 17 bp, Homo sapiens
atctgtttgcttctaaa

SEQ ID NO: 4303484 - DNA, 19 bp, Homo sapiens
atcttaaaagctatcttca

SEQ ID NO: 4303485 - DNA, 17 bp, Homo sapiens
atcttaatgtatatcgt

SEQ ID NO: 4303486 - DNA, 13 bp, Homo sapiens
atcttatgttgat

SEQ ID NO: 4303487 - DNA, 14 bp, Homo sapiens
atcttatttatata

SEQ ID NO: 4303488 - DNA, 18 bp, Homo sapiens
atcttcatgtaaattgac

SEQ ID NO: 4303489 - DNA, 14 bp, Homo sapiens
atcttccaaatatt

SEQ ID NO: 4303490 - DNA, 21 bp, Homo sapiens
atcttccccaacgaaaagcac

SEQ ID NO: 4303491 - DNA, 15 bp, Homo sapiens
atcttcgttagtaat

SEQ ID NO: 4303492 - DNA, 19 bp, Homo sapiens
atcttcgttagtaatctgt

SEQ ID NO: 4303493 - DNA, 19 bp, Homo sapiens
atcttctggactatagctg

SEQ ID NO: 4303494 - DNA, 14 bp, Homo sapiens
atcttgaagaatat

SEQ ID NO: 4303495 - DNA, 15 bp, Homo sapiens
atcttgaagaatatt

SEQ ID NO: 4303496 - DNA, 14 bp, Homo sapiens
atcttgagcaaggc

SEQ ID NO: 4303497 - DNA, 12 bp, Homo sapiens
atctttaaagac

SEQ ID NO: 4303498 - DNA, 20 bp, Homo sapiens
atctttaaagacttgatgaa

SEQ ID NO: 4303499 - DNA, 21 bp, Homo sapiens
atctttcagttattaaatgat

SEQ ID NO: 4303500 - DNA, 14 bp, Homo sapiens
atgaaaggtaatct

SEQ ID NO: 4303501 - DNA, 18 bp, Homo sapiens
atgaaaggtaatctgaaa

SEQ ID NO: 4303502 - DNA, 15 bp, Homo sapiens
atgaaatatttgctt

SEQ ID NO: 4303503 - DNA, 15 bp, Homo sapiens
atgaaatgttaacaa

SEQ ID NO: 4303504 - DNA, 13 bp, Homo sapiens
atgaaattccatt

SEQ ID NO: 4303505 - DNA, 22 bp, Homo sapiens
atgaaattttaccattttgcga

SEQ ID NO: 4303506 - DNA, 23 bp, Homo sapiens
atgaacctcaagctgcatctaga

SEQ ID NO: 4303507 - DNA, 22 bp, Homo sapiens
atgaagaaaagtgggccagtgt

SEQ ID NO: 4303508 - DNA, 23 bp, Homo sapiens
atgaagcaaacacacagactctg

SEQ ID NO: 4303509 - DNA, 14 bp, Homo sapiens
atgaagtaagttct

SEQ ID NO: 4303510 - DNA, 19 bp, Homo sapiens
atgaataatgcctttgtaa

SEQ ID NO: 4303511 - DNA, 21 bp, Homo sapiens
atgaataattatgtttacctc

SEQ ID NO: 4303512 - DNA, 20 bp, Homo sapiens
atgacaagccccaggcaggc

SEQ ID NO: 4303513 - DNA, 16 bp, Homo sapiens
atgacaatttcaaaat

SEQ ID NO: 4303514 - DNA, 19 bp, Homo sapiens
atgacaatttcaaaatgca

SEQ ID NO: 4303515 - DNA, 20 bp, Homo sapiens
atgacaatttcaaaatgcat

SEQ ID NO: 4303516 - DNA, 22 bp, Homo sapiens
atgacaatttcaaaatgcatgt

SEQ ID NO: 4303517 - DNA, 22 bp, Homo sapiens
atgacacataaatctgtctgat

SEQ ID NO: 4303518 - DNA, 20 bp, Homo sapiens
atgacaggcatccaaggaag

SEQ ID NO: 4303519 - DNA, 15 bp, Homo sapiens
atgaccaatctctgt

SEQ ID NO: 4303520 - DNA, 17 bp, Homo sapiens
atgaccaatctctgtga

SEQ ID NO: 4303521 - DNA, 22 bp, Homo sapiens
atgacccggcccccgccctctg

SEQ ID NO: 4303522 - DNA, 19 bp, Homo sapiens
atgactagggtcctcaggc

SEQ ID NO: 4303523 - DNA, 20 bp, Homo sapiens
atgactagggtcctcaggca

SEQ ID NO: 4303524 - DNA, 22 bp, Homo sapiens
atgactagggtcctcaggcagt

SEQ ID NO: 4303525 - DNA, 15 bp, Homo sapiens
atgactataaacatt

SEQ ID NO: 4303526 - DNA, 15 bp, Homo sapiens
atgactctttattgt

SEQ ID NO: 4303527 - DNA, 15 bp, Homo sapiens
atgactggtgcgttc

SEQ ID NO: 4303528 - DNA, 19 bp, Homo sapiens
atgactggtgcgttcctaa

SEQ ID NO: 4303529 - DNA, 17 bp, Homo sapiens
atgactgtttttgtagt

SEQ ID NO: 4303530 - DNA, 20 bp, Homo sapiens
atgacttctttactaacact

SEQ ID NO: 4303531 - DNA, 23 bp, Homo sapiens
atgacttctttactaacactggc

SEQ ID NO: 4303532 - DNA, 10 bp, Homo sapiens
atgagagagt

SEQ ID NO: 4303533 - DNA, 14 bp, Homo sapiens
atgagagagtgtgg

SEQ ID NO: 4303534 - DNA, 22 bp, Homo sapiens
atgagatactttgcattgtctg

SEQ ID NO: 4303535 - DNA, 21 bp, Homo sapiens
atgagatgggttgagtttgct

SEQ ID NO: 4303536 - DNA, 16 bp, Homo sapiens
atgagctcttcatgtt

SEQ ID NO: 4303537 - DNA, 18 bp, Homo sapiens
atgaggcctcagtggact

SEQ ID NO: 4303538 - DNA, 22 bp, Homo sapiens
atgaggggactgcatgcaagct

SEQ ID NO: 4303539 - DNA, 19 bp, Homo sapiens
atgagtctcactagcacat

SEQ ID NO: 4303540 - DNA, 18 bp, Homo sapiens
atgagtttaaaaaaataa

SEQ ID NO: 4303541 - DNA, 19 bp, Homo sapiens
atgagtttaaaaaaataac

SEQ ID NO: 4303542 - DNA, 15 bp, Homo sapiens
atgagtttatgggaa

SEQ ID NO: 4303543 - DNA, 20 bp, Homo sapiens
atgagtttccagctaagcct

SEQ ID NO: 4303544 - DNA, 17 bp, Homo sapiens
atgatataactttagaa

SEQ ID NO: 4303545 - DNA, 23 bp, Homo sapiens
atgatattgctgaagaatctact

SEQ ID NO: 4303546 - DNA, 19 bp, Homo sapiens
atgatcacttatcagtttg

SEQ ID NO: 4303547 - DNA, 17 bp, Homo sapiens
atgatcttccaaatatt

SEQ ID NO: 4303548 - DNA, 14 bp, Homo sapiens
atgatgatttcaga

SEQ ID NO: 4303549 - DNA, 14 bp, Homo sapiens
atgatgggaaagtg

SEQ ID NO: 4303550 - DNA, 16 bp, Homo sapiens
atgatgggtgttttta

SEQ ID NO: 4303551 - DNA, 19 bp, Homo sapiens
atgatgtggagtggggcag

SEQ ID NO: 4303552 - DNA, 23 bp, Homo sapiens
atgatgtggagtggggcagtaga

SEQ ID NO: 4303553 - DNA, 15 bp, Homo sapiens
atgattctcctctcc

SEQ ID NO: 4303554 - DNA, 17 bp, Homo sapiens
atgattctcctctccca

SEQ ID NO: 4303555 - DNA, 14 bp, Homo sapiens
atgattgaaaagaa

SEQ ID NO: 4303556 - DNA, 16 bp, Homo sapiens
atgatttcaatgattg

SEQ ID NO: 4303557 - DNA, 14 bp, Homo sapiens
atgatttcagaaac

SEQ ID NO: 4303558 - DNA, 16 bp, Homo sapiens
atgatttcagaaacaa

SEQ ID NO: 4303559 - DNA, 18 bp, Homo sapiens
atgatttgcaactttaga

SEQ ID NO: 4303560 - DNA, 19 bp, Homo sapiens
atgatttgcaactttagaa

SEQ ID NO: 4303561 - DNA, 17 bp, Homo sapiens
atgcaaagcacacctcg

SEQ ID NO: 4303562 - DNA, 15 bp, Homo sapiens
atgcacagtttgcaa

SEQ ID NO: 4303563 - DNA, 15 bp, Homo sapiens
atgcacctataaata

SEQ ID NO: 4303564 - DNA, 19 bp, Homo sapiens
atgcagatctagccaggcc

SEQ ID NO: 4303565 - DNA, 13 bp, Homo sapiens
atgcagtgccagg

SEQ ID NO: 4303566 - DNA, 11 bp, Homo sapiens
atgcatatact

SEQ ID NO: 4303567 - DNA, 18 bp, Homo sapiens
atgcatgatattgtatgt

SEQ ID NO: 4303568 - DNA, 13 bp, Homo sapiens
atgcatggcctcc

SEQ ID NO: 4303569 - DNA, 19 bp, Homo sapiens
atgcatggcctcccagcca

SEQ ID NO: 4303570 - DNA, 24 bp, Homo sapiens
atgcatgtgattggcagcttcaaa

SEQ ID NO: 4303571 - DNA, 16 bp, Homo sapiens
atgccacggcagccac

SEQ ID NO: 4303572 - DNA, 17 bp, Homo sapiens
atgccacggcagccacc

SEQ ID NO: 4303573 - DNA, 23 bp, Homo sapiens
atgccacggcagccaccctgcca

SEQ ID NO: 4303574 - DNA, 18 bp, Homo sapiens
atgccactaggccctggt

SEQ ID NO: 4303575 - DNA, 16 bp, Homo sapiens
atgccagtgactgctg

SEQ ID NO: 4303576 - DNA, 18 bp, Homo sapiens
atgccagtgactgctgcg

SEQ ID NO: 4303577 - DNA, 22 bp, Homo sapiens
atgccattccgaccttcaccaa

SEQ ID NO: 4303578 - DNA, 20 bp, Homo sapiens
atgccccactctgctgaggc

SEQ ID NO: 4303579 - DNA, 17 bp, Homo sapiens
atgccctcaggcttggg

SEQ ID NO: 4303580 - DNA, 16 bp, Homo sapiens
atgccctccctgctgc

SEQ ID NO: 4303581 - DNA, 21 bp, Homo sapiens
atgccctccctgctgccaggc

SEQ ID NO: 4303582 - DNA, 20 bp, Homo sapiens
atgcctaggccagctcctta

SEQ ID NO: 4303583 - DNA, 22 bp, Homo sapiens
atgcctgagaatgcctaggcca

SEQ ID NO: 4303584 - DNA, 14 bp, Homo sapiens
atgcctgggcctga

SEQ ID NO: 4303585 - DNA, 17 bp, Homo sapiens
atgcctggggtggaggc

SEQ ID NO: 4303586 - DNA, 17 bp, Homo sapiens
atgcctgtatttccaac

SEQ ID NO: 4303587 - DNA, 18 bp, Homo sapiens
atgcggcaagaaggaatt

SEQ ID NO: 4303588 - DNA, 13 bp, Homo sapiens
atgcggccggcct

SEQ ID NO: 4303589 - DNA, 17 bp, Homo sapiens
atgcgtggctcccagca

SEQ ID NO: 4303590 - DNA, 15 bp, Homo sapiens
atgctaatgtaatca

SEQ ID NO: 4303591 - DNA, 22 bp, Homo sapiens
atgctagcacaatattcctatg

SEQ ID NO: 4303592 - DNA, 19 bp, Homo sapiens
atgctatctcgctagccat

SEQ ID NO: 4303593 - DNA, 17 bp, Homo sapiens
atgctccagccaacccc

SEQ ID NO: 4303594 - DNA, 12 bp, Homo sapiens
atgctcctctgc

SEQ ID NO: 4303595 - DNA, 16 bp, Homo sapiens
atgctcctctgcctgt

SEQ ID NO: 4303596 - DNA, 20 bp, Homo sapiens
atgctcctctgcctgtgccc

SEQ ID NO: 4303597 - DNA, 23 bp, Homo sapiens
atgctcctctgcctgtgcccgct

SEQ ID NO: 4303598 - DNA, 19 bp, Homo sapiens
atgctgactgtactcctcc

SEQ ID NO: 4303599 - DNA, 21 bp, Homo sapiens
atgctgactgtactcctccca

SEQ ID NO: 4303600 - DNA, 21 bp, Homo sapiens
atgctgagattacaggtgtga

SEQ ID NO: 4303601 - DNA, 19 bp, Homo sapiens
atgctgcccaccccctgct

SEQ ID NO: 4303602 - DNA, 14 bp, Homo sapiens
atgctgcctgcctc

SEQ ID NO: 4303603 - DNA, 11 bp, Homo sapiens
atgctgctgtg

SEQ ID NO: 4303604 - DNA, 19 bp, Homo sapiens
atgctggctcccagggcca

SEQ ID NO: 4303605 - DNA, 14 bp, Homo sapiens
atgctgggaccctc

SEQ ID NO: 4303606 - DNA, 19 bp, Homo sapiens
atgctgggttctggggctg

SEQ ID NO: 4303607 - DNA, 19 bp, Homo sapiens
atgctggtcatcctgggca

SEQ ID NO: 4303608 - DNA, 15 bp, Homo sapiens
atgctgtatctgtgc

SEQ ID NO: 4303609 - DNA, 16 bp, Homo sapiens
atgcttataagcaaca

SEQ ID NO: 4303610 - DNA, 21 bp, Homo sapiens
atgcttgcctagggcctggtc

SEQ ID NO: 4303611 - DNA, 22 bp, Homo sapiens
atgctttgtgtgattgaatctg

SEQ ID NO: 4303612 - DNA, 21 bp, Homo sapiens
atgcttttctagcaactgttg

SEQ ID NO: 4303613 - DNA, 16 bp, Homo sapiens
atggaaagggtgtggc

SEQ ID NO: 4303614 - DNA, 21 bp, Homo sapiens
atggaaagggtgtggcttgga

SEQ ID NO: 4303615 - DNA, 15 bp, Homo sapiens
atggaagagagaaag

SEQ ID NO: 4303616 - DNA, 18 bp, Homo sapiens
atggacagggccagggtt

SEQ ID NO: 4303617 - DNA, 21 bp, Homo sapiens
atggacctgcacttggcctct

SEQ ID NO: 4303618 - DNA, 14 bp, Homo sapiens
atggactctacact

SEQ ID NO: 4303619 - DNA, 18 bp, Homo sapiens
atggactctacactgtga

SEQ ID NO: 4303620 - DNA, 16 bp, Homo sapiens
atggaggaaaaccaag

SEQ ID NO: 4303621 - DNA, 18 bp, Homo sapiens
atggaggtgatgaaaacc

SEQ ID NO: 4303622 - DNA, 22 bp, Homo sapiens
atggagtccagacctgggccct

SEQ ID NO: 4303623 - DNA, 22 bp, Homo sapiens
atggatatttttaatttatgat

SEQ ID NO: 4303624 - DNA, 18 bp, Homo sapiens
atggatctgctccatgca

SEQ ID NO: 4303625 - DNA, 19 bp, Homo sapiens
atggattcagtttctaaaa

SEQ ID NO: 4303626 - DNA, 18 bp, Homo sapiens
atggattcccctggacat

SEQ ID NO: 4303627 - DNA, 23 bp, Homo sapiens
atggcaattctttgacctcaacc

SEQ ID NO: 4303628 - DNA, 11 bp, Homo sapiens
atggcagtgag

SEQ ID NO: 4303629 - DNA, 12 bp, Homo sapiens
atggcagtgaga

SEQ ID NO: 4303630 - DNA, 22 bp, Homo sapiens
atggccagcccagatggctccc

SEQ ID NO: 4303631 - DNA, 16 bp, Homo sapiens
atggccaggtggccac

SEQ ID NO: 4303632 - DNA, 19 bp, Homo sapiens
atggcctcccagccacccg

SEQ ID NO: 4303633 - DNA, 14 bp, Homo sapiens
atggcgcagtgcct

SEQ ID NO: 4303634 - DNA, 19 bp, Homo sapiens
atggcgcagtgcctctggt

SEQ ID NO: 4303635 - DNA, 18 bp, Homo sapiens
atggctactttggtttct

SEQ ID NO: 4303636 - DNA, 17 bp, Homo sapiens
atggctccctgggctgg

SEQ ID NO: 4303637 - DNA, 21 bp, Homo sapiens
atggctccctgggctggcatg

SEQ ID NO: 4303638 - DNA, 16 bp, Homo sapiens
atggctgggtttgggc

SEQ ID NO: 4303639 - DNA, 16 bp, Homo sapiens
atggctgtcccctgca

SEQ ID NO: 4303640 - DNA, 21 bp, Homo sapiens
atggctgtcccctgcaagtgg

SEQ ID NO: 4303641 - DNA, 19 bp, Homo sapiens
atggctttaacagtaatgt

SEQ ID NO: 4303642 - DNA, 15 bp, Homo sapiens
atgggagtaagagca

SEQ ID NO: 4303643 - DNA, 16 bp, Homo sapiens
atgggagtcagggagc

SEQ ID NO: 4303644 - DNA, 19 bp, Homo sapiens
atgggagtcagggagccct

SEQ ID NO: 4303645 - DNA, 14 bp, Homo sapiens
atgggatcattatt

SEQ ID NO: 4303646 - DNA, 19 bp, Homo sapiens
atgggatcattatttcatg

SEQ ID NO: 4303647 - DNA, 21 bp, Homo sapiens
atgggcacaggctgccccacc

SEQ ID NO: 4303648 - DNA, 22 bp, Homo sapiens
atgggcatggggtgggcctctg

SEQ ID NO: 4303649 - DNA, 15 bp, Homo sapiens
atgggccaagccagg

SEQ ID NO: 4303650 - DNA, 16 bp, Homo sapiens
atgggccaagccaggg

SEQ ID NO: 4303651 - DNA, 12 bp, Homo sapiens
atggggcctctg

SEQ ID NO: 4303652 - DNA, 19 bp, Homo sapiens
atggggctgacagcactaa

SEQ ID NO: 4303653 - DNA, 22 bp, Homo sapiens
atggggggccaacaccagggat

SEQ ID NO: 4303654 - DNA, 19 bp, Homo sapiens
atggggtgggcctctggtt

SEQ ID NO: 4303655 - DNA, 14 bp, Homo sapiens
atggggttgggctc

SEQ ID NO: 4303656 - DNA, 16 bp, Homo sapiens
atggggttgggctctg

SEQ ID NO: 4303657 - DNA, 17 bp, Homo sapiens
atggggttgggctctgc

SEQ ID NO: 4303658 - DNA, 21 bp, Homo sapiens
atgggtcccttccccctgctc

SEQ ID NO: 4303659 - DNA, 18 bp, Homo sapiens
atggtagaaaaatttcac

SEQ ID NO: 4303660 - DNA, 18 bp, Homo sapiens
atggtagaaattttatct

SEQ ID NO: 4303661 - DNA, 23 bp, Homo sapiens
atggtagaaattttatctcttct

SEQ ID NO: 4303662 - DNA, 15 bp, Homo sapiens
atggtagactgtgac

SEQ ID NO: 4303663 - DNA, 22 bp, Homo sapiens
atggtattttcgtgcatttgtg

SEQ ID NO: 4303664 - DNA, 17 bp, Homo sapiens
atggtgcagtgaagaaa

SEQ ID NO: 4303665 - DNA, 16 bp, Homo sapiens
atggtgccttcatttg

SEQ ID NO: 4303666 - DNA, 14 bp, Homo sapiens
atggtgctgcaccc

SEQ ID NO: 4303667 - DNA, 20 bp, Homo sapiens
atggtgctgcacccctggtg

SEQ ID NO: 4303668 - DNA, 16 bp, Homo sapiens
atggtgcttggcagga

SEQ ID NO: 4303669 - DNA, 15 bp, Homo sapiens
atggtgggctccaga

SEQ ID NO: 4303670 - DNA, 14 bp, Homo sapiens
atggtggtttcaga

SEQ ID NO: 4303671 - DNA, 21 bp, Homo sapiens
atggtggtttcagaaagggca

SEQ ID NO: 4303672 - DNA, 20 bp, Homo sapiens
atggttcccctgttcactct

SEQ ID NO: 4303673 - DNA, 13 bp, Homo sapiens
atggttctagaag

SEQ ID NO: 4303674 - DNA, 12 bp, Homo sapiens
atgtaaaattca

SEQ ID NO: 4303675 - DNA, 14 bp, Homo sapiens
atgtaaaattcata

SEQ ID NO: 4303676 - DNA, 22 bp, Homo sapiens
atgtaactgtccgtagtatcag

SEQ ID NO: 4303677 - DNA, 13 bp, Homo sapiens
atgtaagaagccc

SEQ ID NO: 4303678 - DNA, 19 bp, Homo sapiens
atgtaatcatttatcttat

SEQ ID NO: 4303679 - DNA, 18 bp, Homo sapiens
atgtaattaaactgttaa

SEQ ID NO: 4303680 - DNA, 19 bp, Homo sapiens
atgtaattaaactgttaac

SEQ ID NO: 4303681 - DNA, 17 bp, Homo sapiens
atgtaccatgttaaaga

SEQ ID NO: 4303682 - DNA, 14 bp, Homo sapiens
atgtacccagccta

SEQ ID NO: 4303683 - DNA, 22 bp, Homo sapiens
atgtactttcattccctttcat

SEQ ID NO: 4303684 - DNA, 12 bp, Homo sapiens
atgtagaagagg

SEQ ID NO: 4303685 - DNA, 14 bp, Homo sapiens
atgtagaagaggga

SEQ ID NO: 4303686 - DNA, 19 bp, Homo sapiens
atgtagaagagggagaagg

SEQ ID NO: 4303687 - DNA, 13 bp, Homo sapiens
atgtagccagccc

SEQ ID NO: 4303688 - DNA, 14 bp, Homo sapiens
atgtagccagccca

SEQ ID NO: 4303689 - DNA, 19 bp, Homo sapiens
atgtatagtgagtgtggct

SEQ ID NO: 4303690 - DNA, 18 bp, Homo sapiens
atgtatcttatttatata

SEQ ID NO: 4303691 - DNA, 20 bp, Homo sapiens
atgtatcttatttatatatg

SEQ ID NO: 4303692 - DNA, 21 bp, Homo sapiens
atgtatcttatttatatatga

SEQ ID NO: 4303693 - DNA, 22 bp, Homo sapiens
atgtatcttatttatatatgaa

SEQ ID NO: 4303694 - DNA, 15 bp, Homo sapiens
atgtatctttactgg

SEQ ID NO: 4303695 - DNA, 20 bp, Homo sapiens
atgtatctttactggaaatg

SEQ ID NO: 4303696 - DNA, 17 bp, Homo sapiens
atgtatgtgaaagtgta

SEQ ID NO: 4303697 - DNA, 22 bp, Homo sapiens
atgtatgtgaaagtgtaaaata

SEQ ID NO: 4303698 - DNA, 21 bp, Homo sapiens
atgtattaagcccacagtata

SEQ ID NO: 4303699 - DNA, 16 bp, Homo sapiens
atgtattatgcaaagt

SEQ ID NO: 4303700 - DNA, 17 bp, Homo sapiens
atgtattatgcaaagta

SEQ ID NO: 4303701 - DNA, 23 bp, Homo sapiens
atgtcaaccttgtgtgagtgtga

SEQ ID NO: 4303702 - DNA, 15 bp, Homo sapiens
atgtcaagattcagc

SEQ ID NO: 4303703 - DNA, 21 bp, Homo sapiens
atgtcatactctgtgtaatct

SEQ ID NO: 4303704 - DNA, 22 bp, Homo sapiens
atgtcatactctgtgtaatctc

SEQ ID NO: 4303705 - DNA, 21 bp, Homo sapiens
atgtccccattctataaattc

SEQ ID NO: 4303706 - DNA, 13 bp, Homo sapiens
atgtctactgctt

SEQ ID NO: 4303707 - DNA, 22 bp, Homo sapiens
atgtctcaccaggaaattctgt

SEQ ID NO: 4303708 - DNA, 22 bp, Homo sapiens
atgtctttggcttcagaattgt

SEQ ID NO: 4303709 - DNA, 14 bp, Homo sapiens
atgtgaaagtgtaa

SEQ ID NO: 4303710 - DNA, 15 bp, Homo sapiens
atgtgaaagtgtaaa

SEQ ID NO: 4303711 - DNA, 17 bp, Homo sapiens
atgtgaaagtgtaaaat

SEQ ID NO: 4303712 - DNA, 17 bp, Homo sapiens
atgtgaattgaagtcat

SEQ ID NO: 4303713 - DNA, 16 bp, Homo sapiens
atgtgctattaatatt

SEQ ID NO: 4303714 - DNA, 17 bp, Homo sapiens
atgtgctcatcagaaac

SEQ ID NO: 4303715 - DNA, 16 bp, Homo sapiens
atgtgctgctgtggca

SEQ ID NO: 4303716 - DNA, 16 bp, Homo sapiens
atgtggcagctgtctc

SEQ ID NO: 4303717 - DNA, 16 bp, Homo sapiens
atgtgtaacttctaga

SEQ ID NO: 4303718 - DNA, 21 bp, Homo sapiens
atgtgtatcagtgtttatgtg

SEQ ID NO: 4303719 - DNA, 17 bp, Homo sapiens
atgtgtcatgatttcaa

SEQ ID NO: 4303720 - DNA, 16 bp, Homo sapiens
atgtgtccatgtgaaa

SEQ ID NO: 4303721 - DNA, 19 bp, Homo sapiens
atgtgtggctcattctttt

SEQ ID NO: 4303722 - DNA, 20 bp, Homo sapiens
atgtgtggctcattcttttc

SEQ ID NO: 4303723 - DNA, 14 bp, Homo sapiens
atgtgtgtatgtgt

SEQ ID NO: 4303724 - DNA, 16 bp, Homo sapiens
atgtgtgtatgtgtgt

SEQ ID NO: 4303725 - DNA, 22 bp, Homo sapiens
atgtgttgcaaattattctagt

SEQ ID NO: 4303726 - DNA, 21 bp, Homo sapiens
atgtgtttataattgttatac

SEQ ID NO: 4303727 - DNA, 21 bp, Homo sapiens
atgtgtttcaggtggaacagg

SEQ ID NO: 4303728 - DNA, 23 bp, Homo sapiens
atgttaacaatgcctattgtaat

SEQ ID NO: 4303729 - DNA, 15 bp, Homo sapiens
atgttaagctcttta

SEQ ID NO: 4303730 - DNA, 14 bp, Homo sapiens
atgttaccttcaca

SEQ ID NO: 4303731 - DNA, 17 bp, Homo sapiens
atgttactacatgcact

SEQ ID NO: 4303732 - DNA, 17 bp, Homo sapiens
atgttcacgcaacttga

SEQ ID NO: 4303733 - DNA, 20 bp, Homo sapiens
atgttcatgtgtaacttcta

SEQ ID NO: 4303734 - DNA, 21 bp, Homo sapiens
atgttcctgggatgtttaatc

SEQ ID NO: 4303735 - DNA, 12 bp, Homo sapiens
atgttcttgcag

SEQ ID NO: 4303736 - DNA, 14 bp, Homo sapiens
atgttgatcgatgt

SEQ ID NO: 4303737 - DNA, 15 bp, Homo sapiens
atgtttccatagttt

SEQ ID NO: 4303738 - DNA, 23 bp, Homo sapiens
atgtttgagcagtggcctacaaa

SEQ ID NO: 4303739 - DNA, 21 bp, Homo sapiens
atgtttgttttcaaaatactt

SEQ ID NO: 4303740 - DNA, 22 bp, Homo sapiens
atgtttgttttcaaaatacttc

SEQ ID NO: 4303741 - DNA, 18 bp, Homo sapiens
atgttttacaatggctgg

SEQ ID NO: 4303742 - DNA, 21 bp, Homo sapiens
atgttttccccaattatcctc

SEQ ID NO: 4303743 - DNA, 13 bp, Homo sapiens
attaaaaagttaa

SEQ ID NO: 4303744 - DNA, 18 bp, Homo sapiens
attaaaagaagactggaa

SEQ ID NO: 4303745 - DNA, 13 bp, Homo sapiens
attaaaattagtg

SEQ ID NO: 4303746 - DNA, 14 bp, Homo sapiens
attaaaattagtga

SEQ ID NO: 4303747 - DNA, 14 bp, Homo sapiens
attaaagacattta

SEQ ID NO: 4303748 - DNA, 17 bp, Homo sapiens
attaaagtgcactgtgt

SEQ ID NO: 4303749 - DNA, 16 bp, Homo sapiens
attaacctttcaggaa

SEQ ID NO: 4303750 - DNA, 21 bp, Homo sapiens
attaagaaaccccctcatgga

SEQ ID NO: 4303751 - DNA, 11 bp, Homo sapiens
attaagaaact

SEQ ID NO: 4303752 - DNA, 18 bp, Homo sapiens
attaatccacatgtttca

SEQ ID NO: 4303753 - DNA, 14 bp, Homo sapiens
attaatgaaatacc

SEQ ID NO: 4303754 - DNA, 12 bp, Homo sapiens
attaatgagttt

SEQ ID NO: 4303755 - DNA, 14 bp, Homo sapiens
attaattattgaaa

SEQ ID NO: 4303756 - DNA, 21 bp, Homo sapiens
attaatttctgccatttcatg

SEQ ID NO: 4303757 - DNA, 16 bp, Homo sapiens
attaatttgtgtagat

SEQ ID NO: 4303758 - DNA, 18 bp, Homo sapiens
attacaatggccagccca

SEQ ID NO: 4303759 - DNA, 20 bp, Homo sapiens
attacagaagaagctcctga

SEQ ID NO: 4303760 - DNA, 17 bp, Homo sapiens
attacagatttagttta

SEQ ID NO: 4303761 - DNA, 17 bp, Homo sapiens
attacagggaagaaatc

SEQ ID NO: 4303762 - DNA, 19 bp, Homo sapiens
attacagggaagaaatcaa

SEQ ID NO: 4303763 - DNA, 14 bp, Homo sapiens
attaccatttgtta

SEQ ID NO: 4303764 - DNA, 21 bp, Homo sapiens
attagagtgcccttaaaataa

SEQ ID NO: 4303765 - DNA, 18 bp, Homo sapiens
attagataaatgtccatt

SEQ ID NO: 4303766 - DNA, 20 bp, Homo sapiens
attagattttaaaacttcat

SEQ ID NO: 4303767 - DNA, 20 bp, Homo sapiens
attagcatgaaaggtaatct

SEQ ID NO: 4303768 - DNA, 15 bp, Homo sapiens
attagctgtgatttt

SEQ ID NO: 4303769 - DNA, 22 bp, Homo sapiens
attagctgtgatttttgttgat

SEQ ID NO: 4303770 - DNA, 21 bp, Homo sapiens
attagtaagatctctttctaa

SEQ ID NO: 4303771 - DNA, 15 bp, Homo sapiens
attagtgagatttgt

SEQ ID NO: 4303772 - DNA, 19 bp, Homo sapiens
attagtgagatttgtattt

SEQ ID NO: 4303773 - DNA, 20 bp, Homo sapiens
attagtgagatttgtattta

SEQ ID NO: 4303774 - DNA, 15 bp, Homo sapiens
attatcctgtgtgat

SEQ ID NO: 4303775 - DNA, 17 bp, Homo sapiens
attatcctgtgtgatta

SEQ ID NO: 4303776 - DNA, 18 bp, Homo sapiens
attatcctgtgtgattac

SEQ ID NO: 4303777 - DNA, 19 bp, Homo sapiens
attatccttttatctcaca

SEQ ID NO: 4303778 - DNA, 15 bp, Homo sapiens
attatgattagcttt

SEQ ID NO: 4303779 - DNA, 21 bp, Homo sapiens
attatggctttgtgcttgttc

SEQ ID NO: 4303780 - DNA, 18 bp, Homo sapiens
attatgtttacctcactg

SEQ ID NO: 4303781 - DNA, 18 bp, Homo sapiens
attattaaatcagaatct

SEQ ID NO: 4303782 - DNA, 12 bp, Homo sapiens
attattactttt

SEQ ID NO: 4303783 - DNA, 12 bp, Homo sapiens
attattctagtc

SEQ ID NO: 4303784 - DNA, 18 bp, Homo sapiens
attattctagtcaactgc

SEQ ID NO: 4303785 - DNA, 13 bp, Homo sapiens
attattgaatgtt

SEQ ID NO: 4303786 - DNA, 14 bp, Homo sapiens
attattttaaaaat

SEQ ID NO: 4303787 - DNA, 19 bp, Homo sapiens
attcaaaatagttctattt

SEQ ID NO: 4303788 - DNA, 16 bp, Homo sapiens
attcaaatgcatgata

SEQ ID NO: 4303789 - DNA, 14 bp, Homo sapiens
attcaacacttatt

SEQ ID NO: 4303790 - DNA, 15 bp, Homo sapiens
attcaacacttattt

SEQ ID NO: 4303791 - DNA, 13 bp, Homo sapiens
attcaagattccc

SEQ ID NO: 4303792 - DNA, 16 bp, Homo sapiens
attcacaacacaatca

SEQ ID NO: 4303793 - DNA, 13 bp, Homo sapiens
attcacactgtgc

SEQ ID NO: 4303794 - DNA, 23 bp, Homo sapiens
attcacactgtgcgttttagagt

SEQ ID NO: 4303795 - DNA, 14 bp, Homo sapiens
attcaggaatgggc

SEQ ID NO: 4303796 - DNA, 20 bp, Homo sapiens
attcaggcttgcattaaaag

SEQ ID NO: 4303797 - DNA, 14 bp, Homo sapiens
attcataaaaataa

SEQ ID NO: 4303798 - DNA, 23 bp, Homo sapiens
attcataacaatgtatgtgaaag

SEQ ID NO: 4303799 - DNA, 13 bp, Homo sapiens
attcatacttaaa

SEQ ID NO: 4303800 - DNA, 20 bp, Homo sapiens
attcatacttaaaaatttat

SEQ ID NO: 4303801 - DNA, 14 bp, Homo sapiens
attcatactttcca

SEQ ID NO: 4303802 - DNA, 19 bp, Homo sapiens
attcatagcatcctgatta

SEQ ID NO: 4303803 - DNA, 18 bp, Homo sapiens
attcatgtgtaggaagag

SEQ ID NO: 4303804 - DNA, 16 bp, Homo sapiens
attcattctttataaa

SEQ ID NO: 4303805 - DNA, 17 bp, Homo sapiens
attccagacctgaagaa

SEQ ID NO: 4303806 - DNA, 16 bp, Homo sapiens
attccagtgtattttc

SEQ ID NO: 4303807 - DNA, 21 bp, Homo sapiens
attccatctatataaatcgca

SEQ ID NO: 4303808 - DNA, 13 bp, Homo sapiens
attcccaggcagg

SEQ ID NO: 4303809 - DNA, 17 bp, Homo sapiens
attcccaggcagggagg

SEQ ID NO: 4303810 - DNA, 20 bp, Homo sapiens
attcccatggtagactgtga

SEQ ID NO: 4303811 - DNA, 15 bp, Homo sapiens
attccccggagctgg

SEQ ID NO: 4303812 - DNA, 20 bp, Homo sapiens
attcccttctctcagcctcc

SEQ ID NO: 4303813 - DNA, 22 bp, Homo sapiens
attcccttctctcagcctccac

SEQ ID NO: 4303814 - DNA, 20 bp, Homo sapiens
attcgcccaaagccagacag

SEQ ID NO: 4303815 - DNA, 15 bp, Homo sapiens
attctaaaacattct

SEQ ID NO: 4303816 - DNA, 13 bp, Homo sapiens
attctaaattatg

SEQ ID NO: 4303817 - DNA, 21 bp, Homo sapiens
attctaagaaatatctgtgaa

SEQ ID NO: 4303818 - DNA, 17 bp, Homo sapiens
attctaagattgtacat

SEQ ID NO: 4303819 - DNA, 18 bp, Homo sapiens
attctaagattgtacata

SEQ ID NO: 4303820 - DNA, 23 bp, Homo sapiens
attctaagattgtacatatggaa

SEQ ID NO: 4303821 - DNA, 15 bp, Homo sapiens
attctagtcaactgc

SEQ ID NO: 4303822 - DNA, 21 bp, Homo sapiens
attctagtcaactgctgtttt

SEQ ID NO: 4303823 - DNA, 16 bp, Homo sapiens
attctagtctctgatt

SEQ ID NO: 4303824 - DNA, 21 bp, Homo sapiens
attctagtctctgatttgcaa

SEQ ID NO: 4303825 - DNA, 14 bp, Homo sapiens
attctatatttcat

SEQ ID NO: 4303826 - DNA, 15 bp, Homo sapiens
attctatctactgat

SEQ ID NO: 4303827 - DNA, 21 bp, Homo sapiens
attctatgcctgtatttccaa

SEQ ID NO: 4303828 - DNA, 12 bp, Homo sapiens
attctatttcaa

SEQ ID NO: 4303829 - DNA, 11 bp, Homo sapiens
attctcctctc

SEQ ID NO: 4303830 - DNA, 13 bp, Homo sapiens
attctcctctccc

SEQ ID NO: 4303831 - DNA, 14 bp, Homo sapiens
attctcctctccca

SEQ ID NO: 4303832 - DNA, 21 bp, Homo sapiens
attctcttttcaaacacacac

SEQ ID NO: 4303833 - DNA, 13 bp, Homo sapiens
attctgctgcccc

SEQ ID NO: 4303834 - DNA, 12 bp, Homo sapiens
attctggctcca

SEQ ID NO: 4303835 - DNA, 14 bp, Homo sapiens
attctggctccacc

SEQ ID NO: 4303836 - DNA, 18 bp, Homo sapiens
attctgtggattctatat

SEQ ID NO: 4303837 - DNA, 19 bp, Homo sapiens
attctgtgggcagctggct

SEQ ID NO: 4303838 - DNA, 20 bp, Homo sapiens
attctgtgggcagctggctc

SEQ ID NO: 4303839 - DNA, 22 bp, Homo sapiens
attctgtgggcagctggctctg

SEQ ID NO: 4303840 - DNA, 23 bp, Homo sapiens
attctgtgggcagctggctctga

SEQ ID NO: 4303841 - DNA, 15 bp, Homo sapiens
attcttccatctgat

SEQ ID NO: 4303842 - DNA, 19 bp, Homo sapiens
attcttgctttcacaaata

SEQ ID NO: 4303843 - DNA, 20 bp, Homo sapiens
attctttaacatacatctaa

SEQ ID NO: 4303844 - DNA, 21 bp, Homo sapiens
attcttttcagcttgtttcta

SEQ ID NO: 4303845 - DNA, 14 bp, Homo sapiens
attcttttgaaaga

SEQ ID NO: 4303846 - DNA, 16 bp, Homo sapiens
attcttttgaaagatg

SEQ ID NO: 4303847 - DNA, 23 bp, Homo sapiens
attcttttttcttccccctccat

SEQ ID NO: 4303848 - DNA, 20 bp, Homo sapiens
attgaaagtggggtgttgaa

SEQ ID NO: 4303849 - DNA, 21 bp, Homo sapiens
attgaagagagatatatctga

SEQ ID NO: 4303850 - DNA, 18 bp, Homo sapiens
attgaagtatctgtacct

SEQ ID NO: 4303851 - DNA, 18 bp, Homo sapiens
attgaagtcatcataaaa

SEQ ID NO: 4303852 - DNA, 23 bp, Homo sapiens
attgaatctgattggacattttc

SEQ ID NO: 4303853 - DNA, 21 bp, Homo sapiens
attgaatgttatatcatcaat

SEQ ID NO: 4303854 - DNA, 14 bp, Homo sapiens
attgacaagtttaa

SEQ ID NO: 4303855 - DNA, 23 bp, Homo sapiens
attgacgtctagctatgctgtat

SEQ ID NO: 4303856 - DNA, 22 bp, Homo sapiens
attgagagatgttttgttgata

SEQ ID NO: 4303857 - DNA, 23 bp, Homo sapiens
attgagatcagcattcaaaatag

SEQ ID NO: 4303858 - DNA, 20 bp, Homo sapiens
attgagcagaattcattcat

SEQ ID NO: 4303859 - DNA, 22 bp, Homo sapiens
attgagtcattttatatatgaa

SEQ ID NO: 4303860 - DNA, 20 bp, Homo sapiens
attgagttcttcctgtaatc

SEQ ID NO: 4303861 - DNA, 23 bp, Homo sapiens
attgatattctaagaaatatctg

SEQ ID NO: 4303862 - DNA, 13 bp, Homo sapiens
attgcaagggaag

SEQ ID NO: 4303863 - DNA, 17 bp, Homo sapiens
attgcatttttaccttt

SEQ ID NO: 4303864 - DNA, 16 bp, Homo sapiens
attgcccatgatataa

SEQ ID NO: 4303865 - DNA, 19 bp, Homo sapiens
attgcccatgatataactt

SEQ ID NO: 4303866 - DNA, 13 bp, Homo sapiens
attgccctgaggg

SEQ ID NO: 4303867 - DNA, 15 bp, Homo sapiens
attgccctgaggggc

SEQ ID NO: 4303868 - DNA, 21 bp, Homo sapiens
attgctctggggcttgctatt

SEQ ID NO: 4303869 - DNA, 17 bp, Homo sapiens
attggcagcttcaaaac

SEQ ID NO: 4303870 - DNA, 22 bp, Homo sapiens
attggcaggtgtgggctcccac

SEQ ID NO: 4303871 - DNA, 15 bp, Homo sapiens
attggtaccagagcc

SEQ ID NO: 4303872 - DNA, 15 bp, Homo sapiens
attggtgataagtgg

SEQ ID NO: 4303873 - DNA, 16 bp, Homo sapiens
attggtgataagtgga

SEQ ID NO: 4303874 - DNA, 18 bp, Homo sapiens
attggtgataagtggaaa

SEQ ID NO: 4303875 - DNA, 15 bp, Homo sapiens
attggttcatgcctg

SEQ ID NO: 4303876 - DNA, 16 bp, Homo sapiens
attggttcatgcctgg

SEQ ID NO: 4303877 - DNA, 17 bp, Homo sapiens
attggttcatgcctggg

SEQ ID NO: 4303878 - DNA, 15 bp, Homo sapiens
attggttctatttat

SEQ ID NO: 4303879 - DNA, 18 bp, Homo sapiens
attgtaaaggtaggtgca

SEQ ID NO: 4303880 - DNA, 19 bp, Homo sapiens
attgtaaaggtaggtgcat

SEQ ID NO: 4303881 - DNA, 15 bp, Homo sapiens
attgtacatatggaa

SEQ ID NO: 4303882 - DNA, 18 bp, Homo sapiens
attgtagcatttcttgat

SEQ ID NO: 4303883 - DNA, 16 bp, Homo sapiens
attgtataaaacagtg

SEQ ID NO: 4303884 - DNA, 13 bp, Homo sapiens
attgtcatttata

SEQ ID NO: 4303885 - DNA, 15 bp, Homo sapiens
attgtccacaaatgt

SEQ ID NO: 4303886 - DNA, 16 bp, Homo sapiens
attgtccacaaatgtc

SEQ ID NO: 4303887 - DNA, 15 bp, Homo sapiens
attgtgaaatttgtt

SEQ ID NO: 4303888 - DNA, 14 bp, Homo sapiens
attgtggagaggag

SEQ ID NO: 4303889 - DNA, 14 bp, Homo sapiens
attgttattaaatg

SEQ ID NO: 4303890 - DNA, 22 bp, Homo sapiens
attgttcaaagaacccccctcc

SEQ ID NO: 4303891 - DNA, 16 bp, Homo sapiens
attgtttttagaaatt

SEQ ID NO: 4303892 - DNA, 12 bp, Homo sapiens
atttaaaatagt

SEQ ID NO: 4303893 - DNA, 19 bp, Homo sapiens
atttaaaatggacttttgt

SEQ ID NO: 4303894 - DNA, 13 bp, Homo sapiens
atttaaatgattt

SEQ ID NO: 4303895 - DNA, 15 bp, Homo sapiens
atttaactagcactt

SEQ ID NO: 4303896 - DNA, 12 bp, Homo sapiens
atttaactgcat

SEQ ID NO: 4303897 - DNA, 17 bp, Homo sapiens
atttaactgcatataga

SEQ ID NO: 4303898 - DNA, 13 bp, Homo sapiens
atttaagcatttt

SEQ ID NO: 4303899 - DNA, 15 bp, Homo sapiens
atttaagcattttac

SEQ ID NO: 4303900 - DNA, 21 bp, Homo sapiens
atttaatatactgcatatcct

SEQ ID NO: 4303901 - DNA, 16 bp, Homo sapiens
atttacaatgtattaa

SEQ ID NO: 4303902 - DNA, 17 bp, Homo sapiens
atttacaatgtattaag

SEQ ID NO: 4303903 - DNA, 18 bp, Homo sapiens
atttacagttactgccta

SEQ ID NO: 4303904 - DNA, 22 bp, Homo sapiens
atttagcatgacaagccccagg

SEQ ID NO: 4303905 - DNA, 22 bp, Homo sapiens
atttaggcatgagctcttggca

SEQ ID NO: 4303906 - DNA, 14 bp, Homo sapiens
atttatattagagt

SEQ ID NO: 4303907 - DNA, 16 bp, Homo sapiens
atttatcatatttaat

SEQ ID NO: 4303908 - DNA, 17 bp, Homo sapiens
atttatctgtctgagcc

SEQ ID NO: 4303909 - DNA, 15 bp, Homo sapiens
atttattcttatctt

SEQ ID NO: 4303910 - DNA, 18 bp, Homo sapiens
atttatttccaatgtttc

SEQ ID NO: 4303911 - DNA, 13 bp, Homo sapiens
atttattttcctc

SEQ ID NO: 4303912 - DNA, 20 bp, Homo sapiens
atttattttgtatgaaatat

SEQ ID NO: 4303913 - DNA, 12 bp, Homo sapiens
atttcaaaatgc

SEQ ID NO: 4303914 - DNA, 13 bp, Homo sapiens
atttcaaaatgca

SEQ ID NO: 4303915 - DNA, 16 bp, Homo sapiens
atttcaaaatgcatgt

SEQ ID NO: 4303916 - DNA, 18 bp, Homo sapiens
atttcaatgattgtttaa

SEQ ID NO: 4303917 - DNA, 23 bp, Homo sapiens
atttcaatgattgtttaattgta

SEQ ID NO: 4303918 - DNA, 16 bp, Homo sapiens
atttcacgattcattt

SEQ ID NO: 4303919 - DNA, 21 bp, Homo sapiens
atttcagtaagatcaagctcc

SEQ ID NO: 4303920 - DNA, 15 bp, Homo sapiens
atttcatgactggtg

SEQ ID NO: 4303921 - DNA, 21 bp, Homo sapiens
atttcatgtccataaaagaga

SEQ ID NO: 4303922 - DNA, 23 bp, Homo sapiens
atttccaacaaacttactgtcag

SEQ ID NO: 4303923 - DNA, 14 bp, Homo sapiens
atttccaatgtttc

SEQ ID NO: 4303924 - DNA, 22 bp, Homo sapiens
atttccgaagaccttctgaaga

SEQ ID NO: 4303925 - DNA, 18 bp, Homo sapiens
atttctaaatcctcacta

SEQ ID NO: 4303926 - DNA, 16 bp, Homo sapiens
atttctaagcttattt

SEQ ID NO: 4303927 - DNA, 18 bp, Homo sapiens
atttctaagcttatttct

SEQ ID NO: 4303928 - DNA, 22 bp, Homo sapiens
atttctaagcttatttctaact

SEQ ID NO: 4303929 - DNA, 15 bp, Homo sapiens
atttctatctgcaaa

SEQ ID NO: 4303930 - DNA, 22 bp, Homo sapiens
atttctcaaagtttttacagtg

SEQ ID NO: 4303931 - DNA, 17 bp, Homo sapiens
atttctgccatttcatg

SEQ ID NO: 4303932 - DNA, 20 bp, Homo sapiens
atttcttactaaacattttg

SEQ ID NO: 4303933 - DNA, 21 bp, Homo sapiens
atttcttccagtgatgttgaa

SEQ ID NO: 4303934 - DNA, 17 bp, Homo sapiens
atttcttgggccctcct

SEQ ID NO: 4303935 - DNA, 14 bp, Homo sapiens
atttctttgattgt

SEQ ID NO: 4303936 - DNA, 15 bp, Homo sapiens
atttctttgattgtg

SEQ ID NO: 4303937 - DNA, 17 bp, Homo sapiens
atttgaagacttcaaaa

SEQ ID NO: 4303938 - DNA, 15 bp, Homo sapiens
atttgactgttattt

SEQ ID NO: 4303939 - DNA, 13 bp, Homo sapiens
atttgcaaatgca

SEQ ID NO: 4303940 - DNA, 19 bp, Homo sapiens
atttgcaactttagaaaga

SEQ ID NO: 4303941 - DNA, 21 bp, Homo sapiens
atttgcagaccaggaaggaag

SEQ ID NO: 4303942 - DNA, 13 bp, Homo sapiens
atttgcttattta

SEQ ID NO: 4303943 - DNA, 17 bp, Homo sapiens
atttgggctgaatgtat

SEQ ID NO: 4303944 - DNA, 15 bp, Homo sapiens
atttgtaatgtatct

SEQ ID NO: 4303945 - DNA, 16 bp, Homo sapiens
atttgtaatgtatctt

SEQ ID NO: 4303946 - DNA, 18 bp, Homo sapiens
atttgtagctagaatatc

SEQ ID NO: 4303947 - DNA, 18 bp, Homo sapiens
atttgtgtagattgtgta

SEQ ID NO: 4303948 - DNA, 17 bp, Homo sapiens
atttgttaatatatata

SEQ ID NO: 4303949 - DNA, 22 bp, Homo sapiens
attttaaatgctgtatgtcatt

SEQ ID NO: 4303950 - DNA, 18 bp, Homo sapiens
attttactttgtgcaata

SEQ ID NO: 4303951 - DNA, 17 bp, Homo sapiens
attttagccttctctgt

SEQ ID NO: 4303952 - DNA, 21 bp, Homo sapiens
attttagccttctctgttcat

SEQ ID NO: 4303953 - DNA, 16 bp, Homo sapiens
attttagctaatttag

SEQ ID NO: 4303954 - DNA, 13 bp, Homo sapiens
attttatgtgctt

SEQ ID NO: 4303955 - DNA, 17 bp, Homo sapiens
attttatttcaatgtaa

SEQ ID NO: 4303956 - DNA, 19 bp, Homo sapiens
attttatttcaatgtaatt

SEQ ID NO: 4303957 - DNA, 15 bp, Homo sapiens
attttattttcaagc

SEQ ID NO: 4303958 - DNA, 19 bp, Homo sapiens
attttattttcaagcaaat

SEQ ID NO: 4303959 - DNA, 12 bp, Homo sapiens
attttcctcccc

SEQ ID NO: 4303960 - DNA, 14 bp, Homo sapiens
attttcgtgcattt

SEQ ID NO: 4303961 - DNA, 18 bp, Homo sapiens
attttcgtgcatttgtga

SEQ ID NO: 4303962 - DNA, 14 bp, Homo sapiens
attttctaaactgt

SEQ ID NO: 4303963 - DNA, 16 bp, Homo sapiens
attttctaaactgttt

SEQ ID NO: 4303964 - DNA, 19 bp, Homo sapiens
attttctgaattcataaaa

SEQ ID NO: 4303965 - DNA, 16 bp, Homo sapiens
attttctgcatctcca

SEQ ID NO: 4303966 - DNA, 19 bp, Homo sapiens
attttctgtgttgttcata

SEQ ID NO: 4303967 - DNA, 18 bp, Homo sapiens
attttcttcccatttgta

SEQ ID NO: 4303968 - DNA, 16 bp, Homo sapiens
attttctttctatgta

SEQ ID NO: 4303969 - DNA, 22 bp, Homo sapiens
attttctttctatgtagaactg

SEQ ID NO: 4303970 - DNA, 13 bp, Homo sapiens
attttcttttata

SEQ ID NO: 4303971 - DNA, 17 bp, Homo sapiens
attttcttttatatctg

SEQ ID NO: 4303972 - DNA, 16 bp, Homo sapiens
attttgacactgaaat

SEQ ID NO: 4303973 - DNA, 12 bp, Homo sapiens
attttgtaaaat

SEQ ID NO: 4303974 - DNA, 19 bp, Homo sapiens
attttgtaaaatgtattat

SEQ ID NO: 4303975 - DNA, 21 bp, Homo sapiens
attttgtaaaatgtattatgt

SEQ ID NO: 4303976 - DNA, 23 bp, Homo sapiens
attttgtagtagttgatgaccaa

SEQ ID NO: 4303977 - DNA, 15 bp, Homo sapiens
attttgtctggctgt

SEQ ID NO: 4303978 - DNA, 17 bp, Homo sapiens
attttgtctggctgtgg

SEQ ID NO: 4303979 - DNA, 20 bp, Homo sapiens
atttttatcagttacacatg

SEQ ID NO: 4303980 - DNA, 19 bp, Homo sapiens
atttttatcccatctcact

SEQ ID NO: 4303981 - DNA, 12 bp, Homo sapiens
atttttcaatag

SEQ ID NO: 4303982 - DNA, 18 bp, Homo sapiens
atttttctactgctcttt

SEQ ID NO: 4303983 - DNA, 12 bp, Homo sapiens
atttttcttgga

SEQ ID NO: 4303984 - DNA, 23 bp, Homo sapiens
atttttggaagaggactccttaa

SEQ ID NO: 4303985 - DNA, 22 bp, Homo sapiens
atttttgttggagccactctgt

SEQ ID NO: 4303986 - DNA, 23 bp, Homo sapiens
attttttactacataattaaatt

SEQ ID NO: 4303987 - DNA, 15 bp, Homo sapiens
atttttttaacttta

SEQ ID NO: 4303988 - DNA, 22 bp, Homo sapiens
atttttttctagctataacaac

SEQ ID NO: 4303989 - DNA, 17 bp, Homo sapiens
caaaaacaataaacgaa

SEQ ID NO: 4303990 - DNA, 15 bp, Homo sapiens
caaaaatcatcaaag

SEQ ID NO: 4303991 - DNA, 17 bp, Homo sapiens
caaaacaaattcaagaa

SEQ ID NO: 4303992 - DNA, 18 bp, Homo sapiens
caaaactccactcagcac

SEQ ID NO: 4303993 - DNA, 11 bp, Homo sapiens
caaaagtgtca

SEQ ID NO: 4303994 - DNA, 16 bp, Homo sapiens
caaaatagttctattt

SEQ ID NO: 4303995 - DNA, 20 bp, Homo sapiens
caaaatagttctatttctat

SEQ ID NO: 4303996 - DNA, 24 bp, Homo sapiens
caaaatagttctatttctatctgc

SEQ ID NO: 4303997 - DNA, 14 bp, Homo sapiens
caaaatatttctaa

SEQ ID NO: 4303998 - DNA, 23 bp, Homo sapiens
caaacagaaacgagatttgccaa

SEQ ID NO: 4303999 - DNA, 22 bp, Homo sapiens
caaacatgccctcaggcttggg

SEQ ID NO: 4304000 - DNA, 21 bp, Homo sapiens
caaactgtagtaattgttaca

SEQ ID NO: 4304001 - DNA, 22 bp, Homo sapiens
caaactgtagtaattgttacaa

SEQ ID NO: 4304002 - DNA, 14 bp, Homo sapiens
caaacttactgtca

SEQ ID NO: 4304003 - DNA, 15 bp, Homo sapiens
caaagaacccccctc

SEQ ID NO: 4304004 - DNA, 19 bp, Homo sapiens
caaagaacccccctcccca

SEQ ID NO: 4304005 - DNA, 16 bp, Homo sapiens
caaagaatcaacagtg

SEQ ID NO: 4304006 - DNA, 14 bp, Homo sapiens
caaagagaaaacat

SEQ ID NO: 4304007 - DNA, 18 bp, Homo sapiens
caaagaggcattcagcaa

SEQ ID NO: 4304008 - DNA, 17 bp, Homo sapiens
caaagatatctcatctc

SEQ ID NO: 4304009 - DNA, 15 bp, Homo sapiens
caaagcaagcacctg

SEQ ID NO: 4304010 - DNA, 16 bp, Homo sapiens
caaagcaagcacctgg

SEQ ID NO: 4304011 - DNA, 16 bp, Homo sapiens
caaagtaccaactgag

SEQ ID NO: 4304012 - DNA, 19 bp, Homo sapiens
caaagtaccaactgagcca

SEQ ID NO: 4304013 - DNA, 21 bp, Homo sapiens
caaagtaccaactgagccaaa

SEQ ID NO: 4304014 - DNA, 21 bp, Homo sapiens
caaagtgtttaattgtataaa

SEQ ID NO: 4304015 - DNA, 21 bp, Homo sapiens
caaagttaaacgtgatgtgct

SEQ ID NO: 4304016 - DNA, 13 bp, Homo sapiens
caaagttatccag

SEQ ID NO: 4304017 - DNA, 19 bp, Homo sapiens
caaagtttttacagtgtat

SEQ ID NO: 4304018 - DNA, 21 bp, Homo sapiens
caaagtttttacagtgtatct

SEQ ID NO: 4304019 - DNA, 14 bp, Homo sapiens
caaataagtaatat

SEQ ID NO: 4304020 - DNA, 15 bp, Homo sapiens
caaatacattccagt

SEQ ID NO: 4304021 - DNA, 14 bp, Homo sapiens
caaataccagagca

SEQ ID NO: 4304022 - DNA, 22 bp, Homo sapiens
caaataccagagcacagattca

SEQ ID NO: 4304023 - DNA, 16 bp, Homo sapiens
caaatatctctattta

SEQ ID NO: 4304024 - DNA, 17 bp, Homo sapiens
caaatatgattctcctc

SEQ ID NO: 4304025 - DNA, 20 bp, Homo sapiens
caaatattagccaaagaggc

SEQ ID NO: 4304026 - DNA, 21 bp, Homo sapiens
caaatatttatgacctcaaca

SEQ ID NO: 4304027 - DNA, 19 bp, Homo sapiens
caaatccataccccctgcc

SEQ ID NO: 4304028 - DNA, 20 bp, Homo sapiens
caaatccataccccctgccc

SEQ ID NO: 4304029 - DNA, 22 bp, Homo sapiens
caaatcctgggcatccccagcc

SEQ ID NO: 4304030 - DNA, 13 bp, Homo sapiens
caaatctgagcct

SEQ ID NO: 4304031 - DNA, 23 bp, Homo sapiens
caaatgagtttaaaaaaataaca

SEQ ID NO: 4304032 - DNA, 18 bp, Homo sapiens
caaatgcacatttgtcac

SEQ ID NO: 4304033 - DNA, 10 bp, Homo sapiens
caaatgcatg

SEQ ID NO: 4304034 - DNA, 22 bp, Homo sapiens
caaatgcatgatattgtatgta

SEQ ID NO: 4304035 - DNA, 15 bp, Homo sapiens
caaatgctactcagt

SEQ ID NO: 4304036 - DNA, 17 bp, Homo sapiens
caaatgtacccagccta

SEQ ID NO: 4304037 - DNA, 12 bp, Homo sapiens
caaatgtccaag

SEQ ID NO: 4304038 - DNA, 23 bp, Homo sapiens
caaatgtccaagcatcagcaaga

SEQ ID NO: 4304039 - DNA, 14 bp, Homo sapiens
caaatgtcctcaga

SEQ ID NO: 4304040 - DNA, 15 bp, Homo sapiens
caaatgtcctcagag

SEQ ID NO: 4304041 - DNA, 19 bp, Homo sapiens
caaattaacctttcaggaa

SEQ ID NO: 4304042 - DNA, 15 bp, Homo sapiens
caaattattctagtc

SEQ ID NO: 4304043 - DNA, 23 bp, Homo sapiens
caaattcattcccttctctcagc

SEQ ID NO: 4304044 - DNA, 16 bp, Homo sapiens
caaattgcagaagaaa

SEQ ID NO: 4304045 - DNA, 14 bp, Homo sapiens
caaatttatttcca

SEQ ID NO: 4304046 - DNA, 21 bp, Homo sapiens
caacaaagaagaaccatcttt

SEQ ID NO: 4304047 - DNA, 18 bp, Homo sapiens
caacaactccaggaaaac

SEQ ID NO: 4304048 - DNA, 19 bp, Homo sapiens
caacaactccaggaaaact

SEQ ID NO: 4304049 - DNA, 18 bp, Homo sapiens
caacaagaagaatttgaa

SEQ ID NO: 4304050 - DNA, 18 bp, Homo sapiens
caacactgccagaagtgt

SEQ ID NO: 4304051 - DNA, 16 bp, Homo sapiens
caacacttattttctg

SEQ ID NO: 4304052 - DNA, 17 bp, Homo sapiens
caacaggaccaggagcc

SEQ ID NO: 4304053 - DNA, 16 bp, Homo sapiens
caacagggcttctctt

SEQ ID NO: 4304054 - DNA, 15 bp, Homo sapiens
caacattatcctgtg

SEQ ID NO: 4304055 - DNA, 16 bp, Homo sapiens
caacattatcctgtgt

SEQ ID NO: 4304056 - DNA, 18 bp, Homo sapiens
caacattatcctgtgtga

SEQ ID NO: 4304057 - DNA, 24 bp, Homo sapiens
caacattatcctgtgtgattacag

SEQ ID NO: 4304058 - DNA, 14 bp, Homo sapiens
caacatttccgaag

SEQ ID NO: 4304059 - DNA, 23 bp, Homo sapiens
caacatttcctcaggcaattcct

SEQ ID NO: 4304060 - DNA, 14 bp, Homo sapiens
caaccatagaactg

SEQ ID NO: 4304061 - DNA, 14 bp, Homo sapiens
caaccattccccat

SEQ ID NO: 4304062 - DNA, 16 bp, Homo sapiens
caacccaggtgttgtc

SEQ ID NO: 4304063 - DNA, 19 bp, Homo sapiens
caacccatgcatggcctcc

SEQ ID NO: 4304064 - DNA, 18 bp, Homo sapiens
caaccccagcagtcctgg

SEQ ID NO: 4304065 - DNA, 13 bp, Homo sapiens
caaccccctcgga

SEQ ID NO: 4304066 - DNA, 19 bp, Homo sapiens
caaccccctcggagcctgt

SEQ ID NO: 4304067 - DNA, 17 bp, Homo sapiens
caaccccggggcatgga

SEQ ID NO: 4304068 - DNA, 18 bp, Homo sapiens
caaccctcagagccaccc

SEQ ID NO: 4304069 - DNA, 21 bp, Homo sapiens
caaccctcagagccaccccta

SEQ ID NO: 4304070 - DNA, 14 bp, Homo sapiens
caaccctccctcag

SEQ ID NO: 4304071 - DNA, 18 bp, Homo sapiens
caaccctccctcagcccc

SEQ ID NO: 4304072 - DNA, 19 bp, Homo sapiens
caaccctcctatcacctcc

SEQ ID NO: 4304073 - DNA, 22 bp, Homo sapiens
caaccctcctatcacctcccct

SEQ ID NO: 4304074 - DNA, 11 bp, Homo sapiens
caaccctgcaa

SEQ ID NO: 4304075 - DNA, 12 bp, Homo sapiens
caaccctgcaaa

SEQ ID NO: 4304076 - DNA, 16 bp, Homo sapiens
caaccctgcccctgcc

SEQ ID NO: 4304077 - DNA, 23 bp, Homo sapiens
caaccctgcccctgccccgtcac

SEQ ID NO: 4304078 - DNA, 21 bp, Homo sapiens
caaccgatgctccagccaacc

SEQ ID NO: 4304079 - DNA, 18 bp, Homo sapiens
caacctacagtggaggga

SEQ ID NO: 4304080 - DNA, 20 bp, Homo sapiens
caacctacagtggagggaga

SEQ ID NO: 4304081 - DNA, 14 bp, Homo sapiens
caacctcactgccc

SEQ ID NO: 4304082 - DNA, 21 bp, Homo sapiens
caacctcccctggtcctgcac

SEQ ID NO: 4304083 - DNA, 13 bp, Homo sapiens
caaccttcattta

SEQ ID NO: 4304084 - DNA, 19 bp, Homo sapiens
caaccttctgtggctcaca

SEQ ID NO: 4304085 - DNA, 13 bp, Homo sapiens
caacgaaaagcac

SEQ ID NO: 4304086 - DNA, 22 bp, Homo sapiens
caacgaaaagcacatccaggca

SEQ ID NO: 4304087 - DNA, 14 bp, Homo sapiens
caacgggtctgtgg

SEQ ID NO: 4304088 - DNA, 12 bp, Homo sapiens
caactccaaggc

SEQ ID NO: 4304089 - DNA, 14 bp, Homo sapiens
caactccaaggcaa

SEQ ID NO: 4304090 - DNA, 13 bp, Homo sapiens
caactctctctgc

SEQ ID NO: 4304091 - DNA, 15 bp, Homo sapiens
caactctctctgccc

SEQ ID NO: 4304092 - DNA, 16 bp, Homo sapiens
caactctctctgcccc

SEQ ID NO: 4304093 - DNA, 13 bp, Homo sapiens
caactctgactgt

SEQ ID NO: 4304094 - DNA, 15 bp, Homo sapiens
caactctggccttgg

SEQ ID NO: 4304095 - DNA, 22 bp, Homo sapiens
caactgagccaaaaacaataaa

SEQ ID NO: 4304096 - DNA, 14 bp, Homo sapiens
caactgctgtttta

SEQ ID NO: 4304097 - DNA, 17 bp, Homo sapiens
caactgtttttgaagaa

SEQ ID NO: 4304098 - DNA, 24 bp, Homo sapiens
caacttgaaattatatctgtggtc

SEQ ID NO: 4304099 - DNA, 17 bp, Homo sapiens
caacttttctgctacct

SEQ ID NO: 4304100 - DNA, 18 bp, Homo sapiens
caacttttctgctacctg

SEQ ID NO: 4304101 - DNA, 13 bp, Homo sapiens
caagaagaatata

SEQ ID NO: 4304102 - DNA, 16 bp, Homo sapiens
caagagagacaaaatt

SEQ ID NO: 4304103 - DNA, 18 bp, Homo sapiens
caagagctcaggagaagg

SEQ ID NO: 4304104 - DNA, 17 bp, Homo sapiens
caagaggagcaggaagc

SEQ ID NO: 4304105 - DNA, 19 bp, Homo sapiens
caagagggcactggtggcc

SEQ ID NO: 4304106 - DNA, 18 bp, Homo sapiens
caagatgaaattccattt

SEQ ID NO: 4304107 - DNA, 17 bp, Homo sapiens
caagattctgtgggcag

SEQ ID NO: 4304108 - DNA, 15 bp, Homo sapiens
caagcacctgggtgt

SEQ ID NO: 4304109 - DNA, 16 bp, Homo sapiens
caagcatcagcaagac

SEQ ID NO: 4304110 - DNA, 14 bp, Homo sapiens
caagcattctgtct

SEQ ID NO: 4304111 - DNA, 19 bp, Homo sapiens
caagccaaacattcttatt

SEQ ID NO: 4304112 - DNA, 19 bp, Homo sapiens
caagccaggagaccctgtc

SEQ ID NO: 4304113 - DNA, 18 bp, Homo sapiens
caagccagggttccagac

SEQ ID NO: 4304114 - DNA, 17 bp, Homo sapiens
caagcccaggacactgc

SEQ ID NO: 4304115 - DNA, 18 bp, Homo sapiens
caagcccaggacactgcc

SEQ ID NO: 4304116 - DNA, 15 bp, Homo sapiens
caagccccaggcagg

SEQ ID NO: 4304117 - DNA, 14 bp, Homo sapiens
caagccgtggcttc

SEQ ID NO: 4304118 - DNA, 15 bp, Homo sapiens
caagccgtggcttcc

SEQ ID NO: 4304119 - DNA, 14 bp, Homo sapiens
caagcctgccccgg

SEQ ID NO: 4304120 - DNA, 21 bp, Homo sapiens
caagcctgccccggccactct

SEQ ID NO: 4304121 - DNA, 24 bp, Homo sapiens
caagcctggcccagtgagagtgag

SEQ ID NO: 4304122 - DNA, 18 bp, Homo sapiens
caagcctgggccactggc

SEQ ID NO: 4304123 - DNA, 20 bp, Homo sapiens
caagcctgggccactggcat

SEQ ID NO: 4304124 - DNA, 16 bp, Homo sapiens
caagctcaccctgctc

SEQ ID NO: 4304125 - DNA, 14 bp, Homo sapiens
caagctgcatctag

SEQ ID NO: 4304126 - DNA, 14 bp, Homo sapiens
caagctggcaggag

SEQ ID NO: 4304127 - DNA, 16 bp, Homo sapiens
caagctggccgtggag

SEQ ID NO: 4304128 - DNA, 17 bp, Homo sapiens
caaggacccctcacctt

SEQ ID NO: 4304129 - DNA, 14 bp, Homo sapiens
caaggactgccgac

SEQ ID NO: 4304130 - DNA, 13 bp, Homo sapiens
caaggcaaatgtc

SEQ ID NO: 4304131 - DNA, 17 bp, Homo sapiens
caaggcaaatgtccaag

SEQ ID NO: 4304132 - DNA, 14 bp, Homo sapiens
caaggcaagaagtg

SEQ ID NO: 4304133 - DNA, 13 bp, Homo sapiens
caaggcctatgcc

SEQ ID NO: 4304134 - DNA, 16 bp, Homo sapiens
caaggcctatgccacc

SEQ ID NO: 4304135 - DNA, 14 bp, Homo sapiens
caaggctgcctgcc

SEQ ID NO: 4304136 - DNA, 13 bp, Homo sapiens
caagggaagagat

SEQ ID NO: 4304137 - DNA, 12 bp, Homo sapiens
caagggaatgaa

SEQ ID NO: 4304138 - DNA, 13 bp, Homo sapiens
caagggcccagag

SEQ ID NO: 4304139 - DNA, 19 bp, Homo sapiens
caagggtatctgctgcctc

SEQ ID NO: 4304140 - DNA, 16 bp, Homo sapiens
caagggtggcatccca

SEQ ID NO: 4304141 - DNA, 17 bp, Homo sapiens
caaggtgtttctctgta

SEQ ID NO: 4304142 - DNA, 18 bp, Homo sapiens
caagtatatttatttcta

SEQ ID NO: 4304143 - DNA, 20 bp, Homo sapiens
caagtcagctttgccttcca

SEQ ID NO: 4304144 - DNA, 21 bp, Homo sapiens
caagtcccagggagctctgca

SEQ ID NO: 4304145 - DNA, 14 bp, Homo sapiens
caagtcccgaggca

SEQ ID NO: 4304146 - DNA, 15 bp, Homo sapiens
caagtcccgaggcag

SEQ ID NO: 4304147 - DNA, 11 bp, Homo sapiens
caagtctgtga

SEQ ID NO: 4304148 - DNA, 20 bp, Homo sapiens
caagtgaatgagtttccagc

SEQ ID NO: 4304149 - DNA, 15 bp, Homo sapiens
caagtgattgaaaat

SEQ ID NO: 4304150 - DNA, 18 bp, Homo sapiens
caagtgcatttctgggcc

SEQ ID NO: 4304151 - DNA, 19 bp, Homo sapiens
caagtgcatttctgggcct

SEQ ID NO: 4304152 - DNA, 17 bp, Homo sapiens
caagtggacgtgggctc

SEQ ID NO: 4304153 - DNA, 12 bp, Homo sapiens
caagtgtcctgc

SEQ ID NO: 4304154 - DNA, 23 bp, Homo sapiens
caagtgtgcctgctatccagccg

SEQ ID NO: 4304155 - DNA, 19 bp, Homo sapiens
caagttaatgtactttcat

SEQ ID NO: 4304156 - DNA, 21 bp, Homo sapiens
caataaacgaaacacagaact

SEQ ID NO: 4304157 - DNA, 13 bp, Homo sapiens
caataaagcaatg

SEQ ID NO: 4304158 - DNA, 17 bp, Homo sapiens
caataattgtggagagg

SEQ ID NO: 4304159 - DNA, 19 bp, Homo sapiens
caataattgtggagaggag

SEQ ID NO: 4304160 - DNA, 23 bp, Homo sapiens
caataattgtggagaggagagaa

SEQ ID NO: 4304161 - DNA, 13 bp, Homo sapiens
caataattttcta

SEQ ID NO: 4304162 - DNA, 14 bp, Homo sapiens
caataattttctac

SEQ ID NO: 4304163 - DNA, 17 bp, Homo sapiens
caatacttttgtgtatt

SEQ ID NO: 4304164 - DNA, 20 bp, Homo sapiens
caatacttttgtgtattctg

SEQ ID NO: 4304165 - DNA, 21 bp, Homo sapiens
caatacttttgtgtattctgt

SEQ ID NO: 4304166 - DNA, 16 bp, Homo sapiens
caatagcgtgtgtaga

SEQ ID NO: 4304167 - DNA, 21 bp, Homo sapiens
caatatcattttcctgggagt

SEQ ID NO: 4304168 - DNA, 20 bp, Homo sapiens
caatatgaggggactgcatg

SEQ ID NO: 4304169 - DNA, 21 bp, Homo sapiens
caatatgaggggactgcatgc

SEQ ID NO: 4304170 - DNA, 19 bp, Homo sapiens
caatcaacagcatgtctac

SEQ ID NO: 4304171 - DNA, 20 bp, Homo sapiens
caatcacgagatcttccttc

SEQ ID NO: 4304172 - DNA, 22 bp, Homo sapiens
caatcacgagatcttccttccg

SEQ ID NO: 4304173 - DNA, 23 bp, Homo sapiens
caatcacgagatcttccttccgc

SEQ ID NO: 4304174 - DNA, 20 bp, Homo sapiens
caatccaacccatgcatggc

SEQ ID NO: 4304175 - DNA, 19 bp, Homo sapiens
caatccatgtatctgtatg

SEQ ID NO: 4304176 - DNA, 16 bp, Homo sapiens
caatcccaccaaccct

SEQ ID NO: 4304177 - DNA, 17 bp, Homo sapiens
caatcccaccaaccctc

SEQ ID NO: 4304178 - DNA, 20 bp, Homo sapiens
caatctctgtgactcgctta

SEQ ID NO: 4304179 - DNA, 19 bp, Homo sapiens
caatctgcaagtcccaggg

SEQ ID NO: 4304180 - DNA, 20 bp, Homo sapiens
caatctgcaagtcccaggga

SEQ ID NO: 4304181 - DNA, 20 bp, Homo sapiens
caatgaaatatttgcttatt

SEQ ID NO: 4304182 - DNA, 20 bp, Homo sapiens
caatgaagcaaacacacaga

SEQ ID NO: 4304183 - DNA, 23 bp, Homo sapiens
caatgcctattgtaatatagaaa

SEQ ID NO: 4304184 - DNA, 14 bp, Homo sapiens
caatgcctgcctga

SEQ ID NO: 4304185 - DNA, 20 bp, Homo sapiens
caatgctcttttcacagcta

SEQ ID NO: 4304186 - DNA, 20 bp, Homo sapiens
caatggagactgtctcaaga

SEQ ID NO: 4304187 - DNA, 19 bp, Homo sapiens
caatggcgcagtgcctctg

SEQ ID NO: 4304188 - DNA, 20 bp, Homo sapiens
caatggcgcagtgcctctgg

SEQ ID NO: 4304189 - DNA, 17 bp, Homo sapiens
caatggctattaacaat

SEQ ID NO: 4304190 - DNA, 22 bp, Homo sapiens
caatggctgggtttgggcagtg

SEQ ID NO: 4304191 - DNA, 22 bp, Homo sapiens
caatgtatgtgaaagtgtaaaa

SEQ ID NO: 4304192 - DNA, 16 bp, Homo sapiens
caatgtgcccagtcat

SEQ ID NO: 4304193 - DNA, 14 bp, Homo sapiens
caattaattgtctt

SEQ ID NO: 4304194 - DNA, 12 bp, Homo sapiens
caattctgtccc

SEQ ID NO: 4304195 - DNA, 21 bp, Homo sapiens
caattctgtccctgtccctgc

SEQ ID NO: 4304196 - DNA, 18 bp, Homo sapiens
caattggaagtctaagaa

SEQ ID NO: 4304197 - DNA, 17 bp, Homo sapiens
caatttcaaaatgcatg

SEQ ID NO: 4304198 - DNA, 20 bp, Homo sapiens
caatttcaaaatgcatgtga

SEQ ID NO: 4304199 - DNA, 19 bp, Homo sapiens
caattttaaaaaataacat

SEQ ID NO: 4304200 - DNA, 22 bp, Homo sapiens
caattttaaaaaataacatatt

SEQ ID NO: 4304201 - DNA, 14 bp, Homo sapiens
cacaaaatatttct

SEQ ID NO: 4304202 - DNA, 20 bp, Homo sapiens
cacaaagtgagaaattatga

SEQ ID NO: 4304203 - DNA, 16 bp, Homo sapiens
cacaaataccagagca

SEQ ID NO: 4304204 - DNA, 18 bp, Homo sapiens
cacaactgtttttgaaga

SEQ ID NO: 4304205 - DNA, 14 bp, Homo sapiens
cacaagaagtggga

SEQ ID NO: 4304206 - DNA, 17 bp, Homo sapiens
cacaagaagtgggagtg

SEQ ID NO: 4304207 - DNA, 22 bp, Homo sapiens
cacaagcagagtgcacagctgt

SEQ ID NO: 4304208 - DNA, 15 bp, Homo sapiens
cacaattctgtccct

SEQ ID NO: 4304209 - DNA, 23 bp, Homo sapiens
cacaattctgtccctgtccctgc

SEQ ID NO: 4304210 - DNA, 15 bp, Homo sapiens
cacacacacacacgc

SEQ ID NO: 4304211 - DNA, 13 bp, Homo sapiens
cacacacacacag

SEQ ID NO: 4304212 - DNA, 16 bp, Homo sapiens
cacacacacccttccc

SEQ ID NO: 4304213 - DNA, 18 bp, Homo sapiens
cacacaggcctggcccag

SEQ ID NO: 4304214 - DNA, 12 bp, Homo sapiens
cacaccagccct

SEQ ID NO: 4304215 - DNA, 13 bp, Homo sapiens
cacaccagccctg

SEQ ID NO: 4304216 - DNA, 16 bp, Homo sapiens
cacaccagccctggtg

SEQ ID NO: 4304217 - DNA, 13 bp, Homo sapiens
cacacccttcccc

SEQ ID NO: 4304218 - DNA, 17 bp, Homo sapiens
cacacccttccccactc

SEQ ID NO: 4304219 - DNA, 17 bp, Homo sapiens
cacaccgtccctctccc

SEQ ID NO: 4304220 - DNA, 20 bp, Homo sapiens
cacaccgtccctctccccgg

SEQ ID NO: 4304221 - DNA, 21 bp, Homo sapiens
cacaccgtccctctccccgga

SEQ ID NO: 4304222 - DNA, 15 bp, Homo sapiens
cacacctccacccgt

SEQ ID NO: 4304223 - DNA, 15 bp, Homo sapiens
cacacctgcctctga

SEQ ID NO: 4304224 - DNA, 18 bp, Homo sapiens
cacacctgcctctgaact

SEQ ID NO: 4304225 - DNA, 15 bp, Homo sapiens
cacacgcacacacac

SEQ ID NO: 4304226 - DNA, 16 bp, Homo sapiens
cacacgcacacacaca

SEQ ID NO: 4304227 - DNA, 23 bp, Homo sapiens
cacacgcacacacacacacagga

SEQ ID NO: 4304228 - DNA, 22 bp, Homo sapiens
cacactacgcagaagagaaagt

SEQ ID NO: 4304229 - DNA, 23 bp, Homo sapiens
cacactgctaggtgggccagccc

SEQ ID NO: 4304230 - DNA, 17 bp, Homo sapiens
cacacttcaggctcttc

SEQ ID NO: 4304231 - DNA, 22 bp, Homo sapiens
cacacttccacccccagctcct

SEQ ID NO: 4304232 - DNA, 16 bp, Homo sapiens
cacacttcctgtccag

SEQ ID NO: 4304233 - DNA, 20 bp, Homo sapiens
cacacttcctgtccagagag

SEQ ID NO: 4304234 - DNA, 18 bp, Homo sapiens
cacagaactcagccttaa

SEQ ID NO: 4304235 - DNA, 20 bp, Homo sapiens
cacagaagacacgtgttttt

SEQ ID NO: 4304236 - DNA, 19 bp, Homo sapiens
cacagaggacggcttcccc

SEQ ID NO: 4304237 - DNA, 19 bp, Homo sapiens
cacagaggatggcttcccc

SEQ ID NO: 4304238 - DNA, 11 bp, Homo sapiens
cacagaggcag

SEQ ID NO: 4304239 - DNA, 17 bp, Homo sapiens
cacagaggcagtggcag

SEQ ID NO: 4304240 - DNA, 18 bp, Homo sapiens
cacagaggcagtggcagc

SEQ ID NO: 4304241 - DNA, 19 bp, Homo sapiens
cacagaggcagtggcagca

SEQ ID NO: 4304242 - DNA, 14 bp, Homo sapiens
cacagcatctcagc

SEQ ID NO: 4304243 - DNA, 16 bp, Homo sapiens
cacagcatctcagctc

SEQ ID NO: 4304244 - DNA, 15 bp, Homo sapiens
cacagccaccacctg

SEQ ID NO: 4304245 - DNA, 19 bp, Homo sapiens
cacagccaccacctggatg

SEQ ID NO: 4304246 - DNA, 14 bp, Homo sapiens
cacagccctgtcag

SEQ ID NO: 4304247 - DNA, 15 bp, Homo sapiens
cacagcctcacccct

SEQ ID NO: 4304248 - DNA, 22 bp, Homo sapiens
cacagcctcacccctgcaggcg

SEQ ID NO: 4304249 - DNA, 17 bp, Homo sapiens
cacagctgttcttctgt

SEQ ID NO: 4304250 - DNA, 22 bp, Homo sapiens
cacaggaggagaaatctcactt

SEQ ID NO: 4304251 - DNA, 15 bp, Homo sapiens
cacaggcccttcctc

SEQ ID NO: 4304252 - DNA, 16 bp, Homo sapiens
cacaggcccttcctct

SEQ ID NO: 4304253 - DNA, 19 bp, Homo sapiens
cacaggcccttcctctcca

SEQ ID NO: 4304254 - DNA, 12 bp, Homo sapiens
cacaggcctggc

SEQ ID NO: 4304255 - DNA, 14 bp, Homo sapiens
cacaggcctggccc

SEQ ID NO: 4304256 - DNA, 20 bp, Homo sapiens
cacaggcctggcccagccag

SEQ ID NO: 4304257 - DNA, 14 bp, Homo sapiens
cacaggctgcccca

SEQ ID NO: 4304258 - DNA, 23 bp, Homo sapiens
cacagtttgcaatcttatgttga

SEQ ID NO: 4304259 - DNA, 20 bp, Homo sapiens
cacataaatctgtctgattc

SEQ ID NO: 4304260 - DNA, 22 bp, Homo sapiens
cacataaatctgtctgattcta

SEQ ID NO: 4304261 - DNA, 22 bp, Homo sapiens
cacatcatgtaatagtggcttt

SEQ ID NO: 4304262 - DNA, 20 bp, Homo sapiens
cacatccaacatttcctcag

SEQ ID NO: 4304263 - DNA, 21 bp, Homo sapiens
cacatccaggcaatggcctaa

SEQ ID NO: 4304264 - DNA, 14 bp, Homo sapiens
cacatgagtcccag

SEQ ID NO: 4304265 - DNA, 17 bp, Homo sapiens
cacatgagtcccagtgg

SEQ ID NO: 4304266 - DNA, 22 bp, Homo sapiens
cacatgcccttggtgacagctg

SEQ ID NO: 4304267 - DNA, 20 bp, Homo sapiens
cacattagagggacagccaa

SEQ ID NO: 4304268 - DNA, 15 bp, Homo sapiens
cacattatcttctgg

SEQ ID NO: 4304269 - DNA, 14 bp, Homo sapiens
cacattctgctgcc

SEQ ID NO: 4304270 - DNA, 18 bp, Homo sapiens
cacattctgctgccccca

SEQ ID NO: 4304271 - DNA, 21 bp, Homo sapiens
cacattctgctgcccccagac

SEQ ID NO: 4304272 - DNA, 13 bp, Homo sapiens
cacattctggctc

SEQ ID NO: 4304273 - DNA, 13 bp, Homo sapiens
cacattgcacaca

SEQ ID NO: 4304274 - DNA, 17 bp, Homo sapiens
cacattgcccacacctg

SEQ ID NO: 4304275 - DNA, 21 bp, Homo sapiens
cacattgcccacacctgcctc

SEQ ID NO: 4304276 - DNA, 17 bp, Homo sapiens
cacattgccctgagggg

SEQ ID NO: 4304277 - DNA, 19 bp, Homo sapiens
cacatttctggccatttaa

SEQ ID NO: 4304278 - DNA, 16 bp, Homo sapiens
caccaactctctctgc

SEQ ID NO: 4304279 - DNA, 13 bp, Homo sapiens
caccaccaacagg

SEQ ID NO: 4304280 - DNA, 21 bp, Homo sapiens
caccacctggatggatctgct

SEQ ID NO: 4304281 - DNA, 17 bp, Homo sapiens
caccagagcctccctca

SEQ ID NO: 4304282 - DNA, 14 bp, Homo sapiens
caccagatgagaat

SEQ ID NO: 4304283 - DNA, 12 bp, Homo sapiens
caccagcagcac

SEQ ID NO: 4304284 - DNA, 14 bp, Homo sapiens
caccagcctcagtg

SEQ ID NO: 4304285 - DNA, 19 bp, Homo sapiens
caccagctggctctgcagc

SEQ ID NO: 4304286 - DNA, 18 bp, Homo sapiens
caccaggaagaaggcccg

SEQ ID NO: 4304287 - DNA, 19 bp, Homo sapiens
caccaggaagaaggcccgg

SEQ ID NO: 4304288 - DNA, 23 bp, Homo sapiens
caccaggaagaaggcccgggagg

SEQ ID NO: 4304289 - DNA, 22 bp, Homo sapiens
caccatcccctcctagcacaag

SEQ ID NO: 4304290 - DNA, 13 bp, Homo sapiens
caccatctcaggc

SEQ ID NO: 4304291 - DNA, 21 bp, Homo sapiens
caccatctcaggccacctgcc

SEQ ID NO: 4304292 - DNA, 16 bp, Homo sapiens
caccatgtatgtggaa

SEQ ID NO: 4304293 - DNA, 13 bp, Homo sapiens
cacccaccctctg

SEQ ID NO: 4304294 - DNA, 17 bp, Homo sapiens
cacccagcacccatgcc

SEQ ID NO: 4304295 - DNA, 13 bp, Homo sapiens
cacccagccccag

SEQ ID NO: 4304296 - DNA, 18 bp, Homo sapiens
cacccagtggaaccaaaa

SEQ ID NO: 4304297 - DNA, 12 bp, Homo sapiens
cacccccctcat

SEQ ID NO: 4304298 - DNA, 13 bp, Homo sapiens
caccccctccctg

SEQ ID NO: 4304299 - DNA, 18 bp, Homo sapiens
caccccgcctctgggctc

SEQ ID NO: 4304300 - DNA, 22 bp, Homo sapiens
caccccgttgttgtccctgcag

SEQ ID NO: 4304301 - DNA, 14 bp, Homo sapiens
cacccctaaagaga

SEQ ID NO: 4304302 - DNA, 19 bp, Homo sapiens
cacccctcaagccaggaga

SEQ ID NO: 4304303 - DNA, 14 bp, Homo sapiens
cacccctcttccca

SEQ ID NO: 4304304 - DNA, 14 bp, Homo sapiens
cacccctgcacaca

SEQ ID NO: 4304305 - DNA, 18 bp, Homo sapiens
cacccctgcacacacctg

SEQ ID NO: 4304306 - DNA, 12 bp, Homo sapiens
cacccctggtgt

SEQ ID NO: 4304307 - DNA, 15 bp, Homo sapiens
caccccttccccact

SEQ ID NO: 4304308 - DNA, 15 bp, Homo sapiens
cacccggatctccag

SEQ ID NO: 4304309 - DNA, 18 bp, Homo sapiens
cacccgtgccacgcgctc

SEQ ID NO: 4304310 - DNA, 17 bp, Homo sapiens
cacccgtggagatggga

SEQ ID NO: 4304311 - DNA, 16 bp, Homo sapiens
cacccgtttccaagcc

SEQ ID NO: 4304312 - DNA, 17 bp, Homo sapiens
cacccgtttccaagcct

SEQ ID NO: 4304313 - DNA, 19 bp, Homo sapiens
cacccgtttccaagcctgg

SEQ ID NO: 4304314 - DNA, 22 bp, Homo sapiens
cacccgtttccaagcctgggcc

SEQ ID NO: 4304315 - DNA, 17 bp, Homo sapiens
caccctccccattagta

SEQ ID NO: 4304316 - DNA, 21 bp, Homo sapiens
caccctctctgtccaatctgc

SEQ ID NO: 4304317 - DNA, 14 bp, Homo sapiens
caccctgccatgga

SEQ ID NO: 4304318 - DNA, 15 bp, Homo sapiens
caccctggatttgca

SEQ ID NO: 4304319 - DNA, 21 bp, Homo sapiens
cacccttccccactcccgtga

SEQ ID NO: 4304320 - DNA, 21 bp, Homo sapiens
caccgctccccagcccagggt

SEQ ID NO: 4304321 - DNA, 13 bp, Homo sapiens
caccgggcctgga

SEQ ID NO: 4304322 - DNA, 16 bp, Homo sapiens
caccgtccctctcccc

SEQ ID NO: 4304323 - DNA, 18 bp, Homo sapiens
cacctagaatggaagcct

SEQ ID NO: 4304324 - DNA, 20 bp, Homo sapiens
cacctatgtcatttcatttc

SEQ ID NO: 4304325 - DNA, 13 bp, Homo sapiens
cacctcaggggag

SEQ ID NO: 4304326 - DNA, 17 bp, Homo sapiens
cacctccatttcttggt

SEQ ID NO: 4304327 - DNA, 13 bp, Homo sapiens
cacctctggccct

SEQ ID NO: 4304328 - DNA, 12 bp, Homo sapiens
cacctgcacacc

SEQ ID NO: 4304329 - DNA, 17 bp, Homo sapiens
cacctgcacacccctgc

SEQ ID NO: 4304330 - DNA, 20 bp, Homo sapiens
cacctgcacacccctgcaca

SEQ ID NO: 4304331 - DNA, 21 bp, Homo sapiens
cacctgcacacccctgcacac

SEQ ID NO: 4304332 - DNA, 18 bp, Homo sapiens
cacctgcagccccaggcc

SEQ ID NO: 4304333 - DNA, 20 bp, Homo sapiens
cacctgcagccccaggcctc

SEQ ID NO: 4304334 - DNA, 17 bp, Homo sapiens
cacctgcagcgtctgag

SEQ ID NO: 4304335 - DNA, 18 bp, Homo sapiens
cacctgcagcgtctgagc

SEQ ID NO: 4304336 - DNA, 17 bp, Homo sapiens
cacctgcagggagcagc

SEQ ID NO: 4304337 - DNA, 21 bp, Homo sapiens
cacctgcagggagcagcacgc

SEQ ID NO: 4304338 - DNA, 17 bp, Homo sapiens
cacctgcccccttctcc

SEQ ID NO: 4304339 - DNA, 23 bp, Homo sapiens
cacctgcccccttctcccacact

SEQ ID NO: 4304340 - DNA, 15 bp, Homo sapiens
cacctgcctctgaac

SEQ ID NO: 4304341 - DNA, 16 bp, Homo sapiens
cacctgcctctgaact

SEQ ID NO: 4304342 - DNA, 20 bp, Homo sapiens
cacctgcctctgaactgctg

SEQ ID NO: 4304343 - DNA, 20 bp, Homo sapiens
cacctgctggcccctcacct

SEQ ID NO: 4304344 - DNA, 22 bp, Homo sapiens
cacctgcttgtgttgggcccca

SEQ ID NO: 4304345 - DNA, 17 bp, Homo sapiens
cacctggcttcccagga

SEQ ID NO: 4304346 - DNA, 19 bp, Homo sapiens
cacctgggagatgctggga

SEQ ID NO: 4304347 - DNA, 19 bp, Homo sapiens
cacctgggcacctggggag

SEQ ID NO: 4304348 - DNA, 13 bp, Homo sapiens
cacctgggcccta

SEQ ID NO: 4304349 - DNA, 14 bp, Homo sapiens
cacctggggagtgg

SEQ ID NO: 4304350 - DNA, 15 bp, Homo sapiens
cacctggggagtggg

SEQ ID NO: 4304351 - DNA, 17 bp, Homo sapiens
cacctggggagtgggac

SEQ ID NO: 4304352 - DNA, 15 bp, Homo sapiens
cacctgggtgtgctc

SEQ ID NO: 4304353 - DNA, 21 bp, Homo sapiens
cacctgggtgtgctccaggct

SEQ ID NO: 4304354 - DNA, 17 bp, Homo sapiens
cacctggttatgagccg

SEQ ID NO: 4304355 - DNA, 14 bp, Homo sapiens
cacctgtcccagaa

SEQ ID NO: 4304356 - DNA, 21 bp, Homo sapiens
caccttaaaattagcatctgg

SEQ ID NO: 4304357 - DNA, 21 bp, Homo sapiens
caccttccctagttctttgca

SEQ ID NO: 4304358 - DNA, 21 bp, Homo sapiens
caccttcctgggcagcccaga

SEQ ID NO: 4304359 - DNA, 14 bp, Homo sapiens
cacctttccgtgcc

SEQ ID NO: 4304360 - DNA, 15 bp, Homo sapiens
cacgattcatttttg

SEQ ID NO: 4304361 - DNA, 15 bp, Homo sapiens
cacgcaacttgaaat

SEQ ID NO: 4304362 - DNA, 15 bp, Homo sapiens
cacgcaagcctcagc

SEQ ID NO: 4304363 - DNA, 14 bp, Homo sapiens
cacgcacacacaca

SEQ ID NO: 4304364 - DNA, 17 bp, Homo sapiens
cacgcccgactctctcc

SEQ ID NO: 4304365 - DNA, 20 bp, Homo sapiens
cacgccctcctccctccgct

SEQ ID NO: 4304366 - DNA, 17 bp, Homo sapiens
cacgcctctctcagccc

SEQ ID NO: 4304367 - DNA, 20 bp, Homo sapiens
cacgcctctctcagcccagg

SEQ ID NO: 4304368 - DNA, 23 bp, Homo sapiens
cacgcctctctcagcccaggtct

SEQ ID NO: 4304369 - DNA, 13 bp, Homo sapiens
cacgcgctctgca

SEQ ID NO: 4304370 - DNA, 19 bp, Homo sapiens
cacgcgctctgcatgctcc

SEQ ID NO: 4304371 - DNA, 12 bp, Homo sapiens
cacgctcctgcc

SEQ ID NO: 4304372 - DNA, 18 bp, Homo sapiens
cacgctcctgccctcgtc

SEQ ID NO: 4304373 - DNA, 13 bp, Homo sapiens
cacgctgtctcca

SEQ ID NO: 4304374 - DNA, 14 bp, Homo sapiens
cacgctgtctccag

SEQ ID NO: 4304375 - DNA, 18 bp, Homo sapiens
cacgctgtctccagaccc

SEQ ID NO: 4304376 - DNA, 19 bp, Homo sapiens
cacgctgtctccagacccc

SEQ ID NO: 4304377 - DNA, 18 bp, Homo sapiens
cacggcctctggggagac

SEQ ID NO: 4304378 - DNA, 19 bp, Homo sapiens
cacggcctctggggagacc

SEQ ID NO: 4304379 - DNA, 14 bp, Homo sapiens
cacggctgcacctg

SEQ ID NO: 4304380 - DNA, 23 bp, Homo sapiens
cacggctgcacctgcagggagca

SEQ ID NO: 4304381 - DNA, 20 bp, Homo sapiens
cacgggggaggccgaggcag

SEQ ID NO: 4304382 - DNA, 21 bp, Homo sapiens
cacgggggaggccgaggcagg

SEQ ID NO: 4304383 - DNA, 12 bp, Homo sapiens
cacgtttagaaa

SEQ ID NO: 4304384 - DNA, 21 bp, Homo sapiens
cactaaacttggtgcttattg

SEQ ID NO: 4304385 - DNA, 12 bp, Homo sapiens
cactacaaacat

SEQ ID NO: 4304386 - DNA, 14 bp, Homo sapiens
cactacgcagaaga

SEQ ID NO: 4304387 - DNA, 20 bp, Homo sapiens
cactaggccctggtctggct

SEQ ID NO: 4304388 - DNA, 21 bp, Homo sapiens
cactaggtgcccagtcttgag

SEQ ID NO: 4304389 - DNA, 23 bp, Homo sapiens
cactatgtccatgaaaaacagca

SEQ ID NO: 4304390 - DNA, 16 bp, Homo sapiens
cactccagacccctgg

SEQ ID NO: 4304391 - DNA, 17 bp, Homo sapiens
cactccagacccctggc

SEQ ID NO: 4304392 - DNA, 14 bp, Homo sapiens
cactcctacctggt

SEQ ID NO: 4304393 - DNA, 15 bp, Homo sapiens
cactctgcaggaaat

SEQ ID NO: 4304394 - DNA, 16 bp, Homo sapiens
cactctgctctgcaca

SEQ ID NO: 4304395 - DNA, 17 bp, Homo sapiens
cactctgctgaggccag

SEQ ID NO: 4304396 - DNA, 18 bp, Homo sapiens
cactctggcagcctcaga

SEQ ID NO: 4304397 - DNA, 15 bp, Homo sapiens
cactctgtttgctca

SEQ ID NO: 4304398 - DNA, 22 bp, Homo sapiens
cactctgtttgctcacccagga

SEQ ID NO: 4304399 - DNA, 23 bp, Homo sapiens
cactctgtttgctcacccaggac

SEQ ID NO: 4304400 - DNA, 16 bp, Homo sapiens
cactgagtctcattcc

SEQ ID NO: 4304401 - DNA, 22 bp, Homo sapiens
cactgcagtcacccctgtctgc

SEQ ID NO: 4304402 - DNA, 20 bp, Homo sapiens
cactgccagaagtgtgtttt

SEQ ID NO: 4304403 - DNA, 14 bp, Homo sapiens
cactgccctccgcc

SEQ ID NO: 4304404 - DNA, 21 bp, Homo sapiens
cactgccctccgcccttccct

SEQ ID NO: 4304405 - DNA, 15 bp, Homo sapiens
cactgccctctgcca

SEQ ID NO: 4304406 - DNA, 23 bp, Homo sapiens
cactgccctctgccactgacagg

SEQ ID NO: 4304407 - DNA, 10 bp, Homo sapiens
cactgcctgc

SEQ ID NO: 4304408 - DNA, 22 bp, Homo sapiens
cactgcctttgctgccttctgt

SEQ ID NO: 4304409 - DNA, 22 bp, Homo sapiens
cactgctaggtgggccagcccc

SEQ ID NO: 4304410 - DNA, 23 bp, Homo sapiens
cactgctaggtgggccagcccct

SEQ ID NO: 4304411 - DNA, 14 bp, Homo sapiens
cactggaggcctct

SEQ ID NO: 4304412 - DNA, 15 bp, Homo sapiens
cactggaggcctctg

SEQ ID NO: 4304413 - DNA, 19 bp, Homo sapiens
cactggcatctctggagtg

SEQ ID NO: 4304414 - DNA, 20 bp, Homo sapiens
cactggccttctgatgaaat

SEQ ID NO: 4304415 - DNA, 23 bp, Homo sapiens
cactggccttctgatgaaatgtt

SEQ ID NO: 4304416 - DNA, 14 bp, Homo sapiens
cactggctggactg

SEQ ID NO: 4304417 - DNA, 19 bp, Homo sapiens
cactggctggactggaggc

SEQ ID NO: 4304418 - DNA, 16 bp, Homo sapiens
cactggtctcagagga

SEQ ID NO: 4304419 - DNA, 16 bp, Homo sapiens
cactggtgcatttaaa

SEQ ID NO: 4304420 - DNA, 19 bp, Homo sapiens
cactggtgcatttaaaatg

SEQ ID NO: 4304421 - DNA, 21 bp, Homo sapiens
cactggtgcatttaaaatgga

SEQ ID NO: 4304422 - DNA, 17 bp, Homo sapiens
cactgtaaatttaatag

SEQ ID NO: 4304423 - DNA, 18 bp, Homo sapiens
cactgtaaatttaataga

SEQ ID NO: 4304424 - DNA, 22 bp, Homo sapiens
cactgtagtaaatggcaattct

SEQ ID NO: 4304425 - DNA, 13 bp, Homo sapiens
cactgtctgctgc

SEQ ID NO: 4304426 - DNA, 22 bp, Homo sapiens
cactgtgcagccggggagctga

SEQ ID NO: 4304427 - DNA, 20 bp, Homo sapiens
cactgtgcgttttagagtat

SEQ ID NO: 4304428 - DNA, 22 bp, Homo sapiens
cactgtttcactactcagcatg

SEQ ID NO: 4304429 - DNA, 13 bp, Homo sapiens
cacttaaaatcaa

SEQ ID NO: 4304430 - DNA, 13 bp, Homo sapiens
cacttaacctgct

SEQ ID NO: 4304431 - DNA, 14 bp, Homo sapiens
cacttaacctgctt

SEQ ID NO: 4304432 - DNA, 17 bp, Homo sapiens
cacttagaaattgcatt

SEQ ID NO: 4304433 - DNA, 20 bp, Homo sapiens
cacttagaaattgcatttcc

SEQ ID NO: 4304434 - DNA, 13 bp, Homo sapiens
cacttatttccat

SEQ ID NO: 4304435 - DNA, 14 bp, Homo sapiens
cacttatttccatg

SEQ ID NO: 4304436 - DNA, 13 bp, Homo sapiens
cacttatttctaa

SEQ ID NO: 4304437 - DNA, 15 bp, Homo sapiens
cacttcaggctcttc

SEQ ID NO: 4304438 - DNA, 23 bp, Homo sapiens
cacttcaggctcttctcctttca

SEQ ID NO: 4304439 - DNA, 23 bp, Homo sapiens
cacttccccttgggatgggcaca

SEQ ID NO: 4304440 - DNA, 16 bp, Homo sapiens
cacttctgaccacact

SEQ ID NO: 4304441 - DNA, 20 bp, Homo sapiens
cacttgctgcactcttgcac

SEQ ID NO: 4304442 - DNA, 23 bp, Homo sapiens
cacttggctgcataaatgtggta

SEQ ID NO: 4304443 - DNA, 22 bp, Homo sapiens
cacttgtgtttgtatataaatg

SEQ ID NO: 4304444 - DNA, 17 bp, Homo sapiens
cactttaataataaaaa

SEQ ID NO: 4304445 - DNA, 13 bp, Homo sapiens
cactttatcttgg

SEQ ID NO: 4304446 - DNA, 13 bp, Homo sapiens
cactttgacactt

SEQ ID NO: 4304447 - DNA, 14 bp, Homo sapiens
cactttgcagacct

SEQ ID NO: 4304448 - DNA, 18 bp, Homo sapiens
cacttttcatatcatttc

SEQ ID NO: 4304449 - DNA, 14 bp, Homo sapiens
cactttttctggtc

SEQ ID NO: 4304450 - DNA, 19 bp, Homo sapiens
cagaaactgaactggccgc

SEQ ID NO: 4304451 - DNA, 17 bp, Homo sapiens
cagaaagggcagcccct

SEQ ID NO: 4304452 - DNA, 19 bp, Homo sapiens
cagaaagggcagcccctcc

SEQ ID NO: 4304453 - DNA, 22 bp, Homo sapiens
cagaaatgccgctgtgtccccg

SEQ ID NO: 4304454 - DNA, 23 bp, Homo sapiens
cagaaatgccgctgtgtccccgc

SEQ ID NO: 4304455 - DNA, 21 bp, Homo sapiens
cagaaccaacgggtctgtggg

SEQ ID NO: 4304456 - DNA, 22 bp, Homo sapiens
cagaaccagtccctctgagtga

SEQ ID NO: 4304457 - DNA, 16 bp, Homo sapiens
cagaacgcatgcaggg

SEQ ID NO: 4304458 - DNA, 14 bp, Homo sapiens
cagaacgggttctc

SEQ ID NO: 4304459 - DNA, 16 bp, Homo sapiens
cagaactaccaaaatg

SEQ ID NO: 4304460 - DNA, 17 bp, Homo sapiens
cagaactgagctcctct

SEQ ID NO: 4304461 - DNA, 16 bp, Homo sapiens
cagaagacacgtgttt

SEQ ID NO: 4304462 - DNA, 17 bp, Homo sapiens
cagaagacacgtgtttt

SEQ ID NO: 4304463 - DNA, 22 bp, Homo sapiens
cagaagacacgtgtttttgtat

SEQ ID NO: 4304464 - DNA, 20 bp, Homo sapiens
cagaagagaaagtacaacca

SEQ ID NO: 4304465 - DNA, 20 bp, Homo sapiens
cagaaggaggaagggactgg

SEQ ID NO: 4304466 - DNA, 23 bp, Homo sapiens
cagaaggaggaagggactggtcc

SEQ ID NO: 4304467 - DNA, 15 bp, Homo sapiens
cagaaggccttgcct

SEQ ID NO: 4304468 - DNA, 15 bp, Homo sapiens
cagaagggggccatg

SEQ ID NO: 4304469 - DNA, 16 bp, Homo sapiens
cagaagggtttatacc

SEQ ID NO: 4304470 - DNA, 21 bp, Homo sapiens
cagaagtggcaggaggacagg

SEQ ID NO: 4304471 - DNA, 17 bp, Homo sapiens
cagaagttgttagtgat

SEQ ID NO: 4304472 - DNA, 23 bp, Homo sapiens
cagaagttgttagtgatttgcta

SEQ ID NO: 4304473 - DNA, 11 bp, Homo sapiens
cagaatgaatc

SEQ ID NO: 4304474 - DNA, 18 bp, Homo sapiens
cagacaaattcattccct

SEQ ID NO: 4304475 - DNA, 23 bp, Homo sapiens
cagacaaattcattcccttctct

SEQ ID NO: 4304476 - DNA, 18 bp, Homo sapiens
cagacacacgcacacaca

SEQ ID NO: 4304477 - DNA, 12 bp, Homo sapiens
cagacagagtgg

SEQ ID NO: 4304478 - DNA, 13 bp, Homo sapiens
cagacagagtgga

SEQ ID NO: 4304479 - DNA, 17 bp, Homo sapiens
cagacatgctgcccacc

SEQ ID NO: 4304480 - DNA, 14 bp, Homo sapiens
cagacattgtgcta

SEQ ID NO: 4304481 - DNA, 13 bp, Homo sapiens
cagaccccatcca

SEQ ID NO: 4304482 - DNA, 17 bp, Homo sapiens
cagacccccaccccttc

SEQ ID NO: 4304483 - DNA, 14 bp, Homo sapiens
cagacccctaccct

SEQ ID NO: 4304484 - DNA, 15 bp, Homo sapiens
cagacccctaccctt

SEQ ID NO: 4304485 - DNA, 13 bp, Homo sapiens
cagacccctggct

SEQ ID NO: 4304486 - DNA, 13 bp, Homo sapiens
cagacctgggccc

SEQ ID NO: 4304487 - DNA, 15 bp, Homo sapiens
cagacctgggccctg

SEQ ID NO: 4304488 - DNA, 19 bp, Homo sapiens
cagacctgggccctggttc

SEQ ID NO: 4304489 - DNA, 18 bp, Homo sapiens
cagacctttgtctgaagg

SEQ ID NO: 4304490 - DNA, 17 bp, Homo sapiens
cagactctctcctctct

SEQ ID NO: 4304491 - DNA, 23 bp, Homo sapiens
cagactctctcctctctctccct

SEQ ID NO: 4304492 - DNA, 24 bp, Homo sapiens
cagacttcgctattcccaggcagg

SEQ ID NO: 4304493 - DNA, 22 bp, Homo sapiens
cagagaagcctcagtccctccc

SEQ ID NO: 4304494 - DNA, 23 bp, Homo sapiens
cagagaagcctcagtccctccct

SEQ ID NO: 4304495 - DNA, 14 bp, Homo sapiens
cagagagaccctgc

SEQ ID NO: 4304496 - DNA, 15 bp, Homo sapiens
cagagagaccctgcc

SEQ ID NO: 4304497 - DNA, 20 bp, Homo sapiens
cagagattgggggggcttgg

SEQ ID NO: 4304498 - DNA, 21 bp, Homo sapiens
cagagattgggggggcttggg

SEQ ID NO: 4304499 - DNA, 22 bp, Homo sapiens
cagagccacccctaaagagata

SEQ ID NO: 4304500 - DNA, 12 bp, Homo sapiens
cagagcccgccc

SEQ ID NO: 4304501 - DNA, 19 bp, Homo sapiens
cagagcccgcccacctggg

SEQ ID NO: 4304502 - DNA, 18 bp, Homo sapiens
cagagcctatggaaaggg

SEQ ID NO: 4304503 - DNA, 12 bp, Homo sapiens
cagagcctccct

SEQ ID NO: 4304504 - DNA, 13 bp, Homo sapiens
cagagcctccctc

SEQ ID NO: 4304505 - DNA, 18 bp, Homo sapiens
cagagctcagcacagcct

SEQ ID NO: 4304506 - DNA, 19 bp, Homo sapiens
cagagctcagcacagcctc

SEQ ID NO: 4304507 - DNA, 13 bp, Homo sapiens
cagagctcccagg

SEQ ID NO: 4304508 - DNA, 14 bp, Homo sapiens
cagagctcccagga

SEQ ID NO: 4304509 - DNA, 21 bp, Homo sapiens
cagagctgcagaaccagtccc

SEQ ID NO: 4304510 - DNA, 10 bp, Homo sapiens
cagagctggg

SEQ ID NO: 4304511 - DNA, 16 bp, Homo sapiens
cagaggaagggaggcc

SEQ ID NO: 4304512 - DNA, 19 bp, Homo sapiens
cagaggaagggaggcctga

SEQ ID NO: 4304513 - DNA, 21 bp, Homo sapiens
cagaggaagggaggcctgagg

SEQ ID NO: 4304514 - DNA, 14 bp, Homo sapiens
cagaggaggtgccc

SEQ ID NO: 4304515 - DNA, 16 bp, Homo sapiens
cagaggaggtgcccgg

SEQ ID NO: 4304516 - DNA, 17 bp, Homo sapiens
cagaggcagtggcagca

SEQ ID NO: 4304517 - DNA, 16 bp, Homo sapiens
cagaggccccttgctg

SEQ ID NO: 4304518 - DNA, 15 bp, Homo sapiens
cagagggcccctcac

SEQ ID NO: 4304519 - DNA, 23 bp, Homo sapiens
cagagggcccctcactggctgga

SEQ ID NO: 4304520 - DNA, 15 bp, Homo sapiens
cagaggggagaggaa

SEQ ID NO: 4304521 - DNA, 17 bp, Homo sapiens
cagaggggagaggaagc

SEQ ID NO: 4304522 - DNA, 18 bp, Homo sapiens
cagaggggagaggaagca

SEQ ID NO: 4304523 - DNA, 17 bp, Homo sapiens
cagaggggcggggccag

SEQ ID NO: 4304524 - DNA, 20 bp, Homo sapiens
cagaggggcggggccaggat

SEQ ID NO: 4304525 - DNA, 16 bp, Homo sapiens
cagagggtccctaggt

SEQ ID NO: 4304526 - DNA, 16 bp, Homo sapiens
cagagtatatatgtac

SEQ ID NO: 4304527 - DNA, 21 bp, Homo sapiens
cagagtatgtcagtccaataa

SEQ ID NO: 4304528 - DNA, 15 bp, Homo sapiens
cagagtccaggcccc

SEQ ID NO: 4304529 - DNA, 15 bp, Homo sapiens
cagagtgcacagctg

SEQ ID NO: 4304530 - DNA, 17 bp, Homo sapiens
cagagtgcacagctgtc

SEQ ID NO: 4304531 - DNA, 14 bp, Homo sapiens
cagagtggatctgg

SEQ ID NO: 4304532 - DNA, 22 bp, Homo sapiens
cagatagcctagggtgagggtg

SEQ ID NO: 4304533 - DNA, 24 bp, Homo sapiens
cagatagcctagggtgagggtgac

SEQ ID NO: 4304534 - DNA, 12 bp, Homo sapiens
cagatctagcca

SEQ ID NO: 4304535 - DNA, 14 bp, Homo sapiens
cagatctagccagg

SEQ ID NO: 4304536 - DNA, 16 bp, Homo sapiens
cagatctagccaggcc

SEQ ID NO: 4304537 - DNA, 17 bp, Homo sapiens
cagatctagccaggcct

SEQ ID NO: 4304538 - DNA, 18 bp, Homo sapiens
cagatctagccaggcctc

SEQ ID NO: 4304539 - DNA, 12 bp, Homo sapiens
cagatcttgagc

SEQ ID NO: 4304540 - DNA, 16 bp, Homo sapiens
cagatcttgagcaagg

SEQ ID NO: 4304541 - DNA, 16 bp, Homo sapiens
cagatgacacataaat

SEQ ID NO: 4304542 - DNA, 19 bp, Homo sapiens
cagatgacacataaatctg

SEQ ID NO: 4304543 - DNA, 14 bp, Homo sapiens
cagatgacagggag

SEQ ID NO: 4304544 - DNA, 15 bp, Homo sapiens
cagatgacagggagc

SEQ ID NO: 4304545 - DNA, 19 bp, Homo sapiens
cagatgctggtcatcctgg

SEQ ID NO: 4304546 - DNA, 22 bp, Homo sapiens
cagatgctggtcatcctgggca

SEQ ID NO: 4304547 - DNA, 22 bp, Homo sapiens
cagatggcatgtgtttacttta

SEQ ID NO: 4304548 - DNA, 17 bp, Homo sapiens
cagatggctccctgggc

SEQ ID NO: 4304549 - DNA, 18 bp, Homo sapiens
cagatggctccctgggct

SEQ ID NO: 4304550 - DNA, 20 bp, Homo sapiens
cagatggctccctgggctgg

SEQ ID NO: 4304551 - DNA, 21 bp, Homo sapiens
cagatggctccctgggctggc

SEQ ID NO: 4304552 - DNA, 21 bp, Homo sapiens
cagatgggcaaggcctttggc

SEQ ID NO: 4304553 - DNA, 22 bp, Homo sapiens
cagattctaagttgttggcctt

SEQ ID NO: 4304554 - DNA, 21 bp, Homo sapiens
cagattggttcatgcctgggg

SEQ ID NO: 4304555 - DNA, 22 bp, Homo sapiens
cagattggttcatgcctggggt

SEQ ID NO: 4304556 - DNA, 23 bp, Homo sapiens
cagattggttcatgcctggggtg

SEQ ID NO: 4304557 - DNA, 19 bp, Homo sapiens
cagcaacaggaccaggagc

SEQ ID NO: 4304558 - DNA, 15 bp, Homo sapiens
cagcacaattctgtc

SEQ ID NO: 4304559 - DNA, 20 bp, Homo sapiens
cagcacaattctgtccctgt

SEQ ID NO: 4304560 - DNA, 22 bp, Homo sapiens
cagcacaattctgtccctgtcc

SEQ ID NO: 4304561 - DNA, 13 bp, Homo sapiens
cagcacagcctca

SEQ ID NO: 4304562 - DNA, 16 bp, Homo sapiens
cagcacagcctcaccc

SEQ ID NO: 4304563 - DNA, 18 bp, Homo sapiens
cagcacattgccctgagg

SEQ ID NO: 4304564 - DNA, 14 bp, Homo sapiens
cagcacgccaaccc

SEQ ID NO: 4304565 - DNA, 18 bp, Homo sapiens
cagcacgccaaccccagc

SEQ ID NO: 4304566 - DNA, 21 bp, Homo sapiens
cagcacgccaaccccagcagt

SEQ ID NO: 4304567 - DNA, 18 bp, Homo sapiens
cagcagaaggccttgcct

SEQ ID NO: 4304568 - DNA, 19 bp, Homo sapiens
cagcaggggggttgggttc

SEQ ID NO: 4304569 - DNA, 20 bp, Homo sapiens
cagcaggttctctcctgtga

SEQ ID NO: 4304570 - DNA, 21 bp, Homo sapiens
cagcaggttctctcctgtgag

SEQ ID NO: 4304571 - DNA, 24 bp, Homo sapiens
cagcaggttgtgtgtgtgtgcagt

SEQ ID NO: 4304572 - DNA, 22 bp, Homo sapiens
cagcagtacttgctcaataaag

SEQ ID NO: 4304573 - DNA, 15 bp, Homo sapiens
cagcagtcctgggcc

SEQ ID NO: 4304574 - DNA, 19 bp, Homo sapiens
cagcatcgtgtgggtccct

SEQ ID NO: 4304575 - DNA, 12 bp, Homo sapiens
cagcatgtctac

SEQ ID NO: 4304576 - DNA, 15 bp, Homo sapiens
cagcatgtctactgc

SEQ ID NO: 4304577 - DNA, 15 bp, Homo sapiens
cagcattctcactcc

SEQ ID NO: 4304578 - DNA, 21 bp, Homo sapiens
cagcatttcggtgcttccctt

SEQ ID NO: 4304579 - DNA, 14 bp, Homo sapiens
cagccaaattgcag

SEQ ID NO: 4304580 - DNA, 12 bp, Homo sapiens
cagccaacccct

SEQ ID NO: 4304581 - DNA, 16 bp, Homo sapiens
cagccaacccctgtgg

SEQ ID NO: 4304582 - DNA, 15 bp, Homo sapiens
cagccaccaaggctg

SEQ ID NO: 4304583 - DNA, 14 bp, Homo sapiens
cagccaccacctgg

SEQ ID NO: 4304584 - DNA, 19 bp, Homo sapiens
cagccacccggatctccag

SEQ ID NO: 4304585 - DNA, 22 bp, Homo sapiens
cagccacccggatctccaggcc

SEQ ID NO: 4304586 - DNA, 23 bp, Homo sapiens
cagccacccggatctccaggccc

SEQ ID NO: 4304587 - DNA, 13 bp, Homo sapiens
cagccaccctgcc

SEQ ID NO: 4304588 - DNA, 14 bp, Homo sapiens
cagccaccctgcca

SEQ ID NO: 4304589 - DNA, 18 bp, Homo sapiens
cagccaccctgccatgga

SEQ ID NO: 4304590 - DNA, 13 bp, Homo sapiens
cagccacgcctct

SEQ ID NO: 4304591 - DNA, 16 bp, Homo sapiens
cagccacgcctctctc

SEQ ID NO: 4304592 - DNA, 11 bp, Homo sapiens
cagccagcagg

SEQ ID NO: 4304593 - DNA, 20 bp, Homo sapiens
cagccagcaggttctctcct

SEQ ID NO: 4304594 - DNA, 23 bp, Homo sapiens
cagccagcaggttctctcctgtg

SEQ ID NO: 4304595 - DNA, 24 bp, Homo sapiens
cagccagcaggttctctcctgtga

SEQ ID NO: 4304596 - DNA, 16 bp, Homo sapiens
cagcccacccccctca

SEQ ID NO: 4304597 - DNA, 13 bp, Homo sapiens
cagcccagatggc

SEQ ID NO: 4304598 - DNA, 23 bp, Homo sapiens
cagccccagcgagtctggagacc

SEQ ID NO: 4304599 - DNA, 17 bp, Homo sapiens
cagccccagggccctgc

SEQ ID NO: 4304600 - DNA, 19 bp, Homo sapiens
cagccccagggccctgctc

SEQ ID NO: 4304601 - DNA, 21 bp, Homo sapiens
cagcccctcccaccacagcag

SEQ ID NO: 4304602 - DNA, 15 bp, Homo sapiens
cagcccctcttgccc

SEQ ID NO: 4304603 - DNA, 21 bp, Homo sapiens
cagcccctcttgccccccacc

SEQ ID NO: 4304604 - DNA, 23 bp, Homo sapiens
cagcccctcttgccccccacccc

SEQ ID NO: 4304605 - DNA, 15 bp, Homo sapiens
cagcccctgctgctc

SEQ ID NO: 4304606 - DNA, 22 bp, Homo sapiens
cagcccctggggtacttctgtg

SEQ ID NO: 4304607 - DNA, 13 bp, Homo sapiens
cagccctccctgc

SEQ ID NO: 4304608 - DNA, 17 bp, Homo sapiens
cagccctccctgcccct

SEQ ID NO: 4304609 - DNA, 22 bp, Homo sapiens
cagccctccctgcccctccctt

SEQ ID NO: 4304610 - DNA, 21 bp, Homo sapiens
cagccctggttctccatcccc

SEQ ID NO: 4304611 - DNA, 12 bp, Homo sapiens
cagccctgtcag

SEQ ID NO: 4304612 - DNA, 21 bp, Homo sapiens
cagccctgtcagtgcagcccg

SEQ ID NO: 4304613 - DNA, 21 bp, Homo sapiens
cagccggagtcactgcctgga

SEQ ID NO: 4304614 - DNA, 16 bp, Homo sapiens
cagccgtgccttcagc

SEQ ID NO: 4304615 - DNA, 21 bp, Homo sapiens
cagccgtttgaatatatttta

SEQ ID NO: 4304616 - DNA, 16 bp, Homo sapiens
cagcctcagaggcccc

SEQ ID NO: 4304617 - DNA, 20 bp, Homo sapiens
cagcctcagaggccccttgc

SEQ ID NO: 4304618 - DNA, 20 bp, Homo sapiens
cagcctcagtgcagccccct

SEQ ID NO: 4304619 - DNA, 21 bp, Homo sapiens
cagcctccactccctgtctga

SEQ ID NO: 4304620 - DNA, 13 bp, Homo sapiens
cagcctctccaag

SEQ ID NO: 4304621 - DNA, 18 bp, Homo sapiens
cagcctgcagactcactg

SEQ ID NO: 4304622 - DNA, 13 bp, Homo sapiens
cagcctggcacag

SEQ ID NO: 4304623 - DNA, 21 bp, Homo sapiens
cagcctggcacagggcagtgg

SEQ ID NO: 4304624 - DNA, 15 bp, Homo sapiens
cagcctggccccaaa

SEQ ID NO: 4304625 - DNA, 11 bp, Homo sapiens
cagcctgtggc

SEQ ID NO: 4304626 - DNA, 16 bp, Homo sapiens
cagcctgtggcctcag

SEQ ID NO: 4304627 - DNA, 17 bp, Homo sapiens
cagcgagtctggagacc

SEQ ID NO: 4304628 - DNA, 14 bp, Homo sapiens
cagcggcctgggga

SEQ ID NO: 4304629 - DNA, 16 bp, Homo sapiens
cagcgggtaaaaagag

SEQ ID NO: 4304630 - DNA, 19 bp, Homo sapiens
cagcgtctgagcggccgcc

SEQ ID NO: 4304631 - DNA, 23 bp, Homo sapiens
cagctaggttaataggaggacag

SEQ ID NO: 4304632 - DNA, 12 bp, Homo sapiens
cagctccaggca

SEQ ID NO: 4304633 - DNA, 20 bp, Homo sapiens
cagctgaccagaagtggcag

SEQ ID NO: 4304634 - DNA, 22 bp, Homo sapiens
cagctgaccagaagtggcagga

SEQ ID NO: 4304635 - DNA, 23 bp, Homo sapiens
cagctgaccagaagtggcaggag

SEQ ID NO: 4304636 - DNA, 14 bp, Homo sapiens
cagctgccagagaa

SEQ ID NO: 4304637 - DNA, 16 bp, Homo sapiens
cagctgccagagaagc

SEQ ID NO: 4304638 - DNA, 15 bp, Homo sapiens
cagctgctcctcgca

SEQ ID NO: 4304639 - DNA, 13 bp, Homo sapiens
cagctgcttctgc

SEQ ID NO: 4304640 - DNA, 18 bp, Homo sapiens
cagctgcttctgcccacc

SEQ ID NO: 4304641 - DNA, 20 bp, Homo sapiens
cagctgcttctgcccacccc

SEQ ID NO: 4304642 - DNA, 23 bp, Homo sapiens
cagctgcttctgcccaccccgcc

SEQ ID NO: 4304643 - DNA, 15 bp, Homo sapiens
cagctggctctgcag

SEQ ID NO: 4304644 - DNA, 14 bp, Homo sapiens
cagctgtagaaagg

SEQ ID NO: 4304645 - DNA, 15 bp, Homo sapiens
cagcttcaaaacaga

SEQ ID NO: 4304646 - DNA, 16 bp, Homo sapiens
cagcttcacttaaaat

SEQ ID NO: 4304647 - DNA, 13 bp, Homo sapiens
cagcttgtttcta

SEQ ID NO: 4304648 - DNA, 15 bp, Homo sapiens
cagctttcctgggtc

SEQ ID NO: 4304649 - DNA, 14 bp, Homo sapiens
cagctttgccttcc

SEQ ID NO: 4304650 - DNA, 15 bp, Homo sapiens
caggaaaggaagatg

SEQ ID NO: 4304651 - DNA, 21 bp, Homo sapiens
caggaaatagtgttcttttta

SEQ ID NO: 4304652 - DNA, 19 bp, Homo sapiens
caggaacacccagccccag

SEQ ID NO: 4304653 - DNA, 16 bp, Homo sapiens
caggaagaaggcccgg

SEQ ID NO: 4304654 - DNA, 20 bp, Homo sapiens
caggaagaaggcccgggagg

SEQ ID NO: 4304655 - DNA, 14 bp, Homo sapiens
caggaagcaaggcc

SEQ ID NO: 4304656 - DNA, 16 bp, Homo sapiens
caggaagcaaggccag

SEQ ID NO: 4304657 - DNA, 19 bp, Homo sapiens
caggaagcaaggccagccc

SEQ ID NO: 4304658 - DNA, 22 bp, Homo sapiens
caggaagcaaggccagccctgg

SEQ ID NO: 4304659 - DNA, 14 bp, Homo sapiens
caggaagcctcctg

SEQ ID NO: 4304660 - DNA, 18 bp, Homo sapiens
caggaagcctcctgctga

SEQ ID NO: 4304661 - DNA, 19 bp, Homo sapiens
caggaagcctcctgctgag

SEQ ID NO: 4304662 - DNA, 22 bp, Homo sapiens
caggaagcctcctgctgagtgg

SEQ ID NO: 4304663 - DNA, 19 bp, Homo sapiens
caggaaggtctcatgcctg

SEQ ID NO: 4304664 - DNA, 22 bp, Homo sapiens
caggaaggtctcatgcctgaga

SEQ ID NO: 4304665 - DNA, 15 bp, Homo sapiens
caggaattctccctg

SEQ ID NO: 4304666 - DNA, 14 bp, Homo sapiens
caggacactgcctt

SEQ ID NO: 4304667 - DNA, 13 bp, Homo sapiens
caggaccaggagc

SEQ ID NO: 4304668 - DNA, 15 bp, Homo sapiens
caggaccaggagcca

SEQ ID NO: 4304669 - DNA, 13 bp, Homo sapiens
caggaccccatct

SEQ ID NO: 4304670 - DNA, 15 bp, Homo sapiens
caggaccccatctgc

SEQ ID NO: 4304671 - DNA, 20 bp, Homo sapiens
caggaccccatctgctgagc

SEQ ID NO: 4304672 - DNA, 23 bp, Homo sapiens
caggaccccatctgctgagctct

SEQ ID NO: 4304673 - DNA, 15 bp, Homo sapiens
caggacgcagggaga

SEQ ID NO: 4304674 - DNA, 20 bp, Homo sapiens
caggacgcagggagaccctg

SEQ ID NO: 4304675 - DNA, 16 bp, Homo sapiens
caggacgcatgcaggg

SEQ ID NO: 4304676 - DNA, 21 bp, Homo sapiens
caggactcgggctaagtccag

SEQ ID NO: 4304677 - DNA, 14 bp, Homo sapiens
caggactctgcctt

SEQ ID NO: 4304678 - DNA, 15 bp, Homo sapiens
caggactctgccttc

SEQ ID NO: 4304679 - DNA, 17 bp, Homo sapiens
caggactctgccttcca

SEQ ID NO: 4304680 - DNA, 19 bp, Homo sapiens
caggagaaggcctgccccc

SEQ ID NO: 4304681 - DNA, 13 bp, Homo sapiens
caggagacactgg

SEQ ID NO: 4304682 - DNA, 20 bp, Homo sapiens
caggagacactggtctcaga

SEQ ID NO: 4304683 - DNA, 18 bp, Homo sapiens
caggagagcccccaccag

SEQ ID NO: 4304684 - DNA, 22 bp, Homo sapiens
caggagagcccccaccagcagc

SEQ ID NO: 4304685 - DNA, 20 bp, Homo sapiens
caggagaggagcgggacctg

SEQ ID NO: 4304686 - DNA, 15 bp, Homo sapiens
caggagcatgtccta

SEQ ID NO: 4304687 - DNA, 14 bp, Homo sapiens
caggagcctagagg

SEQ ID NO: 4304688 - DNA, 16 bp, Homo sapiens
caggagcctagaggag

SEQ ID NO: 4304689 - DNA, 13 bp, Homo sapiens
caggaggaactgg

SEQ ID NO: 4304690 - DNA, 14 bp, Homo sapiens
caggaggagacagt

SEQ ID NO: 4304691 - DNA, 21 bp, Homo sapiens
caggaggagacagtcaggaag

SEQ ID NO: 4304692 - DNA, 14 bp, Homo sapiens
caggaggcagtggc

SEQ ID NO: 4304693 - DNA, 22 bp, Homo sapiens
caggaggcagtggcttggagca

SEQ ID NO: 4304694 - DNA, 16 bp, Homo sapiens
caggagggcatccctg

SEQ ID NO: 4304695 - DNA, 21 bp, Homo sapiens
caggagtgggtgggacacaga

SEQ ID NO: 4304696 - DNA, 23 bp, Homo sapiens
caggagtgggtgggacacagaga

SEQ ID NO: 4304697 - DNA, 13 bp, Homo sapiens
caggatgaactag

SEQ ID NO: 4304698 - DNA, 15 bp, Homo sapiens
caggatgcatgcagg

SEQ ID NO: 4304699 - DNA, 19 bp, Homo sapiens
caggatgcatgcagggccc

SEQ ID NO: 4304700 - DNA, 19 bp, Homo sapiens
caggatggcgtgtcccctg

SEQ ID NO: 4304701 - DNA, 23 bp, Homo sapiens
caggattaatctctaaaattcta

SEQ ID NO: 4304702 - DNA, 22 bp, Homo sapiens
caggcaatggcctaaacttcag

SEQ ID NO: 4304703 - DNA, 21 bp, Homo sapiens
caggcacttaagcacaagcag

SEQ ID NO: 4304704 - DNA, 13 bp, Homo sapiens
caggcagcctgtg

SEQ ID NO: 4304705 - DNA, 19 bp, Homo sapiens
caggcaggctgtgcgctga

SEQ ID NO: 4304706 - DNA, 14 bp, Homo sapiens
caggcagtggccca

SEQ ID NO: 4304707 - DNA, 15 bp, Homo sapiens
caggcagtggcccag

SEQ ID NO: 4304708 - DNA, 16 bp, Homo sapiens
caggcagtggcccagg

SEQ ID NO: 4304709 - DNA, 16 bp, Homo sapiens
caggcatgcctgtgtg

SEQ ID NO: 4304710 - DNA, 12 bp, Homo sapiens
caggcatgggtc

SEQ ID NO: 4304711 - DNA, 18 bp, Homo sapiens
caggccacctgccccctt

SEQ ID NO: 4304712 - DNA, 22 bp, Homo sapiens
caggccacctgcccccttctcc

SEQ ID NO: 4304713 - DNA, 23 bp, Homo sapiens
caggccacctgcccccttctccc

SEQ ID NO: 4304714 - DNA, 16 bp, Homo sapiens
caggcccagcctggcc

SEQ ID NO: 4304715 - DNA, 18 bp, Homo sapiens
caggcccatgccctccgt

SEQ ID NO: 4304716 - DNA, 23 bp, Homo sapiens
caggccccaaaaccacagccctg

SEQ ID NO: 4304717 - DNA, 12 bp, Homo sapiens
caggccccaggc

SEQ ID NO: 4304718 - DNA, 17 bp, Homo sapiens
caggcccttcctctcca

SEQ ID NO: 4304719 - DNA, 23 bp, Homo sapiens
caggcccttcctctccactgcct

SEQ ID NO: 4304720 - DNA, 16 bp, Homo sapiens
caggcctcacctggct

SEQ ID NO: 4304721 - DNA, 22 bp, Homo sapiens
caggcctcacctggcttcccag

SEQ ID NO: 4304722 - DNA, 16 bp, Homo sapiens
caggcctcatcctcct

SEQ ID NO: 4304723 - DNA, 15 bp, Homo sapiens
caggcctcccgcatg

SEQ ID NO: 4304724 - DNA, 18 bp, Homo sapiens
caggcctcccgcatgctg

SEQ ID NO: 4304725 - DNA, 22 bp, Homo sapiens
caggcctcccgcatgctgcctg

SEQ ID NO: 4304726 - DNA, 23 bp, Homo sapiens
caggcctcccgcatgctgcctgc

SEQ ID NO: 4304727 - DNA, 11 bp, Homo sapiens
caggcctggcc

SEQ ID NO: 4304728 - DNA, 14 bp, Homo sapiens
caggcctggcccag

SEQ ID NO: 4304729 - DNA, 17 bp, Homo sapiens
caggcctggcccagcca

SEQ ID NO: 4304730 - DNA, 14 bp, Homo sapiens
caggcctggccctt

SEQ ID NO: 4304731 - DNA, 19 bp, Homo sapiens
caggcctggccctttcacc

SEQ ID NO: 4304732 - DNA, 15 bp, Homo sapiens
caggcgccccttccc

SEQ ID NO: 4304733 - DNA, 15 bp, Homo sapiens
caggcggtatccaga

SEQ ID NO: 4304734 - DNA, 20 bp, Homo sapiens
caggcggtatccagaggtga

SEQ ID NO: 4304735 - DNA, 20 bp, Homo sapiens
caggcgtagggccagggctc

SEQ ID NO: 4304736 - DNA, 16 bp, Homo sapiens
caggctggatgctggg

SEQ ID NO: 4304737 - DNA, 17 bp, Homo sapiens
caggctggatgctgggt

SEQ ID NO: 4304738 - DNA, 21 bp, Homo sapiens
caggctggcaccgccttctct

SEQ ID NO: 4304739 - DNA, 19 bp, Homo sapiens
caggctgtgcgctgacaac

SEQ ID NO: 4304740 - DNA, 14 bp, Homo sapiens
caggcttcctgccc

SEQ ID NO: 4304741 - DNA, 15 bp, Homo sapiens
caggcttcctgccct

SEQ ID NO: 4304742 - DNA, 18 bp, Homo sapiens
caggcttcctgccctagc

SEQ ID NO: 4304743 - DNA, 15 bp, Homo sapiens
cagggaatcagggag

SEQ ID NO: 4304744 - DNA, 22 bp, Homo sapiens
cagggaccaagatgtcaagctg

SEQ ID NO: 4304745 - DNA, 14 bp, Homo sapiens
cagggaccaaggac

SEQ ID NO: 4304746 - DNA, 15 bp, Homo sapiens
cagggaccaaggacc

SEQ ID NO: 4304747 - DNA, 14 bp, Homo sapiens
cagggagaccctgg

SEQ ID NO: 4304748 - DNA, 18 bp, Homo sapiens
cagggagaccctgggaga

SEQ ID NO: 4304749 - DNA, 22 bp, Homo sapiens
cagggagaccctgggagagtga

SEQ ID NO: 4304750 - DNA, 17 bp, Homo sapiens
cagggagaggccatgat

SEQ ID NO: 4304751 - DNA, 16 bp, Homo sapiens
cagggagcactggagg

SEQ ID NO: 4304752 - DNA, 20 bp, Homo sapiens
cagggagcactggaggcctc

SEQ ID NO: 4304753 - DNA, 21 bp, Homo sapiens
cagggagcactggaggcctct

SEQ ID NO: 4304754 - DNA, 13 bp, Homo sapiens
cagggagccctgg

SEQ ID NO: 4304755 - DNA, 15 bp, Homo sapiens
cagggagccctgggg

SEQ ID NO: 4304756 - DNA, 20 bp, Homo sapiens
cagggagctatgagagatgt

SEQ ID NO: 4304757 - DNA, 21 bp, Homo sapiens
cagggagggaaacccggggaa

SEQ ID NO: 4304758 - DNA, 17 bp, Homo sapiens
cagggcaatcaatgttc

SEQ ID NO: 4304759 - DNA, 11 bp, Homo sapiens
cagggcagcct

SEQ ID NO: 4304760 - DNA, 13 bp, Homo sapiens
cagggcagcctgt

SEQ ID NO: 4304761 - DNA, 17 bp, Homo sapiens
cagggcaggcagagctc

SEQ ID NO: 4304762 - DNA, 15 bp, Homo sapiens
cagggcccccatgca

SEQ ID NO: 4304763 - DNA, 17 bp, Homo sapiens
cagggcccccatgcagg

SEQ ID NO: 4304764 - DNA, 18 bp, Homo sapiens
cagggcccccatgcaggc

SEQ ID NO: 4304765 - DNA, 14 bp, Homo sapiens
cagggccctgctca

SEQ ID NO: 4304766 - DNA, 20 bp, Homo sapiens
cagggccctgctcaggcctc

SEQ ID NO: 4304767 - DNA, 18 bp, Homo sapiens
cagggcgggccaggagaa

SEQ ID NO: 4304768 - DNA, 18 bp, Homo sapiens
cagggcggggctggccag

SEQ ID NO: 4304769 - DNA, 19 bp, Homo sapiens
cagggcggggctggccagc

SEQ ID NO: 4304770 - DNA, 24 bp, Homo sapiens
cagggcggggctggccagctgtgc

SEQ ID NO: 4304771 - DNA, 13 bp, Homo sapiens
cagggctgtcctt

SEQ ID NO: 4304772 - DNA, 16 bp, Homo sapiens
cagggctgtccttaga

SEQ ID NO: 4304773 - DNA, 14 bp, Homo sapiens
caggggagacttag

SEQ ID NO: 4304774 - DNA, 21 bp, Homo sapiens
caggggagacttaggccagag

SEQ ID NO: 4304775 - DNA, 12 bp, Homo sapiens
caggggcacact

SEQ ID NO: 4304776 - DNA, 22 bp, Homo sapiens
caggggctgcatcctcagcccc

SEQ ID NO: 4304777 - DNA, 21 bp, Homo sapiens
caggggggttgggttccagac

SEQ ID NO: 4304778 - DNA, 23 bp, Homo sapiens
caggggggttgggttccagacag

SEQ ID NO: 4304779 - DNA, 16 bp, Homo sapiens
caggggtgagccccgc

SEQ ID NO: 4304780 - DNA, 18 bp, Homo sapiens
cagggtctcgtcaggagg

SEQ ID NO: 4304781 - DNA, 16 bp, Homo sapiens
cagggtggggcttaga

SEQ ID NO: 4304782 - DNA, 16 bp, Homo sapiens
cagggtggtcttcaag

SEQ ID NO: 4304783 - DNA, 22 bp, Homo sapiens
cagggttaaagaaaggcagaga

SEQ ID NO: 4304784 - DNA, 15 bp, Homo sapiens
cagggttccagacag

SEQ ID NO: 4304785 - DNA, 23 bp, Homo sapiens
cagggttccagacagggtggggc

SEQ ID NO: 4304786 - DNA, 19 bp, Homo sapiens
cagggttctagaaggggcg

SEQ ID NO: 4304787 - DNA, 21 bp, Homo sapiens
cagggttctagaaggggcgag

SEQ ID NO: 4304788 - DNA, 22 bp, Homo sapiens
caggtcccgagccccctgtcct

SEQ ID NO: 4304789 - DNA, 20 bp, Homo sapiens
caggtctcctgggcatctgg

SEQ ID NO: 4304790 - DNA, 18 bp, Homo sapiens
caggtgaccttctgggaa

SEQ ID NO: 4304791 - DNA, 17 bp, Homo sapiens
caggtggaacaggagga

SEQ ID NO: 4304792 - DNA, 22 bp, Homo sapiens
caggtggaacaggaggaactgg

SEQ ID NO: 4304793 - DNA, 15 bp, Homo sapiens
caggtggaggcgagc

SEQ ID NO: 4304794 - DNA, 17 bp, Homo sapiens
caggtggaggcgagcca

SEQ ID NO: 4304795 - DNA, 19 bp, Homo sapiens
caggtggaggcgagccaga

SEQ ID NO: 4304796 - DNA, 21 bp, Homo sapiens
caggtggaggcgagccagatt

SEQ ID NO: 4304797 - DNA, 15 bp, Homo sapiens
caggtggccactcca

SEQ ID NO: 4304798 - DNA, 21 bp, Homo sapiens
caggtggccagggctccacgg

SEQ ID NO: 4304799 - DNA, 19 bp, Homo sapiens
caggtgtcctgactgtcct

SEQ ID NO: 4304800 - DNA, 16 bp, Homo sapiens
caggtgtgggctccca

SEQ ID NO: 4304801 - DNA, 19 bp, Homo sapiens
caggttctctcctgtgagc

SEQ ID NO: 4304802 - DNA, 17 bp, Homo sapiens
cagtaaaattatactgt

SEQ ID NO: 4304803 - DNA, 15 bp, Homo sapiens
cagtaattttcggat

SEQ ID NO: 4304804 - DNA, 18 bp, Homo sapiens
cagtacttgctcaataaa

SEQ ID NO: 4304805 - DNA, 20 bp, Homo sapiens
cagtagctgtggggagctgg

SEQ ID NO: 4304806 - DNA, 22 bp, Homo sapiens
cagtagctgtggggagctggtg

SEQ ID NO: 4304807 - DNA, 18 bp, Homo sapiens
cagtagtgcctgtgatcg

SEQ ID NO: 4304808 - DNA, 18 bp, Homo sapiens
cagtatattttatttcaa

SEQ ID NO: 4304809 - DNA, 22 bp, Homo sapiens
cagtatattttatttcaatgta

SEQ ID NO: 4304810 - DNA, 21 bp, Homo sapiens
cagtattatagatataaatat

SEQ ID NO: 4304811 - DNA, 14 bp, Homo sapiens
cagtcacccctgtc

SEQ ID NO: 4304812 - DNA, 15 bp, Homo sapiens
cagtcacccctgtct

SEQ ID NO: 4304813 - DNA, 17 bp, Homo sapiens
cagtcacccctgtctgc

SEQ ID NO: 4304814 - DNA, 18 bp, Homo sapiens
cagtcacccctgtctgcg

SEQ ID NO: 4304815 - DNA, 13 bp, Homo sapiens
cagtcagcacaga

SEQ ID NO: 4304816 - DNA, 12 bp, Homo sapiens
cagtcaggaagc

SEQ ID NO: 4304817 - DNA, 21 bp, Homo sapiens
cagtcaggaagcctcctgctg

SEQ ID NO: 4304818 - DNA, 22 bp, Homo sapiens
cagtcagggcggggctggccag

SEQ ID NO: 4304819 - DNA, 16 bp, Homo sapiens
cagtccccgggaaagg

SEQ ID NO: 4304820 - DNA, 18 bp, Homo sapiens
cagtccccgggaaaggcc

SEQ ID NO: 4304821 - DNA, 17 bp, Homo sapiens
cagtccctccctcctgg

SEQ ID NO: 4304822 - DNA, 18 bp, Homo sapiens
cagtcctgggccccctgg

SEQ ID NO: 4304823 - DNA, 21 bp, Homo sapiens
cagtccttccacacttccacc

SEQ ID NO: 4304824 - DNA, 19 bp, Homo sapiens
cagtctaaaatgcttcagt

SEQ ID NO: 4304825 - DNA, 15 bp, Homo sapiens
cagtctgctgccctc

SEQ ID NO: 4304826 - DNA, 18 bp, Homo sapiens
cagtctgctgccctccat

SEQ ID NO: 4304827 - DNA, 12 bp, Homo sapiens
cagtctggaggt

SEQ ID NO: 4304828 - DNA, 15 bp, Homo sapiens
cagtctgttcagagg

SEQ ID NO: 4304829 - DNA, 17 bp, Homo sapiens
cagtctgttcagaggca

SEQ ID NO: 4304830 - DNA, 15 bp, Homo sapiens
cagtcttgagtgggc

SEQ ID NO: 4304831 - DNA, 17 bp, Homo sapiens
cagtcttgagtgggccc

SEQ ID NO: 4304832 - DNA, 23 bp, Homo sapiens
cagtcttgagtgggccccctctc

SEQ ID NO: 4304833 - DNA, 21 bp, Homo sapiens
cagtctttgggggattcaaat

SEQ ID NO: 4304834 - DNA, 22 bp, Homo sapiens
cagtctttgggggattcaaatg

SEQ ID NO: 4304835 - DNA, 12 bp, Homo sapiens
cagtcttttgtc

SEQ ID NO: 4304836 - DNA, 14 bp, Homo sapiens
cagtgaccctggag

SEQ ID NO: 4304837 - DNA, 18 bp, Homo sapiens
cagtgaccctggagctag

SEQ ID NO: 4304838 - DNA, 16 bp, Homo sapiens
cagtgactccaggaga

SEQ ID NO: 4304839 - DNA, 17 bp, Homo sapiens
cagtgagagtgaggccc

SEQ ID NO: 4304840 - DNA, 19 bp, Homo sapiens
cagtgagagtgaggccccc

SEQ ID NO: 4304841 - DNA, 13 bp, Homo sapiens
cagtgaggcccag

SEQ ID NO: 4304842 - DNA, 17 bp, Homo sapiens
cagtgaggcccagggag

SEQ ID NO: 4304843 - DNA, 21 bp, Homo sapiens
cagtgaggcccagggagaggc

SEQ ID NO: 4304844 - DNA, 18 bp, Homo sapiens
cagtgcaccccctaaaga

SEQ ID NO: 4304845 - DNA, 15 bp, Homo sapiens
cagtgcatctcagcc

SEQ ID NO: 4304846 - DNA, 16 bp, Homo sapiens
cagtgcatctcagccc

SEQ ID NO: 4304847 - DNA, 17 bp, Homo sapiens
cagtggactttccaccc

SEQ ID NO: 4304848 - DNA, 19 bp, Homo sapiens
cagtggactttccaccccc

SEQ ID NO: 4304849 - DNA, 18 bp, Homo sapiens
cagtggagggagactgac

SEQ ID NO: 4304850 - DNA, 19 bp, Homo sapiens
cagtggagggagactgacc

SEQ ID NO: 4304851 - DNA, 14 bp, Homo sapiens
cagtggatacgtgt

SEQ ID NO: 4304852 - DNA, 12 bp, Homo sapiens
cagtggcagcaa

SEQ ID NO: 4304853 - DNA, 16 bp, Homo sapiens
cagtggcatggctcca

SEQ ID NO: 4304854 - DNA, 18 bp, Homo sapiens
cagtggcctacaaatcag

SEQ ID NO: 4304855 - DNA, 23 bp, Homo sapiens
cagtggcctacaaatcagtaatt

SEQ ID NO: 4304856 - DNA, 20 bp, Homo sapiens
cagtggcctcaaccctccct

SEQ ID NO: 4304857 - DNA, 23 bp, Homo sapiens
cagtggcctcaaccctccctcag

SEQ ID NO: 4304858 - DNA, 20 bp, Homo sapiens
cagtggcttggagcagaggt

SEQ ID NO: 4304859 - DNA, 13 bp, Homo sapiens
cagtgggaggcgc

SEQ ID NO: 4304860 - DNA, 15 bp, Homo sapiens
cagtgggccctggct

SEQ ID NO: 4304861 - DNA, 15 bp, Homo sapiens
cagtgtatctcgaag

SEQ ID NO: 4304862 - DNA, 23 bp, Homo sapiens
cagtgtatctcgaagtcttccat

SEQ ID NO: 4304863 - DNA, 20 bp, Homo sapiens
cagtgtccccaggggcacac

SEQ ID NO: 4304864 - DNA, 15 bp, Homo sapiens
cagtgtctaccttca

SEQ ID NO: 4304865 - DNA, 13 bp, Homo sapiens
cagtgtggactct

SEQ ID NO: 4304866 - DNA, 21 bp, Homo sapiens
cagtgtggactctggactggg

SEQ ID NO: 4304867 - DNA, 15 bp, Homo sapiens
cagtgttgcctcctc

SEQ ID NO: 4304868 - DNA, 18 bp, Homo sapiens
cagtgttgcctcctccca

SEQ ID NO: 4304869 - DNA, 21 bp, Homo sapiens
cagtgttgcctcctcccatcc

SEQ ID NO: 4304870 - DNA, 14 bp, Homo sapiens
cagtgttttcttgt

SEQ ID NO: 4304871 - DNA, 12 bp, Homo sapiens
cagttacacatg

SEQ ID NO: 4304872 - DNA, 13 bp, Homo sapiens
cagttaccgagga

SEQ ID NO: 4304873 - DNA, 14 bp, Homo sapiens
cagttcaatcaaac

SEQ ID NO: 4304874 - DNA, 19 bp, Homo sapiens
cagttcctgcagcagagcc

SEQ ID NO: 4304875 - DNA, 17 bp, Homo sapiens
cagttctacagaaaaac

SEQ ID NO: 4304876 - DNA, 14 bp, Homo sapiens
cagttctggaggag

SEQ ID NO: 4304877 - DNA, 22 bp, Homo sapiens
cagttgcaataaactcagtcaa

SEQ ID NO: 4304878 - DNA, 21 bp, Homo sapiens
cagttgcacagcatctcagct

SEQ ID NO: 4304879 - DNA, 14 bp, Homo sapiens
cagttggcctcagc

SEQ ID NO: 4304880 - DNA, 17 bp, Homo sapiens
cagttggcctcagcaga

SEQ ID NO: 4304881 - DNA, 17 bp, Homo sapiens
cagttggttttgcatgt

SEQ ID NO: 4304882 - DNA, 17 bp, Homo sapiens
cagtttaggacccaagg

SEQ ID NO: 4304883 - DNA, 22 bp, Homo sapiens
cagtttgcaatcttatgttgat

SEQ ID NO: 4304884 - DNA, 13 bp, Homo sapiens
cagtttgcctctg

SEQ ID NO: 4304885 - DNA, 14 bp, Homo sapiens
cagtttgcctctgc

SEQ ID NO: 4304886 - DNA, 15 bp, Homo sapiens
cagtttgcctctgca

SEQ ID NO: 4304887 - DNA, 13 bp, Homo sapiens
cataaaaataacc

SEQ ID NO: 4304888 - DNA, 15 bp, Homo sapiens
cataaagtaaatgct

SEQ ID NO: 4304889 - DNA, 22 bp, Homo sapiens
cataaagtaaatgctacctctg

SEQ ID NO: 4304890 - DNA, 15 bp, Homo sapiens
cataaatctgtctga

SEQ ID NO: 4304891 - DNA, 21 bp, Homo sapiens
cataaatctgtctgattctat

SEQ ID NO: 4304892 - DNA, 17 bp, Homo sapiens
cataaccgcacagacat

SEQ ID NO: 4304893 - DNA, 18 bp, Homo sapiens
cataaccttaccagattt

SEQ ID NO: 4304894 - DNA, 22 bp, Homo sapiens
cataactaatacagctgagcta

SEQ ID NO: 4304895 - DNA, 20 bp, Homo sapiens
cataatatcttgaagaatat

SEQ ID NO: 4304896 - DNA, 18 bp, Homo sapiens
cataccatggaggaaggc

SEQ ID NO: 4304897 - DNA, 12 bp, Homo sapiens
catacccagtgt

SEQ ID NO: 4304898 - DNA, 14 bp, Homo sapiens
cataccccctgccc

SEQ ID NO: 4304899 - DNA, 22 bp, Homo sapiens
catacctctctctatatataca

SEQ ID NO: 4304900 - DNA, 23 bp, Homo sapiens
catacctctctctatatatacat

SEQ ID NO: 4304901 - DNA, 15 bp, Homo sapiens
catactctccaggat

SEQ ID NO: 4304902 - DNA, 23 bp, Homo sapiens
catactctccaggattgtccaca

SEQ ID NO: 4304903 - DNA, 24 bp, Homo sapiens
catactctccaggattgtccacaa

SEQ ID NO: 4304904 - DNA, 22 bp, Homo sapiens
catactctgtgtaatctctgat

SEQ ID NO: 4304905 - DNA, 20 bp, Homo sapiens
catacttcctggattttctt

SEQ ID NO: 4304906 - DNA, 13 bp, Homo sapiens
catactttccaac

SEQ ID NO: 4304907 - DNA, 21 bp, Homo sapiens
catactttccaacattatcct

SEQ ID NO: 4304908 - DNA, 22 bp, Homo sapiens
catactttccaacattatcctg

SEQ ID NO: 4304909 - DNA, 13 bp, Homo sapiens
catagatgcctgg

SEQ ID NO: 4304910 - DNA, 15 bp, Homo sapiens
catagatgcctgggc

SEQ ID NO: 4304911 - DNA, 14 bp, Homo sapiens
cataggcagagccc

SEQ ID NO: 4304912 - DNA, 19 bp, Homo sapiens
catagtcaatcaaacaggg

SEQ ID NO: 4304913 - DNA, 14 bp, Homo sapiens
catagtctttgttt

SEQ ID NO: 4304914 - DNA, 22 bp, Homo sapiens
catagtctttgtttacatgagt

SEQ ID NO: 4304915 - DNA, 19 bp, Homo sapiens
catagtgatggttcccctg

SEQ ID NO: 4304916 - DNA, 22 bp, Homo sapiens
catagtgatggttcccctgttc

SEQ ID NO: 4304917 - DNA, 17 bp, Homo sapiens
catatagtttgttttct

SEQ ID NO: 4304918 - DNA, 18 bp, Homo sapiens
catatagtttgttttctt

SEQ ID NO: 4304919 - DNA, 17 bp, Homo sapiens
catatcaagtcccgagg

SEQ ID NO: 4304920 - DNA, 12 bp, Homo sapiens
catatcccggga

SEQ ID NO: 4304921 - DNA, 16 bp, Homo sapiens
catatcccgggagcag

SEQ ID NO: 4304922 - DNA, 15 bp, Homo sapiens
catatcctggtgtct

SEQ ID NO: 4304923 - DNA, 19 bp, Homo sapiens
catatcctggtgtctagtt

SEQ ID NO: 4304924 - DNA, 16 bp, Homo sapiens
catatgacaatttcaa

SEQ ID NO: 4304925 - DNA, 21 bp, Homo sapiens
catatgacaatttcaaaatgc

SEQ ID NO: 4304926 - DNA, 23 bp, Homo sapiens
catatgacaatttcaaaatgcat

SEQ ID NO: 4304927 - DNA, 16 bp, Homo sapiens
catatgattgaaaaga

SEQ ID NO: 4304928 - DNA, 22 bp, Homo sapiens
catatggaaatcctgttactta

SEQ ID NO: 4304929 - DNA, 12 bp, Homo sapiens
catattgacttt

SEQ ID NO: 4304930 - DNA, 22 bp, Homo sapiens
catcaaagtgtttaattgtata

SEQ ID NO: 4304931 - DNA, 13 bp, Homo sapiens
catcagcagtgat

SEQ ID NO: 4304932 - DNA, 14 bp, Homo sapiens
catcagcagtgatt

SEQ ID NO: 4304933 - DNA, 16 bp, Homo sapiens
catcagcccctgctgc

SEQ ID NO: 4304934 - DNA, 18 bp, Homo sapiens
catcagtggcatggctcc

SEQ ID NO: 4304935 - DNA, 21 bp, Homo sapiens
catcatgtaatagtggctttc

SEQ ID NO: 4304936 - DNA, 21 bp, Homo sapiens
catcattttcacctccatttc

SEQ ID NO: 4304937 - DNA, 19 bp, Homo sapiens
catccaacatttcctcagg

SEQ ID NO: 4304938 - DNA, 20 bp, Homo sapiens
catccactaggtgcccagtc

SEQ ID NO: 4304939 - DNA, 17 bp, Homo sapiens
catccatccctggtgaa

SEQ ID NO: 4304940 - DNA, 23 bp, Homo sapiens
catccatccctggtgaaagagta

SEQ ID NO: 4304941 - DNA, 21 bp, Homo sapiens
catccatgcggccggcctggg

SEQ ID NO: 4304942 - DNA, 14 bp, Homo sapiens
catccattccagag

SEQ ID NO: 4304943 - DNA, 15 bp, Homo sapiens
catccattccagagc

SEQ ID NO: 4304944 - DNA, 20 bp, Homo sapiens
catcccagtggcctcaaccc

SEQ ID NO: 4304945 - DNA, 17 bp, Homo sapiens
catcccggggccatgga

SEQ ID NO: 4304946 - DNA, 20 bp, Homo sapiens
catcccggggccatggaagc

SEQ ID NO: 4304947 - DNA, 13 bp, Homo sapiens
catccctccaccc

SEQ ID NO: 4304948 - DNA, 13 bp, Homo sapiens
catcccttggccc

SEQ ID NO: 4304949 - DNA, 17 bp, Homo sapiens
catcccttggcccctct

SEQ ID NO: 4304950 - DNA, 16 bp, Homo sapiens
catccggcccccagag

SEQ ID NO: 4304951 - DNA, 15 bp, Homo sapiens
catcctcagccccag

SEQ ID NO: 4304952 - DNA, 16 bp, Homo sapiens
catcctcagccccagg

SEQ ID NO: 4304953 - DNA, 19 bp, Homo sapiens
catcctccccttccctgca

SEQ ID NO: 4304954 - DNA, 22 bp, Homo sapiens
catcctgccttcatggaactca

SEQ ID NO: 4304955 - DNA, 11 bp, Homo sapiens
catcctgggca

SEQ ID NO: 4304956 - DNA, 17 bp, Homo sapiens
catcctgtacaagtgct

SEQ ID NO: 4304957 - DNA, 12 bp, Homo sapiens
catcgccttctg

SEQ ID NO: 4304958 - DNA, 14 bp, Homo sapiens
catcgccttctggc

SEQ ID NO: 4304959 - DNA, 22 bp, Homo sapiens
catcgccttctggccgctgcag

SEQ ID NO: 4304960 - DNA, 15 bp, Homo sapiens
catcgccttctgggg

SEQ ID NO: 4304961 - DNA, 16 bp, Homo sapiens
catcggttcaggagga

SEQ ID NO: 4304962 - DNA, 19 bp, Homo sapiens
catcggttcaggaggagac

SEQ ID NO: 4304963 - DNA, 19 bp, Homo sapiens
catctagaggcttccttca

SEQ ID NO: 4304964 - DNA, 22 bp, Homo sapiens
catctagaggcttccttcattt

SEQ ID NO: 4304965 - DNA, 13 bp, Homo sapiens
catctcagcccac

SEQ ID NO: 4304966 - DNA, 12 bp, Homo sapiens
catctcatcatg

SEQ ID NO: 4304967 - DNA, 14 bp, Homo sapiens
catctctgactttc

SEQ ID NO: 4304968 - DNA, 19 bp, Homo sapiens
catctctggagtgtgtggg

SEQ ID NO: 4304969 - DNA, 12 bp, Homo sapiens
catctgaaaaga

SEQ ID NO: 4304970 - DNA, 15 bp, Homo sapiens
catctgaaaagaaat

SEQ ID NO: 4304971 - DNA, 23 bp, Homo sapiens
catctgagaaaagctttgaaccc

SEQ ID NO: 4304972 - DNA, 14 bp, Homo sapiens
catctgtctgtcct

SEQ ID NO: 4304973 - DNA, 19 bp, Homo sapiens
catcttagggtaggggaag

SEQ ID NO: 4304974 - DNA, 23 bp, Homo sapiens
catcttccccaacgaaaagcaca

SEQ ID NO: 4304975 - DNA, 12 bp, Homo sapiens
catctttccaaa

SEQ ID NO: 4304976 - DNA, 16 bp, Homo sapiens
catgaaaaacagcaga

SEQ ID NO: 4304977 - DNA, 15 bp, Homo sapiens
catgaacactggctg

SEQ ID NO: 4304978 - DNA, 19 bp, Homo sapiens
catgaacctcaagctgcat

SEQ ID NO: 4304979 - DNA, 20 bp, Homo sapiens
catgaacctcaagctgcatc

SEQ ID NO: 4304980 - DNA, 14 bp, Homo sapiens
catgacaagcccca

SEQ ID NO: 4304981 - DNA, 20 bp, Homo sapiens
catgacaagccccaggcagg

SEQ ID NO: 4304982 - DNA, 15 bp, Homo sapiens
catgaccctggagcc

SEQ ID NO: 4304983 - DNA, 21 bp, Homo sapiens
catgactagggtcctcaggca

SEQ ID NO: 4304984 - DNA, 16 bp, Homo sapiens
catgactggtgcgttc

SEQ ID NO: 4304985 - DNA, 23 bp, Homo sapiens
catgactggtgcgttcctaaact

SEQ ID NO: 4304986 - DNA, 22 bp, Homo sapiens
catgacttctttactaacactg

SEQ ID NO: 4304987 - DNA, 15 bp, Homo sapiens
catgagctccagacc

SEQ ID NO: 4304988 - DNA, 16 bp, Homo sapiens
catgagctccagaccc

SEQ ID NO: 4304989 - DNA, 14 bp, Homo sapiens
catgagtcccagtg

SEQ ID NO: 4304990 - DNA, 22 bp, Homo sapiens
catgagttttttctcttgggct

SEQ ID NO: 4304991 - DNA, 19 bp, Homo sapiens
catgatataactttagaaa

SEQ ID NO: 4304992 - DNA, 14 bp, Homo sapiens
catgatattgtatg

SEQ ID NO: 4304993 - DNA, 16 bp, Homo sapiens
catgatattgtatgta

SEQ ID NO: 4304994 - DNA, 17 bp, Homo sapiens
catgatcacttatcagt

SEQ ID NO: 4304995 - DNA, 16 bp, Homo sapiens
catgatgatttcagaa

SEQ ID NO: 4304996 - DNA, 19 bp, Homo sapiens
catgatggagtcaggtttg

SEQ ID NO: 4304997 - DNA, 14 bp, Homo sapiens
catgattcatttta

SEQ ID NO: 4304998 - DNA, 15 bp, Homo sapiens
catgattccaagggc

SEQ ID NO: 4304999 - DNA, 21 bp, Homo sapiens
catgattccaagggcccagag

SEQ ID NO: 4305000 - DNA, 22 bp, Homo sapiens
catgattccaagggcccagagg

SEQ ID NO: 4305001 - DNA, 21 bp, Homo sapiens
catgattcgcccaaagccaga

SEQ ID NO: 4305002 - DNA, 15 bp, Homo sapiens
catgattttggccac

SEQ ID NO: 4305003 - DNA, 14 bp, Homo sapiens
catgcaagctcagg

SEQ ID NO: 4305004 - DNA, 19 bp, Homo sapiens
catgcagatctagccaggc

SEQ ID NO: 4305005 - DNA, 21 bp, Homo sapiens
catgcagatctagccaggcct

SEQ ID NO: 4305006 - DNA, 15 bp, Homo sapiens
catgcagggccccca

SEQ ID NO: 4305007 - DNA, 20 bp, Homo sapiens
catgcagggcccccacagga

SEQ ID NO: 4305008 - DNA, 21 bp, Homo sapiens
catgcagggcccccacaggag

SEQ ID NO: 4305009 - DNA, 23 bp, Homo sapiens
catgcagtctaaaatgcttcagt

SEQ ID NO: 4305010 - DNA, 13 bp, Homo sapiens
catgcatggcctc

SEQ ID NO: 4305011 - DNA, 22 bp, Homo sapiens
catgcatggcctcccagccacc

SEQ ID NO: 4305012 - DNA, 17 bp, Homo sapiens
catgcattactgcatgc

SEQ ID NO: 4305013 - DNA, 19 bp, Homo sapiens
catgccccactctgctgag

SEQ ID NO: 4305014 - DNA, 22 bp, Homo sapiens
catgccccactctgctgaggcc

SEQ ID NO: 4305015 - DNA, 20 bp, Homo sapiens
catgcctgagaatgcctagg

SEQ ID NO: 4305016 - DNA, 10 bp, Homo sapiens
catgcctggg

SEQ ID NO: 4305017 - DNA, 19 bp, Homo sapiens
catgcctggggtggaggct

SEQ ID NO: 4305018 - DNA, 23 bp, Homo sapiens
catgcctgtgtgacatcagtggc

SEQ ID NO: 4305019 - DNA, 17 bp, Homo sapiens
catgcggccggcctggg

SEQ ID NO: 4305020 - DNA, 19 bp, Homo sapiens
catgcggccggcctggggc

SEQ ID NO: 4305021 - DNA, 22 bp, Homo sapiens
catgcgtgggtggggagggagg

SEQ ID NO: 4305022 - DNA, 17 bp, Homo sapiens
catgctcccaaatgcag

SEQ ID NO: 4305023 - DNA, 20 bp, Homo sapiens
catgctcctctgcctgtgcc

SEQ ID NO: 4305024 - DNA, 21 bp, Homo sapiens
catgctcctctgcctgtgccc

SEQ ID NO: 4305025 - DNA, 11 bp, Homo sapiens
catgctgccca

SEQ ID NO: 4305026 - DNA, 13 bp, Homo sapiens
catgctgcccacc

SEQ ID NO: 4305027 - DNA, 22 bp, Homo sapiens
catgctgcccaccccctgctgg

SEQ ID NO: 4305028 - DNA, 23 bp, Homo sapiens
catgctgcctgcctccggccctg

SEQ ID NO: 4305029 - DNA, 22 bp, Homo sapiens
catgctgtctgtgtgaggctcc

SEQ ID NO: 4305030 - DNA, 22 bp, Homo sapiens
catggaaaaatgccatcaaatg

SEQ ID NO: 4305031 - DNA, 23 bp, Homo sapiens
catggaaacaagatgaaattcca

SEQ ID NO: 4305032 - DNA, 18 bp, Homo sapiens
catggaagctggcaggag

SEQ ID NO: 4305033 - DNA, 17 bp, Homo sapiens
catggacagggccaggg

SEQ ID NO: 4305034 - DNA, 19 bp, Homo sapiens
catggaggcgccttcctgg

SEQ ID NO: 4305035 - DNA, 21 bp, Homo sapiens
catggaggcgccttcctgggt

SEQ ID NO: 4305036 - DNA, 18 bp, Homo sapiens
catggcacactgccctct

SEQ ID NO: 4305037 - DNA, 13 bp, Homo sapiens
catggccacatcc

SEQ ID NO: 4305038 - DNA, 13 bp, Homo sapiens
catggccaggtgg

SEQ ID NO: 4305039 - DNA, 22 bp, Homo sapiens
catggccgttgcctctctgcca

SEQ ID NO: 4305040 - DNA, 13 bp, Homo sapiens
catggcctcccag

SEQ ID NO: 4305041 - DNA, 14 bp, Homo sapiens
catggcctcccagc

SEQ ID NO: 4305042 - DNA, 17 bp, Homo sapiens
catggcctcccagccac

SEQ ID NO: 4305043 - DNA, 18 bp, Homo sapiens
catggcctcccagccacc

SEQ ID NO: 4305044 - DNA, 13 bp, Homo sapiens
catggctccagtc

SEQ ID NO: 4305045 - DNA, 20 bp, Homo sapiens
catggctccagtctgctgcc

SEQ ID NO: 4305046 - DNA, 16 bp, Homo sapiens
catggctcctcaccac

SEQ ID NO: 4305047 - DNA, 18 bp, Homo sapiens
catgggcacctctgctgt

SEQ ID NO: 4305048 - DNA, 14 bp, Homo sapiens
catggggaggggag

SEQ ID NO: 4305049 - DNA, 16 bp, Homo sapiens
catggggtgggcctct

SEQ ID NO: 4305050 - DNA, 17 bp, Homo sapiens
catggggtgggcctctg

SEQ ID NO: 4305051 - DNA, 19 bp, Homo sapiens
catggggtgggcctctggt

SEQ ID NO: 4305052 - DNA, 19 bp, Homo sapiens
catggggttggctgggccc

SEQ ID NO: 4305053 - DNA, 15 bp, Homo sapiens
catggtagactgtga

SEQ ID NO: 4305054 - DNA, 22 bp, Homo sapiens
catggtagcagggtctttgtgt

SEQ ID NO: 4305055 - DNA, 22 bp, Homo sapiens
catggtgttggaggggcaggcc

SEQ ID NO: 4305056 - DNA, 15 bp, Homo sapiens
catgtaagaaataag

SEQ ID NO: 4305057 - DNA, 18 bp, Homo sapiens
catgtaatagtggctttc

SEQ ID NO: 4305058 - DNA, 19 bp, Homo sapiens
catgtagaagagggagaag

SEQ ID NO: 4305059 - DNA, 21 bp, Homo sapiens
catgtatagtgagtgtggctt

SEQ ID NO: 4305060 - DNA, 14 bp, Homo sapiens
catgtcaagattca

SEQ ID NO: 4305061 - DNA, 17 bp, Homo sapiens
catgtcaagattcagct

SEQ ID NO: 4305062 - DNA, 12 bp, Homo sapiens
catgtctactgc

SEQ ID NO: 4305063 - DNA, 21 bp, Homo sapiens
catgtctttggcttcagaatt

SEQ ID NO: 4305064 - DNA, 22 bp, Homo sapiens
catgtgattggcagcttcaaaa

SEQ ID NO: 4305065 - DNA, 18 bp, Homo sapiens
catgtggaaaactcacag

SEQ ID NO: 4305066 - DNA, 19 bp, Homo sapiens
catgtgtcagctgtagaaa

SEQ ID NO: 4305067 - DNA, 17 bp, Homo sapiens
catgtgttgcaaattat

SEQ ID NO: 4305068 - DNA, 23 bp, Homo sapiens
catgtgttgcaaattattctagt

SEQ ID NO: 4305069 - DNA, 19 bp, Homo sapiens
catgtgtttggttctgggg

SEQ ID NO: 4305070 - DNA, 18 bp, Homo sapiens
catgttaattgatagaat

SEQ ID NO: 4305071 - DNA, 20 bp, Homo sapiens
cattaaaagaagactggaag

SEQ ID NO: 4305072 - DNA, 17 bp, Homo sapiens
cattaaagtgcactgtg

SEQ ID NO: 4305073 - DNA, 22 bp, Homo sapiens
cattaatccacatgtttcagag

SEQ ID NO: 4305074 - DNA, 16 bp, Homo sapiens
cattaatgaaatacca

SEQ ID NO: 4305075 - DNA, 18 bp, Homo sapiens
cattagaattaccatttg

SEQ ID NO: 4305076 - DNA, 14 bp, Homo sapiens
cattagcccactgc

SEQ ID NO: 4305077 - DNA, 23 bp, Homo sapiens
cattaggaacagagtatatatgt

SEQ ID NO: 4305078 - DNA, 11 bp, Homo sapiens
cattagtatcc

SEQ ID NO: 4305079 - DNA, 20 bp, Homo sapiens
cattatggctttgtgcttgt

SEQ ID NO: 4305080 - DNA, 23 bp, Homo sapiens
cattattacttttcctcttagaa

SEQ ID NO: 4305081 - DNA, 23 bp, Homo sapiens
cattatttcaaccgcttgccata

SEQ ID NO: 4305082 - DNA, 22 bp, Homo sapiens
cattattttcccacaattcttt

SEQ ID NO: 4305083 - DNA, 20 bp, Homo sapiens
cattcaaaaacatggccaca

SEQ ID NO: 4305084 - DNA, 14 bp, Homo sapiens
cattcaaaaatttc

SEQ ID NO: 4305085 - DNA, 22 bp, Homo sapiens
cattcaaaatagttctatttct

SEQ ID NO: 4305086 - DNA, 23 bp, Homo sapiens
cattcaaaatagttctatttcta

SEQ ID NO: 4305087 - DNA, 21 bp, Homo sapiens
cattcccttctctcagcctcc

SEQ ID NO: 4305088 - DNA, 22 bp, Homo sapiens
cattccgacaaccgatgctcca

SEQ ID NO: 4305089 - DNA, 19 bp, Homo sapiens
cattcctcccattcaagat

SEQ ID NO: 4305090 - DNA, 21 bp, Homo sapiens
cattctagagtgcatatattt

SEQ ID NO: 4305091 - DNA, 14 bp, Homo sapiens
cattctcactccta

SEQ ID NO: 4305092 - DNA, 17 bp, Homo sapiens
cattctcactcctacct

SEQ ID NO: 4305093 - DNA, 22 bp, Homo sapiens
cattctccaggggtttacagtg

SEQ ID NO: 4305094 - DNA, 15 bp, Homo sapiens
cattctccccagtgt

SEQ ID NO: 4305095 - DNA, 20 bp, Homo sapiens
cattctgaaggccttgttaa

SEQ ID NO: 4305096 - DNA, 20 bp, Homo sapiens
cattctgctgcccccagacc

SEQ ID NO: 4305097 - DNA, 14 bp, Homo sapiens
cattctggctccac

SEQ ID NO: 4305098 - DNA, 16 bp, Homo sapiens
cattctggggtggggc

SEQ ID NO: 4305099 - DNA, 20 bp, Homo sapiens
cattctggggtggggcttgg

SEQ ID NO: 4305100 - DNA, 15 bp, Homo sapiens
cattctgtcttgaag

SEQ ID NO: 4305101 - DNA, 13 bp, Homo sapiens
cattcttatttta

SEQ ID NO: 4305102 - DNA, 13 bp, Homo sapiens
cattcttcaagat

SEQ ID NO: 4305103 - DNA, 19 bp, Homo sapiens
cattctttataaaccataa

SEQ ID NO: 4305104 - DNA, 21 bp, Homo sapiens
cattctttataaaccataaaa

SEQ ID NO: 4305105 - DNA, 23 bp, Homo sapiens
cattgacaaggtgtttctctgta

SEQ ID NO: 4305106 - DNA, 22 bp, Homo sapiens
cattgagggaaaacataatatc

SEQ ID NO: 4305107 - DNA, 19 bp, Homo sapiens
cattgcaaaaggttaagcc

SEQ ID NO: 4305108 - DNA, 16 bp, Homo sapiens
cattgcccacacctgc

SEQ ID NO: 4305109 - DNA, 14 bp, Homo sapiens
cattgccctgaggg

SEQ ID NO: 4305110 - DNA, 16 bp, Homo sapiens
cattgccctgaggggc

SEQ ID NO: 4305111 - DNA, 19 bp, Homo sapiens
cattgtattttactttgtg

SEQ ID NO: 4305112 - DNA, 21 bp, Homo sapiens
cattgtggtgtgagcttcaga

SEQ ID NO: 4305113 - DNA, 16 bp, Homo sapiens
catttaaaatggactt

SEQ ID NO: 4305114 - DNA, 15 bp, Homo sapiens
catttaggtttctga

SEQ ID NO: 4305115 - DNA, 23 bp, Homo sapiens
catttagtcctcaccttctgttt

SEQ ID NO: 4305116 - DNA, 17 bp, Homo sapiens
catttatgagctcttca

SEQ ID NO: 4305117 - DNA, 18 bp, Homo sapiens
catttcatgtccataaaa

SEQ ID NO: 4305118 - DNA, 21 bp, Homo sapiens
catttcggtgcttccctttca

SEQ ID NO: 4305119 - DNA, 11 bp, Homo sapiens
catttcttatt

SEQ ID NO: 4305120 - DNA, 19 bp, Homo sapiens
catttcttctctctgtgct

SEQ ID NO: 4305121 - DNA, 16 bp, Homo sapiens
catttcttgggccctc

SEQ ID NO: 4305122 - DNA, 20 bp, Homo sapiens
catttgctttgtctcccgga

SEQ ID NO: 4305123 - DNA, 15 bp, Homo sapiens
catttgctttttgct

SEQ ID NO: 4305124 - DNA, 18 bp, Homo sapiens
catttgctttttgcttgt

SEQ ID NO: 4305125 - DNA, 20 bp, Homo sapiens
catttggctccactgtaaat

SEQ ID NO: 4305126 - DNA, 23 bp, Homo sapiens
catttgtaatgtatcttatttat

SEQ ID NO: 4305127 - DNA, 16 bp, Homo sapiens
cattttaacatctgag

SEQ ID NO: 4305128 - DNA, 22 bp, Homo sapiens
cattttaccatcacacatgttc

SEQ ID NO: 4305129 - DNA, 16 bp, Homo sapiens
cattttagctaattta

SEQ ID NO: 4305130 - DNA, 12 bp, Homo sapiens
cattttcctggg

SEQ ID NO: 4305131 - DNA, 13 bp, Homo sapiens
cattttcctggga

SEQ ID NO: 4305132 - DNA, 22 bp, Homo sapiens
cattttcttcagagagctaaat

SEQ ID NO: 4305133 - DNA, 14 bp, Homo sapiens
cattttgtctggct

SEQ ID NO: 4305134 - DNA, 16 bp, Homo sapiens
cattttgtctggctgt

SEQ ID NO: 4305135 - DNA, 21 bp, Homo sapiens
cattttgtctggctgtggccc

SEQ ID NO: 4305136 - DNA, 14 bp, Homo sapiens
ccaaaacccatcgt

SEQ ID NO: 4305137 - DNA, 13 bp, Homo sapiens
ccaaaactgccta

SEQ ID NO: 4305138 - DNA, 22 bp, Homo sapiens
ccaaaagctagaggagattgct

SEQ ID NO: 4305139 - DNA, 22 bp, Homo sapiens
ccaaaagctgctttccatggca

SEQ ID NO: 4305140 - DNA, 16 bp, Homo sapiens
ccaaaagtacttaccc

SEQ ID NO: 4305141 - DNA, 20 bp, Homo sapiens
ccaaacactttacagttctg

SEQ ID NO: 4305142 - DNA, 17 bp, Homo sapiens
ccaaagaaccccaggca

SEQ ID NO: 4305143 - DNA, 13 bp, Homo sapiens
ccaaagagaaaag

SEQ ID NO: 4305144 - DNA, 16 bp, Homo sapiens
ccaaataaactcctta

SEQ ID NO: 4305145 - DNA, 13 bp, Homo sapiens
ccaaatagggcaa

SEQ ID NO: 4305146 - DNA, 20 bp, Homo sapiens
ccaaatagggcaaagaatca

SEQ ID NO: 4305147 - DNA, 18 bp, Homo sapiens
ccaaattgatgggtgggc

SEQ ID NO: 4305148 - DNA, 16 bp, Homo sapiens
ccaaattgcagaagaa

SEQ ID NO: 4305149 - DNA, 16 bp, Homo sapiens
ccaacattatcctgtg

SEQ ID NO: 4305150 - DNA, 20 bp, Homo sapiens
ccaacattatcctgtgtgat

SEQ ID NO: 4305151 - DNA, 21 bp, Homo sapiens
ccaacattatcctgtgtgatt

SEQ ID NO: 4305152 - DNA, 18 bp, Homo sapiens
ccaaccacctctggccct

SEQ ID NO: 4305153 - DNA, 21 bp, Homo sapiens
ccaaccacctctggccctgtt

SEQ ID NO: 4305154 - DNA, 14 bp, Homo sapiens
ccaaccagcttgtc

SEQ ID NO: 4305155 - DNA, 14 bp, Homo sapiens
ccaacccatgcatg

SEQ ID NO: 4305156 - DNA, 18 bp, Homo sapiens
ccaacccatgcatggcct

SEQ ID NO: 4305157 - DNA, 14 bp, Homo sapiens
ccaaccctgcccct

SEQ ID NO: 4305158 - DNA, 16 bp, Homo sapiens
ccaaccctgcccctgc

SEQ ID NO: 4305159 - DNA, 15 bp, Homo sapiens
ccaacctcactgccc

SEQ ID NO: 4305160 - DNA, 13 bp, Homo sapiens
ccaacctcccctg

SEQ ID NO: 4305161 - DNA, 15 bp, Homo sapiens
ccaacgggtctgtgg

SEQ ID NO: 4305162 - DNA, 21 bp, Homo sapiens
ccaacgggtctgtgggactgg

SEQ ID NO: 4305163 - DNA, 16 bp, Homo sapiens
ccaactctctctgccc

SEQ ID NO: 4305164 - DNA, 19 bp, Homo sapiens
ccaactctctctgccccca

SEQ ID NO: 4305165 - DNA, 12 bp, Homo sapiens
ccaactctggcc

SEQ ID NO: 4305166 - DNA, 13 bp, Homo sapiens
ccaactgagccaa

SEQ ID NO: 4305167 - DNA, 14 bp, Homo sapiens
ccaactgagccaaa

SEQ ID NO: 4305168 - DNA, 12 bp, Homo sapiens
ccaactttccag

SEQ ID NO: 4305169 - DNA, 22 bp, Homo sapiens
ccaagccagggttccagacagg

SEQ ID NO: 4305170 - DNA, 16 bp, Homo sapiens
ccaagccgtggcttcc

SEQ ID NO: 4305171 - DNA, 22 bp, Homo sapiens
ccaagccttggggattcttcca

SEQ ID NO: 4305172 - DNA, 18 bp, Homo sapiens
ccaaggaagaacaaatat

SEQ ID NO: 4305173 - DNA, 14 bp, Homo sapiens
ccaaggacccctca

SEQ ID NO: 4305174 - DNA, 17 bp, Homo sapiens
ccaaggcaaatgtccaa

SEQ ID NO: 4305175 - DNA, 18 bp, Homo sapiens
ccaaggcaaatgtccaag

SEQ ID NO: 4305176 - DNA, 19 bp, Homo sapiens
ccaaggcctatgccacctg

SEQ ID NO: 4305177 - DNA, 21 bp, Homo sapiens
ccaaggcctatgccacctgca

SEQ ID NO: 4305178 - DNA, 23 bp, Homo sapiens
ccaaggcctatgccacctgcagc

SEQ ID NO: 4305179 - DNA, 12 bp, Homo sapiens
ccaaggctgcct

SEQ ID NO: 4305180 - DNA, 15 bp, Homo sapiens
ccaaggctgcctgcc

SEQ ID NO: 4305181 - DNA, 22 bp, Homo sapiens
ccaaggtggtcttggagaggag

SEQ ID NO: 4305182 - DNA, 23 bp, Homo sapiens
ccaaggtggtcttggagaggagg

SEQ ID NO: 4305183 - DNA, 24 bp, Homo sapiens
ccaaggtggtcttggagaggaggt

SEQ ID NO: 4305184 - DNA, 21 bp, Homo sapiens
ccaagtcagctttgccttcca

SEQ ID NO: 4305185 - DNA, 16 bp, Homo sapiens
ccaagtgcaggctggc

SEQ ID NO: 4305186 - DNA, 12 bp, Homo sapiens
ccaagtgtcctg

SEQ ID NO: 4305187 - DNA, 19 bp, Homo sapiens
ccaatcacgagatcttcct

SEQ ID NO: 4305188 - DNA, 17 bp, Homo sapiens
ccaatccaacccatgca

SEQ ID NO: 4305189 - DNA, 22 bp, Homo sapiens
ccaatccaacccatgcatggcc

SEQ ID NO: 4305190 - DNA, 17 bp, Homo sapiens
ccaatgaagcaaacaca

SEQ ID NO: 4305191 - DNA, 17 bp, Homo sapiens
ccaatgattcataacaa

SEQ ID NO: 4305192 - DNA, 21 bp, Homo sapiens
ccaatggagactgtctcaaga

SEQ ID NO: 4305193 - DNA, 14 bp, Homo sapiens
ccaatgtgcccagt

SEQ ID NO: 4305194 - DNA, 12 bp, Homo sapiens
ccacaaatgtcc

SEQ ID NO: 4305195 - DNA, 13 bp, Homo sapiens
ccacaaattcatg

SEQ ID NO: 4305196 - DNA, 18 bp, Homo sapiens
ccacaaggctgaaaagtg

SEQ ID NO: 4305197 - DNA, 21 bp, Homo sapiens
ccacacacacccttccccact

SEQ ID NO: 4305198 - DNA, 11 bp, Homo sapiens
ccacacaggcc

SEQ ID NO: 4305199 - DNA, 23 bp, Homo sapiens
ccacacaggcctggcccagccag

SEQ ID NO: 4305200 - DNA, 17 bp, Homo sapiens
ccacacgtttgccaaat

SEQ ID NO: 4305201 - DNA, 16 bp, Homo sapiens
ccacacttcaggctct

SEQ ID NO: 4305202 - DNA, 16 bp, Homo sapiens
ccacacttcctgtcca

SEQ ID NO: 4305203 - DNA, 21 bp, Homo sapiens
ccacacttcctgtccagagag

SEQ ID NO: 4305204 - DNA, 21 bp, Homo sapiens
ccacagaagacacgtgttttt

SEQ ID NO: 4305205 - DNA, 14 bp, Homo sapiens
ccacagccctgtca

SEQ ID NO: 4305206 - DNA, 20 bp, Homo sapiens
ccacagccctgtcagtgcag

SEQ ID NO: 4305207 - DNA, 20 bp, Homo sapiens
ccacaggagcatgtcctatc

SEQ ID NO: 4305208 - DNA, 15 bp, Homo sapiens
ccacaggagcgtgta

SEQ ID NO: 4305209 - DNA, 17 bp, Homo sapiens
ccacaggagcgtgtact

SEQ ID NO: 4305210 - DNA, 21 bp, Homo sapiens
ccacaggatgaactagccatg

SEQ ID NO: 4305211 - DNA, 16 bp, Homo sapiens
ccacaggcccttcctc

SEQ ID NO: 4305212 - DNA, 18 bp, Homo sapiens
ccacaggcccttcctctc

SEQ ID NO: 4305213 - DNA, 13 bp, Homo sapiens
ccacatgagtccc

SEQ ID NO: 4305214 - DNA, 17 bp, Homo sapiens
ccacatgagtcccagtg

SEQ ID NO: 4305215 - DNA, 19 bp, Homo sapiens
ccacatgagtcccagtggg

SEQ ID NO: 4305216 - DNA, 22 bp, Homo sapiens
ccacatgagtcccagtgggagg

SEQ ID NO: 4305217 - DNA, 20 bp, Homo sapiens
ccacattctgctgcccccag

SEQ ID NO: 4305218 - DNA, 22 bp, Homo sapiens
ccacattctgctgcccccagac

SEQ ID NO: 4305219 - DNA, 23 bp, Homo sapiens
ccacattctgctgcccccagacc

SEQ ID NO: 4305220 - DNA, 18 bp, Homo sapiens
ccacattctggctccacc

SEQ ID NO: 4305221 - DNA, 23 bp, Homo sapiens
ccacatttctggccatttaacta

SEQ ID NO: 4305222 - DNA, 22 bp, Homo sapiens
ccaccaactctctctgccccca

SEQ ID NO: 4305223 - DNA, 21 bp, Homo sapiens
ccaccaaggctgcctgcccca

SEQ ID NO: 4305224 - DNA, 19 bp, Homo sapiens
ccaccaagggtatctgctg

SEQ ID NO: 4305225 - DNA, 15 bp, Homo sapiens
ccaccagcagcacaa

SEQ ID NO: 4305226 - DNA, 16 bp, Homo sapiens
ccaccagcagcacaat

SEQ ID NO: 4305227 - DNA, 23 bp, Homo sapiens
ccaccagcagcacaattctgtcc

SEQ ID NO: 4305228 - DNA, 21 bp, Homo sapiens
ccaccagctggctctgcagca

SEQ ID NO: 4305229 - DNA, 12 bp, Homo sapiens
ccaccccagtcc

SEQ ID NO: 4305230 - DNA, 14 bp, Homo sapiens
ccaccccagtcccc

SEQ ID NO: 4305231 - DNA, 13 bp, Homo sapiens
ccacccccctcat

SEQ ID NO: 4305232 - DNA, 19 bp, Homo sapiens
ccacccccgggtgcctgtg

SEQ ID NO: 4305233 - DNA, 22 bp, Homo sapiens
ccaccccctccctggcctgttc

SEQ ID NO: 4305234 - DNA, 15 bp, Homo sapiens
ccaccccgcctctgg

SEQ ID NO: 4305235 - DNA, 21 bp, Homo sapiens
ccaccccgttgttgtccctgc

SEQ ID NO: 4305236 - DNA, 19 bp, Homo sapiens
ccacccggatctccaggcc

SEQ ID NO: 4305237 - DNA, 23 bp, Homo sapiens
ccacccggatctccaggcccagc

SEQ ID NO: 4305238 - DNA, 18 bp, Homo sapiens
ccacccgtttccaagcct

SEQ ID NO: 4305239 - DNA, 18 bp, Homo sapiens
ccaccctctgcagggcag

SEQ ID NO: 4305240 - DNA, 12 bp, Homo sapiens
ccaccctctggt

SEQ ID NO: 4305241 - DNA, 14 bp, Homo sapiens
ccaccgctccccag

SEQ ID NO: 4305242 - DNA, 18 bp, Homo sapiens
ccacctctggccctgttg

SEQ ID NO: 4305243 - DNA, 20 bp, Homo sapiens
ccacctgcagccccaggcct

SEQ ID NO: 4305244 - DNA, 13 bp, Homo sapiens
ccacctgcagcgt

SEQ ID NO: 4305245 - DNA, 15 bp, Homo sapiens
ccacctgcagcgtct

SEQ ID NO: 4305246 - DNA, 12 bp, Homo sapiens
ccacctgccccc

SEQ ID NO: 4305247 - DNA, 22 bp, Homo sapiens
ccacctgcccccttctcccaca

SEQ ID NO: 4305248 - DNA, 12 bp, Homo sapiens
ccacctgctgcc

SEQ ID NO: 4305249 - DNA, 17 bp, Homo sapiens
ccacctgctgcccgtga

SEQ ID NO: 4305250 - DNA, 21 bp, Homo sapiens
ccacctgcttgtgttgggccc

SEQ ID NO: 4305251 - DNA, 19 bp, Homo sapiens
ccacctggatggatctgct

SEQ ID NO: 4305252 - DNA, 15 bp, Homo sapiens
ccacctgggagatgc

SEQ ID NO: 4305253 - DNA, 21 bp, Homo sapiens
ccacctgggagatgctgggac

SEQ ID NO: 4305254 - DNA, 13 bp, Homo sapiens
ccacctgggccct

SEQ ID NO: 4305255 - DNA, 16 bp, Homo sapiens
ccacctgggccctagg

SEQ ID NO: 4305256 - DNA, 18 bp, Homo sapiens
ccacctgggccctaggca

SEQ ID NO: 4305257 - DNA, 12 bp, Homo sapiens
ccacctgtgctg

SEQ ID NO: 4305258 - DNA, 14 bp, Homo sapiens
ccacctgtgctgct

SEQ ID NO: 4305259 - DNA, 16 bp, Homo sapiens
ccacctgtgctgctgc

SEQ ID NO: 4305260 - DNA, 11 bp, Homo sapiens
ccaccttccct

SEQ ID NO: 4305261 - DNA, 20 bp, Homo sapiens
ccaccttccctccacctgct

SEQ ID NO: 4305262 - DNA, 15 bp, Homo sapiens
ccacgccctcctccc

SEQ ID NO: 4305263 - DNA, 17 bp, Homo sapiens
ccacgccctcctccctc

SEQ ID NO: 4305264 - DNA, 22 bp, Homo sapiens
ccacgccctcctccctccgcta

SEQ ID NO: 4305265 - DNA, 16 bp, Homo sapiens
ccacgcctctctcagc

SEQ ID NO: 4305266 - DNA, 19 bp, Homo sapiens
ccacgcctctctcagccca

SEQ ID NO: 4305267 - DNA, 13 bp, Homo sapiens
ccacgcgctctgc

SEQ ID NO: 4305268 - DNA, 14 bp, Homo sapiens
ccacgctcctgccc

SEQ ID NO: 4305269 - DNA, 15 bp, Homo sapiens
ccacgctgtctccag

SEQ ID NO: 4305270 - DNA, 14 bp, Homo sapiens
ccacggccactgca

SEQ ID NO: 4305271 - DNA, 14 bp, Homo sapiens
ccacgggcgaggac

SEQ ID NO: 4305272 - DNA, 17 bp, Homo sapiens
ccacgggggaggccgag

SEQ ID NO: 4305273 - DNA, 22 bp, Homo sapiens
ccacgggggaggccgaggcagg

SEQ ID NO: 4305274 - DNA, 16 bp, Homo sapiens
ccacgtgctggagagt

SEQ ID NO: 4305275 - DNA, 14 bp, Homo sapiens
ccactaggccctgg

SEQ ID NO: 4305276 - DNA, 18 bp, Homo sapiens
ccactaggccctggtctg

SEQ ID NO: 4305277 - DNA, 16 bp, Homo sapiens
ccactcaggcagcctg

SEQ ID NO: 4305278 - DNA, 18 bp, Homo sapiens
ccactcaggcagcctgtg

SEQ ID NO: 4305279 - DNA, 20 bp, Homo sapiens
ccactcaggcagcctgtggg

SEQ ID NO: 4305280 - DNA, 22 bp, Homo sapiens
ccactcccaggggcctttgcag

SEQ ID NO: 4305281 - DNA, 17 bp, Homo sapiens
ccactcccctcatccac

SEQ ID NO: 4305282 - DNA, 22 bp, Homo sapiens
ccactcctcccaactctggcct

SEQ ID NO: 4305283 - DNA, 14 bp, Homo sapiens
ccactctcctgagg

SEQ ID NO: 4305284 - DNA, 13 bp, Homo sapiens
ccactctgctgag

SEQ ID NO: 4305285 - DNA, 19 bp, Homo sapiens
ccactctgctgaggccaga

SEQ ID NO: 4305286 - DNA, 13 bp, Homo sapiens
ccactgcagtcac

SEQ ID NO: 4305287 - DNA, 14 bp, Homo sapiens
ccactgcccctgca

SEQ ID NO: 4305288 - DNA, 14 bp, Homo sapiens
ccactgcctgccca

SEQ ID NO: 4305289 - DNA, 14 bp, Homo sapiens
ccactggcatctct

SEQ ID NO: 4305290 - DNA, 18 bp, Homo sapiens
ccactggctcctccagca

SEQ ID NO: 4305291 - DNA, 14 bp, Homo sapiens
ccacttatgctgct

SEQ ID NO: 4305292 - DNA, 15 bp, Homo sapiens
ccacttatttctaaa

SEQ ID NO: 4305293 - DNA, 18 bp, Homo sapiens
ccactttgcagacctggg

SEQ ID NO: 4305294 - DNA, 19 bp, Homo sapiens
ccactttgcagacctggga

SEQ ID NO: 4305295 - DNA, 20 bp, Homo sapiens
ccactttgcagacctgggac

SEQ ID NO: 4305296 - DNA, 15 bp, Homo sapiens
ccagaagggggccat

SEQ ID NO: 4305297 - DNA, 14 bp, Homo sapiens
ccagaagtggcagg

SEQ ID NO: 4305298 - DNA, 21 bp, Homo sapiens
ccagacagcaacggggaggcc

SEQ ID NO: 4305299 - DNA, 18 bp, Homo sapiens
ccagacatgctgcccacc

SEQ ID NO: 4305300 - DNA, 14 bp, Homo sapiens
ccagacattgtatt

SEQ ID NO: 4305301 - DNA, 17 bp, Homo sapiens
ccagaccccatccagcc

SEQ ID NO: 4305302 - DNA, 14 bp, Homo sapiens
ccagacccccaccc

SEQ ID NO: 4305303 - DNA, 19 bp, Homo sapiens
ccagacccccaccccttcc

SEQ ID NO: 4305304 - DNA, 22 bp, Homo sapiens
ccagacccccaccccttcccca

SEQ ID NO: 4305305 - DNA, 19 bp, Homo sapiens
ccagacccccagcaaccct

SEQ ID NO: 4305306 - DNA, 12 bp, Homo sapiens
ccagacccctac

SEQ ID NO: 4305307 - DNA, 18 bp, Homo sapiens
ccagacccctggcttttc

SEQ ID NO: 4305308 - DNA, 14 bp, Homo sapiens
ccagacctgggccc

SEQ ID NO: 4305309 - DNA, 15 bp, Homo sapiens
ccagacctgggccct

SEQ ID NO: 4305310 - DNA, 16 bp, Homo sapiens
ccagacctgggccctg

SEQ ID NO: 4305311 - DNA, 17 bp, Homo sapiens
ccagacctgggccctgg

SEQ ID NO: 4305312 - DNA, 19 bp, Homo sapiens
ccagacttcgctattccca

SEQ ID NO: 4305313 - DNA, 21 bp, Homo sapiens
ccagacttcgctattcccagg

SEQ ID NO: 4305314 - DNA, 23 bp, Homo sapiens
ccagacttcgctattcccaggca

SEQ ID NO: 4305315 - DNA, 12 bp, Homo sapiens
ccagagagaagc

SEQ ID NO: 4305316 - DNA, 20 bp, Homo sapiens
ccagagagaagcaccccacc

SEQ ID NO: 4305317 - DNA, 16 bp, Homo sapiens
ccagagagaccctgcc

SEQ ID NO: 4305318 - DNA, 18 bp, Homo sapiens
ccagagagaccctgccaa

SEQ ID NO: 4305319 - DNA, 18 bp, Homo sapiens
ccagagagagaagtgccc

SEQ ID NO: 4305320 - DNA, 19 bp, Homo sapiens
ccagagagagaagtgcccc

SEQ ID NO: 4305321 - DNA, 21 bp, Homo sapiens
ccagagagagaagtgcccctg

SEQ ID NO: 4305322 - DNA, 13 bp, Homo sapiens
ccagagccagggc

SEQ ID NO: 4305323 - DNA, 19 bp, Homo sapiens
ccagagccagggctgtcct

SEQ ID NO: 4305324 - DNA, 20 bp, Homo sapiens
ccagagccagggctgtcctt

SEQ ID NO: 4305325 - DNA, 13 bp, Homo sapiens
ccagagccatgga

SEQ ID NO: 4305326 - DNA, 14 bp, Homo sapiens
ccagagcctccctc

SEQ ID NO: 4305327 - DNA, 19 bp, Homo sapiens
ccagagcctccctcagcca

SEQ ID NO: 4305328 - DNA, 23 bp, Homo sapiens
ccagagcctccctcagccacgcc

SEQ ID NO: 4305329 - DNA, 17 bp, Homo sapiens
ccagagctcccaggacg

SEQ ID NO: 4305330 - DNA, 19 bp, Homo sapiens
ccagaggcctggtgccctg

SEQ ID NO: 4305331 - DNA, 16 bp, Homo sapiens
ccagagggcccctcac

SEQ ID NO: 4305332 - DNA, 16 bp, Homo sapiens
ccagaggtgagggagg

SEQ ID NO: 4305333 - DNA, 21 bp, Homo sapiens
ccagagtaggtgggtcttgga

SEQ ID NO: 4305334 - DNA, 21 bp, Homo sapiens
ccagatagcctagggtgaggg

SEQ ID NO: 4305335 - DNA, 16 bp, Homo sapiens
ccagatgacagggagc

SEQ ID NO: 4305336 - DNA, 14 bp, Homo sapiens
ccagatggctccct

SEQ ID NO: 4305337 - DNA, 17 bp, Homo sapiens
ccagatggctccctggg

SEQ ID NO: 4305338 - DNA, 20 bp, Homo sapiens
ccagatggctccctgggctg

SEQ ID NO: 4305339 - DNA, 21 bp, Homo sapiens
ccagatggctccctgggctgg

SEQ ID NO: 4305340 - DNA, 14 bp, Homo sapiens
ccagatggggcctc

SEQ ID NO: 4305341 - DNA, 15 bp, Homo sapiens
ccagcaaccctccta

SEQ ID NO: 4305342 - DNA, 17 bp, Homo sapiens
ccagcaatgcctgcctg

SEQ ID NO: 4305343 - DNA, 14 bp, Homo sapiens
ccagcacccatgcc

SEQ ID NO: 4305344 - DNA, 18 bp, Homo sapiens
ccagcacccatgccccac

SEQ ID NO: 4305345 - DNA, 22 bp, Homo sapiens
ccagcacccatgccccactctg

SEQ ID NO: 4305346 - DNA, 16 bp, Homo sapiens
ccagcagcacaattct

SEQ ID NO: 4305347 - DNA, 20 bp, Homo sapiens
ccagcagggcgggccaggag

SEQ ID NO: 4305348 - DNA, 18 bp, Homo sapiens
ccagcaggggcagaagga

SEQ ID NO: 4305349 - DNA, 21 bp, Homo sapiens
ccagcaggttctctcctgtga

SEQ ID NO: 4305350 - DNA, 15 bp, Homo sapiens
ccagcagtcctgggc

SEQ ID NO: 4305351 - DNA, 20 bp, Homo sapiens
ccagcatccatgcggccggc

SEQ ID NO: 4305352 - DNA, 15 bp, Homo sapiens
ccagccaccaaggct

SEQ ID NO: 4305353 - DNA, 20 bp, Homo sapiens
ccagccaccaaggctgcctg

SEQ ID NO: 4305354 - DNA, 22 bp, Homo sapiens
ccagccacccggatctccaggc

SEQ ID NO: 4305355 - DNA, 21 bp, Homo sapiens
ccagcccagggttcccccagc

SEQ ID NO: 4305356 - DNA, 17 bp, Homo sapiens
ccagccccagcgagtct

SEQ ID NO: 4305357 - DNA, 12 bp, Homo sapiens
ccagcccctccc

SEQ ID NO: 4305358 - DNA, 15 bp, Homo sapiens
ccagcccctcccacc

SEQ ID NO: 4305359 - DNA, 12 bp, Homo sapiens
ccagccctggtg

SEQ ID NO: 4305360 - DNA, 18 bp, Homo sapiens
ccagccctgtggaaggga

SEQ ID NO: 4305361 - DNA, 19 bp, Homo sapiens
ccagccgcaaatccatacc

SEQ ID NO: 4305362 - DNA, 18 bp, Homo sapiens
ccagcctcagtgcagccc

SEQ ID NO: 4305363 - DNA, 13 bp, Homo sapiens
ccagcctgtggcc

SEQ ID NO: 4305364 - DNA, 23 bp, Homo sapiens
ccagcgtctgcgcggatgtagca

SEQ ID NO: 4305365 - DNA, 20 bp, Homo sapiens
ccagctcaggctactgccac

SEQ ID NO: 4305366 - DNA, 12 bp, Homo sapiens
ccagctccaggc

SEQ ID NO: 4305367 - DNA, 15 bp, Homo sapiens
ccagctccaggcagg

SEQ ID NO: 4305368 - DNA, 16 bp, Homo sapiens
ccagctccaggcagga

SEQ ID NO: 4305369 - DNA, 19 bp, Homo sapiens
ccagctctagacaaccctg

SEQ ID NO: 4305370 - DNA, 20 bp, Homo sapiens
ccagctgcaggaatcaaaaa

SEQ ID NO: 4305371 - DNA, 23 bp, Homo sapiens
ccagctgcaggaatcaaaaattg

SEQ ID NO: 4305372 - DNA, 12 bp, Homo sapiens
ccagctgctcct

SEQ ID NO: 4305373 - DNA, 16 bp, Homo sapiens
ccagctgctcctcgca

SEQ ID NO: 4305374 - DNA, 13 bp, Homo sapiens
ccagctgcttctg

SEQ ID NO: 4305375 - DNA, 18 bp, Homo sapiens
ccagctgcttctgcccac

SEQ ID NO: 4305376 - DNA, 21 bp, Homo sapiens
ccagctgcttctgcccacccc

SEQ ID NO: 4305377 - DNA, 12 bp, Homo sapiens
ccagctggctct

SEQ ID NO: 4305378 - DNA, 17 bp, Homo sapiens
ccagctggctctgcagc

SEQ ID NO: 4305379 - DNA, 16 bp, Homo sapiens
ccaggaaaactgtttt

SEQ ID NO: 4305380 - DNA, 14 bp, Homo sapiens
ccaggaaggaagag

SEQ ID NO: 4305381 - DNA, 14 bp, Homo sapiens
ccaggacactgcct

SEQ ID NO: 4305382 - DNA, 22 bp, Homo sapiens
ccaggacactgcctttgctgcc

SEQ ID NO: 4305383 - DNA, 23 bp, Homo sapiens
ccaggacactgcctttgctgcct

SEQ ID NO: 4305384 - DNA, 15 bp, Homo sapiens
ccaggaccctgggtc

SEQ ID NO: 4305385 - DNA, 14 bp, Homo sapiens
ccaggactctgcct

SEQ ID NO: 4305386 - DNA, 20 bp, Homo sapiens
ccaggactctgccttccagg

SEQ ID NO: 4305387 - DNA, 16 bp, Homo sapiens
ccaggagaccctgtct

SEQ ID NO: 4305388 - DNA, 17 bp, Homo sapiens
ccaggagaccctgtctt

SEQ ID NO: 4305389 - DNA, 20 bp, Homo sapiens
ccaggagagcccccaccagc

SEQ ID NO: 4305390 - DNA, 21 bp, Homo sapiens
ccaggagaggagcgggacctg

SEQ ID NO: 4305391 - DNA, 16 bp, Homo sapiens
ccaggagccaggtgtc

SEQ ID NO: 4305392 - DNA, 19 bp, Homo sapiens
ccaggagccaggtgtcctg

SEQ ID NO: 4305393 - DNA, 13 bp, Homo sapiens
ccaggaggacctg

SEQ ID NO: 4305394 - DNA, 23 bp, Homo sapiens
ccaggagtgggtgggacacagag

SEQ ID NO: 4305395 - DNA, 14 bp, Homo sapiens
ccaggatgcatgca

SEQ ID NO: 4305396 - DNA, 16 bp, Homo sapiens
ccaggatgcatgcagg

SEQ ID NO: 4305397 - DNA, 11 bp, Homo sapiens
ccaggatggcg

SEQ ID NO: 4305398 - DNA, 20 bp, Homo sapiens
ccaggattaatctctaaaat

SEQ ID NO: 4305399 - DNA, 15 bp, Homo sapiens
ccaggattgtccaca

SEQ ID NO: 4305400 - DNA, 13 bp, Homo sapiens
ccaggcaatggcc

SEQ ID NO: 4305401 - DNA, 18 bp, Homo sapiens
ccaggcaggaaaccccga

SEQ ID NO: 4305402 - DNA, 18 bp, Homo sapiens
ccaggcccagcctggccc

SEQ ID NO: 4305403 - DNA, 20 bp, Homo sapiens
ccaggccccaaaaccacagc

SEQ ID NO: 4305404 - DNA, 13 bp, Homo sapiens
ccaggccccaggc

SEQ ID NO: 4305405 - DNA, 14 bp, Homo sapiens
ccaggccccaggct

SEQ ID NO: 4305406 - DNA, 19 bp, Homo sapiens
ccaggccccaggctggatg

SEQ ID NO: 4305407 - DNA, 18 bp, Homo sapiens
ccaggcctcccgcatgct

SEQ ID NO: 4305408 - DNA, 19 bp, Homo sapiens
ccaggcgccccttccccct

SEQ ID NO: 4305409 - DNA, 21 bp, Homo sapiens
ccaggcgtagggccagggctc

SEQ ID NO: 4305410 - DNA, 17 bp, Homo sapiens
ccaggctcacaactgtt

SEQ ID NO: 4305411 - DNA, 17 bp, Homo sapiens
ccaggcttcctgcccta

SEQ ID NO: 4305412 - DNA, 20 bp, Homo sapiens
ccaggcttcctgccctagca

SEQ ID NO: 4305413 - DNA, 22 bp, Homo sapiens
ccagggaatcagggagcactgg

SEQ ID NO: 4305414 - DNA, 18 bp, Homo sapiens
ccagggccatgaactttg

SEQ ID NO: 4305415 - DNA, 12 bp, Homo sapiens
ccagggccctgc

SEQ ID NO: 4305416 - DNA, 14 bp, Homo sapiens
ccagggccctgctc

SEQ ID NO: 4305417 - DNA, 21 bp, Homo sapiens
ccagggccctgctcaggcctc

SEQ ID NO: 4305418 - DNA, 22 bp, Homo sapiens
ccagggccctgctcaggcctca

SEQ ID NO: 4305419 - DNA, 13 bp, Homo sapiens
ccagggctgtcct

SEQ ID NO: 4305420 - DNA, 14 bp, Homo sapiens
ccagggctgtcctt

SEQ ID NO: 4305421 - DNA, 12 bp, Homo sapiens
ccaggggcacac

SEQ ID NO: 4305422 - DNA, 20 bp, Homo sapiens
ccagggggaagcaccagcct

SEQ ID NO: 4305423 - DNA, 18 bp, Homo sapiens
ccaggggtgagccccgcc

SEQ ID NO: 4305424 - DNA, 13 bp, Homo sapiens
ccaggggtgggga

SEQ ID NO: 4305425 - DNA, 20 bp, Homo sapiens
ccagggtcctgggggctgct

SEQ ID NO: 4305426 - DNA, 17 bp, Homo sapiens
ccagggtctcgtcagga

SEQ ID NO: 4305427 - DNA, 18 bp, Homo sapiens
ccagggttaaagaaaggc

SEQ ID NO: 4305428 - DNA, 15 bp, Homo sapiens
ccagggttcccccag

SEQ ID NO: 4305429 - DNA, 20 bp, Homo sapiens
ccagggttcccccagccctg

SEQ ID NO: 4305430 - DNA, 21 bp, Homo sapiens
ccagggttcccccagccctgt

SEQ ID NO: 4305431 - DNA, 20 bp, Homo sapiens
ccaggtctcctgggcatctg

SEQ ID NO: 4305432 - DNA, 22 bp, Homo sapiens
ccaggtctcctgggcatctggc

SEQ ID NO: 4305433 - DNA, 16 bp, Homo sapiens
ccaggtggccactcca

SEQ ID NO: 4305434 - DNA, 22 bp, Homo sapiens
ccaggtgttgtccgtgtctgtt

SEQ ID NO: 4305435 - DNA, 22 bp, Homo sapiens
ccaggtttaagtagatttcatg

SEQ ID NO: 4305436 - DNA, 21 bp, Homo sapiens
ccagtagctacggttccctgc

SEQ ID NO: 4305437 - DNA, 13 bp, Homo sapiens
ccagtccccggga

SEQ ID NO: 4305438 - DNA, 17 bp, Homo sapiens
ccagtccctctgagtga

SEQ ID NO: 4305439 - DNA, 16 bp, Homo sapiens
ccagtctgctgccctc

SEQ ID NO: 4305440 - DNA, 17 bp, Homo sapiens
ccagtctgctgccctcc

SEQ ID NO: 4305441 - DNA, 22 bp, Homo sapiens
ccagtctgctgccctccatccc

SEQ ID NO: 4305442 - DNA, 23 bp, Homo sapiens
ccagtctgctgccctccatcccg

SEQ ID NO: 4305443 - DNA, 21 bp, Homo sapiens
ccagtcttgagtgggccccct

SEQ ID NO: 4305444 - DNA, 13 bp, Homo sapiens
ccagtcttttgtc

SEQ ID NO: 4305445 - DNA, 15 bp, Homo sapiens
ccagtcttttgtcct

SEQ ID NO: 4305446 - DNA, 13 bp, Homo sapiens
ccagtgaccctgg

SEQ ID NO: 4305447 - DNA, 14 bp, Homo sapiens
ccagtgaccctgga

SEQ ID NO: 4305448 - DNA, 19 bp, Homo sapiens
ccagtgaccctggagctag

SEQ ID NO: 4305449 - DNA, 12 bp, Homo sapiens
ccagtgactcca

SEQ ID NO: 4305450 - DNA, 13 bp, Homo sapiens
ccagtgactccag

SEQ ID NO: 4305451 - DNA, 17 bp, Homo sapiens
ccagtgactgctgcgct

SEQ ID NO: 4305452 - DNA, 18 bp, Homo sapiens
ccagtgactgctgcgctg

SEQ ID NO: 4305453 - DNA, 19 bp, Homo sapiens
ccagtgactgctgcgctgt

SEQ ID NO: 4305454 - DNA, 23 bp, Homo sapiens
ccagtgactgctgcgctgtgctg

SEQ ID NO: 4305455 - DNA, 18 bp, Homo sapiens
ccagtgagagtgaggccc

SEQ ID NO: 4305456 - DNA, 19 bp, Homo sapiens
ccagtgagagtgaggcccc

SEQ ID NO: 4305457 - DNA, 16 bp, Homo sapiens
ccagtggcctcaaccc

SEQ ID NO: 4305458 - DNA, 17 bp, Homo sapiens
ccagtggcctcaaccct

SEQ ID NO: 4305459 - DNA, 24 bp, Homo sapiens
ccagtggcctcaaccctccctcag

SEQ ID NO: 4305460 - DNA, 14 bp, Homo sapiens
ccagtgggaggcgc

SEQ ID NO: 4305461 - DNA, 18 bp, Homo sapiens
ccagtgtattttctgtgt

SEQ ID NO: 4305462 - DNA, 19 bp, Homo sapiens
ccagtgtattttctgtgtt

SEQ ID NO: 4305463 - DNA, 20 bp, Homo sapiens
ccagtgtccccaggggcaca

SEQ ID NO: 4305464 - DNA, 17 bp, Homo sapiens
ccagtgtggactctgga

SEQ ID NO: 4305465 - DNA, 20 bp, Homo sapiens
ccagtgtggactctggactg

SEQ ID NO: 4305466 - DNA, 16 bp, Homo sapiens
ccagtgttgcctcctc

SEQ ID NO: 4305467 - DNA, 17 bp, Homo sapiens
ccagtgttgcctcctcc

SEQ ID NO: 4305468 - DNA, 14 bp, Homo sapiens
ccagttggactgtg

SEQ ID NO: 4305469 - DNA, 23 bp, Homo sapiens
ccagttggactgtggcctcagga

SEQ ID NO: 4305470 - DNA, 18 bp, Homo sapiens
ccataccccctgccccag

SEQ ID NO: 4305471 - DNA, 19 bp, Homo sapiens
ccataccccctgccccaga

SEQ ID NO: 4305472 - DNA, 18 bp, Homo sapiens
ccatatagtttgttttct

SEQ ID NO: 4305473 - DNA, 20 bp, Homo sapiens
ccatatagtttgttttcttt

SEQ ID NO: 4305474 - DNA, 13 bp, Homo sapiens
ccatatcccggga

SEQ ID NO: 4305475 - DNA, 16 bp, Homo sapiens
ccatccagccaggggt

SEQ ID NO: 4305476 - DNA, 17 bp, Homo sapiens
ccatcccctcctagcac

SEQ ID NO: 4305477 - DNA, 22 bp, Homo sapiens
ccatcccgacatggacccggag

SEQ ID NO: 4305478 - DNA, 19 bp, Homo sapiens
ccatccggcccccagagcg

SEQ ID NO: 4305479 - DNA, 17 bp, Homo sapiens
ccatcctccccttccct

SEQ ID NO: 4305480 - DNA, 21 bp, Homo sapiens
ccatcctccccttccctgcaa

SEQ ID NO: 4305481 - DNA, 16 bp, Homo sapiens
ccatcgccttctgggg

SEQ ID NO: 4305482 - DNA, 14 bp, Homo sapiens
ccatcggtcagcag

SEQ ID NO: 4305483 - DNA, 17 bp, Homo sapiens
ccatctcaggccacctg

SEQ ID NO: 4305484 - DNA, 20 bp, Homo sapiens
ccatctcaggccacctgccc

SEQ ID NO: 4305485 - DNA, 21 bp, Homo sapiens
ccatcttttgttaagttcacc

SEQ ID NO: 4305486 - DNA, 14 bp, Homo sapiens
ccatgaactttgtc

SEQ ID NO: 4305487 - DNA, 15 bp, Homo sapiens
ccatgagctccagac

SEQ ID NO: 4305488 - DNA, 16 bp, Homo sapiens
ccatgagctccagacc

SEQ ID NO: 4305489 - DNA, 17 bp, Homo sapiens
ccatgatgtggagtggg

SEQ ID NO: 4305490 - DNA, 22 bp, Homo sapiens
ccatgattccaagggcccagag

SEQ ID NO: 4305491 - DNA, 17 bp, Homo sapiens
ccatgcagatctagcca

SEQ ID NO: 4305492 - DNA, 20 bp, Homo sapiens
ccatgcatggcctcccagcc

SEQ ID NO: 4305493 - DNA, 22 bp, Homo sapiens
ccatgcatggcctcccagccac

SEQ ID NO: 4305494 - DNA, 13 bp, Homo sapiens
ccatggaagctgg

SEQ ID NO: 4305495 - DNA, 15 bp, Homo sapiens
ccatggaagctggca

SEQ ID NO: 4305496 - DNA, 23 bp, Homo sapiens
ccatggaggaaggctctgttcca

SEQ ID NO: 4305497 - DNA, 19 bp, Homo sapiens
ccatggaggcgccttcctg

SEQ ID NO: 4305498 - DNA, 21 bp, Homo sapiens
ccatgggaaatgtcaacaagt

SEQ ID NO: 4305499 - DNA, 16 bp, Homo sapiens
ccatggtagactgtga

SEQ ID NO: 4305500 - DNA, 14 bp, Homo sapiens
ccatggtgcagtga

SEQ ID NO: 4305501 - DNA, 20 bp, Homo sapiens
ccatggtgttggaggggcag

SEQ ID NO: 4305502 - DNA, 19 bp, Homo sapiens
ccatgtcaagattcagcta

SEQ ID NO: 4305503 - DNA, 15 bp, Homo sapiens
ccatgtgctgctgtg

SEQ ID NO: 4305504 - DNA, 13 bp, Homo sapiens
ccatgtgctgtgc

SEQ ID NO: 4305505 - DNA, 17 bp, Homo sapiens
ccatgtgtcgcctctca

SEQ ID NO: 4305506 - DNA, 20 bp, Homo sapiens
ccattaagtaaacaataaaa

SEQ ID NO: 4305507 - DNA, 15 bp, Homo sapiens
ccattagtatcctgt

SEQ ID NO: 4305508 - DNA, 13 bp, Homo sapiens
ccattcacatttt

SEQ ID NO: 4305509 - DNA, 19 bp, Homo sapiens
ccattccagagctgcagaa

SEQ ID NO: 4305510 - DNA, 13 bp, Homo sapiens
ccattgccttctg

SEQ ID NO: 4305511 - DNA, 12 bp, Homo sapiens
ccattgtgcatt

SEQ ID NO: 4305512 - DNA, 17 bp, Homo sapiens
ccattgtgcattctaga

SEQ ID NO: 4305513 - DNA, 16 bp, Homo sapiens
ccatttaggtttctga

SEQ ID NO: 4305514 - DNA, 21 bp, Homo sapiens
ccatttaggtttctgagttcc

SEQ ID NO: 4305515 - DNA, 15 bp, Homo sapiens
ccatttcatgtccat

SEQ ID NO: 4305516 - DNA, 22 bp, Homo sapiens
ccatttgaattttttagtgact

SEQ ID NO: 4305517 - DNA, 17 bp, Homo sapiens
ccatttgttaatatcac

SEQ ID NO: 4305518 - DNA, 22 bp, Homo sapiens
ccattttctaaactgttttcat

SEQ ID NO: 4305519 - DNA, 18 bp, Homo sapiens
ccattttgcgatgtgttt

SEQ ID NO: 4305520 - DNA, 12 bp, Homo sapiens
cccaaacccttc

SEQ ID NO: 4305521 - DNA, 18 bp, Homo sapiens
cccaaagcaagcacctgg

SEQ ID NO: 4305522 - DNA, 22 bp, Homo sapiens
cccaaagcaagcacctgggtgt

SEQ ID NO: 4305523 - DNA, 14 bp, Homo sapiens
cccaaccctgcccc

SEQ ID NO: 4305524 - DNA, 15 bp, Homo sapiens
cccaaccctgcccct

SEQ ID NO: 4305525 - DNA, 22 bp, Homo sapiens
cccaaccggggagcccccgccc

SEQ ID NO: 4305526 - DNA, 23 bp, Homo sapiens
cccaactactattgtagagtggt

SEQ ID NO: 4305527 - DNA, 14 bp, Homo sapiens
cccaactctggcct

SEQ ID NO: 4305528 - DNA, 21 bp, Homo sapiens
cccaaggtggtcttggagagg

SEQ ID NO: 4305529 - DNA, 19 bp, Homo sapiens
cccacaaaatatttctaag

SEQ ID NO: 4305530 - DNA, 15 bp, Homo sapiens
cccacacaggcctgg

SEQ ID NO: 4305531 - DNA, 19 bp, Homo sapiens
cccacacaggcctggccca

SEQ ID NO: 4305532 - DNA, 14 bp, Homo sapiens
cccacacctgcctc

SEQ ID NO: 4305533 - DNA, 17 bp, Homo sapiens
cccacaggagcatgtcc

SEQ ID NO: 4305534 - DNA, 19 bp, Homo sapiens
cccacaggagcgtgtccta

SEQ ID NO: 4305535 - DNA, 23 bp, Homo sapiens
cccacagtatattttatttcaat

SEQ ID NO: 4305536 - DNA, 14 bp, Homo sapiens
cccacattccgaca

SEQ ID NO: 4305537 - DNA, 19 bp, Homo sapiens
cccaccaactctctctgcc

SEQ ID NO: 4305538 - DNA, 14 bp, Homo sapiens
cccaccagcagcac

SEQ ID NO: 4305539 - DNA, 13 bp, Homo sapiens
cccacccccctca

SEQ ID NO: 4305540 - DNA, 16 bp, Homo sapiens
cccaccccctgctggt

SEQ ID NO: 4305541 - DNA, 12 bp, Homo sapiens
cccaccccgcct

SEQ ID NO: 4305542 - DNA, 16 bp, Homo sapiens
cccaccccgcctctgg

SEQ ID NO: 4305543 - DNA, 18 bp, Homo sapiens
cccaccccgcctctgggc

SEQ ID NO: 4305544 - DNA, 15 bp, Homo sapiens
cccacccctccatga

SEQ ID NO: 4305545 - DNA, 15 bp, Homo sapiens
cccacccctcttccc

SEQ ID NO: 4305546 - DNA, 22 bp, Homo sapiens
cccacccctcttcccccttccc

SEQ ID NO: 4305547 - DNA, 12 bp, Homo sapiens
cccaccccttcc

SEQ ID NO: 4305548 - DNA, 12 bp, Homo sapiens
cccacctgctgc

SEQ ID NO: 4305549 - DNA, 13 bp, Homo sapiens
cccacctgctgcc

SEQ ID NO: 4305550 - DNA, 14 bp, Homo sapiens
cccacctgctgccc

SEQ ID NO: 4305551 - DNA, 18 bp, Homo sapiens
cccacctgggccctaggc

SEQ ID NO: 4305552 - DNA, 12 bp, Homo sapiens
cccacgccctcc

SEQ ID NO: 4305553 - DNA, 17 bp, Homo sapiens
cccacgccctcctccct

SEQ ID NO: 4305554 - DNA, 16 bp, Homo sapiens
cccacgctcctgccct

SEQ ID NO: 4305555 - DNA, 14 bp, Homo sapiens
cccacggccactgc

SEQ ID NO: 4305556 - DNA, 14 bp, Homo sapiens
cccactctgctgag

SEQ ID NO: 4305557 - DNA, 19 bp, Homo sapiens
cccactgcccctgcacctg

SEQ ID NO: 4305558 - DNA, 14 bp, Homo sapiens
cccactgcctgccc

SEQ ID NO: 4305559 - DNA, 12 bp, Homo sapiens
cccactggctcc

SEQ ID NO: 4305560 - DNA, 18 bp, Homo sapiens
cccactggctcctccagc

SEQ ID NO: 4305561 - DNA, 18 bp, Homo sapiens
cccacttatgctgctgtg

SEQ ID NO: 4305562 - DNA, 17 bp, Homo sapiens
cccagaaatgccgctgt

SEQ ID NO: 4305563 - DNA, 21 bp, Homo sapiens
cccagaaatgccgctgtgtcc

SEQ ID NO: 4305564 - DNA, 14 bp, Homo sapiens
cccagacagcagtg

SEQ ID NO: 4305565 - DNA, 15 bp, Homo sapiens
cccagagaagcctca

SEQ ID NO: 4305566 - DNA, 19 bp, Homo sapiens
cccagagagaccctgccaa

SEQ ID NO: 4305567 - DNA, 12 bp, Homo sapiens
cccagagccagg

SEQ ID NO: 4305568 - DNA, 17 bp, Homo sapiens
cccagagccagggctgt

SEQ ID NO: 4305569 - DNA, 20 bp, Homo sapiens
cccagatggctccctgggct

SEQ ID NO: 4305570 - DNA, 21 bp, Homo sapiens
cccagatggctccctgggctg

SEQ ID NO: 4305571 - DNA, 19 bp, Homo sapiens
cccagcaaccctcctatca

SEQ ID NO: 4305572 - DNA, 21 bp, Homo sapiens
cccagcaaccctcctatcacc

SEQ ID NO: 4305573 - DNA, 15 bp, Homo sapiens
cccagcagcggccca

SEQ ID NO: 4305574 - DNA, 18 bp, Homo sapiens
cccagcagcggcccagat

SEQ ID NO: 4305575 - DNA, 14 bp, Homo sapiens
cccagcaggggcag

SEQ ID NO: 4305576 - DNA, 19 bp, Homo sapiens
cccagcaggtggggagggg

SEQ ID NO: 4305577 - DNA, 16 bp, Homo sapiens
cccagcagtcctgggc

SEQ ID NO: 4305578 - DNA, 18 bp, Homo sapiens
cccagcagtcctgggccc

SEQ ID NO: 4305579 - DNA, 14 bp, Homo sapiens
cccagccacccgga

SEQ ID NO: 4305580 - DNA, 22 bp, Homo sapiens
cccagccacccggatctccagg

SEQ ID NO: 4305581 - DNA, 18 bp, Homo sapiens
cccagccccctggcccct

SEQ ID NO: 4305582 - DNA, 13 bp, Homo sapiens
cccagcctggccc

SEQ ID NO: 4305583 - DNA, 20 bp, Homo sapiens
cccagcctggccccaaatgt

SEQ ID NO: 4305584 - DNA, 14 bp, Homo sapiens
cccagcctgtggcc

SEQ ID NO: 4305585 - DNA, 12 bp, Homo sapiens
cccagctccagg

SEQ ID NO: 4305586 - DNA, 13 bp, Homo sapiens
cccagctccaggc

SEQ ID NO: 4305587 - DNA, 14 bp, Homo sapiens
cccagctccaggca

SEQ ID NO: 4305588 - DNA, 13 bp, Homo sapiens
cccagctgctcct

SEQ ID NO: 4305589 - DNA, 14 bp, Homo sapiens
cccaggacactgcc

SEQ ID NO: 4305590 - DNA, 20 bp, Homo sapiens
cccaggacactgcctttgct

SEQ ID NO: 4305591 - DNA, 16 bp, Homo sapiens
cccaggacctctgggg

SEQ ID NO: 4305592 - DNA, 17 bp, Homo sapiens
cccaggacgcatgcagg

SEQ ID NO: 4305593 - DNA, 20 bp, Homo sapiens
cccaggacgcatgcagggcc

SEQ ID NO: 4305594 - DNA, 23 bp, Homo sapiens
cccaggacgcatgcagggccccc

SEQ ID NO: 4305595 - DNA, 18 bp, Homo sapiens
cccaggagagcccccacc

SEQ ID NO: 4305596 - DNA, 21 bp, Homo sapiens
cccaggagagcccccaccagc

SEQ ID NO: 4305597 - DNA, 23 bp, Homo sapiens
cccaggagagcccccaccagcag

SEQ ID NO: 4305598 - DNA, 13 bp, Homo sapiens
cccaggaggacct

SEQ ID NO: 4305599 - DNA, 19 bp, Homo sapiens
cccaggaggactccctgct

SEQ ID NO: 4305600 - DNA, 15 bp, Homo sapiens
cccaggatgcatgca

SEQ ID NO: 4305601 - DNA, 13 bp, Homo sapiens
cccaggcagggag

SEQ ID NO: 4305602 - DNA, 19 bp, Homo sapiens
cccaggctggagtgcagtg

SEQ ID NO: 4305603 - DNA, 15 bp, Homo sapiens
cccaggctggatgct

SEQ ID NO: 4305604 - DNA, 18 bp, Homo sapiens
cccaggctggatgctggg

SEQ ID NO: 4305605 - DNA, 18 bp, Homo sapiens
cccagggaatcagggagc

SEQ ID NO: 4305606 - DNA, 16 bp, Homo sapiens
cccagggagctctgca

SEQ ID NO: 4305607 - DNA, 18 bp, Homo sapiens
cccagggccctgctcagg

SEQ ID NO: 4305608 - DNA, 19 bp, Homo sapiens
cccagggccctgctcaggc

SEQ ID NO: 4305609 - DNA, 23 bp, Homo sapiens
cccagggccctgctcaggcctca

SEQ ID NO: 4305610 - DNA, 20 bp, Homo sapiens
cccaggggcacacttcccct

SEQ ID NO: 4305611 - DNA, 18 bp, Homo sapiens
cccaggggcactgtgttc

SEQ ID NO: 4305612 - DNA, 17 bp, Homo sapiens
cccaggggtgagccccg

SEQ ID NO: 4305613 - DNA, 20 bp, Homo sapiens
cccagtagctacggttccct

SEQ ID NO: 4305614 - DNA, 21 bp, Homo sapiens
cccagtcatgacatttctcaa

SEQ ID NO: 4305615 - DNA, 22 bp, Homo sapiens
cccagtgagagtgaggcccccg

SEQ ID NO: 4305616 - DNA, 18 bp, Homo sapiens
cccagtggcctcaaccct

SEQ ID NO: 4305617 - DNA, 22 bp, Homo sapiens
cccatcctccccttccctgcaa

SEQ ID NO: 4305618 - DNA, 14 bp, Homo sapiens
cccatcgccttctg

SEQ ID NO: 4305619 - DNA, 18 bp, Homo sapiens
cccatcgccttctggctg

SEQ ID NO: 4305620 - DNA, 17 bp, Homo sapiens
cccatgcaggcagcctg

SEQ ID NO: 4305621 - DNA, 14 bp, Homo sapiens
cccatgcatggcct

SEQ ID NO: 4305622 - DNA, 21 bp, Homo sapiens
cccatgcatggcctcccagcc

SEQ ID NO: 4305623 - DNA, 17 bp, Homo sapiens
cccatggaaaaatgcca

SEQ ID NO: 4305624 - DNA, 18 bp, Homo sapiens
cccatggctcctcaccac

SEQ ID NO: 4305625 - DNA, 15 bp, Homo sapiens
cccattcaagattcc

SEQ ID NO: 4305626 - DNA, 14 bp, Homo sapiens
cccattcacatttt

SEQ ID NO: 4305627 - DNA, 19 bp, Homo sapiens
ccccaaaaccacagccctg

SEQ ID NO: 4305628 - DNA, 20 bp, Homo sapiens
ccccaaaaccacagccctgt

SEQ ID NO: 4305629 - DNA, 17 bp, Homo sapiens
ccccaaccctgcccctg

SEQ ID NO: 4305630 - DNA, 18 bp, Homo sapiens
ccccaaccctgcccctgc

SEQ ID NO: 4305631 - DNA, 20 bp, Homo sapiens
ccccaacgaaaagcacatcc

SEQ ID NO: 4305632 - DNA, 13 bp, Homo sapiens
ccccacacaggcc

SEQ ID NO: 4305633 - DNA, 18 bp, Homo sapiens
ccccacacaggcctggcc

SEQ ID NO: 4305634 - DNA, 18 bp, Homo sapiens
ccccaccacacacaccct

SEQ ID NO: 4305635 - DNA, 13 bp, Homo sapiens
ccccaccagcagc

SEQ ID NO: 4305636 - DNA, 21 bp, Homo sapiens
ccccacccaccctctggtcct

SEQ ID NO: 4305637 - DNA, 13 bp, Homo sapiens
ccccacccctcca

SEQ ID NO: 4305638 - DNA, 13 bp, Homo sapiens
ccccaccccttcc

SEQ ID NO: 4305639 - DNA, 15 bp, Homo sapiens
ccccaccccttcccc

SEQ ID NO: 4305640 - DNA, 22 bp, Homo sapiens
ccccaccccttccccactgcct

SEQ ID NO: 4305641 - DNA, 11 bp, Homo sapiens
ccccactggaa

SEQ ID NO: 4305642 - DNA, 19 bp, Homo sapiens
ccccactggagcgtgtact

SEQ ID NO: 4305643 - DNA, 19 bp, Homo sapiens
ccccacttatgctgctgtg

SEQ ID NO: 4305644 - DNA, 22 bp, Homo sapiens
ccccacttatgctgctgtgaat

SEQ ID NO: 4305645 - DNA, 22 bp, Homo sapiens
ccccagaaatgccgctgtgtcc

SEQ ID NO: 4305646 - DNA, 23 bp, Homo sapiens
ccccagaccccatccagccaggg

SEQ ID NO: 4305647 - DNA, 10 bp, Homo sapiens
ccccagagac

SEQ ID NO: 4305648 - DNA, 12 bp, Homo sapiens
ccccagagccag

SEQ ID NO: 4305649 - DNA, 13 bp, Homo sapiens
ccccagagccagg

SEQ ID NO: 4305650 - DNA, 17 bp, Homo sapiens
ccccagagccagggctg

SEQ ID NO: 4305651 - DNA, 21 bp, Homo sapiens
ccccagcccagggttccccca

SEQ ID NO: 4305652 - DNA, 17 bp, Homo sapiens
ccccagccccctggccc

SEQ ID NO: 4305653 - DNA, 14 bp, Homo sapiens
ccccagccctgtgg

SEQ ID NO: 4305654 - DNA, 15 bp, Homo sapiens
ccccagccctgtgga

SEQ ID NO: 4305655 - DNA, 14 bp, Homo sapiens
ccccagctccaggc

SEQ ID NO: 4305656 - DNA, 16 bp, Homo sapiens
ccccagctccaggcag

SEQ ID NO: 4305657 - DNA, 18 bp, Homo sapiens
ccccagctccaggcagga

SEQ ID NO: 4305658 - DNA, 22 bp, Homo sapiens
ccccagctcctttccctggaag

SEQ ID NO: 4305659 - DNA, 19 bp, Homo sapiens
ccccaggacgcatgcaggg

SEQ ID NO: 4305660 - DNA, 18 bp, Homo sapiens
ccccaggcaggctgtgcg

SEQ ID NO: 4305661 - DNA, 23 bp, Homo sapiens
ccccaggcaggctgtgcgctgac

SEQ ID NO: 4305662 - DNA, 17 bp, Homo sapiens
ccccaggctggatgctg

SEQ ID NO: 4305663 - DNA, 15 bp, Homo sapiens
ccccagggccctgct

SEQ ID NO: 4305664 - DNA, 18 bp, Homo sapiens
ccccagggccctgctcag

SEQ ID NO: 4305665 - DNA, 20 bp, Homo sapiens
ccccaggggcactgtgttct

SEQ ID NO: 4305666 - DNA, 14 bp, Homo sapiens
ccccagtccccggg

SEQ ID NO: 4305667 - DNA, 22 bp, Homo sapiens
ccccagtgtggactctggactg

SEQ ID NO: 4305668 - DNA, 17 bp, Homo sapiens
ccccatccagccagggg

SEQ ID NO: 4305669 - DNA, 17 bp, Homo sapiens
ccccatcctccccttcc

SEQ ID NO: 4305670 - DNA, 17 bp, Homo sapiens
ccccatcgccttctggg

SEQ ID NO: 4305671 - DNA, 11 bp, Homo sapiens
ccccatctgct

SEQ ID NO: 4305672 - DNA, 12 bp, Homo sapiens
ccccatctgctg

SEQ ID NO: 4305673 - DNA, 19 bp, Homo sapiens
ccccatggtgcagtgaaga

SEQ ID NO: 4305674 - DNA, 13 bp, Homo sapiens
cccccacattctg

SEQ ID NO: 4305675 - DNA, 14 bp, Homo sapiens
cccccaccagcagc

SEQ ID NO: 4305676 - DNA, 12 bp, Homo sapiens
cccccacccttt

SEQ ID NO: 4305677 - DNA, 23 bp, Homo sapiens
cccccagagccagggctgtcctt

SEQ ID NO: 4305678 - DNA, 14 bp, Homo sapiens
cccccagccctgtg

SEQ ID NO: 4305679 - DNA, 12 bp, Homo sapiens
cccccatgccct

SEQ ID NO: 4305680 - DNA, 18 bp, Homo sapiens
cccccatgccctccctgc

SEQ ID NO: 4305681 - DNA, 22 bp, Homo sapiens
cccccatgccctccctgctgcc

SEQ ID NO: 4305682 - DNA, 16 bp, Homo sapiens
ccccccagagccaggg

SEQ ID NO: 4305683 - DNA, 21 bp, Homo sapiens
cccccgagctgggggccatga

SEQ ID NO: 4305684 - DNA, 13 bp, Homo sapiens
cccccgccctctg

SEQ ID NO: 4305685 - DNA, 13 bp, Homo sapiens
cccccgctctgcc

SEQ ID NO: 4305686 - DNA, 23 bp, Homo sapiens
cccccgtgccaaatcctgggcat

SEQ ID NO: 4305687 - DNA, 13 bp, Homo sapiens
ccccctgccccag

SEQ ID NO: 4305688 - DNA, 16 bp, Homo sapiens
ccccctgccccagaga

SEQ ID NO: 4305689 - DNA, 17 bp, Homo sapiens
ccccctgccccagagaa

SEQ ID NO: 4305690 - DNA, 12 bp, Homo sapiens
ccccctgggaga

SEQ ID NO: 4305691 - DNA, 22 bp, Homo sapiens
ccccctggggggcacagccaga

SEQ ID NO: 4305692 - DNA, 23 bp, Homo sapiens
ccccctggggggcacagccagaa

SEQ ID NO: 4305693 - DNA, 19 bp, Homo sapiens
cccccttcccctgcgccct

SEQ ID NO: 4305694 - DNA, 14 bp, Homo sapiens
cccccttctcccac

SEQ ID NO: 4305695 - DNA, 19 bp, Homo sapiens
ccccgagccgagctctcct

SEQ ID NO: 4305696 - DNA, 13 bp, Homo sapiens
ccccgagctgggg

SEQ ID NO: 4305697 - DNA, 14 bp, Homo sapiens
ccccgccccccaga

SEQ ID NO: 4305698 - DNA, 20 bp, Homo sapiens
ccccgccccccagagccagg

SEQ ID NO: 4305699 - DNA, 23 bp, Homo sapiens
ccccgctctgccatcagcccctg

SEQ ID NO: 4305700 - DNA, 16 bp, Homo sapiens
ccccggagctgggaag

SEQ ID NO: 4305701 - DNA, 15 bp, Homo sapiens
ccccggccactctgt

SEQ ID NO: 4305702 - DNA, 21 bp, Homo sapiens
ccccggcctgatggccaggcc

SEQ ID NO: 4305703 - DNA, 16 bp, Homo sapiens
ccccgggaaaggccgg

SEQ ID NO: 4305704 - DNA, 21 bp, Homo sapiens
ccccggggcatggacagggcc

SEQ ID NO: 4305705 - DNA, 22 bp, Homo sapiens
ccccggggcatggacagggcca

SEQ ID NO: 4305706 - DNA, 18 bp, Homo sapiens
ccccgggtttggcgggcc

SEQ ID NO: 4305707 - DNA, 19 bp, Homo sapiens
ccccgggtttggcgggcca

SEQ ID NO: 4305708 - DNA, 21 bp, Homo sapiens
ccccgtcaccatctcaggcca

SEQ ID NO: 4305709 - DNA, 19 bp, Homo sapiens
ccccgtgtattcaggaccc

SEQ ID NO: 4305710 - DNA, 14 bp, Homo sapiens
cccctaccctttcc

SEQ ID NO: 4305711 - DNA, 16 bp, Homo sapiens
cccctataccctaggt

SEQ ID NO: 4305712 - DNA, 21 bp, Homo sapiens
cccctatcctgcaccctctgc

SEQ ID NO: 4305713 - DNA, 21 bp, Homo sapiens
cccctcaagccaggagaccct

SEQ ID NO: 4305714 - DNA, 13 bp, Homo sapiens
cccctcaccttgc

SEQ ID NO: 4305715 - DNA, 14 bp, Homo sapiens
cccctcactggctg

SEQ ID NO: 4305716 - DNA, 20 bp, Homo sapiens
cccctccagacccctaccct

SEQ ID NO: 4305717 - DNA, 12 bp, Homo sapiens
cccctccagtgt

SEQ ID NO: 4305718 - DNA, 11 bp, Homo sapiens
cccctcccacc

SEQ ID NO: 4305719 - DNA, 13 bp, Homo sapiens
cccctcctagcac

SEQ ID NO: 4305720 - DNA, 16 bp, Homo sapiens
cccctccttctcccct

SEQ ID NO: 4305721 - DNA, 19 bp, Homo sapiens
cccctccttctcccctcca

SEQ ID NO: 4305722 - DNA, 20 bp, Homo sapiens
cccctccttctcccctccag

SEQ ID NO: 4305723 - DNA, 21 bp, Homo sapiens
cccctccttctcccctccaga

SEQ ID NO: 4305724 - DNA, 20 bp, Homo sapiens
cccctccttgcctcctgtgt

SEQ ID NO: 4305725 - DNA, 20 bp, Homo sapiens
cccctctcctgcatccctcc

SEQ ID NO: 4305726 - DNA, 17 bp, Homo sapiens
cccctcttcccccttcc

SEQ ID NO: 4305727 - DNA, 17 bp, Homo sapiens
cccctgaagtgacccca

SEQ ID NO: 4305728 - DNA, 17 bp, Homo sapiens
cccctgcacacacctgc

SEQ ID NO: 4305729 - DNA, 20 bp, Homo sapiens
cccctgcacacacctgcaca

SEQ ID NO: 4305730 - DNA, 22 bp, Homo sapiens
cccctgccagaggcctggtgcc

SEQ ID NO: 4305731 - DNA, 12 bp, Homo sapiens
cccctgccccag

SEQ ID NO: 4305732 - DNA, 13 bp, Homo sapiens
cccctgccccaga

SEQ ID NO: 4305733 - DNA, 14 bp, Homo sapiens
cccctgccccgtca

SEQ ID NO: 4305734 - DNA, 22 bp, Homo sapiens
cccctgccccgtcaccatctca

SEQ ID NO: 4305735 - DNA, 15 bp, Homo sapiens
cccctgcgcaggccc

SEQ ID NO: 4305736 - DNA, 23 bp, Homo sapiens
cccctgcgccctccctccctcca

SEQ ID NO: 4305737 - DNA, 12 bp, Homo sapiens
cccctgctgcct

SEQ ID NO: 4305738 - DNA, 14 bp, Homo sapiens
cccctgctgcctcc

SEQ ID NO: 4305739 - DNA, 15 bp, Homo sapiens
cccctgctgctcctc

SEQ ID NO: 4305740 - DNA, 13 bp, Homo sapiens
cccctgctggtgc

SEQ ID NO: 4305741 - DNA, 22 bp, Homo sapiens
cccctggcttttcactgctggc

SEQ ID NO: 4305742 - DNA, 20 bp, Homo sapiens
cccctggggggcacagccag

SEQ ID NO: 4305743 - DNA, 21 bp, Homo sapiens
cccctggggggcacagccaga

SEQ ID NO: 4305744 - DNA, 22 bp, Homo sapiens
cccctggggggcacagccagaa

SEQ ID NO: 4305745 - DNA, 13 bp, Homo sapiens
cccctggtcctgc

SEQ ID NO: 4305746 - DNA, 17 bp, Homo sapiens
cccctggtgcctgcagg

SEQ ID NO: 4305747 - DNA, 22 bp, Homo sapiens
cccctggtgtccctgcctggcc

SEQ ID NO: 4305748 - DNA, 19 bp, Homo sapiens
cccctgtctgcgccgctgt

SEQ ID NO: 4305749 - DNA, 15 bp, Homo sapiens
ccccttccccactgc

SEQ ID NO: 4305750 - DNA, 19 bp, Homo sapiens
ccccttccccactgcctgc

SEQ ID NO: 4305751 - DNA, 15 bp, Homo sapiens
ccccttcccctgcgc

SEQ ID NO: 4305752 - DNA, 18 bp, Homo sapiens
ccccttccctgcaaacat

SEQ ID NO: 4305753 - DNA, 13 bp, Homo sapiens
ccccttctcccac

SEQ ID NO: 4305754 - DNA, 16 bp, Homo sapiens
ccccttctcccacact

SEQ ID NO: 4305755 - DNA, 17 bp, Homo sapiens
ccccttgctgctggctc

SEQ ID NO: 4305756 - DNA, 18 bp, Homo sapiens
cccctttggacctgcagt

SEQ ID NO: 4305757 - DNA, 18 bp, Homo sapiens
cccctttttactcccctt

SEQ ID NO: 4305758 - DNA, 19 bp, Homo sapiens
cccctttttactccccttg

SEQ ID NO: 4305759 - DNA, 19 bp, Homo sapiens
cccgagccgagctctcctg

SEQ ID NO: 4305760 - DNA, 22 bp, Homo sapiens
cccgagccgagctctcctgggc

SEQ ID NO: 4305761 - DNA, 22 bp, Homo sapiens
cccgaggcagcaacaggaccag

SEQ ID NO: 4305762 - DNA, 21 bp, Homo sapiens
cccgatgcgtggctcccagca

SEQ ID NO: 4305763 - DNA, 16 bp, Homo sapiens
cccgcacgcaagcctc

SEQ ID NO: 4305764 - DNA, 18 bp, Homo sapiens
cccgcacgcaagcctcag

SEQ ID NO: 4305765 - DNA, 20 bp, Homo sapiens
cccgcacgcaagcctcagcc

SEQ ID NO: 4305766 - DNA, 24 bp, Homo sapiens
cccgcacgcaagcctcagccactc

SEQ ID NO: 4305767 - DNA, 19 bp, Homo sapiens
cccgcatgctgcctgcctc

SEQ ID NO: 4305768 - DNA, 20 bp, Homo sapiens
cccgcatgctgcctgcctcc

SEQ ID NO: 4305769 - DNA, 15 bp, Homo sapiens
cccgccccacattcc

SEQ ID NO: 4305770 - DNA, 15 bp, Homo sapiens
cccgccccccagagc

SEQ ID NO: 4305771 - DNA, 17 bp, Homo sapiens
cccgccccccagagcca

SEQ ID NO: 4305772 - DNA, 23 bp, Homo sapiens
cccgccccccagagccagggctg

SEQ ID NO: 4305773 - DNA, 15 bp, Homo sapiens
cccgccctccccctg

SEQ ID NO: 4305774 - DNA, 20 bp, Homo sapiens
cccgccgtgtctgtggccct

SEQ ID NO: 4305775 - DNA, 19 bp, Homo sapiens
cccgcctctgggctcacac

SEQ ID NO: 4305776 - DNA, 17 bp, Homo sapiens
cccgcctggcagaactg

SEQ ID NO: 4305777 - DNA, 14 bp, Homo sapiens
cccgcgtccaaccc

SEQ ID NO: 4305778 - DNA, 12 bp, Homo sapiens
cccgctcagccc

SEQ ID NO: 4305779 - DNA, 20 bp, Homo sapiens
cccgctgcgctgccctgcaa

SEQ ID NO: 4305780 - DNA, 23 bp, Homo sapiens
cccgctgcgctgccctgcaaacc

SEQ ID NO: 4305781 - DNA, 21 bp, Homo sapiens
cccggagctaacactggcccc

SEQ ID NO: 4305782 - DNA, 11 bp, Homo sapiens
cccggagctgg

SEQ ID NO: 4305783 - DNA, 19 bp, Homo sapiens
cccggatctccaggcccag

SEQ ID NO: 4305784 - DNA, 20 bp, Homo sapiens
cccggatctccaggcccagc

SEQ ID NO: 4305785 - DNA, 22 bp, Homo sapiens
cccggcagccccccagtgtccc

SEQ ID NO: 4305786 - DNA, 21 bp, Homo sapiens
cccggcatgccgagtgcccca

SEQ ID NO: 4305787 - DNA, 14 bp, Homo sapiens
cccggccactctgt

SEQ ID NO: 4305788 - DNA, 16 bp, Homo sapiens
cccggcctgatggcca

SEQ ID NO: 4305789 - DNA, 23 bp, Homo sapiens
cccgggaggaggatccgggcttt

SEQ ID NO: 4305790 - DNA, 18 bp, Homo sapiens
cccgggcaggggccgctt

SEQ ID NO: 4305791 - DNA, 14 bp, Homo sapiens
cccggggcagctgc

SEQ ID NO: 4305792 - DNA, 21 bp, Homo sapiens
cccggggcagctgccagagaa

SEQ ID NO: 4305793 - DNA, 21 bp, Homo sapiens
cccggggcatggacagggcca

SEQ ID NO: 4305794 - DNA, 17 bp, Homo sapiens
cccggggtctccacctc

SEQ ID NO: 4305795 - DNA, 22 bp, Homo sapiens
cccgggtttggcgggccaagga

SEQ ID NO: 4305796 - DNA, 17 bp, Homo sapiens
cccgtcaccatctcagg

SEQ ID NO: 4305797 - DNA, 18 bp, Homo sapiens
cccgtccacggctctagg

SEQ ID NO: 4305798 - DNA, 21 bp, Homo sapiens
cccgtgccacgcgctctgcat

SEQ ID NO: 4305799 - DNA, 24 bp, Homo sapiens
cccgtgccacgcgctctgcatgct

SEQ ID NO: 4305800 - DNA, 12 bp, Homo sapiens
cccgtgctcaca

SEQ ID NO: 4305801 - DNA, 14 bp, Homo sapiens
cccgtgtggcccct

SEQ ID NO: 4305802 - DNA, 17 bp, Homo sapiens
cccgtgtggccccttca

SEQ ID NO: 4305803 - DNA, 18 bp, Homo sapiens
cccgttgttgtccctgca

SEQ ID NO: 4305804 - DNA, 12 bp, Homo sapiens
cccgtttccaag

SEQ ID NO: 4305805 - DNA, 21 bp, Homo sapiens
ccctaaagatggcgcacccgg

SEQ ID NO: 4305806 - DNA, 18 bp, Homo sapiens
ccctaagcacaataaaag

SEQ ID NO: 4305807 - DNA, 16 bp, Homo sapiens
ccctagcagtttgcct

SEQ ID NO: 4305808 - DNA, 17 bp, Homo sapiens
ccctagcagtttgcctc

SEQ ID NO: 4305809 - DNA, 19 bp, Homo sapiens
ccctaggcatactctccag

SEQ ID NO: 4305810 - DNA, 21 bp, Homo sapiens
ccctaggcatactctccagga

SEQ ID NO: 4305811 - DNA, 20 bp, Homo sapiens
ccctaggtctccacccctca

SEQ ID NO: 4305812 - DNA, 22 bp, Homo sapiens
ccctaggtgggtcaactccaag

SEQ ID NO: 4305813 - DNA, 23 bp, Homo sapiens
ccctaggtgggtcaactccaagg

SEQ ID NO: 4305814 - DNA, 19 bp, Homo sapiens
ccctagtgacccggaggcc

SEQ ID NO: 4305815 - DNA, 21 bp, Homo sapiens
ccctagtgacccggaggccac

SEQ ID NO: 4305816 - DNA, 14 bp, Homo sapiens
ccctatcctgcacc

SEQ ID NO: 4305817 - DNA, 23 bp, Homo sapiens
ccctcaagccaggagaccctgtc

SEQ ID NO: 4305818 - DNA, 14 bp, Homo sapiens
ccctcacctgggca

SEQ ID NO: 4305819 - DNA, 15 bp, Homo sapiens
ccctcacctgggcac

SEQ ID NO: 4305820 - DNA, 17 bp, Homo sapiens
ccctcacctgggcacct

SEQ ID NO: 4305821 - DNA, 21 bp, Homo sapiens
ccctcaccttgcaacacacag

SEQ ID NO: 4305822 - DNA, 15 bp, Homo sapiens
ccctcactccactcc

SEQ ID NO: 4305823 - DNA, 13 bp, Homo sapiens
ccctcactggctg

SEQ ID NO: 4305824 - DNA, 19 bp, Homo sapiens
ccctcagccacacccaggc

SEQ ID NO: 4305825 - DNA, 14 bp, Homo sapiens
ccctcagcccctct

SEQ ID NO: 4305826 - DNA, 23 bp, Homo sapiens
ccctcagcccctcttgcccccca

SEQ ID NO: 4305827 - DNA, 15 bp, Homo sapiens
ccctccacctgcttg

SEQ ID NO: 4305828 - DNA, 19 bp, Homo sapiens
ccctccactcctcccaact

SEQ ID NO: 4305829 - DNA, 10 bp, Homo sapiens
ccctccagac

SEQ ID NO: 4305830 - DNA, 17 bp, Homo sapiens
ccctccagacccctacc

SEQ ID NO: 4305831 - DNA, 15 bp, Homo sapiens
ccctccatcccgaca

SEQ ID NO: 4305832 - DNA, 21 bp, Homo sapiens
ccctcccatttgcagaccagg

SEQ ID NO: 4305833 - DNA, 16 bp, Homo sapiens
ccctccctcagcccct

SEQ ID NO: 4305834 - DNA, 12 bp, Homo sapiens
ccctccctccac

SEQ ID NO: 4305835 - DNA, 14 bp, Homo sapiens
ccctccctccacac

SEQ ID NO: 4305836 - DNA, 17 bp, Homo sapiens
ccctccctcctggctca

SEQ ID NO: 4305837 - DNA, 12 bp, Homo sapiens
ccctccctgcag

SEQ ID NO: 4305838 - DNA, 13 bp, Homo sapiens
ccctccctgcagg

SEQ ID NO: 4305839 - DNA, 15 bp, Homo sapiens
ccctccctgctccct

SEQ ID NO: 4305840 - DNA, 11 bp, Homo sapiens
ccctccctgtc

SEQ ID NO: 4305841 - DNA, 16 bp, Homo sapiens
ccctccctgtcccctg

SEQ ID NO: 4305842 - DNA, 12 bp, Homo sapiens
ccctcctagcac

SEQ ID NO: 4305843 - DNA, 14 bp, Homo sapiens
ccctcctgacccca

SEQ ID NO: 4305844 - DNA, 15 bp, Homo sapiens
ccctcctgaccccac

SEQ ID NO: 4305845 - DNA, 16 bp, Homo sapiens
ccctcctggctcacag

SEQ ID NO: 4305846 - DNA, 16 bp, Homo sapiens
ccctccttctcccctc

SEQ ID NO: 4305847 - DNA, 23 bp, Homo sapiens
ccctccttctcccctccagaccc

SEQ ID NO: 4305848 - DNA, 22 bp, Homo sapiens
ccctccttgccgctgggagagc

SEQ ID NO: 4305849 - DNA, 17 bp, Homo sapiens
ccctccttgcctcctgt

SEQ ID NO: 4305850 - DNA, 20 bp, Homo sapiens
ccctcgcttcataggcagag

SEQ ID NO: 4305851 - DNA, 16 bp, Homo sapiens
ccctcggggcaggaag

SEQ ID NO: 4305852 - DNA, 14 bp, Homo sapiens
ccctcgtctccctg

SEQ ID NO: 4305853 - DNA, 23 bp, Homo sapiens
ccctctccccggacaagcccagg

SEQ ID NO: 4305854 - DNA, 12 bp, Homo sapiens
ccctctgcaggg

SEQ ID NO: 4305855 - DNA, 15 bp, Homo sapiens
ccctctgcagggcag

SEQ ID NO: 4305856 - DNA, 12 bp, Homo sapiens
ccctctgccact

SEQ ID NO: 4305857 - DNA, 15 bp, Homo sapiens
ccctctgcctgtccc

SEQ ID NO: 4305858 - DNA, 23 bp, Homo sapiens
ccctctgcctgtccctctcaggc

SEQ ID NO: 4305859 - DNA, 15 bp, Homo sapiens
ccctcttcccccttc

SEQ ID NO: 4305860 - DNA, 13 bp, Homo sapiens
ccctgacactgtc

SEQ ID NO: 4305861 - DNA, 20 bp, Homo sapiens
ccctgagaagcctcatggga

SEQ ID NO: 4305862 - DNA, 13 bp, Homo sapiens
ccctgagggccct

SEQ ID NO: 4305863 - DNA, 14 bp, Homo sapiens
ccctgagggccctt

SEQ ID NO: 4305864 - DNA, 12 bp, Homo sapiens
ccctgcacacac

SEQ ID NO: 4305865 - DNA, 14 bp, Homo sapiens
ccctgcacacacct

SEQ ID NO: 4305866 - DNA, 20 bp, Homo sapiens
ccctgcacacacctgcacac

SEQ ID NO: 4305867 - DNA, 12 bp, Homo sapiens
ccctgcagggca

SEQ ID NO: 4305868 - DNA, 23 bp, Homo sapiens
ccctgcagggtagggggcctgag

SEQ ID NO: 4305869 - DNA, 13 bp, Homo sapiens
ccctgcatccctt

SEQ ID NO: 4305870 - DNA, 17 bp, Homo sapiens
ccctgcatcccttggcc

SEQ ID NO: 4305871 - DNA, 12 bp, Homo sapiens
ccctgccatgga

SEQ ID NO: 4305872 - DNA, 19 bp, Homo sapiens
ccctgccatggaggcgcct

SEQ ID NO: 4305873 - DNA, 13 bp, Homo sapiens
ccctgccccacac

SEQ ID NO: 4305874 - DNA, 12 bp, Homo sapiens
ccctgccccaga

SEQ ID NO: 4305875 - DNA, 16 bp, Homo sapiens
ccctgccccagagaag

SEQ ID NO: 4305876 - DNA, 10 bp, Homo sapiens
ccctgccccc

SEQ ID NO: 4305877 - DNA, 13 bp, Homo sapiens
ccctgccccccac

SEQ ID NO: 4305878 - DNA, 18 bp, Homo sapiens
ccctgccccccacattct

SEQ ID NO: 4305879 - DNA, 14 bp, Homo sapiens
ccctgccccgcccc

SEQ ID NO: 4305880 - DNA, 15 bp, Homo sapiens
ccctgccccgtcacc

SEQ ID NO: 4305881 - DNA, 21 bp, Homo sapiens
ccctgccccgtcaccatctca

SEQ ID NO: 4305882 - DNA, 17 bp, Homo sapiens
ccctgcccctcccttca

SEQ ID NO: 4305883 - DNA, 18 bp, Homo sapiens
ccctgcccctcccttcaa

SEQ ID NO: 4305884 - DNA, 21 bp, Homo sapiens
ccctgccctcactccactccc

SEQ ID NO: 4305885 - DNA, 12 bp, Homo sapiens
ccctgcctggcc

SEQ ID NO: 4305886 - DNA, 13 bp, Homo sapiens
ccctgcctggccc

SEQ ID NO: 4305887 - DNA, 15 bp, Homo sapiens
ccctgcgcaggccct

SEQ ID NO: 4305888 - DNA, 20 bp, Homo sapiens
ccctgctcaggcctcacctg

SEQ ID NO: 4305889 - DNA, 19 bp, Homo sapiens
ccctgctccatgggcacct

SEQ ID NO: 4305890 - DNA, 17 bp, Homo sapiens
ccctgctcccggctctg

SEQ ID NO: 4305891 - DNA, 14 bp, Homo sapiens
ccctgctcctacct

SEQ ID NO: 4305892 - DNA, 14 bp, Homo sapiens
ccctgctgccaggc

SEQ ID NO: 4305893 - DNA, 11 bp, Homo sapiens
ccctgctgccc

SEQ ID NO: 4305894 - DNA, 13 bp, Homo sapiens
ccctgctgctcct

SEQ ID NO: 4305895 - DNA, 21 bp, Homo sapiens
ccctgctgctcctcggccaga

SEQ ID NO: 4305896 - DNA, 24 bp, Homo sapiens
ccctgctgctcctcggccagagct

SEQ ID NO: 4305897 - DNA, 16 bp, Homo sapiens
ccctgctggtgcccac

SEQ ID NO: 4305898 - DNA, 23 bp, Homo sapiens
ccctgcttagtgtcccttacctg

SEQ ID NO: 4305899 - DNA, 15 bp, Homo sapiens
ccctggaactgtctc

SEQ ID NO: 4305900 - DNA, 20 bp, Homo sapiens
ccctggacgcatgcagggcc

SEQ ID NO: 4305901 - DNA, 15 bp, Homo sapiens
ccctggagcccggca

SEQ ID NO: 4305902 - DNA, 19 bp, Homo sapiens
ccctggcattgtttccacc

SEQ ID NO: 4305903 - DNA, 15 bp, Homo sapiens
ccctggcccagcctg

SEQ ID NO: 4305904 - DNA, 16 bp, Homo sapiens
ccctggcccagcctgt

SEQ ID NO: 4305905 - DNA, 22 bp, Homo sapiens
ccctggcccagcctgtggcctc

SEQ ID NO: 4305906 - DNA, 19 bp, Homo sapiens
ccctggctcccacaggccc

SEQ ID NO: 4305907 - DNA, 20 bp, Homo sapiens
ccctggctcccacaggccct

SEQ ID NO: 4305908 - DNA, 13 bp, Homo sapiens
ccctggcttttca

SEQ ID NO: 4305909 - DNA, 18 bp, Homo sapiens
ccctggcttttcactgct

SEQ ID NO: 4305910 - DNA, 22 bp, Homo sapiens
ccctgggagagtgctcaaccta

SEQ ID NO: 4305911 - DNA, 20 bp, Homo sapiens
ccctggggggcacagccaga

SEQ ID NO: 4305912 - DNA, 21 bp, Homo sapiens
ccctggggtttccacacaggc

SEQ ID NO: 4305913 - DNA, 14 bp, Homo sapiens
ccctggtcctgcac

SEQ ID NO: 4305914 - DNA, 14 bp, Homo sapiens
ccctggtgctgcca

SEQ ID NO: 4305915 - DNA, 16 bp, Homo sapiens
ccctggtgctgccaca

SEQ ID NO: 4305916 - DNA, 19 bp, Homo sapiens
ccctggtgtccctgcctgg

SEQ ID NO: 4305917 - DNA, 20 bp, Homo sapiens
ccctggttcccccaggaccc

SEQ ID NO: 4305918 - DNA, 22 bp, Homo sapiens
ccctgtcagtgcagcccgtgtg

SEQ ID NO: 4305919 - DNA, 18 bp, Homo sapiens
ccctgtggaagggactag

SEQ ID NO: 4305920 - DNA, 17 bp, Homo sapiens
ccctgtggagcccgcac

SEQ ID NO: 4305921 - DNA, 14 bp, Homo sapiens
cccttcaaccattc

SEQ ID NO: 4305922 - DNA, 18 bp, Homo sapiens
cccttcaaccattcccca

SEQ ID NO: 4305923 - DNA, 14 bp, Homo sapiens
cccttcccacccct

SEQ ID NO: 4305924 - DNA, 15 bp, Homo sapiens
cccttccccactccc

SEQ ID NO: 4305925 - DNA, 21 bp, Homo sapiens
cccttccccactgcctgccca

SEQ ID NO: 4305926 - DNA, 18 bp, Homo sapiens
cccttcccctgcgccctc

SEQ ID NO: 4305927 - DNA, 22 bp, Homo sapiens
cccttcccctgcgccctccctc

SEQ ID NO: 4305928 - DNA, 13 bp, Homo sapiens
cccttccctgcaa

SEQ ID NO: 4305929 - DNA, 17 bp, Homo sapiens
cccttcctctccactgc

SEQ ID NO: 4305930 - DNA, 20 bp, Homo sapiens
cccttcctctccactgcctt

SEQ ID NO: 4305931 - DNA, 21 bp, Homo sapiens
cccttcctctccactgccttc

SEQ ID NO: 4305932 - DNA, 13 bp, Homo sapiens
cccttctcccaca

SEQ ID NO: 4305933 - DNA, 14 bp, Homo sapiens
cccttctcccacac

SEQ ID NO: 4305934 - DNA, 15 bp, Homo sapiens
cccttctcccacact

SEQ ID NO: 4305935 - DNA, 16 bp, Homo sapiens
cccttctctcagcctc

SEQ ID NO: 4305936 - DNA, 17 bp, Homo sapiens
cccttgctgctggctcc

SEQ ID NO: 4305937 - DNA, 20 bp, Homo sapiens
cccttgggatgggcacaggc

SEQ ID NO: 4305938 - DNA, 18 bp, Homo sapiens
ccctttcccaaacccttc

SEQ ID NO: 4305939 - DNA, 12 bp, Homo sapiens
ccctttccctgc

SEQ ID NO: 4305940 - DNA, 15 bp, Homo sapiens
ccctttccctgcatc

SEQ ID NO: 4305941 - DNA, 16 bp, Homo sapiens
ccctttttactcccct

SEQ ID NO: 4305942 - DNA, 13 bp, Homo sapiens
ccgacagcctggc

SEQ ID NO: 4305943 - DNA, 14 bp, Homo sapiens
ccgagccccctgtc

SEQ ID NO: 4305944 - DNA, 19 bp, Homo sapiens
ccgagctgggggccatgag

SEQ ID NO: 4305945 - DNA, 20 bp, Homo sapiens
ccgaggcagcaacaggacca

SEQ ID NO: 4305946 - DNA, 21 bp, Homo sapiens
ccgaggcagcaacaggaccag

SEQ ID NO: 4305947 - DNA, 17 bp, Homo sapiens
ccgaggcaggggctggg

SEQ ID NO: 4305948 - DNA, 22 bp, Homo sapiens
ccgaggcaggggctgggcagag

SEQ ID NO: 4305949 - DNA, 15 bp, Homo sapiens
ccgaggcctgcgccc

SEQ ID NO: 4305950 - DNA, 17 bp, Homo sapiens
ccgaggctggagctggc

SEQ ID NO: 4305951 - DNA, 12 bp, Homo sapiens
ccgagggaaatg

SEQ ID NO: 4305952 - DNA, 22 bp, Homo sapiens
ccgagtctcttctccactggat

SEQ ID NO: 4305953 - DNA, 16 bp, Homo sapiens
ccgagtgtggagctgc

SEQ ID NO: 4305954 - DNA, 15 bp, Homo sapiens
ccgatgctccagcca

SEQ ID NO: 4305955 - DNA, 17 bp, Homo sapiens
ccgcatgctgcctgcct

SEQ ID NO: 4305956 - DNA, 11 bp, Homo sapiens
ccgcccacctg

SEQ ID NO: 4305957 - DNA, 14 bp, Homo sapiens
ccgcccacctgggc

SEQ ID NO: 4305958 - DNA, 13 bp, Homo sapiens
ccgccccccagag

SEQ ID NO: 4305959 - DNA, 20 bp, Homo sapiens
ccgccccccagagccagggc

SEQ ID NO: 4305960 - DNA, 13 bp, Homo sapiens
ccgccctgggctc

SEQ ID NO: 4305961 - DNA, 18 bp, Homo sapiens
ccgcccttccctgacact

SEQ ID NO: 4305962 - DNA, 17 bp, Homo sapiens
ccgccgtgtctgtggcc

SEQ ID NO: 4305963 - DNA, 23 bp, Homo sapiens
ccgccgtgtctgtggccctctct

SEQ ID NO: 4305964 - DNA, 21 bp, Homo sapiens
ccgcctggcagaactgagctc

SEQ ID NO: 4305965 - DNA, 23 bp, Homo sapiens
ccgccttgagtgacatgcggctg

SEQ ID NO: 4305966 - DNA, 15 bp, Homo sapiens
ccgcgtccaaccccg

SEQ ID NO: 4305967 - DNA, 12 bp, Homo sapiens
ccgctcagccct

SEQ ID NO: 4305968 - DNA, 15 bp, Homo sapiens
ccgctcagccctccc

SEQ ID NO: 4305969 - DNA, 21 bp, Homo sapiens
ccgctcagccctccctgcccc

SEQ ID NO: 4305970 - DNA, 13 bp, Homo sapiens
ccgctctgaggca

SEQ ID NO: 4305971 - DNA, 13 bp, Homo sapiens
ccgctgcagggtg

SEQ ID NO: 4305972 - DNA, 19 bp, Homo sapiens
ccgctgcagtcagcacaga

SEQ ID NO: 4305973 - DNA, 11 bp, Homo sapiens
ccgctgggaga

SEQ ID NO: 4305974 - DNA, 18 bp, Homo sapiens
ccgctgggagaaaagcca

SEQ ID NO: 4305975 - DNA, 21 bp, Homo sapiens
ccgctgggagaaaagccagat

SEQ ID NO: 4305976 - DNA, 19 bp, Homo sapiens
ccgctgggagagccaaggc

SEQ ID NO: 4305977 - DNA, 23 bp, Homo sapiens
ccgctggtgcccaccagctggct

SEQ ID NO: 4305978 - DNA, 19 bp, Homo sapiens
ccgctgtgctgttgtctgc

SEQ ID NO: 4305979 - DNA, 15 bp, Homo sapiens
ccgcttcgccatgtg

SEQ ID NO: 4305980 - DNA, 19 bp, Homo sapiens
ccggacgcatgcagggccc

SEQ ID NO: 4305981 - DNA, 17 bp, Homo sapiens
ccggagctaacactggc

SEQ ID NO: 4305982 - DNA, 22 bp, Homo sapiens
ccggagctaacactggccccta

SEQ ID NO: 4305983 - DNA, 17 bp, Homo sapiens
ccggaggggcctggcag

SEQ ID NO: 4305984 - DNA, 21 bp, Homo sapiens
ccggaggggcctggcagccgt

SEQ ID NO: 4305985 - DNA, 13 bp, Homo sapiens
ccggatctccagg

SEQ ID NO: 4305986 - DNA, 14 bp, Homo sapiens
ccggatctccaggc

SEQ ID NO: 4305987 - DNA, 16 bp, Homo sapiens
ccggatctccaggccc

SEQ ID NO: 4305988 - DNA, 17 bp, Homo sapiens
ccggatctccaggccca

SEQ ID NO: 4305989 - DNA, 20 bp, Homo sapiens
ccggatctccaggcccagcc

SEQ ID NO: 4305990 - DNA, 19 bp, Homo sapiens
ccggatgacacaaatacca

SEQ ID NO: 4305991 - DNA, 13 bp, Homo sapiens
ccggccactctgt

SEQ ID NO: 4305992 - DNA, 23 bp, Homo sapiens
ccggctgagctgtgccagctgct

SEQ ID NO: 4305993 - DNA, 23 bp, Homo sapiens
ccgggagatccgccctgggctct

SEQ ID NO: 4305994 - DNA, 24 bp, Homo sapiens
ccgggagatccgccctgggctctg

SEQ ID NO: 4305995 - DNA, 13 bp, Homo sapiens
ccgggaggaggat

SEQ ID NO: 4305996 - DNA, 13 bp, Homo sapiens
ccggggagctgag

SEQ ID NO: 4305997 - DNA, 20 bp, Homo sapiens
ccggggcagctgccagagaa

SEQ ID NO: 4305998 - DNA, 19 bp, Homo sapiens
ccggggcatggacagggcc

SEQ ID NO: 4305999 - DNA, 20 bp, Homo sapiens
ccgggggtgggggcctgctg

SEQ ID NO: 4306000 - DNA, 22 bp, Homo sapiens
ccggggtctccacctcagggga

SEQ ID NO: 4306001 - DNA, 20 bp, Homo sapiens
ccgggtttggcgggccaagg

SEQ ID NO: 4306002 - DNA, 15 bp, Homo sapiens
ccggtggaaggcctt

SEQ ID NO: 4306003 - DNA, 20 bp, Homo sapiens
ccgtagactcacggctgcac

SEQ ID NO: 4306004 - DNA, 13 bp, Homo sapiens
ccgtcagcctgtg

SEQ ID NO: 4306005 - DNA, 14 bp, Homo sapiens
ccgtccctctcccc

SEQ ID NO: 4306006 - DNA, 17 bp, Homo sapiens
ccgtcctggcagggcag

SEQ ID NO: 4306007 - DNA, 16 bp, Homo sapiens
ccgtgaggagggggag

SEQ ID NO: 4306008 - DNA, 13 bp, Homo sapiens
ccgtgcacggggc

SEQ ID NO: 4306009 - DNA, 19 bp, Homo sapiens
ccgtgccaaatcctgggca

SEQ ID NO: 4306010 - DNA, 19 bp, Homo sapiens
ccgtgccacgcgctctgca

SEQ ID NO: 4306011 - DNA, 20 bp, Homo sapiens
ccgtgccacgcgctctgcat

SEQ ID NO: 4306012 - DNA, 16 bp, Homo sapiens
ccgtgccttcagctct

SEQ ID NO: 4306013 - DNA, 14 bp, Homo sapiens
ccgtggcttcccgc

SEQ ID NO: 4306014 - DNA, 23 bp, Homo sapiens
ccgtgtattcaggaccccatctg

SEQ ID NO: 4306015 - DNA, 16 bp, Homo sapiens
ccgtgtctgtggccct

SEQ ID NO: 4306016 - DNA, 17 bp, Homo sapiens
ccgtgtctgtggccctc

SEQ ID NO: 4306017 - DNA, 19 bp, Homo sapiens
ccgtgtctgtggccctctc

SEQ ID NO: 4306018 - DNA, 21 bp, Homo sapiens
ccgtgtctgtggccctctctt

SEQ ID NO: 4306019 - DNA, 15 bp, Homo sapiens
ccgtgtggccccttc

SEQ ID NO: 4306020 - DNA, 19 bp, Homo sapiens
ccgttgcctctctgccagc

SEQ ID NO: 4306021 - DNA, 14 bp, Homo sapiens
ccgtttccaagcct

SEQ ID NO: 4306022 - DNA, 16 bp, Homo sapiens
ccgtttccaagcctgg

SEQ ID NO: 4306023 - DNA, 20 bp, Homo sapiens
cctaaagatggcgcacccgg

SEQ ID NO: 4306024 - DNA, 12 bp, Homo sapiens
cctaaatgcaaa

SEQ ID NO: 4306025 - DNA, 18 bp, Homo sapiens
cctaatgtggcagctgtc

SEQ ID NO: 4306026 - DNA, 14 bp, Homo sapiens
cctaattaatttca

SEQ ID NO: 4306027 - DNA, 17 bp, Homo sapiens
cctaattaatttcagta

SEQ ID NO: 4306028 - DNA, 22 bp, Homo sapiens
cctacaatatcattttcctggg

SEQ ID NO: 4306029 - DNA, 23 bp, Homo sapiens
cctacaatatcattttcctggga

SEQ ID NO: 4306030 - DNA, 17 bp, Homo sapiens
cctacagtggagggaga

SEQ ID NO: 4306031 - DNA, 18 bp, Homo sapiens
cctacagtggagggagac

SEQ ID NO: 4306032 - DNA, 22 bp, Homo sapiens
cctacccgcccgcgtccaaccc

SEQ ID NO: 4306033 - DNA, 17 bp, Homo sapiens
cctaccgagtctcttct

SEQ ID NO: 4306034 - DNA, 18 bp, Homo sapiens
cctagaatgtttcatttg

SEQ ID NO: 4306035 - DNA, 21 bp, Homo sapiens
cctagctgtgacctctcccct

SEQ ID NO: 4306036 - DNA, 12 bp, Homo sapiens
cctaggagctgg

SEQ ID NO: 4306037 - DNA, 22 bp, Homo sapiens
cctaggcatactctccaggatt

SEQ ID NO: 4306038 - DNA, 12 bp, Homo sapiens
cctaggcctcag

SEQ ID NO: 4306039 - DNA, 16 bp, Homo sapiens
cctagggcctggtcca

SEQ ID NO: 4306040 - DNA, 16 bp, Homo sapiens
cctaggtctccacccc

SEQ ID NO: 4306041 - DNA, 24 bp, Homo sapiens
cctaggtgggtcaactccaaggca

SEQ ID NO: 4306042 - DNA, 20 bp, Homo sapiens
cctagtggcttcagcccctg

SEQ ID NO: 4306043 - DNA, 17 bp, Homo sapiens
cctataaaggaaacacg

SEQ ID NO: 4306044 - DNA, 22 bp, Homo sapiens
cctataccctaggtctccaccc

SEQ ID NO: 4306045 - DNA, 15 bp, Homo sapiens
cctatcacctcccct

SEQ ID NO: 4306046 - DNA, 16 bp, Homo sapiens
cctatcacctcccctc

SEQ ID NO: 4306047 - DNA, 20 bp, Homo sapiens
cctattttggacgtgtgagg

SEQ ID NO: 4306048 - DNA, 13 bp, Homo sapiens
cctcaagccagga

SEQ ID NO: 4306049 - DNA, 20 bp, Homo sapiens
cctcaagccaggagaccctg

SEQ ID NO: 4306050 - DNA, 14 bp, Homo sapiens
cctcacccctgcag

SEQ ID NO: 4306051 - DNA, 15 bp, Homo sapiens
cctcacccctgcagg

SEQ ID NO: 4306052 - DNA, 18 bp, Homo sapiens
cctcacccctgcaggcgg

SEQ ID NO: 4306053 - DNA, 16 bp, Homo sapiens
cctcacctggcttccc

SEQ ID NO: 4306054 - DNA, 19 bp, Homo sapiens
cctcacctggcttcccagg

SEQ ID NO: 4306055 - DNA, 22 bp, Homo sapiens
cctcacctgggcacctggggag

SEQ ID NO: 4306056 - DNA, 22 bp, Homo sapiens
cctcaccttgcaacacacagac

SEQ ID NO: 4306057 - DNA, 14 bp, Homo sapiens
cctcactgccctcc

SEQ ID NO: 4306058 - DNA, 15 bp, Homo sapiens
cctcactggtgcatt

SEQ ID NO: 4306059 - DNA, 17 bp, Homo sapiens
cctcactggtgcattta

SEQ ID NO: 4306060 - DNA, 21 bp, Homo sapiens
cctcagaggccccttgctgct

SEQ ID NO: 4306061 - DNA, 19 bp, Homo sapiens
cctcagagtccaggcccca

SEQ ID NO: 4306062 - DNA, 19 bp, Homo sapiens
cctcagccacacccaggca

SEQ ID NO: 4306063 - DNA, 16 bp, Homo sapiens
cctcagccactcccag

SEQ ID NO: 4306064 - DNA, 15 bp, Homo sapiens
cctcagccccagggc

SEQ ID NO: 4306065 - DNA, 17 bp, Homo sapiens
cctcagccccagggccc

SEQ ID NO: 4306066 - DNA, 18 bp, Homo sapiens
cctcagccccagggccct

SEQ ID NO: 4306067 - DNA, 21 bp, Homo sapiens
cctcagccccagggccctgct

SEQ ID NO: 4306068 - DNA, 14 bp, Homo sapiens
cctcagcccctctt

SEQ ID NO: 4306069 - DNA, 18 bp, Homo sapiens
cctcagcccctcttgccc

SEQ ID NO: 4306070 - DNA, 22 bp, Homo sapiens
cctcaggcagtggcccagggaa

SEQ ID NO: 4306071 - DNA, 20 bp, Homo sapiens
cctcaggcctggccctttca

SEQ ID NO: 4306072 - DNA, 15 bp, Homo sapiens
cctcaggcttgggga

SEQ ID NO: 4306073 - DNA, 13 bp, Homo sapiens
cctcagtccctcc

SEQ ID NO: 4306074 - DNA, 19 bp, Homo sapiens
cctcagtccctccctcctg

SEQ ID NO: 4306075 - DNA, 20 bp, Homo sapiens
cctcagtccctccctcctgg

SEQ ID NO: 4306076 - DNA, 21 bp, Homo sapiens
cctcagtggactttccacccc

SEQ ID NO: 4306077 - DNA, 13 bp, Homo sapiens
cctcatgggagtc

SEQ ID NO: 4306078 - DNA, 23 bp, Homo sapiens
cctccaatcccaccaaccctcag

SEQ ID NO: 4306079 - DNA, 14 bp, Homo sapiens
cctccacacctcca

SEQ ID NO: 4306080 - DNA, 15 bp, Homo sapiens
cctccacacctccac

SEQ ID NO: 4306081 - DNA, 20 bp, Homo sapiens
cctccaccccagtccccggg

SEQ ID NO: 4306082 - DNA, 13 bp, Homo sapiens
cctccacccgtcc

SEQ ID NO: 4306083 - DNA, 14 bp, Homo sapiens
cctccacctgcagc

SEQ ID NO: 4306084 - DNA, 12 bp, Homo sapiens
cctccactcctc

SEQ ID NO: 4306085 - DNA, 15 bp, Homo sapiens
cctccactcctccca

SEQ ID NO: 4306086 - DNA, 16 bp, Homo sapiens
cctccactcctcccaa

SEQ ID NO: 4306087 - DNA, 22 bp, Homo sapiens
cctccagcaatgcctgcctgaa

SEQ ID NO: 4306088 - DNA, 20 bp, Homo sapiens
cctccagccacttatttcca

SEQ ID NO: 4306089 - DNA, 23 bp, Homo sapiens
cctccagtgttgcctcctcccat

SEQ ID NO: 4306090 - DNA, 22 bp, Homo sapiens
cctccatgattccaagggccca

SEQ ID NO: 4306091 - DNA, 17 bp, Homo sapiens
cctccatgtagaagagg

SEQ ID NO: 4306092 - DNA, 23 bp, Homo sapiens
cctcccaaatatgcccctcccca

SEQ ID NO: 4306093 - DNA, 21 bp, Homo sapiens
cctcccaactctggccttggt

SEQ ID NO: 4306094 - DNA, 21 bp, Homo sapiens
cctccccaaccctgcccctgc

SEQ ID NO: 4306095 - DNA, 16 bp, Homo sapiens
cctccccagcaggtgg

SEQ ID NO: 4306096 - DNA, 19 bp, Homo sapiens
cctcccccggggtctccac

SEQ ID NO: 4306097 - DNA, 16 bp, Homo sapiens
cctccccctgccagag

SEQ ID NO: 4306098 - DNA, 20 bp, Homo sapiens
cctccccctgccagaggcct

SEQ ID NO: 4306099 - DNA, 18 bp, Homo sapiens
cctcccctggtcctgcac

SEQ ID NO: 4306100 - DNA, 16 bp, Homo sapiens
cctcccgcatgctgcc

SEQ ID NO: 4306101 - DNA, 21 bp, Homo sapiens
cctcccgcatgctgcctgcct

SEQ ID NO: 4306102 - DNA, 18 bp, Homo sapiens
cctccctagtgacccgga

SEQ ID NO: 4306103 - DNA, 12 bp, Homo sapiens
cctccctcagcc

SEQ ID NO: 4306104 - DNA, 15 bp, Homo sapiens
cctccctccacacct

SEQ ID NO: 4306105 - DNA, 14 bp, Homo sapiens
cctccctccctcca

SEQ ID NO: 4306106 - DNA, 15 bp, Homo sapiens
cctccctccctgctc

SEQ ID NO: 4306107 - DNA, 16 bp, Homo sapiens
cctccctccctgctcc

SEQ ID NO: 4306108 - DNA, 18 bp, Homo sapiens
cctccctccctgctccct

SEQ ID NO: 4306109 - DNA, 14 bp, Homo sapiens
cctccctcctggct

SEQ ID NO: 4306110 - DNA, 15 bp, Homo sapiens
cctccctcctggctc

SEQ ID NO: 4306111 - DNA, 18 bp, Homo sapiens
cctccctgcccctccctt

SEQ ID NO: 4306112 - DNA, 22 bp, Homo sapiens
cctccctgcccctcccttcaac

SEQ ID NO: 4306113 - DNA, 24 bp, Homo sapiens
cctccctgcccctcccttcaacca

SEQ ID NO: 4306114 - DNA, 11 bp, Homo sapiens
cctccctgtcc

SEQ ID NO: 4306115 - DNA, 12 bp, Homo sapiens
cctccctgtccc

SEQ ID NO: 4306116 - DNA, 15 bp, Homo sapiens
cctccctgtcccctg

SEQ ID NO: 4306117 - DNA, 14 bp, Homo sapiens
cctccgcccttccc

SEQ ID NO: 4306118 - DNA, 21 bp, Homo sapiens
cctccgctaaggcttccggct

SEQ ID NO: 4306119 - DNA, 22 bp, Homo sapiens
cctccgctaaggcttccggctg

SEQ ID NO: 4306120 - DNA, 13 bp, Homo sapiens
cctccggccctgc

SEQ ID NO: 4306121 - DNA, 18 bp, Homo sapiens
cctccggccctgccccac

SEQ ID NO: 4306122 - DNA, 20 bp, Homo sapiens
cctccggccctgccccacac

SEQ ID NO: 4306123 - DNA, 18 bp, Homo sapiens
cctcctatcacctcccct

SEQ ID NO: 4306124 - DNA, 19 bp, Homo sapiens
cctcctatcacctcccctc

SEQ ID NO: 4306125 - DNA, 20 bp, Homo sapiens
cctcctcagtctttggggga

SEQ ID NO: 4306126 - DNA, 15 bp, Homo sapiens
cctcctcccatccag

SEQ ID NO: 4306127 - DNA, 12 bp, Homo sapiens
cctcctccctcc

SEQ ID NO: 4306128 - DNA, 20 bp, Homo sapiens
cctcctgaaacttacacaca

SEQ ID NO: 4306129 - DNA, 21 bp, Homo sapiens
cctcctgaaacttacacacaa

SEQ ID NO: 4306130 - DNA, 18 bp, Homo sapiens
cctcctggacccagcagg

SEQ ID NO: 4306131 - DNA, 23 bp, Homo sapiens
cctcctggacccagcaggggcag

SEQ ID NO: 4306132 - DNA, 12 bp, Homo sapiens
cctcctggctca

SEQ ID NO: 4306133 - DNA, 15 bp, Homo sapiens
cctcctggctcacag

SEQ ID NO: 4306134 - DNA, 18 bp, Homo sapiens
cctcctggctcacagcca

SEQ ID NO: 4306135 - DNA, 15 bp, Homo sapiens
cctccttccaggccc

SEQ ID NO: 4306136 - DNA, 12 bp, Homo sapiens
cctccttctccc

SEQ ID NO: 4306137 - DNA, 14 bp, Homo sapiens
cctccttctcccct

SEQ ID NO: 4306138 - DNA, 15 bp, Homo sapiens
cctccttctcccctc

SEQ ID NO: 4306139 - DNA, 18 bp, Homo sapiens
cctccttctcccctccag

SEQ ID NO: 4306140 - DNA, 20 bp, Homo sapiens
cctccttctcccctccagac

SEQ ID NO: 4306141 - DNA, 18 bp, Homo sapiens
cctccttgcctcctgtgt

SEQ ID NO: 4306142 - DNA, 19 bp, Homo sapiens
cctcgaagctgttctctgc

SEQ ID NO: 4306143 - DNA, 15 bp, Homo sapiens
cctcgcccctccagt

SEQ ID NO: 4306144 - DNA, 17 bp, Homo sapiens
cctcgcccctccagtgt

SEQ ID NO: 4306145 - DNA, 17 bp, Homo sapiens
cctcgcttcataggcag

SEQ ID NO: 4306146 - DNA, 20 bp, Homo sapiens
cctcgcttcataggcagagc

SEQ ID NO: 4306147 - DNA, 13 bp, Homo sapiens
cctcggccagagc

SEQ ID NO: 4306148 - DNA, 15 bp, Homo sapiens
cctcggccagagctc

SEQ ID NO: 4306149 - DNA, 16 bp, Homo sapiens
cctcggccagagctcc

SEQ ID NO: 4306150 - DNA, 15 bp, Homo sapiens
cctcggccccaccca

SEQ ID NO: 4306151 - DNA, 16 bp, Homo sapiens
cctcgtctccctggcc

SEQ ID NO: 4306152 - DNA, 16 bp, Homo sapiens
cctctatttagcatga

SEQ ID NO: 4306153 - DNA, 12 bp, Homo sapiens
cctctccactgc

SEQ ID NO: 4306154 - DNA, 14 bp, Homo sapiens
cctctcccaaataa

SEQ ID NO: 4306155 - DNA, 22 bp, Homo sapiens
cctctcccaaataaactcctta

SEQ ID NO: 4306156 - DNA, 23 bp, Homo sapiens
cctctcccaaataaactccttaa

SEQ ID NO: 4306157 - DNA, 13 bp, Homo sapiens
cctctccccggac

SEQ ID NO: 4306158 - DNA, 17 bp, Homo sapiens
cctctcgggctctctca

SEQ ID NO: 4306159 - DNA, 14 bp, Homo sapiens
cctctctcagccca

SEQ ID NO: 4306160 - DNA, 15 bp, Homo sapiens
cctctctcagcccag

SEQ ID NO: 4306161 - DNA, 14 bp, Homo sapiens
cctctctctccctc

SEQ ID NO: 4306162 - DNA, 15 bp, Homo sapiens
cctctctctccctcc

SEQ ID NO: 4306163 - DNA, 20 bp, Homo sapiens
cctctctctccctccactcc

SEQ ID NO: 4306164 - DNA, 21 bp, Homo sapiens
cctctctctccctccactcct

SEQ ID NO: 4306165 - DNA, 19 bp, Homo sapiens
cctctctgccagccgctgg

SEQ ID NO: 4306166 - DNA, 20 bp, Homo sapiens
cctctctgtttaccctccct

SEQ ID NO: 4306167 - DNA, 17 bp, Homo sapiens
cctctcttaatgccacg

SEQ ID NO: 4306168 - DNA, 16 bp, Homo sapiens
cctctcttaccccgtc

SEQ ID NO: 4306169 - DNA, 22 bp, Homo sapiens
cctctcttaccccgtccctttc

SEQ ID NO: 4306170 - DNA, 22 bp, Homo sapiens
cctctgaaaatatttttttcta

SEQ ID NO: 4306171 - DNA, 23 bp, Homo sapiens
cctctgaaaatatttttttctag

SEQ ID NO: 4306172 - DNA, 20 bp, Homo sapiens
cctctgaactgctgctggtc

SEQ ID NO: 4306173 - DNA, 21 bp, Homo sapiens
cctctgcacgtgcacacacct

SEQ ID NO: 4306174 - DNA, 23 bp, Homo sapiens
cctctgcacgtgcacacacctgc

SEQ ID NO: 4306175 - DNA, 19 bp, Homo sapiens
cctctgcagggcagcctgt

SEQ ID NO: 4306176 - DNA, 16 bp, Homo sapiens
cctctgcataaatatt

SEQ ID NO: 4306177 - DNA, 19 bp, Homo sapiens
cctctgccactgacaggaa

SEQ ID NO: 4306178 - DNA, 12 bp, Homo sapiens
cctctgccccca

SEQ ID NO: 4306179 - DNA, 21 bp, Homo sapiens
cctctgcccccagctgctcct

SEQ ID NO: 4306180 - DNA, 17 bp, Homo sapiens
cctctgcctgtccctct

SEQ ID NO: 4306181 - DNA, 18 bp, Homo sapiens
cctctgcctgtccctctc

SEQ ID NO: 4306182 - DNA, 14 bp, Homo sapiens
cctctgccttggac

SEQ ID NO: 4306183 - DNA, 17 bp, Homo sapiens
cctctgctatgtctgtg

SEQ ID NO: 4306184 - DNA, 18 bp, Homo sapiens
cctctgctatgtctgtga

SEQ ID NO: 4306185 - DNA, 17 bp, Homo sapiens
cctctgctgctttccaa

SEQ ID NO: 4306186 - DNA, 17 bp, Homo sapiens
cctctggccctgttgtg

SEQ ID NO: 4306187 - DNA, 13 bp, Homo sapiens
cctctggcctggg

SEQ ID NO: 4306188 - DNA, 16 bp, Homo sapiens
cctctgggctcacacc

SEQ ID NO: 4306189 - DNA, 19 bp, Homo sapiens
cctctgggctcacaccagc

SEQ ID NO: 4306190 - DNA, 16 bp, Homo sapiens
cctctggtccttctga

SEQ ID NO: 4306191 - DNA, 21 bp, Homo sapiens
cctctggtccttctgacccca

SEQ ID NO: 4306192 - DNA, 21 bp, Homo sapiens
cctcttagaagaatattgtat

SEQ ID NO: 4306193 - DNA, 18 bp, Homo sapiens
cctcttagcttttctgca

SEQ ID NO: 4306194 - DNA, 20 bp, Homo sapiens
cctcttcccccttcccctgc

SEQ ID NO: 4306195 - DNA, 23 bp, Homo sapiens
cctcttgccccccaccccagcct

SEQ ID NO: 4306196 - DNA, 13 bp, Homo sapiens
cctcttgggagac

SEQ ID NO: 4306197 - DNA, 16 bp, Homo sapiens
cctgaaatgtttccag

SEQ ID NO: 4306198 - DNA, 18 bp, Homo sapiens
cctgaactaggtgctggc

SEQ ID NO: 4306199 - DNA, 17 bp, Homo sapiens
cctgaagagcgctcctc

SEQ ID NO: 4306200 - DNA, 19 bp, Homo sapiens
cctgaagagcgctcctctg

SEQ ID NO: 4306201 - DNA, 21 bp, Homo sapiens
cctgaagagcgctcctctgcc

SEQ ID NO: 4306202 - DNA, 19 bp, Homo sapiens
cctgaagtgaccccagctc

SEQ ID NO: 4306203 - DNA, 22 bp, Homo sapiens
cctgaagtgaccccagctccag

SEQ ID NO: 4306204 - DNA, 17 bp, Homo sapiens
cctgaatccctttcagt

SEQ ID NO: 4306205 - DNA, 16 bp, Homo sapiens
cctgacagaaggactc

SEQ ID NO: 4306206 - DNA, 17 bp, Homo sapiens
cctgaccccacctagaa

SEQ ID NO: 4306207 - DNA, 15 bp, Homo sapiens
cctgagagcagaatg

SEQ ID NO: 4306208 - DNA, 18 bp, Homo sapiens
cctgaggggcctgccact

SEQ ID NO: 4306209 - DNA, 20 bp, Homo sapiens
cctgagggtttccaccttgg

SEQ ID NO: 4306210 - DNA, 19 bp, Homo sapiens
cctgagtttcaagtatcct

SEQ ID NO: 4306211 - DNA, 15 bp, Homo sapiens
cctgatggccaggcc

SEQ ID NO: 4306212 - DNA, 22 bp, Homo sapiens
cctgcaagtggacgtgggctcc

SEQ ID NO: 4306213 - DNA, 16 bp, Homo sapiens
cctgcacacacctgca

SEQ ID NO: 4306214 - DNA, 17 bp, Homo sapiens
cctgcacacacctgcac

SEQ ID NO: 4306215 - DNA, 16 bp, Homo sapiens
cctgcacacccctgca

SEQ ID NO: 4306216 - DNA, 18 bp, Homo sapiens
cctgcacacccctgcaca

SEQ ID NO: 4306217 - DNA, 18 bp, Homo sapiens
cctgcacaccgtccctct

SEQ ID NO: 4306218 - DNA, 19 bp, Homo sapiens
cctgcacaccgtccctctc

SEQ ID NO: 4306219 - DNA, 22 bp, Homo sapiens
cctgcacaccgtccctctcccc

SEQ ID NO: 4306220 - DNA, 13 bp, Homo sapiens
cctgcaccctctg

SEQ ID NO: 4306221 - DNA, 15 bp, Homo sapiens
cctgcagactcactg

SEQ ID NO: 4306222 - DNA, 16 bp, Homo sapiens
cctgcagactcactgt

SEQ ID NO: 4306223 - DNA, 21 bp, Homo sapiens
cctgcagcagagcctggaaga

SEQ ID NO: 4306224 - DNA, 15 bp, Homo sapiens
cctgcagccccaggc

SEQ ID NO: 4306225 - DNA, 17 bp, Homo sapiens
cctgcagccccaggcct

SEQ ID NO: 4306226 - DNA, 15 bp, Homo sapiens
cctgcagggagcagc

SEQ ID NO: 4306227 - DNA, 17 bp, Homo sapiens
cctgcagggagcagcac

SEQ ID NO: 4306228 - DNA, 19 bp, Homo sapiens
cctgcagttggcctcagca

SEQ ID NO: 4306229 - DNA, 14 bp, Homo sapiens
cctgcatccctcca

SEQ ID NO: 4306230 - DNA, 18 bp, Homo sapiens
cctgcatcccttggcccc

SEQ ID NO: 4306231 - DNA, 14 bp, Homo sapiens
cctgccaactttcc

SEQ ID NO: 4306232 - DNA, 18 bp, Homo sapiens
cctgccaactttccagac

SEQ ID NO: 4306233 - DNA, 19 bp, Homo sapiens
cctgccactctcctgagga

SEQ ID NO: 4306234 - DNA, 17 bp, Homo sapiens
cctgccagaggcctggt

SEQ ID NO: 4306235 - DNA, 18 bp, Homo sapiens
cctgccagaggcctggtg

SEQ ID NO: 4306236 - DNA, 22 bp, Homo sapiens
cctgccatggaggcgccttcct

SEQ ID NO: 4306237 - DNA, 23 bp, Homo sapiens
cctgccatggaggcgccttcctg

SEQ ID NO: 4306238 - DNA, 13 bp, Homo sapiens
cctgcccacccgt

SEQ ID NO: 4306239 - DNA, 22 bp, Homo sapiens
cctgcccacccgtggagatggg

SEQ ID NO: 4306240 - DNA, 12 bp, Homo sapiens
cctgccccacac

SEQ ID NO: 4306241 - DNA, 14 bp, Homo sapiens
cctgccccagagaa

SEQ ID NO: 4306242 - DNA, 15 bp, Homo sapiens
cctgccccagagaag

SEQ ID NO: 4306243 - DNA, 14 bp, Homo sapiens
cctgccccatccca

SEQ ID NO: 4306244 - DNA, 23 bp, Homo sapiens
cctgccccccacattctggctcc

SEQ ID NO: 4306245 - DNA, 15 bp, Homo sapiens
cctgccccccttccc

SEQ ID NO: 4306246 - DNA, 16 bp, Homo sapiens
cctgcccccttctccc

SEQ ID NO: 4306247 - DNA, 19 bp, Homo sapiens
cctgcccccttctcccaca

SEQ ID NO: 4306248 - DNA, 23 bp, Homo sapiens
cctgcccccttctcccacactgc

SEQ ID NO: 4306249 - DNA, 15 bp, Homo sapiens
cctgccccggccact

SEQ ID NO: 4306250 - DNA, 17 bp, Homo sapiens
cctgccccggccactct

SEQ ID NO: 4306251 - DNA, 18 bp, Homo sapiens
cctgccccggccactctg

SEQ ID NO: 4306252 - DNA, 23 bp, Homo sapiens
cctgccccgtcaccatctcaggc

SEQ ID NO: 4306253 - DNA, 18 bp, Homo sapiens
cctgcccctcccttcaac

SEQ ID NO: 4306254 - DNA, 11 bp, Homo sapiens
cctgcccctgc

SEQ ID NO: 4306255 - DNA, 24 bp, Homo sapiens
cctgccctagcagtttgcctctgc

SEQ ID NO: 4306256 - DNA, 18 bp, Homo sapiens
cctgccctcactccactc

SEQ ID NO: 4306257 - DNA, 20 bp, Homo sapiens
cctgccctcactccactccc

SEQ ID NO: 4306258 - DNA, 22 bp, Homo sapiens
cctgccctcgtctccctggcca

SEQ ID NO: 4306259 - DNA, 17 bp, Homo sapiens
cctgcctacgtgctgcc

SEQ ID NO: 4306260 - DNA, 18 bp, Homo sapiens
cctgcctaggagctgggg

SEQ ID NO: 4306261 - DNA, 12 bp, Homo sapiens
cctgcctccggc

SEQ ID NO: 4306262 - DNA, 16 bp, Homo sapiens
cctgcctccggccctg

SEQ ID NO: 4306263 - DNA, 19 bp, Homo sapiens
cctgcctctgaactgctgc

SEQ ID NO: 4306264 - DNA, 16 bp, Homo sapiens
cctgcctggccctcct

SEQ ID NO: 4306265 - DNA, 15 bp, Homo sapiens
cctgcgatggtgctg

SEQ ID NO: 4306266 - DNA, 18 bp, Homo sapiens
cctgcgatggtgctgcac

SEQ ID NO: 4306267 - DNA, 21 bp, Homo sapiens
cctgcgatggtgctgcacccc

SEQ ID NO: 4306268 - DNA, 15 bp, Homo sapiens
cctgcgcaggccctc

SEQ ID NO: 4306269 - DNA, 17 bp, Homo sapiens
cctgcgcaggccctccg

SEQ ID NO: 4306270 - DNA, 17 bp, Homo sapiens
cctgcgccctccctccc

SEQ ID NO: 4306271 - DNA, 17 bp, Homo sapiens
cctgcgtggcctggggc

SEQ ID NO: 4306272 - DNA, 22 bp, Homo sapiens
cctgcgtggcctggggctgccg

SEQ ID NO: 4306273 - DNA, 15 bp, Homo sapiens
cctgctatccagccg

SEQ ID NO: 4306274 - DNA, 15 bp, Homo sapiens
cctgctcagatgctg

SEQ ID NO: 4306275 - DNA, 18 bp, Homo sapiens
cctgctcccggctctgag

SEQ ID NO: 4306276 - DNA, 21 bp, Homo sapiens
cctgctcccggctctgaggct

SEQ ID NO: 4306277 - DNA, 13 bp, Homo sapiens
cctgctccctgct

SEQ ID NO: 4306278 - DNA, 16 bp, Homo sapiens
cctgctgagtggtcca

SEQ ID NO: 4306279 - DNA, 16 bp, Homo sapiens
cctgctgcccgtgagg

SEQ ID NO: 4306280 - DNA, 22 bp, Homo sapiens
cctgctgcccgtgaggaggggg

SEQ ID NO: 4306281 - DNA, 13 bp, Homo sapiens
cctgctgcctccc

SEQ ID NO: 4306282 - DNA, 23 bp, Homo sapiens
cctgctgcctccccaaccctgcc

SEQ ID NO: 4306283 - DNA, 19 bp, Homo sapiens
cctgctgctcctcggccag

SEQ ID NO: 4306284 - DNA, 11 bp, Homo sapiens
cctgctggccc

SEQ ID NO: 4306285 - DNA, 14 bp, Homo sapiens
cctgctggcccctc

SEQ ID NO: 4306286 - DNA, 15 bp, Homo sapiens
cctgctggcccctca

SEQ ID NO: 4306287 - DNA, 16 bp, Homo sapiens
cctgctggcccctcac

SEQ ID NO: 4306288 - DNA, 18 bp, Homo sapiens
cctgctggtgcccaccct

SEQ ID NO: 4306289 - DNA, 15 bp, Homo sapiens
cctgctgtgggtcag

SEQ ID NO: 4306290 - DNA, 20 bp, Homo sapiens
cctgcttgtgttgggcccca

SEQ ID NO: 4306291 - DNA, 22 bp, Homo sapiens
cctgctttgggctgccctggtg

SEQ ID NO: 4306292 - DNA, 16 bp, Homo sapiens
cctggacccagcaggg

SEQ ID NO: 4306293 - DNA, 22 bp, Homo sapiens
cctggactctgtggggccacac

SEQ ID NO: 4306294 - DNA, 16 bp, Homo sapiens
cctggagaactagaga

SEQ ID NO: 4306295 - DNA, 12 bp, Homo sapiens
cctggaggacaa

SEQ ID NO: 4306296 - DNA, 17 bp, Homo sapiens
cctggagttgggctggt

SEQ ID NO: 4306297 - DNA, 20 bp, Homo sapiens
cctggatggatctgctccat

SEQ ID NO: 4306298 - DNA, 13 bp, Homo sapiens
cctggattttctt

SEQ ID NO: 4306299 - DNA, 16 bp, Homo sapiens
cctggcacagggcagt

SEQ ID NO: 4306300 - DNA, 14 bp, Homo sapiens
cctggcagaactga

SEQ ID NO: 4306301 - DNA, 21 bp, Homo sapiens
cctggcagggcaggcagagct

SEQ ID NO: 4306302 - DNA, 19 bp, Homo sapiens
cctggcattgtttccaccc

SEQ ID NO: 4306303 - DNA, 13 bp, Homo sapiens
cctggccaccctt

SEQ ID NO: 4306304 - DNA, 14 bp, Homo sapiens
cctggcccagccag

SEQ ID NO: 4306305 - DNA, 19 bp, Homo sapiens
cctggcccagccagcaggt

SEQ ID NO: 4306306 - DNA, 15 bp, Homo sapiens
cctggcccagcctgt

SEQ ID NO: 4306307 - DNA, 18 bp, Homo sapiens
cctggcccagcctgtggc

SEQ ID NO: 4306308 - DNA, 12 bp, Homo sapiens
cctggccttgag

SEQ ID NO: 4306309 - DNA, 15 bp, Homo sapiens
cctggctcacagcca

SEQ ID NO: 4306310 - DNA, 14 bp, Homo sapiens
cctggctctgtcac

SEQ ID NO: 4306311 - DNA, 13 bp, Homo sapiens
cctggcttcccag

SEQ ID NO: 4306312 - DNA, 20 bp, Homo sapiens
cctggcttcccaggaccctg

SEQ ID NO: 4306313 - DNA, 16 bp, Homo sapiens
cctggcttttcactgc

SEQ ID NO: 4306314 - DNA, 17 bp, Homo sapiens
cctggcttttcactgct

SEQ ID NO: 4306315 - DNA, 21 bp, Homo sapiens
cctggcttttcactgctggct

SEQ ID NO: 4306316 - DNA, 23 bp, Homo sapiens
cctggcttttcactgctggctgc

SEQ ID NO: 4306317 - DNA, 15 bp, Homo sapiens
cctgggaaaagggca

SEQ ID NO: 4306318 - DNA, 17 bp, Homo sapiens
cctgggagatgctggga

SEQ ID NO: 4306319 - DNA, 22 bp, Homo sapiens
cctgggagatgctgggaccctc

SEQ ID NO: 4306320 - DNA, 20 bp, Homo sapiens
cctgggcacctggggagtgg

SEQ ID NO: 4306321 - DNA, 15 bp, Homo sapiens
cctgggcagcccaga

SEQ ID NO: 4306322 - DNA, 18 bp, Homo sapiens
cctgggcagcccagagag

SEQ ID NO: 4306323 - DNA, 19 bp, Homo sapiens
cctgggcatccccagcccc

SEQ ID NO: 4306324 - DNA, 13 bp, Homo sapiens
cctgggcatctgg

SEQ ID NO: 4306325 - DNA, 17 bp, Homo sapiens
cctgggcatctggccct

SEQ ID NO: 4306326 - DNA, 18 bp, Homo sapiens
cctgggcatctggccctg

SEQ ID NO: 4306327 - DNA, 23 bp, Homo sapiens
cctgggcatctggccctgctgcc

SEQ ID NO: 4306328 - DNA, 16 bp, Homo sapiens
cctgggccactggcat

SEQ ID NO: 4306329 - DNA, 17 bp, Homo sapiens
cctgggccactggcatc

SEQ ID NO: 4306330 - DNA, 13 bp, Homo sapiens
cctgggccagggt

SEQ ID NO: 4306331 - DNA, 21 bp, Homo sapiens
cctgggccagggtctcgtcag

SEQ ID NO: 4306332 - DNA, 23 bp, Homo sapiens
cctgggccagggtctcgtcagga

SEQ ID NO: 4306333 - DNA, 13 bp, Homo sapiens
cctgggccccctg

SEQ ID NO: 4306334 - DNA, 19 bp, Homo sapiens
cctgggccccctgggagag

SEQ ID NO: 4306335 - DNA, 13 bp, Homo sapiens
cctgggccctagg

SEQ ID NO: 4306336 - DNA, 11 bp, Homo sapiens
cctgggctctg

SEQ ID NO: 4306337 - DNA, 23 bp, Homo sapiens
cctggggacggagcactgtgcag

SEQ ID NO: 4306338 - DNA, 18 bp, Homo sapiens
cctggggagtgggacaga

SEQ ID NO: 4306339 - DNA, 17 bp, Homo sapiens
cctggggggcacagcca

SEQ ID NO: 4306340 - DNA, 23 bp, Homo sapiens
cctggggtggaggctaagcctgg

SEQ ID NO: 4306341 - DNA, 18 bp, Homo sapiens
cctggggtgggtgtgagc

SEQ ID NO: 4306342 - DNA, 23 bp, Homo sapiens
cctggggtgggtgtgagcagggt

SEQ ID NO: 4306343 - DNA, 20 bp, Homo sapiens
cctggggtttccacacaggc

SEQ ID NO: 4306344 - DNA, 21 bp, Homo sapiens
cctggggtttccacacaggcc

SEQ ID NO: 4306345 - DNA, 22 bp, Homo sapiens
cctggggtttccacacaggccc

SEQ ID NO: 4306346 - DNA, 23 bp, Homo sapiens
cctggggtttccacacaggccca

SEQ ID NO: 4306347 - DNA, 16 bp, Homo sapiens
cctgggtgtgctccag

SEQ ID NO: 4306348 - DNA, 14 bp, Homo sapiens
cctggtctggagcc

SEQ ID NO: 4306349 - DNA, 15 bp, Homo sapiens
cctggtctggagccc

SEQ ID NO: 4306350 - DNA, 17 bp, Homo sapiens
cctggtctggagcccct

SEQ ID NO: 4306351 - DNA, 18 bp, Homo sapiens
cctggtctggagccccta

SEQ ID NO: 4306352 - DNA, 12 bp, Homo sapiens
cctggtctggct

SEQ ID NO: 4306353 - DNA, 22 bp, Homo sapiens
cctggtgaaagagtaaaaccaa

SEQ ID NO: 4306354 - DNA, 15 bp, Homo sapiens
cctggtgccctggcc

SEQ ID NO: 4306355 - DNA, 13 bp, Homo sapiens
cctggtgcctgca

SEQ ID NO: 4306356 - DNA, 15 bp, Homo sapiens
cctggtgctgccaca

SEQ ID NO: 4306357 - DNA, 21 bp, Homo sapiens
cctggtgctgccacacttcag

SEQ ID NO: 4306358 - DNA, 20 bp, Homo sapiens
cctggtggccaagcctgccc

SEQ ID NO: 4306359 - DNA, 16 bp, Homo sapiens
cctggtgtctagtttg

SEQ ID NO: 4306360 - DNA, 17 bp, Homo sapiens
cctgtcaatgtttgctt

SEQ ID NO: 4306361 - DNA, 17 bp, Homo sapiens
cctgtcatactttgtta

SEQ ID NO: 4306362 - DNA, 14 bp, Homo sapiens
cctgtccctgcccc

SEQ ID NO: 4306363 - DNA, 14 bp, Homo sapiens
cctgtcctggctcc

SEQ ID NO: 4306364 - DNA, 20 bp, Homo sapiens
cctgtctgaaaccagaagac

SEQ ID NO: 4306365 - DNA, 21 bp, Homo sapiens
cctgtctgcgccgctgtgctg

SEQ ID NO: 4306366 - DNA, 23 bp, Homo sapiens
cctgtctttgctgtttatatata

SEQ ID NO: 4306367 - DNA, 15 bp, Homo sapiens
cctgtgaactgccag

SEQ ID NO: 4306368 - DNA, 16 bp, Homo sapiens
cctgtgaactgccagg

SEQ ID NO: 4306369 - DNA, 16 bp, Homo sapiens
cctgtgaccggggtcc

SEQ ID NO: 4306370 - DNA, 18 bp, Homo sapiens
cctgtgaccggggtcctg

SEQ ID NO: 4306371 - DNA, 15 bp, Homo sapiens
cctgtgatcgtgtgt

SEQ ID NO: 4306372 - DNA, 17 bp, Homo sapiens
cctgtgatcgtgtgttg

SEQ ID NO: 4306373 - DNA, 16 bp, Homo sapiens
cctgtgcccgctgcgc

SEQ ID NO: 4306374 - DNA, 20 bp, Homo sapiens
cctgtgcccgctgcgctgcc

SEQ ID NO: 4306375 - DNA, 23 bp, Homo sapiens
cctgtgcccgctgcgctgccctg

SEQ ID NO: 4306376 - DNA, 16 bp, Homo sapiens
cctgtgctgctgcacc

SEQ ID NO: 4306377 - DNA, 16 bp, Homo sapiens
cctgtggaagggacta

SEQ ID NO: 4306378 - DNA, 20 bp, Homo sapiens
cctgtggaagggactaggag

SEQ ID NO: 4306379 - DNA, 24 bp, Homo sapiens
cctgtggaagggactaggagcact

SEQ ID NO: 4306380 - DNA, 15 bp, Homo sapiens
cctgtggcctcagca

SEQ ID NO: 4306381 - DNA, 16 bp, Homo sapiens
cctgtggcggtgcagt

SEQ ID NO: 4306382 - DNA, 12 bp, Homo sapiens
cctgtgggagaa

SEQ ID NO: 4306383 - DNA, 20 bp, Homo sapiens
cctgtggtgaggtcctgtcc

SEQ ID NO: 4306384 - DNA, 21 bp, Homo sapiens
cctgtgtaatcatttcttggg

SEQ ID NO: 4306385 - DNA, 20 bp, Homo sapiens
cctgtgttagtgtctgtcca

SEQ ID NO: 4306386 - DNA, 22 bp, Homo sapiens
cctgtgttagtgtctgtccatc

SEQ ID NO: 4306387 - DNA, 18 bp, Homo sapiens
cctgttctcagagctcca

SEQ ID NO: 4306388 - DNA, 20 bp, Homo sapiens
ccttaaaaaatatgctctcc

SEQ ID NO: 4306389 - DNA, 17 bp, Homo sapiens
ccttaaaattagcatct

SEQ ID NO: 4306390 - DNA, 16 bp, Homo sapiens
ccttaagaaagctata

SEQ ID NO: 4306391 - DNA, 23 bp, Homo sapiens
ccttaagtcttactgttttgtgc

SEQ ID NO: 4306392 - DNA, 19 bp, Homo sapiens
ccttagaaaagactgacct

SEQ ID NO: 4306393 - DNA, 14 bp, Homo sapiens
ccttagaacctttc

SEQ ID NO: 4306394 - DNA, 15 bp, Homo sapiens
ccttagaacctttct

SEQ ID NO: 4306395 - DNA, 15 bp, Homo sapiens
ccttagtttcagctg

SEQ ID NO: 4306396 - DNA, 14 bp, Homo sapiens
ccttatcataaatt

SEQ ID NO: 4306397 - DNA, 13 bp, Homo sapiens
ccttatgtggggt

SEQ ID NO: 4306398 - DNA, 13 bp, Homo sapiens
ccttcaccaagct

SEQ ID NO: 4306399 - DNA, 15 bp, Homo sapiens
ccttcacccagcacc

SEQ ID NO: 4306400 - DNA, 16 bp, Homo sapiens
ccttcacccagcaccc

SEQ ID NO: 4306401 - DNA, 19 bp, Homo sapiens
ccttcataaattatttcta

SEQ ID NO: 4306402 - DNA, 11 bp, Homo sapiens
ccttcatttaa

SEQ ID NO: 4306403 - DNA, 12 bp, Homo sapiens
ccttcatttcct

SEQ ID NO: 4306404 - DNA, 13 bp, Homo sapiens
ccttcatttcctc

SEQ ID NO: 4306405 - DNA, 18 bp, Homo sapiens
ccttccaggccccaggct

SEQ ID NO: 4306406 - DNA, 22 bp, Homo sapiens
ccttccaggccccaggctggat

SEQ ID NO: 4306407 - DNA, 22 bp, Homo sapiens
ccttccaggcgtagggccaggg

SEQ ID NO: 4306408 - DNA, 13 bp, Homo sapiens
ccttccatgggca

SEQ ID NO: 4306409 - DNA, 13 bp, Homo sapiens
ccttcccacccct

SEQ ID NO: 4306410 - DNA, 20 bp, Homo sapiens
ccttcccacggccactgcag

SEQ ID NO: 4306411 - DNA, 23 bp, Homo sapiens
ccttcccctcagccacacccagg

SEQ ID NO: 4306412 - DNA, 21 bp, Homo sapiens
ccttcccctgcgccctccctc

SEQ ID NO: 4306413 - DNA, 23 bp, Homo sapiens
ccttcccctgcgccctccctccc

SEQ ID NO: 4306414 - DNA, 17 bp, Homo sapiens
ccttccgctctgaggca

SEQ ID NO: 4306415 - DNA, 17 bp, Homo sapiens
ccttcctctccactgcc

SEQ ID NO: 4306416 - DNA, 16 bp, Homo sapiens
ccttcctgggcagccc

SEQ ID NO: 4306417 - DNA, 17 bp, Homo sapiens
ccttcctgggcagccca

SEQ ID NO: 4306418 - DNA, 22 bp, Homo sapiens
ccttcctgggcagcccagagag

SEQ ID NO: 4306419 - DNA, 23 bp, Homo sapiens
ccttcctgggcagcccagagaga

SEQ ID NO: 4306420 - DNA, 15 bp, Homo sapiens
ccttcgatacaccgg

SEQ ID NO: 4306421 - DNA, 22 bp, Homo sapiens
ccttcgatacaccgggcctgga

SEQ ID NO: 4306422 - DNA, 16 bp, Homo sapiens
ccttcgtggagctcta

SEQ ID NO: 4306423 - DNA, 15 bp, Homo sapiens
ccttctctcagcctc

SEQ ID NO: 4306424 - DNA, 17 bp, Homo sapiens
ccttctggccgctgcag

SEQ ID NO: 4306425 - DNA, 24 bp, Homo sapiens
ccttctggggagggacacagagga

SEQ ID NO: 4306426 - DNA, 21 bp, Homo sapiens
ccttgagccgtgacctccagg

SEQ ID NO: 4306427 - DNA, 19 bp, Homo sapiens
ccttgaggacctccacctg

SEQ ID NO: 4306428 - DNA, 20 bp, Homo sapiens
ccttgaggacctccacctgg

SEQ ID NO: 4306429 - DNA, 19 bp, Homo sapiens
ccttgagtgacatgcggct

SEQ ID NO: 4306430 - DNA, 14 bp, Homo sapiens
ccttgatgtcttga

SEQ ID NO: 4306431 - DNA, 20 bp, Homo sapiens
ccttgattttagccttctct

SEQ ID NO: 4306432 - DNA, 17 bp, Homo sapiens
ccttgcaacacacagac

SEQ ID NO: 4306433 - DNA, 14 bp, Homo sapiens
ccttgcctcctgtg

SEQ ID NO: 4306434 - DNA, 14 bp, Homo sapiens
ccttgctgctggct

SEQ ID NO: 4306435 - DNA, 17 bp, Homo sapiens
ccttgctgctggctccc

SEQ ID NO: 4306436 - DNA, 18 bp, Homo sapiens
ccttgctgctggctccca

SEQ ID NO: 4306437 - DNA, 16 bp, Homo sapiens
ccttggacaccatccc

SEQ ID NO: 4306438 - DNA, 20 bp, Homo sapiens
ccttggacggggacacggcc

SEQ ID NO: 4306439 - DNA, 22 bp, Homo sapiens
ccttggacggggacacggcctc

SEQ ID NO: 4306440 - DNA, 13 bp, Homo sapiens
ccttggcccagca

SEQ ID NO: 4306441 - DNA, 23 bp, Homo sapiens
ccttggcccagcagcggcccaga

SEQ ID NO: 4306442 - DNA, 17 bp, Homo sapiens
ccttggcccctctctgt

SEQ ID NO: 4306443 - DNA, 20 bp, Homo sapiens
ccttgggatgggcacaggct

SEQ ID NO: 4306444 - DNA, 21 bp, Homo sapiens
ccttgggatgggcacaggctg

SEQ ID NO: 4306445 - DNA, 18 bp, Homo sapiens
ccttggggattcttccat

SEQ ID NO: 4306446 - DNA, 14 bp, Homo sapiens
ccttggtctaactt

SEQ ID NO: 4306447 - DNA, 23 bp, Homo sapiens
ccttggtctaacttttgtgtgaa

SEQ ID NO: 4306448 - DNA, 14 bp, Homo sapiens
ccttggttcctcca

SEQ ID NO: 4306449 - DNA, 20 bp, Homo sapiens
ccttgtgatcactttctgaa

SEQ ID NO: 4306450 - DNA, 16 bp, Homo sapiens
cctttaggcaggaagt

SEQ ID NO: 4306451 - DNA, 13 bp, Homo sapiens
cctttcacccctc

SEQ ID NO: 4306452 - DNA, 19 bp, Homo sapiens
cctttcacccctcttccca

SEQ ID NO: 4306453 - DNA, 16 bp, Homo sapiens
cctttcactgaagtga

SEQ ID NO: 4306454 - DNA, 15 bp, Homo sapiens
cctttcatcctcagc

SEQ ID NO: 4306455 - DNA, 12 bp, Homo sapiens
cctttgctgcct

SEQ ID NO: 4306456 - DNA, 16 bp, Homo sapiens
cctttgctgccttctg

SEQ ID NO: 4306457 - DNA, 19 bp, Homo sapiens
cctttgctgccttctgtct

SEQ ID NO: 4306458 - DNA, 16 bp, Homo sapiens
cctttggcacaccctc

SEQ ID NO: 4306459 - DNA, 19 bp, Homo sapiens
ccttttggcccccgagctg

SEQ ID NO: 4306460 - DNA, 15 bp, Homo sapiens
cctttttactcccct

SEQ ID NO: 4306461 - DNA, 14 bp, Homo sapiens
cctttttgagccaa

SEQ ID NO: 4306462 - DNA, 15 bp, Homo sapiens
cgaagctcagcccac

SEQ ID NO: 4306463 - DNA, 12 bp, Homo sapiens
cgacagcctggc

SEQ ID NO: 4306464 - DNA, 19 bp, Homo sapiens
cgacatggacccggagcta

SEQ ID NO: 4306465 - DNA, 12 bp, Homo sapiens
cgagacaggcag

SEQ ID NO: 4306466 - DNA, 20 bp, Homo sapiens
cgagccagattaggcctgga

SEQ ID NO: 4306467 - DNA, 16 bp, Homo sapiens
cgagcgacggctcctc

SEQ ID NO: 4306468 - DNA, 22 bp, Homo sapiens
cgagctctcctgggccagggtc

SEQ ID NO: 4306469 - DNA, 23 bp, Homo sapiens
cgagctctcctgggccagggtct

SEQ ID NO: 4306470 - DNA, 16 bp, Homo sapiens
cgagctgggggccatg

SEQ ID NO: 4306471 - DNA, 20 bp, Homo sapiens
cgagctgggggccatgagct

SEQ ID NO: 4306472 - DNA, 12 bp, Homo sapiens
cgaggcagagga

SEQ ID NO: 4306473 - DNA, 22 bp, Homo sapiens
cgaggcagcaacaggaccagga

SEQ ID NO: 4306474 - DNA, 15 bp, Homo sapiens
cgaggctggagctgg

SEQ ID NO: 4306475 - DNA, 19 bp, Homo sapiens
cgaggggagggtggcaggt

SEQ ID NO: 4306476 - DNA, 19 bp, Homo sapiens
cgagggtcccaaggcgtgc

SEQ ID NO: 4306477 - DNA, 13 bp, Homo sapiens
cgagtgccccaga

SEQ ID NO: 4306478 - DNA, 15 bp, Homo sapiens
cgagtgtggagctgc

SEQ ID NO: 4306479 - DNA, 20 bp, Homo sapiens
cgagtgtggagctgcttcca

SEQ ID NO: 4306480 - DNA, 18 bp, Homo sapiens
cgatccccgacagtggct

SEQ ID NO: 4306481 - DNA, 14 bp, Homo sapiens
cgatgctccagcca

SEQ ID NO: 4306482 - DNA, 22 bp, Homo sapiens
cgatgctccagccaacccctgt

SEQ ID NO: 4306483 - DNA, 21 bp, Homo sapiens
cgatgggatcattatttcatg

SEQ ID NO: 4306484 - DNA, 21 bp, Homo sapiens
cgatgtcaaccttgtgtgagt

SEQ ID NO: 4306485 - DNA, 20 bp, Homo sapiens
cgcaaatacatgcctttcca

SEQ ID NO: 4306486 - DNA, 15 bp, Homo sapiens
cgcaagcctcagcca

SEQ ID NO: 4306487 - DNA, 18 bp, Homo sapiens
cgcaagcctcagccactc

SEQ ID NO: 4306488 - DNA, 11 bp, Homo sapiens
cgcacacacac

SEQ ID NO: 4306489 - DNA, 17 bp, Homo sapiens
cgcacacacactcttca

SEQ ID NO: 4306490 - DNA, 20 bp, Homo sapiens
cgcacagaaggaaggagcca

SEQ ID NO: 4306491 - DNA, 13 bp, Homo sapiens
cgcacccccaccc

SEQ ID NO: 4306492 - DNA, 13 bp, Homo sapiens
cgcacccggcagc

SEQ ID NO: 4306493 - DNA, 19 bp, Homo sapiens
cgcacgcaagcctcagcca

SEQ ID NO: 4306494 - DNA, 10 bp, Homo sapiens
cgcagccctg

SEQ ID NO: 4306495 - DNA, 11 bp, Homo sapiens
cgcaggccctc

SEQ ID NO: 4306496 - DNA, 14 bp, Homo sapiens
cgcagggagaccct

SEQ ID NO: 4306497 - DNA, 16 bp, Homo sapiens
cgcagggagaccctgg

SEQ ID NO: 4306498 - DNA, 15 bp, Homo sapiens
cgcagtgcctctggt

SEQ ID NO: 4306499 - DNA, 15 bp, Homo sapiens
cgcagttactggttg

SEQ ID NO: 4306500 - DNA, 22 bp, Homo sapiens
cgcagttactggttggtgttct

SEQ ID NO: 4306501 - DNA, 23 bp, Homo sapiens
cgcatgcagggcccccactggag

SEQ ID NO: 4306502 - DNA, 21 bp, Homo sapiens
cgcatgctgcctgcctccggc

SEQ ID NO: 4306503 - DNA, 23 bp, Homo sapiens
cgcatgctgcctgcctccggccc

SEQ ID NO: 4306504 - DNA, 21 bp, Homo sapiens
cgccaaccccagcagtcctgg

SEQ ID NO: 4306505 - DNA, 17 bp, Homo sapiens
cgccatgtgctgtgcac

SEQ ID NO: 4306506 - DNA, 17 bp, Homo sapiens
cgcccaaagccagacag

SEQ ID NO: 4306507 - DNA, 20 bp, Homo sapiens
cgcccacctgggccctaggc

SEQ ID NO: 4306508 - DNA, 14 bp, Homo sapiens
cgccccccagagcc

SEQ ID NO: 4306509 - DNA, 20 bp, Homo sapiens
cgccccccagagccagggct

SEQ ID NO: 4306510 - DNA, 21 bp, Homo sapiens
cgccccccagagccagggctg

SEQ ID NO: 4306511 - DNA, 13 bp, Homo sapiens
cgccccttccccc

SEQ ID NO: 4306512 - DNA, 18 bp, Homo sapiens
cgccctccctccctccac

SEQ ID NO: 4306513 - DNA, 13 bp, Homo sapiens
cgccctcctccct

SEQ ID NO: 4306514 - DNA, 11 bp, Homo sapiens
cgccctctgcc

SEQ ID NO: 4306515 - DNA, 23 bp, Homo sapiens
cgcccttccctgacactgtctgc

SEQ ID NO: 4306516 - DNA, 18 bp, Homo sapiens
cgccgctgtgctgttgtc

SEQ ID NO: 4306517 - DNA, 19 bp, Homo sapiens
cgccgtgtctgtggccctc

SEQ ID NO: 4306518 - DNA, 13 bp, Homo sapiens
cgcctctctcagc

SEQ ID NO: 4306519 - DNA, 18 bp, Homo sapiens
cgcctctctcagcccagg

SEQ ID NO: 4306520 - DNA, 13 bp, Homo sapiens
cgcctctgggctc

SEQ ID NO: 4306521 - DNA, 23 bp, Homo sapiens
cgcctctgggctcacaccagccc

SEQ ID NO: 4306522 - DNA, 20 bp, Homo sapiens
cgcctgcgatggtgctgcac

SEQ ID NO: 4306523 - DNA, 19 bp, Homo sapiens
cgccttctggctgctgcag

SEQ ID NO: 4306524 - DNA, 13 bp, Homo sapiens
cgccttctgggga

SEQ ID NO: 4306525 - DNA, 12 bp, Homo sapiens
cgcgcacacaca

SEQ ID NO: 4306526 - DNA, 16 bp, Homo sapiens
cgcgctctgcatgctc

SEQ ID NO: 4306527 - DNA, 14 bp, Homo sapiens
cgcgggggacagga

SEQ ID NO: 4306528 - DNA, 13 bp, Homo sapiens
cgctaaggcttcc

SEQ ID NO: 4306529 - DNA, 17 bp, Homo sapiens
cgctattcccaggcagg

SEQ ID NO: 4306530 - DNA, 13 bp, Homo sapiens
cgctcctgccctc

SEQ ID NO: 4306531 - DNA, 15 bp, Homo sapiens
cgctctgcatgctcc

SEQ ID NO: 4306532 - DNA, 19 bp, Homo sapiens
cgctctgcatgctcctctg

SEQ ID NO: 4306533 - DNA, 20 bp, Homo sapiens
cgctctgcatgctcctctgc

SEQ ID NO: 4306534 - DNA, 18 bp, Homo sapiens
cgctctgccatcagcccc

SEQ ID NO: 4306535 - DNA, 15 bp, Homo sapiens
cgctcttcaccagga

SEQ ID NO: 4306536 - DNA, 16 bp, Homo sapiens
cgctcttcaccaggaa

SEQ ID NO: 4306537 - DNA, 14 bp, Homo sapiens
cgctgagggcaggg

SEQ ID NO: 4306538 - DNA, 22 bp, Homo sapiens
cgctgagggcagggttctagaa

SEQ ID NO: 4306539 - DNA, 23 bp, Homo sapiens
cgctgagggcagggttctagaag

SEQ ID NO: 4306540 - DNA, 15 bp, Homo sapiens
cgctgcagtcagcac

SEQ ID NO: 4306541 - DNA, 14 bp, Homo sapiens
cgctgccctgcaaa

SEQ ID NO: 4306542 - DNA, 13 bp, Homo sapiens
cgctgcgctgccc

SEQ ID NO: 4306543 - DNA, 23 bp, Homo sapiens
cgctgggagaaaagccagatgac

SEQ ID NO: 4306544 - DNA, 12 bp, Homo sapiens
cgctgggagagc

SEQ ID NO: 4306545 - DNA, 14 bp, Homo sapiens
cgctgggagagcca

SEQ ID NO: 4306546 - DNA, 21 bp, Homo sapiens
cgctggtgcccaccagctggc

SEQ ID NO: 4306547 - DNA, 20 bp, Homo sapiens
cgctgtctccagacccccac

SEQ ID NO: 4306548 - DNA, 16 bp, Homo sapiens
cgcttcataggcagag

SEQ ID NO: 4306549 - DNA, 14 bp, Homo sapiens
cggacaagcccagg

SEQ ID NO: 4306550 - DNA, 15 bp, Homo sapiens
cggacaagcccagga

SEQ ID NO: 4306551 - DNA, 23 bp, Homo sapiens
cggagcctgtgttagtgtctgtc

SEQ ID NO: 4306552 - DNA, 20 bp, Homo sapiens
cggagctaacactggcccct

SEQ ID NO: 4306553 - DNA, 16 bp, Homo sapiens
cggaggccacatgagt

SEQ ID NO: 4306554 - DNA, 19 bp, Homo sapiens
cggaggccacatgagtccc

SEQ ID NO: 4306555 - DNA, 23 bp, Homo sapiens
cggaggcttgtcagagctgggag

SEQ ID NO: 4306556 - DNA, 18 bp, Homo sapiens
cggaggggcctggcagcc

SEQ ID NO: 4306557 - DNA, 18 bp, Homo sapiens
cggagtcactgcctggag

SEQ ID NO: 4306558 - DNA, 13 bp, Homo sapiens
cggagttgggggt

SEQ ID NO: 4306559 - DNA, 13 bp, Homo sapiens
cggatctccaggc

SEQ ID NO: 4306560 - DNA, 15 bp, Homo sapiens
cggatctccaggccc

SEQ ID NO: 4306561 - DNA, 17 bp, Homo sapiens
cggatctccaggcccag

SEQ ID NO: 4306562 - DNA, 18 bp, Homo sapiens
cggatctccaggcccagc

SEQ ID NO: 4306563 - DNA, 15 bp, Homo sapiens
cggcactgtggcctt

SEQ ID NO: 4306564 - DNA, 15 bp, Homo sapiens
cggcagccaccctgc

SEQ ID NO: 4306565 - DNA, 18 bp, Homo sapiens
cggcagccccccagtgtc

SEQ ID NO: 4306566 - DNA, 23 bp, Homo sapiens
cggccactctgtttgctcaccca

SEQ ID NO: 4306567 - DNA, 13 bp, Homo sapiens
cggccactgcagt

SEQ ID NO: 4306568 - DNA, 17 bp, Homo sapiens
cggccactgcagtcacc

SEQ ID NO: 4306569 - DNA, 14 bp, Homo sapiens
cggccagagctccc

SEQ ID NO: 4306570 - DNA, 15 bp, Homo sapiens
cggccagagctccca

SEQ ID NO: 4306571 - DNA, 22 bp, Homo sapiens
cggccatgaccactttccccgt

SEQ ID NO: 4306572 - DNA, 18 bp, Homo sapiens
cggcccccagagcgcccc

SEQ ID NO: 4306573 - DNA, 21 bp, Homo sapiens
cggcccccagagcgcccctcc

SEQ ID NO: 4306574 - DNA, 10 bp, Homo sapiens
cggccctgcc

SEQ ID NO: 4306575 - DNA, 11 bp, Homo sapiens
cggccctgccc

SEQ ID NO: 4306576 - DNA, 15 bp, Homo sapiens
cggccgcctgtcctt

SEQ ID NO: 4306577 - DNA, 13 bp, Homo sapiens
cggccggcctggg

SEQ ID NO: 4306578 - DNA, 14 bp, Homo sapiens
cggccggcctgggg

SEQ ID NO: 4306579 - DNA, 23 bp, Homo sapiens
cggcctgagaggagcgtgtccta

SEQ ID NO: 4306580 - DNA, 19 bp, Homo sapiens
cggcctgatggccaggcct

SEQ ID NO: 4306581 - DNA, 23 bp, Homo sapiens
cggcctggggccgggctggcttc

SEQ ID NO: 4306582 - DNA, 19 bp, Homo sapiens
cggcgccttctacctgcag

SEQ ID NO: 4306583 - DNA, 16 bp, Homo sapiens
cggctcgttcccccag

SEQ ID NO: 4306584 - DNA, 17 bp, Homo sapiens
cggctcgttcccccagg

SEQ ID NO: 4306585 - DNA, 18 bp, Homo sapiens
cggctcgttcccccaggg

SEQ ID NO: 4306586 - DNA, 16 bp, Homo sapiens
cggctgagctgtgcca

SEQ ID NO: 4306587 - DNA, 21 bp, Homo sapiens
cggctgggagcctcgcccctc

SEQ ID NO: 4306588 - DNA, 22 bp, Homo sapiens
cggctgggagcctcgcccctcc

SEQ ID NO: 4306589 - DNA, 21 bp, Homo sapiens
cggcttccccattgccttctg

SEQ ID NO: 4306590 - DNA, 13 bp, Homo sapiens
cgggacctgtggc

SEQ ID NO: 4306591 - DNA, 20 bp, Homo sapiens
cgggagatccgccctgggct

SEQ ID NO: 4306592 - DNA, 21 bp, Homo sapiens
cgggagcctgcgtggcctggg

SEQ ID NO: 4306593 - DNA, 20 bp, Homo sapiens
cgggaggccacgggggaggc

SEQ ID NO: 4306594 - DNA, 22 bp, Homo sapiens
cgggaggccacgggggaggccg

SEQ ID NO: 4306595 - DNA, 22 bp, Homo sapiens
cgggagtgtgggggtgccatgg

SEQ ID NO: 4306596 - DNA, 22 bp, Homo sapiens
cgggcagtgacgtgagtgggga

SEQ ID NO: 4306597 - DNA, 20 bp, Homo sapiens
cgggccaaggactgccgacc

SEQ ID NO: 4306598 - DNA, 16 bp, Homo sapiens
cgggcctggagaacta

SEQ ID NO: 4306599 - DNA, 20 bp, Homo sapiens
cgggcctggagaactagaga

SEQ ID NO: 4306600 - DNA, 14 bp, Homo sapiens
cggggacacggcct

SEQ ID NO: 4306601 - DNA, 18 bp, Homo sapiens
cggggagctgaggggcag

SEQ ID NO: 4306602 - DNA, 19 bp, Homo sapiens
cggggagctgaggggcagg

SEQ ID NO: 4306603 - DNA, 12 bp, Homo sapiens
cggggcatggac

SEQ ID NO: 4306604 - DNA, 21 bp, Homo sapiens
cggggcatggacagggccagg

SEQ ID NO: 4306605 - DNA, 19 bp, Homo sapiens
cggggctggccagctgtgc

SEQ ID NO: 4306606 - DNA, 16 bp, Homo sapiens
cggggtctccacctca

SEQ ID NO: 4306607 - DNA, 23 bp, Homo sapiens
cggggtctccacctcaggggaga

SEQ ID NO: 4306608 - DNA, 13 bp, Homo sapiens
cgggtctgtggga

SEQ ID NO: 4306609 - DNA, 16 bp, Homo sapiens
cgggtctgtgggactg

SEQ ID NO: 4306610 - DNA, 22 bp, Homo sapiens
cgggtctgtgggactggcccac

SEQ ID NO: 4306611 - DNA, 21 bp, Homo sapiens
cgggtgccccccatgccctcc

SEQ ID NO: 4306612 - DNA, 11 bp, Homo sapiens
cgggtgcctgt

SEQ ID NO: 4306613 - DNA, 21 bp, Homo sapiens
cggtcaataattgtggagagg

SEQ ID NO: 4306614 - DNA, 23 bp, Homo sapiens
cggtgcttccctttcactgaagt

SEQ ID NO: 4306615 - DNA, 12 bp, Homo sapiens
cgtagggccagg

SEQ ID NO: 4306616 - DNA, 15 bp, Homo sapiens
cgtagggccagggct

SEQ ID NO: 4306617 - DNA, 20 bp, Homo sapiens
cgtattgtgaaatttgttaa

SEQ ID NO: 4306618 - DNA, 21 bp, Homo sapiens
cgtcaccatctcaggccacct

SEQ ID NO: 4306619 - DNA, 12 bp, Homo sapiens
cgtcacctcaga

SEQ ID NO: 4306620 - DNA, 12 bp, Homo sapiens
cgtcagcctgtg

SEQ ID NO: 4306621 - DNA, 13 bp, Homo sapiens
cgtcagcctgtga

SEQ ID NO: 4306622 - DNA, 16 bp, Homo sapiens
cgtccaaccccggggc

SEQ ID NO: 4306623 - DNA, 20 bp, Homo sapiens
cgtccacccgtttccaagcc

SEQ ID NO: 4306624 - DNA, 22 bp, Homo sapiens
cgtccacccgtttccaagcctg

SEQ ID NO: 4306625 - DNA, 16 bp, Homo sapiens
cgtccctctccccgga

SEQ ID NO: 4306626 - DNA, 17 bp, Homo sapiens
cgtccctgagggccctt

SEQ ID NO: 4306627 - DNA, 21 bp, Homo sapiens
cgtccctgagggcccttccca

SEQ ID NO: 4306628 - DNA, 16 bp, Homo sapiens
cgtccctttccctgca

SEQ ID NO: 4306629 - DNA, 19 bp, Homo sapiens
cgtccctttccctgcatcc

SEQ ID NO: 4306630 - DNA, 22 bp, Homo sapiens
cgtccctttccctgcatccctt

SEQ ID NO: 4306631 - DNA, 23 bp, Homo sapiens
cgtccctttccctgcatcccttg

SEQ ID NO: 4306632 - DNA, 22 bp, Homo sapiens
cgtcctggggtggttggaggcc

SEQ ID NO: 4306633 - DNA, 12 bp, Homo sapiens
cgtcttgtattt

SEQ ID NO: 4306634 - DNA, 20 bp, Homo sapiens
cgtctttgcttgtcctgctc

SEQ ID NO: 4306635 - DNA, 21 bp, Homo sapiens
cgtctttgcttgtcctgctca

SEQ ID NO: 4306636 - DNA, 17 bp, Homo sapiens
cgtgaggagggggagaa

SEQ ID NO: 4306637 - DNA, 16 bp, Homo sapiens
cgtgcacacacctgca

SEQ ID NO: 4306638 - DNA, 22 bp, Homo sapiens
cgtgcacacacctgcacacccc

SEQ ID NO: 4306639 - DNA, 22 bp, Homo sapiens
cgtgccacatcaataacaacag

SEQ ID NO: 4306640 - DNA, 15 bp, Homo sapiens
cgtgccttcagctct

SEQ ID NO: 4306641 - DNA, 16 bp, Homo sapiens
cgtgccttcagctcta

SEQ ID NO: 4306642 - DNA, 18 bp, Homo sapiens
cgtgccttcagctctaca

SEQ ID NO: 4306643 - DNA, 22 bp, Homo sapiens
cgtgctgcccgagggcaggggc

SEQ ID NO: 4306644 - DNA, 12 bp, Homo sapiens
cgtgctggagag

SEQ ID NO: 4306645 - DNA, 13 bp, Homo sapiens
cgtgctggagagt

SEQ ID NO: 4306646 - DNA, 15 bp, Homo sapiens
cgtgctggagagtag

SEQ ID NO: 4306647 - DNA, 17 bp, Homo sapiens
cgtggagtcgagctggc

SEQ ID NO: 4306648 - DNA, 12 bp, Homo sapiens
cgtggcctgggg

SEQ ID NO: 4306649 - DNA, 17 bp, Homo sapiens
cgtgggatccagagaga

SEQ ID NO: 4306650 - DNA, 13 bp, Homo sapiens
cgtgtattcagga

SEQ ID NO: 4306651 - DNA, 15 bp, Homo sapiens
cgtgtctgtggccct

SEQ ID NO: 4306652 - DNA, 19 bp, Homo sapiens
cgtgtgtagatagtatgca

SEQ ID NO: 4306653 - DNA, 13 bp, Homo sapiens
cgttaattaaaca

SEQ ID NO: 4306654 - DNA, 23 bp, Homo sapiens
cgttctgggtcagcttgaatgtc

SEQ ID NO: 4306655 - DNA, 16 bp, Homo sapiens
cgttgacatgcacagt

SEQ ID NO: 4306656 - DNA, 23 bp, Homo sapiens
cgttgcaaccactgcaatatctt

SEQ ID NO: 4306657 - DNA, 13 bp, Homo sapiens
cgtttagaaatga

SEQ ID NO: 4306658 - DNA, 12 bp, Homo sapiens
cgttttaagccc

SEQ ID NO: 4306659 - DNA, 23 bp, Homo sapiens
cgttttgcctcatgaacactggc

SEQ ID NO: 4306660 - DNA, 14 bp, Homo sapiens
ctaaaaaataactg

SEQ ID NO: 4306661 - DNA, 16 bp, Homo sapiens
ctaaaaggaggacagg

SEQ ID NO: 4306662 - DNA, 21 bp, Homo sapiens
ctaaaatactcaccaaaatat

SEQ ID NO: 4306663 - DNA, 21 bp, Homo sapiens
ctaaaattctagtctctgatt

SEQ ID NO: 4306664 - DNA, 22 bp, Homo sapiens
ctaaaggggacagatcttgagc

SEQ ID NO: 4306665 - DNA, 23 bp, Homo sapiens
ctaaagggtgtgggtcagggagg

SEQ ID NO: 4306666 - DNA, 21 bp, Homo sapiens
ctaaataatgatcttccaaat

SEQ ID NO: 4306667 - DNA, 16 bp, Homo sapiens
ctaaatccattttcta

SEQ ID NO: 4306668 - DNA, 17 bp, Homo sapiens
ctaaatccattttctaa

SEQ ID NO: 4306669 - DNA, 21 bp, Homo sapiens
ctaaatggcagtgagatgtca

SEQ ID NO: 4306670 - DNA, 23 bp, Homo sapiens
ctaaatggcagtgagatgtcaga

SEQ ID NO: 4306671 - DNA, 18 bp, Homo sapiens
ctaaatgtttctttttct

SEQ ID NO: 4306672 - DNA, 11 bp, Homo sapiens
ctaacactggc

SEQ ID NO: 4306673 - DNA, 17 bp, Homo sapiens
ctaacactggcccctag

SEQ ID NO: 4306674 - DNA, 22 bp, Homo sapiens
ctaactgattcagggcccctga

SEQ ID NO: 4306675 - DNA, 12 bp, Homo sapiens
ctaactgtatat

SEQ ID NO: 4306676 - DNA, 15 bp, Homo sapiens
ctaactgtatatttg

SEQ ID NO: 4306677 - DNA, 19 bp, Homo sapiens
ctaactgtatatttgtatg

SEQ ID NO: 4306678 - DNA, 19 bp, Homo sapiens
ctaagaaatatctgtgaaa

SEQ ID NO: 4306679 - DNA, 17 bp, Homo sapiens
ctaagaataaataaaga

SEQ ID NO: 4306680 - DNA, 20 bp, Homo sapiens
ctaagaataaataaagaaga

SEQ ID NO: 4306681 - DNA, 16 bp, Homo sapiens
ctaagagccacaataa

SEQ ID NO: 4306682 - DNA, 13 bp, Homo sapiens
ctaagattgtaca

SEQ ID NO: 4306683 - DNA, 15 bp, Homo sapiens
ctaagattgtacata

SEQ ID NO: 4306684 - DNA, 16 bp, Homo sapiens
ctaagcctggacacag

SEQ ID NO: 4306685 - DNA, 11 bp, Homo sapiens
ctaaggcttcc

SEQ ID NO: 4306686 - DNA, 17 bp, Homo sapiens
ctaaggcttccggctga

SEQ ID NO: 4306687 - DNA, 20 bp, Homo sapiens
ctaaggcttccggctgagct

SEQ ID NO: 4306688 - DNA, 21 bp, Homo sapiens
ctaatcagcattctcactcct

SEQ ID NO: 4306689 - DNA, 14 bp, Homo sapiens
ctaattaatttcag

SEQ ID NO: 4306690 - DNA, 18 bp, Homo sapiens
ctaattctctaggaaagt

SEQ ID NO: 4306691 - DNA, 22 bp, Homo sapiens
ctaattggcatgaaggtgtcat

SEQ ID NO: 4306692 - DNA, 21 bp, Homo sapiens
ctacaatatcattttcctggg

SEQ ID NO: 4306693 - DNA, 22 bp, Homo sapiens
ctacagaaaaacaatggtaaca

SEQ ID NO: 4306694 - DNA, 19 bp, Homo sapiens
ctacagctaatcagcattc

SEQ ID NO: 4306695 - DNA, 21 bp, Homo sapiens
ctacagtagctgtggggagct

SEQ ID NO: 4306696 - DNA, 17 bp, Homo sapiens
ctacagtggagggagac

SEQ ID NO: 4306697 - DNA, 23 bp, Homo sapiens
ctaccgagtctcttctccactgg

SEQ ID NO: 4306698 - DNA, 15 bp, Homo sapiens
ctacctgcaggactc

SEQ ID NO: 4306699 - DNA, 20 bp, Homo sapiens
ctacctttggcttaattcca

SEQ ID NO: 4306700 - DNA, 13 bp, Homo sapiens
ctacgcagaagag

SEQ ID NO: 4306701 - DNA, 23 bp, Homo sapiens
ctactgccactcaggcagcctgt

SEQ ID NO: 4306702 - DNA, 22 bp, Homo sapiens
ctacttacatgcattactgcat

SEQ ID NO: 4306703 - DNA, 22 bp, Homo sapiens
ctacttagcatgtccctaccga

SEQ ID NO: 4306704 - DNA, 17 bp, Homo sapiens
ctagaagagtctattgt

SEQ ID NO: 4306705 - DNA, 14 bp, Homo sapiens
ctagaaggggcgag

SEQ ID NO: 4306706 - DNA, 16 bp, Homo sapiens
ctagaatggaagcctc

SEQ ID NO: 4306707 - DNA, 14 bp, Homo sapiens
ctagactgggctgg

SEQ ID NO: 4306708 - DNA, 16 bp, Homo sapiens
ctagactgggctggct

SEQ ID NO: 4306709 - DNA, 17 bp, Homo sapiens
ctagactgggctggctg

SEQ ID NO: 4306710 - DNA, 19 bp, Homo sapiens
ctagagagggaattctctt

SEQ ID NO: 4306711 - DNA, 15 bp, Homo sapiens
ctagagatattttgt

SEQ ID NO: 4306712 - DNA, 21 bp, Homo sapiens
ctagaggaggaaaaaggctgg

SEQ ID NO: 4306713 - DNA, 24 bp, Homo sapiens
ctagaggctattcctaggcctcag

SEQ ID NO: 4306714 - DNA, 23 bp, Homo sapiens
ctagaggcttccttcatttcctc

SEQ ID NO: 4306715 - DNA, 20 bp, Homo sapiens
ctagatgggcatggggtggg

SEQ ID NO: 4306716 - DNA, 21 bp, Homo sapiens
ctagcaagaagattctaaaac

SEQ ID NO: 4306717 - DNA, 18 bp, Homo sapiens
ctagcacaaggagtgccc

SEQ ID NO: 4306718 - DNA, 14 bp, Homo sapiens
ctagcagtttgcct

SEQ ID NO: 4306719 - DNA, 18 bp, Homo sapiens
ctagccaggcctcccgca

SEQ ID NO: 4306720 - DNA, 23 bp, Homo sapiens
ctagccatgactagggtcctcag

SEQ ID NO: 4306721 - DNA, 18 bp, Homo sapiens
ctagctatgctgtatctg

SEQ ID NO: 4306722 - DNA, 21 bp, Homo sapiens
ctaggaacctcgaagctgttc

SEQ ID NO: 4306723 - DNA, 15 bp, Homo sapiens
ctaggcatactctcc

SEQ ID NO: 4306724 - DNA, 17 bp, Homo sapiens
ctaggcatactctccag

SEQ ID NO: 4306725 - DNA, 18 bp, Homo sapiens
ctaggcatactctccagg

SEQ ID NO: 4306726 - DNA, 19 bp, Homo sapiens
ctaggcatactctccagga

SEQ ID NO: 4306727 - DNA, 13 bp, Homo sapiens
ctaggccctggtc

SEQ ID NO: 4306728 - DNA, 21 bp, Homo sapiens
ctaggggtcagggaccaagga

SEQ ID NO: 4306729 - DNA, 14 bp, Homo sapiens
ctagggtccccctt

SEQ ID NO: 4306730 - DNA, 22 bp, Homo sapiens
ctagggtcccccttcgtggagc

SEQ ID NO: 4306731 - DNA, 19 bp, Homo sapiens
ctagggtcctcaggcagtg

SEQ ID NO: 4306732 - DNA, 16 bp, Homo sapiens
ctagggtgagggtgac

SEQ ID NO: 4306733 - DNA, 22 bp, Homo sapiens
ctagggtgagggtgacagaggg

SEQ ID NO: 4306734 - DNA, 23 bp, Homo sapiens
ctagggtgagggtgacagaggga

SEQ ID NO: 4306735 - DNA, 13 bp, Homo sapiens
ctaggtctccacc

SEQ ID NO: 4306736 - DNA, 15 bp, Homo sapiens
ctaggtctccacccc

SEQ ID NO: 4306737 - DNA, 14 bp, Homo sapiens
ctaggtgctggcat

SEQ ID NO: 4306738 - DNA, 21 bp, Homo sapiens
ctaggtgctggcatgtctggg

SEQ ID NO: 4306739 - DNA, 17 bp, Homo sapiens
ctaggtgggccagcccc

SEQ ID NO: 4306740 - DNA, 18 bp, Homo sapiens
ctaggtgggccagcccct

SEQ ID NO: 4306741 - DNA, 17 bp, Homo sapiens
ctagtcaactgctgttt

SEQ ID NO: 4306742 - DNA, 14 bp, Homo sapiens
ctagtgacccggag

SEQ ID NO: 4306743 - DNA, 18 bp, Homo sapiens
ctagtgacccggaggcca

SEQ ID NO: 4306744 - DNA, 19 bp, Homo sapiens
ctagtgatacactgtatct

SEQ ID NO: 4306745 - DNA, 18 bp, Homo sapiens
ctagtggcttcagcccct

SEQ ID NO: 4306746 - DNA, 18 bp, Homo sapiens
ctagttctttgcattcgt

SEQ ID NO: 4306747 - DNA, 20 bp, Homo sapiens
ctataaacattaaaagaaga

SEQ ID NO: 4306748 - DNA, 17 bp, Homo sapiens
ctataacaactctattt

SEQ ID NO: 4306749 - DNA, 22 bp, Homo sapiens
ctataagggagtaggctgtatt

SEQ ID NO: 4306750 - DNA, 23 bp, Homo sapiens
ctataagggagtaggctgtattt

SEQ ID NO: 4306751 - DNA, 13 bp, Homo sapiens
ctataatgtgaaa

SEQ ID NO: 4306752 - DNA, 17 bp, Homo sapiens
ctataatgtgaaatgta

SEQ ID NO: 4306753 - DNA, 21 bp, Homo sapiens
ctataatgtgaaatgtaactg

SEQ ID NO: 4306754 - DNA, 18 bp, Homo sapiens
ctatagttactgtcctgt

SEQ ID NO: 4306755 - DNA, 15 bp, Homo sapiens
ctatagtttgattct

SEQ ID NO: 4306756 - DNA, 22 bp, Homo sapiens
ctatatacatcacgttaaagta

SEQ ID NO: 4306757 - DNA, 17 bp, Homo sapiens
ctatatatacatgtata

SEQ ID NO: 4306758 - DNA, 15 bp, Homo sapiens
ctatcacctcccctc

SEQ ID NO: 4306759 - DNA, 16 bp, Homo sapiens
ctatcctgcaccctct

SEQ ID NO: 4306760 - DNA, 19 bp, Homo sapiens
ctatctcgctagccatata

SEQ ID NO: 4306761 - DNA, 15 bp, Homo sapiens
ctatctgcaaatagt

SEQ ID NO: 4306762 - DNA, 16 bp, Homo sapiens
ctatctggtgatttct

SEQ ID NO: 4306763 - DNA, 17 bp, Homo sapiens
ctatctggtgatttcta

SEQ ID NO: 4306764 - DNA, 20 bp, Homo sapiens
ctatgaagagctagagaaat

SEQ ID NO: 4306765 - DNA, 16 bp, Homo sapiens
ctatgagagatgtgtc

SEQ ID NO: 4306766 - DNA, 16 bp, Homo sapiens
ctatgcacctataaat

SEQ ID NO: 4306767 - DNA, 19 bp, Homo sapiens
ctatgcacctataaatact

SEQ ID NO: 4306768 - DNA, 16 bp, Homo sapiens
ctatgccacctgcagc

SEQ ID NO: 4306769 - DNA, 18 bp, Homo sapiens
ctatgccactaggccctg

SEQ ID NO: 4306770 - DNA, 14 bp, Homo sapiens
ctatgctgtatctg

SEQ ID NO: 4306771 - DNA, 20 bp, Homo sapiens
ctatggaaagggtgtggctt

SEQ ID NO: 4306772 - DNA, 21 bp, Homo sapiens
ctatggaaagggtgtggcttg

SEQ ID NO: 4306773 - DNA, 22 bp, Homo sapiens
ctatggaaagggtgtggcttgg

SEQ ID NO: 4306774 - DNA, 15 bp, Homo sapiens
ctatggctgtatttt

SEQ ID NO: 4306775 - DNA, 16 bp, Homo sapiens
ctatggctgtattttt

SEQ ID NO: 4306776 - DNA, 21 bp, Homo sapiens
ctatggctgtatttttagaga

SEQ ID NO: 4306777 - DNA, 12 bp, Homo sapiens
ctatgtctgtga

SEQ ID NO: 4306778 - DNA, 13 bp, Homo sapiens
ctatgtctgtgat

SEQ ID NO: 4306779 - DNA, 19 bp, Homo sapiens
ctattaacaattaattgtc

SEQ ID NO: 4306780 - DNA, 20 bp, Homo sapiens
ctattaacaattaattgtct

SEQ ID NO: 4306781 - DNA, 12 bp, Homo sapiens
ctattaatattt

SEQ ID NO: 4306782 - DNA, 12 bp, Homo sapiens
ctattcccaggc

SEQ ID NO: 4306783 - DNA, 14 bp, Homo sapiens
ctattcccaggcag

SEQ ID NO: 4306784 - DNA, 15 bp, Homo sapiens
ctattcccaggcagg

SEQ ID NO: 4306785 - DNA, 14 bp, Homo sapiens
ctattctattgcag

SEQ ID NO: 4306786 - DNA, 19 bp, Homo sapiens
ctattgtaatatagaaaaa

SEQ ID NO: 4306787 - DNA, 15 bp, Homo sapiens
ctatttaaaaaatga

SEQ ID NO: 4306788 - DNA, 23 bp, Homo sapiens
ctatttagcatgacaagccccag

SEQ ID NO: 4306789 - DNA, 17 bp, Homo sapiens
ctatttctcccttcaat

SEQ ID NO: 4306790 - DNA, 18 bp, Homo sapiens
ctatttttttgttgctgt

SEQ ID NO: 4306791 - DNA, 18 bp, Homo sapiens
ctcaaacctccaaaagcc

SEQ ID NO: 4306792 - DNA, 20 bp, Homo sapiens
ctcaaacctccaaaagccct

SEQ ID NO: 4306793 - DNA, 18 bp, Homo sapiens
ctcaaagagggagtgcat

SEQ ID NO: 4306794 - DNA, 19 bp, Homo sapiens
ctcaaagtttttacagtgt

SEQ ID NO: 4306795 - DNA, 21 bp, Homo sapiens
ctcaaagtttttacagtgtat

SEQ ID NO: 4306796 - DNA, 22 bp, Homo sapiens
ctcaaatgcagtatttttgttg

SEQ ID NO: 4306797 - DNA, 21 bp, Homo sapiens
ctcaaccctccctcagcccct

SEQ ID NO: 4306798 - DNA, 12 bp, Homo sapiens
ctcaagccagga

SEQ ID NO: 4306799 - DNA, 16 bp, Homo sapiens
ctcaagccaggagacc

SEQ ID NO: 4306800 - DNA, 22 bp, Homo sapiens
ctcaagccaggagaccctgtct

SEQ ID NO: 4306801 - DNA, 15 bp, Homo sapiens
ctcaataaaggtcat

SEQ ID NO: 4306802 - DNA, 20 bp, Homo sapiens
ctcaatgtggaaaaaatatt

SEQ ID NO: 4306803 - DNA, 17 bp, Homo sapiens
ctcacagaacccttgga

SEQ ID NO: 4306804 - DNA, 13 bp, Homo sapiens
ctcacagccacca

SEQ ID NO: 4306805 - DNA, 17 bp, Homo sapiens
ctcacagccaccacctg

SEQ ID NO: 4306806 - DNA, 15 bp, Homo sapiens
ctcacatcatgtaat

SEQ ID NO: 4306807 - DNA, 13 bp, Homo sapiens
ctcaccaaaatat

SEQ ID NO: 4306808 - DNA, 14 bp, Homo sapiens
ctcaccaaaatata

SEQ ID NO: 4306809 - DNA, 13 bp, Homo sapiens
ctcacccagcctg

SEQ ID NO: 4306810 - DNA, 14 bp, Homo sapiens
ctcacccaggacct

SEQ ID NO: 4306811 - DNA, 15 bp, Homo sapiens
ctcacccctgcaggc

SEQ ID NO: 4306812 - DNA, 15 bp, Homo sapiens
ctcacctgctggccc

SEQ ID NO: 4306813 - DNA, 21 bp, Homo sapiens
ctcacctgctggcccctcacc

SEQ ID NO: 4306814 - DNA, 13 bp, Homo sapiens
ctcacctggcttc

SEQ ID NO: 4306815 - DNA, 18 bp, Homo sapiens
ctcaccttgcaacacaca

SEQ ID NO: 4306816 - DNA, 22 bp, Homo sapiens
ctcacgcctgtaatcccagcat

SEQ ID NO: 4306817 - DNA, 16 bp, Homo sapiens
ctcactccactcccct

SEQ ID NO: 4306818 - DNA, 18 bp, Homo sapiens
ctcactccactcccctca

SEQ ID NO: 4306819 - DNA, 15 bp, Homo sapiens
ctcactctggcagcc

SEQ ID NO: 4306820 - DNA, 22 bp, Homo sapiens
ctcactgatatattttccaggg

SEQ ID NO: 4306821 - DNA, 15 bp, Homo sapiens
ctcactggtgcattt

SEQ ID NO: 4306822 - DNA, 21 bp, Homo sapiens
ctcagaggccccttgctgctg

SEQ ID NO: 4306823 - DNA, 24 bp, Homo sapiens
ctcagaggccccttgctgctggct

SEQ ID NO: 4306824 - DNA, 12 bp, Homo sapiens
ctcagatgctgg

SEQ ID NO: 4306825 - DNA, 23 bp, Homo sapiens
ctcagatgctggtcatcctgggc

SEQ ID NO: 4306826 - DNA, 20 bp, Homo sapiens
ctcagcacaattatgtgtga

SEQ ID NO: 4306827 - DNA, 12 bp, Homo sapiens
ctcagcacagcc

SEQ ID NO: 4306828 - DNA, 21 bp, Homo sapiens
ctcagcacagcctcacccctg

SEQ ID NO: 4306829 - DNA, 17 bp, Homo sapiens
ctcagccacacccaggc

SEQ ID NO: 4306830 - DNA, 19 bp, Homo sapiens
ctcagccacgcctctctca

SEQ ID NO: 4306831 - DNA, 12 bp, Homo sapiens
ctcagccactcc

SEQ ID NO: 4306832 - DNA, 17 bp, Homo sapiens
ctcagccactcccaggg

SEQ ID NO: 4306833 - DNA, 21 bp, Homo sapiens
ctcagccactcccaggggcct

SEQ ID NO: 4306834 - DNA, 21 bp, Homo sapiens
ctcagcccacatagtgatggt

SEQ ID NO: 4306835 - DNA, 19 bp, Homo sapiens
ctcagcccaggtctcctgg

SEQ ID NO: 4306836 - DNA, 17 bp, Homo sapiens
ctcagccccagggccct

SEQ ID NO: 4306837 - DNA, 18 bp, Homo sapiens
ctcagccccagggccctg

SEQ ID NO: 4306838 - DNA, 20 bp, Homo sapiens
ctcagccccagggccctgct

SEQ ID NO: 4306839 - DNA, 11 bp, Homo sapiens
ctcagcccctc

SEQ ID NO: 4306840 - DNA, 21 bp, Homo sapiens
ctcagccttaagaaagctata

SEQ ID NO: 4306841 - DNA, 22 bp, Homo sapiens
ctcaggaagatcgtgaacataa

SEQ ID NO: 4306842 - DNA, 17 bp, Homo sapiens
ctcaggagaaggcctgc

SEQ ID NO: 4306843 - DNA, 13 bp, Homo sapiens
ctcaggcagcctg

SEQ ID NO: 4306844 - DNA, 15 bp, Homo sapiens
ctcaggcagcctgtg

SEQ ID NO: 4306845 - DNA, 16 bp, Homo sapiens
ctcaggcatgcctgtg

SEQ ID NO: 4306846 - DNA, 18 bp, Homo sapiens
ctcaggcatgcctgtgtg

SEQ ID NO: 4306847 - DNA, 13 bp, Homo sapiens
ctcaggccacctg

SEQ ID NO: 4306848 - DNA, 16 bp, Homo sapiens
ctcaggccacctgccc

SEQ ID NO: 4306849 - DNA, 18 bp, Homo sapiens
ctcaggccacctgccccc

SEQ ID NO: 4306850 - DNA, 19 bp, Homo sapiens
ctcaggccacctgccccct

SEQ ID NO: 4306851 - DNA, 23 bp, Homo sapiens
ctcaggccacctgcccccttctc

SEQ ID NO: 4306852 - DNA, 15 bp, Homo sapiens
ctcaggcctcacctg

SEQ ID NO: 4306853 - DNA, 17 bp, Homo sapiens
ctcaggcctcacctggc

SEQ ID NO: 4306854 - DNA, 19 bp, Homo sapiens
ctcaggcctcacctggctt

SEQ ID NO: 4306855 - DNA, 13 bp, Homo sapiens
ctcaggcctggcc

SEQ ID NO: 4306856 - DNA, 15 bp, Homo sapiens
ctcaggctttttcca

SEQ ID NO: 4306857 - DNA, 17 bp, Homo sapiens
ctcagggaccaaggaga

SEQ ID NO: 4306858 - DNA, 23 bp, Homo sapiens
ctcagggaccaaggagatgggga

SEQ ID NO: 4306859 - DNA, 13 bp, Homo sapiens
ctcagggctggat

SEQ ID NO: 4306860 - DNA, 21 bp, Homo sapiens
ctcagggctggattggcaggt

SEQ ID NO: 4306861 - DNA, 22 bp, Homo sapiens
ctcagggtgctccctcctcagt

SEQ ID NO: 4306862 - DNA, 14 bp, Homo sapiens
ctcaggttgtctga

SEQ ID NO: 4306863 - DNA, 13 bp, Homo sapiens
ctcagtcaaatgt

SEQ ID NO: 4306864 - DNA, 15 bp, Homo sapiens
ctcagtccctccctc

SEQ ID NO: 4306865 - DNA, 24 bp, Homo sapiens
ctcagtccctccctcctggctcac

SEQ ID NO: 4306866 - DNA, 22 bp, Homo sapiens
ctcagtggactttccaccccct

SEQ ID NO: 4306867 - DNA, 14 bp, Homo sapiens
ctcatcaacaaaga

SEQ ID NO: 4306868 - DNA, 19 bp, Homo sapiens
ctcatccactaggtgccca

SEQ ID NO: 4306869 - DNA, 23 bp, Homo sapiens
ctcatcgcagggctcatgatttt

SEQ ID NO: 4306870 - DNA, 12 bp, Homo sapiens
ctcatctgtcac

SEQ ID NO: 4306871 - DNA, 13 bp, Homo sapiens
ctcatgaacactg

SEQ ID NO: 4306872 - DNA, 21 bp, Homo sapiens
ctcatgaacctcaagctgcat

SEQ ID NO: 4306873 - DNA, 19 bp, Homo sapiens
ctcatgggagtcagggagc

SEQ ID NO: 4306874 - DNA, 22 bp, Homo sapiens
ctcatgggagtcagggagccct

SEQ ID NO: 4306875 - DNA, 19 bp, Homo sapiens
ctcattacagatttagttt

SEQ ID NO: 4306876 - DNA, 12 bp, Homo sapiens
ctcattcctctg

SEQ ID NO: 4306877 - DNA, 20 bp, Homo sapiens
ctcatttagcattgaaataa

SEQ ID NO: 4306878 - DNA, 21 bp, Homo sapiens
ctcatttagcattgaaataat

SEQ ID NO: 4306879 - DNA, 16 bp, Homo sapiens
ctccaaagttatccag

SEQ ID NO: 4306880 - DNA, 13 bp, Homo sapiens
ctccacacctcca

SEQ ID NO: 4306881 - DNA, 15 bp, Homo sapiens
ctccacacctccacc

SEQ ID NO: 4306882 - DNA, 16 bp, Homo sapiens
ctccacacctccaccc

SEQ ID NO: 4306883 - DNA, 17 bp, Homo sapiens
ctccacagaaaccctgt

SEQ ID NO: 4306884 - DNA, 20 bp, Homo sapiens
ctccacagaagacacgtgtt

SEQ ID NO: 4306885 - DNA, 15 bp, Homo sapiens
ctccaccccagtccc

SEQ ID NO: 4306886 - DNA, 15 bp, Homo sapiens
ctccacccctcaagc

SEQ ID NO: 4306887 - DNA, 22 bp, Homo sapiens
ctccacccctcaagccaggaga

SEQ ID NO: 4306888 - DNA, 22 bp, Homo sapiens
ctccaccgggagggacagtctg

SEQ ID NO: 4306889 - DNA, 22 bp, Homo sapiens
ctccacctgggagatgctggga

SEQ ID NO: 4306890 - DNA, 19 bp, Homo sapiens
ctccacgggggcctagtgg

SEQ ID NO: 4306891 - DNA, 15 bp, Homo sapiens
ctccactcagcacaa

SEQ ID NO: 4306892 - DNA, 15 bp, Homo sapiens
ctccactcccctcat

SEQ ID NO: 4306893 - DNA, 17 bp, Homo sapiens
ctccactcccctcatcc

SEQ ID NO: 4306894 - DNA, 17 bp, Homo sapiens
ctccactcctcccaact

SEQ ID NO: 4306895 - DNA, 15 bp, Homo sapiens
ctccactgccttcga

SEQ ID NO: 4306896 - DNA, 17 bp, Homo sapiens
ctccacttggcattagc

SEQ ID NO: 4306897 - DNA, 22 bp, Homo sapiens
ctccagaacaaacctctatatg

SEQ ID NO: 4306898 - DNA, 16 bp, Homo sapiens
ctccagacccccagca

SEQ ID NO: 4306899 - DNA, 12 bp, Homo sapiens
ctccagacccct

SEQ ID NO: 4306900 - DNA, 21 bp, Homo sapiens
ctccagacccctaccctttcc

SEQ ID NO: 4306901 - DNA, 14 bp, Homo sapiens
ctccagacccctgg

SEQ ID NO: 4306902 - DNA, 19 bp, Homo sapiens
ctccagacccctggctttt

SEQ ID NO: 4306903 - DNA, 14 bp, Homo sapiens
ctccagcaagacct

SEQ ID NO: 4306904 - DNA, 23 bp, Homo sapiens
ctccaggaagggaccccactgga

SEQ ID NO: 4306905 - DNA, 13 bp, Homo sapiens
ctccaggagagga

SEQ ID NO: 4306906 - DNA, 22 bp, Homo sapiens
ctccaggagaggagcgggacct

SEQ ID NO: 4306907 - DNA, 16 bp, Homo sapiens
ctccaggattgtccac

SEQ ID NO: 4306908 - DNA, 17 bp, Homo sapiens
ctccaggattgtccaca

SEQ ID NO: 4306909 - DNA, 14 bp, Homo sapiens
ctccaggcccagcc

SEQ ID NO: 4306910 - DNA, 18 bp, Homo sapiens
ctccaggcccagcctggc

SEQ ID NO: 4306911 - DNA, 19 bp, Homo sapiens
ctccaggcccagcctggcc

SEQ ID NO: 4306912 - DNA, 14 bp, Homo sapiens
ctccaggcttcctg

SEQ ID NO: 4306913 - DNA, 15 bp, Homo sapiens
ctccaggcttcctgc

SEQ ID NO: 4306914 - DNA, 16 bp, Homo sapiens
ctccaggcttcctgcc

SEQ ID NO: 4306915 - DNA, 22 bp, Homo sapiens
ctccaggcttcctgccctagca

SEQ ID NO: 4306916 - DNA, 12 bp, Homo sapiens
ctccagtctgct

SEQ ID NO: 4306917 - DNA, 12 bp, Homo sapiens
ctccagtgttgc

SEQ ID NO: 4306918 - DNA, 13 bp, Homo sapiens
ctccatcagaagg

SEQ ID NO: 4306919 - DNA, 14 bp, Homo sapiens
ctccatccccatgt

SEQ ID NO: 4306920 - DNA, 18 bp, Homo sapiens
ctccatgattccaagggc

SEQ ID NO: 4306921 - DNA, 21 bp, Homo sapiens
ctccatgcagatctagccagg

SEQ ID NO: 4306922 - DNA, 18 bp, Homo sapiens
ctcccaaataaactcctt

SEQ ID NO: 4306923 - DNA, 23 bp, Homo sapiens
ctcccaaataaactccttaacca

SEQ ID NO: 4306924 - DNA, 19 bp, Homo sapiens
ctcccaaatgcagcttcag

SEQ ID NO: 4306925 - DNA, 15 bp, Homo sapiens
ctcccacactgctag

SEQ ID NO: 4306926 - DNA, 20 bp, Homo sapiens
ctcccacaggcccttcctct

SEQ ID NO: 4306927 - DNA, 21 bp, Homo sapiens
ctcccacaggcccttcctctc

SEQ ID NO: 4306928 - DNA, 13 bp, Homo sapiens
ctcccaccacagc

SEQ ID NO: 4306929 - DNA, 14 bp, Homo sapiens
ctcccaccacagca

SEQ ID NO: 4306930 - DNA, 14 bp, Homo sapiens
ctcccacgccctcc

SEQ ID NO: 4306931 - DNA, 19 bp, Homo sapiens
ctcccaggacgcagggaga

SEQ ID NO: 4306932 - DNA, 22 bp, Homo sapiens
ctcccaggacgcagggagaccc

SEQ ID NO: 4306933 - DNA, 23 bp, Homo sapiens
ctcccaggacgcagggagaccct

SEQ ID NO: 4306934 - DNA, 12 bp, Homo sapiens
ctcccagggcca

SEQ ID NO: 4306935 - DNA, 21 bp, Homo sapiens
ctcccagggccatgaactttg

SEQ ID NO: 4306936 - DNA, 17 bp, Homo sapiens
ctcccatccagcgtctg

SEQ ID NO: 4306937 - DNA, 23 bp, Homo sapiens
ctcccatgggggctccagacatt

SEQ ID NO: 4306938 - DNA, 15 bp, Homo sapiens
ctcccattcaagatt

SEQ ID NO: 4306939 - DNA, 14 bp, Homo sapiens
ctccccaaccctgc

SEQ ID NO: 4306940 - DNA, 19 bp, Homo sapiens
ctccccaaccctgcccctg

SEQ ID NO: 4306941 - DNA, 20 bp, Homo sapiens
ctccccaaccctgcccctgc

SEQ ID NO: 4306942 - DNA, 13 bp, Homo sapiens
ctccccagcccag

SEQ ID NO: 4306943 - DNA, 15 bp, Homo sapiens
ctccccagcccaggg

SEQ ID NO: 4306944 - DNA, 16 bp, Homo sapiens
ctccccagtgtatgtc

SEQ ID NO: 4306945 - DNA, 14 bp, Homo sapiens
ctccccctgccaga

SEQ ID NO: 4306946 - DNA, 23 bp, Homo sapiens
ctccccgatccccgacagtggct

SEQ ID NO: 4306947 - DNA, 12 bp, Homo sapiens
ctcccctccaga

SEQ ID NO: 4306948 - DNA, 13 bp, Homo sapiens
ctcccctccagac

SEQ ID NO: 4306949 - DNA, 15 bp, Homo sapiens
ctcccctccagaccc

SEQ ID NO: 4306950 - DNA, 15 bp, Homo sapiens
ctcccctccttgcct

SEQ ID NO: 4306951 - DNA, 16 bp, Homo sapiens
ctcccctccttgcctc

SEQ ID NO: 4306952 - DNA, 19 bp, Homo sapiens
ctcccctccttgcctcctg

SEQ ID NO: 4306953 - DNA, 10 bp, Homo sapiens
ctcccctcta

SEQ ID NO: 4306954 - DNA, 14 bp, Homo sapiens
ctcccctggtcctg

SEQ ID NO: 4306955 - DNA, 15 bp, Homo sapiens
ctcccctggtcctgc

SEQ ID NO: 4306956 - DNA, 19 bp, Homo sapiens
ctcccctggtcctgcactg

SEQ ID NO: 4306957 - DNA, 15 bp, Homo sapiens
ctccccttccctgca

SEQ ID NO: 4306958 - DNA, 14 bp, Homo sapiens
ctccccttgagctg

SEQ ID NO: 4306959 - DNA, 16 bp, Homo sapiens
ctccccttgagctgag

SEQ ID NO: 4306960 - DNA, 16 bp, Homo sapiens
ctcccgcatgctgcct

SEQ ID NO: 4306961 - DNA, 19 bp, Homo sapiens
ctcccgcatgctgcctgcc

SEQ ID NO: 4306962 - DNA, 21 bp, Homo sapiens
ctcccgcatgctgcctgcctc

SEQ ID NO: 4306963 - DNA, 14 bp, Homo sapiens
ctcccggctctgag

SEQ ID NO: 4306964 - DNA, 15 bp, Homo sapiens
ctcccggtgcccaag

SEQ ID NO: 4306965 - DNA, 21 bp, Homo sapiens
ctcccggtgcccaagaataga

SEQ ID NO: 4306966 - DNA, 18 bp, Homo sapiens
ctccctcagccacgcctc

SEQ ID NO: 4306967 - DNA, 12 bp, Homo sapiens
ctccctcagccc

SEQ ID NO: 4306968 - DNA, 18 bp, Homo sapiens
ctccctccacacctccac

SEQ ID NO: 4306969 - DNA, 19 bp, Homo sapiens
ctccctccacacctccacc

SEQ ID NO: 4306970 - DNA, 13 bp, Homo sapiens
ctccctccactcc

SEQ ID NO: 4306971 - DNA, 18 bp, Homo sapiens
ctccctcccatttgcaga

SEQ ID NO: 4306972 - DNA, 22 bp, Homo sapiens
ctccctcccccggggtctccac

SEQ ID NO: 4306973 - DNA, 16 bp, Homo sapiens
ctccctccctccacac

SEQ ID NO: 4306974 - DNA, 16 bp, Homo sapiens
ctccctccctccctgc

SEQ ID NO: 4306975 - DNA, 13 bp, Homo sapiens
ctccctccctgca

SEQ ID NO: 4306976 - DNA, 16 bp, Homo sapiens
ctccctccctgcaggg

SEQ ID NO: 4306977 - DNA, 13 bp, Homo sapiens
ctccctccctgct

SEQ ID NO: 4306978 - DNA, 16 bp, Homo sapiens
ctccctcctggctcac

SEQ ID NO: 4306979 - DNA, 17 bp, Homo sapiens
ctccctcctggctcaca

SEQ ID NO: 4306980 - DNA, 20 bp, Homo sapiens
ctccctgcccctcccttcaa

SEQ ID NO: 4306981 - DNA, 15 bp, Homo sapiens
ctccctgctgccagg

SEQ ID NO: 4306982 - DNA, 21 bp, Homo sapiens
ctccctggcagcacaggaaaa

SEQ ID NO: 4306983 - DNA, 13 bp, Homo sapiens
ctccctggcctgt

SEQ ID NO: 4306984 - DNA, 12 bp, Homo sapiens
ctccctgggctg

SEQ ID NO: 4306985 - DNA, 13 bp, Homo sapiens
ctccctgggctgg

SEQ ID NO: 4306986 - DNA, 18 bp, Homo sapiens
ctccctgggctggcatgg

SEQ ID NO: 4306987 - DNA, 14 bp, Homo sapiens
ctccctgtcccctg

SEQ ID NO: 4306988 - DNA, 21 bp, Homo sapiens
ctcccttcaaccattccccat

SEQ ID NO: 4306989 - DNA, 22 bp, Homo sapiens
ctcccttcaaccattccccatg

SEQ ID NO: 4306990 - DNA, 20 bp, Homo sapiens
ctccgctaaggcttccggct

SEQ ID NO: 4306991 - DNA, 12 bp, Homo sapiens
ctccggccctgc

SEQ ID NO: 4306992 - DNA, 18 bp, Homo sapiens
ctccgtcctggcagggca

SEQ ID NO: 4306993 - DNA, 18 bp, Homo sapiens
ctccgtttccaaatacat

SEQ ID NO: 4306994 - DNA, 22 bp, Homo sapiens
ctcctagcacaaggagtgcccg

SEQ ID NO: 4306995 - DNA, 19 bp, Homo sapiens
ctcctatcacctcccctcc

SEQ ID NO: 4306996 - DNA, 17 bp, Homo sapiens
ctcctcccaactctggc

SEQ ID NO: 4306997 - DNA, 19 bp, Homo sapiens
ctcctcccaactctggcct

SEQ ID NO: 4306998 - DNA, 23 bp, Homo sapiens
ctcctcccaggcgccccttcccc

SEQ ID NO: 4306999 - DNA, 15 bp, Homo sapiens
ctcctcccggtgccc

SEQ ID NO: 4307000 - DNA, 16 bp, Homo sapiens
ctcctcggccagagct

SEQ ID NO: 4307001 - DNA, 11 bp, Homo sapiens
ctcctctccca

SEQ ID NO: 4307002 - DNA, 15 bp, Homo sapiens
ctcctctgggcagga

SEQ ID NO: 4307003 - DNA, 13 bp, Homo sapiens
ctcctgaccccac

SEQ ID NO: 4307004 - DNA, 16 bp, Homo sapiens
ctcctgctgaccttct

SEQ ID NO: 4307005 - DNA, 18 bp, Homo sapiens
ctcctggacccagcaggg

SEQ ID NO: 4307006 - DNA, 13 bp, Homo sapiens
ctcctggctcaca

SEQ ID NO: 4307007 - DNA, 19 bp, Homo sapiens
ctcctggctcacagccacc

SEQ ID NO: 4307008 - DNA, 23 bp, Homo sapiens
ctcctgggcatctggccctgctg

SEQ ID NO: 4307009 - DNA, 18 bp, Homo sapiens
ctcctgtaattttgtagt

SEQ ID NO: 4307010 - DNA, 17 bp, Homo sapiens
ctcctgtggcggtgcag

SEQ ID NO: 4307011 - DNA, 17 bp, Homo sapiens
ctccttccaggccccag

SEQ ID NO: 4307012 - DNA, 20 bp, Homo sapiens
ctccttccaggccccaggct

SEQ ID NO: 4307013 - DNA, 22 bp, Homo sapiens
ctccttccaggccccaggctgg

SEQ ID NO: 4307014 - DNA, 13 bp, Homo sapiens
ctccttctcccca

SEQ ID NO: 4307015 - DNA, 13 bp, Homo sapiens
ctccttctcccct

SEQ ID NO: 4307016 - DNA, 18 bp, Homo sapiens
ctccttctcccctccaga

SEQ ID NO: 4307017 - DNA, 16 bp, Homo sapiens
ctccttgagttttcct

SEQ ID NO: 4307018 - DNA, 23 bp, Homo sapiens
ctccttgtttgcctttaggcagg

SEQ ID NO: 4307019 - DNA, 16 bp, Homo sapiens
ctcctttcacaacctt

SEQ ID NO: 4307020 - DNA, 17 bp, Homo sapiens
ctcctttcacaaccttc

SEQ ID NO: 4307021 - DNA, 17 bp, Homo sapiens
ctcgaagctgttctctg

SEQ ID NO: 4307022 - DNA, 19 bp, Homo sapiens
ctcgaagctgttctctgct

SEQ ID NO: 4307023 - DNA, 20 bp, Homo sapiens
ctcgaagctgttctctgctt

SEQ ID NO: 4307024 - DNA, 15 bp, Homo sapiens
ctcgaagtcttccat

SEQ ID NO: 4307025 - DNA, 15 bp, Homo sapiens
ctcggagcctgtgtt

SEQ ID NO: 4307026 - DNA, 16 bp, Homo sapiens
ctcggagcctgtgtta

SEQ ID NO: 4307027 - DNA, 24 bp, Homo sapiens
ctcggccagagctcccaggacgca

SEQ ID NO: 4307028 - DNA, 20 bp, Homo sapiens
ctcggccccacccaccctct

SEQ ID NO: 4307029 - DNA, 22 bp, Homo sapiens
ctcggctgtgtggggagggtgg

SEQ ID NO: 4307030 - DNA, 18 bp, Homo sapiens
ctcgttgacatgcacagt

SEQ ID NO: 4307031 - DNA, 18 bp, Homo sapiens
ctctaactgattcagggc

SEQ ID NO: 4307032 - DNA, 16 bp, Homo sapiens
ctctaactgtatattt

SEQ ID NO: 4307033 - DNA, 17 bp, Homo sapiens
ctctaactgtatatttg

SEQ ID NO: 4307034 - DNA, 20 bp, Homo sapiens
ctctaactgtatatttgtat

SEQ ID NO: 4307035 - DNA, 16 bp, Homo sapiens
ctctacttagcatgtc

SEQ ID NO: 4307036 - DNA, 17 bp, Homo sapiens
ctctacttagcatgtcc

SEQ ID NO: 4307037 - DNA, 20 bp, Homo sapiens
ctctactttcctgatgttga

SEQ ID NO: 4307038 - DNA, 17 bp, Homo sapiens
ctctagacaaccctgca

SEQ ID NO: 4307039 - DNA, 20 bp, Homo sapiens
ctctatatatacatgtatag

SEQ ID NO: 4307040 - DNA, 20 bp, Homo sapiens
ctctattgtagcatttcttg

SEQ ID NO: 4307041 - DNA, 21 bp, Homo sapiens
ctctattgtagcatttcttga

SEQ ID NO: 4307042 - DNA, 23 bp, Homo sapiens
ctctcactctggcagcctcagag

SEQ ID NO: 4307043 - DNA, 14 bp, Homo sapiens
ctctcactgtgtcc

SEQ ID NO: 4307044 - DNA, 15 bp, Homo sapiens
ctctcactgtgtccc

SEQ ID NO: 4307045 - DNA, 15 bp, Homo sapiens
ctctcagcccaggtc

SEQ ID NO: 4307046 - DNA, 17 bp, Homo sapiens
ctctcagcccaggtctc

SEQ ID NO: 4307047 - DNA, 14 bp, Homo sapiens
ctctcagcctccac

SEQ ID NO: 4307048 - DNA, 12 bp, Homo sapiens
ctctccactgcc

SEQ ID NO: 4307049 - DNA, 18 bp, Homo sapiens
ctctccaggattgtccac

SEQ ID NO: 4307050 - DNA, 22 bp, Homo sapiens
ctctccccggacaagcccagga

SEQ ID NO: 4307051 - DNA, 21 bp, Homo sapiens
ctctcccctggaactgtctct

SEQ ID NO: 4307052 - DNA, 15 bp, Homo sapiens
ctctccctccactcc

SEQ ID NO: 4307053 - DNA, 18 bp, Homo sapiens
ctctccctccactcctcc

SEQ ID NO: 4307054 - DNA, 20 bp, Homo sapiens
ctctccctccactcctccca

SEQ ID NO: 4307055 - DNA, 16 bp, Homo sapiens
ctctcctctctctccc

SEQ ID NO: 4307056 - DNA, 18 bp, Homo sapiens
ctctcctgaggagcagcc

SEQ ID NO: 4307057 - DNA, 20 bp, Homo sapiens
ctctcctgaggagcagccca

SEQ ID NO: 4307058 - DNA, 18 bp, Homo sapiens
ctctcctgggccagggtc

SEQ ID NO: 4307059 - DNA, 22 bp, Homo sapiens
ctctcgcctcaggctttttcca

SEQ ID NO: 4307060 - DNA, 14 bp, Homo sapiens
ctctctcagcccag

SEQ ID NO: 4307061 - DNA, 13 bp, Homo sapiens
ctctctccctcca

SEQ ID NO: 4307062 - DNA, 13 bp, Homo sapiens
ctctctcctctct

SEQ ID NO: 4307063 - DNA, 15 bp, Homo sapiens
ctctctctatatata

SEQ ID NO: 4307064 - DNA, 17 bp, Homo sapiens
ctctctctatatataca

SEQ ID NO: 4307065 - DNA, 12 bp, Homo sapiens
ctctctctccct

SEQ ID NO: 4307066 - DNA, 16 bp, Homo sapiens
ctctctctccctccac

SEQ ID NO: 4307067 - DNA, 15 bp, Homo sapiens
ctctctgaactgcaa

SEQ ID NO: 4307068 - DNA, 13 bp, Homo sapiens
ctctctgccagcc

SEQ ID NO: 4307069 - DNA, 11 bp, Homo sapiens
ctctctgcccc

SEQ ID NO: 4307070 - DNA, 17 bp, Homo sapiens
ctctctgtccaatctgc

SEQ ID NO: 4307071 - DNA, 12 bp, Homo sapiens
ctctctgtttac

SEQ ID NO: 4307072 - DNA, 17 bp, Homo sapiens
ctctgaaagctgcttct

SEQ ID NO: 4307073 - DNA, 15 bp, Homo sapiens
ctctgaactgcaaca

SEQ ID NO: 4307074 - DNA, 14 bp, Homo sapiens
ctctgaactgctgc

SEQ ID NO: 4307075 - DNA, 18 bp, Homo sapiens
ctctgaactgctgctggt

SEQ ID NO: 4307076 - DNA, 17 bp, Homo sapiens
ctctgaatgtagccagc

SEQ ID NO: 4307077 - DNA, 21 bp, Homo sapiens
ctctgcaagattctgtgggca

SEQ ID NO: 4307078 - DNA, 18 bp, Homo sapiens
ctctgcacgtgcacacac

SEQ ID NO: 4307079 - DNA, 20 bp, Homo sapiens
ctctgcacgtgcacacacct

SEQ ID NO: 4307080 - DNA, 21 bp, Homo sapiens
ctctgcagcacattgccctga

SEQ ID NO: 4307081 - DNA, 13 bp, Homo sapiens
ctctgcagggcag

SEQ ID NO: 4307082 - DNA, 19 bp, Homo sapiens
ctctgcagggcagcctgtg

SEQ ID NO: 4307083 - DNA, 13 bp, Homo sapiens
ctctgcatgctcc

SEQ ID NO: 4307084 - DNA, 14 bp, Homo sapiens
ctctgcatgctcct

SEQ ID NO: 4307085 - DNA, 19 bp, Homo sapiens
ctctgcatgctcctctgcc

SEQ ID NO: 4307086 - DNA, 20 bp, Homo sapiens
ctctgcatgctcctctgcct

SEQ ID NO: 4307087 - DNA, 22 bp, Homo sapiens
ctctgcatgctcctctgcctgt

SEQ ID NO: 4307088 - DNA, 12 bp, Homo sapiens
ctctgccagccg

SEQ ID NO: 4307089 - DNA, 13 bp, Homo sapiens
ctctgccatcagc

SEQ ID NO: 4307090 - DNA, 21 bp, Homo sapiens
ctctgccatcagcccctgctg

SEQ ID NO: 4307091 - DNA, 21 bp, Homo sapiens
ctctgcccccagctgctcctc

SEQ ID NO: 4307092 - DNA, 18 bp, Homo sapiens
ctctgcctgtccctctca

SEQ ID NO: 4307093 - DNA, 19 bp, Homo sapiens
ctctgcctgtccctctcag

SEQ ID NO: 4307094 - DNA, 21 bp, Homo sapiens
ctctgcctgtccctctcaggc

SEQ ID NO: 4307095 - DNA, 14 bp, Homo sapiens
ctctgcctgtgccc

SEQ ID NO: 4307096 - DNA, 16 bp, Homo sapiens
ctctgcctgtgcccgc

SEQ ID NO: 4307097 - DNA, 14 bp, Homo sapiens
ctctgccttccagg

SEQ ID NO: 4307098 - DNA, 17 bp, Homo sapiens
ctctgccttccaggcgt

SEQ ID NO: 4307099 - DNA, 20 bp, Homo sapiens
ctctgctatgtctgtgatgt

SEQ ID NO: 4307100 - DNA, 14 bp, Homo sapiens
ctctgctgaggcca

SEQ ID NO: 4307101 - DNA, 20 bp, Homo sapiens
ctctgctgaggccagaggaa

SEQ ID NO: 4307102 - DNA, 23 bp, Homo sapiens
ctctgctgaggccagaggaaggg

SEQ ID NO: 4307103 - DNA, 22 bp, Homo sapiens
ctctgctggattctaaattatg

SEQ ID NO: 4307104 - DNA, 23 bp, Homo sapiens
ctctgctggattctaaattatgt

SEQ ID NO: 4307105 - DNA, 23 bp, Homo sapiens
ctctggaaaggaggaaggagcct

SEQ ID NO: 4307106 - DNA, 22 bp, Homo sapiens
ctctggactgggaagggggcag

SEQ ID NO: 4307107 - DNA, 13 bp, Homo sapiens
ctctggagtgtgt

SEQ ID NO: 4307108 - DNA, 17 bp, Homo sapiens
ctctggcagcctcagag

SEQ ID NO: 4307109 - DNA, 22 bp, Homo sapiens
ctctggcagcctcagaggcccc

SEQ ID NO: 4307110 - DNA, 23 bp, Homo sapiens
ctctggcaggtggccagggctcc

SEQ ID NO: 4307111 - DNA, 11 bp, Homo sapiens
ctctggccctg

SEQ ID NO: 4307112 - DNA, 12 bp, Homo sapiens
ctctggcctggg

SEQ ID NO: 4307113 - DNA, 14 bp, Homo sapiens
ctctggcctgggaa

SEQ ID NO: 4307114 - DNA, 21 bp, Homo sapiens
ctctggccttggttcctccag

SEQ ID NO: 4307115 - DNA, 11 bp, Homo sapiens
ctctgggctca

SEQ ID NO: 4307116 - DNA, 19 bp, Homo sapiens
ctctgggctcacaccagcc

SEQ ID NO: 4307117 - DNA, 18 bp, Homo sapiens
ctctgtccaatctgcaag

SEQ ID NO: 4307118 - DNA, 13 bp, Homo sapiens
ctctgtcccagga

SEQ ID NO: 4307119 - DNA, 19 bp, Homo sapiens
ctctgtcttggtaggtttg

SEQ ID NO: 4307120 - DNA, 19 bp, Homo sapiens
ctctgtgactcgcttagct

SEQ ID NO: 4307121 - DNA, 21 bp, Homo sapiens
ctctgtgactcgcttagctga

SEQ ID NO: 4307122 - DNA, 20 bp, Homo sapiens
ctctgtgctaagttgtctta

SEQ ID NO: 4307123 - DNA, 15 bp, Homo sapiens
ctctgtggggccaca

SEQ ID NO: 4307124 - DNA, 15 bp, Homo sapiens
ctctgtttaccctcc

SEQ ID NO: 4307125 - DNA, 21 bp, Homo sapiens
ctctgtttaccctccctgtcc

SEQ ID NO: 4307126 - DNA, 13 bp, Homo sapiens
ctctgtttgctca

SEQ ID NO: 4307127 - DNA, 24 bp, Homo sapiens
ctctgtttgctcacccaggacctc

SEQ ID NO: 4307128 - DNA, 23 bp, Homo sapiens
ctcttaatgccacggcagccacc

SEQ ID NO: 4307129 - DNA, 13 bp, Homo sapiens
ctcttaccccgtc

SEQ ID NO: 4307130 - DNA, 20 bp, Homo sapiens
ctcttacctgtaatagcctc

SEQ ID NO: 4307131 - DNA, 22 bp, Homo sapiens
ctcttacctgtaatagcctcac

SEQ ID NO: 4307132 - DNA, 18 bp, Homo sapiens
ctcttagaagaatattgt

SEQ ID NO: 4307133 - DNA, 17 bp, Homo sapiens
ctcttagcttttctgca

SEQ ID NO: 4307134 - DNA, 14 bp, Homo sapiens
ctcttcaccaggaa

SEQ ID NO: 4307135 - DNA, 16 bp, Homo sapiens
ctcttcaccaggaaga

SEQ ID NO: 4307136 - DNA, 14 bp, Homo sapiens
ctcttcccttcaac

SEQ ID NO: 4307137 - DNA, 15 bp, Homo sapiens
ctcttctccactgga

SEQ ID NO: 4307138 - DNA, 16 bp, Homo sapiens
ctcttctcctttcaca

SEQ ID NO: 4307139 - DNA, 21 bp, Homo sapiens
ctcttcttactgtatttggga

SEQ ID NO: 4307140 - DNA, 19 bp, Homo sapiens
ctcttcttatacagataaa

SEQ ID NO: 4307141 - DNA, 12 bp, Homo sapiens
ctcttcttcctt

SEQ ID NO: 4307142 - DNA, 20 bp, Homo sapiens
ctcttgcataagcctcaggc

SEQ ID NO: 4307143 - DNA, 23 bp, Homo sapiens
ctcttgcataagcctcaggcctg

SEQ ID NO: 4307144 - DNA, 14 bp, Homo sapiens
ctcttggcaggagt

SEQ ID NO: 4307145 - DNA, 15 bp, Homo sapiens
ctcttggctggcttc

SEQ ID NO: 4307146 - DNA, 16 bp, Homo sapiens
ctcttgggctgagact

SEQ ID NO: 4307147 - DNA, 17 bp, Homo sapiens
ctcttgggctgagactg

SEQ ID NO: 4307148 - DNA, 20 bp, Homo sapiens
ctctttattgtctgtaaatc

SEQ ID NO: 4307149 - DNA, 11 bp, Homo sapiens
ctgaaaagtgc

SEQ ID NO: 4307150 - DNA, 19 bp, Homo sapiens
ctgaaaatatttttttcta

SEQ ID NO: 4307151 - DNA, 14 bp, Homo sapiens
ctgaaagctgcttc

SEQ ID NO: 4307152 - DNA, 15 bp, Homo sapiens
ctgaaatgtttccag

SEQ ID NO: 4307153 - DNA, 19 bp, Homo sapiens
ctgaaatgtttccaggcat

SEQ ID NO: 4307154 - DNA, 18 bp, Homo sapiens
ctgaactgcaacactgga

SEQ ID NO: 4307155 - DNA, 20 bp, Homo sapiens
ctgaactggccgctgggaga

SEQ ID NO: 4307156 - DNA, 20 bp, Homo sapiens
ctgaagagcgctcctctgcc

SEQ ID NO: 4307157 - DNA, 14 bp, Homo sapiens
ctgaaggagaggag

SEQ ID NO: 4307158 - DNA, 20 bp, Homo sapiens
ctgaaggattttaaatgctg

SEQ ID NO: 4307159 - DNA, 20 bp, Homo sapiens
ctgaaggctttcagggcctc

SEQ ID NO: 4307160 - DNA, 23 bp, Homo sapiens
ctgaaggctttcagggcctccag

SEQ ID NO: 4307161 - DNA, 20 bp, Homo sapiens
ctgaaggttggaactgctgc

SEQ ID NO: 4307162 - DNA, 21 bp, Homo sapiens
ctgaaggttggaactgctgcc

SEQ ID NO: 4307163 - DNA, 14 bp, Homo sapiens
ctgaagtcactgca

SEQ ID NO: 4307164 - DNA, 15 bp, Homo sapiens
ctgaagtcactgcac

SEQ ID NO: 4307165 - DNA, 16 bp, Homo sapiens
ctgaagtcactgcaca

SEQ ID NO: 4307166 - DNA, 22 bp, Homo sapiens
ctgaagtcactgcacagtgcat

SEQ ID NO: 4307167 - DNA, 17 bp, Homo sapiens
ctgaagtgaatacatgg

SEQ ID NO: 4307168 - DNA, 16 bp, Homo sapiens
ctgaagtgaccccagc

SEQ ID NO: 4307169 - DNA, 22 bp, Homo sapiens
ctgaagttggagtgagtgtggc

SEQ ID NO: 4307170 - DNA, 22 bp, Homo sapiens
ctgaataatggaattatgtata

SEQ ID NO: 4307171 - DNA, 13 bp, Homo sapiens
ctgaataatttct

SEQ ID NO: 4307172 - DNA, 14 bp, Homo sapiens
ctgaatgtagccag

SEQ ID NO: 4307173 - DNA, 13 bp, Homo sapiens
ctgaatgtatgta

SEQ ID NO: 4307174 - DNA, 15 bp, Homo sapiens
ctgaatgtatgtaaa

SEQ ID NO: 4307175 - DNA, 14 bp, Homo sapiens
ctgacaaattttaa

SEQ ID NO: 4307176 - DNA, 17 bp, Homo sapiens
ctgacaggaaagtggat

SEQ ID NO: 4307177 - DNA, 21 bp, Homo sapiens
ctgacatgctaacctctctga

SEQ ID NO: 4307178 - DNA, 13 bp, Homo sapiens
ctgaccacacttc

SEQ ID NO: 4307179 - DNA, 16 bp, Homo sapiens
ctgaccacacttcctg

SEQ ID NO: 4307180 - DNA, 21 bp, Homo sapiens
ctgaccacacttcctgtccag

SEQ ID NO: 4307181 - DNA, 19 bp, Homo sapiens
ctgacccattcacatttta

SEQ ID NO: 4307182 - DNA, 15 bp, Homo sapiens
ctgaccccacctaga

SEQ ID NO: 4307183 - DNA, 12 bp, Homo sapiens
ctgaccccactt

SEQ ID NO: 4307184 - DNA, 21 bp, Homo sapiens
ctgaccccacttatgctgctg

SEQ ID NO: 4307185 - DNA, 23 bp, Homo sapiens
ctgaccccacttatgctgctgtg

SEQ ID NO: 4307186 - DNA, 13 bp, Homo sapiens
ctgacctgccccc

SEQ ID NO: 4307187 - DNA, 23 bp, Homo sapiens
ctgacctgcccccgctctgccat

SEQ ID NO: 4307188 - DNA, 17 bp, Homo sapiens
ctgactgtactcctccc

SEQ ID NO: 4307189 - DNA, 14 bp, Homo sapiens
ctgactgtcctaca

SEQ ID NO: 4307190 - DNA, 13 bp, Homo sapiens
ctgacttctcagg

SEQ ID NO: 4307191 - DNA, 18 bp, Homo sapiens
ctgagaagcctcatggga

SEQ ID NO: 4307192 - DNA, 19 bp, Homo sapiens
ctgagaagcctcatgggag

SEQ ID NO: 4307193 - DNA, 21 bp, Homo sapiens
ctgagaatccccgtgctcaca

SEQ ID NO: 4307194 - DNA, 22 bp, Homo sapiens
ctgagaatccccgtgctcacag

SEQ ID NO: 4307195 - DNA, 12 bp, Homo sapiens
ctgagagtgggg

SEQ ID NO: 4307196 - DNA, 15 bp, Homo sapiens
ctgagagtggggcta

SEQ ID NO: 4307197 - DNA, 23 bp, Homo sapiens
ctgagatggaacccttttggccc

SEQ ID NO: 4307198 - DNA, 21 bp, Homo sapiens
ctgagccaaaaacaataaacg

SEQ ID NO: 4307199 - DNA, 19 bp, Homo sapiens
ctgagccctgccctcactc

SEQ ID NO: 4307200 - DNA, 22 bp, Homo sapiens
ctgagccttagtttcagctgac

SEQ ID NO: 4307201 - DNA, 23 bp, Homo sapiens
ctgagccttagtttcagctgacc

SEQ ID NO: 4307202 - DNA, 17 bp, Homo sapiens
ctgagcggccgcctgtc

SEQ ID NO: 4307203 - DNA, 19 bp, Homo sapiens
ctgagcggccgcctgtcct

SEQ ID NO: 4307204 - DNA, 21 bp, Homo sapiens
ctgagcggccgcctgtccttg

SEQ ID NO: 4307205 - DNA, 16 bp, Homo sapiens
ctgagctatgtagtat

SEQ ID NO: 4307206 - DNA, 14 bp, Homo sapiens
ctgagctcctctgg

SEQ ID NO: 4307207 - DNA, 15 bp, Homo sapiens
ctgagctcctctggg

SEQ ID NO: 4307208 - DNA, 17 bp, Homo sapiens
ctgagctcctctgggca

SEQ ID NO: 4307209 - DNA, 18 bp, Homo sapiens
ctgagctcctctgggcag

SEQ ID NO: 4307210 - DNA, 14 bp, Homo sapiens
ctgagctctgacct

SEQ ID NO: 4307211 - DNA, 12 bp, Homo sapiens
ctgagctgtgcc

SEQ ID NO: 4307212 - DNA, 13 bp, Homo sapiens
ctgagctgtgcca

SEQ ID NO: 4307213 - DNA, 14 bp, Homo sapiens
ctgagctgtgccag

SEQ ID NO: 4307214 - DNA, 16 bp, Homo sapiens
ctgagctgtgccagct

SEQ ID NO: 4307215 - DNA, 16 bp, Homo sapiens
ctgagcttggccagaa

SEQ ID NO: 4307216 - DNA, 16 bp, Homo sapiens
ctgaggagcagcccac

SEQ ID NO: 4307217 - DNA, 21 bp, Homo sapiens
ctgaggagcagcccacctgct

SEQ ID NO: 4307218 - DNA, 20 bp, Homo sapiens
ctgaggagctcagggctgga

SEQ ID NO: 4307219 - DNA, 21 bp, Homo sapiens
ctgaggagctcagggctggat

SEQ ID NO: 4307220 - DNA, 14 bp, Homo sapiens
ctgaggatgctgag

SEQ ID NO: 4307221 - DNA, 14 bp, Homo sapiens
ctgaggcaaccccc

SEQ ID NO: 4307222 - DNA, 14 bp, Homo sapiens
ctgaggccagagga

SEQ ID NO: 4307223 - DNA, 15 bp, Homo sapiens
ctgaggccagaggaa

SEQ ID NO: 4307224 - DNA, 16 bp, Homo sapiens
ctgaggccagaggaag

SEQ ID NO: 4307225 - DNA, 21 bp, Homo sapiens
ctgaggccagaggaagggagg

SEQ ID NO: 4307226 - DNA, 14 bp, Homo sapiens
ctgaggggcctgcc

SEQ ID NO: 4307227 - DNA, 15 bp, Homo sapiens
ctgaggggcctgcca

SEQ ID NO: 4307228 - DNA, 16 bp, Homo sapiens
ctgaggggcctgccac

SEQ ID NO: 4307229 - DNA, 17 bp, Homo sapiens
ctgaggtgggccttcca

SEQ ID NO: 4307230 - DNA, 20 bp, Homo sapiens
ctgagtatgttaagctcttt

SEQ ID NO: 4307231 - DNA, 15 bp, Homo sapiens
ctgagtccttaaaca

SEQ ID NO: 4307232 - DNA, 18 bp, Homo sapiens
ctgagtggtccacattct

SEQ ID NO: 4307233 - DNA, 14 bp, Homo sapiens
ctgagttcctgcat

SEQ ID NO: 4307234 - DNA, 21 bp, Homo sapiens
ctgagttgaggggcttccctc

SEQ ID NO: 4307235 - DNA, 15 bp, Homo sapiens
ctgatcaaagcacct

SEQ ID NO: 4307236 - DNA, 18 bp, Homo sapiens
ctgatcaaagcaccttga

SEQ ID NO: 4307237 - DNA, 18 bp, Homo sapiens
ctgatcacaacttttctg

SEQ ID NO: 4307238 - DNA, 15 bp, Homo sapiens
ctgatggtggggcca

SEQ ID NO: 4307239 - DNA, 19 bp, Homo sapiens
ctgattctatgcctgtatt

SEQ ID NO: 4307240 - DNA, 14 bp, Homo sapiens
ctgatttattctgg

SEQ ID NO: 4307241 - DNA, 19 bp, Homo sapiens
ctgatttattctggtgtct

SEQ ID NO: 4307242 - DNA, 17 bp, Homo sapiens
ctgatttattttgtatg

SEQ ID NO: 4307243 - DNA, 20 bp, Homo sapiens
ctgatttgggctgaatgtat

SEQ ID NO: 4307244 - DNA, 14 bp, Homo sapiens
ctgcaaatagtttc

SEQ ID NO: 4307245 - DNA, 21 bp, Homo sapiens
ctgcaagattctgtgggcagc

SEQ ID NO: 4307246 - DNA, 16 bp, Homo sapiens
ctgcaagtcccaggga

SEQ ID NO: 4307247 - DNA, 16 bp, Homo sapiens
ctgcaatacattaaaa

SEQ ID NO: 4307248 - DNA, 17 bp, Homo sapiens
ctgcaatacattaaaat

SEQ ID NO: 4307249 - DNA, 14 bp, Homo sapiens
ctgcacacacctgc

SEQ ID NO: 4307250 - DNA, 15 bp, Homo sapiens
ctgcacacacctgca

SEQ ID NO: 4307251 - DNA, 19 bp, Homo sapiens
ctgcacacacctgcacacc

SEQ ID NO: 4307252 - DNA, 15 bp, Homo sapiens
ctgcacacccctgca

SEQ ID NO: 4307253 - DNA, 18 bp, Homo sapiens
ctgcacacccctgcacac

SEQ ID NO: 4307254 - DNA, 16 bp, Homo sapiens
ctgcacaccgtccctc

SEQ ID NO: 4307255 - DNA, 17 bp, Homo sapiens
ctgcacaccgtccctct

SEQ ID NO: 4307256 - DNA, 18 bp, Homo sapiens
ctgcacagtgcatctcag

SEQ ID NO: 4307257 - DNA, 21 bp, Homo sapiens
ctgcaccaacctcactgccct

SEQ ID NO: 4307258 - DNA, 12 bp, Homo sapiens
ctgcaccccaca

SEQ ID NO: 4307259 - DNA, 15 bp, Homo sapiens
ctgcacccctggtgt

SEQ ID NO: 4307260 - DNA, 13 bp, Homo sapiens
ctgcaccctctgc

SEQ ID NO: 4307261 - DNA, 14 bp, Homo sapiens
ctgcaccctctgct

SEQ ID NO: 4307262 - DNA, 15 bp, Homo sapiens
ctgcacctgcaggga

SEQ ID NO: 4307263 - DNA, 23 bp, Homo sapiens
ctgcacctgcagggagcagcacg

SEQ ID NO: 4307264 - DNA, 16 bp, Homo sapiens
ctgcacctgcttctca

SEQ ID NO: 4307265 - DNA, 22 bp, Homo sapiens
ctgcacgaatggaagaggcacc

SEQ ID NO: 4307266 - DNA, 19 bp, Homo sapiens
ctgcacgtgcacacacctg

SEQ ID NO: 4307267 - DNA, 22 bp, Homo sapiens
ctgcacgtgcacacacctgcac

SEQ ID NO: 4307268 - DNA, 23 bp, Homo sapiens
ctgcacgtgcacacacctgcaca

SEQ ID NO: 4307269 - DNA, 13 bp, Homo sapiens
ctgcacttggcct

SEQ ID NO: 4307270 - DNA, 17 bp, Homo sapiens
ctgcagcacattgccct

SEQ ID NO: 4307271 - DNA, 18 bp, Homo sapiens
ctgcagcacattgccctg

SEQ ID NO: 4307272 - DNA, 19 bp, Homo sapiens
ctgcagcacattgccctga

SEQ ID NO: 4307273 - DNA, 21 bp, Homo sapiens
ctgcagcacattgccctgagg

SEQ ID NO: 4307274 - DNA, 22 bp, Homo sapiens
ctgcaggaatcaaaaattgaag

SEQ ID NO: 4307275 - DNA, 15 bp, Homo sapiens
ctgcaggccacccag

SEQ ID NO: 4307276 - DNA, 17 bp, Homo sapiens
ctgcagggagcagcacg

SEQ ID NO: 4307277 - DNA, 13 bp, Homo sapiens
ctgcagggcagcc

SEQ ID NO: 4307278 - DNA, 14 bp, Homo sapiens
ctgcagggcagcct

SEQ ID NO: 4307279 - DNA, 16 bp, Homo sapiens
ctgcagggcagcctgt

SEQ ID NO: 4307280 - DNA, 18 bp, Homo sapiens
ctgcagggcagcctgtgg

SEQ ID NO: 4307281 - DNA, 20 bp, Homo sapiens
ctgcagggcagcctgtggga

SEQ ID NO: 4307282 - DNA, 18 bp, Homo sapiens
ctgcagtcacccctgtct

SEQ ID NO: 4307283 - DNA, 15 bp, Homo sapiens
ctgcagtcagcacag

SEQ ID NO: 4307284 - DNA, 22 bp, Homo sapiens
ctgcagtgggttctccaaacta

SEQ ID NO: 4307285 - DNA, 16 bp, Homo sapiens
ctgcagttggcctcag

SEQ ID NO: 4307286 - DNA, 21 bp, Homo sapiens
ctgcatatcctggtgtctagt

SEQ ID NO: 4307287 - DNA, 18 bp, Homo sapiens
ctgcatcccttggcccct

SEQ ID NO: 4307288 - DNA, 16 bp, Homo sapiens
ctgcatcctcagcccc

SEQ ID NO: 4307289 - DNA, 22 bp, Homo sapiens
ctgcatcctcagccccagggcc

SEQ ID NO: 4307290 - DNA, 20 bp, Homo sapiens
ctgcatctagaggcttcctt

SEQ ID NO: 4307291 - DNA, 16 bp, Homo sapiens
ctgcatgctcctctgc

SEQ ID NO: 4307292 - DNA, 16 bp, Homo sapiens
ctgccaactttccaga

SEQ ID NO: 4307293 - DNA, 22 bp, Homo sapiens
ctgccacacttcaggctcttct

SEQ ID NO: 4307294 - DNA, 14 bp, Homo sapiens
ctgccactctcctg

SEQ ID NO: 4307295 - DNA, 16 bp, Homo sapiens
ctgccactctcctgag

SEQ ID NO: 4307296 - DNA, 13 bp, Homo sapiens
ctgccagaagtgt

SEQ ID NO: 4307297 - DNA, 11 bp, Homo sapiens
ctgccagagaa

SEQ ID NO: 4307298 - DNA, 17 bp, Homo sapiens
ctgccagaggcctggtg

SEQ ID NO: 4307299 - DNA, 19 bp, Homo sapiens
ctgccagaggcctggtgcc

SEQ ID NO: 4307300 - DNA, 22 bp, Homo sapiens
ctgccagaggcctggtgccctg

SEQ ID NO: 4307301 - DNA, 23 bp, Homo sapiens
ctgccaggctcccactgcccctg

SEQ ID NO: 4307302 - DNA, 17 bp, Homo sapiens
ctgccatcagcccctgc

SEQ ID NO: 4307303 - DNA, 21 bp, Homo sapiens
ctgccatcagcccctgctgct

SEQ ID NO: 4307304 - DNA, 22 bp, Homo sapiens
ctgccatcagcccctgctgctc

SEQ ID NO: 4307305 - DNA, 18 bp, Homo sapiens
ctgccatgattttggcca

SEQ ID NO: 4307306 - DNA, 21 bp, Homo sapiens
ctgccatgattttggccactt

SEQ ID NO: 4307307 - DNA, 20 bp, Homo sapiens
ctgccatggaggcgccttcc

SEQ ID NO: 4307308 - DNA, 15 bp, Homo sapiens
ctgcccaccccctgc

SEQ ID NO: 4307309 - DNA, 17 bp, Homo sapiens
ctgcccaccccctgctg

SEQ ID NO: 4307310 - DNA, 19 bp, Homo sapiens
ctgcccaccccctgctggt

SEQ ID NO: 4307311 - DNA, 21 bp, Homo sapiens
ctgcccaccccctgctggtgc

SEQ ID NO: 4307312 - DNA, 21 bp, Homo sapiens
ctgcccaccccgcctctgggc

SEQ ID NO: 4307313 - DNA, 17 bp, Homo sapiens
ctgcccacgctcctgcc

SEQ ID NO: 4307314 - DNA, 15 bp, Homo sapiens
ctgccccacaacaca

SEQ ID NO: 4307315 - DNA, 16 bp, Homo sapiens
ctgccccacacaggcc

SEQ ID NO: 4307316 - DNA, 17 bp, Homo sapiens
ctgccccacacaggcct

SEQ ID NO: 4307317 - DNA, 18 bp, Homo sapiens
ctgccccacacaggcctg

SEQ ID NO: 4307318 - DNA, 22 bp, Homo sapiens
ctgccccacacaggcctggccc

SEQ ID NO: 4307319 - DNA, 18 bp, Homo sapiens
ctgccccacccctccatg

SEQ ID NO: 4307320 - DNA, 13 bp, Homo sapiens
ctgccccagagaa

SEQ ID NO: 4307321 - DNA, 19 bp, Homo sapiens
ctgccccagagaagcctca

SEQ ID NO: 4307322 - DNA, 13 bp, Homo sapiens
ctgccccatccca

SEQ ID NO: 4307323 - DNA, 17 bp, Homo sapiens
ctgcccccaaaagtgtc

SEQ ID NO: 4307324 - DNA, 16 bp, Homo sapiens
ctgcccccagctgctc

SEQ ID NO: 4307325 - DNA, 21 bp, Homo sapiens
ctgcccccagctgctcctcgc

SEQ ID NO: 4307326 - DNA, 24 bp, Homo sapiens
ctgcccccagctgctcctcgcagt

SEQ ID NO: 4307327 - DNA, 16 bp, Homo sapiens
ctgccccccacattct

SEQ ID NO: 4307328 - DNA, 22 bp, Homo sapiens
ctgccccccacattctggctcc

SEQ ID NO: 4307329 - DNA, 17 bp, Homo sapiens
ctgcccccgctctgcca

SEQ ID NO: 4307330 - DNA, 19 bp, Homo sapiens
ctgcccccgctctgccatc

SEQ ID NO: 4307331 - DNA, 23 bp, Homo sapiens
ctgcccccgctctgccatcagcc

SEQ ID NO: 4307332 - DNA, 20 bp, Homo sapiens
ctgcccccttctcccacact

SEQ ID NO: 4307333 - DNA, 23 bp, Homo sapiens
ctgccccgccccccagagccagg

SEQ ID NO: 4307334 - DNA, 13 bp, Homo sapiens
ctgcccctccctt

SEQ ID NO: 4307335 - DNA, 14 bp, Homo sapiens
ctgcccctcccttc

SEQ ID NO: 4307336 - DNA, 19 bp, Homo sapiens
ctgccctagcagtttgcct

SEQ ID NO: 4307337 - DNA, 23 bp, Homo sapiens
ctgccctagcagtttgcctctgc

SEQ ID NO: 4307338 - DNA, 20 bp, Homo sapiens
ctgccctcactccactcccc

SEQ ID NO: 4307339 - DNA, 16 bp, Homo sapiens
ctgccctccgcccttc

SEQ ID NO: 4307340 - DNA, 19 bp, Homo sapiens
ctgccctccgcccttccct

SEQ ID NO: 4307341 - DNA, 14 bp, Homo sapiens
ctgccctggtgctg

SEQ ID NO: 4307342 - DNA, 15 bp, Homo sapiens
ctgccctggtgctgc

SEQ ID NO: 4307343 - DNA, 19 bp, Homo sapiens
ctgccctggtgctgccaca

SEQ ID NO: 4307344 - DNA, 20 bp, Homo sapiens
ctgccctggtgctgccacac

SEQ ID NO: 4307345 - DNA, 23 bp, Homo sapiens
ctgccctggtgctgccacacttc

SEQ ID NO: 4307346 - DNA, 16 bp, Homo sapiens
ctgcccttcagcatcc

SEQ ID NO: 4307347 - DNA, 21 bp, Homo sapiens
ctgcccttcagcatcctcagt

SEQ ID NO: 4307348 - DNA, 15 bp, Homo sapiens
ctgccgtgagagccc

SEQ ID NO: 4307349 - DNA, 21 bp, Homo sapiens
ctgccgtgcacggggccagca

SEQ ID NO: 4307350 - DNA, 21 bp, Homo sapiens
ctgcctacccaccccttcccg

SEQ ID NO: 4307351 - DNA, 17 bp, Homo sapiens
ctgcctacgtgctgccc

SEQ ID NO: 4307352 - DNA, 15 bp, Homo sapiens
ctgcctccccaaccc

SEQ ID NO: 4307353 - DNA, 18 bp, Homo sapiens
ctgcctccggccctgccc

SEQ ID NO: 4307354 - DNA, 22 bp, Homo sapiens
ctgcctccggccctgccccaca

SEQ ID NO: 4307355 - DNA, 18 bp, Homo sapiens
ctgcctctgaaaatattt

SEQ ID NO: 4307356 - DNA, 14 bp, Homo sapiens
ctgcctctgaactg

SEQ ID NO: 4307357 - DNA, 12 bp, Homo sapiens
ctgcctgcccac

SEQ ID NO: 4307358 - DNA, 12 bp, Homo sapiens
ctgcctgcctcc

SEQ ID NO: 4307359 - DNA, 14 bp, Homo sapiens
ctgcctgcctccgg

SEQ ID NO: 4307360 - DNA, 15 bp, Homo sapiens
ctgcctgcctccggc

SEQ ID NO: 4307361 - DNA, 11 bp, Homo sapiens
ctgcctggccc

SEQ ID NO: 4307362 - DNA, 16 bp, Homo sapiens
ctgcctgtccctctca

SEQ ID NO: 4307363 - DNA, 12 bp, Homo sapiens
ctgcctgtgccc

SEQ ID NO: 4307364 - DNA, 14 bp, Homo sapiens
ctgcctgtgcccgc

SEQ ID NO: 4307365 - DNA, 17 bp, Homo sapiens
ctgcctgtgcccgctgc

SEQ ID NO: 4307366 - DNA, 20 bp, Homo sapiens
ctgcctgtgcccgctgcgct

SEQ ID NO: 4307367 - DNA, 19 bp, Homo sapiens
ctgcctgtggtgaggtcct

SEQ ID NO: 4307368 - DNA, 12 bp, Homo sapiens
ctgccttccagg

SEQ ID NO: 4307369 - DNA, 15 bp, Homo sapiens
ctgccttctgcggag

SEQ ID NO: 4307370 - DNA, 20 bp, Homo sapiens
ctgccttctgtctcttgcat

SEQ ID NO: 4307371 - DNA, 13 bp, Homo sapiens
ctgccttgccatg

SEQ ID NO: 4307372 - DNA, 21 bp, Homo sapiens
ctgccttggacaccatcccct

SEQ ID NO: 4307373 - DNA, 15 bp, Homo sapiens
ctgcctttgctgcct

SEQ ID NO: 4307374 - DNA, 20 bp, Homo sapiens
ctgcctttgctgccttctgt

SEQ ID NO: 4307375 - DNA, 13 bp, Homo sapiens
ctgcgcaggccct

SEQ ID NO: 4307376 - DNA, 17 bp, Homo sapiens
ctgcgcaggccctccgc

SEQ ID NO: 4307377 - DNA, 12 bp, Homo sapiens
ctgcgccctccc

SEQ ID NO: 4307378 - DNA, 13 bp, Homo sapiens
ctgcgccctccct

SEQ ID NO: 4307379 - DNA, 14 bp, Homo sapiens
ctgcgccctccctc

SEQ ID NO: 4307380 - DNA, 21 bp, Homo sapiens
ctgcgccctccctccctccac

SEQ ID NO: 4307381 - DNA, 15 bp, Homo sapiens
ctgcgccgctgtgct

SEQ ID NO: 4307382 - DNA, 16 bp, Homo sapiens
ctgcgcggatgtagca

SEQ ID NO: 4307383 - DNA, 12 bp, Homo sapiens
ctgcgctgccct

SEQ ID NO: 4307384 - DNA, 13 bp, Homo sapiens
ctgcgctgccctg

SEQ ID NO: 4307385 - DNA, 15 bp, Homo sapiens
ctgcgctgccctgca

SEQ ID NO: 4307386 - DNA, 13 bp, Homo sapiens
ctgcgctgtgctg

SEQ ID NO: 4307387 - DNA, 18 bp, Homo sapiens
ctgcgctgtgctggtctc

SEQ ID NO: 4307388 - DNA, 18 bp, Homo sapiens
ctgcgtaggagagaacag

SEQ ID NO: 4307389 - DNA, 19 bp, Homo sapiens
ctgcgtcccactgagtctc

SEQ ID NO: 4307390 - DNA, 13 bp, Homo sapiens
ctgcgtggcctgg

SEQ ID NO: 4307391 - DNA, 20 bp, Homo sapiens
ctgctacctggttttcatta

SEQ ID NO: 4307392 - DNA, 21 bp, Homo sapiens
ctgctaggtgggccagcccct

SEQ ID NO: 4307393 - DNA, 23 bp, Homo sapiens
ctgctaggtgggccagcccctcc

SEQ ID NO: 4307394 - DNA, 12 bp, Homo sapiens
ctgctatccagc

SEQ ID NO: 4307395 - DNA, 23 bp, Homo sapiens
ctgctcagatgctggtcatcctg

SEQ ID NO: 4307396 - DNA, 12 bp, Homo sapiens
ctgctcaggcct

SEQ ID NO: 4307397 - DNA, 23 bp, Homo sapiens
ctgctcaggcctcacctggcttc

SEQ ID NO: 4307398 - DNA, 14 bp, Homo sapiens
ctgctccatgggca

SEQ ID NO: 4307399 - DNA, 16 bp, Homo sapiens
ctgctccatgggcacc

SEQ ID NO: 4307400 - DNA, 16 bp, Homo sapiens
ctgctcctacctatca

SEQ ID NO: 4307401 - DNA, 12 bp, Homo sapiens
ctgctcctcgca

SEQ ID NO: 4307402 - DNA, 13 bp, Homo sapiens
ctgctcctcgcag

SEQ ID NO: 4307403 - DNA, 19 bp, Homo sapiens
ctgctcctcggccagagct

SEQ ID NO: 4307404 - DNA, 14 bp, Homo sapiens
ctgctcctgtggcg

SEQ ID NO: 4307405 - DNA, 23 bp, Homo sapiens
ctgctctattgtagcatttcttg

SEQ ID NO: 4307406 - DNA, 15 bp, Homo sapiens
ctgctgagctctgac

SEQ ID NO: 4307407 - DNA, 13 bp, Homo sapiens
ctgctgaggccag

SEQ ID NO: 4307408 - DNA, 15 bp, Homo sapiens
ctgctgaggccagag

SEQ ID NO: 4307409 - DNA, 23 bp, Homo sapiens
ctgctgcaccaacctcactgccc

SEQ ID NO: 4307410 - DNA, 12 bp, Homo sapiens
ctgctgcactgc

SEQ ID NO: 4307411 - DNA, 13 bp, Homo sapiens
ctgctgcactgcc

SEQ ID NO: 4307412 - DNA, 17 bp, Homo sapiens
ctgctgccatgattttg

SEQ ID NO: 4307413 - DNA, 21 bp, Homo sapiens
ctgctgcccccagaccccatc

SEQ ID NO: 4307414 - DNA, 17 bp, Homo sapiens
ctgctgccctccatccc

SEQ ID NO: 4307415 - DNA, 16 bp, Homo sapiens
ctgctgcgctgtgctg

SEQ ID NO: 4307416 - DNA, 16 bp, Homo sapiens
ctgctgctcctcggcc

SEQ ID NO: 4307417 - DNA, 17 bp, Homo sapiens
ctgctgctcctcggcca

SEQ ID NO: 4307418 - DNA, 18 bp, Homo sapiens
ctgctgctcctcggccag

SEQ ID NO: 4307419 - DNA, 22 bp, Homo sapiens
ctgctgctcctcggccagagct

SEQ ID NO: 4307420 - DNA, 15 bp, Homo sapiens
ctgctggcccctcac

SEQ ID NO: 4307421 - DNA, 16 bp, Homo sapiens
ctgctggcccctcacc

SEQ ID NO: 4307422 - DNA, 19 bp, Homo sapiens
ctgctggctcccatctccc

SEQ ID NO: 4307423 - DNA, 21 bp, Homo sapiens
ctgctggctcccatctccctc

SEQ ID NO: 4307424 - DNA, 12 bp, Homo sapiens
ctgctggctgcc

SEQ ID NO: 4307425 - DNA, 14 bp, Homo sapiens
ctgctggctgcctt

SEQ ID NO: 4307426 - DNA, 22 bp, Homo sapiens
ctgctgggtgggaatgcgctct

SEQ ID NO: 4307427 - DNA, 15 bp, Homo sapiens
ctgctggtcaccccc

SEQ ID NO: 4307428 - DNA, 12 bp, Homo sapiens
ctgctggtgccc

SEQ ID NO: 4307429 - DNA, 22 bp, Homo sapiens
ctgctgtaagacggccttggac

SEQ ID NO: 4307430 - DNA, 14 bp, Homo sapiens
ctgctgtggcatca

SEQ ID NO: 4307431 - DNA, 21 bp, Homo sapiens
ctgctgtgggtcagtgtgcca

SEQ ID NO: 4307432 - DNA, 24 bp, Homo sapiens
ctgctgttttatgtcatactctgt

SEQ ID NO: 4307433 - DNA, 23 bp, Homo sapiens
ctgcttagtatctcatcaacaaa

SEQ ID NO: 4307434 - DNA, 23 bp, Homo sapiens
ctgcttccctctgcctgtccctc

SEQ ID NO: 4307435 - DNA, 12 bp, Homo sapiens
ctgcttctgggg

SEQ ID NO: 4307436 - DNA, 14 bp, Homo sapiens
ctgcttctggggga

SEQ ID NO: 4307437 - DNA, 17 bp, Homo sapiens
ctgcttgtgttgggccc

SEQ ID NO: 4307438 - DNA, 18 bp, Homo sapiens
ctgctttgggctgccctg

SEQ ID NO: 4307439 - DNA, 23 bp, Homo sapiens
ctgctttgggctgccctggtgct

SEQ ID NO: 4307440 - DNA, 22 bp, Homo sapiens
ctgcttttaggtcatccaacct

SEQ ID NO: 4307441 - DNA, 16 bp, Homo sapiens
ctgcttttccattctg

SEQ ID NO: 4307442 - DNA, 17 bp, Homo sapiens
ctggaagggtccggctt

SEQ ID NO: 4307443 - DNA, 16 bp, Homo sapiens
ctggaatctactagaa

SEQ ID NO: 4307444 - DNA, 16 bp, Homo sapiens
ctggacacagtcaggg

SEQ ID NO: 4307445 - DNA, 18 bp, Homo sapiens
ctggactctgtggggcca

SEQ ID NO: 4307446 - DNA, 15 bp, Homo sapiens
ctggagaactagaga

SEQ ID NO: 4307447 - DNA, 15 bp, Homo sapiens
ctggagaccaggact

SEQ ID NO: 4307448 - DNA, 17 bp, Homo sapiens
ctggagaccaggactct

SEQ ID NO: 4307449 - DNA, 18 bp, Homo sapiens
ctggagaccaggactctg

SEQ ID NO: 4307450 - DNA, 20 bp, Homo sapiens
ctggagaccaggactctgcc

SEQ ID NO: 4307451 - DNA, 20 bp, Homo sapiens
ctggagcatgagccagctct

SEQ ID NO: 4307452 - DNA, 14 bp, Homo sapiens
ctggagcccggcag

SEQ ID NO: 4307453 - DNA, 18 bp, Homo sapiens
ctggagcccggcagtgca

SEQ ID NO: 4307454 - DNA, 19 bp, Homo sapiens
ctggagctggcgtctgtct

SEQ ID NO: 4307455 - DNA, 14 bp, Homo sapiens
ctggaggaggaggt

SEQ ID NO: 4307456 - DNA, 13 bp, Homo sapiens
ctggaggcctctg

SEQ ID NO: 4307457 - DNA, 17 bp, Homo sapiens
ctggaggcctctgcaag

SEQ ID NO: 4307458 - DNA, 13 bp, Homo sapiens
ctggagtctgaag

SEQ ID NO: 4307459 - DNA, 18 bp, Homo sapiens
ctggagtctgaaggagag

SEQ ID NO: 4307460 - DNA, 20 bp, Homo sapiens
ctggagtctgaaggagagga

SEQ ID NO: 4307461 - DNA, 21 bp, Homo sapiens
ctggagtctgaaggagaggag

SEQ ID NO: 4307462 - DNA, 20 bp, Homo sapiens
ctggagtggtaacaagagga

SEQ ID NO: 4307463 - DNA, 12 bp, Homo sapiens
ctggatcagtaa

SEQ ID NO: 4307464 - DNA, 20 bp, Homo sapiens
ctggatgctgggttctgggg

SEQ ID NO: 4307465 - DNA, 22 bp, Homo sapiens
ctggatgctgggttctggggct

SEQ ID NO: 4307466 - DNA, 21 bp, Homo sapiens
ctggatggaggaaaaccaagc

SEQ ID NO: 4307467 - DNA, 20 bp, Homo sapiens
ctggatggatctgctccatg

SEQ ID NO: 4307468 - DNA, 22 bp, Homo sapiens
ctggatggatctgctccatgca

SEQ ID NO: 4307469 - DNA, 23 bp, Homo sapiens
ctggatggatctgctccatgcag

SEQ ID NO: 4307470 - DNA, 14 bp, Homo sapiens
ctggattggcaggt

SEQ ID NO: 4307471 - DNA, 16 bp, Homo sapiens
ctggattggcaggtgt

SEQ ID NO: 4307472 - DNA, 23 bp, Homo sapiens
ctggattggcaggtgtgggctcc

SEQ ID NO: 4307473 - DNA, 12 bp, Homo sapiens
ctggatttaact

SEQ ID NO: 4307474 - DNA, 12 bp, Homo sapiens
ctggattttctt

SEQ ID NO: 4307475 - DNA, 19 bp, Homo sapiens
ctggattttctttctatgt

SEQ ID NO: 4307476 - DNA, 17 bp, Homo sapiens
ctggcaccgccttctct

SEQ ID NO: 4307477 - DNA, 18 bp, Homo sapiens
ctggcactccagaacaaa

SEQ ID NO: 4307478 - DNA, 19 bp, Homo sapiens
ctggcagaactgagctcct

SEQ ID NO: 4307479 - DNA, 21 bp, Homo sapiens
ctggcagccgtgccttcagct

SEQ ID NO: 4307480 - DNA, 14 bp, Homo sapiens
ctggcagcctcaga

SEQ ID NO: 4307481 - DNA, 18 bp, Homo sapiens
ctggcagcctcagaggcc

SEQ ID NO: 4307482 - DNA, 23 bp, Homo sapiens
ctggcaggagacactggtctcag

SEQ ID NO: 4307483 - DNA, 19 bp, Homo sapiens
ctggcaggagggtggcact

SEQ ID NO: 4307484 - DNA, 13 bp, Homo sapiens
ctggcagggcagg

SEQ ID NO: 4307485 - DNA, 16 bp, Homo sapiens
ctggcccagccagcag

SEQ ID NO: 4307486 - DNA, 21 bp, Homo sapiens
ctggcccagtgagagtgaggc

SEQ ID NO: 4307487 - DNA, 22 bp, Homo sapiens
ctggcccagtgagagtgaggcc

SEQ ID NO: 4307488 - DNA, 21 bp, Homo sapiens
ctggccccaaatgttctttcc

SEQ ID NO: 4307489 - DNA, 13 bp, Homo sapiens
ctggcccctcacc

SEQ ID NO: 4307490 - DNA, 14 bp, Homo sapiens
ctggcccctcccac

SEQ ID NO: 4307491 - DNA, 15 bp, Homo sapiens
ctggcccctcccaca

SEQ ID NO: 4307492 - DNA, 18 bp, Homo sapiens
ctggcccctcccacatcc

SEQ ID NO: 4307493 - DNA, 14 bp, Homo sapiens
ctggccctcctctg

SEQ ID NO: 4307494 - DNA, 13 bp, Homo sapiens
ctggccctgttgt

SEQ ID NO: 4307495 - DNA, 23 bp, Homo sapiens
ctggccctttcacccctcttccc

SEQ ID NO: 4307496 - DNA, 21 bp, Homo sapiens
ctggccgacggacccctttca

SEQ ID NO: 4307497 - DNA, 16 bp, Homo sapiens
ctggcctctggcctgg

SEQ ID NO: 4307498 - DNA, 18 bp, Homo sapiens
ctggcctctggcctggga

SEQ ID NO: 4307499 - DNA, 14 bp, Homo sapiens
ctggcctgggaaaa

SEQ ID NO: 4307500 - DNA, 16 bp, Homo sapiens
ctggcctgggaaaagg

SEQ ID NO: 4307501 - DNA, 20 bp, Homo sapiens
ctggcctgggaaaagggcag

SEQ ID NO: 4307502 - DNA, 23 bp, Homo sapiens
ctggcctgggaaaagggcaggag

SEQ ID NO: 4307503 - DNA, 12 bp, Homo sapiens
ctggcctgttct

SEQ ID NO: 4307504 - DNA, 20 bp, Homo sapiens
ctggctacgacttgggacgg

SEQ ID NO: 4307505 - DNA, 16 bp, Homo sapiens
ctggctcacagccacc

SEQ ID NO: 4307506 - DNA, 18 bp, Homo sapiens
ctggctcacagccaccac

SEQ ID NO: 4307507 - DNA, 11 bp, Homo sapiens
ctggctccacc

SEQ ID NO: 4307508 - DNA, 15 bp, Homo sapiens
ctggctcccacaggc

SEQ ID NO: 4307509 - DNA, 17 bp, Homo sapiens
ctggctcccagggtcct

SEQ ID NO: 4307510 - DNA, 14 bp, Homo sapiens
ctggctcctccagc

SEQ ID NO: 4307511 - DNA, 16 bp, Homo sapiens
ctggctcctccagcaa

SEQ ID NO: 4307512 - DNA, 18 bp, Homo sapiens
ctggctcctccagcaaga

SEQ ID NO: 4307513 - DNA, 12 bp, Homo sapiens
ctggctctgcag

SEQ ID NO: 4307514 - DNA, 18 bp, Homo sapiens
ctggctgccttctgcgga

SEQ ID NO: 4307515 - DNA, 18 bp, Homo sapiens
ctggctgtggcccctcct

SEQ ID NO: 4307516 - DNA, 21 bp, Homo sapiens
ctggctgtggcccctccttct

SEQ ID NO: 4307517 - DNA, 19 bp, Homo sapiens
ctggcttagcgttctgttt

SEQ ID NO: 4307518 - DNA, 18 bp, Homo sapiens
ctggcttcccaggaccct

SEQ ID NO: 4307519 - DNA, 19 bp, Homo sapiens
ctggcttctccctggactc

SEQ ID NO: 4307520 - DNA, 23 bp, Homo sapiens
ctggctttggaaagacctgtgag

SEQ ID NO: 4307521 - DNA, 24 bp, Homo sapiens
ctggctttggaaagacctgtgagg

SEQ ID NO: 4307522 - DNA, 15 bp, Homo sapiens
ctggcttttcactgc

SEQ ID NO: 4307523 - DNA, 19 bp, Homo sapiens
ctggcttttcactgctggc

SEQ ID NO: 4307524 - DNA, 22 bp, Homo sapiens
ctggcttttcactgctggctgc

SEQ ID NO: 4307525 - DNA, 18 bp, Homo sapiens
ctgggaaaagggcaggag

SEQ ID NO: 4307526 - DNA, 21 bp, Homo sapiens
ctgggaaaagggcaggagcct

SEQ ID NO: 4307527 - DNA, 23 bp, Homo sapiens
ctgggaaaagggcaggagcctag

SEQ ID NO: 4307528 - DNA, 23 bp, Homo sapiens
ctgggaaatggcttgaagccaag

SEQ ID NO: 4307529 - DNA, 13 bp, Homo sapiens
ctgggaagggggc

SEQ ID NO: 4307530 - DNA, 19 bp, Homo sapiens
ctgggaccctcggggcagg

SEQ ID NO: 4307531 - DNA, 17 bp, Homo sapiens
ctgggagaaaagccaga

SEQ ID NO: 4307532 - DNA, 17 bp, Homo sapiens
ctgggagagccaaggcc

SEQ ID NO: 4307533 - DNA, 23 bp, Homo sapiens
ctgggagagccaaggcctatgcc

SEQ ID NO: 4307534 - DNA, 12 bp, Homo sapiens
ctgggaggcagg

SEQ ID NO: 4307535 - DNA, 16 bp, Homo sapiens
ctgggcacctggggag

SEQ ID NO: 4307536 - DNA, 18 bp, Homo sapiens
ctgggcagaggggagagg

SEQ ID NO: 4307537 - DNA, 21 bp, Homo sapiens
ctgggcagaggggagaggaag

SEQ ID NO: 4307538 - DNA, 16 bp, Homo sapiens
ctgggcagcccagaga

SEQ ID NO: 4307539 - DNA, 18 bp, Homo sapiens
ctgggcagcccagagaga

SEQ ID NO: 4307540 - DNA, 17 bp, Homo sapiens
ctgggcatccccagccc

SEQ ID NO: 4307541 - DNA, 19 bp, Homo sapiens
ctgggcatccccagccccc

SEQ ID NO: 4307542 - DNA, 18 bp, Homo sapiens
ctgggcatctggccctgc

SEQ ID NO: 4307543 - DNA, 19 bp, Homo sapiens
ctgggcatctggccctgct

SEQ ID NO: 4307544 - DNA, 22 bp, Homo sapiens
ctgggcatctggccctgctgcc

SEQ ID NO: 4307545 - DNA, 19 bp, Homo sapiens
ctgggcatgtccccagtgt

SEQ ID NO: 4307546 - DNA, 20 bp, Homo sapiens
ctgggcatgtccccagtgtg

SEQ ID NO: 4307547 - DNA, 18 bp, Homo sapiens
ctgggccactggcatctc

SEQ ID NO: 4307548 - DNA, 14 bp, Homo sapiens
ctgggccctaggca

SEQ ID NO: 4307549 - DNA, 15 bp, Homo sapiens
ctgggccctaggcat

SEQ ID NO: 4307550 - DNA, 20 bp, Homo sapiens
ctgggccctaggcatactct

SEQ ID NO: 4307551 - DNA, 23 bp, Homo sapiens
ctgggccctaggcatactctcca

SEQ ID NO: 4307552 - DNA, 19 bp, Homo sapiens
ctgggcctgatggtggggc

SEQ ID NO: 4307553 - DNA, 20 bp, Homo sapiens
ctgggcctgatggtggggcc

SEQ ID NO: 4307554 - DNA, 21 bp, Homo sapiens
ctgggcctgatggtggggcca

SEQ ID NO: 4307555 - DNA, 17 bp, Homo sapiens
ctgggccttatgtgggg

SEQ ID NO: 4307556 - DNA, 20 bp, Homo sapiens
ctgggccttatgtggggttg

SEQ ID NO: 4307557 - DNA, 22 bp, Homo sapiens
ctgggctcacaccagccctggt

SEQ ID NO: 4307558 - DNA, 12 bp, Homo sapiens
ctgggctggctg

SEQ ID NO: 4307559 - DNA, 13 bp, Homo sapiens
ctgggctggctgc

SEQ ID NO: 4307560 - DNA, 14 bp, Homo sapiens
ctgggctggctgcc

SEQ ID NO: 4307561 - DNA, 17 bp, Homo sapiens
ctgggctggctgccttc

SEQ ID NO: 4307562 - DNA, 17 bp, Homo sapiens
ctggggagggacacaga

SEQ ID NO: 4307563 - DNA, 12 bp, Homo sapiens
ctggggcccctt

SEQ ID NO: 4307564 - DNA, 13 bp, Homo sapiens
ctggggccgggct

SEQ ID NO: 4307565 - DNA, 13 bp, Homo sapiens
ctggggcttgcta

SEQ ID NO: 4307566 - DNA, 19 bp, Homo sapiens
ctgggggatttcaagggac

SEQ ID NO: 4307567 - DNA, 16 bp, Homo sapiens
ctgggggccatgagct

SEQ ID NO: 4307568 - DNA, 17 bp, Homo sapiens
ctgggggccatgagctc

SEQ ID NO: 4307569 - DNA, 18 bp, Homo sapiens
ctgggggccatgagctcc

SEQ ID NO: 4307570 - DNA, 23 bp, Homo sapiens
ctgggggccatgagctccagacc

SEQ ID NO: 4307571 - DNA, 16 bp, Homo sapiens
ctgggggctgctgcac

SEQ ID NO: 4307572 - DNA, 13 bp, Homo sapiens
ctggggggcacag

SEQ ID NO: 4307573 - DNA, 19 bp, Homo sapiens
ctggggggcacagccagaa

SEQ ID NO: 4307574 - DNA, 20 bp, Homo sapiens
ctggggggcacagccagaaa

SEQ ID NO: 4307575 - DNA, 18 bp, Homo sapiens
ctggggtacttctgtgtt

SEQ ID NO: 4307576 - DNA, 22 bp, Homo sapiens
ctggggtggttggaggcctggt

SEQ ID NO: 4307577 - DNA, 22 bp, Homo sapiens
ctggggtttccacacaggccca

SEQ ID NO: 4307578 - DNA, 12 bp, Homo sapiens
ctgggtcccggg

SEQ ID NO: 4307579 - DNA, 23 bp, Homo sapiens
ctgggtggccggccctgcccccc

SEQ ID NO: 4307580 - DNA, 15 bp, Homo sapiens
ctgggtgtgctccag

SEQ ID NO: 4307581 - DNA, 24 bp, Homo sapiens
ctgggtgtgctccaggcttcctgc

SEQ ID NO: 4307582 - DNA, 19 bp, Homo sapiens
ctgggttctggggctgaga

SEQ ID NO: 4307583 - DNA, 14 bp, Homo sapiens
ctgggtttgggcag

SEQ ID NO: 4307584 - DNA, 18 bp, Homo sapiens
ctgggtttgggcagtgga

SEQ ID NO: 4307585 - DNA, 20 bp, Homo sapiens
ctgggtttgggcagtggaga

SEQ ID NO: 4307586 - DNA, 23 bp, Homo sapiens
ctgggtttgggcagtggagaggg

SEQ ID NO: 4307587 - DNA, 12 bp, Homo sapiens
ctggtattaaat

SEQ ID NO: 4307588 - DNA, 15 bp, Homo sapiens
ctggtattaaatgcc

SEQ ID NO: 4307589 - DNA, 23 bp, Homo sapiens
ctggtcacttcaaacatgccctc

SEQ ID NO: 4307590 - DNA, 18 bp, Homo sapiens
ctggtcagtgaagcccag

SEQ ID NO: 4307591 - DNA, 20 bp, Homo sapiens
ctggtccaggcatgggtccc

SEQ ID NO: 4307592 - DNA, 17 bp, Homo sapiens
ctggtccatgatggagt

SEQ ID NO: 4307593 - DNA, 12 bp, Homo sapiens
ctggtcctgcac

SEQ ID NO: 4307594 - DNA, 15 bp, Homo sapiens
ctggtctctaggcct

SEQ ID NO: 4307595 - DNA, 13 bp, Homo sapiens
ctggtctggagcc

SEQ ID NO: 4307596 - DNA, 17 bp, Homo sapiens
ctggtgcccaccagctg

SEQ ID NO: 4307597 - DNA, 16 bp, Homo sapiens
ctggtgccctggccca

SEQ ID NO: 4307598 - DNA, 18 bp, Homo sapiens
ctggtgccctggcccagc

SEQ ID NO: 4307599 - DNA, 21 bp, Homo sapiens
ctggtgccctggcccagcctg

SEQ ID NO: 4307600 - DNA, 15 bp, Homo sapiens
ctggtgcctgcaggc

SEQ ID NO: 4307601 - DNA, 12 bp, Homo sapiens
ctggtgctgcca

SEQ ID NO: 4307602 - DNA, 13 bp, Homo sapiens
ctggtgctgccac

SEQ ID NO: 4307603 - DNA, 20 bp, Homo sapiens
ctggtgctgccacacttcag

SEQ ID NO: 4307604 - DNA, 16 bp, Homo sapiens
ctggttccttaagtgg

SEQ ID NO: 4307605 - DNA, 17 bp, Homo sapiens
ctggttctccatcccca

SEQ ID NO: 4307606 - DNA, 22 bp, Homo sapiens
ctggttctgtacatgtggaaaa

SEQ ID NO: 4307607 - DNA, 16 bp, Homo sapiens
ctggtttggggcgagg

SEQ ID NO: 4307608 - DNA, 22 bp, Homo sapiens
ctggtttggtggccaggctggt

SEQ ID NO: 4307609 - DNA, 23 bp, Homo sapiens
ctggtttttctgttccctgctgg

SEQ ID NO: 4307610 - DNA, 20 bp, Homo sapiens
ctgtaaaatacatggtatct

SEQ ID NO: 4307611 - DNA, 23 bp, Homo sapiens
ctgtaaaatacatggtatctctt

SEQ ID NO: 4307612 - DNA, 13 bp, Homo sapiens
ctgtaaaatgaac

SEQ ID NO: 4307613 - DNA, 17 bp, Homo sapiens
ctgtaaatctaacatta

SEQ ID NO: 4307614 - DNA, 20 bp, Homo sapiens
ctgtaaatctaacattatta

SEQ ID NO: 4307615 - DNA, 19 bp, Homo sapiens
ctgtaaatttaactgcata

SEQ ID NO: 4307616 - DNA, 21 bp, Homo sapiens
ctgtaaatttaactgcatata

SEQ ID NO: 4307617 - DNA, 16 bp, Homo sapiens
ctgtaagacggccttg

SEQ ID NO: 4307618 - DNA, 19 bp, Homo sapiens
ctgtaatagcctcaccttc

SEQ ID NO: 4307619 - DNA, 20 bp, Homo sapiens
ctgtaatcccagcatgctga

SEQ ID NO: 4307620 - DNA, 15 bp, Homo sapiens
ctgtaattttgtagt

SEQ ID NO: 4307621 - DNA, 19 bp, Homo sapiens
ctgtaattttgtagtagtt

SEQ ID NO: 4307622 - DNA, 17 bp, Homo sapiens
ctgtacaaagggaagca

SEQ ID NO: 4307623 - DNA, 18 bp, Homo sapiens
ctgtacaaagggaagcag

SEQ ID NO: 4307624 - DNA, 13 bp, Homo sapiens
ctgtacactgcac

SEQ ID NO: 4307625 - DNA, 15 bp, Homo sapiens
ctgtacactgcacga

SEQ ID NO: 4307626 - DNA, 23 bp, Homo sapiens
ctgtacctttctgacaataaata

SEQ ID NO: 4307627 - DNA, 15 bp, Homo sapiens
ctgtactcctcccag

SEQ ID NO: 4307628 - DNA, 16 bp, Homo sapiens
ctgtactcctcccagg

SEQ ID NO: 4307629 - DNA, 21 bp, Homo sapiens
ctgtactcctcccaggcgccc

SEQ ID NO: 4307630 - DNA, 21 bp, Homo sapiens
ctgtataatactttgtataca

SEQ ID NO: 4307631 - DNA, 14 bp, Homo sapiens
ctgtatacaaacag

SEQ ID NO: 4307632 - DNA, 16 bp, Homo sapiens
ctgtatacaaacaggt

SEQ ID NO: 4307633 - DNA, 19 bp, Homo sapiens
ctgtatacaaacaggtgct

SEQ ID NO: 4307634 - DNA, 13 bp, Homo sapiens
ctgtatctgtgct

SEQ ID NO: 4307635 - DNA, 16 bp, Homo sapiens
ctgtatgtcattaaag

SEQ ID NO: 4307636 - DNA, 23 bp, Homo sapiens
ctgtattttcttttatatctgta

SEQ ID NO: 4307637 - DNA, 15 bp, Homo sapiens
ctgtatttttagaga

SEQ ID NO: 4307638 - DNA, 22 bp, Homo sapiens
ctgtcactaaatggcagtgaga

SEQ ID NO: 4307639 - DNA, 16 bp, Homo sapiens
ctgtccaatctgcaag

SEQ ID NO: 4307640 - DNA, 17 bp, Homo sapiens
ctgtccacctgtgctgc

SEQ ID NO: 4307641 - DNA, 16 bp, Homo sapiens
ctgtcccacaaaatat

SEQ ID NO: 4307642 - DNA, 22 bp, Homo sapiens
ctgtcccacaaaatatttctaa

SEQ ID NO: 4307643 - DNA, 17 bp, Homo sapiens
ctgtcccctgcaagtgg

SEQ ID NO: 4307644 - DNA, 12 bp, Homo sapiens
ctgtccctgccc

SEQ ID NO: 4307645 - DNA, 23 bp, Homo sapiens
ctgtccctgccccgccccccaga

SEQ ID NO: 4307646 - DNA, 14 bp, Homo sapiens
ctgtccctgtccct

SEQ ID NO: 4307647 - DNA, 22 bp, Homo sapiens
ctgtccgtagtatcagagatgt

SEQ ID NO: 4307648 - DNA, 14 bp, Homo sapiens
ctgtcctgtaactg

SEQ ID NO: 4307649 - DNA, 17 bp, Homo sapiens
ctgtcctgtaactgtta

SEQ ID NO: 4307650 - DNA, 20 bp, Homo sapiens
ctgtcctgttgattaatttc

SEQ ID NO: 4307651 - DNA, 20 bp, Homo sapiens
ctgtccttagactccttctc

SEQ ID NO: 4307652 - DNA, 21 bp, Homo sapiens
ctgtccttagactccttctcc

SEQ ID NO: 4307653 - DNA, 23 bp, Homo sapiens
ctgtctcaagagggcactggtgg

SEQ ID NO: 4307654 - DNA, 15 bp, Homo sapiens
ctgtctccagacccc

SEQ ID NO: 4307655 - DNA, 16 bp, Homo sapiens
ctgtctccagaccccc

SEQ ID NO: 4307656 - DNA, 19 bp, Homo sapiens
ctgtctccagacccccacc

SEQ ID NO: 4307657 - DNA, 13 bp, Homo sapiens
ctgtctctcatga

SEQ ID NO: 4307658 - DNA, 20 bp, Homo sapiens
ctgtctgaaaccagaagact

SEQ ID NO: 4307659 - DNA, 16 bp, Homo sapiens
ctgtctgagccctgcc

SEQ ID NO: 4307660 - DNA, 20 bp, Homo sapiens
ctgtctgagccctgccctca

SEQ ID NO: 4307661 - DNA, 14 bp, Homo sapiens
ctgtctgattctat

SEQ ID NO: 4307662 - DNA, 15 bp, Homo sapiens
ctgtctgattctatg

SEQ ID NO: 4307663 - DNA, 16 bp, Homo sapiens
ctgtctgcgccgctgt

SEQ ID NO: 4307664 - DNA, 20 bp, Homo sapiens
ctgtctgtaagattttattt

SEQ ID NO: 4307665 - DNA, 19 bp, Homo sapiens
ctgtctgtcccagttaact

SEQ ID NO: 4307666 - DNA, 20 bp, Homo sapiens
ctgtctgtcctacccgcccg

SEQ ID NO: 4307667 - DNA, 21 bp, Homo sapiens
ctgtctgtgtgaggctccctc

SEQ ID NO: 4307668 - DNA, 15 bp, Homo sapiens
ctgtcttcaagggct

SEQ ID NO: 4307669 - DNA, 23 bp, Homo sapiens
ctgtctttgctgtttatatatat

SEQ ID NO: 4307670 - DNA, 21 bp, Homo sapiens
ctgtgaaagtctcctgtatca

SEQ ID NO: 4307671 - DNA, 15 bp, Homo sapiens
ctgtgaaatatcatc

SEQ ID NO: 4307672 - DNA, 23 bp, Homo sapiens
ctgtgaaatatcatcacgtatgt

SEQ ID NO: 4307673 - DNA, 15 bp, Homo sapiens
ctgtgaactgccagg

SEQ ID NO: 4307674 - DNA, 23 bp, Homo sapiens
ctgtgaacttgatgttcctggga

SEQ ID NO: 4307675 - DNA, 15 bp, Homo sapiens
ctgtgaacttgggga

SEQ ID NO: 4307676 - DNA, 22 bp, Homo sapiens
ctgtgaacttggggaacaaggg

SEQ ID NO: 4307677 - DNA, 15 bp, Homo sapiens
ctgtgaccggggtcc

SEQ ID NO: 4307678 - DNA, 14 bp, Homo sapiens
ctgtgacctgtggg

SEQ ID NO: 4307679 - DNA, 20 bp, Homo sapiens
ctgtgactcgcttagctgaa

SEQ ID NO: 4307680 - DNA, 22 bp, Homo sapiens
ctgtgagtgacatcggttcagg

SEQ ID NO: 4307681 - DNA, 19 bp, Homo sapiens
ctgtgatcgtgtgttgcca

SEQ ID NO: 4307682 - DNA, 15 bp, Homo sapiens
ctgtgattaattatt

SEQ ID NO: 4307683 - DNA, 11 bp, Homo sapiens
ctgtgcacagc

SEQ ID NO: 4307684 - DNA, 20 bp, Homo sapiens
ctgtgcacccgtgccacgcg

SEQ ID NO: 4307685 - DNA, 23 bp, Homo sapiens
ctgtgcagccggggagctgaggg

SEQ ID NO: 4307686 - DNA, 14 bp, Homo sapiens
ctgtgccagctgct

SEQ ID NO: 4307687 - DNA, 16 bp, Homo sapiens
ctgtgccagctgcttc

SEQ ID NO: 4307688 - DNA, 20 bp, Homo sapiens
ctgtgccagctgcttctgcc

SEQ ID NO: 4307689 - DNA, 21 bp, Homo sapiens
ctgtgccagctgcttctgccc

SEQ ID NO: 4307690 - DNA, 23 bp, Homo sapiens
ctgtgccagctgcttctgcccac

SEQ ID NO: 4307691 - DNA, 18 bp, Homo sapiens
ctgtgcccgctgcgctgc

SEQ ID NO: 4307692 - DNA, 20 bp, Homo sapiens
ctgtgcccgctgcgctgccc

SEQ ID NO: 4307693 - DNA, 17 bp, Homo sapiens
ctgtgctaagttgtctt

SEQ ID NO: 4307694 - DNA, 13 bp, Homo sapiens
ctgtggattctat

SEQ ID NO: 4307695 - DNA, 18 bp, Homo sapiens
ctgtggcccctccttctc

SEQ ID NO: 4307696 - DNA, 21 bp, Homo sapiens
ctgtggcccctccttctcccc

SEQ ID NO: 4307697 - DNA, 19 bp, Homo sapiens
ctgtggcctcagcatctca

SEQ ID NO: 4307698 - DNA, 16 bp, Homo sapiens
ctgtgggactggccca

SEQ ID NO: 4307699 - DNA, 23 bp, Homo sapiens
ctgtgggactggcccacccctct

SEQ ID NO: 4307700 - DNA, 16 bp, Homo sapiens
ctgtgggagaagggac

SEQ ID NO: 4307701 - DNA, 22 bp, Homo sapiens
ctgtgggagaagggacagcggg

SEQ ID NO: 4307702 - DNA, 20 bp, Homo sapiens
ctgtgggagggactttgctg

SEQ ID NO: 4307703 - DNA, 16 bp, Homo sapiens
ctgtgggcagctggct

SEQ ID NO: 4307704 - DNA, 18 bp, Homo sapiens
ctgtgggcagctggctct

SEQ ID NO: 4307705 - DNA, 16 bp, Homo sapiens
ctgtggggagctggtg

SEQ ID NO: 4307706 - DNA, 19 bp, Homo sapiens
ctgtggggatttctcccag

SEQ ID NO: 4307707 - DNA, 14 bp, Homo sapiens
ctgtggggccacac

SEQ ID NO: 4307708 - DNA, 20 bp, Homo sapiens
ctgtggtgaggtcctgtcct

SEQ ID NO: 4307709 - DNA, 23 bp, Homo sapiens
ctgtggtgaggtcctgtcctggc

SEQ ID NO: 4307710 - DNA, 17 bp, Homo sapiens
ctgtgtaatctctgatt

SEQ ID NO: 4307711 - DNA, 18 bp, Homo sapiens
ctgtgtaatctctgatta

SEQ ID NO: 4307712 - DNA, 22 bp, Homo sapiens
ctgtgtagtagctcgtgtgctt

SEQ ID NO: 4307713 - DNA, 14 bp, Homo sapiens
ctgtgtctgctgta

SEQ ID NO: 4307714 - DNA, 17 bp, Homo sapiens
ctgtgttagtgtctgtc

SEQ ID NO: 4307715 - DNA, 20 bp, Homo sapiens
ctgtgttagtgtctgtccat

SEQ ID NO: 4307716 - DNA, 15 bp, Homo sapiens
ctgttaacttattca

SEQ ID NO: 4307717 - DNA, 20 bp, Homo sapiens
ctgttacagtaatgtcataa

SEQ ID NO: 4307718 - DNA, 22 bp, Homo sapiens
ctgttacctcaacaagaagaat

SEQ ID NO: 4307719 - DNA, 13 bp, Homo sapiens
ctgttcactctac

SEQ ID NO: 4307720 - DNA, 13 bp, Homo sapiens
ctgttcatttcca

SEQ ID NO: 4307721 - DNA, 23 bp, Homo sapiens
ctgttcccagcaaagttttcaga

SEQ ID NO: 4307722 - DNA, 12 bp, Homo sapiens
ctgttctcagag

SEQ ID NO: 4307723 - DNA, 14 bp, Homo sapiens
ctgttctcagagct

SEQ ID NO: 4307724 - DNA, 20 bp, Homo sapiens
ctgttctcagagctccacag

SEQ ID NO: 4307725 - DNA, 13 bp, Homo sapiens
ctgttctctgctt

SEQ ID NO: 4307726 - DNA, 15 bp, Homo sapiens
ctgttgttcagaagt

SEQ ID NO: 4307727 - DNA, 23 bp, Homo sapiens
ctgttgttgaggtggtggtagtg

SEQ ID NO: 4307728 - DNA, 9 bp, Homo sapiens
ctgttgttt

SEQ ID NO: 4307729 - DNA, 14 bp, Homo sapiens
ctgtttaccctccc

SEQ ID NO: 4307730 - DNA, 15 bp, Homo sapiens
ctgtttaccctccct

SEQ ID NO: 4307731 - DNA, 19 bp, Homo sapiens
ctgtttaccctccctgtcc

SEQ ID NO: 4307732 - DNA, 18 bp, Homo sapiens
ctgtttatggtattttcg

SEQ ID NO: 4307733 - DNA, 18 bp, Homo sapiens
ctgtttgctcacccagga

SEQ ID NO: 4307734 - DNA, 13 bp, Homo sapiens
ctgtttgcttcta

SEQ ID NO: 4307735 - DNA, 13 bp, Homo sapiens
ctgttttatgtca

SEQ ID NO: 4307736 - DNA, 22 bp, Homo sapiens
ctgtttttgaagaagggaaatt

SEQ ID NO: 4307737 - DNA, 17 bp, Homo sapiens
ctgttttttcctgagct

SEQ ID NO: 4307738 - DNA, 15 bp, Homo sapiens
cttaaaaatttatta

SEQ ID NO: 4307739 - DNA, 22 bp, Homo sapiens
cttaaaagctatcttcatgtaa

SEQ ID NO: 4307740 - DNA, 13 bp, Homo sapiens
cttaaagcttgtt

SEQ ID NO: 4307741 - DNA, 14 bp, Homo sapiens
cttaacctgctttt

SEQ ID NO: 4307742 - DNA, 15 bp, Homo sapiens
cttaagaaagctata

SEQ ID NO: 4307743 - DNA, 15 bp, Homo sapiens
cttaagacagcatgt

SEQ ID NO: 4307744 - DNA, 18 bp, Homo sapiens
cttaagacagcatgtgtt

SEQ ID NO: 4307745 - DNA, 19 bp, Homo sapiens
cttaagacagcatgtgtta

SEQ ID NO: 4307746 - DNA, 14 bp, Homo sapiens
cttaaggggggatg

SEQ ID NO: 4307747 - DNA, 15 bp, Homo sapiens
cttaagtcttactgt

SEQ ID NO: 4307748 - DNA, 19 bp, Homo sapiens
cttaatatttcttcaaata

SEQ ID NO: 4307749 - DNA, 21 bp, Homo sapiens
cttaatgccacggcagccacc

SEQ ID NO: 4307750 - DNA, 18 bp, Homo sapiens
cttacaaccacatttctg

SEQ ID NO: 4307751 - DNA, 15 bp, Homo sapiens
cttacagtaggagtg

SEQ ID NO: 4307752 - DNA, 22 bp, Homo sapiens
cttacccacactacgcagaaga

SEQ ID NO: 4307753 - DNA, 19 bp, Homo sapiens
cttaccccgtccctttccc

SEQ ID NO: 4307754 - DNA, 20 bp, Homo sapiens
cttaccgtgggcactgaagg

SEQ ID NO: 4307755 - DNA, 12 bp, Homo sapiens
cttacgctctct

SEQ ID NO: 4307756 - DNA, 22 bp, Homo sapiens
cttactaaacattttgttattg

SEQ ID NO: 4307757 - DNA, 17 bp, Homo sapiens
cttagaagaatattgta

SEQ ID NO: 4307758 - DNA, 19 bp, Homo sapiens
cttagactccttctcccca

SEQ ID NO: 4307759 - DNA, 21 bp, Homo sapiens
cttagactccttctccccaat

SEQ ID NO: 4307760 - DNA, 21 bp, Homo sapiens
cttagcattttctgcatctcc

SEQ ID NO: 4307761 - DNA, 18 bp, Homo sapiens
cttagctgccccttctga

SEQ ID NO: 4307762 - DNA, 15 bp, Homo sapiens
cttagcttttctgca

SEQ ID NO: 4307763 - DNA, 17 bp, Homo sapiens
cttagtgtcccttacct

SEQ ID NO: 4307764 - DNA, 17 bp, Homo sapiens
cttatcagtttgctaat

SEQ ID NO: 4307765 - DNA, 22 bp, Homo sapiens
cttatctagcaagaagattcta

SEQ ID NO: 4307766 - DNA, 23 bp, Homo sapiens
cttatgtcatttcttctctctgt

SEQ ID NO: 4307767 - DNA, 21 bp, Homo sapiens
cttatgttgatcgatgttaaa

SEQ ID NO: 4307768 - DNA, 15 bp, Homo sapiens
cttattaaccaaatt

SEQ ID NO: 4307769 - DNA, 19 bp, Homo sapiens
cttattcttgtgcacttta

SEQ ID NO: 4307770 - DNA, 19 bp, Homo sapiens
cttattgatattctaagaa

SEQ ID NO: 4307771 - DNA, 18 bp, Homo sapiens
cttatttaaattttcaga

SEQ ID NO: 4307772 - DNA, 14 bp, Homo sapiens
cttatttatatatg

SEQ ID NO: 4307773 - DNA, 19 bp, Homo sapiens
cttatttatatatgaagta

SEQ ID NO: 4307774 - DNA, 22 bp, Homo sapiens
cttatttatattcagagatgta

SEQ ID NO: 4307775 - DNA, 18 bp, Homo sapiens
cttatttgtatttttcct

SEQ ID NO: 4307776 - DNA, 14 bp, Homo sapiens
cttcaaaatattga

SEQ ID NO: 4307777 - DNA, 22 bp, Homo sapiens
cttcaaaatattgagcagaatt

SEQ ID NO: 4307778 - DNA, 14 bp, Homo sapiens
cttcaaaatcagtg

SEQ ID NO: 4307779 - DNA, 19 bp, Homo sapiens
cttcaaaatcagtgatggg

SEQ ID NO: 4307780 - DNA, 15 bp, Homo sapiens
cttcaaacatgccct

SEQ ID NO: 4307781 - DNA, 16 bp, Homo sapiens
cttcaaacatgccctc

SEQ ID NO: 4307782 - DNA, 13 bp, Homo sapiens
cttcaaagtctca

SEQ ID NO: 4307783 - DNA, 16 bp, Homo sapiens
cttcaaagtctcaatg

SEQ ID NO: 4307784 - DNA, 22 bp, Homo sapiens
cttcaaagtctcaatgaaatag

SEQ ID NO: 4307785 - DNA, 20 bp, Homo sapiens
cttcaaccattccccatggg

SEQ ID NO: 4307786 - DNA, 18 bp, Homo sapiens
cttcaagatcccatttga

SEQ ID NO: 4307787 - DNA, 12 bp, Homo sapiens
cttcaagcctgg

SEQ ID NO: 4307788 - DNA, 14 bp, Homo sapiens
cttcaagcctggcc

SEQ ID NO: 4307789 - DNA, 16 bp, Homo sapiens
cttcaagcctggccca

SEQ ID NO: 4307790 - DNA, 16 bp, Homo sapiens
cttcaatctacgatgt

SEQ ID NO: 4307791 - DNA, 12 bp, Homo sapiens
cttcaccaggaa

SEQ ID NO: 4307792 - DNA, 21 bp, Homo sapiens
cttcacccagcacccatgccc

SEQ ID NO: 4307793 - DNA, 17 bp, Homo sapiens
cttcactcgcccccggg

SEQ ID NO: 4307794 - DNA, 20 bp, Homo sapiens
cttcacttaaaatcaaattt

SEQ ID NO: 4307795 - DNA, 12 bp, Homo sapiens
cttcagcccctg

SEQ ID NO: 4307796 - DNA, 15 bp, Homo sapiens
cttcaggctcttctc

SEQ ID NO: 4307797 - DNA, 17 bp, Homo sapiens
cttcaggctcttctcct

SEQ ID NO: 4307798 - DNA, 18 bp, Homo sapiens
cttcaggctcttctcctt

SEQ ID NO: 4307799 - DNA, 16 bp, Homo sapiens
cttcagtcattaaatt

SEQ ID NO: 4307800 - DNA, 16 bp, Homo sapiens
cttcataggcagagcc

SEQ ID NO: 4307801 - DNA, 16 bp, Homo sapiens
cttcatgctgtctgtg

SEQ ID NO: 4307802 - DNA, 19 bp, Homo sapiens
cttcatgctgtctgtgtga

SEQ ID NO: 4307803 - DNA, 24 bp, Homo sapiens
cttcatttgggatgctactctagt

SEQ ID NO: 4307804 - DNA, 19 bp, Homo sapiens
cttcattttttttaattga

SEQ ID NO: 4307805 - DNA, 16 bp, Homo sapiens
cttccacgctgtctcc

SEQ ID NO: 4307806 - DNA, 18 bp, Homo sapiens
cttccacgctgtctccag

SEQ ID NO: 4307807 - DNA, 17 bp, Homo sapiens
cttccaggccccaggct

SEQ ID NO: 4307808 - DNA, 18 bp, Homo sapiens
cttccaggcgtagggcca

SEQ ID NO: 4307809 - DNA, 22 bp, Homo sapiens
cttccaggcgtagggccagggc

SEQ ID NO: 4307810 - DNA, 20 bp, Homo sapiens
cttccatggtggtttcagaa

SEQ ID NO: 4307811 - DNA, 20 bp, Homo sapiens
cttccattcccagacagcag

SEQ ID NO: 4307812 - DNA, 21 bp, Homo sapiens
cttcccaaagcaagcacctgg

SEQ ID NO: 4307813 - DNA, 18 bp, Homo sapiens
cttcccacggccactgca

SEQ ID NO: 4307814 - DNA, 20 bp, Homo sapiens
cttcccacggccactgcagt

SEQ ID NO: 4307815 - DNA, 17 bp, Homo sapiens
cttcccatgtctttctc

SEQ ID NO: 4307816 - DNA, 21 bp, Homo sapiens
cttcccatgtctttctccaaa

SEQ ID NO: 4307817 - DNA, 10 bp, Homo sapiens
cttccccact

SEQ ID NO: 4307818 - DNA, 16 bp, Homo sapiens
cttccccactgcctgc

SEQ ID NO: 4307819 - DNA, 20 bp, Homo sapiens
cttccccactgcctgcccac

SEQ ID NO: 4307820 - DNA, 12 bp, Homo sapiens
cttccccctcca

SEQ ID NO: 4307821 - DNA, 14 bp, Homo sapiens
cttcccccttcccc

SEQ ID NO: 4307822 - DNA, 15 bp, Homo sapiens
cttcccccttcccct

SEQ ID NO: 4307823 - DNA, 20 bp, Homo sapiens
cttcccctgcgccctccctc

SEQ ID NO: 4307824 - DNA, 21 bp, Homo sapiens
cttcccctgcgccctccctcc

SEQ ID NO: 4307825 - DNA, 22 bp, Homo sapiens
cttccccttgggatgggcacag

SEQ ID NO: 4307826 - DNA, 14 bp, Homo sapiens
cttccctagttctt

SEQ ID NO: 4307827 - DNA, 11 bp, Homo sapiens
cttccctctgc

SEQ ID NO: 4307828 - DNA, 13 bp, Homo sapiens
cttccctctgcct

SEQ ID NO: 4307829 - DNA, 18 bp, Homo sapiens
cttccctctgcctgtccc

SEQ ID NO: 4307830 - DNA, 23 bp, Homo sapiens
cttccctgacactgtctgctgcc

SEQ ID NO: 4307831 - DNA, 16 bp, Homo sapiens
cttccggctgagctgt

SEQ ID NO: 4307832 - DNA, 21 bp, Homo sapiens
cttcctccctccctgcagggt

SEQ ID NO: 4307833 - DNA, 17 bp, Homo sapiens
cttcctgggcagcccag

SEQ ID NO: 4307834 - DNA, 18 bp, Homo sapiens
cttcctgggcagcccaga

SEQ ID NO: 4307835 - DNA, 21 bp, Homo sapiens
cttcctgggcagcccagagag

SEQ ID NO: 4307836 - DNA, 15 bp, Homo sapiens
cttcctgtccagaga

SEQ ID NO: 4307837 - DNA, 16 bp, Homo sapiens
cttcctgtccagagag

SEQ ID NO: 4307838 - DNA, 16 bp, Homo sapiens
cttcctgttctgtgtc

SEQ ID NO: 4307839 - DNA, 16 bp, Homo sapiens
cttccttaccgtgggc

SEQ ID NO: 4307840 - DNA, 17 bp, Homo sapiens
cttccttccgctctgag

SEQ ID NO: 4307841 - DNA, 20 bp, Homo sapiens
cttcgccatgtgctgtgcac

SEQ ID NO: 4307842 - DNA, 18 bp, Homo sapiens
cttcgctattcccaggca

SEQ ID NO: 4307843 - DNA, 16 bp, Homo sapiens
cttcgtggatgacctc

SEQ ID NO: 4307844 - DNA, 21 bp, Homo sapiens
cttctaatccatgtgctgctg

SEQ ID NO: 4307845 - DNA, 18 bp, Homo sapiens
cttctacctgcaggactc

SEQ ID NO: 4307846 - DNA, 22 bp, Homo sapiens
cttctacctgcaggactcgggc

SEQ ID NO: 4307847 - DNA, 14 bp, Homo sapiens
cttctccactggat

SEQ ID NO: 4307848 - DNA, 13 bp, Homo sapiens
cttctctgttcat

SEQ ID NO: 4307849 - DNA, 23 bp, Homo sapiens
cttctgaccacacttcctgtcca

SEQ ID NO: 4307850 - DNA, 14 bp, Homo sapiens
cttctgaccccact

SEQ ID NO: 4307851 - DNA, 22 bp, Homo sapiens
cttctgcccaccccgcctctgg

SEQ ID NO: 4307852 - DNA, 23 bp, Homo sapiens
cttctgcccaccccgcctctggg

SEQ ID NO: 4307853 - DNA, 19 bp, Homo sapiens
cttctgcggagcttctcca

SEQ ID NO: 4307854 - DNA, 23 bp, Homo sapiens
cttctggctgctgcagtcagcac

SEQ ID NO: 4307855 - DNA, 16 bp, Homo sapiens
cttctggggagggaca

SEQ ID NO: 4307856 - DNA, 18 bp, Homo sapiens
cttctggggagggacaca

SEQ ID NO: 4307857 - DNA, 15 bp, Homo sapiens
cttctggggaggggc

SEQ ID NO: 4307858 - DNA, 14 bp, Homo sapiens
cttctgtaatattt

SEQ ID NO: 4307859 - DNA, 14 bp, Homo sapiens
cttctgtctcttgc

SEQ ID NO: 4307860 - DNA, 15 bp, Homo sapiens
cttctgtggctcaca

SEQ ID NO: 4307861 - DNA, 21 bp, Homo sapiens
cttcttacaataattctatga

SEQ ID NO: 4307862 - DNA, 19 bp, Homo sapiens
cttctttactaacactggc

SEQ ID NO: 4307863 - DNA, 21 bp, Homo sapiens
cttctttggtgttctggcctc

SEQ ID NO: 4307864 - DNA, 17 bp, Homo sapiens
cttgaaaccagctcagg

SEQ ID NO: 4307865 - DNA, 17 bp, Homo sapiens
cttgaaattatatctgt

SEQ ID NO: 4307866 - DNA, 15 bp, Homo sapiens
cttgaagaatattgt

SEQ ID NO: 4307867 - DNA, 13 bp, Homo sapiens
cttgaatagtatt

SEQ ID NO: 4307868 - DNA, 10 bp, Homo sapiens
cttgaatgtc

SEQ ID NO: 4307869 - DNA, 19 bp, Homo sapiens
cttgaatgtccccattcta

SEQ ID NO: 4307870 - DNA, 19 bp, Homo sapiens
cttgagagcgctggcctct

SEQ ID NO: 4307871 - DNA, 10 bp, Homo sapiens
cttgagccca

SEQ ID NO: 4307872 - DNA, 14 bp, Homo sapiens
cttgagcccactcc

SEQ ID NO: 4307873 - DNA, 13 bp, Homo sapiens
cttgagctgagat

SEQ ID NO: 4307874 - DNA, 15 bp, Homo sapiens
cttgaggacctccac

SEQ ID NO: 4307875 - DNA, 22 bp, Homo sapiens
cttgaggacctccacctgggag

SEQ ID NO: 4307876 - DNA, 24 bp, Homo sapiens
cttgaggacctccacctgggagat

SEQ ID NO: 4307877 - DNA, 19 bp, Homo sapiens
cttgagtgggccccctctc

SEQ ID NO: 4307878 - DNA, 20 bp, Homo sapiens
cttgagtgggccccctctct

SEQ ID NO: 4307879 - DNA, 18 bp, Homo sapiens
cttgcactggccttctga

SEQ ID NO: 4307880 - DNA, 15 bp, Homo sapiens
cttgcagtcatcaga

SEQ ID NO: 4307881 - DNA, 21 bp, Homo sapiens
cttgcataagcctcaggcctg

SEQ ID NO: 4307882 - DNA, 14 bp, Homo sapiens
cttgccccccaccc

SEQ ID NO: 4307883 - DNA, 13 bp, Homo sapiens
cttgccgctggga

SEQ ID NO: 4307884 - DNA, 14 bp, Homo sapiens
cttgcctagggcct

SEQ ID NO: 4307885 - DNA, 19 bp, Homo sapiens
cttgcctagggcctggtcc

SEQ ID NO: 4307886 - DNA, 23 bp, Homo sapiens
cttgctagtgatacactgtatct

SEQ ID NO: 4307887 - DNA, 16 bp, Homo sapiens
cttgctttcacaaata

SEQ ID NO: 4307888 - DNA, 13 bp, Homo sapiens
cttgctttttcaa

SEQ ID NO: 4307889 - DNA, 18 bp, Homo sapiens
cttggaacatttgggaga

SEQ ID NO: 4307890 - DNA, 11 bp, Homo sapiens
cttggagagga

SEQ ID NO: 4307891 - DNA, 22 bp, Homo sapiens
cttggagccaatggagactgtc

SEQ ID NO: 4307892 - DNA, 14 bp, Homo sapiens
cttggatctttttg

SEQ ID NO: 4307893 - DNA, 22 bp, Homo sapiens
cttggcaggaaccatggacctg

SEQ ID NO: 4307894 - DNA, 17 bp, Homo sapiens
cttggccagaagggggc

SEQ ID NO: 4307895 - DNA, 12 bp, Homo sapiens
cttggcccagca

SEQ ID NO: 4307896 - DNA, 13 bp, Homo sapiens
cttggcccagcag

SEQ ID NO: 4307897 - DNA, 14 bp, Homo sapiens
cttggcccctctct

SEQ ID NO: 4307898 - DNA, 12 bp, Homo sapiens
cttggcctcttc

SEQ ID NO: 4307899 - DNA, 13 bp, Homo sapiens
cttggcctgtcca

SEQ ID NO: 4307900 - DNA, 23 bp, Homo sapiens
cttgggacggaagtggcctgaga

SEQ ID NO: 4307901 - DNA, 12 bp, Homo sapiens
cttgggccctcc

SEQ ID NO: 4307902 - DNA, 13 bp, Homo sapiens
cttgggccctcct

SEQ ID NO: 4307903 - DNA, 14 bp, Homo sapiens
cttgggccctcctg

SEQ ID NO: 4307904 - DNA, 14 bp, Homo sapiens
cttgggctgagact

SEQ ID NO: 4307905 - DNA, 15 bp, Homo sapiens
cttggggatgccctt

SEQ ID NO: 4307906 - DNA, 21 bp, Homo sapiens
cttggggattcttccatctga

SEQ ID NO: 4307907 - DNA, 18 bp, Homo sapiens
cttggtgcttattgatat

SEQ ID NO: 4307908 - DNA, 15 bp, Homo sapiens
cttggttttgtattg

SEQ ID NO: 4307909 - DNA, 23 bp, Homo sapiens
cttgtattttcttcccatttgta

SEQ ID NO: 4307910 - DNA, 17 bp, Homo sapiens
cttgtcacaaagtgaga

SEQ ID NO: 4307911 - DNA, 22 bp, Homo sapiens
cttgtcacaaagtgagaaatta

SEQ ID NO: 4307912 - DNA, 15 bp, Homo sapiens
cttgtcctgctcaga

SEQ ID NO: 4307913 - DNA, 16 bp, Homo sapiens
cttgtgaaacacagct

SEQ ID NO: 4307914 - DNA, 21 bp, Homo sapiens
cttgtgcactttatcttggga

SEQ ID NO: 4307915 - DNA, 16 bp, Homo sapiens
cttgtttctatactgt

SEQ ID NO: 4307916 - DNA, 18 bp, Homo sapiens
cttgtttctatactgttt

SEQ ID NO: 4307917 - DNA, 21 bp, Homo sapiens
cttgttttttttttccactta

SEQ ID NO: 4307918 - DNA, 19 bp, Homo sapiens
ctttaccatagcttaagaa

SEQ ID NO: 4307919 - DNA, 14 bp, Homo sapiens
ctttaccatgctca

SEQ ID NO: 4307920 - DNA, 16 bp, Homo sapiens
ctttacctctctgtca

SEQ ID NO: 4307921 - DNA, 14 bp, Homo sapiens
ctttactggaaatg

SEQ ID NO: 4307922 - DNA, 22 bp, Homo sapiens
ctttagaatagttaaattggct

SEQ ID NO: 4307923 - DNA, 15 bp, Homo sapiens
ctttaggcaggaagt

SEQ ID NO: 4307924 - DNA, 22 bp, Homo sapiens
ctttaggcaggaagtcaggagc

SEQ ID NO: 4307925 - DNA, 23 bp, Homo sapiens
ctttaggcattaaattttagcaa

SEQ ID NO: 4307926 - DNA, 17 bp, Homo sapiens
ctttataaatgcaaatg

SEQ ID NO: 4307927 - DNA, 22 bp, Homo sapiens
ctttataagccaatgaagcaaa

SEQ ID NO: 4307928 - DNA, 19 bp, Homo sapiens
ctttatcatgtgtttctgt

SEQ ID NO: 4307929 - DNA, 23 bp, Homo sapiens
ctttatgactgtttttgtagtgg

SEQ ID NO: 4307930 - DNA, 18 bp, Homo sapiens
ctttattgtctgtaaatc

SEQ ID NO: 4307931 - DNA, 12 bp, Homo sapiens
ctttcacccctc

SEQ ID NO: 4307932 - DNA, 15 bp, Homo sapiens
ctttcactataatgt

SEQ ID NO: 4307933 - DNA, 21 bp, Homo sapiens
ctttcactatgtccatgaaaa

SEQ ID NO: 4307934 - DNA, 16 bp, Homo sapiens
ctttcactgaagtgaa

SEQ ID NO: 4307935 - DNA, 13 bp, Homo sapiens
ctttcagggcctc

SEQ ID NO: 4307936 - DNA, 21 bp, Homo sapiens
ctttcagtttgtccacacaag

SEQ ID NO: 4307937 - DNA, 16 bp, Homo sapiens
ctttcattccctttca

SEQ ID NO: 4307938 - DNA, 14 bp, Homo sapiens
ctttccaccccctc

SEQ ID NO: 4307939 - DNA, 17 bp, Homo sapiens
ctttccaccccctccct

SEQ ID NO: 4307940 - DNA, 21 bp, Homo sapiens
ctttccaccccctccctggcc

SEQ ID NO: 4307941 - DNA, 22 bp, Homo sapiens
ctttccaccccctccctggcct

SEQ ID NO: 4307942 - DNA, 19 bp, Homo sapiens
ctttccagaactaccaaaa

SEQ ID NO: 4307943 - DNA, 15 bp, Homo sapiens
ctttccagtgctgct

SEQ ID NO: 4307944 - DNA, 16 bp, Homo sapiens
ctttccagtgctgctc

SEQ ID NO: 4307945 - DNA, 16 bp, Homo sapiens
ctttccctgcatccct

SEQ ID NO: 4307946 - DNA, 20 bp, Homo sapiens
ctttcctgatgttgataata

SEQ ID NO: 4307947 - DNA, 20 bp, Homo sapiens
ctttcctttcatcctcagca

SEQ ID NO: 4307948 - DNA, 21 bp, Homo sapiens
ctttctagtcctattctattg

SEQ ID NO: 4307949 - DNA, 19 bp, Homo sapiens
ctttgaatcctctctctgt

SEQ ID NO: 4307950 - DNA, 22 bp, Homo sapiens
ctttgacacttttcatatcatt

SEQ ID NO: 4307951 - DNA, 19 bp, Homo sapiens
ctttgagttaagtctatct

SEQ ID NO: 4307952 - DNA, 15 bp, Homo sapiens
ctttgcagacctggg

SEQ ID NO: 4307953 - DNA, 18 bp, Homo sapiens
ctttgcagacctgggact

SEQ ID NO: 4307954 - DNA, 20 bp, Homo sapiens
ctttgcagacctgggacttt

SEQ ID NO: 4307955 - DNA, 22 bp, Homo sapiens
ctttgccttccacgctgtctcc

SEQ ID NO: 4307956 - DNA, 18 bp, Homo sapiens
ctttgctcccagtttctt

SEQ ID NO: 4307957 - DNA, 15 bp, Homo sapiens
ctttgctgccttctg

SEQ ID NO: 4307958 - DNA, 19 bp, Homo sapiens
ctttgctgccttctgtctc

SEQ ID NO: 4307959 - DNA, 24 bp, Homo sapiens
ctttgctgccttctgtctcttgca

SEQ ID NO: 4307960 - DNA, 16 bp, Homo sapiens
ctttgctggagtcctg

SEQ ID NO: 4307961 - DNA, 18 bp, Homo sapiens
ctttgctggagtcctgtt

SEQ ID NO: 4307962 - DNA, 20 bp, Homo sapiens
ctttgctggagtcctgttct

SEQ ID NO: 4307963 - DNA, 22 bp, Homo sapiens
ctttgctggagtcctgttctca

SEQ ID NO: 4307964 - DNA, 18 bp, Homo sapiens
ctttgcttgtcctgctca

SEQ ID NO: 4307965 - DNA, 21 bp, Homo sapiens
ctttggaaagacctgtgaggg

SEQ ID NO: 4307966 - DNA, 20 bp, Homo sapiens
ctttggcacaccctctctgt

SEQ ID NO: 4307967 - DNA, 19 bp, Homo sapiens
ctttggtaatgtgtcaaag

SEQ ID NO: 4307968 - DNA, 18 bp, Homo sapiens
ctttggtgttctggcctc

SEQ ID NO: 4307969 - DNA, 19 bp, Homo sapiens
ctttggtgttctggcctct

SEQ ID NO: 4307970 - DNA, 21 bp, Homo sapiens
ctttggtgttctggcctctgg

SEQ ID NO: 4307971 - DNA, 18 bp, Homo sapiens
ctttgtaaccacaacttt

SEQ ID NO: 4307972 - DNA, 14 bp, Homo sapiens
ctttgtaaggactt

SEQ ID NO: 4307973 - DNA, 13 bp, Homo sapiens
ctttgtgcaatat

SEQ ID NO: 4307974 - DNA, 11 bp, Homo sapiens
ctttgtgctta

SEQ ID NO: 4307975 - DNA, 14 bp, Homo sapiens
ctttgtgcttgttc

SEQ ID NO: 4307976 - DNA, 13 bp, Homo sapiens
ctttgtgtgctgt

SEQ ID NO: 4307977 - DNA, 17 bp, Homo sapiens
cttttaaaccattttct

SEQ ID NO: 4307978 - DNA, 18 bp, Homo sapiens
cttttagcggtttgcaaa

SEQ ID NO: 4307979 - DNA, 16 bp, Homo sapiens
cttttaggtcatccaa

SEQ ID NO: 4307980 - DNA, 15 bp, Homo sapiens
cttttagttcctgtg

SEQ ID NO: 4307981 - DNA, 22 bp, Homo sapiens
cttttagttcctgtgcacagcc

SEQ ID NO: 4307982 - DNA, 22 bp, Homo sapiens
cttttattaacatatattgtta

SEQ ID NO: 4307983 - DNA, 18 bp, Homo sapiens
cttttcactgctggctgc

SEQ ID NO: 4307984 - DNA, 17 bp, Homo sapiens
cttttcagcttgtttct

SEQ ID NO: 4307985 - DNA, 16 bp, Homo sapiens
cttttccatctaaaat

SEQ ID NO: 4307986 - DNA, 13 bp, Homo sapiens
cttttctgaggtt

SEQ ID NO: 4307987 - DNA, 11 bp, Homo sapiens
cttttcttgta

SEQ ID NO: 4307988 - DNA, 16 bp, Homo sapiens
cttttcttgtatctgg

SEQ ID NO: 4307989 - DNA, 15 bp, Homo sapiens
cttttggatttagag

SEQ ID NO: 4307990 - DNA, 14 bp, Homo sapiens
cttttgtatcctcc

SEQ ID NO: 4307991 - DNA, 17 bp, Homo sapiens
cttttgtcatgtggcta

SEQ ID NO: 4307992 - DNA, 15 bp, Homo sapiens
cttttgtgtattctg

SEQ ID NO: 4307993 - DNA, 16 bp, Homo sapiens
cttttgtgtattctgt

SEQ ID NO: 4307994 - DNA, 17 bp, Homo sapiens
cttttgttaagttcacc

SEQ ID NO: 4307995 - DNA, 21 bp, Homo sapiens
ctttttagtgttttgcaaggg

SEQ ID NO: 4307996 - DNA, 22 bp, Homo sapiens
ctttttccatatagtttgtttt

SEQ ID NO: 4307997 - DNA, 22 bp, Homo sapiens
ctttttttgagcgacatctctg

SEQ ID NO: 4307998 - DNA, 13 bp, Homo sapiens
gaaaaaaaaagaa

SEQ ID NO: 4307999 - DNA, 18 bp, Homo sapiens
gaaaaaccaatgattcat

SEQ ID NO: 4308000 - DNA, 15 bp, Homo sapiens
gaaaaaggctggtgg

SEQ ID NO: 4308001 - DNA, 21 bp, Homo sapiens
gaaaaccaagccgtggcttcc

SEQ ID NO: 4308002 - DNA, 19 bp, Homo sapiens
gaaaacctcatttaccata

SEQ ID NO: 4308003 - DNA, 18 bp, Homo sapiens
gaaaacgatttaatttat

SEQ ID NO: 4308004 - DNA, 17 bp, Homo sapiens
gaaaactggaataagaa

SEQ ID NO: 4308005 - DNA, 23 bp, Homo sapiens
gaaaactgtttatggtattttcg

SEQ ID NO: 4308006 - DNA, 15 bp, Homo sapiens
gaaaagaaatgctaa

SEQ ID NO: 4308007 - DNA, 14 bp, Homo sapiens
gaaaagaatttttt

SEQ ID NO: 4308008 - DNA, 13 bp, Homo sapiens
gaaaagggcagga

SEQ ID NO: 4308009 - DNA, 21 bp, Homo sapiens
gaaaagggcaggagcctagag

SEQ ID NO: 4308010 - DNA, 12 bp, Homo sapiens
gaaaattcaaca

SEQ ID NO: 4308011 - DNA, 12 bp, Homo sapiens
gaaacacagctg

SEQ ID NO: 4308012 - DNA, 14 bp, Homo sapiens
gaaacacagctgtt

SEQ ID NO: 4308013 - DNA, 15 bp, Homo sapiens
gaaacacagctgttc

SEQ ID NO: 4308014 - DNA, 23 bp, Homo sapiens
gaaacacagctgttcttctgttc

SEQ ID NO: 4308015 - DNA, 20 bp, Homo sapiens
gaaaccttttcttgtatctg

SEQ ID NO: 4308016 - DNA, 17 bp, Homo sapiens
gaaacgagatttgccaa

SEQ ID NO: 4308017 - DNA, 24 bp, Homo sapiens
gaaactatgcacctataaatacta

SEQ ID NO: 4308018 - DNA, 19 bp, Homo sapiens
gaaactcacctgctggccc

SEQ ID NO: 4308019 - DNA, 21 bp, Homo sapiens
gaaactcacctgctggcccct

SEQ ID NO: 4308020 - DNA, 15 bp, Homo sapiens
gaaacttacacacaa

SEQ ID NO: 4308021 - DNA, 19 bp, Homo sapiens
gaaagacctgtgaggggaa

SEQ ID NO: 4308022 - DNA, 20 bp, Homo sapiens
gaaagagtaaaaccaaaggt

SEQ ID NO: 4308023 - DNA, 20 bp, Homo sapiens
gaaagatggtaatcttttct

SEQ ID NO: 4308024 - DNA, 20 bp, Homo sapiens
gaaagattttatgtgcttga

SEQ ID NO: 4308025 - DNA, 20 bp, Homo sapiens
gaaagccagtgactccagga

SEQ ID NO: 4308026 - DNA, 18 bp, Homo sapiens
gaaagcctcactgatata

SEQ ID NO: 4308027 - DNA, 16 bp, Homo sapiens
gaaagctatatatgaa

SEQ ID NO: 4308028 - DNA, 17 bp, Homo sapiens
gaaagggcagcccctcc

SEQ ID NO: 4308029 - DNA, 23 bp, Homo sapiens
gaaagtatcaccaaaaaatctat

SEQ ID NO: 4308030 - DNA, 14 bp, Homo sapiens
gaaagtctatgctt

SEQ ID NO: 4308031 - DNA, 15 bp, Homo sapiens
gaaagtgagcagtgt

SEQ ID NO: 4308032 - DNA, 22 bp, Homo sapiens
gaaagtgagcagtgttagctta

SEQ ID NO: 4308033 - DNA, 16 bp, Homo sapiens
gaaagtgtaaaataga

SEQ ID NO: 4308034 - DNA, 17 bp, Homo sapiens
gaaagtgtaaaatagaa

SEQ ID NO: 4308035 - DNA, 21 bp, Homo sapiens
gaaataaattggtgataagtg

SEQ ID NO: 4308036 - DNA, 22 bp, Homo sapiens
gaaataaattggtgataagtgg

SEQ ID NO: 4308037 - DNA, 15 bp, Homo sapiens
gaaataagactttta

SEQ ID NO: 4308038 - DNA, 13 bp, Homo sapiens
gaaatatatgtga

SEQ ID NO: 4308039 - DNA, 14 bp, Homo sapiens
gaaatatatgtgaa

SEQ ID NO: 4308040 - DNA, 18 bp, Homo sapiens
gaaatatttgcttattta

SEQ ID NO: 4308041 - DNA, 20 bp, Homo sapiens
gaaatctaagtttcgagaga

SEQ ID NO: 4308042 - DNA, 14 bp, Homo sapiens
gaaatgctgttggt

SEQ ID NO: 4308043 - DNA, 18 bp, Homo sapiens
gaaatggcttgaagccaa

SEQ ID NO: 4308044 - DNA, 13 bp, Homo sapiens
gaaatgtttccag

SEQ ID NO: 4308045 - DNA, 13 bp, Homo sapiens
gaaattcacactg

SEQ ID NO: 4308046 - DNA, 18 bp, Homo sapiens
gaaattcttgttatggta

SEQ ID NO: 4308047 - DNA, 14 bp, Homo sapiens
gaaatttgttaata

SEQ ID NO: 4308048 - DNA, 16 bp, Homo sapiens
gaaatttttttccaga

SEQ ID NO: 4308049 - DNA, 20 bp, Homo sapiens
gaaatttttttccagaattg

SEQ ID NO: 4308050 - DNA, 15 bp, Homo sapiens
gaacaagatttccct

SEQ ID NO: 4308051 - DNA, 21 bp, Homo sapiens
gaacacaagccacgcctgcga

SEQ ID NO: 4308052 - DNA, 13 bp, Homo sapiens
gaacagagtatat

SEQ ID NO: 4308053 - DNA, 17 bp, Homo sapiens
gaacagagtatatatgt

SEQ ID NO: 4308054 - DNA, 15 bp, Homo sapiens
gaacaggaggaactg

SEQ ID NO: 4308055 - DNA, 20 bp, Homo sapiens
gaacaggaggaactggtcca

SEQ ID NO: 4308056 - DNA, 21 bp, Homo sapiens
gaacagttctcccttcaactg

SEQ ID NO: 4308057 - DNA, 19 bp, Homo sapiens
gaacattattaaatcagaa

SEQ ID NO: 4308058 - DNA, 22 bp, Homo sapiens
gaacattattaaatcagaatct

SEQ ID NO: 4308059 - DNA, 18 bp, Homo sapiens
gaaccaacgggtctgtgg

SEQ ID NO: 4308060 - DNA, 19 bp, Homo sapiens
gaaccagagccatggactc

SEQ ID NO: 4308061 - DNA, 19 bp, Homo sapiens
gaaccagtccctctgagtg

SEQ ID NO: 4308062 - DNA, 20 bp, Homo sapiens
gaacccatggaaaaatgcca

SEQ ID NO: 4308063 - DNA, 15 bp, Homo sapiens
gaacccccctcccca

SEQ ID NO: 4308064 - DNA, 16 bp, Homo sapiens
gaacccccctccccaa

SEQ ID NO: 4308065 - DNA, 21 bp, Homo sapiens
gaacccccctccccaaggaag

SEQ ID NO: 4308066 - DNA, 17 bp, Homo sapiens
gaacccttttggccccc

SEQ ID NO: 4308067 - DNA, 19 bp, Homo sapiens
gaacccttttggcccccga

SEQ ID NO: 4308068 - DNA, 22 bp, Homo sapiens
gaacctcgttgacatgcacagt

SEQ ID NO: 4308069 - DNA, 13 bp, Homo sapiens
gaacgcatgcagg

SEQ ID NO: 4308070 - DNA, 14 bp, Homo sapiens
gaacgcatgcaggg

SEQ ID NO: 4308071 - DNA, 15 bp, Homo sapiens
gaactaggtgctggc

SEQ ID NO: 4308072 - DNA, 12 bp, Homo sapiens
gaactgctgcca

SEQ ID NO: 4308073 - DNA, 21 bp, Homo sapiens
gaactgctgccatgattttgg

SEQ ID NO: 4308074 - DNA, 13 bp, Homo sapiens
gaactgctgctgg

SEQ ID NO: 4308075 - DNA, 17 bp, Homo sapiens
gaactgctgctggtcac

SEQ ID NO: 4308076 - DNA, 22 bp, Homo sapiens
gaactgctgctggtcaccccca

SEQ ID NO: 4308077 - DNA, 17 bp, Homo sapiens
gaactgtctctcatgaa

SEQ ID NO: 4308078 - DNA, 21 bp, Homo sapiens
gaactgtctctcatgaacctc

SEQ ID NO: 4308079 - DNA, 19 bp, Homo sapiens
gaagaaaacatgtctgtga

SEQ ID NO: 4308080 - DNA, 19 bp, Homo sapiens
gaagaactcaccagggttt

SEQ ID NO: 4308081 - DNA, 21 bp, Homo sapiens
gaagaaggcccgggaggagga

SEQ ID NO: 4308082 - DNA, 22 bp, Homo sapiens
gaagaagggaaattcacactgt

SEQ ID NO: 4308083 - DNA, 19 bp, Homo sapiens
gaagagcgctcctctgcct

SEQ ID NO: 4308084 - DNA, 10 bp, Homo sapiens
gaagaggact

SEQ ID NO: 4308085 - DNA, 18 bp, Homo sapiens
gaagaggccgctgcaggg

SEQ ID NO: 4308086 - DNA, 20 bp, Homo sapiens
gaagaggccgctgcagggtg

SEQ ID NO: 4308087 - DNA, 21 bp, Homo sapiens
gaagaggccgctgcagggtgg

SEQ ID NO: 4308088 - DNA, 14 bp, Homo sapiens
gaagagggagaagg

SEQ ID NO: 4308089 - DNA, 17 bp, Homo sapiens
gaagatcctccttccag

SEQ ID NO: 4308090 - DNA, 13 bp, Homo sapiens
gaagattctaaaa

SEQ ID NO: 4308091 - DNA, 15 bp, Homo sapiens
gaagattctaaaaca

SEQ ID NO: 4308092 - DNA, 22 bp, Homo sapiens
gaagattctaaaacattcttta

SEQ ID NO: 4308093 - DNA, 15 bp, Homo sapiens
gaagcaaacacacag

SEQ ID NO: 4308094 - DNA, 20 bp, Homo sapiens
gaagcacaagaagtgggagt

SEQ ID NO: 4308095 - DNA, 14 bp, Homo sapiens
gaagcaccagcctc

SEQ ID NO: 4308096 - DNA, 22 bp, Homo sapiens
gaagcaccagcctcagtgcagc

SEQ ID NO: 4308097 - DNA, 13 bp, Homo sapiens
gaagcaccccacc

SEQ ID NO: 4308098 - DNA, 13 bp, Homo sapiens
gaagcagagcctg

SEQ ID NO: 4308099 - DNA, 18 bp, Homo sapiens
gaagccacgtgctggaga

SEQ ID NO: 4308100 - DNA, 19 bp, Homo sapiens
gaagccacgtgctggagag

SEQ ID NO: 4308101 - DNA, 17 bp, Homo sapiens
gaagcctcatgggagtc

SEQ ID NO: 4308102 - DNA, 22 bp, Homo sapiens
gaagcctcatgggagtcaggga

SEQ ID NO: 4308103 - DNA, 15 bp, Homo sapiens
gaagcctccacctgc

SEQ ID NO: 4308104 - DNA, 16 bp, Homo sapiens
gaagcctccacctgca

SEQ ID NO: 4308105 - DNA, 12 bp, Homo sapiens
gaagctcagccc

SEQ ID NO: 4308106 - DNA, 17 bp, Homo sapiens
gaagctcagcccacccc

SEQ ID NO: 4308107 - DNA, 19 bp, Homo sapiens
gaagctcagcccacccccc

SEQ ID NO: 4308108 - DNA, 22 bp, Homo sapiens
gaagctcagcccacccccctca

SEQ ID NO: 4308109 - DNA, 22 bp, Homo sapiens
gaagctggcaggagacactggt

SEQ ID NO: 4308110 - DNA, 17 bp, Homo sapiens
gaagctgttctctgctt

SEQ ID NO: 4308111 - DNA, 17 bp, Homo sapiens
gaaggaaggagccagct

SEQ ID NO: 4308112 - DNA, 20 bp, Homo sapiens
gaaggaaggagccagctccc

SEQ ID NO: 4308113 - DNA, 13 bp, Homo sapiens
gaaggacttcctg

SEQ ID NO: 4308114 - DNA, 13 bp, Homo sapiens
gaaggaggaaggg

SEQ ID NO: 4308115 - DNA, 18 bp, Homo sapiens
gaaggaggaagggactgg

SEQ ID NO: 4308116 - DNA, 24 bp, Homo sapiens
gaaggattttaaatgctgtatgtc

SEQ ID NO: 4308117 - DNA, 17 bp, Homo sapiens
gaaggcaagctggcagg

SEQ ID NO: 4308118 - DNA, 21 bp, Homo sapiens
gaaggcaagctggcaggaggg

SEQ ID NO: 4308119 - DNA, 15 bp, Homo sapiens
gaaggcctgcccccc

SEQ ID NO: 4308120 - DNA, 18 bp, Homo sapiens
gaaggcctgccccccttc

SEQ ID NO: 4308121 - DNA, 21 bp, Homo sapiens
gaaggcctgccccccttccca

SEQ ID NO: 4308122 - DNA, 15 bp, Homo sapiens
gaaggccttgttaaa

SEQ ID NO: 4308123 - DNA, 11 bp, Homo sapiens
gaagggaaatt

SEQ ID NO: 4308124 - DNA, 24 bp, Homo sapiens
gaagggaccgggagcctgcgtggc

SEQ ID NO: 4308125 - DNA, 13 bp, Homo sapiens
gaagggactggtc

SEQ ID NO: 4308126 - DNA, 15 bp, Homo sapiens
gaagggactggtcca

SEQ ID NO: 4308127 - DNA, 14 bp, Homo sapiens
gaagggaggcctga

SEQ ID NO: 4308128 - DNA, 20 bp, Homo sapiens
gaagggaggcctgaggggca

SEQ ID NO: 4308129 - DNA, 14 bp, Homo sapiens
gaaggtcggaggct

SEQ ID NO: 4308130 - DNA, 18 bp, Homo sapiens
gaaggtcggaggcttggg

SEQ ID NO: 4308131 - DNA, 20 bp, Homo sapiens
gaaggtctcatgcctgagaa

SEQ ID NO: 4308132 - DNA, 23 bp, Homo sapiens
gaagtaagttctgaaaactgttt

SEQ ID NO: 4308133 - DNA, 19 bp, Homo sapiens
gaagtatccctgatttatt

SEQ ID NO: 4308134 - DNA, 12 bp, Homo sapiens
gaagtcaggagc

SEQ ID NO: 4308135 - DNA, 13 bp, Homo sapiens
gaagtcaggagcc

SEQ ID NO: 4308136 - DNA, 15 bp, Homo sapiens
gaagtcaggagccag

SEQ ID NO: 4308137 - DNA, 16 bp, Homo sapiens
gaagtcaggagccagc

SEQ ID NO: 4308138 - DNA, 21 bp, Homo sapiens
gaagtccagtgaccctggagc

SEQ ID NO: 4308139 - DNA, 20 bp, Homo sapiens
gaagtcttccatcagcagtg

SEQ ID NO: 4308140 - DNA, 21 bp, Homo sapiens
gaagtcttccatcagcagtga

SEQ ID NO: 4308141 - DNA, 23 bp, Homo sapiens
gaagtcttccatcagcagtgatt

SEQ ID NO: 4308142 - DNA, 21 bp, Homo sapiens
gaagtgacaaggccccagaga

SEQ ID NO: 4308143 - DNA, 19 bp, Homo sapiens
gaagtgaccccagctccag

SEQ ID NO: 4308144 - DNA, 21 bp, Homo sapiens
gaagtgaccccagctccaggc

SEQ ID NO: 4308145 - DNA, 23 bp, Homo sapiens
gaagtgaccccagctccaggcag

SEQ ID NO: 4308146 - DNA, 14 bp, Homo sapiens
gaagtgcccctgct

SEQ ID NO: 4308147 - DNA, 22 bp, Homo sapiens
gaagtgcccctgctgcctcccc

SEQ ID NO: 4308148 - DNA, 18 bp, Homo sapiens
gaagtggcaggaggacag

SEQ ID NO: 4308149 - DNA, 13 bp, Homo sapiens
gaagtgggagtgg

SEQ ID NO: 4308150 - DNA, 17 bp, Homo sapiens
gaagtgggagtgggaga

SEQ ID NO: 4308151 - DNA, 21 bp, Homo sapiens
gaagtgggagtgggagaggaa

SEQ ID NO: 4308152 - DNA, 18 bp, Homo sapiens
gaagtggtaggaaagcct

SEQ ID NO: 4308153 - DNA, 14 bp, Homo sapiens
gaagtgtgctgagg

SEQ ID NO: 4308154 - DNA, 17 bp, Homo sapiens
gaagtgtgctgaggtgg

SEQ ID NO: 4308155 - DNA, 13 bp, Homo sapiens
gaagtgtgttttg

SEQ ID NO: 4308156 - DNA, 12 bp, Homo sapiens
gaataaacactt

SEQ ID NO: 4308157 - DNA, 12 bp, Homo sapiens
gaataaagccac

SEQ ID NO: 4308158 - DNA, 16 bp, Homo sapiens
gaataaataaagaaga

SEQ ID NO: 4308159 - DNA, 22 bp, Homo sapiens
gaataaataaagaagaaaataa

SEQ ID NO: 4308160 - DNA, 16 bp, Homo sapiens
gaataatgcctttgta

SEQ ID NO: 4308161 - DNA, 14 bp, Homo sapiens
gaataatttcttac

SEQ ID NO: 4308162 - DNA, 24 bp, Homo sapiens
gaatactgtattgttacagctgaa

SEQ ID NO: 4308163 - DNA, 14 bp, Homo sapiens
gaatagtattgtgt

SEQ ID NO: 4308164 - DNA, 21 bp, Homo sapiens
gaatatacatagtctttgttt

SEQ ID NO: 4308165 - DNA, 20 bp, Homo sapiens
gaatatgacctaaatccatt

SEQ ID NO: 4308166 - DNA, 21 bp, Homo sapiens
gaatcaaaaattgaagagaga

SEQ ID NO: 4308167 - DNA, 17 bp, Homo sapiens
gaatcaaataaaaattc

SEQ ID NO: 4308168 - DNA, 19 bp, Homo sapiens
gaatcacctaattaatttc

SEQ ID NO: 4308169 - DNA, 16 bp, Homo sapiens
gaatcagggagcactg

SEQ ID NO: 4308170 - DNA, 17 bp, Homo sapiens
gaatcagggagcactgg

SEQ ID NO: 4308171 - DNA, 18 bp, Homo sapiens
gaatcagggagcactgga

SEQ ID NO: 4308172 - DNA, 20 bp, Homo sapiens
gaatcagggagcactggagg

SEQ ID NO: 4308173 - DNA, 17 bp, Homo sapiens
gaatccccgtgctcaca

SEQ ID NO: 4308174 - DNA, 18 bp, Homo sapiens
gaatcgacctcactgtca

SEQ ID NO: 4308175 - DNA, 16 bp, Homo sapiens
gaatcgaggaaccaga

SEQ ID NO: 4308176 - DNA, 18 bp, Homo sapiens
gaatcgaggaaccagagc

SEQ ID NO: 4308177 - DNA, 23 bp, Homo sapiens
gaatctgagagatgctgtagaca

SEQ ID NO: 4308178 - DNA, 12 bp, Homo sapiens
gaatgagagagt

SEQ ID NO: 4308179 - DNA, 13 bp, Homo sapiens
gaatgagagagtg

SEQ ID NO: 4308180 - DNA, 17 bp, Homo sapiens
gaatgcctaggccagct

SEQ ID NO: 4308181 - DNA, 20 bp, Homo sapiens
gaatgcctaggccagctcct

SEQ ID NO: 4308182 - DNA, 22 bp, Homo sapiens
gaatgcgctcttcaccaggaag

SEQ ID NO: 4308183 - DNA, 20 bp, Homo sapiens
gaatgctcccccatcctccc

SEQ ID NO: 4308184 - DNA, 22 bp, Homo sapiens
gaatgctcccccatcctcccct

SEQ ID NO: 4308185 - DNA, 21 bp, Homo sapiens
gaatggaagcctccacctgca

SEQ ID NO: 4308186 - DNA, 23 bp, Homo sapiens
gaatggaagcctccacctgcagc

SEQ ID NO: 4308187 - DNA, 19 bp, Homo sapiens
gaatggagtccagacctgg

SEQ ID NO: 4308188 - DNA, 15 bp, Homo sapiens
gaatggtgggctcca

SEQ ID NO: 4308189 - DNA, 16 bp, Homo sapiens
gaatgtagccagccca

SEQ ID NO: 4308190 - DNA, 17 bp, Homo sapiens
gaatgtgcttttccatc

SEQ ID NO: 4308191 - DNA, 22 bp, Homo sapiens
gaatgtttcatttgcacaagta

SEQ ID NO: 4308192 - DNA, 12 bp, Homo sapiens
gaattaagaact

SEQ ID NO: 4308193 - DNA, 19 bp, Homo sapiens
gaattacagggaagaaatc

SEQ ID NO: 4308194 - DNA, 14 bp, Homo sapiens
gaattaccatttgt

SEQ ID NO: 4308195 - DNA, 18 bp, Homo sapiens
gaattaccatttgttaat

SEQ ID NO: 4308196 - DNA, 15 bp, Homo sapiens
gaattcataaaaata

SEQ ID NO: 4308197 - DNA, 14 bp, Homo sapiens
gaattgaagtcatc

SEQ ID NO: 4308198 - DNA, 17 bp, Homo sapiens
gaattgaagtcatcata

SEQ ID NO: 4308199 - DNA, 12 bp, Homo sapiens
gaattgattttt

SEQ ID NO: 4308200 - DNA, 21 bp, Homo sapiens
gaatttgaagacttcaaaata

SEQ ID NO: 4308201 - DNA, 18 bp, Homo sapiens
gaattttatttctctcag

SEQ ID NO: 4308202 - DNA, 23 bp, Homo sapiens
gacaaaaatataaagttattaat

SEQ ID NO: 4308203 - DNA, 18 bp, Homo sapiens
gacaaccaccgctcccca

SEQ ID NO: 4308204 - DNA, 23 bp, Homo sapiens
gacaaccaccgctccccagccca

SEQ ID NO: 4308205 - DNA, 22 bp, Homo sapiens
gacaagcccaggacactgcctt

SEQ ID NO: 4308206 - DNA, 17 bp, Homo sapiens
gacaaggccccagagac

SEQ ID NO: 4308207 - DNA, 23 bp, Homo sapiens
gacaaggccccagagactcagag

SEQ ID NO: 4308208 - DNA, 13 bp, Homo sapiens
gacaatttcaaaa

SEQ ID NO: 4308209 - DNA, 14 bp, Homo sapiens
gacaatttcaaaat

SEQ ID NO: 4308210 - DNA, 18 bp, Homo sapiens
gacaatttcaaaatgcat

SEQ ID NO: 4308211 - DNA, 19 bp, Homo sapiens
gacaatttcaaaatgcatg

SEQ ID NO: 4308212 - DNA, 13 bp, Homo sapiens
gacaccatcccct

SEQ ID NO: 4308213 - DNA, 22 bp, Homo sapiens
gacacctatcagagaagcagca

SEQ ID NO: 4308214 - DNA, 16 bp, Homo sapiens
gacacgtgtttttgta

SEQ ID NO: 4308215 - DNA, 13 bp, Homo sapiens
gacactgaaataa

SEQ ID NO: 4308216 - DNA, 24 bp, Homo sapiens
gacactgcctttgctgccttctgt

SEQ ID NO: 4308217 - DNA, 20 bp, Homo sapiens
gacactggaagggtccggct

SEQ ID NO: 4308218 - DNA, 13 bp, Homo sapiens
gacactggtctca

SEQ ID NO: 4308219 - DNA, 19 bp, Homo sapiens
gacagaaccaacgggtctg

SEQ ID NO: 4308220 - DNA, 19 bp, Homo sapiens
gacagagggacagtgggct

SEQ ID NO: 4308221 - DNA, 12 bp, Homo sapiens
gacagagtggat

SEQ ID NO: 4308222 - DNA, 17 bp, Homo sapiens
gacagcagagccatctg

SEQ ID NO: 4308223 - DNA, 22 bp, Homo sapiens
gacaggagagattatttacaag

SEQ ID NO: 4308224 - DNA, 12 bp, Homo sapiens
gacagggtgggg

SEQ ID NO: 4308225 - DNA, 23 bp, Homo sapiens
gacagggtggggcttagaatggg

SEQ ID NO: 4308226 - DNA, 19 bp, Homo sapiens
gacaggtggaggcgagcca

SEQ ID NO: 4308227 - DNA, 14 bp, Homo sapiens
gacagtggctctcc

SEQ ID NO: 4308228 - DNA, 15 bp, Homo sapiens
gacatattcccatgg

SEQ ID NO: 4308229 - DNA, 13 bp, Homo sapiens
gacatcagtggca

SEQ ID NO: 4308230 - DNA, 19 bp, Homo sapiens
gacatcagtggcatggctc

SEQ ID NO: 4308231 - DNA, 23 bp, Homo sapiens
gacatgcggctgcccacgctcct

SEQ ID NO: 4308232 - DNA, 20 bp, Homo sapiens
gacatggattggatttcagt

SEQ ID NO: 4308233 - DNA, 12 bp, Homo sapiens
gacattgtattt

SEQ ID NO: 4308234 - DNA, 13 bp, Homo sapiens
gacatttaaaata

SEQ ID NO: 4308235 - DNA, 21 bp, Homo sapiens
gacatttaaaatagttttcta

SEQ ID NO: 4308236 - DNA, 18 bp, Homo sapiens
gaccaagatgtcaagctg

SEQ ID NO: 4308237 - DNA, 20 bp, Homo sapiens
gaccaagatgtcaagctggc

SEQ ID NO: 4308238 - DNA, 18 bp, Homo sapiens
gaccacacttcctgtcca

SEQ ID NO: 4308239 - DNA, 17 bp, Homo sapiens
gaccagaagtggcagga

SEQ ID NO: 4308240 - DNA, 19 bp, Homo sapiens
gaccagaagtggcaggagg

SEQ ID NO: 4308241 - DNA, 18 bp, Homo sapiens
gaccaggactctgccttc

SEQ ID NO: 4308242 - DNA, 18 bp, Homo sapiens
gaccatttagtcctcacc

SEQ ID NO: 4308243 - DNA, 18 bp, Homo sapiens
gaccccacttatgctgct

SEQ ID NO: 4308244 - DNA, 20 bp, Homo sapiens
gaccccatccagccaggggt

SEQ ID NO: 4308245 - DNA, 14 bp, Homo sapiens
gaccccatctgctg

SEQ ID NO: 4308246 - DNA, 15 bp, Homo sapiens
gaccccatctgctga

SEQ ID NO: 4308247 - DNA, 17 bp, Homo sapiens
gaccccatctgctgagc

SEQ ID NO: 4308248 - DNA, 12 bp, Homo sapiens
gacccctaccct

SEQ ID NO: 4308249 - DNA, 16 bp, Homo sapiens
gacccctaccctttcc

SEQ ID NO: 4308250 - DNA, 22 bp, Homo sapiens
gacccggagctaacactggccc

SEQ ID NO: 4308251 - DNA, 23 bp, Homo sapiens
gacccggagctaacactggcccc

SEQ ID NO: 4308252 - DNA, 23 bp, Homo sapiens
gacccggaggccacatgagtccc

SEQ ID NO: 4308253 - DNA, 17 bp, Homo sapiens
gacccggaggggcctgg

SEQ ID NO: 4308254 - DNA, 19 bp, Homo sapiens
gacccggaggggcctggca

SEQ ID NO: 4308255 - DNA, 21 bp, Homo sapiens
gacccggcccccgccctctgc

SEQ ID NO: 4308256 - DNA, 22 bp, Homo sapiens
gacccggcccccgccctctgcc

SEQ ID NO: 4308257 - DNA, 20 bp, Homo sapiens
gaccctgagggtttccacct

SEQ ID NO: 4308258 - DNA, 19 bp, Homo sapiens
gaccctgccaactttccag

SEQ ID NO: 4308259 - DNA, 23 bp, Homo sapiens
gaccctgccaactttccagactt

SEQ ID NO: 4308260 - DNA, 14 bp, Homo sapiens
gaccctggagcccg

SEQ ID NO: 4308261 - DNA, 16 bp, Homo sapiens
gaccctggagcccggc

SEQ ID NO: 4308262 - DNA, 12 bp, Homo sapiens
gaccctggagct

SEQ ID NO: 4308263 - DNA, 16 bp, Homo sapiens
gaccgagtgtggagct

SEQ ID NO: 4308264 - DNA, 18 bp, Homo sapiens
gaccgagtgtggagctgc

SEQ ID NO: 4308265 - DNA, 22 bp, Homo sapiens
gaccgccagatggggcctctgt

SEQ ID NO: 4308266 - DNA, 18 bp, Homo sapiens
gaccggggtcctgaggct

SEQ ID NO: 4308267 - DNA, 20 bp, Homo sapiens
gaccggggtcctgaggctgg

SEQ ID NO: 4308268 - DNA, 18 bp, Homo sapiens
gacctaaatccattttct

SEQ ID NO: 4308269 - DNA, 19 bp, Homo sapiens
gacctaaatccattttcta

SEQ ID NO: 4308270 - DNA, 12 bp, Homo sapiens
gacctgaagaat

SEQ ID NO: 4308271 - DNA, 17 bp, Homo sapiens
gacctgcacttggcctc

SEQ ID NO: 4308272 - DNA, 20 bp, Homo sapiens
gacctgcagttggcctcagc

SEQ ID NO: 4308273 - DNA, 21 bp, Homo sapiens
gacctgcagttggcctcagca

SEQ ID NO: 4308274 - DNA, 14 bp, Homo sapiens
gacctgggccctgg

SEQ ID NO: 4308275 - DNA, 15 bp, Homo sapiens
gacctgggccctggt

SEQ ID NO: 4308276 - DNA, 16 bp, Homo sapiens
gacctgggccctggtt

SEQ ID NO: 4308277 - DNA, 22 bp, Homo sapiens
gacctgtggggatttctcccag

SEQ ID NO: 4308278 - DNA, 23 bp, Homo sapiens
gacctgtggggatttctcccagc

SEQ ID NO: 4308279 - DNA, 19 bp, Homo sapiens
gaccttgatgtcttgagag

SEQ ID NO: 4308280 - DNA, 16 bp, Homo sapiens
gaccttggtggtggga

SEQ ID NO: 4308281 - DNA, 14 bp, Homo sapiens
gacctttgccaaac

SEQ ID NO: 4308282 - DNA, 22 bp, Homo sapiens
gacggagcactgtgcagccggg

SEQ ID NO: 4308283 - DNA, 19 bp, Homo sapiens
gacgggggttggggtgggg

SEQ ID NO: 4308284 - DNA, 20 bp, Homo sapiens
gacgggggttggggtggggc

SEQ ID NO: 4308285 - DNA, 15 bp, Homo sapiens
gacgtgagtggggag

SEQ ID NO: 4308286 - DNA, 19 bp, Homo sapiens
gactagggtcctcaggcag

SEQ ID NO: 4308287 - DNA, 14 bp, Homo sapiens
gactataaacatta

SEQ ID NO: 4308288 - DNA, 17 bp, Homo sapiens
gactatagctgttctaa

SEQ ID NO: 4308289 - DNA, 22 bp, Homo sapiens
gactcaatgtggaaaaaatatt

SEQ ID NO: 4308290 - DNA, 20 bp, Homo sapiens
gactccatatcccgggagca

SEQ ID NO: 4308291 - DNA, 18 bp, Homo sapiens
gactccttctccccaatc

SEQ ID NO: 4308292 - DNA, 22 bp, Homo sapiens
gactcgggctaagtccagctct

SEQ ID NO: 4308293 - DNA, 16 bp, Homo sapiens
gactctctccatcaga

SEQ ID NO: 4308294 - DNA, 18 bp, Homo sapiens
gactctctccatcagaag

SEQ ID NO: 4308295 - DNA, 20 bp, Homo sapiens
gactctctcctctctctccc

SEQ ID NO: 4308296 - DNA, 21 bp, Homo sapiens
gactctctcctctctctccct

SEQ ID NO: 4308297 - DNA, 15 bp, Homo sapiens
gactctgccttccag

SEQ ID NO: 4308298 - DNA, 13 bp, Homo sapiens
gactctggactgg

SEQ ID NO: 4308299 - DNA, 14 bp, Homo sapiens
gactctgtgagatt

SEQ ID NO: 4308300 - DNA, 21 bp, Homo sapiens
gactctttattgtctgtaaat

SEQ ID NO: 4308301 - DNA, 22 bp, Homo sapiens
gactctttattgtctgtaaatc

SEQ ID NO: 4308302 - DNA, 23 bp, Homo sapiens
gactctttattgtctgtaaatct

SEQ ID NO: 4308303 - DNA, 15 bp, Homo sapiens
gactgaatttaacta

SEQ ID NO: 4308304 - DNA, 13 bp, Homo sapiens
gactgcatgcaag

SEQ ID NO: 4308305 - DNA, 15 bp, Homo sapiens
gactgcatgcaagct

SEQ ID NO: 4308306 - DNA, 19 bp, Homo sapiens
gactgccgaccgaggctgg

SEQ ID NO: 4308307 - DNA, 17 bp, Homo sapiens
gactggaggctgggtgg

SEQ ID NO: 4308308 - DNA, 19 bp, Homo sapiens
gactggcccacccctcttc

SEQ ID NO: 4308309 - DNA, 15 bp, Homo sapiens
gactgggaagggggc

SEQ ID NO: 4308310 - DNA, 17 bp, Homo sapiens
gactgggaagggggcag

SEQ ID NO: 4308311 - DNA, 21 bp, Homo sapiens
gactgggaagggggcaggccc

SEQ ID NO: 4308312 - DNA, 13 bp, Homo sapiens
gactgggctggct

SEQ ID NO: 4308313 - DNA, 14 bp, Homo sapiens
gactgggctggctg

SEQ ID NO: 4308314 - DNA, 15 bp, Homo sapiens
gactgggctggctgc

SEQ ID NO: 4308315 - DNA, 18 bp, Homo sapiens
gactgggctggctgcctt

SEQ ID NO: 4308316 - DNA, 22 bp, Homo sapiens
gactgggctggctgccttctgc

SEQ ID NO: 4308317 - DNA, 22 bp, Homo sapiens
gactgggggtgccaaccacctc

SEQ ID NO: 4308318 - DNA, 23 bp, Homo sapiens
gactgggggtgccaaccacctct

SEQ ID NO: 4308319 - DNA, 13 bp, Homo sapiens
gactggtccaggc

SEQ ID NO: 4308320 - DNA, 16 bp, Homo sapiens
gactgtactcctccca

SEQ ID NO: 4308321 - DNA, 17 bp, Homo sapiens
gactgtactcctcccag

SEQ ID NO: 4308322 - DNA, 21 bp, Homo sapiens
gactgtctcaagagggcactg

SEQ ID NO: 4308323 - DNA, 15 bp, Homo sapiens
gactgtggcctcagg

SEQ ID NO: 4308324 - DNA, 19 bp, Homo sapiens
gactgtggcctcaggaggc

SEQ ID NO: 4308325 - DNA, 19 bp, Homo sapiens
gacttcaaaatattgagca

SEQ ID NO: 4308326 - DNA, 22 bp, Homo sapiens
gacttctttactaacactggct

SEQ ID NO: 4308327 - DNA, 23 bp, Homo sapiens
gacttctttggtgttctggcctc

SEQ ID NO: 4308328 - DNA, 14 bp, Homo sapiens
gacttgtgcctctt

SEQ ID NO: 4308329 - DNA, 13 bp, Homo sapiens
gactttccacccc

SEQ ID NO: 4308330 - DNA, 17 bp, Homo sapiens
gactttccaccccctcc

SEQ ID NO: 4308331 - DNA, 18 bp, Homo sapiens
gactttccaccccctccc

SEQ ID NO: 4308332 - DNA, 19 bp, Homo sapiens
gactttccaccccctccct

SEQ ID NO: 4308333 - DNA, 12 bp, Homo sapiens
gagaaaaaccaa

SEQ ID NO: 4308334 - DNA, 20 bp, Homo sapiens
gagaaaacatctcatcatgt

SEQ ID NO: 4308335 - DNA, 12 bp, Homo sapiens
gagaaaagccag

SEQ ID NO: 4308336 - DNA, 20 bp, Homo sapiens
gagaaagcatattgactttt

SEQ ID NO: 4308337 - DNA, 14 bp, Homo sapiens
gagaaattcttgtt

SEQ ID NO: 4308338 - DNA, 18 bp, Homo sapiens
gagaaatttttttccaga

SEQ ID NO: 4308339 - DNA, 20 bp, Homo sapiens
gagaaggacccggaggggcc

SEQ ID NO: 4308340 - DNA, 23 bp, Homo sapiens
gagaaggacccggaggggcctgg

SEQ ID NO: 4308341 - DNA, 12 bp, Homo sapiens
gagaaggagagg

SEQ ID NO: 4308342 - DNA, 18 bp, Homo sapiens
gagaaggagaggctctga

SEQ ID NO: 4308343 - DNA, 20 bp, Homo sapiens
gagaaggcaagctggcagga

SEQ ID NO: 4308344 - DNA, 22 bp, Homo sapiens
gagaaggcctgccccccttccc

SEQ ID NO: 4308345 - DNA, 16 bp, Homo sapiens
gagaagtgcccctgct

SEQ ID NO: 4308346 - DNA, 22 bp, Homo sapiens
gagaagtgcccctgctgcctcc

SEQ ID NO: 4308347 - DNA, 18 bp, Homo sapiens
gagaatcgacctcactgt

SEQ ID NO: 4308348 - DNA, 13 bp, Homo sapiens
gagaattctaaga

SEQ ID NO: 4308349 - DNA, 13 bp, Homo sapiens
gagacactggtct

SEQ ID NO: 4308350 - DNA, 15 bp, Homo sapiens
gagacactggtctca

SEQ ID NO: 4308351 - DNA, 20 bp, Homo sapiens
gagacactggtctcagagga

SEQ ID NO: 4308352 - DNA, 15 bp, Homo sapiens
gagacagtcaggaag

SEQ ID NO: 4308353 - DNA, 16 bp, Homo sapiens
gagacagtcaggaagc

SEQ ID NO: 4308354 - DNA, 19 bp, Homo sapiens
gagaccaggactctgcctt

SEQ ID NO: 4308355 - DNA, 21 bp, Homo sapiens
gagaccgagtgtggagctgct

SEQ ID NO: 4308356 - DNA, 16 bp, Homo sapiens
gagacgggaccgggcc

SEQ ID NO: 4308357 - DNA, 22 bp, Homo sapiens
gagacgtccacccgtttccaag

SEQ ID NO: 4308358 - DNA, 13 bp, Homo sapiens
gagactatgtgtc

SEQ ID NO: 4308359 - DNA, 14 bp, Homo sapiens
gagactatgtgtca

SEQ ID NO: 4308360 - DNA, 13 bp, Homo sapiens
gagactcaggccc

SEQ ID NO: 4308361 - DNA, 14 bp, Homo sapiens
gagactcaggccca

SEQ ID NO: 4308362 - DNA, 15 bp, Homo sapiens
gagactcaggcccac

SEQ ID NO: 4308363 - DNA, 15 bp, Homo sapiens
gagactctgaggtgt

SEQ ID NO: 4308364 - DNA, 21 bp, Homo sapiens
gagactgacccattcacattt

SEQ ID NO: 4308365 - DNA, 21 bp, Homo sapiens
gagagaaggtggtctgcaccc

SEQ ID NO: 4308366 - DNA, 18 bp, Homo sapiens
gagagaagtgcccctgct

SEQ ID NO: 4308367 - DNA, 21 bp, Homo sapiens
gagagaagtgcccctgctgcc

SEQ ID NO: 4308368 - DNA, 13 bp, Homo sapiens
gagagagtgtgga

SEQ ID NO: 4308369 - DNA, 18 bp, Homo sapiens
gagagcccaatcactgcc

SEQ ID NO: 4308370 - DNA, 18 bp, Homo sapiens
gagagccctctgctgctt

SEQ ID NO: 4308371 - DNA, 11 bp, Homo sapiens
gagaggagaga

SEQ ID NO: 4308372 - DNA, 21 bp, Homo sapiens
gagaggctctgaaagctgctt

SEQ ID NO: 4308373 - DNA, 15 bp, Homo sapiens
gagagtatggtgctg

SEQ ID NO: 4308374 - DNA, 11 bp, Homo sapiens
gagatcagcat

SEQ ID NO: 4308375 - DNA, 12 bp, Homo sapiens
gagatcttcctt

SEQ ID NO: 4308376 - DNA, 16 bp, Homo sapiens
gagatgctgggaccct

SEQ ID NO: 4308377 - DNA, 21 bp, Homo sapiens
gagatggggagggcgcttttg

SEQ ID NO: 4308378 - DNA, 17 bp, Homo sapiens
gagatggtgccccctgg

SEQ ID NO: 4308379 - DNA, 21 bp, Homo sapiens
gagatgtaccatgttaaagag

SEQ ID NO: 4308380 - DNA, 20 bp, Homo sapiens
gagatgtgtccatgtgaaat

SEQ ID NO: 4308381 - DNA, 17 bp, Homo sapiens
gagattagcatgaaagg

SEQ ID NO: 4308382 - DNA, 23 bp, Homo sapiens
gagattatttacaagaagaactc

SEQ ID NO: 4308383 - DNA, 16 bp, Homo sapiens
gagattggatcaagta

SEQ ID NO: 4308384 - DNA, 13 bp, Homo sapiens
gagattggctttg

SEQ ID NO: 4308385 - DNA, 13 bp, Homo sapiens
gagcactggaggc

SEQ ID NO: 4308386 - DNA, 14 bp, Homo sapiens
gagcactggaggcc

SEQ ID NO: 4308387 - DNA, 17 bp, Homo sapiens
gagcactggaggcctct

SEQ ID NO: 4308388 - DNA, 13 bp, Homo sapiens
gagcactgtgcag

SEQ ID NO: 4308389 - DNA, 17 bp, Homo sapiens
gagcagcccacctgctg

SEQ ID NO: 4308390 - DNA, 20 bp, Homo sapiens
gagcagcccacctgctgccc

SEQ ID NO: 4308391 - DNA, 19 bp, Homo sapiens
gagcaggaagcaaggccag

SEQ ID NO: 4308392 - DNA, 22 bp, Homo sapiens
gagcaggaagcaaggccagccc

SEQ ID NO: 4308393 - DNA, 16 bp, Homo sapiens
gagcagtgggccctgg

SEQ ID NO: 4308394 - DNA, 18 bp, Homo sapiens
gagcagtgggccctggct

SEQ ID NO: 4308395 - DNA, 21 bp, Homo sapiens
gagcagtgggccctggctctg

SEQ ID NO: 4308396 - DNA, 24 bp, Homo sapiens
gagcagtgggccctggctctgtca

SEQ ID NO: 4308397 - DNA, 15 bp, Homo sapiens
gagcatacccagtgt

SEQ ID NO: 4308398 - DNA, 15 bp, Homo sapiens
gagcatgagccagct

SEQ ID NO: 4308399 - DNA, 13 bp, Homo sapiens
gagccacaggcag

SEQ ID NO: 4308400 - DNA, 21 bp, Homo sapiens
gagccagattaggcctggagt

SEQ ID NO: 4308401 - DNA, 15 bp, Homo sapiens
gagccagcagggcgg

SEQ ID NO: 4308402 - DNA, 14 bp, Homo sapiens
gagccagctcccag

SEQ ID NO: 4308403 - DNA, 13 bp, Homo sapiens
gagccagggctgt

SEQ ID NO: 4308404 - DNA, 16 bp, Homo sapiens
gagccagggctgtcct

SEQ ID NO: 4308405 - DNA, 16 bp, Homo sapiens
gagcccaagcacacat

SEQ ID NO: 4308406 - DNA, 18 bp, Homo sapiens
gagcccaatcactgccta

SEQ ID NO: 4308407 - DNA, 21 bp, Homo sapiens
gagcccccaccagcagcacaa

SEQ ID NO: 4308408 - DNA, 21 bp, Homo sapiens
gagcccccgccccgccccaca

SEQ ID NO: 4308409 - DNA, 14 bp, Homo sapiens
gagccccctgtcct

SEQ ID NO: 4308410 - DNA, 16 bp, Homo sapiens
gagccccctgtccttc

SEQ ID NO: 4308411 - DNA, 22 bp, Homo sapiens
gagcccctatcctgcaccctct

SEQ ID NO: 4308412 - DNA, 20 bp, Homo sapiens
gagcccgcacccccaccctt

SEQ ID NO: 4308413 - DNA, 18 bp, Homo sapiens
gagcccgcccacctgggc

SEQ ID NO: 4308414 - DNA, 22 bp, Homo sapiens
gagccctctgctgctttccaac

SEQ ID NO: 4308415 - DNA, 12 bp, Homo sapiens
gagccctgccct

SEQ ID NO: 4308416 - DNA, 17 bp, Homo sapiens
gagccctgccctcactc

SEQ ID NO: 4308417 - DNA, 13 bp, Homo sapiens
gagccctggggtt

SEQ ID NO: 4308418 - DNA, 15 bp, Homo sapiens
gagccgtcagcctgt

SEQ ID NO: 4308419 - DNA, 14 bp, Homo sapiens
gagcctagaggagg

SEQ ID NO: 4308420 - DNA, 15 bp, Homo sapiens
gagcctagaggagga

SEQ ID NO: 4308421 - DNA, 22 bp, Homo sapiens
gagcctccctcagccacgcctc

SEQ ID NO: 4308422 - DNA, 18 bp, Homo sapiens
gagcctgcgtggcctggg

SEQ ID NO: 4308423 - DNA, 22 bp, Homo sapiens
gagcctggggtgggtgtgagca

SEQ ID NO: 4308424 - DNA, 23 bp, Homo sapiens
gagcctgtgttagtgtctgtcca

SEQ ID NO: 4308425 - DNA, 22 bp, Homo sapiens
gagcgacggctcctccccgatc

SEQ ID NO: 4308426 - DNA, 16 bp, Homo sapiens
gagcgcacctcgccgt

SEQ ID NO: 4308427 - DNA, 14 bp, Homo sapiens
gagcgctcctctgc

SEQ ID NO: 4308428 - DNA, 21 bp, Homo sapiens
gagcgctcctctgccttggac

SEQ ID NO: 4308429 - DNA, 18 bp, Homo sapiens
gagcggccgcctgtcctt

SEQ ID NO: 4308430 - DNA, 23 bp, Homo sapiens
gagcgtgtcctatccccggacgc

SEQ ID NO: 4308431 - DNA, 13 bp, Homo sapiens
gagctagggtccc

SEQ ID NO: 4308432 - DNA, 14 bp, Homo sapiens
gagctcagcacagc

SEQ ID NO: 4308433 - DNA, 22 bp, Homo sapiens
gagctcagcacagcctcacccc

SEQ ID NO: 4308434 - DNA, 15 bp, Homo sapiens
gagctcaggagaagg

SEQ ID NO: 4308435 - DNA, 17 bp, Homo sapiens
gagctcaggagaaggcc

SEQ ID NO: 4308436 - DNA, 12 bp, Homo sapiens
gagctcagggct

SEQ ID NO: 4308437 - DNA, 22 bp, Homo sapiens
gagctccagacccccagcaacc

SEQ ID NO: 4308438 - DNA, 19 bp, Homo sapiens
gagctccccaatccaaccc

SEQ ID NO: 4308439 - DNA, 14 bp, Homo sapiens
gagctcctctgggc

SEQ ID NO: 4308440 - DNA, 16 bp, Homo sapiens
gagctcctctgggcag

SEQ ID NO: 4308441 - DNA, 18 bp, Homo sapiens
gagctcctctgggcagga

SEQ ID NO: 4308442 - DNA, 22 bp, Homo sapiens
gagctcctctgggcaggacctc

SEQ ID NO: 4308443 - DNA, 23 bp, Homo sapiens
gagctctaactgattcagggccc

SEQ ID NO: 4308444 - DNA, 16 bp, Homo sapiens
gagctctcctgggcca

SEQ ID NO: 4308445 - DNA, 17 bp, Homo sapiens
gagctcttcatgtttca

SEQ ID NO: 4308446 - DNA, 10 bp, Homo sapiens
gagctgagat

SEQ ID NO: 4308447 - DNA, 15 bp, Homo sapiens
gagctgaggggcagg

SEQ ID NO: 4308448 - DNA, 19 bp, Homo sapiens
gagctgaggggcagggccg

SEQ ID NO: 4308449 - DNA, 19 bp, Homo sapiens
gagctgcagaaccagtccc

SEQ ID NO: 4308450 - DNA, 18 bp, Homo sapiens
gagctgggggccatgagc

SEQ ID NO: 4308451 - DNA, 24 bp, Homo sapiens
gagctgggggccatgagctccaga

SEQ ID NO: 4308452 - DNA, 20 bp, Homo sapiens
gagctgtgccagctgcttct

SEQ ID NO: 4308453 - DNA, 22 bp, Homo sapiens
gagctgtgccagctgcttctgc

SEQ ID NO: 4308454 - DNA, 15 bp, Homo sapiens
gagcttctccagcca

SEQ ID NO: 4308455 - DNA, 18 bp, Homo sapiens
gagcttctccagccacca

SEQ ID NO: 4308456 - DNA, 16 bp, Homo sapiens
gaggaaaaaggctggt

SEQ ID NO: 4308457 - DNA, 21 bp, Homo sapiens
gaggaaaaccaagccgtggct

SEQ ID NO: 4308458 - DNA, 23 bp, Homo sapiens
gaggaaaaccaagccgtggcttc

SEQ ID NO: 4308459 - DNA, 14 bp, Homo sapiens
gaggaaccagagcc

SEQ ID NO: 4308460 - DNA, 18 bp, Homo sapiens
gaggaaccagagccatgg

SEQ ID NO: 4308461 - DNA, 13 bp, Homo sapiens
gaggaactggtcc

SEQ ID NO: 4308462 - DNA, 23 bp, Homo sapiens
gaggaactggtccaggccaggcc

SEQ ID NO: 4308463 - DNA, 13 bp, Homo sapiens
gaggaagggactg

SEQ ID NO: 4308464 - DNA, 21 bp, Homo sapiens
gaggaagggactggtccaggc

SEQ ID NO: 4308465 - DNA, 13 bp, Homo sapiens
gaggaagggaggc

SEQ ID NO: 4308466 - DNA, 21 bp, Homo sapiens
gaggaatgctcccccatcctc

SEQ ID NO: 4308467 - DNA, 13 bp, Homo sapiens
gaggaatgtgctt

SEQ ID NO: 4308468 - DNA, 19 bp, Homo sapiens
gaggacaaaacagcgggag

SEQ ID NO: 4308469 - DNA, 21 bp, Homo sapiens
gaggacagcttccccatcgcc

SEQ ID NO: 4308470 - DNA, 19 bp, Homo sapiens
gaggacaggtggaggcgag

SEQ ID NO: 4308471 - DNA, 14 bp, Homo sapiens
gaggacggcttccc

SEQ ID NO: 4308472 - DNA, 21 bp, Homo sapiens
gaggacggcttccccatcgcc

SEQ ID NO: 4308473 - DNA, 18 bp, Homo sapiens
gaggagactcaggcccac

SEQ ID NO: 4308474 - DNA, 16 bp, Homo sapiens
gaggagattgctctgg

SEQ ID NO: 4308475 - DNA, 15 bp, Homo sapiens
gaggagctcagggct

SEQ ID NO: 4308476 - DNA, 19 bp, Homo sapiens
gaggagctcagggctggat

SEQ ID NO: 4308477 - DNA, 18 bp, Homo sapiens
gaggaggaaaaaggctgg

SEQ ID NO: 4308478 - DNA, 14 bp, Homo sapiens
gaggagggggagaa

SEQ ID NO: 4308479 - DNA, 23 bp, Homo sapiens
gaggaggtaacatagatgcctgg

SEQ ID NO: 4308480 - DNA, 14 bp, Homo sapiens
gaggaggtgcccgg

SEQ ID NO: 4308481 - DNA, 20 bp, Homo sapiens
gaggaggtgcccgggcaggg

SEQ ID NO: 4308482 - DNA, 16 bp, Homo sapiens
gaggaggtgtggagtg

SEQ ID NO: 4308483 - DNA, 14 bp, Homo sapiens
gaggatccgggctt

SEQ ID NO: 4308484 - DNA, 21 bp, Homo sapiens
gaggcaaccccctcggagcct

SEQ ID NO: 4308485 - DNA, 16 bp, Homo sapiens
gaggcagaatggtggg

SEQ ID NO: 4308486 - DNA, 14 bp, Homo sapiens
gaggcagaggacag

SEQ ID NO: 4308487 - DNA, 21 bp, Homo sapiens
gaggcagcaacaggaccagga

SEQ ID NO: 4308488 - DNA, 22 bp, Homo sapiens
gaggcagcaacaggaccaggag

SEQ ID NO: 4308489 - DNA, 23 bp, Homo sapiens
gaggcagcaacaggaccaggagc

SEQ ID NO: 4308490 - DNA, 18 bp, Homo sapiens
gaggcaggggctgggcag

SEQ ID NO: 4308491 - DNA, 20 bp, Homo sapiens
gaggcaggggctgggcagag

SEQ ID NO: 4308492 - DNA, 16 bp, Homo sapiens
gaggcaggtcccgagc

SEQ ID NO: 4308493 - DNA, 22 bp, Homo sapiens
gaggcaggtcccgagccccctg

SEQ ID NO: 4308494 - DNA, 16 bp, Homo sapiens
gaggcagtggcagcaa

SEQ ID NO: 4308495 - DNA, 16 bp, Homo sapiens
gaggcagtggcttgga

SEQ ID NO: 4308496 - DNA, 21 bp, Homo sapiens
gaggcagtggcttggagcaga

SEQ ID NO: 4308497 - DNA, 17 bp, Homo sapiens
gaggccacatgagtccc

SEQ ID NO: 4308498 - DNA, 20 bp, Homo sapiens
gaggccacgggggaggccga

SEQ ID NO: 4308499 - DNA, 12 bp, Homo sapiens
gaggccagagga

SEQ ID NO: 4308500 - DNA, 13 bp, Homo sapiens
gaggccagaggaa

SEQ ID NO: 4308501 - DNA, 23 bp, Homo sapiens
gaggccatgattcgcccaaagcc

SEQ ID NO: 4308502 - DNA, 22 bp, Homo sapiens
gaggcccccgcacgcaagcctc

SEQ ID NO: 4308503 - DNA, 21 bp, Homo sapiens
gaggccccttgctgctggctc

SEQ ID NO: 4308504 - DNA, 14 bp, Homo sapiens
gaggccgaggcagg

SEQ ID NO: 4308505 - DNA, 19 bp, Homo sapiens
gaggccgaggcaggggctg

SEQ ID NO: 4308506 - DNA, 21 bp, Homo sapiens
gaggcctcagtggactttcca

SEQ ID NO: 4308507 - DNA, 13 bp, Homo sapiens
gaggcctgagggg

SEQ ID NO: 4308508 - DNA, 12 bp, Homo sapiens
gaggcctggtgc

SEQ ID NO: 4308509 - DNA, 18 bp, Homo sapiens
gaggcctggtgccctggc

SEQ ID NO: 4308510 - DNA, 21 bp, Homo sapiens
gaggcgagccagattaggcct

SEQ ID NO: 4308511 - DNA, 22 bp, Homo sapiens
gaggcgagccagattaggcctg

SEQ ID NO: 4308512 - DNA, 20 bp, Homo sapiens
gaggcgccttcctgggttgg

SEQ ID NO: 4308513 - DNA, 20 bp, Homo sapiens
gaggcgtgggatccagagag

SEQ ID NO: 4308514 - DNA, 16 bp, Homo sapiens
gaggctaagcctggac

SEQ ID NO: 4308515 - DNA, 21 bp, Homo sapiens
gaggctattcctaggcctcag

SEQ ID NO: 4308516 - DNA, 19 bp, Homo sapiens
gaggctgggtggccggccc

SEQ ID NO: 4308517 - DNA, 20 bp, Homo sapiens
gaggctgggtggccggccct

SEQ ID NO: 4308518 - DNA, 21 bp, Homo sapiens
gaggctgggtggccggccctg

SEQ ID NO: 4308519 - DNA, 22 bp, Homo sapiens
gaggctgggtggccggccctgc

SEQ ID NO: 4308520 - DNA, 23 bp, Homo sapiens
gaggctgggtggccggccctgcc

SEQ ID NO: 4308521 - DNA, 17 bp, Homo sapiens
gaggcttgtcagagctg

SEQ ID NO: 4308522 - DNA, 19 bp, Homo sapiens
gaggcttgtcagagctggg

SEQ ID NO: 4308523 - DNA, 20 bp, Homo sapiens
gaggctttaagcgaggcaga

SEQ ID NO: 4308524 - DNA, 21 bp, Homo sapiens
gagggaaacccggggaactgg

SEQ ID NO: 4308525 - DNA, 14 bp, Homo sapiens
gagggacacagagg

SEQ ID NO: 4308526 - DNA, 17 bp, Homo sapiens
gagggatagagacgcag

SEQ ID NO: 4308527 - DNA, 12 bp, Homo sapiens
gagggcactggt

SEQ ID NO: 4308528 - DNA, 13 bp, Homo sapiens
gagggcccctcac

SEQ ID NO: 4308529 - DNA, 21 bp, Homo sapiens
gagggcccctcactggctgga

SEQ ID NO: 4308530 - DNA, 21 bp, Homo sapiens
gaggggactgcatgcaagctc

SEQ ID NO: 4308531 - DNA, 14 bp, Homo sapiens
gaggggagagaagg

SEQ ID NO: 4308532 - DNA, 13 bp, Homo sapiens
gaggggagaggaa

SEQ ID NO: 4308533 - DNA, 14 bp, Homo sapiens
gaggggcctcaggt

SEQ ID NO: 4308534 - DNA, 13 bp, Homo sapiens
gaggggcctggca

SEQ ID NO: 4308535 - DNA, 13 bp, Homo sapiens
gagggggcccggc

SEQ ID NO: 4308536 - DNA, 17 bp, Homo sapiens
gagggggcccggctggg

SEQ ID NO: 4308537 - DNA, 20 bp, Homo sapiens
gagggggcccggctgggccc

SEQ ID NO: 4308538 - DNA, 16 bp, Homo sapiens
gaggggtcagcagggg

SEQ ID NO: 4308539 - DNA, 14 bp, Homo sapiens
gagggtccctaggt

SEQ ID NO: 4308540 - DNA, 12 bp, Homo sapiens
gagggtttccac

SEQ ID NO: 4308541 - DNA, 20 bp, Homo sapiens
gaggtaacatagatgcctgg

SEQ ID NO: 4308542 - DNA, 24 bp, Homo sapiens
gaggtcatcccggggccatggaag

SEQ ID NO: 4308543 - DNA, 19 bp, Homo sapiens
gaggtctgctcggccgtct

SEQ ID NO: 4308544 - DNA, 23 bp, Homo sapiens
gaggtctgctcggccgtcttcac

SEQ ID NO: 4308545 - DNA, 19 bp, Homo sapiens
gaggtgcctgagagcagaa

SEQ ID NO: 4308546 - DNA, 22 bp, Homo sapiens
gaggtgggccttccatgggcat

SEQ ID NO: 4308547 - DNA, 18 bp, Homo sapiens
gaggtgtggagtggaggg

SEQ ID NO: 4308548 - DNA, 16 bp, Homo sapiens
gaggtttagcgtttta

SEQ ID NO: 4308549 - DNA, 14 bp, Homo sapiens
gagtaaaaccaaag

SEQ ID NO: 4308550 - DNA, 16 bp, Homo sapiens
gagtaaaaccaaaggt

SEQ ID NO: 4308551 - DNA, 19 bp, Homo sapiens
gagtaaaattacagaagaa

SEQ ID NO: 4308552 - DNA, 15 bp, Homo sapiens
gagtaggtgggtctt

SEQ ID NO: 4308553 - DNA, 11 bp, Homo sapiens
gagtatatatg

SEQ ID NO: 4308554 - DNA, 19 bp, Homo sapiens
gagtatatatgtacagtta

SEQ ID NO: 4308555 - DNA, 19 bp, Homo sapiens
gagtatgcaagaagaatat

SEQ ID NO: 4308556 - DNA, 22 bp, Homo sapiens
gagtatgcaagaagaatataaa

SEQ ID NO: 4308557 - DNA, 21 bp, Homo sapiens
gagtatggtgctgggtcctta

SEQ ID NO: 4308558 - DNA, 19 bp, Homo sapiens
gagtcaagtgtgcctgcta

SEQ ID NO: 4308559 - DNA, 14 bp, Homo sapiens
gagtcagggagccc

SEQ ID NO: 4308560 - DNA, 17 bp, Homo sapiens
gagtcagggagccctgg

SEQ ID NO: 4308561 - DNA, 18 bp, Homo sapiens
gagtccagacctgggccc

SEQ ID NO: 4308562 - DNA, 17 bp, Homo sapiens
gagtccattgcaaaagg

SEQ ID NO: 4308563 - DNA, 18 bp, Homo sapiens
gagtcctgttctcagagc

SEQ ID NO: 4308564 - DNA, 16 bp, Homo sapiens
gagtctcattcctctg

SEQ ID NO: 4308565 - DNA, 17 bp, Homo sapiens
gagtctcttctccactg

SEQ ID NO: 4308566 - DNA, 15 bp, Homo sapiens
gagtctggagaccag

SEQ ID NO: 4308567 - DNA, 18 bp, Homo sapiens
gagtctggagaccaggac

SEQ ID NO: 4308568 - DNA, 20 bp, Homo sapiens
gagtctggagaccaggactc

SEQ ID NO: 4308569 - DNA, 20 bp, Homo sapiens
gagtctgtgaataaagccac

SEQ ID NO: 4308570 - DNA, 15 bp, Homo sapiens
gagtctttttagtgt

SEQ ID NO: 4308571 - DNA, 22 bp, Homo sapiens
gagtgagaaatttttttccaga

SEQ ID NO: 4308572 - DNA, 15 bp, Homo sapiens
gagtgcccatggggt

SEQ ID NO: 4308573 - DNA, 12 bp, Homo sapiens
gagtgccccaga

SEQ ID NO: 4308574 - DNA, 17 bp, Homo sapiens
gagtgccccagaaatgc

SEQ ID NO: 4308575 - DNA, 22 bp, Homo sapiens
gagtgccccagaaatgccgctg

SEQ ID NO: 4308576 - DNA, 15 bp, Homo sapiens
gagtggctcctcccg

SEQ ID NO: 4308577 - DNA, 18 bp, Homo sapiens
gagtgggacagagtctgg

SEQ ID NO: 4308578 - DNA, 15 bp, Homo sapiens
gagtgggctctgagc

SEQ ID NO: 4308579 - DNA, 18 bp, Homo sapiens
gagtggggctagactggg

SEQ ID NO: 4308580 - DNA, 22 bp, Homo sapiens
gagtggggctagactgggctgg

SEQ ID NO: 4308581 - DNA, 17 bp, Homo sapiens
gagtggtccacattctg

SEQ ID NO: 4308582 - DNA, 20 bp, Homo sapiens
gagtgtgaatataaatgtgt

SEQ ID NO: 4308583 - DNA, 22 bp, Homo sapiens
gagtgtgacgggggttggggtg

SEQ ID NO: 4308584 - DNA, 14 bp, Homo sapiens
gagttcaaatactt

SEQ ID NO: 4308585 - DNA, 15 bp, Homo sapiens
gagttcaaatacttt

SEQ ID NO: 4308586 - DNA, 12 bp, Homo sapiens
gagttgggctgg

SEQ ID NO: 4308587 - DNA, 11 bp, Homo sapiens
gagttgggggt

SEQ ID NO: 4308588 - DNA, 22 bp, Homo sapiens
gagtttgctgtatacaaacagg

SEQ ID NO: 4308589 - DNA, 17 bp, Homo sapiens
gataacactggagtggt

SEQ ID NO: 4308590 - DNA, 15 bp, Homo sapiens
gataagcctgaaaca

SEQ ID NO: 4308591 - DNA, 12 bp, Homo sapiens
gataagtggaaa

SEQ ID NO: 4308592 - DNA, 19 bp, Homo sapiens
gataagtggaaaaaagaga

SEQ ID NO: 4308593 - DNA, 18 bp, Homo sapiens
gataataactagatctcc

SEQ ID NO: 4308594 - DNA, 18 bp, Homo sapiens
gatacactcaagcatgaa

SEQ ID NO: 4308595 - DNA, 15 bp, Homo sapiens
gatacgtgtcaatgt

SEQ ID NO: 4308596 - DNA, 17 bp, Homo sapiens
gatactgtctaagaata

SEQ ID NO: 4308597 - DNA, 15 bp, Homo sapiens
gatagcctagggtga

SEQ ID NO: 4308598 - DNA, 12 bp, Homo sapiens
gatatatctgaa

SEQ ID NO: 4308599 - DNA, 14 bp, Homo sapiens
gatatatctgaaaa

SEQ ID NO: 4308600 - DNA, 19 bp, Homo sapiens
gatattacaatggccagcc

SEQ ID NO: 4308601 - DNA, 18 bp, Homo sapiens
gatattcatactttccaa

SEQ ID NO: 4308602 - DNA, 23 bp, Homo sapiens
gatattctaagaaatatctgtga

SEQ ID NO: 4308603 - DNA, 17 bp, Homo sapiens
gatattgctgaagaatc

SEQ ID NO: 4308604 - DNA, 19 bp, Homo sapiens
gatattttcaacgcagccc

SEQ ID NO: 4308605 - DNA, 15 bp, Homo sapiens
gatatttttaattta

SEQ ID NO: 4308606 - DNA, 20 bp, Homo sapiens
gatcattggtatctgatatc

SEQ ID NO: 4308607 - DNA, 18 bp, Homo sapiens
gatccccgacagtggctc

SEQ ID NO: 4308608 - DNA, 16 bp, Homo sapiens
gatcctcaaaaatcat

SEQ ID NO: 4308609 - DNA, 23 bp, Homo sapiens
gatcctccttccaggccccaggc

SEQ ID NO: 4308610 - DNA, 18 bp, Homo sapiens
gatctccaggcccagcct

SEQ ID NO: 4308611 - DNA, 19 bp, Homo sapiens
gatctccaggcccagcctg

SEQ ID NO: 4308612 - DNA, 20 bp, Homo sapiens
gatctctttctaaagacagg

SEQ ID NO: 4308613 - DNA, 16 bp, Homo sapiens
gatctgctccatgcag

SEQ ID NO: 4308614 - DNA, 21 bp, Homo sapiens
gatctgctgacagatgttcca

SEQ ID NO: 4308615 - DNA, 18 bp, Homo sapiens
gatcttccttccgctctg

SEQ ID NO: 4308616 - DNA, 23 bp, Homo sapiens
gatcttccttccgctctgaggca

SEQ ID NO: 4308617 - DNA, 22 bp, Homo sapiens
gatcttgagcaaggcaagaagt

SEQ ID NO: 4308618 - DNA, 17 bp, Homo sapiens
gatgaaattccatttgt

SEQ ID NO: 4308619 - DNA, 13 bp, Homo sapiens
gatgaagaagaaa

SEQ ID NO: 4308620 - DNA, 17 bp, Homo sapiens
gatgaataaacactttt

SEQ ID NO: 4308621 - DNA, 15 bp, Homo sapiens
gatgacacaaatacc

SEQ ID NO: 4308622 - DNA, 15 bp, Homo sapiens
gatgacacataaatc

SEQ ID NO: 4308623 - DNA, 18 bp, Homo sapiens
gatgacacataaatctgt

SEQ ID NO: 4308624 - DNA, 13 bp, Homo sapiens
gatgacagggagc

SEQ ID NO: 4308625 - DNA, 22 bp, Homo sapiens
gatgacctccttagaaaagact

SEQ ID NO: 4308626 - DNA, 18 bp, Homo sapiens
gatgcgtggctcccagca

SEQ ID NO: 4308627 - DNA, 17 bp, Homo sapiens
gatgctccagccaaccc

SEQ ID NO: 4308628 - DNA, 22 bp, Homo sapiens
gatgctccagccaacccctgtg

SEQ ID NO: 4308629 - DNA, 23 bp, Homo sapiens
gatgctccagccaacccctgtgg

SEQ ID NO: 4308630 - DNA, 17 bp, Homo sapiens
gatgctgactgtactcc

SEQ ID NO: 4308631 - DNA, 20 bp, Homo sapiens
gatgctgactgtactcctcc

SEQ ID NO: 4308632 - DNA, 18 bp, Homo sapiens
gatgctgggttctggggc

SEQ ID NO: 4308633 - DNA, 20 bp, Homo sapiens
gatggaacccttttggcccc

SEQ ID NO: 4308634 - DNA, 22 bp, Homo sapiens
gatggaacccttttggcccccg

SEQ ID NO: 4308635 - DNA, 15 bp, Homo sapiens
gatggatctgctcca

SEQ ID NO: 4308636 - DNA, 22 bp, Homo sapiens
gatggatctgctccatgcagat

SEQ ID NO: 4308637 - DNA, 14 bp, Homo sapiens
gatggccaggcctc

SEQ ID NO: 4308638 - DNA, 15 bp, Homo sapiens
gatggcgtgtcccct

SEQ ID NO: 4308639 - DNA, 21 bp, Homo sapiens
gatggctccctgggctggcat

SEQ ID NO: 4308640 - DNA, 14 bp, Homo sapiens
gatgggagtaagag

SEQ ID NO: 4308641 - DNA, 16 bp, Homo sapiens
gatgggatcattattt

SEQ ID NO: 4308642 - DNA, 13 bp, Homo sapiens
gatgggcacaggc

SEQ ID NO: 4308643 - DNA, 14 bp, Homo sapiens
gatgggcacaggct

SEQ ID NO: 4308644 - DNA, 10 bp, Homo sapiens
gatgggtggg

SEQ ID NO: 4308645 - DNA, 16 bp, Homo sapiens
gatggtaatcttttct

SEQ ID NO: 4308646 - DNA, 17 bp, Homo sapiens
gatggtaatcttttctg

SEQ ID NO: 4308647 - DNA, 19 bp, Homo sapiens
gatgtaccatgttaaagag

SEQ ID NO: 4308648 - DNA, 14 bp, Homo sapiens
gatgtcaaccttgt

SEQ ID NO: 4308649 - DNA, 22 bp, Homo sapiens
gatgtcaagctggccgtggagt

SEQ ID NO: 4308650 - DNA, 15 bp, Homo sapiens
gatgtcttgagagcg

SEQ ID NO: 4308651 - DNA, 22 bp, Homo sapiens
gatgtcttgagagcgctggcct

SEQ ID NO: 4308652 - DNA, 19 bp, Homo sapiens
gatgtgagttgcacagcta

SEQ ID NO: 4308653 - DNA, 19 bp, Homo sapiens
gatgtggatggaggtgatg

SEQ ID NO: 4308654 - DNA, 20 bp, Homo sapiens
gatgtgtggctcattctttt

SEQ ID NO: 4308655 - DNA, 12 bp, Homo sapiens
gatgttaaaaca

SEQ ID NO: 4308656 - DNA, 20 bp, Homo sapiens
gattaatctctaaaattcta

SEQ ID NO: 4308657 - DNA, 15 bp, Homo sapiens
gattaggcctggagt

SEQ ID NO: 4308658 - DNA, 23 bp, Homo sapiens
gattaggcctggagttgggctgg

SEQ ID NO: 4308659 - DNA, 13 bp, Homo sapiens
gattcaaatgcat

SEQ ID NO: 4308660 - DNA, 15 bp, Homo sapiens
gattcaggaatgggc

SEQ ID NO: 4308661 - DNA, 23 bp, Homo sapiens
gattccaaataaaacttgagccc

SEQ ID NO: 4308662 - DNA, 17 bp, Homo sapiens
gattccaagggcccaga

SEQ ID NO: 4308663 - DNA, 20 bp, Homo sapiens
gattccagagagtggctcct

SEQ ID NO: 4308664 - DNA, 22 bp, Homo sapiens
gattccagagagtggctcctcc

SEQ ID NO: 4308665 - DNA, 16 bp, Homo sapiens
gattccccggagctgg

SEQ ID NO: 4308666 - DNA, 21 bp, Homo sapiens
gattccccggagctgggaagg

SEQ ID NO: 4308667 - DNA, 14 bp, Homo sapiens
gattctaaattatg

SEQ ID NO: 4308668 - DNA, 16 bp, Homo sapiens
gattctaaattatgtg

SEQ ID NO: 4308669 - DNA, 21 bp, Homo sapiens
gattctatgcctgtatttcca

SEQ ID NO: 4308670 - DNA, 12 bp, Homo sapiens
gattctcctctc

SEQ ID NO: 4308671 - DNA, 20 bp, Homo sapiens
gattctgtgggcagctggct

SEQ ID NO: 4308672 - DNA, 22 bp, Homo sapiens
gattctgtgggcagctggctct

SEQ ID NO: 4308673 - DNA, 22 bp, Homo sapiens
gattgggggggcttggggtaga

SEQ ID NO: 4308674 - DNA, 14 bp, Homo sapiens
gattggtaccagag

SEQ ID NO: 4308675 - DNA, 15 bp, Homo sapiens
gattggttcatgcct

SEQ ID NO: 4308676 - DNA, 20 bp, Homo sapiens
gattgtacatatggaaatcc

SEQ ID NO: 4308677 - DNA, 18 bp, Homo sapiens
gattgtccacaaatgtcc

SEQ ID NO: 4308678 - DNA, 17 bp, Homo sapiens
gatttagagactgtaaa

SEQ ID NO: 4308679 - DNA, 17 bp, Homo sapiens
gatttcaagggactggg

SEQ ID NO: 4308680 - DNA, 14 bp, Homo sapiens
gatttccaagcctc

SEQ ID NO: 4308681 - DNA, 15 bp, Homo sapiens
gatttccatttgcaa

SEQ ID NO: 4308682 - DNA, 14 bp, Homo sapiens
gatttcctaagctg

SEQ ID NO: 4308683 - DNA, 21 bp, Homo sapiens
gatttctcacactctaactgt

SEQ ID NO: 4308684 - DNA, 15 bp, Homo sapiens
gatttgaaacttggt

SEQ ID NO: 4308685 - DNA, 21 bp, Homo sapiens
gatttgcaaatgcacatttgt

SEQ ID NO: 4308686 - DNA, 19 bp, Homo sapiens
gatttgggctgaatgtatg

SEQ ID NO: 4308687 - DNA, 16 bp, Homo sapiens
gatttgtatttatatt

SEQ ID NO: 4308688 - DNA, 20 bp, Homo sapiens
gatttgtatttatattagag

SEQ ID NO: 4308689 - DNA, 20 bp, Homo sapiens
gattttattttcaagcaaat

SEQ ID NO: 4308690 - DNA, 14 bp, Homo sapiens
gattttcatgttct

SEQ ID NO: 4308691 - DNA, 21 bp, Homo sapiens
gatttttttttttttcctgtc

SEQ ID NO: 4308692 - DNA, 11 bp, Homo sapiens
gcaaaaatatt

SEQ ID NO: 4308693 - DNA, 17 bp, Homo sapiens
gcaaaaggttaagccat

SEQ ID NO: 4308694 - DNA, 19 bp, Homo sapiens
gcaaacacacagactctgt

SEQ ID NO: 4308695 - DNA, 21 bp, Homo sapiens
gcaaacatggggttggctggg

SEQ ID NO: 4308696 - DNA, 18 bp, Homo sapiens
gcaaactgaagcccacag

SEQ ID NO: 4308697 - DNA, 14 bp, Homo sapiens
gcaaagaatcaaca

SEQ ID NO: 4308698 - DNA, 16 bp, Homo sapiens
gcaaagatatctcatc

SEQ ID NO: 4308699 - DNA, 21 bp, Homo sapiens
gcaaagcatgccaatttctct

SEQ ID NO: 4308700 - DNA, 18 bp, Homo sapiens
gcaaatgcacatttgtca

SEQ ID NO: 4308701 - DNA, 15 bp, Homo sapiens
gcaaatgtccaagca

SEQ ID NO: 4308702 - DNA, 15 bp, Homo sapiens
gcaaattattctagt

SEQ ID NO: 4308703 - DNA, 16 bp, Homo sapiens
gcaaattattctagtc

SEQ ID NO: 4308704 - DNA, 16 bp, Homo sapiens
gcaaatttcatctttc

SEQ ID NO: 4308705 - DNA, 20 bp, Homo sapiens
gcaaatttcatctttccaaa

SEQ ID NO: 4308706 - DNA, 15 bp, Homo sapiens
gcaacaaaggatttg

SEQ ID NO: 4308707 - DNA, 22 bp, Homo sapiens
gcaacactgccagaagtgtgtt

SEQ ID NO: 4308708 - DNA, 15 bp, Homo sapiens
gcaacttgaaattat

SEQ ID NO: 4308709 - DNA, 15 bp, Homo sapiens
gcaactttagaaaga

SEQ ID NO: 4308710 - DNA, 20 bp, Homo sapiens
gcaactttagaaagaaattg

SEQ ID NO: 4308711 - DNA, 22 bp, Homo sapiens
gcaagacacccagtggaaccaa

SEQ ID NO: 4308712 - DNA, 11 bp, Homo sapiens
gcaagaggagt

SEQ ID NO: 4308713 - DNA, 18 bp, Homo sapiens
gcaagattctgtgggcag

SEQ ID NO: 4308714 - DNA, 22 bp, Homo sapiens
gcaagattctgtgggcagctgg

SEQ ID NO: 4308715 - DNA, 18 bp, Homo sapiens
gcaagcctcagccactcc

SEQ ID NO: 4308716 - DNA, 17 bp, Homo sapiens
gcaagctcagggtgctc

SEQ ID NO: 4308717 - DNA, 17 bp, Homo sapiens
gcaaggcaagaagtggg

SEQ ID NO: 4308718 - DNA, 19 bp, Homo sapiens
gcaaggccagccctggttc

SEQ ID NO: 4308719 - DNA, 20 bp, Homo sapiens
gcaagtcccagggagctctg

SEQ ID NO: 4308720 - DNA, 15 bp, Homo sapiens
gcaagtggttaagaa

SEQ ID NO: 4308721 - DNA, 17 bp, Homo sapiens
gcaataaactcagtcaa

SEQ ID NO: 4308722 - DNA, 20 bp, Homo sapiens
gcaatatcttcgttagtaat

SEQ ID NO: 4308723 - DNA, 16 bp, Homo sapiens
gcacaaggagtgcccg

SEQ ID NO: 4308724 - DNA, 21 bp, Homo sapiens
gcacaattctgtccctgtccc

SEQ ID NO: 4308725 - DNA, 16 bp, Homo sapiens
gcacacacacacacag

SEQ ID NO: 4308726 - DNA, 18 bp, Homo sapiens
gcacacacctgcacaccg

SEQ ID NO: 4308727 - DNA, 16 bp, Homo sapiens
gcacacccctgcacac

SEQ ID NO: 4308728 - DNA, 18 bp, Homo sapiens
gcacacccctgcacacac

SEQ ID NO: 4308729 - DNA, 18 bp, Homo sapiens
gcacaccctctctgtcca

SEQ ID NO: 4308730 - DNA, 16 bp, Homo sapiens
gcacaccgtccctctc

SEQ ID NO: 4308731 - DNA, 18 bp, Homo sapiens
gcacaccgtccctctccc

SEQ ID NO: 4308732 - DNA, 23 bp, Homo sapiens
gcacacctcggccgaggcctgcg

SEQ ID NO: 4308733 - DNA, 18 bp, Homo sapiens
gcacactgccctctgcca

SEQ ID NO: 4308734 - DNA, 12 bp, Homo sapiens
gcacacttcccc

SEQ ID NO: 4308735 - DNA, 22 bp, Homo sapiens
gcacagaaggaaggagccagct

SEQ ID NO: 4308736 - DNA, 20 bp, Homo sapiens
gcacagaggatggcttcccc

SEQ ID NO: 4308737 - DNA, 13 bp, Homo sapiens
gcacagctatgaa

SEQ ID NO: 4308738 - DNA, 16 bp, Homo sapiens
gcacagggcagtggga

SEQ ID NO: 4308739 - DNA, 18 bp, Homo sapiens
gcacattgccctgagggg

SEQ ID NO: 4308740 - DNA, 20 bp, Homo sapiens
gcacattgccctgaggggcc

SEQ ID NO: 4308741 - DNA, 17 bp, Homo sapiens
gcaccaacctcactgcc

SEQ ID NO: 4308742 - DNA, 22 bp, Homo sapiens
gcaccaacctcactgccctccc

SEQ ID NO: 4308743 - DNA, 22 bp, Homo sapiens
gcaccccaccacacacaccctt

SEQ ID NO: 4308744 - DNA, 13 bp, Homo sapiens
gcacccccaccct

SEQ ID NO: 4308745 - DNA, 23 bp, Homo sapiens
gcacccctggtgtccctgcctgg

SEQ ID NO: 4308746 - DNA, 22 bp, Homo sapiens
gcacccgtgccacgcgctctgc

SEQ ID NO: 4308747 - DNA, 22 bp, Homo sapiens
gcaccctctgctatgtctgtga

SEQ ID NO: 4308748 - DNA, 23 bp, Homo sapiens
gcaccctctgctatgtctgtgat

SEQ ID NO: 4308749 - DNA, 23 bp, Homo sapiens
gcacctctgctgtattgatatca

SEQ ID NO: 4308750 - DNA, 13 bp, Homo sapiens
gcacctgcaggga

SEQ ID NO: 4308751 - DNA, 16 bp, Homo sapiens
gcacctgcagggagca

SEQ ID NO: 4308752 - DNA, 12 bp, Homo sapiens
gcacctgcttct

SEQ ID NO: 4308753 - DNA, 14 bp, Homo sapiens
gcacctgcttctca

SEQ ID NO: 4308754 - DNA, 16 bp, Homo sapiens
gcacctgggtgtgctc

SEQ ID NO: 4308755 - DNA, 20 bp, Homo sapiens
gcacctgggtgtgctccagg

SEQ ID NO: 4308756 - DNA, 22 bp, Homo sapiens
gcacctgggtgtgctccaggct

SEQ ID NO: 4308757 - DNA, 23 bp, Homo sapiens
gcacctgggtgtgctccaggctt

SEQ ID NO: 4308758 - DNA, 16 bp, Homo sapiens
gcacgcaagcctcagc

SEQ ID NO: 4308759 - DNA, 22 bp, Homo sapiens
gcacgcaagcctcagccactcc

SEQ ID NO: 4308760 - DNA, 15 bp, Homo sapiens
gcacgcctgccttct

SEQ ID NO: 4308761 - DNA, 11 bp, Homo sapiens
gcactgccctc

SEQ ID NO: 4308762 - DNA, 20 bp, Homo sapiens
gcactgccctccgcccttcc

SEQ ID NO: 4308763 - DNA, 12 bp, Homo sapiens
gcactggaggcc

SEQ ID NO: 4308764 - DNA, 17 bp, Homo sapiens
gcactggaggcctctgc

SEQ ID NO: 4308765 - DNA, 20 bp, Homo sapiens
gcactggaggcctctgcaag

SEQ ID NO: 4308766 - DNA, 21 bp, Homo sapiens
gcactggccttctgatgaaat

SEQ ID NO: 4308767 - DNA, 19 bp, Homo sapiens
gcactggtggcccgacagc

SEQ ID NO: 4308768 - DNA, 22 bp, Homo sapiens
gcactggtggcccgacagcctg

SEQ ID NO: 4308769 - DNA, 22 bp, Homo sapiens
gcacttaagcacaagcagagtg

SEQ ID NO: 4308770 - DNA, 12 bp, Homo sapiens
gcacttggcctc

SEQ ID NO: 4308771 - DNA, 15 bp, Homo sapiens
gcacttggctgcata

SEQ ID NO: 4308772 - DNA, 18 bp, Homo sapiens
gcagaactgagctcctct

SEQ ID NO: 4308773 - DNA, 15 bp, Homo sapiens
gcagaagagaaagta

SEQ ID NO: 4308774 - DNA, 12 bp, Homo sapiens
gcagaaggcctt

SEQ ID NO: 4308775 - DNA, 21 bp, Homo sapiens
gcagaatggtgggctccagag

SEQ ID NO: 4308776 - DNA, 24 bp, Homo sapiens
gcagaccaggaaggaagagcaagc

SEQ ID NO: 4308777 - DNA, 13 bp, Homo sapiens
gcagactcactgt

SEQ ID NO: 4308778 - DNA, 20 bp, Homo sapiens
gcagagattgggggggcttg

SEQ ID NO: 4308779 - DNA, 13 bp, Homo sapiens
gcagagcctgggg

SEQ ID NO: 4308780 - DNA, 19 bp, Homo sapiens
gcagagctcagcacagcct

SEQ ID NO: 4308781 - DNA, 14 bp, Homo sapiens
gcagaggggagagg

SEQ ID NO: 4308782 - DNA, 19 bp, Homo sapiens
gcagagtaaaattacagaa

SEQ ID NO: 4308783 - DNA, 15 bp, Homo sapiens
gcagagtgcacagct

SEQ ID NO: 4308784 - DNA, 18 bp, Homo sapiens
gcagagtgcacagctgtc

SEQ ID NO: 4308785 - DNA, 18 bp, Homo sapiens
gcagatctagccaggcct

SEQ ID NO: 4308786 - DNA, 23 bp, Homo sapiens
gcagatttcagatgtaagaagcc

SEQ ID NO: 4308787 - DNA, 17 bp, Homo sapiens
gcagcacaattctgtcc

SEQ ID NO: 4308788 - DNA, 18 bp, Homo sapiens
gcagcacaattctgtccc

SEQ ID NO: 4308789 - DNA, 21 bp, Homo sapiens
gcagcacattgccctgagggg

SEQ ID NO: 4308790 - DNA, 22 bp, Homo sapiens
gcagcacattgccctgaggggc

SEQ ID NO: 4308791 - DNA, 21 bp, Homo sapiens
gcagcacgccaaccccagcag

SEQ ID NO: 4308792 - DNA, 20 bp, Homo sapiens
gcagcatcaacctaggagca

SEQ ID NO: 4308793 - DNA, 12 bp, Homo sapiens
gcagccaccctg

SEQ ID NO: 4308794 - DNA, 17 bp, Homo sapiens
gcagccaccctgccatg

SEQ ID NO: 4308795 - DNA, 16 bp, Homo sapiens
gcagcccacctgctgc

SEQ ID NO: 4308796 - DNA, 16 bp, Homo sapiens
gcagccccaggcctcc

SEQ ID NO: 4308797 - DNA, 17 bp, Homo sapiens
gcagccccctcctgacc

SEQ ID NO: 4308798 - DNA, 14 bp, Homo sapiens
gcagcccctcccca

SEQ ID NO: 4308799 - DNA, 23 bp, Homo sapiens
gcagcccgggagatccgccctgg

SEQ ID NO: 4308800 - DNA, 15 bp, Homo sapiens
gcagcccgtgtggcc

SEQ ID NO: 4308801 - DNA, 20 bp, Homo sapiens
gcagcccgtgtggccccttc

SEQ ID NO: 4308802 - DNA, 14 bp, Homo sapiens
gcagccctgctttg

SEQ ID NO: 4308803 - DNA, 13 bp, Homo sapiens
gcagccggggagc

SEQ ID NO: 4308804 - DNA, 14 bp, Homo sapiens
gcagcctcagaggc

SEQ ID NO: 4308805 - DNA, 18 bp, Homo sapiens
gcagcctcagaggcccct

SEQ ID NO: 4308806 - DNA, 23 bp, Homo sapiens
gcagcctcagaggccccttgctg

SEQ ID NO: 4308807 - DNA, 15 bp, Homo sapiens
gcagcctgtgggaga

SEQ ID NO: 4308808 - DNA, 23 bp, Homo sapiens
gcagcctgtgggagaagggacag

SEQ ID NO: 4308809 - DNA, 21 bp, Homo sapiens
gcagcgtctgagcggccgcct

SEQ ID NO: 4308810 - DNA, 22 bp, Homo sapiens
gcagctgcagttagcacagagg

SEQ ID NO: 4308811 - DNA, 11 bp, Homo sapiens
gcaggaaatag

SEQ ID NO: 4308812 - DNA, 15 bp, Homo sapiens
gcaggaagcaaggcc

SEQ ID NO: 4308813 - DNA, 18 bp, Homo sapiens
gcaggaagcaaggccagc

SEQ ID NO: 4308814 - DNA, 14 bp, Homo sapiens
gcaggaaggtctca

SEQ ID NO: 4308815 - DNA, 21 bp, Homo sapiens
gcaggaaggtctcatgcctga

SEQ ID NO: 4308816 - DNA, 22 bp, Homo sapiens
gcaggaaggtctcatgcctgag

SEQ ID NO: 4308817 - DNA, 16 bp, Homo sapiens
gcaggaagtcaggagc

SEQ ID NO: 4308818 - DNA, 15 bp, Homo sapiens
gcaggaagtccctga

SEQ ID NO: 4308819 - DNA, 17 bp, Homo sapiens
gcaggaagtccctgaga

SEQ ID NO: 4308820 - DNA, 19 bp, Homo sapiens
gcaggaatcaaaaattgaa

SEQ ID NO: 4308821 - DNA, 11 bp, Homo sapiens
gcaggacctca

SEQ ID NO: 4308822 - DNA, 14 bp, Homo sapiens
gcaggacctcagag

SEQ ID NO: 4308823 - DNA, 16 bp, Homo sapiens
gcaggacctcagagtc

SEQ ID NO: 4308824 - DNA, 14 bp, Homo sapiens
gcaggagcctagag

SEQ ID NO: 4308825 - DNA, 13 bp, Homo sapiens
gcaggaggacagg

SEQ ID NO: 4308826 - DNA, 17 bp, Homo sapiens
gcaggagggtggcactt

SEQ ID NO: 4308827 - DNA, 13 bp, Homo sapiens
gcaggcagagctc

SEQ ID NO: 4308828 - DNA, 23 bp, Homo sapiens
gcaggcagagctcagcacagcct

SEQ ID NO: 4308829 - DNA, 24 bp, Homo sapiens
gcaggcagagctcagcacagcctc

SEQ ID NO: 4308830 - DNA, 18 bp, Homo sapiens
gcaggcccctttggacct

SEQ ID NO: 4308831 - DNA, 15 bp, Homo sapiens
gcaggcggtatccag

SEQ ID NO: 4308832 - DNA, 16 bp, Homo sapiens
gcaggctggcaccgcc

SEQ ID NO: 4308833 - DNA, 23 bp, Homo sapiens
gcagggaccaagatgtcaagctg

SEQ ID NO: 4308834 - DNA, 14 bp, Homo sapiens
gcagggagaccctg

SEQ ID NO: 4308835 - DNA, 15 bp, Homo sapiens
gcagggagaccctgg

SEQ ID NO: 4308836 - DNA, 16 bp, Homo sapiens
gcagggagaccctggg

SEQ ID NO: 4308837 - DNA, 12 bp, Homo sapiens
gcagggcagcct

SEQ ID NO: 4308838 - DNA, 23 bp, Homo sapiens
gcagggccagtcatggctgtccc

SEQ ID NO: 4308839 - DNA, 18 bp, Homo sapiens
gcagggcgggccaggaga

SEQ ID NO: 4308840 - DNA, 18 bp, Homo sapiens
gcaggggccgcttcgcca

SEQ ID NO: 4308841 - DNA, 23 bp, Homo sapiens
gcaggggccgcttcgccatgtgc

SEQ ID NO: 4308842 - DNA, 15 bp, Homo sapiens
gcaggggctgcatcc

SEQ ID NO: 4308843 - DNA, 14 bp, Homo sapiens
gcaggggctgggca

SEQ ID NO: 4308844 - DNA, 17 bp, Homo sapiens
gcaggggctgggcagag

SEQ ID NO: 4308845 - DNA, 13 bp, Homo sapiens
gcagggtctttgt

SEQ ID NO: 4308846 - DNA, 13 bp, Homo sapiens
gcagggttctaga

SEQ ID NO: 4308847 - DNA, 18 bp, Homo sapiens
gcagggttctagaagggg

SEQ ID NO: 4308848 - DNA, 23 bp, Homo sapiens
gcagggttctagaaggggcgagg

SEQ ID NO: 4308849 - DNA, 17 bp, Homo sapiens
gcaggtgaccttctggg

SEQ ID NO: 4308850 - DNA, 19 bp, Homo sapiens
gcaggtgaccttctgggaa

SEQ ID NO: 4308851 - DNA, 22 bp, Homo sapiens
gcaggtgtcatatatggggggc

SEQ ID NO: 4308852 - DNA, 17 bp, Homo sapiens
gcaggtgtgggctccca

SEQ ID NO: 4308853 - DNA, 15 bp, Homo sapiens
gcaggttctctcctg

SEQ ID NO: 4308854 - DNA, 17 bp, Homo sapiens
gcaggttctctcctgtg

SEQ ID NO: 4308855 - DNA, 22 bp, Homo sapiens
gcagtagaaggtcggaggcttg

SEQ ID NO: 4308856 - DNA, 17 bp, Homo sapiens
gcagtcacccctgtctg

SEQ ID NO: 4308857 - DNA, 13 bp, Homo sapiens
gcagtcctgggcc

SEQ ID NO: 4308858 - DNA, 21 bp, Homo sapiens
gcagtcctgggccccctggga

SEQ ID NO: 4308859 - DNA, 15 bp, Homo sapiens
gcagtgatgtggtgg

SEQ ID NO: 4308860 - DNA, 24 bp, Homo sapiens
gcagtggagaggggacttggatag

SEQ ID NO: 4308861 - DNA, 14 bp, Homo sapiens
gcagtggcagcaac

SEQ ID NO: 4308862 - DNA, 21 bp, Homo sapiens
gcagtgggacagggcatggcc

SEQ ID NO: 4308863 - DNA, 16 bp, Homo sapiens
gcagtgggccctggct

SEQ ID NO: 4308864 - DNA, 14 bp, Homo sapiens
gcagtgtagatttt

SEQ ID NO: 4308865 - DNA, 20 bp, Homo sapiens
gcagtgtgagggtgcaggga

SEQ ID NO: 4308866 - DNA, 14 bp, Homo sapiens
gcagttaccgagga

SEQ ID NO: 4308867 - DNA, 16 bp, Homo sapiens
gcagttgcaataaact

SEQ ID NO: 4308868 - DNA, 22 bp, Homo sapiens
gcagttggcctcagcagaaggc

SEQ ID NO: 4308869 - DNA, 14 bp, Homo sapiens
gcagtttgcctctg

SEQ ID NO: 4308870 - DNA, 17 bp, Homo sapiens
gcataagcctcaggcct

SEQ ID NO: 4308871 - DNA, 24 bp, Homo sapiens
gcataagcctcaggcctggccctt

SEQ ID NO: 4308872 - DNA, 19 bp, Homo sapiens
gcataagtggacccagctg

SEQ ID NO: 4308873 - DNA, 22 bp, Homo sapiens
gcatacccagtgtctaccttca

SEQ ID NO: 4308874 - DNA, 15 bp, Homo sapiens
gcatactctccagga

SEQ ID NO: 4308875 - DNA, 20 bp, Homo sapiens
gcatatcctggtgtctagtt

SEQ ID NO: 4308876 - DNA, 13 bp, Homo sapiens
gcatcagcaagac

SEQ ID NO: 4308877 - DNA, 14 bp, Homo sapiens
gcatcagcaagaca

SEQ ID NO: 4308878 - DNA, 19 bp, Homo sapiens
gcatcatcttgaacattaa

SEQ ID NO: 4308879 - DNA, 13 bp, Homo sapiens
gcatcatggctat

SEQ ID NO: 4308880 - DNA, 17 bp, Homo sapiens
gcatcattttcacctcc

SEQ ID NO: 4308881 - DNA, 18 bp, Homo sapiens
gcatcattttcacctcca

SEQ ID NO: 4308882 - DNA, 15 bp, Homo sapiens
gcatcccagtggcct

SEQ ID NO: 4308883 - DNA, 16 bp, Homo sapiens
gcatcccagtggcctc

SEQ ID NO: 4308884 - DNA, 17 bp, Homo sapiens
gcatcccagtggcctca

SEQ ID NO: 4308885 - DNA, 14 bp, Homo sapiens
gcatccccagcccc

SEQ ID NO: 4308886 - DNA, 13 bp, Homo sapiens
gcatcccttggcc

SEQ ID NO: 4308887 - DNA, 16 bp, Homo sapiens
gcatcccttggcccct

SEQ ID NO: 4308888 - DNA, 18 bp, Homo sapiens
gcatcccttggcccctct

SEQ ID NO: 4308889 - DNA, 22 bp, Homo sapiens
gcatcctcagccccagggccct

SEQ ID NO: 4308890 - DNA, 15 bp, Homo sapiens
gcatcctcagttcct

SEQ ID NO: 4308891 - DNA, 20 bp, Homo sapiens
gcatcctcagttcctgcagc

SEQ ID NO: 4308892 - DNA, 21 bp, Homo sapiens
gcatcctcagttcctgcagca

SEQ ID NO: 4308893 - DNA, 22 bp, Homo sapiens
gcatccttgaggacctccacct

SEQ ID NO: 4308894 - DNA, 21 bp, Homo sapiens
gcatctagaggcttccttcat

SEQ ID NO: 4308895 - DNA, 13 bp, Homo sapiens
gcatctccaggaa

SEQ ID NO: 4308896 - DNA, 14 bp, Homo sapiens
gcatctgctcttct

SEQ ID NO: 4308897 - DNA, 14 bp, Homo sapiens
gcatctggccctgc

SEQ ID NO: 4308898 - DNA, 18 bp, Homo sapiens
gcatctggccctgctgcc

SEQ ID NO: 4308899 - DNA, 20 bp, Homo sapiens
gcatgaaactatgcacctat

SEQ ID NO: 4308900 - DNA, 19 bp, Homo sapiens
gcatgacaagccccaggca

SEQ ID NO: 4308901 - DNA, 13 bp, Homo sapiens
gcatgagccagct

SEQ ID NO: 4308902 - DNA, 16 bp, Homo sapiens
gcatgatattgtatgt

SEQ ID NO: 4308903 - DNA, 17 bp, Homo sapiens
gcatgctcctctgcctg

SEQ ID NO: 4308904 - DNA, 21 bp, Homo sapiens
gcatgctcctctgcctgtgcc

SEQ ID NO: 4308905 - DNA, 13 bp, Homo sapiens
gcatgctgcctgc

SEQ ID NO: 4308906 - DNA, 16 bp, Homo sapiens
gcatgctgcctgcctc

SEQ ID NO: 4308907 - DNA, 20 bp, Homo sapiens
gcatgctgcctgcctccggc

SEQ ID NO: 4308908 - DNA, 13 bp, Homo sapiens
gcatggcctccca

SEQ ID NO: 4308909 - DNA, 17 bp, Homo sapiens
gcatggcctcccagcca

SEQ ID NO: 4308910 - DNA, 18 bp, Homo sapiens
gcatggcctcccagccac

SEQ ID NO: 4308911 - DNA, 13 bp, Homo sapiens
gcatggctccagt

SEQ ID NO: 4308912 - DNA, 13 bp, Homo sapiens
gcatggggagggg

SEQ ID NO: 4308913 - DNA, 14 bp, Homo sapiens
gcatggggagggga

SEQ ID NO: 4308914 - DNA, 15 bp, Homo sapiens
gcatggggaggggag

SEQ ID NO: 4308915 - DNA, 21 bp, Homo sapiens
gcatggggaggggagagaagg

SEQ ID NO: 4308916 - DNA, 19 bp, Homo sapiens
gcatggggtgggcctctgg

SEQ ID NO: 4308917 - DNA, 22 bp, Homo sapiens
gcatgtgattggcagcttcaaa

SEQ ID NO: 4308918 - DNA, 22 bp, Homo sapiens
gcatgtgttaatcttaatgtat

SEQ ID NO: 4308919 - DNA, 20 bp, Homo sapiens
gcatgtgtttggttctgggg

SEQ ID NO: 4308920 - DNA, 15 bp, Homo sapiens
gcattctcactccta

SEQ ID NO: 4308921 - DNA, 14 bp, Homo sapiens
gcatttaaaatgga

SEQ ID NO: 4308922 - DNA, 15 bp, Homo sapiens
gcatttaaaatggac

SEQ ID NO: 4308923 - DNA, 14 bp, Homo sapiens
gcatttaagaattg

SEQ ID NO: 4308924 - DNA, 19 bp, Homo sapiens
gcatttctgggccttatgt

SEQ ID NO: 4308925 - DNA, 21 bp, Homo sapiens
gcatttcttgatgttgcttag

SEQ ID NO: 4308926 - DNA, 19 bp, Homo sapiens
gcatttgtgagccaaagag

SEQ ID NO: 4308927 - DNA, 21 bp, Homo sapiens
gccaaaaactaaaattcaaca

SEQ ID NO: 4308928 - DNA, 20 bp, Homo sapiens
gccaaatcctgggcatcccc

SEQ ID NO: 4308929 - DNA, 14 bp, Homo sapiens
gccaaccccagcag

SEQ ID NO: 4308930 - DNA, 22 bp, Homo sapiens
gccaaccccagcagtcctgggc

SEQ ID NO: 4308931 - DNA, 22 bp, Homo sapiens
gccaagccagggttccagacag

SEQ ID NO: 4308932 - DNA, 17 bp, Homo sapiens
gccaagcctgccccggc

SEQ ID NO: 4308933 - DNA, 17 bp, Homo sapiens
gccaaggggtctgctcc

SEQ ID NO: 4308934 - DNA, 20 bp, Homo sapiens
gccaagtgcaggctggcacc

SEQ ID NO: 4308935 - DNA, 19 bp, Homo sapiens
gccaatggagactgtctca

SEQ ID NO: 4308936 - DNA, 12 bp, Homo sapiens
gccacacccagg

SEQ ID NO: 4308937 - DNA, 15 bp, Homo sapiens
gccacacccaggcac

SEQ ID NO: 4308938 - DNA, 20 bp, Homo sapiens
gccacacttcaggctcttct

SEQ ID NO: 4308939 - DNA, 14 bp, Homo sapiens
gccacaggcagacg

SEQ ID NO: 4308940 - DNA, 18 bp, Homo sapiens
gccacatgagtcccagtg

SEQ ID NO: 4308941 - DNA, 20 bp, Homo sapiens
gccacatgagtcccagtggg

SEQ ID NO: 4308942 - DNA, 14 bp, Homo sapiens
gccaccaaggctgc

SEQ ID NO: 4308943 - DNA, 17 bp, Homo sapiens
gccaccaaggctgcctg

SEQ ID NO: 4308944 - DNA, 18 bp, Homo sapiens
gccacccggatctccagg

SEQ ID NO: 4308945 - DNA, 19 bp, Homo sapiens
gccacccggatctccaggc

SEQ ID NO: 4308946 - DNA, 20 bp, Homo sapiens
gccacccggatctccaggcc

SEQ ID NO: 4308947 - DNA, 22 bp, Homo sapiens
gccacccggatctccaggccca

SEQ ID NO: 4308948 - DNA, 13 bp, Homo sapiens
gccaccctctgca

SEQ ID NO: 4308949 - DNA, 19 bp, Homo sapiens
gccaccctctgcagggcag

SEQ ID NO: 4308950 - DNA, 14 bp, Homo sapiens
gccacccttggcct

SEQ ID NO: 4308951 - DNA, 18 bp, Homo sapiens
gccacccttggcctgtcc

SEQ ID NO: 4308952 - DNA, 23 bp, Homo sapiens
gccacctgcccccttctcccaca

SEQ ID NO: 4308953 - DNA, 18 bp, Homo sapiens
gccacgcctctctcagcc

SEQ ID NO: 4308954 - DNA, 15 bp, Homo sapiens
gccacgcgctctgca

SEQ ID NO: 4308955 - DNA, 21 bp, Homo sapiens
gccacgcgctctgcatgctcc

SEQ ID NO: 4308956 - DNA, 20 bp, Homo sapiens
gccacggcagccaccctgcc

SEQ ID NO: 4308957 - DNA, 23 bp, Homo sapiens
gccacgggggaggccgaggcagg

SEQ ID NO: 4308958 - DNA, 15 bp, Homo sapiens
gccacgtgctggaga

SEQ ID NO: 4308959 - DNA, 16 bp, Homo sapiens
gccacgtgctggagag

SEQ ID NO: 4308960 - DNA, 16 bp, Homo sapiens
gccactccagacccct

SEQ ID NO: 4308961 - DNA, 18 bp, Homo sapiens
gccactccagacccctgg

SEQ ID NO: 4308962 - DNA, 16 bp, Homo sapiens
gccactctcctgagga

SEQ ID NO: 4308963 - DNA, 17 bp, Homo sapiens
gccactctcctgaggag

SEQ ID NO: 4308964 - DNA, 22 bp, Homo sapiens
gccactctcctgaggagcagcc

SEQ ID NO: 4308965 - DNA, 14 bp, Homo sapiens
gccactctgtttgc

SEQ ID NO: 4308966 - DNA, 12 bp, Homo sapiens
gccactgcagtc

SEQ ID NO: 4308967 - DNA, 15 bp, Homo sapiens
gccactgcagtcacc

SEQ ID NO: 4308968 - DNA, 17 bp, Homo sapiens
gccactggcatctctgg

SEQ ID NO: 4308969 - DNA, 21 bp, Homo sapiens
gccactggcatctctggagtg

SEQ ID NO: 4308970 - DNA, 20 bp, Homo sapiens
gccactttgcagacctggga

SEQ ID NO: 4308971 - DNA, 13 bp, Homo sapiens
gccagagctccca

SEQ ID NO: 4308972 - DNA, 14 bp, Homo sapiens
gccagagctcccag

SEQ ID NO: 4308973 - DNA, 18 bp, Homo sapiens
gccagagctcccaggacg

SEQ ID NO: 4308974 - DNA, 20 bp, Homo sapiens
gccagaggaagggaggcctg

SEQ ID NO: 4308975 - DNA, 21 bp, Homo sapiens
gccagaggcctggtgccctgg

SEQ ID NO: 4308976 - DNA, 22 bp, Homo sapiens
gccagaggcctggtgccctggc

SEQ ID NO: 4308977 - DNA, 17 bp, Homo sapiens
gccagagggcccctcac

SEQ ID NO: 4308978 - DNA, 14 bp, Homo sapiens
gccagcagggcggg

SEQ ID NO: 4308979 - DNA, 18 bp, Homo sapiens
gccagcagggcgggccag

SEQ ID NO: 4308980 - DNA, 16 bp, Homo sapiens
gccagcccagatggct

SEQ ID NO: 4308981 - DNA, 23 bp, Homo sapiens
gccagcccagatggctccctggg

SEQ ID NO: 4308982 - DNA, 20 bp, Homo sapiens
gccagcccctcccaccacag

SEQ ID NO: 4308983 - DNA, 15 bp, Homo sapiens
gccagccgctggtgc

SEQ ID NO: 4308984 - DNA, 16 bp, Homo sapiens
gccagccgctggtgcc

SEQ ID NO: 4308985 - DNA, 16 bp, Homo sapiens
gccagctccttagaca

SEQ ID NO: 4308986 - DNA, 19 bp, Homo sapiens
gccagctccttagacacct

SEQ ID NO: 4308987 - DNA, 13 bp, Homo sapiens
gccagctgcttct

SEQ ID NO: 4308988 - DNA, 15 bp, Homo sapiens
gccagctgcttctgc

SEQ ID NO: 4308989 - DNA, 19 bp, Homo sapiens
gccagctgcttctgcccac

SEQ ID NO: 4308990 - DNA, 15 bp, Homo sapiens
gccagggctccacgg

SEQ ID NO: 4308991 - DNA, 12 bp, Homo sapiens
gccagggtctcg

SEQ ID NO: 4308992 - DNA, 17 bp, Homo sapiens
gccagggttccagacag

SEQ ID NO: 4308993 - DNA, 23 bp, Homo sapiens
gccagggttccagacagggtggg

SEQ ID NO: 4308994 - DNA, 17 bp, Homo sapiens
gccaggtgtcctgactg

SEQ ID NO: 4308995 - DNA, 21 bp, Homo sapiens
gccagtgactccaggagagga

SEQ ID NO: 4308996 - DNA, 14 bp, Homo sapiens
gccagtgactgctg

SEQ ID NO: 4308997 - DNA, 16 bp, Homo sapiens
gccagtgactgctgcg

SEQ ID NO: 4308998 - DNA, 22 bp, Homo sapiens
gccagtgactgctgcgctgtgc

SEQ ID NO: 4308999 - DNA, 19 bp, Homo sapiens
gccatatattttctgagta

SEQ ID NO: 4309000 - DNA, 13 bp, Homo sapiens
gccatcagcccct

SEQ ID NO: 4309001 - DNA, 13 bp, Homo sapiens
gccatgaactttg

SEQ ID NO: 4309002 - DNA, 22 bp, Homo sapiens
gccatgactagggtcctcaggc

SEQ ID NO: 4309003 - DNA, 14 bp, Homo sapiens
gccatgagctccag

SEQ ID NO: 4309004 - DNA, 15 bp, Homo sapiens
gccatgagctccaga

SEQ ID NO: 4309005 - DNA, 17 bp, Homo sapiens
gccatgagctccagacc

SEQ ID NO: 4309006 - DNA, 16 bp, Homo sapiens
gccatgaggcctcagt

SEQ ID NO: 4309007 - DNA, 18 bp, Homo sapiens
gccatgattttggccact

SEQ ID NO: 4309008 - DNA, 20 bp, Homo sapiens
gccatggactctacactgtg

SEQ ID NO: 4309009 - DNA, 14 bp, Homo sapiens
gccatgggtgcttg

SEQ ID NO: 4309010 - DNA, 20 bp, Homo sapiens
gccatggtgttggaggggca

SEQ ID NO: 4309011 - DNA, 14 bp, Homo sapiens
gccatgtgctgtgc

SEQ ID NO: 4309012 - DNA, 18 bp, Homo sapiens
gccatgtgctgtgcaccc

SEQ ID NO: 4309013 - DNA, 22 bp, Homo sapiens
gccatttcattgagggaaaaca

SEQ ID NO: 4309014 - DNA, 18 bp, Homo sapiens
gcccaaaccagggggaag

SEQ ID NO: 4309015 - DNA, 21 bp, Homo sapiens
gcccaagaatagatgctgact

SEQ ID NO: 4309016 - DNA, 14 bp, Homo sapiens
gcccaatcactgcc

SEQ ID NO: 4309017 - DNA, 17 bp, Homo sapiens
gcccacacctgcctctg

SEQ ID NO: 4309018 - DNA, 15 bp, Homo sapiens
gcccacagtatattt

SEQ ID NO: 4309019 - DNA, 17 bp, Homo sapiens
gcccacagtatatttta

SEQ ID NO: 4309020 - DNA, 14 bp, Homo sapiens
gcccaccagctggc

SEQ ID NO: 4309021 - DNA, 16 bp, Homo sapiens
gcccaccagctggctc

SEQ ID NO: 4309022 - DNA, 15 bp, Homo sapiens
gcccaccccctgctg

SEQ ID NO: 4309023 - DNA, 16 bp, Homo sapiens
gcccaccccctgctgg

SEQ ID NO: 4309024 - DNA, 22 bp, Homo sapiens
gcccaccccctgctggtgccca

SEQ ID NO: 4309025 - DNA, 16 bp, Homo sapiens
gcccaccccgcctctg

SEQ ID NO: 4309026 - DNA, 22 bp, Homo sapiens
gcccaccccgcctctgggctca

SEQ ID NO: 4309027 - DNA, 12 bp, Homo sapiens
gcccacccctct

SEQ ID NO: 4309028 - DNA, 22 bp, Homo sapiens
gcccacccctcttcccccttcc

SEQ ID NO: 4309029 - DNA, 16 bp, Homo sapiens
gcccacctgctgcccg

SEQ ID NO: 4309030 - DNA, 12 bp, Homo sapiens
gcccacctgggc

SEQ ID NO: 4309031 - DNA, 13 bp, Homo sapiens
gcccacctgggcc

SEQ ID NO: 4309032 - DNA, 16 bp, Homo sapiens
gcccagcagcggccca

SEQ ID NO: 4309033 - DNA, 13 bp, Homo sapiens
gcccagccagcag

SEQ ID NO: 4309034 - DNA, 12 bp, Homo sapiens
gcccagcctggc

SEQ ID NO: 4309035 - DNA, 13 bp, Homo sapiens
gcccagcctggcc

SEQ ID NO: 4309036 - DNA, 15 bp, Homo sapiens
gcccaggacactgcc

SEQ ID NO: 4309037 - DNA, 18 bp, Homo sapiens
gcccaggacactgccttt

SEQ ID NO: 4309038 - DNA, 19 bp, Homo sapiens
gcccaggacactgcctttg

SEQ ID NO: 4309039 - DNA, 21 bp, Homo sapiens
gcccaggacactgcctttgct

SEQ ID NO: 4309040 - DNA, 21 bp, Homo sapiens
gcccaggagagcccccaccag

SEQ ID NO: 4309041 - DNA, 16 bp, Homo sapiens
gcccaggaggacctgg

SEQ ID NO: 4309042 - DNA, 20 bp, Homo sapiens
gcccaggctggagtgcagtg

SEQ ID NO: 4309043 - DNA, 20 bp, Homo sapiens
gcccagggaatcagggagca

SEQ ID NO: 4309044 - DNA, 23 bp, Homo sapiens
gcccagggaatcagggagcactg

SEQ ID NO: 4309045 - DNA, 18 bp, Homo sapiens
gcccagggagaggccatg

SEQ ID NO: 4309046 - DNA, 15 bp, Homo sapiens
gcccaggtctcctgg

SEQ ID NO: 4309047 - DNA, 18 bp, Homo sapiens
gcccaggtctcctgggca

SEQ ID NO: 4309048 - DNA, 18 bp, Homo sapiens
gcccagtcttgagtgggc

SEQ ID NO: 4309049 - DNA, 23 bp, Homo sapiens
gcccagtcttgagtgggccccct

SEQ ID NO: 4309050 - DNA, 14 bp, Homo sapiens
gcccatgccctccg

SEQ ID NO: 4309051 - DNA, 20 bp, Homo sapiens
gccccaaaaccacagccctg

SEQ ID NO: 4309052 - DNA, 22 bp, Homo sapiens
gccccaaaaccacagccctgtc

SEQ ID NO: 4309053 - DNA, 23 bp, Homo sapiens
gccccaaaaccacagccctgtca

SEQ ID NO: 4309054 - DNA, 17 bp, Homo sapiens
gccccacacaggcctgg

SEQ ID NO: 4309055 - DNA, 19 bp, Homo sapiens
gccccacacaggcctggcc

SEQ ID NO: 4309056 - DNA, 22 bp, Homo sapiens
gccccacacaggcctggcccag

SEQ ID NO: 4309057 - DNA, 17 bp, Homo sapiens
gccccacccaccctctg

SEQ ID NO: 4309058 - DNA, 15 bp, Homo sapiens
gccccacccctccat

SEQ ID NO: 4309059 - DNA, 15 bp, Homo sapiens
gccccactctgctga

SEQ ID NO: 4309060 - DNA, 19 bp, Homo sapiens
gccccactctgctgaggcc

SEQ ID NO: 4309061 - DNA, 22 bp, Homo sapiens
gccccactctgctgaggccaga

SEQ ID NO: 4309062 - DNA, 19 bp, Homo sapiens
gccccagaaatgccgctgt

SEQ ID NO: 4309063 - DNA, 23 bp, Homo sapiens
gccccagaaatgccgctgtgtcc

SEQ ID NO: 4309064 - DNA, 15 bp, Homo sapiens
gccccagagactcag

SEQ ID NO: 4309065 - DNA, 20 bp, Homo sapiens
gccccaggcaggctgtgcgc

SEQ ID NO: 4309066 - DNA, 12 bp, Homo sapiens
gccccagggccc

SEQ ID NO: 4309067 - DNA, 17 bp, Homo sapiens
gccccagggccctgctc

SEQ ID NO: 4309068 - DNA, 16 bp, Homo sapiens
gccccatcccatccct

SEQ ID NO: 4309069 - DNA, 15 bp, Homo sapiens
gcccccaccagcagc

SEQ ID NO: 4309070 - DNA, 19 bp, Homo sapiens
gccccccacattctggctc

SEQ ID NO: 4309071 - DNA, 13 bp, Homo sapiens
gccccccagagcc

SEQ ID NO: 4309072 - DNA, 14 bp, Homo sapiens
gccccccagagcca

SEQ ID NO: 4309073 - DNA, 16 bp, Homo sapiens
gccccccagagccagg

SEQ ID NO: 4309074 - DNA, 14 bp, Homo sapiens
gccccccatgccct

SEQ ID NO: 4309075 - DNA, 15 bp, Homo sapiens
gccccccttcccacc

SEQ ID NO: 4309076 - DNA, 18 bp, Homo sapiens
gccccccttcccacccct

SEQ ID NO: 4309077 - DNA, 23 bp, Homo sapiens
gcccccgcacgcaagcctcagcc

SEQ ID NO: 4309078 - DNA, 12 bp, Homo sapiens
gccccctcctga

SEQ ID NO: 4309079 - DNA, 15 bp, Homo sapiens
gccccctcctgaccc

SEQ ID NO: 4309080 - DNA, 11 bp, Homo sapiens
gccccctctct

SEQ ID NO: 4309081 - DNA, 19 bp, Homo sapiens
gccccctggcccctcccac

SEQ ID NO: 4309082 - DNA, 21 bp, Homo sapiens
gccccctggcccctcccacat

SEQ ID NO: 4309083 - DNA, 11 bp, Homo sapiens
gccccctgggg

SEQ ID NO: 4309084 - DNA, 23 bp, Homo sapiens
gccccctggggggcacagccaga

SEQ ID NO: 4309085 - DNA, 20 bp, Homo sapiens
gcccccttctcccacactgc

SEQ ID NO: 4309086 - DNA, 13 bp, Homo sapiens
gccccgccccaca

SEQ ID NO: 4309087 - DNA, 22 bp, Homo sapiens
gccccgccccacattccgacaa

SEQ ID NO: 4309088 - DNA, 17 bp, Homo sapiens
gccccgccccccagagc

SEQ ID NO: 4309089 - DNA, 18 bp, Homo sapiens
gccccgccccccagagcc

SEQ ID NO: 4309090 - DNA, 19 bp, Homo sapiens
gccccgccccccagagcca

SEQ ID NO: 4309091 - DNA, 22 bp, Homo sapiens
gccccgccccccagagccaggg

SEQ ID NO: 4309092 - DNA, 22 bp, Homo sapiens
gccccgccgtgtctgtggccct

SEQ ID NO: 4309093 - DNA, 17 bp, Homo sapiens
gcccctagaatcagcct

SEQ ID NO: 4309094 - DNA, 19 bp, Homo sapiens
gcccctatcctgcaccctc

SEQ ID NO: 4309095 - DNA, 20 bp, Homo sapiens
gcccctatcctgcaccctct

SEQ ID NO: 4309096 - DNA, 17 bp, Homo sapiens
gcccctcacctgggcac

SEQ ID NO: 4309097 - DNA, 15 bp, Homo sapiens
gcccctcactggctg

SEQ ID NO: 4309098 - DNA, 20 bp, Homo sapiens
gcccctcactggctggactg

SEQ ID NO: 4309099 - DNA, 14 bp, Homo sapiens
gcccctccagtgtt

SEQ ID NO: 4309100 - DNA, 16 bp, Homo sapiens
gcccctccagtgttgc

SEQ ID NO: 4309101 - DNA, 13 bp, Homo sapiens
gcccctcccacca

SEQ ID NO: 4309102 - DNA, 13 bp, Homo sapiens
gcccctccccatg

SEQ ID NO: 4309103 - DNA, 17 bp, Homo sapiens
gcccctccttctcccct

SEQ ID NO: 4309104 - DNA, 20 bp, Homo sapiens
gcccctccttctcccctcca

SEQ ID NO: 4309105 - DNA, 21 bp, Homo sapiens
gcccctctctgtttaccctcc

SEQ ID NO: 4309106 - DNA, 19 bp, Homo sapiens
gcccctgcacctgcttctc

SEQ ID NO: 4309107 - DNA, 12 bp, Homo sapiens
gcccctgccccg

SEQ ID NO: 4309108 - DNA, 14 bp, Homo sapiens
gcccctgccccgtc

SEQ ID NO: 4309109 - DNA, 22 bp, Homo sapiens
gcccctgccccgtcaccatctc

SEQ ID NO: 4309110 - DNA, 16 bp, Homo sapiens
gcccctgctgcctccc

SEQ ID NO: 4309111 - DNA, 17 bp, Homo sapiens
gcccctgctgcctcccc

SEQ ID NO: 4309112 - DNA, 13 bp, Homo sapiens
gcccctgctgctc

SEQ ID NO: 4309113 - DNA, 23 bp, Homo sapiens
gccccttcacttctgaccacact

SEQ ID NO: 4309114 - DNA, 17 bp, Homo sapiens
gccccttccccctccaa

SEQ ID NO: 4309115 - DNA, 16 bp, Homo sapiens
gccccttgctgctggc

SEQ ID NO: 4309116 - DNA, 18 bp, Homo sapiens
gccccttgctgctggctc

SEQ ID NO: 4309117 - DNA, 13 bp, Homo sapiens
gcccctttggacc

SEQ ID NO: 4309118 - DNA, 14 bp, Homo sapiens
gcccctttggacct

SEQ ID NO: 4309119 - DNA, 16 bp, Homo sapiens
gcccctttggacctgc

SEQ ID NO: 4309120 - DNA, 17 bp, Homo sapiens
gcccctttggacctgca

SEQ ID NO: 4309121 - DNA, 19 bp, Homo sapiens
gcccctttttactcccctt

SEQ ID NO: 4309122 - DNA, 20 bp, Homo sapiens
gcccctttttactccccttg

SEQ ID NO: 4309123 - DNA, 14 bp, Homo sapiens
gcccgacagcctgg

SEQ ID NO: 4309124 - DNA, 17 bp, Homo sapiens
gcccgagggtcccaagg

SEQ ID NO: 4309125 - DNA, 18 bp, Homo sapiens
gcccgagggtcccaaggc

SEQ ID NO: 4309126 - DNA, 15 bp, Homo sapiens
gcccgcacccccacc

SEQ ID NO: 4309127 - DNA, 19 bp, Homo sapiens
gcccgcacccccacccttt

SEQ ID NO: 4309128 - DNA, 18 bp, Homo sapiens
gcccgcccacctgggccc

SEQ ID NO: 4309129 - DNA, 14 bp, Homo sapiens
gcccgcctggcaga

SEQ ID NO: 4309130 - DNA, 18 bp, Homo sapiens
gcccgcctggcagaactg

SEQ ID NO: 4309131 - DNA, 19 bp, Homo sapiens
gcccgcgtccaaccccggg

SEQ ID NO: 4309132 - DNA, 21 bp, Homo sapiens
gcccgggagatccgccctggg

SEQ ID NO: 4309133 - DNA, 14 bp, Homo sapiens
gcccgggcaggggc

SEQ ID NO: 4309134 - DNA, 14 bp, Homo sapiens
gcccggggcagctg

SEQ ID NO: 4309135 - DNA, 15 bp, Homo sapiens
gcccgtgaggagggg

SEQ ID NO: 4309136 - DNA, 15 bp, Homo sapiens
gcccgtgtggcccct

SEQ ID NO: 4309137 - DNA, 16 bp, Homo sapiens
gcccgtgtggcccctt

SEQ ID NO: 4309138 - DNA, 18 bp, Homo sapiens
gcccgtgtggccccttca

SEQ ID NO: 4309139 - DNA, 23 bp, Homo sapiens
gccctaggcatactctccaggat

SEQ ID NO: 4309140 - DNA, 17 bp, Homo sapiens
gccctcactccactccc

SEQ ID NO: 4309141 - DNA, 16 bp, Homo sapiens
gccctccatcccgaca

SEQ ID NO: 4309142 - DNA, 13 bp, Homo sapiens
gccctccccctgc

SEQ ID NO: 4309143 - DNA, 18 bp, Homo sapiens
gccctccccctgccagag

SEQ ID NO: 4309144 - DNA, 20 bp, Homo sapiens
gccctccccctgccagaggc

SEQ ID NO: 4309145 - DNA, 22 bp, Homo sapiens
gccctccccctgccagaggcct

SEQ ID NO: 4309146 - DNA, 23 bp, Homo sapiens
gccctccccctgccagaggcctg

SEQ ID NO: 4309147 - DNA, 17 bp, Homo sapiens
gccctccctccctccac

SEQ ID NO: 4309148 - DNA, 20 bp, Homo sapiens
gccctccctccctccacacc

SEQ ID NO: 4309149 - DNA, 18 bp, Homo sapiens
gccctccctgctgccagg

SEQ ID NO: 4309150 - DNA, 17 bp, Homo sapiens
gccctccgcgggggaca

SEQ ID NO: 4309151 - DNA, 22 bp, Homo sapiens
gccctccgcgggggacaggaac

SEQ ID NO: 4309152 - DNA, 20 bp, Homo sapiens
gccctctgcccccagctgct

SEQ ID NO: 4309153 - DNA, 21 bp, Homo sapiens
gccctctgcccccagctgctc

SEQ ID NO: 4309154 - DNA, 22 bp, Homo sapiens
gccctctgcccccagctgctcc

SEQ ID NO: 4309155 - DNA, 15 bp, Homo sapiens
gccctctgctgcttt

SEQ ID NO: 4309156 - DNA, 16 bp, Homo sapiens
gccctgacatgctaac

SEQ ID NO: 4309157 - DNA, 20 bp, Homo sapiens
gccctgaggggcctgccact

SEQ ID NO: 4309158 - DNA, 19 bp, Homo sapiens
gccctgccccacacaggcc

SEQ ID NO: 4309159 - DNA, 16 bp, Homo sapiens
gccctgccccccacat

SEQ ID NO: 4309160 - DNA, 13 bp, Homo sapiens
gccctgccctcac

SEQ ID NO: 4309161 - DNA, 17 bp, Homo sapiens
gccctgccctcactcca

SEQ ID NO: 4309162 - DNA, 18 bp, Homo sapiens
gccctgccctcactccac

SEQ ID NO: 4309163 - DNA, 19 bp, Homo sapiens
gccctgccctcactccact

SEQ ID NO: 4309164 - DNA, 21 bp, Homo sapiens
gccctgccctcactccactcc

SEQ ID NO: 4309165 - DNA, 13 bp, Homo sapiens
gccctgctcaggc

SEQ ID NO: 4309166 - DNA, 17 bp, Homo sapiens
gccctgctcaggcctca

SEQ ID NO: 4309167 - DNA, 15 bp, Homo sapiens
gccctgctgccccct

SEQ ID NO: 4309168 - DNA, 22 bp, Homo sapiens
gccctgctttgggctgccctgg

SEQ ID NO: 4309169 - DNA, 12 bp, Homo sapiens
gccctggcccag

SEQ ID NO: 4309170 - DNA, 14 bp, Homo sapiens
gccctggcccagcc

SEQ ID NO: 4309171 - DNA, 23 bp, Homo sapiens
gccctggcccagcctgtggcctc

SEQ ID NO: 4309172 - DNA, 20 bp, Homo sapiens
gccctggctcccacaggccc

SEQ ID NO: 4309173 - DNA, 12 bp, Homo sapiens
gccctggctctg

SEQ ID NO: 4309174 - DNA, 13 bp, Homo sapiens
gccctggctctgt

SEQ ID NO: 4309175 - DNA, 17 bp, Homo sapiens
gccctggtgctgccaca

SEQ ID NO: 4309176 - DNA, 22 bp, Homo sapiens
gccctggtggccaagcctgccc

SEQ ID NO: 4309177 - DNA, 17 bp, Homo sapiens
gccctggttcccccagg

SEQ ID NO: 4309178 - DNA, 21 bp, Homo sapiens
gccctggttctccatccccat

SEQ ID NO: 4309179 - DNA, 17 bp, Homo sapiens
gcccttaaaataatgat

SEQ ID NO: 4309180 - DNA, 20 bp, Homo sapiens
gcccttcccaacctcccctg

SEQ ID NO: 4309181 - DNA, 21 bp, Homo sapiens
gcccttccctgacactgtctg

SEQ ID NO: 4309182 - DNA, 12 bp, Homo sapiens
gcccttcctctc

SEQ ID NO: 4309183 - DNA, 17 bp, Homo sapiens
gcccttcctctccactg

SEQ ID NO: 4309184 - DNA, 19 bp, Homo sapiens
gcccttcctctccactgcc

SEQ ID NO: 4309185 - DNA, 22 bp, Homo sapiens
gcccttcctctccactgccttc

SEQ ID NO: 4309186 - DNA, 21 bp, Homo sapiens
gcccttcttccattcccagac

SEQ ID NO: 4309187 - DNA, 12 bp, Homo sapiens
gccctttcaccc

SEQ ID NO: 4309188 - DNA, 19 bp, Homo sapiens
gccctttcacccctcttcc

SEQ ID NO: 4309189 - DNA, 20 bp, Homo sapiens
gccgagctctcctgggccag

SEQ ID NO: 4309190 - DNA, 22 bp, Homo sapiens
gccgagctctcctgggccaggg

SEQ ID NO: 4309191 - DNA, 12 bp, Homo sapiens
gccgaggcaggg

SEQ ID NO: 4309192 - DNA, 20 bp, Homo sapiens
gccgatttcctaagctgttg

SEQ ID NO: 4309193 - DNA, 18 bp, Homo sapiens
gccgctagatgggcatgg

SEQ ID NO: 4309194 - DNA, 15 bp, Homo sapiens
gccgctgcagggtgg

SEQ ID NO: 4309195 - DNA, 22 bp, Homo sapiens
gccgctgcagtcagcacagaga

SEQ ID NO: 4309196 - DNA, 23 bp, Homo sapiens
gccgctgcagtcagcacagagag

SEQ ID NO: 4309197 - DNA, 12 bp, Homo sapiens
gccgctgggaga

SEQ ID NO: 4309198 - DNA, 20 bp, Homo sapiens
gccgctgggagaaaagccag

SEQ ID NO: 4309199 - DNA, 22 bp, Homo sapiens
gccgctgggagaaaagccagat

SEQ ID NO: 4309200 - DNA, 16 bp, Homo sapiens
gccgctgggagagcca

SEQ ID NO: 4309201 - DNA, 17 bp, Homo sapiens
gccgctgggagagccaa

SEQ ID NO: 4309202 - DNA, 14 bp, Homo sapiens
gccgcttcgccatg

SEQ ID NO: 4309203 - DNA, 19 bp, Homo sapiens
gccgcttcgccatgtgctg

SEQ ID NO: 4309204 - DNA, 16 bp, Homo sapiens
gccggccctgcccccc

SEQ ID NO: 4309205 - DNA, 17 bp, Homo sapiens
gccggccctgcccccca

SEQ ID NO: 4309206 - DNA, 14 bp, Homo sapiens
gccggcctggggcc

SEQ ID NO: 4309207 - DNA, 19 bp, Homo sapiens
gccggggagctgaggggca

SEQ ID NO: 4309208 - DNA, 22 bp, Homo sapiens
gccgggggtgggggcctgctgt

SEQ ID NO: 4309209 - DNA, 19 bp, Homo sapiens
gccgtagactcacggctgc

SEQ ID NO: 4309210 - DNA, 19 bp, Homo sapiens
gccgtggcttcccgctcag

SEQ ID NO: 4309211 - DNA, 17 bp, Homo sapiens
gccgtgtctgtggccct

SEQ ID NO: 4309212 - DNA, 22 bp, Homo sapiens
gccgtttgaatatattttatct

SEQ ID NO: 4309213 - DNA, 12 bp, Homo sapiens
gcctagaggagg

SEQ ID NO: 4309214 - DNA, 16 bp, Homo sapiens
gcctaggccagctcct

SEQ ID NO: 4309215 - DNA, 22 bp, Homo sapiens
gcctaggggtcagggaccaagg

SEQ ID NO: 4309216 - DNA, 16 bp, Homo sapiens
gcctatcctaagagct

SEQ ID NO: 4309217 - DNA, 22 bp, Homo sapiens
gcctatggaaagggtgtggctt

SEQ ID NO: 4309218 - DNA, 21 bp, Homo sapiens
gcctattgtaatatagaaaaa

SEQ ID NO: 4309219 - DNA, 21 bp, Homo sapiens
gcctcaaccctccctcagccc

SEQ ID NO: 4309220 - DNA, 11 bp, Homo sapiens
gcctcacccct

SEQ ID NO: 4309221 - DNA, 18 bp, Homo sapiens
gcctcacctggcttccca

SEQ ID NO: 4309222 - DNA, 15 bp, Homo sapiens
gcctcagcagaaggc

SEQ ID NO: 4309223 - DNA, 20 bp, Homo sapiens
gcctcagcagaaggccttgc

SEQ ID NO: 4309224 - DNA, 16 bp, Homo sapiens
gcctcagccactccca

SEQ ID NO: 4309225 - DNA, 18 bp, Homo sapiens
gcctcagccactcccagg

SEQ ID NO: 4309226 - DNA, 13 bp, Homo sapiens
gcctcaggcctgg

SEQ ID NO: 4309227 - DNA, 14 bp, Homo sapiens
gcctcaggcctggc

SEQ ID NO: 4309228 - DNA, 20 bp, Homo sapiens
gcctcaggcctggccctttc

SEQ ID NO: 4309229 - DNA, 17 bp, Homo sapiens
gcctcagtccctccctc

SEQ ID NO: 4309230 - DNA, 22 bp, Homo sapiens
gcctcagtccctccctcctggc

SEQ ID NO: 4309231 - DNA, 21 bp, Homo sapiens
gcctcatcctcctggacccag

SEQ ID NO: 4309232 - DNA, 21 bp, Homo sapiens
gcctcatgggagtcagggagc

SEQ ID NO: 4309233 - DNA, 16 bp, Homo sapiens
gcctccacctgcagcc

SEQ ID NO: 4309234 - DNA, 19 bp, Homo sapiens
gcctccacctgcagcccca

SEQ ID NO: 4309235 - DNA, 23 bp, Homo sapiens
gcctccacctgcagccccaggcc

SEQ ID NO: 4309236 - DNA, 15 bp, Homo sapiens
gcctccactccctgt

SEQ ID NO: 4309237 - DNA, 19 bp, Homo sapiens
gcctccactccctgtctga

SEQ ID NO: 4309238 - DNA, 21 bp, Homo sapiens
gcctcccaaatatgcccctcc

SEQ ID NO: 4309239 - DNA, 13 bp, Homo sapiens
gcctcccagccac

SEQ ID NO: 4309240 - DNA, 19 bp, Homo sapiens
gcctccccaaccctgcccc

SEQ ID NO: 4309241 - DNA, 17 bp, Homo sapiens
gcctcccgcatgctgcc

SEQ ID NO: 4309242 - DNA, 21 bp, Homo sapiens
gcctcccgcatgctgcctgcc

SEQ ID NO: 4309243 - DNA, 13 bp, Homo sapiens
gcctccctcagcc

SEQ ID NO: 4309244 - DNA, 14 bp, Homo sapiens
gcctccggccctgc

SEQ ID NO: 4309245 - DNA, 18 bp, Homo sapiens
gcctccggccctgcccca

SEQ ID NO: 4309246 - DNA, 12 bp, Homo sapiens
gcctcctcccat

SEQ ID NO: 4309247 - DNA, 14 bp, Homo sapiens
gcctcctcccatcc

SEQ ID NO: 4309248 - DNA, 13 bp, Homo sapiens
gcctcctgctgag

SEQ ID NO: 4309249 - DNA, 16 bp, Homo sapiens
gcctcctgctgagtgg

SEQ ID NO: 4309250 - DNA, 20 bp, Homo sapiens
gcctcctgctgagtggtcca

SEQ ID NO: 4309251 - DNA, 12 bp, Homo sapiens
gcctcgcccctc

SEQ ID NO: 4309252 - DNA, 16 bp, Homo sapiens
gcctctcactctggca

SEQ ID NO: 4309253 - DNA, 19 bp, Homo sapiens
gcctctcactctggcagcc

SEQ ID NO: 4309254 - DNA, 23 bp, Homo sapiens
gcctctcactctggcagcctcag

SEQ ID NO: 4309255 - DNA, 19 bp, Homo sapiens
gcctctctcagcccaggtc

SEQ ID NO: 4309256 - DNA, 19 bp, Homo sapiens
gcctctctgccagccgctg

SEQ ID NO: 4309257 - DNA, 21 bp, Homo sapiens
gcctctgcaagattctgtggg

SEQ ID NO: 4309258 - DNA, 18 bp, Homo sapiens
gcctctgcacgtgcacac

SEQ ID NO: 4309259 - DNA, 14 bp, Homo sapiens
gcctctggcctggg

SEQ ID NO: 4309260 - DNA, 17 bp, Homo sapiens
gcctctggcctgggaaa

SEQ ID NO: 4309261 - DNA, 12 bp, Homo sapiens
gcctctgggctc

SEQ ID NO: 4309262 - DNA, 15 bp, Homo sapiens
gcctctgggctcaca

SEQ ID NO: 4309263 - DNA, 16 bp, Homo sapiens
gcctctgggctcacac

SEQ ID NO: 4309264 - DNA, 16 bp, Homo sapiens
gcctcttgggagacgt

SEQ ID NO: 4309265 - DNA, 19 bp, Homo sapiens
gcctgaaatgtttccaggc

SEQ ID NO: 4309266 - DNA, 21 bp, Homo sapiens
gcctgaaatgtttccaggcat

SEQ ID NO: 4309267 - DNA, 20 bp, Homo sapiens
gcctgaactaggtgctggca

SEQ ID NO: 4309268 - DNA, 21 bp, Homo sapiens
gcctgagaatgcctaggccag

SEQ ID NO: 4309269 - DNA, 13 bp, Homo sapiens
gcctgagagcaga

SEQ ID NO: 4309270 - DNA, 23 bp, Homo sapiens
gcctgagggcgaggggagggtgg

SEQ ID NO: 4309271 - DNA, 14 bp, Homo sapiens
gcctgaggggcaga

SEQ ID NO: 4309272 - DNA, 23 bp, Homo sapiens
gcctgatggtggggccataccca

SEQ ID NO: 4309273 - DNA, 15 bp, Homo sapiens
gcctgccactctcct

SEQ ID NO: 4309274 - DNA, 20 bp, Homo sapiens
gcctgccactctcctgagga

SEQ ID NO: 4309275 - DNA, 18 bp, Homo sapiens
gcctgccccggccactct

SEQ ID NO: 4309276 - DNA, 19 bp, Homo sapiens
gcctgcctccggccctgcc

SEQ ID NO: 4309277 - DNA, 22 bp, Homo sapiens
gcctgcgatggtgctgcacccc

SEQ ID NO: 4309278 - DNA, 14 bp, Homo sapiens
gcctgcgtggcctg

SEQ ID NO: 4309279 - DNA, 18 bp, Homo sapiens
gcctgcgtggcctggggc

SEQ ID NO: 4309280 - DNA, 23 bp, Homo sapiens
gcctgcgtggcctggggctgccg

SEQ ID NO: 4309281 - DNA, 13 bp, Homo sapiens
gcctggcagaact

SEQ ID NO: 4309282 - DNA, 22 bp, Homo sapiens
gcctggcagccgtgccttcagc

SEQ ID NO: 4309283 - DNA, 12 bp, Homo sapiens
gcctggcccagc

SEQ ID NO: 4309284 - DNA, 19 bp, Homo sapiens
gcctggcccagtgagagtg

SEQ ID NO: 4309285 - DNA, 17 bp, Homo sapiens
gcctgggaaaagggcag

SEQ ID NO: 4309286 - DNA, 20 bp, Homo sapiens
gcctgggaaaagggcaggag

SEQ ID NO: 4309287 - DNA, 15 bp, Homo sapiens
gcctgggccactggc

SEQ ID NO: 4309288 - DNA, 18 bp, Homo sapiens
gcctgggccactggcatc

SEQ ID NO: 4309289 - DNA, 11 bp, Homo sapiens
gcctgggcctg

SEQ ID NO: 4309290 - DNA, 18 bp, Homo sapiens
gcctggggacggagcact

SEQ ID NO: 4309291 - DNA, 13 bp, Homo sapiens
gcctggggctgcc

SEQ ID NO: 4309292 - DNA, 20 bp, Homo sapiens
gcctggggtgggtgtgagca

SEQ ID NO: 4309293 - DNA, 23 bp, Homo sapiens
gcctggggtgggtgtgagcaggg

SEQ ID NO: 4309294 - DNA, 19 bp, Homo sapiens
gcctggtctggagccccta

SEQ ID NO: 4309295 - DNA, 13 bp, Homo sapiens
gcctggtgccctg

SEQ ID NO: 4309296 - DNA, 14 bp, Homo sapiens
gcctggtgccctgg

SEQ ID NO: 4309297 - DNA, 17 bp, Homo sapiens
gcctggtgccctggccc

SEQ ID NO: 4309298 - DNA, 22 bp, Homo sapiens
gcctggtgccctggcccagcct

SEQ ID NO: 4309299 - DNA, 22 bp, Homo sapiens
gcctgtccacctgtgctgctgc

SEQ ID NO: 4309300 - DNA, 18 bp, Homo sapiens
gcctgtccctctcaggca

SEQ ID NO: 4309301 - DNA, 15 bp, Homo sapiens
gcctgtggcctcagc

SEQ ID NO: 4309302 - DNA, 17 bp, Homo sapiens
gcctgtggcctcagcat

SEQ ID NO: 4309303 - DNA, 14 bp, Homo sapiens
gcctgtgggagaag

SEQ ID NO: 4309304 - DNA, 20 bp, Homo sapiens
gcctgtgttagtgtctgtcc

SEQ ID NO: 4309305 - DNA, 16 bp, Homo sapiens
gccttcagctctacag

SEQ ID NO: 4309306 - DNA, 13 bp, Homo sapiens
gccttctcccctc

SEQ ID NO: 4309307 - DNA, 15 bp, Homo sapiens
gccttctgcggagct

SEQ ID NO: 4309308 - DNA, 18 bp, Homo sapiens
gccttctggccgctgcag

SEQ ID NO: 4309309 - DNA, 20 bp, Homo sapiens
gccttgagtgacatgcggct

SEQ ID NO: 4309310 - DNA, 24 bp, Homo sapiens
gccttgcacaagtacttgagaata

SEQ ID NO: 4309311 - DNA, 16 bp, Homo sapiens
gcctttaggcaggaag

SEQ ID NO: 4309312 - DNA, 12 bp, Homo sapiens
gcctttgctgcc

SEQ ID NO: 4309313 - DNA, 13 bp, Homo sapiens
gcctttgctgcct

SEQ ID NO: 4309314 - DNA, 15 bp, Homo sapiens
gcctttttgagccaa

SEQ ID NO: 4309315 - DNA, 21 bp, Homo sapiens
gcgagaacacaagccacgcct

SEQ ID NO: 4309316 - DNA, 22 bp, Homo sapiens
gcgagaacacaagccacgcctg

SEQ ID NO: 4309317 - DNA, 23 bp, Homo sapiens
gcgagaacacaagccacgcctgc

SEQ ID NO: 4309318 - DNA, 13 bp, Homo sapiens
gcgaggcagagga

SEQ ID NO: 4309319 - DNA, 16 bp, Homo sapiens
gcgaggcagaggacag

SEQ ID NO: 4309320 - DNA, 19 bp, Homo sapiens
gcgaggctttaagcgaggc

SEQ ID NO: 4309321 - DNA, 12 bp, Homo sapiens
gcgcacccggca

SEQ ID NO: 4309322 - DNA, 15 bp, Homo sapiens
gcgcacccggcagcc

SEQ ID NO: 4309323 - DNA, 15 bp, Homo sapiens
gcgcaggccctccgc

SEQ ID NO: 4309324 - DNA, 16 bp, Homo sapiens
gcgcagtgcctctggt

SEQ ID NO: 4309325 - DNA, 13 bp, Homo sapiens
gcgccccttcccc

SEQ ID NO: 4309326 - DNA, 15 bp, Homo sapiens
gcgccttcctgggtt

SEQ ID NO: 4309327 - DNA, 14 bp, Homo sapiens
gcgcgcacacacac

SEQ ID NO: 4309328 - DNA, 19 bp, Homo sapiens
gcgctctgcatgctcctct

SEQ ID NO: 4309329 - DNA, 14 bp, Homo sapiens
gcgctgagggcagg

SEQ ID NO: 4309330 - DNA, 13 bp, Homo sapiens
gcgctgtgctggt

SEQ ID NO: 4309331 - DNA, 13 bp, Homo sapiens
gcggatgtagcat

SEQ ID NO: 4309332 - DNA, 13 bp, Homo sapiens
gcggccggcctgg

SEQ ID NO: 4309333 - DNA, 18 bp, Homo sapiens
gcggccggcctggggccg

SEQ ID NO: 4309334 - DNA, 14 bp, Homo sapiens
gcggctgggagcct

SEQ ID NO: 4309335 - DNA, 15 bp, Homo sapiens
gcgggacctgtggct

SEQ ID NO: 4309336 - DNA, 18 bp, Homo sapiens
gcgggagtgtgggggtgc

SEQ ID NO: 4309337 - DNA, 13 bp, Homo sapiens
gcgggccaaggac

SEQ ID NO: 4309338 - DNA, 21 bp, Homo sapiens
gcggtcaataattgtggagag

SEQ ID NO: 4309339 - DNA, 21 bp, Homo sapiens
gcggtccagaggaggtgcccg

SEQ ID NO: 4309340 - DNA, 19 bp, Homo sapiens
gcgtatgcagtgtagattt

SEQ ID NO: 4309341 - DNA, 19 bp, Homo sapiens
gcgtccctgagggcccttc

SEQ ID NO: 4309342 - DNA, 20 bp, Homo sapiens
gcgtccctgagggcccttcc

SEQ ID NO: 4309343 - DNA, 18 bp, Homo sapiens
gcgtctgtcttcaagggc

SEQ ID NO: 4309344 - DNA, 15 bp, Homo sapiens
gcgtggcctggggct

SEQ ID NO: 4309345 - DNA, 22 bp, Homo sapiens
gcgtgggatccagagagaagca

SEQ ID NO: 4309346 - DNA, 18 bp, Homo sapiens
gcgtgtcctatccccgga

SEQ ID NO: 4309347 - DNA, 11 bp, Homo sapiens
gcgttctcagc

SEQ ID NO: 4309348 - DNA, 18 bp, Homo sapiens
gctaaatgcctaataaac

SEQ ID NO: 4309349 - DNA, 18 bp, Homo sapiens
gctaaattacaattgtca

SEQ ID NO: 4309350 - DNA, 12 bp, Homo sapiens
gctaaggcttcc

SEQ ID NO: 4309351 - DNA, 17 bp, Homo sapiens
gctaaggcttccggctg

SEQ ID NO: 4309352 - DNA, 18 bp, Homo sapiens
gctaaggcttccggctga

SEQ ID NO: 4309353 - DNA, 21 bp, Homo sapiens
gctaagtccagctctcccctg

SEQ ID NO: 4309354 - DNA, 22 bp, Homo sapiens
gctacctctgatcaaagcacct

SEQ ID NO: 4309355 - DNA, 16 bp, Homo sapiens
gctacctggttttcat

SEQ ID NO: 4309356 - DNA, 20 bp, Homo sapiens
gctactctagtattccagac

SEQ ID NO: 4309357 - DNA, 21 bp, Homo sapiens
gctactctagtattccagacc

SEQ ID NO: 4309358 - DNA, 20 bp, Homo sapiens
gctagaatatcctatactgg

SEQ ID NO: 4309359 - DNA, 15 bp, Homo sapiens
gctagactgggctgg

SEQ ID NO: 4309360 - DNA, 16 bp, Homo sapiens
gctagactgggctggc

SEQ ID NO: 4309361 - DNA, 18 bp, Homo sapiens
gctagactgggctggctg

SEQ ID NO: 4309362 - DNA, 19 bp, Homo sapiens
gctagactgggctggctgc

SEQ ID NO: 4309363 - DNA, 20 bp, Homo sapiens
gctagagcattctggggtgg

SEQ ID NO: 4309364 - DNA, 17 bp, Homo sapiens
gctagaggattagtaag

SEQ ID NO: 4309365 - DNA, 19 bp, Homo sapiens
gctagatgggcatggggtg

SEQ ID NO: 4309366 - DNA, 14 bp, Homo sapiens
gctagccatatatt

SEQ ID NO: 4309367 - DNA, 14 bp, Homo sapiens
gctaggtgggccag

SEQ ID NO: 4309368 - DNA, 18 bp, Homo sapiens
gctaggtgggccagcccc

SEQ ID NO: 4309369 - DNA, 22 bp, Homo sapiens
gctaggttaataggaggacaga

SEQ ID NO: 4309370 - DNA, 12 bp, Homo sapiens
gctatccagccg

SEQ ID NO: 4309371 - DNA, 20 bp, Homo sapiens
gctatctactgagacatgac

SEQ ID NO: 4309372 - DNA, 13 bp, Homo sapiens
gctatcttcatgt

SEQ ID NO: 4309373 - DNA, 14 bp, Homo sapiens
gctatcttcatgta

SEQ ID NO: 4309374 - DNA, 18 bp, Homo sapiens
gctatgccactaggccct

SEQ ID NO: 4309375 - DNA, 20 bp, Homo sapiens
gctatgccactaggccctgg

SEQ ID NO: 4309376 - DNA, 19 bp, Homo sapiens
gctattaacaattaattgt

SEQ ID NO: 4309377 - DNA, 14 bp, Homo sapiens
gctattaagaaact

SEQ ID NO: 4309378 - DNA, 15 bp, Homo sapiens
gctattaatatttgt

SEQ ID NO: 4309379 - DNA, 14 bp, Homo sapiens
gctattcccaggca

SEQ ID NO: 4309380 - DNA, 14 bp, Homo sapiens
gctcaataaaggtc

SEQ ID NO: 4309381 - DNA, 17 bp, Homo sapiens
gctcacaactgtttttg

SEQ ID NO: 4309382 - DNA, 13 bp, Homo sapiens
gctcacaccagcc

SEQ ID NO: 4309383 - DNA, 15 bp, Homo sapiens
gctcacccaggacct

SEQ ID NO: 4309384 - DNA, 16 bp, Homo sapiens
gctcaccctgctccta

SEQ ID NO: 4309385 - DNA, 21 bp, Homo sapiens
gctcacttcaagctcaccctg

SEQ ID NO: 4309386 - DNA, 22 bp, Homo sapiens
gctcacttcaagctcaccctgc

SEQ ID NO: 4309387 - DNA, 14 bp, Homo sapiens
gctcagcacagcct

SEQ ID NO: 4309388 - DNA, 21 bp, Homo sapiens
gctcagcacagcctcacccct

SEQ ID NO: 4309389 - DNA, 18 bp, Homo sapiens
gctcagccctccctgccc

SEQ ID NO: 4309390 - DNA, 21 bp, Homo sapiens
gctcagccctccctgcccctc

SEQ ID NO: 4309391 - DNA, 13 bp, Homo sapiens
gctcaggcctcac

SEQ ID NO: 4309392 - DNA, 17 bp, Homo sapiens
gctcaggcctcacctgg

SEQ ID NO: 4309393 - DNA, 18 bp, Homo sapiens
gctcaggcctcacctggc

SEQ ID NO: 4309394 - DNA, 19 bp, Homo sapiens
gctcaggcctcacctggct

SEQ ID NO: 4309395 - DNA, 13 bp, Homo sapiens
gctcagggctgga

SEQ ID NO: 4309396 - DNA, 21 bp, Homo sapiens
gctcagggtgctccctcctca

SEQ ID NO: 4309397 - DNA, 15 bp, Homo sapiens
gctcatcagaaacaa

SEQ ID NO: 4309398 - DNA, 23 bp, Homo sapiens
gctccaccgggagggacagtctg

SEQ ID NO: 4309399 - DNA, 20 bp, Homo sapiens
gctccacgggggcctagtgg

SEQ ID NO: 4309400 - DNA, 17 bp, Homo sapiens
gctccagacccccagca

SEQ ID NO: 4309401 - DNA, 16 bp, Homo sapiens
gctccagccaacccct

SEQ ID NO: 4309402 - DNA, 22 bp, Homo sapiens
gctccagccaacccctgtggag

SEQ ID NO: 4309403 - DNA, 14 bp, Homo sapiens
gctccaggcttcct

SEQ ID NO: 4309404 - DNA, 15 bp, Homo sapiens
gctccagtgttttct

SEQ ID NO: 4309405 - DNA, 16 bp, Homo sapiens
gctccatgggcacctc

SEQ ID NO: 4309406 - DNA, 17 bp, Homo sapiens
gctcccacaggcccttc

SEQ ID NO: 4309407 - DNA, 13 bp, Homo sapiens
gctcccacgccct

SEQ ID NO: 4309408 - DNA, 16 bp, Homo sapiens
gctcccacgccctcct

SEQ ID NO: 4309409 - DNA, 14 bp, Homo sapiens
gctcccagcccact

SEQ ID NO: 4309410 - DNA, 13 bp, Homo sapiens
gctcccaggacgc

SEQ ID NO: 4309411 - DNA, 20 bp, Homo sapiens
gctcccaggacgcagggaga

SEQ ID NO: 4309412 - DNA, 22 bp, Homo sapiens
gctcccagggccatgaactttg

SEQ ID NO: 4309413 - DNA, 15 bp, Homo sapiens
gctccccagcccagg

SEQ ID NO: 4309414 - DNA, 16 bp, Homo sapiens
gctccccagcccaggg

SEQ ID NO: 4309415 - DNA, 22 bp, Homo sapiens
gctccccatggctcctcaccac

SEQ ID NO: 4309416 - DNA, 16 bp, Homo sapiens
gctcccccatcctccc

SEQ ID NO: 4309417 - DNA, 20 bp, Homo sapiens
gctcccccatcctccccttc

SEQ ID NO: 4309418 - DNA, 15 bp, Homo sapiens
gctccctcctcagtc

SEQ ID NO: 4309419 - DNA, 12 bp, Homo sapiens
gctccctgggct

SEQ ID NO: 4309420 - DNA, 14 bp, Homo sapiens
gctcctccccgatc

SEQ ID NO: 4309421 - DNA, 20 bp, Homo sapiens
gctcctccccgatccccgac

SEQ ID NO: 4309422 - DNA, 18 bp, Homo sapiens
gctcctcggccagagctc

SEQ ID NO: 4309423 - DNA, 21 bp, Homo sapiens
gctcctcggccagagctccca

SEQ ID NO: 4309424 - DNA, 22 bp, Homo sapiens
gctcctcggccagagctcccag

SEQ ID NO: 4309425 - DNA, 23 bp, Homo sapiens
gctcctcggccagagctcccagg

SEQ ID NO: 4309426 - DNA, 11 bp, Homo sapiens
gctcctctgcc

SEQ ID NO: 4309427 - DNA, 12 bp, Homo sapiens
gctcctctgcct

SEQ ID NO: 4309428 - DNA, 14 bp, Homo sapiens
gctcctctgcctgt

SEQ ID NO: 4309429 - DNA, 19 bp, Homo sapiens
gctcctctgcctgtgcccg

SEQ ID NO: 4309430 - DNA, 20 bp, Homo sapiens
gctcctctgcctgtgcccgc

SEQ ID NO: 4309431 - DNA, 16 bp, Homo sapiens
gctcctctgccttgga

SEQ ID NO: 4309432 - DNA, 20 bp, Homo sapiens
gctcctctgccttggacacc

SEQ ID NO: 4309433 - DNA, 12 bp, Homo sapiens
gctcctctgggc

SEQ ID NO: 4309434 - DNA, 13 bp, Homo sapiens
gctcctctgggca

SEQ ID NO: 4309435 - DNA, 14 bp, Homo sapiens
gctcctctgggcag

SEQ ID NO: 4309436 - DNA, 19 bp, Homo sapiens
gctcctgctgaccttctgc

SEQ ID NO: 4309437 - DNA, 17 bp, Homo sapiens
gctcctttccctggaag

SEQ ID NO: 4309438 - DNA, 15 bp, Homo sapiens
gctcgttcccccagg

SEQ ID NO: 4309439 - DNA, 17 bp, Homo sapiens
gctctaactgattcagg

SEQ ID NO: 4309440 - DNA, 19 bp, Homo sapiens
gctctagacaaccctgcaa

SEQ ID NO: 4309441 - DNA, 17 bp, Homo sapiens
gctctattgtagcattt

SEQ ID NO: 4309442 - DNA, 21 bp, Homo sapiens
gctctcccctgcgcaggccct

SEQ ID NO: 4309443 - DNA, 14 bp, Homo sapiens
gctctcctgggcca

SEQ ID NO: 4309444 - DNA, 19 bp, Homo sapiens
gctctcctgggccagggtc

SEQ ID NO: 4309445 - DNA, 11 bp, Homo sapiens
gctctctgtct

SEQ ID NO: 4309446 - DNA, 15 bp, Homo sapiens
gctctgaaagctgct

SEQ ID NO: 4309447 - DNA, 18 bp, Homo sapiens
gctctgaaagctgcttct

SEQ ID NO: 4309448 - DNA, 18 bp, Homo sapiens
gctctgacctgcccccgc

SEQ ID NO: 4309449 - DNA, 18 bp, Homo sapiens
gctctgcagcacattgcc

SEQ ID NO: 4309450 - DNA, 20 bp, Homo sapiens
gctctgcagcacattgccct

SEQ ID NO: 4309451 - DNA, 17 bp, Homo sapiens
gctctgcatgctcctct

SEQ ID NO: 4309452 - DNA, 20 bp, Homo sapiens
gctctgcatgctcctctgcc

SEQ ID NO: 4309453 - DNA, 21 bp, Homo sapiens
gctctgcatgctcctctgcct

SEQ ID NO: 4309454 - DNA, 18 bp, Homo sapiens
gctctgccatcagcccct

SEQ ID NO: 4309455 - DNA, 19 bp, Homo sapiens
gctctgccatcagcccctg

SEQ ID NO: 4309456 - DNA, 11 bp, Homo sapiens
gctctggcagg

SEQ ID NO: 4309457 - DNA, 22 bp, Homo sapiens
gctctggcaggtggccagggct

SEQ ID NO: 4309458 - DNA, 14 bp, Homo sapiens
gctcttcaccagga

SEQ ID NO: 4309459 - DNA, 15 bp, Homo sapiens
gctcttcaccaggaa

SEQ ID NO: 4309460 - DNA, 16 bp, Homo sapiens
gctcttcaccaggaag

SEQ ID NO: 4309461 - DNA, 13 bp, Homo sapiens
gctcttctccttt

SEQ ID NO: 4309462 - DNA, 17 bp, Homo sapiens
gctcttggcaggagtgg

SEQ ID NO: 4309463 - DNA, 15 bp, Homo sapiens
gctcttttcacagct

SEQ ID NO: 4309464 - DNA, 12 bp, Homo sapiens
gctgaaaagtgc

SEQ ID NO: 4309465 - DNA, 14 bp, Homo sapiens
gctgaaaagtgctt

SEQ ID NO: 4309466 - DNA, 20 bp, Homo sapiens
gctgagactggatactgccc

SEQ ID NO: 4309467 - DNA, 14 bp, Homo sapiens
gctgagagtggggc

SEQ ID NO: 4309468 - DNA, 15 bp, Homo sapiens
gctgagagtggggct

SEQ ID NO: 4309469 - DNA, 14 bp, Homo sapiens
gctgagctggccta

SEQ ID NO: 4309470 - DNA, 20 bp, Homo sapiens
gctgagctgtgccagctgct

SEQ ID NO: 4309471 - DNA, 21 bp, Homo sapiens
gctgagctgtgccagctgctt

SEQ ID NO: 4309472 - DNA, 22 bp, Homo sapiens
gctgagctgtgccagctgcttc

SEQ ID NO: 4309473 - DNA, 20 bp, Homo sapiens
gctgaggccagaggaaggga

SEQ ID NO: 4309474 - DNA, 15 bp, Homo sapiens
gctgagggcagggtt

SEQ ID NO: 4309475 - DNA, 22 bp, Homo sapiens
gctgagggcagggttctagaag

SEQ ID NO: 4309476 - DNA, 14 bp, Homo sapiens
gctgaggtgggcct

SEQ ID NO: 4309477 - DNA, 16 bp, Homo sapiens
gctgagtggtccacat

SEQ ID NO: 4309478 - DNA, 20 bp, Homo sapiens
gctgcaatacattaaaataa

SEQ ID NO: 4309479 - DNA, 16 bp, Homo sapiens
gctgcacctgcaggga

SEQ ID NO: 4309480 - DNA, 16 bp, Homo sapiens
gctgcagaaccagtcc

SEQ ID NO: 4309481 - DNA, 15 bp, Homo sapiens
gctgcaggaatcaaa

SEQ ID NO: 4309482 - DNA, 13 bp, Homo sapiens
gctgcagggtggc

SEQ ID NO: 4309483 - DNA, 20 bp, Homo sapiens
gctgcagtcagcacagagag

SEQ ID NO: 4309484 - DNA, 18 bp, Homo sapiens
gctgcagttagcacagag

SEQ ID NO: 4309485 - DNA, 17 bp, Homo sapiens
gctgcatcctcagcccc

SEQ ID NO: 4309486 - DNA, 18 bp, Homo sapiens
gctgcatcctcagcccca

SEQ ID NO: 4309487 - DNA, 18 bp, Homo sapiens
gctgccacacttcaggct

SEQ ID NO: 4309488 - DNA, 21 bp, Homo sapiens
gctgccatgattttggccact

SEQ ID NO: 4309489 - DNA, 18 bp, Homo sapiens
gctgcccaccccctgctg

SEQ ID NO: 4309490 - DNA, 22 bp, Homo sapiens
gctgcccaccccctgctggtgc

SEQ ID NO: 4309491 - DNA, 19 bp, Homo sapiens
gctgcccacgctcctgccc

SEQ ID NO: 4309492 - DNA, 20 bp, Homo sapiens
gctgcccacgctcctgccct

SEQ ID NO: 4309493 - DNA, 23 bp, Homo sapiens
gctgcccacgctcctgccctcgt

SEQ ID NO: 4309494 - DNA, 15 bp, Homo sapiens
gctgcccccagaccc

SEQ ID NO: 4309495 - DNA, 15 bp, Homo sapiens
gctgccccctacccg

SEQ ID NO: 4309496 - DNA, 14 bp, Homo sapiens
gctgccctccatcc

SEQ ID NO: 4309497 - DNA, 20 bp, Homo sapiens
gctgccctggtgctgccaca

SEQ ID NO: 4309498 - DNA, 19 bp, Homo sapiens
gctgccgtgcacggggcca

SEQ ID NO: 4309499 - DNA, 20 bp, Homo sapiens
gctgccgtgcacggggccag

SEQ ID NO: 4309500 - DNA, 21 bp, Homo sapiens
gctgccgtgcacggggccagc

SEQ ID NO: 4309501 - DNA, 13 bp, Homo sapiens
gctgcctccccaa

SEQ ID NO: 4309502 - DNA, 20 bp, Homo sapiens
gctgcctccccaaccctgcc

SEQ ID NO: 4309503 - DNA, 21 bp, Homo sapiens
gctgcctccccaaccctgccc

SEQ ID NO: 4309504 - DNA, 17 bp, Homo sapiens
gctgcctctgaaaatat

SEQ ID NO: 4309505 - DNA, 17 bp, Homo sapiens
gctgcctgcctccggcc

SEQ ID NO: 4309506 - DNA, 20 bp, Homo sapiens
gctgcctgtggtgaggtcct

SEQ ID NO: 4309507 - DNA, 15 bp, Homo sapiens
gctgccttctgcgga

SEQ ID NO: 4309508 - DNA, 15 bp, Homo sapiens
gctgccttctgtctc

SEQ ID NO: 4309509 - DNA, 17 bp, Homo sapiens
gctgcgctgccctgcaa

SEQ ID NO: 4309510 - DNA, 15 bp, Homo sapiens
gctgctcatttcact

SEQ ID NO: 4309511 - DNA, 20 bp, Homo sapiens
gctgctcctcgcagttcggt

SEQ ID NO: 4309512 - DNA, 13 bp, Homo sapiens
gctgctgcaccaa

SEQ ID NO: 4309513 - DNA, 15 bp, Homo sapiens
gctgctgcaccaacc

SEQ ID NO: 4309514 - DNA, 17 bp, Homo sapiens
gctgctgcactgccctc

SEQ ID NO: 4309515 - DNA, 21 bp, Homo sapiens
gctgctgcagtcagcacagag

SEQ ID NO: 4309516 - DNA, 12 bp, Homo sapiens
gctgctggctcc

SEQ ID NO: 4309517 - DNA, 13 bp, Homo sapiens
gctgctggctccc

SEQ ID NO: 4309518 - DNA, 14 bp, Homo sapiens
gctgctgtgaattt

SEQ ID NO: 4309519 - DNA, 15 bp, Homo sapiens
gctgctgtggcatca

SEQ ID NO: 4309520 - DNA, 14 bp, Homo sapiens
gctgcttccctctg

SEQ ID NO: 4309521 - DNA, 15 bp, Homo sapiens
gctgcttctgcccac

SEQ ID NO: 4309522 - DNA, 16 bp, Homo sapiens
gctgcttctgcccacc

SEQ ID NO: 4309523 - DNA, 22 bp, Homo sapiens
gctgcttctgcccaccccgcct

SEQ ID NO: 4309524 - DNA, 19 bp, Homo sapiens
gctgctttccaacacacaa

SEQ ID NO: 4309525 - DNA, 16 bp, Homo sapiens
gctgctttccatggca

SEQ ID NO: 4309526 - DNA, 13 bp, Homo sapiens
gctgctttcttct

SEQ ID NO: 4309527 - DNA, 14 bp, Homo sapiens
gctggactggaggc

SEQ ID NO: 4309528 - DNA, 19 bp, Homo sapiens
gctggactggaggctgggt

SEQ ID NO: 4309529 - DNA, 15 bp, Homo sapiens
gctggattggcaggt

SEQ ID NO: 4309530 - DNA, 18 bp, Homo sapiens
gctggcaccgccttctct

SEQ ID NO: 4309531 - DNA, 21 bp, Homo sapiens
gctggcaggagacactggtct

SEQ ID NO: 4309532 - DNA, 22 bp, Homo sapiens
gctggcatggggaggggagaga

SEQ ID NO: 4309533 - DNA, 13 bp, Homo sapiens
gctggccagctgt

SEQ ID NO: 4309534 - DNA, 17 bp, Homo sapiens
gctggctcccagggcca

SEQ ID NO: 4309535 - DNA, 16 bp, Homo sapiens
gctggctcccatctcc

SEQ ID NO: 4309536 - DNA, 13 bp, Homo sapiens
gctggctctgcag

SEQ ID NO: 4309537 - DNA, 16 bp, Homo sapiens
gctggctctgcagcac

SEQ ID NO: 4309538 - DNA, 11 bp, Homo sapiens
gctggctgcct

SEQ ID NO: 4309539 - DNA, 15 bp, Homo sapiens
gctggcttctccctg

SEQ ID NO: 4309540 - DNA, 21 bp, Homo sapiens
gctggcttctccctggactct

SEQ ID NO: 4309541 - DNA, 17 bp, Homo sapiens
gctgggagaaaagccag

SEQ ID NO: 4309542 - DNA, 18 bp, Homo sapiens
gctgggagaaaagccaga

SEQ ID NO: 4309543 - DNA, 13 bp, Homo sapiens
gctgggagagcca

SEQ ID NO: 4309544 - DNA, 17 bp, Homo sapiens
gctgggcagaggggaga

SEQ ID NO: 4309545 - DNA, 20 bp, Homo sapiens
gctggggaatcccctcgctt

SEQ ID NO: 4309546 - DNA, 18 bp, Homo sapiens
gctggggcttttgtgcca

SEQ ID NO: 4309547 - DNA, 20 bp, Homo sapiens
gctggggcttttgtgccagg

SEQ ID NO: 4309548 - DNA, 17 bp, Homo sapiens
gctgggtcccgggtgcc

SEQ ID NO: 4309549 - DNA, 17 bp, Homo sapiens
gctgggtggccggccct

SEQ ID NO: 4309550 - DNA, 19 bp, Homo sapiens
gctgggtggccggccctgc

SEQ ID NO: 4309551 - DNA, 13 bp, Homo sapiens
gctgggtgggaat

SEQ ID NO: 4309552 - DNA, 17 bp, Homo sapiens
gctgggttctggggctg

SEQ ID NO: 4309553 - DNA, 23 bp, Homo sapiens
gctgggttctggggctgagagtg

SEQ ID NO: 4309554 - DNA, 17 bp, Homo sapiens
gctgggtttgggcagtg

SEQ ID NO: 4309555 - DNA, 16 bp, Homo sapiens
gctggtcatcctgggc

SEQ ID NO: 4309556 - DNA, 17 bp, Homo sapiens
gctggtctctaggcctg

SEQ ID NO: 4309557 - DNA, 20 bp, Homo sapiens
gctggtgcccacccttcgca

SEQ ID NO: 4309558 - DNA, 16 bp, Homo sapiens
gctggtttggtggcca

SEQ ID NO: 4309559 - DNA, 17 bp, Homo sapiens
gctggtttggtggccag

SEQ ID NO: 4309560 - DNA, 19 bp, Homo sapiens
gctggtttggtggccaggc

SEQ ID NO: 4309561 - DNA, 16 bp, Homo sapiens
gctgtacgtctggtgt

SEQ ID NO: 4309562 - DNA, 15 bp, Homo sapiens
gctgtatacaaacag

SEQ ID NO: 4309563 - DNA, 17 bp, Homo sapiens
gctgtatgtcattaaag

SEQ ID NO: 4309564 - DNA, 24 bp, Homo sapiens
gctgtattttcttttatatctgta

SEQ ID NO: 4309565 - DNA, 19 bp, Homo sapiens
gctgtatttttagagatta

SEQ ID NO: 4309566 - DNA, 16 bp, Homo sapiens
gctgtcccctgcaagt

SEQ ID NO: 4309567 - DNA, 14 bp, Homo sapiens
gctgtctgtggctt

SEQ ID NO: 4309568 - DNA, 17 bp, Homo sapiens
gctgtctgtgtgaggct

SEQ ID NO: 4309569 - DNA, 14 bp, Homo sapiens
gctgtgaatttttt

SEQ ID NO: 4309570 - DNA, 22 bp, Homo sapiens
gctgtgatttttgttgattaaa

SEQ ID NO: 4309571 - DNA, 15 bp, Homo sapiens
gctgtgccagctgct

SEQ ID NO: 4309572 - DNA, 16 bp, Homo sapiens
gctgtgccagctgctt

SEQ ID NO: 4309573 - DNA, 23 bp, Homo sapiens
gctgtgctggtctctaggcctga

SEQ ID NO: 4309574 - DNA, 18 bp, Homo sapiens
gctgtggcatcaggaaag

SEQ ID NO: 4309575 - DNA, 18 bp, Homo sapiens
gctgtggcccctccttct

SEQ ID NO: 4309576 - DNA, 23 bp, Homo sapiens
gctgtgggtcagtgtgccaccct

SEQ ID NO: 4309577 - DNA, 13 bp, Homo sapiens
gctgttctctgct

SEQ ID NO: 4309578 - DNA, 16 bp, Homo sapiens
gctgttctctgctttt

SEQ ID NO: 4309579 - DNA, 20 bp, Homo sapiens
gctgttcttctgttctgcag

SEQ ID NO: 4309580 - DNA, 21 bp, Homo sapiens
gctgttttatgtcatactctg

SEQ ID NO: 4309581 - DNA, 13 bp, Homo sapiens
gcttagaatgggg

SEQ ID NO: 4309582 - DNA, 13 bp, Homo sapiens
gcttatttatatt

SEQ ID NO: 4309583 - DNA, 14 bp, Homo sapiens
gcttatttatattc

SEQ ID NO: 4309584 - DNA, 11 bp, Homo sapiens
gcttatttcta

SEQ ID NO: 4309585 - DNA, 14 bp, Homo sapiens
gcttcataggcaga

SEQ ID NO: 4309586 - DNA, 21 bp, Homo sapiens
gcttcataggcagagcccgcc

SEQ ID NO: 4309587 - DNA, 10 bp, Homo sapiens
gcttccagat

SEQ ID NO: 4309588 - DNA, 12 bp, Homo sapiens
gcttcccaggac

SEQ ID NO: 4309589 - DNA, 18 bp, Homo sapiens
gcttcccaggaccctggg

SEQ ID NO: 4309590 - DNA, 19 bp, Homo sapiens
gcttcccaggaccctgggt

SEQ ID NO: 4309591 - DNA, 17 bp, Homo sapiens
gcttcccatgtctttct

SEQ ID NO: 4309592 - DNA, 15 bp, Homo sapiens
gcttccccatcgcct

SEQ ID NO: 4309593 - DNA, 12 bp, Homo sapiens
gcttccctctgc

SEQ ID NO: 4309594 - DNA, 15 bp, Homo sapiens
gcttccctctgcctg

SEQ ID NO: 4309595 - DNA, 17 bp, Homo sapiens
gcttccctctgcctgtc

SEQ ID NO: 4309596 - DNA, 19 bp, Homo sapiens
gcttccctctgcctgtccc

SEQ ID NO: 4309597 - DNA, 13 bp, Homo sapiens
gcttccctctgct

SEQ ID NO: 4309598 - DNA, 23 bp, Homo sapiens
gcttccctttcactgaagtgaat

SEQ ID NO: 4309599 - DNA, 13 bp, Homo sapiens
gcttcctgcccta

SEQ ID NO: 4309600 - DNA, 16 bp, Homo sapiens
gcttcctgccctagca

SEQ ID NO: 4309601 - DNA, 14 bp, Homo sapiens
gcttccttcatttc

SEQ ID NO: 4309602 - DNA, 20 bp, Homo sapiens
gcttcgccatgtgctgtgca

SEQ ID NO: 4309603 - DNA, 23 bp, Homo sapiens
gcttctccacaacctcctcctcc

SEQ ID NO: 4309604 - DNA, 20 bp, Homo sapiens
gcttctccctggactctgtg

SEQ ID NO: 4309605 - DNA, 14 bp, Homo sapiens
gcttgaagccaagt

SEQ ID NO: 4309606 - DNA, 14 bp, Homo sapiens
gcttgatgctgttt

SEQ ID NO: 4309607 - DNA, 20 bp, Homo sapiens
gcttgattctaaaggggaca

SEQ ID NO: 4309608 - DNA, 21 bp, Homo sapiens
gcttgcctagggcctggtcca

SEQ ID NO: 4309609 - DNA, 22 bp, Homo sapiens
gcttgcctagggcctggtccat

SEQ ID NO: 4309610 - DNA, 18 bp, Homo sapiens
gcttggatccatacaaaa

SEQ ID NO: 4309611 - DNA, 22 bp, Homo sapiens
gcttggcaggaaccatggacct

SEQ ID NO: 4309612 - DNA, 18 bp, Homo sapiens
gcttggccagaagggggc

SEQ ID NO: 4309613 - DNA, 19 bp, Homo sapiens
gcttggggatgcccttctt

SEQ ID NO: 4309614 - DNA, 14 bp, Homo sapiens
gcttgtagggtgag

SEQ ID NO: 4309615 - DNA, 20 bp, Homo sapiens
gcttgtagggtgaggcgtgg

SEQ ID NO: 4309616 - DNA, 21 bp, Homo sapiens
gcttgtccaacaactccagga

SEQ ID NO: 4309617 - DNA, 11 bp, Homo sapiens
gcttgttcttc

SEQ ID NO: 4309618 - DNA, 22 bp, Homo sapiens
gcttgttcttcctcttacctgt

SEQ ID NO: 4309619 - DNA, 20 bp, Homo sapiens
gcttgtttaaggttcttgct

SEQ ID NO: 4309620 - DNA, 16 bp, Homo sapiens
gcttgtttctatactg

SEQ ID NO: 4309621 - DNA, 13 bp, Homo sapiens
gctttcacaaata

SEQ ID NO: 4309622 - DNA, 18 bp, Homo sapiens
gctttgccttccacgctg

SEQ ID NO: 4309623 - DNA, 20 bp, Homo sapiens
gctttggaaagacctgtgag

SEQ ID NO: 4309624 - DNA, 21 bp, Homo sapiens
gctttggaaagacctgtgagg

SEQ ID NO: 4309625 - DNA, 14 bp, Homo sapiens
gctttgggctgccc

SEQ ID NO: 4309626 - DNA, 15 bp, Homo sapiens
gctttgtgtgattga

SEQ ID NO: 4309627 - DNA, 22 bp, Homo sapiens
gcttttgtacgttaattaaaca

SEQ ID NO: 4309628 - DNA, 21 bp, Homo sapiens
gctttttccatatagtttgtt

SEQ ID NO: 4309629 - DNA, 18 bp, Homo sapiens
gcttttttttgagaatac

SEQ ID NO: 4309630 - DNA, 21 bp, Homo sapiens
ggaaaaccaagccgtggcttc

SEQ ID NO: 4309631 - DNA, 15 bp, Homo sapiens
ggaaaacgatttaat

SEQ ID NO: 4309632 - DNA, 15 bp, Homo sapiens
ggaaaagggcaggag

SEQ ID NO: 4309633 - DNA, 19 bp, Homo sapiens
ggaaagacctgtgagggga

SEQ ID NO: 4309634 - DNA, 19 bp, Homo sapiens
ggaaagccagtgactccag

SEQ ID NO: 4309635 - DNA, 18 bp, Homo sapiens
ggaaagggtgtggcttgg

SEQ ID NO: 4309636 - DNA, 18 bp, Homo sapiens
ggaacagagtatatatgt

SEQ ID NO: 4309637 - DNA, 13 bp, Homo sapiens
ggaaccagagcca

SEQ ID NO: 4309638 - DNA, 23 bp, Homo sapiens
ggaactaaagggtgtgggtcagg

SEQ ID NO: 4309639 - DNA, 12 bp, Homo sapiens
ggaactgctgcc

SEQ ID NO: 4309640 - DNA, 13 bp, Homo sapiens
ggaagaaatcaag

SEQ ID NO: 4309641 - DNA, 23 bp, Homo sapiens
ggaagaacaaatatgattctcct

SEQ ID NO: 4309642 - DNA, 11 bp, Homo sapiens
ggaagaggccg

SEQ ID NO: 4309643 - DNA, 19 bp, Homo sapiens
ggaagaggccgctgcaggg

SEQ ID NO: 4309644 - DNA, 14 bp, Homo sapiens
ggaagcaaggccag

SEQ ID NO: 4309645 - DNA, 22 bp, Homo sapiens
ggaagcacaagaagtgggagtg

SEQ ID NO: 4309646 - DNA, 15 bp, Homo sapiens
ggaagcaccagcctc

SEQ ID NO: 4309647 - DNA, 16 bp, Homo sapiens
ggaagcaccagcctca

SEQ ID NO: 4309648 - DNA, 17 bp, Homo sapiens
ggaagcaccagcctcag

SEQ ID NO: 4309649 - DNA, 19 bp, Homo sapiens
ggaagcaccagcctcagtg

SEQ ID NO: 4309650 - DNA, 23 bp, Homo sapiens
ggaagcactgccattagactgaa

SEQ ID NO: 4309651 - DNA, 16 bp, Homo sapiens
ggaagcagagcctggg

SEQ ID NO: 4309652 - DNA, 15 bp, Homo sapiens
ggaagccacgtgctg

SEQ ID NO: 4309653 - DNA, 18 bp, Homo sapiens
ggaagccacgtgctggag

SEQ ID NO: 4309654 - DNA, 23 bp, Homo sapiens
ggaagccacgtgctggagagtag

SEQ ID NO: 4309655 - DNA, 15 bp, Homo sapiens
ggaagcctcctgctg

SEQ ID NO: 4309656 - DNA, 19 bp, Homo sapiens
ggaagctggcaggagacac

SEQ ID NO: 4309657 - DNA, 14 bp, Homo sapiens
ggaagggaggcctg

SEQ ID NO: 4309658 - DNA, 17 bp, Homo sapiens
ggaagggaggcctgagg

SEQ ID NO: 4309659 - DNA, 19 bp, Homo sapiens
ggaagggaggcctgagggg

SEQ ID NO: 4309660 - DNA, 19 bp, Homo sapiens
ggaaggtctcatgcctgag

SEQ ID NO: 4309661 - DNA, 20 bp, Homo sapiens
ggaagtcaggagccagcagg

SEQ ID NO: 4309662 - DNA, 19 bp, Homo sapiens
ggaagtcatcctgcaatgg

SEQ ID NO: 4309663 - DNA, 19 bp, Homo sapiens
ggaagtgacaaggccccag

SEQ ID NO: 4309664 - DNA, 21 bp, Homo sapiens
ggaagtgacaaggccccagag

SEQ ID NO: 4309665 - DNA, 15 bp, Homo sapiens
ggaagtgtgctgagg

SEQ ID NO: 4309666 - DNA, 17 bp, Homo sapiens
ggaagtgtgctgaggtg

SEQ ID NO: 4309667 - DNA, 21 bp, Homo sapiens
ggaataagaagcaaataaata

SEQ ID NO: 4309668 - DNA, 14 bp, Homo sapiens
ggaatcaaaaattg

SEQ ID NO: 4309669 - DNA, 17 bp, Homo sapiens
ggaatcagggagcactg

SEQ ID NO: 4309670 - DNA, 22 bp, Homo sapiens
ggaatgcgctcttcaccaggaa

SEQ ID NO: 4309671 - DNA, 23 bp, Homo sapiens
ggaatgctcccccatcctcccct

SEQ ID NO: 4309672 - DNA, 13 bp, Homo sapiens
ggaattctcttgg

SEQ ID NO: 4309673 - DNA, 13 bp, Homo sapiens
ggacaagcagtgg

SEQ ID NO: 4309674 - DNA, 11 bp, Homo sapiens
ggacacagagg

SEQ ID NO: 4309675 - DNA, 22 bp, Homo sapiens
ggacactgcctttgctgccttc

SEQ ID NO: 4309676 - DNA, 13 bp, Homo sapiens
ggacagacccagg

SEQ ID NO: 4309677 - DNA, 17 bp, Homo sapiens
ggacagacccagggtgg

SEQ ID NO: 4309678 - DNA, 21 bp, Homo sapiens
ggacagggagggaacagacct

SEQ ID NO: 4309679 - DNA, 14 bp, Homo sapiens
ggacatcatgaagc

SEQ ID NO: 4309680 - DNA, 18 bp, Homo sapiens
ggaccaaggagatgggga

SEQ ID NO: 4309681 - DNA, 23 bp, Homo sapiens
ggaccccatctgctgagctctga

SEQ ID NO: 4309682 - DNA, 20 bp, Homo sapiens
ggacccggaggggcctggca

SEQ ID NO: 4309683 - DNA, 19 bp, Homo sapiens
ggaccctcggggcaggaag

SEQ ID NO: 4309684 - DNA, 22 bp, Homo sapiens
ggaccgccagatggggcctctg

SEQ ID NO: 4309685 - DNA, 19 bp, Homo sapiens
ggacctcagagtccaggcc

SEQ ID NO: 4309686 - DNA, 17 bp, Homo sapiens
ggacctccacctgggag

SEQ ID NO: 4309687 - DNA, 20 bp, Homo sapiens
ggacctctgggggttgttgg

SEQ ID NO: 4309688 - DNA, 19 bp, Homo sapiens
ggacctgcagttggcctca

SEQ ID NO: 4309689 - DNA, 13 bp, Homo sapiens
ggacgcagggaga

SEQ ID NO: 4309690 - DNA, 14 bp, Homo sapiens
ggacgcagggagac

SEQ ID NO: 4309691 - DNA, 19 bp, Homo sapiens
ggacgcagggagaccctgg

SEQ ID NO: 4309692 - DNA, 14 bp, Homo sapiens
ggacgcatgcaggg

SEQ ID NO: 4309693 - DNA, 17 bp, Homo sapiens
ggacggagcactgtgca

SEQ ID NO: 4309694 - DNA, 15 bp, Homo sapiens
ggactgcatgcaagc

SEQ ID NO: 4309695 - DNA, 16 bp, Homo sapiens
ggactggaggctgggt

SEQ ID NO: 4309696 - DNA, 23 bp, Homo sapiens
ggactgggaagggggcaggcccc

SEQ ID NO: 4309697 - DNA, 15 bp, Homo sapiens
ggactggtccaggca

SEQ ID NO: 4309698 - DNA, 12 bp, Homo sapiens
ggactgtggcct

SEQ ID NO: 4309699 - DNA, 15 bp, Homo sapiens
ggactgtggcctcag

SEQ ID NO: 4309700 - DNA, 22 bp, Homo sapiens
ggactgtggcctcaggaggcag

SEQ ID NO: 4309701 - DNA, 23 bp, Homo sapiens
ggacttgtgcctcttgggagacg

SEQ ID NO: 4309702 - DNA, 22 bp, Homo sapiens
ggactttgctgatttcccctct

SEQ ID NO: 4309703 - DNA, 21 bp, Homo sapiens
ggagaacctcgttgacatgca

SEQ ID NO: 4309704 - DNA, 15 bp, Homo sapiens
ggagaacttgaacaa

SEQ ID NO: 4309705 - DNA, 14 bp, Homo sapiens
ggagaaggagaggc

SEQ ID NO: 4309706 - DNA, 13 bp, Homo sapiens
ggagaaggcctgc

SEQ ID NO: 4309707 - DNA, 22 bp, Homo sapiens
ggagaaggcctgccccccttcc

SEQ ID NO: 4309708 - DNA, 14 bp, Homo sapiens
ggagaagggacagc

SEQ ID NO: 4309709 - DNA, 16 bp, Homo sapiens
ggagaatggctctggc

SEQ ID NO: 4309710 - DNA, 15 bp, Homo sapiens
ggagaccaggactct

SEQ ID NO: 4309711 - DNA, 17 bp, Homo sapiens
ggagaccaggactctgc

SEQ ID NO: 4309712 - DNA, 21 bp, Homo sapiens
ggagaccaggactctgccttc

SEQ ID NO: 4309713 - DNA, 23 bp, Homo sapiens
ggagaccaggactctgccttcca

SEQ ID NO: 4309714 - DNA, 14 bp, Homo sapiens
ggagaccctgggag

SEQ ID NO: 4309715 - DNA, 14 bp, Homo sapiens
ggagaccctgtctt

SEQ ID NO: 4309716 - DNA, 22 bp, Homo sapiens
ggagaccgagtgtggagctgct

SEQ ID NO: 4309717 - DNA, 23 bp, Homo sapiens
ggagacgtccacccgtttccaag

SEQ ID NO: 4309718 - DNA, 17 bp, Homo sapiens
ggagactatgtgtcatg

SEQ ID NO: 4309719 - DNA, 17 bp, Homo sapiens
ggagactgacccattca

SEQ ID NO: 4309720 - DNA, 23 bp, Homo sapiens
ggagactgacccattcacatttt

SEQ ID NO: 4309721 - DNA, 16 bp, Homo sapiens
ggagactgtctcaaga

SEQ ID NO: 4309722 - DNA, 18 bp, Homo sapiens
ggagacttaggccagagg

SEQ ID NO: 4309723 - DNA, 14 bp, Homo sapiens
ggagagaaggtggt

SEQ ID NO: 4309724 - DNA, 15 bp, Homo sapiens
ggagagaaggtggtc

SEQ ID NO: 4309725 - DNA, 19 bp, Homo sapiens
ggagagaatgagagagtgt

SEQ ID NO: 4309726 - DNA, 17 bp, Homo sapiens
ggagagaccttctctta

SEQ ID NO: 4309727 - DNA, 17 bp, Homo sapiens
ggagagagttgaaccta

SEQ ID NO: 4309728 - DNA, 11 bp, Homo sapiens
ggagaggaagc

SEQ ID NO: 4309729 - DNA, 13 bp, Homo sapiens
ggagaggaagcac

SEQ ID NO: 4309730 - DNA, 12 bp, Homo sapiens
ggagaggaagcc

SEQ ID NO: 4309731 - DNA, 13 bp, Homo sapiens
ggagaggaagcca

SEQ ID NO: 4309732 - DNA, 12 bp, Homo sapiens
ggagaggagaga

SEQ ID NO: 4309733 - DNA, 13 bp, Homo sapiens
ggagaggagagaa

SEQ ID NO: 4309734 - DNA, 16 bp, Homo sapiens
ggagagtgctcaacct

SEQ ID NO: 4309735 - DNA, 19 bp, Homo sapiens
ggagatccgccctgggctc

SEQ ID NO: 4309736 - DNA, 22 bp, Homo sapiens
ggagatccgccctgggctctgg

SEQ ID NO: 4309737 - DNA, 15 bp, Homo sapiens
ggagcactggaggcc

SEQ ID NO: 4309738 - DNA, 21 bp, Homo sapiens
ggagcactggaggcctctgca

SEQ ID NO: 4309739 - DNA, 17 bp, Homo sapiens
ggagcaggaagcaaggc

SEQ ID NO: 4309740 - DNA, 20 bp, Homo sapiens
ggagcaggaagcaaggccag

SEQ ID NO: 4309741 - DNA, 19 bp, Homo sapiens
ggagcagtgggccctggct

SEQ ID NO: 4309742 - DNA, 21 bp, Homo sapiens
ggagcagtgggccctggctct

SEQ ID NO: 4309743 - DNA, 20 bp, Homo sapiens
ggagcccccgccccgcccca

SEQ ID NO: 4309744 - DNA, 14 bp, Homo sapiens
ggagcccgcacccc

SEQ ID NO: 4309745 - DNA, 16 bp, Homo sapiens
ggagcccgcaccccca

SEQ ID NO: 4309746 - DNA, 18 bp, Homo sapiens
ggagcccgcacccccacc

SEQ ID NO: 4309747 - DNA, 19 bp, Homo sapiens
ggagccctggggtttccac

SEQ ID NO: 4309748 - DNA, 18 bp, Homo sapiens
ggagcctgcgtggcctgg

SEQ ID NO: 4309749 - DNA, 23 bp, Homo sapiens
ggagcctgcgtggcctggggctg

SEQ ID NO: 4309750 - DNA, 13 bp, Homo sapiens
ggagcgggacctg

SEQ ID NO: 4309751 - DNA, 16 bp, Homo sapiens
ggagctaacactggcc

SEQ ID NO: 4309752 - DNA, 17 bp, Homo sapiens
ggagctaacactggccc

SEQ ID NO: 4309753 - DNA, 15 bp, Homo sapiens
ggagctgaggggcag

SEQ ID NO: 4309754 - DNA, 13 bp, Homo sapiens
ggagctgggaagg

SEQ ID NO: 4309755 - DNA, 14 bp, Homo sapiens
ggagcttccagatg

SEQ ID NO: 4309756 - DNA, 16 bp, Homo sapiens
ggagcttctccagcca

SEQ ID NO: 4309757 - DNA, 20 bp, Homo sapiens
ggaggaaaaccaagccgtgg

SEQ ID NO: 4309758 - DNA, 22 bp, Homo sapiens
ggaggaaaaccaagccgtggct

SEQ ID NO: 4309759 - DNA, 18 bp, Homo sapiens
ggaggaactggtccaggc

SEQ ID NO: 4309760 - DNA, 22 bp, Homo sapiens
ggaggaactggtccaggccagg

SEQ ID NO: 4309761 - DNA, 15 bp, Homo sapiens
ggaggaagggactgg

SEQ ID NO: 4309762 - DNA, 16 bp, Homo sapiens
ggaggaagggactggt

SEQ ID NO: 4309763 - DNA, 19 bp, Homo sapiens
ggaggaatcgaggaaccag

SEQ ID NO: 4309764 - DNA, 22 bp, Homo sapiens
ggaggaatcgaggaaccagagc

SEQ ID NO: 4309765 - DNA, 15 bp, Homo sapiens
ggaggagactcaggc

SEQ ID NO: 4309766 - DNA, 18 bp, Homo sapiens
ggaggagggggcccggct

SEQ ID NO: 4309767 - DNA, 18 bp, Homo sapiens
ggaggccaagtgcaggct

SEQ ID NO: 4309768 - DNA, 20 bp, Homo sapiens
ggaggccaagtgcaggctgg

SEQ ID NO: 4309769 - DNA, 17 bp, Homo sapiens
ggaggccacgggggagg

SEQ ID NO: 4309770 - DNA, 18 bp, Homo sapiens
ggaggccacgggggaggc

SEQ ID NO: 4309771 - DNA, 15 bp, Homo sapiens
ggaggccgaggcagg

SEQ ID NO: 4309772 - DNA, 21 bp, Homo sapiens
ggaggccgaggcaggggctgg

SEQ ID NO: 4309773 - DNA, 14 bp, Homo sapiens
ggaggcctgaaatg

SEQ ID NO: 4309774 - DNA, 12 bp, Homo sapiens
ggaggcctgagg

SEQ ID NO: 4309775 - DNA, 17 bp, Homo sapiens
ggaggcctgaggggcag

SEQ ID NO: 4309776 - DNA, 18 bp, Homo sapiens
ggaggcctgaggggcaga

SEQ ID NO: 4309777 - DNA, 14 bp, Homo sapiens
ggaggcctggtctg

SEQ ID NO: 4309778 - DNA, 17 bp, Homo sapiens
ggaggcgccttcctggg

SEQ ID NO: 4309779 - DNA, 18 bp, Homo sapiens
ggaggctaagcctggaca

SEQ ID NO: 4309780 - DNA, 20 bp, Homo sapiens
ggaggctaagcctggacaca

SEQ ID NO: 4309781 - DNA, 16 bp, Homo sapiens
ggaggcttgggaccgc

SEQ ID NO: 4309782 - DNA, 18 bp, Homo sapiens
ggaggcttgtcagagctg

SEQ ID NO: 4309783 - DNA, 19 bp, Homo sapiens
ggaggcttgtcagagctgg

SEQ ID NO: 4309784 - DNA, 17 bp, Homo sapiens
ggagggaattgaggtct

SEQ ID NO: 4309785 - DNA, 15 bp, Homo sapiens
ggagggacacagagg

SEQ ID NO: 4309786 - DNA, 16 bp, Homo sapiens
ggagggagactgaccc

SEQ ID NO: 4309787 - DNA, 17 bp, Homo sapiens
ggagggagactgaccca

SEQ ID NO: 4309788 - DNA, 18 bp, Homo sapiens
ggagggatagagacgcag

SEQ ID NO: 4309789 - DNA, 14 bp, Homo sapiens
ggaggggcctggca

SEQ ID NO: 4309790 - DNA, 15 bp, Homo sapiens
ggagggggcccggct

SEQ ID NO: 4309791 - DNA, 19 bp, Homo sapiens
ggagggggcccggctgggc

SEQ ID NO: 4309792 - DNA, 18 bp, Homo sapiens
ggagggggtttgggggct

SEQ ID NO: 4309793 - DNA, 15 bp, Homo sapiens
ggagggtggcaggtg

SEQ ID NO: 4309794 - DNA, 18 bp, Homo sapiens
ggaggtcccagacatgct

SEQ ID NO: 4309795 - DNA, 23 bp, Homo sapiens
ggaggtcccagacatgctgccca

SEQ ID NO: 4309796 - DNA, 18 bp, Homo sapiens
ggagtcagggagccctgg

SEQ ID NO: 4309797 - DNA, 14 bp, Homo sapiens
ggagtcctgttctc

SEQ ID NO: 4309798 - DNA, 18 bp, Homo sapiens
ggagtcctgttctcagag

SEQ ID NO: 4309799 - DNA, 21 bp, Homo sapiens
ggagtcctgttctcagagctc

SEQ ID NO: 4309800 - DNA, 15 bp, Homo sapiens
ggagtcgagctggcc

SEQ ID NO: 4309801 - DNA, 16 bp, Homo sapiens
ggagtgagaaattttt

SEQ ID NO: 4309802 - DNA, 12 bp, Homo sapiens
ggagtgggacag

SEQ ID NO: 4309803 - DNA, 18 bp, Homo sapiens
ggagtgggctctgagcag

SEQ ID NO: 4309804 - DNA, 16 bp, Homo sapiens
ggagtggggcagtaga

SEQ ID NO: 4309805 - DNA, 18 bp, Homo sapiens
ggagtggtaacaagagga

SEQ ID NO: 4309806 - DNA, 22 bp, Homo sapiens
ggagtggtaacaagaggagcag

SEQ ID NO: 4309807 - DNA, 13 bp, Homo sapiens
ggagtgtgtgggg

SEQ ID NO: 4309808 - DNA, 17 bp, Homo sapiens
ggagttctaacacattt

SEQ ID NO: 4309809 - DNA, 15 bp, Homo sapiens
ggataattatatcag

SEQ ID NO: 4309810 - DNA, 18 bp, Homo sapiens
ggataggagcttccagat

SEQ ID NO: 4309811 - DNA, 23 bp, Homo sapiens
ggatattacaatggccagcccag

SEQ ID NO: 4309812 - DNA, 15 bp, Homo sapiens
ggatcattatttcat

SEQ ID NO: 4309813 - DNA, 13 bp, Homo sapiens
ggatccagagaga

SEQ ID NO: 4309814 - DNA, 20 bp, Homo sapiens
ggatccctttcactatgtcc

SEQ ID NO: 4309815 - DNA, 19 bp, Homo sapiens
ggatcggaggcttgtcaga

SEQ ID NO: 4309816 - DNA, 23 bp, Homo sapiens
ggatcggaggcttgtcagagctg

SEQ ID NO: 4309817 - DNA, 12 bp, Homo sapiens
ggatctccaggc

SEQ ID NO: 4309818 - DNA, 17 bp, Homo sapiens
ggatctgctccatgcag

SEQ ID NO: 4309819 - DNA, 22 bp, Homo sapiens
ggatctggagtctgaaggagag

SEQ ID NO: 4309820 - DNA, 17 bp, Homo sapiens
ggatgaactagccatga

SEQ ID NO: 4309821 - DNA, 16 bp, Homo sapiens
ggatgcatgcagggcc

SEQ ID NO: 4309822 - DNA, 23 bp, Homo sapiens
ggatgctgggttctggggctgag

SEQ ID NO: 4309823 - DNA, 15 bp, Homo sapiens
ggatgggcacaggct

SEQ ID NO: 4309824 - DNA, 23 bp, Homo sapiens
ggatgggggtcctggtatgtctc

SEQ ID NO: 4309825 - DNA, 18 bp, Homo sapiens
ggatggggttgggctctg

SEQ ID NO: 4309826 - DNA, 12 bp, Homo sapiens
ggatgtagcatg

SEQ ID NO: 4309827 - DNA, 13 bp, Homo sapiens
ggattcaaatgca

SEQ ID NO: 4309828 - DNA, 14 bp, Homo sapiens
ggattcaaatgcat

SEQ ID NO: 4309829 - DNA, 16 bp, Homo sapiens
ggattcaaatgcatga

SEQ ID NO: 4309830 - DNA, 16 bp, Homo sapiens
ggattcttccatctga

SEQ ID NO: 4309831 - DNA, 18 bp, Homo sapiens
ggattggtaccagagcct

SEQ ID NO: 4309832 - DNA, 20 bp, Homo sapiens
ggattgtccacaaatgtcct

SEQ ID NO: 4309833 - DNA, 16 bp, Homo sapiens
ggatttcaagggactg

SEQ ID NO: 4309834 - DNA, 22 bp, Homo sapiens
ggcaaatgtccaagcatcagca

SEQ ID NO: 4309835 - DNA, 19 bp, Homo sapiens
ggcaaccccctcggagcct

SEQ ID NO: 4309836 - DNA, 18 bp, Homo sapiens
ggcaagagctcaggagaa

SEQ ID NO: 4309837 - DNA, 20 bp, Homo sapiens
ggcaagagctcaggagaagg

SEQ ID NO: 4309838 - DNA, 22 bp, Homo sapiens
ggcaagagctcaggagaaggcc

SEQ ID NO: 4309839 - DNA, 14 bp, Homo sapiens
ggcaagctggcagg

SEQ ID NO: 4309840 - DNA, 16 bp, Homo sapiens
ggcaagctggcaggag

SEQ ID NO: 4309841 - DNA, 12 bp, Homo sapiens
ggcacagccaga

SEQ ID NO: 4309842 - DNA, 15 bp, Homo sapiens
ggcacagccagaaac

SEQ ID NO: 4309843 - DNA, 15 bp, Homo sapiens
ggcacaggctgcccc

SEQ ID NO: 4309844 - DNA, 15 bp, Homo sapiens
ggcactggtggcccg

SEQ ID NO: 4309845 - DNA, 14 bp, Homo sapiens
ggcagaaggaggaa

SEQ ID NO: 4309846 - DNA, 16 bp, Homo sapiens
ggcagaatggtgggct

SEQ ID NO: 4309847 - DNA, 19 bp, Homo sapiens
ggcagagattgggggggct

SEQ ID NO: 4309848 - DNA, 21 bp, Homo sapiens
ggcagagcccgcccacctggg

SEQ ID NO: 4309849 - DNA, 22 bp, Homo sapiens
ggcagagcccgcccacctgggc

SEQ ID NO: 4309850 - DNA, 14 bp, Homo sapiens
ggcagagctcagca

SEQ ID NO: 4309851 - DNA, 15 bp, Homo sapiens
ggcagaggacagatc

SEQ ID NO: 4309852 - DNA, 16 bp, Homo sapiens
ggcagaggggagagga

SEQ ID NO: 4309853 - DNA, 19 bp, Homo sapiens
ggcagaggggagaggaagc

SEQ ID NO: 4309854 - DNA, 16 bp, Homo sapiens
ggcagcaacaggacca

SEQ ID NO: 4309855 - DNA, 16 bp, Homo sapiens
ggcagccaccctgcca

SEQ ID NO: 4309856 - DNA, 12 bp, Homo sapiens
ggcagcccagag

SEQ ID NO: 4309857 - DNA, 23 bp, Homo sapiens
ggcagcccagagagaccctgcca

SEQ ID NO: 4309858 - DNA, 13 bp, Homo sapiens
ggcagccccccag

SEQ ID NO: 4309859 - DNA, 15 bp, Homo sapiens
ggcagcccctcccca

SEQ ID NO: 4309860 - DNA, 13 bp, Homo sapiens
ggcagcctgcaga

SEQ ID NO: 4309861 - DNA, 15 bp, Homo sapiens
ggcagcctgcagacc

SEQ ID NO: 4309862 - DNA, 17 bp, Homo sapiens
ggcagcctgtgggagaa

SEQ ID NO: 4309863 - DNA, 18 bp, Homo sapiens
ggcagcctgtgggagaag

SEQ ID NO: 4309864 - DNA, 14 bp, Homo sapiens
ggcagctgccagag

SEQ ID NO: 4309865 - DNA, 16 bp, Homo sapiens
ggcagctgccagagaa

SEQ ID NO: 4309866 - DNA, 17 bp, Homo sapiens
ggcagctgccagagaag

SEQ ID NO: 4309867 - DNA, 14 bp, Homo sapiens
ggcagctggctctg

SEQ ID NO: 4309868 - DNA, 15 bp, Homo sapiens
ggcagctggctctga

SEQ ID NO: 4309869 - DNA, 22 bp, Homo sapiens
ggcagctggctctgaatgtagc

SEQ ID NO: 4309870 - DNA, 21 bp, Homo sapiens
ggcaggaaaccccgagaagga

SEQ ID NO: 4309871 - DNA, 14 bp, Homo sapiens
ggcaggaaccatgg

SEQ ID NO: 4309872 - DNA, 16 bp, Homo sapiens
ggcaggaagtcaggag

SEQ ID NO: 4309873 - DNA, 23 bp, Homo sapiens
ggcaggaagtcaggagccagcag

SEQ ID NO: 4309874 - DNA, 15 bp, Homo sapiens
ggcaggaagtccctg

SEQ ID NO: 4309875 - DNA, 16 bp, Homo sapiens
ggcaggaagtccctga

SEQ ID NO: 4309876 - DNA, 18 bp, Homo sapiens
ggcaggagacactggtct

SEQ ID NO: 4309877 - DNA, 16 bp, Homo sapiens
ggcaggagcctagagg

SEQ ID NO: 4309878 - DNA, 17 bp, Homo sapiens
ggcaggagcctagagga

SEQ ID NO: 4309879 - DNA, 15 bp, Homo sapiens
ggcaggaggacaggt

SEQ ID NO: 4309880 - DNA, 20 bp, Homo sapiens
ggcaggagtgggctctgagc

SEQ ID NO: 4309881 - DNA, 14 bp, Homo sapiens
ggcaggggctgggc

SEQ ID NO: 4309882 - DNA, 19 bp, Homo sapiens
ggcaggggctgggcagagg

SEQ ID NO: 4309883 - DNA, 19 bp, Homo sapiens
ggcaggtcccgagccccct

SEQ ID NO: 4309884 - DNA, 13 bp, Homo sapiens
ggcaggtggccag

SEQ ID NO: 4309885 - DNA, 14 bp, Homo sapiens
ggcaggtggccagg

SEQ ID NO: 4309886 - DNA, 16 bp, Homo sapiens
ggcaggtgtgggctcc

SEQ ID NO: 4309887 - DNA, 21 bp, Homo sapiens
ggcagtagaaggtcggaggct

SEQ ID NO: 4309888 - DNA, 18 bp, Homo sapiens
ggcagtgacgtgagtggg

SEQ ID NO: 4309889 - DNA, 15 bp, Homo sapiens
ggcagtgcaccccct

SEQ ID NO: 4309890 - DNA, 16 bp, Homo sapiens
ggcagtgcacccccta

SEQ ID NO: 4309891 - DNA, 11 bp, Homo sapiens
ggcagtggaga

SEQ ID NO: 4309892 - DNA, 13 bp, Homo sapiens
ggcagtggagagg

SEQ ID NO: 4309893 - DNA, 16 bp, Homo sapiens
ggcagtggcccaggga

SEQ ID NO: 4309894 - DNA, 20 bp, Homo sapiens
ggcagtggcttggagcagag

SEQ ID NO: 4309895 - DNA, 18 bp, Homo sapiens
ggcatcccagtggcctca

SEQ ID NO: 4309896 - DNA, 21 bp, Homo sapiens
ggcatcccagtggcctcaacc

SEQ ID NO: 4309897 - DNA, 13 bp, Homo sapiens
ggcatccccagcc

SEQ ID NO: 4309898 - DNA, 16 bp, Homo sapiens
ggcatccccagccccc

SEQ ID NO: 4309899 - DNA, 17 bp, Homo sapiens
ggcatccccagccccct

SEQ ID NO: 4309900 - DNA, 18 bp, Homo sapiens
ggcatccccagccccctg

SEQ ID NO: 4309901 - DNA, 21 bp, Homo sapiens
ggcatccccagccccctggcc

SEQ ID NO: 4309902 - DNA, 13 bp, Homo sapiens
ggcatctccagga

SEQ ID NO: 4309903 - DNA, 14 bp, Homo sapiens
ggcatctggccctg

SEQ ID NO: 4309904 - DNA, 16 bp, Homo sapiens
ggcatctggccctgct

SEQ ID NO: 4309905 - DNA, 19 bp, Homo sapiens
ggcatctggccctgctgcc

SEQ ID NO: 4309906 - DNA, 20 bp, Homo sapiens
ggcatctggccctgctgccc

SEQ ID NO: 4309907 - DNA, 21 bp, Homo sapiens
ggcatctggccctgctgcccc

SEQ ID NO: 4309908 - DNA, 22 bp, Homo sapiens
ggcatctggccctgctgccccc

SEQ ID NO: 4309909 - DNA, 13 bp, Homo sapiens
ggcatgaccctgg

SEQ ID NO: 4309910 - DNA, 19 bp, Homo sapiens
ggcatgccgagtgccccag

SEQ ID NO: 4309911 - DNA, 22 bp, Homo sapiens
ggcatgctggctcccagggcca

SEQ ID NO: 4309912 - DNA, 18 bp, Homo sapiens
ggcatggccaggtggcca

SEQ ID NO: 4309913 - DNA, 16 bp, Homo sapiens
ggcatggctccagtct

SEQ ID NO: 4309914 - DNA, 16 bp, Homo sapiens
ggcatggggaggggag

SEQ ID NO: 4309915 - DNA, 17 bp, Homo sapiens
ggcatggggaggggaga

SEQ ID NO: 4309916 - DNA, 20 bp, Homo sapiens
ggcatggggtgggcctctgg

SEQ ID NO: 4309917 - DNA, 23 bp, Homo sapiens
ggcatgtgtttactttatgttac

SEQ ID NO: 4309918 - DNA, 21 bp, Homo sapiens
ggccaagccagggttccagac

SEQ ID NO: 4309919 - DNA, 16 bp, Homo sapiens
ggccaagcctgccccg

SEQ ID NO: 4309920 - DNA, 15 bp, Homo sapiens
ggccaaggactgccg

SEQ ID NO: 4309921 - DNA, 18 bp, Homo sapiens
ggccaagtgcaggctggc

SEQ ID NO: 4309922 - DNA, 18 bp, Homo sapiens
ggccacatccaacatttc

SEQ ID NO: 4309923 - DNA, 20 bp, Homo sapiens
ggccacatccaacatttcct

SEQ ID NO: 4309924 - DNA, 20 bp, Homo sapiens
ggccacatgagtcccagtgg

SEQ ID NO: 4309925 - DNA, 13 bp, Homo sapiens
ggccacccttggc

SEQ ID NO: 4309926 - DNA, 19 bp, Homo sapiens
ggccacccttggcctgtcc

SEQ ID NO: 4309927 - DNA, 23 bp, Homo sapiens
ggccacctgcccccttctcccac

SEQ ID NO: 4309928 - DNA, 17 bp, Homo sapiens
ggccactccagacccct

SEQ ID NO: 4309929 - DNA, 24 bp, Homo sapiens
ggccactgcagtcacccctgtctg

SEQ ID NO: 4309930 - DNA, 22 bp, Homo sapiens
ggccactttgcagacctgggac

SEQ ID NO: 4309931 - DNA, 11 bp, Homo sapiens
ggccagagctc

SEQ ID NO: 4309932 - DNA, 13 bp, Homo sapiens
ggccagagctccc

SEQ ID NO: 4309933 - DNA, 14 bp, Homo sapiens
ggccagagctccca

SEQ ID NO: 4309934 - DNA, 20 bp, Homo sapiens
ggccagagctcccaggacgc

SEQ ID NO: 4309935 - DNA, 23 bp, Homo sapiens
ggccagaggaagggaggcctgag

SEQ ID NO: 4309936 - DNA, 19 bp, Homo sapiens
ggccagcatccatgcggcc

SEQ ID NO: 4309937 - DNA, 12 bp, Homo sapiens
ggccagcccaga

SEQ ID NO: 4309938 - DNA, 22 bp, Homo sapiens
ggccaggatggcgtgtcccctg

SEQ ID NO: 4309939 - DNA, 16 bp, Homo sapiens
ggccagggctctggca

SEQ ID NO: 4309940 - DNA, 17 bp, Homo sapiens
ggccagggctctggcag

SEQ ID NO: 4309941 - DNA, 19 bp, Homo sapiens
ggccatccggcccccagag

SEQ ID NO: 4309942 - DNA, 23 bp, Homo sapiens
ggccatgaccactttccccgtgg

SEQ ID NO: 4309943 - DNA, 16 bp, Homo sapiens
ggccatgagctccaga

SEQ ID NO: 4309944 - DNA, 18 bp, Homo sapiens
ggccatgagctccagacc

SEQ ID NO: 4309945 - DNA, 21 bp, Homo sapiens
ggccatgaggcctcagtggac

SEQ ID NO: 4309946 - DNA, 18 bp, Homo sapiens
ggccatggaagctggcag

SEQ ID NO: 4309947 - DNA, 22 bp, Homo sapiens
ggccatggaagctggcaggaga

SEQ ID NO: 4309948 - DNA, 17 bp, Homo sapiens
ggcccaaaccaggggga

SEQ ID NO: 4309949 - DNA, 22 bp, Homo sapiens
ggcccacattgcccacacctgc

SEQ ID NO: 4309950 - DNA, 20 bp, Homo sapiens
ggcccaccagagcctccctc

SEQ ID NO: 4309951 - DNA, 15 bp, Homo sapiens
ggcccacccctcttc

SEQ ID NO: 4309952 - DNA, 23 bp, Homo sapiens
ggcccagaggggcggggccagga

SEQ ID NO: 4309953 - DNA, 19 bp, Homo sapiens
ggcccagcagcggcccaga

SEQ ID NO: 4309954 - DNA, 12 bp, Homo sapiens
ggcccagccagc

SEQ ID NO: 4309955 - DNA, 16 bp, Homo sapiens
ggcccagcctggcccc

SEQ ID NO: 4309956 - DNA, 21 bp, Homo sapiens
ggcccagcctgtggcctcagc

SEQ ID NO: 4309957 - DNA, 20 bp, Homo sapiens
ggcccagggagaggccatga

SEQ ID NO: 4309958 - DNA, 18 bp, Homo sapiens
ggccccacccaccctctg

SEQ ID NO: 4309959 - DNA, 21 bp, Homo sapiens
ggccccacccaccctctggtc

SEQ ID NO: 4309960 - DNA, 13 bp, Homo sapiens
ggccccagagact

SEQ ID NO: 4309961 - DNA, 18 bp, Homo sapiens
ggccccagagactcagag

SEQ ID NO: 4309962 - DNA, 21 bp, Homo sapiens
ggccccaggctggatgctggg

SEQ ID NO: 4309963 - DNA, 23 bp, Homo sapiens
ggcccccacaggagcatgtccta

SEQ ID NO: 4309964 - DNA, 23 bp, Homo sapiens
ggcccccacaggagcgtgtccta

SEQ ID NO: 4309965 - DNA, 16 bp, Homo sapiens
ggcccccagagcgccc

SEQ ID NO: 4309966 - DNA, 14 bp, Homo sapiens
ggcccccctctcgg

SEQ ID NO: 4309967 - DNA, 13 bp, Homo sapiens
ggcccccgagctg

SEQ ID NO: 4309968 - DNA, 15 bp, Homo sapiens
ggcccccgccctctg

SEQ ID NO: 4309969 - DNA, 16 bp, Homo sapiens
ggcccccgccctctgc

SEQ ID NO: 4309970 - DNA, 15 bp, Homo sapiens
ggcccctcactggct

SEQ ID NO: 4309971 - DNA, 19 bp, Homo sapiens
ggcccctcactggctggac

SEQ ID NO: 4309972 - DNA, 16 bp, Homo sapiens
ggcccctcccacatcc

SEQ ID NO: 4309973 - DNA, 15 bp, Homo sapiens
ggcccctccttctcc

SEQ ID NO: 4309974 - DNA, 19 bp, Homo sapiens
ggcccctgaagtgacccca

SEQ ID NO: 4309975 - DNA, 21 bp, Homo sapiens
ggccccttcacttctgaccac

SEQ ID NO: 4309976 - DNA, 16 bp, Homo sapiens
ggccccttgctgctgg

SEQ ID NO: 4309977 - DNA, 21 bp, Homo sapiens
ggccccttgctgctggctccc

SEQ ID NO: 4309978 - DNA, 15 bp, Homo sapiens
ggcccgacagcctgg

SEQ ID NO: 4309979 - DNA, 16 bp, Homo sapiens
ggcccgacagcctggc

SEQ ID NO: 4309980 - DNA, 23 bp, Homo sapiens
ggcccgcctggcagaactgagct

SEQ ID NO: 4309981 - DNA, 22 bp, Homo sapiens
ggccctaggcatactctccagg

SEQ ID NO: 4309982 - DNA, 23 bp, Homo sapiens
ggccctaggcatactctccagga

SEQ ID NO: 4309983 - DNA, 16 bp, Homo sapiens
ggccctcctctggtca

SEQ ID NO: 4309984 - DNA, 11 bp, Homo sapiens
ggccctgcccc

SEQ ID NO: 4309985 - DNA, 13 bp, Homo sapiens
ggccctgcccccc

SEQ ID NO: 4309986 - DNA, 14 bp, Homo sapiens
ggccctgcccccca

SEQ ID NO: 4309987 - DNA, 13 bp, Homo sapiens
ggccctgctcagg

SEQ ID NO: 4309988 - DNA, 12 bp, Homo sapiens
ggccctgctgcc

SEQ ID NO: 4309989 - DNA, 12 bp, Homo sapiens
ggccctggctct

SEQ ID NO: 4309990 - DNA, 16 bp, Homo sapiens
ggccctggctctgtca

SEQ ID NO: 4309991 - DNA, 15 bp, Homo sapiens
ggccctggtctggct

SEQ ID NO: 4309992 - DNA, 15 bp, Homo sapiens
ggccctggttccccc

SEQ ID NO: 4309993 - DNA, 20 bp, Homo sapiens
ggcccttcccaacctcccct

SEQ ID NO: 4309994 - DNA, 18 bp, Homo sapiens
ggcccttcctctccactg

SEQ ID NO: 4309995 - DNA, 19 bp, Homo sapiens
ggcccttcctctccactgc

SEQ ID NO: 4309996 - DNA, 23 bp, Homo sapiens
ggcccttcctctccactgccttc

SEQ ID NO: 4309997 - DNA, 12 bp, Homo sapiens
ggccgaggcagg

SEQ ID NO: 4309998 - DNA, 23 bp, Homo sapiens
ggccgaggcaggggctgggcaga

SEQ ID NO: 4309999 - DNA, 14 bp, Homo sapiens
ggccgagggaaatg

SEQ ID NO: 4310000 - DNA, 12 bp, Homo sapiens
ggccgctgcagg

SEQ ID NO: 4310001 - DNA, 21 bp, Homo sapiens
ggccgctgcagtcagcacaga

SEQ ID NO: 4310002 - DNA, 22 bp, Homo sapiens
ggccgctgcagtcagcacagag

SEQ ID NO: 4310003 - DNA, 23 bp, Homo sapiens
ggccgcttcgccatgtgctgtgc

SEQ ID NO: 4310004 - DNA, 12 bp, Homo sapiens
ggccggcctggg

SEQ ID NO: 4310005 - DNA, 14 bp, Homo sapiens
ggccggcctggggc

SEQ ID NO: 4310006 - DNA, 15 bp, Homo sapiens
ggccgggctggcttc

SEQ ID NO: 4310007 - DNA, 22 bp, Homo sapiens
ggccgtagactcacggctgcac

SEQ ID NO: 4310008 - DNA, 15 bp, Homo sapiens
ggccgttgcctctct

SEQ ID NO: 4310009 - DNA, 14 bp, Homo sapiens
ggcctaaacttcag

SEQ ID NO: 4310010 - DNA, 20 bp, Homo sapiens
ggcctagtggcttcagcccc

SEQ ID NO: 4310011 - DNA, 19 bp, Homo sapiens
ggcctatgccacctgcagc

SEQ ID NO: 4310012 - DNA, 23 bp, Homo sapiens
ggcctcaaccctccctcagcccc

SEQ ID NO: 4310013 - DNA, 14 bp, Homo sapiens
ggcctcacctggct

SEQ ID NO: 4310014 - DNA, 15 bp, Homo sapiens
ggcctcacctggctt

SEQ ID NO: 4310015 - DNA, 19 bp, Homo sapiens
ggcctcacctggcttccca

SEQ ID NO: 4310016 - DNA, 22 bp, Homo sapiens
ggcctcacctggcttcccagga

SEQ ID NO: 4310017 - DNA, 11 bp, Homo sapiens
ggcctcagcag

SEQ ID NO: 4310018 - DNA, 17 bp, Homo sapiens
ggcctcaggtttgcctg

SEQ ID NO: 4310019 - DNA, 15 bp, Homo sapiens
ggcctcatcctcctg

SEQ ID NO: 4310020 - DNA, 22 bp, Homo sapiens
ggcctccagccctctcactgtg

SEQ ID NO: 4310021 - DNA, 12 bp, Homo sapiens
ggcctcccagcc

SEQ ID NO: 4310022 - DNA, 17 bp, Homo sapiens
ggcctcccagccacccg

SEQ ID NO: 4310023 - DNA, 11 bp, Homo sapiens
ggcctctggcc

SEQ ID NO: 4310024 - DNA, 21 bp, Homo sapiens
ggcctgaaatgtttccaggca

SEQ ID NO: 4310025 - DNA, 24 bp, Homo sapiens
ggcctgaaatgtttccaggcatga

SEQ ID NO: 4310026 - DNA, 19 bp, Homo sapiens
ggcctgaactaggtgctgg

SEQ ID NO: 4310027 - DNA, 20 bp, Homo sapiens
ggcctgaactaggtgctggc

SEQ ID NO: 4310028 - DNA, 13 bp, Homo sapiens
ggcctgaggggca

SEQ ID NO: 4310029 - DNA, 22 bp, Homo sapiens
ggcctgccactctcctgaggag

SEQ ID NO: 4310030 - DNA, 13 bp, Homo sapiens
ggcctgcccccct

SEQ ID NO: 4310031 - DNA, 17 bp, Homo sapiens
ggcctgccccccttccc

SEQ ID NO: 4310032 - DNA, 23 bp, Homo sapiens
ggcctgccccccttcccacccct

SEQ ID NO: 4310033 - DNA, 16 bp, Homo sapiens
ggcctggcccagccag

SEQ ID NO: 4310034 - DNA, 19 bp, Homo sapiens
ggcctggccctttcacccc

SEQ ID NO: 4310035 - DNA, 17 bp, Homo sapiens
ggcctggggacggagca

SEQ ID NO: 4310036 - DNA, 22 bp, Homo sapiens
ggcctggggctgccgtgcacgg

SEQ ID NO: 4310037 - DNA, 15 bp, Homo sapiens
ggcctggtgccctgg

SEQ ID NO: 4310038 - DNA, 19 bp, Homo sapiens
ggccttggttcctccagca

SEQ ID NO: 4310039 - DNA, 22 bp, Homo sapiens
ggcgagccagattaggcctgga

SEQ ID NO: 4310040 - DNA, 19 bp, Homo sapiens
ggcgaggcagaggacagat

SEQ ID NO: 4310041 - DNA, 20 bp, Homo sapiens
ggcgcacccggcagcccccc

SEQ ID NO: 4310042 - DNA, 15 bp, Homo sapiens
ggcgccttcctgggt

SEQ ID NO: 4310043 - DNA, 15 bp, Homo sapiens
ggcgcgcagcccggg

SEQ ID NO: 4310044 - DNA, 22 bp, Homo sapiens
ggcgggaggccacgggggaggc

SEQ ID NO: 4310045 - DNA, 17 bp, Homo sapiens
ggcgggccaaggactgc

SEQ ID NO: 4310046 - DNA, 14 bp, Homo sapiens
ggcgggccaggaga

SEQ ID NO: 4310047 - DNA, 20 bp, Homo sapiens
ggcggtgcagtggcaaagga

SEQ ID NO: 4310048 - DNA, 18 bp, Homo sapiens
ggcgtagggccagggctc

SEQ ID NO: 4310049 - DNA, 23 bp, Homo sapiens
ggcgtccctgagggcccttccca

SEQ ID NO: 4310050 - DNA, 15 bp, Homo sapiens
ggcgtctgtcttcaa

SEQ ID NO: 4310051 - DNA, 16 bp, Homo sapiens
ggcgtgggatccagag

SEQ ID NO: 4310052 - DNA, 24 bp, Homo sapiens
ggctaaccagttctctttgtaagg

SEQ ID NO: 4310053 - DNA, 15 bp, Homo sapiens
ggctaagtccagctc

SEQ ID NO: 4310054 - DNA, 15 bp, Homo sapiens
ggctccacgggggcc

SEQ ID NO: 4310055 - DNA, 16 bp, Homo sapiens
ggctccagacattgta

SEQ ID NO: 4310056 - DNA, 22 bp, Homo sapiens
ggctccagtctgctgccctcca

SEQ ID NO: 4310057 - DNA, 19 bp, Homo sapiens
ggctcccacaggcccttcc

SEQ ID NO: 4310058 - DNA, 15 bp, Homo sapiens
ggctcccacgccctc

SEQ ID NO: 4310059 - DNA, 19 bp, Homo sapiens
ggctcccacgccctcctcc

SEQ ID NO: 4310060 - DNA, 14 bp, Homo sapiens
ggctccctgggctg

SEQ ID NO: 4310061 - DNA, 17 bp, Homo sapiens
ggctcctccccgatccc

SEQ ID NO: 4310062 - DNA, 17 bp, Homo sapiens
ggctcctcccggtgccc

SEQ ID NO: 4310063 - DNA, 14 bp, Homo sapiens
ggctcgttccccca

SEQ ID NO: 4310064 - DNA, 16 bp, Homo sapiens
ggctctgaaagctgct

SEQ ID NO: 4310065 - DNA, 23 bp, Homo sapiens
ggctctgaaagctgcttctgggg

SEQ ID NO: 4310066 - DNA, 19 bp, Homo sapiens
ggctctgaatgtagccagc

SEQ ID NO: 4310067 - DNA, 22 bp, Homo sapiens
ggctctgaatgtagccagccca

SEQ ID NO: 4310068 - DNA, 17 bp, Homo sapiens
ggctctgcgtcccactg

SEQ ID NO: 4310069 - DNA, 20 bp, Homo sapiens
ggctctggcaggtggccagg

SEQ ID NO: 4310070 - DNA, 10 bp, Homo sapiens
ggctctggct

SEQ ID NO: 4310071 - DNA, 18 bp, Homo sapiens
ggctctgggttcgggaag

SEQ ID NO: 4310072 - DNA, 19 bp, Homo sapiens
ggctgaatgtatgtaaata

SEQ ID NO: 4310073 - DNA, 15 bp, Homo sapiens
ggctgagctgtgcca

SEQ ID NO: 4310074 - DNA, 16 bp, Homo sapiens
ggctgcacctgcaggg

SEQ ID NO: 4310075 - DNA, 18 bp, Homo sapiens
ggctgcacctgcagggag

SEQ ID NO: 4310076 - DNA, 18 bp, Homo sapiens
ggctgcatcctcagcccc

SEQ ID NO: 4310077 - DNA, 19 bp, Homo sapiens
ggctgcatcctcagcccca

SEQ ID NO: 4310078 - DNA, 15 bp, Homo sapiens
ggctgccccacccct

SEQ ID NO: 4310079 - DNA, 17 bp, Homo sapiens
ggctgccccacccctcc

SEQ ID NO: 4310080 - DNA, 17 bp, Homo sapiens
ggctgccccaggggcac

SEQ ID NO: 4310081 - DNA, 14 bp, Homo sapiens
ggctgccctggtgc

SEQ ID NO: 4310082 - DNA, 16 bp, Homo sapiens
ggctgccctggtgctg

SEQ ID NO: 4310083 - DNA, 20 bp, Homo sapiens
ggctgccgtgcacggggcca

SEQ ID NO: 4310084 - DNA, 17 bp, Homo sapiens
ggctgctgcagtcagca

SEQ ID NO: 4310085 - DNA, 16 bp, Homo sapiens
ggctggattggcaggt

SEQ ID NO: 4310086 - DNA, 18 bp, Homo sapiens
ggctggcttctccctgga

SEQ ID NO: 4310087 - DNA, 18 bp, Homo sapiens
ggctgggcagaggggaga

SEQ ID NO: 4310088 - DNA, 11 bp, Homo sapiens
ggctgggcccg

SEQ ID NO: 4310089 - DNA, 13 bp, Homo sapiens
ggctgggcccgag

SEQ ID NO: 4310090 - DNA, 19 bp, Homo sapiens
ggctggggcttttgtgcca

SEQ ID NO: 4310091 - DNA, 22 bp, Homo sapiens
ggctgggtggccggccctgccc

SEQ ID NO: 4310092 - DNA, 19 bp, Homo sapiens
ggctgggtttgggcagtgg

SEQ ID NO: 4310093 - DNA, 20 bp, Homo sapiens
ggctggtggacagacccagg

SEQ ID NO: 4310094 - DNA, 12 bp, Homo sapiens
ggctgtggcccc

SEQ ID NO: 4310095 - DNA, 20 bp, Homo sapiens
ggcttcaatctacgatgtta

SEQ ID NO: 4310096 - DNA, 15 bp, Homo sapiens
ggcttccatggtggt

SEQ ID NO: 4310097 - DNA, 11 bp, Homo sapiens
ggcttcccagg

SEQ ID NO: 4310098 - DNA, 12 bp, Homo sapiens
ggcttcccagga

SEQ ID NO: 4310099 - DNA, 16 bp, Homo sapiens
ggcttcccgctcagcc

SEQ ID NO: 4310100 - DNA, 19 bp, Homo sapiens
ggcttcccgctcagccctc

SEQ ID NO: 4310101 - DNA, 17 bp, Homo sapiens
ggcttccctctgctcca

SEQ ID NO: 4310102 - DNA, 18 bp, Homo sapiens
ggcttccggctgagctgt

SEQ ID NO: 4310103 - DNA, 21 bp, Homo sapiens
ggcttccggctgagctgtgcc

SEQ ID NO: 4310104 - DNA, 22 bp, Homo sapiens
ggcttccggctgagctgtgcca

SEQ ID NO: 4310105 - DNA, 18 bp, Homo sapiens
ggcttcctgccctagcag

SEQ ID NO: 4310106 - DNA, 14 bp, Homo sapiens
ggcttgggaccgcc

SEQ ID NO: 4310107 - DNA, 19 bp, Homo sapiens
ggcttggggatgcccttct

SEQ ID NO: 4310108 - DNA, 15 bp, Homo sapiens
ggcttggggtagaga

SEQ ID NO: 4310109 - DNA, 18 bp, Homo sapiens
ggcttggggtagagagga

SEQ ID NO: 4310110 - DNA, 18 bp, Homo sapiens
ggctttcatttcttatta

SEQ ID NO: 4310111 - DNA, 22 bp, Homo sapiens
ggctttcatttcttattaacca

SEQ ID NO: 4310112 - DNA, 16 bp, Homo sapiens
gggaaaagggcaggag

SEQ ID NO: 4310113 - DNA, 19 bp, Homo sapiens
gggaacaagggtggcatcc

SEQ ID NO: 4310114 - DNA, 21 bp, Homo sapiens
gggaagatcctccttccaggc

SEQ ID NO: 4310115 - DNA, 17 bp, Homo sapiens
gggaagcaccagcctca

SEQ ID NO: 4310116 - DNA, 22 bp, Homo sapiens
gggaagggagcaccagatgaca

SEQ ID NO: 4310117 - DNA, 21 bp, Homo sapiens
gggaagtgacaaggccccaga

SEQ ID NO: 4310118 - DNA, 16 bp, Homo sapiens
gggaagtgtgctgagg

SEQ ID NO: 4310119 - DNA, 19 bp, Homo sapiens
gggaatcagggagcactgg

SEQ ID NO: 4310120 - DNA, 21 bp, Homo sapiens
gggaatcagggagcactggag

SEQ ID NO: 4310121 - DNA, 23 bp, Homo sapiens
gggaatcagggagcactggaggc

SEQ ID NO: 4310122 - DNA, 23 bp, Homo sapiens
gggaatgcgctcttcaccaggaa

SEQ ID NO: 4310123 - DNA, 12 bp, Homo sapiens
gggaattctctt

SEQ ID NO: 4310124 - DNA, 14 bp, Homo sapiens
gggacacagagacc

SEQ ID NO: 4310125 - DNA, 22 bp, Homo sapiens
gggacacggcctctggggagac

SEQ ID NO: 4310126 - DNA, 16 bp, Homo sapiens
gggacactacaaacat

SEQ ID NO: 4310127 - DNA, 20 bp, Homo sapiens
gggacagatcttgagcaagg

SEQ ID NO: 4310128 - DNA, 21 bp, Homo sapiens
gggacaggaacacccagcccc

SEQ ID NO: 4310129 - DNA, 18 bp, Homo sapiens
gggaccaaaactgcctac

SEQ ID NO: 4310130 - DNA, 17 bp, Homo sapiens
gggaccaaggacccctc

SEQ ID NO: 4310131 - DNA, 14 bp, Homo sapiens
gggacggagcactg

SEQ ID NO: 4310132 - DNA, 22 bp, Homo sapiens
gggactggcccacccctcttcc

SEQ ID NO: 4310133 - DNA, 16 bp, Homo sapiens
gggactggtccaggca

SEQ ID NO: 4310134 - DNA, 15 bp, Homo sapiens
gggacttcaaaatca

SEQ ID NO: 4310135 - DNA, 14 bp, Homo sapiens
gggagaaaagccag

SEQ ID NO: 4310136 - DNA, 14 bp, Homo sapiens
gggagaaggagagg

SEQ ID NO: 4310137 - DNA, 17 bp, Homo sapiens
gggagaccctgggagag

SEQ ID NO: 4310138 - DNA, 17 bp, Homo sapiens
gggagactgacccattc

SEQ ID NO: 4310139 - DNA, 17 bp, Homo sapiens
gggagacttaggccaga

SEQ ID NO: 4310140 - DNA, 18 bp, Homo sapiens
gggagacttaggccagag

SEQ ID NO: 4310141 - DNA, 20 bp, Homo sapiens
gggagacttaggccagaggt

SEQ ID NO: 4310142 - DNA, 14 bp, Homo sapiens
gggagagaaggtgg

SEQ ID NO: 4310143 - DNA, 22 bp, Homo sapiens
gggagagccaaggcctatgcca

SEQ ID NO: 4310144 - DNA, 13 bp, Homo sapiens
gggagagtgaggt

SEQ ID NO: 4310145 - DNA, 14 bp, Homo sapiens
gggagatccgccct

SEQ ID NO: 4310146 - DNA, 16 bp, Homo sapiens
gggagatccgccctgg

SEQ ID NO: 4310147 - DNA, 20 bp, Homo sapiens
gggagatccgccctgggctc

SEQ ID NO: 4310148 - DNA, 16 bp, Homo sapiens
gggagcctcgcccctc

SEQ ID NO: 4310149 - DNA, 18 bp, Homo sapiens
gggagcctgcgtggcctg

SEQ ID NO: 4310150 - DNA, 17 bp, Homo sapiens
gggaggagactcaggcc

SEQ ID NO: 4310151 - DNA, 15 bp, Homo sapiens
gggaggcctgagggg

SEQ ID NO: 4310152 - DNA, 21 bp, Homo sapiens
gggagtcaagtgtgcctgcta

SEQ ID NO: 4310153 - DNA, 12 bp, Homo sapiens
gggagtgggaga

SEQ ID NO: 4310154 - DNA, 16 bp, Homo sapiens
gggagtgggagaggaa

SEQ ID NO: 4310155 - DNA, 21 bp, Homo sapiens
gggagtgtgggggtgccatgg

SEQ ID NO: 4310156 - DNA, 16 bp, Homo sapiens
gggatccagagagaag

SEQ ID NO: 4310157 - DNA, 17 bp, Homo sapiens
gggatctaaaaggagga

SEQ ID NO: 4310158 - DNA, 19 bp, Homo sapiens
gggatgaattgcctgtcct

SEQ ID NO: 4310159 - DNA, 19 bp, Homo sapiens
gggcaagagctcaggagaa

SEQ ID NO: 4310160 - DNA, 12 bp, Homo sapiens
gggcacaggctg

SEQ ID NO: 4310161 - DNA, 13 bp, Homo sapiens
gggcacaggctgc

SEQ ID NO: 4310162 - DNA, 13 bp, Homo sapiens
gggcactggtggc

SEQ ID NO: 4310163 - DNA, 15 bp, Homo sapiens
gggcagcccagagag

SEQ ID NO: 4310164 - DNA, 16 bp, Homo sapiens
gggcagcccctcccca

SEQ ID NO: 4310165 - DNA, 18 bp, Homo sapiens
gggcagcctgtgggagaa

SEQ ID NO: 4310166 - DNA, 12 bp, Homo sapiens
gggcagctgcca

SEQ ID NO: 4310167 - DNA, 16 bp, Homo sapiens
gggcagctgccagaga

SEQ ID NO: 4310168 - DNA, 12 bp, Homo sapiens
gggcagctggct

SEQ ID NO: 4310169 - DNA, 12 bp, Homo sapiens
gggcaggccttt

SEQ ID NO: 4310170 - DNA, 16 bp, Homo sapiens
gggcatccccagcccc

SEQ ID NO: 4310171 - DNA, 18 bp, Homo sapiens
gggcatccttgaggacct

SEQ ID NO: 4310172 - DNA, 15 bp, Homo sapiens
gggcatctggccctg

SEQ ID NO: 4310173 - DNA, 16 bp, Homo sapiens
gggcatctggccctgc

SEQ ID NO: 4310174 - DNA, 22 bp, Homo sapiens
gggcatctggccctgctgcccc

SEQ ID NO: 4310175 - DNA, 21 bp, Homo sapiens
gggcatggggtgggcctctgg

SEQ ID NO: 4310176 - DNA, 15 bp, Homo sapiens
gggcatttttcttgg

SEQ ID NO: 4310177 - DNA, 11 bp, Homo sapiens
gggccaacacc

SEQ ID NO: 4310178 - DNA, 21 bp, Homo sapiens
gggccactggcatctctggag

SEQ ID NO: 4310179 - DNA, 15 bp, Homo sapiens
gggccatgaactttg

SEQ ID NO: 4310180 - DNA, 19 bp, Homo sapiens
gggccatgagctccagacc

SEQ ID NO: 4310181 - DNA, 11 bp, Homo sapiens
gggcccagagg

SEQ ID NO: 4310182 - DNA, 15 bp, Homo sapiens
gggcccccacaggag

SEQ ID NO: 4310183 - DNA, 18 bp, Homo sapiens
gggcccctttttactccc

SEQ ID NO: 4310184 - DNA, 23 bp, Homo sapiens
gggcccgcctggcagaactgagc

SEQ ID NO: 4310185 - DNA, 12 bp, Homo sapiens
gggccctcctga

SEQ ID NO: 4310186 - DNA, 24 bp, Homo sapiens
gggccctggttcccccaggaccct

SEQ ID NO: 4310187 - DNA, 15 bp, Homo sapiens
gggccgcttcgccat

SEQ ID NO: 4310188 - DNA, 22 bp, Homo sapiens
gggccgcttcgccatgtgctgt

SEQ ID NO: 4310189 - DNA, 23 bp, Homo sapiens
gggcctctggtttggggcgaggc

SEQ ID NO: 4310190 - DNA, 14 bp, Homo sapiens
gggcctgccactct

SEQ ID NO: 4310191 - DNA, 19 bp, Homo sapiens
gggcctgccactctcctga

SEQ ID NO: 4310192 - DNA, 21 bp, Homo sapiens
gggcctgccactctcctgagg

SEQ ID NO: 4310193 - DNA, 14 bp, Homo sapiens
gggcctttgcagcg

SEQ ID NO: 4310194 - DNA, 13 bp, Homo sapiens
gggcgaggcagag

SEQ ID NO: 4310195 - DNA, 16 bp, Homo sapiens
gggcgaggcagaggac

SEQ ID NO: 4310196 - DNA, 16 bp, Homo sapiens
gggctagactgggctg

SEQ ID NO: 4310197 - DNA, 21 bp, Homo sapiens
gggctagtaataaaatattta

SEQ ID NO: 4310198 - DNA, 19 bp, Homo sapiens
gggctatgccactaggccc

SEQ ID NO: 4310199 - DNA, 16 bp, Homo sapiens
gggctcacaccagccc

SEQ ID NO: 4310200 - DNA, 17 bp, Homo sapiens
gggctcacaccagccct

SEQ ID NO: 4310201 - DNA, 20 bp, Homo sapiens
gggctccagagtaggtgggt

SEQ ID NO: 4310202 - DNA, 14 bp, Homo sapiens
gggctcccacgccc

SEQ ID NO: 4310203 - DNA, 20 bp, Homo sapiens
gggctcccacgccctcctcc

SEQ ID NO: 4310204 - DNA, 23 bp, Homo sapiens
gggctcccacgccctcctccctc

SEQ ID NO: 4310205 - DNA, 13 bp, Homo sapiens
gggctctgggttc

SEQ ID NO: 4310206 - DNA, 23 bp, Homo sapiens
gggctgcatcctcagccccaggg

SEQ ID NO: 4310207 - DNA, 14 bp, Homo sapiens
gggctgctgcactg

SEQ ID NO: 4310208 - DNA, 16 bp, Homo sapiens
gggctgctgcactgcc

SEQ ID NO: 4310209 - DNA, 21 bp, Homo sapiens
gggctggcatggggaggggag

SEQ ID NO: 4310210 - DNA, 14 bp, Homo sapiens
gggctggccagctg

SEQ ID NO: 4310211 - DNA, 14 bp, Homo sapiens
gggctggctgcctt

SEQ ID NO: 4310212 - DNA, 15 bp, Homo sapiens
gggctgggcagaggg

SEQ ID NO: 4310213 - DNA, 23 bp, Homo sapiens
gggctggtttggtggccaggctg

SEQ ID NO: 4310214 - DNA, 10 bp, Homo sapiens
gggctgtcct

SEQ ID NO: 4310215 - DNA, 11 bp, Homo sapiens
gggctgtcctt

SEQ ID NO: 4310216 - DNA, 14 bp, Homo sapiens
gggcttagaatggg

SEQ ID NO: 4310217 - DNA, 15 bp, Homo sapiens
gggcttagaatgggg

SEQ ID NO: 4310218 - DNA, 14 bp, Homo sapiens
gggcttccctctgc

SEQ ID NO: 4310219 - DNA, 19 bp, Homo sapiens
gggcttgcaagtatgtttt

SEQ ID NO: 4310220 - DNA, 14 bp, Homo sapiens
gggcttggaagggc

SEQ ID NO: 4310221 - DNA, 13 bp, Homo sapiens
gggcttggggtag

SEQ ID NO: 4310222 - DNA, 16 bp, Homo sapiens
gggcttggggtagaga

SEQ ID NO: 4310223 - DNA, 18 bp, Homo sapiens
gggcttggggtagagagg

SEQ ID NO: 4310224 - DNA, 20 bp, Homo sapiens
ggggaagcaccagcctcagt

SEQ ID NO: 4310225 - DNA, 16 bp, Homo sapiens
ggggaagtgtgctgag

SEQ ID NO: 4310226 - DNA, 13 bp, Homo sapiens
ggggacggagcac

SEQ ID NO: 4310227 - DNA, 16 bp, Homo sapiens
ggggagctgaggggca

SEQ ID NO: 4310228 - DNA, 22 bp, Homo sapiens
ggggatctaaaaggaggacagg

SEQ ID NO: 4310229 - DNA, 23 bp, Homo sapiens
ggggatctaaaaggaggacaggg

SEQ ID NO: 4310230 - DNA, 13 bp, Homo sapiens
ggggattcaaatg

SEQ ID NO: 4310231 - DNA, 20 bp, Homo sapiens
ggggattcttccatctgatt

SEQ ID NO: 4310232 - DNA, 17 bp, Homo sapiens
ggggcacacttcccctt

SEQ ID NO: 4310233 - DNA, 14 bp, Homo sapiens
ggggcacagccaga

SEQ ID NO: 4310234 - DNA, 15 bp, Homo sapiens
ggggcacagccagaa

SEQ ID NO: 4310235 - DNA, 17 bp, Homo sapiens
ggggcatggacagggcc

SEQ ID NO: 4310236 - DNA, 21 bp, Homo sapiens
ggggcccctttttactcccct

SEQ ID NO: 4310237 - DNA, 19 bp, Homo sapiens
ggggccgcttcgccatgtg

SEQ ID NO: 4310238 - DNA, 21 bp, Homo sapiens
ggggccgcttcgccatgtgct

SEQ ID NO: 4310239 - DNA, 22 bp, Homo sapiens
ggggccgcttcgccatgtgctg

SEQ ID NO: 4310240 - DNA, 12 bp, Homo sapiens
ggggcctcaggt

SEQ ID NO: 4310241 - DNA, 18 bp, Homo sapiens
ggggctagactgggctgg

SEQ ID NO: 4310242 - DNA, 21 bp, Homo sapiens
ggggctgagagtggggctaga

SEQ ID NO: 4310243 - DNA, 21 bp, Homo sapiens
ggggctgctgcactgccctcc

SEQ ID NO: 4310244 - DNA, 18 bp, Homo sapiens
ggggcttccatggtggtt

SEQ ID NO: 4310245 - DNA, 17 bp, Homo sapiens
ggggcttggaagggcgc

SEQ ID NO: 4310246 - DNA, 13 bp, Homo sapiens
gggggacaggaac

SEQ ID NO: 4310247 - DNA, 21 bp, Homo sapiens
gggggacttacatgattcatt

SEQ ID NO: 4310248 - DNA, 18 bp, Homo sapiens
gggggattcaaatgcatg

SEQ ID NO: 4310249 - DNA, 21 bp, Homo sapiens
gggggcaagagctcaggagaa

SEQ ID NO: 4310250 - DNA, 14 bp, Homo sapiens
gggggcacagccag

SEQ ID NO: 4310251 - DNA, 15 bp, Homo sapiens
gggggcacagccaga

SEQ ID NO: 4310252 - DNA, 15 bp, Homo sapiens
gggggccaacaccag

SEQ ID NO: 4310253 - DNA, 12 bp, Homo sapiens
gggggctccaga

SEQ ID NO: 4310254 - DNA, 20 bp, Homo sapiens
gggggcttggggtagagagg

SEQ ID NO: 4310255 - DNA, 22 bp, Homo sapiens
gggggtgtcacagaggcagtgg

SEQ ID NO: 4310256 - DNA, 15 bp, Homo sapiens
gggggttgggttcca

SEQ ID NO: 4310257 - DNA, 15 bp, Homo sapiens
ggggtagagaggaca

SEQ ID NO: 4310258 - DNA, 16 bp, Homo sapiens
ggggtagagaggacag

SEQ ID NO: 4310259 - DNA, 22 bp, Homo sapiens
ggggtcagggaccaaggacccc

SEQ ID NO: 4310260 - DNA, 16 bp, Homo sapiens
ggggtcctgaggctgg

SEQ ID NO: 4310261 - DNA, 23 bp, Homo sapiens
ggggtctccacctcaggggagac

SEQ ID NO: 4310262 - DNA, 12 bp, Homo sapiens
ggggtctgggag

SEQ ID NO: 4310263 - DNA, 12 bp, Homo sapiens
ggggtggaggct

SEQ ID NO: 4310264 - DNA, 15 bp, Homo sapiens
ggggtggggcttgga

SEQ ID NO: 4310265 - DNA, 19 bp, Homo sapiens
ggggtttccacacaggccc

SEQ ID NO: 4310266 - DNA, 21 bp, Homo sapiens
ggggtttccacacaggcccat

SEQ ID NO: 4310267 - DNA, 23 bp, Homo sapiens
ggggttttcgaagctcagcccac

SEQ ID NO: 4310268 - DNA, 21 bp, Homo sapiens
gggtaaaaagagaaggcaagc

SEQ ID NO: 4310269 - DNA, 15 bp, Homo sapiens
gggtagagaggacag

SEQ ID NO: 4310270 - DNA, 14 bp, Homo sapiens
gggtcaactccaag

SEQ ID NO: 4310271 - DNA, 17 bp, Homo sapiens
gggtcaccttcctgggc

SEQ ID NO: 4310272 - DNA, 15 bp, Homo sapiens
gggtcccttccccct

SEQ ID NO: 4310273 - DNA, 18 bp, Homo sapiens
gggtctgggaggcaggtc

SEQ ID NO: 4310274 - DNA, 19 bp, Homo sapiens
gggtctgtgggactggccc

SEQ ID NO: 4310275 - DNA, 14 bp, Homo sapiens
gggtgacagaggga

SEQ ID NO: 4310276 - DNA, 15 bp, Homo sapiens
gggtgaggcgtggga

SEQ ID NO: 4310277 - DNA, 22 bp, Homo sapiens
gggtgaggcgtgggatccagag

SEQ ID NO: 4310278 - DNA, 23 bp, Homo sapiens
gggtgccaaccacctctggccct

SEQ ID NO: 4310279 - DNA, 18 bp, Homo sapiens
gggtgctccctcctcagt

SEQ ID NO: 4310280 - DNA, 14 bp, Homo sapiens
gggtggccggccct

SEQ ID NO: 4310281 - DNA, 22 bp, Homo sapiens
gggtggccggccctgcccccca

SEQ ID NO: 4310282 - DNA, 12 bp, Homo sapiens
gggtgggcctct

SEQ ID NO: 4310283 - DNA, 15 bp, Homo sapiens
gggtggggcgggagg

SEQ ID NO: 4310284 - DNA, 17 bp, Homo sapiens
gggtggggcttggaagg

SEQ ID NO: 4310285 - DNA, 16 bp, Homo sapiens
gggtgggggcctgctg

SEQ ID NO: 4310286 - DNA, 17 bp, Homo sapiens
gggtgtcacagaggcag

SEQ ID NO: 4310287 - DNA, 18 bp, Homo sapiens
gggttagacaagcctgga

SEQ ID NO: 4310288 - DNA, 13 bp, Homo sapiens
gggttccagacag

SEQ ID NO: 4310289 - DNA, 23 bp, Homo sapiens
gggttccagacagagtggatctg

SEQ ID NO: 4310290 - DNA, 17 bp, Homo sapiens
gggttcccactggctcc

SEQ ID NO: 4310291 - DNA, 15 bp, Homo sapiens
gggttcccccagccc

SEQ ID NO: 4310292 - DNA, 18 bp, Homo sapiens
gggttcgtggaaagggtg

SEQ ID NO: 4310293 - DNA, 16 bp, Homo sapiens
gggttctagaaggggc

SEQ ID NO: 4310294 - DNA, 13 bp, Homo sapiens
gggttctggggct

SEQ ID NO: 4310295 - DNA, 15 bp, Homo sapiens
gggttggggtggggc

SEQ ID NO: 4310296 - DNA, 16 bp, Homo sapiens
gggttgggttccagac

SEQ ID NO: 4310297 - DNA, 18 bp, Homo sapiens
gggttgggttccagacag

SEQ ID NO: 4310298 - DNA, 18 bp, Homo sapiens
gggtttccacacaggccc

SEQ ID NO: 4310299 - DNA, 22 bp, Homo sapiens
gggtttggcgggccaaggactg

SEQ ID NO: 4310300 - DNA, 14 bp, Homo sapiens
gggtttgggcagtg

SEQ ID NO: 4310301 - DNA, 18 bp, Homo sapiens
gggttttgttaggggtgg

SEQ ID NO: 4310302 - DNA, 17 bp, Homo sapiens
ggtaacaagaggagcag

SEQ ID NO: 4310303 - DNA, 18 bp, Homo sapiens
ggtaagattgttattaaa

SEQ ID NO: 4310304 - DNA, 13 bp, Homo sapiens
ggtaatctgaaac

SEQ ID NO: 4310305 - DNA, 21 bp, Homo sapiens
ggtaggggaagtgtgctgagg

SEQ ID NO: 4310306 - DNA, 12 bp, Homo sapiens
ggtatccagagg

SEQ ID NO: 4310307 - DNA, 21 bp, Homo sapiens
ggtattttcgtgcatttgtga

SEQ ID NO: 4310308 - DNA, 14 bp, Homo sapiens
ggtcacccccaccc

SEQ ID NO: 4310309 - DNA, 18 bp, Homo sapiens
ggtcaccttcctgggcag

SEQ ID NO: 4310310 - DNA, 23 bp, Homo sapiens
ggtcaccttcctgggcagcccag

SEQ ID NO: 4310311 - DNA, 20 bp, Homo sapiens
ggtcacttcaaacatgccct

SEQ ID NO: 4310312 - DNA, 22 bp, Homo sapiens
ggtcacttcaaacatgccctca

SEQ ID NO: 4310313 - DNA, 11 bp, Homo sapiens
ggtcagggagg

SEQ ID NO: 4310314 - DNA, 20 bp, Homo sapiens
ggtcagtgaagcccaggagg

SEQ ID NO: 4310315 - DNA, 23 bp, Homo sapiens
ggtcagtgtgccaccctctgcag

SEQ ID NO: 4310316 - DNA, 22 bp, Homo sapiens
ggtcatcccggggccatggaag

SEQ ID NO: 4310317 - DNA, 16 bp, Homo sapiens
ggtcatcctgggcatg

SEQ ID NO: 4310318 - DNA, 17 bp, Homo sapiens
ggtccacattctgctgc

SEQ ID NO: 4310319 - DNA, 13 bp, Homo sapiens
ggtccaggccagg

SEQ ID NO: 4310320 - DNA, 19 bp, Homo sapiens
ggtccaggccaggcctcat

SEQ ID NO: 4310321 - DNA, 20 bp, Homo sapiens
ggtcccagacatgctgccca

SEQ ID NO: 4310322 - DNA, 20 bp, Homo sapiens
ggtcccgagccccctgtcct

SEQ ID NO: 4310323 - DNA, 21 bp, Homo sapiens
ggtcccgagccccctgtcctt

SEQ ID NO: 4310324 - DNA, 20 bp, Homo sapiens
ggtcctcaggcagtggccca

SEQ ID NO: 4310325 - DNA, 17 bp, Homo sapiens
ggtcctgaggctggggc

SEQ ID NO: 4310326 - DNA, 18 bp, Homo sapiens
ggtcctgggggctgctgc

SEQ ID NO: 4310327 - DNA, 22 bp, Homo sapiens
ggtcctgggggctgctgcactg

SEQ ID NO: 4310328 - DNA, 21 bp, Homo sapiens
ggtcctgtcctggctcccagg

SEQ ID NO: 4310329 - DNA, 11 bp, Homo sapiens
ggtccttaaaa

SEQ ID NO: 4310330 - DNA, 21 bp, Homo sapiens
ggtccttaaaaaaaaaaatga

SEQ ID NO: 4310331 - DNA, 15 bp, Homo sapiens
ggtccttctgacccc

SEQ ID NO: 4310332 - DNA, 14 bp, Homo sapiens
ggtctcagaggagg

SEQ ID NO: 4310333 - DNA, 14 bp, Homo sapiens
ggtctcatgcctga

SEQ ID NO: 4310334 - DNA, 15 bp, Homo sapiens
ggtctcatgcctgag

SEQ ID NO: 4310335 - DNA, 11 bp, Homo sapiens
ggtctccaccc

SEQ ID NO: 4310336 - DNA, 12 bp, Homo sapiens
ggtctccacccc

SEQ ID NO: 4310337 - DNA, 18 bp, Homo sapiens
ggtctccacctcagggga

SEQ ID NO: 4310338 - DNA, 19 bp, Homo sapiens
ggtctccacctcaggggag

SEQ ID NO: 4310339 - DNA, 13 bp, Homo sapiens
ggtctggagcccc

SEQ ID NO: 4310340 - DNA, 14 bp, Homo sapiens
ggtctgggaggcag

SEQ ID NO: 4310341 - DNA, 19 bp, Homo sapiens
ggtcttcaagcctggccca

SEQ ID NO: 4310342 - DNA, 22 bp, Homo sapiens
ggtcttggattggtaccagagc

SEQ ID NO: 4310343 - DNA, 11 bp, Homo sapiens
ggtgaaagagt

SEQ ID NO: 4310344 - DNA, 23 bp, Homo sapiens
ggtgaaagagtaaaaccaaaggt

SEQ ID NO: 4310345 - DNA, 15 bp, Homo sapiens
ggtgaccttctggga

SEQ ID NO: 4310346 - DNA, 16 bp, Homo sapiens
ggtgagaattaaaata

SEQ ID NO: 4310347 - DNA, 20 bp, Homo sapiens
ggtgagactctgaggtgtca

SEQ ID NO: 4310348 - DNA, 14 bp, Homo sapiens
ggtgagccaagggg

SEQ ID NO: 4310349 - DNA, 14 bp, Homo sapiens
ggtgagccccgccg

SEQ ID NO: 4310350 - DNA, 20 bp, Homo sapiens
ggtgaggcgtgggatccaga

SEQ ID NO: 4310351 - DNA, 14 bp, Homo sapiens
ggtgagggtgacag

SEQ ID NO: 4310352 - DNA, 19 bp, Homo sapiens
ggtgagggtgacagaggga

SEQ ID NO: 4310353 - DNA, 14 bp, Homo sapiens
ggtgataagtggaa

SEQ ID NO: 4310354 - DNA, 14 bp, Homo sapiens
ggtgcagggaccaa

SEQ ID NO: 4310355 - DNA, 22 bp, Homo sapiens
ggtgccaaccacctctggccct

SEQ ID NO: 4310356 - DNA, 16 bp, Homo sapiens
ggtgcccaccagctgg

SEQ ID NO: 4310357 - DNA, 22 bp, Homo sapiens
ggtgcccaccagctggctctgc

SEQ ID NO: 4310358 - DNA, 19 bp, Homo sapiens
ggtgccccccatgccctcc

SEQ ID NO: 4310359 - DNA, 15 bp, Homo sapiens
ggtgcccgggcaggg

SEQ ID NO: 4310360 - DNA, 21 bp, Homo sapiens
ggtgccctggcccagcctgtg

SEQ ID NO: 4310361 - DNA, 12 bp, Homo sapiens
ggtgcctgtgac

SEQ ID NO: 4310362 - DNA, 18 bp, Homo sapiens
ggtgctggcatgtctggg

SEQ ID NO: 4310363 - DNA, 18 bp, Homo sapiens
ggtggacagacccagggt

SEQ ID NO: 4310364 - DNA, 17 bp, Homo sapiens
ggtggcatcccagtggc

SEQ ID NO: 4310365 - DNA, 19 bp, Homo sapiens
ggtggccaagcctgccccg

SEQ ID NO: 4310366 - DNA, 22 bp, Homo sapiens
ggtggccaagcctgccccggcc

SEQ ID NO: 4310367 - DNA, 17 bp, Homo sapiens
ggtggcccgacagcctg

SEQ ID NO: 4310368 - DNA, 14 bp, Homo sapiens
ggtggccggccctg

SEQ ID NO: 4310369 - DNA, 16 bp, Homo sapiens
ggtggccggccctgcc

SEQ ID NO: 4310370 - DNA, 19 bp, Homo sapiens
ggtggccggccctgccccc

SEQ ID NO: 4310371 - DNA, 21 bp, Homo sapiens
ggtggccggccctgcccccca

SEQ ID NO: 4310372 - DNA, 21 bp, Homo sapiens
ggtgggagcacagctttcctg

SEQ ID NO: 4310373 - DNA, 15 bp, Homo sapiens
ggtgggctccagagt

SEQ ID NO: 4310374 - DNA, 20 bp, Homo sapiens
ggtggggcttagaatggggc

SEQ ID NO: 4310375 - DNA, 13 bp, Homo sapiens
ggtgggggcctgc

SEQ ID NO: 4310376 - DNA, 15 bp, Homo sapiens
ggtgggggcctgctg

SEQ ID NO: 4310377 - DNA, 16 bp, Homo sapiens
ggtgggggcctgctgt

SEQ ID NO: 4310378 - DNA, 19 bp, Homo sapiens
ggtgggtgtgagcagggtg

SEQ ID NO: 4310379 - DNA, 17 bp, Homo sapiens
ggtggtcttggagagga

SEQ ID NO: 4310380 - DNA, 18 bp, Homo sapiens
ggtggtcttggagaggag

SEQ ID NO: 4310381 - DNA, 22 bp, Homo sapiens
ggtggtcttggagaggaggtgt

SEQ ID NO: 4310382 - DNA, 18 bp, Homo sapiens
ggtggtttcagaaagggc

SEQ ID NO: 4310383 - DNA, 22 bp, Homo sapiens
ggtgtatttattttcctcccca

SEQ ID NO: 4310384 - DNA, 14 bp, Homo sapiens
ggtgtgagatggtg

SEQ ID NO: 4310385 - DNA, 12 bp, Homo sapiens
ggtgtgctccag

SEQ ID NO: 4310386 - DNA, 15 bp, Homo sapiens
ggtgtgctccaggct

SEQ ID NO: 4310387 - DNA, 21 bp, Homo sapiens
ggtgtgctccaggcttcctgc

SEQ ID NO: 4310388 - DNA, 15 bp, Homo sapiens
ggtgtggagtggagg

SEQ ID NO: 4310389 - DNA, 21 bp, Homo sapiens
ggtgtggagtggaggggtcag

SEQ ID NO: 4310390 - DNA, 17 bp, Homo sapiens
ggtgtgggtcagggagg

SEQ ID NO: 4310391 - DNA, 14 bp, Homo sapiens
ggtgttggaggggc

SEQ ID NO: 4310392 - DNA, 16 bp, Homo sapiens
ggtgttggaggggcag

SEQ ID NO: 4310393 - DNA, 13 bp, Homo sapiens
ggttaagccatat

SEQ ID NO: 4310394 - DNA, 17 bp, Homo sapiens
ggttagacaagcctgga

SEQ ID NO: 4310395 - DNA, 19 bp, Homo sapiens
ggttagacaagcctggagg

SEQ ID NO: 4310396 - DNA, 13 bp, Homo sapiens
ggttccagacaga

SEQ ID NO: 4310397 - DNA, 14 bp, Homo sapiens
ggttccagacaggg

SEQ ID NO: 4310398 - DNA, 17 bp, Homo sapiens
ggttcccactggctcct

SEQ ID NO: 4310399 - DNA, 15 bp, Homo sapiens
ggttcccccagccct

SEQ ID NO: 4310400 - DNA, 17 bp, Homo sapiens
ggttcccccaggaccct

SEQ ID NO: 4310401 - DNA, 13 bp, Homo sapiens
ggttcctccagca

SEQ ID NO: 4310402 - DNA, 13 bp, Homo sapiens
ggttctagaaggg

SEQ ID NO: 4310403 - DNA, 13 bp, Homo sapiens
ggttctccatccc

SEQ ID NO: 4310404 - DNA, 12 bp, Homo sapiens
ggttctggggcc

SEQ ID NO: 4310405 - DNA, 17 bp, Homo sapiens
ggttctggggctgagag

SEQ ID NO: 4310406 - DNA, 14 bp, Homo sapiens
ggttggaggcctgg

SEQ ID NO: 4310407 - DNA, 20 bp, Homo sapiens
ggttggccagagggcccctc

SEQ ID NO: 4310408 - DNA, 15 bp, Homo sapiens
ggttggctgggccca

SEQ ID NO: 4310409 - DNA, 12 bp, Homo sapiens
ggtttactctgt

SEQ ID NO: 4310410 - DNA, 14 bp, Homo sapiens
ggtttcagaaaggg

SEQ ID NO: 4310411 - DNA, 20 bp, Homo sapiens
ggtttccacacaggcccatg

SEQ ID NO: 4310412 - DNA, 14 bp, Homo sapiens
ggtttgggcagtgg

SEQ ID NO: 4310413 - DNA, 16 bp, Homo sapiens
ggtttgggcagtggag

SEQ ID NO: 4310414 - DNA, 22 bp, Homo sapiens
ggtttgggcagtggagagggga

SEQ ID NO: 4310415 - DNA, 15 bp, Homo sapiens
ggtttggtggccagg

SEQ ID NO: 4310416 - DNA, 17 bp, Homo sapiens
ggttttgttaggggtgg

SEQ ID NO: 4310417 - DNA, 14 bp, Homo sapiens
gtaaaattacagaa

SEQ ID NO: 4310418 - DNA, 16 bp, Homo sapiens
gtaaaattcatagcat

SEQ ID NO: 4310419 - DNA, 23 bp, Homo sapiens
gtaaaggtttatttttctgttac

SEQ ID NO: 4310420 - DNA, 21 bp, Homo sapiens
gtaaatctaacattattactt

SEQ ID NO: 4310421 - DNA, 20 bp, Homo sapiens
gtaaatgctacctctgatca

SEQ ID NO: 4310422 - DNA, 12 bp, Homo sapiens
gtaaatttaact

SEQ ID NO: 4310423 - DNA, 16 bp, Homo sapiens
gtaacacataaagtaa

SEQ ID NO: 4310424 - DNA, 19 bp, Homo sapiens
gtaacatagatgcctgggc

SEQ ID NO: 4310425 - DNA, 20 bp, Homo sapiens
gtaacatagatgcctgggcc

SEQ ID NO: 4310426 - DNA, 21 bp, Homo sapiens
gtaagattgttattaaatgta

SEQ ID NO: 4310427 - DNA, 17 bp, Homo sapiens
gtaagattttattttca

SEQ ID NO: 4310428 - DNA, 14 bp, Homo sapiens
gtaaggacttgtgc

SEQ ID NO: 4310429 - DNA, 15 bp, Homo sapiens
gtaaggacttgtgcc

SEQ ID NO: 4310430 - DNA, 16 bp, Homo sapiens
gtaaggacttgtgcct

SEQ ID NO: 4310431 - DNA, 13 bp, Homo sapiens
gtaagtggagcat

SEQ ID NO: 4310432 - DNA, 21 bp, Homo sapiens
gtaagttggctcacatcatgt

SEQ ID NO: 4310433 - DNA, 15 bp, Homo sapiens
gtaatagcctcacct

SEQ ID NO: 4310434 - DNA, 16 bp, Homo sapiens
gtaatagcctcacctt

SEQ ID NO: 4310435 - DNA, 23 bp, Homo sapiens
gtaatatttacaatgtattaagc

SEQ ID NO: 4310436 - DNA, 20 bp, Homo sapiens
gtaatcatttcttgggccct

SEQ ID NO: 4310437 - DNA, 14 bp, Homo sapiens
gtaatctctgatta

SEQ ID NO: 4310438 - DNA, 19 bp, Homo sapiens
gtaatctgaaacacagtca

SEQ ID NO: 4310439 - DNA, 16 bp, Homo sapiens
gtaatctgtataatac

SEQ ID NO: 4310440 - DNA, 13 bp, Homo sapiens
gtaatgtatctta

SEQ ID NO: 4310441 - DNA, 16 bp, Homo sapiens
gtaattaaactgttaa

SEQ ID NO: 4310442 - DNA, 22 bp, Homo sapiens
gtaattaaactgttaacttatt

SEQ ID NO: 4310443 - DNA, 14 bp, Homo sapiens
gtacaaacccagat

SEQ ID NO: 4310444 - DNA, 16 bp, Homo sapiens
gtacaaagggaagcag

SEQ ID NO: 4310445 - DNA, 20 bp, Homo sapiens
gtacaagtgctcagttccaa

SEQ ID NO: 4310446 - DNA, 21 bp, Homo sapiens
gtaccagagcctatggaaagg

SEQ ID NO: 4310447 - DNA, 17 bp, Homo sapiens
gtaccatgttaaagagg

SEQ ID NO: 4310448 - DNA, 22 bp, Homo sapiens
gtacctttctgacaataaataa

SEQ ID NO: 4310449 - DNA, 22 bp, Homo sapiens
gtactaccccagaacgcatgca

SEQ ID NO: 4310450 - DNA, 15 bp, Homo sapiens
gtacttcttctgtaa

SEQ ID NO: 4310451 - DNA, 20 bp, Homo sapiens
gtacttgctcaataaaggtc

SEQ ID NO: 4310452 - DNA, 19 bp, Homo sapiens
gtactttcattccctttca

SEQ ID NO: 4310453 - DNA, 20 bp, Homo sapiens
gtagaaattttatctcttct

SEQ ID NO: 4310454 - DNA, 21 bp, Homo sapiens
gtagaagagggagaaggagag

SEQ ID NO: 4310455 - DNA, 13 bp, Homo sapiens
gtagactgtgaca

SEQ ID NO: 4310456 - DNA, 14 bp, Homo sapiens
gtagagaggacagt

SEQ ID NO: 4310457 - DNA, 17 bp, Homo sapiens
gtagattgtgtaaattc

SEQ ID NO: 4310458 - DNA, 21 bp, Homo sapiens
gtagattgtgtaaattcctgt

SEQ ID NO: 4310459 - DNA, 20 bp, Homo sapiens
gtagcaacccaggtgttgtc

SEQ ID NO: 4310460 - DNA, 18 bp, Homo sapiens
gtagcagagtcattgtta

SEQ ID NO: 4310461 - DNA, 16 bp, Homo sapiens
gtagctacggttccct

SEQ ID NO: 4310462 - DNA, 16 bp, Homo sapiens
gtagctcgtgtgctta

SEQ ID NO: 4310463 - DNA, 21 bp, Homo sapiens
gtagcttcagtcattaaatta

SEQ ID NO: 4310464 - DNA, 17 bp, Homo sapiens
gtaggctgtattttctt

SEQ ID NO: 4310465 - DNA, 16 bp, Homo sapiens
gtagggccagggctct

SEQ ID NO: 4310466 - DNA, 21 bp, Homo sapiens
gtagggggcctgagttgaggg

SEQ ID NO: 4310467 - DNA, 16 bp, Homo sapiens
gtagggtgaggcgtgg

SEQ ID NO: 4310468 - DNA, 21 bp, Homo sapiens
gtaggttattatgattagctt

SEQ ID NO: 4310469 - DNA, 15 bp, Homo sapiens
gtagtaacacataaa

SEQ ID NO: 4310470 - DNA, 14 bp, Homo sapiens
gtagtaattgttac

SEQ ID NO: 4310471 - DNA, 21 bp, Homo sapiens
gtagtacttcttctgtaatat

SEQ ID NO: 4310472 - DNA, 18 bp, Homo sapiens
gtagtagaatctcagcac

SEQ ID NO: 4310473 - DNA, 17 bp, Homo sapiens
gtagtagttgatgacca

SEQ ID NO: 4310474 - DNA, 19 bp, Homo sapiens
gtagtgtctggatcagtaa

SEQ ID NO: 4310475 - DNA, 18 bp, Homo sapiens
gtagttgatgaccaatct

SEQ ID NO: 4310476 - DNA, 20 bp, Homo sapiens
gtataacaagccaaacattc

SEQ ID NO: 4310477 - DNA, 13 bp, Homo sapiens
gtataatactttg

SEQ ID NO: 4310478 - DNA, 22 bp, Homo sapiens
gtataatactttgtatacaagt

SEQ ID NO: 4310479 - DNA, 18 bp, Homo sapiens
gtatatcgttatcactgt

SEQ ID NO: 4310480 - DNA, 17 bp, Homo sapiens
gtatattttatttcaat

SEQ ID NO: 4310481 - DNA, 20 bp, Homo sapiens
gtatattttatttcaatgta

SEQ ID NO: 4310482 - DNA, 14 bp, Homo sapiens
gtatcagtgtttat

SEQ ID NO: 4310483 - DNA, 12 bp, Homo sapiens
gtatccagaggt

SEQ ID NO: 4310484 - DNA, 13 bp, Homo sapiens
gtatccagaggtg

SEQ ID NO: 4310485 - DNA, 18 bp, Homo sapiens
gtatcgctgccttgccat

SEQ ID NO: 4310486 - DNA, 19 bp, Homo sapiens
gtatctaaaaaataactgt

SEQ ID NO: 4310487 - DNA, 17 bp, Homo sapiens
gtatctatgcattttct

SEQ ID NO: 4310488 - DNA, 15 bp, Homo sapiens
gtatcttatttatat

SEQ ID NO: 4310489 - DNA, 16 bp, Homo sapiens
gtatcttatttatata

SEQ ID NO: 4310490 - DNA, 17 bp, Homo sapiens
gtatgaaatatatgtga

SEQ ID NO: 4310491 - DNA, 23 bp, Homo sapiens
gtatgggtcattctcacctgaat

SEQ ID NO: 4310492 - DNA, 18 bp, Homo sapiens
gtatgttaagctctttat

SEQ ID NO: 4310493 - DNA, 14 bp, Homo sapiens
gtatgttatacaac

SEQ ID NO: 4310494 - DNA, 14 bp, Homo sapiens
gtatgttttagcat

SEQ ID NO: 4310495 - DNA, 17 bp, Homo sapiens
gtattcattttgcaact

SEQ ID NO: 4310496 - DNA, 19 bp, Homo sapiens
gtattccagacctgaagaa

SEQ ID NO: 4310497 - DNA, 16 bp, Homo sapiens
gtattccttggcccag

SEQ ID NO: 4310498 - DNA, 19 bp, Homo sapiens
gtattctgtggattctata

SEQ ID NO: 4310499 - DNA, 15 bp, Homo sapiens
gtattgtgaaatttg

SEQ ID NO: 4310500 - DNA, 18 bp, Homo sapiens
gtatttattttcctcccc

SEQ ID NO: 4310501 - DNA, 18 bp, Homo sapiens
gtattttcgtgcatttgt

SEQ ID NO: 4310502 - DNA, 16 bp, Homo sapiens
gtattttcttcccatt

SEQ ID NO: 4310503 - DNA, 20 bp, Homo sapiens
gtattttcttcccatttgta

SEQ ID NO: 4310504 - DNA, 21 bp, Homo sapiens
gtattttcttcccatttgtaa

SEQ ID NO: 4310505 - DNA, 22 bp, Homo sapiens
gtatttttagagattaatttgt

SEQ ID NO: 4310506 - DNA, 17 bp, Homo sapiens
gtcaaccttgtgtgagt

SEQ ID NO: 4310507 - DNA, 17 bp, Homo sapiens
gtcaactccaaggcaaa

SEQ ID NO: 4310508 - DNA, 15 bp, Homo sapiens
gtcaactgctgtttt

SEQ ID NO: 4310509 - DNA, 15 bp, Homo sapiens
gtcaagtgtgcctgc

SEQ ID NO: 4310510 - DNA, 17 bp, Homo sapiens
gtcaagtgtgcctgcta

SEQ ID NO: 4310511 - DNA, 18 bp, Homo sapiens
gtcaataattgtggagag

SEQ ID NO: 4310512 - DNA, 20 bp, Homo sapiens
gtcaataattgtggagagga

SEQ ID NO: 4310513 - DNA, 21 bp, Homo sapiens
gtcaatgaaatatttgcttat

SEQ ID NO: 4310514 - DNA, 13 bp, Homo sapiens
gtcacagaggcag

SEQ ID NO: 4310515 - DNA, 23 bp, Homo sapiens
gtcacatatcaagtcccgaggca

SEQ ID NO: 4310516 - DNA, 15 bp, Homo sapiens
gtcaccatctcaggc

SEQ ID NO: 4310517 - DNA, 16 bp, Homo sapiens
gtcaccatctcaggcc

SEQ ID NO: 4310518 - DNA, 20 bp, Homo sapiens
gtcaccatctcaggccacct

SEQ ID NO: 4310519 - DNA, 21 bp, Homo sapiens
gtcacctcagagacatacacc

SEQ ID NO: 4310520 - DNA, 15 bp, Homo sapiens
gtcaccttcctgggc

SEQ ID NO: 4310521 - DNA, 24 bp, Homo sapiens
gtcaccttcctgggcagcccagag

SEQ ID NO: 4310522 - DNA, 23 bp, Homo sapiens
gtcacgttttgcctcatgaacac

SEQ ID NO: 4310523 - DNA, 20 bp, Homo sapiens
gtcactgcacagtgcatctc

SEQ ID NO: 4310524 - DNA, 23 bp, Homo sapiens
gtcacttcaaacatgccctcagg

SEQ ID NO: 4310525 - DNA, 12 bp, Homo sapiens
gtcagagctggg

SEQ ID NO: 4310526 - DNA, 13 bp, Homo sapiens
gtcagagctggga

SEQ ID NO: 4310527 - DNA, 14 bp, Homo sapiens
gtcagcggcctggg

SEQ ID NO: 4310528 - DNA, 13 bp, Homo sapiens
gtcagctgtagaa

SEQ ID NO: 4310529 - DNA, 17 bp, Homo sapiens
gtcagctgtagaaaggt

SEQ ID NO: 4310530 - DNA, 14 bp, Homo sapiens
gtcagcttgaatgt

SEQ ID NO: 4310531 - DNA, 16 bp, Homo sapiens
gtcagctttgccttcc

SEQ ID NO: 4310532 - DNA, 17 bp, Homo sapiens
gtcagctttgccttcca

SEQ ID NO: 4310533 - DNA, 23 bp, Homo sapiens
gtcagctttgccttccacgctgt

SEQ ID NO: 4310534 - DNA, 14 bp, Homo sapiens
gtcaggagccagca

SEQ ID NO: 4310535 - DNA, 15 bp, Homo sapiens
gtcaggagccagcag

SEQ ID NO: 4310536 - DNA, 17 bp, Homo sapiens
gtcaggagccagcaggg

SEQ ID NO: 4310537 - DNA, 17 bp, Homo sapiens
gtcaggaggtgcctgag

SEQ ID NO: 4310538 - DNA, 15 bp, Homo sapiens
gtcagggagccctgg

SEQ ID NO: 4310539 - DNA, 17 bp, Homo sapiens
gtcagggcggggctggc

SEQ ID NO: 4310540 - DNA, 19 bp, Homo sapiens
gtcagggcggggctggcca

SEQ ID NO: 4310541 - DNA, 23 bp, Homo sapiens
gtcagggcggggctggccagctg

SEQ ID NO: 4310542 - DNA, 18 bp, Homo sapiens
gtcagtgaagcccaggag

SEQ ID NO: 4310543 - DNA, 23 bp, Homo sapiens
gtcagtgaagcccaggaggacct

SEQ ID NO: 4310544 - DNA, 14 bp, Homo sapiens
gtcagtgaggccca

SEQ ID NO: 4310545 - DNA, 16 bp, Homo sapiens
gtcagtgcagcccgtg

SEQ ID NO: 4310546 - DNA, 23 bp, Homo sapiens
gtcagtgcagcccgtgtggcccc

SEQ ID NO: 4310547 - DNA, 16 bp, Homo sapiens
gtcagtgtgccaccct

SEQ ID NO: 4310548 - DNA, 21 bp, Homo sapiens
gtcagtgtgccaccctctgca

SEQ ID NO: 4310549 - DNA, 22 bp, Homo sapiens
gtcataaagtgagaaaactgtg

SEQ ID NO: 4310550 - DNA, 14 bp, Homo sapiens
gtcataccatccat

SEQ ID NO: 4310551 - DNA, 19 bp, Homo sapiens
gtcatcccggggccatgga

SEQ ID NO: 4310552 - DNA, 12 bp, Homo sapiens
gtcatcctgggc

SEQ ID NO: 4310553 - DNA, 19 bp, Homo sapiens
gtcatgatgaatcagtcct

SEQ ID NO: 4310554 - DNA, 14 bp, Homo sapiens
gtcattaaagtgca

SEQ ID NO: 4310555 - DNA, 20 bp, Homo sapiens
gtcattaaagtgcactgtgt

SEQ ID NO: 4310556 - DNA, 17 bp, Homo sapiens
gtcattaaattactata

SEQ ID NO: 4310557 - DNA, 20 bp, Homo sapiens
gtccaacaactccaggaaaa

SEQ ID NO: 4310558 - DNA, 20 bp, Homo sapiens
gtccacacaagacagcagag

SEQ ID NO: 4310559 - DNA, 15 bp, Homo sapiens
gtccacattctgctg

SEQ ID NO: 4310560 - DNA, 20 bp, Homo sapiens
gtccacccgtttccaagcct

SEQ ID NO: 4310561 - DNA, 13 bp, Homo sapiens
gtccacctgtgct

SEQ ID NO: 4310562 - DNA, 18 bp, Homo sapiens
gtccacctgtgctgctgc

SEQ ID NO: 4310563 - DNA, 12 bp, Homo sapiens
gtccagacctgg

SEQ ID NO: 4310564 - DNA, 18 bp, Homo sapiens
gtccagacctgggccctg

SEQ ID NO: 4310565 - DNA, 22 bp, Homo sapiens
gtccagagagagaagtgcccct

SEQ ID NO: 4310566 - DNA, 14 bp, Homo sapiens
gtccaggccaggcc

SEQ ID NO: 4310567 - DNA, 24 bp, Homo sapiens
gtccaggccaggcctcatcctcct

SEQ ID NO: 4310568 - DNA, 19 bp, Homo sapiens
gtccagtgaccctggagct

SEQ ID NO: 4310569 - DNA, 20 bp, Homo sapiens
gtccagtgaccctggagcta

SEQ ID NO: 4310570 - DNA, 22 bp, Homo sapiens
gtccagtttgtgcaagacaccc

SEQ ID NO: 4310571 - DNA, 17 bp, Homo sapiens
gtccatctgtctgtcct

SEQ ID NO: 4310572 - DNA, 18 bp, Homo sapiens
gtccattgcaaaaggtta

SEQ ID NO: 4310573 - DNA, 19 bp, Homo sapiens
gtcccagacatgctgccca

SEQ ID NO: 4310574 - DNA, 23 bp, Homo sapiens
gtcccagacatgctgcccacccc

SEQ ID NO: 4310575 - DNA, 15 bp, Homo sapiens
gtcccagtgggaggc

SEQ ID NO: 4310576 - DNA, 18 bp, Homo sapiens
gtcccagtgggaggcgcg

SEQ ID NO: 4310577 - DNA, 23 bp, Homo sapiens
gtccccagtgtggactctggact

SEQ ID NO: 4310578 - DNA, 17 bp, Homo sapiens
gtccccattctataaat

SEQ ID NO: 4310579 - DNA, 16 bp, Homo sapiens
gtccccgggaaaggcc

SEQ ID NO: 4310580 - DNA, 18 bp, Homo sapiens
gtccccgggaaaggccgg

SEQ ID NO: 4310581 - DNA, 15 bp, Homo sapiens
gtcccgagccccctg

SEQ ID NO: 4310582 - DNA, 19 bp, Homo sapiens
gtcccgagccccctgtcct

SEQ ID NO: 4310583 - DNA, 15 bp, Homo sapiens
gtcccggagctcagg

SEQ ID NO: 4310584 - DNA, 16 bp, Homo sapiens
gtccctccctcctggc

SEQ ID NO: 4310585 - DNA, 18 bp, Homo sapiens
gtccctccctcctggctc

SEQ ID NO: 4310586 - DNA, 19 bp, Homo sapiens
gtccctccctcctggctca

SEQ ID NO: 4310587 - DNA, 22 bp, Homo sapiens
gtccctccctcctggctcacag

SEQ ID NO: 4310588 - DNA, 18 bp, Homo sapiens
gtccctgagggcccttcc

SEQ ID NO: 4310589 - DNA, 16 bp, Homo sapiens
gtccctgccccgcccc

SEQ ID NO: 4310590 - DNA, 18 bp, Homo sapiens
gtccctgccccgcccccc

SEQ ID NO: 4310591 - DNA, 21 bp, Homo sapiens
gtccctgccccgccccccaga

SEQ ID NO: 4310592 - DNA, 12 bp, Homo sapiens
gtccctgcctgg

SEQ ID NO: 4310593 - DNA, 13 bp, Homo sapiens
gtccctgcctggc

SEQ ID NO: 4310594 - DNA, 14 bp, Homo sapiens
gtccctgcctggcc

SEQ ID NO: 4310595 - DNA, 15 bp, Homo sapiens
gtccctgtccctgcc

SEQ ID NO: 4310596 - DNA, 17 bp, Homo sapiens
gtccctgtccctgcccc

SEQ ID NO: 4310597 - DNA, 16 bp, Homo sapiens
gtcccttccccctgct

SEQ ID NO: 4310598 - DNA, 15 bp, Homo sapiens
gtccctttccctgca

SEQ ID NO: 4310599 - DNA, 21 bp, Homo sapiens
gtccggtggaaggccttcttt

SEQ ID NO: 4310600 - DNA, 23 bp, Homo sapiens
gtcctacaatatcattttcctgg

SEQ ID NO: 4310601 - DNA, 14 bp, Homo sapiens
gtcctacccgcccg

SEQ ID NO: 4310602 - DNA, 23 bp, Homo sapiens
gtcctcaggcagtggcccaggga

SEQ ID NO: 4310603 - DNA, 16 bp, Homo sapiens
gtcctgaggctggggc

SEQ ID NO: 4310604 - DNA, 16 bp, Homo sapiens
gtcctgctcagatgct

SEQ ID NO: 4310605 - DNA, 14 bp, Homo sapiens
gtcctggcagggca

SEQ ID NO: 4310606 - DNA, 20 bp, Homo sapiens
gtcctggcagggcaggcaga

SEQ ID NO: 4310607 - DNA, 20 bp, Homo sapiens
gtcctggctcccagggtcct

SEQ ID NO: 4310608 - DNA, 14 bp, Homo sapiens
gtcctgggggctgc

SEQ ID NO: 4310609 - DNA, 13 bp, Homo sapiens
gtcctggggtggt

SEQ ID NO: 4310610 - DNA, 17 bp, Homo sapiens
gtcctgtcctggctccc

SEQ ID NO: 4310611 - DNA, 21 bp, Homo sapiens
gtccttaaaaaatatgctctc

SEQ ID NO: 4310612 - DNA, 18 bp, Homo sapiens
gtccttagactccttctc

SEQ ID NO: 4310613 - DNA, 23 bp, Homo sapiens
gtccttagactccttctccccaa

SEQ ID NO: 4310614 - DNA, 19 bp, Homo sapiens
gtccttcccacggccactg

SEQ ID NO: 4310615 - DNA, 20 bp, Homo sapiens
gtccttcccacggccactgc

SEQ ID NO: 4310616 - DNA, 22 bp, Homo sapiens
gtccttcccacggccactgcag

SEQ ID NO: 4310617 - DNA, 15 bp, Homo sapiens
gtccttctgacccca

SEQ ID NO: 4310618 - DNA, 19 bp, Homo sapiens
gtcgcctctcactctggca

SEQ ID NO: 4310619 - DNA, 16 bp, Homo sapiens
gtcggaggcttgggac

SEQ ID NO: 4310620 - DNA, 18 bp, Homo sapiens
gtcggcgccttctacctg

SEQ ID NO: 4310621 - DNA, 18 bp, Homo sapiens
gtctaaagttagggcatt

SEQ ID NO: 4310622 - DNA, 12 bp, Homo sapiens
gtctaataaaca

SEQ ID NO: 4310623 - DNA, 20 bp, Homo sapiens
gtctcaagagggcactggtg

SEQ ID NO: 4310624 - DNA, 12 bp, Homo sapiens
gtctcatgcctg

SEQ ID NO: 4310625 - DNA, 16 bp, Homo sapiens
gtctcatgcctgagaa

SEQ ID NO: 4310626 - DNA, 13 bp, Homo sapiens
gtctccacccctc

SEQ ID NO: 4310627 - DNA, 20 bp, Homo sapiens
gtctccagacccccacccct

SEQ ID NO: 4310628 - DNA, 18 bp, Homo sapiens
gtctcctgtatcatttct

SEQ ID NO: 4310629 - DNA, 15 bp, Homo sapiens
gtctctcatgaacct

SEQ ID NO: 4310630 - DNA, 14 bp, Homo sapiens
gtctcttctccact

SEQ ID NO: 4310631 - DNA, 15 bp, Homo sapiens
gtctcttctccactg

SEQ ID NO: 4310632 - DNA, 20 bp, Homo sapiens
gtctcttgcataagcctcag

SEQ ID NO: 4310633 - DNA, 14 bp, Homo sapiens
gtctgaaggagagg

SEQ ID NO: 4310634 - DNA, 17 bp, Homo sapiens
gtctgaaggagaggagt

SEQ ID NO: 4310635 - DNA, 23 bp, Homo sapiens
gtctgaaggattttaaatgctgt

SEQ ID NO: 4310636 - DNA, 24 bp, Homo sapiens
gtctgacatcagaggtatcttact

SEQ ID NO: 4310637 - DNA, 18 bp, Homo sapiens
gtctgagccctgccctca

SEQ ID NO: 4310638 - DNA, 22 bp, Homo sapiens
gtctgagcggccgcctgtcctt

SEQ ID NO: 4310639 - DNA, 13 bp, Homo sapiens
gtctgattctatg

SEQ ID NO: 4310640 - DNA, 20 bp, Homo sapiens
gtctgcacaccttgaatctg

SEQ ID NO: 4310641 - DNA, 15 bp, Homo sapiens
gtctgctgccctcca

SEQ ID NO: 4310642 - DNA, 22 bp, Homo sapiens
gtctggagcccctatcctgcac

SEQ ID NO: 4310643 - DNA, 24 bp, Homo sapiens
gtctggagcccctatcctgcaccc

SEQ ID NO: 4310644 - DNA, 17 bp, Homo sapiens
gtctggaggtcccagac

SEQ ID NO: 4310645 - DNA, 19 bp, Homo sapiens
gtctggaggtcccagacat

SEQ ID NO: 4310646 - DNA, 19 bp, Homo sapiens
gtctggatcagtaaaatta

SEQ ID NO: 4310647 - DNA, 22 bp, Homo sapiens
gtctggattcccgtggctttgt

SEQ ID NO: 4310648 - DNA, 19 bp, Homo sapiens
gtctggctgtggcccctcc

SEQ ID NO: 4310649 - DNA, 22 bp, Homo sapiens
gtctggctgtggcccctccttc

SEQ ID NO: 4310650 - DNA, 21 bp, Homo sapiens
gtctggctttggaaagacctg

SEQ ID NO: 4310651 - DNA, 19 bp, Homo sapiens
gtctgtaaatctaacatta

SEQ ID NO: 4310652 - DNA, 14 bp, Homo sapiens
gtctgtaagagaat

SEQ ID NO: 4310653 - DNA, 22 bp, Homo sapiens
gtctgtccatctgtctgtccta

SEQ ID NO: 4310654 - DNA, 13 bp, Homo sapiens
gtctgtcctaccc

SEQ ID NO: 4310655 - DNA, 18 bp, Homo sapiens
gtctgtcctacccgcccg

SEQ ID NO: 4310656 - DNA, 21 bp, Homo sapiens
gtctgtgaacttgatgttcct

SEQ ID NO: 4310657 - DNA, 22 bp, Homo sapiens
gtctgtgaacttgatgttcctg

SEQ ID NO: 4310658 - DNA, 17 bp, Homo sapiens
gtctgtgaataaagcca

SEQ ID NO: 4310659 - DNA, 20 bp, Homo sapiens
gtcttagtcataccatccat

SEQ ID NO: 4310660 - DNA, 17 bp, Homo sapiens
gtcttcaaattgtcttt

SEQ ID NO: 4310661 - DNA, 15 bp, Homo sapiens
gtcttcaagcctggc

SEQ ID NO: 4310662 - DNA, 14 bp, Homo sapiens
gtcttcaagggctt

SEQ ID NO: 4310663 - DNA, 19 bp, Homo sapiens
gtcttgagtgggccccctc

SEQ ID NO: 4310664 - DNA, 15 bp, Homo sapiens
gtcttggagaggagg

SEQ ID NO: 4310665 - DNA, 20 bp, Homo sapiens
gtcttggagaggaggtgtgg

SEQ ID NO: 4310666 - DNA, 13 bp, Homo sapiens
gtcttgtattttc

SEQ ID NO: 4310667 - DNA, 22 bp, Homo sapiens
gtcttgttttttttttccactt

SEQ ID NO: 4310668 - DNA, 14 bp, Homo sapiens
gtctttctccaaag

SEQ ID NO: 4310669 - DNA, 16 bp, Homo sapiens
gtctttctccaaagtt

SEQ ID NO: 4310670 - DNA, 16 bp, Homo sapiens
gtctttgctgtttata

SEQ ID NO: 4310671 - DNA, 19 bp, Homo sapiens
gtctttgctgtttatatat

SEQ ID NO: 4310672 - DNA, 15 bp, Homo sapiens
gtctttgcttgtcct

SEQ ID NO: 4310673 - DNA, 19 bp, Homo sapiens
gtctttggcttcagaattg

SEQ ID NO: 4310674 - DNA, 20 bp, Homo sapiens
gtctttgggggattcaaatg

SEQ ID NO: 4310675 - DNA, 14 bp, Homo sapiens
gtctttgtgtgctg

SEQ ID NO: 4310676 - DNA, 13 bp, Homo sapiens
gtgaaacacagct

SEQ ID NO: 4310677 - DNA, 15 bp, Homo sapiens
gtgaaacacagctgt

SEQ ID NO: 4310678 - DNA, 12 bp, Homo sapiens
gtgaaatatcat

SEQ ID NO: 4310679 - DNA, 14 bp, Homo sapiens
gtgaaatgtaactg

SEQ ID NO: 4310680 - DNA, 22 bp, Homo sapiens
gtgaagaaagcctgttgtttaa

SEQ ID NO: 4310681 - DNA, 15 bp, Homo sapiens
gtgaagcctcccgaa

SEQ ID NO: 4310682 - DNA, 18 bp, Homo sapiens
gtgaatacatggtagcag

SEQ ID NO: 4310683 - DNA, 16 bp, Homo sapiens
gtgaatataaatgtgt

SEQ ID NO: 4310684 - DNA, 13 bp, Homo sapiens
gtgacaaggcccc

SEQ ID NO: 4310685 - DNA, 14 bp, Homo sapiens
gtgacaaggcccca

SEQ ID NO: 4310686 - DNA, 17 bp, Homo sapiens
gtgacaaggccccagag

SEQ ID NO: 4310687 - DNA, 20 bp, Homo sapiens
gtgacagagggacagtgggc

SEQ ID NO: 4310688 - DNA, 15 bp, Homo sapiens
gtgacatgcggctgc

SEQ ID NO: 4310689 - DNA, 18 bp, Homo sapiens
gtgaccccagctccaggc

SEQ ID NO: 4310690 - DNA, 22 bp, Homo sapiens
gtgaccccagctccaggcagga

SEQ ID NO: 4310691 - DNA, 14 bp, Homo sapiens
gtgaccctggagct

SEQ ID NO: 4310692 - DNA, 16 bp, Homo sapiens
gtgaccggggtcctga

SEQ ID NO: 4310693 - DNA, 21 bp, Homo sapiens
gtgacgggggttggggtgggg

SEQ ID NO: 4310694 - DNA, 17 bp, Homo sapiens
gtgacgtgagtggggag

SEQ ID NO: 4310695 - DNA, 22 bp, Homo sapiens
gtgactaccacttatttctaaa

SEQ ID NO: 4310696 - DNA, 19 bp, Homo sapiens
gtgactccaggagaggagc

SEQ ID NO: 4310697 - DNA, 14 bp, Homo sapiens
gtgactccatatcc

SEQ ID NO: 4310698 - DNA, 21 bp, Homo sapiens
gtgactgctgcgctgtgctgg

SEQ ID NO: 4310699 - DNA, 20 bp, Homo sapiens
gtgacttcagactctctcct

SEQ ID NO: 4310700 - DNA, 22 bp, Homo sapiens
gtgagaatcgacctcactgtca

SEQ ID NO: 4310701 - DNA, 16 bp, Homo sapiens
gtgagaattaaaataa

SEQ ID NO: 4310702 - DNA, 14 bp, Homo sapiens
gtgagactctgagg

SEQ ID NO: 4310703 - DNA, 15 bp, Homo sapiens
gtgagatgtcagaca

SEQ ID NO: 4310704 - DNA, 13 bp, Homo sapiens
gtgagattctaaa

SEQ ID NO: 4310705 - DNA, 23 bp, Homo sapiens
gtgagatttgtatttatattaga

SEQ ID NO: 4310706 - DNA, 18 bp, Homo sapiens
gtgaggagggggagaagg

SEQ ID NO: 4310707 - DNA, 23 bp, Homo sapiens
gtgaggcccccgcacgcaagcct

SEQ ID NO: 4310708 - DNA, 13 bp, Homo sapiens
gtgaggcgtggga

SEQ ID NO: 4310709 - DNA, 16 bp, Homo sapiens
gtgagggtgacagagg

SEQ ID NO: 4310710 - DNA, 19 bp, Homo sapiens
gtgagggtgacagagggac

SEQ ID NO: 4310711 - DNA, 19 bp, Homo sapiens
gtgaggtcctgtcctggct

SEQ ID NO: 4310712 - DNA, 19 bp, Homo sapiens
gtgataagtggaaaaaaga

SEQ ID NO: 4310713 - DNA, 17 bp, Homo sapiens
gtgatacactgtatcta

SEQ ID NO: 4310714 - DNA, 21 bp, Homo sapiens
gtgatccctagctgtgacctc

SEQ ID NO: 4310715 - DNA, 22 bp, Homo sapiens
gtgatgaagaaaagtgggccag

SEQ ID NO: 4310716 - DNA, 11 bp, Homo sapiens
gtgatgggagt

SEQ ID NO: 4310717 - DNA, 16 bp, Homo sapiens
gtgcaagacacccagt

SEQ ID NO: 4310718 - DNA, 16 bp, Homo sapiens
gtgcaatatgagggga

SEQ ID NO: 4310719 - DNA, 18 bp, Homo sapiens
gtgcaatatgtaacatgt

SEQ ID NO: 4310720 - DNA, 16 bp, Homo sapiens
gtgcacacacctgcac

SEQ ID NO: 4310721 - DNA, 18 bp, Homo sapiens
gtgcacacacctgcacac

SEQ ID NO: 4310722 - DNA, 11 bp, Homo sapiens
gtgcacagccc

SEQ ID NO: 4310723 - DNA, 11 bp, Homo sapiens
gtgcacagctg

SEQ ID NO: 4310724 - DNA, 17 bp, Homo sapiens
gtgcagttgctgtttac

SEQ ID NO: 4310725 - DNA, 18 bp, Homo sapiens
gtgcatctcagcccacat

SEQ ID NO: 4310726 - DNA, 12 bp, Homo sapiens
gtgcatttaaaa

SEQ ID NO: 4310727 - DNA, 17 bp, Homo sapiens
gtgcatttatgagctct

SEQ ID NO: 4310728 - DNA, 16 bp, Homo sapiens
gtgcatttctgggcct

SEQ ID NO: 4310729 - DNA, 23 bp, Homo sapiens
gtgcatttgtgagccaaagagaa

SEQ ID NO: 4310730 - DNA, 17 bp, Homo sapiens
gtgccaaccacctctgg

SEQ ID NO: 4310731 - DNA, 18 bp, Homo sapiens
gtgccaccctctgcaggg

SEQ ID NO: 4310732 - DNA, 21 bp, Homo sapiens
gtgccaccctctgcagggcag

SEQ ID NO: 4310733 - DNA, 23 bp, Homo sapiens
gtgccaccctctgcagggcagcc

SEQ ID NO: 4310734 - DNA, 16 bp, Homo sapiens
gtgccacgcgctctgc

SEQ ID NO: 4310735 - DNA, 18 bp, Homo sapiens
gtgccacgcgctctgcat

SEQ ID NO: 4310736 - DNA, 16 bp, Homo sapiens
gtgccagctgcttctg

SEQ ID NO: 4310737 - DNA, 20 bp, Homo sapiens
gtgccagctgcttctgccca

SEQ ID NO: 4310738 - DNA, 21 bp, Homo sapiens
gtgccagctgcttctgcccac

SEQ ID NO: 4310739 - DNA, 22 bp, Homo sapiens
gtgccagctgcttctgcccacc

SEQ ID NO: 4310740 - DNA, 19 bp, Homo sapiens
gtgccaggagtgggtggga

SEQ ID NO: 4310741 - DNA, 22 bp, Homo sapiens
gtgccaggagtgggtgggacac

SEQ ID NO: 4310742 - DNA, 23 bp, Homo sapiens
gtgcccaccagctggctctgcag

SEQ ID NO: 4310743 - DNA, 14 bp, Homo sapiens
gtgcccagtcttga

SEQ ID NO: 4310744 - DNA, 16 bp, Homo sapiens
gtgcccatggggtaga

SEQ ID NO: 4310745 - DNA, 23 bp, Homo sapiens
gtgccccctggggggcacagcca

SEQ ID NO: 4310746 - DNA, 17 bp, Homo sapiens
gtgcccgctgcgctgcc

SEQ ID NO: 4310747 - DNA, 18 bp, Homo sapiens
gtgcccgctgcgctgccc

SEQ ID NO: 4310748 - DNA, 19 bp, Homo sapiens
gtgcccgctgcgctgccct

SEQ ID NO: 4310749 - DNA, 22 bp, Homo sapiens
gtgcccgctgcgctgccctgca

SEQ ID NO: 4310750 - DNA, 13 bp, Homo sapiens
gtgccctggccca

SEQ ID NO: 4310751 - DNA, 16 bp, Homo sapiens
gtgcctcttgggagac

SEQ ID NO: 4310752 - DNA, 17 bp, Homo sapiens
gtgcctgctatccagcc

SEQ ID NO: 4310753 - DNA, 20 bp, Homo sapiens
gtgcctgctatccagccgca

SEQ ID NO: 4310754 - DNA, 15 bp, Homo sapiens
gtgccttcagctcta

SEQ ID NO: 4310755 - DNA, 22 bp, Homo sapiens
gtgcgctgacaaccaccgctcc

SEQ ID NO: 4310756 - DNA, 19 bp, Homo sapiens
gtgcgtatgcagtgtagat

SEQ ID NO: 4310757 - DNA, 14 bp, Homo sapiens
gtgcgttttagagt

SEQ ID NO: 4310758 - DNA, 14 bp, Homo sapiens
gtgctaagttgtct

SEQ ID NO: 4310759 - DNA, 13 bp, Homo sapiens
gtgctattaatat

SEQ ID NO: 4310760 - DNA, 21 bp, Homo sapiens
gtgctccaggcttcctgccct

SEQ ID NO: 4310761 - DNA, 14 bp, Homo sapiens
gtgctccagtgttt

SEQ ID NO: 4310762 - DNA, 20 bp, Homo sapiens
gtgctccagtgttttcttgt

SEQ ID NO: 4310763 - DNA, 16 bp, Homo sapiens
gtgctgcacccctggt

SEQ ID NO: 4310764 - DNA, 15 bp, Homo sapiens
gtgctgctgcaccaa

SEQ ID NO: 4310765 - DNA, 19 bp, Homo sapiens
gtgctggtctctaggcctg

SEQ ID NO: 4310766 - DNA, 13 bp, Homo sapiens
gtgctgtgcaccc

SEQ ID NO: 4310767 - DNA, 19 bp, Homo sapiens
gtgctgtgcacccgtgcca

SEQ ID NO: 4310768 - DNA, 17 bp, Homo sapiens
gtgcttggcaggaacca

SEQ ID NO: 4310769 - DNA, 14 bp, Homo sapiens
gtggaaaaaagaga

SEQ ID NO: 4310770 - DNA, 15 bp, Homo sapiens
gtggaaaaaagagaa

SEQ ID NO: 4310771 - DNA, 16 bp, Homo sapiens
gtggaaaactcacaga

SEQ ID NO: 4310772 - DNA, 20 bp, Homo sapiens
gtggaaagggtgctgcttcc

SEQ ID NO: 4310773 - DNA, 22 bp, Homo sapiens
gtggaagcaggttgcttcaaga

SEQ ID NO: 4310774 - DNA, 13 bp, Homo sapiens
gtggacccagctg

SEQ ID NO: 4310775 - DNA, 20 bp, Homo sapiens
gtggacgtgggctccaggga

SEQ ID NO: 4310776 - DNA, 16 bp, Homo sapiens
gtggactttccacccc

SEQ ID NO: 4310777 - DNA, 20 bp, Homo sapiens
gtggactttccaccccctcc

SEQ ID NO: 4310778 - DNA, 11 bp, Homo sapiens
gtggagaggag

SEQ ID NO: 4310779 - DNA, 13 bp, Homo sapiens
gtggagccacagg

SEQ ID NO: 4310780 - DNA, 20 bp, Homo sapiens
gtggagccacaggcagacga

SEQ ID NO: 4310781 - DNA, 11 bp, Homo sapiens
gtggagctcta

SEQ ID NO: 4310782 - DNA, 17 bp, Homo sapiens
gtggaggctaagcctgg

SEQ ID NO: 4310783 - DNA, 13 bp, Homo sapiens
gtggaggggtcag

SEQ ID NO: 4310784 - DNA, 15 bp, Homo sapiens
gtggagtcgagctgg

SEQ ID NO: 4310785 - DNA, 17 bp, Homo sapiens
gtggagtcgagctggcc

SEQ ID NO: 4310786 - DNA, 15 bp, Homo sapiens
gtggattttgtggct

SEQ ID NO: 4310787 - DNA, 16 bp, Homo sapiens
gtggcatcccagtggc

SEQ ID NO: 4310788 - DNA, 18 bp, Homo sapiens
gtggccaagcctgccccg

SEQ ID NO: 4310789 - DNA, 12 bp, Homo sapiens
gtggccaggctg

SEQ ID NO: 4310790 - DNA, 14 bp, Homo sapiens
gtggccaggctggt

SEQ ID NO: 4310791 - DNA, 22 bp, Homo sapiens
gtggcccaccagagcctccctc

SEQ ID NO: 4310792 - DNA, 18 bp, Homo sapiens
gtggcccgacagcctggc

SEQ ID NO: 4310793 - DNA, 14 bp, Homo sapiens
gtggccggccctgc

SEQ ID NO: 4310794 - DNA, 21 bp, Homo sapiens
gtggccgggggtgggggcctg

SEQ ID NO: 4310795 - DNA, 14 bp, Homo sapiens
gtggcctggggctg

SEQ ID NO: 4310796 - DNA, 12 bp, Homo sapiens
gtggcggtgcag

SEQ ID NO: 4310797 - DNA, 15 bp, Homo sapiens
gtggctcattctttt

SEQ ID NO: 4310798 - DNA, 17 bp, Homo sapiens
gtggctcattcttttca

SEQ ID NO: 4310799 - DNA, 21 bp, Homo sapiens
gtggctctacaactgagtcct

SEQ ID NO: 4310800 - DNA, 18 bp, Homo sapiens
gtggcttcccatgtcttt

SEQ ID NO: 4310801 - DNA, 18 bp, Homo sapiens
gtggcttcccgctcagcc

SEQ ID NO: 4310802 - DNA, 20 bp, Homo sapiens
gtggcttggagcagaggtgg

SEQ ID NO: 4310803 - DNA, 20 bp, Homo sapiens
gtgggaagagggcaggggct

SEQ ID NO: 4310804 - DNA, 14 bp, Homo sapiens
gtgggacacagaga

SEQ ID NO: 4310805 - DNA, 13 bp, Homo sapiens
gtgggagaaggga

SEQ ID NO: 4310806 - DNA, 12 bp, Homo sapiens
gtgggagaggaa

SEQ ID NO: 4310807 - DNA, 17 bp, Homo sapiens
gtgggagaggaagccac

SEQ ID NO: 4310808 - DNA, 18 bp, Homo sapiens
gtgggatccagagagaag

SEQ ID NO: 4310809 - DNA, 16 bp, Homo sapiens
gtgggcagctggctct

SEQ ID NO: 4310810 - DNA, 13 bp, Homo sapiens
gtgggccagcccc

SEQ ID NO: 4310811 - DNA, 15 bp, Homo sapiens
gtgggccagcccctc

SEQ ID NO: 4310812 - DNA, 17 bp, Homo sapiens
gtgggccagcccctccc

SEQ ID NO: 4310813 - DNA, 14 bp, Homo sapiens
gtgggccctggctc

SEQ ID NO: 4310814 - DNA, 15 bp, Homo sapiens
gtgggccctggctct

SEQ ID NO: 4310815 - DNA, 13 bp, Homo sapiens
gtgggcctgccta

SEQ ID NO: 4310816 - DNA, 14 bp, Homo sapiens
gtgggccttccatg

SEQ ID NO: 4310817 - DNA, 13 bp, Homo sapiens
gtgggctccagag

SEQ ID NO: 4310818 - DNA, 22 bp, Homo sapiens
gtgggctccagggactggagtg

SEQ ID NO: 4310819 - DNA, 19 bp, Homo sapiens
gtgggctcccacgccctcc

SEQ ID NO: 4310820 - DNA, 14 bp, Homo sapiens
gtgggctctgagca

SEQ ID NO: 4310821 - DNA, 17 bp, Homo sapiens
gtggggatttctcccag

SEQ ID NO: 4310822 - DNA, 13 bp, Homo sapiens
gtggggcgggagg

SEQ ID NO: 4310823 - DNA, 18 bp, Homo sapiens
gtggggcttagaatgggg

SEQ ID NO: 4310824 - DNA, 24 bp, Homo sapiens
gtggggcttagaatggggcttcca

SEQ ID NO: 4310825 - DNA, 21 bp, Homo sapiens
gtgggggagaatggctctggc

SEQ ID NO: 4310826 - DNA, 16 bp, Homo sapiens
gtgggggtctgggagg

SEQ ID NO: 4310827 - DNA, 19 bp, Homo sapiens
gtgggggtctgggaggcag

SEQ ID NO: 4310828 - DNA, 16 bp, Homo sapiens
gtgggtcaactccaag

SEQ ID NO: 4310829 - DNA, 18 bp, Homo sapiens
gtgggtcaactccaaggc

SEQ ID NO: 4310830 - DNA, 19 bp, Homo sapiens
gtgggtcagtgtgccaccc

SEQ ID NO: 4310831 - DNA, 21 bp, Homo sapiens
gtgggtcttggattggtacca

SEQ ID NO: 4310832 - DNA, 21 bp, Homo sapiens
gtggtctgcaccccacaggat

SEQ ID NO: 4310833 - DNA, 23 bp, Homo sapiens
gtggtcttcaaattgtcttttgt

SEQ ID NO: 4310834 - DNA, 19 bp, Homo sapiens
gtggtcttcaagcctggcc

SEQ ID NO: 4310835 - DNA, 18 bp, Homo sapiens
gtggtcttggagaggagg

SEQ ID NO: 4310836 - DNA, 22 bp, Homo sapiens
gtggtgaggtcctgtcctggct

SEQ ID NO: 4310837 - DNA, 13 bp, Homo sapiens
gtggttggaggcc

SEQ ID NO: 4310838 - DNA, 16 bp, Homo sapiens
gtggtttcagaaaggg

SEQ ID NO: 4310839 - DNA, 13 bp, Homo sapiens
gtgtaggaagagg

SEQ ID NO: 4310840 - DNA, 19 bp, Homo sapiens
gtgtaggaagaggccgctg

SEQ ID NO: 4310841 - DNA, 14 bp, Homo sapiens
gtgtatcagtgttt

SEQ ID NO: 4310842 - DNA, 22 bp, Homo sapiens
gtgtatgtgtttataattgtta

SEQ ID NO: 4310843 - DNA, 19 bp, Homo sapiens
gtgtatttattttcctccc

SEQ ID NO: 4310844 - DNA, 23 bp, Homo sapiens
gtgtcaaggggccctaggaacct

SEQ ID NO: 4310845 - DNA, 14 bp, Homo sapiens
gtgtcccgttgtgt

SEQ ID NO: 4310846 - DNA, 15 bp, Homo sapiens
gtgtccctgcctggc

SEQ ID NO: 4310847 - DNA, 22 bp, Homo sapiens
gtgtcgcctctcactctggcag

SEQ ID NO: 4310848 - DNA, 11 bp, Homo sapiens
gtgtctgctgt

SEQ ID NO: 4310849 - DNA, 16 bp, Homo sapiens
gtgtctggatcagtaa

SEQ ID NO: 4310850 - DNA, 20 bp, Homo sapiens
gtgtctggatcagtaaaatt

SEQ ID NO: 4310851 - DNA, 18 bp, Homo sapiens
gtgtctgtccatctgtct

SEQ ID NO: 4310852 - DNA, 20 bp, Homo sapiens
gtgtcttttaatgatactgt

SEQ ID NO: 4310853 - DNA, 17 bp, Homo sapiens
gtgtgaatgctgtacct

SEQ ID NO: 4310854 - DNA, 12 bp, Homo sapiens
gtgtgagggtgc

SEQ ID NO: 4310855 - DNA, 13 bp, Homo sapiens
gtgtgagtgtgac

SEQ ID NO: 4310856 - DNA, 23 bp, Homo sapiens
gtgtgccaccctctgcagggcag

SEQ ID NO: 4310857 - DNA, 21 bp, Homo sapiens
gtgtgctccaggcttcctgcc

SEQ ID NO: 4310858 - DNA, 12 bp, Homo sapiens
gtgtgctgaggt

SEQ ID NO: 4310859 - DNA, 15 bp, Homo sapiens
gtgtggccccttcac

SEQ ID NO: 4310860 - DNA, 15 bp, Homo sapiens
gtgtggctcccctct

SEQ ID NO: 4310861 - DNA, 14 bp, Homo sapiens
gtgtgggctcccac

SEQ ID NO: 4310862 - DNA, 17 bp, Homo sapiens
gtgtggggagggtgggc

SEQ ID NO: 4310863 - DNA, 17 bp, Homo sapiens
gtgtgggggtctgggag

SEQ ID NO: 4310864 - DNA, 13 bp, Homo sapiens
gtgtgtgtgtgca

SEQ ID NO: 4310865 - DNA, 19 bp, Homo sapiens
gtgtgttgtgctttcaaga

SEQ ID NO: 4310866 - DNA, 15 bp, Homo sapiens
gtgtgtttctgtcct

SEQ ID NO: 4310867 - DNA, 19 bp, Homo sapiens
gtgtgtttctgtcctgtaa

SEQ ID NO: 4310868 - DNA, 22 bp, Homo sapiens
gtgttcctatattccaggttta

SEQ ID NO: 4310869 - DNA, 18 bp, Homo sapiens
gtgttcgtggagccacag

SEQ ID NO: 4310870 - DNA, 17 bp, Homo sapiens
gtgttctcaatgctttt

SEQ ID NO: 4310871 - DNA, 20 bp, Homo sapiens
gtgttctggcctctggcctg

SEQ ID NO: 4310872 - DNA, 14 bp, Homo sapiens
gtgttctgttgttt

SEQ ID NO: 4310873 - DNA, 20 bp, Homo sapiens
gtgttggaggggcaggcctt

SEQ ID NO: 4310874 - DNA, 18 bp, Homo sapiens
gtgtttaattgtataaaa

SEQ ID NO: 4310875 - DNA, 18 bp, Homo sapiens
gtgtttatgtgctattaa

SEQ ID NO: 4310876 - DNA, 23 bp, Homo sapiens
gtgtttcaggtggaacaggagga

SEQ ID NO: 4310877 - DNA, 13 bp, Homo sapiens
gtgtttctgtcct

SEQ ID NO: 4310878 - DNA, 21 bp, Homo sapiens
gtgtttctgtcctgtaactgt

SEQ ID NO: 4310879 - DNA, 14 bp, Homo sapiens
gtgttttattcact

SEQ ID NO: 4310880 - DNA, 20 bp, Homo sapiens
gttaaaggaagtttgttcac

SEQ ID NO: 4310881 - DNA, 16 bp, Homo sapiens
gttaataggaggacag

SEQ ID NO: 4310882 - DNA, 17 bp, Homo sapiens
gttaattgatagaataa

SEQ ID NO: 4310883 - DNA, 19 bp, Homo sapiens
gttaattggttaatcactt

SEQ ID NO: 4310884 - DNA, 20 bp, Homo sapiens
gttacccagtaactcatctg

SEQ ID NO: 4310885 - DNA, 22 bp, Homo sapiens
gttactgcctaggagttaatga

SEQ ID NO: 4310886 - DNA, 14 bp, Homo sapiens
gttagacaagcctg

SEQ ID NO: 4310887 - DNA, 15 bp, Homo sapiens
gttagacaagcctgg

SEQ ID NO: 4310888 - DNA, 16 bp, Homo sapiens
gttagacaagcctgga

SEQ ID NO: 4310889 - DNA, 18 bp, Homo sapiens
gttagacaagcctggagg

SEQ ID NO: 4310890 - DNA, 11 bp, Homo sapiens
gttagatgttt

SEQ ID NO: 4310891 - DNA, 12 bp, Homo sapiens
gttagatgtttg

SEQ ID NO: 4310892 - DNA, 22 bp, Homo sapiens
gttaggattaggtttagaatca

SEQ ID NO: 4310893 - DNA, 15 bp, Homo sapiens
gttagggcatttttc

SEQ ID NO: 4310894 - DNA, 16 bp, Homo sapiens
gttagggcatttttct

SEQ ID NO: 4310895 - DNA, 21 bp, Homo sapiens
gttaggggtgggggagaatgg

SEQ ID NO: 4310896 - DNA, 15 bp, Homo sapiens
gttagtgatttgcta

SEQ ID NO: 4310897 - DNA, 17 bp, Homo sapiens
gttagtgatttgctatc

SEQ ID NO: 4310898 - DNA, 16 bp, Homo sapiens
gttagtgtctgtccat

SEQ ID NO: 4310899 - DNA, 12 bp, Homo sapiens
gttatattcatt

SEQ ID NO: 4310900 - DNA, 16 bp, Homo sapiens
gttatggtagaaaaat

SEQ ID NO: 4310901 - DNA, 20 bp, Homo sapiens
gttattgggcaagtgattga

SEQ ID NO: 4310902 - DNA, 18 bp, Homo sapiens
gttcaaagaacccccctc

SEQ ID NO: 4310903 - DNA, 21 bp, Homo sapiens
gttcaaagaacccccctcccc

SEQ ID NO: 4310904 - DNA, 19 bp, Homo sapiens
gttcaacttttcctttgaa

SEQ ID NO: 4310905 - DNA, 20 bp, Homo sapiens
gttccaatgtgcccagtcat

SEQ ID NO: 4310906 - DNA, 11 bp, Homo sapiens
gttccagacag

SEQ ID NO: 4310907 - DNA, 15 bp, Homo sapiens
gttccagacagagtg

SEQ ID NO: 4310908 - DNA, 19 bp, Homo sapiens
gttccagacagagtggatc

SEQ ID NO: 4310909 - DNA, 20 bp, Homo sapiens
gttccagacagggtggggct

SEQ ID NO: 4310910 - DNA, 21 bp, Homo sapiens
gttcccactggctcctccagc

SEQ ID NO: 4310911 - DNA, 13 bp, Homo sapiens
gttcccccagccc

SEQ ID NO: 4310912 - DNA, 17 bp, Homo sapiens
gttcccccagccctgtg

SEQ ID NO: 4310913 - DNA, 19 bp, Homo sapiens
gttcccccaggaccctgag

SEQ ID NO: 4310914 - DNA, 17 bp, Homo sapiens
gttcccctgttcactct

SEQ ID NO: 4310915 - DNA, 13 bp, Homo sapiens
gttcctccagcaa

SEQ ID NO: 4310916 - DNA, 19 bp, Homo sapiens
gttcctccagcaatgcctg

SEQ ID NO: 4310917 - DNA, 12 bp, Homo sapiens
gttcctgcagca

SEQ ID NO: 4310918 - DNA, 22 bp, Homo sapiens
gttcctgggatgtttaatcaag

SEQ ID NO: 4310919 - DNA, 17 bp, Homo sapiens
gttcgtggaaagggtgc

SEQ ID NO: 4310920 - DNA, 19 bp, Homo sapiens
gttcgtggagccacaggca

SEQ ID NO: 4310921 - DNA, 17 bp, Homo sapiens
gttctatttatttattg

SEQ ID NO: 4310922 - DNA, 16 bp, Homo sapiens
gttctcaatgcttttc

SEQ ID NO: 4310923 - DNA, 17 bp, Homo sapiens
gttctcaatgcttttct

SEQ ID NO: 4310924 - DNA, 20 bp, Homo sapiens
gttctcagagctccacagaa

SEQ ID NO: 4310925 - DNA, 21 bp, Homo sapiens
gttctgaaggttggaactgct

SEQ ID NO: 4310926 - DNA, 20 bp, Homo sapiens
gttctggcctctggcctggg

SEQ ID NO: 4310927 - DNA, 14 bp, Homo sapiens
gttctggggcccct

SEQ ID NO: 4310928 - DNA, 19 bp, Homo sapiens
gttctggggctgagagtgg

SEQ ID NO: 4310929 - DNA, 16 bp, Homo sapiens
gttcttcctcttacct

SEQ ID NO: 4310930 - DNA, 15 bp, Homo sapiens
gttcttcctgtaatc

SEQ ID NO: 4310931 - DNA, 21 bp, Homo sapiens
gttcttctgttctgcagacac

SEQ ID NO: 4310932 - DNA, 13 bp, Homo sapiens
gttgatgaccaat

SEQ ID NO: 4310933 - DNA, 14 bp, Homo sapiens
gttgatgaccaatc

SEQ ID NO: 4310934 - DNA, 20 bp, Homo sapiens
gttgcattaaaaatgcatat

SEQ ID NO: 4310935 - DNA, 13 bp, Homo sapiens
gttgcctctctgc

SEQ ID NO: 4310936 - DNA, 16 bp, Homo sapiens
gttggaactgctgcca

SEQ ID NO: 4310937 - DNA, 18 bp, Homo sapiens
gttggagccactctgttc

SEQ ID NO: 4310938 - DNA, 19 bp, Homo sapiens
gttggagccactctgttcc

SEQ ID NO: 4310939 - DNA, 12 bp, Homo sapiens
gttggaggggca

SEQ ID NO: 4310940 - DNA, 15 bp, Homo sapiens
gttggaggggcaggc

SEQ ID NO: 4310941 - DNA, 18 bp, Homo sapiens
gttggaggggcaggcctt

SEQ ID NO: 4310942 - DNA, 19 bp, Homo sapiens
gttggccagagggcccctc

SEQ ID NO: 4310943 - DNA, 14 bp, Homo sapiens
gttggctgggccca

SEQ ID NO: 4310944 - DNA, 17 bp, Homo sapiens
gttggctgggcccagaa

SEQ ID NO: 4310945 - DNA, 14 bp, Homo sapiens
gttgggttccagac

SEQ ID NO: 4310946 - DNA, 15 bp, Homo sapiens
gttgtaggactaaat

SEQ ID NO: 4310947 - DNA, 23 bp, Homo sapiens
gttgtcaaaactccactcagcac

SEQ ID NO: 4310948 - DNA, 13 bp, Homo sapiens
gttgtgctgcctg

SEQ ID NO: 4310949 - DNA, 14 bp, Homo sapiens
gttgttatattcat

SEQ ID NO: 4310950 - DNA, 18 bp, Homo sapiens
gttgttatattcattctt

SEQ ID NO: 4310951 - DNA, 21 bp, Homo sapiens
gttgttcagaagttgttagtg

SEQ ID NO: 4310952 - DNA, 22 bp, Homo sapiens
gtttaacggcactgtggccttg

SEQ ID NO: 4310953 - DNA, 16 bp, Homo sapiens
gtttaatcaagagaga

SEQ ID NO: 4310954 - DNA, 15 bp, Homo sapiens
gtttaattgtttgtc

SEQ ID NO: 4310955 - DNA, 13 bp, Homo sapiens
gtttacagtgaag

SEQ ID NO: 4310956 - DNA, 22 bp, Homo sapiens
gtttacatagtctgaagtgaag

SEQ ID NO: 4310957 - DNA, 14 bp, Homo sapiens
gtttaccctccctg

SEQ ID NO: 4310958 - DNA, 15 bp, Homo sapiens
gtttaccctccctgt

SEQ ID NO: 4310959 - DNA, 13 bp, Homo sapiens
gtttacctcactg

SEQ ID NO: 4310960 - DNA, 21 bp, Homo sapiens
gtttacctcactggtgcattt

SEQ ID NO: 4310961 - DNA, 13 bp, Homo sapiens
gtttactctgtgc

SEQ ID NO: 4310962 - DNA, 21 bp, Homo sapiens
gtttataattgttatacattt

SEQ ID NO: 4310963 - DNA, 17 bp, Homo sapiens
gtttatttttctgttac

SEQ ID NO: 4310964 - DNA, 23 bp, Homo sapiens
gtttcagaaagggcagcccctcc

SEQ ID NO: 4310965 - DNA, 14 bp, Homo sapiens
gtttcagctgacca

SEQ ID NO: 4310966 - DNA, 17 bp, Homo sapiens
gtttcatattctcagat

SEQ ID NO: 4310967 - DNA, 21 bp, Homo sapiens
gtttccaagcctgggccactg

SEQ ID NO: 4310968 - DNA, 15 bp, Homo sapiens
gtttccacacaggcc

SEQ ID NO: 4310969 - DNA, 16 bp, Homo sapiens
gtttccacacaggccc

SEQ ID NO: 4310970 - DNA, 19 bp, Homo sapiens
gtttccacacaggcccatg

SEQ ID NO: 4310971 - DNA, 22 bp, Homo sapiens
gtttccagctaagcctgatgat

SEQ ID NO: 4310972 - DNA, 20 bp, Homo sapiens
gtttccaggcatgaccctgg

SEQ ID NO: 4310973 - DNA, 22 bp, Homo sapiens
gtttctatactgtttgtaatat

SEQ ID NO: 4310974 - DNA, 13 bp, Homo sapiens
gtttctgtctgta

SEQ ID NO: 4310975 - DNA, 24 bp, Homo sapiens
gtttgaattacagggaagaaatca

SEQ ID NO: 4310976 - DNA, 13 bp, Homo sapiens
gtttgcctctgca

SEQ ID NO: 4310977 - DNA, 21 bp, Homo sapiens
gtttgcctttaggcaggaagt

SEQ ID NO: 4310978 - DNA, 16 bp, Homo sapiens
gtttggcgggccaagg

SEQ ID NO: 4310979 - DNA, 18 bp, Homo sapiens
gtttggggcgaggcagag

SEQ ID NO: 4310980 - DNA, 15 bp, Homo sapiens
gtttggtggccaggc

SEQ ID NO: 4310981 - DNA, 23 bp, Homo sapiens
gtttgtaatatacagtttttgta

SEQ ID NO: 4310982 - DNA, 16 bp, Homo sapiens
gtttgtatataaatgg

SEQ ID NO: 4310983 - DNA, 21 bp, Homo sapiens
gtttgttgagctggtaacatc

SEQ ID NO: 4310984 - DNA, 22 bp, Homo sapiens
gtttgttgagctggtaacatcg

SEQ ID NO: 4310985 - DNA, 19 bp, Homo sapiens
gttttatgtcatactctgt

SEQ ID NO: 4310986 - DNA, 20 bp, Homo sapiens
gttttattgagttctgaagg

SEQ ID NO: 4310987 - DNA, 17 bp, Homo sapiens
gttttcagaaagatgaa

SEQ ID NO: 4310988 - DNA, 22 bp, Homo sapiens
gttttcagacctttgtctgaag

SEQ ID NO: 4310989 - DNA, 23 bp, Homo sapiens
gttttcagattgtaaaggtaggt

SEQ ID NO: 4310990 - DNA, 20 bp, Homo sapiens
gttttccccaattatcctcc

SEQ ID NO: 4310991 - DNA, 18 bp, Homo sapiens
gttttcgaagctcagccc

SEQ ID NO: 4310992 - DNA, 20 bp, Homo sapiens
gttttcgaagctcagcccac

SEQ ID NO: 4310993 - DNA, 16 bp, Homo sapiens
gttttctaaatgtttc

SEQ ID NO: 4310994 - DNA, 11 bp, Homo sapiens
gttttcttttt

SEQ ID NO: 4310995 - DNA, 19 bp, Homo sapiens
gtttttctgttccctgctg

SEQ ID NO: 4310996 - DNA, 21 bp, Homo sapiens
gtttttgaagaagggaaattc

SEQ ID NO: 4310997 - DNA, 14 bp, Homo sapiens
gttttttcctgagc

SEQ ID NO: 4310998 - DNA, 13 bp, Homo sapiens
taaaaaaataaca

SEQ ID NO: 4310999 - DNA, 15 bp, Homo sapiens
taaaaaaataacatc

SEQ ID NO: 4311000 - DNA, 18 bp, Homo sapiens
taaaaaataacatattct

SEQ ID NO: 4311001 - DNA, 22 bp, Homo sapiens
taaaaacctcttagcttttctg

SEQ ID NO: 4311002 - DNA, 19 bp, Homo sapiens
taaaaagtcagatgtttga

SEQ ID NO: 4311003 - DNA, 18 bp, Homo sapiens
taaaacatgactcctaca

SEQ ID NO: 4311004 - DNA, 23 bp, Homo sapiens
taaaagagaccacccatatcatg

SEQ ID NO: 4311005 - DNA, 15 bp, Homo sapiens
taaaaggaggacagg

SEQ ID NO: 4311006 - DNA, 20 bp, Homo sapiens
taaaaggaggacagggaggg

SEQ ID NO: 4311007 - DNA, 18 bp, Homo sapiens
taaaagtgtccattgaaa

SEQ ID NO: 4311008 - DNA, 15 bp, Homo sapiens
taaaataatgattta

SEQ ID NO: 4311009 - DNA, 13 bp, Homo sapiens
taaaatacttctt

SEQ ID NO: 4311010 - DNA, 17 bp, Homo sapiens
taaaatggacttttgtt

SEQ ID NO: 4311011 - DNA, 20 bp, Homo sapiens
taaaatgtattatgtcctgt

SEQ ID NO: 4311012 - DNA, 14 bp, Homo sapiens
taaaattacagaag

SEQ ID NO: 4311013 - DNA, 20 bp, Homo sapiens
taaaattagtgagatttgta

SEQ ID NO: 4311014 - DNA, 20 bp, Homo sapiens
taaaattctagtctctgatt

SEQ ID NO: 4311015 - DNA, 21 bp, Homo sapiens
taaaattctagtctctgattt

SEQ ID NO: 4311016 - DNA, 23 bp, Homo sapiens
taaaattgagttcttcctgtaat

SEQ ID NO: 4311017 - DNA, 17 bp, Homo sapiens
taaacaaattccttccc

SEQ ID NO: 4311018 - DNA, 14 bp, Homo sapiens
taaacattaaaaga

SEQ ID NO: 4311019 - DNA, 21 bp, Homo sapiens
taaacattaaaagaagactgg

SEQ ID NO: 4311020 - DNA, 14 bp, Homo sapiens
taaaccttaatatt

SEQ ID NO: 4311021 - DNA, 13 bp, Homo sapiens
taaactcagtcaa

SEQ ID NO: 4311022 - DNA, 16 bp, Homo sapiens
taaactctgaaatcag

SEQ ID NO: 4311023 - DNA, 12 bp, Homo sapiens
taaactgttttc

SEQ ID NO: 4311024 - DNA, 14 bp, Homo sapiens
taaactgttttcat

SEQ ID NO: 4311025 - DNA, 22 bp, Homo sapiens
taaacttttaccacttgctgca

SEQ ID NO: 4311026 - DNA, 15 bp, Homo sapiens
taaagaaaggcagag

SEQ ID NO: 4311027 - DNA, 18 bp, Homo sapiens
taaagacatttaaaatag

SEQ ID NO: 4311028 - DNA, 23 bp, Homo sapiens
taaagaccatttagtcctcacct

SEQ ID NO: 4311029 - DNA, 23 bp, Homo sapiens
taaagaggcgtcttgtattttct

SEQ ID NO: 4311030 - DNA, 19 bp, Homo sapiens
taaagcaagctcacttgct

SEQ ID NO: 4311031 - DNA, 20 bp, Homo sapiens
taaaggaaacacgtttagaa

SEQ ID NO: 4311032 - DNA, 21 bp, Homo sapiens
taaaggggacagatcttgagc

SEQ ID NO: 4311033 - DNA, 15 bp, Homo sapiens
taaaggtttattttt

SEQ ID NO: 4311034 - DNA, 19 bp, Homo sapiens
taaagtaaatgctacctct

SEQ ID NO: 4311035 - DNA, 15 bp, Homo sapiens
taaagtgaccaggct

SEQ ID NO: 4311036 - DNA, 22 bp, Homo sapiens
taaagttagggcatttttcttg

SEQ ID NO: 4311037 - DNA, 23 bp, Homo sapiens
taaagttagggcatttttcttgg

SEQ ID NO: 4311038 - DNA, 20 bp, Homo sapiens
taaagttccatgaagacaaa

SEQ ID NO: 4311039 - DNA, 16 bp, Homo sapiens
taaataaaaatattct

SEQ ID NO: 4311040 - DNA, 17 bp, Homo sapiens
taaataatgatcttcca

SEQ ID NO: 4311041 - DNA, 20 bp, Homo sapiens
taaataatgatcttccaaat

SEQ ID NO: 4311042 - DNA, 16 bp, Homo sapiens
taaatactaaatatga

SEQ ID NO: 4311043 - DNA, 20 bp, Homo sapiens
taaatatatatttatcatat

SEQ ID NO: 4311044 - DNA, 13 bp, Homo sapiens
taaatcagaatct

SEQ ID NO: 4311045 - DNA, 15 bp, Homo sapiens
taaatcagaatcttt

SEQ ID NO: 4311046 - DNA, 19 bp, Homo sapiens
taaatccattttctaaact

SEQ ID NO: 4311047 - DNA, 22 bp, Homo sapiens
taaatcgcattaatgaaatacc

SEQ ID NO: 4311048 - DNA, 13 bp, Homo sapiens
taaatctaacatt

SEQ ID NO: 4311049 - DNA, 19 bp, Homo sapiens
taaatctgtctgattctat

SEQ ID NO: 4311050 - DNA, 21 bp, Homo sapiens
taaatctgtctgattctatgc

SEQ ID NO: 4311051 - DNA, 12 bp, Homo sapiens
taaatgaagaaa

SEQ ID NO: 4311052 - DNA, 13 bp, Homo sapiens
taaatgagcattt

SEQ ID NO: 4311053 - DNA, 15 bp, Homo sapiens
taaatgagcattttt

SEQ ID NO: 4311054 - DNA, 15 bp, Homo sapiens
taaatgattccaaat

SEQ ID NO: 4311055 - DNA, 18 bp, Homo sapiens
taaatgattccaaataaa

SEQ ID NO: 4311056 - DNA, 20 bp, Homo sapiens
taaatgatttaaatttaagt

SEQ ID NO: 4311057 - DNA, 14 bp, Homo sapiens
taaatgcctaataa

SEQ ID NO: 4311058 - DNA, 22 bp, Homo sapiens
taaatgctgtatgtcattaaag

SEQ ID NO: 4311059 - DNA, 21 bp, Homo sapiens
taaatggtgagaattaaaata

SEQ ID NO: 4311060 - DNA, 15 bp, Homo sapiens
taaatgtccattctt

SEQ ID NO: 4311061 - DNA, 13 bp, Homo sapiens
taaatgtgtgtat

SEQ ID NO: 4311062 - DNA, 14 bp, Homo sapiens
taaatgtttctttt

SEQ ID NO: 4311063 - DNA, 17 bp, Homo sapiens
taaatgtttctttttct

SEQ ID NO: 4311064 - DNA, 17 bp, Homo sapiens
taaattactatagcaaa

SEQ ID NO: 4311065 - DNA, 20 bp, Homo sapiens
taaattactatagcaaagta

SEQ ID NO: 4311066 - DNA, 23 bp, Homo sapiens
taaattactatagcaaagtagta

SEQ ID NO: 4311067 - DNA, 15 bp, Homo sapiens
taaattatttctaaa

SEQ ID NO: 4311068 - DNA, 15 bp, Homo sapiens
taaattcaaacctaa

SEQ ID NO: 4311069 - DNA, 17 bp, Homo sapiens
taaattggtgataagtg

SEQ ID NO: 4311070 - DNA, 21 bp, Homo sapiens
taaattggtgataagtggaaa

SEQ ID NO: 4311071 - DNA, 22 bp, Homo sapiens
taaattggtgataagtggaaaa

SEQ ID NO: 4311072 - DNA, 18 bp, Homo sapiens
taaatttaactgcatata

SEQ ID NO: 4311073 - DNA, 20 bp, Homo sapiens
taaattttaatgtaaaattc

SEQ ID NO: 4311074 - DNA, 18 bp, Homo sapiens
taacaagccaaacattct

SEQ ID NO: 4311075 - DNA, 21 bp, Homo sapiens
taacaagccaaacattcttat

SEQ ID NO: 4311076 - DNA, 17 bp, Homo sapiens
taacaatgcctattgta

SEQ ID NO: 4311077 - DNA, 21 bp, Homo sapiens
taacaatgcctattgtaatat

SEQ ID NO: 4311078 - DNA, 20 bp, Homo sapiens
taacaattaattgtcttgca

SEQ ID NO: 4311079 - DNA, 13 bp, Homo sapiens
taacactggcccc

SEQ ID NO: 4311080 - DNA, 16 bp, Homo sapiens
taacatagatgcctgg

SEQ ID NO: 4311081 - DNA, 17 bp, Homo sapiens
taacatagatgcctggg

SEQ ID NO: 4311082 - DNA, 19 bp, Homo sapiens
taacatagatgcctgggcc

SEQ ID NO: 4311083 - DNA, 22 bp, Homo sapiens
taacatagatgcctgggcctga

SEQ ID NO: 4311084 - DNA, 15 bp, Homo sapiens
taacatattcttgct

SEQ ID NO: 4311085 - DNA, 19 bp, Homo sapiens
taacatattcttgctttca

SEQ ID NO: 4311086 - DNA, 13 bp, Homo sapiens
taacatctgaaaa

SEQ ID NO: 4311087 - DNA, 14 bp, Homo sapiens
taacatctgaaaag

SEQ ID NO: 4311088 - DNA, 13 bp, Homo sapiens
taacatctgagaa

SEQ ID NO: 4311089 - DNA, 15 bp, Homo sapiens
taacattctatttca

SEQ ID NO: 4311090 - DNA, 15 bp, Homo sapiens
taaccaaattaacct

SEQ ID NO: 4311091 - DNA, 21 bp, Homo sapiens
taaccatatgattgaaaagaa

SEQ ID NO: 4311092 - DNA, 17 bp, Homo sapiens
taaccttatcataaatt

SEQ ID NO: 4311093 - DNA, 15 bp, Homo sapiens
taactagatctcctg

SEQ ID NO: 4311094 - DNA, 15 bp, Homo sapiens
taactcatctgtcac

SEQ ID NO: 4311095 - DNA, 23 bp, Homo sapiens
taactgtccgtagtatcagagat

SEQ ID NO: 4311096 - DNA, 23 bp, Homo sapiens
taactgtcctttttcttccctta

SEQ ID NO: 4311097 - DNA, 15 bp, Homo sapiens
taactgtgcactata

SEQ ID NO: 4311098 - DNA, 17 bp, Homo sapiens
taactgttacagtaatg

SEQ ID NO: 4311099 - DNA, 20 bp, Homo sapiens
taagaatgtatatcagggtt

SEQ ID NO: 4311100 - DNA, 22 bp, Homo sapiens
taagagaattctaagattgtac

SEQ ID NO: 4311101 - DNA, 21 bp, Homo sapiens
taagattccagagagtggctc

SEQ ID NO: 4311102 - DNA, 14 bp, Homo sapiens
taagattgtacata

SEQ ID NO: 4311103 - DNA, 16 bp, Homo sapiens
taagattgtacatatg

SEQ ID NO: 4311104 - DNA, 18 bp, Homo sapiens
taagattgttattaaatg

SEQ ID NO: 4311105 - DNA, 19 bp, Homo sapiens
taagattgttattaaatgt

SEQ ID NO: 4311106 - DNA, 21 bp, Homo sapiens
taagcaacatgaattaagaac

SEQ ID NO: 4311107 - DNA, 22 bp, Homo sapiens
taagcaagtatatttatttcta

SEQ ID NO: 4311108 - DNA, 13 bp, Homo sapiens
taagcaggaaggt

SEQ ID NO: 4311109 - DNA, 18 bp, Homo sapiens
taagcccacagtatattt

SEQ ID NO: 4311110 - DNA, 16 bp, Homo sapiens
taagcctcaggcctgg

SEQ ID NO: 4311111 - DNA, 20 bp, Homo sapiens
taagcctcaggcctggccct

SEQ ID NO: 4311112 - DNA, 21 bp, Homo sapiens
taagcctcaggcctggccctt

SEQ ID NO: 4311113 - DNA, 11 bp, Homo sapiens
taagcctggac

SEQ ID NO: 4311114 - DNA, 21 bp, Homo sapiens
taagcctggacacagtcaggg

SEQ ID NO: 4311115 - DNA, 21 bp, Homo sapiens
taaggaatgatattgctgaag

SEQ ID NO: 4311116 - DNA, 23 bp, Homo sapiens
taagggagtaggctgtattttct

SEQ ID NO: 4311117 - DNA, 16 bp, Homo sapiens
taagtcaacttagcat

SEQ ID NO: 4311118 - DNA, 21 bp, Homo sapiens
taagtcagtttcacatatttg

SEQ ID NO: 4311119 - DNA, 12 bp, Homo sapiens
taagtggaaaaa

SEQ ID NO: 4311120 - DNA, 16 bp, Homo sapiens
taagtggaaaaaagag

SEQ ID NO: 4311121 - DNA, 21 bp, Homo sapiens
taagttcaccgtagtaacaca

SEQ ID NO: 4311122 - DNA, 14 bp, Homo sapiens
taagttgtcttaca

SEQ ID NO: 4311123 - DNA, 21 bp, Homo sapiens
taataaagtctgtctgcactg

SEQ ID NO: 4311124 - DNA, 15 bp, Homo sapiens
taataactagatctc

SEQ ID NO: 4311125 - DNA, 15 bp, Homo sapiens
taatagcctcacctt

SEQ ID NO: 4311126 - DNA, 14 bp, Homo sapiens
taatatactgcata

SEQ ID NO: 4311127 - DNA, 12 bp, Homo sapiens
taatatagaaaa

SEQ ID NO: 4311128 - DNA, 23 bp, Homo sapiens
taatatagaaaaaaacattctat

SEQ ID NO: 4311129 - DNA, 17 bp, Homo sapiens
taatatcactcattaat

SEQ ID NO: 4311130 - DNA, 15 bp, Homo sapiens
taatatcttgaagaa

SEQ ID NO: 4311131 - DNA, 15 bp, Homo sapiens
taatatctttcagtt

SEQ ID NO: 4311132 - DNA, 19 bp, Homo sapiens
taatatttacaatgtatta

SEQ ID NO: 4311133 - DNA, 18 bp, Homo sapiens
taatatttcttcaaatat

SEQ ID NO: 4311134 - DNA, 23 bp, Homo sapiens
taatcatttatcttatctagcaa

SEQ ID NO: 4311135 - DNA, 12 bp, Homo sapiens
taatcatttctt

SEQ ID NO: 4311136 - DNA, 16 bp, Homo sapiens
taatccatgtgctgct

SEQ ID NO: 4311137 - DNA, 20 bp, Homo sapiens
taatctctaaaattctagtc

SEQ ID NO: 4311138 - DNA, 18 bp, Homo sapiens
taatctgtataatacttt

SEQ ID NO: 4311139 - DNA, 17 bp, Homo sapiens
taatcttgttgataaaa

SEQ ID NO: 4311140 - DNA, 14 bp, Homo sapiens
taatcttttctgag

SEQ ID NO: 4311141 - DNA, 16 bp, Homo sapiens
taatgacgtattgtga

SEQ ID NO: 4311142 - DNA, 19 bp, Homo sapiens
taatgatactgtctaagaa

SEQ ID NO: 4311143 - DNA, 22 bp, Homo sapiens
taatgatactgtctaagaataa

SEQ ID NO: 4311144 - DNA, 24 bp, Homo sapiens
taatgatactgtctaagaataatg

SEQ ID NO: 4311145 - DNA, 15 bp, Homo sapiens
taatgatcttccaaa

SEQ ID NO: 4311146 - DNA, 16 bp, Homo sapiens
taatgatcttccaaat

SEQ ID NO: 4311147 - DNA, 18 bp, Homo sapiens
taatggtgccttcatttg

SEQ ID NO: 4311148 - DNA, 17 bp, Homo sapiens
taatgtaaaattcatag

SEQ ID NO: 4311149 - DNA, 14 bp, Homo sapiens
taatgtgaaatgta

SEQ ID NO: 4311150 - DNA, 19 bp, Homo sapiens
taatgtgaaatgtaactgt

SEQ ID NO: 4311151 - DNA, 16 bp, Homo sapiens
taatgtgtcaaagaga

SEQ ID NO: 4311152 - DNA, 21 bp, Homo sapiens
taatgtgtcaaagagatgagg

SEQ ID NO: 4311153 - DNA, 20 bp, Homo sapiens
taatgttctgaataatttct

SEQ ID NO: 4311154 - DNA, 22 bp, Homo sapiens
taatgttctgaataatttctta

SEQ ID NO: 4311155 - DNA, 14 bp, Homo sapiens
taattaatttcagt

SEQ ID NO: 4311156 - DNA, 11 bp, Homo sapiens
taattatgttt

SEQ ID NO: 4311157 - DNA, 23 bp, Homo sapiens
taattctcttttcaaacacacac

SEQ ID NO: 4311158 - DNA, 21 bp, Homo sapiens
taattgtaggtcaatgaaata

SEQ ID NO: 4311159 - DNA, 15 bp, Homo sapiens
taattgtataaaaca

SEQ ID NO: 4311160 - DNA, 17 bp, Homo sapiens
taattgtggctttatga

SEQ ID NO: 4311161 - DNA, 12 bp, Homo sapiens
taattgttatac

SEQ ID NO: 4311162 - DNA, 15 bp, Homo sapiens
taattgttatacatt

SEQ ID NO: 4311163 - DNA, 21 bp, Homo sapiens
taatttagatattcatacttt

SEQ ID NO: 4311164 - DNA, 11 bp, Homo sapiens
taatttttcct

SEQ ID NO: 4311165 - DNA, 21 bp, Homo sapiens
tacaaggccccaaggtttaca

SEQ ID NO: 4311166 - DNA, 16 bp, Homo sapiens
tacaagttatagtact

SEQ ID NO: 4311167 - DNA, 20 bp, Homo sapiens
tacaatatcattttcctggg

SEQ ID NO: 4311168 - DNA, 14 bp, Homo sapiens
tacaatggccagcc

SEQ ID NO: 4311169 - DNA, 22 bp, Homo sapiens
tacaatggctgggtttgggcag

SEQ ID NO: 4311170 - DNA, 19 bp, Homo sapiens
tacaattaaagctgttatt

SEQ ID NO: 4311171 - DNA, 13 bp, Homo sapiens
tacacccaatttt

SEQ ID NO: 4311172 - DNA, 14 bp, Homo sapiens
tacacctatgtcat

SEQ ID NO: 4311173 - DNA, 21 bp, Homo sapiens
tacacctatgtcatttcattt

SEQ ID NO: 4311174 - DNA, 13 bp, Homo sapiens
tacactgtatcta

SEQ ID NO: 4311175 - DNA, 12 bp, Homo sapiens
tacactgtgaac

SEQ ID NO: 4311176 - DNA, 16 bp, Homo sapiens
tacagatttagtttac

SEQ ID NO: 4311177 - DNA, 15 bp, Homo sapiens
tacagctgagctatg

SEQ ID NO: 4311178 - DNA, 15 bp, Homo sapiens
tacagggaagaaatc

SEQ ID NO: 4311179 - DNA, 13 bp, Homo sapiens
tacaggtgtacta

SEQ ID NO: 4311180 - DNA, 14 bp, Homo sapiens
tacagtaagctgct

SEQ ID NO: 4311181 - DNA, 14 bp, Homo sapiens
tacataattaaatt

SEQ ID NO: 4311182 - DNA, 15 bp, Homo sapiens
tacataattaaattt

SEQ ID NO: 4311183 - DNA, 14 bp, Homo sapiens
tacatacctctctc

SEQ ID NO: 4311184 - DNA, 19 bp, Homo sapiens
tacatacctctctctatat

SEQ ID NO: 4311185 - DNA, 14 bp, Homo sapiens
tacatagtctttgt

SEQ ID NO: 4311186 - DNA, 19 bp, Homo sapiens
tacatatggaaatcctgtt

SEQ ID NO: 4311187 - DNA, 16 bp, Homo sapiens
tacatcacgttaaagt

SEQ ID NO: 4311188 - DNA, 13 bp, Homo sapiens
tacatgagttcaa

SEQ ID NO: 4311189 - DNA, 16 bp, Homo sapiens
tacatgagttcaaata

SEQ ID NO: 4311190 - DNA, 15 bp, Homo sapiens
tacatgatgatttca

SEQ ID NO: 4311191 - DNA, 14 bp, Homo sapiens
tacatgattcattt

SEQ ID NO: 4311192 - DNA, 14 bp, Homo sapiens
tacatggtagcagg

SEQ ID NO: 4311193 - DNA, 15 bp, Homo sapiens
tacatggtttaaagt

SEQ ID NO: 4311194 - DNA, 21 bp, Homo sapiens
tacattcttcaagatcccatt

SEQ ID NO: 4311195 - DNA, 22 bp, Homo sapiens
tacattgccgtggcatcttaaa

SEQ ID NO: 4311196 - DNA, 13 bp, Homo sapiens
taccaaaatgaag

SEQ ID NO: 4311197 - DNA, 21 bp, Homo sapiens
taccaatgctcttttcacagc

SEQ ID NO: 4311198 - DNA, 21 bp, Homo sapiens
taccacaccgaggagtccagt

SEQ ID NO: 4311199 - DNA, 18 bp, Homo sapiens
taccaggggttccccagg

SEQ ID NO: 4311200 - DNA, 20 bp, Homo sapiens
taccaggggttccccaggag

SEQ ID NO: 4311201 - DNA, 21 bp, Homo sapiens
taccattatggctttgtgctt

SEQ ID NO: 4311202 - DNA, 14 bp, Homo sapiens
taccattttgcgat

SEQ ID NO: 4311203 - DNA, 20 bp, Homo sapiens
taccattttgcgatgtgttt

SEQ ID NO: 4311204 - DNA, 22 bp, Homo sapiens
taccattttgcgatgtgtttta

SEQ ID NO: 4311205 - DNA, 19 bp, Homo sapiens
taccccaggacgcatgcag

SEQ ID NO: 4311206 - DNA, 16 bp, Homo sapiens
taccccctgccccaga

SEQ ID NO: 4311207 - DNA, 15 bp, Homo sapiens
taccccgtccctttc

SEQ ID NO: 4311208 - DNA, 18 bp, Homo sapiens
taccccgtccctttccct

SEQ ID NO: 4311209 - DNA, 23 bp, Homo sapiens
tacccctttggcacaccctctct

SEQ ID NO: 4311210 - DNA, 20 bp, Homo sapiens
tacccgcccgcgtccaaccc

SEQ ID NO: 4311211 - DNA, 18 bp, Homo sapiens
taccctaggtctccaccc

SEQ ID NO: 4311212 - DNA, 20 bp, Homo sapiens
taccctaggtctccacccct

SEQ ID NO: 4311213 - DNA, 22 bp, Homo sapiens
taccctaggtctccacccctca

SEQ ID NO: 4311214 - DNA, 23 bp, Homo sapiens
taccctaggtctccacccctcaa

SEQ ID NO: 4311215 - DNA, 13 bp, Homo sapiens
taccctccctgtc

SEQ ID NO: 4311216 - DNA, 17 bp, Homo sapiens
taccctccctgtcccct

SEQ ID NO: 4311217 - DNA, 19 bp, Homo sapiens
taccctccctgtcccctga

SEQ ID NO: 4311218 - DNA, 18 bp, Homo sapiens
taccgaggagctaaacat

SEQ ID NO: 4311219 - DNA, 20 bp, Homo sapiens
tacctgcccccactcagcat

SEQ ID NO: 4311220 - DNA, 21 bp, Homo sapiens
tacctggaatcaaataaaaat

SEQ ID NO: 4311221 - DNA, 23 bp, Homo sapiens
tacctgtaatagcctcaccttcc

SEQ ID NO: 4311222 - DNA, 23 bp, Homo sapiens
tacctgtattgtctgacttctca

SEQ ID NO: 4311223 - DNA, 14 bp, Homo sapiens
tacgctctctgtct

SEQ ID NO: 4311224 - DNA, 16 bp, Homo sapiens
tacggtgagactctga

SEQ ID NO: 4311225 - DNA, 24 bp, Homo sapiens
tacggttccctgcctaggagctgg

SEQ ID NO: 4311226 - DNA, 16 bp, Homo sapiens
tacgtgtcaatgtgtg

SEQ ID NO: 4311227 - DNA, 17 bp, Homo sapiens
tacgtgtcaatgtgtgc

SEQ ID NO: 4311228 - DNA, 15 bp, Homo sapiens
tacgttaattaaaca

SEQ ID NO: 4311229 - DNA, 12 bp, Homo sapiens
tactaaatatga

SEQ ID NO: 4311230 - DNA, 14 bp, Homo sapiens
tactaacactggct

SEQ ID NO: 4311231 - DNA, 22 bp, Homo sapiens
tactaagaataaataaagaaga

SEQ ID NO: 4311232 - DNA, 13 bp, Homo sapiens
tactacatgcact

SEQ ID NO: 4311233 - DNA, 16 bp, Homo sapiens
tactatagcaaagtag

SEQ ID NO: 4311234 - DNA, 16 bp, Homo sapiens
tactatggctgtattt

SEQ ID NO: 4311235 - DNA, 17 bp, Homo sapiens
tactcaaactccattct

SEQ ID NO: 4311236 - DNA, 15 bp, Homo sapiens
tactcattagaatta

SEQ ID NO: 4311237 - DNA, 12 bp, Homo sapiens
tactcctcccag

SEQ ID NO: 4311238 - DNA, 15 bp, Homo sapiens
tactctgtgctaagt

SEQ ID NO: 4311239 - DNA, 18 bp, Homo sapiens
tactgaaggtgccagacg

SEQ ID NO: 4311240 - DNA, 19 bp, Homo sapiens
tactgcccggggcagctgc

SEQ ID NO: 4311241 - DNA, 21 bp, Homo sapiens
tactgcctaggagttaatgat

SEQ ID NO: 4311242 - DNA, 15 bp, Homo sapiens
tactggatctcttaa

SEQ ID NO: 4311243 - DNA, 19 bp, Homo sapiens
tactggttggtgttcttcc

SEQ ID NO: 4311244 - DNA, 15 bp, Homo sapiens
tactgtcagagaata

SEQ ID NO: 4311245 - DNA, 17 bp, Homo sapiens
tactgtctgtaagagaa

SEQ ID NO: 4311246 - DNA, 12 bp, Homo sapiens
tactgtttgtaa

SEQ ID NO: 4311247 - DNA, 21 bp, Homo sapiens
tacttaaaaatatgtgagcat

SEQ ID NO: 4311248 - DNA, 21 bp, Homo sapiens
tacttaaatagcatctgctct

SEQ ID NO: 4311249 - DNA, 21 bp, Homo sapiens
tacttccaaagagtcatcatg

SEQ ID NO: 4311250 - DNA, 14 bp, Homo sapiens
tacttcctggattt

SEQ ID NO: 4311251 - DNA, 16 bp, Homo sapiens
tacttctttttcatta

SEQ ID NO: 4311252 - DNA, 14 bp, Homo sapiens
tacttgaatagtat

SEQ ID NO: 4311253 - DNA, 16 bp, Homo sapiens
tacttgccctgaccat

SEQ ID NO: 4311254 - DNA, 16 bp, Homo sapiens
tactttacctctctgt

SEQ ID NO: 4311255 - DNA, 24 bp, Homo sapiens
tactttggaatgactataaacatt

SEQ ID NO: 4311256 - DNA, 18 bp, Homo sapiens
tactttggtttctgtctg

SEQ ID NO: 4311257 - DNA, 18 bp, Homo sapiens
tacttttgtgtattctgt

SEQ ID NO: 4311258 - DNA, 21 bp, Homo sapiens
tagaaccagtcttttgaaaga

SEQ ID NO: 4311259 - DNA, 21 bp, Homo sapiens
tagaactgtcccacaaaatat

SEQ ID NO: 4311260 - DNA, 21 bp, Homo sapiens
tagaactgttcatttccacca

SEQ ID NO: 4311261 - DNA, 15 bp, Homo sapiens
tagaatcaagtctgt

SEQ ID NO: 4311262 - DNA, 17 bp, Homo sapiens
tagaatcaagtctgtga

SEQ ID NO: 4311263 - DNA, 18 bp, Homo sapiens
tagaatcaagtctgtgaa

SEQ ID NO: 4311264 - DNA, 16 bp, Homo sapiens
tagaatgtttcatttg

SEQ ID NO: 4311265 - DNA, 14 bp, Homo sapiens
tagacaagcctgga

SEQ ID NO: 4311266 - DNA, 15 bp, Homo sapiens
tagacaagcctggag

SEQ ID NO: 4311267 - DNA, 16 bp, Homo sapiens
tagacaagcctggagg

SEQ ID NO: 4311268 - DNA, 20 bp, Homo sapiens
tagacatccccctccttgcc

SEQ ID NO: 4311269 - DNA, 18 bp, Homo sapiens
tagactccttctccccaa

SEQ ID NO: 4311270 - DNA, 13 bp, Homo sapiens
tagactgaattta

SEQ ID NO: 4311271 - DNA, 17 bp, Homo sapiens
tagactgggctggctgc

SEQ ID NO: 4311272 - DNA, 13 bp, Homo sapiens
tagagaaggaccc

SEQ ID NO: 4311273 - DNA, 21 bp, Homo sapiens
tagagatattttgtaaaatgt

SEQ ID NO: 4311274 - DNA, 19 bp, Homo sapiens
tagaggcttccttcatttc

SEQ ID NO: 4311275 - DNA, 17 bp, Homo sapiens
tagagtatgcaagaaga

SEQ ID NO: 4311276 - DNA, 14 bp, Homo sapiens
tagataattatcca

SEQ ID NO: 4311277 - DNA, 13 bp, Homo sapiens
tagatataaatat

SEQ ID NO: 4311278 - DNA, 18 bp, Homo sapiens
tagatattcatactttcc

SEQ ID NO: 4311279 - DNA, 22 bp, Homo sapiens
tagatcaactcatgttaattga

SEQ ID NO: 4311280 - DNA, 13 bp, Homo sapiens
tagatgcctgggc

SEQ ID NO: 4311281 - DNA, 23 bp, Homo sapiens
tagatgctgactgtactcctccc

SEQ ID NO: 4311282 - DNA, 20 bp, Homo sapiens
tagatgggcatggggtgggc

SEQ ID NO: 4311283 - DNA, 17 bp, Homo sapiens
tagcaaagatatctcat

SEQ ID NO: 4311284 - DNA, 16 bp, Homo sapiens
tagcaagaagattcta

SEQ ID NO: 4311285 - DNA, 19 bp, Homo sapiens
tagcacaaggagtgcccgc

SEQ ID NO: 4311286 - DNA, 21 bp, Homo sapiens
tagcacagaggatggcttccc

SEQ ID NO: 4311287 - DNA, 19 bp, Homo sapiens
tagcagtttgcctctgcac

SEQ ID NO: 4311288 - DNA, 23 bp, Homo sapiens
tagcatcctgattattgaatgtt

SEQ ID NO: 4311289 - DNA, 17 bp, Homo sapiens
tagcatgacaagcccca

SEQ ID NO: 4311290 - DNA, 21 bp, Homo sapiens
tagcatgacaagccccaggca

SEQ ID NO: 4311291 - DNA, 22 bp, Homo sapiens
tagcatgtgtttggttctgggg

SEQ ID NO: 4311292 - DNA, 12 bp, Homo sapiens
tagcatgttcta

SEQ ID NO: 4311293 - DNA, 17 bp, Homo sapiens
tagcattttctgcatct

SEQ ID NO: 4311294 - DNA, 14 bp, Homo sapiens
tagccagcccacat

SEQ ID NO: 4311295 - DNA, 21 bp, Homo sapiens
tagccagcccacatccattcc

SEQ ID NO: 4311296 - DNA, 16 bp, Homo sapiens
tagccatgactagggt

SEQ ID NO: 4311297 - DNA, 16 bp, Homo sapiens
tagccatttgaagaag

SEQ ID NO: 4311298 - DNA, 17 bp, Homo sapiens
tagctagaatatcctat

SEQ ID NO: 4311299 - DNA, 14 bp, Homo sapiens
tagctattactgga

SEQ ID NO: 4311300 - DNA, 15 bp, Homo sapiens
tagctcgtgtgctta

SEQ ID NO: 4311301 - DNA, 21 bp, Homo sapiens
tagctctcgcctcaggctttt

SEQ ID NO: 4311302 - DNA, 21 bp, Homo sapiens
taggaaagcctcactgatata

SEQ ID NO: 4311303 - DNA, 12 bp, Homo sapiens
taggaacccggc

SEQ ID NO: 4311304 - DNA, 22 bp, Homo sapiens
taggaacccggcatgccgagtg

SEQ ID NO: 4311305 - DNA, 21 bp, Homo sapiens
taggactaaataatgatcttc

SEQ ID NO: 4311306 - DNA, 16 bp, Homo sapiens
taggaggacagaacca

SEQ ID NO: 4311307 - DNA, 17 bp, Homo sapiens
taggatattacaatggc

SEQ ID NO: 4311308 - DNA, 14 bp, Homo sapiens
taggcaagaggagt

SEQ ID NO: 4311309 - DNA, 23 bp, Homo sapiens
taggcagagcccgcccacctggg

SEQ ID NO: 4311310 - DNA, 17 bp, Homo sapiens
taggcaggaagtcagga

SEQ ID NO: 4311311 - DNA, 21 bp, Homo sapiens
taggcaggaagtcaggagcca

SEQ ID NO: 4311312 - DNA, 22 bp, Homo sapiens
taggcaggaagtcaggagccag

SEQ ID NO: 4311313 - DNA, 17 bp, Homo sapiens
taggcatactctccagg

SEQ ID NO: 4311314 - DNA, 12 bp, Homo sapiens
taggccagctcc

SEQ ID NO: 4311315 - DNA, 14 bp, Homo sapiens
taggccctggtctg

SEQ ID NO: 4311316 - DNA, 20 bp, Homo sapiens
taggcctggagttgggctgg

SEQ ID NO: 4311317 - DNA, 12 bp, Homo sapiens
taggctgtattt

SEQ ID NO: 4311318 - DNA, 16 bp, Homo sapiens
taggctgtattttctt

SEQ ID NO: 4311319 - DNA, 16 bp, Homo sapiens
tagggcatttttcttg

SEQ ID NO: 4311320 - DNA, 17 bp, Homo sapiens
tagggcatttttcttgg

SEQ ID NO: 4311321 - DNA, 16 bp, Homo sapiens
tagggctctaatttcc

SEQ ID NO: 4311322 - DNA, 17 bp, Homo sapiens
tagggctctaatttcct

SEQ ID NO: 4311323 - DNA, 15 bp, Homo sapiens
taggggaagtgtgct

SEQ ID NO: 4311324 - DNA, 16 bp, Homo sapiens
taggggaagtgtgctg

SEQ ID NO: 4311325 - DNA, 14 bp, Homo sapiens
taggggtgggggag

SEQ ID NO: 4311326 - DNA, 21 bp, Homo sapiens
tagggtcccccttcgtggagc

SEQ ID NO: 4311327 - DNA, 15 bp, Homo sapiens
taggtaagttggctc

SEQ ID NO: 4311328 - DNA, 12 bp, Homo sapiens
taggtgctggca

SEQ ID NO: 4311329 - DNA, 23 bp, Homo sapiens
taggtgtcttttaatgatactgt

SEQ ID NO: 4311330 - DNA, 14 bp, Homo sapiens
tagtaattgttaca

SEQ ID NO: 4311331 - DNA, 16 bp, Homo sapiens
tagtacttcttctgta

SEQ ID NO: 4311332 - DNA, 17 bp, Homo sapiens
tagtagttgatgaccaa

SEQ ID NO: 4311333 - DNA, 14 bp, Homo sapiens
tagtcctattctat

SEQ ID NO: 4311334 - DNA, 22 bp, Homo sapiens
tagtcctattctattgcagtta

SEQ ID NO: 4311335 - DNA, 13 bp, Homo sapiens
tagtcctcacctt

SEQ ID NO: 4311336 - DNA, 20 bp, Homo sapiens
tagtcctcaccttctgtttt

SEQ ID NO: 4311337 - DNA, 19 bp, Homo sapiens
tagtctctgatttgcaaat

SEQ ID NO: 4311338 - DNA, 21 bp, Homo sapiens
tagtctgaagtgaagtacaga

SEQ ID NO: 4311339 - DNA, 17 bp, Homo sapiens
tagtctttgtttacatg

SEQ ID NO: 4311340 - DNA, 20 bp, Homo sapiens
tagtgacccggaggccacat

SEQ ID NO: 4311341 - DNA, 22 bp, Homo sapiens
tagtgactaaaccattgtgcat

SEQ ID NO: 4311342 - DNA, 22 bp, Homo sapiens
tagtgatacactgtatctaaaa

SEQ ID NO: 4311343 - DNA, 14 bp, Homo sapiens
tagtgatggttccc

SEQ ID NO: 4311344 - DNA, 20 bp, Homo sapiens
tagtgtcccttacctggctt

SEQ ID NO: 4311345 - DNA, 19 bp, Homo sapiens
tagtgtctggatcagtaaa

SEQ ID NO: 4311346 - DNA, 21 bp, Homo sapiens
tagtgtctggatcagtaaaat

SEQ ID NO: 4311347 - DNA, 12 bp, Homo sapiens
tagtgtgttgtg

SEQ ID NO: 4311348 - DNA, 18 bp, Homo sapiens
tagttaattgtggcttta

SEQ ID NO: 4311349 - DNA, 15 bp, Homo sapiens
tagttctatttctat

SEQ ID NO: 4311350 - DNA, 18 bp, Homo sapiens
tagttctatttctatctg

SEQ ID NO: 4311351 - DNA, 20 bp, Homo sapiens
tagttgaacaagatttccct

SEQ ID NO: 4311352 - DNA, 23 bp, Homo sapiens
tagttgaacaagatttccctaaa

SEQ ID NO: 4311353 - DNA, 14 bp, Homo sapiens
tagttgttaagttt

SEQ ID NO: 4311354 - DNA, 17 bp, Homo sapiens
tagtttgcatttaagaa

SEQ ID NO: 4311355 - DNA, 16 bp, Homo sapiens
tagttttctaaatgtt

SEQ ID NO: 4311356 - DNA, 14 bp, Homo sapiens
tataaaacagtgtt

SEQ ID NO: 4311357 - DNA, 17 bp, Homo sapiens
tataaacattaaaagaa

SEQ ID NO: 4311358 - DNA, 23 bp, Homo sapiens
tataaacattaaaagaagactgg

SEQ ID NO: 4311359 - DNA, 15 bp, Homo sapiens
tataaaccataaaat

SEQ ID NO: 4311360 - DNA, 15 bp, Homo sapiens
tataaatgggaagaa

SEQ ID NO: 4311361 - DNA, 13 bp, Homo sapiens
tataaatggtgag

SEQ ID NO: 4311362 - DNA, 18 bp, Homo sapiens
tataaatggtgagaatta

SEQ ID NO: 4311363 - DNA, 22 bp, Homo sapiens
tataaatggtgagaattaaaat

SEQ ID NO: 4311364 - DNA, 17 bp, Homo sapiens
tataacaactctatttt

SEQ ID NO: 4311365 - DNA, 16 bp, Homo sapiens
tataactttagaaata

SEQ ID NO: 4311366 - DNA, 21 bp, Homo sapiens
tataagggagtaggctgtatt

SEQ ID NO: 4311367 - DNA, 20 bp, Homo sapiens
tataatacttaaaaatatgt

SEQ ID NO: 4311368 - DNA, 14 bp, Homo sapiens
tataatactttgta

SEQ ID NO: 4311369 - DNA, 15 bp, Homo sapiens
tataatactttgtat

SEQ ID NO: 4311370 - DNA, 22 bp, Homo sapiens
tataatactttgtatacaagta

SEQ ID NO: 4311371 - DNA, 18 bp, Homo sapiens
tataattttattgctgga

SEQ ID NO: 4311372 - DNA, 19 bp, Homo sapiens
tataattttattgctggaa

SEQ ID NO: 4311373 - DNA, 17 bp, Homo sapiens
tatacaaccttcattta

SEQ ID NO: 4311374 - DNA, 17 bp, Homo sapiens
tatacatacctctctct

SEQ ID NO: 4311375 - DNA, 18 bp, Homo sapiens
tatacatacctctctcta

SEQ ID NO: 4311376 - DNA, 16 bp, Homo sapiens
tatactcattagaatt

SEQ ID NO: 4311377 - DNA, 21 bp, Homo sapiens
tatactggttatagttgatat

SEQ ID NO: 4311378 - DNA, 24 bp, Homo sapiens
tatactggttatagttgatatgta

SEQ ID NO: 4311379 - DNA, 20 bp, Homo sapiens
tatactgtttgtaatataca

SEQ ID NO: 4311380 - DNA, 20 bp, Homo sapiens
tatagaaaaaaacattctat

SEQ ID NO: 4311381 - DNA, 15 bp, Homo sapiens
tatagttgatatgta

SEQ ID NO: 4311382 - DNA, 20 bp, Homo sapiens
tatataatacttaaaaatat

SEQ ID NO: 4311383 - DNA, 17 bp, Homo sapiens
tatatacatgtatagtg

SEQ ID NO: 4311384 - DNA, 13 bp, Homo sapiens
tatatataaatat

SEQ ID NO: 4311385 - DNA, 14 bp, Homo sapiens
tatatataatactt

SEQ ID NO: 4311386 - DNA, 16 bp, Homo sapiens
tatatatgaagtaagt

SEQ ID NO: 4311387 - DNA, 19 bp, Homo sapiens
tatatatgaataattatgt

SEQ ID NO: 4311388 - DNA, 13 bp, Homo sapiens
tatatattatata

SEQ ID NO: 4311389 - DNA, 16 bp, Homo sapiens
tatatcgttatcactg

SEQ ID NO: 4311390 - DNA, 18 bp, Homo sapiens
tatatctgaaaactggaa

SEQ ID NO: 4311391 - DNA, 13 bp, Homo sapiens
tatatctgtaaat

SEQ ID NO: 4311392 - DNA, 11 bp, Homo sapiens
tatatgtacag

SEQ ID NO: 4311393 - DNA, 14 bp, Homo sapiens
tatattataagatt

SEQ ID NO: 4311394 - DNA, 15 bp, Homo sapiens
tatattataagattt

SEQ ID NO: 4311395 - DNA, 13 bp, Homo sapiens
tatattcattctt

SEQ ID NO: 4311396 - DNA, 17 bp, Homo sapiens
tatattttatttcaatg

SEQ ID NO: 4311397 - DNA, 16 bp, Homo sapiens
tatcacctcccctcct

SEQ ID NO: 4311398 - DNA, 20 bp, Homo sapiens
tatcactaataaagtctgtc

SEQ ID NO: 4311399 - DNA, 22 bp, Homo sapiens
tatcagaatcaaatctgagcct

SEQ ID NO: 4311400 - DNA, 20 bp, Homo sapiens
tatcatcacgtatgttatac

SEQ ID NO: 4311401 - DNA, 23 bp, Homo sapiens
tatcatgcacacaattagatttc

SEQ ID NO: 4311402 - DNA, 15 bp, Homo sapiens
tatcatttcttaacc

SEQ ID NO: 4311403 - DNA, 18 bp, Homo sapiens
tatcattttcctgggagt

SEQ ID NO: 4311404 - DNA, 15 bp, Homo sapiens
tatcctgcaccctct

SEQ ID NO: 4311405 - DNA, 20 bp, Homo sapiens
tatcctgcaccctctgctat

SEQ ID NO: 4311406 - DNA, 16 bp, Homo sapiens
tatcctggtgtctagt

SEQ ID NO: 4311407 - DNA, 23 bp, Homo sapiens
tatcctgttaggggaaaatagta

SEQ ID NO: 4311408 - DNA, 18 bp, Homo sapiens
tatctaaaaaataactgt

SEQ ID NO: 4311409 - DNA, 15 bp, Homo sapiens
tatctagcaagaaga

SEQ ID NO: 4311410 - DNA, 16 bp, Homo sapiens
tatctagcaagaagat

SEQ ID NO: 4311411 - DNA, 20 bp, Homo sapiens
tatctagcaagaagattcta

SEQ ID NO: 4311412 - DNA, 23 bp, Homo sapiens
tatctagcaagaagattctaaaa

SEQ ID NO: 4311413 - DNA, 18 bp, Homo sapiens
tatctatttatctgtctg

SEQ ID NO: 4311414 - DNA, 14 bp, Homo sapiens
tatctcatcaacaa

SEQ ID NO: 4311415 - DNA, 14 bp, Homo sapiens
tatctcgaagtctt

SEQ ID NO: 4311416 - DNA, 20 bp, Homo sapiens
tatctcgctagccatatatt

SEQ ID NO: 4311417 - DNA, 12 bp, Homo sapiens
tatctctacttt

SEQ ID NO: 4311418 - DNA, 15 bp, Homo sapiens
tatctctactttcct

SEQ ID NO: 4311419 - DNA, 19 bp, Homo sapiens
tatctctactttcctgatg

SEQ ID NO: 4311420 - DNA, 12 bp, Homo sapiens
tatctgaaaact

SEQ ID NO: 4311421 - DNA, 15 bp, Homo sapiens
tatctgaaaactgga

SEQ ID NO: 4311422 - DNA, 16 bp, Homo sapiens
tatctgaaaactggaa

SEQ ID NO: 4311423 - DNA, 19 bp, Homo sapiens
tatctgcaaatagtttcaa

SEQ ID NO: 4311424 - DNA, 16 bp, Homo sapiens
tatctggattcaaatt

SEQ ID NO: 4311425 - DNA, 19 bp, Homo sapiens
tatctggattcaaatttat

SEQ ID NO: 4311426 - DNA, 21 bp, Homo sapiens
tatctgtaaatttaactgcat

SEQ ID NO: 4311427 - DNA, 12 bp, Homo sapiens
tatctgtctgag

SEQ ID NO: 4311428 - DNA, 14 bp, Homo sapiens
tatctgtctgagcc

SEQ ID NO: 4311429 - DNA, 15 bp, Homo sapiens
tatcttcatgtaaat

SEQ ID NO: 4311430 - DNA, 23 bp, Homo sapiens
tatcttcgttagtaatctgtata

SEQ ID NO: 4311431 - DNA, 16 bp, Homo sapiens
tatgaataattatgtt

SEQ ID NO: 4311432 - DNA, 21 bp, Homo sapiens
tatgaataattatgtttacct

SEQ ID NO: 4311433 - DNA, 20 bp, Homo sapiens
tatgacctcaacaaagaaga

SEQ ID NO: 4311434 - DNA, 12 bp, Homo sapiens
tatgagagactg

SEQ ID NO: 4311435 - DNA, 14 bp, Homo sapiens
tatgagctcttcat

SEQ ID NO: 4311436 - DNA, 17 bp, Homo sapiens
tatgaggggactgcatg

SEQ ID NO: 4311437 - DNA, 13 bp, Homo sapiens
tatgataaatttg

SEQ ID NO: 4311438 - DNA, 21 bp, Homo sapiens
tatgatgggtgtttttagcag

SEQ ID NO: 4311439 - DNA, 17 bp, Homo sapiens
tatgattgaaaagaaga

SEQ ID NO: 4311440 - DNA, 16 bp, Homo sapiens
tatgcaagaagaatat

SEQ ID NO: 4311441 - DNA, 15 bp, Homo sapiens
tatgccacctgcagc

SEQ ID NO: 4311442 - DNA, 16 bp, Homo sapiens
tatgccacctgcagcg

SEQ ID NO: 4311443 - DNA, 23 bp, Homo sapiens
tatgccagtgactgctgcgctgt

SEQ ID NO: 4311444 - DNA, 12 bp, Homo sapiens
tatgcctgtatt

SEQ ID NO: 4311445 - DNA, 13 bp, Homo sapiens
tatgctgctgtga

SEQ ID NO: 4311446 - DNA, 15 bp, Homo sapiens
tatgctgctgtgaat

SEQ ID NO: 4311447 - DNA, 15 bp, Homo sapiens
tatgctgtatctgtg

SEQ ID NO: 4311448 - DNA, 19 bp, Homo sapiens
tatgcttaggccagtcagt

SEQ ID NO: 4311449 - DNA, 20 bp, Homo sapiens
tatgcttatattgttcactt

SEQ ID NO: 4311450 - DNA, 15 bp, Homo sapiens
tatggctgtattttt

SEQ ID NO: 4311451 - DNA, 13 bp, Homo sapiens
tatggtattttcg

SEQ ID NO: 4311452 - DNA, 20 bp, Homo sapiens
tatggtattttcgtgcattt

SEQ ID NO: 4311453 - DNA, 20 bp, Homo sapiens
tatgtaaataggtttctaaa

SEQ ID NO: 4311454 - DNA, 13 bp, Homo sapiens
tatgtaacatgtc

SEQ ID NO: 4311455 - DNA, 18 bp, Homo sapiens
tatgtacagttatacata

SEQ ID NO: 4311456 - DNA, 15 bp, Homo sapiens
tatgtagaactgttc

SEQ ID NO: 4311457 - DNA, 17 bp, Homo sapiens
tatgtcagtccaataaa

SEQ ID NO: 4311458 - DNA, 13 bp, Homo sapiens
tatgtcattaaag

SEQ ID NO: 4311459 - DNA, 22 bp, Homo sapiens
tatgtgaaagtgtaaaatagaa

SEQ ID NO: 4311460 - DNA, 15 bp, Homo sapiens
tatgtttacctcact

SEQ ID NO: 4311461 - DNA, 16 bp, Homo sapiens
tatgtttacctcactg

SEQ ID NO: 4311462 - DNA, 18 bp, Homo sapiens
tatgttttagcatgtgtt

SEQ ID NO: 4311463 - DNA, 12 bp, Homo sapiens
tattaaatgcca

SEQ ID NO: 4311464 - DNA, 14 bp, Homo sapiens
tattaacaattaat

SEQ ID NO: 4311465 - DNA, 15 bp, Homo sapiens
tattaacaattaatt

SEQ ID NO: 4311466 - DNA, 21 bp, Homo sapiens
tattaagcccacagtatattt

SEQ ID NO: 4311467 - DNA, 15 bp, Homo sapiens
tattagccaaagagg

SEQ ID NO: 4311468 - DNA, 16 bp, Homo sapiens
tattagccctgcattt

SEQ ID NO: 4311469 - DNA, 20 bp, Homo sapiens
tattagccctgcattttcat

SEQ ID NO: 4311470 - DNA, 16 bp, Homo sapiens
tattatccccatttct

SEQ ID NO: 4311471 - DNA, 17 bp, Homo sapiens
tattattttaaaaattg

SEQ ID NO: 4311472 - DNA, 16 bp, Homo sapiens
tattcaaagagaaaac

SEQ ID NO: 4311473 - DNA, 12 bp, Homo sapiens
tattcaatctta

SEQ ID NO: 4311474 - DNA, 15 bp, Homo sapiens
tattcacttgtgttt

SEQ ID NO: 4311475 - DNA, 14 bp, Homo sapiens
tattcagagatgta

SEQ ID NO: 4311476 - DNA, 19 bp, Homo sapiens
tattcagagatgtaccatg

SEQ ID NO: 4311477 - DNA, 16 bp, Homo sapiens
tattcatactttccaa

SEQ ID NO: 4311478 - DNA, 19 bp, Homo sapiens
tattccatccatatacttt

SEQ ID NO: 4311479 - DNA, 14 bp, Homo sapiens
tattcccaggcagg

SEQ ID NO: 4311480 - DNA, 14 bp, Homo sapiens
tattccttggccca

SEQ ID NO: 4311481 - DNA, 17 bp, Homo sapiens
tattccttggcccagca

SEQ ID NO: 4311482 - DNA, 19 bp, Homo sapiens
tattccttggcccagcagc

SEQ ID NO: 4311483 - DNA, 18 bp, Homo sapiens
tattctagtcaactgctg

SEQ ID NO: 4311484 - DNA, 16 bp, Homo sapiens
tattctgtggattcta

SEQ ID NO: 4311485 - DNA, 20 bp, Homo sapiens
tattctgtggattctatatt

SEQ ID NO: 4311486 - DNA, 18 bp, Homo sapiens
tattcttgctttcacaaa

SEQ ID NO: 4311487 - DNA, 19 bp, Homo sapiens
tattgagcagaattcattc

SEQ ID NO: 4311488 - DNA, 11 bp, Homo sapiens
tattgatattc

SEQ ID NO: 4311489 - DNA, 17 bp, Homo sapiens
tattgctgaatgcaaga

SEQ ID NO: 4311490 - DNA, 14 bp, Homo sapiens
tattggtgtgaatg

SEQ ID NO: 4311491 - DNA, 13 bp, Homo sapiens
tattggttctatt

SEQ ID NO: 4311492 - DNA, 16 bp, Homo sapiens
tattgtagcatttctt

SEQ ID NO: 4311493 - DNA, 16 bp, Homo sapiens
tattgtattgttagat

SEQ ID NO: 4311494 - DNA, 17 bp, Homo sapiens
tattgtattgttagatg

SEQ ID NO: 4311495 - DNA, 22 bp, Homo sapiens
tattgtctgtaaatctaacatt

SEQ ID NO: 4311496 - DNA, 19 bp, Homo sapiens
tattgtgaaatttgttaat

SEQ ID NO: 4311497 - DNA, 14 bp, Homo sapiens
tattgttagatgtt

SEQ ID NO: 4311498 - DNA, 20 bp, Homo sapiens
tatttaactaattaaaaaat

SEQ ID NO: 4311499 - DNA, 17 bp, Homo sapiens
tatttacaatgtattaa

SEQ ID NO: 4311500 - DNA, 13 bp, Homo sapiens
tatttatatatga

SEQ ID NO: 4311501 - DNA, 14 bp, Homo sapiens
tatttatctgtctg

SEQ ID NO: 4311502 - DNA, 14 bp, Homo sapiens
tatttatgacctca

SEQ ID NO: 4311503 - DNA, 16 bp, Homo sapiens
tatttcaatgtaatta

SEQ ID NO: 4311504 - DNA, 14 bp, Homo sapiens
tatttcatgactgg

SEQ ID NO: 4311505 - DNA, 14 bp, Homo sapiens
tatttctaagctta

SEQ ID NO: 4311506 - DNA, 17 bp, Homo sapiens
tatttctaagcttattt

SEQ ID NO: 4311507 - DNA, 21 bp, Homo sapiens
tatttctcccttcaatcctgt

SEQ ID NO: 4311508 - DNA, 14 bp, Homo sapiens
tatttcttcaaata

SEQ ID NO: 4311509 - DNA, 15 bp, Homo sapiens
tatttgctaattaaa

SEQ ID NO: 4311510 - DNA, 13 bp, Homo sapiens
tatttgcttattt

SEQ ID NO: 4311511 - DNA, 15 bp, Homo sapiens
tatttgcttatttat

SEQ ID NO: 4311512 - DNA, 21 bp, Homo sapiens
tatttgtagctagaatatcct

SEQ ID NO: 4311513 - DNA, 14 bp, Homo sapiens
tatttgtatgatat

SEQ ID NO: 4311514 - DNA, 21 bp, Homo sapiens
tattttaaactactgattgaa

SEQ ID NO: 4311515 - DNA, 15 bp, Homo sapiens
tattttatttcaatg

SEQ ID NO: 4311516 - DNA, 19 bp, Homo sapiens
tattttcccacaattcttt

SEQ ID NO: 4311517 - DNA, 13 bp, Homo sapiens
tattttcgtgcat

SEQ ID NO: 4311518 - DNA, 17 bp, Homo sapiens
tattttcgtgcatttgt

SEQ ID NO: 4311519 - DNA, 13 bp, Homo sapiens
tattttctgaatt

SEQ ID NO: 4311520 - DNA, 19 bp, Homo sapiens
tattttctgaattcataaa

SEQ ID NO: 4311521 - DNA, 19 bp, Homo sapiens
tattttgtaaaatgtatta

SEQ ID NO: 4311522 - DNA, 22 bp, Homo sapiens
tattttgtaaaatgtattatgt

SEQ ID NO: 4311523 - DNA, 12 bp, Homo sapiens
tatttttagaga

SEQ ID NO: 4311524 - DNA, 15 bp, Homo sapiens
tatttttctgttacc

SEQ ID NO: 4311525 - DNA, 17 bp, Homo sapiens
tatttttttaactttac

SEQ ID NO: 4311526 - DNA, 20 bp, Homo sapiens
tatttttttaactttaccat

SEQ ID NO: 4311527 - DNA, 21 bp, Homo sapiens
tatttttttaactttaccatg

SEQ ID NO: 4311528 - DNA, 15 bp, Homo sapiens
tatttttttctagct

SEQ ID NO: 4311529 - DNA, 17 bp, Homo sapiens
tcaaaaatcatcaaagt

SEQ ID NO: 4311530 - DNA, 21 bp, Homo sapiens
tcaaaaatcatcaaagtgttt

SEQ ID NO: 4311531 - DNA, 16 bp, Homo sapiens
tcaaaaattgaagaga

SEQ ID NO: 4311532 - DNA, 21 bp, Homo sapiens
tcaaaaattgaagagagatat

SEQ ID NO: 4311533 - DNA, 18 bp, Homo sapiens
tcaaaactccactcagca

SEQ ID NO: 4311534 - DNA, 19 bp, Homo sapiens
tcaaaagattaacaacact

SEQ ID NO: 4311535 - DNA, 15 bp, Homo sapiens
tcaaaatagttctat

SEQ ID NO: 4311536 - DNA, 17 bp, Homo sapiens
tcaaaatagttctattt

SEQ ID NO: 4311537 - DNA, 20 bp, Homo sapiens
tcaaaatagttctatttcta

SEQ ID NO: 4311538 - DNA, 22 bp, Homo sapiens
tcaaaatagttctatttctatc

SEQ ID NO: 4311539 - DNA, 23 bp, Homo sapiens
tcaaaatagttctatttctatct

SEQ ID NO: 4311540 - DNA, 19 bp, Homo sapiens
tcaaaatctagaagagtct

SEQ ID NO: 4311541 - DNA, 16 bp, Homo sapiens
tcaaaatgcatgtgat

SEQ ID NO: 4311542 - DNA, 23 bp, Homo sapiens
tcaaacagggacactacaaacat

SEQ ID NO: 4311543 - DNA, 12 bp, Homo sapiens
tcaaactttcag

SEQ ID NO: 4311544 - DNA, 20 bp, Homo sapiens
tcaaagaacccccctcccca

SEQ ID NO: 4311545 - DNA, 19 bp, Homo sapiens
tcaaagagatgaggaaata

SEQ ID NO: 4311546 - DNA, 20 bp, Homo sapiens
tcaaagtctcaatgaaatag

SEQ ID NO: 4311547 - DNA, 22 bp, Homo sapiens
tcaaagtgtttaattgtataaa

SEQ ID NO: 4311548 - DNA, 19 bp, Homo sapiens
tcaaagtttttacagtgta

SEQ ID NO: 4311549 - DNA, 22 bp, Homo sapiens
tcaaagtttttacagtgtatct

SEQ ID NO: 4311550 - DNA, 19 bp, Homo sapiens
tcaaataaaaattctagat

SEQ ID NO: 4311551 - DNA, 13 bp, Homo sapiens
tcaaatctgagcc

SEQ ID NO: 4311552 - DNA, 19 bp, Homo sapiens
tcaaatgaataatgccttt

SEQ ID NO: 4311553 - DNA, 21 bp, Homo sapiens
tcaaatgaataatgcctttgt

SEQ ID NO: 4311554 - DNA, 10 bp, Homo sapiens
tcaaatgcat

SEQ ID NO: 4311555 - DNA, 11 bp, Homo sapiens
tcaaatgcatg

SEQ ID NO: 4311556 - DNA, 20 bp, Homo sapiens
tcaaatgctactcagtatat

SEQ ID NO: 4311557 - DNA, 22 bp, Homo sapiens
tcaaatttttctgggaagaaaa

SEQ ID NO: 4311558 - DNA, 15 bp, Homo sapiens
tcaacaaagaaatat

SEQ ID NO: 4311559 - DNA, 21 bp, Homo sapiens
tcaacaaagaaatattatttg

SEQ ID NO: 4311560 - DNA, 17 bp, Homo sapiens
tcaacacttattttctg

SEQ ID NO: 4311561 - DNA, 15 bp, Homo sapiens
tcaacagcatgtcta

SEQ ID NO: 4311562 - DNA, 17 bp, Homo sapiens
tcaacagcatgtctact

SEQ ID NO: 4311563 - DNA, 17 bp, Homo sapiens
tcaacatttgctttttg

SEQ ID NO: 4311564 - DNA, 15 bp, Homo sapiens
tcaaccattccccat

SEQ ID NO: 4311565 - DNA, 16 bp, Homo sapiens
tcaaccgcttgccata

SEQ ID NO: 4311566 - DNA, 17 bp, Homo sapiens
tcaaccgcttgccatat

SEQ ID NO: 4311567 - DNA, 20 bp, Homo sapiens
tcaacctgtgatgaggggag

SEQ ID NO: 4311568 - DNA, 18 bp, Homo sapiens
tcaaccttgagacagctt

SEQ ID NO: 4311569 - DNA, 20 bp, Homo sapiens
tcaaccttgtgtgagtgtga

SEQ ID NO: 4311570 - DNA, 20 bp, Homo sapiens
tcaactccaaggcaaatgtc

SEQ ID NO: 4311571 - DNA, 21 bp, Homo sapiens
tcaactccaaggcaaatgtcc

SEQ ID NO: 4311572 - DNA, 22 bp, Homo sapiens
tcaactccaaggcaaatgtcca

SEQ ID NO: 4311573 - DNA, 19 bp, Homo sapiens
tcaactcttgagtttttca

SEQ ID NO: 4311574 - DNA, 14 bp, Homo sapiens
tcaacttcaggaaa

SEQ ID NO: 4311575 - DNA, 16 bp, Homo sapiens
tcaagaatgtgtagga

SEQ ID NO: 4311576 - DNA, 11 bp, Homo sapiens
tcaagcaaata

SEQ ID NO: 4311577 - DNA, 15 bp, Homo sapiens
tcaagccaggagacc

SEQ ID NO: 4311578 - DNA, 21 bp, Homo sapiens
tcaagccaggagaccctgtct

SEQ ID NO: 4311579 - DNA, 11 bp, Homo sapiens
tcaagcctggc

SEQ ID NO: 4311580 - DNA, 14 bp, Homo sapiens
tcaaggggccctag

SEQ ID NO: 4311581 - DNA, 21 bp, Homo sapiens
tcaagtcccgaggcagcaaca

SEQ ID NO: 4311582 - DNA, 22 bp, Homo sapiens
tcaataattgtggagaggagag

SEQ ID NO: 4311583 - DNA, 16 bp, Homo sapiens
tcaatagcgtgtgtag

SEQ ID NO: 4311584 - DNA, 14 bp, Homo sapiens
tcaatcaaactttc

SEQ ID NO: 4311585 - DNA, 17 bp, Homo sapiens
tcaatcaaactttcagc

SEQ ID NO: 4311586 - DNA, 23 bp, Homo sapiens
tcaatgaaatatttgcttattta

SEQ ID NO: 4311587 - DNA, 18 bp, Homo sapiens
tcaatggcgcagtgcctc

SEQ ID NO: 4311588 - DNA, 22 bp, Homo sapiens
tcaatgttcacgcaacttgaaa

SEQ ID NO: 4311589 - DNA, 14 bp, Homo sapiens
tcacaacacaatca

SEQ ID NO: 4311590 - DNA, 13 bp, Homo sapiens
tcacaactgtttt

SEQ ID NO: 4311591 - DNA, 19 bp, Homo sapiens
tcacaactgtttttgaaga

SEQ ID NO: 4311592 - DNA, 13 bp, Homo sapiens
tcacaacttttct

SEQ ID NO: 4311593 - DNA, 14 bp, Homo sapiens
tcacaccagccctg

SEQ ID NO: 4311594 - DNA, 21 bp, Homo sapiens
tcacagaacccttggagccaa

SEQ ID NO: 4311595 - DNA, 12 bp, Homo sapiens
tcacagaggcag

SEQ ID NO: 4311596 - DNA, 16 bp, Homo sapiens
tcacagaggcagtggc

SEQ ID NO: 4311597 - DNA, 17 bp, Homo sapiens
tcacagccaccacctgg

SEQ ID NO: 4311598 - DNA, 19 bp, Homo sapiens
tcacatatcaagtcccgag

SEQ ID NO: 4311599 - DNA, 20 bp, Homo sapiens
tcacatatcaagtcccgagg

SEQ ID NO: 4311600 - DNA, 12 bp, Homo sapiens
tcacatatttgt

SEQ ID NO: 4311601 - DNA, 13 bp, Homo sapiens
tcacatttaatat

SEQ ID NO: 4311602 - DNA, 22 bp, Homo sapiens
tcaccaggaagaaggcccggga

SEQ ID NO: 4311603 - DNA, 23 bp, Homo sapiens
tcaccatctcaggccacctgccc

SEQ ID NO: 4311604 - DNA, 13 bp, Homo sapiens
tcacccagcaccc

SEQ ID NO: 4311605 - DNA, 11 bp, Homo sapiens
tcacccaggac

SEQ ID NO: 4311606 - DNA, 17 bp, Homo sapiens
tcacctaattaatttca

SEQ ID NO: 4311607 - DNA, 17 bp, Homo sapiens
tcacctcccctccttgc

SEQ ID NO: 4311608 - DNA, 20 bp, Homo sapiens
tcacctgaattcgagacagg

SEQ ID NO: 4311609 - DNA, 11 bp, Homo sapiens
tcacctgctgg

SEQ ID NO: 4311610 - DNA, 15 bp, Homo sapiens
tcacctggcttccca

SEQ ID NO: 4311611 - DNA, 18 bp, Homo sapiens
tcacctggcttcccagga

SEQ ID NO: 4311612 - DNA, 19 bp, Homo sapiens
tcacctggcttcccaggac

SEQ ID NO: 4311613 - DNA, 18 bp, Homo sapiens
tcacctggttatgagccg

SEQ ID NO: 4311614 - DNA, 19 bp, Homo sapiens
tcaccttccctagttcttt

SEQ ID NO: 4311615 - DNA, 13 bp, Homo sapiens
tcaccttcctggg

SEQ ID NO: 4311616 - DNA, 17 bp, Homo sapiens
tcaccttcctgggcagc

SEQ ID NO: 4311617 - DNA, 14 bp, Homo sapiens
tcaccttctgtttt

SEQ ID NO: 4311618 - DNA, 21 bp, Homo sapiens
tcaccttgcaacacacagaca

SEQ ID NO: 4311619 - DNA, 16 bp, Homo sapiens
tcacgagatcttcctt

SEQ ID NO: 4311620 - DNA, 17 bp, Homo sapiens
tcacgagatcttccttc

SEQ ID NO: 4311621 - DNA, 15 bp, Homo sapiens
tcacgcaacttgaaa

SEQ ID NO: 4311622 - DNA, 14 bp, Homo sapiens
tcactactcagcat

SEQ ID NO: 4311623 - DNA, 19 bp, Homo sapiens
tcactataatgtgaaatgt

SEQ ID NO: 4311624 - DNA, 14 bp, Homo sapiens
tcactcattaatta

SEQ ID NO: 4311625 - DNA, 19 bp, Homo sapiens
tcactctacttagcatgtc

SEQ ID NO: 4311626 - DNA, 18 bp, Homo sapiens
tcactctggcagcctcag

SEQ ID NO: 4311627 - DNA, 19 bp, Homo sapiens
tcactctggcagcctcaga

SEQ ID NO: 4311628 - DNA, 24 bp, Homo sapiens
tcactgcacagtgcatctcagccc

SEQ ID NO: 4311629 - DNA, 12 bp, Homo sapiens
tcactgctggct

SEQ ID NO: 4311630 - DNA, 22 bp, Homo sapiens
tcactggtgcatttaaaatgga

SEQ ID NO: 4311631 - DNA, 15 bp, Homo sapiens
tcactgtttcactac

SEQ ID NO: 4311632 - DNA, 16 bp, Homo sapiens
tcacttaacctgcttt

SEQ ID NO: 4311633 - DNA, 11 bp, Homo sapiens
tcacttaaggg

SEQ ID NO: 4311634 - DNA, 22 bp, Homo sapiens
tcacttcaagctcaccctgctc

SEQ ID NO: 4311635 - DNA, 17 bp, Homo sapiens
tcacttctgaccacact

SEQ ID NO: 4311636 - DNA, 22 bp, Homo sapiens
tcacttgtcctcagtttttcct

SEQ ID NO: 4311637 - DNA, 18 bp, Homo sapiens
tcacttgtgtttgtatat

SEQ ID NO: 4311638 - DNA, 19 bp, Homo sapiens
tcagaaagggcagcccctc

SEQ ID NO: 4311639 - DNA, 20 bp, Homo sapiens
tcagaaagggcagcccctcc

SEQ ID NO: 4311640 - DNA, 21 bp, Homo sapiens
tcagaatcaaatctgagcctt

SEQ ID NO: 4311641 - DNA, 17 bp, Homo sapiens
tcagaattgtttttaga

SEQ ID NO: 4311642 - DNA, 17 bp, Homo sapiens
tcagacctttgtctgaa

SEQ ID NO: 4311643 - DNA, 14 bp, Homo sapiens
tcagactctctcct

SEQ ID NO: 4311644 - DNA, 18 bp, Homo sapiens
tcagagatgtaccatgtt

SEQ ID NO: 4311645 - DNA, 21 bp, Homo sapiens
tcagagccacccctaaagaga

SEQ ID NO: 4311646 - DNA, 15 bp, Homo sapiens
tcagaggccccttgc

SEQ ID NO: 4311647 - DNA, 18 bp, Homo sapiens
tcagaggccccttgctgc

SEQ ID NO: 4311648 - DNA, 21 bp, Homo sapiens
tcagaggccccttgctgctgg

SEQ ID NO: 4311649 - DNA, 16 bp, Homo sapiens
tcagagtccaggcccc

SEQ ID NO: 4311650 - DNA, 12 bp, Homo sapiens
tcagatgtttga

SEQ ID NO: 4311651 - DNA, 22 bp, Homo sapiens
tcagattgtaaaggtaggtgca

SEQ ID NO: 4311652 - DNA, 24 bp, Homo sapiens
tcagattgtaaaggtaggtgcatg

SEQ ID NO: 4311653 - DNA, 18 bp, Homo sapiens
tcagcaattaaagacatt

SEQ ID NO: 4311654 - DNA, 23 bp, Homo sapiens
tcagcacaattatgtgtgaagct

SEQ ID NO: 4311655 - DNA, 12 bp, Homo sapiens
tcagcacagaga

SEQ ID NO: 4311656 - DNA, 15 bp, Homo sapiens
tcagcagaaggcctt

SEQ ID NO: 4311657 - DNA, 12 bp, Homo sapiens
tcagcagtgatt

SEQ ID NO: 4311658 - DNA, 18 bp, Homo sapiens
tcagcagtgattgaagta

SEQ ID NO: 4311659 - DNA, 23 bp, Homo sapiens
tcagcagtgattgaagtatctgt

SEQ ID NO: 4311660 - DNA, 19 bp, Homo sapiens
tcagcatcgtgtgggtccc

SEQ ID NO: 4311661 - DNA, 20 bp, Homo sapiens
tcagcattcaaaatagttct

SEQ ID NO: 4311662 - DNA, 17 bp, Homo sapiens
tcagcattctcactcct

SEQ ID NO: 4311663 - DNA, 15 bp, Homo sapiens
tcagccacacccagg

SEQ ID NO: 4311664 - DNA, 17 bp, Homo sapiens
tcagccacacccaggca

SEQ ID NO: 4311665 - DNA, 14 bp, Homo sapiens
tcagccattcacaa

SEQ ID NO: 4311666 - DNA, 18 bp, Homo sapiens
tcagccccagggccctgc

SEQ ID NO: 4311667 - DNA, 11 bp, Homo sapiens
tcagcccctct

SEQ ID NO: 4311668 - DNA, 18 bp, Homo sapiens
tcagcccctgctgctcct

SEQ ID NO: 4311669 - DNA, 18 bp, Homo sapiens
tcagccctccctgcccct

SEQ ID NO: 4311670 - DNA, 23 bp, Homo sapiens
tcagccctgcccttcagcatcct

SEQ ID NO: 4311671 - DNA, 12 bp, Homo sapiens
tcagcctccact

SEQ ID NO: 4311672 - DNA, 21 bp, Homo sapiens
tcagcctccactccctgtctg

SEQ ID NO: 4311673 - DNA, 22 bp, Homo sapiens
tcagcctccggatgacacaaat

SEQ ID NO: 4311674 - DNA, 21 bp, Homo sapiens
tcagctgaccagaagtggcag

SEQ ID NO: 4311675 - DNA, 16 bp, Homo sapiens
tcagctgtagaaaggt

SEQ ID NO: 4311676 - DNA, 14 bp, Homo sapiens
tcagcttgtttcta

SEQ ID NO: 4311677 - DNA, 16 bp, Homo sapiens
tcagcttgtttctata

SEQ ID NO: 4311678 - DNA, 20 bp, Homo sapiens
tcagcttgtttctatactgt

SEQ ID NO: 4311679 - DNA, 16 bp, Homo sapiens
tcagcttttttttcag

SEQ ID NO: 4311680 - DNA, 22 bp, Homo sapiens
tcaggaaaggaagatgtaagaa

SEQ ID NO: 4311681 - DNA, 15 bp, Homo sapiens
tcaggaccccatctg

SEQ ID NO: 4311682 - DNA, 15 bp, Homo sapiens
tcaggagccagcagg

SEQ ID NO: 4311683 - DNA, 22 bp, Homo sapiens
tcaggaggtgcctgagagcaga

SEQ ID NO: 4311684 - DNA, 12 bp, Homo sapiens
tcaggcagtggc

SEQ ID NO: 4311685 - DNA, 14 bp, Homo sapiens
tcaggcatgcctgt

SEQ ID NO: 4311686 - DNA, 15 bp, Homo sapiens
tcaggcatgcctgtg

SEQ ID NO: 4311687 - DNA, 17 bp, Homo sapiens
tcaggccacctgccccc

SEQ ID NO: 4311688 - DNA, 19 bp, Homo sapiens
tcaggccacctgccccctt

SEQ ID NO: 4311689 - DNA, 14 bp, Homo sapiens
tcaggcctcacctg

SEQ ID NO: 4311690 - DNA, 20 bp, Homo sapiens
tcaggcctcacctggcttcc

SEQ ID NO: 4311691 - DNA, 22 bp, Homo sapiens
tcaggcctcacctggcttccca

SEQ ID NO: 4311692 - DNA, 16 bp, Homo sapiens
tcaggctcttctcctt

SEQ ID NO: 4311693 - DNA, 15 bp, Homo sapiens
tcagggaccaaggag

SEQ ID NO: 4311694 - DNA, 13 bp, Homo sapiens
tcagggagcactg

SEQ ID NO: 4311695 - DNA, 21 bp, Homo sapiens
tcagggagcactggaggcctc

SEQ ID NO: 4311696 - DNA, 20 bp, Homo sapiens
tcagggcggggctggccagc

SEQ ID NO: 4311697 - DNA, 22 bp, Homo sapiens
tcagggctggattggcaggtgt

SEQ ID NO: 4311698 - DNA, 23 bp, Homo sapiens
tcagggctggattggcaggtgtg

SEQ ID NO: 4311699 - DNA, 15 bp, Homo sapiens
tcaggtgagccaagg

SEQ ID NO: 4311700 - DNA, 13 bp, Homo sapiens
tcaggtggaacag

SEQ ID NO: 4311701 - DNA, 18 bp, Homo sapiens
tcagtaaaattatactgt

SEQ ID NO: 4311702 - DNA, 17 bp, Homo sapiens
tcagtaaacaccatgaa

SEQ ID NO: 4311703 - DNA, 19 bp, Homo sapiens
tcagtacacccaattttaa

SEQ ID NO: 4311704 - DNA, 20 bp, Homo sapiens
tcagtacttgtgaaacacag

SEQ ID NO: 4311705 - DNA, 14 bp, Homo sapiens
tcagtgaggcccag

SEQ ID NO: 4311706 - DNA, 17 bp, Homo sapiens
tcagtgaggcccaggga

SEQ ID NO: 4311707 - DNA, 18 bp, Homo sapiens
tcagtgaggcccagggag

SEQ ID NO: 4311708 - DNA, 21 bp, Homo sapiens
tcagtgcagccccctcctgac

SEQ ID NO: 4311709 - DNA, 23 bp, Homo sapiens
tcagtggactttccaccccctcc

SEQ ID NO: 4311710 - DNA, 14 bp, Homo sapiens
tcagtgtttatgtg

SEQ ID NO: 4311711 - DNA, 18 bp, Homo sapiens
tcagtgtttatgtgctat

SEQ ID NO: 4311712 - DNA, 14 bp, Homo sapiens
tcagttcaatcaaa

SEQ ID NO: 4311713 - DNA, 18 bp, Homo sapiens
tcagtttgtccacacaag

SEQ ID NO: 4311714 - DNA, 21 bp, Homo sapiens
tcagtttgtccacacaagaca

SEQ ID NO: 4311715 - DNA, 13 bp, Homo sapiens
tcataaaaataac

SEQ ID NO: 4311716 - DNA, 21 bp, Homo sapiens
tcataaaaggtgacccttctg

SEQ ID NO: 4311717 - DNA, 18 bp, Homo sapiens
tcataaattatttctaaa

SEQ ID NO: 4311718 - DNA, 12 bp, Homo sapiens
tcataacaatgt

SEQ ID NO: 4311719 - DNA, 13 bp, Homo sapiens
tcatactctgtgt

SEQ ID NO: 4311720 - DNA, 13 bp, Homo sapiens
tcatacttaaaaa

SEQ ID NO: 4311721 - DNA, 18 bp, Homo sapiens
tcataggcagagcccgcc

SEQ ID NO: 4311722 - DNA, 17 bp, Homo sapiens
tcatatataataaatta

SEQ ID NO: 4311723 - DNA, 12 bp, Homo sapiens
tcatatcatttc

SEQ ID NO: 4311724 - DNA, 17 bp, Homo sapiens
tcatatttacctgtgaa

SEQ ID NO: 4311725 - DNA, 23 bp, Homo sapiens
tcatcaatacttttgtgtattct

SEQ ID NO: 4311726 - DNA, 13 bp, Homo sapiens
tcatcatgtctat

SEQ ID NO: 4311727 - DNA, 18 bp, Homo sapiens
tcatcccggggccatgga

SEQ ID NO: 4311728 - DNA, 12 bp, Homo sapiens
tcatcctcagca

SEQ ID NO: 4311729 - DNA, 14 bp, Homo sapiens
tcatcctcctggac

SEQ ID NO: 4311730 - DNA, 23 bp, Homo sapiens
tcatcctgccttcatggaactca

SEQ ID NO: 4311731 - DNA, 13 bp, Homo sapiens
tcatcctgggcat

SEQ ID NO: 4311732 - DNA, 21 bp, Homo sapiens
tcatcgcagggctcatgattt

SEQ ID NO: 4311733 - DNA, 16 bp, Homo sapiens
tcatgacatttctcaa

SEQ ID NO: 4311734 - DNA, 19 bp, Homo sapiens
tcatgacatttctcaaagt

SEQ ID NO: 4311735 - DNA, 17 bp, Homo sapiens
tcatgatttgcaacttt

SEQ ID NO: 4311736 - DNA, 12 bp, Homo sapiens
tcatgcctgaga

SEQ ID NO: 4311737 - DNA, 20 bp, Homo sapiens
tcatgcctggggtggaggct

SEQ ID NO: 4311738 - DNA, 20 bp, Homo sapiens
tcatgctcccaaatgcagct

SEQ ID NO: 4311739 - DNA, 19 bp, Homo sapiens
tcatggctgtcccctgcaa

SEQ ID NO: 4311740 - DNA, 19 bp, Homo sapiens
tcatgggagtcagggagcc

SEQ ID NO: 4311741 - DNA, 22 bp, Homo sapiens
tcatgggagtcagggagccctg

SEQ ID NO: 4311742 - DNA, 22 bp, Homo sapiens
tcatgtaatagtggctttcatt

SEQ ID NO: 4311743 - DNA, 20 bp, Homo sapiens
tcatgtctattgtccaaagt

SEQ ID NO: 4311744 - DNA, 20 bp, Homo sapiens
tcatgtgtcagctgtagaaa

SEQ ID NO: 4311745 - DNA, 18 bp, Homo sapiens
tcatgttaattgatagaa

SEQ ID NO: 4311746 - DNA, 19 bp, Homo sapiens
tcattaaagtgcactgtgt

SEQ ID NO: 4311747 - DNA, 13 bp, Homo sapiens
tcattaaattact

SEQ ID NO: 4311748 - DNA, 15 bp, Homo sapiens
tcattaaattactat

SEQ ID NO: 4311749 - DNA, 14 bp, Homo sapiens
tcattatttcatga

SEQ ID NO: 4311750 - DNA, 13 bp, Homo sapiens
tcattattttccc

SEQ ID NO: 4311751 - DNA, 22 bp, Homo sapiens
tcattcccttctctcagcctcc

SEQ ID NO: 4311752 - DNA, 22 bp, Homo sapiens
tcattctttataaaccataaaa

SEQ ID NO: 4311753 - DNA, 20 bp, Homo sapiens
tcattcttttcagcttgttt

SEQ ID NO: 4311754 - DNA, 18 bp, Homo sapiens
tcattgagggaaaacata

SEQ ID NO: 4311755 - DNA, 22 bp, Homo sapiens
tcatttaccataaaaatccttc

SEQ ID NO: 4311756 - DNA, 20 bp, Homo sapiens
tcattttaacatctgagaaa

SEQ ID NO: 4311757 - DNA, 13 bp, Homo sapiens
tcattttcacctc

SEQ ID NO: 4311758 - DNA, 21 bp, Homo sapiens
tcatttttgaaactgcatttg

SEQ ID NO: 4311759 - DNA, 13 bp, Homo sapiens
tcattttttttaa

SEQ ID NO: 4311760 - DNA, 16 bp, Homo sapiens
tccaaaggtttcaact

SEQ ID NO: 4311761 - DNA, 17 bp, Homo sapiens
tccaaatacattccagt

SEQ ID NO: 4311762 - DNA, 15 bp, Homo sapiens
tccaaattgatgggt

SEQ ID NO: 4311763 - DNA, 18 bp, Homo sapiens
tccaaattgatgggtggg

SEQ ID NO: 4311764 - DNA, 19 bp, Homo sapiens
tccaacaactccaggaaaa

SEQ ID NO: 4311765 - DNA, 19 bp, Homo sapiens
tccaacattatcctgtgtg

SEQ ID NO: 4311766 - DNA, 17 bp, Homo sapiens
tccaacccatgcatggc

SEQ ID NO: 4311767 - DNA, 19 bp, Homo sapiens
tccaacttgtcacttgcca

SEQ ID NO: 4311768 - DNA, 18 bp, Homo sapiens
tccaagaccttacaacca

SEQ ID NO: 4311769 - DNA, 20 bp, Homo sapiens
tccaagcatcagcaagacaa

SEQ ID NO: 4311770 - DNA, 15 bp, Homo sapiens
tccaagcctgggcca

SEQ ID NO: 4311771 - DNA, 20 bp, Homo sapiens
tccaagcctgggccactggc

SEQ ID NO: 4311772 - DNA, 22 bp, Homo sapiens
tccaagcctgggccactggcat

SEQ ID NO: 4311773 - DNA, 23 bp, Homo sapiens
tccaaggaagggatgtatttgta

SEQ ID NO: 4311774 - DNA, 14 bp, Homo sapiens
tccaaggcaaatgt

SEQ ID NO: 4311775 - DNA, 14 bp, Homo sapiens
tccaagggcccaga

SEQ ID NO: 4311776 - DNA, 16 bp, Homo sapiens
tccaagggcccagagg

SEQ ID NO: 4311777 - DNA, 17 bp, Homo sapiens
tccaagggcccagaggg

SEQ ID NO: 4311778 - DNA, 19 bp, Homo sapiens
tccaatgtgcccagtcatg

SEQ ID NO: 4311779 - DNA, 13 bp, Homo sapiens
tccacacaagaca

SEQ ID NO: 4311780 - DNA, 14 bp, Homo sapiens
tccacacaggccca

SEQ ID NO: 4311781 - DNA, 22 bp, Homo sapiens
tccacacaggcccatgccctcc

SEQ ID NO: 4311782 - DNA, 15 bp, Homo sapiens
tccacacctccaccc

SEQ ID NO: 4311783 - DNA, 16 bp, Homo sapiens
tccacacctccacccg

SEQ ID NO: 4311784 - DNA, 12 bp, Homo sapiens
tccacacttcca

SEQ ID NO: 4311785 - DNA, 21 bp, Homo sapiens
tccacagaagacacgtgtttt

SEQ ID NO: 4311786 - DNA, 21 bp, Homo sapiens
tccacagggacacagtctggt

SEQ ID NO: 4311787 - DNA, 14 bp, Homo sapiens
tccacattctgctg

SEQ ID NO: 4311788 - DNA, 15 bp, Homo sapiens
tccacattctgctgc

SEQ ID NO: 4311789 - DNA, 21 bp, Homo sapiens
tccacattctgctgcccccag

SEQ ID NO: 4311790 - DNA, 23 bp, Homo sapiens
tccacattctgctgcccccagac

SEQ ID NO: 4311791 - DNA, 20 bp, Homo sapiens
tccaccaagggtatctgctg

SEQ ID NO: 4311792 - DNA, 12 bp, Homo sapiens
tccaccccctcc

SEQ ID NO: 4311793 - DNA, 18 bp, Homo sapiens
tccaccccctccctggcc

SEQ ID NO: 4311794 - DNA, 21 bp, Homo sapiens
tccacccctcaagccaggaga

SEQ ID NO: 4311795 - DNA, 16 bp, Homo sapiens
tccacccgtttccaag

SEQ ID NO: 4311796 - DNA, 18 bp, Homo sapiens
tccacccgtttccaagcc

SEQ ID NO: 4311797 - DNA, 11 bp, Homo sapiens
tccacctcagg

SEQ ID NO: 4311798 - DNA, 15 bp, Homo sapiens
tccacctgcagcccc

SEQ ID NO: 4311799 - DNA, 16 bp, Homo sapiens
tccacctgcagcccca

SEQ ID NO: 4311800 - DNA, 21 bp, Homo sapiens
tccacctgcagccccaggcct

SEQ ID NO: 4311801 - DNA, 13 bp, Homo sapiens
tccacctgcttgt

SEQ ID NO: 4311802 - DNA, 15 bp, Homo sapiens
tccacctgtgctgct

SEQ ID NO: 4311803 - DNA, 16 bp, Homo sapiens
tccacgctgtctccag

SEQ ID NO: 4311804 - DNA, 17 bp, Homo sapiens
tccacgctgtctccaga

SEQ ID NO: 4311805 - DNA, 22 bp, Homo sapiens
tccacgctgtctccagaccccc

SEQ ID NO: 4311806 - DNA, 19 bp, Homo sapiens
tccactaggtgcccagtct

SEQ ID NO: 4311807 - DNA, 13 bp, Homo sapiens
tccactcccctca

SEQ ID NO: 4311808 - DNA, 13 bp, Homo sapiens
tccactgccttcg

SEQ ID NO: 4311809 - DNA, 22 bp, Homo sapiens
tccactgccttcgatacaccgg

SEQ ID NO: 4311810 - DNA, 19 bp, Homo sapiens
tccactgtaaatttaatag

SEQ ID NO: 4311811 - DNA, 16 bp, Homo sapiens
tccagacagggtgggg

SEQ ID NO: 4311812 - DNA, 18 bp, Homo sapiens
tccagacagggtggggct

SEQ ID NO: 4311813 - DNA, 9 bp, Homo sapiens
tccagaccc

SEQ ID NO: 4311814 - DNA, 13 bp, Homo sapiens
tccagacccccac

SEQ ID NO: 4311815 - DNA, 15 bp, Homo sapiens
tccagacccccagca

SEQ ID NO: 4311816 - DNA, 16 bp, Homo sapiens
tccagacccctggctt

SEQ ID NO: 4311817 - DNA, 13 bp, Homo sapiens
tccagacctgggc

SEQ ID NO: 4311818 - DNA, 15 bp, Homo sapiens
tccagacctgggccc

SEQ ID NO: 4311819 - DNA, 17 bp, Homo sapiens
tccagacctgggccctg

SEQ ID NO: 4311820 - DNA, 14 bp, Homo sapiens
tccagacttcgcta

SEQ ID NO: 4311821 - DNA, 22 bp, Homo sapiens
tccagacttcgctattcccagg

SEQ ID NO: 4311822 - DNA, 20 bp, Homo sapiens
tccagagagaagcaccccac

SEQ ID NO: 4311823 - DNA, 19 bp, Homo sapiens
tccagagagagaagtgccc

SEQ ID NO: 4311824 - DNA, 15 bp, Homo sapiens
tccagagagtggctc

SEQ ID NO: 4311825 - DNA, 22 bp, Homo sapiens
tccagagagtggctcctcccgg

SEQ ID NO: 4311826 - DNA, 12 bp, Homo sapiens
tccagaggaggt

SEQ ID NO: 4311827 - DNA, 23 bp, Homo sapiens
tccagaggaggtgcccgggcagg

SEQ ID NO: 4311828 - DNA, 21 bp, Homo sapiens
tccagaggtgagggaggcctg

SEQ ID NO: 4311829 - DNA, 23 bp, Homo sapiens
tccagagtaggtgggtcttggat

SEQ ID NO: 4311830 - DNA, 21 bp, Homo sapiens
tccagatagcctagggtgagg

SEQ ID NO: 4311831 - DNA, 22 bp, Homo sapiens
tccagatagcctagggtgaggg

SEQ ID NO: 4311832 - DNA, 14 bp, Homo sapiens
tccagcaatgcctg

SEQ ID NO: 4311833 - DNA, 23 bp, Homo sapiens
tccagccaacccctgtggagccc

SEQ ID NO: 4311834 - DNA, 16 bp, Homo sapiens
tccagccaccaaggct

SEQ ID NO: 4311835 - DNA, 22 bp, Homo sapiens
tccagccaccaaggctgcctgc

SEQ ID NO: 4311836 - DNA, 19 bp, Homo sapiens
tccagctaagcctgatgat

SEQ ID NO: 4311837 - DNA, 11 bp, Homo sapiens
tccaggcagga

SEQ ID NO: 4311838 - DNA, 22 bp, Homo sapiens
tccaggcatgaccctggagccc

SEQ ID NO: 4311839 - DNA, 21 bp, Homo sapiens
tccaggccccaaaaccacagc

SEQ ID NO: 4311840 - DNA, 13 bp, Homo sapiens
tccaggccccagg

SEQ ID NO: 4311841 - DNA, 19 bp, Homo sapiens
tccaggccccaggctggat

SEQ ID NO: 4311842 - DNA, 23 bp, Homo sapiens
tccaggccccaggctggatgctg

SEQ ID NO: 4311843 - DNA, 14 bp, Homo sapiens
tccaggcgtagggc

SEQ ID NO: 4311844 - DNA, 16 bp, Homo sapiens
tccaggcgtagggcca

SEQ ID NO: 4311845 - DNA, 15 bp, Homo sapiens
tccaggcttcctgcc

SEQ ID NO: 4311846 - DNA, 18 bp, Homo sapiens
tccaggcttcctgcccta

SEQ ID NO: 4311847 - DNA, 20 bp, Homo sapiens
tccaggcttcctgccctagc

SEQ ID NO: 4311848 - DNA, 21 bp, Homo sapiens
tccaggcttcctgccctagca

SEQ ID NO: 4311849 - DNA, 14 bp, Homo sapiens
tccaggggtttaca

SEQ ID NO: 4311850 - DNA, 13 bp, Homo sapiens
tccagtctgctgc

SEQ ID NO: 4311851 - DNA, 14 bp, Homo sapiens
tccagtctgctgcc

SEQ ID NO: 4311852 - DNA, 18 bp, Homo sapiens
tccagtctgctgccctcc

SEQ ID NO: 4311853 - DNA, 19 bp, Homo sapiens
tccagtctgctgccctcca

SEQ ID NO: 4311854 - DNA, 22 bp, Homo sapiens
tccagtgacacaactcatccag

SEQ ID NO: 4311855 - DNA, 16 bp, Homo sapiens
tccagtgctgctccct

SEQ ID NO: 4311856 - DNA, 19 bp, Homo sapiens
tccagtgtattttctgtgt

SEQ ID NO: 4311857 - DNA, 13 bp, Homo sapiens
tccagtgttgcct

SEQ ID NO: 4311858 - DNA, 16 bp, Homo sapiens
tccagtgttgcctcct

SEQ ID NO: 4311859 - DNA, 13 bp, Homo sapiens
tccagtgttttct

SEQ ID NO: 4311860 - DNA, 15 bp, Homo sapiens
tccataccccctgcc

SEQ ID NO: 4311861 - DNA, 16 bp, Homo sapiens
tccataccccctgccc

SEQ ID NO: 4311862 - DNA, 20 bp, Homo sapiens
tccataccccctgccccaga

SEQ ID NO: 4311863 - DNA, 20 bp, Homo sapiens
tccatatagtttgttttctt

SEQ ID NO: 4311864 - DNA, 16 bp, Homo sapiens
tccatcagcagtgatt

SEQ ID NO: 4311865 - DNA, 17 bp, Homo sapiens
tccatccctggtgaaag

SEQ ID NO: 4311866 - DNA, 21 bp, Homo sapiens
tccatctaaaatactcaccaa

SEQ ID NO: 4311867 - DNA, 12 bp, Homo sapiens
tccatctgtctg

SEQ ID NO: 4311868 - DNA, 13 bp, Homo sapiens
tccatctgtctgt

SEQ ID NO: 4311869 - DNA, 19 bp, Homo sapiens
tccatctgtctgtcctacc

SEQ ID NO: 4311870 - DNA, 12 bp, Homo sapiens
tccatgatggag

SEQ ID NO: 4311871 - DNA, 18 bp, Homo sapiens
tccatgcagatctagcca

SEQ ID NO: 4311872 - DNA, 18 bp, Homo sapiens
tccatgcggccggcctgg

SEQ ID NO: 4311873 - DNA, 23 bp, Homo sapiens
tccatgtagaagagggagaagga

SEQ ID NO: 4311874 - DNA, 16 bp, Homo sapiens
tccatgtcaagattca

SEQ ID NO: 4311875 - DNA, 16 bp, Homo sapiens
tccatgtgaaatttac

SEQ ID NO: 4311876 - DNA, 17 bp, Homo sapiens
tccattaatttaaatga

SEQ ID NO: 4311877 - DNA, 19 bp, Homo sapiens
tccattaatttaaatgatt

SEQ ID NO: 4311878 - DNA, 13 bp, Homo sapiens
tccattctgggtg

SEQ ID NO: 4311879 - DNA, 19 bp, Homo sapiens
tccattctgggtgttttca

SEQ ID NO: 4311880 - DNA, 14 bp, Homo sapiens
tccattttctaaac

SEQ ID NO: 4311881 - DNA, 15 bp, Homo sapiens
tccatttttacaagt

SEQ ID NO: 4311882 - DNA, 17 bp, Homo sapiens
tcccaaatatgcccctc

SEQ ID NO: 4311883 - DNA, 23 bp, Homo sapiens
tcccaaatatgcccctccccagt

SEQ ID NO: 4311884 - DNA, 14 bp, Homo sapiens
tcccaactctggcc

SEQ ID NO: 4311885 - DNA, 19 bp, Homo sapiens
tcccaaggcgtgcaggggc

SEQ ID NO: 4311886 - DNA, 13 bp, Homo sapiens
tcccacaaaatat

SEQ ID NO: 4311887 - DNA, 16 bp, Homo sapiens
tcccacaattcttttg

SEQ ID NO: 4311888 - DNA, 22 bp, Homo sapiens
tcccacactgctaggtgggcca

SEQ ID NO: 4311889 - DNA, 21 bp, Homo sapiens
tcccacaggcccttcctctcc

SEQ ID NO: 4311890 - DNA, 18 bp, Homo sapiens
tcccacggccactgcagt

SEQ ID NO: 4311891 - DNA, 14 bp, Homo sapiens
tcccactggctcct

SEQ ID NO: 4311892 - DNA, 17 bp, Homo sapiens
tcccactggctcctcca

SEQ ID NO: 4311893 - DNA, 22 bp, Homo sapiens
tcccagccacccggatctccag

SEQ ID NO: 4311894 - DNA, 23 bp, Homo sapiens
tcccagccacccggatctccagg

SEQ ID NO: 4311895 - DNA, 14 bp, Homo sapiens
tcccaggaccctgg

SEQ ID NO: 4311896 - DNA, 21 bp, Homo sapiens
tcccaggaccctgggtcacct

SEQ ID NO: 4311897 - DNA, 23 bp, Homo sapiens
tcccaggacgcagggagaccctg

SEQ ID NO: 4311898 - DNA, 16 bp, Homo sapiens
tcccaggcgccccttc

SEQ ID NO: 4311899 - DNA, 18 bp, Homo sapiens
tcccagggagctctgcat

SEQ ID NO: 4311900 - DNA, 20 bp, Homo sapiens
tcccagtggcctcaaccctc

SEQ ID NO: 4311901 - DNA, 17 bp, Homo sapiens
tcccatccagcgtctgc

SEQ ID NO: 4311902 - DNA, 14 bp, Homo sapiens
tcccattcaagatt

SEQ ID NO: 4311903 - DNA, 12 bp, Homo sapiens
tcccatttgtaa

SEQ ID NO: 4311904 - DNA, 16 bp, Homo sapiens
tccccaaccctgcccc

SEQ ID NO: 4311905 - DNA, 18 bp, Homo sapiens
tccccaaccctgcccctg

SEQ ID NO: 4311906 - DNA, 13 bp, Homo sapiens
tccccaaggaaga

SEQ ID NO: 4311907 - DNA, 18 bp, Homo sapiens
tccccactgcctgcccac

SEQ ID NO: 4311908 - DNA, 20 bp, Homo sapiens
tccccactgcctgcccaccc

SEQ ID NO: 4311909 - DNA, 19 bp, Homo sapiens
tccccagcaggtggggagg

SEQ ID NO: 4311910 - DNA, 12 bp, Homo sapiens
tccccagcccag

SEQ ID NO: 4311911 - DNA, 23 bp, Homo sapiens
tccccaggagagaccttctctta

SEQ ID NO: 4311912 - DNA, 16 bp, Homo sapiens
tccccatcgccttctg

SEQ ID NO: 4311913 - DNA, 18 bp, Homo sapiens
tccccatcgccttctggg

SEQ ID NO: 4311914 - DNA, 17 bp, Homo sapiens
tccccattctataaatt

SEQ ID NO: 4311915 - DNA, 19 bp, Homo sapiens
tccccatttaggtttctga

SEQ ID NO: 4311916 - DNA, 16 bp, Homo sapiens
tcccccagccctgtgg

SEQ ID NO: 4311917 - DNA, 21 bp, Homo sapiens
tcccccaggggtgagccccgc

SEQ ID NO: 4311918 - DNA, 19 bp, Homo sapiens
tcccccatcctccccttcc

SEQ ID NO: 4311919 - DNA, 19 bp, Homo sapiens
tcccccggggtctccacct

SEQ ID NO: 4311920 - DNA, 14 bp, Homo sapiens
tccccctccttgcc

SEQ ID NO: 4311921 - DNA, 13 bp, Homo sapiens
tccccctgccaga

SEQ ID NO: 4311922 - DNA, 19 bp, Homo sapiens
tccccctgccagaggcctg

SEQ ID NO: 4311923 - DNA, 21 bp, Homo sapiens
tccccctgccagaggcctggt

SEQ ID NO: 4311924 - DNA, 15 bp, Homo sapiens
tccccgacagtggct

SEQ ID NO: 4311925 - DNA, 21 bp, Homo sapiens
tccccgagccgagctctcctg

SEQ ID NO: 4311926 - DNA, 19 bp, Homo sapiens
tccccggacaagcccagga

SEQ ID NO: 4311927 - DNA, 21 bp, Homo sapiens
tccccggacaagcccaggaca

SEQ ID NO: 4311928 - DNA, 22 bp, Homo sapiens
tccccggaccggacgcatgcag

SEQ ID NO: 4311929 - DNA, 17 bp, Homo sapiens
tccccggacgcatgcag

SEQ ID NO: 4311930 - DNA, 13 bp, Homo sapiens
tccccggagctgg

SEQ ID NO: 4311931 - DNA, 16 bp, Homo sapiens
tccccgtgctcacagt

SEQ ID NO: 4311932 - DNA, 12 bp, Homo sapiens
tcccctccagac

SEQ ID NO: 4311933 - DNA, 13 bp, Homo sapiens
tcccctccctttt

SEQ ID NO: 4311934 - DNA, 21 bp, Homo sapiens
tcccctccttgcctcctgtgt

SEQ ID NO: 4311935 - DNA, 22 bp, Homo sapiens
tcccctccttgcctcctgtgta

SEQ ID NO: 4311936 - DNA, 15 bp, Homo sapiens
tcccctcgcttcata

SEQ ID NO: 4311937 - DNA, 19 bp, Homo sapiens
tcccctcgcttcataggca

SEQ ID NO: 4311938 - DNA, 22 bp, Homo sapiens
tcccctcgcttcataggcagag

SEQ ID NO: 4311939 - DNA, 20 bp, Homo sapiens
tcccctgaggttaaggggat

SEQ ID NO: 4311940 - DNA, 19 bp, Homo sapiens
tcccctgcgcaggccctcc

SEQ ID NO: 4311941 - DNA, 18 bp, Homo sapiens
tcccctggaactgtctct

SEQ ID NO: 4311942 - DNA, 17 bp, Homo sapiens
tcccctggtcctgcact

SEQ ID NO: 4311943 - DNA, 18 bp, Homo sapiens
tcccctggtcctgcactg

SEQ ID NO: 4311944 - DNA, 15 bp, Homo sapiens
tcccctgttcactct

SEQ ID NO: 4311945 - DNA, 14 bp, Homo sapiens
tccccttgagctga

SEQ ID NO: 4311946 - DNA, 15 bp, Homo sapiens
tccccttgagctgag

SEQ ID NO: 4311947 - DNA, 17 bp, Homo sapiens
tcccgagccccctgtcc

SEQ ID NO: 4311948 - DNA, 13 bp, Homo sapiens
tcccgaggcagca

SEQ ID NO: 4311949 - DNA, 22 bp, Homo sapiens
tcccgatgcgtggctcccagca

SEQ ID NO: 4311950 - DNA, 12 bp, Homo sapiens
tcccgcatgctg

SEQ ID NO: 4311951 - DNA, 14 bp, Homo sapiens
tcccgctcagccct

SEQ ID NO: 4311952 - DNA, 19 bp, Homo sapiens
tcccggctctgaggctgcc

SEQ ID NO: 4311953 - DNA, 14 bp, Homo sapiens
tcccggggccatgg

SEQ ID NO: 4311954 - DNA, 19 bp, Homo sapiens
tccctaccgagtctcttct

SEQ ID NO: 4311955 - DNA, 21 bp, Homo sapiens
tccctaccgagtctcttctcc

SEQ ID NO: 4311956 - DNA, 13 bp, Homo sapiens
tccctagttcttt

SEQ ID NO: 4311957 - DNA, 16 bp, Homo sapiens
tccctcagcccctctt

SEQ ID NO: 4311958 - DNA, 12 bp, Homo sapiens
tccctccacacc

SEQ ID NO: 4311959 - DNA, 19 bp, Homo sapiens
tccctccacacctccaccc

SEQ ID NO: 4311960 - DNA, 16 bp, Homo sapiens
tccctccaccccagtc

SEQ ID NO: 4311961 - DNA, 19 bp, Homo sapiens
tccctccaccccagtcccc

SEQ ID NO: 4311962 - DNA, 16 bp, Homo sapiens
tccctccacctgcttg

SEQ ID NO: 4311963 - DNA, 15 bp, Homo sapiens
tccctccactcctcc

SEQ ID NO: 4311964 - DNA, 13 bp, Homo sapiens
tccctccctccac

SEQ ID NO: 4311965 - DNA, 14 bp, Homo sapiens
tccctccctccaca

SEQ ID NO: 4311966 - DNA, 15 bp, Homo sapiens
tccctccctccacac

SEQ ID NO: 4311967 - DNA, 13 bp, Homo sapiens
tccctccctgcag

SEQ ID NO: 4311968 - DNA, 15 bp, Homo sapiens
tccctccctgcaggg

SEQ ID NO: 4311969 - DNA, 14 bp, Homo sapiens
tccctcctggctca

SEQ ID NO: 4311970 - DNA, 16 bp, Homo sapiens
tccctgagggcccttc

SEQ ID NO: 4311971 - DNA, 18 bp, Homo sapiens
tccctgagggcccttccc

SEQ ID NO: 4311972 - DNA, 23 bp, Homo sapiens
tccctgagggcccttcccaacct

SEQ ID NO: 4311973 - DNA, 14 bp, Homo sapiens
tccctgcagggtag

SEQ ID NO: 4311974 - DNA, 21 bp, Homo sapiens
tccctgccccgccccccagag

SEQ ID NO: 4311975 - DNA, 14 bp, Homo sapiens
tccctgcccctccc

SEQ ID NO: 4311976 - DNA, 18 bp, Homo sapiens
tccctgcccctcccttca

SEQ ID NO: 4311977 - DNA, 13 bp, Homo sapiens
tccctgcctggcc

SEQ ID NO: 4311978 - DNA, 20 bp, Homo sapiens
tccctgcctggccctcctct

SEQ ID NO: 4311979 - DNA, 14 bp, Homo sapiens
tccctggcctgttc

SEQ ID NO: 4311980 - DNA, 18 bp, Homo sapiens
tccctggcctgttctgtt

SEQ ID NO: 4311981 - DNA, 22 bp, Homo sapiens
tccctgggctggcatggggagg

SEQ ID NO: 4311982 - DNA, 22 bp, Homo sapiens
tccctggggatgtggctggagc

SEQ ID NO: 4311983 - DNA, 21 bp, Homo sapiens
tccctggtgaaagagtaaaac

SEQ ID NO: 4311984 - DNA, 11 bp, Homo sapiens
tccctgtcccc

SEQ ID NO: 4311985 - DNA, 21 bp, Homo sapiens
tcccttactttacctctctgt

SEQ ID NO: 4311986 - DNA, 11 bp, Homo sapiens
tcccttcaacc

SEQ ID NO: 4311987 - DNA, 14 bp, Homo sapiens
tcccttctctcagc

SEQ ID NO: 4311988 - DNA, 19 bp, Homo sapiens
tcccttctctcagcctcca

SEQ ID NO: 4311989 - DNA, 18 bp, Homo sapiens
tcccttctggctgtcagt

SEQ ID NO: 4311990 - DNA, 21 bp, Homo sapiens
tccctttcatgatttgcaact

SEQ ID NO: 4311991 - DNA, 17 bp, Homo sapiens
tccctttctaagcagga

SEQ ID NO: 4311992 - DNA, 19 bp, Homo sapiens
tccctttttaaacaaatgg

SEQ ID NO: 4311993 - DNA, 20 bp, Homo sapiens
tccgacaaccgatgctccag

SEQ ID NO: 4311994 - DNA, 14 bp, Homo sapiens
tccgccctgggctc

SEQ ID NO: 4311995 - DNA, 21 bp, Homo sapiens
tccggatgacacaaataccag

SEQ ID NO: 4311996 - DNA, 18 bp, Homo sapiens
tccggcccccagagcgcc

SEQ ID NO: 4311997 - DNA, 23 bp, Homo sapiens
tccggccctgccccacacaggcc

SEQ ID NO: 4311998 - DNA, 17 bp, Homo sapiens
tccggctgagctgtgcc

SEQ ID NO: 4311999 - DNA, 20 bp, Homo sapiens
tccggcttggctagtcacat

SEQ ID NO: 4312000 - DNA, 14 bp, Homo sapiens
tccgtcctggcagg

SEQ ID NO: 4312001 - DNA, 16 bp, Homo sapiens
tcctatcacctcccct

SEQ ID NO: 4312002 - DNA, 19 bp, Homo sapiens
tcctatcacctcccctcct

SEQ ID NO: 4312003 - DNA, 13 bp, Homo sapiens
tcctatccccgga

SEQ ID NO: 4312004 - DNA, 16 bp, Homo sapiens
tcctatgagagaagag

SEQ ID NO: 4312005 - DNA, 19 bp, Homo sapiens
tcctattactgatgtgtgc

SEQ ID NO: 4312006 - DNA, 14 bp, Homo sapiens
tcctattctattgc

SEQ ID NO: 4312007 - DNA, 17 bp, Homo sapiens
tcctcaaaaatcatcaa

SEQ ID NO: 4312008 - DNA, 19 bp, Homo sapiens
tcctcaaaaatcatcaaag

SEQ ID NO: 4312009 - DNA, 18 bp, Homo sapiens
tcctcaccttctgtttta

SEQ ID NO: 4312010 - DNA, 13 bp, Homo sapiens
tcctcagccccag

SEQ ID NO: 4312011 - DNA, 17 bp, Homo sapiens
tcctcagccccagggcc

SEQ ID NO: 4312012 - DNA, 22 bp, Homo sapiens
tcctcagccccagggccctgct

SEQ ID NO: 4312013 - DNA, 15 bp, Homo sapiens
tcctcaggcagtggc

SEQ ID NO: 4312014 - DNA, 19 bp, Homo sapiens
tcctcaggcagtggcccag

SEQ ID NO: 4312015 - DNA, 22 bp, Homo sapiens
tcctcaggcagtggcccaggga

SEQ ID NO: 4312016 - DNA, 16 bp, Homo sapiens
tcctccattgtatctt

SEQ ID NO: 4312017 - DNA, 17 bp, Homo sapiens
tcctcccaactctggcc

SEQ ID NO: 4312018 - DNA, 22 bp, Homo sapiens
tcctcccaactctggccttggt

SEQ ID NO: 4312019 - DNA, 13 bp, Homo sapiens
tcctccccagcag

SEQ ID NO: 4312020 - DNA, 17 bp, Homo sapiens
tcctccccttccctgca

SEQ ID NO: 4312021 - DNA, 23 bp, Homo sapiens
tcctcctggacccagcaggggca

SEQ ID NO: 4312022 - DNA, 19 bp, Homo sapiens
tcctccttcactccctgtc

SEQ ID NO: 4312023 - DNA, 15 bp, Homo sapiens
tcctcggccagagct

SEQ ID NO: 4312024 - DNA, 12 bp, Homo sapiens
tcctctccactg

SEQ ID NO: 4312025 - DNA, 17 bp, Homo sapiens
tcctctccactgccttc

SEQ ID NO: 4312026 - DNA, 19 bp, Homo sapiens
tcctctctctccctccact

SEQ ID NO: 4312027 - DNA, 16 bp, Homo sapiens
tcctctctctgtgtta

SEQ ID NO: 4312028 - DNA, 17 bp, Homo sapiens
tcctctgccttggacac

SEQ ID NO: 4312029 - DNA, 14 bp, Homo sapiens
tcctcttacctgta

SEQ ID NO: 4312030 - DNA, 23 bp, Homo sapiens
tcctcttacctgtaatagcctca

SEQ ID NO: 4312031 - DNA, 15 bp, Homo sapiens
tcctcttagaagaat

SEQ ID NO: 4312032 - DNA, 19 bp, Homo sapiens
tcctgaaacttacacacaa

SEQ ID NO: 4312033 - DNA, 18 bp, Homo sapiens
tcctgaatccctttcagt

SEQ ID NO: 4312034 - DNA, 16 bp, Homo sapiens
tcctgagcttggccag

SEQ ID NO: 4312035 - DNA, 17 bp, Homo sapiens
tcctgaggagcagccca

SEQ ID NO: 4312036 - DNA, 15 bp, Homo sapiens
tcctgaggctggggc

SEQ ID NO: 4312037 - DNA, 12 bp, Homo sapiens
tcctgcaccctc

SEQ ID NO: 4312038 - DNA, 14 bp, Homo sapiens
tcctgcaccctctg

SEQ ID NO: 4312039 - DNA, 16 bp, Homo sapiens
tcctgcaccctctgct

SEQ ID NO: 4312040 - DNA, 21 bp, Homo sapiens
tcctgcaccctctgctatgtc

SEQ ID NO: 4312041 - DNA, 21 bp, Homo sapiens
tcctgcatccctccaccccag

SEQ ID NO: 4312042 - DNA, 17 bp, Homo sapiens
tcctgctcagatgctgg

SEQ ID NO: 4312043 - DNA, 17 bp, Homo sapiens
tcctgctgaccttctgc

SEQ ID NO: 4312044 - DNA, 19 bp, Homo sapiens
tcctgctgagtggtccaca

SEQ ID NO: 4312045 - DNA, 20 bp, Homo sapiens
tcctgctgagtggtccacat

SEQ ID NO: 4312046 - DNA, 23 bp, Homo sapiens
tcctggcagggcaggcagagctc

SEQ ID NO: 4312047 - DNA, 17 bp, Homo sapiens
tcctggctcacagccac

SEQ ID NO: 4312048 - DNA, 13 bp, Homo sapiens
tcctggctcagcc

SEQ ID NO: 4312049 - DNA, 16 bp, Homo sapiens
tcctgggcagcccaga

SEQ ID NO: 4312050 - DNA, 17 bp, Homo sapiens
tcctgggcagcccagag

SEQ ID NO: 4312051 - DNA, 19 bp, Homo sapiens
tcctgggcagcccagagag

SEQ ID NO: 4312052 - DNA, 15 bp, Homo sapiens
tcctgggcatcccca

SEQ ID NO: 4312053 - DNA, 20 bp, Homo sapiens
tcctgggcatccccagcccc

SEQ ID NO: 4312054 - DNA, 17 bp, Homo sapiens
tcctgggcatctggccc

SEQ ID NO: 4312055 - DNA, 22 bp, Homo sapiens
tcctgggcatgtccccagtgtg

SEQ ID NO: 4312056 - DNA, 12 bp, Homo sapiens
tcctgggccagg

SEQ ID NO: 4312057 - DNA, 17 bp, Homo sapiens
tcctgggccccctggga

SEQ ID NO: 4312058 - DNA, 19 bp, Homo sapiens
tcctgtaactgttacagta

SEQ ID NO: 4312059 - DNA, 21 bp, Homo sapiens
tcctgtaactgttacagtaat

SEQ ID NO: 4312060 - DNA, 19 bp, Homo sapiens
tcctgtaattttgtagtag

SEQ ID NO: 4312061 - DNA, 12 bp, Homo sapiens
tcctgtacaagt

SEQ ID NO: 4312062 - DNA, 17 bp, Homo sapiens
tcctgtcaatgtttgct

SEQ ID NO: 4312063 - DNA, 18 bp, Homo sapiens
tcctgtcaatgtttgctt

SEQ ID NO: 4312064 - DNA, 16 bp, Homo sapiens
tcctgtcctggctccc

SEQ ID NO: 4312065 - DNA, 13 bp, Homo sapiens
tcctgtgcacagc

SEQ ID NO: 4312066 - DNA, 18 bp, Homo sapiens
tcctgtgtaatcatttct

SEQ ID NO: 4312067 - DNA, 23 bp, Homo sapiens
tcctgtgtaatcatttcttgggc

SEQ ID NO: 4312068 - DNA, 15 bp, Homo sapiens
tcctgttctcagagc

SEQ ID NO: 4312069 - DNA, 19 bp, Homo sapiens
tcctgttctcagagctcca

SEQ ID NO: 4312070 - DNA, 11 bp, Homo sapiens
tccttaagaat

SEQ ID NO: 4312071 - DNA, 13 bp, Homo sapiens
tccttaagagatt

SEQ ID NO: 4312072 - DNA, 22 bp, Homo sapiens
tccttaccgtgggcactgaagg

SEQ ID NO: 4312073 - DNA, 20 bp, Homo sapiens
tccttagaatactgtattgt

SEQ ID NO: 4312074 - DNA, 22 bp, Homo sapiens
tccttcactccctgtcatagtt

SEQ ID NO: 4312075 - DNA, 14 bp, Homo sapiens
tccttcatttcctc

SEQ ID NO: 4312076 - DNA, 23 bp, Homo sapiens
tccttccaggccccaggctggat

SEQ ID NO: 4312077 - DNA, 20 bp, Homo sapiens
tccttcccacggccactgca

SEQ ID NO: 4312078 - DNA, 16 bp, Homo sapiens
tccttctcccctccag

SEQ ID NO: 4312079 - DNA, 17 bp, Homo sapiens
tccttctcccctccaga

SEQ ID NO: 4312080 - DNA, 18 bp, Homo sapiens
tccttctcccctccagac

SEQ ID NO: 4312081 - DNA, 23 bp, Homo sapiens
tccttgaggacctccacctggga

SEQ ID NO: 4312082 - DNA, 20 bp, Homo sapiens
tccttgccgctgggagagcc

SEQ ID NO: 4312083 - DNA, 17 bp, Homo sapiens
tccttgcctcctgtgta

SEQ ID NO: 4312084 - DNA, 12 bp, Homo sapiens
tccttggcccag

SEQ ID NO: 4312085 - DNA, 17 bp, Homo sapiens
tccttggcccagcagcg

SEQ ID NO: 4312086 - DNA, 23 bp, Homo sapiens
tccttggcccagcagcggcccag

SEQ ID NO: 4312087 - DNA, 23 bp, Homo sapiens
tccttgtttgcctttaggcagga

SEQ ID NO: 4312088 - DNA, 19 bp, Homo sapiens
tcctttcacaaccttctgt

SEQ ID NO: 4312089 - DNA, 20 bp, Homo sapiens
tcctttcatcctcagcaagt

SEQ ID NO: 4312090 - DNA, 15 bp, Homo sapiens
tccttttgtatcctc

SEQ ID NO: 4312091 - DNA, 16 bp, Homo sapiens
tccttttgtatcctcc

SEQ ID NO: 4312092 - DNA, 21 bp, Homo sapiens
tcgaagaattggcagaagcag

SEQ ID NO: 4312093 - DNA, 14 bp, Homo sapiens
tcgaagctcagccc

SEQ ID NO: 4312094 - DNA, 16 bp, Homo sapiens
tcgaagtcttccatca

SEQ ID NO: 4312095 - DNA, 13 bp, Homo sapiens
tcgccatgtgctg

SEQ ID NO: 4312096 - DNA, 18 bp, Homo sapiens
tcgcccaaagccagacag

SEQ ID NO: 4312097 - DNA, 16 bp, Homo sapiens
tcgcccctccagtgtt

SEQ ID NO: 4312098 - DNA, 12 bp, Homo sapiens
tcgccttctggg

SEQ ID NO: 4312099 - DNA, 13 bp, Homo sapiens
tcgccttctgggg

SEQ ID NO: 4312100 - DNA, 13 bp, Homo sapiens
tcgctattcccag

SEQ ID NO: 4312101 - DNA, 14 bp, Homo sapiens
tcgctattcccagg

SEQ ID NO: 4312102 - DNA, 18 bp, Homo sapiens
tcgctattcccaggcagg

SEQ ID NO: 4312103 - DNA, 19 bp, Homo sapiens
tcgctattcccaggcaggg

SEQ ID NO: 4312104 - DNA, 17 bp, Homo sapiens
tcgcttcataggcagag

SEQ ID NO: 4312105 - DNA, 23 bp, Homo sapiens
tcggagcctgtgttagtgtctgt

SEQ ID NO: 4312106 - DNA, 12 bp, Homo sapiens
tcggccagagct

SEQ ID NO: 4312107 - DNA, 13 bp, Homo sapiens
tcggccagagctc

SEQ ID NO: 4312108 - DNA, 16 bp, Homo sapiens
tcggccagagctccca

SEQ ID NO: 4312109 - DNA, 19 bp, Homo sapiens
tcggccagagctcccagga

SEQ ID NO: 4312110 - DNA, 24 bp, Homo sapiens
tcggccccacccaccctctggtcc

SEQ ID NO: 4312111 - DNA, 22 bp, Homo sapiens
tcgggctctctcacccagcctg

SEQ ID NO: 4312112 - DNA, 22 bp, Homo sapiens
tcggggcaggaagtccctgaga

SEQ ID NO: 4312113 - DNA, 20 bp, Homo sapiens
tcgtcaggaggtgcctgaga

SEQ ID NO: 4312114 - DNA, 22 bp, Homo sapiens
tcgtcaggaggtgcctgagagc

SEQ ID NO: 4312115 - DNA, 19 bp, Homo sapiens
tcgtctttgcttgtcctgc

SEQ ID NO: 4312116 - DNA, 16 bp, Homo sapiens
tcgtgaacataactga

SEQ ID NO: 4312117 - DNA, 18 bp, Homo sapiens
tcgtggagccacaggcag

SEQ ID NO: 4312118 - DNA, 11 bp, Homo sapiens
tcgtggagctc

SEQ ID NO: 4312119 - DNA, 16 bp, Homo sapiens
tctaaaaaataactgt

SEQ ID NO: 4312120 - DNA, 17 bp, Homo sapiens
tctaaaaaataactgtg

SEQ ID NO: 4312121 - DNA, 14 bp, Homo sapiens
tctaaaaagtcaga

SEQ ID NO: 4312122 - DNA, 22 bp, Homo sapiens
tctaaaatactcaccaaaatat

SEQ ID NO: 4312123 - DNA, 12 bp, Homo sapiens
tctaaaattcta

SEQ ID NO: 4312124 - DNA, 15 bp, Homo sapiens
tctaaactgttttca

SEQ ID NO: 4312125 - DNA, 18 bp, Homo sapiens
tctaaatgtttctttttc

SEQ ID NO: 4312126 - DNA, 18 bp, Homo sapiens
tctaactgtatatttgta

SEQ ID NO: 4312127 - DNA, 16 bp, Homo sapiens
tctaagattgtacata

SEQ ID NO: 4312128 - DNA, 14 bp, Homo sapiens
tctaagcaggaagg

SEQ ID NO: 4312129 - DNA, 18 bp, Homo sapiens
tctaagcttatttctaac

SEQ ID NO: 4312130 - DNA, 23 bp, Homo sapiens
tctactgcttggatccatacaaa

SEQ ID NO: 4312131 - DNA, 18 bp, Homo sapiens
tctagaagagtctattgt

SEQ ID NO: 4312132 - DNA, 19 bp, Homo sapiens
tctagaagagtctattgtc

SEQ ID NO: 4312133 - DNA, 13 bp, Homo sapiens
tctagaaggggcg

SEQ ID NO: 4312134 - DNA, 16 bp, Homo sapiens
tctagaaggggcgagg

SEQ ID NO: 4312135 - DNA, 13 bp, Homo sapiens
tctagacaaccct

SEQ ID NO: 4312136 - DNA, 23 bp, Homo sapiens
tctagcaactgttggataataac

SEQ ID NO: 4312137 - DNA, 14 bp, Homo sapiens
tctagcaagaagat

SEQ ID NO: 4312138 - DNA, 12 bp, Homo sapiens
tctagctataac

SEQ ID NO: 4312139 - DNA, 15 bp, Homo sapiens
tctagtcaactgctg

SEQ ID NO: 4312140 - DNA, 19 bp, Homo sapiens
tctagtcctattctattgc

SEQ ID NO: 4312141 - DNA, 20 bp, Homo sapiens
tctagtttgcatacttcctg

SEQ ID NO: 4312142 - DNA, 12 bp, Homo sapiens
tctatactgttt

SEQ ID NO: 4312143 - DNA, 23 bp, Homo sapiens
tctatactgtttgtaatatacag

SEQ ID NO: 4312144 - DNA, 18 bp, Homo sapiens
tctatatatacatgtata

SEQ ID NO: 4312145 - DNA, 18 bp, Homo sapiens
tctatatgttgctgaaac

SEQ ID NO: 4312146 - DNA, 13 bp, Homo sapiens
tctatatttcata

SEQ ID NO: 4312147 - DNA, 16 bp, Homo sapiens
tctatatttcatattg

SEQ ID NO: 4312148 - DNA, 14 bp, Homo sapiens
tctatgtagaactg

SEQ ID NO: 4312149 - DNA, 17 bp, Homo sapiens
tctattgtagcatttct

SEQ ID NO: 4312150 - DNA, 20 bp, Homo sapiens
tctattgtagcatttcttga

SEQ ID NO: 4312151 - DNA, 13 bp, Homo sapiens
tctatttaatttt

SEQ ID NO: 4312152 - DNA, 13 bp, Homo sapiens
tctatttagcatg

SEQ ID NO: 4312153 - DNA, 16 bp, Homo sapiens
tctatttatctgtctg

SEQ ID NO: 4312154 - DNA, 14 bp, Homo sapiens
tctattttttacta

SEQ ID NO: 4312155 - DNA, 21 bp, Homo sapiens
tctcaaagtttttacagtgta

SEQ ID NO: 4312156 - DNA, 18 bp, Homo sapiens
tctcaagagggcactggt

SEQ ID NO: 4312157 - DNA, 19 bp, Homo sapiens
tctcaagagggcactggtg

SEQ ID NO: 4312158 - DNA, 18 bp, Homo sapiens
tctcacactctaactgta

SEQ ID NO: 4312159 - DNA, 14 bp, Homo sapiens
tctcactctggcag

SEQ ID NO: 4312160 - DNA, 14 bp, Homo sapiens
tctcactgtgtccc

SEQ ID NO: 4312161 - DNA, 21 bp, Homo sapiens
tctcactttaataataaaaat

SEQ ID NO: 4312162 - DNA, 15 bp, Homo sapiens
tctcacttttctcca

SEQ ID NO: 4312163 - DNA, 17 bp, Homo sapiens
tctcacttttctccatg

SEQ ID NO: 4312164 - DNA, 15 bp, Homo sapiens
tctcagataaagtga

SEQ ID NO: 4312165 - DNA, 18 bp, Homo sapiens
tctcagataaagtgacca

SEQ ID NO: 4312166 - DNA, 16 bp, Homo sapiens
tctcagctcatcttca

SEQ ID NO: 4312167 - DNA, 20 bp, Homo sapiens
tctcaggcatgcctgtgtga

SEQ ID NO: 4312168 - DNA, 18 bp, Homo sapiens
tctcaggccacctgcccc

SEQ ID NO: 4312169 - DNA, 18 bp, Homo sapiens
tctcatcatgtctattgt

SEQ ID NO: 4312170 - DNA, 13 bp, Homo sapiens
tctcatgaacctc

SEQ ID NO: 4312171 - DNA, 22 bp, Homo sapiens
tctcatgaacctcaagctgcat

SEQ ID NO: 4312172 - DNA, 21 bp, Homo sapiens
tctcatgcactgcaaatactt

SEQ ID NO: 4312173 - DNA, 13 bp, Homo sapiens
tctcatgcctgag

SEQ ID NO: 4312174 - DNA, 14 bp, Homo sapiens
tctcatgcctgaga

SEQ ID NO: 4312175 - DNA, 23 bp, Homo sapiens
tctcatgcctgagaatgcctagg

SEQ ID NO: 4312176 - DNA, 24 bp, Homo sapiens
tctcatgcctgagaatgcctaggc

SEQ ID NO: 4312177 - DNA, 16 bp, Homo sapiens
tctcatgctccttaat

SEQ ID NO: 4312178 - DNA, 15 bp, Homo sapiens
tctcattcctctgtc

SEQ ID NO: 4312179 - DNA, 16 bp, Homo sapiens
tctccacaacctcctc

SEQ ID NO: 4312180 - DNA, 21 bp, Homo sapiens
tctccacccctcaagccagga

SEQ ID NO: 4312181 - DNA, 19 bp, Homo sapiens
tctccagacccccacccct

SEQ ID NO: 4312182 - DNA, 13 bp, Homo sapiens
tctccaggcccag

SEQ ID NO: 4312183 - DNA, 14 bp, Homo sapiens
tctccatcagaagg

SEQ ID NO: 4312184 - DNA, 14 bp, Homo sapiens
tctccatccccatg

SEQ ID NO: 4312185 - DNA, 18 bp, Homo sapiens
tctcccatgggggctcca

SEQ ID NO: 4312186 - DNA, 19 bp, Homo sapiens
tctcccatgggggctccag

SEQ ID NO: 4312187 - DNA, 14 bp, Homo sapiens
tctccctggactct

SEQ ID NO: 4312188 - DNA, 22 bp, Homo sapiens
tctcctctctctccctccactc

SEQ ID NO: 4312189 - DNA, 21 bp, Homo sapiens
tctcctgaggagcagcccacc

SEQ ID NO: 4312190 - DNA, 17 bp, Homo sapiens
tctcctgggcatctggc

SEQ ID NO: 4312191 - DNA, 18 bp, Homo sapiens
tctcctgggcatctggcc

SEQ ID NO: 4312192 - DNA, 20 bp, Homo sapiens
tctcctgggcatctggccct

SEQ ID NO: 4312193 - DNA, 17 bp, Homo sapiens
tctccttggttatattt

SEQ ID NO: 4312194 - DNA, 15 bp, Homo sapiens
tctcgaagtcttcca

SEQ ID NO: 4312195 - DNA, 21 bp, Homo sapiens
tctcgaagtcttccatcagca

SEQ ID NO: 4312196 - DNA, 17 bp, Homo sapiens
tctctaaaattctagtc

SEQ ID NO: 4312197 - DNA, 13 bp, Homo sapiens
tctctaggaaagt

SEQ ID NO: 4312198 - DNA, 12 bp, Homo sapiens
tctctaggcctg

SEQ ID NO: 4312199 - DNA, 19 bp, Homo sapiens
tctctatatatacatgtat

SEQ ID NO: 4312200 - DNA, 21 bp, Homo sapiens
tctctatatatacatgtatag

SEQ ID NO: 4312201 - DNA, 13 bp, Homo sapiens
tctctcagcccag

SEQ ID NO: 4312202 - DNA, 12 bp, Homo sapiens
tctctcagcctc

SEQ ID NO: 4312203 - DNA, 22 bp, Homo sapiens
tctctcatgaacctcaagctgc

SEQ ID NO: 4312204 - DNA, 11 bp, Homo sapiens
tctctccctcc

SEQ ID NO: 4312205 - DNA, 12 bp, Homo sapiens
tctctccctcca

SEQ ID NO: 4312206 - DNA, 21 bp, Homo sapiens
tctctccctccactcctccca

SEQ ID NO: 4312207 - DNA, 19 bp, Homo sapiens
tctctctatatatacatgt

SEQ ID NO: 4312208 - DNA, 14 bp, Homo sapiens
tctctctccctcca

SEQ ID NO: 4312209 - DNA, 15 bp, Homo sapiens
tctctctccctccac

SEQ ID NO: 4312210 - DNA, 11 bp, Homo sapiens
tctctctgccc

SEQ ID NO: 4312211 - DNA, 13 bp, Homo sapiens
tctctctgtgctg

SEQ ID NO: 4312212 - DNA, 15 bp, Homo sapiens
tctctctgtgctggt

SEQ ID NO: 4312213 - DNA, 19 bp, Homo sapiens
tctctgaactgcaacactg

SEQ ID NO: 4312214 - DNA, 16 bp, Homo sapiens
tctctgatttgcaaat

SEQ ID NO: 4312215 - DNA, 11 bp, Homo sapiens
tctctgccagc

SEQ ID NO: 4312216 - DNA, 12 bp, Homo sapiens
tctctgccagcc

SEQ ID NO: 4312217 - DNA, 9 bp, Homo sapiens
tctctgccc

SEQ ID NO: 4312218 - DNA, 15 bp, Homo sapiens
tctctgcttttccat

SEQ ID NO: 4312219 - DNA, 23 bp, Homo sapiens
tctctggccactctgctctgcac

SEQ ID NO: 4312220 - DNA, 17 bp, Homo sapiens
tctctgtttaccctccc

SEQ ID NO: 4312221 - DNA, 14 bp, Homo sapiens
tctcttaccccgtc

SEQ ID NO: 4312222 - DNA, 20 bp, Homo sapiens
tctcttgcataagcctcagg

SEQ ID NO: 4312223 - DNA, 12 bp, Homo sapiens
tctctttcatct

SEQ ID NO: 4312224 - DNA, 20 bp, Homo sapiens
tctcttttcaaacacacaca

SEQ ID NO: 4312225 - DNA, 14 bp, Homo sapiens
tctgaaaactggaa

SEQ ID NO: 4312226 - DNA, 14 bp, Homo sapiens
tctgaaaactgttt

SEQ ID NO: 4312227 - DNA, 17 bp, Homo sapiens
tctgaaacacagtcatg

SEQ ID NO: 4312228 - DNA, 17 bp, Homo sapiens
tctgaaggccttgttaa

SEQ ID NO: 4312229 - DNA, 15 bp, Homo sapiens
tctgaataatttctt

SEQ ID NO: 4312230 - DNA, 16 bp, Homo sapiens
tctgaataatttctta

SEQ ID NO: 4312231 - DNA, 22 bp, Homo sapiens
tctgacctgcccccgctctgcc

SEQ ID NO: 4312232 - DNA, 23 bp, Homo sapiens
tctgacctgcccccgctctgcca

SEQ ID NO: 4312233 - DNA, 17 bp, Homo sapiens
tctgagccctgccctca

SEQ ID NO: 4312234 - DNA, 18 bp, Homo sapiens
tctgagccctgccctcac

SEQ ID NO: 4312235 - DNA, 21 bp, Homo sapiens
tctgagccttagtttcagctg

SEQ ID NO: 4312236 - DNA, 15 bp, Homo sapiens
tctgagcggccgcct

SEQ ID NO: 4312237 - DNA, 22 bp, Homo sapiens
tctgagcggccgcctgtccttg

SEQ ID NO: 4312238 - DNA, 21 bp, Homo sapiens
tctgatattggtgtgaatgct

SEQ ID NO: 4312239 - DNA, 15 bp, Homo sapiens
tctgattaaatttaa

SEQ ID NO: 4312240 - DNA, 20 bp, Homo sapiens
tctgattggacattttcttc

SEQ ID NO: 4312241 - DNA, 23 bp, Homo sapiens
tctgattggacattttcttcaga

SEQ ID NO: 4312242 - DNA, 16 bp, Homo sapiens
tctgattgtgatgtga

SEQ ID NO: 4312243 - DNA, 23 bp, Homo sapiens
tctgatttattttgtatgaaata

SEQ ID NO: 4312244 - DNA, 16 bp, Homo sapiens
tctgcaaatagtttca

SEQ ID NO: 4312245 - DNA, 20 bp, Homo sapiens
tctgcaagattctgtgggca

SEQ ID NO: 4312246 - DNA, 23 bp, Homo sapiens
tctgcacaccttgaatctgcctg

SEQ ID NO: 4312247 - DNA, 16 bp, Homo sapiens
tctgcacgtgcacaca

SEQ ID NO: 4312248 - DNA, 12 bp, Homo sapiens
tctgcagggcag

SEQ ID NO: 4312249 - DNA, 16 bp, Homo sapiens
tctgcagggcagcctg

SEQ ID NO: 4312250 - DNA, 18 bp, Homo sapiens
tctgcagggcagcctgtg

SEQ ID NO: 4312251 - DNA, 13 bp, Homo sapiens
tctgcatctccac

SEQ ID NO: 4312252 - DNA, 13 bp, Homo sapiens
tctgcatgctcct

SEQ ID NO: 4312253 - DNA, 17 bp, Homo sapiens
tctgccagccgctggtg

SEQ ID NO: 4312254 - DNA, 15 bp, Homo sapiens
tctgccatcagcccc

SEQ ID NO: 4312255 - DNA, 23 bp, Homo sapiens
tctgccatcagcccctgctgctc

SEQ ID NO: 4312256 - DNA, 13 bp, Homo sapiens
tctgcccaccccg

SEQ ID NO: 4312257 - DNA, 22 bp, Homo sapiens
tctgcccaccccgcctctgggc

SEQ ID NO: 4312258 - DNA, 18 bp, Homo sapiens
tctgcccccaaaagtgtc

SEQ ID NO: 4312259 - DNA, 16 bp, Homo sapiens
tctgcccccagctgct

SEQ ID NO: 4312260 - DNA, 12 bp, Homo sapiens
tctgcctgtccc

SEQ ID NO: 4312261 - DNA, 13 bp, Homo sapiens
tctgcctgtccct

SEQ ID NO: 4312262 - DNA, 21 bp, Homo sapiens
tctgcctgtccctctcaggca

SEQ ID NO: 4312263 - DNA, 13 bp, Homo sapiens
tctgcctgtgccc

SEQ ID NO: 4312264 - DNA, 15 bp, Homo sapiens
tctgcctgtgcccgc

SEQ ID NO: 4312265 - DNA, 22 bp, Homo sapiens
tctgcctgtgcccgctgcgctg

SEQ ID NO: 4312266 - DNA, 14 bp, Homo sapiens
tctgccttccaggc

SEQ ID NO: 4312267 - DNA, 18 bp, Homo sapiens
tctgcgccgctgtgctgt

SEQ ID NO: 4312268 - DNA, 22 bp, Homo sapiens
tctgcgccgctgtgctgttgtc

SEQ ID NO: 4312269 - DNA, 18 bp, Homo sapiens
tctgcgcggatgtagcat

SEQ ID NO: 4312270 - DNA, 21 bp, Homo sapiens
tctgcggagcttctccagcca

SEQ ID NO: 4312271 - DNA, 20 bp, Homo sapiens
tctgctacctggttttcatt

SEQ ID NO: 4312272 - DNA, 12 bp, Homo sapiens
tctgctccatgc

SEQ ID NO: 4312273 - DNA, 11 bp, Homo sapiens
tctgctcctgt

SEQ ID NO: 4312274 - DNA, 14 bp, Homo sapiens
tctgctcggccgtc

SEQ ID NO: 4312275 - DNA, 18 bp, Homo sapiens
tctgctcggccgtcttca

SEQ ID NO: 4312276 - DNA, 12 bp, Homo sapiens
tctgctctgcac

SEQ ID NO: 4312277 - DNA, 19 bp, Homo sapiens
tctgctgacagatgttcca

SEQ ID NO: 4312278 - DNA, 16 bp, Homo sapiens
tctgctgaggccagag

SEQ ID NO: 4312279 - DNA, 18 bp, Homo sapiens
tctgctgccctccatccc

SEQ ID NO: 4312280 - DNA, 21 bp, Homo sapiens
tctgctgcctctgaaaatatt

SEQ ID NO: 4312281 - DNA, 16 bp, Homo sapiens
tctgctgctttccaac

SEQ ID NO: 4312282 - DNA, 18 bp, Homo sapiens
tctgcttttccattctgg

SEQ ID NO: 4312283 - DNA, 15 bp, Homo sapiens
tctggaaaggaggaa

SEQ ID NO: 4312284 - DNA, 16 bp, Homo sapiens
tctggaaaggaggaag

SEQ ID NO: 4312285 - DNA, 16 bp, Homo sapiens
tctggagcccctatcc

SEQ ID NO: 4312286 - DNA, 20 bp, Homo sapiens
tctggagcccctatcctgca

SEQ ID NO: 4312287 - DNA, 23 bp, Homo sapiens
tctggagcccctatcctgcaccc

SEQ ID NO: 4312288 - DNA, 22 bp, Homo sapiens
tctggaggtcccagacatgctg

SEQ ID NO: 4312289 - DNA, 24 bp, Homo sapiens
tctggaggtcccagacatgctgcc

SEQ ID NO: 4312290 - DNA, 13 bp, Homo sapiens
tctggagtctgaa

SEQ ID NO: 4312291 - DNA, 21 bp, Homo sapiens
tctggagtctgaaggagagga

SEQ ID NO: 4312292 - DNA, 15 bp, Homo sapiens
tctggagtgtgtggg

SEQ ID NO: 4312293 - DNA, 19 bp, Homo sapiens
tctggcaggtggccagggc

SEQ ID NO: 4312294 - DNA, 14 bp, Homo sapiens
tctggccctgctgc

SEQ ID NO: 4312295 - DNA, 13 bp, Homo sapiens
tctggccctgttg

SEQ ID NO: 4312296 - DNA, 19 bp, Homo sapiens
tctggccttggttcctcca

SEQ ID NO: 4312297 - DNA, 20 bp, Homo sapiens
tctggccttggttcctccag

SEQ ID NO: 4312298 - DNA, 21 bp, Homo sapiens
tctggctacgacttgggacgg

SEQ ID NO: 4312299 - DNA, 13 bp, Homo sapiens
tctggctgtggcc

SEQ ID NO: 4312300 - DNA, 22 bp, Homo sapiens
tctgggctcacaccagccctgg

SEQ ID NO: 4312301 - DNA, 15 bp, Homo sapiens
tctggggagggacac

SEQ ID NO: 4312302 - DNA, 14 bp, Homo sapiens
tctgggtgttttca

SEQ ID NO: 4312303 - DNA, 13 bp, Homo sapiens
tctggtttggggc

SEQ ID NO: 4312304 - DNA, 23 bp, Homo sapiens
tctggtttggggcgaggcagagg

SEQ ID NO: 4312305 - DNA, 22 bp, Homo sapiens
tctgtaaatttaactgcatata

SEQ ID NO: 4312306 - DNA, 13 bp, Homo sapiens
tctgtaatattta

SEQ ID NO: 4312307 - DNA, 17 bp, Homo sapiens
tctgtaatatttacaat

SEQ ID NO: 4312308 - DNA, 18 bp, Homo sapiens
tctgtaatatttacaatg

SEQ ID NO: 4312309 - DNA, 23 bp, Homo sapiens
tctgtaatcacactctcttctta

SEQ ID NO: 4312310 - DNA, 21 bp, Homo sapiens
tctgtacatgtggaaaactca

SEQ ID NO: 4312311 - DNA, 19 bp, Homo sapiens
tctgtataatactttgtat

SEQ ID NO: 4312312 - DNA, 13 bp, Homo sapiens
tctgtccatctgt

SEQ ID NO: 4312313 - DNA, 24 bp, Homo sapiens
tctgtccccgagccgagctctcct

SEQ ID NO: 4312314 - DNA, 13 bp, Homo sapiens
tctgtccctgtcc

SEQ ID NO: 4312315 - DNA, 15 bp, Homo sapiens
tctgtccctgtccct

SEQ ID NO: 4312316 - DNA, 14 bp, Homo sapiens
tctgtctgagccct

SEQ ID NO: 4312317 - DNA, 16 bp, Homo sapiens
tctgtctgagccctgc

SEQ ID NO: 4312318 - DNA, 16 bp, Homo sapiens
tctgtctgattctatg

SEQ ID NO: 4312319 - DNA, 17 bp, Homo sapiens
tctgtctgattctatgc

SEQ ID NO: 4312320 - DNA, 13 bp, Homo sapiens
tctgtctgtccta

SEQ ID NO: 4312321 - DNA, 21 bp, Homo sapiens
tctgtgaaagtctcctgtatc

SEQ ID NO: 4312322 - DNA, 15 bp, Homo sapiens
tctgtgaaatatcat

SEQ ID NO: 4312323 - DNA, 15 bp, Homo sapiens
tctgtggattctata

SEQ ID NO: 4312324 - DNA, 16 bp, Homo sapiens
tctgtggattctatat

SEQ ID NO: 4312325 - DNA, 14 bp, Homo sapiens
tctgtggccctctc

SEQ ID NO: 4312326 - DNA, 13 bp, Homo sapiens
tctgtgggactgg

SEQ ID NO: 4312327 - DNA, 16 bp, Homo sapiens
tctgtgggactggccc

SEQ ID NO: 4312328 - DNA, 17 bp, Homo sapiens
tctgtgggcagctggct

SEQ ID NO: 4312329 - DNA, 13 bp, Homo sapiens
tctgttccctgct

SEQ ID NO: 4312330 - DNA, 13 bp, Homo sapiens
tctgttcctggct

SEQ ID NO: 4312331 - DNA, 22 bp, Homo sapiens
tctgttcctggctcagcctcaa

SEQ ID NO: 4312332 - DNA, 23 bp, Homo sapiens
tctgtttaccctccctgtcccct

SEQ ID NO: 4312333 - DNA, 21 bp, Homo sapiens
tctgtttatgttcttgcagca

SEQ ID NO: 4312334 - DNA, 19 bp, Homo sapiens
tcttaaaagctatcttcat

SEQ ID NO: 4312335 - DNA, 24 bp, Homo sapiens
tcttaaaagctatcttcatgtaaa

SEQ ID NO: 4312336 - DNA, 21 bp, Homo sapiens
tcttaagacagcatgtgttaa

SEQ ID NO: 4312337 - DNA, 24 bp, Homo sapiens
tcttaagacagcatgtgttaatct

SEQ ID NO: 4312338 - DNA, 14 bp, Homo sapiens
tcttacccacacta

SEQ ID NO: 4312339 - DNA, 22 bp, Homo sapiens
tcttaccccgtccctttccctg

SEQ ID NO: 4312340 - DNA, 20 bp, Homo sapiens
tcttacctgtaatagcctca

SEQ ID NO: 4312341 - DNA, 24 bp, Homo sapiens
tcttactaaacattttgttattgg

SEQ ID NO: 4312342 - DNA, 18 bp, Homo sapiens
tcttagaagaatattgta

SEQ ID NO: 4312343 - DNA, 19 bp, Homo sapiens
tcttagaagaatattgtat

SEQ ID NO: 4312344 - DNA, 20 bp, Homo sapiens
tcttagaagaatattgtatt

SEQ ID NO: 4312345 - DNA, 20 bp, Homo sapiens
tcttatacagataaaacatg

SEQ ID NO: 4312346 - DNA, 16 bp, Homo sapiens
tcttatttatatatga

SEQ ID NO: 4312347 - DNA, 17 bp, Homo sapiens
tcttatttatatatgaa

SEQ ID NO: 4312348 - DNA, 19 bp, Homo sapiens
tcttatttatatatgaagt

SEQ ID NO: 4312349 - DNA, 20 bp, Homo sapiens
tcttcatgtaaattgactgt

SEQ ID NO: 4312350 - DNA, 23 bp, Homo sapiens
tcttcatgtaaattgactgtact

SEQ ID NO: 4312351 - DNA, 17 bp, Homo sapiens
tcttccatcagcagtga

SEQ ID NO: 4312352 - DNA, 22 bp, Homo sapiens
tcttcccaaagcaagcacctgg

SEQ ID NO: 4312353 - DNA, 14 bp, Homo sapiens
tcttcccccttccc

SEQ ID NO: 4312354 - DNA, 24 bp, Homo sapiens
tcttcccccttcccctgcgccctc

SEQ ID NO: 4312355 - DNA, 16 bp, Homo sapiens
tcttgaagaatattgt

SEQ ID NO: 4312356 - DNA, 18 bp, Homo sapiens
tcttgagtgggccccctc

SEQ ID NO: 4312357 - DNA, 22 bp, Homo sapiens
tcttgcataagcctcaggcctg

SEQ ID NO: 4312358 - DNA, 13 bp, Homo sapiens
tcttgctttcaca

SEQ ID NO: 4312359 - DNA, 17 bp, Homo sapiens
tcttgctttcacaaata

SEQ ID NO: 4312360 - DNA, 18 bp, Homo sapiens
tcttgctttcacaaatat

SEQ ID NO: 4312361 - DNA, 21 bp, Homo sapiens
tcttgctttcacaaatatagt

SEQ ID NO: 4312362 - DNA, 17 bp, Homo sapiens
tcttggatctttttgca

SEQ ID NO: 4312363 - DNA, 16 bp, Homo sapiens
tcttggctggcttcct

SEQ ID NO: 4312364 - DNA, 21 bp, Homo sapiens
tcttggttttgtattgtttaa

SEQ ID NO: 4312365 - DNA, 13 bp, Homo sapiens
tcttgtattttct

SEQ ID NO: 4312366 - DNA, 15 bp, Homo sapiens
tcttgtgttgttttc

SEQ ID NO: 4312367 - DNA, 18 bp, Homo sapiens
tcttgtgttgttttctct

SEQ ID NO: 4312368 - DNA, 20 bp, Homo sapiens
tcttgtgttgttttctctga

SEQ ID NO: 4312369 - DNA, 14 bp, Homo sapiens
tcttgttgataaaa

SEQ ID NO: 4312370 - DNA, 18 bp, Homo sapiens
tctttataaatgcaaatg

SEQ ID NO: 4312371 - DNA, 14 bp, Homo sapiens
tctttattgtctgt

SEQ ID NO: 4312372 - DNA, 13 bp, Homo sapiens
tctttcatctagc

SEQ ID NO: 4312373 - DNA, 21 bp, Homo sapiens
tctttccaaattgatgggtgg

SEQ ID NO: 4312374 - DNA, 22 bp, Homo sapiens
tctttcctttcatcctcagcaa

SEQ ID NO: 4312375 - DNA, 15 bp, Homo sapiens
tctttgattgtgaaa

SEQ ID NO: 4312376 - DNA, 13 bp, Homo sapiens
tctttggcttcag

SEQ ID NO: 4312377 - DNA, 17 bp, Homo sapiens
tctttgggggattcaaa

SEQ ID NO: 4312378 - DNA, 19 bp, Homo sapiens
tctttgggggattcaaatg

SEQ ID NO: 4312379 - DNA, 21 bp, Homo sapiens
tctttggtgttctggcctctg

SEQ ID NO: 4312380 - DNA, 16 bp, Homo sapiens
tctttgtaaggacttg

SEQ ID NO: 4312381 - DNA, 18 bp, Homo sapiens
tctttgtaaggacttgtg

SEQ ID NO: 4312382 - DNA, 22 bp, Homo sapiens
tctttgtaaggacttgtgcctc

SEQ ID NO: 4312383 - DNA, 21 bp, Homo sapiens
tcttttaatgatactgtctaa

SEQ ID NO: 4312384 - DNA, 15 bp, Homo sapiens
tcttttatatctgta

SEQ ID NO: 4312385 - DNA, 19 bp, Homo sapiens
tcttttatatctgtaaatt

SEQ ID NO: 4312386 - DNA, 18 bp, Homo sapiens
tcttttcagcttgtttct

SEQ ID NO: 4312387 - DNA, 21 bp, Homo sapiens
tcttttcagcttgtttctata

SEQ ID NO: 4312388 - DNA, 21 bp, Homo sapiens
tcttttgtcctgcatcatctt

SEQ ID NO: 4312389 - DNA, 14 bp, Homo sapiens
tgaaaaacagcaga

SEQ ID NO: 4312390 - DNA, 12 bp, Homo sapiens
tgaaaactggaa

SEQ ID NO: 4312391 - DNA, 17 bp, Homo sapiens
tgaaaagaaatgctaat

SEQ ID NO: 4312392 - DNA, 22 bp, Homo sapiens
tgaaaagaagaaagtctatgct

SEQ ID NO: 4312393 - DNA, 16 bp, Homo sapiens
tgaaaagatgttgtgt

SEQ ID NO: 4312394 - DNA, 20 bp, Homo sapiens
tgaaaagctcacttcaagct

SEQ ID NO: 4312395 - DNA, 21 bp, Homo sapiens
tgaaaatatttttttctagct

SEQ ID NO: 4312396 - DNA, 14 bp, Homo sapiens
tgaaacacagctgt

SEQ ID NO: 4312397 - DNA, 21 bp, Homo sapiens
tgaaaccagaagactggatca

SEQ ID NO: 4312398 - DNA, 16 bp, Homo sapiens
tgaaacttacacacaa

SEQ ID NO: 4312399 - DNA, 15 bp, Homo sapiens
tgaaagacagtaaag

SEQ ID NO: 4312400 - DNA, 13 bp, Homo sapiens
tgaaagctgcttc

SEQ ID NO: 4312401 - DNA, 18 bp, Homo sapiens
tgaaaggtagacttttat

SEQ ID NO: 4312402 - DNA, 21 bp, Homo sapiens
tgaaagtatcaccaaaaaatc

SEQ ID NO: 4312403 - DNA, 21 bp, Homo sapiens
tgaaagtcagtttaagaggct

SEQ ID NO: 4312404 - DNA, 17 bp, Homo sapiens
tgaaagtgtaaaataga

SEQ ID NO: 4312405 - DNA, 22 bp, Homo sapiens
tgaaatacatatgataaatttg

SEQ ID NO: 4312406 - DNA, 21 bp, Homo sapiens
tgaaataggagggaaaccttt

SEQ ID NO: 4312407 - DNA, 19 bp, Homo sapiens
tgaaatatatgtgaaagga

SEQ ID NO: 4312408 - DNA, 14 bp, Homo sapiens
tgaaatatttgctt

SEQ ID NO: 4312409 - DNA, 17 bp, Homo sapiens
tgaaatatttgcttatt

SEQ ID NO: 4312410 - DNA, 21 bp, Homo sapiens
tgaaatgttaacaatgcctat

SEQ ID NO: 4312411 - DNA, 14 bp, Homo sapiens
tgaaattatatctg

SEQ ID NO: 4312412 - DNA, 15 bp, Homo sapiens
tgaaattatatctgt

SEQ ID NO: 4312413 - DNA, 14 bp, Homo sapiens
tgaaatttgttaat

SEQ ID NO: 4312414 - DNA, 16 bp, Homo sapiens
tgaaatttgttaatat

SEQ ID NO: 4312415 - DNA, 20 bp, Homo sapiens
tgaacgatccttcaaagtct

SEQ ID NO: 4312416 - DNA, 17 bp, Homo sapiens
tgaactaggtgctggca

SEQ ID NO: 4312417 - DNA, 15 bp, Homo sapiens
tgaactgcaacactg

SEQ ID NO: 4312418 - DNA, 17 bp, Homo sapiens
tgaactgcaacactgga

SEQ ID NO: 4312419 - DNA, 15 bp, Homo sapiens
tgaagaagggaaatt

SEQ ID NO: 4312420 - DNA, 11 bp, Homo sapiens
tgaagaatatt

SEQ ID NO: 4312421 - DNA, 19 bp, Homo sapiens
tgaagacacgcccgactct

SEQ ID NO: 4312422 - DNA, 23 bp, Homo sapiens
tgaagacacgcccgactctctcc

SEQ ID NO: 4312423 - DNA, 21 bp, Homo sapiens
tgaagagagatatatctgaaa

SEQ ID NO: 4312424 - DNA, 15 bp, Homo sapiens
tgaagagctagagaa

SEQ ID NO: 4312425 - DNA, 23 bp, Homo sapiens
tgaagataaatccaactctgact

SEQ ID NO: 4312426 - DNA, 15 bp, Homo sapiens
tgaagattcaggctt

SEQ ID NO: 4312427 - DNA, 18 bp, Homo sapiens
tgaagcattctccccagt

SEQ ID NO: 4312428 - DNA, 14 bp, Homo sapiens
tgaagcccaggagg

SEQ ID NO: 4312429 - DNA, 18 bp, Homo sapiens
tgaaggattttaaatgct

SEQ ID NO: 4312430 - DNA, 14 bp, Homo sapiens
tgaaggctgtacac

SEQ ID NO: 4312431 - DNA, 19 bp, Homo sapiens
tgaagggcaggtgcttcag

SEQ ID NO: 4312432 - DNA, 15 bp, Homo sapiens
tgaaggtgccagacg

SEQ ID NO: 4312433 - DNA, 23 bp, Homo sapiens
tgaagtaagttctgaaaactgtt

SEQ ID NO: 4312434 - DNA, 17 bp, Homo sapiens
tgaagtatctgtacctg

SEQ ID NO: 4312435 - DNA, 15 bp, Homo sapiens
tgaagtcactgcaca

SEQ ID NO: 4312436 - DNA, 22 bp, Homo sapiens
tgaagtccagtgaccctggagc

SEQ ID NO: 4312437 - DNA, 23 bp, Homo sapiens
tgaagtccagtgaccctggagct

SEQ ID NO: 4312438 - DNA, 13 bp, Homo sapiens
tgaagtgaataca

SEQ ID NO: 4312439 - DNA, 18 bp, Homo sapiens
tgaagtgaatacatggta

SEQ ID NO: 4312440 - DNA, 15 bp, Homo sapiens
tgaagtgaccccagc

SEQ ID NO: 4312441 - DNA, 17 bp, Homo sapiens
tgaagtgaccccagctc

SEQ ID NO: 4312442 - DNA, 18 bp, Homo sapiens
tgaagtgatgatggatga

SEQ ID NO: 4312443 - DNA, 21 bp, Homo sapiens
tgaataatgcctttgtaacca

SEQ ID NO: 4312444 - DNA, 22 bp, Homo sapiens
tgaataattatgtttacctcac

SEQ ID NO: 4312445 - DNA, 18 bp, Homo sapiens
tgaatacatggtagcagg

SEQ ID NO: 4312446 - DNA, 14 bp, Homo sapiens
tgaatataaatgtg

SEQ ID NO: 4312447 - DNA, 19 bp, Homo sapiens
tgaatataaatgtgtgtat

SEQ ID NO: 4312448 - DNA, 22 bp, Homo sapiens
tgaatataaatgtgtgtatgtg

SEQ ID NO: 4312449 - DNA, 16 bp, Homo sapiens
tgaatatattttatct

SEQ ID NO: 4312450 - DNA, 14 bp, Homo sapiens
tgaatcctctctct

SEQ ID NO: 4312451 - DNA, 21 bp, Homo sapiens
tgaatcctctctctgtgttac

SEQ ID NO: 4312452 - DNA, 19 bp, Homo sapiens
tgaatctgagagatgctgt

SEQ ID NO: 4312453 - DNA, 20 bp, Homo sapiens
tgaatgctgtacctttctga

SEQ ID NO: 4312454 - DNA, 13 bp, Homo sapiens
tgaatgtatgtaa

SEQ ID NO: 4312455 - DNA, 19 bp, Homo sapiens
tgaatgtccccattctata

SEQ ID NO: 4312456 - DNA, 16 bp, Homo sapiens
tgaattacagggaaga

SEQ ID NO: 4312457 - DNA, 23 bp, Homo sapiens
tgaattttttttttaaatgattc

SEQ ID NO: 4312458 - DNA, 16 bp, Homo sapiens
tgacaaccaccgctcc

SEQ ID NO: 4312459 - DNA, 23 bp, Homo sapiens
tgacaaccaccgctccccagccc

SEQ ID NO: 4312460 - DNA, 15 bp, Homo sapiens
tgacaaggccccaga

SEQ ID NO: 4312461 - DNA, 17 bp, Homo sapiens
tgacaaggccccagaga

SEQ ID NO: 4312462 - DNA, 15 bp, Homo sapiens
tgacaatttcaaaat

SEQ ID NO: 4312463 - DNA, 17 bp, Homo sapiens
tgacaatttcaaaatgc

SEQ ID NO: 4312464 - DNA, 21 bp, Homo sapiens
tgacaatttcaaaatgcatgt

SEQ ID NO: 4312465 - DNA, 17 bp, Homo sapiens
tgacacataaatctgtc

SEQ ID NO: 4312466 - DNA, 18 bp, Homo sapiens
tgacacataaatctgtct

SEQ ID NO: 4312467 - DNA, 19 bp, Homo sapiens
tgacacattgcacacacag

SEQ ID NO: 4312468 - DNA, 21 bp, Homo sapiens
tgacactggaagggtccggct

SEQ ID NO: 4312469 - DNA, 22 bp, Homo sapiens
tgacagcactaaacttggtgct

SEQ ID NO: 4312470 - DNA, 13 bp, Homo sapiens
tgacatgcacagt

SEQ ID NO: 4312471 - DNA, 16 bp, Homo sapiens
tgacatttctcaaagt

SEQ ID NO: 4312472 - DNA, 15 bp, Homo sapiens
tgaccacacttcctg

SEQ ID NO: 4312473 - DNA, 20 bp, Homo sapiens
tgaccacacttcctgtccag

SEQ ID NO: 4312474 - DNA, 13 bp, Homo sapiens
tgaccataaaatt

SEQ ID NO: 4312475 - DNA, 19 bp, Homo sapiens
tgaccatgcattttaccat

SEQ ID NO: 4312476 - DNA, 16 bp, Homo sapiens
tgacccattcacattt

SEQ ID NO: 4312477 - DNA, 19 bp, Homo sapiens
tgaccccacttatgctgct

SEQ ID NO: 4312478 - DNA, 20 bp, Homo sapiens
tgaccccacttatgctgctg

SEQ ID NO: 4312479 - DNA, 23 bp, Homo sapiens
tgaccccacttatgctgctgtga

SEQ ID NO: 4312480 - DNA, 12 bp, Homo sapiens
tgaccccagctc

SEQ ID NO: 4312481 - DNA, 18 bp, Homo sapiens
tgacccctcatctgaaag

SEQ ID NO: 4312482 - DNA, 14 bp, Homo sapiens
tgacccggaggcca

SEQ ID NO: 4312483 - DNA, 21 bp, Homo sapiens
tgacccggaggccacatgagt

SEQ ID NO: 4312484 - DNA, 23 bp, Homo sapiens
tgacccggcccccgccctctgcc

SEQ ID NO: 4312485 - DNA, 16 bp, Homo sapiens
tgaccctggagctagg

SEQ ID NO: 4312486 - DNA, 19 bp, Homo sapiens
tgacctaaatccattttct

SEQ ID NO: 4312487 - DNA, 17 bp, Homo sapiens
tgacctgatttccattt

SEQ ID NO: 4312488 - DNA, 21 bp, Homo sapiens
tgacctgtggggatttctccc

SEQ ID NO: 4312489 - DNA, 22 bp, Homo sapiens
tgacctgtggggatttctccca

SEQ ID NO: 4312490 - DNA, 20 bp, Homo sapiens
tgaccttgatgtcttgagag

SEQ ID NO: 4312491 - DNA, 16 bp, Homo sapiens
tgacctttaggtatta

SEQ ID NO: 4312492 - DNA, 20 bp, Homo sapiens
tgacgggggttggggtgggg

SEQ ID NO: 4312493 - DNA, 18 bp, Homo sapiens
tgacgtattgtgaaattt

SEQ ID NO: 4312494 - DNA, 20 bp, Homo sapiens
tgacgtattgtgaaatttgt

SEQ ID NO: 4312495 - DNA, 19 bp, Homo sapiens
tgacgtctagctatgctgt

SEQ ID NO: 4312496 - DNA, 16 bp, Homo sapiens
tgactccaaccattca

SEQ ID NO: 4312497 - DNA, 11 bp, Homo sapiens
tgactccagga

SEQ ID NO: 4312498 - DNA, 17 bp, Homo sapiens
tgactctttattgtctg

SEQ ID NO: 4312499 - DNA, 22 bp, Homo sapiens
tgactgaacgatccttcaaagt

SEQ ID NO: 4312500 - DNA, 23 bp, Homo sapiens
tgactgctgcgctgtgctggtct

SEQ ID NO: 4312501 - DNA, 18 bp, Homo sapiens
tgactgtactcctcccag

SEQ ID NO: 4312502 - DNA, 22 bp, Homo sapiens
tgactgtactcctcccaggcgc

SEQ ID NO: 4312503 - DNA, 14 bp, Homo sapiens
tgagaaaactgtga

SEQ ID NO: 4312504 - DNA, 19 bp, Homo sapiens
tgagaatcgacctcactgt

SEQ ID NO: 4312505 - DNA, 14 bp, Homo sapiens
tgagaattaaaata

SEQ ID NO: 4312506 - DNA, 23 bp, Homo sapiens
tgagacacacaacggcagtgaag

SEQ ID NO: 4312507 - DNA, 14 bp, Homo sapiens
tgagagtggggcta

SEQ ID NO: 4312508 - DNA, 22 bp, Homo sapiens
tgagatactttgcattgtctgt

SEQ ID NO: 4312509 - DNA, 16 bp, Homo sapiens
tgagatcagcattcaa

SEQ ID NO: 4312510 - DNA, 18 bp, Homo sapiens
tgagatcagcattcaaaa

SEQ ID NO: 4312511 - DNA, 16 bp, Homo sapiens
tgagatgatttccaag

SEQ ID NO: 4312512 - DNA, 19 bp, Homo sapiens
tgagatggtgccccctggg

SEQ ID NO: 4312513 - DNA, 20 bp, Homo sapiens
tgagatgtgtatcagtgttt

SEQ ID NO: 4312514 - DNA, 19 bp, Homo sapiens
tgagattctaaatgttcat

SEQ ID NO: 4312515 - DNA, 13 bp, Homo sapiens
tgagcaaggcaag

SEQ ID NO: 4312516 - DNA, 20 bp, Homo sapiens
tgagcaaggcaagaagtggg

SEQ ID NO: 4312517 - DNA, 17 bp, Homo sapiens
tgagcagggtgacccct

SEQ ID NO: 4312518 - DNA, 16 bp, Homo sapiens
tgagcagtgttagctt

SEQ ID NO: 4312519 - DNA, 15 bp, Homo sapiens
tgagccaaagagaaa

SEQ ID NO: 4312520 - DNA, 18 bp, Homo sapiens
tgagccaaggggtctgct

SEQ ID NO: 4312521 - DNA, 20 bp, Homo sapiens
tgagccaaggggtctgctcc

SEQ ID NO: 4312522 - DNA, 22 bp, Homo sapiens
tgagccaaggggtctgctcctg

SEQ ID NO: 4312523 - DNA, 12 bp, Homo sapiens
tgagcccactcc

SEQ ID NO: 4312524 - DNA, 13 bp, Homo sapiens
tgagcccactcct

SEQ ID NO: 4312525 - DNA, 20 bp, Homo sapiens
tgagccccgccgtgtctgtg

SEQ ID NO: 4312526 - DNA, 23 bp, Homo sapiens
tgagccccgccgtgtctgtggcc

SEQ ID NO: 4312527 - DNA, 14 bp, Homo sapiens
tgagccgtgacctc

SEQ ID NO: 4312528 - DNA, 13 bp, Homo sapiens
tgagctccagacc

SEQ ID NO: 4312529 - DNA, 15 bp, Homo sapiens
tgagctccagacccc

SEQ ID NO: 4312530 - DNA, 17 bp, Homo sapiens
tgagctccagaccccca

SEQ ID NO: 4312531 - DNA, 19 bp, Homo sapiens
tgagctccagacccccagc

SEQ ID NO: 4312532 - DNA, 20 bp, Homo sapiens
tgagctccccaatccaaccc

SEQ ID NO: 4312533 - DNA, 15 bp, Homo sapiens
tgagctcttcatgtt

SEQ ID NO: 4312534 - DNA, 15 bp, Homo sapiens
tgagctcttggcagg

SEQ ID NO: 4312535 - DNA, 13 bp, Homo sapiens
tgagctgtgccag

SEQ ID NO: 4312536 - DNA, 23 bp, Homo sapiens
tgagctgtgccagctgcttctgc

SEQ ID NO: 4312537 - DNA, 21 bp, Homo sapiens
tgagcttgattctaaagggga

SEQ ID NO: 4312538 - DNA, 14 bp, Homo sapiens
tgagcttggccaga

SEQ ID NO: 4312539 - DNA, 15 bp, Homo sapiens
tgagcttggccagaa

SEQ ID NO: 4312540 - DNA, 20 bp, Homo sapiens
tgaggacctccacctgggag

SEQ ID NO: 4312541 - DNA, 19 bp, Homo sapiens
tgaggagcagcccacctgc

SEQ ID NO: 4312542 - DNA, 21 bp, Homo sapiens
tgaggagcagcccacctgctg

SEQ ID NO: 4312543 - DNA, 17 bp, Homo sapiens
tgaggagctcagggctg

SEQ ID NO: 4312544 - DNA, 11 bp, Homo sapiens
tgaggaggggg

SEQ ID NO: 4312545 - DNA, 16 bp, Homo sapiens
tgaggagggggagaag

SEQ ID NO: 4312546 - DNA, 13 bp, Homo sapiens
tgaggatgatgta

SEQ ID NO: 4312547 - DNA, 21 bp, Homo sapiens
tgaggcaaccccctcggagcc

SEQ ID NO: 4312548 - DNA, 22 bp, Homo sapiens
tgaggcaaccccctcggagcct

SEQ ID NO: 4312549 - DNA, 14 bp, Homo sapiens
tgaggccagaggaa

SEQ ID NO: 4312550 - DNA, 15 bp, Homo sapiens
tgaggccagaggaag

SEQ ID NO: 4312551 - DNA, 23 bp, Homo sapiens
tgaggccagaggaagggaggcct

SEQ ID NO: 4312552 - DNA, 14 bp, Homo sapiens
tgaggcccagggag

SEQ ID NO: 4312553 - DNA, 17 bp, Homo sapiens
tgaggcccagggagagg

SEQ ID NO: 4312554 - DNA, 14 bp, Homo sapiens
tgagggaggcctga

SEQ ID NO: 4312555 - DNA, 23 bp, Homo sapiens
tgaggggaaaccttcacccagca

SEQ ID NO: 4312556 - DNA, 18 bp, Homo sapiens
tgaggggcctgccactct

SEQ ID NO: 4312557 - DNA, 22 bp, Homo sapiens
tgagggtgacagagggacagtg

SEQ ID NO: 4312558 - DNA, 23 bp, Homo sapiens
tgagggtgacagagggacagtgg

SEQ ID NO: 4312559 - DNA, 13 bp, Homo sapiens
tgaggtcatcccg

SEQ ID NO: 4312560 - DNA, 13 bp, Homo sapiens
tgagtcccagtgg

SEQ ID NO: 4312561 - DNA, 16 bp, Homo sapiens
tgagtcccagtgggag

SEQ ID NO: 4312562 - DNA, 18 bp, Homo sapiens
tgagtgacatgcggctgc

SEQ ID NO: 4312563 - DNA, 22 bp, Homo sapiens
tgagtggtccacattctgctgc

SEQ ID NO: 4312564 - DNA, 21 bp, Homo sapiens
tgagtgtgacgggggttgggg

SEQ ID NO: 4312565 - DNA, 12 bp, Homo sapiens
tgagtttatggg

SEQ ID NO: 4312566 - DNA, 22 bp, Homo sapiens
tgagtttatgggaatgcctttt

SEQ ID NO: 4312567 - DNA, 13 bp, Homo sapiens
tgataaaaatact

SEQ ID NO: 4312568 - DNA, 17 bp, Homo sapiens
tgataaatttgactgtt

SEQ ID NO: 4312569 - DNA, 18 bp, Homo sapiens
tgataagtggaaaaaaga

SEQ ID NO: 4312570 - DNA, 14 bp, Homo sapiens
tgatactgtctaag

SEQ ID NO: 4312571 - DNA, 17 bp, Homo sapiens
tgatactgtctaagaat

SEQ ID NO: 4312572 - DNA, 19 bp, Homo sapiens
tgatattttcaacgcagcc

SEQ ID NO: 4312573 - DNA, 21 bp, Homo sapiens
tgatattttcaacgcagccct

SEQ ID NO: 4312574 - DNA, 23 bp, Homo sapiens
tgatattttcaacgcagccctgc

SEQ ID NO: 4312575 - DNA, 17 bp, Homo sapiens
tgatcgatgttaaacgt

SEQ ID NO: 4312576 - DNA, 19 bp, Homo sapiens
tgatcgatgttaaacgtca

SEQ ID NO: 4312577 - DNA, 18 bp, Homo sapiens
tgatgaagaaaagtgggc

SEQ ID NO: 4312578 - DNA, 22 bp, Homo sapiens
tgatgaatcagtcctagaatgt

SEQ ID NO: 4312579 - DNA, 15 bp, Homo sapiens
tgatgaccaatctct

SEQ ID NO: 4312580 - DNA, 17 bp, Homo sapiens
tgatgaccaatctctgt

SEQ ID NO: 4312581 - DNA, 18 bp, Homo sapiens
tgatgaccaatctctgtg

SEQ ID NO: 4312582 - DNA, 16 bp, Homo sapiens
tgatgatttcagaaac

SEQ ID NO: 4312583 - DNA, 14 bp, Homo sapiens
tgatggccaggcct

SEQ ID NO: 4312584 - DNA, 23 bp, Homo sapiens
tgatggtagaaattttatctctt

SEQ ID NO: 4312585 - DNA, 15 bp, Homo sapiens
tgatgtcttgagagc

SEQ ID NO: 4312586 - DNA, 20 bp, Homo sapiens
tgatgtcttgagagcgctgg

SEQ ID NO: 4312587 - DNA, 19 bp, Homo sapiens
tgatgtgctcatcagaaac

SEQ ID NO: 4312588 - DNA, 17 bp, Homo sapiens
tgatgtggagtggggca

SEQ ID NO: 4312589 - DNA, 21 bp, Homo sapiens
tgattaatttctgccatttca

SEQ ID NO: 4312590 - DNA, 22 bp, Homo sapiens
tgattaatttctgccatttcat

SEQ ID NO: 4312591 - DNA, 19 bp, Homo sapiens
tgattagctttgtcactgt

SEQ ID NO: 4312592 - DNA, 12 bp, Homo sapiens
tgattcataaca

SEQ ID NO: 4312593 - DNA, 23 bp, Homo sapiens
tgattcataacaatgtatgtgaa

SEQ ID NO: 4312594 - DNA, 22 bp, Homo sapiens
tgattcattttaacatctgaga

SEQ ID NO: 4312595 - DNA, 20 bp, Homo sapiens
tgattccaagggcccagagg

SEQ ID NO: 4312596 - DNA, 18 bp, Homo sapiens
tgattccccggagctggg

SEQ ID NO: 4312597 - DNA, 16 bp, Homo sapiens
tgattctcctctccca

SEQ ID NO: 4312598 - DNA, 19 bp, Homo sapiens
tgattgaagtatctgtacc

SEQ ID NO: 4312599 - DNA, 22 bp, Homo sapiens
tgattgaatctgattggacatt

SEQ ID NO: 4312600 - DNA, 22 bp, Homo sapiens
tgattggcagcttcaaaacaga

SEQ ID NO: 4312601 - DNA, 13 bp, Homo sapiens
tgatttaaacttc

SEQ ID NO: 4312602 - DNA, 21 bp, Homo sapiens
tgatttaaacttcttaactgg

SEQ ID NO: 4312603 - DNA, 14 bp, Homo sapiens
tgatttaagcattt

SEQ ID NO: 4312604 - DNA, 15 bp, Homo sapiens
tgatttaagcatttt

SEQ ID NO: 4312605 - DNA, 18 bp, Homo sapiens
tgatttaagcattttact

SEQ ID NO: 4312606 - DNA, 16 bp, Homo sapiens
tgatttacgctcattg

SEQ ID NO: 4312607 - DNA, 12 bp, Homo sapiens
tgatttattctg

SEQ ID NO: 4312608 - DNA, 17 bp, Homo sapiens
tgatttccgtcatgctc

SEQ ID NO: 4312609 - DNA, 17 bp, Homo sapiens
tgatttgcaactttaga

SEQ ID NO: 4312610 - DNA, 16 bp, Homo sapiens
tgattttagatttctt

SEQ ID NO: 4312611 - DNA, 19 bp, Homo sapiens
tgattttagccttctctgt

SEQ ID NO: 4312612 - DNA, 14 bp, Homo sapiens
tgatttttgttgat

SEQ ID NO: 4312613 - DNA, 14 bp, Homo sapiens
tgattttttacaaa

SEQ ID NO: 4312614 - DNA, 21 bp, Homo sapiens
tgattttttacaaattatgtt

SEQ ID NO: 4312615 - DNA, 19 bp, Homo sapiens
tgcaaaaggttaagccata

SEQ ID NO: 4312616 - DNA, 23 bp, Homo sapiens
tgcaaaatacatgatgatttcag

SEQ ID NO: 4312617 - DNA, 22 bp, Homo sapiens
tgcaaacatggggttggctggg

SEQ ID NO: 4312618 - DNA, 14 bp, Homo sapiens
tgcaaagcacacct

SEQ ID NO: 4312619 - DNA, 15 bp, Homo sapiens
tgcaaatagtttcaa

SEQ ID NO: 4312620 - DNA, 18 bp, Homo sapiens
tgcaaatagtttcaaatg

SEQ ID NO: 4312621 - DNA, 17 bp, Homo sapiens
tgcaaatgcacatttgt

SEQ ID NO: 4312622 - DNA, 12 bp, Homo sapiens
tgcaacacacag

SEQ ID NO: 4312623 - DNA, 13 bp, Homo sapiens
tgcaacacacaga

SEQ ID NO: 4312624 - DNA, 19 bp, Homo sapiens
tgcaactttagaaagaaat

SEQ ID NO: 4312625 - DNA, 15 bp, Homo sapiens
tgcaagaagaatata

SEQ ID NO: 4312626 - DNA, 20 bp, Homo sapiens
tgcaagattctgtgggcagc

SEQ ID NO: 4312627 - DNA, 21 bp, Homo sapiens
tgcaagtatgttttagcatgt

SEQ ID NO: 4312628 - DNA, 15 bp, Homo sapiens
tgcaagtcccaggga

SEQ ID NO: 4312629 - DNA, 23 bp, Homo sapiens
tgcaagtggacgtgggctccagg

SEQ ID NO: 4312630 - DNA, 17 bp, Homo sapiens
tgcaagtggttaagaat

SEQ ID NO: 4312631 - DNA, 23 bp, Homo sapiens
tgcaataaactcagtcaaatgta

SEQ ID NO: 4312632 - DNA, 14 bp, Homo sapiens
tgcaatatgagggg

SEQ ID NO: 4312633 - DNA, 21 bp, Homo sapiens
tgcaatatgaggggactgcat

SEQ ID NO: 4312634 - DNA, 12 bp, Homo sapiens
tgcaatatgtaa

SEQ ID NO: 4312635 - DNA, 17 bp, Homo sapiens
tgcaatatgtaacatgt

SEQ ID NO: 4312636 - DNA, 17 bp, Homo sapiens
tgcaatccatgtatctg

SEQ ID NO: 4312637 - DNA, 15 bp, Homo sapiens
tgcacacaattagat

SEQ ID NO: 4312638 - DNA, 13 bp, Homo sapiens
tgcacacccctgc

SEQ ID NO: 4312639 - DNA, 24 bp, Homo sapiens
tgcacagcccctaagtcaacttag

SEQ ID NO: 4312640 - DNA, 12 bp, Homo sapiens
tgcacagctgtc

SEQ ID NO: 4312641 - DNA, 13 bp, Homo sapiens
tgcacagctgtcc

SEQ ID NO: 4312642 - DNA, 17 bp, Homo sapiens
tgcacagtgcatctcag

SEQ ID NO: 4312643 - DNA, 17 bp, Homo sapiens
tgcacatggattcagtt

SEQ ID NO: 4312644 - DNA, 21 bp, Homo sapiens
tgcacattaggaacagagtat

SEQ ID NO: 4312645 - DNA, 17 bp, Homo sapiens
tgcaccaacctcactgc

SEQ ID NO: 4312646 - DNA, 19 bp, Homo sapiens
tgcaccaacctcactgccc

SEQ ID NO: 4312647 - DNA, 13 bp, Homo sapiens
tgcacccgtgcca

SEQ ID NO: 4312648 - DNA, 14 bp, Homo sapiens
tgcacctataaata

SEQ ID NO: 4312649 - DNA, 14 bp, Homo sapiens
tgcacgtgcacaca

SEQ ID NO: 4312650 - DNA, 16 bp, Homo sapiens
tgcacgtgcacacacc

SEQ ID NO: 4312651 - DNA, 23 bp, Homo sapiens
tgcacgtgcacacacctgcacac

SEQ ID NO: 4312652 - DNA, 16 bp, Homo sapiens
tgcactgcaaatactt

SEQ ID NO: 4312653 - DNA, 16 bp, Homo sapiens
tgcactggccttctga

SEQ ID NO: 4312654 - DNA, 21 bp, Homo sapiens
tgcactggccttctgatgaaa

SEQ ID NO: 4312655 - DNA, 14 bp, Homo sapiens
tgcacttcttacaa

SEQ ID NO: 4312656 - DNA, 17 bp, Homo sapiens
tgcactttatcttggga

SEQ ID NO: 4312657 - DNA, 18 bp, Homo sapiens
tgcagaagaaactcctgg

SEQ ID NO: 4312658 - DNA, 21 bp, Homo sapiens
tgcagaatacagtaagctgct

SEQ ID NO: 4312659 - DNA, 20 bp, Homo sapiens
tgcagaccacactctgcctg

SEQ ID NO: 4312660 - DNA, 11 bp, Homo sapiens
tgcagacctgg

SEQ ID NO: 4312661 - DNA, 14 bp, Homo sapiens
tgcagacctgggac

SEQ ID NO: 4312662 - DNA, 14 bp, Homo sapiens
tgcagactcactgt

SEQ ID NO: 4312663 - DNA, 19 bp, Homo sapiens
tgcagcacattgccctgag

SEQ ID NO: 4312664 - DNA, 22 bp, Homo sapiens
tgcagcacattgccctgagggg

SEQ ID NO: 4312665 - DNA, 14 bp, Homo sapiens
tgcagccccaggcc

SEQ ID NO: 4312666 - DNA, 21 bp, Homo sapiens
tgcagcccgtgtggccccttc

SEQ ID NO: 4312667 - DNA, 20 bp, Homo sapiens
tgcagccggggagctgaggg

SEQ ID NO: 4312668 - DNA, 22 bp, Homo sapiens
tgcagcttcaggtgagccaagg

SEQ ID NO: 4312669 - DNA, 15 bp, Homo sapiens
tgcaggaatcaaaaa

SEQ ID NO: 4312670 - DNA, 19 bp, Homo sapiens
tgcaggaatcaaaaattga

SEQ ID NO: 4312671 - DNA, 20 bp, Homo sapiens
tgcaggaatcaaaaattgaa

SEQ ID NO: 4312672 - DNA, 15 bp, Homo sapiens
tgcaggcagcctgca

SEQ ID NO: 4312673 - DNA, 22 bp, Homo sapiens
tgcaggcggtatccagaggtga

SEQ ID NO: 4312674 - DNA, 18 bp, Homo sapiens
tgcaggctggcaccgcct

SEQ ID NO: 4312675 - DNA, 14 bp, Homo sapiens
tgcagggagcagca

SEQ ID NO: 4312676 - DNA, 14 bp, Homo sapiens
tgcagggcagcctg

SEQ ID NO: 4312677 - DNA, 15 bp, Homo sapiens
tgcagggcagcctgt

SEQ ID NO: 4312678 - DNA, 18 bp, Homo sapiens
tgcagggcagcctgtggg

SEQ ID NO: 4312679 - DNA, 23 bp, Homo sapiens
tgcagtatccgcgagcctgcttg

SEQ ID NO: 4312680 - DNA, 18 bp, Homo sapiens
tgcagtcacccctgtctg

SEQ ID NO: 4312681 - DNA, 14 bp, Homo sapiens
tgcagtcagcacag

SEQ ID NO: 4312682 - DNA, 15 bp, Homo sapiens
tgcagtcatcagaag

SEQ ID NO: 4312683 - DNA, 14 bp, Homo sapiens
tgcagtggcaaagg

SEQ ID NO: 4312684 - DNA, 12 bp, Homo sapiens
tgcagttgctgt

SEQ ID NO: 4312685 - DNA, 15 bp, Homo sapiens
tgcagttggcctcag

SEQ ID NO: 4312686 - DNA, 17 bp, Homo sapiens
tgcagttggcctcagca

SEQ ID NO: 4312687 - DNA, 20 bp, Homo sapiens
tgcatatcctggtgtctagt

SEQ ID NO: 4312688 - DNA, 14 bp, Homo sapiens
tgcatcctcagccc

SEQ ID NO: 4312689 - DNA, 15 bp, Homo sapiens
tgcatcctcagcccc

SEQ ID NO: 4312690 - DNA, 18 bp, Homo sapiens
tgcatcctcagccccagg

SEQ ID NO: 4312691 - DNA, 19 bp, Homo sapiens
tgcatcctcagccccaggg

SEQ ID NO: 4312692 - DNA, 17 bp, Homo sapiens
tgcatgatattgtatgt

SEQ ID NO: 4312693 - DNA, 13 bp, Homo sapiens
tgcatgctcctct

SEQ ID NO: 4312694 - DNA, 15 bp, Homo sapiens
tgcatgctcctctgc

SEQ ID NO: 4312695 - DNA, 16 bp, Homo sapiens
tgcatgctcctctgcc

SEQ ID NO: 4312696 - DNA, 17 bp, Homo sapiens
tgcatgctcctctgcct

SEQ ID NO: 4312697 - DNA, 23 bp, Homo sapiens
tgcatgctcctctgcctgtgccc

SEQ ID NO: 4312698 - DNA, 23 bp, Homo sapiens
tgcatggcatttgttccacagga

SEQ ID NO: 4312699 - DNA, 12 bp, Homo sapiens
tgcatggcctcc

SEQ ID NO: 4312700 - DNA, 18 bp, Homo sapiens
tgcatggcctcccagcca

SEQ ID NO: 4312701 - DNA, 21 bp, Homo sapiens
tgcatggcctcccagccaccc

SEQ ID NO: 4312702 - DNA, 18 bp, Homo sapiens
tgcattactgcatgcact

SEQ ID NO: 4312703 - DNA, 12 bp, Homo sapiens
tgcattgtctgt

SEQ ID NO: 4312704 - DNA, 13 bp, Homo sapiens
tgcatttcctgac

SEQ ID NO: 4312705 - DNA, 15 bp, Homo sapiens
tgcatttttaccttt

SEQ ID NO: 4312706 - DNA, 22 bp, Homo sapiens
tgccaaaaactaaaattcaaca

SEQ ID NO: 4312707 - DNA, 15 bp, Homo sapiens
tgccaaatcctgggc

SEQ ID NO: 4312708 - DNA, 16 bp, Homo sapiens
tgccaaatcctgggca

SEQ ID NO: 4312709 - DNA, 12 bp, Homo sapiens
tgccacacttca

SEQ ID NO: 4312710 - DNA, 14 bp, Homo sapiens
tgccacacttcagg

SEQ ID NO: 4312711 - DNA, 17 bp, Homo sapiens
tgccaccctctgcaggg

SEQ ID NO: 4312712 - DNA, 14 bp, Homo sapiens
tgccacctgcagcg

SEQ ID NO: 4312713 - DNA, 15 bp, Homo sapiens
tgccacctgcagcgt

SEQ ID NO: 4312714 - DNA, 16 bp, Homo sapiens
tgccacgcgctctgca

SEQ ID NO: 4312715 - DNA, 20 bp, Homo sapiens
tgccacgcgctctgcatgct

SEQ ID NO: 4312716 - DNA, 23 bp, Homo sapiens
tgccacgcgctctgcatgctcct

SEQ ID NO: 4312717 - DNA, 20 bp, Homo sapiens
tgccacggcagccaccctgc

SEQ ID NO: 4312718 - DNA, 22 bp, Homo sapiens
tgccacggcagccaccctgcca

SEQ ID NO: 4312719 - DNA, 23 bp, Homo sapiens
tgccacggcagccaccctgccat

SEQ ID NO: 4312720 - DNA, 16 bp, Homo sapiens
tgccactctcctgagg

SEQ ID NO: 4312721 - DNA, 12 bp, Homo sapiens
tgccagaagtgt

SEQ ID NO: 4312722 - DNA, 13 bp, Homo sapiens
tgccagaagtgtg

SEQ ID NO: 4312723 - DNA, 17 bp, Homo sapiens
tgccagacgtgctcctg

SEQ ID NO: 4312724 - DNA, 10 bp, Homo sapiens
tgccagaggc

SEQ ID NO: 4312725 - DNA, 22 bp, Homo sapiens
tgccagaggcctggtgccctgg

SEQ ID NO: 4312726 - DNA, 15 bp, Homo sapiens
tgccagctgcttctg

SEQ ID NO: 4312727 - DNA, 18 bp, Homo sapiens
tgccagctgcttctgccc

SEQ ID NO: 4312728 - DNA, 13 bp, Homo sapiens
tgccaggagtggg

SEQ ID NO: 4312729 - DNA, 17 bp, Homo sapiens
tgccagtgactgctgcg

SEQ ID NO: 4312730 - DNA, 21 bp, Homo sapiens
tgccagtgactgctgcgctgt

SEQ ID NO: 4312731 - DNA, 13 bp, Homo sapiens
tgccatcaaatga

SEQ ID NO: 4312732 - DNA, 15 bp, Homo sapiens
tgccatcaaatgaat

SEQ ID NO: 4312733 - DNA, 14 bp, Homo sapiens
tgccatcagcccct

SEQ ID NO: 4312734 - DNA, 19 bp, Homo sapiens
tgccatcagcccctgctgc

SEQ ID NO: 4312735 - DNA, 22 bp, Homo sapiens
tgccatggaggcgccttcctgg

SEQ ID NO: 4312736 - DNA, 20 bp, Homo sapiens
tgccatggtgttggaggggc

SEQ ID NO: 4312737 - DNA, 18 bp, Homo sapiens
tgccattagactgaattt

SEQ ID NO: 4312738 - DNA, 15 bp, Homo sapiens
tgccatttcatgtcc

SEQ ID NO: 4312739 - DNA, 20 bp, Homo sapiens
tgccattttgtctggctgtg

SEQ ID NO: 4312740 - DNA, 22 bp, Homo sapiens
tgcccaagaatagatgctgact

SEQ ID NO: 4312741 - DNA, 19 bp, Homo sapiens
tgcccaccagctggctctg

SEQ ID NO: 4312742 - DNA, 22 bp, Homo sapiens
tgcccaccagctggctctgcag

SEQ ID NO: 4312743 - DNA, 15 bp, Homo sapiens
tgcccaccccctgct

SEQ ID NO: 4312744 - DNA, 21 bp, Homo sapiens
tgcccaccccctgctggtgcc

SEQ ID NO: 4312745 - DNA, 19 bp, Homo sapiens
tgcccacccgtggagatgg

SEQ ID NO: 4312746 - DNA, 20 bp, Homo sapiens
tgcccacccgtggagatggg

SEQ ID NO: 4312747 - DNA, 21 bp, Homo sapiens
tgcccacccgtggagatggga

SEQ ID NO: 4312748 - DNA, 15 bp, Homo sapiens
tgcccacccttcgca

SEQ ID NO: 4312749 - DNA, 19 bp, Homo sapiens
tgcccacgctcctgccctc

SEQ ID NO: 4312750 - DNA, 18 bp, Homo sapiens
tgcccagtcatgacattt

SEQ ID NO: 4312751 - DNA, 22 bp, Homo sapiens
tgcccagtcatgacatttctca

SEQ ID NO: 4312752 - DNA, 17 bp, Homo sapiens
tgccccacacaggcctg

SEQ ID NO: 4312753 - DNA, 19 bp, Homo sapiens
tgccccactctgctgaggc

SEQ ID NO: 4312754 - DNA, 19 bp, Homo sapiens
tgccccagagaagcctcag

SEQ ID NO: 4312755 - DNA, 19 bp, Homo sapiens
tgcccccagaccccatcca

SEQ ID NO: 4312756 - DNA, 12 bp, Homo sapiens
tgccccccaccc

SEQ ID NO: 4312757 - DNA, 18 bp, Homo sapiens
tgccccccaccccagcct

SEQ ID NO: 4312758 - DNA, 20 bp, Homo sapiens
tgccccccaccccagcctaa

SEQ ID NO: 4312759 - DNA, 17 bp, Homo sapiens
tgccccccatgccctcc

SEQ ID NO: 4312760 - DNA, 14 bp, Homo sapiens
tgccccccttccca

SEQ ID NO: 4312761 - DNA, 18 bp, Homo sapiens
tgccccccttcccacccc

SEQ ID NO: 4312762 - DNA, 19 bp, Homo sapiens
tgccccccttcccacccct

SEQ ID NO: 4312763 - DNA, 13 bp, Homo sapiens
tgccccctacccg

SEQ ID NO: 4312764 - DNA, 12 bp, Homo sapiens
tgcccccttctc

SEQ ID NO: 4312765 - DNA, 16 bp, Homo sapiens
tgcccccttctcccac

SEQ ID NO: 4312766 - DNA, 18 bp, Homo sapiens
tgcccccttctcccacac

SEQ ID NO: 4312767 - DNA, 22 bp, Homo sapiens
tgcccccttctcccacactgct

SEQ ID NO: 4312768 - DNA, 16 bp, Homo sapiens
tgccccgccccccaga

SEQ ID NO: 4312769 - DNA, 20 bp, Homo sapiens
tgccccgccccccagagcca

SEQ ID NO: 4312770 - DNA, 16 bp, Homo sapiens
tgccccggccactctg

SEQ ID NO: 4312771 - DNA, 21 bp, Homo sapiens
tgccccggccactctgtttgc

SEQ ID NO: 4312772 - DNA, 17 bp, Homo sapiens
tgccccgtcaccatctc

SEQ ID NO: 4312773 - DNA, 18 bp, Homo sapiens
tgccccgtcaccatctca

SEQ ID NO: 4312774 - DNA, 21 bp, Homo sapiens
tgccccgtcaccatctcaggc

SEQ ID NO: 4312775 - DNA, 13 bp, Homo sapiens
tgcccctcccttc

SEQ ID NO: 4312776 - DNA, 16 bp, Homo sapiens
tgcccctcccttcaac

SEQ ID NO: 4312777 - DNA, 13 bp, Homo sapiens
tgcccctgcacct

SEQ ID NO: 4312778 - DNA, 16 bp, Homo sapiens
tgcccctgctgcctcc

SEQ ID NO: 4312779 - DNA, 19 bp, Homo sapiens
tgcccgctgcgctgccctg

SEQ ID NO: 4312780 - DNA, 21 bp, Homo sapiens
tgcccgggcaggggccgcttc

SEQ ID NO: 4312781 - DNA, 19 bp, Homo sapiens
tgccctagcagtttgcctc

SEQ ID NO: 4312782 - DNA, 20 bp, Homo sapiens
tgccctagcagtttgcctct

SEQ ID NO: 4312783 - DNA, 22 bp, Homo sapiens
tgccctagcagtttgcctctgc

SEQ ID NO: 4312784 - DNA, 19 bp, Homo sapiens
tgccctcaaaatctttaga

SEQ ID NO: 4312785 - DNA, 20 bp, Homo sapiens
tgccctcactccactcccct

SEQ ID NO: 4312786 - DNA, 12 bp, Homo sapiens
tgccctcaggct

SEQ ID NO: 4312787 - DNA, 17 bp, Homo sapiens
tgccctcaggcttgggg

SEQ ID NO: 4312788 - DNA, 17 bp, Homo sapiens
tgccctccctgctgcca

SEQ ID NO: 4312789 - DNA, 15 bp, Homo sapiens
tgccctccgcccttc

SEQ ID NO: 4312790 - DNA, 17 bp, Homo sapiens
tgccctccgcccttccc

SEQ ID NO: 4312791 - DNA, 18 bp, Homo sapiens
tgccctgaccatgcattt

SEQ ID NO: 4312792 - DNA, 19 bp, Homo sapiens
tgccctgaccatgcatttt

SEQ ID NO: 4312793 - DNA, 12 bp, Homo sapiens
tgccctgagggg

SEQ ID NO: 4312794 - DNA, 14 bp, Homo sapiens
tgccctgaggggcc

SEQ ID NO: 4312795 - DNA, 17 bp, Homo sapiens
tgccctgaggggcctgc

SEQ ID NO: 4312796 - DNA, 14 bp, Homo sapiens
tgccctggcccagc

SEQ ID NO: 4312797 - DNA, 19 bp, Homo sapiens
tgcccttaaaataatgatt

SEQ ID NO: 4312798 - DNA, 23 bp, Homo sapiens
tgcccttcagcatcctcagttcc

SEQ ID NO: 4312799 - DNA, 18 bp, Homo sapiens
tgcccttcttccattccc

SEQ ID NO: 4312800 - DNA, 17 bp, Homo sapiens
tgcctaggagctgggga

SEQ ID NO: 4312801 - DNA, 13 bp, Homo sapiens
tgcctaggccagc

SEQ ID NO: 4312802 - DNA, 14 bp, Homo sapiens
tgcctaggccagct

SEQ ID NO: 4312803 - DNA, 16 bp, Homo sapiens
tgcctaggccagctcc

SEQ ID NO: 4312804 - DNA, 17 bp, Homo sapiens
tgcctaggccagctcct

SEQ ID NO: 4312805 - DNA, 20 bp, Homo sapiens
tgcctataaaggaaacacgt

SEQ ID NO: 4312806 - DNA, 15 bp, Homo sapiens
tgcctattgtaatat

SEQ ID NO: 4312807 - DNA, 22 bp, Homo sapiens
tgcctccaagaggaacctctga

SEQ ID NO: 4312808 - DNA, 19 bp, Homo sapiens
tgcctccccaaccctgccc

SEQ ID NO: 4312809 - DNA, 20 bp, Homo sapiens
tgcctccccaaccctgcccc

SEQ ID NO: 4312810 - DNA, 22 bp, Homo sapiens
tgcctccccaaccctgcccctg

SEQ ID NO: 4312811 - DNA, 18 bp, Homo sapiens
tgcctccggccctgcccc

SEQ ID NO: 4312812 - DNA, 19 bp, Homo sapiens
tgcctccggccctgcccca

SEQ ID NO: 4312813 - DNA, 18 bp, Homo sapiens
tgcctctctgccagccgc

SEQ ID NO: 4312814 - DNA, 12 bp, Homo sapiens
tgcctctgaaaa

SEQ ID NO: 4312815 - DNA, 23 bp, Homo sapiens
tgcctctgcacgtgcacacacct

SEQ ID NO: 4312816 - DNA, 13 bp, Homo sapiens
tgcctcttgggag

SEQ ID NO: 4312817 - DNA, 19 bp, Homo sapiens
tgcctgaagttggagtgag

SEQ ID NO: 4312818 - DNA, 19 bp, Homo sapiens
tgcctgagaatgcctaggc

SEQ ID NO: 4312819 - DNA, 16 bp, Homo sapiens
tgcctgcccacccgtg

SEQ ID NO: 4312820 - DNA, 16 bp, Homo sapiens
tgcctgctatccagcc

SEQ ID NO: 4312821 - DNA, 13 bp, Homo sapiens
tgcctgggcctga

SEQ ID NO: 4312822 - DNA, 15 bp, Homo sapiens
tgcctggggtggagg

SEQ ID NO: 4312823 - DNA, 21 bp, Homo sapiens
tgcctggggtggaggctaagc

SEQ ID NO: 4312824 - DNA, 22 bp, Homo sapiens
tgcctggggtggaggctaagcc

SEQ ID NO: 4312825 - DNA, 14 bp, Homo sapiens
tgcctgtggtgagg

SEQ ID NO: 4312826 - DNA, 13 bp, Homo sapiens
tgccttcagctct

SEQ ID NO: 4312827 - DNA, 24 bp, Homo sapiens
tgccttcatggaactcagctgtct

SEQ ID NO: 4312828 - DNA, 17 bp, Homo sapiens
tgccttccacgctgtct

SEQ ID NO: 4312829 - DNA, 20 bp, Homo sapiens
tgccttccacgctgtctcca

SEQ ID NO: 4312830 - DNA, 23 bp, Homo sapiens
tgccttccaggcgtagggccagg

SEQ ID NO: 4312831 - DNA, 20 bp, Homo sapiens
tgcctttccagtgctgctcc

SEQ ID NO: 4312832 - DNA, 16 bp, Homo sapiens
tgcctttgctgccttc

SEQ ID NO: 4312833 - DNA, 17 bp, Homo sapiens
tgcgacaccaccaacag

SEQ ID NO: 4312834 - DNA, 22 bp, Homo sapiens
tgcgagaacacaagccacgcct

SEQ ID NO: 4312835 - DNA, 13 bp, Homo sapiens
tgcgccctccctc

SEQ ID NO: 4312836 - DNA, 20 bp, Homo sapiens
tgcgccctccctccctccac

SEQ ID NO: 4312837 - DNA, 16 bp, Homo sapiens
tgcgctcttcaccagg

SEQ ID NO: 4312838 - DNA, 23 bp, Homo sapiens
tgcgctgacaaccaccgctcccc

SEQ ID NO: 4312839 - DNA, 12 bp, Homo sapiens
tgcgctgccctg

SEQ ID NO: 4312840 - DNA, 13 bp, Homo sapiens
tgcgctgccctgc

SEQ ID NO: 4312841 - DNA, 13 bp, Homo sapiens
tgcgtaaatcaac

SEQ ID NO: 4312842 - DNA, 22 bp, Homo sapiens
tgcgtgccacatcaataacaac

SEQ ID NO: 4312843 - DNA, 13 bp, Homo sapiens
tgcgtggcctggg

SEQ ID NO: 4312844 - DNA, 13 bp, Homo sapiens
tgcgttttagagt

SEQ ID NO: 4312845 - DNA, 20 bp, Homo sapiens
tgcgttttagagtatgcaag

SEQ ID NO: 4312846 - DNA, 13 bp, Homo sapiens
tgctaatgtaatc

SEQ ID NO: 4312847 - DNA, 14 bp, Homo sapiens
tgctacctggtttt

SEQ ID NO: 4312848 - DNA, 17 bp, Homo sapiens
tgctacctggttttcat

SEQ ID NO: 4312849 - DNA, 12 bp, Homo sapiens
tgctactcagta

SEQ ID NO: 4312850 - DNA, 14 bp, Homo sapiens
tgctagcacaatat

SEQ ID NO: 4312851 - DNA, 19 bp, Homo sapiens
tgctaggtgggccagcccc

SEQ ID NO: 4312852 - DNA, 23 bp, Homo sapiens
tgctaggtgggccagcccctccc

SEQ ID NO: 4312853 - DNA, 13 bp, Homo sapiens
tgctagtgataca

SEQ ID NO: 4312854 - DNA, 16 bp, Homo sapiens
tgctatcatatattat

SEQ ID NO: 4312855 - DNA, 21 bp, Homo sapiens
tgctatcatatattataagat

SEQ ID NO: 4312856 - DNA, 23 bp, Homo sapiens
tgctatcatatattataagattt

SEQ ID NO: 4312857 - DNA, 13 bp, Homo sapiens
tgctatgtctgtg

SEQ ID NO: 4312858 - DNA, 22 bp, Homo sapiens
tgctcaacctacagtggaggga

SEQ ID NO: 4312859 - DNA, 23 bp, Homo sapiens
tgctcaacctacagtggagggag

SEQ ID NO: 4312860 - DNA, 20 bp, Homo sapiens
tgctcacccaggacctctgg

SEQ ID NO: 4312861 - DNA, 18 bp, Homo sapiens
tgctcagatgctggtcat

SEQ ID NO: 4312862 - DNA, 21 bp, Homo sapiens
tgctcaggcctcacctggctt

SEQ ID NO: 4312863 - DNA, 23 bp, Homo sapiens
tgctcaggcctcacctggcttcc

SEQ ID NO: 4312864 - DNA, 14 bp, Homo sapiens
tgctcagttccaat

SEQ ID NO: 4312865 - DNA, 18 bp, Homo sapiens
tgctccagccaacccctg

SEQ ID NO: 4312866 - DNA, 22 bp, Homo sapiens
tgctccagccaacccctgtgga

SEQ ID NO: 4312867 - DNA, 14 bp, Homo sapiens
tgctccaggcttcc

SEQ ID NO: 4312868 - DNA, 19 bp, Homo sapiens
tgctccaggcttcctgccc

SEQ ID NO: 4312869 - DNA, 19 bp, Homo sapiens
tgctccagtgttttcttgt

SEQ ID NO: 4312870 - DNA, 21 bp, Homo sapiens
tgctccatgcagatctagcca

SEQ ID NO: 4312871 - DNA, 22 bp, Homo sapiens
tgctccatgcagatctagccag

SEQ ID NO: 4312872 - DNA, 23 bp, Homo sapiens
tgctccatgcagatctagccagg

SEQ ID NO: 4312873 - DNA, 17 bp, Homo sapiens
tgctcccagtttcttga

SEQ ID NO: 4312874 - DNA, 15 bp, Homo sapiens
tgctcccccatcctc

SEQ ID NO: 4312875 - DNA, 19 bp, Homo sapiens
tgctcccccatcctcccct

SEQ ID NO: 4312876 - DNA, 21 bp, Homo sapiens
tgctcccccatcctccccttc

SEQ ID NO: 4312877 - DNA, 19 bp, Homo sapiens
tgctcccggctctgaggct

SEQ ID NO: 4312878 - DNA, 15 bp, Homo sapiens
tgctcctctgcctgt

SEQ ID NO: 4312879 - DNA, 18 bp, Homo sapiens
tgctcctctgcctgtgcc

SEQ ID NO: 4312880 - DNA, 19 bp, Homo sapiens
tgctcctctgcctgtgccc

SEQ ID NO: 4312881 - DNA, 13 bp, Homo sapiens
tgctcctgtggcg

SEQ ID NO: 4312882 - DNA, 15 bp, Homo sapiens
tgctcggccgtcttc

SEQ ID NO: 4312883 - DNA, 21 bp, Homo sapiens
tgctctattgtagcatttctt

SEQ ID NO: 4312884 - DNA, 23 bp, Homo sapiens
tgctctcccctccctttttaaac

SEQ ID NO: 4312885 - DNA, 18 bp, Homo sapiens
tgctcttacccacactac

SEQ ID NO: 4312886 - DNA, 22 bp, Homo sapiens
tgctcttctcttacgctctctg

SEQ ID NO: 4312887 - DNA, 14 bp, Homo sapiens
tgctgaccttctgc

SEQ ID NO: 4312888 - DNA, 16 bp, Homo sapiens
tgctgactgtactcct

SEQ ID NO: 4312889 - DNA, 21 bp, Homo sapiens
tgctgaggccagaggaaggga

SEQ ID NO: 4312890 - DNA, 15 bp, Homo sapiens
tgctgaggtgggcct

SEQ ID NO: 4312891 - DNA, 19 bp, Homo sapiens
tgctgaggtgggccttcca

SEQ ID NO: 4312892 - DNA, 21 bp, Homo sapiens
tgctgagtatgttaagctctt

SEQ ID NO: 4312893 - DNA, 17 bp, Homo sapiens
tgctgagtggtccacat

SEQ ID NO: 4312894 - DNA, 19 bp, Homo sapiens
tgctgatttcccctcttcc

SEQ ID NO: 4312895 - DNA, 16 bp, Homo sapiens
tgctgccacacttcag

SEQ ID NO: 4312896 - DNA, 21 bp, Homo sapiens
tgctgcccaccccctgctggt

SEQ ID NO: 4312897 - DNA, 17 bp, Homo sapiens
tgctgccccacaacaca

SEQ ID NO: 4312898 - DNA, 16 bp, Homo sapiens
tgctgcccgtgaggag

SEQ ID NO: 4312899 - DNA, 19 bp, Homo sapiens
tgctgcccgtgaggagggg

SEQ ID NO: 4312900 - DNA, 20 bp, Homo sapiens
tgctgcccgtgaggaggggg

SEQ ID NO: 4312901 - DNA, 13 bp, Homo sapiens
tgctgccctccat

SEQ ID NO: 4312902 - DNA, 14 bp, Homo sapiens
tgctgcctccccaa

SEQ ID NO: 4312903 - DNA, 15 bp, Homo sapiens
tgctgcctctgaaaa

SEQ ID NO: 4312904 - DNA, 23 bp, Homo sapiens
tgctgcctgcctccggccctgcc

SEQ ID NO: 4312905 - DNA, 24 bp, Homo sapiens
tgctgctccctttatcatgtgttt

SEQ ID NO: 4312906 - DNA, 19 bp, Homo sapiens
tgctgctcctcggccagag

SEQ ID NO: 4312907 - DNA, 23 bp, Homo sapiens
tgctgctcctcggccagagctcc

SEQ ID NO: 4312908 - DNA, 14 bp, Homo sapiens
tgctgctggctccc

SEQ ID NO: 4312909 - DNA, 16 bp, Homo sapiens
tgctgcttccctctgc

SEQ ID NO: 4312910 - DNA, 17 bp, Homo sapiens
tgctgcttccctctgcc

SEQ ID NO: 4312911 - DNA, 20 bp, Homo sapiens
tgctgcttccctctgcctgt

SEQ ID NO: 4312912 - DNA, 22 bp, Homo sapiens
tgctggagagtagacatccccc

SEQ ID NO: 4312913 - DNA, 17 bp, Homo sapiens
tgctggagtcctgttct

SEQ ID NO: 4312914 - DNA, 18 bp, Homo sapiens
tgctggagtcctgttctc

SEQ ID NO: 4312915 - DNA, 20 bp, Homo sapiens
tgctggcatgtctgggtcgt

SEQ ID NO: 4312916 - DNA, 20 bp, Homo sapiens
tgctggcccctcacctgggc

SEQ ID NO: 4312917 - DNA, 13 bp, Homo sapiens
tgctggctgcctt

SEQ ID NO: 4312918 - DNA, 14 bp, Homo sapiens
tgctggctgcctta

SEQ ID NO: 4312919 - DNA, 15 bp, Homo sapiens
tgctgggaccctcgg

SEQ ID NO: 4312920 - DNA, 15 bp, Homo sapiens
tgctgggtgggaatg

SEQ ID NO: 4312921 - DNA, 13 bp, Homo sapiens
tgctgggttctgg

SEQ ID NO: 4312922 - DNA, 16 bp, Homo sapiens
tgctggtgcccaccct

SEQ ID NO: 4312923 - DNA, 22 bp, Homo sapiens
tgctgtatacaaacaggtgcta

SEQ ID NO: 4312924 - DNA, 18 bp, Homo sapiens
tgctgtctgtgtgaggct

SEQ ID NO: 4312925 - DNA, 21 bp, Homo sapiens
tgctgtctgtgtgaggctccc

SEQ ID NO: 4312926 - DNA, 16 bp, Homo sapiens
tgctgttttatgtcat

SEQ ID NO: 4312927 - DNA, 22 bp, Homo sapiens
tgctgttttatgtcatactctg

SEQ ID NO: 4312928 - DNA, 13 bp, Homo sapiens
tgcttagcaaaaa

SEQ ID NO: 4312929 - DNA, 14 bp, Homo sapiens
tgcttatttatatt

SEQ ID NO: 4312930 - DNA, 13 bp, Homo sapiens
tgcttccctctgc

SEQ ID NO: 4312931 - DNA, 22 bp, Homo sapiens
tgcttccctttcactgaagtga

SEQ ID NO: 4312932 - DNA, 12 bp, Homo sapiens
tgcttctgccca

SEQ ID NO: 4312933 - DNA, 16 bp, Homo sapiens
tgcttctgcccacccc

SEQ ID NO: 4312934 - DNA, 17 bp, Homo sapiens
tgcttctgcccaccccg

SEQ ID NO: 4312935 - DNA, 23 bp, Homo sapiens
tgcttctgcccaccccgcctctg

SEQ ID NO: 4312936 - DNA, 13 bp, Homo sapiens
tgcttgaagattc

SEQ ID NO: 4312937 - DNA, 19 bp, Homo sapiens
tgcttgcctagggcctggt

SEQ ID NO: 4312938 - DNA, 20 bp, Homo sapiens
tgcttggtttagctgtgcag

SEQ ID NO: 4312939 - DNA, 21 bp, Homo sapiens
tgcttgtgttgggccccaggg

SEQ ID NO: 4312940 - DNA, 20 bp, Homo sapiens
tgctttgctggagtcctgtt

SEQ ID NO: 4312941 - DNA, 14 bp, Homo sapiens
tgctttgggctgcc

SEQ ID NO: 4312942 - DNA, 16 bp, Homo sapiens
tgctttgggctgccct

SEQ ID NO: 4312943 - DNA, 19 bp, Homo sapiens
tgctttgggctgccctggt

SEQ ID NO: 4312944 - DNA, 12 bp, Homo sapiens
tgcttttccatc

SEQ ID NO: 4312945 - DNA, 16 bp, Homo sapiens
tgcttttccattctgg

SEQ ID NO: 4312946 - DNA, 20 bp, Homo sapiens
tgcttttccattctgggtgt

SEQ ID NO: 4312947 - DNA, 15 bp, Homo sapiens
tggaaaaaagagaaa

SEQ ID NO: 4312948 - DNA, 21 bp, Homo sapiens
tggaaaaaagagaaaaaccaa

SEQ ID NO: 4312949 - DNA, 13 bp, Homo sapiens
tggaaaaaatatt

SEQ ID NO: 4312950 - DNA, 19 bp, Homo sapiens
tggaaaaatgccatcaaat

SEQ ID NO: 4312951 - DNA, 19 bp, Homo sapiens
tggaaagacctgtgagggg

SEQ ID NO: 4312952 - DNA, 22 bp, Homo sapiens
tggaaagggtgtggcttggaac

SEQ ID NO: 4312953 - DNA, 17 bp, Homo sapiens
tggaacaggaggaactg

SEQ ID NO: 4312954 - DNA, 18 bp, Homo sapiens
tggaacccttttggcccc

SEQ ID NO: 4312955 - DNA, 21 bp, Homo sapiens
tggaacccttttggcccccga

SEQ ID NO: 4312956 - DNA, 23 bp, Homo sapiens
tggaactcagctgtctgtggctt

SEQ ID NO: 4312957 - DNA, 16 bp, Homo sapiens
tggaagagagaaagca

SEQ ID NO: 4312958 - DNA, 14 bp, Homo sapiens
tggaagctggcagg

SEQ ID NO: 4312959 - DNA, 13 bp, Homo sapiens
tggaaggaaaaca

SEQ ID NO: 4312960 - DNA, 15 bp, Homo sapiens
tggaattatgtataa

SEQ ID NO: 4312961 - DNA, 23 bp, Homo sapiens
tggacacagtcagggcggggctg

SEQ ID NO: 4312962 - DNA, 16 bp, Homo sapiens
tggacagacccagggt

SEQ ID NO: 4312963 - DNA, 17 bp, Homo sapiens
tggacagggccagggtt

SEQ ID NO: 4312964 - DNA, 16 bp, Homo sapiens
tggacccagcaggggc

SEQ ID NO: 4312965 - DNA, 19 bp, Homo sapiens
tggacctgcacttggcctc

SEQ ID NO: 4312966 - DNA, 14 bp, Homo sapiens
tggacctgcagttg

SEQ ID NO: 4312967 - DNA, 17 bp, Homo sapiens
tggactctacactgtga

SEQ ID NO: 4312968 - DNA, 20 bp, Homo sapiens
tggactctggactgggaagg

SEQ ID NO: 4312969 - DNA, 21 bp, Homo sapiens
tggactgggaagggggcaggc

SEQ ID NO: 4312970 - DNA, 15 bp, Homo sapiens
tggactgtggcctca

SEQ ID NO: 4312971 - DNA, 17 bp, Homo sapiens
tggactgtggcctcagg

SEQ ID NO: 4312972 - DNA, 19 bp, Homo sapiens
tggactttccaccccctcc

SEQ ID NO: 4312973 - DNA, 14 bp, Homo sapiens
tggagaactagaga

SEQ ID NO: 4312974 - DNA, 21 bp, Homo sapiens
tggagaggaggtgtggagtgg

SEQ ID NO: 4312975 - DNA, 23 bp, Homo sapiens
tggagaggaggtgtggagtggag

SEQ ID NO: 4312976 - DNA, 15 bp, Homo sapiens
tggagcagaggtggg

SEQ ID NO: 4312977 - DNA, 19 bp, Homo sapiens
tggagcatttggaaggaaa

SEQ ID NO: 4312978 - DNA, 21 bp, Homo sapiens
tggagcatttggaaggaaagg

SEQ ID NO: 4312979 - DNA, 17 bp, Homo sapiens
tggagccaatggagact

SEQ ID NO: 4312980 - DNA, 15 bp, Homo sapiens
tggagccacaggcag

SEQ ID NO: 4312981 - DNA, 16 bp, Homo sapiens
tggagccacaggcaga

SEQ ID NO: 4312982 - DNA, 16 bp, Homo sapiens
tggagccactctgttc

SEQ ID NO: 4312983 - DNA, 18 bp, Homo sapiens
tggagcccgcacccccac

SEQ ID NO: 4312984 - DNA, 22 bp, Homo sapiens
tggagcccgcacccccaccctt

SEQ ID NO: 4312985 - DNA, 20 bp, Homo sapiens
tggagccggactttcggagt

SEQ ID NO: 4312986 - DNA, 22 bp, Homo sapiens
tggagccggactttcggagttg

SEQ ID NO: 4312987 - DNA, 13 bp, Homo sapiens
tggagctgcttcc

SEQ ID NO: 4312988 - DNA, 15 bp, Homo sapiens
tggagctgcttccag

SEQ ID NO: 4312989 - DNA, 16 bp, Homo sapiens
tggaggaatgctcccc

SEQ ID NO: 4312990 - DNA, 12 bp, Homo sapiens
tggaggcctctg

SEQ ID NO: 4312991 - DNA, 18 bp, Homo sapiens
tggaggcctggtctggag

SEQ ID NO: 4312992 - DNA, 19 bp, Homo sapiens
tggaggcctggtctggagc

SEQ ID NO: 4312993 - DNA, 13 bp, Homo sapiens
tggaggcgagcca

SEQ ID NO: 4312994 - DNA, 16 bp, Homo sapiens
tggaggcgccttcctg

SEQ ID NO: 4312995 - DNA, 14 bp, Homo sapiens
tggaggggcaggcc

SEQ ID NO: 4312996 - DNA, 14 bp, Homo sapiens
tggaggtcccagac

SEQ ID NO: 4312997 - DNA, 16 bp, Homo sapiens
tggagtccagacctgg

SEQ ID NO: 4312998 - DNA, 23 bp, Homo sapiens
tggagtccagacctgggccctgg

SEQ ID NO: 4312999 - DNA, 14 bp, Homo sapiens
tggagtcctgttct

SEQ ID NO: 4313000 - DNA, 16 bp, Homo sapiens
tggagtctgaaggaga

SEQ ID NO: 4313001 - DNA, 20 bp, Homo sapiens
tggagtctgaaggagaggag

SEQ ID NO: 4313002 - DNA, 16 bp, Homo sapiens
tggagtggggcagtag

SEQ ID NO: 4313003 - DNA, 17 bp, Homo sapiens
tggagtggggcagtaga

SEQ ID NO: 4313004 - DNA, 14 bp, Homo sapiens
tggagtgtgtgggg

SEQ ID NO: 4313005 - DNA, 20 bp, Homo sapiens
tggagtgtgtgggggtctgg

SEQ ID NO: 4313006 - DNA, 17 bp, Homo sapiens
tggatacgtgtcaatgt

SEQ ID NO: 4313007 - DNA, 17 bp, Homo sapiens
tggatactgcccggggc

SEQ ID NO: 4313008 - DNA, 18 bp, Homo sapiens
tggatccatacaaaacta

SEQ ID NO: 4313009 - DNA, 14 bp, Homo sapiens
tggatctcttaaga

SEQ ID NO: 4313010 - DNA, 17 bp, Homo sapiens
tggatctgctccatgca

SEQ ID NO: 4313011 - DNA, 18 bp, Homo sapiens
tggatctgctccatgcag

SEQ ID NO: 4313012 - DNA, 19 bp, Homo sapiens
tggatctgctccatgcaga

SEQ ID NO: 4313013 - DNA, 18 bp, Homo sapiens
tggatctggagtctgaag

SEQ ID NO: 4313014 - DNA, 13 bp, Homo sapiens
tggatggatctgc

SEQ ID NO: 4313015 - DNA, 16 bp, Homo sapiens
tggattataatcagaa

SEQ ID NO: 4313016 - DNA, 17 bp, Homo sapiens
tggattataatcagaat

SEQ ID NO: 4313017 - DNA, 16 bp, Homo sapiens
tggattctaaattatg

SEQ ID NO: 4313018 - DNA, 16 bp, Homo sapiens
tggattctatatttca

SEQ ID NO: 4313019 - DNA, 22 bp, Homo sapiens
tggattggcaggtgtgggctcc

SEQ ID NO: 4313020 - DNA, 19 bp, Homo sapiens
tggatttagagactgtaaa

SEQ ID NO: 4313021 - DNA, 17 bp, Homo sapiens
tggattttctttctatg

SEQ ID NO: 4313022 - DNA, 19 bp, Homo sapiens
tggattttctttctatgta

SEQ ID NO: 4313023 - DNA, 21 bp, Homo sapiens
tggattttctttctatgtaga

SEQ ID NO: 4313024 - DNA, 16 bp, Homo sapiens
tggcacagggcagtgg

SEQ ID NO: 4313025 - DNA, 16 bp, Homo sapiens
tggcagccgtgccttc

SEQ ID NO: 4313026 - DNA, 19 bp, Homo sapiens
tggcagccgtgccttcagc

SEQ ID NO: 4313027 - DNA, 15 bp, Homo sapiens
tggcagcttcaaaac

SEQ ID NO: 4313028 - DNA, 19 bp, Homo sapiens
tggcagcttcaaaacagaa

SEQ ID NO: 4313029 - DNA, 22 bp, Homo sapiens
tggcaggagacactggtctcag

SEQ ID NO: 4313030 - DNA, 16 bp, Homo sapiens
tggcaggaggacaggt

SEQ ID NO: 4313031 - DNA, 13 bp, Homo sapiens
tggcaggagggtg

SEQ ID NO: 4313032 - DNA, 16 bp, Homo sapiens
tggcagggcaggcaga

SEQ ID NO: 4313033 - DNA, 20 bp, Homo sapiens
tggcagggcaggcagagctc

SEQ ID NO: 4313034 - DNA, 16 bp, Homo sapiens
tggcaggtggccaggg

SEQ ID NO: 4313035 - DNA, 19 bp, Homo sapiens
tggcaggtggccagggctc

SEQ ID NO: 4313036 - DNA, 19 bp, Homo sapiens
tggcatcccagtggcctca

SEQ ID NO: 4313037 - DNA, 17 bp, Homo sapiens
tggcatggctccagtct

SEQ ID NO: 4313038 - DNA, 22 bp, Homo sapiens
tggcatgtctgggtcgtctttt

SEQ ID NO: 4313039 - DNA, 12 bp, Homo sapiens
tggcatgtgttt

SEQ ID NO: 4313040 - DNA, 13 bp, Homo sapiens
tggccaagcctgc

SEQ ID NO: 4313041 - DNA, 15 bp, Homo sapiens
tggccaagcctgccc

SEQ ID NO: 4313042 - DNA, 16 bp, Homo sapiens
tggccaagcctgcccc

SEQ ID NO: 4313043 - DNA, 17 bp, Homo sapiens
tggccaagcctgccccg

SEQ ID NO: 4313044 - DNA, 19 bp, Homo sapiens
tggccaagcctgccccggc

SEQ ID NO: 4313045 - DNA, 20 bp, Homo sapiens
tggccactccagacccctgg

SEQ ID NO: 4313046 - DNA, 18 bp, Homo sapiens
tggccactctgctctgca

SEQ ID NO: 4313047 - DNA, 21 bp, Homo sapiens
tggccactttgcagacctggg

SEQ ID NO: 4313048 - DNA, 17 bp, Homo sapiens
tggccagagggcccctc

SEQ ID NO: 4313049 - DNA, 20 bp, Homo sapiens
tggccagagggcccctcact

SEQ ID NO: 4313050 - DNA, 15 bp, Homo sapiens
tggccagcccagatg

SEQ ID NO: 4313051 - DNA, 18 bp, Homo sapiens
tggccagcccagatggct

SEQ ID NO: 4313052 - DNA, 24 bp, Homo sapiens
tggccagcccagatggctccctgg

SEQ ID NO: 4313053 - DNA, 11 bp, Homo sapiens
tggccaggctg

SEQ ID NO: 4313054 - DNA, 11 bp, Homo sapiens
tggccaggtgg

SEQ ID NO: 4313055 - DNA, 17 bp, Homo sapiens
tggccaggtggccactc

SEQ ID NO: 4313056 - DNA, 19 bp, Homo sapiens
tggccaggtggccactcca

SEQ ID NO: 4313057 - DNA, 17 bp, Homo sapiens
tggcccacccctcttcc

SEQ ID NO: 4313058 - DNA, 18 bp, Homo sapiens
tggcccacccctcttccc

SEQ ID NO: 4313059 - DNA, 22 bp, Homo sapiens
tggcccacccctcttccccctt

SEQ ID NO: 4313060 - DNA, 12 bp, Homo sapiens
tggcccagcagc

SEQ ID NO: 4313061 - DNA, 12 bp, Homo sapiens
tggcccagccag

SEQ ID NO: 4313062 - DNA, 15 bp, Homo sapiens
tggcccagccagcag

SEQ ID NO: 4313063 - DNA, 17 bp, Homo sapiens
tggcccagcctgtggcc

SEQ ID NO: 4313064 - DNA, 19 bp, Homo sapiens
tggcccagcctgtggcctc

SEQ ID NO: 4313065 - DNA, 17 bp, Homo sapiens
tggcccagtgagagtga

SEQ ID NO: 4313066 - DNA, 14 bp, Homo sapiens
tggcccccgagctg

SEQ ID NO: 4313067 - DNA, 16 bp, Homo sapiens
tggcccccgagctggg

SEQ ID NO: 4313068 - DNA, 13 bp, Homo sapiens
tggcccctcacct

SEQ ID NO: 4313069 - DNA, 16 bp, Homo sapiens
tggcccctcacctggg

SEQ ID NO: 4313070 - DNA, 16 bp, Homo sapiens
tggcccctcccacatc

SEQ ID NO: 4313071 - DNA, 23 bp, Homo sapiens
tggcccctctctgtttaccctcc

SEQ ID NO: 4313072 - DNA, 13 bp, Homo sapiens
tggccccttcact

SEQ ID NO: 4313073 - DNA, 19 bp, Homo sapiens
tggcccgacagcctggcac

SEQ ID NO: 4313074 - DNA, 15 bp, Homo sapiens
tggccctcctctggt

SEQ ID NO: 4313075 - DNA, 12 bp, Homo sapiens
tggccctgctgc

SEQ ID NO: 4313076 - DNA, 16 bp, Homo sapiens
tggccctgctgccccc

SEQ ID NO: 4313077 - DNA, 22 bp, Homo sapiens
tggccctttcacccctcttccc

SEQ ID NO: 4313078 - DNA, 15 bp, Homo sapiens
tggccggccctgccc

SEQ ID NO: 4313079 - DNA, 22 bp, Homo sapiens
tggccgggggtgggggcctgct

SEQ ID NO: 4313080 - DNA, 20 bp, Homo sapiens
tggccgtggagtcgagctgg

SEQ ID NO: 4313081 - DNA, 17 bp, Homo sapiens
tggccgttgcctctctg

SEQ ID NO: 4313082 - DNA, 13 bp, Homo sapiens
tggcctcaaccct

SEQ ID NO: 4313083 - DNA, 14 bp, Homo sapiens
tggcctcaaccctc

SEQ ID NO: 4313084 - DNA, 16 bp, Homo sapiens
tggcctcaaccctccc

SEQ ID NO: 4313085 - DNA, 18 bp, Homo sapiens
tggcctcaaccctccctc

SEQ ID NO: 4313086 - DNA, 23 bp, Homo sapiens
tggcctcaaccctccctcagccc

SEQ ID NO: 4313087 - DNA, 16 bp, Homo sapiens
tggcctcagcatctca

SEQ ID NO: 4313088 - DNA, 14 bp, Homo sapiens
tggcctcccagcca

SEQ ID NO: 4313089 - DNA, 15 bp, Homo sapiens
tggcctcccagccac

SEQ ID NO: 4313090 - DNA, 18 bp, Homo sapiens
tggcctcccagccacccg

SEQ ID NO: 4313091 - DNA, 19 bp, Homo sapiens
tggcctcccagccacccgg

SEQ ID NO: 4313092 - DNA, 15 bp, Homo sapiens
tggcctctggcctgg

SEQ ID NO: 4313093 - DNA, 15 bp, Homo sapiens
tggcctgggaaaagg

SEQ ID NO: 4313094 - DNA, 22 bp, Homo sapiens
tggcctgtccacctgtgctgct

SEQ ID NO: 4313095 - DNA, 19 bp, Homo sapiens
tggccttggttcctccagc

SEQ ID NO: 4313096 - DNA, 20 bp, Homo sapiens
tggccttggttcctccagca

SEQ ID NO: 4313097 - DNA, 13 bp, Homo sapiens
tggcgggccaagg

SEQ ID NO: 4313098 - DNA, 15 bp, Homo sapiens
tggcggtgcagtggc

SEQ ID NO: 4313099 - DNA, 15 bp, Homo sapiens
tggcgtctgtcttca

SEQ ID NO: 4313100 - DNA, 14 bp, Homo sapiens
tggctaaggcatca

SEQ ID NO: 4313101 - DNA, 23 bp, Homo sapiens
tggctactttggtttctgtctgt

SEQ ID NO: 4313102 - DNA, 15 bp, Homo sapiens
tggctcacagccacc

SEQ ID NO: 4313103 - DNA, 16 bp, Homo sapiens
tggctcacagccacca

SEQ ID NO: 4313104 - DNA, 17 bp, Homo sapiens
tggctcacagccaccac

SEQ ID NO: 4313105 - DNA, 17 bp, Homo sapiens
tggctcacatcatgtaa

SEQ ID NO: 4313106 - DNA, 11 bp, Homo sapiens
tggctccaccg

SEQ ID NO: 4313107 - DNA, 17 bp, Homo sapiens
tggctcccacaggccct

SEQ ID NO: 4313108 - DNA, 13 bp, Homo sapiens
tggctcccctcta

SEQ ID NO: 4313109 - DNA, 21 bp, Homo sapiens
tggctcccctctatttagcat

SEQ ID NO: 4313110 - DNA, 16 bp, Homo sapiens
tggctccctgggctgg

SEQ ID NO: 4313111 - DNA, 20 bp, Homo sapiens
tggctccctgggctggcatg

SEQ ID NO: 4313112 - DNA, 14 bp, Homo sapiens
tggctcctcccggt

SEQ ID NO: 4313113 - DNA, 16 bp, Homo sapiens
tggctcctcccggtgc

SEQ ID NO: 4313114 - DNA, 18 bp, Homo sapiens
tggctcctcccggtgccc

SEQ ID NO: 4313115 - DNA, 12 bp, Homo sapiens
tggctctgcagc

SEQ ID NO: 4313116 - DNA, 22 bp, Homo sapiens
tggctgcaagtggttaagaatg

SEQ ID NO: 4313117 - DNA, 19 bp, Homo sapiens
tggctgcataaatgtggta

SEQ ID NO: 4313118 - DNA, 16 bp, Homo sapiens
tggctgccttctgcgg

SEQ ID NO: 4313119 - DNA, 13 bp, Homo sapiens
tggctgctgcagt

SEQ ID NO: 4313120 - DNA, 11 bp, Homo sapiens
tggctggactg

SEQ ID NO: 4313121 - DNA, 17 bp, Homo sapiens
tggctgggtttgggcag

SEQ ID NO: 4313122 - DNA, 19 bp, Homo sapiens
tggctgggtttgggcagtg

SEQ ID NO: 4313123 - DNA, 22 bp, Homo sapiens
tggctgggtttgggcagtggag

SEQ ID NO: 4313124 - DNA, 17 bp, Homo sapiens
tggctgtatttttagag

SEQ ID NO: 4313125 - DNA, 17 bp, Homo sapiens
tggctgtcccctgcaag

SEQ ID NO: 4313126 - DNA, 18 bp, Homo sapiens
tggctgtcccctgcaagt

SEQ ID NO: 4313127 - DNA, 11 bp, Homo sapiens
tggcttaattc

SEQ ID NO: 4313128 - DNA, 13 bp, Homo sapiens
tggcttcagaatt

SEQ ID NO: 4313129 - DNA, 18 bp, Homo sapiens
tggcttcccaggaccctg

SEQ ID NO: 4313130 - DNA, 23 bp, Homo sapiens
tggcttcccaggaccctgggtca

SEQ ID NO: 4313131 - DNA, 18 bp, Homo sapiens
tggcttcccgctcagccc

SEQ ID NO: 4313132 - DNA, 16 bp, Homo sapiens
tggcttgtagggtgag

SEQ ID NO: 4313133 - DNA, 21 bp, Homo sapiens
tgggaaaagggcaggagccta

SEQ ID NO: 4313134 - DNA, 14 bp, Homo sapiens
tgggaagggggcag

SEQ ID NO: 4313135 - DNA, 23 bp, Homo sapiens
tgggaatgcgctcttcaccagga

SEQ ID NO: 4313136 - DNA, 22 bp, Homo sapiens
tgggacaattagataaatgtcc

SEQ ID NO: 4313137 - DNA, 18 bp, Homo sapiens
tgggacacagagaccccc

SEQ ID NO: 4313138 - DNA, 22 bp, Homo sapiens
tgggaccctcggggcaggaagt

SEQ ID NO: 4313139 - DNA, 21 bp, Homo sapiens
tgggaccgccagatggggcct

SEQ ID NO: 4313140 - DNA, 23 bp, Homo sapiens
tgggaccgccagatggggcctct

SEQ ID NO: 4313141 - DNA, 20 bp, Homo sapiens
tgggacggaagtggcctgag

SEQ ID NO: 4313142 - DNA, 14 bp, Homo sapiens
tgggagaagggaca

SEQ ID NO: 4313143 - DNA, 15 bp, Homo sapiens
tgggagaagggacag

SEQ ID NO: 4313144 - DNA, 16 bp, Homo sapiens
tgggagactgagcttg

SEQ ID NO: 4313145 - DNA, 17 bp, Homo sapiens
tgggagaggaagccacg

SEQ ID NO: 4313146 - DNA, 16 bp, Homo sapiens
tgggagatgctgggac

SEQ ID NO: 4313147 - DNA, 18 bp, Homo sapiens
tgggagcctcgcccctcc

SEQ ID NO: 4313148 - DNA, 22 bp, Homo sapiens
tgggaggagggggcccggctgg

SEQ ID NO: 4313149 - DNA, 14 bp, Homo sapiens
tgggagtcagggag

SEQ ID NO: 4313150 - DNA, 14 bp, Homo sapiens
tgggagtgggagag

SEQ ID NO: 4313151 - DNA, 19 bp, Homo sapiens
tgggagtgggagaggaagc

SEQ ID NO: 4313152 - DNA, 15 bp, Homo sapiens
tgggatccagagaga

SEQ ID NO: 4313153 - DNA, 14 bp, Homo sapiens
tgggatgcttgcct

SEQ ID NO: 4313154 - DNA, 15 bp, Homo sapiens
tgggatgggcacagg

SEQ ID NO: 4313155 - DNA, 19 bp, Homo sapiens
tgggatgggcacaggctgc

SEQ ID NO: 4313156 - DNA, 14 bp, Homo sapiens
tgggattcaggaat

SEQ ID NO: 4313157 - DNA, 18 bp, Homo sapiens
tgggattcaggaatgggc

SEQ ID NO: 4313158 - DNA, 18 bp, Homo sapiens
tgggcaaggcctttggct

SEQ ID NO: 4313159 - DNA, 15 bp, Homo sapiens
tgggcaagtgattga

SEQ ID NO: 4313160 - DNA, 21 bp, Homo sapiens
tgggcacaggctgccccaccc

SEQ ID NO: 4313161 - DNA, 15 bp, Homo sapiens
tgggcacctggggag

SEQ ID NO: 4313162 - DNA, 17 bp, Homo sapiens
tgggcacctggggagtg

SEQ ID NO: 4313163 - DNA, 21 bp, Homo sapiens
tgggcagaggggagaggaagc

SEQ ID NO: 4313164 - DNA, 15 bp, Homo sapiens
tgggcagcccagaga

SEQ ID NO: 4313165 - DNA, 18 bp, Homo sapiens
tgggcagcccagagagac

SEQ ID NO: 4313166 - DNA, 14 bp, Homo sapiens
tgggcagctggctc

SEQ ID NO: 4313167 - DNA, 15 bp, Homo sapiens
tgggcagctggctct

SEQ ID NO: 4313168 - DNA, 13 bp, Homo sapiens
tgggcagtggaga

SEQ ID NO: 4313169 - DNA, 15 bp, Homo sapiens
tgggcagtggagagg

SEQ ID NO: 4313170 - DNA, 15 bp, Homo sapiens
tgggcatggggtggg

SEQ ID NO: 4313171 - DNA, 23 bp, Homo sapiens
tgggccaagccagggttccagac

SEQ ID NO: 4313172 - DNA, 15 bp, Homo sapiens
tgggccagcccctcc

SEQ ID NO: 4313173 - DNA, 16 bp, Homo sapiens
tgggccagcccctccc

SEQ ID NO: 4313174 - DNA, 14 bp, Homo sapiens
tgggccccagggaa

SEQ ID NO: 4313175 - DNA, 14 bp, Homo sapiens
tgggccccctggga

SEQ ID NO: 4313176 - DNA, 13 bp, Homo sapiens
tgggccctaggca

SEQ ID NO: 4313177 - DNA, 14 bp, Homo sapiens
tgggccctggttcc

SEQ ID NO: 4313178 - DNA, 19 bp, Homo sapiens
tgggccctggttcccccag

SEQ ID NO: 4313179 - DNA, 14 bp, Homo sapiens
tgggctcacaccag

SEQ ID NO: 4313180 - DNA, 16 bp, Homo sapiens
tgggctcacaccagcc

SEQ ID NO: 4313181 - DNA, 17 bp, Homo sapiens
tgggctcacaccagccc

SEQ ID NO: 4313182 - DNA, 18 bp, Homo sapiens
tgggctcacaccagccct

SEQ ID NO: 4313183 - DNA, 20 bp, Homo sapiens
tgggctcacaccagccctgg

SEQ ID NO: 4313184 - DNA, 14 bp, Homo sapiens
tgggctccagagta

SEQ ID NO: 4313185 - DNA, 15 bp, Homo sapiens
tgggctccagagtag

SEQ ID NO: 4313186 - DNA, 14 bp, Homo sapiens
tgggctctgggttc

SEQ ID NO: 4313187 - DNA, 21 bp, Homo sapiens
tgggctgaatgtatgtaaata

SEQ ID NO: 4313188 - DNA, 14 bp, Homo sapiens
tgggctgagactgg

SEQ ID NO: 4313189 - DNA, 13 bp, Homo sapiens
tgggctgccctgg

SEQ ID NO: 4313190 - DNA, 15 bp, Homo sapiens
tgggctgccctggtg

SEQ ID NO: 4313191 - DNA, 19 bp, Homo sapiens
tgggctgccctggtgctgc

SEQ ID NO: 4313192 - DNA, 18 bp, Homo sapiens
tgggctggctgccttctg

SEQ ID NO: 4313193 - DNA, 23 bp, Homo sapiens
tggggagggacacagaggacggc

SEQ ID NO: 4313194 - DNA, 14 bp, Homo sapiens
tggggaggggagag

SEQ ID NO: 4313195 - DNA, 14 bp, Homo sapiens
tggggagggtgggc

SEQ ID NO: 4313196 - DNA, 20 bp, Homo sapiens
tggggatggggttgggctct

SEQ ID NO: 4313197 - DNA, 15 bp, Homo sapiens
tggggatttctccca

SEQ ID NO: 4313198 - DNA, 17 bp, Homo sapiens
tggggcagtagaaggtc

SEQ ID NO: 4313199 - DNA, 21 bp, Homo sapiens
tggggcccctttttactcccc

SEQ ID NO: 4313200 - DNA, 11 bp, Homo sapiens
tggggcctctg

SEQ ID NO: 4313201 - DNA, 12 bp, Homo sapiens
tggggcctctgt

SEQ ID NO: 4313202 - DNA, 15 bp, Homo sapiens
tggggcgaggcagag

SEQ ID NO: 4313203 - DNA, 17 bp, Homo sapiens
tggggcgaggcagagga

SEQ ID NO: 4313204 - DNA, 16 bp, Homo sapiens
tggggcgggaggccac

SEQ ID NO: 4313205 - DNA, 15 bp, Homo sapiens
tggggctagactggg

SEQ ID NO: 4313206 - DNA, 22 bp, Homo sapiens
tggggctagactgggctggctg

SEQ ID NO: 4313207 - DNA, 23 bp, Homo sapiens
tggggctagactgggctggctgc

SEQ ID NO: 4313208 - DNA, 14 bp, Homo sapiens
tgggggacttacat

SEQ ID NO: 4313209 - DNA, 22 bp, Homo sapiens
tgggggatttcaagggactggg

SEQ ID NO: 4313210 - DNA, 13 bp, Homo sapiens
tgggggccatgag

SEQ ID NO: 4313211 - DNA, 11 bp, Homo sapiens
tgggggctgct

SEQ ID NO: 4313212 - DNA, 15 bp, Homo sapiens
tgggggtctgggagg

SEQ ID NO: 4313213 - DNA, 18 bp, Homo sapiens
tgggggtctgggaggcag

SEQ ID NO: 4313214 - DNA, 20 bp, Homo sapiens
tgggggtctgggaggcaggt

SEQ ID NO: 4313215 - DNA, 23 bp, Homo sapiens
tgggggtgccaaccacctctggc

SEQ ID NO: 4313216 - DNA, 20 bp, Homo sapiens
tgggggtgtcacagaggcag

SEQ ID NO: 4313217 - DNA, 14 bp, Homo sapiens
tggggtagagagga

SEQ ID NO: 4313218 - DNA, 16 bp, Homo sapiens
tggggtagagaggaca

SEQ ID NO: 4313219 - DNA, 19 bp, Homo sapiens
tggggtttccacacaggcc

SEQ ID NO: 4313220 - DNA, 21 bp, Homo sapiens
tggggtttccacacaggccca

SEQ ID NO: 4313221 - DNA, 17 bp, Homo sapiens
tgggtcaactccaaggc

SEQ ID NO: 4313222 - DNA, 18 bp, Homo sapiens
tgggtcaccttcctgggc

SEQ ID NO: 4313223 - DNA, 22 bp, Homo sapiens
tgggtcttgttttttttttcca

SEQ ID NO: 4313224 - DNA, 20 bp, Homo sapiens
tgggtggccggccctgcccc

SEQ ID NO: 4313225 - DNA, 21 bp, Homo sapiens
tgggtggccggccctgccccc

SEQ ID NO: 4313226 - DNA, 13 bp, Homo sapiens
tgggtgggacaca

SEQ ID NO: 4313227 - DNA, 13 bp, Homo sapiens
tgggttccagaca

SEQ ID NO: 4313228 - DNA, 14 bp, Homo sapiens
tgggttccagacag

SEQ ID NO: 4313229 - DNA, 20 bp, Homo sapiens
tgggttccagacagagtgga

SEQ ID NO: 4313230 - DNA, 21 bp, Homo sapiens
tgggttccagacagagtggat

SEQ ID NO: 4313231 - DNA, 14 bp, Homo sapiens
tgggttctggggct

SEQ ID NO: 4313232 - DNA, 14 bp, Homo sapiens
tggtaagattgtta

SEQ ID NO: 4313233 - DNA, 19 bp, Homo sapiens
tggtaagattgttattaaa

SEQ ID NO: 4313234 - DNA, 16 bp, Homo sapiens
tggtaatcttttctga

SEQ ID NO: 4313235 - DNA, 17 bp, Homo sapiens
tggtattttcgtgcatt

SEQ ID NO: 4313236 - DNA, 20 bp, Homo sapiens
tggtcacttcaaacatgccc

SEQ ID NO: 4313237 - DNA, 24 bp, Homo sapiens
tggtcacttcaaacatgccctcag

SEQ ID NO: 4313238 - DNA, 13 bp, Homo sapiens
tggtccaggccag

SEQ ID NO: 4313239 - DNA, 12 bp, Homo sapiens
tggtcctgcact

SEQ ID NO: 4313240 - DNA, 13 bp, Homo sapiens
tggtctatttctc

SEQ ID NO: 4313241 - DNA, 17 bp, Homo sapiens
tggtctctaggcctgaa

SEQ ID NO: 4313242 - DNA, 14 bp, Homo sapiens
tggtctggagcccc

SEQ ID NO: 4313243 - DNA, 15 bp, Homo sapiens
tggtctggctttgga

SEQ ID NO: 4313244 - DNA, 19 bp, Homo sapiens
tggtcttcaaattgtcttt

SEQ ID NO: 4313245 - DNA, 16 bp, Homo sapiens
tggtcttggagaggag

SEQ ID NO: 4313246 - DNA, 17 bp, Homo sapiens
tggtcttggagaggagg

SEQ ID NO: 4313247 - DNA, 13 bp, Homo sapiens
tggtgaaagagta

SEQ ID NO: 4313248 - DNA, 22 bp, Homo sapiens
tggtgaaagagtaaaaccaaag

SEQ ID NO: 4313249 - DNA, 22 bp, Homo sapiens
tggtgagaattaaaataaaacg

SEQ ID NO: 4313250 - DNA, 13 bp, Homo sapiens
tggtgataagtgg

SEQ ID NO: 4313251 - DNA, 14 bp, Homo sapiens
tggtgcagtgaaga

SEQ ID NO: 4313252 - DNA, 17 bp, Homo sapiens
tggtgcccaccagctgg

SEQ ID NO: 4313253 - DNA, 22 bp, Homo sapiens
tggtgcccagactcaaggcctc

SEQ ID NO: 4313254 - DNA, 15 bp, Homo sapiens
tggtgccctggccca

SEQ ID NO: 4313255 - DNA, 14 bp, Homo sapiens
tggtgccttcattt

SEQ ID NO: 4313256 - DNA, 20 bp, Homo sapiens
tggtgctgcacccctggtgt

SEQ ID NO: 4313257 - DNA, 15 bp, Homo sapiens
tggtggccaggctgg

SEQ ID NO: 4313258 - DNA, 21 bp, Homo sapiens
tggtggcccgacagcctggca

SEQ ID NO: 4313259 - DNA, 16 bp, Homo sapiens
tggtgtccctgcctgg

SEQ ID NO: 4313260 - DNA, 20 bp, Homo sapiens
tggtgtgttcgtggagccac

SEQ ID NO: 4313261 - DNA, 21 bp, Homo sapiens
tggtgttctcaatgcttttct

SEQ ID NO: 4313262 - DNA, 18 bp, Homo sapiens
tggtgttggaggggcagg

SEQ ID NO: 4313263 - DNA, 13 bp, Homo sapiens
tggttaatcactt

SEQ ID NO: 4313264 - DNA, 11 bp, Homo sapiens
tggttcccctg

SEQ ID NO: 4313265 - DNA, 19 bp, Homo sapiens
tggttcccctgttcactct

SEQ ID NO: 4313266 - DNA, 23 bp, Homo sapiens
tggttggaggcctggtctggagc

SEQ ID NO: 4313267 - DNA, 14 bp, Homo sapiens
tggtttcagaaagg

SEQ ID NO: 4313268 - DNA, 13 bp, Homo sapiens
tggttttcattat

SEQ ID NO: 4313269 - DNA, 17 bp, Homo sapiens
tgtaaaggtaggtgcat

SEQ ID NO: 4313270 - DNA, 22 bp, Homo sapiens
tgtaaaggtaggtgcatgcctt

SEQ ID NO: 4313271 - DNA, 16 bp, Homo sapiens
tgtaaattcctgttgt

SEQ ID NO: 4313272 - DNA, 22 bp, Homo sapiens
tgtaaattgactgtactaggcc

SEQ ID NO: 4313273 - DNA, 19 bp, Homo sapiens
tgtaacagttggtgatttt

SEQ ID NO: 4313274 - DNA, 15 bp, Homo sapiens
tgtaaccatatgatt

SEQ ID NO: 4313275 - DNA, 22 bp, Homo sapiens
tgtaagaagctaaaatgaaaaa

SEQ ID NO: 4313276 - DNA, 19 bp, Homo sapiens
tgtaagattttattttcaa

SEQ ID NO: 4313277 - DNA, 17 bp, Homo sapiens
tgtaaggacttgtgcct

SEQ ID NO: 4313278 - DNA, 18 bp, Homo sapiens
tgtaatagtggctttcat

SEQ ID NO: 4313279 - DNA, 23 bp, Homo sapiens
tgtaatagtggctttcatttctt

SEQ ID NO: 4313280 - DNA, 23 bp, Homo sapiens
tgtaatatagaaaaaaacattct

SEQ ID NO: 4313281 - DNA, 21 bp, Homo sapiens
tgtaatatttacaatgtatta

SEQ ID NO: 4313282 - DNA, 19 bp, Homo sapiens
tgtaatcacactctcttct

SEQ ID NO: 4313283 - DNA, 23 bp, Homo sapiens
tgtaatcacactctcttcttact

SEQ ID NO: 4313284 - DNA, 13 bp, Homo sapiens
tgtaatcatttat

SEQ ID NO: 4313285 - DNA, 19 bp, Homo sapiens
tgtaatctctgattaaatt

SEQ ID NO: 4313286 - DNA, 15 bp, Homo sapiens
tgtaatgtatcttat

SEQ ID NO: 4313287 - DNA, 17 bp, Homo sapiens
tgtacaagtgctcagtt

SEQ ID NO: 4313288 - DNA, 14 bp, Homo sapiens
tgtacagttataca

SEQ ID NO: 4313289 - DNA, 22 bp, Homo sapiens
tgtacatatggaaatcctgtta

SEQ ID NO: 4313290 - DNA, 17 bp, Homo sapiens
tgtacgttaattaaaca

SEQ ID NO: 4313291 - DNA, 13 bp, Homo sapiens
tgtactaccccag

SEQ ID NO: 4313292 - DNA, 12 bp, Homo sapiens
tgtactcctccc

SEQ ID NO: 4313293 - DNA, 21 bp, Homo sapiens
tgtagaaaggttgattctcat

SEQ ID NO: 4313294 - DNA, 18 bp, Homo sapiens
tgtagaagagggagaagg

SEQ ID NO: 4313295 - DNA, 17 bp, Homo sapiens
tgtagacgcacctgctg

SEQ ID NO: 4313296 - DNA, 17 bp, Homo sapiens
tgtagagtggtctattt

SEQ ID NO: 4313297 - DNA, 20 bp, Homo sapiens
tgtagatcaactcatgttaa

SEQ ID NO: 4313298 - DNA, 16 bp, Homo sapiens
tgtagattgtgtaaat

SEQ ID NO: 4313299 - DNA, 17 bp, Homo sapiens
tgtagattttatagtgt

SEQ ID NO: 4313300 - DNA, 15 bp, Homo sapiens
tgtagccagcccaca

SEQ ID NO: 4313301 - DNA, 19 bp, Homo sapiens
tgtagcttcagtcattaaa

SEQ ID NO: 4313302 - DNA, 22 bp, Homo sapiens
tgtaggaagaggccgctgcagg

SEQ ID NO: 4313303 - DNA, 14 bp, Homo sapiens
tgtagtaattgtta

SEQ ID NO: 4313304 - DNA, 14 bp, Homo sapiens
tgtataaaacagtg

SEQ ID NO: 4313305 - DNA, 17 bp, Homo sapiens
tgtataaaacagtgttt

SEQ ID NO: 4313306 - DNA, 17 bp, Homo sapiens
tgtataatactttgtat

SEQ ID NO: 4313307 - DNA, 20 bp, Homo sapiens
tgtataatactttgtataca

SEQ ID NO: 4313308 - DNA, 22 bp, Homo sapiens
tgtataatactttgtatacaag

SEQ ID NO: 4313309 - DNA, 13 bp, Homo sapiens
tgtatacaaacag

SEQ ID NO: 4313310 - DNA, 15 bp, Homo sapiens
tgtatacaaacaggt

SEQ ID NO: 4313311 - DNA, 16 bp, Homo sapiens
tgtatacaaacaggtg

SEQ ID NO: 4313312 - DNA, 12 bp, Homo sapiens
tgtatataaatg

SEQ ID NO: 4313313 - DNA, 19 bp, Homo sapiens
tgtatatcgttatcactgt

SEQ ID NO: 4313314 - DNA, 18 bp, Homo sapiens
tgtatatttgtatgatat

SEQ ID NO: 4313315 - DNA, 15 bp, Homo sapiens
tgtatcagtgtttat

SEQ ID NO: 4313316 - DNA, 13 bp, Homo sapiens
tgtatctaaaaaa

SEQ ID NO: 4313317 - DNA, 15 bp, Homo sapiens
tgtatctaaaaaata

SEQ ID NO: 4313318 - DNA, 18 bp, Homo sapiens
tgtatctatgcattttct

SEQ ID NO: 4313319 - DNA, 20 bp, Homo sapiens
tgtatctcgaagtcttccat

SEQ ID NO: 4313320 - DNA, 14 bp, Homo sapiens
tgtatctgtgcttt

SEQ ID NO: 4313321 - DNA, 14 bp, Homo sapiens
tgtatgaaatatat

SEQ ID NO: 4313322 - DNA, 18 bp, Homo sapiens
tgtatgaaatatatgtga

SEQ ID NO: 4313323 - DNA, 19 bp, Homo sapiens
tgtatttattttcctcccc

SEQ ID NO: 4313324 - DNA, 14 bp, Homo sapiens
tgtattttctgtgt

SEQ ID NO: 4313325 - DNA, 21 bp, Homo sapiens
tgtatttttcctctttcactt

SEQ ID NO: 4313326 - DNA, 17 bp, Homo sapiens
tgtcaaaactccactca

SEQ ID NO: 4313327 - DNA, 18 bp, Homo sapiens
tgtcaaggggccctagga

SEQ ID NO: 4313328 - DNA, 13 bp, Homo sapiens
tgtcacagaggca

SEQ ID NO: 4313329 - DNA, 15 bp, Homo sapiens
tgtcacagaggcagt

SEQ ID NO: 4313330 - DNA, 21 bp, Homo sapiens
tgtcactaaatggcagtgaga

SEQ ID NO: 4313331 - DNA, 12 bp, Homo sapiens
tgtcagagctgg

SEQ ID NO: 4313332 - DNA, 17 bp, Homo sapiens
tgtcagtcgtgttgctt

SEQ ID NO: 4313333 - DNA, 14 bp, Homo sapiens
tgtcagtgcagccc

SEQ ID NO: 4313334 - DNA, 14 bp, Homo sapiens
tgtcatactctgtg

SEQ ID NO: 4313335 - DNA, 17 bp, Homo sapiens
tgtcatactctgtgtaa

SEQ ID NO: 4313336 - DNA, 20 bp, Homo sapiens
tgtccaacaactccaggaaa

SEQ ID NO: 4313337 - DNA, 18 bp, Homo sapiens
tgtccaagcatcagcaag

SEQ ID NO: 4313338 - DNA, 14 bp, Homo sapiens
tgtccaatctgcaa

SEQ ID NO: 4313339 - DNA, 13 bp, Homo sapiens
tgtccacaaatgt

SEQ ID NO: 4313340 - DNA, 22 bp, Homo sapiens
tgtccacaaatgtcctcagagg

SEQ ID NO: 4313341 - DNA, 18 bp, Homo sapiens
tgtccacacaagacagca

SEQ ID NO: 4313342 - DNA, 20 bp, Homo sapiens
tgtccacacaagacagcaga

SEQ ID NO: 4313343 - DNA, 19 bp, Homo sapiens
tgtccatgaaaaacagcag

SEQ ID NO: 4313344 - DNA, 21 bp, Homo sapiens
tgtccatgaaaaacagcagag

SEQ ID NO: 4313345 - DNA, 19 bp, Homo sapiens
tgtcccaggatggtcccag

SEQ ID NO: 4313346 - DNA, 18 bp, Homo sapiens
tgtccccagtgtggactc

SEQ ID NO: 4313347 - DNA, 14 bp, Homo sapiens
tgtccccattctat

SEQ ID NO: 4313348 - DNA, 22 bp, Homo sapiens
tgtccccgagccgagctctcct

SEQ ID NO: 4313349 - DNA, 22 bp, Homo sapiens
tgtccctaccgagtctcttctc

SEQ ID NO: 4313350 - DNA, 14 bp, Homo sapiens
tgtccctctcaggc

SEQ ID NO: 4313351 - DNA, 14 bp, Homo sapiens
tgtccctgcctggc

SEQ ID NO: 4313352 - DNA, 17 bp, Homo sapiens
tgtccctgcctggccct

SEQ ID NO: 4313353 - DNA, 17 bp, Homo sapiens
tgtccctgtccctgccc

SEQ ID NO: 4313354 - DNA, 16 bp, Homo sapiens
tgtcctaaatgcaaag

SEQ ID NO: 4313355 - DNA, 15 bp, Homo sapiens
tgtcctatccccgga

SEQ ID NO: 4313356 - DNA, 21 bp, Homo sapiens
tgtcctatccctggacgcatg

SEQ ID NO: 4313357 - DNA, 22 bp, Homo sapiens
tgtcctcagagggtccctaggt

SEQ ID NO: 4313358 - DNA, 21 bp, Homo sapiens
tgtcctggctcccagggtcct

SEQ ID NO: 4313359 - DNA, 20 bp, Homo sapiens
tgtcctgtaactgttacagt

SEQ ID NO: 4313360 - DNA, 15 bp, Homo sapiens
tgtcctgtgagatgt

SEQ ID NO: 4313361 - DNA, 16 bp, Homo sapiens
tgtccttcccacggcc

SEQ ID NO: 4313362 - DNA, 22 bp, Homo sapiens
tgtcgcctctcactctggcagc

SEQ ID NO: 4313363 - DNA, 12 bp, Homo sapiens
tgtctactgctt

SEQ ID NO: 4313364 - DNA, 13 bp, Homo sapiens
tgtctactgcttg

SEQ ID NO: 4313365 - DNA, 21 bp, Homo sapiens
tgtctagtttgcatacttcct

SEQ ID NO: 4313366 - DNA, 18 bp, Homo sapiens
tgtctattgtccaaagtt

SEQ ID NO: 4313367 - DNA, 19 bp, Homo sapiens
tgtctcaagagggcactgg

SEQ ID NO: 4313368 - DNA, 11 bp, Homo sapiens
tgtctccagac

SEQ ID NO: 4313369 - DNA, 12 bp, Homo sapiens
tgtctccagacc

SEQ ID NO: 4313370 - DNA, 20 bp, Homo sapiens
tgtctccagacccccacccc

SEQ ID NO: 4313371 - DNA, 22 bp, Homo sapiens
tgtctccagacccccacccctt

SEQ ID NO: 4313372 - DNA, 20 bp, Homo sapiens
tgtctgaagtcactgcacag

SEQ ID NO: 4313373 - DNA, 17 bp, Homo sapiens
tgtctgacttctcagga

SEQ ID NO: 4313374 - DNA, 15 bp, Homo sapiens
tgtctgagccctgcc

SEQ ID NO: 4313375 - DNA, 16 bp, Homo sapiens
tgtctgagccctgccc

SEQ ID NO: 4313376 - DNA, 12 bp, Homo sapiens
tgtctgatattg

SEQ ID NO: 4313377 - DNA, 16 bp, Homo sapiens
tgtctgattctatgcc

SEQ ID NO: 4313378 - DNA, 16 bp, Homo sapiens
tgtctgccgtgagagc

SEQ ID NO: 4313379 - DNA, 17 bp, Homo sapiens
tgtctgcgccgctgtgc

SEQ ID NO: 4313380 - DNA, 18 bp, Homo sapiens
tgtctgtaagagaattct

SEQ ID NO: 4313381 - DNA, 13 bp, Homo sapiens
tgtctgtggccct

SEQ ID NO: 4313382 - DNA, 15 bp, Homo sapiens
tgtctgtggccctct

SEQ ID NO: 4313383 - DNA, 20 bp, Homo sapiens
tgtcttgagagcgctggcct

SEQ ID NO: 4313384 - DNA, 19 bp, Homo sapiens
tgtcttgcactggccttct

SEQ ID NO: 4313385 - DNA, 14 bp, Homo sapiens
tgtcttgtaggtaa

SEQ ID NO: 4313386 - DNA, 16 bp, Homo sapiens
tgtcttgtgttgctgt

SEQ ID NO: 4313387 - DNA, 13 bp, Homo sapiens
tgtctttgctgtt

SEQ ID NO: 4313388 - DNA, 17 bp, Homo sapiens
tgtgaaacacagctgtt

SEQ ID NO: 4313389 - DNA, 14 bp, Homo sapiens
tgtgaaatgtaact

SEQ ID NO: 4313390 - DNA, 14 bp, Homo sapiens
tgtgaaatttgtta

SEQ ID NO: 4313391 - DNA, 14 bp, Homo sapiens
tgtgaactatgttt

SEQ ID NO: 4313392 - DNA, 14 bp, Homo sapiens
tgtgaatatgccag

SEQ ID NO: 4313393 - DNA, 17 bp, Homo sapiens
tgtgaatgctgtacctt

SEQ ID NO: 4313394 - DNA, 20 bp, Homo sapiens
tgtgaattgaagtcatcata

SEQ ID NO: 4313395 - DNA, 21 bp, Homo sapiens
tgtgaattgaagtcatcataa

SEQ ID NO: 4313396 - DNA, 16 bp, Homo sapiens
tgtgaccggggtcctg

SEQ ID NO: 4313397 - DNA, 20 bp, Homo sapiens
tgtgactccatatcccggga

SEQ ID NO: 4313398 - DNA, 14 bp, Homo sapiens
tgtgagggtgcagg

SEQ ID NO: 4313399 - DNA, 13 bp, Homo sapiens
tgtgagtgtgaat

SEQ ID NO: 4313400 - DNA, 20 bp, Homo sapiens
tgtgattccccggagctggg

SEQ ID NO: 4313401 - DNA, 13 bp, Homo sapiens
tgtgattgaatct

SEQ ID NO: 4313402 - DNA, 15 bp, Homo sapiens
tgtgattgaatctga

SEQ ID NO: 4313403 - DNA, 21 bp, Homo sapiens
tgtgattggcagcttcaaaac

SEQ ID NO: 4313404 - DNA, 17 bp, Homo sapiens
tgtgcaagacacccagt

SEQ ID NO: 4313405 - DNA, 23 bp, Homo sapiens
tgtgcaagacacccagtggaacc

SEQ ID NO: 4313406 - DNA, 16 bp, Homo sapiens
tgtgcaatatgtaaca

SEQ ID NO: 4313407 - DNA, 15 bp, Homo sapiens
tgtgcacccgtgcca

SEQ ID NO: 4313408 - DNA, 23 bp, Homo sapiens
tgtgccaccctctgcagggcagc

SEQ ID NO: 4313409 - DNA, 12 bp, Homo sapiens
tgtgccagctgc

SEQ ID NO: 4313410 - DNA, 20 bp, Homo sapiens
tgtgccagctgcttctgccc

SEQ ID NO: 4313411 - DNA, 21 bp, Homo sapiens
tgtgccagctgcttctgccca

SEQ ID NO: 4313412 - DNA, 18 bp, Homo sapiens
tgtgcccgctgcgctgcc

SEQ ID NO: 4313413 - DNA, 20 bp, Homo sapiens
tgtgcccgctgcgctgccct

SEQ ID NO: 4313414 - DNA, 22 bp, Homo sapiens
tgtgcccgctgcgctgccctgc

SEQ ID NO: 4313415 - DNA, 23 bp, Homo sapiens
tgtgcccgctgcgctgccctgca

SEQ ID NO: 4313416 - DNA, 17 bp, Homo sapiens
tgtgcctcttgggagac

SEQ ID NO: 4313417 - DNA, 18 bp, Homo sapiens
tgtgcctgctatccagcc

SEQ ID NO: 4313418 - DNA, 19 bp, Homo sapiens
tgtgcctgctatccagccg

SEQ ID NO: 4313419 - DNA, 21 bp, Homo sapiens
tgtgcctgctatccagccgca

SEQ ID NO: 4313420 - DNA, 16 bp, Homo sapiens
tgtgctattaatattt

SEQ ID NO: 4313421 - DNA, 18 bp, Homo sapiens
tgtgctattaatatttgt

SEQ ID NO: 4313422 - DNA, 18 bp, Homo sapiens
tgtgctccaggcttcctg

SEQ ID NO: 4313423 - DNA, 22 bp, Homo sapiens
tgtgctccagtgttttcttgtg

SEQ ID NO: 4313424 - DNA, 15 bp, Homo sapiens
tgtgctgctgtggca

SEQ ID NO: 4313425 - DNA, 21 bp, Homo sapiens
tgtgctggtctctaggcctga

SEQ ID NO: 4313426 - DNA, 18 bp, Homo sapiens
tgtgcttatgtcatttct

SEQ ID NO: 4313427 - DNA, 13 bp, Homo sapiens
tgtgcttgaagat

SEQ ID NO: 4313428 - DNA, 16 bp, Homo sapiens
tgtgcttgaagattca

SEQ ID NO: 4313429 - DNA, 14 bp, Homo sapiens
tgtgcttgttcttc

SEQ ID NO: 4313430 - DNA, 14 bp, Homo sapiens
tgtgctttcaagat

SEQ ID NO: 4313431 - DNA, 14 bp, Homo sapiens
tgtggaagggacta

SEQ ID NO: 4313432 - DNA, 16 bp, Homo sapiens
tgtggagaggagagaa

SEQ ID NO: 4313433 - DNA, 16 bp, Homo sapiens
tgtggagcccgcaccc

SEQ ID NO: 4313434 - DNA, 18 bp, Homo sapiens
tgtggagcccgcaccccc

SEQ ID NO: 4313435 - DNA, 18 bp, Homo sapiens
tgtggagctgcttccagt

SEQ ID NO: 4313436 - DNA, 13 bp, Homo sapiens
tgtggagtggagg

SEQ ID NO: 4313437 - DNA, 14 bp, Homo sapiens
tgtggagtggaggg

SEQ ID NO: 4313438 - DNA, 19 bp, Homo sapiens
tgtggagtggaggggtcag

SEQ ID NO: 4313439 - DNA, 17 bp, Homo sapiens
tgtggcatcaggaaagg

SEQ ID NO: 4313440 - DNA, 21 bp, Homo sapiens
tgtggctaaatgcctaataaa

SEQ ID NO: 4313441 - DNA, 13 bp, Homo sapiens
tgtggctcccctc

SEQ ID NO: 4313442 - DNA, 18 bp, Homo sapiens
tgtgggaatgcggcaaga

SEQ ID NO: 4313443 - DNA, 15 bp, Homo sapiens
tgtgggactggccca

SEQ ID NO: 4313444 - DNA, 17 bp, Homo sapiens
tgtgggcagctggctct

SEQ ID NO: 4313445 - DNA, 18 bp, Homo sapiens
tgtgggctcccacgccct

SEQ ID NO: 4313446 - DNA, 14 bp, Homo sapiens
tgtgggtcagggag

SEQ ID NO: 4313447 - DNA, 16 bp, Homo sapiens
tgtgggtcagtgtgcc

SEQ ID NO: 4313448 - DNA, 21 bp, Homo sapiens
tgtgggtcagtgtgccaccct

SEQ ID NO: 4313449 - DNA, 19 bp, Homo sapiens
tgtgggtttactctgtgct

SEQ ID NO: 4313450 - DNA, 20 bp, Homo sapiens
tgtgggtttactctgtgcta

SEQ ID NO: 4313451 - DNA, 20 bp, Homo sapiens
tgtggtcagcggcctgggga

SEQ ID NO: 4313452 - DNA, 23 bp, Homo sapiens
tgtggtgaggtcctgtcctggct

SEQ ID NO: 4313453 - DNA, 22 bp, Homo sapiens
tgtgtaatcatttcttgggccc

SEQ ID NO: 4313454 - DNA, 21 bp, Homo sapiens
tgtgtaggaagaggccgctgc

SEQ ID NO: 4313455 - DNA, 20 bp, Homo sapiens
tgtgtagggcttttttttga

SEQ ID NO: 4313456 - DNA, 19 bp, Homo sapiens
tgtgtatgtgtttataatt

SEQ ID NO: 4313457 - DNA, 20 bp, Homo sapiens
tgtgtattctgtggattcta

SEQ ID NO: 4313458 - DNA, 18 bp, Homo sapiens
tgtgtcctaaatgcaaag

SEQ ID NO: 4313459 - DNA, 14 bp, Homo sapiens
tgtgtgattacagc

SEQ ID NO: 4313460 - DNA, 12 bp, Homo sapiens
tgtgtgtatgtg

SEQ ID NO: 4313461 - DNA, 19 bp, Homo sapiens
tgtgttaatcttaatgtat

SEQ ID NO: 4313462 - DNA, 16 bp, Homo sapiens
tgtgtttataattgtt

SEQ ID NO: 4313463 - DNA, 17 bp, Homo sapiens
tgttaaaacaaattaaa

SEQ ID NO: 4313464 - DNA, 20 bp, Homo sapiens
tgttaaagaggcgtcttgta

SEQ ID NO: 4313465 - DNA, 15 bp, Homo sapiens
tgttaaataaggcct

SEQ ID NO: 4313466 - DNA, 18 bp, Homo sapiens
tgttaacttattcaaaga

SEQ ID NO: 4313467 - DNA, 16 bp, Homo sapiens
tgttaagttcaccgta

SEQ ID NO: 4313468 - DNA, 22 bp, Homo sapiens
tgttaataaagtgcactgccac

SEQ ID NO: 4313469 - DNA, 12 bp, Homo sapiens
tgttaatatcac

SEQ ID NO: 4313470 - DNA, 18 bp, Homo sapiens
tgttaatatcactcatta

SEQ ID NO: 4313471 - DNA, 21 bp, Homo sapiens
tgttaatatcactcattaatt

SEQ ID NO: 4313472 - DNA, 16 bp, Homo sapiens
tgttacaggtgtacta

SEQ ID NO: 4313473 - DNA, 18 bp, Homo sapiens
tgttacaggtgtactatg

SEQ ID NO: 4313474 - DNA, 14 bp, Homo sapiens
tgttacagtaatgt

SEQ ID NO: 4313475 - DNA, 21 bp, Homo sapiens
tgttacagtaatgtcataaag

SEQ ID NO: 4313476 - DNA, 21 bp, Homo sapiens
tgttacccagtaactcatctg

SEQ ID NO: 4313477 - DNA, 16 bp, Homo sapiens
tgttacttaaatagca

SEQ ID NO: 4313478 - DNA, 16 bp, Homo sapiens
tgttactttggaatga

SEQ ID NO: 4313479 - DNA, 16 bp, Homo sapiens
tgttaggggaaaatag

SEQ ID NO: 4313480 - DNA, 17 bp, Homo sapiens
tgttatacaaccttcat

SEQ ID NO: 4313481 - DNA, 15 bp, Homo sapiens
tgttatggtagaaaa

SEQ ID NO: 4313482 - DNA, 16 bp, Homo sapiens
tgttatggtagaaaaa

SEQ ID NO: 4313483 - DNA, 17 bp, Homo sapiens
tgttatggtagaaaaat

SEQ ID NO: 4313484 - DNA, 21 bp, Homo sapiens
tgttattgggcaagtgattga

SEQ ID NO: 4313485 - DNA, 22 bp, Homo sapiens
tgttattgggcaagtgattgaa

SEQ ID NO: 4313486 - DNA, 21 bp, Homo sapiens
tgttcagaagttgttagtgat

SEQ ID NO: 4313487 - DNA, 11 bp, Homo sapiens
tgttcatttcc

SEQ ID NO: 4313488 - DNA, 17 bp, Homo sapiens
tgttccatcctgtacaa

SEQ ID NO: 4313489 - DNA, 21 bp, Homo sapiens
tgttccatcctgtacaagtgc

SEQ ID NO: 4313490 - DNA, 14 bp, Homo sapiens
tgttccctgctggg

SEQ ID NO: 4313491 - DNA, 11 bp, Homo sapiens
tgttcctggga

SEQ ID NO: 4313492 - DNA, 19 bp, Homo sapiens
tgttctagttagcaggaaa

SEQ ID NO: 4313493 - DNA, 14 bp, Homo sapiens
tgttctcaatgctt

SEQ ID NO: 4313494 - DNA, 18 bp, Homo sapiens
tgttctcaatgcttttct

SEQ ID NO: 4313495 - DNA, 11 bp, Homo sapiens
tgttctctgct

SEQ ID NO: 4313496 - DNA, 14 bp, Homo sapiens
tgttctggcctctg

SEQ ID NO: 4313497 - DNA, 16 bp, Homo sapiens
tgttctgtgtctgctg

SEQ ID NO: 4313498 - DNA, 23 bp, Homo sapiens
tgttctttcctttcatcctcagc

SEQ ID NO: 4313499 - DNA, 14 bp, Homo sapiens
tgttgattaaaaca

SEQ ID NO: 4313500 - DNA, 20 bp, Homo sapiens
tgttgcaaattattctagtc

SEQ ID NO: 4313501 - DNA, 15 bp, Homo sapiens
tgttgcctcctccca

SEQ ID NO: 4313502 - DNA, 19 bp, Homo sapiens
tgttgcctcctcccatcca

SEQ ID NO: 4313503 - DNA, 16 bp, Homo sapiens
tgtttaaggttcttgc

SEQ ID NO: 4313504 - DNA, 16 bp, Homo sapiens
tgtttaccctccctgt

SEQ ID NO: 4313505 - DNA, 19 bp, Homo sapiens
tgtttaccctccctgtccc

SEQ ID NO: 4313506 - DNA, 22 bp, Homo sapiens
tgtttacctcactggtgcattt

SEQ ID NO: 4313507 - DNA, 17 bp, Homo sapiens
tgtttatgtgctattaa

SEQ ID NO: 4313508 - DNA, 22 bp, Homo sapiens
tgtttatgtgctattaatattt

SEQ ID NO: 4313509 - DNA, 12 bp, Homo sapiens
tgtttccaggca

SEQ ID NO: 4313510 - DNA, 12 bp, Homo sapiens
tgtttccagtga

SEQ ID NO: 4313511 - DNA, 20 bp, Homo sapiens
tgtttcccgctccaagagaa

SEQ ID NO: 4313512 - DNA, 11 bp, Homo sapiens
tgtttctctgt

SEQ ID NO: 4313513 - DNA, 14 bp, Homo sapiens
tgtttctctgtaaa

SEQ ID NO: 4313514 - DNA, 18 bp, Homo sapiens
tgtttctgtcctgtaact

SEQ ID NO: 4313515 - DNA, 20 bp, Homo sapiens
tgtttctgtcctgtaactgt

SEQ ID NO: 4313516 - DNA, 21 bp, Homo sapiens
tgtttgaattgatttttaaac

SEQ ID NO: 4313517 - DNA, 14 bp, Homo sapiens
tgtttgatgtgtat

SEQ ID NO: 4313518 - DNA, 16 bp, Homo sapiens
tgtttgatgtgtatgt

SEQ ID NO: 4313519 - DNA, 18 bp, Homo sapiens
tgtttgatgtgtatgtgt

SEQ ID NO: 4313520 - DNA, 22 bp, Homo sapiens
tgtttgcctttaggcaggaagt

SEQ ID NO: 4313521 - DNA, 16 bp, Homo sapiens
tgtttgtatataaatg

SEQ ID NO: 4313522 - DNA, 14 bp, Homo sapiens
tgtttgttttcaaa

SEQ ID NO: 4313523 - DNA, 17 bp, Homo sapiens
tgttttacaatggctgg

SEQ ID NO: 4313524 - DNA, 12 bp, Homo sapiens
tgttttatgtca

SEQ ID NO: 4313525 - DNA, 14 bp, Homo sapiens
tgttttatgtcata

SEQ ID NO: 4313526 - DNA, 22 bp, Homo sapiens
tgttttattgagttctgaaggt

SEQ ID NO: 4313527 - DNA, 21 bp, Homo sapiens
tgttttccccaattatcctcc

SEQ ID NO: 4313528 - DNA, 23 bp, Homo sapiens
tgttttcttgtgttgttttctct

SEQ ID NO: 4313529 - DNA, 23 bp, Homo sapiens
tgttttgcaagggaatgaatcca

SEQ ID NO: 4313530 - DNA, 23 bp, Homo sapiens
tgttttggtatgcactggttcct

SEQ ID NO: 4313531 - DNA, 17 bp, Homo sapiens
tgttttttcctgagctt

SEQ ID NO: 4313532 - DNA, 12 bp, Homo sapiens
tgttttttctaa

SEQ ID NO: 4313533 - DNA, 16 bp, Homo sapiens
ttaaaaaaaaaaatga

SEQ ID NO: 4313534 - DNA, 16 bp, Homo sapiens
ttaaaaaagaaagatt

SEQ ID NO: 4313535 - DNA, 14 bp, Homo sapiens
ttaaaaaatagttg

SEQ ID NO: 4313536 - DNA, 14 bp, Homo sapiens
ttaaaaacacctaa

SEQ ID NO: 4313537 - DNA, 15 bp, Homo sapiens
ttaaaacaaattaaa

SEQ ID NO: 4313538 - DNA, 21 bp, Homo sapiens
ttaaaagctatcttcatgtaa

SEQ ID NO: 4313539 - DNA, 21 bp, Homo sapiens
ttaaaataaaacgttatctca

SEQ ID NO: 4313540 - DNA, 16 bp, Homo sapiens
ttaaaatagttttcta

SEQ ID NO: 4313541 - DNA, 20 bp, Homo sapiens
ttaaaatagttttctaaatg

SEQ ID NO: 4313542 - DNA, 12 bp, Homo sapiens
ttaaaatggact

SEQ ID NO: 4313543 - DNA, 13 bp, Homo sapiens
ttaaaattagtga

SEQ ID NO: 4313544 - DNA, 17 bp, Homo sapiens
ttaaaattagtgagatt

SEQ ID NO: 4313545 - DNA, 12 bp, Homo sapiens
ttaaacaaatgg

SEQ ID NO: 4313546 - DNA, 19 bp, Homo sapiens
ttaaacagttgcacagcat

SEQ ID NO: 4313547 - DNA, 12 bp, Homo sapiens
ttaaagaaaggc

SEQ ID NO: 4313548 - DNA, 17 bp, Homo sapiens
ttaaagacatttaaaat

SEQ ID NO: 4313549 - DNA, 23 bp, Homo sapiens
ttaaagacttgatgaataaacac

SEQ ID NO: 4313550 - DNA, 19 bp, Homo sapiens
ttaaagaggcgtcttgtat

SEQ ID NO: 4313551 - DNA, 23 bp, Homo sapiens
ttaaagaggcgtcttgtattttc

SEQ ID NO: 4313552 - DNA, 21 bp, Homo sapiens
ttaaatgtagcttcagtcatt

SEQ ID NO: 4313553 - DNA, 18 bp, Homo sapiens
ttaaattttaatgtaaaa

SEQ ID NO: 4313554 - DNA, 15 bp, Homo sapiens
ttaacatacatctaa

SEQ ID NO: 4313555 - DNA, 20 bp, Homo sapiens
ttaaccaaattaacctttca

SEQ ID NO: 4313556 - DNA, 15 bp, Homo sapiens
ttaacctttcaggaa

SEQ ID NO: 4313557 - DNA, 15 bp, Homo sapiens
ttaagaaagctatat

SEQ ID NO: 4313558 - DNA, 15 bp, Homo sapiens
ttaagaactgacaca

SEQ ID NO: 4313559 - DNA, 22 bp, Homo sapiens
ttaagcttaaaaaagaaagatt

SEQ ID NO: 4313560 - DNA, 14 bp, Homo sapiens
ttaaggcagtgact

SEQ ID NO: 4313561 - DNA, 12 bp, Homo sapiens
ttaagtaagttt

SEQ ID NO: 4313562 - DNA, 17 bp, Homo sapiens
ttaagtctatctggtat

SEQ ID NO: 4313563 - DNA, 15 bp, Homo sapiens
ttaagtcttactgtt

SEQ ID NO: 4313564 - DNA, 20 bp, Homo sapiens
ttaatagccatttgaagaag

SEQ ID NO: 4313565 - DNA, 17 bp, Homo sapiens
ttaataggataaattaa

SEQ ID NO: 4313566 - DNA, 18 bp, Homo sapiens
ttaatatcactcattaat

SEQ ID NO: 4313567 - DNA, 14 bp, Homo sapiens
ttaatcaagagaga

SEQ ID NO: 4313568 - DNA, 14 bp, Homo sapiens
ttaatctctaaaat

SEQ ID NO: 4313569 - DNA, 17 bp, Homo sapiens
ttaatctctaaaattct

SEQ ID NO: 4313570 - DNA, 16 bp, Homo sapiens
ttaatcttaatgtata

SEQ ID NO: 4313571 - DNA, 20 bp, Homo sapiens
ttaatgccacggcagccacc

SEQ ID NO: 4313572 - DNA, 18 bp, Homo sapiens
ttaatgtaaaattcatag

SEQ ID NO: 4313573 - DNA, 18 bp, Homo sapiens
ttaattggttaatcactt

SEQ ID NO: 4313574 - DNA, 15 bp, Homo sapiens
ttaattgtcttgcac

SEQ ID NO: 4313575 - DNA, 11 bp, Homo sapiens
ttaatttgtgt

SEQ ID NO: 4313576 - DNA, 20 bp, Homo sapiens
ttaattttgacactgaaata

SEQ ID NO: 4313577 - DNA, 19 bp, Homo sapiens
ttacaagttatagtactag

SEQ ID NO: 4313578 - DNA, 17 bp, Homo sapiens
ttacaatggccagccca

SEQ ID NO: 4313579 - DNA, 13 bp, Homo sapiens
ttacaatgtatta

SEQ ID NO: 4313580 - DNA, 13 bp, Homo sapiens
ttacaattgtcat

SEQ ID NO: 4313581 - DNA, 15 bp, Homo sapiens
ttacagggaagaaat

SEQ ID NO: 4313582 - DNA, 15 bp, Homo sapiens
ttacaggtgtactat

SEQ ID NO: 4313583 - DNA, 22 bp, Homo sapiens
ttacagtaatgtcataaagtga

SEQ ID NO: 4313584 - DNA, 22 bp, Homo sapiens
ttacagtaggagtgagaaattt

SEQ ID NO: 4313585 - DNA, 22 bp, Homo sapiens
ttacagtgtatctcgaagtctt

SEQ ID NO: 4313586 - DNA, 18 bp, Homo sapiens
ttacatagtctgaagtga

SEQ ID NO: 4313587 - DNA, 20 bp, Homo sapiens
ttacatgagttcaaatactt

SEQ ID NO: 4313588 - DNA, 17 bp, Homo sapiens
ttacatgattcatttta

SEQ ID NO: 4313589 - DNA, 21 bp, Homo sapiens
ttaccagatttttacacatgt

SEQ ID NO: 4313590 - DNA, 24 bp, Homo sapiens
ttaccagatttttacacatgtatc

SEQ ID NO: 4313591 - DNA, 19 bp, Homo sapiens
ttaccatttgttaatatca

SEQ ID NO: 4313592 - DNA, 12 bp, Homo sapiens
ttaccctccctg

SEQ ID NO: 4313593 - DNA, 19 bp, Homo sapiens
ttaccctccctgtcccctg

SEQ ID NO: 4313594 - DNA, 21 bp, Homo sapiens
ttacctaagagccacaataag

SEQ ID NO: 4313595 - DNA, 19 bp, Homo sapiens
ttacctcactggtgcattt

SEQ ID NO: 4313596 - DNA, 15 bp, Homo sapiens
ttacctctctgtcat

SEQ ID NO: 4313597 - DNA, 17 bp, Homo sapiens
ttacctctctgtcatgt

SEQ ID NO: 4313598 - DNA, 23 bp, Homo sapiens
ttaccttcacatgtcctattact

SEQ ID NO: 4313599 - DNA, 13 bp, Homo sapiens
ttactaaacattt

SEQ ID NO: 4313600 - DNA, 21 bp, Homo sapiens
ttactaaacattttgttattg

SEQ ID NO: 4313601 - DNA, 18 bp, Homo sapiens
ttactatagcaaagtagt

SEQ ID NO: 4313602 - DNA, 11 bp, Homo sapiens
ttactcccctt

SEQ ID NO: 4313603 - DNA, 22 bp, Homo sapiens
ttactgatgtgtgcaacctttt

SEQ ID NO: 4313604 - DNA, 22 bp, Homo sapiens
ttactggatctcttaagacagc

SEQ ID NO: 4313605 - DNA, 18 bp, Homo sapiens
ttactgtctgtaagagaa

SEQ ID NO: 4313606 - DNA, 16 bp, Homo sapiens
ttacttaaagcttgtt

SEQ ID NO: 4313607 - DNA, 14 bp, Homo sapiens
ttacttaaatagca

SEQ ID NO: 4313608 - DNA, 22 bp, Homo sapiens
ttacttaaatagcatctgctct

SEQ ID NO: 4313609 - DNA, 23 bp, Homo sapiens
ttactttaggtagtagaatctca

SEQ ID NO: 4313610 - DNA, 21 bp, Homo sapiens
ttactttggaatgactataaa

SEQ ID NO: 4313611 - DNA, 13 bp, Homo sapiens
ttactttgtgcaa

SEQ ID NO: 4313612 - DNA, 22 bp, Homo sapiens
ttagaaccagtcttttgaaaga

SEQ ID NO: 4313613 - DNA, 11 bp, Homo sapiens
ttagaagccac

SEQ ID NO: 4313614 - DNA, 18 bp, Homo sapiens
ttagaatcaagtctgtga

SEQ ID NO: 4313615 - DNA, 20 bp, Homo sapiens
ttagacaaccatagaactgt

SEQ ID NO: 4313616 - DNA, 17 bp, Homo sapiens
ttagacaagcctggagg

SEQ ID NO: 4313617 - DNA, 18 bp, Homo sapiens
ttagagattaatttgtgt

SEQ ID NO: 4313618 - DNA, 16 bp, Homo sapiens
ttagagggacagccaa

SEQ ID NO: 4313619 - DNA, 23 bp, Homo sapiens
ttagagggacagccaaaagtaag

SEQ ID NO: 4313620 - DNA, 15 bp, Homo sapiens
ttagattcactttga

SEQ ID NO: 4313621 - DNA, 22 bp, Homo sapiens
ttagcaaagatatctcatctct

SEQ ID NO: 4313622 - DNA, 12 bp, Homo sapiens
ttagcacagagg

SEQ ID NO: 4313623 - DNA, 16 bp, Homo sapiens
ttagcatgaaaggtaa

SEQ ID NO: 4313624 - DNA, 16 bp, Homo sapiens
ttagcattgaaataat

SEQ ID NO: 4313625 - DNA, 20 bp, Homo sapiens
ttagcattttctgcatctcc

SEQ ID NO: 4313626 - DNA, 12 bp, Homo sapiens
ttagctttgtca

SEQ ID NO: 4313627 - DNA, 23 bp, Homo sapiens
ttaggcaggaagtcaggagccag

SEQ ID NO: 4313628 - DNA, 16 bp, Homo sapiens
ttagggaaatccaact

SEQ ID NO: 4313629 - DNA, 16 bp, Homo sapiens
ttaggggaaaatagta

SEQ ID NO: 4313630 - DNA, 14 bp, Homo sapiens
ttagtcataccatc

SEQ ID NO: 4313631 - DNA, 17 bp, Homo sapiens
ttagtgactaaaccatt

SEQ ID NO: 4313632 - DNA, 13 bp, Homo sapiens
ttagtgagatttg

SEQ ID NO: 4313633 - DNA, 13 bp, Homo sapiens
ttagtgatttgct

SEQ ID NO: 4313634 - DNA, 13 bp, Homo sapiens
ttagttaaaatct

SEQ ID NO: 4313635 - DNA, 18 bp, Homo sapiens
ttagttcctgtgcacagc

SEQ ID NO: 4313636 - DNA, 17 bp, Homo sapiens
ttagtttaccaatcaac

SEQ ID NO: 4313637 - DNA, 22 bp, Homo sapiens
ttataaaaccatcaaaaatatt

SEQ ID NO: 4313638 - DNA, 16 bp, Homo sapiens
ttatacaaccttcatt

SEQ ID NO: 4313639 - DNA, 13 bp, Homo sapiens
ttatatataaata

SEQ ID NO: 4313640 - DNA, 18 bp, Homo sapiens
ttatatcatcaatacttt

SEQ ID NO: 4313641 - DNA, 18 bp, Homo sapiens
ttatattagagtgccctt

SEQ ID NO: 4313642 - DNA, 19 bp, Homo sapiens
ttatattagagtgccctta

SEQ ID NO: 4313643 - DNA, 17 bp, Homo sapiens
ttatattgttcacttct

SEQ ID NO: 4313644 - DNA, 20 bp, Homo sapiens
ttatcagtttgctaatgttt

SEQ ID NO: 4313645 - DNA, 23 bp, Homo sapiens
ttatcccatctcactttaataat

SEQ ID NO: 4313646 - DNA, 23 bp, Homo sapiens
ttatctagcaagaagattctaaa

SEQ ID NO: 4313647 - DNA, 14 bp, Homo sapiens
ttatcttatctagc

SEQ ID NO: 4313648 - DNA, 22 bp, Homo sapiens
ttatgaagttaacagtctcatt

SEQ ID NO: 4313649 - DNA, 18 bp, Homo sapiens
ttatgagctcttcatgtt

SEQ ID NO: 4313650 - DNA, 14 bp, Homo sapiens
ttatggtattttcg

SEQ ID NO: 4313651 - DNA, 22 bp, Homo sapiens
ttatggtattttcgtgcatttg

SEQ ID NO: 4313652 - DNA, 11 bp, Homo sapiens
ttatgtcatac

SEQ ID NO: 4313653 - DNA, 17 bp, Homo sapiens
ttatgtcctgtgagatg

SEQ ID NO: 4313654 - DNA, 20 bp, Homo sapiens
ttatgtcctgtgagatgtgt

SEQ ID NO: 4313655 - DNA, 22 bp, Homo sapiens
ttatgtcctgtgagatgtgtat

SEQ ID NO: 4313656 - DNA, 22 bp, Homo sapiens
ttatgtttacctcactggtgca

SEQ ID NO: 4313657 - DNA, 15 bp, Homo sapiens
ttattaaatgtagct

SEQ ID NO: 4313658 - DNA, 17 bp, Homo sapiens
ttattaacatatattgt

SEQ ID NO: 4313659 - DNA, 13 bp, Homo sapiens
ttattcaaagaga

SEQ ID NO: 4313660 - DNA, 14 bp, Homo sapiens
ttattcaaagagaa

SEQ ID NO: 4313661 - DNA, 17 bp, Homo sapiens
ttattcattagctgtga

SEQ ID NO: 4313662 - DNA, 12 bp, Homo sapiens
ttattctaatta

SEQ ID NO: 4313663 - DNA, 11 bp, Homo sapiens
ttattctagtc

SEQ ID NO: 4313664 - DNA, 20 bp, Homo sapiens
ttattctagtcaactgctgt

SEQ ID NO: 4313665 - DNA, 19 bp, Homo sapiens
ttattgatattctaagaaa

SEQ ID NO: 4313666 - DNA, 21 bp, Homo sapiens
ttattgcccatgatataactt

SEQ ID NO: 4313667 - DNA, 15 bp, Homo sapiens
ttattgtctgtaaat

SEQ ID NO: 4313668 - DNA, 16 bp, Homo sapiens
ttatttaaaatgattt

SEQ ID NO: 4313669 - DNA, 16 bp, Homo sapiens
ttatttcaatgtaatt

SEQ ID NO: 4313670 - DNA, 12 bp, Homo sapiens
ttatttcatgac

SEQ ID NO: 4313671 - DNA, 15 bp, Homo sapiens
ttatttctaaaacat

SEQ ID NO: 4313672 - DNA, 12 bp, Homo sapiens
ttatttctaaat

SEQ ID NO: 4313673 - DNA, 13 bp, Homo sapiens
ttatttctaacta

SEQ ID NO: 4313674 - DNA, 23 bp, Homo sapiens
ttattttagacaaccatagaact

SEQ ID NO: 4313675 - DNA, 16 bp, Homo sapiens
ttattttcaagcaaat

SEQ ID NO: 4313676 - DNA, 14 bp, Homo sapiens
ttattttcctcccc

SEQ ID NO: 4313677 - DNA, 15 bp, Homo sapiens
ttattttcctcccca

SEQ ID NO: 4313678 - DNA, 14 bp, Homo sapiens
ttatttttctgtta

SEQ ID NO: 4313679 - DNA, 16 bp, Homo sapiens
ttcaaaatacttcttt

SEQ ID NO: 4313680 - DNA, 14 bp, Homo sapiens
ttcaaaatattgag

SEQ ID NO: 4313681 - DNA, 19 bp, Homo sapiens
ttcaaaatcagtgatggga

SEQ ID NO: 4313682 - DNA, 22 bp, Homo sapiens
ttcaaaatcagtgatgggagta

SEQ ID NO: 4313683 - DNA, 20 bp, Homo sapiens
ttcaaaatgatattcaatct

SEQ ID NO: 4313684 - DNA, 13 bp, Homo sapiens
ttcaaaatgcatg

SEQ ID NO: 4313685 - DNA, 14 bp, Homo sapiens
ttcaaaatgcatgt

SEQ ID NO: 4313686 - DNA, 17 bp, Homo sapiens
ttcaaaatgcatgtgat

SEQ ID NO: 4313687 - DNA, 13 bp, Homo sapiens
ttcaaacacacac

SEQ ID NO: 4313688 - DNA, 18 bp, Homo sapiens
ttcaaagaacccccctcc

SEQ ID NO: 4313689 - DNA, 13 bp, Homo sapiens
ttcaaagaatcac

SEQ ID NO: 4313690 - DNA, 11 bp, Homo sapiens
ttcaaagtctc

SEQ ID NO: 4313691 - DNA, 19 bp, Homo sapiens
ttcaaagtctcaatgaaat

SEQ ID NO: 4313692 - DNA, 15 bp, Homo sapiens
ttcaaatacttttgg

SEQ ID NO: 4313693 - DNA, 12 bp, Homo sapiens
ttcaaatgcatg

SEQ ID NO: 4313694 - DNA, 23 bp, Homo sapiens
ttcaaatgcatgatattgtatgt

SEQ ID NO: 4313695 - DNA, 21 bp, Homo sapiens
ttcaacacttattttctgaat

SEQ ID NO: 4313696 - DNA, 18 bp, Homo sapiens
ttcaaccgcttgccatat

SEQ ID NO: 4313697 - DNA, 23 bp, Homo sapiens
ttcaactaatacatggtttaaag

SEQ ID NO: 4313698 - DNA, 22 bp, Homo sapiens
ttcaatcctgtcaatgtttgct

SEQ ID NO: 4313699 - DNA, 18 bp, Homo sapiens
ttcacaaatatagttgaa

SEQ ID NO: 4313700 - DNA, 20 bp, Homo sapiens
ttcacaacacaatcaaaaga

SEQ ID NO: 4313701 - DNA, 21 bp, Homo sapiens
ttcacaaccttctgtggctca

SEQ ID NO: 4313702 - DNA, 23 bp, Homo sapiens
ttcaccccatccctccttaagag

SEQ ID NO: 4313703 - DNA, 14 bp, Homo sapiens
ttcacccctcttcc

SEQ ID NO: 4313704 - DNA, 15 bp, Homo sapiens
ttcacccctcttccc

SEQ ID NO: 4313705 - DNA, 18 bp, Homo sapiens
ttcacccctcttcccacc

SEQ ID NO: 4313706 - DNA, 19 bp, Homo sapiens
ttcacccctcttcccacca

SEQ ID NO: 4313707 - DNA, 22 bp, Homo sapiens
ttcacgcaacttgaaattatat

SEQ ID NO: 4313708 - DNA, 16 bp, Homo sapiens
ttcactataatgtgaa

SEQ ID NO: 4313709 - DNA, 15 bp, Homo sapiens
ttcactgaagtgaat

SEQ ID NO: 4313710 - DNA, 15 bp, Homo sapiens
ttcacttgtgtttgt

SEQ ID NO: 4313711 - DNA, 22 bp, Homo sapiens
ttcagaaacaaagcatttgact

SEQ ID NO: 4313712 - DNA, 19 bp, Homo sapiens
ttcagaaagggcagcccct

SEQ ID NO: 4313713 - DNA, 22 bp, Homo sapiens
ttcagaagacacaggggagcag

SEQ ID NO: 4313714 - DNA, 23 bp, Homo sapiens
ttcagaattgtttttagaaattt

SEQ ID NO: 4313715 - DNA, 18 bp, Homo sapiens
ttcagagatgtaccatgt

SEQ ID NO: 4313716 - DNA, 19 bp, Homo sapiens
ttcagcaattaaagacatt

SEQ ID NO: 4313717 - DNA, 21 bp, Homo sapiens
ttcagcttgtttctatactgt

SEQ ID NO: 4313718 - DNA, 20 bp, Homo sapiens
ttcaggagagagttgaacct

SEQ ID NO: 4313719 - DNA, 21 bp, Homo sapiens
ttcaggagagagttgaaccta

SEQ ID NO: 4313720 - DNA, 20 bp, Homo sapiens
ttcaggaggagacagtcagg

SEQ ID NO: 4313721 - DNA, 13 bp, Homo sapiens
ttcagggcctcca

SEQ ID NO: 4313722 - DNA, 13 bp, Homo sapiens
ttcagtcattaaa

SEQ ID NO: 4313723 - DNA, 15 bp, Homo sapiens
ttcagtcattaaatt

SEQ ID NO: 4313724 - DNA, 16 bp, Homo sapiens
ttcagtcattaaatta

SEQ ID NO: 4313725 - DNA, 14 bp, Homo sapiens
ttcagttgacacat

SEQ ID NO: 4313726 - DNA, 13 bp, Homo sapiens
ttcataaaaataa

SEQ ID NO: 4313727 - DNA, 22 bp, Homo sapiens
ttcatactttccaacattatcc

SEQ ID NO: 4313728 - DNA, 11 bp, Homo sapiens
ttcatatcatt

SEQ ID NO: 4313729 - DNA, 15 bp, Homo sapiens
ttcatcctcagcaag

SEQ ID NO: 4313730 - DNA, 15 bp, Homo sapiens
ttcatctttccaaat

SEQ ID NO: 4313731 - DNA, 22 bp, Homo sapiens
ttcatgatttgcaactttagaa

SEQ ID NO: 4313732 - DNA, 10 bp, Homo sapiens
ttcatgcctg

SEQ ID NO: 4313733 - DNA, 12 bp, Homo sapiens
ttcatgcctggg

SEQ ID NO: 4313734 - DNA, 23 bp, Homo sapiens
ttcatgtgttgcaaattattcta

SEQ ID NO: 4313735 - DNA, 20 bp, Homo sapiens
ttcattcccttctctcagcc

SEQ ID NO: 4313736 - DNA, 21 bp, Homo sapiens
ttcattccctttcatgatttg

SEQ ID NO: 4313737 - DNA, 16 bp, Homo sapiens
ttcatttcctcaaaaa

SEQ ID NO: 4313738 - DNA, 18 bp, Homo sapiens
ttcattttaacatctgag

SEQ ID NO: 4313739 - DNA, 22 bp, Homo sapiens
ttcatttttgaaactgcatttg

SEQ ID NO: 4313740 - DNA, 11 bp, Homo sapiens
ttccaaataaa

SEQ ID NO: 4313741 - DNA, 18 bp, Homo sapiens
ttccaaatacattccagt

SEQ ID NO: 4313742 - DNA, 16 bp, Homo sapiens
ttccaagcctgggcca

SEQ ID NO: 4313743 - DNA, 21 bp, Homo sapiens
ttccaagcctgggccactggc

SEQ ID NO: 4313744 - DNA, 22 bp, Homo sapiens
ttccaagcctgggccactggca

SEQ ID NO: 4313745 - DNA, 18 bp, Homo sapiens
ttccaagggcccagaggg

SEQ ID NO: 4313746 - DNA, 12 bp, Homo sapiens
ttccaatgtgcc

SEQ ID NO: 4313747 - DNA, 21 bp, Homo sapiens
ttccaatgtgcccagtcatga

SEQ ID NO: 4313748 - DNA, 16 bp, Homo sapiens
ttccacacaggcccat

SEQ ID NO: 4313749 - DNA, 21 bp, Homo sapiens
ttccacacttccacccccagc

SEQ ID NO: 4313750 - DNA, 10 bp, Homo sapiens
ttccagacag

SEQ ID NO: 4313751 - DNA, 17 bp, Homo sapiens
ttccagacagagtggat

SEQ ID NO: 4313752 - DNA, 14 bp, Homo sapiens
ttccagacctgaag

SEQ ID NO: 4313753 - DNA, 16 bp, Homo sapiens
ttccagacctgaagaa

SEQ ID NO: 4313754 - DNA, 17 bp, Homo sapiens
ttccaggccccaggctg

SEQ ID NO: 4313755 - DNA, 21 bp, Homo sapiens
ttccagtaaggaatgatattg

SEQ ID NO: 4313756 - DNA, 17 bp, Homo sapiens
ttccagtgatgttgaaa

SEQ ID NO: 4313757 - DNA, 19 bp, Homo sapiens
ttccagtgatgttgaaatt

SEQ ID NO: 4313758 - DNA, 13 bp, Homo sapiens
ttccagtgctgct

SEQ ID NO: 4313759 - DNA, 18 bp, Homo sapiens
ttccagttggactgtggc

SEQ ID NO: 4313760 - DNA, 21 bp, Homo sapiens
ttccatcctgtacaagtgctc

SEQ ID NO: 4313761 - DNA, 24 bp, Homo sapiens
ttccatcctgtacaagtgctcagt

SEQ ID NO: 4313762 - DNA, 12 bp, Homo sapiens
ttccatctgatt

SEQ ID NO: 4313763 - DNA, 16 bp, Homo sapiens
ttccatggcacactgc

SEQ ID NO: 4313764 - DNA, 15 bp, Homo sapiens
ttccattctgggtgt

SEQ ID NO: 4313765 - DNA, 22 bp, Homo sapiens
ttcccaccaactctctctgccc

SEQ ID NO: 4313766 - DNA, 17 bp, Homo sapiens
ttcccacggccactgca

SEQ ID NO: 4313767 - DNA, 14 bp, Homo sapiens
ttcccactggctcc

SEQ ID NO: 4313768 - DNA, 15 bp, Homo sapiens
ttcccaggcagggag

SEQ ID NO: 4313769 - DNA, 17 bp, Homo sapiens
ttcccaggcagggaggg

SEQ ID NO: 4313770 - DNA, 22 bp, Homo sapiens
ttcccaggcagggagggaaacc

SEQ ID NO: 4313771 - DNA, 13 bp, Homo sapiens
ttcccatttgtaa

SEQ ID NO: 4313772 - DNA, 14 bp, Homo sapiens
ttcccatttgtaat

SEQ ID NO: 4313773 - DNA, 18 bp, Homo sapiens
ttcccatttgtaatgtat

SEQ ID NO: 4313774 - DNA, 20 bp, Homo sapiens
ttcccatttgtaatgtatct

SEQ ID NO: 4313775 - DNA, 18 bp, Homo sapiens
ttccccactgcctgccca

SEQ ID NO: 4313776 - DNA, 21 bp, Homo sapiens
ttccccatcgccttctgggga

SEQ ID NO: 4313777 - DNA, 16 bp, Homo sapiens
ttccccattgccttct

SEQ ID NO: 4313778 - DNA, 12 bp, Homo sapiens
ttcccccttccc

SEQ ID NO: 4313779 - DNA, 13 bp, Homo sapiens
ttcccccttcccc

SEQ ID NO: 4313780 - DNA, 17 bp, Homo sapiens
ttcccccttcccctgcg

SEQ ID NO: 4313781 - DNA, 20 bp, Homo sapiens
ttccccggagctgggaaggt

SEQ ID NO: 4313782 - DNA, 17 bp, Homo sapiens
ttcccctgcgccctccc

SEQ ID NO: 4313783 - DNA, 22 bp, Homo sapiens
ttcccgccctccccctgccaga

SEQ ID NO: 4313784 - DNA, 12 bp, Homo sapiens
ttcccgctcagc

SEQ ID NO: 4313785 - DNA, 18 bp, Homo sapiens
ttcccgctcagccctccc

SEQ ID NO: 4313786 - DNA, 22 bp, Homo sapiens
ttcccgctcagccctccctgcc

SEQ ID NO: 4313787 - DNA, 19 bp, Homo sapiens
ttcccgtggctttgtgctt

SEQ ID NO: 4313788 - DNA, 21 bp, Homo sapiens
ttccctctgcctgtccctctc

SEQ ID NO: 4313789 - DNA, 23 bp, Homo sapiens
ttccctgcatcccttggcccctc

SEQ ID NO: 4313790 - DNA, 22 bp, Homo sapiens
ttccctgcctaggagctgggga

SEQ ID NO: 4313791 - DNA, 13 bp, Homo sapiens
ttccgctctgagg

SEQ ID NO: 4313792 - DNA, 15 bp, Homo sapiens
ttccggctgagctgt

SEQ ID NO: 4313793 - DNA, 19 bp, Homo sapiens
ttccggctgagctgtgcca

SEQ ID NO: 4313794 - DNA, 13 bp, Homo sapiens
ttcctaagctgtt

SEQ ID NO: 4313795 - DNA, 12 bp, Homo sapiens
ttcctctccact

SEQ ID NO: 4313796 - DNA, 16 bp, Homo sapiens
ttcctcttacctgtaa

SEQ ID NO: 4313797 - DNA, 19 bp, Homo sapiens
ttcctcttagaagaatatt

SEQ ID NO: 4313798 - DNA, 22 bp, Homo sapiens
ttcctcttagaagaatattgta

SEQ ID NO: 4313799 - DNA, 13 bp, Homo sapiens
ttcctgagcttgg

SEQ ID NO: 4313800 - DNA, 20 bp, Homo sapiens
ttcctgatgttgataatagt

SEQ ID NO: 4313801 - DNA, 19 bp, Homo sapiens
ttcctggattttctttcta

SEQ ID NO: 4313802 - DNA, 15 bp, Homo sapiens
ttcctgtccagagag

SEQ ID NO: 4313803 - DNA, 15 bp, Homo sapiens
ttcctgtgcacagcc

SEQ ID NO: 4313804 - DNA, 16 bp, Homo sapiens
ttcctgttctgtgtct

SEQ ID NO: 4313805 - DNA, 17 bp, Homo sapiens
ttccttcatttcctccg

SEQ ID NO: 4313806 - DNA, 17 bp, Homo sapiens
ttccttggcccagcagc

SEQ ID NO: 4313807 - DNA, 15 bp, Homo sapiens
ttcctttcatcctca

SEQ ID NO: 4313808 - DNA, 17 bp, Homo sapiens
ttcctttcatcctcagc

SEQ ID NO: 4313809 - DNA, 22 bp, Homo sapiens
ttcctttgaatcctctctctgt

SEQ ID NO: 4313810 - DNA, 14 bp, Homo sapiens
ttcgaagctcagcc

SEQ ID NO: 4313811 - DNA, 16 bp, Homo sapiens
ttcgaagctcagccca

SEQ ID NO: 4313812 - DNA, 19 bp, Homo sapiens
ttcgagacaggcagaatca

SEQ ID NO: 4313813 - DNA, 16 bp, Homo sapiens
ttcgcagaacatgagt

SEQ ID NO: 4313814 - DNA, 14 bp, Homo sapiens
ttcgctattcccag

SEQ ID NO: 4313815 - DNA, 16 bp, Homo sapiens
ttcgctattcccaggc

SEQ ID NO: 4313816 - DNA, 23 bp, Homo sapiens
ttcgtccttagaatactgtattg

SEQ ID NO: 4313817 - DNA, 11 bp, Homo sapiens
ttcgtgcattt

SEQ ID NO: 4313818 - DNA, 15 bp, Homo sapiens
ttcgtgcatttgtga

SEQ ID NO: 4313819 - DNA, 18 bp, Homo sapiens
ttcgtggagccacaggca

SEQ ID NO: 4313820 - DNA, 19 bp, Homo sapiens
ttctaagaaatatctgtga

SEQ ID NO: 4313821 - DNA, 14 bp, Homo sapiens
ttctaagcttattt

SEQ ID NO: 4313822 - DNA, 21 bp, Homo sapiens
ttctagaaggggcgaggcttt

SEQ ID NO: 4313823 - DNA, 21 bp, Homo sapiens
ttctagagagggaattctctt

SEQ ID NO: 4313824 - DNA, 14 bp, Homo sapiens
ttctagcaactgtt

SEQ ID NO: 4313825 - DNA, 18 bp, Homo sapiens
ttctagctataacaactc

SEQ ID NO: 4313826 - DNA, 15 bp, Homo sapiens
ttctagtcaactgct

SEQ ID NO: 4313827 - DNA, 18 bp, Homo sapiens
ttctagtcaactgctgtt

SEQ ID NO: 4313828 - DNA, 20 bp, Homo sapiens
ttctagtcaactgctgtttt

SEQ ID NO: 4313829 - DNA, 15 bp, Homo sapiens
ttctagtctctgatt

SEQ ID NO: 4313830 - DNA, 19 bp, Homo sapiens
ttctatactgtttgtaata

SEQ ID NO: 4313831 - DNA, 16 bp, Homo sapiens
ttctatatttcatatt

SEQ ID NO: 4313832 - DNA, 17 bp, Homo sapiens
ttctatctgcaaatagt

SEQ ID NO: 4313833 - DNA, 16 bp, Homo sapiens
ttctatgcctgtattt

SEQ ID NO: 4313834 - DNA, 13 bp, Homo sapiens
ttctatttctatc

SEQ ID NO: 4313835 - DNA, 15 bp, Homo sapiens
ttctatttctatctg

SEQ ID NO: 4313836 - DNA, 19 bp, Homo sapiens
ttctcaaagtttttacagt

SEQ ID NO: 4313837 - DNA, 19 bp, Homo sapiens
ttctcaaatgctactcagt

SEQ ID NO: 4313838 - DNA, 16 bp, Homo sapiens
ttctcactcctacctg

SEQ ID NO: 4313839 - DNA, 19 bp, Homo sapiens
ttctcagagctccacagaa

SEQ ID NO: 4313840 - DNA, 15 bp, Homo sapiens
ttctcatgcactgca

SEQ ID NO: 4313841 - DNA, 17 bp, Homo sapiens
ttctcatgcactgcaaa

SEQ ID NO: 4313842 - DNA, 22 bp, Homo sapiens
ttctcatgcactgcaaatactt

SEQ ID NO: 4313843 - DNA, 21 bp, Homo sapiens
ttctccagccaccaaggctgc

SEQ ID NO: 4313844 - DNA, 12 bp, Homo sapiens
ttctccatcccc

SEQ ID NO: 4313845 - DNA, 13 bp, Homo sapiens
ttctccatcccca

SEQ ID NO: 4313846 - DNA, 16 bp, Homo sapiens
ttctcccctccagacc

SEQ ID NO: 4313847 - DNA, 18 bp, Homo sapiens
ttctcctttcacaacctt

SEQ ID NO: 4313848 - DNA, 19 bp, Homo sapiens
ttctctcagcctccactcc

SEQ ID NO: 4313849 - DNA, 13 bp, Homo sapiens
ttctctctgtgct

SEQ ID NO: 4313850 - DNA, 21 bp, Homo sapiens
ttctctgatcacaacttttct

SEQ ID NO: 4313851 - DNA, 12 bp, Homo sapiens
ttctctgctttt

SEQ ID NO: 4313852 - DNA, 18 bp, Homo sapiens
ttctcttacgctctctgt

SEQ ID NO: 4313853 - DNA, 17 bp, Homo sapiens
ttctgaaaactgtttat

SEQ ID NO: 4313854 - DNA, 14 bp, Homo sapiens
ttctgaagatctca

SEQ ID NO: 4313855 - DNA, 17 bp, Homo sapiens
ttctgaattcataaaaa

SEQ ID NO: 4313856 - DNA, 18 bp, Homo sapiens
ttctgacaataaataata

SEQ ID NO: 4313857 - DNA, 13 bp, Homo sapiens
ttctgaccacact

SEQ ID NO: 4313858 - DNA, 14 bp, Homo sapiens
ttctgaccacactt

SEQ ID NO: 4313859 - DNA, 23 bp, Homo sapiens
ttctgaccccacttatgctgctg

SEQ ID NO: 4313860 - DNA, 20 bp, Homo sapiens
ttctgagcaccgaatattga

SEQ ID NO: 4313861 - DNA, 12 bp, Homo sapiens
ttctgagttcct

SEQ ID NO: 4313862 - DNA, 16 bp, Homo sapiens
ttctgataatgaaaat

SEQ ID NO: 4313863 - DNA, 20 bp, Homo sapiens
ttctgcagacacgccttccc

SEQ ID NO: 4313864 - DNA, 16 bp, Homo sapiens
ttctgccatttcatgt

SEQ ID NO: 4313865 - DNA, 20 bp, Homo sapiens
ttctgcccaccccgcctctg

SEQ ID NO: 4313866 - DNA, 19 bp, Homo sapiens
ttctgcggagcttctccag

SEQ ID NO: 4313867 - DNA, 22 bp, Homo sapiens
ttctgcggagcttctccagcca

SEQ ID NO: 4313868 - DNA, 16 bp, Homo sapiens
ttctgctacctggttt

SEQ ID NO: 4313869 - DNA, 15 bp, Homo sapiens
ttctgctgcccccag

SEQ ID NO: 4313870 - DNA, 17 bp, Homo sapiens
ttctggactatagctgt

SEQ ID NO: 4313871 - DNA, 20 bp, Homo sapiens
ttctggactatagctgttct

SEQ ID NO: 4313872 - DNA, 13 bp, Homo sapiens
ttctggaggagga

SEQ ID NO: 4313873 - DNA, 23 bp, Homo sapiens
ttctggggctgagagtggggcta

SEQ ID NO: 4313874 - DNA, 20 bp, Homo sapiens
ttctgtaatatttacaatgt

SEQ ID NO: 4313875 - DNA, 14 bp, Homo sapiens
ttctgtccctgtcc

SEQ ID NO: 4313876 - DNA, 15 bp, Homo sapiens
ttctgtccctgtccc

SEQ ID NO: 4313877 - DNA, 15 bp, Homo sapiens
ttctgtggattctat

SEQ ID NO: 4313878 - DNA, 21 bp, Homo sapiens
ttctgttttgcctgaagttgg

SEQ ID NO: 4313879 - DNA, 15 bp, Homo sapiens
ttcttactaaacatt

SEQ ID NO: 4313880 - DNA, 18 bp, Homo sapiens
ttcttactaaacattttg

SEQ ID NO: 4313881 - DNA, 17 bp, Homo sapiens
ttcttatacagataaaa

SEQ ID NO: 4313882 - DNA, 20 bp, Homo sapiens
ttcttatacagataaaacat

SEQ ID NO: 4313883 - DNA, 21 bp, Homo sapiens
ttcttatttaaattttcagaa

SEQ ID NO: 4313884 - DNA, 18 bp, Homo sapiens
ttcttcaagatcccattt

SEQ ID NO: 4313885 - DNA, 14 bp, Homo sapiens
ttcttccatctgat

SEQ ID NO: 4313886 - DNA, 20 bp, Homo sapiens
ttcttccttttgtatcctcc

SEQ ID NO: 4313887 - DNA, 13 bp, Homo sapiens
ttcttctgtaata

SEQ ID NO: 4313888 - DNA, 16 bp, Homo sapiens
ttcttctgttctgcag

SEQ ID NO: 4313889 - DNA, 16 bp, Homo sapiens
ttcttggtatgatcat

SEQ ID NO: 4313890 - DNA, 12 bp, Homo sapiens
ttcttgtatctg

SEQ ID NO: 4313891 - DNA, 20 bp, Homo sapiens
ttctttaacatacatctaag

SEQ ID NO: 4313892 - DNA, 12 bp, Homo sapiens
ttctttagtctt

SEQ ID NO: 4313893 - DNA, 14 bp, Homo sapiens
ttctttctatgtag

SEQ ID NO: 4313894 - DNA, 19 bp, Homo sapiens
ttcttttatatctgtaaat

SEQ ID NO: 4313895 - DNA, 14 bp, Homo sapiens
ttgaaaagaagaaa

SEQ ID NO: 4313896 - DNA, 20 bp, Homo sapiens
ttgaaaagaagaaagtctat

SEQ ID NO: 4313897 - DNA, 16 bp, Homo sapiens
ttgaaactgcatttgt

SEQ ID NO: 4313898 - DNA, 19 bp, Homo sapiens
ttgaaagatggtaatcttt

SEQ ID NO: 4313899 - DNA, 14 bp, Homo sapiens
ttgaaattatatct

SEQ ID NO: 4313900 - DNA, 17 bp, Homo sapiens
ttgaaattatatctgtg

SEQ ID NO: 4313901 - DNA, 20 bp, Homo sapiens
ttgaacaagatttccctaaa

SEQ ID NO: 4313902 - DNA, 22 bp, Homo sapiens
ttgaacattaatccacatgttt

SEQ ID NO: 4313903 - DNA, 22 bp, Homo sapiens
ttgaagaaggaggaattttaga

SEQ ID NO: 4313904 - DNA, 18 bp, Homo sapiens
ttgaagaagggaaattca

SEQ ID NO: 4313905 - DNA, 18 bp, Homo sapiens
ttgaagaatattgttaaa

SEQ ID NO: 4313906 - DNA, 16 bp, Homo sapiens
ttgaagacttcaaaat

SEQ ID NO: 4313907 - DNA, 20 bp, Homo sapiens
ttgaagacttcaaaatattg

SEQ ID NO: 4313908 - DNA, 13 bp, Homo sapiens
ttgaagattcagg

SEQ ID NO: 4313909 - DNA, 14 bp, Homo sapiens
ttgaagtcatcata

SEQ ID NO: 4313910 - DNA, 19 bp, Homo sapiens
ttgaagtcatcataaaagg

SEQ ID NO: 4313911 - DNA, 15 bp, Homo sapiens
ttgaatagtattgtg

SEQ ID NO: 4313912 - DNA, 16 bp, Homo sapiens
ttgaatagtattgtgt

SEQ ID NO: 4313913 - DNA, 21 bp, Homo sapiens
ttgaatatattttatcttggt

SEQ ID NO: 4313914 - DNA, 20 bp, Homo sapiens
ttgacaaggtgtttctctgt

SEQ ID NO: 4313915 - DNA, 19 bp, Homo sapiens
ttgacacttttcatatcat

SEQ ID NO: 4313916 - DNA, 22 bp, Homo sapiens
ttgagatctgctgacagatgtt

SEQ ID NO: 4313917 - DNA, 15 bp, Homo sapiens
ttgagcaaggcaaga

SEQ ID NO: 4313918 - DNA, 15 bp, Homo sapiens
ttgagccttttatta

SEQ ID NO: 4313919 - DNA, 23 bp, Homo sapiens
ttgaggacctccacctgggagat

SEQ ID NO: 4313920 - DNA, 18 bp, Homo sapiens
ttgagtccattgcaaaag

SEQ ID NO: 4313921 - DNA, 16 bp, Homo sapiens
ttgagtgggccccctc

SEQ ID NO: 4313922 - DNA, 18 bp, Homo sapiens
ttgagttcttcctgtaat

SEQ ID NO: 4313923 - DNA, 21 bp, Homo sapiens
ttgataatagtaatggttcta

SEQ ID NO: 4313924 - DNA, 23 bp, Homo sapiens
ttgataatagtaatggttctaga

SEQ ID NO: 4313925 - DNA, 15 bp, Homo sapiens
ttgatattctaagaa

SEQ ID NO: 4313926 - DNA, 18 bp, Homo sapiens
ttgatattctaagaaata

SEQ ID NO: 4313927 - DNA, 23 bp, Homo sapiens
ttgatattctaagaaatatctgt

SEQ ID NO: 4313928 - DNA, 15 bp, Homo sapiens
ttgatcgatgttaaa

SEQ ID NO: 4313929 - DNA, 19 bp, Homo sapiens
ttgatggtagaaattttat

SEQ ID NO: 4313930 - DNA, 19 bp, Homo sapiens
ttgatgtgtatgtgtttat

SEQ ID NO: 4313931 - DNA, 22 bp, Homo sapiens
ttgatgtgtatgtgtttataat

SEQ ID NO: 4313932 - DNA, 14 bp, Homo sapiens
ttgcaaaaggttaa

SEQ ID NO: 4313933 - DNA, 20 bp, Homo sapiens
ttgcaaaaggttaagccata

SEQ ID NO: 4313934 - DNA, 20 bp, Homo sapiens
ttgcaaatgcacatttgtca

SEQ ID NO: 4313935 - DNA, 17 bp, Homo sapiens
ttgcaaattattctagt

SEQ ID NO: 4313936 - DNA, 13 bp, Homo sapiens
ttgcaagggaatg

SEQ ID NO: 4313937 - DNA, 19 bp, Homo sapiens
ttgcaagggaatgaatcca

SEQ ID NO: 4313938 - DNA, 21 bp, Homo sapiens
ttgcaagtatgttttagcatg

SEQ ID NO: 4313939 - DNA, 16 bp, Homo sapiens
ttgcacagctatgaag

SEQ ID NO: 4313940 - DNA, 15 bp, Homo sapiens
ttgcagaagaaactc

SEQ ID NO: 4313941 - DNA, 17 bp, Homo sapiens
ttgcagaccaggaagga

SEQ ID NO: 4313942 - DNA, 16 bp, Homo sapiens
ttgcagacctgggact

SEQ ID NO: 4313943 - DNA, 13 bp, Homo sapiens
ttgcagtaaagtt

SEQ ID NO: 4313944 - DNA, 17 bp, Homo sapiens
ttgcagtcatcagaagt

SEQ ID NO: 4313945 - DNA, 16 bp, Homo sapiens
ttgcattaaaagactg

SEQ ID NO: 4313946 - DNA, 15 bp, Homo sapiens
ttgcattgtctgtct

SEQ ID NO: 4313947 - DNA, 18 bp, Homo sapiens
ttgcccacacctgcctct

SEQ ID NO: 4313948 - DNA, 20 bp, Homo sapiens
ttgcccaggctggagtgcag

SEQ ID NO: 4313949 - DNA, 12 bp, Homo sapiens
ttgccctgaggg

SEQ ID NO: 4313950 - DNA, 14 bp, Homo sapiens
ttgccgctgggaga

SEQ ID NO: 4313951 - DNA, 16 bp, Homo sapiens
ttgccgctgggagagc

SEQ ID NO: 4313952 - DNA, 15 bp, Homo sapiens
ttgcctcctgtgtaa

SEQ ID NO: 4313953 - DNA, 14 bp, Homo sapiens
ttgcctctgcacgt

SEQ ID NO: 4313954 - DNA, 21 bp, Homo sapiens
ttgccttccacgctgtctcca

SEQ ID NO: 4313955 - DNA, 15 bp, Homo sapiens
ttgctcaataaaggt

SEQ ID NO: 4313956 - DNA, 16 bp, Homo sapiens
ttgctgatattgcagt

SEQ ID NO: 4313957 - DNA, 17 bp, Homo sapiens
ttgctgcactcttgcac

SEQ ID NO: 4313958 - DNA, 19 bp, Homo sapiens
ttgctgcactcttgcacat

SEQ ID NO: 4313959 - DNA, 14 bp, Homo sapiens
ttgctgccttctgt

SEQ ID NO: 4313960 - DNA, 18 bp, Homo sapiens
ttgctgccttctgtctct

SEQ ID NO: 4313961 - DNA, 21 bp, Homo sapiens
ttgctggagtcctgttctcag

SEQ ID NO: 4313962 - DNA, 22 bp, Homo sapiens
ttgctgttgttcagaagttgtt

SEQ ID NO: 4313963 - DNA, 16 bp, Homo sapiens
ttgcttatttatattc

SEQ ID NO: 4313964 - DNA, 13 bp, Homo sapiens
ttgctttgtatgc

SEQ ID NO: 4313965 - DNA, 19 bp, Homo sapiens
ttggaacagtaatcagttt

SEQ ID NO: 4313966 - DNA, 15 bp, Homo sapiens
ttggaactgctgcca

SEQ ID NO: 4313967 - DNA, 23 bp, Homo sapiens
ttggaagggcgctgagggcaggg

SEQ ID NO: 4313968 - DNA, 12 bp, Homo sapiens
ttggaggggcag

SEQ ID NO: 4313969 - DNA, 16 bp, Homo sapiens
ttggaggggcaggcct

SEQ ID NO: 4313970 - DNA, 20 bp, Homo sapiens
ttggagtgagtgtggctccc

SEQ ID NO: 4313971 - DNA, 20 bp, Homo sapiens
ttggataggagcttccagat

SEQ ID NO: 4313972 - DNA, 15 bp, Homo sapiens
ttggatcaagtatta

SEQ ID NO: 4313973 - DNA, 19 bp, Homo sapiens
ttggcacaccctctctgtc

SEQ ID NO: 4313974 - DNA, 21 bp, Homo sapiens
ttggccactttgcagacctgg

SEQ ID NO: 4313975 - DNA, 11 bp, Homo sapiens
ttggcccctct

SEQ ID NO: 4313976 - DNA, 13 bp, Homo sapiens
ttggcctcagcag

SEQ ID NO: 4313977 - DNA, 17 bp, Homo sapiens
ttggctcgggacttcaa

SEQ ID NO: 4313978 - DNA, 18 bp, Homo sapiens
ttggctcgggacttcaaa

SEQ ID NO: 4313979 - DNA, 19 bp, Homo sapiens
ttgggaccaaaactgccta

SEQ ID NO: 4313980 - DNA, 17 bp, Homo sapiens
ttgggcagtggagaggg

SEQ ID NO: 4313981 - DNA, 23 bp, Homo sapiens
ttgggcagtggagaggggacttg

SEQ ID NO: 4313982 - DNA, 17 bp, Homo sapiens
ttgggccccagggaact

SEQ ID NO: 4313983 - DNA, 12 bp, Homo sapiens
ttgggccctcct

SEQ ID NO: 4313984 - DNA, 19 bp, Homo sapiens
ttgggggattcaaatgcat

SEQ ID NO: 4313985 - DNA, 23 bp, Homo sapiens
ttggggggggcccgcctggcaga

SEQ ID NO: 4313986 - DNA, 16 bp, Homo sapiens
ttggtaatgtgtcaaa

SEQ ID NO: 4313987 - DNA, 14 bp, Homo sapiens
ttggtgataagtgg

SEQ ID NO: 4313988 - DNA, 18 bp, Homo sapiens
ttggtgataagtggaaaa

SEQ ID NO: 4313989 - DNA, 20 bp, Homo sapiens
ttggtgataagtggaaaaaa

SEQ ID NO: 4313990 - DNA, 16 bp, Homo sapiens
ttggtgattttagatt

SEQ ID NO: 4313991 - DNA, 14 bp, Homo sapiens
ttggtggccaggct

SEQ ID NO: 4313992 - DNA, 16 bp, Homo sapiens
ttggtgttctggcctc

SEQ ID NO: 4313993 - DNA, 24 bp, Homo sapiens
ttggtgttctggcctctggcctgg

SEQ ID NO: 4313994 - DNA, 17 bp, Homo sapiens
ttggttaatcacttaac

SEQ ID NO: 4313995 - DNA, 14 bp, Homo sapiens
ttggttcatgcctg

SEQ ID NO: 4313996 - DNA, 13 bp, Homo sapiens
ttggttttgtatt

SEQ ID NO: 4313997 - DNA, 17 bp, Homo sapiens
ttgtaaaggtaggtgca

SEQ ID NO: 4313998 - DNA, 18 bp, Homo sapiens
ttgtaaaggtaggtgcat

SEQ ID NO: 4313999 - DNA, 13 bp, Homo sapiens
ttgtaaggacttg

SEQ ID NO: 4314000 - DNA, 16 bp, Homo sapiens
ttgtaaggacttgtgc

SEQ ID NO: 4314001 - DNA, 15 bp, Homo sapiens
ttgtaatatacagtt

SEQ ID NO: 4314002 - DNA, 15 bp, Homo sapiens
ttgtacatatggaaa

SEQ ID NO: 4314003 - DNA, 16 bp, Homo sapiens
ttgtacgttaattaaa

SEQ ID NO: 4314004 - DNA, 14 bp, Homo sapiens
ttgtaggactaaat

SEQ ID NO: 4314005 - DNA, 16 bp, Homo sapiens
ttgtagggatgccttt

SEQ ID NO: 4314006 - DNA, 20 bp, Homo sapiens
ttgtagtagttgatgaccaa

SEQ ID NO: 4314007 - DNA, 13 bp, Homo sapiens
ttgtataaaacag

SEQ ID NO: 4314008 - DNA, 16 bp, Homo sapiens
ttgtatataaatggtg

SEQ ID NO: 4314009 - DNA, 22 bp, Homo sapiens
ttgtatgaaatatatgtgaaag

SEQ ID NO: 4314010 - DNA, 18 bp, Homo sapiens
ttgtattttcttcccatt

SEQ ID NO: 4314011 - DNA, 22 bp, Homo sapiens
ttgtcaaaactccactcagcac

SEQ ID NO: 4314012 - DNA, 20 bp, Homo sapiens
ttgtccaacaactccaggaa

SEQ ID NO: 4314013 - DNA, 14 bp, Homo sapiens
ttgtccacaaatgt

SEQ ID NO: 4314014 - DNA, 16 bp, Homo sapiens
ttgtccacaaatgtcc

SEQ ID NO: 4314015 - DNA, 12 bp, Homo sapiens
ttgtccctgcag

SEQ ID NO: 4314016 - DNA, 21 bp, Homo sapiens
ttgtccggtggaaggccttct

SEQ ID NO: 4314017 - DNA, 18 bp, Homo sapiens
ttgtctattacctgttag

SEQ ID NO: 4314018 - DNA, 17 bp, Homo sapiens
ttgtctcgaaataattt

SEQ ID NO: 4314019 - DNA, 13 bp, Homo sapiens
ttgtctgaaggat

SEQ ID NO: 4314020 - DNA, 17 bp, Homo sapiens
ttgtctgaagtcactgc

SEQ ID NO: 4314021 - DNA, 16 bp, Homo sapiens
ttgtctggctgtggcc

SEQ ID NO: 4314022 - DNA, 17 bp, Homo sapiens
ttgtgcctcttgggaga

SEQ ID NO: 4314023 - DNA, 21 bp, Homo sapiens
ttgtgcggtgtgtctccagct

SEQ ID NO: 4314024 - DNA, 14 bp, Homo sapiens
ttgtggctttatga

SEQ ID NO: 4314025 - DNA, 15 bp, Homo sapiens
ttgtgtagattgtgt

SEQ ID NO: 4314026 - DNA, 21 bp, Homo sapiens
ttgtgtgggtttactctgtgc

SEQ ID NO: 4314027 - DNA, 23 bp, Homo sapiens
ttgtgtgggtttactctgtgcta

SEQ ID NO: 4314028 - DNA, 17 bp, Homo sapiens
ttgtgtggtattcaact

SEQ ID NO: 4314029 - DNA, 17 bp, Homo sapiens
ttgtgttgggccccagg

SEQ ID NO: 4314030 - DNA, 17 bp, Homo sapiens
ttgttacaggtgtacta

SEQ ID NO: 4314031 - DNA, 12 bp, Homo sapiens
ttgttagatgtt

SEQ ID NO: 4314032 - DNA, 13 bp, Homo sapiens
ttgttattaaatg

SEQ ID NO: 4314033 - DNA, 14 bp, Homo sapiens
ttgttgtccctgca

SEQ ID NO: 4314034 - DNA, 13 bp, Homo sapiens
ttgtttaattgta

SEQ ID NO: 4314035 - DNA, 15 bp, Homo sapiens
ttgtttacatgagtt

SEQ ID NO: 4314036 - DNA, 13 bp, Homo sapiens
ttgtttctatact

SEQ ID NO: 4314037 - DNA, 15 bp, Homo sapiens
ttgtttctatactgt

SEQ ID NO: 4314038 - DNA, 19 bp, Homo sapiens
ttgtttgttaataaagtgc

SEQ ID NO: 4314039 - DNA, 20 bp, Homo sapiens
tttaaaaaaaaacattcaaa

SEQ ID NO: 4314040 - DNA, 15 bp, Homo sapiens
tttaaaaaaataaca

SEQ ID NO: 4314041 - DNA, 18 bp, Homo sapiens
tttaaaaaaataacatct

SEQ ID NO: 4314042 - DNA, 23 bp, Homo sapiens
tttaaaaaaataacatctgaaaa

SEQ ID NO: 4314043 - DNA, 15 bp, Homo sapiens
tttaaaaaataacat

SEQ ID NO: 4314044 - DNA, 19 bp, Homo sapiens
tttaaaaaataatttagat

SEQ ID NO: 4314045 - DNA, 20 bp, Homo sapiens
tttaaaagccctttccaaag

SEQ ID NO: 4314046 - DNA, 15 bp, Homo sapiens
tttaaaatagttttc

SEQ ID NO: 4314047 - DNA, 21 bp, Homo sapiens
tttaaaatagttttctaaatg

SEQ ID NO: 4314048 - DNA, 19 bp, Homo sapiens
tttaaaatggacttttgtt

SEQ ID NO: 4314049 - DNA, 18 bp, Homo sapiens
tttaaacttcttaactgg

SEQ ID NO: 4314050 - DNA, 23 bp, Homo sapiens
tttaaatgctgtatgtcattaaa

SEQ ID NO: 4314051 - DNA, 14 bp, Homo sapiens
tttaaatttaagta

SEQ ID NO: 4314052 - DNA, 14 bp, Homo sapiens
tttaacctcagaaa

SEQ ID NO: 4314053 - DNA, 14 bp, Homo sapiens
tttaactttaccat

SEQ ID NO: 4314054 - DNA, 14 bp, Homo sapiens
tttaagtagatttc

SEQ ID NO: 4314055 - DNA, 18 bp, Homo sapiens
tttaagtgtactggattt

SEQ ID NO: 4314056 - DNA, 14 bp, Homo sapiens
tttaatgtaaaatt

SEQ ID NO: 4314057 - DNA, 15 bp, Homo sapiens
tttaattttgacact

SEQ ID NO: 4314058 - DNA, 14 bp, Homo sapiens
tttacaatgtatta

SEQ ID NO: 4314059 - DNA, 14 bp, Homo sapiens
tttacagttactgc

SEQ ID NO: 4314060 - DNA, 23 bp, Homo sapiens
tttacatagtctgaagtgaagta

SEQ ID NO: 4314061 - DNA, 22 bp, Homo sapiens
tttaccattttgcgatgtgttt

SEQ ID NO: 4314062 - DNA, 22 bp, Homo sapiens
tttactacataattaaatttta

SEQ ID NO: 4314063 - DNA, 13 bp, Homo sapiens
tttagaaagaaat

SEQ ID NO: 4314064 - DNA, 17 bp, Homo sapiens
tttagaaataaacctta

SEQ ID NO: 4314065 - DNA, 11 bp, Homo sapiens
tttagaaatga

SEQ ID NO: 4314066 - DNA, 21 bp, Homo sapiens
tttagacaaccatagaactgt

SEQ ID NO: 4314067 - DNA, 23 bp, Homo sapiens
tttagacaaccatagaactgtcc

SEQ ID NO: 4314068 - DNA, 20 bp, Homo sapiens
tttagcatgacaagccccag

SEQ ID NO: 4314069 - DNA, 15 bp, Homo sapiens
tttagcggtttgcaa

SEQ ID NO: 4314070 - DNA, 17 bp, Homo sapiens
tttagtctttagctatt

SEQ ID NO: 4314071 - DNA, 23 bp, Homo sapiens
tttagtgactaaaccattgtgca

SEQ ID NO: 4314072 - DNA, 19 bp, Homo sapiens
tttagttcctgtgcacagc

SEQ ID NO: 4314073 - DNA, 19 bp, Homo sapiens
tttagtttaccaatcaaca

SEQ ID NO: 4314074 - DNA, 21 bp, Homo sapiens
tttatcagaatcaaatctgag

SEQ ID NO: 4314075 - DNA, 22 bp, Homo sapiens
tttatcagaatcaaatctgagc

SEQ ID NO: 4314076 - DNA, 15 bp, Homo sapiens
tttatcatgtgtttc

SEQ ID NO: 4314077 - DNA, 22 bp, Homo sapiens
tttatgaagttaacagtctcat

SEQ ID NO: 4314078 - DNA, 16 bp, Homo sapiens
tttatgtgctattaat

SEQ ID NO: 4314079 - DNA, 15 bp, Homo sapiens
tttatgtgcttgaag

SEQ ID NO: 4314080 - DNA, 20 bp, Homo sapiens
tttatgtgcttgaagattca

SEQ ID NO: 4314081 - DNA, 20 bp, Homo sapiens
tttatgttactacatgcact

SEQ ID NO: 4314082 - DNA, 22 bp, Homo sapiens
tttattaacatatattgttatt

SEQ ID NO: 4314083 - DNA, 19 bp, Homo sapiens
tttattgaaaatgtggtaa

SEQ ID NO: 4314084 - DNA, 15 bp, Homo sapiens
tttatttcaatgtaa

SEQ ID NO: 4314085 - DNA, 12 bp, Homo sapiens
tttatttctatc

SEQ ID NO: 4314086 - DNA, 13 bp, Homo sapiens
tttatttttctgt

SEQ ID NO: 4314087 - DNA, 15 bp, Homo sapiens
tttcaaaatgcatgt

SEQ ID NO: 4314088 - DNA, 15 bp, Homo sapiens
tttcaaacacacaca

SEQ ID NO: 4314089 - DNA, 19 bp, Homo sapiens
tttcaaatgagtttaaaaa

SEQ ID NO: 4314090 - DNA, 18 bp, Homo sapiens
tttcaaccgcttgccata

SEQ ID NO: 4314091 - DNA, 22 bp, Homo sapiens
tttcacaaccttctgtggctca

SEQ ID NO: 4314092 - DNA, 16 bp, Homo sapiens
tttcactataatgtga

SEQ ID NO: 4314093 - DNA, 19 bp, Homo sapiens
tttcactgaagtgaataca

SEQ ID NO: 4314094 - DNA, 15 bp, Homo sapiens
tttcagaaagatgaa

SEQ ID NO: 4314095 - DNA, 23 bp, Homo sapiens
tttcagaaagggcagcccctccc

SEQ ID NO: 4314096 - DNA, 17 bp, Homo sapiens
tttcagccattcacaac

SEQ ID NO: 4314097 - DNA, 16 bp, Homo sapiens
tttcagcttgtttcta

SEQ ID NO: 4314098 - DNA, 22 bp, Homo sapiens
tttcaggagagagttgaaccta

SEQ ID NO: 4314099 - DNA, 14 bp, Homo sapiens
tttcataggaagac

SEQ ID NO: 4314100 - DNA, 19 bp, Homo sapiens
tttcataggaagacacatt

SEQ ID NO: 4314101 - DNA, 23 bp, Homo sapiens
tttcatgtgttgcaaattattct

SEQ ID NO: 4314102 - DNA, 16 bp, Homo sapiens
tttcatttcttattaa

SEQ ID NO: 4314103 - DNA, 22 bp, Homo sapiens
tttccaacaaacttactgtcag

SEQ ID NO: 4314104 - DNA, 14 bp, Homo sapiens
tttccaacacacaa

SEQ ID NO: 4314105 - DNA, 22 bp, Homo sapiens
tttccaacattatcctgtgtga

SEQ ID NO: 4314106 - DNA, 19 bp, Homo sapiens
tttccaagcctctctggca

SEQ ID NO: 4314107 - DNA, 23 bp, Homo sapiens
tttccaagcctgggccactggca

SEQ ID NO: 4314108 - DNA, 23 bp, Homo sapiens
tttccaccaagggtatctgctgc

SEQ ID NO: 4314109 - DNA, 22 bp, Homo sapiens
tttccaccccctccctggcctg

SEQ ID NO: 4314110 - DNA, 12 bp, Homo sapiens
tttccagaattg

SEQ ID NO: 4314111 - DNA, 15 bp, Homo sapiens
tttccagtgctgctc

SEQ ID NO: 4314112 - DNA, 18 bp, Homo sapiens
tttccccaattatcctcc

SEQ ID NO: 4314113 - DNA, 23 bp, Homo sapiens
tttccccatttaggtttctgagt

SEQ ID NO: 4314114 - DNA, 15 bp, Homo sapiens
tttccctgcatccct

SEQ ID NO: 4314115 - DNA, 16 bp, Homo sapiens
tttcctccccagcagg

SEQ ID NO: 4314116 - DNA, 22 bp, Homo sapiens
tttcctccgtcacctcagagac

SEQ ID NO: 4314117 - DNA, 22 bp, Homo sapiens
tttcctgagcttggccagaagg

SEQ ID NO: 4314118 - DNA, 23 bp, Homo sapiens
tttcctgccttttagttcctgtg

SEQ ID NO: 4314119 - DNA, 22 bp, Homo sapiens
tttcctgggagtgggagtcaag

SEQ ID NO: 4314120 - DNA, 15 bp, Homo sapiens
tttcgtgcatttgtg

SEQ ID NO: 4314121 - DNA, 14 bp, Homo sapiens
tttctaaaaagtca

SEQ ID NO: 4314122 - DNA, 18 bp, Homo sapiens
tttctaaactgttttcat

SEQ ID NO: 4314123 - DNA, 22 bp, Homo sapiens
tttctagctataacaactctat

SEQ ID NO: 4314124 - DNA, 17 bp, Homo sapiens
tttctatctgcaaatag

SEQ ID NO: 4314125 - DNA, 22 bp, Homo sapiens
tttctcaaagtttttacagtgt

SEQ ID NO: 4314126 - DNA, 12 bp, Homo sapiens
tttctcccagct

SEQ ID NO: 4314127 - DNA, 22 bp, Homo sapiens
tttctgaattcataaaaataac

SEQ ID NO: 4314128 - DNA, 19 bp, Homo sapiens
tttctgaggtttagcgttt

SEQ ID NO: 4314129 - DNA, 16 bp, Homo sapiens
tttctgagttcctgca

SEQ ID NO: 4314130 - DNA, 13 bp, Homo sapiens
tttctgcatctcc

SEQ ID NO: 4314131 - DNA, 15 bp, Homo sapiens
tttctgcatctccac

SEQ ID NO: 4314132 - DNA, 17 bp, Homo sapiens
tttctgctacctggttt

SEQ ID NO: 4314133 - DNA, 21 bp, Homo sapiens
tttctgctacctggttttcat

SEQ ID NO: 4314134 - DNA, 14 bp, Homo sapiens
tttctgtcctgtaa

SEQ ID NO: 4314135 - DNA, 15 bp, Homo sapiens
tttctgttccctgct

SEQ ID NO: 4314136 - DNA, 21 bp, Homo sapiens
tttcttccagtgatgttgaaa

SEQ ID NO: 4314137 - DNA, 16 bp, Homo sapiens
tttcttcccatttgta

SEQ ID NO: 4314138 - DNA, 22 bp, Homo sapiens
tttcttgagatctgctgacaga

SEQ ID NO: 4314139 - DNA, 14 bp, Homo sapiens
tttcttgtatctgg

SEQ ID NO: 4314140 - DNA, 20 bp, Homo sapiens
tttgaaagatggtaatcttt

SEQ ID NO: 4314141 - DNA, 21 bp, Homo sapiens
tttgaagaagggaaattcaca

SEQ ID NO: 4314142 - DNA, 21 bp, Homo sapiens
tttgatgtgtatgtgtttata

SEQ ID NO: 4314143 - DNA, 15 bp, Homo sapiens
tttgcaaacaaaatg

SEQ ID NO: 4314144 - DNA, 17 bp, Homo sapiens
tttgcaaacaaaatgat

SEQ ID NO: 4314145 - DNA, 21 bp, Homo sapiens
tttgcaagggaatgaatccat

SEQ ID NO: 4314146 - DNA, 17 bp, Homo sapiens
tttgcctcatgaacact

SEQ ID NO: 4314147 - DNA, 12 bp, Homo sapiens
tttgcctctgca

SEQ ID NO: 4314148 - DNA, 19 bp, Homo sapiens
tttgcctctgcacgtgcac

SEQ ID NO: 4314149 - DNA, 18 bp, Homo sapiens
tttgctatcatatattat

SEQ ID NO: 4314150 - DNA, 13 bp, Homo sapiens
tttgctcccagtt

SEQ ID NO: 4314151 - DNA, 23 bp, Homo sapiens
tttgctgccttctgtctcttgca

SEQ ID NO: 4314152 - DNA, 23 bp, Homo sapiens
tttgctgtatacaaacaggtgct

SEQ ID NO: 4314153 - DNA, 17 bp, Homo sapiens
tttgcttatttatattc

SEQ ID NO: 4314154 - DNA, 20 bp, Homo sapiens
tttggatataggtcagtgag

SEQ ID NO: 4314155 - DNA, 14 bp, Homo sapiens
tttgggctgaatgt
